United States Patent 7,901,882 (ANALYSIS OF METHYLATION USING NUCLEIC ACID ARRAYS) - sequence listing, part 13

SEQ ID NO: 472205 - DNA, 25 bp, Rattus norvegicus
tggcacacaaacaccggctccatgg

SEQ ID NO: 472206 - DNA, 25 bp, Rattus norvegicus
cagggcgcacgctggcacacaaaca

SEQ ID NO: 472207 - DNA, 25 bp, Rattus norvegicus
agagacgtagcagtccacgacgtgg

SEQ ID NO: 472208 - DNA, 25 bp, Rattus norvegicus
agactgaacaggtaggtccaccaca

SEQ ID NO: 472209 - DNA, 25 bp, Rattus norvegicus
agtcaaagtctttttgctcgtcgcc

SEQ ID NO: 472210 - DNA, 25 bp, Rattus norvegicus
tacaaccgggctgcctggtgttaca

SEQ ID NO: 472211 - DNA, 25 bp, Rattus norvegicus
tgtcatagcacacgttggtacaacc

SEQ ID NO: 472212 - DNA, 25 bp, Rattus norvegicus
ggacacgtgacgaagatgagctgca

SEQ ID NO: 472213 - DNA, 25 bp, Rattus norvegicus
tgaccagcatagagggacacgtgac

SEQ ID NO: 472214 - DNA, 25 bp, Rattus norvegicus
accagcacccggaagacgaacacta

SEQ ID NO: 472215 - DNA, 25 bp, Rattus norvegicus
tgccagagcgtgtgtagaacataca

SEQ ID NO: 472216 - DNA, 25 bp, Rattus norvegicus
taccagacgcggcatggtgaagcca

SEQ ID NO: 472217 - DNA, 25 bp, Rattus norvegicus
caaggtaccacgctggcgcactgta

SEQ ID NO: 472218 - DNA, 25 bp, Rattus norvegicus
tgggccgagcgatgtagcaatccac

SEQ ID NO: 472219 - DNA, 25 bp, Rattus norvegicus
ggcagacgcgcctaccatgaagtag

SEQ ID NO: 472220 - DNA, 25 bp, Rattus norvegicus
ggctacgtgcaggatgaccagcata

SEQ ID NO: 472221 - DNA, 25 bp, Rattus norvegicus
ggctgtacagtttggcgcaatgctc

SEQ ID NO: 472222 - DNA, 25 bp, Rattus norvegicus
gcgtgggcagactccagtccagcac

SEQ ID NO: 472223 - DNA, 25 bp, Rattus norvegicus
aggccggagccaagccgagctctgg

SEQ ID NO: 472224 - DNA, 25 bp, Rattus norvegicus
caagacccacagcagaagaggaaag

SEQ ID NO: 472225 - DNA, 25 bp, Rattus norvegicus
tgcccaagacccacagcagaagagg

SEQ ID NO: 472226 - DNA, 25 bp, Rattus norvegicus
acgtgcccaagacccacagcagaag

SEQ ID NO: 472227 - DNA, 25 bp, Rattus norvegicus
gaggcctgtctccacgtgcccaaga

SEQ ID NO: 472228 - DNA, 25 bp, Rattus norvegicus
ccgtacttacagtcagcggcgccgc

SEQ ID NO: 472229 - DNA, 25 bp, Rattus norvegicus
ggttctcagccctggactgtcgtcc

SEQ ID NO: 472230 - DNA, 25 bp, Rattus norvegicus
ccatagtgaggggttctcagccctg

SEQ ID NO: 472231 - DNA, 25 bp, Rattus norvegicus
atcgccatagtgaggggttctcagc

SEQ ID NO: 472232 - DNA, 25 bp, Rattus norvegicus
cacgccaggggatcgccatagtgag

SEQ ID NO: 472233 - DNA, 25 bp, Rattus norvegicus
tccagcacgccaggggatcgccata

SEQ ID NO: 472234 - DNA, 25 bp, Rattus norvegicus
ctcctggcccgcacagccagaggca

SEQ ID NO: 472235 - DNA, 25 bp, Rattus norvegicus
gactccagtccagcacgccagggga

SEQ ID NO: 472236 - DNA, 25 bp, Rattus norvegicus
gggacacgggaaagaactcgtcata

SEQ ID NO: 472237 - DNA, 25 bp, Rattus norvegicus
gtgtttcctctctcgctcttcgcga

SEQ ID NO: 472238 - DNA, 25 bp, Rattus norvegicus
cgctcttcgcgataggccacatgca

SEQ ID NO: 472239 - DNA, 25 bp, Rattus norvegicus
ggccacatgcatgaccactaacagg

SEQ ID NO: 472240 - DNA, 25 bp, Rattus norvegicus
cactaacagggaaggacaggtgacc

SEQ ID NO: 472241 - DNA, 25 bp, Rattus norvegicus
actcgtcatagcagacgttggggca

SEQ ID NO: 472242 - DNA, 25 bp, Rattus norvegicus
cagatgaagaccaccgacagccaga

SEQ ID NO: 472243 - DNA, 25 bp, Rattus norvegicus
cccagcgctgtggagtacttgttca

SEQ ID NO: 472244 - DNA, 25 bp, Rattus norvegicus
gagtacttgttcacgccgctcagga

SEQ ID NO: 472245 - DNA, 25 bp, Rattus norvegicus
cccagttcatgttggctgtgtcctg

SEQ ID NO: 472246 - DNA, 25 bp, Rattus norvegicus
ctgtgtcctggtgcctcacgtggac

SEQ ID NO: 472247 - DNA, 25 bp, Rattus norvegicus
gcactcgtgcgctaacctctcgggg

SEQ ID NO: 472248 - DNA, 25 bp, Rattus norvegicus
ggcccatgtttgaggcggtgtttcc

SEQ ID NO: 472249 - DNA, 25 bp, Rattus norvegicus
tgaaatccttctgctcgtcatccca

SEQ ID NO: 472250 - DNA, 25 bp, Rattus norvegicus
cgtcagccaatgagtgcactatctt

SEQ ID NO: 472251 - DNA, 25 bp, Rattus norvegicus
actcccaaaaggcatcgcgcgagca

SEQ ID NO: 472252 - DNA, 25 bp, Rattus norvegicus
atcgcgcgagcaccggtgggcaact

SEQ ID NO: 472253 - DNA, 25 bp, Rattus norvegicus
cctatcgaccgcctttcagatgacg

SEQ ID NO: 472254 - DNA, 25 bp, Rattus norvegicus
aatctagactagagggtgtgaggtc

SEQ ID NO: 472255 - DNA, 25 bp, Rattus norvegicus
cgcctagtgggtggaatctagacta

SEQ ID NO: 472256 - DNA, 25 bp, Rattus norvegicus
tcttcagcgacggtaccgcctagtg

SEQ ID NO: 472257 - DNA, 25 bp, Rattus norvegicus
cttaacattggttcttcagcgacgg

SEQ ID NO: 472258 - DNA, 25 bp, Rattus norvegicus
ggtactattccgactcttaacattg

SEQ ID NO: 472259 - DNA, 25 bp, Rattus norvegicus
gtgggtgtagctcggtactattccg

SEQ ID NO: 472260 - DNA, 25 bp, Rattus norvegicus
ggaacaaatcttgcagggtcaacgc

SEQ ID NO: 472261 - DNA, 25 bp, Rattus norvegicus
caggagctctgtaccggaacaaatc

SEQ ID NO: 472262 - DNA, 25 bp, Rattus norvegicus
gcctttcagatgacgtcagccaatg

SEQ ID NO: 472263 - DNA, 25 bp, Rattus norvegicus
gcactatcttctcaggagctctgta

SEQ ID NO: 472264 - DNA, 25 bp, Rattus norvegicus
tgacacgctccggtatgctaataca

SEQ ID NO: 472265 - DNA, 25 bp, Rattus norvegicus
cggagcagcactaaggcgtgttcaa

SEQ ID NO: 472266 - DNA, 25 bp, Rattus norvegicus
taaggcgtgttcaattcaatctccg

SEQ ID NO: 472267 - DNA, 25 bp, Rattus norvegicus
tcaattcaatctccgcctttccaga

SEQ ID NO: 472268 - DNA, 25 bp, Rattus norvegicus
cctttccagagtgaggattggctcg

SEQ ID NO: 472269 - DNA, 25 bp, Rattus norvegicus
attggctcgagtgggcacgtgacac

SEQ ID NO: 472270 - DNA, 25 bp, Rattus norvegicus
tatgctaatacatggtaatcgaccc

SEQ ID NO: 472271 - DNA, 25 bp, Rattus norvegicus
cagcgcggtggacaccggttcaccg

SEQ ID NO: 472272 - DNA, 25 bp, Rattus norvegicus
acccggccgcgatgaggaccacgga

SEQ ID NO: 472273 - DNA, 25 bp, Rattus norvegicus
tctccggggtgcgtggccttctaac

SEQ ID NO: 472274 - DNA, 25 bp, Rattus norvegicus
tggccttctaacgtggagaggcccg

SEQ ID NO: 472275 - DNA, 25 bp, Rattus norvegicus
gacaccggggttcggcctgctctgc

SEQ ID NO: 472276 - DNA, 25 bp, Rattus norvegicus
cggcaaccggttcagtcccggagca

SEQ ID NO: 472277 - DNA, 25 bp, Rattus norvegicus
ttgggcacctagctgtcacggtgcg

SEQ ID NO: 472278 - DNA, 25 bp, Rattus norvegicus
cgacggtctcgggacgtctacttga

SEQ ID NO: 472279 - DNA, 25 bp, Rattus norvegicus
aaacagtgcctcagcgacggtctcg

SEQ ID NO: 472280 - DNA, 25 bp, Rattus norvegicus
agcagcgccgagcttaccttccatg

SEQ ID NO: 472281 - DNA, 25 bp, Rattus norvegicus
ctgatcgcgtggaaacagtgcctca

SEQ ID NO: 472282 - DNA, 25 bp, Rattus norvegicus
ctgaggaaccctgatcgcgtggaaa

SEQ ID NO: 472283 - DNA, 25 bp, Rattus norvegicus
gagcgcaccgctccggctgctcaaa

SEQ ID NO: 472284 - DNA, 25 bp, Rattus norvegicus
ttttgaatgtcaagcctgaggaacc

SEQ ID NO: 472285 - DNA, 25 bp, Rattus norvegicus
gcaccctcaacccacttttgaatgt

SEQ ID NO: 472286 - DNA, 25 bp, Rattus norvegicus
agcacgctccgagcgcagcgggttc

SEQ ID NO: 472287 - DNA, 25 bp, Rattus norvegicus
tggcggccgctttaaagcacgctcc

SEQ ID NO: 472288 - DNA, 25 bp, Rattus norvegicus
gtcgctccacgtgctgctgccgtgg

SEQ ID NO: 472289 - DNA, 25 bp, Rattus norvegicus
ggctgtagctgtcgctcaggctccc

SEQ ID NO: 472290 - DNA, 25 bp, Rattus norvegicus
agcttaccttccatgtcgccgcggg

SEQ ID NO: 472291 - DNA, 25 bp, Rattus norvegicus
tcgggacgtctacttgagaaacacc

SEQ ID NO: 472292 - DNA, 25 bp, Rattus norvegicus
caggtaatgtgcacggccagaatgc

SEQ ID NO: 472293 - DNA, 25 bp, Rattus norvegicus
acgctttcgagccttccggaggacg

SEQ ID NO: 472294 - DNA, 25 bp, Rattus norvegicus
ctcgagtgcacaaaggaagcgcgcg

SEQ ID NO: 472295 - DNA, 25 bp, Rattus norvegicus
gacaagttgttttgtgcctgtcctc

SEQ ID NO: 472296 - DNA, 25 bp, Rattus norvegicus
tgcctgtcctcttccgtttttagga

SEQ ID NO: 472297 - DNA, 25 bp, Rattus norvegicus
taggagagcgttttctcgccctccg

SEQ ID NO: 472298 - DNA, 25 bp, Rattus norvegicus
gccctccggtgccaagcgaaggtat

SEQ ID NO: 472299 - DNA, 25 bp, Rattus norvegicus
ccaagcgaaggtatgctgcatctgc

SEQ ID NO: 472300 - DNA, 25 bp, Rattus norvegicus
gcatctgcgggctctttacgttaaa

SEQ ID NO: 472301 - DNA, 25 bp, Rattus norvegicus
tccggaatctgtgagcgtctgttta

SEQ ID NO: 472302 - DNA, 25 bp, Rattus norvegicus
tgacgtccagagaggcaggtaatgt

SEQ ID NO: 472303 - DNA, 25 bp, Rattus norvegicus
cggccagaatgcgaaccggttaagt

SEQ ID NO: 472304 - DNA, 25 bp, Rattus norvegicus
accggttaagttgtcgccagagcgc

SEQ ID NO: 472305 - DNA, 25 bp, Rattus norvegicus
gcgtctgtttaagttgacgtccaga

SEQ ID NO: 472306 - DNA, 25 bp, Rattus norvegicus
cgatttctactaccacgccgcggtg

SEQ ID NO: 472307 - DNA, 25 bp, Rattus norvegicus
cggtaacttcggacccgaggtgctg

SEQ ID NO: 472308 - DNA, 25 bp, Rattus norvegicus
tttaccgaccgaccggaagcagtgc

SEQ ID NO: 472309 - DNA, 25 bp, Rattus norvegicus
gtcaatggctcgcatgctcacgcta

SEQ ID NO: 472310 - DNA, 25 bp, Rattus norvegicus
gctcacgctacacgaggctctggga

SEQ ID NO: 472311 - DNA, 25 bp, Rattus norvegicus
ctgggccgagaagctgactatgtgt

SEQ ID NO: 472312 - DNA, 25 bp, Rattus norvegicus
gacggctcactgtgcgactggccaa

SEQ ID NO: 472313 - DNA, 25 bp, Rattus norvegicus
ggaccagtacttcagcggtaacttc

SEQ ID NO: 472314 - DNA, 25 bp, Rattus norvegicus
ggccaacagctggaccgtgagcatg

SEQ ID NO: 472315 - DNA, 25 bp, Rattus norvegicus
cagatttggtggcacagctgcacgc

SEQ ID NO: 472316 - DNA, 25 bp, Rattus norvegicus
tgccctacgagagggacaagcggtc

SEQ ID NO: 472317 - DNA, 25 bp, Rattus norvegicus
ctgtcgttaagcgaaggcgatttct

SEQ ID NO: 472318 - DNA, 25 bp, Rattus norvegicus
cggctctgctcaagctgacggctca

SEQ ID NO: 472319 - DNA, 25 bp, Rattus norvegicus
tgactatgtgttctgcctggacgtg

SEQ ID NO: 472320 - DNA, 25 bp, Rattus norvegicus
cgcggcgaatgaccagtgcgagccc

SEQ ID NO: 472321 - DNA, 25 bp, Rattus norvegicus
atgaaagtgtccatcaggttcgggg

SEQ ID NO: 472322 - DNA, 25 bp, Rattus norvegicus
aatgaccagtgcgagcccggagtag

SEQ ID NO: 472323 - DNA, 25 bp, Rattus norvegicus
ctggaaacgctagacctgtgaggtg

SEQ ID NO: 472324 - DNA, 25 bp, Rattus norvegicus
tgaagctttggtagacatggctccc

SEQ ID NO: 472325 - DNA, 25 bp, Rattus norvegicus
ggtagacatggctcccaacgcgttg

SEQ ID NO: 472326 - DNA, 25 bp, Rattus norvegicus
ggctcccaacgcgttggctcctgaa

SEQ ID NO: 472327 - DNA, 25 bp, Rattus norvegicus
acgcgttggctcctgaaccggagca

SEQ ID NO: 472328 - DNA, 25 bp, Rattus norvegicus
tgaaccggagcatccgaagggcatc

SEQ ID NO: 472329 - DNA, 25 bp, Rattus norvegicus
atccgaagggcatccgggccgtgtt

SEQ ID NO: 472330 - DNA, 25 bp, Rattus norvegicus
ccaggtgagtgtccgttccgtgccc

SEQ ID NO: 472331 - DNA, 25 bp, Rattus norvegicus
gtcggagatccggaagctcctttcc

SEQ ID NO: 472332 - DNA, 25 bp, Rattus norvegicus
cgtacgattggtagatgaaagtgtc

SEQ ID NO: 472333 - DNA, 25 bp, Rattus norvegicus
gtgctggcctggaaacgctagacct

SEQ ID NO: 472334 - DNA, 25 bp, Rattus norvegicus
ggactgcggaggaatcccagcctgg

SEQ ID NO: 472335 - DNA, 25 bp, Rattus norvegicus
ctctagggatgtaacccgtggtcgg

SEQ ID NO: 472336 - DNA, 25 bp, Rattus norvegicus
gcactctctagggatgtaacccgtg

SEQ ID NO: 472337 - DNA, 25 bp, Rattus norvegicus
tcgtgcactctctagggatgtaacc

SEQ ID NO: 472338 - DNA, 25 bp, Rattus norvegicus
aagggcgggagtcgtgcactctcta

SEQ ID NO: 472339 - DNA, 25 bp, Rattus norvegicus
caccgcgcgtctgggaatctgggaa

SEQ ID NO: 472340 - DNA, 25 bp, Rattus norvegicus
ctgctagggagccagggaaagctgc

SEQ ID NO: 472341 - DNA, 25 bp, Rattus norvegicus
ctggattggccggtctggctgctag

SEQ ID NO: 472342 - DNA, 25 bp, Rattus norvegicus
ccaccaggcgttgctggattggccg

SEQ ID NO: 472343 - DNA, 25 bp, Rattus norvegicus
tcgccaccaggcgttgctggattgg

SEQ ID NO: 472344 - DNA, 25 bp, Rattus norvegicus
ggaagctgatcacgtggcatcgcca

SEQ ID NO: 472345 - DNA, 25 bp, Rattus norvegicus
atggcggggataccggtcttccctg

SEQ ID NO: 472346 - DNA, 25 bp, Rattus norvegicus
ccgtggtcgggtccctcggtgctct

SEQ ID NO: 472347 - DNA, 25 bp, Rattus norvegicus
atcccagcctggcaggagcgcccac

SEQ ID NO: 472348 - DNA, 25 bp, Rattus norvegicus
gtgtgtgcacaaggaacggtcccca

SEQ ID NO: 472349 - DNA, 25 bp, Rattus norvegicus
cccagaggtctggtgactcagatct

SEQ ID NO: 472350 - DNA, 25 bp, Rattus norvegicus
ggtctggtgactcagatctcctttg

SEQ ID NO: 472351 - DNA, 25 bp, Rattus norvegicus
tggtgactcagatctcctttgagga

SEQ ID NO: 472352 - DNA, 25 bp, Rattus norvegicus
cagatctcctttgaggatttccttc

SEQ ID NO: 472353 - DNA, 25 bp, Rattus norvegicus
tgaggatttccttctaataccgggc

SEQ ID NO: 472354 - DNA, 25 bp, Rattus norvegicus
tgacaacggttagcggccgagccgc

SEQ ID NO: 472355 - DNA, 25 bp, Rattus norvegicus
ccctgaggttcggttgtgtggagcc

SEQ ID NO: 472356 - DNA, 25 bp, Rattus norvegicus
gagcggcaggaacaacgcggtgttc

SEQ ID NO: 472357 - DNA, 25 bp, Rattus norvegicus
cccggcaggtcttggacgctgatcg

SEQ ID NO: 472358 - DNA, 25 bp, Rattus norvegicus
ttggacgctgatcgggcgctctgct

SEQ ID NO: 472359 - DNA, 25 bp, Rattus norvegicus
atcgggtaggtctggccgtgtcctc

SEQ ID NO: 472360 - DNA, 25 bp, Rattus norvegicus
cactcgctcgcgtcctcggcggcgt

SEQ ID NO: 472361 - DNA, 25 bp, Rattus norvegicus
ttgggcggatttcctagagggagac

SEQ ID NO: 472362 - DNA, 25 bp, Rattus norvegicus
gcggaggctttataaccacttcgta

SEQ ID NO: 472363 - DNA, 25 bp, Rattus norvegicus
ccatgggctccgagaaggactccga

SEQ ID NO: 472364 - DNA, 25 bp, Rattus norvegicus
agaaggactccgagtcgccgcgctc

SEQ ID NO: 472365 - DNA, 25 bp, Rattus norvegicus
tcccgtaacattagcgcggggcggc

SEQ ID NO: 472366 - DNA, 25 bp, Rattus norvegicus
gcgcccggaacaagcgtctgaccga

SEQ ID NO: 472367 - DNA, 25 bp, Rattus norvegicus
tgaagagttcatgctgcgccggtac

SEQ ID NO: 472368 - DNA, 25 bp, Rattus norvegicus
cgatggaagctctgccctcggagcc

SEQ ID NO: 472369 - DNA, 25 bp, Rattus norvegicus
agtgcccgctgtgcctagtgcgcct

SEQ ID NO: 472370 - DNA, 25 bp, Rattus norvegicus
actacctgcgcctggagatcagcga

SEQ ID NO: 472371 - DNA, 25 bp, Rattus norvegicus
agatcagcgagagccgcgtgcccat

SEQ ID NO: 472372 - DNA, 25 bp, Rattus norvegicus
agtgagcggctcaacccacacgaca

SEQ ID NO: 472373 - DNA, 25 bp, Rattus norvegicus
aaccacttcgtagcggctggtctgc

SEQ ID NO: 472374 - DNA, 25 bp, Rattus norvegicus
gacccgccgctcatgcacaagtatg

SEQ ID NO: 472375 - DNA, 25 bp, Rattus norvegicus
acgacatccgtctgctgctggccga

SEQ ID NO: 472376 - DNA, 25 bp, Rattus norvegicus
gagcctcaatatccatccatggatg

SEQ ID NO: 472377 - DNA, 25 bp, Rattus norvegicus
gaagggagcctccaggagcctgctt

SEQ ID NO: 472378 - DNA, 25 bp, Rattus norvegicus
gtccgaccggcctccacaacgcgcg

SEQ ID NO: 472379 - DNA, 25 bp, Rattus norvegicus
tgactcagccgcacagtcccggggt

SEQ ID NO: 472380 - DNA, 25 bp, Rattus norvegicus
cagtctggcgccgggcactggctca

SEQ ID NO: 472381 - DNA, 25 bp, Rattus norvegicus
ccatccatggatgggcgtgctagag

SEQ ID NO: 472382 - DNA, 25 bp, Rattus norvegicus
cgatggagaccccttggagcctcaa

SEQ ID NO: 472383 - DNA, 25 bp, Rattus norvegicus
ttggagcctcaatatccatccatgg

SEQ ID NO: 472384 - DNA, 25 bp, Rattus norvegicus
acctcccagcaggacgatggagacc

SEQ ID NO: 472385 - DNA, 25 bp, Rattus norvegicus
atccgggtggctaacgccatcacct

SEQ ID NO: 472386 - DNA, 25 bp, Rattus norvegicus
acatccgggtggctaacgccatcac

SEQ ID NO: 472387 - DNA, 25 bp, Rattus norvegicus
ccgtccggctcccacatccgggtgg

SEQ ID NO: 472388 - DNA, 25 bp, Rattus norvegicus
gtgctagagggaacgagggcagtct

SEQ ID NO: 472389 - DNA, 25 bp, Rattus norvegicus
catcacctcccagcaggacgatgga

SEQ ID NO: 472390 - DNA, 25 bp, Rattus norvegicus
caggaacaatccacccttacctggg

SEQ ID NO: 472391 - DNA, 25 bp, Rattus norvegicus
cacttggcggtcaggaccctggaga

SEQ ID NO: 472392 - DNA, 25 bp, Rattus norvegicus
cactgggttcgaggtacctcctgga

SEQ ID NO: 472393 - DNA, 25 bp, Rattus norvegicus
aacactggacttgggttcctggctc

SEQ ID NO: 472394 - DNA, 25 bp, Rattus norvegicus
catccttcccgcactgggttcgagg

SEQ ID NO: 472395 - DNA, 25 bp, Rattus norvegicus
ctccgagggcggaatccgataggca

SEQ ID NO: 472396 - DNA, 25 bp, Rattus norvegicus
aacgccgagacaccgactgcgcagg

SEQ ID NO: 472397 - DNA, 25 bp, Rattus norvegicus
ggactgctctcctaagccaggaaca

SEQ ID NO: 472398 - DNA, 25 bp, Rattus norvegicus
ggtcagtgtccagggactgctctcc

SEQ ID NO: 472399 - DNA, 25 bp, Rattus norvegicus
tctgcaagccgacccggaggggcaa

SEQ ID NO: 472400 - DNA, 25 bp, Rattus norvegicus
cttcaccctgggaggatgatccgga

SEQ ID NO: 472401 - DNA, 25 bp, Rattus norvegicus
ctctctagggagcacttcaccctgg

SEQ ID NO: 472402 - DNA, 25 bp, Rattus norvegicus
agagagaacggaacgccctcgatgc

SEQ ID NO: 472403 - DNA, 25 bp, Rattus norvegicus
cggaatccgataggcaccctcgctg

SEQ ID NO: 472404 - DNA, 25 bp, Rattus norvegicus
tcaccgtccgcggaaccgatatgca

SEQ ID NO: 472405 - DNA, 25 bp, Rattus norvegicus
aaaacgcgggctggagcgagagtgc

SEQ ID NO: 472406 - DNA, 25 bp, Rattus norvegicus
gcgagagtgcgagcggtcacccggc

SEQ ID NO: 472407 - DNA, 25 bp, Rattus norvegicus
ggtcacccggcgtaggagccgccat

SEQ ID NO: 472408 - DNA, 25 bp, Rattus norvegicus
gtcacccggcgtaggagccgccatg

SEQ ID NO: 472409 - DNA, 25 bp, Rattus norvegicus
acccggcgtaggagccgccatgccc

SEQ ID NO: 472410 - DNA, 25 bp, Rattus norvegicus
cgccatgcccccagggccgtgcgcc

SEQ ID NO: 472411 - DNA, 25 bp, Rattus norvegicus
cggccaagaaaaacgcgggctggag

SEQ ID NO: 472412 - DNA, 25 bp, Rattus norvegicus
cggaaccgatatgcaggcggcgcgg

SEQ ID NO: 472413 - DNA, 25 bp, Rattus norvegicus
tccgcggaaccgatatgcaggcggc

SEQ ID NO: 472414 - DNA, 25 bp, Rattus norvegicus
ccgtccgcggaaccgatatgcaggc

SEQ ID NO: 472415 - DNA, 25 bp, Rattus norvegicus
accgtccgcggaaccgatatgcagg

SEQ ID NO: 472416 - DNA, 25 bp, Rattus norvegicus
ccaagaaaaacgcgggctggagcga

SEQ ID NO: 472417 - DNA, 25 bp, Rattus norvegicus
caccgtccgcggaaccgatatgcag

SEQ ID NO: 472418 - DNA, 25 bp, Rattus norvegicus
ccttcctgtttcatcgattctttcg

SEQ ID NO: 472419 - DNA, 25 bp, Rattus norvegicus
ctgacgggactagcgtgacagttcc

SEQ ID NO: 472420 - DNA, 25 bp, Rattus norvegicus
gctcagctgatgcaacctgacggga

SEQ ID NO: 472421 - DNA, 25 bp, Rattus norvegicus
gcctatcaagcggagctacgagctc

SEQ ID NO: 472422 - DNA, 25 bp, Rattus norvegicus
gggagaggatctaggcctatcaagc

SEQ ID NO: 472423 - DNA, 25 bp, Rattus norvegicus
cgattctttcggctctctgctgctc

SEQ ID NO: 472424 - DNA, 25 bp, Rattus norvegicus
tacactgttttttctggctccgccc

SEQ ID NO: 472425 - DNA, 25 bp, Rattus norvegicus
ttgtgtcctgggcagccttcctaac

SEQ ID NO: 472426 - DNA, 25 bp, Rattus norvegicus
caaacagtgattggcaggaaaccgc

SEQ ID NO: 472427 - DNA, 25 bp, Rattus norvegicus
tacgcggccctgtgaagaagcaaca

SEQ ID NO: 472428 - DNA, 25 bp, Rattus norvegicus
agaatcagcccttccctcagcgaga

SEQ ID NO: 472429 - DNA, 25 bp, Rattus norvegicus
tctcctcagcaggatgaggggcgtc

SEQ ID NO: 472430 - DNA, 25 bp, Rattus norvegicus
tctgctgctcctgactcggggctac

SEQ ID NO: 472431 - DNA, 25 bp, Rattus norvegicus
cgccatcacctcaggagggagaatc

SEQ ID NO: 472432 - DNA, 25 bp, Rattus norvegicus
agcccagctgttgccgctagtgcct

SEQ ID NO: 472433 - DNA, 25 bp, Rattus norvegicus
aagacacggagggtgtagcgctcca

SEQ ID NO: 472434 - DNA, 25 bp, Rattus norvegicus
agccggaactcgcaggcgctctcgg

SEQ ID NO: 472435 - DNA, 25 bp, Rattus norvegicus
gtgtagcgctccacaactgcgcctg

SEQ ID NO: 472436 - DNA, 25 bp, Rattus norvegicus
cggggccctccatccgcgagcgctt

SEQ ID NO: 472437 - DNA, 25 bp, Rattus norvegicus
tgccgagccggaactcgcaggcgct

SEQ ID NO: 472438 - DNA, 25 bp, Rattus norvegicus
acagccgcccccgtggtagactggg

SEQ ID NO: 472439 - DNA, 25 bp, Rattus norvegicus
atgccctcggcggtttgcttcgctc

SEQ ID NO: 472440 - DNA, 25 bp, Rattus norvegicus
tgcttcgctctgtagaggagcgatg

SEQ ID NO: 472441 - DNA, 25 bp, Rattus norvegicus
cgctagtgcctgagccgtgatgctc

SEQ ID NO: 472442 - DNA, 25 bp, Rattus norvegicus
agtgcctgagccgtgatgctcgcgt

SEQ ID NO: 472443 - DNA, 25 bp, Rattus norvegicus
tgatgctcgcgtgggccctactctc

SEQ ID NO: 472444 - DNA, 25 bp, Rattus norvegicus
tccgcggtgctctggtctctcgcag

SEQ ID NO: 472445 - DNA, 25 bp, Rattus norvegicus
cggcggtttgcttcgctctgtagag

SEQ ID NO: 472446 - DNA, 25 bp, Rattus norvegicus
gtatcggtgccagcctctgcttctg

SEQ ID NO: 472447 - DNA, 25 bp, Rattus norvegicus
tgtccctaaggccaggcccgctggg

SEQ ID NO: 472448 - DNA, 25 bp, Rattus norvegicus
tggatcggccaacaagcgtgtcatc

SEQ ID NO: 472449 - DNA, 25 bp, Rattus norvegicus
ggccaacaagcgtgtcatcacggta

SEQ ID NO: 472450 - DNA, 25 bp, Rattus norvegicus
gtgtcatcacggtaaacacggtcga

SEQ ID NO: 472451 - DNA, 25 bp, Rattus norvegicus
taaacacggtcgatgtggcgctgga

SEQ ID NO: 472452 - DNA, 25 bp, Rattus norvegicus
tagcctctgtatcggtgccagcctc

SEQ ID NO: 472453 - DNA, 25 bp, Rattus norvegicus
tgcttctgcctccagagcctgcagg

SEQ ID NO: 472454 - DNA, 25 bp, Rattus norvegicus
gcgctcccgtggatcggccaacaag

SEQ ID NO: 472455 - DNA, 25 bp, Rattus norvegicus
ccactgtgggaattcggacagcgtc

SEQ ID NO: 472456 - DNA, 25 bp, Rattus norvegicus
ggcgctggatgatagcctctgtatc

SEQ ID NO: 472457 - DNA, 25 bp, Rattus norvegicus
aattcggacagcgtcccgtgacccg

SEQ ID NO: 472458 - DNA, 25 bp, Rattus norvegicus
ctgggcgaccatccactgtgggaat

SEQ ID NO: 472459 - DNA, 25 bp, Rattus norvegicus
agtgcccggagcctcgcggttgttc

SEQ ID NO: 472460 - DNA, 25 bp, Rattus norvegicus
ccttcctcttgtggtgtgagttgcc

SEQ ID NO: 472461 - DNA, 25 bp, Rattus norvegicus
gggagccggcacaagcacccaagcg

SEQ ID NO: 472462 - DNA, 25 bp, Rattus norvegicus
acgggagccggcacaagcacccaag

SEQ ID NO: 472463 - DNA, 25 bp, Rattus norvegicus
ttgcccatggtgagcacgggagccg

SEQ ID NO: 472464 - DNA, 25 bp, Rattus norvegicus
ttcctcttgtggtgtgagttgccca

SEQ ID NO: 472465 - DNA, 25 bp, Rattus norvegicus
gggccttcctcttgtggtgtgagtt

SEQ ID NO: 472466 - DNA, 25 bp, Rattus norvegicus
tccgtgcgcatgtgaggggtgggat

SEQ ID NO: 472467 - DNA, 25 bp, Rattus norvegicus
cgatcgcccgaagcgccagaagctg

SEQ ID NO: 472468 - DNA, 25 bp, Rattus norvegicus
acctgcgggccgcttcgccgatcgc

SEQ ID NO: 472469 - DNA, 25 bp, Rattus norvegicus
agcaccgccggcgactgcagggacc

SEQ ID NO: 472470 - DNA, 25 bp, Rattus norvegicus
ggtgggatctgagcggattcccggc

SEQ ID NO: 472471 - DNA, 25 bp, Rattus norvegicus
ccgaagcgccagaagctgcgggtcc

SEQ ID NO: 472472 - DNA, 25 bp, Rattus norvegicus
cccgcccgcgggtatgagtgggtat

SEQ ID NO: 472473 - DNA, 25 bp, Rattus norvegicus
tcttgtggtgtgagttgcccatggt

SEQ ID NO: 472474 - DNA, 25 bp, Rattus norvegicus
gctattaataacgttccgggcgagc

SEQ ID NO: 472475 - DNA, 25 bp, Rattus norvegicus
tcgcagacggcgttggctattaata

SEQ ID NO: 472476 - DNA, 25 bp, Rattus norvegicus
cgcagacggcgttggctattaataa

SEQ ID NO: 472477 - DNA, 25 bp, Rattus norvegicus
gcagacggcgttggctattaataac

SEQ ID NO: 472478 - DNA, 25 bp, Rattus norvegicus
tggctattaataacgttccgggcga

SEQ ID NO: 472479 - DNA, 25 bp, Rattus norvegicus
gcacaatcgcagacggcgttggcta

SEQ ID NO: 472480 - DNA, 25 bp, Rattus norvegicus
tctggtgtccgctgcagctggcagt

SEQ ID NO: 472481 - DNA, 25 bp, Rattus norvegicus
agacggcgttggctattaataacgt

SEQ ID NO: 472482 - DNA, 25 bp, Rattus norvegicus
ggcaccggcacaatcgcagacggcg

SEQ ID NO: 472483 - DNA, 25 bp, Rattus norvegicus
atctggtgtccgctgcagctggcag

SEQ ID NO: 472484 - DNA, 25 bp, Rattus norvegicus
atcgtccggccaagtgggcgcgtcc

SEQ ID NO: 472485 - DNA, 25 bp, Rattus norvegicus
tcccgcgggcgatcgtccggccaag

SEQ ID NO: 472486 - DNA, 25 bp, Rattus norvegicus
ccggcacaatcgcagacggcgttgg

SEQ ID NO: 472487 - DNA, 25 bp, Rattus norvegicus
caccggcacaatcgcagacggcgtt

SEQ ID NO: 472488 - DNA, 25 bp, Rattus norvegicus
tgcccggactattcccgtgcagatc

SEQ ID NO: 472489 - DNA, 25 bp, Rattus norvegicus
caccgcgtcgtcaaaggccgctaaa

SEQ ID NO: 472490 - DNA, 25 bp, Rattus norvegicus
cgcccgggttctgacaacgaaatgg

SEQ ID NO: 472491 - DNA, 25 bp, Rattus norvegicus
gtcttaatctcctaggtcgcaggca

SEQ ID NO: 472492 - DNA, 25 bp, Rattus norvegicus
actccgttactcctttggggcgatg

SEQ ID NO: 472493 - DNA, 25 bp, Rattus norvegicus
ggcgatgctgtccaacctcgaagca

SEQ ID NO: 472494 - DNA, 25 bp, Rattus norvegicus
gaacgtcgtactcgcctaggcccga

SEQ ID NO: 472495 - DNA, 25 bp, Rattus norvegicus
gagctcattcctcaggccggagtta

SEQ ID NO: 472496 - DNA, 25 bp, Rattus norvegicus
ttctctccgtcttaggccgcgtaac

SEQ ID NO: 472497 - DNA, 25 bp, Rattus norvegicus
accttccttgtcagccatggcggca

SEQ ID NO: 472498 - DNA, 25 bp, Rattus norvegicus
tcgcggcctatggagacgctcaaga

SEQ ID NO: 472499 - DNA, 25 bp, Rattus norvegicus
tcaagagtcgctttccgcgggtcga

SEQ ID NO: 472500 - DNA, 25 bp, Rattus norvegicus
actacggtccagaggcttccacgga

SEQ ID NO: 472501 - DNA, 25 bp, Rattus norvegicus
gttgatcacacgttcttccaccgcg

SEQ ID NO: 472502 - DNA, 25 bp, Rattus norvegicus
ttctgccctcggttctaagcccgga

SEQ ID NO: 472503 - DNA, 25 bp, Rattus norvegicus
ttctaagcccggaactgtcgcgtcg

SEQ ID NO: 472504 - DNA, 25 bp, Rattus norvegicus
gtgcccgctaggtgtgaatcctatt

SEQ ID NO: 472505 - DNA, 25 bp, Rattus norvegicus
gaatcctattccaaacacgtctcgg

SEQ ID NO: 472506 - DNA, 25 bp, Rattus norvegicus
attccaaacacgtctcggaaagacg

SEQ ID NO: 472507 - DNA, 25 bp, Rattus norvegicus
ctcggaaagacgtggattatggcta

SEQ ID NO: 472508 - DNA, 25 bp, Rattus norvegicus
tggattatggctaaccgcacggtca

SEQ ID NO: 472509 - DNA, 25 bp, Rattus norvegicus
accgcacggtcaagggcgagtaagc

SEQ ID NO: 472510 - DNA, 25 bp, Rattus norvegicus
cgccagagcgcgaagggaccaagcc

SEQ ID NO: 472511 - DNA, 25 bp, Rattus norvegicus
cgcgaagggaccaagccagacaggt

SEQ ID NO: 472512 - DNA, 25 bp, Rattus norvegicus
tgggagatgccagggacattttgcc

SEQ ID NO: 472513 - DNA, 25 bp, Rattus norvegicus
gccagctggggctccatatttctgc

SEQ ID NO: 472514 - DNA, 25 bp, Rattus norvegicus
actgtcgcgtcgtgatggaaagcca

SEQ ID NO: 472515 - DNA, 25 bp, Rattus norvegicus
ggctccatatttctgccctcggttc

SEQ ID NO: 472516 - DNA, 25 bp, Rattus norvegicus
gcagagtgttcaccttgttgcaata

SEQ ID NO: 472517 - DNA, 25 bp, Rattus norvegicus
tcctctggcaagtgatccgaagcaa

SEQ ID NO: 472518 - DNA, 25 bp, Rattus norvegicus
tccgaagcaagaaagcgatgccacg

SEQ ID NO: 472519 - DNA, 25 bp, Rattus norvegicus
tgggctggaggtggataaaatctta

SEQ ID NO: 472520 - DNA, 25 bp, Rattus norvegicus
agggtggaaaagtgctcaactctcc

SEQ ID NO: 472521 - DNA, 25 bp, Rattus norvegicus
cgccagaatcggtgcagacaaaagc

SEQ ID NO: 472522 - DNA, 25 bp, Rattus norvegicus
ctcctagttgctcctctggcaagtg

SEQ ID NO: 472523 - DNA, 25 bp, Rattus norvegicus
cggagctgctccacaatatttacta

SEQ ID NO: 472524 - DNA, 25 bp, Rattus norvegicus
actttccgcacaatcgcgttgtttg

SEQ ID NO: 472525 - DNA, 25 bp, Rattus norvegicus
cagggatccttagtggcgaacagca

SEQ ID NO: 472526 - DNA, 25 bp, Rattus norvegicus
aatgtctcccggcaaacctaagcag

SEQ ID NO: 472527 - DNA, 25 bp, Rattus norvegicus
cgtgggttttctctctcgatcgctc

SEQ ID NO: 472528 - DNA, 25 bp, Rattus norvegicus
tgaattctcctactctgcctcagtt

SEQ ID NO: 472529 - DNA, 25 bp, Rattus norvegicus
tgggctcaggagtaaaagaaacacc

SEQ ID NO: 472530 - DNA, 25 bp, Rattus norvegicus
gggaagcaccctgttccaaagccga

SEQ ID NO: 472531 - DNA, 25 bp, Rattus norvegicus
caaaaggtatttgctgacgtgggcg

SEQ ID NO: 472532 - DNA, 25 bp, Rattus norvegicus
ccaacgtgagagaaacaaaaggtat

SEQ ID NO: 472533 - DNA, 25 bp, Rattus norvegicus
gctttgcgccctaaaacaagtagcc

SEQ ID NO: 472534 - DNA, 25 bp, Rattus norvegicus
agccgaggctttgcgccctaaaaca

SEQ ID NO: 472535 - DNA, 25 bp, Rattus norvegicus
caccctgttccaaagccgaggcttt

SEQ ID NO: 472536 - DNA, 25 bp, Rattus norvegicus
tggtaggggaagcaccctgttccaa

SEQ ID NO: 472537 - DNA, 25 bp, Rattus norvegicus
tgcggagcgattcccggttcctggt

SEQ ID NO: 472538 - DNA, 25 bp, Rattus norvegicus
tatttgctgacgtgggcgttggaca

SEQ ID NO: 472539 - DNA, 25 bp, Rattus norvegicus
ggctctggctgctcgcttgctcgct

SEQ ID NO: 472540 - DNA, 25 bp, Rattus norvegicus
gcagccacttaccgcggggctctgg

SEQ ID NO: 472541 - DNA, 25 bp, Rattus norvegicus
tcctggtaggggaagcaccctgttc

SEQ ID NO: 472542 - DNA, 25 bp, Rattus norvegicus
cgtgcccgcgcagccacttaccgcg

SEQ ID NO: 472543 - DNA, 25 bp, Rattus norvegicus
cgctgcggagcgattcccggttcct

SEQ ID NO: 472544 - DNA, 25 bp, Rattus norvegicus
catcgtcgtcgtgagggtctgtgac

SEQ ID NO: 472545 - DNA, 25 bp, Rattus norvegicus
cgtcagaatcctccgcagctgggtc

SEQ ID NO: 472546 - DNA, 25 bp, Rattus norvegicus
cagctgggtcgttctcctcaccgga

SEQ ID NO: 472547 - DNA, 25 bp, Rattus norvegicus
ctcctcaccggactctatgtagatg

SEQ ID NO: 472548 - DNA, 25 bp, Rattus norvegicus
actctatgtagatgggccagtcgtc

SEQ ID NO: 472549 - DNA, 25 bp, Rattus norvegicus
agtcgtctgtgtcactcttctcgtg

SEQ ID NO: 472550 - DNA, 25 bp, Rattus norvegicus
tgtcactcttctcgtggctttcaga

SEQ ID NO: 472551 - DNA, 25 bp, Rattus norvegicus
tctcgtggctttcagaagacgcctc

SEQ ID NO: 472552 - DNA, 25 bp, Rattus norvegicus
ttcagaagacgcctccaccaggcta

SEQ ID NO: 472553 - DNA, 25 bp, Rattus norvegicus
acacaggtgcagctgtcacacagcc

SEQ ID NO: 472554 - DNA, 25 bp, Rattus norvegicus
acgggcatcaggtcgtcatcgtcgt

SEQ ID NO: 472555 - DNA, 25 bp, Rattus norvegicus
ggtctgtgacacaggtgcagctgtc

SEQ ID NO: 472556 - DNA, 25 bp, Rattus norvegicus
ggatgtacggcttgtcgtcagaatc

SEQ ID NO: 472557 - DNA, 25 bp, Rattus norvegicus
caccaggctaaggttgacgggcatc

SEQ ID NO: 472558 - DNA, 25 bp, Rattus norvegicus
cgaccggatgctgtgttctcacctg

SEQ ID NO: 472559 - DNA, 25 bp, Rattus norvegicus
tcctccagcgagctgagcgtactga

SEQ ID NO: 472560 - DNA, 25 bp, Rattus norvegicus
ctggcaccgggttccagcctcctcc

SEQ ID NO: 472561 - DNA, 25 bp, Rattus norvegicus
ccaaagctggctgagaaaggcaatc

SEQ ID NO: 472562 - DNA, 25 bp, Rattus norvegicus
agctggctgagaaaggcaatcgtgc

SEQ ID NO: 472563 - DNA, 25 bp, Rattus norvegicus
tgagaaaggcaatcgtgcctgctta

SEQ ID NO: 472564 - DNA, 25 bp, Rattus norvegicus
aggcaatcgtgcctgcttatctaca

SEQ ID NO: 472565 - DNA, 25 bp, Rattus norvegicus
agccgctgcgccgaccggatgctgt

SEQ ID NO: 472566 - DNA, 25 bp, Rattus norvegicus
cggtccaaagctggctgagaaaggc

SEQ ID NO: 472567 - DNA, 25 bp, Rattus norvegicus
ccggatgctgtgttctcacctggca

SEQ ID NO: 472568 - DNA, 25 bp, Rattus norvegicus
atgctgtgttctcacctggcaccgg

SEQ ID NO: 472569 - DNA, 25 bp, Rattus norvegicus
ctgtgttctcacctggcaccgggtt

SEQ ID NO: 472570 - DNA, 25 bp, Rattus norvegicus
gttctcacctggcaccgggttccag

SEQ ID NO: 472571 - DNA, 25 bp, Rattus norvegicus
tcgtgcctgcttatctacacccggt

SEQ ID NO: 472572 - DNA, 25 bp, Rattus norvegicus
agcacctttctctcggcggggcacc

SEQ ID NO: 472573 - DNA, 25 bp, Rattus norvegicus
gtaagccgggccagcacctttctct

SEQ ID NO: 472574 - DNA, 25 bp, Rattus norvegicus
ccaggcagtcaaagagaaggtaagc

SEQ ID NO: 472575 - DNA, 25 bp, Rattus norvegicus
agctaccaggcagtcaaagagaagg

SEQ ID NO: 472576 - DNA, 25 bp, Rattus norvegicus
gcagcagagctaccaggcagtcaaa

SEQ ID NO: 472577 - DNA, 25 bp, Rattus norvegicus
agctggctgcagcagagctaccagg

SEQ ID NO: 472578 - DNA, 25 bp, Rattus norvegicus
tctgtcttccacagggaggacgtgg

SEQ ID NO: 472579 - DNA, 25 bp, Rattus norvegicus
atgtgtctgtcttccacagggagga

SEQ ID NO: 472580 - DNA, 25 bp, Rattus norvegicus
cagatgtgtctgtcttccacaggga

SEQ ID NO: 472581 - DNA, 25 bp, Rattus norvegicus
ccgtcagatgtgtctgtcttccaca

SEQ ID NO: 472582 - DNA, 25 bp, Rattus norvegicus
ggcccgagaagcctcatccgccggc

SEQ ID NO: 472583 - DNA, 25 bp, Rattus norvegicus
caggagtcgcaaagcaggcagggcc

SEQ ID NO: 472584 - DNA, 25 bp, Rattus norvegicus
gaccgagctgaaagggcagagtgga

SEQ ID NO: 472585 - DNA, 25 bp, Rattus norvegicus
cagggccgtcagatgtgtctgtctt

SEQ ID NO: 472586 - DNA, 25 bp, Rattus norvegicus
gcacctgctgcgaaggacgcagata

SEQ ID NO: 472587 - DNA, 25 bp, Rattus norvegicus
gcagggcggccctatttctttcgca

SEQ ID NO: 472588 - DNA, 25 bp, Rattus norvegicus
tatttctttcgcacccatgcccggg

SEQ ID NO: 472589 - DNA, 25 bp, Rattus norvegicus
tctgcgctgtctgccagctaaaacg

SEQ ID NO: 472590 - DNA, 25 bp, Rattus norvegicus
tttgcgaatcaactcggcccgaggc

SEQ ID NO: 472591 - DNA, 25 bp, Rattus norvegicus
tgggaaacgcaaagcacggggctac

SEQ ID NO: 472592 - DNA, 25 bp, Rattus norvegicus
tctggactacgcatcccggcagact

SEQ ID NO: 472593 - DNA, 25 bp, Rattus norvegicus
atctcccgtaatgccttgcgactca

SEQ ID NO: 472594 - DNA, 25 bp, Rattus norvegicus
cttgcgactcaacggctattccatc

SEQ ID NO: 472595 - DNA, 25 bp, Rattus norvegicus
ggcagctccacgtctgtctggacta

SEQ ID NO: 472596 - DNA, 25 bp, Rattus norvegicus
taacctcgtacttcggtctggcggc

SEQ ID NO: 472597 - DNA, 25 bp, Rattus norvegicus
tgtgttgcagggctgtaacctcgta

SEQ ID NO: 472598 - DNA, 25 bp, Rattus norvegicus
ctaggcaatgcctctgctggtggac

SEQ ID NO: 472599 - DNA, 25 bp, Rattus norvegicus
gtggcctcccacaaagttaggacta

SEQ ID NO: 472600 - DNA, 25 bp, Rattus norvegicus
ctccgggactgcctagaattccagc

SEQ ID NO: 472601 - DNA, 25 bp, Rattus norvegicus
ggcccgtgctacctgagtgcgcctg

SEQ ID NO: 472602 - DNA, 25 bp, Rattus norvegicus
atcgacgtctacctggccatgggcg

SEQ ID NO: 472603 - DNA, 25 bp, Rattus norvegicus
tgccactgtctgacgctgctgcacg

SEQ ID NO: 472604 - DNA, 25 bp, Rattus norvegicus
cctgtagctacggatcaaaaccctg

SEQ ID NO: 472605 - DNA, 25 bp, Rattus norvegicus
caggatagcccggagcctgtagcta

SEQ ID NO: 472606 - DNA, 25 bp, Rattus norvegicus
cccggggcctggacatgagtgccca

SEQ ID NO: 472607 - DNA, 25 bp, Rattus norvegicus
atctaggggcccagagctgcctgac

SEQ ID NO: 472608 - DNA, 25 bp, Rattus norvegicus
gcaggtaagccaccgcacaggaggc

SEQ ID NO: 472609 - DNA, 25 bp, Rattus norvegicus
ggcagttgcttccagcctgggaccg

SEQ ID NO: 472610 - DNA, 25 bp, Rattus norvegicus
agacccgggtcacaatgcagtcctc

SEQ ID NO: 472611 - DNA, 25 bp, Rattus norvegicus
tcagcacgcagagacccgggtcaca

SEQ ID NO: 472612 - DNA, 25 bp, Rattus norvegicus
tagaattccagcgaggaacaggctg

SEQ ID NO: 472613 - DNA, 25 bp, Rattus norvegicus
gcctgcgcacggcagctctgcagga

SEQ ID NO: 472614 - DNA, 25 bp, Rattus norvegicus
catgagacccgaccctcgggagagg

SEQ ID NO: 472615 - DNA, 25 bp, Rattus norvegicus
aagccggggagactacagcctgagt

SEQ ID NO: 472616 - DNA, 25 bp, Rattus norvegicus
gactacagcctgagtcccgcagcgt

SEQ ID NO: 472617 - DNA, 25 bp, Rattus norvegicus
tagtgccgtcgcttgcccaagtaca

SEQ ID NO: 472618 - DNA, 25 bp, Rattus norvegicus
ttgcccaagtacaggaagccgctct

SEQ ID NO: 472619 - DNA, 25 bp, Rattus norvegicus
aggaagccgctctgtccgggccatc

SEQ ID NO: 472620 - DNA, 25 bp, Rattus norvegicus
caccgaacacactcgctggctaagg

SEQ ID NO: 472621 - DNA, 25 bp, Rattus norvegicus
gctaaggcgcccagactcagaagcg

SEQ ID NO: 472622 - DNA, 25 bp, Rattus norvegicus
ccagactcagaagcgggtcgggcaa

SEQ ID NO: 472623 - DNA, 25 bp, Rattus norvegicus
cctgacatgggtacttgtcggccgg

SEQ ID NO: 472624 - DNA, 25 bp, Rattus norvegicus
tctgggcatgagacccgaccctcgg

SEQ ID NO: 472625 - DNA, 25 bp, Rattus norvegicus
gcgtggcctgacatgggtacttgtc

SEQ ID NO: 472626 - DNA, 25 bp, Rattus norvegicus
ggcctctttggagctcgcggaagcc

SEQ ID NO: 472627 - DNA, 25 bp, Rattus norvegicus
ttcggccgagccctggaggaagtcc

SEQ ID NO: 472628 - DNA, 25 bp, Rattus norvegicus
cctggtcgtcccaagtcatggggga

SEQ ID NO: 472629 - DNA, 25 bp, Rattus norvegicus
tctcagtccttcttccggaccgacc

SEQ ID NO: 472630 - DNA, 25 bp, Rattus norvegicus
gggaacctctctttcccacactgaa

SEQ ID NO: 472631 - DNA, 25 bp, Rattus norvegicus
ggaaccagacagctggcactgccca

SEQ ID NO: 472632 - DNA, 25 bp, Rattus norvegicus
ggcactgcccactgcacgagaggaa

SEQ ID NO: 472633 - DNA, 25 bp, Rattus norvegicus
tgcccactgcacgagaggaacccgg

SEQ ID NO: 472634 - DNA, 25 bp, Rattus norvegicus
cccggattgggtgctcatttaaatg

SEQ ID NO: 472635 - DNA, 25 bp, Rattus norvegicus
cggattgggtgctcatttaaatgtc

SEQ ID NO: 472636 - DNA, 25 bp, Rattus norvegicus
agcctcgggcgcgtacatataggcg

SEQ ID NO: 472637 - DNA, 25 bp, Rattus norvegicus
tcgggcgcgtacatataggcggctc

SEQ ID NO: 472638 - DNA, 25 bp, Rattus norvegicus
gccgggccatcccagccgaactatc

SEQ ID NO: 472639 - DNA, 25 bp, Rattus norvegicus
ccatcatgggcagccagagctccaa

SEQ ID NO: 472640 - DNA, 25 bp, Rattus norvegicus
atgggcagccagagctccaaggctc

SEQ ID NO: 472641 - DNA, 25 bp, Rattus norvegicus
ggtccctttgttctcggcgccgcag

SEQ ID NO: 472642 - DNA, 25 bp, Rattus norvegicus
ggaacaaagacgctgctaggccgca

SEQ ID NO: 472643 - DNA, 25 bp, Rattus norvegicus
gcccaatagcgctgggcaaggctgg

SEQ ID NO: 472644 - DNA, 25 bp, Rattus norvegicus
aaaataggccgtccaggtgcaggga

SEQ ID NO: 472645 - DNA, 25 bp, Rattus norvegicus
caagcctgggaaaataggccgtcca

SEQ ID NO: 472646 - DNA, 25 bp, Rattus norvegicus
aggttccgcgcggaaaatagagagc

SEQ ID NO: 472647 - DNA, 25 bp, Rattus norvegicus
ccagcgaaggatccaggcccggtga

SEQ ID NO: 472648 - DNA, 25 bp, Rattus norvegicus
cacaaagcgcaagcctgggaaaata

SEQ ID NO: 472649 - DNA, 25 bp, Rattus norvegicus
cgcgcggaaaatagagagcgcgccc

SEQ ID NO: 472650 - DNA, 25 bp, Rattus norvegicus
ggccgggctcatcgccttctttgtt

SEQ ID NO: 472651 - DNA, 25 bp, Rattus norvegicus
gctgttcacacaaagcgcaagcctg

SEQ ID NO: 472652 - DNA, 25 bp, Rattus norvegicus
tcggcagcccgcggtggcttttgaa

SEQ ID NO: 472653 - DNA, 25 bp, Rattus norvegicus
aagacgctgctaggccgcaccaagg

SEQ ID NO: 472654 - DNA, 25 bp, Rattus norvegicus
ccgcgcgggaacaaagacgctgcta

SEQ ID NO: 472655 - DNA, 25 bp, Rattus norvegicus
ggctggcccgccagcgaaggatcca

SEQ ID NO: 472656 - DNA, 25 bp, Rattus norvegicus
caatcagcacatgcggggccgggcc

SEQ ID NO: 472657 - DNA, 25 bp, Rattus norvegicus
ctctaaccaatcagcacatgcgggg

SEQ ID NO: 472658 - DNA, 25 bp, Rattus norvegicus
taggactcacctatagccacacagc

SEQ ID NO: 472659 - DNA, 25 bp, Rattus norvegicus
tgagtctgcgccatcttgctcgccg

SEQ ID NO: 472660 - DNA, 25 bp, Rattus norvegicus
tttcctcttggtgccctgagtctgc

SEQ ID NO: 472661 - DNA, 25 bp, Rattus norvegicus
acagactttcctcttggtgccctga

SEQ ID NO: 472662 - DNA, 25 bp, Rattus norvegicus
gtcgtagtagtaacagactttcctc

SEQ ID NO: 472663 - DNA, 25 bp, Rattus norvegicus
ccgccgctcaccgtcgtagtagtaa

SEQ ID NO: 472664 - DNA, 25 bp, Rattus norvegicus
agaatctccgccaccgagattaccg

SEQ ID NO: 472665 - DNA, 25 bp, Rattus norvegicus
taggattccctgagaatctccgcca

SEQ ID NO: 472666 - DNA, 25 bp, Rattus norvegicus
caacttcgcgtaggattccctgaga

SEQ ID NO: 472667 - DNA, 25 bp, Rattus norvegicus
ctgggcctgtaccaaagtccggcgc

SEQ ID NO: 472668 - DNA, 25 bp, Rattus norvegicus
ggagtccctctccaacttcgcgtag

SEQ ID NO: 472669 - DNA, 25 bp, Rattus norvegicus
gcaagggcagcttagagaagccacg

SEQ ID NO: 472670 - DNA, 25 bp, Rattus norvegicus
tacgccggccctaaactggcctgag

SEQ ID NO: 472671 - DNA, 25 bp, Rattus norvegicus
aggcgctagctgtccggaaccagcc

SEQ ID NO: 472672 - DNA, 25 bp, Rattus norvegicus
cctaaactggcctgaggggcactcc

SEQ ID NO: 472673 - DNA, 25 bp, Rattus norvegicus
gcctgaggggcactcccgatcagat

SEQ ID NO: 472674 - DNA, 25 bp, Rattus norvegicus
gatcagatttctcctcccataccta

SEQ ID NO: 472675 - DNA, 25 bp, Rattus norvegicus
ctcccatacctatctggatgcttca

SEQ ID NO: 472676 - DNA, 25 bp, Rattus norvegicus
ggatgcttcagacatctgcttcaga

SEQ ID NO: 472677 - DNA, 25 bp, Rattus norvegicus
ggctccgctcgctcagacttggcgg

SEQ ID NO: 472678 - DNA, 25 bp, Rattus norvegicus
ccgcagcggtagcttcagcggcagc

SEQ ID NO: 472679 - DNA, 25 bp, Rattus norvegicus
cagcggcagcttcggcagacaatat

SEQ ID NO: 472680 - DNA, 25 bp, Rattus norvegicus
cttcggcagacaatatggcggacct

SEQ ID NO: 472681 - DNA, 25 bp, Rattus norvegicus
acaatatggcggacctgcaggacgg

SEQ ID NO: 472682 - DNA, 25 bp, Rattus norvegicus
gtgctaaacgcgttcttaaccctca

SEQ ID NO: 472683 - DNA, 25 bp, Rattus norvegicus
tgcttcagactagagacaggccctc

SEQ ID NO: 472684 - DNA, 25 bp, Rattus norvegicus
cagctgcactaactctccgagcaaa

SEQ ID NO: 472685 - DNA, 25 bp, Rattus norvegicus
gcagtaagctaataacttgcgtccg

SEQ ID NO: 472686 - DNA, 25 bp, Rattus norvegicus
cgaggccgagaagcagtaagctaat

SEQ ID NO: 472687 - DNA, 25 bp, Rattus norvegicus
tgcaacgcgcgggagattggtacct

SEQ ID NO: 472688 - DNA, 25 bp, Rattus norvegicus
cagccgctttctgcaacgcgcggga

SEQ ID NO: 472689 - DNA, 25 bp, Rattus norvegicus
aattacttccgtcgcgtcacagccg

SEQ ID NO: 472690 - DNA, 25 bp, Rattus norvegicus
ggcacaggaaggaattacttccgtc

SEQ ID NO: 472691 - DNA, 25 bp, Rattus norvegicus
tcactagccagtcccgcagccacca

SEQ ID NO: 472692 - DNA, 25 bp, Rattus norvegicus
cgcgaaggggtaagcagagaaataa

SEQ ID NO: 472693 - DNA, 25 bp, Rattus norvegicus
tccgagcaaaatcagatcccggttc

SEQ ID NO: 472694 - DNA, 25 bp, Rattus norvegicus
gaaataactaaagtgcccagtccca

SEQ ID NO: 472695 - DNA, 25 bp, Rattus norvegicus
taataacttgcgtccgaaggaagtg

SEQ ID NO: 472696 - DNA, 25 bp, Rattus norvegicus
acaggtcgacactcactagccagtc

SEQ ID NO: 472697 - DNA, 25 bp, Rattus norvegicus
agacgctcagagcttccgttccttc

SEQ ID NO: 472698 - DNA, 25 bp, Rattus norvegicus
tcccggcgctgcatcaggaatgatg

SEQ ID NO: 472699 - DNA, 25 bp, Rattus norvegicus
actcaggctccgagtttattgcgcc

SEQ ID NO: 472700 - DNA, 25 bp, Rattus norvegicus
cctgcgccgactgaagacgtagcct

SEQ ID NO: 472701 - DNA, 25 bp, Rattus norvegicus
cccagcgagagagcaccggaaatga

SEQ ID NO: 472702 - DNA, 25 bp, Rattus norvegicus
caggtacttattctccggctccatc

SEQ ID NO: 472703 - DNA, 25 bp, Rattus norvegicus
agccatgagttcaggcaggtactta

SEQ ID NO: 472704 - DNA, 25 bp, Rattus norvegicus
gcgggagcacggtactatccatcaa

SEQ ID NO: 472705 - DNA, 25 bp, Rattus norvegicus
cttacctacggacagcagctgcatg

SEQ ID NO: 472706 - DNA, 25 bp, Rattus norvegicus
agatgagcactctcgatgcctgggc

SEQ ID NO: 472707 - DNA, 25 bp, Rattus norvegicus
ctctaaggctaggtcgagatgagca

SEQ ID NO: 472708 - DNA, 25 bp, Rattus norvegicus
actgagggtgcagaatctctaaggc

SEQ ID NO: 472709 - DNA, 25 bp, Rattus norvegicus
atcgcgagtcctcttcgggcctcga

SEQ ID NO: 472710 - DNA, 25 bp, Rattus norvegicus
gtcgagcgagtccttctcagccatg

SEQ ID NO: 472711 - DNA, 25 bp, Rattus norvegicus
cgcccttgagtttctccgcggagaa

SEQ ID NO: 472712 - DNA, 25 bp, Rattus norvegicus
tttagaattctgacccagactgcca

SEQ ID NO: 472713 - DNA, 25 bp, Rattus norvegicus
ctgccacactgctgtcgcgagtctt

SEQ ID NO: 472714 - DNA, 25 bp, Rattus norvegicus
gcgagtcttgccctgtctcggccaa

SEQ ID NO: 472715 - DNA, 25 bp, Rattus norvegicus
gtctcggccaagatcccagcagtgc

SEQ ID NO: 472716 - DNA, 25 bp, Rattus norvegicus
gactctgcccggagtcgttccggtc

SEQ ID NO: 472717 - DNA, 25 bp, Rattus norvegicus
atccgactcccgcgttcgtctttgg

SEQ ID NO: 472718 - DNA, 25 bp, Rattus norvegicus
tagcccgtcttgcttaattctcctc

SEQ ID NO: 472719 - DNA, 25 bp, Rattus norvegicus
cctcagcctggaattggggccgtgt

SEQ ID NO: 472720 - DNA, 25 bp, Rattus norvegicus
ggtgctccgttagcccgtcttgctt

SEQ ID NO: 472721 - DNA, 25 bp, Rattus norvegicus
agtgcccgcactcggggtgctccgt

SEQ ID NO: 472722 - DNA, 25 bp, Rattus norvegicus
tcctgctgctgacggcgcccaggtg

SEQ ID NO: 472723 - DNA, 25 bp, Rattus norvegicus
cccgccttagggatggcaaacttgc

SEQ ID NO: 472724 - DNA, 25 bp, Rattus norvegicus
tccggcccgaacagagtctgtccag

SEQ ID NO: 472725 - DNA, 25 bp, Rattus norvegicus
agagtctgtccagtgctcacccagc

SEQ ID NO: 472726 - DNA, 25 bp, Rattus norvegicus
tccgcacgagccctctgagagaaac

SEQ ID NO: 472727 - DNA, 25 bp, Rattus norvegicus
ttttcacctagcaacgttatcttcg

SEQ ID NO: 472728 - DNA, 25 bp, Rattus norvegicus
cttggagctcgtatccagaatgccg

SEQ ID NO: 472729 - DNA, 25 bp, Rattus norvegicus
tcgctgggaaaccagctggcgcatg

SEQ ID NO: 472730 - DNA, 25 bp, Rattus norvegicus
cgctgctgagagaagagcgtcctct

SEQ ID NO: 472731 - DNA, 25 bp, Rattus norvegicus
ctccagtgaccgaggaggtgtcctc

SEQ ID NO: 472732 - DNA, 25 bp, Rattus norvegicus
acgcttctcttcacgagccttcagt

SEQ ID NO: 472733 - DNA, 25 bp, Rattus norvegicus
ggcggtttctaattcttctccacta

SEQ ID NO: 472734 - DNA, 25 bp, Rattus norvegicus
ccgagtgatgcattcgggcggtttc

SEQ ID NO: 472735 - DNA, 25 bp, Rattus norvegicus
agtttctcaaccaacccgagtgatg

SEQ ID NO: 472736 - DNA, 25 bp, Rattus norvegicus
ccgcggcatgggagtactccagttt

SEQ ID NO: 472737 - DNA, 25 bp, Rattus norvegicus
tgaacctataagcttccgcggcatg

SEQ ID NO: 472738 - DNA, 25 bp, Rattus norvegicus
cgttatcttcgtaagtgaacctata

SEQ ID NO: 472739 - DNA, 25 bp, Rattus norvegicus
gcgccgggataagcacttggagctc

SEQ ID NO: 472740 - DNA, 25 bp, Rattus norvegicus
ccctggcaggcaccgatgctgctga

SEQ ID NO: 472741 - DNA, 25 bp, Rattus norvegicus
caggcaccgatgctgctgaggatga

SEQ ID NO: 472742 - DNA, 25 bp, Rattus norvegicus
ttggagctgtcaggtggataaacgc

SEQ ID NO: 472743 - DNA, 25 bp, Rattus norvegicus
ccctagctcgagaggctggatggag

SEQ ID NO: 472744 - DNA, 25 bp, Rattus norvegicus
tgtgcgcctctctgggtgccagagc

SEQ ID NO: 472745 - DNA, 25 bp, Rattus norvegicus
ccagagctcttggagaggggtccac

SEQ ID NO: 472746 - DNA, 25 bp, Rattus norvegicus
agtgacgggcgcgtgaattggagct

SEQ ID NO: 472747 - DNA, 25 bp, Rattus norvegicus
tcaggtggataaacgcgacggatgt

SEQ ID NO: 472748 - DNA, 25 bp, Rattus norvegicus
aaacgcgacggatgtgcgcgtcgcc

SEQ ID NO: 472749 - DNA, 25 bp, Rattus norvegicus
cctccggagcgaccctctctgtcat

SEQ ID NO: 472750 - DNA, 25 bp, Rattus norvegicus
tctgccgcaggcctccggagcgacc

SEQ ID NO: 472751 - DNA, 25 bp, Rattus norvegicus
ctcacccgggttgcccgctccttcg

SEQ ID NO: 472752 - DNA, 25 bp, Rattus norvegicus
cctctctgtcatcggccctgaaagg

SEQ ID NO: 472753 - DNA, 25 bp, Rattus norvegicus
tgtcatcggccctgaaaggcctcac

SEQ ID NO: 472754 - DNA, 25 bp, Rattus norvegicus
cccgagctgcagactaaactctgca

SEQ ID NO: 472755 - DNA, 25 bp, Rattus norvegicus
gccaagggacttctaggcaggcgct

SEQ ID NO: 472756 - DNA, 25 bp, Rattus norvegicus
ggtcagtagcgccaagggacttcta

SEQ ID NO: 472757 - DNA, 25 bp, Rattus norvegicus
gcctgcccgggtcagtagcgccaag

SEQ ID NO: 472758 - DNA, 25 bp, Rattus norvegicus
agtatggccgcctgcccgggtcagt

SEQ ID NO: 472759 - DNA, 25 bp, Rattus norvegicus
agactaaactctgcagtatggccgc

SEQ ID NO: 472760 - DNA, 25 bp, Rattus norvegicus
ccagcacggcggcaaggcctgcgag

SEQ ID NO: 472761 - DNA, 25 bp, Rattus norvegicus
ggtcctggagcctgtgctcccgcag

SEQ ID NO: 472762 - DNA, 25 bp, Rattus norvegicus
tgcttccttgcagtgcacggcgtgt

SEQ ID NO: 472763 - DNA, 25 bp, Rattus norvegicus
accggccacgtgcttccttgcagtg

SEQ ID NO: 472764 - DNA, 25 bp, Rattus norvegicus
caaggtgccgcccagccaccggcca

SEQ ID NO: 472765 - DNA, 25 bp, Rattus norvegicus
aaactgcggaactcctgattggtgg

SEQ ID NO: 472766 - DNA, 25 bp, Rattus norvegicus
gtaaaactgcggaactcctgattgg

SEQ ID NO: 472767 - DNA, 25 bp, Rattus norvegicus
aaactctgcagtatggccgcctgcc

SEQ ID NO: 472768 - DNA, 25 bp, Rattus norvegicus
cgcgcctagcctggcctccctcccg

SEQ ID NO: 472769 - DNA, 25 bp, Rattus norvegicus
ctcagtctagagaactcgggacgcg

SEQ ID NO: 472770 - DNA, 25 bp, Rattus norvegicus
gcctgattctgggcgcgcctagcct

SEQ ID NO: 472771 - DNA, 25 bp, Rattus norvegicus
tctgggcacgcaaggtcccgccttg

SEQ ID NO: 472772 - DNA, 25 bp, Rattus norvegicus
cggtgcagtccagtggccagcgcct

SEQ ID NO: 472773 - DNA, 25 bp, Rattus norvegicus
ggctggcccagctgtgttccattag

SEQ ID NO: 472774 - DNA, 25 bp, Rattus norvegicus
ggcccagctgtgttccattagcctc

SEQ ID NO: 472775 - DNA, 25 bp, Rattus norvegicus
gttccattagcctcttggcaggccc

SEQ ID NO: 472776 - DNA, 25 bp, Rattus norvegicus
tcttccctctccaggagcgcccggc

SEQ ID NO: 472777 - DNA, 25 bp, Rattus norvegicus
gctgcggtgcggcactcagtctaga

SEQ ID NO: 472778 - DNA, 25 bp, Rattus norvegicus
gtgcggcactcagtctagagaactc

SEQ ID NO: 472779 - DNA, 25 bp, Rattus norvegicus
cggcactcagtctagagaactcggg

SEQ ID NO: 472780 - DNA, 25 bp, Rattus norvegicus
agctgtgttccattagcctcttggc

SEQ ID NO: 472781 - DNA, 25 bp, Rattus norvegicus
ccgtaaaccccaggcctgattctgg

SEQ ID NO: 472782 - DNA, 25 bp, Rattus norvegicus
ggttgctcgtatctggacctcgctc

SEQ ID NO: 472783 - DNA, 25 bp, Rattus norvegicus
atcctgagcatcctttcgacactta

SEQ ID NO: 472784 - DNA, 25 bp, Rattus norvegicus
cgtccgctggctcattcatatcctg

SEQ ID NO: 472785 - DNA, 25 bp, Rattus norvegicus
cacgcgtccgctggctcattcatat

SEQ ID NO: 472786 - DNA, 25 bp, Rattus norvegicus
tgcctcgaggtcacccagctggagc

SEQ ID NO: 472787 - DNA, 25 bp, Rattus norvegicus
gtcccgtctctgttgcccgcggtag

SEQ ID NO: 472788 - DNA, 25 bp, Rattus norvegicus
ctcggtggctgcgtggtcccgtctc

SEQ ID NO: 472789 - DNA, 25 bp, Rattus norvegicus
gacttcgccttagggcagagctgga

SEQ ID NO: 472790 - DNA, 25 bp, Rattus norvegicus
atctggacctcgctcgcgggacttc

SEQ ID NO: 472791 - DNA, 25 bp, Rattus norvegicus
gggcatcctcggttgctcgtatctg

SEQ ID NO: 472792 - DNA, 25 bp, Rattus norvegicus
ccgccttgtacttcacgcttccatc

SEQ ID NO: 472793 - DNA, 25 bp, Rattus norvegicus
gagcatcctttcgacacttacgctc

SEQ ID NO: 472794 - DNA, 25 bp, Rattus norvegicus
ctcgctcgcgggacttcgccttagg

SEQ ID NO: 472795 - DNA, 25 bp, Rattus norvegicus
tgtctgcctcgaggtcacccagctg

SEQ ID NO: 472796 - DNA, 25 bp, Rattus norvegicus
tgccgaagccgttcgtcactttccg

SEQ ID NO: 472797 - DNA, 25 bp, Rattus norvegicus
ctttccggcaatgctcgggacctcg

SEQ ID NO: 472798 - DNA, 25 bp, Rattus norvegicus
ggacgctctgccagaaagacagaaa

SEQ ID NO: 472799 - DNA, 25 bp, Rattus norvegicus
gggccggaaccctgccagttacaca

SEQ ID NO: 472800 - DNA, 25 bp, Rattus norvegicus
ctgccagttacacaaagagtcccgc

SEQ ID NO: 472801 - DNA, 25 bp, Rattus norvegicus
tggcctcagtgtcccggttccctga

SEQ ID NO: 472802 - DNA, 25 bp, Rattus norvegicus
cacccgatccgcgacaccagctgtc

SEQ ID NO: 472803 - DNA, 25 bp, Rattus norvegicus
agcgactgcgggatgaagataagaa

SEQ ID NO: 472804 - DNA, 25 bp, Rattus norvegicus
ggcaagtttggaggaagcaaaaaga

SEQ ID NO: 472805 - DNA, 25 bp, Rattus norvegicus
tggcactcacgcagctgagcaggga

SEQ ID NO: 472806 - DNA, 25 bp, Rattus norvegicus
agaaagacagaaacgcagtggggcc

SEQ ID NO: 472807 - DNA, 25 bp, Rattus norvegicus
tcggatcccggatccggtgggactc

SEQ ID NO: 472808 - DNA, 25 bp, Rattus norvegicus
ggggcaccagcctcggatcccggat

SEQ ID NO: 472809 - DNA, 25 bp, Rattus norvegicus
gttcgtcactttccggcaatgctcg

SEQ ID NO: 472810 - DNA, 25 bp, Rattus norvegicus
ttaaagagactctccagccgggagc

SEQ ID NO: 472811 - DNA, 25 bp, Rattus norvegicus
catgaagtcactcggtgagcgaacg

SEQ ID NO: 472812 - DNA, 25 bp, Rattus norvegicus
cgtgacgccagctcaagagcgagtt

SEQ ID NO: 472813 - DNA, 25 bp, Rattus norvegicus
agagcgagtttcctttcagtatggc

SEQ ID NO: 472814 - DNA, 25 bp, Rattus norvegicus
gagcgaacgactggcgcaggatcca

SEQ ID NO: 472815 - DNA, 25 bp, Rattus norvegicus
ccgggcttcctatttcgggagcaag

SEQ ID NO: 472816 - DNA, 25 bp, Rattus norvegicus
tcatcatgtgatgcgagggctattt

SEQ ID NO: 472817 - DNA, 25 bp, Rattus norvegicus
tcctctctcattgcaccatggcgga

SEQ ID NO: 472818 - DNA, 25 bp, Rattus norvegicus
tgcaccatggcggacgcctttgtcg

SEQ ID NO: 472819 - DNA, 25 bp, Rattus norvegicus
cgcctttgtcggtacctggaagcta

SEQ ID NO: 472820 - DNA, 25 bp, Rattus norvegicus
cctggaagctagtggacagcaagaa

SEQ ID NO: 472821 - DNA, 25 bp, Rattus norvegicus
cagcaagaattttgatgactacatg

SEQ ID NO: 472822 - DNA, 25 bp, Rattus norvegicus
ccagaaggatcaggcggcgtttccc

SEQ ID NO: 472823 - DNA, 25 bp, Rattus norvegicus
ggtgtgggccactttcatcatgtga

SEQ ID NO: 472824 - DNA, 25 bp, Rattus norvegicus
gctcctaacaggacagccgcttcat

SEQ ID NO: 472825 - DNA, 25 bp, Rattus norvegicus
tcaagcggccgcgacatgagttgct

SEQ ID NO: 472826 - DNA, 25 bp, Rattus norvegicus
gcagaaacgcaagggcccagagcta

SEQ ID NO: 472827 - DNA, 25 bp, Rattus norvegicus
gccgccatgatcgagcagcagaaac

SEQ ID NO: 472828 - DNA, 25 bp, Rattus norvegicus
ttgaaaccaattgcgcaacgcctgc

SEQ ID NO: 472829 - DNA, 25 bp, Rattus norvegicus
ctggaggaagaactcagttgaaacc

SEQ ID NO: 472830 - DNA, 25 bp, Rattus norvegicus
attggttgctctcttccggaagttc

SEQ ID NO: 472831 - DNA, 25 bp, Rattus norvegicus
aagagtgtattcagagggcgttgca

SEQ ID NO: 472832 - DNA, 25 bp, Rattus norvegicus
agagaccaatcgcaagagtgtattc

SEQ ID NO: 472833 - DNA, 25 bp, Rattus norvegicus
tccagagtggagttctcgtgacgtc

SEQ ID NO: 472834 - DNA, 25 bp, Rattus norvegicus
agaacgtcagttctgcgacccaatc

SEQ ID NO: 472835 - DNA, 25 bp, Rattus norvegicus
actgaatctgctccgctcgttctca

SEQ ID NO: 472836 - DNA, 25 bp, Rattus norvegicus
acatgagttgctgttgggagccgca

SEQ ID NO: 472837 - DNA, 25 bp, Rattus norvegicus
gccgcttcatccctaggaacactga

SEQ ID NO: 472838 - DNA, 25 bp, Rattus norvegicus
cgcgggctggcttgtccctttgtgt

SEQ ID NO: 472839 - DNA, 25 bp, Rattus norvegicus
accgggcgcaccatgcactaggggt

SEQ ID NO: 472840 - DNA, 25 bp, Rattus norvegicus
agccatgggcaagtgcagcgggcgc

SEQ ID NO: 472841 - DNA, 25 bp, Rattus norvegicus
gggcgctgcacgctggtcgccttct

SEQ ID NO: 472842 - DNA, 25 bp, Rattus norvegicus
cacgctggtcgccttctgttgcctg

SEQ ID NO: 472843 - DNA, 25 bp, Rattus norvegicus
cttctgttgcctgcagctggtgagt

SEQ ID NO: 472844 - DNA, 25 bp, Rattus norvegicus
gcttgtccctttgtgtgcgctcctc

SEQ ID NO: 472845 - DNA, 25 bp, Rattus norvegicus
acggtccaacgctcccgggctgcac

SEQ ID NO: 472846 - DNA, 25 bp, Rattus norvegicus
ggctgcacgcgtccgttcacactgt

SEQ ID NO: 472847 - DNA, 25 bp, Rattus norvegicus
tgcacgcgtccgttcacactgtgtg

SEQ ID NO: 472848 - DNA, 25 bp, Rattus norvegicus
ttcacactgtgtgcgtgagctcccg

SEQ ID NO: 472849 - DNA, 25 bp, Rattus norvegicus
acactgtgtgcgtgagctcccgctg

SEQ ID NO: 472850 - DNA, 25 bp, Rattus norvegicus
cccagctgggcagtgctgcaccgcg

SEQ ID NO: 472851 - DNA, 25 bp, Rattus norvegicus
gcgctcgcgcgcacggtccaacgct

SEQ ID NO: 472852 - DNA, 25 bp, Rattus norvegicus
ggtgcgaaccgcaccggggcagcct

SEQ ID NO: 472853 - DNA, 25 bp, Rattus norvegicus
ccgggcgcaggcttgcgctttttaa

SEQ ID NO: 472854 - DNA, 25 bp, Rattus norvegicus
ccgcgagcgcgagcggtagacagcc

SEQ ID NO: 472855 - DNA, 25 bp, Rattus norvegicus
ggaccgcacggagcgtggcagtccc

SEQ ID NO: 472856 - DNA, 25 bp, Rattus norvegicus
caagtcagccatgggcggctctgcg

SEQ ID NO: 472857 - DNA, 25 bp, Rattus norvegicus
actcaagtcagccatgggcggctct

SEQ ID NO: 472858 - DNA, 25 bp, Rattus norvegicus
tgaaactcaagtcagccatgggcgg

SEQ ID NO: 472859 - DNA, 25 bp, Rattus norvegicus
tcaatgaaactcaagtcagccatgg

SEQ ID NO: 472860 - DNA, 25 bp, Rattus norvegicus
atcctcaatgaaactcaagtcagcc

SEQ ID NO: 472861 - DNA, 25 bp, Rattus norvegicus
ctgcatcctcaatgaaactcaagtc

SEQ ID NO: 472862 - DNA, 25 bp, Rattus norvegicus
ggcgactgcatcctcaatgaaactc

SEQ ID NO: 472863 - DNA, 25 bp, Rattus norvegicus
gaaggcgactgcatcctcaatgaaa

SEQ ID NO: 472864 - DNA, 25 bp, Rattus norvegicus
cgcaggcttgcgctttttaaggtcg

SEQ ID NO: 472865 - DNA, 25 bp, Rattus norvegicus
gggaaggcgactgcatcctcaatga

SEQ ID NO: 472866 - DNA, 25 bp, Rattus norvegicus
ctgggcactctcttggggcccatca

SEQ ID NO: 472867 - DNA, 25 bp, Rattus norvegicus
gagacccggtgagaccgggacacac

SEQ ID NO: 472868 - DNA, 25 bp, Rattus norvegicus
tgagaccgggacacacccagaacgg

SEQ ID NO: 472869 - DNA, 25 bp, Rattus norvegicus
cgcgacgaggggacacgcaaagaca

SEQ ID NO: 472870 - DNA, 25 bp, Rattus norvegicus
cacgcaaagacacgcggggtacacg

SEQ ID NO: 472871 - DNA, 25 bp, Rattus norvegicus
cggggtacacgctgggcactctctt

SEQ ID NO: 472872 - DNA, 25 bp, Rattus norvegicus
cagcagcggtggcagtaacaacccg

SEQ ID NO: 472873 - DNA, 25 bp, Rattus norvegicus
cggcccgggcttcatggcggccttt

SEQ ID NO: 472874 - DNA, 25 bp, Rattus norvegicus
cttcatggcggcctttgttcgcggc

SEQ ID NO: 472875 - DNA, 25 bp, Rattus norvegicus
gctccgcctcgctcgttcgttcgct

SEQ ID NO: 472876 - DNA, 25 bp, Rattus norvegicus
cccaactgtggattcgcggagcacg

SEQ ID NO: 472877 - DNA, 25 bp, Rattus norvegicus
agctgcgggagaacctgggctcctc

SEQ ID NO: 472878 - DNA, 25 bp, Rattus norvegicus
agcggataccggacgcacacgcttc

SEQ ID NO: 472879 - DNA, 25 bp, Rattus norvegicus
cagcggtggcagtaacaacccgcgg

SEQ ID NO: 472880 - DNA, 25 bp, Rattus norvegicus
gcccgtatggactcaccgcgctggg

SEQ ID NO: 472881 - DNA, 25 bp, Rattus norvegicus
ttctctctcggctttccaagccgtg

SEQ ID NO: 472882 - DNA, 25 bp, Rattus norvegicus
actcaccgcgctgggccggaggtcg

SEQ ID NO: 472883 - DNA, 25 bp, Rattus norvegicus
tcggcactccttcgcctgatgcacg

SEQ ID NO: 472884 - DNA, 25 bp, Rattus norvegicus
tccttcgcctgatgcacgcacactc

SEQ ID NO: 472885 - DNA, 25 bp, Rattus norvegicus
tcgcctgatgcacgcacactccacc

SEQ ID NO: 472886 - DNA, 25 bp, Rattus norvegicus
ccagccacccagctcaggtctcctc

SEQ ID NO: 472887 - DNA, 25 bp, Rattus norvegicus
tctcggctttccaagccgtggagcc

SEQ ID NO: 472888 - DNA, 25 bp, Rattus norvegicus
gctttccaagccgtggagccttcga

SEQ ID NO: 472889 - DNA, 25 bp, Rattus norvegicus
ttccaagccgtggagccttcgagct

SEQ ID NO: 472890 - DNA, 25 bp, Rattus norvegicus
tcaccactccgaagccgcccgtatg

SEQ ID NO: 472891 - DNA, 25 bp, Rattus norvegicus
actttcctctctcggcactccttcg

SEQ ID NO: 472892 - DNA, 25 bp, Rattus norvegicus
cgtatggactcaccgcgctgggccg

SEQ ID NO: 472893 - DNA, 25 bp, Rattus norvegicus
ttcgagcttcaccactccgaagccg

SEQ ID NO: 472894 - DNA, 25 bp, Rattus norvegicus
cggataacaatagggcctcgctgcc

SEQ ID NO: 472895 - DNA, 25 bp, Rattus norvegicus
catgccaaccgcagggcctgcgtga

SEQ ID NO: 472896 - DNA, 25 bp, Rattus norvegicus
aggttgcccggttgccatgccaacc

SEQ ID NO: 472897 - DNA, 25 bp, Rattus norvegicus
cggctctggaacaggttgcccggtt

SEQ ID NO: 472898 - DNA, 25 bp, Rattus norvegicus
gggaaactcgcaggccacacaaccg

SEQ ID NO: 472899 - DNA, 25 bp, Rattus norvegicus
gcacggagtgcccagcctgccgtag

SEQ ID NO: 472900 - DNA, 25 bp, Rattus norvegicus
gtaggatgaagatggattccggccc

SEQ ID NO: 472901 - DNA, 25 bp, Rattus norvegicus
ttcagagcacggtttggggccaccg

SEQ ID NO: 472902 - DNA, 25 bp, Rattus norvegicus
acgccaatacgaggggcgcatcggc

SEQ ID NO: 472903 - DNA, 25 bp, Rattus norvegicus
accgctgccaaacgccaatacgagg

SEQ ID NO: 472904 - DNA, 25 bp, Rattus norvegicus
cctgcgtgaactcggggaaactcgc

SEQ ID NO: 472905 - DNA, 25 bp, Rattus norvegicus
ccaaacacgtacgagcggagcgagc

SEQ ID NO: 472906 - DNA, 25 bp, Rattus norvegicus
ggcggcgtctctaagcccttctcgc

SEQ ID NO: 472907 - DNA, 25 bp, Rattus norvegicus
acctttcactccgacaacatggcgg

SEQ ID NO: 472908 - DNA, 25 bp, Rattus norvegicus
tctaaccggccaagctgagaattcc

SEQ ID NO: 472909 - DNA, 25 bp, Rattus norvegicus
ctcccagcgggaacaaagaagaagc

SEQ ID NO: 472910 - DNA, 25 bp, Rattus norvegicus
cgcaccggggcgtccagcgagaact

SEQ ID NO: 472911 - DNA, 25 bp, Rattus norvegicus
agaattccgcatttccctgcaaagg

SEQ ID NO: 472912 - DNA, 25 bp, Rattus norvegicus
ggccaagctgagaattccgcatttc

SEQ ID NO: 472913 - DNA, 25 bp, Rattus norvegicus
gcatttccctgcaaaggcgcggctc

SEQ ID NO: 472914 - DNA, 25 bp, Rattus norvegicus
ctggacttctaaccggccaagctga

SEQ ID NO: 472915 - DNA, 25 bp, Rattus norvegicus
gagggacctaataaactagcgagtg

SEQ ID NO: 472916 - DNA, 25 bp, Rattus norvegicus
aaactagcgagtgcattggatagtc

SEQ ID NO: 472917 - DNA, 25 bp, Rattus norvegicus
tgcattggatagtcggtcctgattg

SEQ ID NO: 472918 - DNA, 25 bp, Rattus norvegicus
gcgtccagcgagaactggacttcta

SEQ ID NO: 472919 - DNA, 25 bp, Rattus norvegicus
gcacacaccttttacacagagcgca

SEQ ID NO: 472920 - DNA, 25 bp, Rattus norvegicus
ccttttacacagagcgcaccggggc

SEQ ID NO: 472921 - DNA, 25 bp, Rattus norvegicus
caaagaagaagcgaggtggggccta

SEQ ID NO: 472922 - DNA, 25 bp, Rattus norvegicus
tgcaggttgtcatcgtcgtgactga

SEQ ID NO: 472923 - DNA, 25 bp, Rattus norvegicus
catcgtcgtgactgatgggaggcct

SEQ ID NO: 472924 - DNA, 25 bp, Rattus norvegicus
ttccaagaggccttttgcggttcgc

SEQ ID NO: 472925 - DNA, 25 bp, Rattus norvegicus
caagaagttccaagaggccttttgc

SEQ ID NO: 472926 - DNA, 25 bp, Rattus norvegicus
acaatgtcatcgagaagctggccaa

SEQ ID NO: 472927 - DNA, 25 bp, Rattus norvegicus
ttacgtggagagctacaatgtcatc

SEQ ID NO: 472928 - DNA, 25 bp, Rattus norvegicus
cgtggattacgtggagagctacaat

SEQ ID NO: 472929 - DNA, 25 bp, Rattus norvegicus
cgcaggatgagcacgtggattacgt

SEQ ID NO: 472930 - DNA, 25 bp, Rattus norvegicus
agatcgctagcgagccgcaggatga

SEQ ID NO: 472931 - DNA, 25 bp, Rattus norvegicus
acactgagacagatcgctagcgagc

SEQ ID NO: 472932 - DNA, 25 bp, Rattus norvegicus
gccgcgtggacaaggctacactgag

SEQ ID NO: 472933 - DNA, 25 bp, Rattus norvegicus
gcatcgagctgttcgccatcggcgt

SEQ ID NO: 472934 - DNA, 25 bp, Rattus norvegicus
agccagtggcatcgagctgttcgcc

SEQ ID NO: 472935 - DNA, 25 bp, Rattus norvegicus
ccacctcgtgcaggttgtcatcgtc

SEQ ID NO: 472936 - DNA, 25 bp, Rattus norvegicus
cacgcataaacaaacacgcgggttt

SEQ ID NO: 472937 - DNA, 25 bp, Rattus norvegicus
gccgcttggaacttgcgaaacaaca

SEQ ID NO: 472938 - DNA, 25 bp, Rattus norvegicus
tctctgacattcactcggacccata

SEQ ID NO: 472939 - DNA, 25 bp, Rattus norvegicus
ccacagggtcactcgtgggcacagc

SEQ ID NO: 472940 - DNA, 25 bp, Rattus norvegicus
tgggcacagcgcacagatacacagg

SEQ ID NO: 472941 - DNA, 25 bp, Rattus norvegicus
gatacacaggctccaaccaggttcc

SEQ ID NO: 472942 - DNA, 25 bp, Rattus norvegicus
agagccctcacagcacacgcataaa

SEQ ID NO: 472943 - DNA, 25 bp, Rattus norvegicus
acgcgggttttcaaatgcaccagca

SEQ ID NO: 472944 - DNA, 25 bp, Rattus norvegicus
tcccgcctggggaatacaaaacagc

SEQ ID NO: 472945 - DNA, 25 bp, Rattus norvegicus
cttggcagcgtggacaaacatgagc

SEQ ID NO: 472946 - DNA, 25 bp, Rattus norvegicus
tgcacacaaactacagacacagagg

SEQ ID NO: 472947 - DNA, 25 bp, Rattus norvegicus
gatgccaccgcgacaacttgttccg

SEQ ID NO: 472948 - DNA, 25 bp, Rattus norvegicus
cccgaaatgtcggagtcggcggcta

SEQ ID NO: 472949 - DNA, 25 bp, Rattus norvegicus
tggggcaggatccacagagccctca

SEQ ID NO: 472950 - DNA, 25 bp, Rattus norvegicus
tccgctttctcggagccgtcgcatg

SEQ ID NO: 472951 - DNA, 25 bp, Rattus norvegicus
ggtctatggcaaccacggggatcca

SEQ ID NO: 472952 - DNA, 25 bp, Rattus norvegicus
tgcttgcgagtctcctcgaggcttg

SEQ ID NO: 472953 - DNA, 25 bp, Rattus norvegicus
ggtttcttccttcaccacgagctgg

SEQ ID NO: 472954 - DNA, 25 bp, Rattus norvegicus
atccagtaagagtcggcgctggccc

SEQ ID NO: 472955 - DNA, 25 bp, Rattus norvegicus
cacggggatccagccaaggtcatcc

SEQ ID NO: 472956 - DNA, 25 bp, Rattus norvegicus
gcgggcgctggtctatggcaaccac

SEQ ID NO: 472957 - DNA, 25 bp, Rattus norvegicus
cttggtgccgccagggcaggaccac

SEQ ID NO: 472958 - DNA, 25 bp, Rattus norvegicus
tgacgtatccggagcgccgggttct

SEQ ID NO: 472959 - DNA, 25 bp, Rattus norvegicus
gaccaatgacgtatccggagcgccg

SEQ ID NO: 472960 - DNA, 25 bp, Rattus norvegicus
tgaagtcgcggaccaatgacgtatc

SEQ ID NO: 472961 - DNA, 25 bp, Rattus norvegicus
cgcaggcttgaagtcgcggaccaat

SEQ ID NO: 472962 - DNA, 25 bp, Rattus norvegicus
tccttcaccacgagctgggcggaga

SEQ ID NO: 472963 - DNA, 25 bp, Rattus norvegicus
caaggtcatccagtaagagtcggcg

SEQ ID NO: 472964 - DNA, 25 bp, Rattus norvegicus
agcagatgagggttccggctctctt

SEQ ID NO: 472965 - DNA, 25 bp, Rattus norvegicus
gagcgcttctttaagggctacggga

SEQ ID NO: 472966 - DNA, 25 bp, Rattus norvegicus
tcgactccgaagtgagacgggcctc

SEQ ID NO: 472967 - DNA, 25 bp, Rattus norvegicus
ccgcggcctgtttcgactccgaagt

SEQ ID NO: 472968 - DNA, 25 bp, Rattus norvegicus
ttccgtcgctggacagcgagtccgc

SEQ ID NO: 472969 - DNA, 25 bp, Rattus norvegicus
cacggcgctcgctgggcactaagtc

SEQ ID NO: 472970 - DNA, 25 bp, Rattus norvegicus
agcgcgatgtggagcgcttctttaa

SEQ ID NO: 472971 - DNA, 25 bp, Rattus norvegicus
tacatcggccgcctgagctaccagg

SEQ ID NO: 472972 - DNA, 25 bp, Rattus norvegicus
gaatgccgcgcgtgtacatcggccg

SEQ ID NO: 472973 - DNA, 25 bp, Rattus norvegicus
ctacgtgctcgcgtacgtcgccggg

SEQ ID NO: 472974 - DNA, 25 bp, Rattus norvegicus
acgcgcgttctcgagctacgtgctc

SEQ ID NO: 472975 - DNA, 25 bp, Rattus norvegicus
cagctgtcgctcactgggccaagtc

SEQ ID NO: 472976 - DNA, 25 bp, Rattus norvegicus
agctcgcgagatgtgccgcagctgt

SEQ ID NO: 472977 - DNA, 25 bp, Rattus norvegicus
aagtgccgacaccacggcgagctcg

SEQ ID NO: 472978 - DNA, 25 bp, Rattus norvegicus
acaccgcaatctgggaacagacttg

SEQ ID NO: 472979 - DNA, 25 bp, Rattus norvegicus
agcccgaatcggaaacaccgcaatc

SEQ ID NO: 472980 - DNA, 25 bp, Rattus norvegicus
aacagacttgcctgggccgacgaga

SEQ ID NO: 472981 - DNA, 25 bp, Rattus norvegicus
gaatcctggacaaagtccgccgctg

SEQ ID NO: 472982 - DNA, 25 bp, Rattus norvegicus
ctctgctctgactggctggtcttga

SEQ ID NO: 472983 - DNA, 25 bp, Rattus norvegicus
ctggtcttgaccagagcggtttttc

SEQ ID NO: 472984 - DNA, 25 bp, Rattus norvegicus
gcggtttttcccagagtctagctca

SEQ ID NO: 472985 - DNA, 25 bp, Rattus norvegicus
gagaagccggagtcagagacacctc

SEQ ID NO: 472986 - DNA, 25 bp, Rattus norvegicus
ccctcgctgcggtatgtaaagcgca

SEQ ID NO: 472987 - DNA, 25 bp, Rattus norvegicus
ggtcgagctccggagatacttaccc

SEQ ID NO: 472988 - DNA, 25 bp, Rattus norvegicus
tggctcccagctccgctgcggaaaa

SEQ ID NO: 472989 - DNA, 25 bp, Rattus norvegicus
tcgggtcagcgtttgcctctctgct

SEQ ID NO: 472990 - DNA, 25 bp, Rattus norvegicus
cagtgctggctgaagaagtctgcaa

SEQ ID NO: 472991 - DNA, 25 bp, Rattus norvegicus
gagcgcccgaacgaccgcgcgatga

SEQ ID NO: 472992 - DNA, 25 bp, Rattus norvegicus
ccgcggattccgcttgacttcttcg

SEQ ID NO: 472993 - DNA, 25 bp, Rattus norvegicus
cacgcctaactttgcaacgtggtcc

SEQ ID NO: 472994 - DNA, 25 bp, Rattus norvegicus
ggcctgcaaggaggctggagacaaa

SEQ ID NO: 472995 - DNA, 25 bp, Rattus norvegicus
ggcgccagccgtagcttcagccgga

SEQ ID NO: 472996 - DNA, 25 bp, Rattus norvegicus
agccgtagcttcagccggacgaaca

SEQ ID NO: 472997 - DNA, 25 bp, Rattus norvegicus
cttcagccggacgaacaatagcagg

SEQ ID NO: 472998 - DNA, 25 bp, Rattus norvegicus
acgaacaatagcaggaggcggcgcc

SEQ ID NO: 472999 - DNA, 25 bp, Rattus norvegicus
cgggctgcaggctagctgactaaac

SEQ ID NO: 473000 - DNA, 25 bp, Rattus norvegicus
tagctgactaaacccgccggcggag

SEQ ID NO: 473001 - DNA, 25 bp, Rattus norvegicus
gcacccagcaccttcgccgtccacc

SEQ ID NO: 473002 - DNA, 25 bp, Rattus norvegicus
ccatcacgaaggactcgctccgctc

SEQ ID NO: 473003 - DNA, 25 bp, Rattus norvegicus
cgcttgacttcttcgggtctgccca

SEQ ID NO: 473004 - DNA, 25 bp, Rattus norvegicus
gctgcccacctggtttcctgccagg

SEQ ID NO: 473005 - DNA, 25 bp, Rattus norvegicus
gacttcttcgggtctgcccagcttc

SEQ ID NO: 473006 - DNA, 25 bp, Rattus norvegicus
gagctactgcatgccgtctcccgag

SEQ ID NO: 473007 - DNA, 25 bp, Rattus norvegicus
tcagttacgtaaggacccgagcagg

SEQ ID NO: 473008 - DNA, 25 bp, Rattus norvegicus
gggcacagagacctactgcggacga

SEQ ID NO: 473009 - DNA, 25 bp, Rattus norvegicus
actccaggtccggagcgagctactg

SEQ ID NO: 473010 - DNA, 25 bp, Rattus norvegicus
acaccctcgactttgagactccaga

SEQ ID NO: 473011 - DNA, 25 bp, Rattus norvegicus
ctggggacctcaagtttggagcatc

SEQ ID NO: 473012 - DNA, 25 bp, Rattus norvegicus
ttctgggtcttgcaccttgtccttc

SEQ ID NO: 473013 - DNA, 25 bp, Rattus norvegicus
ttaagaggttcctgccactttgccc

SEQ ID NO: 473014 - DNA, 25 bp, Rattus norvegicus
ccggaggtcctctaattggtgcaga

SEQ ID NO: 473015 - DNA, 25 bp, Rattus norvegicus
tggtgcagacaactgccaatctttg

SEQ ID NO: 473016 - DNA, 25 bp, Rattus norvegicus
agcagcccgactgtcgcaaccggga

SEQ ID NO: 473017 - DNA, 25 bp, Rattus norvegicus
ccagcctagaacagctcctgataga

SEQ ID NO: 473018 - DNA, 25 bp, Rattus norvegicus
cacctgcactgacagggcaactctg

SEQ ID NO: 473019 - DNA, 25 bp, Rattus norvegicus
ctgcggacgaacacccgcgacagga

SEQ ID NO: 473020 - DNA, 25 bp, Rattus norvegicus
tcatcatcggcgacacaggtgaggc

SEQ ID NO: 473021 - DNA, 25 bp, Rattus norvegicus
agtgagagaaaagccgagcgaatta

SEQ ID NO: 473022 - DNA, 25 bp, Rattus norvegicus
gcctcgactgtctttgcggcccggg

SEQ ID NO: 473023 - DNA, 25 bp, Rattus norvegicus
agtgtgacagcaggatggctgtccc

SEQ ID NO: 473024 - DNA, 25 bp, Rattus norvegicus
actcccggagagtgtgacagcagga

SEQ ID NO: 473025 - DNA, 25 bp, Rattus norvegicus
ctccatttccgcagtgctggcgctg

SEQ ID NO: 473026 - DNA, 25 bp, Rattus norvegicus
cgagcgaattagagcgtgacaggcc

SEQ ID NO: 473027 - DNA, 25 bp, Rattus norvegicus
tggcgtacgcctatctcttcaagta

SEQ ID NO: 473028 - DNA, 25 bp, Rattus norvegicus
ctgctggctctgacggcgaccgacg

SEQ ID NO: 473029 - DNA, 25 bp, Rattus norvegicus
tcggcgctgtcagttcgtcccgctg

SEQ ID NO: 473030 - DNA, 25 bp, Rattus norvegicus
tgcgatccgcgctcggcgctgtcag

SEQ ID NO: 473031 - DNA, 25 bp, Rattus norvegicus
tgttattgttccgaagggctgggcc

SEQ ID NO: 473032 - DNA, 25 bp, Rattus norvegicus
gcgccgcggctgttattgttccgaa

SEQ ID NO: 473033 - DNA, 25 bp, Rattus norvegicus
cagccgtttgccactcccggagagt

SEQ ID NO: 473034 - DNA, 25 bp, Rattus norvegicus
ttagcgtctgttgtaacccagtttg

SEQ ID NO: 473035 - DNA, 25 bp, Rattus norvegicus
gagcacgagcctggcggatttcatt

SEQ ID NO: 473036 - DNA, 25 bp, Rattus norvegicus
tggcggatttcattggggacctgac

SEQ ID NO: 473037 - DNA, 25 bp, Rattus norvegicus
tcattggggacctgacccgtgaaaa

SEQ ID NO: 473038 - DNA, 25 bp, Rattus norvegicus
ctgacccgtgaaaactgggagagtt

SEQ ID NO: 473039 - DNA, 25 bp, Rattus norvegicus
gagaccgcccggcaactcatgacgt

SEQ ID NO: 473040 - DNA, 25 bp, Rattus norvegicus
tcctcatctgcgctctgataggtcc

SEQ ID NO: 473041 - DNA, 25 bp, Rattus norvegicus
tctgcgctctgataggtcctaccta

SEQ ID NO: 473042 - DNA, 25 bp, Rattus norvegicus
cctacttacgttttagcgtctgttg

SEQ ID NO: 473043 - DNA, 25 bp, Rattus norvegicus
ctgttgtaacccagtttgaagtcta

SEQ ID NO: 473044 - DNA, 25 bp, Rattus norvegicus
tttgaagtctaaagggacctctcgc

SEQ ID NO: 473045 - DNA, 25 bp, Rattus norvegicus
ctaaagggacctctcgcggacattc

SEQ ID NO: 473046 - DNA, 25 bp, Rattus norvegicus
cgcggacattcgaagatatgcactc

SEQ ID NO: 473047 - DNA, 25 bp, Rattus norvegicus
ctctgataggtcctacctacttacg

SEQ ID NO: 473048 - DNA, 25 bp, Rattus norvegicus
cgtagcccagcgcaatgcacaagtg

SEQ ID NO: 473049 - DNA, 25 bp, Rattus norvegicus
aagcagcgcttgaagttctcgtcca

SEQ ID NO: 473050 - DNA, 25 bp, Rattus norvegicus
ctcgtccaggaaggcgtagagaacc

SEQ ID NO: 473051 - DNA, 25 bp, Rattus norvegicus
ttgaggctgctgttggcgtagccca

SEQ ID NO: 473052 - DNA, 25 bp, Rattus norvegicus
atgcacaagtgcagcgcggccacca

SEQ ID NO: 473053 - DNA, 25 bp, Rattus norvegicus
ccacaagtgggtcgcgccgattgat

SEQ ID NO: 473054 - DNA, 25 bp, Rattus norvegicus
gccgattgatgtccaccagcgtcca

SEQ ID NO: 473055 - DNA, 25 bp, Rattus norvegicus
gcgtccagacgatgacgaagatgtg

SEQ ID NO: 473056 - DNA, 25 bp, Rattus norvegicus
atgggcgcccagcacaccacgaagg

SEQ ID NO: 473057 - DNA, 25 bp, Rattus norvegicus
caccatgcgcgtgatgcgccgcagg

SEQ ID NO: 473058 - DNA, 25 bp, Rattus norvegicus
cttctccttggagccggacagcagg

SEQ ID NO: 473059 - DNA, 25 bp, Rattus norvegicus
cgcagcagcatgaggccatagcaca

SEQ ID NO: 473060 - DNA, 25 bp, Rattus norvegicus
cacacggtgatgatgagaatgggca

SEQ ID NO: 473061 - DNA, 25 bp, Rattus norvegicus
caccacgaaggcgaagaggaacacg

SEQ ID NO: 473062 - DNA, 25 bp, Rattus norvegicus
atggccagagccagggacgaggcac

SEQ ID NO: 473063 - DNA, 25 bp, Rattus norvegicus
gactcaccggacgattccaaacatg

SEQ ID NO: 473064 - DNA, 25 bp, Rattus norvegicus
cggacgattccaaacatgacgagca

SEQ ID NO: 473065 - DNA, 25 bp, Rattus norvegicus
ccctgcctggactttgctgactcta

SEQ ID NO: 473066 - DNA, 25 bp, Rattus norvegicus
gcgctccctgcctggactttgctga

SEQ ID NO: 473067 - DNA, 25 bp, Rattus norvegicus
agaaggcaccggctccatggcgcct

SEQ ID NO: 473068 - DNA, 25 bp, Rattus norvegicus
ctgcagctccgcacgggcagaaggc

SEQ ID NO: 473069 - DNA, 25 bp, Rattus norvegicus
cgaaaactgcagctccgcacgggca

SEQ ID NO: 473070 - DNA, 25 bp, Rattus norvegicus
tccaaacatgacgagcacgttgccc

SEQ ID NO: 473071 - DNA, 25 bp, Rattus norvegicus
acgcattggcgctcgcactggggaa

SEQ ID NO: 473072 - DNA, 25 bp, Rattus norvegicus
tggactttgctgactctaggcgccc

SEQ ID NO: 473073 - DNA, 25 bp, Rattus norvegicus
cacacagccgagtagagtgcggtga

SEQ ID NO: 473074 - DNA, 25 bp, Rattus norvegicus
ggcagacttgactcaccggacgatt

SEQ ID NO: 473075 - DNA, 25 bp, Rattus norvegicus
acgttggcgaggagcgaaaactgca

SEQ ID NO: 473076 - DNA, 25 bp, Rattus norvegicus
catctcgggaaggtagaatcgtgcc

SEQ ID NO: 473077 - DNA, 25 bp, Rattus norvegicus
gagcagcaagtcgtccgggaagaaa

SEQ ID NO: 473078 - DNA, 25 bp, Rattus norvegicus
gacaaatgaaagcagggcccgagcc

SEQ ID NO: 473079 - DNA, 25 bp, Rattus norvegicus
aagccctggccgctaatgggacgga

SEQ ID NO: 473080 - DNA, 25 bp, Rattus norvegicus
cgcctcacacaatggccgagacatg

SEQ ID NO: 473081 - DNA, 25 bp, Rattus norvegicus
tgtacctgctccaagaggctgctgg

SEQ ID NO: 473082 - DNA, 25 bp, Rattus norvegicus
tggccgacatggctctcggatcctc

SEQ ID NO: 473083 - DNA, 25 bp, Rattus norvegicus
tcggatcctcactggtaacgtcggt

SEQ ID NO: 473084 - DNA, 25 bp, Rattus norvegicus
tttgtccctgacactcggagcctcg

SEQ ID NO: 473085 - DNA, 25 bp, Rattus norvegicus
cggctccgattcagcgacgctctag

SEQ ID NO: 473086 - DNA, 25 bp, Rattus norvegicus
agcgacgctctagccggacagctca

SEQ ID NO: 473087 - DNA, 25 bp, Rattus norvegicus
tgaccttttggtctctgcgagagga

SEQ ID NO: 473088 - DNA, 25 bp, Rattus norvegicus
cacattcactaacccacgcggaagg

SEQ ID NO: 473089 - DNA, 25 bp, Rattus norvegicus
aatcgtgcccgtgacgccctctggt

SEQ ID NO: 473090 - DNA, 25 bp, Rattus norvegicus
gccgagcttggtgataagaactctc

SEQ ID NO: 473091 - DNA, 25 bp, Rattus norvegicus
gagcgagcgaacgagactttagtcc

SEQ ID NO: 473092 - DNA, 25 bp, Rattus norvegicus
cgagactttagtccggtttccatgt

SEQ ID NO: 473093 - DNA, 25 bp, Rattus norvegicus
cggtttccatgtcaacgattcagtc

SEQ ID NO: 473094 - DNA, 25 bp, Rattus norvegicus
tgtcaacgattcagtccatatttgc

SEQ ID NO: 473095 - DNA, 25 bp, Rattus norvegicus
tccatatttgccatcaggctgcctg

SEQ ID NO: 473096 - DNA, 25 bp, Rattus norvegicus
agagaagagcgctgtcctagcccta

SEQ ID NO: 473097 - DNA, 25 bp, Rattus norvegicus
agcgctgtcctagccctataatctg

SEQ ID NO: 473098 - DNA, 25 bp, Rattus norvegicus
agccctataatctgcgccgggattc

SEQ ID NO: 473099 - DNA, 25 bp, Rattus norvegicus
ctgcgccgggattcctgagctgcct

SEQ ID NO: 473100 - DNA, 25 bp, Rattus norvegicus
ggatccagtccgcttttgccgactg

SEQ ID NO: 473101 - DNA, 25 bp, Rattus norvegicus
gagttccggcgcccagaaacgacac

SEQ ID NO: 473102 - DNA, 25 bp, Rattus norvegicus
aagaactctcctgtgagagcgagcg

SEQ ID NO: 473103 - DNA, 25 bp, Rattus norvegicus
cgactgccgtcctgccgagcttggt

SEQ ID NO: 473104 - DNA, 25 bp, Rattus norvegicus
gcgctccactccgggtttttcaggc

SEQ ID NO: 473105 - DNA, 25 bp, Rattus norvegicus
tcctcctttgtgaggggaagggagc

SEQ ID NO: 473106 - DNA, 25 bp, Rattus norvegicus
gagcgagtccattccacggcctgcg

SEQ ID NO: 473107 - DNA, 25 bp, Rattus norvegicus
aagggagcgagtccattccacggcc

SEQ ID NO: 473108 - DNA, 25 bp, Rattus norvegicus
cgaaagaggctgagggcttgccgcc

SEQ ID NO: 473109 - DNA, 25 bp, Rattus norvegicus
acaggccaggatgggaacgccgcga

SEQ ID NO: 473110 - DNA, 25 bp, Rattus norvegicus
cgctcccttcagatcggccaggagg

SEQ ID NO: 473111 - DNA, 25 bp, Rattus norvegicus
tttttcaggcggccgcgacggcgct

SEQ ID NO: 473112 - DNA, 25 bp, Rattus norvegicus
ggccaattttgcaggcgcgggtaaa

SEQ ID NO: 473113 - DNA, 25 bp, Rattus norvegicus
cgctgggtaaaatggcagtgctgag

SEQ ID NO: 473114 - DNA, 25 bp, Rattus norvegicus
tcgggctcaggccaattttgcaggc

SEQ ID NO: 473115 - DNA, 25 bp, Rattus norvegicus
cgcggtttcgggctcaggccaattt

SEQ ID NO: 473116 - DNA, 25 bp, Rattus norvegicus
ttgcaggcgcgggtaaagttcacgc

SEQ ID NO: 473117 - DNA, 25 bp, Rattus norvegicus
agtgctgagcctcgtgtcggagtga

SEQ ID NO: 473118 - DNA, 25 bp, Rattus norvegicus
catggcggacaacaaagccctggcc

SEQ ID NO: 473119 - DNA, 25 bp, Rattus norvegicus
ccgccctcggagctgaagaaagccg

SEQ ID NO: 473120 - DNA, 25 bp, Rattus norvegicus
tgaagaaagccgagcagcaacagcg

SEQ ID NO: 473121 - DNA, 25 bp, Rattus norvegicus
gtcgtcttcgtccttcgctccgcag

SEQ ID NO: 473122 - DNA, 25 bp, Rattus norvegicus
agcgcctctgcctcctcgtcgtctt

SEQ ID NO: 473123 - DNA, 25 bp, Rattus norvegicus
aaagccctggcctggcagcgctgca

SEQ ID NO: 473124 - DNA, 25 bp, Rattus norvegicus
aactgctcacgtcgcccagctcggc

SEQ ID NO: 473125 - DNA, 25 bp, Rattus norvegicus
cgtcttccaccaacaacatggcgga

SEQ ID NO: 473126 - DNA, 25 bp, Rattus norvegicus
cagcctacggcttcgggcaacccta

SEQ ID NO: 473127 - DNA, 25 bp, Rattus norvegicus
tgaacaataacctcacggagccgcc

SEQ ID NO: 473128 - DNA, 25 bp, Rattus norvegicus
cgccctgaacaataacctcacggag

SEQ ID NO: 473129 - DNA, 25 bp, Rattus norvegicus
cctgaagaactcgaacgggaacgcg

SEQ ID NO: 473130 - DNA, 25 bp, Rattus norvegicus
cggagccggacctgaagaactcgaa

SEQ ID NO: 473131 - DNA, 25 bp, Rattus norvegicus
agcagaactcgcacgaccacggctt

SEQ ID NO: 473132 - DNA, 25 bp, Rattus norvegicus
tgaaattaggcggaggctgtaaaga

SEQ ID NO: 473133 - DNA, 25 bp, Rattus norvegicus
caacgagaagtcagaggctgtttac

SEQ ID NO: 473134 - DNA, 25 bp, Rattus norvegicus
gcagcgcccgcgcacaaactgatgg

SEQ ID NO: 473135 - DNA, 25 bp, Rattus norvegicus
ggcaaactcctcaggtgtcaccacg

SEQ ID NO: 473136 - DNA, 25 bp, Rattus norvegicus
gccctagccggggtcaacatggccg

SEQ ID NO: 473137 - DNA, 25 bp, Rattus norvegicus
agcctcggcccacaacgagaagtca

SEQ ID NO: 473138 - DNA, 25 bp, Rattus norvegicus
gaaactgtcaaacggaggccgagtg

SEQ ID NO: 473139 - DNA, 25 bp, Rattus norvegicus
tgatggcgagcgaagaggcaaactc

SEQ ID NO: 473140 - DNA, 25 bp, Rattus norvegicus
gctcccttggggtgagggtcactac

SEQ ID NO: 473141 - DNA, 25 bp, Rattus norvegicus
ttgtgtccgaaaagagcaggctgga

SEQ ID NO: 473142 - DNA, 25 bp, Rattus norvegicus
ccagtaccgcggaacttaggagaag

SEQ ID NO: 473143 - DNA, 25 bp, Rattus norvegicus
acttaggagaaggaggccgctcgct

SEQ ID NO: 473144 - DNA, 25 bp, Rattus norvegicus
cgccagctctggaactctggagttc

SEQ ID NO: 473145 - DNA, 25 bp, Rattus norvegicus
tcaccacgccgggaaggtgcgacgc

SEQ ID NO: 473146 - DNA, 25 bp, Rattus norvegicus
cgccacctccgctgctctgcccggt

SEQ ID NO: 473147 - DNA, 25 bp, Rattus norvegicus
catctgcagatctaaggcggggcgc

SEQ ID NO: 473148 - DNA, 25 bp, Rattus norvegicus
cgctcacgctgctgctcatcctcag

SEQ ID NO: 473149 - DNA, 25 bp, Rattus norvegicus
tcccgggccgcaaccgcttctactg

SEQ ID NO: 473150 - DNA, 25 bp, Rattus norvegicus
cctcttcttcatcttcgagtgagtt

SEQ ID NO: 473151 - DNA, 25 bp, Rattus norvegicus
gcaaccgcttctactgcggcggccg

SEQ ID NO: 473152 - DNA, 25 bp, Rattus norvegicus
acggcggcgtcttcgcgctcacgct

SEQ ID NO: 473153 - DNA, 25 bp, Rattus norvegicus
cttcatcttcgagtgagttcgcgca

SEQ ID NO: 473154 - DNA, 25 bp, Rattus norvegicus
cgcccgggtcaccagattttgccgg

SEQ ID NO: 473155 - DNA, 25 bp, Rattus norvegicus
atccgtgtgccctcgggcctccgcc

SEQ ID NO: 473156 - DNA, 25 bp, Rattus norvegicus
cttccgcgcccgcatccgtgtgccc

SEQ ID NO: 473157 - DNA, 25 bp, Rattus norvegicus
catcttcgagtgagttcgcgcaccc

SEQ ID NO: 473158 - DNA, 25 bp, Rattus norvegicus
tcaccagattttgccgggtccttca

SEQ ID NO: 473159 - DNA, 25 bp, Rattus norvegicus
tggaggccgcatctgcagatctaag

SEQ ID NO: 473160 - DNA, 25 bp, Rattus norvegicus
gaacaggccgaacgctacgaagaca

SEQ ID NO: 473161 - DNA, 25 bp, Rattus norvegicus
cgagctcagaggtgtgtgcgacacc

SEQ ID NO: 473162 - DNA, 25 bp, Rattus norvegicus
accgagctcagaggtgtgtgcgaca

SEQ ID NO: 473163 - DNA, 25 bp, Rattus norvegicus
taccgggagaaggtagagaccgagc

SEQ ID NO: 473164 - DNA, 25 bp, Rattus norvegicus
gcatcgagcagaagagcaacgagga

SEQ ID NO: 473165 - DNA, 25 bp, Rattus norvegicus
agagtcctgtccagcatcgagcaga

SEQ ID NO: 473166 - DNA, 25 bp, Rattus norvegicus
cgaggagcggaacctgctctccgtg

SEQ ID NO: 473167 - DNA, 25 bp, Rattus norvegicus
ctctcctgcgaggagcggaacctgc

SEQ ID NO: 473168 - DNA, 25 bp, Rattus norvegicus
aaaagggtgaggagctctcctgcga

SEQ ID NO: 473169 - DNA, 25 bp, Rattus norvegicus
ttcatgaagagtgccgtggaaaagg

SEQ ID NO: 473170 - DNA, 25 bp, Rattus norvegicus
cagctttcatgaagagtgccgtgga

SEQ ID NO: 473171 - DNA, 25 bp, Rattus norvegicus
gacatggcagctttcatgaagagtg

SEQ ID NO: 473172 - DNA, 25 bp, Rattus norvegicus
cgctacgaagacatggcagctttca

SEQ ID NO: 473173 - DNA, 25 bp, Rattus norvegicus
ggccgaacgctacgaagacatggca

SEQ ID NO: 473174 - DNA, 25 bp, Rattus norvegicus
tttcactcagacaagttgccacccg

SEQ ID NO: 473175 - DNA, 25 bp, Rattus norvegicus
gtgtctagaccaggcccgcggctga

SEQ ID NO: 473176 - DNA, 25 bp, Rattus norvegicus
actcacctggcggtgtctagaccag

SEQ ID NO: 473177 - DNA, 25 bp, Rattus norvegicus
tctgagtcaccgactcacctggcgg

SEQ ID NO: 473178 - DNA, 25 bp, Rattus norvegicus
gcaaaacttagtctccgccctctga

SEQ ID NO: 473179 - DNA, 25 bp, Rattus norvegicus
gggccgcgcgcaaaacttagtctcc

SEQ ID NO: 473180 - DNA, 25 bp, Rattus norvegicus
atgggagagcgaaaggagaatcctc

SEQ ID NO: 473181 - DNA, 25 bp, Rattus norvegicus
gcggcgtcttcccggtttcactcag

SEQ ID NO: 473182 - DNA, 25 bp, Rattus norvegicus
aaagacgtagctgcgtcccggtcgc

SEQ ID NO: 473183 - DNA, 25 bp, Rattus norvegicus
ttcaggaaaagacgtagctgcgtcc

SEQ ID NO: 473184 - DNA, 25 bp, Rattus norvegicus
tctcccggcaggcagcaacacgcac

SEQ ID NO: 473185 - DNA, 25 bp, Rattus norvegicus
ccgcggctgaaatcgattgggaaga

SEQ ID NO: 473186 - DNA, 25 bp, Rattus norvegicus
ttgggaagaggccaagacgctcctc

SEQ ID NO: 473187 - DNA, 25 bp, Rattus norvegicus
aatcaggacgcactctccacagagc

SEQ ID NO: 473188 - DNA, 25 bp, Rattus norvegicus
gacggtcatccttcagtccatcctg

SEQ ID NO: 473189 - DNA, 25 bp, Rattus norvegicus
cggtgagagcccaacttctgcgcta

SEQ ID NO: 473190 - DNA, 25 bp, Rattus norvegicus
ggtgacttccgacccaaccatgtgg

SEQ ID NO: 473191 - DNA, 25 bp, Rattus norvegicus
agacgggaagctttgcctcatgtgg

SEQ ID NO: 473192 - DNA, 25 bp, Rattus norvegicus
gagctgcatcataaacaccttcatc

SEQ ID NO: 473193 - DNA, 25 bp, Rattus norvegicus
cgtgcgtggacaacgtgcattcatt

SEQ ID NO: 473194 - DNA, 25 bp, Rattus norvegicus
aagaatgctctgtggccgtgctgac

SEQ ID NO: 473195 - DNA, 25 bp, Rattus norvegicus
cgttgtgtcacggaagaatgctctg

SEQ ID NO: 473196 - DNA, 25 bp, Rattus norvegicus
ttgagacccaaaccaccatcgggta

SEQ ID NO: 473197 - DNA, 25 bp, Rattus norvegicus
gtgcattcatttacggcggcgtttt

SEQ ID NO: 473198 - DNA, 25 bp, Rattus norvegicus
agctatttcgcactcatcggcatga

SEQ ID NO: 473199 - DNA, 25 bp, Rattus norvegicus
gcggcgtttttattctcccttgaga

SEQ ID NO: 473200 - DNA, 25 bp, Rattus norvegicus
caccttcatcattggggcagccttg

SEQ ID NO: 473201 - DNA, 25 bp, Rattus norvegicus
ctcatgtggcgcataggtgacttcc

SEQ ID NO: 473202 - DNA, 25 bp, Rattus norvegicus
gcgagagttggacactgtcacctta

SEQ ID NO: 473203 - DNA, 25 bp, Rattus norvegicus
cagcggccacggtgattcgacttct

SEQ ID NO: 473204 - DNA, 25 bp, Rattus norvegicus
acggcaaggcagctgcgaccgagca

SEQ ID NO: 473205 - DNA, 25 bp, Rattus norvegicus
cgaccgagcactcccagcgagagtt

SEQ ID NO: 473206 - DNA, 25 bp, Rattus norvegicus
tgattcgacttctccctgggacctc

SEQ ID NO: 473207 - DNA, 25 bp, Rattus norvegicus
gccacggtgattcgacttctccctg

SEQ ID NO: 473208 - DNA, 25 bp, Rattus norvegicus
gggacctctgcgtaacctccaccta

SEQ ID NO: 473209 - DNA, 25 bp, Rattus norvegicus
tgacagcggccacggtgattcgact

SEQ ID NO: 473210 - DNA, 25 bp, Rattus norvegicus
tgccgcgatcactggtgacagcggc

SEQ ID NO: 473211 - DNA, 25 bp, Rattus norvegicus
tcgtgccgcgatcactggtgacagc

SEQ ID NO: 473212 - DNA, 25 bp, Rattus norvegicus
tcaccttagaaggtacgggatccca

SEQ ID NO: 473213 - DNA, 25 bp, Rattus norvegicus
ttggacactgtcaccttagaaggta

SEQ ID NO: 473214 - DNA, 25 bp, Rattus norvegicus
ctcccagcgagagttggacactgtc

SEQ ID NO: 473215 - DNA, 25 bp, Rattus norvegicus
acggtgattcgacttctccctggga

SEQ ID NO: 473216 - DNA, 25 bp, Rattus norvegicus
tagccaatcagcgatggtcattttg

SEQ ID NO: 473217 - DNA, 25 bp, Rattus norvegicus
gtgttttttaaagcgcacctcgaca

SEQ ID NO: 473218 - DNA, 25 bp, Rattus norvegicus
agcgatggtcattttgggcccgccc

SEQ ID NO: 473219 - DNA, 25 bp, Rattus norvegicus
cggagctacgcgaagatagccaatc

SEQ ID NO: 473220 - DNA, 25 bp, Rattus norvegicus
acgagggtcacggaagctttcctgc

SEQ ID NO: 473221 - DNA, 25 bp, Rattus norvegicus
aggacgcctcggcaggacacccgaa

SEQ ID NO: 473222 - DNA, 25 bp, Rattus norvegicus
gcccgatgcagttcaaggacgcctc

SEQ ID NO: 473223 - DNA, 25 bp, Rattus norvegicus
cgggacttagacgtccagcattctc

SEQ ID NO: 473224 - DNA, 25 bp, Rattus norvegicus
tgccagagcccggtggtccgcaaag

SEQ ID NO: 473225 - DNA, 25 bp, Rattus norvegicus
ttaagcccacgttctccggactgcg

SEQ ID NO: 473226 - DNA, 25 bp, Rattus norvegicus
aggccggtaactccgagcgcaagtc

SEQ ID NO: 473227 - DNA, 25 bp, Rattus norvegicus
ccgcgacctcaaacaacttagcttt

SEQ ID NO: 473228 - DNA, 25 bp, Rattus norvegicus
tctgccaatcacagggaccggccgg

SEQ ID NO: 473229 - DNA, 25 bp, Rattus norvegicus
gggacccagcctagcccgatgcagt

SEQ ID NO: 473230 - DNA, 25 bp, Rattus norvegicus
gctgtggtcacgcagccgcatttct

SEQ ID NO: 473231 - DNA, 25 bp, Rattus norvegicus
cagtccttcgttagctgggtccagg

SEQ ID NO: 473232 - DNA, 25 bp, Rattus norvegicus
gcgcaggaactcactcatgcccagg

SEQ ID NO: 473233 - DNA, 25 bp, Rattus norvegicus
catgcccaggcagtacgtagttttc

SEQ ID NO: 473234 - DNA, 25 bp, Rattus norvegicus
ccgccatggttggataagcagccca

SEQ ID NO: 473235 - DNA, 25 bp, Rattus norvegicus
tacccggcaaggaagggaaatgctc

SEQ ID NO: 473236 - DNA, 25 bp, Rattus norvegicus
ggttagcttccaggtactccatgca

SEQ ID NO: 473237 - DNA, 25 bp, Rattus norvegicus
gattccgccggaacttgcctggaga

SEQ ID NO: 473238 - DNA, 25 bp, Rattus norvegicus
gggaaatgctccgacttccggattc

SEQ ID NO: 473239 - DNA, 25 bp, Rattus norvegicus
cagtcgaagagaaagtagtggcctc

SEQ ID NO: 473240 - DNA, 25 bp, Rattus norvegicus
cggcacattcataaggcagtccttc

SEQ ID NO: 473241 - DNA, 25 bp, Rattus norvegicus
cgcgcagccagtctaggttagcttc

SEQ ID NO: 473242 - DNA, 25 bp, Rattus norvegicus
ccatgcagtagagcaggccaccgtt

SEQ ID NO: 473243 - DNA, 25 bp, Rattus norvegicus
cccgcctacaggacagcggcatagg

SEQ ID NO: 473244 - DNA, 25 bp, Rattus norvegicus
tttggtgaacgtggagtctgtgacc

SEQ ID NO: 473245 - DNA, 25 bp, Rattus norvegicus
gcgacccgagtacatgcgaagcagt

SEQ ID NO: 473246 - DNA, 25 bp, Rattus norvegicus
tcgccatcttggactgtcacatgac

SEQ ID NO: 473247 - DNA, 25 bp, Rattus norvegicus
gggatcccactcaccaccaggtaaa

SEQ ID NO: 473248 - DNA, 25 bp, Rattus norvegicus
cgagcgtaacacagccgggatccca

SEQ ID NO: 473249 - DNA, 25 bp, Rattus norvegicus
ctccgtagctgagccgagcgtaaca

SEQ ID NO: 473250 - DNA, 25 bp, Rattus norvegicus
ttggctaaagtagctccgtagctga

SEQ ID NO: 473251 - DNA, 25 bp, Rattus norvegicus
gccgcgctgttctcggaattggcta

SEQ ID NO: 473252 - DNA, 25 bp, Rattus norvegicus
agaacaccacgtctcggactctgga

SEQ ID NO: 473253 - DNA, 25 bp, Rattus norvegicus
tggaaacacagaaaacctccgccgc

SEQ ID NO: 473254 - DNA, 25 bp, Rattus norvegicus
ccgatgccggtagtggaaacacaga

SEQ ID NO: 473255 - DNA, 25 bp, Rattus norvegicus
ctcaccgagacgatgcagcagcagg

SEQ ID NO: 473256 - DNA, 25 bp, Rattus norvegicus
cgaagcagtcgctgagcttgcgcca

SEQ ID NO: 473257 - DNA, 25 bp, Rattus norvegicus
tcacatgactgctgggcgtcaactc

SEQ ID NO: 473258 - DNA, 25 bp, Rattus norvegicus
gcctgttgatttgctgctcgggtta

SEQ ID NO: 473259 - DNA, 25 bp, Rattus norvegicus
gcgccacagcttccggtctgcccac

SEQ ID NO: 473260 - DNA, 25 bp, Rattus norvegicus
cttctctgtggacggccgagacctc

SEQ ID NO: 473261 - DNA, 25 bp, Rattus norvegicus
tgccgcagcccttctctgtggacgg

SEQ ID NO: 473262 - DNA, 25 bp, Rattus norvegicus
ggtaaacgacgtggcccgtgccgca

SEQ ID NO: 473263 - DNA, 25 bp, Rattus norvegicus
acggcatgctgctggccatggcgca

SEQ ID NO: 473264 - DNA, 25 bp, Rattus norvegicus
aggagcgcttcgacggcatgctgct

SEQ ID NO: 473265 - DNA, 25 bp, Rattus norvegicus
gaaccgtaccgagcgcgggcatcgc

SEQ ID NO: 473266 - DNA, 25 bp, Rattus norvegicus
tgggcccgagcgaaccgtaccgagc

SEQ ID NO: 473267 - DNA, 25 bp, Rattus norvegicus
tttccggctccgctgcggaaggcta

SEQ ID NO: 473268 - DNA, 25 bp, Rattus norvegicus
cacggcttgcccgtgcgtgtttccg

SEQ ID NO: 473269 - DNA, 25 bp, Rattus norvegicus
tccgggagtttaatgggcaccgatg

SEQ ID NO: 473270 - DNA, 25 bp, Rattus norvegicus
tgctgctcgggttagccaatgaacg

SEQ ID NO: 473271 - DNA, 25 bp, Rattus norvegicus
ttggggccgcgcctgttgatttgct

SEQ ID NO: 473272 - DNA, 25 bp, Rattus norvegicus
accgcgtccatgcattgccgtcggg

SEQ ID NO: 473273 - DNA, 25 bp, Rattus norvegicus
gcaggaaccgcgtccatgcattgcc

SEQ ID NO: 473274 - DNA, 25 bp, Rattus norvegicus
ctcagccgccctcctctgcaggcag

SEQ ID NO: 473275 - DNA, 25 bp, Rattus norvegicus
aagcgccgccttgtacctggccgag

SEQ ID NO: 473276 - DNA, 25 bp, Rattus norvegicus
gggacacacttcctggctccgcgaa

SEQ ID NO: 473277 - DNA, 25 bp, Rattus norvegicus
tcgcaggtaagctcgcggtagcgcc

SEQ ID NO: 473278 - DNA, 25 bp, Rattus norvegicus
tcacctgggtcgcaggtaagctcgc

SEQ ID NO: 473279 - DNA, 25 bp, Rattus norvegicus
tctgcactcacctgggtcgcaggta

SEQ ID NO: 473280 - DNA, 25 bp, Rattus norvegicus
ggtgagccgcctccgctcagtcctt

SEQ ID NO: 473281 - DNA, 25 bp, Rattus norvegicus
cggacttacctgcccagccaggtga

SEQ ID NO: 473282 - DNA, 25 bp, Rattus norvegicus
cgacgctattccaagaaccgtaccg

SEQ ID NO: 473283 - DNA, 25 bp, Rattus norvegicus
cgagactcccgacgctattccaaga

SEQ ID NO: 473284 - DNA, 25 bp, Rattus norvegicus
cacctcgcttgccacagcgccgtgg

SEQ ID NO: 473285 - DNA, 25 bp, Rattus norvegicus
gtggcccgagactcccgacgctatt

SEQ ID NO: 473286 - DNA, 25 bp, Rattus norvegicus
cagggcagattcagggcacgcaagt

SEQ ID NO: 473287 - DNA, 25 bp, Rattus norvegicus
gtctcggattggctgtgctgccatc

SEQ ID NO: 473288 - DNA, 25 bp, Rattus norvegicus
cccgtgtgctataagatgctgggcg

SEQ ID NO: 473289 - DNA, 25 bp, Rattus norvegicus
ctctgcggccgcctctcactagtct

SEQ ID NO: 473290 - DNA, 25 bp, Rattus norvegicus
tcactagtctcgtgcccagcatctc

SEQ ID NO: 473291 - DNA, 25 bp, Rattus norvegicus
tcagtcaccgcagttacccgaagcg

SEQ ID NO: 473292 - DNA, 25 bp, Rattus norvegicus
ccgaagcggccgagacacccgtgga

SEQ ID NO: 473293 - DNA, 25 bp, Rattus norvegicus
tgctgcagctgcaccgagtcttttt

SEQ ID NO: 473294 - DNA, 25 bp, Rattus norvegicus
cagctgcaccgagtctttttggctg

SEQ ID NO: 473295 - DNA, 25 bp, Rattus norvegicus
gtggcccaggccgagctctacctgg

SEQ ID NO: 473296 - DNA, 25 bp, Rattus norvegicus
agctctacctggcagcgcacgggtc

SEQ ID NO: 473297 - DNA, 25 bp, Rattus norvegicus
cagcgcacgggtcgcgtctcaagaa

SEQ ID NO: 473298 - DNA, 25 bp, Rattus norvegicus
tcgcgtctcaagaagggtgcgcgcc

SEQ ID NO: 473299 - DNA, 25 bp, Rattus norvegicus
attcagggcacgcaagtctcggatt

SEQ ID NO: 473300 - DNA, 25 bp, Rattus norvegicus
gaccacccggtgcagtgtcacaagg

SEQ ID NO: 473301 - DNA, 25 bp, Rattus norvegicus
cagtgctgggccttggccggaaacc

SEQ ID NO: 473302 - DNA, 25 bp, Rattus norvegicus
gcgcgaacatcagtgctgggccttg

SEQ ID NO: 473303 - DNA, 25 bp, Rattus norvegicus
tatatctctgtagggcgcgaacatc

SEQ ID NO: 473304 - DNA, 25 bp, Rattus norvegicus
ggaacacatatatctctgtagggcg

SEQ ID NO: 473305 - DNA, 25 bp, Rattus norvegicus
caccgggtccggaaagtcgatgaag

SEQ ID NO: 473306 - DNA, 25 bp, Rattus norvegicus
agaatgcgcctctgttccaccgggt

SEQ ID NO: 473307 - DNA, 25 bp, Rattus norvegicus
agcgctccagaatgcgcctctgttc

SEQ ID NO: 473308 - DNA, 25 bp, Rattus norvegicus
gggcctccaggtagcgctccagaat

SEQ ID NO: 473309 - DNA, 25 bp, Rattus norvegicus
gctccgccgaagtgggcctccaggt

SEQ ID NO: 473310 - DNA, 25 bp, Rattus norvegicus
cgggctgcttctgctccgccgaagt

SEQ ID NO: 473311 - DNA, 25 bp, Rattus norvegicus
gcagtgtcacaaggcaagcataccg

SEQ ID NO: 473312 - DNA, 25 bp, Rattus norvegicus
tcgtggctcatgaggcacactgtgc

SEQ ID NO: 473313 - DNA, 25 bp, Rattus norvegicus
atctcctcggggctgcgtgtggcaa

SEQ ID NO: 473314 - DNA, 25 bp, Rattus norvegicus
ctgacacttataggccgcgggccgc

SEQ ID NO: 473315 - DNA, 25 bp, Rattus norvegicus
acgcccattggtcggcacagctgtc

SEQ ID NO: 473316 - DNA, 25 bp, Rattus norvegicus
tcggcacagctgtcacacagcagga

SEQ ID NO: 473317 - DNA, 25 bp, Rattus norvegicus
cacacagcaggatgcccgcctctca

SEQ ID NO: 473318 - DNA, 25 bp, Rattus norvegicus
accattggccaacggagttttgcaa

SEQ ID NO: 473319 - DNA, 25 bp, Rattus norvegicus
gccaacggagttttgcaagggaatc

SEQ ID NO: 473320 - DNA, 25 bp, Rattus norvegicus
aagggaatcgcttgctctctgattg

SEQ ID NO: 473321 - DNA, 25 bp, Rattus norvegicus
tgattggccgaaaggcacgcccctt

SEQ ID NO: 473322 - DNA, 25 bp, Rattus norvegicus
cgaattccctcttttgggcttgcga

SEQ ID NO: 473323 - DNA, 25 bp, Rattus norvegicus
tcttttgggcttgcgattggctcga

SEQ ID NO: 473324 - DNA, 25 bp, Rattus norvegicus
attggctcgagcctggcgggactta

SEQ ID NO: 473325 - DNA, 25 bp, Rattus norvegicus
ggacttagagggacagcgccctcca

SEQ ID NO: 473326 - DNA, 25 bp, Rattus norvegicus
acagatcttagagccaggcggatcg

SEQ ID NO: 473327 - DNA, 25 bp, Rattus norvegicus
gatcgggcccagctgacacttatag

SEQ ID NO: 473328 - DNA, 25 bp, Rattus norvegicus
tgtaaaggaagacgaagagcggctc

SEQ ID NO: 473329 - DNA, 25 bp, Rattus norvegicus
acacgacaaagaagctcaggaagcc

SEQ ID NO: 473330 - DNA, 25 bp, Rattus norvegicus
ccgagggacacgacaaagaagctca

SEQ ID NO: 473331 - DNA, 25 bp, Rattus norvegicus
cccgccgagggacacgacaaagaag

SEQ ID NO: 473332 - DNA, 25 bp, Rattus norvegicus
aaggctgcgatgaccccgtagacca

SEQ ID NO: 473333 - DNA, 25 bp, Rattus norvegicus
taaatcgtgaggtgaaggctgcgat

SEQ ID NO: 473334 - DNA, 25 bp, Rattus norvegicus
aagagcggctcgatgacccggatgt

SEQ ID NO: 473335 - DNA, 25 bp, Rattus norvegicus
gccatatagctgtaaaggaagacga

SEQ ID NO: 473336 - DNA, 25 bp, Rattus norvegicus
caggtaagccatatagctgtaaagg

SEQ ID NO: 473337 - DNA, 25 bp, Rattus norvegicus
gctcggctgacaggtaagccatata

SEQ ID NO: 473338 - DNA, 25 bp, Rattus norvegicus
tccagacaggtggaagagctcggct

SEQ ID NO: 473339 - DNA, 25 bp, Rattus norvegicus
tcacgccatgattccagacaggtgg

SEQ ID NO: 473340 - DNA, 25 bp, Rattus norvegicus
gactcacgccatgattccagacagg

SEQ ID NO: 473341 - DNA, 25 bp, Rattus norvegicus
cccggatgtgggaggtaaatcgtga

SEQ ID NO: 473342 - DNA, 25 bp, Rattus norvegicus
ccgagtcccgcggtagcggactgat

SEQ ID NO: 473343 - DNA, 25 bp, Rattus norvegicus
ctgatgcttcactgagcacggcgca

SEQ ID NO: 473344 - DNA, 25 bp, Rattus norvegicus
cctcggcgcaggctgaagacggctc

SEQ ID NO: 473345 - DNA, 25 bp, Rattus norvegicus
gctgaagacggctcgcagtgagcca

SEQ ID NO: 473346 - DNA, 25 bp, Rattus norvegicus
ctcgcagtgagccagcagcaacaca

SEQ ID NO: 473347 - DNA, 25 bp, Rattus norvegicus
cagctccttcggtcagctccagctc

SEQ ID NO: 473348 - DNA, 25 bp, Rattus norvegicus
cggtagcggactgatgcttcactga

SEQ ID NO: 473349 - DNA, 25 bp, Rattus norvegicus
gcgcagccatttataggcaccaacg

SEQ ID NO: 473350 - DNA, 25 bp, Rattus norvegicus
ttataggcaccaacgagtagccggc

SEQ ID NO: 473351 - DNA, 25 bp, Rattus norvegicus
caccaacgagtagccggcgcagcgg

SEQ ID NO: 473352 - DNA, 25 bp, Rattus norvegicus
cgcagcgggctagagagacctgtca

SEQ ID NO: 473353 - DNA, 25 bp, Rattus norvegicus
gctagagagacctgtcagcgcccgc

SEQ ID NO: 473354 - DNA, 25 bp, Rattus norvegicus
agcagcaacacagccctccttgaga

SEQ ID NO: 473355 - DNA, 25 bp, Rattus norvegicus
tgagcacggcgcagccatttatagg

SEQ ID NO: 473356 - DNA, 25 bp, Rattus norvegicus
tgctgttaagtggtcggtgggccct

SEQ ID NO: 473357 - DNA, 25 bp, Rattus norvegicus
tctgtccggccggtctgctgcgcat

SEQ ID NO: 473358 - DNA, 25 bp, Rattus norvegicus
ctgctgcgcattcccgggatgggcc

SEQ ID NO: 473359 - DNA, 25 bp, Rattus norvegicus
tatgcaaatgcatcgcgattgatta

SEQ ID NO: 473360 - DNA, 25 bp, Rattus norvegicus
catcgcgattgattatgcaaagccg

SEQ ID NO: 473361 - DNA, 25 bp, Rattus norvegicus
ttgattatgcaaagccgcgggtctc

SEQ ID NO: 473362 - DNA, 25 bp, Rattus norvegicus
aaagccgcgggtctctggccagctc

SEQ ID NO: 473363 - DNA, 25 bp, Rattus norvegicus
cgggtgaccctgtcacagcccgaga

SEQ ID NO: 473364 - DNA, 25 bp, Rattus norvegicus
gaccctgtcacagcccgagagctag

SEQ ID NO: 473365 - DNA, 25 bp, Rattus norvegicus
tcacagcccgagagctagtcactta

SEQ ID NO: 473366 - DNA, 25 bp, Rattus norvegicus
agctagtcacttacgccctggggaa

SEQ ID NO: 473367 - DNA, 25 bp, Rattus norvegicus
cctggggaaggaaggtgctgttaag

SEQ ID NO: 473368 - DNA, 25 bp, Rattus norvegicus
gtccttgctcagctcggtccagcgc

SEQ ID NO: 473369 - DNA, 25 bp, Rattus norvegicus
gagcgagggggcattaatatgcaaa

SEQ ID NO: 473370 - DNA, 25 bp, Rattus norvegicus
cactattcaggaaactgccgggcgc

SEQ ID NO: 473371 - DNA, 25 bp, Rattus norvegicus
gggcctgagcccgactacctcggga

SEQ ID NO: 473372 - DNA, 25 bp, Rattus norvegicus
cagatgccaagtcggggacaggctc

SEQ ID NO: 473373 - DNA, 25 bp, Rattus norvegicus
agacctgacaggtatgggtcgccgc

SEQ ID NO: 473374 - DNA, 25 bp, Rattus norvegicus
gctggtcctgggaagagacctgaca

SEQ ID NO: 473375 - DNA, 25 bp, Rattus norvegicus
ctcctgaagttgctccgctgctggt

SEQ ID NO: 473376 - DNA, 25 bp, Rattus norvegicus
gaccgacatgggctcctgaagttgc

SEQ ID NO: 473377 - DNA, 25 bp, Rattus norvegicus
gccatcgccgtagcgtagtcaccga

SEQ ID NO: 473378 - DNA, 25 bp, Rattus norvegicus
gggcccgcgctcactattcaggaaa

SEQ ID NO: 473379 - DNA, 25 bp, Rattus norvegicus
ccgctagcaggttagtgggcgccac

SEQ ID NO: 473380 - DNA, 25 bp, Rattus norvegicus
tccagagctgagtcccgcttttccg

SEQ ID NO: 473381 - DNA, 25 bp, Rattus norvegicus
gactcccatgatactccagagctga

SEQ ID NO: 473382 - DNA, 25 bp, Rattus norvegicus
gcacctctgcgatggcgaaagacta

SEQ ID NO: 473383 - DNA, 25 bp, Rattus norvegicus
cgcagtgcggaacttcttctgggtc

SEQ ID NO: 473384 - DNA, 25 bp, Rattus norvegicus
caggctgcccgagaggctgcggcgg

SEQ ID NO: 473385 - DNA, 25 bp, Rattus norvegicus
gctgcgcggaaacgtggcaccctct

SEQ ID NO: 473386 - DNA, 25 bp, Rattus norvegicus
tgcataaattatgccaggcgcgcct

SEQ ID NO: 473387 - DNA, 25 bp, Rattus norvegicus
ttgcataaattatgccaggcgcgcc

SEQ ID NO: 473388 - DNA, 25 bp, Rattus norvegicus
ttcttgcataaattatgccaggcgc

SEQ ID NO: 473389 - DNA, 25 bp, Rattus norvegicus
ccgaattcttgcataaattatgcca

SEQ ID NO: 473390 - DNA, 25 bp, Rattus norvegicus
ggccgaattcttgcataaattatgc

SEQ ID NO: 473391 - DNA, 25 bp, Rattus norvegicus
agcgcttgcagcaggctgcccgaga

SEQ ID NO: 473392 - DNA, 25 bp, Rattus norvegicus
cataaattatgccaggcgcgcctga

SEQ ID NO: 473393 - DNA, 25 bp, Rattus norvegicus
gtgctgcgcggaaacgtggcaccct

SEQ ID NO: 473394 - DNA, 25 bp, Rattus norvegicus
gcttcctgtcccagggcggcgcacc

SEQ ID NO: 473395 - DNA, 25 bp, Rattus norvegicus
ggcctcggcttcctgtcccagggcg

SEQ ID NO: 473396 - DNA, 25 bp, Rattus norvegicus
gtccgcacggcgctggacacccctc

SEQ ID NO: 473397 - DNA, 25 bp, Rattus norvegicus
cttgcagcaggctgcccgagaggct

SEQ ID NO: 473398 - DNA, 25 bp, Rattus norvegicus
gccgagacggacatgaagcagtacc

SEQ ID NO: 473399 - DNA, 25 bp, Rattus norvegicus
gagcttcctgaggtccacgtaaatg

SEQ ID NO: 473400 - DNA, 25 bp, Rattus norvegicus
ggtccacgtaaatgctccgccggcg

SEQ ID NO: 473401 - DNA, 25 bp, Rattus norvegicus
ggtccagaaggactaggctccaatt

SEQ ID NO: 473402 - DNA, 25 bp, Rattus norvegicus
ttcccggagggaagatcaaccaagc

SEQ ID NO: 473403 - DNA, 25 bp, Rattus norvegicus
ggaagggagttctccgctcctctta

SEQ ID NO: 473404 - DNA, 25 bp, Rattus norvegicus
gacttgcagcaacccttactctcgg

SEQ ID NO: 473405 - DNA, 25 bp, Rattus norvegicus
tcgctaggactagactgagagcttc

SEQ ID NO: 473406 - DNA, 25 bp, Rattus norvegicus
tcacgtgagtctcttccggtgtcgc

SEQ ID NO: 473407 - DNA, 25 bp, Rattus norvegicus
atgaagcagtaccacgggtccggtg

SEQ ID NO: 473408 - DNA, 25 bp, Rattus norvegicus
ccctactgcgtggtatggacaccca

SEQ ID NO: 473409 - DNA, 25 bp, Rattus norvegicus
gtatggacacccatcccggtgctca

SEQ ID NO: 473410 - DNA, 25 bp, Rattus norvegicus
agcgtcctccagtgtgccattctag

SEQ ID NO: 473411 - DNA, 25 bp, Rattus norvegicus
ccctcctcggatggcggaagtagag

SEQ ID NO: 473412 - DNA, 25 bp, Rattus norvegicus
ctctgggcccgcagttgagcttgca

SEQ ID NO: 473413 - DNA, 25 bp, Rattus norvegicus
gcgtcgcatccgcagtcaacagaga

SEQ ID NO: 473414 - DNA, 25 bp, Rattus norvegicus
agttgagcttgcagggcccgcagct

SEQ ID NO: 473415 - DNA, 25 bp, Rattus norvegicus
cggttaggagtatggatttgtgccc

SEQ ID NO: 473416 - DNA, 25 bp, Rattus norvegicus
cccgaggcaccgaagcagaagttcc

SEQ ID NO: 473417 - DNA, 25 bp, Rattus norvegicus
ggcaccgaagcagaagttccacatg

SEQ ID NO: 473418 - DNA, 25 bp, Rattus norvegicus
agttccacatgattcctgctgagtc

SEQ ID NO: 473419 - DNA, 25 bp, Rattus norvegicus
ccacatgattcctgctgagtcgaga

SEQ ID NO: 473420 - DNA, 25 bp, Rattus norvegicus
ctgagtcgagaatcctaaaaagagg

SEQ ID NO: 473421 - DNA, 25 bp, Rattus norvegicus
tccgcagtcaacagagatgctcgcc

SEQ ID NO: 473422 - DNA, 25 bp, Rattus norvegicus
gagatgctcgccgttggaccataaa

SEQ ID NO: 473423 - DNA, 25 bp, Rattus norvegicus
cgccgttggaccataaattcttatc

SEQ ID NO: 473424 - DNA, 25 bp, Rattus norvegicus
ataaattcttatcccagctcgacca

SEQ ID NO: 473425 - DNA, 25 bp, Rattus norvegicus
tcctgctgagtcgagaatcctaaaa

SEQ ID NO: 473426 - DNA, 25 bp, Rattus norvegicus
gccgcgtgctctggagctgagcaca

SEQ ID NO: 473427 - DNA, 25 bp, Rattus norvegicus
cgggtccaggctcgcgggtcaacac

SEQ ID NO: 473428 - DNA, 25 bp, Rattus norvegicus
agactcacccgcgttgtagaaggag

SEQ ID NO: 473429 - DNA, 25 bp, Rattus norvegicus
cacgaggctgaaggtgtggatccag

SEQ ID NO: 473430 - DNA, 25 bp, Rattus norvegicus
gccagagggtcctgccagcagctgc

SEQ ID NO: 473431 - DNA, 25 bp, Rattus norvegicus
agaccacactgagaggccggctccg

SEQ ID NO: 473432 - DNA, 25 bp, Rattus norvegicus
caacacgtagaccacactgagaggc

SEQ ID NO: 473433 - DNA, 25 bp, Rattus norvegicus
ggctcgcgggtcaacacgtagacca

SEQ ID NO: 473434 - DNA, 25 bp, Rattus norvegicus
tgctctggagctgagcacaggcctc

SEQ ID NO: 473435 - DNA, 25 bp, Rattus norvegicus
ctagcgccagcgtcgcaaagggcag

SEQ ID NO: 473436 - DNA, 25 bp, Rattus norvegicus
gtcgcctagcgccagcgtcgcaaag

SEQ ID NO: 473437 - DNA, 25 bp, Rattus norvegicus
gagtctagcgcagcggtgtcgccta

SEQ ID NO: 473438 - DNA, 25 bp, Rattus norvegicus
acccgcgttgtagaaggagtctagc

SEQ ID NO: 473439 - DNA, 25 bp, Rattus norvegicus
tgagcacaggcctcgcgcaggcatc

SEQ ID NO: 473440 - DNA, 25 bp, Rattus norvegicus
ctgctgggcttcagacgtcaccaaa

SEQ ID NO: 473441 - DNA, 25 bp, Rattus norvegicus
cggcgcgaggcctcattactatgcc

SEQ ID NO: 473442 - DNA, 25 bp, Rattus norvegicus
ccacggtcactttttatgaatgggg

SEQ ID NO: 473443 - DNA, 25 bp, Rattus norvegicus
cgcggccacggtcactttttatgaa

SEQ ID NO: 473444 - DNA, 25 bp, Rattus norvegicus
cgtcaaggacagagagagccggctc

SEQ ID NO: 473445 - DNA, 25 bp, Rattus norvegicus
tacccggagtctgggaggacacagc

SEQ ID NO: 473446 - DNA, 25 bp, Rattus norvegicus
gccctgctgcgggtacccggagtct

SEQ ID NO: 473447 - DNA, 25 bp, Rattus norvegicus
acccggtcctgagccacgggtgagt

SEQ ID NO: 473448 - DNA, 25 bp, Rattus norvegicus
cagaacctgagtggaggctccccgc

SEQ ID NO: 473449 - DNA, 25 bp, Rattus norvegicus
ttcagacgtcaccaaaccggtggcc

SEQ ID NO: 473450 - DNA, 25 bp, Rattus norvegicus
ggcctcattactatgccgcgcagca

SEQ ID NO: 473451 - DNA, 25 bp, Rattus norvegicus
gtccattggtctgctgggcttcaga

SEQ ID NO: 473452 - DNA, 25 bp, Rattus norvegicus
gctccagcgcgcagcgtccattggt

SEQ ID NO: 473453 - DNA, 25 bp, Rattus norvegicus
ggggtccgcacacaccttcctctgc

SEQ ID NO: 473454 - DNA, 25 bp, Rattus norvegicus
gggacttgttgctcacctgacttcg

SEQ ID NO: 473455 - DNA, 25 bp, Rattus norvegicus
acccgagcgacttccgcaatcggag

SEQ ID NO: 473456 - DNA, 25 bp, Rattus norvegicus
cgccacagagctgacagcccgattg

SEQ ID NO: 473457 - DNA, 25 bp, Rattus norvegicus
cggcagtcagagcagacacaggacg

SEQ ID NO: 473458 - DNA, 25 bp, Rattus norvegicus
ttgctcacctgacttcgcgcagtcg

SEQ ID NO: 473459 - DNA, 25 bp, Rattus norvegicus
gcgcagtcgccctcaacgacatgaa

SEQ ID NO: 473460 - DNA, 25 bp, Rattus norvegicus
tcaacgacatgaagggctgggcagc

SEQ ID NO: 473461 - DNA, 25 bp, Rattus norvegicus
ctttgcgggctgctacacagccgga

SEQ ID NO: 473462 - DNA, 25 bp, Rattus norvegicus
agacgtattcaaaggtagtgtcccg

SEQ ID NO: 473463 - DNA, 25 bp, Rattus norvegicus
ggtctgaatccaatgccaattaaat

SEQ ID NO: 473464 - DNA, 25 bp, Rattus norvegicus
tggtcttccacctatcccattggtc

SEQ ID NO: 473465 - DNA, 25 bp, Rattus norvegicus
aaccgttctgattggctccctgtcc

SEQ ID NO: 473466 - DNA, 25 bp, Rattus norvegicus
gcctgagtccgccattacacgattt

SEQ ID NO: 473467 - DNA, 25 bp, Rattus norvegicus
ccctaagagcggcagtcagagcaga

SEQ ID NO: 473468 - DNA, 25 bp, Rattus norvegicus
ctcggcgcaccatggcaaccgctcc

SEQ ID NO: 473469 - DNA, 25 bp, Rattus norvegicus
aggcggtcaccattgggcttgactg

SEQ ID NO: 473470 - DNA, 25 bp, Rattus norvegicus
cccaaaggaccaggcggtcaccatt

SEQ ID NO: 473471 - DNA, 25 bp, Rattus norvegicus
cttgactggacctcgaggagggaaa

SEQ ID NO: 473472 - DNA, 25 bp, Rattus norvegicus
cctctcctcccacaggtggtggcgc

SEQ ID NO: 473473 - DNA, 25 bp, Rattus norvegicus
gcccattagtatgcggccgcgctcg

SEQ ID NO: 473474 - DNA, 25 bp, Rattus norvegicus
accattgggcttgactggacctcga

SEQ ID NO: 473475 - DNA, 25 bp, Rattus norvegicus
cccatggccgcccattagtatgcgg

SEQ ID NO: 473476 - DNA, 25 bp, Rattus norvegicus
cgggaccaaggactcaggatctgag

SEQ ID NO: 473477 - DNA, 25 bp, Rattus norvegicus
tcccgggaccaaggactcaggatct

SEQ ID NO: 473478 - DNA, 25 bp, Rattus norvegicus
atagcgtcccgggaccaaggactca

SEQ ID NO: 473479 - DNA, 25 bp, Rattus norvegicus
gatgaagcaatagcgtcccgggacc

SEQ ID NO: 473480 - DNA, 25 bp, Rattus norvegicus
cctcgaggagggaaagatgaagcaa

SEQ ID NO: 473481 - DNA, 25 bp, Rattus norvegicus
cacgggcacgcacgctcggccctcc

SEQ ID NO: 473482 - DNA, 25 bp, Rattus norvegicus
gcaccaccggatgcaggttcacacg

SEQ ID NO: 473483 - DNA, 25 bp, Rattus norvegicus
gttcacacgcccgttgtcccagtga

SEQ ID NO: 473484 - DNA, 25 bp, Rattus norvegicus
cgtctcccttggcaaggactggtgg

SEQ ID NO: 473485 - DNA, 25 bp, Rattus norvegicus
ggtccttcatgatgtcaatcagctg

SEQ ID NO: 473486 - DNA, 25 bp, Rattus norvegicus
gccgcagtctagatgcacaccactg

SEQ ID NO: 473487 - DNA, 25 bp, Rattus norvegicus
cccttggcaaggactggtggacgcc

SEQ ID NO: 473488 - DNA, 25 bp, Rattus norvegicus
cacgcccgttgtcccagtgacggag

SEQ ID NO: 473489 - DNA, 25 bp, Rattus norvegicus
atgcaggttcacacgcccgttgtcc

SEQ ID NO: 473490 - DNA, 25 bp, Rattus norvegicus
tgtcaatcagctgcaccaccggatg

SEQ ID NO: 473491 - DNA, 25 bp, Rattus norvegicus
tgtcaggtccttcatgatgtcaatc

SEQ ID NO: 473492 - DNA, 25 bp, Rattus norvegicus
gacagccgtgtcaggtccttcatga

SEQ ID NO: 473493 - DNA, 25 bp, Rattus norvegicus
tgcaggtcctgggacagccgtgtca

SEQ ID NO: 473494 - DNA, 25 bp, Rattus norvegicus
cacaccactgtgctgcaggtcctgg

SEQ ID NO: 473495 - DNA, 25 bp, Rattus norvegicus
tcccagtgacggagggagttgttgt

SEQ ID NO: 473496 - DNA, 25 bp, Rattus norvegicus
cctccagccgagaagaagtccttcg

SEQ ID NO: 473497 - DNA, 25 bp, Rattus norvegicus
ctaatagcgcctgacacagccggtg

SEQ ID NO: 473498 - DNA, 25 bp, Rattus norvegicus
ggtcttgagagagaaccgcctcgtc

SEQ ID NO: 473499 - DNA, 25 bp, Rattus norvegicus
gaagaagtccttcgacgcctcagct

SEQ ID NO: 473500 - DNA, 25 bp, Rattus norvegicus
ttcgacgcctcagctcgagcaggag

SEQ ID NO: 473501 - DNA, 25 bp, Rattus norvegicus
cggccgaaggaatccgctcccgagt

SEQ ID NO: 473502 - DNA, 25 bp, Rattus norvegicus
aggccgcagggcttctgactccggc

SEQ ID NO: 473503 - DNA, 25 bp, Rattus norvegicus
tgcaggaaattccagaagctctcca

SEQ ID NO: 473504 - DNA, 25 bp, Rattus norvegicus
aagctctccatcatccggcactgtg

SEQ ID NO: 473505 - DNA, 25 bp, Rattus norvegicus
ccgaaggagagccacatgccggccg

SEQ ID NO: 473506 - DNA, 25 bp, Rattus norvegicus
cgagcggcgggattactaatagcgc

SEQ ID NO: 473507 - DNA, 25 bp, Rattus norvegicus
tcgcgctctccagctgcaggaaatt

SEQ ID NO: 473508 - DNA, 25 bp, Rattus norvegicus
ctgacacagccggtggctccaaggc

SEQ ID NO: 473509 - DNA, 25 bp, Rattus norvegicus
gagacacccggtcggactcgcttgc

SEQ ID NO: 473510 - DNA, 25 bp, Rattus norvegicus
cagcttctcggaatgcatgttgttc

SEQ ID NO: 473511 - DNA, 25 bp, Rattus norvegicus
ttctccattcccgagcggtctgtgg

SEQ ID NO: 473512 - DNA, 25 bp, Rattus norvegicus
tccaccgaagcggaattctccattc

SEQ ID NO: 473513 - DNA, 25 bp, Rattus norvegicus
gcagagttcgattctgtacaagggg

SEQ ID NO: 473514 - DNA, 25 bp, Rattus norvegicus
cacccggaaggacagcagcttctcg

SEQ ID NO: 473515 - DNA, 25 bp, Rattus norvegicus
gagaagtgcagagttcgattctgta

SEQ ID NO: 473516 - DNA, 25 bp, Rattus norvegicus
tgcatgttgttcagggtccgcaggt

SEQ ID NO: 473517 - DNA, 25 bp, Rattus norvegicus
ccgcaggtccggcagcttgagcagc

SEQ ID NO: 473518 - DNA, 25 bp, Rattus norvegicus
cagtttggtgaagcgggaagtctcc

SEQ ID NO: 473519 - DNA, 25 bp, Rattus norvegicus
tccgagggccggttcttcagcacca

SEQ ID NO: 473520 - DNA, 25 bp, Rattus norvegicus
cggttcttcagcaccagagcccgaa

SEQ ID NO: 473521 - DNA, 25 bp, Rattus norvegicus
agagcccgaagagcccgcagcagcg

SEQ ID NO: 473522 - DNA, 25 bp, Rattus norvegicus
tggagctgctccaccgaagcggaat

SEQ ID NO: 473523 - DNA, 25 bp, Rattus norvegicus
gtcactgggcgtccacccggaagga

SEQ ID NO: 473524 - DNA, 25 bp, Rattus norvegicus
tggcttgcgcctcggctcacattct

SEQ ID NO: 473525 - DNA, 25 bp, Rattus norvegicus
ccggtggaaacaaagaccgatcgca

SEQ ID NO: 473526 - DNA, 25 bp, Rattus norvegicus
attctccgccgctaactccgctgga

SEQ ID NO: 473527 - DNA, 25 bp, Rattus norvegicus
tcgctgacagcatggcttgcgcctc

SEQ ID NO: 473528 - DNA, 25 bp, Rattus norvegicus
cctgccgtcgctgacagcatggctt

SEQ ID NO: 473529 - DNA, 25 bp, Rattus norvegicus
gggcgtctatcttccgccggcgaca

SEQ ID NO: 473530 - DNA, 25 bp, Rattus norvegicus
tgccggctccgtgggtccgagccaa

SEQ ID NO: 473531 - DNA, 25 bp, Rattus norvegicus
acgattactccttcgctatctgcgc

SEQ ID NO: 473532 - DNA, 25 bp, Rattus norvegicus
ggagacgctacttaccggagtgctg

SEQ ID NO: 473533 - DNA, 25 bp, Rattus norvegicus
agctggggaggagacgctacttacc

SEQ ID NO: 473534 - DNA, 25 bp, Rattus norvegicus
gctgcacaaaagagcctggccggcc

SEQ ID NO: 473535 - DNA, 25 bp, Rattus norvegicus
cccacagtgcgctgcacaaaagagc

SEQ ID NO: 473536 - DNA, 25 bp, Rattus norvegicus
ctacttaccggagtgctgggctgcc

SEQ ID NO: 473537 - DNA, 25 bp, Rattus norvegicus
acaaagaccgatcgcaccgcgggca

SEQ ID NO: 473538 - DNA, 25 bp, Rattus norvegicus
acttcgtcgagtatcgcgagaaaca

SEQ ID NO: 473539 - DNA, 25 bp, Rattus norvegicus
gcgtgtcctggtgcttagcaacggc

SEQ ID NO: 473540 - DNA, 25 bp, Rattus norvegicus
ccgccaggttgtgcctgagactgtc

SEQ ID NO: 473541 - DNA, 25 bp, Rattus norvegicus
acgcgaaccagcgaacggcctctga

SEQ ID NO: 473542 - DNA, 25 bp, Rattus norvegicus
cgaatcagagccgtcgggaactcca

SEQ ID NO: 473543 - DNA, 25 bp, Rattus norvegicus
cgagcgtcatagtggcgtagtccaa

SEQ ID NO: 473544 - DNA, 25 bp, Rattus norvegicus
aagacgctcttttcaggcggcgccc

SEQ ID NO: 473545 - DNA, 25 bp, Rattus norvegicus
gccctccttcggctagcgggaagct

SEQ ID NO: 473546 - DNA, 25 bp, Rattus norvegicus
cgagaaacactcatgagcccgcggc

SEQ ID NO: 473547 - DNA, 25 bp, Rattus norvegicus
gcgggaagctccatggcaacccaaa

SEQ ID NO: 473548 - DNA, 25 bp, Rattus norvegicus
ggacggcgagtctcctgtttgtccc

SEQ ID NO: 473549 - DNA, 25 bp, Rattus norvegicus
ggcgtagtccaatccagaccgaatc

SEQ ID NO: 473550 - DNA, 25 bp, Rattus norvegicus
gagggcttccgctatcctactcgga

SEQ ID NO: 473551 - DNA, 25 bp, Rattus norvegicus
cgcgtgactgcgctttacataatcg

SEQ ID NO: 473552 - DNA, 25 bp, Rattus norvegicus
gcaccgagcacgagttgccggctgc

SEQ ID NO: 473553 - DNA, 25 bp, Rattus norvegicus
cggccgagggtcacttcctcttttg

SEQ ID NO: 473554 - DNA, 25 bp, Rattus norvegicus
agcgactttaatccgcgatcccaac

SEQ ID NO: 473555 - DNA, 25 bp, Rattus norvegicus
aatggctttttgttgtgctgccggc

SEQ ID NO: 473556 - DNA, 25 bp, Rattus norvegicus
tgtttgtttgcttcgcaccggggac

SEQ ID NO: 473557 - DNA, 25 bp, Rattus norvegicus
tgccggctgcgttcgatagaaaagg

SEQ ID NO: 473558 - DNA, 25 bp, Rattus norvegicus
aagttgggctccaactccggcgcga

SEQ ID NO: 473559 - DNA, 25 bp, Rattus norvegicus
cgcaccggcgcgaacaaagtgcgtc

SEQ ID NO: 473560 - DNA, 25 bp, Rattus norvegicus
gaacaaagtgcgtccctgcgggcgc

SEQ ID NO: 473561 - DNA, 25 bp, Rattus norvegicus
cgcagagttccgagcccgcagctag

SEQ ID NO: 473562 - DNA, 25 bp, Rattus norvegicus
ccggcagctcccaagtgcgcgagga

SEQ ID NO: 473563 - DNA, 25 bp, Rattus norvegicus
ccaagtgcgcgaggacgagaagaaa

SEQ ID NO: 473564 - DNA, 25 bp, Rattus norvegicus
ggcggcggcataatagcgactttaa

SEQ ID NO: 473565 - DNA, 25 bp, Rattus norvegicus
ggtcacttcctcttttgttaatggc

SEQ ID NO: 473566 - DNA, 25 bp, Rattus norvegicus
cgtgcgcatgcgcaccgcaatgggc

SEQ ID NO: 473567 - DNA, 25 bp, Rattus norvegicus
ctctcagctactgggcccggtcagt

SEQ ID NO: 473568 - DNA, 25 bp, Rattus norvegicus
cagcttccggtaggagcgccgtgaa

SEQ ID NO: 473569 - DNA, 25 bp, Rattus norvegicus
ggtctctgctccgtgtcatgtccta

SEQ ID NO: 473570 - DNA, 25 bp, Rattus norvegicus
gtgtcatgtcctacggtcccttaga

SEQ ID NO: 473571 - DNA, 25 bp, Rattus norvegicus
acggtcccttagacatgtatcggaa

SEQ ID NO: 473572 - DNA, 25 bp, Rattus norvegicus
acatgtatcggaatcccgggccgtc

SEQ ID NO: 473573 - DNA, 25 bp, Rattus norvegicus
cgtgacttcaacagcatcatccaga

SEQ ID NO: 473574 - DNA, 25 bp, Rattus norvegicus
atcatccagacatgcagtggcaaca

SEQ ID NO: 473575 - DNA, 25 bp, Rattus norvegicus
tgcagtggcaacatccagcggatca

SEQ ID NO: 473576 - DNA, 25 bp, Rattus norvegicus
ggtcagtgtgtacgcagtcacggcc

SEQ ID NO: 473577 - DNA, 25 bp, Rattus norvegicus
gagctgccttctcccgggtcggtca

SEQ ID NO: 473578 - DNA, 25 bp, Rattus norvegicus
gggcctcagctacggccaaacctga

SEQ ID NO: 473579 - DNA, 25 bp, Rattus norvegicus
cagcggatcagccaagccagtgagc

SEQ ID NO: 473580 - DNA, 25 bp, Rattus norvegicus
cgacctcccagtttcccggcgtgct

SEQ ID NO: 473581 - DNA, 25 bp, Rattus norvegicus
tcccaggcgagcgtcctggcgttac

SEQ ID NO: 473582 - DNA, 25 bp, Rattus norvegicus
agcgtcctggcgttacgcgtgcgca

SEQ ID NO: 473583 - DNA, 25 bp, Rattus norvegicus
ctggcgttacgcgtgcgcacgcacg

SEQ ID NO: 473584 - DNA, 25 bp, Rattus norvegicus
aggctgctgggaggccgcctcttcc

SEQ ID NO: 473585 - DNA, 25 bp, Rattus norvegicus
agtttcccggcgtgcttcaggcccg

SEQ ID NO: 473586 - DNA, 25 bp, Rattus norvegicus
cggcgtgcttcaggcccgccaaatg

SEQ ID NO: 473587 - DNA, 25 bp, Rattus norvegicus
tgcttcaggcccgccaaatgggagg

SEQ ID NO: 473588 - DNA, 25 bp, Rattus norvegicus
atggcggcagccgtgaactccggct

SEQ ID NO: 473589 - DNA, 25 bp, Rattus norvegicus
cagccgtgaactccggctccagcct

SEQ ID NO: 473590 - DNA, 25 bp, Rattus norvegicus
ccgctgttcgactgcccgacttggt

SEQ ID NO: 473591 - DNA, 25 bp, Rattus norvegicus
cgactgcccgacttggtgagtaata

SEQ ID NO: 473592 - DNA, 25 bp, Rattus norvegicus
actgcccgacttggtgagtaatacg

SEQ ID NO: 473593 - DNA, 25 bp, Rattus norvegicus
cacgcacgcgctgcgcacaggctgc

SEQ ID NO: 473594 - DNA, 25 bp, Rattus norvegicus
gcgcgtccacgagggcgtacactct

SEQ ID NO: 473595 - DNA, 25 bp, Rattus norvegicus
cacttttttgggtcatatccggctg

SEQ ID NO: 473596 - DNA, 25 bp, Rattus norvegicus
agcgtccgaggcgatgctttcctcg

SEQ ID NO: 473597 - DNA, 25 bp, Rattus norvegicus
gaggcgatgctttcctcgtgcgctg

SEQ ID NO: 473598 - DNA, 25 bp, Rattus norvegicus
cttggttttgcagcacatggcactt

SEQ ID NO: 473599 - DNA, 25 bp, Rattus norvegicus
accgacttcctgtgagcgtccgagg

SEQ ID NO: 473600 - DNA, 25 bp, Rattus norvegicus
tttgcagcacatggcacttttttgg

SEQ ID NO: 473601 - DNA, 25 bp, Rattus norvegicus
ttttgggtcatatccggctggaacc

SEQ ID NO: 473602 - DNA, 25 bp, Rattus norvegicus
ggtcatatccggctggaaccgcaca

SEQ ID NO: 473603 - DNA, 25 bp, Rattus norvegicus
tggaaccgcacaagcctcagcagat

SEQ ID NO: 473604 - DNA, 25 bp, Rattus norvegicus
gcacaagcctcagcagattcccatt

SEQ ID NO: 473605 - DNA, 25 bp, Rattus norvegicus
gcagattcccattgactccacggtc

SEQ ID NO: 473606 - DNA, 25 bp, Rattus norvegicus
gactccacggtctcgttcggcgcgt

SEQ ID NO: 473607 - DNA, 25 bp, Rattus norvegicus
attgactccacggtctcgttcggcg

SEQ ID NO: 473608 - DNA, 25 bp, Rattus norvegicus
tgctccggagtctacttcgagggtg

SEQ ID NO: 473609 - DNA, 25 bp, Rattus norvegicus
ggtctgctccggagtctacttcgag

SEQ ID NO: 473610 - DNA, 25 bp, Rattus norvegicus
cttccgcgcgtgctgcgggtctgct

SEQ ID NO: 473611 - DNA, 25 bp, Rattus norvegicus
ggactttgcgagcagcctggacccc

SEQ ID NO: 473612 - DNA, 25 bp, Rattus norvegicus
tcgcgaccatggagcctgtgccgct

SEQ ID NO: 473613 - DNA, 25 bp, Rattus norvegicus
actttagttgggtcgcgaccatgga

SEQ ID NO: 473614 - DNA, 25 bp, Rattus norvegicus
agccactttagttgggtcgcgacca

SEQ ID NO: 473615 - DNA, 25 bp, Rattus norvegicus
actggtctgagccactttagttggg

SEQ ID NO: 473616 - DNA, 25 bp, Rattus norvegicus
tgcggactggtctgagccactttag

SEQ ID NO: 473617 - DNA, 25 bp, Rattus norvegicus
cgcaaactgcggactggtctgagcc

SEQ ID NO: 473618 - DNA, 25 bp, Rattus norvegicus
gacagtcctccgcaaactgcggact

SEQ ID NO: 473619 - DNA, 25 bp, Rattus norvegicus
gtggcttccggacagtcctccgcaa

SEQ ID NO: 473620 - DNA, 25 bp, Rattus norvegicus
tcagagaacccggtggggctcctac

SEQ ID NO: 473621 - DNA, 25 bp, Rattus norvegicus
tccggagtctacttcgagggtgagc

SEQ ID NO: 473622 - DNA, 25 bp, Rattus norvegicus
cttcccgcgaagagccagctaatca

SEQ ID NO: 473623 - DNA, 25 bp, Rattus norvegicus
gggtcactctacgtactgatttctt

SEQ ID NO: 473624 - DNA, 25 bp, Rattus norvegicus
gatttcttctctgcctgcgacggtg

SEQ ID NO: 473625 - DNA, 25 bp, Rattus norvegicus
ctgaagctttcgaatccgcctggta

SEQ ID NO: 473626 - DNA, 25 bp, Rattus norvegicus
ccgcctggtagtgaacgacagagtc

SEQ ID NO: 473627 - DNA, 25 bp, Rattus norvegicus
gagtcagaatctgcacggcgctccc

SEQ ID NO: 473628 - DNA, 25 bp, Rattus norvegicus
aactctgtacctggcaaacgctgtc

SEQ ID NO: 473629 - DNA, 25 bp, Rattus norvegicus
catcctggtcgcagttttcctgaga

SEQ ID NO: 473630 - DNA, 25 bp, Rattus norvegicus
gtagctactttgcactggcgccaca

SEQ ID NO: 473631 - DNA, 25 bp, Rattus norvegicus
agcgcctgggacacatctaccttta

SEQ ID NO: 473632 - DNA, 25 bp, Rattus norvegicus
ttttccggtatcaaggccaagctta

SEQ ID NO: 473633 - DNA, 25 bp, Rattus norvegicus
ggccatctttactgagggcgaattc

SEQ ID NO: 473634 - DNA, 25 bp, Rattus norvegicus
ggcgagtgcgcaactccttacgtca

SEQ ID NO: 473635 - DNA, 25 bp, Rattus norvegicus
cttaagaagtgtttgccgctccggc

SEQ ID NO: 473636 - DNA, 25 bp, Rattus norvegicus
agatggggaagttccgcccagcagc

SEQ ID NO: 473637 - DNA, 25 bp, Rattus norvegicus
tcgttggccgttacctgtgggccgc

SEQ ID NO: 473638 - DNA, 25 bp, Rattus norvegicus
ttcctgccggactagccgggctgga

SEQ ID NO: 473639 - DNA, 25 bp, Rattus norvegicus
ccagtacgtgctcgttggccgttac

SEQ ID NO: 473640 - DNA, 25 bp, Rattus norvegicus
ggcggagtcgtggactcgctcctcc

SEQ ID NO: 473641 - DNA, 25 bp, Rattus norvegicus
gagggccatgcctctgtccgtgcac

SEQ ID NO: 473642 - DNA, 25 bp, Rattus norvegicus
ccaagtggccttagacgtggtcata

SEQ ID NO: 473643 - DNA, 25 bp, Rattus norvegicus
cgtggtcataggtctggtgagtacc

SEQ ID NO: 473644 - DNA, 25 bp, Rattus norvegicus
ggtgagtaccttgtctttcctgttg

SEQ ID NO: 473645 - DNA, 25 bp, Rattus norvegicus
tctttcctgttggacctggtcgccg

SEQ ID NO: 473646 - DNA, 25 bp, Rattus norvegicus
acctggtcgccgacctgtgggccgt

SEQ ID NO: 473647 - DNA, 25 bp, Rattus norvegicus
acctgtgggccgtcgtccagtacgt

SEQ ID NO: 473648 - DNA, 25 bp, Rattus norvegicus
aggttgcctggagggccatgcctct

SEQ ID NO: 473649 - DNA, 25 bp, Rattus norvegicus
cagatccgcggttgtgaggttgcct

SEQ ID NO: 473650 - DNA, 25 bp, Rattus norvegicus
acgaccggggaggaactcttcagct

SEQ ID NO: 473651 - DNA, 25 bp, Rattus norvegicus
ttctggggccgcctaacaatccaca

SEQ ID NO: 473652 - DNA, 25 bp, Rattus norvegicus
tgcgcatccctaggaaccggaagta

SEQ ID NO: 473653 - DNA, 25 bp, Rattus norvegicus
agcgtgacccggatgcgcatcccta

SEQ ID NO: 473654 - DNA, 25 bp, Rattus norvegicus
accgcggcgttagcgtgacccggat

SEQ ID NO: 473655 - DNA, 25 bp, Rattus norvegicus
ctggcaccaacagagtggcggaaac

SEQ ID NO: 473656 - DNA, 25 bp, Rattus norvegicus
atgggaccacttcggacccactctg

SEQ ID NO: 473657 - DNA, 25 bp, Rattus norvegicus
agacggctgcagatactccaaagca

SEQ ID NO: 473658 - DNA, 25 bp, Rattus norvegicus
aggaactcttcagctggggccctga

SEQ ID NO: 473659 - DNA, 25 bp, Rattus norvegicus
cccgagtatgcgtcaggtttctcgg

SEQ ID NO: 473660 - DNA, 25 bp, Rattus norvegicus
agcggaaaatgctcgagggtagatc

SEQ ID NO: 473661 - DNA, 25 bp, Rattus norvegicus
tccaaagcacaacatgggaccactt

SEQ ID NO: 473662 - DNA, 25 bp, Rattus norvegicus
ctggggccctgaaggctgcacccga

SEQ ID NO: 473663 - DNA, 25 bp, Rattus norvegicus
cggagactcaccagacggctgcaga

SEQ ID NO: 473664 - DNA, 25 bp, Rattus norvegicus
gtgtatcgcctacccaggtcctcga

SEQ ID NO: 473665 - DNA, 25 bp, Rattus norvegicus
atcttcgtcaaagcggaggagcctg

SEQ ID NO: 473666 - DNA, 25 bp, Rattus norvegicus
cagggacggctagtgtgaacatctt

SEQ ID NO: 473667 - DNA, 25 bp, Rattus norvegicus
atgctccggcggaaaaagccctgga

SEQ ID NO: 473668 - DNA, 25 bp, Rattus norvegicus
gtactggatgttctgctggatgctc

SEQ ID NO: 473669 - DNA, 25 bp, Rattus norvegicus
tttcaaacaccgcttgtactggatg

SEQ ID NO: 473670 - DNA, 25 bp, Rattus norvegicus
tgatacggacaatggagcagttctc

SEQ ID NO: 473671 - DNA, 25 bp, Rattus norvegicus
gcagcggttgcgattgatacggaca

SEQ ID NO: 473672 - DNA, 25 bp, Rattus norvegicus
acttcttgaagcgacactgctggca

SEQ ID NO: 473673 - DNA, 25 bp, Rattus norvegicus
catgccaacggagagacacttcttg

SEQ ID NO: 473674 - DNA, 25 bp, Rattus norvegicus
ccgtctctagacatgccaacggaga

SEQ ID NO: 473675 - DNA, 25 bp, Rattus norvegicus
ggacacgggccttaccgtctctaga

SEQ ID NO: 473676 - DNA, 25 bp, Rattus norvegicus
ggagcagttctcgtttttcaaacac

SEQ ID NO: 473677 - DNA, 25 bp, Rattus norvegicus
gaggagcctgtgtatcgcctaccca

SEQ ID NO: 473678 - DNA, 25 bp, Rattus norvegicus
tactccgggctcacctcactgtaga

SEQ ID NO: 473679 - DNA, 25 bp, Rattus norvegicus
agccctctcagggtctgggtctaca

SEQ ID NO: 473680 - DNA, 25 bp, Rattus norvegicus
ggtctgggtctacaggcccagccgc

SEQ ID NO: 473681 - DNA, 25 bp, Rattus norvegicus
gttccggggacctcagcagccacag

SEQ ID NO: 473682 - DNA, 25 bp, Rattus norvegicus
ccacagtggcggtcgcgtacgcact

SEQ ID NO: 473683 - DNA, 25 bp, Rattus norvegicus
agcgcggtcgcgctgaggccaccat

SEQ ID NO: 473684 - DNA, 25 bp, Rattus norvegicus
cctcactgtagaaggtcataaatgc

SEQ ID NO: 473685 - DNA, 25 bp, Rattus norvegicus
ataaatgcctcctctgtgctacctc

SEQ ID NO: 473686 - DNA, 25 bp, Rattus norvegicus
tccgccgccagaagcaccactctct

SEQ ID NO: 473687 - DNA, 25 bp, Rattus norvegicus
attttcccggctagccgccacgtga

SEQ ID NO: 473688 - DNA, 25 bp, Rattus norvegicus
gccacgtgaccgttctgcgcaagcg

SEQ ID NO: 473689 - DNA, 25 bp, Rattus norvegicus
gtgaccctacaagcccgccttcctg

SEQ ID NO: 473690 - DNA, 25 bp, Rattus norvegicus
tgcatcgcgcgataagcggctcgcc

SEQ ID NO: 473691 - DNA, 25 bp, Rattus norvegicus
ggtcataaatgcctcctctgtgcta

SEQ ID NO: 473692 - DNA, 25 bp, Rattus norvegicus
gccgtctagattggcggttccagcc

SEQ ID NO: 473693 - DNA, 25 bp, Rattus norvegicus
ctggctccatccgagaagctggtgg

SEQ ID NO: 473694 - DNA, 25 bp, Rattus norvegicus
ctctgcagtcggagagcatggattc

SEQ ID NO: 473695 - DNA, 25 bp, Rattus norvegicus
aatgtccacgactctctctgcagtc

SEQ ID NO: 473696 - DNA, 25 bp, Rattus norvegicus
cgggtcctcttccttgttgtgcctt

SEQ ID NO: 473697 - DNA, 25 bp, Rattus norvegicus
gtaggtggcggcacgacctaccgcc

SEQ ID NO: 473698 - DNA, 25 bp, Rattus norvegicus
aacccgaggcttcggctcggactcg

SEQ ID NO: 473699 - DNA, 25 bp, Rattus norvegicus
tggggtatgagggtcctgcaaaccc

SEQ ID NO: 473700 - DNA, 25 bp, Rattus norvegicus
cgaagataatggcaggctcggcgtt

SEQ ID NO: 473701 - DNA, 25 bp, Rattus norvegicus
cgagctgagcaacgccgaagataat

SEQ ID NO: 473702 - DNA, 25 bp, Rattus norvegicus
cgcaacgcgagctgagcaacgccga

SEQ ID NO: 473703 - DNA, 25 bp, Rattus norvegicus
ttagcgcgctaggagagaagcaacc

SEQ ID NO: 473704 - DNA, 25 bp, Rattus norvegicus
aaggctgaagaggatcggtacttcc

SEQ ID NO: 473705 - DNA, 25 bp, Rattus norvegicus
cgccctcgcagttagcgcgctagga

SEQ ID NO: 473706 - DNA, 25 bp, Rattus norvegicus
ccgggaaacaggcatctgattggct

SEQ ID NO: 473707 - DNA, 25 bp, Rattus norvegicus
aacaaccgggcgaagccgctctctt

SEQ ID NO: 473708 - DNA, 25 bp, Rattus norvegicus
ccgagaggtaagcaacaaccgggcg

SEQ ID NO: 473709 - DNA, 25 bp, Rattus norvegicus
caagggctacctgccgttcaccagg

SEQ ID NO: 473710 - DNA, 25 bp, Rattus norvegicus
tgccatggggagatcaagggctacc

SEQ ID NO: 473711 - DNA, 25 bp, Rattus norvegicus
tgatcgtagccgactccgagtgcca

SEQ ID NO: 473712 - DNA, 25 bp, Rattus norvegicus
tcctggcgcacaccatgatcgtagc

SEQ ID NO: 473713 - DNA, 25 bp, Rattus norvegicus
gtatcgccagttctcctcgttcgga

SEQ ID NO: 473714 - DNA, 25 bp, Rattus norvegicus
aaggagtgtccagcgcggtatcgcc

SEQ ID NO: 473715 - DNA, 25 bp, Rattus norvegicus
aggccggccacagttctccaagctg

SEQ ID NO: 473716 - DNA, 25 bp, Rattus norvegicus
gcactccgggccgtgaaaacctctg

SEQ ID NO: 473717 - DNA, 25 bp, Rattus norvegicus
ctggccactgcggacttccgaggca

SEQ ID NO: 473718 - DNA, 25 bp, Rattus norvegicus
ccacagacgagcttcgggttgaccc

SEQ ID NO: 473719 - DNA, 25 bp, Rattus norvegicus
attggctgctccgtgggacttttgt

SEQ ID NO: 473720 - DNA, 25 bp, Rattus norvegicus
tcgaacccatcacagaggagcgtgc

SEQ ID NO: 473721 - DNA, 25 bp, Rattus norvegicus
tgccaagcccgaggacggtaggtac

SEQ ID NO: 473722 - DNA, 25 bp, Rattus norvegicus
cggtaggtacatgaacggacgacta

SEQ ID NO: 473723 - DNA, 25 bp, Rattus norvegicus
tgaacggacgactagccacactgtg

SEQ ID NO: 473724 - DNA, 25 bp, Rattus norvegicus
gccacactgtgctaggcagacggga

SEQ ID NO: 473725 - DNA, 25 bp, Rattus norvegicus
ctaggcagacgggactgtgcatgcc

SEQ ID NO: 473726 - DNA, 25 bp, Rattus norvegicus
ggcccaaggcctgcccagttaacga

SEQ ID NO: 473727 - DNA, 25 bp, Rattus norvegicus
cctgcccagttaacgactgtgcttc

SEQ ID NO: 473728 - DNA, 25 bp, Rattus norvegicus
cgactgtgcttcgtgttacagagcc

SEQ ID NO: 473729 - DNA, 25 bp, Rattus norvegicus
gtgttacagagccaccagacctcgc

SEQ ID NO: 473730 - DNA, 25 bp, Rattus norvegicus
aggagcgtgcatccaggacgctgta

SEQ ID NO: 473731 - DNA, 25 bp, Rattus norvegicus
gcattgaactgcttcgcaaaatccg

SEQ ID NO: 473732 - DNA, 25 bp, Rattus norvegicus
cgggtatgtcggatgcctgccaagc

SEQ ID NO: 473733 - DNA, 25 bp, Rattus norvegicus
ccaggacgctgtaccgcattgaact

SEQ ID NO: 473734 - DNA, 25 bp, Rattus norvegicus
gcccagacctggcttttgcaaacta

SEQ ID NO: 473735 - DNA, 25 bp, Rattus norvegicus
tttacagcggcgcacgggtttggtc

SEQ ID NO: 473736 - DNA, 25 bp, Rattus norvegicus
acactgggcacatctcggccgcttt

SEQ ID NO: 473737 - DNA, 25 bp, Rattus norvegicus
ttgtgcaaacaaacctctccggagg

SEQ ID NO: 473738 - DNA, 25 bp, Rattus norvegicus
tcgcgcccgcaattttggcggcagc

SEQ ID NO: 473739 - DNA, 25 bp, Rattus norvegicus
tcgggtttgaatcgcccgctcgctc

SEQ ID NO: 473740 - DNA, 25 bp, Rattus norvegicus
tcggcgctgagcacgggtttacagc

SEQ ID NO: 473741 - DNA, 25 bp, Rattus norvegicus
tcgctgcttcttcacactgctcggg

SEQ ID NO: 473742 - DNA, 25 bp, Rattus norvegicus
taaagtttttatagcgctgggagcc

SEQ ID NO: 473743 - DNA, 25 bp, Rattus norvegicus
cgctcattggcccagttggggtcac

SEQ ID NO: 473744 - DNA, 25 bp, Rattus norvegicus
gtttaaactcacctcctctggagtg

SEQ ID NO: 473745 - DNA, 25 bp, Rattus norvegicus
gcgcctcggagtcggaggtaatata

SEQ ID NO: 473746 - DNA, 25 bp, Rattus norvegicus
acttctccaagctgcgcgacactgg

SEQ ID NO: 473747 - DNA, 25 bp, Rattus norvegicus
gctcgcgccacgtacctttcttttg

SEQ ID NO: 473748 - DNA, 25 bp, Rattus norvegicus
agagagtagagcctagcggcctgca

SEQ ID NO: 473749 - DNA, 25 bp, Rattus norvegicus
cagagaaggcgtttttctaccagtc

SEQ ID NO: 473750 - DNA, 25 bp, Rattus norvegicus
acctggcgctggaagaacacgtcac

SEQ ID NO: 473751 - DNA, 25 bp, Rattus norvegicus
aacacgtcaccactgcgcgcttgga

SEQ ID NO: 473752 - DNA, 25 bp, Rattus norvegicus
gcgccatgcgcctacggactcggga

SEQ ID NO: 473753 - DNA, 25 bp, Rattus norvegicus
ctacggactcgggagtgcgagttcc

SEQ ID NO: 473754 - DNA, 25 bp, Rattus norvegicus
tgcgagttccagagagttggctatt

SEQ ID NO: 473755 - DNA, 25 bp, Rattus norvegicus
gttggctattggtggccgctctcgt

SEQ ID NO: 473756 - DNA, 25 bp, Rattus norvegicus
ccgaggtcacgtgaggcgataatga

SEQ ID NO: 473757 - DNA, 25 bp, Rattus norvegicus
ataatgagccgggtagggtctcctg

SEQ ID NO: 473758 - DNA, 25 bp, Rattus norvegicus
ggtagggtctcctgcggcaatccct

SEQ ID NO: 473759 - DNA, 25 bp, Rattus norvegicus
caatccctgcgggttaggcgagaga

SEQ ID NO: 473760 - DNA, 25 bp, Rattus norvegicus
agcggcctgcaattcggtcggccca

SEQ ID NO: 473761 - DNA, 25 bp, Rattus norvegicus
ttttctaccagtcctgggcgactcc

SEQ ID NO: 473762 - DNA, 25 bp, Rattus norvegicus
ccaagcggctggtaagaagaaacct

SEQ ID NO: 473763 - DNA, 25 bp, Rattus norvegicus
acctgcaaactgctggttggacacc

SEQ ID NO: 473764 - DNA, 25 bp, Rattus norvegicus
ccgctgaatcgcaagctcgaacctg

SEQ ID NO: 473765 - DNA, 25 bp, Rattus norvegicus
caccctaaggtgtgcccgctgaatc

SEQ ID NO: 473766 - DNA, 25 bp, Rattus norvegicus
gctccgcgtacaagccactggaaca

SEQ ID NO: 473767 - DNA, 25 bp, Rattus norvegicus
gtcttcccacaacaagttgcccgtg

SEQ ID NO: 473768 - DNA, 25 bp, Rattus norvegicus
cgaaagttttgcttgtcttcccaca

SEQ ID NO: 473769 - DNA, 25 bp, Rattus norvegicus
gaagaaacctgtcctagctgcctcc

SEQ ID NO: 473770 - DNA, 25 bp, Rattus norvegicus
tcagcccgcggatagacacccagga

SEQ ID NO: 473771 - DNA, 25 bp, Rattus norvegicus
atcagctggggaccaaggaatcgca

SEQ ID NO: 473772 - DNA, 25 bp, Rattus norvegicus
ccttggcgcagccacctggagatag

SEQ ID NO: 473773 - DNA, 25 bp, Rattus norvegicus
gcgcacgttgaaccacttacagatg

SEQ ID NO: 473774 - DNA, 25 bp, Rattus norvegicus
cacgggcggtcatagacaggaagcc

SEQ ID NO: 473775 - DNA, 25 bp, Rattus norvegicus
cccaagcttacaccgaggatgctaa

SEQ ID NO: 473776 - DNA, 25 bp, Rattus norvegicus
actgcgacgactggggctccggcaa

SEQ ID NO: 473777 - DNA, 25 bp, Rattus norvegicus
aggcaggacgaggaagaccttagcc

SEQ ID NO: 473778 - DNA, 25 bp, Rattus norvegicus
gagctagcgcagcacggacccaaca

SEQ ID NO: 473779 - DNA, 25 bp, Rattus norvegicus
ggctccggcaattgcgcccttggct

SEQ ID NO: 473780 - DNA, 25 bp, Rattus norvegicus
gctcccttcagccagttgtgcaggt

SEQ ID NO: 473781 - DNA, 25 bp, Rattus norvegicus
ttgtgcaggtgtgtatctgaacggt

SEQ ID NO: 473782 - DNA, 25 bp, Rattus norvegicus
taccgcaactgcgacgactggggct

SEQ ID NO: 473783 - DNA, 25 bp, Rattus norvegicus
agaagggcgtgtaccgcaactgcga

SEQ ID NO: 473784 - DNA, 25 bp, Rattus norvegicus
cttctccggcgaacagtacatcctg

SEQ ID NO: 473785 - DNA, 25 bp, Rattus norvegicus
ctatgagcaagtaggcttctccggc

SEQ ID NO: 473786 - DNA, 25 bp, Rattus norvegicus
tgctcagcggcgtgtgagtaatccc

SEQ ID NO: 473787 - DNA, 25 bp, Rattus norvegicus
aagccatccacgtgctcagcggcgt

SEQ ID NO: 473788 - DNA, 25 bp, Rattus norvegicus
ccctggctgcctacttaaggcagga

SEQ ID NO: 473789 - DNA, 25 bp, Rattus norvegicus
tcagccagttgtgcaggtgtgtatc

SEQ ID NO: 473790 - DNA, 25 bp, Rattus norvegicus
tcgtcagaattattccaccgaagtg

SEQ ID NO: 473791 - DNA, 25 bp, Rattus norvegicus
ggatcagccatgacctctcagattc

SEQ ID NO: 473792 - DNA, 25 bp, Rattus norvegicus
cgccttcggctcctaggaccagcca

SEQ ID NO: 473793 - DNA, 25 bp, Rattus norvegicus
ttcggctcctaggaccagccagccc

SEQ ID NO: 473794 - DNA, 25 bp, Rattus norvegicus
gatcagccatgacctctcagattcg

SEQ ID NO: 473795 - DNA, 25 bp, Rattus norvegicus
atcagccatgacctctcagattcgt

SEQ ID NO: 473796 - DNA, 25 bp, Rattus norvegicus
tctcagattcgtcagaattattcca

SEQ ID NO: 473797 - DNA, 25 bp, Rattus norvegicus
agattcgtcagaattattccaccga

SEQ ID NO: 473798 - DNA, 25 bp, Rattus norvegicus
cgtcagaattattccaccgaagtgg

SEQ ID NO: 473799 - DNA, 25 bp, Rattus norvegicus
gtcagaattattccaccgaagtgga

SEQ ID NO: 473800 - DNA, 25 bp, Rattus norvegicus
tcagaattattccaccgaagtggaa

SEQ ID NO: 473801 - DNA, 25 bp, Rattus norvegicus
gcgggcctcttacacctacctctct

SEQ ID NO: 473802 - DNA, 25 bp, Rattus norvegicus
gcctcttacacctacctctctctgg

SEQ ID NO: 473803 - DNA, 25 bp, Rattus norvegicus
tcagattcgtcagaattattccacc

SEQ ID NO: 473804 - DNA, 25 bp, Rattus norvegicus
ctggttcgctagaggtcctctcgga

SEQ ID NO: 473805 - DNA, 25 bp, Rattus norvegicus
tcgagtcctggtcgcctgggaaacc

SEQ ID NO: 473806 - DNA, 25 bp, Rattus norvegicus
tgggaaaccccgagacaacaagatg

SEQ ID NO: 473807 - DNA, 25 bp, Rattus norvegicus
cccgtggtgagtcccagctccggat

SEQ ID NO: 473808 - DNA, 25 bp, Rattus norvegicus
tgagtcccagctccggatctttctg

SEQ ID NO: 473809 - DNA, 25 bp, Rattus norvegicus
tctaagtcttccggcagaccgcggc

SEQ ID NO: 473810 - DNA, 25 bp, Rattus norvegicus
ccggcgaactgcatggcttggttca

SEQ ID NO: 473811 - DNA, 25 bp, Rattus norvegicus
cgaactgcatggcttggttcaggag

SEQ ID NO: 473812 - DNA, 25 bp, Rattus norvegicus
atgtggggaccctactctccgtgtc

SEQ ID NO: 473813 - DNA, 25 bp, Rattus norvegicus
ctactctccgtgtccgcgcgtggag

SEQ ID NO: 473814 - DNA, 25 bp, Rattus norvegicus
cttcgctgccggctggttcgctaga

SEQ ID NO: 473815 - DNA, 25 bp, Rattus norvegicus
ttagccaatgagaagtgctcgagtc

SEQ ID NO: 473816 - DNA, 25 bp, Rattus norvegicus
agaagtgctcgagtcctggtcgcct

SEQ ID NO: 473817 - DNA, 25 bp, Rattus norvegicus
gaggtcctctcggaattagccaatg

SEQ ID NO: 473818 - DNA, 25 bp, Rattus norvegicus
gaccacagggctgctggccgaaagc

SEQ ID NO: 473819 - DNA, 25 bp, Rattus norvegicus
atgtcgtccacggaactccagtttt

SEQ ID NO: 473820 - DNA, 25 bp, Rattus norvegicus
actaggctaatgtcgtccacggaac

SEQ ID NO: 473821 - DNA, 25 bp, Rattus norvegicus
tctcccttcggtgccgtgtgggact

SEQ ID NO: 473822 - DNA, 25 bp, Rattus norvegicus
cgagcatggccgtggtctcccttcg

SEQ ID NO: 473823 - DNA, 25 bp, Rattus norvegicus
taacctccaaggtggcgagcatggc

SEQ ID NO: 473824 - DNA, 25 bp, Rattus norvegicus
ttggtgtcctaacctccaaggtggc

SEQ ID NO: 473825 - DNA, 25 bp, Rattus norvegicus
gctccgtactgattggtgtcctaac

SEQ ID NO: 473826 - DNA, 25 bp, Rattus norvegicus
gcagaaacttttggctccgtactga

SEQ ID NO: 473827 - DNA, 25 bp, Rattus norvegicus
tgctggccgaaagcgctctgagccc

SEQ ID NO: 473828 - DNA, 25 bp, Rattus norvegicus
tatttacctttctgagcgcctcgga

SEQ ID NO: 473829 - DNA, 25 bp, Rattus norvegicus
tttctgagcgcctcggaaagccacc

SEQ ID NO: 473830 - DNA, 25 bp, Rattus norvegicus
cccacaaagcttcggcagaaacttt

SEQ ID NO: 473831 - DNA, 25 bp, Rattus norvegicus
cagtttttatttacctttctgagcg

SEQ ID NO: 473832 - DNA, 25 bp, Rattus norvegicus
cggcagctgcacagctaggaactac

SEQ ID NO: 473833 - DNA, 25 bp, Rattus norvegicus
ccaggcacgcacttacttcacgaga

SEQ ID NO: 473834 - DNA, 25 bp, Rattus norvegicus
ttacttcacgagagccggtgaccga

SEQ ID NO: 473835 - DNA, 25 bp, Rattus norvegicus
gtgaccgacgtgctgtagactcgca

SEQ ID NO: 473836 - DNA, 25 bp, Rattus norvegicus
gctgtagactcgcaggccactcatg

SEQ ID NO: 473837 - DNA, 25 bp, Rattus norvegicus
ccactcatgctgcaggcaggggaca

SEQ ID NO: 473838 - DNA, 25 bp, Rattus norvegicus
acagctaggaactacgcggccaccg

SEQ ID NO: 473839 - DNA, 25 bp, Rattus norvegicus
caccgcgcttgggagcggtttcctt

SEQ ID NO: 473840 - DNA, 25 bp, Rattus norvegicus
tgggagcggtttccttcctgctccg

SEQ ID NO: 473841 - DNA, 25 bp, Rattus norvegicus
cgcgtgtcactgttctcgggaccaa

SEQ ID NO: 473842 - DNA, 25 bp, Rattus norvegicus
gttctcgggaccaatgagctgcgca

SEQ ID NO: 473843 - DNA, 25 bp, Rattus norvegicus
gcggggcctacatgacaccgccctg

SEQ ID NO: 473844 - DNA, 25 bp, Rattus norvegicus
ccagtcggagcacagagagaccgcc

SEQ ID NO: 473845 - DNA, 25 bp, Rattus norvegicus
aactacgcggccaccgcgcttggga

SEQ ID NO: 473846 - DNA, 25 bp, Rattus norvegicus
ctgcgcatgacacagaggctactta

SEQ ID NO: 473847 - DNA, 25 bp, Rattus norvegicus
gtgaaaggtctccactcgccgagtc

SEQ ID NO: 473848 - DNA, 25 bp, Rattus norvegicus
cagctcccggccgtttgtgaaaggt

SEQ ID NO: 473849 - DNA, 25 bp, Rattus norvegicus
tccgcctctttttgccctacaattg

SEQ ID NO: 473850 - DNA, 25 bp, Rattus norvegicus
tctggcacacaagtacggaaactgc

SEQ ID NO: 473851 - DNA, 25 bp, Rattus norvegicus
ggctacttagatcagtctcttcgca

SEQ ID NO: 473852 - DNA, 25 bp, Rattus norvegicus
tgaccaatggagacctaggctgctc

SEQ ID NO: 473853 - DNA, 25 bp, Rattus norvegicus
ctcaggtcgtctaacggccgttcca

SEQ ID NO: 473854 - DNA, 25 bp, Rattus norvegicus
gcgaatccgctcctcaggtcgtcta

SEQ ID NO: 473855 - DNA, 25 bp, Rattus norvegicus
tcactctgggatactgaaggcggcc

SEQ ID NO: 473856 - DNA, 25 bp, Rattus norvegicus
tcccgggcttacgaaatgagggaca

SEQ ID NO: 473857 - DNA, 25 bp, Rattus norvegicus
caagaagctaggtcccgacttttca

SEQ ID NO: 473858 - DNA, 25 bp, Rattus norvegicus
aattacggctcggtccatctgcgca

SEQ ID NO: 473859 - DNA, 25 bp, Rattus norvegicus
ccctttcaccgtgtccagggctgtg

SEQ ID NO: 473860 - DNA, 25 bp, Rattus norvegicus
acgggtcccaagacagagaagcttc

SEQ ID NO: 473861 - DNA, 25 bp, Rattus norvegicus
tagacttacgcgcaggccagacagc

SEQ ID NO: 473862 - DNA, 25 bp, Rattus norvegicus
gccgttcgatgacgtcccgaaaggc

SEQ ID NO: 473863 - DNA, 25 bp, Rattus norvegicus
cagaccttgccgctccgggtggtat

SEQ ID NO: 473864 - DNA, 25 bp, Rattus norvegicus
gcctcagctcgcgatggatctcatc

SEQ ID NO: 473865 - DNA, 25 bp, Rattus norvegicus
aggcagactgcttctgatgacgtca

SEQ ID NO: 473866 - DNA, 25 bp, Rattus norvegicus
ggtggtatctcagaccctgctccgc

SEQ ID NO: 473867 - DNA, 25 bp, Rattus norvegicus
cgggagcgacccatgataagagaga

SEQ ID NO: 473868 - DNA, 25 bp, Rattus norvegicus
tcttggccttcatctggcgggctaa

SEQ ID NO: 473869 - DNA, 25 bp, Rattus norvegicus
agacccacacgtgcaggcgtttccg

SEQ ID NO: 473870 - DNA, 25 bp, Rattus norvegicus
gccggatatcagattccgaacccga

SEQ ID NO: 473871 - DNA, 25 bp, Rattus norvegicus
ttccgaacccgaaaggatgagaggc

SEQ ID NO: 473872 - DNA, 25 bp, Rattus norvegicus
gagaagcttctagcggctctcggcc

SEQ ID NO: 473873 - DNA, 25 bp, Rattus norvegicus
atggatctcatccaggtccggccgc

SEQ ID NO: 473874 - DNA, 25 bp, Rattus norvegicus
tcctcccgtgtggtggtggtcacac

SEQ ID NO: 473875 - DNA, 25 bp, Rattus norvegicus
agcagatccgggagcctaagaacca

SEQ ID NO: 473876 - DNA, 25 bp, Rattus norvegicus
ctggcagccatataaccactggatg

SEQ ID NO: 473877 - DNA, 25 bp, Rattus norvegicus
cgctccaagccgcagtagttgaaga

SEQ ID NO: 473878 - DNA, 25 bp, Rattus norvegicus
aagaatcgctccttctctgacagtg

SEQ ID NO: 473879 - DNA, 25 bp, Rattus norvegicus
catgtgggacacaatgcgcgcttcc

SEQ ID NO: 473880 - DNA, 25 bp, Rattus norvegicus
ggcccttggcgttctctttgttcac

SEQ ID NO: 473881 - DNA, 25 bp, Rattus norvegicus
cagtcccgcttctggcggtagaaga

SEQ ID NO: 473882 - DNA, 25 bp, Rattus norvegicus
tggctcctgacgacgcactatcact

SEQ ID NO: 473883 - DNA, 25 bp, Rattus norvegicus
cactatcacttggtgcgtcttgacg

SEQ ID NO: 473884 - DNA, 25 bp, Rattus norvegicus
cgtcttgacgtacttggctttgtca

SEQ ID NO: 473885 - DNA, 25 bp, Rattus norvegicus
gctttgtcagcctccagtctttcca

SEQ ID NO: 473886 - DNA, 25 bp, Rattus norvegicus
actctaccggtttccacagtgcgcg

SEQ ID NO: 473887 - DNA, 25 bp, Rattus norvegicus
cgtccctgtcgctggatgtccaatc

SEQ ID NO: 473888 - DNA, 25 bp, Rattus norvegicus
gatggcgggcctgcccaacgtgttc

SEQ ID NO: 473889 - DNA, 25 bp, Rattus norvegicus
tgagaaaagcacagacgccgtttcg

SEQ ID NO: 473890 - DNA, 25 bp, Rattus norvegicus
cgagaaccgagactctgagaaaagc

SEQ ID NO: 473891 - DNA, 25 bp, Rattus norvegicus
acgacaatgaagacgagaaccgaga

SEQ ID NO: 473892 - DNA, 25 bp, Rattus norvegicus
cggcacttcaaaagcggaagagaaa

SEQ ID NO: 473893 - DNA, 25 bp, Rattus norvegicus
cagaggacggcacttcaaaagcgga

SEQ ID NO: 473894 - DNA, 25 bp, Rattus norvegicus
aggagagccagaggacggcacttca

SEQ ID NO: 473895 - DNA, 25 bp, Rattus norvegicus
tactgcttcgagtcaaggagagcca

SEQ ID NO: 473896 - DNA, 25 bp, Rattus norvegicus
caccactactgcttcgagtcaagga

SEQ ID NO: 473897 - DNA, 25 bp, Rattus norvegicus
gctgctactggaaacaccactactg

SEQ ID NO: 473898 - DNA, 25 bp, Rattus norvegicus
ctctcagctgctactggaaacacca

SEQ ID NO: 473899 - DNA, 25 bp, Rattus norvegicus
gcctgggcgggctgctgaacaaccc

SEQ ID NO: 473900 - DNA, 25 bp, Rattus norvegicus
ccgtttcggctgctgactctgcgaa

SEQ ID NO: 473901 - DNA, 25 bp, Rattus norvegicus
gcctgcccaacgtgttcggcctggg

SEQ ID NO: 473902 - DNA, 25 bp, Rattus norvegicus
tctcttcagacctaccgagcggcgg

SEQ ID NO: 473903 - DNA, 25 bp, Rattus norvegicus
aactcctcgcggctgcggactatgg

SEQ ID NO: 473904 - DNA, 25 bp, Rattus norvegicus
acacatgcagggaggtcggttctga

SEQ ID NO: 473905 - DNA, 25 bp, Rattus norvegicus
tcggttctgactgcagggcatccgt

SEQ ID NO: 473906 - DNA, 25 bp, Rattus norvegicus
gccaggtttacctcagggcagccgc

SEQ ID NO: 473907 - DNA, 25 bp, Rattus norvegicus
agcggacagtgcacgtgcccattgc

SEQ ID NO: 473908 - DNA, 25 bp, Rattus norvegicus
atgagctctgcaggccgccattatc

SEQ ID NO: 473909 - DNA, 25 bp, Rattus norvegicus
cggcgcatctttctcgccggtggtg

SEQ ID NO: 473910 - DNA, 25 bp, Rattus norvegicus
ggctggctacaccttcgatccgagt

SEQ ID NO: 473911 - DNA, 25 bp, Rattus norvegicus
atccgagtcaccgagccgtgtttgc

SEQ ID NO: 473912 - DNA, 25 bp, Rattus norvegicus
cgatcatctgggtggatgctgtccc

SEQ ID NO: 473913 - DNA, 25 bp, Rattus norvegicus
cggcgcggtggtatctcccttaaag

SEQ ID NO: 473914 - DNA, 25 bp, Rattus norvegicus
cattatcgggcagctcgcgcctcag

SEQ ID NO: 473915 - DNA, 25 bp, Rattus norvegicus
tctggcgctgcacacagtcgagcgt

SEQ ID NO: 473916 - DNA, 25 bp, Rattus norvegicus
gctccttcaggctccggacgcagga

SEQ ID NO: 473917 - DNA, 25 bp, Rattus norvegicus
gcgcggagcccggtaagttcaagcc

SEQ ID NO: 473918 - DNA, 25 bp, Rattus norvegicus
agcagaacctgctggagagcacgcg

SEQ ID NO: 473919 - DNA, 25 bp, Rattus norvegicus
tgcagaccatggacaagcagaacct

SEQ ID NO: 473920 - DNA, 25 bp, Rattus norvegicus
caacttcgagggctcaccgggagag

SEQ ID NO: 473921 - DNA, 25 bp, Rattus norvegicus
gcgcgcaacttcgagggctcaccgg

SEQ ID NO: 473922 - DNA, 25 bp, Rattus norvegicus
gtgactgcgagctgccatcgtcccg

SEQ ID NO: 473923 - DNA, 25 bp, Rattus norvegicus
agtagaaggtgactgcgagctgcca

SEQ ID NO: 473924 - DNA, 25 bp, Rattus norvegicus
ccagagctgaaagtagaaggtgact

SEQ ID NO: 473925 - DNA, 25 bp, Rattus norvegicus
aggcaggaccagagctgaaagtaga

SEQ ID NO: 473926 - DNA, 25 bp, Rattus norvegicus
acacgacgcgctgcgggcggcttca

SEQ ID NO: 473927 - DNA, 25 bp, Rattus norvegicus
cgcgggcttttgcacacgacgcgct

SEQ ID NO: 473928 - DNA, 25 bp, Rattus norvegicus
agcagcgattccctttgcagccggc

SEQ ID NO: 473929 - DNA, 25 bp, Rattus norvegicus
gggcagagcagcgattccctttgca

SEQ ID NO: 473930 - DNA, 25 bp, Rattus norvegicus
tgccctgaagtcagcccgggaaacg

SEQ ID NO: 473931 - DNA, 25 bp, Rattus norvegicus
cccggctgctgtgccctgaagtcag

SEQ ID NO: 473932 - DNA, 25 bp, Rattus norvegicus
ggagtccattgctccgactccagca

SEQ ID NO: 473933 - DNA, 25 bp, Rattus norvegicus
tgcccgcgggatattggagtccatt

SEQ ID NO: 473934 - DNA, 25 bp, Rattus norvegicus
acattccggacggtgcccgcgggat

SEQ ID NO: 473935 - DNA, 25 bp, Rattus norvegicus
catgctggatgctgcagcccggctc

SEQ ID NO: 473936 - DNA, 25 bp, Rattus norvegicus
tactgggtgctgcatgctggatgct

SEQ ID NO: 473937 - DNA, 25 bp, Rattus norvegicus
caaatgaagcgagctaggtgctgcg

SEQ ID NO: 473938 - DNA, 25 bp, Rattus norvegicus
ctaccagcctctggggtgaacaccg

SEQ ID NO: 473939 - DNA, 25 bp, Rattus norvegicus
agtcagcccgggaaacgccactgct

SEQ ID NO: 473940 - DNA, 25 bp, Rattus norvegicus
cctttgccgcactgcagggtgcaga

SEQ ID NO: 473941 - DNA, 25 bp, Rattus norvegicus
gttctttcaaatgctggcgctggcc

SEQ ID NO: 473942 - DNA, 25 bp, Rattus norvegicus
gccggcggctttgttctttcaaatg

SEQ ID NO: 473943 - DNA, 25 bp, Rattus norvegicus
gtgcagagagcgagctaccagcctc

SEQ ID NO: 473944 - DNA, 25 bp, Rattus norvegicus
cccattgtctaaaggagagcgaggc

SEQ ID NO: 473945 - DNA, 25 bp, Rattus norvegicus
gttccgtaacggattcactcctgtg

SEQ ID NO: 473946 - DNA, 25 bp, Rattus norvegicus
tggaggccatgcgaccaagccctct

SEQ ID NO: 473947 - DNA, 25 bp, Rattus norvegicus
tgcacttttcctagggagggagttc

SEQ ID NO: 473948 - DNA, 25 bp, Rattus norvegicus
ggcgtgagccgtcctctgcatctac

SEQ ID NO: 473949 - DNA, 25 bp, Rattus norvegicus
tcttcagatcagaggcccaggtcca

SEQ ID NO: 473950 - DNA, 25 bp, Rattus norvegicus
gccgggtagaagaagagtccagtcc

SEQ ID NO: 473951 - DNA, 25 bp, Rattus norvegicus
tggacgcggccaaatgctcttcaga

SEQ ID NO: 473952 - DNA, 25 bp, Rattus norvegicus
aattcccgaaatgcgccgctccgga

SEQ ID NO: 473953 - DNA, 25 bp, Rattus norvegicus
tgcggtcacccgcagccaatgcggt

SEQ ID NO: 473954 - DNA, 25 bp, Rattus norvegicus
acgtgccgctgtttggcgcttttgt

SEQ ID NO: 473955 - DNA, 25 bp, Rattus norvegicus
tctgttggttctcagagtgtggcca

SEQ ID NO: 473956 - DNA, 25 bp, Rattus norvegicus
gcgttcgtcttttgtgtggagctcc

SEQ ID NO: 473957 - DNA, 25 bp, Rattus norvegicus
agcgaaagaaactcctatggccggg

SEQ ID NO: 473958 - DNA, 25 bp, Rattus norvegicus
taccggccgctgcaccagaactggt

SEQ ID NO: 473959 - DNA, 25 bp, Rattus norvegicus
accgggccgaggtgccacggctctt

SEQ ID NO: 473960 - DNA, 25 bp, Rattus norvegicus
aggtgccacggctcttctggaagcc

SEQ ID NO: 473961 - DNA, 25 bp, Rattus norvegicus
ggctcttctggaagccgtacatcta

SEQ ID NO: 473962 - DNA, 25 bp, Rattus norvegicus
tctggaagccgtacatctatgctgg

SEQ ID NO: 473963 - DNA, 25 bp, Rattus norvegicus
tacatctatgctggctaccggccgc

SEQ ID NO: 473964 - DNA, 25 bp, Rattus norvegicus
gaactggtgtttctacttccgcaca

SEQ ID NO: 473965 - DNA, 25 bp, Rattus norvegicus
ggtgtttctacttccgcacactgtt

SEQ ID NO: 473966 - DNA, 25 bp, Rattus norvegicus
gcacactgttccagcagcacaacga

SEQ ID NO: 473967 - DNA, 25 bp, Rattus norvegicus
tgttccagcagcacaacgaggctgt

SEQ ID NO: 473968 - DNA, 25 bp, Rattus norvegicus
aacgaggctgtgaacgtgtggaccc

SEQ ID NO: 473969 - DNA, 25 bp, Rattus norvegicus
tgctgctgcggctgatcgtcttggc

SEQ ID NO: 473970 - DNA, 25 bp, Rattus norvegicus
gccgctgcaccagaactggtgtttc

SEQ ID NO: 473971 - DNA, 25 bp, Rattus norvegicus
tgaacgtgtggacccacctcctggc

SEQ ID NO: 473972 - DNA, 25 bp, Rattus norvegicus
gttcggtgcccttgccctgtccgcc

SEQ ID NO: 473973 - DNA, 25 bp, Rattus norvegicus
cccggcatcgtaagctcaaggagcc

SEQ ID NO: 473974 - DNA, 25 bp, Rattus norvegicus
agcgactggactacgagcgggctgc

SEQ ID NO: 473975 - DNA, 25 bp, Rattus norvegicus
cccgagcagcgactggactacgagc

SEQ ID NO: 473976 - DNA, 25 bp, Rattus norvegicus
atccgcagtgttcaaggcggccgcg

SEQ ID NO: 473977 - DNA, 25 bp, Rattus norvegicus
ccatgagatccgcagtgttcaaggc

SEQ ID NO: 473978 - DNA, 25 bp, Rattus norvegicus
tatgaccatgagatccgcagtgttc

SEQ ID NO: 473979 - DNA, 25 bp, Rattus norvegicus
ctccggaccactatgaccatgagat

SEQ ID NO: 473980 - DNA, 25 bp, Rattus norvegicus
cgctccggaccactatgaccatgag

SEQ ID NO: 473981 - DNA, 25 bp, Rattus norvegicus
ccctcccggagtaggagggctctgg

SEQ ID NO: 473982 - DNA, 25 bp, Rattus norvegicus
ttaaagggaaacgctgaggagccga

SEQ ID NO: 473983 - DNA, 25 bp, Rattus norvegicus
ccgctgccctctcggcgcatgcgcg

SEQ ID NO: 473984 - DNA, 25 bp, Rattus norvegicus
ggcggcccctttcacaatagcgcta

SEQ ID NO: 473985 - DNA, 25 bp, Rattus norvegicus
acaatagcgctacccgcctccctcc

SEQ ID NO: 473986 - DNA, 25 bp, Rattus norvegicus
gcctcctacagtggcgggaaatctg

SEQ ID NO: 473987 - DNA, 25 bp, Rattus norvegicus
agaagctggcgcctaagtcgtcctg

SEQ ID NO: 473988 - DNA, 25 bp, Rattus norvegicus
cgcgaggccagaagctggcgcctaa

SEQ ID NO: 473989 - DNA, 25 bp, Rattus norvegicus
cgatacgcggactttggggacgcct

SEQ ID NO: 473990 - DNA, 25 bp, Rattus norvegicus
cgtcattgaggcgatacgcggactt

SEQ ID NO: 473991 - DNA, 25 bp, Rattus norvegicus
tgggacgccgtcattgaggcgatac

SEQ ID NO: 473992 - DNA, 25 bp, Rattus norvegicus
cggcgctgaagaggcagaagatgca

SEQ ID NO: 473993 - DNA, 25 bp, Rattus norvegicus
ccgctatgagtcgtagagggccaga

SEQ ID NO: 473994 - DNA, 25 bp, Rattus norvegicus
gttctcggccgctatgagtcgtaga

SEQ ID NO: 473995 - DNA, 25 bp, Rattus norvegicus
cgggaaatctgaacgcgggtctccg

SEQ ID NO: 473996 - DNA, 25 bp, Rattus norvegicus
aggcggaattacgtcacgacggccg

SEQ ID NO: 473997 - DNA, 25 bp, Rattus norvegicus
tggttagaggcggaattacgtcacg

SEQ ID NO: 473998 - DNA, 25 bp, Rattus norvegicus
ggtctccgctaacggccgctacagg

SEQ ID NO: 473999 - DNA, 25 bp, Rattus norvegicus
tagaggcggaattacgtcacgacgg

SEQ ID NO: 474000 - DNA, 25 bp, Rattus norvegicus
tggtcagccagatgcagcaccttgc

SEQ ID NO: 474001 - DNA, 25 bp, Rattus norvegicus
cgcgtctttacgtgcggactctctc

SEQ ID NO: 474002 - DNA, 25 bp, Rattus norvegicus
gcccgttccgcaaactgggtcttca

SEQ ID NO: 474003 - DNA, 25 bp, Rattus norvegicus
ggcagaccctctctgttccgagaag

SEQ ID NO: 474004 - DNA, 25 bp, Rattus norvegicus
gtcctgggccactgagaaacttttg

SEQ ID NO: 474005 - DNA, 25 bp, Rattus norvegicus
gaaacttttgcccagcggtgcctgg

SEQ ID NO: 474006 - DNA, 25 bp, Rattus norvegicus
ggtcaagtccttaccgcgcgtccag

SEQ ID NO: 474007 - DNA, 25 bp, Rattus norvegicus
cgtatcgcactccaacggctgggtc

SEQ ID NO: 474008 - DNA, 25 bp, Rattus norvegicus
ggccagcaactacgcctcgggacta

SEQ ID NO: 474009 - DNA, 25 bp, Rattus norvegicus
cccgtttagggctcacctcagattc

SEQ ID NO: 474010 - DNA, 25 bp, Rattus norvegicus
agcaatcatttgcagctgcgcggca

SEQ ID NO: 474011 - DNA, 25 bp, Rattus norvegicus
ctgtaggcgacactaacttagcttc

SEQ ID NO: 474012 - DNA, 25 bp, Rattus norvegicus
gaaggtctgtgctttcatccgttga

SEQ ID NO: 474013 - DNA, 25 bp, Rattus norvegicus
acccgcctccggaagcaatcatttg

SEQ ID NO: 474014 - DNA, 25 bp, Rattus norvegicus
ggtgcccagccacgctggagctgtc

SEQ ID NO: 474015 - DNA, 25 bp, Rattus norvegicus
cagggtctgcccatagtgggctttc

SEQ ID NO: 474016 - DNA, 25 bp, Rattus norvegicus
tctgcccatagtgggctttccgtcc

SEQ ID NO: 474017 - DNA, 25 bp, Rattus norvegicus
tgcctctgagaacggtcccggatcc

SEQ ID NO: 474018 - DNA, 25 bp, Rattus norvegicus
tcccggatcccaagaaagtagaggc

SEQ ID NO: 474019 - DNA, 25 bp, Rattus norvegicus
tcccaagaaagtagaggcgtccctg

SEQ ID NO: 474020 - DNA, 25 bp, Rattus norvegicus
gtcagtggcggtgcccagccacgct

SEQ ID NO: 474021 - DNA, 25 bp, Rattus norvegicus
atccgtccagggtctgcccatagtg

SEQ ID NO: 474022 - DNA, 25 bp, Rattus norvegicus
ccacgctggagctgtccgagcggtt

SEQ ID NO: 474023 - DNA, 25 bp, Rattus norvegicus
tgctggtacgtcaccagctcctgtc

SEQ ID NO: 474024 - DNA, 25 bp, Rattus norvegicus
gtctgtccgacacatccgtccaggg

SEQ ID NO: 474025 - DNA, 25 bp, Rattus norvegicus
aagtagaggcgtccctgagacacgg

SEQ ID NO: 474026 - DNA, 25 bp, Rattus norvegicus
aaaaaagtcgtctgtccgacacatc

SEQ ID NO: 474027 - DNA, 25 bp, Rattus norvegicus
cagcccgggtcccatgctggtacgt

SEQ ID NO: 474028 - DNA, 25 bp, Rattus norvegicus
cggggcacacacttaggatgctttc

SEQ ID NO: 474029 - DNA, 25 bp, Rattus norvegicus
ttactcggggcacacacttaggatg

SEQ ID NO: 474030 - DNA, 25 bp, Rattus norvegicus
cttaggatgctttctgtgacagtgc

SEQ ID NO: 474031 - DNA, 25 bp, Rattus norvegicus
ttctgtgacagtgcgagcagaaagt

SEQ ID NO: 474032 - DNA, 25 bp, Rattus norvegicus
tgctttctgtgacagtgcgagcaga

SEQ ID NO: 474033 - DNA, 25 bp, Rattus norvegicus
tgtgcttgaaaggattcctgcagcc

SEQ ID NO: 474034 - DNA, 25 bp, Rattus norvegicus
ggcgagagcatcaggcgatttgatc

SEQ ID NO: 474035 - DNA, 25 bp, Rattus norvegicus
agtgctgtgtgcttgaaaggattcc

SEQ ID NO: 474036 - DNA, 25 bp, Rattus norvegicus
gcggcccttcgaggttcctaatgag

SEQ ID NO: 474037 - DNA, 25 bp, Rattus norvegicus
tcgaggttcctaatgaggaccggtg

SEQ ID NO: 474038 - DNA, 25 bp, Rattus norvegicus
ctctcactcccgcaagactgaatta

SEQ ID NO: 474039 - DNA, 25 bp, Rattus norvegicus
cgcaagactgaattactcggggcac

SEQ ID NO: 474040 - DNA, 25 bp, Rattus norvegicus
gactgaattactcggggcacacact

SEQ ID NO: 474041 - DNA, 25 bp, Rattus norvegicus
tgcagccgccctctgaaaagggaac

SEQ ID NO: 474042 - DNA, 25 bp, Rattus norvegicus
cagcctctggagcagtttgcaaagg

SEQ ID NO: 474043 - DNA, 25 bp, Rattus norvegicus
agcaacgatgaagtgactggggtcc

SEQ ID NO: 474044 - DNA, 25 bp, Rattus norvegicus
ggctccaggagtctttagagtcctc

SEQ ID NO: 474045 - DNA, 25 bp, Rattus norvegicus
cgagcagagctgtgcacctcgaggc

SEQ ID NO: 474046 - DNA, 25 bp, Rattus norvegicus
ttcagggagtttggagcgaatcctc

SEQ ID NO: 474047 - DNA, 25 bp, Rattus norvegicus
gaacggtcacatgccgtccgcgacg

SEQ ID NO: 474048 - DNA, 25 bp, Rattus norvegicus
ggcacccgaagtttcagcctctgga

SEQ ID NO: 474049 - DNA, 25 bp, Rattus norvegicus
tcgggacacgtccacaactttgctc

SEQ ID NO: 474050 - DNA, 25 bp, Rattus norvegicus
acccaggggctctagatgctcgcgc

SEQ ID NO: 474051 - DNA, 25 bp, Rattus norvegicus
gatacccaggaagcgcgtgctaagc

SEQ ID NO: 474052 - DNA, 25 bp, Rattus norvegicus
gtgctaagcctgaagctggcctcta

SEQ ID NO: 474053 - DNA, 25 bp, Rattus norvegicus
gggtctcccgctgcgatcacctgtt

SEQ ID NO: 474054 - DNA, 25 bp, Rattus norvegicus
ccgcagtctggccaatggggaacct

SEQ ID NO: 474055 - DNA, 25 bp, Rattus norvegicus
tcaggctctcactgcgacagcgctg

SEQ ID NO: 474056 - DNA, 25 bp, Rattus norvegicus
tctcgcacagatgtcgcaggctgcc

SEQ ID NO: 474057 - DNA, 25 bp, Rattus norvegicus
aaccaagcagtgacaggccggaggc

SEQ ID NO: 474058 - DNA, 25 bp, Rattus norvegicus
ccagggagacaaaccaagcagtgac

SEQ ID NO: 474059 - DNA, 25 bp, Rattus norvegicus
tgctccaggacaacagtgtcgcccg

SEQ ID NO: 474060 - DNA, 25 bp, Rattus norvegicus
cagagaccagtgctccaggacaaca

SEQ ID NO: 474061 - DNA, 25 bp, Rattus norvegicus
tctgaggttcagagaccagtgctcc

SEQ ID NO: 474062 - DNA, 25 bp, Rattus norvegicus
gcgtcgtccctgcagctggtgcgtc

SEQ ID NO: 474063 - DNA, 25 bp, Rattus norvegicus
atgaaggccgccaaggcagcacagg

SEQ ID NO: 474064 - DNA, 25 bp, Rattus norvegicus
atgggcgtcctgattgtaacgaccc

SEQ ID NO: 474065 - DNA, 25 bp, Rattus norvegicus
caaagcccggccagatgggcgtcct

SEQ ID NO: 474066 - DNA, 25 bp, Rattus norvegicus
ttctggcaccagagcaaagcccggc

SEQ ID NO: 474067 - DNA, 25 bp, Rattus norvegicus
cttgacttctgcctcttggcttctg

SEQ ID NO: 474068 - DNA, 25 bp, Rattus norvegicus
cgccgcagcgtttaaccttgacttc

SEQ ID NO: 474069 - DNA, 25 bp, Rattus norvegicus
gaacaaaggcgagcctgtgctcggc

SEQ ID NO: 474070 - DNA, 25 bp, Rattus norvegicus
acctgcgggactcagcgttcagaag

SEQ ID NO: 474071 - DNA, 25 bp, Rattus norvegicus
tgggtcgagaggctctagacgtcct

SEQ ID NO: 474072 - DNA, 25 bp, Rattus norvegicus
gaggctctagacgtcctctctgcgc

SEQ ID NO: 474073 - DNA, 25 bp, Rattus norvegicus
gggcgggacgaagccaccctgtcca

SEQ ID NO: 474074 - DNA, 25 bp, Rattus norvegicus
ggaggcccgacctgaggcgcacaca

SEQ ID NO: 474075 - DNA, 25 bp, Rattus norvegicus
tgaggcgcacacactcactgcggtg

SEQ ID NO: 474076 - DNA, 25 bp, Rattus norvegicus
ccagactggggctccggattagcgc

SEQ ID NO: 474077 - DNA, 25 bp, Rattus norvegicus
tgccgccgccaaaagtcctccagga

SEQ ID NO: 474078 - DNA, 25 bp, Rattus norvegicus
gcagagaggctacgcccacggacac

SEQ ID NO: 474079 - DNA, 25 bp, Rattus norvegicus
gacctggacttgctccgagcctgca

SEQ ID NO: 474080 - DNA, 25 bp, Rattus norvegicus
ttgctccgagcctgcacgcgctgtt

SEQ ID NO: 474081 - DNA, 25 bp, Rattus norvegicus
gcacgcgctgttccttggctctcaa

SEQ ID NO: 474082 - DNA, 25 bp, Rattus norvegicus
ctctgcttggccagactggggctcc

SEQ ID NO: 474083 - DNA, 25 bp, Rattus norvegicus
gccacctggacgcatccagagggga

SEQ ID NO: 474084 - DNA, 25 bp, Rattus norvegicus
ccctggcagctcctaactttggcgg

SEQ ID NO: 474085 - DNA, 25 bp, Rattus norvegicus
gccgaagctcacctgccgtagatac

SEQ ID NO: 474086 - DNA, 25 bp, Rattus norvegicus
gcgccgaagctcacctgccgtagat

SEQ ID NO: 474087 - DNA, 25 bp, Rattus norvegicus
accctcggctggctggccctgcgct

SEQ ID NO: 474088 - DNA, 25 bp, Rattus norvegicus
cccggcacactaccgccaacggcgg

SEQ ID NO: 474089 - DNA, 25 bp, Rattus norvegicus
gcagggcgcacagcctgctggggac

SEQ ID NO: 474090 - DNA, 25 bp, Rattus norvegicus
actcctgagctcagcgtgacccggg

SEQ ID NO: 474091 - DNA, 25 bp, Rattus norvegicus
tcgggcagccaactcctgagctcag

SEQ ID NO: 474092 - DNA, 25 bp, Rattus norvegicus
cccgtcgcacgcgtccacgagcctc

SEQ ID NO: 474093 - DNA, 25 bp, Rattus norvegicus
tggcagctcctaactttggcggctc

SEQ ID NO: 474094 - DNA, 25 bp, Rattus norvegicus
cacctgccgtagataccctcggtga

SEQ ID NO: 474095 - DNA, 25 bp, Rattus norvegicus
cagccaactcctgagctcagcgtga

SEQ ID NO: 474096 - DNA, 25 bp, Rattus norvegicus
gctcctaactttggcggctcgctct

SEQ ID NO: 474097 - DNA, 25 bp, Rattus norvegicus
gagcctcgggcagccaactcctgag

SEQ ID NO: 474098 - DNA, 25 bp, Rattus norvegicus
tcagccggggtacgaatgacaaagc

SEQ ID NO: 474099 - DNA, 25 bp, Rattus norvegicus
cgctgaggcaacactgacccttaga

SEQ ID NO: 474100 - DNA, 25 bp, Rattus norvegicus
ggtgtctctcgtcctccgagtctgt

SEQ ID NO: 474101 - DNA, 25 bp, Rattus norvegicus
ctccgccttcggaaacaaagaaatg

SEQ ID NO: 474102 - DNA, 25 bp, Rattus norvegicus
tccacgtccgcaggtttgtgcatgc

SEQ ID NO: 474103 - DNA, 25 bp, Rattus norvegicus
ccgcctctttgaaggacataagggc

SEQ ID NO: 474104 - DNA, 25 bp, Rattus norvegicus
ggctgggcctatcagaaaagagtta

SEQ ID NO: 474105 - DNA, 25 bp, Rattus norvegicus
atgccttgttgcgaaggtgcgcttc

SEQ ID NO: 474106 - DNA, 25 bp, Rattus norvegicus
cccgcctggcgtgtgagaaccaaac

SEQ ID NO: 474107 - DNA, 25 bp, Rattus norvegicus
ggactctgcgctgacatgtgcttca

SEQ ID NO: 474108 - DNA, 25 bp, Rattus norvegicus
cagtcagccgcgtccttatgtaaga

SEQ ID NO: 474109 - DNA, 25 bp, Rattus norvegicus
cagtcgagcatgcagccataccggc

SEQ ID NO: 474110 - DNA, 25 bp, Rattus norvegicus
acggcccgcgtagccaatcgaaggc

SEQ ID NO: 474111 - DNA, 25 bp, Rattus norvegicus
ggcccacgtcggagtacaccgtgtg

SEQ ID NO: 474112 - DNA, 25 bp, Rattus norvegicus
gatgagcgtgcccaactccgcagtt

SEQ ID NO: 474113 - DNA, 25 bp, Rattus norvegicus
atcccgagggtgcagcttacgggcc

SEQ ID NO: 474114 - DNA, 25 bp, Rattus norvegicus
atctagagcgaagggcggatcccga

SEQ ID NO: 474115 - DNA, 25 bp, Rattus norvegicus
gtcagtgcgcatgcggatctagagc

SEQ ID NO: 474116 - DNA, 25 bp, Rattus norvegicus
actcccggatgtggatgtgccggtc

SEQ ID NO: 474117 - DNA, 25 bp, Rattus norvegicus
cactccagttctgcaagaaaacaaa

SEQ ID NO: 474118 - DNA, 25 bp, Rattus norvegicus
ctctgttcactccagttctgcaaga

SEQ ID NO: 474119 - DNA, 25 bp, Rattus norvegicus
gcgcgtttggcagcctctgttcact

SEQ ID NO: 474120 - DNA, 25 bp, Rattus norvegicus
cgatgctccgccgtcggatgagcgt

SEQ ID NO: 474121 - DNA, 25 bp, Rattus norvegicus
ctccgcagttctggggaattgtccc

SEQ ID NO: 474122 - DNA, 25 bp, Rattus norvegicus
gggtgcagcttacgggccacgccca

SEQ ID NO: 474123 - DNA, 25 bp, Rattus norvegicus
ccaagtccgatgtcgcggcgcgttt

SEQ ID NO: 474124 - DNA, 25 bp, Rattus norvegicus
gcactcacgtccaagtccgatgtcg

SEQ ID NO: 474125 - DNA, 25 bp, Rattus norvegicus
aggtcgcgcgatctcagccgcggca

SEQ ID NO: 474126 - DNA, 25 bp, Rattus norvegicus
tctccagaaaacgtgccgcagggcg

SEQ ID NO: 474127 - DNA, 25 bp, Rattus norvegicus
ccttcatctgcgacgggtggagagc

SEQ ID NO: 474128 - DNA, 25 bp, Rattus norvegicus
gcttcgggttccgacagcggctctc

SEQ ID NO: 474129 - DNA, 25 bp, Rattus norvegicus
aagaatctggtgcttcgggttccga

SEQ ID NO: 474130 - DNA, 25 bp, Rattus norvegicus
aggacactgaggacgaagaatctgg

SEQ ID NO: 474131 - DNA, 25 bp, Rattus norvegicus
ggcagcgcgcttcccaggacactga

SEQ ID NO: 474132 - DNA, 25 bp, Rattus norvegicus
ccgttctccgtaagatggcggaccg

SEQ ID NO: 474133 - DNA, 25 bp, Rattus norvegicus
agctgaccagcggtggccgttctcc

SEQ ID NO: 474134 - DNA, 25 bp, Rattus norvegicus
ccgccctagacgtgaagcacgctgg

SEQ ID NO: 474135 - DNA, 25 bp, Rattus norvegicus
gacagacgtaatctcgctctccaga

SEQ ID NO: 474136 - DNA, 25 bp, Rattus norvegicus
ctccttacatcaccgacagacgtaa

SEQ ID NO: 474137 - DNA, 25 bp, Rattus norvegicus
gaagtaaagcgctaagtcacgcctc

SEQ ID NO: 474138 - DNA, 25 bp, Rattus norvegicus
cggtaaaggatgcaagagcccgatc

SEQ ID NO: 474139 - DNA, 25 bp, Rattus norvegicus
agcacgctgggactcctctcgagct

SEQ ID NO: 474140 - DNA, 25 bp, Rattus norvegicus
cttcagttcgcatccggacttcgtc

SEQ ID NO: 474141 - DNA, 25 bp, Rattus norvegicus
tgcgcatgcgtatttagaaggagta

SEQ ID NO: 474142 - DNA, 25 bp, Rattus norvegicus
cctctgctgttttgtcggttggaac

SEQ ID NO: 474143 - DNA, 25 bp, Rattus norvegicus
tggtcacagagaaaggtgcccgcta

SEQ ID NO: 474144 - DNA, 25 bp, Rattus norvegicus
ccttgcgagcgcttcatcagtttaa

SEQ ID NO: 474145 - DNA, 25 bp, Rattus norvegicus
gcgactgacctacctttttgctgta

SEQ ID NO: 474146 - DNA, 25 bp, Rattus norvegicus
ttgctgtagtccctagacgtcgttg

SEQ ID NO: 474147 - DNA, 25 bp, Rattus norvegicus
cccgatctgagaaggaagtcatgtc

SEQ ID NO: 474148 - DNA, 25 bp, Rattus norvegicus
ggccgccgtgtccaagtatgtgaac

SEQ ID NO: 474149 - DNA, 25 bp, Rattus norvegicus
tctccgcaggagaaagcctcgccgt

SEQ ID NO: 474150 - DNA, 25 bp, Rattus norvegicus
accggcgatactcgcggtcgtactc

SEQ ID NO: 474151 - DNA, 25 bp, Rattus norvegicus
tcaccggaggtcgtactacgcgatc

SEQ ID NO: 474152 - DNA, 25 bp, Rattus norvegicus
gcgctactatggcttcggccgaacc

SEQ ID NO: 474153 - DNA, 25 bp, Rattus norvegicus
ccgcgccagcttctagtattttcga

SEQ ID NO: 474154 - DNA, 25 bp, Rattus norvegicus
cccagatctcagaacggggcgttcc

SEQ ID NO: 474155 - DNA, 25 bp, Rattus norvegicus
aaactgacgccacgcgggagggcct

SEQ ID NO: 474156 - DNA, 25 bp, Rattus norvegicus
cctgactaatggcagcgggccagag

SEQ ID NO: 474157 - DNA, 25 bp, Rattus norvegicus
ccggaagtgttcagtgttgttgacg

SEQ ID NO: 474158 - DNA, 25 bp, Rattus norvegicus
ctgtaatggcggctgtgactgaagt

SEQ ID NO: 474159 - DNA, 25 bp, Rattus norvegicus
tgactgaagttgtggtgagtacctc

SEQ ID NO: 474160 - DNA, 25 bp, Rattus norvegicus
tacctccggcttcgcgtaggtgtta

SEQ ID NO: 474161 - DNA, 25 bp, Rattus norvegicus
acgtcgagcctgaagccgggtatga

SEQ ID NO: 474162 - DNA, 25 bp, Rattus norvegicus
tgaagccgggtatgaccgcaggtac

SEQ ID NO: 474163 - DNA, 25 bp, Rattus norvegicus
atgaccgcaggtacccgcggacggc

SEQ ID NO: 474164 - DNA, 25 bp, Rattus norvegicus
cgagagcagagactgcgcaagttcc

SEQ ID NO: 474165 - DNA, 25 bp, Rattus norvegicus
cgcaagttccgtgagctgcatctga

SEQ ID NO: 474166 - DNA, 25 bp, Rattus norvegicus
tccgtgagctgcatctgaagcgggt

SEQ ID NO: 474167 - DNA, 25 bp, Rattus norvegicus
tcccgggttatttgcgcctgcgcat

SEQ ID NO: 474168 - DNA, 25 bp, Rattus norvegicus
ggggatgtcacccagctggcaagac

SEQ ID NO: 474169 - DNA, 25 bp, Rattus norvegicus
cgctgcccgcaggacacggagattt

SEQ ID NO: 474170 - DNA, 25 bp, Rattus norvegicus
cactacaggagccagtacccggaac

SEQ ID NO: 474171 - DNA, 25 bp, Rattus norvegicus
taccagaagggcgtccaggagaact

SEQ ID NO: 474172 - DNA, 25 bp, Rattus norvegicus
gtgacatcagtcaggagagatacca

SEQ ID NO: 474173 - DNA, 25 bp, Rattus norvegicus
gtccagagagaaatatggtgacatc

SEQ ID NO: 474174 - DNA, 25 bp, Rattus norvegicus
ccaggcccggcagaacatgaaagga

SEQ ID NO: 474175 - DNA, 25 bp, Rattus norvegicus
cgcttcccgctctcgttggcgaaaa

SEQ ID NO: 474176 - DNA, 25 bp, Rattus norvegicus
gggatcactcggctagcagaacaca

SEQ ID NO: 474177 - DNA, 25 bp, Rattus norvegicus
acttggggagacctagctgctagga

SEQ ID NO: 474178 - DNA, 25 bp, Rattus norvegicus
caggagcccagacaagggaggactt

SEQ ID NO: 474179 - DNA, 25 bp, Rattus norvegicus
gccggtcgccttcaaggtgagtgca

SEQ ID NO: 474180 - DNA, 25 bp, Rattus norvegicus
gcgctgcaacaagacgctgccggtc

SEQ ID NO: 474181 - DNA, 25 bp, Rattus norvegicus
tgcctggtcacccacgctgcaggag

SEQ ID NO: 474182 - DNA, 25 bp, Rattus norvegicus
tcctaccagttctccatggcagctg

SEQ ID NO: 474183 - DNA, 25 bp, Rattus norvegicus
agcctcacagagagccgtttcccgg

SEQ ID NO: 474184 - DNA, 25 bp, Rattus norvegicus
tttcccgggcccaagggatgcacta

SEQ ID NO: 474185 - DNA, 25 bp, Rattus norvegicus
aagccgacggcagtcacagcaactc

SEQ ID NO: 474186 - DNA, 25 bp, Rattus norvegicus
ccaccggcgcttcggtgtcagcagg

SEQ ID NO: 474187 - DNA, 25 bp, Rattus norvegicus
gtttgatcgctccttccctacgctg

SEQ ID NO: 474188 - DNA, 25 bp, Rattus norvegicus
atggcacctcctccggctcctacca

SEQ ID NO: 474189 - DNA, 25 bp, Rattus norvegicus
ctgcgccctaccacctcttctatgg

SEQ ID NO: 474190 - DNA, 25 bp, Rattus norvegicus
tcagagcgggccctttcaggccaac

SEQ ID NO: 474191 - DNA, 25 bp, Rattus norvegicus
cccgcagagtcagagcgggcccttt

SEQ ID NO: 474192 - DNA, 25 bp, Rattus norvegicus
tacagtgccacaccatcgggaacca

SEQ ID NO: 474193 - DNA, 25 bp, Rattus norvegicus
cctacgctgcaaagcctcacagaga

SEQ ID NO: 474194 - DNA, 25 bp, Rattus norvegicus
agcaactcgcccacggccctgagca

SEQ ID NO: 474195 - DNA, 25 bp, Rattus norvegicus
ggcgcttcggtgtcagcaggcaatc

SEQ ID NO: 474196 - DNA, 25 bp, Rattus norvegicus
cgacgctgcggatctgaactgacaa

SEQ ID NO: 474197 - DNA, 25 bp, Rattus norvegicus
gcgtgaaccgatcttgcaccaggtg

SEQ ID NO: 474198 - DNA, 25 bp, Rattus norvegicus
aaccgatcttgcaccaggtgtcgcc

SEQ ID NO: 474199 - DNA, 25 bp, Rattus norvegicus
cctggtccctgggtgcgaagtgtca

SEQ ID NO: 474200 - DNA, 25 bp, Rattus norvegicus
aagtgtcgctcgctcgctacatggc

SEQ ID NO: 474201 - DNA, 25 bp, Rattus norvegicus
ctcgctacatggctgcgtccgttcg

SEQ ID NO: 474202 - DNA, 25 bp, Rattus norvegicus
tacatggctgcgtccgttcgccaca

SEQ ID NO: 474203 - DNA, 25 bp, Rattus norvegicus
tccgttcgccacaggaaggagggaa

SEQ ID NO: 474204 - DNA, 25 bp, Rattus norvegicus
gaggccggaggtgccttcacgacac

SEQ ID NO: 474205 - DNA, 25 bp, Rattus norvegicus
gaggtgccttcacgacacgccgcgg

SEQ ID NO: 474206 - DNA, 25 bp, Rattus norvegicus
cagatctgataaagaggaaggaagc

SEQ ID NO: 474207 - DNA, 25 bp, Rattus norvegicus
gcaaagggcccacgcgtgaaccgat

SEQ ID NO: 474208 - DNA, 25 bp, Rattus norvegicus
gctgcggatctgaactgacaactcc

SEQ ID NO: 474209 - DNA, 25 bp, Rattus norvegicus
gccgcggccctgacagatctgataa

SEQ ID NO: 474210 - DNA, 25 bp, Rattus norvegicus
tcactggacagtccgggcgtctagc

SEQ ID NO: 474211 - DNA, 25 bp, Rattus norvegicus
gcttcaaaccgctgggcggagcccg

SEQ ID NO: 474212 - DNA, 25 bp, Rattus norvegicus
ctccttcagtccgttcaggggcatc

SEQ ID NO: 474213 - DNA, 25 bp, Rattus norvegicus
ctagagccgcaaggactcatcgtcc

SEQ ID NO: 474214 - DNA, 25 bp, Rattus norvegicus
tggttggtgccaagtgacctcatgc

SEQ ID NO: 474215 - DNA, 25 bp, Rattus norvegicus
agtggcccagagcaataggatcttg

SEQ ID NO: 474216 - DNA, 25 bp, Rattus norvegicus
ggctgcggtcgctgccgcttcaaac

SEQ ID NO: 474217 - DNA, 25 bp, Rattus norvegicus
agctacccgtggctcagatcctcag

SEQ ID NO: 474218 - DNA, 25 bp, Rattus norvegicus
cgttcaggggcatcgacagcgccat

SEQ ID NO: 474219 - DNA, 25 bp, Rattus norvegicus
agagctcgatgaggggctctttgtc

SEQ ID NO: 474220 - DNA, 25 bp, Rattus norvegicus
gacggcgagcgctcaccttgacgaa

SEQ ID NO: 474221 - DNA, 25 bp, Rattus norvegicus
aggatcctccaaggtcccgctgcga

SEQ ID NO: 474222 - DNA, 25 bp, Rattus norvegicus
cttcaagtaagttgggtgagcaatc

SEQ ID NO: 474223 - DNA, 25 bp, Rattus norvegicus
agcgctctagcctaggtcgaccgac

SEQ ID NO: 474224 - DNA, 25 bp, Rattus norvegicus
ttgaccttcacagaggatacctgcg

SEQ ID NO: 474225 - DNA, 25 bp, Rattus norvegicus
tgcaagtacgtatatgtacacgcta

SEQ ID NO: 474226 - DNA, 25 bp, Rattus norvegicus
tgtacacgctatatgctacacgagc

SEQ ID NO: 474227 - DNA, 25 bp, Rattus norvegicus
tatgctacacgagcgtaaacaagag

SEQ ID NO: 474228 - DNA, 25 bp, Rattus norvegicus
gagccaacataaccagtgtcgttta

SEQ ID NO: 474229 - DNA, 25 bp, Rattus norvegicus
gtttaataaacgctaccacttcaga

SEQ ID NO: 474230 - DNA, 25 bp, Rattus norvegicus
gctaccacttcagaatccacgacga

SEQ ID NO: 474231 - DNA, 25 bp, Rattus norvegicus
tccacgacgacttcaaggccatgtc

SEQ ID NO: 474232 - DNA, 25 bp, Rattus norvegicus
tcaaggccatgtcgtgatttaaaca

SEQ ID NO: 474233 - DNA, 25 bp, Rattus norvegicus
gtgatttaaacatggctggtgcttc

SEQ ID NO: 474234 - DNA, 25 bp, Rattus norvegicus
ctggtgcttcagtgtttgggcagta

SEQ ID NO: 474235 - DNA, 25 bp, Rattus norvegicus
tgcttcagtgtttgggcagtagtgc

SEQ ID NO: 474236 - DNA, 25 bp, Rattus norvegicus
gccgggcatgttgaccttcacagag

SEQ ID NO: 474237 - DNA, 25 bp, Rattus norvegicus
cagaggatacctgcgggctctccca

SEQ ID NO: 474238 - DNA, 25 bp, Rattus norvegicus
gcgctactacttacgcggaagaatc

SEQ ID NO: 474239 - DNA, 25 bp, Rattus norvegicus
ccgccgcgaaagcttaagacccaga

SEQ ID NO: 474240 - DNA, 25 bp, Rattus norvegicus
tcgcagacacagctcgctctaaaag

SEQ ID NO: 474241 - DNA, 25 bp, Rattus norvegicus
ggggacattcgctttctccaaagct

SEQ ID NO: 474242 - DNA, 25 bp, Rattus norvegicus
cctagtgacttcctccttggggctc

SEQ ID NO: 474243 - DNA, 25 bp, Rattus norvegicus
gtgaggttcggctctagcccattcc

SEQ ID NO: 474244 - DNA, 25 bp, Rattus norvegicus
ccaatggaaataggagggcgaattc

SEQ ID NO: 474245 - DNA, 25 bp, Rattus norvegicus
cgtcctgtcccgaattttgagcgcc

SEQ ID NO: 474246 - DNA, 25 bp, Rattus norvegicus
gaagaatcccgcgtccatcttgctg

SEQ ID NO: 474247 - DNA, 25 bp, Rattus norvegicus
catcttgctgcctcgctcggagatc

SEQ ID NO: 474248 - DNA, 25 bp, Rattus norvegicus
ggagatcgctccctatcccagtgtg

SEQ ID NO: 474249 - DNA, 25 bp, Rattus norvegicus
atgcagctgcgcctgctcaatacgc

SEQ ID NO: 474250 - DNA, 25 bp, Rattus norvegicus
atacgccacgaggacgacacgcatg

SEQ ID NO: 474251 - DNA, 25 bp, Rattus norvegicus
cgatcccagaggaggagactgcgca

SEQ ID NO: 474252 - DNA, 25 bp, Rattus norvegicus
agcttcccgcatgccagagatgttg

SEQ ID NO: 474253 - DNA, 25 bp, Rattus norvegicus
tcctcccgtcgctagtgggaacttc

SEQ ID NO: 474254 - DNA, 25 bp, Rattus norvegicus
acttgagcctctgcgcgctgtcctt

SEQ ID NO: 474255 - DNA, 25 bp, Rattus norvegicus
cgcgagctatcttctccggacttga

SEQ ID NO: 474256 - DNA, 25 bp, Rattus norvegicus
gggacctcgcatagagccgcataga

SEQ ID NO: 474257 - DNA, 25 bp, Rattus norvegicus
cttctcttccgggagtccaggtcgc

SEQ ID NO: 474258 - DNA, 25 bp, Rattus norvegicus
ttgctgacctttcggctaccggctc

SEQ ID NO: 474259 - DNA, 25 bp, Rattus norvegicus
cgtctgcagacaaccgggaggtgtt

SEQ ID NO: 474260 - DNA, 25 bp, Rattus norvegicus
aatgcagccagctttggggcgcttc

SEQ ID NO: 474261 - DNA, 25 bp, Rattus norvegicus
caccggagcggataaggaaatcacc

SEQ ID NO: 474262 - DNA, 25 bp, Rattus norvegicus
agtgggaacttcaggtctgacaccc

SEQ ID NO: 474263 - DNA, 25 bp, Rattus norvegicus
cggcacccacttcttcgaggtcgga

SEQ ID NO: 474264 - DNA, 25 bp, Rattus norvegicus
tccaggtcgctaccggtgacttcac

SEQ ID NO: 474265 - DNA, 25 bp, Rattus norvegicus
cgcttcgaggcttgcaccctgaaca

SEQ ID NO: 474266 - DNA, 25 bp, Rattus norvegicus
gccgcgtctgcgtgattttctgttt

SEQ ID NO: 474267 - DNA, 25 bp, Rattus norvegicus
cccagcagctggacggatgcatcag

SEQ ID NO: 474268 - DNA, 25 bp, Rattus norvegicus
ctggacggatgcatcagcatcgctg

SEQ ID NO: 474269 - DNA, 25 bp, Rattus norvegicus
atgcatcagcatcgctgggctgcgc

SEQ ID NO: 474270 - DNA, 25 bp, Rattus norvegicus
gcaggcgcagcagccgctcacagtg

SEQ ID NO: 474271 - DNA, 25 bp, Rattus norvegicus
tcacagtgcacagtccagccgctca

SEQ ID NO: 474272 - DNA, 25 bp, Rattus norvegicus
tcactcagtgctgccgtgggagctt

SEQ ID NO: 474273 - DNA, 25 bp, Rattus norvegicus
tggactcggttcctgcgtgcagttc

SEQ ID NO: 474274 - DNA, 25 bp, Rattus norvegicus
ttggattttttgtgtcttcttcctc

SEQ ID NO: 474275 - DNA, 25 bp, Rattus norvegicus
tcctcttcggtttcgctctcacaga

SEQ ID NO: 474276 - DNA, 25 bp, Rattus norvegicus
ttcggtttcgctctcacagacgtgc

SEQ ID NO: 474277 - DNA, 25 bp, Rattus norvegicus
gtttcgctctcacagacgtgcacca

SEQ ID NO: 474278 - DNA, 25 bp, Rattus norvegicus
caccaccacactgggggtggactcg

SEQ ID NO: 474279 - DNA, 25 bp, Rattus norvegicus
agccgctcactcagtgctgccgtgg

SEQ ID NO: 474280 - DNA, 25 bp, Rattus norvegicus
gtcagcaccagcgcccaagttcaag

SEQ ID NO: 474281 - DNA, 25 bp, Rattus norvegicus
attttcctcgcggtcagcaccagcg

SEQ ID NO: 474282 - DNA, 25 bp, Rattus norvegicus
ccaagttcaagcctcgcgcggacgg

SEQ ID NO: 474283 - DNA, 25 bp, Rattus norvegicus
ggcgcggtctcaattctgccacctt

SEQ ID NO: 474284 - DNA, 25 bp, Rattus norvegicus
aggactgagacggggacaccagccc

SEQ ID NO: 474285 - DNA, 25 bp, Rattus norvegicus
gagagccagctcctcttccctctgg

SEQ ID NO: 474286 - DNA, 25 bp, Rattus norvegicus
ccactggactctggccagcgaggct

SEQ ID NO: 474287 - DNA, 25 bp, Rattus norvegicus
ggccacctctcgctcgcagtccgac

SEQ ID NO: 474288 - DNA, 25 bp, Rattus norvegicus
gcagtccgacgcctggcacagccct

SEQ ID NO: 474289 - DNA, 25 bp, Rattus norvegicus
gggcatgaagccactggagaaattt

SEQ ID NO: 474290 - DNA, 25 bp, Rattus norvegicus
aagccactggagaaatttttgaaga

SEQ ID NO: 474291 - DNA, 25 bp, Rattus norvegicus
tttttgaagaagcagacgtcgcaac

SEQ ID NO: 474292 - DNA, 25 bp, Rattus norvegicus
agcggcgtcagagcgtgtctcgcct

SEQ ID NO: 474293 - DNA, 25 bp, Rattus norvegicus
gtcagagcgtgtctcgcctgctgct

SEQ ID NO: 474294 - DNA, 25 bp, Rattus norvegicus
tcaccaggtgtgtgactgcacccgc

SEQ ID NO: 474295 - DNA, 25 bp, Rattus norvegicus
cgcgacccagaaacctttgctttct

SEQ ID NO: 474296 - DNA, 25 bp, Rattus norvegicus
cgaagggaagactcacctgtgcgct

SEQ ID NO: 474297 - DNA, 25 bp, Rattus norvegicus
cggacagactttcaccgccgggagc

SEQ ID NO: 474298 - DNA, 25 bp, Rattus norvegicus
cagccggctacacgggcggtgacct

SEQ ID NO: 474299 - DNA, 25 bp, Rattus norvegicus
cctggctctccgcactggctgtgag

SEQ ID NO: 474300 - DNA, 25 bp, Rattus norvegicus
ctgaggcgttatgggacctcccaaa

SEQ ID NO: 474301 - DNA, 25 bp, Rattus norvegicus
tgctttctcttcttgctaccttgcg

SEQ ID NO: 474302 - DNA, 25 bp, Rattus norvegicus
accttgcgtgacagtggcaggaaca

SEQ ID NO: 474303 - DNA, 25 bp, Rattus norvegicus
caggaacagctagcaggggacacta

SEQ ID NO: 474304 - DNA, 25 bp, Rattus norvegicus
caggggacactaggaacccttctca

SEQ ID NO: 474305 - DNA, 25 bp, Rattus norvegicus
ttcctgtgagcttcacccggggtag

SEQ ID NO: 474306 - DNA, 25 bp, Rattus norvegicus
cccgtcgcccattagaggcgaaggc

SEQ ID NO: 474307 - DNA, 25 bp, Rattus norvegicus
ggaaccctaaggctgaggcgttatg

SEQ ID NO: 474308 - DNA, 25 bp, Rattus norvegicus
cttcaatatcgaaacccagcagagc

SEQ ID NO: 474309 - DNA, 25 bp, Rattus norvegicus
ccagcagagccctgacgtgtctcgg

SEQ ID NO: 474310 - DNA, 25 bp, Rattus norvegicus
tcattttcctgcacgcgccattcag

SEQ ID NO: 474311 - DNA, 25 bp, Rattus norvegicus
tccagggcgctcattttcctgcacg

SEQ ID NO: 474312 - DNA, 25 bp, Rattus norvegicus
ctgcgtcccacctgttggctgtatt

SEQ ID NO: 474313 - DNA, 25 bp, Rattus norvegicus
acctgttggctgtattgcgtcctta

SEQ ID NO: 474314 - DNA, 25 bp, Rattus norvegicus
tgtattgcgtccttaatctcccagc

SEQ ID NO: 474315 - DNA, 25 bp, Rattus norvegicus
ccgctgctgtttcccaggggttccg

SEQ ID NO: 474316 - DNA, 25 bp, Rattus norvegicus
caggggttccgctgtgaccatgaac

SEQ ID NO: 474317 - DNA, 25 bp, Rattus norvegicus
cgcaggctgcgttaactgtcaccga

SEQ ID NO: 474318 - DNA, 25 bp, Rattus norvegicus
tgcgttaactgtcaccgactgtccc

SEQ ID NO: 474319 - DNA, 25 bp, Rattus norvegicus
gcttctatcaggtagcttcaatatc

SEQ ID NO: 474320 - DNA, 25 bp, Rattus norvegicus
atgaacctgcgcgtggagcttccag

SEQ ID NO: 474321 - DNA, 25 bp, Rattus norvegicus
ctgtgaccatgaacctgcgcgtgga

SEQ ID NO: 474322 - DNA, 25 bp, Rattus norvegicus
ttccttctccgaggttccggcgatc

SEQ ID NO: 474323 - DNA, 25 bp, Rattus norvegicus
tcgcttgtctctaattctcctgtga

SEQ ID NO: 474324 - DNA, 25 bp, Rattus norvegicus
tccctgcccggggaagcgtttgctc

SEQ ID NO: 474325 - DNA, 25 bp, Rattus norvegicus
ttggctggaagcacaggtgccgact

SEQ ID NO: 474326 - DNA, 25 bp, Rattus norvegicus
ctcctgttggctcgcaggcgctgct

SEQ ID NO: 474327 - DNA, 25 bp, Rattus norvegicus
ttctcctgtgacacagacattccct

SEQ ID NO: 474328 - DNA, 25 bp, Rattus norvegicus
aagcgtttgctcgacggtgcgctct

SEQ ID NO: 474329 - DNA, 25 bp, Rattus norvegicus
aggcgctgctgatcgcttgtctcta

SEQ ID NO: 474330 - DNA, 25 bp, Rattus norvegicus
aggttccggcgatccggctcctgtt

SEQ ID NO: 474331 - DNA, 25 bp, Rattus norvegicus
gttcattcgacatcttccttctccg

SEQ ID NO: 474332 - DNA, 25 bp, Rattus norvegicus
ccgcggctttactcactcaagttca

SEQ ID NO: 474333 - DNA, 25 bp, Rattus norvegicus
gaggccaggcatccgcggctttact

SEQ ID NO: 474334 - DNA, 25 bp, Rattus norvegicus
cggtgcgctctggatgttgagattt

SEQ ID NO: 474335 - DNA, 25 bp, Rattus norvegicus
ttgagattttgctgacagcggtccc

SEQ ID NO: 474336 - DNA, 25 bp, Rattus norvegicus
ttgcttggtccttggacggcctttc

SEQ ID NO: 474337 - DNA, 25 bp, Rattus norvegicus
cttggtccttggacggcctttcctg

SEQ ID NO: 474338 - DNA, 25 bp, Rattus norvegicus
tcgccgcgggtttgcttggtccttg

SEQ ID NO: 474339 - DNA, 25 bp, Rattus norvegicus
caaggaccctttgcgttcgccgcgg

SEQ ID NO: 474340 - DNA, 25 bp, Rattus norvegicus
tgggcctcaaggaccctttgcgttc

SEQ ID NO: 474341 - DNA, 25 bp, Rattus norvegicus
gaagatgtgtcacccgtggtctgga

SEQ ID NO: 474342 - DNA, 25 bp, Rattus norvegicus
cggggacagcgaagatgtgtcaccc

SEQ ID NO: 474343 - DNA, 25 bp, Rattus norvegicus
aagcgccctaggtaagcacgttccg

SEQ ID NO: 474344 - DNA, 25 bp, Rattus norvegicus
ttcctgatgcaaagcgccctaggta

SEQ ID NO: 474345 - DNA, 25 bp, Rattus norvegicus
cctgttcctgatgcaaagcgcccta

SEQ ID NO: 474346 - DNA, 25 bp, Rattus norvegicus
ccctactcctgttcctgatgcaaag

SEQ ID NO: 474347 - DNA, 25 bp, Rattus norvegicus
cctcgggaccgaaatgtggcgggct

SEQ ID NO: 474348 - DNA, 25 bp, Rattus norvegicus
cgcgaggcggccctaggtgaatccc

SEQ ID NO: 474349 - DNA, 25 bp, Rattus norvegicus
taggtaagcacgttccgcggggaca

SEQ ID NO: 474350 - DNA, 25 bp, Rattus norvegicus
cccgcgtgctcgtggctggtccagt

SEQ ID NO: 474351 - DNA, 25 bp, Rattus norvegicus
gctcccgtttgccaatatgagaaga

SEQ ID NO: 474352 - DNA, 25 bp, Rattus norvegicus
ggcgggaaaatgaagcgctaaagaa

SEQ ID NO: 474353 - DNA, 25 bp, Rattus norvegicus
gcccggagccaatgaacaggagcga

SEQ ID NO: 474354 - DNA, 25 bp, Rattus norvegicus
ggcagttgccgtagcggagccctct

SEQ ID NO: 474355 - DNA, 25 bp, Rattus norvegicus
gacggtttgccgagcccgttagcgc

SEQ ID NO: 474356 - DNA, 25 bp, Rattus norvegicus
caacacgtctctgttcgtcagaaac

SEQ ID NO: 474357 - DNA, 25 bp, Rattus norvegicus
cgtcagaaacgtggcggacgacacc

SEQ ID NO: 474358 - DNA, 25 bp, Rattus norvegicus
gcggacgacaccaggtgagcgcacc

SEQ ID NO: 474359 - DNA, 25 bp, Rattus norvegicus
tcctcattgatcagacgtccacgtt

SEQ ID NO: 474360 - DNA, 25 bp, Rattus norvegicus
gagcccattcgagccgaaccgctga

SEQ ID NO: 474361 - DNA, 25 bp, Rattus norvegicus
gggccggatgtctgttcctcattga

SEQ ID NO: 474362 - DNA, 25 bp, Rattus norvegicus
gtccacgttccatgaggtgcacgcc

SEQ ID NO: 474363 - DNA, 25 bp, Rattus norvegicus
ggacccggagcccattcgagccgaa

SEQ ID NO: 474364 - DNA, 25 bp, Rattus norvegicus
ataactgcccagcttcgggagccgc

SEQ ID NO: 474365 - DNA, 25 bp, Rattus norvegicus
agctgctcttctgttggcctctgtg

SEQ ID NO: 474366 - DNA, 25 bp, Rattus norvegicus
aggcccaacaatggtgcccgctgtg

SEQ ID NO: 474367 - DNA, 25 bp, Rattus norvegicus
ctctccagggagaaacgatgcacgg

SEQ ID NO: 474368 - DNA, 25 bp, Rattus norvegicus
gatgcacggaccaaacagcccacga

SEQ ID NO: 474369 - DNA, 25 bp, Rattus norvegicus
cgagcgagtcccagatcacaacttc

SEQ ID NO: 474370 - DNA, 25 bp, Rattus norvegicus
ttggaccaacctcctactgccttta

SEQ ID NO: 474371 - DNA, 25 bp, Rattus norvegicus
ttaccgacaaaatggaggctgctgc

SEQ ID NO: 474372 - DNA, 25 bp, Rattus norvegicus
aggatcggagactgtgcagccaatg

SEQ ID NO: 474373 - DNA, 25 bp, Rattus norvegicus
tgcagccaatgaggacgcagcagcg

SEQ ID NO: 474374 - DNA, 25 bp, Rattus norvegicus
cagcgcgtgccgcagccaatgagat

SEQ ID NO: 474375 - DNA, 25 bp, Rattus norvegicus
atggctgttgtcgtggtttgaaatc

SEQ ID NO: 474376 - DNA, 25 bp, Rattus norvegicus
ctcaccgacttcgagttcgggcggc

SEQ ID NO: 474377 - DNA, 25 bp, Rattus norvegicus
ggagcatgtcgggaataactgccca

SEQ ID NO: 474378 - DNA, 25 bp, Rattus norvegicus
cggtgctgcctgacctcgaaaggcc

SEQ ID NO: 474379 - DNA, 25 bp, Rattus norvegicus
cgccgactttgcaccgcagtttaca

SEQ ID NO: 474380 - DNA, 25 bp, Rattus norvegicus
acggccttctggaccgccatactga

SEQ ID NO: 474381 - DNA, 25 bp, Rattus norvegicus
ccaagccaatcgttactctgagagg

SEQ ID NO: 474382 - DNA, 25 bp, Rattus norvegicus
actctccggtgcctgcgcattaaga

SEQ ID NO: 474383 - DNA, 25 bp, Rattus norvegicus
ttctgctgctactggcagcttcggc

SEQ ID NO: 474384 - DNA, 25 bp, Rattus norvegicus
ctacactccggactggccgagcttg

SEQ ID NO: 474385 - DNA, 25 bp, Rattus norvegicus
tggactcgcgaccactgccgagatg

SEQ ID NO: 474386 - DNA, 25 bp, Rattus norvegicus
ccgagatggttcgacgaggccaagt

SEQ ID NO: 474387 - DNA, 25 bp, Rattus norvegicus
ccaagttcgggttgttcgtgcattg

SEQ ID NO: 474388 - DNA, 25 bp, Rattus norvegicus
gtcggcgtacgtgcgcttcatgaaa

SEQ ID NO: 474389 - DNA, 25 bp, Rattus norvegicus
gcgcttcatgaaagaaaactacccg

SEQ ID NO: 474390 - DNA, 25 bp, Rattus norvegicus
cggcttcagctacgccgactttgca

SEQ ID NO: 474391 - DNA, 25 bp, Rattus norvegicus
ttacagcgcgcttcttccatccgga

SEQ ID NO: 474392 - DNA, 25 bp, Rattus norvegicus
gggcaccaatcctaccgcgtgttca

SEQ ID NO: 474393 - DNA, 25 bp, Rattus norvegicus
gtctagggagctccagtgcgagtcc

SEQ ID NO: 474394 - DNA, 25 bp, Rattus norvegicus
gctagccgagcctttggggtcaccc

SEQ ID NO: 474395 - DNA, 25 bp, Rattus norvegicus
gctccgagattccagggtcgtcctc

SEQ ID NO: 474396 - DNA, 25 bp, Rattus norvegicus
caggcctatggcacggccggactag

SEQ ID NO: 474397 - DNA, 25 bp, Rattus norvegicus
ccggtggacagcaggcctatggcac

SEQ ID NO: 474398 - DNA, 25 bp, Rattus norvegicus
ttgcctatggtcagccggtggacag

SEQ ID NO: 474399 - DNA, 25 bp, Rattus norvegicus
cgcagcatgttgttgcctatggtca

SEQ ID NO: 474400 - DNA, 25 bp, Rattus norvegicus
ccatccaacccgcagcatgttgttg

SEQ ID NO: 474401 - DNA, 25 bp, Rattus norvegicus
tttggccgctgctgcaaaccgacag

SEQ ID NO: 474402 - DNA, 25 bp, Rattus norvegicus
ctgtagtgtaaagtcgctttttggc

SEQ ID NO: 474403 - DNA, 25 bp, Rattus norvegicus
cctctctgactgctactgtagtgta

SEQ ID NO: 474404 - DNA, 25 bp, Rattus norvegicus
tccgggaggagcaggcctcgacttc

SEQ ID NO: 474405 - DNA, 25 bp, Rattus norvegicus
atcctaccgcgtgttcaacttaagg

SEQ ID NO: 474406 - DNA, 25 bp, Rattus norvegicus
tgaaggacgccaacacaagccaatc

SEQ ID NO: 474407 - DNA, 25 bp, Rattus norvegicus
cggacagatgaccagaccagacctg

SEQ ID NO: 474408 - DNA, 25 bp, Rattus norvegicus
atcgcgagctgctctagggactgca

SEQ ID NO: 474409 - DNA, 25 bp, Rattus norvegicus
ccttgctgagtgctctagggacacc

SEQ ID NO: 474410 - DNA, 25 bp, Rattus norvegicus
gcctcggacgactagcacaagcgtg

SEQ ID NO: 474411 - DNA, 25 bp, Rattus norvegicus
cctgcgactcctttggctgccagga

SEQ ID NO: 474412 - DNA, 25 bp, Rattus norvegicus
caatcccaaggacctctggcagggg

SEQ ID NO: 474413 - DNA, 25 bp, Rattus norvegicus
taagcttgtcttttgctgcgcagtg

SEQ ID NO: 474414 - DNA, 25 bp, Rattus norvegicus
cttgtggctttctagtctgccttga

SEQ ID NO: 474415 - DNA, 25 bp, Rattus norvegicus
ttgatcctctggaacgtggcaaacg

SEQ ID NO: 474416 - DNA, 25 bp, Rattus norvegicus
gcaaacgtggaagcccgcaggactc

SEQ ID NO: 474417 - DNA, 25 bp, Rattus norvegicus
ttggcgctctggttccaacggaatg

SEQ ID NO: 474418 - DNA, 25 bp, Rattus norvegicus
cgcgcacacaggagcctcgctaagg

SEQ ID NO: 474419 - DNA, 25 bp, Rattus norvegicus
agccctccgcaggactaagcttgtc

SEQ ID NO: 474420 - DNA, 25 bp, Rattus norvegicus
ccgcccacataggtgtcggcggtca

SEQ ID NO: 474421 - DNA, 25 bp, Rattus norvegicus
cttggcgtccctccgggctgtaagt

SEQ ID NO: 474422 - DNA, 25 bp, Rattus norvegicus
ggcttggcgtccctccgggctgtaa

SEQ ID NO: 474423 - DNA, 25 bp, Rattus norvegicus
ctttcccacagaggctggtgggctt

SEQ ID NO: 474424 - DNA, 25 bp, Rattus norvegicus
aaggctttcccacagaggctggtgg

SEQ ID NO: 474425 - DNA, 25 bp, Rattus norvegicus
ggaaggctttcccacagaggctggt

SEQ ID NO: 474426 - DNA, 25 bp, Rattus norvegicus
tgaggaaggctttcccacagaggct

SEQ ID NO: 474427 - DNA, 25 bp, Rattus norvegicus
cgacagtgaggaaggctttcccaca

SEQ ID NO: 474428 - DNA, 25 bp, Rattus norvegicus
tggcgacagtgaggaaggctttccc

SEQ ID NO: 474429 - DNA, 25 bp, Rattus norvegicus
ccacccgagactccgggcgaagatg

SEQ ID NO: 474430 - DNA, 25 bp, Rattus norvegicus
tcacgtggtacccaggggcggccac

SEQ ID NO: 474431 - DNA, 25 bp, Rattus norvegicus
ccacataggtgtcggcggtcacgtg

SEQ ID NO: 474432 - DNA, 25 bp, Rattus norvegicus
ctgtaagtgccccaggcgggtgaca

SEQ ID NO: 474433 - DNA, 25 bp, Rattus norvegicus
cccacataggtgtcggcggtcacgt

SEQ ID NO: 474434 - DNA, 25 bp, Rattus norvegicus
tcttgccacagtcgaggcagtggta

SEQ ID NO: 474435 - DNA, 25 bp, Rattus norvegicus
gcgtgcgattatgtgcgatgagatt

SEQ ID NO: 474436 - DNA, 25 bp, Rattus norvegicus
agattggagcgctggctgaagcact

SEQ ID NO: 474437 - DNA, 25 bp, Rattus norvegicus
cagagctctgggtgaagcacttgcc

SEQ ID NO: 474438 - DNA, 25 bp, Rattus norvegicus
aagcacttgccgcaaatggggcact

SEQ ID NO: 474439 - DNA, 25 bp, Rattus norvegicus
tgccctggtgtgtgactaggtccga

SEQ ID NO: 474440 - DNA, 25 bp, Rattus norvegicus
agcgcttggcacagcggtcgcacac

SEQ ID NO: 474441 - DNA, 25 bp, Rattus norvegicus
ggtcgcacacgtagggcttctcacc

SEQ ID NO: 474442 - DNA, 25 bp, Rattus norvegicus
gctgaagctcttccaacacgagggg

SEQ ID NO: 474443 - DNA, 25 bp, Rattus norvegicus
tccgtgcaggtataaggcttctcgc

SEQ ID NO: 474444 - DNA, 25 bp, Rattus norvegicus
gtgtcaccaggtgcgagtgccaact

SEQ ID NO: 474445 - DNA, 25 bp, Rattus norvegicus
gagtgccaactgaagcccttgccgc

SEQ ID NO: 474446 - DNA, 25 bp, Rattus norvegicus
tgccgcactgttcgcacttgtatgt

SEQ ID NO: 474447 - DNA, 25 bp, Rattus norvegicus
gtatgtcttcttgccagtgtcgctg

SEQ ID NO: 474448 - DNA, 25 bp, Rattus norvegicus
ttcgactggtagaatgaagggctta

SEQ ID NO: 474449 - DNA, 25 bp, Rattus norvegicus
actgcgcagtcgcttaaagcctgtg

SEQ ID NO: 474450 - DNA, 25 bp, Rattus norvegicus
gtgcaagccatttgtccctccaggg

SEQ ID NO: 474451 - DNA, 25 bp, Rattus norvegicus
cgtagagtgggcaaccgagtacaca

SEQ ID NO: 474452 - DNA, 25 bp, Rattus norvegicus
cgagtacacacgtttcctggagggc

SEQ ID NO: 474453 - DNA, 25 bp, Rattus norvegicus
ggatcctctgcaggttcgactggta

SEQ ID NO: 474454 - DNA, 25 bp, Rattus norvegicus
gctcgtgttttccatagccatagtg

SEQ ID NO: 474455 - DNA, 25 bp, Rattus norvegicus
cctcgcccgtggtgttgaaagtcag

SEQ ID NO: 474456 - DNA, 25 bp, Rattus norvegicus
gtgttgaaagtcagcacccgctctc

SEQ ID NO: 474457 - DNA, 25 bp, Rattus norvegicus
tcccttgtacagaccacgaaaactg

SEQ ID NO: 474458 - DNA, 25 bp, Rattus norvegicus
gtcctcgagcaatgcgggaactgta

SEQ ID NO: 474459 - DNA, 25 bp, Rattus norvegicus
tagagaccggggatctcactcaggc

SEQ ID NO: 474460 - DNA, 25 bp, Rattus norvegicus
gccctcaatggaaacgcactgcgca

SEQ ID NO: 474461 - DNA, 25 bp, Rattus norvegicus
cgagtcccagctcagaaccgaagtc

SEQ ID NO: 474462 - DNA, 25 bp, Rattus norvegicus
tcccagaactggacagcgccctcca

SEQ ID NO: 474463 - DNA, 25 bp, Rattus norvegicus
cgcggccgctctcccgccacgcgcg

SEQ ID NO: 474464 - DNA, 25 bp, Rattus norvegicus
tggcccggccgtcccagaactggac

SEQ ID NO: 474465 - DNA, 25 bp, Rattus norvegicus
cccgggaccctcacagcctcgctgc

SEQ ID NO: 474466 - DNA, 25 bp, Rattus norvegicus
gcctcgctgcgcgatcgcctgggta

SEQ ID NO: 474467 - DNA, 25 bp, Rattus norvegicus
tgcgcgatcgcctgggtacctcact

SEQ ID NO: 474468 - DNA, 25 bp, Rattus norvegicus
gtcccgggaacccagccatcctgct

SEQ ID NO: 474469 - DNA, 25 bp, Rattus norvegicus
gagcttccgcgaccgttcgggcgat

SEQ ID NO: 474470 - DNA, 25 bp, Rattus norvegicus
ttccgcgaccgttcgggcgattctc

SEQ ID NO: 474471 - DNA, 25 bp, Rattus norvegicus
atcctgctgccggaagtagcccggc

SEQ ID NO: 474472 - DNA, 25 bp, Rattus norvegicus
agccatcctgctgccggaagtagcc

SEQ ID NO: 474473 - DNA, 25 bp, Rattus norvegicus
gctgccggaagtagcccggccaaca

SEQ ID NO: 474474 - DNA, 25 bp, Rattus norvegicus
ctgggtacctcactcccaggagctt

SEQ ID NO: 474475 - DNA, 25 bp, Rattus norvegicus
gaagtagcccggccaacagtacgga

SEQ ID NO: 474476 - DNA, 25 bp, Rattus norvegicus
tacagttcaagcgtggaagctgacg

SEQ ID NO: 474477 - DNA, 25 bp, Rattus norvegicus
tgccctcgcggctctcattgaggca

SEQ ID NO: 474478 - DNA, 25 bp, Rattus norvegicus
attgaggcactgcagtcgctccagg

SEQ ID NO: 474479 - DNA, 25 bp, Rattus norvegicus
tcgctccaggtcgatgcgcaggtac

SEQ ID NO: 474480 - DNA, 25 bp, Rattus norvegicus
atgcgcaggtacagcccgtaggcca

SEQ ID NO: 474481 - DNA, 25 bp, Rattus norvegicus
gcgccgcgaccgaagcgtcgtaaaa

SEQ ID NO: 474482 - DNA, 25 bp, Rattus norvegicus
tggggatgagtgatacagttcaagc

SEQ ID NO: 474483 - DNA, 25 bp, Rattus norvegicus
acgcgtagcagggacgcgaatcctc

SEQ ID NO: 474484 - DNA, 25 bp, Rattus norvegicus
ccctccggaacaaagcgtgcgcttt

SEQ ID NO: 474485 - DNA, 25 bp, Rattus norvegicus
ggcctcagttcctctgtctggctac

SEQ ID NO: 474486 - DNA, 25 bp, Rattus norvegicus
atggaggcgacgcacccaactgctc

SEQ ID NO: 474487 - DNA, 25 bp, Rattus norvegicus
ctctctccggagtggtgaataaggc

SEQ ID NO: 474488 - DNA, 25 bp, Rattus norvegicus
gggacctgcgccagcaaagcttgac

SEQ ID NO: 474489 - DNA, 25 bp, Rattus norvegicus
gtgcgctttcttccctaagcggcca

SEQ ID NO: 474490 - DNA, 25 bp, Rattus norvegicus
caggcacccgagttccaggcgcaga

SEQ ID NO: 474491 - DNA, 25 bp, Rattus norvegicus
agtcacagcacagctcaggtcacgc

SEQ ID NO: 474492 - DNA, 25 bp, Rattus norvegicus
agcgcgaatggtcccttccgggcct

SEQ ID NO: 474493 - DNA, 25 bp, Rattus norvegicus
aactgggctcgcgtagcgtcctcgg

SEQ ID NO: 474494 - DNA, 25 bp, Rattus norvegicus
acatcacggcgaccaagtcacagca

SEQ ID NO: 474495 - DNA, 25 bp, Rattus norvegicus
cctcgccggaactgggctcgcgtag

SEQ ID NO: 474496 - DNA, 25 bp, Rattus norvegicus
ctgctcaccttcttggggtccgggt

SEQ ID NO: 474497 - DNA, 25 bp, Rattus norvegicus
tcgagtcctcagcactcagtcgggg

SEQ ID NO: 474498 - DNA, 25 bp, Rattus norvegicus
accggcaaacagctggcgcgactgc

SEQ ID NO: 474499 - DNA, 25 bp, Rattus norvegicus
tcgctcggctaggaccggcaaacag

SEQ ID NO: 474500 - DNA, 25 bp, Rattus norvegicus
accagcggacagagtcgctcggcta

SEQ ID NO: 474501 - DNA, 25 bp, Rattus norvegicus
cagagctcaaaaacccaaggcgttc

SEQ ID NO: 474502 - DNA, 25 bp, Rattus norvegicus
ttccaggcgcagagctcaaaaaccc

SEQ ID NO: 474503 - DNA, 25 bp, Rattus norvegicus
agacggaagcgcgaatggtcccttc

SEQ ID NO: 474504 - DNA, 25 bp, Rattus norvegicus
tgcggtgccgcacactaacattcag

SEQ ID NO: 474505 - DNA, 25 bp, Rattus norvegicus
caggggtcgcgcaaagatcccggac

SEQ ID NO: 474506 - DNA, 25 bp, Rattus norvegicus
tccacgttcactccctttgtttcaa

SEQ ID NO: 474507 - DNA, 25 bp, Rattus norvegicus
atgcacactgcggtgccgcacacta

SEQ ID NO: 474508 - DNA, 25 bp, Rattus norvegicus
tgcacactgcggtgccgcacactaa

SEQ ID NO: 474509 - DNA, 25 bp, Rattus norvegicus
actgcggtgccgcacactaacattc

SEQ ID NO: 474510 - DNA, 25 bp, Rattus norvegicus
agtgggattccacgttcactccctt

SEQ ID NO: 474511 - DNA, 25 bp, Rattus norvegicus
cggtgccgcacactaacattcagga

SEQ ID NO: 474512 - DNA, 25 bp, Rattus norvegicus
tgggattccacgttcactccctttg

SEQ ID NO: 474513 - DNA, 25 bp, Rattus norvegicus
gccgcacactaacattcaggattca

SEQ ID NO: 474514 - DNA, 25 bp, Rattus norvegicus
cattcaggattcacaccaacgtacc

SEQ ID NO: 474515 - DNA, 25 bp, Rattus norvegicus
atggagtgggattccacgttcactc

SEQ ID NO: 474516 - DNA, 25 bp, Rattus norvegicus
ccaggggtcgcgcaaagatcccgga

SEQ ID NO: 474517 - DNA, 25 bp, Rattus norvegicus
gtgccgcacactaacattcaggatt

SEQ ID NO: 474518 - DNA, 25 bp, Rattus norvegicus
gctcggcacattccgctcgcgctcc

SEQ ID NO: 474519 - DNA, 25 bp, Rattus norvegicus
cgtcctcctccagccaccggcgaaa

SEQ ID NO: 474520 - DNA, 25 bp, Rattus norvegicus
ttaatgccaccagcatcgcgggctc

SEQ ID NO: 474521 - DNA, 25 bp, Rattus norvegicus
tgccggtcttaatgccaccagcatc

SEQ ID NO: 474522 - DNA, 25 bp, Rattus norvegicus
gcccgcacagccctgccggtcttaa

SEQ ID NO: 474523 - DNA, 25 bp, Rattus norvegicus
acgggcgagccctgcgcccgcacag

SEQ ID NO: 474524 - DNA, 25 bp, Rattus norvegicus
cccattcctacgatgggcggcgacg

SEQ ID NO: 474525 - DNA, 25 bp, Rattus norvegicus
cagagagctcggcacattccgctcg

SEQ ID NO: 474526 - DNA, 25 bp, Rattus norvegicus
gcgtctgggccctcggggccgctga

SEQ ID NO: 474527 - DNA, 25 bp, Rattus norvegicus
gagagctcggcacattccgctcgcg

SEQ ID NO: 474528 - DNA, 25 bp, Rattus norvegicus
accggcgaaacagccctcgtgggct

SEQ ID NO: 474529 - DNA, 25 bp, Rattus norvegicus
tgccaccagcatcgcgggctccgtc

SEQ ID NO: 474530 - DNA, 25 bp, Rattus norvegicus
tgacctgagccccattcctacgatg

SEQ ID NO: 474531 - DNA, 25 bp, Rattus norvegicus
gtcttaatgccaccagcatcgcggg

SEQ ID NO: 474532 - DNA, 25 bp, Rattus norvegicus
actggctggagaagctatttttcac

SEQ ID NO: 474533 - DNA, 25 bp, Rattus norvegicus
ctgcggccgtcggagcagccacatt

SEQ ID NO: 474534 - DNA, 25 bp, Rattus norvegicus
cagctgcgcgccaacgctggggtgg

SEQ ID NO: 474535 - DNA, 25 bp, Rattus norvegicus
gcgattgtgtgtcccgcagctgcgc

SEQ ID NO: 474536 - DNA, 25 bp, Rattus norvegicus
gcttttgttgaacgaggggctgctc

SEQ ID NO: 474537 - DNA, 25 bp, Rattus norvegicus
ctgttgtgggaaaagaaagcggctt

SEQ ID NO: 474538 - DNA, 25 bp, Rattus norvegicus
cctggtctttaatctgttgtgggaa

SEQ ID NO: 474539 - DNA, 25 bp, Rattus norvegicus
tggctggagaagctatttttcaccc

SEQ ID NO: 474540 - DNA, 25 bp, Rattus norvegicus
attcgccatcaaagcgtccccaaag

SEQ ID NO: 474541 - DNA, 25 bp, Rattus norvegicus
gtttcccacacattcgccatcaaag

SEQ ID NO: 474542 - DNA, 25 bp, Rattus norvegicus
gcgctggcaggagacccaagcgagc

SEQ ID NO: 474543 - DNA, 25 bp, Rattus norvegicus
gggtttcccacacattcgccatcaa

SEQ ID NO: 474544 - DNA, 25 bp, Rattus norvegicus
ggagcagccacattcctccgggttt

SEQ ID NO: 474545 - DNA, 25 bp, Rattus norvegicus
ccctcctggtctttaatctgttgtg

SEQ ID NO: 474546 - DNA, 25 bp, Rattus norvegicus
tccaggtacgagagggagctagacc

SEQ ID NO: 474547 - DNA, 25 bp, Rattus norvegicus
gagccttggcgatctgttttgaata

SEQ ID NO: 474548 - DNA, 25 bp, Rattus norvegicus
ggtgtgtcctagagcggattctata

SEQ ID NO: 474549 - DNA, 25 bp, Rattus norvegicus
ggattctataagagcggcccgctgc

SEQ ID NO: 474550 - DNA, 25 bp, Rattus norvegicus
agcgtgcgcacagtttgctgcttta

SEQ ID NO: 474551 - DNA, 25 bp, Rattus norvegicus
acctccaacatgaaggcgctgagcc

SEQ ID NO: 474552 - DNA, 25 bp, Rattus norvegicus
cctgtcggaacgtagcctagccatt

SEQ ID NO: 474553 - DNA, 25 bp, Rattus norvegicus
ccgcttagcctcttggacgacatga

SEQ ID NO: 474554 - DNA, 25 bp, Rattus norvegicus
actcagcttagccaggtggaaatcc

SEQ ID NO: 474555 - DNA, 25 bp, Rattus norvegicus
cctgcagcgtgtcatagactacatc

SEQ ID NO: 474556 - DNA, 25 bp, Rattus norvegicus
ccttcaagtggttctggcagagccc

SEQ ID NO: 474557 - DNA, 25 bp, Rattus norvegicus
tggtccgcatctcccgatccaggta

SEQ ID NO: 474558 - DNA, 25 bp, Rattus norvegicus
ggtatcagctcttcctcattccgcg

SEQ ID NO: 474559 - DNA, 25 bp, Rattus norvegicus
gctagaccaggctcatctgaacgtg

SEQ ID NO: 474560 - DNA, 25 bp, Rattus norvegicus
tgagccctcagttccattagcgccg

SEQ ID NO: 474561 - DNA, 25 bp, Rattus norvegicus
aacatgggcttggaagaagagctgc

SEQ ID NO: 474562 - DNA, 25 bp, Rattus norvegicus
gctgctgaggatcgccaaaaaactg

SEQ ID NO: 474563 - DNA, 25 bp, Rattus norvegicus
agacggtgaggctgcaaagtttgca

SEQ ID NO: 474564 - DNA, 25 bp, Rattus norvegicus
ggggagtctcccagatacttgctgg

SEQ ID NO: 474565 - DNA, 25 bp, Rattus norvegicus
gcagcttgcgccgagcagagaaagc

SEQ ID NO: 474566 - DNA, 25 bp, Rattus norvegicus
gggacacattttgggtgacttcgaa

SEQ ID NO: 474567 - DNA, 25 bp, Rattus norvegicus
aagatcggagaacctcgggctgaga

SEQ ID NO: 474568 - DNA, 25 bp, Rattus norvegicus
cctacgagactcctagctggggtgc

SEQ ID NO: 474569 - DNA, 25 bp, Rattus norvegicus
caggagttctgtttgcaactttttc

SEQ ID NO: 474570 - DNA, 25 bp, Rattus norvegicus
ccaccgagcgtcgtggaccaacatg

SEQ ID NO: 474571 - DNA, 25 bp, Rattus norvegicus
gccgctgctgcaagtcagtgtggat

SEQ ID NO: 474572 - DNA, 25 bp, Rattus norvegicus
cccaaggattgagcctacgagactc

SEQ ID NO: 474573 - DNA, 25 bp, Rattus norvegicus
gcagcgagaactagagggacacatt

SEQ ID NO: 474574 - DNA, 25 bp, Rattus norvegicus
tctctcgccatggacactcctaggg

SEQ ID NO: 474575 - DNA, 25 bp, Rattus norvegicus
gactgccgggacaatctctggggca

SEQ ID NO: 474576 - DNA, 25 bp, Rattus norvegicus
cgaattggactccaccaaggacgtg

SEQ ID NO: 474577 - DNA, 25 bp, Rattus norvegicus
cgggtttccagcaggcttccatctc

SEQ ID NO: 474578 - DNA, 25 bp, Rattus norvegicus
tcctctgggatttgccgggtttcca

SEQ ID NO: 474579 - DNA, 25 bp, Rattus norvegicus
tctgggcgatcttcctcatcagctt

SEQ ID NO: 474580 - DNA, 25 bp, Rattus norvegicus
actcctagggtccttctctgggcga

SEQ ID NO: 474581 - DNA, 25 bp, Rattus norvegicus
tctcggagaaactcagccactctct

SEQ ID NO: 474582 - DNA, 25 bp, Rattus norvegicus
ccgcactcggagtctgcaggaggaa

SEQ ID NO: 474583 - DNA, 25 bp, Rattus norvegicus
tttgtgtagctgctacccggctccc

SEQ ID NO: 474584 - DNA, 25 bp, Rattus norvegicus
actgaccgtctaaggatcaggcggc

SEQ ID NO: 474585 - DNA, 25 bp, Rattus norvegicus
actcctaggaaaatgcgggcagctg

SEQ ID NO: 474586 - DNA, 25 bp, Rattus norvegicus
tgtcgctcccaagtccctggatagc

SEQ ID NO: 474587 - DNA, 25 bp, Rattus norvegicus
ggatagcccgaccagactcctagga

SEQ ID NO: 474588 - DNA, 25 bp, Rattus norvegicus
cccgccaggtgggaaagacgccgag

SEQ ID NO: 474589 - DNA, 25 bp, Rattus norvegicus
gagcggatccatttccgggttggta

SEQ ID NO: 474590 - DNA, 25 bp, Rattus norvegicus
ggaggattcgctcccggagtagccc

SEQ ID NO: 474591 - DNA, 25 bp, Rattus norvegicus
actgaggtgacggaggattcgctcc

SEQ ID NO: 474592 - DNA, 25 bp, Rattus norvegicus
ctaaacccggactgaggtgacggag

SEQ ID NO: 474593 - DNA, 25 bp, Rattus norvegicus
cgggcaggactaaacccggactgag

SEQ ID NO: 474594 - DNA, 25 bp, Rattus norvegicus
tcccgcggctctcagctctcggctc

SEQ ID NO: 474595 - DNA, 25 bp, Rattus norvegicus
gctccgctcgcgaccttctcaagat

SEQ ID NO: 474596 - DNA, 25 bp, Rattus norvegicus
atctaactgcggagctccgctcgcg

SEQ ID NO: 474597 - DNA, 25 bp, Rattus norvegicus
cggcatctaactgcggagctccgct

SEQ ID NO: 474598 - DNA, 25 bp, Rattus norvegicus
gcctccattttgttcgcggacgctg

SEQ ID NO: 474599 - DNA, 25 bp, Rattus norvegicus
tgagcccgccgctgaggtgacctgc

SEQ ID NO: 474600 - DNA, 25 bp, Rattus norvegicus
tgcatacccggcatctaactgcgga

SEQ ID NO: 474601 - DNA, 25 bp, Rattus norvegicus
gcaggcttcccagggcgcatgcgtc

SEQ ID NO: 474602 - DNA, 25 bp, Rattus norvegicus
tcgtgccgtggtctccgagaaaaaa

SEQ ID NO: 474603 - DNA, 25 bp, Rattus norvegicus
ttgtgactgccgcaaggcctactgg

SEQ ID NO: 474604 - DNA, 25 bp, Rattus norvegicus
tgaaactccaagtcccgtcaggctg

SEQ ID NO: 474605 - DNA, 25 bp, Rattus norvegicus
ttgaaggatgcgatcctgtctcctc

SEQ ID NO: 474606 - DNA, 25 bp, Rattus norvegicus
aagcttcctttgctgagtcgtgccg

SEQ ID NO: 474607 - DNA, 25 bp, Rattus norvegicus
cgtaggaccatgaaaccgaacaagg

SEQ ID NO: 474608 - DNA, 25 bp, Rattus norvegicus
atgactcaaagatggtcgtaggacc

SEQ ID NO: 474609 - DNA, 25 bp, Rattus norvegicus
actcgatctaacctcgcggataata

SEQ ID NO: 474610 - DNA, 25 bp, Rattus norvegicus
aggggtgctctcagctaagttcagc

SEQ ID NO: 474611 - DNA, 25 bp, Rattus norvegicus
cccgctctggccttgggtgtcaaat

SEQ ID NO: 474612 - DNA, 25 bp, Rattus norvegicus
ggaaagtgagcgttttcccgctctg

SEQ ID NO: 474613 - DNA, 25 bp, Rattus norvegicus
gcctttgtacgccagagtgaaactc

SEQ ID NO: 474614 - DNA, 25 bp, Rattus norvegicus
tctaggacctagaaagcgagcgctg

SEQ ID NO: 474615 - DNA, 25 bp, Rattus norvegicus
ccaaagttccttcgtggccagggag

SEQ ID NO: 474616 - DNA, 25 bp, Rattus norvegicus
attcagcaccagacgatccacaccg

SEQ ID NO: 474617 - DNA, 25 bp, Rattus norvegicus
ccacagcggggagaaaccgtacgag

SEQ ID NO: 474618 - DNA, 25 bp, Rattus norvegicus
cagaggacccacagcggggagaaac

SEQ ID NO: 474619 - DNA, 25 bp, Rattus norvegicus
agcaccagaggacccacagcgggga

SEQ ID NO: 474620 - DNA, 25 bp, Rattus norvegicus
ggaaaagcttctgccgtctctccca

SEQ ID NO: 474621 - DNA, 25 bp, Rattus norvegicus
caccgagtgcgggaaaagcttctgc

SEQ ID NO: 474622 - DNA, 25 bp, Rattus norvegicus
cggccgtacgactgtaacgagtgtg

SEQ ID NO: 474623 - DNA, 25 bp, Rattus norvegicus
aaggagctctcacctcattcagcac

SEQ ID NO: 474624 - DNA, 25 bp, Rattus norvegicus
tcggaaggagctctcacctcattca

SEQ ID NO: 474625 - DNA, 25 bp, Rattus norvegicus
gcttcggaaggagctctcacctcat

SEQ ID NO: 474626 - DNA, 25 bp, Rattus norvegicus
ctgtaacgagtgtgggaaaagcttc

SEQ ID NO: 474627 - DNA, 25 bp, Rattus norvegicus
aaaccgtacgagtgcgaggagtgcg

SEQ ID NO: 474628 - DNA, 25 bp, Rattus norvegicus
gcgagcggccgtacgactgtaacga

SEQ ID NO: 474629 - DNA, 25 bp, Rattus norvegicus
gcgggaaaagcttctgccgtctctc

SEQ ID NO: 474630 - DNA, 25 bp, Rattus norvegicus
ccgggatcgcgtctctgtccatgca

SEQ ID NO: 474631 - DNA, 25 bp, Rattus norvegicus
gcggcgcgaggcctaaattttcaac

SEQ ID NO: 474632 - DNA, 25 bp, Rattus norvegicus
ctcataacccgggtagacggagagg

SEQ ID NO: 474633 - DNA, 25 bp, Rattus norvegicus
gccagtggcgctgagaaccctcatt

SEQ ID NO: 474634 - DNA, 25 bp, Rattus norvegicus
agcctgacggccacaccgattggtc

SEQ ID NO: 474635 - DNA, 25 bp, Rattus norvegicus
tccctctctctgattggtccgctga

SEQ ID NO: 474636 - DNA, 25 bp, Rattus norvegicus
ggtccgctgagctgcctatcaggca

SEQ ID NO: 474637 - DNA, 25 bp, Rattus norvegicus
gccgtatggagtccctggaagcagt

SEQ ID NO: 474638 - DNA, 25 bp, Rattus norvegicus
gcgccatttctagtcgttttcaaag

SEQ ID NO: 474639 - DNA, 25 bp, Rattus norvegicus
aagcgcctcgcgctgattctcacgg

SEQ ID NO: 474640 - DNA, 25 bp, Rattus norvegicus
cctggagtcccggtctgaccggatt

SEQ ID NO: 474641 - DNA, 25 bp, Rattus norvegicus
cctgcagtttgggtctttgctccga

SEQ ID NO: 474642 - DNA, 25 bp, Rattus norvegicus
ccgcatctcgccttgccaggagtgg

SEQ ID NO: 474643 - DNA, 25 bp, Rattus norvegicus
ctcctgaactgattgctcggccgta

SEQ ID NO: 474644 - DNA, 25 bp, Rattus norvegicus
ctgcgggaccctaggagagcgtcct

SEQ ID NO: 474645 - DNA, 25 bp, Rattus norvegicus
agcgcaccgaaagacggtccccaag

SEQ ID NO: 474646 - DNA, 25 bp, Rattus norvegicus
cggatggagtctaggcacggtccac

SEQ ID NO: 474647 - DNA, 25 bp, Rattus norvegicus
gcacccaggatcgttatccagaatc

SEQ ID NO: 474648 - DNA, 25 bp, Rattus norvegicus
catcggggcccgaagggagcaccca

SEQ ID NO: 474649 - DNA, 25 bp, Rattus norvegicus
cccaggatcgttatccagaatcctg

SEQ ID NO: 474650 - DNA, 25 bp, Rattus norvegicus
cctctgtgagcctctaggacgggag

SEQ ID NO: 474651 - DNA, 25 bp, Rattus norvegicus
gtcacctggcgtcccgcctctgtga

SEQ ID NO: 474652 - DNA, 25 bp, Rattus norvegicus
ggtcccgatgggtcacctggcgtcc

SEQ ID NO: 474653 - DNA, 25 bp, Rattus norvegicus
gcgctcgcacccttggcccgtacct

SEQ ID NO: 474654 - DNA, 25 bp, Rattus norvegicus
aggtgggccttctccactcttgtcc

SEQ ID NO: 474655 - DNA, 25 bp, Rattus norvegicus
ttccttcctacaggtgggccttctc

SEQ ID NO: 474656 - DNA, 25 bp, Rattus norvegicus
ggagtctaggcacggtccactttcc

SEQ ID NO: 474657 - DNA, 25 bp, Rattus norvegicus
agggagcacccaggatcgttatcca

SEQ ID NO: 474658 - DNA, 25 bp, Rattus norvegicus
gtccctgggtgcagcgagctgtcac

SEQ ID NO: 474659 - DNA, 25 bp, Rattus norvegicus
gctgagtgctccaccgggtcgctag

SEQ ID NO: 474660 - DNA, 25 bp, Rattus norvegicus
tcgctaggacgttactggacccgct

SEQ ID NO: 474661 - DNA, 25 bp, Rattus norvegicus
ggcgcggacccagcgctcgctttga

SEQ ID NO: 474662 - DNA, 25 bp, Rattus norvegicus
cgtggccaggatcctgcaggcgcca

SEQ ID NO: 474663 - DNA, 25 bp, Rattus norvegicus
gtgcagcgagctgtcaccgtcgccg

SEQ ID NO: 474664 - DNA, 25 bp, Rattus norvegicus
gtccttcggctgcaggaagcgcgct

SEQ ID NO: 474665 - DNA, 25 bp, Rattus norvegicus
ctcaggaaacgcagagaaagccagg

SEQ ID NO: 474666 - DNA, 25 bp, Rattus norvegicus
tcgtccggctcaggaaacgcagaga

SEQ ID NO: 474667 - DNA, 25 bp, Rattus norvegicus
agaaggagctttgcgccgcaggtcc

SEQ ID NO: 474668 - DNA, 25 bp, Rattus norvegicus
ccgcgttccggagaaggagctttgc

SEQ ID NO: 474669 - DNA, 25 bp, Rattus norvegicus
cgagttcacaagacgcggcttcctg

SEQ ID NO: 474670 - DNA, 25 bp, Rattus norvegicus
ttactggacccgctggcgttagact

SEQ ID NO: 474671 - DNA, 25 bp, Rattus norvegicus
cttcctggccgcgttccggagaagg

SEQ ID NO: 474672 - DNA, 25 bp, Rattus norvegicus
ttggagggagagactcagagatttt

SEQ ID NO: 474673 - DNA, 25 bp, Rattus norvegicus
ttcccgaagcgcaggaatgaagtgc

SEQ ID NO: 474674 - DNA, 25 bp, Rattus norvegicus
gcccgggaaggaattcgaggcattc

SEQ ID NO: 474675 - DNA, 25 bp, Rattus norvegicus
tgctaattacctcgcaggagcctcc

SEQ ID NO: 474676 - DNA, 25 bp, Rattus norvegicus
gcctgcggtttctgctaattacctc

SEQ ID NO: 474677 - DNA, 25 bp, Rattus norvegicus
gccgcttttggcctgcgcttggcca

SEQ ID NO: 474678 - DNA, 25 bp, Rattus norvegicus
gaagggagccatggcttcccgaagc

SEQ ID NO: 474679 - DNA, 25 bp, Rattus norvegicus
cgcggtgaactttccgcagcgcgca

SEQ ID NO: 474680 - DNA, 25 bp, Rattus norvegicus
aatggtggaatctgcaggggcactc

SEQ ID NO: 474681 - DNA, 25 bp, Rattus norvegicus
ccgaggactaattaatggtggaatc

SEQ ID NO: 474682 - DNA, 25 bp, Rattus norvegicus
tgccagtcgacagtcccgaggacta

SEQ ID NO: 474683 - DNA, 25 bp, Rattus norvegicus
gtttaagttgccagtcgacagtccc

SEQ ID NO: 474684 - DNA, 25 bp, Rattus norvegicus
cgaggcattcgctttgtttaagttg

SEQ ID NO: 474685 - DNA, 25 bp, Rattus norvegicus
gacctctccgcggtgcctgcggttt

SEQ ID NO: 474686 - DNA, 25 bp, Rattus norvegicus
gaacctcacacggtccgcgcgaaac

SEQ ID NO: 474687 - DNA, 25 bp, Rattus norvegicus
agcgcgaggctgatctagagcgccc

SEQ ID NO: 474688 - DNA, 25 bp, Rattus norvegicus
gcctcagcatcgagcgcgaggctga

SEQ ID NO: 474689 - DNA, 25 bp, Rattus norvegicus
ctagagcggagcctcagcatcgagc

SEQ ID NO: 474690 - DNA, 25 bp, Rattus norvegicus
tcccggaggctagagcggagcctca

SEQ ID NO: 474691 - DNA, 25 bp, Rattus norvegicus
ccatagagcagcgtcccggaggcta

SEQ ID NO: 474692 - DNA, 25 bp, Rattus norvegicus
tgctcaagaccatagagcagcgtcc

SEQ ID NO: 474693 - DNA, 25 bp, Rattus norvegicus
ccgcgtcaggacaaaaagcagcagc

SEQ ID NO: 474694 - DNA, 25 bp, Rattus norvegicus
aaccgagcacctccgcgtgcgcacg

SEQ ID NO: 474695 - DNA, 25 bp, Rattus norvegicus
tcgcctctccgctccgaacctcaca

SEQ ID NO: 474696 - DNA, 25 bp, Rattus norvegicus
cctagcacatccctttgaccggatt

SEQ ID NO: 474697 - DNA, 25 bp, Rattus norvegicus
acatccctttgaccggattctgagc

SEQ ID NO: 474698 - DNA, 25 bp, Rattus norvegicus
tctcgccgcgtcaggacaaaaagca

SEQ ID NO: 474699 - DNA, 25 bp, Rattus norvegicus
gcgattgggagtccgccctagcaca

SEQ ID NO: 474700 - DNA, 25 bp, Rattus norvegicus
cgcgcctctaattggattcgcaaca

SEQ ID NO: 474701 - DNA, 25 bp, Rattus norvegicus
agcgtcactcctggtctcatctgcg

SEQ ID NO: 474702 - DNA, 25 bp, Rattus norvegicus
tgacattcaccagcgtcactcctgg

SEQ ID NO: 474703 - DNA, 25 bp, Rattus norvegicus
gggacgtgacattcaccagcgtcac

SEQ ID NO: 474704 - DNA, 25 bp, Rattus norvegicus
ttcttcccgggccacaaagacggca

SEQ ID NO: 474705 - DNA, 25 bp, Rattus norvegicus
aaagagaggcattcttcccgggcca

SEQ ID NO: 474706 - DNA, 25 bp, Rattus norvegicus
cgctatggagaggagaatcaaagga

SEQ ID NO: 474707 - DNA, 25 bp, Rattus norvegicus
aggtcagcagaaacgctatggagag

SEQ ID NO: 474708 - DNA, 25 bp, Rattus norvegicus
ttggattcgcaacacgcagaggtca

SEQ ID NO: 474709 - DNA, 25 bp, Rattus norvegicus
cgccttccgcgcctctaattggatt

SEQ ID NO: 474710 - DNA, 25 bp, Rattus norvegicus
attcggcgcggctgtcaatctcgcc

SEQ ID NO: 474711 - DNA, 25 bp, Rattus norvegicus
gctgggcccagcatgacaagcaggc

SEQ ID NO: 474712 - DNA, 25 bp, Rattus norvegicus
ttcgcaacacgcagaggtcagcaga

SEQ ID NO: 474713 - DNA, 25 bp, Rattus norvegicus
actcctggtctcatctgcggagcgc

SEQ ID NO: 474714 - DNA, 25 bp, Rattus norvegicus
tgttgattttcatgacgcggccacc

SEQ ID NO: 474715 - DNA, 25 bp, Rattus norvegicus
gggtacatccacttcttcagcgttg

SEQ ID NO: 474716 - DNA, 25 bp, Rattus norvegicus
cgagaacttcatctccacgtggatg

SEQ ID NO: 474717 - DNA, 25 bp, Rattus norvegicus
cacgctgggaatgctgctacagtca

SEQ ID NO: 474718 - DNA, 25 bp, Rattus norvegicus
ctccatccagttgggaaaggtcttg

SEQ ID NO: 474719 - DNA, 25 bp, Rattus norvegicus
gccttgcacatgcagcgaccgatgg

SEQ ID NO: 474720 - DNA, 25 bp, Rattus norvegicus
gatccacctgggaaaagctctcatc

SEQ ID NO: 474721 - DNA, 25 bp, Rattus norvegicus
ctgtcccttacctcggcagacggta

SEQ ID NO: 474722 - DNA, 25 bp, Rattus norvegicus
ccgaagcttcgcacctcagtgttga

SEQ ID NO: 474723 - DNA, 25 bp, Rattus norvegicus
tgtctcctggaagatggcaccattc

SEQ ID NO: 474724 - DNA, 25 bp, Rattus norvegicus
tacagccgccgtagtcctggaaggc

SEQ ID NO: 474725 - DNA, 25 bp, Rattus norvegicus
cgcaccgcaatgagggacatacagc

SEQ ID NO: 474726 - DNA, 25 bp, Rattus norvegicus
gcacttccggtagaagacgcgcacc

SEQ ID NO: 474727 - DNA, 25 bp, Rattus norvegicus
atcagccgcaatggtgtccaccttc

SEQ ID NO: 474728 - DNA, 25 bp, Rattus norvegicus
aagcctcggcaagatggtcccttcg

SEQ ID NO: 474729 - DNA, 25 bp, Rattus norvegicus
aatcctgtgcccttgcccggtgcat

SEQ ID NO: 474730 - DNA, 25 bp, Rattus norvegicus
tgcccggtgcatccacgggtcgtac

SEQ ID NO: 474731 - DNA, 25 bp, Rattus norvegicus
acgggtcgtaccacgcccgaggcat

SEQ ID NO: 474732 - DNA, 25 bp, Rattus norvegicus
gaggcatggtctcctaattctcttg

SEQ ID NO: 474733 - DNA, 25 bp, Rattus norvegicus
tcgccgggctggctacaaagcctcg

SEQ ID NO: 474734 - DNA, 25 bp, Rattus norvegicus
aattctcttgtgtcccttcagaggg

SEQ ID NO: 474735 - DNA, 25 bp, Rattus norvegicus
cttcagagggagcatcatccgcgta

SEQ ID NO: 474736 - DNA, 25 bp, Rattus norvegicus
catccgcgtaggaacattgtgatcc

SEQ ID NO: 474737 - DNA, 25 bp, Rattus norvegicus
cagcagtggtctctcccggcgctgt

SEQ ID NO: 474738 - DNA, 25 bp, Rattus norvegicus
ctgcgcacggccattgatacgctgc

SEQ ID NO: 474739 - DNA, 25 bp, Rattus norvegicus
gaatgagccatccagcccgggcaga

SEQ ID NO: 474740 - DNA, 25 bp, Rattus norvegicus
ttcgggtggcccagactgcatccaa

SEQ ID NO: 474741 - DNA, 25 bp, Rattus norvegicus
gagccggggttggactgccaatcct

SEQ ID NO: 474742 - DNA, 25 bp, Rattus norvegicus
tggagagaaagattgagggcggaca

SEQ ID NO: 474743 - DNA, 25 bp, Rattus norvegicus
agaagtccaggagcttttttgtttg

SEQ ID NO: 474744 - DNA, 25 bp, Rattus norvegicus
cggagaagtccaggagcttttttgt

SEQ ID NO: 474745 - DNA, 25 bp, Rattus norvegicus
ccggagaagtccaggagcttttttg

SEQ ID NO: 474746 - DNA, 25 bp, Rattus norvegicus
atcccggagaagtccaggagctttt

SEQ ID NO: 474747 - DNA, 25 bp, Rattus norvegicus
tatcccggagaagtccaggagcttt

SEQ ID NO: 474748 - DNA, 25 bp, Rattus norvegicus
atatcccggagaagtccaggagctt

SEQ ID NO: 474749 - DNA, 25 bp, Rattus norvegicus
acatatcccggagaagtccaggagc

SEQ ID NO: 474750 - DNA, 25 bp, Rattus norvegicus
cacatatcccggagaagtccaggag

SEQ ID NO: 474751 - DNA, 25 bp, Rattus norvegicus
ccacatatcccggagaagtccagga

SEQ ID NO: 474752 - DNA, 25 bp, Rattus norvegicus
gagagaggaaccagcggctccctcc

SEQ ID NO: 474753 - DNA, 25 bp, Rattus norvegicus
cgagagaggaaccagcggctccctc

SEQ ID NO: 474754 - DNA, 25 bp, Rattus norvegicus
gcgagagaggaaccagcggctccct

SEQ ID NO: 474755 - DNA, 25 bp, Rattus norvegicus
attgagggcggacaaggcgagagag

SEQ ID NO: 474756 - DNA, 25 bp, Rattus norvegicus
tcagacaagcaatcgctagcacatc

SEQ ID NO: 474757 - DNA, 25 bp, Rattus norvegicus
agctcagtcagacaagcaatcgcta

SEQ ID NO: 474758 - DNA, 25 bp, Rattus norvegicus
aaatctcgccggctattgagtgcgg

SEQ ID NO: 474759 - DNA, 25 bp, Rattus norvegicus
acatctaaatctcgccggctattga

SEQ ID NO: 474760 - DNA, 25 bp, Rattus norvegicus
gcacatctaaatctcgccggctatt

SEQ ID NO: 474761 - DNA, 25 bp, Rattus norvegicus
cgctagcacatctaaatctcgccgg

SEQ ID NO: 474762 - DNA, 25 bp, Rattus norvegicus
gcaatcgctagcacatctaaatctc

SEQ ID NO: 474763 - DNA, 25 bp, Rattus norvegicus
gccattcgcgaggagaaacagctca

SEQ ID NO: 474764 - DNA, 25 bp, Rattus norvegicus
ttcaccgccattcgcgaggagaaac

SEQ ID NO: 474765 - DNA, 25 bp, Rattus norvegicus
ctcgccggctattgagtgcgggtcc

SEQ ID NO: 474766 - DNA, 25 bp, Rattus norvegicus
tgattcaccgccattcgcgaggaga

SEQ ID NO: 474767 - DNA, 25 bp, Rattus norvegicus
gtaagtgattcaccgccattcgcga

SEQ ID NO: 474768 - DNA, 25 bp, Rattus norvegicus
gacaagcaatcgctagcacatctaa

SEQ ID NO: 474769 - DNA, 25 bp, Rattus norvegicus
ccgccattcgcgaggagaaacagct

SEQ ID NO: 474770 - DNA, 25 bp, Rattus norvegicus
accttgtggccggagagtccttgcg

SEQ ID NO: 474771 - DNA, 25 bp, Rattus norvegicus
gtccttgcggttctgatcgagatca

SEQ ID NO: 474772 - DNA, 25 bp, Rattus norvegicus
tttgcagcagctgtggaccttgtgg

SEQ ID NO: 474773 - DNA, 25 bp, Rattus norvegicus
gctgactttgcagcagctgtggacc

SEQ ID NO: 474774 - DNA, 25 bp, Rattus norvegicus
gaatttggcgcgagctgactttgca

SEQ ID NO: 474775 - DNA, 25 bp, Rattus norvegicus
tgacaactaatcagaagcctggctg

SEQ ID NO: 474776 - DNA, 25 bp, Rattus norvegicus
cgaaggcgtggtgattagtgacaac

SEQ ID NO: 474777 - DNA, 25 bp, Rattus norvegicus
tattggctgccaactgccaccggcg

SEQ ID NO: 474778 - DNA, 25 bp, Rattus norvegicus
ctggggctgtccctattggctgcca

SEQ ID NO: 474779 - DNA, 25 bp, Rattus norvegicus
tgacttcgtgttgggcgctgagacc

SEQ ID NO: 474780 - DNA, 25 bp, Rattus norvegicus
aacgccctcctggacgagtgggtgt

SEQ ID NO: 474781 - DNA, 25 bp, Rattus norvegicus
gtctctgaagttaacgccctcctgg

SEQ ID NO: 474782 - DNA, 25 bp, Rattus norvegicus
ccttcctccgaggtctctgaagtta

SEQ ID NO: 474783 - DNA, 25 bp, Rattus norvegicus
tgccaactgccaccggcgaaggcgt

SEQ ID NO: 474784 - DNA, 25 bp, Rattus norvegicus
ctgtgcttggagcttcgggcagtct

SEQ ID NO: 474785 - DNA, 25 bp, Rattus norvegicus
acggcaagaagtccaggctgcgctg

SEQ ID NO: 474786 - DNA, 25 bp, Rattus norvegicus
gtcacggcaagcgacacggcaagaa

SEQ ID NO: 474787 - DNA, 25 bp, Rattus norvegicus
acctgttcactgagatgcatgagca

SEQ ID NO: 474788 - DNA, 25 bp, Rattus norvegicus
tcgcagcgcaagaacctgttcactg

SEQ ID NO: 474789 - DNA, 25 bp, Rattus norvegicus
gtcgtgttcaccagatcgcagcgca

SEQ ID NO: 474790 - DNA, 25 bp, Rattus norvegicus
acgccagggattcaggagcgcgccc

SEQ ID NO: 474791 - DNA, 25 bp, Rattus norvegicus
ccctcagccgtggaagcagctgtgc

SEQ ID NO: 474792 - DNA, 25 bp, Rattus norvegicus
acgtgtggcaggtcctgcgccctca

SEQ ID NO: 474793 - DNA, 25 bp, Rattus norvegicus
cgccctgcttgtcgtgttcaccaga

SEQ ID NO: 474794 - DNA, 25 bp, Rattus norvegicus
gctgcgctgcagcagaaaacctctg

SEQ ID NO: 474795 - DNA, 25 bp, Rattus norvegicus
ccctagagtacgaggcctatcactg

SEQ ID NO: 474796 - DNA, 25 bp, Rattus norvegicus
aacctctgcacgtgaattttaagga

SEQ ID NO: 474797 - DNA, 25 bp, Rattus norvegicus
ctgggacgattggattatcgcgccc

SEQ ID NO: 474798 - DNA, 25 bp, Rattus norvegicus
aaccttctcgtagtacttgatctcg

SEQ ID NO: 474799 - DNA, 25 bp, Rattus norvegicus
acctggaacatgtagcgagtgcctg

SEQ ID NO: 474800 - DNA, 25 bp, Rattus norvegicus
cagctccctgttggctcctcaccca

SEQ ID NO: 474801 - DNA, 25 bp, Rattus norvegicus
aacatgtagcgagtgcctggtttga

SEQ ID NO: 474802 - DNA, 25 bp, Rattus norvegicus
ccgtgggactttgaggcactcctca

SEQ ID NO: 474803 - DNA, 25 bp, Rattus norvegicus
tcctgcccggagaagaaaggccgtg

SEQ ID NO: 474804 - DNA, 25 bp, Rattus norvegicus
gagtgcctggtttgaggcccgacac

SEQ ID NO: 474805 - DNA, 25 bp, Rattus norvegicus
cgttctcgaaccttctcgtagtact

SEQ ID NO: 474806 - DNA, 25 bp, Rattus norvegicus
ggtagagtagctttgcatctcctta

SEQ ID NO: 474807 - DNA, 25 bp, Rattus norvegicus
cccggacctggaacatgtagcgagt

SEQ ID NO: 474808 - DNA, 25 bp, Rattus norvegicus
cttgagggtagagtagctttgcatc

SEQ ID NO: 474809 - DNA, 25 bp, Rattus norvegicus
tgacagccttgagggtagagtagct

SEQ ID NO: 474810 - DNA, 25 bp, Rattus norvegicus
tttgcatctccttatcctgcccgga

SEQ ID NO: 474811 - DNA, 25 bp, Rattus norvegicus
aaaggccgtgggactttgaggcact

SEQ ID NO: 474812 - DNA, 25 bp, Rattus norvegicus
aggcacctatgtcctggaaggccag

SEQ ID NO: 474813 - DNA, 25 bp, Rattus norvegicus
ggcctcgaacctctaccagcgagga

SEQ ID NO: 474814 - DNA, 25 bp, Rattus norvegicus
tgcgccggtgaagctctcatccgct

SEQ ID NO: 474815 - DNA, 25 bp, Rattus norvegicus
gccctcggcactgcagtacatcttg

SEQ ID NO: 474816 - DNA, 25 bp, Rattus norvegicus
agtacatcttgggtgtgtcgcgctc

SEQ ID NO: 474817 - DNA, 25 bp, Rattus norvegicus
acgcacctccgtgttcagcttgagc

SEQ ID NO: 474818 - DNA, 25 bp, Rattus norvegicus
tgagtgtcgcacacactggcctcga

SEQ ID NO: 474819 - DNA, 25 bp, Rattus norvegicus
atagccggcactgcacacgcacttg

SEQ ID NO: 474820 - DNA, 25 bp, Rattus norvegicus
agaaggccgccaggttgcgtaccat

SEQ ID NO: 474821 - DNA, 25 bp, Rattus norvegicus
ccatggcgggacacttcttgtagta

SEQ ID NO: 474822 - DNA, 25 bp, Rattus norvegicus
gcacgcccagatctgcgccggtgaa

SEQ ID NO: 474823 - DNA, 25 bp, Rattus norvegicus
aggccaggtagaagccgcgcttgct

SEQ ID NO: 474824 - DNA, 25 bp, Rattus norvegicus
gtgttcagcttgagcctccgcacgc

SEQ ID NO: 474825 - DNA, 25 bp, Rattus norvegicus
gtcgcgctcctctgagtgtcgcaca

SEQ ID NO: 474826 - DNA, 25 bp, Rattus norvegicus
gccgttctttattgacagcgccata

SEQ ID NO: 474827 - DNA, 25 bp, Rattus norvegicus
tgtgcgcacgccatagtcacgtgtt

SEQ ID NO: 474828 - DNA, 25 bp, Rattus norvegicus
ctggagacgccaaaaggcagccatc

SEQ ID NO: 474829 - DNA, 25 bp, Rattus norvegicus
gctttctccattcaacagcgctgga

SEQ ID NO: 474830 - DNA, 25 bp, Rattus norvegicus
ctgcccgaagggaacaataaagctt

SEQ ID NO: 474831 - DNA, 25 bp, Rattus norvegicus
gaacacgaacactcctgcccgaagg

SEQ ID NO: 474832 - DNA, 25 bp, Rattus norvegicus
gttacctgttcagtaccgattcaaa

SEQ ID NO: 474833 - DNA, 25 bp, Rattus norvegicus
agtcccagcgccgtttctatggtta

SEQ ID NO: 474834 - DNA, 25 bp, Rattus norvegicus
cctcactcagggagtctctggagcc

SEQ ID NO: 474835 - DNA, 25 bp, Rattus norvegicus
tacgaccgagattacgcccggagtg

SEQ ID NO: 474836 - DNA, 25 bp, Rattus norvegicus
gcacagcccgggagcggagtaaaaa

SEQ ID NO: 474837 - DNA, 25 bp, Rattus norvegicus
aaccggtcttgtctcgcagtaaaca

SEQ ID NO: 474838 - DNA, 25 bp, Rattus norvegicus
gcaagcggccggacaacacacttaa

SEQ ID NO: 474839 - DNA, 25 bp, Rattus norvegicus
ccgtgcaatttcacttctgggaact

SEQ ID NO: 474840 - DNA, 25 bp, Rattus norvegicus
cgctagtgactaggttcgcgcgagt

SEQ ID NO: 474841 - DNA, 25 bp, Rattus norvegicus
tgcgactcctcgtcttcgccgtgtt

SEQ ID NO: 474842 - DNA, 25 bp, Rattus norvegicus
cgccgcgagcaactggctgtaagtc

SEQ ID NO: 474843 - DNA, 25 bp, Rattus norvegicus
tccctgcaggtgtctcagccgcggg

SEQ ID NO: 474844 - DNA, 25 bp, Rattus norvegicus
tctcagccgcgggacccgaggatcg

SEQ ID NO: 474845 - DNA, 25 bp, Rattus norvegicus
tctagctcggcccaactgggcggcg

SEQ ID NO: 474846 - DNA, 25 bp, Rattus norvegicus
aggatcgcgcttctgccggttcctc

SEQ ID NO: 474847 - DNA, 25 bp, Rattus norvegicus
accggctgctcggagactgagcctc

SEQ ID NO: 474848 - DNA, 25 bp, Rattus norvegicus
actgtcccgacttccctctggagtt

SEQ ID NO: 474849 - DNA, 25 bp, Rattus norvegicus
caaaccggcgggctgacaggtctcc

SEQ ID NO: 474850 - DNA, 25 bp, Rattus norvegicus
gcgtcccgggcataatagcaggtta

SEQ ID NO: 474851 - DNA, 25 bp, Rattus norvegicus
tagcaggttaatagcgaggagtcta

SEQ ID NO: 474852 - DNA, 25 bp, Rattus norvegicus
ttcgtgcctgcggtcgctgcgactc

SEQ ID NO: 474853 - DNA, 25 bp, Rattus norvegicus
gggcggacacccacggcaccatgag

SEQ ID NO: 474854 - DNA, 25 bp, Rattus norvegicus
aaaggagaagtttgacggcgccacg

SEQ ID NO: 474855 - DNA, 25 bp, Rattus norvegicus
ttccgtcaggttggccacgcactaa

SEQ ID NO: 474856 - DNA, 25 bp, Rattus norvegicus
actggtaccgcgaaacgcgcagttc

SEQ ID NO: 474857 - DNA, 25 bp, Rattus norvegicus
acgcgcagttcaagccacatacgga

SEQ ID NO: 474858 - DNA, 25 bp, Rattus norvegicus
cacatacggatgaggacctggtgta

SEQ ID NO: 474859 - DNA, 25 bp, Rattus norvegicus
acctggtgtacctggagccaagtcc

SEQ ID NO: 474860 - DNA, 25 bp, Rattus norvegicus
cttctgtgagcaggacatgcgcagc

SEQ ID NO: 474861 - DNA, 25 bp, Rattus norvegicus
acgaggggccgcacttgcaacaaga

SEQ ID NO: 474862 - DNA, 25 bp, Rattus norvegicus
tgcaacaagacgtctaaggccattg

SEQ ID NO: 474863 - DNA, 25 bp, Rattus norvegicus
gccattgacggctgcgagctactgt

SEQ ID NO: 474864 - DNA, 25 bp, Rattus norvegicus
gcggcttccacacagcgcacgtgga

SEQ ID NO: 474865 - DNA, 25 bp, Rattus norvegicus
ctgcttcgtcaagtgccggcagtgc

SEQ ID NO: 474866 - DNA, 25 bp, Rattus norvegicus
tggagatgcacacgtgccggtgacc

SEQ ID NO: 474867 - DNA, 25 bp, Rattus norvegicus
tggccacgcactaaaggagaagttt

SEQ ID NO: 474868 - DNA, 25 bp, Rattus norvegicus
ccgcgagcgtccacgagaaccgagg

SEQ ID NO: 474869 - DNA, 25 bp, Rattus norvegicus
tgctctctgcgccttttaacggtga

SEQ ID NO: 474870 - DNA, 25 bp, Rattus norvegicus
ttctttgcgtgttcgggtttgctct

SEQ ID NO: 474871 - DNA, 25 bp, Rattus norvegicus
cacgcgcgggctacgttctttgcgt

SEQ ID NO: 474872 - DNA, 25 bp, Rattus norvegicus
acaaagagaaagaaggggctcaggc

SEQ ID NO: 474873 - DNA, 25 bp, Rattus norvegicus
ctgacgtcagcacgcaggggacgca

SEQ ID NO: 474874 - DNA, 25 bp, Rattus norvegicus
gacgctcccgcagggaggctactcg

SEQ ID NO: 474875 - DNA, 25 bp, Rattus norvegicus
gccgcccgcaagcaccgggatgtcc

SEQ ID NO: 474876 - DNA, 25 bp, Rattus norvegicus
ggcgcacgcgaacccggcaatccct

SEQ ID NO: 474877 - DNA, 25 bp, Rattus norvegicus
aagtcgaggcccacagcgcagagac

SEQ ID NO: 474878 - DNA, 25 bp, Rattus norvegicus
tcccggaaggcaaagaggctggccc

SEQ ID NO: 474879 - DNA, 25 bp, Rattus norvegicus
tacttaggcaggtcccggaaggcaa

SEQ ID NO: 474880 - DNA, 25 bp, Rattus norvegicus
tctgcgccttttaacggtgatttta

SEQ ID NO: 474881 - DNA, 25 bp, Rattus norvegicus
aggggcacgcgcctgacgtcagcac

SEQ ID NO: 474882 - DNA, 25 bp, Rattus norvegicus
ctgccaggtggcgtctcagtcttat

SEQ ID NO: 474883 - DNA, 25 bp, Rattus norvegicus
atggcccggcctacagttctggcgt

SEQ ID NO: 474884 - DNA, 25 bp, Rattus norvegicus
tcaggctcaaagtcgcctctgggca

SEQ ID NO: 474885 - DNA, 25 bp, Rattus norvegicus
gccggccacgttgttcaggctcaaa

SEQ ID NO: 474886 - DNA, 25 bp, Rattus norvegicus
ggctgtccctgcaagcgtggaaatc

SEQ ID NO: 474887 - DNA, 25 bp, Rattus norvegicus
cgccgagtgagccagcgaacgagac

SEQ ID NO: 474888 - DNA, 25 bp, Rattus norvegicus
agtccgaaggactcggcaggacagc

SEQ ID NO: 474889 - DNA, 25 bp, Rattus norvegicus
agacctcctgaacttggcgcctcgg

SEQ ID NO: 474890 - DNA, 25 bp, Rattus norvegicus
aacctggtcttgtagggcgtggcta

SEQ ID NO: 474891 - DNA, 25 bp, Rattus norvegicus
ctagttgatcaggaggggttgcctc

SEQ ID NO: 474892 - DNA, 25 bp, Rattus norvegicus
ccaggtcttgtaggggcgtgaccta

SEQ ID NO: 474893 - DNA, 25 bp, Rattus norvegicus
cgcgccactcctctagagagcttag

SEQ ID NO: 474894 - DNA, 25 bp, Rattus norvegicus
tggggcccagacaaaggcactgtcg

SEQ ID NO: 474895 - DNA, 25 bp, Rattus norvegicus
agccggttgggcctcatcccatatc

SEQ ID NO: 474896 - DNA, 25 bp, Rattus norvegicus
agtgtctggccctgggtgaccctaa

SEQ ID NO: 474897 - DNA, 25 bp, Rattus norvegicus
cctcaggtgacgtggagcaaagtcg

SEQ ID NO: 474898 - DNA, 25 bp, Rattus norvegicus
cgcctgcggtctggcatcgtgcaaa

SEQ ID NO: 474899 - DNA, 25 bp, Rattus norvegicus
tgcaggacagtaccgctgtgccgct

SEQ ID NO: 474900 - DNA, 25 bp, Rattus norvegicus
tggctgatgcaggacagtaccgctg

SEQ ID NO: 474901 - DNA, 25 bp, Rattus norvegicus
tgcccacgtggagctggctgatgca

SEQ ID NO: 474902 - DNA, 25 bp, Rattus norvegicus
gtcatcaggattgcccacgtggagc

SEQ ID NO: 474903 - DNA, 25 bp, Rattus norvegicus
aagcggaagtgtcatcaggattgcc

SEQ ID NO: 474904 - DNA, 25 bp, Rattus norvegicus
gtgaccctaagcctcaggtgacgtg

SEQ ID NO: 474905 - DNA, 25 bp, Rattus norvegicus
gtagtcggccactctgtcgagtttg

SEQ ID NO: 474906 - DNA, 25 bp, Rattus norvegicus
tggcatcgtgcaaagcggaagtgtc

SEQ ID NO: 474907 - DNA, 25 bp, Rattus norvegicus
tccgcacgtcggtgcactccgtggt

SEQ ID NO: 474908 - DNA, 25 bp, Rattus norvegicus
ggccactctgtcgagtttgagtgtc

SEQ ID NO: 474909 - DNA, 25 bp, Rattus norvegicus
cactccgtggtagtcggccactctg

SEQ ID NO: 474910 - DNA, 25 bp, Rattus norvegicus
gcgcatcctgtcttcaggggccgca

SEQ ID NO: 474911 - DNA, 25 bp, Rattus norvegicus
ccctctctgggtgatccaggaagtc

SEQ ID NO: 474912 - DNA, 25 bp, Rattus norvegicus
gggtcatgccggatcaccctgccat

SEQ ID NO: 474913 - DNA, 25 bp, Rattus norvegicus
cagggaccgggtcatgccggatcac

SEQ ID NO: 474914 - DNA, 25 bp, Rattus norvegicus
ccgtcagatccgctgcgggaagagt

SEQ ID NO: 474915 - DNA, 25 bp, Rattus norvegicus
tctgtccgcacaggtccgtcagatc

SEQ ID NO: 474916 - DNA, 25 bp, Rattus norvegicus
tagaacttgcgcgaagtcgagtgcg

SEQ ID NO: 474917 - DNA, 25 bp, Rattus norvegicus
tctggagtcacgaagtagaacttgc

SEQ ID NO: 474918 - DNA, 25 bp, Rattus norvegicus
cgcagccacagcgtgcagtcagtgt

SEQ ID NO: 474919 - DNA, 25 bp, Rattus norvegicus
agcgaaactggaagcgcatcctgtc

SEQ ID NO: 474920 - DNA, 25 bp, Rattus norvegicus
gtggccgaggacaggctgtaaacca

SEQ ID NO: 474921 - DNA, 25 bp, Rattus norvegicus
aattgcaagtaggagcccggtgcgc

SEQ ID NO: 474922 - DNA, 25 bp, Rattus norvegicus
tgcgggccgtcgtagaattgcaagt

SEQ ID NO: 474923 - DNA, 25 bp, Rattus norvegicus
cagtcagtgtctggagtcacgaagt

SEQ ID NO: 474924 - DNA, 25 bp, Rattus norvegicus
gctttgccgagttttcccttgcgtc

SEQ ID NO: 474925 - DNA, 25 bp, Rattus norvegicus
aatgggttaagcgtcggcctccaca

SEQ ID NO: 474926 - DNA, 25 bp, Rattus norvegicus
accggcggaaatccagacaggagcg

SEQ ID NO: 474927 - DNA, 25 bp, Rattus norvegicus
caccgctttgccgagttttcccttg

SEQ ID NO: 474928 - DNA, 25 bp, Rattus norvegicus
agcgctgcaccgctttgccgagttt

SEQ ID NO: 474929 - DNA, 25 bp, Rattus norvegicus
gagcgggagactgctctagcccagc

SEQ ID NO: 474930 - DNA, 25 bp, Rattus norvegicus
acaggagcgggagactgctctagcc

SEQ ID NO: 474931 - DNA, 25 bp, Rattus norvegicus
tcgcaccggcggaaatccagacagg

SEQ ID NO: 474932 - DNA, 25 bp, Rattus norvegicus
cgcatgtttgtggatggatctggac

SEQ ID NO: 474933 - DNA, 25 bp, Rattus norvegicus
ctgagcgcatgtttgtggatggatc

SEQ ID NO: 474934 - DNA, 25 bp, Rattus norvegicus
ttcttgcctgctgagcgcatgtttg

SEQ ID NO: 474935 - DNA, 25 bp, Rattus norvegicus
attgacgcattcttgcctgctgagc

SEQ ID NO: 474936 - DNA, 25 bp, Rattus norvegicus
ggcctccacatctgggagccattga

SEQ ID NO: 474937 - DNA, 25 bp, Rattus norvegicus
tctgggagccattgacgcattcttg

SEQ ID NO: 474938 - DNA, 25 bp, Rattus norvegicus
cgcaggagcatatcgagaccgccta

SEQ ID NO: 474939 - DNA, 25 bp, Rattus norvegicus
accggtccaggctcaagttaaatca

SEQ ID NO: 474940 - DNA, 25 bp, Rattus norvegicus
gctgacccggtttctactattaaca

SEQ ID NO: 474941 - DNA, 25 bp, Rattus norvegicus
gggcaagtgccctctcgtcagagta

SEQ ID NO: 474942 - DNA, 25 bp, Rattus norvegicus
cgccagtcggattacaggcgctttg

SEQ ID NO: 474943 - DNA, 25 bp, Rattus norvegicus
catgcgcagactacagcaggttata

SEQ ID NO: 474944 - DNA, 25 bp, Rattus norvegicus
gttatacgcctccaacgtccacagg

SEQ ID NO: 474945 - DNA, 25 bp, Rattus norvegicus
gtccgaccgtagcatcgacaaaaca

SEQ ID NO: 474946 - DNA, 25 bp, Rattus norvegicus
ctatttcggtcaaggccatggctcc

SEQ ID NO: 474947 - DNA, 25 bp, Rattus norvegicus
gcagccctatggtgtacgttgagta

SEQ ID NO: 474948 - DNA, 25 bp, Rattus norvegicus
taccgcatctggctggagccctgta

SEQ ID NO: 474949 - DNA, 25 bp, Rattus norvegicus
gggctaatgcatctcctctcggttt

SEQ ID NO: 474950 - DNA, 25 bp, Rattus norvegicus
cgcgcaggtgattgactggtccctt

SEQ ID NO: 474951 - DNA, 25 bp, Rattus norvegicus
acgtggcaagcctcctttgggcagc

SEQ ID NO: 474952 - DNA, 25 bp, Rattus norvegicus
gtgcaatctaaaagcgctcctccgg

SEQ ID NO: 474953 - DNA, 25 bp, Rattus norvegicus
ccttccaccgcggtttggcagggct

SEQ ID NO: 474954 - DNA, 25 bp, Rattus norvegicus
gaactgtcgaactgtcgcctccttc

SEQ ID NO: 474955 - DNA, 25 bp, Rattus norvegicus
atgtcccgaactgtcgaactgtcgc

SEQ ID NO: 474956 - DNA, 25 bp, Rattus norvegicus
ctctttctaatgtcccgaactgtcg

SEQ ID NO: 474957 - DNA, 25 bp, Rattus norvegicus
ttggcaactctttctaatgtcccga

SEQ ID NO: 474958 - DNA, 25 bp, Rattus norvegicus
cggagcgctttttggcaactctttc

SEQ ID NO: 474959 - DNA, 25 bp, Rattus norvegicus
ctttcggagcgctttttggcaactc

SEQ ID NO: 474960 - DNA, 25 bp, Rattus norvegicus
atcgtgcactttcggagcgcttttt

SEQ ID NO: 474961 - DNA, 25 bp, Rattus norvegicus
cagccgaaattaatcgtgcactttc

SEQ ID NO: 474962 - DNA, 25 bp, Rattus norvegicus
ggtatctcttttgacagccgaaatt

SEQ ID NO: 474963 - DNA, 25 bp, Rattus norvegicus
tcctccggtatctcttttgacagcc

SEQ ID NO: 474964 - DNA, 25 bp, Rattus norvegicus
agcgctcctccggtatctcttttga

SEQ ID NO: 474965 - DNA, 25 bp, Rattus norvegicus
gaagggatcacagcggccaccgcgt

SEQ ID NO: 474966 - DNA, 25 bp, Rattus norvegicus
agacccggcgggcatcagccatgcc

SEQ ID NO: 474967 - DNA, 25 bp, Rattus norvegicus
cgcgggcaccggagtgccaagccca

SEQ ID NO: 474968 - DNA, 25 bp, Rattus norvegicus
tgccaagcccaggacaacccgaccc

SEQ ID NO: 474969 - DNA, 25 bp, Rattus norvegicus
aggacaacccgacccaggcctgtgg

SEQ ID NO: 474970 - DNA, 25 bp, Rattus norvegicus
acaacccgacccaggcctgtggtga

SEQ ID NO: 474971 - DNA, 25 bp, Rattus norvegicus
caacccgacccaggcctgtggtgag

SEQ ID NO: 474972 - DNA, 25 bp, Rattus norvegicus
cccgacccaggcctgtggtgagtgc

SEQ ID NO: 474973 - DNA, 25 bp, Rattus norvegicus
acccaggcctgtggtgagtgccagc

SEQ ID NO: 474974 - DNA, 25 bp, Rattus norvegicus
caggcctgtggtgagtgccagctct

SEQ ID NO: 474975 - DNA, 25 bp, Rattus norvegicus
tgtggtgagtgccagctctgtgcat

SEQ ID NO: 474976 - DNA, 25 bp, Rattus norvegicus
tgtgcatgggattctggcagggagg

SEQ ID NO: 474977 - DNA, 25 bp, Rattus norvegicus
gccaggctagatggcggcgcagcag

SEQ ID NO: 474978 - DNA, 25 bp, Rattus norvegicus
gtggcgagcgagtcccggcagagct

SEQ ID NO: 474979 - DNA, 25 bp, Rattus norvegicus
gggaaggagcgctcggcggtcacgt

SEQ ID NO: 474980 - DNA, 25 bp, Rattus norvegicus
tcgtgcgcgggactcgtgagctccc

SEQ ID NO: 474981 - DNA, 25 bp, Rattus norvegicus
ccggagcgaacaagcggccctttct

SEQ ID NO: 474982 - DNA, 25 bp, Rattus norvegicus
tacatccaagtcgtgcgcgggactc

SEQ ID NO: 474983 - DNA, 25 bp, Rattus norvegicus
gaggctgcgaggcaagcatacatcc

SEQ ID NO: 474984 - DNA, 25 bp, Rattus norvegicus
agtgcatgtgcgcatccggggtctt

SEQ ID NO: 474985 - DNA, 25 bp, Rattus norvegicus
caccttcggtgcctatggagggtag

SEQ ID NO: 474986 - DNA, 25 bp, Rattus norvegicus
cgcagcttcaccttcggtgcctatg

SEQ ID NO: 474987 - DNA, 25 bp, Rattus norvegicus
cggaagcgcagcttcaccttcggtg

SEQ ID NO: 474988 - DNA, 25 bp, Rattus norvegicus
cgacgataccatgagcggccggaag

SEQ ID NO: 474989 - DNA, 25 bp, Rattus norvegicus
acgggcagcggcgacgataccatga

SEQ ID NO: 474990 - DNA, 25 bp, Rattus norvegicus
ttgccaaggtgaccctgcgctgggc

SEQ ID NO: 474991 - DNA, 25 bp, Rattus norvegicus
cggcgttgccaaggtgaccctgcgc

SEQ ID NO: 474992 - DNA, 25 bp, Rattus norvegicus
tttctgtacccggacctcagctggc

SEQ ID NO: 474993 - DNA, 25 bp, Rattus norvegicus
gaggcaagcatacatccaagtcgtg

SEQ ID NO: 474994 - DNA, 25 bp, Rattus norvegicus
agtgggcgtggcctacacgtcccgc

SEQ ID NO: 474995 - DNA, 25 bp, Rattus norvegicus
agccgcggcccccagcgccccaagg

SEQ ID NO: 474996 - DNA, 25 bp, Rattus norvegicus
ctggggctcgggatggcgcagccgc

SEQ ID NO: 474997 - DNA, 25 bp, Rattus norvegicus
gctggcttacaacgccgccggggct

SEQ ID NO: 474998 - DNA, 25 bp, Rattus norvegicus
gacaggagcgcggagctccggctac

SEQ ID NO: 474999 - DNA, 25 bp, Rattus norvegicus
gcgtggcctacacgtcccgcccctc

SEQ ID NO: 475000 - DNA, 25 bp, Rattus norvegicus
aggcgcagtgtcctgggccacttgc

SEQ ID NO: 475001 - DNA, 25 bp, Rattus norvegicus
acttgccgggccttcccgcgagtgg

SEQ ID NO: 475002 - DNA, 25 bp, Rattus norvegicus
tgtcctgggccacttgccgggcctt

SEQ ID NO: 475003 - DNA, 25 bp, Rattus norvegicus
agtgtcctgggccacttgccgggcc

SEQ ID NO: 475004 - DNA, 25 bp, Rattus norvegicus
gcgcagtgtcctgggccacttgccg

SEQ ID NO: 475005 - DNA, 25 bp, Rattus norvegicus
ggcgcagtgtcctgggccacttgcc

SEQ ID NO: 475006 - DNA, 25 bp, Rattus norvegicus
caggcgcagtgtcctgggccacttg

SEQ ID NO: 475007 - DNA, 25 bp, Rattus norvegicus
ccagagaaggcagagcagcggcggc

SEQ ID NO: 475008 - DNA, 25 bp, Rattus norvegicus
atgctttccttacctgcaggcagga

SEQ ID NO: 475009 - DNA, 25 bp, Rattus norvegicus
gcgacacgaccgtcatcctgccagg

SEQ ID NO: 475010 - DNA, 25 bp, Rattus norvegicus
gagccgttcgcaggctccttccgtt

SEQ ID NO: 475011 - DNA, 25 bp, Rattus norvegicus
tcgcaggctccttccgtttcctggg

SEQ ID NO: 475012 - DNA, 25 bp, Rattus norvegicus
gctcccagacagacactagcttgcg

SEQ ID NO: 475013 - DNA, 25 bp, Rattus norvegicus
cagacagacactagcttgcggtctc

SEQ ID NO: 475014 - DNA, 25 bp, Rattus norvegicus
cgccaaagatctcagcacgtgcctt

SEQ ID NO: 475015 - DNA, 25 bp, Rattus norvegicus
ctactttagacaccaacgggacaga

SEQ ID NO: 475016 - DNA, 25 bp, Rattus norvegicus
gacaccaacgggacagagtggcttg

SEQ ID NO: 475017 - DNA, 25 bp, Rattus norvegicus
ccacgaagggcgcagctgtggatta

SEQ ID NO: 475018 - DNA, 25 bp, Rattus norvegicus
caccgggagcaggtgcttagcacca

SEQ ID NO: 475019 - DNA, 25 bp, Rattus norvegicus
tagcaccagggtagggtcctgagta

SEQ ID NO: 475020 - DNA, 25 bp, Rattus norvegicus
gggcgcagcatgctttccttacctg

SEQ ID NO: 475021 - DNA, 25 bp, Rattus norvegicus
gcctgcttatgaaggcggcccggct

SEQ ID NO: 475022 - DNA, 25 bp, Rattus norvegicus
cgtcccgctgttcgctagcttggac

SEQ ID NO: 475023 - DNA, 25 bp, Rattus norvegicus
cccgcatagttcaagtgagtttggg

SEQ ID NO: 475024 - DNA, 25 bp, Rattus norvegicus
tagagctcagcgcagagcaccggga

SEQ ID NO: 475025 - DNA, 25 bp, Rattus norvegicus
agccttagcgggaggtgcatccaaa

SEQ ID NO: 475026 - DNA, 25 bp, Rattus norvegicus
aggtgcatccaaagcccggccgttc

SEQ ID NO: 475027 - DNA, 25 bp, Rattus norvegicus
tgagtacgtcctgcggctccacgca

SEQ ID NO: 475028 - DNA, 25 bp, Rattus norvegicus
ctcctggcatggaagactcgggatc

SEQ ID NO: 475029 - DNA, 25 bp, Rattus norvegicus
ttcagttggacttgagctcacgccc

SEQ ID NO: 475030 - DNA, 25 bp, Rattus norvegicus
gtccggtctgcgaggaccttagttc

SEQ ID NO: 475031 - DNA, 25 bp, Rattus norvegicus
attcagagacgtcggggttcagttg

SEQ ID NO: 475032 - DNA, 25 bp, Rattus norvegicus
ggaccttagttctgggctgctggtc

SEQ ID NO: 475033 - DNA, 25 bp, Rattus norvegicus
agctaggccgggtcgattcagagac

SEQ ID NO: 475034 - DNA, 25 bp, Rattus norvegicus
tggggtgtgcaaatccctgagcttg

SEQ ID NO: 475035 - DNA, 25 bp, Rattus norvegicus
cccgcgagcgatggtgagtacgtcc

SEQ ID NO: 475036 - DNA, 25 bp, Rattus norvegicus
cccagcagtccggcgcgtggagaca

SEQ ID NO: 475037 - DNA, 25 bp, Rattus norvegicus
agaggcacgtgcctagcaggccacg

SEQ ID NO: 475038 - DNA, 25 bp, Rattus norvegicus
ggccatccatccgtgggctgatctc

SEQ ID NO: 475039 - DNA, 25 bp, Rattus norvegicus
agggccatccatccgtgggctgatc

SEQ ID NO: 475040 - DNA, 25 bp, Rattus norvegicus
catgcggaccgtgtggccgcctctg

SEQ ID NO: 475041 - DNA, 25 bp, Rattus norvegicus
aacatgcggaccgtgtggccgcctc

SEQ ID NO: 475042 - DNA, 25 bp, Rattus norvegicus
tgcaacatgcggaccgtgtggccgc

SEQ ID NO: 475043 - DNA, 25 bp, Rattus norvegicus
aaggcctgggagaggcacgtgccta

SEQ ID NO: 475044 - DNA, 25 bp, Rattus norvegicus
cagattgggcgtcgcggggtgcaac

SEQ ID NO: 475045 - DNA, 25 bp, Rattus norvegicus
acccgacccagattgggcgtcgcgg

SEQ ID NO: 475046 - DNA, 25 bp, Rattus norvegicus
gccatccatccgtgggctgatctcg

SEQ ID NO: 475047 - DNA, 25 bp, Rattus norvegicus
agacaggagctcgaggggacccgac

SEQ ID NO: 475048 - DNA, 25 bp, Rattus norvegicus
gaggcacgtgcctagcaggccacgc

SEQ ID NO: 475049 - DNA, 25 bp, Rattus norvegicus
ggacccgacccagattgggcgtcgc

SEQ ID NO: 475050 - DNA, 25 bp, Rattus norvegicus
gccgcctctcgacgtttgcttgaca

SEQ ID NO: 475051 - DNA, 25 bp, Rattus norvegicus
gaggctgggctctttccctacagac

SEQ ID NO: 475052 - DNA, 25 bp, Rattus norvegicus
gggatcaccgatctttgccgagaaa

SEQ ID NO: 475053 - DNA, 25 bp, Rattus norvegicus
ggccgctcgcagtctccggaaatag

SEQ ID NO: 475054 - DNA, 25 bp, Rattus norvegicus
cagcgccatgttggatgctctgctc

SEQ ID NO: 475055 - DNA, 25 bp, Rattus norvegicus
attgccgtgaaaggtccggtctctc

SEQ ID NO: 475056 - DNA, 25 bp, Rattus norvegicus
ttagcggttccctccacagagactc

SEQ ID NO: 475057 - DNA, 25 bp, Rattus norvegicus
cctatctgtcggtttgtgctctggc

SEQ ID NO: 475058 - DNA, 25 bp, Rattus norvegicus
tgttaataactccttgcggcgggcg

SEQ ID NO: 475059 - DNA, 25 bp, Rattus norvegicus
ccggcgagtggcatttgttatgtta

SEQ ID NO: 475060 - DNA, 25 bp, Rattus norvegicus
tgtcgacataatgcccaggacttgc

SEQ ID NO: 475061 - DNA, 25 bp, Rattus norvegicus
catttcgcacttagggcatctgagg

SEQ ID NO: 475062 - DNA, 25 bp, Rattus norvegicus
tgagtgaagaaaatccgtccgcatc

SEQ ID NO: 475063 - DNA, 25 bp, Rattus norvegicus
tttgcttgacaggtctcggcggaca

SEQ ID NO: 475064 - DNA, 25 bp, Rattus norvegicus
ctggttcttgctacattgcccgaga

SEQ ID NO: 475065 - DNA, 25 bp, Rattus norvegicus
caggattctgcctgatcaatgcagg

SEQ ID NO: 475066 - DNA, 25 bp, Rattus norvegicus
aggcttcttgggaatagcaggattc

SEQ ID NO: 475067 - DNA, 25 bp, Rattus norvegicus
gggcattttgcccttgcgaggcttc

SEQ ID NO: 475068 - DNA, 25 bp, Rattus norvegicus
catcgctgtggttttgggtgtcatt

SEQ ID NO: 475069 - DNA, 25 bp, Rattus norvegicus
ctggttccgacagatcatcgctgtg

SEQ ID NO: 475070 - DNA, 25 bp, Rattus norvegicus
atctctgtgtttggtagtctggttc

SEQ ID NO: 475071 - DNA, 25 bp, Rattus norvegicus
tagatgtgatctactggttccgaca

SEQ ID NO: 475072 - DNA, 25 bp, Rattus norvegicus
gctgggatgacaaggatgaattttt

SEQ ID NO: 475073 - DNA, 25 bp, Rattus norvegicus
gacacttatgctagactgtcgctgc

SEQ ID NO: 475074 - DNA, 25 bp, Rattus norvegicus
tggtgtcttctccagttaaaaacga

SEQ ID NO: 475075 - DNA, 25 bp, Rattus norvegicus
cttagccttcctgttagctggtgtc

SEQ ID NO: 475076 - DNA, 25 bp, Rattus norvegicus
cccgagaggtctactatactggata

SEQ ID NO: 475077 - DNA, 25 bp, Rattus norvegicus
tactggataaagcagtccttctggc

SEQ ID NO: 475078 - DNA, 25 bp, Rattus norvegicus
aagctagaggtctcattccgacaca

SEQ ID NO: 475079 - DNA, 25 bp, Rattus norvegicus
gtggttctaacgctgggccacctgc

SEQ ID NO: 475080 - DNA, 25 bp, Rattus norvegicus
ttactgcccgcctgttcggactttg

SEQ ID NO: 475081 - DNA, 25 bp, Rattus norvegicus
cagcacgctgcgtttgtggttctaa

SEQ ID NO: 475082 - DNA, 25 bp, Rattus norvegicus
gctgcacaatgtcacacccgggaca

SEQ ID NO: 475083 - DNA, 25 bp, Rattus norvegicus
agcacccaggctgcacaatgtcaca

SEQ ID NO: 475084 - DNA, 25 bp, Rattus norvegicus
cacagacagtgacacaagctagagg

SEQ ID NO: 475085 - DNA, 25 bp, Rattus norvegicus
tctcacatgatgtcacagacagtga

SEQ ID NO: 475086 - DNA, 25 bp, Rattus norvegicus
cggcagccggagtctcacatgatgt

SEQ ID NO: 475087 - DNA, 25 bp, Rattus norvegicus
ttctgccgcgtcgttttcgggcgag

SEQ ID NO: 475088 - DNA, 25 bp, Rattus norvegicus
tgtgctaacagctcagttctgccgc

SEQ ID NO: 475089 - DNA, 25 bp, Rattus norvegicus
cccgctagtgtttgtgctaacagct

SEQ ID NO: 475090 - DNA, 25 bp, Rattus norvegicus
ttgcttgccggaagcacgcagagtg

SEQ ID NO: 475091 - DNA, 25 bp, Rattus norvegicus
acaccctgggcggagctttgcttgc

SEQ ID NO: 475092 - DNA, 25 bp, Rattus norvegicus
cccatctatcacgatgaatcctata

SEQ ID NO: 475093 - DNA, 25 bp, Rattus norvegicus
ttaatggatttatttgccttttaga

SEQ ID NO: 475094 - DNA, 25 bp, Rattus norvegicus
taccttctcccatctatcacgatga

SEQ ID NO: 475095 - DNA, 25 bp, Rattus norvegicus
agacaggggcctcactctctgtagc

SEQ ID NO: 475096 - DNA, 25 bp, Rattus norvegicus
cacgatgaatcctatatctctgatc

SEQ ID NO: 475097 - DNA, 25 bp, Rattus norvegicus
cctatatctctgatcacaaattttt

SEQ ID NO: 475098 - DNA, 25 bp, Rattus norvegicus
tagttgatgtagaccgagtcccggc

SEQ ID NO: 475099 - DNA, 25 bp, Rattus norvegicus
atgtagaccgagtcccggctgatgt

SEQ ID NO: 475100 - DNA, 25 bp, Rattus norvegicus
accgagtcccggctgatgtgcaggc

SEQ ID NO: 475101 - DNA, 25 bp, Rattus norvegicus
tctgggacctgagcttgatcacaaa

SEQ ID NO: 475102 - DNA, 25 bp, Rattus norvegicus
gggacctgagcttgatcacaaattt

SEQ ID NO: 475103 - DNA, 25 bp, Rattus norvegicus
ctgagcttgatcacaaatttttaga

SEQ ID NO: 475104 - DNA, 25 bp, Rattus norvegicus
ttagacatttctattaatggattta

SEQ ID NO: 475105 - DNA, 25 bp, Rattus norvegicus
ctctcttacttcatcctgtcctcta

SEQ ID NO: 475106 - DNA, 25 bp, Rattus norvegicus
gccattacggagttcccagtggtga

SEQ ID NO: 475107 - DNA, 25 bp, Rattus norvegicus
aacgcggagcggtccctgcgccgaa

SEQ ID NO: 475108 - DNA, 25 bp, Rattus norvegicus
cgtggccgccattacggagttccca

SEQ ID NO: 475109 - DNA, 25 bp, Rattus norvegicus
cttcaagccggttcgaaagatgccg

SEQ ID NO: 475110 - DNA, 25 bp, Rattus norvegicus
ggcccactgtcaactgtcttcaagc

SEQ ID NO: 475111 - DNA, 25 bp, Rattus norvegicus
agccctattggctgcgggctcgcgc

SEQ ID NO: 475112 - DNA, 25 bp, Rattus norvegicus
cgtgcgccgcagagccctattggct

SEQ ID NO: 475113 - DNA, 25 bp, Rattus norvegicus
ggggcagcttttctctggtcgtgcc

SEQ ID NO: 475114 - DNA, 25 bp, Rattus norvegicus
cgcgctcccgcccttgttttgtttg

SEQ ID NO: 475115 - DNA, 25 bp, Rattus norvegicus
cgcggggaccgaaagctgccagctt

SEQ ID NO: 475116 - DNA, 25 bp, Rattus norvegicus
cggactcccgagtaccagtggtgga

SEQ ID NO: 475117 - DNA, 25 bp, Rattus norvegicus
ccgcagcaacgctgaggggccgtac

SEQ ID NO: 475118 - DNA, 25 bp, Rattus norvegicus
tcagcgatcggtggtccgcagcaac

SEQ ID NO: 475119 - DNA, 25 bp, Rattus norvegicus
tgtcttcgctgctcctccgggcgat

SEQ ID NO: 475120 - DNA, 25 bp, Rattus norvegicus
agaccaagttctgcagactcgaccc

SEQ ID NO: 475121 - DNA, 25 bp, Rattus norvegicus
atccacaggctgtgtggacaccacg

SEQ ID NO: 475122 - DNA, 25 bp, Rattus norvegicus
gacaccacgggaagcgctgggacac

SEQ ID NO: 475123 - DNA, 25 bp, Rattus norvegicus
acgcagccaccgaaaccagcagtgg

SEQ ID NO: 475124 - DNA, 25 bp, Rattus norvegicus
accgcgagtgctcgctggtccgaac

SEQ ID NO: 475125 - DNA, 25 bp, Rattus norvegicus
cgacggtttctcacgttgccttgga

SEQ ID NO: 475126 - DNA, 25 bp, Rattus norvegicus
gggacatccctgctcggggcccaaa

SEQ ID NO: 475127 - DNA, 25 bp, Rattus norvegicus
cctggctccagagggaaagacgtgt

SEQ ID NO: 475128 - DNA, 25 bp, Rattus norvegicus
aagacgtgtctgtccaagatggcga

SEQ ID NO: 475129 - DNA, 25 bp, Rattus norvegicus
tctggatgaagtcgagaccaagttc

SEQ ID NO: 475130 - DNA, 25 bp, Rattus norvegicus
agacactctcaggttaacgcgggcg

SEQ ID NO: 475131 - DNA, 25 bp, Rattus norvegicus
cggagcccaggagaaagacactctc

SEQ ID NO: 475132 - DNA, 25 bp, Rattus norvegicus
gtcgcgacagcgtgaaaagagacgc

SEQ ID NO: 475133 - DNA, 25 bp, Rattus norvegicus
gacctggacgagcttctggatgaag

SEQ ID NO: 475134 - DNA, 25 bp, Rattus norvegicus
gcgcgcgctggctaaattcactcac

SEQ ID NO: 475135 - DNA, 25 bp, Rattus norvegicus
tgctcgcgcgtccacatagatttcg

SEQ ID NO: 475136 - DNA, 25 bp, Rattus norvegicus
gcgtcttccctatccagcctgtgtg

SEQ ID NO: 475137 - DNA, 25 bp, Rattus norvegicus
atccgagctgtgagacctgccagga

SEQ ID NO: 475138 - DNA, 25 bp, Rattus norvegicus
gacgactggagatgccctgagctca

SEQ ID NO: 475139 - DNA, 25 bp, Rattus norvegicus
gtcattgagcgaccgtgcagatcta

SEQ ID NO: 475140 - DNA, 25 bp, Rattus norvegicus
gaccctagctgagcggcccaatcaa

SEQ ID NO: 475141 - DNA, 25 bp, Rattus norvegicus
tttatttgggccacctactgcgctc

SEQ ID NO: 475142 - DNA, 25 bp, Rattus norvegicus
aagcgcttgcctgtctcggatttgc

SEQ ID NO: 475143 - DNA, 25 bp, Rattus norvegicus
gggtttaatacacaccaagcgcttg

SEQ ID NO: 475144 - DNA, 25 bp, Rattus norvegicus
tacgggcagtttctcatgcgttctc

SEQ ID NO: 475145 - DNA, 25 bp, Rattus norvegicus
actgcgctcctcacctaatgggatc

SEQ ID NO: 475146 - DNA, 25 bp, Rattus norvegicus
tgaggggatacctgccaccaagtcc

SEQ ID NO: 475147 - DNA, 25 bp, Rattus norvegicus
ctaagtggatttccgtgaggcccga

SEQ ID NO: 475148 - DNA, 25 bp, Rattus norvegicus
gcggaggcaaaaggctctcggcttt

SEQ ID NO: 475149 - DNA, 25 bp, Rattus norvegicus
tgttcttccgcagcctgaagggtga

SEQ ID NO: 475150 - DNA, 25 bp, Rattus norvegicus
tgcgggacacgcactcactgttctt

SEQ ID NO: 475151 - DNA, 25 bp, Rattus norvegicus
ctggacaacttgaacgtgcgggaca

SEQ ID NO: 475152 - DNA, 25 bp, Rattus norvegicus
gcaccctcgtgctgctggacaactt

SEQ ID NO: 475153 - DNA, 25 bp, Rattus norvegicus
tcccgctggaagatgaagatggttc

SEQ ID NO: 475154 - DNA, 25 bp, Rattus norvegicus
tactccatcgctgcgagcggccatt

SEQ ID NO: 475155 - DNA, 25 bp, Rattus norvegicus
gaccacttctaggtggtactccatc

SEQ ID NO: 475156 - DNA, 25 bp, Rattus norvegicus
gactcggcttccgaagggccacttc

SEQ ID NO: 475157 - DNA, 25 bp, Rattus norvegicus
caataaggtttggagactcggcttc

SEQ ID NO: 475158 - DNA, 25 bp, Rattus norvegicus
cggagcttcaagtgcatttcgccaa

SEQ ID NO: 475159 - DNA, 25 bp, Rattus norvegicus
gtctctcttggattggcgctcttcc

SEQ ID NO: 475160 - DNA, 25 bp, Rattus norvegicus
agcagctacggagctgtctctcttg

SEQ ID NO: 475161 - DNA, 25 bp, Rattus norvegicus
cggctttattgattggcagcagcta

SEQ ID NO: 475162 - DNA, 25 bp, Rattus norvegicus
ccgccacaaacgtccgaaaagctga

SEQ ID NO: 475163 - DNA, 25 bp, Rattus norvegicus
gcaccacgaactgccgctggattcg

SEQ ID NO: 475164 - DNA, 25 bp, Rattus norvegicus
ggcgcaacccgctcttctccgcatc

SEQ ID NO: 475165 - DNA, 25 bp, Rattus norvegicus
gatctcctgacaggccgaggcggcc

SEQ ID NO: 475166 - DNA, 25 bp, Rattus norvegicus
gttctcctgcacagcacgtgggggc

SEQ ID NO: 475167 - DNA, 25 bp, Rattus norvegicus
aggaagactgctcggccgcaaggcc

SEQ ID NO: 475168 - DNA, 25 bp, Rattus norvegicus
acgaactgccgctggattcgcgccg

SEQ ID NO: 475169 - DNA, 25 bp, Rattus norvegicus
agcccagccaccgactggcggaaga

SEQ ID NO: 475170 - DNA, 25 bp, Rattus norvegicus
cccagcctgacaccgggcccggctt

SEQ ID NO: 475171 - DNA, 25 bp, Rattus norvegicus
agcagcgcccgacccagctgcaggc

SEQ ID NO: 475172 - DNA, 25 bp, Rattus norvegicus
cagtgcctgtcgcaccgccatggtg

SEQ ID NO: 475173 - DNA, 25 bp, Rattus norvegicus
acgtccgaaaagctgaggacaacaa

SEQ ID NO: 475174 - DNA, 25 bp, Rattus norvegicus
tgctctcacctggatctcctgacag

SEQ ID NO: 475175 - DNA, 25 bp, Rattus norvegicus
agtccgaaggccaggaagactgctc

SEQ ID NO: 475176 - DNA, 25 bp, Rattus norvegicus
tgtggtgtttataatctgaagactc

SEQ ID NO: 475177 - DNA, 25 bp, Rattus norvegicus
aggacatgctgtggtgtttataatc

SEQ ID NO: 475178 - DNA, 25 bp, Rattus norvegicus
ttcttcgtcatcaggacatgctgtg

SEQ ID NO: 475179 - DNA, 25 bp, Rattus norvegicus
aaaaacacgttcttcgtcatcagga

SEQ ID NO: 475180 - DNA, 25 bp, Rattus norvegicus
cacacggactaagaacaaaaacacg

SEQ ID NO: 475181 - DNA, 25 bp, Rattus norvegicus
cagaaggacgcagctaattctgccc

SEQ ID NO: 475182 - DNA, 25 bp, Rattus norvegicus
ggaagcatccacatcctccagaagg

SEQ ID NO: 475183 - DNA, 25 bp, Rattus norvegicus
cttagagaggcaccgtggaagcatc

SEQ ID NO: 475184 - DNA, 25 bp, Rattus norvegicus
agacgccacttagagaggcaccgtg

SEQ ID NO: 475185 - DNA, 25 bp, Rattus norvegicus
agcttcggatctcagacgccactta

SEQ ID NO: 475186 - DNA, 25 bp, Rattus norvegicus
caggggcaaggagcttcggatctca

SEQ ID NO: 475187 - DNA, 25 bp, Rattus norvegicus
gagctgtacacacggactaagaaca

SEQ ID NO: 475188 - DNA, 25 bp, Rattus norvegicus
tctgaagactcacacgacggagccg

SEQ ID NO: 475189 - DNA, 25 bp, Rattus norvegicus
tcctccagaaggacgcagctaattc

SEQ ID NO: 475190 - DNA, 25 bp, Rattus norvegicus
tcctccactagcacgaatttgttcc

SEQ ID NO: 475191 - DNA, 25 bp, Rattus norvegicus
cgttgcccaggtaccacacagtgta

SEQ ID NO: 475192 - DNA, 25 bp, Rattus norvegicus
gaagacagcgttgcgtgagatgccc

SEQ ID NO: 475193 - DNA, 25 bp, Rattus norvegicus
cggtaagcgcacttggcgttgagca

SEQ ID NO: 475194 - DNA, 25 bp, Rattus norvegicus
cgctgcagtcgcttgaagtcgctga

SEQ ID NO: 475195 - DNA, 25 bp, Rattus norvegicus
tcccagacgggctggccactgagat

SEQ ID NO: 475196 - DNA, 25 bp, Rattus norvegicus
cggacccagggtcagtttcatcttc

SEQ ID NO: 475197 - DNA, 25 bp, Rattus norvegicus
tggctttgcagatgcccggttccca

SEQ ID NO: 475198 - DNA, 25 bp, Rattus norvegicus
cacacagtgtaggtggggtcctcct

SEQ ID NO: 475199 - DNA, 25 bp, Rattus norvegicus
gtggggtcctccttgttaagctcca

SEQ ID NO: 475200 - DNA, 25 bp, Rattus norvegicus
aagctccactttctggcgccggctg

SEQ ID NO: 475201 - DNA, 25 bp, Rattus norvegicus
gctcaggctcttcgccttgcgcttg

SEQ ID NO: 475202 - DNA, 25 bp, Rattus norvegicus
tttgttccgtctccagggtagcatc

SEQ ID NO: 475203 - DNA, 25 bp, Rattus norvegicus
tagacccaggtgaagactcgcggat

SEQ ID NO: 475204 - DNA, 25 bp, Rattus norvegicus
ttcctgcgagtacgtcatcaacggg

SEQ ID NO: 475205 - DNA, 25 bp, Rattus norvegicus
caggtcgcccaggaactcaaggtca

SEQ ID NO: 475206 - DNA, 25 bp, Rattus norvegicus
tataccggcagaaggcccaggtcgc

SEQ ID NO: 475207 - DNA, 25 bp, Rattus norvegicus
ccattctaggatagcgggacgtcta

SEQ ID NO: 475208 - DNA, 25 bp, Rattus norvegicus
ggtcaccgccgtactgtactccata

SEQ ID NO: 475209 - DNA, 25 bp, Rattus norvegicus
ggccgtcactcggtcaggtcatcct

SEQ ID NO: 475210 - DNA, 25 bp, Rattus norvegicus
gtcgcaaccacctaggcaacgtctt

SEQ ID NO: 475211 - DNA, 25 bp, Rattus norvegicus
tgaggccgcagtaacgtcgcaacca

SEQ ID NO: 475212 - DNA, 25 bp, Rattus norvegicus
cattggacgtcaccgcagtgctgta

SEQ ID NO: 475213 - DNA, 25 bp, Rattus norvegicus
ggtgtcctccgagttaccctcagtg

SEQ ID NO: 475214 - DNA, 25 bp, Rattus norvegicus
tcacagccagcgcttggaacgttca

SEQ ID NO: 475215 - DNA, 25 bp, Rattus norvegicus
caggccattgtcctggtggaaattc

SEQ ID NO: 475216 - DNA, 25 bp, Rattus norvegicus
atttctcgaaaacctgctgtgcacc

SEQ ID NO: 475217 - DNA, 25 bp, Rattus norvegicus
gaacgttcacggtcctcctgggatc

SEQ ID NO: 475218 - DNA, 25 bp, Rattus norvegicus
gtgacgtcgctcagcttccagggat

SEQ ID NO: 475219 - DNA, 25 bp, Rattus norvegicus
caacaacttcttcggcgccgggcag

SEQ ID NO: 475220 - DNA, 25 bp, Rattus norvegicus
aggacaccaacaacttcttcggcgc

SEQ ID NO: 475221 - DNA, 25 bp, Rattus norvegicus
gggccagatcttctcgtgccgcctg

SEQ ID NO: 475222 - DNA, 25 bp, Rattus norvegicus
gacgtgggccagatcttctcgtgcc

SEQ ID NO: 475223 - DNA, 25 bp, Rattus norvegicus
cctacggcgacgagaagctgagccc

SEQ ID NO: 475224 - DNA, 25 bp, Rattus norvegicus
aggtgctgccctacggcgacgagaa

SEQ ID NO: 475225 - DNA, 25 bp, Rattus norvegicus
aggatgtgagtcctgcccgcctgcc

SEQ ID NO: 475226 - DNA, 25 bp, Rattus norvegicus
agcgccgaggatgtgagtcctgccc

SEQ ID NO: 475227 - DNA, 25 bp, Rattus norvegicus
cccttgctttcttctgactttctga

SEQ ID NO: 475228 - DNA, 25 bp, Rattus norvegicus
ccgcctctccgctccagatctactc

SEQ ID NO: 475229 - DNA, 25 bp, Rattus norvegicus
tgggctggcattcaccctagcagct

SEQ ID NO: 475230 - DNA, 25 bp, Rattus norvegicus
acgcgaccatgtcggaggtgctgcc

SEQ ID NO: 475231 - DNA, 25 bp, Rattus norvegicus
gtcgctcagcttccagggatctctc

SEQ ID NO: 475232 - DNA, 25 bp, Rattus norvegicus
tctagccgacttgcacggatggcgc

SEQ ID NO: 475233 - DNA, 25 bp, Rattus norvegicus
cccggccggcaaaaggaagtgctcg

SEQ ID NO: 475234 - DNA, 25 bp, Rattus norvegicus
ccttcgcggggcaagatgtacgaaa

SEQ ID NO: 475235 - DNA, 25 bp, Rattus norvegicus
ctcctggatcttcggccttcgcggg

SEQ ID NO: 475236 - DNA, 25 bp, Rattus norvegicus
taagccacggagaagcccgggagcc

SEQ ID NO: 475237 - DNA, 25 bp, Rattus norvegicus
tggactctgcctgggacaccgaagc

SEQ ID NO: 475238 - DNA, 25 bp, Rattus norvegicus
tgggacaccgaagcctcgagttctc

SEQ ID NO: 475239 - DNA, 25 bp, Rattus norvegicus
tcgagttctcgagccaccgagcgtt

SEQ ID NO: 475240 - DNA, 25 bp, Rattus norvegicus
accgagcgttccctgcgagcgagca

SEQ ID NO: 475241 - DNA, 25 bp, Rattus norvegicus
gagcgagcaccgagagacctcttcc

SEQ ID NO: 475242 - DNA, 25 bp, Rattus norvegicus
cgcttttcacctgggaccggcggag

SEQ ID NO: 475243 - DNA, 25 bp, Rattus norvegicus
acctgcggacttaggcgcgggcaat

SEQ ID NO: 475244 - DNA, 25 bp, Rattus norvegicus
catcggggcgaagggacttgtccct

SEQ ID NO: 475245 - DNA, 25 bp, Rattus norvegicus
gcacccggaatctaagccacggaga

SEQ ID NO: 475246 - DNA, 25 bp, Rattus norvegicus
cctttgcggtggcactaagagcgga

SEQ ID NO: 475247 - DNA, 25 bp, Rattus norvegicus
aatccggcctggactagcggcacca

SEQ ID NO: 475248 - DNA, 25 bp, Rattus norvegicus
cgggcttcgaatccggcctggacta

SEQ ID NO: 475249 - DNA, 25 bp, Rattus norvegicus
gtgggaacctatgccagcctccctt

SEQ ID NO: 475250 - DNA, 25 bp, Rattus norvegicus
actctccagccgtggatcggcgtgg

SEQ ID NO: 475251 - DNA, 25 bp, Rattus norvegicus
ggcctaaactctccagccgtggatc

SEQ ID NO: 475252 - DNA, 25 bp, Rattus norvegicus
tgcaggccaggcctaaactctccag

SEQ ID NO: 475253 - DNA, 25 bp, Rattus norvegicus
aaggaaggttctgccctttgcggtg

SEQ ID NO: 475254 - DNA, 25 bp, Rattus norvegicus
gggcacagagaagggagcacggcat

SEQ ID NO: 475255 - DNA, 25 bp, Rattus norvegicus
ggttctgccctttgcggtggcacta

SEQ ID NO: 475256 - DNA, 25 bp, Rattus norvegicus
ctggactagcggcaccagtgatccg

SEQ ID NO: 475257 - DNA, 25 bp, Rattus norvegicus
tgctccgggcttcgaatccggcctg

SEQ ID NO: 475258 - DNA, 25 bp, Rattus norvegicus
agcacggcatggggacacccgtgca

SEQ ID NO: 475259 - DNA, 25 bp, Rattus norvegicus
atcggcgtgggaacctatgccagcc

SEQ ID NO: 475260 - DNA, 25 bp, Rattus norvegicus
tacctattgagggatgaagctgtcc

SEQ ID NO: 475261 - DNA, 25 bp, Rattus norvegicus
aaagcgcctggacgctgctcagctg

SEQ ID NO: 475262 - DNA, 25 bp, Rattus norvegicus
ctcagctgcagagaactggtcttgc

SEQ ID NO: 475263 - DNA, 25 bp, Rattus norvegicus
ctggtcttgctggacacagtgtcca

SEQ ID NO: 475264 - DNA, 25 bp, Rattus norvegicus
gtcctccgagctcctcctgttgatg

SEQ ID NO: 475265 - DNA, 25 bp, Rattus norvegicus
cctcctgttgatggacgggaggact

SEQ ID NO: 475266 - DNA, 25 bp, Rattus norvegicus
atgaagctgtccttatgggcgcctg

SEQ ID NO: 475267 - DNA, 25 bp, Rattus norvegicus
cagcagctccggcatctcatcggga

SEQ ID NO: 475268 - DNA, 25 bp, Rattus norvegicus
ctcatcgggagctccctgagacgca

SEQ ID NO: 475269 - DNA, 25 bp, Rattus norvegicus
ctccctgagacgcaggggcagttgc

SEQ ID NO: 475270 - DNA, 25 bp, Rattus norvegicus
gcagttgcgcagacctcgcgtttct

SEQ ID NO: 475271 - DNA, 25 bp, Rattus norvegicus
tcgcgtttctggttgcttggcgacc

SEQ ID NO: 475272 - DNA, 25 bp, Rattus norvegicus
gggcctcctcttggtaaagcgcctg

SEQ ID NO: 475273 - DNA, 25 bp, Rattus norvegicus
ttatgggcgcctgctgcagcagctc

SEQ ID NO: 475274 - DNA, 25 bp, Rattus norvegicus
ggcacctcccgcagcttcagtccca

SEQ ID NO: 475275 - DNA, 25 bp, Rattus norvegicus
ggtcgcctggcacccaggtcacgtg

SEQ ID NO: 475276 - DNA, 25 bp, Rattus norvegicus
taaggagacggcacctggcgacagc

SEQ ID NO: 475277 - DNA, 25 bp, Rattus norvegicus
cggcacacggctcgccgcggaagga

SEQ ID NO: 475278 - DNA, 25 bp, Rattus norvegicus
tgctttcgggacatggctgcggcac

SEQ ID NO: 475279 - DNA, 25 bp, Rattus norvegicus
cgccgcttgctttcgggacatggct

SEQ ID NO: 475280 - DNA, 25 bp, Rattus norvegicus
ctcttcgccgcttgctttcgggaca

SEQ ID NO: 475281 - DNA, 25 bp, Rattus norvegicus
gttccgccgctccttggccagcgcc

SEQ ID NO: 475282 - DNA, 25 bp, Rattus norvegicus
acaaactcttcttcgcagccgctgc

SEQ ID NO: 475283 - DNA, 25 bp, Rattus norvegicus
tggcgaagctcacaaactcttcttc

SEQ ID NO: 475284 - DNA, 25 bp, Rattus norvegicus
gttggttggcgaagctcacaaactc

SEQ ID NO: 475285 - DNA, 25 bp, Rattus norvegicus
gcctgcagttggttggcgaagctca

SEQ ID NO: 475286 - DNA, 25 bp, Rattus norvegicus
aggtcacgtggcgatagctccgccc

SEQ ID NO: 475287 - DNA, 25 bp, Rattus norvegicus
cgcagcttcagtcccagggcctgca

SEQ ID NO: 475288 - DNA, 25 bp, Rattus norvegicus
gtgcaccgctcgcaggtgacttcac

SEQ ID NO: 475289 - DNA, 25 bp, Rattus norvegicus
gacaggcgcccgcaaagtttcgctt

SEQ ID NO: 475290 - DNA, 25 bp, Rattus norvegicus
aggcgcccgcaaagtttcgcttctc

SEQ ID NO: 475291 - DNA, 25 bp, Rattus norvegicus
gcccgcaaagtttcgcttctccctc

SEQ ID NO: 475292 - DNA, 25 bp, Rattus norvegicus
ccgcccggtgcgtcccgacctccat

SEQ ID NO: 475293 - DNA, 25 bp, Rattus norvegicus
tgcgtcccgacctccatggtaccta

SEQ ID NO: 475294 - DNA, 25 bp, Rattus norvegicus
cggcggcgccaagggtgcgactcct

SEQ ID NO: 475295 - DNA, 25 bp, Rattus norvegicus
ctcctcgtcgccgactcggggcgcg

SEQ ID NO: 475296 - DNA, 25 bp, Rattus norvegicus
actcggggcgcggactctgcctgct

SEQ ID NO: 475297 - DNA, 25 bp, Rattus norvegicus
gcggactctgcctgctcctcggccc

SEQ ID NO: 475298 - DNA, 25 bp, Rattus norvegicus
cccagcctcgcagggtgcgtggggc

SEQ ID NO: 475299 - DNA, 25 bp, Rattus norvegicus
cgggtgcaccgctcgcaggtgactt

SEQ ID NO: 475300 - DNA, 25 bp, Rattus norvegicus
gccgtccgggctggcttccctcctg

SEQ ID NO: 475301 - DNA, 25 bp, Rattus norvegicus
gcgcgattcggacgcggcgggtgca

SEQ ID NO: 475302 - DNA, 25 bp, Rattus norvegicus
gaagaatgggcggaagctgcctcca

SEQ ID NO: 475303 - DNA, 25 bp, Rattus norvegicus
gggtcttcagcggaggccacaccca

SEQ ID NO: 475304 - DNA, 25 bp, Rattus norvegicus
cttctgcacagaggtgacgcgcaca

SEQ ID NO: 475305 - DNA, 25 bp, Rattus norvegicus
tgacgcgcacagaaaccggctgagg

SEQ ID NO: 475306 - DNA, 25 bp, Rattus norvegicus
agaaaccggctgaggcaatcctggg

SEQ ID NO: 475307 - DNA, 25 bp, Rattus norvegicus
atcctgggtcgccagacctgacttt

SEQ ID NO: 475308 - DNA, 25 bp, Rattus norvegicus
gactttcctgactcgggctagcctt

SEQ ID NO: 475309 - DNA, 25 bp, Rattus norvegicus
tagccttcggaaagggctcttaagc

SEQ ID NO: 475310 - DNA, 25 bp, Rattus norvegicus
ggctcttaagcagtccgcgaagttc

SEQ ID NO: 475311 - DNA, 25 bp, Rattus norvegicus
gtccgcgaagttctctggaagaatg

SEQ ID NO: 475312 - DNA, 25 bp, Rattus norvegicus
tccacgcctccctaaggaacaggaa

SEQ ID NO: 475313 - DNA, 25 bp, Rattus norvegicus
gcgcggagcacctgctgtcgcttct

SEQ ID NO: 475314 - DNA, 25 bp, Rattus norvegicus
ggggaacgcgctcttctgcacagag

SEQ ID NO: 475315 - DNA, 25 bp, Rattus norvegicus
caggaaaggctttgcatctcgccac

SEQ ID NO: 475316 - DNA, 25 bp, Rattus norvegicus
cagcggggcctctgggatcctagtc

SEQ ID NO: 475317 - DNA, 25 bp, Rattus norvegicus
ccctggcgagcactttctgcagagt

SEQ ID NO: 475318 - DNA, 25 bp, Rattus norvegicus
gcgagcactttctgcagagtcctcc

SEQ ID NO: 475319 - DNA, 25 bp, Rattus norvegicus
cccgcgctcccaagtcttggggttg

SEQ ID NO: 475320 - DNA, 25 bp, Rattus norvegicus
ccagcacccgggcgatggttttgat

SEQ ID NO: 475321 - DNA, 25 bp, Rattus norvegicus
tgtcgcctccaggtaagcccgcggg

SEQ ID NO: 475322 - DNA, 25 bp, Rattus norvegicus
ttcggacccggaagtgctctcggga

SEQ ID NO: 475323 - DNA, 25 bp, Rattus norvegicus
ctgcgttttcggacccggaagtgct

SEQ ID NO: 475324 - DNA, 25 bp, Rattus norvegicus
atccgtcgctgtcgcctccaggtaa

SEQ ID NO: 475325 - DNA, 25 bp, Rattus norvegicus
gacccggaagtgctctcgggactcg

SEQ ID NO: 475326 - DNA, 25 bp, Rattus norvegicus
ggcctctgggatcctagtcaccgtc

SEQ ID NO: 475327 - DNA, 25 bp, Rattus norvegicus
tctgggatcctagtcaccgtcccat

SEQ ID NO: 475328 - DNA, 25 bp, Rattus norvegicus
tagtcaccgtcccatccgtcgctgt

SEQ ID NO: 475329 - DNA, 25 bp, Rattus norvegicus
cgatggttttgatggcttaggtggc

SEQ ID NO: 475330 - DNA, 25 bp, Rattus norvegicus
tgtgtcgtcacagaacgcgtgtcga

SEQ ID NO: 475331 - DNA, 25 bp, Rattus norvegicus
tggggccattcttcccgagtataac

SEQ ID NO: 475332 - DNA, 25 bp, Rattus norvegicus
cgagtataaccaccgcctccaattg

SEQ ID NO: 475333 - DNA, 25 bp, Rattus norvegicus
ccaattgcagacctgagtcgggttc

SEQ ID NO: 475334 - DNA, 25 bp, Rattus norvegicus
atgaggccgagcacgccaccaattc

SEQ ID NO: 475335 - DNA, 25 bp, Rattus norvegicus
aggccgctttctcccagctggggaa

SEQ ID NO: 475336 - DNA, 25 bp, Rattus norvegicus
ggctgctcgcccaaaccaggtgaca

SEQ ID NO: 475337 - DNA, 25 bp, Rattus norvegicus
cagggcctaccggagaaagatacgc

SEQ ID NO: 475338 - DNA, 25 bp, Rattus norvegicus
tagcttcactaacgcgtcggccata

SEQ ID NO: 475339 - DNA, 25 bp, Rattus norvegicus
acgcgtgtcgaaaaggcaagctgga

SEQ ID NO: 475340 - DNA, 25 bp, Rattus norvegicus
cccgcgctccgactaatggtaagtc

SEQ ID NO: 475341 - DNA, 25 bp, Rattus norvegicus
agagccggccgacaccataagcttc

SEQ ID NO: 475342 - DNA, 25 bp, Rattus norvegicus
cggcgcgccgaatatcgcgagatta

SEQ ID NO: 475343 - DNA, 25 bp, Rattus norvegicus
ggctcggactccgacatgttcccta

SEQ ID NO: 475344 - DNA, 25 bp, Rattus norvegicus
tccatacttggcgatcgctgcggcc

SEQ ID NO: 475345 - DNA, 25 bp, Rattus norvegicus
ctggtcgcgcaggaccgttgcgcct

SEQ ID NO: 475346 - DNA, 25 bp, Rattus norvegicus
agacgccactcttcgggtcctgagt

SEQ ID NO: 475347 - DNA, 25 bp, Rattus norvegicus
tccgggaccttaggcagacgccact

SEQ ID NO: 475348 - DNA, 25 bp, Rattus norvegicus
atgttcactcttgggcacccgggga

SEQ ID NO: 475349 - DNA, 25 bp, Rattus norvegicus
ccgcacgctcattggtcgcgagctg

SEQ ID NO: 475350 - DNA, 25 bp, Rattus norvegicus
cgcgcggcgctccatacttggcgat

SEQ ID NO: 475351 - DNA, 25 bp, Rattus norvegicus
ctgcaagaagcgaggctgacagtca

SEQ ID NO: 475352 - DNA, 25 bp, Rattus norvegicus
ctgacccggatgttcactcttgggc

SEQ ID NO: 475353 - DNA, 25 bp, Rattus norvegicus
tcaggggaaccagtgaaccgctcca

SEQ ID NO: 475354 - DNA, 25 bp, Rattus norvegicus
gcatcctctgctcaggggaaccagt

SEQ ID NO: 475355 - DNA, 25 bp, Rattus norvegicus
ttcctagtttcagcgccttccgcat

SEQ ID NO: 475356 - DNA, 25 bp, Rattus norvegicus
gtccagtgcgccagttccgggtccg

SEQ ID NO: 475357 - DNA, 25 bp, Rattus norvegicus
tgacagtcagaggagagacacaagc

SEQ ID NO: 475358 - DNA, 25 bp, Rattus norvegicus
agcgcggcctcaacgagctggacac

SEQ ID NO: 475359 - DNA, 25 bp, Rattus norvegicus
gcagcggcgactgcacaggtaaccg

SEQ ID NO: 475360 - DNA, 25 bp, Rattus norvegicus
acgagctggacaccgccttcatgta

SEQ ID NO: 475361 - DNA, 25 bp, Rattus norvegicus
ccttcatgtattgcgacggccagtc

SEQ ID NO: 475362 - DNA, 25 bp, Rattus norvegicus
gcgcgcaagcgcagtcttcatgttg

SEQ ID NO: 475363 - DNA, 25 bp, Rattus norvegicus
tccgaaagcatcctgggcagcctgg

SEQ ID NO: 475364 - DNA, 25 bp, Rattus norvegicus
aacaaggccgcccagtccaggaaag

SEQ ID NO: 475365 - DNA, 25 bp, Rattus norvegicus
acaggtaaccgctgcacccggtctt

SEQ ID NO: 475366 - DNA, 25 bp, Rattus norvegicus
ccgcacagagtagagccgagccagt

SEQ ID NO: 475367 - DNA, 25 bp, Rattus norvegicus
ccgcatggatgcgagtgctagcgct

SEQ ID NO: 475368 - DNA, 25 bp, Rattus norvegicus
cttcatgttgcgtgcagtgtcccga

SEQ ID NO: 475369 - DNA, 25 bp, Rattus norvegicus
agccgctctcagcttcaggatcgga

SEQ ID NO: 475370 - DNA, 25 bp, Rattus norvegicus
gtcccggatcggatccctggccaga

SEQ ID NO: 475371 - DNA, 25 bp, Rattus norvegicus
ttgcgacggccagtccgaaagcatc

SEQ ID NO: 475372 - DNA, 25 bp, Rattus norvegicus
tctacgaagaccaagtgggcaagtt

SEQ ID NO: 475373 - DNA, 25 bp, Rattus norvegicus
agtcctggttctgcctctgtgctgt

SEQ ID NO: 475374 - DNA, 25 bp, Rattus norvegicus
cgaatccggaacacttcaccaaggc

SEQ ID NO: 475375 - DNA, 25 bp, Rattus norvegicus
ctctgtgctgtgctacttgtccctg

SEQ ID NO: 475376 - DNA, 25 bp, Rattus norvegicus
tccctgcggccgcagtctacgaaga

SEQ ID NO: 475377 - DNA, 25 bp, Rattus norvegicus
ctctcgtgtgcctgacccgaagtgt

SEQ ID NO: 475378 - DNA, 25 bp, Rattus norvegicus
gtgcttgggcttcaatcatggcggc

SEQ ID NO: 475379 - DNA, 25 bp, Rattus norvegicus
acctacctttcttgtctcgcttgga

SEQ ID NO: 475380 - DNA, 25 bp, Rattus norvegicus
catcgcgctaaaggcacgtgcggcg

SEQ ID NO: 475381 - DNA, 25 bp, Rattus norvegicus
ttccctgcctgcgttctgcctaggg

SEQ ID NO: 475382 - DNA, 25 bp, Rattus norvegicus
tagggcctggaaggccacttctctg

SEQ ID NO: 475383 - DNA, 25 bp, Rattus norvegicus
ttctctgcccaggttccagagcctt

SEQ ID NO: 475384 - DNA, 25 bp, Rattus norvegicus
atcgccgcggcttccgaatccggaa

SEQ ID NO: 475385 - DNA, 25 bp, Rattus norvegicus
tcgcttggatttgggcatcgcgcta

SEQ ID NO: 475386 - DNA, 25 bp, Rattus norvegicus
ctgcacaggcgcagtaccctgggtt

SEQ ID NO: 475387 - DNA, 25 bp, Rattus norvegicus
gtagaccgcgcttcccgcgagcatg

SEQ ID NO: 475388 - DNA, 25 bp, Rattus norvegicus
agcatgcgcagtattgctcgccgcc

SEQ ID NO: 475389 - DNA, 25 bp, Rattus norvegicus
acgcgctgagggcttagctcctcgc

SEQ ID NO: 475390 - DNA, 25 bp, Rattus norvegicus
gtcctactccgccttcgagatgaag

SEQ ID NO: 475391 - DNA, 25 bp, Rattus norvegicus
agtacgacgaaagatggcgacgagc

SEQ ID NO: 475392 - DNA, 25 bp, Rattus norvegicus
agggagccgcagtagtacgacgaaa

SEQ ID NO: 475393 - DNA, 25 bp, Rattus norvegicus
tgacgcgcacgagtgcgtcacttcc

SEQ ID NO: 475394 - DNA, 25 bp, Rattus norvegicus
gcgcgctttctgacgcgcacgagtg

SEQ ID NO: 475395 - DNA, 25 bp, Rattus norvegicus
ccttgcgtttttgttgagcgacccg

SEQ ID NO: 475396 - DNA, 25 bp, Rattus norvegicus
ggccgtccatctccttgcgtttttg

SEQ ID NO: 475397 - DNA, 25 bp, Rattus norvegicus
ccggagaagtcagaggccgtccatc

SEQ ID NO: 475398 - DNA, 25 bp, Rattus norvegicus
ccggtcactctcaattctgcacagg

SEQ ID NO: 475399 - DNA, 25 bp, Rattus norvegicus
cagtaccctgggttgagcccggaga

SEQ ID NO: 475400 - DNA, 25 bp, Rattus norvegicus
agcagcaggatgtggaacagccaga

SEQ ID NO: 475401 - DNA, 25 bp, Rattus norvegicus
gggccggctcacgaaacagtcgacc

SEQ ID NO: 475402 - DNA, 25 bp, Rattus norvegicus
atctcgccgctagatggccaggtcc

SEQ ID NO: 475403 - DNA, 25 bp, Rattus norvegicus
cgctggcgacccttccagagcaggt

SEQ ID NO: 475404 - DNA, 25 bp, Rattus norvegicus
ggacgtaacaggtctggcgacaacc

SEQ ID NO: 475405 - DNA, 25 bp, Rattus norvegicus
cgaagaccgtcttctcggtgggccg

SEQ ID NO: 475406 - DNA, 25 bp, Rattus norvegicus
cgcggaagccatagagcagcgcctg

SEQ ID NO: 475407 - DNA, 25 bp, Rattus norvegicus
agagccacgctcagcaggtagcagc

SEQ ID NO: 475408 - DNA, 25 bp, Rattus norvegicus
catggagtagatgacgaacagcacc

SEQ ID NO: 475409 - DNA, 25 bp, Rattus norvegicus
cagccagaagcggtagtgggacacc

SEQ ID NO: 475410 - DNA, 25 bp, Rattus norvegicus
gcgtgttacacacgaactcctcctg

SEQ ID NO: 475411 - DNA, 25 bp, Rattus norvegicus
cagcaccaggatgcggaagatcagc

SEQ ID NO: 475412 - DNA, 25 bp, Rattus norvegicus
cagcatgatcaccagccagaggcga

SEQ ID NO: 475413 - DNA, 25 bp, Rattus norvegicus
gcccgacggcgaagtagaagaccac

SEQ ID NO: 475414 - DNA, 25 bp, Rattus norvegicus
ctttggtccacagttcaggctccgc

SEQ ID NO: 475415 - DNA, 25 bp, Rattus norvegicus
cgccctctccggacttaggccacgc

SEQ ID NO: 475416 - DNA, 25 bp, Rattus norvegicus
tgagactctgctcctaagcctccag

SEQ ID NO: 475417 - DNA, 25 bp, Rattus norvegicus
ggccacgcccatcggtccttggact

SEQ ID NO: 475418 - DNA, 25 bp, Rattus norvegicus
ccactcgtctgcgaggcgcctttgg

SEQ ID NO: 475419 - DNA, 25 bp, Rattus norvegicus
aggcgcctttggtccacagttcagg

SEQ ID NO: 475420 - DNA, 25 bp, Rattus norvegicus
ggctccgcccagcaacggcccagaa

SEQ ID NO: 475421 - DNA, 25 bp, Rattus norvegicus
gcctagcggggttcagatgatctaa

SEQ ID NO: 475422 - DNA, 25 bp, Rattus norvegicus
ggttcagatgatctaacgcagtctg

SEQ ID NO: 475423 - DNA, 25 bp, Rattus norvegicus
taacgcagtctgcatgcgaaactgc

SEQ ID NO: 475424 - DNA, 25 bp, Rattus norvegicus
gcatgcgaaactgcacccgagaacg

SEQ ID NO: 475425 - DNA, 25 bp, Rattus norvegicus
tgcacccgagaacgcggcagagccg

SEQ ID NO: 475426 - DNA, 25 bp, Rattus norvegicus
gacgctgaccgcacacaccacctag

SEQ ID NO: 475427 - DNA, 25 bp, Rattus norvegicus
cggcccagaaaaccctcgcctgcgt

SEQ ID NO: 475428 - DNA, 25 bp, Rattus norvegicus
tgaatagagtcgctttaacccgctg

SEQ ID NO: 475429 - DNA, 25 bp, Rattus norvegicus
cctgtgtctgaatagagtcgcttta

SEQ ID NO: 475430 - DNA, 25 bp, Rattus norvegicus
gaggctcgagctcggcttctactta

SEQ ID NO: 475431 - DNA, 25 bp, Rattus norvegicus
tcgagctcggcttctacttacagtc

SEQ ID NO: 475432 - DNA, 25 bp, Rattus norvegicus
ctcggcttctacttacagtcgtggc

SEQ ID NO: 475433 - DNA, 25 bp, Rattus norvegicus
tctacttacagtcgtggctggctgg

SEQ ID NO: 475434 - DNA, 25 bp, Rattus norvegicus
tcgtggctggctggtttgttctgat

SEQ ID NO: 475435 - DNA, 25 bp, Rattus norvegicus
tgcttaacccattgccgccctcggg

SEQ ID NO: 475436 - DNA, 25 bp, Rattus norvegicus
tgcttccctgtgtctgaatagagtc

SEQ ID NO: 475437 - DNA, 25 bp, Rattus norvegicus
tttaacccgctgcttaacccattgc

SEQ ID NO: 475438 - DNA, 25 bp, Rattus norvegicus
ccctcggggcctgacatctgtacgt

SEQ ID NO: 475439 - DNA, 25 bp, Rattus norvegicus
cctgacatctgtacgtgttgctcga

SEQ ID NO: 475440 - DNA, 25 bp, Rattus norvegicus
atctgtacgtgttgctcgactctcc

SEQ ID NO: 475441 - DNA, 25 bp, Rattus norvegicus
tcccgacattgcttccctgtgtctg

SEQ ID NO: 475442 - DNA, 25 bp, Rattus norvegicus
gtgcctaacacgaccaacctgcgga

SEQ ID NO: 475443 - DNA, 25 bp, Rattus norvegicus
gggctatcgacccagttctgcataa

SEQ ID NO: 475444 - DNA, 25 bp, Rattus norvegicus
gactgtgacgcctgcttgaacacca

SEQ ID NO: 475445 - DNA, 25 bp, Rattus norvegicus
aagccagggtatcccgtgcctaaca

SEQ ID NO: 475446 - DNA, 25 bp, Rattus norvegicus
cacacgggtacttttctgggcgtca

SEQ ID NO: 475447 - DNA, 25 bp, Rattus norvegicus
agccacctgttgagccagcgtctga

SEQ ID NO: 475448 - DNA, 25 bp, Rattus norvegicus
tctgaccaaaacgagcgacatctgc

SEQ ID NO: 475449 - DNA, 25 bp, Rattus norvegicus
atctgcattgccttccaggaggttc

SEQ ID NO: 475450 - DNA, 25 bp, Rattus norvegicus
ggttctgcccatacctgagtccagc

SEQ ID NO: 475451 - DNA, 25 bp, Rattus norvegicus
agtccagccaggtcatgaggtccga

SEQ ID NO: 475452 - DNA, 25 bp, Rattus norvegicus
cgcccgagctgagcctgtatagctt

SEQ ID NO: 475453 - DNA, 25 bp, Rattus norvegicus
cttcacgggttttgtgtggatcgcc

SEQ ID NO: 475454 - DNA, 25 bp, Rattus norvegicus
tactcagcagtttacgcggtggccc

SEQ ID NO: 475455 - DNA, 25 bp, Rattus norvegicus
tagcttctttcacgaggtgctccgc

SEQ ID NO: 475456 - DNA, 25 bp, Rattus norvegicus
tagtgggtcctctcgaaagccttct

SEQ ID NO: 475457 - DNA, 25 bp, Rattus norvegicus
ccgtgagcttggtcctctgtgccag

SEQ ID NO: 475458 - DNA, 25 bp, Rattus norvegicus
gggtcctctcgaaagccttctccag

SEQ ID NO: 475459 - DNA, 25 bp, Rattus norvegicus
tcagccgtgaatgtggtccgactgc

SEQ ID NO: 475460 - DNA, 25 bp, Rattus norvegicus
gtccgactgcgacgctgcttacgct

SEQ ID NO: 475461 - DNA, 25 bp, Rattus norvegicus
cgacgctgcttacgcttcagtggga

SEQ ID NO: 475462 - DNA, 25 bp, Rattus norvegicus
cgctgcttacgcttcagtgggaggt

SEQ ID NO: 475463 - DNA, 25 bp, Rattus norvegicus
aggtcgggttctgattccacgtccg

SEQ ID NO: 475464 - DNA, 25 bp, Rattus norvegicus
gttctgattccacgtccgagccttc

SEQ ID NO: 475465 - DNA, 25 bp, Rattus norvegicus
ttccacgtccgagccttcatcaaga

SEQ ID NO: 475466 - DNA, 25 bp, Rattus norvegicus
gagccttcatcaagacggttgccta

SEQ ID NO: 475467 - DNA, 25 bp, Rattus norvegicus
ttcatcaagacggttgcctacagcg

SEQ ID NO: 475468 - DNA, 25 bp, Rattus norvegicus
cgtgcctccgtgagcttggtcctct

SEQ ID NO: 475469 - DNA, 25 bp, Rattus norvegicus
tcctccagctgctcagccgtgaatg

SEQ ID NO: 475470 - DNA, 25 bp, Rattus norvegicus
gtttctacttccagcccggaggctg

SEQ ID NO: 475471 - DNA, 25 bp, Rattus norvegicus
gtcaagcgggcagaccgtgacccac

SEQ ID NO: 475472 - DNA, 25 bp, Rattus norvegicus
gacgcagaccgtttctacttccagc

SEQ ID NO: 475473 - DNA, 25 bp, Rattus norvegicus
gtcactcggagtcaagcgggcagac

SEQ ID NO: 475474 - DNA, 25 bp, Rattus norvegicus
cagctgcggggcgttaatctttggc

SEQ ID NO: 475475 - DNA, 25 bp, Rattus norvegicus
ttgccattgtttggggccgcagcca

SEQ ID NO: 475476 - DNA, 25 bp, Rattus norvegicus
tcttgccattgtttggggccgcagc

SEQ ID NO: 475477 - DNA, 25 bp, Rattus norvegicus
agaccgtgacccacccgcctcactg

SEQ ID NO: 475478 - DNA, 25 bp, Rattus norvegicus
cttcactttctaggtcttgccattg

SEQ ID NO: 475479 - DNA, 25 bp, Rattus norvegicus
gggctctgtactcctctggcgatcc

SEQ ID NO: 475480 - DNA, 25 bp, Rattus norvegicus
acagggctctgtactcctctggcga

SEQ ID NO: 475481 - DNA, 25 bp, Rattus norvegicus
cactggacagggctctgtactcctc

SEQ ID NO: 475482 - DNA, 25 bp, Rattus norvegicus
gcctcactggacagggctctgtact

SEQ ID NO: 475483 - DNA, 25 bp, Rattus norvegicus
tctaggtcttgccattgtttggggc

SEQ ID NO: 475484 - DNA, 25 bp, Rattus norvegicus
agacctcgtgcgctcgctaacggca

SEQ ID NO: 475485 - DNA, 25 bp, Rattus norvegicus
tcgctcgcttccaaggcttagaaac

SEQ ID NO: 475486 - DNA, 25 bp, Rattus norvegicus
tttctgcagacgctctcctactttc

SEQ ID NO: 475487 - DNA, 25 bp, Rattus norvegicus
ggtgtcacccaacgccgagcatcaa

SEQ ID NO: 475488 - DNA, 25 bp, Rattus norvegicus
gagccgcctttgtactggtgtcacc

SEQ ID NO: 475489 - DNA, 25 bp, Rattus norvegicus
cggcgcgctcgcctctaattaagcg

SEQ ID NO: 475490 - DNA, 25 bp, Rattus norvegicus
gcactgtcgcctttcagacccggga

SEQ ID NO: 475491 - DNA, 25 bp, Rattus norvegicus
aaatcgaggcgcagagacattcatc

SEQ ID NO: 475492 - DNA, 25 bp, Rattus norvegicus
acaagccagcggatggtcgcgaaca

SEQ ID NO: 475493 - DNA, 25 bp, Rattus norvegicus
attcatcgacgcatggcaagttgca

SEQ ID NO: 475494 - DNA, 25 bp, Rattus norvegicus
ctaacggcagccctggacttccaga

SEQ ID NO: 475495 - DNA, 25 bp, Rattus norvegicus
ccctggctctgaggacaaaacctgg

SEQ ID NO: 475496 - DNA, 25 bp, Rattus norvegicus
gcagcactttgcattctcgggcagt

SEQ ID NO: 475497 - DNA, 25 bp, Rattus norvegicus
ggaacagcacccgaagcagcacttt

SEQ ID NO: 475498 - DNA, 25 bp, Rattus norvegicus
tacagacgccttgaaacggccgccg

SEQ ID NO: 475499 - DNA, 25 bp, Rattus norvegicus
gtgaacacggaacgcgcgcgttcgc

SEQ ID NO: 475500 - DNA, 25 bp, Rattus norvegicus
ctcggtgcacgcgaatcttttaggt

SEQ ID NO: 475501 - DNA, 25 bp, Rattus norvegicus
ggtgcacgcgaatcttttaggtaca

SEQ ID NO: 475502 - DNA, 25 bp, Rattus norvegicus
cacgcgaatcttttaggtacagacg

SEQ ID NO: 475503 - DNA, 25 bp, Rattus norvegicus
aggtacagacgccttgaaacggccg

SEQ ID NO: 475504 - DNA, 25 bp, Rattus norvegicus
actccagcaacttcggtacgccggg

SEQ ID NO: 475505 - DNA, 25 bp, Rattus norvegicus
cagcaacttcggtacgccggggcct

SEQ ID NO: 475506 - DNA, 25 bp, Rattus norvegicus
ggcctggctcctgcatccctagtat

SEQ ID NO: 475507 - DNA, 25 bp, Rattus norvegicus
gttacggccctgcacgtcttctgcg

SEQ ID NO: 475508 - DNA, 25 bp, Rattus norvegicus
tgcgctctgcactcgttgattctcg

SEQ ID NO: 475509 - DNA, 25 bp, Rattus norvegicus
gccctgcacgtcttctgcgctctgc

SEQ ID NO: 475510 - DNA, 25 bp, Rattus norvegicus
ttgctcgactccagcaacttcggta

SEQ ID NO: 475511 - DNA, 25 bp, Rattus norvegicus
gaatcttttaggtacagacgccttg

SEQ ID NO: 475512 - DNA, 25 bp, Rattus norvegicus
gggagaaatagacccgtgcacccta

SEQ ID NO: 475513 - DNA, 25 bp, Rattus norvegicus
cgccgctcgggctaattcttattga

SEQ ID NO: 475514 - DNA, 25 bp, Rattus norvegicus
ttcttattgattgcagcggtcagtc

SEQ ID NO: 475515 - DNA, 25 bp, Rattus norvegicus
agtcagctgtcaggcggggtttcaa

SEQ ID NO: 475516 - DNA, 25 bp, Rattus norvegicus
tgcggggctggttaacaaattcatt

SEQ ID NO: 475517 - DNA, 25 bp, Rattus norvegicus
ttgtctcccgcacacttgtctaagt

SEQ ID NO: 475518 - DNA, 25 bp, Rattus norvegicus
ttgatcgacgccaaaatgccagctc

SEQ ID NO: 475519 - DNA, 25 bp, Rattus norvegicus
ccgcgctcccaggacttgcagtggt

SEQ ID NO: 475520 - DNA, 25 bp, Rattus norvegicus
caggccgccggcgatctgagacttt

SEQ ID NO: 475521 - DNA, 25 bp, Rattus norvegicus
tcccagctgtggcagaggttaatgc

SEQ ID NO: 475522 - DNA, 25 bp, Rattus norvegicus
tgcgtacacgttctcaccagaagcg

SEQ ID NO: 475523 - DNA, 25 bp, Rattus norvegicus
cagaagcgtgggaaaacgtggtctc

SEQ ID NO: 475524 - DNA, 25 bp, Rattus norvegicus
acctttgtcgcccaggatgccatcg

SEQ ID NO: 475525 - DNA, 25 bp, Rattus norvegicus
acagttgaggcgcaggtttgtgcta

SEQ ID NO: 475526 - DNA, 25 bp, Rattus norvegicus
tggcactatgcgttgttttcaatta

SEQ ID NO: 475527 - DNA, 25 bp, Rattus norvegicus
tggctgaaagccttccatcggttta

SEQ ID NO: 475528 - DNA, 25 bp, Rattus norvegicus
tacatcccggagtggctagagaatt

SEQ ID NO: 475529 - DNA, 25 bp, Rattus norvegicus
ccagagtcggctggataaacctctt

SEQ ID NO: 475530 - DNA, 25 bp, Rattus norvegicus
tctcccgggacatttgtagacttta

SEQ ID NO: 475531 - DNA, 25 bp, Rattus norvegicus
caattagtttgtgtccgagcgggga

SEQ ID NO: 475532 - DNA, 25 bp, Rattus norvegicus
gggaactccgcagtgccagagaata

SEQ ID NO: 475533 - DNA, 25 bp, Rattus norvegicus
tttaccggagcgcaaaatggaccag

SEQ ID NO: 475534 - DNA, 25 bp, Rattus norvegicus
tcaacggagtccacgcagaaactga

SEQ ID NO: 475535 - DNA, 25 bp, Rattus norvegicus
agtgtccgctctagaaacttcccgg

SEQ ID NO: 475536 - DNA, 25 bp, Rattus norvegicus
tccagcgcgatcttaccttccaggg

SEQ ID NO: 475537 - DNA, 25 bp, Rattus norvegicus
gccgggtctcatcatcctggggacc

SEQ ID NO: 475538 - DNA, 25 bp, Rattus norvegicus
gcacgccggagacgaatccagagtc

SEQ ID NO: 475539 - DNA, 25 bp, Rattus norvegicus
ttgctgtacagtttctcggtttcga

SEQ ID NO: 475540 - DNA, 25 bp, Rattus norvegicus
gcagcggtgacaactccatggtgac

SEQ ID NO: 475541 - DNA, 25 bp, Rattus norvegicus
catggtgaccgtcctgaaggggctc

SEQ ID NO: 475542 - DNA, 25 bp, Rattus norvegicus
gacaactccatggtgaccgtcctga

SEQ ID NO: 475543 - DNA, 25 bp, Rattus norvegicus
gaaggggctcgagaatcctaaaagc

SEQ ID NO: 475544 - DNA, 25 bp, Rattus norvegicus
tcccatccgcgagctgtacctgcag

SEQ ID NO: 475545 - DNA, 25 bp, Rattus norvegicus
gaagccgcgtaaaggctctactacc

SEQ ID NO: 475546 - DNA, 25 bp, Rattus norvegicus
tcatcacccgccatgaacgcagaag

SEQ ID NO: 475547 - DNA, 25 bp, Rattus norvegicus
ggcccaggagcctcaactttcatca

SEQ ID NO: 475548 - DNA, 25 bp, Rattus norvegicus
ccgccatgaacgcagaagccgcgta

SEQ ID NO: 475549 - DNA, 25 bp, Rattus norvegicus
gaccggcgacttggacgcttctcca

SEQ ID NO: 475550 - DNA, 25 bp, Rattus norvegicus
tgagaaacgctaggcgaccggcgac

SEQ ID NO: 475551 - DNA, 25 bp, Rattus norvegicus
aatcagtgagaaacgctaggcgacc

SEQ ID NO: 475552 - DNA, 25 bp, Rattus norvegicus
tcctaaaagcgacaaaatcagtgag

SEQ ID NO: 475553 - DNA, 25 bp, Rattus norvegicus
ttggacgcttctccacagacgtgcg

SEQ ID NO: 475554 - DNA, 25 bp, Rattus norvegicus
ctgcggttgaggtcaaaacggtaga

SEQ ID NO: 475555 - DNA, 25 bp, Rattus norvegicus
tccgccaggaagcagagtgtgcgcc

SEQ ID NO: 475556 - DNA, 25 bp, Rattus norvegicus
gcgcctgcgtcccacacaatagata

SEQ ID NO: 475557 - DNA, 25 bp, Rattus norvegicus
tagatacgatcgtccaccacggcgc

SEQ ID NO: 475558 - DNA, 25 bp, Rattus norvegicus
caccacggcgcactggaaggcatcg

SEQ ID NO: 475559 - DNA, 25 bp, Rattus norvegicus
gcaagcggtacgtggcacactcata

SEQ ID NO: 475560 - DNA, 25 bp, Rattus norvegicus
gtgcgccagggcaaatgtgtcattt

SEQ ID NO: 475561 - DNA, 25 bp, Rattus norvegicus
acggtagaggaagccattgacagcc

SEQ ID NO: 475562 - DNA, 25 bp, Rattus norvegicus
attgacagccaccatctcggccgtg

SEQ ID NO: 475563 - DNA, 25 bp, Rattus norvegicus
tcctgggccgagaatcggagcaaca

SEQ ID NO: 475564 - DNA, 25 bp, Rattus norvegicus
cggagcaacaagtagcgcaggctgc

SEQ ID NO: 475565 - DNA, 25 bp, Rattus norvegicus
aaagatctcattggcgcacaccgtg

SEQ ID NO: 475566 - DNA, 25 bp, Rattus norvegicus
agcggtacacgctgatgcccaggct

SEQ ID NO: 475567 - DNA, 25 bp, Rattus norvegicus
accagagccgtgtgctggcattgca

SEQ ID NO: 475568 - DNA, 25 bp, Rattus norvegicus
ggtgccaacgtcatttgaaacacta

SEQ ID NO: 475569 - DNA, 25 bp, Rattus norvegicus
cgcacggagtccgttttgataaagt

SEQ ID NO: 475570 - DNA, 25 bp, Rattus norvegicus
cgtatccagggacgcgctttgttgt

SEQ ID NO: 475571 - DNA, 25 bp, Rattus norvegicus
tgaaacactagcgtgggccgtatcc

SEQ ID NO: 475572 - DNA, 25 bp, Rattus norvegicus
gcgctttgttgtggggagaatccca

SEQ ID NO: 475573 - DNA, 25 bp, Rattus norvegicus
atcccagggcttgttatgaggggtc

SEQ ID NO: 475574 - DNA, 25 bp, Rattus norvegicus
ccgtgagagccctctctggagatca

SEQ ID NO: 475575 - DNA, 25 bp, Rattus norvegicus
tctctggagatcacttccaaggagc

SEQ ID NO: 475576 - DNA, 25 bp, Rattus norvegicus
agctctgggcgatttggattctctg

SEQ ID NO: 475577 - DNA, 25 bp, Rattus norvegicus
ggattctctgctgtttcccttgtca

SEQ ID NO: 475578 - DNA, 25 bp, Rattus norvegicus
tttcccttgtcaaatcggcgccttg

SEQ ID NO: 475579 - DNA, 25 bp, Rattus norvegicus
tcggcgccttgataaagctggtctc

SEQ ID NO: 475580 - DNA, 25 bp, Rattus norvegicus
aagctggtctccgacgtctctcaga

SEQ ID NO: 475581 - DNA, 25 bp, Rattus norvegicus
cgtctctcagagagcgcacggagtc

SEQ ID NO: 475582 - DNA, 25 bp, Rattus norvegicus
gcgggccgacaccttaatctctatc

SEQ ID NO: 475583 - DNA, 25 bp, Rattus norvegicus
ggtgagtcctcgctgctgaacgtcg

SEQ ID NO: 475584 - DNA, 25 bp, Rattus norvegicus
cctcgctcgggcctgtgagaccgga

SEQ ID NO: 475585 - DNA, 25 bp, Rattus norvegicus
gacatcaatacacgtggctccctgc

SEQ ID NO: 475586 - DNA, 25 bp, Rattus norvegicus
gctccgagggacatcaatacacgtg

SEQ ID NO: 475587 - DNA, 25 bp, Rattus norvegicus
ctgccagctccgagggacatcaata

SEQ ID NO: 475588 - DNA, 25 bp, Rattus norvegicus
ttaatacctttctgcctccagtcgc

SEQ ID NO: 475589 - DNA, 25 bp, Rattus norvegicus
aactgctaattaatacctttctgcc

SEQ ID NO: 475590 - DNA, 25 bp, Rattus norvegicus
agtgccggcaaataactgctaatta

SEQ ID NO: 475591 - DNA, 25 bp, Rattus norvegicus
tccatctccacagtgccggcaaata

SEQ ID NO: 475592 - DNA, 25 bp, Rattus norvegicus
tcggagccggtgaaactgactaggc

SEQ ID NO: 475593 - DNA, 25 bp, Rattus norvegicus
ttaatctctatccatctccacagtg

SEQ ID NO: 475594 - DNA, 25 bp, Rattus norvegicus
gcggctgctacaaaacggatgtgcg

SEQ ID NO: 475595 - DNA, 25 bp, Rattus norvegicus
tacaaaacggatgtgcgggccgaca

SEQ ID NO: 475596 - DNA, 25 bp, Rattus norvegicus
ggatttcgcacctctgtagagaaga

SEQ ID NO: 475597 - DNA, 25 bp, Rattus norvegicus
cgtcgcgaggactctcttgcttcca

SEQ ID NO: 475598 - DNA, 25 bp, Rattus norvegicus
ttccacctcgcacggtggcctggaa

SEQ ID NO: 475599 - DNA, 25 bp, Rattus norvegicus
tggatcccaccctgaggatttcgca

SEQ ID NO: 475600 - DNA, 25 bp, Rattus norvegicus
tagagaagagaagccttggaacctc

SEQ ID NO: 475601 - DNA, 25 bp, Rattus norvegicus
ggtccctgcgcccagcacaaagttt

SEQ ID NO: 475602 - DNA, 25 bp, Rattus norvegicus
tttcgagtgcgagatctgtgcttgc

SEQ ID NO: 475603 - DNA, 25 bp, Rattus norvegicus
agccgagaggcagcgtgtaagccac

SEQ ID NO: 475604 - DNA, 25 bp, Rattus norvegicus
tgtaagccacccacgtgccctggtt

SEQ ID NO: 475605 - DNA, 25 bp, Rattus norvegicus
tgcagaggctagcaagcggagccaa

SEQ ID NO: 475606 - DNA, 25 bp, Rattus norvegicus
agccaaggctccagggcgccggaat

SEQ ID NO: 475607 - DNA, 25 bp, Rattus norvegicus
gccggaatagctctccgcagccaag

SEQ ID NO: 475608 - DNA, 25 bp, Rattus norvegicus
gccaagccacaaacgagctcgcagg

SEQ ID NO: 475609 - DNA, 25 bp, Rattus norvegicus
gcctggaaagggaaactggatccca

SEQ ID NO: 475610 - DNA, 25 bp, Rattus norvegicus
taccgggatgctccgggatacacca

SEQ ID NO: 475611 - DNA, 25 bp, Rattus norvegicus
caggctactctgagctgtactagga

SEQ ID NO: 475612 - DNA, 25 bp, Rattus norvegicus
cttggagcagctcgcatggtgccca

SEQ ID NO: 475613 - DNA, 25 bp, Rattus norvegicus
cgcagctgctctcggctggtcggct

SEQ ID NO: 475614 - DNA, 25 bp, Rattus norvegicus
acacactggctgctctgggctgcac

SEQ ID NO: 475615 - DNA, 25 bp, Rattus norvegicus
tgtactaggatgctccgggctgcac

SEQ ID NO: 475616 - DNA, 25 bp, Rattus norvegicus
tcatgctaccgtggtcgggccgcca

SEQ ID NO: 475617 - DNA, 25 bp, Rattus norvegicus
gggatacaccaccaggctactctga

SEQ ID NO: 475618 - DNA, 25 bp, Rattus norvegicus
ctgctctgggctgtaccgggatgct

SEQ ID NO: 475619 - DNA, 25 bp, Rattus norvegicus
ggacgtcctcatgctaccgtggtcg

SEQ ID NO: 475620 - DNA, 25 bp, Rattus norvegicus
cagaagcgcttatgacccgggccgc

SEQ ID NO: 475621 - DNA, 25 bp, Rattus norvegicus
ctcgccatgggctcagaagcgctta

SEQ ID NO: 475622 - DNA, 25 bp, Rattus norvegicus
agctcgcatggtgcccaggagctga

SEQ ID NO: 475623 - DNA, 25 bp, Rattus norvegicus
cgggctgcaccagacacactggctg

SEQ ID NO: 475624 - DNA, 25 bp, Rattus norvegicus
gtcggcgacggaacagaccagccaa

SEQ ID NO: 475625 - DNA, 25 bp, Rattus norvegicus
gacggaacagaccagccaaaccgaa

SEQ ID NO: 475626 - DNA, 25 bp, Rattus norvegicus
ctcagcagaggaaggacgccactca

SEQ ID NO: 475627 - DNA, 25 bp, Rattus norvegicus
ccttggaccggggactgatcccagc

SEQ ID NO: 475628 - DNA, 25 bp, Rattus norvegicus
actgatcccagcatggaggtcgcca

SEQ ID NO: 475629 - DNA, 25 bp, Rattus norvegicus
ggtcgccatgacaccttcttacgtg

SEQ ID NO: 475630 - DNA, 25 bp, Rattus norvegicus
cggcagagctcagcaactcagcaga

SEQ ID NO: 475631 - DNA, 25 bp, Rattus norvegicus
ggaaggacgccactcagaccggagc

SEQ ID NO: 475632 - DNA, 25 bp, Rattus norvegicus
cggagccagatgtcgctgtggtccc

SEQ ID NO: 475633 - DNA, 25 bp, Rattus norvegicus
ctccaggcaatagaggtgggaatcc

SEQ ID NO: 475634 - DNA, 25 bp, Rattus norvegicus
ggcctcctccaagcaccagcacggg

SEQ ID NO: 475635 - DNA, 25 bp, Rattus norvegicus
ggctccaggttcagcactcctcgtt

SEQ ID NO: 475636 - DNA, 25 bp, Rattus norvegicus
ggttcagcactcctcgttccacggg

SEQ ID NO: 475637 - DNA, 25 bp, Rattus norvegicus
tcagaccggagccagatgtcgctgt

SEQ ID NO: 475638 - DNA, 25 bp, Rattus norvegicus
caggtgacctgtctagacgctcaga

SEQ ID NO: 475639 - DNA, 25 bp, Rattus norvegicus
gacctgtctagacgctcagagggaa

SEQ ID NO: 475640 - DNA, 25 bp, Rattus norvegicus
gtctagacgctcagagggaaaaaca

SEQ ID NO: 475641 - DNA, 25 bp, Rattus norvegicus
cagcgagtgtcctcaggtgacctgt

SEQ ID NO: 475642 - DNA, 25 bp, Rattus norvegicus
cgctcagagggaaaaacaagagaat

SEQ ID NO: 475643 - DNA, 25 bp, Rattus norvegicus
agcaactattttccagcgagtgtcc

SEQ ID NO: 475644 - DNA, 25 bp, Rattus norvegicus
ctgcgtgagcaaagcaactattttc

SEQ ID NO: 475645 - DNA, 25 bp, Rattus norvegicus
gagaatctgacactcttccgagccc

SEQ ID NO: 475646 - DNA, 25 bp, Rattus norvegicus
ctgctgcgtgagcaaagcaactatt

SEQ ID NO: 475647 - DNA, 25 bp, Rattus norvegicus
acgtccctcgttggctgctgcgtga

SEQ ID NO: 475648 - DNA, 25 bp, Rattus norvegicus
agtgtcctcaggtgacctgtctaga

SEQ ID NO: 475649 - DNA, 25 bp, Rattus norvegicus
gatcgctcaacgagggcacgtccct

SEQ ID NO: 475650 - DNA, 25 bp, Rattus norvegicus
cgaagacgcctcgtgacgcgcaggc

SEQ ID NO: 475651 - DNA, 25 bp, Rattus norvegicus
gagggcacgtccctcgttggctgct

SEQ ID NO: 475652 - DNA, 25 bp, Rattus norvegicus
gtcggttctcctataggctccggtc

SEQ ID NO: 475653 - DNA, 25 bp, Rattus norvegicus
ttctcctataggctccggtctgggc

SEQ ID NO: 475654 - DNA, 25 bp, Rattus norvegicus
gcgcatgctcctcggaggccctccc

SEQ ID NO: 475655 - DNA, 25 bp, Rattus norvegicus
cggttctcctataggctccggtctg

SEQ ID NO: 475656 - DNA, 25 bp, Rattus norvegicus
tggggtcggttctcctataggctcc

SEQ ID NO: 475657 - DNA, 25 bp, Rattus norvegicus
tgggctttgtctgcctccggtgccc

SEQ ID NO: 475658 - DNA, 25 bp, Rattus norvegicus
gcactgggctttgtctgcctccggt

SEQ ID NO: 475659 - DNA, 25 bp, Rattus norvegicus
agcggcactgggctttgtctgcctc

SEQ ID NO: 475660 - DNA, 25 bp, Rattus norvegicus
ggctctcctcctcccacccgcgacc

SEQ ID NO: 475661 - DNA, 25 bp, Rattus norvegicus
gcgcatgctccgtgtgtgccctgcg

SEQ ID NO: 475662 - DNA, 25 bp, Rattus norvegicus
tgcgcgcatgctccgtgtgtgccct

SEQ ID NO: 475663 - DNA, 25 bp, Rattus norvegicus
ggggctttgaggttcccgccgctgc

SEQ ID NO: 475664 - DNA, 25 bp, Rattus norvegicus
ctcctataggctccggtctgggcca

SEQ ID NO: 475665 - DNA, 25 bp, Rattus norvegicus
cctgctgagcggcactgggctttgt

SEQ ID NO: 475666 - DNA, 25 bp, Rattus norvegicus
ctgtagcaggtgctcattcccggga

SEQ ID NO: 475667 - DNA, 25 bp, Rattus norvegicus
tagacggacgggctcgcaggtccac

SEQ ID NO: 475668 - DNA, 25 bp, Rattus norvegicus
tcgcaggtccactccaagaagcgtc

SEQ ID NO: 475669 - DNA, 25 bp, Rattus norvegicus
ctccaagaagcgtccggcggacagc

SEQ ID NO: 475670 - DNA, 25 bp, Rattus norvegicus
cgcagcggagggctcacctgtagca

SEQ ID NO: 475671 - DNA, 25 bp, Rattus norvegicus
ctcattcccgggagcagcgcggact

SEQ ID NO: 475672 - DNA, 25 bp, Rattus norvegicus
cagccgcctctgcggggaaagatgc

SEQ ID NO: 475673 - DNA, 25 bp, Rattus norvegicus
gagcggaccgtacggctgcaatacg

SEQ ID NO: 475674 - DNA, 25 bp, Rattus norvegicus
tacggctgcaatacgggagccgcgt

SEQ ID NO: 475675 - DNA, 25 bp, Rattus norvegicus
tacgtgctgggcacgcagctctgga

SEQ ID NO: 475676 - DNA, 25 bp, Rattus norvegicus
gcacgcagctctggaccgatgtcta

SEQ ID NO: 475677 - DNA, 25 bp, Rattus norvegicus
ctggaccgatgtctacaggtgagcc

SEQ ID NO: 475678 - DNA, 25 bp, Rattus norvegicus
tgcagcttaaggccgccggctgctc

SEQ ID NO: 475679 - DNA, 25 bp, Rattus norvegicus
tgtctacaggtgagccgagacagcg

SEQ ID NO: 475680 - DNA, 25 bp, Rattus norvegicus
ggcacactcgcacttcctgtccgtt

SEQ ID NO: 475681 - DNA, 25 bp, Rattus norvegicus
gaaccgtgccggtcaccgaggctgc

SEQ ID NO: 475682 - DNA, 25 bp, Rattus norvegicus
ctctcggcagagtcggcctgcaggt

SEQ ID NO: 475683 - DNA, 25 bp, Rattus norvegicus
tttcggctacggctctcggcagagt

SEQ ID NO: 475684 - DNA, 25 bp, Rattus norvegicus
cttgaagcgcggcttttcggctacg

SEQ ID NO: 475685 - DNA, 25 bp, Rattus norvegicus
gggtctccttgaagcgcggcttttc

SEQ ID NO: 475686 - DNA, 25 bp, Rattus norvegicus
gctgacgtcaggagccaaaatggcg

SEQ ID NO: 475687 - DNA, 25 bp, Rattus norvegicus
tcccaccgcggtgttcgacgggatg

SEQ ID NO: 475688 - DNA, 25 bp, Rattus norvegicus
agaggccggcttcccaccgcggtgt

SEQ ID NO: 475689 - DNA, 25 bp, Rattus norvegicus
cttaggctgctagcggacctcaagg

SEQ ID NO: 475690 - DNA, 25 bp, Rattus norvegicus
ccactcgttggctcttaggctgcta

SEQ ID NO: 475691 - DNA, 25 bp, Rattus norvegicus
ggaagctgccttccactcgttggct

SEQ ID NO: 475692 - DNA, 25 bp, Rattus norvegicus
tttactcgggataccggaagctgcc

SEQ ID NO: 475693 - DNA, 25 bp, Rattus norvegicus
ttcagtggggaaccgtgccggtcac

SEQ ID NO: 475694 - DNA, 25 bp, Rattus norvegicus
tgcggagcaaaggactttcagatgt

SEQ ID NO: 475695 - DNA, 25 bp, Rattus norvegicus
actttcagatgttgtagcggtggcg

SEQ ID NO: 475696 - DNA, 25 bp, Rattus norvegicus
agcgcagcgcctcggtgtccaggct

SEQ ID NO: 475697 - DNA, 25 bp, Rattus norvegicus
aggctcgctctgctccagcgtgctt

SEQ ID NO: 475698 - DNA, 25 bp, Rattus norvegicus
agcgtgcttgctaacttcccttggc

SEQ ID NO: 475699 - DNA, 25 bp, Rattus norvegicus
ctccgggtctggttctctaagctct

SEQ ID NO: 475700 - DNA, 25 bp, Rattus norvegicus
tctaagctctctgggagctgcctcc

SEQ ID NO: 475701 - DNA, 25 bp, Rattus norvegicus
gggttccttgcagcccgctcgcgag

SEQ ID NO: 475702 - DNA, 25 bp, Rattus norvegicus
tgccctccttgctccgaggagaagc

SEQ ID NO: 475703 - DNA, 25 bp, Rattus norvegicus
cctggctgcggttgttgtgccactt

SEQ ID NO: 475704 - DNA, 25 bp, Rattus norvegicus
ccacgctgtggctcaggcatgcgct

SEQ ID NO: 475705 - DNA, 25 bp, Rattus norvegicus
cctgcgcacattgatgcacgggcaa

SEQ ID NO: 475706 - DNA, 25 bp, Rattus norvegicus
tgtatgcacggagctgtcggaaatc

SEQ ID NO: 475707 - DNA, 25 bp, Rattus norvegicus
cttccaactgcgtcgctttcttctg

SEQ ID NO: 475708 - DNA, 25 bp, Rattus norvegicus
ggagtcgaaatgagcgcaggtgagc

SEQ ID NO: 475709 - DNA, 25 bp, Rattus norvegicus
gcatcgttccagtcacggtcgcgtc

SEQ ID NO: 475710 - DNA, 25 bp, Rattus norvegicus
gcctcgcacgccgagcccaggccgc

SEQ ID NO: 475711 - DNA, 25 bp, Rattus norvegicus
cgatgagcgcgaggagtcgaaatga

SEQ ID NO: 475712 - DNA, 25 bp, Rattus norvegicus
actgcggcatcgttccagtcacggt

SEQ ID NO: 475713 - DNA, 25 bp, Rattus norvegicus
gcggcatcgttccagtcacggtcgc

SEQ ID NO: 475714 - DNA, 25 bp, Rattus norvegicus
accgactgcggcatcgttccagtca

SEQ ID NO: 475715 - DNA, 25 bp, Rattus norvegicus
atcgttccagtcacggtcgcgtcgt

SEQ ID NO: 475716 - DNA, 25 bp, Rattus norvegicus
gttccagtcacggtcgcgtcgtgca

SEQ ID NO: 475717 - DNA, 25 bp, Rattus norvegicus
tccagtcacggtcgcgtcgtgcagg

SEQ ID NO: 475718 - DNA, 25 bp, Rattus norvegicus
gcgtcgtgcaggtgccgcccagccc

SEQ ID NO: 475719 - DNA, 25 bp, Rattus norvegicus
tccgaagctcgcctcagtcggtgtc

SEQ ID NO: 475720 - DNA, 25 bp, Rattus norvegicus
cccggggcctcgcacgccgagccca

SEQ ID NO: 475721 - DNA, 25 bp, Rattus norvegicus
gcttgacggccgcagaccgactgcg

SEQ ID NO: 475722 - DNA, 25 bp, Rattus norvegicus
gtgcccgtgaaggagatcgtgatcc

SEQ ID NO: 475723 - DNA, 25 bp, Rattus norvegicus
gctcggtaccatctacagcatcatc

SEQ ID NO: 475724 - DNA, 25 bp, Rattus norvegicus
catcattctctaccgaaaccgggta

SEQ ID NO: 475725 - DNA, 25 bp, Rattus norvegicus
cgaaaccgggtaagccagaggccag

SEQ ID NO: 475726 - DNA, 25 bp, Rattus norvegicus
ctcctcccaggtgcccgtgaaggag

SEQ ID NO: 475727 - DNA, 25 bp, Rattus norvegicus
gagtaggccgcatacctcactctgc

SEQ ID NO: 475728 - DNA, 25 bp, Rattus norvegicus
gatcgtgatccgagctctggacctg

SEQ ID NO: 475729 - DNA, 25 bp, Rattus norvegicus
atccgagctctggacctggtgacgg

SEQ ID NO: 475730 - DNA, 25 bp, Rattus norvegicus
gccatgaccgtgtgcacactctacg

SEQ ID NO: 475731 - DNA, 25 bp, Rattus norvegicus
gcccagagccggctgcgtacacagg

SEQ ID NO: 475732 - DNA, 25 bp, Rattus norvegicus
gggcatcttctgtatccacccgctg

SEQ ID NO: 475733 - DNA, 25 bp, Rattus norvegicus
tccgtcctgggtgagtaggccgcat

SEQ ID NO: 475734 - DNA, 25 bp, Rattus norvegicus
cgctgcgcatcaacttggggggcaa

SEQ ID NO: 475735 - DNA, 25 bp, Rattus norvegicus
ggctgcgtacacagggcatcttctg

SEQ ID NO: 475736 - DNA, 25 bp, Rattus norvegicus
tccggagtgcccaggggtgtctggg

SEQ ID NO: 475737 - DNA, 25 bp, Rattus norvegicus
agcctcgagggtgcttcgtggcggc

SEQ ID NO: 475738 - DNA, 25 bp, Rattus norvegicus
cggcggcactctcagctgcactaga

SEQ ID NO: 475739 - DNA, 25 bp, Rattus norvegicus
ggcggcactctcagctgcactagag

SEQ ID NO: 475740 - DNA, 25 bp, Rattus norvegicus
cggcactctcagctgcactagagca

SEQ ID NO: 475741 - DNA, 25 bp, Rattus norvegicus
gcactctcagctgcactagagcaca

SEQ ID NO: 475742 - DNA, 25 bp, Rattus norvegicus
ccgatcccggagctggggagacttc

SEQ ID NO: 475743 - DNA, 25 bp, Rattus norvegicus
actctcagctgcactagagcacagc

SEQ ID NO: 475744 - DNA, 25 bp, Rattus norvegicus
tctcagctgcactagagcacagcgc

SEQ ID NO: 475745 - DNA, 25 bp, Rattus norvegicus
actccgatcccggagctggggagac

SEQ ID NO: 475746 - DNA, 25 bp, Rattus norvegicus
cgcagaggccccaacaggtaggcgc

SEQ ID NO: 475747 - DNA, 25 bp, Rattus norvegicus
gggcaccatgctccgcactccgatc

SEQ ID NO: 475748 - DNA, 25 bp, Rattus norvegicus
ggctggagcctcgagggtgcttcgt

SEQ ID NO: 475749 - DNA, 25 bp, Rattus norvegicus
ctcagctgcactagagcacagcgca

SEQ ID NO: 475750 - DNA, 25 bp, Rattus norvegicus
ccaacaggcctcgttcgcgtgcacg

SEQ ID NO: 475751 - DNA, 25 bp, Rattus norvegicus
gggagcccaacaggcctcgttcgcg

SEQ ID NO: 475752 - DNA, 25 bp, Rattus norvegicus
tccagggagcccaacaggcctcgtt

SEQ ID NO: 475753 - DNA, 25 bp, Rattus norvegicus
gcaccacgcgcctcctccagggagc

SEQ ID NO: 475754 - DNA, 25 bp, Rattus norvegicus
ttcttctcggcaccacgcgcctcct

SEQ ID NO: 475755 - DNA, 25 bp, Rattus norvegicus
cgagcagagtccagaagcttcttct

SEQ ID NO: 475756 - DNA, 25 bp, Rattus norvegicus
ctccagtcttagctccaggctgcga

SEQ ID NO: 475757 - DNA, 25 bp, Rattus norvegicus
agagtccagaagcttcttctcggca

SEQ ID NO: 475758 - DNA, 25 bp, Rattus norvegicus
agctctgaggtctctgcccgcacac

SEQ ID NO: 475759 - DNA, 25 bp, Rattus norvegicus
aagctcgacctccaggccctgggcc

SEQ ID NO: 475760 - DNA, 25 bp, Rattus norvegicus
cctccacgcgggcaagctcgacctc

SEQ ID NO: 475761 - DNA, 25 bp, Rattus norvegicus
gctacccggcgctgcgcctccacgc

SEQ ID NO: 475762 - DNA, 25 bp, Rattus norvegicus
gagcgcaggccacccagctgggcct

SEQ ID NO: 475763 - DNA, 25 bp, Rattus norvegicus
tgcgagcagagtccagaagcttctt

SEQ ID NO: 475764 - DNA, 25 bp, Rattus norvegicus
gagggctcgaccaaagagaaaggcc

SEQ ID NO: 475765 - DNA, 25 bp, Rattus norvegicus
acgaggagactccaatgggaacata

SEQ ID NO: 475766 - DNA, 25 bp, Rattus norvegicus
aatgggaacataccgctggtgcgtc

SEQ ID NO: 475767 - DNA, 25 bp, Rattus norvegicus
aggtccgccgccaagaccgagattg

SEQ ID NO: 475768 - DNA, 25 bp, Rattus norvegicus
gccaagaccgagattgcactgcccg

SEQ ID NO: 475769 - DNA, 25 bp, Rattus norvegicus
gcaaccaggggcgtggctccttgaa

SEQ ID NO: 475770 - DNA, 25 bp, Rattus norvegicus
gcagcggctcgcgtctgccagtgat

SEQ ID NO: 475771 - DNA, 25 bp, Rattus norvegicus
aaagagaaaggcctccgcagcgcgg

SEQ ID NO: 475772 - DNA, 25 bp, Rattus norvegicus
ctaaggagaccgctccaacgggcga

SEQ ID NO: 475773 - DNA, 25 bp, Rattus norvegicus
tctcctgtggagaaaggcggctaaa

SEQ ID NO: 475774 - DNA, 25 bp, Rattus norvegicus
cggctaaaacggagcatgcgcttca

SEQ ID NO: 475775 - DNA, 25 bp, Rattus norvegicus
cggagcatgcgcttcacggtgaaaa

SEQ ID NO: 475776 - DNA, 25 bp, Rattus norvegicus
caccaaaggggcgtggcgcaaccag

SEQ ID NO: 475777 - DNA, 25 bp, Rattus norvegicus
gctcgcgtctgccagtgatcgtcct

SEQ ID NO: 475778 - DNA, 25 bp, Rattus norvegicus
cgggcgcctcagatcagaacgtgaa

SEQ ID NO: 475779 - DNA, 25 bp, Rattus norvegicus
ccggagataggtacagggtccctga

SEQ ID NO: 475780 - DNA, 25 bp, Rattus norvegicus
caggtcctgtctagatcagaggctc

SEQ ID NO: 475781 - DNA, 25 bp, Rattus norvegicus
agtgacgcgacgctatgaccaggtc

SEQ ID NO: 475782 - DNA, 25 bp, Rattus norvegicus
gagctctcgggacttccggcttctt

SEQ ID NO: 475783 - DNA, 25 bp, Rattus norvegicus
ctggcttgacacagagaacagactc

SEQ ID NO: 475784 - DNA, 25 bp, Rattus norvegicus
cggtagacatggacctctggcttga

SEQ ID NO: 475785 - DNA, 25 bp, Rattus norvegicus
gttaagccagaaacggtcacctgta

SEQ ID NO: 475786 - DNA, 25 bp, Rattus norvegicus
ctagcccggataggaagtagccaca

SEQ ID NO: 475787 - DNA, 25 bp, Rattus norvegicus
ccagagcctggctatgaggttgccc

SEQ ID NO: 475788 - DNA, 25 bp, Rattus norvegicus
agcgctgtaacacgacccgtagatc

SEQ ID NO: 475789 - DNA, 25 bp, Rattus norvegicus
gggatcccgtcagaactgtcggtta

SEQ ID NO: 475790 - DNA, 25 bp, Rattus norvegicus
tcctccagatggagccgggttccct

SEQ ID NO: 475791 - DNA, 25 bp, Rattus norvegicus
ctcccagcggcagtatgttgtgatc

SEQ ID NO: 475792 - DNA, 25 bp, Rattus norvegicus
acggcgacacctagaacctgcgggt

SEQ ID NO: 475793 - DNA, 25 bp, Rattus norvegicus
agccgggaagccgatcagctgttcc

SEQ ID NO: 475794 - DNA, 25 bp, Rattus norvegicus
accgtgacgtgcacggcgacaccta

SEQ ID NO: 475795 - DNA, 25 bp, Rattus norvegicus
cgttgcctgctctctgactttccta

SEQ ID NO: 475796 - DNA, 25 bp, Rattus norvegicus
cggctcacgtaagtgcgggcgacac

SEQ ID NO: 475797 - DNA, 25 bp, Rattus norvegicus
gctgcacaacaacaaaaggacccgg

SEQ ID NO: 475798 - DNA, 25 bp, Rattus norvegicus
agctgttcccagagctgcacaacaa

SEQ ID NO: 475799 - DNA, 25 bp, Rattus norvegicus
cccgcacagcggattggtcggcctg

SEQ ID NO: 475800 - DNA, 25 bp, Rattus norvegicus
cgttagtgacaacctctcgcagggc

SEQ ID NO: 475801 - DNA, 25 bp, Rattus norvegicus
agtgccaggtcacgtgcgttagtga

SEQ ID NO: 475802 - DNA, 25 bp, Rattus norvegicus
tcacgctttgttgcccgggcttgtt

SEQ ID NO: 475803 - DNA, 25 bp, Rattus norvegicus
agtgttctccggctcacgctttgtt

SEQ ID NO: 475804 - DNA, 25 bp, Rattus norvegicus
acctgcgggtgacgggaaacctgct

SEQ ID NO: 475805 - DNA, 25 bp, Rattus norvegicus
ggctcttctcttggtcctgcgggct

SEQ ID NO: 475806 - DNA, 25 bp, Rattus norvegicus
agtttaaaacctacggcatctgcgg

SEQ ID NO: 475807 - DNA, 25 bp, Rattus norvegicus
ggacggcctcggtatgcagaacgac

SEQ ID NO: 475808 - DNA, 25 bp, Rattus norvegicus
catctgcggggccattcgcaggatg

SEQ ID NO: 475809 - DNA, 25 bp, Rattus norvegicus
tggtcagtttaaaacctacggcatc

SEQ ID NO: 475810 - DNA, 25 bp, Rattus norvegicus
acaggccgatttaatggtcagttta

SEQ ID NO: 475811 - DNA, 25 bp, Rattus norvegicus
gacaggagtacaggccgatttaatg

SEQ ID NO: 475812 - DNA, 25 bp, Rattus norvegicus
tccatccagatgaatgtggccgagg

SEQ ID NO: 475813 - DNA, 25 bp, Rattus norvegicus
tatgcagaacgacgccggcgagttt

SEQ ID NO: 475814 - DNA, 25 bp, Rattus norvegicus
aaggaccacgcgtccatccagatga

SEQ ID NO: 475815 - DNA, 25 bp, Rattus norvegicus
catcattgctgccaaggaccacgcg

SEQ ID NO: 475816 - DNA, 25 bp, Rattus norvegicus
gcgagcaaccgcatcattgctgcca

SEQ ID NO: 475817 - DNA, 25 bp, Rattus norvegicus
tggacctgtacgtgccgcggaaatg

SEQ ID NO: 475818 - DNA, 25 bp, Rattus norvegicus
ccggcgagtttgtggacctgtacgt

SEQ ID NO: 475819 - DNA, 25 bp, Rattus norvegicus
ccacgcgtccatccagatgaatgtg

SEQ ID NO: 475820 - DNA, 25 bp, Rattus norvegicus
gcgcccagtggtcccagaggacaca

SEQ ID NO: 475821 - DNA, 25 bp, Rattus norvegicus
cactgcgcagatctctgggtgggtc

SEQ ID NO: 475822 - DNA, 25 bp, Rattus norvegicus
cctgcgccttgaagcgcgctgggtc

SEQ ID NO: 475823 - DNA, 25 bp, Rattus norvegicus
tgcttgcagagtttaggggagctcc

SEQ ID NO: 475824 - DNA, 25 bp, Rattus norvegicus
tttaggggagctccgctgagatccc

SEQ ID NO: 475825 - DNA, 25 bp, Rattus norvegicus
ggagactcggagtaaaactgaaaga

SEQ ID NO: 475826 - DNA, 25 bp, Rattus norvegicus
tcaccagacagagcacaagaacttt

SEQ ID NO: 475827 - DNA, 25 bp, Rattus norvegicus
cccaggctcgctcactggggcggaa

SEQ ID NO: 475828 - DNA, 25 bp, Rattus norvegicus
cagaggacacatggttgcttgctcc

SEQ ID NO: 475829 - DNA, 25 bp, Rattus norvegicus
cctttaagaggccttcgcggcgctc

SEQ ID NO: 475830 - DNA, 25 bp, Rattus norvegicus
ttgagcgacgcgcacaccgctgggc

SEQ ID NO: 475831 - DNA, 25 bp, Rattus norvegicus
cacaagaactttaaaatggtccctg

SEQ ID NO: 475832 - DNA, 25 bp, Rattus norvegicus
agaaaacccaggctcgctcactggg

SEQ ID NO: 475833 - DNA, 25 bp, Rattus norvegicus
gaagagcggatgcttgcagagttta

SEQ ID NO: 475834 - DNA, 25 bp, Rattus norvegicus
cctcttctcagcagggtggtcctgg

SEQ ID NO: 475835 - DNA, 25 bp, Rattus norvegicus
cgtggccagggcaagaatggctttc

SEQ ID NO: 475836 - DNA, 25 bp, Rattus norvegicus
aagagtcctaggaagctccgctccc

SEQ ID NO: 475837 - DNA, 25 bp, Rattus norvegicus
gtgcagacctgtgccctcttctcag

SEQ ID NO: 475838 - DNA, 25 bp, Rattus norvegicus
gggacaggcgcccatttgcagccac

SEQ ID NO: 475839 - DNA, 25 bp, Rattus norvegicus
acgcctcctgcgctttatgcctggg

SEQ ID NO: 475840 - DNA, 25 bp, Rattus norvegicus
cggagcacagcaagcaccggcctga

SEQ ID NO: 475841 - DNA, 25 bp, Rattus norvegicus
gccgattccaaacaagagtcctagg

SEQ ID NO: 475842 - DNA, 25 bp, Rattus norvegicus
gggttccgccagctgtgaagatccc

SEQ ID NO: 475843 - DNA, 25 bp, Rattus norvegicus
gcgctgtcttctcccagtctgagca

SEQ ID NO: 475844 - DNA, 25 bp, Rattus norvegicus
gctccctcggtccttctcaatatgg

SEQ ID NO: 475845 - DNA, 25 bp, Rattus norvegicus
cttaagtcctcggtgaagagcggga

SEQ ID NO: 475846 - DNA, 25 bp, Rattus norvegicus
cttcaccggagacgcgaaaccgaga

SEQ ID NO: 475847 - DNA, 25 bp, Rattus norvegicus
agaccgctgccctcccgaattgggg

SEQ ID NO: 475848 - DNA, 25 bp, Rattus norvegicus
tactccgctgatggacgtgtggatg

SEQ ID NO: 475849 - DNA, 25 bp, Rattus norvegicus
gcaggaactgcgcagactgcgtacc

SEQ ID NO: 475850 - DNA, 25 bp, Rattus norvegicus
ataaagggactagtggcgcctccga

SEQ ID NO: 475851 - DNA, 25 bp, Rattus norvegicus
cgcctccgagaagctgtcccggatg

SEQ ID NO: 475852 - DNA, 25 bp, Rattus norvegicus
acacgctccggggaattttctgcgg

SEQ ID NO: 475853 - DNA, 25 bp, Rattus norvegicus
cgacgaacagcccttccagtgaaga

SEQ ID NO: 475854 - DNA, 25 bp, Rattus norvegicus
ttccagtgaagacgcggcaaggttt

SEQ ID NO: 475855 - DNA, 25 bp, Rattus norvegicus
gcaaggtttagtgcgccaaagattt

SEQ ID NO: 475856 - DNA, 25 bp, Rattus norvegicus
aggctcctcggatccctcagaagtc

SEQ ID NO: 475857 - DNA, 25 bp, Rattus norvegicus
aatttggatcctgtcccagccgggc

SEQ ID NO: 475858 - DNA, 25 bp, Rattus norvegicus
aggctcgctggagcctctcccggga

SEQ ID NO: 475859 - DNA, 25 bp, Rattus norvegicus
gctctgatcctctgtactccgctga

SEQ ID NO: 475860 - DNA, 25 bp, Rattus norvegicus
ccgcgttttggtccttgctggcgct

SEQ ID NO: 475861 - DNA, 25 bp, Rattus norvegicus
cctcagaagtctttcaatttggatc

SEQ ID NO: 475862 - DNA, 25 bp, Rattus norvegicus
gtcctggccacgctgagcctgcgcg

SEQ ID NO: 475863 - DNA, 25 bp, Rattus norvegicus
accttctcgctgtggcaggacatcc

SEQ ID NO: 475864 - DNA, 25 bp, Rattus norvegicus
cagcggcgtcctggccacgctgagc

SEQ ID NO: 475865 - DNA, 25 bp, Rattus norvegicus
tctaccaggagtacagcgacgtggc

SEQ ID NO: 475866 - DNA, 25 bp, Rattus norvegicus
gctccaccttctcgctgtggcagga

SEQ ID NO: 475867 - DNA, 25 bp, Rattus norvegicus
gaggctccaccttctcgctgtggca

SEQ ID NO: 475868 - DNA, 25 bp, Rattus norvegicus
cgcagcgctcgacgcgaggctccac

SEQ ID NO: 475869 - DNA, 25 bp, Rattus norvegicus
ccgagcagctctttccgcgcgcagc

SEQ ID NO: 475870 - DNA, 25 bp, Rattus norvegicus
tccaccttctcgctgtggcaggaca

SEQ ID NO: 475871 - DNA, 25 bp, Rattus norvegicus
tcctctaccaggagtacagcgacgt

SEQ ID NO: 475872 - DNA, 25 bp, Rattus norvegicus
agtacagcgacgtggccagcgcgcg

SEQ ID NO: 475873 - DNA, 25 bp, Rattus norvegicus
accaggagtacagcgacgtggccag

SEQ ID NO: 475874 - DNA, 25 bp, Rattus norvegicus
ctgtggcaggacatccccgacgtgc

SEQ ID NO: 475875 - DNA, 25 bp, Rattus norvegicus
ccagcgcgcgcgaattgcggcggca

SEQ ID NO: 475876 - DNA, 25 bp, Rattus norvegicus
gggcgcacctttggaaactgactta

SEQ ID NO: 475877 - DNA, 25 bp, Rattus norvegicus
ctctctggggcgcacctttggaaac

SEQ ID NO: 475878 - DNA, 25 bp, Rattus norvegicus
ctaacagggactccgggacacagga

SEQ ID NO: 475879 - DNA, 25 bp, Rattus norvegicus
aggtggccgcagctaacagggactc

SEQ ID NO: 475880 - DNA, 25 bp, Rattus norvegicus
atactctgagatcccaggttcactg

SEQ ID NO: 475881 - DNA, 25 bp, Rattus norvegicus
tttggaaactgacttagggctgctg

SEQ ID NO: 475882 - DNA, 25 bp, Rattus norvegicus
tgcagcatgaagcttcgggcagccg

SEQ ID NO: 475883 - DNA, 25 bp, Rattus norvegicus
cacagggaaaagaaggtgagtgtct

SEQ ID NO: 475884 - DNA, 25 bp, Rattus norvegicus
aagcttcgggcagccggtttctgcc

SEQ ID NO: 475885 - DNA, 25 bp, Rattus norvegicus
gccggtttctgcctggccctgttgt

SEQ ID NO: 475886 - DNA, 25 bp, Rattus norvegicus
ttctgcctggccctgttgtggggtt

SEQ ID NO: 475887 - DNA, 25 bp, Rattus norvegicus
cggggacgatcttggagactcatac

SEQ ID NO: 475888 - DNA, 25 bp, Rattus norvegicus
tgacttagggctgctgggtctcagc

SEQ ID NO: 475889 - DNA, 25 bp, Rattus norvegicus
cttggagactcatactctgagatcc

SEQ ID NO: 475890 - DNA, 25 bp, Rattus norvegicus
agagagtctcctgcggactccaggc

SEQ ID NO: 475891 - DNA, 25 bp, Rattus norvegicus
tagagagtctcctgcggactccagg

SEQ ID NO: 475892 - DNA, 25 bp, Rattus norvegicus
ctgcttctgggcatagagagtctcc

SEQ ID NO: 475893 - DNA, 25 bp, Rattus norvegicus
tgcttctgggcatagagagtctcct

SEQ ID NO: 475894 - DNA, 25 bp, Rattus norvegicus
gcttctgggcatagagagtctcctg

SEQ ID NO: 475895 - DNA, 25 bp, Rattus norvegicus
cttctgggcatagagagtctcctgc

SEQ ID NO: 475896 - DNA, 25 bp, Rattus norvegicus
ttctgggcatagagagtctcctgcg

SEQ ID NO: 475897 - DNA, 25 bp, Rattus norvegicus
tctgggcatagagagtctcctgcgg

SEQ ID NO: 475898 - DNA, 25 bp, Rattus norvegicus
ctgggcatagagagtctcctgcgga

SEQ ID NO: 475899 - DNA, 25 bp, Rattus norvegicus
tgggcatagagagtctcctgcggac

SEQ ID NO: 475900 - DNA, 25 bp, Rattus norvegicus
ggcatagagagtctcctgcggactc

SEQ ID NO: 475901 - DNA, 25 bp, Rattus norvegicus
gcatagagagtctcctgcggactcc

SEQ ID NO: 475902 - DNA, 25 bp, Rattus norvegicus
catagagagtctcctgcggactcca

SEQ ID NO: 475903 - DNA, 25 bp, Rattus norvegicus
gagtctcctgcggactccaggcggg

SEQ ID NO: 475904 - DNA, 25 bp, Rattus norvegicus
agcgcaaacttttccctgcttctgg

SEQ ID NO: 475905 - DNA, 25 bp, Rattus norvegicus
cggagctggcttccgtttcccacag

SEQ ID NO: 475906 - DNA, 25 bp, Rattus norvegicus
cctcagctagggtctccgagagggt

SEQ ID NO: 475907 - DNA, 25 bp, Rattus norvegicus
tgtccctcagctagggtctccgaga

SEQ ID NO: 475908 - DNA, 25 bp, Rattus norvegicus
gggcgttgtccctcagctagggtct

SEQ ID NO: 475909 - DNA, 25 bp, Rattus norvegicus
aaacttttccctgcttctgggcata

SEQ ID NO: 475910 - DNA, 25 bp, Rattus norvegicus
cccgcggtgtggagccgtcatctcg

SEQ ID NO: 475911 - DNA, 25 bp, Rattus norvegicus
ggccgcagagattgcctttgcccga

SEQ ID NO: 475912 - DNA, 25 bp, Rattus norvegicus
tgcgagggccgcagagattgccttt

SEQ ID NO: 475913 - DNA, 25 bp, Rattus norvegicus
cccagccacgctaggtgcgagggcc

SEQ ID NO: 475914 - DNA, 25 bp, Rattus norvegicus
tggcttccgtttcccacagcgcaaa

SEQ ID NO: 475915 - DNA, 25 bp, Rattus norvegicus
ccacggagagcccaggcacctggag

SEQ ID NO: 475916 - DNA, 25 bp, Rattus norvegicus
gcttcccgcggtgtggagccgtcat

SEQ ID NO: 475917 - DNA, 25 bp, Rattus norvegicus
agagattgcctttgcccgaggcgca

SEQ ID NO: 475918 - DNA, 25 bp, Rattus norvegicus
cccttgcacaacgagtctaatcttg

SEQ ID NO: 475919 - DNA, 25 bp, Rattus norvegicus
caacgagtctaatcttgcttttccc

SEQ ID NO: 475920 - DNA, 25 bp, Rattus norvegicus
gacgagtggcccacctcatcgagtg

SEQ ID NO: 475921 - DNA, 25 bp, Rattus norvegicus
ggctggagcgcccatcagtcaggct

SEQ ID NO: 475922 - DNA, 25 bp, Rattus norvegicus
catcagtcaggctgggagctgtccc

SEQ ID NO: 475923 - DNA, 25 bp, Rattus norvegicus
cccggcagaggacgaacattactgc

SEQ ID NO: 475924 - DNA, 25 bp, Rattus norvegicus
gaacattactgctgcctcccggacg

SEQ ID NO: 475925 - DNA, 25 bp, Rattus norvegicus
atctgggagagaggtctacagtctg

SEQ ID NO: 475926 - DNA, 25 bp, Rattus norvegicus
aggtctacagtctgaaggtgggcct

SEQ ID NO: 475927 - DNA, 25 bp, Rattus norvegicus
tgcagtaaaagcacaggatgtcggc

SEQ ID NO: 475928 - DNA, 25 bp, Rattus norvegicus
ggcactcggtggcttcctctatcac

SEQ ID NO: 475929 - DNA, 25 bp, Rattus norvegicus
tctatcacctgggacagcccagaga

SEQ ID NO: 475930 - DNA, 25 bp, Rattus norvegicus
cctcatcgagtggaaaggctggagc

SEQ ID NO: 475931 - DNA, 25 bp, Rattus norvegicus
ccagagagacccatataggcatagc

SEQ ID NO: 475932 - DNA, 25 bp, Rattus norvegicus
cacctccatctgtggtggggttcgg

SEQ ID NO: 475933 - DNA, 25 bp, Rattus norvegicus
aacttttggctggcgaggcgcatgc

SEQ ID NO: 475934 - DNA, 25 bp, Rattus norvegicus
cgcacctcggacgagcgctgcgcca

SEQ ID NO: 475935 - DNA, 25 bp, Rattus norvegicus
cgctgcgccagcgacggaagtcgca

SEQ ID NO: 475936 - DNA, 25 bp, Rattus norvegicus
acggaagtcgcagccgggaagccag

SEQ ID NO: 475937 - DNA, 25 bp, Rattus norvegicus
ggaagccagcgaggtccgttccgcc

SEQ ID NO: 475938 - DNA, 25 bp, Rattus norvegicus
gttccgcccgactctaacatggcgg

SEQ ID NO: 475939 - DNA, 25 bp, Rattus norvegicus
catggcggcgccctttgtctactgt

SEQ ID NO: 475940 - DNA, 25 bp, Rattus norvegicus
cggcgccctttgtctactgtgaagc

SEQ ID NO: 475941 - DNA, 25 bp, Rattus norvegicus
ctttgtctactgtgaagcgctgccc

SEQ ID NO: 475942 - DNA, 25 bp, Rattus norvegicus
gcggccgtgatgcacctccatctgt

SEQ ID NO: 475943 - DNA, 25 bp, Rattus norvegicus
ccgtgatgcacctccatctgtggtg

SEQ ID NO: 475944 - DNA, 25 bp, Rattus norvegicus
tgcacctccatctgtggtggggttc

SEQ ID NO: 475945 - DNA, 25 bp, Rattus norvegicus
acatggcaggtgagaccgggacggc

SEQ ID NO: 475946 - DNA, 25 bp, Rattus norvegicus
ctgcgggaaggagttcacgcacaca

SEQ ID NO: 475947 - DNA, 25 bp, Rattus norvegicus
gccagaaaccctaccagtgcgacta

SEQ ID NO: 475948 - DNA, 25 bp, Rattus norvegicus
aagcgccaccagctggtacacagtg

SEQ ID NO: 475949 - DNA, 25 bp, Rattus norvegicus
gggactgcggcaagctcttcaccac

SEQ ID NO: 475950 - DNA, 25 bp, Rattus norvegicus
atcagcctgctgaacctgcacaaga

SEQ ID NO: 475951 - DNA, 25 bp, Rattus norvegicus
gtgcggcaagagctacaggctcatc

SEQ ID NO: 475952 - DNA, 25 bp, Rattus norvegicus
gaccgcactgagtccaaggcttatg

SEQ ID NO: 475953 - DNA, 25 bp, Rattus norvegicus
acagcccgttgaaaccctatgggtg

SEQ ID NO: 475954 - DNA, 25 bp, Rattus norvegicus
cttcctatggcctagcaccttctga

SEQ ID NO: 475955 - DNA, 25 bp, Rattus norvegicus
aggctcacgagaagacacacaggta

SEQ ID NO: 475956 - DNA, 25 bp, Rattus norvegicus
agtgcagcaaggctttctcggaccc

SEQ ID NO: 475957 - DNA, 25 bp, Rattus norvegicus
ccattctcctgtcgggagtgcagca

SEQ ID NO: 475958 - DNA, 25 bp, Rattus norvegicus
tgcgactactgtggccgttcattct

SEQ ID NO: 475959 - DNA, 25 bp, Rattus norvegicus
cacagggaacttcaaacggcacatc

SEQ ID NO: 475960 - DNA, 25 bp, Rattus norvegicus
ccgctcatggtctcggtcagattca

SEQ ID NO: 475961 - DNA, 25 bp, Rattus norvegicus
ttttgtatagcgctccaaccgtgcc

SEQ ID NO: 475962 - DNA, 25 bp, Rattus norvegicus
accgtgccttctccagcttatcgta

SEQ ID NO: 475963 - DNA, 25 bp, Rattus norvegicus
acttctctctgaggaccggcggtac

SEQ ID NO: 475964 - DNA, 25 bp, Rattus norvegicus
cgacgcaagtgcacgggactctgac

SEQ ID NO: 475965 - DNA, 25 bp, Rattus norvegicus
tgacttcgctcaatgggcctccgct

SEQ ID NO: 475966 - DNA, 25 bp, Rattus norvegicus
ctgcctatagctgtattcccgaatg

SEQ ID NO: 475967 - DNA, 25 bp, Rattus norvegicus
agggtcgctcctgtattctctgtac

SEQ ID NO: 475968 - DNA, 25 bp, Rattus norvegicus
ctctgtactctcgagggtcatcata

SEQ ID NO: 475969 - DNA, 25 bp, Rattus norvegicus
gggactcgtaatactctccttggta

SEQ ID NO: 475970 - DNA, 25 bp, Rattus norvegicus
tggtacgtctcccactccgagtaaa

SEQ ID NO: 475971 - DNA, 25 bp, Rattus norvegicus
aaagctctctccctcgagctgggta

SEQ ID NO: 475972 - DNA, 25 bp, Rattus norvegicus
acccgctcagcgtcaaaaattcgtt

SEQ ID NO: 475973 - DNA, 25 bp, Rattus norvegicus
cccgaatgtcttgttcataagggtc

SEQ ID NO: 475974 - DNA, 25 bp, Rattus norvegicus
ggttgggtctcaaatccaccgcctg

SEQ ID NO: 475975 - DNA, 25 bp, Rattus norvegicus
ttctgacaaaattcggctcttggaa

SEQ ID NO: 475976 - DNA, 25 bp, Rattus norvegicus
tccttctgacaaaattcggctcttg

SEQ ID NO: 475977 - DNA, 25 bp, Rattus norvegicus
ggatccttctgacaaaattcggctc

SEQ ID NO: 475978 - DNA, 25 bp, Rattus norvegicus
tgccggatccttctgacaaaattcg

SEQ ID NO: 475979 - DNA, 25 bp, Rattus norvegicus
gttgccggatccttctgacaaaatt

SEQ ID NO: 475980 - DNA, 25 bp, Rattus norvegicus
cagttgccggatccttctgacaaaa

SEQ ID NO: 475981 - DNA, 25 bp, Rattus norvegicus
tgactgtcagttgccggatccttct

SEQ ID NO: 475982 - DNA, 25 bp, Rattus norvegicus
tttgactgtcagttgccggatcctt

SEQ ID NO: 475983 - DNA, 25 bp, Rattus norvegicus
caccgcctgcgtaggagaagttctc

SEQ ID NO: 475984 - DNA, 25 bp, Rattus norvegicus
caaatccaccgcctgcgtaggagaa

SEQ ID NO: 475985 - DNA, 25 bp, Rattus norvegicus
gtctcaaatccaccgcctgcgtagg

SEQ ID NO: 475986 - DNA, 25 bp, Rattus norvegicus
tcttggaacgtcttccagagctgca

SEQ ID NO: 475987 - DNA, 25 bp, Rattus norvegicus
gggtctcaaatccaccgcctgcgta

SEQ ID NO: 475988 - DNA, 25 bp, Rattus norvegicus
atgaattttcacaggcgatcgcaga

SEQ ID NO: 475989 - DNA, 25 bp, Rattus norvegicus
ctcaccaaagaggttccagaccaga

SEQ ID NO: 475990 - DNA, 25 bp, Rattus norvegicus
cagaccgggcgacacaacccatttt

SEQ ID NO: 475991 - DNA, 25 bp, Rattus norvegicus
ccggttgactctaatgaggacgttc

SEQ ID NO: 475992 - DNA, 25 bp, Rattus norvegicus
aattatattctctgcacccactgga

SEQ ID NO: 475993 - DNA, 25 bp, Rattus norvegicus
gggaattcagagtacgaccaacttg

SEQ ID NO: 475994 - DNA, 25 bp, Rattus norvegicus
tgaggcctctagcagttacgggaca

SEQ ID NO: 475995 - DNA, 25 bp, Rattus norvegicus
tctgggagcaaataagcgcggaatg

SEQ ID NO: 475996 - DNA, 25 bp, Rattus norvegicus
gcgcggaatgctaccaacgcgtata

SEQ ID NO: 475997 - DNA, 25 bp, Rattus norvegicus
gatctattgtaaaaaccgctcggtc

SEQ ID NO: 475998 - DNA, 25 bp, Rattus norvegicus
aatgcatccgcagcgccttggcgtt

SEQ ID NO: 475999 - DNA, 25 bp, Rattus norvegicus
atctgccgctgcacgaatcttcgga

SEQ ID NO: 476000 - DNA, 25 bp, Rattus norvegicus
tcaatggccctccagaaaggcgctc

SEQ ID NO: 476001 - DNA, 25 bp, Rattus norvegicus
acacgctacgggacacgcatttctg

SEQ ID NO: 476002 - DNA, 25 bp, Rattus norvegicus
caagcggtttctagaggacaaagtc

SEQ ID NO: 476003 - DNA, 25 bp, Rattus norvegicus
tgcttgggaaagtggtccgaaccag

SEQ ID NO: 476004 - DNA, 25 bp, Rattus norvegicus
cgcctgcttgggaaagtggtccgaa

SEQ ID NO: 476005 - DNA, 25 bp, Rattus norvegicus
ggccaagcggtttctagaggacaaa

SEQ ID NO: 476006 - DNA, 25 bp, Rattus norvegicus
gtccctagcctgtccgccctacgga

SEQ ID NO: 476007 - DNA, 25 bp, Rattus norvegicus
tagaggacaaagtccctagcctgtc

SEQ ID NO: 476008 - DNA, 25 bp, Rattus norvegicus
ctccctgcgatcaggcgttgctctg

SEQ ID NO: 476009 - DNA, 25 bp, Rattus norvegicus
gcttctccctgcgatcaggcgttgc

SEQ ID NO: 476010 - DNA, 25 bp, Rattus norvegicus
tggggccgcttctccctgcgatcag

SEQ ID NO: 476011 - DNA, 25 bp, Rattus norvegicus
atcaggcgttgctctggggaaacac

SEQ ID NO: 476012 - DNA, 25 bp, Rattus norvegicus
cgttgctctggggaaacacaagaga

SEQ ID NO: 476013 - DNA, 25 bp, Rattus norvegicus
ctctggggaaacacaagagaacccg

SEQ ID NO: 476014 - DNA, 25 bp, Rattus norvegicus
tagtttcgaggccaagcggtttcta

SEQ ID NO: 476015 - DNA, 25 bp, Rattus norvegicus
aggacaaagtccctagcctgtccgc

SEQ ID NO: 476016 - DNA, 25 bp, Rattus norvegicus
ctccagagtctgcagattgcgtttc

SEQ ID NO: 476017 - DNA, 25 bp, Rattus norvegicus
cgtcagaagggttagtagcccgctt

SEQ ID NO: 476018 - DNA, 25 bp, Rattus norvegicus
cgatgcactctgaagaggaatcgtc

SEQ ID NO: 476019 - DNA, 25 bp, Rattus norvegicus
aatctgttgctgcagcgatgcactc

SEQ ID NO: 476020 - DNA, 25 bp, Rattus norvegicus
tcctgcgtcgtctgaaatctgttgc

SEQ ID NO: 476021 - DNA, 25 bp, Rattus norvegicus
cagctcgtttctggccgccgtgatt

SEQ ID NO: 476022 - DNA, 25 bp, Rattus norvegicus
agtctgcagattgcgtttcagttcc

SEQ ID NO: 476023 - DNA, 25 bp, Rattus norvegicus
gtgattgctcctgcgtcgtctgaaa

SEQ ID NO: 476024 - DNA, 25 bp, Rattus norvegicus
ggattgaagttctatctccagagtc

SEQ ID NO: 476025 - DNA, 25 bp, Rattus norvegicus
ccatagccgtgatggattgaagttc

SEQ ID NO: 476026 - DNA, 25 bp, Rattus norvegicus
tccgttctcacgtaccatagccgtg

SEQ ID NO: 476027 - DNA, 25 bp, Rattus norvegicus
acgccttcagttccgttctcacgta

SEQ ID NO: 476028 - DNA, 25 bp, Rattus norvegicus
gcccgcttgattgtttgccaaacga

SEQ ID NO: 476029 - DNA, 25 bp, Rattus norvegicus
ttcagttccatcagctcgtttctgg

SEQ ID NO: 476030 - DNA, 25 bp, Rattus norvegicus
aggtcctcaaatgctctcctcgtca

SEQ ID NO: 476031 - DNA, 25 bp, Rattus norvegicus
gcgcggaaaggccacccatttctct

SEQ ID NO: 476032 - DNA, 25 bp, Rattus norvegicus
cgggaagcgaaccttgtctgagaga

SEQ ID NO: 476033 - DNA, 25 bp, Rattus norvegicus
gccattttgtaacgcggccgccatt

SEQ ID NO: 476034 - DNA, 25 bp, Rattus norvegicus
gtccaaagtacacggcctgagcaga

SEQ ID NO: 476035 - DNA, 25 bp, Rattus norvegicus
acctagtggctcctggctgagttac

SEQ ID NO: 476036 - DNA, 25 bp, Rattus norvegicus
gtccgtgcctgaagccaggcgcatg

SEQ ID NO: 476037 - DNA, 25 bp, Rattus norvegicus
tgtccattgtgagagaggaccgccc

SEQ ID NO: 476038 - DNA, 25 bp, Rattus norvegicus
cgcgggattcagaaggataggatca

SEQ ID NO: 476039 - DNA, 25 bp, Rattus norvegicus
tcccagtccctcaaaggaacgcgag

SEQ ID NO: 476040 - DNA, 25 bp, Rattus norvegicus
agcccacccagctgccattttgtaa

SEQ ID NO: 476041 - DNA, 25 bp, Rattus norvegicus
ggaaaaccgcacacggccgaactgc

SEQ ID NO: 476042 - DNA, 25 bp, Rattus norvegicus
tcacggaggcaacgcggaaaaccgc

SEQ ID NO: 476043 - DNA, 25 bp, Rattus norvegicus
gctgagttaccctgagaagtttctg

SEQ ID NO: 476044 - DNA, 25 bp, Rattus norvegicus
cagggagctcagagatccgggtctc

SEQ ID NO: 476045 - DNA, 25 bp, Rattus norvegicus
cttcttcaccgacagcgagatgttc

SEQ ID NO: 476046 - DNA, 25 bp, Rattus norvegicus
tggagaccagggagctcagagatcc

SEQ ID NO: 476047 - DNA, 25 bp, Rattus norvegicus
tgcgcggccgcaggaactgatgtca

SEQ ID NO: 476048 - DNA, 25 bp, Rattus norvegicus
aggattcggtccttcacctcccgag

SEQ ID NO: 476049 - DNA, 25 bp, Rattus norvegicus
cgagatgttctccaggattcggtcc

SEQ ID NO: 476050 - DNA, 25 bp, Rattus norvegicus
aaaatagctcggaggccgcggcgct

SEQ ID NO: 476051 - DNA, 25 bp, Rattus norvegicus
tctttaaaaatagctcggaggccgc

SEQ ID NO: 476052 - DNA, 25 bp, Rattus norvegicus
acgctgacctcaactttgttcttta

SEQ ID NO: 476053 - DNA, 25 bp, Rattus norvegicus
ggagctccgaggacgctgacctcaa

SEQ ID NO: 476054 - DNA, 25 bp, Rattus norvegicus
ttcccgaggtgtcaccggccagtct

SEQ ID NO: 476055 - DNA, 25 bp, Rattus norvegicus
cggggacctgcagatcgcatagatc

SEQ ID NO: 476056 - DNA, 25 bp, Rattus norvegicus
cgggtcaaaggaggccgctcacctt

SEQ ID NO: 476057 - DNA, 25 bp, Rattus norvegicus
tcaccggccagtctcgggaaggcaa

SEQ ID NO: 476058 - DNA, 25 bp, Rattus norvegicus
actcgagctcgcacagcgcgcggaa

SEQ ID NO: 476059 - DNA, 25 bp, Rattus norvegicus
ctccttcgcgactcttggatgtggg

SEQ ID NO: 476060 - DNA, 25 bp, Rattus norvegicus
tgcagcctccttcgcgactcttgga

SEQ ID NO: 476061 - DNA, 25 bp, Rattus norvegicus
agccgtaaagcacgccaggctgcag

SEQ ID NO: 476062 - DNA, 25 bp, Rattus norvegicus
cgtcgcaacgcgacagccgtaaagc

SEQ ID NO: 476063 - DNA, 25 bp, Rattus norvegicus
cagtacacggtgagcagcatggccc

SEQ ID NO: 476064 - DNA, 25 bp, Rattus norvegicus
ctccgcacacagtacacggtgagca

SEQ ID NO: 476065 - DNA, 25 bp, Rattus norvegicus
ggagaggtccctccgcacacagtac

SEQ ID NO: 476066 - DNA, 25 bp, Rattus norvegicus
aggtcacctcggagaggtccctccg

SEQ ID NO: 476067 - DNA, 25 bp, Rattus norvegicus
cacagcgcgcggaagttgtgcagct

SEQ ID NO: 476068 - DNA, 25 bp, Rattus norvegicus
ggatcccggactcgagctcgcacag

SEQ ID NO: 476069 - DNA, 25 bp, Rattus norvegicus
tgcatctacgggaggctgcaggact

SEQ ID NO: 476070 - DNA, 25 bp, Rattus norvegicus
cctctagctgcagtgtgtgcatcta

SEQ ID NO: 476071 - DNA, 25 bp, Rattus norvegicus
tgcagctcgaagtcggcgtcgacct

SEQ ID NO: 476072 - DNA, 25 bp, Rattus norvegicus
gtagaatcgcttcccacgcagactc

SEQ ID NO: 476073 - DNA, 25 bp, Rattus norvegicus
acgcagactcgcgaaaagtctttga

SEQ ID NO: 476074 - DNA, 25 bp, Rattus norvegicus
gtctttgaagcgcatttgggatctc

SEQ ID NO: 476075 - DNA, 25 bp, Rattus norvegicus
catttgggatctcgatgggcactta

SEQ ID NO: 476076 - DNA, 25 bp, Rattus norvegicus
cgatgggcacttaagccaaagaagc

SEQ ID NO: 476077 - DNA, 25 bp, Rattus norvegicus
ccaatgcttcgtctgtgggtgtgtc

SEQ ID NO: 476078 - DNA, 25 bp, Rattus norvegicus
ccaaagaagcgcttggtgcaaggac

SEQ ID NO: 476079 - DNA, 25 bp, Rattus norvegicus
gacttcccagccaatgcttcgtctg

SEQ ID NO: 476080 - DNA, 25 bp, Rattus norvegicus
tgactgtggcccgtgcgtatgctgc

SEQ ID NO: 476081 - DNA, 25 bp, Rattus norvegicus
cgcaatgggcgggtccgcctagtca

SEQ ID NO: 476082 - DNA, 25 bp, Rattus norvegicus
ttgctaaggtgactgtggcccgtgc

SEQ ID NO: 476083 - DNA, 25 bp, Rattus norvegicus
cgggtccgcctagtcacgtgacttc

SEQ ID NO: 476084 - DNA, 25 bp, Rattus norvegicus
tagtcacgtgacttcccagccaatg

SEQ ID NO: 476085 - DNA, 25 bp, Rattus norvegicus
gtttcctgtagaatcgcttcccacg

SEQ ID NO: 476086 - DNA, 25 bp, Rattus norvegicus
gcaggaccaagtcccgactccggtg

SEQ ID NO: 476087 - DNA, 25 bp, Rattus norvegicus
tcgcggaggatctcacggaagatcc

SEQ ID NO: 476088 - DNA, 25 bp, Rattus norvegicus
cgcagagtccgtgctccagtgaatc

SEQ ID NO: 476089 - DNA, 25 bp, Rattus norvegicus
cccaaacgcaggtggctgaggctcc

SEQ ID NO: 476090 - DNA, 25 bp, Rattus norvegicus
gcgtgcctactagcgaggccaactc

SEQ ID NO: 476091 - DNA, 25 bp, Rattus norvegicus
cgggccgtcacgtgtcacttaaaga

SEQ ID NO: 476092 - DNA, 25 bp, Rattus norvegicus
acccagtgtctggaaggcgtgcaag

SEQ ID NO: 476093 - DNA, 25 bp, Rattus norvegicus
aaggactgggtttaggctgcactct

SEQ ID NO: 476094 - DNA, 25 bp, Rattus norvegicus
tgcactctcagccagcctattttgg

SEQ ID NO: 476095 - DNA, 25 bp, Rattus norvegicus
attttggccctgatggtctccgtag

SEQ ID NO: 476096 - DNA, 25 bp, Rattus norvegicus
ttgctataggaacggagcgcgctct

SEQ ID NO: 476097 - DNA, 25 bp, Rattus norvegicus
gctgggtctgaaggcttgatcttga

SEQ ID NO: 476098 - DNA, 25 bp, Rattus norvegicus
gcttgatcttgaccagcgaggccag

SEQ ID NO: 476099 - DNA, 25 bp, Rattus norvegicus
ctggccaacaggtagccctcggtgt

SEQ ID NO: 476100 - DNA, 25 bp, Rattus norvegicus
gctggtctatgaggcaaggaagagc

SEQ ID NO: 476101 - DNA, 25 bp, Rattus norvegicus
cggagcgaaggaactccatagggcc

SEQ ID NO: 476102 - DNA, 25 bp, Rattus norvegicus
acgaagcaaggacatcttggggcgt

SEQ ID NO: 476103 - DNA, 25 bp, Rattus norvegicus
ggcggaacgaagcaaggacatcttg

SEQ ID NO: 476104 - DNA, 25 bp, Rattus norvegicus
ccagcaggcggaacgaagcaaggac

SEQ ID NO: 476105 - DNA, 25 bp, Rattus norvegicus
cgagtcttatatgaggcgtgtgacg

SEQ ID NO: 476106 - DNA, 25 bp, Rattus norvegicus
aggaagagcgagtcttatatgaggc

SEQ ID NO: 476107 - DNA, 25 bp, Rattus norvegicus
agcgaaggaactccatagggccgga

SEQ ID NO: 476108 - DNA, 25 bp, Rattus norvegicus
gcatggaaagtcacgtgggtcgcat

SEQ ID NO: 476109 - DNA, 25 bp, Rattus norvegicus
cggggacaaaggcaaaagcagagaa

SEQ ID NO: 476110 - DNA, 25 bp, Rattus norvegicus
gccggactaggagagagttggaata

SEQ ID NO: 476111 - DNA, 25 bp, Rattus norvegicus
ttacgtttggccgctgttagaggcg

SEQ ID NO: 476112 - DNA, 25 bp, Rattus norvegicus
gcaacgttacgtttggccgctgtta

SEQ ID NO: 476113 - DNA, 25 bp, Rattus norvegicus
ccatagggccggagtgctggtctat

SEQ ID NO: 476114 - DNA, 25 bp, Rattus norvegicus
cgcgaactgcaagtcgcggagctgt

SEQ ID NO: 476115 - DNA, 25 bp, Rattus norvegicus
accactggtcggagcgtgatcccta

SEQ ID NO: 476116 - DNA, 25 bp, Rattus norvegicus
catggaggaggctgaccggcaactc

SEQ ID NO: 476117 - DNA, 25 bp, Rattus norvegicus
ccagcaatccgctagccatggagga

SEQ ID NO: 476118 - DNA, 25 bp, Rattus norvegicus
acggaaccaggggtccagcaatccg

SEQ ID NO: 476119 - DNA, 25 bp, Rattus norvegicus
ggtacgccttgtgcgcgaactgcaa

SEQ ID NO: 476120 - DNA, 25 bp, Rattus norvegicus
gaccggcaactcctgcggcgatgca

SEQ ID NO: 476121 - DNA, 25 bp, Rattus norvegicus
cgctctgctgagtcgtgagctcttc

SEQ ID NO: 476122 - DNA, 25 bp, Rattus norvegicus
cgtgagctcttcacgcgcgacatga

SEQ ID NO: 476123 - DNA, 25 bp, Rattus norvegicus
cgcgcgacatgatcgaggatattca

SEQ ID NO: 476124 - DNA, 25 bp, Rattus norvegicus
tgatcgaggatattcaggtgctccc

SEQ ID NO: 476125 - DNA, 25 bp, Rattus norvegicus
gtcgcagagaggttcactgaagcca

SEQ ID NO: 476126 - DNA, 25 bp, Rattus norvegicus
ttcactgaagccaccgctacggagc

SEQ ID NO: 476127 - DNA, 25 bp, Rattus norvegicus
cctgcggcgatgcagggtacgcctt

SEQ ID NO: 476128 - DNA, 25 bp, Rattus norvegicus
cacgagcagtgacacgaggaacatt

SEQ ID NO: 476129 - DNA, 25 bp, Rattus norvegicus
cgaggaacattgcataacggtggcc

SEQ ID NO: 476130 - DNA, 25 bp, Rattus norvegicus
acacagcaagggacacgcacgtaca

SEQ ID NO: 476131 - DNA, 25 bp, Rattus norvegicus
cgcacgtacacacacgtaaagcgtg

SEQ ID NO: 476132 - DNA, 25 bp, Rattus norvegicus
taaagcgtgaagcaagcacatgagc

SEQ ID NO: 476133 - DNA, 25 bp, Rattus norvegicus
gtcacagttccacaacacagcaagg

SEQ ID NO: 476134 - DNA, 25 bp, Rattus norvegicus
cccggtggccgttcacttagactgg

SEQ ID NO: 476135 - DNA, 25 bp, Rattus norvegicus
ttagactggggtgacgtcacagttc

SEQ ID NO: 476136 - DNA, 25 bp, Rattus norvegicus
ctggtgacaaactcaaggaagggta

SEQ ID NO: 476137 - DNA, 25 bp, Rattus norvegicus
cacatgagctatggagcagcggcac

SEQ ID NO: 476138 - DNA, 25 bp, Rattus norvegicus
gacgagtgccatcgctggtgacaaa

SEQ ID NO: 476139 - DNA, 25 bp, Rattus norvegicus
agcggcacgggtttcactacggcct

SEQ ID NO: 476140 - DNA, 25 bp, Rattus norvegicus
cccatgcgatctggtgctgacgagt

SEQ ID NO: 476141 - DNA, 25 bp, Rattus norvegicus
ttcactacggcctgtctggtgacag

SEQ ID NO: 476142 - DNA, 25 bp, Rattus norvegicus
ggctccctgtcctcctaaagcagga

SEQ ID NO: 476143 - DNA, 25 bp, Rattus norvegicus
ggctcacgctccctgctgtgggtcg

SEQ ID NO: 476144 - DNA, 25 bp, Rattus norvegicus
tcgtcgcgcctctttttgcggctca

SEQ ID NO: 476145 - DNA, 25 bp, Rattus norvegicus
cgctatatagcccaccgccgggaag

SEQ ID NO: 476146 - DNA, 25 bp, Rattus norvegicus
gtagctctacactcggcgctatata

SEQ ID NO: 476147 - DNA, 25 bp, Rattus norvegicus
agccggctctgaggtagctctacac

SEQ ID NO: 476148 - DNA, 25 bp, Rattus norvegicus
agctacgcccgcgagtcggagcttt

SEQ ID NO: 476149 - DNA, 25 bp, Rattus norvegicus
cgagggctgccaaccgctcgagctg

SEQ ID NO: 476150 - DNA, 25 bp, Rattus norvegicus
tcctaaagcaggagtgcgccaagcg

SEQ ID NO: 476151 - DNA, 25 bp, Rattus norvegicus
gtccggtcgtcgctcttcctggtct

SEQ ID NO: 476152 - DNA, 25 bp, Rattus norvegicus
tgtcaccgcgatccggacgcgaaga

SEQ ID NO: 476153 - DNA, 25 bp, Rattus norvegicus
agtcggagctttcccagccggctct

SEQ ID NO: 476154 - DNA, 25 bp, Rattus norvegicus
tcgcgggagttgtcaacttgactca

SEQ ID NO: 476155 - DNA, 25 bp, Rattus norvegicus
gggcaccaggctccgcagcgtagct

SEQ ID NO: 476156 - DNA, 25 bp, Rattus norvegicus
cgaggacagggttcacacgtaccta

SEQ ID NO: 476157 - DNA, 25 bp, Rattus norvegicus
ttagcgccaggagtctgcggagaaa

SEQ ID NO: 476158 - DNA, 25 bp, Rattus norvegicus
cccgagatccaagagctatcgtgag

SEQ ID NO: 476159 - DNA, 25 bp, Rattus norvegicus
aaagccgagctgaaccgcagcctga

SEQ ID NO: 476160 - DNA, 25 bp, Rattus norvegicus
agcctctgagaagatttgggtgccc

SEQ ID NO: 476161 - DNA, 25 bp, Rattus norvegicus
tgctgccgtcctttcctgccattgg

SEQ ID NO: 476162 - DNA, 25 bp, Rattus norvegicus
ggcgcgctccggaatgtttacattc

SEQ ID NO: 476163 - DNA, 25 bp, Rattus norvegicus
ccacccgactgtgtgaggagtgtca

SEQ ID NO: 476164 - DNA, 25 bp, Rattus norvegicus
tcagtctcgagaggtggttagcgcc

SEQ ID NO: 476165 - DNA, 25 bp, Rattus norvegicus
gagggctcccacttcagtctcgaga

SEQ ID NO: 476166 - DNA, 25 bp, Rattus norvegicus
gccctgagcttaagtgcccggatca

SEQ ID NO: 476167 - DNA, 25 bp, Rattus norvegicus
cacaaacccggcctggagaggcgca

SEQ ID NO: 476168 - DNA, 25 bp, Rattus norvegicus
tgaggagtgtcacccacaaacccgg

SEQ ID NO: 476169 - DNA, 25 bp, Rattus norvegicus
cacacgtacctagtccaggggctga

SEQ ID NO: 476170 - DNA, 25 bp, Rattus norvegicus
ggaccccgcgatgtgctctctcaag

SEQ ID NO: 476171 - DNA, 25 bp, Rattus norvegicus
ggctgccaccgcaacttccggtttg

SEQ ID NO: 476172 - DNA, 25 bp, Rattus norvegicus
ccgtatttccagtccggctgccacc

SEQ ID NO: 476173 - DNA, 25 bp, Rattus norvegicus
taggcagtcctgtccaagcagacca

SEQ ID NO: 476174 - DNA, 25 bp, Rattus norvegicus
tctttcgcgcgctctccataggcag

SEQ ID NO: 476175 - DNA, 25 bp, Rattus norvegicus
tccgccacgccacactccgcagcag

SEQ ID NO: 476176 - DNA, 25 bp, Rattus norvegicus
tggggagctcctagatccgccacgc

SEQ ID NO: 476177 - DNA, 25 bp, Rattus norvegicus
cagcacactttctggggagctccta

SEQ ID NO: 476178 - DNA, 25 bp, Rattus norvegicus
tgcactccgcagcacactttctggg

SEQ ID NO: 476179 - DNA, 25 bp, Rattus norvegicus
caaaggccttctacgcctgcaaaga

SEQ ID NO: 476180 - DNA, 25 bp, Rattus norvegicus
aagggcaaaggccttctacgcctgc

SEQ ID NO: 476181 - DNA, 25 bp, Rattus norvegicus
atagcaccggtttagaagggcaaag

SEQ ID NO: 476182 - DNA, 25 bp, Rattus norvegicus
cctctttctcgagctcgccattctc

SEQ ID NO: 476183 - DNA, 25 bp, Rattus norvegicus
ctcaagccttgatagcaccggttta

SEQ ID NO: 476184 - DNA, 25 bp, Rattus norvegicus
tgcagcctccgactcagcttgctgg

SEQ ID NO: 476185 - DNA, 25 bp, Rattus norvegicus
ctcgccgatgccctggttgaggtcc

SEQ ID NO: 476186 - DNA, 25 bp, Rattus norvegicus
agcagcttggcgctcagctcgtcgt

SEQ ID NO: 476187 - DNA, 25 bp, Rattus norvegicus
ctctctgatgacctctgggggaccg

SEQ ID NO: 476188 - DNA, 25 bp, Rattus norvegicus
caacgcctgggcagtctcgtcggga

SEQ ID NO: 476189 - DNA, 25 bp, Rattus norvegicus
gccctcgtcctccatctgcagcctc

SEQ ID NO: 476190 - DNA, 25 bp, Rattus norvegicus
ctgagtcccgggagccctctggaag

SEQ ID NO: 476191 - DNA, 25 bp, Rattus norvegicus
gtgaaaaaccatcaacatctctctg

SEQ ID NO: 476192 - DNA, 25 bp, Rattus norvegicus
tgcttcctagctcttcatcgtcgtc

SEQ ID NO: 476193 - DNA, 25 bp, Rattus norvegicus
gtgcattctgcttcctagctcttca

SEQ ID NO: 476194 - DNA, 25 bp, Rattus norvegicus
ggggtcatgtgcattctgcttccta

SEQ ID NO: 476195 - DNA, 25 bp, Rattus norvegicus
cagctcgtccgtggccatggtggcc

SEQ ID NO: 476196 - DNA, 25 bp, Rattus norvegicus
cagcttgctggccagctcgtccgtg

SEQ ID NO: 476197 - DNA, 25 bp, Rattus norvegicus
ctcgcatgaggtggctgtgcgttca

SEQ ID NO: 476198 - DNA, 25 bp, Rattus norvegicus
ggcctcgttgaattcgatgagcgcg

SEQ ID NO: 476199 - DNA, 25 bp, Rattus norvegicus
gggttctcgatgaccagctcgtagg

SEQ ID NO: 476200 - DNA, 25 bp, Rattus norvegicus
gcactcgttgacaaacgtgccgttg

SEQ ID NO: 476201 - DNA, 25 bp, Rattus norvegicus
gccctcggcctcgttgaattcgatg

SEQ ID NO: 476202 - DNA, 25 bp, Rattus norvegicus
agtcctgaaggacgaaggtgccctc

SEQ ID NO: 476203 - DNA, 25 bp, Rattus norvegicus
tgcgggtgttaaagtcctgaaggac

SEQ ID NO: 476204 - DNA, 25 bp, Rattus norvegicus
gacaaacgtgccgttgcgggtgtta

SEQ ID NO: 476205 - DNA, 25 bp, Rattus norvegicus
ctgaatgtggcactcgttgacaaac

SEQ ID NO: 476206 - DNA, 25 bp, Rattus norvegicus
gcttcactgccacattctgaatgtg

SEQ ID NO: 476207 - DNA, 25 bp, Rattus norvegicus
agggatcagcttcactgccacattc

SEQ ID NO: 476208 - DNA, 25 bp, Rattus norvegicus
ccgaagacccgaaccgcagaatgtc

SEQ ID NO: 476209 - DNA, 25 bp, Rattus norvegicus
ggctcacctgggacgggttctcgat

SEQ ID NO: 476210 - DNA, 25 bp, Rattus norvegicus
cgatgaccagctcgtaggtcggccc

SEQ ID NO: 476211 - DNA, 25 bp, Rattus norvegicus
accgcgcaatggctgggctcacctg

SEQ ID NO: 476212 - DNA, 25 bp, Rattus norvegicus
aggcgggagtaccccacatcggccg

SEQ ID NO: 476213 - DNA, 25 bp, Rattus norvegicus
gtgcggctgctgagggtgcggggcc

SEQ ID NO: 476214 - DNA, 25 bp, Rattus norvegicus
ccgggtgcggctgctgagggtgcgg

SEQ ID NO: 476215 - DNA, 25 bp, Rattus norvegicus
ccccacatcggccgggtgcggctgc

SEQ ID NO: 476216 - DNA, 25 bp, Rattus norvegicus
agtaccccacatcggccgggtgcgg

SEQ ID NO: 476217 - DNA, 25 bp, Rattus norvegicus
gagtaccccacatcggccgggtgcg

SEQ ID NO: 476218 - DNA, 25 bp, Rattus norvegicus
ggagtaccccacatcggccgggtgc

SEQ ID NO: 476219 - DNA, 25 bp, Rattus norvegicus
gaggcgggagtaccccacatcggcc

SEQ ID NO: 476220 - DNA, 25 bp, Rattus norvegicus
gccagagcgacgcggggaggcggga

SEQ ID NO: 476221 - DNA, 25 bp, Rattus norvegicus
aagccagagcgacgcggggaggcgg

SEQ ID NO: 476222 - DNA, 25 bp, Rattus norvegicus
gcccccgaggccgaagccagagcga

SEQ ID NO: 476223 - DNA, 25 bp, Rattus norvegicus
tgccacctgtccccgccaacagggg

SEQ ID NO: 476224 - DNA, 25 bp, Rattus norvegicus
gatgccacctgtccccgccaacagg

SEQ ID NO: 476225 - DNA, 25 bp, Rattus norvegicus
ggcccggagtcccctgaggaacatg

SEQ ID NO: 476226 - DNA, 25 bp, Rattus norvegicus
ccctgaggaacatgtccgacatgat

SEQ ID NO: 476227 - DNA, 25 bp, Rattus norvegicus
ccaccctgcgccctacgccaccagg

SEQ ID NO: 476228 - DNA, 25 bp, Rattus norvegicus
agccacgccgggtctctgtccggag

SEQ ID NO: 476229 - DNA, 25 bp, Rattus norvegicus
tccgacatgatgctccgggacgcaa

SEQ ID NO: 476230 - DNA, 25 bp, Rattus norvegicus
acctctgtggtgatcagccagcacg

SEQ ID NO: 476231 - DNA, 25 bp, Rattus norvegicus
gatgctccgggacgcaaagatacca

SEQ ID NO: 476232 - DNA, 25 bp, Rattus norvegicus
ggtgatcagccagcacggcccacag

SEQ ID NO: 476233 - DNA, 25 bp, Rattus norvegicus
cccaggcaatcacgggtcgcggagc

SEQ ID NO: 476234 - DNA, 25 bp, Rattus norvegicus
aaggcagcgagccacgccgggtctc

SEQ ID NO: 476235 - DNA, 25 bp, Rattus norvegicus
tcagtgcggggacgcagactcaccc

SEQ ID NO: 476236 - DNA, 25 bp, Rattus norvegicus
gcacacttttcagtgcggggacgca

SEQ ID NO: 476237 - DNA, 25 bp, Rattus norvegicus
gggccctaccgcacacttttcagtg

SEQ ID NO: 476238 - DNA, 25 bp, Rattus norvegicus
gcaaagataccaaactcgggcccta

SEQ ID NO: 476239 - DNA, 25 bp, Rattus norvegicus
cagggacctctgtggtgatcagcca

SEQ ID NO: 476240 - DNA, 25 bp, Rattus norvegicus
ggatcgctactttgagccctagtca

SEQ ID NO: 476241 - DNA, 25 bp, Rattus norvegicus
aggcacggatctgcgtctcctgcca

SEQ ID NO: 476242 - DNA, 25 bp, Rattus norvegicus
gaagcgaacttttcccaacctctca

SEQ ID NO: 476243 - DNA, 25 bp, Rattus norvegicus
tgcgtctcctgccagctctgaattc

SEQ ID NO: 476244 - DNA, 25 bp, Rattus norvegicus
cctcacctgcctggaagtttgccta

SEQ ID NO: 476245 - DNA, 25 bp, Rattus norvegicus
ttccagcgaatcacaggctggcttc

SEQ ID NO: 476246 - DNA, 25 bp, Rattus norvegicus
agaaaactttccagcgaatcacagg

SEQ ID NO: 476247 - DNA, 25 bp, Rattus norvegicus
tcccggcttggcagaaaactttcca

SEQ ID NO: 476248 - DNA, 25 bp, Rattus norvegicus
acgactccaggcacggatctgcgtc

SEQ ID NO: 476249 - DNA, 25 bp, Rattus norvegicus
gacgctctccggatcgctactttga

SEQ ID NO: 476250 - DNA, 25 bp, Rattus norvegicus
attctctggtgtcccggacgctctc

SEQ ID NO: 476251 - DNA, 25 bp, Rattus norvegicus
ctctgaattccgacctgggtggctt

SEQ ID NO: 476252 - DNA, 25 bp, Rattus norvegicus
tttgagccctagtcagtagtgtccc

SEQ ID NO: 476253 - DNA, 25 bp, Rattus norvegicus
taaggaacgcgttcccggcttggca

SEQ ID NO: 476254 - DNA, 25 bp, Rattus norvegicus
gtaccatcaaagaggcccgggtcga

SEQ ID NO: 476255 - DNA, 25 bp, Rattus norvegicus
tacagcgattacagaggtgacgacg

SEQ ID NO: 476256 - DNA, 25 bp, Rattus norvegicus
tcacatttgtgtttctgtctgttcc

SEQ ID NO: 476257 - DNA, 25 bp, Rattus norvegicus
gttccaggcgcttggctacacgcac

SEQ ID NO: 476258 - DNA, 25 bp, Rattus norvegicus
ctacacgcacccacgagggcgagtg

SEQ ID NO: 476259 - DNA, 25 bp, Rattus norvegicus
gggcgagtgcctccgtgcacacaca

SEQ ID NO: 476260 - DNA, 25 bp, Rattus norvegicus
cggtgggttatcaccagtccgcgtc

SEQ ID NO: 476261 - DNA, 25 bp, Rattus norvegicus
agtccgcgtcttcctctatgtaata

SEQ ID NO: 476262 - DNA, 25 bp, Rattus norvegicus
taatcaggggcggtaccatcaaaga

SEQ ID NO: 476263 - DNA, 25 bp, Rattus norvegicus
gctcagagacaacggggttgacaga

SEQ ID NO: 476264 - DNA, 25 bp, Rattus norvegicus
gacttccgttgtttccctctggcga

SEQ ID NO: 476265 - DNA, 25 bp, Rattus norvegicus
gttgacagagtcacacacggtttgt

SEQ ID NO: 476266 - DNA, 25 bp, Rattus norvegicus
cacacggtttgtggtatgtacagcg

SEQ ID NO: 476267 - DNA, 25 bp, Rattus norvegicus
ctctatgtaataatcaggggcggta

SEQ ID NO: 476268 - DNA, 25 bp, Rattus norvegicus
cccaaatccctgctgatctcggggc

SEQ ID NO: 476269 - DNA, 25 bp, Rattus norvegicus
ggctgctgtagccatcggctgcatc

SEQ ID NO: 476270 - DNA, 25 bp, Rattus norvegicus
gccatcggctgcatcgggaactgcc

SEQ ID NO: 476271 - DNA, 25 bp, Rattus norvegicus
tctcacgtgggaacaactccagatc

SEQ ID NO: 476272 - DNA, 25 bp, Rattus norvegicus
gcacctacccggctggctgctgtag

SEQ ID NO: 476273 - DNA, 25 bp, Rattus norvegicus
ttcgcgcatagcttgcaggctccga

SEQ ID NO: 476274 - DNA, 25 bp, Rattus norvegicus
atagcttgcaggctccgaggtccgg

SEQ ID NO: 476275 - DNA, 25 bp, Rattus norvegicus
aagctggcggacacgctcccatgaa

SEQ ID NO: 476276 - DNA, 25 bp, Rattus norvegicus
gccggctcacagacctccgagtcgc

SEQ ID NO: 476277 - DNA, 25 bp, Rattus norvegicus
gccgcaccagaggaatccagcgcga

SEQ ID NO: 476278 - DNA, 25 bp, Rattus norvegicus
cagaggaatccagcgcgatcttctc

SEQ ID NO: 476279 - DNA, 25 bp, Rattus norvegicus
gcagcgttcgcgcatagcttgcagg

SEQ ID NO: 476280 - DNA, 25 bp, Rattus norvegicus
gggctgccgaggtaccctctggcca

SEQ ID NO: 476281 - DNA, 25 bp, Rattus norvegicus
gtgggaacaactccagatcaagggg

SEQ ID NO: 476282 - DNA, 25 bp, Rattus norvegicus
cgtgtgacccactgtgcacactgca

SEQ ID NO: 476283 - DNA, 25 bp, Rattus norvegicus
gggttacgaaccacaatgcaaagcc

SEQ ID NO: 476284 - DNA, 25 bp, Rattus norvegicus
ccaagcgaagggttaggagtgtatc

SEQ ID NO: 476285 - DNA, 25 bp, Rattus norvegicus
atgcaaagccatctcgcggcgagcg

SEQ ID NO: 476286 - DNA, 25 bp, Rattus norvegicus
caattccgccagtctccggttggtg

SEQ ID NO: 476287 - DNA, 25 bp, Rattus norvegicus
tctccgagtggagcctaccattcgc

SEQ ID NO: 476288 - DNA, 25 bp, Rattus norvegicus
cgcgagctgcttattgtcttccatc

SEQ ID NO: 476289 - DNA, 25 bp, Rattus norvegicus
gatggttctccatggtcgccaccgc

SEQ ID NO: 476290 - DNA, 25 bp, Rattus norvegicus
tggcgttaatgacaaccgctatgga

SEQ ID NO: 476291 - DNA, 25 bp, Rattus norvegicus
ctcctccggcgcaggaatgacagcg

SEQ ID NO: 476292 - DNA, 25 bp, Rattus norvegicus
cactgccaagcgaaaagggttacga

SEQ ID NO: 476293 - DNA, 25 bp, Rattus norvegicus
gtcttccatcatgctcaggattttg

SEQ ID NO: 476294 - DNA, 25 bp, Rattus norvegicus
cttgagctccgtgctgatggttctc

SEQ ID NO: 476295 - DNA, 25 bp, Rattus norvegicus
aagcagcgggttgacactgccaagc

SEQ ID NO: 476296 - DNA, 25 bp, Rattus norvegicus
attgtaccagaccaggagctcctcg

SEQ ID NO: 476297 - DNA, 25 bp, Rattus norvegicus
ctttgtctctcccaggtccggttct

SEQ ID NO: 476298 - DNA, 25 bp, Rattus norvegicus
ccaatcagagacacggttgttggcg

SEQ ID NO: 476299 - DNA, 25 bp, Rattus norvegicus
gcgcgattggctaccgaagagaaga

SEQ ID NO: 476300 - DNA, 25 bp, Rattus norvegicus
cgcggaccgcaaacagctgtcggga

SEQ ID NO: 476301 - DNA, 25 bp, Rattus norvegicus
cagctgctatctcagggttgtcttc

SEQ ID NO: 476302 - DNA, 25 bp, Rattus norvegicus
gctcttcctcaatcgcagctgctat

SEQ ID NO: 476303 - DNA, 25 bp, Rattus norvegicus
ggcgattcctacctctgcggctctt

SEQ ID NO: 476304 - DNA, 25 bp, Rattus norvegicus
cggaaaaggtcaccgcgacgctacg

SEQ ID NO: 476305 - DNA, 25 bp, Rattus norvegicus
gactgccgtgattcagcagcgggcc

SEQ ID NO: 476306 - DNA, 25 bp, Rattus norvegicus
aagttcgcaaacagcccgaacgcgc

SEQ ID NO: 476307 - DNA, 25 bp, Rattus norvegicus
gagcgctcaggcacaagttcgcaaa

SEQ ID NO: 476308 - DNA, 25 bp, Rattus norvegicus
gcggccagccctattccgggagcaa

SEQ ID NO: 476309 - DNA, 25 bp, Rattus norvegicus
agacaaggggcagaccaatcagaga

SEQ ID NO: 476310 - DNA, 25 bp, Rattus norvegicus
agcttaacacgacggccgggcgtga

SEQ ID NO: 476311 - DNA, 25 bp, Rattus norvegicus
tcctcactgacaccaagggacattc

SEQ ID NO: 476312 - DNA, 25 bp, Rattus norvegicus
cagagcgcgacgtgccaacgcttca

SEQ ID NO: 476313 - DNA, 25 bp, Rattus norvegicus
ccgccatcttggcttcggccggaag

SEQ ID NO: 476314 - DNA, 25 bp, Rattus norvegicus
agtgacgtcgacacggcacccgcaa

SEQ ID NO: 476315 - DNA, 25 bp, Rattus norvegicus
cccaaggagcttaacacgacggccg

SEQ ID NO: 476316 - DNA, 25 bp, Rattus norvegicus
tgaccctgacggacttgtgtcgccc

SEQ ID NO: 476317 - DNA, 25 bp, Rattus norvegicus
gctagccactggttcctggcggttc

SEQ ID NO: 476318 - DNA, 25 bp, Rattus norvegicus
gtgtcgccctctctgtcaatcactg

SEQ ID NO: 476319 - DNA, 25 bp, Rattus norvegicus
gtcaatcactggttctccactcgtc

SEQ ID NO: 476320 - DNA, 25 bp, Rattus norvegicus
tcgtcccagagcgttccctcgaaag

SEQ ID NO: 476321 - DNA, 25 bp, Rattus norvegicus
caaacttggccgcagggacttaaga

SEQ ID NO: 476322 - DNA, 25 bp, Rattus norvegicus
agcccgtgtcgccattgcctggacg

SEQ ID NO: 476323 - DNA, 25 bp, Rattus norvegicus
tccctcgaaaggaagcccgtgtcgc

SEQ ID NO: 476324 - DNA, 25 bp, Rattus norvegicus
cttcatcttccatggagatctggta

SEQ ID NO: 476325 - DNA, 25 bp, Rattus norvegicus
ggaacaactcgctgcgctcgctgga

SEQ ID NO: 476326 - DNA, 25 bp, Rattus norvegicus
gccttcctggacctgagctacaaca

SEQ ID NO: 476327 - DNA, 25 bp, Rattus norvegicus
tccttgcaggtgctggaactcaacg

SEQ ID NO: 476328 - DNA, 25 bp, Rattus norvegicus
cggggacatgagtctctacgctgtc

SEQ ID NO: 476329 - DNA, 25 bp, Rattus norvegicus
gtctgtgcgacaggtcccaattccc

SEQ ID NO: 476330 - DNA, 25 bp, Rattus norvegicus
ataacctggccggtgtacacgaggc

SEQ ID NO: 476331 - DNA, 25 bp, Rattus norvegicus
gctaagcctggccaacaataacctg

SEQ ID NO: 476332 - DNA, 25 bp, Rattus norvegicus
gcagcctcaacgtggcggctttgga

SEQ ID NO: 476333 - DNA, 25 bp, Rattus norvegicus
cgcggtctccacctgtgctttggaa

SEQ ID NO: 476334 - DNA, 25 bp, Rattus norvegicus
tgaacttagtcttgagcaccgctgg

SEQ ID NO: 476335 - DNA, 25 bp, Rattus norvegicus
ctccagggatccgtcactgaactta

SEQ ID NO: 476336 - DNA, 25 bp, Rattus norvegicus
cctttgcgggtgaattctgcgccca

SEQ ID NO: 476337 - DNA, 25 bp, Rattus norvegicus
ccagagggtcagtttcctttgcggg

SEQ ID NO: 476338 - DNA, 25 bp, Rattus norvegicus
ttatcacagggaccgcctcaaaagc

SEQ ID NO: 476339 - DNA, 25 bp, Rattus norvegicus
cgcactggagccctggccagcgcgc

SEQ ID NO: 476340 - DNA, 25 bp, Rattus norvegicus
aggctatcgcagagcgcactggagc

SEQ ID NO: 476341 - DNA, 25 bp, Rattus norvegicus
cttccaggctatcgcagagcgcact

SEQ ID NO: 476342 - DNA, 25 bp, Rattus norvegicus
agcttccaggctatcgcagagcgca

SEQ ID NO: 476343 - DNA, 25 bp, Rattus norvegicus
tcaaaagcttccaggctatcgcaga

SEQ ID NO: 476344 - DNA, 25 bp, Rattus norvegicus
agggaccgcctcaaaagcttccagg

SEQ ID NO: 476345 - DNA, 25 bp, Rattus norvegicus
gctggttatcacagggaccgcctca

SEQ ID NO: 476346 - DNA, 25 bp, Rattus norvegicus
ccagcaaggctggttatcacaggga

SEQ ID NO: 476347 - DNA, 25 bp, Rattus norvegicus
gcggagccagcaaggctggttatca

SEQ ID NO: 476348 - DNA, 25 bp, Rattus norvegicus
cgctccgattggtcagcagtgggca

SEQ ID NO: 476349 - DNA, 25 bp, Rattus norvegicus
aggtgcgctccgattggtcagcagt

SEQ ID NO: 476350 - DNA, 25 bp, Rattus norvegicus
cagtcaggtgcgctccgattggtca

SEQ ID NO: 476351 - DNA, 25 bp, Rattus norvegicus
gaccgcctcaaaagcttccaggcta

SEQ ID NO: 476352 - DNA, 25 bp, Rattus norvegicus
gttcatctccacattcacgttacct

SEQ ID NO: 476353 - DNA, 25 bp, Rattus norvegicus
cacattcacgttacctccggccgcg

SEQ ID NO: 476354 - DNA, 25 bp, Rattus norvegicus
cgcggcatccgcatccatgcttggt

SEQ ID NO: 476355 - DNA, 25 bp, Rattus norvegicus
tgccagcgagcctggctttaccttc

SEQ ID NO: 476356 - DNA, 25 bp, Rattus norvegicus
gctttaccttctcttggaaccaggc

SEQ ID NO: 476357 - DNA, 25 bp, Rattus norvegicus
ttctcttggaaccaggcctcggcgt

SEQ ID NO: 476358 - DNA, 25 bp, Rattus norvegicus
tcggcgtccctgcggttctgctcag

SEQ ID NO: 476359 - DNA, 25 bp, Rattus norvegicus
ttctgctcagccagggcctcgtact

SEQ ID NO: 476360 - DNA, 25 bp, Rattus norvegicus
cctcgtactcggctcgcatgttgtt

SEQ ID NO: 476361 - DNA, 25 bp, Rattus norvegicus
tactcggctcgcatgttgttcagca

SEQ ID NO: 476362 - DNA, 25 bp, Rattus norvegicus
cggctcgcatgttgttcagcaagac

SEQ ID NO: 476363 - DNA, 25 bp, Rattus norvegicus
cgcatgttgttcagcaagacggtga

SEQ ID NO: 476364 - DNA, 25 bp, Rattus norvegicus
tccgcatccatgcttggtgtggggt

SEQ ID NO: 476365 - DNA, 25 bp, Rattus norvegicus
ttcagcaagacggtgaggtccacgc

SEQ ID NO: 476366 - DNA, 25 bp, Rattus norvegicus
tttgcgcagatgcttctctagcagc

SEQ ID NO: 476367 - DNA, 25 bp, Rattus norvegicus
gctagcttctcctgttctcaccaaa

SEQ ID NO: 476368 - DNA, 25 bp, Rattus norvegicus
cagggccgtgagacaccgaggaccc

SEQ ID NO: 476369 - DNA, 25 bp, Rattus norvegicus
gtgagcgccctacgctgtgaggaca

SEQ ID NO: 476370 - DNA, 25 bp, Rattus norvegicus
ctgtgaggacagctgcagactgaaa

SEQ ID NO: 476371 - DNA, 25 bp, Rattus norvegicus
cgcagagccgcgatggctagcttct

SEQ ID NO: 476372 - DNA, 25 bp, Rattus norvegicus
agctgcagactgaaaggcctttgtc

SEQ ID NO: 476373 - DNA, 25 bp, Rattus norvegicus
aggcctttgtctgaaactttcctca

SEQ ID NO: 476374 - DNA, 25 bp, Rattus norvegicus
caggcctcagtcagcggggcacaga

SEQ ID NO: 476375 - DNA, 25 bp, Rattus norvegicus
cgaccaatcgttgttcgacttcgga

SEQ ID NO: 476376 - DNA, 25 bp, Rattus norvegicus
cccaagatggcgcagtagtctgccg

SEQ ID NO: 476377 - DNA, 25 bp, Rattus norvegicus
tagaccgctcgcactgcccaagatg

SEQ ID NO: 476378 - DNA, 25 bp, Rattus norvegicus
agcaggaactcgaaccagcagggtc

SEQ ID NO: 476379 - DNA, 25 bp, Rattus norvegicus
actttcctcagaccctttgcggcga

SEQ ID NO: 476380 - DNA, 25 bp, Rattus norvegicus
gatacggataaaaacgcttcaggcc

SEQ ID NO: 476381 - DNA, 25 bp, Rattus norvegicus
tgttgtcaatcaatccagagacagg

SEQ ID NO: 476382 - DNA, 25 bp, Rattus norvegicus
cagagacaggaaacgcccagacatg

SEQ ID NO: 476383 - DNA, 25 bp, Rattus norvegicus
cagacatggcggaaactaaatcatc

SEQ ID NO: 476384 - DNA, 25 bp, Rattus norvegicus
cggaaactaaatcatccaatcagcg

SEQ ID NO: 476385 - DNA, 25 bp, Rattus norvegicus
caggcggggctataaaccggaaatg

SEQ ID NO: 476386 - DNA, 25 bp, Rattus norvegicus
accggaaatgtgagactgaatacgc

SEQ ID NO: 476387 - DNA, 25 bp, Rattus norvegicus
gggctcataccggaagtgtttagat

SEQ ID NO: 476388 - DNA, 25 bp, Rattus norvegicus
cataccggaagtgtttagatggaac

SEQ ID NO: 476389 - DNA, 25 bp, Rattus norvegicus
tggaacccggaggaaataagcttca

SEQ ID NO: 476390 - DNA, 25 bp, Rattus norvegicus
aaataagcttcaggccggaagtgtg

SEQ ID NO: 476391 - DNA, 25 bp, Rattus norvegicus
acggagaatctgttgtcaatcaatc

SEQ ID NO: 476392 - DNA, 25 bp, Rattus norvegicus
tgtgagacgggatacggataaaaac

SEQ ID NO: 476393 - DNA, 25 bp, Rattus norvegicus
tctttttcacggagaatctgttgtc

SEQ ID NO: 476394 - DNA, 25 bp, Rattus norvegicus
acactgctgagtccaagagcgtgca

SEQ ID NO: 476395 - DNA, 25 bp, Rattus norvegicus
agacatctccggtttatattgaatc

SEQ ID NO: 476396 - DNA, 25 bp, Rattus norvegicus
cagccacctggcgagtctgacatgg

SEQ ID NO: 476397 - DNA, 25 bp, Rattus norvegicus
tgacatggctgtcagcgacgctctg

SEQ ID NO: 476398 - DNA, 25 bp, Rattus norvegicus
gggctcctctacagccgagaatctg

SEQ ID NO: 476399 - DNA, 25 bp, Rattus norvegicus
aacacaggtggagggctcctctaca

SEQ ID NO: 476400 - DNA, 25 bp, Rattus norvegicus
cacagacctggaaagtggtggagct

SEQ ID NO: 476401 - DNA, 25 bp, Rattus norvegicus
ttgcagcagtaacaacccggcccta

SEQ ID NO: 476402 - DNA, 25 bp, Rattus norvegicus
agggagaccgaggagttcaacgatc

SEQ ID NO: 476403 - DNA, 25 bp, Rattus norvegicus
cagcctggccatcggacctacttat

SEQ ID NO: 476404 - DNA, 25 bp, Rattus norvegicus
ctcgctatcccaccaggaatcggtg

SEQ ID NO: 476405 - DNA, 25 bp, Rattus norvegicus
cggacctacttatctgccttgctga

SEQ ID NO: 476406 - DNA, 25 bp, Rattus norvegicus
tgcagcttcagctatccgatccggg

SEQ ID NO: 476407 - DNA, 25 bp, Rattus norvegicus
aacctggcggacatcaatgacgtga

SEQ ID NO: 476408 - DNA, 25 bp, Rattus norvegicus
tctccatcttggctccctatcttgg

SEQ ID NO: 476409 - DNA, 25 bp, Rattus norvegicus
cagaaaaggatctttgttggatttc

SEQ ID NO: 476410 - DNA, 25 bp, Rattus norvegicus
ttgtaggattgtaactccatgtttg

SEQ ID NO: 476411 - DNA, 25 bp, Rattus norvegicus
tgtaactccatgtttgctttcaatg

SEQ ID NO: 476412 - DNA, 25 bp, Rattus norvegicus
tgctttcaatgagcttgactacacc

SEQ ID NO: 476413 - DNA, 25 bp, Rattus norvegicus
aatgagcttgactacacccgtgtta

SEQ ID NO: 476414 - DNA, 25 bp, Rattus norvegicus
ctacatggtgtcagaaaaggatctt

SEQ ID NO: 476415 - DNA, 25 bp, Rattus norvegicus
ccttctcttgcaggatggcgtggtg

SEQ ID NO: 476416 - DNA, 25 bp, Rattus norvegicus
tgcttgcctgcctgctccctgattt

SEQ ID NO: 476417 - DNA, 25 bp, Rattus norvegicus
gggcccgcgtagctgccaaacagct

SEQ ID NO: 476418 - DNA, 25 bp, Rattus norvegicus
cgtagctgccaaacagctgtggctc

SEQ ID NO: 476419 - DNA, 25 bp, Rattus norvegicus
tgctccctgatttctacatggtgtc

SEQ ID NO: 476420 - DNA, 25 bp, Rattus norvegicus
ctgcgctcccttgtttgcttgcctg

SEQ ID NO: 476421 - DNA, 25 bp, Rattus norvegicus
cacccgtgttatccttctcttgcag

SEQ ID NO: 476422 - DNA, 25 bp, Rattus norvegicus
cctcggggactagggcagcaagtcc

SEQ ID NO: 476423 - DNA, 25 bp, Rattus norvegicus
ctgagcccaagaatagcaatgagtc

SEQ ID NO: 476424 - DNA, 25 bp, Rattus norvegicus
gcgtttaagcaatttcctgagccca

SEQ ID NO: 476425 - DNA, 25 bp, Rattus norvegicus
ctggcaatcagatcgcgtttaagca

SEQ ID NO: 476426 - DNA, 25 bp, Rattus norvegicus
ttctcctgcacggtgctggcaatca

SEQ ID NO: 476427 - DNA, 25 bp, Rattus norvegicus
ctgtgcacgggaagaaactgacacc

SEQ ID NO: 476428 - DNA, 25 bp, Rattus norvegicus
tccgggctcgtccaagttggaaaga

SEQ ID NO: 476429 - DNA, 25 bp, Rattus norvegicus
acgagtgctccacagtccgggctcg

SEQ ID NO: 476430 - DNA, 25 bp, Rattus norvegicus
taggacgtcctatccacgagtgctc

SEQ ID NO: 476431 - DNA, 25 bp, Rattus norvegicus
atacggcggtgcaaactaggacgtc

SEQ ID NO: 476432 - DNA, 25 bp, Rattus norvegicus
gcacggtagtgaagcctcccaacaa

SEQ ID NO: 476433 - DNA, 25 bp, Rattus norvegicus
cagccactcagaggcacggtagtga

SEQ ID NO: 476434 - DNA, 25 bp, Rattus norvegicus
gtcccaggagagtgcaagacgcagc

SEQ ID NO: 476435 - DNA, 25 bp, Rattus norvegicus
gtcccagcttgcagaaaagagaagc

SEQ ID NO: 476436 - DNA, 25 bp, Rattus norvegicus
tcgcgggagtcagtcctcatcaccg

SEQ ID NO: 476437 - DNA, 25 bp, Rattus norvegicus
tatctggtaaccaaagcagccgtgg

SEQ ID NO: 476438 - DNA, 25 bp, Rattus norvegicus
tgcgaagcaagtcggtttcaacctt

SEQ ID NO: 476439 - DNA, 25 bp, Rattus norvegicus
tcacctgggactgcgaagcaagtcg

SEQ ID NO: 476440 - DNA, 25 bp, Rattus norvegicus
ccaagcttcgggacttgtcgcggga

SEQ ID NO: 476441 - DNA, 25 bp, Rattus norvegicus
cgctggtagtgctccctctgcaaat

SEQ ID NO: 476442 - DNA, 25 bp, Rattus norvegicus
gagaggcatcggacgccacctcgct

SEQ ID NO: 476443 - DNA, 25 bp, Rattus norvegicus
actgcgacacctggaagtgggctct

SEQ ID NO: 476444 - DNA, 25 bp, Rattus norvegicus
ccctctgcaaatgatctatctggta

SEQ ID NO: 476445 - DNA, 25 bp, Rattus norvegicus
tctgagggtaaagggactctggctt

SEQ ID NO: 476446 - DNA, 25 bp, Rattus norvegicus
ggtgcggaaaccagcgccaaccatc

SEQ ID NO: 476447 - DNA, 25 bp, Rattus norvegicus
agcgccaaccatctgaaagtcttag

SEQ ID NO: 476448 - DNA, 25 bp, Rattus norvegicus
tctgaaagtcttaggccacccactc

SEQ ID NO: 476449 - DNA, 25 bp, Rattus norvegicus
ccaaagcagccgtgggactggtgtt

SEQ ID NO: 476450 - DNA, 25 bp, Rattus norvegicus
aagtgccggcgacactcggactccg

SEQ ID NO: 476451 - DNA, 25 bp, Rattus norvegicus
atatgcctgggcctggccagccgag

SEQ ID NO: 476452 - DNA, 25 bp, Rattus norvegicus
cttcccgtgaggtcctcggtcatga

SEQ ID NO: 476453 - DNA, 25 bp, Rattus norvegicus
tgaggtcctcggtcatgaccgccgc

SEQ ID NO: 476454 - DNA, 25 bp, Rattus norvegicus
tagctgtagctaccgctgtcgctgc

SEQ ID NO: 476455 - DNA, 25 bp, Rattus norvegicus
cccaagcccggttcggcgaggtgct

SEQ ID NO: 476456 - DNA, 25 bp, Rattus norvegicus
gttcggcgaggtgcttcctctccgc

SEQ ID NO: 476457 - DNA, 25 bp, Rattus norvegicus
ccactcctcaatggcggtgactgga

SEQ ID NO: 476458 - DNA, 25 bp, Rattus norvegicus
tcctcaatggcggtgactggagcgc

SEQ ID NO: 476459 - DNA, 25 bp, Rattus norvegicus
gtgactggagcgctagactcgacca

SEQ ID NO: 476460 - DNA, 25 bp, Rattus norvegicus
ccgtcggagcacagccgggtcgatc

SEQ ID NO: 476461 - DNA, 25 bp, Rattus norvegicus
ctcgaccaatcaagtggctatatgc

SEQ ID NO: 476462 - DNA, 25 bp, Rattus norvegicus
aagtggctatatgcctgggcctggc

SEQ ID NO: 476463 - DNA, 25 bp, Rattus norvegicus
agcgctagactcgaccaatcaagtg

SEQ ID NO: 476464 - DNA, 25 bp, Rattus norvegicus
caagagtcacccaccttggcgggca

SEQ ID NO: 476465 - DNA, 25 bp, Rattus norvegicus
tggcccacagctgcagttcgacgac

SEQ ID NO: 476466 - DNA, 25 bp, Rattus norvegicus
agttcgacgaccagcgcgacccaga

SEQ ID NO: 476467 - DNA, 25 bp, Rattus norvegicus
gtagctcccgctcttgcgcctggag

SEQ ID NO: 476468 - DNA, 25 bp, Rattus norvegicus
cagtagctaggatgggcactttgtg

SEQ ID NO: 476469 - DNA, 25 bp, Rattus norvegicus
tgtcccggaattaagcagtagctag

SEQ ID NO: 476470 - DNA, 25 bp, Rattus norvegicus
gcctctcgtgctgtcccggaattaa

SEQ ID NO: 476471 - DNA, 25 bp, Rattus norvegicus
acctgccagtcttcgggttcctaga

SEQ ID NO: 476472 - DNA, 25 bp, Rattus norvegicus
ctggaacatgagtttgtcgggaacc

SEQ ID NO: 476473 - DNA, 25 bp, Rattus norvegicus
gccacagggtatttctggaacatga

SEQ ID NO: 476474 - DNA, 25 bp, Rattus norvegicus
gagccctgaccaagctctcagagag

SEQ ID NO: 476475 - DNA, 25 bp, Rattus norvegicus
ggtgttacccgagccctgaccaagc

SEQ ID NO: 476476 - DNA, 25 bp, Rattus norvegicus
gcactttgtgatgcgcagctgtccc

SEQ ID NO: 476477 - DNA, 25 bp, Rattus norvegicus
acttcgcaaggctgaaaggtgttcc

SEQ ID NO: 476478 - DNA, 25 bp, Rattus norvegicus
gccgctgtcccagtcggccaattgg

SEQ ID NO: 476479 - DNA, 25 bp, Rattus norvegicus
tggcggtaccaggacttgtttcttc

SEQ ID NO: 476480 - DNA, 25 bp, Rattus norvegicus
ttgtttcttcgcatccggaagcggc

SEQ ID NO: 476481 - DNA, 25 bp, Rattus norvegicus
gggagaatttatggggcctcactgc

SEQ ID NO: 476482 - DNA, 25 bp, Rattus norvegicus
ggggcctcactgctaattggttaac

SEQ ID NO: 476483 - DNA, 25 bp, Rattus norvegicus
ctgctaattggttaaccgatgatgc

SEQ ID NO: 476484 - DNA, 25 bp, Rattus norvegicus
ccgatgatgctaattctaccagttc

SEQ ID NO: 476485 - DNA, 25 bp, Rattus norvegicus
ccagttcaaattttaccgaatagca

SEQ ID NO: 476486 - DNA, 25 bp, Rattus norvegicus
cgaatagcacggtaccaggaggaca

SEQ ID NO: 476487 - DNA, 25 bp, Rattus norvegicus
caggaggacaggttccgattggtca

SEQ ID NO: 476488 - DNA, 25 bp, Rattus norvegicus
ttccgattggtcagtgtggcccggt

SEQ ID NO: 476489 - DNA, 25 bp, Rattus norvegicus
cccggttacgcaatttccggatgtg

SEQ ID NO: 476490 - DNA, 25 bp, Rattus norvegicus
ttccggatgtgaaacggctactggc

SEQ ID NO: 476491 - DNA, 25 bp, Rattus norvegicus
cccagtcggccaattggcggtacca

SEQ ID NO: 476492 - DNA, 25 bp, Rattus norvegicus
ttgtagtttgaaccagcgcccggca

SEQ ID NO: 476493 - DNA, 25 bp, Rattus norvegicus
gagcaggggaaaagcccgtatgacc

SEQ ID NO: 476494 - DNA, 25 bp, Rattus norvegicus
aagcccgtatgaccggagcctgagc

SEQ ID NO: 476495 - DNA, 25 bp, Rattus norvegicus
cagcgccacattgagagaagcggga

SEQ ID NO: 476496 - DNA, 25 bp, Rattus norvegicus
tgcgctcgtcactagccctgctgaa

SEQ ID NO: 476497 - DNA, 25 bp, Rattus norvegicus
agccctgctgaagcccggatgaacc

SEQ ID NO: 476498 - DNA, 25 bp, Rattus norvegicus
cggatgaaccgatggcctctgaaca

SEQ ID NO: 476499 - DNA, 25 bp, Rattus norvegicus
tatcactcctatacagtgtcgagga

SEQ ID NO: 476500 - DNA, 25 bp, Rattus norvegicus
tgtcgaggaactccgcgctccaaaa

SEQ ID NO: 476501 - DNA, 25 bp, Rattus norvegicus
tccaaaaggagcctccgcgtgcctg

SEQ ID NO: 476502 - DNA, 25 bp, Rattus norvegicus
tgcctgataaccgtcccgcgtctta

SEQ ID NO: 476503 - DNA, 25 bp, Rattus norvegicus
cccgcgtcttatgcagatgacgtaa

SEQ ID NO: 476504 - DNA, 25 bp, Rattus norvegicus
ctcccagcgcatcatgggagttgta

SEQ ID NO: 476505 - DNA, 25 bp, Rattus norvegicus
gatggcctctgaacaccgtcacttc

SEQ ID NO: 476506 - DNA, 25 bp, Rattus norvegicus
accttgtcgcgcaagtcctcgatgg

SEQ ID NO: 476507 - DNA, 25 bp, Rattus norvegicus
gcagcccatcggtcacagtcagggc

SEQ ID NO: 476508 - DNA, 25 bp, Rattus norvegicus
tggatgctaggtgcgcggaaaacac

SEQ ID NO: 476509 - DNA, 25 bp, Rattus norvegicus
gtgatcttctcattgccacccagca

SEQ ID NO: 476510 - DNA, 25 bp, Rattus norvegicus
caggttctgcatggtgatcttctca

SEQ ID NO: 476511 - DNA, 25 bp, Rattus norvegicus
cgaggcgatcgttcaggttctgcat

SEQ ID NO: 476512 - DNA, 25 bp, Rattus norvegicus
cgcaccttgtccaagtaggaggcga

SEQ ID NO: 476513 - DNA, 25 bp, Rattus norvegicus
tccagggcgcgcaccttgtccaagt

SEQ ID NO: 476514 - DNA, 25 bp, Rattus norvegicus
agctcgccattagcctgctccaggg

SEQ ID NO: 476515 - DNA, 25 bp, Rattus norvegicus
ggtaccagtcgcgaatcttcacctc

SEQ ID NO: 476516 - DNA, 25 bp, Rattus norvegicus
ggtccctgcttctggtaccagtcgc

SEQ ID NO: 476517 - DNA, 25 bp, Rattus norvegicus
gtactggctgtaatcacggaagggc

SEQ ID NO: 476518 - DNA, 25 bp, Rattus norvegicus
ctcgatggtcttgaagtactggctg

SEQ ID NO: 476519 - DNA, 25 bp, Rattus norvegicus
gtcgaggacacggacacgccacggc

SEQ ID NO: 476520 - DNA, 25 bp, Rattus norvegicus
agtcgagtcttggagacgatccgcc

SEQ ID NO: 476521 - DNA, 25 bp, Rattus norvegicus
tgctcgcaggacaaacctaggaatc

SEQ ID NO: 476522 - DNA, 25 bp, Rattus norvegicus
cccatgagaggaagtgatctatcgg

SEQ ID NO: 476523 - DNA, 25 bp, Rattus norvegicus
gatctatcggagtcacccgcgggca

SEQ ID NO: 476524 - DNA, 25 bp, Rattus norvegicus
cgcgggcaagtggacagatgaccaa

SEQ ID NO: 476525 - DNA, 25 bp, Rattus norvegicus
tggacagatgaccaagacccagttc

SEQ ID NO: 476526 - DNA, 25 bp, Rattus norvegicus
tgaactggaaacttcgcgatggggc

SEQ ID NO: 476527 - DNA, 25 bp, Rattus norvegicus
gacacccgggtcctcggcgagacag

SEQ ID NO: 476528 - DNA, 25 bp, Rattus norvegicus
ggcgagacagcctgacacagctccg

SEQ ID NO: 476529 - DNA, 25 bp, Rattus norvegicus
acacaagctgaactggaaacttcgc

SEQ ID NO: 476530 - DNA, 25 bp, Rattus norvegicus
cagcagggaccgcatagtcgagtct

SEQ ID NO: 476531 - DNA, 25 bp, Rattus norvegicus
tccgccggcactgaaacacaagctg

SEQ ID NO: 476532 - DNA, 25 bp, Rattus norvegicus
atgaggggtgtactccggctgtcct

SEQ ID NO: 476533 - DNA, 25 bp, Rattus norvegicus
tcgtccttcgcctgggccagaagaa

SEQ ID NO: 476534 - DNA, 25 bp, Rattus norvegicus
ctctggtgtcgccgccaactgtgtc

SEQ ID NO: 476535 - DNA, 25 bp, Rattus norvegicus
ttctcctaggaggagcgagtgcccg

SEQ ID NO: 476536 - DNA, 25 bp, Rattus norvegicus
acgggtcgcaattctcctaggagga

SEQ ID NO: 476537 - DNA, 25 bp, Rattus norvegicus
gccacgggtcgcaattctcctagga

SEQ ID NO: 476538 - DNA, 25 bp, Rattus norvegicus
tccactatggccacgggtcgcaatt

SEQ ID NO: 476539 - DNA, 25 bp, Rattus norvegicus
ccttgtccactatggccacgggtcg

SEQ ID NO: 476540 - DNA, 25 bp, Rattus norvegicus
tgagccttgtccactatggccacgg

SEQ ID NO: 476541 - DNA, 25 bp, Rattus norvegicus
cgctccgggaaccagagtgcaggga

SEQ ID NO: 476542 - DNA, 25 bp, Rattus norvegicus
ggagtctcccaaacctccgcgaatc

SEQ ID NO: 476543 - DNA, 25 bp, Rattus norvegicus
cagagtcccgggtggccctcctgtt

SEQ ID NO: 476544 - DNA, 25 bp, Rattus norvegicus
tcctttgccatcgtctccgcagagt

SEQ ID NO: 476545 - DNA, 25 bp, Rattus norvegicus
gagcctttaccttcttcctttgcca

SEQ ID NO: 476546 - DNA, 25 bp, Rattus norvegicus
tggcgcgctgcacgccggagccttt

SEQ ID NO: 476547 - DNA, 25 bp, Rattus norvegicus
gccggagcgtttctccggcgcgcct

SEQ ID NO: 476548 - DNA, 25 bp, Rattus norvegicus
ggccgcttttccaccttgtcgcaaa

SEQ ID NO: 476549 - DNA, 25 bp, Rattus norvegicus
aactcagcgatgctttacggccggc

SEQ ID NO: 476550 - DNA, 25 bp, Rattus norvegicus
tgctttacggccggcggcgtttgac

SEQ ID NO: 476551 - DNA, 25 bp, Rattus norvegicus
tcagcgatgctttacggccggcggc

SEQ ID NO: 476552 - DNA, 25 bp, Rattus norvegicus
aaactcagcgatgctttacggccgg

SEQ ID NO: 476553 - DNA, 25 bp, Rattus norvegicus
aaaactcagcgatgctttacggccg

SEQ ID NO: 476554 - DNA, 25 bp, Rattus norvegicus
aaaaactcagcgatgctttacggcc

SEQ ID NO: 476555 - DNA, 25 bp, Rattus norvegicus
aaaaaactcagcgatgctttacggc

SEQ ID NO: 476556 - DNA, 25 bp, Rattus norvegicus
gccgcttttccaccttgtcgcaaaa

SEQ ID NO: 476557 - DNA, 25 bp, Rattus norvegicus
ttggccgcttttccaccttgtcgca

SEQ ID NO: 476558 - DNA, 25 bp, Rattus norvegicus
gccacgccctcaaagaaactccgcc

SEQ ID NO: 476559 - DNA, 25 bp, Rattus norvegicus
cggccacgccctcaaagaaactccg

SEQ ID NO: 476560 - DNA, 25 bp, Rattus norvegicus
tggccgcttttccaccttgtcgcaa

SEQ ID NO: 476561 - DNA, 25 bp, Rattus norvegicus
actcagcgatgctttacggccggcg

SEQ ID NO: 476562 - DNA, 25 bp, Rattus norvegicus
agtgcgctgcctgcagctgggaacc

SEQ ID NO: 476563 - DNA, 25 bp, Rattus norvegicus
gctgctcttgtggttcgcgagctcc

SEQ ID NO: 476564 - DNA, 25 bp, Rattus norvegicus
gccagctctggtggccaacggcttt

SEQ ID NO: 476565 - DNA, 25 bp, Rattus norvegicus
ccaacggctttctggctctggacgc

SEQ ID NO: 476566 - DNA, 25 bp, Rattus norvegicus
ctggacgctgccaacaaccggctgt

SEQ ID NO: 476567 - DNA, 25 bp, Rattus norvegicus
agcctgccgtgacgccggacttcgt

SEQ ID NO: 476568 - DNA, 25 bp, Rattus norvegicus
ggacttcgtgcccttcgtgcaacta

SEQ ID NO: 476569 - DNA, 25 bp, Rattus norvegicus
tacgcccgctgaatgtggtggctga

SEQ ID NO: 476570 - DNA, 25 bp, Rattus norvegicus
tatctgcagcgcatccagctcaaca

SEQ ID NO: 476571 - DNA, 25 bp, Rattus norvegicus
tgtccacgggttcaggccgtgactg

SEQ ID NO: 476572 - DNA, 25 bp, Rattus norvegicus
gctcaacaatcccacggagcgcgtg

SEQ ID NO: 476573 - DNA, 25 bp, Rattus norvegicus
ctgcgtgctactgcaggaggacttc

SEQ ID NO: 476574 - DNA, 25 bp, Rattus norvegicus
gcaggaggacttcctggcgcaccga

SEQ ID NO: 476575 - DNA, 25 bp, Rattus norvegicus
ttcgtgcaactacgcccgctgaatg

SEQ ID NO: 476576 - DNA, 25 bp, Rattus norvegicus
ccgctctttctgtttcccttagcaa

SEQ ID NO: 476577 - DNA, 25 bp, Rattus norvegicus
ctccagcgatctgacgcatgaggta

SEQ ID NO: 476578 - DNA, 25 bp, Rattus norvegicus
cttctccgcatgtgcacgggaggtg

SEQ ID NO: 476579 - DNA, 25 bp, Rattus norvegicus
gggcaccgtcttttgtggcttccgc

SEQ ID NO: 476580 - DNA, 25 bp, Rattus norvegicus
gcgccaagaaagacggatgcttcca

SEQ ID NO: 476581 - DNA, 25 bp, Rattus norvegicus
cggcaacgcctcttgtcatcttgtc

SEQ ID NO: 476582 - DNA, 25 bp, Rattus norvegicus
gctggcttcccaagagacctccggg

SEQ ID NO: 476583 - DNA, 25 bp, Rattus norvegicus
tcacatgacgcggtacttggctggc

SEQ ID NO: 476584 - DNA, 25 bp, Rattus norvegicus
ctctcgagctttgggtccggagaca

SEQ ID NO: 476585 - DNA, 25 bp, Rattus norvegicus
tcgggaacacctcgccgcaggctaa

SEQ ID NO: 476586 - DNA, 25 bp, Rattus norvegicus
tcaccagctcctcgggagtgcggct

SEQ ID NO: 476587 - DNA, 25 bp, Rattus norvegicus
taaagcaaaaggcttgggacgccgc

SEQ ID NO: 476588 - DNA, 25 bp, Rattus norvegicus
cttgtcatcttgtcatccctcagca

SEQ ID NO: 476589 - DNA, 25 bp, Rattus norvegicus
cgcaggctaaacctgtggggcccgc

SEQ ID NO: 476590 - DNA, 25 bp, Rattus norvegicus
tgactgcagtcggttgctaggagac

SEQ ID NO: 476591 - DNA, 25 bp, Rattus norvegicus
tgcgccagttccaacggcgtgaggc

SEQ ID NO: 476592 - DNA, 25 bp, Rattus norvegicus
tgaggccaatccgcgcggccacgtg

SEQ ID NO: 476593 - DNA, 25 bp, Rattus norvegicus
ttccaacggcgtgaggccaatccgc

SEQ ID NO: 476594 - DNA, 25 bp, Rattus norvegicus
gtcgcgttgcgccagttccaacggc

SEQ ID NO: 476595 - DNA, 25 bp, Rattus norvegicus
tcctgggctccgaactcgggaacaa

SEQ ID NO: 476596 - DNA, 25 bp, Rattus norvegicus
gactcctgggctccgaactcgggaa

SEQ ID NO: 476597 - DNA, 25 bp, Rattus norvegicus
cggagggcacctgagcgacggccac

SEQ ID NO: 476598 - DNA, 25 bp, Rattus norvegicus
cagctccatcccgacccggcggagg

SEQ ID NO: 476599 - DNA, 25 bp, Rattus norvegicus
aagttcacggcaggcagctccatcc

SEQ ID NO: 476600 - DNA, 25 bp, Rattus norvegicus
ccttcaagttcacggcaggcagctc

SEQ ID NO: 476601 - DNA, 25 bp, Rattus norvegicus
cggccaccttcaagttcacggcagg

SEQ ID NO: 476602 - DNA, 25 bp, Rattus norvegicus
gggacccgtgccagcctgggtccat

SEQ ID NO: 476603 - DNA, 25 bp, Rattus norvegicus
gccacgtgactgcagtcggttgcta

SEQ ID NO: 476604 - DNA, 25 bp, Rattus norvegicus
gtgtgcgcgagaacctcaaagagtg

SEQ ID NO: 476605 - DNA, 25 bp, Rattus norvegicus
atggcacacttacgccttcttttca

SEQ ID NO: 476606 - DNA, 25 bp, Rattus norvegicus
tgtaggtacctatggcacacttacg

SEQ ID NO: 476607 - DNA, 25 bp, Rattus norvegicus
cctcaaagagtgatcggacctcatg

SEQ ID NO: 476608 - DNA, 25 bp, Rattus norvegicus
ggttctcagagaagtccctttacca

SEQ ID NO: 476609 - DNA, 25 bp, Rattus norvegicus
acaatagatctaggctgggcgttca

SEQ ID NO: 476610 - DNA, 25 bp, Rattus norvegicus
tcggacctcatgtaggtacctatgg

SEQ ID NO: 476611 - DNA, 25 bp, Rattus norvegicus
ttgtagcctagaaagtgcgcggagt

SEQ ID NO: 476612 - DNA, 25 bp, Rattus norvegicus
tgcgtaaaacccacctcggcgaggc

SEQ ID NO: 476613 - DNA, 25 bp, Rattus norvegicus
caaaaggattattccgcctaggctg

SEQ ID NO: 476614 - DNA, 25 bp, Rattus norvegicus
tccgcctaggctgtcaaatgggacg

SEQ ID NO: 476615 - DNA, 25 bp, Rattus norvegicus
caaatgggacggaagaaatgcccgc

SEQ ID NO: 476616 - DNA, 25 bp, Rattus norvegicus
cggcgaggcctttgtagcctagaaa

SEQ ID NO: 476617 - DNA, 25 bp, Rattus norvegicus
cggggcaaacaaaggaggcagacaa

SEQ ID NO: 476618 - DNA, 25 bp, Rattus norvegicus
tgtgcagaggccaccgaaatctctt

SEQ ID NO: 476619 - DNA, 25 bp, Rattus norvegicus
cgcaagaagtacaacgtgccggttc

SEQ ID NO: 476620 - DNA, 25 bp, Rattus norvegicus
tacccggtgggcatctttcagaagc

SEQ ID NO: 476621 - DNA, 25 bp, Rattus norvegicus
gtggccgtgcacttgatcctctatg

SEQ ID NO: 476622 - DNA, 25 bp, Rattus norvegicus
tcttccacagtggtggccgacgtgc

SEQ ID NO: 476623 - DNA, 25 bp, Rattus norvegicus
tggagtcctgctcatcagctgtgtc

SEQ ID NO: 476624 - DNA, 25 bp, Rattus norvegicus
ctcaacttcggccaaggtatggatc

SEQ ID NO: 476625 - DNA, 25 bp, Rattus norvegicus
aggcagccaaggatgaccaccctca

SEQ ID NO: 476626 - DNA, 25 bp, Rattus norvegicus
ctgggtgctgtgagtccctacaaac

SEQ ID NO: 476627 - DNA, 25 bp, Rattus norvegicus
tgtagccgggtcgtagattcgaacc

SEQ ID NO: 476628 - DNA, 25 bp, Rattus norvegicus
attcttgtcgctcaggcgaggctcc

SEQ ID NO: 476629 - DNA, 25 bp, Rattus norvegicus
ttagctcgctcgtcggagattcttg

SEQ ID NO: 476630 - DNA, 25 bp, Rattus norvegicus
ccacctgaagtccaaaggcggctta

SEQ ID NO: 476631 - DNA, 25 bp, Rattus norvegicus
gaaatctctttatcgctcccacctg

SEQ ID NO: 476632 - DNA, 25 bp, Rattus norvegicus
cttccgcgtcagtgcgaagatggtg

SEQ ID NO: 476633 - DNA, 25 bp, Rattus norvegicus
gccgggtcacgagcgaacgacctac

SEQ ID NO: 476634 - DNA, 25 bp, Rattus norvegicus
gcgaacgacctaccctaacgcttga

SEQ ID NO: 476635 - DNA, 25 bp, Rattus norvegicus
taccctaacgcttgaagccctgtgc

SEQ ID NO: 476636 - DNA, 25 bp, Rattus norvegicus
gaagccctgtgcctcaaggagaagc

SEQ ID NO: 476637 - DNA, 25 bp, Rattus norvegicus
cctcaaggagaagccggtgtcgcca

SEQ ID NO: 476638 - DNA, 25 bp, Rattus norvegicus
agaagccggtgtcgccaccgtccgg

SEQ ID NO: 476639 - DNA, 25 bp, Rattus norvegicus
ggggccctcgcgtacctacagcagg

SEQ ID NO: 476640 - DNA, 25 bp, Rattus norvegicus
tgggcacccggtggcctcggctatc

SEQ ID NO: 476641 - DNA, 25 bp, Rattus norvegicus
atcctcggccttgggcctggacctt

SEQ ID NO: 476642 - DNA, 25 bp, Rattus norvegicus
ggaccttggctacgcgatcctctgt

SEQ ID NO: 476643 - DNA, 25 bp, Rattus norvegicus
ccgaccttccgcgtcagtgcgaaga

SEQ ID NO: 476644 - DNA, 25 bp, Rattus norvegicus
tggtgggctctgagccctcgaatca

SEQ ID NO: 476645 - DNA, 25 bp, Rattus norvegicus
ttggctacgcgatcctctgtcgcct

SEQ ID NO: 476646 - DNA, 25 bp, Rattus norvegicus
cccggaagcagcaccttggactacg

SEQ ID NO: 476647 - DNA, 25 bp, Rattus norvegicus
acttggagcccacccattctgtagg

SEQ ID NO: 476648 - DNA, 25 bp, Rattus norvegicus
gatgtcctcttgcagtcattctcta

SEQ ID NO: 476649 - DNA, 25 bp, Rattus norvegicus
caccacagcgtaggaaaattacctg

SEQ ID NO: 476650 - DNA, 25 bp, Rattus norvegicus
acggcgcttttctgccagtgttggc

SEQ ID NO: 476651 - DNA, 25 bp, Rattus norvegicus
ccattttctctgtcaccggcgtttg

SEQ ID NO: 476652 - DNA, 25 bp, Rattus norvegicus
ttgtcacccacgtttggtcgcgctg

SEQ ID NO: 476653 - DNA, 25 bp, Rattus norvegicus
gtgagacccgcccactgtttgtctg

SEQ ID NO: 476654 - DNA, 25 bp, Rattus norvegicus
tgccgcgttggagaacagcacctaa

SEQ ID NO: 476655 - DNA, 25 bp, Rattus norvegicus
ctgctccttgcaatgtgccgcgttg

SEQ ID NO: 476656 - DNA, 25 bp, Rattus norvegicus
gcccggaatgcagacctgcctacta

SEQ ID NO: 476657 - DNA, 25 bp, Rattus norvegicus
gcgctgagtgatcctgccagaccgt

SEQ ID NO: 476658 - DNA, 25 bp, Rattus norvegicus
atggtgatccaggtatccgctgctg

SEQ ID NO: 476659 - DNA, 25 bp, Rattus norvegicus
tgcgccatacccttggttcacagga

SEQ ID NO: 476660 - DNA, 25 bp, Rattus norvegicus
gaatcaacagaacgccctttccagg

SEQ ID NO: 476661 - DNA, 25 bp, Rattus norvegicus
acgtcaccgtcgttgtcacggagca

SEQ ID NO: 476662 - DNA, 25 bp, Rattus norvegicus
atttactaatggctcctgtctctgg

SEQ ID NO: 476663 - DNA, 25 bp, Rattus norvegicus
tctcgggtggcgcatttactaatgg

SEQ ID NO: 476664 - DNA, 25 bp, Rattus norvegicus
tcgacctccaagagtgcccggaaga

SEQ ID NO: 476665 - DNA, 25 bp, Rattus norvegicus
agcgctgcgagcctttgttagcttg

SEQ ID NO: 476666 - DNA, 25 bp, Rattus norvegicus
tccactctttcggtaagcctgggga

SEQ ID NO: 476667 - DNA, 25 bp, Rattus norvegicus
tcgtatcgtatgtccgctatccaga

SEQ ID NO: 476668 - DNA, 25 bp, Rattus norvegicus
tccaccgaggaaaaggaatcgtatc

SEQ ID NO: 476669 - DNA, 25 bp, Rattus norvegicus
ttccgcaggccgtttccaccgagga

SEQ ID NO: 476670 - DNA, 25 bp, Rattus norvegicus
atataagtgaatacaggcgccgccc

SEQ ID NO: 476671 - DNA, 25 bp, Rattus norvegicus
ccgaccaataggaagcctcagtgta

SEQ ID NO: 476672 - DNA, 25 bp, Rattus norvegicus
cccgccttgagagttcggcttccgg

SEQ ID NO: 476673 - DNA, 25 bp, Rattus norvegicus
gtgcgcacgcgtcgatccttgactc

SEQ ID NO: 476674 - DNA, 25 bp, Rattus norvegicus
cccatccgcagcgtttggacgctga

SEQ ID NO: 476675 - DNA, 25 bp, Rattus norvegicus
tggagcgtgtggaaaccccatccgc

SEQ ID NO: 476676 - DNA, 25 bp, Rattus norvegicus
tccgcagcgtttggacgctgagagt

SEQ ID NO: 476677 - DNA, 25 bp, Rattus norvegicus
cccgttagcccacaatcagagctag

SEQ ID NO: 476678 - DNA, 25 bp, Rattus norvegicus
caatcagagctagggtcgaggcgct

SEQ ID NO: 476679 - DNA, 25 bp, Rattus norvegicus
gacggcaggggacagccttagaccc

SEQ ID NO: 476680 - DNA, 25 bp, Rattus norvegicus
gaggctgacgcggtaccttttcacc

SEQ ID NO: 476681 - DNA, 25 bp, Rattus norvegicus
acactttcaccgactacgggccagg

SEQ ID NO: 476682 - DNA, 25 bp, Rattus norvegicus
tttcaccgactacgggccaggcgtc

SEQ ID NO: 476683 - DNA, 25 bp, Rattus norvegicus
aggcgtccgctacgtccgcttcgag

SEQ ID NO: 476684 - DNA, 25 bp, Rattus norvegicus
acgtccgcttcgagcacggagggca

SEQ ID NO: 476685 - DNA, 25 bp, Rattus norvegicus
cacggagggcaggactcggtctact

SEQ ID NO: 476686 - DNA, 25 bp, Rattus norvegicus
caggactcggtctactggaagggct

SEQ ID NO: 476687 - DNA, 25 bp, Rattus norvegicus
ctcggtctactggaagggctggttc

SEQ ID NO: 476688 - DNA, 25 bp, Rattus norvegicus
ctaaggagctgcgtttaaggctatc

SEQ ID NO: 476689 - DNA, 25 bp, Rattus norvegicus
ccgacacacgttaccacggtgtttg

SEQ ID NO: 476690 - DNA, 25 bp, Rattus norvegicus
atgtcgttattgaaggtccggcgta

SEQ ID NO: 476691 - DNA, 25 bp, Rattus norvegicus
accatttggcccagctctaaggagc

SEQ ID NO: 476692 - DNA, 25 bp, Rattus norvegicus
tgaaggtccggcgtacctcatagtc

SEQ ID NO: 476693 - DNA, 25 bp, Rattus norvegicus
ctgcgtttaaggctatcccggcatc

SEQ ID NO: 476694 - DNA, 25 bp, Rattus norvegicus
ggctatcccggcatccttgaacagg

SEQ ID NO: 476695 - DNA, 25 bp, Rattus norvegicus
gcatccttgaacaggccggtgcgtg

SEQ ID NO: 476696 - DNA, 25 bp, Rattus norvegicus
agccttcggagatgcggtacctgag

SEQ ID NO: 476697 - DNA, 25 bp, Rattus norvegicus
ttaggatgtagacaagggcagcgat

SEQ ID NO: 476698 - DNA, 25 bp, Rattus norvegicus
ggcagcgatgcagctgctgctaatg

SEQ ID NO: 476699 - DNA, 25 bp, Rattus norvegicus
cagctgctgctaatgaaggcgagga

SEQ ID NO: 476700 - DNA, 25 bp, Rattus norvegicus
aaggcgaggagcatgtcgttattga

SEQ ID NO: 476701 - DNA, 25 bp, Rattus norvegicus
acggtgtttgagcaccatttggccc

SEQ ID NO: 476702 - DNA, 25 bp, Rattus norvegicus
aagggtccctgctcgtggactcagc

SEQ ID NO: 476703 - DNA, 25 bp, Rattus norvegicus
ggccaaggcgcctagaggtaaaaga

SEQ ID NO: 476704 - DNA, 25 bp, Rattus norvegicus
cgcctagaggtaaaagaaggccaga

SEQ ID NO: 476705 - DNA, 25 bp, Rattus norvegicus
taaaagaaggccagaggtgaggccc

SEQ ID NO: 476706 - DNA, 25 bp, Rattus norvegicus
ccctggaagctggtgcgggcaatta

SEQ ID NO: 476707 - DNA, 25 bp, Rattus norvegicus
agctggtgcgggcaattaccgaacc

SEQ ID NO: 476708 - DNA, 25 bp, Rattus norvegicus
tgcgggcaattaccgaacccggcaa

SEQ ID NO: 476709 - DNA, 25 bp, Rattus norvegicus
tgagcccagcacacctttctgtgca

SEQ ID NO: 476710 - DNA, 25 bp, Rattus norvegicus
cctttctgtgcaaacagccggagga

SEQ ID NO: 476711 - DNA, 25 bp, Rattus norvegicus
tgcaaacagccggaggaaggtgtcc

SEQ ID NO: 476712 - DNA, 25 bp, Rattus norvegicus
tccctgctcgtggactcagcgttgg

SEQ ID NO: 476713 - DNA, 25 bp, Rattus norvegicus
ggaggctggcattcgctctctccac

SEQ ID NO: 476714 - DNA, 25 bp, Rattus norvegicus
ctcacgacgcgggaggctggcattc

SEQ ID NO: 476715 - DNA, 25 bp, Rattus norvegicus
gaggaaggtgtcctgcccgccctgc

SEQ ID NO: 476716 - DNA, 25 bp, Rattus norvegicus
tacgcgagtaatcccagcgagaggc

SEQ ID NO: 476717 - DNA, 25 bp, Rattus norvegicus
acgcctcgtggttgcggatctcaaa

SEQ ID NO: 476718 - DNA, 25 bp, Rattus norvegicus
tccaaactgggacttgagggccaag

SEQ ID NO: 476719 - DNA, 25 bp, Rattus norvegicus
ctgcagcgtctcagaggtgaagtcc

SEQ ID NO: 476720 - DNA, 25 bp, Rattus norvegicus
agctgctctgagatgaggcgctgca

SEQ ID NO: 476721 - DNA, 25 bp, Rattus norvegicus
cgggacgcaggtcgagaatgattcc

SEQ ID NO: 476722 - DNA, 25 bp, Rattus norvegicus
ccctcgtattggttgctgatctctg

SEQ ID NO: 476723 - DNA, 25 bp, Rattus norvegicus
tggcgctcacataggtacgcgagta

SEQ ID NO: 476724 - DNA, 25 bp, Rattus norvegicus
aaatgttgcgctccgcatctccgcg

SEQ ID NO: 476725 - DNA, 25 bp, Rattus norvegicus
agacgctcgctggtgaaaatgttgc

SEQ ID NO: 476726 - DNA, 25 bp, Rattus norvegicus
tctcgtggatcgtcaccagacgctc

SEQ ID NO: 476727 - DNA, 25 bp, Rattus norvegicus
gggtggtccatgattttacgctcga

SEQ ID NO: 476728 - DNA, 25 bp, Rattus norvegicus
cgcgccagaaagatgagctcgattc

SEQ ID NO: 476729 - DNA, 25 bp, Rattus norvegicus
atctctgagtggcagcagtgtccct

SEQ ID NO: 476730 - DNA, 25 bp, Rattus norvegicus
ttagccgcaacccaagactcaaaga

SEQ ID NO: 476731 - DNA, 25 bp, Rattus norvegicus
cccatcacagtccttacggatgttc

SEQ ID NO: 476732 - DNA, 25 bp, Rattus norvegicus
tctgggctgacccaaggatcctcta

SEQ ID NO: 476733 - DNA, 25 bp, Rattus norvegicus
gctgacccaaggatcctctagcgct

SEQ ID NO: 476734 - DNA, 25 bp, Rattus norvegicus
cgctccgcttccatcgcctgccgga

SEQ ID NO: 476735 - DNA, 25 bp, Rattus norvegicus
ctgcagcgggttagccgcaacccaa

SEQ ID NO: 476736 - DNA, 25 bp, Rattus norvegicus
gactcaaagaacgtcccgccaagcg

SEQ ID NO: 476737 - DNA, 25 bp, Rattus norvegicus
cgactgtgctccacggctgctcaga

SEQ ID NO: 476738 - DNA, 25 bp, Rattus norvegicus
tgctccacggctgctcagatgccaa

SEQ ID NO: 476739 - DNA, 25 bp, Rattus norvegicus
aacgtcccgccaagcgcgtgagtgc

SEQ ID NO: 476740 - DNA, 25 bp, Rattus norvegicus
gctggccatccggactcgccgccac

SEQ ID NO: 476741 - DNA, 25 bp, Rattus norvegicus
tcgccgccactcgtgctggtaatct

SEQ ID NO: 476742 - DNA, 25 bp, Rattus norvegicus
gccactcgtgctggtaatctttccc

SEQ ID NO: 476743 - DNA, 25 bp, Rattus norvegicus
tccttacggatgttctgggctgacc

SEQ ID NO: 476744 - DNA, 25 bp, Rattus norvegicus
tctgccgcccgcctttgtttgggtc

SEQ ID NO: 476745 - DNA, 25 bp, Rattus norvegicus
ctagatttccgggtgcccaggtctc

SEQ ID NO: 476746 - DNA, 25 bp, Rattus norvegicus
gggtcagtcttagtcactgcaaacg

SEQ ID NO: 476747 - DNA, 25 bp, Rattus norvegicus
agggacagagcatagcgcagcgacc

SEQ ID NO: 476748 - DNA, 25 bp, Rattus norvegicus
ctgcgtcaccgtccggctagggctt

SEQ ID NO: 476749 - DNA, 25 bp, Rattus norvegicus
ggccaggtccgtgacaactacgtcc

SEQ ID NO: 476750 - DNA, 25 bp, Rattus norvegicus
gcgtgcagaccacggccaggtccgt

SEQ ID NO: 476751 - DNA, 25 bp, Rattus norvegicus
tcagagctataggaggccaacggcc

SEQ ID NO: 476752 - DNA, 25 bp, Rattus norvegicus
tcagaaggaaaggtcctcagagcta

SEQ ID NO: 476753 - DNA, 25 bp, Rattus norvegicus
tcccttgtagggaatttcagaagga

SEQ ID NO: 476754 - DNA, 25 bp, Rattus norvegicus
ccgcttcgaacacttgtcccttgta

SEQ ID NO: 476755 - DNA, 25 bp, Rattus norvegicus
tgcctcaggggttaagggacttcga

SEQ ID NO: 476756 - DNA, 25 bp, Rattus norvegicus
ctgatacacgggtgcctcaggggtt

SEQ ID NO: 476757 - DNA, 25 bp, Rattus norvegicus
agctgcgtggtggtacagccagctc

SEQ ID NO: 476758 - DNA, 25 bp, Rattus norvegicus
gccatcttgtgcgtcggcctcagga

SEQ ID NO: 476759 - DNA, 25 bp, Rattus norvegicus
aggccggccgggaaacacaggcctg

SEQ ID NO: 476760 - DNA, 25 bp, Rattus norvegicus
tgtgccacaactcaatagccggcct

SEQ ID NO: 476761 - DNA, 25 bp, Rattus norvegicus
tttccctgtgccacaactcaatagc

SEQ ID NO: 476762 - DNA, 25 bp, Rattus norvegicus
gagcgagacctgtctggggtccctt

SEQ ID NO: 476763 - DNA, 25 bp, Rattus norvegicus
tgtcacctgagcgagacctgtctgg

SEQ ID NO: 476764 - DNA, 25 bp, Rattus norvegicus
catgcaccgtcacggggtcagcggc

SEQ ID NO: 476765 - DNA, 25 bp, Rattus norvegicus
caacgaggaggccatgcaccgtcac

SEQ ID NO: 476766 - DNA, 25 bp, Rattus norvegicus
gggcggtaaaaactggagacagcaa

SEQ ID NO: 476767 - DNA, 25 bp, Rattus norvegicus
gactggcctgacctttggttccgcc

SEQ ID NO: 476768 - DNA, 25 bp, Rattus norvegicus
gacagactggcctgacctttggttc

SEQ ID NO: 476769 - DNA, 25 bp, Rattus norvegicus
ataggcgggacagactggcctgacc

SEQ ID NO: 476770 - DNA, 25 bp, Rattus norvegicus
aactggagacagcaacgaggaggcc

SEQ ID NO: 476771 - DNA, 25 bp, Rattus norvegicus
cgtgatcagagaagggcgtggtcaa

SEQ ID NO: 476772 - DNA, 25 bp, Rattus norvegicus
cctcaaggtatcaaacagtggctcc

SEQ ID NO: 476773 - DNA, 25 bp, Rattus norvegicus
cggaatactccttagcctccttttg

SEQ ID NO: 476774 - DNA, 25 bp, Rattus norvegicus
aagccgcctgtctggaccgtacagc

SEQ ID NO: 476775 - DNA, 25 bp, Rattus norvegicus
cgggacgtccagactcacggcaatt

SEQ ID NO: 476776 - DNA, 25 bp, Rattus norvegicus
tagggcttaagagcccgccctcttc

SEQ ID NO: 476777 - DNA, 25 bp, Rattus norvegicus
gttctccgccctctgattggttgta

SEQ ID NO: 476778 - DNA, 25 bp, Rattus norvegicus
cacaattattggtggatgttccgcc

SEQ ID NO: 476779 - DNA, 25 bp, Rattus norvegicus
ctccttttgcttgccactggttgca

SEQ ID NO: 476780 - DNA, 25 bp, Rattus norvegicus
ggtctttcaacacgtcctcaaggta

SEQ ID NO: 476781 - DNA, 25 bp, Rattus norvegicus
agtggctccacacggtcacaacgtg

SEQ ID NO: 476782 - DNA, 25 bp, Rattus norvegicus
acaacgtgtatggaccggactagta

SEQ ID NO: 476783 - DNA, 25 bp, Rattus norvegicus
cgactgattggctctccggaatact

SEQ ID NO: 476784 - DNA, 25 bp, Rattus norvegicus
gtgaccgaagtcaactcacgactga

SEQ ID NO: 476785 - DNA, 25 bp, Rattus norvegicus
tcccgaacgcgattcctgatctctt

SEQ ID NO: 476786 - DNA, 25 bp, Rattus norvegicus
gtgacacggaaccaggccccgtgtg

SEQ ID NO: 476787 - DNA, 25 bp, Rattus norvegicus
gaagcaggccccgtgtgacacggaa

SEQ ID NO: 476788 - DNA, 25 bp, Rattus norvegicus
tgacacggaagctggccccgtgtga

SEQ ID NO: 476789 - DNA, 25 bp, Rattus norvegicus
cgtgtgacacggaagctggccccgt

SEQ ID NO: 476790 - DNA, 25 bp, Rattus norvegicus
gaagctggccccgtgtgacacggaa

SEQ ID NO: 476791 - DNA, 25 bp, Rattus norvegicus
tgacacggaaccaggccccgtgtga

SEQ ID NO: 476792 - DNA, 25 bp, Rattus norvegicus
ccgtgtgacacggaagctggccccg

SEQ ID NO: 476793 - DNA, 25 bp, Rattus norvegicus
cgtgtgacacggaaccaggccccgt

SEQ ID NO: 476794 - DNA, 25 bp, Rattus norvegicus
gtgtgacacggaaccaggccccgtg

SEQ ID NO: 476795 - DNA, 25 bp, Rattus norvegicus
tgtgacacggaaccaggccctgtgt

SEQ ID NO: 476796 - DNA, 25 bp, Rattus norvegicus
gacacggaaccaggccctgtgtgac

SEQ ID NO: 476797 - DNA, 25 bp, Rattus norvegicus
tgtgtgacacggaaccaggccccgt

SEQ ID NO: 476798 - DNA, 25 bp, Rattus norvegicus
gcaggccccgtgtgacacggaagca

SEQ ID NO: 476799 - DNA, 25 bp, Rattus norvegicus
tgtgacacggaaccaggccccgtgt

SEQ ID NO: 476800 - DNA, 25 bp, Rattus norvegicus
atgcgcgttacgctcttctccggtc

SEQ ID NO: 476801 - DNA, 25 bp, Rattus norvegicus
cttcggaagggcgtccgtcatccac

SEQ ID NO: 476802 - DNA, 25 bp, Rattus norvegicus
agaaagctgtgtccgcgccttcgga

SEQ ID NO: 476803 - DNA, 25 bp, Rattus norvegicus
gcggcttcgcgtagaaagctgtgtc

SEQ ID NO: 476804 - DNA, 25 bp, Rattus norvegicus
aacggcagcgaagggctccgcgctt

SEQ ID NO: 476805 - DNA, 25 bp, Rattus norvegicus
tggggcaccgctgttttagccggaa

SEQ ID NO: 476806 - DNA, 25 bp, Rattus norvegicus
cttcgtaaaggtcagttcgcgggct

SEQ ID NO: 476807 - DNA, 25 bp, Rattus norvegicus
cttcccggatgcagacagcttcgta

SEQ ID NO: 476808 - DNA, 25 bp, Rattus norvegicus
aagcctgacgcggagatggtactgc

SEQ ID NO: 476809 - DNA, 25 bp, Rattus norvegicus
gggagcatcagtccgcgccagcgac

SEQ ID NO: 476810 - DNA, 25 bp, Rattus norvegicus
taggacggaaaaatggcgcctccca

SEQ ID NO: 476811 - DNA, 25 bp, Rattus norvegicus
atctcgcgagaagagccgccctagg

SEQ ID NO: 476812 - DNA, 25 bp, Rattus norvegicus
tcctgaggagcccaacagctgagcg

SEQ ID NO: 476813 - DNA, 25 bp, Rattus norvegicus
ggtccgccggaacaatctcgcgaga

SEQ ID NO: 476814 - DNA, 25 bp, Rattus norvegicus
gatgccctaataacgcccagtgtgg

SEQ ID NO: 476815 - DNA, 25 bp, Rattus norvegicus
tgagagtgcgcagatctgccacagc

SEQ ID NO: 476816 - DNA, 25 bp, Rattus norvegicus
ggggagagcaagacagccctagatc

SEQ ID NO: 476817 - DNA, 25 bp, Rattus norvegicus
tctgacgcacctacaataatcgggg

SEQ ID NO: 476818 - DNA, 25 bp, Rattus norvegicus
ggaaaccaaacaggcacggcggaca

SEQ ID NO: 476819 - DNA, 25 bp, Rattus norvegicus
cgcctgagtcggtggttattagaga

SEQ ID NO: 476820 - DNA, 25 bp, Rattus norvegicus
agtttaccttcctgcagctctcgaa

SEQ ID NO: 476821 - DNA, 25 bp, Rattus norvegicus
ggctggcgtcttccagattccctca

SEQ ID NO: 476822 - DNA, 25 bp, Rattus norvegicus
ccctggaatatgtagcgggtccatg

SEQ ID NO: 476823 - DNA, 25 bp, Rattus norvegicus
cggatcctggacctacaaaagcttc

SEQ ID NO: 476824 - DNA, 25 bp, Rattus norvegicus
ctcctgtcttggttcgggatcctga

SEQ ID NO: 476825 - DNA, 25 bp, Rattus norvegicus
gatcctgatttctgtccggacccgg

SEQ ID NO: 476826 - DNA, 25 bp, Rattus norvegicus
tccggccaagcagtgtcaaaggctc

SEQ ID NO: 476827 - DNA, 25 bp, Rattus norvegicus
agctctcgaataaacgccgcgcgct

SEQ ID NO: 476828 - DNA, 25 bp, Rattus norvegicus
caacccgcggaaggtaccgcattgc

SEQ ID NO: 476829 - DNA, 25 bp, Rattus norvegicus
actcgtggccggtctgccacgtgtc

SEQ ID NO: 476830 - DNA, 25 bp, Rattus norvegicus
ggtctgccacgtgtcaccctgaatg

SEQ ID NO: 476831 - DNA, 25 bp, Rattus norvegicus
gtcaccctgaatgtccacccgggga

SEQ ID NO: 476832 - DNA, 25 bp, Rattus norvegicus
tcactgccgggacacgtcagccgag

SEQ ID NO: 476833 - DNA, 25 bp, Rattus norvegicus
ctgcgtccacgtgtcactgccggga

SEQ ID NO: 476834 - DNA, 25 bp, Rattus norvegicus
agaagttctgcgctaggcccggctc

SEQ ID NO: 476835 - DNA, 25 bp, Rattus norvegicus
cacagctgtcagaagttctgcgcta

SEQ ID NO: 476836 - DNA, 25 bp, Rattus norvegicus
agctcctcgtgaagccgcgggcctg

SEQ ID NO: 476837 - DNA, 25 bp, Rattus norvegicus
ggggccaatgagctcctcgtgaagc

SEQ ID NO: 476838 - DNA, 25 bp, Rattus norvegicus
aaccaatcaccgtgaggtgaagccc

SEQ ID NO: 476839 - DNA, 25 bp, Rattus norvegicus
acagacagcgcgacccaaccaatca

SEQ ID NO: 476840 - DNA, 25 bp, Rattus norvegicus
gggctgggacccattctccctgtgc

SEQ ID NO: 476841 - DNA, 25 bp, Rattus norvegicus
cgactgtcactctgcccgcagtaaa

SEQ ID NO: 476842 - DNA, 25 bp, Rattus norvegicus
gaacctttaaggactagcactgctg

SEQ ID NO: 476843 - DNA, 25 bp, Rattus norvegicus
cctacgtcacgtggaagatggcttc

SEQ ID NO: 476844 - DNA, 25 bp, Rattus norvegicus
gaacagtgtggtctcgtaggcttta

SEQ ID NO: 476845 - DNA, 25 bp, Rattus norvegicus
cccttcggcgtgcagaacagaggaa

SEQ ID NO: 476846 - DNA, 25 bp, Rattus norvegicus
cggctcggatactagcaggcccttc

SEQ ID NO: 476847 - DNA, 25 bp, Rattus norvegicus
gagctaccgcttcgtgcccacaaaa

SEQ ID NO: 476848 - DNA, 25 bp, Rattus norvegicus
ccatgcgcgacagacaacgttgatt

SEQ ID NO: 476849 - DNA, 25 bp, Rattus norvegicus
tactccttgaggtaggccgccactt

SEQ ID NO: 476850 - DNA, 25 bp, Rattus norvegicus
aaggtctggctaaacttgggcgtca

SEQ ID NO: 476851 - DNA, 25 bp, Rattus norvegicus
cgcagttctattcctcattttcgga

SEQ ID NO: 476852 - DNA, 25 bp, Rattus norvegicus
ggtggagcacgaaaaccgacgttca

SEQ ID NO: 476853 - DNA, 25 bp, Rattus norvegicus
cgcgtgggtccaagtcccatagtga

SEQ ID NO: 476854 - DNA, 25 bp, Rattus norvegicus
agagacgctctatcctcgacgcggc

SEQ ID NO: 476855 - DNA, 25 bp, Rattus norvegicus
ctgggccgctgctaggaagcacaac

SEQ ID NO: 476856 - DNA, 25 bp, Rattus norvegicus
cttctgggcccggttgcgcgctgcc

SEQ ID NO: 476857 - DNA, 25 bp, Rattus norvegicus
tggcagcttcgcgaatgacggctgc

SEQ ID NO: 476858 - DNA, 25 bp, Rattus norvegicus
tattgtggcagcttcgcgaatgacg

SEQ ID NO: 476859 - DNA, 25 bp, Rattus norvegicus
caatattgtggcagcttcgcgaatg

SEQ ID NO: 476860 - DNA, 25 bp, Rattus norvegicus
cgcggagccttcacaatattgtggc

SEQ ID NO: 476861 - DNA, 25 bp, Rattus norvegicus
agcgcggagccttcacaatattgtg

SEQ ID NO: 476862 - DNA, 25 bp, Rattus norvegicus
cgggagcgcggagccttcacaatat

SEQ ID NO: 476863 - DNA, 25 bp, Rattus norvegicus
ttattcatcggcagcccgcgtcgct

SEQ ID NO: 476864 - DNA, 25 bp, Rattus norvegicus
attattcatcggcagcccgcgtcgc

SEQ ID NO: 476865 - DNA, 25 bp, Rattus norvegicus
atgcattattcatcggcagcccgcg

SEQ ID NO: 476866 - DNA, 25 bp, Rattus norvegicus
tagtcatgcattattcatcggcagc

SEQ ID NO: 476867 - DNA, 25 bp, Rattus norvegicus
gcgccttagtcatgcattattcatc

SEQ ID NO: 476868 - DNA, 25 bp, Rattus norvegicus
gggcgccttagtcatgcattattca

SEQ ID NO: 476869 - DNA, 25 bp, Rattus norvegicus
ggggcgccttagtcatgcattattc

SEQ ID NO: 476870 - DNA, 25 bp, Rattus norvegicus
gcctcagggctctctctagacgtga

SEQ ID NO: 476871 - DNA, 25 bp, Rattus norvegicus
tgattacagccgcacctgaagcggc

SEQ ID NO: 476872 - DNA, 25 bp, Rattus norvegicus
ggttgcagagaaagtgattacagcc

SEQ ID NO: 476873 - DNA, 25 bp, Rattus norvegicus
caggcaagcgaaggttgcagagaaa

SEQ ID NO: 476874 - DNA, 25 bp, Rattus norvegicus
gcacgctcagcacacggggctggaa

SEQ ID NO: 476875 - DNA, 25 bp, Rattus norvegicus
acctggacggggcacgagactccgc

SEQ ID NO: 476876 - DNA, 25 bp, Rattus norvegicus
ctctcccgaagaggcagcacctgga

SEQ ID NO: 476877 - DNA, 25 bp, Rattus norvegicus
ctagacgtgaggatctcggttgctc

SEQ ID NO: 476878 - DNA, 25 bp, Rattus norvegicus
acccagattgcattgcagtgggcga

SEQ ID NO: 476879 - DNA, 25 bp, Rattus norvegicus
ctggaaaaaccacccagattgcatt

SEQ ID NO: 476880 - DNA, 25 bp, Rattus norvegicus
gcctccttgtccctaggagtcgcgg

SEQ ID NO: 476881 - DNA, 25 bp, Rattus norvegicus
agggaggactggctcgcacccagct

SEQ ID NO: 476882 - DNA, 25 bp, Rattus norvegicus
cggcgcgtttcccactaggatgagt

SEQ ID NO: 476883 - DNA, 25 bp, Rattus norvegicus
ctcggttgctcagctctcccgaaga

SEQ ID NO: 476884 - DNA, 25 bp, Rattus norvegicus
atccgtgcctgggaagtttatctca

SEQ ID NO: 476885 - DNA, 25 bp, Rattus norvegicus
tctcttttcgaagccagcgtgaccg

SEQ ID NO: 476886 - DNA, 25 bp, Rattus norvegicus
cgtcggccgccaggaagttttgctt

SEQ ID NO: 476887 - DNA, 25 bp, Rattus norvegicus
gaatgtgcagctgatgaccgtcggc

SEQ ID NO: 476888 - DNA, 25 bp, Rattus norvegicus
ctcggtggcatttgcagaatgtgca

SEQ ID NO: 476889 - DNA, 25 bp, Rattus norvegicus
caggagcgtcaagtggtaactgaca

SEQ ID NO: 476890 - DNA, 25 bp, Rattus norvegicus
tcgaccttcactctacaggagcgtc

SEQ ID NO: 476891 - DNA, 25 bp, Rattus norvegicus
cgggacacttgggtcgaccttcact

SEQ ID NO: 476892 - DNA, 25 bp, Rattus norvegicus
gacacgggattgaaataggctcctg

SEQ ID NO: 476893 - DNA, 25 bp, Rattus norvegicus
tcccaccgttctgctgtcggctgga

SEQ ID NO: 476894 - DNA, 25 bp, Rattus norvegicus
gcttgcaacactgggtactggctcc

SEQ ID NO: 476895 - DNA, 25 bp, Rattus norvegicus
agtttatctcaagtgcgccgctcca

SEQ ID NO: 476896 - DNA, 25 bp, Rattus norvegicus
ctgccagcagaggtaggcagtgttc

SEQ ID NO: 476897 - DNA, 25 bp, Rattus norvegicus
ggcaagtggcgcttctcactctctc

SEQ ID NO: 476898 - DNA, 25 bp, Rattus norvegicus
ggctcggggcccacatccttacgtg

SEQ ID NO: 476899 - DNA, 25 bp, Rattus norvegicus
ggggcccacatccttacgtgcacaa

SEQ ID NO: 476900 - DNA, 25 bp, Rattus norvegicus
tccttacgtgcacaaagccggactg

SEQ ID NO: 476901 - DNA, 25 bp, Rattus norvegicus
gagagtggataaggagaatgccctc

SEQ ID NO: 476902 - DNA, 25 bp, Rattus norvegicus
aacacgcggacatgggatgttacta

SEQ ID NO: 476903 - DNA, 25 bp, Rattus norvegicus
cgcggacatgggatgttactagccc

SEQ ID NO: 476904 - DNA, 25 bp, Rattus norvegicus
catgggatgttactagcccgtagga

SEQ ID NO: 476905 - DNA, 25 bp, Rattus norvegicus
ttactagcccgtaggaagggagatg

SEQ ID NO: 476906 - DNA, 25 bp, Rattus norvegicus
gatggagggcccgaatttcaacttc

SEQ ID NO: 476907 - DNA, 25 bp, Rattus norvegicus
ggcccgaatttcaacttcagttcta

SEQ ID NO: 476908 - DNA, 25 bp, Rattus norvegicus
caacttcagttctagacgcaggatg

SEQ ID NO: 476909 - DNA, 25 bp, Rattus norvegicus
ttcagttctagacgcaggatgggtc

SEQ ID NO: 476910 - DNA, 25 bp, Rattus norvegicus
ttctagacgcaggatgggtctgaga

SEQ ID NO: 476911 - DNA, 25 bp, Rattus norvegicus
tgcacaaagccggactgcacgctcg

SEQ ID NO: 476912 - DNA, 25 bp, Rattus norvegicus
gaggagagtcccttggctcccaccg

SEQ ID NO: 476913 - DNA, 25 bp, Rattus norvegicus
gcaccaccctggttacagcgcagct

SEQ ID NO: 476914 - DNA, 25 bp, Rattus norvegicus
ggcctgtggattcctccctttgccg

SEQ ID NO: 476915 - DNA, 25 bp, Rattus norvegicus
tctcgctggggcctgtggattcctc

SEQ ID NO: 476916 - DNA, 25 bp, Rattus norvegicus
aaaacgtgatcagaggcggcccggt

SEQ ID NO: 476917 - DNA, 25 bp, Rattus norvegicus
ggcagtggccctgaaaacgtgatca

SEQ ID NO: 476918 - DNA, 25 bp, Rattus norvegicus
cgcggcatccctttcgtacttcaaa

SEQ ID NO: 476919 - DNA, 25 bp, Rattus norvegicus
gacccgctccagttttgtcccgctg

SEQ ID NO: 476920 - DNA, 25 bp, Rattus norvegicus
gtgcgcttggctccaaacctgtttg

SEQ ID NO: 476921 - DNA, 25 bp, Rattus norvegicus
ggctgcagccatccatcatcccggc

SEQ ID NO: 476922 - DNA, 25 bp, Rattus norvegicus
gttatgtaaatagcggggcctgccc

SEQ ID NO: 476923 - DNA, 25 bp, Rattus norvegicus
gtggaacgccagtgttatgtaaata

SEQ ID NO: 476924 - DNA, 25 bp, Rattus norvegicus
gtgaccggtggaacgccagtgttat

SEQ ID NO: 476925 - DNA, 25 bp, Rattus norvegicus
ccagcattgtctgcgcctgcgggca

SEQ ID NO: 476926 - DNA, 25 bp, Rattus norvegicus
ctgagtgttaccgtcaggagcaatg

SEQ ID NO: 476927 - DNA, 25 bp, Rattus norvegicus
ttagttgaaggaactcggagctgcc

SEQ ID NO: 476928 - DNA, 25 bp, Rattus norvegicus
cagccacgggcagtttctgttttag

SEQ ID NO: 476929 - DNA, 25 bp, Rattus norvegicus
tccgactatggtgagtaccggcagc

SEQ ID NO: 476930 - DNA, 25 bp, Rattus norvegicus
ttcggctttcgactctccgactatg

SEQ ID NO: 476931 - DNA, 25 bp, Rattus norvegicus
caggagcaatgacatcaggatttta

SEQ ID NO: 476932 - DNA, 25 bp, Rattus norvegicus
tgccaaactgttaccctgagtgtta

SEQ ID NO: 476933 - DNA, 25 bp, Rattus norvegicus
tgatctttcacctgccagagccgcg

SEQ ID NO: 476934 - DNA, 25 bp, Rattus norvegicus
gcgcgcggacgagtctgatctttca

SEQ ID NO: 476935 - DNA, 25 bp, Rattus norvegicus
attcaccttcgcaccactgtgaggc

SEQ ID NO: 476936 - DNA, 25 bp, Rattus norvegicus
tccgagctttggagagtcgccgccc

SEQ ID NO: 476937 - DNA, 25 bp, Rattus norvegicus
ggcgcacgatttctccacacaagcg

SEQ ID NO: 476938 - DNA, 25 bp, Rattus norvegicus
gtgccgcagaaagtctcgcacctgc

SEQ ID NO: 476939 - DNA, 25 bp, Rattus norvegicus
ttcggggagtaatcagttgcaatta

SEQ ID NO: 476940 - DNA, 25 bp, Rattus norvegicus
tctacatggtccagccgcagggctg

SEQ ID NO: 476941 - DNA, 25 bp, Rattus norvegicus
cgggctccccgaagtgaggaagaca

SEQ ID NO: 476942 - DNA, 25 bp, Rattus norvegicus
aagtgaggaagacaagaggcgggca

SEQ ID NO: 476943 - DNA, 25 bp, Rattus norvegicus
ggcagtgatcgagaagtgggtcaac

SEQ ID NO: 476944 - DNA, 25 bp, Rattus norvegicus
agtgggtcaacggagagtactgtga

SEQ ID NO: 476945 - DNA, 25 bp, Rattus norvegicus
gtgaggagcccgcacccacgccagt

SEQ ID NO: 476946 - DNA, 25 bp, Rattus norvegicus
acccacgccagtgttggggcgcatc

SEQ ID NO: 476947 - DNA, 25 bp, Rattus norvegicus
cacgccagtgttggggcgcatcgtc

SEQ ID NO: 476948 - DNA, 25 bp, Rattus norvegicus
cgcatcgtccgcgagggctcggagc

SEQ ID NO: 476949 - DNA, 25 bp, Rattus norvegicus
cccagagggcgtctacatggtccag

SEQ ID NO: 476950 - DNA, 25 bp, Rattus norvegicus
cccgggacagagagcgcagtggccc

SEQ ID NO: 476951 - DNA, 25 bp, Rattus norvegicus
agggcgtctacatggtccagccgca

SEQ ID NO: 476952 - DNA, 25 bp, Rattus norvegicus
ggcgtctacatggtccagccgcagg

SEQ ID NO: 476953 - DNA, 25 bp, Rattus norvegicus
cagagggcgtctacatggtccagcc

SEQ ID NO: 476954 - DNA, 25 bp, Rattus norvegicus
agaatgctggggaagaacttcgacc

SEQ ID NO: 476955 - DNA, 25 bp, Rattus norvegicus
aaagcacagccgcaggtgagcgccc

SEQ ID NO: 476956 - DNA, 25 bp, Rattus norvegicus
tgtgggcaacgaaagcacagccgca

SEQ ID NO: 476957 - DNA, 25 bp, Rattus norvegicus
ggagtcttccaccatggaccgcagc

SEQ ID NO: 476958 - DNA, 25 bp, Rattus norvegicus
gcatggactacacgggctgcagccc

SEQ ID NO: 476959 - DNA, 25 bp, Rattus norvegicus
gacagacgagggcatggactacacg

SEQ ID NO: 476960 - DNA, 25 bp, Rattus norvegicus
ctaatggatgccgagacagacgagg

SEQ ID NO: 476961 - DNA, 25 bp, Rattus norvegicus
cccgagcctaatggatgccgagaca

SEQ ID NO: 476962 - DNA, 25 bp, Rattus norvegicus
cacgctacccataatgcccaaggaa

SEQ ID NO: 476963 - DNA, 25 bp, Rattus norvegicus
ggcccgacgaccgtcctcactcgta

SEQ ID NO: 476964 - DNA, 25 bp, Rattus norvegicus
tggggaagaacttcgaccgagtgcc

SEQ ID NO: 476965 - DNA, 25 bp, Rattus norvegicus
ccggaagcacatgcggagaatgctg

SEQ ID NO: 476966 - DNA, 25 bp, Rattus norvegicus
catgcccggaagcacatgcggagaa

SEQ ID NO: 476967 - DNA, 25 bp, Rattus norvegicus
ccatcccaggtgagagccgaggccg

SEQ ID NO: 476968 - DNA, 25 bp, Rattus norvegicus
tcccaggtggattaagcgagaaatc

SEQ ID NO: 476969 - DNA, 25 bp, Rattus norvegicus
gacgccttccatcttactgcgttca

SEQ ID NO: 476970 - DNA, 25 bp, Rattus norvegicus
tgtcatccacaggtcctcgagctca

SEQ ID NO: 476971 - DNA, 25 bp, Rattus norvegicus
ttgcgtgtcatccacaggtcctcga

SEQ ID NO: 476972 - DNA, 25 bp, Rattus norvegicus
gctttcaacgtgttgcgtgtcatcc

SEQ ID NO: 476973 - DNA, 25 bp, Rattus norvegicus
tccggtatggctttcaacgtgttgc

SEQ ID NO: 476974 - DNA, 25 bp, Rattus norvegicus
agcgagaaatccaaactccggtatg

SEQ ID NO: 476975 - DNA, 25 bp, Rattus norvegicus
ctgtgtcttcccaggtggattaagc

SEQ ID NO: 476976 - DNA, 25 bp, Rattus norvegicus
atcgaggcagtacgcctgtgtcttc

SEQ ID NO: 476977 - DNA, 25 bp, Rattus norvegicus
tgacctgagaatcgaggcagtacgc

SEQ ID NO: 476978 - DNA, 25 bp, Rattus norvegicus
tccgaggtgacctgagaatcgaggc

SEQ ID NO: 476979 - DNA, 25 bp, Rattus norvegicus
attgaatacattccgaggtgacctg

SEQ ID NO: 476980 - DNA, 25 bp, Rattus norvegicus
ttctctgttgttctacacaacattg

SEQ ID NO: 476981 - DNA, 25 bp, Rattus norvegicus
ccaaactccggtatggctttcaacg

SEQ ID NO: 476982 - DNA, 25 bp, Rattus norvegicus
ccacgaccgcgtggacaacctggtg

SEQ ID NO: 476983 - DNA, 25 bp, Rattus norvegicus
ctagaactgctctgtatgtgaaccc

SEQ ID NO: 476984 - DNA, 25 bp, Rattus norvegicus
acctgcgcaccgactcggaggagtc

SEQ ID NO: 476985 - DNA, 25 bp, Rattus norvegicus
aggctcgctgctcttcctgcagaca

SEQ ID NO: 476986 - DNA, 25 bp, Rattus norvegicus
tcgcacaagcgcaagcacgagaagc

SEQ ID NO: 476987 - DNA, 25 bp, Rattus norvegicus
atgtcgcagatggactcgcacaagc

SEQ ID NO: 476988 - DNA, 25 bp, Rattus norvegicus
gccacacagtggtgggcatgtcgca

SEQ ID NO: 476989 - DNA, 25 bp, Rattus norvegicus
gtacaagctcaagtgctcgcacttc

SEQ ID NO: 476990 - DNA, 25 bp, Rattus norvegicus
ggtgcccgactgcaagtacaagctc

SEQ ID NO: 476991 - DNA, 25 bp, Rattus norvegicus
ggcttctgccagttcagctcgagcg

SEQ ID NO: 476992 - DNA, 25 bp, Rattus norvegicus
caccacggcaagcaggacgtgatca

SEQ ID NO: 476993 - DNA, 25 bp, Rattus norvegicus
tgcacagacagcaccaaggtcactg

SEQ ID NO: 476994 - DNA, 25 bp, Rattus norvegicus
ttcaagcgcttcaaggcctcgctca

SEQ ID NO: 476995 - DNA, 25 bp, Rattus norvegicus
acaacctggtgctggacgacttcaa

SEQ ID NO: 476996 - DNA, 25 bp, Rattus norvegicus
ccaaaaccatggacgcactgaagga

SEQ ID NO: 476997 - DNA, 25 bp, Rattus norvegicus
aggagccacaccaaaaccatggacg

SEQ ID NO: 476998 - DNA, 25 bp, Rattus norvegicus
gcccggcagaaggagccacaccaaa

SEQ ID NO: 476999 - DNA, 25 bp, Rattus norvegicus
gaagcgccttaacgcgggtctcagc

SEQ ID NO: 477000 - DNA, 25 bp, Rattus norvegicus
cctaggagagagaagcgccttaacg

SEQ ID NO: 477001 - DNA, 25 bp, Rattus norvegicus
cactcctcctgcctaggagagagaa

SEQ ID NO: 477002 - DNA, 25 bp, Rattus norvegicus
gagggcactcctcctgcctaggaga

SEQ ID NO: 477003 - DNA, 25 bp, Rattus norvegicus
agctacacaacagagggcactcctc

SEQ ID NO: 477004 - DNA, 25 bp, Rattus norvegicus
agcgccagctacacaacagagggca

SEQ ID NO: 477005 - DNA, 25 bp, Rattus norvegicus
actgaaggaggaacaggacttacgg

SEQ ID NO: 477006 - DNA, 25 bp, Rattus norvegicus
gaacaggacttacgggcagctcccg

SEQ ID NO: 477007 - DNA, 25 bp, Rattus norvegicus
accatggacgcactgaaggaggaac

SEQ ID NO: 477008 - DNA, 25 bp, Rattus norvegicus
agctcccgcctctggctggacgttg

SEQ ID NO: 477009 - DNA, 25 bp, Rattus norvegicus
tccgagcgccagctacacaacagag

SEQ ID NO: 477010 - DNA, 25 bp, Rattus norvegicus
gtcgagaccccaaccccagaatgtg

SEQ ID NO: 477011 - DNA, 25 bp, Rattus norvegicus
cctgacagtcgcgacggggcagtac

SEQ ID NO: 477012 - DNA, 25 bp, Rattus norvegicus
ggtcgccgtcctactgccaggagcg

SEQ ID NO: 477013 - DNA, 25 bp, Rattus norvegicus
cagggtcgccgtcctactgccagga

SEQ ID NO: 477014 - DNA, 25 bp, Rattus norvegicus
tcagcttcaaggagtcagggtcgcc

SEQ ID NO: 477015 - DNA, 25 bp, Rattus norvegicus
aagtcggaggtcctcagcttcaagg

SEQ ID NO: 477016 - DNA, 25 bp, Rattus norvegicus
cccagaatgtggtgagaggggtcac

SEQ ID NO: 477017 - DNA, 25 bp, Rattus norvegicus
gagggcctgagacccggtcgagacc

SEQ ID NO: 477018 - DNA, 25 bp, Rattus norvegicus
ccctcacctggttcggctgctctgc

SEQ ID NO: 477019 - DNA, 25 bp, Rattus norvegicus
tgacagtcgcgacggggcagtacca

SEQ ID NO: 477020 - DNA, 25 bp, Rattus norvegicus
aggacgccatcttcctcaggcctga

SEQ ID NO: 477021 - DNA, 25 bp, Rattus norvegicus
gccatcttcctcaggcctgactaat

SEQ ID NO: 477022 - DNA, 25 bp, Rattus norvegicus
ttcctcaggcctgactaatcggccg

SEQ ID NO: 477023 - DNA, 25 bp, Rattus norvegicus
aagaaacgaagtcggaggtcctcag

SEQ ID NO: 477024 - DNA, 25 bp, Rattus norvegicus
cggcgtggcagcctccagtctcgag

SEQ ID NO: 477025 - DNA, 25 bp, Rattus norvegicus
aaccgtgtctgcttcgccgcaacca

SEQ ID NO: 477026 - DNA, 25 bp, Rattus norvegicus
gtcgggcctctcaaaccgtgtctgc

SEQ ID NO: 477027 - DNA, 25 bp, Rattus norvegicus
cccggacgatgtcgggcctctcaaa

SEQ ID NO: 477028 - DNA, 25 bp, Rattus norvegicus
ccaagtcccactttgaggatggagc

SEQ ID NO: 477029 - DNA, 25 bp, Rattus norvegicus
ccagagtcgccaagtcccactttga

SEQ ID NO: 477030 - DNA, 25 bp, Rattus norvegicus
tacctgggatttcccagagtcgcca

SEQ ID NO: 477031 - DNA, 25 bp, Rattus norvegicus
ctctgggctacctgggatttcccag

SEQ ID NO: 477032 - DNA, 25 bp, Rattus norvegicus
tggcaaagcttagggaagccgctct

SEQ ID NO: 477033 - DNA, 25 bp, Rattus norvegicus
catctcccgtcaagccgcgagagga

SEQ ID NO: 477034 - DNA, 25 bp, Rattus norvegicus
acttgctgagggaaactacatctcc

SEQ ID NO: 477035 - DNA, 25 bp, Rattus norvegicus
tcgcgtaacttgctgagggaaacta

SEQ ID NO: 477036 - DNA, 25 bp, Rattus norvegicus
gtgccttggtctcgcgtaacttgct

SEQ ID NO: 477037 - DNA, 25 bp, Rattus norvegicus
gcaaccacagccgtgagcagcacgg

SEQ ID NO: 477038 - DNA, 25 bp, Rattus norvegicus
ccagcaccggaagttctgcttcagc

SEQ ID NO: 477039 - DNA, 25 bp, Rattus norvegicus
ggctgcagtcacgtgctcagctccg

SEQ ID NO: 477040 - DNA, 25 bp, Rattus norvegicus
ccttcttccgtacgcaggcgcagtg

SEQ ID NO: 477041 - DNA, 25 bp, Rattus norvegicus
caccctggccgtggcccttctcgga

SEQ ID NO: 477042 - DNA, 25 bp, Rattus norvegicus
tcccggaggctgcagtcacgtgctc

SEQ ID NO: 477043 - DNA, 25 bp, Rattus norvegicus
atggacctccgagccagtgtgacct

SEQ ID NO: 477044 - DNA, 25 bp, Rattus norvegicus
aaggtcatggacctccgagccagtg

SEQ ID NO: 477045 - DNA, 25 bp, Rattus norvegicus
catagacgtgaaggtcatggacctc

SEQ ID NO: 477046 - DNA, 25 bp, Rattus norvegicus
ctgagcgtccgcctcatagacgtga

SEQ ID NO: 477047 - DNA, 25 bp, Rattus norvegicus
ttaggacggtctgagcgtccgcctc

SEQ ID NO: 477048 - DNA, 25 bp, Rattus norvegicus
acgctgcagtagtcaacgcagggct

SEQ ID NO: 477049 - DNA, 25 bp, Rattus norvegicus
gcatacgctgcagtagtcaacgcag

SEQ ID NO: 477050 - DNA, 25 bp, Rattus norvegicus
ccgcctcatagacgtgaaggtcatg

SEQ ID NO: 477051 - DNA, 25 bp, Rattus norvegicus
ggaagttctgcttcagcgtcctgcg

SEQ ID NO: 477052 - DNA, 25 bp, Rattus norvegicus
gccgtctagcgacttggggcatttc

SEQ ID NO: 477053 - DNA, 25 bp, Rattus norvegicus
agtcttgctagcgttggtgtgaccc

SEQ ID NO: 477054 - DNA, 25 bp, Rattus norvegicus
ctcgcggtagagtcttgctagcgtt

SEQ ID NO: 477055 - DNA, 25 bp, Rattus norvegicus
ccctggctacggctcgcggtagagt

SEQ ID NO: 477056 - DNA, 25 bp, Rattus norvegicus
gtcaaagcgcgaagcgcctctttcc

SEQ ID NO: 477057 - DNA, 25 bp, Rattus norvegicus
ccgagggtcaaagcgcgaagcgcct

SEQ ID NO: 477058 - DNA, 25 bp, Rattus norvegicus
cgactttcccgctctacctctgcga

SEQ ID NO: 477059 - DNA, 25 bp, Rattus norvegicus
ccggtgagagtactgctgctgctcc

SEQ ID NO: 477060 - DNA, 25 bp, Rattus norvegicus
ttgtacctgccggtgagagtactgc

SEQ ID NO: 477061 - DNA, 25 bp, Rattus norvegicus
aggaactcgccgtcctaccctgctg

SEQ ID NO: 477062 - DNA, 25 bp, Rattus norvegicus
cacgccgaggccgtctagcgacttg

SEQ ID NO: 477063 - DNA, 25 bp, Rattus norvegicus
ctccttgcagccgagtgacgcatgc

SEQ ID NO: 477064 - DNA, 25 bp, Rattus norvegicus
cgtttattttgtacctgccggtgag

SEQ ID NO: 477065 - DNA, 25 bp, Rattus norvegicus
gcagccgagtgacgcatgcgtgcac

SEQ ID NO: 477066 - DNA, 25 bp, Rattus norvegicus
aggacacgatctctctcgccggtgc

SEQ ID NO: 477067 - DNA, 25 bp, Rattus norvegicus
ggcttactgagacaccggccaatca

SEQ ID NO: 477068 - DNA, 25 bp, Rattus norvegicus
ctcgcagccgcaagcccaagaaggg

SEQ ID NO: 477069 - DNA, 25 bp, Rattus norvegicus
cccaactgcgcgtgtgggtcactca

SEQ ID NO: 477070 - DNA, 25 bp, Rattus norvegicus
acacgaaaagactgagcgctccgga

SEQ ID NO: 477071 - DNA, 25 bp, Rattus norvegicus
agaaagtgctgtgaactccggctcc

SEQ ID NO: 477072 - DNA, 25 bp, Rattus norvegicus
cccggcgcctcaagaggcttactga

SEQ ID NO: 477073 - DNA, 25 bp, Rattus norvegicus
tggggcgatgcccacaccctactgg

SEQ ID NO: 477074 - DNA, 25 bp, Rattus norvegicus
gcagcgcctgttataccacctgagg

SEQ ID NO: 477075 - DNA, 25 bp, Rattus norvegicus
ccagatctgtagagcgccgagtagt

SEQ ID NO: 477076 - DNA, 25 bp, Rattus norvegicus
cgagtagtcgatggcaccttgagca

SEQ ID NO: 477077 - DNA, 25 bp, Rattus norvegicus
gttgtaacggaaccaggacacgatc

SEQ ID NO: 477078 - DNA, 25 bp, Rattus norvegicus
acacagagcggattccttccctcga

SEQ ID NO: 477079 - DNA, 25 bp, Rattus norvegicus
accttgagcaggagaggagcattta

SEQ ID NO: 477080 - DNA, 25 bp, Rattus norvegicus
cgcggaatatgaccaatcgaagtga

SEQ ID NO: 477081 - DNA, 25 bp, Rattus norvegicus
cggctccctcagagctgcaatgtgc

SEQ ID NO: 477082 - DNA, 25 bp, Rattus norvegicus
gtccagagtttccaccctggtgacc

SEQ ID NO: 477083 - DNA, 25 bp, Rattus norvegicus
cgaagccggtgtccagagtttccac

SEQ ID NO: 477084 - DNA, 25 bp, Rattus norvegicus
gagcgacggagacactcgagcgccc

SEQ ID NO: 477085 - DNA, 25 bp, Rattus norvegicus
gtgttgctgggtagcattcgcgcct

SEQ ID NO: 477086 - DNA, 25 bp, Rattus norvegicus
caatgtgcgcacatacggcgggaca

SEQ ID NO: 477087 - DNA, 25 bp, Rattus norvegicus
cagcaaccgagaatgacgcggaata

SEQ ID NO: 477088 - DNA, 25 bp, Rattus norvegicus
agagaagcccggacccgagctgtcg

SEQ ID NO: 477089 - DNA, 25 bp, Rattus norvegicus
gccgcccagctctgcatcgaggatt

SEQ ID NO: 477090 - DNA, 25 bp, Rattus norvegicus
cgagccggccgagtcagaagacgcc

SEQ ID NO: 477091 - DNA, 25 bp, Rattus norvegicus
gatgaccaatagtaaagcgagtctg

SEQ ID NO: 477092 - DNA, 25 bp, Rattus norvegicus
tctctccactgagggcgaggcttct

SEQ ID NO: 477093 - DNA, 25 bp, Rattus norvegicus
agcgaccgatctgctggcccgcgga

SEQ ID NO: 477094 - DNA, 25 bp, Rattus norvegicus
ccggactcaccagccaataagcaga

SEQ ID NO: 477095 - DNA, 25 bp, Rattus norvegicus
gcgggaacggctatactgcacagtg

SEQ ID NO: 477096 - DNA, 25 bp, Rattus norvegicus
tgcgaccctacagcagccaaggcag

SEQ ID NO: 477097 - DNA, 25 bp, Rattus norvegicus
agccaaggcagagcccagcaccgta

SEQ ID NO: 477098 - DNA, 25 bp, Rattus norvegicus
cgcctccacgcaagaaccttggtag

SEQ ID NO: 477099 - DNA, 25 bp, Rattus norvegicus
tggcgaagcgctcgctgtaagcgta

SEQ ID NO: 477100 - DNA, 25 bp, Rattus norvegicus
tcgctgtaagcgtaaaacctcctac

SEQ ID NO: 477101 - DNA, 25 bp, Rattus norvegicus
atctttgaaagggatcacgtgaccc

SEQ ID NO: 477102 - DNA, 25 bp, Rattus norvegicus
agccaataagcagaaggcgtcgcgc

SEQ ID NO: 477103 - DNA, 25 bp, Rattus norvegicus
gcgccgctgatttcctcttcgcttg

SEQ ID NO: 477104 - DNA, 25 bp, Rattus norvegicus
atttcctcttcgcttgcatcctgtc

SEQ ID NO: 477105 - DNA, 25 bp, Rattus norvegicus
ggtaggatgcgccaatccaaagatg

SEQ ID NO: 477106 - DNA, 25 bp, Rattus norvegicus
caatccaaagatggcccttcccggg

SEQ ID NO: 477107 - DNA, 25 bp, Rattus norvegicus
tcatcaaaacaacagggcggccatc

SEQ ID NO: 477108 - DNA, 25 bp, Rattus norvegicus
ctcggtcaccaggtggatgttgctc

SEQ ID NO: 477109 - DNA, 25 bp, Rattus norvegicus
ggcattccggtcttcgctctcagag

SEQ ID NO: 477110 - DNA, 25 bp, Rattus norvegicus
cgctctcagagttgtacagatcatg

SEQ ID NO: 477111 - DNA, 25 bp, Rattus norvegicus
atcatgctcctcaatgtactcttgg

SEQ ID NO: 477112 - DNA, 25 bp, Rattus norvegicus
tactcttggacgaggtccggcacca

SEQ ID NO: 477113 - DNA, 25 bp, Rattus norvegicus
ccggcaccaagtagcggatgctctg

SEQ ID NO: 477114 - DNA, 25 bp, Rattus norvegicus
gtcattggtgatccactcggtcacc

SEQ ID NO: 477115 - DNA, 25 bp, Rattus norvegicus
tgtcgccacagcacgtcggactcgt

SEQ ID NO: 477116 - DNA, 25 bp, Rattus norvegicus
cgtcggactcgtagatgaatttctg

SEQ ID NO: 477117 - DNA, 25 bp, Rattus norvegicus
atttctgagcgtcactgccagcccg

SEQ ID NO: 477118 - DNA, 25 bp, Rattus norvegicus
tcctctgtagaggtgccagggtgac

SEQ ID NO: 477119 - DNA, 25 bp, Rattus norvegicus
atgttgctctggtgtcgccacagca

SEQ ID NO: 477120 - DNA, 25 bp, Rattus norvegicus
tggaatggttgtgtttggcctccga

SEQ ID NO: 477121 - DNA, 25 bp, Rattus norvegicus
ttggcctccgaggtgttcctctgta

SEQ ID NO: 477122 - DNA, 25 bp, Rattus norvegicus
gcggtaaattcctgtcaccgtggga

SEQ ID NO: 477123 - DNA, 25 bp, Rattus norvegicus
ttcctgtcaccgtgggatctgggac

SEQ ID NO: 477124 - DNA, 25 bp, Rattus norvegicus
gggtcaaagtctgcccggtcagctc

SEQ ID NO: 477125 - DNA, 25 bp, Rattus norvegicus
tgaaaccgctggaaccaacctctcg

SEQ ID NO: 477126 - DNA, 25 bp, Rattus norvegicus
tactctaccctcagtgatacgtacc

SEQ ID NO: 477127 - DNA, 25 bp, Rattus norvegicus
ccctgtcgctggtgtaggatgcact

SEQ ID NO: 477128 - DNA, 25 bp, Rattus norvegicus
gaactccgaggcacctgccctagtt

SEQ ID NO: 477129 - DNA, 25 bp, Rattus norvegicus
cctatccggtgtacctgagcgtgga

SEQ ID NO: 477130 - DNA, 25 bp, Rattus norvegicus
ttgccctactctaccctcagtgata

SEQ ID NO: 477131 - DNA, 25 bp, Rattus norvegicus
tcagctccaggggagagtcagcgac

SEQ ID NO: 477132 - DNA, 25 bp, Rattus norvegicus
gtgtaggatgcactccctggcaccc

SEQ ID NO: 477133 - DNA, 25 bp, Rattus norvegicus
acccagatcgcttgtcccaggggtc

SEQ ID NO: 477134 - DNA, 25 bp, Rattus norvegicus
accgagcctggaggggcgctccaac

SEQ ID NO: 477135 - DNA, 25 bp, Rattus norvegicus
agacctgcggttcaccgagcctgga

SEQ ID NO: 477136 - DNA, 25 bp, Rattus norvegicus
ttctcatcagggaggaccgagaagc

SEQ ID NO: 477137 - DNA, 25 bp, Rattus norvegicus
cggtcccaaaggtgcgtctcctagg

SEQ ID NO: 477138 - DNA, 25 bp, Rattus norvegicus
aagtgctcgctccatgtggtccgcc

SEQ ID NO: 477139 - DNA, 25 bp, Rattus norvegicus
cttaccaggccgtgaaggccaaacg

SEQ ID NO: 477140 - DNA, 25 bp, Rattus norvegicus
gggctcctggttccaaattctggga

SEQ ID NO: 477141 - DNA, 25 bp, Rattus norvegicus
ggcgctctcattggtcccacgaagc

SEQ ID NO: 477142 - DNA, 25 bp, Rattus norvegicus
aggaggttgtcctgtttctcatcag

SEQ ID NO: 477143 - DNA, 25 bp, Rattus norvegicus
aagcgtttcgcaggcgtaggactcc

SEQ ID NO: 477144 - DNA, 25 bp, Rattus norvegicus
caaacggccctagtcctccaggaga

SEQ ID NO: 477145 - DNA, 25 bp, Rattus norvegicus
acctcaggtgaccactgggcctgct

SEQ ID NO: 477146 - DNA, 25 bp, Rattus norvegicus
agggaacaccgaagcggcgctctca

SEQ ID NO: 477147 - DNA, 25 bp, Rattus norvegicus
acctgcagaccggagcttggagttc

SEQ ID NO: 477148 - DNA, 25 bp, Rattus norvegicus
gcgcccgagcgtggcagtttatttt

SEQ ID NO: 477149 - DNA, 25 bp, Rattus norvegicus
acgccatagcagaaggaggttgtcc

SEQ ID NO: 477150 - DNA, 25 bp, Rattus norvegicus
tcctggtcccattgccttgtctctt

SEQ ID NO: 477151 - DNA, 25 bp, Rattus norvegicus
agcagcccgccccaaaggtgtgtta

SEQ ID NO: 477152 - DNA, 25 bp, Rattus norvegicus
aggtgtgttaaccaatgcctgttcc

SEQ ID NO: 477153 - DNA, 25 bp, Rattus norvegicus
tcaagtgtacctcccctggggcgtg

SEQ ID NO: 477154 - DNA, 25 bp, Rattus norvegicus
tcccggccgcggtgactcacggaga

SEQ ID NO: 477155 - DNA, 25 bp, Rattus norvegicus
cacccggcgctgctacctcccgccg

SEQ ID NO: 477156 - DNA, 25 bp, Rattus norvegicus
ctcccgccgcagaccaccctgctgc

SEQ ID NO: 477157 - DNA, 25 bp, Rattus norvegicus
caccctgctgccttcctccctttct

SEQ ID NO: 477158 - DNA, 25 bp, Rattus norvegicus
ggggtctcctccacaggtgtcccaa

SEQ ID NO: 477159 - DNA, 25 bp, Rattus norvegicus
gtctcctccacaggtgtcccaattg

SEQ ID NO: 477160 - DNA, 25 bp, Rattus norvegicus
ctctgggcccgcgtgcttgtcatcg

SEQ ID NO: 477161 - DNA, 25 bp, Rattus norvegicus
gtgcttgtcatcgtctgtccaccct

SEQ ID NO: 477162 - DNA, 25 bp, Rattus norvegicus
tggtcccattgccttgtctcttcct

SEQ ID NO: 477163 - DNA, 25 bp, Rattus norvegicus
cgcgtgcttgtcatcgtctgtccac

SEQ ID NO: 477164 - DNA, 25 bp, Rattus norvegicus
agagagctccggagaacctagtcgc

SEQ ID NO: 477165 - DNA, 25 bp, Rattus norvegicus
aggttcaggcgctcagagagagctc

SEQ ID NO: 477166 - DNA, 25 bp, Rattus norvegicus
gctcactacgtgaggttcaggttca

SEQ ID NO: 477167 - DNA, 25 bp, Rattus norvegicus
tgcggaacatcgagcccgctcacta

SEQ ID NO: 477168 - DNA, 25 bp, Rattus norvegicus
attgcccgggctcagtgcggaacat

SEQ ID NO: 477169 - DNA, 25 bp, Rattus norvegicus
cccagtgcaggaatagtgtcagagc

SEQ ID NO: 477170 - DNA, 25 bp, Rattus norvegicus
gcaaatcgtcttcggcaaggttcgg

SEQ ID NO: 477171 - DNA, 25 bp, Rattus norvegicus
ctcggatcctagtgcgcaaatcgtc

SEQ ID NO: 477172 - DNA, 25 bp, Rattus norvegicus
tacgagtgcgcgaatcatattgggc

SEQ ID NO: 477173 - DNA, 25 bp, Rattus norvegicus
cattgtatcaggcaaggttcgggtc

SEQ ID NO: 477174 - DNA, 25 bp, Rattus norvegicus
gggccctagtgcacgcattgtatca

SEQ ID NO: 477175 - DNA, 25 bp, Rattus norvegicus
gcgggtatagtgctgcagtcttgca

SEQ ID NO: 477176 - DNA, 25 bp, Rattus norvegicus
ccataactgggtgcaaggttgggcc

SEQ ID NO: 477177 - DNA, 25 bp, Rattus norvegicus
gcccagatcgtatcaggtgcacgga

SEQ ID NO: 477178 - DNA, 25 bp, Rattus norvegicus
tggagcccacctaccacgggatcgt

SEQ ID NO: 477179 - DNA, 25 bp, Rattus norvegicus
gccttcaaaggcgacagcatctcgg

SEQ ID NO: 477180 - DNA, 25 bp, Rattus norvegicus
cacgggatcgtcaccgagaacgata

SEQ ID NO: 477181 - DNA, 25 bp, Rattus norvegicus
ctcaccgctgcgctttgcaggtacg

SEQ ID NO: 477182 - DNA, 25 bp, Rattus norvegicus
tgcgtgcacacgcactcgtgcggaa

SEQ ID NO: 477183 - DNA, 25 bp, Rattus norvegicus
gccagatgacacagactcgccttca

SEQ ID NO: 477184 - DNA, 25 bp, Rattus norvegicus
ctggacaaagactcaccgctgcgct

SEQ ID NO: 477185 - DNA, 25 bp, Rattus norvegicus
acgataacacggtgctgctcgaccc

SEQ ID NO: 477186 - DNA, 25 bp, Rattus norvegicus
aggcgacagcatctcggtctgaatc

SEQ ID NO: 477187 - DNA, 25 bp, Rattus norvegicus
tcggtctgaatcttacccgtgtttc

SEQ ID NO: 477188 - DNA, 25 bp, Rattus norvegicus
gtgtttcccgttttctcccaatgca

SEQ ID NO: 477189 - DNA, 25 bp, Rattus norvegicus
ccgttttctcccaatgcagttaaca

SEQ ID NO: 477190 - DNA, 25 bp, Rattus norvegicus
gcagttaacaagcacaagccatggc

SEQ ID NO: 477191 - DNA, 25 bp, Rattus norvegicus
cactcgtgcggaaagccagatgaca

SEQ ID NO: 477192 - DNA, 25 bp, Rattus norvegicus
cgaggtttttcggagatgagagcaa

SEQ ID NO: 477193 - DNA, 25 bp, Rattus norvegicus
gcgcactcacctccgcgcaatccgg

SEQ ID NO: 477194 - DNA, 25 bp, Rattus norvegicus
tttttcggagatgagagcaaaggtg

SEQ ID NO: 477195 - DNA, 25 bp, Rattus norvegicus
caaaggtggagacggagaaagcatc

SEQ ID NO: 477196 - DNA, 25 bp, Rattus norvegicus
cggagaaagcatctcgcatccgcga

SEQ ID NO: 477197 - DNA, 25 bp, Rattus norvegicus
tctcgcatccgcgagcaggcctggt

SEQ ID NO: 477198 - DNA, 25 bp, Rattus norvegicus
gcaatccggtagagcaccacgccgg

SEQ ID NO: 477199 - DNA, 25 bp, Rattus norvegicus
atccggtagagcaccacgccggcgg

SEQ ID NO: 477200 - DNA, 25 bp, Rattus norvegicus
gccagcagcgcgctcactccttcca

SEQ ID NO: 477201 - DNA, 25 bp, Rattus norvegicus
actccttccatagcttccgggcgga

SEQ ID NO: 477202 - DNA, 25 bp, Rattus norvegicus
gcgccgtgaccttcgccgctttgta

SEQ ID NO: 477203 - DNA, 25 bp, Rattus norvegicus
cttcgccgctttgtagccggcgcgg

SEQ ID NO: 477204 - DNA, 25 bp, Rattus norvegicus
cgacggaagcgctcagcgctggctc

SEQ ID NO: 477205 - DNA, 25 bp, Rattus norvegicus
cttccatagcttccgggcggagtcg

SEQ ID NO: 477206 - DNA, 25 bp, Rattus norvegicus
cgagatctgcgaccctggttcgaca

SEQ ID NO: 477207 - DNA, 25 bp, Rattus norvegicus
tgatctgaggccctgctcggtggtc

SEQ ID NO: 477208 - DNA, 25 bp, Rattus norvegicus
tggtcagcgcttggcacccgaatat

SEQ ID NO: 477209 - DNA, 25 bp, Rattus norvegicus
ttggcacccgaatatcgtcggccca

SEQ ID NO: 477210 - DNA, 25 bp, Rattus norvegicus
actgtgtgcacatttgtcgttttgc

SEQ ID NO: 477211 - DNA, 25 bp, Rattus norvegicus
cctggttcgacaagtactgtgtgca

SEQ ID NO: 477212 - DNA, 25 bp, Rattus norvegicus
aggccctggtcagtggtcagctccc

SEQ ID NO: 477213 - DNA, 25 bp, Rattus norvegicus
gactcggtgccgagatctgcgaccc

SEQ ID NO: 477214 - DNA, 25 bp, Rattus norvegicus
tgcaaaacggactcgggagagactc

SEQ ID NO: 477215 - DNA, 25 bp, Rattus norvegicus
tgaccactgtgcaaaacggactcgg

SEQ ID NO: 477216 - DNA, 25 bp, Rattus norvegicus
gcggaccgcgctgaccactgtgcaa

SEQ ID NO: 477217 - DNA, 25 bp, Rattus norvegicus
atttctgtgcccttccgtgcggacc

SEQ ID NO: 477218 - DNA, 25 bp, Rattus norvegicus
tgcgtgagttgcgatttctgtgccc

SEQ ID NO: 477219 - DNA, 25 bp, Rattus norvegicus
attttccctgccagccttgggtgtg

SEQ ID NO: 477220 - DNA, 25 bp, Rattus norvegicus
tcaaaaggagaatacggcgagaggc

SEQ ID NO: 477221 - DNA, 25 bp, Rattus norvegicus
aggtctcgaggtccgctggcctcgc

SEQ ID NO: 477222 - DNA, 25 bp, Rattus norvegicus
tccttctgctgagtgtccgtcgcca

SEQ ID NO: 477223 - DNA, 25 bp, Rattus norvegicus
ccagtccgcggcagaagggaaacgc

SEQ ID NO: 477224 - DNA, 25 bp, Rattus norvegicus
ttccagccgctggttagagcccagc

SEQ ID NO: 477225 - DNA, 25 bp, Rattus norvegicus
cagtcacaccagtcaggaattgttc

SEQ ID NO: 477226 - DNA, 25 bp, Rattus norvegicus
ccgcagcgtggtcgggaaaacgcaa

SEQ ID NO: 477227 - DNA, 25 bp, Rattus norvegicus
cgcacctttgaagcggtgagtgacc

SEQ ID NO: 477228 - DNA, 25 bp, Rattus norvegicus
agcgcagtacctcctgcgctagcta

SEQ ID NO: 477229 - DNA, 25 bp, Rattus norvegicus
taaggctctttgacccagcgcagta

SEQ ID NO: 477230 - DNA, 25 bp, Rattus norvegicus
ccggatcccgtacgcctattggacg

SEQ ID NO: 477231 - DNA, 25 bp, Rattus norvegicus
gatgaagcagcgtgttctccttctg

SEQ ID NO: 477232 - DNA, 25 bp, Rattus norvegicus
tgcgacacctgcctaaggctctttg

SEQ ID NO: 477233 - DNA, 25 bp, Rattus norvegicus
ctgtggggacgcagaagccctccac

SEQ ID NO: 477234 - DNA, 25 bp, Rattus norvegicus
tcgcacagtgtcaccaggcggtctc

SEQ ID NO: 477235 - DNA, 25 bp, Rattus norvegicus
gagcgaagtcgcttcctctccgcgg

SEQ ID NO: 477236 - DNA, 25 bp, Rattus norvegicus
gcgactcgtgcgctgagaagaaaaa

SEQ ID NO: 477237 - DNA, 25 bp, Rattus norvegicus
gatttcctgacataacctcggttgc

SEQ ID NO: 477238 - DNA, 25 bp, Rattus norvegicus
aaaagccaccgaccgctctaaagtg

SEQ ID NO: 477239 - DNA, 25 bp, Rattus norvegicus
tgtgaccactgcaaatcagagctcg

SEQ ID NO: 477240 - DNA, 25 bp, Rattus norvegicus
cagagctcgtactggcgggaaaagc

SEQ ID NO: 477241 - DNA, 25 bp, Rattus norvegicus
ctaacttaactcagcagggtcgcga

SEQ ID NO: 477242 - DNA, 25 bp, Rattus norvegicus
cgatgcacggtgcagaaaggatccc

SEQ ID NO: 477243 - DNA, 25 bp, Rattus norvegicus
tgggagtccgcctcagcaaccagaa

SEQ ID NO: 477244 - DNA, 25 bp, Rattus norvegicus
aggctcatcctagtgcgctacagta

SEQ ID NO: 477245 - DNA, 25 bp, Rattus norvegicus
ggggacccaagatcgatcacggctc

SEQ ID NO: 477246 - DNA, 25 bp, Rattus norvegicus
agttcccactgcgtggtggttcccg

SEQ ID NO: 477247 - DNA, 25 bp, Rattus norvegicus
ggctgctcttgtttctctgtttcca

SEQ ID NO: 477248 - DNA, 25 bp, Rattus norvegicus
gctggcgtgtcctaggatgcaaaaa

SEQ ID NO: 477249 - DNA, 25 bp, Rattus norvegicus
cacgttccaggaagcccagggacaa

SEQ ID NO: 477250 - DNA, 25 bp, Rattus norvegicus
ccaggaagcccagggacaagggcac

SEQ ID NO: 477251 - DNA, 25 bp, Rattus norvegicus
tactggcccgccacctaactgcacc

SEQ ID NO: 477252 - DNA, 25 bp, Rattus norvegicus
ggtgacgacgcctttattccgcaga

SEQ ID NO: 477253 - DNA, 25 bp, Rattus norvegicus
gacgcctttattccgcagaaggagg

SEQ ID NO: 477254 - DNA, 25 bp, Rattus norvegicus
cgtgtcctaggatgcaaaaaatgcg

SEQ ID NO: 477255 - DNA, 25 bp, Rattus norvegicus
ggatgcaaaaaatgcgcagcccaga

SEQ ID NO: 477256 - DNA, 25 bp, Rattus norvegicus
aaatgcgcagcccagagcaagcggg

SEQ ID NO: 477257 - DNA, 25 bp, Rattus norvegicus
gtggggtgcagcttacttcatttcg

SEQ ID NO: 477258 - DNA, 25 bp, Rattus norvegicus
agcttacttcatttcgttcgtccgg

SEQ ID NO: 477259 - DNA, 25 bp, Rattus norvegicus
gctctccgcggcacgttccaggaag

SEQ ID NO: 477260 - DNA, 25 bp, Rattus norvegicus
agttctacccgggaagccgcagagg

SEQ ID NO: 477261 - DNA, 25 bp, Rattus norvegicus
tcatttcgttcgtccgggaagtggc

SEQ ID NO: 477262 - DNA, 25 bp, Rattus norvegicus
agcacgtcttcctcactccggggat

SEQ ID NO: 477263 - DNA, 25 bp, Rattus norvegicus
tgcctgactcgcagcccagactcct

SEQ ID NO: 477264 - DNA, 25 bp, Rattus norvegicus
gcagctctcggctccgtacttctgt

SEQ ID NO: 477265 - DNA, 25 bp, Rattus norvegicus
cggctccgtacttctgtctgagtta

SEQ ID NO: 477266 - DNA, 25 bp, Rattus norvegicus
tctgtctgagttagtacaaaagccc

SEQ ID NO: 477267 - DNA, 25 bp, Rattus norvegicus
ctgagttagtacaaaagccctgccc

SEQ ID NO: 477268 - DNA, 25 bp, Rattus norvegicus
taccgagctgggtcgccacaaaatc

SEQ ID NO: 477269 - DNA, 25 bp, Rattus norvegicus
tcccagctcaagagcgccatgcgcc

SEQ ID NO: 477270 - DNA, 25 bp, Rattus norvegicus
ctcactccggggatcagctcacgga

SEQ ID NO: 477271 - DNA, 25 bp, Rattus norvegicus
ccggggatcagctcacggagtttta

SEQ ID NO: 477272 - DNA, 25 bp, Rattus norvegicus
tcagctcacggagttttaaaaccta

SEQ ID NO: 477273 - DNA, 25 bp, Rattus norvegicus
taaaacctaccgagctgggtcgcca

SEQ ID NO: 477274 - DNA, 25 bp, Rattus norvegicus
tgggtcgccacaaaatcccgcagcg

SEQ ID NO: 477275 - DNA, 25 bp, Rattus norvegicus
cactcgtggtctcttgccctgcgct

SEQ ID NO: 477276 - DNA, 25 bp, Rattus norvegicus
gccttctctagtcggttcgcctggt

SEQ ID NO: 477277 - DNA, 25 bp, Rattus norvegicus
tcactgtcgcgcagcagccgatgca

SEQ ID NO: 477278 - DNA, 25 bp, Rattus norvegicus
cccaccttgaagtgcgcgtagtgca

SEQ ID NO: 477279 - DNA, 25 bp, Rattus norvegicus
cggttctggaagtcgcgcagtagct

SEQ ID NO: 477280 - DNA, 25 bp, Rattus norvegicus
gcacgctccaggacgtggccgaaga

SEQ ID NO: 477281 - DNA, 25 bp, Rattus norvegicus
atcaccctcgttgtcgccgtcgggg

SEQ ID NO: 477282 - DNA, 25 bp, Rattus norvegicus
accgcgagcctcacgttctagggaa

SEQ ID NO: 477283 - DNA, 25 bp, Rattus norvegicus
catactgctccagagcgtggccgta

SEQ ID NO: 477284 - DNA, 25 bp, Rattus norvegicus
cgtggccagaggcatcaggtcctcc

SEQ ID NO: 477285 - DNA, 25 bp, Rattus norvegicus
ggggaatcctcggaagctgtacttc

SEQ ID NO: 477286 - DNA, 25 bp, Rattus norvegicus
tgtacttctcatactgcgcgccggc

SEQ ID NO: 477287 - DNA, 25 bp, Rattus norvegicus
ggactccgctctctttcgaacgctg

SEQ ID NO: 477288 - DNA, 25 bp, Rattus norvegicus
tcacgttctagggaaactcgacggc

SEQ ID NO: 477289 - DNA, 25 bp, Rattus norvegicus
cccggagcttctgctgggtcttagc

SEQ ID NO: 477290 - DNA, 25 bp, Rattus norvegicus
cggagatgtggccacaccgaccatc

SEQ ID NO: 477291 - DNA, 25 bp, Rattus norvegicus
tggccacaccgaccatctaaagcga

SEQ ID NO: 477292 - DNA, 25 bp, Rattus norvegicus
ggccaacgcatagaccagcgtgacc

SEQ ID NO: 477293 - DNA, 25 bp, Rattus norvegicus
cccaactccgatgaagcctggctgg

SEQ ID NO: 477294 - DNA, 25 bp, Rattus norvegicus
tgtggccacaccgaccatctaaagc

SEQ ID NO: 477295 - DNA, 25 bp, Rattus norvegicus
tgacggagatgtggccacaccgacc

SEQ ID NO: 477296 - DNA, 25 bp, Rattus norvegicus
caactccgatgaagcctggctggaa

SEQ ID NO: 477297 - DNA, 25 bp, Rattus norvegicus
caggtgacggagatgtggccacacc

SEQ ID NO: 477298 - DNA, 25 bp, Rattus norvegicus
cttttcaggtgacggagatgtggcc

SEQ ID NO: 477299 - DNA, 25 bp, Rattus norvegicus
cactttttcttttcaggtgacggag

SEQ ID NO: 477300 - DNA, 25 bp, Rattus norvegicus
cgctcggcctttcgcccaccttgac

SEQ ID NO: 477301 - DNA, 25 bp, Rattus norvegicus
agtgctcgctggcaccgccctcgcg

SEQ ID NO: 477302 - DNA, 25 bp, Rattus norvegicus
cggcgcccgcagtgctcgctggcac

SEQ ID NO: 477303 - DNA, 25 bp, Rattus norvegicus
cttggccaacgcatagaccagcgtg

SEQ ID NO: 477304 - DNA, 25 bp, Rattus norvegicus
actgtctgcaacccgcgccatagga

SEQ ID NO: 477305 - DNA, 25 bp, Rattus norvegicus
aggtgcgggacccactgtctgcaac

SEQ ID NO: 477306 - DNA, 25 bp, Rattus norvegicus
ctctcgctaggggaagagcagaccg

SEQ ID NO: 477307 - DNA, 25 bp, Rattus norvegicus
actctgagctctcgctaggggaaga

SEQ ID NO: 477308 - DNA, 25 bp, Rattus norvegicus
gcgctgcgcaaactctgagctctcg

SEQ ID NO: 477309 - DNA, 25 bp, Rattus norvegicus
ggaaaagggcgctgcgcaaactctg

SEQ ID NO: 477310 - DNA, 25 bp, Rattus norvegicus
attcttagggtggtgcgccctggaa

SEQ ID NO: 477311 - DNA, 25 bp, Rattus norvegicus
ctttggcctcatcgcggagaggcga

SEQ ID NO: 477312 - DNA, 25 bp, Rattus norvegicus
ccgggtgcatgcgacatcattctta

SEQ ID NO: 477313 - DNA, 25 bp, Rattus norvegicus
gtctccggaaggatagcgatggccc

SEQ ID NO: 477314 - DNA, 25 bp, Rattus norvegicus
ctgcttggtccccttacggtgtttg

SEQ ID NO: 477315 - DNA, 25 bp, Rattus norvegicus
cgccctggaactgggcagcgagcta

SEQ ID NO: 477316 - DNA, 25 bp, Rattus norvegicus
tgcatgcgacatcattcttagggtg

SEQ ID NO: 477317 - DNA, 25 bp, Rattus norvegicus
gacatcattcttagggtggtgcgcc

SEQ ID NO: 477318 - DNA, 25 bp, Rattus norvegicus
agggcgcgctctctactttcgccaa

SEQ ID NO: 477319 - DNA, 25 bp, Rattus norvegicus
tccttcttctggaccgtggccatcg

SEQ ID NO: 477320 - DNA, 25 bp, Rattus norvegicus
gcacttcgtgggattgcgtccttca

SEQ ID NO: 477321 - DNA, 25 bp, Rattus norvegicus
cttctacggagtgctgcaggacttt

SEQ ID NO: 477322 - DNA, 25 bp, Rattus norvegicus
tctcggctgcctcgtacttctacgg

SEQ ID NO: 477323 - DNA, 25 bp, Rattus norvegicus
tgctactcttcctgtcgctggcgga

SEQ ID NO: 477324 - DNA, 25 bp, Rattus norvegicus
gctgtcctgtgtgctgtcagctctg

SEQ ID NO: 477325 - DNA, 25 bp, Rattus norvegicus
ccttgatgcccagacagaggcgacc

SEQ ID NO: 477326 - DNA, 25 bp, Rattus norvegicus
acgccggctgtgtagttgatagact

SEQ ID NO: 477327 - DNA, 25 bp, Rattus norvegicus
gctcgtgaaagggtcacccagcttg

SEQ ID NO: 477328 - DNA, 25 bp, Rattus norvegicus
tcagatcctagtgtgttacggcgcg

SEQ ID NO: 477329 - DNA, 25 bp, Rattus norvegicus
cggagcgatggagcttcagatccta

SEQ ID NO: 477330 - DNA, 25 bp, Rattus norvegicus
caccagggcggagcaatgcacaagt

SEQ ID NO: 477331 - DNA, 25 bp, Rattus norvegicus
tctgcttggtcacgacctctcggca

SEQ ID NO: 477332 - DNA, 25 bp, Rattus norvegicus
gctggcaactcatctccacgatcgt

SEQ ID NO: 477333 - DNA, 25 bp, Rattus norvegicus
caggggtgaaaagcaacgacgtcca

SEQ ID NO: 477334 - DNA, 25 bp, Rattus norvegicus
cagatctacctcagcgcaggggtga

SEQ ID NO: 477335 - DNA, 25 bp, Rattus norvegicus
tttactactacgctgaccagatcta

SEQ ID NO: 477336 - DNA, 25 bp, Rattus norvegicus
ccatggttctcctccagatttacta

SEQ ID NO: 477337 - DNA, 25 bp, Rattus norvegicus
tggccatcctacactcgaggccaaa

SEQ ID NO: 477338 - DNA, 25 bp, Rattus norvegicus
agtgcggcgggccactggccatcct

SEQ ID NO: 477339 - DNA, 25 bp, Rattus norvegicus
tgacgatgattctctcacgtatccc

SEQ ID NO: 477340 - DNA, 25 bp, Rattus norvegicus
caaggcagtgtgagcgaccaggctc

SEQ ID NO: 477341 - DNA, 25 bp, Rattus norvegicus
gatcgtcctcatggccggccagcag

SEQ ID NO: 477342 - DNA, 25 bp, Rattus norvegicus
tccaatatgtgacggctgggactgg

SEQ ID NO: 477343 - DNA, 25 bp, Rattus norvegicus
tctctcacgtatccctgaggggctg

SEQ ID NO: 477344 - DNA, 25 bp, Rattus norvegicus
cagctgtcaggagtgaacgcggtac

SEQ ID NO: 477345 - DNA, 25 bp, Rattus norvegicus
ccaggctctgacactatgacgatga

SEQ ID NO: 477346 - DNA, 25 bp, Rattus norvegicus
acgctcttctcgtggagtgacggca

SEQ ID NO: 477347 - DNA, 25 bp, Rattus norvegicus
tccggtcaattccacgcgggagtga

SEQ ID NO: 477348 - DNA, 25 bp, Rattus norvegicus
taggccgcgcatcaacgtttccaca

SEQ ID NO: 477349 - DNA, 25 bp, Rattus norvegicus
gaaggcccagccctaaaggtcatca

SEQ ID NO: 477350 - DNA, 25 bp, Rattus norvegicus
aaggtcatcagcaaggtcgtgggcc

SEQ ID NO: 477351 - DNA, 25 bp, Rattus norvegicus
gcattccgcctatgcctcaggcagg

SEQ ID NO: 477352 - DNA, 25 bp, Rattus norvegicus
ggcctaacgagcaggctaggaagtc

SEQ ID NO: 477353 - DNA, 25 bp, Rattus norvegicus
tactgccaggtatggtccgtgttcc

SEQ ID NO: 477354 - DNA, 25 bp, Rattus norvegicus
ttgggcacagctcgcctaggaactc

SEQ ID NO: 477355 - DNA, 25 bp, Rattus norvegicus
cctaggaactcctcttggtgacccg

SEQ ID NO: 477356 - DNA, 25 bp, Rattus norvegicus
gcagtcaccaccgagcttcagggtt

SEQ ID NO: 477357 - DNA, 25 bp, Rattus norvegicus
gtacccaagcggacaacagtaaatg

SEQ ID NO: 477358 - DNA, 25 bp, Rattus norvegicus
taaatgcaggccacggataatcgcg

SEQ ID NO: 477359 - DNA, 25 bp, Rattus norvegicus
ccgggctctgtagaccctcagctag

SEQ ID NO: 477360 - DNA, 25 bp, Rattus norvegicus
cctcattccggggtcggggtgctct

SEQ ID NO: 477361 - DNA, 25 bp, Rattus norvegicus
agggtgagaatggagacctgccctc

SEQ ID NO: 477362 - DNA, 25 bp, Rattus norvegicus
tcctattggtccgttctccgcgggc

SEQ ID NO: 477363 - DNA, 25 bp, Rattus norvegicus
gagacctgccctcggggaaccatgg

SEQ ID NO: 477364 - DNA, 25 bp, Rattus norvegicus
aaggtaagtgtccaagttgtccgcg

SEQ ID NO: 477365 - DNA, 25 bp, Rattus norvegicus
cgtcacgtccagacgcaccaatgga

SEQ ID NO: 477366 - DNA, 25 bp, Rattus norvegicus
actgctgaaggcttggcccacccga

SEQ ID NO: 477367 - DNA, 25 bp, Rattus norvegicus
atggtcctgggctcccactgctgaa

SEQ ID NO: 477368 - DNA, 25 bp, Rattus norvegicus
caaaaccagacatggtcctgggctc

SEQ ID NO: 477369 - DNA, 25 bp, Rattus norvegicus
aaaaaacatctaccatcctcctgtg

SEQ ID NO: 477370 - DNA, 25 bp, Rattus norvegicus
tctctcctggttgaagggaaggaaa

SEQ ID NO: 477371 - DNA, 25 bp, Rattus norvegicus
cgcctcgttttctctcctggttgaa

SEQ ID NO: 477372 - DNA, 25 bp, Rattus norvegicus
cctctcattgatggtgtagcgtctg

SEQ ID NO: 477373 - DNA, 25 bp, Rattus norvegicus
aatggagacgctcgatactgcgagg

SEQ ID NO: 477374 - DNA, 25 bp, Rattus norvegicus
ccttgtgctgcgaggcaacccaggt

SEQ ID NO: 477375 - DNA, 25 bp, Rattus norvegicus
cggccttgtgctgcgaggcaaccca

SEQ ID NO: 477376 - DNA, 25 bp, Rattus norvegicus
cccagccgtgcaggcaagtggccgg

SEQ ID NO: 477377 - DNA, 25 bp, Rattus norvegicus
ccaggaggaggactggcccagccgt

SEQ ID NO: 477378 - DNA, 25 bp, Rattus norvegicus
gtttggaggtgcaattcaccgccca

SEQ ID NO: 477379 - DNA, 25 bp, Rattus norvegicus
gtgctgcgaggcaacccaggtctcg

SEQ ID NO: 477380 - DNA, 25 bp, Rattus norvegicus
aggtgcaattcaccgcccagccctg

SEQ ID NO: 477381 - DNA, 25 bp, Rattus norvegicus
tggaggtgcaattcaccgcccagcc

SEQ ID NO: 477382 - DNA, 25 bp, Rattus norvegicus
ctccttttgtttggaggtgcaattc

SEQ ID NO: 477383 - DNA, 25 bp, Rattus norvegicus
cggcctccttttgtttggaggtgca

SEQ ID NO: 477384 - DNA, 25 bp, Rattus norvegicus
tcgagggcccgtgcctgtagcagcc

SEQ ID NO: 477385 - DNA, 25 bp, Rattus norvegicus
atccctagtcgagggcccgtgcctg

SEQ ID NO: 477386 - DNA, 25 bp, Rattus norvegicus
ggcgcatccctagtcgagggcccgt

SEQ ID NO: 477387 - DNA, 25 bp, Rattus norvegicus
cttttgtttggaggtgcaattcacc

SEQ ID NO: 477388 - DNA, 25 bp, Rattus norvegicus
gctgactctacctaagcggcgggcc

SEQ ID NO: 477389 - DNA, 25 bp, Rattus norvegicus
ctcaactccaagcaggggtgccgga

SEQ ID NO: 477390 - DNA, 25 bp, Rattus norvegicus
aactacagcacttccggtaaatagg

SEQ ID NO: 477391 - DNA, 25 bp, Rattus norvegicus
cccagcgcgactgagggaggacacc

SEQ ID NO: 477392 - DNA, 25 bp, Rattus norvegicus
gtcgaaatcaggtcccgaagcctta

SEQ ID NO: 477393 - DNA, 25 bp, Rattus norvegicus
gaagccttacctcagcgcttggatg

SEQ ID NO: 477394 - DNA, 25 bp, Rattus norvegicus
cagcgcttggatgtttaaaagtatc

SEQ ID NO: 477395 - DNA, 25 bp, Rattus norvegicus
atggacgagtccaccgccatgttcg

SEQ ID NO: 477396 - DNA, 25 bp, Rattus norvegicus
cggtaaataggacgccgtcgcctca

SEQ ID NO: 477397 - DNA, 25 bp, Rattus norvegicus
tcgcatcttactaccttgagtcgta

SEQ ID NO: 477398 - DNA, 25 bp, Rattus norvegicus
actacggtgtttgcgatggtccaaa

SEQ ID NO: 477399 - DNA, 25 bp, Rattus norvegicus
tgcgatggtccaaatcccgtcgttc

SEQ ID NO: 477400 - DNA, 25 bp, Rattus norvegicus
aatcccgtcgttctcccgagcggag

SEQ ID NO: 477401 - DNA, 25 bp, Rattus norvegicus
aaaatagcagctccatggacgagtc

SEQ ID NO: 477402 - DNA, 25 bp, Rattus norvegicus
ttgcttttcccgaaacgcgcggcgc

SEQ ID NO: 477403 - DNA, 25 bp, Rattus norvegicus
cttcctgcagcttgtggttcccgga

SEQ ID NO: 477404 - DNA, 25 bp, Rattus norvegicus
ttggttgtttgcaccttcctgcagc

SEQ ID NO: 477405 - DNA, 25 bp, Rattus norvegicus
ttgcaacgcgggctgttggttgttt

SEQ ID NO: 477406 - DNA, 25 bp, Rattus norvegicus
gaaggcatctgcttccgcgggtgaa

SEQ ID NO: 477407 - DNA, 25 bp, Rattus norvegicus
cccgagacacttctgcgaaggcatc

SEQ ID NO: 477408 - DNA, 25 bp, Rattus norvegicus
agagggccatatcagcccgagacac

SEQ ID NO: 477409 - DNA, 25 bp, Rattus norvegicus
agccgggcaaagtgaaagtctgctc

SEQ ID NO: 477410 - DNA, 25 bp, Rattus norvegicus
agctgcgagtcttcatcggatcgga

SEQ ID NO: 477411 - DNA, 25 bp, Rattus norvegicus
ggcctccttacctgtagctgcgagt

SEQ ID NO: 477412 - DNA, 25 bp, Rattus norvegicus
tccgtggtgatcacttgcgaagtgc

SEQ ID NO: 477413 - DNA, 25 bp, Rattus norvegicus
gggtttcgctgcctcactgtgggca

SEQ ID NO: 477414 - DNA, 25 bp, Rattus norvegicus
caagtttggccttgcagtgacctgc

SEQ ID NO: 477415 - DNA, 25 bp, Rattus norvegicus
ggccgccttagctccgattgctttt

SEQ ID NO: 477416 - DNA, 25 bp, Rattus norvegicus
gaaacgcccggtacctgtgcgtcca

SEQ ID NO: 477417 - DNA, 25 bp, Rattus norvegicus
gcgcaaagccgtggaactgggcgga

SEQ ID NO: 477418 - DNA, 25 bp, Rattus norvegicus
cgcaggaggaaacgcccggtacctg

SEQ ID NO: 477419 - DNA, 25 bp, Rattus norvegicus
tcacggctgcatcccgccgcttcgt

SEQ ID NO: 477420 - DNA, 25 bp, Rattus norvegicus
tgacgtcacggctgcatcccgccgc

SEQ ID NO: 477421 - DNA, 25 bp, Rattus norvegicus
cggcagctgcagcatcaccccgcgg

SEQ ID NO: 477422 - DNA, 25 bp, Rattus norvegicus
tcccgggtacagctccgtcccagcc

SEQ ID NO: 477423 - DNA, 25 bp, Rattus norvegicus
tggttctcccgggtacagctccgtc

SEQ ID NO: 477424 - DNA, 25 bp, Rattus norvegicus
tgcgtccagacgggaggcatccctt

SEQ ID NO: 477425 - DNA, 25 bp, Rattus norvegicus
tgtgcgtccagacgggaggcatccc

SEQ ID NO: 477426 - DNA, 25 bp, Rattus norvegicus
cctgtgcgtccagacgggaggcatc

SEQ ID NO: 477427 - DNA, 25 bp, Rattus norvegicus
tacctgtgcgtccagacgggaggca

SEQ ID NO: 477428 - DNA, 25 bp, Rattus norvegicus
cccggtacctgtgcgtccagacggg

SEQ ID NO: 477429 - DNA, 25 bp, Rattus norvegicus
aacgcccggtacctgtgcgtccaga

SEQ ID NO: 477430 - DNA, 25 bp, Rattus norvegicus
taccagttctgagtctcggtgcgac

SEQ ID NO: 477431 - DNA, 25 bp, Rattus norvegicus
ctgagtctcggtgcgactcagcgac

SEQ ID NO: 477432 - DNA, 25 bp, Rattus norvegicus
ccctcaggagacgaggatgccagcg

SEQ ID NO: 477433 - DNA, 25 bp, Rattus norvegicus
acgcaaaggcttcgatagcaccatc

SEQ ID NO: 477434 - DNA, 25 bp, Rattus norvegicus
gcgtcgacgtcacgttgtcggctcg

SEQ ID NO: 477435 - DNA, 25 bp, Rattus norvegicus
tgtcggctcgccttataaatacggg

SEQ ID NO: 477436 - DNA, 25 bp, Rattus norvegicus
ataaatacgggcgtcggctgcgccg

SEQ ID NO: 477437 - DNA, 25 bp, Rattus norvegicus
cgagggcgatcacagcctgcgaaca

SEQ ID NO: 477438 - DNA, 25 bp, Rattus norvegicus
atgcacgggcgagcacacgacacgt

SEQ ID NO: 477439 - DNA, 25 bp, Rattus norvegicus
tccggcccggaaagcttctgcggga

SEQ ID NO: 477440 - DNA, 25 bp, Rattus norvegicus
ggcgagctcggagattgctagtctc

SEQ ID NO: 477441 - DNA, 25 bp, Rattus norvegicus
gattgctagtctctggttggtacca

SEQ ID NO: 477442 - DNA, 25 bp, Rattus norvegicus
agacgaggatgccagcgccacccgg

SEQ ID NO: 477443 - DNA, 25 bp, Rattus norvegicus
agtctctggttggtaccagttctga

SEQ ID NO: 477444 - DNA, 25 bp, Rattus norvegicus
cgagacccaagagaaccgctgactc

SEQ ID NO: 477445 - DNA, 25 bp, Rattus norvegicus
ctcacctgtcgcgagacccaagaga

SEQ ID NO: 477446 - DNA, 25 bp, Rattus norvegicus
aggcgtcgcctctcacaagtcgcgt

SEQ ID NO: 477447 - DNA, 25 bp, Rattus norvegicus
agctcccgccttacagccacactgc

SEQ ID NO: 477448 - DNA, 25 bp, Rattus norvegicus
tgggcggctccgaagacagctcccg

SEQ ID NO: 477449 - DNA, 25 bp, Rattus norvegicus
tggccttacctcctccgccatcgcg

SEQ ID NO: 477450 - DNA, 25 bp, Rattus norvegicus
tgggcaccaggacagctaggcctcc

SEQ ID NO: 477451 - DNA, 25 bp, Rattus norvegicus
tggccttcatcaggctgctcacctg

SEQ ID NO: 477452 - DNA, 25 bp, Rattus norvegicus
gtaggcttgaagagcgcacactcca

SEQ ID NO: 477453 - DNA, 25 bp, Rattus norvegicus
cgcatcaggaccgtggccttcatca

SEQ ID NO: 477454 - DNA, 25 bp, Rattus norvegicus
cgaagggcgctcacgatttcctgca

SEQ ID NO: 477455 - DNA, 25 bp, Rattus norvegicus
aagtcccggtacctgcaggcggtct

SEQ ID NO: 477456 - DNA, 25 bp, Rattus norvegicus
gcacactccagttggcgggaaggcc

SEQ ID NO: 477457 - DNA, 25 bp, Rattus norvegicus
agagaaccgctgactcgagcgccgc

SEQ ID NO: 477458 - DNA, 25 bp, Rattus norvegicus
tcctgggaagagctcgacagtccgc

SEQ ID NO: 477459 - DNA, 25 bp, Rattus norvegicus
gcacacatcggtttccggccgatca

SEQ ID NO: 477460 - DNA, 25 bp, Rattus norvegicus
ttagggaagcacacatcggtttccg

SEQ ID NO: 477461 - DNA, 25 bp, Rattus norvegicus
ttcgctgaggccttagggaagcaca

SEQ ID NO: 477462 - DNA, 25 bp, Rattus norvegicus
tccgctccttcgctgaggccttagg

SEQ ID NO: 477463 - DNA, 25 bp, Rattus norvegicus
aacggacgcgaacccattcaatggc

SEQ ID NO: 477464 - DNA, 25 bp, Rattus norvegicus
tctctgaacggacgcgaacccattc

SEQ ID NO: 477465 - DNA, 25 bp, Rattus norvegicus
tgtcccttcttctctgaacggacgc

SEQ ID NO: 477466 - DNA, 25 bp, Rattus norvegicus
ggcatccgaaaggatccttccagaa

SEQ ID NO: 477467 - DNA, 25 bp, Rattus norvegicus
gatcggggaagaaaggcatccgaaa

SEQ ID NO: 477468 - DNA, 25 bp, Rattus norvegicus
ttaccaccaacgcatccggagaaaa

SEQ ID NO: 477469 - DNA, 25 bp, Rattus norvegicus
ccacaccgagccagccaccatctta

SEQ ID NO: 477470 - DNA, 25 bp, Rattus norvegicus
ggaagagctcgacagtccgcgctcc

SEQ ID NO: 477471 - DNA, 25 bp, Rattus norvegicus
ttccggccgatcacggggccgatca

SEQ ID NO: 477472 - DNA, 25 bp, Rattus norvegicus
ttagccgccactgtgaagcacgttc

SEQ ID NO: 477473 - DNA, 25 bp, Rattus norvegicus
acagaggatactacgcggccgtttt

SEQ ID NO: 477474 - DNA, 25 bp, Rattus norvegicus
tcacgtccggttgagctcaggaccc

SEQ ID NO: 477475 - DNA, 25 bp, Rattus norvegicus
atgaggctgcgcaccctcttgcttc

SEQ ID NO: 477476 - DNA, 25 bp, Rattus norvegicus
gtcgcacagatttgtacacaacacg

SEQ ID NO: 477477 - DNA, 25 bp, Rattus norvegicus
gtacccggctcagtcgcacagattt

SEQ ID NO: 477478 - DNA, 25 bp, Rattus norvegicus
tgcaccgcgaacgagagcagttagc

SEQ ID NO: 477479 - DNA, 25 bp, Rattus norvegicus
cagacagtcccgcaggaacaccgta

SEQ ID NO: 477480 - DNA, 25 bp, Rattus norvegicus
aactgtgctcgccacaacccggagg

SEQ ID NO: 477481 - DNA, 25 bp, Rattus norvegicus
tggttaagccttccagtaactgtgc

SEQ ID NO: 477482 - DNA, 25 bp, Rattus norvegicus
gcggttcccaggcatcaaaactttg

SEQ ID NO: 477483 - DNA, 25 bp, Rattus norvegicus
gcgtgtttttcctgcgcggttccca

SEQ ID NO: 477484 - DNA, 25 bp, Rattus norvegicus
ccaaccaatggtactgagcaccctg

SEQ ID NO: 477485 - DNA, 25 bp, Rattus norvegicus
gtgaagcacgttccgcgtgtttttc

SEQ ID NO: 477486 - DNA, 25 bp, Rattus norvegicus
cccgccggaaatgagtcggctgacc

SEQ ID NO: 477487 - DNA, 25 bp, Rattus norvegicus
gagccctgacctttgaggccgcgct

SEQ ID NO: 477488 - DNA, 25 bp, Rattus norvegicus
ctggcgcaaggggaaaattctgaca

SEQ ID NO: 477489 - DNA, 25 bp, Rattus norvegicus
attctgacacggagatctgtgaggg

SEQ ID NO: 477490 - DNA, 25 bp, Rattus norvegicus
gccgggacgttgtaaagcttctcga

SEQ ID NO: 477491 - DNA, 25 bp, Rattus norvegicus
taaagcttctcgagggttgaccacc

SEQ ID NO: 477492 - DNA, 25 bp, Rattus norvegicus
tcggctgacccgcagagacgcacag

SEQ ID NO: 477493 - DNA, 25 bp, Rattus norvegicus
cgattggctaaacctaaccgtagtg

SEQ ID NO: 477494 - DNA, 25 bp, Rattus norvegicus
ggacttagtgcgcttgcccagcttt

SEQ ID NO: 477495 - DNA, 25 bp, Rattus norvegicus
cccgcacacaacctgatggtatttg

SEQ ID NO: 477496 - DNA, 25 bp, Rattus norvegicus
tatttgggtcgacctctgcggtccc

SEQ ID NO: 477497 - DNA, 25 bp, Rattus norvegicus
aagtactgcgaccttgtggacgtcc

SEQ ID NO: 477498 - DNA, 25 bp, Rattus norvegicus
cacgaaaggtcaggtcggcgcgacc

SEQ ID NO: 477499 - DNA, 25 bp, Rattus norvegicus
cggcgccgtcgattggctaaaccta

SEQ ID NO: 477500 - DNA, 25 bp, Rattus norvegicus
cacgggcttgaatccttctgcggtc

SEQ ID NO: 477501 - DNA, 25 bp, Rattus norvegicus
ttgaatccttctgcggtcacgtgag

SEQ ID NO: 477502 - DNA, 25 bp, Rattus norvegicus
gtcaacatagttctgctcttccttc

SEQ ID NO: 477503 - DNA, 25 bp, Rattus norvegicus
tctcccggaacctgtcaacatagtt

SEQ ID NO: 477504 - DNA, 25 bp, Rattus norvegicus
gcgaggtcaggatcttctcccggaa

SEQ ID NO: 477505 - DNA, 25 bp, Rattus norvegicus
agataacagccgtagggcgaggtca

SEQ ID NO: 477506 - DNA, 25 bp, Rattus norvegicus
cttcttgctgaagataacagccgta

SEQ ID NO: 477507 - DNA, 25 bp, Rattus norvegicus
ggcatggttcctgccttcttgctga

SEQ ID NO: 477508 - DNA, 25 bp, Rattus norvegicus
acgacgcaggcgtacttggcatggt

SEQ ID NO: 477509 - DNA, 25 bp, Rattus norvegicus
atgtagctacctccgacgacgcagg

SEQ ID NO: 477510 - DNA, 25 bp, Rattus norvegicus
ggcgtacactgaatgtagctacctc

SEQ ID NO: 477511 - DNA, 25 bp, Rattus norvegicus
cgtaaggatgtaaggggcgtacact

SEQ ID NO: 477512 - DNA, 25 bp, Rattus norvegicus
tcttccttctgcgtgtgcgcggaga

SEQ ID NO: 477513 - DNA, 25 bp, Rattus norvegicus
cctgtgcgtgagtcatggtaacgta

SEQ ID NO: 477514 - DNA, 25 bp, Rattus norvegicus
ttcgggaaagactggtcgccgacca

SEQ ID NO: 477515 - DNA, 25 bp, Rattus norvegicus
ggggcacttttctcctcagcatgtc

SEQ ID NO: 477516 - DNA, 25 bp, Rattus norvegicus
ccacagaatctgctcgggtgacgag

SEQ ID NO: 477517 - DNA, 25 bp, Rattus norvegicus
gggtgacgagctacatcgacagttc

SEQ ID NO: 477518 - DNA, 25 bp, Rattus norvegicus
atcgacagttcgacgccggaagccg

SEQ ID NO: 477519 - DNA, 25 bp, Rattus norvegicus
gcgttcagccggcaacaacttttcc

SEQ ID NO: 477520 - DNA, 25 bp, Rattus norvegicus
ttccacggtcagtgctgggaagccg

SEQ ID NO: 477521 - DNA, 25 bp, Rattus norvegicus
agccggcgagcatccagaaacacct

SEQ ID NO: 477522 - DNA, 25 bp, Rattus norvegicus
aaacacctcagagcgcaacgtccgg

SEQ ID NO: 477523 - DNA, 25 bp, Rattus norvegicus
taccggccatgcgagctcccattgg

SEQ ID NO: 477524 - DNA, 25 bp, Rattus norvegicus
ggtgcaaaggctctggagtacctta

SEQ ID NO: 477525 - DNA, 25 bp, Rattus norvegicus
ccttacataactcacgggtcgggca

SEQ ID NO: 477526 - DNA, 25 bp, Rattus norvegicus
cgcaagcctcctgctgggtttttcc

SEQ ID NO: 477527 - DNA, 25 bp, Rattus norvegicus
cacgctcatctgaggggcacttttc

SEQ ID NO: 477528 - DNA, 25 bp, Rattus norvegicus
aacgctggtctaccatgggctgggc

SEQ ID NO: 477529 - DNA, 25 bp, Rattus norvegicus
ttacatgggctgtaacctccgggct

SEQ ID NO: 477530 - DNA, 25 bp, Rattus norvegicus
ctagcagcgcgagagctcctctgag

SEQ ID NO: 477531 - DNA, 25 bp, Rattus norvegicus
accttccgctgccaaggtgcgctag

SEQ ID NO: 477532 - DNA, 25 bp, Rattus norvegicus
gaagtagcgcccacgctgacgagtg

SEQ ID NO: 477533 - DNA, 25 bp, Rattus norvegicus
aacctccgggctgaccagagtagga

SEQ ID NO: 477534 - DNA, 25 bp, Rattus norvegicus
accggaaccggcgatgcgctctcag

SEQ ID NO: 477535 - DNA, 25 bp, Rattus norvegicus
acttgcgctgcaggcaaccgaggct

SEQ ID NO: 477536 - DNA, 25 bp, Rattus norvegicus
cgtcactcacattttggcggcggcg

SEQ ID NO: 477537 - DNA, 25 bp, Rattus norvegicus
gcagcgcagcgcgtcactcacattt

SEQ ID NO: 477538 - DNA, 25 bp, Rattus norvegicus
actcgagtccgagtgccgagcagca

SEQ ID NO: 477539 - DNA, 25 bp, Rattus norvegicus
gcgaggcctccactcgagtccgagt

SEQ ID NO: 477540 - DNA, 25 bp, Rattus norvegicus
tctgaggacgccaaacgctggtcta

SEQ ID NO: 477541 - DNA, 25 bp, Rattus norvegicus
ccagagcttgcgctgaagtagcgcc

SEQ ID NO: 477542 - DNA, 25 bp, Rattus norvegicus
ctcgacctggcgattcccaaaggca

SEQ ID NO: 477543 - DNA, 25 bp, Rattus norvegicus
gggcaagttccgagatgacagcctc

SEQ ID NO: 477544 - DNA, 25 bp, Rattus norvegicus
tgacagcctcgtgaatctgtacctg

SEQ ID NO: 477545 - DNA, 25 bp, Rattus norvegicus
tctgtacctggattggtgctcgcga

SEQ ID NO: 477546 - DNA, 25 bp, Rattus norvegicus
attggtgctcgcgatgacggtgacc

SEQ ID NO: 477547 - DNA, 25 bp, Rattus norvegicus
cccttgggtatttccggagagctca

SEQ ID NO: 477548 - DNA, 25 bp, Rattus norvegicus
tatttccggagagctcacggcctcc

SEQ ID NO: 477549 - DNA, 25 bp, Rattus norvegicus
ccactgggccatccagctgtctgtg

SEQ ID NO: 477550 - DNA, 25 bp, Rattus norvegicus
tccagctgtctgtgcttggctcttc

SEQ ID NO: 477551 - DNA, 25 bp, Rattus norvegicus
cttggctcttcgctcggggcgcagt

SEQ ID NO: 477552 - DNA, 25 bp, Rattus norvegicus
agacactctgctaacttcacgtggc

SEQ ID NO: 477553 - DNA, 25 bp, Rattus norvegicus
tggcgattcccaaaggcagccgtcc

SEQ ID NO: 477554 - DNA, 25 bp, Rattus norvegicus
aaaggcagccgtcccagagagtcgg

SEQ ID NO: 477555 - DNA, 25 bp, Rattus norvegicus
agctgggcctgctcgtctctctgca

SEQ ID NO: 477556 - DNA, 25 bp, Rattus norvegicus
cctcccggcgggagcgctgacgtca

SEQ ID NO: 477557 - DNA, 25 bp, Rattus norvegicus
gaccgacggcaaacgcccacccagc

SEQ ID NO: 477558 - DNA, 25 bp, Rattus norvegicus
agcaggcattgtccggaccgacggc

SEQ ID NO: 477559 - DNA, 25 bp, Rattus norvegicus
attgcagcaggcagcaggcattgtc

SEQ ID NO: 477560 - DNA, 25 bp, Rattus norvegicus
caagcattgcagcaggcagcaggca

SEQ ID NO: 477561 - DNA, 25 bp, Rattus norvegicus
caggcggcaagcattgcagcaggca

SEQ ID NO: 477562 - DNA, 25 bp, Rattus norvegicus
aacccgcatcggcaggcggcaagca

SEQ ID NO: 477563 - DNA, 25 bp, Rattus norvegicus
ttagactgcggaacccgcatcggca

SEQ ID NO: 477564 - DNA, 25 bp, Rattus norvegicus
acagccttagactgcggaacccgca

SEQ ID NO: 477565 - DNA, 25 bp, Rattus norvegicus
acatcacacagccttagactgcgga

SEQ ID NO: 477566 - DNA, 25 bp, Rattus norvegicus
ggcggcactgccagcggacatcaca

SEQ ID NO: 477567 - DNA, 25 bp, Rattus norvegicus
ccgcggaggcttcaggaggcggcac

SEQ ID NO: 477568 - DNA, 25 bp, Rattus norvegicus
ctgccgggcgcgctataaacggcgg

SEQ ID NO: 477569 - DNA, 25 bp, Rattus norvegicus
gctgacgtcacggaaaagccccgtc

SEQ ID NO: 477570 - DNA, 25 bp, Rattus norvegicus
cagccaggtgtaagagggtcattcc

SEQ ID NO: 477571 - DNA, 25 bp, Rattus norvegicus
gtacgcgttatatccggggccacag

SEQ ID NO: 477572 - DNA, 25 bp, Rattus norvegicus
ggtcattccacggaacgtcttcgaa

SEQ ID NO: 477573 - DNA, 25 bp, Rattus norvegicus
cgtcttcgaatggatcagatgcttg

SEQ ID NO: 477574 - DNA, 25 bp, Rattus norvegicus
atcagatgcttggacttggcccagc

SEQ ID NO: 477575 - DNA, 25 bp, Rattus norvegicus
cttggcccagcaggttctgttcatc

SEQ ID NO: 477576 - DNA, 25 bp, Rattus norvegicus
gcaggttctgttcatcatcttctca

SEQ ID NO: 477577 - DNA, 25 bp, Rattus norvegicus
cggccttaccgccacttgatgaggg

SEQ ID NO: 477578 - DNA, 25 bp, Rattus norvegicus
atggctgaggcctttgcgccgcccg

SEQ ID NO: 477579 - DNA, 25 bp, Rattus norvegicus
gttcatcatcttctcacagacgaca

SEQ ID NO: 477580 - DNA, 25 bp, Rattus norvegicus
gacgacaaccacacggctctcgaag

SEQ ID NO: 477581 - DNA, 25 bp, Rattus norvegicus
ggcgccagatgcacactgcgtcatg

SEQ ID NO: 477582 - DNA, 25 bp, Rattus norvegicus
ctgcgtcatgagaaggtacgcgtta

SEQ ID NO: 477583 - DNA, 25 bp, Rattus norvegicus
cgccacttgatgagggtctggatca

SEQ ID NO: 477584 - DNA, 25 bp, Rattus norvegicus
cggtctccgtcgtacgcagtagaca

SEQ ID NO: 477585 - DNA, 25 bp, Rattus norvegicus
ggactgaccttgacccgggcagtaa

SEQ ID NO: 477586 - DNA, 25 bp, Rattus norvegicus
cgggcagtaagcctgttctgtatac

SEQ ID NO: 477587 - DNA, 25 bp, Rattus norvegicus
tgtatacgccaaacagacacgttta

SEQ ID NO: 477588 - DNA, 25 bp, Rattus norvegicus
acacgtttagagagactcggaaatc

SEQ ID NO: 477589 - DNA, 25 bp, Rattus norvegicus
ctcggaaatcatcagccagtgacta

SEQ ID NO: 477590 - DNA, 25 bp, Rattus norvegicus
ccagtgactaagcagggaacgtttc

SEQ ID NO: 477591 - DNA, 25 bp, Rattus norvegicus
cagcgagaatacttcacggtagttg

SEQ ID NO: 477592 - DNA, 25 bp, Rattus norvegicus
agctaaacacgcaaggcccggtctc

SEQ ID NO: 477593 - DNA, 25 bp, Rattus norvegicus
cgtacgcagtagacaccatcattta

SEQ ID NO: 477594 - DNA, 25 bp, Rattus norvegicus
ccatcatttattggagggacaattt

SEQ ID NO: 477595 - DNA, 25 bp, Rattus norvegicus
cttcacggtagttgtggctgacgtt

SEQ ID NO: 477596 - DNA, 25 bp, Rattus norvegicus
gggaacgtttccagctaaacacgca

SEQ ID NO: 477597 - DNA, 25 bp, Rattus norvegicus
gggacaatttaagtcagcgagaata

SEQ ID NO: 477598 - DNA, 25 bp, Rattus norvegicus
tacgcggctgcactacctacttagc

SEQ ID NO: 477599 - DNA, 25 bp, Rattus norvegicus
cggctgcactacctacttagctttg

SEQ ID NO: 477600 - DNA, 25 bp, Rattus norvegicus
gcactacctacttagctttgctgag

SEQ ID NO: 477601 - DNA, 25 bp, Rattus norvegicus
ttagctttgctgagctgcctggcct

SEQ ID NO: 477602 - DNA, 25 bp, Rattus norvegicus
tgcctggcctgctgtagacttacct

SEQ ID NO: 477603 - DNA, 25 bp, Rattus norvegicus
cctggcctgctgtagacttacctgg

SEQ ID NO: 477604 - DNA, 25 bp, Rattus norvegicus
ggctgcgctgcctgagctgctgaca

SEQ ID NO: 477605 - DNA, 25 bp, Rattus norvegicus
ggcctgctgtagacttacctggctg

SEQ ID NO: 477606 - DNA, 25 bp, Rattus norvegicus
gacttacctggctgcgtagcttgcc

SEQ ID NO: 477607 - DNA, 25 bp, Rattus norvegicus
tacctggctgcgtagcttgcctgac

SEQ ID NO: 477608 - DNA, 25 bp, Rattus norvegicus
ggctgcgtagcttgcctgaccggct

SEQ ID NO: 477609 - DNA, 25 bp, Rattus norvegicus
ctgcgctctgccctacgcggctgca

SEQ ID NO: 477610 - DNA, 25 bp, Rattus norvegicus
ctgcgccgcctgcacgcgcgagcag

SEQ ID NO: 477611 - DNA, 25 bp, Rattus norvegicus
tagcttgcctgaccggctgcgctgg

SEQ ID NO: 477612 - DNA, 25 bp, Rattus norvegicus
tcaccgtcgcgcctataaagacaca

SEQ ID NO: 477613 - DNA, 25 bp, Rattus norvegicus
taaacacgggcctcgcgccagcgat

SEQ ID NO: 477614 - DNA, 25 bp, Rattus norvegicus
tagcgcacgtaaacacactccgtct

SEQ ID NO: 477615 - DNA, 25 bp, Rattus norvegicus
tcgctccagaaacacagctcggttc

SEQ ID NO: 477616 - DNA, 25 bp, Rattus norvegicus
aaagcacgcgcgtctcacacgcagt

SEQ ID NO: 477617 - DNA, 25 bp, Rattus norvegicus
ccagggttcactcgcgccataaaca

SEQ ID NO: 477618 - DNA, 25 bp, Rattus norvegicus
agacacaacccgaacggccttgctt

SEQ ID NO: 477619 - DNA, 25 bp, Rattus norvegicus
cgttccagaatcacgcgtgcctaaa

SEQ ID NO: 477620 - DNA, 25 bp, Rattus norvegicus
gcgtgcctaaacctagcttctccga

SEQ ID NO: 477621 - DNA, 25 bp, Rattus norvegicus
acactcactgggacgtgggagcaca

SEQ ID NO: 477622 - DNA, 25 bp, Rattus norvegicus
ggagcacagtcacccttggtccgtc

SEQ ID NO: 477623 - DNA, 25 bp, Rattus norvegicus
ccgcgaggaccaatcgaagtaagct

SEQ ID NO: 477624 - DNA, 25 bp, Rattus norvegicus
cgaagtaagctacgtcacctggagc

SEQ ID NO: 477625 - DNA, 25 bp, Rattus norvegicus
tcaaacctacttgctgctgcgaccg

SEQ ID NO: 477626 - DNA, 25 bp, Rattus norvegicus
gcttttgcgccttccctgccaggaa

SEQ ID NO: 477627 - DNA, 25 bp, Rattus norvegicus
acctggccttgaatctggtaaacaa

SEQ ID NO: 477628 - DNA, 25 bp, Rattus norvegicus
cgcgtagcagacaagactgagcatt

SEQ ID NO: 477629 - DNA, 25 bp, Rattus norvegicus
agggacaaagactgcggctaggaca

SEQ ID NO: 477630 - DNA, 25 bp, Rattus norvegicus
ccttgtgcgcgcaaatgctctgcga

SEQ ID NO: 477631 - DNA, 25 bp, Rattus norvegicus
tgctctgcgattcaggaccaggcgc

SEQ ID NO: 477632 - DNA, 25 bp, Rattus norvegicus
tccattgttttaaagcggcaaaggc

SEQ ID NO: 477633 - DNA, 25 bp, Rattus norvegicus
aggctgaaattaccgtcctcatatg

SEQ ID NO: 477634 - DNA, 25 bp, Rattus norvegicus
tgtaatgtgtgcatagcgtgcgcgc

SEQ ID NO: 477635 - DNA, 25 bp, Rattus norvegicus
ccagcccacaatcgcagtgcttttg

SEQ ID NO: 477636 - DNA, 25 bp, Rattus norvegicus
cggcagtcagcgtgcactggaaccc

SEQ ID NO: 477637 - DNA, 25 bp, Rattus norvegicus
acgagacccgcgtcaccagctattg

SEQ ID NO: 477638 - DNA, 25 bp, Rattus norvegicus
tcaccagctattgcgcgaaaagacc

SEQ ID NO: 477639 - DNA, 25 bp, Rattus norvegicus
tgccaggaaggacagcaaaactacc

SEQ ID NO: 477640 - DNA, 25 bp, Rattus norvegicus
aatcttccggccaccgtcaagggtg

SEQ ID NO: 477641 - DNA, 25 bp, Rattus norvegicus
acgtctggccctgctttgggttatt

SEQ ID NO: 477642 - DNA, 25 bp, Rattus norvegicus
gccctgctttgggttattgaggaaa

SEQ ID NO: 477643 - DNA, 25 bp, Rattus norvegicus
tgctaaccatttcggctttcaggcc

SEQ ID NO: 477644 - DNA, 25 bp, Rattus norvegicus
atggcggtctctggaatcttccggc

SEQ ID NO: 477645 - DNA, 25 bp, Rattus norvegicus
gttattgaggaaacagtcggggtca

SEQ ID NO: 477646 - DNA, 25 bp, Rattus norvegicus
ggagaggaccaactcttcggacaca

SEQ ID NO: 477647 - DNA, 25 bp, Rattus norvegicus
tcttcggacacattcgcgggcagca

SEQ ID NO: 477648 - DNA, 25 bp, Rattus norvegicus
acattcgcgggcagcatggacaggc

SEQ ID NO: 477649 - DNA, 25 bp, Rattus norvegicus
atggacaggctgtccgagctgcccg

SEQ ID NO: 477650 - DNA, 25 bp, Rattus norvegicus
aacagtcggggtcaaagttcatggc

SEQ ID NO: 477651 - DNA, 25 bp, Rattus norvegicus
gggtcaaagttcatggcggtctctg

SEQ ID NO: 477652 - DNA, 25 bp, Rattus norvegicus
gccggatattggtgctaaccatttc

SEQ ID NO: 477653 - DNA, 25 bp, Rattus norvegicus
cgagtgccggatattggtgctaacc

SEQ ID NO: 477654 - DNA, 25 bp, Rattus norvegicus
ggacggtgataaataaacgtgaagc

SEQ ID NO: 477655 - DNA, 25 bp, Rattus norvegicus
cttctgtggttcatcgatgctcgga

SEQ ID NO: 477656 - DNA, 25 bp, Rattus norvegicus
gtgtctccgttttgctgactttgga

SEQ ID NO: 477657 - DNA, 25 bp, Rattus norvegicus
taacgacttctgtggttcatcgatg

SEQ ID NO: 477658 - DNA, 25 bp, Rattus norvegicus
cgagcgcggagaatgataacgactt

SEQ ID NO: 477659 - DNA, 25 bp, Rattus norvegicus
tcgttaacacgccagcgagcgcgga

SEQ ID NO: 477660 - DNA, 25 bp, Rattus norvegicus
ctaattatcaccattccgaggcgtc

SEQ ID NO: 477661 - DNA, 25 bp, Rattus norvegicus
gaaatggtgcttcgtctaattatca

SEQ ID NO: 477662 - DNA, 25 bp, Rattus norvegicus
gtggtgcgaaatggtgcttcgtcta

SEQ ID NO: 477663 - DNA, 25 bp, Rattus norvegicus
aataaacgtgaagcacgcgggcggt

SEQ ID NO: 477664 - DNA, 25 bp, Rattus norvegicus
atcgatgctcggatttgccatccta

SEQ ID NO: 477665 - DNA, 25 bp, Rattus norvegicus
ctgactttggagaaaaggacggtga

SEQ ID NO: 477666 - DNA, 25 bp, Rattus norvegicus
tcaccattccgaggcgtcgttaaca

SEQ ID NO: 477667 - DNA, 25 bp, Rattus norvegicus
tttgccatcctaagccctgggcgca

SEQ ID NO: 477668 - DNA, 25 bp, Rattus norvegicus
gcgcagccttggtggttcccagcgc

SEQ ID NO: 477669 - DNA, 25 bp, Rattus norvegicus
tgtccctgcgacctcgcacatgcgc

SEQ ID NO: 477670 - DNA, 25 bp, Rattus norvegicus
ctgtgtccctgcgacctcgcatgcg

SEQ ID NO: 477671 - DNA, 25 bp, Rattus norvegicus
tgcgacctcgcatgcgcagccttgg

SEQ ID NO: 477672 - DNA, 25 bp, Rattus norvegicus
ctcgcatgcgcagccttggtggttc

SEQ ID NO: 477673 - DNA, 25 bp, Rattus norvegicus
gcatgcgcagccttggtggttccca

SEQ ID NO: 477674 - DNA, 25 bp, Rattus norvegicus
atgcgcagccttggtggttcccagc

SEQ ID NO: 477675 - DNA, 25 bp, Rattus norvegicus
gcctgtgtccctgcgacctcgcatg

SEQ ID NO: 477676 - DNA, 25 bp, Rattus norvegicus
gcgacctcgcatgcgcagccttggt

SEQ ID NO: 477677 - DNA, 25 bp, Rattus norvegicus
acctcgcatgcgcagccttggtggt

SEQ ID NO: 477678 - DNA, 25 bp, Rattus norvegicus
tgcgcagccttggtggttcccagcg

SEQ ID NO: 477679 - DNA, 25 bp, Rattus norvegicus
gcctgtgtccctgcgacctcgcaca

SEQ ID NO: 477680 - DNA, 25 bp, Rattus norvegicus
ctgtgtccctgcgacctcgcacatg

SEQ ID NO: 477681 - DNA, 25 bp, Rattus norvegicus
cctcgcatgcgcagccttggtggtt

SEQ ID NO: 477682 - DNA, 25 bp, Rattus norvegicus
acggaatatttcctcgaggccgaga

SEQ ID NO: 477683 - DNA, 25 bp, Rattus norvegicus
gccgatgagtcataggtgcctgtcc

SEQ ID NO: 477684 - DNA, 25 bp, Rattus norvegicus
tcacgttgcccatgtgaccggcgga

SEQ ID NO: 477685 - DNA, 25 bp, Rattus norvegicus
ctagcaaggggatacgtaaggcacc

SEQ ID NO: 477686 - DNA, 25 bp, Rattus norvegicus
ccgagacgtggtgttttgattggac

SEQ ID NO: 477687 - DNA, 25 bp, Rattus norvegicus
cgcccaatggatagcgcgtctgtca

SEQ ID NO: 477688 - DNA, 25 bp, Rattus norvegicus
cggcccaatcaggatgagtctgaca

SEQ ID NO: 477689 - DNA, 25 bp, Rattus norvegicus
cagaggtcgaaagaacggcccaatc

SEQ ID NO: 477690 - DNA, 25 bp, Rattus norvegicus
caaagcttcctagtggccagaggtc

SEQ ID NO: 477691 - DNA, 25 bp, Rattus norvegicus
cgactaaagtgattggcctggaata

SEQ ID NO: 477692 - DNA, 25 bp, Rattus norvegicus
tgatcaccaccgcaccgactaaagt

SEQ ID NO: 477693 - DNA, 25 bp, Rattus norvegicus
actactctccgggaggagcgtccta

SEQ ID NO: 477694 - DNA, 25 bp, Rattus norvegicus
cgcgtctgtcagtcatcgtttccac

SEQ ID NO: 477695 - DNA, 25 bp, Rattus norvegicus
tacagtgtttcccaagccgtccaga

SEQ ID NO: 477696 - DNA, 25 bp, Rattus norvegicus
ttagggttatcgtcctgagacagca

SEQ ID NO: 477697 - DNA, 25 bp, Rattus norvegicus
tattactcactgctgaacgtgcgca

SEQ ID NO: 477698 - DNA, 25 bp, Rattus norvegicus
cccggctcaatggttctggacggtc

SEQ ID NO: 477699 - DNA, 25 bp, Rattus norvegicus
cactcctgccatagactaggggtta

SEQ ID NO: 477700 - DNA, 25 bp, Rattus norvegicus
tacccgcacaggctagcgtttcgtg

SEQ ID NO: 477701 - DNA, 25 bp, Rattus norvegicus
cccttgagcctttgcccagaaatta

SEQ ID NO: 477702 - DNA, 25 bp, Rattus norvegicus
cccagaaattagagagcaggacctc

SEQ ID NO: 477703 - DNA, 25 bp, Rattus norvegicus
gcaccagcgctctgactaggcttcg

SEQ ID NO: 477704 - DNA, 25 bp, Rattus norvegicus
taggcttcggcatcccagtcaagtg

SEQ ID NO: 477705 - DNA, 25 bp, Rattus norvegicus
cgacgcggtctcctcgagaataaaa

SEQ ID NO: 477706 - DNA, 25 bp, Rattus norvegicus
ggtcaagcctctccagggctcagtc

SEQ ID NO: 477707 - DNA, 25 bp, Rattus norvegicus
tctgatgctaccgaagccgagttta

SEQ ID NO: 477708 - DNA, 25 bp, Rattus norvegicus
acccgcactgtctggcacgtgtata

SEQ ID NO: 477709 - DNA, 25 bp, Rattus norvegicus
gggctcagtcggacctctcaatctc

SEQ ID NO: 477710 - DNA, 25 bp, Rattus norvegicus
tgctgtagcggttgcagcattgccg

SEQ ID NO: 477711 - DNA, 25 bp, Rattus norvegicus
gccgggccgcgcaagacttcggcat

SEQ ID NO: 477712 - DNA, 25 bp, Rattus norvegicus
caagacttcggcatctcggagatgg

SEQ ID NO: 477713 - DNA, 25 bp, Rattus norvegicus
tcctgcggctgctgtagcggttgca

SEQ ID NO: 477714 - DNA, 25 bp, Rattus norvegicus
cgagctttccgtggagtgggctccc

SEQ ID NO: 477715 - DNA, 25 bp, Rattus norvegicus
tcacgcccatctagttcgcactgag

SEQ ID NO: 477716 - DNA, 25 bp, Rattus norvegicus
ccggtgaactgaggcccgcgagctt

SEQ ID NO: 477717 - DNA, 25 bp, Rattus norvegicus
agtcctggtccacctcgcccgcaaa

SEQ ID NO: 477718 - DNA, 25 bp, Rattus norvegicus
agcacctactgcttccaggcgagga

SEQ ID NO: 477719 - DNA, 25 bp, Rattus norvegicus
tctagttcgcactgagcacctactg

SEQ ID NO: 477720 - DNA, 25 bp, Rattus norvegicus
gcatctcggagatgggcccactgcc

SEQ ID NO: 477721 - DNA, 25 bp, Rattus norvegicus
ccctcaaaaagatggcggctccgcg

SEQ ID NO: 477722 - DNA, 25 bp, Rattus norvegicus
agagcagggacacgaccagacacca

SEQ ID NO: 477723 - DNA, 25 bp, Rattus norvegicus
tcccatccctcaccggtgaaaggtg

SEQ ID NO: 477724 - DNA, 25 bp, Rattus norvegicus
gccgtcggtccggacaatgcctgct

SEQ ID NO: 477725 - DNA, 25 bp, Rattus norvegicus
aatgcttgccgcctgccgatgcggg

SEQ ID NO: 477726 - DNA, 25 bp, Rattus norvegicus
tcggtccggacaatgcctgctgcct

SEQ ID NO: 477727 - DNA, 25 bp, Rattus norvegicus
cggacaatgcctgctgcctgctgca

SEQ ID NO: 477728 - DNA, 25 bp, Rattus norvegicus
tgctgcctgctgcaatgcttgccgc

SEQ ID NO: 477729 - DNA, 25 bp, Rattus norvegicus
gctgcaatgcttgccgcctgccgat

SEQ ID NO: 477730 - DNA, 25 bp, Rattus norvegicus
atgcgggttccgcagtctaaggctg

SEQ ID NO: 477731 - DNA, 25 bp, Rattus norvegicus
tccgcagtctaaggctgtgtgatgt

SEQ ID NO: 477732 - DNA, 25 bp, Rattus norvegicus
gtgatgtccgctggcagtgccgcct

SEQ ID NO: 477733 - DNA, 25 bp, Rattus norvegicus
agtgccgcctcctgaagcctccgcg

SEQ ID NO: 477734 - DNA, 25 bp, Rattus norvegicus
ccgccgtttatagcgcgcccggcag

SEQ ID NO: 477735 - DNA, 25 bp, Rattus norvegicus
gacggggcttttccgtgacgtcagc

SEQ ID NO: 477736 - DNA, 25 bp, Rattus norvegicus
tgcctgctgcaatgcttgccgcctg

SEQ ID NO: 477737 - DNA, 25 bp, Rattus norvegicus
tgccgatgcgggttccgcagtctaa

SEQ ID NO: 477738 - DNA, 25 bp, Rattus norvegicus
tggaagaggacaccgcgccgacctc

SEQ ID NO: 477739 - DNA, 25 bp, Rattus norvegicus
acagggcgatcctaccgggctccaa

SEQ ID NO: 477740 - DNA, 25 bp, Rattus norvegicus
cactcgggaggccacagggcgatcc

SEQ ID NO: 477741 - DNA, 25 bp, Rattus norvegicus
cacggtcctaacttgctccagcagg

SEQ ID NO: 477742 - DNA, 25 bp, Rattus norvegicus
cgcagcactttcaaacacggtccta

SEQ ID NO: 477743 - DNA, 25 bp, Rattus norvegicus
ggcgcgcaacgcagcactttcaaac

SEQ ID NO: 477744 - DNA, 25 bp, Rattus norvegicus
ccgacctccgagagcctcccgcaaa

SEQ ID NO: 477745 - DNA, 25 bp, Rattus norvegicus
gatcctaccgggctccaactcggga

SEQ ID NO: 477746 - DNA, 25 bp, Rattus norvegicus
ccgccagtttggaagaggacaccgc

SEQ ID NO: 477747 - DNA, 25 bp, Rattus norvegicus
ccgtgttcaggtgctccgccagttt

SEQ ID NO: 477748 - DNA, 25 bp, Rattus norvegicus
tccggcaacattccctgcggtggct

SEQ ID NO: 477749 - DNA, 25 bp, Rattus norvegicus
ggctccggcaacattccctgcggtg

SEQ ID NO: 477750 - DNA, 25 bp, Rattus norvegicus
gaagcaccgcggctccggcaacatt

SEQ ID NO: 477751 - DNA, 25 bp, Rattus norvegicus
caaagcggcgcgcaacgcagcactt

SEQ ID NO: 477752 - DNA, 25 bp, Rattus norvegicus
cgttctgccgccaggacaactcgga

SEQ ID NO: 477753 - DNA, 25 bp, Rattus norvegicus
gtgcaatgcgcacaagctagactcg

SEQ ID NO: 477754 - DNA, 25 bp, Rattus norvegicus
tgtacatgtactcgataacggcttc

SEQ ID NO: 477755 - DNA, 25 bp, Rattus norvegicus
taacggcttctaccgtgtcaggttc

SEQ ID NO: 477756 - DNA, 25 bp, Rattus norvegicus
ggcctgaccgcgattccgaaaactg

SEQ ID NO: 477757 - DNA, 25 bp, Rattus norvegicus
tcgcagaacagaccttgacgccgct

SEQ ID NO: 477758 - DNA, 25 bp, Rattus norvegicus
cccgtgtcgacaagggtagagatcc

SEQ ID NO: 477759 - DNA, 25 bp, Rattus norvegicus
ggtcacaaagtctaccgtgccactg

SEQ ID NO: 477760 - DNA, 25 bp, Rattus norvegicus
acttgaaaagatgctgccgcggccg

SEQ ID NO: 477761 - DNA, 25 bp, Rattus norvegicus
cctcagcttccgaacggtgcggcaa

SEQ ID NO: 477762 - DNA, 25 bp, Rattus norvegicus
tgcggcaactctggtgcgacacaga

SEQ ID NO: 477763 - DNA, 25 bp, Rattus norvegicus
cctagcgaggcaagcgcagttctcg

SEQ ID NO: 477764 - DNA, 25 bp, Rattus norvegicus
aagcacagggtgatgtcgcagaaca

SEQ ID NO: 477765 - DNA, 25 bp, Rattus norvegicus
agtactgcactcgaagtcctcggcc

SEQ ID NO: 477766 - DNA, 25 bp, Rattus norvegicus
cggagcgcacttgttttcgcggccg

SEQ ID NO: 477767 - DNA, 25 bp, Rattus norvegicus
tttagctaagaggttcctggccacc

SEQ ID NO: 477768 - DNA, 25 bp, Rattus norvegicus
cgcaggagtcggagtccatgttccg

SEQ ID NO: 477769 - DNA, 25 bp, Rattus norvegicus
tgtgtcgcgtcgtaggttcgctgat

SEQ ID NO: 477770 - DNA, 25 bp, Rattus norvegicus
ttcgctgatcccgaactggagtctc

SEQ ID NO: 477771 - DNA, 25 bp, Rattus norvegicus
aactggagtctcctcagagaactga

SEQ ID NO: 477772 - DNA, 25 bp, Rattus norvegicus
cgcggcacacgcaccggctttagtt

SEQ ID NO: 477773 - DNA, 25 bp, Rattus norvegicus
gctttctcccgtggggcctcagctt

SEQ ID NO: 477774 - DNA, 25 bp, Rattus norvegicus
actcccaagaggctttgcggcagtg

SEQ ID NO: 477775 - DNA, 25 bp, Rattus norvegicus
gactgtcttagaactccaactccca

SEQ ID NO: 477776 - DNA, 25 bp, Rattus norvegicus
cgcgccatctggagactgtcttaga

SEQ ID NO: 477777 - DNA, 25 bp, Rattus norvegicus
ccgggttgtctggacttcgtcatgt

SEQ ID NO: 477778 - DNA, 25 bp, Rattus norvegicus
acctgacgcccagttcggctcgtgt

SEQ ID NO: 477779 - DNA, 25 bp, Rattus norvegicus
aactgagtggaggatgcagctccca

SEQ ID NO: 477780 - DNA, 25 bp, Rattus norvegicus
gcctggacatgcaggacttcgccga

SEQ ID NO: 477781 - DNA, 25 bp, Rattus norvegicus
agctgcgcgccgagcgcaagttcct

SEQ ID NO: 477782 - DNA, 25 bp, Rattus norvegicus
aaatgggcacggttaagtggcgctc

SEQ ID NO: 477783 - DNA, 25 bp, Rattus norvegicus
cctgcgtatttatagaggcggtgcc

SEQ ID NO: 477784 - DNA, 25 bp, Rattus norvegicus
tttggccgtgctgcccttctccgat

SEQ ID NO: 477785 - DNA, 25 bp, Rattus norvegicus
cgcaacgctgggaacagaagggtta

SEQ ID NO: 477786 - DNA, 25 bp, Rattus norvegicus
gcaagttcctggacgtgaccctgga

SEQ ID NO: 477787 - DNA, 25 bp, Rattus norvegicus
cctggacttcagctacaccggcaga

SEQ ID NO: 477788 - DNA, 25 bp, Rattus norvegicus
cgacctggccaactgcctggacatg

SEQ ID NO: 477789 - DNA, 25 bp, Rattus norvegicus
ttggtgactcagaacgcaacgctgg

SEQ ID NO: 477790 - DNA, 25 bp, Rattus norvegicus
gcagcgcttcattctgcgccacgtg

SEQ ID NO: 477791 - DNA, 25 bp, Rattus norvegicus
atttccaggcggctcgctacgaccg

SEQ ID NO: 477792 - DNA, 25 bp, Rattus norvegicus
gcactggccgcagttgctggaagct

SEQ ID NO: 477793 - DNA, 25 bp, Rattus norvegicus
tgcagcagcagctcgacctggccaa

SEQ ID NO: 477794 - DNA, 25 bp, Rattus norvegicus
caactgatctgtagcgcacccaacg

SEQ ID NO: 477795 - DNA, 25 bp, Rattus norvegicus
tataggcgctcaggccagaaccgga

SEQ ID NO: 477796 - DNA, 25 bp, Rattus norvegicus
gtggacgacaactgatctgtagcgc

SEQ ID NO: 477797 - DNA, 25 bp, Rattus norvegicus
accggcctcactgctccgggctaga

SEQ ID NO: 477798 - DNA, 25 bp, Rattus norvegicus
gatctgtagcgcacccaacgcacag

SEQ ID NO: 477799 - DNA, 25 bp, Rattus norvegicus
caacgcacagccagaagggcagggc

SEQ ID NO: 477800 - DNA, 25 bp, Rattus norvegicus
gcggctgcgcacaggtgacccaagc

SEQ ID NO: 477801 - DNA, 25 bp, Rattus norvegicus
gctccgggctagaccacttccaccg

SEQ ID NO: 477802 - DNA, 25 bp, Rattus norvegicus
gcggcgcaaagtccttaggtcccgc

SEQ ID NO: 477803 - DNA, 25 bp, Rattus norvegicus
aagactaactactgcccggcccaca

SEQ ID NO: 477804 - DNA, 25 bp, Rattus norvegicus
gtcgccgcgccggatgtgacgtata

SEQ ID NO: 477805 - DNA, 25 bp, Rattus norvegicus
gccggatgtgacgtataggcgctca

SEQ ID NO: 477806 - DNA, 25 bp, Rattus norvegicus
cctcggcggcgcaaagtccttaggt

SEQ ID NO: 477807 - DNA, 25 bp, Rattus norvegicus
agaaccggacgcctcggcggcgcaa

SEQ ID NO: 477808 - DNA, 25 bp, Rattus norvegicus
ttccgggccaagtatggcggaatca

SEQ ID NO: 477809 - DNA, 25 bp, Rattus norvegicus
atgctccggcgggttccgagtcgct

SEQ ID NO: 477810 - DNA, 25 bp, Rattus norvegicus
ttccgagtcgctcttcctggcagcg

SEQ ID NO: 477811 - DNA, 25 bp, Rattus norvegicus
tcctcacccggggtgagctgcgtcg

SEQ ID NO: 477812 - DNA, 25 bp, Rattus norvegicus
cacgtggcggtaaagtgcaaaatcc

SEQ ID NO: 477813 - DNA, 25 bp, Rattus norvegicus
gtgcaaaatccgaacccgcagccgg

SEQ ID NO: 477814 - DNA, 25 bp, Rattus norvegicus
cctgcacccgggtcgggtcatgcag

SEQ ID NO: 477815 - DNA, 25 bp, Rattus norvegicus
gtcgggtcatgcagcctgctcaatc

SEQ ID NO: 477816 - DNA, 25 bp, Rattus norvegicus
ggtcctaaaggtgtcgccgaacatc

SEQ ID NO: 477817 - DNA, 25 bp, Rattus norvegicus
aaggtgtcgccgaacatcacccaac

SEQ ID NO: 477818 - DNA, 25 bp, Rattus norvegicus
atggcggaatcagaggtgatgctcc

SEQ ID NO: 477819 - DNA, 25 bp, Rattus norvegicus
taccgcccggagaggtgagtcgccc

SEQ ID NO: 477820 - DNA, 25 bp, Rattus norvegicus
gccgcgtgttgctgatgctaccgcc

SEQ ID NO: 477821 - DNA, 25 bp, Rattus norvegicus
caacccacgttggacttaggctcgg

SEQ ID NO: 477822 - DNA, 25 bp, Rattus norvegicus
aagttaagtttggtgcgtgcgccga

SEQ ID NO: 477823 - DNA, 25 bp, Rattus norvegicus
tgcacccaggactagctgcagctgc

SEQ ID NO: 477824 - DNA, 25 bp, Rattus norvegicus
ccctcgcaggctgactggcagtccc

SEQ ID NO: 477825 - DNA, 25 bp, Rattus norvegicus
aacccagctgggtgggacccacctg

SEQ ID NO: 477826 - DNA, 25 bp, Rattus norvegicus
cgcgtggccatcaccagaagggcct

SEQ ID NO: 477827 - DNA, 25 bp, Rattus norvegicus
accgtgcaggagaccgcctggaacc

SEQ ID NO: 477828 - DNA, 25 bp, Rattus norvegicus
cgtggctaccgtgcaggagaccgcc

SEQ ID NO: 477829 - DNA, 25 bp, Rattus norvegicus
cctgctctttggaggcacttccggc

SEQ ID NO: 477830 - DNA, 25 bp, Rattus norvegicus
aggcgcctgctctttggaggcactt

SEQ ID NO: 477831 - DNA, 25 bp, Rattus norvegicus
atccgcgggtggcagccattccgaa

SEQ ID NO: 477832 - DNA, 25 bp, Rattus norvegicus
gtcctcaaccctggatccgcgggtg

SEQ ID NO: 477833 - DNA, 25 bp, Rattus norvegicus
agcagccgttcaatgaggccacccg

SEQ ID NO: 477834 - DNA, 25 bp, Rattus norvegicus
gccgagctgggaacactaacaacta

SEQ ID NO: 477835 - DNA, 25 bp, Rattus norvegicus
ctaacaactacagcagcagccgttc

SEQ ID NO: 477836 - DNA, 25 bp, Rattus norvegicus
ggccagaaaacagtccagaacccga

SEQ ID NO: 477837 - DNA, 25 bp, Rattus norvegicus
tcaacgctgccgagttcccagcggg

SEQ ID NO: 477838 - DNA, 25 bp, Rattus norvegicus
gggctacacaacgagagcagtgctc

SEQ ID NO: 477839 - DNA, 25 bp, Rattus norvegicus
acgagagcagtgctcgcagggccca

SEQ ID NO: 477840 - DNA, 25 bp, Rattus norvegicus
cggtacagaccgcaatggagcaacg

SEQ ID NO: 477841 - DNA, 25 bp, Rattus norvegicus
agaccgcaatggagcaacggccgcg

SEQ ID NO: 477842 - DNA, 25 bp, Rattus norvegicus
gtcgcaggaggccagaaaacagtcc

SEQ ID NO: 477843 - DNA, 25 bp, Rattus norvegicus
cggttgccttcaccaacgacctagt

SEQ ID NO: 477844 - DNA, 25 bp, Rattus norvegicus
aaacagtccagaacccgacctgcag

SEQ ID NO: 477845 - DNA, 25 bp, Rattus norvegicus
tgcagccctggagctaagcctcgaa

SEQ ID NO: 477846 - DNA, 25 bp, Rattus norvegicus
agctaagcctcgaagggagggtcta

SEQ ID NO: 477847 - DNA, 25 bp, Rattus norvegicus
gggtctaggggagcttctcaacgct

SEQ ID NO: 477848 - DNA, 25 bp, Rattus norvegicus
ggagcttctcaacgctgccgagttc

SEQ ID NO: 477849 - DNA, 25 bp, Rattus norvegicus
acgacctagttagaggctcgggcgc

SEQ ID NO: 477850 - DNA, 25 bp, Rattus norvegicus
ctggaaggctgtgctgaggaccttc

SEQ ID NO: 477851 - DNA, 25 bp, Rattus norvegicus
atctatgcggccctggagcgcatgg

SEQ ID NO: 477852 - DNA, 25 bp, Rattus norvegicus
gcttgggtgccatctatgcggccct

SEQ ID NO: 477853 - DNA, 25 bp, Rattus norvegicus
ctgcaggcttgggtgccatctatgc

SEQ ID NO: 477854 - DNA, 25 bp, Rattus norvegicus
gcagtatgagatgctcaagcgctgg

SEQ ID NO: 477855 - DNA, 25 bp, Rattus norvegicus
ttccgagaccagcagtatgagatgc

SEQ ID NO: 477856 - DNA, 25 bp, Rattus norvegicus
tgccgcttccgagaccagcagtatg

SEQ ID NO: 477857 - DNA, 25 bp, Rattus norvegicus
aggtggagatctgccgcttccgaga

SEQ ID NO: 477858 - DNA, 25 bp, Rattus norvegicus
cccagccagaaggtggaaggagttt

SEQ ID NO: 477859 - DNA, 25 bp, Rattus norvegicus
gacgtaatggatgcggtcccagcca

SEQ ID NO: 477860 - DNA, 25 bp, Rattus norvegicus
ctctacgacgtaatggatgcggtcc

SEQ ID NO: 477861 - DNA, 25 bp, Rattus norvegicus
tggcccgcaactctacgacgtaatg

SEQ ID NO: 477862 - DNA, 25 bp, Rattus norvegicus
tccggctgctgtgctccagcctggc

SEQ ID NO: 477863 - DNA, 25 bp, Rattus norvegicus
gaggaccttcgtagccgcctgcagc

SEQ ID NO: 477864 - DNA, 25 bp, Rattus norvegicus
tcgaacatctcgtagcacagcaggt

SEQ ID NO: 477865 - DNA, 25 bp, Rattus norvegicus
acctcctcaagcactgtacggtgga

SEQ ID NO: 477866 - DNA, 25 bp, Rattus norvegicus
tagcacagcaggtggcggaatttcc

SEQ ID NO: 477867 - DNA, 25 bp, Rattus norvegicus
gaatttccgttcctctcggctcagg

SEQ ID NO: 477868 - DNA, 25 bp, Rattus norvegicus
tggctgcccagacggtcgaacatct

SEQ ID NO: 477869 - DNA, 25 bp, Rattus norvegicus
tacggtggaactgacggataagctc

SEQ ID NO: 477870 - DNA, 25 bp, Rattus norvegicus
agtgagactgtcgtagttccgcgga

SEQ ID NO: 477871 - DNA, 25 bp, Rattus norvegicus
gcatgaaaagatccagagtgagact

SEQ ID NO: 477872 - DNA, 25 bp, Rattus norvegicus
gtagcctagcatgaaaagatccaga

SEQ ID NO: 477873 - DNA, 25 bp, Rattus norvegicus
tccagcagctggaagtagcctagca

SEQ ID NO: 477874 - DNA, 25 bp, Rattus norvegicus
tcaggcccatctccagcagctggaa

SEQ ID NO: 477875 - DNA, 25 bp, Rattus norvegicus
aagctcccacgggtggctgcccaga

SEQ ID NO: 477876 - DNA, 25 bp, Rattus norvegicus
ctgacggataagctcccacgggtgg

SEQ ID NO: 477877 - DNA, 25 bp, Rattus norvegicus
cgtagttccgcggagtgccgccgtc

SEQ ID NO: 477878 - DNA, 25 bp, Rattus norvegicus
ttcccggcaccagctgagcgaatga

SEQ ID NO: 477879 - DNA, 25 bp, Rattus norvegicus
tgaccgtgaagcgtggtgctgacaa

SEQ ID NO: 477880 - DNA, 25 bp, Rattus norvegicus
gagatcttgctgcaccaggcaggca

SEQ ID NO: 477881 - DNA, 25 bp, Rattus norvegicus
ctcttgagcagcgtagagatcttgc

SEQ ID NO: 477882 - DNA, 25 bp, Rattus norvegicus
agcagcgtggccatgctcttgagca

SEQ ID NO: 477883 - DNA, 25 bp, Rattus norvegicus
ctgcagctagcagttccgccagatg

SEQ ID NO: 477884 - DNA, 25 bp, Rattus norvegicus
ctgagcgaatgagaacgtcccaaac

SEQ ID NO: 477885 - DNA, 25 bp, Rattus norvegicus
acgccacattcgaggatctcccgtg

SEQ ID NO: 477886 - DNA, 25 bp, Rattus norvegicus
aggtcctgcaccgagacgccacatt

SEQ ID NO: 477887 - DNA, 25 bp, Rattus norvegicus
atcctcctcgaggatgggctcccgg

SEQ ID NO: 477888 - DNA, 25 bp, Rattus norvegicus
cactggaaccaagtgccacgtaatc

SEQ ID NO: 477889 - DNA, 25 bp, Rattus norvegicus
tggtggctctctgttcactggaacc

SEQ ID NO: 477890 - DNA, 25 bp, Rattus norvegicus
caggccattagcgatggtggctctc

SEQ ID NO: 477891 - DNA, 25 bp, Rattus norvegicus
tcccaaacagagtggtccaggcctt

SEQ ID NO: 477892 - DNA, 25 bp, Rattus norvegicus
gcgaatggcgcctgatgcgtgattt

SEQ ID NO: 477893 - DNA, 25 bp, Rattus norvegicus
gaatggcgcctgatgcgtgattttc

SEQ ID NO: 477894 - DNA, 25 bp, Rattus norvegicus
cgcatagtgtaagccagccccgaca

SEQ ID NO: 477895 - DNA, 25 bp, Rattus norvegicus
catgtgcgcatcctgaatggcgaat

SEQ ID NO: 477896 - DNA, 25 bp, Rattus norvegicus
aatggcgcctgatgcgtgattttct

SEQ ID NO: 477897 - DNA, 25 bp, Rattus norvegicus
cgaatggcgcctgatgcgtgatttt

SEQ ID NO: 477898 - DNA, 25 bp, Rattus norvegicus
atgtgcgcatcctgaatggcgaatg

SEQ ID NO: 477899 - DNA, 25 bp, Rattus norvegicus
acatgtgcgcatcctgaatggcgaa

SEQ ID NO: 477900 - DNA, 25 bp, Rattus norvegicus
aacatgtgcgcatcctgaatggcga

SEQ ID NO: 477901 - DNA, 25 bp, Rattus norvegicus
caacatgtgcgcatcctgaatggcg

SEQ ID NO: 477902 - DNA, 25 bp, Rattus norvegicus
ccaacatgtgcgcatcctgaatggc

SEQ ID NO: 477903 - DNA, 25 bp, Rattus norvegicus
ttcccaacatgtgcgcatcctgaat

SEQ ID NO: 477904 - DNA, 25 bp, Rattus norvegicus
tgccgcatagtgtaagccagccccg

SEQ ID NO: 477905 - DNA, 25 bp, Rattus norvegicus
cttcccaacatgtgcgcatcctgaa

SEQ ID NO: 477906 - DNA, 25 bp, Rattus norvegicus
agcctcagcagggagctattttcgt

SEQ ID NO: 477907 - DNA, 25 bp, Rattus norvegicus
tactgggcttccaaaataggaggcc

SEQ ID NO: 477908 - DNA, 25 bp, Rattus norvegicus
aaaggcgtttagagcagcctcagca

SEQ ID NO: 477909 - DNA, 25 bp, Rattus norvegicus
gaggagtgaccgctcaggtcgactc

SEQ ID NO: 477910 - DNA, 25 bp, Rattus norvegicus
gtggatcgacagagcgagcttcttg

SEQ ID NO: 477911 - DNA, 25 bp, Rattus norvegicus
tcgtctactgggcttccaaaatagg

SEQ ID NO: 477912 - DNA, 25 bp, Rattus norvegicus
gctattttcgtctactgggcttcca

SEQ ID NO: 477913 - DNA, 25 bp, Rattus norvegicus
gagcagcctcagcagggagctattt

SEQ ID NO: 477914 - DNA, 25 bp, Rattus norvegicus
tccggtagcaaaggcgtttagagca

SEQ ID NO: 477915 - DNA, 25 bp, Rattus norvegicus
cgctccggtagcaaaggcgtttaga

SEQ ID NO: 477916 - DNA, 25 bp, Rattus norvegicus
tggaccgctccggtagcaaaggcgt

SEQ ID NO: 477917 - DNA, 25 bp, Rattus norvegicus
agcttcttgcaatttaagtgggttt

SEQ ID NO: 477918 - DNA, 25 bp, Rattus norvegicus
gagcgagcttcttgcaatttaagtg

SEQ ID NO: 477919 - DNA, 25 bp, Rattus norvegicus
cgacagagcgagcttcttgcaattt

SEQ ID NO: 477920 - DNA, 25 bp, Rattus norvegicus
tttctctgagcctaccttccggtgc

SEQ ID NO: 477921 - DNA, 25 bp, Rattus norvegicus
gatccttccggtgtctgtggtgcgg

SEQ ID NO: 477922 - DNA, 25 bp, Rattus norvegicus
tggacgcagctccatcctcaagctg

SEQ ID NO: 477923 - DNA, 25 bp, Rattus norvegicus
tcaagctgcacatgcgcacgcacac

SEQ ID NO: 477924 - DNA, 25 bp, Rattus norvegicus
gcgcacgcacacagacgagcgaccc

SEQ ID NO: 477925 - DNA, 25 bp, Rattus norvegicus
gccatctctgcagccaccgcttccg

SEQ ID NO: 477926 - DNA, 25 bp, Rattus norvegicus
ttccgccagagctcacacctgagga

SEQ ID NO: 477927 - DNA, 25 bp, Rattus norvegicus
ctcacacctgaggaagcacttgcta

SEQ ID NO: 477928 - DNA, 25 bp, Rattus norvegicus
cgggaagacttttggacgcagctcc

SEQ ID NO: 477929 - DNA, 25 bp, Rattus norvegicus
gctaacgcatttctctgagcctacc

SEQ ID NO: 477930 - DNA, 25 bp, Rattus norvegicus
ctaccttccggtgcgctgagtgtaa

SEQ ID NO: 477931 - DNA, 25 bp, Rattus norvegicus
tgagtgtaaccagggcttccggcgt

SEQ ID NO: 477932 - DNA, 25 bp, Rattus norvegicus
tgcgctgagtgtaaccagggcttcc

SEQ ID NO: 477933 - DNA, 25 bp, Rattus norvegicus
agcacttgctaacgcatttctctga

SEQ ID NO: 477934 - DNA, 25 bp, Rattus norvegicus
ctggccaacatcgtggagcgctaca

SEQ ID NO: 477935 - DNA, 25 bp, Rattus norvegicus
tgccaggctcacgacaaggtcaagc

SEQ ID NO: 477936 - DNA, 25 bp, Rattus norvegicus
gcgctgcacgagcaacaccaggtca

SEQ ID NO: 477937 - DNA, 25 bp, Rattus norvegicus
tgcttcttctgtgacgagcccgcgc

SEQ ID NO: 477938 - DNA, 25 bp, Rattus norvegicus
gggctgcgagcactacttctgccgc

SEQ ID NO: 477939 - DNA, 25 bp, Rattus norvegicus
aggtcaagctcttctgcctcacgga

SEQ ID NO: 477940 - DNA, 25 bp, Rattus norvegicus
ctgagcatctaccaggacccggtga

SEQ ID NO: 477941 - DNA, 25 bp, Rattus norvegicus
caaggacgagctgctgtgctccatc

SEQ ID NO: 477942 - DNA, 25 bp, Rattus norvegicus
tggtggccacctaggacctcgaaac

SEQ ID NO: 477943 - DNA, 25 bp, Rattus norvegicus
tgtctggtcctctagatcctcctcg

SEQ ID NO: 477944 - DNA, 25 bp, Rattus norvegicus
tctatcccttgggactgtctggtcc

SEQ ID NO: 477945 - DNA, 25 bp, Rattus norvegicus
gggatctcctcctcgcagcatctat

SEQ ID NO: 477946 - DNA, 25 bp, Rattus norvegicus
tggctgctctgtcccgcagaaatcc

SEQ ID NO: 477947 - DNA, 25 bp, Rattus norvegicus
ggtcactggcatcgacgacgccttc

SEQ ID NO: 477948 - DNA, 25 bp, Rattus norvegicus
ggcctagaggctgccgagcacattt

SEQ ID NO: 477949 - DNA, 25 bp, Rattus norvegicus
ttcttgggaacggaagtgacgtcaa

SEQ ID NO: 477950 - DNA, 25 bp, Rattus norvegicus
cagagggcgcaagagcacatggctc

SEQ ID NO: 477951 - DNA, 25 bp, Rattus norvegicus
ttagcagttcgcagtcaagtcggta

SEQ ID NO: 477952 - DNA, 25 bp, Rattus norvegicus
gagcacatttctggctttccaccta

SEQ ID NO: 477953 - DNA, 25 bp, Rattus norvegicus
atcgagtttcctttagtggcctaga

SEQ ID NO: 477954 - DNA, 25 bp, Rattus norvegicus
gccctcggcgaaggatcgagtttcc

SEQ ID NO: 477955 - DNA, 25 bp, Rattus norvegicus
tgtaccaggttgtccgtggaagccc

SEQ ID NO: 477956 - DNA, 25 bp, Rattus norvegicus
cccatgtcgctgctgtaccaggttg

SEQ ID NO: 477957 - DNA, 25 bp, Rattus norvegicus
tgacgtcaagaaaacggaactctgc

SEQ ID NO: 477958 - DNA, 25 bp, Rattus norvegicus
tgagcggttccctgaagccgaattc

SEQ ID NO: 477959 - DNA, 25 bp, Rattus norvegicus
tcaagtcggtaaagtcgattcctcc

SEQ ID NO: 477960 - DNA, 25 bp, Rattus norvegicus
ttccacctatgggttagcagttcgc

SEQ ID NO: 477961 - DNA, 25 bp, Rattus norvegicus
cacatggctcgacgtttcttgggaa

SEQ ID NO: 477962 - DNA, 25 bp, Rattus norvegicus
gagcggaccctgtccgggagtatcc

SEQ ID NO: 477963 - DNA, 25 bp, Rattus norvegicus
tgcgagctcgccttaccttcgctgc

SEQ ID NO: 477964 - DNA, 25 bp, Rattus norvegicus
taccttcgctgctcaccatccggaa

SEQ ID NO: 477965 - DNA, 25 bp, Rattus norvegicus
aagcacgccggaacttgtagtcacc

SEQ ID NO: 477966 - DNA, 25 bp, Rattus norvegicus
cgctgcctctgcgagctcgccttac

SEQ ID NO: 477967 - DNA, 25 bp, Rattus norvegicus
gcccggatgagtcccgttttatcta

SEQ ID NO: 477968 - DNA, 25 bp, Rattus norvegicus
cggatgagtcccgttttatctagga

SEQ ID NO: 477969 - DNA, 25 bp, Rattus norvegicus
cccgttttatctaggactgctgatc

SEQ ID NO: 477970 - DNA, 25 bp, Rattus norvegicus
ctaggactgctgatcctcctcaagg

SEQ ID NO: 477971 - DNA, 25 bp, Rattus norvegicus
gactgctgatcctcctcaagggtta

SEQ ID NO: 477972 - DNA, 25 bp, Rattus norvegicus
tgctgatcctcctcaagggttagga

SEQ ID NO: 477973 - DNA, 25 bp, Rattus norvegicus
tcctcctcaagggttaggaacattc

SEQ ID NO: 477974 - DNA, 25 bp, Rattus norvegicus
ctgcgccaaggttgcgggtggtagc

SEQ ID NO: 477975 - DNA, 25 bp, Rattus norvegicus
gtgcgcaaagcacgccggaacttgt

SEQ ID NO: 477976 - DNA, 25 bp, Rattus norvegicus
catcgagcagcgatttcaagagatc

SEQ ID NO: 477977 - DNA, 25 bp, Rattus norvegicus
aggcgctgcagcacatcacgtcgaa

SEQ ID NO: 477978 - DNA, 25 bp, Rattus norvegicus
gacagaggcctcgagctaacaccca

SEQ ID NO: 477979 - DNA, 25 bp, Rattus norvegicus
ccatacagcgcgttcagcatggctg

SEQ ID NO: 477980 - DNA, 25 bp, Rattus norvegicus
gtccgacgtgaagagcgacaccaga

SEQ ID NO: 477981 - DNA, 25 bp, Rattus norvegicus
tgagcacgatcagcagcgaattggc

SEQ ID NO: 477982 - DNA, 25 bp, Rattus norvegicus
ggctgctgtcagcacgatgaccacg

SEQ ID NO: 477983 - DNA, 25 bp, Rattus norvegicus
acgggatatggtgactgcaggtaca

SEQ ID NO: 477984 - DNA, 25 bp, Rattus norvegicus
agctgcaccttagagtagtattggc

SEQ ID NO: 477985 - DNA, 25 bp, Rattus norvegicus
aacggggttcttaggtcatcgagca

SEQ ID NO: 477986 - DNA, 25 bp, Rattus norvegicus
cacgtcgaaggcagtccaaagcaga

SEQ ID NO: 477987 - DNA, 25 bp, Rattus norvegicus
ggaaagcaggtctcctctcgccttg

SEQ ID NO: 477988 - DNA, 25 bp, Rattus norvegicus
tgagtacgttagatcaccagctgtc

SEQ ID NO: 477989 - DNA, 25 bp, Rattus norvegicus
ggccacctggagtactcgggtaaga

SEQ ID NO: 477990 - DNA, 25 bp, Rattus norvegicus
gggacactgcaggtcgcagaagcaa

SEQ ID NO: 477991 - DNA, 25 bp, Rattus norvegicus
gacagaaatgaaagggcacgagcca

SEQ ID NO: 477992 - DNA, 25 bp, Rattus norvegicus
cgtgagtccagtgtcccagcgctgc

SEQ ID NO: 477993 - DNA, 25 bp, Rattus norvegicus
cccgacggccaggacagaaatgaaa

SEQ ID NO: 477994 - DNA, 25 bp, Rattus norvegicus
tggcggtgaaactcctacaagaaac

SEQ ID NO: 477995 - DNA, 25 bp, Rattus norvegicus
cgtcagggtgtctcagttccaaata

SEQ ID NO: 477996 - DNA, 25 bp, Rattus norvegicus
tgcaggtcgcagaagcaaagggacc

SEQ ID NO: 477997 - DNA, 25 bp, Rattus norvegicus
gcgcgtcctcttagaggtcttagaa

SEQ ID NO: 477998 - DNA, 25 bp, Rattus norvegicus
ttagaggtcttagaaagtgggatgc

SEQ ID NO: 477999 - DNA, 25 bp, Rattus norvegicus
cctcctactctcagtcttggcggtg

SEQ ID NO: 478000 - DNA, 25 bp, Rattus norvegicus
gctcggctgtgcttcgctgctggcc

SEQ ID NO: 478001 - DNA, 25 bp, Rattus norvegicus
ccgagcgcctccgacgtcagggtgt

SEQ ID NO: 478002 - DNA, 25 bp, Rattus norvegicus
cagggtgtctcagttccaaataggg

SEQ ID NO: 478003 - DNA, 25 bp, Rattus norvegicus
cagtcttggcggtgaaactcctaca

SEQ ID NO: 478004 - DNA, 25 bp, Rattus norvegicus
agcctgcctgcctccatggagacgg

SEQ ID NO: 478005 - DNA, 25 bp, Rattus norvegicus
ctgtgtgcacctgaggcccatttca

SEQ ID NO: 478006 - DNA, 25 bp, Rattus norvegicus
tgaggcccatttcaaccgcggaagg

SEQ ID NO: 478007 - DNA, 25 bp, Rattus norvegicus
acgcattcccgtctttgtcttctga

SEQ ID NO: 478008 - DNA, 25 bp, Rattus norvegicus
tgtcttctgaatactacggaaatga

SEQ ID NO: 478009 - DNA, 25 bp, Rattus norvegicus
gccacgtttctttgttctagggatg

SEQ ID NO: 478010 - DNA, 25 bp, Rattus norvegicus
cctccatggagacggagaaggtcca

SEQ ID NO: 478011 - DNA, 25 bp, Rattus norvegicus
gagaaggtccaaggtccgtccactg

SEQ ID NO: 478012 - DNA, 25 bp, Rattus norvegicus
gtccgtccactggtcctcacctggt

SEQ ID NO: 478013 - DNA, 25 bp, Rattus norvegicus
tcacctggtcccgacgacggcattg

SEQ ID NO: 478014 - DNA, 25 bp, Rattus norvegicus
accgcattccgccacgtttctttgt

SEQ ID NO: 478015 - DNA, 25 bp, Rattus norvegicus
acgacggcattgtggggtccgctcc

SEQ ID NO: 478016 - DNA, 25 bp, Rattus norvegicus
acggaaatgatctgagctgggcacc

SEQ ID NO: 478017 - DNA, 25 bp, Rattus norvegicus
tttctttgttctagggatgtgggga

SEQ ID NO: 478018 - DNA, 25 bp, Rattus norvegicus
gaggggaagccacccgccactgctg

SEQ ID NO: 478019 - DNA, 25 bp, Rattus norvegicus
tctgcgaaggtaaggctgccctgat

SEQ ID NO: 478020 - DNA, 25 bp, Rattus norvegicus
caccgagtatgaagtgggcgtctgc

SEQ ID NO: 478021 - DNA, 25 bp, Rattus norvegicus
atggcgactccatcaccgagtatga

SEQ ID NO: 478022 - DNA, 25 bp, Rattus norvegicus
cgcccgccagaggaacgagagctgc

SEQ ID NO: 478023 - DNA, 25 bp, Rattus norvegicus
tgctgctacatgtgcgcccgccaga

SEQ ID NO: 478024 - DNA, 25 bp, Rattus norvegicus
tgcctgccctgtgacgagtccaagt

SEQ ID NO: 478025 - DNA, 25 bp, Rattus norvegicus
cggagctgccgcgaggaaacttttt

SEQ ID NO: 478026 - DNA, 25 bp, Rattus norvegicus
cgccgccgccagaagtttgggttga

SEQ ID NO: 478027 - DNA, 25 bp, Rattus norvegicus
accagccctgcttcggagcggtgcg

SEQ ID NO: 478028 - DNA, 25 bp, Rattus norvegicus
ggaccagaaggagccaccagccctg

SEQ ID NO: 478029 - DNA, 25 bp, Rattus norvegicus
gaacggacgccacggaccttctgct

SEQ ID NO: 478030 - DNA, 25 bp, Rattus norvegicus
cagccataaacaagcgcccggagga

SEQ ID NO: 478031 - DNA, 25 bp, Rattus norvegicus
gacgagtccaagtgcgaggagcctc

SEQ ID NO: 478032 - DNA, 25 bp, Rattus norvegicus
ggctcgcgttacagttctcctggtc

SEQ ID NO: 478033 - DNA, 25 bp, Rattus norvegicus
tccgggctcgcgttacagttctcct

SEQ ID NO: 478034 - DNA, 25 bp, Rattus norvegicus
aagccagcgccgggaagctgtcgcc

SEQ ID NO: 478035 - DNA, 25 bp, Rattus norvegicus
ttctcctccaggctggaagccagcg

SEQ ID NO: 478036 - DNA, 25 bp, Rattus norvegicus
tcctgggcccgcactcactcgtccc

SEQ ID NO: 478037 - DNA, 25 bp, Rattus norvegicus
tgcgctccgtgatgggccgcacggc

SEQ ID NO: 478038 - DNA, 25 bp, Rattus norvegicus
gcgttacagttctcctggtcccgga

SEQ ID NO: 478039 - DNA, 25 bp, Rattus norvegicus
gccacgccctgtcgctgtcaggaca

SEQ ID NO: 478040 - DNA, 25 bp, Rattus norvegicus
cttgcaagaggctgcgctccgtgat

SEQ ID NO: 478041 - DNA, 25 bp, Rattus norvegicus
tacagttctcctggtcccggacact

SEQ ID NO: 478042 - DNA, 25 bp, Rattus norvegicus
cccggccggctcctggaactcatag

SEQ ID NO: 478043 - DNA, 25 bp, Rattus norvegicus
catcgcgccggctgccagcgtgcgc

SEQ ID NO: 478044 - DNA, 25 bp, Rattus norvegicus
tagaaatcctgccagtccccgtctg

SEQ ID NO: 478045 - DNA, 25 bp, Rattus norvegicus
ttggtgccgcccactcgaaaccacg

SEQ ID NO: 478046 - DNA, 25 bp, Rattus norvegicus
ccgaactcctcgttgtggctgagca

SEQ ID NO: 478047 - DNA, 25 bp, Rattus norvegicus
gaaggcgtccatcatgtctcgagga

SEQ ID NO: 478048 - DNA, 25 bp, Rattus norvegicus
ccgggttgggaaaaagctgcagcca

SEQ ID NO: 478049 - DNA, 25 bp, Rattus norvegicus
aactcggcatcgtcgtggttgtacc

SEQ ID NO: 478050 - DNA, 25 bp, Rattus norvegicus
tggttgtaccgacagccgaagcata

SEQ ID NO: 478051 - DNA, 25 bp, Rattus norvegicus
cgccactatgatcggctgcgtcgga

SEQ ID NO: 478052 - DNA, 25 bp, Rattus norvegicus
ccagcgctctgagtagtggccgaac

SEQ ID NO: 478053 - DNA, 25 bp, Rattus norvegicus
ggccaccagacaccacacggaaaga

SEQ ID NO: 478054 - DNA, 25 bp, Rattus norvegicus
ccctgctgcaccagagcctgatgga

SEQ ID NO: 478055 - DNA, 25 bp, Rattus norvegicus
cggatctgaaaaacgtcgccatagc

SEQ ID NO: 478056 - DNA, 25 bp, Rattus norvegicus
aagtacaagtgcgatgcccggccaa

SEQ ID NO: 478057 - DNA, 25 bp, Rattus norvegicus
cagacgccgcgtttccgatcaatgg

SEQ ID NO: 478058 - DNA, 25 bp, Rattus norvegicus
ttgatctgctcgaactcgcggaaga

SEQ ID NO: 478059 - DNA, 25 bp, Rattus norvegicus
tttctcggtgcctcaggaacttgtc

SEQ ID NO: 478060 - DNA, 25 bp, Rattus norvegicus
gcgcagtcacgcgtgggagataccc

SEQ ID NO: 478061 - DNA, 25 bp, Rattus norvegicus
cccagctcatggtgtcttcccggag

SEQ ID NO: 478062 - DNA, 25 bp, Rattus norvegicus
agcaacccgccgcttccacgccgcg

SEQ ID NO: 478063 - DNA, 25 bp, Rattus norvegicus
agcaggggagcagcaacccgccgct

SEQ ID NO: 478064 - DNA, 25 bp, Rattus norvegicus
agcgtcccgccacctgcctgctccg

SEQ ID NO: 478065 - DNA, 25 bp, Rattus norvegicus
gcctccgagcacctcggtgcggccc

SEQ ID NO: 478066 - DNA, 25 bp, Rattus norvegicus
gacacgtcctaggaggcctccgagc

SEQ ID NO: 478067 - DNA, 25 bp, Rattus norvegicus
agccagagagcgagcgccacaagca

SEQ ID NO: 478068 - DNA, 25 bp, Rattus norvegicus
cgtgtggaaacccaccagggtgcgc

SEQ ID NO: 478069 - DNA, 25 bp, Rattus norvegicus
gccaggcactcatctcagccagaga

SEQ ID NO: 478070 - DNA, 25 bp, Rattus norvegicus
tcatggtgtcttcccggagcccggc

SEQ ID NO: 478071 - DNA, 25 bp, Rattus norvegicus
aaacccaccagggtgcgcagtcacg

SEQ ID NO: 478072 - DNA, 25 bp, Rattus norvegicus
tttgcccctcaacagcgggaaggtc

SEQ ID NO: 478073 - DNA, 25 bp, Rattus norvegicus
tcatctcagccagagagcgagcgcc

SEQ ID NO: 478074 - DNA, 25 bp, Rattus norvegicus
aggcctcaggcactcttaagcagca

SEQ ID NO: 478075 - DNA, 25 bp, Rattus norvegicus
accctaggagcttgtctcatccaga

SEQ ID NO: 478076 - DNA, 25 bp, Rattus norvegicus
gagcactctgaccatctgttgtttg

SEQ ID NO: 478077 - DNA, 25 bp, Rattus norvegicus
cggagtcaagtcctcgcagcaaggc

SEQ ID NO: 478078 - DNA, 25 bp, Rattus norvegicus
cggctcgctccacttcgacatagag

SEQ ID NO: 478079 - DNA, 25 bp, Rattus norvegicus
cgacatagagcttaagggattcacc

SEQ ID NO: 478080 - DNA, 25 bp, Rattus norvegicus
cggcatccggtagtgaacccgaatg

SEQ ID NO: 478081 - DNA, 25 bp, Rattus norvegicus
ctggggcgaagactgctataaagct

SEQ ID NO: 478082 - DNA, 25 bp, Rattus norvegicus
gctgagacccgcacaaaacttccga

SEQ ID NO: 478083 - DNA, 25 bp, Rattus norvegicus
tcacctcttcgagaaagcccgagtg

SEQ ID NO: 478084 - DNA, 25 bp, Rattus norvegicus
gagtgtggctctctgtccgtaagca

SEQ ID NO: 478085 - DNA, 25 bp, Rattus norvegicus
gcaatgtgcaaactcccaggaacta

SEQ ID NO: 478086 - DNA, 25 bp, Rattus norvegicus
tacaccggtagggagctccttagca

SEQ ID NO: 478087 - DNA, 25 bp, Rattus norvegicus
gggagagtagccaccgccatctcta

SEQ ID NO: 478088 - DNA, 25 bp, Rattus norvegicus
gagcaaaggcttcggtgaacatggc

SEQ ID NO: 478089 - DNA, 25 bp, Rattus norvegicus
gaagcgcgagatggtcctaaagtgc

SEQ ID NO: 478090 - DNA, 25 bp, Rattus norvegicus
tcctaaagtgcgcagagtagctctg

SEQ ID NO: 478091 - DNA, 25 bp, Rattus norvegicus
acacgctgaggagccaggcctggaa

SEQ ID NO: 478092 - DNA, 25 bp, Rattus norvegicus
agccgggctcagacctcatggatac

SEQ ID NO: 478093 - DNA, 25 bp, Rattus norvegicus
agacctcatggataccgcgggatcg

SEQ ID NO: 478094 - DNA, 25 bp, Rattus norvegicus
ccaggcaggtgcaggtaccgcttag

SEQ ID NO: 478095 - DNA, 25 bp, Rattus norvegicus
cattgctgctctagctccgcggcag

SEQ ID NO: 478096 - DNA, 25 bp, Rattus norvegicus
aaggcacgtactcctggtgcagccg

SEQ ID NO: 478097 - DNA, 25 bp, Rattus norvegicus
agccggttgttagctgtctcccaca

SEQ ID NO: 478098 - DNA, 25 bp, Rattus norvegicus
cgcaagtgaccgtcgctagaggcta

SEQ ID NO: 478099 - DNA, 25 bp, Rattus norvegicus
agtaggcttgactgtccggcgagaa

SEQ ID NO: 478100 - DNA, 25 bp, Rattus norvegicus
taccgcttaggtgcgcggaaggcac

SEQ ID NO: 478101 - DNA, 25 bp, Rattus norvegicus
agtagctctgatggggacacgctga

SEQ ID NO: 478102 - DNA, 25 bp, Rattus norvegicus
cgtgctgttcacgatggcccaagtg

SEQ ID NO: 478103 - DNA, 25 bp, Rattus norvegicus
aaattatttcggctctgcaacgtcg

SEQ ID NO: 478104 - DNA, 25 bp, Rattus norvegicus
cccttccagagagggacgcctttcg

SEQ ID NO: 478105 - DNA, 25 bp, Rattus norvegicus
cgaaccgggagagcttcttgcttcc

SEQ ID NO: 478106 - DNA, 25 bp, Rattus norvegicus
ctaagggcttcacgggaggaatcac

SEQ ID NO: 478107 - DNA, 25 bp, Rattus norvegicus
gtctctagtatgtggaaaccctccg

SEQ ID NO: 478108 - DNA, 25 bp, Rattus norvegicus
tgccttgccagggagctcaatttcg

SEQ ID NO: 478109 - DNA, 25 bp, Rattus norvegicus
tgactccaaggatcgcgtgctgttc

SEQ ID NO: 478110 - DNA, 25 bp, Rattus norvegicus
cttccttgtgaggttgaggcgcctc

SEQ ID NO: 478111 - DNA, 25 bp, Rattus norvegicus
tgcgacagcacctactctagagacg

SEQ ID NO: 478112 - DNA, 25 bp, Rattus norvegicus
agggccacagagacactacaggatc

SEQ ID NO: 478113 - DNA, 25 bp, Rattus norvegicus
tcgggaccggtttgtctctagtatg

SEQ ID NO: 478114 - DNA, 25 bp, Rattus norvegicus
gagacgccgtgcttcttccttgtga

SEQ ID NO: 478115 - DNA, 25 bp, Rattus norvegicus
gcggccgaagctcggagtttcattc

SEQ ID NO: 478116 - DNA, 25 bp, Rattus norvegicus
gaccacagcagctcagaactcaata

SEQ ID NO: 478117 - DNA, 25 bp, Rattus norvegicus
ttaccagccttaagctgcgggccgg

SEQ ID NO: 478118 - DNA, 25 bp, Rattus norvegicus
ctcagcgatctacctcaggcggttg

SEQ ID NO: 478119 - DNA, 25 bp, Rattus norvegicus
cctcctcacgcaggactgagggagc

SEQ ID NO: 478120 - DNA, 25 bp, Rattus norvegicus
gtacctgtgcaggtcagcgaagcgc

SEQ ID NO: 478121 - DNA, 25 bp, Rattus norvegicus
gacactcgggactcgccatcaggcg

SEQ ID NO: 478122 - DNA, 25 bp, Rattus norvegicus
acgtcctggcccttggagcggaccg

SEQ ID NO: 478123 - DNA, 25 bp, Rattus norvegicus
gtcacggaacaaagtggcaggaccc

SEQ ID NO: 478124 - DNA, 25 bp, Rattus norvegicus
tcgcggtgagaccacagcagctcag

SEQ ID NO: 478125 - DNA, 25 bp, Rattus norvegicus
gagaacgttcgttcttttggagaga

SEQ ID NO: 478126 - DNA, 25 bp, Rattus norvegicus
caagtaggcacgagaacgttcgttc

SEQ ID NO: 478127 - DNA, 25 bp, Rattus norvegicus
actggcggcaagtaggcacgagaac

SEQ ID NO: 478128 - DNA, 25 bp, Rattus norvegicus
cccttggagcggaccggacgctcga

SEQ ID NO: 478129 - DNA, 25 bp, Rattus norvegicus
aaagtggcaggacccgtgtgtcgac

SEQ ID NO: 478130 - DNA, 25 bp, Rattus norvegicus
atgcgatcgcgctttcctgcgaacg

SEQ ID NO: 478131 - DNA, 25 bp, Rattus norvegicus
gggcgcctcttaccttctgccgtta

SEQ ID NO: 478132 - DNA, 25 bp, Rattus norvegicus
cccgcgatgagctgggcgcctctta

SEQ ID NO: 478133 - DNA, 25 bp, Rattus norvegicus
accttctgccgttattccgctctag

SEQ ID NO: 478134 - DNA, 25 bp, Rattus norvegicus
agctgcccaccgttctccctcccag

SEQ ID NO: 478135 - DNA, 25 bp, Rattus norvegicus
ggagctgccctgcagaccacagctg

SEQ ID NO: 478136 - DNA, 25 bp, Rattus norvegicus
aggagacggagctgccctgcagacc

SEQ ID NO: 478137 - DNA, 25 bp, Rattus norvegicus
tgcagcggttgaggagctccgtaca

SEQ ID NO: 478138 - DNA, 25 bp, Rattus norvegicus
cgaacgctgtctgtgtgcagcggtt

SEQ ID NO: 478139 - DNA, 25 bp, Rattus norvegicus
cgctttcctgcgaacgctgtctgtg

SEQ ID NO: 478140 - DNA, 25 bp, Rattus norvegicus
tttggacctccttgatgcgatcgcg

SEQ ID NO: 478141 - DNA, 25 bp, Rattus norvegicus
attccgctctagctctttggacctc

SEQ ID NO: 478142 - DNA, 25 bp, Rattus norvegicus
gccgttattccgctctagctctttg

SEQ ID NO: 478143 - DNA, 25 bp, Rattus norvegicus
ttcctgcgaacgctgtctgtgtgca

SEQ ID NO: 478144 - DNA, 25 bp, Rattus norvegicus
aacaagggcttctccgcggcggcag

SEQ ID NO: 478145 - DNA, 25 bp, Rattus norvegicus
tgtacaaagtgaacgcagagcccgc

SEQ ID NO: 478146 - DNA, 25 bp, Rattus norvegicus
ggcggagccagccttgttgtacaaa

SEQ ID NO: 478147 - DNA, 25 bp, Rattus norvegicus
gaatagtcgccagtacgcaggcgca

SEQ ID NO: 478148 - DNA, 25 bp, Rattus norvegicus
ccactgcgccgaatagtcgccagta

SEQ ID NO: 478149 - DNA, 25 bp, Rattus norvegicus
gacgctaacgcgcaggtgcgactcc

SEQ ID NO: 478150 - DNA, 25 bp, Rattus norvegicus
cggcggcacccactagaaataaata

SEQ ID NO: 478151 - DNA, 25 bp, Rattus norvegicus
ggtagctcggcgttctcacctacga

SEQ ID NO: 478152 - DNA, 25 bp, Rattus norvegicus
cgtccgccatcttgtaggcaccaga

SEQ ID NO: 478153 - DNA, 25 bp, Rattus norvegicus
tgatgaggctgtccacgttcagctc

SEQ ID NO: 478154 - DNA, 25 bp, Rattus norvegicus
tcaccctccagcaggcgggtgatga

SEQ ID NO: 478155 - DNA, 25 bp, Rattus norvegicus
aaggctgtaccggtcgatgggcctc

SEQ ID NO: 478156 - DNA, 25 bp, Rattus norvegicus
cgcctctccggaaggctgtaccggt

SEQ ID NO: 478157 - DNA, 25 bp, Rattus norvegicus
tcacctacgagtcacgcggcgtttc

SEQ ID NO: 478158 - DNA, 25 bp, Rattus norvegicus
tgcccatttttcactcagagcctgc

SEQ ID NO: 478159 - DNA, 25 bp, Rattus norvegicus
aaaatcgcagcctgaagaccagacg

SEQ ID NO: 478160 - DNA, 25 bp, Rattus norvegicus
tttggccttccaattaatttgctaa

SEQ ID NO: 478161 - DNA, 25 bp, Rattus norvegicus
tgttttggccttccaattaatttgc

SEQ ID NO: 478162 - DNA, 25 bp, Rattus norvegicus
atttttcactcagagcctgcctgcc

SEQ ID NO: 478163 - DNA, 25 bp, Rattus norvegicus
aggcctgcccatttttcactcagag

SEQ ID NO: 478164 - DNA, 25 bp, Rattus norvegicus
ggcaggcctgcccatttttcactca

SEQ ID NO: 478165 - DNA, 25 bp, Rattus norvegicus
gcggggcaggcctgcccatttttca

SEQ ID NO: 478166 - DNA, 25 bp, Rattus norvegicus
acgcaccgggcacccgcgccaccct

SEQ ID NO: 478167 - DNA, 25 bp, Rattus norvegicus
gtgcagcgggcgtcctggacgcacc

SEQ ID NO: 478168 - DNA, 25 bp, Rattus norvegicus
ccgtgcgcagtcgtccgcaccctca

SEQ ID NO: 478169 - DNA, 25 bp, Rattus norvegicus
ctgaagaccagacgggcggctcagt

SEQ ID NO: 478170 - DNA, 25 bp, Rattus norvegicus
atcgcagcctgaagaccagacgggc

SEQ ID NO: 478171 - DNA, 25 bp, Rattus norvegicus
tgcccactgcttcccctttgagtgt

SEQ ID NO: 478172 - DNA, 25 bp, Rattus norvegicus
gacgtctgcagagcatcacggaatc

SEQ ID NO: 478173 - DNA, 25 bp, Rattus norvegicus
cgaggtggccagacttcgcatttct

SEQ ID NO: 478174 - DNA, 25 bp, Rattus norvegicus
cgggtcctcgatcgccctagagaaa

SEQ ID NO: 478175 - DNA, 25 bp, Rattus norvegicus
cacagtccttccagtaacgcggggc

SEQ ID NO: 478176 - DNA, 25 bp, Rattus norvegicus
taatcgtgagcttctgggtctctcc

SEQ ID NO: 478177 - DNA, 25 bp, Rattus norvegicus
cacggaatctgtgctgatgcaagtc

SEQ ID NO: 478178 - DNA, 25 bp, Rattus norvegicus
cagcagcaggaatagacgcactttt

SEQ ID NO: 478179 - DNA, 25 bp, Rattus norvegicus
ctaggaaccgcgtgtcacagcagca

SEQ ID NO: 478180 - DNA, 25 bp, Rattus norvegicus
tttgacgcaaaacggatcagccctt

SEQ ID NO: 478181 - DNA, 25 bp, Rattus norvegicus
tacgcgcctctctcagcaggactga

SEQ ID NO: 478182 - DNA, 25 bp, Rattus norvegicus
cctgcctgagtgtttacgcgcctct

SEQ ID NO: 478183 - DNA, 25 bp, Rattus norvegicus
gcagctgcccttacagcagaatgtg

SEQ ID NO: 478184 - DNA, 25 bp, Rattus norvegicus
ctcggggtcattgtttacagttata

SEQ ID NO: 478185 - DNA, 25 bp, Rattus norvegicus
tgcagctctgctgactggcgaacgt

SEQ ID NO: 478186 - DNA, 25 bp, Rattus norvegicus
cggctcttgagggaatccgcgtgct

SEQ ID NO: 478187 - DNA, 25 bp, Rattus norvegicus
tttcgggcattagagtgggcgaccc

SEQ ID NO: 478188 - DNA, 25 bp, Rattus norvegicus
ggcgactagacagggtacaggttac

SEQ ID NO: 478189 - DNA, 25 bp, Rattus norvegicus
caccttggcgcgctctgtgattctt

SEQ ID NO: 478190 - DNA, 25 bp, Rattus norvegicus
ggcatctttggaacgcgggccttct

SEQ ID NO: 478191 - DNA, 25 bp, Rattus norvegicus
ggttcctgcatgaccgacctggtca

SEQ ID NO: 478192 - DNA, 25 bp, Rattus norvegicus
ggcgacccgcacaggcgtgtgaaac

SEQ ID NO: 478193 - DNA, 25 bp, Rattus norvegicus
ccagaggaaccagggccagccaaaa

SEQ ID NO: 478194 - DNA, 25 bp, Rattus norvegicus
gtccgatcagtaaccggcgactaga

SEQ ID NO: 478195 - DNA, 25 bp, Rattus norvegicus
ggtacctggaacttaagtccgatca

SEQ ID NO: 478196 - DNA, 25 bp, Rattus norvegicus
tgcgccacctgtgcgactgagatcc

SEQ ID NO: 478197 - DNA, 25 bp, Rattus norvegicus
ggccatactcaaacacggctctctg

SEQ ID NO: 478198 - DNA, 25 bp, Rattus norvegicus
agaggctagctctctggccatactc

SEQ ID NO: 478199 - DNA, 25 bp, Rattus norvegicus
cgcgggccttctcttgaagaggcta

SEQ ID NO: 478200 - DNA, 25 bp, Rattus norvegicus
cgccaggtcctccacccaccgggct

SEQ ID NO: 478201 - DNA, 25 bp, Rattus norvegicus
cctgacaccgacttacaagagacgg

SEQ ID NO: 478202 - DNA, 25 bp, Rattus norvegicus
ccgcctgacaccgacttacaagaga

SEQ ID NO: 478203 - DNA, 25 bp, Rattus norvegicus
cgacttacaagagacggcagaaagc

SEQ ID NO: 478204 - DNA, 25 bp, Rattus norvegicus
gcagtgggcgacagagctcccaccg

SEQ ID NO: 478205 - DNA, 25 bp, Rattus norvegicus
tgggcgacagagctcccaccgcctc

SEQ ID NO: 478206 - DNA, 25 bp, Rattus norvegicus
gacctgcgagtcaccgcctcggccc

SEQ ID NO: 478207 - DNA, 25 bp, Rattus norvegicus
acaagagacggcagaaagcagcatg

SEQ ID NO: 478208 - DNA, 25 bp, Rattus norvegicus
ggcagaaagcagcatggcgtccgta

SEQ ID NO: 478209 - DNA, 25 bp, Rattus norvegicus
agaaagcagcatggcgtccgtaccc

SEQ ID NO: 478210 - DNA, 25 bp, Rattus norvegicus
acaccgacttacaagagacggcaga

SEQ ID NO: 478211 - DNA, 25 bp, Rattus norvegicus
cccgggacctgcgagtcaccgcctc

SEQ ID NO: 478212 - DNA, 25 bp, Rattus norvegicus
tcctcaccagactcggaggcccgcc

SEQ ID NO: 478213 - DNA, 25 bp, Rattus norvegicus
tgccgcctgacaccgacttacaaga

SEQ ID NO: 478214 - DNA, 25 bp, Rattus norvegicus
tcgcagaggtgtctgcaacgcaccc

SEQ ID NO: 478215 - DNA, 25 bp, Rattus norvegicus
tctcaagtctgtgctcagggtgacc

SEQ ID NO: 478216 - DNA, 25 bp, Rattus norvegicus
gacttgggtctcaagtctgtgctca

SEQ ID NO: 478217 - DNA, 25 bp, Rattus norvegicus
ccacagatctgggacttgggtctca

SEQ ID NO: 478218 - DNA, 25 bp, Rattus norvegicus
actgcgaaagtccacagatctggga

SEQ ID NO: 478219 - DNA, 25 bp, Rattus norvegicus
gacgcactgcgaaagtccacagatc

SEQ ID NO: 478220 - DNA, 25 bp, Rattus norvegicus
gcgggacgcactgcgaaagtccaca

SEQ ID NO: 478221 - DNA, 25 bp, Rattus norvegicus
ggcgacacgccatccctctactccg

SEQ ID NO: 478222 - DNA, 25 bp, Rattus norvegicus
ctggcgtcgcagaggtgtctgcaac

SEQ ID NO: 478223 - DNA, 25 bp, Rattus norvegicus
caagtctgtgctcagggtgacccag

SEQ ID NO: 478224 - DNA, 25 bp, Rattus norvegicus
tttcaagctggcgtcgcagaggtgt

SEQ ID NO: 478225 - DNA, 25 bp, Rattus norvegicus
cggctttcaagctggcgtcgcagag

SEQ ID NO: 478226 - DNA, 25 bp, Rattus norvegicus
cccagggtggtccagtgggacgtct

SEQ ID NO: 478227 - DNA, 25 bp, Rattus norvegicus
agactggaggaagtgggaccttaag

SEQ ID NO: 478228 - DNA, 25 bp, Rattus norvegicus
atgctaacggaaagcgaaagtcttg

SEQ ID NO: 478229 - DNA, 25 bp, Rattus norvegicus
cccgggctatgaaaggagccctgcg

SEQ ID NO: 478230 - DNA, 25 bp, Rattus norvegicus
atgaaaggagccctgcgtggggtcc

SEQ ID NO: 478231 - DNA, 25 bp, Rattus norvegicus
cgtggggtcctgacaccccgagacg

SEQ ID NO: 478232 - DNA, 25 bp, Rattus norvegicus
cgagacgcccgtgtccctcgcgcag

SEQ ID NO: 478233 - DNA, 25 bp, Rattus norvegicus
cccggagacatagtgcccgcaaagg

SEQ ID NO: 478234 - DNA, 25 bp, Rattus norvegicus
cggagacatagtgcccgcaaaggcg

SEQ ID NO: 478235 - DNA, 25 bp, Rattus norvegicus
catagtgcccgcaaaggcggtgacg

SEQ ID NO: 478236 - DNA, 25 bp, Rattus norvegicus
cggtgacggcggtgcgcccactcat

SEQ ID NO: 478237 - DNA, 25 bp, Rattus norvegicus
cggtgcgcccactcatcatggtgag

SEQ ID NO: 478238 - DNA, 25 bp, Rattus norvegicus
ggagagatgctaacggaaagcgaaa

SEQ ID NO: 478239 - DNA, 25 bp, Rattus norvegicus
cggaaagcgaaagtcttgaggatgc

SEQ ID NO: 478240 - DNA, 25 bp, Rattus norvegicus
cgtgcgcagaggctcgggctgaccc

SEQ ID NO: 478241 - DNA, 25 bp, Rattus norvegicus
gcccactcatcatggtgagcgcagc

SEQ ID NO: 478242 - DNA, 25 bp, Rattus norvegicus
acaccaacagacacacggggagctc

SEQ ID NO: 478243 - DNA, 25 bp, Rattus norvegicus
aattggccggaatagccaaaccgcg

SEQ ID NO: 478244 - DNA, 25 bp, Rattus norvegicus
tttagagctgcaattggccggaata

SEQ ID NO: 478245 - DNA, 25 bp, Rattus norvegicus
tccggcctctctgagtttagagctg

SEQ ID NO: 478246 - DNA, 25 bp, Rattus norvegicus
acgatccggcctctctgagtttaga

SEQ ID NO: 478247 - DNA, 25 bp, Rattus norvegicus
attggtcggacgatccggcctctct

SEQ ID NO: 478248 - DNA, 25 bp, Rattus norvegicus
tagggctacgattggtcggacgatc

SEQ ID NO: 478249 - DNA, 25 bp, Rattus norvegicus
tggtagaaaaatccgccctcttgcg

SEQ ID NO: 478250 - DNA, 25 bp, Rattus norvegicus
aagggctgtgattggtagaaaaatc

SEQ ID NO: 478251 - DNA, 25 bp, Rattus norvegicus
ctcgctgcattaagggctgtgattg

SEQ ID NO: 478252 - DNA, 25 bp, Rattus norvegicus
ctgcggactcgctgcattaagggct

SEQ ID NO: 478253 - DNA, 25 bp, Rattus norvegicus
accactcacagatgggcctgcgggc

SEQ ID NO: 478254 - DNA, 25 bp, Rattus norvegicus
agacacacggggagctccggagccc

SEQ ID NO: 478255 - DNA, 25 bp, Rattus norvegicus
ccctcttgcgtatagggctacgatt

SEQ ID NO: 478256 - DNA, 25 bp, Rattus norvegicus
cgggaaaggagtcacgtgacgactc

SEQ ID NO: 478257 - DNA, 25 bp, Rattus norvegicus
gctcgacagctctatctctaaagta

SEQ ID NO: 478258 - DNA, 25 bp, Rattus norvegicus
tctctaaagtatatggtcacaccaa

SEQ ID NO: 478259 - DNA, 25 bp, Rattus norvegicus
accaagaaactcacggcggtgactg

SEQ ID NO: 478260 - DNA, 25 bp, Rattus norvegicus
ctcacggcggtgactgcaccgagtc

SEQ ID NO: 478261 - DNA, 25 bp, Rattus norvegicus
gcaccgagtctggaagacatcactc

SEQ ID NO: 478262 - DNA, 25 bp, Rattus norvegicus
cacgcctaacaatttcacccaaggg

SEQ ID NO: 478263 - DNA, 25 bp, Rattus norvegicus
aatttcacccaagggctccggccag

SEQ ID NO: 478264 - DNA, 25 bp, Rattus norvegicus
tcgcctctcccggatgtggtctcgg

SEQ ID NO: 478265 - DNA, 25 bp, Rattus norvegicus
ttccagacaagggagtagggacgcc

SEQ ID NO: 478266 - DNA, 25 bp, Rattus norvegicus
ttctgaacatctacttccgcctagc

SEQ ID NO: 478267 - DNA, 25 bp, Rattus norvegicus
gacgactcgtcttcggcttccattg

SEQ ID NO: 478268 - DNA, 25 bp, Rattus norvegicus
cgtgttctcggctcgacagctctat

SEQ ID NO: 478269 - DNA, 25 bp, Rattus norvegicus
cggcgactagccctgttctgaacat

SEQ ID NO: 478270 - DNA, 25 bp, Rattus norvegicus
ccataaactacgcttcccgagttgc

SEQ ID NO: 478271 - DNA, 25 bp, Rattus norvegicus
cgggagcgacctgagctgggctctg

SEQ ID NO: 478272 - DNA, 25 bp, Rattus norvegicus
gctccatgaatggaagcggcggcgg

SEQ ID NO: 478273 - DNA, 25 bp, Rattus norvegicus
acggaggtaccagctggtcttcgga

SEQ ID NO: 478274 - DNA, 25 bp, Rattus norvegicus
ggtacggaggtaccagctggtcttc

SEQ ID NO: 478275 - DNA, 25 bp, Rattus norvegicus
cttcccgagttgctctgcggtggcg

SEQ ID NO: 478276 - DNA, 25 bp, Rattus norvegicus
ctacgcttcccgagttgctctgcgg

SEQ ID NO: 478277 - DNA, 25 bp, Rattus norvegicus
gtctatattccataaactacgcttc

SEQ ID NO: 478278 - DNA, 25 bp, Rattus norvegicus
gctcccgtctatattccataaacta

SEQ ID NO: 478279 - DNA, 25 bp, Rattus norvegicus
tgcgctcccgtctatattccataaa

SEQ ID NO: 478280 - DNA, 25 bp, Rattus norvegicus
gctgcgctcccgtctatattccata

SEQ ID NO: 478281 - DNA, 25 bp, Rattus norvegicus
tattccataaactacgcttcccgag

SEQ ID NO: 478282 - DNA, 25 bp, Rattus norvegicus
acgcttcccgagttgctctgcggtg

SEQ ID NO: 478283 - DNA, 25 bp, Rattus norvegicus
taaactacgcttcccgagttgctct

SEQ ID NO: 478284 - DNA, 25 bp, Rattus norvegicus
ctagcagctcctcaccacgtaggtg

SEQ ID NO: 478285 - DNA, 25 bp, Rattus norvegicus
tgtggtcatgccaacccagcagcca

SEQ ID NO: 478286 - DNA, 25 bp, Rattus norvegicus
ctgtcctttgatcctgccgcgcagt

SEQ ID NO: 478287 - DNA, 25 bp, Rattus norvegicus
ccgctgttcccagaagggtgactga

SEQ ID NO: 478288 - DNA, 25 bp, Rattus norvegicus
gtttacacgatctagggcgcagccc

SEQ ID NO: 478289 - DNA, 25 bp, Rattus norvegicus
tgccgccaggtttcttcgcatcgcg

SEQ ID NO: 478290 - DNA, 25 bp, Rattus norvegicus
ctaggacccacagtcatggctgcgg

SEQ ID NO: 478291 - DNA, 25 bp, Rattus norvegicus
gacccagtgcacgtcggaagttgta

SEQ ID NO: 478292 - DNA, 25 bp, Rattus norvegicus
caacatctcttggtcgtcgtcgcga

SEQ ID NO: 478293 - DNA, 25 bp, Rattus norvegicus
ccggagactatcctagttgggaact

SEQ ID NO: 478294 - DNA, 25 bp, Rattus norvegicus
aagctgtaagacgtcggctctgcga

SEQ ID NO: 478295 - DNA, 25 bp, Rattus norvegicus
cctgaactccgaggtgggaaagctg

SEQ ID NO: 478296 - DNA, 25 bp, Rattus norvegicus
tccgcagcccagttcgccattttgg

SEQ ID NO: 478297 - DNA, 25 bp, Rattus norvegicus
ttccctaaggcagagctccgtacta

SEQ ID NO: 478298 - DNA, 25 bp, Rattus norvegicus
agccacgccacagcttgagggagtc

SEQ ID NO: 478299 - DNA, 25 bp, Rattus norvegicus
cggcgccatcttcgaacttggactt

SEQ ID NO: 478300 - DNA, 25 bp, Rattus norvegicus
gggaacgcattccagaccaagattg

SEQ ID NO: 478301 - DNA, 25 bp, Rattus norvegicus
gcgacagctaaagcgcgacactttc

SEQ ID NO: 478302 - DNA, 25 bp, Rattus norvegicus
ccttccggtcgctgaaattcccaga

SEQ ID NO: 478303 - DNA, 25 bp, Rattus norvegicus
gcgccgcgctgcattatggaacaca

SEQ ID NO: 478304 - DNA, 25 bp, Rattus norvegicus
ctcgttacgttgagcctttggacgc

SEQ ID NO: 478305 - DNA, 25 bp, Rattus norvegicus
cgcgctgcttacgttgaactcgtta

SEQ ID NO: 478306 - DNA, 25 bp, Rattus norvegicus
actcggcgtatgtagcgcggcaatc

SEQ ID NO: 478307 - DNA, 25 bp, Rattus norvegicus
tctgccagccggtcttaccttctta

SEQ ID NO: 478308 - DNA, 25 bp, Rattus norvegicus
aggcagcgcgccttctagcctttgc

SEQ ID NO: 478309 - DNA, 25 bp, Rattus norvegicus
ccgtagcgctaaggcaatgggaaca

SEQ ID NO: 478310 - DNA, 25 bp, Rattus norvegicus
ctcccattcttttgccgtagcgcta

SEQ ID NO: 478311 - DNA, 25 bp, Rattus norvegicus
cggcaaggttgctggtgaagccaca

SEQ ID NO: 478312 - DNA, 25 bp, Rattus norvegicus
ttgctgcttctggttcagctgcgcc

SEQ ID NO: 478313 - DNA, 25 bp, Rattus norvegicus
acgctcctggtagcgttgctgcttc

SEQ ID NO: 478314 - DNA, 25 bp, Rattus norvegicus
cggcgaatgtggtccaggatccgaa

SEQ ID NO: 478315 - DNA, 25 bp, Rattus norvegicus
gtccgcgcactcctcttgctgttag

SEQ ID NO: 478316 - DNA, 25 bp, Rattus norvegicus
ctgcggaccctgctagagctagctc

SEQ ID NO: 478317 - DNA, 25 bp, Rattus norvegicus
aggatccgaatctgcgatggaaccc

SEQ ID NO: 478318 - DNA, 25 bp, Rattus norvegicus
ctagagctagctcggacacagagcc

SEQ ID NO: 478319 - DNA, 25 bp, Rattus norvegicus
gacacagagccagcgcgagcgcgca

SEQ ID NO: 478320 - DNA, 25 bp, Rattus norvegicus
gcgcgcagagcagaaccgcatcata

SEQ ID NO: 478321 - DNA, 25 bp, Rattus norvegicus
cgcatcatattcgattcggtgggca

SEQ ID NO: 478322 - DNA, 25 bp, Rattus norvegicus
ccgtatggggtccagaaagccttga

SEQ ID NO: 478323 - DNA, 25 bp, Rattus norvegicus
cgcgcacaaccggagctggctcagt

SEQ ID NO: 478324 - DNA, 25 bp, Rattus norvegicus
cgagcggcaacgacgagacgacccg

SEQ ID NO: 478325 - DNA, 25 bp, Rattus norvegicus
ctcttgctgttagcggagcgcttcc

SEQ ID NO: 478326 - DNA, 25 bp, Rattus norvegicus
gctcgctggtttagctggacagaca

SEQ ID NO: 478327 - DNA, 25 bp, Rattus norvegicus
tcgtcatcgaccgaggcgtgtctaa

SEQ ID NO: 478328 - DNA, 25 bp, Rattus norvegicus
tatgtcctcctgagacgcaagccga

SEQ ID NO: 478329 - DNA, 25 bp, Rattus norvegicus
ttgggtccggcacctgccaatatcg

SEQ ID NO: 478330 - DNA, 25 bp, Rattus norvegicus
cttccagacacggtgtggctttctc

SEQ ID NO: 478331 - DNA, 25 bp, Rattus norvegicus
attgttgtcatgctccctgttgtcg

SEQ ID NO: 478332 - DNA, 25 bp, Rattus norvegicus
gtgtctaagccggttcctcattctg

SEQ ID NO: 478333 - DNA, 25 bp, Rattus norvegicus
ggggagctagcacactgatctctga

SEQ ID NO: 478334 - DNA, 25 bp, Rattus norvegicus
ggccacttaagcaccagcgccattg

SEQ ID NO: 478335 - DNA, 25 bp, Rattus norvegicus
ctccagggcaagcagtaaatttaga

SEQ ID NO: 478336 - DNA, 25 bp, Rattus norvegicus
acctttgctctgacatgggccgaca

SEQ ID NO: 478337 - DNA, 25 bp, Rattus norvegicus
tccaggacatgcagacagggttttc

SEQ ID NO: 478338 - DNA, 25 bp, Rattus norvegicus
gcccgctgcccggtttgtataatcc

SEQ ID NO: 478339 - DNA, 25 bp, Rattus norvegicus
atcccagaggaagccattgttgtca

SEQ ID NO: 478340 - DNA, 25 bp, Rattus norvegicus
ttctcgcggcctggcgaagcaagtc

SEQ ID NO: 478341 - DNA, 25 bp, Rattus norvegicus
gtattcccggctccgcacagacggg

SEQ ID NO: 478342 - DNA, 25 bp, Rattus norvegicus
gctcggagaccacccgcctagtgag

SEQ ID NO: 478343 - DNA, 25 bp, Rattus norvegicus
atgtccgcattgctctgtgcgccgc

SEQ ID NO: 478344 - DNA, 25 bp, Rattus norvegicus
aggcagcggggacatggaaccttct

SEQ ID NO: 478345 - DNA, 25 bp, Rattus norvegicus
tctgccctgccatctcgagtggcca

SEQ ID NO: 478346 - DNA, 25 bp, Rattus norvegicus
acatggaaccttctccggccagcgg

SEQ ID NO: 478347 - DNA, 25 bp, Rattus norvegicus
cctgcgattgaagaggtaggacaga

SEQ ID NO: 478348 - DNA, 25 bp, Rattus norvegicus
taggacagacttgggctggccgtca

SEQ ID NO: 478349 - DNA, 25 bp, Rattus norvegicus
gggccgccagactgatgccatcggt

SEQ ID NO: 478350 - DNA, 25 bp, Rattus norvegicus
ctgatgccatcggtccatttcgttg

SEQ ID NO: 478351 - DNA, 25 bp, Rattus norvegicus
atttcgttgtctcccttggcgcggg

SEQ ID NO: 478352 - DNA, 25 bp, Rattus norvegicus
aggtgcggcgatgtccgcattgctc

SEQ ID NO: 478353 - DNA, 25 bp, Rattus norvegicus
tcggtccatttcgttgtctcccttg

SEQ ID NO: 478354 - DNA, 25 bp, Rattus norvegicus
agcgtagtgagctgaagcacgactg

SEQ ID NO: 478355 - DNA, 25 bp, Rattus norvegicus
accgcgcgccggagttggtccacgt

SEQ ID NO: 478356 - DNA, 25 bp, Rattus norvegicus
ctgaagcacgactgcgacggcgcag

SEQ ID NO: 478357 - DNA, 25 bp, Rattus norvegicus
tgagctgaagcacgactgcgacggc

SEQ ID NO: 478358 - DNA, 25 bp, Rattus norvegicus
ggcgagccccactggaaccaagcaa

SEQ ID NO: 478359 - DNA, 25 bp, Rattus norvegicus
agcagtcgacacagcggccccgaag

SEQ ID NO: 478360 - DNA, 25 bp, Rattus norvegicus
gaagggccggccctgcagcaccgac

SEQ ID NO: 478361 - DNA, 25 bp, Rattus norvegicus
ctgcagcaccgacccgtcctccaac

SEQ ID NO: 478362 - DNA, 25 bp, Rattus norvegicus
agcggcaagctggagccctaagcgt

SEQ ID NO: 478363 - DNA, 25 bp, Rattus norvegicus
ccgccatcgggtcggagctgaggca

SEQ ID NO: 478364 - DNA, 25 bp, Rattus norvegicus
ccctaagcgtagtgagctgaagcac

SEQ ID NO: 478365 - DNA, 25 bp, Rattus norvegicus
caagctggagccctaagcgtagtga

SEQ ID NO: 478366 - DNA, 25 bp, Rattus norvegicus
ctggagccctaagcgtagtgagctg

SEQ ID NO: 478367 - DNA, 25 bp, Rattus norvegicus
agttggtccacgtggctcgctgcgc

SEQ ID NO: 478368 - DNA, 25 bp, Rattus norvegicus
attctgggcccttgtccgcgctccc

SEQ ID NO: 478369 - DNA, 25 bp, Rattus norvegicus
tcgcggaattctgggcccttgtccg

SEQ ID NO: 478370 - DNA, 25 bp, Rattus norvegicus
ggctgctcgcggaattctgggccct

SEQ ID NO: 478371 - DNA, 25 bp, Rattus norvegicus
ctctcgagcgccgcgtgatgtgccg

SEQ ID NO: 478372 - DNA, 25 bp, Rattus norvegicus
cccatgcatgcgctctcgagcgccg

SEQ ID NO: 478373 - DNA, 25 bp, Rattus norvegicus
gctcccccgcgcttgttcgtggtgg

SEQ ID NO: 478374 - DNA, 25 bp, Rattus norvegicus
caaatccctgtcactctggggcgtg

SEQ ID NO: 478375 - DNA, 25 bp, Rattus norvegicus
ccttgaggcgtggtttagctcccaa

SEQ ID NO: 478376 - DNA, 25 bp, Rattus norvegicus
ggtttagctcccaaatccctgtcac

SEQ ID NO: 478377 - DNA, 25 bp, Rattus norvegicus
gcgtggtttagctcccaaatccctg

SEQ ID NO: 478378 - DNA, 25 bp, Rattus norvegicus
tgaggcgtggtttagctcccaaatc

SEQ ID NO: 478379 - DNA, 25 bp, Rattus norvegicus
agcgtgtcacgcctccgccttgagg

SEQ ID NO: 478380 - DNA, 25 bp, Rattus norvegicus
cgcctccgccttgaggcgtggttta

SEQ ID NO: 478381 - DNA, 25 bp, Rattus norvegicus
atccctgtcactctggggcgtggcc

SEQ ID NO: 478382 - DNA, 25 bp, Rattus norvegicus
gcacttagttgccttgagctactgc

SEQ ID NO: 478383 - DNA, 25 bp, Rattus norvegicus
cgtggtggaatgacccaacatctct

SEQ ID NO: 478384 - DNA, 25 bp, Rattus norvegicus
ctctccattcttcctgtagcgcagg

SEQ ID NO: 478385 - DNA, 25 bp, Rattus norvegicus
attcttcctgtagcgcaggcctgtc

SEQ ID NO: 478386 - DNA, 25 bp, Rattus norvegicus
gcgcaggcctgtccacttagcactt

SEQ ID NO: 478387 - DNA, 25 bp, Rattus norvegicus
ggcctgtccacttagcacttagttg

SEQ ID NO: 478388 - DNA, 25 bp, Rattus norvegicus
gccttgagctactgcaagttccctc

SEQ ID NO: 478389 - DNA, 25 bp, Rattus norvegicus
ccgggaacttcctcagctccatccg

SEQ ID NO: 478390 - DNA, 25 bp, Rattus norvegicus
gctccatccgcccttagtaaacatg

SEQ ID NO: 478391 - DNA, 25 bp, Rattus norvegicus
cccttagtaaacatggcgttgcggc

SEQ ID NO: 478392 - DNA, 25 bp, Rattus norvegicus
gtaaacatggcgttgcggcgaaccg

SEQ ID NO: 478393 - DNA, 25 bp, Rattus norvegicus
tgtcaccaagccaggcgctgcaagc

SEQ ID NO: 478394 - DNA, 25 bp, Rattus norvegicus
gcttgttcgtggtggaatgacccaa

SEQ ID NO: 478395 - DNA, 25 bp, Rattus norvegicus
actgcaagttccctcagcccgggaa

SEQ ID NO: 478396 - DNA, 25 bp, Rattus norvegicus
gctcggctcatcgtggagaagtacc

SEQ ID NO: 478397 - DNA, 25 bp, Rattus norvegicus
gctgcacgagtgcaagacgctgttc

SEQ ID NO: 478398 - DNA, 25 bp, Rattus norvegicus
agtccactctggctcggctcatcgt

SEQ ID NO: 478399 - DNA, 25 bp, Rattus norvegicus
gagaagtaccacaacggcaccaaga

SEQ ID NO: 478400 - DNA, 25 bp, Rattus norvegicus
caccaagatggtgtctgctgatgct

SEQ ID NO: 478401 - DNA, 25 bp, Rattus norvegicus
ggtgtctgctgatgcttacaagatc

SEQ ID NO: 478402 - DNA, 25 bp, Rattus norvegicus
tacaagatcattcctggctctcggg

SEQ ID NO: 478403 - DNA, 25 bp, Rattus norvegicus
ctggctctcgggcagacttctccga

SEQ ID NO: 478404 - DNA, 25 bp, Rattus norvegicus
cttctccgaggagtacaagcgtctg

SEQ ID NO: 478405 - DNA, 25 bp, Rattus norvegicus
caagcgtctggacgaggacctggct

SEQ ID NO: 478406 - DNA, 25 bp, Rattus norvegicus
actgccgccgggacatcagggttct

SEQ ID NO: 478407 - DNA, 25 bp, Rattus norvegicus
tcagggttcttgtgctcgatgacac

SEQ ID NO: 478408 - DNA, 25 bp, Rattus norvegicus
tcgatgacaccaaccatgagcggga

SEQ ID NO: 478409 - DNA, 25 bp, Rattus norvegicus
aagacgctgttcatcctgcgtggcc

SEQ ID NO: 478410 - DNA, 25 bp, Rattus norvegicus
aggaggcagctctgtacgccagcaa

SEQ ID NO: 478411 - DNA, 25 bp, Rattus norvegicus
ccggaggatgcttggtcgccgccaa

SEQ ID NO: 478412 - DNA, 25 bp, Rattus norvegicus
gcacgcacagctgcgcccgcgggac

SEQ ID NO: 478413 - DNA, 25 bp, Rattus norvegicus
tcacggcacctgacacgccgaggcg

SEQ ID NO: 478414 - DNA, 25 bp, Rattus norvegicus
ctcccgcgcttctcacggcacctga

SEQ ID NO: 478415 - DNA, 25 bp, Rattus norvegicus
ctgggaagtcggctccagtcatctc

SEQ ID NO: 478416 - DNA, 25 bp, Rattus norvegicus
cgccgcttctgggaagtcggctcca

SEQ ID NO: 478417 - DNA, 25 bp, Rattus norvegicus
gctgtgccttgcgtgcgccgcttct

SEQ ID NO: 478418 - DNA, 25 bp, Rattus norvegicus
tgtcgcctccccattgcgtgcggag

SEQ ID NO: 478419 - DNA, 25 bp, Rattus norvegicus
tgaaaagtttctgctgtcgcctccc

SEQ ID NO: 478420 - DNA, 25 bp, Rattus norvegicus
ttgggttgaaaagtttctgctgtcg

SEQ ID NO: 478421 - DNA, 25 bp, Rattus norvegicus
tacgccagcaaacggttgggttgaa

SEQ ID NO: 478422 - DNA, 25 bp, Rattus norvegicus
aggatgcttggtcgccgccaacttg

SEQ ID NO: 478423 - DNA, 25 bp, Rattus norvegicus
gctctgtacgccagcaaacggttgg

SEQ ID NO: 478424 - DNA, 25 bp, Rattus norvegicus
aaggtagcgcttccgcagagcggca

SEQ ID NO: 478425 - DNA, 25 bp, Rattus norvegicus
gaaccaccgacgcaaggaaggtagc

SEQ ID NO: 478426 - DNA, 25 bp, Rattus norvegicus
gctgatttcggaaagaacgaaggaa

SEQ ID NO: 478427 - DNA, 25 bp, Rattus norvegicus
ccaatgctgatttcggaaagaacga

SEQ ID NO: 478428 - DNA, 25 bp, Rattus norvegicus
ggaaaaaaccaatgctgatttcgga

SEQ ID NO: 478429 - DNA, 25 bp, Rattus norvegicus
agacgctttcttaactcctgttctt

SEQ ID NO: 478430 - DNA, 25 bp, Rattus norvegicus
accgacgcaaggaaggtagcgcttc

SEQ ID NO: 478431 - DNA, 25 bp, Rattus norvegicus
cgcggagcgggaaagacgctttctt

SEQ ID NO: 478432 - DNA, 25 bp, Rattus norvegicus
ttccaagcccgggcaaggacgcgga

SEQ ID NO: 478433 - DNA, 25 bp, Rattus norvegicus
taatgttgcgtagtgttccaagccc

SEQ ID NO: 478434 - DNA, 25 bp, Rattus norvegicus
gaacccttcaccttaatgttgcgta

SEQ ID NO: 478435 - DNA, 25 bp, Rattus norvegicus
agcctgggaacccttcaccttaatg

SEQ ID NO: 478436 - DNA, 25 bp, Rattus norvegicus
caggaggacacgagcctgggaaccc

SEQ ID NO: 478437 - DNA, 25 bp, Rattus norvegicus
caaacgctggcaggaggacacgagc

SEQ ID NO: 478438 - DNA, 25 bp, Rattus norvegicus
gcagatcggctacctgcggtgatta

SEQ ID NO: 478439 - DNA, 25 bp, Rattus norvegicus
tcattcgaggttaggaaccggatcc

SEQ ID NO: 478440 - DNA, 25 bp, Rattus norvegicus
gatccgaagccagggttccgtgaca

SEQ ID NO: 478441 - DNA, 25 bp, Rattus norvegicus
tcccgctagtgctgacgcagattgg

SEQ ID NO: 478442 - DNA, 25 bp, Rattus norvegicus
gcactgaacgcctgcgagacccagt

SEQ ID NO: 478443 - DNA, 25 bp, Rattus norvegicus
cccaagactggactgctcatcgctg

SEQ ID NO: 478444 - DNA, 25 bp, Rattus norvegicus
caaatccacagtgctgagaggggtc

SEQ ID NO: 478445 - DNA, 25 bp, Rattus norvegicus
agtcttccgggaaactgtagcacca

SEQ ID NO: 478446 - DNA, 25 bp, Rattus norvegicus
gtagcaccaagttccgcagcttttg

SEQ ID NO: 478447 - DNA, 25 bp, Rattus norvegicus
gttcccgttgtacgcgcttcggata

SEQ ID NO: 478448 - DNA, 25 bp, Rattus norvegicus
ggagctgccaagaccggcataaaga

SEQ ID NO: 478449 - DNA, 25 bp, Rattus norvegicus
tataccgtggccgagggcgattcca

SEQ ID NO: 478450 - DNA, 25 bp, Rattus norvegicus
cagattggcgtactgcgcttgcgca

SEQ ID NO: 478451 - DNA, 25 bp, Rattus norvegicus
caaggccactgggaacaggttatac

SEQ ID NO: 478452 - DNA, 25 bp, Rattus norvegicus
gcgcggtgcctataacgcgcacgaa

SEQ ID NO: 478453 - DNA, 25 bp, Rattus norvegicus
cggtggccctcctgtggctgtcgct

SEQ ID NO: 478454 - DNA, 25 bp, Rattus norvegicus
tcctgtggctgtcgctcgctccgga

SEQ ID NO: 478455 - DNA, 25 bp, Rattus norvegicus
gtggctgtcgctcgctccggactct

SEQ ID NO: 478456 - DNA, 25 bp, Rattus norvegicus
ccgggagggcgacgtggaatggcca

SEQ ID NO: 478457 - DNA, 25 bp, Rattus norvegicus
gcggcgcggtgcctataacgcgcac

SEQ ID NO: 478458 - DNA, 25 bp, Rattus norvegicus
cggtgcctataacgcgcacgaagcc

SEQ ID NO: 478459 - DNA, 25 bp, Rattus norvegicus
gcctataacgcgcacgaagccggag

SEQ ID NO: 478460 - DNA, 25 bp, Rattus norvegicus
ctataacgcgcacgaagccggagcc

SEQ ID NO: 478461 - DNA, 25 bp, Rattus norvegicus
tataacgcgcacgaagccggagccc

SEQ ID NO: 478462 - DNA, 25 bp, Rattus norvegicus
cccagacgcgcacagcgccgccgca

SEQ ID NO: 478463 - DNA, 25 bp, Rattus norvegicus
cagcaggtgggtcggactccggcag

SEQ ID NO: 478464 - DNA, 25 bp, Rattus norvegicus
actccggcagggaccagggcccaga

SEQ ID NO: 478465 - DNA, 25 bp, Rattus norvegicus
tggaatggccacgtggagcggcccg

SEQ ID NO: 478466 - DNA, 25 bp, Rattus norvegicus
cccgccagattagctgtgtcacatg

SEQ ID NO: 478467 - DNA, 25 bp, Rattus norvegicus
cgcgatttggcccaccctgcggaag

SEQ ID NO: 478468 - DNA, 25 bp, Rattus norvegicus
tgtgtcacatgacagggaacgctgc

SEQ ID NO: 478469 - DNA, 25 bp, Rattus norvegicus
catgacagggaacgctgccagcctt

SEQ ID NO: 478470 - DNA, 25 bp, Rattus norvegicus
aacgctgccagccttcgcggtggtt

SEQ ID NO: 478471 - DNA, 25 bp, Rattus norvegicus
gctgccagccttcgcggtggttctg

SEQ ID NO: 478472 - DNA, 25 bp, Rattus norvegicus
cagcgccacctagcggtcactgggg

SEQ ID NO: 478473 - DNA, 25 bp, Rattus norvegicus
cctgagtccgcaggcgcacttagca

SEQ ID NO: 478474 - DNA, 25 bp, Rattus norvegicus
gcgcacttagcaggagcgcaccgta

SEQ ID NO: 478475 - DNA, 25 bp, Rattus norvegicus
ttagcaggagcgcaccgtaggacca

SEQ ID NO: 478476 - DNA, 25 bp, Rattus norvegicus
aggagcgcaccgtaggaccaccagc

SEQ ID NO: 478477 - DNA, 25 bp, Rattus norvegicus
ggagcaccaaagcactcgctactct

SEQ ID NO: 478478 - DNA, 25 bp, Rattus norvegicus
gcactcgctactctacctccgcccg

SEQ ID NO: 478479 - DNA, 25 bp, Rattus norvegicus
gtgaccctgagtccgcaggcgcact

SEQ ID NO: 478480 - DNA, 25 bp, Rattus norvegicus
agctagtcaggtgagacgctcccag

SEQ ID NO: 478481 - DNA, 25 bp, Rattus norvegicus
cttgtggtcctctatcactacgtgg

SEQ ID NO: 478482 - DNA, 25 bp, Rattus norvegicus
cgtgtcgcttttcttgcttgtggtc

SEQ ID NO: 478483 - DNA, 25 bp, Rattus norvegicus
tcttcgccaacatgctgggcgtgtc

SEQ ID NO: 478484 - DNA, 25 bp, Rattus norvegicus
atcacggacgtgcagctcgccatct

SEQ ID NO: 478485 - DNA, 25 bp, Rattus norvegicus
cccttgtccacaggatgatcacgga

SEQ ID NO: 478486 - DNA, 25 bp, Rattus norvegicus
tgtccgaaccgaggctcagtccttc

SEQ ID NO: 478487 - DNA, 25 bp, Rattus norvegicus
cctacctcgagttggtgtggcagta

SEQ ID NO: 478488 - DNA, 25 bp, Rattus norvegicus
ttccggcttaggttgcctacctcga

SEQ ID NO: 478489 - DNA, 25 bp, Rattus norvegicus
gctagcactacgaagttccggctta

SEQ ID NO: 478490 - DNA, 25 bp, Rattus norvegicus
aagccggaagtgctgcgttgttccc

SEQ ID NO: 478491 - DNA, 25 bp, Rattus norvegicus
aagacctgctcattgtgcgcgcgcc

SEQ ID NO: 478492 - DNA, 25 bp, Rattus norvegicus
atcgtggtggcaaggatctagcctg

SEQ ID NO: 478493 - DNA, 25 bp, Rattus norvegicus
gctcccaggcttcgtttcacaggcg

SEQ ID NO: 478494 - DNA, 25 bp, Rattus norvegicus
gcgctcctcgctctactgtgtaaca

SEQ ID NO: 478495 - DNA, 25 bp, Rattus norvegicus
tggtcgccacgcagtgttccgtgca

SEQ ID NO: 478496 - DNA, 25 bp, Rattus norvegicus
cgggacccacacaaaaccagagagc

SEQ ID NO: 478497 - DNA, 25 bp, Rattus norvegicus
tctgccaggaaacaagaagtctctt

SEQ ID NO: 478498 - DNA, 25 bp, Rattus norvegicus
ctcttgcctattggccgcagctgca

SEQ ID NO: 478499 - DNA, 25 bp, Rattus norvegicus
ctcccgaggcgggaaagacaaagca

SEQ ID NO: 478500 - DNA, 25 bp, Rattus norvegicus
gttccgtgcacgttggcaggtacct

SEQ ID NO: 478501 - DNA, 25 bp, Rattus norvegicus
gccaccgccgtgtgaggctcagaag

SEQ ID NO: 478502 - DNA, 25 bp, Rattus norvegicus
tcagaaggcgtcttctctgtaggca

SEQ ID NO: 478503 - DNA, 25 bp, Rattus norvegicus
tgcagctggctacccgcccagtaaa

SEQ ID NO: 478504 - DNA, 25 bp, Rattus norvegicus
tgtaggcagttaacggcccgcctcc

SEQ ID NO: 478505 - DNA, 25 bp, Rattus norvegicus
aagcgcactgccattggtcgccacg

SEQ ID NO: 478506 - DNA, 25 bp, Rattus norvegicus
ggaaaagacttacctgcgaataaga

SEQ ID NO: 478507 - DNA, 25 bp, Rattus norvegicus
gtgaagccgatctttgcataccgcg

SEQ ID NO: 478508 - DNA, 25 bp, Rattus norvegicus
tttcctttgtttttcggcgtgatga

SEQ ID NO: 478509 - DNA, 25 bp, Rattus norvegicus
cggcgtgatgaaagtataaagcatg

SEQ ID NO: 478510 - DNA, 25 bp, Rattus norvegicus
ttctgatgatgcgaaagacattttc

SEQ ID NO: 478511 - DNA, 25 bp, Rattus norvegicus
tacgaatcgtgcttgctgcttctgc

SEQ ID NO: 478512 - DNA, 25 bp, Rattus norvegicus
aagcagacgttagtttcggtgtttg

SEQ ID NO: 478513 - DNA, 25 bp, Rattus norvegicus
tcggtgtttgggactacgaatcgtg

SEQ ID NO: 478514 - DNA, 25 bp, Rattus norvegicus
gctgcttctgctccaggtttccttt

SEQ ID NO: 478515 - DNA, 25 bp, Rattus norvegicus
gtggcccggattcctgctcccggtg

SEQ ID NO: 478516 - DNA, 25 bp, Rattus norvegicus
ggtccattcactgaggcccgagcca

SEQ ID NO: 478517 - DNA, 25 bp, Rattus norvegicus
aagacctagccgcaggagccagcga

SEQ ID NO: 478518 - DNA, 25 bp, Rattus norvegicus
gacattttctccgttagctgaagtg

SEQ ID NO: 478519 - DNA, 25 bp, Rattus norvegicus
cgccgtgagccgaattgaggctaaa

SEQ ID NO: 478520 - DNA, 25 bp, Rattus norvegicus
cgttcctcccgctaagcagacgtta

SEQ ID NO: 478521 - DNA, 25 bp, Rattus norvegicus
cccgagccagaagggaagacctagc

SEQ ID NO: 478522 - DNA, 25 bp, Rattus norvegicus
tgctatcagtcagcgtggccgggcc

SEQ ID NO: 478523 - DNA, 25 bp, Rattus norvegicus
ggcggcggcgaatacttacagctca

SEQ ID NO: 478524 - DNA, 25 bp, Rattus norvegicus
gcgaatacttacagctcaggtcata

SEQ ID NO: 478525 - DNA, 25 bp, Rattus norvegicus
aggtcatatttccacactccatttg

SEQ ID NO: 478526 - DNA, 25 bp, Rattus norvegicus
atttgcctctccgagtgcccggcgg

SEQ ID NO: 478527 - DNA, 25 bp, Rattus norvegicus
cgcaaggcatcctgggactcgtagt

SEQ ID NO: 478528 - DNA, 25 bp, Rattus norvegicus
actcgtagtctgttctcgtcgcgcg

SEQ ID NO: 478529 - DNA, 25 bp, Rattus norvegicus
cctgcggcgcaaaaattaccctgca

SEQ ID NO: 478530 - DNA, 25 bp, Rattus norvegicus
attaccctgcacctgcgatgcgggc

SEQ ID NO: 478531 - DNA, 25 bp, Rattus norvegicus
gtggaaatgaccacctctccttgtg

SEQ ID NO: 478532 - DNA, 25 bp, Rattus norvegicus
cccgacctatgcagtggaaatgacc

SEQ ID NO: 478533 - DNA, 25 bp, Rattus norvegicus
tccgcttcccgacctatgcagtgga

SEQ ID NO: 478534 - DNA, 25 bp, Rattus norvegicus
tctccttgtgctatcagtcagcgtg

SEQ ID NO: 478535 - DNA, 25 bp, Rattus norvegicus
cgcgaaagacggtttctctgggcct

SEQ ID NO: 478536 - DNA, 25 bp, Rattus norvegicus
caccgaggacaggagaccggcggaa

SEQ ID NO: 478537 - DNA, 25 bp, Rattus norvegicus
ggtctccggcttcaacgcaccgaga

SEQ ID NO: 478538 - DNA, 25 bp, Rattus norvegicus
ggcttcaacgcaccgagactgcggg

SEQ ID NO: 478539 - DNA, 25 bp, Rattus norvegicus
gtctccacagcaaccaggcggcgag

SEQ ID NO: 478540 - DNA, 25 bp, Rattus norvegicus
ccacagcaaccaggcggcgagagga

SEQ ID NO: 478541 - DNA, 25 bp, Rattus norvegicus
gcgagaggaggacaaccgctacctc

SEQ ID NO: 478542 - DNA, 25 bp, Rattus norvegicus
tctacacctcgtcctagcaacggcg

SEQ ID NO: 478543 - DNA, 25 bp, Rattus norvegicus
gtgcgggagccgagaacaatccctc

SEQ ID NO: 478544 - DNA, 25 bp, Rattus norvegicus
agccgagaacaatccctctagatcg

SEQ ID NO: 478545 - DNA, 25 bp, Rattus norvegicus
atccctctagatcgccatagcaacg

SEQ ID NO: 478546 - DNA, 25 bp, Rattus norvegicus
cgccatagcaacgagaagaaactga

SEQ ID NO: 478547 - DNA, 25 bp, Rattus norvegicus
cgagaagaaactgactggtaaacgt

SEQ ID NO: 478548 - DNA, 25 bp, Rattus norvegicus
tgactggtaaacgtaccgcggtatg

SEQ ID NO: 478549 - DNA, 25 bp, Rattus norvegicus
tcagcccggactcacagtgcgcgag

SEQ ID NO: 478550 - DNA, 25 bp, Rattus norvegicus
ggcctcaacgatgaagtcgaccttc

SEQ ID NO: 478551 - DNA, 25 bp, Rattus norvegicus
gcttgcctcactggcgagtcgacct

SEQ ID NO: 478552 - DNA, 25 bp, Rattus norvegicus
gtctctacgtttggagcttgcctca

SEQ ID NO: 478553 - DNA, 25 bp, Rattus norvegicus
gtctgcaagagaggcatcgtctcta

SEQ ID NO: 478554 - DNA, 25 bp, Rattus norvegicus
cgcggcaggacaagaccatgcctca

SEQ ID NO: 478555 - DNA, 25 bp, Rattus norvegicus
attaccacatcgcactccgcggtag

SEQ ID NO: 478556 - DNA, 25 bp, Rattus norvegicus
cactctgcagccgacctctgggatt

SEQ ID NO: 478557 - DNA, 25 bp, Rattus norvegicus
tcgtggctatgttaaggaagtcgtc

SEQ ID NO: 478558 - DNA, 25 bp, Rattus norvegicus
cccatccctggaggtccacggtggt

SEQ ID NO: 478559 - DNA, 25 bp, Rattus norvegicus
cgtctaccaacgagaggctccgctt

SEQ ID NO: 478560 - DNA, 25 bp, Rattus norvegicus
gctctaccgcctggttacctctttg

SEQ ID NO: 478561 - DNA, 25 bp, Rattus norvegicus
agcacttccggttggagcatcgagc

SEQ ID NO: 478562 - DNA, 25 bp, Rattus norvegicus
tcctccagcagttcaggttcggtcg

SEQ ID NO: 478563 - DNA, 25 bp, Rattus norvegicus
cctgtatcgactccgctcagatggg

SEQ ID NO: 478564 - DNA, 25 bp, Rattus norvegicus
gcaggtccggccaccagagaaaatg

SEQ ID NO: 478565 - DNA, 25 bp, Rattus norvegicus
tcagcctgggaagatcaagcccacc

SEQ ID NO: 478566 - DNA, 25 bp, Rattus norvegicus
cctcccttttgtgcgcctcaggaag

SEQ ID NO: 478567 - DNA, 25 bp, Rattus norvegicus
ctaaacatctctttcagcagctggg

SEQ ID NO: 478568 - DNA, 25 bp, Rattus norvegicus
cgtgggcgtacaaagaccctgactt

SEQ ID NO: 478569 - DNA, 25 bp, Rattus norvegicus
tttagccatttactgcacgtcgatc

SEQ ID NO: 478570 - DNA, 25 bp, Rattus norvegicus
ctttggaccacgttaggcagatatc

SEQ ID NO: 478571 - DNA, 25 bp, Rattus norvegicus
ctttgtggtttcagcaggtgcctca

SEQ ID NO: 478572 - DNA, 25 bp, Rattus norvegicus
ctgggcagatgcaagaggcctttgt

SEQ ID NO: 478573 - DNA, 25 bp, Rattus norvegicus
gtcgatgtccctcactcgccgagat

SEQ ID NO: 478574 - DNA, 25 bp, Rattus norvegicus
gtttcggctcaaatccaggcctcta

SEQ ID NO: 478575 - DNA, 25 bp, Rattus norvegicus
tcttcattcttcagagcagcctcgc

SEQ ID NO: 478576 - DNA, 25 bp, Rattus norvegicus
tgccctacccgcttcatgaggagga

SEQ ID NO: 478577 - DNA, 25 bp, Rattus norvegicus
cttggtcgcctccttactctagtta

SEQ ID NO: 478578 - DNA, 25 bp, Rattus norvegicus
gggctccgcagctctcaaacttcta

SEQ ID NO: 478579 - DNA, 25 bp, Rattus norvegicus
tacctaaggaggtcgtggacgagac

SEQ ID NO: 478580 - DNA, 25 bp, Rattus norvegicus
cccgacgctcgagtcgctagtctgt

SEQ ID NO: 478581 - DNA, 25 bp, Rattus norvegicus
agtcgctagtctgtcgccggcgcct

SEQ ID NO: 478582 - DNA, 25 bp, Rattus norvegicus
gccgctttatcaacctcccgggagc

SEQ ID NO: 478583 - DNA, 25 bp, Rattus norvegicus
agccagccgcggtcttcgaccctac

SEQ ID NO: 478584 - DNA, 25 bp, Rattus norvegicus
aggcgagagccgagaccagccagcc

SEQ ID NO: 478585 - DNA, 25 bp, Rattus norvegicus
aacgagctaacgagcgtgcgaacga

SEQ ID NO: 478586 - DNA, 25 bp, Rattus norvegicus
ctaggccctgcgaacgagctaacga

SEQ ID NO: 478587 - DNA, 25 bp, Rattus norvegicus
ctgtgagagccgaggccctcgagcc

SEQ ID NO: 478588 - DNA, 25 bp, Rattus norvegicus
cgccagctgtgagagccgaggccct

SEQ ID NO: 478589 - DNA, 25 bp, Rattus norvegicus
ccgcgctaggcacagagggcagcaa

SEQ ID NO: 478590 - DNA, 25 bp, Rattus norvegicus
gctctcaaacttctaggaagaattg

SEQ ID NO: 478591 - DNA, 25 bp, Rattus norvegicus
cgccatcttgtaccgatttaaaatt

SEQ ID NO: 478592 - DNA, 25 bp, Rattus norvegicus
gtcctgcggccaaaacggaactcga

SEQ ID NO: 478593 - DNA, 25 bp, Rattus norvegicus
ctcgcaaggtcacggaagcagcctc

SEQ ID NO: 478594 - DNA, 25 bp, Rattus norvegicus
tactccggagctccgtcgcgagggt

SEQ ID NO: 478595 - DNA, 25 bp, Rattus norvegicus
ctcgtcggagtcctcgactggcgac

SEQ ID NO: 478596 - DNA, 25 bp, Rattus norvegicus
taagccttccgggtcctgcggccaa

SEQ ID NO: 478597 - DNA, 25 bp, Rattus norvegicus
ggaactcgacagcaagcctaccgtg

SEQ ID NO: 478598 - DNA, 25 bp, Rattus norvegicus
agcaagcctaccgtgcccgagtcag

SEQ ID NO: 478599 - DNA, 25 bp, Rattus norvegicus
ccgagtcagggacgccggatctccg

SEQ ID NO: 478600 - DNA, 25 bp, Rattus norvegicus
tccgccgccagtagttcaaaaatca

SEQ ID NO: 478601 - DNA, 25 bp, Rattus norvegicus
gttcaaaaatcagacgctccgccca

SEQ ID NO: 478602 - DNA, 25 bp, Rattus norvegicus
cgcatttttaaaatccactccgtga

SEQ ID NO: 478603 - DNA, 25 bp, Rattus norvegicus
tccgtgactctcagtggctggctct

SEQ ID NO: 478604 - DNA, 25 bp, Rattus norvegicus
tggctctgagcgtagagcgacattc

SEQ ID NO: 478605 - DNA, 25 bp, Rattus norvegicus
gcgccggactagagggtcgcctcct

SEQ ID NO: 478606 - DNA, 25 bp, Rattus norvegicus
gtgcagcatttcagcatagacgttg

SEQ ID NO: 478607 - DNA, 25 bp, Rattus norvegicus
ggtgctctgcatcacgcttctcgtc

SEQ ID NO: 478608 - DNA, 25 bp, Rattus norvegicus
cgtcctcggcgttcatggtcatgaa

SEQ ID NO: 478609 - DNA, 25 bp, Rattus norvegicus
catgaatcgcagcaccacgaggttg

SEQ ID NO: 478610 - DNA, 25 bp, Rattus norvegicus
ccggtgaggatgtatacgaagctga

SEQ ID NO: 478611 - DNA, 25 bp, Rattus norvegicus
gccacgtactgaggctgcgtttgca

SEQ ID NO: 478612 - DNA, 25 bp, Rattus norvegicus
ggcgccgatacacagcgtgctgatg

SEQ ID NO: 478613 - DNA, 25 bp, Rattus norvegicus
gctgatgcacgacacgaaaccgatg

SEQ ID NO: 478614 - DNA, 25 bp, Rattus norvegicus
accgatgagcaccatgttggccatg

SEQ ID NO: 478615 - DNA, 25 bp, Rattus norvegicus
cacggtgcagcaggtacctcacgaa

SEQ ID NO: 478616 - DNA, 25 bp, Rattus norvegicus
cctcacgaaggtgttgatgcgttca

SEQ ID NO: 478617 - DNA, 25 bp, Rattus norvegicus
cccaggctctggaacatgactagtg

SEQ ID NO: 478618 - DNA, 25 bp, Rattus norvegicus
cccagcagcgcgtagaacatgcaga

SEQ ID NO: 478619 - DNA, 25 bp, Rattus norvegicus
agcttctcgcggctcttgtaccaga

SEQ ID NO: 478620 - DNA, 25 bp, Rattus norvegicus
ggcgcggccagtgtagttaccgatt

SEQ ID NO: 478621 - DNA, 25 bp, Rattus norvegicus
ccagtgtagttaccgattgtggtga

SEQ ID NO: 478622 - DNA, 25 bp, Rattus norvegicus
aaggtgcacacgatgagagccaacg

SEQ ID NO: 478623 - DNA, 25 bp, Rattus norvegicus
ttgaggcgcagcacgacgcgctcca

SEQ ID NO: 478624 - DNA, 25 bp, Rattus norvegicus
tgagagccaacgtgcgcacattctg

SEQ ID NO: 478625 - DNA, 25 bp, Rattus norvegicus
tgcgcacattctgccgcttcatcgt

SEQ ID NO: 478626 - DNA, 25 bp, Rattus norvegicus
gcatggctgcgctcgcggatctcca

SEQ ID NO: 478627 - DNA, 25 bp, Rattus norvegicus
agctccagccgctgccgctcgatca

SEQ ID NO: 478628 - DNA, 25 bp, Rattus norvegicus
aaggagccggcgaagcgccactgca

SEQ ID NO: 478629 - DNA, 25 bp, Rattus norvegicus
tgcacgccggccttgtgcggcttga

SEQ ID NO: 478630 - DNA, 25 bp, Rattus norvegicus
ccttgtgcggcttgaggcgcagcac

SEQ ID NO: 478631 - DNA, 25 bp, Rattus norvegicus
cgtagccgccctcgctgaggttgta

SEQ ID NO: 478632 - DNA, 25 bp, Rattus norvegicus
ttaccgattgtggtgatgacggtga

SEQ ID NO: 478633 - DNA, 25 bp, Rattus norvegicus
tcgctgaggttgtagcgcgcccgca

SEQ ID NO: 478634 - DNA, 25 bp, Rattus norvegicus
tcgacagggtaaggaaacaggagca

SEQ ID NO: 478635 - DNA, 25 bp, Rattus norvegicus
gctcgccttctctaccttatacttg

SEQ ID NO: 478636 - DNA, 25 bp, Rattus norvegicus
cacaaggtgacacggaccgcgccgg

SEQ ID NO: 478637 - DNA, 25 bp, Rattus norvegicus
ccacgcggcaggcacaaggtgacac

SEQ ID NO: 478638 - DNA, 25 bp, Rattus norvegicus
aacggcgggcctaggatgctcccat

SEQ ID NO: 478639 - DNA, 25 bp, Rattus norvegicus
gcagcgacactgctcgacagggtaa

SEQ ID NO: 478640 - DNA, 25 bp, Rattus norvegicus
ctcacgtattcgtagccagccatga

SEQ ID NO: 478641 - DNA, 25 bp, Rattus norvegicus
gccttcacccaatcggaacaggata

SEQ ID NO: 478642 - DNA, 25 bp, Rattus norvegicus
acaggatagccaacgccaagtcccg

SEQ ID NO: 478643 - DNA, 25 bp, Rattus norvegicus
catgatgacccgaaaactgaacgcc

SEQ ID NO: 478644 - DNA, 25 bp, Rattus norvegicus
cttatacttgtcaaagcccgccagc

SEQ ID NO: 478645 - DNA, 25 bp, Rattus norvegicus
tgctctgggctcacgtattcgtagc

SEQ ID NO: 478646 - DNA, 25 bp, Rattus norvegicus
gtagccagccatgatgacccgaaaa

SEQ ID NO: 478647 - DNA, 25 bp, Rattus norvegicus
gtcaaagcccgccagctgctctggg

SEQ ID NO: 478648 - DNA, 25 bp, Rattus norvegicus
ccgttcgtgaacctgaagtgataaa

SEQ ID NO: 478649 - DNA, 25 bp, Rattus norvegicus
tcttacagcactgggtagcggccgc

SEQ ID NO: 478650 - DNA, 25 bp, Rattus norvegicus
gagtccggagcaaagtggcacctgc

SEQ ID NO: 478651 - DNA, 25 bp, Rattus norvegicus
cgctctcggtacttcgactcttaca

SEQ ID NO: 478652 - DNA, 25 bp, Rattus norvegicus
aagtccagactgataaacgcccgcc

SEQ ID NO: 478653 - DNA, 25 bp, Rattus norvegicus
gcccgcacttaatgacgcgttctca

SEQ ID NO: 478654 - DNA, 25 bp, Rattus norvegicus
gttctcaatctctacagccgccgga

SEQ ID NO: 478655 - DNA, 25 bp, Rattus norvegicus
cgccggactgcctagagaggtaagc

SEQ ID NO: 478656 - DNA, 25 bp, Rattus norvegicus
gtttcacacacacgcaaaccgttcg

SEQ ID NO: 478657 - DNA, 25 bp, Rattus norvegicus
tgcagcgagccacgccaagaacgcg

SEQ ID NO: 478658 - DNA, 25 bp, Rattus norvegicus
gaaaagcgcgctgccgcaccttaga

SEQ ID NO: 478659 - DNA, 25 bp, Rattus norvegicus
acctgcctgcgggaaagtcagaaga

SEQ ID NO: 478660 - DNA, 25 bp, Rattus norvegicus
cggttcgcaacggaagcctggacca

SEQ ID NO: 478661 - DNA, 25 bp, Rattus norvegicus
agcaggggaaacgacaccgctctga

SEQ ID NO: 478662 - DNA, 25 bp, Rattus norvegicus
aaaggacgcaggtcttgcccactcc

SEQ ID NO: 478663 - DNA, 25 bp, Rattus norvegicus
cagcttgaaaagcaggtcgtacgtc

SEQ ID NO: 478664 - DNA, 25 bp, Rattus norvegicus
gtacgtcttcttcgccattgggagg

SEQ ID NO: 478665 - DNA, 25 bp, Rattus norvegicus
tcggtgctgctcactacggccaact

SEQ ID NO: 478666 - DNA, 25 bp, Rattus norvegicus
gagaccttccgaacggcctcgtcga

SEQ ID NO: 478667 - DNA, 25 bp, Rattus norvegicus
gagtcggtcgggacaaaatggcctc

SEQ ID NO: 478668 - DNA, 25 bp, Rattus norvegicus
ggagcaaaaactccgcgctaggacg

SEQ ID NO: 478669 - DNA, 25 bp, Rattus norvegicus
tgcctgagacgcacgcaaggacgta

SEQ ID NO: 478670 - DNA, 25 bp, Rattus norvegicus
ccttgcctttttggggcgtacagct

SEQ ID NO: 478671 - DNA, 25 bp, Rattus norvegicus
gactgctgagatcctctactctctt

SEQ ID NO: 478672 - DNA, 25 bp, Rattus norvegicus
ctctctttcagtctcctgttgagga

SEQ ID NO: 478673 - DNA, 25 bp, Rattus norvegicus
ctaaggatgttagcccagcgacgga

SEQ ID NO: 478674 - DNA, 25 bp, Rattus norvegicus
ccacgcgttcctgtgtgtgtagttc

SEQ ID NO: 478675 - DNA, 25 bp, Rattus norvegicus
gtgcacggcttgaggaacacgccca

SEQ ID NO: 478676 - DNA, 25 bp, Rattus norvegicus
ctgggtgggcaccagaccctgtcat

SEQ ID NO: 478677 - DNA, 25 bp, Rattus norvegicus
ctgtttttctctcattctccggtgg

SEQ ID NO: 478678 - DNA, 25 bp, Rattus norvegicus
ccttctgtttttctctcattctccg

SEQ ID NO: 478679 - DNA, 25 bp, Rattus norvegicus
agcaacatctgtctcgccgccgctg

SEQ ID NO: 478680 - DNA, 25 bp, Rattus norvegicus
agcggccgcagcaacatctgtctcg

SEQ ID NO: 478681 - DNA, 25 bp, Rattus norvegicus
gcagcggccgcagcaacatctgtct

SEQ ID NO: 478682 - DNA, 25 bp, Rattus norvegicus
gagacctaacccgggccgcagcgca

SEQ ID NO: 478683 - DNA, 25 bp, Rattus norvegicus
tgcgccgcatccgactggtgggcgc

SEQ ID NO: 478684 - DNA, 25 bp, Rattus norvegicus
accgctgtccctcgcccaagggccg

SEQ ID NO: 478685 - DNA, 25 bp, Rattus norvegicus
ccggcggcgatgcaccgctgtccct

SEQ ID NO: 478686 - DNA, 25 bp, Rattus norvegicus
accctgtcatccctgagaggtcggc

SEQ ID NO: 478687 - DNA, 25 bp, Rattus norvegicus
accagaccctgtcatccctgagagg

SEQ ID NO: 478688 - DNA, 25 bp, Rattus norvegicus
gggtgggcaccagaccctgtcatcc

SEQ ID NO: 478689 - DNA, 25 bp, Rattus norvegicus
ttctctcattctccggtggtggcgg

SEQ ID NO: 478690 - DNA, 25 bp, Rattus norvegicus
tgcgctttgcgaaccgagccaagaa

SEQ ID NO: 478691 - DNA, 25 bp, Rattus norvegicus
cgctgcttagggaattccaggaaga

SEQ ID NO: 478692 - DNA, 25 bp, Rattus norvegicus
tgcgaaccgagccaagaacatcaag

SEQ ID NO: 478693 - DNA, 25 bp, Rattus norvegicus
gaacatcaagaacaaaccgcgggtg

SEQ ID NO: 478694 - DNA, 25 bp, Rattus norvegicus
atcaagaacaaaccgcgggtgaacg

SEQ ID NO: 478695 - DNA, 25 bp, Rattus norvegicus
ccaaggacacgctgcttagggaatt

SEQ ID NO: 478696 - DNA, 25 bp, Rattus norvegicus
ttccaggaagagatcgcccgcttga

SEQ ID NO: 478697 - DNA, 25 bp, Rattus norvegicus
cgcttgaaggcccagcttgagaaga

SEQ ID NO: 478698 - DNA, 25 bp, Rattus norvegicus
tgctgggaaagcgacctcggagaaa

SEQ ID NO: 478699 - DNA, 25 bp, Rattus norvegicus
acctcggagaaagagcagtcgcaga

SEQ ID NO: 478700 - DNA, 25 bp, Rattus norvegicus
cagtcgcagaaagaaggccgtgtct

SEQ ID NO: 478701 - DNA, 25 bp, Rattus norvegicus
aagaaggccgtgtctgctccggccg

SEQ ID NO: 478702 - DNA, 25 bp, Rattus norvegicus
gcctctccaccctgcgctttgcgaa

SEQ ID NO: 478703 - DNA, 25 bp, Rattus norvegicus
gatcgcccgcttgaaggcccagctt

SEQ ID NO: 478704 - DNA, 25 bp, Rattus norvegicus
gctatgcgatcagcgctcactttgc

SEQ ID NO: 478705 - DNA, 25 bp, Rattus norvegicus
agcgctcactttgcgccgccggaag

SEQ ID NO: 478706 - DNA, 25 bp, Rattus norvegicus
cacccagaggaagagggccgtcttt

SEQ ID NO: 478707 - DNA, 25 bp, Rattus norvegicus
ggaagagggccgtctttacaatcga

SEQ ID NO: 478708 - DNA, 25 bp, Rattus norvegicus
agggccgtctttacaatcgaactgc

SEQ ID NO: 478709 - DNA, 25 bp, Rattus norvegicus
tgcgatcagcgctcactttgcgccg

SEQ ID NO: 478710 - DNA, 25 bp, Rattus norvegicus
cgccggaagttgtcttgaagtctgg

SEQ ID NO: 478711 - DNA, 25 bp, Rattus norvegicus
agttgtcttgaagtctggacgttgg

SEQ ID NO: 478712 - DNA, 25 bp, Rattus norvegicus
cagggcaagtccttccacccagagg

SEQ ID NO: 478713 - DNA, 25 bp, Rattus norvegicus
gggcaagtccttccacccagaggaa

SEQ ID NO: 478714 - DNA, 25 bp, Rattus norvegicus
ggccgtctttacaatcgaactgccc

SEQ ID NO: 478715 - DNA, 25 bp, Rattus norvegicus
ccctcccatggtccggcccactccg

SEQ ID NO: 478716 - DNA, 25 bp, Rattus norvegicus
ttccacccagaggaagagggccgtc

SEQ ID NO: 478717 - DNA, 25 bp, Rattus norvegicus
ggcgctatgcgatcagcgctcactt

SEQ ID NO: 478718 - DNA, 25 bp, Rattus norvegicus
gttagcccttgtctctggcccagtg

SEQ ID NO: 478719 - DNA, 25 bp, Rattus norvegicus
gcccagtgtgttgtgtttgccagta

SEQ ID NO: 478720 - DNA, 25 bp, Rattus norvegicus
ccgcgaccgcgttgagaagcacgaa

SEQ ID NO: 478721 - DNA, 25 bp, Rattus norvegicus
aaaggccggcagcagttcgttttct

SEQ ID NO: 478722 - DNA, 25 bp, Rattus norvegicus
agccttccagtcagttcaagaaccg

SEQ ID NO: 478723 - DNA, 25 bp, Rattus norvegicus
gccgcttcctcgctgagttgcttct

SEQ ID NO: 478724 - DNA, 25 bp, Rattus norvegicus
acccaatatggcagcggcggtagca

SEQ ID NO: 478725 - DNA, 25 bp, Rattus norvegicus
cagcggctgcctgtacagtaagaac

SEQ ID NO: 478726 - DNA, 25 bp, Rattus norvegicus
cgtggacaaccgcttcagactgccg

SEQ ID NO: 478727 - DNA, 25 bp, Rattus norvegicus
atgcgctcgaagatggccagagacc

SEQ ID NO: 478728 - DNA, 25 bp, Rattus norvegicus
tgggtgtgaccgctagacatccaac

SEQ ID NO: 478729 - DNA, 25 bp, Rattus norvegicus
agcagattccgtttccgctcgcgga

SEQ ID NO: 478730 - DNA, 25 bp, Rattus norvegicus
gcgcaatcagcctttcccggaagga

SEQ ID NO: 478731 - DNA, 25 bp, Rattus norvegicus
taaccggttcttctcccttgtgcgc

SEQ ID NO: 478732 - DNA, 25 bp, Rattus norvegicus
ctcaaacgagcctgctgaggcaatg

SEQ ID NO: 478733 - DNA, 25 bp, Rattus norvegicus
tgctgatgcagcctgagccggactt

SEQ ID NO: 478734 - DNA, 25 bp, Rattus norvegicus
gaacggcgacccttgggagaccgca

SEQ ID NO: 478735 - DNA, 25 bp, Rattus norvegicus
gctgcttcagctgcctctgccgagg

SEQ ID NO: 478736 - DNA, 25 bp, Rattus norvegicus
ctacctgtggagtggaagcgcacct

SEQ ID NO: 478737 - DNA, 25 bp, Rattus norvegicus
cttacggttcagtcacgtcggcgca

SEQ ID NO: 478738 - DNA, 25 bp, Rattus norvegicus
tcgaggcgcgggtgaatgattcacc

SEQ ID NO: 478739 - DNA, 25 bp, Rattus norvegicus
ctcggtccttcgcaaggctgctctt

SEQ ID NO: 478740 - DNA, 25 bp, Rattus norvegicus
caccaggcgcatgagttagtgctca

SEQ ID NO: 478741 - DNA, 25 bp, Rattus norvegicus
agggccgtgacccagatcgtgtcca

SEQ ID NO: 478742 - DNA, 25 bp, Rattus norvegicus
aagttatgcgctcttggggaccagg

SEQ ID NO: 478743 - DNA, 25 bp, Rattus norvegicus
ctgctcttctccctaagttatgcgc

SEQ ID NO: 478744 - DNA, 25 bp, Rattus norvegicus
ttgcctttgcgcagaggaccggact

SEQ ID NO: 478745 - DNA, 25 bp, Rattus norvegicus
ttcaccgggtatttcttcgcattcc

SEQ ID NO: 478746 - DNA, 25 bp, Rattus norvegicus
aggcgtcgcttcctggcgattctcg

SEQ ID NO: 478747 - DNA, 25 bp, Rattus norvegicus
taaataagtgataagcccgagtccc

SEQ ID NO: 478748 - DNA, 25 bp, Rattus norvegicus
cctccgtcttgaggcgcttggcctg

SEQ ID NO: 478749 - DNA, 25 bp, Rattus norvegicus
cgggaaatgtgtgcaataaataagt

SEQ ID NO: 478750 - DNA, 25 bp, Rattus norvegicus
tcggtgtgcacgcagcagaatagga

SEQ ID NO: 478751 - DNA, 25 bp, Rattus norvegicus
cgccgcgctttgttaccgtggacgg

SEQ ID NO: 478752 - DNA, 25 bp, Rattus norvegicus
tcctcagccgagtagacgatctctc

SEQ ID NO: 478753 - DNA, 25 bp, Rattus norvegicus
gcttggcctggctttcgaactcccg

SEQ ID NO: 478754 - DNA, 25 bp, Rattus norvegicus
tatgggcctcagatgtcgccgagca

SEQ ID NO: 478755 - DNA, 25 bp, Rattus norvegicus
tgcgcctcctcagcgcgggtctgag

SEQ ID NO: 478756 - DNA, 25 bp, Rattus norvegicus
tctgagaggcgtcggcgtcctccgc

SEQ ID NO: 478757 - DNA, 25 bp, Rattus norvegicus
ctgaggggacgcttccctttatctc

SEQ ID NO: 478758 - DNA, 25 bp, Rattus norvegicus
cgggatcgaatcctcaagcccaaga

SEQ ID NO: 478759 - DNA, 25 bp, Rattus norvegicus
cgcactcgccgtcaggattcgggaa

SEQ ID NO: 478760 - DNA, 25 bp, Rattus norvegicus
aatccgcgccaggtagaggggcgcc

SEQ ID NO: 478761 - DNA, 25 bp, Rattus norvegicus
ggcagctgtccctacggccagtgct

SEQ ID NO: 478762 - DNA, 25 bp, Rattus norvegicus
tgtccctacggccagtgctggatgc

SEQ ID NO: 478763 - DNA, 25 bp, Rattus norvegicus
aggcacttgacaccggcccgggaga

SEQ ID NO: 478764 - DNA, 25 bp, Rattus norvegicus
tcgggagaactgcagggcgaaggcc

SEQ ID NO: 478765 - DNA, 25 bp, Rattus norvegicus
cgcgcagagcgcagtgggctctggt

SEQ ID NO: 478766 - DNA, 25 bp, Rattus norvegicus
tttggccaccgcggcacctggctga

SEQ ID NO: 478767 - DNA, 25 bp, Rattus norvegicus
tggccgtgtgcagccgtttggccac

SEQ ID NO: 478768 - DNA, 25 bp, Rattus norvegicus
ccaggcgctgcgaccttggccgtgt

SEQ ID NO: 478769 - DNA, 25 bp, Rattus norvegicus
aggcaccaggcgctgcgaccttggc

SEQ ID NO: 478770 - DNA, 25 bp, Rattus norvegicus
atggcctcgaggcaccaggcgctgc

SEQ ID NO: 478771 - DNA, 25 bp, Rattus norvegicus
ccctaggatggcctcgaggcaccag

SEQ ID NO: 478772 - DNA, 25 bp, Rattus norvegicus
gaccgtgctcgagcccctaggatgg

SEQ ID NO: 478773 - DNA, 25 bp, Rattus norvegicus
ccgcacagaatccgcgccaggtaga

SEQ ID NO: 478774 - DNA, 25 bp, Rattus norvegicus
cataaactccgcgtttccctgaact

SEQ ID NO: 478775 - DNA, 25 bp, Rattus norvegicus
tgaactccgagtctcatctctaatc

SEQ ID NO: 478776 - DNA, 25 bp, Rattus norvegicus
ccgagtctcatctctaatctgtaaa

SEQ ID NO: 478777 - DNA, 25 bp, Rattus norvegicus
tctaatctgtaaactcgcttgcgcg

SEQ ID NO: 478778 - DNA, 25 bp, Rattus norvegicus
aatctgtaaactcgcttgcgcgctc

SEQ ID NO: 478779 - DNA, 25 bp, Rattus norvegicus
gctcccgcactcactcggctctttt

SEQ ID NO: 478780 - DNA, 25 bp, Rattus norvegicus
tcctctgttcttgcttctgcgaaac

SEQ ID NO: 478781 - DNA, 25 bp, Rattus norvegicus
tctgttcttgcttctgcgaaactca

SEQ ID NO: 478782 - DNA, 25 bp, Rattus norvegicus
actttctcccggcactctcaggctg

SEQ ID NO: 478783 - DNA, 25 bp, Rattus norvegicus
gcgaaactcactttctgcaactttc

SEQ ID NO: 478784 - DNA, 25 bp, Rattus norvegicus
agccagcgctcctatcccaccaccg

SEQ ID NO: 478785 - DNA, 25 bp, Rattus norvegicus
tagagcgggcccgtccgatagcgct

SEQ ID NO: 478786 - DNA, 25 bp, Rattus norvegicus
ttgcttctgcgaaactcactttctg

SEQ ID NO: 478787 - DNA, 25 bp, Rattus norvegicus
tctcaggctgcctgaagccagcgct

SEQ ID NO: 478788 - DNA, 25 bp, Rattus norvegicus
cttagcaggtcgtccccgaggcccg

SEQ ID NO: 478789 - DNA, 25 bp, Rattus norvegicus
accggctgggctctggtgcgacctc

SEQ ID NO: 478790 - DNA, 25 bp, Rattus norvegicus
cggggacttcacctttgtctcttcg

SEQ ID NO: 478791 - DNA, 25 bp, Rattus norvegicus
caacggggacttcacctttgtctct

SEQ ID NO: 478792 - DNA, 25 bp, Rattus norvegicus
atgcgcctgccaacggggacttcac

SEQ ID NO: 478793 - DNA, 25 bp, Rattus norvegicus
ctatgcgcctgccaacggggacttc

SEQ ID NO: 478794 - DNA, 25 bp, Rattus norvegicus
gcctatgcgcctgccaacggggact

SEQ ID NO: 478795 - DNA, 25 bp, Rattus norvegicus
cggcctatgcgcctgccaacgggga

SEQ ID NO: 478796 - DNA, 25 bp, Rattus norvegicus
caggccgccccttagcaggtcgtcc

SEQ ID NO: 478797 - DNA, 25 bp, Rattus norvegicus
ggctcgcgcgtctccaccctcgccc

SEQ ID NO: 478798 - DNA, 25 bp, Rattus norvegicus
ggtggactggctcgcgcgtctccac

SEQ ID NO: 478799 - DNA, 25 bp, Rattus norvegicus
ggctctggtgcgacctcgttaggag

SEQ ID NO: 478800 - DNA, 25 bp, Rattus norvegicus
gcgcctcctggctcgcaggccgccc

SEQ ID NO: 478801 - DNA, 25 bp, Rattus norvegicus
ctgggctctggtgcgacctcgttag

SEQ ID NO: 478802 - DNA, 25 bp, Rattus norvegicus
caaggacaagcgctacggcggcttc

SEQ ID NO: 478803 - DNA, 25 bp, Rattus norvegicus
gcagactcgacctctcggcggagac

SEQ ID NO: 478804 - DNA, 25 bp, Rattus norvegicus
ggagacgcccgtgtttccaggcaac

SEQ ID NO: 478805 - DNA, 25 bp, Rattus norvegicus
tccaggcaacggagatgaacagccc

SEQ ID NO: 478806 - DNA, 25 bp, Rattus norvegicus
tgaacagcccttgactgaaaatccc

SEQ ID NO: 478807 - DNA, 25 bp, Rattus norvegicus
cccggaagtacgtcatgggtcactt

SEQ ID NO: 478808 - DNA, 25 bp, Rattus norvegicus
agggcaagcgctcctactccatgga

SEQ ID NO: 478809 - DNA, 25 bp, Rattus norvegicus
ctactccatggagcacttccgctgg

SEQ ID NO: 478810 - DNA, 25 bp, Rattus norvegicus
cccaatgtcgccgagaacgagtcgg

SEQ ID NO: 478811 - DNA, 25 bp, Rattus norvegicus
agcctgatggcttggagcacgtcct

SEQ ID NO: 478812 - DNA, 25 bp, Rattus norvegicus
agcacgtcctggagccggataccga

SEQ ID NO: 478813 - DNA, 25 bp, Rattus norvegicus
ccctatcgggtggagcacttccgct

SEQ ID NO: 478814 - DNA, 25 bp, Rattus norvegicus
ggtgacgctcttcaagaacgccatc

SEQ ID NO: 478815 - DNA, 25 bp, Rattus norvegicus
ggcggcttcatgacctccgagaaga

SEQ ID NO: 478816 - DNA, 25 bp, Rattus norvegicus
ccggtggcagcgataactgcagctt

SEQ ID NO: 478817 - DNA, 25 bp, Rattus norvegicus
tcgtagctcccggttagcgcgtagt

SEQ ID NO: 478818 - DNA, 25 bp, Rattus norvegicus
agcgcgtagtcgatgctgagtcgca

SEQ ID NO: 478819 - DNA, 25 bp, Rattus norvegicus
gcgataactgcagcttccgatagga

SEQ ID NO: 478820 - DNA, 25 bp, Rattus norvegicus
gataggacttccacgatgccggcgc

SEQ ID NO: 478821 - DNA, 25 bp, Rattus norvegicus
cccttaccgacagagccggtggcag

SEQ ID NO: 478822 - DNA, 25 bp, Rattus norvegicus
gttggtcctaaatccaacgcctgca

SEQ ID NO: 478823 - DNA, 25 bp, Rattus norvegicus
atcatgacaagaatccctcctactc

SEQ ID NO: 478824 - DNA, 25 bp, Rattus norvegicus
ggggagggccccataaatcatgaca

SEQ ID NO: 478825 - DNA, 25 bp, Rattus norvegicus
atctccagaaccgtgggccctgagc

SEQ ID NO: 478826 - DNA, 25 bp, Rattus norvegicus
tattgaacatctccagaaccgtggg

SEQ ID NO: 478827 - DNA, 25 bp, Rattus norvegicus
tgccgcagcagggtattgaacatct

SEQ ID NO: 478828 - DNA, 25 bp, Rattus norvegicus
gatgctgagtcgcagctgccgcagc

SEQ ID NO: 478829 - DNA, 25 bp, Rattus norvegicus
gcagcttccgataggacttccacga

SEQ ID NO: 478830 - DNA, 25 bp, Rattus norvegicus
ctcgcttttcccaaagccgggtgca

SEQ ID NO: 478831 - DNA, 25 bp, Rattus norvegicus
actgagtcggcgttctcgcttttgc

SEQ ID NO: 478832 - DNA, 25 bp, Rattus norvegicus
tgtcctctcggcacaaacgcacggt

SEQ ID NO: 478833 - DNA, 25 bp, Rattus norvegicus
cggccggaggcatctttgtcctctc

SEQ ID NO: 478834 - DNA, 25 bp, Rattus norvegicus
atcagagtccctaccaggcgacgga

SEQ ID NO: 478835 - DNA, 25 bp, Rattus norvegicus
agccgggtgcatctcgacaatcaga

SEQ ID NO: 478836 - DNA, 25 bp, Rattus norvegicus
tcagctccggagatactcgcttttc

SEQ ID NO: 478837 - DNA, 25 bp, Rattus norvegicus
caacactccgttggttcagctccgg

SEQ ID NO: 478838 - DNA, 25 bp, Rattus norvegicus
ctggaccactttcgcgcatcaaact

SEQ ID NO: 478839 - DNA, 25 bp, Rattus norvegicus
gagcccggcatcagactgccagtga

SEQ ID NO: 478840 - DNA, 25 bp, Rattus norvegicus
gtgccggttcgccagcttctgcact

SEQ ID NO: 478841 - DNA, 25 bp, Rattus norvegicus
caaaggtccgcgtctggaagtttgc

SEQ ID NO: 478842 - DNA, 25 bp, Rattus norvegicus
tccttaccgtacatctcggcgggga

SEQ ID NO: 478843 - DNA, 25 bp, Rattus norvegicus
cgcacggtcacaggcgactgaaaca

SEQ ID NO: 478844 - DNA, 25 bp, Rattus norvegicus
caacgtgccgaagcggaaggagccc

SEQ ID NO: 478845 - DNA, 25 bp, Rattus norvegicus
aagtccctccgcatcaaagtcatct

SEQ ID NO: 478846 - DNA, 25 bp, Rattus norvegicus
aggggcaggacctccgcgtgccaga

SEQ ID NO: 478847 - DNA, 25 bp, Rattus norvegicus
ggaaagtgagtaccgcgtgctgtga

SEQ ID NO: 478848 - DNA, 25 bp, Rattus norvegicus
tctccatgggcaacgccgaagtggg

SEQ ID NO: 478849 - DNA, 25 bp, Rattus norvegicus
aagtcatctccatgggcaacgccga

SEQ ID NO: 478850 - DNA, 25 bp, Rattus norvegicus
caatggagtccaacgtgccgaagcg

SEQ ID NO: 478851 - DNA, 25 bp, Rattus norvegicus
tcacggcgcgctgtcatcgcgagac

SEQ ID NO: 478852 - DNA, 25 bp, Rattus norvegicus
cagagcgaaggcaatggagtccaac

SEQ ID NO: 478853 - DNA, 25 bp, Rattus norvegicus
ccagcagagcgaaggcaatggagtc

SEQ ID NO: 478854 - DNA, 25 bp, Rattus norvegicus
gctggctgggtgcttaaggacacca

SEQ ID NO: 478855 - DNA, 25 bp, Rattus norvegicus
gtgacgagcgcagcggctccgtcat

SEQ ID NO: 478856 - DNA, 25 bp, Rattus norvegicus
ggcgcgctgtcatcgcgagactccg

SEQ ID NO: 478857 - DNA, 25 bp, Rattus norvegicus
cgcatcaaagtcatctccatgggca

SEQ ID NO: 478858 - DNA, 25 bp, Rattus norvegicus
acccacaggcagcaccgaggtcagg

SEQ ID NO: 478859 - DNA, 25 bp, Rattus norvegicus
tcgcagactgcgagtagcccaagca

SEQ ID NO: 478860 - DNA, 25 bp, Rattus norvegicus
ccgttcattcgggaagccttggagc

SEQ ID NO: 478861 - DNA, 25 bp, Rattus norvegicus
cgggctcggagatctcccgttcatt

SEQ ID NO: 478862 - DNA, 25 bp, Rattus norvegicus
ttccacacagtggtaggtgcggcgt

SEQ ID NO: 478863 - DNA, 25 bp, Rattus norvegicus
gtagcccaagcagttccacacagtg

SEQ ID NO: 478864 - DNA, 25 bp, Rattus norvegicus
gagagcctttcggtggcgctccaag

SEQ ID NO: 478865 - DNA, 25 bp, Rattus norvegicus
tccgacagccggcttcgcatggagt

SEQ ID NO: 478866 - DNA, 25 bp, Rattus norvegicus
gcctatcgcttctagcgagggtctg

SEQ ID NO: 478867 - DNA, 25 bp, Rattus norvegicus
cgccgtgcacacacagttcttcagg

SEQ ID NO: 478868 - DNA, 25 bp, Rattus norvegicus
agcttgcggcagcagcccaccttga

SEQ ID NO: 478869 - DNA, 25 bp, Rattus norvegicus
tagccgtcgtacgtctgccaaggcc

SEQ ID NO: 478870 - DNA, 25 bp, Rattus norvegicus
ggtcttcagcacgtagccgtcgtac

SEQ ID NO: 478871 - DNA, 25 bp, Rattus norvegicus
gggacctaagatcgccgccaaagcg

SEQ ID NO: 478872 - DNA, 25 bp, Rattus norvegicus
ctgcgaccacggatgctgaaccaca

SEQ ID NO: 478873 - DNA, 25 bp, Rattus norvegicus
ggctggggtgcctcagcacgcctca

SEQ ID NO: 478874 - DNA, 25 bp, Rattus norvegicus
tcacctgcagggaggatacgtcctg

SEQ ID NO: 478875 - DNA, 25 bp, Rattus norvegicus
acgtcctgggctttgatcttctgta

SEQ ID NO: 478876 - DNA, 25 bp, Rattus norvegicus
tgatcttctgtaacacggtctgttc

SEQ ID NO: 478877 - DNA, 25 bp, Rattus norvegicus
taacacggtctgttcgaggcaaagc

SEQ ID NO: 478878 - DNA, 25 bp, Rattus norvegicus
tcgaggcaaagcgtggagtcacctc

SEQ ID NO: 478879 - DNA, 25 bp, Rattus norvegicus
gagtcacctcgctcttttctgtctg

SEQ ID NO: 478880 - DNA, 25 bp, Rattus norvegicus
ttctgtctgccacctactcggcgtt

SEQ ID NO: 478881 - DNA, 25 bp, Rattus norvegicus
acgcagctatctccgggcgctggca

SEQ ID NO: 478882 - DNA, 25 bp, Rattus norvegicus
gagttcccgcacaggtcagcgccaa

SEQ ID NO: 478883 - DNA, 25 bp, Rattus norvegicus
gtcagcgccaaaccaggatccaggg

SEQ ID NO: 478884 - DNA, 25 bp, Rattus norvegicus
agacactgagatggggcgcgcccat

SEQ ID NO: 478885 - DNA, 25 bp, Rattus norvegicus
tactcggcgtttccacgcagctatc

SEQ ID NO: 478886 - DNA, 25 bp, Rattus norvegicus
cagtacttagtattacgaaaggatc

SEQ ID NO: 478887 - DNA, 25 bp, Rattus norvegicus
atgcgtccggccattctgatgatca

SEQ ID NO: 478888 - DNA, 25 bp, Rattus norvegicus
agcgcaacttcaaaaacgcaacttg

SEQ ID NO: 478889 - DNA, 25 bp, Rattus norvegicus
acttgctgatcccagcgtgctttgc

SEQ ID NO: 478890 - DNA, 25 bp, Rattus norvegicus
tgcgcttccgccgtacaaaaacatg

SEQ ID NO: 478891 - DNA, 25 bp, Rattus norvegicus
tttttcctggcccacgggcgcattg

SEQ ID NO: 478892 - DNA, 25 bp, Rattus norvegicus
cccagcatgcaacgcaaaatgcgtc

SEQ ID NO: 478893 - DNA, 25 bp, Rattus norvegicus
cagcagccttgcaccttcatcgaga

SEQ ID NO: 478894 - DNA, 25 bp, Rattus norvegicus
tgatgatcaggaagatggcaggctc

SEQ ID NO: 478895 - DNA, 25 bp, Rattus norvegicus
tggagccacagatccttgtacagta

SEQ ID NO: 478896 - DNA, 25 bp, Rattus norvegicus
aggatctatctcaggctcctttttc

SEQ ID NO: 478897 - DNA, 25 bp, Rattus norvegicus
attggtagcgcaggcttgtcacgcc

SEQ ID NO: 478898 - DNA, 25 bp, Rattus norvegicus
cgcacacagcagcttatctccggga

SEQ ID NO: 478899 - DNA, 25 bp, Rattus norvegicus
ccgtacaaaaacatggtggcgccca

SEQ ID NO: 478900 - DNA, 25 bp, Rattus norvegicus
caagattcagagaggctgacgggct

SEQ ID NO: 478901 - DNA, 25 bp, Rattus norvegicus
tgtcccggcgaacaagattcagaga

SEQ ID NO: 478902 - DNA, 25 bp, Rattus norvegicus
gtcgaaagctgcacccacagaaaag

SEQ ID NO: 478903 - DNA, 25 bp, Rattus norvegicus
aagctgcacccacagaaaagcacgc

SEQ ID NO: 478904 - DNA, 25 bp, Rattus norvegicus
cacagaaaagcacgcctcggtcgcc

SEQ ID NO: 478905 - DNA, 25 bp, Rattus norvegicus
tggtgcggtgacagctgcgacctcc

SEQ ID NO: 478906 - DNA, 25 bp, Rattus norvegicus
cccatttagctgtcccggcgaacaa

SEQ ID NO: 478907 - DNA, 25 bp, Rattus norvegicus
agatgggtcccagagcaagcagagc

SEQ ID NO: 478908 - DNA, 25 bp, Rattus norvegicus
ctaactagggcaactggagtgcgcc

SEQ ID NO: 478909 - DNA, 25 bp, Rattus norvegicus
cgcactccactaactagggcaactg

SEQ ID NO: 478910 - DNA, 25 bp, Rattus norvegicus
gcggatgctcgcactccactaacta

SEQ ID NO: 478911 - DNA, 25 bp, Rattus norvegicus
caaggtcaccgtgcttgctcgtcgg

SEQ ID NO: 478912 - DNA, 25 bp, Rattus norvegicus
gctggccaaggtcaccgtgcttgct

SEQ ID NO: 478913 - DNA, 25 bp, Rattus norvegicus
tcgtgacagctgcacccaccgcgag

SEQ ID NO: 478914 - DNA, 25 bp, Rattus norvegicus
ccatagtgaagagcagggccgaacc

SEQ ID NO: 478915 - DNA, 25 bp, Rattus norvegicus
gcgtactcggctctagcttgcaatg

SEQ ID NO: 478916 - DNA, 25 bp, Rattus norvegicus
tttccatgggaacgccaggatctcg

SEQ ID NO: 478917 - DNA, 25 bp, Rattus norvegicus
ttctgtcaacgttctgcgcggcaca

SEQ ID NO: 478918 - DNA, 25 bp, Rattus norvegicus
tcccggcggcactacaaggaagagg

SEQ ID NO: 478919 - DNA, 25 bp, Rattus norvegicus
ggaagcggctacacaacctcctctg

SEQ ID NO: 478920 - DNA, 25 bp, Rattus norvegicus
gcttgcaatgctcacagcgcgagta

SEQ ID NO: 478921 - DNA, 25 bp, Rattus norvegicus
taccgcccgtaacgtgacatgatgg

SEQ ID NO: 478922 - DNA, 25 bp, Rattus norvegicus
tgctcagtcggaggacagcactgtc

SEQ ID NO: 478923 - DNA, 25 bp, Rattus norvegicus
ggcttcagcctgtccaagagaccaa

SEQ ID NO: 478924 - DNA, 25 bp, Rattus norvegicus
aggaaatgcgccaccacagtcgtca

SEQ ID NO: 478925 - DNA, 25 bp, Rattus norvegicus
agctgccagtttcgttccgtctcca

SEQ ID NO: 478926 - DNA, 25 bp, Rattus norvegicus
cgctggttgcaacggtctttccttc

SEQ ID NO: 478927 - DNA, 25 bp, Rattus norvegicus
atcttccacagcaggcgcaggctca

SEQ ID NO: 478928 - DNA, 25 bp, Rattus norvegicus
gggccgatgtcctaaggaagtgtga

SEQ ID NO: 478929 - DNA, 25 bp, Rattus norvegicus
cctctgtccgctgccaggaagcctc

SEQ ID NO: 478930 - DNA, 25 bp, Rattus norvegicus
gctgccctccggctccgacggcgcg

SEQ ID NO: 478931 - DNA, 25 bp, Rattus norvegicus
ccgcgcggcgtaaagccgccccgcg

SEQ ID NO: 478932 - DNA, 25 bp, Rattus norvegicus
ctctgccggccgcaggcacgccagg

SEQ ID NO: 478933 - DNA, 25 bp, Rattus norvegicus
gcaggcacgccagggccgatgtcct

SEQ ID NO: 478934 - DNA, 25 bp, Rattus norvegicus
cacgccagggccgatgtcctaagga

SEQ ID NO: 478935 - DNA, 25 bp, Rattus norvegicus
acgccagggccgatgtcctaaggaa

SEQ ID NO: 478936 - DNA, 25 bp, Rattus norvegicus
cagggccgatgtcctaaggaagtgt

SEQ ID NO: 478937 - DNA, 25 bp, Rattus norvegicus
taaggaagtgtgaggaggccagaac

SEQ ID NO: 478938 - DNA, 25 bp, Rattus norvegicus
ggaagtgtgaggaggccagaactct

SEQ ID NO: 478939 - DNA, 25 bp, Rattus norvegicus
cgcacagaccctcccctcggggcgg

SEQ ID NO: 478940 - DNA, 25 bp, Rattus norvegicus
gcggtcctctgtccgctgccaggaa

SEQ ID NO: 478941 - DNA, 25 bp, Rattus norvegicus
cgccagggccgatgtcctaaggaag

SEQ ID NO: 478942 - DNA, 25 bp, Rattus norvegicus
ttctgtatttctggagtgcgctttc

SEQ ID NO: 478943 - DNA, 25 bp, Rattus norvegicus
tccaggaaactgacctcagggcgcg

SEQ ID NO: 478944 - DNA, 25 bp, Rattus norvegicus
cgaacgcgcagtggatccaggaaac

SEQ ID NO: 478945 - DNA, 25 bp, Rattus norvegicus
aggtgccgactcactgcggcccaga

SEQ ID NO: 478946 - DNA, 25 bp, Rattus norvegicus
gccgggagctccaggtctgcattca

SEQ ID NO: 478947 - DNA, 25 bp, Rattus norvegicus
gcgatgtccttctcccgagttctga

SEQ ID NO: 478948 - DNA, 25 bp, Rattus norvegicus
tttcagagtaagaagcgcgatgtcc

SEQ ID NO: 478949 - DNA, 25 bp, Rattus norvegicus
cctaactcggaagtttctgggcact

SEQ ID NO: 478950 - DNA, 25 bp, Rattus norvegicus
acatctcgacggctcctaactcgga

SEQ ID NO: 478951 - DNA, 25 bp, Rattus norvegicus
agcgctgctgtttcatgcttcttta

SEQ ID NO: 478952 - DNA, 25 bp, Rattus norvegicus
gctttcggcagctttcgcctttgga

SEQ ID NO: 478953 - DNA, 25 bp, Rattus norvegicus
cgttcggcgcactagtcattctgta

SEQ ID NO: 478954 - DNA, 25 bp, Rattus norvegicus
gggcttcagtccctcagcccaggag

SEQ ID NO: 478955 - DNA, 25 bp, Rattus norvegicus
cgcctttggaaatagagacatctcg

SEQ ID NO: 478956 - DNA, 25 bp, Rattus norvegicus
tgtgcagttcacagcccagagcgcc

SEQ ID NO: 478957 - DNA, 25 bp, Rattus norvegicus
gcagttctttgcgtcatccaggcca

SEQ ID NO: 478958 - DNA, 25 bp, Rattus norvegicus
tctgcgccttctcgggtccaagtct

SEQ ID NO: 478959 - DNA, 25 bp, Rattus norvegicus
gtccggactatgttccacgcgtaaa

SEQ ID NO: 478960 - DNA, 25 bp, Rattus norvegicus
aatctggggtcctctgtcttggcaa

SEQ ID NO: 478961 - DNA, 25 bp, Rattus norvegicus
cccagtctcgacaggccagcaaaag

SEQ ID NO: 478962 - DNA, 25 bp, Rattus norvegicus
gcaaggcattgaagggtccggacta

SEQ ID NO: 478963 - DNA, 25 bp, Rattus norvegicus
tctagaagcggccttgtcggccctg

SEQ ID NO: 478964 - DNA, 25 bp, Rattus norvegicus
gagccctgacgcacggagctcgaga

SEQ ID NO: 478965 - DNA, 25 bp, Rattus norvegicus
agctcccgctgaggacggctgagca

SEQ ID NO: 478966 - DNA, 25 bp, Rattus norvegicus
ttctgctccgctctagcctgtcggg

SEQ ID NO: 478967 - DNA, 25 bp, Rattus norvegicus
tgcgtcccggaaaggcaacgcgagc

SEQ ID NO: 478968 - DNA, 25 bp, Rattus norvegicus
ccctggctggaccatggtgaacacc

SEQ ID NO: 478969 - DNA, 25 bp, Rattus norvegicus
gtaaattcgtcctgcgccctagctc

SEQ ID NO: 478970 - DNA, 25 bp, Rattus norvegicus
gcggtaatctctttcgaagcggcta

SEQ ID NO: 478971 - DNA, 25 bp, Rattus norvegicus
tttcgaagcggctatggtgcctgga

SEQ ID NO: 478972 - DNA, 25 bp, Rattus norvegicus
gaagcggctatggtgcctggacatc

SEQ ID NO: 478973 - DNA, 25 bp, Rattus norvegicus
gtaatctctttcgaagcggctatgg

SEQ ID NO: 478974 - DNA, 25 bp, Rattus norvegicus
cccacgcggtaatctctttcgaagc

SEQ ID NO: 478975 - DNA, 25 bp, Rattus norvegicus
cagcccacgcggtaatctctttcga

SEQ ID NO: 478976 - DNA, 25 bp, Rattus norvegicus
acactccactcacggcggtcccagc

SEQ ID NO: 478977 - DNA, 25 bp, Rattus norvegicus
atggtgcctggacatctcggtgggc

SEQ ID NO: 478978 - DNA, 25 bp, Rattus norvegicus
agactgctggctgtgcctccaccgg

SEQ ID NO: 478979 - DNA, 25 bp, Rattus norvegicus
caccggcaccggaggtgacgctgca

SEQ ID NO: 478980 - DNA, 25 bp, Rattus norvegicus
atgggtcccattgacactccactca

SEQ ID NO: 478981 - DNA, 25 bp, Rattus norvegicus
acgctgcagacgctggtggccccat

SEQ ID NO: 478982 - DNA, 25 bp, Rattus norvegicus
gctgagactgctggctgtgcctcca

SEQ ID NO: 478983 - DNA, 25 bp, Rattus norvegicus
atctctttcgaagcggctatggtgc

SEQ ID NO: 478984 - DNA, 25 bp, Rattus norvegicus
aaagggatccaggtccacctcctcg

SEQ ID NO: 478985 - DNA, 25 bp, Rattus norvegicus
gcgctactcggctccggtgtcatat

SEQ ID NO: 478986 - DNA, 25 bp, Rattus norvegicus
gcttccattggcacacaggcgcgca

SEQ ID NO: 478987 - DNA, 25 bp, Rattus norvegicus
ggggcagaacccatcatctagcttc

SEQ ID NO: 478988 - DNA, 25 bp, Rattus norvegicus
cccaaatgctaggtctgagaacgcg

SEQ ID NO: 478989 - DNA, 25 bp, Rattus norvegicus
tgggatctagtgaagaaacccggtc

SEQ ID NO: 478990 - DNA, 25 bp, Rattus norvegicus
gctcttccacctcgaaagttacttg

SEQ ID NO: 478991 - DNA, 25 bp, Rattus norvegicus
tcacaacacggtctgtgtgggttcc

SEQ ID NO: 478992 - DNA, 25 bp, Rattus norvegicus
cttctgcaggcttgcgagcccagac

SEQ ID NO: 478993 - DNA, 25 bp, Rattus norvegicus
tccggtgtcatatttgcttccagca

SEQ ID NO: 478994 - DNA, 25 bp, Rattus norvegicus
cccgctggaaaccacaaggtgtcaa

SEQ ID NO: 478995 - DNA, 25 bp, Rattus norvegicus
tgtgggttccattcagatgattttc

SEQ ID NO: 478996 - DNA, 25 bp, Rattus norvegicus
tggggaccagctttccagtgctttc

SEQ ID NO: 478997 - DNA, 25 bp, Rattus norvegicus
tagcccagaagctaccaggaccctg

SEQ ID NO: 478998 - DNA, 25 bp, Rattus norvegicus
tccggtcctggtgaagctttgacaa

SEQ ID NO: 478999 - DNA, 25 bp, Rattus norvegicus
acttccggtcctggtgaagctttga

SEQ ID NO: 479000 - DNA, 25 bp, Rattus norvegicus
tcgcacgcaaagcattctaagggtc

SEQ ID NO: 479001 - DNA, 25 bp, Rattus norvegicus
ggagctgccatcacccggatgcaca

SEQ ID NO: 479002 - DNA, 25 bp, Rattus norvegicus
cctggtgaagctttgacaagaggtc

SEQ ID NO: 479003 - DNA, 25 bp, Rattus norvegicus
gagatgctcgcacgcaaagcattct

SEQ ID NO: 479004 - DNA, 25 bp, Rattus norvegicus
tcaggatagcggagctgccatcacc

SEQ ID NO: 479005 - DNA, 25 bp, Rattus norvegicus
atcacccggatgcacagccgcagag

SEQ ID NO: 479006 - DNA, 25 bp, Rattus norvegicus
cccggatgcacagccgcagagctgg

SEQ ID NO: 479007 - DNA, 25 bp, Rattus norvegicus
ctgccagcactgagtgtggtttgtc

SEQ ID NO: 479008 - DNA, 25 bp, Rattus norvegicus
aggtgagatgatgctgccagcactg

SEQ ID NO: 479009 - DNA, 25 bp, Rattus norvegicus
gcggacgaccccgatactttgtgga

SEQ ID NO: 479010 - DNA, 25 bp, Rattus norvegicus
tttgacaagaggtccgcggacgacc

SEQ ID NO: 479011 - DNA, 25 bp, Rattus norvegicus
cactgagtgtggtttgtctgaggaa

SEQ ID NO: 479012 - DNA, 25 bp, Rattus norvegicus
ggacttgcgcctttctctggctagc

SEQ ID NO: 479013 - DNA, 25 bp, Rattus norvegicus
cctttctctggctagcgcgctgctg

SEQ ID NO: 479014 - DNA, 25 bp, Rattus norvegicus
gcctttctctggctagcgcgctgct

SEQ ID NO: 479015 - DNA, 25 bp, Rattus norvegicus
tgcgcctttctctggctagcgcgct

SEQ ID NO: 479016 - DNA, 25 bp, Rattus norvegicus
cttgcgcctttctctggctagcgcg

SEQ ID NO: 479017 - DNA, 25 bp, Rattus norvegicus
gacttgcgcctttctctggctagcg

SEQ ID NO: 479018 - DNA, 25 bp, Rattus norvegicus
ccggacttgcgcctttctctggcta

SEQ ID NO: 479019 - DNA, 25 bp, Rattus norvegicus
acccctagtttctcaagcttcttgg

SEQ ID NO: 479020 - DNA, 25 bp, Rattus norvegicus
tgcaagctgagaagacccctagttt

SEQ ID NO: 479021 - DNA, 25 bp, Rattus norvegicus
gcccccaccttgcaagctgagaaga

SEQ ID NO: 479022 - DNA, 25 bp, Rattus norvegicus
ggcgactagagcttcgtccccattc

SEQ ID NO: 479023 - DNA, 25 bp, Rattus norvegicus
agcggctcggcgactagagcttcgt

SEQ ID NO: 479024 - DNA, 25 bp, Rattus norvegicus
ctgctgctggctcaggccaggtcga

SEQ ID NO: 479025 - DNA, 25 bp, Rattus norvegicus
ggctcggcgactagagcttcgtccc

SEQ ID NO: 479026 - DNA, 25 bp, Rattus norvegicus
acgtcgaataagaagctctggcctg

SEQ ID NO: 479027 - DNA, 25 bp, Rattus norvegicus
tttccgagatccagcgcctagtcct

SEQ ID NO: 479028 - DNA, 25 bp, Rattus norvegicus
gggcgcgtatctcccggaacagact

SEQ ID NO: 479029 - DNA, 25 bp, Rattus norvegicus
gtcgcaaacgccctcgcagtggtat

SEQ ID NO: 479030 - DNA, 25 bp, Rattus norvegicus
cagtggtatgcctcgtagtctaatg

SEQ ID NO: 479031 - DNA, 25 bp, Rattus norvegicus
agctccttaaagtccacatgcagtg

SEQ ID NO: 479032 - DNA, 25 bp, Rattus norvegicus
cctagtcctggatctggtggcagct

SEQ ID NO: 479033 - DNA, 25 bp, Rattus norvegicus
aagcccagtcttctcagggccagcg

SEQ ID NO: 479034 - DNA, 25 bp, Rattus norvegicus
cccgcgagtgcagcaagtgagctgt

SEQ ID NO: 479035 - DNA, 25 bp, Rattus norvegicus
agggtcgcactgtccctgtctggct

SEQ ID NO: 479036 - DNA, 25 bp, Rattus norvegicus
tcggcattcaccacctcgtcggagt

SEQ ID NO: 479037 - DNA, 25 bp, Rattus norvegicus
tccgagaggctggatacgtcgaata

SEQ ID NO: 479038 - DNA, 25 bp, Rattus norvegicus
ctaatggcgcgatgatccagtcgtc

SEQ ID NO: 479039 - DNA, 25 bp, Rattus norvegicus
gaggagatcaccaacagcgcgcgct

SEQ ID NO: 479040 - DNA, 25 bp, Rattus norvegicus
cagagatctccttggctggaagatg

SEQ ID NO: 479041 - DNA, 25 bp, Rattus norvegicus
gccaggctccggtaaagcgacatca

SEQ ID NO: 479042 - DNA, 25 bp, Rattus norvegicus
cgacatcatgaagtggtgtggcacc

SEQ ID NO: 479043 - DNA, 25 bp, Rattus norvegicus
gtggcaccaccgagccgttcctgaa

SEQ ID NO: 479044 - DNA, 25 bp, Rattus norvegicus
cgcagaagacgcgtaaagtaccttg

SEQ ID NO: 479045 - DNA, 25 bp, Rattus norvegicus
ccttgagttgcttggtctgtgaagc

SEQ ID NO: 479046 - DNA, 25 bp, Rattus norvegicus
ccgcgatcttgcgagtgctagcgat

SEQ ID NO: 479047 - DNA, 25 bp, Rattus norvegicus
ttgccaagtgaaggccatccgcccg

SEQ ID NO: 479048 - DNA, 25 bp, Rattus norvegicus
ccctcgttgtaatgccgggtccctg

SEQ ID NO: 479049 - DNA, 25 bp, Rattus norvegicus
caggcctatcgagcaatgcagggta

SEQ ID NO: 479050 - DNA, 25 bp, Rattus norvegicus
ctgaacgctcgacctgtagcgctga

SEQ ID NO: 479051 - DNA, 25 bp, Rattus norvegicus
cccgacgccttttgaacatagtgtt

SEQ ID NO: 479052 - DNA, 25 bp, Rattus norvegicus
caagcgctcagcagccagagacaca

SEQ ID NO: 479053 - DNA, 25 bp, Rattus norvegicus
ctgtgaagccggtgatcgtgtccac

SEQ ID NO: 479054 - DNA, 25 bp, Rattus norvegicus
ccaggacgccagatcccgtgaccgt

SEQ ID NO: 479055 - DNA, 25 bp, Rattus norvegicus
gatcccgtgaccgtccgccagaccg

SEQ ID NO: 479056 - DNA, 25 bp, Rattus norvegicus
gcagcgacgcccaggacgccagatc

SEQ ID NO: 479057 - DNA, 25 bp, Rattus norvegicus
ccgatatgcagtccccggcggtgct

SEQ ID NO: 479058 - DNA, 25 bp, Rattus norvegicus
ggcggtgctcgtcacctccaggtga

SEQ ID NO: 479059 - DNA, 25 bp, Rattus norvegicus
tcccgcactttccagacatcccagc

SEQ ID NO: 479060 - DNA, 25 bp, Rattus norvegicus
acatcccagcagctggcggtttatc

SEQ ID NO: 479061 - DNA, 25 bp, Rattus norvegicus
atcccagcagctggcggtttatccc

SEQ ID NO: 479062 - DNA, 25 bp, Rattus norvegicus
cagcagctggcggtttatcccgctg

SEQ ID NO: 479063 - DNA, 25 bp, Rattus norvegicus
agctggcggtttatcccgctgcacc

SEQ ID NO: 479064 - DNA, 25 bp, Rattus norvegicus
ggtttatcccgctgcaccgcacact

SEQ ID NO: 479065 - DNA, 25 bp, Rattus norvegicus
cccgctgcaccgcacactctcctgc

SEQ ID NO: 479066 - DNA, 25 bp, Rattus norvegicus
actctcctgcgggagtggtggtgcg

SEQ ID NO: 479067 - DNA, 25 bp, Rattus norvegicus
cgccagaccgcagccgatatgcagt

SEQ ID NO: 479068 - DNA, 25 bp, Rattus norvegicus
cgggcacccacttctcggggatgtt

SEQ ID NO: 479069 - DNA, 25 bp, Rattus norvegicus
agctccgtgcggacatgctcatcgc

SEQ ID NO: 479070 - DNA, 25 bp, Rattus norvegicus
ggttcttctccagacctagggtaca

SEQ ID NO: 479071 - DNA, 25 bp, Rattus norvegicus
ctcatcgctgcgcaggtcttttttg

SEQ ID NO: 479072 - DNA, 25 bp, Rattus norvegicus
ggccaccaagatgatgggcacattg

SEQ ID NO: 479073 - DNA, 25 bp, Rattus norvegicus
cgggttcccgtcagcttgattgaca

SEQ ID NO: 479074 - DNA, 25 bp, Rattus norvegicus
tagcgcccgctatttaaagagtccg

SEQ ID NO: 479075 - DNA, 25 bp, Rattus norvegicus
gctaggcacgctaactgcacctgga

SEQ ID NO: 479076 - DNA, 25 bp, Rattus norvegicus
accaccagcttcttgcggatggccg

SEQ ID NO: 479077 - DNA, 25 bp, Rattus norvegicus
tcggggaactcgtccttactgaaca

SEQ ID NO: 479078 - DNA, 25 bp, Rattus norvegicus
ttctcgaacacggtgggcacgtaca

SEQ ID NO: 479079 - DNA, 25 bp, Rattus norvegicus
taaacgatcgtagtcctcctggccc

SEQ ID NO: 479080 - DNA, 25 bp, Rattus norvegicus
tccgggctgtctaccgagaagcaca

SEQ ID NO: 479081 - DNA, 25 bp, Rattus norvegicus
gagtccggccactttcttaatatag

SEQ ID NO: 479082 - DNA, 25 bp, Rattus norvegicus
aggcaggcctggcaaccttgaaccc

SEQ ID NO: 479083 - DNA, 25 bp, Rattus norvegicus
caggatcctgttggtcccggttcac

SEQ ID NO: 479084 - DNA, 25 bp, Rattus norvegicus
aatccggagatatggtctgggcctc

SEQ ID NO: 479085 - DNA, 25 bp, Rattus norvegicus
gtcctcggatgtgagctctggagaa

SEQ ID NO: 479086 - DNA, 25 bp, Rattus norvegicus
tggacgacctcgactgcagatcccg

SEQ ID NO: 479087 - DNA, 25 bp, Rattus norvegicus
acacgccacgttaggccgtacctgg

SEQ ID NO: 479088 - DNA, 25 bp, Rattus norvegicus
ggttcggcctccttcttggacctca

SEQ ID NO: 479089 - DNA, 25 bp, Rattus norvegicus
cccttgcatgtttgcttccgggtga

SEQ ID NO: 479090 - DNA, 25 bp, Rattus norvegicus
ctgagtcgcgaaagcctgtcctaca

SEQ ID NO: 479091 - DNA, 25 bp, Rattus norvegicus
ctgtcctacacgtctccatcaagtg

SEQ ID NO: 479092 - DNA, 25 bp, Rattus norvegicus
catcaagtgagtgcgcttcctccca

SEQ ID NO: 479093 - DNA, 25 bp, Rattus norvegicus
aagggcgccttcacctggagccgat

SEQ ID NO: 479094 - DNA, 25 bp, Rattus norvegicus
gagccagctgcagcgttcgcaatgg

SEQ ID NO: 479095 - DNA, 25 bp, Rattus norvegicus
acagacaggaccatcggggcaggac

SEQ ID NO: 479096 - DNA, 25 bp, Rattus norvegicus
tttctcccgaagtgccttgcgcgcg

SEQ ID NO: 479097 - DNA, 25 bp, Rattus norvegicus
cttgggttcccgcagtctggaagaa

SEQ ID NO: 479098 - DNA, 25 bp, Rattus norvegicus
gtctggaagaagctcggtggaccca

SEQ ID NO: 479099 - DNA, 25 bp, Rattus norvegicus
cggccttagtgaccaaatcgtgtgc

SEQ ID NO: 479100 - DNA, 25 bp, Rattus norvegicus
ggagaaagaagacgtcgccgccacc

SEQ ID NO: 479101 - DNA, 25 bp, Rattus norvegicus
ccgccatgttgttgggagtctctgg

SEQ ID NO: 479102 - DNA, 25 bp, Rattus norvegicus
cacatcactgagaggcgtcgcgtct

SEQ ID NO: 479103 - DNA, 25 bp, Rattus norvegicus
cgggagaagctacgcacatcactga

SEQ ID NO: 479104 - DNA, 25 bp, Rattus norvegicus
agccgcgacagtgcgcatgcgcaga

SEQ ID NO: 479105 - DNA, 25 bp, Rattus norvegicus
cacccgcgagaagagagccgcgaca

SEQ ID NO: 479106 - DNA, 25 bp, Rattus norvegicus
aaaggccggtacgtgcacgcttgat

SEQ ID NO: 479107 - DNA, 25 bp, Rattus norvegicus
ctcggtggacccagagaaacgtgcg

SEQ ID NO: 479108 - DNA, 25 bp, Rattus norvegicus
cgatagaggtcgagcgcgaagccca

SEQ ID NO: 479109 - DNA, 25 bp, Rattus norvegicus
tgaccaaatcgtgtgccagccggcc

SEQ ID NO: 479110 - DNA, 25 bp, Rattus norvegicus
cgaagcgcagagcaatcagcagagc

SEQ ID NO: 479111 - DNA, 25 bp, Rattus norvegicus
ttggcttcaccacgctaaggagcta

SEQ ID NO: 479112 - DNA, 25 bp, Rattus norvegicus
cgggattaaggctgttcttgggaca

SEQ ID NO: 479113 - DNA, 25 bp, Rattus norvegicus
ttgcacccgggcaagtttgggctca

SEQ ID NO: 479114 - DNA, 25 bp, Rattus norvegicus
ggccatggccacaatgccttttcca

SEQ ID NO: 479115 - DNA, 25 bp, Rattus norvegicus
gttgctgtctcgctggccatttcag

SEQ ID NO: 479116 - DNA, 25 bp, Rattus norvegicus
ggagttgctctctcccgttgctgtc

SEQ ID NO: 479117 - DNA, 25 bp, Rattus norvegicus
actccacatgggtctgagtccgccg

SEQ ID NO: 479118 - DNA, 25 bp, Rattus norvegicus
tggttctccgctctcaattaagtaa

SEQ ID NO: 479119 - DNA, 25 bp, Rattus norvegicus
cccgcagagtggaacctcccttggt

SEQ ID NO: 479120 - DNA, 25 bp, Rattus norvegicus
tgttccagttcctccacggtccgtg

SEQ ID NO: 479121 - DNA, 25 bp, Rattus norvegicus
agcccttaaatgaggactcctgttc

SEQ ID NO: 479122 - DNA, 25 bp, Rattus norvegicus
tccagggatggtgagcccttaaatg

SEQ ID NO: 479123 - DNA, 25 bp, Rattus norvegicus
accttgggcttttctctggctgtcc

SEQ ID NO: 479124 - DNA, 25 bp, Rattus norvegicus
ctctgattaaaagtctcgttgccga

SEQ ID NO: 479125 - DNA, 25 bp, Rattus norvegicus
tgcgcttcattggtctgtatgtacc

SEQ ID NO: 479126 - DNA, 25 bp, Rattus norvegicus
tcgggcatggtaaactacggagata

SEQ ID NO: 479127 - DNA, 25 bp, Rattus norvegicus
ccgcgtccaaacagcaccagagaga

SEQ ID NO: 479128 - DNA, 25 bp, Rattus norvegicus
ttgggcgtgagctgtttcaatctcc

SEQ ID NO: 479129 - DNA, 25 bp, Rattus norvegicus
aggtaacccggctttctgcgcttca

SEQ ID NO: 479130 - DNA, 25 bp, Rattus norvegicus
aagacgcgtcgtttggctttggaca

SEQ ID NO: 479131 - DNA, 25 bp, Rattus norvegicus
cccgatggtgtccatgactttcaaa

SEQ ID NO: 479132 - DNA, 25 bp, Rattus norvegicus
tgtccgcaccgggacgatcatcctg

SEQ ID NO: 479133 - DNA, 25 bp, Rattus norvegicus
gatcatcctggggacctggtacatg

SEQ ID NO: 479134 - DNA, 25 bp, Rattus norvegicus
cttttaactgtgaactgaggccggg

SEQ ID NO: 479135 - DNA, 25 bp, Rattus norvegicus
ggactttacgagacggggctcacca

SEQ ID NO: 479136 - DNA, 25 bp, Rattus norvegicus
tgggcatcgcagtgacaaagacaac

SEQ ID NO: 479137 - DNA, 25 bp, Rattus norvegicus
accgctgggccgaaagcttttgtca

SEQ ID NO: 479138 - DNA, 25 bp, Rattus norvegicus
atgttgttctcagccctcttacgca

SEQ ID NO: 479139 - DNA, 25 bp, Rattus norvegicus
tgtccgccgactggggacaagagtc

SEQ ID NO: 479140 - DNA, 25 bp, Rattus norvegicus
ggagcctcagaagcgggacctttaa

SEQ ID NO: 479141 - DNA, 25 bp, Rattus norvegicus
catttctctgctcgggctacttcca

SEQ ID NO: 479142 - DNA, 25 bp, Rattus norvegicus
ggcagccctgggcatttctctgctc

SEQ ID NO: 479143 - DNA, 25 bp, Rattus norvegicus
gctgctcctggacgtttgacccgcg

SEQ ID NO: 479144 - DNA, 25 bp, Rattus norvegicus
aagcccatcatgttgttctcagccc

SEQ ID NO: 479145 - DNA, 25 bp, Rattus norvegicus
gcaggtcgtcaagcccatcatgttg

SEQ ID NO: 479146 - DNA, 25 bp, Rattus norvegicus
tctagtcacctcgtggctcacagac

SEQ ID NO: 479147 - DNA, 25 bp, Rattus norvegicus
agtactctagtcacctcgtggctca

SEQ ID NO: 479148 - DNA, 25 bp, Rattus norvegicus
cgcgaccgacccttagtactctagt

SEQ ID NO: 479149 - DNA, 25 bp, Rattus norvegicus
attggtcgcggacgtgcgatcccac

SEQ ID NO: 479150 - DNA, 25 bp, Rattus norvegicus
cctttaaattggtcgcggacgtgcg

SEQ ID NO: 479151 - DNA, 25 bp, Rattus norvegicus
tttgacccgcgcgagtgtccgccga

SEQ ID NO: 479152 - DNA, 25 bp, Rattus norvegicus
cctccattcctgtatcctggcggta

SEQ ID NO: 479153 - DNA, 25 bp, Rattus norvegicus
atggaggtgtagaacgcgttatgta

SEQ ID NO: 479154 - DNA, 25 bp, Rattus norvegicus
aggccacaccggaagtcctctaagc

SEQ ID NO: 479155 - DNA, 25 bp, Rattus norvegicus
gcgacgggagcttctccgagacacc

SEQ ID NO: 479156 - DNA, 25 bp, Rattus norvegicus
agacaccggtgctcgcaaatggagg

SEQ ID NO: 479157 - DNA, 25 bp, Rattus norvegicus
gcgttatgtatagcgggccttggcc

SEQ ID NO: 479158 - DNA, 25 bp, Rattus norvegicus
cgctgccggtcatcttctccgagtt

SEQ ID NO: 479159 - DNA, 25 bp, Rattus norvegicus
tctccgagttcccacgatgttcttc

SEQ ID NO: 479160 - DNA, 25 bp, Rattus norvegicus
cccacgatgttcttctacctgagca

SEQ ID NO: 479161 - DNA, 25 bp, Rattus norvegicus
tgagtttctcttggggaccgccatc

SEQ ID NO: 479162 - DNA, 25 bp, Rattus norvegicus
acgacaaccagcaccaggccggagg

SEQ ID NO: 479163 - DNA, 25 bp, Rattus norvegicus
tggcggtacctgcattctcccagga

SEQ ID NO: 479164 - DNA, 25 bp, Rattus norvegicus
ctcctccagcgggtagttcttggcc

SEQ ID NO: 479165 - DNA, 25 bp, Rattus norvegicus
tctacctgagcaagaaagtgagttt

SEQ ID NO: 479166 - DNA, 25 bp, Rattus norvegicus
tccggatccggatcttcagctctgc

SEQ ID NO: 479167 - DNA, 25 bp, Rattus norvegicus
caatcaacgcgggaaaggaggaaga

SEQ ID NO: 479168 - DNA, 25 bp, Rattus norvegicus
tacccacaatcaacgcgggaaagga

SEQ ID NO: 479169 - DNA, 25 bp, Rattus norvegicus
agccgctccggatccggatcttcag

SEQ ID NO: 479170 - DNA, 25 bp, Rattus norvegicus
ctccggcctccacttccgcctttca

SEQ ID NO: 479171 - DNA, 25 bp, Rattus norvegicus
cccgcctctctatagtctcaggtaa

SEQ ID NO: 479172 - DNA, 25 bp, Rattus norvegicus
gcctctctatagtctcaggtaactg

SEQ ID NO: 479173 - DNA, 25 bp, Rattus norvegicus
tctcaggtaactgacagaaaggaca

SEQ ID NO: 479174 - DNA, 25 bp, Rattus norvegicus
cagaaaggacagaccaatgggagac

SEQ ID NO: 479175 - DNA, 25 bp, Rattus norvegicus
ggacagaccaatgggagacactccg

SEQ ID NO: 479176 - DNA, 25 bp, Rattus norvegicus
accaatgggagacactccgatccta

SEQ ID NO: 479177 - DNA, 25 bp, Rattus norvegicus
atgggagacactccgatcctaccca

SEQ ID NO: 479178 - DNA, 25 bp, Rattus norvegicus
gatcctacccacaatcaacgcggga

SEQ ID NO: 479179 - DNA, 25 bp, Rattus norvegicus
ccacttccgcctttcagccgctccg

SEQ ID NO: 479180 - DNA, 25 bp, Rattus norvegicus
aagtccagtgcagcgaccctcacag

SEQ ID NO: 479181 - DNA, 25 bp, Rattus norvegicus
tcaccggctcgagttcagattcaga

SEQ ID NO: 479182 - DNA, 25 bp, Rattus norvegicus
gaccaacgcggaacaaggtaactga

SEQ ID NO: 479183 - DNA, 25 bp, Rattus norvegicus
ctaagggatgagtgagacgtagctc

SEQ ID NO: 479184 - DNA, 25 bp, Rattus norvegicus
agcaagttctcaccggctcgagttc

SEQ ID NO: 479185 - DNA, 25 bp, Rattus norvegicus
cagattcagaaaaggagccaggagc

SEQ ID NO: 479186 - DNA, 25 bp, Rattus norvegicus
agccaggagcgaagctcaccagacc

SEQ ID NO: 479187 - DNA, 25 bp, Rattus norvegicus
cgcttggagtcaccgcagctagaga

SEQ ID NO: 479188 - DNA, 25 bp, Rattus norvegicus
tagagaagcgtcaggactctagttc

SEQ ID NO: 479189 - DNA, 25 bp, Rattus norvegicus
tccagagtctctggtcactcaagtc

SEQ ID NO: 479190 - DNA, 25 bp, Rattus norvegicus
acagacgcgctttgcccgggaccaa

SEQ ID NO: 479191 - DNA, 25 bp, Rattus norvegicus
cggaacaaggtaactgaagccctgg

SEQ ID NO: 479192 - DNA, 25 bp, Rattus norvegicus
actctagttcgccaggggtgccagg

SEQ ID NO: 479193 - DNA, 25 bp, Rattus norvegicus
tagctcggcctcttcccagcaagtt

SEQ ID NO: 479194 - DNA, 25 bp, Rattus norvegicus
tattgcgactggcactttatgctga

SEQ ID NO: 479195 - DNA, 25 bp, Rattus norvegicus
ccgcgcgactcctgggcctccagct

SEQ ID NO: 479196 - DNA, 25 bp, Rattus norvegicus
tgaccttcagctccgggcgcggaaa

SEQ ID NO: 479197 - DNA, 25 bp, Rattus norvegicus
gaaaccgggctgagaaccaggcgcc

SEQ ID NO: 479198 - DNA, 25 bp, Rattus norvegicus
aaccgggctgagaaccaggcgcccg

SEQ ID NO: 479199 - DNA, 25 bp, Rattus norvegicus
ctgttccaacggtgcgtgtgagcga

SEQ ID NO: 479200 - DNA, 25 bp, Rattus norvegicus
ctggcactttatgctgacatcggta

SEQ ID NO: 479201 - DNA, 25 bp, Rattus norvegicus
ccgggcgttgtattgcgactggcac

SEQ ID NO: 479202 - DNA, 25 bp, Rattus norvegicus
gttgtattgcgactggcactttatg

SEQ ID NO: 479203 - DNA, 25 bp, Rattus norvegicus
gcgactggcactttatgctgacatc

SEQ ID NO: 479204 - DNA, 25 bp, Rattus norvegicus
agctgaccttcagctccgggcgcgg

SEQ ID NO: 479205 - DNA, 25 bp, Rattus norvegicus
ttgcgactggcactttatgctgaca

SEQ ID NO: 479206 - DNA, 25 bp, Rattus norvegicus
gcactttatgctgacatcggtaacg

SEQ ID NO: 479207 - DNA, 25 bp, Rattus norvegicus
gcgttgtattgcgactggcacttta

SEQ ID NO: 479208 - DNA, 25 bp, Rattus norvegicus
cccagagtccttcgcgtgtaggtgg

SEQ ID NO: 479209 - DNA, 25 bp, Rattus norvegicus
ggagctggatctcgcctcgctgcgc

SEQ ID NO: 479210 - DNA, 25 bp, Rattus norvegicus
aaccggtgtgctaggccctgtgcac

SEQ ID NO: 479211 - DNA, 25 bp, Rattus norvegicus
gcaccctgcccggaaggctatggca

SEQ ID NO: 479212 - DNA, 25 bp, Rattus norvegicus
agcccggcggttctctgggtcaagt

SEQ ID NO: 479213 - DNA, 25 bp, Rattus norvegicus
gagacccgggcctcatgcacgggaa

SEQ ID NO: 479214 - DNA, 25 bp, Rattus norvegicus
agacagtgctgatcaccggagcaaa

SEQ ID NO: 479215 - DNA, 25 bp, Rattus norvegicus
accggagcaaacagtggcctgggcc

SEQ ID NO: 479216 - DNA, 25 bp, Rattus norvegicus
tcatcatgggatgtcgggaccgcgc

SEQ ID NO: 479217 - DNA, 25 bp, Rattus norvegicus
gtctcgggcccgatgccaccgatgg

SEQ ID NO: 479218 - DNA, 25 bp, Rattus norvegicus
ccaccgatggccagctggtcgttaa

SEQ ID NO: 479219 - DNA, 25 bp, Rattus norvegicus
tcgttaaggagctggatctcgcctc

SEQ ID NO: 479220 - DNA, 25 bp, Rattus norvegicus
cctcatgcacgggaagacagtgctg

SEQ ID NO: 479221 - DNA, 25 bp, Rattus norvegicus
cctggactccggaaccggtgtgcta

SEQ ID NO: 479222 - DNA, 25 bp, Rattus norvegicus
ggcagtccgcagctcgcgcaacagg

SEQ ID NO: 479223 - DNA, 25 bp, Rattus norvegicus
gtggggacccaagcaggtacctgca

SEQ ID NO: 479224 - DNA, 25 bp, Rattus norvegicus
tacaataaagttgaggggtcgcctg

SEQ ID NO: 479225 - DNA, 25 bp, Rattus norvegicus
tgcacccataacctgaaaaccattg

SEQ ID NO: 479226 - DNA, 25 bp, Rattus norvegicus
tccctaagcagattttgcacccata

SEQ ID NO: 479227 - DNA, 25 bp, Rattus norvegicus
cgcaacaggcagagtccgagctcca

SEQ ID NO: 479228 - DNA, 25 bp, Rattus norvegicus
acccacgctcggtttgggcagtccg

SEQ ID NO: 479229 - DNA, 25 bp, Rattus norvegicus
cgtccaaagagacccacgctcggtt

SEQ ID NO: 479230 - DNA, 25 bp, Rattus norvegicus
gctccctttcctaggcgtccaaaga

SEQ ID NO: 479231 - DNA, 25 bp, Rattus norvegicus
aagctggtcctagctccctttccta

SEQ ID NO: 479232 - DNA, 25 bp, Rattus norvegicus
agtctccagtcggtcctccacttaa

SEQ ID NO: 479233 - DNA, 25 bp, Rattus norvegicus
actaacatttgccaggaaagcgcct

SEQ ID NO: 479234 - DNA, 25 bp, Rattus norvegicus
gcccgggaaacactaacatttgcca

SEQ ID NO: 479235 - DNA, 25 bp, Rattus norvegicus
cacccggcaggatgcaaagtcccta

SEQ ID NO: 479236 - DNA, 25 bp, Rattus norvegicus
cagcggtctagatccgccgcagagg

SEQ ID NO: 479237 - DNA, 25 bp, Rattus norvegicus
gcagcagttcgaatccagcgccatc

SEQ ID NO: 479238 - DNA, 25 bp, Rattus norvegicus
catgcgtagagctgttgccaaggcg

SEQ ID NO: 479239 - DNA, 25 bp, Rattus norvegicus
ttccggttccctctggccgactaga

SEQ ID NO: 479240 - DNA, 25 bp, Rattus norvegicus
tctggccgactagagcggcgcgaaa

SEQ ID NO: 479241 - DNA, 25 bp, Rattus norvegicus
tgtctgcagggctcccgcctgcatt

SEQ ID NO: 479242 - DNA, 25 bp, Rattus norvegicus
cttagggtggccttcgtgtcgtgac

SEQ ID NO: 479243 - DNA, 25 bp, Rattus norvegicus
tcgtgacagccgtgcggactagctt

SEQ ID NO: 479244 - DNA, 25 bp, Rattus norvegicus
gagggcgcgtgcttcctctctccat

SEQ ID NO: 479245 - DNA, 25 bp, Rattus norvegicus
agacgcagctctccgccgcgggaaa

SEQ ID NO: 479246 - DNA, 25 bp, Rattus norvegicus
ctccgccgcgggaaacttggccgtg

SEQ ID NO: 479247 - DNA, 25 bp, Rattus norvegicus
ccggcgtcggagctgggtattccac

SEQ ID NO: 479248 - DNA, 25 bp, Rattus norvegicus
agctgggtattccacgcgcaggcac

SEQ ID NO: 479249 - DNA, 25 bp, Rattus norvegicus
tcggccctgcggacgcatgcgtaga

SEQ ID NO: 479250 - DNA, 25 bp, Rattus norvegicus
agcctggacatctgcttcctgcggc

SEQ ID NO: 479251 - DNA, 25 bp, Rattus norvegicus
tggcagggcgtttaccacacctaga

SEQ ID NO: 479252 - DNA, 25 bp, Rattus norvegicus
gttacaggatctggccctggtggcc

SEQ ID NO: 479253 - DNA, 25 bp, Rattus norvegicus
ccagcacacgcgtggttacaggatc

SEQ ID NO: 479254 - DNA, 25 bp, Rattus norvegicus
ccgggcctagatctcagggccagtc

SEQ ID NO: 479255 - DNA, 25 bp, Rattus norvegicus
cagaggtcccaaagcgaaaaacaga

SEQ ID NO: 479256 - DNA, 25 bp, Rattus norvegicus
tcaaggtcgagcgtgctcccgcatc

SEQ ID NO: 479257 - DNA, 25 bp, Rattus norvegicus
ctacagcacgcgcagcagcagcgga

SEQ ID NO: 479258 - DNA, 25 bp, Rattus norvegicus
ctgagccgctcgctcaaggagttcc

SEQ ID NO: 479259 - DNA, 25 bp, Rattus norvegicus
cagcagcggcgcctacaagctggag

SEQ ID NO: 479260 - DNA, 25 bp, Rattus norvegicus
aggcgccagcgctcttcgacaactg

SEQ ID NO: 479261 - DNA, 25 bp, Rattus norvegicus
ctacgacgaggagcccttccaggcg

SEQ ID NO: 479262 - DNA, 25 bp, Rattus norvegicus
gccgctgcaggccatcccagagatg

SEQ ID NO: 479263 - DNA, 25 bp, Rattus norvegicus
gcacacgggaaagccaagccgctga

SEQ ID NO: 479264 - DNA, 25 bp, Rattus norvegicus
cgactctctcacgaactgttcttgg

SEQ ID NO: 479265 - DNA, 25 bp, Rattus norvegicus
gctcacgactctctcacgaactgtt

SEQ ID NO: 479266 - DNA, 25 bp, Rattus norvegicus
ggagaggcatccacagcggcggagc

SEQ ID NO: 479267 - DNA, 25 bp, Rattus norvegicus
agctagctcacgactctctcacgaa

SEQ ID NO: 479268 - DNA, 25 bp, Rattus norvegicus
cgaactgttcttggttcccgagcca

SEQ ID NO: 479269 - DNA, 25 bp, Rattus norvegicus
aagcagctagctcacgactctctca

SEQ ID NO: 479270 - DNA, 25 bp, Rattus norvegicus
gagggaagcagctagctcacgactc

SEQ ID NO: 479271 - DNA, 25 bp, Rattus norvegicus
gccgggatcgcgacgccctgcagcc

SEQ ID NO: 479272 - DNA, 25 bp, Rattus norvegicus
agtggctttcctcgccgggatcgcg

SEQ ID NO: 479273 - DNA, 25 bp, Rattus norvegicus
cgacagtggctttcctcgccgggat

SEQ ID NO: 479274 - DNA, 25 bp, Rattus norvegicus
gagcgaggcgacagtggctttcctc

SEQ ID NO: 479275 - DNA, 25 bp, Rattus norvegicus
gctgggactcgcagggaaaggtgct

SEQ ID NO: 479276 - DNA, 25 bp, Rattus norvegicus
gacagcggctgcgactctggtgagc

SEQ ID NO: 479277 - DNA, 25 bp, Rattus norvegicus
ctgttcttggttcccgagccagagg

SEQ ID NO: 479278 - DNA, 25 bp, Rattus norvegicus
aggacgaccgcctgcacgagcagga

SEQ ID NO: 479279 - DNA, 25 bp, Rattus norvegicus
gccgtgctgcagcttctcgttcact

SEQ ID NO: 479280 - DNA, 25 bp, Rattus norvegicus
gctccagcttctcgcgggcagagaa

SEQ ID NO: 479281 - DNA, 25 bp, Rattus norvegicus
gcagtcctgaaggatgaccggatta

SEQ ID NO: 479282 - DNA, 25 bp, Rattus norvegicus
accggattaggagtgaggccaccca

SEQ ID NO: 479283 - DNA, 25 bp, Rattus norvegicus
atctccgtggcccaatttgagggct

SEQ ID NO: 479284 - DNA, 25 bp, Rattus norvegicus
cgggaccgccgaagtagaagtcatc

SEQ ID NO: 479285 - DNA, 25 bp, Rattus norvegicus
acacactccgcagccgggtgggaaa

SEQ ID NO: 479286 - DNA, 25 bp, Rattus norvegicus
actctcgcttgttcaccgggaaggg

SEQ ID NO: 479287 - DNA, 25 bp, Rattus norvegicus
ggcaccgaagccgactctcgcttgt

SEQ ID NO: 479288 - DNA, 25 bp, Rattus norvegicus
ctcccggagccggacaggatgagct

SEQ ID NO: 479289 - DNA, 25 bp, Rattus norvegicus
ggctacagccgggacagacacacta

SEQ ID NO: 479290 - DNA, 25 bp, Rattus norvegicus
gccactgttggcaggacgaccgcct

SEQ ID NO: 479291 - DNA, 25 bp, Rattus norvegicus
gacacactagtgaccacagcgctgg

SEQ ID NO: 479292 - DNA, 25 bp, Rattus norvegicus
agtaccgctccttacctcccgcaga

SEQ ID NO: 479293 - DNA, 25 bp, Rattus norvegicus
tggctagcgctcgttcggctccaac

SEQ ID NO: 479294 - DNA, 25 bp, Rattus norvegicus
tcggctccaacccagttcccaggag

SEQ ID NO: 479295 - DNA, 25 bp, Rattus norvegicus
gcttacgcctggctagcgctcgttc

SEQ ID NO: 479296 - DNA, 25 bp, Rattus norvegicus
tgtgtgcgcgcttacgcctggctag

SEQ ID NO: 479297 - DNA, 25 bp, Rattus norvegicus
tcgtcctcgggacgctgcagtgtgt

SEQ ID NO: 479298 - DNA, 25 bp, Rattus norvegicus
ttacctcccgcagactgccggggat

SEQ ID NO: 479299 - DNA, 25 bp, Rattus norvegicus
gctcggaggtttgcaagtaccgctc

SEQ ID NO: 479300 - DNA, 25 bp, Rattus norvegicus
cccggcgctcggaggtttgcaagta

SEQ ID NO: 479301 - DNA, 25 bp, Rattus norvegicus
ggggtttgcctagccgcagcgctcc

SEQ ID NO: 479302 - DNA, 25 bp, Rattus norvegicus
gtctaggggtttgcctagccgcagc

SEQ ID NO: 479303 - DNA, 25 bp, Rattus norvegicus
aaagcccggcatatttgggcgcagg

SEQ ID NO: 479304 - DNA, 25 bp, Rattus norvegicus
ccgcgtctaggggtttgcctagccg

SEQ ID NO: 479305 - DNA, 25 bp, Rattus norvegicus
gaggtttgcaagtaccgctccttac

SEQ ID NO: 479306 - DNA, 25 bp, Rattus norvegicus
gagagactcggagacacgcccacca

SEQ ID NO: 479307 - DNA, 25 bp, Rattus norvegicus
ctacgcgcgtggttccctggctgct

SEQ ID NO: 479308 - DNA, 25 bp, Rattus norvegicus
gcccttctttcagggtgatcacgcc

SEQ ID NO: 479309 - DNA, 25 bp, Rattus norvegicus
ggctccgcccttctttcagggtgat

SEQ ID NO: 479310 - DNA, 25 bp, Rattus norvegicus
ccaagcttaagaggtgggactcgaa

SEQ ID NO: 479311 - DNA, 25 bp, Rattus norvegicus
accatccaagcttaagaggtgggac

SEQ ID NO: 479312 - DNA, 25 bp, Rattus norvegicus
cccacgcgtgtctcttggggagaga

SEQ ID NO: 479313 - DNA, 25 bp, Rattus norvegicus
ctcgcagcacttcgggagccgccac

SEQ ID NO: 479314 - DNA, 25 bp, Rattus norvegicus
tagttctaagctccgctcgcagcac

SEQ ID NO: 479315 - DNA, 25 bp, Rattus norvegicus
ctgttagttctaagctccgctcgca

SEQ ID NO: 479316 - DNA, 25 bp, Rattus norvegicus
ctgtgtgctctgaacctgttagttc

SEQ ID NO: 479317 - DNA, 25 bp, Rattus norvegicus
ggttccctggctgctccggtagctc

SEQ ID NO: 479318 - DNA, 25 bp, Rattus norvegicus
tccagaaaggtgttttgcggggcca

SEQ ID NO: 479319 - DNA, 25 bp, Rattus norvegicus
ctcacgcgtgccgtcaaagcgagtg

SEQ ID NO: 479320 - DNA, 25 bp, Rattus norvegicus
cccacgtaggaacgagaccgcagga

SEQ ID NO: 479321 - DNA, 25 bp, Rattus norvegicus
gtgggcacgtttctctccctaaaca

SEQ ID NO: 479322 - DNA, 25 bp, Rattus norvegicus
tgtattcttcgctcacaaccgtggg

SEQ ID NO: 479323 - DNA, 25 bp, Rattus norvegicus
ctagagcagggtgcgtgtattcttc

SEQ ID NO: 479324 - DNA, 25 bp, Rattus norvegicus
tgatcagagagagcgcgacatctta

SEQ ID NO: 479325 - DNA, 25 bp, Rattus norvegicus
cctcacttacgaggtggcgtgatca

SEQ ID NO: 479326 - DNA, 25 bp, Rattus norvegicus
tcgaggaaagccaccatcaacttgg

SEQ ID NO: 479327 - DNA, 25 bp, Rattus norvegicus
gttgcccaaaccaccgctcagtata

SEQ ID NO: 479328 - DNA, 25 bp, Rattus norvegicus
cgaacagctgcattcgttgcccaaa

SEQ ID NO: 479329 - DNA, 25 bp, Rattus norvegicus
cgaagcctgggttgaattccgaaca

SEQ ID NO: 479330 - DNA, 25 bp, Rattus norvegicus
cctaccgcggaatggattgtgagac

SEQ ID NO: 479331 - DNA, 25 bp, Rattus norvegicus
cccgcgagacagttagcgaatccta

SEQ ID NO: 479332 - DNA, 25 bp, Rattus norvegicus
cacctcgcggagacaagcagaaagc

SEQ ID NO: 479333 - DNA, 25 bp, Rattus norvegicus
ccgcaggaggtttctagtttcaaat

SEQ ID NO: 479334 - DNA, 25 bp, Rattus norvegicus
aaggtggaaggaaaagctgcttagc

SEQ ID NO: 479335 - DNA, 25 bp, Rattus norvegicus
ttttccaattccgggcggggatgca

SEQ ID NO: 479336 - DNA, 25 bp, Rattus norvegicus
gactccgcgagtgcagatgccacgg

SEQ ID NO: 479337 - DNA, 25 bp, Rattus norvegicus
ggttccgaggacgaaaagatcctgc

SEQ ID NO: 479338 - DNA, 25 bp, Rattus norvegicus
tatgcacagtggaaaagacgaaggc

SEQ ID NO: 479339 - DNA, 25 bp, Rattus norvegicus
aagctgcttagcgaagattcccggg

SEQ ID NO: 479340 - DNA, 25 bp, Rattus norvegicus
ttagcgaagattcccgggcaagccc

SEQ ID NO: 479341 - DNA, 25 bp, Rattus norvegicus
ttcccggagggcgatagctcttcgg

SEQ ID NO: 479342 - DNA, 25 bp, Rattus norvegicus
gggcgatagctcttcggtcgcccgc

SEQ ID NO: 479343 - DNA, 25 bp, Rattus norvegicus
gaacccactgacacaacagaacatt

SEQ ID NO: 479344 - DNA, 25 bp, Rattus norvegicus
tcgaggcgagttgctcgtaaccctt

SEQ ID NO: 479345 - DNA, 25 bp, Rattus norvegicus
agttgctcgtaacccttcagcttcc

SEQ ID NO: 479346 - DNA, 25 bp, Rattus norvegicus
acgcaccggagaaggccgccatctt

SEQ ID NO: 479347 - DNA, 25 bp, Rattus norvegicus
tgagtcgtgcaggtgagtatgcaca

SEQ ID NO: 479348 - DNA, 25 bp, Rattus norvegicus
ctctgcagacgaggaggagacgatt

SEQ ID NO: 479349 - DNA, 25 bp, Rattus norvegicus
acgtcgcggtgccacgcagtgccag

SEQ ID NO: 479350 - DNA, 25 bp, Rattus norvegicus
cttttaagactgtaggcatggcgcg

SEQ ID NO: 479351 - DNA, 25 bp, Rattus norvegicus
ccgagacagaagtgcaggtgagcct

SEQ ID NO: 479352 - DNA, 25 bp, Rattus norvegicus
agtggccacccgagacagaagtgca

SEQ ID NO: 479353 - DNA, 25 bp, Rattus norvegicus
gtcaacaccgagtggccacccgaga

SEQ ID NO: 479354 - DNA, 25 bp, Rattus norvegicus
ggagacgattctctatgacttgcta

SEQ ID NO: 479355 - DNA, 25 bp, Rattus norvegicus
gccggctttgagtccgggctctgca

SEQ ID NO: 479356 - DNA, 25 bp, Rattus norvegicus
caccactctgtttcaggccaacatg

SEQ ID NO: 479357 - DNA, 25 bp, Rattus norvegicus
tttgatccgcgcgaggtgccgtagt

SEQ ID NO: 479358 - DNA, 25 bp, Rattus norvegicus
gtccgcgttcagcaaagtttgatcc

SEQ ID NO: 479359 - DNA, 25 bp, Rattus norvegicus
agcctggctctcttttaagactgta

SEQ ID NO: 479360 - DNA, 25 bp, Rattus norvegicus
gacttgctagtcaacaccgagtggc

SEQ ID NO: 479361 - DNA, 25 bp, Rattus norvegicus
cgagtagagccacgtcgcggtgcca

SEQ ID NO: 479362 - DNA, 25 bp, Rattus norvegicus
ttgaagcttctagacgctggtcctg

SEQ ID NO: 479363 - DNA, 25 bp, Rattus norvegicus
ctcatccgagaagaagtaggcaacc

SEQ ID NO: 479364 - DNA, 25 bp, Rattus norvegicus
tggagggcccttcacaccaaacttg

SEQ ID NO: 479365 - DNA, 25 bp, Rattus norvegicus
ctctctgggcaagggctacaacctg

SEQ ID NO: 479366 - DNA, 25 bp, Rattus norvegicus
gccgccggtcactttggaaaagatg

SEQ ID NO: 479367 - DNA, 25 bp, Rattus norvegicus
gtatacactcaagtcggcgccctga

SEQ ID NO: 479368 - DNA, 25 bp, Rattus norvegicus
gccggctgtagccacaagagctcta

SEQ ID NO: 479369 - DNA, 25 bp, Rattus norvegicus
cgaagctctcggagttcgtccagca

SEQ ID NO: 479370 - DNA, 25 bp, Rattus norvegicus
tttccaaagcggcaccaggcagcga

SEQ ID NO: 479371 - DNA, 25 bp, Rattus norvegicus
cagccttgaactcgcgctttccaaa

SEQ ID NO: 479372 - DNA, 25 bp, Rattus norvegicus
ataatactgctgttgcggaggctgc

SEQ ID NO: 479373 - DNA, 25 bp, Rattus norvegicus
cctctagatgcaccttgagataata

SEQ ID NO: 479374 - DNA, 25 bp, Rattus norvegicus
accgagccgtatggactttgttctc

SEQ ID NO: 479375 - DNA, 25 bp, Rattus norvegicus
cggaggctactccttgtcatccaca

SEQ ID NO: 479376 - DNA, 25 bp, Rattus norvegicus
cctgcctcactgctttgggagcgta

SEQ ID NO: 479377 - DNA, 25 bp, Rattus norvegicus
gtctgctccacctggcaagtcctgg

SEQ ID NO: 479378 - DNA, 25 bp, Rattus norvegicus
agccgcgcggacgactcttaaatcc

SEQ ID NO: 479379 - DNA, 25 bp, Rattus norvegicus
tccgagccctgccaatctgtgctgg

SEQ ID NO: 479380 - DNA, 25 bp, Rattus norvegicus
gcgtggctagtacacccagctgctc

SEQ ID NO: 479381 - DNA, 25 bp, Rattus norvegicus
ttgcaaccgagtccctagtaacaga

SEQ ID NO: 479382 - DNA, 25 bp, Rattus norvegicus
cccgcgttcgtgttctgtattctaa

SEQ ID NO: 479383 - DNA, 25 bp, Rattus norvegicus
aacactctgcgaggccacggcattg

SEQ ID NO: 479384 - DNA, 25 bp, Rattus norvegicus
aaccgcgtatttgaggctgctttga

SEQ ID NO: 479385 - DNA, 25 bp, Rattus norvegicus
gttcctgtcagtcacggacgcctta

SEQ ID NO: 479386 - DNA, 25 bp, Rattus norvegicus
cttagaaattgcaggatggcgctca

SEQ ID NO: 479387 - DNA, 25 bp, Rattus norvegicus
gcgcccgtcctttgagccaagtgaa

SEQ ID NO: 479388 - DNA, 25 bp, Rattus norvegicus
ggactgcggttcagatctatccgga

SEQ ID NO: 479389 - DNA, 25 bp, Rattus norvegicus
aacgcgcccattggctaggactcgc

SEQ ID NO: 479390 - DNA, 25 bp, Rattus norvegicus
ttttgttacccagaagccgccagcg

SEQ ID NO: 479391 - DNA, 25 bp, Rattus norvegicus
taagcacgggtctaccggctcacgc

SEQ ID NO: 479392 - DNA, 25 bp, Rattus norvegicus
tcctcctctgatgaagcaagaagtg

SEQ ID NO: 479393 - DNA, 25 bp, Rattus norvegicus
cgcgcggtcagcactagctcttgct

SEQ ID NO: 479394 - DNA, 25 bp, Rattus norvegicus
ggtaccgcgacaaagcccaaagctg

SEQ ID NO: 479395 - DNA, 25 bp, Rattus norvegicus
agcatttaacttggggcggtcagca

SEQ ID NO: 479396 - DNA, 25 bp, Rattus norvegicus
ttttccaaaaaatcgcagagctctc

SEQ ID NO: 479397 - DNA, 25 bp, Rattus norvegicus
agatggcgtctgaggcttttccaaa

SEQ ID NO: 479398 - DNA, 25 bp, Rattus norvegicus
cgcactctggagtcagtgggtctct

SEQ ID NO: 479399 - DNA, 25 bp, Rattus norvegicus
ctccgtagaggagagttaagaacta

SEQ ID NO: 479400 - DNA, 25 bp, Rattus norvegicus
tctgtgccacagacttaaaaggatc

SEQ ID NO: 479401 - DNA, 25 bp, Rattus norvegicus
tgtggggatcgcacacgacaaaaca

SEQ ID NO: 479402 - DNA, 25 bp, Rattus norvegicus
ctcgctattgtgataggggtagacc

SEQ ID NO: 479403 - DNA, 25 bp, Rattus norvegicus
ctgcctggagtttgtgcagtcttca

SEQ ID NO: 479404 - DNA, 25 bp, Rattus norvegicus
gcttggatgatccagaccaaccctc

SEQ ID NO: 479405 - DNA, 25 bp, Rattus norvegicus
tgaaaaactcgtagggcagctgctg

SEQ ID NO: 479406 - DNA, 25 bp, Rattus norvegicus
ctcgcctcggtgcttggatgatcca

SEQ ID NO: 479407 - DNA, 25 bp, Rattus norvegicus
tcgcaactgagcatgcgccagcggc

SEQ ID NO: 479408 - DNA, 25 bp, Rattus norvegicus
gcaaactgaacctgctcgcaactga

SEQ ID NO: 479409 - DNA, 25 bp, Rattus norvegicus
gcttcctactagcaaactgaacctg

SEQ ID NO: 479410 - DNA, 25 bp, Rattus norvegicus
ggtgtagcgctggagcttcctacta

SEQ ID NO: 479411 - DNA, 25 bp, Rattus norvegicus
tgtcaacagctggagcagcggacgc

SEQ ID NO: 479412 - DNA, 25 bp, Rattus norvegicus
cagctgctgcgcctgcatggtgcat

SEQ ID NO: 479413 - DNA, 25 bp, Rattus norvegicus
gggttttccatctgcccgcggatga

SEQ ID NO: 479414 - DNA, 25 bp, Rattus norvegicus
gggcgcgttctcctcgctgaaaaac

SEQ ID NO: 479415 - DNA, 25 bp, Rattus norvegicus
ctacctttttcagcgcaggcaccag

SEQ ID NO: 479416 - DNA, 25 bp, Rattus norvegicus
ggacgcggggaacctcacagcctga

SEQ ID NO: 479417 - DNA, 25 bp, Rattus norvegicus
ggaactcaagcgagaggcccagagc

SEQ ID NO: 479418 - DNA, 25 bp, Rattus norvegicus
ctcggagcccgcgctaccggagttg

SEQ ID NO: 479419 - DNA, 25 bp, Rattus norvegicus
ttgtcctcgccctgcgtcctcggag

SEQ ID NO: 479420 - DNA, 25 bp, Rattus norvegicus
ttacctcgcgccctttgtcctcgcc

SEQ ID NO: 479421 - DNA, 25 bp, Rattus norvegicus
gccctgcggccacccttacctcgcg

SEQ ID NO: 479422 - DNA, 25 bp, Rattus norvegicus
ccggagttggcgctgcgcaaagcct

SEQ ID NO: 479423 - DNA, 25 bp, Rattus norvegicus
tgtaggcacaggaggggactggcca

SEQ ID NO: 479424 - DNA, 25 bp, Rattus norvegicus
gcggagctggagagtccgcccgtcc

SEQ ID NO: 479425 - DNA, 25 bp, Rattus norvegicus
ctccgtccaggtgtaggcacaggag

SEQ ID NO: 479426 - DNA, 25 bp, Rattus norvegicus
cggctccgtccaggtgtaggcacag

SEQ ID NO: 479427 - DNA, 25 bp, Rattus norvegicus
actgcggctccgtccaggtgtaggc

SEQ ID NO: 479428 - DNA, 25 bp, Rattus norvegicus
tgagatgggactgcggctccgtcca

SEQ ID NO: 479429 - DNA, 25 bp, Rattus norvegicus
acctgagatgggactgcggctccgt

SEQ ID NO: 479430 - DNA, 25 bp, Rattus norvegicus
cgtccgggtcttgcgggccgccgtg

SEQ ID NO: 479431 - DNA, 25 bp, Rattus norvegicus
gctaccggagttggcgctgcgcaaa

SEQ ID NO: 479432 - DNA, 25 bp, Rattus norvegicus
gaccgcgacgctccgtgagtgaagc

SEQ ID NO: 479433 - DNA, 25 bp, Rattus norvegicus
gagaacctactggtgagcgggaacc

SEQ ID NO: 479434 - DNA, 25 bp, Rattus norvegicus
gcgggactgtcatcgtccctgggca

SEQ ID NO: 479435 - DNA, 25 bp, Rattus norvegicus
gtccggactagggagcgccgactct

SEQ ID NO: 479436 - DNA, 25 bp, Rattus norvegicus
ctagggagcgccgactctggtaccc

SEQ ID NO: 479437 - DNA, 25 bp, Rattus norvegicus
atcctccggaacacccgggtgtcag

SEQ ID NO: 479438 - DNA, 25 bp, Rattus norvegicus
ggacctgagtgcctctgaggtcacc

SEQ ID NO: 479439 - DNA, 25 bp, Rattus norvegicus
tgaggtcaccctggtcaccctggtc

SEQ ID NO: 479440 - DNA, 25 bp, Rattus norvegicus
ctccgtgagtgaagccgcagtgctc

SEQ ID NO: 479441 - DNA, 25 bp, Rattus norvegicus
catcatgagtcagcagcggacggcg

SEQ ID NO: 479442 - DNA, 25 bp, Rattus norvegicus
gcggaaactgcccagcctgctggtg

SEQ ID NO: 479443 - DNA, 25 bp, Rattus norvegicus
cagcctgctggtggacccggctcag

SEQ ID NO: 479444 - DNA, 25 bp, Rattus norvegicus
gcgcgggacatcatgagtcagcagc

SEQ ID NO: 479445 - DNA, 25 bp, Rattus norvegicus
cccatcaacgtagagaacctactgg

SEQ ID NO: 479446 - DNA, 25 bp, Rattus norvegicus
gagacccaggttccggagtggatac

SEQ ID NO: 479447 - DNA, 25 bp, Rattus norvegicus
cacctgggattcttgggtccacctc

SEQ ID NO: 479448 - DNA, 25 bp, Rattus norvegicus
agtcccacactctgagcgcgggcta

SEQ ID NO: 479449 - DNA, 25 bp, Rattus norvegicus
gcatgcatagctgcgtgctgagtca

SEQ ID NO: 479450 - DNA, 25 bp, Rattus norvegicus
cggacgtcaactaggccgctgggtc

SEQ ID NO: 479451 - DNA, 25 bp, Rattus norvegicus
gacgcgggacacacgacaggaacca

SEQ ID NO: 479452 - DNA, 25 bp, Rattus norvegicus
acctccctgtggagcgagtgtcacc

SEQ ID NO: 479453 - DNA, 25 bp, Rattus norvegicus
caggcgggaacggaaaagctttgct

SEQ ID NO: 479454 - DNA, 25 bp, Rattus norvegicus
aagctttgctgctgagctcggtggc

SEQ ID NO: 479455 - DNA, 25 bp, Rattus norvegicus
gagcggactcctcagacagcggcgc

SEQ ID NO: 479456 - DNA, 25 bp, Rattus norvegicus
aagctggaggcgctcatccgagacc

SEQ ID NO: 479457 - DNA, 25 bp, Rattus norvegicus
ctcgctcgcccatcaacgtggaaag

SEQ ID NO: 479458 - DNA, 25 bp, Rattus norvegicus
catcaacgtggaaagcctgctggta

SEQ ID NO: 479459 - DNA, 25 bp, Rattus norvegicus
caacgggattcaaacgagtcccaca

SEQ ID NO: 479460 - DNA, 25 bp, Rattus norvegicus
tgataggctatctgctcatcgccgt

SEQ ID NO: 479461 - DNA, 25 bp, Rattus norvegicus
ctgctggcggcaagggttgaaaatc

SEQ ID NO: 479462 - DNA, 25 bp, Rattus norvegicus
acatccgcttcacccagctgagtga

SEQ ID NO: 479463 - DNA, 25 bp, Rattus norvegicus
ttcacccagctgagtgaccggggca

SEQ ID NO: 479464 - DNA, 25 bp, Rattus norvegicus
gtgaccggggcatctattactgctg

SEQ ID NO: 479465 - DNA, 25 bp, Rattus norvegicus
gcatctattactgctggcggcaagg

SEQ ID NO: 479466 - DNA, 25 bp, Rattus norvegicus
gttgaaaatcgctggcttccggcta

SEQ ID NO: 479467 - DNA, 25 bp, Rattus norvegicus
ttccggctaggcgtaacatctcgag

SEQ ID NO: 479468 - DNA, 25 bp, Rattus norvegicus
cgtaacatctcgagggcgctaccca

SEQ ID NO: 479469 - DNA, 25 bp, Rattus norvegicus
gggcgctacccagcctcactctcag

SEQ ID NO: 479470 - DNA, 25 bp, Rattus norvegicus
ccgagactcgcacagccgtggagct

SEQ ID NO: 479471 - DNA, 25 bp, Rattus norvegicus
ggagctcaccctgataggctatctg

SEQ ID NO: 479472 - DNA, 25 bp, Rattus norvegicus
ctatctgctcatcgccgttgtcttc

SEQ ID NO: 479473 - DNA, 25 bp, Rattus norvegicus
ccgtggagctcaccctgataggcta

SEQ ID NO: 479474 - DNA, 25 bp, Rattus norvegicus
gaacagactcacatctctcctaacg

SEQ ID NO: 479475 - DNA, 25 bp, Rattus norvegicus
cgcactcctcctcgggcatgagtga

SEQ ID NO: 479476 - DNA, 25 bp, Rattus norvegicus
gccgaagaggccaccgaacagactc

SEQ ID NO: 479477 - DNA, 25 bp, Rattus norvegicus
cggtgagcaagacgcgagtgatccc

SEQ ID NO: 479478 - DNA, 25 bp, Rattus norvegicus
gagcactccggtgagcaagacgcga

SEQ ID NO: 479479 - DNA, 25 bp, Rattus norvegicus
ctcgggcatgagtgaggtgcactcc

SEQ ID NO: 479480 - DNA, 25 bp, Rattus norvegicus
cgccatcttcaaggcgctgcaagcg

SEQ ID NO: 479481 - DNA, 25 bp, Rattus norvegicus
cggctgcgcgtgcagcacaagaaag

SEQ ID NO: 479482 - DNA, 25 bp, Rattus norvegicus
gaggccaccgaacagactcacatct

SEQ ID NO: 479483 - DNA, 25 bp, Rattus norvegicus
aagcagaggccgaagaggccaccga

SEQ ID NO: 479484 - DNA, 25 bp, Rattus norvegicus
gaagtcggtgaagaatgggcaagca

SEQ ID NO: 479485 - DNA, 25 bp, Rattus norvegicus
agaccaccccgattacaagtaccag

SEQ ID NO: 479486 - DNA, 25 bp, Rattus norvegicus
gcgtgcagcacaagaaagaccaccc

SEQ ID NO: 479487 - DNA, 25 bp, Rattus norvegicus
cccgggcgagcactccggtgagcaa

SEQ ID NO: 479488 - DNA, 25 bp, Rattus norvegicus
gcgctgcagccgtccttggaggcct

SEQ ID NO: 479489 - DNA, 25 bp, Rattus norvegicus
tcgtagagacggcaggaacacgtct

SEQ ID NO: 479490 - DNA, 25 bp, Rattus norvegicus
cgtgcaacagttcgtagagacggca

SEQ ID NO: 479491 - DNA, 25 bp, Rattus norvegicus
tgccagctccgtgcaacagttcgta

SEQ ID NO: 479492 - DNA, 25 bp, Rattus norvegicus
atgcccgcggcgtggttgccagctc

SEQ ID NO: 479493 - DNA, 25 bp, Rattus norvegicus
gtcttctggcgacagcagtcgggca

SEQ ID NO: 479494 - DNA, 25 bp, Rattus norvegicus
ccaggtcgccgctttcccagagtga

SEQ ID NO: 479495 - DNA, 25 bp, Rattus norvegicus
accagggcagggatatggctctagc

SEQ ID NO: 479496 - DNA, 25 bp, Rattus norvegicus
gctgcgtggttaccgttggcctgaa

SEQ ID NO: 479497 - DNA, 25 bp, Rattus norvegicus
tgccagctgcgtggttaccgttggc

SEQ ID NO: 479498 - DNA, 25 bp, Rattus norvegicus
cccatggtcaggatgccagctgcgt

SEQ ID NO: 479499 - DNA, 25 bp, Rattus norvegicus
atatggctctagctctgcgcctgcg

SEQ ID NO: 479500 - DNA, 25 bp, Rattus norvegicus
aggaacacgtcttctggcgacagca

SEQ ID NO: 479501 - DNA, 25 bp, Rattus norvegicus
gccgctttcccagagtgaggatgcc

SEQ ID NO: 479502 - DNA, 25 bp, Rattus norvegicus
tcgtgatgctccctgccgggcgtct

SEQ ID NO: 479503 - DNA, 25 bp, Rattus norvegicus
tgcgcgtagatctgcggcagtttga

SEQ ID NO: 479504 - DNA, 25 bp, Rattus norvegicus
ttgagtgcggcgcacacgcccagcg

SEQ ID NO: 479505 - DNA, 25 bp, Rattus norvegicus
gcccagcgtgctccagttgcagaac

SEQ ID NO: 479506 - DNA, 25 bp, Rattus norvegicus
gttgcagaaccatagcagcccggcc

SEQ ID NO: 479507 - DNA, 25 bp, Rattus norvegicus
cctccattctgcagtcacgggcgtg

SEQ ID NO: 479508 - DNA, 25 bp, Rattus norvegicus
gggcttcgggatcttataggttata

SEQ ID NO: 479509 - DNA, 25 bp, Rattus norvegicus
tcttataggttataacctgaggctc

SEQ ID NO: 479510 - DNA, 25 bp, Rattus norvegicus
cctgaggctcaaaatccaaagagtc

SEQ ID NO: 479511 - DNA, 25 bp, Rattus norvegicus
ctccgccgggagtttgctctgctta

SEQ ID NO: 479512 - DNA, 25 bp, Rattus norvegicus
tgctctgcttaggatgctccctacc

SEQ ID NO: 479513 - DNA, 25 bp, Rattus norvegicus
agtcggcttggctcgtgatgctccc

SEQ ID NO: 479514 - DNA, 25 bp, Rattus norvegicus
gcgccgccagctgcgcgtagatctg

SEQ ID NO: 479515 - DNA, 25 bp, Rattus norvegicus
gtgtgcactgccctgggtctgctcc

SEQ ID NO: 479516 - DNA, 25 bp, Rattus norvegicus
gtcgtccaagatgagctgcaccctg

SEQ ID NO: 479517 - DNA, 25 bp, Rattus norvegicus
gctactgtaccctcttctggtgaga

SEQ ID NO: 479518 - DNA, 25 bp, Rattus norvegicus
ggctcttgcaacagtcatccaggaa

SEQ ID NO: 479519 - DNA, 25 bp, Rattus norvegicus
gggcagatgcctttcttcatgtgga

SEQ ID NO: 479520 - DNA, 25 bp, Rattus norvegicus
cgggtcccgatcaaagtagaattcg

SEQ ID NO: 479521 - DNA, 25 bp, Rattus norvegicus
tcgcgcttgcctgggtcgtaatcat

SEQ ID NO: 479522 - DNA, 25 bp, Rattus norvegicus
cccgccaagcagttgatgagctctg

SEQ ID NO: 479523 - DNA, 25 bp, Rattus norvegicus
gctgagcaggtctccatagagcacc

SEQ ID NO: 479524 - DNA, 25 bp, Rattus norvegicus
gtcatcgcctgccacagagtcctgg

SEQ ID NO: 479525 - DNA, 25 bp, Rattus norvegicus
ctgggctgtaccgagagctaacttg

SEQ ID NO: 479526 - DNA, 25 bp, Rattus norvegicus
gctaacttggactggctttgccgga

SEQ ID NO: 479527 - DNA, 25 bp, Rattus norvegicus
gccggagcgggtccgaaacacaata

SEQ ID NO: 479528 - DNA, 25 bp, Rattus norvegicus
ttccagcctgacgtcaaacgctttg

SEQ ID NO: 479529 - DNA, 25 bp, Rattus norvegicus
gttcctcgcgcttctcactcagatg

SEQ ID NO: 479530 - DNA, 25 bp, Rattus norvegicus
gccgctcggctttgatccttaccag

SEQ ID NO: 479531 - DNA, 25 bp, Rattus norvegicus
tcccattgagaaagtgcacacccgg

SEQ ID NO: 479532 - DNA, 25 bp, Rattus norvegicus
tgctggggacccgagactcaagctc

SEQ ID NO: 479533 - DNA, 25 bp, Rattus norvegicus
agaaagtgcacacccggaccacgag

SEQ ID NO: 479534 - DNA, 25 bp, Rattus norvegicus
cacgaggacccacggaagtacggat

SEQ ID NO: 479535 - DNA, 25 bp, Rattus norvegicus
attcgaccgagggaacgcgtgtcgc

SEQ ID NO: 479536 - DNA, 25 bp, Rattus norvegicus
cttgtagcggcctcgacagctagct

SEQ ID NO: 479537 - DNA, 25 bp, Rattus norvegicus
agactatctgagctgtggacgacac

SEQ ID NO: 479538 - DNA, 25 bp, Rattus norvegicus
cggcttctatggtccggtgcgcgcc

SEQ ID NO: 479539 - DNA, 25 bp, Rattus norvegicus
ccagcaggaggagcatccctgggtc

SEQ ID NO: 479540 - DNA, 25 bp, Rattus norvegicus
tccctgggtccttcggatatttgca

SEQ ID NO: 479541 - DNA, 25 bp, Rattus norvegicus
tcggatatttgcataccggctgccc

SEQ ID NO: 479542 - DNA, 25 bp, Rattus norvegicus
gccggcttcccatgttcccattgag

SEQ ID NO: 479543 - DNA, 25 bp, Rattus norvegicus
ctttgatccttaccaggagaggcgg

SEQ ID NO: 479544 - DNA, 25 bp, Rattus norvegicus
ttgagctggtgcgtctccatgacga

SEQ ID NO: 479545 - DNA, 25 bp, Rattus norvegicus
tcccgccagggaataaatactacgc

SEQ ID NO: 479546 - DNA, 25 bp, Rattus norvegicus
tactacgcgctgaatgcaaagccga

SEQ ID NO: 479547 - DNA, 25 bp, Rattus norvegicus
ccgaggaagagttttgctagtcttc

SEQ ID NO: 479548 - DNA, 25 bp, Rattus norvegicus
ctgcgtgattgaaccggttgcaaga

SEQ ID NO: 479549 - DNA, 25 bp, Rattus norvegicus
ttgcaagacggacgaccaagcgcct

SEQ ID NO: 479550 - DNA, 25 bp, Rattus norvegicus
gcctgtgcgcatgcaccggccgaat

SEQ ID NO: 479551 - DNA, 25 bp, Rattus norvegicus
aagtctagtctacgtggcccgcaca

SEQ ID NO: 479552 - DNA, 25 bp, Rattus norvegicus
ctgcggcaagctggtagtcaggact

SEQ ID NO: 479553 - DNA, 25 bp, Rattus norvegicus
tgacgacgtgctccgcctataagta

SEQ ID NO: 479554 - DNA, 25 bp, Rattus norvegicus
gcaccgtcgggctttgtcagtccct

SEQ ID NO: 479555 - DNA, 25 bp, Rattus norvegicus
gccctgaaggcagcagctgttcctg

SEQ ID NO: 479556 - DNA, 25 bp, Rattus norvegicus
cttccctgtgctgtgaggtaagcgg

SEQ ID NO: 479557 - DNA, 25 bp, Rattus norvegicus
tgctgcccataggaccctgcggcaa

SEQ ID NO: 479558 - DNA, 25 bp, Rattus norvegicus
tccgtgaaaacgcagcaatggccaa

SEQ ID NO: 479559 - DNA, 25 bp, Rattus norvegicus
cctcatccgtgaaaacgcagcaatg

SEQ ID NO: 479560 - DNA, 25 bp, Rattus norvegicus
gaaaacgcagcaatggccaagatta

SEQ ID NO: 479561 - DNA, 25 bp, Rattus norvegicus
tggccaagattaaggcacgtgacct

SEQ ID NO: 479562 - DNA, 25 bp, Rattus norvegicus
ccaagattaaggcacgtgacctgca

SEQ ID NO: 479563 - DNA, 25 bp, Rattus norvegicus
aaggcacgtgacctgcacggcaaga

SEQ ID NO: 479564 - DNA, 25 bp, Rattus norvegicus
acgtgacctgcacggcaagaagaag

SEQ ID NO: 479565 - DNA, 25 bp, Rattus norvegicus
gtttcgcatagccaaagtgacaggc

SEQ ID NO: 479566 - DNA, 25 bp, Rattus norvegicus
aggtggaaccgtcccagtttcgcat

SEQ ID NO: 479567 - DNA, 25 bp, Rattus norvegicus
tggaaccgtcccagtttcgcatagc

SEQ ID NO: 479568 - DNA, 25 bp, Rattus norvegicus
accgtcccagtttcgcatagccaaa

SEQ ID NO: 479569 - DNA, 25 bp, Rattus norvegicus
gcggcctcatccgtgaaaacgcagc

SEQ ID NO: 479570 - DNA, 25 bp, Rattus norvegicus
gtcccagtttcgcatagccaaagtg

SEQ ID NO: 479571 - DNA, 25 bp, Rattus norvegicus
cccagtttcgcatagccaaagtgac

SEQ ID NO: 479572 - DNA, 25 bp, Rattus norvegicus
cacacttgcctgtggggactagtgc

SEQ ID NO: 479573 - DNA, 25 bp, Rattus norvegicus
tggctctagaatggcgtgtcctcgt

SEQ ID NO: 479574 - DNA, 25 bp, Rattus norvegicus
gcactttttagattacgtttgtgga

SEQ ID NO: 479575 - DNA, 25 bp, Rattus norvegicus
tgtttctctgcgtagtgggcttgca

SEQ ID NO: 479576 - DNA, 25 bp, Rattus norvegicus
ggctcgatgggatgtgcacttttta

SEQ ID NO: 479577 - DNA, 25 bp, Rattus norvegicus
ggaaacttgagtgcccgccctgcga

SEQ ID NO: 479578 - DNA, 25 bp, Rattus norvegicus
tgcagagcggcggtcgcctacacct

SEQ ID NO: 479579 - DNA, 25 bp, Rattus norvegicus
tttgtctctccaagcggtgaaggtc

SEQ ID NO: 479580 - DNA, 25 bp, Rattus norvegicus
actgacgcccgttctattggttatc

SEQ ID NO: 479581 - DNA, 25 bp, Rattus norvegicus
gccaccgccgaacttgagctcgaga

SEQ ID NO: 479582 - DNA, 25 bp, Rattus norvegicus
cttgagctcgagaagccagcggatc

SEQ ID NO: 479583 - DNA, 25 bp, Rattus norvegicus
ccagcggatcgcgtccagttccgga

SEQ ID NO: 479584 - DNA, 25 bp, Rattus norvegicus
gctactgacggtgcctgtttctctg

SEQ ID NO: 479585 - DNA, 25 bp, Rattus norvegicus
tggaattgtgtgtcgggcacacttg

SEQ ID NO: 479586 - DNA, 25 bp, Rattus norvegicus
aaatgctggagattgtgcaggtacc

SEQ ID NO: 479587 - DNA, 25 bp, Rattus norvegicus
acatcagccgcagtgaaatgctgga

SEQ ID NO: 479588 - DNA, 25 bp, Rattus norvegicus
cctggacggcaacggctacatcagc

SEQ ID NO: 479589 - DNA, 25 bp, Rattus norvegicus
ttcagcatgtacgacctggacggca

SEQ ID NO: 479590 - DNA, 25 bp, Rattus norvegicus
aagtgggccttcagcatgtacgacc

SEQ ID NO: 479591 - DNA, 25 bp, Rattus norvegicus
gagcagaagctcaagtgggccttca

SEQ ID NO: 479592 - DNA, 25 bp, Rattus norvegicus
cctctcggggcaagctggagcagaa

SEQ ID NO: 479593 - DNA, 25 bp, Rattus norvegicus
tcatcgcactgagcgtgacctctcg

SEQ ID NO: 479594 - DNA, 25 bp, Rattus norvegicus
ttccgggagttcatcatcgcactga

SEQ ID NO: 479595 - DNA, 25 bp, Rattus norvegicus
tggcaccatcgacttccgggagttc

SEQ ID NO: 479596 - DNA, 25 bp, Rattus norvegicus
gcacctttgacaccaacagcgatgg

SEQ ID NO: 479597 - DNA, 25 bp, Rattus norvegicus
aagtttgccgaacacgtcttccgca

SEQ ID NO: 479598 - DNA, 25 bp, Rattus norvegicus
attgtgcaggtaccggcactcggca

SEQ ID NO: 479599 - DNA, 25 bp, Rattus norvegicus
gacgcctctaagtttgccgaacacg

SEQ ID NO: 479600 - DNA, 25 bp, Rattus norvegicus
gaggcaggaactcgtcattttcacg

SEQ ID NO: 479601 - DNA, 25 bp, Rattus norvegicus
ttttcacgcacagggccttcgactt

SEQ ID NO: 479602 - DNA, 25 bp, Rattus norvegicus
ggccttcgacttgcggcgcaagcgc

SEQ ID NO: 479603 - DNA, 25 bp, Rattus norvegicus
acttgcggcgcaagcgcagacgctc

SEQ ID NO: 479604 - DNA, 25 bp, Rattus norvegicus
tccacggtgctaggcagcctcactg

SEQ ID NO: 479605 - DNA, 25 bp, Rattus norvegicus
ggcgcgtctgtactcactagtcgca

SEQ ID NO: 479606 - DNA, 25 bp, Rattus norvegicus
tgtactcactagtcgcaaccctaag

SEQ ID NO: 479607 - DNA, 25 bp, Rattus norvegicus
agtcgcaaccctaagcgaagcgttc

SEQ ID NO: 479608 - DNA, 25 bp, Rattus norvegicus
agcgaagcgttcaggcaaagtagtc

SEQ ID NO: 479609 - DNA, 25 bp, Rattus norvegicus
ttcaggcaaagtagtcgagttccga

SEQ ID NO: 479610 - DNA, 25 bp, Rattus norvegicus
gagttccgagctcatccgacctgga

SEQ ID NO: 479611 - DNA, 25 bp, Rattus norvegicus
catccgacctggagcgtcaagggaa

SEQ ID NO: 479612 - DNA, 25 bp, Rattus norvegicus
cgcgctcgctccctgcaggtgaaag

SEQ ID NO: 479613 - DNA, 25 bp, Rattus norvegicus
tcgtcattttcacgcacagggcctt

SEQ ID NO: 479614 - DNA, 25 bp, Rattus norvegicus
tggccgagacccatgaggactacaa

SEQ ID NO: 479615 - DNA, 25 bp, Rattus norvegicus
ctagcttcaccacgcgcacggccca

SEQ ID NO: 479616 - DNA, 25 bp, Rattus norvegicus
ctggtgccggatgcctagtgcccgc

SEQ ID NO: 479617 - DNA, 25 bp, Rattus norvegicus
gcgccgcggcgatgccggaccacat

SEQ ID NO: 479618 - DNA, 25 bp, Rattus norvegicus
cggaccacatctccgtgtcggaatt

SEQ ID NO: 479619 - DNA, 25 bp, Rattus norvegicus
aattcgtggccgagacccatgagga

SEQ ID NO: 479620 - DNA, 25 bp, Rattus norvegicus
tgaggactacaaggtgcccacggca

SEQ ID NO: 479621 - DNA, 25 bp, Rattus norvegicus
cagtgccggaacaccgtggcggcca

SEQ ID NO: 479622 - DNA, 25 bp, Rattus norvegicus
cttcggcgcctggtgccggatgcct

SEQ ID NO: 479623 - DNA, 25 bp, Rattus norvegicus
gcccacggcatctagcttcaccacg

SEQ ID NO: 479624 - DNA, 25 bp, Rattus norvegicus
catcgaggaggtgagtggtagcctc

SEQ ID NO: 479625 - DNA, 25 bp, Rattus norvegicus
ccggaacaccgtggcggccatcgag

SEQ ID NO: 479626 - DNA, 25 bp, Rattus norvegicus
tcctgaagcacagcgggcagagctg

SEQ ID NO: 479627 - DNA, 25 bp, Rattus norvegicus
tctccgtgtcggaattcgtggccga

SEQ ID NO: 479628 - DNA, 25 bp, Rattus norvegicus
ttaggcctcgcctctagttcctgaa

SEQ ID NO: 479629 - DNA, 25 bp, Rattus norvegicus
ctccgcctcgggacaaggagggaat

SEQ ID NO: 479630 - DNA, 25 bp, Rattus norvegicus
gtttacactcagtgcgtgcctccgc

SEQ ID NO: 479631 - DNA, 25 bp, Rattus norvegicus
agcaatggctggcttcggaggactc

SEQ ID NO: 479632 - DNA, 25 bp, Rattus norvegicus
gaggctactcccgttcgtaatccag

SEQ ID NO: 479633 - DNA, 25 bp, Rattus norvegicus
ccgttcgtaatccagctccatcttt

SEQ ID NO: 479634 - DNA, 25 bp, Rattus norvegicus
tttcctgccatggtccgctaggcca

SEQ ID NO: 479635 - DNA, 25 bp, Rattus norvegicus
cctttccctcggtttacactcagtg

SEQ ID NO: 479636 - DNA, 25 bp, Rattus norvegicus
ctctagttcctgaaccgcaccgggg

SEQ ID NO: 479637 - DNA, 25 bp, Rattus norvegicus
gaacctatggaacctcgttctccga

SEQ ID NO: 479638 - DNA, 25 bp, Rattus norvegicus
ctcgttctccgaccggaagttggag

SEQ ID NO: 479639 - DNA, 25 bp, Rattus norvegicus
gggacgaatctagctccgagagcac

SEQ ID NO: 479640 - DNA, 25 bp, Rattus norvegicus
tagctccgagagcactagagcgccg

SEQ ID NO: 479641 - DNA, 25 bp, Rattus norvegicus
atctttgccagttttcctgccatgg

SEQ ID NO: 479642 - DNA, 25 bp, Rattus norvegicus
tgcggccgcggcttcagccgcaatt

SEQ ID NO: 479643 - DNA, 25 bp, Rattus norvegicus
aggcgcaaggccttactcctgtgtg

SEQ ID NO: 479644 - DNA, 25 bp, Rattus norvegicus
ctgctgcttcacacaggcgcaaggc

SEQ ID NO: 479645 - DNA, 25 bp, Rattus norvegicus
gtggcaagagcttcaatcgcagctc

SEQ ID NO: 479646 - DNA, 25 bp, Rattus norvegicus
ggtcacacacacagggtcaaagcaa

SEQ ID NO: 479647 - DNA, 25 bp, Rattus norvegicus
cggccgtagtttccgacgcaatgcg

SEQ ID NO: 479648 - DNA, 25 bp, Rattus norvegicus
agctgtccaacctgcggccgtagtt

SEQ ID NO: 479649 - DNA, 25 bp, Rattus norvegicus
ggggaacggccctacagctgtccaa

SEQ ID NO: 479650 - DNA, 25 bp, Rattus norvegicus
accgccgcagtcacactggggaacg

SEQ ID NO: 479651 - DNA, 25 bp, Rattus norvegicus
gtggtcaccgtttccgcaacagctc

SEQ ID NO: 479652 - DNA, 25 bp, Rattus norvegicus
ggggttcagccagaatgcccacctg

SEQ ID NO: 479653 - DNA, 25 bp, Rattus norvegicus
agaagccctgccgatgcaacgaatg

SEQ ID NO: 479654 - DNA, 25 bp, Rattus norvegicus
acctacgctgccacacaggggagaa

SEQ ID NO: 479655 - DNA, 25 bp, Rattus norvegicus
agacgctgtactagctccacccgtg

SEQ ID NO: 479656 - DNA, 25 bp, Rattus norvegicus
acaggagacaggattgcggcgaaca

SEQ ID NO: 479657 - DNA, 25 bp, Rattus norvegicus
cgagatccgccacatccggcgtaga

SEQ ID NO: 479658 - DNA, 25 bp, Rattus norvegicus
acatccggcgtagacttgcgggttc

SEQ ID NO: 479659 - DNA, 25 bp, Rattus norvegicus
tgcgggttcagacctttccatcatg

SEQ ID NO: 479660 - DNA, 25 bp, Rattus norvegicus
tccatcatgtcgctgtgcgagcttg

SEQ ID NO: 479661 - DNA, 25 bp, Rattus norvegicus
ccggtcttctcagcgggattttgaa

SEQ ID NO: 479662 - DNA, 25 bp, Rattus norvegicus
aatgacccggtgcactttggggtgc

SEQ ID NO: 479663 - DNA, 25 bp, Rattus norvegicus
ccagagagctaagccggttggtccc

SEQ ID NO: 479664 - DNA, 25 bp, Rattus norvegicus
aggacactcgcctgtagaccagaga

SEQ ID NO: 479665 - DNA, 25 bp, Rattus norvegicus
ttgcggcgaacaggccaaaggagcc

SEQ ID NO: 479666 - DNA, 25 bp, Rattus norvegicus
agtctacagactcacccggccagga

SEQ ID NO: 479667 - DNA, 25 bp, Rattus norvegicus
agcttaaggggttcaggttcgctgc

SEQ ID NO: 479668 - DNA, 25 bp, Rattus norvegicus
gttagctccgcccacggcacgagat

SEQ ID NO: 479669 - DNA, 25 bp, Rattus norvegicus
gccaaaggagccaaagtctacagac

SEQ ID NO: 479670 - DNA, 25 bp, Rattus norvegicus
agataagtcagtttgctcctcgggc

SEQ ID NO: 479671 - DNA, 25 bp, Rattus norvegicus
ccgagctcttaccaagtcgcgggtg

SEQ ID NO: 479672 - DNA, 25 bp, Rattus norvegicus
gagccagagcctggttcctccggag

SEQ ID NO: 479673 - DNA, 25 bp, Rattus norvegicus
tgccaggacgaaaggcaccaaagtg

SEQ ID NO: 479674 - DNA, 25 bp, Rattus norvegicus
ggagacgctgcctcatgttcccgtc

SEQ ID NO: 479675 - DNA, 25 bp, Rattus norvegicus
tctgggcaaccttctagagagagcg

SEQ ID NO: 479676 - DNA, 25 bp, Rattus norvegicus
ctagagagagcgttcgagaaactgc

SEQ ID NO: 479677 - DNA, 25 bp, Rattus norvegicus
cgagaaactgctcacattgggaagc

SEQ ID NO: 479678 - DNA, 25 bp, Rattus norvegicus
aagcggaggtgatcttcccagcacg

SEQ ID NO: 479679 - DNA, 25 bp, Rattus norvegicus
cgcgccgcctacagggaaaactcaa

SEQ ID NO: 479680 - DNA, 25 bp, Rattus norvegicus
aactcaagagctaggctgaagtccc

SEQ ID NO: 479681 - DNA, 25 bp, Rattus norvegicus
cctgctgcccacagccggaagagga

SEQ ID NO: 479682 - DNA, 25 bp, Rattus norvegicus
atcttgtgggctctgttccttcctg

SEQ ID NO: 479683 - DNA, 25 bp, Rattus norvegicus
ggtgcgtccctccaagcactctgga

SEQ ID NO: 479684 - DNA, 25 bp, Rattus norvegicus
tttgtctcagcgcacgaggctgcgt

SEQ ID NO: 479685 - DNA, 25 bp, Rattus norvegicus
agccggatccggagtcctcctgaga

SEQ ID NO: 479686 - DNA, 25 bp, Rattus norvegicus
cctccaattagatccagggtgaatg

SEQ ID NO: 479687 - DNA, 25 bp, Rattus norvegicus
gacgagctcgctaccgaccaataga

SEQ ID NO: 479688 - DNA, 25 bp, Rattus norvegicus
agtcccgaggactgagctccgccaa

SEQ ID NO: 479689 - DNA, 25 bp, Rattus norvegicus
tcagacaatgaagccggacgcccgc

SEQ ID NO: 479690 - DNA, 25 bp, Rattus norvegicus
gctccgtcacggctttcatgcaggt

SEQ ID NO: 479691 - DNA, 25 bp, Rattus norvegicus
ccacagatagcaggttgcgctcctc

SEQ ID NO: 479692 - DNA, 25 bp, Rattus norvegicus
tcaatgctcgagatgaccctccagg

SEQ ID NO: 479693 - DNA, 25 bp, Rattus norvegicus
ggtatcggtcttctgctcaatgctc

SEQ ID NO: 479694 - DNA, 25 bp, Rattus norvegicus
gctgcaacttcttgtccgaggtatc

SEQ ID NO: 479695 - DNA, 25 bp, Rattus norvegicus
tctcccgatagtccttgatcagctg

SEQ ID NO: 479696 - DNA, 25 bp, Rattus norvegicus
gatcagctcggtcttctccatggcg

SEQ ID NO: 479697 - DNA, 25 bp, Rattus norvegicus
ttgatctgctttgggctttagccga

SEQ ID NO: 479698 - DNA, 25 bp, Rattus norvegicus
ctagaggtatgggtcgagctccaac

SEQ ID NO: 479699 - DNA, 25 bp, Rattus norvegicus
ctcccggaagcggtgcctgggtagc

SEQ ID NO: 479700 - DNA, 25 bp, Rattus norvegicus
ctggctcctagtccgccctgggaga

SEQ ID NO: 479701 - DNA, 25 bp, Rattus norvegicus
tgacccgcatagtgggcggagcgag

SEQ ID NO: 479702 - DNA, 25 bp, Rattus norvegicus
caaccaaggacaactaggaggagga

SEQ ID NO: 479703 - DNA, 25 bp, Rattus norvegicus
tccctaactgaaacaaccaaggaca

SEQ ID NO: 479704 - DNA, 25 bp, Rattus norvegicus
gctccaactcgggttccctaactga

SEQ ID NO: 479705 - DNA, 25 bp, Rattus norvegicus
atgggtcgagctccaactcgggttc

SEQ ID NO: 479706 - DNA, 25 bp, Rattus norvegicus
tacctagaggtatgggtcgagctcc

SEQ ID NO: 479707 - DNA, 25 bp, Rattus norvegicus
agcagatggtaagtacctagaggta

SEQ ID NO: 479708 - DNA, 25 bp, Rattus norvegicus
acgtggagcagatggtaagtaccta

SEQ ID NO: 479709 - DNA, 25 bp, Rattus norvegicus
tgtcagcagcgatggacgtggagca

SEQ ID NO: 479710 - DNA, 25 bp, Rattus norvegicus
cctgggtagcggtgtcagcagcgat

SEQ ID NO: 479711 - DNA, 25 bp, Rattus norvegicus
gtcgagctccaactcgggttcccta

SEQ ID NO: 479712 - DNA, 25 bp, Rattus norvegicus
tgccaagctgccaaagcgagagatc

SEQ ID NO: 479713 - DNA, 25 bp, Rattus norvegicus
tggactccgggcagcctgctgtcac

SEQ ID NO: 479714 - DNA, 25 bp, Rattus norvegicus
acacaggagtacgacaagtgagtga

SEQ ID NO: 479715 - DNA, 25 bp, Rattus norvegicus
gccagccaatgggaggccgagccca

SEQ ID NO: 479716 - DNA, 25 bp, Rattus norvegicus
ctccatctcaccaatcaggaggagg

SEQ ID NO: 479717 - DNA, 25 bp, Rattus norvegicus
agcgcgatgacacaggagtacgaca

SEQ ID NO: 479718 - DNA, 25 bp, Rattus norvegicus
tgtactgtcccaacccgaaagtcca

SEQ ID NO: 479719 - DNA, 25 bp, Rattus norvegicus
gatcgggtgtactgtcccaacccga

SEQ ID NO: 479720 - DNA, 25 bp, Rattus norvegicus
ggaactgaccgcgaacgagaactgg

SEQ ID NO: 479721 - DNA, 25 bp, Rattus norvegicus
aaggttgaagtgtccgctgccccgc

SEQ ID NO: 479722 - DNA, 25 bp, Rattus norvegicus
gaactggaaggtgagacgcgcccac

SEQ ID NO: 479723 - DNA, 25 bp, Rattus norvegicus
cgcctcctagctccagaagctccgc

SEQ ID NO: 479724 - DNA, 25 bp, Rattus norvegicus
ctgaccgcgaacgagaactggaagg

SEQ ID NO: 479725 - DNA, 25 bp, Rattus norvegicus
aaagtccagttctgcggcccggcag

SEQ ID NO: 479726 - DNA, 25 bp, Rattus norvegicus
tgcctgcaggccgtacggcaccatg

SEQ ID NO: 479727 - DNA, 25 bp, Rattus norvegicus
agctttgtctcttgtccgctgcggc

SEQ ID NO: 479728 - DNA, 25 bp, Rattus norvegicus
atggcgactcttctctgcggtggag

SEQ ID NO: 479729 - DNA, 25 bp, Rattus norvegicus
aagaggaccttactgcagtcgactg

SEQ ID NO: 479730 - DNA, 25 bp, Rattus norvegicus
cctccagcagggagcggtgtatttt

SEQ ID NO: 479731 - DNA, 25 bp, Rattus norvegicus
cggtgtattttggtttgcccgcgcg

SEQ ID NO: 479732 - DNA, 25 bp, Rattus norvegicus
cgccgggaacagacgctcgggacac

SEQ ID NO: 479733 - DNA, 25 bp, Rattus norvegicus
cagcattgctgcctgcaggccgtac

SEQ ID NO: 479734 - DNA, 25 bp, Rattus norvegicus
cggcagccagccttcagctttgtct

SEQ ID NO: 479735 - DNA, 25 bp, Rattus norvegicus
taccagatccgtccactgcgtgggg

SEQ ID NO: 479736 - DNA, 25 bp, Rattus norvegicus
ccggcgcggctatttccagccatga

SEQ ID NO: 479737 - DNA, 25 bp, Rattus norvegicus
ttccagccatgacgtcacccgaatg

SEQ ID NO: 479738 - DNA, 25 bp, Rattus norvegicus
tcacccgaatgcagcggaggaccgc

SEQ ID NO: 479739 - DNA, 25 bp, Rattus norvegicus
acgcgggaaggatggcgactcttct

SEQ ID NO: 479740 - DNA, 25 bp, Rattus norvegicus
gctccggctactgccgctgcccatg

SEQ ID NO: 479741 - DNA, 25 bp, Rattus norvegicus
ccaaggctgtctctcccgggcctgt

SEQ ID NO: 479742 - DNA, 25 bp, Rattus norvegicus
gcccatggcgcgtaccggacctgga

SEQ ID NO: 479743 - DNA, 25 bp, Rattus norvegicus
aggattcggccgctccggctactgc

SEQ ID NO: 479744 - DNA, 25 bp, Rattus norvegicus
tctggcgcctgtcaggactgcgccg

SEQ ID NO: 479745 - DNA, 25 bp, Rattus norvegicus
cctgtctggcgcctgtcaggactgc

SEQ ID NO: 479746 - DNA, 25 bp, Rattus norvegicus
agacctctgactcggccagcaactg

SEQ ID NO: 479747 - DNA, 25 bp, Rattus norvegicus
tgtcttggcctggtcagccgcgccg

SEQ ID NO: 479748 - DNA, 25 bp, Rattus norvegicus
gccagcaactggtccagcaggcgca

SEQ ID NO: 479749 - DNA, 25 bp, Rattus norvegicus
aggcgcagggtctcctcccggccac

SEQ ID NO: 479750 - DNA, 25 bp, Rattus norvegicus
ggggatcagggccgcactcctcctg

SEQ ID NO: 479751 - DNA, 25 bp, Rattus norvegicus
caccgcggctgtcttggcctggtca

SEQ ID NO: 479752 - DNA, 25 bp, Rattus norvegicus
tctgactcggccagcaactggtcca

SEQ ID NO: 479753 - DNA, 25 bp, Rattus norvegicus
agccgcgccgccctccaaggctgtc

SEQ ID NO: 479754 - DNA, 25 bp, Rattus norvegicus
tctagcaatccaaaacggttccggc

SEQ ID NO: 479755 - DNA, 25 bp, Rattus norvegicus
gtggacggtgcttaccgccactcac

SEQ ID NO: 479756 - DNA, 25 bp, Rattus norvegicus
gcagctgccggtgcaccggattcca

SEQ ID NO: 479757 - DNA, 25 bp, Rattus norvegicus
aggcctacggcgcaactcaaatctc

SEQ ID NO: 479758 - DNA, 25 bp, Rattus norvegicus
gtcactcaaggcaacgtgtcccaga

SEQ ID NO: 479759 - DNA, 25 bp, Rattus norvegicus
agcggcgtccaatcgcagccgagga

SEQ ID NO: 479760 - DNA, 25 bp, Rattus norvegicus
gaccgcgcgattcgaacgcccttta

SEQ ID NO: 479761 - DNA, 25 bp, Rattus norvegicus
cggcgcagactccttgtaggtcttt

SEQ ID NO: 479762 - DNA, 25 bp, Rattus norvegicus
ccctgaagcgactcagtctggctga

SEQ ID NO: 479763 - DNA, 25 bp, Rattus norvegicus
ctggctgacaaggagaacacggtga

SEQ ID NO: 479764 - DNA, 25 bp, Rattus norvegicus
cctggctagcaaggctgcaaggaga

SEQ ID NO: 479765 - DNA, 25 bp, Rattus norvegicus
ctagactagggacgcaaagtcactc

SEQ ID NO: 479766 - DNA, 25 bp, Rattus norvegicus
ctgcaaggagaatcttccaggactc

SEQ ID NO: 479767 - DNA, 25 bp, Rattus norvegicus
gggctgaggcctccaatagacggca

SEQ ID NO: 479768 - DNA, 25 bp, Rattus norvegicus
aactctgccgacataggctttgtca

SEQ ID NO: 479769 - DNA, 25 bp, Rattus norvegicus
ttcgacaagtataacagcaaagccg

SEQ ID NO: 479770 - DNA, 25 bp, Rattus norvegicus
ggctttgtcattgatggctcaagca

SEQ ID NO: 479771 - DNA, 25 bp, Rattus norvegicus
ctcaagcagcgtggggacaagcaac

SEQ ID NO: 479772 - DNA, 25 bp, Rattus norvegicus
gacaagcaacttccgcacggtcctg

SEQ ID NO: 479773 - DNA, 25 bp, Rattus norvegicus
gcacggtcctgcagttcgtggccaa

SEQ ID NO: 479774 - DNA, 25 bp, Rattus norvegicus
tcgtggccaacctcagcaaggagtt

SEQ ID NO: 479775 - DNA, 25 bp, Rattus norvegicus
gcctcgcctgcagcaagacctgttt

SEQ ID NO: 479776 - DNA, 25 bp, Rattus norvegicus
caaggagtttgagatttcagacacc

SEQ ID NO: 479777 - DNA, 25 bp, Rattus norvegicus
ttcagacaccgacactcgcatcggg

SEQ ID NO: 479778 - DNA, 25 bp, Rattus norvegicus
catcggggccgtgcagtacacctat

SEQ ID NO: 479779 - DNA, 25 bp, Rattus norvegicus
agtacacctatgagcagcggctgga

SEQ ID NO: 479780 - DNA, 25 bp, Rattus norvegicus
agcggctggaattcgggttcgacaa

SEQ ID NO: 479781 - DNA, 25 bp, Rattus norvegicus
gacctgtttaaactctgccgacata

SEQ ID NO: 479782 - DNA, 25 bp, Rattus norvegicus
cacgtaggtttgtcaaacgccaagc

SEQ ID NO: 479783 - DNA, 25 bp, Rattus norvegicus
cagaggcagcccttcccgggactgg

SEQ ID NO: 479784 - DNA, 25 bp, Rattus norvegicus
acaccgctccggtgaggacgctgag

SEQ ID NO: 479785 - DNA, 25 bp, Rattus norvegicus
ccagcacctcggttcgtcacacaga

SEQ ID NO: 479786 - DNA, 25 bp, Rattus norvegicus
ctcccggcttgcgaatctgtccgta

SEQ ID NO: 479787 - DNA, 25 bp, Rattus norvegicus
ctgcctctttgttccgtccgggcgg

SEQ ID NO: 479788 - DNA, 25 bp, Rattus norvegicus
gtgccgctgcctatgcgttggatca

SEQ ID NO: 479789 - DNA, 25 bp, Rattus norvegicus
ctatgcgttggatcagctcgaagtc

SEQ ID NO: 479790 - DNA, 25 bp, Rattus norvegicus
tcagctcgaagtcctcctgcgggtt

SEQ ID NO: 479791 - DNA, 25 bp, Rattus norvegicus
gagccgggtcacacccaccaggaga

SEQ ID NO: 479792 - DNA, 25 bp, Rattus norvegicus
ctcgctcagggtgcagctccaacat

SEQ ID NO: 479793 - DNA, 25 bp, Rattus norvegicus
aatctgtccgtacgcgctggacgcg

SEQ ID NO: 479794 - DNA, 25 bp, Rattus norvegicus
ccttcccgggactgggcgcagtaga

SEQ ID NO: 479795 - DNA, 25 bp, Rattus norvegicus
gggtcacacccaccaggagaggagc

SEQ ID NO: 479796 - DNA, 25 bp, Rattus norvegicus
cacggcctgacacgggacaggcatc

SEQ ID NO: 479797 - DNA, 25 bp, Rattus norvegicus
cccagcctagtggtcggtcgtgtaa

SEQ ID NO: 479798 - DNA, 25 bp, Rattus norvegicus
agctcgcgcgctgtgtatggtctat

SEQ ID NO: 479799 - DNA, 25 bp, Rattus norvegicus
gtctatcggaggcagctgacctttg

SEQ ID NO: 479800 - DNA, 25 bp, Rattus norvegicus
tgacctttgaggaggaaatcgctgc

SEQ ID NO: 479801 - DNA, 25 bp, Rattus norvegicus
ggaaatcgctgctctctgctccttc

SEQ ID NO: 479802 - DNA, 25 bp, Rattus norvegicus
tgctccttcctgtagtaacagcctc

SEQ ID NO: 479803 - DNA, 25 bp, Rattus norvegicus
agcacagaccgggagtcccggtgat

SEQ ID NO: 479804 - DNA, 25 bp, Rattus norvegicus
agagccgtcaggagccgtcagaagc

SEQ ID NO: 479805 - DNA, 25 bp, Rattus norvegicus
cccgccgcgcgtggacaggatctag

SEQ ID NO: 479806 - DNA, 25 bp, Rattus norvegicus
gacaggcatcggtcccagcttcgaa

SEQ ID NO: 479807 - DNA, 25 bp, Rattus norvegicus
cccagcttcgaatgggatcttcaga

SEQ ID NO: 479808 - DNA, 25 bp, Rattus norvegicus
tcgaatgggatcttcagagggagca

SEQ ID NO: 479809 - DNA, 25 bp, Rattus norvegicus
ctccgcagcaccaggtgagtgggtc

SEQ ID NO: 479810 - DNA, 25 bp, Rattus norvegicus
cggtgaggccaacgtcctctgattg

SEQ ID NO: 479811 - DNA, 25 bp, Rattus norvegicus
cgtgcagctgcccatcgatcaggta

SEQ ID NO: 479812 - DNA, 25 bp, Rattus norvegicus
taaaagcacggctgctcggaccgcg

SEQ ID NO: 479813 - DNA, 25 bp, Rattus norvegicus
tagtgcgtctccctgtagctcccag

SEQ ID NO: 479814 - DNA, 25 bp, Rattus norvegicus
tgttgtccaccgtcactgccagtga

SEQ ID NO: 479815 - DNA, 25 bp, Rattus norvegicus
gacggcgcccaccattcctgagaaa

SEQ ID NO: 479816 - DNA, 25 bp, Rattus norvegicus
accagcgagcatgactctcggtcgc

SEQ ID NO: 479817 - DNA, 25 bp, Rattus norvegicus
ggggcgccgcaacgccattggatca

SEQ ID NO: 479818 - DNA, 25 bp, Rattus norvegicus
tggtttcttgtagtgcgtctccctg

SEQ ID NO: 479819 - DNA, 25 bp, Rattus norvegicus
ggcactttctgcttttggtttcttg

SEQ ID NO: 479820 - DNA, 25 bp, Rattus norvegicus
cagcaagggagacaaaggcactttc

SEQ ID NO: 479821 - DNA, 25 bp, Rattus norvegicus
cgccattggatcacagggctgtctg

SEQ ID NO: 479822 - DNA, 25 bp, Rattus norvegicus
tgcccatcgatcaggtaccggcgtc

SEQ ID NO: 479823 - DNA, 25 bp, Rattus norvegicus
aggcggaggcaaagccgccctcaca

SEQ ID NO: 479824 - DNA, 25 bp, Rattus norvegicus
gcgtggtacgggcactttgctaata

SEQ ID NO: 479825 - DNA, 25 bp, Rattus norvegicus
ggagtcctcagccaggccgagatac

SEQ ID NO: 479826 - DNA, 25 bp, Rattus norvegicus
ggaacactggcgctctgttgcagcg

SEQ ID NO: 479827 - DNA, 25 bp, Rattus norvegicus
cggtgcagccgaggcccggaacact

SEQ ID NO: 479828 - DNA, 25 bp, Rattus norvegicus
cctgagtctcaggaaaatggccgcc

SEQ ID NO: 479829 - DNA, 25 bp, Rattus norvegicus
caggccgagatacggtcagtgcgaa

SEQ ID NO: 479830 - DNA, 25 bp, Rattus norvegicus
catacgcccacgtgacctgtcagtt

SEQ ID NO: 479831 - DNA, 25 bp, Rattus norvegicus
cggccctgtgagctggctctacaga

SEQ ID NO: 479832 - DNA, 25 bp, Rattus norvegicus
cctctgacaaggtctgcggccctgt

SEQ ID NO: 479833 - DNA, 25 bp, Rattus norvegicus
ctcttggcgtcgtgtcctctgacaa

SEQ ID NO: 479834 - DNA, 25 bp, Rattus norvegicus
ctaatagctgtgctctcttggcgtc

SEQ ID NO: 479835 - DNA, 25 bp, Rattus norvegicus
tctcaggaaaatggccgccgggcgt

SEQ ID NO: 479836 - DNA, 25 bp, Rattus norvegicus
gtgacctgtcagttcctgagtctca

SEQ ID NO: 479837 - DNA, 25 bp, Rattus norvegicus
acgaatctgtaagtgacagcggaga

SEQ ID NO: 479838 - DNA, 25 bp, Rattus norvegicus
tgagagctctcggttcttccgcgtt

SEQ ID NO: 479839 - DNA, 25 bp, Rattus norvegicus
cgtcttttatgtgcactcgccctgg

SEQ ID NO: 479840 - DNA, 25 bp, Rattus norvegicus
ttttgctccgggagatgcccaagct

SEQ ID NO: 479841 - DNA, 25 bp, Rattus norvegicus
ctgtggtccgacaggctgtttttcc

SEQ ID NO: 479842 - DNA, 25 bp, Rattus norvegicus
cggacctcaccggactgaaggcttt

SEQ ID NO: 479843 - DNA, 25 bp, Rattus norvegicus
gaaggctttcatgctgctcgtagga

SEQ ID NO: 479844 - DNA, 25 bp, Rattus norvegicus
catgctgctcgtaggaggaaaggcc

SEQ ID NO: 479845 - DNA, 25 bp, Rattus norvegicus
ctctgttcagaatgaagcgcgagcc

SEQ ID NO: 479846 - DNA, 25 bp, Rattus norvegicus
gggcatccctgaatcgccattggtg

SEQ ID NO: 479847 - DNA, 25 bp, Rattus norvegicus
aggggtgccgtccatcataccaggc

SEQ ID NO: 479848 - DNA, 25 bp, Rattus norvegicus
cataccaggcgaatcctcccattgg

SEQ ID NO: 479849 - DNA, 25 bp, Rattus norvegicus
ctcccattggtgagtgagagctctc

SEQ ID NO: 479850 - DNA, 25 bp, Rattus norvegicus
ggttcttccgcgttcgcagccaatg

SEQ ID NO: 479851 - DNA, 25 bp, Rattus norvegicus
tggccgctcaatcgggcatccctga

SEQ ID NO: 479852 - DNA, 25 bp, Rattus norvegicus
cgataatcagaagcaggtcccggcc

SEQ ID NO: 479853 - DNA, 25 bp, Rattus norvegicus
catttaaagcaacagacccgcttgg

SEQ ID NO: 479854 - DNA, 25 bp, Rattus norvegicus
ggctgccatggtaaccgcgccgtca

SEQ ID NO: 479855 - DNA, 25 bp, Rattus norvegicus
ccatgtccaggccacgcgcgataat

SEQ ID NO: 479856 - DNA, 25 bp, Rattus norvegicus
gcccagctgatcaatgcctgcaagg

SEQ ID NO: 479857 - DNA, 25 bp, Rattus norvegicus
ggcgagtctcaaggtcttctctgca

SEQ ID NO: 479858 - DNA, 25 bp, Rattus norvegicus
ttctctgcacatctggcgcaattgg

SEQ ID NO: 479859 - DNA, 25 bp, Rattus norvegicus
gcgcaattgggagctctcgcctttc

SEQ ID NO: 479860 - DNA, 25 bp, Rattus norvegicus
cctcggttttgttctcacagctgtg

SEQ ID NO: 479861 - DNA, 25 bp, Rattus norvegicus
acagctgtgtccattccgcccgtga

SEQ ID NO: 479862 - DNA, 25 bp, Rattus norvegicus
cccgagtgatccctgacaggtgatg

SEQ ID NO: 479863 - DNA, 25 bp, Rattus norvegicus
tgacaggtgatgaattggcagcagc

SEQ ID NO: 479864 - DNA, 25 bp, Rattus norvegicus
gagcagactctctggcgccaggcgc

SEQ ID NO: 479865 - DNA, 25 bp, Rattus norvegicus
ggagttgcccgaaccctgctaccag

SEQ ID NO: 479866 - DNA, 25 bp, Rattus norvegicus
gccctccaagcgcaaagagcgtagc

SEQ ID NO: 479867 - DNA, 25 bp, Rattus norvegicus
tgggaacccgcaagcagcctgcaac

SEQ ID NO: 479868 - DNA, 25 bp, Rattus norvegicus
agcctgcaacaagggcgggcttgtc

SEQ ID NO: 479869 - DNA, 25 bp, Rattus norvegicus
cgggcttgtccggaatcaaactgct

SEQ ID NO: 479870 - DNA, 25 bp, Rattus norvegicus
ttgtccggaatcaaactgcttctta

SEQ ID NO: 479871 - DNA, 25 bp, Rattus norvegicus
ctgcttcttaatattataatgccgc

SEQ ID NO: 479872 - DNA, 25 bp, Rattus norvegicus
aatgccgcaccaaaagcaaaacctg

SEQ ID NO: 479873 - DNA, 25 bp, Rattus norvegicus
ggagtccctaacaagaaacacattg

SEQ ID NO: 479874 - DNA, 25 bp, Rattus norvegicus
aacacattgtgtgcgctgcctccgc

SEQ ID NO: 479875 - DNA, 25 bp, Rattus norvegicus
cttggttggctccagcctcgtttgc

SEQ ID NO: 479876 - DNA, 25 bp, Rattus norvegicus
aagagcgtagcgcacaggccacccg

SEQ ID NO: 479877 - DNA, 25 bp, Rattus norvegicus
gactgtagtctacccgagcccggag

SEQ ID NO: 479878 - DNA, 25 bp, Rattus norvegicus
aagtccaggactgtagtctacccga

SEQ ID NO: 479879 - DNA, 25 bp, Rattus norvegicus
ctgcagacagccaagtccaggactg

SEQ ID NO: 479880 - DNA, 25 bp, Rattus norvegicus
cgcctagggtgaagaagtcgcctct

SEQ ID NO: 479881 - DNA, 25 bp, Rattus norvegicus
ttaaatctctgagctccagggacgg

SEQ ID NO: 479882 - DNA, 25 bp, Rattus norvegicus
acaccgagactcctgggccagaggc

SEQ ID NO: 479883 - DNA, 25 bp, Rattus norvegicus
agaggccagcagaggaccatgccca

SEQ ID NO: 479884 - DNA, 25 bp, Rattus norvegicus
catgcccatggctaggcgcggctaa

SEQ ID NO: 479885 - DNA, 25 bp, Rattus norvegicus
ggtactcgcgactgccactgtctag

SEQ ID NO: 479886 - DNA, 25 bp, Rattus norvegicus
cactgtctagaacggaccggacctt

SEQ ID NO: 479887 - DNA, 25 bp, Rattus norvegicus
ggagtccacccaaggcctgcagacg

SEQ ID NO: 479888 - DNA, 25 bp, Rattus norvegicus
cgcctgcggctgtagacttctccgt

SEQ ID NO: 479889 - DNA, 25 bp, Rattus norvegicus
cgtcacccagcggactcaaggagca

SEQ ID NO: 479890 - DNA, 25 bp, Rattus norvegicus
ccgctcgggcgatgccgacacaaag

SEQ ID NO: 479891 - DNA, 25 bp, Rattus norvegicus
gcagagccagtttgcacgccagcgc

SEQ ID NO: 479892 - DNA, 25 bp, Rattus norvegicus
ttctgttagcaggagcgattaaatc

SEQ ID NO: 479893 - DNA, 25 bp, Rattus norvegicus
ggcggccaggaagccttctgttagc

SEQ ID NO: 479894 - DNA, 25 bp, Rattus norvegicus
ctgggtctgtaatcaccgcggtttc

SEQ ID NO: 479895 - DNA, 25 bp, Rattus norvegicus
ggccagaatttcctaaccgccgctg

SEQ ID NO: 479896 - DNA, 25 bp, Rattus norvegicus
aggaggtcccagctgcatctgcctt

SEQ ID NO: 479897 - DNA, 25 bp, Rattus norvegicus
tcactttcgtttccaggggatcctg

SEQ ID NO: 479898 - DNA, 25 bp, Rattus norvegicus
cgtggcacccatggccctaataagc

SEQ ID NO: 479899 - DNA, 25 bp, Rattus norvegicus
gcagctacgcgctgtgtgtgccatt

SEQ ID NO: 479900 - DNA, 25 bp, Rattus norvegicus
gcgagctgagcaaactgctgggata

SEQ ID NO: 479901 - DNA, 25 bp, Rattus norvegicus
gatcaggccagcgaagcccagcatg

SEQ ID NO: 479902 - DNA, 25 bp, Rattus norvegicus
tgctgcagcttctgggctcatgcca

SEQ ID NO: 479903 - DNA, 25 bp, Rattus norvegicus
ttccaggccgattcccagggattgc

SEQ ID NO: 479904 - DNA, 25 bp, Rattus norvegicus
ctgctgcctgatctgctcaactctg

SEQ ID NO: 479905 - DNA, 25 bp, Rattus norvegicus
ctcaactctgcggtgtttcaagacc

SEQ ID NO: 479906 - DNA, 25 bp, Rattus norvegicus
ttagtaacacgccagagcccagggc

SEQ ID NO: 479907 - DNA, 25 bp, Rattus norvegicus
cgcttcactgtagagctgcccgatt

SEQ ID NO: 479908 - DNA, 25 bp, Rattus norvegicus
gataacccagaagggcgcggccctc

SEQ ID NO: 479909 - DNA, 25 bp, Rattus norvegicus
ggctgttgggcaccgagtttcaatt

SEQ ID NO: 479910 - DNA, 25 bp, Rattus norvegicus
aggagctctctacctgcagttcgca

SEQ ID NO: 479911 - DNA, 25 bp, Rattus norvegicus
tagccctgtggacactagctccgga

SEQ ID NO: 479912 - DNA, 25 bp, Rattus norvegicus
ccgcgtccgctgatctgtgaacacg

SEQ ID NO: 479913 - DNA, 25 bp, Rattus norvegicus
cgacctggatccctattggccaagt

SEQ ID NO: 479914 - DNA, 25 bp, Rattus norvegicus
taacggtttctgtgggtctagagtc

SEQ ID NO: 479915 - DNA, 25 bp, Rattus norvegicus
cgagtttcaattcaccgccggaagg

SEQ ID NO: 479916 - DNA, 25 bp, Rattus norvegicus
ccaaagccaccctgtaccgtggagg

SEQ ID NO: 479917 - DNA, 25 bp, Rattus norvegicus
taggcgcatttgctttcctcctgcc

SEQ ID NO: 479918 - DNA, 25 bp, Rattus norvegicus
gcgcgctgtgagatcgagcagctca

SEQ ID NO: 479919 - DNA, 25 bp, Rattus norvegicus
acttgtatcccattgagcgcgcgcg

SEQ ID NO: 479920 - DNA, 25 bp, Rattus norvegicus
aggacaccgggctgccacctacatg

SEQ ID NO: 479921 - DNA, 25 bp, Rattus norvegicus
cctaagggctctagaagcggcatcc

SEQ ID NO: 479922 - DNA, 25 bp, Rattus norvegicus
tctgcaaaaagttgagggctctctc

SEQ ID NO: 479923 - DNA, 25 bp, Rattus norvegicus
aggaagacgcacttggctgccttgc

SEQ ID NO: 479924 - DNA, 25 bp, Rattus norvegicus
cgccttgagcttggcgcacttcttg

SEQ ID NO: 479925 - DNA, 25 bp, Rattus norvegicus
gtcgggataatcagccatgtgcttg

SEQ ID NO: 479926 - DNA, 25 bp, Rattus norvegicus
gtccttcagcatcttccaacgcttg

SEQ ID NO: 479927 - DNA, 25 bp, Rattus norvegicus
tcatcatcgtcgtccaggaagacgc

SEQ ID NO: 479928 - DNA, 25 bp, Rattus norvegicus
caacgcttgcccagcctcttggaga

SEQ ID NO: 479929 - DNA, 25 bp, Rattus norvegicus
tgctccatgatcttcctgcgctcga

SEQ ID NO: 479930 - DNA, 25 bp, Rattus norvegicus
gcgctcgatcttggaccacaccatg

SEQ ID NO: 479931 - DNA, 25 bp, Rattus norvegicus
cgcgcgcgcttcttctgcaaaaagt

SEQ ID NO: 479932 - DNA, 25 bp, Rattus norvegicus
agggctctctctcaactcgttatca

SEQ ID NO: 479933 - DNA, 25 bp, Rattus norvegicus
agccaatagctggtctcgactccgc

SEQ ID NO: 479934 - DNA, 25 bp, Rattus norvegicus
gactccgcctatctcccgttattaa

SEQ ID NO: 479935 - DNA, 25 bp, Rattus norvegicus
tctccggcaagttgcaaagtccttg

SEQ ID NO: 479936 - DNA, 25 bp, Rattus norvegicus
gcgccgggagaacacgaacttacgc

SEQ ID NO: 479937 - DNA, 25 bp, Rattus norvegicus
tgctcggtcagctgctccagcagag

SEQ ID NO: 479938 - DNA, 25 bp, Rattus norvegicus
tgtccaccagcgcatagggtccgcg

SEQ ID NO: 479939 - DNA, 25 bp, Rattus norvegicus
agcacacgctgacctgacgtccggg

SEQ ID NO: 479940 - DNA, 25 bp, Rattus norvegicus
gtctgcagcgactccagttcgagca

SEQ ID NO: 479941 - DNA, 25 bp, Rattus norvegicus
tagagtcgccgcacaccaaagggca

SEQ ID NO: 479942 - DNA, 25 bp, Rattus norvegicus
agagcctcgaagttagctacgcggc

SEQ ID NO: 479943 - DNA, 25 bp, Rattus norvegicus
cccgttgcggtacaccaagatggtc

SEQ ID NO: 479944 - DNA, 25 bp, Rattus norvegicus
tgtgcccatggccactgctcgctag

SEQ ID NO: 479945 - DNA, 25 bp, Rattus norvegicus
tagcctcgggacatgcagaactgtg

SEQ ID NO: 479946 - DNA, 25 bp, Rattus norvegicus
gcagaactgtgcaagaaggcgccca

SEQ ID NO: 479947 - DNA, 25 bp, Rattus norvegicus
tgcctgcctaatgggtcctgagcct

SEQ ID NO: 479948 - DNA, 25 bp, Rattus norvegicus
tcctgagcctgaagcagcacacgct

SEQ ID NO: 479949 - DNA, 25 bp, Rattus norvegicus
ttcgagcacccggtggccataagtg

SEQ ID NO: 479950 - DNA, 25 bp, Rattus norvegicus
gcggcaccttgtagaccgcggtctt

SEQ ID NO: 479951 - DNA, 25 bp, Rattus norvegicus
tcgcggatcttcttgacatggaagg

SEQ ID NO: 479952 - DNA, 25 bp, Rattus norvegicus
cgtgaaggacttgcgcagcttgtcg

SEQ ID NO: 479953 - DNA, 25 bp, Rattus norvegicus
tgagtcctgctcagtcgctgtcgct

SEQ ID NO: 479954 - DNA, 25 bp, Rattus norvegicus
tcgctgtcgctcttgtccaccagga

SEQ ID NO: 479955 - DNA, 25 bp, Rattus norvegicus
ggccttcttgaagtcgtccacgcgc

SEQ ID NO: 479956 - DNA, 25 bp, Rattus norvegicus
tgatctccagcagcgtgtgcacgtc

SEQ ID NO: 479957 - DNA, 25 bp, Rattus norvegicus
cgtacaccacgtggtcgggcgtgaa

SEQ ID NO: 479958 - DNA, 25 bp, Rattus norvegicus
gcttgtcgcgcgacgtcttcagctt

SEQ ID NO: 479959 - DNA, 25 bp, Rattus norvegicus
tgcccagcttgttcatgcgcttctc

SEQ ID NO: 479960 - DNA, 25 bp, Rattus norvegicus
ctccttagtcttcaggcgcgtcttc

SEQ ID NO: 479961 - DNA, 25 bp, Rattus norvegicus
gtcagacgacagctcgatcgccgca

SEQ ID NO: 479962 - DNA, 25 bp, Rattus norvegicus
ttctccttggagaaggccttcttga

SEQ ID NO: 479963 - DNA, 25 bp, Rattus norvegicus
cggcgtccgattcctcggtgatctc

SEQ ID NO: 479964 - DNA, 25 bp, Rattus norvegicus
cgccgaggccaagtgcattgtgtct

SEQ ID NO: 479965 - DNA, 25 bp, Rattus norvegicus
cggttgcctctccagttgctgcgct

SEQ ID NO: 479966 - DNA, 25 bp, Rattus norvegicus
accgatcactggtacgagaccgacc

SEQ ID NO: 479967 - DNA, 25 bp, Rattus norvegicus
gggcgctcgtcacggcgctaagcct

SEQ ID NO: 479968 - DNA, 25 bp, Rattus norvegicus
agcctttgctccctggggctgctcg

SEQ ID NO: 479969 - DNA, 25 bp, Rattus norvegicus
gggctgctcgtcacggccatcttca

SEQ ID NO: 479970 - DNA, 25 bp, Rattus norvegicus
cggccatcttcaccgatcactggta

SEQ ID NO: 479971 - DNA, 25 bp, Rattus norvegicus
gcggagcacagtccgggcatcccag

SEQ ID NO: 479972 - DNA, 25 bp, Rattus norvegicus
gggacatcgacaccctcatcctgaa

SEQ ID NO: 479973 - DNA, 25 bp, Rattus norvegicus
cctgggcatcgaccgggacatcgac

SEQ ID NO: 479974 - DNA, 25 bp, Rattus norvegicus
gaagtgctacttcctgggcatcgac

SEQ ID NO: 479975 - DNA, 25 bp, Rattus norvegicus
ctgggcgctctgacccggagtcctg

SEQ ID NO: 479976 - DNA, 25 bp, Rattus norvegicus
cccggatcagaagaaccgcctgatg

SEQ ID NO: 479977 - DNA, 25 bp, Rattus norvegicus
agaaccgcctgatgccgctgtcgca

SEQ ID NO: 479978 - DNA, 25 bp, Rattus norvegicus
cggggcacaagctcacctgagagat

SEQ ID NO: 479979 - DNA, 25 bp, Rattus norvegicus
aggctgccagccacactcatgggca

SEQ ID NO: 479980 - DNA, 25 bp, Rattus norvegicus
acactcatgggcagtgagcgcaccc

SEQ ID NO: 479981 - DNA, 25 bp, Rattus norvegicus
ctcgagcagcgcctgcgaatacaga

SEQ ID NO: 479982 - DNA, 25 bp, Rattus norvegicus
cgaatacagagaacgtgggcgccac

SEQ ID NO: 479983 - DNA, 25 bp, Rattus norvegicus
caggagacccggaggtcaacagatc

SEQ ID NO: 479984 - DNA, 25 bp, Rattus norvegicus
agacccgggccatctacgggcgcag

SEQ ID NO: 479985 - DNA, 25 bp, Rattus norvegicus
caggactcttttcgcccaaactctg

SEQ ID NO: 479986 - DNA, 25 bp, Rattus norvegicus
tctgcgaaaaaccacagccacattg

SEQ ID NO: 479987 - DNA, 25 bp, Rattus norvegicus
acattgcgggccgtgaacctacctt

SEQ ID NO: 479988 - DNA, 25 bp, Rattus norvegicus
aagagacacagctctcgcgagaaca

SEQ ID NO: 479989 - DNA, 25 bp, Rattus norvegicus
cgagaacagctcatatccgggtggc

SEQ ID NO: 479990 - DNA, 25 bp, Rattus norvegicus
ctccgggaatgaaagtctgcctcgc

SEQ ID NO: 479991 - DNA, 25 bp, Rattus norvegicus
agggcggataatccgctgcatccca

SEQ ID NO: 479992 - DNA, 25 bp, Rattus norvegicus
cgacgtcaccttcctgagccggaag

SEQ ID NO: 479993 - DNA, 25 bp, Rattus norvegicus
tgtttgcgggctcggcatgttctat

SEQ ID NO: 479994 - DNA, 25 bp, Rattus norvegicus
acactggccgtagtgcgcgtcaggc

SEQ ID NO: 479995 - DNA, 25 bp, Rattus norvegicus
cactgtgacactggccgtagtgcgc

SEQ ID NO: 479996 - DNA, 25 bp, Rattus norvegicus
gtttcgcactgtgacactggccgta

SEQ ID NO: 479997 - DNA, 25 bp, Rattus norvegicus
gccgctgtttcgcactgtgacactg

SEQ ID NO: 479998 - DNA, 25 bp, Rattus norvegicus
ggctgctgccgctgtttcgcactgt

SEQ ID NO: 479999 - DNA, 25 bp, Rattus norvegicus
cagaaatgtgggttgccgcgctggc

SEQ ID NO: 480000 - DNA, 25 bp, Rattus norvegicus
cacggagagggcagaaatgtgggtt

SEQ ID NO: 480001 - DNA, 25 bp, Rattus norvegicus
ccggaagcttgtctgctcgctggcg

SEQ ID NO: 480002 - DNA, 25 bp, Rattus norvegicus
tgagccggaagcttgtctgctcgct

SEQ ID NO: 480003 - DNA, 25 bp, Rattus norvegicus
ttcctgagccggaagcttgtctgct

SEQ ID NO: 480004 - DNA, 25 bp, Rattus norvegicus
ctcggcatgttctatgcggtgagga

SEQ ID NO: 480005 - DNA, 25 bp, Rattus norvegicus
gtcaccttcctgagccggaagcttg

SEQ ID NO: 480006 - DNA, 25 bp, Rattus norvegicus
atctagggcactgcgcaagctcagc

SEQ ID NO: 480007 - DNA, 25 bp, Rattus norvegicus
ctattggaaggtacgagtgcaggcc

SEQ ID NO: 480008 - DNA, 25 bp, Rattus norvegicus
ctcggagtgctctattggaaggtac

SEQ ID NO: 480009 - DNA, 25 bp, Rattus norvegicus
gggaatctagggcactgcgcaagct

SEQ ID NO: 480010 - DNA, 25 bp, Rattus norvegicus
tgcgcacgctcggagtgctctattg

SEQ ID NO: 480011 - DNA, 25 bp, Rattus norvegicus
agcccgaccgccctgtgggactgga

SEQ ID NO: 480012 - DNA, 25 bp, Rattus norvegicus
tatggacgagtccacggccgacccg

SEQ ID NO: 480013 - DNA, 25 bp, Rattus norvegicus
cccttcagccagttcgtggaagccg

SEQ ID NO: 480014 - DNA, 25 bp, Rattus norvegicus
ctggtatatggacgagtccacggcc

SEQ ID NO: 480015 - DNA, 25 bp, Rattus norvegicus
gcaggcctggtatatggacgagtcc

SEQ ID NO: 480016 - DNA, 25 bp, Rattus norvegicus
tcgtggaagccgtcgccgccatggt

SEQ ID NO: 480017 - DNA, 25 bp, Rattus norvegicus
ttcagccagttcgtggaagccgtcg

SEQ ID NO: 480018 - DNA, 25 bp, Rattus norvegicus
gggcactgcgcaagctcagcacggc

SEQ ID NO: 480019 - DNA, 25 bp, Rattus norvegicus
gccggagcaccacgcgcctgcgcac

SEQ ID NO: 480020 - DNA, 25 bp, Rattus norvegicus
acgccgccctccgtgggaagatcga

SEQ ID NO: 480021 - DNA, 25 bp, Rattus norvegicus
ggcgaccctcctcactgcgacccgc

SEQ ID NO: 480022 - DNA, 25 bp, Rattus norvegicus
actgcgacccgctcctcacctgcca

SEQ ID NO: 480023 - DNA, 25 bp, Rattus norvegicus
tgaggtccgttcacccacaggcgaa

SEQ ID NO: 480024 - DNA, 25 bp, Rattus norvegicus
cacaggcgaaaagggtccgaagagc

SEQ ID NO: 480025 - DNA, 25 bp, Rattus norvegicus
aagagctgacggaagacgggaaata

SEQ ID NO: 480026 - DNA, 25 bp, Rattus norvegicus
gaagacgggaaataaactcaagatc

SEQ ID NO: 480027 - DNA, 25 bp, Rattus norvegicus
taaactcaagatccaaggtcccgca

SEQ ID NO: 480028 - DNA, 25 bp, Rattus norvegicus
aagatccaaggtcccgcacttgtgc

SEQ ID NO: 480029 - DNA, 25 bp, Rattus norvegicus
gcacttgtgcgcctgcgtattctag

SEQ ID NO: 480030 - DNA, 25 bp, Rattus norvegicus
cgcctgcgtattctagccactgaga

SEQ ID NO: 480031 - DNA, 25 bp, Rattus norvegicus
attctagccactgagacccgacttc

SEQ ID NO: 480032 - DNA, 25 bp, Rattus norvegicus
gagacccgacttccgcacatgctca

SEQ ID NO: 480033 - DNA, 25 bp, Rattus norvegicus
gtgattatgcgaggacgccgccctc

SEQ ID NO: 480034 - DNA, 25 bp, Rattus norvegicus
tagtccatttttaggccgggaatga

SEQ ID NO: 480035 - DNA, 25 bp, Rattus norvegicus
cccggtgatctacgggctggaattt

SEQ ID NO: 480036 - DNA, 25 bp, Rattus norvegicus
cagagtatcatggaagacgacgccc

SEQ ID NO: 480037 - DNA, 25 bp, Rattus norvegicus
tcggcaggcagagtatcatggaaga

SEQ ID NO: 480038 - DNA, 25 bp, Rattus norvegicus
gagtagttcggcaggcagagtatca

SEQ ID NO: 480039 - DNA, 25 bp, Rattus norvegicus
taaggcttgagtagttcggcaggca

SEQ ID NO: 480040 - DNA, 25 bp, Rattus norvegicus
ctctaaggcttgagtagttcggcag

SEQ ID NO: 480041 - DNA, 25 bp, Rattus norvegicus
gtctcgggctcgtagtccattttta

SEQ ID NO: 480042 - DNA, 25 bp, Rattus norvegicus
atgaatgggttctggccgatccctg

SEQ ID NO: 480043 - DNA, 25 bp, Rattus norvegicus
tcgggctcgtagtccatttttaggc

SEQ ID NO: 480044 - DNA, 25 bp, Rattus norvegicus
atttcaggtgagcatggcggagttt

SEQ ID NO: 480045 - DNA, 25 bp, Rattus norvegicus
ggcgccggcagagcctggccctcac

SEQ ID NO: 480046 - DNA, 25 bp, Rattus norvegicus
ccgatccctggtgaggcgggactcg

SEQ ID NO: 480047 - DNA, 25 bp, Rattus norvegicus
tacgggctggaatttcaggtgagca

SEQ ID NO: 480048 - DNA, 25 bp, Rattus norvegicus
gagcatccgggacctggccagtcat

SEQ ID NO: 480049 - DNA, 25 bp, Rattus norvegicus
tggttccgggagcacaaccgcatcg

SEQ ID NO: 480050 - DNA, 25 bp, Rattus norvegicus
gcatgcatacgctgtggttccggga

SEQ ID NO: 480051 - DNA, 25 bp, Rattus norvegicus
tgggcctgaccagcatgcatacgct

SEQ ID NO: 480052 - DNA, 25 bp, Rattus norvegicus
gccaacgagcagctgggcctgacca

SEQ ID NO: 480053 - DNA, 25 bp, Rattus norvegicus
tgaccatcgtgccaacgagcagctg

SEQ ID NO: 480054 - DNA, 25 bp, Rattus norvegicus
tggccggtgaccatcgtgccaacga

SEQ ID NO: 480055 - DNA, 25 bp, Rattus norvegicus
taccgtgctttctggccggtgacca

SEQ ID NO: 480056 - DNA, 25 bp, Rattus norvegicus
aatgagagtccaataccgtgctttc

SEQ ID NO: 480057 - DNA, 25 bp, Rattus norvegicus
acggggccacccactgagtgtatgc

SEQ ID NO: 480058 - DNA, 25 bp, Rattus norvegicus
tatcgtgcagaggtctggcaagccc

SEQ ID NO: 480059 - DNA, 25 bp, Rattus norvegicus
tacgtcagggtatcgtgcagaggtc

SEQ ID NO: 480060 - DNA, 25 bp, Rattus norvegicus
cctggccagtcatcgtggcctgcta

SEQ ID NO: 480061 - DNA, 25 bp, Rattus norvegicus
catcgtggcctgctacgtcagggta

SEQ ID NO: 480062 - DNA, 25 bp, Rattus norvegicus
gggctccggagctcctaagtccagc

SEQ ID NO: 480063 - DNA, 25 bp, Rattus norvegicus
caagtcccgcccgttaccatcaagc

SEQ ID NO: 480064 - DNA, 25 bp, Rattus norvegicus
tgttcaccgcccaccaagtcccgcc

SEQ ID NO: 480065 - DNA, 25 bp, Rattus norvegicus
actactctgttcaccgcccaccaag

SEQ ID NO: 480066 - DNA, 25 bp, Rattus norvegicus
agcaagcagggcaggctcggaaccc

SEQ ID NO: 480067 - DNA, 25 bp, Rattus norvegicus
ctgcgctagcaagcagggcaggctc

SEQ ID NO: 480068 - DNA, 25 bp, Rattus norvegicus
gcagccactgcgctagcaagcaggg

SEQ ID NO: 480069 - DNA, 25 bp, Rattus norvegicus
ctcctaagtccagcgcctgcacggc

SEQ ID NO: 480070 - DNA, 25 bp, Rattus norvegicus
cgcccacgcggctaggcgtgcgctt

SEQ ID NO: 480071 - DNA, 25 bp, Rattus norvegicus
ctcggcgctcatcgccgcccacgcg

SEQ ID NO: 480072 - DNA, 25 bp, Rattus norvegicus
agggactgcgatccctcggcgctca

SEQ ID NO: 480073 - DNA, 25 bp, Rattus norvegicus
ccagtaggtgactaggacgcccgcg

SEQ ID NO: 480074 - DNA, 25 bp, Rattus norvegicus
gcaccagtaggtgactaggacgccc

SEQ ID NO: 480075 - DNA, 25 bp, Rattus norvegicus
ggcggacagagccagcagccactgc

SEQ ID NO: 480076 - DNA, 25 bp, Rattus norvegicus
agagctaagcgccaggttcatacct

SEQ ID NO: 480077 - DNA, 25 bp, Rattus norvegicus
gttcatacctgtagatctcgcgaga

SEQ ID NO: 480078 - DNA, 25 bp, Rattus norvegicus
ctcgcgagaagactaggcgactttc

SEQ ID NO: 480079 - DNA, 25 bp, Rattus norvegicus
cctgcagtgatcatggtaactaacc

SEQ ID NO: 480080 - DNA, 25 bp, Rattus norvegicus
agtcagcatccctgcagtgatcatg

SEQ ID NO: 480081 - DNA, 25 bp, Rattus norvegicus
taggcgactttcgtggctgtcggaa

SEQ ID NO: 480082 - DNA, 25 bp, Rattus norvegicus
aagcggcggacttgtcctggctgtt

SEQ ID NO: 480083 - DNA, 25 bp, Rattus norvegicus
gcgatggcgtctccgtattcagtca

SEQ ID NO: 480084 - DNA, 25 bp, Rattus norvegicus
tccgtattcagtcagagtcttccca

SEQ ID NO: 480085 - DNA, 25 bp, Rattus norvegicus
actaaccggctctgaggactgggcg

SEQ ID NO: 480086 - DNA, 25 bp, Rattus norvegicus
tttggtggggatttgctagttcttg

SEQ ID NO: 480087 - DNA, 25 bp, Rattus norvegicus
ctagttcttgtgtggactgcgcagg

SEQ ID NO: 480088 - DNA, 25 bp, Rattus norvegicus
catggtaactaaccggctctgagga

SEQ ID NO: 480089 - DNA, 25 bp, Rattus norvegicus
agtcagagtcttcccagtcagcatc

SEQ ID NO: 480090 - DNA, 25 bp, Rattus norvegicus
cggcgctcggtggttctaattaaag

SEQ ID NO: 480091 - DNA, 25 bp, Rattus norvegicus
ctcgtgaagtagtgtcgggactgaa

SEQ ID NO: 480092 - DNA, 25 bp, Rattus norvegicus
actgaagaaccgaggagcgccgcac

SEQ ID NO: 480093 - DNA, 25 bp, Rattus norvegicus
acacgcgggacctccggcgtgagct

SEQ ID NO: 480094 - DNA, 25 bp, Rattus norvegicus
atctctcaagtccagggcggcccat

SEQ ID NO: 480095 - DNA, 25 bp, Rattus norvegicus
tgtgacctcccatctcatcgaggtg

SEQ ID NO: 480096 - DNA, 25 bp, Rattus norvegicus
atctcatcgaggtgtccaaagaccc

SEQ ID NO: 480097 - DNA, 25 bp, Rattus norvegicus
gaaagaaagttctgcggcgggctcc

SEQ ID NO: 480098 - DNA, 25 bp, Rattus norvegicus
taagaagcgcccgaggacagccgga

SEQ ID NO: 480099 - DNA, 25 bp, Rattus norvegicus
tactgctgctactgagcaccgtggg

SEQ ID NO: 480100 - DNA, 25 bp, Rattus norvegicus
gcgcccgatgctccttgcgttactg

SEQ ID NO: 480101 - DNA, 25 bp, Rattus norvegicus
taggagctgtgcgtcctgtgtccct

SEQ ID NO: 480102 - DNA, 25 bp, Rattus norvegicus
ggttctaattaaagcggcgctcgga

SEQ ID NO: 480103 - DNA, 25 bp, Rattus norvegicus
ctggactccgcgtgcggggaaactt

SEQ ID NO: 480104 - DNA, 25 bp, Rattus norvegicus
aggctcagcaccagtacaccgttta

SEQ ID NO: 480105 - DNA, 25 bp, Rattus norvegicus
aacggcgccgatgattttatccaga

SEQ ID NO: 480106 - DNA, 25 bp, Rattus norvegicus
cttgggtcagctggatctggtcaac

SEQ ID NO: 480107 - DNA, 25 bp, Rattus norvegicus
gctcacctggtagatcatgactttg

SEQ ID NO: 480108 - DNA, 25 bp, Rattus norvegicus
agctctccctggatgctctgcacag

SEQ ID NO: 480109 - DNA, 25 bp, Rattus norvegicus
ttcacgttgacgctgaccttgcgca

SEQ ID NO: 480110 - DNA, 25 bp, Rattus norvegicus
agtttctttatctggccagcctggc

SEQ ID NO: 480111 - DNA, 25 bp, Rattus norvegicus
atgactttgaagttgcggcgccgca

SEQ ID NO: 480112 - DNA, 25 bp, Rattus norvegicus
ggatatccggaatacggccgctcga

SEQ ID NO: 480113 - DNA, 25 bp, Rattus norvegicus
gcctcgttgacctccagtttcttta

SEQ ID NO: 480114 - DNA, 25 bp, Rattus norvegicus
ctcgacgatatggagcgtgacatcc

SEQ ID NO: 480115 - DNA, 25 bp, Rattus norvegicus
gcaccgggactctagccagaactgt

SEQ ID NO: 480116 - DNA, 25 bp, Rattus norvegicus
ccgtttacctggtccgacttgatca

SEQ ID NO: 480117 - DNA, 25 bp, Rattus norvegicus
ccctcggaggaagcatcgggatatc

SEQ ID NO: 480118 - DNA, 25 bp, Rattus norvegicus
caaccgggtctagcgttcactctgg

SEQ ID NO: 480119 - DNA, 25 bp, Rattus norvegicus
ggcgagtccttaccgagacacacga

SEQ ID NO: 480120 - DNA, 25 bp, Rattus norvegicus
gaacagcactgacttggacccaacc

SEQ ID NO: 480121 - DNA, 25 bp, Rattus norvegicus
tgccatgtttcggtgcagaccctgg

SEQ ID NO: 480122 - DNA, 25 bp, Rattus norvegicus
ccggcaactcttcctcttgcgaagg

SEQ ID NO: 480123 - DNA, 25 bp, Rattus norvegicus
ctggcaccagtgagtaagggtctga

SEQ ID NO: 480124 - DNA, 25 bp, Rattus norvegicus
aacaccgtcctcttcctggactgga

SEQ ID NO: 480125 - DNA, 25 bp, Rattus norvegicus
tctcattggcaaaaacagggcacac

SEQ ID NO: 480126 - DNA, 25 bp, Rattus norvegicus
caagtgtataggaccagtgatctca

SEQ ID NO: 480127 - DNA, 25 bp, Rattus norvegicus
acgcagttgagctatgttctgagca

SEQ ID NO: 480128 - DNA, 25 bp, Rattus norvegicus
caaagagagcggcttgcagaccctc

SEQ ID NO: 480129 - DNA, 25 bp, Rattus norvegicus
ccagggctgccaatgagctcaaaga

SEQ ID NO: 480130 - DNA, 25 bp, Rattus norvegicus
ctggcgcccagaaaccgcgtagaga

SEQ ID NO: 480131 - DNA, 25 bp, Rattus norvegicus
ggctctgctttgatcccaccgctaa

SEQ ID NO: 480132 - DNA, 25 bp, Rattus norvegicus
cccgagctgacgccaagaggggacc

SEQ ID NO: 480133 - DNA, 25 bp, Rattus norvegicus
gcgcgcgcacctcccgcatcaagaa

SEQ ID NO: 480134 - DNA, 25 bp, Rattus norvegicus
catcaagaacggctccaggccgcgg

SEQ ID NO: 480135 - DNA, 25 bp, Rattus norvegicus
tgcagaagaactgggcgccgccagc

SEQ ID NO: 480136 - DNA, 25 bp, Rattus norvegicus
ccagcgggttcagaacccgggtctg

SEQ ID NO: 480137 - DNA, 25 bp, Rattus norvegicus
ccgccatggtgctcgggcgcgaccc

SEQ ID NO: 480138 - DNA, 25 bp, Rattus norvegicus
ccgagacccggtcacgtgatctcga

SEQ ID NO: 480139 - DNA, 25 bp, Rattus norvegicus
acccggtcacgtgatctcgagagcg

SEQ ID NO: 480140 - DNA, 25 bp, Rattus norvegicus
cggtcacgtgatctcgagagcgcgc

SEQ ID NO: 480141 - DNA, 25 bp, Rattus norvegicus
gcgccttccgaggaacgcgctgagc

SEQ ID NO: 480142 - DNA, 25 bp, Rattus norvegicus
aggaacgcgctgagcgtccgcctct

SEQ ID NO: 480143 - DNA, 25 bp, Rattus norvegicus
ctatggggcgtcctggaaactacac

SEQ ID NO: 480144 - DNA, 25 bp, Rattus norvegicus
atggggcgtcctggaaactacaccg

SEQ ID NO: 480145 - DNA, 25 bp, Rattus norvegicus
ggtgagcccaactcacctgcgtggc

SEQ ID NO: 480146 - DNA, 25 bp, Rattus norvegicus
caagagcgctgtggagagactagca

SEQ ID NO: 480147 - DNA, 25 bp, Rattus norvegicus
caccagcttggtgggttcgagtact

SEQ ID NO: 480148 - DNA, 25 bp, Rattus norvegicus
tcctgtagcccgcagagctgtcgct

SEQ ID NO: 480149 - DNA, 25 bp, Rattus norvegicus
gctggcgccggaatgattcaccttt

SEQ ID NO: 480150 - DNA, 25 bp, Rattus norvegicus
ccttgcggacttcggaacggactcg

SEQ ID NO: 480151 - DNA, 25 bp, Rattus norvegicus
ggcaccggaacaggagcagtctcta

SEQ ID NO: 480152 - DNA, 25 bp, Rattus norvegicus
gcagtctctactggacaccagcttg

SEQ ID NO: 480153 - DNA, 25 bp, Rattus norvegicus
ttcgagtactgcgagaatgcgcgcc

SEQ ID NO: 480154 - DNA, 25 bp, Rattus norvegicus
ctggactcgcttgccagaacgcggc

SEQ ID NO: 480155 - DNA, 25 bp, Rattus norvegicus
ccagtatccgaaaacagggtccctg

SEQ ID NO: 480156 - DNA, 25 bp, Rattus norvegicus
gagggcactcttacccggcagccag

SEQ ID NO: 480157 - DNA, 25 bp, Rattus norvegicus
gactagcagcggaccgtgccaagta

SEQ ID NO: 480158 - DNA, 25 bp, Rattus norvegicus
tgccaagtatgttcgcagcacgctg

SEQ ID NO: 480159 - DNA, 25 bp, Rattus norvegicus
agaacgcggccatctctcggggact

SEQ ID NO: 480160 - DNA, 25 bp, Rattus norvegicus
ggtgtcctaggtaactcaagctaag

SEQ ID NO: 480161 - DNA, 25 bp, Rattus norvegicus
gctggcttccgaggctattgctccg

SEQ ID NO: 480162 - DNA, 25 bp, Rattus norvegicus
acagagctcgcgctcctgctggctt

SEQ ID NO: 480163 - DNA, 25 bp, Rattus norvegicus
tgggttttgcgcacagagctcgcgc

SEQ ID NO: 480164 - DNA, 25 bp, Rattus norvegicus
caccgctctcgcttcggtggtggct

SEQ ID NO: 480165 - DNA, 25 bp, Rattus norvegicus
taacgccgtgggatcgatcgccacc

SEQ ID NO: 480166 - DNA, 25 bp, Rattus norvegicus
tggttggaaataacgccgtgggatc

SEQ ID NO: 480167 - DNA, 25 bp, Rattus norvegicus
gctcctgctggcttccgaggctatt

SEQ ID NO: 480168 - DNA, 25 bp, Rattus norvegicus
tcgcctttggtgtcctaggtaactc

SEQ ID NO: 480169 - DNA, 25 bp, Rattus norvegicus
tgctccaggtgttcgcctttggtgt

SEQ ID NO: 480170 - DNA, 25 bp, Rattus norvegicus
ccctcgcctgcaaggactggacatg

SEQ ID NO: 480171 - DNA, 25 bp, Rattus norvegicus
agacgggcagcttgcctgccgcgtc

SEQ ID NO: 480172 - DNA, 25 bp, Rattus norvegicus
agaaaagacgggcagcttgcctgcc

SEQ ID NO: 480173 - DNA, 25 bp, Rattus norvegicus
ttgccccggcattgaaggaatcttg

SEQ ID NO: 480174 - DNA, 25 bp, Rattus norvegicus
gtgtctctgagcctgtagtctagca

SEQ ID NO: 480175 - DNA, 25 bp, Rattus norvegicus
gcagaggctttctggtcgctgcgtc

SEQ ID NO: 480176 - DNA, 25 bp, Rattus norvegicus
agcatcgcgtcatctccgaggagca

SEQ ID NO: 480177 - DNA, 25 bp, Rattus norvegicus
gcgtgcgcaacagcatcgcgtcatc

SEQ ID NO: 480178 - DNA, 25 bp, Rattus norvegicus
acgcctagtagacttatccaaggtc

SEQ ID NO: 480179 - DNA, 25 bp, Rattus norvegicus
tttcacctccgcagaacgcctagta

SEQ ID NO: 480180 - DNA, 25 bp, Rattus norvegicus
agcagtacacacgactccagctctg

SEQ ID NO: 480181 - DNA, 25 bp, Rattus norvegicus
ccttggccaaggagcagtacacacg

SEQ ID NO: 480182 - DNA, 25 bp, Rattus norvegicus
tagtctagcatcaccgccacgcaga

SEQ ID NO: 480183 - DNA, 25 bp, Rattus norvegicus
aggtccctccctagccagggcttgt

SEQ ID NO: 480184 - DNA, 25 bp, Rattus norvegicus
gcggacagtcattccgcagcaggtc

SEQ ID NO: 480185 - DNA, 25 bp, Rattus norvegicus
cccgtgcacgggtgaaggcccaagc

SEQ ID NO: 480186 - DNA, 25 bp, Rattus norvegicus
cgtggcaagggtgatttactcgtcc

SEQ ID NO: 480187 - DNA, 25 bp, Rattus norvegicus
agacggccctcaccttggccaagga

SEQ ID NO: 480188 - DNA, 25 bp, Rattus norvegicus
cgcctccttaccagtgtgatccatg

SEQ ID NO: 480189 - DNA, 25 bp, Rattus norvegicus
tgctgggcgaccagtcccacacgag

SEQ ID NO: 480190 - DNA, 25 bp, Rattus norvegicus
aaaggttcttattgcctaatcaggc

SEQ ID NO: 480191 - DNA, 25 bp, Rattus norvegicus
ccatgattcggctcgcagggtacag

SEQ ID NO: 480192 - DNA, 25 bp, Rattus norvegicus
gaagtgcgctgggactgctctcact

SEQ ID NO: 480193 - DNA, 25 bp, Rattus norvegicus
ccgactttggtgagggagtcacaca

SEQ ID NO: 480194 - DNA, 25 bp, Rattus norvegicus
gtcacacataggcaggactgaggca

SEQ ID NO: 480195 - DNA, 25 bp, Rattus norvegicus
cagaggctgccctcagctgtaggaa

SEQ ID NO: 480196 - DNA, 25 bp, Rattus norvegicus
cgaagggttccgaaacgagctcagc

SEQ ID NO: 480197 - DNA, 25 bp, Rattus norvegicus
acccagagtgcagtctcagccgtta

SEQ ID NO: 480198 - DNA, 25 bp, Rattus norvegicus
cgccgctgggtatagagaagtgtaa

SEQ ID NO: 480199 - DNA, 25 bp, Rattus norvegicus
tcttgcccgagggaagctgagttag

SEQ ID NO: 480200 - DNA, 25 bp, Rattus norvegicus
gctctggtgccgagacttctaattc

SEQ ID NO: 480201 - DNA, 25 bp, Rattus norvegicus
gctcagcggcaccaaagaagcggtg

SEQ ID NO: 480202 - DNA, 25 bp, Rattus norvegicus
cgtgtgacacctaaagagtcgagta

SEQ ID NO: 480203 - DNA, 25 bp, Rattus norvegicus
gcactcgatcggagacgcaactcca

SEQ ID NO: 480204 - DNA, 25 bp, Rattus norvegicus
ccacctgtggcagcggcttcggaaa

SEQ ID NO: 480205 - DNA, 25 bp, Rattus norvegicus
cggacttactggtgcccgtgtgaca

SEQ ID NO: 480206 - DNA, 25 bp, Rattus norvegicus
gcgctgtccgcgtcctgaaatcttc

SEQ ID NO: 480207 - DNA, 25 bp, Rattus norvegicus
gaacctcactttgaaggcttgggtg

SEQ ID NO: 480208 - DNA, 25 bp, Rattus norvegicus
cgctgtccagggagtgaacctcact

SEQ ID NO: 480209 - DNA, 25 bp, Rattus norvegicus
tactgctggccacctgcaggacagc

SEQ ID NO: 480210 - DNA, 25 bp, Rattus norvegicus
gcgacaccgcatagctgcagctgta

SEQ ID NO: 480211 - DNA, 25 bp, Rattus norvegicus
aaaggcctgcaatgggcacctggga

SEQ ID NO: 480212 - DNA, 25 bp, Rattus norvegicus
gggaagacactcagaaacgcggatc

SEQ ID NO: 480213 - DNA, 25 bp, Rattus norvegicus
gatctgcaccttcccggacgggtgt

SEQ ID NO: 480214 - DNA, 25 bp, Rattus norvegicus
cagcgctggcagcaaactgtcccta

SEQ ID NO: 480215 - DNA, 25 bp, Rattus norvegicus
acgcggatcaagcaaaaggcctgca

SEQ ID NO: 480216 - DNA, 25 bp, Rattus norvegicus
tctaaccccgggtgacgaggctgtg

SEQ ID NO: 480217 - DNA, 25 bp, Rattus norvegicus
ttcacgcgggctcggtacccgcgaa

SEQ ID NO: 480218 - DNA, 25 bp, Rattus norvegicus
tgactgaggctccttcacgcgggct

SEQ ID NO: 480219 - DNA, 25 bp, Rattus norvegicus
cgtgaggtgactgaggctccttcac

SEQ ID NO: 480220 - DNA, 25 bp, Rattus norvegicus
cacggccgttgtttcctggtgcgcg

SEQ ID NO: 480221 - DNA, 25 bp, Rattus norvegicus
ttccacggccgttgtttcctggtgc

SEQ ID NO: 480222 - DNA, 25 bp, Rattus norvegicus
tgaggtcacactggcgcgaccgcgc

SEQ ID NO: 480223 - DNA, 25 bp, Rattus norvegicus
agcgcgccaagcccggctgaggtca

SEQ ID NO: 480224 - DNA, 25 bp, Rattus norvegicus
cgcgcacgtcacacgccgctgggag

SEQ ID NO: 480225 - DNA, 25 bp, Rattus norvegicus
tagtcaggcttacccgccgccgatc

SEQ ID NO: 480226 - DNA, 25 bp, Rattus norvegicus
agccgccctccgctagtcaggctta

SEQ ID NO: 480227 - DNA, 25 bp, Rattus norvegicus
aaacacgttcatcagcggagccgcc

SEQ ID NO: 480228 - DNA, 25 bp, Rattus norvegicus
ggagcctccaaacacgttcatcagc

SEQ ID NO: 480229 - DNA, 25 bp, Rattus norvegicus
ggccggagcctccaaacacgttcat

SEQ ID NO: 480230 - DNA, 25 bp, Rattus norvegicus
gttctcaggcccaatacttgcgttg

SEQ ID NO: 480231 - DNA, 25 bp, Rattus norvegicus
gattgtcatgtccacgcgtttcccg

SEQ ID NO: 480232 - DNA, 25 bp, Rattus norvegicus
tttctggtctggacttggccactcc

SEQ ID NO: 480233 - DNA, 25 bp, Rattus norvegicus
ccggtcgccttgcataaagttttct

SEQ ID NO: 480234 - DNA, 25 bp, Rattus norvegicus
ttgccttgcgcagagcctgagaacc

SEQ ID NO: 480235 - DNA, 25 bp, Rattus norvegicus
tgcaggagctcttgcaggacggtaa

SEQ ID NO: 480236 - DNA, 25 bp, Rattus norvegicus
acagcacagtctcggtggcaggccg

SEQ ID NO: 480237 - DNA, 25 bp, Rattus norvegicus
tcaacccggtacttgccaacatgga

SEQ ID NO: 480238 - DNA, 25 bp, Rattus norvegicus
ggggcgatcgcaagacgtcatcaac

SEQ ID NO: 480239 - DNA, 25 bp, Rattus norvegicus
gcgccttgattctgcgtcacttgga

SEQ ID NO: 480240 - DNA, 25 bp, Rattus norvegicus
ttttattgcacggagggaatggacc

SEQ ID NO: 480241 - DNA, 25 bp, Rattus norvegicus
gtggtagctacgtcccgagcggaat

SEQ ID NO: 480242 - DNA, 25 bp, Rattus norvegicus
ccagcgtacgggattgtcatgtcca

SEQ ID NO: 480243 - DNA, 25 bp, Rattus norvegicus
agggccgtgatgctcctctttccca

SEQ ID NO: 480244 - DNA, 25 bp, Rattus norvegicus
cccagagagttgactcgagcgctca

SEQ ID NO: 480245 - DNA, 25 bp, Rattus norvegicus
tgttttgtttaaatctgcctgcaga

SEQ ID NO: 480246 - DNA, 25 bp, Rattus norvegicus
gcgagtcaaactttccggagccctc

SEQ ID NO: 480247 - DNA, 25 bp, Rattus norvegicus
gaatacagtgcccagcgtcccaagg

SEQ ID NO: 480248 - DNA, 25 bp, Rattus norvegicus
agcgtcccaagggtcaccgctcgag

SEQ ID NO: 480249 - DNA, 25 bp, Rattus norvegicus
acacagagtcaggacgccggccgtc

SEQ ID NO: 480250 - DNA, 25 bp, Rattus norvegicus
gtcggtcgcgacagcgtcgccagca

SEQ ID NO: 480251 - DNA, 25 bp, Rattus norvegicus
cgccgcgtttacttctcagccgaaa

SEQ ID NO: 480252 - DNA, 25 bp, Rattus norvegicus
accaagtctttcaagcttcgtcttc

SEQ ID NO: 480253 - DNA, 25 bp, Rattus norvegicus
ggctgagccttcgtccaccgttttc

SEQ ID NO: 480254 - DNA, 25 bp, Rattus norvegicus
gttttcaacccgactccaactgaga

SEQ ID NO: 480255 - DNA, 25 bp, Rattus norvegicus
tgtcccgcccagctgtcagtgtttt

SEQ ID NO: 480256 - DNA, 25 bp, Rattus norvegicus
gcccgctagagcgaggctacagaac

SEQ ID NO: 480257 - DNA, 25 bp, Rattus norvegicus
agcgaggctacagaacccggcttcg

SEQ ID NO: 480258 - DNA, 25 bp, Rattus norvegicus
ggtccgcgactctgctcagcctgag

SEQ ID NO: 480259 - DNA, 25 bp, Rattus norvegicus
aggcaatgtctcattggtcaactga

SEQ ID NO: 480260 - DNA, 25 bp, Rattus norvegicus
tagactgtactgaggcagcacggga

SEQ ID NO: 480261 - DNA, 25 bp, Rattus norvegicus
gcacgggagaggcaatgtctcattg

SEQ ID NO: 480262 - DNA, 25 bp, Rattus norvegicus
ggtgcgcactccgatatctcggacg

SEQ ID NO: 480263 - DNA, 25 bp, Rattus norvegicus
gatgtggtgcgcactccgatatctc

SEQ ID NO: 480264 - DNA, 25 bp, Rattus norvegicus
cgactctgctcagcctgagccgggg

SEQ ID NO: 480265 - DNA, 25 bp, Rattus norvegicus
cgcacaccaggactcgcccgagccc

SEQ ID NO: 480266 - DNA, 25 bp, Rattus norvegicus
cttgcgtacgctggtccgcgactct

SEQ ID NO: 480267 - DNA, 25 bp, Rattus norvegicus
cggagccttgcttgcgtacgctggt

SEQ ID NO: 480268 - DNA, 25 bp, Rattus norvegicus
gtcaactgagatgaagtcatcttgg

SEQ ID NO: 480269 - DNA, 25 bp, Rattus norvegicus
ctcattggtcaactgagatgaagtc

SEQ ID NO: 480270 - DNA, 25 bp, Rattus norvegicus
agatggcgaccgcacaccaggactc

SEQ ID NO: 480271 - DNA, 25 bp, Rattus norvegicus
gcgagggttgtaaaaagagcgcttc

SEQ ID NO: 480272 - DNA, 25 bp, Rattus norvegicus
tgccgcctctcaagtggcctaaggg

SEQ ID NO: 480273 - DNA, 25 bp, Rattus norvegicus
cgcatgggctcctccgcgaagttga

SEQ ID NO: 480274 - DNA, 25 bp, Rattus norvegicus
tccgcgaagttgacacccttactgg

SEQ ID NO: 480275 - DNA, 25 bp, Rattus norvegicus
aggtcctgccctcatggccgaagcg

SEQ ID NO: 480276 - DNA, 25 bp, Rattus norvegicus
tgctgcagccgcgtgaagtgctgca

SEQ ID NO: 480277 - DNA, 25 bp, Rattus norvegicus
tgaagtgctgcagcgcgaactccag

SEQ ID NO: 480278 - DNA, 25 bp, Rattus norvegicus
cctcttcgccgttctcggaatcgga

SEQ ID NO: 480279 - DNA, 25 bp, Rattus norvegicus
cagcgcgaactccagcaggtcggcg

SEQ ID NO: 480280 - DNA, 25 bp, Rattus norvegicus
tcggcgggctggtgcctcagcacct

SEQ ID NO: 480281 - DNA, 25 bp, Rattus norvegicus
ccgcggggatctcgatgctcatcct

SEQ ID NO: 480282 - DNA, 25 bp, Rattus norvegicus
tcgatgctcatcctgcctgtgcacg

SEQ ID NO: 480283 - DNA, 25 bp, Rattus norvegicus
ctcctatccgcggtcgggtcttggg

SEQ ID NO: 480284 - DNA, 25 bp, Rattus norvegicus
ggagggttggcagcatctccagctc

SEQ ID NO: 480285 - DNA, 25 bp, Rattus norvegicus
ctcggaatcggagcgcatgggctcc

SEQ ID NO: 480286 - DNA, 25 bp, Rattus norvegicus
cgggcccatttaaagaaaggctgag

SEQ ID NO: 480287 - DNA, 25 bp, Rattus norvegicus
ctgagggcgaaaggaggcaagagaa

SEQ ID NO: 480288 - DNA, 25 bp, Rattus norvegicus
gcccatttaaagaaaggctgagggc

SEQ ID NO: 480289 - DNA, 25 bp, Rattus norvegicus
cccatttaaagaaaggctgagggcg

SEQ ID NO: 480290 - DNA, 25 bp, Rattus norvegicus
ccatttaaagaaaggctgagggcga

SEQ ID NO: 480291 - DNA, 25 bp, Rattus norvegicus
catttaaagaaaggctgagggcgaa

SEQ ID NO: 480292 - DNA, 25 bp, Rattus norvegicus
gcgggcgccgtccaatgacaaagcc

SEQ ID NO: 480293 - DNA, 25 bp, Rattus norvegicus
tttagcccggccacaggacatccag

SEQ ID NO: 480294 - DNA, 25 bp, Rattus norvegicus
agcccggccacaggacatccagcgc

SEQ ID NO: 480295 - DNA, 25 bp, Rattus norvegicus
ccggccacaggacatccagcgcgtc

SEQ ID NO: 480296 - DNA, 25 bp, Rattus norvegicus
ggccacaggacatccagcgcgtcct

SEQ ID NO: 480297 - DNA, 25 bp, Rattus norvegicus
cggcaaggcgagaaaagtagcgagc

SEQ ID NO: 480298 - DNA, 25 bp, Rattus norvegicus
gcgggcccatttaaagaaaggctga

SEQ ID NO: 480299 - DNA, 25 bp, Rattus norvegicus
gccgccatctttagcccggccacag

SEQ ID NO: 480300 - DNA, 25 bp, Rattus norvegicus
ccagaccctcgccctccaccacact

SEQ ID NO: 480301 - DNA, 25 bp, Rattus norvegicus
tcaggcttggaagccctgcgcgccg

SEQ ID NO: 480302 - DNA, 25 bp, Rattus norvegicus
gcctcaggcttggaagccctgcgcg

SEQ ID NO: 480303 - DNA, 25 bp, Rattus norvegicus
tggcctcaggcttggaagccctgcg

SEQ ID NO: 480304 - DNA, 25 bp, Rattus norvegicus
cctggcctcaggcttggaagccctg

SEQ ID NO: 480305 - DNA, 25 bp, Rattus norvegicus
ggtcccgttatccagcctggcctca

SEQ ID NO: 480306 - DNA, 25 bp, Rattus norvegicus
cctcccggtcccgttatccagcctg

SEQ ID NO: 480307 - DNA, 25 bp, Rattus norvegicus
ccttgcgatccctgcacccgggccc

SEQ ID NO: 480308 - DNA, 25 bp, Rattus norvegicus
agcgtgcacccttgcgatccctgca

SEQ ID NO: 480309 - DNA, 25 bp, Rattus norvegicus
gaggcagcgtgcacccttgcgatcc

SEQ ID NO: 480310 - DNA, 25 bp, Rattus norvegicus
cccgagtccccccaggaggcagcgt

SEQ ID NO: 480311 - DNA, 25 bp, Rattus norvegicus
agagcagcctcacccgcagaaggcg

SEQ ID NO: 480312 - DNA, 25 bp, Rattus norvegicus
agtccccactcttcgcgctctcgca

SEQ ID NO: 480313 - DNA, 25 bp, Rattus norvegicus
agcctcacccgcagaaggcgggaac

SEQ ID NO: 480314 - DNA, 25 bp, Rattus norvegicus
tccgcgcgctggaacggactaatgt

SEQ ID NO: 480315 - DNA, 25 bp, Rattus norvegicus
cgaactaggcccctggatgcggtgc

SEQ ID NO: 480316 - DNA, 25 bp, Rattus norvegicus
cgcgccaagtgctgcgagtggacct

SEQ ID NO: 480317 - DNA, 25 bp, Rattus norvegicus
aagtgctgcgagtggacctggaccc

SEQ ID NO: 480318 - DNA, 25 bp, Rattus norvegicus
acccggtggtgaggctccgccgctt

SEQ ID NO: 480319 - DNA, 25 bp, Rattus norvegicus
ccgaggtagcttccgcgcgctggaa

SEQ ID NO: 480320 - DNA, 25 bp, Rattus norvegicus
gccgcaccctggaggagatctggag

SEQ ID NO: 480321 - DNA, 25 bp, Rattus norvegicus
cgcgctggaacggactaatgtcagt

SEQ ID NO: 480322 - DNA, 25 bp, Rattus norvegicus
gacgctgaccagcttcccgaccatc

SEQ ID NO: 480323 - DNA, 25 bp, Rattus norvegicus
cggactaatgtcagtcgaaagttta

SEQ ID NO: 480324 - DNA, 25 bp, Rattus norvegicus
tcagtcgaaagtttacagaaccggc

SEQ ID NO: 480325 - DNA, 25 bp, Rattus norvegicus
ggtgcactttatgcgcgaactaggc

SEQ ID NO: 480326 - DNA, 25 bp, Rattus norvegicus
gaccatccgcgtcggcgacgacgtg

SEQ ID NO: 480327 - DNA, 25 bp, Rattus norvegicus
tgtgatgtgcgttgcggcgcctcct

SEQ ID NO: 480328 - DNA, 25 bp, Rattus norvegicus
aatgctgcggcagaagccgagttca

SEQ ID NO: 480329 - DNA, 25 bp, Rattus norvegicus
aggcagagcgcgtgcctcacgtcct

SEQ ID NO: 480330 - DNA, 25 bp, Rattus norvegicus
tgcgagcgagcggtgacttaagcaa

SEQ ID NO: 480331 - DNA, 25 bp, Rattus norvegicus
ggtgacttaagcaacggagcgcagc

SEQ ID NO: 480332 - DNA, 25 bp, Rattus norvegicus
ggagcgcagcgaagcccatttttct

SEQ ID NO: 480333 - DNA, 25 bp, Rattus norvegicus
atttttctccttgctcgcagccgcg

SEQ ID NO: 480334 - DNA, 25 bp, Rattus norvegicus
gcgaggctgggaacgcccaagccac

SEQ ID NO: 480335 - DNA, 25 bp, Rattus norvegicus
gatcacgggacgatcgggttcgtta

SEQ ID NO: 480336 - DNA, 25 bp, Rattus norvegicus
aactggatgagatcacgggacgatc

SEQ ID NO: 480337 - DNA, 25 bp, Rattus norvegicus
ctcccggacaggatgaactggatga

SEQ ID NO: 480338 - DNA, 25 bp, Rattus norvegicus
atgggtgcacgctgcagctacggtc

SEQ ID NO: 480339 - DNA, 25 bp, Rattus norvegicus
tgctggccaccgactcgtacaaggt

SEQ ID NO: 480340 - DNA, 25 bp, Rattus norvegicus
aagccgagttcaacatcctgctggc

SEQ ID NO: 480341 - DNA, 25 bp, Rattus norvegicus
tctggcccgagatgaatgctgcggc

SEQ ID NO: 480342 - DNA, 25 bp, Rattus norvegicus
gggcgccacacgcatggcttccaaa

SEQ ID NO: 480343 - DNA, 25 bp, Rattus norvegicus
agcctacttgattcgccagcggttc

SEQ ID NO: 480344 - DNA, 25 bp, Rattus norvegicus
gctctctcggccgaagtgctcgggt

SEQ ID NO: 480345 - DNA, 25 bp, Rattus norvegicus
tttccctcagaggatgtccaccttc

SEQ ID NO: 480346 - DNA, 25 bp, Rattus norvegicus
gatcaacctcaacccgctcaaggag

SEQ ID NO: 480347 - DNA, 25 bp, Rattus norvegicus
gagccgctcggcttcatcaagatcc

SEQ ID NO: 480348 - DNA, 25 bp, Rattus norvegicus
ttcatcaagatcctcgagtgggtga

SEQ ID NO: 480349 - DNA, 25 bp, Rattus norvegicus
agtgcagcctacgacgcggtcctcg

SEQ ID NO: 480350 - DNA, 25 bp, Rattus norvegicus
tcaggcttcactgcggtccgccaag

SEQ ID NO: 480351 - DNA, 25 bp, Rattus norvegicus
gtccgccaaggaagacaggacttcc

SEQ ID NO: 480352 - DNA, 25 bp, Rattus norvegicus
ggacttcctgctgcggtccaacaga

SEQ ID NO: 480353 - DNA, 25 bp, Rattus norvegicus
tccaacagattacggaccgcccgga

SEQ ID NO: 480354 - DNA, 25 bp, Rattus norvegicus
ctagacctgggttgcgtccttcgct

SEQ ID NO: 480355 - DNA, 25 bp, Rattus norvegicus
cgcgtgcgctgtagagaaagagata

SEQ ID NO: 480356 - DNA, 25 bp, Rattus norvegicus
gggatttgcagcgagcaaaactttc

SEQ ID NO: 480357 - DNA, 25 bp, Rattus norvegicus
aactttcggtcctccagcggcgact

SEQ ID NO: 480358 - DNA, 25 bp, Rattus norvegicus
cgactgggcgaaagaacctttgctt

SEQ ID NO: 480359 - DNA, 25 bp, Rattus norvegicus
acctttgcttctttccggagttgca

SEQ ID NO: 480360 - DNA, 25 bp, Rattus norvegicus
agttgcaccagtctccgggttgctg

SEQ ID NO: 480361 - DNA, 25 bp, Rattus norvegicus
agcatccttgcgaggtgaccctgcc

SEQ ID NO: 480362 - DNA, 25 bp, Rattus norvegicus
agcggcctcacgcagcacagcaggg

SEQ ID NO: 480363 - DNA, 25 bp, Rattus norvegicus
tcggaacgttccgaagatgacgtcg

SEQ ID NO: 480364 - DNA, 25 bp, Rattus norvegicus
gatgacgtcggagcgttctcgaatc

SEQ ID NO: 480365 - DNA, 25 bp, Rattus norvegicus
cgaatcccgtgtctctcggctgctg

SEQ ID NO: 480366 - DNA, 25 bp, Rattus norvegicus
ctgctgccgaaggaacagggaaaaa

SEQ ID NO: 480367 - DNA, 25 bp, Rattus norvegicus
tccgggatccttccaggacgtcgcg

SEQ ID NO: 480368 - DNA, 25 bp, Rattus norvegicus
caaagtgcccagtccggaggcgttt

SEQ ID NO: 480369 - DNA, 25 bp, Rattus norvegicus
aatggcgacactgcaccgcaaagtg

SEQ ID NO: 480370 - DNA, 25 bp, Rattus norvegicus
gttgcaccagcttcgtgaaccttag

SEQ ID NO: 480371 - DNA, 25 bp, Rattus norvegicus
ccaaagcatcctgacaagccgcatg

SEQ ID NO: 480372 - DNA, 25 bp, Rattus norvegicus
cgggctccgtaacaccatggaggta

SEQ ID NO: 480373 - DNA, 25 bp, Rattus norvegicus
gcagctcagatgatgcctgtcgccc

SEQ ID NO: 480374 - DNA, 25 bp, Rattus norvegicus
cggtcggtcgctttttgatgatgta

SEQ ID NO: 480375 - DNA, 25 bp, Rattus norvegicus
atgtttgcgtcattcgtgcgagccc

SEQ ID NO: 480376 - DNA, 25 bp, Rattus norvegicus
gggattctgccttgcctggaactac

SEQ ID NO: 480377 - DNA, 25 bp, Rattus norvegicus
aactaccgagctatgccgcggcgtg

SEQ ID NO: 480378 - DNA, 25 bp, Rattus norvegicus
tgtgcgctggtaagcagccgctatt

SEQ ID NO: 480379 - DNA, 25 bp, Rattus norvegicus
agccgctattcctgcttggtggccg

SEQ ID NO: 480380 - DNA, 25 bp, Rattus norvegicus
actcctgcgctactccgagaggtaa

SEQ ID NO: 480381 - DNA, 25 bp, Rattus norvegicus
gaggtaagggctctctgtctccttc

SEQ ID NO: 480382 - DNA, 25 bp, Rattus norvegicus
tgtctccttctgtgagccggcagct

SEQ ID NO: 480383 - DNA, 25 bp, Rattus norvegicus
ttgatgatgtaagccaagcgtcgga

SEQ ID NO: 480384 - DNA, 25 bp, Rattus norvegicus
gtcatggccgcctctaagcccgtag

SEQ ID NO: 480385 - DNA, 25 bp, Rattus norvegicus
gacagtcgtcatggccgcctctaag

SEQ ID NO: 480386 - DNA, 25 bp, Rattus norvegicus
cggaggacagtcgtcatggccgcct

SEQ ID NO: 480387 - DNA, 25 bp, Rattus norvegicus
tcccggcttcctctccacgctgccc

SEQ ID NO: 480388 - DNA, 25 bp, Rattus norvegicus
atggccgcctctaagcccgtagagg

SEQ ID NO: 480389 - DNA, 25 bp, Rattus norvegicus
cccgcttctggaaatggagtgggca

SEQ ID NO: 480390 - DNA, 25 bp, Rattus norvegicus
ggccatgtacctgtggagccgaaga

SEQ ID NO: 480391 - DNA, 25 bp, Rattus norvegicus
atgtacctgtggagccgaagacgga

SEQ ID NO: 480392 - DNA, 25 bp, Rattus norvegicus
gacgccagcggcctgaagcgcaaca

SEQ ID NO: 480393 - DNA, 25 bp, Rattus norvegicus
cggcctgaagcgcaacagcgaacga

SEQ ID NO: 480394 - DNA, 25 bp, Rattus norvegicus
aagcgcaacagcgaacgaaagaccc

SEQ ID NO: 480395 - DNA, 25 bp, Rattus norvegicus
ttgctttcctccacgctcccggctt

SEQ ID NO: 480396 - DNA, 25 bp, Rattus norvegicus
ggaccctgccgcgatggcacgtggc

SEQ ID NO: 480397 - DNA, 25 bp, Rattus norvegicus
gtgctcgctcgcgcgttgctttcct

SEQ ID NO: 480398 - DNA, 25 bp, Rattus norvegicus
ccaggtccgttttgaatggttctca

SEQ ID NO: 480399 - DNA, 25 bp, Rattus norvegicus
cagacacagcgggtcatggccaacg

SEQ ID NO: 480400 - DNA, 25 bp, Rattus norvegicus
tcgtacgaggagctgcagacacagc

SEQ ID NO: 480401 - DNA, 25 bp, Rattus norvegicus
caagcgcggcaagaaatctgcgggc

SEQ ID NO: 480402 - DNA, 25 bp, Rattus norvegicus
gctcgcaagagacgcagcagtcggc

SEQ ID NO: 480403 - DNA, 25 bp, Rattus norvegicus
acgacagcctgagcaacagcgagga

SEQ ID NO: 480404 - DNA, 25 bp, Rattus norvegicus
tgcaggacgtgtccagctcgccagt

SEQ ID NO: 480405 - DNA, 25 bp, Rattus norvegicus
ccgcccgcgagatgatgcaggacgt

SEQ ID NO: 480406 - DNA, 25 bp, Rattus norvegicus
agcaccgggtctgcgctaggccaga

SEQ ID NO: 480407 - DNA, 25 bp, Rattus norvegicus
gttctcaggatgaattgttagaccc

SEQ ID NO: 480408 - DNA, 25 bp, Rattus norvegicus
acccagtcgctgaacgaggcatttg

SEQ ID NO: 480409 - DNA, 25 bp, Rattus norvegicus
gatcggagcgccttctttttggacc

SEQ ID NO: 480410 - DNA, 25 bp, Rattus norvegicus
acgtcaggccaatgacactgctgcc

SEQ ID NO: 480411 - DNA, 25 bp, Rattus norvegicus
cgcccgcacggaggtataagaaccg

SEQ ID NO: 480412 - DNA, 25 bp, Rattus norvegicus
gagactggagcttgcatccaccctc

SEQ ID NO: 480413 - DNA, 25 bp, Rattus norvegicus
tcttctaggccagagataatccgcg

SEQ ID NO: 480414 - DNA, 25 bp, Rattus norvegicus
gttcccgtccgtctgtagctcggcg

SEQ ID NO: 480415 - DNA, 25 bp, Rattus norvegicus
ctcggcgggacagcaagagaccacg

SEQ ID NO: 480416 - DNA, 25 bp, Rattus norvegicus
cggagagaggagtgtacgcattatc

SEQ ID NO: 480417 - DNA, 25 bp, Rattus norvegicus
ggagtgtacgcattatcctcttacg

SEQ ID NO: 480418 - DNA, 25 bp, Rattus norvegicus
gcattatcctcttacgccgagactg

SEQ ID NO: 480419 - DNA, 25 bp, Rattus norvegicus
tacgccgagactggagcttgcatcc

SEQ ID NO: 480420 - DNA, 25 bp, Rattus norvegicus
gccagagataatccgcgcgcgcaga

SEQ ID NO: 480421 - DNA, 25 bp, Rattus norvegicus
cgatggcaccctcgtccttaggacc

SEQ ID NO: 480422 - DNA, 25 bp, Rattus norvegicus
gtcgcgctgacacaggaacgccatc

SEQ ID NO: 480423 - DNA, 25 bp, Rattus norvegicus
acaggaacgccatcgcagtcttcta

SEQ ID NO: 480424 - DNA, 25 bp, Rattus norvegicus
ccatcgcagtcttctaggccagaga

SEQ ID NO: 480425 - DNA, 25 bp, Rattus norvegicus
ctcccgtgcgtagctgtcgcgctga

SEQ ID NO: 480426 - DNA, 25 bp, Rattus norvegicus
cgcgcagactatagggaaccgagca

SEQ ID NO: 480427 - DNA, 25 bp, Rattus norvegicus
ctgaggcggaaggtgccaggtgaca

SEQ ID NO: 480428 - DNA, 25 bp, Rattus norvegicus
agactatagggaaccgagcacccga

SEQ ID NO: 480429 - DNA, 25 bp, Rattus norvegicus
acctggaagacggtctgaggcggaa

SEQ ID NO: 480430 - DNA, 25 bp, Rattus norvegicus
gggcaggatctagcgcatccctaca

SEQ ID NO: 480431 - DNA, 25 bp, Rattus norvegicus
tgccaggtgacaggcgggcgacccg

SEQ ID NO: 480432 - DNA, 25 bp, Rattus norvegicus
gcgacccggccagtgcggaggagga

SEQ ID NO: 480433 - DNA, 25 bp, Rattus norvegicus
cccggccgcgcagactatagggaac

SEQ ID NO: 480434 - DNA, 25 bp, Rattus norvegicus
ggccgcgcagactatagggaaccga

SEQ ID NO: 480435 - DNA, 25 bp, Rattus norvegicus
gcagactatagggaaccgagcaccc

SEQ ID NO: 480436 - DNA, 25 bp, Rattus norvegicus
tatagggaaccgagcacccgagagc

SEQ ID NO: 480437 - DNA, 25 bp, Rattus norvegicus
atagggaaccgagcacccgagagcg

SEQ ID NO: 480438 - DNA, 25 bp, Rattus norvegicus
ccgagcacccgagagcggtggggca

SEQ ID NO: 480439 - DNA, 25 bp, Rattus norvegicus
tggggcaggatctagcgcatcccta

SEQ ID NO: 480440 - DNA, 25 bp, Rattus norvegicus
tgtcccgagcactgtacggtctcca

SEQ ID NO: 480441 - DNA, 25 bp, Rattus norvegicus
gcagggttcccacaagtgccaccga

SEQ ID NO: 480442 - DNA, 25 bp, Rattus norvegicus
aagcggcgcccagtgtttacctgag

SEQ ID NO: 480443 - DNA, 25 bp, Rattus norvegicus
tgttaacagaggtaagcggcgccca

SEQ ID NO: 480444 - DNA, 25 bp, Rattus norvegicus
cccggggtgtaatgatgttaacaga

SEQ ID NO: 480445 - DNA, 25 bp, Rattus norvegicus
actgaagcagcagttgccgccgttg

SEQ ID NO: 480446 - DNA, 25 bp, Rattus norvegicus
acgcggacgtcgctcttccaagatg

SEQ ID NO: 480447 - DNA, 25 bp, Rattus norvegicus
tgtcgctcacccagcacaggactta

SEQ ID NO: 480448 - DNA, 25 bp, Rattus norvegicus
gatggaagtttctccgccagcacgc

SEQ ID NO: 480449 - DNA, 25 bp, Rattus norvegicus
acaggacttactgagcgctggcagc

SEQ ID NO: 480450 - DNA, 25 bp, Rattus norvegicus
cgctggcagcgacagagacaagttt

SEQ ID NO: 480451 - DNA, 25 bp, Rattus norvegicus
tgctgactcggcagagttccacctc

SEQ ID NO: 480452 - DNA, 25 bp, Rattus norvegicus
cggcgccatggagacagtcacaaga

SEQ ID NO: 480453 - DNA, 25 bp, Rattus norvegicus
tgcccggatcacgtctacaacctgt

SEQ ID NO: 480454 - DNA, 25 bp, Rattus norvegicus
ggctgaacctctccgggacacgcgt

SEQ ID NO: 480455 - DNA, 25 bp, Rattus norvegicus
tcgaggggaccgcacacacgcgctg

SEQ ID NO: 480456 - DNA, 25 bp, Rattus norvegicus
aggagaaacccgcaagccagccgcg

SEQ ID NO: 480457 - DNA, 25 bp, Rattus norvegicus
cagggacgaattttttaatgcattg

SEQ ID NO: 480458 - DNA, 25 bp, Rattus norvegicus
ctgctcccggatggctgcacgcgtg

SEQ ID NO: 480459 - DNA, 25 bp, Rattus norvegicus
actcacgttttctgcaccggcttgc

SEQ ID NO: 480460 - DNA, 25 bp, Rattus norvegicus
gcttgcgccgcttgcggctggcata

SEQ ID NO: 480461 - DNA, 25 bp, Rattus norvegicus
cataggtgatgttggcgccgctgct

SEQ ID NO: 480462 - DNA, 25 bp, Rattus norvegicus
aggagccgtagtgctcaagggcttc

SEQ ID NO: 480463 - DNA, 25 bp, Rattus norvegicus
caagggcttccctgctcaggcgata

SEQ ID NO: 480464 - DNA, 25 bp, Rattus norvegicus
gctcaggcgataagcccgcgctgct

SEQ ID NO: 480465 - DNA, 25 bp, Rattus norvegicus
tgctcaaagcccagcaaggctgcca

SEQ ID NO: 480466 - DNA, 25 bp, Rattus norvegicus
aggcgcccgaaagcagggacgaatt

SEQ ID NO: 480467 - DNA, 25 bp, Rattus norvegicus
caccgagcgtcgaggggaccgcaca

SEQ ID NO: 480468 - DNA, 25 bp, Rattus norvegicus
agtacgtgggctctggctacactaa

SEQ ID NO: 480469 - DNA, 25 bp, Rattus norvegicus
ccgcaacgtgtctggcgcgcagtac

SEQ ID NO: 480470 - DNA, 25 bp, Rattus norvegicus
cagtggacttcagcggccacgatct

SEQ ID NO: 480471 - DNA, 25 bp, Rattus norvegicus
gggctctggctacactaaggctgtg

SEQ ID NO: 480472 - DNA, 25 bp, Rattus norvegicus
tggctacactaaggctgtgtaccgg

SEQ ID NO: 480473 - DNA, 25 bp, Rattus norvegicus
gcggcccacaagctgctcaaggaga

SEQ ID NO: 480474 - DNA, 25 bp, Rattus norvegicus
gacttcagcggccacgatctgggca

SEQ ID NO: 480475 - DNA, 25 bp, Rattus norvegicus
cccacaagctgctcaaggagatggt

SEQ ID NO: 480476 - DNA, 25 bp, Rattus norvegicus
aagctgctcaaggagatggtgctgc

SEQ ID NO: 480477 - DNA, 25 bp, Rattus norvegicus
cccaacgtgctgcaggtacgacagt

SEQ ID NO: 480478 - DNA, 25 bp, Rattus norvegicus
caacgtgctgcaggtacgacagtgg

SEQ ID NO: 480479 - DNA, 25 bp, Rattus norvegicus
cttaaagcagtggacttcagcggcc

SEQ ID NO: 480480 - DNA, 25 bp, Rattus norvegicus
cggtggcgcttaaagcagtggactt

SEQ ID NO: 480481 - DNA, 25 bp, Rattus norvegicus
ccacgatctgggcagctgtgtgcgc

SEQ ID NO: 480482 - DNA, 25 bp, Rattus norvegicus
actgcgacaagcaggctcggggtcc

SEQ ID NO: 480483 - DNA, 25 bp, Rattus norvegicus
tggggcacaggcgaatactcaaacc

SEQ ID NO: 480484 - DNA, 25 bp, Rattus norvegicus
gcgagcgagcgccacaatgaaggac

SEQ ID NO: 480485 - DNA, 25 bp, Rattus norvegicus
caggcgaatactcaaacccggagga

SEQ ID NO: 480486 - DNA, 25 bp, Rattus norvegicus
ctcaaacccggaggaggccgacagc

SEQ ID NO: 480487 - DNA, 25 bp, Rattus norvegicus
ctactcacggtgtatagcaggttga

SEQ ID NO: 480488 - DNA, 25 bp, Rattus norvegicus
gtgtatagcaggttgagcgcgcaca

SEQ ID NO: 480489 - DNA, 25 bp, Rattus norvegicus
cgcgcacaggcagttcttggagcac

SEQ ID NO: 480490 - DNA, 25 bp, Rattus norvegicus
gcagttcttggagcacgagaagccc

SEQ ID NO: 480491 - DNA, 25 bp, Rattus norvegicus
gcacaccatcgtggcgcgtgggcta

SEQ ID NO: 480492 - DNA, 25 bp, Rattus norvegicus
cctgcgggtcgaggcgtcctccgaa

SEQ ID NO: 480493 - DNA, 25 bp, Rattus norvegicus
gatcccggccttctgggcctgtagc

SEQ ID NO: 480494 - DNA, 25 bp, Rattus norvegicus
tgcggccgcagcagatccgccgatc

SEQ ID NO: 480495 - DNA, 25 bp, Rattus norvegicus
ccacaatgaaggacgggcggagact

SEQ ID NO: 480496 - DNA, 25 bp, Rattus norvegicus
acgcagcgaggtctaggtcttgctc

SEQ ID NO: 480497 - DNA, 25 bp, Rattus norvegicus
tggcgggaacgatgggtcacataaa

SEQ ID NO: 480498 - DNA, 25 bp, Rattus norvegicus
cgacgcacacacgtctctggtgttt

SEQ ID NO: 480499 - DNA, 25 bp, Rattus norvegicus
tcgagtttccttgctccggtcgtca

SEQ ID NO: 480500 - DNA, 25 bp, Rattus norvegicus
gaccctggcgagtgccacttcactg

SEQ ID NO: 480501 - DNA, 25 bp, Rattus norvegicus
tcccgtctgggccaatgagactcgg

SEQ ID NO: 480502 - DNA, 25 bp, Rattus norvegicus
ttggagtctcttgctgcctcttgca

SEQ ID NO: 480503 - DNA, 25 bp, Rattus norvegicus
gacctcgtgggttgctccaattgga

SEQ ID NO: 480504 - DNA, 25 bp, Rattus norvegicus
ggaacctgtgtctctgtacttctta

SEQ ID NO: 480505 - DNA, 25 bp, Rattus norvegicus
cccacagaagtcactagcaggcaga

SEQ ID NO: 480506 - DNA, 25 bp, Rattus norvegicus
aatgcctccgtacgtgcccacagaa

SEQ ID NO: 480507 - DNA, 25 bp, Rattus norvegicus
ctctcaaggggcagtgcagcccatc

SEQ ID NO: 480508 - DNA, 25 bp, Rattus norvegicus
cttacctgtccaaggagggagcgac

SEQ ID NO: 480509 - DNA, 25 bp, Rattus norvegicus
gctcgagaggcactaatacgcggta

SEQ ID NO: 480510 - DNA, 25 bp, Rattus norvegicus
ggtacacccggcagcacaacgagtc

SEQ ID NO: 480511 - DNA, 25 bp, Rattus norvegicus
tgcaagtgcaagaggtacacccggc

SEQ ID NO: 480512 - DNA, 25 bp, Rattus norvegicus
accgtggtcacagcgtgcaagtgca

SEQ ID NO: 480513 - DNA, 25 bp, Rattus norvegicus
cgcacctacaaaatcaccgtggtca

SEQ ID NO: 480514 - DNA, 25 bp, Rattus norvegicus
ggacggcagcacacgcacctacaaa

SEQ ID NO: 480515 - DNA, 25 bp, Rattus norvegicus
gcacaacgagtccagccacaacttt

SEQ ID NO: 480516 - DNA, 25 bp, Rattus norvegicus
ctgcagtgtcaggacggcagcacac

SEQ ID NO: 480517 - DNA, 25 bp, Rattus norvegicus
cccagagaatccagctgcagtgtca

SEQ ID NO: 480518 - DNA, 25 bp, Rattus norvegicus
cgacaagacgcgcacccagagaatc

SEQ ID NO: 480519 - DNA, 25 bp, Rattus norvegicus
tggcggtgtgtcaacgacaagacgc

SEQ ID NO: 480520 - DNA, 25 bp, Rattus norvegicus
gtccagccacaactttgaaagcgtg

SEQ ID NO: 480521 - DNA, 25 bp, Rattus norvegicus
gaggaggctacggaacaaagtactg

SEQ ID NO: 480522 - DNA, 25 bp, Rattus norvegicus
ttgaaagcgtgtctcccgccaagcc

SEQ ID NO: 480523 - DNA, 25 bp, Rattus norvegicus
caaagtactggagccggaggagctc

SEQ ID NO: 480524 - DNA, 25 bp, Rattus norvegicus
cccgaagcagttctgccgggtcctg

SEQ ID NO: 480525 - DNA, 25 bp, Rattus norvegicus
tgccacagcgcatgcgtgcgcagga

SEQ ID NO: 480526 - DNA, 25 bp, Rattus norvegicus
agtgctttgggcacgctgccacagc

SEQ ID NO: 480527 - DNA, 25 bp, Rattus norvegicus
gaaccgctgctctaggagtgctttg

SEQ ID NO: 480528 - DNA, 25 bp, Rattus norvegicus
cctggctaaccagtgcttggggacc

SEQ ID NO: 480529 - DNA, 25 bp, Rattus norvegicus
taggaccaacctaacagacagcgtg

SEQ ID NO: 480530 - DNA, 25 bp, Rattus norvegicus
ggagaggccgctcatcagctacaca

SEQ ID NO: 480531 - DNA, 25 bp, Rattus norvegicus
gccgcattggaactgtagccgctgt

SEQ ID NO: 480532 - DNA, 25 bp, Rattus norvegicus
cccgctgagcctcggcattgcgtga

SEQ ID NO: 480533 - DNA, 25 bp, Rattus norvegicus
ccatctgcaccttggggttctgcgc

SEQ ID NO: 480534 - DNA, 25 bp, Rattus norvegicus
gcgtttcgctcttagttcccatctg

SEQ ID NO: 480535 - DNA, 25 bp, Rattus norvegicus
agtccgatcggtgatctccgcccag

SEQ ID NO: 480536 - DNA, 25 bp, Rattus norvegicus
gttcctcgctcagtccgatcggtga

SEQ ID NO: 480537 - DNA, 25 bp, Rattus norvegicus
tcagctacacactgcaggctatgga

SEQ ID NO: 480538 - DNA, 25 bp, Rattus norvegicus
ggaggatcatcctccccggcccgag

SEQ ID NO: 480539 - DNA, 25 bp, Rattus norvegicus
cgcgcaggaggaggatcatcctccc

SEQ ID NO: 480540 - DNA, 25 bp, Rattus norvegicus
acgcgcaggaggaggatcatcctcc

SEQ ID NO: 480541 - DNA, 25 bp, Rattus norvegicus
tacgcgcaggaggaggatcatcctc

SEQ ID NO: 480542 - DNA, 25 bp, Rattus norvegicus
actacgcgcaggaggaggatcatcc

SEQ ID NO: 480543 - DNA, 25 bp, Rattus norvegicus
tcgactacgcgcaggaggaggatca

SEQ ID NO: 480544 - DNA, 25 bp, Rattus norvegicus
ctacgcgcaggaggaggatcatcct

SEQ ID NO: 480545 - DNA, 25 bp, Rattus norvegicus
ttcgactacgcgcaggaggaggatc

SEQ ID NO: 480546 - DNA, 25 bp, Rattus norvegicus
ctcggttcgactacgcgcaggagga

SEQ ID NO: 480547 - DNA, 25 bp, Rattus norvegicus
cctcggttcgactacgcgcaggagg

SEQ ID NO: 480548 - DNA, 25 bp, Rattus norvegicus
ccctcggttcgactacgcgcaggag

SEQ ID NO: 480549 - DNA, 25 bp, Rattus norvegicus
cgctttagcgtcgtcgcctacgggg

SEQ ID NO: 480550 - DNA, 25 bp, Rattus norvegicus
tcgctttagcgtcgtcgcctacggg

SEQ ID NO: 480551 - DNA, 25 bp, Rattus norvegicus
cgactacgcgcaggaggaggatcat

SEQ ID NO: 480552 - DNA, 25 bp, Rattus norvegicus
gtgggtcccttacgtcacgtcacaa

SEQ ID NO: 480553 - DNA, 25 bp, Rattus norvegicus
cgatcccattggtcgccgtgtcaga

SEQ ID NO: 480554 - DNA, 25 bp, Rattus norvegicus
tcgccgtgtcagagcggccatgcca

SEQ ID NO: 480555 - DNA, 25 bp, Rattus norvegicus
ccctaattggcgagggtgcctgcca

SEQ ID NO: 480556 - DNA, 25 bp, Rattus norvegicus
cggcaccacctgttgccctaagtgg

SEQ ID NO: 480557 - DNA, 25 bp, Rattus norvegicus
tgcagcacgggccacagtgataagg

SEQ ID NO: 480558 - DNA, 25 bp, Rattus norvegicus
taaggccctacacggtgggagttgc

SEQ ID NO: 480559 - DNA, 25 bp, Rattus norvegicus
tcagctcgcagtccgccgaggttcg

SEQ ID NO: 480560 - DNA, 25 bp, Rattus norvegicus
tggctgacggtcctccgtcgatccg

SEQ ID NO: 480561 - DNA, 25 bp, Rattus norvegicus
gggctaacggtgctctcgccagcct

SEQ ID NO: 480562 - DNA, 25 bp, Rattus norvegicus
acgtcacgtcacaaggcagcctggg

SEQ ID NO: 480563 - DNA, 25 bp, Rattus norvegicus
gtctcctagcaacgtccaaacaagg

SEQ ID NO: 480564 - DNA, 25 bp, Rattus norvegicus
aacattggctggtgtctctccgcgc

SEQ ID NO: 480565 - DNA, 25 bp, Rattus norvegicus
cagggaagccctgactccgtctctg

SEQ ID NO: 480566 - DNA, 25 bp, Rattus norvegicus
ggctgtcctcacgtcctaggttatg

SEQ ID NO: 480567 - DNA, 25 bp, Rattus norvegicus
actcaatccaggcttcgctgccaga

SEQ ID NO: 480568 - DNA, 25 bp, Rattus norvegicus
acagtgaagaaagcgatgtgctgcc

SEQ ID NO: 480569 - DNA, 25 bp, Rattus norvegicus
gaagactttgccttccgcggctgtc

SEQ ID NO: 480570 - DNA, 25 bp, Rattus norvegicus
tctcctgcgcgagctcgaagacttt

SEQ ID NO: 480571 - DNA, 25 bp, Rattus norvegicus
cggagcagcaacgtctcctgcgcga

SEQ ID NO: 480572 - DNA, 25 bp, Rattus norvegicus
ttcagttccgcctgcgccaggtagt

SEQ ID NO: 480573 - DNA, 25 bp, Rattus norvegicus
ttcgcgcaagttcagttccgcctgc

SEQ ID NO: 480574 - DNA, 25 bp, Rattus norvegicus
gctgtcctcgcacttcgcgcaagtt

SEQ ID NO: 480575 - DNA, 25 bp, Rattus norvegicus
tgtccgcacgctgaggcggttgcaa

SEQ ID NO: 480576 - DNA, 25 bp, Rattus norvegicus
gtcgctgccaccatgcgagactgtg

SEQ ID NO: 480577 - DNA, 25 bp, Rattus norvegicus
gctgggaacagtagtgactgctgtc

SEQ ID NO: 480578 - DNA, 25 bp, Rattus norvegicus
ttcgctgccagagcccgttgccatg

SEQ ID NO: 480579 - DNA, 25 bp, Rattus norvegicus
ggctggaagacccttgtgacagtga

SEQ ID NO: 480580 - DNA, 25 bp, Rattus norvegicus
atccgcgccctgagcccaaggaaga

SEQ ID NO: 480581 - DNA, 25 bp, Rattus norvegicus
gcccaaggaagagccggttgacagc

SEQ ID NO: 480582 - DNA, 25 bp, Rattus norvegicus
gccggttgacagcaaacctgctctc

SEQ ID NO: 480583 - DNA, 25 bp, Rattus norvegicus
acctgctctcccagcttttatgctg

SEQ ID NO: 480584 - DNA, 25 bp, Rattus norvegicus
cttttatgctgctcgcccgaagcga

SEQ ID NO: 480585 - DNA, 25 bp, Rattus norvegicus
gctggcagagccgaatacttgatcc

SEQ ID NO: 480586 - DNA, 25 bp, Rattus norvegicus
aactcggggtgctgcagctcctgag

SEQ ID NO: 480587 - DNA, 25 bp, Rattus norvegicus
gccatggtgccttgttgctggcaga

SEQ ID NO: 480588 - DNA, 25 bp, Rattus norvegicus
agctcctgagccatggtgccttgtt

SEQ ID NO: 480589 - DNA, 25 bp, Rattus norvegicus
gcctgttttcctgcgcgcgcgaact

SEQ ID NO: 480590 - DNA, 25 bp, Rattus norvegicus
ggcaccggtaccagttccagcttct

SEQ ID NO: 480591 - DNA, 25 bp, Rattus norvegicus
agtcaccataggcaccctggggcac

SEQ ID NO: 480592 - DNA, 25 bp, Rattus norvegicus
cgaatacttgatccgcgccctgagc

SEQ ID NO: 480593 - DNA, 25 bp, Rattus norvegicus
gtctccgacgtaaaagtcaccatag

SEQ ID NO: 480594 - DNA, 25 bp, Rattus norvegicus
ccggcgtgttcgcttagttcagtga

SEQ ID NO: 480595 - DNA, 25 bp, Rattus norvegicus
cgccaggctgcaaatgccaggtctt

SEQ ID NO: 480596 - DNA, 25 bp, Rattus norvegicus
tcgcgggcgaacttttaccacgctc

SEQ ID NO: 480597 - DNA, 25 bp, Rattus norvegicus
ccttcatgatcgatgtgcccgattc

SEQ ID NO: 480598 - DNA, 25 bp, Rattus norvegicus
agcgccctttatagccatgtggata

SEQ ID NO: 480599 - DNA, 25 bp, Rattus norvegicus
agccgtgcattgttgtgagccactg

SEQ ID NO: 480600 - DNA, 25 bp, Rattus norvegicus
tgccgtcacattttggaccaatcga

SEQ ID NO: 480601 - DNA, 25 bp, Rattus norvegicus
tcagaacaatgactgcgccgccggg

SEQ ID NO: 480602 - DNA, 25 bp, Rattus norvegicus
ctagggtttcgctcctcactgcgca

SEQ ID NO: 480603 - DNA, 25 bp, Rattus norvegicus
ggcctctggagcagccattacctga

SEQ ID NO: 480604 - DNA, 25 bp, Rattus norvegicus
catgccgacccactgagagagtttc

SEQ ID NO: 480605 - DNA, 25 bp, Rattus norvegicus
agagagtttctacacgcctgggctg

SEQ ID NO: 480606 - DNA, 25 bp, Rattus norvegicus
agggacagcgcactcaccttcatga

SEQ ID NO: 480607 - DNA, 25 bp, Rattus norvegicus
tccgtctcgtccgtgtagtgtcagt

SEQ ID NO: 480608 - DNA, 25 bp, Rattus norvegicus
cgcctagggatacccacagagcggc

SEQ ID NO: 480609 - DNA, 25 bp, Rattus norvegicus
gaggcggagtctccgctgtcaccaa

SEQ ID NO: 480610 - DNA, 25 bp, Rattus norvegicus
cacacgggtgggcttaggcagaccc

SEQ ID NO: 480611 - DNA, 25 bp, Rattus norvegicus
tgggcttaggcagaccctttgtgta

SEQ ID NO: 480612 - DNA, 25 bp, Rattus norvegicus
taccgggcagggtttcttatctctg

SEQ ID NO: 480613 - DNA, 25 bp, Rattus norvegicus
agggtttcttatctctggcttgtcc

SEQ ID NO: 480614 - DNA, 25 bp, Rattus norvegicus
tctggcttgtcctcagccaagtggg

SEQ ID NO: 480615 - DNA, 25 bp, Rattus norvegicus
tcctcagccaagtgggcgttgctgg

SEQ ID NO: 480616 - DNA, 25 bp, Rattus norvegicus
ctcggccgctatctgcgcgacggta

SEQ ID NO: 480617 - DNA, 25 bp, Rattus norvegicus
atctgcgcgacggtagcgagcatgc

SEQ ID NO: 480618 - DNA, 25 bp, Rattus norvegicus
aggccgcgcggctgtcctctcagtt

SEQ ID NO: 480619 - DNA, 25 bp, Rattus norvegicus
ccggatccgggcgagtagccgactt

SEQ ID NO: 480620 - DNA, 25 bp, Rattus norvegicus
gggcgagtagccgacttcttctccc

SEQ ID NO: 480621 - DNA, 25 bp, Rattus norvegicus
gcagaccctttgtgtaccgggcagg

SEQ ID NO: 480622 - DNA, 25 bp, Rattus norvegicus
agccgagcaaccttcgtcctgttcg

SEQ ID NO: 480623 - DNA, 25 bp, Rattus norvegicus
gatttcctcatccttccctggggcg

SEQ ID NO: 480624 - DNA, 25 bp, Rattus norvegicus
ctgagcaaccgtaggacaccaaggc

SEQ ID NO: 480625 - DNA, 25 bp, Rattus norvegicus
ccgcctctagagaagacctacacga

SEQ ID NO: 480626 - DNA, 25 bp, Rattus norvegicus
acgcgcacgtggaaaactgttgttg

SEQ ID NO: 480627 - DNA, 25 bp, Rattus norvegicus
ttgttgccgtttgatccctacgtca

SEQ ID NO: 480628 - DNA, 25 bp, Rattus norvegicus
cggaagtgagtcgacgatttcctca

SEQ ID NO: 480629 - DNA, 25 bp, Rattus norvegicus
cgcatcgctgcgcaggcgctgtaaa

SEQ ID NO: 480630 - DNA, 25 bp, Rattus norvegicus
cgctgtaaatggtgagcctggccct

SEQ ID NO: 480631 - DNA, 25 bp, Rattus norvegicus
ctcgcgggcggaaaacttcgctact

SEQ ID NO: 480632 - DNA, 25 bp, Rattus norvegicus
ttcgctactgcgtggccatcgctct

SEQ ID NO: 480633 - DNA, 25 bp, Rattus norvegicus
gctgtgacgcaaccatctcggggta

SEQ ID NO: 480634 - DNA, 25 bp, Rattus norvegicus
tgttgctggcacaaccgcctctaga

SEQ ID NO: 480635 - DNA, 25 bp, Rattus norvegicus
cttcgctgcccaaagcaactgagca

SEQ ID NO: 480636 - DNA, 25 bp, Rattus norvegicus
cttggttcgggccatcttctctcac

SEQ ID NO: 480637 - DNA, 25 bp, Rattus norvegicus
tccaacgaacgaccaaaccgctctg

SEQ ID NO: 480638 - DNA, 25 bp, Rattus norvegicus
gccgcaatcgcagagcagaacaaga

SEQ ID NO: 480639 - DNA, 25 bp, Rattus norvegicus
acaagcgccgcaatcgcagagcaga

SEQ ID NO: 480640 - DNA, 25 bp, Rattus norvegicus
agcgctcgaacaagcgccgcaatcg

SEQ ID NO: 480641 - DNA, 25 bp, Rattus norvegicus
tgtaagcgctcgaacaagcgccgca

SEQ ID NO: 480642 - DNA, 25 bp, Rattus norvegicus
gcgccgctgtaagcgctcgaacaag

SEQ ID NO: 480643 - DNA, 25 bp, Rattus norvegicus
acgcgccgctgtaagcgctcgaaca

SEQ ID NO: 480644 - DNA, 25 bp, Rattus norvegicus
cttgctgggaccgacgcgccgctgt

SEQ ID NO: 480645 - DNA, 25 bp, Rattus norvegicus
gtctgcttggttcgggccatcttct

SEQ ID NO: 480646 - DNA, 25 bp, Rattus norvegicus
gacttcctagcggtctgcttggttc

SEQ ID NO: 480647 - DNA, 25 bp, Rattus norvegicus
cttcctagcggtctgcttggttcgg

SEQ ID NO: 480648 - DNA, 25 bp, Rattus norvegicus
cccgccagtagagggcgcgcttttc

SEQ ID NO: 480649 - DNA, 25 bp, Rattus norvegicus
tttccgggccgccttggtggccagc

SEQ ID NO: 480650 - DNA, 25 bp, Rattus norvegicus
tctggcagttcaccggagtcgtttt

SEQ ID NO: 480651 - DNA, 25 bp, Rattus norvegicus
cgtcttgtattttggtggctgaata

SEQ ID NO: 480652 - DNA, 25 bp, Rattus norvegicus
aggcagtgtgcgtcttgtattttgg

SEQ ID NO: 480653 - DNA, 25 bp, Rattus norvegicus
ttacttcgtccttgactaggcagtg

SEQ ID NO: 480654 - DNA, 25 bp, Rattus norvegicus
ctgaatatttttacttgtcggcgac

SEQ ID NO: 480655 - DNA, 25 bp, Rattus norvegicus
aatggggtgttctctggcagttcac

SEQ ID NO: 480656 - DNA, 25 bp, Rattus norvegicus
tcgggtcctgaatggggtgttctct

SEQ ID NO: 480657 - DNA, 25 bp, Rattus norvegicus
tgccgtggcccgtcgggtcctgaat

SEQ ID NO: 480658 - DNA, 25 bp, Rattus norvegicus
tgtcccgcgggcatttcggaggccc

SEQ ID NO: 480659 - DNA, 25 bp, Rattus norvegicus
gactgttgcctacgtccaggtgagt

SEQ ID NO: 480660 - DNA, 25 bp, Rattus norvegicus
cggcgcccgtgactgttgcctacgt

SEQ ID NO: 480661 - DNA, 25 bp, Rattus norvegicus
cggacatcatcgcaggcggaaggca

SEQ ID NO: 480662 - DNA, 25 bp, Rattus norvegicus
ccgggcaggctgatgcggacatcat

SEQ ID NO: 480663 - DNA, 25 bp, Rattus norvegicus
tccttgactaggcagtgtgcgtctt

SEQ ID NO: 480664 - DNA, 25 bp, Rattus norvegicus
tcccgggtcaacttcagcctgggtg

SEQ ID NO: 480665 - DNA, 25 bp, Rattus norvegicus
gacacttgctttgttggcctccagg

SEQ ID NO: 480666 - DNA, 25 bp, Rattus norvegicus
ctcagctttctcagccctggcaagg

SEQ ID NO: 480667 - DNA, 25 bp, Rattus norvegicus
cgtgggctttgttcagatgtgctca

SEQ ID NO: 480668 - DNA, 25 bp, Rattus norvegicus
ccctgcctagaggtctgcctgtgaa

SEQ ID NO: 480669 - DNA, 25 bp, Rattus norvegicus
tgggcgcggcacaaaaacgtgagta

SEQ ID NO: 480670 - DNA, 25 bp, Rattus norvegicus
gcgccctgagaagacgctgcttcga

SEQ ID NO: 480671 - DNA, 25 bp, Rattus norvegicus
cacagtcagggcaccggctagaaaa

SEQ ID NO: 480672 - DNA, 25 bp, Rattus norvegicus
aggtcggcgacttcattttctcttg

SEQ ID NO: 480673 - DNA, 25 bp, Rattus norvegicus
aggcttccgcgttgtcactcagact

SEQ ID NO: 480674 - DNA, 25 bp, Rattus norvegicus
acactcagtcctggtgggttgacgc

SEQ ID NO: 480675 - DNA, 25 bp, Rattus norvegicus
cacagcctctgtggacaggagattc

SEQ ID NO: 480676 - DNA, 25 bp, Rattus norvegicus
acgacagctgcactctgcggtcttg

SEQ ID NO: 480677 - DNA, 25 bp, Rattus norvegicus
gcggttgcattggtgacactcagtc

SEQ ID NO: 480678 - DNA, 25 bp, Rattus norvegicus
cagccgcggtagctgcaactgtacc

SEQ ID NO: 480679 - DNA, 25 bp, Rattus norvegicus
gcccggggcaaagatcggtagccca

SEQ ID NO: 480680 - DNA, 25 bp, Rattus norvegicus
catgcccagtgctgctgcgagcgag

SEQ ID NO: 480681 - DNA, 25 bp, Rattus norvegicus
tgcgagctagcaaaaccaatctgcc

SEQ ID NO: 480682 - DNA, 25 bp, Rattus norvegicus
ctgccgagtgcgagctagcaaaacc

SEQ ID NO: 480683 - DNA, 25 bp, Rattus norvegicus
ggcaactccaactccgggcgccaga

SEQ ID NO: 480684 - DNA, 25 bp, Rattus norvegicus
tcttcgcgcgcacaaagcagctgtg

SEQ ID NO: 480685 - DNA, 25 bp, Rattus norvegicus
tcggggaaactcctggcaactccaa

SEQ ID NO: 480686 - DNA, 25 bp, Rattus norvegicus
actaaagctggctcgactcggctgc

SEQ ID NO: 480687 - DNA, 25 bp, Rattus norvegicus
agatcggggctgcagactaaagctg

SEQ ID NO: 480688 - DNA, 25 bp, Rattus norvegicus
ggcacgcgtcccaaccgaagacagt

SEQ ID NO: 480689 - DNA, 25 bp, Rattus norvegicus
taccgtgcagcctggctcgtgctcg

SEQ ID NO: 480690 - DNA, 25 bp, Rattus norvegicus
gcaaagatcggtagcccagggctcg

SEQ ID NO: 480691 - DNA, 25 bp, Rattus norvegicus
aggaacctaccgtgcagcctggctc

SEQ ID NO: 480692 - DNA, 25 bp, Rattus norvegicus
aagcccatggcctgtggcgcagacc

SEQ ID NO: 480693 - DNA, 25 bp, Rattus norvegicus
tagaccggaaaagcccatggcctgt

SEQ ID NO: 480694 - DNA, 25 bp, Rattus norvegicus
gcctgtggcgtagaccggaaaagcc

SEQ ID NO: 480695 - DNA, 25 bp, Rattus norvegicus
tggcgtagaccggaaaaagcccatg

SEQ ID NO: 480696 - DNA, 25 bp, Rattus norvegicus
aaagcccatggcctgtggcgcagac

SEQ ID NO: 480697 - DNA, 25 bp, Rattus norvegicus
tggcgcagaccggaaaagcccatgg

SEQ ID NO: 480698 - DNA, 25 bp, Rattus norvegicus
cgcagaccggaaaagcccatggcct

SEQ ID NO: 480699 - DNA, 25 bp, Rattus norvegicus
aagcccatggcctgtggcgtagacc

SEQ ID NO: 480700 - DNA, 25 bp, Rattus norvegicus
gcgtagaccggaaaaagcccatggc

SEQ ID NO: 480701 - DNA, 25 bp, Rattus norvegicus
aaagcccatggcctgtggcgtagac

SEQ ID NO: 480702 - DNA, 25 bp, Rattus norvegicus
ggcgtagaccggaaaagcccatggc

SEQ ID NO: 480703 - DNA, 25 bp, Rattus norvegicus
tggcgtagaccggaaaagcccatgg

SEQ ID NO: 480704 - DNA, 25 bp, Rattus norvegicus
ctgtggcgtagaccggaaaagccca

SEQ ID NO: 480705 - DNA, 25 bp, Rattus norvegicus
gcgtagaccggaaaagcccatggcc

SEQ ID NO: 480706 - DNA, 25 bp, Rattus norvegicus
taaatcagtggtcgctgacagctcg

SEQ ID NO: 480707 - DNA, 25 bp, Rattus norvegicus
tggacaggtcatcagggccgcccag

SEQ ID NO: 480708 - DNA, 25 bp, Rattus norvegicus
tcagtggtcgctgacagctcgtggt

SEQ ID NO: 480709 - DNA, 25 bp, Rattus norvegicus
gcagcgccgtgcgactccatttagt

SEQ ID NO: 480710 - DNA, 25 bp, Rattus norvegicus
gcgccgtgcgactccatttagtttg

SEQ ID NO: 480711 - DNA, 25 bp, Rattus norvegicus
gcgactccatttagtttgtccttca

SEQ ID NO: 480712 - DNA, 25 bp, Rattus norvegicus
catttagtttgtccttcaaagtccg

SEQ ID NO: 480713 - DNA, 25 bp, Rattus norvegicus
tcaaagtccggagaataattattcc

SEQ ID NO: 480714 - DNA, 25 bp, Rattus norvegicus
attattccataattctttcacctga

SEQ ID NO: 480715 - DNA, 25 bp, Rattus norvegicus
ctttcacctgattaattcttaacta

SEQ ID NO: 480716 - DNA, 25 bp, Rattus norvegicus
gagcataattacactctgcagaagg

SEQ ID NO: 480717 - DNA, 25 bp, Rattus norvegicus
ctctgcagaaggtaaatcggttgta

SEQ ID NO: 480718 - DNA, 25 bp, Rattus norvegicus
tccggcctgggtggacaggtcatca

SEQ ID NO: 480719 - DNA, 25 bp, Rattus norvegicus
atcggttgtataaatcagtggtcgc

SEQ ID NO: 480720 - DNA, 25 bp, Rattus norvegicus
gcgggtagcaagagcccaaccttca

SEQ ID NO: 480721 - DNA, 25 bp, Rattus norvegicus
tctgtggctgtcacatagcctggtc

SEQ ID NO: 480722 - DNA, 25 bp, Rattus norvegicus
tgcaccgctacctgcgtgacttctg

SEQ ID NO: 480723 - DNA, 25 bp, Rattus norvegicus
cgggcctggacacctacagtctgag

SEQ ID NO: 480724 - DNA, 25 bp, Rattus norvegicus
cggccgatttcttggtgtccgtgga

SEQ ID NO: 480725 - DNA, 25 bp, Rattus norvegicus
cgattctggggttcttactcctggc

SEQ ID NO: 480726 - DNA, 25 bp, Rattus norvegicus
cacgagcccggatcttggtattggt

SEQ ID NO: 480727 - DNA, 25 bp, Rattus norvegicus
gcagtcgattggatgttggcagccc

SEQ ID NO: 480728 - DNA, 25 bp, Rattus norvegicus
caaccttcaggccatgtggtctgca

SEQ ID NO: 480729 - DNA, 25 bp, Rattus norvegicus
cagcaggtctgggtccggaaaccaa

SEQ ID NO: 480730 - DNA, 25 bp, Rattus norvegicus
tgtttccttagggtcacgcaccctc

SEQ ID NO: 480731 - DNA, 25 bp, Rattus norvegicus
ccatctggccgaggatgtttcctta

SEQ ID NO: 480732 - DNA, 25 bp, Rattus norvegicus
tcctaaaggcttgggcatgcgcagc

SEQ ID NO: 480733 - DNA, 25 bp, Rattus norvegicus
tgtggtctgcagtccgcagtcgatt

SEQ ID NO: 480734 - DNA, 25 bp, Rattus norvegicus
ggcccaggcaacacggctcaggcaa

SEQ ID NO: 480735 - DNA, 25 bp, Rattus norvegicus
cggctcaggcaaacgtcagcggctt

SEQ ID NO: 480736 - DNA, 25 bp, Rattus norvegicus
ctcaggcaaacgtcagcggcttgcc

SEQ ID NO: 480737 - DNA, 25 bp, Rattus norvegicus
acgtcagcggcttgccgcggaaacc

SEQ ID NO: 480738 - DNA, 25 bp, Rattus norvegicus
ccgaggggtccacaaaacgcgctag

SEQ ID NO: 480739 - DNA, 25 bp, Rattus norvegicus
aggggtccacaaaacgcgctaggcg

SEQ ID NO: 480740 - DNA, 25 bp, Rattus norvegicus
cacaaaacgcgctaggcggggaggc

SEQ ID NO: 480741 - DNA, 25 bp, Rattus norvegicus
agtgacggccgcagcagccaatgac

SEQ ID NO: 480742 - DNA, 25 bp, Rattus norvegicus
cagccaatgacagccgagcgaggga

SEQ ID NO: 480743 - DNA, 25 bp, Rattus norvegicus
tggtccagctgggacttggtggtga

SEQ ID NO: 480744 - DNA, 25 bp, Rattus norvegicus
acttggtggtgacagtttgagcttg

SEQ ID NO: 480745 - DNA, 25 bp, Rattus norvegicus
tgacagtttgagcttgtccgggaag

SEQ ID NO: 480746 - DNA, 25 bp, Rattus norvegicus
tccgggaagggcgtctgagtgaccg

SEQ ID NO: 480747 - DNA, 25 bp, Rattus norvegicus
ggcaacacggctcaggcaaacgtca

SEQ ID NO: 480748 - DNA, 25 bp, Rattus norvegicus
gagcctgcggtccaactgcgctgct

SEQ ID NO: 480749 - DNA, 25 bp, Rattus norvegicus
acttggagccaaaggcgagccaggc

SEQ ID NO: 480750 - DNA, 25 bp, Rattus norvegicus
caaggctgacgcacttggagccaaa

SEQ ID NO: 480751 - DNA, 25 bp, Rattus norvegicus
tccctgaggccgtccagaacgacaa

SEQ ID NO: 480752 - DNA, 25 bp, Rattus norvegicus
tcgttcagcatcaacagcctggtcc

SEQ ID NO: 480753 - DNA, 25 bp, Rattus norvegicus
cccgacgcctgggtgatgctggaca

SEQ ID NO: 480754 - DNA, 25 bp, Rattus norvegicus
acgggttgcttctgcctctagcttc

SEQ ID NO: 480755 - DNA, 25 bp, Rattus norvegicus
ttgctacatgccttgccagcgccgg

SEQ ID NO: 480756 - DNA, 25 bp, Rattus norvegicus
tctaattcttgaggggtggttgcag

SEQ ID NO: 480757 - DNA, 25 bp, Rattus norvegicus
cctgtagctcggaaaattaattgtg

SEQ ID NO: 480758 - DNA, 25 bp, Rattus norvegicus
attaattgtggctatagcagactcg

SEQ ID NO: 480759 - DNA, 25 bp, Rattus norvegicus
agcagactcgatcgctgtctcctag

SEQ ID NO: 480760 - DNA, 25 bp, Rattus norvegicus
atgattcccaagtcctcgttcagca

SEQ ID NO: 480761 - DNA, 25 bp, Rattus norvegicus
gtggttgcagcttttgctacatgcc

SEQ ID NO: 480762 - DNA, 25 bp, Rattus norvegicus
gagcgcgccagactctggctggctc

SEQ ID NO: 480763 - DNA, 25 bp, Rattus norvegicus
gagggcgctctagcccaggacactg

SEQ ID NO: 480764 - DNA, 25 bp, Rattus norvegicus
agcagcaacgcgagggcgctctagc

SEQ ID NO: 480765 - DNA, 25 bp, Rattus norvegicus
agccgcgctgctggtgagcagcaac

SEQ ID NO: 480766 - DNA, 25 bp, Rattus norvegicus
ttcagacagtcctagcctgcgaacc

SEQ ID NO: 480767 - DNA, 25 bp, Rattus norvegicus
ggccggcgttcagacagtcctagcc

SEQ ID NO: 480768 - DNA, 25 bp, Rattus norvegicus
cgttcagtcgcacggcctgtccttg

SEQ ID NO: 480769 - DNA, 25 bp, Rattus norvegicus
caggatagctagctggggccgttca

SEQ ID NO: 480770 - DNA, 25 bp, Rattus norvegicus
ctaacagcagagcatggagcaaggc

SEQ ID NO: 480771 - DNA, 25 bp, Rattus norvegicus
tccggctagcggctaacagcagagc

SEQ ID NO: 480772 - DNA, 25 bp, Rattus norvegicus
ccagcatttaggtctccggctagcg

SEQ ID NO: 480773 - DNA, 25 bp, Rattus norvegicus
gctcggcccagcatttaggtctccg

SEQ ID NO: 480774 - DNA, 25 bp, Rattus norvegicus
ctccaagtagagtggcaggctcggc

SEQ ID NO: 480775 - DNA, 25 bp, Rattus norvegicus
tgtcgggatggcctgccctgcgcct

SEQ ID NO: 480776 - DNA, 25 bp, Rattus norvegicus
tctccttttacaccagtcacgtggc

SEQ ID NO: 480777 - DNA, 25 bp, Rattus norvegicus
ccaaccattcttcagcccgggatcc

SEQ ID NO: 480778 - DNA, 25 bp, Rattus norvegicus
tccagtgaaggcctgcggcggcacc

SEQ ID NO: 480779 - DNA, 25 bp, Rattus norvegicus
acccgcctggcgctgtctgcaaggt

SEQ ID NO: 480780 - DNA, 25 bp, Rattus norvegicus
agctcggacgcagctcgctaacccg

SEQ ID NO: 480781 - DNA, 25 bp, Rattus norvegicus
tacaccagtcacgtggctgaggatg

SEQ ID NO: 480782 - DNA, 25 bp, Rattus norvegicus
tcgttccgaggatcggagaactctc

SEQ ID NO: 480783 - DNA, 25 bp, Rattus norvegicus
ttcgcggtcgttggggcgtctccca

SEQ ID NO: 480784 - DNA, 25 bp, Rattus norvegicus
tctgcgctcccttcgcggtcgttgg

SEQ ID NO: 480785 - DNA, 25 bp, Rattus norvegicus
aaggaaggcgccaggctccacggcc

SEQ ID NO: 480786 - DNA, 25 bp, Rattus norvegicus
tctaccgctcttcgggaaggaaggc

SEQ ID NO: 480787 - DNA, 25 bp, Rattus norvegicus
tgcgctctaccgctcttcgggaagg

SEQ ID NO: 480788 - DNA, 25 bp, Rattus norvegicus
ccagtcacgtggctgaggatggttc

SEQ ID NO: 480789 - DNA, 25 bp, Rattus norvegicus
tcggagaactctcgcggctgaaccc

SEQ ID NO: 480790 - DNA, 25 bp, Rattus norvegicus
ggctcaggccgatctgcagatggaa

SEQ ID NO: 480791 - DNA, 25 bp, Rattus norvegicus
cagtgcctggggtaagagcatgcaa

SEQ ID NO: 480792 - DNA, 25 bp, Rattus norvegicus
ccacaaccaggctgtacggcgcggg

SEQ ID NO: 480793 - DNA, 25 bp, Rattus norvegicus
gggcaccttaccttctggtccacga

SEQ ID NO: 480794 - DNA, 25 bp, Rattus norvegicus
ttctggtccacgatggagcaagcca

SEQ ID NO: 480795 - DNA, 25 bp, Rattus norvegicus
acgatggagcaagccatctcccgga

SEQ ID NO: 480796 - DNA, 25 bp, Rattus norvegicus
atctcccggacatgcgccaggctgt

SEQ ID NO: 480797 - DNA, 25 bp, Rattus norvegicus
atgcgccaggctgtagtcgccagag

SEQ ID NO: 480798 - DNA, 25 bp, Rattus norvegicus
ctggggtaagagcatgcaacccggc

SEQ ID NO: 480799 - DNA, 25 bp, Rattus norvegicus
gagtcctgaaggagcagcaccggct

SEQ ID NO: 480800 - DNA, 25 bp, Rattus norvegicus
gatctgcagatggaacgagatgccc

SEQ ID NO: 480801 - DNA, 25 bp, Rattus norvegicus
actcggcggacactagcgccgcgga

SEQ ID NO: 480802 - DNA, 25 bp, Rattus norvegicus
tgcggcggccgaaaacaaccaccaa

SEQ ID NO: 480803 - DNA, 25 bp, Rattus norvegicus
ctgtagtcgccagaggagtcctgaa

SEQ ID NO: 480804 - DNA, 25 bp, Rattus norvegicus
aacaagcttgcagagcgctggcgcg

SEQ ID NO: 480805 - DNA, 25 bp, Rattus norvegicus
tggctagggcgctaatagggcgctg

SEQ ID NO: 480806 - DNA, 25 bp, Rattus norvegicus
gccgcgggaggaatcccagctattt

SEQ ID NO: 480807 - DNA, 25 bp, Rattus norvegicus
gaggaatcccagctatttcctctgc

SEQ ID NO: 480808 - DNA, 25 bp, Rattus norvegicus
cgacaccagctgactgccagctgcc

SEQ ID NO: 480809 - DNA, 25 bp, Rattus norvegicus
cgccgtgcagctccggatcccggcc

SEQ ID NO: 480810 - DNA, 25 bp, Rattus norvegicus
ctcttcccaggccacgaaaccagcc

SEQ ID NO: 480811 - DNA, 25 bp, Rattus norvegicus
gaaaccagcctttccagcagcctga

SEQ ID NO: 480812 - DNA, 25 bp, Rattus norvegicus
gcctttccagcagcctgagacctgt

SEQ ID NO: 480813 - DNA, 25 bp, Rattus norvegicus
ttccagcagcctgagacctgtaccg

SEQ ID NO: 480814 - DNA, 25 bp, Rattus norvegicus
agcctgagacctgtaccgctgtgcc

SEQ ID NO: 480815 - DNA, 25 bp, Rattus norvegicus
gacctgtaccgctgtgccagccaga

SEQ ID NO: 480816 - DNA, 25 bp, Rattus norvegicus
taccgctgtgccagccagaacctgt

SEQ ID NO: 480817 - DNA, 25 bp, Rattus norvegicus
aaaagtcgggcggacacagcgccca

SEQ ID NO: 480818 - DNA, 25 bp, Rattus norvegicus
gggacttatactccgcgcctggtga

SEQ ID NO: 480819 - DNA, 25 bp, Rattus norvegicus
gcattcgctcgcgttctcattagca

SEQ ID NO: 480820 - DNA, 25 bp, Rattus norvegicus
acctattttcagcaggcggcctgtt

SEQ ID NO: 480821 - DNA, 25 bp, Rattus norvegicus
gtgactggtgcactccgcacgtctc

SEQ ID NO: 480822 - DNA, 25 bp, Rattus norvegicus
cggcgcatctgtccttgcgcacagg

SEQ ID NO: 480823 - DNA, 25 bp, Rattus norvegicus
ttgcgcacaggcctaaattcacacc

SEQ ID NO: 480824 - DNA, 25 bp, Rattus norvegicus
ttcacaccagaagccacggcgcaga

SEQ ID NO: 480825 - DNA, 25 bp, Rattus norvegicus
agcagtcgtgtcttccgggtcgcaa

SEQ ID NO: 480826 - DNA, 25 bp, Rattus norvegicus
tcgcaagcggaagtggacaaatttg

SEQ ID NO: 480827 - DNA, 25 bp, Rattus norvegicus
tttgaattctgcgagccgttggatg

SEQ ID NO: 480828 - DNA, 25 bp, Rattus norvegicus
cggtcgacgtgagcggtaacgcatc

SEQ ID NO: 480829 - DNA, 25 bp, Rattus norvegicus
tctcattagcatgggtacacctatt

SEQ ID NO: 480830 - DNA, 25 bp, Rattus norvegicus
ggtaacgcatcgaccctgggactta

SEQ ID NO: 480831 - DNA, 25 bp, Rattus norvegicus
ttctccttgcgctggacggtgcgca

SEQ ID NO: 480832 - DNA, 25 bp, Rattus norvegicus
tgctctctgcctcggtgggtacacg

SEQ ID NO: 480833 - DNA, 25 bp, Rattus norvegicus
tacacagggtctgtgcgtcctggtc

SEQ ID NO: 480834 - DNA, 25 bp, Rattus norvegicus
ttgctcgatctgcagccgccgggct

SEQ ID NO: 480835 - DNA, 25 bp, Rattus norvegicus
tctctccgcaggtgcgtggctgctg

SEQ ID NO: 480836 - DNA, 25 bp, Rattus norvegicus
aaggaggacagggtcagtccacgca

SEQ ID NO: 480837 - DNA, 25 bp, Rattus norvegicus
acagggtcagtccacgcaggctgag

SEQ ID NO: 480838 - DNA, 25 bp, Rattus norvegicus
ttacctgtttttccacgccagtgtc

SEQ ID NO: 480839 - DNA, 25 bp, Rattus norvegicus
cgcttaccgcactcgggtgttgccg

SEQ ID NO: 480840 - DNA, 25 bp, Rattus norvegicus
catagggcgtctggagttgctcgat

SEQ ID NO: 480841 - DNA, 25 bp, Rattus norvegicus
cccgcctttatagcggctgcagagc

SEQ ID NO: 480842 - DNA, 25 bp, Rattus norvegicus
tgtccggtaccctgcatgccctgag

SEQ ID NO: 480843 - DNA, 25 bp, Rattus norvegicus
cgggacaccactggcgaccttcacg

SEQ ID NO: 480844 - DNA, 25 bp, Rattus norvegicus
agagccgcgcttaccgcactcgggt

SEQ ID NO: 480845 - DNA, 25 bp, Rattus norvegicus
gcgtcgcccgcctttatagcggctg

SEQ ID NO: 480846 - DNA, 25 bp, Rattus norvegicus
tcccggaatagtgtactgttgcggc

SEQ ID NO: 480847 - DNA, 25 bp, Rattus norvegicus
gcacagcatgctgggtagcgaacgc

SEQ ID NO: 480848 - DNA, 25 bp, Rattus norvegicus
ttccacacccgtggaaacgggatgc

SEQ ID NO: 480849 - DNA, 25 bp, Rattus norvegicus
cgagcccactcgtgctggatgtagt

SEQ ID NO: 480850 - DNA, 25 bp, Rattus norvegicus
cacagccctcagtcgactcgggtga

SEQ ID NO: 480851 - DNA, 25 bp, Rattus norvegicus
tcaccctacgcaggcgcactaagga

SEQ ID NO: 480852 - DNA, 25 bp, Rattus norvegicus
ggcagctgcactccggataaccaaa

SEQ ID NO: 480853 - DNA, 25 bp, Rattus norvegicus
agcgagacaccgacagctgcggaga

SEQ ID NO: 480854 - DNA, 25 bp, Rattus norvegicus
cagctcgtccattgtgtgtggggcc

SEQ ID NO: 480855 - DNA, 25 bp, Rattus norvegicus
gctcccggcggaaggctcaggttcc

SEQ ID NO: 480856 - DNA, 25 bp, Rattus norvegicus
gcgcactaaggatgaactgctcttc

SEQ ID NO: 480857 - DNA, 25 bp, Rattus norvegicus
gatgtagtgcagtattcccggaata

SEQ ID NO: 480858 - DNA, 25 bp, Rattus norvegicus
actcgggtgaggtacctgcagttcg

SEQ ID NO: 480859 - DNA, 25 bp, Rattus norvegicus
ggataaccaaatagagtccggcctc

SEQ ID NO: 480860 - DNA, 25 bp, Rattus norvegicus
gctcgggagccagaaagacaagccc

SEQ ID NO: 480861 - DNA, 25 bp, Rattus norvegicus
cgaatcaccgcgctgtcaatcggcg

SEQ ID NO: 480862 - DNA, 25 bp, Rattus norvegicus
cggctacggctctcttcaaccagga

SEQ ID NO: 480863 - DNA, 25 bp, Rattus norvegicus
aggagaggccgcgtccatcgccagc

SEQ ID NO: 480864 - DNA, 25 bp, Rattus norvegicus
ttcaaagccaggtccgcgcggagct

SEQ ID NO: 480865 - DNA, 25 bp, Rattus norvegicus
agaccctgcggttcaaagccaggtc

SEQ ID NO: 480866 - DNA, 25 bp, Rattus norvegicus
ccaggaaaccgcaggccgcgcaggt

SEQ ID NO: 480867 - DNA, 25 bp, Rattus norvegicus
cgcgagcagctggttcgcgcacgct

SEQ ID NO: 480868 - DNA, 25 bp, Rattus norvegicus
gtacccggagctcgggagccagaaa

SEQ ID NO: 480869 - DNA, 25 bp, Rattus norvegicus
ctgagccttaccaaggacaagggga

SEQ ID NO: 480870 - DNA, 25 bp, Rattus norvegicus
gcccggcagctgagccttaccaagg

SEQ ID NO: 480871 - DNA, 25 bp, Rattus norvegicus
tctcccggaactcagaggcccagtg

SEQ ID NO: 480872 - DNA, 25 bp, Rattus norvegicus
cgagctcgagaggaagccgccaagc

SEQ ID NO: 480873 - DNA, 25 bp, Rattus norvegicus
caggaaaagccgtgtctcgtccctc

SEQ ID NO: 480874 - DNA, 25 bp, Rattus norvegicus
tctttgcccactatcagcgtggtta

SEQ ID NO: 480875 - DNA, 25 bp, Rattus norvegicus
agctacgtcgaagccatgcaccgcg

SEQ ID NO: 480876 - DNA, 25 bp, Rattus norvegicus
ggagcgagcagatgcccagacccgc

SEQ ID NO: 480877 - DNA, 25 bp, Rattus norvegicus
cccagtggcagcagctacgtcgaag

SEQ ID NO: 480878 - DNA, 25 bp, Rattus norvegicus
gctggcccgaatgcgcacagaggac

SEQ ID NO: 480879 - DNA, 25 bp, Rattus norvegicus
tgccgctggcccgaatgcgcacaga

SEQ ID NO: 480880 - DNA, 25 bp, Rattus norvegicus
cacaaaccgcttcctgccgctggcc

SEQ ID NO: 480881 - DNA, 25 bp, Rattus norvegicus
ctcttcttgactgcgatgcgagccc

SEQ ID NO: 480882 - DNA, 25 bp, Rattus norvegicus
ttcagctcttcttgactgcgatgcg

SEQ ID NO: 480883 - DNA, 25 bp, Rattus norvegicus
caagccctgagcgaggcgcaggacc

SEQ ID NO: 480884 - DNA, 25 bp, Rattus norvegicus
gtggttatgagcaagccctgagcga

SEQ ID NO: 480885 - DNA, 25 bp, Rattus norvegicus
tatcagcgtggttatgagcaagccc

SEQ ID NO: 480886 - DNA, 25 bp, Rattus norvegicus
ctgcgctgcgctacttctccacaaa

SEQ ID NO: 480887 - DNA, 25 bp, Rattus norvegicus
gctctggagcgagcagatgcccaga

SEQ ID NO: 480888 - DNA, 25 bp, Rattus norvegicus
acagcacagcggcacccggctcacc

SEQ ID NO: 480889 - DNA, 25 bp, Rattus norvegicus
tgggctcacacctgtcccggctgtg

SEQ ID NO: 480890 - DNA, 25 bp, Rattus norvegicus
cttgcctgcagagacgccctgggct

SEQ ID NO: 480891 - DNA, 25 bp, Rattus norvegicus
tcccgcatcctggacccgcagcagc

SEQ ID NO: 480892 - DNA, 25 bp, Rattus norvegicus
cccgcctacctgttgtgcggaggga

SEQ ID NO: 480893 - DNA, 25 bp, Rattus norvegicus
cctacctgttgtgcggagggagaaa

SEQ ID NO: 480894 - DNA, 25 bp, Rattus norvegicus
gagaaacccgccacgccgcagtcag

SEQ ID NO: 480895 - DNA, 25 bp, Rattus norvegicus
catgtcccgtctgcatttgcagccg

SEQ ID NO: 480896 - DNA, 25 bp, Rattus norvegicus
ctgtcccggctgtgccacgttacgg

SEQ ID NO: 480897 - DNA, 25 bp, Rattus norvegicus
acgttacgggctccgcgacagcaca

SEQ ID NO: 480898 - DNA, 25 bp, Rattus norvegicus
tgcctgcagagacgccctgggctca

SEQ ID NO: 480899 - DNA, 25 bp, Rattus norvegicus
gtctgcatttgcagccgggaccctg

SEQ ID NO: 480900 - DNA, 25 bp, Rattus norvegicus
tcagcctcctctccgcgtctcccag

SEQ ID NO: 480901 - DNA, 25 bp, Rattus norvegicus
ctgtgccacgttacgggctccgcga

SEQ ID NO: 480902 - DNA, 25 bp, Rattus norvegicus
gctgcgcatgctcggataagctcct

SEQ ID NO: 480903 - DNA, 25 bp, Rattus norvegicus
aagctcctcctattgctcgtagctc

SEQ ID NO: 480904 - DNA, 25 bp, Rattus norvegicus
ggataagctcctcctattgctcgta

SEQ ID NO: 480905 - DNA, 25 bp, Rattus norvegicus
tgctcggataagctcctcctattgc

SEQ ID NO: 480906 - DNA, 25 bp, Rattus norvegicus
cgcatgctcggataagctcctccta

SEQ ID NO: 480907 - DNA, 25 bp, Rattus norvegicus
tgaacctcacgaccgccgtccgcca

SEQ ID NO: 480908 - DNA, 25 bp, Rattus norvegicus
gagcgctcgagcctgaacctcacga

SEQ ID NO: 480909 - DNA, 25 bp, Rattus norvegicus
tgcaagagcgctcgagcctgaacct

SEQ ID NO: 480910 - DNA, 25 bp, Rattus norvegicus
cgtagctccaccctaggaaggcggg

SEQ ID NO: 480911 - DNA, 25 bp, Rattus norvegicus
cgagcgtgcaggcactgctgcaaga

SEQ ID NO: 480912 - DNA, 25 bp, Rattus norvegicus
ccgcgtctccatcggccgggcgcac

SEQ ID NO: 480913 - DNA, 25 bp, Rattus norvegicus
gggagttacctccacccactgcgcc

SEQ ID NO: 480914 - DNA, 25 bp, Rattus norvegicus
ccgtccgccatgacgcgggtccgcg

SEQ ID NO: 480915 - DNA, 25 bp, Rattus norvegicus
caggcactgctgcaagagcgctcga

SEQ ID NO: 480916 - DNA, 25 bp, Rattus norvegicus
caccctggccccgggaagagctttg

SEQ ID NO: 480917 - DNA, 25 bp, Rattus norvegicus
gccgagctttgggttgtgggcgtca

SEQ ID NO: 480918 - DNA, 25 bp, Rattus norvegicus
cctgcccctggggtgccgagctttg

SEQ ID NO: 480919 - DNA, 25 bp, Rattus norvegicus
tgtcactccggggtggtggcgtggc

SEQ ID NO: 480920 - DNA, 25 bp, Rattus norvegicus
ttgctgctctttggcggggtgtcac

SEQ ID NO: 480921 - DNA, 25 bp, Rattus norvegicus
ctggcggcgtttgctgctctttggc

SEQ ID NO: 480922 - DNA, 25 bp, Rattus norvegicus
tggtacgggccgtaccgcatgcgcc

SEQ ID NO: 480923 - DNA, 25 bp, Rattus norvegicus
acctggcggcgtttgctgctctttg

SEQ ID NO: 480924 - DNA, 25 bp, Rattus norvegicus
gtacgggccgtaccgcatgcgcctg

SEQ ID NO: 480925 - DNA, 25 bp, Rattus norvegicus
gaagagctttgagccatggggacct

SEQ ID NO: 480926 - DNA, 25 bp, Rattus norvegicus
gggcgcgaagtgcttccaccctggc

SEQ ID NO: 480927 - DNA, 25 bp, Rattus norvegicus
tcatttctccgcgccgggcgcgaag

SEQ ID NO: 480928 - DNA, 25 bp, Rattus norvegicus
gccgtaccgcatgcgcctgcgcgct

SEQ ID NO: 480929 - DNA, 25 bp, Rattus norvegicus
ggacctggcggcgtttgctgctctt

SEQ ID NO: 480930 - DNA, 25 bp, Rattus norvegicus
cagaggcctgctggtagccgagctc

SEQ ID NO: 480931 - DNA, 25 bp, Rattus norvegicus
gcgttgttaggtaggacctccgaga

SEQ ID NO: 480932 - DNA, 25 bp, Rattus norvegicus
gccgccgccggttgtaaccagttga

SEQ ID NO: 480933 - DNA, 25 bp, Rattus norvegicus
gagaggggccgctttctccacaggt

SEQ ID NO: 480934 - DNA, 25 bp, Rattus norvegicus
ctttctccacaggtgatcgggccgg

SEQ ID NO: 480935 - DNA, 25 bp, Rattus norvegicus
cgccaggcgtcctctctccgcgcca

SEQ ID NO: 480936 - DNA, 25 bp, Rattus norvegicus
gccaccttcacttgtccggggcttg

SEQ ID NO: 480937 - DNA, 25 bp, Rattus norvegicus
accttcacttgtccggggcttggag

SEQ ID NO: 480938 - DNA, 25 bp, Rattus norvegicus
gctgttaacgagttccacctggaag

SEQ ID NO: 480939 - DNA, 25 bp, Rattus norvegicus
cgcagatccgcaggaacaggacctc

SEQ ID NO: 480940 - DNA, 25 bp, Rattus norvegicus
caggacctcggctgcaaacttaacc

SEQ ID NO: 480941 - DNA, 25 bp, Rattus norvegicus
tcggctgcaaacttaaccgcctttc

SEQ ID NO: 480942 - DNA, 25 bp, Rattus norvegicus
ggctgccgctgttaacgagttccac

SEQ ID NO: 480943 - DNA, 25 bp, Rattus norvegicus
ggccgctttctccacaggtgatcgg

SEQ ID NO: 480944 - DNA, 25 bp, Rattus norvegicus
gcctgcgcaaaatgtgcacgggatg

SEQ ID NO: 480945 - DNA, 25 bp, Rattus norvegicus
gttgggcacacttctacaggcactg

SEQ ID NO: 480946 - DNA, 25 bp, Rattus norvegicus
ggatggcactacctgcgactggcca

SEQ ID NO: 480947 - DNA, 25 bp, Rattus norvegicus
accgaagggcgtggccgcccagtct

SEQ ID NO: 480948 - DNA, 25 bp, Rattus norvegicus
agtctaactcctcgggtccaggcgc

SEQ ID NO: 480949 - DNA, 25 bp, Rattus norvegicus
gccgccagcgcctgctggtaataga

SEQ ID NO: 480950 - DNA, 25 bp, Rattus norvegicus
cgcctgctggtaatagactgcaccc

SEQ ID NO: 480951 - DNA, 25 bp, Rattus norvegicus
ctctcgaggtgctcaccgaaccttg

SEQ ID NO: 480952 - DNA, 25 bp, Rattus norvegicus
accgaaccttggctacgcaccaaga

SEQ ID NO: 480953 - DNA, 25 bp, Rattus norvegicus
acgcaccaagagtacggggccgata

SEQ ID NO: 480954 - DNA, 25 bp, Rattus norvegicus
gctagcgcctgccaggcacctgtga

SEQ ID NO: 480955 - DNA, 25 bp, Rattus norvegicus
atcacctggcgggttgggcacactt

SEQ ID NO: 480956 - DNA, 25 bp, Rattus norvegicus
ttctacaggcactgcgctcctacgt

SEQ ID NO: 480957 - DNA, 25 bp, Rattus norvegicus
gatagttctgggaccgagccggtct

SEQ ID NO: 480958 - DNA, 25 bp, Rattus norvegicus
gtggaaacggcagcttcttctttct

SEQ ID NO: 480959 - DNA, 25 bp, Rattus norvegicus
cgtgactgcaggcttggctgggtct

SEQ ID NO: 480960 - DNA, 25 bp, Rattus norvegicus
agtgagcagctcagattgtgacctc

SEQ ID NO: 480961 - DNA, 25 bp, Rattus norvegicus
agctcagattgtgacctcttgtgga

SEQ ID NO: 480962 - DNA, 25 bp, Rattus norvegicus
attgtgacctcttgtggaaacggca

SEQ ID NO: 480963 - DNA, 25 bp, Rattus norvegicus
tgacctcttgtggaaacggcagctt

SEQ ID NO: 480964 - DNA, 25 bp, Rattus norvegicus
ctcttgtggaaacggcagcttcttc

SEQ ID NO: 480965 - DNA, 25 bp, Rattus norvegicus
ttctctctgcggctcggcttgggtg

SEQ ID NO: 480966 - DNA, 25 bp, Rattus norvegicus
cagatggctggacggactgtgcttt

SEQ ID NO: 480967 - DNA, 25 bp, Rattus norvegicus
ggacggactgtgctttcagaccata

SEQ ID NO: 480968 - DNA, 25 bp, Rattus norvegicus
tgtgctttcagaccatagcgtgctg

SEQ ID NO: 480969 - DNA, 25 bp, Rattus norvegicus
tttcagaccatagcgtgctgatggc

SEQ ID NO: 480970 - DNA, 25 bp, Rattus norvegicus
accatagcgtgctgatggcgtaggt

SEQ ID NO: 480971 - DNA, 25 bp, Rattus norvegicus
cgtaggtgagagacgacgacgagtc

SEQ ID NO: 480972 - DNA, 25 bp, Rattus norvegicus
ggtgtgctgaatgaagcgcccgccc

SEQ ID NO: 480973 - DNA, 25 bp, Rattus norvegicus
ccgttcggtcggtgtgctgaatgaa

SEQ ID NO: 480974 - DNA, 25 bp, Rattus norvegicus
cccgccgttcggtcggtgtgctgaa

SEQ ID NO: 480975 - DNA, 25 bp, Rattus norvegicus
aggaggggcatgtcgggagaagccc

SEQ ID NO: 480976 - DNA, 25 bp, Rattus norvegicus
cccgcaagatggacggtttcgccgg

SEQ ID NO: 480977 - DNA, 25 bp, Rattus norvegicus
gcccggcagaaggaggggcatgtcg

SEQ ID NO: 480978 - DNA, 25 bp, Rattus norvegicus
caagatggacggtttcgccggcagc

SEQ ID NO: 480979 - DNA, 25 bp, Rattus norvegicus
gatggacggtttcgccggcagcctc

SEQ ID NO: 480980 - DNA, 25 bp, Rattus norvegicus
gtttcgccggcagcctcggtgagtc

SEQ ID NO: 480981 - DNA, 25 bp, Rattus norvegicus
ttcgccggcagcctcggtgagtccg

SEQ ID NO: 480982 - DNA, 25 bp, Rattus norvegicus
agcctcggtgagtccggcagcgggc

SEQ ID NO: 480983 - DNA, 25 bp, Rattus norvegicus
cgcgcccctcgtgcgtaaccaggga

SEQ ID NO: 480984 - DNA, 25 bp, Rattus norvegicus
ctcccggcacatggtccccgcgagg

SEQ ID NO: 480985 - DNA, 25 bp, Rattus norvegicus
tcggtgtgctgaatgaagcgcccgc

SEQ ID NO: 480986 - DNA, 25 bp, Rattus norvegicus
acccggctgctggtgccaacatcat

SEQ ID NO: 480987 - DNA, 25 bp, Rattus norvegicus
ctggacgaaggcctgatcgactacg

SEQ ID NO: 480988 - DNA, 25 bp, Rattus norvegicus
ggcctgatcgactacgtcgacaaga

SEQ ID NO: 480989 - DNA, 25 bp, Rattus norvegicus
gagctacgagcacgccctgggcaac

SEQ ID NO: 480990 - DNA, 25 bp, Rattus norvegicus
gctggtgccaacatcatcgccaaca

SEQ ID NO: 480991 - DNA, 25 bp, Rattus norvegicus
tcacgccatcgagttcctgctctgg

SEQ ID NO: 480992 - DNA, 25 bp, Rattus norvegicus
tacgtcgacaagagctacgagcacg

SEQ ID NO: 480993 - DNA, 25 bp, Rattus norvegicus
gaaggtcgacgtcaaggacattacc

SEQ ID NO: 480994 - DNA, 25 bp, Rattus norvegicus
aactggccagcctgaacgagctggc

SEQ ID NO: 480995 - DNA, 25 bp, Rattus norvegicus
cagcctgaacgagctggctggctcc

SEQ ID NO: 480996 - DNA, 25 bp, Rattus norvegicus
tggctggctccgaggccaacgttgc

SEQ ID NO: 480997 - DNA, 25 bp, Rattus norvegicus
gaggccaacgttgccaccggctatc

SEQ ID NO: 480998 - DNA, 25 bp, Rattus norvegicus
gagttcctgctctggggccaggacc

SEQ ID NO: 480999 - DNA, 25 bp, Rattus norvegicus
ggctatcacgccatcgagttcctgc

SEQ ID NO: 481000 - DNA, 25 bp, Rattus norvegicus
tcgcacctcctaagctcggcgaatg

SEQ ID NO: 481001 - DNA, 25 bp, Rattus norvegicus
ccgtctccgagagctgctaggccgg

SEQ ID NO: 481002 - DNA, 25 bp, Rattus norvegicus
ggccgtctccgagagctgctaggcc

SEQ ID NO: 481003 - DNA, 25 bp, Rattus norvegicus
tgctctctaggaagggaatgagctg

SEQ ID NO: 481004 - DNA, 25 bp, Rattus norvegicus
cagctgctctctaggaagggaatga

SEQ ID NO: 481005 - DNA, 25 bp, Rattus norvegicus
ccgcagctgctctctaggaagggaa

SEQ ID NO: 481006 - DNA, 25 bp, Rattus norvegicus
aaagagaaggcgctgtgtgtgccgg

SEQ ID NO: 481007 - DNA, 25 bp, Rattus norvegicus
tggagtgactcgctggtggaaaaaa

SEQ ID NO: 481008 - DNA, 25 bp, Rattus norvegicus
agctcggcgaatggagtgactcgct

SEQ ID NO: 481009 - DNA, 25 bp, Rattus norvegicus
ctaagctcggcgaatggagtgactc

SEQ ID NO: 481010 - DNA, 25 bp, Rattus norvegicus
gcacctcctaagctcggcgaatgga

SEQ ID NO: 481011 - DNA, 25 bp, Rattus norvegicus
agcaagtcgcacctcctaagctcgg

SEQ ID NO: 481012 - DNA, 25 bp, Rattus norvegicus
cagtcccagcgcattgtccgcccgc

SEQ ID NO: 481013 - DNA, 25 bp, Rattus norvegicus
gcggcgagcaagtcgcacctcctaa

SEQ ID NO: 481014 - DNA, 25 bp, Rattus norvegicus
cacagcgcttcggtgctcaagatca

SEQ ID NO: 481015 - DNA, 25 bp, Rattus norvegicus
caggcgtccagcaagcaccagaagc

SEQ ID NO: 481016 - DNA, 25 bp, Rattus norvegicus
ctcacgtcggacagcgccaaggact

SEQ ID NO: 481017 - DNA, 25 bp, Rattus norvegicus
ccaagacgcccatggagatgctcta

SEQ ID NO: 481018 - DNA, 25 bp, Rattus norvegicus
cgtggacgttaacagcccaggcttc

SEQ ID NO: 481019 - DNA, 25 bp, Rattus norvegicus
atgcgcatgctgttaacttcgtgga

SEQ ID NO: 481020 - DNA, 25 bp, Rattus norvegicus
ggcaacctgctacccaatgcgcatg

SEQ ID NO: 481021 - DNA, 25 bp, Rattus norvegicus
agcacagccgcacagagggtctaca

SEQ ID NO: 481022 - DNA, 25 bp, Rattus norvegicus
gcaatgtcgtgcttccgctggtaca

SEQ ID NO: 481023 - DNA, 25 bp, Rattus norvegicus
tccttgctgtacactggggacctgg

SEQ ID NO: 481024 - DNA, 25 bp, Rattus norvegicus
ctggtacgtccaactccttgctgta

SEQ ID NO: 481025 - DNA, 25 bp, Rattus norvegicus
actgctggccgcaagactcagttca

SEQ ID NO: 481026 - DNA, 25 bp, Rattus norvegicus
ccaaggactcagacagcgcgacaga

SEQ ID NO: 481027 - DNA, 25 bp, Rattus norvegicus
gctgggctccatgcagatcaaagtg

SEQ ID NO: 481028 - DNA, 25 bp, Rattus norvegicus
gagtttgaccaatacctgccgccca

SEQ ID NO: 481029 - DNA, 25 bp, Rattus norvegicus
acttccgcgacgtggacatcggtga

SEQ ID NO: 481030 - DNA, 25 bp, Rattus norvegicus
atcggtgagctgagcagcgacgtca

SEQ ID NO: 481031 - DNA, 25 bp, Rattus norvegicus
tcgagaccttcgacgtcaatgagtt

SEQ ID NO: 481032 - DNA, 25 bp, Rattus norvegicus
aggtctcctacactggcagctacgg

SEQ ID NO: 481033 - DNA, 25 bp, Rattus norvegicus
tggcagctacggcatcagcagcacc

SEQ ID NO: 481034 - DNA, 25 bp, Rattus norvegicus
ggccagtcccagagaacgcacatca

SEQ ID NO: 481035 - DNA, 25 bp, Rattus norvegicus
aacgcacatcaagacggagcaactg

SEQ ID NO: 481036 - DNA, 25 bp, Rattus norvegicus
cggagcaactgagcccgagccacta

SEQ ID NO: 481037 - DNA, 25 bp, Rattus norvegicus
cgagccactacagcgagcagcagca

SEQ ID NO: 481038 - DNA, 25 bp, Rattus norvegicus
ccatcacgcgctcgcagtatgacta

SEQ ID NO: 481039 - DNA, 25 bp, Rattus norvegicus
agtatgactacaccgaccaccagaa

SEQ ID NO: 481040 - DNA, 25 bp, Rattus norvegicus
cgggccacgtgtggatgtcaaagca

SEQ ID NO: 481041 - DNA, 25 bp, Rattus norvegicus
agcgacgtcatctccaacatcgaga

SEQ ID NO: 481042 - DNA, 25 bp, Rattus norvegicus
tccggtttctatcagcgaacggccc

SEQ ID NO: 481043 - DNA, 25 bp, Rattus norvegicus
tggtgctgacaacgccgctggccac

SEQ ID NO: 481044 - DNA, 25 bp, Rattus norvegicus
cgtattccgctcaggcctcctggtg

SEQ ID NO: 481045 - DNA, 25 bp, Rattus norvegicus
ccctgactgtctgcaggcctggata

SEQ ID NO: 481046 - DNA, 25 bp, Rattus norvegicus
ctccctgccaggattccggtttcta

SEQ ID NO: 481047 - DNA, 25 bp, Rattus norvegicus
gttcctggtcggttctccctgccag

SEQ ID NO: 481048 - DNA, 25 bp, Rattus norvegicus
cagtcccatgactcaggggttcctg

SEQ ID NO: 481049 - DNA, 25 bp, Rattus norvegicus
caagaggggctaggatccctgaagc

SEQ ID NO: 481050 - DNA, 25 bp, Rattus norvegicus
tggttcagcttaacaagaggggcta

SEQ ID NO: 481051 - DNA, 25 bp, Rattus norvegicus
tcttcgcagatgctggttcagctta

SEQ ID NO: 481052 - DNA, 25 bp, Rattus norvegicus
ggaaagcagcccgagccacggcatt

SEQ ID NO: 481053 - DNA, 25 bp, Rattus norvegicus
cccgagctcagtgagtagggaaagc

SEQ ID NO: 481054 - DNA, 25 bp, Rattus norvegicus
ctcctcggcggtgtaagtagaagca

SEQ ID NO: 481055 - DNA, 25 bp, Rattus norvegicus
cctggatagcatggccgtattccgc

SEQ ID NO: 481056 - DNA, 25 bp, Rattus norvegicus
ttgacatagtatttgcccaggcggc

SEQ ID NO: 481057 - DNA, 25 bp, Rattus norvegicus
atccacgtgatctggtcgcctcgca

SEQ ID NO: 481058 - DNA, 25 bp, Rattus norvegicus
tgcagctgcttgactcgctccagta

SEQ ID NO: 481059 - DNA, 25 bp, Rattus norvegicus
cctcgcctaggaagttgtccaggta

SEQ ID NO: 481060 - DNA, 25 bp, Rattus norvegicus
tgtccaggtagcagaagccgacctc

SEQ ID NO: 481061 - DNA, 25 bp, Rattus norvegicus
gtactccagggcgatcttctccaga

SEQ ID NO: 481062 - DNA, 25 bp, Rattus norvegicus
tccagatccagcctcatgatgtgtc

SEQ ID NO: 481063 - DNA, 25 bp, Rattus norvegicus
gtcccagaggcatctcgctcacaga

SEQ ID NO: 481064 - DNA, 25 bp, Rattus norvegicus
ttgcccagagcgaacgcacagcgga

SEQ ID NO: 481065 - DNA, 25 bp, Rattus norvegicus
cccgagccactttagctgcaaaggc

SEQ ID NO: 481066 - DNA, 25 bp, Rattus norvegicus
cggggaaagttgcttgaaactctga

SEQ ID NO: 481067 - DNA, 25 bp, Rattus norvegicus
ctctgaagagaagggagtcccgctc

SEQ ID NO: 481068 - DNA, 25 bp, Rattus norvegicus
tagtgtagagttctgccacccagcg

SEQ ID NO: 481069 - DNA, 25 bp, Rattus norvegicus
ttggaccgctccttgacatagtatt

SEQ ID NO: 481070 - DNA, 25 bp, Rattus norvegicus
ctcgaacgctgatttggccggcgtc

SEQ ID NO: 481071 - DNA, 25 bp, Rattus norvegicus
gaagcccgccgctgtttgctgcgac

SEQ ID NO: 481072 - DNA, 25 bp, Rattus norvegicus
cgggtcttcccgctgttgctgtcgg

SEQ ID NO: 481073 - DNA, 25 bp, Rattus norvegicus
cgccgctgtttgctgcgacctcatg

SEQ ID NO: 481074 - DNA, 25 bp, Rattus norvegicus
cgaacgctgatttggccggcgtccc

SEQ ID NO: 481075 - DNA, 25 bp, Rattus norvegicus
tactcgaacgctgatttggccggcg

SEQ ID NO: 481076 - DNA, 25 bp, Rattus norvegicus
ttactcgaacgctgatttggccggc

SEQ ID NO: 481077 - DNA, 25 bp, Rattus norvegicus
cggaggaagtagcaacaaatccacc

SEQ ID NO: 481078 - DNA, 25 bp, Rattus norvegicus
gcggaggaagtagcaacaaatccac

SEQ ID NO: 481079 - DNA, 25 bp, Rattus norvegicus
acctcatggagggtggcggaggaag

SEQ ID NO: 481080 - DNA, 25 bp, Rattus norvegicus
tgtttgctgcgacctcatggagggt

SEQ ID NO: 481081 - DNA, 25 bp, Rattus norvegicus
gctgtttgctgcgacctcatggagg

SEQ ID NO: 481082 - DNA, 25 bp, Rattus norvegicus
ccgctgtttgctgcgacctcatgga

SEQ ID NO: 481083 - DNA, 25 bp, Rattus norvegicus
gaacgctgatttggccggcgtcccg

SEQ ID NO: 481084 - DNA, 25 bp, Rattus norvegicus
tctggatataagtgctggctctgca

SEQ ID NO: 481085 - DNA, 25 bp, Rattus norvegicus
ccacgcgcacgcatggcagttgcaa

SEQ ID NO: 481086 - DNA, 25 bp, Rattus norvegicus
tgccctgggaaacggtctggatata

SEQ ID NO: 481087 - DNA, 25 bp, Rattus norvegicus
cgcttattggccaggcggacacttc

SEQ ID NO: 481088 - DNA, 25 bp, Rattus norvegicus
tcctaaagctccaggccttggggcc

SEQ ID NO: 481089 - DNA, 25 bp, Rattus norvegicus
aggacatctgcttccatgctcgcgc

SEQ ID NO: 481090 - DNA, 25 bp, Rattus norvegicus
tccagcatgtagagcgcagtgacca

SEQ ID NO: 481091 - DNA, 25 bp, Rattus norvegicus
tactgaacacggttcgctcccaggg

SEQ ID NO: 481092 - DNA, 25 bp, Rattus norvegicus
gccaggccaggacacacaggatact

SEQ ID NO: 481093 - DNA, 25 bp, Rattus norvegicus
gggaattgcgtccaagacccggatc

SEQ ID NO: 481094 - DNA, 25 bp, Rattus norvegicus
ggatacctccaccttgggcagggga

SEQ ID NO: 481095 - DNA, 25 bp, Rattus norvegicus
tgcatgcagaaatcaggatacctcc

SEQ ID NO: 481096 - DNA, 25 bp, Rattus norvegicus
gagacgtcgtcctccctactgcatg

SEQ ID NO: 481097 - DNA, 25 bp, Rattus norvegicus
gccaggaagcaccaagagagacgtc

SEQ ID NO: 481098 - DNA, 25 bp, Rattus norvegicus
gatgcctacacggtcccggtgtctg

SEQ ID NO: 481099 - DNA, 25 bp, Rattus norvegicus
taccacgtctctgcgttttcttttc

SEQ ID NO: 481100 - DNA, 25 bp, Rattus norvegicus
tgcggagggtcaatgttaccacgtc

SEQ ID NO: 481101 - DNA, 25 bp, Rattus norvegicus
cccacggaaaaggatgtcagcgacg

SEQ ID NO: 481102 - DNA, 25 bp, Rattus norvegicus
tgcgcaagccgtcccacggaaaagg

SEQ ID NO: 481103 - DNA, 25 bp, Rattus norvegicus
attgcgagtccttcctgtgcgcctg

SEQ ID NO: 481104 - DNA, 25 bp, Rattus norvegicus
ccggtgtctgtgtactcctcaagca

SEQ ID NO: 481105 - DNA, 25 bp, Rattus norvegicus
tcatggcggcctaaggatgcctaca

SEQ ID NO: 481106 - DNA, 25 bp, Rattus norvegicus
tcatagtcatcctggagccggttca

SEQ ID NO: 481107 - DNA, 25 bp, Rattus norvegicus
ttccaccgcgtaggggtcatagtca

SEQ ID NO: 481108 - DNA, 25 bp, Rattus norvegicus
ggcctcagccaaggccctgcggata

SEQ ID NO: 481109 - DNA, 25 bp, Rattus norvegicus
gacgcgacaagcacaacggcctcag

SEQ ID NO: 481110 - DNA, 25 bp, Rattus norvegicus
gcccagggaccgcagacgcgacaag

SEQ ID NO: 481111 - DNA, 25 bp, Rattus norvegicus
acttccgcccatattgcgagtcctt

SEQ ID NO: 481112 - DNA, 25 bp, Rattus norvegicus
agagactgccggtcgcgtggatcca

SEQ ID NO: 481113 - DNA, 25 bp, Rattus norvegicus
tttccgtgagggacgataagacggc

SEQ ID NO: 481114 - DNA, 25 bp, Rattus norvegicus
gcagatgacgttcgcgcagagactg

SEQ ID NO: 481115 - DNA, 25 bp, Rattus norvegicus
cgtgtcgtgtttctggacgttggac

SEQ ID NO: 481116 - DNA, 25 bp, Rattus norvegicus
gtctagtgggtggtcatccggctct

SEQ ID NO: 481117 - DNA, 25 bp, Rattus norvegicus
cggacgtggtgaccgcatgttcaaa

SEQ ID NO: 481118 - DNA, 25 bp, Rattus norvegicus
ctggcatacatagtcgtgtgaggtg

SEQ ID NO: 481119 - DNA, 25 bp, Rattus norvegicus
cgggctgtgtctggcatacatagtc

SEQ ID NO: 481120 - DNA, 25 bp, Rattus norvegicus
ctggacgttggacgcaaacgcgatc

SEQ ID NO: 481121 - DNA, 25 bp, Rattus norvegicus
cgcaaacgcgatccggacacggttc

SEQ ID NO: 481122 - DNA, 25 bp, Rattus norvegicus
acacggttcccacggatggtgtcta

SEQ ID NO: 481123 - DNA, 25 bp, Rattus norvegicus
ggcgtatgcagatgacgttcgcgca

SEQ ID NO: 481124 - DNA, 25 bp, Rattus norvegicus
gctctgtccgcggagtgcacactgg

SEQ ID NO: 481125 - DNA, 25 bp, Rattus norvegicus
catgttcaaagtgagtgtgcggtga

SEQ ID NO: 481126 - DNA, 25 bp, Rattus norvegicus
ttttgccgggcaagagacccagacc

SEQ ID NO: 481127 - DNA, 25 bp, Rattus norvegicus
acccatccctgtgccgcgatgcttc

SEQ ID NO: 481128 - DNA, 25 bp, Rattus norvegicus
cgcgggacactccacccgtgatatg

SEQ ID NO: 481129 - DNA, 25 bp, Rattus norvegicus
actccacccgtgatatggccgtttg

SEQ ID NO: 481130 - DNA, 25 bp, Rattus norvegicus
cgtgatatggccgtttgggttcccg

SEQ ID NO: 481131 - DNA, 25 bp, Rattus norvegicus
gctaatctgcatacgccacgcccac

SEQ ID NO: 481132 - DNA, 25 bp, Rattus norvegicus
acgcccacaagcctctcctctctgg

SEQ ID NO: 481133 - DNA, 25 bp, Rattus norvegicus
tctggctctcgcgttcactgtctcg

SEQ ID NO: 481134 - DNA, 25 bp, Rattus norvegicus
ctcgcgttcactgtctcggttttta

SEQ ID NO: 481135 - DNA, 25 bp, Rattus norvegicus
ggccgcgtcctcacgccacccatcc

SEQ ID NO: 481136 - DNA, 25 bp, Rattus norvegicus
cactgtctcggtttttattgctttt

SEQ ID NO: 481137 - DNA, 25 bp, Rattus norvegicus
gccgggcaagagacccagacccgga

SEQ ID NO: 481138 - DNA, 25 bp, Rattus norvegicus
acccggacagggtgacctcgagcga

SEQ ID NO: 481139 - DNA, 25 bp, Rattus norvegicus
cgttcactgtctcggtttttattgc

SEQ ID NO: 481140 - DNA, 25 bp, Rattus norvegicus
gccacggcctcggtctcacgccccc

SEQ ID NO: 481141 - DNA, 25 bp, Rattus norvegicus
cgcacggcttcatctgcgtacgccc

SEQ ID NO: 481142 - DNA, 25 bp, Rattus norvegicus
tgcgcacggcttcatctgcgtacgc

SEQ ID NO: 481143 - DNA, 25 bp, Rattus norvegicus
ctgcgcacggcttcatctgcgtacg

SEQ ID NO: 481144 - DNA, 25 bp, Rattus norvegicus
actgcgcacggcttcatctgcgtac

SEQ ID NO: 481145 - DNA, 25 bp, Rattus norvegicus
cactgcgcacggcttcatctgcgta

SEQ ID NO: 481146 - DNA, 25 bp, Rattus norvegicus
ccttaaggctctgccggaccggcag

SEQ ID NO: 481147 - DNA, 25 bp, Rattus norvegicus
acacggcccttaaggctctgccgga

SEQ ID NO: 481148 - DNA, 25 bp, Rattus norvegicus
agacacggcccttaaggctctgccg

SEQ ID NO: 481149 - DNA, 25 bp, Rattus norvegicus
gagacacggcccttaaggctctgcc

SEQ ID NO: 481150 - DNA, 25 bp, Rattus norvegicus
cgagacacggcccttaaggctctgc

SEQ ID NO: 481151 - DNA, 25 bp, Rattus norvegicus
gcggtacactccacccgagacacgg

SEQ ID NO: 481152 - DNA, 25 bp, Rattus norvegicus
cacacgcctgtcacgcggtacactc

SEQ ID NO: 481153 - DNA, 25 bp, Rattus norvegicus
cactcctctgccgagatgcttccgc

SEQ ID NO: 481154 - DNA, 25 bp, Rattus norvegicus
ctccaagcctgcgtgaaaggattcc

SEQ ID NO: 481155 - DNA, 25 bp, Rattus norvegicus
tgacagatgcgcaagcgtcctttgg

SEQ ID NO: 481156 - DNA, 25 bp, Rattus norvegicus
gctcatttgtatgtgggcagtacca

SEQ ID NO: 481157 - DNA, 25 bp, Rattus norvegicus
aactcaggcttctttgtgctgctca

SEQ ID NO: 481158 - DNA, 25 bp, Rattus norvegicus
ctgtgctgaggctttccgaaaactc

SEQ ID NO: 481159 - DNA, 25 bp, Rattus norvegicus
accgcgctctctcaagacttaggga

SEQ ID NO: 481160 - DNA, 25 bp, Rattus norvegicus
cgtcagggaaacaaaccgcgctctc

SEQ ID NO: 481161 - DNA, 25 bp, Rattus norvegicus
gtatacccacttaagcaacgtcagg

SEQ ID NO: 481162 - DNA, 25 bp, Rattus norvegicus
tctagatagcgcctgacccaaagta

SEQ ID NO: 481163 - DNA, 25 bp, Rattus norvegicus
ggcgcaaggacccagatccaagatg

SEQ ID NO: 481164 - DNA, 25 bp, Rattus norvegicus
tgtgcgaccgccctagaaaaggacc

SEQ ID NO: 481165 - DNA, 25 bp, Rattus norvegicus
tgaagccagcttcgcactgccgctg

SEQ ID NO: 481166 - DNA, 25 bp, Rattus norvegicus
tctgcgtgaaactgctaaacttgta

SEQ ID NO: 481167 - DNA, 25 bp, Rattus norvegicus
ggcacacccgtacctgcggagtata

SEQ ID NO: 481168 - DNA, 25 bp, Rattus norvegicus
aagtcggggccgtcatccaggcctt

SEQ ID NO: 481169 - DNA, 25 bp, Rattus norvegicus
gtgaacacccaccatcatggctgct

SEQ ID NO: 481170 - DNA, 25 bp, Rattus norvegicus
gccacgggaccagcggaaccaagaa

SEQ ID NO: 481171 - DNA, 25 bp, Rattus norvegicus
ctccgcggtcttcctccgagaggaa

SEQ ID NO: 481172 - DNA, 25 bp, Rattus norvegicus
atccaggccttcctgcggagtcagc

SEQ ID NO: 481173 - DNA, 25 bp, Rattus norvegicus
agtcagcgggcccagcacaccgaaa

SEQ ID NO: 481174 - DNA, 25 bp, Rattus norvegicus
cagaagacacaacttactccgcggt

SEQ ID NO: 481175 - DNA, 25 bp, Rattus norvegicus
ttcgagtccaggtctcgcgcagact

SEQ ID NO: 481176 - DNA, 25 bp, Rattus norvegicus
accgagggtcctagacgacagaaga

SEQ ID NO: 481177 - DNA, 25 bp, Rattus norvegicus
tcatggctgcttcgagtccaggtct

SEQ ID NO: 481178 - DNA, 25 bp, Rattus norvegicus
caaggagagatattagcgcccagtc

SEQ ID NO: 481179 - DNA, 25 bp, Rattus norvegicus
tcgcgcagactcacaagcaaggcca

SEQ ID NO: 481180 - DNA, 25 bp, Rattus norvegicus
aagcaaggccacgaaccgagccggc

SEQ ID NO: 481181 - DNA, 25 bp, Rattus norvegicus
atattagcgcccagtccgcgctgtc

SEQ ID NO: 481182 - DNA, 25 bp, Rattus norvegicus
taccaaccttaaagcgcgcgagtta

SEQ ID NO: 481183 - DNA, 25 bp, Rattus norvegicus
ctccgtggttgcgacgagaggaaac

SEQ ID NO: 481184 - DNA, 25 bp, Rattus norvegicus
cgaccatccgggttcgtcgctcgag

SEQ ID NO: 481185 - DNA, 25 bp, Rattus norvegicus
tgatgctggacgtagcgaccatccg

SEQ ID NO: 481186 - DNA, 25 bp, Rattus norvegicus
agccctgatgctggacgtagcgacc

SEQ ID NO: 481187 - DNA, 25 bp, Rattus norvegicus
ctagaagaacaacgcagtggcggcg

SEQ ID NO: 481188 - DNA, 25 bp, Rattus norvegicus
accgctagaagaacaacgcagtggc

SEQ ID NO: 481189 - DNA, 25 bp, Rattus norvegicus
cccgagctccagaaccgctagaaga

SEQ ID NO: 481190 - DNA, 25 bp, Rattus norvegicus
accttaccatagtgcccgcggctga

SEQ ID NO: 481191 - DNA, 25 bp, Rattus norvegicus
tcaggactccgagcggcccgcttgt

SEQ ID NO: 481192 - DNA, 25 bp, Rattus norvegicus
gagccgtggcccaaggagcgaccct

SEQ ID NO: 481193 - DNA, 25 bp, Rattus norvegicus
agcagcacgcggagccgtggcccaa

SEQ ID NO: 481194 - DNA, 25 bp, Rattus norvegicus
ttaaaaacattaagccgcgcagggc

SEQ ID NO: 481195 - DNA, 25 bp, Rattus norvegicus
agcgcgcgagttaaaaacattaagc

SEQ ID NO: 481196 - DNA, 25 bp, Rattus norvegicus
agcgctttcgcaccgctcaagactg

SEQ ID NO: 481197 - DNA, 25 bp, Rattus norvegicus
attcagtggtccctgcacccgtggt

SEQ ID NO: 481198 - DNA, 25 bp, Rattus norvegicus
tagccagggctgagcttaaccattc

SEQ ID NO: 481199 - DNA, 25 bp, Rattus norvegicus
cctgtgccaaggtggggagacaaac

SEQ ID NO: 481200 - DNA, 25 bp, Rattus norvegicus
gaagacagctctcacccggcctgtg

SEQ ID NO: 481201 - DNA, 25 bp, Rattus norvegicus
ggggctgcagagaagacagctctca

SEQ ID NO: 481202 - DNA, 25 bp, Rattus norvegicus
tcaaggcaagctccgcggatgcgca

SEQ ID NO: 481203 - DNA, 25 bp, Rattus norvegicus
tccggaggacccttgggtcaaggca

SEQ ID NO: 481204 - DNA, 25 bp, Rattus norvegicus
tccggttcggtaggtccacgatgac

SEQ ID NO: 481205 - DNA, 25 bp, Rattus norvegicus
ccagtccgctggcttgtttccggtt

SEQ ID NO: 481206 - DNA, 25 bp, Rattus norvegicus
gtgactgagcctcgcctcttcctgg

SEQ ID NO: 481207 - DNA, 25 bp, Rattus norvegicus
attggtggcttggatcacgtgactg

SEQ ID NO: 481208 - DNA, 25 bp, Rattus norvegicus
ctcaagactgcggttgtggattggt

SEQ ID NO: 481209 - DNA, 25 bp, Rattus norvegicus
cacccgtggtatgtgcattcgcgga

SEQ ID NO: 481210 - DNA, 25 bp, Rattus norvegicus
cttcccacgaggaacgccgcgaggg

SEQ ID NO: 481211 - DNA, 25 bp, Rattus norvegicus
ctcgcctccagtacgcgaggtgggc

SEQ ID NO: 481212 - DNA, 25 bp, Rattus norvegicus
cctccagtacgcgaggtgggcgcat

SEQ ID NO: 481213 - DNA, 25 bp, Rattus norvegicus
agtacgcgaggtgggcgcatcacaa

SEQ ID NO: 481214 - DNA, 25 bp, Rattus norvegicus
tgggcgcatcacaagggagaggact

SEQ ID NO: 481215 - DNA, 25 bp, Rattus norvegicus
ccggtccggggactcgcaatgtgct

SEQ ID NO: 481216 - DNA, 25 bp, Rattus norvegicus
gggactcgcaatgtgctcggagtta

SEQ ID NO: 481217 - DNA, 25 bp, Rattus norvegicus
actcgcaatgtgctcggagttaggc

SEQ ID NO: 481218 - DNA, 25 bp, Rattus norvegicus
caatgtgctcggagttaggcgctct

SEQ ID NO: 481219 - DNA, 25 bp, Rattus norvegicus
ctcacctgcgagcacttgcccgccg

SEQ ID NO: 481220 - DNA, 25 bp, Rattus norvegicus
cccggagtctctcccagccgccgcc

SEQ ID NO: 481221 - DNA, 25 bp, Rattus norvegicus
tcgcgttgccactgcccggctctgc

SEQ ID NO: 481222 - DNA, 25 bp, Rattus norvegicus
cggggatcgcgtcccgccggcactt

SEQ ID NO: 481223 - DNA, 25 bp, Rattus norvegicus
ctctggagctaggcggccacggacc

SEQ ID NO: 481224 - DNA, 25 bp, Rattus norvegicus
gaccgaaaatccatggcgaaggcag

SEQ ID NO: 481225 - DNA, 25 bp, Rattus norvegicus
gcgaaggcagccaacaagaccgaag

SEQ ID NO: 481226 - DNA, 25 bp, Rattus norvegicus
tcacgaaggccaaaacgctaagccc

SEQ ID NO: 481227 - DNA, 25 bp, Rattus norvegicus
tccagtcacgaaggccaaaacgcta

SEQ ID NO: 481228 - DNA, 25 bp, Rattus norvegicus
tccgcggatcctccagtcacgaagg

SEQ ID NO: 481229 - DNA, 25 bp, Rattus norvegicus
acgcgtagctagacacgcgcccgcc

SEQ ID NO: 481230 - DNA, 25 bp, Rattus norvegicus
ttctcgcccagcacgcgtagctaga

SEQ ID NO: 481231 - DNA, 25 bp, Rattus norvegicus
tttccgagcggaccgaaaatccatg

SEQ ID NO: 481232 - DNA, 25 bp, Rattus norvegicus
caagaccgaagaagattctcgccca

SEQ ID NO: 481233 - DNA, 25 bp, Rattus norvegicus
cgagcggaccgaaaatccatggcga

SEQ ID NO: 481234 - DNA, 25 bp, Rattus norvegicus
tgaagcacagctttccgagcggacc

SEQ ID NO: 481235 - DNA, 25 bp, Rattus norvegicus
ttcgagcagctgaagcacagctttc

SEQ ID NO: 481236 - DNA, 25 bp, Rattus norvegicus
agccgtggtttcgagcagctgaagc

SEQ ID NO: 481237 - DNA, 25 bp, Rattus norvegicus
cgaagaagattctcgcccagcacgc

SEQ ID NO: 481238 - DNA, 25 bp, Rattus norvegicus
ccgcgtgattatccggcgcaggtag

SEQ ID NO: 481239 - DNA, 25 bp, Rattus norvegicus
aggcgctggacatttcggggttact

SEQ ID NO: 481240 - DNA, 25 bp, Rattus norvegicus
cgatctaggctcgtcttcgctggga

SEQ ID NO: 481241 - DNA, 25 bp, Rattus norvegicus
ctgggcgatccggtaggatccttcg

SEQ ID NO: 481242 - DNA, 25 bp, Rattus norvegicus
gctttccggggagacactccagcca

SEQ ID NO: 481243 - DNA, 25 bp, Rattus norvegicus
ggactaacctctgtgtcgccgctgc

SEQ ID NO: 481244 - DNA, 25 bp, Rattus norvegicus
ccaccggttgccagcgagagaaaac

SEQ ID NO: 481245 - DNA, 25 bp, Rattus norvegicus
tgcccgagctttccggggagacact

SEQ ID NO: 481246 - DNA, 25 bp, Rattus norvegicus
actttccgtgtcctcattttgcttg

SEQ ID NO: 481247 - DNA, 25 bp, Rattus norvegicus
aacgttcttcggactaacctctgtg

SEQ ID NO: 481248 - DNA, 25 bp, Rattus norvegicus
aacacgacaggtaggttggcgacga

SEQ ID NO: 481249 - DNA, 25 bp, Rattus norvegicus
cggcgttcggagacacaacacgaca

SEQ ID NO: 481250 - DNA, 25 bp, Rattus norvegicus
cccgggccggcgctaatgatggacc

SEQ ID NO: 481251 - DNA, 25 bp, Rattus norvegicus
ccagcgagagaaaacaggcgtgtcc

SEQ ID NO: 481252 - DNA, 25 bp, Rattus norvegicus
ggtgctttggaactcctccactgga

SEQ ID NO: 481253 - DNA, 25 bp, Rattus norvegicus
cggtgctccggaagcagtagccata

SEQ ID NO: 481254 - DNA, 25 bp, Rattus norvegicus
cagtagccataacttccgggagggg

SEQ ID NO: 481255 - DNA, 25 bp, Rattus norvegicus
ctacggggtgtagactgtgtctgaa

SEQ ID NO: 481256 - DNA, 25 bp, Rattus norvegicus
ctgtgtctgaaatagcgggaacgcc

SEQ ID NO: 481257 - DNA, 25 bp, Rattus norvegicus
gggaacgccatgtcccgtggttcca

SEQ ID NO: 481258 - DNA, 25 bp, Rattus norvegicus
ttttgaccggcacattactattttc

SEQ ID NO: 481259 - DNA, 25 bp, Rattus norvegicus
aattgctctgtcatgcttcggcctg

SEQ ID NO: 481260 - DNA, 25 bp, Rattus norvegicus
cgagggccgactctaccaagtaggt

SEQ ID NO: 481261 - DNA, 25 bp, Rattus norvegicus
cgcctgtgggacatccgaattgctc

SEQ ID NO: 481262 - DNA, 25 bp, Rattus norvegicus
cttaccagagcggaagcagctaggc

SEQ ID NO: 481263 - DNA, 25 bp, Rattus norvegicus
cgaccacagaatgagctcggggccc

SEQ ID NO: 481264 - DNA, 25 bp, Rattus norvegicus
ccgcccacttagaggcggtgctttg

SEQ ID NO: 481265 - DNA, 25 bp, Rattus norvegicus
tactattttctctcccgagggccga

SEQ ID NO: 481266 - DNA, 25 bp, Rattus norvegicus
tggcagccgcccagggactttccgt

SEQ ID NO: 481267 - DNA, 25 bp, Rattus norvegicus
tataaacgctggcaggggatttctc

SEQ ID NO: 481268 - DNA, 25 bp, Rattus norvegicus
tcggcgccctataaacgctggcagg

SEQ ID NO: 481269 - DNA, 25 bp, Rattus norvegicus
gccgtgcccagctggctgaaacatg

SEQ ID NO: 481270 - DNA, 25 bp, Rattus norvegicus
ctgaaacatggctgtgcggagctga

SEQ ID NO: 481271 - DNA, 25 bp, Rattus norvegicus
ttcatggagtccaagccgctgtcgt

SEQ ID NO: 481272 - DNA, 25 bp, Rattus norvegicus
cgtaatcctcgtccttcatggagtc

SEQ ID NO: 481273 - DNA, 25 bp, Rattus norvegicus
cgtcctccgtgagctgttgcttcca

SEQ ID NO: 481274 - DNA, 25 bp, Rattus norvegicus
ttcaccatctgctcgtaatcctcgt

SEQ ID NO: 481275 - DNA, 25 bp, Rattus norvegicus
acttacgagtctccgtcctccgtga

SEQ ID NO: 481276 - DNA, 25 bp, Rattus norvegicus
tatgagctgagtgttcctggcagcc

SEQ ID NO: 481277 - DNA, 25 bp, Rattus norvegicus
tttccgcgaggttattatgagctga

SEQ ID NO: 481278 - DNA, 25 bp, Rattus norvegicus
agttcagactgttgtgggctcggca

SEQ ID NO: 481279 - DNA, 25 bp, Rattus norvegicus
ttgcttccagggctcggcagccaga

SEQ ID NO: 481280 - DNA, 25 bp, Rattus norvegicus
ccgaaccatcatgccgaggggattc

SEQ ID NO: 481281 - DNA, 25 bp, Rattus norvegicus
tgtgcaagcagcagtacgcggaccc

SEQ ID NO: 481282 - DNA, 25 bp, Rattus norvegicus
cggtgctgggtctgaagatcaaaga

SEQ ID NO: 481283 - DNA, 25 bp, Rattus norvegicus
gctgagcttcgcagatgaggtgaca

SEQ ID NO: 481284 - DNA, 25 bp, Rattus norvegicus
aaacctaaggctgtgaggcggctga

SEQ ID NO: 481285 - DNA, 25 bp, Rattus norvegicus
cccgcagccgtcaggaaacctaagg

SEQ ID NO: 481286 - DNA, 25 bp, Rattus norvegicus
ttggtgccaccacgggtccctgtat

SEQ ID NO: 481287 - DNA, 25 bp, Rattus norvegicus
acctcgggcgaacagttggtgccac

SEQ ID NO: 481288 - DNA, 25 bp, Rattus norvegicus
acctccgcaggacagcaccgagtgg

SEQ ID NO: 481289 - DNA, 25 bp, Rattus norvegicus
taccgctgtcccgagtgcgacaagg

SEQ ID NO: 481290 - DNA, 25 bp, Rattus norvegicus
ggggattcctcgtgaagcgaactaa

SEQ ID NO: 481291 - DNA, 25 bp, Rattus norvegicus
acaaggtcttcagctgtcctgcgaa

SEQ ID NO: 481292 - DNA, 25 bp, Rattus norvegicus
tctcagctataaagcgggcggccgc

SEQ ID NO: 481293 - DNA, 25 bp, Rattus norvegicus
gcgaactaaacgctcgggcagcttc

SEQ ID NO: 481294 - DNA, 25 bp, Rattus norvegicus
cccttaaggttgaagcttctctagc

SEQ ID NO: 481295 - DNA, 25 bp, Rattus norvegicus
caccgatgacgatgcgcaggtgctt

SEQ ID NO: 481296 - DNA, 25 bp, Rattus norvegicus
gggtcactactctcctcaccgatga

SEQ ID NO: 481297 - DNA, 25 bp, Rattus norvegicus
caccttctgggtggacttcttcacg

SEQ ID NO: 481298 - DNA, 25 bp, Rattus norvegicus
cccgtgcggcttcttagagaacatc

SEQ ID NO: 481299 - DNA, 25 bp, Rattus norvegicus
cacagccgcggagatggagcgctcc

SEQ ID NO: 481300 - DNA, 25 bp, Rattus norvegicus
agcttctctagcagcttcaaccctg

SEQ ID NO: 481301 - DNA, 25 bp, Rattus norvegicus
ttcaaccctgcggaggccaaaatcc

SEQ ID NO: 481302 - DNA, 25 bp, Rattus norvegicus
tgcggaggccaaaatccagtcgtgt

SEQ ID NO: 481303 - DNA, 25 bp, Rattus norvegicus
ccagtcgtgtggtgatggagtttca

SEQ ID NO: 481304 - DNA, 25 bp, Rattus norvegicus
tggagtttcacgactctgccgtcgg

SEQ ID NO: 481305 - DNA, 25 bp, Rattus norvegicus
ggcaaccgccttctgacgtcaagtg

SEQ ID NO: 481306 - DNA, 25 bp, Rattus norvegicus
caagtgctcgtgacgtcatgctagc

SEQ ID NO: 481307 - DNA, 25 bp, Rattus norvegicus
cttagagaacatcctgcggccgccg

SEQ ID NO: 481308 - DNA, 25 bp, Rattus norvegicus
agaagtactcgttgcgctcccggtc

SEQ ID NO: 481309 - DNA, 25 bp, Rattus norvegicus
ctggcagcagtactccaggtgcgcg

SEQ ID NO: 481310 - DNA, 25 bp, Rattus norvegicus
cccagtagatcatctcgttgtagaa

SEQ ID NO: 481311 - DNA, 25 bp, Rattus norvegicus
ctcgttgtagaaggagagctcgcac

SEQ ID NO: 481312 - DNA, 25 bp, Rattus norvegicus
agagctcgcacatccgcggcgcgaa

SEQ ID NO: 481313 - DNA, 25 bp, Rattus norvegicus
ccgcgcacgtacagcaggatgaagc

SEQ ID NO: 481314 - DNA, 25 bp, Rattus norvegicus
gatgaagccgaaggcctccgagtgc

SEQ ID NO: 481315 - DNA, 25 bp, Rattus norvegicus
ctccgagtgccggtcgaagaagtac

SEQ ID NO: 481316 - DNA, 25 bp, Rattus norvegicus
ctcacacggcgcagcgggaagtcct

SEQ ID NO: 481317 - DNA, 25 bp, Rattus norvegicus
ggaagtccttgagcagctcccggga

SEQ ID NO: 481318 - DNA, 25 bp, Rattus norvegicus
cgcccttaggagtccgggtggctat

SEQ ID NO: 481319 - DNA, 25 bp, Rattus norvegicus
gtggctatccgcagctccaggtggc

SEQ ID NO: 481320 - DNA, 25 bp, Rattus norvegicus
ccgtccagaggcgaaaggcaaagtg

SEQ ID NO: 481321 - DNA, 25 bp, Rattus norvegicus
agccatcgggatggtgggcacacct

SEQ ID NO: 481322 - DNA, 25 bp, Rattus norvegicus
agaaggagacgaatcatcacgatga

SEQ ID NO: 481323 - DNA, 25 bp, Rattus norvegicus
gccgcgccgtaatcacgggtaacca

SEQ ID NO: 481324 - DNA, 25 bp, Rattus norvegicus
acgggtaaccaatcgttcgcttgca

SEQ ID NO: 481325 - DNA, 25 bp, Rattus norvegicus
atcgttcgcttgcaaggcaggccac

SEQ ID NO: 481326 - DNA, 25 bp, Rattus norvegicus
agctcagggacagttttcaccaatg

SEQ ID NO: 481327 - DNA, 25 bp, Rattus norvegicus
ccaatggctgagctcgcagcgcaca

SEQ ID NO: 481328 - DNA, 25 bp, Rattus norvegicus
cagcgcacagcctgcgggttaggtt

SEQ ID NO: 481329 - DNA, 25 bp, Rattus norvegicus
tgccggtccattcccgaggagataa

SEQ ID NO: 481330 - DNA, 25 bp, Rattus norvegicus
acattcagcggaaggccgcgccgta

SEQ ID NO: 481331 - DNA, 25 bp, Rattus norvegicus
gcagttccgaagacgaggacaccga

SEQ ID NO: 481332 - DNA, 25 bp, Rattus norvegicus
acaccgagagctcgtcggtctccga

SEQ ID NO: 481333 - DNA, 25 bp, Rattus norvegicus
cctagggtcacctggcggtaccctg

SEQ ID NO: 481334 - DNA, 25 bp, Rattus norvegicus
cccaggcgattctgtgcaccgtggg

SEQ ID NO: 481335 - DNA, 25 bp, Rattus norvegicus
cgcggctggaaaatgccggtccatt

SEQ ID NO: 481336 - DNA, 25 bp, Rattus norvegicus
gtcacctgtgcaagcctgcacctgg

SEQ ID NO: 481337 - DNA, 25 bp, Rattus norvegicus
tgtgcaagcctgcacctggcgccgc

SEQ ID NO: 481338 - DNA, 25 bp, Rattus norvegicus
gcgccgcctccggaagaggtcttcg

SEQ ID NO: 481339 - DNA, 25 bp, Rattus norvegicus
gcatggttggggaggaccggtcgga

SEQ ID NO: 481340 - DNA, 25 bp, Rattus norvegicus
acacctaggtttggggcatggttgg

SEQ ID NO: 481341 - DNA, 25 bp, Rattus norvegicus
tgctgagggcgggacacctaggttt

SEQ ID NO: 481342 - DNA, 25 bp, Rattus norvegicus
aacctcggagagagccgggtggcga

SEQ ID NO: 481343 - DNA, 25 bp, Rattus norvegicus
ggatcggggaacctcggagagagcc

SEQ ID NO: 481344 - DNA, 25 bp, Rattus norvegicus
ctccggaagaggtcttcggggatcg

SEQ ID NO: 481345 - DNA, 25 bp, Rattus norvegicus
cgccgcctccggaagaggtcttcgg

SEQ ID NO: 481346 - DNA, 25 bp, Rattus norvegicus
gcaagcctgcacctggcgccgcctc

SEQ ID NO: 481347 - DNA, 25 bp, Rattus norvegicus
ccgggtggcgacaggtgagagccta

SEQ ID NO: 481348 - DNA, 25 bp, Rattus norvegicus
tcggaacggtaggatgaaggcgatc

SEQ ID NO: 481349 - DNA, 25 bp, Rattus norvegicus
gcgggacacctaggtttggggcatg

SEQ ID NO: 481350 - DNA, 25 bp, Rattus norvegicus
accgccgtgcttcctgtagtgagga

SEQ ID NO: 481351 - DNA, 25 bp, Rattus norvegicus
ccgtgcttcctgtagtgaggatatt

SEQ ID NO: 481352 - DNA, 25 bp, Rattus norvegicus
tagtgaggatattgggtaccgccgt

SEQ ID NO: 481353 - DNA, 25 bp, Rattus norvegicus
cgtgcttcctgtagtgaggatattg

SEQ ID NO: 481354 - DNA, 25 bp, Rattus norvegicus
aggatattgggtaccgccgtgcttc

SEQ ID NO: 481355 - DNA, 25 bp, Rattus norvegicus
tgaggatattgggtaccgccgtgct

SEQ ID NO: 481356 - DNA, 25 bp, Rattus norvegicus
cctgtagtgaggatattgggtaccg

SEQ ID NO: 481357 - DNA, 25 bp, Rattus norvegicus
cgccgtgcttcctgtagtgaggata

SEQ ID NO: 481358 - DNA, 25 bp, Rattus norvegicus
ctgtagtgaggatattgggtaccgc

SEQ ID NO: 481359 - DNA, 25 bp, Rattus norvegicus
taccgccgtgcttgcttcctgtagt

SEQ ID NO: 481360 - DNA, 25 bp, Rattus norvegicus
aggatattgggtaccgccgtgcttg

SEQ ID NO: 481361 - DNA, 25 bp, Rattus norvegicus
gtgcttgcttcctgtagtgaggata

SEQ ID NO: 481362 - DNA, 25 bp, Rattus norvegicus
gtaccgccgtgcttcctgtagtgag

SEQ ID NO: 481363 - DNA, 25 bp, Rattus norvegicus
taccgccgtgcttcctgtagtgagg

SEQ ID NO: 481364 - DNA, 25 bp, Rattus norvegicus
tgtgcaaggagcgaaagacttcgca

SEQ ID NO: 481365 - DNA, 25 bp, Rattus norvegicus
aactacagcgtctcatttagacccg

SEQ ID NO: 481366 - DNA, 25 bp, Rattus norvegicus
caccgagatgacgtaaaactacagc

SEQ ID NO: 481367 - DNA, 25 bp, Rattus norvegicus
tcgcggatttcgtctcaccgagatg

SEQ ID NO: 481368 - DNA, 25 bp, Rattus norvegicus
tccgcagtagcagccatgacacctt

SEQ ID NO: 481369 - DNA, 25 bp, Rattus norvegicus
tcgaggaactatgctccgcagtagc

SEQ ID NO: 481370 - DNA, 25 bp, Rattus norvegicus
ctctaggttcttctcgcagctgctc

SEQ ID NO: 481371 - DNA, 25 bp, Rattus norvegicus
ggcatctcagggtcccaggcatctg

SEQ ID NO: 481372 - DNA, 25 bp, Rattus norvegicus
gtcagctagtgtgccgctggcatct

SEQ ID NO: 481373 - DNA, 25 bp, Rattus norvegicus
ttggtactcacgctcggtcagctag

SEQ ID NO: 481374 - DNA, 25 bp, Rattus norvegicus
cgcttttctctagaccttggtactc

SEQ ID NO: 481375 - DNA, 25 bp, Rattus norvegicus
cttacctgtcctgtcagggtgtgca

SEQ ID NO: 481376 - DNA, 25 bp, Rattus norvegicus
tcgcagctgctcgaggaactatgct

SEQ ID NO: 481377 - DNA, 25 bp, Rattus norvegicus
gggctggagcttcgctctaggttct

SEQ ID NO: 481378 - DNA, 25 bp, Rattus norvegicus
ggcggcctgaactacatccctcctt

SEQ ID NO: 481379 - DNA, 25 bp, Rattus norvegicus
tggagtttccgcagagcctggttct

SEQ ID NO: 481380 - DNA, 25 bp, Rattus norvegicus
gcagagcctggttcttccacggaaa

SEQ ID NO: 481381 - DNA, 25 bp, Rattus norvegicus
tcttccacggaaaagcccgacggca

SEQ ID NO: 481382 - DNA, 25 bp, Rattus norvegicus
cggaaaagcccgacggcagagctgc

SEQ ID NO: 481383 - DNA, 25 bp, Rattus norvegicus
cctccggccactggagctgagcaaa

SEQ ID NO: 481384 - DNA, 25 bp, Rattus norvegicus
ttcctccttcccagatcggcccgca

SEQ ID NO: 481385 - DNA, 25 bp, Rattus norvegicus
gcaccgcagcgattccctcccggaa

SEQ ID NO: 481386 - DNA, 25 bp, Rattus norvegicus
cctcccggaaacctcaccctgctgg

SEQ ID NO: 481387 - DNA, 25 bp, Rattus norvegicus
cagagcgagccggtgcttcacagcc

SEQ ID NO: 481388 - DNA, 25 bp, Rattus norvegicus
acagccgcccaagcgtctcaaatga

SEQ ID NO: 481389 - DNA, 25 bp, Rattus norvegicus
gccgcccaagcgtctcaaatgagca

SEQ ID NO: 481390 - DNA, 25 bp, Rattus norvegicus
ggaggcgcaagacctccggccactg

SEQ ID NO: 481391 - DNA, 25 bp, Rattus norvegicus
gcgtctcaaatgagcacttcggccg

SEQ ID NO: 481392 - DNA, 25 bp, Rattus norvegicus
cgtccctatgaaaggccaagcacta

SEQ ID NO: 481393 - DNA, 25 bp, Rattus norvegicus
ccagactcccggcaatgcggtgtgt

SEQ ID NO: 481394 - DNA, 25 bp, Rattus norvegicus
cgctgtctcctcgaggccctgatag

SEQ ID NO: 481395 - DNA, 25 bp, Rattus norvegicus
gccctgatagccctgcagtcgtgga

SEQ ID NO: 481396 - DNA, 25 bp, Rattus norvegicus
ggacgccgttctcgatgctcactaa

SEQ ID NO: 481397 - DNA, 25 bp, Rattus norvegicus
tggacccagacaccgcttaccttgt

SEQ ID NO: 481398 - DNA, 25 bp, Rattus norvegicus
actcctaagcaggttcgtccctatg

SEQ ID NO: 481399 - DNA, 25 bp, Rattus norvegicus
tccaggtccagactcggaggattta

SEQ ID NO: 481400 - DNA, 25 bp, Rattus norvegicus
actaagcagtggcacggagcgctgt

SEQ ID NO: 481401 - DNA, 25 bp, Rattus norvegicus
acgtcgccaatggagcttccaggtc

SEQ ID NO: 481402 - DNA, 25 bp, Rattus norvegicus
aagccagatccaaacgtcgccaatg

SEQ ID NO: 481403 - DNA, 25 bp, Rattus norvegicus
cctgggctttcgaaatcaaagacta

SEQ ID NO: 481404 - DNA, 25 bp, Rattus norvegicus
agtctgcgaatcttcctgggctttc

SEQ ID NO: 481405 - DNA, 25 bp, Rattus norvegicus
gtgcggccttgaaagtctgcgaatc

SEQ ID NO: 481406 - DNA, 25 bp, Rattus norvegicus
ctataggagactgttcggctgccca

SEQ ID NO: 481407 - DNA, 25 bp, Rattus norvegicus
cccatgaagcgggagactgtaagca

SEQ ID NO: 481408 - DNA, 25 bp, Rattus norvegicus
ccagctcttctaagtgcctcatttg

SEQ ID NO: 481409 - DNA, 25 bp, Rattus norvegicus
atcaagcctgttgttggcgcctgca

SEQ ID NO: 481410 - DNA, 25 bp, Rattus norvegicus
tttttagaaatccaggcagccgggc

SEQ ID NO: 481411 - DNA, 25 bp, Rattus norvegicus
cgagctctaggtgagggcacccatc

SEQ ID NO: 481412 - DNA, 25 bp, Rattus norvegicus
ctcctcatcggtgtcagtgtctcta

SEQ ID NO: 481413 - DNA, 25 bp, Rattus norvegicus
tcatttgaaacccttgcccagcggg

SEQ ID NO: 481414 - DNA, 25 bp, Rattus norvegicus
gctcatattcatgccgctcgccggg

SEQ ID NO: 481415 - DNA, 25 bp, Rattus norvegicus
ggggccatgttcttgctcacgtccc

SEQ ID NO: 481416 - DNA, 25 bp, Rattus norvegicus
gctcgtacacctgcgcctgggagaa

SEQ ID NO: 481417 - DNA, 25 bp, Rattus norvegicus
tgaagcgtcgctcgagctcgtacac

SEQ ID NO: 481418 - DNA, 25 bp, Rattus norvegicus
tgccgtcgaactgcttaaggggttc

SEQ ID NO: 481419 - DNA, 25 bp, Rattus norvegicus
ggggttcaagtctagctactcctca

SEQ ID NO: 481420 - DNA, 25 bp, Rattus norvegicus
cacgcttcagcttgtagcggtggtt

SEQ ID NO: 481421 - DNA, 25 bp, Rattus norvegicus
gtctgggccttggagaacagcaccc

SEQ ID NO: 481422 - DNA, 25 bp, Rattus norvegicus
ccctgccattgcacggtgatcggtc

SEQ ID NO: 481423 - DNA, 25 bp, Rattus norvegicus
cacggtgatcggtcgtgaaccagca

SEQ ID NO: 481424 - DNA, 25 bp, Rattus norvegicus
tcgtgaaccagcacgggtaccacta

SEQ ID NO: 481425 - DNA, 25 bp, Rattus norvegicus
acgggtaccactacgcggcgcagca

SEQ ID NO: 481426 - DNA, 25 bp, Rattus norvegicus
agcggcgtgcagatcagctgatgct

SEQ ID NO: 481427 - DNA, 25 bp, Rattus norvegicus
cagctgatgctgtcacatccgaaga

SEQ ID NO: 481428 - DNA, 25 bp, Rattus norvegicus
gctgtcacatccgaagattctgtga

SEQ ID NO: 481429 - DNA, 25 bp, Rattus norvegicus
tcgcccacgcttcagcttgtagcgg

SEQ ID NO: 481430 - DNA, 25 bp, Rattus norvegicus
gaaagcgccgctccaactccaaagt

SEQ ID NO: 481431 - DNA, 25 bp, Rattus norvegicus
ctccaactccaaagtctgggccttg

SEQ ID NO: 481432 - DNA, 25 bp, Rattus norvegicus
cctcttctctgcgtcggagccaggg

SEQ ID NO: 481433 - DNA, 25 bp, Rattus norvegicus
gcgcagaagtcgagccagctgttcc

SEQ ID NO: 481434 - DNA, 25 bp, Rattus norvegicus
tcgggtaaattcaggaggcttcgca

SEQ ID NO: 481435 - DNA, 25 bp, Rattus norvegicus
tccggggtcttaagtacctgaatga

SEQ ID NO: 481436 - DNA, 25 bp, Rattus norvegicus
ccactcggtgggctttgaaagccac

SEQ ID NO: 481437 - DNA, 25 bp, Rattus norvegicus
cctgaatgagtgctggagcgaagcc

SEQ ID NO: 481438 - DNA, 25 bp, Rattus norvegicus
actcacacgggtagtggctgcgctc

SEQ ID NO: 481439 - DNA, 25 bp, Rattus norvegicus
ccaggcggccgtctgaggaacgcac

SEQ ID NO: 481440 - DNA, 25 bp, Rattus norvegicus
gctgcgcatcctgttcgggtaaatt

SEQ ID NO: 481441 - DNA, 25 bp, Rattus norvegicus
tataaacagcccttgccactcggtg

SEQ ID NO: 481442 - DNA, 25 bp, Rattus norvegicus
cttcgcacggtgaagccgaggcgtc

SEQ ID NO: 481443 - DNA, 25 bp, Rattus norvegicus
gacgccgctcctaaggatggaagtg

SEQ ID NO: 481444 - DNA, 25 bp, Rattus norvegicus
ggcctcaggttatcagcgcctttgc

SEQ ID NO: 481445 - DNA, 25 bp, Rattus norvegicus
cgcctttgcggaggaatccctgttt

SEQ ID NO: 481446 - DNA, 25 bp, Rattus norvegicus
cagtcctggcgcactcacacgggta

SEQ ID NO: 481447 - DNA, 25 bp, Rattus norvegicus
ggaacgcacgtctgttgctcgcacc

SEQ ID NO: 481448 - DNA, 25 bp, Rattus norvegicus
ctaggccgcgaacaaaggggaaatg

SEQ ID NO: 481449 - DNA, 25 bp, Rattus norvegicus
cgctgggataaatcggagcttgtcc

SEQ ID NO: 481450 - DNA, 25 bp, Rattus norvegicus
ggctgaattcgaacctgacaagggc

SEQ ID NO: 481451 - DNA, 25 bp, Rattus norvegicus
tccagctgcagtcctaccaagcgtg

SEQ ID NO: 481452 - DNA, 25 bp, Rattus norvegicus
tcctaccaagcgtgcctgaggtggc

SEQ ID NO: 481453 - DNA, 25 bp, Rattus norvegicus
cggaggctagcccactataggccaa

SEQ ID NO: 481454 - DNA, 25 bp, Rattus norvegicus
ctataggccaactgctaggccgcga

SEQ ID NO: 481455 - DNA, 25 bp, Rattus norvegicus
aatggaactgggacgcccggacctg

SEQ ID NO: 481456 - DNA, 25 bp, Rattus norvegicus
agcatttgttccagcaaagattttg

SEQ ID NO: 481457 - DNA, 25 bp, Rattus norvegicus
agattttgcatttgttcagtccgga

SEQ ID NO: 481458 - DNA, 25 bp, Rattus norvegicus
ccggaataatgcgtgattgacgtct

SEQ ID NO: 481459 - DNA, 25 bp, Rattus norvegicus
tgacgtctgctcacaatgcgcttta

SEQ ID NO: 481460 - DNA, 25 bp, Rattus norvegicus
cccggacctgttggaagcatttgtt

SEQ ID NO: 481461 - DNA, 25 bp, Rattus norvegicus
caatgcgctttagctcgctgggata

SEQ ID NO: 481462 - DNA, 25 bp, Rattus norvegicus
ctgctcgcggtactgcgacccgagt

SEQ ID NO: 481463 - DNA, 25 bp, Rattus norvegicus
tgggcctggccgagattccagccac

SEQ ID NO: 481464 - DNA, 25 bp, Rattus norvegicus
ggccgagattccagccacgcagcat

SEQ ID NO: 481465 - DNA, 25 bp, Rattus norvegicus
gccacgcagcatcgcttgccttgta

SEQ ID NO: 481466 - DNA, 25 bp, Rattus norvegicus
atcgcttgccttgtagagtttgacc

SEQ ID NO: 481467 - DNA, 25 bp, Rattus norvegicus
ttgtagagtttgacctgtggccgga

SEQ ID NO: 481468 - DNA, 25 bp, Rattus norvegicus
ccggagcggtctcagaatctagcga

SEQ ID NO: 481469 - DNA, 25 bp, Rattus norvegicus
ttcctcgggaggtggcgccacagcc

SEQ ID NO: 481470 - DNA, 25 bp, Rattus norvegicus
tctcagaatctagcgatcccgcatc

SEQ ID NO: 481471 - DNA, 25 bp, Rattus norvegicus
tagcgatcccgcatcgctcgggtgc

SEQ ID NO: 481472 - DNA, 25 bp, Rattus norvegicus
tgcgcgtcctcttccagatgcttca

SEQ ID NO: 481473 - DNA, 25 bp, Rattus norvegicus
ttccagatgcttcagccgtgggtgt

SEQ ID NO: 481474 - DNA, 25 bp, Rattus norvegicus
tgtcccaggcgcctgctgttgggct

SEQ ID NO: 481475 - DNA, 25 bp, Rattus norvegicus
cccgcagctcaacgctggtgtgggc

SEQ ID NO: 481476 - DNA, 25 bp, Rattus norvegicus
tggcgaaccctgcttgcctgtaggc

SEQ ID NO: 481477 - DNA, 25 bp, Rattus norvegicus
gagggtctttacctgcaactccgcc

SEQ ID NO: 481478 - DNA, 25 bp, Rattus norvegicus
tcgaagcgggcccattcgtgctgca

SEQ ID NO: 481479 - DNA, 25 bp, Rattus norvegicus
tcgtgctgcaggaagtgcaagatcc

SEQ ID NO: 481480 - DNA, 25 bp, Rattus norvegicus
ccagctcccggatggttgttgctga

SEQ ID NO: 481481 - DNA, 25 bp, Rattus norvegicus
ttgttgctgaagaagacgccgggcc

SEQ ID NO: 481482 - DNA, 25 bp, Rattus norvegicus
tgcttgcctgtaggcctgcgtctct

SEQ ID NO: 481483 - DNA, 25 bp, Rattus norvegicus
aggcgggactgaagccacgcccttt

SEQ ID NO: 481484 - DNA, 25 bp, Rattus norvegicus
cgcgggtttcctcctcagaggtgta

SEQ ID NO: 481485 - DNA, 25 bp, Rattus norvegicus
ctcctcagaggtgtagccagccgat

SEQ ID NO: 481486 - DNA, 25 bp, Rattus norvegicus
ccctttcatgcggaagttcgcgggc

SEQ ID NO: 481487 - DNA, 25 bp, Rattus norvegicus
ggcggcgctccctgttgcatactca

SEQ ID NO: 481488 - DNA, 25 bp, Rattus norvegicus
caggccgggagggtctttacctgca

SEQ ID NO: 481489 - DNA, 25 bp, Rattus norvegicus
ctgtaggcctgcgtctctcggaggc

SEQ ID NO: 481490 - DNA, 25 bp, Rattus norvegicus
ctcacgtgtgaagtaggacctgttg

SEQ ID NO: 481491 - DNA, 25 bp, Rattus norvegicus
cgcgagcacgctaatgattcccgtt

SEQ ID NO: 481492 - DNA, 25 bp, Rattus norvegicus
catccacgggagtgggacagttttc

SEQ ID NO: 481493 - DNA, 25 bp, Rattus norvegicus
tcaaggttgcacagagctagtcatc

SEQ ID NO: 481494 - DNA, 25 bp, Rattus norvegicus
gggtcaactctcacgctgctcaagg

SEQ ID NO: 481495 - DNA, 25 bp, Rattus norvegicus
tcgtgaccttgagctagacccgcgt

SEQ ID NO: 481496 - DNA, 25 bp, Rattus norvegicus
gtctccggcctttgcgacaggtcaa

SEQ ID NO: 481497 - DNA, 25 bp, Rattus norvegicus
tcgtaggcctagtaacctcggtcta

SEQ ID NO: 481498 - DNA, 25 bp, Rattus norvegicus
cgggaccctaatattgattggttga

SEQ ID NO: 481499 - DNA, 25 bp, Rattus norvegicus
atctgtctgttgctccgggaaacgc

SEQ ID NO: 481500 - DNA, 25 bp, Rattus norvegicus
cgccaccaaactcgagatctggatc

SEQ ID NO: 481501 - DNA, 25 bp, Rattus norvegicus
gcccggcttttactcatggcctttc

SEQ ID NO: 481502 - DNA, 25 bp, Rattus norvegicus
tcctgcaggtaccttaggacgatcc

SEQ ID NO: 481503 - DNA, 25 bp, Rattus norvegicus
gattcccgttttcgtgtcgcatgta

SEQ ID NO: 481504 - DNA, 25 bp, Rattus norvegicus
gttgttttccgcaattgcaggaccc

SEQ ID NO: 481505 - DNA, 25 bp, Rattus norvegicus
tgctcgtcaggtctgcaaaaacacc

SEQ ID NO: 481506 - DNA, 25 bp, Rattus norvegicus
tcacaaaaattgctcgtcaggtctg

SEQ ID NO: 481507 - DNA, 25 bp, Rattus norvegicus
cctccatactacgtatttcacaaaa

SEQ ID NO: 481508 - DNA, 25 bp, Rattus norvegicus
aagctttcttcctccatactacgta

SEQ ID NO: 481509 - DNA, 25 bp, Rattus norvegicus
cggccgtgaagacccgccaagcttt

SEQ ID NO: 481510 - DNA, 25 bp, Rattus norvegicus
caagtcggccgtgaagacccgccaa

SEQ ID NO: 481511 - DNA, 25 bp, Rattus norvegicus
catgccggtccggaacaccgggagc

SEQ ID NO: 481512 - DNA, 25 bp, Rattus norvegicus
ccttgcagggcatgccggtccggaa

SEQ ID NO: 481513 - DNA, 25 bp, Rattus norvegicus
acctgtcccggcaggccttgcaggg

SEQ ID NO: 481514 - DNA, 25 bp, Rattus norvegicus
gcgtgagaagccacctgtcccggca

SEQ ID NO: 481515 - DNA, 25 bp, Rattus norvegicus
gcaattgcaggacccgcgcgtgaga

SEQ ID NO: 481516 - DNA, 25 bp, Rattus norvegicus
ggtctgcaaaaacaccctgcggctg

SEQ ID NO: 481517 - DNA, 25 bp, Rattus norvegicus
tttccgcaattgcaggacccgcgcg

SEQ ID NO: 481518 - DNA, 25 bp, Rattus norvegicus
gccgtgggcatcttcccagctcttg

SEQ ID NO: 481519 - DNA, 25 bp, Rattus norvegicus
aagcttctggctgcccgggtgcgtc

SEQ ID NO: 481520 - DNA, 25 bp, Rattus norvegicus
ccttggggtcccctgaagcttctgg

SEQ ID NO: 481521 - DNA, 25 bp, Rattus norvegicus
agaaagcgacgcttcgggagtcctt

SEQ ID NO: 481522 - DNA, 25 bp, Rattus norvegicus
gtggaaggctgaacagccagaaagc

SEQ ID NO: 481523 - DNA, 25 bp, Rattus norvegicus
tccatctggtggaaggctgaacagc

SEQ ID NO: 481524 - DNA, 25 bp, Rattus norvegicus
tgtgaggttcctccatctggtggaa

SEQ ID NO: 481525 - DNA, 25 bp, Rattus norvegicus
ccgcagaggagaaaagcctttcgga

SEQ ID NO: 481526 - DNA, 25 bp, Rattus norvegicus
tcttgcccaccctccggcagcctca

SEQ ID NO: 481527 - DNA, 25 bp, Rattus norvegicus
gcctttcggaatgtgaggttcctcc

SEQ ID NO: 481528 - DNA, 25 bp, Rattus norvegicus
gccggactccagcactggctccttg

SEQ ID NO: 481529 - DNA, 25 bp, Rattus norvegicus
agagagccggctctaagcgctcgcc

SEQ ID NO: 481530 - DNA, 25 bp, Rattus norvegicus
tcacctgccgcagaggagaaaagcc

SEQ ID NO: 481531 - DNA, 25 bp, Rattus norvegicus
ctgccgcagaggagaaaagcctttc

SEQ ID NO: 481532 - DNA, 25 bp, Rattus norvegicus
gcgctctattgactcagaccgcgtc

SEQ ID NO: 481533 - DNA, 25 bp, Rattus norvegicus
gaagccaaggcacccgcggcttgga

SEQ ID NO: 481534 - DNA, 25 bp, Rattus norvegicus
cttggagcagcgacaggccggccca

SEQ ID NO: 481535 - DNA, 25 bp, Rattus norvegicus
tttctttctgggagtgcggaactgg

SEQ ID NO: 481536 - DNA, 25 bp, Rattus norvegicus
ctcctcccggggagaagccaaggca

SEQ ID NO: 481537 - DNA, 25 bp, Rattus norvegicus
agaccgcgtccctacgagttgtatg

SEQ ID NO: 481538 - DNA, 25 bp, Rattus norvegicus
tacgagttgtatgcacacgccaagg

SEQ ID NO: 481539 - DNA, 25 bp, Rattus norvegicus
acacgccaagggtcagcggctaaaa

SEQ ID NO: 481540 - DNA, 25 bp, Rattus norvegicus
ctaaaagggtgctgtgggagctacc

SEQ ID NO: 481541 - DNA, 25 bp, Rattus norvegicus
gagctaccgagtggcagttgatgcc

SEQ ID NO: 481542 - DNA, 25 bp, Rattus norvegicus
ggcagttgatgccatttcccgattt

SEQ ID NO: 481543 - DNA, 25 bp, Rattus norvegicus
gccatttcccgattttaacagacga

SEQ ID NO: 481544 - DNA, 25 bp, Rattus norvegicus
tttaacagacgagggccgtggcact

SEQ ID NO: 481545 - DNA, 25 bp, Rattus norvegicus
ccggcccagtgagagcaaggaaaaa

SEQ ID NO: 481546 - DNA, 25 bp, Rattus norvegicus
ttcctgcaagcggtcgggaatccca

SEQ ID NO: 481547 - DNA, 25 bp, Rattus norvegicus
gtcaccgacatcctgggcatccgtt

SEQ ID NO: 481548 - DNA, 25 bp, Rattus norvegicus
tggcccagcagggtcactacgactc

SEQ ID NO: 481549 - DNA, 25 bp, Rattus norvegicus
cagccggattctgcgcaacaagatc

SEQ ID NO: 481550 - DNA, 25 bp, Rattus norvegicus
tctgtgagttccatcagccggattc

SEQ ID NO: 481551 - DNA, 25 bp, Rattus norvegicus
tggcgtgtgcgacaagtacaacgta

SEQ ID NO: 481552 - DNA, 25 bp, Rattus norvegicus
atctttgcttgggagatccgggacc

SEQ ID NO: 481553 - DNA, 25 bp, Rattus norvegicus
cagagggacccaggcatctttgctt

SEQ ID NO: 481554 - DNA, 25 bp, Rattus norvegicus
cagcaagatcttggcgcgctacaac

SEQ ID NO: 481555 - DNA, 25 bp, Rattus norvegicus
gggcatccgaccttgtgacatcagc

SEQ ID NO: 481556 - DNA, 25 bp, Rattus norvegicus
catcgtggaattagcccaactgggc

SEQ ID NO: 481557 - DNA, 25 bp, Rattus norvegicus
acgccattcggcttcgcatcgtgga

SEQ ID NO: 481558 - DNA, 25 bp, Rattus norvegicus
gcgcgctctatggtccttttgcaga

SEQ ID NO: 481559 - DNA, 25 bp, Rattus norvegicus
ggaatcccagtaccttcggcctcta

SEQ ID NO: 481560 - DNA, 25 bp, Rattus norvegicus
ggcagccttacctgcacaccctccg

SEQ ID NO: 481561 - DNA, 25 bp, Rattus norvegicus
cacacaaactttcggttggaaggcg

SEQ ID NO: 481562 - DNA, 25 bp, Rattus norvegicus
tcctctgctcttcgccgagtcagag

SEQ ID NO: 481563 - DNA, 25 bp, Rattus norvegicus
aaggcgagccttggggacgttgtcg

SEQ ID NO: 481564 - DNA, 25 bp, Rattus norvegicus
cacaaactttcggttggaaggcgag

SEQ ID NO: 481565 - DNA, 25 bp, Rattus norvegicus
ggagcgggcagccttacctgcacac

SEQ ID NO: 481566 - DNA, 25 bp, Rattus norvegicus
ggacgcacacaaactttcggttgga

SEQ ID NO: 481567 - DNA, 25 bp, Rattus norvegicus
gaggacgcacacaaactttcggttg

SEQ ID NO: 481568 - DNA, 25 bp, Rattus norvegicus
ttaggaggacgcacacaaactttcg

SEQ ID NO: 481569 - DNA, 25 bp, Rattus norvegicus
tggaagatttaggaggacgcacaca

SEQ ID NO: 481570 - DNA, 25 bp, Rattus norvegicus
ccgagtcagagtggaagatttagga

SEQ ID NO: 481571 - DNA, 25 bp, Rattus norvegicus
tcgccgagtcagagtggaagattta

SEQ ID NO: 481572 - DNA, 25 bp, Rattus norvegicus
ctgctcttcgccgagtcagagtgga

SEQ ID NO: 481573 - DNA, 25 bp, Rattus norvegicus
actttcggttggaaggcgagccttg

SEQ ID NO: 481574 - DNA, 25 bp, Rattus norvegicus
cggtccagctaaagacggcggttct

SEQ ID NO: 481575 - DNA, 25 bp, Rattus norvegicus
caggggacagagtagccaagatgct

SEQ ID NO: 481576 - DNA, 25 bp, Rattus norvegicus
tgtggctgcggtccagctaaagacg

SEQ ID NO: 481577 - DNA, 25 bp, Rattus norvegicus
aagtcttccctgtgtggctgcggtc

SEQ ID NO: 481578 - DNA, 25 bp, Rattus norvegicus
tcccgtcggttctggggctgaagtc

SEQ ID NO: 481579 - DNA, 25 bp, Rattus norvegicus
gagcgagctcctctgaaggccgccg

SEQ ID NO: 481580 - DNA, 25 bp, Rattus norvegicus
aaagacggcggttctggcaccggct

SEQ ID NO: 481581 - DNA, 25 bp, Rattus norvegicus
atcttcgtgaccaggggacagagta

SEQ ID NO: 481582 - DNA, 25 bp, Rattus norvegicus
ccgacatcttcgtgaccaggggaca

SEQ ID NO: 481583 - DNA, 25 bp, Rattus norvegicus
gttggaggccgacatcttcgtgacc

SEQ ID NO: 481584 - DNA, 25 bp, Rattus norvegicus
tctcgtgcagcaagctgacgttgga

SEQ ID NO: 481585 - DNA, 25 bp, Rattus norvegicus
acctgcctgcaggtctcgtgcagca

SEQ ID NO: 481586 - DNA, 25 bp, Rattus norvegicus
agatgctggagcgagctcctctgaa

SEQ ID NO: 481587 - DNA, 25 bp, Rattus norvegicus
gacagagtagccaagatgctggagc

SEQ ID NO: 481588 - DNA, 25 bp, Rattus norvegicus
tttaagaattgaccgcgagagtgcc

SEQ ID NO: 481589 - DNA, 25 bp, Rattus norvegicus
ccctggaagaatgcaggagtactgc

SEQ ID NO: 481590 - DNA, 25 bp, Rattus norvegicus
atcccgtggctccacaggtaacggc

SEQ ID NO: 481591 - DNA, 25 bp, Rattus norvegicus
tctccacgcaaacggaaaccacagt

SEQ ID NO: 481592 - DNA, 25 bp, Rattus norvegicus
agagtgccggccacctttggtagcc

SEQ ID NO: 481593 - DNA, 25 bp, Rattus norvegicus
tgggcccttaaggatcccgtggctc

SEQ ID NO: 481594 - DNA, 25 bp, Rattus norvegicus
cacaggacccgcgaactgcgtgagc

SEQ ID NO: 481595 - DNA, 25 bp, Rattus norvegicus
cccgccctttttggtcactcagagg

SEQ ID NO: 481596 - DNA, 25 bp, Rattus norvegicus
ttctcgcgtgcgtgcagcacgtttc

SEQ ID NO: 481597 - DNA, 25 bp, Rattus norvegicus
tgcttcccggagcaatccgtaggtc

SEQ ID NO: 481598 - DNA, 25 bp, Rattus norvegicus
tcgaacaagacttccaggccacgtt

SEQ ID NO: 481599 - DNA, 25 bp, Rattus norvegicus
cacacgtttctgcagagttagcgcg

SEQ ID NO: 481600 - DNA, 25 bp, Rattus norvegicus
ggctgagctcacgaaccacacgttt

SEQ ID NO: 481601 - DNA, 25 bp, Rattus norvegicus
tcgcggcgttcacaggtgacacgcc

SEQ ID NO: 481602 - DNA, 25 bp, Rattus norvegicus
cccagtccgggtcctgcagcgtcgc

SEQ ID NO: 481603 - DNA, 25 bp, Rattus norvegicus
cgcgatggagctgagtaaacacagc

SEQ ID NO: 481604 - DNA, 25 bp, Rattus norvegicus
tagctagggccactgggcagccgcc

SEQ ID NO: 481605 - DNA, 25 bp, Rattus norvegicus
agctagggccactgggcagccgcct

SEQ ID NO: 481606 - DNA, 25 bp, Rattus norvegicus
aggccgcgatggagctgagtaaaca

SEQ ID NO: 481607 - DNA, 25 bp, Rattus norvegicus
gccgcgatggagctgagtaaacaca

SEQ ID NO: 481608 - DNA, 25 bp, Rattus norvegicus
ccgcgatggagctgagtaaacacag

SEQ ID NO: 481609 - DNA, 25 bp, Rattus norvegicus
cgatggagctgagtaaacacagcgc

SEQ ID NO: 481610 - DNA, 25 bp, Rattus norvegicus
tggagctgagtaaacacagcgctgc

SEQ ID NO: 481611 - DNA, 25 bp, Rattus norvegicus
agctgagtaaacacagcgctgcggg

SEQ ID NO: 481612 - DNA, 25 bp, Rattus norvegicus
ctgagtaaacacagcgctgcggggc

SEQ ID NO: 481613 - DNA, 25 bp, Rattus norvegicus
tgagtaaacacagcgctgcggggcc

SEQ ID NO: 481614 - DNA, 25 bp, Rattus norvegicus
cccacctctgcccagtccgggtcct

SEQ ID NO: 481615 - DNA, 25 bp, Rattus norvegicus
gtaaacacagcgctgcggggcccgc

SEQ ID NO: 481616 - DNA, 25 bp, Rattus norvegicus
ggtcagttggaagccctcctcgcca

SEQ ID NO: 481617 - DNA, 25 bp, Rattus norvegicus
tgcgccgctggaagcacagatgttt

SEQ ID NO: 481618 - DNA, 25 bp, Rattus norvegicus
agcacagatgttttcttcctggccc

SEQ ID NO: 481619 - DNA, 25 bp, Rattus norvegicus
gtttccgaggaagggattacgcagc

SEQ ID NO: 481620 - DNA, 25 bp, Rattus norvegicus
gactttttaggtctgtggctcaaca

SEQ ID NO: 481621 - DNA, 25 bp, Rattus norvegicus
ctgtggctcaacagaagatttattc

SEQ ID NO: 481622 - DNA, 25 bp, Rattus norvegicus
tattcgctaggaggggaaaatgccc

SEQ ID NO: 481623 - DNA, 25 bp, Rattus norvegicus
tgcccaaacaatgaagaactaactg

SEQ ID NO: 481624 - DNA, 25 bp, Rattus norvegicus
taactgcatttgtcacctcgggatg

SEQ ID NO: 481625 - DNA, 25 bp, Rattus norvegicus
cgtagactcggaaccggctcgaagc

SEQ ID NO: 481626 - DNA, 25 bp, Rattus norvegicus
tgaaactttccacttgggtcagttg

SEQ ID NO: 481627 - DNA, 25 bp, Rattus norvegicus
gctgagccctgtacgtccactttct

SEQ ID NO: 481628 - DNA, 25 bp, Rattus norvegicus
tccactttctggaggatgaagcacg

SEQ ID NO: 481629 - DNA, 25 bp, Rattus norvegicus
aaaaatctgagctccgggcgtctgc

SEQ ID NO: 481630 - DNA, 25 bp, Rattus norvegicus
cccgatgaatgggtgattcggcact

SEQ ID NO: 481631 - DNA, 25 bp, Rattus norvegicus
acggcgcaagtagcagccgttctcg

SEQ ID NO: 481632 - DNA, 25 bp, Rattus norvegicus
gggatcgcgccaccttgacgaaaca

SEQ ID NO: 481633 - DNA, 25 bp, Rattus norvegicus
cgctgctggttctgacggtaatagg

SEQ ID NO: 481634 - DNA, 25 bp, Rattus norvegicus
ccactggtagatttcgctcagcgtg

SEQ ID NO: 481635 - DNA, 25 bp, Rattus norvegicus
tcagcgtgagcatcttgctgggcgc

SEQ ID NO: 481636 - DNA, 25 bp, Rattus norvegicus
agggtaactgcgcttgaacgtcttg

SEQ ID NO: 481637 - DNA, 25 bp, Rattus norvegicus
ccagattggacggagcgtacgccat

SEQ ID NO: 481638 - DNA, 25 bp, Rattus norvegicus
cgccatgggactcatgcacgggttc

SEQ ID NO: 481639 - DNA, 25 bp, Rattus norvegicus
cgtagggacccaggccgttcataga

SEQ ID NO: 481640 - DNA, 25 bp, Rattus norvegicus
cgtcatgctgttcatggcgcctgca

SEQ ID NO: 481641 - DNA, 25 bp, Rattus norvegicus
ctaagcccgggttggcgtaggacat

SEQ ID NO: 481642 - DNA, 25 bp, Rattus norvegicus
acatgttgaaggaagccggggtcat

SEQ ID NO: 481643 - DNA, 25 bp, Rattus norvegicus
tgaagcgcttttgacggcgcaagta

SEQ ID NO: 481644 - DNA, 25 bp, Rattus norvegicus
gcgtgaccgagatgcctcccggtaa

SEQ ID NO: 481645 - DNA, 25 bp, Rattus norvegicus
ctacaaagcccgaggtgcacctgtg

SEQ ID NO: 481646 - DNA, 25 bp, Rattus norvegicus
atcttacgtcgctggagtgcccacc

SEQ ID NO: 481647 - DNA, 25 bp, Rattus norvegicus
gttgggctgatgtggatcttacgtc

SEQ ID NO: 481648 - DNA, 25 bp, Rattus norvegicus
agctgttccagtcgttgctctcatg

SEQ ID NO: 481649 - DNA, 25 bp, Rattus norvegicus
cgccagaatccagcgggcagtaggc

SEQ ID NO: 481650 - DNA, 25 bp, Rattus norvegicus
tcagctccttacaagcgccagaatc

SEQ ID NO: 481651 - DNA, 25 bp, Rattus norvegicus
tttgtccgccgcacaaagacgctcg

SEQ ID NO: 481652 - DNA, 25 bp, Rattus norvegicus
ggctaattaagtggcgtgaccgaga

SEQ ID NO: 481653 - DNA, 25 bp, Rattus norvegicus
gtgcttcccggagtcggtgttttca

SEQ ID NO: 481654 - DNA, 25 bp, Rattus norvegicus
cggtaagcgaccaccgactctctta

SEQ ID NO: 481655 - DNA, 25 bp, Rattus norvegicus
gactctcttagttgctcttaactca

SEQ ID NO: 481656 - DNA, 25 bp, Rattus norvegicus
tctaccgggcaaaggctagtgcttc

SEQ ID NO: 481657 - DNA, 25 bp, Rattus norvegicus
cggtgttttcaaagctcagagtttc

SEQ ID NO: 481658 - DNA, 25 bp, Rattus norvegicus
gcgcgtgcgcataaactcctgtgcg

SEQ ID NO: 481659 - DNA, 25 bp, Rattus norvegicus
agcgacttgggatgttaccagaagc

SEQ ID NO: 481660 - DNA, 25 bp, Rattus norvegicus
taccagaagctcgtggagagtgtcc

SEQ ID NO: 481661 - DNA, 25 bp, Rattus norvegicus
caacctgatgaattcccgcctagta

SEQ ID NO: 481662 - DNA, 25 bp, Rattus norvegicus
cgagggtccaggtctctcaccagaa

SEQ ID NO: 481663 - DNA, 25 bp, Rattus norvegicus
acccggctcagcagaggctcgtaag

SEQ ID NO: 481664 - DNA, 25 bp, Rattus norvegicus
ttgctaagcctgttcgtcccacgcg

SEQ ID NO: 481665 - DNA, 25 bp, Rattus norvegicus
tcctgtgcgcattctccggacggaa

SEQ ID NO: 481666 - DNA, 25 bp, Rattus norvegicus
cgtcaaaatacgttccgggcgctga

SEQ ID NO: 481667 - DNA, 25 bp, Rattus norvegicus
aacctgcactactgaagcccaatga

SEQ ID NO: 481668 - DNA, 25 bp, Rattus norvegicus
gaggaaattccatctgcggagctta

SEQ ID NO: 481669 - DNA, 25 bp, Rattus norvegicus
gctcccattggagcggggaaagatc

SEQ ID NO: 481670 - DNA, 25 bp, Rattus norvegicus
cgggagagactgcaacgcctatgtc

SEQ ID NO: 481671 - DNA, 25 bp, Rattus norvegicus
ggcccggcagtcacaataacaccaa

SEQ ID NO: 481672 - DNA, 25 bp, Rattus norvegicus
acagcaggcagcagttcgacgaaga

SEQ ID NO: 481673 - DNA, 25 bp, Rattus norvegicus
ttcgacgaagaaggggcacgtgtcc

SEQ ID NO: 481674 - DNA, 25 bp, Rattus norvegicus
gaagccgaggaaaacgcgcgtttgc

SEQ ID NO: 481675 - DNA, 25 bp, Rattus norvegicus
gctaagccatcctcagccaagctgt

SEQ ID NO: 481676 - DNA, 25 bp, Rattus norvegicus
caagctgtcgtctagggtgctgagc

SEQ ID NO: 481677 - DNA, 25 bp, Rattus norvegicus
gcagccctgggaagcctcagccatt

SEQ ID NO: 481678 - DNA, 25 bp, Rattus norvegicus
ttccagcgagagatcatgcggtggc

SEQ ID NO: 481679 - DNA, 25 bp, Rattus norvegicus
cgcgggaattctacctgcggagctc

SEQ ID NO: 481680 - DNA, 25 bp, Rattus norvegicus
tgcccgatccgtgtttctgctgcgg

SEQ ID NO: 481681 - DNA, 25 bp, Rattus norvegicus
tggccaagcgcgtgtccaagagccc

SEQ ID NO: 481682 - DNA, 25 bp, Rattus norvegicus
gtggcatcacaagccctcgtccaga

SEQ ID NO: 481683 - DNA, 25 bp, Rattus norvegicus
gcacggatcgcccttgatcgacatg

SEQ ID NO: 481684 - DNA, 25 bp, Rattus norvegicus
tgtctagcctgagcagcgaagccga

SEQ ID NO: 481685 - DNA, 25 bp, Rattus norvegicus
agccaagtcttcgtcctccgctaag

SEQ ID NO: 481686 - DNA, 25 bp, Rattus norvegicus
ccctcgggctgagaagccgagctag

SEQ ID NO: 481687 - DNA, 25 bp, Rattus norvegicus
cggcctcgcgccatcggaagggcgg

SEQ ID NO: 481688 - DNA, 25 bp, Rattus norvegicus
gctgcccggcctcgcgccatcggaa

SEQ ID NO: 481689 - DNA, 25 bp, Rattus norvegicus
gccgagctaggctccgctgcccggc

SEQ ID NO: 481690 - DNA, 25 bp, Rattus norvegicus
agccgagctaggctccgctgcccgg

SEQ ID NO: 481691 - DNA, 25 bp, Rattus norvegicus
gaagccgagctaggctccgctgccc

SEQ ID NO: 481692 - DNA, 25 bp, Rattus norvegicus
tgagaagccgagctaggctccgctg

SEQ ID NO: 481693 - DNA, 25 bp, Rattus norvegicus
ctgagaagccgagctaggctccgct

SEQ ID NO: 481694 - DNA, 25 bp, Rattus norvegicus
ctcgggctgagaagccgagctaggc

SEQ ID NO: 481695 - DNA, 25 bp, Rattus norvegicus
accctcgggctgagaagccgagcta

SEQ ID NO: 481696 - DNA, 25 bp, Rattus norvegicus
ctcgcgccatcggaagggcgggccg

SEQ ID NO: 481697 - DNA, 25 bp, Rattus norvegicus
cgcgccatcggaagggcgggccggg

SEQ ID NO: 481698 - DNA, 25 bp, Rattus norvegicus
gctgagaagccgagctaggctccgc

SEQ ID NO: 481699 - DNA, 25 bp, Rattus norvegicus
gcctcgcgccatcggaagggcgggc

SEQ ID NO: 481700 - DNA, 25 bp, Rattus norvegicus
ttcgcttcccggagcggatgggagc

SEQ ID NO: 481701 - DNA, 25 bp, Rattus norvegicus
cggtgcgagctcgatcccgcagact

SEQ ID NO: 481702 - DNA, 25 bp, Rattus norvegicus
agccgcgcggcgactctgtccgccc

SEQ ID NO: 481703 - DNA, 25 bp, Rattus norvegicus
cccggactcccgacactggctcaca

SEQ ID NO: 481704 - DNA, 25 bp, Rattus norvegicus
actggctcacagtcctcagtccggt

SEQ ID NO: 481705 - DNA, 25 bp, Rattus norvegicus
tcagtccggtcccacgttgcgggaa

SEQ ID NO: 481706 - DNA, 25 bp, Rattus norvegicus
tccggtcccacgttgcgggaagctg

SEQ ID NO: 481707 - DNA, 25 bp, Rattus norvegicus
gcatgctccaccgacgccttgccgg

SEQ ID NO: 481708 - DNA, 25 bp, Rattus norvegicus
gccttgccgggtctgatagagcctt

SEQ ID NO: 481709 - DNA, 25 bp, Rattus norvegicus
gccgggtctgatagagccttcgcaa

SEQ ID NO: 481710 - DNA, 25 bp, Rattus norvegicus
tctgatagagccttcgcaaggcggc

SEQ ID NO: 481711 - DNA, 25 bp, Rattus norvegicus
agagccttcgcaaggcggccacagc

SEQ ID NO: 481712 - DNA, 25 bp, Rattus norvegicus
caggcggcggatgcgcatgctccac

SEQ ID NO: 481713 - DNA, 25 bp, Rattus norvegicus
cctgcctggcttgtctgcgcgtgcg

SEQ ID NO: 481714 - DNA, 25 bp, Rattus norvegicus
cacggtgagccagttgtctgtcatc

SEQ ID NO: 481715 - DNA, 25 bp, Rattus norvegicus
acggtggcctgcaacatgctcatgc

SEQ ID NO: 481716 - DNA, 25 bp, Rattus norvegicus
tggatgcctttctacgtggtacagc

SEQ ID NO: 481717 - DNA, 25 bp, Rattus norvegicus
gggtagcgccattctcatctctttc

SEQ ID NO: 481718 - DNA, 25 bp, Rattus norvegicus
tagtcaacgtgttcgccgagcaaga

SEQ ID NO: 481719 - DNA, 25 bp, Rattus norvegicus
tgactgtgcttagtgtggaccgcta

SEQ ID NO: 481720 - DNA, 25 bp, Rattus norvegicus
cagcgtggatgcagtcaacatgttc

SEQ ID NO: 481721 - DNA, 25 bp, Rattus norvegicus
agcgtgccctttctggtcacttcca

SEQ ID NO: 481722 - DNA, 25 bp, Rattus norvegicus
cctggccattgctgatgagctgctc

SEQ ID NO: 481723 - DNA, 25 bp, Rattus norvegicus
ggtcatttacgtgatcctgcgctac

SEQ ID NO: 481724 - DNA, 25 bp, Rattus norvegicus
gccatctgcctgtgttacgtgctca

SEQ ID NO: 481725 - DNA, 25 bp, Rattus norvegicus
tgcacccgatcaaggcagcgcgcta

SEQ ID NO: 481726 - DNA, 25 bp, Rattus norvegicus
ctacggcttcctgtcggacaacttc

SEQ ID NO: 481727 - DNA, 25 bp, Rattus norvegicus
actggttatcttgcccatcgtggtc

SEQ ID NO: 481728 - DNA, 25 bp, Rattus norvegicus
gctaagggttagaccgcgtcgttca

SEQ ID NO: 481729 - DNA, 25 bp, Rattus norvegicus
aggttagaccgcgtcactcagagtc

SEQ ID NO: 481730 - DNA, 25 bp, Rattus norvegicus
gctaagggctagaccgcatcactca

SEQ ID NO: 481731 - DNA, 25 bp, Rattus norvegicus
cgtcactcagagaagctaagggtta

SEQ ID NO: 481732 - DNA, 25 bp, Rattus norvegicus
gctaagggttagaccgcgtcactca

SEQ ID NO: 481733 - DNA, 25 bp, Rattus norvegicus
gctaagggttagaccacgtcgttca

SEQ ID NO: 481734 - DNA, 25 bp, Rattus norvegicus
tagaccgcgtcgttcagagaagcta

SEQ ID NO: 481735 - DNA, 25 bp, Rattus norvegicus
ctagaccgcgtcgttcagagaagct

SEQ ID NO: 481736 - DNA, 25 bp, Rattus norvegicus
gctaagggttagaccgcgtcattca

SEQ ID NO: 481737 - DNA, 25 bp, Rattus norvegicus
ttgaccgcgtcgttcagagaagcta

SEQ ID NO: 481738 - DNA, 25 bp, Rattus norvegicus
gctaagggttagactgcgtcactca

SEQ ID NO: 481739 - DNA, 25 bp, Rattus norvegicus
agctaaggttagaccgcgtcgttca

SEQ ID NO: 481740 - DNA, 25 bp, Rattus norvegicus
agggctagaccgcatcactcagaga

SEQ ID NO: 481741 - DNA, 25 bp, Rattus norvegicus
cgtcactcagagaagctaaaggcta

SEQ ID NO: 481742 - DNA, 25 bp, Rattus norvegicus
gcgagcgtgaaggaagtccaagcaa

SEQ ID NO: 481743 - DNA, 25 bp, Rattus norvegicus
gcgagcaggaagcaataggcggggc

SEQ ID NO: 481744 - DNA, 25 bp, Rattus norvegicus
cagagggcggggacaattcaggaag

SEQ ID NO: 481745 - DNA, 25 bp, Rattus norvegicus
aaggaagtccaagcaaagcaaagca

SEQ ID NO: 481746 - DNA, 25 bp, Rattus norvegicus
gcctctgccacgtcaaatgggagga

SEQ ID NO: 481747 - DNA, 25 bp, Rattus norvegicus
gagtaataaagagggtggggcgagc

SEQ ID NO: 481748 - DNA, 25 bp, Rattus norvegicus
atgaaccggagtaataaagagggtg

SEQ ID NO: 481749 - DNA, 25 bp, Rattus norvegicus
gcggaaaagatgaaccggagtaata

SEQ ID NO: 481750 - DNA, 25 bp, Rattus norvegicus
tggcggaaaagatgaaccggagtaa

SEQ ID NO: 481751 - DNA, 25 bp, Rattus norvegicus
aatgggagggatgagtggcggaaaa

SEQ ID NO: 481752 - DNA, 25 bp, Rattus norvegicus
gcgcgcaggaggtaatgggagggat

SEQ ID NO: 481753 - DNA, 25 bp, Rattus norvegicus
aggaggcggggatgcgactaacgga

SEQ ID NO: 481754 - DNA, 25 bp, Rattus norvegicus
tctgccacgtcaaatgggaggaggc

SEQ ID NO: 481755 - DNA, 25 bp, Rattus norvegicus
gcgtgaaggaagtccaagcaaagca

SEQ ID NO: 481756 - DNA, 25 bp, Rattus norvegicus
gccctgtgacttgacggaaggtttc

SEQ ID NO: 481757 - DNA, 25 bp, Rattus norvegicus
ggtacaggcgccaatagagactggc

SEQ ID NO: 481758 - DNA, 25 bp, Rattus norvegicus
tagcatgttgctccgactccttacg

SEQ ID NO: 481759 - DNA, 25 bp, Rattus norvegicus
gcttgagcgcctgcgcggtacctac

SEQ ID NO: 481760 - DNA, 25 bp, Rattus norvegicus
tacctaccttgggtacaggcgccaa

SEQ ID NO: 481761 - DNA, 25 bp, Rattus norvegicus
gagactggcgggagtaaataccatg

SEQ ID NO: 481762 - DNA, 25 bp, Rattus norvegicus
aaataccatggcgtgggttccagcc

SEQ ID NO: 481763 - DNA, 25 bp, Rattus norvegicus
cggagccataagcttgacgcaacta

SEQ ID NO: 481764 - DNA, 25 bp, Rattus norvegicus
gttgttacctgtggagccctgtgac

SEQ ID NO: 481765 - DNA, 25 bp, Rattus norvegicus
taagcttgacgcaactagcatgttg

SEQ ID NO: 481766 - DNA, 25 bp, Rattus norvegicus
cttgacggaaggtttcgatccctcg

SEQ ID NO: 481767 - DNA, 25 bp, Rattus norvegicus
aagagttgatgccacggttgttacc

SEQ ID NO: 481768 - DNA, 25 bp, Rattus norvegicus
actccttacgcctgtggcgggtggc

SEQ ID NO: 481769 - DNA, 25 bp, Rattus norvegicus
gctacattctaccaccggagccata

SEQ ID NO: 481770 - DNA, 25 bp, Rattus norvegicus
atggagcagaagctggcaggtaggc

SEQ ID NO: 481771 - DNA, 25 bp, Rattus norvegicus
cgcatggccaaggaacggaattgga

SEQ ID NO: 481772 - DNA, 25 bp, Rattus norvegicus
gccaaggaacggaattggagagtaa

SEQ ID NO: 481773 - DNA, 25 bp, Rattus norvegicus
ggaacggaattggagagtaaataca

SEQ ID NO: 481774 - DNA, 25 bp, Rattus norvegicus
aaatacatggcggactttccgctcc

SEQ ID NO: 481775 - DNA, 25 bp, Rattus norvegicus
ttggagagtaaatacatggcggact

SEQ ID NO: 481776 - DNA, 25 bp, Rattus norvegicus
tacatggcggactttccgctccagc

SEQ ID NO: 481777 - DNA, 25 bp, Rattus norvegicus
gagagtaaatacatggcggactttc

SEQ ID NO: 481778 - DNA, 25 bp, Rattus norvegicus
ctatcgcatggccaaggaacggaat

SEQ ID NO: 481779 - DNA, 25 bp, Rattus norvegicus
atcgcatggccaaggaacggaattg

SEQ ID NO: 481780 - DNA, 25 bp, Rattus norvegicus
cgggaaagatggagcagaagctggc

SEQ ID NO: 481781 - DNA, 25 bp, Rattus norvegicus
atggcggactttccgctccagcggg

SEQ ID NO: 481782 - DNA, 25 bp, Rattus norvegicus
gagtaaatacatggcggactttccg

SEQ ID NO: 481783 - DNA, 25 bp, Rattus norvegicus
cggaattggagagtaaatacatggc

SEQ ID NO: 481784 - DNA, 25 bp, Rattus norvegicus
cgctccagcgggcagctggaccatg

SEQ ID NO: 481785 - DNA, 25 bp, Rattus norvegicus
agctggaccatgtggcccactgcga

SEQ ID NO: 481786 - DNA, 25 bp, Rattus norvegicus
agcgtgaaggcgcaggcgatgagca

SEQ ID NO: 481787 - DNA, 25 bp, Rattus norvegicus
aaagcaggttgcctcctgtcacctg

SEQ ID NO: 481788 - DNA, 25 bp, Rattus norvegicus
agcagcgtggaaagcaggttgcctc

SEQ ID NO: 481789 - DNA, 25 bp, Rattus norvegicus
cgtggaaagcaggttgcctcctgtc

SEQ ID NO: 481790 - DNA, 25 bp, Rattus norvegicus
gtcacctgctccatcgcctgcccga

SEQ ID NO: 481791 - DNA, 25 bp, Rattus norvegicus
gcaccgagccgcctgactgcagcaa

SEQ ID NO: 481792 - DNA, 25 bp, Rattus norvegicus
cctgactgcagcaagcccagcagta

SEQ ID NO: 481793 - DNA, 25 bp, Rattus norvegicus
agcaagcccagcagtaccatcccga

SEQ ID NO: 481794 - DNA, 25 bp, Rattus norvegicus
cgctgcttcgatccgcccggtaagc

SEQ ID NO: 481795 - DNA, 25 bp, Rattus norvegicus
atccgcccggtaagctggaggccga

SEQ ID NO: 481796 - DNA, 25 bp, Rattus norvegicus
actgcgaggcggaacaggtagacaa

SEQ ID NO: 481797 - DNA, 25 bp, Rattus norvegicus
catcgcctgcccgagcaccgagccg

SEQ ID NO: 481798 - DNA, 25 bp, Rattus norvegicus
caccatctcgttatggagaagcaaa

SEQ ID NO: 481799 - DNA, 25 bp, Rattus norvegicus
agaagcaaaaacaacgcctcgtccg

SEQ ID NO: 481800 - DNA, 25 bp, Rattus norvegicus
gcggccgccactgggcctttgagac

SEQ ID NO: 481801 - DNA, 25 bp, Rattus norvegicus
gtcctaaggccgctgtggaccgcgc

SEQ ID NO: 481802 - DNA, 25 bp, Rattus norvegicus
tcggctccaattagtgcgggactcg

SEQ ID NO: 481803 - DNA, 25 bp, Rattus norvegicus
tccagcgccgagtcggctccaatta

SEQ ID NO: 481804 - DNA, 25 bp, Rattus norvegicus
ggcctttgagaccctatgacaaccc

SEQ ID NO: 481805 - DNA, 25 bp, Rattus norvegicus
atactccggacaccatctcgttatg

SEQ ID NO: 481806 - DNA, 25 bp, Rattus norvegicus
tcggcggacttatatactccggaca

SEQ ID NO: 481807 - DNA, 25 bp, Rattus norvegicus
ccctgctcggcggacttatatactc

SEQ ID NO: 481808 - DNA, 25 bp, Rattus norvegicus
tggaagcaagtgtcgctgcatgacc

SEQ ID NO: 481809 - DNA, 25 bp, Rattus norvegicus
aacctactgggcgtctacgttcgcg

SEQ ID NO: 481810 - DNA, 25 bp, Rattus norvegicus
cacacccggcgttccggcagggtgt

SEQ ID NO: 481811 - DNA, 25 bp, Rattus norvegicus
gcctcgtccgccatttcccgccgat

SEQ ID NO: 481812 - DNA, 25 bp, Rattus norvegicus
cgcttggtgcaagtgcttgcgaatg

SEQ ID NO: 481813 - DNA, 25 bp, Rattus norvegicus
aagcctgctgcagagagaagatggc

SEQ ID NO: 481814 - DNA, 25 bp, Rattus norvegicus
ttgcaggagcagctagaaaaggcca

SEQ ID NO: 481815 - DNA, 25 bp, Rattus norvegicus
cctcaagaatgtggacgagaatatc

SEQ ID NO: 481816 - DNA, 25 bp, Rattus norvegicus
agaatatccgcaagctcaccgggcg

SEQ ID NO: 481817 - DNA, 25 bp, Rattus norvegicus
acccgaatgatgtgaggtacgtttc

SEQ ID NO: 481818 - DNA, 25 bp, Rattus norvegicus
cggccgagccctctactcggttagg

SEQ ID NO: 481819 - DNA, 25 bp, Rattus norvegicus
cctgtagagcagtcgcgaagcctgc

SEQ ID NO: 481820 - DNA, 25 bp, Rattus norvegicus
ctgcgtcctaggtcgcttggtgcaa

SEQ ID NO: 481821 - DNA, 25 bp, Rattus norvegicus
tcgctgtgagagctttgcaggagca

SEQ ID NO: 481822 - DNA, 25 bp, Rattus norvegicus
cctgggaaggccaagaccacggctt

SEQ ID NO: 481823 - DNA, 25 bp, Rattus norvegicus
caggcccggaactgcagtacaaagc

SEQ ID NO: 481824 - DNA, 25 bp, Rattus norvegicus
ggggagacgccatacctgcgtccta

SEQ ID NO: 481825 - DNA, 25 bp, Rattus norvegicus
aaggccaaagagagcctcaagaatg

SEQ ID NO: 481826 - DNA, 25 bp, Rattus norvegicus
cacgctcggattcctcgtgctacga

SEQ ID NO: 481827 - DNA, 25 bp, Rattus norvegicus
tgcttgcccaggagaggttaaactc

SEQ ID NO: 481828 - DNA, 25 bp, Rattus norvegicus
ctcagccactgcttgcctcggggaa

SEQ ID NO: 481829 - DNA, 25 bp, Rattus norvegicus
gcaatgtggacgtcccaaaggagcc

SEQ ID NO: 481830 - DNA, 25 bp, Rattus norvegicus
cgggccctttaagcttgagcgagga

SEQ ID NO: 481831 - DNA, 25 bp, Rattus norvegicus
gaacttttttcactccgggactgca

SEQ ID NO: 481832 - DNA, 25 bp, Rattus norvegicus
tctagcctgaattatggcggaggcc

SEQ ID NO: 481833 - DNA, 25 bp, Rattus norvegicus
cgtcacgggccgtttttctagcctg

SEQ ID NO: 481834 - DNA, 25 bp, Rattus norvegicus
tcacaaagcaggtcgcaccggctca

SEQ ID NO: 481835 - DNA, 25 bp, Rattus norvegicus
tccgaagtgcggactcacaaagcag

SEQ ID NO: 481836 - DNA, 25 bp, Rattus norvegicus
tagccagcgcccatcaggaggacac

SEQ ID NO: 481837 - DNA, 25 bp, Rattus norvegicus
gaacgccttcgtgtccagagtccga

SEQ ID NO: 481838 - DNA, 25 bp, Rattus norvegicus
ctctgatcagaccacacagttgacc

SEQ ID NO: 481839 - DNA, 25 bp, Rattus norvegicus
cagtgcattcgcgatcccagaccgg

SEQ ID NO: 481840 - DNA, 25 bp, Rattus norvegicus
gctggccaagtgttaccgtgcgcac

SEQ ID NO: 481841 - DNA, 25 bp, Rattus norvegicus
acagcgcccgcatcaaaacagcggg

SEQ ID NO: 481842 - DNA, 25 bp, Rattus norvegicus
ggagagcccacactgcacacgcgca

SEQ ID NO: 481843 - DNA, 25 bp, Rattus norvegicus
aggagagaaaatgatgcccaggatg

SEQ ID NO: 481844 - DNA, 25 bp, Rattus norvegicus
ctgctaggagagaaaatgatgccca

SEQ ID NO: 481845 - DNA, 25 bp, Rattus norvegicus
gctgcaactgctaggagagaaaatg

SEQ ID NO: 481846 - DNA, 25 bp, Rattus norvegicus
tgaattccagctgcaactgctagga

SEQ ID NO: 481847 - DNA, 25 bp, Rattus norvegicus
cgcctgtgctgaattccagctgcaa

SEQ ID NO: 481848 - DNA, 25 bp, Rattus norvegicus
ctcactctgcgcctgtgctgaattc

SEQ ID NO: 481849 - DNA, 25 bp, Rattus norvegicus
aagcgtggcctcactctgcgcctgt

SEQ ID NO: 481850 - DNA, 25 bp, Rattus norvegicus
tgacaggaagcgtggcctcactctg

SEQ ID NO: 481851 - DNA, 25 bp, Rattus norvegicus
cgcgcacatagtgacaggaagcgtg

SEQ ID NO: 481852 - DNA, 25 bp, Rattus norvegicus
tgcgcacgcgcacatagtgacagga

SEQ ID NO: 481853 - DNA, 25 bp, Rattus norvegicus
ccaagtgttaccgtgcgcacgcgca

SEQ ID NO: 481854 - DNA, 25 bp, Rattus norvegicus
tgcctggatctcgtggcacgtgatc

SEQ ID NO: 481855 - DNA, 25 bp, Rattus norvegicus
attcgctgaactgaggtcgcggctc

SEQ ID NO: 481856 - DNA, 25 bp, Rattus norvegicus
ctgggtagaagaggcactcccgcca

SEQ ID NO: 481857 - DNA, 25 bp, Rattus norvegicus
tcaaaatcctcgctcgaacggaccg

SEQ ID NO: 481858 - DNA, 25 bp, Rattus norvegicus
agggccggcacgcagcatcttttcc

SEQ ID NO: 481859 - DNA, 25 bp, Rattus norvegicus
gacccgacgctttttcattcgctga

SEQ ID NO: 481860 - DNA, 25 bp, Rattus norvegicus
gggcggaaccactcagagcgtccct

SEQ ID NO: 481861 - DNA, 25 bp, Rattus norvegicus
gtgatccaggacgtcagcaaaccgg

SEQ ID NO: 481862 - DNA, 25 bp, Rattus norvegicus
ctgcttcggaggaaaccgcggctct

SEQ ID NO: 481863 - DNA, 25 bp, Rattus norvegicus
tccggctttctgtaccgcacgcaag

SEQ ID NO: 481864 - DNA, 25 bp, Rattus norvegicus
ttcggcggaaccaagtgcaccacga

SEQ ID NO: 481865 - DNA, 25 bp, Rattus norvegicus
cggcactgacaagaacaacaacatc

SEQ ID NO: 481866 - DNA, 25 bp, Rattus norvegicus
atgtgcacgatgagttcgctgggca

SEQ ID NO: 481867 - DNA, 25 bp, Rattus norvegicus
gttcagagtaggacaaaatcggcta

SEQ ID NO: 481868 - DNA, 25 bp, Rattus norvegicus
taccgctggcgcaaagagaaagaga

SEQ ID NO: 481869 - DNA, 25 bp, Rattus norvegicus
tcccagaaccctagaaacaggagac

SEQ ID NO: 481870 - DNA, 25 bp, Rattus norvegicus
tgcagtcaacgccagcccagaggag

SEQ ID NO: 481871 - DNA, 25 bp, Rattus norvegicus
ggacgagtcctcagctcaggctcga

SEQ ID NO: 481872 - DNA, 25 bp, Rattus norvegicus
ctccgcgctgcagcatggaggcagc

SEQ ID NO: 481873 - DNA, 25 bp, Rattus norvegicus
ccggtccctagctgcagtgacgaga

SEQ ID NO: 481874 - DNA, 25 bp, Rattus norvegicus
tgcagtgacgagaacggccgcacct

SEQ ID NO: 481875 - DNA, 25 bp, Rattus norvegicus
gccgctatactctcggcctttgaga

SEQ ID NO: 481876 - DNA, 25 bp, Rattus norvegicus
gcctttgagactccgggctggatgt

SEQ ID NO: 481877 - DNA, 25 bp, Rattus norvegicus
gctggatgtgttcagggaaccgatt

SEQ ID NO: 481878 - DNA, 25 bp, Rattus norvegicus
cgggaagctgcaatccgatctggca

SEQ ID NO: 481879 - DNA, 25 bp, Rattus norvegicus
agagcgctgtgcctgcaaatcccta

SEQ ID NO: 481880 - DNA, 25 bp, Rattus norvegicus
ggaaccgatttaccgctggcgcaaa

SEQ ID NO: 481881 - DNA, 25 bp, Rattus norvegicus
caaatccctaagcagaggaggcgcg

SEQ ID NO: 481882 - DNA, 25 bp, Rattus norvegicus
gaggacgccacagctcccgctgctg

SEQ ID NO: 481883 - DNA, 25 bp, Rattus norvegicus
ttgaagccagccgacagcatactcc

SEQ ID NO: 481884 - DNA, 25 bp, Rattus norvegicus
ggcttcctgccagcgcagaggacgc

SEQ ID NO: 481885 - DNA, 25 bp, Rattus norvegicus
gtgctctctgatgcccggcggcttc

SEQ ID NO: 481886 - DNA, 25 bp, Rattus norvegicus
cggatgcagaccgaagtcccctgtg

SEQ ID NO: 481887 - DNA, 25 bp, Rattus norvegicus
taaacggcttcaggaccccggatgc

SEQ ID NO: 481888 - DNA, 25 bp, Rattus norvegicus
ctgcgcagcatccagcagttgaagc

SEQ ID NO: 481889 - DNA, 25 bp, Rattus norvegicus
gcagttgaagccagccgacagcata

SEQ ID NO: 481890 - DNA, 25 bp, Rattus norvegicus
ttccgagctgccgtgtagctactgc

SEQ ID NO: 481891 - DNA, 25 bp, Rattus norvegicus
cactcggtttccgagctgccgtgta

SEQ ID NO: 481892 - DNA, 25 bp, Rattus norvegicus
ctgaagctctgcactcggtttccga

SEQ ID NO: 481893 - DNA, 25 bp, Rattus norvegicus
ggaaaacagctcgttctgaagctct

SEQ ID NO: 481894 - DNA, 25 bp, Rattus norvegicus
gctcgttctgaagctctgcactcgg

SEQ ID NO: 481895 - DNA, 25 bp, Rattus norvegicus
tgccgtgtagctactgcgcagcatc

SEQ ID NO: 481896 - DNA, 25 bp, Rattus norvegicus
ctgatcctgtctccgattgggcaag

SEQ ID NO: 481897 - DNA, 25 bp, Rattus norvegicus
acacacccgacacgcgcacgctggg

SEQ ID NO: 481898 - DNA, 25 bp, Rattus norvegicus
gaagactgtacacacacccgacacg

SEQ ID NO: 481899 - DNA, 25 bp, Rattus norvegicus
gtctgaagactgtacacacacccga

SEQ ID NO: 481900 - DNA, 25 bp, Rattus norvegicus
tccgattgggcaagtctgaagactg

SEQ ID NO: 481901 - DNA, 25 bp, Rattus norvegicus
tctccgattgggcaagtctgaagac

SEQ ID NO: 481902 - DNA, 25 bp, Rattus norvegicus
tcctgtctccgattgggcaagtctg

SEQ ID NO: 481903 - DNA, 25 bp, Rattus norvegicus
acctgatcctgtctccgattgggca

SEQ ID NO: 481904 - DNA, 25 bp, Rattus norvegicus
tacacctgatcctgtctccgattgg

SEQ ID NO: 481905 - DNA, 25 bp, Rattus norvegicus
aggacccgccctcctacacctgatc

SEQ ID NO: 481906 - DNA, 25 bp, Rattus norvegicus
cctctcgtcaggacccgccctccta

SEQ ID NO: 481907 - DNA, 25 bp, Rattus norvegicus
ccgtaacaagcgacgcgccgcgccc

SEQ ID NO: 481908 - DNA, 25 bp, Rattus norvegicus
tcctgctccgtaacaagcgacgcgc

SEQ ID NO: 481909 - DNA, 25 bp, Rattus norvegicus
ctgtctccgattgggcaagtctgaa

SEQ ID NO: 481910 - DNA, 25 bp, Rattus norvegicus
tttcaactagctggtccggtcctgg

SEQ ID NO: 481911 - DNA, 25 bp, Rattus norvegicus
tgggtgcatcaccatggaagcgctc

SEQ ID NO: 481912 - DNA, 25 bp, Rattus norvegicus
tgcttgcagcttctctcggatgttc

SEQ ID NO: 481913 - DNA, 25 bp, Rattus norvegicus
cccgccgcaaggaagccttatatcg

SEQ ID NO: 481914 - DNA, 25 bp, Rattus norvegicus
agactcggcttcttcaactcctgcg

SEQ ID NO: 481915 - DNA, 25 bp, Rattus norvegicus
taccggcggaggctatttcaactag

SEQ ID NO: 481916 - DNA, 25 bp, Rattus norvegicus
agaaaagctactactgccgtggggc

SEQ ID NO: 481917 - DNA, 25 bp, Rattus norvegicus
cccagggactgatggtcgtcgatct

SEQ ID NO: 481918 - DNA, 25 bp, Rattus norvegicus
tatttgacgaccctccatggcggcc

SEQ ID NO: 481919 - DNA, 25 bp, Rattus norvegicus
ggttccctccagctctcgctatttg

SEQ ID NO: 481920 - DNA, 25 bp, Rattus norvegicus
agccctcccaagacggcaatggttc

SEQ ID NO: 481921 - DNA, 25 bp, Rattus norvegicus
cagctgaccggagccgttccttctt

SEQ ID NO: 481922 - DNA, 25 bp, Rattus norvegicus
caagaggttcgttctgggtgcatca

SEQ ID NO: 481923 - DNA, 25 bp, Rattus norvegicus
ttccaggctttgcaggctgccttgc

SEQ ID NO: 481924 - DNA, 25 bp, Rattus norvegicus
cggcgtctcgctttaggactacagc

SEQ ID NO: 481925 - DNA, 25 bp, Rattus norvegicus
tcacgtgaccgctgcgcctctggat

SEQ ID NO: 481926 - DNA, 25 bp, Rattus norvegicus
cggtagctgagtgaactgaggcatt

SEQ ID NO: 481927 - DNA, 25 bp, Rattus norvegicus
ctgaggcattggcaggctcatcttt

SEQ ID NO: 481928 - DNA, 25 bp, Rattus norvegicus
caggctcatctttggcgatcttggc

SEQ ID NO: 481929 - DNA, 25 bp, Rattus norvegicus
gatcttggccctggcttcggctcat

SEQ ID NO: 481930 - DNA, 25 bp, Rattus norvegicus
tcggctcatggcaccgagaagcatc

SEQ ID NO: 481931 - DNA, 25 bp, Rattus norvegicus
tggcaccgagaagcatccatcgtaa

SEQ ID NO: 481932 - DNA, 25 bp, Rattus norvegicus
atccatcgtaaggtagctggggcta

SEQ ID NO: 481933 - DNA, 25 bp, Rattus norvegicus
aggtagctggggctagctccctgaa

SEQ ID NO: 481934 - DNA, 25 bp, Rattus norvegicus
gctcgtctcgctcgaggcctggcgt

SEQ ID NO: 481935 - DNA, 25 bp, Rattus norvegicus
tcatggtgcgcgcatcacgtgaccg

SEQ ID NO: 481936 - DNA, 25 bp, Rattus norvegicus
atcccacctgttgggaagagcaggc

SEQ ID NO: 481937 - DNA, 25 bp, Rattus norvegicus
gcggggctgcgcgtctgcttcccta

SEQ ID NO: 481938 - DNA, 25 bp, Rattus norvegicus
tccacggtccatgcacgctgcggaa

SEQ ID NO: 481939 - DNA, 25 bp, Rattus norvegicus
gtccatgcacgctgcggaacagccg

SEQ ID NO: 481940 - DNA, 25 bp, Rattus norvegicus
cttcttgggcagctgctcgctgcgc

SEQ ID NO: 481941 - DNA, 25 bp, Rattus norvegicus
taatgtccttcttgggcagctgctc

SEQ ID NO: 481942 - DNA, 25 bp, Rattus norvegicus
cctgcagaaacttgataatgtcctt

SEQ ID NO: 481943 - DNA, 25 bp, Rattus norvegicus
ccgtgatcctgcagaaacttgataa

SEQ ID NO: 481944 - DNA, 25 bp, Rattus norvegicus
tgaaccgtgatcctgcagaaacttg

SEQ ID NO: 481945 - DNA, 25 bp, Rattus norvegicus
ttggtaccgaatctgaaccgtgatc

SEQ ID NO: 481946 - DNA, 25 bp, Rattus norvegicus
gaagcctttggtaccgaatctgaac

SEQ ID NO: 481947 - DNA, 25 bp, Rattus norvegicus
gcccagaagcctttggtaccgaatc

SEQ ID NO: 481948 - DNA, 25 bp, Rattus norvegicus
tccggtatgtaaggcatctccgggg

SEQ ID NO: 481949 - DNA, 25 bp, Rattus norvegicus
ggaggaatccggtatgtaaggcatc

SEQ ID NO: 481950 - DNA, 25 bp, Rattus norvegicus
ggcctggccagcacgggccacagaa

SEQ ID NO: 481951 - DNA, 25 bp, Rattus norvegicus
accgaatctgaaccgtgatcctgca

SEQ ID NO: 481952 - DNA, 25 bp, Rattus norvegicus
tggcagcgtacgaggctgaacagca

SEQ ID NO: 481953 - DNA, 25 bp, Rattus norvegicus
acttcgctcaacacgcatgcgtttc

SEQ ID NO: 481954 - DNA, 25 bp, Rattus norvegicus
catgcgtttcagctggtttccggaa

SEQ ID NO: 481955 - DNA, 25 bp, Rattus norvegicus
tccggaatggcaaccaatcatcttc

SEQ ID NO: 481956 - DNA, 25 bp, Rattus norvegicus
atcttcctgctgcaaagtcggcggc

SEQ ID NO: 481957 - DNA, 25 bp, Rattus norvegicus
gttccactgtgtcactggcgggaga

SEQ ID NO: 481958 - DNA, 25 bp, Rattus norvegicus
ctgctgctgggcatcatgagcggac

SEQ ID NO: 481959 - DNA, 25 bp, Rattus norvegicus
gcggacggcagagaacgctcttcca

SEQ ID NO: 481960 - DNA, 25 bp, Rattus norvegicus
tgcgcgactaccagctggacatctc

SEQ ID NO: 481961 - DNA, 25 bp, Rattus norvegicus
ccgcggtgacggagtctctcccgga

SEQ ID NO: 481962 - DNA, 25 bp, Rattus norvegicus
ggctgaacagcaactggatcccggg

SEQ ID NO: 481963 - DNA, 25 bp, Rattus norvegicus
gcggattcttcaacccgaccggctg

SEQ ID NO: 481964 - DNA, 25 bp, Rattus norvegicus
tcttccagacgtggggcccgagcct

SEQ ID NO: 481965 - DNA, 25 bp, Rattus norvegicus
gcgtccgatccgtgtcggttgcacc

SEQ ID NO: 481966 - DNA, 25 bp, Rattus norvegicus
aacagatctcgagcgctagggcagc

SEQ ID NO: 481967 - DNA, 25 bp, Rattus norvegicus
caggctggagctacactcgacttcc

SEQ ID NO: 481968 - DNA, 25 bp, Rattus norvegicus
cggctgagcgaacactgcgaagtca

SEQ ID NO: 481969 - DNA, 25 bp, Rattus norvegicus
gggtgacacgtaaaaccgcagtggc

SEQ ID NO: 481970 - DNA, 25 bp, Rattus norvegicus
cctgggattggtacgctcagaaatt

SEQ ID NO: 481971 - DNA, 25 bp, Rattus norvegicus
ttgcgtcacgaaacgtcttccggga

SEQ ID NO: 481972 - DNA, 25 bp, Rattus norvegicus
agtgtgagcccaaagagtctgacca

SEQ ID NO: 481973 - DNA, 25 bp, Rattus norvegicus
gagcgcgcgcgatttactaagtttg

SEQ ID NO: 481974 - DNA, 25 bp, Rattus norvegicus
cactactcccgtgatgctcggcgga

SEQ ID NO: 481975 - DNA, 25 bp, Rattus norvegicus
ttgtttctctctacagggccggctc

SEQ ID NO: 481976 - DNA, 25 bp, Rattus norvegicus
cacggttgcacgtggagtttgtttc

SEQ ID NO: 481977 - DNA, 25 bp, Rattus norvegicus
ctcgccgctttgacaaggcagtgtg

SEQ ID NO: 481978 - DNA, 25 bp, Rattus norvegicus
tgttattctaggctgcgctcgcaca

SEQ ID NO: 481979 - DNA, 25 bp, Rattus norvegicus
cttgcgggccacacttgttattcta

SEQ ID NO: 481980 - DNA, 25 bp, Rattus norvegicus
tgcagccgcactcggatgtggaagc

SEQ ID NO: 481981 - DNA, 25 bp, Rattus norvegicus
ggcttcgatcacgtgctccttgttc

SEQ ID NO: 481982 - DNA, 25 bp, Rattus norvegicus
acttgaacttggctctgcgtagggc

SEQ ID NO: 481983 - DNA, 25 bp, Rattus norvegicus
tcgctttcttccgacccaggtcaaa

SEQ ID NO: 481984 - DNA, 25 bp, Rattus norvegicus
tgtggccacagagtggaaactcgtc

SEQ ID NO: 481985 - DNA, 25 bp, Rattus norvegicus
gagagctgctcatactcgtcggaca

SEQ ID NO: 481986 - DNA, 25 bp, Rattus norvegicus
acctggccgatgtggactctcgcca

SEQ ID NO: 481987 - DNA, 25 bp, Rattus norvegicus
tggaagccgtccttgccacagctct

SEQ ID NO: 481988 - DNA, 25 bp, Rattus norvegicus
agcgcccgcgcaggacaacatcttg

SEQ ID NO: 481989 - DNA, 25 bp, Rattus norvegicus
tggtttcccgaaggcacctcgcata

SEQ ID NO: 481990 - DNA, 25 bp, Rattus norvegicus
tctcgccaccgtaccttgtggtttc

SEQ ID NO: 481991 - DNA, 25 bp, Rattus norvegicus
cttacagtaccggtaacagcgggca

SEQ ID NO: 481992 - DNA, 25 bp, Rattus norvegicus
tgcggatggacatgatgacctggcc

SEQ ID NO: 481993 - DNA, 25 bp, Rattus norvegicus
caccatgtacttgttggcgcagatg

SEQ ID NO: 481994 - DNA, 25 bp, Rattus norvegicus
gtgctcagctccagaacgtcatacc

SEQ ID NO: 481995 - DNA, 25 bp, Rattus norvegicus
cacctgggctgtgctttccgtcgag

SEQ ID NO: 481996 - DNA, 25 bp, Rattus norvegicus
tcccagcaccgcagccgtcgtgctg

SEQ ID NO: 481997 - DNA, 25 bp, Rattus norvegicus
acactgcgccgccagagccaggtag

SEQ ID NO: 481998 - DNA, 25 bp, Rattus norvegicus
ccagagccaggtaggcagccatagc

SEQ ID NO: 481999 - DNA, 25 bp, Rattus norvegicus
ggtaggcagccatagcctcagcttg

SEQ ID NO: 482000 - DNA, 25 bp, Rattus norvegicus
aacgtcataccgagcagcgccgaac

SEQ ID NO: 482001 - DNA, 25 bp, Rattus norvegicus
agccatagcctcagcttggcccatg

SEQ ID NO: 482002 - DNA, 25 bp, Rattus norvegicus
tccagaacgtcataccgagcagcgc

SEQ ID NO: 482003 - DNA, 25 bp, Rattus norvegicus
ggaaaagtcgcggtgcaaactctgc

SEQ ID NO: 482004 - DNA, 25 bp, Rattus norvegicus
tgtgctttccgtcgagcggcccgtc

SEQ ID NO: 482005 - DNA, 25 bp, Rattus norvegicus
ggcattagacggtccaggagcggca

SEQ ID NO: 482006 - DNA, 25 bp, Rattus norvegicus
aagtcgcggtgcaaactctgcaggc

SEQ ID NO: 482007 - DNA, 25 bp, Rattus norvegicus
ccgccagggcgcgcagtgtgtcatc

SEQ ID NO: 482008 - DNA, 25 bp, Rattus norvegicus
atgccgagcgcagagcagatccgca

SEQ ID NO: 482009 - DNA, 25 bp, Rattus norvegicus
cagagctgcgaggacaagtgttctt

SEQ ID NO: 482010 - DNA, 25 bp, Rattus norvegicus
aagtggcctctgacccgggcacgaa

SEQ ID NO: 482011 - DNA, 25 bp, Rattus norvegicus
cgcctttacaaagtaactcgcgaag

SEQ ID NO: 482012 - DNA, 25 bp, Rattus norvegicus
cccattccatcagttgccattgcaa

SEQ ID NO: 482013 - DNA, 25 bp, Rattus norvegicus
ttgcaacgccaatcctgttacacga

SEQ ID NO: 482014 - DNA, 25 bp, Rattus norvegicus
tgttacacgacacagactcgcatcg

SEQ ID NO: 482015 - DNA, 25 bp, Rattus norvegicus
acgaaagggtccaagcgagagcgaa

SEQ ID NO: 482016 - DNA, 25 bp, Rattus norvegicus
acggctcttccaaacagccttgagc

SEQ ID NO: 482017 - DNA, 25 bp, Rattus norvegicus
cccgcaagcaaagagggtgctcctg

SEQ ID NO: 482018 - DNA, 25 bp, Rattus norvegicus
ggtgctcctggtggcagcaccaatc

SEQ ID NO: 482019 - DNA, 25 bp, Rattus norvegicus
aatcccgggagctgaaaacagagtc

SEQ ID NO: 482020 - DNA, 25 bp, Rattus norvegicus
tccgagcaccaccacttgcaggaga

SEQ ID NO: 482021 - DNA, 25 bp, Rattus norvegicus
gcctgggaaaaatcgcagacgcctg

SEQ ID NO: 482022 - DNA, 25 bp, Rattus norvegicus
ttcgcgtactgacggaagcactgtc

SEQ ID NO: 482023 - DNA, 25 bp, Rattus norvegicus
gaagcctatgtccttcgcgtactga

SEQ ID NO: 482024 - DNA, 25 bp, Rattus norvegicus
tcggcacatgttcagcccgtattta

SEQ ID NO: 482025 - DNA, 25 bp, Rattus norvegicus
tttacggatcagaccgtggcggtta

SEQ ID NO: 482026 - DNA, 25 bp, Rattus norvegicus
ccggcctagcaccagtccgtaatgg

SEQ ID NO: 482027 - DNA, 25 bp, Rattus norvegicus
ccagccgcgagccttgaatttcgga

SEQ ID NO: 482028 - DNA, 25 bp, Rattus norvegicus
ttcttaccaagagcgagaaccctgg

SEQ ID NO: 482029 - DNA, 25 bp, Rattus norvegicus
tggtgacccatcttgccttcagacg

SEQ ID NO: 482030 - DNA, 25 bp, Rattus norvegicus
gcacgcatgcgctcttcaaagttct

SEQ ID NO: 482031 - DNA, 25 bp, Rattus norvegicus
tgcgtagtgcgataacattggttcc

SEQ ID NO: 482032 - DNA, 25 bp, Rattus norvegicus
cattggttcctgtgctttgagtgac

SEQ ID NO: 482033 - DNA, 25 bp, Rattus norvegicus
gtgacatttctaaggctggctgggc

SEQ ID NO: 482034 - DNA, 25 bp, Rattus norvegicus
ctccagtagagctgctggtgaccca

SEQ ID NO: 482035 - DNA, 25 bp, Rattus norvegicus
cgcgggtaccttaatgaagcctatg

SEQ ID NO: 482036 - DNA, 25 bp, Rattus norvegicus
ctaaaaacatggtgccttcggcggc

SEQ ID NO: 482037 - DNA, 25 bp, Rattus norvegicus
tgagctggtagatagcgatcccgcc

SEQ ID NO: 482038 - DNA, 25 bp, Rattus norvegicus
gcgtcgcccagtattgtcacctaaa

SEQ ID NO: 482039 - DNA, 25 bp, Rattus norvegicus
ccgctctgactcgaaatggtgctta

SEQ ID NO: 482040 - DNA, 25 bp, Rattus norvegicus
acaagagtacttgctcgctggcgtc

SEQ ID NO: 482041 - DNA, 25 bp, Rattus norvegicus
cgctggcgtctgtctctataaacaa

SEQ ID NO: 482042 - DNA, 25 bp, Rattus norvegicus
ggtgacaaccgccttccaggtatcc

SEQ ID NO: 482043 - DNA, 25 bp, Rattus norvegicus
cgagcacgcagaggttcggtcatta

SEQ ID NO: 482044 - DNA, 25 bp, Rattus norvegicus
tagctgcaagatgaggcttccctgc

SEQ ID NO: 482045 - DNA, 25 bp, Rattus norvegicus
ccgtagctgtcacttgccaaccttg

SEQ ID NO: 482046 - DNA, 25 bp, Rattus norvegicus
cccgagcaagaatgagctgcagcct

SEQ ID NO: 482047 - DNA, 25 bp, Rattus norvegicus
tgcctgctagtctccaccatgaagg

SEQ ID NO: 482048 - DNA, 25 bp, Rattus norvegicus
ccgcggttcgttgagcgtacacaca

SEQ ID NO: 482049 - DNA, 25 bp, Rattus norvegicus
cgcgccacggacagctctaatgcga

SEQ ID NO: 482050 - DNA, 25 bp, Rattus norvegicus
agggatttctccgtctgccaaaggg

SEQ ID NO: 482051 - DNA, 25 bp, Rattus norvegicus
tgcgctcaccgttctcgctgaaaga

SEQ ID NO: 482052 - DNA, 25 bp, Rattus norvegicus
cgctgaaagagcgatcccggaattt

SEQ ID NO: 482053 - DNA, 25 bp, Rattus norvegicus
ggcgcaaacacagtccgggaagtcc

SEQ ID NO: 482054 - DNA, 25 bp, Rattus norvegicus
gctttccttgttgaccagcgccgtg

SEQ ID NO: 482055 - DNA, 25 bp, Rattus norvegicus
cgcccacagttgcaagcacacagta

SEQ ID NO: 482056 - DNA, 25 bp, Rattus norvegicus
ggcggccaagtctcggaactccaaa

SEQ ID NO: 482057 - DNA, 25 bp, Rattus norvegicus
gctccgggtctagccatgtgatcct

SEQ ID NO: 482058 - DNA, 25 bp, Rattus norvegicus
cgctgtcggcttaccttgcacaaga

SEQ ID NO: 482059 - DNA, 25 bp, Rattus norvegicus
gggaactgcagaatggacgccaatc

SEQ ID NO: 482060 - DNA, 25 bp, Rattus norvegicus
tggtgttccttgtgggttccaattc

SEQ ID NO: 482061 - DNA, 25 bp, Rattus norvegicus
ctacacttacaaaacgcaggccgga

SEQ ID NO: 482062 - DNA, 25 bp, Rattus norvegicus
actggcacttctcgccgtacttgca

SEQ ID NO: 482063 - DNA, 25 bp, Rattus norvegicus
caccgccttcttgtccagcatgttg

SEQ ID NO: 482064 - DNA, 25 bp, Rattus norvegicus
tcctctggagtagcaatgggcgaca

SEQ ID NO: 482065 - DNA, 25 bp, Rattus norvegicus
gaaccggctactgctcaactccaga

SEQ ID NO: 482066 - DNA, 25 bp, Rattus norvegicus
ccagacttaccgagagacaggcagc

SEQ ID NO: 482067 - DNA, 25 bp, Rattus norvegicus
aactgaacctgagcgacgggactgc

SEQ ID NO: 482068 - DNA, 25 bp, Rattus norvegicus
cgacgggactgcgagccaataagca

SEQ ID NO: 482069 - DNA, 25 bp, Rattus norvegicus
ggcttctgggaagcgccaaccagtg

SEQ ID NO: 482070 - DNA, 25 bp, Rattus norvegicus
ccacgggcagcgcaggtaaagaaac

SEQ ID NO: 482071 - DNA, 25 bp, Rattus norvegicus
aggcgacactaagccgcggctcata

SEQ ID NO: 482072 - DNA, 25 bp, Rattus norvegicus
ggctgcttgagctgcaactgccaga

SEQ ID NO: 482073 - DNA, 25 bp, Rattus norvegicus
ttcctagggctacaggccaaggcga

SEQ ID NO: 482074 - DNA, 25 bp, Rattus norvegicus
tggagaccatgaggttccgcatcta

SEQ ID NO: 482075 - DNA, 25 bp, Rattus norvegicus
ccgcatctacaaacggaaggtgcta

SEQ ID NO: 482076 - DNA, 25 bp, Rattus norvegicus
aggtgctaatcctgacgctcgtggt

SEQ ID NO: 482077 - DNA, 25 bp, Rattus norvegicus
ccatgctggagcgtctcttctgagg

SEQ ID NO: 482078 - DNA, 25 bp, Rattus norvegicus
ggtccagcctgacgccgaactgctg

SEQ ID NO: 482079 - DNA, 25 bp, Rattus norvegicus
cttcagcttttgcagtcccggcatc

SEQ ID NO: 482080 - DNA, 25 bp, Rattus norvegicus
gtagcgattaccgttgcggcccgca

SEQ ID NO: 482081 - DNA, 25 bp, Rattus norvegicus
cgtccagcatttcgcggaagcgctc

SEQ ID NO: 482082 - DNA, 25 bp, Rattus norvegicus
cgcgagcaacggtaatcctggaggt

SEQ ID NO: 482083 - DNA, 25 bp, Rattus norvegicus
atggtgaccaccaactcgtgcggca

SEQ ID NO: 482084 - DNA, 25 bp, Rattus norvegicus
tcggggtttctggaatctaggcaca

SEQ ID NO: 482085 - DNA, 25 bp, Rattus norvegicus
tctggggctaccacacagctctttc

SEQ ID NO: 482086 - DNA, 25 bp, Rattus norvegicus
tctttctcccgtggtcagctccaga

SEQ ID NO: 482087 - DNA, 25 bp, Rattus norvegicus
tcgcccgcggaagtgcaggctatat

SEQ ID NO: 482088 - DNA, 25 bp, Rattus norvegicus
ctatattgtcagttccggtctcggc

SEQ ID NO: 482089 - DNA, 25 bp, Rattus norvegicus
ccttccggtgtcgtcgagaagtcct

SEQ ID NO: 482090 - DNA, 25 bp, Rattus norvegicus
ccgcgccttattgtactgtgccctg

SEQ ID NO: 482091 - DNA, 25 bp, Rattus norvegicus
ttgatcttcagggtcttggcgttcc

SEQ ID NO: 482092 - DNA, 25 bp, Rattus norvegicus
tacagcctcagatgcaccagatcga

SEQ ID NO: 482093 - DNA, 25 bp, Rattus norvegicus
gcatcctgcagaggcggggacctac

SEQ ID NO: 482094 - DNA, 25 bp, Rattus norvegicus
cctacgccgatcagaagccagcaaa

SEQ ID NO: 482095 - DNA, 25 bp, Rattus norvegicus
cgctccggcgccatgtttgagattt

SEQ ID NO: 482096 - DNA, 25 bp, Rattus norvegicus
gtcgcagaaacctagggaggctcta

SEQ ID NO: 482097 - DNA, 25 bp, Rattus norvegicus
catgtttgagatttggcgccaccgc

SEQ ID NO: 482098 - DNA, 25 bp, Rattus norvegicus
cttgaaagctgagaccgtgcggctc

SEQ ID NO: 482099 - DNA, 25 bp, Rattus norvegicus
gagactcacctcctgagcagcaagc

SEQ ID NO: 482100 - DNA, 25 bp, Rattus norvegicus
gacaggttgcctctcgagactcacc

SEQ ID NO: 482101 - DNA, 25 bp, Rattus norvegicus
atgttctagatagggcattgcggcg

SEQ ID NO: 482102 - DNA, 25 bp, Rattus norvegicus
gcctcttacgacagaatgttctaga

SEQ ID NO: 482103 - DNA, 25 bp, Rattus norvegicus
gatcgacctcgcctcttacgacaga

SEQ ID NO: 482104 - DNA, 25 bp, Rattus norvegicus
gaaggaacatttgcacccggcgcca

SEQ ID NO: 482105 - DNA, 25 bp, Rattus norvegicus
ctccatgggagtggacacgcccgct

SEQ ID NO: 482106 - DNA, 25 bp, Rattus norvegicus
cgccaatctggaccctcctcgcgtt

SEQ ID NO: 482107 - DNA, 25 bp, Rattus norvegicus
actcgcaggcgttctgcgtggcgga

SEQ ID NO: 482108 - DNA, 25 bp, Rattus norvegicus
cacttcctctacgtgtgggggggct

SEQ ID NO: 482109 - DNA, 25 bp, Rattus norvegicus
acggacacttcctctacgtgtgggg

SEQ ID NO: 482110 - DNA, 25 bp, Rattus norvegicus
tggacggacacttcctctacgtgtg

SEQ ID NO: 482111 - DNA, 25 bp, Rattus norvegicus
tgtggtggacggacacttcctctac

SEQ ID NO: 482112 - DNA, 25 bp, Rattus norvegicus
ccactgcgctgtggtggacggacac

SEQ ID NO: 482113 - DNA, 25 bp, Rattus norvegicus
ctcgcgttccgttcgcgcgtgcgag

SEQ ID NO: 482114 - DNA, 25 bp, Rattus norvegicus
acgcgcaggtttctcggttccgcct

SEQ ID NO: 482115 - DNA, 25 bp, Rattus norvegicus
agacgcgcaggtttctcggttccgc

SEQ ID NO: 482116 - DNA, 25 bp, Rattus norvegicus
cggccgcgcagacgcgcaggtttct

SEQ ID NO: 482117 - DNA, 25 bp, Rattus norvegicus
tgttctccgggagccagcagacccg

SEQ ID NO: 482118 - DNA, 25 bp, Rattus norvegicus
ggtgttctccgggagccagcagacc

SEQ ID NO: 482119 - DNA, 25 bp, Rattus norvegicus
cggatggcggactcgcaggcgttct

SEQ ID NO: 482120 - DNA, 25 bp, Rattus norvegicus
ggctgcgagtgcgagccgcctcggc

SEQ ID NO: 482121 - DNA, 25 bp, Rattus norvegicus
ctctcccgctccgagctaggtcccg

SEQ ID NO: 482122 - DNA, 25 bp, Rattus norvegicus
tccgagctaggtcccggctgctgcg

SEQ ID NO: 482123 - DNA, 25 bp, Rattus norvegicus
tgtccgctgcggacgacttccggcg

SEQ ID NO: 482124 - DNA, 25 bp, Rattus norvegicus
gccgggcgggctcgatcaccaccgc

SEQ ID NO: 482125 - DNA, 25 bp, Rattus norvegicus
ggctacaaggtcagtagggccgggc

SEQ ID NO: 482126 - DNA, 25 bp, Rattus norvegicus
cttgcggacagtgtccgctgcggac

SEQ ID NO: 482127 - DNA, 25 bp, Rattus norvegicus
ccggagcttgcggacagtgtccgct

SEQ ID NO: 482128 - DNA, 25 bp, Rattus norvegicus
cttccggagcttgcggacagtgtcc

SEQ ID NO: 482129 - DNA, 25 bp, Rattus norvegicus
cgcttccggagcttgcggacagtgt

SEQ ID NO: 482130 - DNA, 25 bp, Rattus norvegicus
agcgcgcttccggagcttgcggaca

SEQ ID NO: 482131 - DNA, 25 bp, Rattus norvegicus
cagcacaggggttgagcgcgcttcc

SEQ ID NO: 482132 - DNA, 25 bp, Rattus norvegicus
gaccggccggaggatccgcagcaca

SEQ ID NO: 482133 - DNA, 25 bp, Rattus norvegicus
acagtgtccgctgcggacgacttcc

SEQ ID NO: 482134 - DNA, 25 bp, Rattus norvegicus
accctcagccgctgtcggcgcgcgc

SEQ ID NO: 482135 - DNA, 25 bp, Rattus norvegicus
agcggtgcagcctcaagatggctga

SEQ ID NO: 482136 - DNA, 25 bp, Rattus norvegicus
gcctcaagatggctgatggcaacga

SEQ ID NO: 482137 - DNA, 25 bp, Rattus norvegicus
tcaagatggctgatggcaacgagga

SEQ ID NO: 482138 - DNA, 25 bp, Rattus norvegicus
ccaccgctccgctttcctttgtctc

SEQ ID NO: 482139 - DNA, 25 bp, Rattus norvegicus
atggctgatggcaacgaggatgctc

SEQ ID NO: 482140 - DNA, 25 bp, Rattus norvegicus
ctcgagcggaggacatgccaggccc

SEQ ID NO: 482141 - DNA, 25 bp, Rattus norvegicus
gaggacatgccaggcccggccttcg

SEQ ID NO: 482142 - DNA, 25 bp, Rattus norvegicus
gtgcccagcggtgcagcctcaagat

SEQ ID NO: 482143 - DNA, 25 bp, Rattus norvegicus
agcgatgggcgccacatgttcgtct

SEQ ID NO: 482144 - DNA, 25 bp, Rattus norvegicus
cgcagcacagtagaggcgggtcgtc

SEQ ID NO: 482145 - DNA, 25 bp, Rattus norvegicus
acatgttcgtctggggcggctacaa

SEQ ID NO: 482146 - DNA, 25 bp, Rattus norvegicus
cgccacatgttcgtctggggcggct

SEQ ID NO: 482147 - DNA, 25 bp, Rattus norvegicus
tgccaggcccggccttcgaaggcta

SEQ ID NO: 482148 - DNA, 25 bp, Rattus norvegicus
agaccgtgaggctctccggtccgtc

SEQ ID NO: 482149 - DNA, 25 bp, Rattus norvegicus
ccgacgcagaactgctaggcttctg

SEQ ID NO: 482150 - DNA, 25 bp, Rattus norvegicus
tcttcatggctagggtgcgcgtcgc

SEQ ID NO: 482151 - DNA, 25 bp, Rattus norvegicus
gtcaacagtgctgaagcgggtcttc

SEQ ID NO: 482152 - DNA, 25 bp, Rattus norvegicus
agcaccgcgcggaggtcaacagtgc

SEQ ID NO: 482153 - DNA, 25 bp, Rattus norvegicus
tgctctcctagcacgagcctgttca

SEQ ID NO: 482154 - DNA, 25 bp, Rattus norvegicus
agaactgctaggcttctgcgcacgc

SEQ ID NO: 482155 - DNA, 25 bp, Rattus norvegicus
tctcccgagggcactggctcggagc

SEQ ID NO: 482156 - DNA, 25 bp, Rattus norvegicus
tacggacacgcgtctccggaggtct

SEQ ID NO: 482157 - DNA, 25 bp, Rattus norvegicus
ctaaggagagacagcgtacggacac

SEQ ID NO: 482158 - DNA, 25 bp, Rattus norvegicus
tcggaaccagagctaaggagagaca

SEQ ID NO: 482159 - DNA, 25 bp, Rattus norvegicus
cgctgtgagatctctcggaaccaga

SEQ ID NO: 482160 - DNA, 25 bp, Rattus norvegicus
gttctaccaagcgttcgctgtgaga

SEQ ID NO: 482161 - DNA, 25 bp, Rattus norvegicus
ttcgcattcagttccgcgagcaccg

SEQ ID NO: 482162 - DNA, 25 bp, Rattus norvegicus
gaacacggttctaaatccctctaga

SEQ ID NO: 482163 - DNA, 25 bp, Rattus norvegicus
ctggactcgggctccttagctcaaa

SEQ ID NO: 482164 - DNA, 25 bp, Rattus norvegicus
tagctcaaaggtctcgtcgtcctcg

SEQ ID NO: 482165 - DNA, 25 bp, Rattus norvegicus
tagtcccggtgcagaagagtgaagc

SEQ ID NO: 482166 - DNA, 25 bp, Rattus norvegicus
agtgaagcctcgacggcagcaaaga

SEQ ID NO: 482167 - DNA, 25 bp, Rattus norvegicus
tagtaggaaggattgaacacggttc

SEQ ID NO: 482168 - DNA, 25 bp, Rattus norvegicus
ccagcaggtggacagcgccttgtgt

SEQ ID NO: 482169 - DNA, 25 bp, Rattus norvegicus
gaggaccgagtttggcccaagtatg

SEQ ID NO: 482170 - DNA, 25 bp, Rattus norvegicus
cgccttgtgtgaggcgcaaggccca

SEQ ID NO: 482171 - DNA, 25 bp, Rattus norvegicus
ggcccacaggcacatcccgaatagg

SEQ ID NO: 482172 - DNA, 25 bp, Rattus norvegicus
cacattccttggctctggcggaggc

SEQ ID NO: 482173 - DNA, 25 bp, Rattus norvegicus
tccagttggccaagaggaccgagtt

SEQ ID NO: 482174 - DNA, 25 bp, Rattus norvegicus
tctggccttcagacaagaatctccc

SEQ ID NO: 482175 - DNA, 25 bp, Rattus norvegicus
cccaagtatggagcaggttcaggcg

SEQ ID NO: 482176 - DNA, 25 bp, Rattus norvegicus
gtgacgtcaccggaggcaggataaa

SEQ ID NO: 482177 - DNA, 25 bp, Rattus norvegicus
aagctttccttgacacgcccaggca

SEQ ID NO: 482178 - DNA, 25 bp, Rattus norvegicus
cggtccagagactgagactgagtga

SEQ ID NO: 482179 - DNA, 25 bp, Rattus norvegicus
gactgagactgagtgatgtcacctg

SEQ ID NO: 482180 - DNA, 25 bp, Rattus norvegicus
actgagtgatgtcacctgggcccgc

SEQ ID NO: 482181 - DNA, 25 bp, Rattus norvegicus
tgggcccgccttcttccgctggaga

SEQ ID NO: 482182 - DNA, 25 bp, Rattus norvegicus
ctttctcgttggtgtatacgccgcg

SEQ ID NO: 482183 - DNA, 25 bp, Rattus norvegicus
ttcttccgctggagactggagcctt

SEQ ID NO: 482184 - DNA, 25 bp, Rattus norvegicus
ctggagccttgcgattcactgggaa

SEQ ID NO: 482185 - DNA, 25 bp, Rattus norvegicus
ttcactgggaatcgcacgtattttc

SEQ ID NO: 482186 - DNA, 25 bp, Rattus norvegicus
gggaatcgcacgtattttctcaaaa

SEQ ID NO: 482187 - DNA, 25 bp, Rattus norvegicus
tcaccggaggcaggataaagctttc

SEQ ID NO: 482188 - DNA, 25 bp, Rattus norvegicus
gcctctgcttcctttctcgttggtg

SEQ ID NO: 482189 - DNA, 25 bp, Rattus norvegicus
tttctcaaaatacttgcctctgctt

SEQ ID NO: 482190 - DNA, 25 bp, Rattus norvegicus
gttcccgcgaggatccatgacctga

SEQ ID NO: 482191 - DNA, 25 bp, Rattus norvegicus
tgtacaagttgaagctgggccagtc

SEQ ID NO: 482192 - DNA, 25 bp, Rattus norvegicus
gccggcaagacaacgatcctgtaca

SEQ ID NO: 482193 - DNA, 25 bp, Rattus norvegicus
aaatgcggatcctcatgctgggcct

SEQ ID NO: 482194 - DNA, 25 bp, Rattus norvegicus
cttcgggaacaaggaaatgcggatc

SEQ ID NO: 482195 - DNA, 25 bp, Rattus norvegicus
tggggaaggtgctatccaagatctt

SEQ ID NO: 482196 - DNA, 25 bp, Rattus norvegicus
cgcagtttgacctgccgcgtgctga

SEQ ID NO: 482197 - DNA, 25 bp, Rattus norvegicus
tctctgcaggtagcaccgagttccc

SEQ ID NO: 482198 - DNA, 25 bp, Rattus norvegicus
gtcggtctcagcaccgtcggagtcc

SEQ ID NO: 482199 - DNA, 25 bp, Rattus norvegicus
tggaggtaatctcaagggccgagcc

SEQ ID NO: 482200 - DNA, 25 bp, Rattus norvegicus
cctttcagaggtcgcgctcttccga

SEQ ID NO: 482201 - DNA, 25 bp, Rattus norvegicus
cgcgggccactctcctttcagaggt

SEQ ID NO: 482202 - DNA, 25 bp, Rattus norvegicus
cgctccagcaggttccgcaaggcgt

SEQ ID NO: 482203 - DNA, 25 bp, Rattus norvegicus
ctagcaggcagcttcgcgcaagccg

SEQ ID NO: 482204 - DNA, 25 bp, Rattus norvegicus
ccctagtaacacacacaggtgatag

SEQ ID NO: 482205 - DNA, 25 bp, Rattus norvegicus
aacacacacaggtgatagctcttga

SEQ ID NO: 482206 - DNA, 25 bp, Rattus norvegicus
acacacacaggtgatagctcttgaa

SEQ ID NO: 482207 - DNA, 25 bp, Rattus norvegicus
cacacacaggtgatagctcttgaaa

SEQ ID NO: 482208 - DNA, 25 bp, Rattus norvegicus
gtaacacacacaggtgatagctctt

SEQ ID NO: 482209 - DNA, 25 bp, Rattus norvegicus
agtaacacacacaggtgatagctct

SEQ ID NO: 482210 - DNA, 25 bp, Rattus norvegicus
tagtaacacacacaggtgatagctc

SEQ ID NO: 482211 - DNA, 25 bp, Rattus norvegicus
cctagtaacacacacaggtgatagc

SEQ ID NO: 482212 - DNA, 25 bp, Rattus norvegicus
cccctagtaacacacacaggtgata

SEQ ID NO: 482213 - DNA, 25 bp, Rattus norvegicus
ccccctagtaacacacacaggtgat

SEQ ID NO: 482214 - DNA, 25 bp, Rattus norvegicus
cccccctagtaacacacacaggtga

SEQ ID NO: 482215 - DNA, 25 bp, Rattus norvegicus
ccccccctagtaacacacacaggtg

SEQ ID NO: 482216 - DNA, 25 bp, Rattus norvegicus
taacacacacaggtgatagctcttg

SEQ ID NO: 482217 - DNA, 25 bp, Rattus norvegicus
ctagtaacacacacaggtgatagct

SEQ ID NO: 482218 - DNA, 25 bp, Rattus norvegicus
taagcttcttgagcgcctcgatgtc

SEQ ID NO: 482219 - DNA, 25 bp, Rattus norvegicus
cttgttaagcttcttgagcgcctcg

SEQ ID NO: 482220 - DNA, 25 bp, Rattus norvegicus
tttgaccaacttcttgttcttgtta

SEQ ID NO: 482221 - DNA, 25 bp, Rattus norvegicus
gaccaacttcttgttcttgttaagc

SEQ ID NO: 482222 - DNA, 25 bp, Rattus norvegicus
caacttcttgttcttgttaagcttc

SEQ ID NO: 482223 - DNA, 25 bp, Rattus norvegicus
cttcttgttcttgttaagcttcttg

SEQ ID NO: 482224 - DNA, 25 bp, Rattus norvegicus
cttgttcttgttaagcttcttgagc

SEQ ID NO: 482225 - DNA, 25 bp, Rattus norvegicus
ttcttgagcgcctcgatgtccatgt

SEQ ID NO: 482226 - DNA, 25 bp, Rattus norvegicus
tcttgttaagcttcttgagcgcctc

SEQ ID NO: 482227 - DNA, 25 bp, Rattus norvegicus
cttcttgagcgcctcgatgtccatg

SEQ ID NO: 482228 - DNA, 25 bp, Rattus norvegicus
ttgttaagcttcttgagcgcctcga

SEQ ID NO: 482229 - DNA, 25 bp, Rattus norvegicus
gttaagcttcttgagcgcctcgatg

SEQ ID NO: 482230 - DNA, 25 bp, Rattus norvegicus
ttaagcttcttgagcgcctcgatgt

SEQ ID NO: 482231 - DNA, 25 bp, Rattus norvegicus
gttcttgttaagcttcttgagcgcc

SEQ ID NO: 482232 - DNA, 25 bp, Rattus norvegicus
aggtacaggcgcacggctgcacgcc

SEQ ID NO: 482233 - DNA, 25 bp, Rattus norvegicus
tgcgtgactctcaaagcccggaagg

SEQ ID NO: 482234 - DNA, 25 bp, Rattus norvegicus
cggttgttcaaagcgcatgcgtgac

SEQ ID NO: 482235 - DNA, 25 bp, Rattus norvegicus
tcccagcggcaaagcggttgttcaa

SEQ ID NO: 482236 - DNA, 25 bp, Rattus norvegicus
tcctcggcggacgatattccagctc

SEQ ID NO: 482237 - DNA, 25 bp, Rattus norvegicus
tccggctccacgacggacggtattc

SEQ ID NO: 482238 - DNA, 25 bp, Rattus norvegicus
gcacaaagctccagagcggatcctc

SEQ ID NO: 482239 - DNA, 25 bp, Rattus norvegicus
gtcgaagcgcggtcccatctcgctt

SEQ ID NO: 482240 - DNA, 25 bp, Rattus norvegicus
ccggagccgtactgctgcagtcgaa

SEQ ID NO: 482241 - DNA, 25 bp, Rattus norvegicus
cccggcgtctccaggtatttggcaa

SEQ ID NO: 482242 - DNA, 25 bp, Rattus norvegicus
gcaccgagcgccgactcagagcgtg

SEQ ID NO: 482243 - DNA, 25 bp, Rattus norvegicus
tcttacccgagggtcgcagccatga

SEQ ID NO: 482244 - DNA, 25 bp, Rattus norvegicus
gtgaactgatgccttcccgccagct

SEQ ID NO: 482245 - DNA, 25 bp, Rattus norvegicus
cttcccgccggtgaactgatgcctt

SEQ ID NO: 482246 - DNA, 25 bp, Rattus norvegicus
actcccacgtacagtccgaagactg

SEQ ID NO: 482247 - DNA, 25 bp, Rattus norvegicus
cctaggactcggtgattctgcgcgt

SEQ ID NO: 482248 - DNA, 25 bp, Rattus norvegicus
agagtagccgagtgctgttcctcca

SEQ ID NO: 482249 - DNA, 25 bp, Rattus norvegicus
ggcgtctgcccataggtaccacttg

SEQ ID NO: 482250 - DNA, 25 bp, Rattus norvegicus
cgtgacgtcatcagagagggcgttt

SEQ ID NO: 482251 - DNA, 25 bp, Rattus norvegicus
atggagacctcagcgcccaaagcca

SEQ ID NO: 482252 - DNA, 25 bp, Rattus norvegicus
accggctggcaatgtggaaggacca

SEQ ID NO: 482253 - DNA, 25 bp, Rattus norvegicus
cctcgtgcccgaggacgtctgtaaa

SEQ ID NO: 482254 - DNA, 25 bp, Rattus norvegicus
cgtctgtaaagtgtcgccacgtctg

SEQ ID NO: 482255 - DNA, 25 bp, Rattus norvegicus
cgagtcccggaagcccgtcaagtct

SEQ ID NO: 482256 - DNA, 25 bp, Rattus norvegicus
gtctacggtgtccaggaggattcta

SEQ ID NO: 482257 - DNA, 25 bp, Rattus norvegicus
attctaacgtggtgcgcgttccacc

SEQ ID NO: 482258 - DNA, 25 bp, Rattus norvegicus
gtccggaatctgacaaggaaatatc

SEQ ID NO: 482259 - DNA, 25 bp, Rattus norvegicus
tctgcgcgttcgagggataaacgtg

SEQ ID NO: 482260 - DNA, 25 bp, Rattus norvegicus
gtccttcgggatgcaacaggcaatg

SEQ ID NO: 482261 - DNA, 25 bp, Rattus norvegicus
gagcaccggactcccggcctgagaa

SEQ ID NO: 482262 - DNA, 25 bp, Rattus norvegicus
cctgagaaggctgggtcccggcacc

SEQ ID NO: 482263 - DNA, 25 bp, Rattus norvegicus
gagcgcgagccgtgctccctgttct

SEQ ID NO: 482264 - DNA, 25 bp, Rattus norvegicus
gttacaagttgtgcgagctcccggc

SEQ ID NO: 482265 - DNA, 25 bp, Rattus norvegicus
agcactgaccttccgcagggccggg

SEQ ID NO: 482266 - DNA, 25 bp, Rattus norvegicus
cgccatttcgggctgttctcttcgc

SEQ ID NO: 482267 - DNA, 25 bp, Rattus norvegicus
tcgggctgttctcttcgctgaagaa

SEQ ID NO: 482268 - DNA, 25 bp, Rattus norvegicus
ctgacaggcaggacgcaggccgcct

SEQ ID NO: 482269 - DNA, 25 bp, Rattus norvegicus
cccgagtctcgggagaagaccagca

SEQ ID NO: 482270 - DNA, 25 bp, Rattus norvegicus
acaggcaatgaggagcaccggactc

SEQ ID NO: 482271 - DNA, 25 bp, Rattus norvegicus
gctgttccagacacactcggcggcg

SEQ ID NO: 482272 - DNA, 25 bp, Rattus norvegicus
taatcggtctctcctgggaacgtgc

SEQ ID NO: 482273 - DNA, 25 bp, Rattus norvegicus
ggagaagaccagcaccgagcatgcg

SEQ ID NO: 482274 - DNA, 25 bp, Rattus norvegicus
ctccgccagcacaggcttgactgga

SEQ ID NO: 482275 - DNA, 25 bp, Rattus norvegicus
gctccctgtcactaccggactggta

SEQ ID NO: 482276 - DNA, 25 bp, Rattus norvegicus
cagttggcaacgctctggcccggga

SEQ ID NO: 482277 - DNA, 25 bp, Rattus norvegicus
cgttccgccacagaaggccgggcgt

SEQ ID NO: 482278 - DNA, 25 bp, Rattus norvegicus
gtggtggttccactctcccgagcct

SEQ ID NO: 482279 - DNA, 25 bp, Rattus norvegicus
cgccgcacgccgtgagtagaggaac

SEQ ID NO: 482280 - DNA, 25 bp, Rattus norvegicus
ccaagcgagagccaatgaaacagtg

SEQ ID NO: 482281 - DNA, 25 bp, Rattus norvegicus
ccttagcagtggcagcctgaacgga

SEQ ID NO: 482282 - DNA, 25 bp, Rattus norvegicus
cgcagagtcggccacatggtctaca

SEQ ID NO: 482283 - DNA, 25 bp, Rattus norvegicus
agacacctcccacataacgcagagt

SEQ ID NO: 482284 - DNA, 25 bp, Rattus norvegicus
acctacctggtactggagctgcgac

SEQ ID NO: 482285 - DNA, 25 bp, Rattus norvegicus
tgaaacagtgctttggcacaacgtg

SEQ ID NO: 482286 - DNA, 25 bp, Rattus norvegicus
acgcctcctggtcagttggcaacgc

SEQ ID NO: 482287 - DNA, 25 bp, Rattus norvegicus
cctgaacggactctaagggtgcagc

SEQ ID NO: 482288 - DNA, 25 bp, Rattus norvegicus
cagggtccctgaccctgcgctgatg

SEQ ID NO: 482289 - DNA, 25 bp, Rattus norvegicus
gagccgagctgtaagataatctatc

SEQ ID NO: 482290 - DNA, 25 bp, Rattus norvegicus
tagctcatgggagtcacagcgtgga

SEQ ID NO: 482291 - DNA, 25 bp, Rattus norvegicus
tgaccctgcgctgatggtccgcagg

SEQ ID NO: 482292 - DNA, 25 bp, Rattus norvegicus
agctccgctaggtcgccgctgcgat

SEQ ID NO: 482293 - DNA, 25 bp, Rattus norvegicus
ccagctcgagcaccgcagcctgcag

SEQ ID NO: 482294 - DNA, 25 bp, Rattus norvegicus
accggctgggcaactaggcccgcgt

SEQ ID NO: 482295 - DNA, 25 bp, Rattus norvegicus
tccctctggaagaggacaccggctg

SEQ ID NO: 482296 - DNA, 25 bp, Rattus norvegicus
aatttcgggtctcatttccctctgg

SEQ ID NO: 482297 - DNA, 25 bp, Rattus norvegicus
agacacttgagctggctggagcacg

SEQ ID NO: 482298 - DNA, 25 bp, Rattus norvegicus
tacgatctaagacacttgagctggc

SEQ ID NO: 482299 - DNA, 25 bp, Rattus norvegicus
gttatggttcatacgatctaagaca

SEQ ID NO: 482300 - DNA, 25 bp, Rattus norvegicus
tctatcgttttaacgttatggttca

SEQ ID NO: 482301 - DNA, 25 bp, Rattus norvegicus
cgcagggtttagctcatgggagtca

SEQ ID NO: 482302 - DNA, 25 bp, Rattus norvegicus
tgtggcacccgtatcccgctaacga

SEQ ID NO: 482303 - DNA, 25 bp, Rattus norvegicus
ggcgcttcccaacatggagcctcag

SEQ ID NO: 482304 - DNA, 25 bp, Rattus norvegicus
agaggctgttccttccttgttgagc

SEQ ID NO: 482305 - DNA, 25 bp, Rattus norvegicus
ggagacccgcgtcttctccgagacg

SEQ ID NO: 482306 - DNA, 25 bp, Rattus norvegicus
ctcagaggggcctccatcttcgctg

SEQ ID NO: 482307 - DNA, 25 bp, Rattus norvegicus
aggcacggccaggattcgtccagtt

SEQ ID NO: 482308 - DNA, 25 bp, Rattus norvegicus
ccaaggcattcgtgcggcgtctgac

SEQ ID NO: 482309 - DNA, 25 bp, Rattus norvegicus
attcgtccagttgccggcaggacta

SEQ ID NO: 482310 - DNA, 25 bp, Rattus norvegicus
agcggtgcctcctacttccattcag

SEQ ID NO: 482311 - DNA, 25 bp, Rattus norvegicus
taaactgagtccgtccgggcaggag

SEQ ID NO: 482312 - DNA, 25 bp, Rattus norvegicus
ccctctgcaccagttcgtagtcgtg

SEQ ID NO: 482313 - DNA, 25 bp, Rattus norvegicus
ccggtcggtagcgttagaatcgatg

SEQ ID NO: 482314 - DNA, 25 bp, Rattus norvegicus
gggccacttcctggccggactctgt

SEQ ID NO: 482315 - DNA, 25 bp, Rattus norvegicus
ttccgtctcaggatgtcggcggcag

SEQ ID NO: 482316 - DNA, 25 bp, Rattus norvegicus
tcactgtccacacggtacctcaccg

SEQ ID NO: 482317 - DNA, 25 bp, Rattus norvegicus
tacctcaccgtccacacggtacctc

SEQ ID NO: 482318 - DNA, 25 bp, Rattus norvegicus
cacggtacctcaccgtccacacggt

SEQ ID NO: 482319 - DNA, 25 bp, Rattus norvegicus
cgtccacacggtacctcactgtcca

SEQ ID NO: 482320 - DNA, 25 bp, Rattus norvegicus
cctcactgtccacacggtgcctcac

SEQ ID NO: 482321 - DNA, 25 bp, Rattus norvegicus
cacggtgcctcaccgtccacacggt

SEQ ID NO: 482322 - DNA, 25 bp, Rattus norvegicus
acggtgcctcactgtccacacagta

SEQ ID NO: 482323 - DNA, 25 bp, Rattus norvegicus
tgtccacacagtacctcaccgtcca

SEQ ID NO: 482324 - DNA, 25 bp, Rattus norvegicus
ccgtccacacggtacctcactgtcc

SEQ ID NO: 482325 - DNA, 25 bp, Rattus norvegicus
tcactgtccacacggtacctcactg

SEQ ID NO: 482326 - DNA, 25 bp, Rattus norvegicus
cacacggtacctcaccgtccacacg

SEQ ID NO: 482327 - DNA, 25 bp, Rattus norvegicus
tacctcactgtccacacggtacctc

SEQ ID NO: 482328 - DNA, 25 bp, Rattus norvegicus
acggtgcctcactgtccacacggta

SEQ ID NO: 482329 - DNA, 25 bp, Rattus norvegicus
tgtccacacggtacctcactgtcca

SEQ ID NO: 482330 - DNA, 25 bp, Rattus norvegicus
ccatgacacccagaggcagcgcgaa

SEQ ID NO: 482331 - DNA, 25 bp, Rattus norvegicus
ctgtagggcaactgcagcaccacga

SEQ ID NO: 482332 - DNA, 25 bp, Rattus norvegicus
agcagcgacaacagccacacgaaga

SEQ ID NO: 482333 - DNA, 25 bp, Rattus norvegicus
tcccggctgaaaaggagcgcaggta

SEQ ID NO: 482334 - DNA, 25 bp, Rattus norvegicus
tcgggaaaaaggagccgacagcgtc

SEQ ID NO: 482335 - DNA, 25 bp, Rattus norvegicus
gtctgcgtgaggctttcgggaaaaa

SEQ ID NO: 482336 - DNA, 25 bp, Rattus norvegicus
ggagagctcttgtgatggccacata

SEQ ID NO: 482337 - DNA, 25 bp, Rattus norvegicus
cccaggagcgcataacaggctgcca

SEQ ID NO: 482338 - DNA, 25 bp, Rattus norvegicus
ctccggtgaccagcagagctaaatc

SEQ ID NO: 482339 - DNA, 25 bp, Rattus norvegicus
gagctaaatccttgcgcttgctgga

SEQ ID NO: 482340 - DNA, 25 bp, Rattus norvegicus
ctgcagcggactaaggtcaagcctc

SEQ ID NO: 482341 - DNA, 25 bp, Rattus norvegicus
gcgcaggcccaaaaaagcatacagc

SEQ ID NO: 482342 - DNA, 25 bp, Rattus norvegicus
tgtagcagcctcctcaggtcctggc

SEQ ID NO: 482343 - DNA, 25 bp, Rattus norvegicus
gctgccagtagatcggctgtatcca

SEQ ID NO: 482344 - DNA, 25 bp, Rattus norvegicus
tgccctgaacctcggccggcttaga

SEQ ID NO: 482345 - DNA, 25 bp, Rattus norvegicus
atggtagcaaacacggggcacgccc

SEQ ID NO: 482346 - DNA, 25 bp, Rattus norvegicus
gtggcacccgcgatggtagcaaaca

SEQ ID NO: 482347 - DNA, 25 bp, Rattus norvegicus
tgcccgggtcgaagcattttttctc

SEQ ID NO: 482348 - DNA, 25 bp, Rattus norvegicus
tacccagcagaaaggtgcccgggtc

SEQ ID NO: 482349 - DNA, 25 bp, Rattus norvegicus
cccgatgtacccagcagaaaggtgc

SEQ ID NO: 482350 - DNA, 25 bp, Rattus norvegicus
tttggttttcttgcgggacagcatc

SEQ ID NO: 482351 - DNA, 25 bp, Rattus norvegicus
tccttcttcacgtacttgccctgaa

SEQ ID NO: 482352 - DNA, 25 bp, Rattus norvegicus
ggggcgacgtctccttcttcacgta

SEQ ID NO: 482353 - DNA, 25 bp, Rattus norvegicus
tggacactcactccgcagcaggggc

SEQ ID NO: 482354 - DNA, 25 bp, Rattus norvegicus
cgagagtctgtcttccagcaccagc

SEQ ID NO: 482355 - DNA, 25 bp, Rattus norvegicus
tccaagtgcattcccgagagtctgt

SEQ ID NO: 482356 - DNA, 25 bp, Rattus norvegicus
tcgaagcattttttctccaagtgca

SEQ ID NO: 482357 - DNA, 25 bp, Rattus norvegicus
cgggacagcatcctcgcggacgtcg

SEQ ID NO: 482358 - DNA, 25 bp, Rattus norvegicus
tggttgctgagggaaggcggccctc

SEQ ID NO: 482359 - DNA, 25 bp, Rattus norvegicus
tgcctcttttggtgacagcgtaaaa

SEQ ID NO: 482360 - DNA, 25 bp, Rattus norvegicus
gtatgcctcttttggtgacagcgta

SEQ ID NO: 482361 - DNA, 25 bp, Rattus norvegicus
aacgcgtatgcctcttttggtgaca

SEQ ID NO: 482362 - DNA, 25 bp, Rattus norvegicus
cctagtaacgcgtatgcctcttttg

SEQ ID NO: 482363 - DNA, 25 bp, Rattus norvegicus
agggcggcacctagtaacgcgtatg

SEQ ID NO: 482364 - DNA, 25 bp, Rattus norvegicus
ggaccacagccagggcggcacctag

SEQ ID NO: 482365 - DNA, 25 bp, Rattus norvegicus
ggaggcagaactgcccacagccgca

SEQ ID NO: 482366 - DNA, 25 bp, Rattus norvegicus
cctgttggaggcagaactgcccaca

SEQ ID NO: 482367 - DNA, 25 bp, Rattus norvegicus
cgaccgccctgttggaggcagaact

SEQ ID NO: 482368 - DNA, 25 bp, Rattus norvegicus
agcccactgggctgcgagccgctct

SEQ ID NO: 482369 - DNA, 25 bp, Rattus norvegicus
tgacagcgtaaaaaccgagtatccg

SEQ ID NO: 482370 - DNA, 25 bp, Rattus norvegicus
acagccgcagccgcgagtggttgct

SEQ ID NO: 482371 - DNA, 25 bp, Rattus norvegicus
ctcggacttgtcgaccgccctgttg

SEQ ID NO: 482372 - DNA, 25 bp, Rattus norvegicus
agagcgaggcacagtagcagctttc

SEQ ID NO: 482373 - DNA, 25 bp, Rattus norvegicus
gcgggccagcccaggttcctagcaa

SEQ ID NO: 482374 - DNA, 25 bp, Rattus norvegicus
tagcagctttcagctccgggcgcct

SEQ ID NO: 482375 - DNA, 25 bp, Rattus norvegicus
tcggcgtgatcgtcctgcacccaga

SEQ ID NO: 482376 - DNA, 25 bp, Rattus norvegicus
tttgaatttgggaacgccctggctc

SEQ ID NO: 482377 - DNA, 25 bp, Rattus norvegicus
gcacagaccatgaccgcgggactct

SEQ ID NO: 482378 - DNA, 25 bp, Rattus norvegicus
agcttgtagcttaccgcgtcctggg

SEQ ID NO: 482379 - DNA, 25 bp, Rattus norvegicus
gtgcctcgtagacggcgcattggca

SEQ ID NO: 482380 - DNA, 25 bp, Rattus norvegicus
agcacttacaaaagcgcgccggcgc

SEQ ID NO: 482381 - DNA, 25 bp, Rattus norvegicus
ttccatatgtaaggggccagcactt

SEQ ID NO: 482382 - DNA, 25 bp, Rattus norvegicus
gcgccggcgtcatttccatatgtaa

SEQ ID NO: 482383 - DNA, 25 bp, Rattus norvegicus
tccttccagaggacgcgactaggga

SEQ ID NO: 482384 - DNA, 25 bp, Rattus norvegicus
agctctgcaaggaaagggcgctttg

SEQ ID NO: 482385 - DNA, 25 bp, Rattus norvegicus
gggtcgcagagctcactcgccagac

SEQ ID NO: 482386 - DNA, 25 bp, Rattus norvegicus
gaagccctttttcagctccgctacg

SEQ ID NO: 482387 - DNA, 25 bp, Rattus norvegicus
agaacgtccgggtcacgtagcgcgc

SEQ ID NO: 482388 - DNA, 25 bp, Rattus norvegicus
caggtgacgattgaagccctttttc

SEQ ID NO: 482389 - DNA, 25 bp, Rattus norvegicus
cccaccaggtggtcgcgcactgtgt

SEQ ID NO: 482390 - DNA, 25 bp, Rattus norvegicus
cgctacgttctccacgcccacgatg

SEQ ID NO: 482391 - DNA, 25 bp, Rattus norvegicus
cacgatgccgcggatgctgatctgc

SEQ ID NO: 482392 - DNA, 25 bp, Rattus norvegicus
cggatgctgatctgccgtcgctttt

SEQ ID NO: 482393 - DNA, 25 bp, Rattus norvegicus
ccgtcgcttttcctggtcggtcaag

SEQ ID NO: 482394 - DNA, 25 bp, Rattus norvegicus
gtcggtcaagggcttcgccatggtt

SEQ ID NO: 482395 - DNA, 25 bp, Rattus norvegicus
gtcgcctggctgcaggactgtccac

SEQ ID NO: 482396 - DNA, 25 bp, Rattus norvegicus
cccttaccttacatactgcttttga

SEQ ID NO: 482397 - DNA, 25 bp, Rattus norvegicus
cacccgcggcttccggagcaacaca

SEQ ID NO: 482398 - DNA, 25 bp, Rattus norvegicus
gctcccagaacgtccgggtcacgta

SEQ ID NO: 482399 - DNA, 25 bp, Rattus norvegicus
ccagagtgaagtgcaggtgacgatt

SEQ ID NO: 482400 - DNA, 25 bp, Rattus norvegicus
tcgataggcctgtggtgtccagcac

SEQ ID NO: 482401 - DNA, 25 bp, Rattus norvegicus
cacacacggggcattttaactcttc

SEQ ID NO: 482402 - DNA, 25 bp, Rattus norvegicus
gcgccttctcacagagctggcactt

SEQ ID NO: 482403 - DNA, 25 bp, Rattus norvegicus
catctcttccatggggacctggctg

SEQ ID NO: 482404 - DNA, 25 bp, Rattus norvegicus
agagctgcgttctcattggcttccc

SEQ ID NO: 482405 - DNA, 25 bp, Rattus norvegicus
cctgacctggcgaagcagtcgatag

SEQ ID NO: 482406 - DNA, 25 bp, Rattus norvegicus
gagcagccgcttggcttgctgaagc

SEQ ID NO: 482407 - DNA, 25 bp, Rattus norvegicus
tcccgatagaaggagccacacacgg

SEQ ID NO: 482408 - DNA, 25 bp, Rattus norvegicus
gcgggcgcaagcctggcataaattg

SEQ ID NO: 482409 - DNA, 25 bp, Rattus norvegicus
tgtccaggtccagatagtcatagtc

SEQ ID NO: 482410 - DNA, 25 bp, Rattus norvegicus
cctcgctgtaaaggctcatcttgtc

SEQ ID NO: 482411 - DNA, 25 bp, Rattus norvegicus
cgctggcgaaacctccgtaggagcc

SEQ ID NO: 482412 - DNA, 25 bp, Rattus norvegicus
acacggacgccgttgggcgacttct

SEQ ID NO: 482413 - DNA, 25 bp, Rattus norvegicus
cccggtcatccagaatgaggctgcg

SEQ ID NO: 482414 - DNA, 25 bp, Rattus norvegicus
gtcccataggcgatgctactgtttg

SEQ ID NO: 482415 - DNA, 25 bp, Rattus norvegicus
tgtgccttccgattagccactccgg

SEQ ID NO: 482416 - DNA, 25 bp, Rattus norvegicus
cactccggccgccaatcccgcagga

SEQ ID NO: 482417 - DNA, 25 bp, Rattus norvegicus
atgcagcgctgaacgccgcgcgcct

SEQ ID NO: 482418 - DNA, 25 bp, Rattus norvegicus
gctggggacggctctacgtaccctg

SEQ ID NO: 482419 - DNA, 25 bp, Rattus norvegicus
gctctacgtaccctgggctcctgtg

SEQ ID NO: 482420 - DNA, 25 bp, Rattus norvegicus
gggctcctgtgacgttctgttataa

SEQ ID NO: 482421 - DNA, 25 bp, Rattus norvegicus
tcctgtgacgttctgttataaaagc

SEQ ID NO: 482422 - DNA, 25 bp, Rattus norvegicus
gtcggctgtgccttccgattagcca

SEQ ID NO: 482423 - DNA, 25 bp, Rattus norvegicus
ccgtgggtcccataggcgatgctac

SEQ ID NO: 482424 - DNA, 25 bp, Rattus norvegicus
gatgctactgtttggcctgcgcttc

SEQ ID NO: 482425 - DNA, 25 bp, Rattus norvegicus
ctactgtttggcctgcgcttctgag

SEQ ID NO: 482426 - DNA, 25 bp, Rattus norvegicus
tttggcctgcgcttctgaggagtcg

SEQ ID NO: 482427 - DNA, 25 bp, Rattus norvegicus
tgacgttctgttataaaagcggggc

SEQ ID NO: 482428 - DNA, 25 bp, Rattus norvegicus
acgtgcgcgtcctcaccgatgagaa

SEQ ID NO: 482429 - DNA, 25 bp, Rattus norvegicus
aggtcttgaggtcccagccttcgcc

SEQ ID NO: 482430 - DNA, 25 bp, Rattus norvegicus
tcttcctcggccaggtcttgaggtc

SEQ ID NO: 482431 - DNA, 25 bp, Rattus norvegicus
accgatgagaactggacctcattgc

SEQ ID NO: 482432 - DNA, 25 bp, Rattus norvegicus
cagccctggtcctgttgctctgggc

SEQ ID NO: 482433 - DNA, 25 bp, Rattus norvegicus
gcacttggggcgtctcctggttccc

SEQ ID NO: 482434 - DNA, 25 bp, Rattus norvegicus
cgcctcgcaggctcgttgtgcgcat

SEQ ID NO: 482435 - DNA, 25 bp, Rattus norvegicus
gtcaggacccggacatgcgcactga

SEQ ID NO: 482436 - DNA, 25 bp, Rattus norvegicus
ctccaccttccgctaggggtcagga

SEQ ID NO: 482437 - DNA, 25 bp, Rattus norvegicus
tgctcctatgcacggaaacaaaagc

SEQ ID NO: 482438 - DNA, 25 bp, Rattus norvegicus
tgggcagcctccttttgctcctatg

SEQ ID NO: 482439 - DNA, 25 bp, Rattus norvegicus
tttcgagggaccacaatgggcagcc

SEQ ID NO: 482440 - DNA, 25 bp, Rattus norvegicus
ttttagcgcttttcgagggaccaca

SEQ ID NO: 482441 - DNA, 25 bp, Rattus norvegicus
acctcattgctggaaggagagtgga

SEQ ID NO: 482442 - DNA, 25 bp, Rattus norvegicus
cgccaatgcctagtgtgggaaaccc

SEQ ID NO: 482443 - DNA, 25 bp, Rattus norvegicus
cggtattgcctgttgtgcacgcagg

SEQ ID NO: 482444 - DNA, 25 bp, Rattus norvegicus
cacccgagcgatgtgcggtattgcc

SEQ ID NO: 482445 - DNA, 25 bp, Rattus norvegicus
tgggaccagccgtgagtcccgtgca

SEQ ID NO: 482446 - DNA, 25 bp, Rattus norvegicus
ccgtctgtgactaactgggaccagc

SEQ ID NO: 482447 - DNA, 25 bp, Rattus norvegicus
ctgcgcccaggactctggctcgagg

SEQ ID NO: 482448 - DNA, 25 bp, Rattus norvegicus
tcgcctctccgcgagttggagctcg

SEQ ID NO: 482449 - DNA, 25 bp, Rattus norvegicus
tttcttctttctcacggggctctgg

SEQ ID NO: 482450 - DNA, 25 bp, Rattus norvegicus
ggctctcggcgtctttcttctttct

SEQ ID NO: 482451 - DNA, 25 bp, Rattus norvegicus
tgcgattccgggctttgcggctctc

SEQ ID NO: 482452 - DNA, 25 bp, Rattus norvegicus
ccctgctggtctaaagtgcgattcc

SEQ ID NO: 482453 - DNA, 25 bp, Rattus norvegicus
ccgattctgagtcggacgcctggct

SEQ ID NO: 482454 - DNA, 25 bp, Rattus norvegicus
ccgctgtagcagacgccgattctga

SEQ ID NO: 482455 - DNA, 25 bp, Rattus norvegicus
acgcctggctctggcgactttggag

SEQ ID NO: 482456 - DNA, 25 bp, Rattus norvegicus
cttcaccaagtgagtggccgtgggc

SEQ ID NO: 482457 - DNA, 25 bp, Rattus norvegicus
tgactgcctcctcgatgtcaggcct

SEQ ID NO: 482458 - DNA, 25 bp, Rattus norvegicus
atgtcaggcctttccctggacagcc

SEQ ID NO: 482459 - DNA, 25 bp, Rattus norvegicus
ggcggaccacttcatcgtctcaacg

SEQ ID NO: 482460 - DNA, 25 bp, Rattus norvegicus
atcgtctcaacgtcggtctctcaac

SEQ ID NO: 482461 - DNA, 25 bp, Rattus norvegicus
ggtctctcaacgatgccgctctatg

SEQ ID NO: 482462 - DNA, 25 bp, Rattus norvegicus
atgccgctctatgagggcctcggga

SEQ ID NO: 482463 - DNA, 25 bp, Rattus norvegicus
gaagacggcggtcgtgatcgaccta

SEQ ID NO: 482464 - DNA, 25 bp, Rattus norvegicus
aggagaagccttcaccaagtgagtg

SEQ ID NO: 482465 - DNA, 25 bp, Rattus norvegicus
caactgtccttaggcccgctgggca

SEQ ID NO: 482466 - DNA, 25 bp, Rattus norvegicus
accatcccggggcagtctggcatat

SEQ ID NO: 482467 - DNA, 25 bp, Rattus norvegicus
gggcagtctggcatatgttcgagca

SEQ ID NO: 482468 - DNA, 25 bp, Rattus norvegicus
gtctggcatatgttcgagcagtccg

SEQ ID NO: 482469 - DNA, 25 bp, Rattus norvegicus
ggtcgtgatcgacctaggagaagcc

SEQ ID NO: 482470 - DNA, 25 bp, Rattus norvegicus
cgctgaaggatccacatctggagaa

SEQ ID NO: 482471 - DNA, 25 bp, Rattus norvegicus
ccgaccgcgggaaagacgacgctcg

SEQ ID NO: 482472 - DNA, 25 bp, Rattus norvegicus
ggtgcacacccgaccgcgggaaaga

SEQ ID NO: 482473 - DNA, 25 bp, Rattus norvegicus
actgatgcgtgctggcggtgcacac

SEQ ID NO: 482474 - DNA, 25 bp, Rattus norvegicus
atctggagaactgatgcgtgctggc

SEQ ID NO: 482475 - DNA, 25 bp, Rattus norvegicus
tccacatctggagaactgatgcgtg

SEQ ID NO: 482476 - DNA, 25 bp, Rattus norvegicus
ggcagcgctgaaggatccacatctg

SEQ ID NO: 482477 - DNA, 25 bp, Rattus norvegicus
agtgagtctcagaggcagcgctgaa

SEQ ID NO: 482478 - DNA, 25 bp, Rattus norvegicus
gttccctggcgagtgagtctcagag

SEQ ID NO: 482479 - DNA, 25 bp, Rattus norvegicus
acatccatccgttccctggcgagtg

SEQ ID NO: 482480 - DNA, 25 bp, Rattus norvegicus
aagggaaggagctgcttctgcttct

SEQ ID NO: 482481 - DNA, 25 bp, Rattus norvegicus
cactgagggacctggccgcccagga

SEQ ID NO: 482482 - DNA, 25 bp, Rattus norvegicus
cccgaagaagtcctgacaggaggga

SEQ ID NO: 482483 - DNA, 25 bp, Rattus norvegicus
tcggtgccccgattctcagaagcca

SEQ ID NO: 482484 - DNA, 25 bp, Rattus norvegicus
cagggtcccttgcagacgccaagga

SEQ ID NO: 482485 - DNA, 25 bp, Rattus norvegicus
tttccgatgtcacgccatgccgagg

SEQ ID NO: 482486 - DNA, 25 bp, Rattus norvegicus
ggcgagttagatcagcggcaagctc

SEQ ID NO: 482487 - DNA, 25 bp, Rattus norvegicus
gggtccctcaacattcaggaccgca

SEQ ID NO: 482488 - DNA, 25 bp, Rattus norvegicus
cctctcgagccctgagtttccgatg

SEQ ID NO: 482489 - DNA, 25 bp, Rattus norvegicus
aggcaatggtatggacctcagcttc

SEQ ID NO: 482490 - DNA, 25 bp, Rattus norvegicus
gagacgcagacactcgccactagga

SEQ ID NO: 482491 - DNA, 25 bp, Rattus norvegicus
taaagcctctgcaagctcgatccgg

SEQ ID NO: 482492 - DNA, 25 bp, Rattus norvegicus
tttcgccttcatatcggcctggcca

SEQ ID NO: 482493 - DNA, 25 bp, Rattus norvegicus
gaacctcgctcatttcgccttcata

SEQ ID NO: 482494 - DNA, 25 bp, Rattus norvegicus
gggcgccttgagaacctcgctcatt

SEQ ID NO: 482495 - DNA, 25 bp, Rattus norvegicus
tcgacccttacacttgggcgccttg

SEQ ID NO: 482496 - DNA, 25 bp, Rattus norvegicus
gcgacccttggaagctcgaccctta

SEQ ID NO: 482497 - DNA, 25 bp, Rattus norvegicus
caagctccgggagcaaaatgttggg

SEQ ID NO: 482498 - DNA, 25 bp, Rattus norvegicus
gcccgcggaacaagccacaagacta

SEQ ID NO: 482499 - DNA, 25 bp, Rattus norvegicus
cgggtcagcaccatgagctccattg

SEQ ID NO: 482500 - DNA, 25 bp, Rattus norvegicus
tccattggcactggggtgagtctct

SEQ ID NO: 482501 - DNA, 25 bp, Rattus norvegicus
gccgtcttttccagctcggtgttga

SEQ ID NO: 482502 - DNA, 25 bp, Rattus norvegicus
gccacaagactaaaggctattggtg

SEQ ID NO: 482503 - DNA, 25 bp, Rattus norvegicus
ctgcggttcgagctggtctttaccg

SEQ ID NO: 482504 - DNA, 25 bp, Rattus norvegicus
tggggtgctgagtcactttcatctc

SEQ ID NO: 482505 - DNA, 25 bp, Rattus norvegicus
ctcctacttaaggaaactgaaagtg

SEQ ID NO: 482506 - DNA, 25 bp, Rattus norvegicus
aagttgcgggcctgccctagtgtaa

SEQ ID NO: 482507 - DNA, 25 bp, Rattus norvegicus
gagcctgttactggcctgagcagtg

SEQ ID NO: 482508 - DNA, 25 bp, Rattus norvegicus
cagtaaggctgtggctcagaaggcc

SEQ ID NO: 482509 - DNA, 25 bp, Rattus norvegicus
cgcttgaggcctggaagcgttctgt

SEQ ID NO: 482510 - DNA, 25 bp, Rattus norvegicus
agccatgagcgcgtcttgcggccac

SEQ ID NO: 482511 - DNA, 25 bp, Rattus norvegicus
gcgcagccaataggcgagcctgtta

SEQ ID NO: 482512 - DNA, 25 bp, Rattus norvegicus
ccggagtctgctcctccaatcaaaa

SEQ ID NO: 482513 - DNA, 25 bp, Rattus norvegicus
agccggtgccacactgaactaaacc

SEQ ID NO: 482514 - DNA, 25 bp, Rattus norvegicus
ctaccagatagagtccgcttccttc

SEQ ID NO: 482515 - DNA, 25 bp, Rattus norvegicus
tgttcagtcaagcacatccggagtc

SEQ ID NO: 482516 - DNA, 25 bp, Rattus norvegicus
cgtgcgtcttcagatccagccaatc

SEQ ID NO: 482517 - DNA, 25 bp, Rattus norvegicus
gtggaagatgtcctacctgctgttt

SEQ ID NO: 482518 - DNA, 25 bp, Rattus norvegicus
tgctgttttccgcaccaatcatgga

SEQ ID NO: 482519 - DNA, 25 bp, Rattus norvegicus
gacagcgagctccaatccgaagcta

SEQ ID NO: 482520 - DNA, 25 bp, Rattus norvegicus
agctattcggcgtcatgaacagcca

SEQ ID NO: 482521 - DNA, 25 bp, Rattus norvegicus
agcgagtctgctcaacagcttgtta

SEQ ID NO: 482522 - DNA, 25 bp, Rattus norvegicus
cagcgctctgcacccgcagtaggta

SEQ ID NO: 482523 - DNA, 25 bp, Rattus norvegicus
ccgcctctccgggaaaatggctgtg

SEQ ID NO: 482524 - DNA, 25 bp, Rattus norvegicus
caactctgctgtgcgtctttggcga

SEQ ID NO: 482525 - DNA, 25 bp, Rattus norvegicus
ctggattccgtttccatgggacaca

SEQ ID NO: 482526 - DNA, 25 bp, Rattus norvegicus
actccgggtttctcacgcgtggtcg

SEQ ID NO: 482527 - DNA, 25 bp, Rattus norvegicus
tcccggccaccagttggcgctccca

SEQ ID NO: 482528 - DNA, 25 bp, Rattus norvegicus
ggaggcggcaccgagaccccgcatt

SEQ ID NO: 482529 - DNA, 25 bp, Rattus norvegicus
ctactgcgtctacctggaccggagg

SEQ ID NO: 482530 - DNA, 25 bp, Rattus norvegicus
tgctctgctactgcgtctacctgga

SEQ ID NO: 482531 - DNA, 25 bp, Rattus norvegicus
gctggacagtccaacgccaaggcgc

SEQ ID NO: 482532 - DNA, 25 bp, Rattus norvegicus
gcgtccgccttagcgtcgggctcct

SEQ ID NO: 482533 - DNA, 25 bp, Rattus norvegicus
agcccgatgcccagcgtccgcctta

SEQ ID NO: 482534 - DNA, 25 bp, Rattus norvegicus
gaaagaagagctggacagtccaacg

SEQ ID NO: 482535 - DNA, 25 bp, Rattus norvegicus
gtttctcacgcgtggtcggcccgcg

SEQ ID NO: 482536 - DNA, 25 bp, Rattus norvegicus
gcctgtgtttgcagaaagaagagct

SEQ ID NO: 482537 - DNA, 25 bp, Rattus norvegicus
cagccagctcgtgcctgtgtttgca

SEQ ID NO: 482538 - DNA, 25 bp, Rattus norvegicus
cccaacgctcgctgggcagcccgat

SEQ ID NO: 482539 - DNA, 25 bp, Rattus norvegicus
attccgccgctgtctgcgggaccgt

SEQ ID NO: 482540 - DNA, 25 bp, Rattus norvegicus
tattcactggatgacaaggcctccg

SEQ ID NO: 482541 - DNA, 25 bp, Rattus norvegicus
ctgcctgctacctttcccgaatgaa

SEQ ID NO: 482542 - DNA, 25 bp, Rattus norvegicus
gcggcggctcccttcagagtacctg

SEQ ID NO: 482543 - DNA, 25 bp, Rattus norvegicus
cggggcctagggttcctattcactg

SEQ ID NO: 482544 - DNA, 25 bp, Rattus norvegicus
ccaattgcccgcgaatcccggatta

SEQ ID NO: 482545 - DNA, 25 bp, Rattus norvegicus
tcccggattatgagagtagaggaaa

SEQ ID NO: 482546 - DNA, 25 bp, Rattus norvegicus
tttcccgaatgaaggctgccaccca

SEQ ID NO: 482547 - DNA, 25 bp, Rattus norvegicus
gtcagtaccgagagagcgccgcgcc

SEQ ID NO: 482548 - DNA, 25 bp, Rattus norvegicus
ctatacttagccacgggatctcgca

SEQ ID NO: 482549 - DNA, 25 bp, Rattus norvegicus
cgggatctcgcatctgacactggta

SEQ ID NO: 482550 - DNA, 25 bp, Rattus norvegicus
tctgacactggtaccgggatgaagg

SEQ ID NO: 482551 - DNA, 25 bp, Rattus norvegicus
ctgcagtgcaggtagagtccgagct

SEQ ID NO: 482552 - DNA, 25 bp, Rattus norvegicus
tagaggaaagggactatacttagcc

SEQ ID NO: 482553 - DNA, 25 bp, Rattus norvegicus
ccgcgccgctagatagcggagaaca

SEQ ID NO: 482554 - DNA, 25 bp, Rattus norvegicus
gggatctctggccacgacgtgaccc

SEQ ID NO: 482555 - DNA, 25 bp, Rattus norvegicus
ggatgcctgctttgtgtcacctgag

SEQ ID NO: 482556 - DNA, 25 bp, Rattus norvegicus
acttccacgcgttgttggcggatgc

SEQ ID NO: 482557 - DNA, 25 bp, Rattus norvegicus
ctggtagcttctggccgtgggatct

SEQ ID NO: 482558 - DNA, 25 bp, Rattus norvegicus
ttcctggaggagaacatcttgctgc

SEQ ID NO: 482559 - DNA, 25 bp, Rattus norvegicus
ggtacctgcggcaacgccaggagct

SEQ ID NO: 482560 - DNA, 25 bp, Rattus norvegicus
tcatgaagcccgactcagcgcgcga

SEQ ID NO: 482561 - DNA, 25 bp, Rattus norvegicus
ggaccctagcgcgtgctgctgctct

SEQ ID NO: 482562 - DNA, 25 bp, Rattus norvegicus
acgtagcgtggccagggcgttatca

SEQ ID NO: 482563 - DNA, 25 bp, Rattus norvegicus
gcgcctgacaggagctgatcgccgt

SEQ ID NO: 482564 - DNA, 25 bp, Rattus norvegicus
tggagccgagccaatcggcgccgaa

SEQ ID NO: 482565 - DNA, 25 bp, Rattus norvegicus
ttcagaaagttgtcccgggagccca

SEQ ID NO: 482566 - DNA, 25 bp, Rattus norvegicus
ctgtaacaagatgctcggcccgcgc

SEQ ID NO: 482567 - DNA, 25 bp, Rattus norvegicus
gccctcggggctggctgtaacaaga

SEQ ID NO: 482568 - DNA, 25 bp, Rattus norvegicus
gtgtcgcaaggagcgccaccttgaa

SEQ ID NO: 482569 - DNA, 25 bp, Rattus norvegicus
caggcagccacagaacatggccttc

SEQ ID NO: 482570 - DNA, 25 bp, Rattus norvegicus
catggccttcccaccgtcagggaga

SEQ ID NO: 482571 - DNA, 25 bp, Rattus norvegicus
tgccgtttcccagacgacttggata

SEQ ID NO: 482572 - DNA, 25 bp, Rattus norvegicus
actcaggaaggcctcctccaagggc

SEQ ID NO: 482573 - DNA, 25 bp, Rattus norvegicus
acaagcgaaccgactaccggaggtg

SEQ ID NO: 482574 - DNA, 25 bp, Rattus norvegicus
gcaactacaccaccaactgctttgg

SEQ ID NO: 482575 - DNA, 25 bp, Rattus norvegicus
tcaccgtgcacacaggaacccgggt

SEQ ID NO: 482576 - DNA, 25 bp, Rattus norvegicus
ccagcgaggacgatcagagcaacta

SEQ ID NO: 482577 - DNA, 25 bp, Rattus norvegicus
cgaggtctcctacgaagaggccctg

SEQ ID NO: 482578 - DNA, 25 bp, Rattus norvegicus
acgtggccagcgactctgagtactc

SEQ ID NO: 482579 - DNA, 25 bp, Rattus norvegicus
ctgctttggcgacagtgagtccagc

SEQ ID NO: 482580 - DNA, 25 bp, Rattus norvegicus
gccgagtgtgagtcgctcttccact

SEQ ID NO: 482581 - DNA, 25 bp, Rattus norvegicus
cgctcttccactccacggtggtgga

SEQ ID NO: 482582 - DNA, 25 bp, Rattus norvegicus
cggcacgcgttaggtactgagtaaa

SEQ ID NO: 482583 - DNA, 25 bp, Rattus norvegicus
cttgcggactacatgattgcggctc

SEQ ID NO: 482584 - DNA, 25 bp, Rattus norvegicus
ccaggattgccttgcggactacatg

SEQ ID NO: 482585 - DNA, 25 bp, Rattus norvegicus
ctggtgtacagaaggtgctcggcac

SEQ ID NO: 482586 - DNA, 25 bp, Rattus norvegicus
actggcgtgtgctctttaccctgcc

SEQ ID NO: 482587 - DNA, 25 bp, Rattus norvegicus
actgagtaaatcagccctttgctcc

SEQ ID NO: 482588 - DNA, 25 bp, Rattus norvegicus
tttgctccttcatcactggcgtgtg

SEQ ID NO: 482589 - DNA, 25 bp, Rattus norvegicus
gctcctcctgtcgagtgggatgaga

SEQ ID NO: 482590 - DNA, 25 bp, Rattus norvegicus
ctggtggatggtgacgattacaatg

SEQ ID NO: 482591 - DNA, 25 bp, Rattus norvegicus
gacgattacaatgcggttcctgcga

SEQ ID NO: 482592 - DNA, 25 bp, Rattus norvegicus
gttcctgcgagccagctcgaccaag

SEQ ID NO: 482593 - DNA, 25 bp, Rattus norvegicus
agccagctcgaccaagaggaggacg

SEQ ID NO: 482594 - DNA, 25 bp, Rattus norvegicus
acatgattgcggctcgaatgggctg

SEQ ID NO: 482595 - DNA, 25 bp, Rattus norvegicus
tcccttacgtggaagagctcagagc

SEQ ID NO: 482596 - DNA, 25 bp, Rattus norvegicus
actcaaaacggaggggctgactgta

SEQ ID NO: 482597 - DNA, 25 bp, Rattus norvegicus
tcacctgcgagttggtaacctacga

SEQ ID NO: 482598 - DNA, 25 bp, Rattus norvegicus
cggatcccattgtaccgggaacgca

SEQ ID NO: 482599 - DNA, 25 bp, Rattus norvegicus
agcggcctttccagcatgcagcggc

SEQ ID NO: 482600 - DNA, 25 bp, Rattus norvegicus
gggtgccatcttgtatcctatcaga

SEQ ID NO: 482601 - DNA, 25 bp, Rattus norvegicus
gcactcattcattagcggcaccgca

SEQ ID NO: 482602 - DNA, 25 bp, Rattus norvegicus
agctcccgggccagtaggtaaatat

SEQ ID NO: 482603 - DNA, 25 bp, Rattus norvegicus
cttcgggctgccaatctaggctttg

SEQ ID NO: 482604 - DNA, 25 bp, Rattus norvegicus
ccttctttctttccgaggcgctggg

SEQ ID NO: 482605 - DNA, 25 bp, Rattus norvegicus
ttcgggtcaagccatactcaaaacg

SEQ ID NO: 482606 - DNA, 25 bp, Rattus norvegicus
ccgagcttactgtgtgcggaaagaa

SEQ ID NO: 482607 - DNA, 25 bp, Rattus norvegicus
atcgagacctgcaaagggcacctgg

SEQ ID NO: 482608 - DNA, 25 bp, Rattus norvegicus
cagtcttggctctgcggaatcgaga

SEQ ID NO: 482609 - DNA, 25 bp, Rattus norvegicus
aagccggtccggtacatctcgcttc

SEQ ID NO: 482610 - DNA, 25 bp, Rattus norvegicus
gcataggtggtcatcggccgcacac

SEQ ID NO: 482611 - DNA, 25 bp, Rattus norvegicus
ctgaccagaacagcagccgcgggga

SEQ ID NO: 482612 - DNA, 25 bp, Rattus norvegicus
ccgacagggacagcgataggatgaa

SEQ ID NO: 482613 - DNA, 25 bp, Rattus norvegicus
tccgacaggcgcacagtcttgcaga

SEQ ID NO: 482614 - DNA, 25 bp, Rattus norvegicus
tggtagcggcagaaacacatcagca

SEQ ID NO: 482615 - DNA, 25 bp, Rattus norvegicus
cgagatgagcgccacgctgaacgtg

SEQ ID NO: 482616 - DNA, 25 bp, Rattus norvegicus
acacgaactgaagaagcggctggcg

SEQ ID NO: 482617 - DNA, 25 bp, Rattus norvegicus
gcgcagtttcccaggctagacagta

SEQ ID NO: 482618 - DNA, 25 bp, Rattus norvegicus
gcatcgctctggtttcccagcgtta

SEQ ID NO: 482619 - DNA, 25 bp, Rattus norvegicus
tggctacggagctgaacgacagcgc

SEQ ID NO: 482620 - DNA, 25 bp, Rattus norvegicus
tacccggcaaggttgcactcgcagc

SEQ ID NO: 482621 - DNA, 25 bp, Rattus norvegicus
gctcctccataggttcccgggcagg

SEQ ID NO: 482622 - DNA, 25 bp, Rattus norvegicus
catcccgcagcagggtgaaaggttg

SEQ ID NO: 482623 - DNA, 25 bp, Rattus norvegicus
ctgaacgtggagacgatgccgaaac

SEQ ID NO: 482624 - DNA, 25 bp, Rattus norvegicus
tggaagcgcacagggccgcaactac

SEQ ID NO: 482625 - DNA, 25 bp, Rattus norvegicus
ttgcactgcacggtggtgctctctc

SEQ ID NO: 482626 - DNA, 25 bp, Rattus norvegicus
tgtctgcgtccactccaactgttgc

SEQ ID NO: 482627 - DNA, 25 bp, Rattus norvegicus
aagcgccgcttccattgtctgcgtc

SEQ ID NO: 482628 - DNA, 25 bp, Rattus norvegicus
gtgtgcatgtccaccaccgacagtg

SEQ ID NO: 482629 - DNA, 25 bp, Rattus norvegicus
tgcacgatgcgcaaaggctcgccgc

SEQ ID NO: 482630 - DNA, 25 bp, Rattus norvegicus
catgtagcgccgcttggccagcaac

SEQ ID NO: 482631 - DNA, 25 bp, Rattus norvegicus
tcgaggtgttgacgcatgtagcgcc

SEQ ID NO: 482632 - DNA, 25 bp, Rattus norvegicus
cgccgtacgtagtcgaggtgttgac

SEQ ID NO: 482633 - DNA, 25 bp, Rattus norvegicus
cagctcactgggtactaggatggcc

SEQ ID NO: 482634 - DNA, 25 bp, Rattus norvegicus
ttgtgcaggaacaggacgcctaggt

SEQ ID NO: 482635 - DNA, 25 bp, Rattus norvegicus
ctgtaaccttcgttgtgcaggaaca

SEQ ID NO: 482636 - DNA, 25 bp, Rattus norvegicus
gcaccagtccgaagtcgagcgcgaa

SEQ ID NO: 482637 - DNA, 25 bp, Rattus norvegicus
tggccgcacatggagctgtaacctt

SEQ ID NO: 482638 - DNA, 25 bp, Rattus norvegicus
aagggctacgactggaccctggtgc

SEQ ID NO: 482639 - DNA, 25 bp, Rattus norvegicus
atgccggtgcgcgtcaacggctcca

SEQ ID NO: 482640 - DNA, 25 bp, Rattus norvegicus
gggacgcgggctgcacttaccgacc

SEQ ID NO: 482641 - DNA, 25 bp, Rattus norvegicus
tgccacggagggctcagtggctacc

SEQ ID NO: 482642 - DNA, 25 bp, Rattus norvegicus
agtacccgcatctgcacaacgcgga

SEQ ID NO: 482643 - DNA, 25 bp, Rattus norvegicus
gctccagcaagaacaagccacacgt

SEQ ID NO: 482644 - DNA, 25 bp, Rattus norvegicus
aattcccagtgtgcatccgcgaggc

SEQ ID NO: 482645 - DNA, 25 bp, Rattus norvegicus
aaggagagcgaggaagataaattcc

SEQ ID NO: 482646 - DNA, 25 bp, Rattus norvegicus
ggctccgacacggagaacacacggc

SEQ ID NO: 482647 - DNA, 25 bp, Rattus norvegicus
cgggctcaggctccgacacggagaa

SEQ ID NO: 482648 - DNA, 25 bp, Rattus norvegicus
cccttcatgaagatgaccgacgagc

SEQ ID NO: 482649 - DNA, 25 bp, Rattus norvegicus
ggctcgcgtatgaatctcctggacc

SEQ ID NO: 482650 - DNA, 25 bp, Rattus norvegicus
gtgctgaagggctacgactggaccc

SEQ ID NO: 482651 - DNA, 25 bp, Rattus norvegicus
cgcgtcaacggctccagcaagaaca

SEQ ID NO: 482652 - DNA, 25 bp, Rattus norvegicus
agagtgggccaaggcaatccaggcc

SEQ ID NO: 482653 - DNA, 25 bp, Rattus norvegicus
atcgaggccagcacgggaccaccct

SEQ ID NO: 482654 - DNA, 25 bp, Rattus norvegicus
gctgctgggcggtgagcacagcgtt

SEQ ID NO: 482655 - DNA, 25 bp, Rattus norvegicus
tcgctgtgaccagcgcccagcggcc

SEQ ID NO: 482656 - DNA, 25 bp, Rattus norvegicus
gatcacagctcgctgtgaccagcgc

SEQ ID NO: 482657 - DNA, 25 bp, Rattus norvegicus
ccgggtggatcacagctcgctgtga

SEQ ID NO: 482658 - DNA, 25 bp, Rattus norvegicus
ctcctcgccatctcgcccaaggcgt

SEQ ID NO: 482659 - DNA, 25 bp, Rattus norvegicus
gctggggcccgggatataggcgccc

SEQ ID NO: 482660 - DNA, 25 bp, Rattus norvegicus
gtgcggcagtgactccctctgcagc

SEQ ID NO: 482661 - DNA, 25 bp, Rattus norvegicus
caaggcaatccaggccgagtgaatt

SEQ ID NO: 482662 - DNA, 25 bp, Rattus norvegicus
tccgagctggaagcgagagtgggcc

SEQ ID NO: 482663 - DNA, 25 bp, Rattus norvegicus
ggaccaccctgcgagtgccaaccga

SEQ ID NO: 482664 - DNA, 25 bp, Rattus norvegicus
tgaattacgggtgcggcagtgactc

SEQ ID NO: 482665 - DNA, 25 bp, Rattus norvegicus
ctgcgccatcgaggccagcacggga

SEQ ID NO: 482666 - DNA, 25 bp, Rattus norvegicus
tctgctgcttttccaacgcattttc

SEQ ID NO: 482667 - DNA, 25 bp, Rattus norvegicus
ttttcttgggctcgcctccgaccga

SEQ ID NO: 482668 - DNA, 25 bp, Rattus norvegicus
actcggagcttaatgtagcaggggc

SEQ ID NO: 482669 - DNA, 25 bp, Rattus norvegicus
gttccagagcgattgccaggctctc

SEQ ID NO: 482670 - DNA, 25 bp, Rattus norvegicus
atgttcgggcgctgtgttcggaccc

SEQ ID NO: 482671 - DNA, 25 bp, Rattus norvegicus
tgttcggacccgctgattcccggct

SEQ ID NO: 482672 - DNA, 25 bp, Rattus norvegicus
gctgattcccggcttctctggggaa

SEQ ID NO: 482673 - DNA, 25 bp, Rattus norvegicus
ttctctggggaacctagtgtggcca

SEQ ID NO: 482674 - DNA, 25 bp, Rattus norvegicus
acctagtgtggccaatgggtaagtg

SEQ ID NO: 482675 - DNA, 25 bp, Rattus norvegicus
ccaatgggtaagtggtcgattaggc

SEQ ID NO: 482676 - DNA, 25 bp, Rattus norvegicus
gcgggactcggagcttaatgtagca

SEQ ID NO: 482677 - DNA, 25 bp, Rattus norvegicus
ctgtctttgtctctgctgcttttcc

SEQ ID NO: 482678 - DNA, 25 bp, Rattus norvegicus
caacgcattttcttgggctcgcctc

SEQ ID NO: 482679 - DNA, 25 bp, Rattus norvegicus
aggctgcgggcgtgtctctgtcttt

SEQ ID NO: 482680 - DNA, 25 bp, Rattus norvegicus
tgagcttgcactctgcgtcgctgcc

SEQ ID NO: 482681 - DNA, 25 bp, Rattus norvegicus
cccaggatggtagagcaggcgaaga

SEQ ID NO: 482682 - DNA, 25 bp, Rattus norvegicus
tgctgcggctgctcaagcggaccgc

SEQ ID NO: 482683 - DNA, 25 bp, Rattus norvegicus
gacagcgaatcagcgcggtcccgga

SEQ ID NO: 482684 - DNA, 25 bp, Rattus norvegicus
gcgcggctgcagactgaagctgccc

SEQ ID NO: 482685 - DNA, 25 bp, Rattus norvegicus
ctccaggcgctgagcttgcactctg

SEQ ID NO: 482686 - DNA, 25 bp, Rattus norvegicus
ccatcttggtggaatcggcagtggc

SEQ ID NO: 482687 - DNA, 25 bp, Rattus norvegicus
acagtccatcttggtggaatcggca

SEQ ID NO: 482688 - DNA, 25 bp, Rattus norvegicus
gctccacacacagtccatcttggtg

SEQ ID NO: 482689 - DNA, 25 bp, Rattus norvegicus
aagagaataccctgacttttccagt

SEQ ID NO: 482690 - DNA, 25 bp, Rattus norvegicus
ctaccgaaataaagagaataccctg

SEQ ID NO: 482691 - DNA, 25 bp, Rattus norvegicus
cgcaggcatgcactaccgaaataaa

SEQ ID NO: 482692 - DNA, 25 bp, Rattus norvegicus
tgcgccgcaggcatgcactaccgaa

SEQ ID NO: 482693 - DNA, 25 bp, Rattus norvegicus
gccgcagagcgcgacagcgaatcag

SEQ ID NO: 482694 - DNA, 25 bp, Rattus norvegicus
ccggcttacctgtggatgcagtttc

SEQ ID NO: 482695 - DNA, 25 bp, Rattus norvegicus
cgctgctgctgttctgggcgcttcg

SEQ ID NO: 482696 - DNA, 25 bp, Rattus norvegicus
caactcaggccgagacgctgctgct

SEQ ID NO: 482697 - DNA, 25 bp, Rattus norvegicus
ttttctgcaactcaggccgagacgc

SEQ ID NO: 482698 - DNA, 25 bp, Rattus norvegicus
gccaccgtcgctgctttttctgcaa

SEQ ID NO: 482699 - DNA, 25 bp, Rattus norvegicus
ggaggctgcagagtctccgcgccac

SEQ ID NO: 482700 - DNA, 25 bp, Rattus norvegicus
gctcatcttgcagatccggcggtgc

SEQ ID NO: 482701 - DNA, 25 bp, Rattus norvegicus
gcctctatttgtggggtcccggtgc

SEQ ID NO: 482702 - DNA, 25 bp, Rattus norvegicus
cagatccggcggtgcggccatgact

SEQ ID NO: 482703 - DNA, 25 bp, Rattus norvegicus
tagccggagacagtggctcatcttg

SEQ ID NO: 482704 - DNA, 25 bp, Rattus norvegicus
gagcacagttcccgcgacgacacta

SEQ ID NO: 482705 - DNA, 25 bp, Rattus norvegicus
tgtggatgcagtttccatggcgacg

SEQ ID NO: 482706 - DNA, 25 bp, Rattus norvegicus
ctccagaggcagctcgctgtgcctg

SEQ ID NO: 482707 - DNA, 25 bp, Rattus norvegicus
tagggacgcggacgctccctgctgc

SEQ ID NO: 482708 - DNA, 25 bp, Rattus norvegicus
agctcggctacggagcgcacgtgac

SEQ ID NO: 482709 - DNA, 25 bp, Rattus norvegicus
tgactccaggtatgtccgtcctcga

SEQ ID NO: 482710 - DNA, 25 bp, Rattus norvegicus
ccctgcggtgactccaggtatgtcc

SEQ ID NO: 482711 - DNA, 25 bp, Rattus norvegicus
gagatgtggtcccaggacgcgctct

SEQ ID NO: 482712 - DNA, 25 bp, Rattus norvegicus
cttcagcaggggagatgtggtccca

SEQ ID NO: 482713 - DNA, 25 bp, Rattus norvegicus
ccaacctacttcagcaggggagatg

SEQ ID NO: 482714 - DNA, 25 bp, Rattus norvegicus
ctcgggcgagacctcccaacctact

SEQ ID NO: 482715 - DNA, 25 bp, Rattus norvegicus
tggtggggccctcatccagcctcgg

SEQ ID NO: 482716 - DNA, 25 bp, Rattus norvegicus
tcagctgctggtggggccctcatcc

SEQ ID NO: 482717 - DNA, 25 bp, Rattus norvegicus
ttagccatggaaaccggagcggtcc

SEQ ID NO: 482718 - DNA, 25 bp, Rattus norvegicus
cgcagttgatgttagccatggaaac

SEQ ID NO: 482719 - DNA, 25 bp, Rattus norvegicus
gcccgagcgcagttgatgttagcca

SEQ ID NO: 482720 - DNA, 25 bp, Rattus norvegicus
atgtccgtcctcgacacacctggga

SEQ ID NO: 482721 - DNA, 25 bp, Rattus norvegicus
acgtgacccgcctccgctgagccta

SEQ ID NO: 482722 - DNA, 25 bp, Rattus norvegicus
gctagcttgagagtgcactgtctgg

SEQ ID NO: 482723 - DNA, 25 bp, Rattus norvegicus
agctagcttgagagtgcactgtctg

SEQ ID NO: 482724 - DNA, 25 bp, Rattus norvegicus
aagctagcttgagagtgcactgtct

SEQ ID NO: 482725 - DNA, 25 bp, Rattus norvegicus
aaagctagcttgagagtgcactgtc

SEQ ID NO: 482726 - DNA, 25 bp, Rattus norvegicus
gaaagctagcttgagagtgcactgt

SEQ ID NO: 482727 - DNA, 25 bp, Rattus norvegicus
agaaagctagcttgagagtgcactg

SEQ ID NO: 482728 - DNA, 25 bp, Rattus norvegicus
tagaaagctagcttgagagtgcact

SEQ ID NO: 482729 - DNA, 25 bp, Rattus norvegicus
tagcttgagagtgcactgtctgggc

SEQ ID NO: 482730 - DNA, 25 bp, Rattus norvegicus
ctagcttgagagtgcactgtctggg

SEQ ID NO: 482731 - DNA, 25 bp, Rattus norvegicus
acccaggacttcgaggctcccaagg

SEQ ID NO: 482732 - DNA, 25 bp, Rattus norvegicus
gggaggagacgcgacaactccaccc

SEQ ID NO: 482733 - DNA, 25 bp, Rattus norvegicus
caggcctggggcctgtaaacaagcc

SEQ ID NO: 482734 - DNA, 25 bp, Rattus norvegicus
tccgacgcccggatgatctgagccg

SEQ ID NO: 482735 - DNA, 25 bp, Rattus norvegicus
aaagcgatgaatcctcggcgcctcc

SEQ ID NO: 482736 - DNA, 25 bp, Rattus norvegicus
tagaacgccgtggtctccgcgccgg

SEQ ID NO: 482737 - DNA, 25 bp, Rattus norvegicus
caggagctagaacgccgtggtctcc

SEQ ID NO: 482738 - DNA, 25 bp, Rattus norvegicus
cgcagggcagtgacgtcaccacagc

SEQ ID NO: 482739 - DNA, 25 bp, Rattus norvegicus
aggctcccaagggatcagcccgcgg

SEQ ID NO: 482740 - DNA, 25 bp, Rattus norvegicus
ctccgcgctctagcacgaaggccgc

SEQ ID NO: 482741 - DNA, 25 bp, Rattus norvegicus
taagagtcaggtgtggacgaagacc

SEQ ID NO: 482742 - DNA, 25 bp, Rattus norvegicus
ctgcacctgatgactggcgtctgta

SEQ ID NO: 482743 - DNA, 25 bp, Rattus norvegicus
gggccctaaccgagactgcacctga

SEQ ID NO: 482744 - DNA, 25 bp, Rattus norvegicus
cacagcagccggctaaggagcagcg

SEQ ID NO: 482745 - DNA, 25 bp, Rattus norvegicus
ttaagagtctaagccctttggtgcc

SEQ ID NO: 482746 - DNA, 25 bp, Rattus norvegicus
gtggtcagccacagatctcgcgaga

SEQ ID NO: 482747 - DNA, 25 bp, Rattus norvegicus
tgcgcaccacgtggtcagccacaga

SEQ ID NO: 482748 - DNA, 25 bp, Rattus norvegicus
gaagaccctgcgcaccacgtggtca

SEQ ID NO: 482749 - DNA, 25 bp, Rattus norvegicus
cttggaagaccctgcgcaccacgtg

SEQ ID NO: 482750 - DNA, 25 bp, Rattus norvegicus
tctaagccctttggtgccggccttg

SEQ ID NO: 482751 - DNA, 25 bp, Rattus norvegicus
gccctgagctttaagagtctaagcc

SEQ ID NO: 482752 - DNA, 25 bp, Rattus norvegicus
acctgccctgagctttaagagtcta

SEQ ID NO: 482753 - DNA, 25 bp, Rattus norvegicus
acgctacctgccctgagctttaaga

SEQ ID NO: 482754 - DNA, 25 bp, Rattus norvegicus
gttctgcaaacgctacctgccctga

SEQ ID NO: 482755 - DNA, 25 bp, Rattus norvegicus
cggggttctgcaaacgctacctgcc

SEQ ID NO: 482756 - DNA, 25 bp, Rattus norvegicus
cagcgcggggttctgcaaacgctac

SEQ ID NO: 482757 - DNA, 25 bp, Rattus norvegicus
cagccacagatctcgcgagatcacg

SEQ ID NO: 482758 - DNA, 25 bp, Rattus norvegicus
tgccggccttggaagaccctgcgca

SEQ ID NO: 482759 - DNA, 25 bp, Rattus norvegicus
gagagccagcatcgccgtgtatctc

SEQ ID NO: 482760 - DNA, 25 bp, Rattus norvegicus
agctgctgcggagagccagcatcgc

SEQ ID NO: 482761 - DNA, 25 bp, Rattus norvegicus
gcatcgccgtgtatctcagcgtctc

SEQ ID NO: 482762 - DNA, 25 bp, Rattus norvegicus
tcccgcaccgtgaggctgctcagaa

SEQ ID NO: 482763 - DNA, 25 bp, Rattus norvegicus
ccgtgaggctgctcagaaagacatc

SEQ ID NO: 482764 - DNA, 25 bp, Rattus norvegicus
ggctgctcagaaagacatcgctctg

SEQ ID NO: 482765 - DNA, 25 bp, Rattus norvegicus
gaaagacatcgctctgcaggaaagg

SEQ ID NO: 482766 - DNA, 25 bp, Rattus norvegicus
acgcccacctgcaggaggtaggaga

SEQ ID NO: 482767 - DNA, 25 bp, Rattus norvegicus
gacgcagtcttggaactggtccctg

SEQ ID NO: 482768 - DNA, 25 bp, Rattus norvegicus
cttggaactggtccctgcgcagctc

SEQ ID NO: 482769 - DNA, 25 bp, Rattus norvegicus
tgcgcagctcgcagccgttcacaaa

SEQ ID NO: 482770 - DNA, 25 bp, Rattus norvegicus
agctcgcagccgttcacaaacactt

SEQ ID NO: 482771 - DNA, 25 bp, Rattus norvegicus
agcctcccagagatggcgtccagca

SEQ ID NO: 482772 - DNA, 25 bp, Rattus norvegicus
gggacacgcccacctgcaggaggta

SEQ ID NO: 482773 - DNA, 25 bp, Rattus norvegicus
tcactgcttcaaggagcgcacacgg

SEQ ID NO: 482774 - DNA, 25 bp, Rattus norvegicus
acaaaaatgagtcggtgctgcgcgc

SEQ ID NO: 482775 - DNA, 25 bp, Rattus norvegicus
tttgggatggcgaacagaagactca

SEQ ID NO: 482776 - DNA, 25 bp, Rattus norvegicus
aacgctgagcagtctcccggcaaac

SEQ ID NO: 482777 - DNA, 25 bp, Rattus norvegicus
aggcactgtggctcgaagctcatta

SEQ ID NO: 482778 - DNA, 25 bp, Rattus norvegicus
aacccacatctcttccaggcgggaa

SEQ ID NO: 482779 - DNA, 25 bp, Rattus norvegicus
ctaaggaatcgcacgccaagctgca

SEQ ID NO: 482780 - DNA, 25 bp, Rattus norvegicus
ggcgtgtcctagctgagcaagcgca

SEQ ID NO: 482781 - DNA, 25 bp, Rattus norvegicus
tcatccttcaggtcggtaaaacgct

SEQ ID NO: 482782 - DNA, 25 bp, Rattus norvegicus
tggcagagctgcctagtgactgaca

SEQ ID NO: 482783 - DNA, 25 bp, Rattus norvegicus
cgcgctagtcgcagcattgattggc

SEQ ID NO: 482784 - DNA, 25 bp, Rattus norvegicus
tcgtggccttccacggtggcaacta

SEQ ID NO: 482785 - DNA, 25 bp, Rattus norvegicus
cggcagcctgtgaggccctcaacaa

SEQ ID NO: 482786 - DNA, 25 bp, Rattus norvegicus
taccgcgagctctaccacattctgg

SEQ ID NO: 482787 - DNA, 25 bp, Rattus norvegicus
gggaagctcacccaatggaggcatt

SEQ ID NO: 482788 - DNA, 25 bp, Rattus norvegicus
ggagttgcagcttctcgctctattc

SEQ ID NO: 482789 - DNA, 25 bp, Rattus norvegicus
ggccgatttccgctcccattgtgag

SEQ ID NO: 482790 - DNA, 25 bp, Rattus norvegicus
ctcccattgtgagaccggcagcagg

SEQ ID NO: 482791 - DNA, 25 bp, Rattus norvegicus
cggctcagcgtaatcagggctaatg

SEQ ID NO: 482792 - DNA, 25 bp, Rattus norvegicus
ctgcagacctgcgatgtctcggccg

SEQ ID NO: 482793 - DNA, 25 bp, Rattus norvegicus
aatggaggcattgagccgcttctgc

SEQ ID NO: 482794 - DNA, 25 bp, Rattus norvegicus
tcgaaggtccgctacagcgtgcaca

SEQ ID NO: 482795 - DNA, 25 bp, Rattus norvegicus
gcggaccggagaccctccagcaagt

SEQ ID NO: 482796 - DNA, 25 bp, Rattus norvegicus
tccagcaagtctgggcagcacccga

SEQ ID NO: 482797 - DNA, 25 bp, Rattus norvegicus
cggcctggacttctggcctcacgaa

SEQ ID NO: 482798 - DNA, 25 bp, Rattus norvegicus
agctggcgccttagttctggactca

SEQ ID NO: 482799 - DNA, 25 bp, Rattus norvegicus
tctggactcaggtaacgcgacaagg

SEQ ID NO: 482800 - DNA, 25 bp, Rattus norvegicus
gctttgtcggcctgaatggctaatg

SEQ ID NO: 482801 - DNA, 25 bp, Rattus norvegicus
cttcccatgctagcacctcgaaata

SEQ ID NO: 482802 - DNA, 25 bp, Rattus norvegicus
cgccgcttctctgggaaggctgagc

SEQ ID NO: 482803 - DNA, 25 bp, Rattus norvegicus
atctccgtctctcacctccatgggg

SEQ ID NO: 482804 - DNA, 25 bp, Rattus norvegicus
tggctttgcggccatctccgtctct

SEQ ID NO: 482805 - DNA, 25 bp, Rattus norvegicus
tgtcccaaacggaggccgacctggc

SEQ ID NO: 482806 - DNA, 25 bp, Rattus norvegicus
gggtccacatgtcccaaacggaggc

SEQ ID NO: 482807 - DNA, 25 bp, Rattus norvegicus
ctcgaaatacagagaccggggtcca

SEQ ID NO: 482808 - DNA, 25 bp, Rattus norvegicus
gtctgcctgtcagggtgctgctccc

SEQ ID NO: 482809 - DNA, 25 bp, Rattus norvegicus
cgtatccagccggtctgcctgtcag

SEQ ID NO: 482810 - DNA, 25 bp, Rattus norvegicus
tcaaccggagcgctgcgtatccagc

SEQ ID NO: 482811 - DNA, 25 bp, Rattus norvegicus
cagctcaaccggagcgctgcgtatc

SEQ ID NO: 482812 - DNA, 25 bp, Rattus norvegicus
tgggtaacacgtcaggttcacaagg

SEQ ID NO: 482813 - DNA, 25 bp, Rattus norvegicus
gagaccggggtccacatgtcccaaa

SEQ ID NO: 482814 - DNA, 25 bp, Rattus norvegicus
cgctcttcgagaccgagccgccgca

SEQ ID NO: 482815 - DNA, 25 bp, Rattus norvegicus
agcaagcatcaacttctcggctttg

SEQ ID NO: 482816 - DNA, 25 bp, Rattus norvegicus
tcggagcaagcatcaacttctcggc

SEQ ID NO: 482817 - DNA, 25 bp, Rattus norvegicus
ggggctcggagcaagcatcaacttc

SEQ ID NO: 482818 - DNA, 25 bp, Rattus norvegicus
cgacttgagccaccgatgaaggacc

SEQ ID NO: 482819 - DNA, 25 bp, Rattus norvegicus
actcagggcgcgatgattgacaggc

SEQ ID NO: 482820 - DNA, 25 bp, Rattus norvegicus
caggcgacttgagccaccgatgaag

SEQ ID NO: 482821 - DNA, 25 bp, Rattus norvegicus
agagctcgatcccactcagggcgcg

SEQ ID NO: 482822 - DNA, 25 bp, Rattus norvegicus
cttctcggctttgcttctcccatta

SEQ ID NO: 482823 - DNA, 25 bp, Rattus norvegicus
aggccgctgactgatgagggcagac

SEQ ID NO: 482824 - DNA, 25 bp, Rattus norvegicus
agcttccaccgccagtgccgggagg

SEQ ID NO: 482825 - DNA, 25 bp, Rattus norvegicus
tggaagcttccaccgccagtgccgg

SEQ ID NO: 482826 - DNA, 25 bp, Rattus norvegicus
ccggcacccgctggaagcttccacc

SEQ ID NO: 482827 - DNA, 25 bp, Rattus norvegicus
cgatcccactcagggcgcgatgatt

SEQ ID NO: 482828 - DNA, 25 bp, Rattus norvegicus
ttgagccaccgatgaaggaccgcgt

SEQ ID NO: 482829 - DNA, 25 bp, Rattus norvegicus
actcatcagggaggccgagccttga

SEQ ID NO: 482830 - DNA, 25 bp, Rattus norvegicus
cgagccttgagtctgggagagtccc

SEQ ID NO: 482831 - DNA, 25 bp, Rattus norvegicus
gctaggaactcatcagggaggccga

SEQ ID NO: 482832 - DNA, 25 bp, Rattus norvegicus
cactcgcgtgagctaggaactcatc

SEQ ID NO: 482833 - DNA, 25 bp, Rattus norvegicus
agcgtcctgtgccactcgcgtgagc

SEQ ID NO: 482834 - DNA, 25 bp, Rattus norvegicus
ctgggatcctcttgcagccagggga

SEQ ID NO: 482835 - DNA, 25 bp, Rattus norvegicus
tgaaactcgcactgggatcctcttg

SEQ ID NO: 482836 - DNA, 25 bp, Rattus norvegicus
cccggtgatgctgaaactcgcactg

SEQ ID NO: 482837 - DNA, 25 bp, Rattus norvegicus
tagaagcccggtgatgctgaaactc

SEQ ID NO: 482838 - DNA, 25 bp, Rattus norvegicus
tgcaccgaccggagcggactgtcga

SEQ ID NO: 482839 - DNA, 25 bp, Rattus norvegicus
attccagtctagtgggaagagccgc

SEQ ID NO: 482840 - DNA, 25 bp, Rattus norvegicus
ccgaagtcaagattccagtctagtg

SEQ ID NO: 482841 - DNA, 25 bp, Rattus norvegicus
agtcacagaaccgaagtcaagattc

SEQ ID NO: 482842 - DNA, 25 bp, Rattus norvegicus
ctcgataaggcgttaaagtcacaga

SEQ ID NO: 482843 - DNA, 25 bp, Rattus norvegicus
ccctttgtccaactagcacagaatg

SEQ ID NO: 482844 - DNA, 25 bp, Rattus norvegicus
ttataggacaccaaggagcgacacc

SEQ ID NO: 482845 - DNA, 25 bp, Rattus norvegicus
cgtagtgcgctttcagccacagctg

SEQ ID NO: 482846 - DNA, 25 bp, Rattus norvegicus
gcagaactttcctccatagaccagc

SEQ ID NO: 482847 - DNA, 25 bp, Rattus norvegicus
gggccgagcattcaactcagagctg

SEQ ID NO: 482848 - DNA, 25 bp, Rattus norvegicus
tcagagctgcttcaagccggagaga

SEQ ID NO: 482849 - DNA, 25 bp, Rattus norvegicus
caggcttggaccctcttataggaca

SEQ ID NO: 482850 - DNA, 25 bp, Rattus norvegicus
atggtctcatccctggggtcacccg

SEQ ID NO: 482851 - DNA, 25 bp, Rattus norvegicus
aagcacgccgcgtacctttccttgg

SEQ ID NO: 482852 - DNA, 25 bp, Rattus norvegicus
gtagctagtctcttcgccatcccag

SEQ ID NO: 482853 - DNA, 25 bp, Rattus norvegicus
cgatatttgcccacggcacccaggg

SEQ ID NO: 482854 - DNA, 25 bp, Rattus norvegicus
aagtttctcggcctccacgtagtgc

SEQ ID NO: 482855 - DNA, 25 bp, Rattus norvegicus
gccacagctgctgcaatttgggatg

SEQ ID NO: 482856 - DNA, 25 bp, Rattus norvegicus
tgaacttttactgcagcgccgccga

SEQ ID NO: 482857 - DNA, 25 bp, Rattus norvegicus
ggggaccctgacactgctgcagtgc

SEQ ID NO: 482858 - DNA, 25 bp, Rattus norvegicus
agccttccgcctgctggaaccgaaa

SEQ ID NO: 482859 - DNA, 25 bp, Rattus norvegicus
gtcttcctggcaaagcagccttccg

SEQ ID NO: 482860 - DNA, 25 bp, Rattus norvegicus
gggcgctgtcttcctggcaaagcag

SEQ ID NO: 482861 - DNA, 25 bp, Rattus norvegicus
ctccagggttgataggcgattagaa

SEQ ID NO: 482862 - DNA, 25 bp, Rattus norvegicus
gctctccagggttgataggcgatta

SEQ ID NO: 482863 - DNA, 25 bp, Rattus norvegicus
gatccggcgctctagccaggtggcc

SEQ ID NO: 482864 - DNA, 25 bp, Rattus norvegicus
tgcagagcagggatccggcgctcta

SEQ ID NO: 482865 - DNA, 25 bp, Rattus norvegicus
tccgcccagttgtgcagagcaggga

SEQ ID NO: 482866 - DNA, 25 bp, Rattus norvegicus
tgctggaaccgaaacaaaaagagga

SEQ ID NO: 482867 - DNA, 25 bp, Rattus norvegicus
acactgctgcagtgcggggaccgct

SEQ ID NO: 482868 - DNA, 25 bp, Rattus norvegicus
tggggaccgcagaacctggcctcac

SEQ ID NO: 482869 - DNA, 25 bp, Rattus norvegicus
gaccgctccgcccagttgtgcagag

SEQ ID NO: 482870 - DNA, 25 bp, Rattus norvegicus
gcactccgagtgttcccatggggac

SEQ ID NO: 482871 - DNA, 25 bp, Rattus norvegicus
aagttggcgctcaccttttggactg

SEQ ID NO: 482872 - DNA, 25 bp, Rattus norvegicus
tcgttgccacgtagcaggtcgctct

SEQ ID NO: 482873 - DNA, 25 bp, Rattus norvegicus
ttcagcaggctctcgttgccacgta

SEQ ID NO: 482874 - DNA, 25 bp, Rattus norvegicus
tggctctcgaggatgctgtacaact

SEQ ID NO: 482875 - DNA, 25 bp, Rattus norvegicus
gccgactcgaagctgtggctctcga

SEQ ID NO: 482876 - DNA, 25 bp, Rattus norvegicus
cgcgccttgtaccagagctgctgca

SEQ ID NO: 482877 - DNA, 25 bp, Rattus norvegicus
tgcgcgacttctccttgaaacaata

SEQ ID NO: 482878 - DNA, 25 bp, Rattus norvegicus
gcgattctgcttgtagagctcctta

SEQ ID NO: 482879 - DNA, 25 bp, Rattus norvegicus
gccatgttttcgagcgcttggagga

SEQ ID NO: 482880 - DNA, 25 bp, Rattus norvegicus
cctaggagggcgaccagaaacttct

SEQ ID NO: 482881 - DNA, 25 bp, Rattus norvegicus
ccaaggcgagagtggcaacttcaaa

SEQ ID NO: 482882 - DNA, 25 bp, Rattus norvegicus
gcgtgcacacacactccctaaaaga

SEQ ID NO: 482883 - DNA, 25 bp, Rattus norvegicus
agagcagccttgtcggcgtgcacac

SEQ ID NO: 482884 - DNA, 25 bp, Rattus norvegicus
agagctccttaagcgcgttgcgcga

SEQ ID NO: 482885 - DNA, 25 bp, Rattus norvegicus
cgtgaaggcagcgtacagaccctgt

SEQ ID NO: 482886 - DNA, 25 bp, Rattus norvegicus
agcctggctggtacgtatctgtcca

SEQ ID NO: 482887 - DNA, 25 bp, Rattus norvegicus
ccaccgggtcttttgcatcacacga

SEQ ID NO: 482888 - DNA, 25 bp, Rattus norvegicus
agtcggtcgcgaagtaccatgcagg

SEQ ID NO: 482889 - DNA, 25 bp, Rattus norvegicus
gcaggcgtcccggtacagtatagaa

SEQ ID NO: 482890 - DNA, 25 bp, Rattus norvegicus
gggccgcgatttgctacggaatccg

SEQ ID NO: 482891 - DNA, 25 bp, Rattus norvegicus
tcttctgcggatggtgacgtcatca

SEQ ID NO: 482892 - DNA, 25 bp, Rattus norvegicus
agagtggagtccgttgctaagcaac

SEQ ID NO: 482893 - DNA, 25 bp, Rattus norvegicus
gtgcagctcggaaatgggtcttctg

SEQ ID NO: 482894 - DNA, 25 bp, Rattus norvegicus
cagtcgaggccggattaagacccaa

SEQ ID NO: 482895 - DNA, 25 bp, Rattus norvegicus
ttccagatccagcaacagtcgaggc

SEQ ID NO: 482896 - DNA, 25 bp, Rattus norvegicus
ggctctctaaccagctgcatctttc

SEQ ID NO: 482897 - DNA, 25 bp, Rattus norvegicus
tcacacgaaagtctacggctctcta

SEQ ID NO: 482898 - DNA, 25 bp, Rattus norvegicus
tcgctgatttactaggcagtcggtc

SEQ ID NO: 482899 - DNA, 25 bp, Rattus norvegicus
ggcagcgtgaagctccaggagcact

SEQ ID NO: 482900 - DNA, 25 bp, Rattus norvegicus
tgggatccgggctgagctcataaac

SEQ ID NO: 482901 - DNA, 25 bp, Rattus norvegicus
atacagcttgcggaacgtgggcagc

SEQ ID NO: 482902 - DNA, 25 bp, Rattus norvegicus
gcggtgcgcatccacaccacgaagt

SEQ ID NO: 482903 - DNA, 25 bp, Rattus norvegicus
cacgaagtcctggttgatgaagccg

SEQ ID NO: 482904 - DNA, 25 bp, Rattus norvegicus
ctgagctcataaaccggccggtgcc

SEQ ID NO: 482905 - DNA, 25 bp, Rattus norvegicus
gttgcggaacttgacgtggtagtca

SEQ ID NO: 482906 - DNA, 25 bp, Rattus norvegicus
tggtagtcagtccaccaggcgatgg

SEQ ID NO: 482907 - DNA, 25 bp, Rattus norvegicus
cgagcggcacctcgacgaaagggtc

SEQ ID NO: 482908 - DNA, 25 bp, Rattus norvegicus
ttggacagctcgtagtagaggtaca

SEQ ID NO: 482909 - DNA, 25 bp, Rattus norvegicus
ttgccggtgtagtcgtactccagct

SEQ ID NO: 482910 - DNA, 25 bp, Rattus norvegicus
gtactccagctcctggatgccgttg

SEQ ID NO: 482911 - DNA, 25 bp, Rattus norvegicus
cagtcccaggccgatgaacgccagg

SEQ ID NO: 482912 - DNA, 25 bp, Rattus norvegicus
tgccagagcgagaaggaatcgttga

SEQ ID NO: 482913 - DNA, 25 bp, Rattus norvegicus
gctcttcaaaaagggccaccagctg

SEQ ID NO: 482914 - DNA, 25 bp, Rattus norvegicus
cgccgggcttcagagaacttggagc

SEQ ID NO: 482915 - DNA, 25 bp, Rattus norvegicus
tgggtaagtagtgatcgcctcgccc

SEQ ID NO: 482916 - DNA, 25 bp, Rattus norvegicus
gccggcacatcggacaccttcgagg

SEQ ID NO: 482917 - DNA, 25 bp, Rattus norvegicus
caatggctatctgagggtccgcatc

SEQ ID NO: 482918 - DNA, 25 bp, Rattus norvegicus
cctacctgacggtgagcgtagacca

SEQ ID NO: 482919 - DNA, 25 bp, Rattus norvegicus
gtgggccagaccagcacaaagcaga

SEQ ID NO: 482920 - DNA, 25 bp, Rattus norvegicus
cccacctacaacgaggagttctgca

SEQ ID NO: 482921 - DNA, 25 bp, Rattus norvegicus
gttctgcaccaatgtctccgacggc

SEQ ID NO: 482922 - DNA, 25 bp, Rattus norvegicus
tggagctagccgtcttccacgagac

SEQ ID NO: 482923 - DNA, 25 bp, Rattus norvegicus
ccctgggctatgaccactttgtggc

SEQ ID NO: 482924 - DNA, 25 bp, Rattus norvegicus
actttgtggccaactgcacgctgca

SEQ ID NO: 482925 - DNA, 25 bp, Rattus norvegicus
gcacgctgcagttccaggagctgtt

SEQ ID NO: 482926 - DNA, 25 bp, Rattus norvegicus
tcgtccggcacgatgaagttcaatg

SEQ ID NO: 482927 - DNA, 25 bp, Rattus norvegicus
atgttccagccctgcacctaggtta

SEQ ID NO: 482928 - DNA, 25 bp, Rattus norvegicus
ctcagcagggctgacatggttcacc

SEQ ID NO: 482929 - DNA, 25 bp, Rattus norvegicus
caggaggaagggtccagtactcacc

SEQ ID NO: 482930 - DNA, 25 bp, Rattus norvegicus
aattggagcgaatgagcaggacacc

SEQ ID NO: 482931 - DNA, 25 bp, Rattus norvegicus
ctgcagaggacctggaggaacacgt

SEQ ID NO: 482932 - DNA, 25 bp, Rattus norvegicus
caagtcccgagagcgcctagcctag

SEQ ID NO: 482933 - DNA, 25 bp, Rattus norvegicus
ccgagctcctgggatcatctgaatc

SEQ ID NO: 482934 - DNA, 25 bp, Rattus norvegicus
tgaatccgccttttgttttacaatg

SEQ ID NO: 482935 - DNA, 25 bp, Rattus norvegicus
gtgtcgtttttgtgctctgctctca

SEQ ID NO: 482936 - DNA, 25 bp, Rattus norvegicus
cagtgttcctgtttccgtgtccagc

SEQ ID NO: 482937 - DNA, 25 bp, Rattus norvegicus
ccggcttttagagagctcggccaca

SEQ ID NO: 482938 - DNA, 25 bp, Rattus norvegicus
ccctccattttgcagttggtagagc

SEQ ID NO: 482939 - DNA, 25 bp, Rattus norvegicus
ttcaccgtagtcaaggcaggatgca

SEQ ID NO: 482940 - DNA, 25 bp, Rattus norvegicus
ggccaactaggagctacaccgaagg

SEQ ID NO: 482941 - DNA, 25 bp, Rattus norvegicus
accgcgggcaccgattcgccatgga

SEQ ID NO: 482942 - DNA, 25 bp, Rattus norvegicus
acaagccagccggaggagcaactag

SEQ ID NO: 482943 - DNA, 25 bp, Rattus norvegicus
gcggcgagaacgagaagaaaaagta

SEQ ID NO: 482944 - DNA, 25 bp, Rattus norvegicus
ggagcaactaggaacccgaaccaga

SEQ ID NO: 482945 - DNA, 25 bp, Rattus norvegicus
cctagctgcacacagacgagcacgt

SEQ ID NO: 482946 - DNA, 25 bp, Rattus norvegicus
tctggccaggccttgacaagccagc

SEQ ID NO: 482947 - DNA, 25 bp, Rattus norvegicus
taccgtcgcgagcagtgtctggcca

SEQ ID NO: 482948 - DNA, 25 bp, Rattus norvegicus
gggctcagctgacctcctcctgatt

SEQ ID NO: 482949 - DNA, 25 bp, Rattus norvegicus
cacagaggctcctcgtctgagggga

SEQ ID NO: 482950 - DNA, 25 bp, Rattus norvegicus
tgcctcagcgcctcagtgcacagag

SEQ ID NO: 482951 - DNA, 25 bp, Rattus norvegicus
tgcgtcctttcccattggctctcgg

SEQ ID NO: 482952 - DNA, 25 bp, Rattus norvegicus
tcctgattggctgagagcaacgtgg

SEQ ID NO: 482953 - DNA, 25 bp, Rattus norvegicus
gaggactgtcctcgctaccgtcgcg

SEQ ID NO: 482954 - DNA, 25 bp, Rattus norvegicus
tttctctgcgcgtgaggacagagcc

SEQ ID NO: 482955 - DNA, 25 bp, Rattus norvegicus
atgatggagagaagccgggtctcaa

SEQ ID NO: 482956 - DNA, 25 bp, Rattus norvegicus
caggttcactatccaggatcttctg

SEQ ID NO: 482957 - DNA, 25 bp, Rattus norvegicus
ttcactatccaggatcttctgaccc

SEQ ID NO: 482958 - DNA, 25 bp, Rattus norvegicus
cttccgcgaggaacgtggtgtgcat

SEQ ID NO: 482959 - DNA, 25 bp, Rattus norvegicus
gcagtggcagcgggctccgctcact

SEQ ID NO: 482960 - DNA, 25 bp, Rattus norvegicus
gagagaagccgggtctcaaactctg

SEQ ID NO: 482961 - DNA, 25 bp, Rattus norvegicus
ggtctcaaactctggctgcgcatgg

SEQ ID NO: 482962 - DNA, 25 bp, Rattus norvegicus
ctctggctgcgcatggaggacgcac

SEQ ID NO: 482963 - DNA, 25 bp, Rattus norvegicus
gggcgcccaagggacaaccaggcca

SEQ ID NO: 482964 - DNA, 25 bp, Rattus norvegicus
aagggacaaccaggccatcgagttc

SEQ ID NO: 482965 - DNA, 25 bp, Rattus norvegicus
ggccatcgagttcctgttccagctc

SEQ ID NO: 482966 - DNA, 25 bp, Rattus norvegicus
agttcctgttccagctcggtcggga

SEQ ID NO: 482967 - DNA, 25 bp, Rattus norvegicus
tgttccagctcggtcgggatgcagc

SEQ ID NO: 482968 - DNA, 25 bp, Rattus norvegicus
tgacccacgcgttcttccgcgagga

SEQ ID NO: 482969 - DNA, 25 bp, Rattus norvegicus
tgcgagtgcatgtgctaagctggcg

SEQ ID NO: 482970 - DNA, 25 bp, Rattus norvegicus
ctcccgcctacgtgtgcgagtgcat

SEQ ID NO: 482971 - DNA, 25 bp, Rattus norvegicus
cccggtacgtgcctgggctcagcgc

SEQ ID NO: 482972 - DNA, 25 bp, Rattus norvegicus
tgctgtggttggaaacctagcccgg

SEQ ID NO: 482973 - DNA, 25 bp, Rattus norvegicus
gctacctgctgtggttggaaaccta

SEQ ID NO: 482974 - DNA, 25 bp, Rattus norvegicus
actccaagctcagggcgcggtgcta

SEQ ID NO: 482975 - DNA, 25 bp, Rattus norvegicus
gcccgcagagacctagttcctggta

SEQ ID NO: 482976 - DNA, 25 bp, Rattus norvegicus
ctttcggacggagcctgggatgtcc

SEQ ID NO: 482977 - DNA, 25 bp, Rattus norvegicus
cggtgctacctgctgtggttggaaa

SEQ ID NO: 482978 - DNA, 25 bp, Rattus norvegicus
gagacctagttcctggtacgctttc

SEQ ID NO: 482979 - DNA, 25 bp, Rattus norvegicus
ctagttcctggtacgctttcggacg

SEQ ID NO: 482980 - DNA, 25 bp, Rattus norvegicus
cggagagcccagtactccaagctca

SEQ ID NO: 482981 - DNA, 25 bp, Rattus norvegicus
ttcctggtacgctttcggacggagc

SEQ ID NO: 482982 - DNA, 25 bp, Rattus norvegicus
tacgctttcggacggagcctgggat

SEQ ID NO: 482983 - DNA, 25 bp, Rattus norvegicus
tgaagttcgcgaccatcttctggtg

SEQ ID NO: 482984 - DNA, 25 bp, Rattus norvegicus
taaaagcgccaagcattcacgcacg

SEQ ID NO: 482985 - DNA, 25 bp, Rattus norvegicus
agctctggcgcagcatgaagttcgc

SEQ ID NO: 482986 - DNA, 25 bp, Rattus norvegicus
cgcttcgaggacttcgcggagctct

SEQ ID NO: 482987 - DNA, 25 bp, Rattus norvegicus
tccaagagatggacagcgtgcgctt

SEQ ID NO: 482988 - DNA, 25 bp, Rattus norvegicus
ctcagccgcttccaagagatggaca

SEQ ID NO: 482989 - DNA, 25 bp, Rattus norvegicus
gaccgactgtgagacgctgctcagc

SEQ ID NO: 482990 - DNA, 25 bp, Rattus norvegicus
gcggtgctacaggagcttgttcttg

SEQ ID NO: 482991 - DNA, 25 bp, Rattus norvegicus
ttgaggtcccggataatgcgtcacg

SEQ ID NO: 482992 - DNA, 25 bp, Rattus norvegicus
aggcgccatgaaagacccggatgaa

SEQ ID NO: 482993 - DNA, 25 bp, Rattus norvegicus
gcaagaagcacagcaggcgccatga

SEQ ID NO: 482994 - DNA, 25 bp, Rattus norvegicus
ttcacgcacgcgcaagaagcacagc

SEQ ID NO: 482995 - DNA, 25 bp, Rattus norvegicus
tgggtccctgacctccgcctgggtg

SEQ ID NO: 482996 - DNA, 25 bp, Rattus norvegicus
gtgggaattcctccgggcctgcaga

SEQ ID NO: 482997 - DNA, 25 bp, Rattus norvegicus
cctccacctggctgcgaggccatcc

SEQ ID NO: 482998 - DNA, 25 bp, Rattus norvegicus
actgccggatctgggttgacatcgt

SEQ ID NO: 482999 - DNA, 25 bp, Rattus norvegicus
ggatctgggttgacatcgtccgcca

SEQ ID NO: 483000 - DNA, 25 bp, Rattus norvegicus
atctgggttgacatcgtccgccacg

SEQ ID NO: 483001 - DNA, 25 bp, Rattus norvegicus
gggttgacatcgtccgccacggtca

SEQ ID NO: 483002 - DNA, 25 bp, Rattus norvegicus
gacatcgtccgccacggtcacttgg

SEQ ID NO: 483003 - DNA, 25 bp, Rattus norvegicus
gccacggtcacttggcccgagcagg

SEQ ID NO: 483004 - DNA, 25 bp, Rattus norvegicus
gtcacttggcccgagcaggcgtcct

SEQ ID NO: 483005 - DNA, 25 bp, Rattus norvegicus
cacttggcccgagcaggcgtcctgg

SEQ ID NO: 483006 - DNA, 25 bp, Rattus norvegicus
caccactgccggatctgggttgaca

SEQ ID NO: 483007 - DNA, 25 bp, Rattus norvegicus
gtcatgtctcggcacctccacctgg

SEQ ID NO: 483008 - DNA, 25 bp, Rattus norvegicus
ggacctcaccactgccggatctggg

SEQ ID NO: 483009 - DNA, 25 bp, Rattus norvegicus
ctgcgaggccatcccgcaccgaggc

SEQ ID NO: 483010 - DNA, 25 bp, Rattus norvegicus
cagggccccgggtcatgtctcggca

SEQ ID NO: 483011 - DNA, 25 bp, Rattus norvegicus
ttcctgggacgcgagactcttctca

SEQ ID NO: 483012 - DNA, 25 bp, Rattus norvegicus
tccaatgcgcgcctagaaaagccgc

SEQ ID NO: 483013 - DNA, 25 bp, Rattus norvegicus
cctttggtccaatgcgcgcctagaa

SEQ ID NO: 483014 - DNA, 25 bp, Rattus norvegicus
cggataacatctgctccctttggtc

SEQ ID NO: 483015 - DNA, 25 bp, Rattus norvegicus
cgctcctagcaaccggataacatct

SEQ ID NO: 483016 - DNA, 25 bp, Rattus norvegicus
tagcaacgctcctagcaaccggata

SEQ ID NO: 483017 - DNA, 25 bp, Rattus norvegicus
ccttcaggaaagttgcttcgggcgg

SEQ ID NO: 483018 - DNA, 25 bp, Rattus norvegicus
agctcctagactggctctcagtagc

SEQ ID NO: 483019 - DNA, 25 bp, Rattus norvegicus
ttcctggaagagctcctagactggc

SEQ ID NO: 483020 - DNA, 25 bp, Rattus norvegicus
ccaaatcagtatggcccgtggctgg

SEQ ID NO: 483021 - DNA, 25 bp, Rattus norvegicus
ccagctcttctggaccaaatcagta

SEQ ID NO: 483022 - DNA, 25 bp, Rattus norvegicus
ctaccgcatagccagctcttctgga

SEQ ID NO: 483023 - DNA, 25 bp, Rattus norvegicus
cctcgcgttctgagctggagcgaga

SEQ ID NO: 483024 - DNA, 25 bp, Rattus norvegicus
accgtttcctgggacgcgagactct

SEQ ID NO: 483025 - DNA, 25 bp, Rattus norvegicus
ccgacccggatgagcagctctggga

SEQ ID NO: 483026 - DNA, 25 bp, Rattus norvegicus
ctgagtgtgtctccagtccgacccg

SEQ ID NO: 483027 - DNA, 25 bp, Rattus norvegicus
agtgtgtctccagtccgacccggat

SEQ ID NO: 483028 - DNA, 25 bp, Rattus norvegicus
tgtgtctccagtccgacccggatga

SEQ ID NO: 483029 - DNA, 25 bp, Rattus norvegicus
gtctccagtccgacccggatgagca

SEQ ID NO: 483030 - DNA, 25 bp, Rattus norvegicus
agcagttcatggtagtagcgctccc

SEQ ID NO: 483031 - DNA, 25 bp, Rattus norvegicus
caagcagttcatggtagtagcgctc

SEQ ID NO: 483032 - DNA, 25 bp, Rattus norvegicus
ggaccaagcagttcatggtagtagc

SEQ ID NO: 483033 - DNA, 25 bp, Rattus norvegicus
ttcatggtagtagcgctcccccggc

SEQ ID NO: 483034 - DNA, 25 bp, Rattus norvegicus
cgacccggatgagcagctctgggaa

SEQ ID NO: 483035 - DNA, 25 bp, Rattus norvegicus
cagctctgggaaggaggaccaagca

SEQ ID NO: 483036 - DNA, 25 bp, Rattus norvegicus
ctctgggaaggaggaccaagcagtt

SEQ ID NO: 483037 - DNA, 25 bp, Rattus norvegicus
tctgggaaggaggaccaagcagttc

SEQ ID NO: 483038 - DNA, 25 bp, Rattus norvegicus
cagtccgacccggatgagcagctct

SEQ ID NO: 483039 - DNA, 25 bp, Rattus norvegicus
tccgaggtgcaagagggctcctgct

SEQ ID NO: 483040 - DNA, 25 bp, Rattus norvegicus
tctggtgcctgaagccttgacacgg

SEQ ID NO: 483041 - DNA, 25 bp, Rattus norvegicus
ggctctggtgcctgaagccttgaca

SEQ ID NO: 483042 - DNA, 25 bp, Rattus norvegicus
ctccgggctctggtgcctgaagcct

SEQ ID NO: 483043 - DNA, 25 bp, Rattus norvegicus
cggagcagccacctgacgctgctac

SEQ ID NO: 483044 - DNA, 25 bp, Rattus norvegicus
taggaagtgaactgggtggcgctca

SEQ ID NO: 483045 - DNA, 25 bp, Rattus norvegicus
ctgtgcgccgagtaggaagtgaact

SEQ ID NO: 483046 - DNA, 25 bp, Rattus norvegicus
tctagcccaggctgtgcgccgagta

SEQ ID NO: 483047 - DNA, 25 bp, Rattus norvegicus
gtgcaagagggctcctgctctagcc

SEQ ID NO: 483048 - DNA, 25 bp, Rattus norvegicus
cggactctggcggactcgggtcctg

SEQ ID NO: 483049 - DNA, 25 bp, Rattus norvegicus
cagctctggcggactctggcggact

SEQ ID NO: 483050 - DNA, 25 bp, Rattus norvegicus
cctgaagccttgacacgggagcttt

SEQ ID NO: 483051 - DNA, 25 bp, Rattus norvegicus
gaagccttgacacgggagctttcga

SEQ ID NO: 483052 - DNA, 25 bp, Rattus norvegicus
agagggctcctgctctagcccaggc

SEQ ID NO: 483053 - DNA, 25 bp, Rattus norvegicus
gtgggcgcgatgaaaacaggatcct

SEQ ID NO: 483054 - DNA, 25 bp, Rattus norvegicus
acttgcctgctgatgagctacgcca

SEQ ID NO: 483055 - DNA, 25 bp, Rattus norvegicus
gctcgcgtgtgtctgggctgtgcct

SEQ ID NO: 483056 - DNA, 25 bp, Rattus norvegicus
ggccagccacagtcaggccgcctga

SEQ ID NO: 483057 - DNA, 25 bp, Rattus norvegicus
gggcccgtgccaccgctccatgcac

SEQ ID NO: 483058 - DNA, 25 bp, Rattus norvegicus
gccaccgctccatgcactacagaag

SEQ ID NO: 483059 - DNA, 25 bp, Rattus norvegicus
tgcactacagaagccccagcagctg

SEQ ID NO: 483060 - DNA, 25 bp, Rattus norvegicus
cagctgctgcgggagccaccaacat

SEQ ID NO: 483061 - DNA, 25 bp, Rattus norvegicus
gcgggagccaccaacatgagctgca

SEQ ID NO: 483062 - DNA, 25 bp, Rattus norvegicus
aggggactgacagcagctgcggctg

SEQ ID NO: 483063 - DNA, 25 bp, Rattus norvegicus
aaacaggatcctgaagtgcgtggtg

SEQ ID NO: 483064 - DNA, 25 bp, Rattus norvegicus
ggaagacttgcctgctgatgagcta

SEQ ID NO: 483065 - DNA, 25 bp, Rattus norvegicus
ttgcctgctgatgagctacgccaac

SEQ ID NO: 483066 - DNA, 25 bp, Rattus norvegicus
ggcgcgatgaaaacaggatcctgaa

SEQ ID NO: 483067 - DNA, 25 bp, Rattus norvegicus
cgcccactggagacttcaaacggga

SEQ ID NO: 483068 - DNA, 25 bp, Rattus norvegicus
gccctgtgtaaacgcggccctggaa

SEQ ID NO: 483069 - DNA, 25 bp, Rattus norvegicus
cacggtctcctgtgccctgtgtaaa

SEQ ID NO: 483070 - DNA, 25 bp, Rattus norvegicus
catcaaatcggcaccgacccggttg

SEQ ID NO: 483071 - DNA, 25 bp, Rattus norvegicus
ggctcttcgttcacattcccggcgg

SEQ ID NO: 483072 - DNA, 25 bp, Rattus norvegicus
ttgcagcggcagcaagcacaggagt

SEQ ID NO: 483073 - DNA, 25 bp, Rattus norvegicus
gcaaccgaacctcctggctagcaga

SEQ ID NO: 483074 - DNA, 25 bp, Rattus norvegicus
agagacccactgagcacggagccca

SEQ ID NO: 483075 - DNA, 25 bp, Rattus norvegicus
agcgagacttcattggcctccgcgc

SEQ ID NO: 483076 - DNA, 25 bp, Rattus norvegicus
ctcccaggctagcatgttcggctga

SEQ ID NO: 483077 - DNA, 25 bp, Rattus norvegicus
acggcgagcgtcttcacccgcgatt

SEQ ID NO: 483078 - DNA, 25 bp, Rattus norvegicus
ttccgaaggccacagtgcggcaatc

SEQ ID NO: 483079 - DNA, 25 bp, Rattus norvegicus
tagcggcagtgtttctaggcctctc

SEQ ID NO: 483080 - DNA, 25 bp, Rattus norvegicus
ggctgagtccatggcacaggcgcaa

SEQ ID NO: 483081 - DNA, 25 bp, Rattus norvegicus
tctagatcaggttaacggaagtccc

SEQ ID NO: 483082 - DNA, 25 bp, Rattus norvegicus
accacacgtgatcgcaaagcctagc

SEQ ID NO: 483083 - DNA, 25 bp, Rattus norvegicus
tccgcttgttcccttccgattggac

SEQ ID NO: 483084 - DNA, 25 bp, Rattus norvegicus
tccgattggacaagggcagaagatc

SEQ ID NO: 483085 - DNA, 25 bp, Rattus norvegicus
tctacgcatgcgtgactgggcctac

SEQ ID NO: 483086 - DNA, 25 bp, Rattus norvegicus
tgggcctacggaccacgccatacat

SEQ ID NO: 483087 - DNA, 25 bp, Rattus norvegicus
catcaccgccctctagatcaggtta

SEQ ID NO: 483088 - DNA, 25 bp, Rattus norvegicus
caccttcctggatgtgtggccagta

SEQ ID NO: 483089 - DNA, 25 bp, Rattus norvegicus
caagaacatcgaaggttccgccttt

SEQ ID NO: 483090 - DNA, 25 bp, Rattus norvegicus
ccttttcatgcggatgtggctttgc

SEQ ID NO: 483091 - DNA, 25 bp, Rattus norvegicus
gctcttctttcgcttcctcatactg

SEQ ID NO: 483092 - DNA, 25 bp, Rattus norvegicus
cctcatactggggtggaaaattatt

SEQ ID NO: 483093 - DNA, 25 bp, Rattus norvegicus
gtggccagtaaaaaccaagaacatc

SEQ ID NO: 483094 - DNA, 25 bp, Rattus norvegicus
aggatttcgtggatctgagataacc

SEQ ID NO: 483095 - DNA, 25 bp, Rattus norvegicus
gccgctggtactctgaccgcctggt

SEQ ID NO: 483096 - DNA, 25 bp, Rattus norvegicus
acgtagattgacaggcttttcagca

SEQ ID NO: 483097 - DNA, 25 bp, Rattus norvegicus
gattgacaggcttttcagcaaaccg

SEQ ID NO: 483098 - DNA, 25 bp, Rattus norvegicus
caggcttttcagcaaaccgagggca

SEQ ID NO: 483099 - DNA, 25 bp, Rattus norvegicus
cttttcagcaaaccgagggcagcgg

SEQ ID NO: 483100 - DNA, 25 bp, Rattus norvegicus
ttcagcaaaccgagggcagcggtga

SEQ ID NO: 483101 - DNA, 25 bp, Rattus norvegicus
caaaccgagggcagcggtgacacgc

SEQ ID NO: 483102 - DNA, 25 bp, Rattus norvegicus
acacgcgcggcgtcccaatgggtgc

SEQ ID NO: 483103 - DNA, 25 bp, Rattus norvegicus
cgcggcgtcccaatgggtgcccttg

SEQ ID NO: 483104 - DNA, 25 bp, Rattus norvegicus
agcggccgctgctcaatggcggaaa

SEQ ID NO: 483105 - DNA, 25 bp, Rattus norvegicus
gccgctgctcaatggcggaaaagcc

SEQ ID NO: 483106 - DNA, 25 bp, Rattus norvegicus
cggaaaagccgctggtactctgacc

SEQ ID NO: 483107 - DNA, 25 bp, Rattus norvegicus
aaaagccgctggtactctgaccgcc

SEQ ID NO: 483108 - DNA, 25 bp, Rattus norvegicus
gggagaacgtagattgacaggcttt

SEQ ID NO: 483109 - DNA, 25 bp, Rattus norvegicus
tgtgacacaatctctcgacgcgcga

SEQ ID NO: 483110 - DNA, 25 bp, Rattus norvegicus
gaagcacccttatgctaagcagctc

SEQ ID NO: 483111 - DNA, 25 bp, Rattus norvegicus
agcggtgtggcatgttccatcttga

SEQ ID NO: 483112 - DNA, 25 bp, Rattus norvegicus
cgcgcctgcgtagaacgtctccagt

SEQ ID NO: 483113 - DNA, 25 bp, Rattus norvegicus
cccagaaggctctacgtgtgacaca

SEQ ID NO: 483114 - DNA, 25 bp, Rattus norvegicus
taagcagctcccagagctgtccagc

SEQ ID NO: 483115 - DNA, 25 bp, Rattus norvegicus
ggagaactccacgaagcacccttat

SEQ ID NO: 483116 - DNA, 25 bp, Rattus norvegicus
tgtctcgaaccacagaaacctagga

SEQ ID NO: 483117 - DNA, 25 bp, Rattus norvegicus
caggtccgtgctgtctcgaaccaca

SEQ ID NO: 483118 - DNA, 25 bp, Rattus norvegicus
gctcaacaactaagacggcaggtcc

SEQ ID NO: 483119 - DNA, 25 bp, Rattus norvegicus
ggcactgcctatcgctcaacaacta

SEQ ID NO: 483120 - DNA, 25 bp, Rattus norvegicus
tgagtgtggctcttctcgttgcgcc

SEQ ID NO: 483121 - DNA, 25 bp, Rattus norvegicus
ctctcgactccggacgtgcctgagt

SEQ ID NO: 483122 - DNA, 25 bp, Rattus norvegicus
tcgtacgggtcgtcttccgcgcctg

SEQ ID NO: 483123 - DNA, 25 bp, Rattus norvegicus
tgtagaagagctcgttgcccagttc

SEQ ID NO: 483124 - DNA, 25 bp, Rattus norvegicus
agatctccagcttgatgaccggcgg

SEQ ID NO: 483125 - DNA, 25 bp, Rattus norvegicus
ccgcggccaacggatgatgtccttg

SEQ ID NO: 483126 - DNA, 25 bp, Rattus norvegicus
tccttggtgcactggcccaggtaca

SEQ ID NO: 483127 - DNA, 25 bp, Rattus norvegicus
gtacatgaccagcacccagatgatc

SEQ ID NO: 483128 - DNA, 25 bp, Rattus norvegicus
aaggggtccagattccagatccaga

SEQ ID NO: 483129 - DNA, 25 bp, Rattus norvegicus
cggtgccgaagcagaacaggtagta

SEQ ID NO: 483130 - DNA, 25 bp, Rattus norvegicus
ctcctgcagacggatggctagcaga

SEQ ID NO: 483131 - DNA, 25 bp, Rattus norvegicus
ccactcgggaattgatccggccacg

SEQ ID NO: 483132 - DNA, 25 bp, Rattus norvegicus
cctaggcagagctgatgacccagga

SEQ ID NO: 483133 - DNA, 25 bp, Rattus norvegicus
agccgcgcgcaggttttattagcct

SEQ ID NO: 483134 - DNA, 25 bp, Rattus norvegicus
ttagcctggaatcaactggggcgtg

SEQ ID NO: 483135 - DNA, 25 bp, Rattus norvegicus
aaggcatgctgtattccgaattgta

SEQ ID NO: 483136 - DNA, 25 bp, Rattus norvegicus
agcggcaagttgctcactttggcca

SEQ ID NO: 483137 - DNA, 25 bp, Rattus norvegicus
tccggtcgctgatttgtagattcta

SEQ ID NO: 483138 - DNA, 25 bp, Rattus norvegicus
ccgggttttagaacagtgaagctgc

SEQ ID NO: 483139 - DNA, 25 bp, Rattus norvegicus
gtttgcattcctcgcgtcacgcctg

SEQ ID NO: 483140 - DNA, 25 bp, Rattus norvegicus
cgcgctcgactgattgtttgcattc

SEQ ID NO: 483141 - DNA, 25 bp, Rattus norvegicus
cggcttctttgtgtcacctccgggc

SEQ ID NO: 483142 - DNA, 25 bp, Rattus norvegicus
tgcagcctccagtccagagcggagc

SEQ ID NO: 483143 - DNA, 25 bp, Rattus norvegicus
agccacctgcaagggtctggaagga

SEQ ID NO: 483144 - DNA, 25 bp, Rattus norvegicus
gttagttcgttgctccagccacctg

SEQ ID NO: 483145 - DNA, 25 bp, Rattus norvegicus
gctggtgaacctgcattcggagtta

SEQ ID NO: 483146 - DNA, 25 bp, Rattus norvegicus
tttgtctccagctgcgggtaggcat

SEQ ID NO: 483147 - DNA, 25 bp, Rattus norvegicus
agtgttctaggagagtcggcttccc

SEQ ID NO: 483148 - DNA, 25 bp, Rattus norvegicus
gtgaaacccgcctgaaagtgttcta

SEQ ID NO: 483149 - DNA, 25 bp, Rattus norvegicus
gctgcggcgcagagattgcaaaacc

SEQ ID NO: 483150 - DNA, 25 bp, Rattus norvegicus
gattctaggcatccacccacagtga

SEQ ID NO: 483151 - DNA, 25 bp, Rattus norvegicus
taactagaggcaagaccagaagctc

SEQ ID NO: 483152 - DNA, 25 bp, Rattus norvegicus
agctgtctctctccgcgctggggag

SEQ ID NO: 483153 - DNA, 25 bp, Rattus norvegicus
gtttgggtccgtgctcctcgacctc

SEQ ID NO: 483154 - DNA, 25 bp, Rattus norvegicus
cctcgacctcgggagcagggctgtc

SEQ ID NO: 483155 - DNA, 25 bp, Rattus norvegicus
ggctgtcctgagaccgcaacgatct

SEQ ID NO: 483156 - DNA, 25 bp, Rattus norvegicus
ccgcaacgatctgggtaactagagg

SEQ ID NO: 483157 - DNA, 25 bp, Rattus norvegicus
accagaagctctgggtcagaatctg

SEQ ID NO: 483158 - DNA, 25 bp, Rattus norvegicus
ggtcagaatctgatgcactgagccc

SEQ ID NO: 483159 - DNA, 25 bp, Rattus norvegicus
cccggggtcctggtcaccagattgt

SEQ ID NO: 483160 - DNA, 25 bp, Rattus norvegicus
accagattgtgagggacacggacta

SEQ ID NO: 483161 - DNA, 25 bp, Rattus norvegicus
gacacggactacaaggtcgccagtc

SEQ ID NO: 483162 - DNA, 25 bp, Rattus norvegicus
aaggtcgccagtcctcaggcggctc

SEQ ID NO: 483163 - DNA, 25 bp, Rattus norvegicus
ggtgaccctgggcaattctgctgcc

SEQ ID NO: 483164 - DNA, 25 bp, Rattus norvegicus
cattggcgcggccagctgtctctct

SEQ ID NO: 483165 - DNA, 25 bp, Rattus norvegicus
cggctgggacctagctgacacagac

SEQ ID NO: 483166 - DNA, 25 bp, Rattus norvegicus
ctccaaggttgtgcggttcccgcgc

SEQ ID NO: 483167 - DNA, 25 bp, Rattus norvegicus
cacaacacgcggctgcgcccgctca

SEQ ID NO: 483168 - DNA, 25 bp, Rattus norvegicus
agggccgcgttgcttacccagactc

SEQ ID NO: 483169 - DNA, 25 bp, Rattus norvegicus
tgacacagacggactgaagcttctg

SEQ ID NO: 483170 - DNA, 25 bp, Rattus norvegicus
atgggctccaaggttgtgcggttcc

SEQ ID NO: 483171 - DNA, 25 bp, Rattus norvegicus
ctagcactcgctcgccgttgctaat

SEQ ID NO: 483172 - DNA, 25 bp, Rattus norvegicus
tcgccgttgctaatttcctcctggg

SEQ ID NO: 483173 - DNA, 25 bp, Rattus norvegicus
tgggccctgactgacatctccaacg

SEQ ID NO: 483174 - DNA, 25 bp, Rattus norvegicus
tgactgacatctccaacggaccaaa

SEQ ID NO: 483175 - DNA, 25 bp, Rattus norvegicus
agctacttgcatctgtcccgcgacg

SEQ ID NO: 483176 - DNA, 25 bp, Rattus norvegicus
catctgtcccgcgacgggtgcagct

SEQ ID NO: 483177 - DNA, 25 bp, Rattus norvegicus
gacctagctgacacagacggactga

SEQ ID NO: 483178 - DNA, 25 bp, Rattus norvegicus
gactgaagcttctgcgcccggtcag

SEQ ID NO: 483179 - DNA, 25 bp, Rattus norvegicus
gtgcagagcgcagtcatcactgttc

SEQ ID NO: 483180 - DNA, 25 bp, Rattus norvegicus
acccacctgggtggcgaagacttcg

SEQ ID NO: 483181 - DNA, 25 bp, Rattus norvegicus
atcttcgaggtcaagtccacggccg

SEQ ID NO: 483182 - DNA, 25 bp, Rattus norvegicus
gggcaccttcgatgtgtccatcctc

SEQ ID NO: 483183 - DNA, 25 bp, Rattus norvegicus
gcggcgagaagaacgtgctcatctt

SEQ ID NO: 483184 - DNA, 25 bp, Rattus norvegicus
gcgggcaccatcaccggtctcaatg

SEQ ID NO: 483185 - DNA, 25 bp, Rattus norvegicus
tgttcctgcctatttcaacgactcg

SEQ ID NO: 483186 - DNA, 25 bp, Rattus norvegicus
gagatttcttccatggtcctcacta

SEQ ID NO: 483187 - DNA, 25 bp, Rattus norvegicus
agaccttcttccctgaggagatttc

SEQ ID NO: 483188 - DNA, 25 bp, Rattus norvegicus
gccacggtgcagtcggatatgaagc

SEQ ID NO: 483189 - DNA, 25 bp, Rattus norvegicus
tgtttttcagtcaggatgtccgccc

SEQ ID NO: 483190 - DNA, 25 bp, Rattus norvegicus
ggcttgcctctcctgactctttcgt

SEQ ID NO: 483191 - DNA, 25 bp, Rattus norvegicus
gggaccgattggctctgagagtttc

SEQ ID NO: 483192 - DNA, 25 bp, Rattus norvegicus
gacaaccgtatggtcagccacctgg

SEQ ID NO: 483193 - DNA, 25 bp, Rattus norvegicus
aggctgtatcccaggtgacgcggcc

SEQ ID NO: 483194 - DNA, 25 bp, Rattus norvegicus
tcctccgcaggtgggtcgtcgcctt

SEQ ID NO: 483195 - DNA, 25 bp, Rattus norvegicus
taagtgccgcctggtcgcacgcttc

SEQ ID NO: 483196 - DNA, 25 bp, Rattus norvegicus
tgacgcggccaccatgtacaagggt

SEQ ID NO: 483197 - DNA, 25 bp, Rattus norvegicus
agaccagggcagagcttggcgtcct

SEQ ID NO: 483198 - DNA, 25 bp, Rattus norvegicus
ccaccatgtacaagggtgagacctt

SEQ ID NO: 483199 - DNA, 25 bp, Rattus norvegicus
gcgtcctggtcctgtgctctgcgct

SEQ ID NO: 483200 - DNA, 25 bp, Rattus norvegicus
ccgtgggagtccagtgggattctat

SEQ ID NO: 483201 - DNA, 25 bp, Rattus norvegicus
ctacccgactggacgtaagtgccgc

SEQ ID NO: 483202 - DNA, 25 bp, Rattus norvegicus
gggcaatcctctacccgactggacg

SEQ ID NO: 483203 - DNA, 25 bp, Rattus norvegicus
ggaagcagtttgtcgggcaatcctc

SEQ ID NO: 483204 - DNA, 25 bp, Rattus norvegicus
tgttctccatcccagagttgtaccc

SEQ ID NO: 483205 - DNA, 25 bp, Rattus norvegicus
gtgagaccttgttctccatcccaga

SEQ ID NO: 483206 - DNA, 25 bp, Rattus norvegicus
ccagtgggattctatagggagacca

SEQ ID NO: 483207 - DNA, 25 bp, Rattus norvegicus
gagcgcagtctccacccactggaaa

SEQ ID NO: 483208 - DNA, 25 bp, Rattus norvegicus
ctcttgtgtttactgacgcccgtga

SEQ ID NO: 483209 - DNA, 25 bp, Rattus norvegicus
ttgaaatccgggcagctctcgacgt

SEQ ID NO: 483210 - DNA, 25 bp, Rattus norvegicus
gcagcataagctttacagagtttga

SEQ ID NO: 483211 - DNA, 25 bp, Rattus norvegicus
gcttcggacgcactcagaggaggtt

SEQ ID NO: 483212 - DNA, 25 bp, Rattus norvegicus
cccaggctagccctctgtgggatga

SEQ ID NO: 483213 - DNA, 25 bp, Rattus norvegicus
ttggtgagtgtctcctctccctttg

SEQ ID NO: 483214 - DNA, 25 bp, Rattus norvegicus
ttcggccgcaacttcctgccgtgtg

SEQ ID NO: 483215 - DNA, 25 bp, Rattus norvegicus
ccagagccgccaattgctggatctc

SEQ ID NO: 483216 - DNA, 25 bp, Rattus norvegicus
ggccacgcgggttaatcattagcca

SEQ ID NO: 483217 - DNA, 25 bp, Rattus norvegicus
ttccaggtggcaagggacccacacg

SEQ ID NO: 483218 - DNA, 25 bp, Rattus norvegicus
tccacgtgcgtcttgggatcctaga

SEQ ID NO: 483219 - DNA, 25 bp, Rattus norvegicus
tcagggcggtgacactagagtaacc

SEQ ID NO: 483220 - DNA, 25 bp, Rattus norvegicus
gcggcttccgagagcgactttcaaa

SEQ ID NO: 483221 - DNA, 25 bp, Rattus norvegicus
ccctcagactatgatctcgttttga

SEQ ID NO: 483222 - DNA, 25 bp, Rattus norvegicus
actcacctgcgctggggctgaagcg

SEQ ID NO: 483223 - DNA, 25 bp, Rattus norvegicus
gcggctccagctttcaagcagggta

SEQ ID NO: 483224 - DNA, 25 bp, Rattus norvegicus
ggccggctacaaccgactggtagta

SEQ ID NO: 483225 - DNA, 25 bp, Rattus norvegicus
taggctggaagggacagattgttcc

SEQ ID NO: 483226 - DNA, 25 bp, Rattus norvegicus
ctggcggcgaaaaggagtcctccca

SEQ ID NO: 483227 - DNA, 25 bp, Rattus norvegicus
ctaattcgtgtgtccggagccgcaa

SEQ ID NO: 483228 - DNA, 25 bp, Rattus norvegicus
gactctgcagctccggcctaattcg

SEQ ID NO: 483229 - DNA, 25 bp, Rattus norvegicus
ttgcctcgggaagaggactcgactc

SEQ ID NO: 483230 - DNA, 25 bp, Rattus norvegicus
tgccaatcagactgcgcgcccgggg

SEQ ID NO: 483231 - DNA, 25 bp, Rattus norvegicus
gacatcgctgctgccgggaccagat

SEQ ID NO: 483232 - DNA, 25 bp, Rattus norvegicus
taacattatctgaggagggacattc

SEQ ID NO: 483233 - DNA, 25 bp, Rattus norvegicus
cggacccgcccagagatataaataa

SEQ ID NO: 483234 - DNA, 25 bp, Rattus norvegicus
ttacgttagaaagcgtgctcccggc

SEQ ID NO: 483235 - DNA, 25 bp, Rattus norvegicus
cgcttgcggcaatcaaaatcccagt

SEQ ID NO: 483236 - DNA, 25 bp, Rattus norvegicus
atcccgcctaacaaccgttactatg

SEQ ID NO: 483237 - DNA, 25 bp, Rattus norvegicus
gttctccataaactgcgtgacgatg

SEQ ID NO: 483238 - DNA, 25 bp, Rattus norvegicus
gcctcccgcaggttcggtgttcgac

SEQ ID NO: 483239 - DNA, 25 bp, Rattus norvegicus
agcaagtgggcacgaagagcctccc

SEQ ID NO: 483240 - DNA, 25 bp, Rattus norvegicus
cccaatcgggtgagcaagtgggcac

SEQ ID NO: 483241 - DNA, 25 bp, Rattus norvegicus
ggagaccgcggtgcatcccgcctaa

SEQ ID NO: 483242 - DNA, 25 bp, Rattus norvegicus
aaccgttactatgggcggagactgc

SEQ ID NO: 483243 - DNA, 25 bp, Rattus norvegicus
gcggagactgctagccaactaagga

SEQ ID NO: 483244 - DNA, 25 bp, Rattus norvegicus
aggagtccttagaacgcttgcggca

SEQ ID NO: 483245 - DNA, 25 bp, Rattus norvegicus
ggcaatcaaaatcccagttctcgcg

SEQ ID NO: 483246 - DNA, 25 bp, Rattus norvegicus
aggtttcgtcttccgggtgtcgctg

SEQ ID NO: 483247 - DNA, 25 bp, Rattus norvegicus
tcgctggggacgttctccataaact

SEQ ID NO: 483248 - DNA, 25 bp, Rattus norvegicus
ctgctagccaactaaggagtcctta

SEQ ID NO: 483249 - DNA, 25 bp, Rattus norvegicus
aactcgttgtcggtgaagcggcata

SEQ ID NO: 483250 - DNA, 25 bp, Rattus norvegicus
gcgccactgcctctaccttgagggg

SEQ ID NO: 483251 - DNA, 25 bp, Rattus norvegicus
ttgaggggcgcaccatcccttccgg

SEQ ID NO: 483252 - DNA, 25 bp, Rattus norvegicus
gctggggatgaattagcagccaccg

SEQ ID NO: 483253 - DNA, 25 bp, Rattus norvegicus
tctttccgccgaggatctgagaggc

SEQ ID NO: 483254 - DNA, 25 bp, Rattus norvegicus
gcgaagggatacatctgcatctttc

SEQ ID NO: 483255 - DNA, 25 bp, Rattus norvegicus
tcccgacccgggcagagttgcgaag

SEQ ID NO: 483256 - DNA, 25 bp, Rattus norvegicus
ctctgctttcaagccctggggtgtc

SEQ ID NO: 483257 - DNA, 25 bp, Rattus norvegicus
gcggtgtcccagctctgctttcaag

SEQ ID NO: 483258 - DNA, 25 bp, Rattus norvegicus
catcgtactgtttcgccatggcagg

SEQ ID NO: 483259 - DNA, 25 bp, Rattus norvegicus
gccgaaatagcacatcgtactgttt

SEQ ID NO: 483260 - DNA, 25 bp, Rattus norvegicus
cccgatcagcagtagccgaaatagc

SEQ ID NO: 483261 - DNA, 25 bp, Rattus norvegicus
tatgcgaggagtggaactcgttgtc

SEQ ID NO: 483262 - DNA, 25 bp, Rattus norvegicus
aagcggcatagcaggcaggtcttgc

SEQ ID NO: 483263 - DNA, 25 bp, Rattus norvegicus
gggcgcgaaaagctgttgacagttc

SEQ ID NO: 483264 - DNA, 25 bp, Rattus norvegicus
gtacctggcgcataaactgcagctg

SEQ ID NO: 483265 - DNA, 25 bp, Rattus norvegicus
cgtggtggacatttcgttttcttca

SEQ ID NO: 483266 - DNA, 25 bp, Rattus norvegicus
tttctcccgcgatgggtcaatgcgc

SEQ ID NO: 483267 - DNA, 25 bp, Rattus norvegicus
atgcgctgagcgaatggggcatttc

SEQ ID NO: 483268 - DNA, 25 bp, Rattus norvegicus
ggggcatttccactcttagcatcca

SEQ ID NO: 483269 - DNA, 25 bp, Rattus norvegicus
ttagcatccagagggtcaccagctc

SEQ ID NO: 483270 - DNA, 25 bp, Rattus norvegicus
ctaagccgaagagcccggaactcgc

SEQ ID NO: 483271 - DNA, 25 bp, Rattus norvegicus
agtctttgacttccgcgaggaattc

SEQ ID NO: 483272 - DNA, 25 bp, Rattus norvegicus
atgcccaggccggtcacgatgttcc

SEQ ID NO: 483273 - DNA, 25 bp, Rattus norvegicus
tgagaagcgccctgtttcctgattg

SEQ ID NO: 483274 - DNA, 25 bp, Rattus norvegicus
tctgccactgggctagttgtacctg

SEQ ID NO: 483275 - DNA, 25 bp, Rattus norvegicus
agaggtagggtctctccgccctagg

SEQ ID NO: 483276 - DNA, 25 bp, Rattus norvegicus
agctgcgcaggggtcaatttctccc

SEQ ID NO: 483277 - DNA, 25 bp, Rattus norvegicus
cccgggaatgcagtgctctcggtct

SEQ ID NO: 483278 - DNA, 25 bp, Rattus norvegicus
gtaggagtcctcgagctgtaaaccc

SEQ ID NO: 483279 - DNA, 25 bp, Rattus norvegicus
cctctgaaaacgttcctggggcaca

SEQ ID NO: 483280 - DNA, 25 bp, Rattus norvegicus
gtgcgtgtcagcctgcaagatctga

SEQ ID NO: 483281 - DNA, 25 bp, Rattus norvegicus
ctcctagactagtctgggccgacca

SEQ ID NO: 483282 - DNA, 25 bp, Rattus norvegicus
ctacgcatgcgctagatgctggtca

SEQ ID NO: 483283 - DNA, 25 bp, Rattus norvegicus
gtttcccagcgaatctgcagtcagg

SEQ ID NO: 483284 - DNA, 25 bp, Rattus norvegicus
gtctgtgaatcttgcgcctatcgta

SEQ ID NO: 483285 - DNA, 25 bp, Rattus norvegicus
gctgggtaccggcattaaagcttcg

SEQ ID NO: 483286 - DNA, 25 bp, Rattus norvegicus
ttcggtctcaaggtatgcggactcc

SEQ ID NO: 483287 - DNA, 25 bp, Rattus norvegicus
actcccgggagaatgactgaggtcg

SEQ ID NO: 483288 - DNA, 25 bp, Rattus norvegicus
aagttggccgtgactgccgatcata

SEQ ID NO: 483289 - DNA, 25 bp, Rattus norvegicus
tgccgatcatacataccgtcagctg

SEQ ID NO: 483290 - DNA, 25 bp, Rattus norvegicus
gggatgtcagcctcacgtaggagtc

SEQ ID NO: 483291 - DNA, 25 bp, Rattus norvegicus
caccacctttcggcgttactctccg

SEQ ID NO: 483292 - DNA, 25 bp, Rattus norvegicus
cgcgcaggaaaacaccacctttcgg

SEQ ID NO: 483293 - DNA, 25 bp, Rattus norvegicus
ccgcgcaggaaaacaccacctttcg

SEQ ID NO: 483294 - DNA, 25 bp, Rattus norvegicus
gccgcgcaggaaaacaccacctttc

SEQ ID NO: 483295 - DNA, 25 bp, Rattus norvegicus
cgccgcgcaggaaaacaccaccttt

SEQ ID NO: 483296 - DNA, 25 bp, Rattus norvegicus
agtcctgcacgccgcgcaggaaaac

SEQ ID NO: 483297 - DNA, 25 bp, Rattus norvegicus
acgccgcgcaggaaaacaccacctt

SEQ ID NO: 483298 - DNA, 25 bp, Rattus norvegicus
cacgccgcgcaggaaaacaccacct

SEQ ID NO: 483299 - DNA, 25 bp, Rattus norvegicus
gcacgccgcgcaggaaaacaccacc

SEQ ID NO: 483300 - DNA, 25 bp, Rattus norvegicus
tgcacgccgcgcaggaaaacaccac

SEQ ID NO: 483301 - DNA, 25 bp, Rattus norvegicus
tcctgcacgccgcgcaggaaaacac

SEQ ID NO: 483302 - DNA, 25 bp, Rattus norvegicus
gtcctgcacgccgcgcaggaaaaca

SEQ ID NO: 483303 - DNA, 25 bp, Rattus norvegicus
cgcgggccaccccaggccgcggctc

SEQ ID NO: 483304 - DNA, 25 bp, Rattus norvegicus
ctgcacgccgcgcaggaaaacacca

SEQ ID NO: 483305 - DNA, 25 bp, Rattus norvegicus
agcctgctctcggagcaccgggcta

SEQ ID NO: 483306 - DNA, 25 bp, Rattus norvegicus
gggcaagcccgcgagaccttgcctt

SEQ ID NO: 483307 - DNA, 25 bp, Rattus norvegicus
ccgcgagaccttgccttccaccttc

SEQ ID NO: 483308 - DNA, 25 bp, Rattus norvegicus
caggtaaggccgctctgcgcccagc

SEQ ID NO: 483309 - DNA, 25 bp, Rattus norvegicus
ctctgcgcccagccgagtggggaac

SEQ ID NO: 483310 - DNA, 25 bp, Rattus norvegicus
tggggaacggccgtcagtccagcct

SEQ ID NO: 483311 - DNA, 25 bp, Rattus norvegicus
gtcagtccagcctgctctcggagca

SEQ ID NO: 483312 - DNA, 25 bp, Rattus norvegicus
tgctctcggagcaccgggctaggcc

SEQ ID NO: 483313 - DNA, 25 bp, Rattus norvegicus
catcgcctccgctcgcgctcgaggc

SEQ ID NO: 483314 - DNA, 25 bp, Rattus norvegicus
tagtttacccgctcgcgtggaagtc

SEQ ID NO: 483315 - DNA, 25 bp, Rattus norvegicus
ttacccgctcgcgtggaagtccgct

SEQ ID NO: 483316 - DNA, 25 bp, Rattus norvegicus
ctcgcgtggaagtccgctgcttcct

SEQ ID NO: 483317 - DNA, 25 bp, Rattus norvegicus
ccagcatgcaggcagcgcccatggg

SEQ ID NO: 483318 - DNA, 25 bp, Rattus norvegicus
ggaacggccgtcagtccagcctgct

SEQ ID NO: 483319 - DNA, 25 bp, Rattus norvegicus
cgtagcgccttagcccgctcgagtt

SEQ ID NO: 483320 - DNA, 25 bp, Rattus norvegicus
ctcagtggaaacagtcacgtccata

SEQ ID NO: 483321 - DNA, 25 bp, Rattus norvegicus
cggttgcaagacgactcagtggaaa

SEQ ID NO: 483322 - DNA, 25 bp, Rattus norvegicus
gaaccgctgtatagtctgagacctg

SEQ ID NO: 483323 - DNA, 25 bp, Rattus norvegicus
cctgtttggtcagaaccgctgtata

SEQ ID NO: 483324 - DNA, 25 bp, Rattus norvegicus
cgagttccttcacctattattgtcc

SEQ ID NO: 483325 - DNA, 25 bp, Rattus norvegicus
gcagctctcccgatcatggcttctt

SEQ ID NO: 483326 - DNA, 25 bp, Rattus norvegicus
ttgctggacgaagctgagtcctata

SEQ ID NO: 483327 - DNA, 25 bp, Rattus norvegicus
gcccgctcgagtttcaatgcgcgtt

SEQ ID NO: 483328 - DNA, 25 bp, Rattus norvegicus
ttgactctacccactttccgtagcg

SEQ ID NO: 483329 - DNA, 25 bp, Rattus norvegicus
cgtccatagaacaggtgaggtggca

SEQ ID NO: 483330 - DNA, 25 bp, Rattus norvegicus
catggcttcttcgagttccttcacc

SEQ ID NO: 483331 - DNA, 25 bp, Rattus norvegicus
tcaatgcgcgttgttgctggacgaa

SEQ ID NO: 483332 - DNA, 25 bp, Rattus norvegicus
tgagtcctatacagcgctcgcagct

SEQ ID NO: 483333 - DNA, 25 bp, Rattus norvegicus
gatgtagtccatagaccgcgagttg

SEQ ID NO: 483334 - DNA, 25 bp, Rattus norvegicus
tatcgctcatttcctacggcccagg

SEQ ID NO: 483335 - DNA, 25 bp, Rattus norvegicus
gtcaccgacaacaacaagccgagtg

SEQ ID NO: 483336 - DNA, 25 bp, Rattus norvegicus
ttcagtcccaggaggcctctccgga

SEQ ID NO: 483337 - DNA, 25 bp, Rattus norvegicus
tcaggaaccgcacacagtcttcgtc

SEQ ID NO: 483338 - DNA, 25 bp, Rattus norvegicus
accgcgagttgtcaggagattttcc

SEQ ID NO: 483339 - DNA, 25 bp, Rattus norvegicus
cttgttgacagagcgcagagcgcct

SEQ ID NO: 483340 - DNA, 25 bp, Rattus norvegicus
gggcgacaaccacctcactgtagca

SEQ ID NO: 483341 - DNA, 25 bp, Rattus norvegicus
ctgtagcaccggatcaacggcggca

SEQ ID NO: 483342 - DNA, 25 bp, Rattus norvegicus
agtcttcgtcagacccgcttgttga

SEQ ID NO: 483343 - DNA, 25 bp, Rattus norvegicus
ctgagacttgtagtcctcgagcgtc

SEQ ID NO: 483344 - DNA, 25 bp, Rattus norvegicus
ggataatgggatctccagcccggca

SEQ ID NO: 483345 - DNA, 25 bp, Rattus norvegicus
acaccctcctccacgggagaatgtg

SEQ ID NO: 483346 - DNA, 25 bp, Rattus norvegicus
gctctccacctcgatgtcatcgtta

SEQ ID NO: 483347 - DNA, 25 bp, Rattus norvegicus
ggcgaccgagggaatgatcctcaca

SEQ ID NO: 483348 - DNA, 25 bp, Rattus norvegicus
tctcttgccatccaggcgtctcggg

SEQ ID NO: 483349 - DNA, 25 bp, Rattus norvegicus
tcgttctcgcgctctccaaggcaag

SEQ ID NO: 483350 - DNA, 25 bp, Rattus norvegicus
ttgcgctgggaaacatggcgaccga

SEQ ID NO: 483351 - DNA, 25 bp, Rattus norvegicus
gtctcactcggcagagcctctgggt

SEQ ID NO: 483352 - DNA, 25 bp, Rattus norvegicus
ccggctccgcagtctgaagcatgct

SEQ ID NO: 483353 - DNA, 25 bp, Rattus norvegicus
tcaaatccgtgtcggagtcctcaca

SEQ ID NO: 483354 - DNA, 25 bp, Rattus norvegicus
ctcgacttgccggaggtttctctcc

SEQ ID NO: 483355 - DNA, 25 bp, Rattus norvegicus
gtttctcccaccttagaatcgcttc

SEQ ID NO: 483356 - DNA, 25 bp, Rattus norvegicus
cgagctctagcagccaaagtctctg

SEQ ID NO: 483357 - DNA, 25 bp, Rattus norvegicus
gggcgcctcttccactaaagctctt

SEQ ID NO: 483358 - DNA, 25 bp, Rattus norvegicus
cctgacagaactcggggtacggcat

SEQ ID NO: 483359 - DNA, 25 bp, Rattus norvegicus
ggtacggcatgcgaactctgctccg

SEQ ID NO: 483360 - DNA, 25 bp, Rattus norvegicus
tgtattttacaacctccgagagctg

SEQ ID NO: 483361 - DNA, 25 bp, Rattus norvegicus
agccttaacggcttccgagtcagtc

SEQ ID NO: 483362 - DNA, 25 bp, Rattus norvegicus
atcgcgctgaggagcgaataagagc

SEQ ID NO: 483363 - DNA, 25 bp, Rattus norvegicus
cttggatcgcgctgaggagcgaata

SEQ ID NO: 483364 - DNA, 25 bp, Rattus norvegicus
ctggattctttatccggtgttcgga

SEQ ID NO: 483365 - DNA, 25 bp, Rattus norvegicus
caatcgggagtttctggattcttta

SEQ ID NO: 483366 - DNA, 25 bp, Rattus norvegicus
caggattgggcgatccgttccagcc

SEQ ID NO: 483367 - DNA, 25 bp, Rattus norvegicus
ccctcacgcgctcaggattgggcga

SEQ ID NO: 483368 - DNA, 25 bp, Rattus norvegicus
gcggaccaatcagcgggctctgtcc

SEQ ID NO: 483369 - DNA, 25 bp, Rattus norvegicus
actagcgcttcgcagtttgaggcgc

SEQ ID NO: 483370 - DNA, 25 bp, Rattus norvegicus
tcgggactagcgcttcgcagtttga

SEQ ID NO: 483371 - DNA, 25 bp, Rattus norvegicus
cgaagcgactcagcggtcgggacta

SEQ ID NO: 483372 - DNA, 25 bp, Rattus norvegicus
caaggcgaccacacagaggcggaga

SEQ ID NO: 483373 - DNA, 25 bp, Rattus norvegicus
tcagtctcggagaagcaaggcgacc

SEQ ID NO: 483374 - DNA, 25 bp, Rattus norvegicus
cttccgagtcagtctcggagaagca

SEQ ID NO: 483375 - DNA, 25 bp, Rattus norvegicus
tcggcagggagtcgtctagctgcac

SEQ ID NO: 483376 - DNA, 25 bp, Rattus norvegicus
gtggcgggccatcccgccggacttg

SEQ ID NO: 483377 - DNA, 25 bp, Rattus norvegicus
gcagggagtcgtctagctgcaccca

SEQ ID NO: 483378 - DNA, 25 bp, Rattus norvegicus
cctcggcagggagtcgtctagctgc

SEQ ID NO: 483379 - DNA, 25 bp, Rattus norvegicus
ggagtcgtctagctgcacccaggcc

SEQ ID NO: 483380 - DNA, 25 bp, Rattus norvegicus
cagcccaacctttgtcccttggagg

SEQ ID NO: 483381 - DNA, 25 bp, Rattus norvegicus
tttgtcccttggaggaacgctcctg

SEQ ID NO: 483382 - DNA, 25 bp, Rattus norvegicus
tgtcccttggaggaacgctcctggt

SEQ ID NO: 483383 - DNA, 25 bp, Rattus norvegicus
tcccttggaggaacgctcctggtgt

SEQ ID NO: 483384 - DNA, 25 bp, Rattus norvegicus
cccttggaggaacgctcctggtgtg

SEQ ID NO: 483385 - DNA, 25 bp, Rattus norvegicus
aacgctcctggtgtggtacgggttg

SEQ ID NO: 483386 - DNA, 25 bp, Rattus norvegicus
gttctctgggccgcggacgcacctt

SEQ ID NO: 483387 - DNA, 25 bp, Rattus norvegicus
ccgcggacgcaccttggcgcggtgg

SEQ ID NO: 483388 - DNA, 25 bp, Rattus norvegicus
cagggagtcgtctagctgcacccag

SEQ ID NO: 483389 - DNA, 25 bp, Rattus norvegicus
gctccgggaagatgtgcctgaacgt

SEQ ID NO: 483390 - DNA, 25 bp, Rattus norvegicus
tgcccgacattctgacggtgactcg

SEQ ID NO: 483391 - DNA, 25 bp, Rattus norvegicus
gggacaatcgggaccgcaacacctc

SEQ ID NO: 483392 - DNA, 25 bp, Rattus norvegicus
cccagtgggacaatcgggaccgcaa

SEQ ID NO: 483393 - DNA, 25 bp, Rattus norvegicus
acattctgacggtgactcggctcgg

SEQ ID NO: 483394 - DNA, 25 bp, Rattus norvegicus
aatccggtctttgcccgacattctg

SEQ ID NO: 483395 - DNA, 25 bp, Rattus norvegicus
gggaagatttcaatccggtctttgc

SEQ ID NO: 483396 - DNA, 25 bp, Rattus norvegicus
cattcgcgaagggaagatttcaatc

SEQ ID NO: 483397 - DNA, 25 bp, Rattus norvegicus
tctttaacttacattcgcgaaggga

SEQ ID NO: 483398 - DNA, 25 bp, Rattus norvegicus
gtggtgtcacttgttctattcttta

SEQ ID NO: 483399 - DNA, 25 bp, Rattus norvegicus
aagatgtgcctgaacgtggtgtcac

SEQ ID NO: 483400 - DNA, 25 bp, Rattus norvegicus
aatgcgctccgggaagatgtgcctg

SEQ ID NO: 483401 - DNA, 25 bp, Rattus norvegicus
ctgacggtgactcggctcgggtccc

SEQ ID NO: 483402 - DNA, 25 bp, Rattus norvegicus
tgcctgaacgtggtgtcacttgttc

SEQ ID NO: 483403 - DNA, 25 bp, Rattus norvegicus
gcccgctggatatttcctgcgcctt

SEQ ID NO: 483404 - DNA, 25 bp, Rattus norvegicus
aaccagaaacgtggctgtacgggcg

SEQ ID NO: 483405 - DNA, 25 bp, Rattus norvegicus
cctgtgaaccagaaacgtggctgta

SEQ ID NO: 483406 - DNA, 25 bp, Rattus norvegicus
tggtcctgtgaaccagaaacgtggc

SEQ ID NO: 483407 - DNA, 25 bp, Rattus norvegicus
aaccggtgtctggtcctgtgaacca

SEQ ID NO: 483408 - DNA, 25 bp, Rattus norvegicus
gccaaccggtgtctggtcctgtgaa

SEQ ID NO: 483409 - DNA, 25 bp, Rattus norvegicus
ctggatatttcctgcgccttctcgc

SEQ ID NO: 483410 - DNA, 25 bp, Rattus norvegicus
cacggcccgctggatatttcctgcg

SEQ ID NO: 483411 - DNA, 25 bp, Rattus norvegicus
gtatctggacaacgtcgccacggcc

SEQ ID NO: 483412 - DNA, 25 bp, Rattus norvegicus
gaagtatctggacaacgtcgccacg

SEQ ID NO: 483413 - DNA, 25 bp, Rattus norvegicus
cgggaagtatctggacaacgtcgcc

SEQ ID NO: 483414 - DNA, 25 bp, Rattus norvegicus
tgcgcgggaagtatctggacaacgt

SEQ ID NO: 483415 - DNA, 25 bp, Rattus norvegicus
ttcttgcgcgggaagtatctggaca

SEQ ID NO: 483416 - DNA, 25 bp, Rattus norvegicus
gccttctcgccaaccggtgtctggt

SEQ ID NO: 483417 - DNA, 25 bp, Rattus norvegicus
agttccagagactcccgccctgcgg

SEQ ID NO: 483418 - DNA, 25 bp, Rattus norvegicus
cccggtgtgccagccctacccggca

SEQ ID NO: 483419 - DNA, 25 bp, Rattus norvegicus
ttgcgccgaccttcccacgccaggt

SEQ ID NO: 483420 - DNA, 25 bp, Rattus norvegicus
cagtccggacttttgcgccgacctt

SEQ ID NO: 483421 - DNA, 25 bp, Rattus norvegicus
agtctggcccagtccggacttttgc

SEQ ID NO: 483422 - DNA, 25 bp, Rattus norvegicus
tggcgcgcatccagttccagagact

SEQ ID NO: 483423 - DNA, 25 bp, Rattus norvegicus
cctccatgtcgccagtccaggtgag

SEQ ID NO: 483424 - DNA, 25 bp, Rattus norvegicus
cacaaggaaaccctccttaagcacg

SEQ ID NO: 483425 - DNA, 25 bp, Rattus norvegicus
ggccagagcacactcaccctcttca

SEQ ID NO: 483426 - DNA, 25 bp, Rattus norvegicus
agctgctctgcgcatccagcacttg

SEQ ID NO: 483427 - DNA, 25 bp, Rattus norvegicus
ggaacacttcgccagctgctctgcg

SEQ ID NO: 483428 - DNA, 25 bp, Rattus norvegicus
tacccggcacggtccgcagtgatcg

SEQ ID NO: 483429 - DNA, 25 bp, Rattus norvegicus
gccagtgggaacacttcgccagctg

SEQ ID NO: 483430 - DNA, 25 bp, Rattus norvegicus
gtcgccagtccaggtgagctgtccc

SEQ ID NO: 483431 - DNA, 25 bp, Rattus norvegicus
gcttctttctaaggtctcactttag

SEQ ID NO: 483432 - DNA, 25 bp, Rattus norvegicus
tcggggcaccatccagaggctgaga

SEQ ID NO: 483433 - DNA, 25 bp, Rattus norvegicus
cagatccatgctttcccggctcggg

SEQ ID NO: 483434 - DNA, 25 bp, Rattus norvegicus
tccctctgggagtggaatgacacca

SEQ ID NO: 483435 - DNA, 25 bp, Rattus norvegicus
cggtcttcagctacttcccggtcgg

SEQ ID NO: 483436 - DNA, 25 bp, Rattus norvegicus
agaggaaagcccgatccgcgccatt

SEQ ID NO: 483437 - DNA, 25 bp, Rattus norvegicus
gcccagaagtgacgccttgacgaga

SEQ ID NO: 483438 - DNA, 25 bp, Rattus norvegicus
tgacaccaagaggacccgcttccgg

SEQ ID NO: 483439 - DNA, 25 bp, Rattus norvegicus
tccggggcagagcacggctaaagca

SEQ ID NO: 483440 - DNA, 25 bp, Rattus norvegicus
gctaaagcagtttggactcccgggc

SEQ ID NO: 483441 - DNA, 25 bp, Rattus norvegicus
ccgccagggattctaggcttctttc

SEQ ID NO: 483442 - DNA, 25 bp, Rattus norvegicus
agcgagacctccagagttcccatcg

SEQ ID NO: 483443 - DNA, 25 bp, Rattus norvegicus
ccggtcggctagctgaagacttccg

SEQ ID NO: 483444 - DNA, 25 bp, Rattus norvegicus
cgaggctacccgctgcctagatggt

SEQ ID NO: 483445 - DNA, 25 bp, Rattus norvegicus
ccgtctgcccaacgcaggtgcggcc

SEQ ID NO: 483446 - DNA, 25 bp, Rattus norvegicus
ccggccctgtttaactccttcagcg

SEQ ID NO: 483447 - DNA, 25 bp, Rattus norvegicus
atgctcgcttctgacaggcgctctg

SEQ ID NO: 483448 - DNA, 25 bp, Rattus norvegicus
ggtgcaaactgcacatgctcgcttc

SEQ ID NO: 483449 - DNA, 25 bp, Rattus norvegicus
gtacggatgcggtgcaaactgcaca

SEQ ID NO: 483450 - DNA, 25 bp, Rattus norvegicus
cccatagtacggatgcggtgcaaac

SEQ ID NO: 483451 - DNA, 25 bp, Rattus norvegicus
cggcggcactcacccatagtacgga

SEQ ID NO: 483452 - DNA, 25 bp, Rattus norvegicus
tattcccgcatcgagtgtccgcggc

SEQ ID NO: 483453 - DNA, 25 bp, Rattus norvegicus
ccgcgccgagtgaccggacaagcct

SEQ ID NO: 483454 - DNA, 25 bp, Rattus norvegicus
tcttaggcacctaccggtgcggggc

SEQ ID NO: 483455 - DNA, 25 bp, Rattus norvegicus
tgcgggcatcttaggcacctaccgg

SEQ ID NO: 483456 - DNA, 25 bp, Rattus norvegicus
tctctgcgggcatcttaggcaccta

SEQ ID NO: 483457 - DNA, 25 bp, Rattus norvegicus
ccgaaaggcctctctgcgggcatct

SEQ ID NO: 483458 - DNA, 25 bp, Rattus norvegicus
caactattcccgcatcgagtgtccg

SEQ ID NO: 483459 - DNA, 25 bp, Rattus norvegicus
gggaacttccagactccaacctcga

SEQ ID NO: 483460 - DNA, 25 bp, Rattus norvegicus
gagctccttgataccagcactggga

SEQ ID NO: 483461 - DNA, 25 bp, Rattus norvegicus
gcaggcaacccggagctccttgata

SEQ ID NO: 483462 - DNA, 25 bp, Rattus norvegicus
aggtgcctctttacctgggagccgc

SEQ ID NO: 483463 - DNA, 25 bp, Rattus norvegicus
gctgggcgaacgaggctgactcctc

SEQ ID NO: 483464 - DNA, 25 bp, Rattus norvegicus
cctcccgcagtaggtactggcgttt

SEQ ID NO: 483465 - DNA, 25 bp, Rattus norvegicus
cggagctccggggaacttccagact

SEQ ID NO: 483466 - DNA, 25 bp, Rattus norvegicus
gctgaggtcatttcctgtgcctggc

SEQ ID NO: 483467 - DNA, 25 bp, Rattus norvegicus
cggctgctgaggtcatttcctgtgc

SEQ ID NO: 483468 - DNA, 25 bp, Rattus norvegicus
atccggtctagtgagcatcccgcgg

SEQ ID NO: 483469 - DNA, 25 bp, Rattus norvegicus
ggaaggatccggtctagtgagcatc

SEQ ID NO: 483470 - DNA, 25 bp, Rattus norvegicus
aggtggctagacactcgcttggacc

SEQ ID NO: 483471 - DNA, 25 bp, Rattus norvegicus
tgggacgttcttacaggtggctaga

SEQ ID NO: 483472 - DNA, 25 bp, Rattus norvegicus
aacgaggctgactcctcgcggctgg

SEQ ID NO: 483473 - DNA, 25 bp, Rattus norvegicus
ctgtccggtggaagctcctgcgaca

SEQ ID NO: 483474 - DNA, 25 bp, Rattus norvegicus
gttgccaaggagacgcgaataccgg

SEQ ID NO: 483475 - DNA, 25 bp, Rattus norvegicus
cgcgaataccggaaatgcggaattc

SEQ ID NO: 483476 - DNA, 25 bp, Rattus norvegicus
aggcccggcgtcacaggtcctgaca

SEQ ID NO: 483477 - DNA, 25 bp, Rattus norvegicus
acaggtcctgacagggaagaagttg

SEQ ID NO: 483478 - DNA, 25 bp, Rattus norvegicus
ctccgggtccagtcaaccctggtga

SEQ ID NO: 483479 - DNA, 25 bp, Rattus norvegicus
aaccctggtgatggagtcgcaggtc

SEQ ID NO: 483480 - DNA, 25 bp, Rattus norvegicus
gcgggcaagggtcccatgattgaca

SEQ ID NO: 483481 - DNA, 25 bp, Rattus norvegicus
gtcccatgattgacagtgccagcca

SEQ ID NO: 483482 - DNA, 25 bp, Rattus norvegicus
aagggtcgctggtctcggcgcccaa

SEQ ID NO: 483483 - DNA, 25 bp, Rattus norvegicus
ttgacagtgccagccaagggtcgct

SEQ ID NO: 483484 - DNA, 25 bp, Rattus norvegicus
ccctttcgtcaggagccaagcgaga

SEQ ID NO: 483485 - DNA, 25 bp, Rattus norvegicus
taagggctagcgctcgccacctctg

SEQ ID NO: 483486 - DNA, 25 bp, Rattus norvegicus
ctcctgcgacaggtaagggctagcg

SEQ ID NO: 483487 - DNA, 25 bp, Rattus norvegicus
tcccggatccacaggtgagtcccaa

SEQ ID NO: 483488 - DNA, 25 bp, Rattus norvegicus
gagtcccaagacctttccaagcagc

SEQ ID NO: 483489 - DNA, 25 bp, Rattus norvegicus
ccggcctttacctcgcacagggtga

SEQ ID NO: 483490 - DNA, 25 bp, Rattus norvegicus
cctttacctcgcacagggtgaagag

SEQ ID NO: 483491 - DNA, 25 bp, Rattus norvegicus
tgaagagcccgtaggccgccagcca

SEQ ID NO: 483492 - DNA, 25 bp, Rattus norvegicus
gccagccacaccgtacaggtgacag

SEQ ID NO: 483493 - DNA, 25 bp, Rattus norvegicus
tgagcgaccacagcgacagccgagc

SEQ ID NO: 483494 - DNA, 25 bp, Rattus norvegicus
agctgaggccgaattcgcggcagta

SEQ ID NO: 483495 - DNA, 25 bp, Rattus norvegicus
cgaattcgcggcagtacggtgaata

SEQ ID NO: 483496 - DNA, 25 bp, Rattus norvegicus
tacggtgaatagtagcggcgccgca

SEQ ID NO: 483497 - DNA, 25 bp, Rattus norvegicus
cgccgcagatatcggagaagctctt

SEQ ID NO: 483498 - DNA, 25 bp, Rattus norvegicus
gagaagctcttctcgtcctccatgg

SEQ ID NO: 483499 - DNA, 25 bp, Rattus norvegicus
caggtgacagcggtgagcgaccaca

SEQ ID NO: 483500 - DNA, 25 bp, Rattus norvegicus
aacggcgtcccagatccagggagtc

SEQ ID NO: 483501 - DNA, 25 bp, Rattus norvegicus
atgcttacgtcacagggcggagcgc

SEQ ID NO: 483502 - DNA, 25 bp, Rattus norvegicus
gacactaagcctagagagtttcgtg

SEQ ID NO: 483503 - DNA, 25 bp, Rattus norvegicus
ccgagctgacgggacactaagccta

SEQ ID NO: 483504 - DNA, 25 bp, Rattus norvegicus
ggtgagagctgctacccgagctgac

SEQ ID NO: 483505 - DNA, 25 bp, Rattus norvegicus
gagatccgtccactctgtagctgta

SEQ ID NO: 483506 - DNA, 25 bp, Rattus norvegicus
ctcctccacgggcaaattccttgtg

SEQ ID NO: 483507 - DNA, 25 bp, Rattus norvegicus
tgttcctgaggagcagcgtctcccg

SEQ ID NO: 483508 - DNA, 25 bp, Rattus norvegicus
ctccctgccaatcatgttcctgagg

SEQ ID NO: 483509 - DNA, 25 bp, Rattus norvegicus
agctgcttctgctagggcgatcgcc

SEQ ID NO: 483510 - DNA, 25 bp, Rattus norvegicus
cttgcctagtgaagctgcgaagctg

SEQ ID NO: 483511 - DNA, 25 bp, Rattus norvegicus
gtgtgtccgagagatgcttacgtca

SEQ ID NO: 483512 - DNA, 25 bp, Rattus norvegicus
acccggagcgcacgtgggattttct

SEQ ID NO: 483513 - DNA, 25 bp, Rattus norvegicus
attccttgtgccctgacgagatccg

SEQ ID NO: 483514 - DNA, 25 bp, Rattus norvegicus
ctcactcgaggtcctgagttgcgcg

SEQ ID NO: 483515 - DNA, 25 bp, Rattus norvegicus
cgtgcagcttctcgaaatgctcgga

SEQ ID NO: 483516 - DNA, 25 bp, Rattus norvegicus
tctccaacctggagacaggcagtgg

SEQ ID NO: 483517 - DNA, 25 bp, Rattus norvegicus
caaggcgagctgctgtctccaacct

SEQ ID NO: 483518 - DNA, 25 bp, Rattus norvegicus
gcgaggacgacacccggctactata

SEQ ID NO: 483519 - DNA, 25 bp, Rattus norvegicus
tgcgagcgccaaagcctgacagaaa

SEQ ID NO: 483520 - DNA, 25 bp, Rattus norvegicus
cctgttgtcactgtgcgagcgccaa

SEQ ID NO: 483521 - DNA, 25 bp, Rattus norvegicus
aagtggccatagtgcaggttgctcg

SEQ ID NO: 483522 - DNA, 25 bp, Rattus norvegicus
ccaaagcgaagagcccaagggagcc

SEQ ID NO: 483523 - DNA, 25 bp, Rattus norvegicus
gccgcggaagatctcgtgcagcttc

SEQ ID NO: 483524 - DNA, 25 bp, Rattus norvegicus
caccctgcggagttctaccggtctg

SEQ ID NO: 483525 - DNA, 25 bp, Rattus norvegicus
attgcgtttgggatcccgcaccctg

SEQ ID NO: 483526 - DNA, 25 bp, Rattus norvegicus
cccagtcacaagaggctgcagatcc

SEQ ID NO: 483527 - DNA, 25 bp, Rattus norvegicus
ggctcgctaggagacgacatcctaa

SEQ ID NO: 483528 - DNA, 25 bp, Rattus norvegicus
ctcggcctcccggaatcaggcgttt

SEQ ID NO: 483529 - DNA, 25 bp, Rattus norvegicus
cataagggcaaaagccgatggtgtg

SEQ ID NO: 483530 - DNA, 25 bp, Rattus norvegicus
cgcgtcgctcctcggcgttgtgaat

SEQ ID NO: 483531 - DNA, 25 bp, Rattus norvegicus
cctcggcgttgtgaatgaagtggca

SEQ ID NO: 483532 - DNA, 25 bp, Rattus norvegicus
cagcggggcccataagggcaaaagc

SEQ ID NO: 483533 - DNA, 25 bp, Rattus norvegicus
tacttacaggcaccgttttcttcga

SEQ ID NO: 483534 - DNA, 25 bp, Rattus norvegicus
cgttttcttcgaaggggcggcacag

SEQ ID NO: 483535 - DNA, 25 bp, Rattus norvegicus
ggcggcacagctccgttttgtagcg

SEQ ID NO: 483536 - DNA, 25 bp, Rattus norvegicus
ctccgttttgtagcggctggagttg

SEQ ID NO: 483537 - DNA, 25 bp, Rattus norvegicus
ctggagttgacctggccgctcccag

SEQ ID NO: 483538 - DNA, 25 bp, Rattus norvegicus
cccttcggagaaagagcggtctcga

SEQ ID NO: 483539 - DNA, 25 bp, Rattus norvegicus
agaaagagcggtctcgaaagcggct

SEQ ID NO: 483540 - DNA, 25 bp, Rattus norvegicus
cgaaagcggctgtcgcgtgagctca

SEQ ID NO: 483541 - DNA, 25 bp, Rattus norvegicus
ctcccaggctgcttctgagtgggca

SEQ ID NO: 483542 - DNA, 25 bp, Rattus norvegicus
aatgaagtggcagcggggcccataa

SEQ ID NO: 483543 - DNA, 25 bp, Rattus norvegicus
gcagcctccggctctccggtcagga

SEQ ID NO: 483544 - DNA, 25 bp, Rattus norvegicus
tccgccctactttaccttgcataaa

SEQ ID NO: 483545 - DNA, 25 bp, Rattus norvegicus
tttaccttgcataaaacttcgctca

SEQ ID NO: 483546 - DNA, 25 bp, Rattus norvegicus
ttgcataaaacttcgctcaagtcga

SEQ ID NO: 483547 - DNA, 25 bp, Rattus norvegicus
cttcgctcaagtcgaaaatggtggc

SEQ ID NO: 483548 - DNA, 25 bp, Rattus norvegicus
ctcaagtcgaaaatggtggcggaca

SEQ ID NO: 483549 - DNA, 25 bp, Rattus norvegicus
aagtcgaaaatggtggcggacacga

SEQ ID NO: 483550 - DNA, 25 bp, Rattus norvegicus
tggtggtcatcgtgggcgttcgcac

SEQ ID NO: 483551 - DNA, 25 bp, Rattus norvegicus
ttcgcacggggcaaggactaggatc

SEQ ID NO: 483552 - DNA, 25 bp, Rattus norvegicus
ggcaaggactaggatctgttgtgtc

SEQ ID NO: 483553 - DNA, 25 bp, Rattus norvegicus
actaggatctgttgtgtcgtgaagg

SEQ ID NO: 483554 - DNA, 25 bp, Rattus norvegicus
tctgttgtgtcgtgaaggtcccggt

SEQ ID NO: 483555 - DNA, 25 bp, Rattus norvegicus
gatctgttgtgtcgtgaaggtcccg

SEQ ID NO: 483556 - DNA, 25 bp, Rattus norvegicus
aggagtcccacacgcctgctcccgg

SEQ ID NO: 483557 - DNA, 25 bp, Rattus norvegicus
tctctcaaagaagaaaggcgattcc

SEQ ID NO: 483558 - DNA, 25 bp, Rattus norvegicus
ttggacactccgaactgcctaagta

SEQ ID NO: 483559 - DNA, 25 bp, Rattus norvegicus
ctcccgagtgtttgcggagctcagc

SEQ ID NO: 483560 - DNA, 25 bp, Rattus norvegicus
tgagtcctgatgtgaagctatttcg

SEQ ID NO: 483561 - DNA, 25 bp, Rattus norvegicus
tctgttatgaaacccggtgagccga

SEQ ID NO: 483562 - DNA, 25 bp, Rattus norvegicus
cgagtggctacgagcgagttccatt

SEQ ID NO: 483563 - DNA, 25 bp, Rattus norvegicus
ccattgcgatgtaattaggtcaccc

SEQ ID NO: 483564 - DNA, 25 bp, Rattus norvegicus
acacgacttttgctgcagcccacga

SEQ ID NO: 483565 - DNA, 25 bp, Rattus norvegicus
cagcccacgagcctaacattaattc

SEQ ID NO: 483566 - DNA, 25 bp, Rattus norvegicus
cgcggagtctctgcttgattcgtct

SEQ ID NO: 483567 - DNA, 25 bp, Rattus norvegicus
ctccagtgacttgaattgatggctc

SEQ ID NO: 483568 - DNA, 25 bp, Rattus norvegicus
atttcgtgccgtttctcggtgatga

SEQ ID NO: 483569 - DNA, 25 bp, Rattus norvegicus
cccggctggtctaaactcccgagtg

SEQ ID NO: 483570 - DNA, 25 bp, Rattus norvegicus
accacaaggttagactgagtcctga

SEQ ID NO: 483571 - DNA, 25 bp, Rattus norvegicus
ttaagggcgccaagatggccggctt

SEQ ID NO: 483572 - DNA, 25 bp, Rattus norvegicus
tgcccggagcttcagggccgctgct

SEQ ID NO: 483573 - DNA, 25 bp, Rattus norvegicus
agatggccggcttgttttgctcgcc

SEQ ID NO: 483574 - DNA, 25 bp, Rattus norvegicus
ggcttgttttgctcgccgaggcatc

SEQ ID NO: 483575 - DNA, 25 bp, Rattus norvegicus
tttgctcgccgaggcatcacgcgga

SEQ ID NO: 483576 - DNA, 25 bp, Rattus norvegicus
atcacgcggaggctgccctttgcct

SEQ ID NO: 483577 - DNA, 25 bp, Rattus norvegicus
ttccgcatctcggagcgtctgcggc

SEQ ID NO: 483578 - DNA, 25 bp, Rattus norvegicus
cgcggtcaaggttccgccgccctct

SEQ ID NO: 483579 - DNA, 25 bp, Rattus norvegicus
cgccgccctctctggcacactgccc

SEQ ID NO: 483580 - DNA, 25 bp, Rattus norvegicus
cccggccggcccgagcaagcctcct

SEQ ID NO: 483581 - DNA, 25 bp, Rattus norvegicus
gcgcctcgcgaaccttccagacccg

SEQ ID NO: 483582 - DNA, 25 bp, Rattus norvegicus
cagacccggacgcagcagagcggca

SEQ ID NO: 483583 - DNA, 25 bp, Rattus norvegicus
gcagtgtggcttgcccggagcttca

SEQ ID NO: 483584 - DNA, 25 bp, Rattus norvegicus
cctagagcggccaggagcgggttaa

SEQ ID NO: 483585 - DNA, 25 bp, Rattus norvegicus
gcttctccagccgacgtcactaggg

SEQ ID NO: 483586 - DNA, 25 bp, Rattus norvegicus
agggcgcgacgcctactcttccaga

SEQ ID NO: 483587 - DNA, 25 bp, Rattus norvegicus
cacggtgaagtcgagttccgggaca

SEQ ID NO: 483588 - DNA, 25 bp, Rattus norvegicus
ctcttccagaagcagtggcacgtga

SEQ ID NO: 483589 - DNA, 25 bp, Rattus norvegicus
gcacgtgaggtaccacggtgaagtc

SEQ ID NO: 483590 - DNA, 25 bp, Rattus norvegicus
ggtcacaaggcctggagctccatta

SEQ ID NO: 483591 - DNA, 25 bp, Rattus norvegicus
agggcagcggagattcctcaggccc

SEQ ID NO: 483592 - DNA, 25 bp, Rattus norvegicus
gcgattggctgtgacgcaacttccg

SEQ ID NO: 483593 - DNA, 25 bp, Rattus norvegicus
cctccgagaacctgtagagttgagc

SEQ ID NO: 483594 - DNA, 25 bp, Rattus norvegicus
tgtcctaggtttgccaccacaggtc

SEQ ID NO: 483595 - DNA, 25 bp, Rattus norvegicus
gggtctcagcatccctgtcctaggt

SEQ ID NO: 483596 - DNA, 25 bp, Rattus norvegicus
cgggagatttgggtctcagcatccc

SEQ ID NO: 483597 - DNA, 25 bp, Rattus norvegicus
agttccgggacaataagacacatca

SEQ ID NO: 483598 - DNA, 25 bp, Rattus norvegicus
agttgagcatcacagcggctgcgca

SEQ ID NO: 483599 - DNA, 25 bp, Rattus norvegicus
atgtagtctagagcacccggcacgg

SEQ ID NO: 483600 - DNA, 25 bp, Rattus norvegicus
cgtaaacttgccagtcatgttcagc

SEQ ID NO: 483601 - DNA, 25 bp, Rattus norvegicus
ctattaggtcgtaaacttgccagtc

SEQ ID NO: 483602 - DNA, 25 bp, Rattus norvegicus
acggcattgccgcaactattaggtc

SEQ ID NO: 483603 - DNA, 25 bp, Rattus norvegicus
tggccggaaagcaatacggcattgc

SEQ ID NO: 483604 - DNA, 25 bp, Rattus norvegicus
cgcaaagctcggcagtggccggaaa

SEQ ID NO: 483605 - DNA, 25 bp, Rattus norvegicus
attctgcggagaaagcatggtcagg

SEQ ID NO: 483606 - DNA, 25 bp, Rattus norvegicus
cagtactcggcttggtcaggtggca

SEQ ID NO: 483607 - DNA, 25 bp, Rattus norvegicus
ggccattctcgcgatgcagtactcg

SEQ ID NO: 483608 - DNA, 25 bp, Rattus norvegicus
cgccgtggagaaggacatgtagtct

SEQ ID NO: 483609 - DNA, 25 bp, Rattus norvegicus
catgttcagcaacgcggcactggca

SEQ ID NO: 483610 - DNA, 25 bp, Rattus norvegicus
gaaagcatggtcagggtcgcaaagc

SEQ ID NO: 483611 - DNA, 25 bp, Rattus norvegicus
cgcgatgcagtactcggcttggtca

SEQ ID NO: 483612 - DNA, 25 bp, Rattus norvegicus
cccggtgatgtaattctgcggagaa

SEQ ID NO: 483613 - DNA, 25 bp, Rattus norvegicus
ttggccaggccgagttgcccaaact

SEQ ID NO: 483614 - DNA, 25 bp, Rattus norvegicus
agcgcctctcattgggaattcctgg

SEQ ID NO: 483615 - DNA, 25 bp, Rattus norvegicus
tcccgaggttctctattggccaggc

SEQ ID NO: 483616 - DNA, 25 bp, Rattus norvegicus
tgctaggggctagatttctttctcc

SEQ ID NO: 483617 - DNA, 25 bp, Rattus norvegicus
tggtctgctgggaatcataatggtc

SEQ ID NO: 483618 - DNA, 25 bp, Rattus norvegicus
ttcaggctgcatatagtcattggtc

SEQ ID NO: 483619 - DNA, 25 bp, Rattus norvegicus
gcgggcagaacccagatcagggatc

SEQ ID NO: 483620 - DNA, 25 bp, Rattus norvegicus
tgcgcgccgggaactggtttccaac

SEQ ID NO: 483621 - DNA, 25 bp, Rattus norvegicus
tggagcctaagtctcagtcccagcc

SEQ ID NO: 483622 - DNA, 25 bp, Rattus norvegicus
tgtaagcagccatggagcctaagtc

SEQ ID NO: 483623 - DNA, 25 bp, Rattus norvegicus
gaaaatcgatcccatgtaagcagcc

SEQ ID NO: 483624 - DNA, 25 bp, Rattus norvegicus
cacgccatatggaggcgccaggaaa

SEQ ID NO: 483625 - DNA, 25 bp, Rattus norvegicus
ggccgctaacctttctctgctgctt

SEQ ID NO: 483626 - DNA, 25 bp, Rattus norvegicus
ctctgtgcatataggtggactgggc

SEQ ID NO: 483627 - DNA, 25 bp, Rattus norvegicus
aggggacgcctctcaagctacccgt

SEQ ID NO: 483628 - DNA, 25 bp, Rattus norvegicus
aagaggctaccactgcgtgttggga

SEQ ID NO: 483629 - DNA, 25 bp, Rattus norvegicus
ccgatctggtctaggcccttcgcag

SEQ ID NO: 483630 - DNA, 25 bp, Rattus norvegicus
ccttcgcagcgcagcatggtttcag

SEQ ID NO: 483631 - DNA, 25 bp, Rattus norvegicus
ctctccgggtgcaataggctatcga

SEQ ID NO: 483632 - DNA, 25 bp, Rattus norvegicus
taggctatcgattcagctgcctgtc

SEQ ID NO: 483633 - DNA, 25 bp, Rattus norvegicus
tggaggcaagtaggcccagctgaac

SEQ ID NO: 483634 - DNA, 25 bp, Rattus norvegicus
ggaggaggcgaacagccctacaaca

SEQ ID NO: 483635 - DNA, 25 bp, Rattus norvegicus
ccctacaacaggagccgcgggtgaa

SEQ ID NO: 483636 - DNA, 25 bp, Rattus norvegicus
cgagcagcgcatccaagttcaagct

SEQ ID NO: 483637 - DNA, 25 bp, Rattus norvegicus
aagttcaagctggtgtccctcggtc

SEQ ID NO: 483638 - DNA, 25 bp, Rattus norvegicus
cctcgctactctcggaaccataata

SEQ ID NO: 483639 - DNA, 25 bp, Rattus norvegicus
taacaagacgcggaagaggctacca

SEQ ID NO: 483640 - DNA, 25 bp, Rattus norvegicus
ttttctccatgacaccgaggactgg

SEQ ID NO: 483641 - DNA, 25 bp, Rattus norvegicus
cacggcggagccattagtgattgtc

SEQ ID NO: 483642 - DNA, 25 bp, Rattus norvegicus
cggcggagccattagtgattgtcga

SEQ ID NO: 483643 - DNA, 25 bp, Rattus norvegicus
cggagccattagtgattgtcgagtc

SEQ ID NO: 483644 - DNA, 25 bp, Rattus norvegicus
gagccattagtgattgtcgagtcca

SEQ ID NO: 483645 - DNA, 25 bp, Rattus norvegicus
gccattagtgattgtcgagtccaaa

SEQ ID NO: 483646 - DNA, 25 bp, Rattus norvegicus
cattagtgattgtcgagtccaaagc

SEQ ID NO: 483647 - DNA, 25 bp, Rattus norvegicus
tagtgattgtcgagtccaaagcaga

SEQ ID NO: 483648 - DNA, 25 bp, Rattus norvegicus
tgattgtcgagtccaaagcagacgg

SEQ ID NO: 483649 - DNA, 25 bp, Rattus norvegicus
ttgtcgagtccaaagcagacgggcg

SEQ ID NO: 483650 - DNA, 25 bp, Rattus norvegicus
tggttttcggggtacaaaggcatgc

SEQ ID NO: 483651 - DNA, 25 bp, Rattus norvegicus
ttttcggggtacaaaggcatgctcg

SEQ ID NO: 483652 - DNA, 25 bp, Rattus norvegicus
ctgtcacggcggagccattagtgat

SEQ ID NO: 483653 - DNA, 25 bp, Rattus norvegicus
gccgagggtggacccgagccctggc

SEQ ID NO: 483654 - DNA, 25 bp, Rattus norvegicus
gtacaaaggcatgctcggggcaccc

SEQ ID NO: 483655 - DNA, 25 bp, Rattus norvegicus
cccagttctctttccaagcgaggga

SEQ ID NO: 483656 - DNA, 25 bp, Rattus norvegicus
cctggagggacagcggctcgcccaa

SEQ ID NO: 483657 - DNA, 25 bp, Rattus norvegicus
cgagccggaggcttctttaaccagc

SEQ ID NO: 483658 - DNA, 25 bp, Rattus norvegicus
tttaaccagccatggcagacggagc

SEQ ID NO: 483659 - DNA, 25 bp, Rattus norvegicus
gttcgcggcttcctcacggtcgcgt

SEQ ID NO: 483660 - DNA, 25 bp, Rattus norvegicus
tgcccgcgccgaaccacggttgatt

SEQ ID NO: 483661 - DNA, 25 bp, Rattus norvegicus
ccacggttgattcaggatggcggcc

SEQ ID NO: 483662 - DNA, 25 bp, Rattus norvegicus
gcgccgcactctgtgaagttggaca

SEQ ID NO: 483663 - DNA, 25 bp, Rattus norvegicus
tctgtgaagttggacacgcgtaaca

SEQ ID NO: 483664 - DNA, 25 bp, Rattus norvegicus
ttggacacgcgtaacaatcagagtg

SEQ ID NO: 483665 - DNA, 25 bp, Rattus norvegicus
taacaatcagagtggcagccgggct

SEQ ID NO: 483666 - DNA, 25 bp, Rattus norvegicus
ggctgtgggctcaccctccttccct

SEQ ID NO: 483667 - DNA, 25 bp, Rattus norvegicus
tccttccctggagggacagcggctc

SEQ ID NO: 483668 - DNA, 25 bp, Rattus norvegicus
ctctttccaagcgagggatcccgcg

SEQ ID NO: 483669 - DNA, 25 bp, Rattus norvegicus
cgtgatgctgaaggtaccactttgc

SEQ ID NO: 483670 - DNA, 25 bp, Rattus norvegicus
acaccgcttgctgcccagcgatttg

SEQ ID NO: 483671 - DNA, 25 bp, Rattus norvegicus
tccgtacaaaatggcgcggcccaca

SEQ ID NO: 483672 - DNA, 25 bp, Rattus norvegicus
cggaagtggctacggcttttatgca

SEQ ID NO: 483673 - DNA, 25 bp, Rattus norvegicus
tacggcttttatgcatccgggtggg

SEQ ID NO: 483674 - DNA, 25 bp, Rattus norvegicus
ccgcaggtaagtgaagcttgggtta

SEQ ID NO: 483675 - DNA, 25 bp, Rattus norvegicus
tctccgggattgtttgccgggcaga

SEQ ID NO: 483676 - DNA, 25 bp, Rattus norvegicus
ctgacctagtcagttaaaaagcagc

SEQ ID NO: 483677 - DNA, 25 bp, Rattus norvegicus
accactttgcgcgtgggcgactgtt

SEQ ID NO: 483678 - DNA, 25 bp, Rattus norvegicus
gtgcccaggcgttgttggcactgcc

SEQ ID NO: 483679 - DNA, 25 bp, Rattus norvegicus
ccggtcttctcgtcaggagcttcca

SEQ ID NO: 483680 - DNA, 25 bp, Rattus norvegicus
gcccttcaaggcttcctgacctagt

SEQ ID NO: 483681 - DNA, 25 bp, Rattus norvegicus
gtcctagcggcttccgtacaaaatg

SEQ ID NO: 483682 - DNA, 25 bp, Rattus norvegicus
agcttgggttagcaaagtcttctcc

SEQ ID NO: 483683 - DNA, 25 bp, Rattus norvegicus
gcaggacaaccgagcccatgcagca

SEQ ID NO: 483684 - DNA, 25 bp, Rattus norvegicus
cattaggaccgtgtggatcttctgc

SEQ ID NO: 483685 - DNA, 25 bp, Rattus norvegicus
gctcattgtgagtacgctctgcgca

SEQ ID NO: 483686 - DNA, 25 bp, Rattus norvegicus
ccgagcgccgttcaggctttgtata

SEQ ID NO: 483687 - DNA, 25 bp, Rattus norvegicus
gttggagaattcctgctcgttgtta

SEQ ID NO: 483688 - DNA, 25 bp, Rattus norvegicus
ttatggcaacctgtgctggcccgga

SEQ ID NO: 483689 - DNA, 25 bp, Rattus norvegicus
aaagtgctgcaagtttggtgggccc

SEQ ID NO: 483690 - DNA, 25 bp, Rattus norvegicus
ctgaccgtagcctggatcctgggca

SEQ ID NO: 483691 - DNA, 25 bp, Rattus norvegicus
aatgccatcgccatcctgaccgtag

SEQ ID NO: 483692 - DNA, 25 bp, Rattus norvegicus
gaggaccgcaccattccgctcattg

SEQ ID NO: 483693 - DNA, 25 bp, Rattus norvegicus
cagccgggcgtaagcgataacaaac

SEQ ID NO: 483694 - DNA, 25 bp, Rattus norvegicus
gtctgtctcaccgagacccgggatg

SEQ ID NO: 483695 - DNA, 25 bp, Rattus norvegicus
ctgggcactttctactacttatggc

SEQ ID NO: 483696 - DNA, 25 bp, Rattus norvegicus
gtccgcccaccatgaggaagatccg

SEQ ID NO: 483697 - DNA, 25 bp, Rattus norvegicus
caggttcggggcctacagtcaaggc

SEQ ID NO: 483698 - DNA, 25 bp, Rattus norvegicus
gctgcacactgcaaagcaaatccga

SEQ ID NO: 483699 - DNA, 25 bp, Rattus norvegicus
ccaggccgacatacgggaaacagta

SEQ ID NO: 483700 - DNA, 25 bp, Rattus norvegicus
taaaggtgacgggtgtgtcagtttc

SEQ ID NO: 483701 - DNA, 25 bp, Rattus norvegicus
ttcaggaaacgtctgacacacgttc

SEQ ID NO: 483702 - DNA, 25 bp, Rattus norvegicus
cggccattgttcctagagtccgcta

SEQ ID NO: 483703 - DNA, 25 bp, Rattus norvegicus
gagtccgctagtgcatctgaagaga

SEQ ID NO: 483704 - DNA, 25 bp, Rattus norvegicus
cctcttacaggcagcgatcggcaga

SEQ ID NO: 483705 - DNA, 25 bp, Rattus norvegicus
cgcagccgcaagtaagaccaggttc

SEQ ID NO: 483706 - DNA, 25 bp, Rattus norvegicus
gagaaactcaccatcgcgccaaacg

SEQ ID NO: 483707 - DNA, 25 bp, Rattus norvegicus
aacgctttgctgcagccgccgataa

SEQ ID NO: 483708 - DNA, 25 bp, Rattus norvegicus
gagccgtcgccggaaatcgtcggaa

SEQ ID NO: 483709 - DNA, 25 bp, Rattus norvegicus
gaagcgcgacgcaaaagagcctttc

SEQ ID NO: 483710 - DNA, 25 bp, Rattus norvegicus
tcggcagatagcgtattctcagccc

SEQ ID NO: 483711 - DNA, 25 bp, Rattus norvegicus
atctaagtccaactccgtgtcgcca

SEQ ID NO: 483712 - DNA, 25 bp, Rattus norvegicus
tgccggggcagagtcttctagacac

SEQ ID NO: 483713 - DNA, 25 bp, Rattus norvegicus
ggctagccgagccatataaagcttg

SEQ ID NO: 483714 - DNA, 25 bp, Rattus norvegicus
cagctctatggggttctgtggaagc

SEQ ID NO: 483715 - DNA, 25 bp, Rattus norvegicus
tcccacgaagggagtgggtcctgcc

SEQ ID NO: 483716 - DNA, 25 bp, Rattus norvegicus
caccagaattgaggctgcccgcaca

SEQ ID NO: 483717 - DNA, 25 bp, Rattus norvegicus
actgagctagttcctgcagccggcg

SEQ ID NO: 483718 - DNA, 25 bp, Rattus norvegicus
gaccaggaccctgcagactcactga

SEQ ID NO: 483719 - DNA, 25 bp, Rattus norvegicus
tggggaagtgcagtggccaaatccc

SEQ ID NO: 483720 - DNA, 25 bp, Rattus norvegicus
ctttgatataggcaggacggaccac

SEQ ID NO: 483721 - DNA, 25 bp, Rattus norvegicus
cgcacctggccagcgctttgatata

SEQ ID NO: 483722 - DNA, 25 bp, Rattus norvegicus
cggagtgactccagcctagcacgga

SEQ ID NO: 483723 - DNA, 25 bp, Rattus norvegicus
cttgagttggaaccgcaagcgctgt

SEQ ID NO: 483724 - DNA, 25 bp, Rattus norvegicus
cgctggacatcagcaccaaagtgca

SEQ ID NO: 483725 - DNA, 25 bp, Rattus norvegicus
actgggagaagtcctgcgagcaact

SEQ ID NO: 483726 - DNA, 25 bp, Rattus norvegicus
gcgaacgatgcgctccacatgctga

SEQ ID NO: 483727 - DNA, 25 bp, Rattus norvegicus
agtggctcttcctacctgtccgaga

SEQ ID NO: 483728 - DNA, 25 bp, Rattus norvegicus
gagtccagcgagtggctcttcctac

SEQ ID NO: 483729 - DNA, 25 bp, Rattus norvegicus
ggccagcgaagctcccgaaggctct

SEQ ID NO: 483730 - DNA, 25 bp, Rattus norvegicus
ctcaggtctccgaggctgaagctgc

SEQ ID NO: 483731 - DNA, 25 bp, Rattus norvegicus
ttcagcgcgcacttggcgaacgatg

SEQ ID NO: 483732 - DNA, 25 bp, Rattus norvegicus
cgatcttacggtcgcgctcgggtac

SEQ ID NO: 483733 - DNA, 25 bp, Rattus norvegicus
gctcttcctggtgccgggccagcat

SEQ ID NO: 483734 - DNA, 25 bp, Rattus norvegicus
ctgttgctcccactggccgtgggca

SEQ ID NO: 483735 - DNA, 25 bp, Rattus norvegicus
tgcagcttacgcagccggtcgtcac

SEQ ID NO: 483736 - DNA, 25 bp, Rattus norvegicus
ccctctgctttaggttctgctcctg

SEQ ID NO: 483737 - DNA, 25 bp, Rattus norvegicus
agctggccctcttgcttctgtctgg

SEQ ID NO: 483738 - DNA, 25 bp, Rattus norvegicus
gcagctgttcctggctgaagctcga

SEQ ID NO: 483739 - DNA, 25 bp, Rattus norvegicus
ttctctgcagaaatgggcaagttta

SEQ ID NO: 483740 - DNA, 25 bp, Rattus norvegicus
acttctgagcggctccttgtctttg

SEQ ID NO: 483741 - DNA, 25 bp, Rattus norvegicus
gggccttccgctttacagacttctg

SEQ ID NO: 483742 - DNA, 25 bp, Rattus norvegicus
ctacgaccggggctcgcacgtagaa

SEQ ID NO: 483743 - DNA, 25 bp, Rattus norvegicus
agtgatataaagtcgcgggcctacg

SEQ ID NO: 483744 - DNA, 25 bp, Rattus norvegicus
gggcgcgtggcctaaagtgatataa

SEQ ID NO: 483745 - DNA, 25 bp, Rattus norvegicus
ttgctgggctcgttcagactctgag

SEQ ID NO: 483746 - DNA, 25 bp, Rattus norvegicus
gcaactttgaccaccaaccgcaggg

SEQ ID NO: 483747 - DNA, 25 bp, Rattus norvegicus
cgcctctctgcaaggtgaaaggtta

SEQ ID NO: 483748 - DNA, 25 bp, Rattus norvegicus
cagtcggtgagtagaggcctttaga

SEQ ID NO: 483749 - DNA, 25 bp, Rattus norvegicus
tttagagggtcttgcaatccgccgc

SEQ ID NO: 483750 - DNA, 25 bp, Rattus norvegicus
ctggacgctactccggacgcaaagc

SEQ ID NO: 483751 - DNA, 25 bp, Rattus norvegicus
gacgagttgcgtccctccagtagaa

SEQ ID NO: 483752 - DNA, 25 bp, Rattus norvegicus
ctctgagcctttggcggcttcacga

SEQ ID NO: 483753 - DNA, 25 bp, Rattus norvegicus
agcgtctctccatgggagactacga

SEQ ID NO: 483754 - DNA, 25 bp, Rattus norvegicus
tagagggccgtaaaccctgccgctc

SEQ ID NO: 483755 - DNA, 25 bp, Rattus norvegicus
taaaccctgccgctccatactggaa

SEQ ID NO: 483756 - DNA, 25 bp, Rattus norvegicus
tgccgctccatactggaagctgcca

SEQ ID NO: 483757 - DNA, 25 bp, Rattus norvegicus
tccatactggaagctgccaggtccc

SEQ ID NO: 483758 - DNA, 25 bp, Rattus norvegicus
ccacgccgagggcttttgttcacca

SEQ ID NO: 483759 - DNA, 25 bp, Rattus norvegicus
cgccgagggcttttgttcaccactc

SEQ ID NO: 483760 - DNA, 25 bp, Rattus norvegicus
gcttttgttcaccactcgccgctgt

SEQ ID NO: 483761 - DNA, 25 bp, Rattus norvegicus
ctcttcagtcactgcgccggcgggg

SEQ ID NO: 483762 - DNA, 25 bp, Rattus norvegicus
gcagccagcgtctctccatgggaga

SEQ ID NO: 483763 - DNA, 25 bp, Rattus norvegicus
ttactgcgggctgcagcagccagcg

SEQ ID NO: 483764 - DNA, 25 bp, Rattus norvegicus
cagggtgcacacatcccagacgcta

SEQ ID NO: 483765 - DNA, 25 bp, Rattus norvegicus
tccatgggagactacgaacagggtg

SEQ ID NO: 483766 - DNA, 25 bp, Rattus norvegicus
agactacgaacagggtgcacacatc

SEQ ID NO: 483767 - DNA, 25 bp, Rattus norvegicus
cacgcacttcgtcagggacgcgggc

SEQ ID NO: 483768 - DNA, 25 bp, Rattus norvegicus
ttattatgtggaccgaaactcgccg

SEQ ID NO: 483769 - DNA, 25 bp, Rattus norvegicus
tggtcgcctcttcagtcgcaaaaac

SEQ ID NO: 483770 - DNA, 25 bp, Rattus norvegicus
ccgctcgcctgtgcgcgtgagcgtt

SEQ ID NO: 483771 - DNA, 25 bp, Rattus norvegicus
tcctgaggaaatcttgcagccgctc

SEQ ID NO: 483772 - DNA, 25 bp, Rattus norvegicus
cggttccgcacagcgggacaggctt

SEQ ID NO: 483773 - DNA, 25 bp, Rattus norvegicus
cggtgtcagcgctgctagccgcgtt

SEQ ID NO: 483774 - DNA, 25 bp, Rattus norvegicus
agctgctagcgttcccttcccggag

SEQ ID NO: 483775 - DNA, 25 bp, Rattus norvegicus
gctcccgggtgagttgtcaccgccg

SEQ ID NO: 483776 - DNA, 25 bp, Rattus norvegicus
gcgcccggcagcgtgagacagacca

SEQ ID NO: 483777 - DNA, 25 bp, Rattus norvegicus
ccgcgctgtacagctgggccagtga

SEQ ID NO: 483778 - DNA, 25 bp, Rattus norvegicus
cgacgcctgcgcttgttgcgtgcgt

SEQ ID NO: 483779 - DNA, 25 bp, Rattus norvegicus
cttgcaaggcggaggccctttcgcc

SEQ ID NO: 483780 - DNA, 25 bp, Rattus norvegicus
gcgttccatcctctggagtcggtca

SEQ ID NO: 483781 - DNA, 25 bp, Rattus norvegicus
cggctccgcggaaacttctgttcta

SEQ ID NO: 483782 - DNA, 25 bp, Rattus norvegicus
cgcctttccttaactgcggcagatg

SEQ ID NO: 483783 - DNA, 25 bp, Rattus norvegicus
ggctgccattggacaaggccttgca

SEQ ID NO: 483784 - DNA, 25 bp, Rattus norvegicus
gcccgaggctgcagttccttattgg

SEQ ID NO: 483785 - DNA, 25 bp, Rattus norvegicus
ccttatgcttgtacgctggtatccg

SEQ ID NO: 483786 - DNA, 25 bp, Rattus norvegicus
ggtggttcttatccggtccttatgc

SEQ ID NO: 483787 - DNA, 25 bp, Rattus norvegicus
cgtttatagagggaagcagcgcgcc

SEQ ID NO: 483788 - DNA, 25 bp, Rattus norvegicus
acgtctcccttttggtgttgcttga

SEQ ID NO: 483789 - DNA, 25 bp, Rattus norvegicus
ggcgtctaacagagcgcagttgatt

SEQ ID NO: 483790 - DNA, 25 bp, Rattus norvegicus
ggcttctcggatcgaggcttcttca

SEQ ID NO: 483791 - DNA, 25 bp, Rattus norvegicus
cgtcaaagaccctgtccggtaggtg

SEQ ID NO: 483792 - DNA, 25 bp, Rattus norvegicus
aggcagacagctccgacgcagacta

SEQ ID NO: 483793 - DNA, 25 bp, Rattus norvegicus
tccgagctgctaagtgcgtcagttg

SEQ ID NO: 483794 - DNA, 25 bp, Rattus norvegicus
tccattttgtgaacgtccgagctgc

SEQ ID NO: 483795 - DNA, 25 bp, Rattus norvegicus
agatctaaatctccagcatctgtgg

SEQ ID NO: 483796 - DNA, 25 bp, Rattus norvegicus
gagttcctctaggtcccgtagccga

SEQ ID NO: 483797 - DNA, 25 bp, Rattus norvegicus
agccgatcccgttcacgcaggagca

SEQ ID NO: 483798 - DNA, 25 bp, Rattus norvegicus
gcaggagcaagtcttacagccgatc

SEQ ID NO: 483799 - DNA, 25 bp, Rattus norvegicus
tacagccgatcaaggagcaggagcc

SEQ ID NO: 483800 - DNA, 25 bp, Rattus norvegicus
agccggagcaagtcccgttctggta

SEQ ID NO: 483801 - DNA, 25 bp, Rattus norvegicus
agcatctgtggatcgccagaggtcc

SEQ ID NO: 483802 - DNA, 25 bp, Rattus norvegicus
gcaagtcccgttctggtagtaggtc

SEQ ID NO: 483803 - DNA, 25 bp, Rattus norvegicus
ttctggtagtaggtctcccgtgcct

SEQ ID NO: 483804 - DNA, 25 bp, Rattus norvegicus
agtaggtctcccgtgcctgagaaga

SEQ ID NO: 483805 - DNA, 25 bp, Rattus norvegicus
cccgtgcctgagaagagccagaaac

SEQ ID NO: 483806 - DNA, 25 bp, Rattus norvegicus
agccagaaacgtggttcttcgagta

SEQ ID NO: 483807 - DNA, 25 bp, Rattus norvegicus
gatctcggaccaggagttcctctag

SEQ ID NO: 483808 - DNA, 25 bp, Rattus norvegicus
gtggttcttcgagtagatctaaatc

SEQ ID NO: 483809 - DNA, 25 bp, Rattus norvegicus
caggacgccggcgtccctctgtgaa

SEQ ID NO: 483810 - DNA, 25 bp, Rattus norvegicus
cacccggcgtgccaagggttaagtg

SEQ ID NO: 483811 - DNA, 25 bp, Rattus norvegicus
ccaagggttaagtgctccgatcgcc

SEQ ID NO: 483812 - DNA, 25 bp, Rattus norvegicus
taagtgctccgatcgccgctctcgg

SEQ ID NO: 483813 - DNA, 25 bp, Rattus norvegicus
gtcctgattttcaggcccaccgagc

SEQ ID NO: 483814 - DNA, 25 bp, Rattus norvegicus
cgagccgcccgagaaagttttcaat

SEQ ID NO: 483815 - DNA, 25 bp, Rattus norvegicus
aagttttcaattcgacgaggctggc

SEQ ID NO: 483816 - DNA, 25 bp, Rattus norvegicus
aattcgacgaggctggcgcgtttca

SEQ ID NO: 483817 - DNA, 25 bp, Rattus norvegicus
cgtttcaggggctgagctccttaga

SEQ ID NO: 483818 - DNA, 25 bp, Rattus norvegicus
ctgagctccttagaaagcttcgggg

SEQ ID NO: 483819 - DNA, 25 bp, Rattus norvegicus
gggcgacttgccctgtcctggacac

SEQ ID NO: 483820 - DNA, 25 bp, Rattus norvegicus
cctgtcctggacacgctaattacaa

SEQ ID NO: 483821 - DNA, 25 bp, Rattus norvegicus
cacgctaattacaaggattcggttt

SEQ ID NO: 483822 - DNA, 25 bp, Rattus norvegicus
tccctctgtgaagacgcccgcaggg

SEQ ID NO: 483823 - DNA, 25 bp, Rattus norvegicus
ctctcgtctctctcccattggcttc

SEQ ID NO: 483824 - DNA, 25 bp, Rattus norvegicus
gtgctttgaagctagcctgagaccc

SEQ ID NO: 483825 - DNA, 25 bp, Rattus norvegicus
accaccaccaagtgctttgaagcta

SEQ ID NO: 483826 - DNA, 25 bp, Rattus norvegicus
ctgcaggctcttccgccactcccag

SEQ ID NO: 483827 - DNA, 25 bp, Rattus norvegicus
ggcctccgccgttcatgaccgtgac

SEQ ID NO: 483828 - DNA, 25 bp, Rattus norvegicus
acgggaattcccatggcccaggctc

SEQ ID NO: 483829 - DNA, 25 bp, Rattus norvegicus
ttataacgggaattcccatggccca

SEQ ID NO: 483830 - DNA, 25 bp, Rattus norvegicus
acaggcttctcgacccgtcagtcag

SEQ ID NO: 483831 - DNA, 25 bp, Rattus norvegicus
gctgcccgctagtggctgctcggct

SEQ ID NO: 483832 - DNA, 25 bp, Rattus norvegicus
ggctgctacaggcttctcgacccgt

SEQ ID NO: 483833 - DNA, 25 bp, Rattus norvegicus
acctgccagagggtcggctgctaca

SEQ ID NO: 483834 - DNA, 25 bp, Rattus norvegicus
attggcttccacctgccagagggtc

SEQ ID NO: 483835 - DNA, 25 bp, Rattus norvegicus
ctgctcctgttggtgcagttgtccc

SEQ ID NO: 483836 - DNA, 25 bp, Rattus norvegicus
cccagggtaagtgcgtctcccggct

SEQ ID NO: 483837 - DNA, 25 bp, Rattus norvegicus
cccaaccgttgagcctggaacctag

SEQ ID NO: 483838 - DNA, 25 bp, Rattus norvegicus
aggcttccctcttgtcctcgggaga

SEQ ID NO: 483839 - DNA, 25 bp, Rattus norvegicus
tggtagccctgaagtcccgacagca

SEQ ID NO: 483840 - DNA, 25 bp, Rattus norvegicus
accaggcagcgcatctggagctcga

SEQ ID NO: 483841 - DNA, 25 bp, Rattus norvegicus
tggaacctagagcatcggagcagac

SEQ ID NO: 483842 - DNA, 25 bp, Rattus norvegicus
tgacaagccgcgcatatttagcctc

SEQ ID NO: 483843 - DNA, 25 bp, Rattus norvegicus
tagaatgcggatgcaagccctaccc

SEQ ID NO: 483844 - DNA, 25 bp, Rattus norvegicus
cacggacctagcgttcagagagccc

SEQ ID NO: 483845 - DNA, 25 bp, Rattus norvegicus
gcctgggacaccaagcacggaccta

SEQ ID NO: 483846 - DNA, 25 bp, Rattus norvegicus
aggggagttttccacagcgcttctc

SEQ ID NO: 483847 - DNA, 25 bp, Rattus norvegicus
ggcgagcctagagctttgcccatta

SEQ ID NO: 483848 - DNA, 25 bp, Rattus norvegicus
tgcccattaagcctccgcaaggagc

SEQ ID NO: 483849 - DNA, 25 bp, Rattus norvegicus
caccctatcagctgggagacagcta

SEQ ID NO: 483850 - DNA, 25 bp, Rattus norvegicus
ggcgactcgtcctgacctggattcc

SEQ ID NO: 483851 - DNA, 25 bp, Rattus norvegicus
ttcctcggagactaaataatccacc

SEQ ID NO: 483852 - DNA, 25 bp, Rattus norvegicus
ttcctcggctgccaggccggaaaag

SEQ ID NO: 483853 - DNA, 25 bp, Rattus norvegicus
agcatagcttttacagtttcctcgg

SEQ ID NO: 483854 - DNA, 25 bp, Rattus norvegicus
aaggtgaatcaagctccgtgccgcc

SEQ ID NO: 483855 - DNA, 25 bp, Rattus norvegicus
cccggcgcaggtgaaggtgaatcaa

SEQ ID NO: 483856 - DNA, 25 bp, Rattus norvegicus
tctgactgctctccgggcggaaacc

SEQ ID NO: 483857 - DNA, 25 bp, Rattus norvegicus
taatccacccgtccgttcatatctg

SEQ ID NO: 483858 - DNA, 25 bp, Rattus norvegicus
tggtcaggttgatctcttcctcgga

SEQ ID NO: 483859 - DNA, 25 bp, Rattus norvegicus
gagtgcagcaattactccctccacg

SEQ ID NO: 483860 - DNA, 25 bp, Rattus norvegicus
agagttctcagaaccggctcggtcg

SEQ ID NO: 483861 - DNA, 25 bp, Rattus norvegicus
gtgtccgacagagttctcagaaccg

SEQ ID NO: 483862 - DNA, 25 bp, Rattus norvegicus
agataaacccggctccgccaaagca

SEQ ID NO: 483863 - DNA, 25 bp, Rattus norvegicus
ttcatatctgactgctctccgggcg

SEQ ID NO: 483864 - DNA, 25 bp, Rattus norvegicus
gcctacccgagggtcctctggtcag

SEQ ID NO: 483865 - DNA, 25 bp, Rattus norvegicus
cggcgcacagtaaaggtaatgagta

SEQ ID NO: 483866 - DNA, 25 bp, Rattus norvegicus
gccataattccaaaagcgctctaag

SEQ ID NO: 483867 - DNA, 25 bp, Rattus norvegicus
agcgctctaagaacctacttccggc

SEQ ID NO: 483868 - DNA, 25 bp, Rattus norvegicus
cttccggcgcacagtaaaggtaatg

SEQ ID NO: 483869 - DNA, 25 bp, Rattus norvegicus
gccgccataattccaaaagcgctct

SEQ ID NO: 483870 - DNA, 25 bp, Rattus norvegicus
gtaatgagtactgcgacggaagctg

SEQ ID NO: 483871 - DNA, 25 bp, Rattus norvegicus
actgcgacggaagctgcggctgact

SEQ ID NO: 483872 - DNA, 25 bp, Rattus norvegicus
ctgactgcggtacggttagcgagga

SEQ ID NO: 483873 - DNA, 25 bp, Rattus norvegicus
gaggtcaaaagtattcacgtggagg

SEQ ID NO: 483874 - DNA, 25 bp, Rattus norvegicus
cgaggttttgttgtaggacacctgc

SEQ ID NO: 483875 - DNA, 25 bp, Rattus norvegicus
gttttgttgtaggacacctgccgga

SEQ ID NO: 483876 - DNA, 25 bp, Rattus norvegicus
tgtaggacacctgccggaaggaaaa

SEQ ID NO: 483877 - DNA, 25 bp, Rattus norvegicus
ggaaaaaggcgtggcacagggtgtc

SEQ ID NO: 483878 - DNA, 25 bp, Rattus norvegicus
taagaacctacttccggcgcacagt

SEQ ID NO: 483879 - DNA, 25 bp, Rattus norvegicus
gcgcgcgcacgagtttaagagccaa

SEQ ID NO: 483880 - DNA, 25 bp, Rattus norvegicus
atcaccgggcgttgctggagctgaa

SEQ ID NO: 483881 - DNA, 25 bp, Rattus norvegicus
gactgttacaacagcctggcaggta

SEQ ID NO: 483882 - DNA, 25 bp, Rattus norvegicus
gaagccattgagatcgactgttaca

SEQ ID NO: 483883 - DNA, 25 bp, Rattus norvegicus
caagacggttgaagccattgagatc

SEQ ID NO: 483884 - DNA, 25 bp, Rattus norvegicus
ctcggaggaacagagcaagacggtt

SEQ ID NO: 483885 - DNA, 25 bp, Rattus norvegicus
aagccagccgcctctcggaggaaca

SEQ ID NO: 483886 - DNA, 25 bp, Rattus norvegicus
catcggcaaatatcaccgggcgttg

SEQ ID NO: 483887 - DNA, 25 bp, Rattus norvegicus
cgaagccatcggcaaatatcaccgg

SEQ ID NO: 483888 - DNA, 25 bp, Rattus norvegicus
ggacaagaaattccgcgaagccatc

SEQ ID NO: 483889 - DNA, 25 bp, Rattus norvegicus
tttaagagccaaggggcgcagtgct

SEQ ID NO: 483890 - DNA, 25 bp, Rattus norvegicus
aagggcttggcagcccgagcctcag

SEQ ID NO: 483891 - DNA, 25 bp, Rattus norvegicus
cggcgcttttaaagcccggatcgcg

SEQ ID NO: 483892 - DNA, 25 bp, Rattus norvegicus
ggcgcagtgctacaaggacaagaaa

SEQ ID NO: 483893 - DNA, 25 bp, Rattus norvegicus
gacgtgcgttcccagctgtaccgaa

SEQ ID NO: 483894 - DNA, 25 bp, Rattus norvegicus
tgtaccgaaccggtgcacagctggg

SEQ ID NO: 483895 - DNA, 25 bp, Rattus norvegicus
acacgcgtcaggaagagcgcaggct

SEQ ID NO: 483896 - DNA, 25 bp, Rattus norvegicus
ccgacatggctagactcccgacgtg

SEQ ID NO: 483897 - DNA, 25 bp, Rattus norvegicus
acccagctgcgagggcgcgaaaaga

SEQ ID NO: 483898 - DNA, 25 bp, Rattus norvegicus
tcggcaaagttgagcccgcaggctc

SEQ ID NO: 483899 - DNA, 25 bp, Rattus norvegicus
cttaaagggctaggccctctgctga

SEQ ID NO: 483900 - DNA, 25 bp, Rattus norvegicus
ctctgctgacccagctgcgagggcg

SEQ ID NO: 483901 - DNA, 25 bp, Rattus norvegicus
gcttcgcgggcagacttaaagggct

SEQ ID NO: 483902 - DNA, 25 bp, Rattus norvegicus
aagccggtgagtaccaggcagcgaa

SEQ ID NO: 483903 - DNA, 25 bp, Rattus norvegicus
tttatcgtagccaccgaagccggtg

SEQ ID NO: 483904 - DNA, 25 bp, Rattus norvegicus
gtcggctctgcagcttcactttatc

SEQ ID NO: 483905 - DNA, 25 bp, Rattus norvegicus
cggcccatgaggtcggcaaagttga

SEQ ID NO: 483906 - DNA, 25 bp, Rattus norvegicus
agcttcactttatcgtagccaccga

SEQ ID NO: 483907 - DNA, 25 bp, Rattus norvegicus
aggcctcattgggtggctcccgaag

SEQ ID NO: 483908 - DNA, 25 bp, Rattus norvegicus
tggttcagctgtccggtccaccagc

SEQ ID NO: 483909 - DNA, 25 bp, Rattus norvegicus
atcgccggacacctgagagtccttg

SEQ ID NO: 483910 - DNA, 25 bp, Rattus norvegicus
gggaccacctgacgcgaatctggct

SEQ ID NO: 483911 - DNA, 25 bp, Rattus norvegicus
gagtccttggacagcacctctacca

SEQ ID NO: 483912 - DNA, 25 bp, Rattus norvegicus
tcgtactcgaacacagccgtccagt

SEQ ID NO: 483913 - DNA, 25 bp, Rattus norvegicus
tcttacgctgaatgggcgggtagca

SEQ ID NO: 483914 - DNA, 25 bp, Rattus norvegicus
cagcgtggcatgagatcccagctcg

SEQ ID NO: 483915 - DNA, 25 bp, Rattus norvegicus
ctgtccgtctcctgaggatagctga

SEQ ID NO: 483916 - DNA, 25 bp, Rattus norvegicus
gtgcccgccttcttacgctgaatgg

SEQ ID NO: 483917 - DNA, 25 bp, Rattus norvegicus
ggactccatggagcggccggtccat

SEQ ID NO: 483918 - DNA, 25 bp, Rattus norvegicus
cgcctattgttcatgcggctcggca

SEQ ID NO: 483919 - DNA, 25 bp, Rattus norvegicus
ccgagaagcgatctggaggactcca

SEQ ID NO: 483920 - DNA, 25 bp, Rattus norvegicus
ggaagatgcccacccgctggttcag

SEQ ID NO: 483921 - DNA, 25 bp, Rattus norvegicus
gcacctcggtctccggctgtgcgga

SEQ ID NO: 483922 - DNA, 25 bp, Rattus norvegicus
tggcggctggtactacgacccacac

SEQ ID NO: 483923 - DNA, 25 bp, Rattus norvegicus
acctggctggcatttaacccgtttg

SEQ ID NO: 483924 - DNA, 25 bp, Rattus norvegicus
cagacgctgcagatcctccggcagg

SEQ ID NO: 483925 - DNA, 25 bp, Rattus norvegicus
tgttgtcaggctagcgctgtgcaca

SEQ ID NO: 483926 - DNA, 25 bp, Rattus norvegicus
gtgcctctgcaaaccgttggtcggt

SEQ ID NO: 483927 - DNA, 25 bp, Rattus norvegicus
tctacctgtggctctttctgctcgg

SEQ ID NO: 483928 - DNA, 25 bp, Rattus norvegicus
gctcgtactcgcttcccgtgttggg

SEQ ID NO: 483929 - DNA, 25 bp, Rattus norvegicus
ttcctagcgcctcgcgtgcgggtct

SEQ ID NO: 483930 - DNA, 25 bp, Rattus norvegicus
agtattttcagcacctcccttctca

SEQ ID NO: 483931 - DNA, 25 bp, Rattus norvegicus
cccgggatttccagtattttcagca

SEQ ID NO: 483932 - DNA, 25 bp, Rattus norvegicus
acactctgaggacgctcggcgggtc

SEQ ID NO: 483933 - DNA, 25 bp, Rattus norvegicus
ggcctgcccttcacgctttacatgg

SEQ ID NO: 483934 - DNA, 25 bp, Rattus norvegicus
cccgggtggctcgtgcctctgcaaa

SEQ ID NO: 483935 - DNA, 25 bp, Rattus norvegicus
cttcagggtcattaaggtgagtctc

SEQ ID NO: 483936 - DNA, 25 bp, Rattus norvegicus
gcttgcttactttgcgctagttccc

SEQ ID NO: 483937 - DNA, 25 bp, Rattus norvegicus
gcggagcgcagtccttgccaactct

SEQ ID NO: 483938 - DNA, 25 bp, Rattus norvegicus
tggctctgcggcatgtcatggacga

SEQ ID NO: 483939 - DNA, 25 bp, Rattus norvegicus
catggacgatggcaccaacgagtac

SEQ ID NO: 483940 - DNA, 25 bp, Rattus norvegicus
acggccaccgtctgttgagactgtg

SEQ ID NO: 483941 - DNA, 25 bp, Rattus norvegicus
ccgacgctacctgagcttcagggtc

SEQ ID NO: 483942 - DNA, 25 bp, Rattus norvegicus
tgagtctcgggtcacacgacggtga

SEQ ID NO: 483943 - DNA, 25 bp, Rattus norvegicus
cgacggtgacgtagacatgaggcta

SEQ ID NO: 483944 - DNA, 25 bp, Rattus norvegicus
catgaggctagcatcttggtccagc

SEQ ID NO: 483945 - DNA, 25 bp, Rattus norvegicus
tccagcctggaacgtgtaacggcca

SEQ ID NO: 483946 - DNA, 25 bp, Rattus norvegicus
ggttcacgaacgcttgcttactttg

SEQ ID NO: 483947 - DNA, 25 bp, Rattus norvegicus
gagactgtgctttcgtggttcacga

SEQ ID NO: 483948 - DNA, 25 bp, Rattus norvegicus
agatcatcatgctcaaccgacgcta

SEQ ID NO: 483949 - DNA, 25 bp, Rattus norvegicus
gctcggagcctcagatctccacaga

SEQ ID NO: 483950 - DNA, 25 bp, Rattus norvegicus
ccggcccgagcttgggcttctaatc

SEQ ID NO: 483951 - DNA, 25 bp, Rattus norvegicus
ctcgcgagacttgcctgagcgcaga

SEQ ID NO: 483952 - DNA, 25 bp, Rattus norvegicus
ccgcggtgatctcacccgagactga

SEQ ID NO: 483953 - DNA, 25 bp, Rattus norvegicus
ccaccgccggcaactttgtgagcga

SEQ ID NO: 483954 - DNA, 25 bp, Rattus norvegicus
gggcgagtctgcacttcaccgcgca

SEQ ID NO: 483955 - DNA, 25 bp, Rattus norvegicus
ttagatttccgatttagtggcgtgc

SEQ ID NO: 483956 - DNA, 25 bp, Rattus norvegicus
cacagcggctgaaagttagatttcc

SEQ ID NO: 483957 - DNA, 25 bp, Rattus norvegicus
aagcccaggccaagcggtaagtggc

SEQ ID NO: 483958 - DNA, 25 bp, Rattus norvegicus
ctttgtgagcgagttcagtacgtgc

SEQ ID NO: 483959 - DNA, 25 bp, Rattus norvegicus
ctggggagctgtgctaatcctgccc

SEQ ID NO: 483960 - DNA, 25 bp, Rattus norvegicus
gggtcccggcttctgcacaatagtt

SEQ ID NO: 483961 - DNA, 25 bp, Rattus norvegicus
ggactaatcacttcggcctccgcag

SEQ ID NO: 483962 - DNA, 25 bp, Rattus norvegicus
agctggacgctcacagcggctgaaa

SEQ ID NO: 483963 - DNA, 25 bp, Rattus norvegicus
atggaaatcgccttcccggctttgg

SEQ ID NO: 483964 - DNA, 25 bp, Rattus norvegicus
tcgccgcctcggagagtggcaccaa

SEQ ID NO: 483965 - DNA, 25 bp, Rattus norvegicus
actccaggcagctccttggcgatcg

SEQ ID NO: 483966 - DNA, 25 bp, Rattus norvegicus
tgggtgcaggtctacatggaaatcg

SEQ ID NO: 483967 - DNA, 25 bp, Rattus norvegicus
gggctgcacagtctgctcgttgagc

SEQ ID NO: 483968 - DNA, 25 bp, Rattus norvegicus
cactagggagatcagtgcccggacg

SEQ ID NO: 483969 - DNA, 25 bp, Rattus norvegicus
ctttaggagaaactgagacgccgga

SEQ ID NO: 483970 - DNA, 25 bp, Rattus norvegicus
ccggagcgagtcgaggcaattcttt

SEQ ID NO: 483971 - DNA, 25 bp, Rattus norvegicus
ctttggttgctaaggtaattgtact

SEQ ID NO: 483972 - DNA, 25 bp, Rattus norvegicus
cccgatctgtatggcttgcattcct

SEQ ID NO: 483973 - DNA, 25 bp, Rattus norvegicus
gcgcctgtccatttcagatgcgtga

SEQ ID NO: 483974 - DNA, 25 bp, Rattus norvegicus
tctgcagtttgggactgtgcacggc

SEQ ID NO: 483975 - DNA, 25 bp, Rattus norvegicus
cacggcgagcttacgtaagtgactc

SEQ ID NO: 483976 - DNA, 25 bp, Rattus norvegicus
acctgttcaggtgtcagggtcccgc

SEQ ID NO: 483977 - DNA, 25 bp, Rattus norvegicus
gctgacgcagcctcgagggctattt

SEQ ID NO: 483978 - DNA, 25 bp, Rattus norvegicus
ggacacggtcccattgccttgcaaa

SEQ ID NO: 483979 - DNA, 25 bp, Rattus norvegicus
tcgcggagcacaaagctggaccctc

SEQ ID NO: 483980 - DNA, 25 bp, Rattus norvegicus
gctggaccctcgttctgcaagcggt

SEQ ID NO: 483981 - DNA, 25 bp, Rattus norvegicus
cgtcgggaaagagacactgggctcc

SEQ ID NO: 483982 - DNA, 25 bp, Rattus norvegicus
aggccaagggccagggaactataca

SEQ ID NO: 483983 - DNA, 25 bp, Rattus norvegicus
atacaagtggacaccgcaggctggc

SEQ ID NO: 483984 - DNA, 25 bp, Rattus norvegicus
ctgacatggcattcaaggtccaagc

SEQ ID NO: 483985 - DNA, 25 bp, Rattus norvegicus
tccaagcttgaaggtgtctcagacg

SEQ ID NO: 483986 - DNA, 25 bp, Rattus norvegicus
gacggagtccttctgtccatccttt

SEQ ID NO: 483987 - DNA, 25 bp, Rattus norvegicus
tgaggtcctgaaccattcccggcca

SEQ ID NO: 483988 - DNA, 25 bp, Rattus norvegicus
ctgcttcctgcagaaccagaactgg

SEQ ID NO: 483989 - DNA, 25 bp, Rattus norvegicus
ccagagtgggaaacaaaggccgatc

SEQ ID NO: 483990 - DNA, 25 bp, Rattus norvegicus
tgaccgatgatctttgtgccctctg

SEQ ID NO: 483991 - DNA, 25 bp, Rattus norvegicus
agtgctcccgtggtagtgctcccgt

SEQ ID NO: 483992 - DNA, 25 bp, Rattus norvegicus
ggtagtgctcccgtggtagtgctcc

SEQ ID NO: 483993 - DNA, 25 bp, Rattus norvegicus
tcccgtggtagtgctcccgtggtag

SEQ ID NO: 483994 - DNA, 25 bp, Rattus norvegicus
ctcccgtggtagtgctcccgtggta

SEQ ID NO: 483995 - DNA, 25 bp, Rattus norvegicus
tagtgctcccgtggtagtgctcccg

SEQ ID NO: 483996 - DNA, 25 bp, Rattus norvegicus
ctcccgtggtagtgctcccgtggtt

SEQ ID NO: 483997 - DNA, 25 bp, Rattus norvegicus
gctcccgtggttggtagtgctcccg

SEQ ID NO: 483998 - DNA, 25 bp, Rattus norvegicus
tagtgctcccgtggttggtagtgct

SEQ ID NO: 483999 - DNA, 25 bp, Rattus norvegicus
ctcccgtggttggtagtgctcccgt

SEQ ID NO: 484000 - DNA, 25 bp, Rattus norvegicus
tgctcccgtggttggtagtgctccc

SEQ ID NO: 484001 - DNA, 25 bp, Rattus norvegicus
cccgtggtagtgctcccgtggtagt

SEQ ID NO: 484002 - DNA, 25 bp, Rattus norvegicus
agtgctcccgtggttggtagtgctc

SEQ ID NO: 484003 - DNA, 25 bp, Rattus norvegicus
gtgctcccgtggttggtagtgctcc

SEQ ID NO: 484004 - DNA, 25 bp, Rattus norvegicus
gctcccgtggtagtgctcccgtggt

SEQ ID NO: 484005 - DNA, 25 bp, Rattus norvegicus
cgcgcagttaaaagccaagatcgac

SEQ ID NO: 484006 - DNA, 25 bp, Rattus norvegicus
ccactgacacagaccgggaagaatt

SEQ ID NO: 484007 - DNA, 25 bp, Rattus norvegicus
cccagaggctttcatcagggcgtga

SEQ ID NO: 484008 - DNA, 25 bp, Rattus norvegicus
cagggcgtgaagtcctagtacactc

SEQ ID NO: 484009 - DNA, 25 bp, Rattus norvegicus
tgagagccacactagttttcccagg

SEQ ID NO: 484010 - DNA, 25 bp, Rattus norvegicus
cacccgcagacttggcggcttcata

SEQ ID NO: 484011 - DNA, 25 bp, Rattus norvegicus
ggcttcatattcagtccaccgactg

SEQ ID NO: 484012 - DNA, 25 bp, Rattus norvegicus
ccagagcaggcgagcacaccattaa

SEQ ID NO: 484013 - DNA, 25 bp, Rattus norvegicus
caccattaataagacctgcagtttc

SEQ ID NO: 484014 - DNA, 25 bp, Rattus norvegicus
ccgtctccatatcaacctcaagtta

SEQ ID NO: 484015 - DNA, 25 bp, Rattus norvegicus
cccagatcgttaatttactagagcc

SEQ ID NO: 484016 - DNA, 25 bp, Rattus norvegicus
agagcgaacgccctgcaaaactccg

SEQ ID NO: 484017 - DNA, 25 bp, Rattus norvegicus
cttaggacgctgtagcgcgcagtta

SEQ ID NO: 484018 - DNA, 25 bp, Rattus norvegicus
gtccgctcaaagtctccgggaggca

SEQ ID NO: 484019 - DNA, 25 bp, Rattus norvegicus
cgccctccgtaaagtaacatggaca

SEQ ID NO: 484020 - DNA, 25 bp, Rattus norvegicus
cagaacatgggtgtctttccggatc

SEQ ID NO: 484021 - DNA, 25 bp, Rattus norvegicus
ctatgggctgcgacaacacagaaca

SEQ ID NO: 484022 - DNA, 25 bp, Rattus norvegicus
agaaccggtcgctttagtcctatgg

SEQ ID NO: 484023 - DNA, 25 bp, Rattus norvegicus
ttcgcacgcctctgggtactccagg

SEQ ID NO: 484024 - DNA, 25 bp, Rattus norvegicus
caggcagaagcctaatccaatgaga

SEQ ID NO: 484025 - DNA, 25 bp, Rattus norvegicus
aaggccaggctaaaaacaggagtga

SEQ ID NO: 484026 - DNA, 25 bp, Rattus norvegicus
ccctaagcgtgtcaagccggggcac

SEQ ID NO: 484027 - DNA, 25 bp, Rattus norvegicus
tccaatgagaagaaagaaccggtcg

SEQ ID NO: 484028 - DNA, 25 bp, Rattus norvegicus
tactccaggccagccgtgttgtgtc

SEQ ID NO: 484029 - DNA, 25 bp, Rattus norvegicus
accgtctgcgcaggtaagactgttc

SEQ ID NO: 484030 - DNA, 25 bp, Rattus norvegicus
gccgctgtacccacgcaagaggaca

SEQ ID NO: 484031 - DNA, 25 bp, Rattus norvegicus
agtgagcgtgcaatacatggccgga

SEQ ID NO: 484032 - DNA, 25 bp, Rattus norvegicus
taagactgttcccacgcttggcgtg

SEQ ID NO: 484033 - DNA, 25 bp, Rattus norvegicus
gccgaatccattgtttatgccaccc

SEQ ID NO: 484034 - DNA, 25 bp, Rattus norvegicus
agcagctcggccaaggcaaggcggt

SEQ ID NO: 484035 - DNA, 25 bp, Rattus norvegicus
ctcggccaaggcaaggcggtgtgtg

SEQ ID NO: 484036 - DNA, 25 bp, Rattus norvegicus
cgactggagccccgggaccagagct

SEQ ID NO: 484037 - DNA, 25 bp, Rattus norvegicus
ttcctcccaggagcgactggagccc

SEQ ID NO: 484038 - DNA, 25 bp, Rattus norvegicus
cccttcctcccaggagcgactggag

SEQ ID NO: 484039 - DNA, 25 bp, Rattus norvegicus
gaatccattgtttatgccaccccac

SEQ ID NO: 484040 - DNA, 25 bp, Rattus norvegicus
ggagccgaatccattgtttatgcca

SEQ ID NO: 484041 - DNA, 25 bp, Rattus norvegicus
cggagccgaatccattgtttatgcc

SEQ ID NO: 484042 - DNA, 25 bp, Rattus norvegicus
ccggagccgaatccattgtttatgc

SEQ ID NO: 484043 - DNA, 25 bp, Rattus norvegicus
cccggagccgaatccattgtttatg

SEQ ID NO: 484044 - DNA, 25 bp, Rattus norvegicus
gcacaacccggagccgaatccattg

SEQ ID NO: 484045 - DNA, 25 bp, Rattus norvegicus
caacccggagccgaatccattgttt

SEQ ID NO: 484046 - DNA, 25 bp, Rattus norvegicus
agccgaatccattgtttatgccacc

SEQ ID NO: 484047 - DNA, 25 bp, Rattus norvegicus
gccctgcgcttgtgtttgtagcttc

SEQ ID NO: 484048 - DNA, 25 bp, Rattus norvegicus
cgcgctagagtctgactcgctacta

SEQ ID NO: 484049 - DNA, 25 bp, Rattus norvegicus
tcaggggtcacagctgcgcgctaga

SEQ ID NO: 484050 - DNA, 25 bp, Rattus norvegicus
caacactcaggggtcacagctgcgc

SEQ ID NO: 484051 - DNA, 25 bp, Rattus norvegicus
cgctggtcaccaacactcaggggtc

SEQ ID NO: 484052 - DNA, 25 bp, Rattus norvegicus
aaacagggttcgctggtcaccaaca

SEQ ID NO: 484053 - DNA, 25 bp, Rattus norvegicus
ctcctcaaataaacagggttcgctg

SEQ ID NO: 484054 - DNA, 25 bp, Rattus norvegicus
cttgtgtttgtagcttcgcagccga

SEQ ID NO: 484055 - DNA, 25 bp, Rattus norvegicus
tcgagccctgcgcttgtgtttgtag

SEQ ID NO: 484056 - DNA, 25 bp, Rattus norvegicus
gcacacagaaggctcgagccctgcg

SEQ ID NO: 484057 - DNA, 25 bp, Rattus norvegicus
cgtgggcacacagaaggctcgagcc

SEQ ID NO: 484058 - DNA, 25 bp, Rattus norvegicus
tgcacgcgtgggcacacagaaggct

SEQ ID NO: 484059 - DNA, 25 bp, Rattus norvegicus
cactagtacacctgcgtgcacgcgt

SEQ ID NO: 484060 - DNA, 25 bp, Rattus norvegicus
tgtagcttcgcagccgacccttcag

SEQ ID NO: 484061 - DNA, 25 bp, Rattus norvegicus
cgggtgagttcacgcttccgaacgc

SEQ ID NO: 484062 - DNA, 25 bp, Rattus norvegicus
cacgcttccgaacgcgtgaggaaac

SEQ ID NO: 484063 - DNA, 25 bp, Rattus norvegicus
caagaggaagacctccagtagctcc

SEQ ID NO: 484064 - DNA, 25 bp, Rattus norvegicus
acgccgggcaagaggaagacctcca

SEQ ID NO: 484065 - DNA, 25 bp, Rattus norvegicus
cagcgcggctgtgtttgcggcctat

SEQ ID NO: 484066 - DNA, 25 bp, Rattus norvegicus
gcgcgcagaaacctccaaccggtgg

SEQ ID NO: 484067 - DNA, 25 bp, Rattus norvegicus
taggcgcttcggaaccagtctctga

SEQ ID NO: 484068 - DNA, 25 bp, Rattus norvegicus
ccaaccggtggagcctactcataac

SEQ ID NO: 484069 - DNA, 25 bp, Rattus norvegicus
tactcataacctgacgcccagaggc

SEQ ID NO: 484070 - DNA, 25 bp, Rattus norvegicus
tgcggcctattcgagtaggcgcttc

SEQ ID NO: 484071 - DNA, 25 bp, Rattus norvegicus
agaggccgcgaagacagtaccgttt

SEQ ID NO: 484072 - DNA, 25 bp, Rattus norvegicus
agacagtaccgttttcttagcggcg

SEQ ID NO: 484073 - DNA, 25 bp, Rattus norvegicus
tcttagcggcgggtgagttcacgct

SEQ ID NO: 484074 - DNA, 25 bp, Rattus norvegicus
aaccagtctctgagtcgggcggcgc

SEQ ID NO: 484075 - DNA, 25 bp, Rattus norvegicus
cgcccactttctctattgcttcaga

SEQ ID NO: 484076 - DNA, 25 bp, Rattus norvegicus
tcgtgaatttttgtcgcccactttc

SEQ ID NO: 484077 - DNA, 25 bp, Rattus norvegicus
ccagagcgttccttcgtgaattttt

SEQ ID NO: 484078 - DNA, 25 bp, Rattus norvegicus
ggcctacgtccagagcgttccttcg

SEQ ID NO: 484079 - DNA, 25 bp, Rattus norvegicus
ctcaagatccgcctctcagtagatt

SEQ ID NO: 484080 - DNA, 25 bp, Rattus norvegicus
tttctctattgcttcagattccgtt

SEQ ID NO: 484081 - DNA, 25 bp, Rattus norvegicus
gcctctcagtagatttccggggccg

SEQ ID NO: 484082 - DNA, 25 bp, Rattus norvegicus
ccttacggggctccatcttagccag

SEQ ID NO: 484083 - DNA, 25 bp, Rattus norvegicus
cggggctccatcttagccagggata

SEQ ID NO: 484084 - DNA, 25 bp, Rattus norvegicus
tcttagccagggataggatcggtcg

SEQ ID NO: 484085 - DNA, 25 bp, Rattus norvegicus
gcccttgttttatccggcctcaaga

SEQ ID NO: 484086 - DNA, 25 bp, Rattus norvegicus
gttttatccggcctcaagatccgcc

SEQ ID NO: 484087 - DNA, 25 bp, Rattus norvegicus
attccgtttgggagtgaatcgcctc

SEQ ID NO: 484088 - DNA, 25 bp, Rattus norvegicus
tttgggagtgaatcgcctcgtccct

SEQ ID NO: 484089 - DNA, 25 bp, Rattus norvegicus
gtctctgcgggttatgttcaccgtc

SEQ ID NO: 484090 - DNA, 25 bp, Rattus norvegicus
tgaggcggaaacctagctgcgagcc

SEQ ID NO: 484091 - DNA, 25 bp, Rattus norvegicus
tgaggtatcacctctccgagctttg

SEQ ID NO: 484092 - DNA, 25 bp, Rattus norvegicus
gtcggaaacaaaacagcggcagctg

SEQ ID NO: 484093 - DNA, 25 bp, Rattus norvegicus
tatgttcaccgtcgtctgccgggtg

SEQ ID NO: 484094 - DNA, 25 bp, Rattus norvegicus
cggccaggctgaggtatcacctctc

SEQ ID NO: 484095 - DNA, 25 bp, Rattus norvegicus
gggccgcgagtattcgtcggaaaca

SEQ ID NO: 484096 - DNA, 25 bp, Rattus norvegicus
gccgagaccggaaattgcgacacga

SEQ ID NO: 484097 - DNA, 25 bp, Rattus norvegicus
ctgtgtctctgtgggccgcgcagct

SEQ ID NO: 484098 - DNA, 25 bp, Rattus norvegicus
ttgcgacacgagtgagacctctagg

SEQ ID NO: 484099 - DNA, 25 bp, Rattus norvegicus
gcctaggacgacctgctcagtgggc

SEQ ID NO: 484100 - DNA, 25 bp, Rattus norvegicus
tctaggggccaacgtcgccgagacc

SEQ ID NO: 484101 - DNA, 25 bp, Rattus norvegicus
tcagaagaaggaggccagctgcagc

SEQ ID NO: 484102 - DNA, 25 bp, Rattus norvegicus
gcgcacgacctattcagaagaagga

SEQ ID NO: 484103 - DNA, 25 bp, Rattus norvegicus
ccggggaatctgtaggcatctgccc

SEQ ID NO: 484104 - DNA, 25 bp, Rattus norvegicus
ggctgcacttctggacccgcattcc

SEQ ID NO: 484105 - DNA, 25 bp, Rattus norvegicus
cccacaatccggctgcacttctgga

SEQ ID NO: 484106 - DNA, 25 bp, Rattus norvegicus
ggttggccggtaatcagattcccca

SEQ ID NO: 484107 - DNA, 25 bp, Rattus norvegicus
ccgctccgcatctggagcccggggt

SEQ ID NO: 484108 - DNA, 25 bp, Rattus norvegicus
gcatctgccccgtctggctcgggta

SEQ ID NO: 484109 - DNA, 25 bp, Rattus norvegicus
caggtaagaaggcaaacgggcgtct

SEQ ID NO: 484110 - DNA, 25 bp, Rattus norvegicus
tcgtgaggcaggtaagaaggcaaac

SEQ ID NO: 484111 - DNA, 25 bp, Rattus norvegicus
taggcaccgataagccggctcccgg

SEQ ID NO: 484112 - DNA, 25 bp, Rattus norvegicus
tgacccaggctaggcaccgataagc

SEQ ID NO: 484113 - DNA, 25 bp, Rattus norvegicus
cggcaagtttgacccaggctaggca

SEQ ID NO: 484114 - DNA, 25 bp, Rattus norvegicus
gtcccggcaagtttgacccaggcta

SEQ ID NO: 484115 - DNA, 25 bp, Rattus norvegicus
tcctggctttcgtcggtcccggcaa

SEQ ID NO: 484116 - DNA, 25 bp, Rattus norvegicus
tgagcattgaggagggtctccgctc

SEQ ID NO: 484117 - DNA, 25 bp, Rattus norvegicus
cagggctgcctctgggcagcccaag

SEQ ID NO: 484118 - DNA, 25 bp, Rattus norvegicus
gctcgggtctcttcaggaagccgca

SEQ ID NO: 484119 - DNA, 25 bp, Rattus norvegicus
tgagggtcctccctcagtccagact

SEQ ID NO: 484120 - DNA, 25 bp, Rattus norvegicus
agactccagtcccagacccgctgtg

SEQ ID NO: 484121 - DNA, 25 bp, Rattus norvegicus
gaggagttcgttcaaggtctccacc

SEQ ID NO: 484122 - DNA, 25 bp, Rattus norvegicus
ggcgcctttcctccattccctgtca

SEQ ID NO: 484123 - DNA, 25 bp, Rattus norvegicus
taggctcccagagcaccgagaaacc

SEQ ID NO: 484124 - DNA, 25 bp, Rattus norvegicus
cgaagccgtcactttgagggtcctc

SEQ ID NO: 484125 - DNA, 25 bp, Rattus norvegicus
caggctcccgtcactgtacccaggg

SEQ ID NO: 484126 - DNA, 25 bp, Rattus norvegicus
agcgcgaactccgacggcaggaacc

SEQ ID NO: 484127 - DNA, 25 bp, Rattus norvegicus
agcgcacagctagagtttccggccc

SEQ ID NO: 484128 - DNA, 25 bp, Rattus norvegicus
gtgcgactcgaagccgtcactttga

SEQ ID NO: 484129 - DNA, 25 bp, Rattus norvegicus
ccctgcacaactccggcgcctcaga

SEQ ID NO: 484130 - DNA, 25 bp, Rattus norvegicus
ttcaggaagccgcacacacacaggc

SEQ ID NO: 484131 - DNA, 25 bp, Rattus norvegicus
gccaggccatggatgagcttccgaa

SEQ ID NO: 484132 - DNA, 25 bp, Rattus norvegicus
ttacagctggaaggtcggaaactct

SEQ ID NO: 484133 - DNA, 25 bp, Rattus norvegicus
ccactacgacgacatcgaggctttc

SEQ ID NO: 484134 - DNA, 25 bp, Rattus norvegicus
agcatggcaggctccaacgtttacc

SEQ ID NO: 484135 - DNA, 25 bp, Rattus norvegicus
tcaggaacagtttggaagcatggca

SEQ ID NO: 484136 - DNA, 25 bp, Rattus norvegicus
ctcgcccacggtgtggcagtttttg

SEQ ID NO: 484137 - DNA, 25 bp, Rattus norvegicus
ggtccttgtaccaagccggctgctc

SEQ ID NO: 484138 - DNA, 25 bp, Rattus norvegicus
atgctgcgctacgaggacgtgcact

SEQ ID NO: 484139 - DNA, 25 bp, Rattus norvegicus
tacctccgacctggactggatgctg

SEQ ID NO: 484140 - DNA, 25 bp, Rattus norvegicus
ccacagctactacgaaggtctattc

SEQ ID NO: 484141 - DNA, 25 bp, Rattus norvegicus
cgcgctctcccgaaacctggggaag

SEQ ID NO: 484142 - DNA, 25 bp, Rattus norvegicus
ctcggactcgaacgtggaatcggtc

SEQ ID NO: 484143 - DNA, 25 bp, Rattus norvegicus
gaaactctggcgagtctaccgaccg

SEQ ID NO: 484144 - DNA, 25 bp, Rattus norvegicus
cgctcctgagcgaagactcggactc

SEQ ID NO: 484145 - DNA, 25 bp, Rattus norvegicus
tattcttgtgtctcggcctttctgg

SEQ ID NO: 484146 - DNA, 25 bp, Rattus norvegicus
acgctgcagtcgcttcttattcttg

SEQ ID NO: 484147 - DNA, 25 bp, Rattus norvegicus
ttcacgctgcagtcgcttcttattc

SEQ ID NO: 484148 - DNA, 25 bp, Rattus norvegicus
cccttcggggtcagtgcgctaccag

SEQ ID NO: 484149 - DNA, 25 bp, Rattus norvegicus
gtcagtgcgctaccagcacagggcc

SEQ ID NO: 484150 - DNA, 25 bp, Rattus norvegicus
cacagggccgcacgcctctcctgct

SEQ ID NO: 484151 - DNA, 25 bp, Rattus norvegicus
ctcctgctagccgtgtggctcttaa

SEQ ID NO: 484152 - DNA, 25 bp, Rattus norvegicus
tgctagccgtgtggctcttaaagag

SEQ ID NO: 484153 - DNA, 25 bp, Rattus norvegicus
ctccgccctgcgtgctcctccgacc

SEQ ID NO: 484154 - DNA, 25 bp, Rattus norvegicus
acgccgacgcctcaagtccctgctg

SEQ ID NO: 484155 - DNA, 25 bp, Rattus norvegicus
tgcagtcgcttcttattcttgtgtc

SEQ ID NO: 484156 - DNA, 25 bp, Rattus norvegicus
ccgctcctcgcagcctttcacgctg

SEQ ID NO: 484157 - DNA, 25 bp, Rattus norvegicus
cgcttcttattcttgtgtctcggcc

SEQ ID NO: 484158 - DNA, 25 bp, Rattus norvegicus
cctttcacgctgcagtcgcttctta

SEQ ID NO: 484159 - DNA, 25 bp, Rattus norvegicus
agcgcgacgtgcagaagccttatgt

SEQ ID NO: 484160 - DNA, 25 bp, Rattus norvegicus
tggccggaccacttttgcgcggaca

SEQ ID NO: 484161 - DNA, 25 bp, Rattus norvegicus
gccggaccacttttgcgcggacaaa

SEQ ID NO: 484162 - DNA, 25 bp, Rattus norvegicus
acgtgcagaagccttatgtggtgga

SEQ ID NO: 484163 - DNA, 25 bp, Rattus norvegicus
tgcgcggacaaatgctacgctgagc

SEQ ID NO: 484164 - DNA, 25 bp, Rattus norvegicus
ccgacgccggtggtgagctggacct

SEQ ID NO: 484165 - DNA, 25 bp, Rattus norvegicus
ggacaaatgctacgctgagcctgga

SEQ ID NO: 484166 - DNA, 25 bp, Rattus norvegicus
gcggacaaatgctacgctgagcctg

SEQ ID NO: 484167 - DNA, 25 bp, Rattus norvegicus
cggaccacttttgcgcggacaaatg

SEQ ID NO: 484168 - DNA, 25 bp, Rattus norvegicus
cacttttgcgcggacaaatgctacg

SEQ ID NO: 484169 - DNA, 25 bp, Rattus norvegicus
caccggtggccggaccacttttgcg

SEQ ID NO: 484170 - DNA, 25 bp, Rattus norvegicus
ttttgcgcggacaaatgctacgctg

SEQ ID NO: 484171 - DNA, 25 bp, Rattus norvegicus
tgcagaagccttatgtggtggagct

SEQ ID NO: 484172 - DNA, 25 bp, Rattus norvegicus
cgcgacgtgcagaagccttatgtgg

SEQ ID NO: 484173 - DNA, 25 bp, Rattus norvegicus
gagtggtcccgcctcgcgactacta

SEQ ID NO: 484174 - DNA, 25 bp, Rattus norvegicus
gactactactccaggagcacgagtc

SEQ ID NO: 484175 - DNA, 25 bp, Rattus norvegicus
ctactactccaggagcacgagtcca

SEQ ID NO: 484176 - DNA, 25 bp, Rattus norvegicus
tactactccaggagcacgagtccac

SEQ ID NO: 484177 - DNA, 25 bp, Rattus norvegicus
agatggaggcgactctgagcctgga

SEQ ID NO: 484178 - DNA, 25 bp, Rattus norvegicus
aggagcacgagtccaccctcctagt

SEQ ID NO: 484179 - DNA, 25 bp, Rattus norvegicus
gcgactactactccaggagcacgag

SEQ ID NO: 484180 - DNA, 25 bp, Rattus norvegicus
accctcctagtccagctcgagatgg

SEQ ID NO: 484181 - DNA, 25 bp, Rattus norvegicus
ccctcctagtccagctcgagatgga

SEQ ID NO: 484182 - DNA, 25 bp, Rattus norvegicus
tcctagtccagctcgagatggaggc

SEQ ID NO: 484183 - DNA, 25 bp, Rattus norvegicus
ctagtccagctcgagatggaggcga

SEQ ID NO: 484184 - DNA, 25 bp, Rattus norvegicus
gtccagctcgagatggaggcgactc

SEQ ID NO: 484185 - DNA, 25 bp, Rattus norvegicus
tcgagatggaggcgactctgagcct

SEQ ID NO: 484186 - DNA, 25 bp, Rattus norvegicus
tcgcgactactactccaggagcacg

SEQ ID NO: 484187 - DNA, 25 bp, Rattus norvegicus
actccgcgtggtgctctcgtaagtt

SEQ ID NO: 484188 - DNA, 25 bp, Rattus norvegicus
gaactccgcgtggtgctctcgtaag

SEQ ID NO: 484189 - DNA, 25 bp, Rattus norvegicus
tccgcgtggtgctctcgtaagtttt

SEQ ID NO: 484190 - DNA, 25 bp, Rattus norvegicus
cgcgtggtgctctcgtaagttttca

SEQ ID NO: 484191 - DNA, 25 bp, Rattus norvegicus
gcgtggtgctctcgtaagttttcag

SEQ ID NO: 484192 - DNA, 25 bp, Rattus norvegicus
cgtggtgctctcgtaagttttcagc

SEQ ID NO: 484193 - DNA, 25 bp, Rattus norvegicus
tggtgctctcgtaagttttcagctc

SEQ ID NO: 484194 - DNA, 25 bp, Rattus norvegicus
ggtgctctcgtaagttttcagctcc

SEQ ID NO: 484195 - DNA, 25 bp, Rattus norvegicus
gtgctctcgtaagttttcagctccc

SEQ ID NO: 484196 - DNA, 25 bp, Rattus norvegicus
cgcgcgctaccacgccgactcccac

SEQ ID NO: 484197 - DNA, 25 bp, Rattus norvegicus
acgccgactcccacggaatgctgga

SEQ ID NO: 484198 - DNA, 25 bp, Rattus norvegicus
cgactcccacggaatgctggacctg

SEQ ID NO: 484199 - DNA, 25 bp, Rattus norvegicus
gactcccacggaatgctggacctgg

SEQ ID NO: 484200 - DNA, 25 bp, Rattus norvegicus
aactccgcgtggtgctctcgtaagt

SEQ ID NO: 484201 - DNA, 25 bp, Rattus norvegicus
atatctcataggagcctcgggtttg

SEQ ID NO: 484202 - DNA, 25 bp, Rattus norvegicus
tccaagagcggacccgcgccaagag

SEQ ID NO: 484203 - DNA, 25 bp, Rattus norvegicus
ccgaaggttctgaccggtgcatcct

SEQ ID NO: 484204 - DNA, 25 bp, Rattus norvegicus
ggtgcatcctgtctcctcgcatagc

SEQ ID NO: 484205 - DNA, 25 bp, Rattus norvegicus
atagctctgcgcctttcttctatga

SEQ ID NO: 484206 - DNA, 25 bp, Rattus norvegicus
cttctatgagcatcgtcagcacaca

SEQ ID NO: 484207 - DNA, 25 bp, Rattus norvegicus
ccctctggcgaatccagaatatctc

SEQ ID NO: 484208 - DNA, 25 bp, Rattus norvegicus
ccaagcagcgcgatctccaagagcg

SEQ ID NO: 484209 - DNA, 25 bp, Rattus norvegicus
caggcagcaaagctctggatgcgca

SEQ ID NO: 484210 - DNA, 25 bp, Rattus norvegicus
ggcaccgcgagaagcaaacactttc

SEQ ID NO: 484211 - DNA, 25 bp, Rattus norvegicus
actttccgcggcactactgggctct

SEQ ID NO: 484212 - DNA, 25 bp, Rattus norvegicus
gcccttgggccattctggcctttta

SEQ ID NO: 484213 - DNA, 25 bp, Rattus norvegicus
gccttttatagagaccgtctgcgga

SEQ ID NO: 484214 - DNA, 25 bp, Rattus norvegicus
gtcagcacacaatccgcactagcag

SEQ ID NO: 484215 - DNA, 25 bp, Rattus norvegicus
taggagcatcagaagatcccggagg

SEQ ID NO: 484216 - DNA, 25 bp, Rattus norvegicus
agtagctccccggatcttcccttag

SEQ ID NO: 484217 - DNA, 25 bp, Rattus norvegicus
agctaggattctgtggaggtggaga

SEQ ID NO: 484218 - DNA, 25 bp, Rattus norvegicus
agtctagctaggattctgtggaggt

SEQ ID NO: 484219 - DNA, 25 bp, Rattus norvegicus
ctgagagtctagctaggattctgtg

SEQ ID NO: 484220 - DNA, 25 bp, Rattus norvegicus
gggtctgagagtctagctaggattc

SEQ ID NO: 484221 - DNA, 25 bp, Rattus norvegicus
ctgagagggaaagaactaggggcta

SEQ ID NO: 484222 - DNA, 25 bp, Rattus norvegicus
aatgtcggaggtcccgggcatctga

SEQ ID NO: 484223 - DNA, 25 bp, Rattus norvegicus
cccggagggcgctctgggagaatgt

SEQ ID NO: 484224 - DNA, 25 bp, Rattus norvegicus
tcaaggaacacggtgaaatatatgg

SEQ ID NO: 484225 - DNA, 25 bp, Rattus norvegicus
aggaatcaaggaacacggtgaaata

SEQ ID NO: 484226 - DNA, 25 bp, Rattus norvegicus
cttaggagcatcagaagatcccgga

SEQ ID NO: 484227 - DNA, 25 bp, Rattus norvegicus
ggcttaggagcatcagaagatcccg

SEQ ID NO: 484228 - DNA, 25 bp, Rattus norvegicus
agaatgtcggaggtcccgggcatct

SEQ ID NO: 484229 - DNA, 25 bp, Rattus norvegicus
gctgcctttgcgaccagccggtgca

SEQ ID NO: 484230 - DNA, 25 bp, Rattus norvegicus
acgcccatggagtgctggacctgga

SEQ ID NO: 484231 - DNA, 25 bp, Rattus norvegicus
cgacgcccatggagtgctggacctg

SEQ ID NO: 484232 - DNA, 25 bp, Rattus norvegicus
ccgacgcccatggagtgctggacct

SEQ ID NO: 484233 - DNA, 25 bp, Rattus norvegicus
gccgacgcccatggagtgctggacc

SEQ ID NO: 484234 - DNA, 25 bp, Rattus norvegicus
cgccgacgcccatggagtgctggac

SEQ ID NO: 484235 - DNA, 25 bp, Rattus norvegicus
tttgcgaccagccggtgcacatcac

SEQ ID NO: 484236 - DNA, 25 bp, Rattus norvegicus
tgcctttgcgaccagccggtgcaca

SEQ ID NO: 484237 - DNA, 25 bp, Rattus norvegicus
ggctgcctttgcgaccagccggtgc

SEQ ID NO: 484238 - DNA, 25 bp, Rattus norvegicus
ttggctgcctttgcgaccagccggt

SEQ ID NO: 484239 - DNA, 25 bp, Rattus norvegicus
gttggctgcctttgcgaccagccgg

SEQ ID NO: 484240 - DNA, 25 bp, Rattus norvegicus
cggttggctgcctttgcgaccagcc

SEQ ID NO: 484241 - DNA, 25 bp, Rattus norvegicus
gcggttggctgcctttgcgaccagc

SEQ ID NO: 484242 - DNA, 25 bp, Rattus norvegicus
gcctttgcgaccagccggtgcacat

SEQ ID NO: 484243 - DNA, 25 bp, Rattus norvegicus
ccagtagtgagcctggagcccgaca

SEQ ID NO: 484244 - DNA, 25 bp, Rattus norvegicus
gaggagcagcatccgaggttgctta

SEQ ID NO: 484245 - DNA, 25 bp, Rattus norvegicus
aactgaaagtcagcggaggagcagc

SEQ ID NO: 484246 - DNA, 25 bp, Rattus norvegicus
catgggtgaatcctgaactgaaagt

SEQ ID NO: 484247 - DNA, 25 bp, Rattus norvegicus
aagctttgcagacatgggtgaatcc

SEQ ID NO: 484248 - DNA, 25 bp, Rattus norvegicus
aggggtgcagcaccaaagctttgca

SEQ ID NO: 484249 - DNA, 25 bp, Rattus norvegicus
cagtccaggatgcttaaggggtgca

SEQ ID NO: 484250 - DNA, 25 bp, Rattus norvegicus
ccctcgtgcgcttgcagtccaggat

SEQ ID NO: 484251 - DNA, 25 bp, Rattus norvegicus
gagcagcctgtcacactacactcgg

SEQ ID NO: 484252 - DNA, 25 bp, Rattus norvegicus
tggagcccgacagccacagttgctg

SEQ ID NO: 484253 - DNA, 25 bp, Rattus norvegicus
ctgtgtcaatatggtgccagtagtg

SEQ ID NO: 484254 - DNA, 25 bp, Rattus norvegicus
acccaagcccggtgaaatcttcatc

SEQ ID NO: 484255 - DNA, 25 bp, Rattus norvegicus
gcagagcatcaaagctcacccaagc

SEQ ID NO: 484256 - DNA, 25 bp, Rattus norvegicus
cctaagcattactgtgcgtggcctg

SEQ ID NO: 484257 - DNA, 25 bp, Rattus norvegicus
ctagtgcgtctctgggagtttctga

SEQ ID NO: 484258 - DNA, 25 bp, Rattus norvegicus
cgcgcagggacgagcacaacgtgac

SEQ ID NO: 484259 - DNA, 25 bp, Rattus norvegicus
acgagcacaacgtgacgggctgctc

SEQ ID NO: 484260 - DNA, 25 bp, Rattus norvegicus
tccacgcaccgtgatcctcagcggc

SEQ ID NO: 484261 - DNA, 25 bp, Rattus norvegicus
tgggctccagggtcagccttgcctc

SEQ ID NO: 484262 - DNA, 25 bp, Rattus norvegicus
ggtcagccttgcctccatgaggagc

SEQ ID NO: 484263 - DNA, 25 bp, Rattus norvegicus
ccttgcctccatgaggagcgagggt

SEQ ID NO: 484264 - DNA, 25 bp, Rattus norvegicus
agagcacgaccggagttcggagcag

SEQ ID NO: 484265 - DNA, 25 bp, Rattus norvegicus
cctgacctgctgtggaggcgaccta

SEQ ID NO: 484266 - DNA, 25 bp, Rattus norvegicus
acctgctgtggaggcgacctagtgc

SEQ ID NO: 484267 - DNA, 25 bp, Rattus norvegicus
cgacctagtgcgtctctgggagttt

SEQ ID NO: 484268 - DNA, 25 bp, Rattus norvegicus
cgtctctgggagtttctgactcgtg

SEQ ID NO: 484269 - DNA, 25 bp, Rattus norvegicus
tctcgtcgcgcagggacgagcacaa

SEQ ID NO: 484270 - DNA, 25 bp, Rattus norvegicus
ggagtttctgactcgtgggctccgc

SEQ ID NO: 484271 - DNA, 25 bp, Rattus norvegicus
cgcgctgatgtccaaggagagctga

SEQ ID NO: 484272 - DNA, 25 bp, Rattus norvegicus
actcaactcgcgtggcactacacga

SEQ ID NO: 484273 - DNA, 25 bp, Rattus norvegicus
gctgatgtccaaggagagctgaacc

SEQ ID NO: 484274 - DNA, 25 bp, Rattus norvegicus
gctctaccgcgctgatgtccaagga

SEQ ID NO: 484275 - DNA, 25 bp, Rattus norvegicus
gtctgtcacactatgctcggccctg

SEQ ID NO: 484276 - DNA, 25 bp, Rattus norvegicus
ccggagcagtctgtcacactatgct

SEQ ID NO: 484277 - DNA, 25 bp, Rattus norvegicus
gagcatcgtcctgagcggcctggcc

SEQ ID NO: 484278 - DNA, 25 bp, Rattus norvegicus
gcggcgacgcttactctggagcccg

SEQ ID NO: 484279 - DNA, 25 bp, Rattus norvegicus
ccctatggcggcgacgcttactctg

SEQ ID NO: 484280 - DNA, 25 bp, Rattus norvegicus
gaggtttccagctccctatggcggc

SEQ ID NO: 484281 - DNA, 25 bp, Rattus norvegicus
tacacgaggtttccagctccctatg

SEQ ID NO: 484282 - DNA, 25 bp, Rattus norvegicus
tggcactacacgaggtttccagctc

SEQ ID NO: 484283 - DNA, 25 bp, Rattus norvegicus
tccgaactcaactcgcgtggcacta

SEQ ID NO: 484284 - DNA, 25 bp, Rattus norvegicus
tcgcgtggcactacacgaggtttcc

SEQ ID NO: 484285 - DNA, 25 bp, Rattus norvegicus
ttgcgtcactgctttgagaagggga

SEQ ID NO: 484286 - DNA, 25 bp, Rattus norvegicus
atgtcgcccttttggtccgggcagg

SEQ ID NO: 484287 - DNA, 25 bp, Rattus norvegicus
gctgtgccttgcgtcactgctttga

SEQ ID NO: 484288 - DNA, 25 bp, Rattus norvegicus
gggacactccgcctatcactcgaat

SEQ ID NO: 484289 - DNA, 25 bp, Rattus norvegicus
ttactcgaggccgtggctcagctac

SEQ ID NO: 484290 - DNA, 25 bp, Rattus norvegicus
cgtggctcagctacaccgagagagg

SEQ ID NO: 484291 - DNA, 25 bp, Rattus norvegicus
ctacaccgagagaggcggcactcga

SEQ ID NO: 484292 - DNA, 25 bp, Rattus norvegicus
cggcactcgaagcaccggggactga

SEQ ID NO: 484293 - DNA, 25 bp, Rattus norvegicus
aggcagctctgctcagcgcttatgg

SEQ ID NO: 484294 - DNA, 25 bp, Rattus norvegicus
tgctcagcgcttatggccgcgcgct

SEQ ID NO: 484295 - DNA, 25 bp, Rattus norvegicus
tccagcaacggcctccgtgcagctg

SEQ ID NO: 484296 - DNA, 25 bp, Rattus norvegicus
tgtcaccgtgacaactgtgtccatg

SEQ ID NO: 484297 - DNA, 25 bp, Rattus norvegicus
ctgtgtccatgacgacgcgagatgc

SEQ ID NO: 484298 - DNA, 25 bp, Rattus norvegicus
tatcactcgaatgtcgcccttttgg

SEQ ID NO: 484299 - DNA, 25 bp, Rattus norvegicus
ttgtgctctggatcaccccgcttcg

SEQ ID NO: 484300 - DNA, 25 bp, Rattus norvegicus
aatcccagggcttcggaatggggct

SEQ ID NO: 484301 - DNA, 25 bp, Rattus norvegicus
gtctccgccttgtgctctggatcac

SEQ ID NO: 484302 - DNA, 25 bp, Rattus norvegicus
cgcttcgcatcatctgcccacagtc

SEQ ID NO: 484303 - DNA, 25 bp, Rattus norvegicus
ccctgccctcgagacctcctcatta

SEQ ID NO: 484304 - DNA, 25 bp, Rattus norvegicus
agacctcctcattacccacggcggg

SEQ ID NO: 484305 - DNA, 25 bp, Rattus norvegicus
tgcgactcccggagttctaacggga

SEQ ID NO: 484306 - DNA, 25 bp, Rattus norvegicus
tgcgtctccgccttgtgctctggat

SEQ ID NO: 484307 - DNA, 25 bp, Rattus norvegicus
acgggaatcccagggcttcggaatg

SEQ ID NO: 484308 - DNA, 25 bp, Rattus norvegicus
cctcattacccacggcgggagcctc

SEQ ID NO: 484309 - DNA, 25 bp, Rattus norvegicus
gcagctgcgactcccggagttctaa

SEQ ID NO: 484310 - DNA, 25 bp, Rattus norvegicus
cagcagctgcgactcccggagttct

SEQ ID NO: 484311 - DNA, 25 bp, Rattus norvegicus
cggccattgggtgccagtctgtccc

SEQ ID NO: 484312 - DNA, 25 bp, Rattus norvegicus
ccgctctcggccattgggtgccagt

SEQ ID NO: 484313 - DNA, 25 bp, Rattus norvegicus
cgctggcgtgctacaaaggattgca

SEQ ID NO: 484314 - DNA, 25 bp, Rattus norvegicus
tagctgcacaaacacgacgaggctg

SEQ ID NO: 484315 - DNA, 25 bp, Rattus norvegicus
gccgccttaggtcgcctctgaagaa

SEQ ID NO: 484316 - DNA, 25 bp, Rattus norvegicus
tctgaagaacccagtcgcctgcaca

SEQ ID NO: 484317 - DNA, 25 bp, Rattus norvegicus
gcctgcacacactcccggattttaa

SEQ ID NO: 484318 - DNA, 25 bp, Rattus norvegicus
cgttcgcagggtttcagccaagccc

SEQ ID NO: 484319 - DNA, 25 bp, Rattus norvegicus
cccgaagcctggaagtttgctggca

SEQ ID NO: 484320 - DNA, 25 bp, Rattus norvegicus
ttacagtccgcctcgagagcgctct

SEQ ID NO: 484321 - DNA, 25 bp, Rattus norvegicus
cctgcgatgcagtgtcaggattgca

SEQ ID NO: 484322 - DNA, 25 bp, Rattus norvegicus
ttgcacaactcgaggctgggagctc

SEQ ID NO: 484323 - DNA, 25 bp, Rattus norvegicus
catcggttgagctcacagcttgaaa

SEQ ID NO: 484324 - DNA, 25 bp, Rattus norvegicus
aggggcgccctctctaagttctcgc

SEQ ID NO: 484325 - DNA, 25 bp, Rattus norvegicus
cacgatcgagctgcgtagctgcaca

SEQ ID NO: 484326 - DNA, 25 bp, Rattus norvegicus
ttgcacggctctgactcatcggttg

SEQ ID NO: 484327 - DNA, 25 bp, Rattus norvegicus
caagtcccggctgctgcgggccgaa

SEQ ID NO: 484328 - DNA, 25 bp, Rattus norvegicus
tacttgcggagaggcaagtcccggc

SEQ ID NO: 484329 - DNA, 25 bp, Rattus norvegicus
cgcagagccttacttgcggagaggc

SEQ ID NO: 484330 - DNA, 25 bp, Rattus norvegicus
cctgagccctcctcccggctttagc

SEQ ID NO: 484331 - DNA, 25 bp, Rattus norvegicus
ccggctttagcgctcacaaggcggc

SEQ ID NO: 484332 - DNA, 25 bp, Rattus norvegicus
tttagcgctcacaaggcggcgccgc

SEQ ID NO: 484333 - DNA, 25 bp, Rattus norvegicus
cactggctggagtacagggctgttc

SEQ ID NO: 484334 - DNA, 25 bp, Rattus norvegicus
tcccgagctgcatctgtaatccttg

SEQ ID NO: 484335 - DNA, 25 bp, Rattus norvegicus
gctgcatctgtaatccttgtgcctc

SEQ ID NO: 484336 - DNA, 25 bp, Rattus norvegicus
cttgtgcctcaattcttcctgagtg

SEQ ID NO: 484337 - DNA, 25 bp, Rattus norvegicus
ttcttcctgagtggcgagggttttc

SEQ ID NO: 484338 - DNA, 25 bp, Rattus norvegicus
cgagggttttcgatttcagcgcttt

SEQ ID NO: 484339 - DNA, 25 bp, Rattus norvegicus
cgatttcagcgctttcggcacagcc

SEQ ID NO: 484340 - DNA, 25 bp, Rattus norvegicus
gtacagggctgttcccgagctgcat

SEQ ID NO: 484341 - DNA, 25 bp, Rattus norvegicus
aagagtactcggtacccgcgactca

SEQ ID NO: 484342 - DNA, 25 bp, Rattus norvegicus
ttgctctccggacggcgcagtcgtc

SEQ ID NO: 484343 - DNA, 25 bp, Rattus norvegicus
cgacccgcagactcaaactttgttg

SEQ ID NO: 484344 - DNA, 25 bp, Rattus norvegicus
ctcggttctccgtgctgcagcggtt

SEQ ID NO: 484345 - DNA, 25 bp, Rattus norvegicus
ggaccctcggttctccgtgctgcag

SEQ ID NO: 484346 - DNA, 25 bp, Rattus norvegicus
ggacggcgcagtcgtcacttcctcg

SEQ ID NO: 484347 - DNA, 25 bp, Rattus norvegicus
aaactttgttgctctccggacggcg

SEQ ID NO: 484348 - DNA, 25 bp, Rattus norvegicus
gactcaaactttgttgctctccgga

SEQ ID NO: 484349 - DNA, 25 bp, Rattus norvegicus
acgctggatccctgggtagctccga

SEQ ID NO: 484350 - DNA, 25 bp, Rattus norvegicus
gcgcgacccgcagactcaaactttg

SEQ ID NO: 484351 - DNA, 25 bp, Rattus norvegicus
agtcgtcacttcctcgccgagcagg

SEQ ID NO: 484352 - DNA, 25 bp, Rattus norvegicus
aggcgagcgcgacccgcagactcaa

SEQ ID NO: 484353 - DNA, 25 bp, Rattus norvegicus
gcgacaccggtcgagatctccgcca

SEQ ID NO: 484354 - DNA, 25 bp, Rattus norvegicus
tcacctgcacgctggatccctgggt

SEQ ID NO: 484355 - DNA, 25 bp, Rattus norvegicus
ccgcgagatctcaaactgacagcca

SEQ ID NO: 484356 - DNA, 25 bp, Rattus norvegicus
tctgtgtttcttcactctcacgaac

SEQ ID NO: 484357 - DNA, 25 bp, Rattus norvegicus
gggaccaaaggaccgcatgcatcta

SEQ ID NO: 484358 - DNA, 25 bp, Rattus norvegicus
cgacaccggcggtatagcttgggac

SEQ ID NO: 484359 - DNA, 25 bp, Rattus norvegicus
tgcatctaaacttcaaaatctcggc

SEQ ID NO: 484360 - DNA, 25 bp, Rattus norvegicus
aatctcggccttaggggaggacacg

SEQ ID NO: 484361 - DNA, 25 bp, Rattus norvegicus
ttctagggctaaggtcgtgcagcca

SEQ ID NO: 484362 - DNA, 25 bp, Rattus norvegicus
cttgcgcactgtggttctagggcta

SEQ ID NO: 484363 - DNA, 25 bp, Rattus norvegicus
gctgttcatcaaatcccgcgagatc

SEQ ID NO: 484364 - DNA, 25 bp, Rattus norvegicus
agccggaccctttgctgttcatcaa

SEQ ID NO: 484365 - DNA, 25 bp, Rattus norvegicus
gggccactgtatccgggcaccggaa

SEQ ID NO: 484366 - DNA, 25 bp, Rattus norvegicus
ctctcacgaaccttggggaccaaag

SEQ ID NO: 484367 - DNA, 25 bp, Rattus norvegicus
gaggaagtttcaagccagggtgacc

SEQ ID NO: 484368 - DNA, 25 bp, Rattus norvegicus
aaaggatcagtcctgcgcttgcgca

SEQ ID NO: 484369 - DNA, 25 bp, Rattus norvegicus
aacgccgaggcctaaatgccggaga

SEQ ID NO: 484370 - DNA, 25 bp, Rattus norvegicus
ccgaggcctaaatgccggagaagcc

SEQ ID NO: 484371 - DNA, 25 bp, Rattus norvegicus
aggagataggtcttcgagttgcacc

SEQ ID NO: 484372 - DNA, 25 bp, Rattus norvegicus
ataggtcttcgagttgcaccagcgg

SEQ ID NO: 484373 - DNA, 25 bp, Rattus norvegicus
cgcgcagccgcaattacaatctatc

SEQ ID NO: 484374 - DNA, 25 bp, Rattus norvegicus
ctatctgaaattcccgcgctcttcg

SEQ ID NO: 484375 - DNA, 25 bp, Rattus norvegicus
gctcttcgtcgccaaggaaaccggc

SEQ ID NO: 484376 - DNA, 25 bp, Rattus norvegicus
aaaccggccgcttggcgcctagtgc

SEQ ID NO: 484377 - DNA, 25 bp, Rattus norvegicus
cgcctagtgctagcctttcggaaca

SEQ ID NO: 484378 - DNA, 25 bp, Rattus norvegicus
gctagcctttcggaacaagagatct

SEQ ID NO: 484379 - DNA, 25 bp, Rattus norvegicus
tctagacacgtcagcggaagggaga

SEQ ID NO: 484380 - DNA, 25 bp, Rattus norvegicus
gtcttcgagttgcaccagcggccac

SEQ ID NO: 484381 - DNA, 25 bp, Rattus norvegicus
tcggaacaagagatctagacacgtc

SEQ ID NO: 484382 - DNA, 25 bp, Rattus norvegicus
agccgcaattacaatctatctgaaa

SEQ ID NO: 484383 - DNA, 25 bp, Rattus norvegicus
cctcagccggaaggcagtgacgtca

SEQ ID NO: 484384 - DNA, 25 bp, Rattus norvegicus
cccagaaagccagagttagcgagtc

SEQ ID NO: 484385 - DNA, 25 bp, Rattus norvegicus
ggggcacgctgtttcttctcttttg

SEQ ID NO: 484386 - DNA, 25 bp, Rattus norvegicus
aggtgagctccaggctagtgctagc

SEQ ID NO: 484387 - DNA, 25 bp, Rattus norvegicus
ctgccctagactggaaggtgagctc

SEQ ID NO: 484388 - DNA, 25 bp, Rattus norvegicus
cggaattcgggactgactgacggac

SEQ ID NO: 484389 - DNA, 25 bp, Rattus norvegicus
aagacgccgagtgtggacggaattc

SEQ ID NO: 484390 - DNA, 25 bp, Rattus norvegicus
ttcctgtcccgctctggagctgctt

SEQ ID NO: 484391 - DNA, 25 bp, Rattus norvegicus
ctcgacctgagtaacaccgtagggc

SEQ ID NO: 484392 - DNA, 25 bp, Rattus norvegicus
agctgcccaagagtcagcacctcga

SEQ ID NO: 484393 - DNA, 25 bp, Rattus norvegicus
acatttcgcggacctgagagccttg

SEQ ID NO: 484394 - DNA, 25 bp, Rattus norvegicus
actgacctggtttcacatttcgcgg

SEQ ID NO: 484395 - DNA, 25 bp, Rattus norvegicus
ttcacccagggctgccggttcctat

SEQ ID NO: 484396 - DNA, 25 bp, Rattus norvegicus
tgacgtcacggctagaatgcactga

SEQ ID NO: 484397 - DNA, 25 bp, Rattus norvegicus
atttccggttctgaagcgccgcaca

SEQ ID NO: 484398 - DNA, 25 bp, Rattus norvegicus
ccttcactgcattagcctcggattg

SEQ ID NO: 484399 - DNA, 25 bp, Rattus norvegicus
gcctcggattggctttcaatcgcta

SEQ ID NO: 484400 - DNA, 25 bp, Rattus norvegicus
caatcgctagtctgttccaatgagg

SEQ ID NO: 484401 - DNA, 25 bp, Rattus norvegicus
ttccaatgaggcaagggcgctttct

SEQ ID NO: 484402 - DNA, 25 bp, Rattus norvegicus
ccggaagcacttttcaggacctatc

SEQ ID NO: 484403 - DNA, 25 bp, Rattus norvegicus
cacagtcatcttcctaactagaggg

SEQ ID NO: 484404 - DNA, 25 bp, Rattus norvegicus
tggagtctttatggcggcccgcatt

SEQ ID NO: 484405 - DNA, 25 bp, Rattus norvegicus
cccatggcaggtttgctctgtgttc

SEQ ID NO: 484406 - DNA, 25 bp, Rattus norvegicus
tggagtaccgcgcaacttgcagcca

SEQ ID NO: 484407 - DNA, 25 bp, Rattus norvegicus
ccactagttgcctgtcggcgatgga

SEQ ID NO: 484408 - DNA, 25 bp, Rattus norvegicus
cgatggacgagctcctcgacagact

SEQ ID NO: 484409 - DNA, 25 bp, Rattus norvegicus
agccgcaaggtgctgctagctacgc

SEQ ID NO: 484410 - DNA, 25 bp, Rattus norvegicus
cctatcagcaagaagtccgggtcgc

SEQ ID NO: 484411 - DNA, 25 bp, Rattus norvegicus
aggcttggaagatccgccggccaga

SEQ ID NO: 484412 - DNA, 25 bp, Rattus norvegicus
caactgcctccctgaaagcgtttgg

SEQ ID NO: 484413 - DNA, 25 bp, Rattus norvegicus
tggtggtttccttagagacggagtc

SEQ ID NO: 484414 - DNA, 25 bp, Rattus norvegicus
ccctgaaagcgtttggcctgggatg

SEQ ID NO: 484415 - DNA, 25 bp, Rattus norvegicus
tgtcctccagggtgcccgcgagaca

SEQ ID NO: 484416 - DNA, 25 bp, Rattus norvegicus
cccgcgagacagaaacgaggatgga

SEQ ID NO: 484417 - DNA, 25 bp, Rattus norvegicus
tttccttagagacggagtcggccca

SEQ ID NO: 484418 - DNA, 25 bp, Rattus norvegicus
agagccgccggcaatggagcctcag

SEQ ID NO: 484419 - DNA, 25 bp, Rattus norvegicus
ctcagcaggcgcgaggcaagtctct

SEQ ID NO: 484420 - DNA, 25 bp, Rattus norvegicus
cgcgaggcaagtctctggaggataa

SEQ ID NO: 484421 - DNA, 25 bp, Rattus norvegicus
tctggaggataagacgccgcagctc

SEQ ID NO: 484422 - DNA, 25 bp, Rattus norvegicus
ctcaacggcgcggaggacgttagcc

SEQ ID NO: 484423 - DNA, 25 bp, Rattus norvegicus
tgacccgcggagactgacagcctca

SEQ ID NO: 484424 - DNA, 25 bp, Rattus norvegicus
ccggccagactggaagcgcttcaag

SEQ ID NO: 484425 - DNA, 25 bp, Rattus norvegicus
tgcacggttgtacgaccggagaaga

SEQ ID NO: 484426 - DNA, 25 bp, Rattus norvegicus
gcagtctacgagctggacacagaga

SEQ ID NO: 484427 - DNA, 25 bp, Rattus norvegicus
gtctacaagtccacgcgctcggcga

SEQ ID NO: 484428 - DNA, 25 bp, Rattus norvegicus
agtctgggcgtcgtctacaagtcca

SEQ ID NO: 484429 - DNA, 25 bp, Rattus norvegicus
gggcggcccacaatccaatgatcca

SEQ ID NO: 484430 - DNA, 25 bp, Rattus norvegicus
cagtagcgacgaaggctgcacggtt

SEQ ID NO: 484431 - DNA, 25 bp, Rattus norvegicus
cgcagtcgaagatggcagaacaagt

SEQ ID NO: 484432 - DNA, 25 bp, Rattus norvegicus
gcagctactgccagccgtttcggcg

SEQ ID NO: 484433 - DNA, 25 bp, Rattus norvegicus
tgcttagcagtgacgcagcagcccg

SEQ ID NO: 484434 - DNA, 25 bp, Rattus norvegicus
agcagtgacgtagccgcgctgctta

SEQ ID NO: 484435 - DNA, 25 bp, Rattus norvegicus
acacagagaaggagcgagacgcaca

SEQ ID NO: 484436 - DNA, 25 bp, Rattus norvegicus
atgcgccgtgacgttctcggcctca

SEQ ID NO: 484437 - DNA, 25 bp, Rattus norvegicus
caggtgtgcaccttcctcttcaaaa

SEQ ID NO: 484438 - DNA, 25 bp, Rattus norvegicus
gggcttactgtgatctgagcagcga

SEQ ID NO: 484439 - DNA, 25 bp, Rattus norvegicus
gggagcaaaagacccgcggcctcag

SEQ ID NO: 484440 - DNA, 25 bp, Rattus norvegicus
ttcacgcaggtcaagggatctcagc

SEQ ID NO: 484441 - DNA, 25 bp, Rattus norvegicus
cgggaggaaaagttcacgcaggtca

SEQ ID NO: 484442 - DNA, 25 bp, Rattus norvegicus
tgcctgccacactgcttgggaaagt

SEQ ID NO: 484443 - DNA, 25 bp, Rattus norvegicus
agcgtccacttgcagccactaggca

SEQ ID NO: 484444 - DNA, 25 bp, Rattus norvegicus
tgtccgatccgcagagcgtccactt

SEQ ID NO: 484445 - DNA, 25 bp, Rattus norvegicus
agggcttcccggcttctacgcacag

SEQ ID NO: 484446 - DNA, 25 bp, Rattus norvegicus
tcctaggcttgaacaaggagcctcc

SEQ ID NO: 484447 - DNA, 25 bp, Rattus norvegicus
agggttcggcatccaggagatccta

SEQ ID NO: 484448 - DNA, 25 bp, Rattus norvegicus
gggaagcgctgagcaagcctaaatc

SEQ ID NO: 484449 - DNA, 25 bp, Rattus norvegicus
gggatctcagcctaggcctaaagtc

SEQ ID NO: 484450 - DNA, 25 bp, Rattus norvegicus
ccttcctggaagtgctgtccgatcc

SEQ ID NO: 484451 - DNA, 25 bp, Rattus norvegicus
cctaaatccgagacagtggccaaga

SEQ ID NO: 484452 - DNA, 25 bp, Rattus norvegicus
cgggcatttgttagctgcgcgctct

SEQ ID NO: 484453 - DNA, 25 bp, Rattus norvegicus
ggtcctcaccgtttgctcggcgctg

SEQ ID NO: 484454 - DNA, 25 bp, Rattus norvegicus
gctcccagaaggtggggtcctcacc

SEQ ID NO: 484455 - DNA, 25 bp, Rattus norvegicus
ccgagagcttcggtggagaccacag

SEQ ID NO: 484456 - DNA, 25 bp, Rattus norvegicus
ctgcgtcgtatgcaggagcctatcc

SEQ ID NO: 484457 - DNA, 25 bp, Rattus norvegicus
ccgctcgcttttcagattccgaaga

SEQ ID NO: 484458 - DNA, 25 bp, Rattus norvegicus
gattccgaagatgtttcctccagtg

SEQ ID NO: 484459 - DNA, 25 bp, Rattus norvegicus
ttcctccagtgaccgaaaaatgtcc

SEQ ID NO: 484460 - DNA, 25 bp, Rattus norvegicus
tccaaatcggctttaaaccagacca

SEQ ID NO: 484461 - DNA, 25 bp, Rattus norvegicus
ccaagaaacgtaagaagcggcgaca

SEQ ID NO: 484462 - DNA, 25 bp, Rattus norvegicus
cggcgacacaggtaagagccacaca

SEQ ID NO: 484463 - DNA, 25 bp, Rattus norvegicus
gagccacacagtcctttcttgttcc

SEQ ID NO: 484464 - DNA, 25 bp, Rattus norvegicus
ccgggtgacccagatgtcgttttct

SEQ ID NO: 484465 - DNA, 25 bp, Rattus norvegicus
cgttttctgcggatcacagatgtga

SEQ ID NO: 484466 - DNA, 25 bp, Rattus norvegicus
cggggcaaagacacctgcgtcgtat

SEQ ID NO: 484467 - DNA, 25 bp, Rattus norvegicus
aagtgacgatctgcgcccactgcgc

SEQ ID NO: 484468 - DNA, 25 bp, Rattus norvegicus
tttttaatgtgctaacgacctaatc

SEQ ID NO: 484469 - DNA, 25 bp, Rattus norvegicus
agcgccagacggcaagcaatttttt

SEQ ID NO: 484470 - DNA, 25 bp, Rattus norvegicus
gataaattacccaggcgctgccgcg

SEQ ID NO: 484471 - DNA, 25 bp, Rattus norvegicus
gaaatcaaattctttgccgtataaa

SEQ ID NO: 484472 - DNA, 25 bp, Rattus norvegicus
cccatatatctgcagattgaaatca

SEQ ID NO: 484473 - DNA, 25 bp, Rattus norvegicus
ggcgcgaagttaaacaggtgtcaaa

SEQ ID NO: 484474 - DNA, 25 bp, Rattus norvegicus
ctaagggttaagctgtcagcggcgc

SEQ ID NO: 484475 - DNA, 25 bp, Rattus norvegicus
cggccctacttcagactatgtctga

SEQ ID NO: 484476 - DNA, 25 bp, Rattus norvegicus
gagccgagcgtccaagccttagctc

SEQ ID NO: 484477 - DNA, 25 bp, Rattus norvegicus
cctaatcaagcaatcaagtcggaga

SEQ ID NO: 484478 - DNA, 25 bp, Rattus norvegicus
ctatgtctgacaagtgacgatctgc

SEQ ID NO: 484479 - DNA, 25 bp, Rattus norvegicus
tggccggccctacttcagactatgt

SEQ ID NO: 484480 - DNA, 25 bp, Rattus norvegicus
ccggtgcccaggcagctaagggtta

SEQ ID NO: 484481 - DNA, 25 bp, Rattus norvegicus
ctgctcgggcgcgttggttgctccc

SEQ ID NO: 484482 - DNA, 25 bp, Rattus norvegicus
cgaccacagagacgctgtggataga

SEQ ID NO: 484483 - DNA, 25 bp, Rattus norvegicus
ttccagcgaccacagagacgctgtg

SEQ ID NO: 484484 - DNA, 25 bp, Rattus norvegicus
ggcgtggttccagcgaccacagaga

SEQ ID NO: 484485 - DNA, 25 bp, Rattus norvegicus
gtagagtccgcagagctccgggccc

SEQ ID NO: 484486 - DNA, 25 bp, Rattus norvegicus
cccgggtagagtccgcagagctccg

SEQ ID NO: 484487 - DNA, 25 bp, Rattus norvegicus
tgagcaacaagacaaccgagaaagc

SEQ ID NO: 484488 - DNA, 25 bp, Rattus norvegicus
cctgggatgtgagcaacaagacaac

SEQ ID NO: 484489 - DNA, 25 bp, Rattus norvegicus
ggccgtcctcagtagccctgctcac

SEQ ID NO: 484490 - DNA, 25 bp, Rattus norvegicus
tcacctggcactagctcgggccgtg

SEQ ID NO: 484491 - DNA, 25 bp, Rattus norvegicus
tcccgggaccgccatgacctgggat

SEQ ID NO: 484492 - DNA, 25 bp, Rattus norvegicus
accgccatgacctgggatgtgagca

SEQ ID NO: 484493 - DNA, 25 bp, Rattus norvegicus
ccatgacctgggatgtgagcaacaa

SEQ ID NO: 484494 - DNA, 25 bp, Rattus norvegicus
caagacaaccgagaaagcccggtgt

SEQ ID NO: 484495 - DNA, 25 bp, Rattus norvegicus
caagaaacgagaactggcgcaggcc

SEQ ID NO: 484496 - DNA, 25 bp, Rattus norvegicus
ggggagcagaagacccattgcttca

SEQ ID NO: 484497 - DNA, 25 bp, Rattus norvegicus
ggccacagccttcgggactagggaa

SEQ ID NO: 484498 - DNA, 25 bp, Rattus norvegicus
cccacacaagtaggcaactggttta

SEQ ID NO: 484499 - DNA, 25 bp, Rattus norvegicus
ctgtaccacatcctggagaatcaca

SEQ ID NO: 484500 - DNA, 25 bp, Rattus norvegicus
ggaatggtacctgcaggatccctac

SEQ ID NO: 484501 - DNA, 25 bp, Rattus norvegicus
gcgaggccatcaacaaacacgagtc

SEQ ID NO: 484502 - DNA, 25 bp, Rattus norvegicus
ggcaacttccgagacctgtaccaca

SEQ ID NO: 484503 - DNA, 25 bp, Rattus norvegicus
caagttcaccaaggagtctcacggc

SEQ ID NO: 484504 - DNA, 25 bp, Rattus norvegicus
gtctcacggcaagctgcaggccatg

SEQ ID NO: 484505 - DNA, 25 bp, Rattus norvegicus
gcactaccaggaggccgagaagctg

SEQ ID NO: 484506 - DNA, 25 bp, Rattus norvegicus
accgcgtgcgcaagaagttccctct

SEQ ID NO: 484507 - DNA, 25 bp, Rattus norvegicus
cattgcttcaaggagcggactcgga

SEQ ID NO: 484508 - DNA, 25 bp, Rattus norvegicus
aaacacgagtcgatcctgcgcgcgc

SEQ ID NO: 484509 - DNA, 25 bp, Rattus norvegicus
cccgcattctggctctgccgcgctc

SEQ ID NO: 484510 - DNA, 25 bp, Rattus norvegicus
tgtcgccaccgctgcttcagcaccg

SEQ ID NO: 484511 - DNA, 25 bp, Rattus norvegicus
agacggctccttacctgtcgctctg

SEQ ID NO: 484512 - DNA, 25 bp, Rattus norvegicus
ctgcctctcgcctccgtgctccctt

SEQ ID NO: 484513 - DNA, 25 bp, Rattus norvegicus
gtggagcttccaggagagctccctg

SEQ ID NO: 484514 - DNA, 25 bp, Rattus norvegicus
ggctccttacctgtcgctctgcgga

SEQ ID NO: 484515 - DNA, 25 bp, Rattus norvegicus
ccaccaggcactccggacccagctc

SEQ ID NO: 484516 - DNA, 25 bp, Rattus norvegicus
ctcacggccgcggtggagcttccag

SEQ ID NO: 484517 - DNA, 25 bp, Rattus norvegicus
cgctccagaatcagcccaccaggca

SEQ ID NO: 484518 - DNA, 25 bp, Rattus norvegicus
gcgcgcagctggaaccggcttttct

SEQ ID NO: 484519 - DNA, 25 bp, Rattus norvegicus
aaccggcttttctgcttcctggagc

SEQ ID NO: 484520 - DNA, 25 bp, Rattus norvegicus
tttctgcttcctggagccaaaccct

SEQ ID NO: 484521 - DNA, 25 bp, Rattus norvegicus
tgtcgcgcaccccagaagcgatgcg

SEQ ID NO: 484522 - DNA, 25 bp, Rattus norvegicus
gtgctcccttccacgctccagaatc

SEQ ID NO: 484523 - DNA, 25 bp, Rattus norvegicus
ggatctcatctcaggagagacgcga

SEQ ID NO: 484524 - DNA, 25 bp, Rattus norvegicus
ccggtgtacaaatagtcagtgggga

SEQ ID NO: 484525 - DNA, 25 bp, Rattus norvegicus
gatgcctcaggctttccccggtgta

SEQ ID NO: 484526 - DNA, 25 bp, Rattus norvegicus
cgaaaagcgcaacaaaaccttctcg

SEQ ID NO: 484527 - DNA, 25 bp, Rattus norvegicus
acggccagggctccgcggaactctg

SEQ ID NO: 484528 - DNA, 25 bp, Rattus norvegicus
cagatgaggacacggccagggctcc

SEQ ID NO: 484529 - DNA, 25 bp, Rattus norvegicus
ctgtgaagaagaacggagcggaacc

SEQ ID NO: 484530 - DNA, 25 bp, Rattus norvegicus
ctgaaagactgtgaagaagaacgga

SEQ ID NO: 484531 - DNA, 25 bp, Rattus norvegicus
ttctgtgtctgaaagactgtgaaga

SEQ ID NO: 484532 - DNA, 25 bp, Rattus norvegicus
tgtcagttctgtgtctgaaagactg

SEQ ID NO: 484533 - DNA, 25 bp, Rattus norvegicus
cgggtgttgtcagttctgtgtctga

SEQ ID NO: 484534 - DNA, 25 bp, Rattus norvegicus
acgcgaggccactagatgaaagagg

SEQ ID NO: 484535 - DNA, 25 bp, Rattus norvegicus
agacgcgaggccactagatgaaaga

SEQ ID NO: 484536 - DNA, 25 bp, Rattus norvegicus
atctcaggagagacgcgaggccact

SEQ ID NO: 484537 - DNA, 25 bp, Rattus norvegicus
gcgccagggaaggtacctaacgtca

SEQ ID NO: 484538 - DNA, 25 bp, Rattus norvegicus
gcccgacagtcacaagataaacttg

SEQ ID NO: 484539 - DNA, 25 bp, Rattus norvegicus
tgtgaccagtaaccagcgaagaccc

SEQ ID NO: 484540 - DNA, 25 bp, Rattus norvegicus
cgcctagcctacagcttatccttta

SEQ ID NO: 484541 - DNA, 25 bp, Rattus norvegicus
gggcatccagagaaccctcactctt

SEQ ID NO: 484542 - DNA, 25 bp, Rattus norvegicus
ggaagcattctctgccaatcaaaac

SEQ ID NO: 484543 - DNA, 25 bp, Rattus norvegicus
tcgttatacccaataggcacgcttg

SEQ ID NO: 484544 - DNA, 25 bp, Rattus norvegicus
cctcacagacagctgcgtccaggta

SEQ ID NO: 484545 - DNA, 25 bp, Rattus norvegicus
tcctgggcatgaacgctgtgcaatc

SEQ ID NO: 484546 - DNA, 25 bp, Rattus norvegicus
tgagggtcatcaggtgccacttttg

SEQ ID NO: 484547 - DNA, 25 bp, Rattus norvegicus
atttagaccatgctaggggcggagc

SEQ ID NO: 484548 - DNA, 25 bp, Rattus norvegicus
cttgtccctaactgctgaggcgttc

SEQ ID NO: 484549 - DNA, 25 bp, Rattus norvegicus
cagggctcaccgcagtccttgaagt

SEQ ID NO: 484550 - DNA, 25 bp, Rattus norvegicus
tgacccgctgggaaacaacgtcctc

SEQ ID NO: 484551 - DNA, 25 bp, Rattus norvegicus
tcgggctctcggaacagactgtaca

SEQ ID NO: 484552 - DNA, 25 bp, Rattus norvegicus
gcacaagagcctaacgtcggggttc

SEQ ID NO: 484553 - DNA, 25 bp, Rattus norvegicus
actttctgaaagctggtcccgagcc

SEQ ID NO: 484554 - DNA, 25 bp, Rattus norvegicus
cctcgggatggtttctctacattac

SEQ ID NO: 484555 - DNA, 25 bp, Rattus norvegicus
ccactaaaggcatgaccgtccagta

SEQ ID NO: 484556 - DNA, 25 bp, Rattus norvegicus
tggcccggctgattccactcagagg

SEQ ID NO: 484557 - DNA, 25 bp, Rattus norvegicus
cggggcgccacaaccgattggcatc

SEQ ID NO: 484558 - DNA, 25 bp, Rattus norvegicus
atcccggctagctggttcgtatctc

SEQ ID NO: 484559 - DNA, 25 bp, Rattus norvegicus
acggaatccctttgggcatgacttg

SEQ ID NO: 484560 - DNA, 25 bp, Rattus norvegicus
cccatcaagagagccaggacaagtg

SEQ ID NO: 484561 - DNA, 25 bp, Rattus norvegicus
aacgcgccctttggatgcgtccgga

SEQ ID NO: 484562 - DNA, 25 bp, Rattus norvegicus
gaggtgctctccatcgttcgctcca

SEQ ID NO: 484563 - DNA, 25 bp, Rattus norvegicus
ccgtctaggggacctctgaaacaga

SEQ ID NO: 484564 - DNA, 25 bp, Rattus norvegicus
gggattgcttctccgagtctggaca

SEQ ID NO: 484565 - DNA, 25 bp, Rattus norvegicus
cttcgccagcgttaagagccggctc

SEQ ID NO: 484566 - DNA, 25 bp, Rattus norvegicus
attccggaagaaacaggagtgcgtc

SEQ ID NO: 484567 - DNA, 25 bp, Rattus norvegicus
ccggaaagagcttgtagatgacgta

SEQ ID NO: 484568 - DNA, 25 bp, Rattus norvegicus
tgacgtaaagtgtcgcgctgtgaac

SEQ ID NO: 484569 - DNA, 25 bp, Rattus norvegicus
tggcctttgccggaaagagcttgta

SEQ ID NO: 484570 - DNA, 25 bp, Rattus norvegicus
agagccggctccgagcttttccgtt

SEQ ID NO: 484571 - DNA, 25 bp, Rattus norvegicus
agtagccgcttcatccagcacaaaa

SEQ ID NO: 484572 - DNA, 25 bp, Rattus norvegicus
ggtccgaggaagtagccgcttcatc

SEQ ID NO: 484573 - DNA, 25 bp, Rattus norvegicus
gaaacgttacccgaactggagctgc

SEQ ID NO: 484574 - DNA, 25 bp, Rattus norvegicus
agagtcggctggactctgcctccgg

SEQ ID NO: 484575 - DNA, 25 bp, Rattus norvegicus
tctgttgcctgagagtcggctggac

SEQ ID NO: 484576 - DNA, 25 bp, Rattus norvegicus
gccttagcaactctgttgcctgaga

SEQ ID NO: 484577 - DNA, 25 bp, Rattus norvegicus
ccagtgtagatcttcgccagcgtta

SEQ ID NO: 484578 - DNA, 25 bp, Rattus norvegicus
cgcgctgtgaacgattccggaagaa

SEQ ID NO: 484579 - DNA, 25 bp, Rattus norvegicus
tctcctctcggtgctactgcgcatg

SEQ ID NO: 484580 - DNA, 25 bp, Rattus norvegicus
taccgcttacattttccgaacctga

SEQ ID NO: 484581 - DNA, 25 bp, Rattus norvegicus
agcaaatgcagtgcgtgctccagcc

SEQ ID NO: 484582 - DNA, 25 bp, Rattus norvegicus
tatctggcctttgttctcctctcgg

SEQ ID NO: 484583 - DNA, 25 bp, Rattus norvegicus
ggctacggagactggcagccgccac

SEQ ID NO: 484584 - DNA, 25 bp, Rattus norvegicus
cgcatgcgtagttgcttcagcactg

SEQ ID NO: 484585 - DNA, 25 bp, Rattus norvegicus
gcggcctgtaggcaccgcgagttcc

SEQ ID NO: 484586 - DNA, 25 bp, Rattus norvegicus
ctggaggtcggttgcaacgagtaac

SEQ ID NO: 484587 - DNA, 25 bp, Rattus norvegicus
cccgcgccttcatttctgatatgta

SEQ ID NO: 484588 - DNA, 25 bp, Rattus norvegicus
atgtacccgaattggggccggtatg

SEQ ID NO: 484589 - DNA, 25 bp, Rattus norvegicus
tatggcgggagcagccactatccgc

SEQ ID NO: 484590 - DNA, 25 bp, Rattus norvegicus
cgggcttcatgagcttccgagagca

SEQ ID NO: 484591 - DNA, 25 bp, Rattus norvegicus
ttccgagagcaacacttggcgcagc

SEQ ID NO: 484592 - DNA, 25 bp, Rattus norvegicus
cggcaacagcgagtacccgcgcaaa

SEQ ID NO: 484593 - DNA, 25 bp, Rattus norvegicus
gcgggatggttgtcctcgaagaata

SEQ ID NO: 484594 - DNA, 25 bp, Rattus norvegicus
agcccgctcttagagccacagattc

SEQ ID NO: 484595 - DNA, 25 bp, Rattus norvegicus
cccagcgctgggaccgctaatgata

SEQ ID NO: 484596 - DNA, 25 bp, Rattus norvegicus
gctaatgatactagcccggctcacc

SEQ ID NO: 484597 - DNA, 25 bp, Rattus norvegicus
cacggttagtggttcactccgaaca

SEQ ID NO: 484598 - DNA, 25 bp, Rattus norvegicus
ggccggcctcacttccggttgttgc

SEQ ID NO: 484599 - DNA, 25 bp, Rattus norvegicus
ttgccgggccctatatccggtgtcc

SEQ ID NO: 484600 - DNA, 25 bp, Rattus norvegicus
tctgccttccagaaggtacggtctg

SEQ ID NO: 484601 - DNA, 25 bp, Rattus norvegicus
ccgcagcgacattgagttagagtta

SEQ ID NO: 484602 - DNA, 25 bp, Rattus norvegicus
tagagttaatagaggaggtacggcc

SEQ ID NO: 484603 - DNA, 25 bp, Rattus norvegicus
gaatactaacccaagctagcccgct

SEQ ID NO: 484604 - DNA, 25 bp, Rattus norvegicus
aggttgacatagtttagccgactcg

SEQ ID NO: 484605 - DNA, 25 bp, Rattus norvegicus
tcaaaaccagcgcttgtcagtctcg

SEQ ID NO: 484606 - DNA, 25 bp, Rattus norvegicus
tgtctcctccaggtttcaaaaccag

SEQ ID NO: 484607 - DNA, 25 bp, Rattus norvegicus
tggttttcaaggctgtgcatggggc

SEQ ID NO: 484608 - DNA, 25 bp, Rattus norvegicus
taggcgttagcttgccccggggtca

SEQ ID NO: 484609 - DNA, 25 bp, Rattus norvegicus
ccctggaagctaggcgttagcttgc

SEQ ID NO: 484610 - DNA, 25 bp, Rattus norvegicus
tgcagatctctaggcccctggaagc

SEQ ID NO: 484611 - DNA, 25 bp, Rattus norvegicus
ggtgcagatctctaggcccctggaa

SEQ ID NO: 484612 - DNA, 25 bp, Rattus norvegicus
ccgcagggcgccgaaggggcgctgc

SEQ ID NO: 484613 - DNA, 25 bp, Rattus norvegicus
ggccgctggttttcaaggctgtgca

SEQ ID NO: 484614 - DNA, 25 bp, Rattus norvegicus
gccgctggttttcaaggctgtgcat

SEQ ID NO: 484615 - DNA, 25 bp, Rattus norvegicus
cgctggttttcaaggctgtgcatgg

SEQ ID NO: 484616 - DNA, 25 bp, Rattus norvegicus
ttttcaaggctgtgcatggggcggg

SEQ ID NO: 484617 - DNA, 25 bp, Rattus norvegicus
cagctcggagcgctgagagctcggt

SEQ ID NO: 484618 - DNA, 25 bp, Rattus norvegicus
gagagctcggttggcggtgagacct

SEQ ID NO: 484619 - DNA, 25 bp, Rattus norvegicus
tgagacctgagtgcgcgtgaccccc

SEQ ID NO: 484620 - DNA, 25 bp, Rattus norvegicus
ccgctggttttcaaggctgtgcatg

SEQ ID NO: 484621 - DNA, 25 bp, Rattus norvegicus
cctcgaaggagcatgaaattgtatc

SEQ ID NO: 484622 - DNA, 25 bp, Rattus norvegicus
cggctcggcgttaacaactgtctgc

SEQ ID NO: 484623 - DNA, 25 bp, Rattus norvegicus
gttaacaactgtctgcccaccagtc

SEQ ID NO: 484624 - DNA, 25 bp, Rattus norvegicus
ccagtctccttcctggggcgttgag

SEQ ID NO: 484625 - DNA, 25 bp, Rattus norvegicus
agtctccttcctggggcgttgagca

SEQ ID NO: 484626 - DNA, 25 bp, Rattus norvegicus
ttctcctcgaaggagcatgaaattg

SEQ ID NO: 484627 - DNA, 25 bp, Rattus norvegicus
ggagcatgaaattgtatcccaacga

SEQ ID NO: 484628 - DNA, 25 bp, Rattus norvegicus
attgtatcccaacgacagtgcagtg

SEQ ID NO: 484629 - DNA, 25 bp, Rattus norvegicus
tatcccaacgacagtgcagtggccg

SEQ ID NO: 484630 - DNA, 25 bp, Rattus norvegicus
acgacagtgcagtggccgccatcca

SEQ ID NO: 484631 - DNA, 25 bp, Rattus norvegicus
agtggccgccatccaggggaacgcc

SEQ ID NO: 484632 - DNA, 25 bp, Rattus norvegicus
cttttgcatgtttgcccggctcctc

SEQ ID NO: 484633 - DNA, 25 bp, Rattus norvegicus
ggctcctctctagcctctagccgcg

SEQ ID NO: 484634 - DNA, 25 bp, Rattus norvegicus
aggggatgacccctcgcagttctcc

SEQ ID NO: 484635 - DNA, 25 bp, Rattus norvegicus
cccggaagtgaaactggtctggcag

SEQ ID NO: 484636 - DNA, 25 bp, Rattus norvegicus
tttctgattggcctcagcagagtga

SEQ ID NO: 484637 - DNA, 25 bp, Rattus norvegicus
ggcttctgcaagtccagggactgta

SEQ ID NO: 484638 - DNA, 25 bp, Rattus norvegicus
gaccaccactggaacaacgccggtg

SEQ ID NO: 484639 - DNA, 25 bp, Rattus norvegicus
ggcgcagactcccaagaggacactt

SEQ ID NO: 484640 - DNA, 25 bp, Rattus norvegicus
gctccactgtaacacgtttctgatt

SEQ ID NO: 484641 - DNA, 25 bp, Rattus norvegicus
ggcgggcttacaacttctcaaactc

SEQ ID NO: 484642 - DNA, 25 bp, Rattus norvegicus
actcaattatgcttcaccgagcgga

SEQ ID NO: 484643 - DNA, 25 bp, Rattus norvegicus
caccgagcggaagttgacctctctc

SEQ ID NO: 484644 - DNA, 25 bp, Rattus norvegicus
tggtctggcagttgaggcttctgca

SEQ ID NO: 484645 - DNA, 25 bp, Rattus norvegicus
gttgtccgagaggatcgagagcttc

SEQ ID NO: 484646 - DNA, 25 bp, Rattus norvegicus
ttcgtggaaactctgaagcgaggtg

SEQ ID NO: 484647 - DNA, 25 bp, Rattus norvegicus
ggctcatcacggaccaccactggaa

SEQ ID NO: 484648 - DNA, 25 bp, Rattus norvegicus
agaggacacttccagccgtcacttc

SEQ ID NO: 484649 - DNA, 25 bp, Rattus norvegicus
ttcgctccagagcatgcgcttccga

SEQ ID NO: 484650 - DNA, 25 bp, Rattus norvegicus
ggaccatatttcaccacgtgctttc

SEQ ID NO: 484651 - DNA, 25 bp, Rattus norvegicus
agccggcttctgcacgacgtctcag

SEQ ID NO: 484652 - DNA, 25 bp, Rattus norvegicus
gagacgccgcgagccggcttctgca

SEQ ID NO: 484653 - DNA, 25 bp, Rattus norvegicus
agagcatgcgcttccgagacgccgc

SEQ ID NO: 484654 - DNA, 25 bp, Rattus norvegicus
tccaacgtccggtgttcgctccaga

SEQ ID NO: 484655 - DNA, 25 bp, Rattus norvegicus
agacaagctcttaggaccatatttc

SEQ ID NO: 484656 - DNA, 25 bp, Rattus norvegicus
tgctcctgtaaagttagacaagctc

SEQ ID NO: 484657 - DNA, 25 bp, Rattus norvegicus
ggccgtcaccactgctcctgtaaag

SEQ ID NO: 484658 - DNA, 25 bp, Rattus norvegicus
aagacagtccgggttcccgtgcagg

SEQ ID NO: 484659 - DNA, 25 bp, Rattus norvegicus
tgtagggtcaagacagtccgggttc

SEQ ID NO: 484660 - DNA, 25 bp, Rattus norvegicus
ctgcacgacgtctcagtgcgcaggc

SEQ ID NO: 484661 - DNA, 25 bp, Rattus norvegicus
acaccgcagttgtagggtcaagaca

SEQ ID NO: 484662 - DNA, 25 bp, Rattus norvegicus
gaatctcctccatcaattctcacgg

SEQ ID NO: 484663 - DNA, 25 bp, Rattus norvegicus
ggcacttctatcctctcggtaacct

SEQ ID NO: 484664 - DNA, 25 bp, Rattus norvegicus
cctctcggtaacctccagcgactcg

SEQ ID NO: 484665 - DNA, 25 bp, Rattus norvegicus
gcgaagtgcaatcgaggtggctagg

SEQ ID NO: 484666 - DNA, 25 bp, Rattus norvegicus
cggaccaccgagtgagggcgggcat

SEQ ID NO: 484667 - DNA, 25 bp, Rattus norvegicus
gggcgggcatggctctcttgttccc

SEQ ID NO: 484668 - DNA, 25 bp, Rattus norvegicus
cccgcaggctccagcaccaggccat

SEQ ID NO: 484669 - DNA, 25 bp, Rattus norvegicus
cagcaccaggccatcgggccgagcg

SEQ ID NO: 484670 - DNA, 25 bp, Rattus norvegicus
acgcacggctcagcagagtcaccgt

SEQ ID NO: 484671 - DNA, 25 bp, Rattus norvegicus
tcagcagagtcaccgtccacggcag

SEQ ID NO: 484672 - DNA, 25 bp, Rattus norvegicus
agagtcaccgtccacggcagccagt

SEQ ID NO: 484673 - DNA, 25 bp, Rattus norvegicus
gcagccagtccgaccaccagtgtgt

SEQ ID NO: 484674 - DNA, 25 bp, Rattus norvegicus
tccagcctgacggagcgcgcggaca

SEQ ID NO: 484675 - DNA, 25 bp, Rattus norvegicus
agcgcgcggacactggcacttctat

SEQ ID NO: 484676 - DNA, 25 bp, Rattus norvegicus
cactggcacttctatcctctcggta

SEQ ID NO: 484677 - DNA, 25 bp, Rattus norvegicus
agacacgcgcccgacaccgagcctc

SEQ ID NO: 484678 - DNA, 25 bp, Rattus norvegicus
gcctcgcgtctctcctgagatgaga

SEQ ID NO: 484679 - DNA, 25 bp, Rattus norvegicus
tcgcgtctctcctgagatgagatcc

SEQ ID NO: 484680 - DNA, 25 bp, Rattus norvegicus
tcagacacagaactgacaacacccg

SEQ ID NO: 484681 - DNA, 25 bp, Rattus norvegicus
tcacagtctttcagacacagaactg

SEQ ID NO: 484682 - DNA, 25 bp, Rattus norvegicus
ccgttcttcttcacagtctttcaga

SEQ ID NO: 484683 - DNA, 25 bp, Rattus norvegicus
ggttccgctccgttcttcttcacag

SEQ ID NO: 484684 - DNA, 25 bp, Rattus norvegicus
agccacgctggaccgaccgaggccc

SEQ ID NO: 484685 - DNA, 25 bp, Rattus norvegicus
ggagccctggccgtgtcctcatctg

SEQ ID NO: 484686 - DNA, 25 bp, Rattus norvegicus
ctctttcatctagtggcctcgcgtc

SEQ ID NO: 484687 - DNA, 25 bp, Rattus norvegicus
cagagttccgcggagccctggccgt

SEQ ID NO: 484688 - DNA, 25 bp, Rattus norvegicus
cgagaaggttttgttgcgcttttcg

SEQ ID NO: 484689 - DNA, 25 bp, Rattus norvegicus
acaccggggaaagcctgaggcatcc

SEQ ID NO: 484690 - DNA, 25 bp, Rattus norvegicus
ccactgactatttgtacaccgggga

SEQ ID NO: 484691 - DNA, 25 bp, Rattus norvegicus
ttccatctacccgtgaactctcgga

SEQ ID NO: 484692 - DNA, 25 bp, Rattus norvegicus
ggcctgcgcacccacctcaaggtgc

SEQ ID NO: 484693 - DNA, 25 bp, Rattus norvegicus
tacgagatcaccgaccagtctgggg

SEQ ID NO: 484694 - DNA, 25 bp, Rattus norvegicus
ttacgggcgcgtacgagatcaccga

SEQ ID NO: 484695 - DNA, 25 bp, Rattus norvegicus
acaaagacttgctggttacgggcgc

SEQ ID NO: 484696 - DNA, 25 bp, Rattus norvegicus
cgaggagatccacaaagacttgctg

SEQ ID NO: 484697 - DNA, 25 bp, Rattus norvegicus
tcggaagtgtctccgcgaggagatc

SEQ ID NO: 484698 - DNA, 25 bp, Rattus norvegicus
cctcgccaggttagaggcgagtcac

SEQ ID NO: 484699 - DNA, 25 bp, Rattus norvegicus
acccgtgaactctcggaagtgtctc

SEQ ID NO: 484700 - DNA, 25 bp, Rattus norvegicus
tagaggcgagtcacgtgggtttccc

SEQ ID NO: 484701 - DNA, 25 bp, Rattus norvegicus
caccatgtctggtttgtctggccca

SEQ ID NO: 484702 - DNA, 25 bp, Rattus norvegicus
tgtctggcccactatcctggcctgg

SEQ ID NO: 484703 - DNA, 25 bp, Rattus norvegicus
tcctatccgccttgctctttctgtt

SEQ ID NO: 484704 - DNA, 25 bp, Rattus norvegicus
ggtcctcggcatctccttccatcta

SEQ ID NO: 484705 - DNA, 25 bp, Rattus norvegicus
tggaatcgcagtgtcgctcatactc

SEQ ID NO: 484706 - DNA, 25 bp, Rattus norvegicus
gtgactcgcttagttcgccgtgata

SEQ ID NO: 484707 - DNA, 25 bp, Rattus norvegicus
tcgccgtgatagcagtgatcaaacc

SEQ ID NO: 484708 - DNA, 25 bp, Rattus norvegicus
tggggcccgagacataagcctcagg

SEQ ID NO: 484709 - DNA, 25 bp, Rattus norvegicus
agggctccgagcaagcagtgctaga

SEQ ID NO: 484710 - DNA, 25 bp, Rattus norvegicus
cgcttccgaagtccgagttgatgga

SEQ ID NO: 484711 - DNA, 25 bp, Rattus norvegicus
tcatactcgcccagcacggacatgg

SEQ ID NO: 484712 - DNA, 25 bp, Rattus norvegicus
taagccaccggcttaggcaacactg

SEQ ID NO: 484713 - DNA, 25 bp, Rattus norvegicus
cacccggaagcagttctcggtattt

SEQ ID NO: 484714 - DNA, 25 bp, Rattus norvegicus
ccacttgttacaaatgagtcccgta

SEQ ID NO: 484715 - DNA, 25 bp, Rattus norvegicus
cccgtacactctaaggcatcgctga

SEQ ID NO: 484716 - DNA, 25 bp, Rattus norvegicus
gcatcgctgactttggcacctgtga

SEQ ID NO: 484717 - DNA, 25 bp, Rattus norvegicus
cgaaaattcaaaagaccgctcagtg

SEQ ID NO: 484718 - DNA, 25 bp, Rattus norvegicus
tagcgcctcactggcctcagacgta

SEQ ID NO: 484719 - DNA, 25 bp, Rattus norvegicus
gttatagcacgattttcgagacttc

SEQ ID NO: 484720 - DNA, 25 bp, Rattus norvegicus
tctagacgctaggttcgccaatgcc

SEQ ID NO: 484721 - DNA, 25 bp, Rattus norvegicus
taggtctctagacgctaggttcgcc

SEQ ID NO: 484722 - DNA, 25 bp, Rattus norvegicus
aagagccctaggtctctagacgcta

SEQ ID NO: 484723 - DNA, 25 bp, Rattus norvegicus
gtcgaaagagccctaggtctctaga

SEQ ID NO: 484724 - DNA, 25 bp, Rattus norvegicus
cgaagtcgaaagagccctaggtctc

SEQ ID NO: 484725 - DNA, 25 bp, Rattus norvegicus
agcccgaagtcgaaagagccctagg

SEQ ID NO: 484726 - DNA, 25 bp, Rattus norvegicus
gatgacagcccgaagtcgaaagagc

SEQ ID NO: 484727 - DNA, 25 bp, Rattus norvegicus
accctgatgacagcccgaagtcgaa

SEQ ID NO: 484728 - DNA, 25 bp, Rattus norvegicus
gacacaaaaccctgatgacagcccg

SEQ ID NO: 484729 - DNA, 25 bp, Rattus norvegicus
gagacttcacagacacaaaaccctg

SEQ ID NO: 484730 - DNA, 25 bp, Rattus norvegicus
cgattttcgagacttcacagacaca

SEQ ID NO: 484731 - DNA, 25 bp, Rattus norvegicus
gctaggttcgccaatgcctctctgc

SEQ ID NO: 484732 - DNA, 25 bp, Rattus norvegicus
agcacgattttcgagacttcacaga

SEQ ID NO: 484733 - DNA, 25 bp, Rattus norvegicus
aaatcgcctagctcccgggtgcggc

SEQ ID NO: 484734 - DNA, 25 bp, Rattus norvegicus
gcggcgctgtgttgctgtaaacagc

SEQ ID NO: 484735 - DNA, 25 bp, Rattus norvegicus
cccaacccgagggtgatgtcagtcg

SEQ ID NO: 484736 - DNA, 25 bp, Rattus norvegicus
caacccgagggtgatgtcagtcggc

SEQ ID NO: 484737 - DNA, 25 bp, Rattus norvegicus
cctggccagggaggccacggctctt

SEQ ID NO: 484738 - DNA, 25 bp, Rattus norvegicus
cctggatgggcggaccgtgagcccg

SEQ ID NO: 484739 - DNA, 25 bp, Rattus norvegicus
ctgtgttgctgtaaacagccgcttc

SEQ ID NO: 484740 - DNA, 25 bp, Rattus norvegicus
gttgctgtaaacagccgcttcgctg

SEQ ID NO: 484741 - DNA, 25 bp, Rattus norvegicus
agccgcttcgctgttactatctata

SEQ ID NO: 484742 - DNA, 25 bp, Rattus norvegicus
cgcttcgctgttactatctatagca

SEQ ID NO: 484743 - DNA, 25 bp, Rattus norvegicus
cgctgttactatctatagcaaaatc

SEQ ID NO: 484744 - DNA, 25 bp, Rattus norvegicus
tagcaaaatcgcctagctcccgggt

SEQ ID NO: 484745 - DNA, 25 bp, Rattus norvegicus
caaaatcgcctagctcccgggtgcg

SEQ ID NO: 484746 - DNA, 25 bp, Rattus norvegicus
actatctatagcaaaatcgcctagc

SEQ ID NO: 484747 - DNA, 25 bp, Rattus norvegicus
tgtttctgagatcagccggggccaa

SEQ ID NO: 484748 - DNA, 25 bp, Rattus norvegicus
ccggggccaacaagtctctagcaaa

SEQ ID NO: 484749 - DNA, 25 bp, Rattus norvegicus
cgcggcaggtttactctgagtgtcc

SEQ ID NO: 484750 - DNA, 25 bp, Rattus norvegicus
tctgagcgcgtgcacacttgtcata

SEQ ID NO: 484751 - DNA, 25 bp, Rattus norvegicus
cttccttgtttgctccggagggaga

SEQ ID NO: 484752 - DNA, 25 bp, Rattus norvegicus
gggacagcctttcctactaccattc

SEQ ID NO: 484753 - DNA, 25 bp, Rattus norvegicus
aggcgtcatcctcccgctgcagtag

SEQ ID NO: 484754 - DNA, 25 bp, Rattus norvegicus
ccatgatgttctcgggtttcaacgc

SEQ ID NO: 484755 - DNA, 25 bp, Rattus norvegicus
ctttgcccaaaccacgaccatgatg

SEQ ID NO: 484756 - DNA, 25 bp, Rattus norvegicus
actccaaccgcgattgcagctagca

SEQ ID NO: 484757 - DNA, 25 bp, Rattus norvegicus
ccgctcatgacgtagtaagccattc

SEQ ID NO: 484758 - DNA, 25 bp, Rattus norvegicus
gagaccttctaagatcccaattgtg

SEQ ID NO: 484759 - DNA, 25 bp, Rattus norvegicus
ccgaaatcctacatgcggagggtcc

SEQ ID NO: 484760 - DNA, 25 bp, Rattus norvegicus
tcaacgcggactacgaggcgtcatc

SEQ ID NO: 484761 - DNA, 25 bp, Rattus norvegicus
cagagcgccccatccttacggactc

SEQ ID NO: 484762 - DNA, 25 bp, Rattus norvegicus
caaagtagagcaggtgagtagcgat

SEQ ID NO: 484763 - DNA, 25 bp, Rattus norvegicus
gtggccccatcgcagaccagagcgc

SEQ ID NO: 484764 - DNA, 25 bp, Rattus norvegicus
agcgggagtggtgaagaccatgtca

SEQ ID NO: 484765 - DNA, 25 bp, Rattus norvegicus
cgtcgaccggggcttacgccagagc

SEQ ID NO: 484766 - DNA, 25 bp, Rattus norvegicus
gaccggggcttacgccagagcggga

SEQ ID NO: 484767 - DNA, 25 bp, Rattus norvegicus
ccagagcgggagtggtgaagaccat

SEQ ID NO: 484768 - DNA, 25 bp, Rattus norvegicus
accatgtcaggcggcagagcgcaga

SEQ ID NO: 484769 - DNA, 25 bp, Rattus norvegicus
aggtgagtagcgattctggacctgc

SEQ ID NO: 484770 - DNA, 25 bp, Rattus norvegicus
gcagagcgcagagcatcggcagaag

SEQ ID NO: 484771 - DNA, 25 bp, Rattus norvegicus
gcagagcatcggcagaaggggcaaa

SEQ ID NO: 484772 - DNA, 25 bp, Rattus norvegicus
gcatcggcagaaggggcaaagtaga

SEQ ID NO: 484773 - DNA, 25 bp, Rattus norvegicus
agcaggtgagtagcgattctggacc

SEQ ID NO: 484774 - DNA, 25 bp, Rattus norvegicus
aagtagagcaggtgagtagcgattc

SEQ ID NO: 484775 - DNA, 25 bp, Rattus norvegicus
gagacgggtttcaccttcataagtc

SEQ ID NO: 484776 - DNA, 25 bp, Rattus norvegicus
cttttacaggcggagggaatattga

SEQ ID NO: 484777 - DNA, 25 bp, Rattus norvegicus
gcggagggaatattgagatgattaa

SEQ ID NO: 484778 - DNA, 25 bp, Rattus norvegicus
atgattaataatcgcgcggcagggt

SEQ ID NO: 484779 - DNA, 25 bp, Rattus norvegicus
cagggttgctgatgtaaagcgattt

SEQ ID NO: 484780 - DNA, 25 bp, Rattus norvegicus
tgatgtaaagcgatttgcggatgta

SEQ ID NO: 484781 - DNA, 25 bp, Rattus norvegicus
ttgcggatgtagagggcaataaaca

SEQ ID NO: 484782 - DNA, 25 bp, Rattus norvegicus
gagggcaataaacatgcggatgtaa

SEQ ID NO: 484783 - DNA, 25 bp, Rattus norvegicus
gcggatgtaaaggaatccatcgaga

SEQ ID NO: 484784 - DNA, 25 bp, Rattus norvegicus
tccatcgagattccagaagtctctg

SEQ ID NO: 484785 - DNA, 25 bp, Rattus norvegicus
cgcaattccttttacaggcggaggg

SEQ ID NO: 484786 - DNA, 25 bp, Rattus norvegicus
agtggctactgctgggtactccgtc

SEQ ID NO: 484787 - DNA, 25 bp, Rattus norvegicus
ccgcagtggctactgctgggtactc

SEQ ID NO: 484788 - DNA, 25 bp, Rattus norvegicus
gagattccagaagtctctgaggagc

SEQ ID NO: 484789 - DNA, 25 bp, Rattus norvegicus
cgaccgcgatgctgccgggacaagc

SEQ ID NO: 484790 - DNA, 25 bp, Rattus norvegicus
cactgtattggagcgctgcagccgc

SEQ ID NO: 484791 - DNA, 25 bp, Rattus norvegicus
ccggagcactgtattggagcgctgc

SEQ ID NO: 484792 - DNA, 25 bp, Rattus norvegicus
ccgtagtaactaccgctggggctct

SEQ ID NO: 484793 - DNA, 25 bp, Rattus norvegicus
gcccgctatatagccggggctgatg

SEQ ID NO: 484794 - DNA, 25 bp, Rattus norvegicus
actcagggcccgctatatagccggg

SEQ ID NO: 484795 - DNA, 25 bp, Rattus norvegicus
cagccctgtctgtggccgggacagc

SEQ ID NO: 484796 - DNA, 25 bp, Rattus norvegicus
gtgtcttgctgcctcgcgctctcgg

SEQ ID NO: 484797 - DNA, 25 bp, Rattus norvegicus
ttacataaccgctcgccgtgtcttg

SEQ ID NO: 484798 - DNA, 25 bp, Rattus norvegicus
cgagcaggggatgcgcttacataac

SEQ ID NO: 484799 - DNA, 25 bp, Rattus norvegicus
aggggttctctgctcatccggccgc

SEQ ID NO: 484800 - DNA, 25 bp, Rattus norvegicus
agctggaaggggttctctgctcatc

SEQ ID NO: 484801 - DNA, 25 bp, Rattus norvegicus
ctggcagctcgaccggttccgcatt

SEQ ID NO: 484802 - DNA, 25 bp, Rattus norvegicus
cctctgacgtgtggagctggcagct

SEQ ID NO: 484803 - DNA, 25 bp, Rattus norvegicus
tggcgaaacaagagcggtgccctgc

SEQ ID NO: 484804 - DNA, 25 bp, Rattus norvegicus
tacccgaacctatggcgaaacaaga

SEQ ID NO: 484805 - DNA, 25 bp, Rattus norvegicus
acgcttcatcgggacagcctggagc

SEQ ID NO: 484806 - DNA, 25 bp, Rattus norvegicus
tttccaggacagtcaacgcttcatc

SEQ ID NO: 484807 - DNA, 25 bp, Rattus norvegicus
atcgcagttcaggaacgaaactttt

SEQ ID NO: 484808 - DNA, 25 bp, Rattus norvegicus
ccctgccgcagatcgcagttcagga

SEQ ID NO: 484809 - DNA, 25 bp, Rattus norvegicus
cccagctcaaggcaggggatcctgg

SEQ ID NO: 484810 - DNA, 25 bp, Rattus norvegicus
ggtgccctgcgagcccagctcaagg

SEQ ID NO: 484811 - DNA, 25 bp, Rattus norvegicus
ctggctcggagaagactctgacctc

SEQ ID NO: 484812 - DNA, 25 bp, Rattus norvegicus
agactctgacctcggaaggacgtgg

SEQ ID NO: 484813 - DNA, 25 bp, Rattus norvegicus
cgtggggaatcattcagcgaagtcc

SEQ ID NO: 484814 - DNA, 25 bp, Rattus norvegicus
cattcagcgaagtcctctgggagtg

SEQ ID NO: 484815 - DNA, 25 bp, Rattus norvegicus
gctaaccgggcggtttccatggcac

SEQ ID NO: 484816 - DNA, 25 bp, Rattus norvegicus
ggagaagaatgtacccgaacctatg

SEQ ID NO: 484817 - DNA, 25 bp, Rattus norvegicus
cagagagaaaaggagccaagagatc

SEQ ID NO: 484818 - DNA, 25 bp, Rattus norvegicus
gcagctgagcgttgttcgcgccgct

SEQ ID NO: 484819 - DNA, 25 bp, Rattus norvegicus
cggttgcttgttggttgttgtagta

SEQ ID NO: 484820 - DNA, 25 bp, Rattus norvegicus
ttcggcggctgcgttgattccggct

SEQ ID NO: 484821 - DNA, 25 bp, Rattus norvegicus
cccaggagcagctgttggcttccgg

SEQ ID NO: 484822 - DNA, 25 bp, Rattus norvegicus
ttagaagatgagacaggtaaacgcc

SEQ ID NO: 484823 - DNA, 25 bp, Rattus norvegicus
aggtaaacgcctgcgccagcgcgct

SEQ ID NO: 484824 - DNA, 25 bp, Rattus norvegicus
actgagcgcgccgtggtgacgccat

SEQ ID NO: 484825 - DNA, 25 bp, Rattus norvegicus
gccaagagatcttccggtgacagcc

SEQ ID NO: 484826 - DNA, 25 bp, Rattus norvegicus
ctctgagtttggagtcagtctttta

SEQ ID NO: 484827 - DNA, 25 bp, Rattus norvegicus
tcgagcgtggcggaactctgagttt

SEQ ID NO: 484828 - DNA, 25 bp, Rattus norvegicus
taaacccttctgtcgagcgtggcgg

SEQ ID NO: 484829 - DNA, 25 bp, Rattus norvegicus
gctcacgcggtaaacccttctgtcg

SEQ ID NO: 484830 - DNA, 25 bp, Rattus norvegicus
acagcctgggttggctctggtgact

SEQ ID NO: 484831 - DNA, 25 bp, Rattus norvegicus
cgaataacgtgagtcaccatcgccc

SEQ ID NO: 484832 - DNA, 25 bp, Rattus norvegicus
tcgcgctggacaagaagcgcagtcc

SEQ ID NO: 484833 - DNA, 25 bp, Rattus norvegicus
tcagtcggctcgaataacgtgagtc

SEQ ID NO: 484834 - DNA, 25 bp, Rattus norvegicus
gtcagggtcagtcggctcgaataac

SEQ ID NO: 484835 - DNA, 25 bp, Rattus norvegicus
ggctgcaggtcagaagctggcggct

SEQ ID NO: 484836 - DNA, 25 bp, Rattus norvegicus
agctgccgcttgagcatggggcgtt

SEQ ID NO: 484837 - DNA, 25 bp, Rattus norvegicus
acttgtcgaggtccgcgctccagga

SEQ ID NO: 484838 - DNA, 25 bp, Rattus norvegicus
catgcacttgtcgaggtccgcgctc

SEQ ID NO: 484839 - DNA, 25 bp, Rattus norvegicus
agtccatgcacttgtcgaggtccgc

SEQ ID NO: 484840 - DNA, 25 bp, Rattus norvegicus
cgcagtccatgcacttgtcgaggtc

SEQ ID NO: 484841 - DNA, 25 bp, Rattus norvegicus
gaagcgcagtccatgcacttgtcga

SEQ ID NO: 484842 - DNA, 25 bp, Rattus norvegicus
gacaagaagcgcagtccatgcactt

SEQ ID NO: 484843 - DNA, 25 bp, Rattus norvegicus
cgctggacaagaagcgcagtccatg

SEQ ID NO: 484844 - DNA, 25 bp, Rattus norvegicus
ggctcgaataacgtgagtcaccatc

SEQ ID NO: 484845 - DNA, 25 bp, Rattus norvegicus
taacaggcccttgcgctgtgaagcc

SEQ ID NO: 484846 - DNA, 25 bp, Rattus norvegicus
tcactgggacgaacccgatgttctc

SEQ ID NO: 484847 - DNA, 25 bp, Rattus norvegicus
gagtgctgccactcactgggacgaa

SEQ ID NO: 484848 - DNA, 25 bp, Rattus norvegicus
aggtgctgcaaagacccgagtgctg

SEQ ID NO: 484849 - DNA, 25 bp, Rattus norvegicus
caagctttttcgaagtcggtggtgc

SEQ ID NO: 484850 - DNA, 25 bp, Rattus norvegicus
cggcttcagaaggtggagtgtttca

SEQ ID NO: 484851 - DNA, 25 bp, Rattus norvegicus
ctcgccgaggccacggcttcagaag

SEQ ID NO: 484852 - DNA, 25 bp, Rattus norvegicus
aacgtttaggcctctcctcgccgag

SEQ ID NO: 484853 - DNA, 25 bp, Rattus norvegicus
gatgtctttctactaccagtccaaa

SEQ ID NO: 484854 - DNA, 25 bp, Rattus norvegicus
ccggcttgtggatgtctttctacta

SEQ ID NO: 484855 - DNA, 25 bp, Rattus norvegicus
agaaagcatccgaatcccaggggta

SEQ ID NO: 484856 - DNA, 25 bp, Rattus norvegicus
ccgatgttctcctaacaggcccttg

SEQ ID NO: 484857 - DNA, 25 bp, Rattus norvegicus
tgtgaagcccgactccctgccgggg

SEQ ID NO: 484858 - DNA, 25 bp, Rattus norvegicus
ccggggcatccgaagcgaagatccc

SEQ ID NO: 484859 - DNA, 25 bp, Rattus norvegicus
tgcgccggggccagctgtcagtcca

SEQ ID NO: 484860 - DNA, 25 bp, Rattus norvegicus
cggtccggccactctctccaggccc

SEQ ID NO: 484861 - DNA, 25 bp, Rattus norvegicus
tggaaccgggctcggccgcgatcct

SEQ ID NO: 484862 - DNA, 25 bp, Rattus norvegicus
ctcggccgcgatcctggcagcggtt

SEQ ID NO: 484863 - DNA, 25 bp, Rattus norvegicus
atcctggcagcggttcctcactgac

SEQ ID NO: 484864 - DNA, 25 bp, Rattus norvegicus
tggcagcggttcctcactgaccatc

SEQ ID NO: 484865 - DNA, 25 bp, Rattus norvegicus
acaggggacacaggctaggttcgct

SEQ ID NO: 484866 - DNA, 25 bp, Rattus norvegicus
tcctcactgaccatcccgagcccgg

SEQ ID NO: 484867 - DNA, 25 bp, Rattus norvegicus
tggggtaaatgatggcactttccgg

SEQ ID NO: 484868 - DNA, 25 bp, Rattus norvegicus
tgatggcactttccggaaggccgag

SEQ ID NO: 484869 - DNA, 25 bp, Rattus norvegicus
tgacagaagcttggaggcaagcaac

SEQ ID NO: 484870 - DNA, 25 bp, Rattus norvegicus
tggaggcaagcaacaccagatcctg

SEQ ID NO: 484871 - DNA, 25 bp, Rattus norvegicus
agcaacaccagatcctgcgatcacg

SEQ ID NO: 484872 - DNA, 25 bp, Rattus norvegicus
agatcctgcgatcacgtcccgaccc

SEQ ID NO: 484873 - DNA, 25 bp, Rattus norvegicus
gcccagagtcgggacagaccctggc

SEQ ID NO: 484874 - DNA, 25 bp, Rattus norvegicus
ttgcccgagtgcgaattccacctta

SEQ ID NO: 484875 - DNA, 25 bp, Rattus norvegicus
agtgcgaattccaccttaacggagg

SEQ ID NO: 484876 - DNA, 25 bp, Rattus norvegicus
acggctgtttccaggaagtgacatc

SEQ ID NO: 484877 - DNA, 25 bp, Rattus norvegicus
agaccctggcccaattgcccgagtg

SEQ ID NO: 484878 - DNA, 25 bp, Rattus norvegicus
gaagcccagagtcgggacagaccct

SEQ ID NO: 484879 - DNA, 25 bp, Rattus norvegicus
agtggcccggctctctgagaagccc

SEQ ID NO: 484880 - DNA, 25 bp, Rattus norvegicus
ccacctccgtgaggagcgatgctgg

SEQ ID NO: 484881 - DNA, 25 bp, Rattus norvegicus
gctcggccacctccgtgaggagcga

SEQ ID NO: 484882 - DNA, 25 bp, Rattus norvegicus
gagaaacgtcgcagctcggccacct

SEQ ID NO: 484883 - DNA, 25 bp, Rattus norvegicus
agaggagaaacgtcgcagctcggcc

SEQ ID NO: 484884 - DNA, 25 bp, Rattus norvegicus
acgatttactggatctgggagagga

SEQ ID NO: 484885 - DNA, 25 bp, Rattus norvegicus
cggccgcggtgatggacgatttact

SEQ ID NO: 484886 - DNA, 25 bp, Rattus norvegicus
cctggcccaattgcccgagtgcgaa

SEQ ID NO: 484887 - DNA, 25 bp, Rattus norvegicus
caggcgcctcttacggcagagaaca

SEQ ID NO: 484888 - DNA, 25 bp, Rattus norvegicus
cggcagagaacaatttattagcgcc

SEQ ID NO: 484889 - DNA, 25 bp, Rattus norvegicus
tatctcctcgcggaggcttccagtc

SEQ ID NO: 484890 - DNA, 25 bp, Rattus norvegicus
tcgcggaggcttccagtccgtgccg

SEQ ID NO: 484891 - DNA, 25 bp, Rattus norvegicus
ccgccgctggcataataaatgaaga

SEQ ID NO: 484892 - DNA, 25 bp, Rattus norvegicus
taaatgaagacaaagtgccggcggc

SEQ ID NO: 484893 - DNA, 25 bp, Rattus norvegicus
agccgctgccagcttcattattcgc

SEQ ID NO: 484894 - DNA, 25 bp, Rattus norvegicus
ttcattattcgcttaagttgccgga

SEQ ID NO: 484895 - DNA, 25 bp, Rattus norvegicus
ttcgcttaagttgccggagagaatt

SEQ ID NO: 484896 - DNA, 25 bp, Rattus norvegicus
gccggagagaattacttaaccctga

SEQ ID NO: 484897 - DNA, 25 bp, Rattus norvegicus
ctgacccgtgtattaggggcctgta

SEQ ID NO: 484898 - DNA, 25 bp, Rattus norvegicus
aaatgaagcgatatctcctcgcgga

SEQ ID NO: 484899 - DNA, 25 bp, Rattus norvegicus
taatgccgcgacaggcgcctcttac

SEQ ID NO: 484900 - DNA, 25 bp, Rattus norvegicus
aggggcctgtattaatgccgcgaca

SEQ ID NO: 484901 - DNA, 25 bp, Rattus norvegicus
cgcctccgtgggaatgtcccttaga

SEQ ID NO: 484902 - DNA, 25 bp, Rattus norvegicus
caccgtggagcggaagtaggcgcac

SEQ ID NO: 484903 - DNA, 25 bp, Rattus norvegicus
gcctgtcctttcttgtagcccgccc

SEQ ID NO: 484904 - DNA, 25 bp, Rattus norvegicus
acctcttaggcccagaccggaaatg

SEQ ID NO: 484905 - DNA, 25 bp, Rattus norvegicus
cttaggcccagaccggaaatgaggt

SEQ ID NO: 484906 - DNA, 25 bp, Rattus norvegicus
cccagaccggaaatgaggtcagaga

SEQ ID NO: 484907 - DNA, 25 bp, Rattus norvegicus
agagagtccttcaaaacgcggcttt

SEQ ID NO: 484908 - DNA, 25 bp, Rattus norvegicus
gctaccctaggtgcgtcttctcagc

SEQ ID NO: 484909 - DNA, 25 bp, Rattus norvegicus
atgtcccttagatgggcgacagcga

SEQ ID NO: 484910 - DNA, 25 bp, Rattus norvegicus
ccttagatgggcgacagcgagaact

SEQ ID NO: 484911 - DNA, 25 bp, Rattus norvegicus
gcgacagcgagaactcaggcttggt

SEQ ID NO: 484912 - DNA, 25 bp, Rattus norvegicus
ggctggaaatggaagagagtccttc

SEQ ID NO: 484913 - DNA, 25 bp, Rattus norvegicus
ccaggctgggagctacggccccgaa

SEQ ID NO: 484914 - DNA, 25 bp, Rattus norvegicus
cctggctaccctaggtgcgtcttct

SEQ ID NO: 484915 - DNA, 25 bp, Rattus norvegicus
tctctcctggatgtcgcagttcctc

SEQ ID NO: 484916 - DNA, 25 bp, Rattus norvegicus
ccgcacacttgccagggtttcttaa

SEQ ID NO: 484917 - DNA, 25 bp, Rattus norvegicus
gtggcgctttctcgttcactttgaa

SEQ ID NO: 484918 - DNA, 25 bp, Rattus norvegicus
actttgaatttgctccacggtgaca

SEQ ID NO: 484919 - DNA, 25 bp, Rattus norvegicus
agcaagggtgttctgtcccgtccta

SEQ ID NO: 484920 - DNA, 25 bp, Rattus norvegicus
acgggcgctttgatttccatcctgg

SEQ ID NO: 484921 - DNA, 25 bp, Rattus norvegicus
ggtgccttactttcctgtctgtctg

SEQ ID NO: 484922 - DNA, 25 bp, Rattus norvegicus
actgggaatgctaaaacgggactga

SEQ ID NO: 484923 - DNA, 25 bp, Rattus norvegicus
caaaatgatttcagccaggggcaga

SEQ ID NO: 484924 - DNA, 25 bp, Rattus norvegicus
ccgtgagggaaaactgcaggtgacc

SEQ ID NO: 484925 - DNA, 25 bp, Rattus norvegicus
ccgcgggccagaacgtagattaagt

SEQ ID NO: 484926 - DNA, 25 bp, Rattus norvegicus
cgcctttctcctccaactgggaatg

SEQ ID NO: 484927 - DNA, 25 bp, Rattus norvegicus
cctcggctaccacaaccagtaggtg

SEQ ID NO: 484928 - DNA, 25 bp, Rattus norvegicus
tggacgtgtccgaactctgcatccc

SEQ ID NO: 484929 - DNA, 25 bp, Rattus norvegicus
cgaggactgtactagcggtatcatg

SEQ ID NO: 484930 - DNA, 25 bp, Rattus norvegicus
tgcgagtacatgcttaacgccatcc

SEQ ID NO: 484931 - DNA, 25 bp, Rattus norvegicus
cggtatcatggaggactcggccatc

SEQ ID NO: 484932 - DNA, 25 bp, Rattus norvegicus
tcaagacggagccatctagcccatc

SEQ ID NO: 484933 - DNA, 25 bp, Rattus norvegicus
cgcaagagctacgaggactgtacta

SEQ ID NO: 484934 - DNA, 25 bp, Rattus norvegicus
aggcaacccgtgtcgcaagagctac

SEQ ID NO: 484935 - DNA, 25 bp, Rattus norvegicus
ctctccgcctatgttcgcaggtgcg

SEQ ID NO: 484936 - DNA, 25 bp, Rattus norvegicus
caacggtctggactctccgcctatg

SEQ ID NO: 484937 - DNA, 25 bp, Rattus norvegicus
tctagcccatcctcgggcattgatg

SEQ ID NO: 484938 - DNA, 25 bp, Rattus norvegicus
actcccgcgttctgtgcctgcaggt

SEQ ID NO: 484939 - DNA, 25 bp, Rattus norvegicus
tcggccatcaagtgcgagtacatgc

SEQ ID NO: 484940 - DNA, 25 bp, Rattus norvegicus
tagctgcggctccttcatcaagacg

SEQ ID NO: 484941 - DNA, 25 bp, Rattus norvegicus
ggttgctgaaccgaatgtcgtccga

SEQ ID NO: 484942 - DNA, 25 bp, Rattus norvegicus
tgtcgtccgaagacaggcacctggg

SEQ ID NO: 484943 - DNA, 25 bp, Rattus norvegicus
ttctgcttcgccgaaccgggacgca

SEQ ID NO: 484944 - DNA, 25 bp, Rattus norvegicus
atgggaacacgctggccctttaagg

SEQ ID NO: 484945 - DNA, 25 bp, Rattus norvegicus
gtcgcgacagagaagtcacaccgtg

SEQ ID NO: 484946 - DNA, 25 bp, Rattus norvegicus
aaccgggacgcagcgatcggccgat

SEQ ID NO: 484947 - DNA, 25 bp, Rattus norvegicus
ggctgcaccttctcaggctgttgct

SEQ ID NO: 484948 - DNA, 25 bp, Rattus norvegicus
gcctgggctttgtcagtcgattcca

SEQ ID NO: 484949 - DNA, 25 bp, Rattus norvegicus
ctttgcccgctcatgctgcagttgg

SEQ ID NO: 484950 - DNA, 25 bp, Rattus norvegicus
ccgctctccacgatggctgagcttg

SEQ ID NO: 484951 - DNA, 25 bp, Rattus norvegicus
cccgctttggctcggctgagaccgt

SEQ ID NO: 484952 - DNA, 25 bp, Rattus norvegicus
ctcatgctgcagttggtggccagca

SEQ ID NO: 484953 - DNA, 25 bp, Rattus norvegicus
cagcagcgaagctgcggctgaaatc

SEQ ID NO: 484954 - DNA, 25 bp, Rattus norvegicus
tgaaatctgccgctcagtgacctca

SEQ ID NO: 484955 - DNA, 25 bp, Rattus norvegicus
cctgtggtccagactcggagctcac

SEQ ID NO: 484956 - DNA, 25 bp, Rattus norvegicus
agtgagacaggcttggaatgtgctc

SEQ ID NO: 484957 - DNA, 25 bp, Rattus norvegicus
gcggaccacctcacacttggcagag

SEQ ID NO: 484958 - DNA, 25 bp, Rattus norvegicus
cccaggagcccaataggggcagacc

SEQ ID NO: 484959 - DNA, 25 bp, Rattus norvegicus
ggaccaccgccacagccaaggaaga

SEQ ID NO: 484960 - DNA, 25 bp, Rattus norvegicus
aggtaatataggcacgacgcgatca

SEQ ID NO: 484961 - DNA, 25 bp, Rattus norvegicus
ggcagcagcaggtaatataggcacg

SEQ ID NO: 484962 - DNA, 25 bp, Rattus norvegicus
ggctgcccacgagagtcgccggtca

SEQ ID NO: 484963 - DNA, 25 bp, Rattus norvegicus
cgcccatcaggacgcaaggccggta

SEQ ID NO: 484964 - DNA, 25 bp, Rattus norvegicus
aggcacgacgcgatcatggccggcc

SEQ ID NO: 484965 - DNA, 25 bp, Rattus norvegicus
gactgcggtcatgcggcctgacgct

SEQ ID NO: 484966 - DNA, 25 bp, Rattus norvegicus
acttggcagaggactgcggtcatgc

SEQ ID NO: 484967 - DNA, 25 bp, Rattus norvegicus
cagcccaagcctcgtggggccagga

SEQ ID NO: 484968 - DNA, 25 bp, Rattus norvegicus
acgtcaccagaccacagcgtgagga

SEQ ID NO: 484969 - DNA, 25 bp, Rattus norvegicus
cagccctgggtccacgttaaccgtg

SEQ ID NO: 484970 - DNA, 25 bp, Rattus norvegicus
acgcaaggccggtacctgagaggaa

SEQ ID NO: 484971 - DNA, 25 bp, Rattus norvegicus
aattgacgcaaccacggcatacggg

SEQ ID NO: 484972 - DNA, 25 bp, Rattus norvegicus
tacgggttcggagaagtcccagatc

SEQ ID NO: 484973 - DNA, 25 bp, Rattus norvegicus
ggtcggcgccttcgtaattgacgca

SEQ ID NO: 484974 - DNA, 25 bp, Rattus norvegicus
tcacgaattctatgcggtcggcgcc

SEQ ID NO: 484975 - DNA, 25 bp, Rattus norvegicus
gtctgtgctcgacaccgatccaggc

SEQ ID NO: 484976 - DNA, 25 bp, Rattus norvegicus
ggcgtgctgtctcgatcacgaattc

SEQ ID NO: 484977 - DNA, 25 bp, Rattus norvegicus
cgggcaacactgcaggcttggtaga

SEQ ID NO: 484978 - DNA, 25 bp, Rattus norvegicus
cgggtactcgaaacggctgcgttgt

SEQ ID NO: 484979 - DNA, 25 bp, Rattus norvegicus
aagccaccgatgttgccgctgagga

SEQ ID NO: 484980 - DNA, 25 bp, Rattus norvegicus
gtcccagatcatggcccagggcatg

SEQ ID NO: 484981 - DNA, 25 bp, Rattus norvegicus
agcagaggatacagtggccgacaca

SEQ ID NO: 484982 - DNA, 25 bp, Rattus norvegicus
agcgttgcgctgcttttcctttagc

SEQ ID NO: 484983 - DNA, 25 bp, Rattus norvegicus
ctttagctcacgctcctggtctgtg

SEQ ID NO: 484984 - DNA, 25 bp, Rattus norvegicus
cactatgagtcccacgccgagaagc

SEQ ID NO: 484985 - DNA, 25 bp, Rattus norvegicus
ttgctgactctcgaggccgagactg

SEQ ID NO: 484986 - DNA, 25 bp, Rattus norvegicus
gtgctcttggcttgctgactctcga

SEQ ID NO: 484987 - DNA, 25 bp, Rattus norvegicus
ccacaatttggaactcaaatggggc

SEQ ID NO: 484988 - DNA, 25 bp, Rattus norvegicus
cggccggttactgagccttgcaaac

SEQ ID NO: 484989 - DNA, 25 bp, Rattus norvegicus
tgcagagagaaaggccttttttggt

SEQ ID NO: 484990 - DNA, 25 bp, Rattus norvegicus
gccaggaatcgcctcgcgccagtaa

SEQ ID NO: 484991 - DNA, 25 bp, Rattus norvegicus
tttggccttagcgaggccaggaatc

SEQ ID NO: 484992 - DNA, 25 bp, Rattus norvegicus
ctgggccctcctttggccttagcga

SEQ ID NO: 484993 - DNA, 25 bp, Rattus norvegicus
tgaaaacaaacgtgtgggctgggcc

SEQ ID NO: 484994 - DNA, 25 bp, Rattus norvegicus
agccgctaaggagtagatgaaaaca

SEQ ID NO: 484995 - DNA, 25 bp, Rattus norvegicus
tgttctttggcctgcgagccgctaa

SEQ ID NO: 484996 - DNA, 25 bp, Rattus norvegicus
cccggcagtaagcagtgccctgttc

SEQ ID NO: 484997 - DNA, 25 bp, Rattus norvegicus
gaggccgagactgaacctcgcgtca

SEQ ID NO: 484998 - DNA, 25 bp, Rattus norvegicus
tttggtaacacacagcccggcagta

SEQ ID NO: 484999 - DNA, 25 bp, Rattus norvegicus
gaccttgcgcgtgcgccgtccggtt

SEQ ID NO: 485000 - DNA, 25 bp, Rattus norvegicus
cctcaggtaaggacaaagctgtgtg

SEQ ID NO: 485001 - DNA, 25 bp, Rattus norvegicus
caggtaaggacaaagctgtgtgccc

SEQ ID NO: 485002 - DNA, 25 bp, Rattus norvegicus
ccgtgtccttcattccccagtgttg

SEQ ID NO: 485003 - DNA, 25 bp, Rattus norvegicus
tggggtctgtgacattcttgggtct

SEQ ID NO: 485004 - DNA, 25 bp, Rattus norvegicus
acattcttgggtctggggaacactc

SEQ ID NO: 485005 - DNA, 25 bp, Rattus norvegicus
tctggggaacactcgagcgagactc

SEQ ID NO: 485006 - DNA, 25 bp, Rattus norvegicus
tggggaacactcgagcgagactccc

SEQ ID NO: 485007 - DNA, 25 bp, Rattus norvegicus
cccgctggcacaagagcgcggagca

SEQ ID NO: 485008 - DNA, 25 bp, Rattus norvegicus
ccaggaccccggataaggctaggcg

SEQ ID NO: 485009 - DNA, 25 bp, Rattus norvegicus
gctaggcgctcgctgttggaacctt

SEQ ID NO: 485010 - DNA, 25 bp, Rattus norvegicus
tgttggaaccttgccgggcactagc

SEQ ID NO: 485011 - DNA, 25 bp, Rattus norvegicus
cagcaccgccctgccggtcgacttt

SEQ ID NO: 485012 - DNA, 25 bp, Rattus norvegicus
ccgtccggttgccaaggcctcaggt

SEQ ID NO: 485013 - DNA, 25 bp, Rattus norvegicus
tggctactggaattggagttctcgc

SEQ ID NO: 485014 - DNA, 25 bp, Rattus norvegicus
tagcaccgacttgccgctgccattg

SEQ ID NO: 485015 - DNA, 25 bp, Rattus norvegicus
ccaggctgtgtagggaaggcaaccc

SEQ ID NO: 485016 - DNA, 25 bp, Rattus norvegicus
gcaccaagcacggaaagcaagcgcc

SEQ ID NO: 485017 - DNA, 25 bp, Rattus norvegicus
taggtccacaaggttggccgacatg

SEQ ID NO: 485018 - DNA, 25 bp, Rattus norvegicus
agagctctaggagcctaggtccaca

SEQ ID NO: 485019 - DNA, 25 bp, Rattus norvegicus
acggcgtcttctcgtcctcggaact

SEQ ID NO: 485020 - DNA, 25 bp, Rattus norvegicus
ctcggaactgcctagcaccgacttg

SEQ ID NO: 485021 - DNA, 25 bp, Rattus norvegicus
ccagcgggttgtggctactggaatt

SEQ ID NO: 485022 - DNA, 25 bp, Rattus norvegicus
gagttctcgctgttctccctgcaag

SEQ ID NO: 485023 - DNA, 25 bp, Rattus norvegicus
ttctccctgcaagcgcgggaggaaa

SEQ ID NO: 485024 - DNA, 25 bp, Rattus norvegicus
cagggcagtcttccagtacccggtc

SEQ ID NO: 485025 - DNA, 25 bp, Rattus norvegicus
agtacccggtccagactccaatcta

SEQ ID NO: 485026 - DNA, 25 bp, Rattus norvegicus
ctgccattgagcgaggaagccagcg

SEQ ID NO: 485027 - DNA, 25 bp, Rattus norvegicus
tcaaaccaggcgacaatcgtggcaa

SEQ ID NO: 485028 - DNA, 25 bp, Rattus norvegicus
acccggcgaataccaggttgtcatg

SEQ ID NO: 485029 - DNA, 25 bp, Rattus norvegicus
gagatagctagagacccggcgaata

SEQ ID NO: 485030 - DNA, 25 bp, Rattus norvegicus
aatcacgtgactggcgaaagctgtc

SEQ ID NO: 485031 - DNA, 25 bp, Rattus norvegicus
cttctaggagtacagcgcgcagtct

SEQ ID NO: 485032 - DNA, 25 bp, Rattus norvegicus
ccaaccatagagaggccacggctgt

SEQ ID NO: 485033 - DNA, 25 bp, Rattus norvegicus
gcgaagccttaagtgccaaccatag

SEQ ID NO: 485034 - DNA, 25 bp, Rattus norvegicus
ctcaaggaacggacaaaatggcggc

SEQ ID NO: 485035 - DNA, 25 bp, Rattus norvegicus
cacaacagcgtcaaggggacacacc

SEQ ID NO: 485036 - DNA, 25 bp, Rattus norvegicus
gtcatggagtcatggggcccatctc

SEQ ID NO: 485037 - DNA, 25 bp, Rattus norvegicus
gcttctagtcctcgtgcacggtctg

SEQ ID NO: 485038 - DNA, 25 bp, Rattus norvegicus
ggggcctcggaaccgaatcacgtga

SEQ ID NO: 485039 - DNA, 25 bp, Rattus norvegicus
atgcgtctacaagccactacccatg

SEQ ID NO: 485040 - DNA, 25 bp, Rattus norvegicus
gagagcgtcgctctcctcgttgctc

SEQ ID NO: 485041 - DNA, 25 bp, Rattus norvegicus
tctcctgtaatttaattgtctctcc

SEQ ID NO: 485042 - DNA, 25 bp, Rattus norvegicus
ctcccggccgatgcgagtactgcat

SEQ ID NO: 485043 - DNA, 25 bp, Rattus norvegicus
gagtactgcatcttccctgcgtggc

SEQ ID NO: 485044 - DNA, 25 bp, Rattus norvegicus
atcttccctgcgtggctggtggcta

SEQ ID NO: 485045 - DNA, 25 bp, Rattus norvegicus
ctggtggctaggtggaaacaccacc

SEQ ID NO: 485046 - DNA, 25 bp, Rattus norvegicus
ccctacgcgcgtggtctaagtgctc

SEQ ID NO: 485047 - DNA, 25 bp, Rattus norvegicus
ccgttctgttgtctcctgtaattta

SEQ ID NO: 485048 - DNA, 25 bp, Rattus norvegicus
attgtctctcccgaaagcgttgcta

SEQ ID NO: 485049 - DNA, 25 bp, Rattus norvegicus
agcgttgctaattaactcctttctc

SEQ ID NO: 485050 - DNA, 25 bp, Rattus norvegicus
ccctgctgttgtggattaattacgc

SEQ ID NO: 485051 - DNA, 25 bp, Rattus norvegicus
ttaattacgctgtgctggtgaggga

SEQ ID NO: 485052 - DNA, 25 bp, Rattus norvegicus
tgctggtgagggatttcttagcctc

SEQ ID NO: 485053 - DNA, 25 bp, Rattus norvegicus
ggatttcttagcctcggcgggctcc

SEQ ID NO: 485054 - DNA, 25 bp, Rattus norvegicus
ggtcctccaaccgttctgttgtctc

SEQ ID NO: 485055 - DNA, 25 bp, Rattus norvegicus
agctgtccgctcagcaccggagtcc

SEQ ID NO: 485056 - DNA, 25 bp, Rattus norvegicus
cccgaggctgcaaagttgtgggctc

SEQ ID NO: 485057 - DNA, 25 bp, Rattus norvegicus
cccagctccagtcgcgacaggagga

SEQ ID NO: 485058 - DNA, 25 bp, Rattus norvegicus
tggggaacaaactcacccagctcca

SEQ ID NO: 485059 - DNA, 25 bp, Rattus norvegicus
cagagggctggggaacaaactcacc

SEQ ID NO: 485060 - DNA, 25 bp, Rattus norvegicus
tgcggacccaaacagcgcgggcacc

SEQ ID NO: 485061 - DNA, 25 bp, Rattus norvegicus
cccgcaacggtcagcagagagtggc

SEQ ID NO: 485062 - DNA, 25 bp, Rattus norvegicus
cctgtgtcccgcaacggtcagcaga

SEQ ID NO: 485063 - DNA, 25 bp, Rattus norvegicus
aagcaagtgtcttcccggcgccagt

SEQ ID NO: 485064 - DNA, 25 bp, Rattus norvegicus
ctccagcgagggaagcaagtgtctt

SEQ ID NO: 485065 - DNA, 25 bp, Rattus norvegicus
taccgggctccagcgagggaagcaa

SEQ ID NO: 485066 - DNA, 25 bp, Rattus norvegicus
tccacagagccctaggtaccgggct

SEQ ID NO: 485067 - DNA, 25 bp, Rattus norvegicus
ggttcctcagccactgcctcctgga

SEQ ID NO: 485068 - DNA, 25 bp, Rattus norvegicus
ctgcaaagttgtgggctcgcccgac

SEQ ID NO: 485069 - DNA, 25 bp, Rattus norvegicus
aacggtgtctttgctggtccagccc

SEQ ID NO: 485070 - DNA, 25 bp, Rattus norvegicus
cccagaggatgtgcagggccagctt

SEQ ID NO: 485071 - DNA, 25 bp, Rattus norvegicus
cagagaaccgccctttaaagctacg

SEQ ID NO: 485072 - DNA, 25 bp, Rattus norvegicus
ttaaagctacggtggctcccaccca

SEQ ID NO: 485073 - DNA, 25 bp, Rattus norvegicus
ccactctggcccagggaggcttgcg

SEQ ID NO: 485074 - DNA, 25 bp, Rattus norvegicus
gaggcttgcgcgctccctctgcacc

SEQ ID NO: 485075 - DNA, 25 bp, Rattus norvegicus
tttgctggtccagcccagaggatgt

SEQ ID NO: 485076 - DNA, 25 bp, Rattus norvegicus
ggggcccagcaacggtgtctttgct

SEQ ID NO: 485077 - DNA, 25 bp, Rattus norvegicus
ccaggcccagtgccttagtcgggcg

SEQ ID NO: 485078 - DNA, 25 bp, Rattus norvegicus
agcgccatctcctcggagacgcggg

SEQ ID NO: 485079 - DNA, 25 bp, Rattus norvegicus
ggcgtcaacgcacatgcagcgccat

SEQ ID NO: 485080 - DNA, 25 bp, Rattus norvegicus
tgggcacggcgtcaacgcacatgca

SEQ ID NO: 485081 - DNA, 25 bp, Rattus norvegicus
tccagcccagaggatgtgcagggcc

SEQ ID NO: 485082 - DNA, 25 bp, Rattus norvegicus
ctctgcacccgccttagggactacc

SEQ ID NO: 485083 - DNA, 25 bp, Rattus norvegicus
agcgccgctgccaattcccggtccg

SEQ ID NO: 485084 - DNA, 25 bp, Rattus norvegicus
actcggaaagcctgggctcgccgaa

SEQ ID NO: 485085 - DNA, 25 bp, Rattus norvegicus
cgaaaccggaaatggctgcagcgcc

SEQ ID NO: 485086 - DNA, 25 bp, Rattus norvegicus
acctctccgaaaccggaaatggctg

SEQ ID NO: 485087 - DNA, 25 bp, Rattus norvegicus
atcctcccggcagcacccggcagca

SEQ ID NO: 485088 - DNA, 25 bp, Rattus norvegicus
gtttttcacgcagccgttcgcccgc

SEQ ID NO: 485089 - DNA, 25 bp, Rattus norvegicus
ggtgctgctcctcaagtacccgttc

SEQ ID NO: 485090 - DNA, 25 bp, Rattus norvegicus
tgagccgcgcccagccgccaaccag

SEQ ID NO: 485091 - DNA, 25 bp, Rattus norvegicus
ggtcccggtcgctcagcacacctga

SEQ ID NO: 485092 - DNA, 25 bp, Rattus norvegicus
tcagtgccgggacccagtcagtgcc

SEQ ID NO: 485093 - DNA, 25 bp, Rattus norvegicus
gaggcccagtcagtgccgggaccca

SEQ ID NO: 485094 - DNA, 25 bp, Rattus norvegicus
gctgcccttgagtcttcctcccgca

SEQ ID NO: 485095 - DNA, 25 bp, Rattus norvegicus
tcggtcccatcgtacctggcccgca

SEQ ID NO: 485096 - DNA, 25 bp, Rattus norvegicus
aaagcctgggctcgccgaagcccgg

SEQ ID NO: 485097 - DNA, 25 bp, Rattus norvegicus
gccacgtgagcctctgagaagtcga

SEQ ID NO: 485098 - DNA, 25 bp, Rattus norvegicus
actggtcggcctatagcgtttatta

SEQ ID NO: 485099 - DNA, 25 bp, Rattus norvegicus
ggactaactgcgttgcgttcccgta

SEQ ID NO: 485100 - DNA, 25 bp, Rattus norvegicus
gcagcctccgcggtaaaaggactaa

SEQ ID NO: 485101 - DNA, 25 bp, Rattus norvegicus
ttcagttttaacatggcagcctccg

SEQ ID NO: 485102 - DNA, 25 bp, Rattus norvegicus
ccaggctttggttcattcagtttta

SEQ ID NO: 485103 - DNA, 25 bp, Rattus norvegicus
ggcccggaagcagaactccaaattc

SEQ ID NO: 485104 - DNA, 25 bp, Rattus norvegicus
gttaatgaaacgaccgcagccgcca

SEQ ID NO: 485105 - DNA, 25 bp, Rattus norvegicus
gatgaccgctcctaggtccgccgta

SEQ ID NO: 485106 - DNA, 25 bp, Rattus norvegicus
tcatcgcctggcagtacagctcgtc

SEQ ID NO: 485107 - DNA, 25 bp, Rattus norvegicus
aaaattccttggaccgcggcatcga

SEQ ID NO: 485108 - DNA, 25 bp, Rattus norvegicus
cctgtaagttcttccgaggtcacga

SEQ ID NO: 485109 - DNA, 25 bp, Rattus norvegicus
cggctctgcctgtagaagcggaaaa

SEQ ID NO: 485110 - DNA, 25 bp, Rattus norvegicus
cccatctcgatgttgcgaacagttt

SEQ ID NO: 485111 - DNA, 25 bp, Rattus norvegicus
ggcgcttaatctgccgcgccgctta

SEQ ID NO: 485112 - DNA, 25 bp, Rattus norvegicus
tgcggcctactcagcaaggaagccc

SEQ ID NO: 485113 - DNA, 25 bp, Rattus norvegicus
cgccgcttacgcgaagcacacgtga

SEQ ID NO: 485114 - DNA, 25 bp, Rattus norvegicus
aagcccgcgagaggttctagctacg

SEQ ID NO: 485115 - DNA, 25 bp, Rattus norvegicus
tacggccttggctaggctacttctg

SEQ ID NO: 485116 - DNA, 25 bp, Rattus norvegicus
tagcctgaacagtccggagagaaaa

SEQ ID NO: 485117 - DNA, 25 bp, Rattus norvegicus
atgaaaaatgctcactgcgcaggcg

SEQ ID NO: 485118 - DNA, 25 bp, Rattus norvegicus
gtatcgcaaacacctcagcccggag

SEQ ID NO: 485119 - DNA, 25 bp, Rattus norvegicus
ccttccgtatcgaggacccaaatca

SEQ ID NO: 485120 - DNA, 25 bp, Rattus norvegicus
gcccggagtccacagggcgcttaat

SEQ ID NO: 485121 - DNA, 25 bp, Rattus norvegicus
gaagcacacgtgagctccgcagcga

SEQ ID NO: 485122 - DNA, 25 bp, Rattus norvegicus
tgcccgggaacgaggaaccgaatga

SEQ ID NO: 485123 - DNA, 25 bp, Rattus norvegicus
ggtgagcgccatcttcttccgcttc

SEQ ID NO: 485124 - DNA, 25 bp, Rattus norvegicus
gatgtgtactccagacccttccgta

SEQ ID NO: 485125 - DNA, 25 bp, Rattus norvegicus
ctcaggcttttcccggcgtaaactg

SEQ ID NO: 485126 - DNA, 25 bp, Rattus norvegicus
caacaaaactttgtcggcctacttg

SEQ ID NO: 485127 - DNA, 25 bp, Rattus norvegicus
acttggatcgctcaggcttttcccg

SEQ ID NO: 485128 - DNA, 25 bp, Rattus norvegicus
ggcctacttggatcgctcaggcttt

SEQ ID NO: 485129 - DNA, 25 bp, Rattus norvegicus
tgtcggcctacttggatcgctcagg

SEQ ID NO: 485130 - DNA, 25 bp, Rattus norvegicus
gctcgctgctctggctcgaagccgt

SEQ ID NO: 485131 - DNA, 25 bp, Rattus norvegicus
aactttgtcggcctacttggatcgc

SEQ ID NO: 485132 - DNA, 25 bp, Rattus norvegicus
gctctggctcgaagccgttcctgtc

SEQ ID NO: 485133 - DNA, 25 bp, Rattus norvegicus
ccgttcctgtcgctggcgtgcgctg

SEQ ID NO: 485134 - DNA, 25 bp, Rattus norvegicus
ctgggcggagcatgcaaatgaagac

SEQ ID NO: 485135 - DNA, 25 bp, Rattus norvegicus
atgcaaatgaagacgcggccgggtc

SEQ ID NO: 485136 - DNA, 25 bp, Rattus norvegicus
cgcggccgggtctccgcggaactct

SEQ ID NO: 485137 - DNA, 25 bp, Rattus norvegicus
tgggagcgaaaagctcaacaaaact

SEQ ID NO: 485138 - DNA, 25 bp, Rattus norvegicus
gcgtaaactggtggagagggtagaa

SEQ ID NO: 485139 - DNA, 25 bp, Rattus norvegicus
gagtagcagcggcacacagagcccg

SEQ ID NO: 485140 - DNA, 25 bp, Rattus norvegicus
tgtgaccctgtcaccttagcaggcg

SEQ ID NO: 485141 - DNA, 25 bp, Rattus norvegicus
gtcgttagtgtggactggccacttg

SEQ ID NO: 485142 - DNA, 25 bp, Rattus norvegicus
tgccctagcggtcgttagtgtggac

SEQ ID NO: 485143 - DNA, 25 bp, Rattus norvegicus
tgactcttcgctcggtgccctagcg

SEQ ID NO: 485144 - DNA, 25 bp, Rattus norvegicus
ctccgctgtgactcttcgctcggtg

SEQ ID NO: 485145 - DNA, 25 bp, Rattus norvegicus
ttagcaggcgcaaccacgtggttca

SEQ ID NO: 485146 - DNA, 25 bp, Rattus norvegicus
tggccacttgggtggcccaaccttg

SEQ ID NO: 485147 - DNA, 25 bp, Rattus norvegicus
gaaactcgagcctgtgaccctgtca

SEQ ID NO: 485148 - DNA, 25 bp, Rattus norvegicus
cggcaccggcttctgaaggcgctct

SEQ ID NO: 485149 - DNA, 25 bp, Rattus norvegicus
gcgaaggcactgtttcctggagttt

SEQ ID NO: 485150 - DNA, 25 bp, Rattus norvegicus
gcactgtttcctggagtttgggttc

SEQ ID NO: 485151 - DNA, 25 bp, Rattus norvegicus
ccctcgggtgagtagcagcggcaca

SEQ ID NO: 485152 - DNA, 25 bp, Rattus norvegicus
acgtggttcaggtgactctcagtgc

SEQ ID NO: 485153 - DNA, 25 bp, Rattus norvegicus
ttggtttagggacacttgggctgtc

SEQ ID NO: 485154 - DNA, 25 bp, Rattus norvegicus
tgtgggtctcctgcgcgcaagcatg

SEQ ID NO: 485155 - DNA, 25 bp, Rattus norvegicus
tcaccggcgccttggtcgccgagtt

SEQ ID NO: 485156 - DNA, 25 bp, Rattus norvegicus
ctaagcgcagcataaacagccgggc

SEQ ID NO: 485157 - DNA, 25 bp, Rattus norvegicus
gtggacgccctaagcgcagcataaa

SEQ ID NO: 485158 - DNA, 25 bp, Rattus norvegicus
gcgccgaagagtggacgccctaagc

SEQ ID NO: 485159 - DNA, 25 bp, Rattus norvegicus
gtccggtgtgcttacagactcaggg

SEQ ID NO: 485160 - DNA, 25 bp, Rattus norvegicus
tgtgtacgagcagccgcgagctagc

SEQ ID NO: 485161 - DNA, 25 bp, Rattus norvegicus
ctgtcggtgcatggtgcattccaga

SEQ ID NO: 485162 - DNA, 25 bp, Rattus norvegicus
ggtgcatggtgcattccagacaaaa

SEQ ID NO: 485163 - DNA, 25 bp, Rattus norvegicus
tggtgcattccagacaaaaccttca

SEQ ID NO: 485164 - DNA, 25 bp, Rattus norvegicus
attccagacaaaaccttcaccggcg

SEQ ID NO: 485165 - DNA, 25 bp, Rattus norvegicus
cgcagcataaacagccgggcgccta

SEQ ID NO: 485166 - DNA, 25 bp, Rattus norvegicus
caggcagtccggtgtgcttacagac

SEQ ID NO: 485167 - DNA, 25 bp, Rattus norvegicus
tgacgtaggcctgaaaagcaccttc

SEQ ID NO: 485168 - DNA, 25 bp, Rattus norvegicus
ccgagataagtgctttccaaccttc

SEQ ID NO: 485169 - DNA, 25 bp, Rattus norvegicus
cacattgcgttggtgactcttttta

SEQ ID NO: 485170 - DNA, 25 bp, Rattus norvegicus
ctcctggctccggagcgaaatttcg

SEQ ID NO: 485171 - DNA, 25 bp, Rattus norvegicus
cgccattttatccactggggaggaa

SEQ ID NO: 485172 - DNA, 25 bp, Rattus norvegicus
ctggtgcttttgctagtcgaggata

SEQ ID NO: 485173 - DNA, 25 bp, Rattus norvegicus
agcagcgggaagtaggcaaatatca

SEQ ID NO: 485174 - DNA, 25 bp, Rattus norvegicus
ggtggcctagtgatcacattgcgtt

SEQ ID NO: 485175 - DNA, 25 bp, Rattus norvegicus
cccgagtcgccaacggtacagtgtc

SEQ ID NO: 485176 - DNA, 25 bp, Rattus norvegicus
cagccatgatggatcgacccgagtc

SEQ ID NO: 485177 - DNA, 25 bp, Rattus norvegicus
gcggcaatggctctatataaacagg

SEQ ID NO: 485178 - DNA, 25 bp, Rattus norvegicus
tcccatcctggcagagtctatatta

SEQ ID NO: 485179 - DNA, 25 bp, Rattus norvegicus
cgcgctctgcagctctcactattta

SEQ ID NO: 485180 - DNA, 25 bp, Rattus norvegicus
ggactcttgggccactcactgtagg

SEQ ID NO: 485181 - DNA, 25 bp, Rattus norvegicus
acagctgctgcagcttggcgtggtt

SEQ ID NO: 485182 - DNA, 25 bp, Rattus norvegicus
cacaggaagcgacctagccgctcga

SEQ ID NO: 485183 - DNA, 25 bp, Rattus norvegicus
gaacttgcgccgcacgcggtacttg

SEQ ID NO: 485184 - DNA, 25 bp, Rattus norvegicus
ctcccgtataggtcgctcgcagctt

SEQ ID NO: 485185 - DNA, 25 bp, Rattus norvegicus
cctcgatgtagtgcgccttgagcca

SEQ ID NO: 485186 - DNA, 25 bp, Rattus norvegicus
gcgacctagccgctcgatgttgccg

SEQ ID NO: 485187 - DNA, 25 bp, Rattus norvegicus
tgctcgcaggcaggcagcgaccaca

SEQ ID NO: 485188 - DNA, 25 bp, Rattus norvegicus
tttcattcttgtggaggtgctcgca

SEQ ID NO: 485189 - DNA, 25 bp, Rattus norvegicus
ttgagcacgctttcattcttgtgga

SEQ ID NO: 485190 - DNA, 25 bp, Rattus norvegicus
ttgctcctgcgtgaagccgaaggtg

SEQ ID NO: 485191 - DNA, 25 bp, Rattus norvegicus
tgtagtgcgccttgagccacagctg

SEQ ID NO: 485192 - DNA, 25 bp, Rattus norvegicus
gtcgctcgcagcttttttaataata

SEQ ID NO: 485193 - DNA, 25 bp, Rattus norvegicus
cagcttctccgcctcgatgtagtgc

SEQ ID NO: 485194 - DNA, 25 bp, Rattus norvegicus
atattattctaagcgggcatgaggc

SEQ ID NO: 485195 - DNA, 25 bp, Rattus norvegicus
ttagggaacccagagttcgtggcta

SEQ ID NO: 485196 - DNA, 25 bp, Rattus norvegicus
tttatatagcgagccaacaagctgc

SEQ ID NO: 485197 - DNA, 25 bp, Rattus norvegicus
ttgattcgtagagcttaggtcgggc

SEQ ID NO: 485198 - DNA, 25 bp, Rattus norvegicus
gcggagtcatcttttgattcgtaga

SEQ ID NO: 485199 - DNA, 25 bp, Rattus norvegicus
agcgagccaacaagctgcgcgagcc

SEQ ID NO: 485200 - DNA, 25 bp, Rattus norvegicus
ggacagttttaaatgcggagtcatc

SEQ ID NO: 485201 - DNA, 25 bp, Rattus norvegicus
gccgagcgcgagacaccgcgagaac

SEQ ID NO: 485202 - DNA, 25 bp, Rattus norvegicus
acccagagttcgtggctacctagca

SEQ ID NO: 485203 - DNA, 25 bp, Rattus norvegicus
gtcactggacgaggctggtttattt

SEQ ID NO: 485204 - DNA, 25 bp, Rattus norvegicus
agccctagcggaagcgtttcgcggc

SEQ ID NO: 485205 - DNA, 25 bp, Rattus norvegicus
ccaagtctcgcgtgatcacgtggtc

SEQ ID NO: 485206 - DNA, 25 bp, Rattus norvegicus
gccgccttttccaagtctcgcgtga

SEQ ID NO: 485207 - DNA, 25 bp, Rattus norvegicus
agacaccgcgagaaccgcgtgcgca

SEQ ID NO: 485208 - DNA, 25 bp, Rattus norvegicus
ttcgtggctacctagcagggcatcg

SEQ ID NO: 485209 - DNA, 25 bp, Rattus norvegicus
gcaggcatccagagggttgaacaga

SEQ ID NO: 485210 - DNA, 25 bp, Rattus norvegicus
cgttgaggcccaagcggcactcggc

SEQ ID NO: 485211 - DNA, 25 bp, Rattus norvegicus
aaacggcactcgtggagcttgatcc

SEQ ID NO: 485212 - DNA, 25 bp, Rattus norvegicus
cccgttaatgctcgctgctgtcctg

SEQ ID NO: 485213 - DNA, 25 bp, Rattus norvegicus
gggcaaggtcttctcggcaaacacg

SEQ ID NO: 485214 - DNA, 25 bp, Rattus norvegicus
tcattagctcgaaccggcaggcatc

SEQ ID NO: 485215 - DNA, 25 bp, Rattus norvegicus
gttgaacagaatgacccgggaactg

SEQ ID NO: 485216 - DNA, 25 bp, Rattus norvegicus
tgttaaacacgtcctcgtccacgca

SEQ ID NO: 485217 - DNA, 25 bp, Rattus norvegicus
cgcacccgtggaaacggcactcgtg

SEQ ID NO: 485218 - DNA, 25 bp, Rattus norvegicus
cgtggagcttgatccacttggtggt

SEQ ID NO: 485219 - DNA, 25 bp, Rattus norvegicus
atgtcctgccgggagacgatttcgt

SEQ ID NO: 485220 - DNA, 25 bp, Rattus norvegicus
gacgatttcgttccctttgatgagg

SEQ ID NO: 485221 - DNA, 25 bp, Rattus norvegicus
tttgatgaggatgtcgttgaggccc

SEQ ID NO: 485222 - DNA, 25 bp, Rattus norvegicus
gcaaacacggtcctgaacctcatta

SEQ ID NO: 485223 - DNA, 25 bp, Rattus norvegicus
ggctggggtcccgactcagaacacc

SEQ ID NO: 485224 - DNA, 25 bp, Rattus norvegicus
cgggtcgtactcaccagcatcgaga

SEQ ID NO: 485225 - DNA, 25 bp, Rattus norvegicus
agagtcccggagtccgcactgaggt

SEQ ID NO: 485226 - DNA, 25 bp, Rattus norvegicus
agcatcgagatgagcagagtcccgg

SEQ ID NO: 485227 - DNA, 25 bp, Rattus norvegicus
ggttacaggggtctctccacaaaca

SEQ ID NO: 485228 - DNA, 25 bp, Rattus norvegicus
gatctctgcggagaaggcaccggct

SEQ ID NO: 485229 - DNA, 25 bp, Rattus norvegicus
gtcgccctggccgacttggatctct

SEQ ID NO: 485230 - DNA, 25 bp, Rattus norvegicus
gggcgaggcaccatctccaaggaca

SEQ ID NO: 485231 - DNA, 25 bp, Rattus norvegicus
tcagggagcagctctcgccgttcct

SEQ ID NO: 485232 - DNA, 25 bp, Rattus norvegicus
tgtccagcgggcaaagagcctgaga

SEQ ID NO: 485233 - DNA, 25 bp, Rattus norvegicus
caggaaactccatccaaggcccggg

SEQ ID NO: 485234 - DNA, 25 bp, Rattus norvegicus
gcttggcaacgcgttcaggaaactc

SEQ ID NO: 485235 - DNA, 25 bp, Rattus norvegicus
gaggcggtgtccagcaaattgcttg

SEQ ID NO: 485236 - DNA, 25 bp, Rattus norvegicus
cgctcaggacaacgaagtcgccctg

SEQ ID NO: 485237 - DNA, 25 bp, Rattus norvegicus
gaatttccggcacccggaggcagca

SEQ ID NO: 485238 - DNA, 25 bp, Rattus norvegicus
tggtagttctcaacgatgggcagga

SEQ ID NO: 485239 - DNA, 25 bp, Rattus norvegicus
cctctgctgccgcaccagcttcttc

SEQ ID NO: 485240 - DNA, 25 bp, Rattus norvegicus
ataccatgcccggagagtccctctg

SEQ ID NO: 485241 - DNA, 25 bp, Rattus norvegicus
gtgcgctcctagctggtccttggcg

SEQ ID NO: 485242 - DNA, 25 bp, Rattus norvegicus
tcaacgatgggcaggagggacctca

SEQ ID NO: 485243 - DNA, 25 bp, Rattus norvegicus
tctgcttccaggtgcgctcctagct

SEQ ID NO: 485244 - DNA, 25 bp, Rattus norvegicus
tcaagctggtagttctcaacgatgg

SEQ ID NO: 485245 - DNA, 25 bp, Rattus norvegicus
cctcaggatcaagctggtagttctc

SEQ ID NO: 485246 - DNA, 25 bp, Rattus norvegicus
tccgagcctcaggatcaagctggta

SEQ ID NO: 485247 - DNA, 25 bp, Rattus norvegicus
gaaccggtcaccgagtcctccgagc

SEQ ID NO: 485248 - DNA, 25 bp, Rattus norvegicus
ccggaggcagcaccgcagaaccggt

SEQ ID NO: 485249 - DNA, 25 bp, Rattus norvegicus
gtccttggcgccgaatttccggcac

SEQ ID NO: 485250 - DNA, 25 bp, Rattus norvegicus
cctaaaacaataccatgcccggaga

SEQ ID NO: 485251 - DNA, 25 bp, Rattus norvegicus
tggtccgcgcacactctgtgaccga

SEQ ID NO: 485252 - DNA, 25 bp, Rattus norvegicus
cccgcgaattcattacagtaaacat

SEQ ID NO: 485253 - DNA, 25 bp, Rattus norvegicus
ttacagtaaacatctcccgcgaggg

SEQ ID NO: 485254 - DNA, 25 bp, Rattus norvegicus
ggggacctcgctccgagcctacatt

SEQ ID NO: 485255 - DNA, 25 bp, Rattus norvegicus
cctacattaggctgaccgggtccga

SEQ ID NO: 485256 - DNA, 25 bp, Rattus norvegicus
accgggtccgatcccggctgcagtg

SEQ ID NO: 485257 - DNA, 25 bp, Rattus norvegicus
gacgctgcacttggagccagctccg

SEQ ID NO: 485258 - DNA, 25 bp, Rattus norvegicus
cagcgggagaccgagctcggttcca

SEQ ID NO: 485259 - DNA, 25 bp, Rattus norvegicus
cggtttttcagcagtccgggactcg

SEQ ID NO: 485260 - DNA, 25 bp, Rattus norvegicus
cagcagtccgggactcgctcggacg

SEQ ID NO: 485261 - DNA, 25 bp, Rattus norvegicus
cggcggcagaccgagtctagagaaa

SEQ ID NO: 485262 - DNA, 25 bp, Rattus norvegicus
tctagagaaagtggcatgcccgacc

SEQ ID NO: 485263 - DNA, 25 bp, Rattus norvegicus
taggcgacagcaagcaaggcgagcc

SEQ ID NO: 485264 - DNA, 25 bp, Rattus norvegicus
ccgcagacgctgcacttggagccag

SEQ ID NO: 485265 - DNA, 25 bp, Rattus norvegicus
gccagcatcgcgcacaacaacaagg

SEQ ID NO: 485266 - DNA, 25 bp, Rattus norvegicus
cctggccacttgactgcagcagaca

SEQ ID NO: 485267 - DNA, 25 bp, Rattus norvegicus
ctgggaagccttaggtcggctgtta

SEQ ID NO: 485268 - DNA, 25 bp, Rattus norvegicus
ccattttaagtgagggctccgggct

SEQ ID NO: 485269 - DNA, 25 bp, Rattus norvegicus
aacgagtgttccctcgagccctggc

SEQ ID NO: 485270 - DNA, 25 bp, Rattus norvegicus
gacacctgttccttcgagacctctg

SEQ ID NO: 485271 - DNA, 25 bp, Rattus norvegicus
tgccagctcgggttcatctcaagcc

SEQ ID NO: 485272 - DNA, 25 bp, Rattus norvegicus
cacgcggatagtggcgtttgctctc

SEQ ID NO: 485273 - DNA, 25 bp, Rattus norvegicus
gctgactgcgccgatgccatcgaac

SEQ ID NO: 485274 - DNA, 25 bp, Rattus norvegicus
cggtcatgacttttgcttggcgttg

SEQ ID NO: 485275 - DNA, 25 bp, Rattus norvegicus
tcggctgttagccattgtgcgggtc

SEQ ID NO: 485276 - DNA, 25 bp, Rattus norvegicus
ccctgaggaaaaagagcggacggct

SEQ ID NO: 485277 - DNA, 25 bp, Rattus norvegicus
gctgaggaagctttcgccattttaa

SEQ ID NO: 485278 - DNA, 25 bp, Rattus norvegicus
gtcggcgatccagaacgagtgttcc

SEQ ID NO: 485279 - DNA, 25 bp, Rattus norvegicus
ctgcctgcgagtgcggctgactgaa

SEQ ID NO: 485280 - DNA, 25 bp, Rattus norvegicus
tgtgacgtcacgagagggtttttaa

SEQ ID NO: 485281 - DNA, 25 bp, Rattus norvegicus
aaccaggaacctgagcagcggcaca

SEQ ID NO: 485282 - DNA, 25 bp, Rattus norvegicus
cctgagcagcggcacagcaaaatcc

SEQ ID NO: 485283 - DNA, 25 bp, Rattus norvegicus
cggcacagcaaaatccgctggggta

SEQ ID NO: 485284 - DNA, 25 bp, Rattus norvegicus
gcaaaatccgctggggtaggaagct

SEQ ID NO: 485285 - DNA, 25 bp, Rattus norvegicus
ggtgcctggacgatgcaaagacgac

SEQ ID NO: 485286 - DNA, 25 bp, Rattus norvegicus
agacgacgatgccttgcggggtttc

SEQ ID NO: 485287 - DNA, 25 bp, Rattus norvegicus
ccagcgttgtgggtatgcagagctt

SEQ ID NO: 485288 - DNA, 25 bp, Rattus norvegicus
agcccgacccgtatggggctctttg

SEQ ID NO: 485289 - DNA, 25 bp, Rattus norvegicus
cccgtatggggctctttgggcatac

SEQ ID NO: 485290 - DNA, 25 bp, Rattus norvegicus
gctctttgggcatactgcccgaccg

SEQ ID NO: 485291 - DNA, 25 bp, Rattus norvegicus
tgctgattggtttgcgtcatgtgac

SEQ ID NO: 485292 - DNA, 25 bp, Rattus norvegicus
acgatgcaaagacgacgatgccttg

SEQ ID NO: 485293 - DNA, 25 bp, Rattus norvegicus
tgcttctgcagcagcgcggtagaca

SEQ ID NO: 485294 - DNA, 25 bp, Rattus norvegicus
agacacgcttggctgcctggaaggc

SEQ ID NO: 485295 - DNA, 25 bp, Rattus norvegicus
accgcttggcgttggctgcgatctc

SEQ ID NO: 485296 - DNA, 25 bp, Rattus norvegicus
gccttttgttctgggaccgcttggc

SEQ ID NO: 485297 - DNA, 25 bp, Rattus norvegicus
gctaataccagccatgagccttttg

SEQ ID NO: 485298 - DNA, 25 bp, Rattus norvegicus
cgctcctgagcgaagcaggctaata

SEQ ID NO: 485299 - DNA, 25 bp, Rattus norvegicus
gtcacttcatttttggtactccact

SEQ ID NO: 485300 - DNA, 25 bp, Rattus norvegicus
ggtgcctgctctttctcttttgtca

SEQ ID NO: 485301 - DNA, 25 bp, Rattus norvegicus
ctcgatggagttgcagccggagaca

SEQ ID NO: 485302 - DNA, 25 bp, Rattus norvegicus
cgcggctgctacttactggcgcggc

SEQ ID NO: 485303 - DNA, 25 bp, Rattus norvegicus
ggagctcgcggctaaggcgaccctc

SEQ ID NO: 485304 - DNA, 25 bp, Rattus norvegicus
tcgctcggctgagcacagagcactc

SEQ ID NO: 485305 - DNA, 25 bp, Rattus norvegicus
aaagagccgggctgcttctgcagca

SEQ ID NO: 485306 - DNA, 25 bp, Rattus norvegicus
cacccgccgaaagccattggacaga

SEQ ID NO: 485307 - DNA, 25 bp, Rattus norvegicus
cctggcgacggtcactgtggcccat

SEQ ID NO: 485308 - DNA, 25 bp, Rattus norvegicus
cggcttggtccctgtaagaaccaag

SEQ ID NO: 485309 - DNA, 25 bp, Rattus norvegicus
ggcctagagcacacgtccccatatt

SEQ ID NO: 485310 - DNA, 25 bp, Rattus norvegicus
tcataatctgcagccgcggaccggc

SEQ ID NO: 485311 - DNA, 25 bp, Rattus norvegicus
gtccccatattgtgacgtcataatc

SEQ ID NO: 485312 - DNA, 25 bp, Rattus norvegicus
acgtcataatctgcagccgcggacc

SEQ ID NO: 485313 - DNA, 25 bp, Rattus norvegicus
ccgcagaaggactaggcatggatgg

SEQ ID NO: 485314 - DNA, 25 bp, Rattus norvegicus
tccaagtttcacctccgctgcgggg

SEQ ID NO: 485315 - DNA, 25 bp, Rattus norvegicus
ttccaagtttcacctccgctgcggg

SEQ ID NO: 485316 - DNA, 25 bp, Rattus norvegicus
gtctttccaagtttcacctccgctg

SEQ ID NO: 485317 - DNA, 25 bp, Rattus norvegicus
gccaggtctttccaagtttcacctc

SEQ ID NO: 485318 - DNA, 25 bp, Rattus norvegicus
gacggtcactgtggcccattgcgcc

SEQ ID NO: 485319 - DNA, 25 bp, Rattus norvegicus
aaccggcctggcgacggtcactgtg

SEQ ID NO: 485320 - DNA, 25 bp, Rattus norvegicus
gcgggccaggtctttccaagtttca

SEQ ID NO: 485321 - DNA, 25 bp, Rattus norvegicus
gaagactttgctctttgttacgccc

SEQ ID NO: 485322 - DNA, 25 bp, Rattus norvegicus
tcaaaccatgatccagaattaagcc

SEQ ID NO: 485323 - DNA, 25 bp, Rattus norvegicus
agcctggcaagggaagactttgctc

SEQ ID NO: 485324 - DNA, 25 bp, Rattus norvegicus
cagactctttttagaaatgactagg

SEQ ID NO: 485325 - DNA, 25 bp, Rattus norvegicus
tccggaatagaagttccagactctt

SEQ ID NO: 485326 - DNA, 25 bp, Rattus norvegicus
catccgcggaggagtccggaataga

SEQ ID NO: 485327 - DNA, 25 bp, Rattus norvegicus
tgactaggagatcagagcaagcctg

SEQ ID NO: 485328 - DNA, 25 bp, Rattus norvegicus
cgcgtgacctcagagagttggaatg

SEQ ID NO: 485329 - DNA, 25 bp, Rattus norvegicus
gcgcgccgctgctgtttttaaccgt

SEQ ID NO: 485330 - DNA, 25 bp, Rattus norvegicus
gctgctgtttttaaccgtgtgacca

SEQ ID NO: 485331 - DNA, 25 bp, Rattus norvegicus
tgtgaccagttattttaagtttcca

SEQ ID NO: 485332 - DNA, 25 bp, Rattus norvegicus
taagtttccaaataaagcagagctt

SEQ ID NO: 485333 - DNA, 25 bp, Rattus norvegicus
atccagaattaagccgcagccatcc

SEQ ID NO: 485334 - DNA, 25 bp, Rattus norvegicus
tgaaggggaggttattttgagtcca

SEQ ID NO: 485335 - DNA, 25 bp, Rattus norvegicus
cggcaccgagatcagccgcaagatc

SEQ ID NO: 485336 - DNA, 25 bp, Rattus norvegicus
agccatggaaatcggcaccgagatc

SEQ ID NO: 485337 - DNA, 25 bp, Rattus norvegicus
gaccagcagtggtcgccagagcaca

SEQ ID NO: 485338 - DNA, 25 bp, Rattus norvegicus
gcagtggtcgccagagcacaggttc

SEQ ID NO: 485339 - DNA, 25 bp, Rattus norvegicus
tgtgcacacacgcatgcgcgttggc

SEQ ID NO: 485340 - DNA, 25 bp, Rattus norvegicus
acgcatgcgcgttggctcccacttg

SEQ ID NO: 485341 - DNA, 25 bp, Rattus norvegicus
cgcgttggctcccacttgcacgggg

SEQ ID NO: 485342 - DNA, 25 bp, Rattus norvegicus
gttccaggtaaccgaggcgccgcgc

SEQ ID NO: 485343 - DNA, 25 bp, Rattus norvegicus
ctgccgcgtcttctcctcgcgggcc

SEQ ID NO: 485344 - DNA, 25 bp, Rattus norvegicus
cgccgccgagccatggaaatcggca

SEQ ID NO: 485345 - DNA, 25 bp, Rattus norvegicus
atcagccgcaagatccgggtgaggc

SEQ ID NO: 485346 - DNA, 25 bp, Rattus norvegicus
gcctctgactgagcgcaggcgcggc

SEQ ID NO: 485347 - DNA, 25 bp, Rattus norvegicus
cgcggagctgccctctcactgtcgc

SEQ ID NO: 485348 - DNA, 25 bp, Rattus norvegicus
ccgcgcagtgttgacctggccgccc

SEQ ID NO: 485349 - DNA, 25 bp, Rattus norvegicus
gagaaactaccggtagtcttgtgtg

SEQ ID NO: 485350 - DNA, 25 bp, Rattus norvegicus
ccgcggcccgtaccgcccacactcg

SEQ ID NO: 485351 - DNA, 25 bp, Rattus norvegicus
tacggaagttgactcttgcaaggtc

SEQ ID NO: 485352 - DNA, 25 bp, Rattus norvegicus
gatttgctccttgccaggcggggac

SEQ ID NO: 485353 - DNA, 25 bp, Rattus norvegicus
gccaggcggggactcagatttaacc

SEQ ID NO: 485354 - DNA, 25 bp, Rattus norvegicus
agctggacgcctgagaatcaacttc

SEQ ID NO: 485355 - DNA, 25 bp, Rattus norvegicus
taccggtagtcttgtgtggccttta

SEQ ID NO: 485356 - DNA, 25 bp, Rattus norvegicus
ctgagaatcaacttcccggaggatc

SEQ ID NO: 485357 - DNA, 25 bp, Rattus norvegicus
cttgtgtggcctttacggaagttga

SEQ ID NO: 485358 - DNA, 25 bp, Rattus norvegicus
ggcctttacggaagttgactcttgc

SEQ ID NO: 485359 - DNA, 25 bp, Rattus norvegicus
cacactcggcgcgatttgctccttg

SEQ ID NO: 485360 - DNA, 25 bp, Rattus norvegicus
tgcaaggtcggcgacaataaaccgg

SEQ ID NO: 485361 - DNA, 25 bp, Rattus norvegicus
gactcttgcaaggtcggcgacaata

SEQ ID NO: 485362 - DNA, 25 bp, Rattus norvegicus
ttcctttccgagcgggctgcttgcc

SEQ ID NO: 485363 - DNA, 25 bp, Rattus norvegicus
cggagcccgtacctgatgatgtcgt

SEQ ID NO: 485364 - DNA, 25 bp, Rattus norvegicus
acacgatctccttggccgcggtgta

SEQ ID NO: 485365 - DNA, 25 bp, Rattus norvegicus
gaacggtcacgacttccagaaggac

SEQ ID NO: 485366 - DNA, 25 bp, Rattus norvegicus
aggacaggcagctgcaaactcggca

SEQ ID NO: 485367 - DNA, 25 bp, Rattus norvegicus
cgcggtagaacttctgccgatgctc

SEQ ID NO: 485368 - DNA, 25 bp, Rattus norvegicus
cgccacgaagtacacgatctccttg

SEQ ID NO: 485369 - DNA, 25 bp, Rattus norvegicus
gtacacccactcgagccgcaggtgg

SEQ ID NO: 485370 - DNA, 25 bp, Rattus norvegicus
tgacgaaagctctcccgctggcggc

SEQ ID NO: 485371 - DNA, 25 bp, Rattus norvegicus
tcctctaagccgagcccggcaggtg

SEQ ID NO: 485372 - DNA, 25 bp, Rattus norvegicus
gaaaagcctcgcctcaccaaacatg

SEQ ID NO: 485373 - DNA, 25 bp, Rattus norvegicus
accaaacatgctgagggccgcgagc

SEQ ID NO: 485374 - DNA, 25 bp, Rattus norvegicus
gctaggagacaaccaagctaagagg

SEQ ID NO: 485375 - DNA, 25 bp, Rattus norvegicus
tgcggcgctcaggtccagccgctat

SEQ ID NO: 485376 - DNA, 25 bp, Rattus norvegicus
tcagcccagtgcctaggctaggaga

SEQ ID NO: 485377 - DNA, 25 bp, Rattus norvegicus
ccagactcggattgctgaggatgcc

SEQ ID NO: 485378 - DNA, 25 bp, Rattus norvegicus
cactgctggtcagatgtcataaacc

SEQ ID NO: 485379 - DNA, 25 bp, Rattus norvegicus
taaaccttttattggccgcagcgtg

SEQ ID NO: 485380 - DNA, 25 bp, Rattus norvegicus
cagcgtggcgagactaaaacaaatc

SEQ ID NO: 485381 - DNA, 25 bp, Rattus norvegicus
gcccagaaaggcgtgcaaagagtca

SEQ ID NO: 485382 - DNA, 25 bp, Rattus norvegicus
gggatctttgttaggcgcctgttcg

SEQ ID NO: 485383 - DNA, 25 bp, Rattus norvegicus
gagttgatgtgcaccctctgccaga

SEQ ID NO: 485384 - DNA, 25 bp, Rattus norvegicus
gaggatgcctgttccacagacaata

SEQ ID NO: 485385 - DNA, 25 bp, Rattus norvegicus
cgctctccgagtctgaggggaaacc

SEQ ID NO: 485386 - DNA, 25 bp, Rattus norvegicus
accgaggcacgcgaaaccgacagca

SEQ ID NO: 485387 - DNA, 25 bp, Rattus norvegicus
cgacagcacgtcagggcaggaaact

SEQ ID NO: 485388 - DNA, 25 bp, Rattus norvegicus
caggaaactcctgggcgggcaactt

SEQ ID NO: 485389 - DNA, 25 bp, Rattus norvegicus
cgccgagctgcgagaaattgtttcc

SEQ ID NO: 485390 - DNA, 25 bp, Rattus norvegicus
tgccttcagcgcagccgacaaagtt

SEQ ID NO: 485391 - DNA, 25 bp, Rattus norvegicus
ccatgtgaaggcaaaagaaacgttc

SEQ ID NO: 485392 - DNA, 25 bp, Rattus norvegicus
ggcgtgcgtgtgtcttgctttcaat

SEQ ID NO: 485393 - DNA, 25 bp, Rattus norvegicus
tgctttcaatgagaagctagaagcg

SEQ ID NO: 485394 - DNA, 25 bp, Rattus norvegicus
gacagccagatccaaagccgggctt

SEQ ID NO: 485395 - DNA, 25 bp, Rattus norvegicus
gcgtgtgtcttgctttcaatgagaa

SEQ ID NO: 485396 - DNA, 25 bp, Rattus norvegicus
gccgggcttcttgtgccccatgtga

SEQ ID NO: 485397 - DNA, 25 bp, Rattus norvegicus
tgtgaaggcaaaagaaacgttcttg

SEQ ID NO: 485398 - DNA, 25 bp, Rattus norvegicus
ttgaaggaaacgagacgtctgctcc

SEQ ID NO: 485399 - DNA, 25 bp, Rattus norvegicus
acgagacgtctgctccagggaactc

SEQ ID NO: 485400 - DNA, 25 bp, Rattus norvegicus
tgctccagggaactctcgcacgaga

SEQ ID NO: 485401 - DNA, 25 bp, Rattus norvegicus
gaactctcgcacgagaggaagggaa

SEQ ID NO: 485402 - DNA, 25 bp, Rattus norvegicus
agagccgactaagagggcaaacctc

SEQ ID NO: 485403 - DNA, 25 bp, Rattus norvegicus
gggcaaacctcattgctgtcgtgtc

SEQ ID NO: 485404 - DNA, 25 bp, Rattus norvegicus
gccagatccaaagccgggcttcttg

SEQ ID NO: 485405 - DNA, 25 bp, Rattus norvegicus
ctcggagatttcagagtatccggga

SEQ ID NO: 485406 - DNA, 25 bp, Rattus norvegicus
cgctagacagccagcgagctggatt

SEQ ID NO: 485407 - DNA, 25 bp, Rattus norvegicus
cacgagcgggaaagccgtgcagcct

SEQ ID NO: 485408 - DNA, 25 bp, Rattus norvegicus
cggagaaagcggagctcagtgccaa

SEQ ID NO: 485409 - DNA, 25 bp, Rattus norvegicus
ctcagtgccaaagcctgggtgtgca

SEQ ID NO: 485410 - DNA, 25 bp, Rattus norvegicus
tgtgcaaagaaaggcgctggctccc

SEQ ID NO: 485411 - DNA, 25 bp, Rattus norvegicus
tggctcccgccgaattcccagaagg

SEQ ID NO: 485412 - DNA, 25 bp, Rattus norvegicus
agatgctagaatctgcagcccgggc

SEQ ID NO: 485413 - DNA, 25 bp, Rattus norvegicus
atgcacaagcgtggccgagaggttt

SEQ ID NO: 485414 - DNA, 25 bp, Rattus norvegicus
gtttgctccgtgcacctgtggtata

SEQ ID NO: 485415 - DNA, 25 bp, Rattus norvegicus
acctgtggtatagagtgcgcttgca

SEQ ID NO: 485416 - DNA, 25 bp, Rattus norvegicus
gcgcttgcagaaggtaagagacatc

SEQ ID NO: 485417 - DNA, 25 bp, Rattus norvegicus
catcgcgggatcctcggagatttca

SEQ ID NO: 485418 - DNA, 25 bp, Rattus norvegicus
gctggattttccttaccttcgatcg

SEQ ID NO: 485419 - DNA, 25 bp, Rattus norvegicus
tgaggggacgcgcatgcacgtttct

SEQ ID NO: 485420 - DNA, 25 bp, Rattus norvegicus
ggaaaagacgcacggcctcaaggtg

SEQ ID NO: 485421 - DNA, 25 bp, Rattus norvegicus
gcgcatgcacgtttctgccgagttt

SEQ ID NO: 485422 - DNA, 25 bp, Rattus norvegicus
ttctgccgagtttagaccttgccgg

SEQ ID NO: 485423 - DNA, 25 bp, Rattus norvegicus
agaccttgccgggacgatcaactcc

SEQ ID NO: 485424 - DNA, 25 bp, Rattus norvegicus
gatcaactccgtcccttcgaactga

SEQ ID NO: 485425 - DNA, 25 bp, Rattus norvegicus
tcccttcgaactgaaaaagtctcca

SEQ ID NO: 485426 - DNA, 25 bp, Rattus norvegicus
actgaaaaagtctccaagccgtgac

SEQ ID NO: 485427 - DNA, 25 bp, Rattus norvegicus
ccggttacgcccgaggagcgactcg

SEQ ID NO: 485428 - DNA, 25 bp, Rattus norvegicus
gagcgactcggtggctgcgcctttc

SEQ ID NO: 485429 - DNA, 25 bp, Rattus norvegicus
tcagggcccgagcttcccacagaag

SEQ ID NO: 485430 - DNA, 25 bp, Rattus norvegicus
gccatggcaaccgtggcctgccggt

SEQ ID NO: 485431 - DNA, 25 bp, Rattus norvegicus
ctggcgttgctaggagacctgcagc

SEQ ID NO: 485432 - DNA, 25 bp, Rattus norvegicus
agacgcacggcctcaaggtgtgtgc

SEQ ID NO: 485433 - DNA, 25 bp, Rattus norvegicus
tctcccgggccgaaggaggaagatg

SEQ ID NO: 485434 - DNA, 25 bp, Rattus norvegicus
ttctcccgcgggaacgtgccttcga

SEQ ID NO: 485435 - DNA, 25 bp, Rattus norvegicus
atggacgagttctcccgcgggaacg

SEQ ID NO: 485436 - DNA, 25 bp, Rattus norvegicus
accgaatggacgagttctcccgcgg

SEQ ID NO: 485437 - DNA, 25 bp, Rattus norvegicus
gccaccaccgaatggacgagttctc

SEQ ID NO: 485438 - DNA, 25 bp, Rattus norvegicus
gccgccaccaccgaatggacgagtt

SEQ ID NO: 485439 - DNA, 25 bp, Rattus norvegicus
tgcgggtcttcaccaccaacaacgg

SEQ ID NO: 485440 - DNA, 25 bp, Rattus norvegicus
tgctgctgcgggtcttcaccaccaa

SEQ ID NO: 485441 - DNA, 25 bp, Rattus norvegicus
cggagaagccgatcgaccgcgagaa

SEQ ID NO: 485442 - DNA, 25 bp, Rattus norvegicus
gaaattaagaaggagccggagaagc

SEQ ID NO: 485443 - DNA, 25 bp, Rattus norvegicus
ccaggaggaaattaagaaggagccg

SEQ ID NO: 485444 - DNA, 25 bp, Rattus norvegicus
tcgcgcgttacccaggaggaaatta

SEQ ID NO: 485445 - DNA, 25 bp, Rattus norvegicus
tcccgcgggaacgtgccttcgagcg

SEQ ID NO: 485446 - DNA, 25 bp, Rattus norvegicus
atggcggtggaatcgcgcgttaccc

SEQ ID NO: 485447 - DNA, 25 bp, Rattus norvegicus
accgacaccaagaccaagccaggga

SEQ ID NO: 485448 - DNA, 25 bp, Rattus norvegicus
agcgagaacagccactgcggccacg

SEQ ID NO: 485449 - DNA, 25 bp, Rattus norvegicus
ctacttccacccatttcctgcgttc

SEQ ID NO: 485450 - DNA, 25 bp, Rattus norvegicus
tcctgcgttctgaggcgctgatttc

SEQ ID NO: 485451 - DNA, 25 bp, Rattus norvegicus
tctgaggcgctgatttcgcctgctc

SEQ ID NO: 485452 - DNA, 25 bp, Rattus norvegicus
tgatttcgcctgctcgcggcctggc

SEQ ID NO: 485453 - DNA, 25 bp, Rattus norvegicus
ggcgcctgcctctgacaggaacatc

SEQ ID NO: 485454 - DNA, 25 bp, Rattus norvegicus
attggccagcctccgagccactggc

SEQ ID NO: 485455 - DNA, 25 bp, Rattus norvegicus
cagggaagctccttcgctccagcga

SEQ ID NO: 485456 - DNA, 25 bp, Rattus norvegicus
tgggactcaacttcgccgcgcaact

SEQ ID NO: 485457 - DNA, 25 bp, Rattus norvegicus
cttcgccgcgcaactccaacggttc

SEQ ID NO: 485458 - DNA, 25 bp, Rattus norvegicus
ttcgctccagcgagaacagccactg

SEQ ID NO: 485459 - DNA, 25 bp, Rattus norvegicus
ggtcgcgttcccacacctacttcca

SEQ ID NO: 485460 - DNA, 25 bp, Rattus norvegicus
tccaacggttcctcccattggccag

SEQ ID NO: 485461 - DNA, 25 bp, Rattus norvegicus
gctcgtggctgtaactctgcgcccg

SEQ ID NO: 485462 - DNA, 25 bp, Rattus norvegicus
acctgcggtcctggtccttgggacg

SEQ ID NO: 485463 - DNA, 25 bp, Rattus norvegicus
ccggaacctgcggtcctggtccttg

SEQ ID NO: 485464 - DNA, 25 bp, Rattus norvegicus
aaggccagcagggttcggtgtgcac

SEQ ID NO: 485465 - DNA, 25 bp, Rattus norvegicus
ccgatgtggtagtggaaggccagca

SEQ ID NO: 485466 - DNA, 25 bp, Rattus norvegicus
ctggccgctgcgttccgatgtggta

SEQ ID NO: 485467 - DNA, 25 bp, Rattus norvegicus
tctgcgcccgccctcctgatggcgg

SEQ ID NO: 485468 - DNA, 25 bp, Rattus norvegicus
gtctctgctcgtggctgtaactctg

SEQ ID NO: 485469 - DNA, 25 bp, Rattus norvegicus
ttgaactgcgcgcatgcgcggacgc

SEQ ID NO: 485470 - DNA, 25 bp, Rattus norvegicus
cgagtttgaactgcgcgcatgcgcg

SEQ ID NO: 485471 - DNA, 25 bp, Rattus norvegicus
cgcctgcgagtttgaactgcgcgca

SEQ ID NO: 485472 - DNA, 25 bp, Rattus norvegicus
cgcggcgcctgcgagtttgaactgc

SEQ ID NO: 485473 - DNA, 25 bp, Rattus norvegicus
gccgactggcaaagccgcggcgcct

SEQ ID NO: 485474 - DNA, 25 bp, Rattus norvegicus
cgcgctggccgctgcgttccgatgt

SEQ ID NO: 485475 - DNA, 25 bp, Rattus norvegicus
cgaggctctcgacctcttaaacaac

SEQ ID NO: 485476 - DNA, 25 bp, Rattus norvegicus
cctgtggctaaacggctggggacca

SEQ ID NO: 485477 - DNA, 25 bp, Rattus norvegicus
accaggtgtgtctgaagggcacgca

SEQ ID NO: 485478 - DNA, 25 bp, Rattus norvegicus
gaagggcacgcagcgccctcttctg

SEQ ID NO: 485479 - DNA, 25 bp, Rattus norvegicus
cagaacatgcagaccatcgaggctc

SEQ ID NO: 485480 - DNA, 25 bp, Rattus norvegicus
gaccatcgaggctctcgacctctta

SEQ ID NO: 485481 - DNA, 25 bp, Rattus norvegicus
cactccagggatcggcacaaccggg

SEQ ID NO: 485482 - DNA, 25 bp, Rattus norvegicus
ggcacaaccgggtggaagcatcgct

SEQ ID NO: 485483 - DNA, 25 bp, Rattus norvegicus
tggaagcatcgctgctcccttccga

SEQ ID NO: 485484 - DNA, 25 bp, Rattus norvegicus
tcccttccgagctcccggcgatcgc

SEQ ID NO: 485485 - DNA, 25 bp, Rattus norvegicus
gagacctgcgtaggagactggccct

SEQ ID NO: 485486 - DNA, 25 bp, Rattus norvegicus
gccctgaggccaagaggcggacacc

SEQ ID NO: 485487 - DNA, 25 bp, Rattus norvegicus
gcggatatattcgatcccctgtggc

SEQ ID NO: 485488 - DNA, 25 bp, Rattus norvegicus
tcttaaacaaccactccagggatcg

SEQ ID NO: 485489 - DNA, 25 bp, Rattus norvegicus
tcttctccgcgctggagctagcgca

SEQ ID NO: 485490 - DNA, 25 bp, Rattus norvegicus
gtcttcggccttaaggagaactcca

SEQ ID NO: 485491 - DNA, 25 bp, Rattus norvegicus
cggcggcgacaaagcggattcgaaa

SEQ ID NO: 485492 - DNA, 25 bp, Rattus norvegicus
cggattcgaaaccacgagtccaggc

SEQ ID NO: 485493 - DNA, 25 bp, Rattus norvegicus
gagctggctccacaggaacaacgga

SEQ ID NO: 485494 - DNA, 25 bp, Rattus norvegicus
cccgcaggcagagcgggctaagatc

SEQ ID NO: 485495 - DNA, 25 bp, Rattus norvegicus
tccgcagagccggatcttaccaggg

SEQ ID NO: 485496 - DNA, 25 bp, Rattus norvegicus
ggttgtcctccagtgccatggctgg

SEQ ID NO: 485497 - DNA, 25 bp, Rattus norvegicus
cgaccctctggtcttcggccttaag

SEQ ID NO: 485498 - DNA, 25 bp, Rattus norvegicus
ggggctcatcctgctttacctgctg

SEQ ID NO: 485499 - DNA, 25 bp, Rattus norvegicus
ggggccacaacctgagccgcgaaga

SEQ ID NO: 485500 - DNA, 25 bp, Rattus norvegicus
accaaggcgggcatccgcatggaca

SEQ ID NO: 485501 - DNA, 25 bp, Rattus norvegicus
cgccactacgaggaagccaccaagg

SEQ ID NO: 485502 - DNA, 25 bp, Rattus norvegicus
acctgaacgaggacaacgcgcgctt

SEQ ID NO: 485503 - DNA, 25 bp, Rattus norvegicus
ctgaaggaagatggtgagtgactaa

SEQ ID NO: 485504 - DNA, 25 bp, Rattus norvegicus
agcagacctgctgtgacccgatcga

SEQ ID NO: 485505 - DNA, 25 bp, Rattus norvegicus
gacccgatcgagtggtttctgaagg

SEQ ID NO: 485506 - DNA, 25 bp, Rattus norvegicus
tgtctcactcctcggcggacgcggg

SEQ ID NO: 485507 - DNA, 25 bp, Rattus norvegicus
cgggtcggagcgtgtctcactcctc

SEQ ID NO: 485508 - DNA, 25 bp, Rattus norvegicus
tcgggttcatcgcagcccgcgggtc

SEQ ID NO: 485509 - DNA, 25 bp, Rattus norvegicus
cgatccggcgctcgggttcatcgca

SEQ ID NO: 485510 - DNA, 25 bp, Rattus norvegicus
gtagtcccgggtaccgaagcgctgc

SEQ ID NO: 485511 - DNA, 25 bp, Rattus norvegicus
gagctacggagcagacctgctgtga

SEQ ID NO: 485512 - DNA, 25 bp, Rattus norvegicus
tgactaagggtttcggctggtagtc

SEQ ID NO: 485513 - DNA, 25 bp, Rattus norvegicus
cgacttggacgactgaaggaagatg

SEQ ID NO: 485514 - DNA, 25 bp, Rattus norvegicus
tgagccgcagaaccagcgtagtata

SEQ ID NO: 485515 - DNA, 25 bp, Rattus norvegicus
cgtagtatatatccgccgacggctc

SEQ ID NO: 485516 - DNA, 25 bp, Rattus norvegicus
acggctcagcgttctccggtttggt

SEQ ID NO: 485517 - DNA, 25 bp, Rattus norvegicus
ctccaagagcgtttggaggccctta

SEQ ID NO: 485518 - DNA, 25 bp, Rattus norvegicus
tgtagacacaatgtgcgagcgccgc

SEQ ID NO: 485519 - DNA, 25 bp, Rattus norvegicus
tcctgggcagtttgttgtagacaca

SEQ ID NO: 485520 - DNA, 25 bp, Rattus norvegicus
accgcggccatacccgggatcttgt

SEQ ID NO: 485521 - DNA, 25 bp, Rattus norvegicus
aacgaaaagagagagcaccgggctc

SEQ ID NO: 485522 - DNA, 25 bp, Rattus norvegicus
taaagcagatgatccgcctgggagg

SEQ ID NO: 485523 - DNA, 25 bp, Rattus norvegicus
gcaggtggtgttttaggcgactaaa

SEQ ID NO: 485524 - DNA, 25 bp, Rattus norvegicus
gtctctcccgtgattgctgctcagg

SEQ ID NO: 485525 - DNA, 25 bp, Rattus norvegicus
cggtgcgcctttggacaccgctgca

SEQ ID NO: 485526 - DNA, 25 bp, Rattus norvegicus
ccagcatccggagaagggccggttc

SEQ ID NO: 485527 - DNA, 25 bp, Rattus norvegicus
gggccggttcatggaattttcagga

SEQ ID NO: 485528 - DNA, 25 bp, Rattus norvegicus
tttccgcgggacagtagagtgactg

SEQ ID NO: 485529 - DNA, 25 bp, Rattus norvegicus
tagagtgactgtgcgttcctgggca

SEQ ID NO: 485530 - DNA, 25 bp, Rattus norvegicus
cccgggatcttgtgcgaacgaaaag

SEQ ID NO: 485531 - DNA, 25 bp, Rattus norvegicus
gctgccagggaacctcctctgagtt

SEQ ID NO: 485532 - DNA, 25 bp, Rattus norvegicus
tggctaggccgtgcaacctcggtcc

SEQ ID NO: 485533 - DNA, 25 bp, Rattus norvegicus
cgcctctagggctggactctacagt

SEQ ID NO: 485534 - DNA, 25 bp, Rattus norvegicus
gtccgtggtgccgttactcgcagtc

SEQ ID NO: 485535 - DNA, 25 bp, Rattus norvegicus
tgcccaagctttctgaacagatttg

SEQ ID NO: 485536 - DNA, 25 bp, Rattus norvegicus
ttgccaggtgttacgcagcagcagc

SEQ ID NO: 485537 - DNA, 25 bp, Rattus norvegicus
cggctgaggctcagcgcacaacgca

SEQ ID NO: 485538 - DNA, 25 bp, Rattus norvegicus
ctcctctgagttttggacgcctcta

SEQ ID NO: 485539 - DNA, 25 bp, Rattus norvegicus
ccttcgctcgcaccatggtaggttg

SEQ ID NO: 485540 - DNA, 25 bp, Rattus norvegicus
gacgtcccggtagccagtccctgat

SEQ ID NO: 485541 - DNA, 25 bp, Rattus norvegicus
cctgatcgcggagaatgaatgggtc

SEQ ID NO: 485542 - DNA, 25 bp, Rattus norvegicus
cgtacaggacttggaccgcgaactc

SEQ ID NO: 485543 - DNA, 25 bp, Rattus norvegicus
cagacgtagcagctgcccaagcttt

SEQ ID NO: 485544 - DNA, 25 bp, Rattus norvegicus
atttcgggtttgcatctccgccttg

SEQ ID NO: 485545 - DNA, 25 bp, Rattus norvegicus
gggatccgctcccattggcactcgg

SEQ ID NO: 485546 - DNA, 25 bp, Rattus norvegicus
cgcgcgtaccgttggcgataagctt

SEQ ID NO: 485547 - DNA, 25 bp, Rattus norvegicus
aggactctagggctccaacacagcc

SEQ ID NO: 485548 - DNA, 25 bp, Rattus norvegicus
caccctgcacgtcaggactctaggg

SEQ ID NO: 485549 - DNA, 25 bp, Rattus norvegicus
cgcccgcgcgtaccgttggcgataa

SEQ ID NO: 485550 - DNA, 25 bp, Rattus norvegicus
ccgttggcgataagcttggccgaca

SEQ ID NO: 485551 - DNA, 25 bp, Rattus norvegicus
agcttggccgacagctgcttgacga

SEQ ID NO: 485552 - DNA, 25 bp, Rattus norvegicus
tggccgacagctgcttgacgagctc

SEQ ID NO: 485553 - DNA, 25 bp, Rattus norvegicus
acgtcaggactctagggctccaaca

SEQ ID NO: 485554 - DNA, 25 bp, Rattus norvegicus
acgagctcggggatccgctcccatt

SEQ ID NO: 485555 - DNA, 25 bp, Rattus norvegicus
tcccattggcactcggagcggcagc

SEQ ID NO: 485556 - DNA, 25 bp, Rattus norvegicus
gagcggcagcgctcgatctccgtct

SEQ ID NO: 485557 - DNA, 25 bp, Rattus norvegicus
tctccagccgcgagcccgccttcct

SEQ ID NO: 485558 - DNA, 25 bp, Rattus norvegicus
agctgcttgacgagctcggggatcc

SEQ ID NO: 485559 - DNA, 25 bp, Rattus norvegicus
cccgctgctcgaattgttgttgctt

SEQ ID NO: 485560 - DNA, 25 bp, Rattus norvegicus
gctccggacctctaattggctactg

SEQ ID NO: 485561 - DNA, 25 bp, Rattus norvegicus
tgtcacccacgtgtttacgcgcgcg

SEQ ID NO: 485562 - DNA, 25 bp, Rattus norvegicus
cctggagggaagcacttgtcaccca

SEQ ID NO: 485563 - DNA, 25 bp, Rattus norvegicus
cgcttgatccgccaatcaccgtgga

SEQ ID NO: 485564 - DNA, 25 bp, Rattus norvegicus
ctccgacactgaggcgagtctcttt

SEQ ID NO: 485565 - DNA, 25 bp, Rattus norvegicus
cccagcttcgatctgttagtaaaca

SEQ ID NO: 485566 - DNA, 25 bp, Rattus norvegicus
ccacctattcgctttagtacgcatg

SEQ ID NO: 485567 - DNA, 25 bp, Rattus norvegicus
ctccgattggcaagacccacgattc

SEQ ID NO: 485568 - DNA, 25 bp, Rattus norvegicus
ggtccgcagctcatgcttgacagta

SEQ ID NO: 485569 - DNA, 25 bp, Rattus norvegicus
cggccgttcctgacgtttcacgagc

SEQ ID NO: 485570 - DNA, 25 bp, Rattus norvegicus
gctctgatgggaacctgatgggaca

SEQ ID NO: 485571 - DNA, 25 bp, Rattus norvegicus
cttgacagtaaggagctgctcgccg

SEQ ID NO: 485572 - DNA, 25 bp, Rattus norvegicus
tcaccgtggacaaaggagggtcctg

SEQ ID NO: 485573 - DNA, 25 bp, Rattus norvegicus
acaccagaccctgagcttcggagca

SEQ ID NO: 485574 - DNA, 25 bp, Rattus norvegicus
tgcagttcacactgaccgcaggcca

SEQ ID NO: 485575 - DNA, 25 bp, Rattus norvegicus
gtcacgctgtgcgagattcctcccg

SEQ ID NO: 485576 - DNA, 25 bp, Rattus norvegicus
acggcctaatgtcctccggtgcggt

SEQ ID NO: 485577 - DNA, 25 bp, Rattus norvegicus
cgacagtctgggacgacggcctaat

SEQ ID NO: 485578 - DNA, 25 bp, Rattus norvegicus
ggaacacgtacctgcgccgcgacag

SEQ ID NO: 485579 - DNA, 25 bp, Rattus norvegicus
ggagcaggacccagaacccaccaga

SEQ ID NO: 485580 - DNA, 25 bp, Rattus norvegicus
gcttctgctcggcacaagcgtctgc

SEQ ID NO: 485581 - DNA, 25 bp, Rattus norvegicus
caccgcacgcacacggtactgtttg

SEQ ID NO: 485582 - DNA, 25 bp, Rattus norvegicus
gtcagtcatttctgcgggtccaccg

SEQ ID NO: 485583 - DNA, 25 bp, Rattus norvegicus
cagatatccctggtggcttcggtca

SEQ ID NO: 485584 - DNA, 25 bp, Rattus norvegicus
cgaccgcataaggagacaccggacc

SEQ ID NO: 485585 - DNA, 25 bp, Rattus norvegicus
tgctaaacctggtggcgaccgcata

SEQ ID NO: 485586 - DNA, 25 bp, Rattus norvegicus
gccctggtaagccagcgacccgtga

SEQ ID NO: 485587 - DNA, 25 bp, Rattus norvegicus
gcgcgctgagtgtaaacgttaagga

SEQ ID NO: 485588 - DNA, 25 bp, Rattus norvegicus
gtcctaatgggctcggaacctggcc

SEQ ID NO: 485589 - DNA, 25 bp, Rattus norvegicus
cgacccggaagtggaagctgtaact

SEQ ID NO: 485590 - DNA, 25 bp, Rattus norvegicus
aacaagagacgtgtgccgacccgga

SEQ ID NO: 485591 - DNA, 25 bp, Rattus norvegicus
atccatacggagacagacaactttc

SEQ ID NO: 485592 - DNA, 25 bp, Rattus norvegicus
agaacttcctgccagatctctctga

SEQ ID NO: 485593 - DNA, 25 bp, Rattus norvegicus
acgtctttcgggttcccttgcatag

SEQ ID NO: 485594 - DNA, 25 bp, Rattus norvegicus
ctgtaacttcgcgttctggccgacc

SEQ ID NO: 485595 - DNA, 25 bp, Rattus norvegicus
attcagtgagtctggccgtctgtga

SEQ ID NO: 485596 - DNA, 25 bp, Rattus norvegicus
cttgcataggtcacggtcgccctct

SEQ ID NO: 485597 - DNA, 25 bp, Rattus norvegicus
acgtaaaggcaagggagtcctctca

SEQ ID NO: 485598 - DNA, 25 bp, Rattus norvegicus
gccctctgctgacgtagtgcggaaa

SEQ ID NO: 485599 - DNA, 25 bp, Rattus norvegicus
tctggccgaccggaaggagaccaaa

SEQ ID NO: 485600 - DNA, 25 bp, Rattus norvegicus
ggccgccactcaacgtacaacttaa

SEQ ID NO: 485601 - DNA, 25 bp, Rattus norvegicus
cccggtacttcttcgcaggcagcaa

SEQ ID NO: 485602 - DNA, 25 bp, Rattus norvegicus
tggaaagcagcacgctcagctcagc

SEQ ID NO: 485603 - DNA, 25 bp, Rattus norvegicus
aggcagcaagcctatccttcccgag

SEQ ID NO: 485604 - DNA, 25 bp, Rattus norvegicus
cagacgcgggacaggaggaaaactt

SEQ ID NO: 485605 - DNA, 25 bp, Rattus norvegicus
agagcgcgaggaaaatacagaaata

SEQ ID NO: 485606 - DNA, 25 bp, Rattus norvegicus
cgcgtctcagaagcactggaaagca

SEQ ID NO: 485607 - DNA, 25 bp, Rattus norvegicus
aggtcaccagcggactctgcagaaa

SEQ ID NO: 485608 - DNA, 25 bp, Rattus norvegicus
agctcaacgagctgcgacaccgtca

SEQ ID NO: 485609 - DNA, 25 bp, Rattus norvegicus
tgcgacaccgtcacgtccatgctga

SEQ ID NO: 485610 - DNA, 25 bp, Rattus norvegicus
ggctcagtgttatcctcaggctgca

SEQ ID NO: 485611 - DNA, 25 bp, Rattus norvegicus
tctcccttccagaagttccttcagg

SEQ ID NO: 485612 - DNA, 25 bp, Rattus norvegicus
agttccttcaggatgctggcgctgt

SEQ ID NO: 485613 - DNA, 25 bp, Rattus norvegicus
atagcacaccgtggtggagagcccg

SEQ ID NO: 485614 - DNA, 25 bp, Rattus norvegicus
ttcaacaaattcctcgcgtctcaga

SEQ ID NO: 485615 - DNA, 25 bp, Rattus norvegicus
gcgctgctctgcacgtactgtcgtg

SEQ ID NO: 485616 - DNA, 25 bp, Rattus norvegicus
tcctcgttgagcgtgtagaccttca

SEQ ID NO: 485617 - DNA, 25 bp, Rattus norvegicus
cgcttctggccaccggagaactctt

SEQ ID NO: 485618 - DNA, 25 bp, Rattus norvegicus
agccggaggacacatggccagtacc

SEQ ID NO: 485619 - DNA, 25 bp, Rattus norvegicus
cacttaaagagacaggaccggagcc

SEQ ID NO: 485620 - DNA, 25 bp, Rattus norvegicus
ttcagcctctccacgtagccggagg

SEQ ID NO: 485621 - DNA, 25 bp, Rattus norvegicus
gagaactcttggctcctcttagaag

SEQ ID NO: 485622 - DNA, 25 bp, Rattus norvegicus
tcccgggagactctgaacgcttctg

SEQ ID NO: 485623 - DNA, 25 bp, Rattus norvegicus
tccgaagccgacgaggtagcacttc

SEQ ID NO: 485624 - DNA, 25 bp, Rattus norvegicus
tcccgcttagagcatccgaagccga

SEQ ID NO: 485625 - DNA, 25 bp, Rattus norvegicus
cgccgccatgttttccttccttgta

SEQ ID NO: 485626 - DNA, 25 bp, Rattus norvegicus
cggcgctattgtccaggccgagtga

SEQ ID NO: 485627 - DNA, 25 bp, Rattus norvegicus
gcgtccgtcgcatcctgtattcgtc

SEQ ID NO: 485628 - DNA, 25 bp, Rattus norvegicus
ttccgtcttcctcacagagccaaag

SEQ ID NO: 485629 - DNA, 25 bp, Rattus norvegicus
agccagcgacgggtaactgaagcca

SEQ ID NO: 485630 - DNA, 25 bp, Rattus norvegicus
agaactccggggcacaaggccgctc

SEQ ID NO: 485631 - DNA, 25 bp, Rattus norvegicus
aactgaagccagaggctctgcttta

SEQ ID NO: 485632 - DNA, 25 bp, Rattus norvegicus
caccgtttcagccagcgacgggtaa

SEQ ID NO: 485633 - DNA, 25 bp, Rattus norvegicus
cctaggaggcgctccaccgtttcag

SEQ ID NO: 485634 - DNA, 25 bp, Rattus norvegicus
aggcacacctgcgtcgccgaggtct

SEQ ID NO: 485635 - DNA, 25 bp, Rattus norvegicus
cgcgacccttgacagaagctaacta

SEQ ID NO: 485636 - DNA, 25 bp, Rattus norvegicus
taggcccacgcgacccttgacagaa

SEQ ID NO: 485637 - DNA, 25 bp, Rattus norvegicus
cacagcaggcgtcaggaggagtctc

SEQ ID NO: 485638 - DNA, 25 bp, Rattus norvegicus
gttcgcctcgtcaggccggagcgca

SEQ ID NO: 485639 - DNA, 25 bp, Rattus norvegicus
tcaggtaaagtcttgcgggctgctc

SEQ ID NO: 485640 - DNA, 25 bp, Rattus norvegicus
tctgctttagcagcgctcagttcct

SEQ ID NO: 485641 - DNA, 25 bp, Rattus norvegicus
cagaagctaactaaagaggctcaga

SEQ ID NO: 485642 - DNA, 25 bp, Rattus norvegicus
gggtctcagaagcttctcaggtaaa

SEQ ID NO: 485643 - DNA, 25 bp, Rattus norvegicus
gcttcaccaagggttcaccgctatg

SEQ ID NO: 485644 - DNA, 25 bp, Rattus norvegicus
aaatgtccctggacgccgaagctgg

SEQ ID NO: 485645 - DNA, 25 bp, Rattus norvegicus
gggtggacacgtccgctccaaatgt

SEQ ID NO: 485646 - DNA, 25 bp, Rattus norvegicus
ttgaccaagagactggcccaagccg

SEQ ID NO: 485647 - DNA, 25 bp, Rattus norvegicus
ccttcgtgaagtttgaaatctggcc

SEQ ID NO: 485648 - DNA, 25 bp, Rattus norvegicus
cgtcagaaaaccgaggcccggcctg

SEQ ID NO: 485649 - DNA, 25 bp, Rattus norvegicus
gtgcggctgcaccacttctttctca

SEQ ID NO: 485650 - DNA, 25 bp, Rattus norvegicus
tcgtgggccagtcctgccaactcaa

SEQ ID NO: 485651 - DNA, 25 bp, Rattus norvegicus
ggcggcgaccatagagaagtttcac

SEQ ID NO: 485652 - DNA, 25 bp, Rattus norvegicus
gctgttacctggcacatcctccgtg

SEQ ID NO: 485653 - DNA, 25 bp, Rattus norvegicus
tttcacgatggcgtagaagggccgc

SEQ ID NO: 485654 - DNA, 25 bp, Rattus norvegicus
ctgcggaactttaggtggagactga

SEQ ID NO: 485655 - DNA, 25 bp, Rattus norvegicus
tgactttcctcagtttcgtgggcca

SEQ ID NO: 485656 - DNA, 25 bp, Rattus norvegicus
cggatccagacgctgaggactcgca

SEQ ID NO: 485657 - DNA, 25 bp, Rattus norvegicus
ctgctgtgcggaggaacttctctac

SEQ ID NO: 485658 - DNA, 25 bp, Rattus norvegicus
gcccgcgctaatcctccggatgaag

SEQ ID NO: 485659 - DNA, 25 bp, Rattus norvegicus
agacgcatgcgggaggcttcatgaa

SEQ ID NO: 485660 - DNA, 25 bp, Rattus norvegicus
cgggaggcttcatgaacggtgccat

SEQ ID NO: 485661 - DNA, 25 bp, Rattus norvegicus
ctcacccagccaagtcgggatgggg

SEQ ID NO: 485662 - DNA, 25 bp, Rattus norvegicus
ccaccgaacgcccacactcactttc

SEQ ID NO: 485663 - DNA, 25 bp, Rattus norvegicus
ttctcgtggaagatggactccatgt

SEQ ID NO: 485664 - DNA, 25 bp, Rattus norvegicus
gatggactccatgtttatttgtctg

SEQ ID NO: 485665 - DNA, 25 bp, Rattus norvegicus
ccatgtttatttgtctggagccaac

SEQ ID NO: 485666 - DNA, 25 bp, Rattus norvegicus
tttatttgtctggagccaacggccc

SEQ ID NO: 485667 - DNA, 25 bp, Rattus norvegicus
cgtgcctcccgccacccaatcacta

SEQ ID NO: 485668 - DNA, 25 bp, Rattus norvegicus
tactgcgggcgcacgtcacgcggca

SEQ ID NO: 485669 - DNA, 25 bp, Rattus norvegicus
ctcccgccgcgtgtgtgatgctgcg

SEQ ID NO: 485670 - DNA, 25 bp, Rattus norvegicus
aagtgaacaagaaacgcccgcgcta

SEQ ID NO: 485671 - DNA, 25 bp, Rattus norvegicus
tccgtctccgtggttcctggaacaa

SEQ ID NO: 485672 - DNA, 25 bp, Rattus norvegicus
cgagtgagtcctctacattttgagc

SEQ ID NO: 485673 - DNA, 25 bp, Rattus norvegicus
ctccgacttgcgttccactaggggt

SEQ ID NO: 485674 - DNA, 25 bp, Rattus norvegicus
taggtctactcgctctccgacttgc

SEQ ID NO: 485675 - DNA, 25 bp, Rattus norvegicus
acacagaggctcctgccggctgttc

SEQ ID NO: 485676 - DNA, 25 bp, Rattus norvegicus
aagatggcggccaccacacagaggc

SEQ ID NO: 485677 - DNA, 25 bp, Rattus norvegicus
ttggatccaagctgacaaggtttgc

SEQ ID NO: 485678 - DNA, 25 bp, Rattus norvegicus
tggcgatggccaatcgacgcctctc

SEQ ID NO: 485679 - DNA, 25 bp, Rattus norvegicus
gaagccgtgacccaaggagctgcca

SEQ ID NO: 485680 - DNA, 25 bp, Rattus norvegicus
accttcagcccggtgtcaagcgcga

SEQ ID NO: 485681 - DNA, 25 bp, Rattus norvegicus
tgacagcgcgcagaggtcacccgaa

SEQ ID NO: 485682 - DNA, 25 bp, Rattus norvegicus
tctctgtgaaaggtgtgaagctgac

SEQ ID NO: 485683 - DNA, 25 bp, Rattus norvegicus
agctagcatagcgaattctctgtga

SEQ ID NO: 485684 - DNA, 25 bp, Rattus norvegicus
gcttggcgccgtcactttccctgaa

SEQ ID NO: 485685 - DNA, 25 bp, Rattus norvegicus
agacaccgtcatctgctctgcagtc

SEQ ID NO: 485686 - DNA, 25 bp, Rattus norvegicus
ccagtgtttgtgcagctgggatctc

SEQ ID NO: 485687 - DNA, 25 bp, Rattus norvegicus
cggacgaatgctgtgaaaccagtgc

SEQ ID NO: 485688 - DNA, 25 bp, Rattus norvegicus
tggaggcagtcacccaccctagggt

SEQ ID NO: 485689 - DNA, 25 bp, Rattus norvegicus
ccgccgctgagcgattcccgaagag

SEQ ID NO: 485690 - DNA, 25 bp, Rattus norvegicus
tccgggcagaccaaacagggtaggc

SEQ ID NO: 485691 - DNA, 25 bp, Rattus norvegicus
agaaagccctctggctgcggacccg

SEQ ID NO: 485692 - DNA, 25 bp, Rattus norvegicus
acccgagtgtagagaggttcccatg

SEQ ID NO: 485693 - DNA, 25 bp, Rattus norvegicus
aggttcccatggtttctggcgactg

SEQ ID NO: 485694 - DNA, 25 bp, Rattus norvegicus
agcctggggctcacaaagttcaaga

SEQ ID NO: 485695 - DNA, 25 bp, Rattus norvegicus
tgcagtctcggtatcaagctccacg

SEQ ID NO: 485696 - DNA, 25 bp, Rattus norvegicus
aatagaacctagagacgccgggcgc

SEQ ID NO: 485697 - DNA, 25 bp, Rattus norvegicus
caagctcccaggtctggagtgactc

SEQ ID NO: 485698 - DNA, 25 bp, Rattus norvegicus
gggcagtttcgttgcgcccatctgc

SEQ ID NO: 485699 - DNA, 25 bp, Rattus norvegicus
gtgcctgccttgctcgcagaccatg

SEQ ID NO: 485700 - DNA, 25 bp, Rattus norvegicus
agcactgattgctcccggtggactc

SEQ ID NO: 485701 - DNA, 25 bp, Rattus norvegicus
atgctgccgcagcaagttggcttcg

SEQ ID NO: 485702 - DNA, 25 bp, Rattus norvegicus
ccgtggactcatccggcagtgcaaa

SEQ ID NO: 485703 - DNA, 25 bp, Rattus norvegicus
acggagatggcgctccgtggactca

SEQ ID NO: 485704 - DNA, 25 bp, Rattus norvegicus
gcagaccatgaaactatctcccgga

SEQ ID NO: 485705 - DNA, 25 bp, Rattus norvegicus
tcctctggtattcccatccggacta

SEQ ID NO: 485706 - DNA, 25 bp, Rattus norvegicus
cggaactctgagctccggccgtgca

SEQ ID NO: 485707 - DNA, 25 bp, Rattus norvegicus
ggactgcgccaagccgaccagcagg

SEQ ID NO: 485708 - DNA, 25 bp, Rattus norvegicus
ggcgctcgccaagcactgattgctc

SEQ ID NO: 485709 - DNA, 25 bp, Rattus norvegicus
tgctttccgagcagaggagcctcgc

SEQ ID NO: 485710 - DNA, 25 bp, Rattus norvegicus
gtggtcctcctgcacgcacttggct

SEQ ID NO: 485711 - DNA, 25 bp, Rattus norvegicus
tccaacccttgaagctccggatctt

SEQ ID NO: 485712 - DNA, 25 bp, Rattus norvegicus
gtctcctcgccacggagtcatggtg

SEQ ID NO: 485713 - DNA, 25 bp, Rattus norvegicus
taagggccacgctgcccggtgccaa

SEQ ID NO: 485714 - DNA, 25 bp, Rattus norvegicus
gcgactgccgcacttagccaaactt

SEQ ID NO: 485715 - DNA, 25 bp, Rattus norvegicus
ttgttaactggaaaagccgcgcacg

SEQ ID NO: 485716 - DNA, 25 bp, Rattus norvegicus
ccagtagggaccaagaccggacctg

SEQ ID NO: 485717 - DNA, 25 bp, Rattus norvegicus
acatcgtgggtgtcatgctgaaatg

SEQ ID NO: 485718 - DNA, 25 bp, Rattus norvegicus
tagtgctctgggctatgggacatcg

SEQ ID NO: 485719 - DNA, 25 bp, Rattus norvegicus
gtcctgccctttgctcagcttggtc

SEQ ID NO: 485720 - DNA, 25 bp, Rattus norvegicus
agcgcccaccctgccgggtaagtgg

SEQ ID NO: 485721 - DNA, 25 bp, Rattus norvegicus
gcttctgacaaaaaacccttgacca

SEQ ID NO: 485722 - DNA, 25 bp, Rattus norvegicus
gccgcggccgaatggcttctgacaa

SEQ ID NO: 485723 - DNA, 25 bp, Rattus norvegicus
gccacagttcgtgttgtcctcgacc

SEQ ID NO: 485724 - DNA, 25 bp, Rattus norvegicus
ccggacctgggttctgcaaggaaag

SEQ ID NO: 485725 - DNA, 25 bp, Rattus norvegicus
gtgccaacttggaaactttcctgtg

SEQ ID NO: 485726 - DNA, 25 bp, Rattus norvegicus
tgtgagttttcctcgcaggctctgg

SEQ ID NO: 485727 - DNA, 25 bp, Rattus norvegicus
acatcttcgttaggaaacaccagga

SEQ ID NO: 485728 - DNA, 25 bp, Rattus norvegicus
acggtgagcccgagaagccctcgct

SEQ ID NO: 485729 - DNA, 25 bp, Rattus norvegicus
cggggcccactgtcaagagaggaca

SEQ ID NO: 485730 - DNA, 25 bp, Rattus norvegicus
aacaaatacatgatcccggggccca

SEQ ID NO: 485731 - DNA, 25 bp, Rattus norvegicus
ggtcggtgaagtaaacaaatacatg

SEQ ID NO: 485732 - DNA, 25 bp, Rattus norvegicus
acaccaggattccagtggctccgtg

SEQ ID NO: 485733 - DNA, 25 bp, Rattus norvegicus
gacgacaacgaccaggacggtgatg

SEQ ID NO: 485734 - DNA, 25 bp, Rattus norvegicus
agcagaactcacatcttcgttagga

SEQ ID NO: 485735 - DNA, 25 bp, Rattus norvegicus
aagccctcgcttcccaccgcagttt

SEQ ID NO: 485736 - DNA, 25 bp, Rattus norvegicus
cgatcaaaacggtaaagcagaactc

SEQ ID NO: 485737 - DNA, 25 bp, Rattus norvegicus
cgacacaaacctacgatcaaaacgg

SEQ ID NO: 485738 - DNA, 25 bp, Rattus norvegicus
gtgatgacgacacaaacctacgatc

SEQ ID NO: 485739 - DNA, 25 bp, Rattus norvegicus
cgaccaggacggtgatgacgacaca

SEQ ID NO: 485740 - DNA, 25 bp, Rattus norvegicus
gctccgtggtcggtgaagtaaacaa

SEQ ID NO: 485741 - DNA, 25 bp, Rattus norvegicus
tagctgtaactcgatgcgacacatc

SEQ ID NO: 485742 - DNA, 25 bp, Rattus norvegicus
gaactgaagccaggtgcgacaccca

SEQ ID NO: 485743 - DNA, 25 bp, Rattus norvegicus
atggagactcgcctgccgttttcac

SEQ ID NO: 485744 - DNA, 25 bp, Rattus norvegicus
tggctctgcaacctgtgccctgttc

SEQ ID NO: 485745 - DNA, 25 bp, Rattus norvegicus
tccgtggtaggcacggctttgcaaa

SEQ ID NO: 485746 - DNA, 25 bp, Rattus norvegicus
tttgcaaacttgagaacgtgcctta

SEQ ID NO: 485747 - DNA, 25 bp, Rattus norvegicus
gtcccggagctagtctaggtcaccc

SEQ ID NO: 485748 - DNA, 25 bp, Rattus norvegicus
tgcctgcaatttgttgggtaaaacc

SEQ ID NO: 485749 - DNA, 25 bp, Rattus norvegicus
aagccagcacgtcctcatcgggagg

SEQ ID NO: 485750 - DNA, 25 bp, Rattus norvegicus
gtggggacactgacatcgcttcacc

SEQ ID NO: 485751 - DNA, 25 bp, Rattus norvegicus
gatccgctgacttatcctcactggg

SEQ ID NO: 485752 - DNA, 25 bp, Rattus norvegicus
cgtcgatgatctacaggccagggta

SEQ ID NO: 485753 - DNA, 25 bp, Rattus norvegicus
gagctactgcggagcgccaaacacc

SEQ ID NO: 485754 - DNA, 25 bp, Rattus norvegicus
acgcaagctctctcagacgccagga

SEQ ID NO: 485755 - DNA, 25 bp, Rattus norvegicus
cgatcgcgaggctttggatcggaca

SEQ ID NO: 485756 - DNA, 25 bp, Rattus norvegicus
cacaactaaagtggcggggctaggc

SEQ ID NO: 485757 - DNA, 25 bp, Rattus norvegicus
ttccgcagcttcacctgaggtcggg

SEQ ID NO: 485758 - DNA, 25 bp, Rattus norvegicus
cgaatcggggaaatcacagacactc

SEQ ID NO: 485759 - DNA, 25 bp, Rattus norvegicus
attcgcacgcctataactcgggcgc

SEQ ID NO: 485760 - DNA, 25 bp, Rattus norvegicus
gctcagccgggactaggttacataa

SEQ ID NO: 485761 - DNA, 25 bp, Rattus norvegicus
ttggatcggacagcgaaacttctcc

SEQ ID NO: 485762 - DNA, 25 bp, Rattus norvegicus
ttacataagacgtgtgtgtgcgtgc

SEQ ID NO: 485763 - DNA, 25 bp, Rattus norvegicus
aggcagttcgcacacggtcccggga

SEQ ID NO: 485764 - DNA, 25 bp, Rattus norvegicus
ctggtccaagtatccgcctttcatc

SEQ ID NO: 485765 - DNA, 25 bp, Rattus norvegicus
tagggcactcgctggtccaagtatc

SEQ ID NO: 485766 - DNA, 25 bp, Rattus norvegicus
acgctgcagaaggtgtagggcactc

SEQ ID NO: 485767 - DNA, 25 bp, Rattus norvegicus
gaaacttctccgactcgctgggacc

SEQ ID NO: 485768 - DNA, 25 bp, Rattus norvegicus
tgtctgctttctgcagccctgctca

SEQ ID NO: 485769 - DNA, 25 bp, Rattus norvegicus
cagaaccgtgggaattccgtgcgtc

SEQ ID NO: 485770 - DNA, 25 bp, Rattus norvegicus
ccgtgcgtcgcgcagactcagaaca

SEQ ID NO: 485771 - DNA, 25 bp, Rattus norvegicus
acaagtctccggctgggagcgttca

SEQ ID NO: 485772 - DNA, 25 bp, Rattus norvegicus
gcgttcagaagggaaatattgctca

SEQ ID NO: 485773 - DNA, 25 bp, Rattus norvegicus
tcgagggatggcaagcctagccaaa

SEQ ID NO: 485774 - DNA, 25 bp, Rattus norvegicus
cagtaagtcacctctcgtggggcgc

SEQ ID NO: 485775 - DNA, 25 bp, Rattus norvegicus
tcagaacagccacctctagagtccg

SEQ ID NO: 485776 - DNA, 25 bp, Rattus norvegicus
ccgattacctggctgggtgatcgcc

SEQ ID NO: 485777 - DNA, 25 bp, Rattus norvegicus
tcggagtgtggcgtattaggaaacc

SEQ ID NO: 485778 - DNA, 25 bp, Rattus norvegicus
ccgctgtgattgatctgcagcaaca

SEQ ID NO: 485779 - DNA, 25 bp, Rattus norvegicus
aacacggatccctgagcccgggata

SEQ ID NO: 485780 - DNA, 25 bp, Rattus norvegicus
gcccgggatacctgcgcatcttgat

SEQ ID NO: 485781 - DNA, 25 bp, Rattus norvegicus
cgcatcttgattggtgcggcctcgg

SEQ ID NO: 485782 - DNA, 25 bp, Rattus norvegicus
aagcacacccgcgacacaaacaagt

SEQ ID NO: 485783 - DNA, 25 bp, Rattus norvegicus
cccgcaatgttgtggcagccgcgtg

SEQ ID NO: 485784 - DNA, 25 bp, Rattus norvegicus
ctggacaccggggttgacctgccct

SEQ ID NO: 485785 - DNA, 25 bp, Rattus norvegicus
cagggctaacgaaggggacgccaca

SEQ ID NO: 485786 - DNA, 25 bp, Rattus norvegicus
agctcgtcttcgctcagggctaacg

SEQ ID NO: 485787 - DNA, 25 bp, Rattus norvegicus
tcccgagcgctgtcgagctcgtctt

SEQ ID NO: 485788 - DNA, 25 bp, Rattus norvegicus
tcccggaagagctagccggcaggtc

SEQ ID NO: 485789 - DNA, 25 bp, Rattus norvegicus
tgttttgaggtcctcgccgcccttc

SEQ ID NO: 485790 - DNA, 25 bp, Rattus norvegicus
ggccactctgttttgaggtcctcgc

SEQ ID NO: 485791 - DNA, 25 bp, Rattus norvegicus
ctcaggcagctgagcggccactctg

SEQ ID NO: 485792 - DNA, 25 bp, Rattus norvegicus
agctatccgccgctcaggcagctga

SEQ ID NO: 485793 - DNA, 25 bp, Rattus norvegicus
cgccgcctgagtgacctgctaggcg

SEQ ID NO: 485794 - DNA, 25 bp, Rattus norvegicus
tgttacgtcacacgcacgctggcgg

SEQ ID NO: 485795 - DNA, 25 bp, Rattus norvegicus
tgcgggcggtgttacgtcacacgca

SEQ ID NO: 485796 - DNA, 25 bp, Rattus norvegicus
gcagtgcggtgtgttctcgcctccc

SEQ ID NO: 485797 - DNA, 25 bp, Rattus norvegicus
acggacagggatctcccggcacgac

SEQ ID NO: 485798 - DNA, 25 bp, Rattus norvegicus
acccgtgcctcgagctcgagcagga

SEQ ID NO: 485799 - DNA, 25 bp, Rattus norvegicus
cttccctttcaggaaggtctgcatc

SEQ ID NO: 485800 - DNA, 25 bp, Rattus norvegicus
tgactttcttctcgctcagccagta

SEQ ID NO: 485801 - DNA, 25 bp, Rattus norvegicus
ggaaattgagcttcttgactttctt

SEQ ID NO: 485802 - DNA, 25 bp, Rattus norvegicus
ctccgcgaaggcctggaaattgagc

SEQ ID NO: 485803 - DNA, 25 bp, Rattus norvegicus
gggtcccaccacactggacggacag

SEQ ID NO: 485804 - DNA, 25 bp, Rattus norvegicus
agtgcacctgagagccgcggtccga

SEQ ID NO: 485805 - DNA, 25 bp, Rattus norvegicus
tccaggactctagggatccgggacc

SEQ ID NO: 485806 - DNA, 25 bp, Rattus norvegicus
ccacactggacggacagggatctcc

SEQ ID NO: 485807 - DNA, 25 bp, Rattus norvegicus
tcgagctcgagcaggagcacgccct

SEQ ID NO: 485808 - DNA, 25 bp, Rattus norvegicus
gcgacgctccaggactctagggatc

SEQ ID NO: 485809 - DNA, 25 bp, Rattus norvegicus
gagagccgcggtccgagcctaacgc

SEQ ID NO: 485810 - DNA, 25 bp, Rattus norvegicus
ttcttctcgctcagccagtagccaa

SEQ ID NO: 485811 - DNA, 25 bp, Rattus norvegicus
agacgcaccgctcaggctccggaga

SEQ ID NO: 485812 - DNA, 25 bp, Rattus norvegicus
ccgggttgctcagcttggctgtcag

SEQ ID NO: 485813 - DNA, 25 bp, Rattus norvegicus
cactcaggacaggaaggtgagaccc

SEQ ID NO: 485814 - DNA, 25 bp, Rattus norvegicus
cggcccaagacggaagctctgactg

SEQ ID NO: 485815 - DNA, 25 bp, Rattus norvegicus
gcctgacgtcacgagagactggcgc

SEQ ID NO: 485816 - DNA, 25 bp, Rattus norvegicus
gcgcgaagtagacagcctgacgtca

SEQ ID NO: 485817 - DNA, 25 bp, Rattus norvegicus
cagggagcagacaaccgcctccgga

SEQ ID NO: 485818 - DNA, 25 bp, Rattus norvegicus
acctttgcgggcatcaggagacacc

SEQ ID NO: 485819 - DNA, 25 bp, Rattus norvegicus
gaggtctgcagaccacctgcctaca

SEQ ID NO: 485820 - DNA, 25 bp, Rattus norvegicus
tctgcgctcatatacgaaccacatg

SEQ ID NO: 485821 - DNA, 25 bp, Rattus norvegicus
cggtgccttgactcctgagcagttc

SEQ ID NO: 485822 - DNA, 25 bp, Rattus norvegicus
tccgtgtaagttaacggtgccttga

SEQ ID NO: 485823 - DNA, 25 bp, Rattus norvegicus
cctgagaaaacagagcatccgtgta

SEQ ID NO: 485824 - DNA, 25 bp, Rattus norvegicus
tcaggagacaccaggggatcacgtc

SEQ ID NO: 485825 - DNA, 25 bp, Rattus norvegicus
agaagtgctcctactcgcaggtgcg

SEQ ID NO: 485826 - DNA, 25 bp, Rattus norvegicus
tggacgtgctcgaggaagacgagga

SEQ ID NO: 485827 - DNA, 25 bp, Rattus norvegicus
ccttccttgggattggttggctggt

SEQ ID NO: 485828 - DNA, 25 bp, Rattus norvegicus
ttggctggtgctcgggcccctcctt

SEQ ID NO: 485829 - DNA, 25 bp, Rattus norvegicus
ctggcggccacttttcccgccgcct

SEQ ID NO: 485830 - DNA, 25 bp, Rattus norvegicus
agcccggtgacagttgaggatggcc

SEQ ID NO: 485831 - DNA, 25 bp, Rattus norvegicus
atggccggagccgagagtcccaccg

SEQ ID NO: 485832 - DNA, 25 bp, Rattus norvegicus
agccgagagtcccaccgggtgccag

SEQ ID NO: 485833 - DNA, 25 bp, Rattus norvegicus
agagtaggagggatgacttccgttt

SEQ ID NO: 485834 - DNA, 25 bp, Rattus norvegicus
gcgactccgagaagtgctcctactc

SEQ ID NO: 485835 - DNA, 25 bp, Rattus norvegicus
gctcctactcgcaggtgcgcgtggc

SEQ ID NO: 485836 - DNA, 25 bp, Rattus norvegicus
acctgcctgtttcccgctggccgca

SEQ ID NO: 485837 - DNA, 25 bp, Rattus norvegicus
ggagaatgaggcgtgcgccgtcttg

SEQ ID NO: 485838 - DNA, 25 bp, Rattus norvegicus
gcagcgactccgagaagtgctccta

SEQ ID NO: 485839 - DNA, 25 bp, Rattus norvegicus
gaactccgctaccaactccttcatg

SEQ ID NO: 485840 - DNA, 25 bp, Rattus norvegicus
gatcttccgccacgccctgtgcgtc

SEQ ID NO: 485841 - DNA, 25 bp, Rattus norvegicus
tactcgccagaaagctccatggcga

SEQ ID NO: 485842 - DNA, 25 bp, Rattus norvegicus
aggacacttgtagccgctgcggctc

SEQ ID NO: 485843 - DNA, 25 bp, Rattus norvegicus
cttcacaggacacttgtagccgctg

SEQ ID NO: 485844 - DNA, 25 bp, Rattus norvegicus
cgctcgacgcttcacaggacacttg

SEQ ID NO: 485845 - DNA, 25 bp, Rattus norvegicus
gcgccacagagaatcgtcacccgga

SEQ ID NO: 485846 - DNA, 25 bp, Rattus norvegicus
ttcatgcggaccacgcccgccgaca

SEQ ID NO: 485847 - DNA, 25 bp, Rattus norvegicus
gtcctgctccactagggtcccgaag

SEQ ID NO: 485848 - DNA, 25 bp, Rattus norvegicus
cactagggtcccgaagaactccgct

SEQ ID NO: 485849 - DNA, 25 bp, Rattus norvegicus
tcagcttcaacagcgcgccacagag

SEQ ID NO: 485850 - DNA, 25 bp, Rattus norvegicus
caacagcgcgccacagagaatcgtc

SEQ ID NO: 485851 - DNA, 25 bp, Rattus norvegicus
agagggtccgcgtcgctcgacgctt

SEQ ID NO: 485852 - DNA, 25 bp, Rattus norvegicus
aagctccatggcgaccgctcagctt

SEQ ID NO: 485853 - DNA, 25 bp, Rattus norvegicus
cgtaagtgactttagctgcgtcgcg

SEQ ID NO: 485854 - DNA, 25 bp, Rattus norvegicus
gcgcacattcttctggctaagtctg

SEQ ID NO: 485855 - DNA, 25 bp, Rattus norvegicus
gcgcgcacattcttctggctaagtc

SEQ ID NO: 485856 - DNA, 25 bp, Rattus norvegicus
gagtgcgcgcacattcttctggcta

SEQ ID NO: 485857 - DNA, 25 bp, Rattus norvegicus
caagaggcgagtgcgcgcacattct

SEQ ID NO: 485858 - DNA, 25 bp, Rattus norvegicus
agtccaagaggcgagtgcgcgcaca

SEQ ID NO: 485859 - DNA, 25 bp, Rattus norvegicus
cgctagggaggcacgttgccaaaga

SEQ ID NO: 485860 - DNA, 25 bp, Rattus norvegicus
gcacgctagggaggcacgttgccaa

SEQ ID NO: 485861 - DNA, 25 bp, Rattus norvegicus
gggcgtaagtgactttagctgcgtc

SEQ ID NO: 485862 - DNA, 25 bp, Rattus norvegicus
agtgactttagctgcgtcgcggatg

SEQ ID NO: 485863 - DNA, 25 bp, Rattus norvegicus
ttctggctaagtctgtccgaggccc

SEQ ID NO: 485864 - DNA, 25 bp, Rattus norvegicus
taagtctgtccgaggcccgtgcgaa

SEQ ID NO: 485865 - DNA, 25 bp, Rattus norvegicus
actttagctgcgtcgcggatgagaa

SEQ ID NO: 485866 - DNA, 25 bp, Rattus norvegicus
cattcttctggctaagtctgtccga

SEQ ID NO: 485867 - DNA, 25 bp, Rattus norvegicus
aagccatgcagagggttacttctcc

SEQ ID NO: 485868 - DNA, 25 bp, Rattus norvegicus
ccaccaaagcggagcagtgtaagta

SEQ ID NO: 485869 - DNA, 25 bp, Rattus norvegicus
gggcaaagcctttccatctggacag

SEQ ID NO: 485870 - DNA, 25 bp, Rattus norvegicus
gggagctcacacgacacagattttg

SEQ ID NO: 485871 - DNA, 25 bp, Rattus norvegicus
ttcctcgcaacatcgctggcggagc

SEQ ID NO: 485872 - DNA, 25 bp, Rattus norvegicus
ggggtatgcgctcttttcctcgcaa

SEQ ID NO: 485873 - DNA, 25 bp, Rattus norvegicus
ccgaatggtagcgacacgggcctaa

SEQ ID NO: 485874 - DNA, 25 bp, Rattus norvegicus
atgtgcgttttgtccgaatggtagc

SEQ ID NO: 485875 - DNA, 25 bp, Rattus norvegicus
ttccgggaccgaattctgcaatttg

SEQ ID NO: 485876 - DNA, 25 bp, Rattus norvegicus
cctccgtgcgccttatgaatggaaa

SEQ ID NO: 485877 - DNA, 25 bp, Rattus norvegicus
tccggcactttaagaggcttttctc

SEQ ID NO: 485878 - DNA, 25 bp, Rattus norvegicus
cgccaatggggagatccaaatggtc

SEQ ID NO: 485879 - DNA, 25 bp, Rattus norvegicus
gatctacgggcctggagaacgccaa

SEQ ID NO: 485880 - DNA, 25 bp, Rattus norvegicus
ctgcttcgcccgcaggatctacggg

SEQ ID NO: 485881 - DNA, 25 bp, Rattus norvegicus
ctgcagtatacaaggaattgggatc

SEQ ID NO: 485882 - DNA, 25 bp, Rattus norvegicus
gccggactcccctgatcgggttgta

SEQ ID NO: 485883 - DNA, 25 bp, Rattus norvegicus
agggagaatcgctcgcacggcgatc

SEQ ID NO: 485884 - DNA, 25 bp, Rattus norvegicus
atttcctgcattagagggagggaga

SEQ ID NO: 485885 - DNA, 25 bp, Rattus norvegicus
cctcccataacgctcggtatctttt

SEQ ID NO: 485886 - DNA, 25 bp, Rattus norvegicus
ctgacgtcttttgcgcatttcctgc

SEQ ID NO: 485887 - DNA, 25 bp, Rattus norvegicus
cacacactgacgtcttttgcgcatt

SEQ ID NO: 485888 - DNA, 25 bp, Rattus norvegicus
ttatacgacacgaaactcctaggct

SEQ ID NO: 485889 - DNA, 25 bp, Rattus norvegicus
tattgggtctctggcccatatcgcc

SEQ ID NO: 485890 - DNA, 25 bp, Rattus norvegicus
agggaatattattgggtctctggcc

SEQ ID NO: 485891 - DNA, 25 bp, Rattus norvegicus
gactcttagtccctgacccgccggc

SEQ ID NO: 485892 - DNA, 25 bp, Rattus norvegicus
cccagcgctcatacaaaaacagata

SEQ ID NO: 485893 - DNA, 25 bp, Rattus norvegicus
ttgcgcatttcctgcattagaggga

SEQ ID NO: 485894 - DNA, 25 bp, Rattus norvegicus
gaccctccacctgcagtatacaagg

SEQ ID NO: 485895 - DNA, 25 bp, Rattus norvegicus
cctcgtagatgccagtggacgcacc

SEQ ID NO: 485896 - DNA, 25 bp, Rattus norvegicus
gagttctagggcctcgtagatgcca

SEQ ID NO: 485897 - DNA, 25 bp, Rattus norvegicus
tgccagtggacgcaccgctgggcac

SEQ ID NO: 485898 - DNA, 25 bp, Rattus norvegicus
ctgggcaccgcagcacggaagagac

SEQ ID NO: 485899 - DNA, 25 bp, Rattus norvegicus
accgcagcacggaagagaccttttg

SEQ ID NO: 485900 - DNA, 25 bp, Rattus norvegicus
cggaagagaccttttgcggtgtaga

SEQ ID NO: 485901 - DNA, 25 bp, Rattus norvegicus
accttttgcggtgtagagatccacc

SEQ ID NO: 485902 - DNA, 25 bp, Rattus norvegicus
cacctcaacggtgggatgcccgcgg

SEQ ID NO: 485903 - DNA, 25 bp, Rattus norvegicus
atgcccgcgggagtcaaagatctct

SEQ ID NO: 485904 - DNA, 25 bp, Rattus norvegicus
gggagtcaaagatctctctagcatg

SEQ ID NO: 485905 - DNA, 25 bp, Rattus norvegicus
ctctctagcatggatcttgagaatg

SEQ ID NO: 485906 - DNA, 25 bp, Rattus norvegicus
atggtgaagttctggcagtaggatc

SEQ ID NO: 485907 - DNA, 25 bp, Rattus norvegicus
gaatggacatggtgaagttctggca

SEQ ID NO: 485908 - DNA, 25 bp, Rattus norvegicus
ggtgtagagatccacctcaacggtg

SEQ ID NO: 485909 - DNA, 25 bp, Rattus norvegicus
ggaaggcgtaggttttcctgcacgc

SEQ ID NO: 485910 - DNA, 25 bp, Rattus norvegicus
gctgcagtgattcctcgtctccatc

SEQ ID NO: 485911 - DNA, 25 bp, Rattus norvegicus
cgggcggaggcgaaataaataatgc

SEQ ID NO: 485912 - DNA, 25 bp, Rattus norvegicus
aagtgtcctcggatcctccgctagc

SEQ ID NO: 485913 - DNA, 25 bp, Rattus norvegicus
aaaggcggtcacctctgaacccgtg

SEQ ID NO: 485914 - DNA, 25 bp, Rattus norvegicus
gcgggccgctgaagcaaaagtttgc

SEQ ID NO: 485915 - DNA, 25 bp, Rattus norvegicus
gcttcacttgcagaggacgagcgcg

SEQ ID NO: 485916 - DNA, 25 bp, Rattus norvegicus
ccaccgatcgtcgacacggagaagg

SEQ ID NO: 485917 - DNA, 25 bp, Rattus norvegicus
ccagttactgctcccaggaaggcgt

SEQ ID NO: 485918 - DNA, 25 bp, Rattus norvegicus
acataggcacctccgtgtgtgtccc

SEQ ID NO: 485919 - DNA, 25 bp, Rattus norvegicus
agggacttcactgcgcacactgtca

SEQ ID NO: 485920 - DNA, 25 bp, Rattus norvegicus
gtaccaccaaatcactcgctgcgtg

SEQ ID NO: 485921 - DNA, 25 bp, Rattus norvegicus
acactccttgactctgcttgcacag

SEQ ID NO: 485922 - DNA, 25 bp, Rattus norvegicus
acggcagctctgttctcagcggctg

SEQ ID NO: 485923 - DNA, 25 bp, Rattus norvegicus
cctcaggagtcctccagccttggtg

SEQ ID NO: 485924 - DNA, 25 bp, Rattus norvegicus
agccggtgaggccaggaagcccggt

SEQ ID NO: 485925 - DNA, 25 bp, Rattus norvegicus
ggatgcgaaggcctccctggagcac

SEQ ID NO: 485926 - DNA, 25 bp, Rattus norvegicus
cagcggatgcgaaggcctccctgga

SEQ ID NO: 485927 - DNA, 25 bp, Rattus norvegicus
tcacgcagcggatgcgaaggcctcc

SEQ ID NO: 485928 - DNA, 25 bp, Rattus norvegicus
cggcccgggagggtcggtcacgcag

SEQ ID NO: 485929 - DNA, 25 bp, Rattus norvegicus
gtcctccagccttggtggctgccag

SEQ ID NO: 485930 - DNA, 25 bp, Rattus norvegicus
gacgtgcagtctcccggcgggtccc

SEQ ID NO: 485931 - DNA, 25 bp, Rattus norvegicus
ggatgggaaggacgtgcagtctccc

SEQ ID NO: 485932 - DNA, 25 bp, Rattus norvegicus
acctcgcccggatgcctgagcgtgg

SEQ ID NO: 485933 - DNA, 25 bp, Rattus norvegicus
agacctcgcccggatgcctgagcgt

SEQ ID NO: 485934 - DNA, 25 bp, Rattus norvegicus
caggagtcctccagccttggtggct

SEQ ID NO: 485935 - DNA, 25 bp, Rattus norvegicus
cgccgctaaccctgctggcggccgg

SEQ ID NO: 485936 - DNA, 25 bp, Rattus norvegicus
ctgccagcgccgctaaccctgctgg

SEQ ID NO: 485937 - DNA, 25 bp, Rattus norvegicus
ttctgtaagaggacgagcacgagta

SEQ ID NO: 485938 - DNA, 25 bp, Rattus norvegicus
catacaggcaggaaaagcagggctc

SEQ ID NO: 485939 - DNA, 25 bp, Rattus norvegicus
agcagggctcgccatcgcaaccgag

SEQ ID NO: 485940 - DNA, 25 bp, Rattus norvegicus
cgcaaccgaggtccatgaggaactt

SEQ ID NO: 485941 - DNA, 25 bp, Rattus norvegicus
cgaaaggcacttcatggcaaacatg

SEQ ID NO: 485942 - DNA, 25 bp, Rattus norvegicus
tgtaggcgtcgatgtttgcaccatg

SEQ ID NO: 485943 - DNA, 25 bp, Rattus norvegicus
ttgcaccatggtccaacagcagctg

SEQ ID NO: 485944 - DNA, 25 bp, Rattus norvegicus
acagcagctgcatggtgcgcaggca

SEQ ID NO: 485945 - DNA, 25 bp, Rattus norvegicus
ccagcagcaacaactccgtggcgta

SEQ ID NO: 485946 - DNA, 25 bp, Rattus norvegicus
ctccgtggcgtacacattgttgttg

SEQ ID NO: 485947 - DNA, 25 bp, Rattus norvegicus
cattgttgttgaccacggcgaagta

SEQ ID NO: 485948 - DNA, 25 bp, Rattus norvegicus
cagaggcgtgttcacgtcgaagcgc

SEQ ID NO: 485949 - DNA, 25 bp, Rattus norvegicus
agcatctgcactattctgtaagagg

SEQ ID NO: 485950 - DNA, 25 bp, Rattus norvegicus
ctggtcacaggcaacagcatctgca

SEQ ID NO: 485951 - DNA, 25 bp, Rattus norvegicus
actttctgtgacgtcccgcgtccgg

SEQ ID NO: 485952 - DNA, 25 bp, Rattus norvegicus
agtgcagtcccacccactttctgtg

SEQ ID NO: 485953 - DNA, 25 bp, Rattus norvegicus
cccgcgtccgggcttctgattgcgg

SEQ ID NO: 485954 - DNA, 25 bp, Rattus norvegicus
ctgattgcgggcctccgacgtcaat

SEQ ID NO: 485955 - DNA, 25 bp, Rattus norvegicus
tccgacgtcaatcgcgggccgtgcg

SEQ ID NO: 485956 - DNA, 25 bp, Rattus norvegicus
acacagtggaggtctgcgctccggt

SEQ ID NO: 485957 - DNA, 25 bp, Rattus norvegicus
ctcctcgctggagcgagacgtggcc

SEQ ID NO: 485958 - DNA, 25 bp, Rattus norvegicus
agacgtggcccgacggctccggtca

SEQ ID NO: 485959 - DNA, 25 bp, Rattus norvegicus
acggctccggtcactatggtcagtg

SEQ ID NO: 485960 - DNA, 25 bp, Rattus norvegicus
tccggtcactatggtcagtggtggc

SEQ ID NO: 485961 - DNA, 25 bp, Rattus norvegicus
caccctcgggatggtgaacatcgga

SEQ ID NO: 485962 - DNA, 25 bp, Rattus norvegicus
gcggtcgggtgtattctgcactcac

SEQ ID NO: 485963 - DNA, 25 bp, Rattus norvegicus
acataggccgaaggcgagtgcagtc

SEQ ID NO: 485964 - DNA, 25 bp, Rattus norvegicus
gtgaacatcggagtgcgcccgccgc

SEQ ID NO: 485965 - DNA, 25 bp, Rattus norvegicus
ctctggtatgggacgcaaagcgacc

SEQ ID NO: 485966 - DNA, 25 bp, Rattus norvegicus
cttcggagacaatggggagacatcc

SEQ ID NO: 485967 - DNA, 25 bp, Rattus norvegicus
ctgtagagacacctgtgagtcacta

SEQ ID NO: 485968 - DNA, 25 bp, Rattus norvegicus
ccatcgggaaccaaggctgtagaga

SEQ ID NO: 485969 - DNA, 25 bp, Rattus norvegicus
ttgctgggccttgatgcttaagaga

SEQ ID NO: 485970 - DNA, 25 bp, Rattus norvegicus
gctccggatccacaaagaacactca

SEQ ID NO: 485971 - DNA, 25 bp, Rattus norvegicus
gagtgacctgtaccgcttccaagag

SEQ ID NO: 485972 - DNA, 25 bp, Rattus norvegicus
tcggacccaccttgacgagagaacg

SEQ ID NO: 485973 - DNA, 25 bp, Rattus norvegicus
ggatcgcccagcagtctctggtatg

SEQ ID NO: 485974 - DNA, 25 bp, Rattus norvegicus
gacatccgcagctagccaaggcctg

SEQ ID NO: 485975 - DNA, 25 bp, Rattus norvegicus
agtcccacgggcactatagccgata

SEQ ID NO: 485976 - DNA, 25 bp, Rattus norvegicus
cgtcactagaaatagggcgctggga

SEQ ID NO: 485977 - DNA, 25 bp, Rattus norvegicus
tgcgcgttgcagaaggaagtcccgc

SEQ ID NO: 485978 - DNA, 25 bp, Rattus norvegicus
ttgactcgcaggcaaggatcgccca

SEQ ID NO: 485979 - DNA, 25 bp, Rattus norvegicus
ggaggacctgcaggaactcaccatc

SEQ ID NO: 485980 - DNA, 25 bp, Rattus norvegicus
gcgctccagcaccagtcgccgttgt

SEQ ID NO: 485981 - DNA, 25 bp, Rattus norvegicus
gtccgactgcccttcggcgctccag

SEQ ID NO: 485982 - DNA, 25 bp, Rattus norvegicus
tgcgcgggaccgagagacgctaccc

SEQ ID NO: 485983 - DNA, 25 bp, Rattus norvegicus
tgcaggaactcaccatcatcgagag

SEQ ID NO: 485984 - DNA, 25 bp, Rattus norvegicus
tgttcggctacatggaggacctgca

SEQ ID NO: 485985 - DNA, 25 bp, Rattus norvegicus
agaacagcctgttcggctacatgga

SEQ ID NO: 485986 - DNA, 25 bp, Rattus norvegicus
ggatttcgggcagaacagcctgttc

SEQ ID NO: 485987 - DNA, 25 bp, Rattus norvegicus
cccgacgccggcgtcgcgatggatt

SEQ ID NO: 485988 - DNA, 25 bp, Rattus norvegicus
ggccgctgaggtggctccctgttct

SEQ ID NO: 485989 - DNA, 25 bp, Rattus norvegicus
gcagttgcgtcctaccgcgcgcaaa

SEQ ID NO: 485990 - DNA, 25 bp, Rattus norvegicus
gcgaagaactttgcgcacgcgccga

SEQ ID NO: 485991 - DNA, 25 bp, Rattus norvegicus
tcgcctgggtgacgcgaagaacttt

SEQ ID NO: 485992 - DNA, 25 bp, Rattus norvegicus
tcaccatcatcgagaggccggtccg

SEQ ID NO: 485993 - DNA, 25 bp, Rattus norvegicus
taggacgcagctccgaccggctcaa

SEQ ID NO: 485994 - DNA, 25 bp, Rattus norvegicus
cgaccggctcaacctcttgttggtt

SEQ ID NO: 485995 - DNA, 25 bp, Rattus norvegicus
tagctgaactcaacccgccggtagg

SEQ ID NO: 485996 - DNA, 25 bp, Rattus norvegicus
tcccgcgggcgagcaaaccgaaaga

SEQ ID NO: 485997 - DNA, 25 bp, Rattus norvegicus
cgcgccgaagaagaagtctccaagt

SEQ ID NO: 485998 - DNA, 25 bp, Rattus norvegicus
tgctgaacatgctggcgggcatccc

SEQ ID NO: 485999 - DNA, 25 bp, Rattus norvegicus
cggccaggatgttgtcgatgctgaa

SEQ ID NO: 486000 - DNA, 25 bp, Rattus norvegicus
cgggagcaccgcgtctttgcagcgc

SEQ ID NO: 486001 - DNA, 25 bp, Rattus norvegicus
gtgcagagccggaaagaccaccgga

SEQ ID NO: 486002 - DNA, 25 bp, Rattus norvegicus
ccgtagaagtagctgttgtagccca

SEQ ID NO: 486003 - DNA, 25 bp, Rattus norvegicus
tgcacgtgcagctgcccgtagaagt

SEQ ID NO: 486004 - DNA, 25 bp, Rattus norvegicus
acgcaggaacactgctgggcgccca

SEQ ID NO: 486005 - DNA, 25 bp, Rattus norvegicus
tagcagccaccgactgccgcgatgg

SEQ ID NO: 486006 - DNA, 25 bp, Rattus norvegicus
cttgttggttttatactgagtcgac

SEQ ID NO: 486007 - DNA, 25 bp, Rattus norvegicus
gaaggtaaacgattctctgcgcaga

SEQ ID NO: 486008 - DNA, 25 bp, Rattus norvegicus
tctccgtgaggcacggtcgaaccgt

SEQ ID NO: 486009 - DNA, 25 bp, Rattus norvegicus
cccggaattgcagagcagtccatcg

SEQ ID NO: 486010 - DNA, 25 bp, Rattus norvegicus
cagaggccagaagtcgcgcgtccct

SEQ ID NO: 486011 - DNA, 25 bp, Rattus norvegicus
gcgcagaacgaaagcagaggccaga

SEQ ID NO: 486012 - DNA, 25 bp, Rattus norvegicus
cgattctctgcgcagaacgaaagca

SEQ ID NO: 486013 - DNA, 25 bp, Rattus norvegicus
tcgaaccgtgggaggcgcagccaac

SEQ ID NO: 486014 - DNA, 25 bp, Rattus norvegicus
atttgcgggattctccgtgaggcac

SEQ ID NO: 486015 - DNA, 25 bp, Rattus norvegicus
gcggccctgatgatttgcgggattc

SEQ ID NO: 486016 - DNA, 25 bp, Rattus norvegicus
caacctagatctacgcgcaggcggc

SEQ ID NO: 486017 - DNA, 25 bp, Rattus norvegicus
gcctggaccagagtcgggccactgc

SEQ ID NO: 486018 - DNA, 25 bp, Rattus norvegicus
gggaggcgcagccaacctagatcta

SEQ ID NO: 486019 - DNA, 25 bp, Rattus norvegicus
attgcagagcagtccatcgtcccgg

SEQ ID NO: 486020 - DNA, 25 bp, Rattus norvegicus
ctccgggaaggtaaacgattctctg

SEQ ID NO: 486021 - DNA, 25 bp, Rattus norvegicus
tatttctcccgaccgttgccagcag

SEQ ID NO: 486022 - DNA, 25 bp, Rattus norvegicus
aagattgtgtccagaagcccgcggc

SEQ ID NO: 486023 - DNA, 25 bp, Rattus norvegicus
gtctcgcacggctcgcttagattaa

SEQ ID NO: 486024 - DNA, 25 bp, Rattus norvegicus
ggctcgcttagattaataacatttg

SEQ ID NO: 486025 - DNA, 25 bp, Rattus norvegicus
catttgtgatcctgcccattaggca

SEQ ID NO: 486026 - DNA, 25 bp, Rattus norvegicus
ccattaggcaccgaggcagcgagaa

SEQ ID NO: 486027 - DNA, 25 bp, Rattus norvegicus
ggcagcgagaaagcaccttctaacc

SEQ ID NO: 486028 - DNA, 25 bp, Rattus norvegicus
agcaccttctaaccaattccaattc

SEQ ID NO: 486029 - DNA, 25 bp, Rattus norvegicus
ccaattccagataccgcgcgatgga

SEQ ID NO: 486030 - DNA, 25 bp, Rattus norvegicus
taccgcgcgatggaaactatttctc

SEQ ID NO: 486031 - DNA, 25 bp, Rattus norvegicus
gttgccagcagcgagctttcctcta

SEQ ID NO: 486032 - DNA, 25 bp, Rattus norvegicus
cctctaacggcttaattatgattca

SEQ ID NO: 486033 - DNA, 25 bp, Rattus norvegicus
tgattcaagattgtgtccagaagcc

SEQ ID NO: 486034 - DNA, 25 bp, Rattus norvegicus
cagcgagctttcctctaacggctta

SEQ ID NO: 486035 - DNA, 25 bp, Rattus norvegicus
gggacctgtcaaagcccgctcctcc

SEQ ID NO: 486036 - DNA, 25 bp, Rattus norvegicus
ggacctgtcaaagcccgctcctccc

SEQ ID NO: 486037 - DNA, 25 bp, Rattus norvegicus
acgggacctgtcaaagcccgctcct

SEQ ID NO: 486038 - DNA, 25 bp, Rattus norvegicus
gaacgggacctgtcaaagcccgctc

SEQ ID NO: 486039 - DNA, 25 bp, Rattus norvegicus
tcgaacgcggaacgggacctgtcaa

SEQ ID NO: 486040 - DNA, 25 bp, Rattus norvegicus
ttcgaacgcggaacgggacctgtca

SEQ ID NO: 486041 - DNA, 25 bp, Rattus norvegicus
tcttctcccgggcttcgaacgcgga

SEQ ID NO: 486042 - DNA, 25 bp, Rattus norvegicus
cgcgtggatacctcctgtcttctcc

SEQ ID NO: 486043 - DNA, 25 bp, Rattus norvegicus
ccgcgtggatacctcctgtcttctc

SEQ ID NO: 486044 - DNA, 25 bp, Rattus norvegicus
cccgcgtggatacctcctgtcttct

SEQ ID NO: 486045 - DNA, 25 bp, Rattus norvegicus
ggcccgcgtggatacctcctgtctt

SEQ ID NO: 486046 - DNA, 25 bp, Rattus norvegicus
atttggcaggcccgggtcgctcccg

SEQ ID NO: 486047 - DNA, 25 bp, Rattus norvegicus
gccatttggcaggcccgggtcgctc

SEQ ID NO: 486048 - DNA, 25 bp, Rattus norvegicus
cctgtcaaagcccgctcctcccagg

SEQ ID NO: 486049 - DNA, 25 bp, Rattus norvegicus
catttctgttgctgcaatgccggta

SEQ ID NO: 486050 - DNA, 25 bp, Rattus norvegicus
tcggagaagaaaccgtgaagtaaca

SEQ ID NO: 486051 - DNA, 25 bp, Rattus norvegicus
ttcacggaacgactgcccaccaagg

SEQ ID NO: 486052 - DNA, 25 bp, Rattus norvegicus
gacggtgtctttctcgaagcaaaca

SEQ ID NO: 486053 - DNA, 25 bp, Rattus norvegicus
cccgcagggagacggtgtctttctc

SEQ ID NO: 486054 - DNA, 25 bp, Rattus norvegicus
tgagagctgcctacgtctagtcttc

SEQ ID NO: 486055 - DNA, 25 bp, Rattus norvegicus
cagtgtcgtcctgcagcttgagagc

SEQ ID NO: 486056 - DNA, 25 bp, Rattus norvegicus
aaccgtgaagtaacaatagagcgcg

SEQ ID NO: 486057 - DNA, 25 bp, Rattus norvegicus
tgcaatgccggtaccaaagccctcg

SEQ ID NO: 486058 - DNA, 25 bp, Rattus norvegicus
tgcccaccaaggagctcggagaaga

SEQ ID NO: 486059 - DNA, 25 bp, Rattus norvegicus
cgcagtaatgttctccttgcatttc

SEQ ID NO: 486060 - DNA, 25 bp, Rattus norvegicus
gcctcgaaggatcgcagtaatgttc

SEQ ID NO: 486061 - DNA, 25 bp, Rattus norvegicus
ccagaaaagacccagtgtcgtcctg

SEQ ID NO: 486062 - DNA, 25 bp, Rattus norvegicus
gcaaacacactacagcttcacggaa

SEQ ID NO: 486063 - DNA, 25 bp, Rattus norvegicus
cctcccggctctggcgactctctct

SEQ ID NO: 486064 - DNA, 25 bp, Rattus norvegicus
gtctagagtagcctcccggctctgg

SEQ ID NO: 486065 - DNA, 25 bp, Rattus norvegicus
cccagccgcaaaccccattgcaacg

SEQ ID NO: 486066 - DNA, 25 bp, Rattus norvegicus
gacccatcgcccccagccgcaaacc

SEQ ID NO: 486067 - DNA, 25 bp, Rattus norvegicus
gcagacccatcgcccccagccgcaa

SEQ ID NO: 486068 - DNA, 25 bp, Rattus norvegicus
tcgcagacccatcgcccccagccgc

SEQ ID NO: 486069 - DNA, 25 bp, Rattus norvegicus
ctcgcagacccatcgcccccagccg

SEQ ID NO: 486070 - DNA, 25 bp, Rattus norvegicus
cctcgcagacccatcgcccccagcc

SEQ ID NO: 486071 - DNA, 25 bp, Rattus norvegicus
ccctcgcagacccatcgcccccagc

SEQ ID NO: 486072 - DNA, 25 bp, Rattus norvegicus
caccctcgcagacccatcgccccca

SEQ ID NO: 486073 - DNA, 25 bp, Rattus norvegicus
gcaccctcgcagacccatcgccccc

SEQ ID NO: 486074 - DNA, 25 bp, Rattus norvegicus
cctggatgatggcaccctcgcagac

SEQ ID NO: 486075 - DNA, 25 bp, Rattus norvegicus
cccggctctggcgactctctctcct

SEQ ID NO: 486076 - DNA, 25 bp, Rattus norvegicus
ctcctggatgatggcaccctcgcag

SEQ ID NO: 486077 - DNA, 25 bp, Rattus norvegicus
tgaatgaggcccaatgcgaagaccg

SEQ ID NO: 486078 - DNA, 25 bp, Rattus norvegicus
gtccgggcttggtctagagtagcct

SEQ ID NO: 486079 - DNA, 25 bp, Rattus norvegicus
ctgtaccaagtccggtccgggcttg

SEQ ID NO: 486080 - DNA, 25 bp, Rattus norvegicus
ccggcgggctggagtcctgtaccaa

SEQ ID NO: 486081 - DNA, 25 bp, Rattus norvegicus
tgtaacgcagtcagccagccggcgg

SEQ ID NO: 486082 - DNA, 25 bp, Rattus norvegicus
tctgtaacgcagtcagccagccggc

SEQ ID NO: 486083 - DNA, 25 bp, Rattus norvegicus
cgaagaccgagctctgtaacgcagt

SEQ ID NO: 486084 - DNA, 25 bp, Rattus norvegicus
agctgggagacagcggactcagtcc

SEQ ID NO: 486085 - DNA, 25 bp, Rattus norvegicus
cgcatgaaagccgtcctgtgattgg

SEQ ID NO: 486086 - DNA, 25 bp, Rattus norvegicus
tgcggccgcatgaaagccgtcctgt

SEQ ID NO: 486087 - DNA, 25 bp, Rattus norvegicus
gttgctcgccctgcggccgcatgaa

SEQ ID NO: 486088 - DNA, 25 bp, Rattus norvegicus
tccgaggcggtgaatgaggcccaat

SEQ ID NO: 486089 - DNA, 25 bp, Rattus norvegicus
ccgagctctgtaacgcagtcagcca

SEQ ID NO: 486090 - DNA, 25 bp, Rattus norvegicus
cccaatgcgaagaccgagctctgta

SEQ ID NO: 486091 - DNA, 25 bp, Rattus norvegicus
ctgggcaaacgcgacaattgactgc

SEQ ID NO: 486092 - DNA, 25 bp, Rattus norvegicus
gtgccacactgggtagagttgggga

SEQ ID NO: 486093 - DNA, 25 bp, Rattus norvegicus
caaatagccgccaggcttggcctgc

SEQ ID NO: 486094 - DNA, 25 bp, Rattus norvegicus
ggatcccacacaaatagccgccagg

SEQ ID NO: 486095 - DNA, 25 bp, Rattus norvegicus
ttacaatcggatcccacacaaatag

SEQ ID NO: 486096 - DNA, 25 bp, Rattus norvegicus
gggcccaaattacaatcggatccca

SEQ ID NO: 486097 - DNA, 25 bp, Rattus norvegicus
acgcgacaattgactgcggcccacg

SEQ ID NO: 486098 - DNA, 25 bp, Rattus norvegicus
ggcgctgggcaaacgcgacaattga

SEQ ID NO: 486099 - DNA, 25 bp, Rattus norvegicus
ccgggctatttcagcctggcgctgg

SEQ ID NO: 486100 - DNA, 25 bp, Rattus norvegicus
cgcgcgccgggctatttcagcctgg

SEQ ID NO: 486101 - DNA, 25 bp, Rattus norvegicus
tgagctcatttcctgggccgcgcgc

SEQ ID NO: 486102 - DNA, 25 bp, Rattus norvegicus
gtcctgagctcatttcctgggccgc

SEQ ID NO: 486103 - DNA, 25 bp, Rattus norvegicus
ggcctgggtcctgagctcatttcct

SEQ ID NO: 486104 - DNA, 25 bp, Rattus norvegicus
cgacaattgactgcggcccacgggg

SEQ ID NO: 486105 - DNA, 25 bp, Rattus norvegicus
tgtcgctgatctgcccgatgagctc

SEQ ID NO: 486106 - DNA, 25 bp, Rattus norvegicus
ctcctgagcagccatggagcgcgcg

SEQ ID NO: 486107 - DNA, 25 bp, Rattus norvegicus
ctgagctctgcaagcccggcgcagg

SEQ ID NO: 486108 - DNA, 25 bp, Rattus norvegicus
agtcccactcctgagcagccatgga

SEQ ID NO: 486109 - DNA, 25 bp, Rattus norvegicus
tggaaccagtcccactcctgagcag

SEQ ID NO: 486110 - DNA, 25 bp, Rattus norvegicus
tgatctgcccgatgagctcctcgcg

SEQ ID NO: 486111 - DNA, 25 bp, Rattus norvegicus
acacggatgtcgctgatctgcccga

SEQ ID NO: 486112 - DNA, 25 bp, Rattus norvegicus
tctgcacacggatgtcgctgatctg

SEQ ID NO: 486113 - DNA, 25 bp, Rattus norvegicus
aggttctgcacacggatgtcgctga

SEQ ID NO: 486114 - DNA, 25 bp, Rattus norvegicus
gccgccgtaccttgcaggttctgca

SEQ ID NO: 486115 - DNA, 25 bp, Rattus norvegicus
ggcccacgcttggtgaagactgccc

SEQ ID NO: 486116 - DNA, 25 bp, Rattus norvegicus
cagccacatcggctccggggcgcac

SEQ ID NO: 486117 - DNA, 25 bp, Rattus norvegicus
aagcccggcgcaggccagccacatc

SEQ ID NO: 486118 - DNA, 25 bp, Rattus norvegicus
cgatgagctcctcgcgctggaacca

SEQ ID NO: 486119 - DNA, 25 bp, Rattus norvegicus
ccgatcctcggggacgcgtcaagac

SEQ ID NO: 486120 - DNA, 25 bp, Rattus norvegicus
caagacaggggtacgctagggatcc

SEQ ID NO: 486121 - DNA, 25 bp, Rattus norvegicus
ccgccacactgcagatgaggaacca

SEQ ID NO: 486122 - DNA, 25 bp, Rattus norvegicus
tgaaacgaagctccgcccgccggca

SEQ ID NO: 486123 - DNA, 25 bp, Rattus norvegicus
tggggccgagactctagggtgccca

SEQ ID NO: 486124 - DNA, 25 bp, Rattus norvegicus
acactgcagatgaggaaccagggcg

SEQ ID NO: 486125 - DNA, 25 bp, Rattus norvegicus
cctcccacagccctgaccttactca

SEQ ID NO: 486126 - DNA, 25 bp, Rattus norvegicus
gcggctgggccgagtcccttctgca

SEQ ID NO: 486127 - DNA, 25 bp, Rattus norvegicus
gacgcgtcaagacaggggtacgcta

SEQ ID NO: 486128 - DNA, 25 bp, Rattus norvegicus
cccgccggcagctgtcacgctggcc

SEQ ID NO: 486129 - DNA, 25 bp, Rattus norvegicus
gcggttgcttttgaaacgaagctcc

SEQ ID NO: 486130 - DNA, 25 bp, Rattus norvegicus
gaggagcggttgcttttgaaacgaa

SEQ ID NO: 486131 - DNA, 25 bp, Rattus norvegicus
tgcccaggatttcgcagcgggagga

SEQ ID NO: 486132 - DNA, 25 bp, Rattus norvegicus
gccctgaccttactcaccctgcccg

SEQ ID NO: 486133 - DNA, 25 bp, Rattus norvegicus
ttcgcaggactatcggaccgcatta

SEQ ID NO: 486134 - DNA, 25 bp, Rattus norvegicus
gctagtgatgcgtgaaggcccacca

SEQ ID NO: 486135 - DNA, 25 bp, Rattus norvegicus
gaaccggaaactgcgtctgacgtga

SEQ ID NO: 486136 - DNA, 25 bp, Rattus norvegicus
cgcggtgaacttgagcagatctcga

SEQ ID NO: 486137 - DNA, 25 bp, Rattus norvegicus
gcacgctggaggaaagccgtcttcc

SEQ ID NO: 486138 - DNA, 25 bp, Rattus norvegicus
cgtcttcctgtagtcacacctcttg

SEQ ID NO: 486139 - DNA, 25 bp, Rattus norvegicus
tgacggacgtccagtttgtccaatc

SEQ ID NO: 486140 - DNA, 25 bp, Rattus norvegicus
tcccagagcctatccaatgagaact

SEQ ID NO: 486141 - DNA, 25 bp, Rattus norvegicus
ttcagcaacgccgtggtacagatcc

SEQ ID NO: 486142 - DNA, 25 bp, Rattus norvegicus
actatgcggcctacaacgtgctgga

SEQ ID NO: 486143 - DNA, 25 bp, Rattus norvegicus
cacgcaaagtggtcgtccaggctca

SEQ ID NO: 486144 - DNA, 25 bp, Rattus norvegicus
tggcggctcacctcagctagtgatg

SEQ ID NO: 486145 - DNA, 25 bp, Rattus norvegicus
aatgagaacttccagtgggccggcc

SEQ ID NO: 486146 - DNA, 25 bp, Rattus norvegicus
taagggccctccctagttgcgaagc

SEQ ID NO: 486147 - DNA, 25 bp, Rattus norvegicus
gggtatcgcctgcagacaacccagc

SEQ ID NO: 486148 - DNA, 25 bp, Rattus norvegicus
tcccggagcgagtcgctaggtaaca

SEQ ID NO: 486149 - DNA, 25 bp, Rattus norvegicus
aggtaacagggctggctccgcagac

SEQ ID NO: 486150 - DNA, 25 bp, Rattus norvegicus
cctcggatgccttaagggcggccac

SEQ ID NO: 486151 - DNA, 25 bp, Rattus norvegicus
gcggaccggccatgtgctaaagttt

SEQ ID NO: 486152 - DNA, 25 bp, Rattus norvegicus
gggcgcagctcagtgctctctcacg

SEQ ID NO: 486153 - DNA, 25 bp, Rattus norvegicus
ctcgccagtcgctgacagagacatg

SEQ ID NO: 486154 - DNA, 25 bp, Rattus norvegicus
acatgagcagcatgattgggttgcg

SEQ ID NO: 486155 - DNA, 25 bp, Rattus norvegicus
cttgggagaatgaggcaggaaccca

SEQ ID NO: 486156 - DNA, 25 bp, Rattus norvegicus
ctgcctccggatgctcttctcggta

SEQ ID NO: 486157 - DNA, 25 bp, Rattus norvegicus
tgtgctaaagtttctggggctcggc

SEQ ID NO: 486158 - DNA, 25 bp, Rattus norvegicus
tcttctcggtaagccaggcccttcg

SEQ ID NO: 486159 - DNA, 25 bp, Rattus norvegicus
atgaggcaggaacccacggccacct

SEQ ID NO: 486160 - DNA, 25 bp, Rattus norvegicus
agctcctagcgcgtcagcgtgggct

SEQ ID NO: 486161 - DNA, 25 bp, Rattus norvegicus
tctgtgaaattctggcgcctcccga

SEQ ID NO: 486162 - DNA, 25 bp, Rattus norvegicus
cccaagtcgggagcttctgaagcgc

SEQ ID NO: 486163 - DNA, 25 bp, Rattus norvegicus
tccgtcggtccggagacagttcata

SEQ ID NO: 486164 - DNA, 25 bp, Rattus norvegicus
ggccacctcagcgaagactttgtgc

SEQ ID NO: 486165 - DNA, 25 bp, Rattus norvegicus
acagttcatacgagagccagaaggc

SEQ ID NO: 486166 - DNA, 25 bp, Rattus norvegicus
ccgacactgcgcgacaaatttgttg

SEQ ID NO: 486167 - DNA, 25 bp, Rattus norvegicus
cactggagcaactggcacaagcgga

SEQ ID NO: 486168 - DNA, 25 bp, Rattus norvegicus
tgacgccatattgcggggctgtaaa

SEQ ID NO: 486169 - DNA, 25 bp, Rattus norvegicus
tgggcccttacttcgctgttgcggc

SEQ ID NO: 486170 - DNA, 25 bp, Rattus norvegicus
gggtgcctattgtcagcaggttgtc

SEQ ID NO: 486171 - DNA, 25 bp, Rattus norvegicus
gccggcattgtttgcaaagcatcta

SEQ ID NO: 486172 - DNA, 25 bp, Rattus norvegicus
gccacgccgacgtccaggaaacttg

SEQ ID NO: 486173 - DNA, 25 bp, Rattus norvegicus
cgtttgcgggcaacactgttttctc

SEQ ID NO: 486174 - DNA, 25 bp, Rattus norvegicus
atttgttgtcatctactgggcgcgc

SEQ ID NO: 486175 - DNA, 25 bp, Rattus norvegicus
tcacatttgacgtgtttctcgggtc

SEQ ID NO: 486176 - DNA, 25 bp, Rattus norvegicus
agagtccttagagcccaccgctggt

SEQ ID NO: 486177 - DNA, 25 bp, Rattus norvegicus
ccgcccagacgggattcgtggagaa

SEQ ID NO: 486178 - DNA, 25 bp, Rattus norvegicus
acgggattcgtggagaacatcggca

SEQ ID NO: 486179 - DNA, 25 bp, Rattus norvegicus
agaacatcggcagcatcctcaaaga

SEQ ID NO: 486180 - DNA, 25 bp, Rattus norvegicus
agcatcctcaaagagtacaagcaga

SEQ ID NO: 486181 - DNA, 25 bp, Rattus norvegicus
caagcagagccgaggactgttggta

SEQ ID NO: 486182 - DNA, 25 bp, Rattus norvegicus
ctgtttctgtttctcagagtcctta

SEQ ID NO: 486183 - DNA, 25 bp, Rattus norvegicus
cgctggtgcctctgtcccagcggga

SEQ ID NO: 486184 - DNA, 25 bp, Rattus norvegicus
cccagcgggaggctttccatgttaa

SEQ ID NO: 486185 - DNA, 25 bp, Rattus norvegicus
ttccatgttaaaacgtctgagcacg

SEQ ID NO: 486186 - DNA, 25 bp, Rattus norvegicus
cgtctgagcacgtggttcacatttg

SEQ ID NO: 486187 - DNA, 25 bp, Rattus norvegicus
ctcgggtcttataatttgcacgtgc

SEQ ID NO: 486188 - DNA, 25 bp, Rattus norvegicus
agccgaggactgttggtacccgccg

SEQ ID NO: 486189 - DNA, 25 bp, Rattus norvegicus
cgctttcctcctcgaaacgggtgag

SEQ ID NO: 486190 - DNA, 25 bp, Rattus norvegicus
gggctccaacgcatttaagtcctcg

SEQ ID NO: 486191 - DNA, 25 bp, Rattus norvegicus
cgatgtttcgtaggcagttctccca

SEQ ID NO: 486192 - DNA, 25 bp, Rattus norvegicus
gctgcgtcactctcattcgccagga

SEQ ID NO: 486193 - DNA, 25 bp, Rattus norvegicus
acggcgtcgccaagcgaatgaacta

SEQ ID NO: 486194 - DNA, 25 bp, Rattus norvegicus
taccacgaacgcatgagatcaccgg

SEQ ID NO: 486195 - DNA, 25 bp, Rattus norvegicus
atcaccggagaaagagcgctggctc

SEQ ID NO: 486196 - DNA, 25 bp, Rattus norvegicus
gcgctggctcgcttcaagaactaca

SEQ ID NO: 486197 - DNA, 25 bp, Rattus norvegicus
gcggcgtcagcgattctagaacgtt

SEQ ID NO: 486198 - DNA, 25 bp, Rattus norvegicus
ctagaacgttgctgtggtagcgctc

SEQ ID NO: 486199 - DNA, 25 bp, Rattus norvegicus
cgccggagacgatgccgttgtaagt

SEQ ID NO: 486200 - DNA, 25 bp, Rattus norvegicus
gatctcaaagcggaacggtgccctg

SEQ ID NO: 486201 - DNA, 25 bp, Rattus norvegicus
tgtcccgttttcaccatggcgccgt

SEQ ID NO: 486202 - DNA, 25 bp, Rattus norvegicus
tgaactactgcctgtcgctcggagc

SEQ ID NO: 486203 - DNA, 25 bp, Rattus norvegicus
gacatctgcgttccggagttcagca

SEQ ID NO: 486204 - DNA, 25 bp, Rattus norvegicus
ccagaccattattgcctggtgcaga

SEQ ID NO: 486205 - DNA, 25 bp, Rattus norvegicus
ttattgcctggtgcagaggtcgaga

SEQ ID NO: 486206 - DNA, 25 bp, Rattus norvegicus
cggccgaggcgctaatgaaacacaa

SEQ ID NO: 486207 - DNA, 25 bp, Rattus norvegicus
ggcgctaatgaaacacaaatgggac

SEQ ID NO: 486208 - DNA, 25 bp, Rattus norvegicus
acaaatgggacatctgcgttccgga

SEQ ID NO: 486209 - DNA, 25 bp, Rattus norvegicus
gcgttccggagttcagcaaaccatg

SEQ ID NO: 486210 - DNA, 25 bp, Rattus norvegicus
cagcaaaccatgcaaagccaacttt

SEQ ID NO: 486211 - DNA, 25 bp, Rattus norvegicus
tttatgtactgccgcgcgcagaaca

SEQ ID NO: 486212 - DNA, 25 bp, Rattus norvegicus
tccggctgcagagagcaccagagac

SEQ ID NO: 486213 - DNA, 25 bp, Rattus norvegicus
ctgcagagagcaccagagaccagtc

SEQ ID NO: 486214 - DNA, 25 bp, Rattus norvegicus
agagcaccagagaccagtctccgct

SEQ ID NO: 486215 - DNA, 25 bp, Rattus norvegicus
atgggcctgcgccagaccattattg

SEQ ID NO: 486216 - DNA, 25 bp, Rattus norvegicus
cggagttcagcaaaccatgcaaagc

SEQ ID NO: 486217 - DNA, 25 bp, Rattus norvegicus
ccttgcgctccctctagcgttagta

SEQ ID NO: 486218 - DNA, 25 bp, Rattus norvegicus
ctcccggtcaaggagaggtcgcgac

SEQ ID NO: 486219 - DNA, 25 bp, Rattus norvegicus
tcgtagcttgtgtttctcccggtca

SEQ ID NO: 486220 - DNA, 25 bp, Rattus norvegicus
ggctttcatcccagctcgtagcttg

SEQ ID NO: 486221 - DNA, 25 bp, Rattus norvegicus
agtccaagaactaagctccaggcga

SEQ ID NO: 486222 - DNA, 25 bp, Rattus norvegicus
ggcagctctttccaagcctggggcc

SEQ ID NO: 486223 - DNA, 25 bp, Rattus norvegicus
gccggctttgggcagctctttccaa

SEQ ID NO: 486224 - DNA, 25 bp, Rattus norvegicus
tgggagatgctaattgccggctttg

SEQ ID NO: 486225 - DNA, 25 bp, Rattus norvegicus
ggactcctggagttgcacgcggccc

SEQ ID NO: 486226 - DNA, 25 bp, Rattus norvegicus
gcacaccgttgctgagtgcaccgga

SEQ ID NO: 486227 - DNA, 25 bp, Rattus norvegicus
tgcagctgggatgcctgcaatcccg

SEQ ID NO: 486228 - DNA, 25 bp, Rattus norvegicus
atcgccatgagctgcggtgcagctg

SEQ ID NO: 486229 - DNA, 25 bp, Rattus norvegicus
ctaggcggtccctgctttgcgtacc

SEQ ID NO: 486230 - DNA, 25 bp, Rattus norvegicus
gcgttagtatctgggatcgccatga

SEQ ID NO: 486231 - DNA, 25 bp, Rattus norvegicus
ccggatagttccgaggccttgagac

SEQ ID NO: 486232 - DNA, 25 bp, Rattus norvegicus
tggggcagcagacgtacctttcttt

SEQ ID NO: 486233 - DNA, 25 bp, Rattus norvegicus
cctcgagtctcagggtttccatgct

SEQ ID NO: 486234 - DNA, 25 bp, Rattus norvegicus
ttgaaatgtttctgggccgatgccc

SEQ ID NO: 486235 - DNA, 25 bp, Rattus norvegicus
tgctcccggattttttccaacctgc

SEQ ID NO: 486236 - DNA, 25 bp, Rattus norvegicus
actttccaggtcttttcgagcgcgc

SEQ ID NO: 486237 - DNA, 25 bp, Rattus norvegicus
agtgactccagttcggggataaacg

SEQ ID NO: 486238 - DNA, 25 bp, Rattus norvegicus
ttccaaagtctgtcgtccctagagc

SEQ ID NO: 486239 - DNA, 25 bp, Rattus norvegicus
tcgcagtggagttgcaaaccggata

SEQ ID NO: 486240 - DNA, 25 bp, Rattus norvegicus
ggaacttcaggtcccttgtcgctgc

SEQ ID NO: 486241 - DNA, 25 bp, Rattus norvegicus
cgctgctctcttttggcgtcttgca

SEQ ID NO: 486242 - DNA, 25 bp, Rattus norvegicus
ttccacctgattgtgcgggactctc

SEQ ID NO: 486243 - DNA, 25 bp, Rattus norvegicus
acctgcgagcactgaagacctgtct

SEQ ID NO: 486244 - DNA, 25 bp, Rattus norvegicus
ccgcggcgacaatgacagctgacaa

SEQ ID NO: 486245 - DNA, 25 bp, Rattus norvegicus
ggcgcgccctagtaggcgttctcca

SEQ ID NO: 486246 - DNA, 25 bp, Rattus norvegicus
cagctgtactcggacacgtctgcgg

SEQ ID NO: 486247 - DNA, 25 bp, Rattus norvegicus
tcacgaagcgggtgtagtgcagctc

SEQ ID NO: 486248 - DNA, 25 bp, Rattus norvegicus
ccaactcggtgaccggcttggcact

SEQ ID NO: 486249 - DNA, 25 bp, Rattus norvegicus
tggcccgagcacaccaactcggtga

SEQ ID NO: 486250 - DNA, 25 bp, Rattus norvegicus
ttcacgcgcccgatggcgttgggca

SEQ ID NO: 486251 - DNA, 25 bp, Rattus norvegicus
cttgcacttgcacgaggccaccaga

SEQ ID NO: 486252 - DNA, 25 bp, Rattus norvegicus
tctcaggtccgaagtccttgagctc

SEQ ID NO: 486253 - DNA, 25 bp, Rattus norvegicus
aaacgagtcggatcgcacggggact

SEQ ID NO: 486254 - DNA, 25 bp, Rattus norvegicus
gcaggctttacactgaaaacgagtc

SEQ ID NO: 486255 - DNA, 25 bp, Rattus norvegicus
cctggcctgggctgcaggctttaca

SEQ ID NO: 486256 - DNA, 25 bp, Rattus norvegicus
ccgcacggtctggaaagtttggcac

SEQ ID NO: 486257 - DNA, 25 bp, Rattus norvegicus
tctctacgggctggggactccgcac

SEQ ID NO: 486258 - DNA, 25 bp, Rattus norvegicus
ccttgagctccgactggttgtggaa

SEQ ID NO: 486259 - DNA, 25 bp, Rattus norvegicus
ttcgtactacgctgtgggacggcga

SEQ ID NO: 486260 - DNA, 25 bp, Rattus norvegicus
caagtctagaaagcggcgggaagtt

SEQ ID NO: 486261 - DNA, 25 bp, Rattus norvegicus
ccgtgggcaagtcgcaagtctagaa

SEQ ID NO: 486262 - DNA, 25 bp, Rattus norvegicus
aaggctctgtactacgaggtgcaga

SEQ ID NO: 486263 - DNA, 25 bp, Rattus norvegicus
ggtgacagagaagcgcggcctttct

SEQ ID NO: 486264 - DNA, 25 bp, Rattus norvegicus
ccgctcgcagccaatgggaaggctc

SEQ ID NO: 486265 - DNA, 25 bp, Rattus norvegicus
cttgcctcttccttagcagcggtga

SEQ ID NO: 486266 - DNA, 25 bp, Rattus norvegicus
acggtgggtacagcgacgcatcaga

SEQ ID NO: 486267 - DNA, 25 bp, Rattus norvegicus
atgctcaccgcggtgacagagaagc

SEQ ID NO: 486268 - DNA, 25 bp, Rattus norvegicus
acgcatcagagaggcgcctgctcat

SEQ ID NO: 486269 - DNA, 25 bp, Rattus norvegicus
acaggaatctggaccggccgagctt

SEQ ID NO: 486270 - DNA, 25 bp, Rattus norvegicus
cggacaccgggacaggaatctggac

SEQ ID NO: 486271 - DNA, 25 bp, Rattus norvegicus
gagctgccggaagcccggttctaga

SEQ ID NO: 486272 - DNA, 25 bp, Rattus norvegicus
agaaggccgcccgaagcctggacag

SEQ ID NO: 486273 - DNA, 25 bp, Rattus norvegicus
cgccggtgcacgatgagattgctct

SEQ ID NO: 486274 - DNA, 25 bp, Rattus norvegicus
cccgccttgtgcatgtgcgtcttca

SEQ ID NO: 486275 - DNA, 25 bp, Rattus norvegicus
cgagagcccatcgtctgagcggcca

SEQ ID NO: 486276 - DNA, 25 bp, Rattus norvegicus
ccgctttgaggtcacctggcagctc

SEQ ID NO: 486277 - DNA, 25 bp, Rattus norvegicus
tcccagagatgggtcgctctcatgg

SEQ ID NO: 486278 - DNA, 25 bp, Rattus norvegicus
ggtcggctttcattctccagcagca

SEQ ID NO: 486279 - DNA, 25 bp, Rattus norvegicus
tccatgctgaagctcgactcaggtc

SEQ ID NO: 486280 - DNA, 25 bp, Rattus norvegicus
ttctcatctgccagagccgcagctg

SEQ ID NO: 486281 - DNA, 25 bp, Rattus norvegicus
cgcgtcgcctgcacgcttcaggaag

SEQ ID NO: 486282 - DNA, 25 bp, Rattus norvegicus
ttctccaccttgatgcgcttggccg

SEQ ID NO: 486283 - DNA, 25 bp, Rattus norvegicus
gtccttcatgaagtggcgcgacgcc

SEQ ID NO: 486284 - DNA, 25 bp, Rattus norvegicus
gcgcgcatccgtgaagcccaggaac

SEQ ID NO: 486285 - DNA, 25 bp, Rattus norvegicus
ttgccgcagaactcacaggacttgc

SEQ ID NO: 486286 - DNA, 25 bp, Rattus norvegicus
ctcagaggaatgttccgacgacgtg

SEQ ID NO: 486287 - DNA, 25 bp, Rattus norvegicus
gacctgggccgaagcggacagggaa

SEQ ID NO: 486288 - DNA, 25 bp, Rattus norvegicus
aaaggaacgcgcctgccccgcgagg

SEQ ID NO: 486289 - DNA, 25 bp, Rattus norvegicus
aggccagacggctacagggtcagct

SEQ ID NO: 486290 - DNA, 25 bp, Rattus norvegicus
ccagacggctacagggtcagctgtg

SEQ ID NO: 486291 - DNA, 25 bp, Rattus norvegicus
gacggctacagggtcagctgtgcct

SEQ ID NO: 486292 - DNA, 25 bp, Rattus norvegicus
ggcagctgctccattaagcccggga

SEQ ID NO: 486293 - DNA, 25 bp, Rattus norvegicus
gctgctccattaagcccgggaatta

SEQ ID NO: 486294 - DNA, 25 bp, Rattus norvegicus
taagcccgggaattatgcatggccc

SEQ ID NO: 486295 - DNA, 25 bp, Rattus norvegicus
ggaattatgcatggccccggacccg

SEQ ID NO: 486296 - DNA, 25 bp, Rattus norvegicus
ctcccgctcagggtgcaatcaacgt

SEQ ID NO: 486297 - DNA, 25 bp, Rattus norvegicus
ccgctcagggtgcaatcaacgtgca

SEQ ID NO: 486298 - DNA, 25 bp, Rattus norvegicus
tcagggtgcaatcaacgtgcacggc

SEQ ID NO: 486299 - DNA, 25 bp, Rattus norvegicus
tgcaatcaacgtgcacggcgaggag

SEQ ID NO: 486300 - DNA, 25 bp, Rattus norvegicus
cagggaagaaaggaacgcgcctgcc

SEQ ID NO: 486301 - DNA, 25 bp, Rattus norvegicus
gcttggcctcttagacttgtaaatg

SEQ ID NO: 486302 - DNA, 25 bp, Rattus norvegicus
ccgaaagcaatgaaaaactgccttg

SEQ ID NO: 486303 - DNA, 25 bp, Rattus norvegicus
actgccttggttcggttctttctgg

SEQ ID NO: 486304 - DNA, 25 bp, Rattus norvegicus
gaacgcgcacttccacccaagggga

SEQ ID NO: 486305 - DNA, 25 bp, Rattus norvegicus
ctgacacttttctttcggggtctgg

SEQ ID NO: 486306 - DNA, 25 bp, Rattus norvegicus
ttttgcaccggcctctgacactttt

SEQ ID NO: 486307 - DNA, 25 bp, Rattus norvegicus
aatgtcttcttgaagttacgccggg

SEQ ID NO: 486308 - DNA, 25 bp, Rattus norvegicus
caggaagatggcttgctctaaaata

SEQ ID NO: 486309 - DNA, 25 bp, Rattus norvegicus
atcgcccggaaagctgcacagatgc

SEQ ID NO: 486310 - DNA, 25 bp, Rattus norvegicus
ggcatctattctggcatcgcccgga

SEQ ID NO: 486311 - DNA, 25 bp, Rattus norvegicus
tccctctgggacaagtgctgcgggt

SEQ ID NO: 486312 - DNA, 25 bp, Rattus norvegicus
cttcttcaaagtgcttggcctctta

SEQ ID NO: 486313 - DNA, 25 bp, Rattus norvegicus
acttacgcgtgatgagttccctctg

SEQ ID NO: 486314 - DNA, 25 bp, Rattus norvegicus
gttctttctgggttttctgcgcgct

SEQ ID NO: 486315 - DNA, 25 bp, Rattus norvegicus
actctcggacccagaagtgggcgtg

SEQ ID NO: 486316 - DNA, 25 bp, Rattus norvegicus
tttgcggtgagcctggctgcaccac

SEQ ID NO: 486317 - DNA, 25 bp, Rattus norvegicus
ggggtcactccacgtagaagtctgg

SEQ ID NO: 486318 - DNA, 25 bp, Rattus norvegicus
tagaagtctgggactctcggaccca

SEQ ID NO: 486319 - DNA, 25 bp, Rattus norvegicus
aattccctccgtgaaatctctgcaa

SEQ ID NO: 486320 - DNA, 25 bp, Rattus norvegicus
atctctgcaacctggaagtcgtccc

SEQ ID NO: 486321 - DNA, 25 bp, Rattus norvegicus
cccgggatcggacttgaaattgctt

SEQ ID NO: 486322 - DNA, 25 bp, Rattus norvegicus
cttgaaattgcttgtccgaccggga

SEQ ID NO: 486323 - DNA, 25 bp, Rattus norvegicus
gggaaggacagagccgccttgtcaa

SEQ ID NO: 486324 - DNA, 25 bp, Rattus norvegicus
gccgccttgtcaaccgtttgatctc

SEQ ID NO: 486325 - DNA, 25 bp, Rattus norvegicus
ctgggcgcgccagtaagctggaccc

SEQ ID NO: 486326 - DNA, 25 bp, Rattus norvegicus
gtttgatctccagccggcgaggaca

SEQ ID NO: 486327 - DNA, 25 bp, Rattus norvegicus
tcctccaggagaccagctgggtcta

SEQ ID NO: 486328 - DNA, 25 bp, Rattus norvegicus
ctgggtctactggataacctggcct

SEQ ID NO: 486329 - DNA, 25 bp, Rattus norvegicus
gttaatgtctggtctcacagctccc

SEQ ID NO: 486330 - DNA, 25 bp, Rattus norvegicus
gtgtctcgcgttcccaaccagatca

SEQ ID NO: 486331 - DNA, 25 bp, Rattus norvegicus
gcgttcccaaccagatcaatagctg

SEQ ID NO: 486332 - DNA, 25 bp, Rattus norvegicus
ccctttagtcttgcggcgctccgtg

SEQ ID NO: 486333 - DNA, 25 bp, Rattus norvegicus
gagcgatcccagctgccactccagt

SEQ ID NO: 486334 - DNA, 25 bp, Rattus norvegicus
cgctgaaagctgttaatgtctggtc

SEQ ID NO: 486335 - DNA, 25 bp, Rattus norvegicus
gcatggtttgcgctgaaagctgtta

SEQ ID NO: 486336 - DNA, 25 bp, Rattus norvegicus
ctgcccgtctggcacggcatggttt

SEQ ID NO: 486337 - DNA, 25 bp, Rattus norvegicus
aagtggcgttgcagtccggactgac

SEQ ID NO: 486338 - DNA, 25 bp, Rattus norvegicus
agtccggactgaccctagcaggtcc

SEQ ID NO: 486339 - DNA, 25 bp, Rattus norvegicus
cgaaccgcgcgctaccctgaaggtg

SEQ ID NO: 486340 - DNA, 25 bp, Rattus norvegicus
tctccacctcgaggccgccagcaag

SEQ ID NO: 486341 - DNA, 25 bp, Rattus norvegicus
ctccactcccaagaggcgcccgggc

SEQ ID NO: 486342 - DNA, 25 bp, Rattus norvegicus
agtcttgcggcgctccgtgtctcgc

SEQ ID NO: 486343 - DNA, 25 bp, Rattus norvegicus
ccgccgccagaggaaggaaaccaag

SEQ ID NO: 486344 - DNA, 25 bp, Rattus norvegicus
ctccaggccgaagttccgttaacag

SEQ ID NO: 486345 - DNA, 25 bp, Rattus norvegicus
ctcgcccacgatgaagctgtgattg

SEQ ID NO: 486346 - DNA, 25 bp, Rattus norvegicus
tcgaggattcgattggttagatctc

SEQ ID NO: 486347 - DNA, 25 bp, Rattus norvegicus
gaggcgggaccatattcgaggattc

SEQ ID NO: 486348 - DNA, 25 bp, Rattus norvegicus
tcagccattggacatcagcaacaga

SEQ ID NO: 486349 - DNA, 25 bp, Rattus norvegicus
ccagccagggtattgctcagccatt

SEQ ID NO: 486350 - DNA, 25 bp, Rattus norvegicus
cctcacagcgtcagaagcggcggaa

SEQ ID NO: 486351 - DNA, 25 bp, Rattus norvegicus
gaagctacagaagctcgcgagtccc

SEQ ID NO: 486352 - DNA, 25 bp, Rattus norvegicus
gtcccagtggctgagggaagctaca

SEQ ID NO: 486353 - DNA, 25 bp, Rattus norvegicus
ccggtgggcaacagaaagctgcaga

SEQ ID NO: 486354 - DNA, 25 bp, Rattus norvegicus
tctacgcctgcctttgcaagcgggc

SEQ ID NO: 486355 - DNA, 25 bp, Rattus norvegicus
cgaactccctttcgccaatggggcg

SEQ ID NO: 486356 - DNA, 25 bp, Rattus norvegicus
cgcgtgggaagaaacatgacctatt

SEQ ID NO: 486357 - DNA, 25 bp, Rattus norvegicus
atcaggccgccgtgctccagcatga

SEQ ID NO: 486358 - DNA, 25 bp, Rattus norvegicus
gaggtccctctacgcggtgcgctga

SEQ ID NO: 486359 - DNA, 25 bp, Rattus norvegicus
cgccctgccagaggcgcgttagagc

SEQ ID NO: 486360 - DNA, 25 bp, Rattus norvegicus
cagaggcgcgttagagccacggtcc

SEQ ID NO: 486361 - DNA, 25 bp, Rattus norvegicus
cccacaggtctgattgggcaggttc

SEQ ID NO: 486362 - DNA, 25 bp, Rattus norvegicus
gggaggctgcaaagatggtatcttc

SEQ ID NO: 486363 - DNA, 25 bp, Rattus norvegicus
ggtatcttccaaccgcggagccttg

SEQ ID NO: 486364 - DNA, 25 bp, Rattus norvegicus
ttcttcgcccggaggacgcggcctg

SEQ ID NO: 486365 - DNA, 25 bp, Rattus norvegicus
tgggccaatcccaggactacaaggg

SEQ ID NO: 486366 - DNA, 25 bp, Rattus norvegicus
gcagggcttcccttaaaggcgacgc

SEQ ID NO: 486367 - DNA, 25 bp, Rattus norvegicus
ccttaaaggcgacgcgcgaaaatgc

SEQ ID NO: 486368 - DNA, 25 bp, Rattus norvegicus
gcgaaaatgcgcgtcccttatccgg

SEQ ID NO: 486369 - DNA, 25 bp, Rattus norvegicus
tctcaccctaaataaacaaatgccc

SEQ ID NO: 486370 - DNA, 25 bp, Rattus norvegicus
cgcgcgcgcctcaaggctgaggaac

SEQ ID NO: 486371 - DNA, 25 bp, Rattus norvegicus
acgtgtgcgggctacgcactggacc

SEQ ID NO: 486372 - DNA, 25 bp, Rattus norvegicus
atcgccaggctaatggctagacaga

SEQ ID NO: 486373 - DNA, 25 bp, Rattus norvegicus
ctgctgcttctgcagatcgccaggc

SEQ ID NO: 486374 - DNA, 25 bp, Rattus norvegicus
tggctggcctttggctgctgcttct

SEQ ID NO: 486375 - DNA, 25 bp, Rattus norvegicus
atttccctgtgatctcccgggaggg

SEQ ID NO: 486376 - DNA, 25 bp, Rattus norvegicus
cggggcgaatccagggatttccctg

SEQ ID NO: 486377 - DNA, 25 bp, Rattus norvegicus
tacgcactggacctgctgtgccagg

SEQ ID NO: 486378 - DNA, 25 bp, Rattus norvegicus
ccgggccctggagacccgcatggat

SEQ ID NO: 486379 - DNA, 25 bp, Rattus norvegicus
gtactccgccttcggttgctgcacg

SEQ ID NO: 486380 - DNA, 25 bp, Rattus norvegicus
tgcgcgcagtactccgccttcggtt

SEQ ID NO: 486381 - DNA, 25 bp, Rattus norvegicus
agtgcttggacttcaggccgccctt

SEQ ID NO: 486382 - DNA, 25 bp, Rattus norvegicus
gcgcacccgcagtgcttggacttca

SEQ ID NO: 486383 - DNA, 25 bp, Rattus norvegicus
taatggctagacagaggactgtggc

SEQ ID NO: 486384 - DNA, 25 bp, Rattus norvegicus
gaccctaggcctgcggggcgaatcc

SEQ ID NO: 486385 - DNA, 25 bp, Rattus norvegicus
taacatgtggcgctgctccttcgac

SEQ ID NO: 486386 - DNA, 25 bp, Rattus norvegicus
agggcttcgagtgctacgaccgcaa

SEQ ID NO: 486387 - DNA, 25 bp, Rattus norvegicus
ggcccgaggtctatgccttaggcgt

SEQ ID NO: 486388 - DNA, 25 bp, Rattus norvegicus
tacgaccgcaagctttgcgccaacg

SEQ ID NO: 486389 - DNA, 25 bp, Rattus norvegicus
gcaactacggctggcgcgctcgcga

SEQ ID NO: 486390 - DNA, 25 bp, Rattus norvegicus
cagaacaagtacgaggaagtggacc

SEQ ID NO: 486391 - DNA, 25 bp, Rattus norvegicus
cagtgtctggcactcaccgtggccg

SEQ ID NO: 486392 - DNA, 25 bp, Rattus norvegicus
cttcgaccgcggagacccagtgtct

SEQ ID NO: 486393 - DNA, 25 bp, Rattus norvegicus
tgcctcctgcgcagatgcaatgtaa

SEQ ID NO: 486394 - DNA, 25 bp, Rattus norvegicus
atgccttaggcgtgcgtaacatgtg

SEQ ID NO: 486395 - DNA, 25 bp, Rattus norvegicus
tggacgatcccgaagcgcggcccga

SEQ ID NO: 486396 - DNA, 25 bp, Rattus norvegicus
ctcgacaacccgttcgtggacgatc

SEQ ID NO: 486397 - DNA, 25 bp, Rattus norvegicus
gatgcaatgtaaccagcccgcgctc

SEQ ID NO: 486398 - DNA, 25 bp, Rattus norvegicus
tgcgcatcgacgtggaccgcaagga

SEQ ID NO: 486399 - DNA, 25 bp, Rattus norvegicus
gcccaagcccaagccagagctggta

SEQ ID NO: 486400 - DNA, 25 bp, Rattus norvegicus
ttgtaacgtcatcccgttgccatgg

SEQ ID NO: 486401 - DNA, 25 bp, Rattus norvegicus
cgaaggcagacattccacggtgacc

SEQ ID NO: 486402 - DNA, 25 bp, Rattus norvegicus
agaactaggcagctgtcacgtgacc

SEQ ID NO: 486403 - DNA, 25 bp, Rattus norvegicus
agccctgccacctgttaagagaacg

SEQ ID NO: 486404 - DNA, 25 bp, Rattus norvegicus
taagagaacgtggtagccttgaccc

SEQ ID NO: 486405 - DNA, 25 bp, Rattus norvegicus
ggcacccgctcttgactgaggtcag

SEQ ID NO: 486406 - DNA, 25 bp, Rattus norvegicus
ggagactcacgcgttgcccacgtag

SEQ ID NO: 486407 - DNA, 25 bp, Rattus norvegicus
ttgcccacgtagaccctcgggatga

SEQ ID NO: 486408 - DNA, 25 bp, Rattus norvegicus
cgtccgagagcaggtcgttgagatc

SEQ ID NO: 486409 - DNA, 25 bp, Rattus norvegicus
cgttgagatcttgcaccgagagctc

SEQ ID NO: 486410 - DNA, 25 bp, Rattus norvegicus
acgccgtaccaatgcgggacgccta

SEQ ID NO: 486411 - DNA, 25 bp, Rattus norvegicus
gtgtcacccgtactggaacgccgta

SEQ ID NO: 486412 - DNA, 25 bp, Rattus norvegicus
gccgagatgtcgtcactccggtgtc

SEQ ID NO: 486413 - DNA, 25 bp, Rattus norvegicus
aggacacggtccctcatgacgggta

SEQ ID NO: 486414 - DNA, 25 bp, Rattus norvegicus
aggtacacgaggacacggtccctca

SEQ ID NO: 486415 - DNA, 25 bp, Rattus norvegicus
ctcatgacgggtaaagaggtacacg

SEQ ID NO: 486416 - DNA, 25 bp, Rattus norvegicus
cacggtccctcatgacgggtaaaga

SEQ ID NO: 486417 - DNA, 25 bp, Rattus norvegicus
ggtacacgaggacacggtccctcat

SEQ ID NO: 486418 - DNA, 25 bp, Rattus norvegicus
cggtccctcatgacgggtaaagagg

SEQ ID NO: 486419 - DNA, 25 bp, Rattus norvegicus
acacggtccctcatgacgggtaaag

SEQ ID NO: 486420 - DNA, 25 bp, Rattus norvegicus
gaggtacacgaggacacggtccctc

SEQ ID NO: 486421 - DNA, 25 bp, Rattus norvegicus
tcatgacgggtaaagaggtacacga

SEQ ID NO: 486422 - DNA, 25 bp, Rattus norvegicus
ggacacggtccctcatgacgggtaa

SEQ ID NO: 486423 - DNA, 25 bp, Rattus norvegicus
gtacacgaggacacggtccctcatg

SEQ ID NO: 486424 - DNA, 25 bp, Rattus norvegicus
catgacgggtaaagaggtacacgag

SEQ ID NO: 486425 - DNA, 25 bp, Rattus norvegicus
taaagaggtacacgaggacacggtc

SEQ ID NO: 486426 - DNA, 25 bp, Rattus norvegicus
ccctcatgacgggtaaagaggtaca

SEQ ID NO: 486427 - DNA, 25 bp, Rattus norvegicus
gacgtccaggtaccgcagttcccga

SEQ ID NO: 486428 - DNA, 25 bp, Rattus norvegicus
tggcgtcgagtgcagccacgaagac

SEQ ID NO: 486429 - DNA, 25 bp, Rattus norvegicus
caaacacgaagaggacgctggcgtc

SEQ ID NO: 486430 - DNA, 25 bp, Rattus norvegicus
cgcacaattgcaaacacgaagagga

SEQ ID NO: 486431 - DNA, 25 bp, Rattus norvegicus
gcgtgggcacgcacaattgcaaaca

SEQ ID NO: 486432 - DNA, 25 bp, Rattus norvegicus
gcacgctggcgtgggcacgcacaat

SEQ ID NO: 486433 - DNA, 25 bp, Rattus norvegicus
atcttgctggacgacgtgcgctgcg

SEQ ID NO: 486434 - DNA, 25 bp, Rattus norvegicus
tctgcgaccaacaaagcccgcaagg

SEQ ID NO: 486435 - DNA, 25 bp, Rattus norvegicus
ttgcacacgcggtgcgagccgccaa

SEQ ID NO: 486436 - DNA, 25 bp, Rattus norvegicus
tcgccagctgggctttgcacacgcg

SEQ ID NO: 486437 - DNA, 25 bp, Rattus norvegicus
tcggtgcgcctggtacggccctcag

SEQ ID NO: 486438 - DNA, 25 bp, Rattus norvegicus
cgaacctcagaacggctcggtgcgc

SEQ ID NO: 486439 - DNA, 25 bp, Rattus norvegicus
ggtaccgcagttcccgaacctcaga

SEQ ID NO: 486440 - DNA, 25 bp, Rattus norvegicus
cgctgcggatcttgctggacgacgt

SEQ ID NO: 486441 - DNA, 25 bp, Rattus norvegicus
cgcgaggacctttggcattgactaa

SEQ ID NO: 486442 - DNA, 25 bp, Rattus norvegicus
gcattgactaactttggggcgctaa

SEQ ID NO: 486443 - DNA, 25 bp, Rattus norvegicus
tgaatacttcttgctctgggcggga

SEQ ID NO: 486444 - DNA, 25 bp, Rattus norvegicus
gcacggcttgcaccgacctgcaatg

SEQ ID NO: 486445 - DNA, 25 bp, Rattus norvegicus
gtaacaaattactcacagccgcagc

SEQ ID NO: 486446 - DNA, 25 bp, Rattus norvegicus
ttgcgctcaggaagcgaggttgcca

SEQ ID NO: 486447 - DNA, 25 bp, Rattus norvegicus
aggttgccaggacaacgcgttctgg

SEQ ID NO: 486448 - DNA, 25 bp, Rattus norvegicus
ctcagagtctgagccgaaagcgagg

SEQ ID NO: 486449 - DNA, 25 bp, Rattus norvegicus
agaggggcgctaactattcttagta

SEQ ID NO: 486450 - DNA, 25 bp, Rattus norvegicus
aagaggcctggcaaatgcacgcgga

SEQ ID NO: 486451 - DNA, 25 bp, Rattus norvegicus
cgaggttgtgattggtgaatacttc

SEQ ID NO: 486452 - DNA, 25 bp, Rattus norvegicus
ggtccagcctcgtcttgtacgcacg

SEQ ID NO: 486453 - DNA, 25 bp, Rattus norvegicus
cccgggagatgtttgggaacagtca

SEQ ID NO: 486454 - DNA, 25 bp, Rattus norvegicus
atcgcgctcgcagccgctatgagca

SEQ ID NO: 486455 - DNA, 25 bp, Rattus norvegicus
tctcctccgggccatgccaccgagg

SEQ ID NO: 486456 - DNA, 25 bp, Rattus norvegicus
ttctcagagccccagcggatgcagc

SEQ ID NO: 486457 - DNA, 25 bp, Rattus norvegicus
cgagggcggatctgtggttctcaga

SEQ ID NO: 486458 - DNA, 25 bp, Rattus norvegicus
aggccgcgccaagtggctccggttc

SEQ ID NO: 486459 - DNA, 25 bp, Rattus norvegicus
tgcagttctgcaacggtgagcatgg

SEQ ID NO: 486460 - DNA, 25 bp, Rattus norvegicus
cgctgctgcagttctgcaacggtga

SEQ ID NO: 486461 - DNA, 25 bp, Rattus norvegicus
acgtcctcgctgctgcagttctgca

SEQ ID NO: 486462 - DNA, 25 bp, Rattus norvegicus
tgtacgacacgtcctcgctgctgca

SEQ ID NO: 486463 - DNA, 25 bp, Rattus norvegicus
tagcagcctgtacgacacgtcctcg

SEQ ID NO: 486464 - DNA, 25 bp, Rattus norvegicus
tccagctatagcagcctgtacgaca

SEQ ID NO: 486465 - DNA, 25 bp, Rattus norvegicus
gcttctccagctatagcagcctgta

SEQ ID NO: 486466 - DNA, 25 bp, Rattus norvegicus
gaggacggcttctccagctatagca

SEQ ID NO: 486467 - DNA, 25 bp, Rattus norvegicus
cgtcgttccggggacgtgttgctct

SEQ ID NO: 486468 - DNA, 25 bp, Rattus norvegicus
ctcagcatggaggacggcttctcca

SEQ ID NO: 486469 - DNA, 25 bp, Rattus norvegicus
tgtagacccactcgaagtcgctgcg

SEQ ID NO: 486470 - DNA, 25 bp, Rattus norvegicus
agctctagcgagctctctgcttcgc

SEQ ID NO: 486471 - DNA, 25 bp, Rattus norvegicus
gacgttggagctctagcgagctctc

SEQ ID NO: 486472 - DNA, 25 bp, Rattus norvegicus
acccatgatggggacgttggagctc

SEQ ID NO: 486473 - DNA, 25 bp, Rattus norvegicus
gctgcgctgttacccatgatgggga

SEQ ID NO: 486474 - DNA, 25 bp, Rattus norvegicus
acccactcgaagtcgctgcgggctg

SEQ ID NO: 486475 - DNA, 25 bp, Rattus norvegicus
ggtcgctgtagacccactcgaagtc

SEQ ID NO: 486476 - DNA, 25 bp, Rattus norvegicus
tgcggctggtcgctgtagacccact

SEQ ID NO: 486477 - DNA, 25 bp, Rattus norvegicus
atctctttgcgcctctgggtgtgcg

SEQ ID NO: 486478 - DNA, 25 bp, Rattus norvegicus
accgagcatctctttgcgcctctgg

SEQ ID NO: 486479 - DNA, 25 bp, Rattus norvegicus
ggacccagctaggttcgcgcgcgct

SEQ ID NO: 486480 - DNA, 25 bp, Rattus norvegicus
tagccaccgggacccagctaggttc

SEQ ID NO: 486481 - DNA, 25 bp, Rattus norvegicus
ctctgcttcgcagtgttcacctgtc

SEQ ID NO: 486482 - DNA, 25 bp, Rattus norvegicus
tgcgggctgcgctgttacccatgat

SEQ ID NO: 486483 - DNA, 25 bp, Rattus norvegicus
cagggcggcctcacatggtcagcgc

SEQ ID NO: 486484 - DNA, 25 bp, Rattus norvegicus
cgccgccagcctggtcatcgtcaca

SEQ ID NO: 486485 - DNA, 25 bp, Rattus norvegicus
caaggagccgcagccattgctgccg

SEQ ID NO: 486486 - DNA, 25 bp, Rattus norvegicus
aggagccgcagccattgctgccggc

SEQ ID NO: 486487 - DNA, 25 bp, Rattus norvegicus
accgcaaccatgagaaacccagcag

SEQ ID NO: 486488 - DNA, 25 bp, Rattus norvegicus
gcaaccatgagaaacccagcagccg

SEQ ID NO: 486489 - DNA, 25 bp, Rattus norvegicus
atgagaaacccagcagccgccctca

SEQ ID NO: 486490 - DNA, 25 bp, Rattus norvegicus
tcagcgctgccaacaccaagcctgg

SEQ ID NO: 486491 - DNA, 25 bp, Rattus norvegicus
gcgctgccaacaccaagcctggctc

SEQ ID NO: 486492 - DNA, 25 bp, Rattus norvegicus
tggctccacaggcagcaacgcgggt

SEQ ID NO: 486493 - DNA, 25 bp, Rattus norvegicus
cgccagcctggtcatcgtcacaccc

SEQ ID NO: 486494 - DNA, 25 bp, Rattus norvegicus
gccagggcggcctcacatggtcagc

SEQ ID NO: 486495 - DNA, 25 bp, Rattus norvegicus
ctcacatggtcagcgcccgccggcg

SEQ ID NO: 486496 - DNA, 25 bp, Rattus norvegicus
tccacaggcagcaacgcgggtagtg

SEQ ID NO: 486497 - DNA, 25 bp, Rattus norvegicus
ctgttctccgtgttctgctctgtgt

SEQ ID NO: 486498 - DNA, 25 bp, Rattus norvegicus
tcctcaactcaagcggactcgcaga

SEQ ID NO: 486499 - DNA, 25 bp, Rattus norvegicus
actcgcagaggggaagcaatcctcc

SEQ ID NO: 486500 - DNA, 25 bp, Rattus norvegicus
ggctgcgacctcaggaactcacggc

SEQ ID NO: 486501 - DNA, 25 bp, Rattus norvegicus
tgacttagcgcacgcacgaccgagc

SEQ ID NO: 486502 - DNA, 25 bp, Rattus norvegicus
tgctggcgtctttcccatccgagca

SEQ ID NO: 486503 - DNA, 25 bp, Rattus norvegicus
gtgcttcggaaccagcggaaccgcc

SEQ ID NO: 486504 - DNA, 25 bp, Rattus norvegicus
cctgcagtggccttctgttctccgt

SEQ ID NO: 486505 - DNA, 25 bp, Rattus norvegicus
tcagagttgaggactggccgtaaac

SEQ ID NO: 486506 - DNA, 25 bp, Rattus norvegicus
gcggggacatcctcagctaagaata

SEQ ID NO: 486507 - DNA, 25 bp, Rattus norvegicus
cgagtcgcactcattttcagagttg

SEQ ID NO: 486508 - DNA, 25 bp, Rattus norvegicus
gcctggctgcctttcctactaaacg

SEQ ID NO: 486509 - DNA, 25 bp, Rattus norvegicus
gctaagaatacacaggggcgcggct

SEQ ID NO: 486510 - DNA, 25 bp, Rattus norvegicus
attggtcattctggtcacgtgtcgc

SEQ ID NO: 486511 - DNA, 25 bp, Rattus norvegicus
gccgagatcgtggaactgcatgaga

SEQ ID NO: 486512 - DNA, 25 bp, Rattus norvegicus
ctgcatgagattgaggtggagacca

SEQ ID NO: 486513 - DNA, 25 bp, Rattus norvegicus
agattgaggtggagaccatcccggt

SEQ ID NO: 486514 - DNA, 25 bp, Rattus norvegicus
tcgagcagacgctggtcaccgtggc

SEQ ID NO: 486515 - DNA, 25 bp, Rattus norvegicus
cgactacatcgagcagacgctggtc

SEQ ID NO: 486516 - DNA, 25 bp, Rattus norvegicus
ccggcggagacgacgactacatcga

SEQ ID NO: 486517 - DNA, 25 bp, Rattus norvegicus
accatcccggtggagactatcgaga

SEQ ID NO: 486518 - DNA, 25 bp, Rattus norvegicus
tggagactatcgagaccacggtggt

SEQ ID NO: 486519 - DNA, 25 bp, Rattus norvegicus
ggacgggttcgaggaccagatcctc

SEQ ID NO: 486520 - DNA, 25 bp, Rattus norvegicus
ctcggagatgccagccgagatcgtg

SEQ ID NO: 486521 - DNA, 25 bp, Rattus norvegicus
ccaccaccaagaggtgattctggtg

SEQ ID NO: 486522 - DNA, 25 bp, Rattus norvegicus
tctacattgccacggacggctcgga

SEQ ID NO: 486523 - DNA, 25 bp, Rattus norvegicus
atgatcgcgctgcagccgctggtca

SEQ ID NO: 486524 - DNA, 25 bp, Rattus norvegicus
aggaccagatcctcattccggtacc

SEQ ID NO: 486525 - DNA, 25 bp, Rattus norvegicus
gagctgcctcgctgtctacctgatc

SEQ ID NO: 486526 - DNA, 25 bp, Rattus norvegicus
gttgatgccgcgcaggccctcatgc

SEQ ID NO: 486527 - DNA, 25 bp, Rattus norvegicus
tctcccgcaggagtgtggacaccat

SEQ ID NO: 486528 - DNA, 25 bp, Rattus norvegicus
acatcgtaagtgaggaagtagaccc

SEQ ID NO: 486529 - DNA, 25 bp, Rattus norvegicus
ccatggcacgggtcagtacatcgta

SEQ ID NO: 486530 - DNA, 25 bp, Rattus norvegicus
cttaaccacgtccatgggataggtg

SEQ ID NO: 486531 - DNA, 25 bp, Rattus norvegicus
gcttgcaggcgcgacttaaccacgt

SEQ ID NO: 486532 - DNA, 25 bp, Rattus norvegicus
tagcgaggggttccctgcagcccgt

SEQ ID NO: 486533 - DNA, 25 bp, Rattus norvegicus
tgccgcatgcagtcgacgatgccgc

SEQ ID NO: 486534 - DNA, 25 bp, Rattus norvegicus
cggcctggtaactctgccgcatgca

SEQ ID NO: 486535 - DNA, 25 bp, Rattus norvegicus
ttgtgaagacttgccagccctcggc

SEQ ID NO: 486536 - DNA, 25 bp, Rattus norvegicus
tggaggccagccctcttgtgaagac

SEQ ID NO: 486537 - DNA, 25 bp, Rattus norvegicus
gcaccacagtgaccgtggcgaaggt

SEQ ID NO: 486538 - DNA, 25 bp, Rattus norvegicus
cccggatatacgtaagcaccacagt

SEQ ID NO: 486539 - DNA, 25 bp, Rattus norvegicus
gcgctcgatctgcttcgaccctggg

SEQ ID NO: 486540 - DNA, 25 bp, Rattus norvegicus
atctccttaggcgaacgggctgaag

SEQ ID NO: 486541 - DNA, 25 bp, Rattus norvegicus
agttcgagaacagccgcccacttgg

SEQ ID NO: 486542 - DNA, 25 bp, Rattus norvegicus
cggccttggactcagctagctgtga

SEQ ID NO: 486543 - DNA, 25 bp, Rattus norvegicus
cctcacggtgtttggatgcgactct

SEQ ID NO: 486544 - DNA, 25 bp, Rattus norvegicus
tggagccggaaacgtcccaactgca

SEQ ID NO: 486545 - DNA, 25 bp, Rattus norvegicus
acaaagactgtgcttctcgggcccg

SEQ ID NO: 486546 - DNA, 25 bp, Rattus norvegicus
ctcggggttcagtagacaaagactg

SEQ ID NO: 486547 - DNA, 25 bp, Rattus norvegicus
ggatgcagccgccaagcctcattgg

SEQ ID NO: 486548 - DNA, 25 bp, Rattus norvegicus
ggggtcagagcacaaccaatcggca

SEQ ID NO: 486549 - DNA, 25 bp, Rattus norvegicus
cgttttcaaacagaaggggcctgtg

SEQ ID NO: 486550 - DNA, 25 bp, Rattus norvegicus
caggggcttgagtttgaacgacgca

SEQ ID NO: 486551 - DNA, 25 bp, Rattus norvegicus
cgactgggtggcgaatcttagaaaa

SEQ ID NO: 486552 - DNA, 25 bp, Rattus norvegicus
aacttcatcgtccttgcctgtgtca

SEQ ID NO: 486553 - DNA, 25 bp, Rattus norvegicus
tgccggttcagaggcaagaacggtc

SEQ ID NO: 486554 - DNA, 25 bp, Rattus norvegicus
aggcaagaacggtctgctcccacca

SEQ ID NO: 486555 - DNA, 25 bp, Rattus norvegicus
ccggagccatgattgccggttcaga

SEQ ID NO: 486556 - DNA, 25 bp, Rattus norvegicus
accggccagccaagactcggggctg

SEQ ID NO: 486557 - DNA, 25 bp, Rattus norvegicus
gcggccaacccggagccatgattgc

SEQ ID NO: 486558 - DNA, 25 bp, Rattus norvegicus
ctctgctctgcgacgccgaaagttg

SEQ ID NO: 486559 - DNA, 25 bp, Rattus norvegicus
atcccaacacgaggagctgcggcag

SEQ ID NO: 486560 - DNA, 25 bp, Rattus norvegicus
gcgtgtatcaacaccaacccgaatc

SEQ ID NO: 486561 - DNA, 25 bp, Rattus norvegicus
cggccgtggcgtgtatcaacaccaa

SEQ ID NO: 486562 - DNA, 25 bp, Rattus norvegicus
gccatgcatacctggtgcttgctcc

SEQ ID NO: 486563 - DNA, 25 bp, Rattus norvegicus
ctgtctctgagccatgcatacctgg

SEQ ID NO: 486564 - DNA, 25 bp, Rattus norvegicus
ccaagtccgaggtttactgtctctg

SEQ ID NO: 486565 - DNA, 25 bp, Rattus norvegicus
cgacgccgaaagttgttcagttccg

SEQ ID NO: 486566 - DNA, 25 bp, Rattus norvegicus
acccgaatcccaacacgaggagctg

SEQ ID NO: 486567 - DNA, 25 bp, Rattus norvegicus
cagccggctggaacaacttccggtc

SEQ ID NO: 486568 - DNA, 25 bp, Rattus norvegicus
gccattggttgtccagccagaggca

SEQ ID NO: 486569 - DNA, 25 bp, Rattus norvegicus
tcgtggtgctagtgctcagagaaca

SEQ ID NO: 486570 - DNA, 25 bp, Rattus norvegicus
ctcagagaacattgagtccggttcc

SEQ ID NO: 486571 - DNA, 25 bp, Rattus norvegicus
gtccggttccgagctggaccctcat

SEQ ID NO: 486572 - DNA, 25 bp, Rattus norvegicus
acgtcaggccaaggttccggcgcca

SEQ ID NO: 486573 - DNA, 25 bp, Rattus norvegicus
tacctcctgggcgtctgtggaaacc

SEQ ID NO: 486574 - DNA, 25 bp, Rattus norvegicus
tcagttcgctgctcgccttcctttt

SEQ ID NO: 486575 - DNA, 25 bp, Rattus norvegicus
ctctgattggctgaggttcccggcg

SEQ ID NO: 486576 - DNA, 25 bp, Rattus norvegicus
tcccggcgtcgtggtggaacgccac

SEQ ID NO: 486577 - DNA, 25 bp, Rattus norvegicus
ggcagggcagagctcatctctgatt

SEQ ID NO: 486578 - DNA, 25 bp, Rattus norvegicus
aggggtgtaccaagcgcttccgtgt

SEQ ID NO: 486579 - DNA, 25 bp, Rattus norvegicus
cttagcgccgggctcagttcgctgc

SEQ ID NO: 486580 - DNA, 25 bp, Rattus norvegicus
agcaccgctggttcagccaccggta

SEQ ID NO: 486581 - DNA, 25 bp, Rattus norvegicus
cggtcttatgatccggcggatcctc

SEQ ID NO: 486582 - DNA, 25 bp, Rattus norvegicus
cctgaggacgcttccgggctctggc

SEQ ID NO: 486583 - DNA, 25 bp, Rattus norvegicus
ccctggggccggacggtcttatgat

SEQ ID NO: 486584 - DNA, 25 bp, Rattus norvegicus
ccggcggatcctcctggggaggccg

SEQ ID NO: 486585 - DNA, 25 bp, Rattus norvegicus
tgtcgtggttcccgaaaggcctcca

SEQ ID NO: 486586 - DNA, 25 bp, Rattus norvegicus
tcccgaaaggcctccacctctcctc

SEQ ID NO: 486587 - DNA, 25 bp, Rattus norvegicus
tctggccgcactttcgcgaggagcc

SEQ ID NO: 486588 - DNA, 25 bp, Rattus norvegicus
tggccgcactttcgcgaggagccct

SEQ ID NO: 486589 - DNA, 25 bp, Rattus norvegicus
actttcgcgaggagccctgggctcc

SEQ ID NO: 486590 - DNA, 25 bp, Rattus norvegicus
gcgaggagccctgggctccttccga

SEQ ID NO: 486591 - DNA, 25 bp, Rattus norvegicus
ccttccgagcggctgcccgagagcc

SEQ ID NO: 486592 - DNA, 25 bp, Rattus norvegicus
tcaagctagagtgagcggcaggagc

SEQ ID NO: 486593 - DNA, 25 bp, Rattus norvegicus
ccgcctcgcggggagtcaagctaga

SEQ ID NO: 486594 - DNA, 25 bp, Rattus norvegicus
gacggtcttatgatccggcggatcc

SEQ ID NO: 486595 - DNA, 25 bp, Rattus norvegicus
tcctgagcagaagcaagagtgcctc

SEQ ID NO: 486596 - DNA, 25 bp, Rattus norvegicus
ggtgcgtggttccaacactctccag

SEQ ID NO: 486597 - DNA, 25 bp, Rattus norvegicus
cccgttgcgcgcaggaagtacgatc

SEQ ID NO: 486598 - DNA, 25 bp, Rattus norvegicus
caggaagtacgatcccgctcgggcc

SEQ ID NO: 486599 - DNA, 25 bp, Rattus norvegicus
gcagaagggtcctgagcagaagcaa

SEQ ID NO: 486600 - DNA, 25 bp, Rattus norvegicus
aagagtgcctcgcttccgatgccgt

SEQ ID NO: 486601 - DNA, 25 bp, Rattus norvegicus
agccgcccaagagtcgacgggcacg

SEQ ID NO: 486602 - DNA, 25 bp, Rattus norvegicus
gggcgggctcacctgttacacagcc

SEQ ID NO: 486603 - DNA, 25 bp, Rattus norvegicus
gggctcacctgttacacagccgcgg

SEQ ID NO: 486604 - DNA, 25 bp, Rattus norvegicus
gcgcgcacggggctgcccacgaaaa

SEQ ID NO: 486605 - DNA, 25 bp, Rattus norvegicus
tctcctttgctctccgcaggcctct

SEQ ID NO: 486606 - DNA, 25 bp, Rattus norvegicus
aggcctctgccgcagacatggagaa

SEQ ID NO: 486607 - DNA, 25 bp, Rattus norvegicus
ccgcagacatggagaaactcaggtg

SEQ ID NO: 486608 - DNA, 25 bp, Rattus norvegicus
gtggttccaacactctccagcgact

SEQ ID NO: 486609 - DNA, 25 bp, Rattus norvegicus
cccgtacaagggagacatctactgc

SEQ ID NO: 486610 - DNA, 25 bp, Rattus norvegicus
tgggcttcctgcgtgcgcagaattc

SEQ ID NO: 486611 - DNA, 25 bp, Rattus norvegicus
ctgtcctcgcgcatgtcggatgcct

SEQ ID NO: 486612 - DNA, 25 bp, Rattus norvegicus
tcatcgccaaggtgctggagaagcc

SEQ ID NO: 486613 - DNA, 25 bp, Rattus norvegicus
tcgccctgcaacttctcagaacgtt

SEQ ID NO: 486614 - DNA, 25 bp, Rattus norvegicus
agggcgatgacctctcccagggtca

SEQ ID NO: 486615 - DNA, 25 bp, Rattus norvegicus
tctactgcagcgacacggctctcta

SEQ ID NO: 486616 - DNA, 25 bp, Rattus norvegicus
tgccagctacaaagccgatagtttc

SEQ ID NO: 486617 - DNA, 25 bp, Rattus norvegicus
tctactgccctgacgagcgagatca

SEQ ID NO: 486618 - DNA, 25 bp, Rattus norvegicus
attccaccgacagcctggcggaaga

SEQ ID NO: 486619 - DNA, 25 bp, Rattus norvegicus
aggccatctacctgaacagccgcga

SEQ ID NO: 486620 - DNA, 25 bp, Rattus norvegicus
gcttcgctcggactgtgtctccgta

SEQ ID NO: 486621 - DNA, 25 bp, Rattus norvegicus
tcagaacgtttctacggcggcggtg

SEQ ID NO: 486622 - DNA, 25 bp, Rattus norvegicus
tgtgggcgcctactcttaccaggcc

SEQ ID NO: 486623 - DNA, 25 bp, Rattus norvegicus
gggtgaatgagtcccgcgcacatga

SEQ ID NO: 486624 - DNA, 25 bp, Rattus norvegicus
ccgccattcatgtgcgcgggactca

SEQ ID NO: 486625 - DNA, 25 bp, Rattus norvegicus
cgccattcatgtgcgcgggactcat

SEQ ID NO: 486626 - DNA, 25 bp, Rattus norvegicus
tcatgtgcgcgggactcattcaccc

SEQ ID NO: 486627 - DNA, 25 bp, Rattus norvegicus
atgtgcgcgggactcattcaccccg

SEQ ID NO: 486628 - DNA, 25 bp, Rattus norvegicus
cgcgcgccgccattccgcgccctgt

SEQ ID NO: 486629 - DNA, 25 bp, Rattus norvegicus
gccgccattcatgtgcgcgggactc

SEQ ID NO: 486630 - DNA, 25 bp, Rattus norvegicus
cggggtgaatgagtcccgcgcacat

SEQ ID NO: 486631 - DNA, 25 bp, Rattus norvegicus
atgagtcccgcgcacatgaatggcg

SEQ ID NO: 486632 - DNA, 25 bp, Rattus norvegicus
tgagtcccgcgcacatgaatggcgg

SEQ ID NO: 486633 - DNA, 25 bp, Rattus norvegicus
gagtcccgcgcacatgaatggcggc

SEQ ID NO: 486634 - DNA, 25 bp, Rattus norvegicus
agtcccgcgcacatgaatggcggcg

SEQ ID NO: 486635 - DNA, 25 bp, Rattus norvegicus
cgcgccgccattccgcgccctgtgc

SEQ ID NO: 486636 - DNA, 25 bp, Rattus norvegicus
cacagggcgcggaatggcggcgcgc

SEQ ID NO: 486637 - DNA, 25 bp, Rattus norvegicus
gggactccgcaaaccgggacagctg

SEQ ID NO: 486638 - DNA, 25 bp, Rattus norvegicus
agctgtcggagtctatcgagggccc

SEQ ID NO: 486639 - DNA, 25 bp, Rattus norvegicus
caaatcggtggaaacaggagcgagc

SEQ ID NO: 486640 - DNA, 25 bp, Rattus norvegicus
ctgcttagagtacaaatcggtggaa

SEQ ID NO: 486641 - DNA, 25 bp, Rattus norvegicus
ccagcttctgcttagagtacaaatc

SEQ ID NO: 486642 - DNA, 25 bp, Rattus norvegicus
ggggttctcccagcttctgcttaga

SEQ ID NO: 486643 - DNA, 25 bp, Rattus norvegicus
cagagcccaagttggcgggatgtca

SEQ ID NO: 486644 - DNA, 25 bp, Rattus norvegicus
gagcccgttgtgcagagcccaagtt

SEQ ID NO: 486645 - DNA, 25 bp, Rattus norvegicus
tttcatctcgggagacacgcggttc

SEQ ID NO: 486646 - DNA, 25 bp, Rattus norvegicus
ttcctttgcaatctttcatctcggg

SEQ ID NO: 486647 - DNA, 25 bp, Rattus norvegicus
ggaactatttttgtcttcctttgca

SEQ ID NO: 486648 - DNA, 25 bp, Rattus norvegicus
tgaggcagtccctttcggaggaact

SEQ ID NO: 486649 - DNA, 25 bp, Rattus norvegicus
tccgcaaaccgggacagctgaggca

SEQ ID NO: 486650 - DNA, 25 bp, Rattus norvegicus
gacagctgaggcagtccctttcgga

SEQ ID NO: 486651 - DNA, 25 bp, Rattus norvegicus
agatgatcgcgaccggagccctcct

SEQ ID NO: 486652 - DNA, 25 bp, Rattus norvegicus
ctcggcagccgcacttagtagcgtg

SEQ ID NO: 486653 - DNA, 25 bp, Rattus norvegicus
gctttcggccacagcacctatggtg

SEQ ID NO: 486654 - DNA, 25 bp, Rattus norvegicus
gcgcaggtacccgtctagccaaaga

SEQ ID NO: 486655 - DNA, 25 bp, Rattus norvegicus
tctagccaaagagtgcagccgcgtg

SEQ ID NO: 486656 - DNA, 25 bp, Rattus norvegicus
tacgacagtacgaaaaggcggcgcg

SEQ ID NO: 486657 - DNA, 25 bp, Rattus norvegicus
accctggctttctttccgctggaca

SEQ ID NO: 486658 - DNA, 25 bp, Rattus norvegicus
ttggttcctgagacttgcgctaagc

SEQ ID NO: 486659 - DNA, 25 bp, Rattus norvegicus
gtcctcttgctcctgctggctttcg

SEQ ID NO: 486660 - DNA, 25 bp, Rattus norvegicus
tgcgtacgagggctttcgctcgcct

SEQ ID NO: 486661 - DNA, 25 bp, Rattus norvegicus
agcgttttgtattctgggtgcgtac

SEQ ID NO: 486662 - DNA, 25 bp, Rattus norvegicus
gactccagccctaagtgtcttactg

SEQ ID NO: 486663 - DNA, 25 bp, Rattus norvegicus
gtgcgtctttcacatcttcgtggtg

SEQ ID NO: 486664 - DNA, 25 bp, Rattus norvegicus
gttttcgtgtgtgcatctgtgatca

SEQ ID NO: 486665 - DNA, 25 bp, Rattus norvegicus
tccagcacacccaggtgagcttcga

SEQ ID NO: 486666 - DNA, 25 bp, Rattus norvegicus
gaacgatggcgtctgcaccgacatc

SEQ ID NO: 486667 - DNA, 25 bp, Rattus norvegicus
tggcttctcgggcaacttctgtgag

SEQ ID NO: 486668 - DNA, 25 bp, Rattus norvegicus
tcgggcaacttctgtgagatcgtga

SEQ ID NO: 486669 - DNA, 25 bp, Rattus norvegicus
tgagatcgtgaccaacagctgtacc

SEQ ID NO: 486670 - DNA, 25 bp, Rattus norvegicus
gggcctcgcatgcttcctgcctgtg

SEQ ID NO: 486671 - DNA, 25 bp, Rattus norvegicus
cctaacccatgcgagaacgatggcg

SEQ ID NO: 486672 - DNA, 25 bp, Rattus norvegicus
tgcccagctggattcgtcgacaaga

SEQ ID NO: 486673 - DNA, 25 bp, Rattus norvegicus
gtcgacaagacctgcagccgtccgg

SEQ ID NO: 486674 - DNA, 25 bp, Rattus norvegicus
aactgcgccagtggcccgtgcctga

SEQ ID NO: 486675 - DNA, 25 bp, Rattus norvegicus
aggtgagcttcgagtgtctgtgcaa

SEQ ID NO: 486676 - DNA, 25 bp, Rattus norvegicus
ttcatgggtcccacatgcgcgaaga

SEQ ID NO: 486677 - DNA, 25 bp, Rattus norvegicus
acatgcgcgaagaagcgcgggacca

SEQ ID NO: 486678 - DNA, 25 bp, Rattus norvegicus
agccgtccggtgagcaactgcgcca

SEQ ID NO: 486679 - DNA, 25 bp, Rattus norvegicus
acacaatgttctcggcctggtgctt

SEQ ID NO: 486680 - DNA, 25 bp, Rattus norvegicus
tacacaatgttctcggcctggtgct

SEQ ID NO: 486681 - DNA, 25 bp, Rattus norvegicus
gcggtggtacacaatgttctcggcc

SEQ ID NO: 486682 - DNA, 25 bp, Rattus norvegicus
tcgcgaggctaagcggtggtacaca

SEQ ID NO: 486683 - DNA, 25 bp, Rattus norvegicus
cgaggctaagcggtggtacacaatg

SEQ ID NO: 486684 - DNA, 25 bp, Rattus norvegicus
ggctaagcggtggtacacaatgttc

SEQ ID NO: 486685 - DNA, 25 bp, Rattus norvegicus
ctaagcggtggtacacaatgttctc

SEQ ID NO: 486686 - DNA, 25 bp, Rattus norvegicus
agcggtggtacacaatgttctcggc

SEQ ID NO: 486687 - DNA, 25 bp, Rattus norvegicus
ggtggtacacaatgttctcggcctg

SEQ ID NO: 486688 - DNA, 25 bp, Rattus norvegicus
gtggtacacaatgttctcggcctgg

SEQ ID NO: 486689 - DNA, 25 bp, Rattus norvegicus
tggtacacaatgttctcggcctggt

SEQ ID NO: 486690 - DNA, 25 bp, Rattus norvegicus
ggtacacaatgttctcggcctggtg

SEQ ID NO: 486691 - DNA, 25 bp, Rattus norvegicus
gtacacaatgttctcggcctggtgc

SEQ ID NO: 486692 - DNA, 25 bp, Rattus norvegicus
taagcggtggtacacaatgttctcg

SEQ ID NO: 486693 - DNA, 25 bp, Rattus norvegicus
cttcgtgaaacaggcacggggcact

SEQ ID NO: 486694 - DNA, 25 bp, Rattus norvegicus
cgcggctcagagtggtagtgaatca

SEQ ID NO: 486695 - DNA, 25 bp, Rattus norvegicus
tgaatcacgtcacatccgcaaagct

SEQ ID NO: 486696 - DNA, 25 bp, Rattus norvegicus
acaggctgaaggcttcgtgaaacag

SEQ ID NO: 486697 - DNA, 25 bp, Rattus norvegicus
cactgacggtgtgggttttaccgtg

SEQ ID NO: 486698 - DNA, 25 bp, Rattus norvegicus
gtgggttttaccgtgacacagattc

SEQ ID NO: 486699 - DNA, 25 bp, Rattus norvegicus
cgtgacacagattcaagaagcgcgc

SEQ ID NO: 486700 - DNA, 25 bp, Rattus norvegicus
agaagcgcgctataacgcggatgta

SEQ ID NO: 486701 - DNA, 25 bp, Rattus norvegicus
cgcggatgtagcgaatcttcactaa

SEQ ID NO: 486702 - DNA, 25 bp, Rattus norvegicus
tcttcactaagaaacagtacgcgcc

SEQ ID NO: 486703 - DNA, 25 bp, Rattus norvegicus
cagtacgcgccatgggacaatgttc

SEQ ID NO: 486704 - DNA, 25 bp, Rattus norvegicus
gacaatgttcttacgtggatcactg

SEQ ID NO: 486705 - DNA, 25 bp, Rattus norvegicus
atcactgtggtctagggtaggcgcc

SEQ ID NO: 486706 - DNA, 25 bp, Rattus norvegicus
gcaaagctccacctcacaggctgaa

SEQ ID NO: 486707 - DNA, 25 bp, Rattus norvegicus
cttcctggtacagctacgtggtata

SEQ ID NO: 486708 - DNA, 25 bp, Rattus norvegicus
gccaagcgccttcctggtacagcta

SEQ ID NO: 486709 - DNA, 25 bp, Rattus norvegicus
agcgccttcctggtacagctacgtg

SEQ ID NO: 486710 - DNA, 25 bp, Rattus norvegicus
gagccaagcgccttcctggtacagc

SEQ ID NO: 486711 - DNA, 25 bp, Rattus norvegicus
gcctcacggcaaaaaatgtgtggat

SEQ ID NO: 486712 - DNA, 25 bp, Rattus norvegicus
agcgcctcacggcaaaaaatgtgtg

SEQ ID NO: 486713 - DNA, 25 bp, Rattus norvegicus
gccaagcgcctcacggcaaaaaatg

SEQ ID NO: 486714 - DNA, 25 bp, Rattus norvegicus
gaagccaagcgcctcacggcaaaaa

SEQ ID NO: 486715 - DNA, 25 bp, Rattus norvegicus
acggtagaagccaagcgcctcacgg

SEQ ID NO: 486716 - DNA, 25 bp, Rattus norvegicus
ctggtacagctacgtggtatactac

SEQ ID NO: 486717 - DNA, 25 bp, Rattus norvegicus
gccttcctggtacagctacgtggta

SEQ ID NO: 486718 - DNA, 25 bp, Rattus norvegicus
cactacggtaggagccaagcgcctt

SEQ ID NO: 486719 - DNA, 25 bp, Rattus norvegicus
tactacggtagaagccaagcgcctc

SEQ ID NO: 486720 - DNA, 25 bp, Rattus norvegicus
cctggtacagctacgtggtatacta

SEQ ID NO: 486721 - DNA, 25 bp, Rattus norvegicus
tgtggcacagctacgtggtacacta

SEQ ID NO: 486722 - DNA, 25 bp, Rattus norvegicus
tgtggcacagacacacggacgtacc

SEQ ID NO: 486723 - DNA, 25 bp, Rattus norvegicus
atatactacggtacaggccaagcgc

SEQ ID NO: 486724 - DNA, 25 bp, Rattus norvegicus
cgcctcagcaccgttacatgatata

SEQ ID NO: 486725 - DNA, 25 bp, Rattus norvegicus
caggtcagacgcctcagcaccgtta

SEQ ID NO: 486726 - DNA, 25 bp, Rattus norvegicus
cggacgtaccgcaatacaggtcaga

SEQ ID NO: 486727 - DNA, 25 bp, Rattus norvegicus
ggccaagcgctatgtggcacagcta

SEQ ID NO: 486728 - DNA, 25 bp, Rattus norvegicus
tacgtgagatactacagtgtaggcc

SEQ ID NO: 486729 - DNA, 25 bp, Rattus norvegicus
gcctgtggcacagatacgtgagata

SEQ ID NO: 486730 - DNA, 25 bp, Rattus norvegicus
actatgtatggtacaagctgggtgc

SEQ ID NO: 486731 - DNA, 25 bp, Rattus norvegicus
gcgcaaacacatcgtgtactatgta

SEQ ID NO: 486732 - DNA, 25 bp, Rattus norvegicus
cttcgtggcgcaaacacatcgtgta

SEQ ID NO: 486733 - DNA, 25 bp, Rattus norvegicus
tacgtggatgttctgcggtataggc

SEQ ID NO: 486734 - DNA, 25 bp, Rattus norvegicus
cggtataggcgcttcgtggcgcaaa

SEQ ID NO: 486735 - DNA, 25 bp, Rattus norvegicus
ggcccactgcgtggagcaccagtca

SEQ ID NO: 486736 - DNA, 25 bp, Rattus norvegicus
caccaggtcccttgtgcaccacgcg

SEQ ID NO: 486737 - DNA, 25 bp, Rattus norvegicus
gaccgcgcaccaggtcccttgtgca

SEQ ID NO: 486738 - DNA, 25 bp, Rattus norvegicus
tggcacacccaaggggcgagtctcc

SEQ ID NO: 486739 - DNA, 25 bp, Rattus norvegicus
ggccgtgaggctgtggcacacccaa

SEQ ID NO: 486740 - DNA, 25 bp, Rattus norvegicus
gtcgtgggatgcagaaccacggaaa

SEQ ID NO: 486741 - DNA, 25 bp, Rattus norvegicus
agctggaggacaaacccccgaggtg

SEQ ID NO: 486742 - DNA, 25 bp, Rattus norvegicus
ccctcggcggcttccagctgcgccc

SEQ ID NO: 486743 - DNA, 25 bp, Rattus norvegicus
gaaggcagaagaatggtacccggcc

SEQ ID NO: 486744 - DNA, 25 bp, Rattus norvegicus
caccgaaggcagaagaatggtaccc

SEQ ID NO: 486745 - DNA, 25 bp, Rattus norvegicus
cagtcacaccgaaggcagaagaatg

SEQ ID NO: 486746 - DNA, 25 bp, Rattus norvegicus
gcaccagtcacaccgaaggcagaag

SEQ ID NO: 486747 - DNA, 25 bp, Rattus norvegicus
tggagcaccagtcacaccgaaggca

SEQ ID NO: 486748 - DNA, 25 bp, Rattus norvegicus
tgcgtggagcaccagtcacaccgaa

SEQ ID NO: 486749 - DNA, 25 bp, Rattus norvegicus
tgtgattcaggcctgggagccagtt

SEQ ID NO: 486750 - DNA, 25 bp, Rattus norvegicus
tgactccggcatcagagtcctgaca

SEQ ID NO: 486751 - DNA, 25 bp, Rattus norvegicus
gcgttggggatctagccacccaaga

SEQ ID NO: 486752 - DNA, 25 bp, Rattus norvegicus
cctgggagccagttgtacccgctct

SEQ ID NO: 486753 - DNA, 25 bp, Rattus norvegicus
acccaagacagtgactccggcatca

SEQ ID NO: 486754 - DNA, 25 bp, Rattus norvegicus
agcggccaaagctggtgcgctcttt

SEQ ID NO: 486755 - DNA, 25 bp, Rattus norvegicus
ccgcatccttttctgaatgtcgctc

SEQ ID NO: 486756 - DNA, 25 bp, Rattus norvegicus
gctcatcagtgtggccgctgtgatt

SEQ ID NO: 486757 - DNA, 25 bp, Rattus norvegicus
ttcccacgtcgcctgcggtgtgggt

SEQ ID NO: 486758 - DNA, 25 bp, Rattus norvegicus
cttgtgaccgcggagttcccacgtc

SEQ ID NO: 486759 - DNA, 25 bp, Rattus norvegicus
acgacctcgcggaggcccttgtgac

SEQ ID NO: 486760 - DNA, 25 bp, Rattus norvegicus
tggacagtcaaagcccacgacctcg

SEQ ID NO: 486761 - DNA, 25 bp, Rattus norvegicus
tcctgacaatgtgctgtggacagtc

SEQ ID NO: 486762 - DNA, 25 bp, Rattus norvegicus
aatgtcgctcgcagactcaggccct

SEQ ID NO: 486763 - DNA, 25 bp, Rattus norvegicus
cttgtcccgcatgaatttttgctgc

SEQ ID NO: 486764 - DNA, 25 bp, Rattus norvegicus
gaagcacgccgcatggcccgggaca

SEQ ID NO: 486765 - DNA, 25 bp, Rattus norvegicus
cctgccgatcatcagcagaagcgca

SEQ ID NO: 486766 - DNA, 25 bp, Rattus norvegicus
ccgatcatcagcagaagcgcagcag

SEQ ID NO: 486767 - DNA, 25 bp, Rattus norvegicus
cagcgccggaccgattcctctggat

SEQ ID NO: 486768 - DNA, 25 bp, Rattus norvegicus
ggaccgattcctctggatccttcta

SEQ ID NO: 486769 - DNA, 25 bp, Rattus norvegicus
gattcctctggatccttctagaagc

SEQ ID NO: 486770 - DNA, 25 bp, Rattus norvegicus
ctggctgcgcagaagcacgccgcat

SEQ ID NO: 486771 - DNA, 25 bp, Rattus norvegicus
ccttctagaagcaactacgccactg

SEQ ID NO: 486772 - DNA, 25 bp, Rattus norvegicus
gcagctcgctggctgcgcagaagca

SEQ ID NO: 486773 - DNA, 25 bp, Rattus norvegicus
aactacgccactggctgtcaggcgc

SEQ ID NO: 486774 - DNA, 25 bp, Rattus norvegicus
gctgtcaggcgcctgcgctcttgtc

SEQ ID NO: 486775 - DNA, 25 bp, Rattus norvegicus
cctgcgctcttgtcccgcatgaatt

SEQ ID NO: 486776 - DNA, 25 bp, Rattus norvegicus
ctctggatccttctagaagcaacta

SEQ ID NO: 486777 - DNA, 25 bp, Rattus norvegicus
gtttccatggaaaccgcatggcgcg

SEQ ID NO: 486778 - DNA, 25 bp, Rattus norvegicus
gtgagcacagtaggaaatacccttc

SEQ ID NO: 486779 - DNA, 25 bp, Rattus norvegicus
gaagcggttaccttcgtgcctccga

SEQ ID NO: 486780 - DNA, 25 bp, Rattus norvegicus
ccgcacgggtaagagtctccttgca

SEQ ID NO: 486781 - DNA, 25 bp, Rattus norvegicus
ccgaggtggttggaatgaatgcttt

SEQ ID NO: 486782 - DNA, 25 bp, Rattus norvegicus
gctggacacgcgagcgcagccctta

SEQ ID NO: 486783 - DNA, 25 bp, Rattus norvegicus
ccgccgacattgtaggctggacacg

SEQ ID NO: 486784 - DNA, 25 bp, Rattus norvegicus
ctaaaggttcctggtccgccgacat

SEQ ID NO: 486785 - DNA, 25 bp, Rattus norvegicus
tcttggcaaggaactctaaaggttc

SEQ ID NO: 486786 - DNA, 25 bp, Rattus norvegicus
cacctctttgggacgccagggattc

SEQ ID NO: 486787 - DNA, 25 bp, Rattus norvegicus
gtctggatcttctgtcacctctttg

SEQ ID NO: 486788 - DNA, 25 bp, Rattus norvegicus
ctcctccagagagaagccattcttg

SEQ ID NO: 486789 - DNA, 25 bp, Rattus norvegicus
aggcgtaacacctcctccagagaga

SEQ ID NO: 486790 - DNA, 25 bp, Rattus norvegicus
atgaatgctttggtgagacgctgtg

SEQ ID NO: 486791 - DNA, 25 bp, Rattus norvegicus
ctgaggggcatcatcagagagagcc

SEQ ID NO: 486792 - DNA, 25 bp, Rattus norvegicus
cccggtaacctgagagacggtgaca

SEQ ID NO: 486793 - DNA, 25 bp, Rattus norvegicus
cgtgcccaaacgcaaaggccggttg

SEQ ID NO: 486794 - DNA, 25 bp, Rattus norvegicus
aggccggttgaatggagcccttcct

SEQ ID NO: 486795 - DNA, 25 bp, Rattus norvegicus
gggcgagtttccctagcacgccaca

SEQ ID NO: 486796 - DNA, 25 bp, Rattus norvegicus
agtcgcgatcccacgagagcccggt

SEQ ID NO: 486797 - DNA, 25 bp, Rattus norvegicus
gaagccgcccttcggagtcgcgatc

SEQ ID NO: 486798 - DNA, 25 bp, Rattus norvegicus
gcagcagtccgcagagcgacctgca

SEQ ID NO: 486799 - DNA, 25 bp, Rattus norvegicus
ctgagtacggaagcgaactgacgta

SEQ ID NO: 486800 - DNA, 25 bp, Rattus norvegicus
acttaggaagcatccctcccgctta

SEQ ID NO: 486801 - DNA, 25 bp, Rattus norvegicus
accctcaggtgcgacaggctgccat

SEQ ID NO: 486802 - DNA, 25 bp, Rattus norvegicus
ctcacaagcggatagccaatcgttg

SEQ ID NO: 486803 - DNA, 25 bp, Rattus norvegicus
ttctccatcctggataggccggagc

SEQ ID NO: 486804 - DNA, 25 bp, Rattus norvegicus
acagacgccgggatctcagagggtc

SEQ ID NO: 486805 - DNA, 25 bp, Rattus norvegicus
ttatggcccaaggaaaccgccgctc

SEQ ID NO: 486806 - DNA, 25 bp, Rattus norvegicus
gctcagcggccgtgactttatcacc

SEQ ID NO: 486807 - DNA, 25 bp, Rattus norvegicus
tgcatttccgctcctcactgtcgtg

SEQ ID NO: 486808 - DNA, 25 bp, Rattus norvegicus
ggacggctgcagaatagttgccata

SEQ ID NO: 486809 - DNA, 25 bp, Rattus norvegicus
gacagagcttttcgtgcctggacgg

SEQ ID NO: 486810 - DNA, 25 bp, Rattus norvegicus
agcgtcgtcgcgaccaggcttacag

SEQ ID NO: 486811 - DNA, 25 bp, Rattus norvegicus
ggagccagcagcattgccttcgtgg

SEQ ID NO: 486812 - DNA, 25 bp, Rattus norvegicus
aggggcttaagtgagtcccgcctca

SEQ ID NO: 486813 - DNA, 25 bp, Rattus norvegicus
aagagttcctttgctcgcgtgggcg

SEQ ID NO: 486814 - DNA, 25 bp, Rattus norvegicus
ctacacttagacagcggtgggtgga

SEQ ID NO: 486815 - DNA, 25 bp, Rattus norvegicus
gggaactgtgcggagtctacactta

SEQ ID NO: 486816 - DNA, 25 bp, Rattus norvegicus
caagacgtaagatgggcgttgccta

SEQ ID NO: 486817 - DNA, 25 bp, Rattus norvegicus
gtagagtctcccagggtgcagctga

SEQ ID NO: 486818 - DNA, 25 bp, Rattus norvegicus
ccaggcttacaggacagagcttttc

SEQ ID NO: 486819 - DNA, 25 bp, Rattus norvegicus
actgggtttatcagtccctacctgg

SEQ ID NO: 486820 - DNA, 25 bp, Rattus norvegicus
cacagacatgaagagaaacggaatt

SEQ ID NO: 486821 - DNA, 25 bp, Rattus norvegicus
cagacatgaagagaaacggaatttg

SEQ ID NO: 486822 - DNA, 25 bp, Rattus norvegicus
agaaacggaatttgaaggctcctgg

SEQ ID NO: 486823 - DNA, 25 bp, Rattus norvegicus
tccctacctggagttttcacctcgc

SEQ ID NO: 486824 - DNA, 25 bp, Rattus norvegicus
tcagtccctacctggagttttcacc

SEQ ID NO: 486825 - DNA, 25 bp, Rattus norvegicus
ttatcagtccctacctggagttttc

SEQ ID NO: 486826 - DNA, 25 bp, Rattus norvegicus
tgggtttatcagtccctacctggag

SEQ ID NO: 486827 - DNA, 25 bp, Rattus norvegicus
agagcactgggtttatcagtcccta

SEQ ID NO: 486828 - DNA, 25 bp, Rattus norvegicus
gcggagagcactgggtttatcagtc

SEQ ID NO: 486829 - DNA, 25 bp, Rattus norvegicus
cggatgctccggcagtgctctgcgt

SEQ ID NO: 486830 - DNA, 25 bp, Rattus norvegicus
cccaacacagacatgaagagaaacg

SEQ ID NO: 486831 - DNA, 25 bp, Rattus norvegicus
gtgctggagcgttcaggactcgccc

SEQ ID NO: 486832 - DNA, 25 bp, Rattus norvegicus
agcactgggtttatcagtccctacc

SEQ ID NO: 486833 - DNA, 25 bp, Rattus norvegicus
tggacggaggactcacatgatacta

SEQ ID NO: 486834 - DNA, 25 bp, Rattus norvegicus
cctctacgacgcacgtgactggatg

SEQ ID NO: 486835 - DNA, 25 bp, Rattus norvegicus
ctcgcgagattcacgggaggagact

SEQ ID NO: 486836 - DNA, 25 bp, Rattus norvegicus
ggaggagactgagccaatcgcaata

SEQ ID NO: 486837 - DNA, 25 bp, Rattus norvegicus
caatagctcttcttccaggccgcgg

SEQ ID NO: 486838 - DNA, 25 bp, Rattus norvegicus
tgatactacgatgcccacgtgaccg

SEQ ID NO: 486839 - DNA, 25 bp, Rattus norvegicus
cgggaactgactgattctgaatctc

SEQ ID NO: 486840 - DNA, 25 bp, Rattus norvegicus
cgcagggaaatgacgtagcgcatca

SEQ ID NO: 486841 - DNA, 25 bp, Rattus norvegicus
gcctgggcccacgttcagaaatttg

SEQ ID NO: 486842 - DNA, 25 bp, Rattus norvegicus
gcgacatatagaggaaacgggcaca

SEQ ID NO: 486843 - DNA, 25 bp, Rattus norvegicus
tgacttaggacaaggcagcgacata

SEQ ID NO: 486844 - DNA, 25 bp, Rattus norvegicus
gcatctcgaacgcagtctgacttag

SEQ ID NO: 486845 - DNA, 25 bp, Rattus norvegicus
ggatgagtcacagcgccaggaaacc

SEQ ID NO: 486846 - DNA, 25 bp, Rattus norvegicus
ggaaacctcggttcagcatctcgaa

SEQ ID NO: 486847 - DNA, 25 bp, Rattus norvegicus
tgggaagaatctgtctagggcagcc

SEQ ID NO: 486848 - DNA, 25 bp, Rattus norvegicus
ttcgattcgtgtccaagcatagctc

SEQ ID NO: 486849 - DNA, 25 bp, Rattus norvegicus
agtcacatgagcttttttggtttcg

SEQ ID NO: 486850 - DNA, 25 bp, Rattus norvegicus
agggccgcatccatgcctccaaagt

SEQ ID NO: 486851 - DNA, 25 bp, Rattus norvegicus
gtctccgcggcttctcaagatggcc

SEQ ID NO: 486852 - DNA, 25 bp, Rattus norvegicus
ctcccaagtcgcgtggagcagctag

SEQ ID NO: 486853 - DNA, 25 bp, Rattus norvegicus
gtggagcgctccaccctcaaaggtg

SEQ ID NO: 486854 - DNA, 25 bp, Rattus norvegicus
agatgcgcaagttcctgtcagaccc

SEQ ID NO: 486855 - DNA, 25 bp, Rattus norvegicus
cgccctggagcagatgcgcaagttc

SEQ ID NO: 486856 - DNA, 25 bp, Rattus norvegicus
gcaccttcgtaagctggttccgctg

SEQ ID NO: 486857 - DNA, 25 bp, Rattus norvegicus
cggaggtagctcttctcggctctct

SEQ ID NO: 486858 - DNA, 25 bp, Rattus norvegicus
tcactgctccctcgttccggaggta

SEQ ID NO: 486859 - DNA, 25 bp, Rattus norvegicus
tcgccggtttctttcgctcactgct

SEQ ID NO: 486860 - DNA, 25 bp, Rattus norvegicus
gcctccagtcgcatgcgtaacgtcg

SEQ ID NO: 486861 - DNA, 25 bp, Rattus norvegicus
gacaaggtgaccagcgcatgcgcta

SEQ ID NO: 486862 - DNA, 25 bp, Rattus norvegicus
tgactcctggcttccacctgatggg

SEQ ID NO: 486863 - DNA, 25 bp, Rattus norvegicus
gctcccattggggacgtagactccc

SEQ ID NO: 486864 - DNA, 25 bp, Rattus norvegicus
ttaggtgtctgaggcgagaagatcc

SEQ ID NO: 486865 - DNA, 25 bp, Rattus norvegicus
ctgcgttgctgtgtgaacctcagtg

SEQ ID NO: 486866 - DNA, 25 bp, Rattus norvegicus
ctagaggccgccatgtgagcactct

SEQ ID NO: 486867 - DNA, 25 bp, Rattus norvegicus
gcgcggcgctttttccagaagcctc

SEQ ID NO: 486868 - DNA, 25 bp, Rattus norvegicus
tgccttatatagaggcgggcccgcc

SEQ ID NO: 486869 - DNA, 25 bp, Rattus norvegicus
gggacactgaagcaactggcgcgcc

SEQ ID NO: 486870 - DNA, 25 bp, Rattus norvegicus
gtgactaaccgcaccgggacactga

SEQ ID NO: 486871 - DNA, 25 bp, Rattus norvegicus
caccttggcagaatgagcacgcacg

SEQ ID NO: 486872 - DNA, 25 bp, Rattus norvegicus
ctctgcgaggacactcaccttggca

SEQ ID NO: 486873 - DNA, 25 bp, Rattus norvegicus
aggcaaaggccagagccgaacgttc

SEQ ID NO: 486874 - DNA, 25 bp, Rattus norvegicus
aagggatgttcccatgtgaggctgc

SEQ ID NO: 486875 - DNA, 25 bp, Rattus norvegicus
cgcgtgcgcacttagactgtaaact

SEQ ID NO: 486876 - DNA, 25 bp, Rattus norvegicus
gcgaccgcctctgcttcaatgtggg

SEQ ID NO: 486877 - DNA, 25 bp, Rattus norvegicus
gaaagggtctctcagcgaagctgca

SEQ ID NO: 486878 - DNA, 25 bp, Rattus norvegicus
agaccggttcctgcaccaatgctcg

SEQ ID NO: 486879 - DNA, 25 bp, Rattus norvegicus
cggtaactccgttgaggtactctga

SEQ ID NO: 486880 - DNA, 25 bp, Rattus norvegicus
gcggccggcacttgtacttttgagt

SEQ ID NO: 486881 - DNA, 25 bp, Rattus norvegicus
tccgggcacttagggcaggatgaac

SEQ ID NO: 486882 - DNA, 25 bp, Rattus norvegicus
ccacccgggaaggtctgtacaagct

SEQ ID NO: 486883 - DNA, 25 bp, Rattus norvegicus
tgtacaagctgctgccgcactcgga

SEQ ID NO: 486884 - DNA, 25 bp, Rattus norvegicus
gggtgcccttcaactcgcagggatc

SEQ ID NO: 486885 - DNA, 25 bp, Rattus norvegicus
gcgtctccttcgtaaacctcaacga

SEQ ID NO: 486886 - DNA, 25 bp, Rattus norvegicus
tcaggttccgataccgacagggagc

SEQ ID NO: 486887 - DNA, 25 bp, Rattus norvegicus
gcttccaccagcactcagagggcgg

SEQ ID NO: 486888 - DNA, 25 bp, Rattus norvegicus
gccgggagctctacttctatatcta

SEQ ID NO: 486889 - DNA, 25 bp, Rattus norvegicus
ctcgatcctccacagcgggaggctg

SEQ ID NO: 486890 - DNA, 25 bp, Rattus norvegicus
caccgctgccgggtgaccaggttga

SEQ ID NO: 486891 - DNA, 25 bp, Rattus norvegicus
cgcagggaagcatagtagcggctca

SEQ ID NO: 486892 - DNA, 25 bp, Rattus norvegicus
gcatagtagcggctcagctcctccg

SEQ ID NO: 486893 - DNA, 25 bp, Rattus norvegicus
agctcctccggggaggcatcttcgc

SEQ ID NO: 486894 - DNA, 25 bp, Rattus norvegicus
gtgggccatcctgagcctcgatcct

SEQ ID NO: 486895 - DNA, 25 bp, Rattus norvegicus
gccaccatctaggaggagagcattg

SEQ ID NO: 486896 - DNA, 25 bp, Rattus norvegicus
tgcgtaccgccaccatctaggagga

SEQ ID NO: 486897 - DNA, 25 bp, Rattus norvegicus
ataacgggccaaggcctgcgtaccg

SEQ ID NO: 486898 - DNA, 25 bp, Rattus norvegicus
ttgcgaccataacgggccaaggcct

SEQ ID NO: 486899 - DNA, 25 bp, Rattus norvegicus
tagcagcattgcgaccataacgggc

SEQ ID NO: 486900 - DNA, 25 bp, Rattus norvegicus
aggcgagcaggactagcagcattgc

SEQ ID NO: 486901 - DNA, 25 bp, Rattus norvegicus
tttagcggggtaggcgtccaccagc

SEQ ID NO: 486902 - DNA, 25 bp, Rattus norvegicus
tgagcctcgatcctccacagcggga

SEQ ID NO: 486903 - DNA, 25 bp, Rattus norvegicus
ctccgctgttcacgcatgcgcagtg

SEQ ID NO: 486904 - DNA, 25 bp, Rattus norvegicus
aggctgaagagaagctccgctgttc

SEQ ID NO: 486905 - DNA, 25 bp, Rattus norvegicus
cgtgtacgcatgctccaagtggggt

SEQ ID NO: 486906 - DNA, 25 bp, Rattus norvegicus
ttttcctgagacaggcgtgtacgca

SEQ ID NO: 486907 - DNA, 25 bp, Rattus norvegicus
tggcaaccgccagacccttaggagg

SEQ ID NO: 486908 - DNA, 25 bp, Rattus norvegicus
ttgtattcctgtcgccctggcaacc

SEQ ID NO: 486909 - DNA, 25 bp, Rattus norvegicus
agccgccatattgtattcctgtcgc

SEQ ID NO: 486910 - DNA, 25 bp, Rattus norvegicus
ggagcgttaggatccagccgccata

SEQ ID NO: 486911 - DNA, 25 bp, Rattus norvegicus
tcctttccagaggtggcttccggct

SEQ ID NO: 486912 - DNA, 25 bp, Rattus norvegicus
tgaacgcggatgacgccgtcagccc

SEQ ID NO: 486913 - DNA, 25 bp, Rattus norvegicus
aaggccttctcctttccagaggtgg

SEQ ID NO: 486914 - DNA, 25 bp, Rattus norvegicus
tctgccgcctcggtttggtcgctaa

SEQ ID NO: 486915 - DNA, 25 bp, Rattus norvegicus
actcactcttcatcctgaacgcgga

SEQ ID NO: 486916 - DNA, 25 bp, Rattus norvegicus
gctcgaggaccttcgcagtggtccc

SEQ ID NO: 486917 - DNA, 25 bp, Rattus norvegicus
tcggggacatcctcctttctctgcg

SEQ ID NO: 486918 - DNA, 25 bp, Rattus norvegicus
acgtttttgcctgccgggcactcgt

SEQ ID NO: 486919 - DNA, 25 bp, Rattus norvegicus
gcactcgtaggttccgccctttaca

SEQ ID NO: 486920 - DNA, 25 bp, Rattus norvegicus
gccgcttcaagcgacgcgggttcga

SEQ ID NO: 486921 - DNA, 25 bp, Rattus norvegicus
agtggctcgactcttccgggccgga

SEQ ID NO: 486922 - DNA, 25 bp, Rattus norvegicus
gccggagccacggtaccgtgcgctt

SEQ ID NO: 486923 - DNA, 25 bp, Rattus norvegicus
cagcgggttctgaagcaggtgactc

SEQ ID NO: 486924 - DNA, 25 bp, Rattus norvegicus
aagcaggtgactcgggcacagccac

SEQ ID NO: 486925 - DNA, 25 bp, Rattus norvegicus
cgttcggagccttggtcgtctacgc

SEQ ID NO: 486926 - DNA, 25 bp, Rattus norvegicus
tcgtctacgcccagctccgtgggaa

SEQ ID NO: 486927 - DNA, 25 bp, Rattus norvegicus
aacggcgcagtgacgtactccgagc

SEQ ID NO: 486928 - DNA, 25 bp, Rattus norvegicus
cgaggtggcgacaattaagtatacc

SEQ ID NO: 486929 - DNA, 25 bp, Rattus norvegicus
tctcagcgacgtttttgcctgccgg

SEQ ID NO: 486930 - DNA, 25 bp, Rattus norvegicus
aagtataccgcttcggagtctcagc

SEQ ID NO: 486931 - DNA, 25 bp, Rattus norvegicus
cacacgacacgacacgggctcgtta

SEQ ID NO: 486932 - DNA, 25 bp, Rattus norvegicus
tagataccgagatgaccagaagccc

SEQ ID NO: 486933 - DNA, 25 bp, Rattus norvegicus
ccgcccacggactaaggaagtgatg

SEQ ID NO: 486934 - DNA, 25 bp, Rattus norvegicus
gggcccgccgacacttgtagctctg

SEQ ID NO: 486935 - DNA, 25 bp, Rattus norvegicus
cgacacttgtagctctgccgctcta

SEQ ID NO: 486936 - DNA, 25 bp, Rattus norvegicus
tgccgctctagctctccggcggagt

SEQ ID NO: 486937 - DNA, 25 bp, Rattus norvegicus
agtcacggctcgtctctgaggccta

SEQ ID NO: 486938 - DNA, 25 bp, Rattus norvegicus
gctcgtctctgaggcctaacccgtt

SEQ ID NO: 486939 - DNA, 25 bp, Rattus norvegicus
ggcctaacccgttgcctaggcaaca

SEQ ID NO: 486940 - DNA, 25 bp, Rattus norvegicus
agggccgcctttccttgtctcagcc

SEQ ID NO: 486941 - DNA, 25 bp, Rattus norvegicus
cctcagagtctccacagccgtgttg

SEQ ID NO: 486942 - DNA, 25 bp, Rattus norvegicus
ggcgcgtctgtcagcccgcgtctgt

SEQ ID NO: 486943 - DNA, 25 bp, Rattus norvegicus
agcccgcgtctgtgcagagcaccgg

SEQ ID NO: 486944 - DNA, 25 bp, Rattus norvegicus
ccatgcggtccacaggtagataccg

SEQ ID NO: 486945 - DNA, 25 bp, Rattus norvegicus
cgctcttcgactgggaagtcctgca

SEQ ID NO: 486946 - DNA, 25 bp, Rattus norvegicus
tccaggaggcgcacgcgctcttcga

SEQ ID NO: 486947 - DNA, 25 bp, Rattus norvegicus
tcctgcacggttcgcaggatgcggc

SEQ ID NO: 486948 - DNA, 25 bp, Rattus norvegicus
atctcgcactgccaggtagaaagcg

SEQ ID NO: 486949 - DNA, 25 bp, Rattus norvegicus
atgcccacgcggttgtagcgcaccg

SEQ ID NO: 486950 - DNA, 25 bp, Rattus norvegicus
aggtagccagcaggtagtgagcata

SEQ ID NO: 486951 - DNA, 25 bp, Rattus norvegicus
cctccgatggcgaatatgcggcagc

SEQ ID NO: 486952 - DNA, 25 bp, Rattus norvegicus
cacgctcgtcccagtggaaggcttc

SEQ ID NO: 486953 - DNA, 25 bp, Rattus norvegicus
gaaggcttcgctggcacgcatgtcc

SEQ ID NO: 486954 - DNA, 25 bp, Rattus norvegicus
cgcatgtcctcgagtagccacactg

SEQ ID NO: 486955 - DNA, 25 bp, Rattus norvegicus
agccacactggcagcagatctcgca

SEQ ID NO: 486956 - DNA, 25 bp, Rattus norvegicus
cctggtgtcccacggcatgctggac

SEQ ID NO: 486957 - DNA, 25 bp, Rattus norvegicus
agcgaaggatgacttccggcactgc

SEQ ID NO: 486958 - DNA, 25 bp, Rattus norvegicus
ctcacaggccacgtgcagcgacgta

SEQ ID NO: 486959 - DNA, 25 bp, Rattus norvegicus
agcttacgcgcagtaggctctcggt

SEQ ID NO: 486960 - DNA, 25 bp, Rattus norvegicus
tacgtctcggaggaattgcttttcg

SEQ ID NO: 486961 - DNA, 25 bp, Rattus norvegicus
ctgcctggccgcaggtgccctggat

SEQ ID NO: 486962 - DNA, 25 bp, Rattus norvegicus
attgcttttcggttggagtcagggc

SEQ ID NO: 486963 - DNA, 25 bp, Rattus norvegicus
agcgcggctggacctccttaactcg

SEQ ID NO: 486964 - DNA, 25 bp, Rattus norvegicus
gctctcggtacgtctcggaggaatt

SEQ ID NO: 486965 - DNA, 25 bp, Rattus norvegicus
tgtgcccggcgcagtcttcctcggg

SEQ ID NO: 486966 - DNA, 25 bp, Rattus norvegicus
gctgcccttcagagaggtgtggccc

SEQ ID NO: 486967 - DNA, 25 bp, Rattus norvegicus
gtcacggtaggctgcccttcagaga

SEQ ID NO: 486968 - DNA, 25 bp, Rattus norvegicus
cccgcctgccattggtcacggtagg

SEQ ID NO: 486969 - DNA, 25 bp, Rattus norvegicus
cgcctctggattggcctccgggagt

SEQ ID NO: 486970 - DNA, 25 bp, Rattus norvegicus
cggccttcacctacccgcctctgga

SEQ ID NO: 486971 - DNA, 25 bp, Rattus norvegicus
ctccgtccagaggaagcgaggctgc

SEQ ID NO: 486972 - DNA, 25 bp, Rattus norvegicus
ctgataggagggcattcgtcatcgg

SEQ ID NO: 486973 - DNA, 25 bp, Rattus norvegicus
ttgtttttgtgcgtgttggccttcg

SEQ ID NO: 486974 - DNA, 25 bp, Rattus norvegicus
ctgcagatccaggtgcggggaggcc

SEQ ID NO: 486975 - DNA, 25 bp, Rattus norvegicus
cgctcgcacacgagcgagctgcaga

SEQ ID NO: 486976 - DNA, 25 bp, Rattus norvegicus
ttttgtgcgtgttggccttcggttc

SEQ ID NO: 486977 - DNA, 25 bp, Rattus norvegicus
caactttgtttttgtgcgtgttggc

SEQ ID NO: 486978 - DNA, 25 bp, Rattus norvegicus
gtgagtagcgagagacgggagcccg

SEQ ID NO: 486979 - DNA, 25 bp, Rattus norvegicus
tcgaccctggtgagtagcgagagac

SEQ ID NO: 486980 - DNA, 25 bp, Rattus norvegicus
acttcgaccctggtgagtagcgaga

SEQ ID NO: 486981 - DNA, 25 bp, Rattus norvegicus
cgacttcgaccctggtgagtagcga

SEQ ID NO: 486982 - DNA, 25 bp, Rattus norvegicus
gcccgacttcgaccctggtgagtag

SEQ ID NO: 486983 - DNA, 25 bp, Rattus norvegicus
cggtgcccgacttcgaccctggtga

SEQ ID NO: 486984 - DNA, 25 bp, Rattus norvegicus
acgaggagcacggtaggtggcagcc

SEQ ID NO: 486985 - DNA, 25 bp, Rattus norvegicus
catgcgggtgggaccccagtaccaa

SEQ ID NO: 486986 - DNA, 25 bp, Rattus norvegicus
ggcacgctcgcacacgagcgagctg

SEQ ID NO: 486987 - DNA, 25 bp, Rattus norvegicus
ggttcacacctagacagcggcgagt

SEQ ID NO: 486988 - DNA, 25 bp, Rattus norvegicus
ttcacacctagacagcggcgagtgc

SEQ ID NO: 486989 - DNA, 25 bp, Rattus norvegicus
gagtgcggctctcttccaggttaca

SEQ ID NO: 486990 - DNA, 25 bp, Rattus norvegicus
gttcacacctagacagcggcgagtg

SEQ ID NO: 486991 - DNA, 25 bp, Rattus norvegicus
agtgcggctctcttccaggttacag

SEQ ID NO: 486992 - DNA, 25 bp, Rattus norvegicus
caggttcacacctagacagcggcga

SEQ ID NO: 486993 - DNA, 25 bp, Rattus norvegicus
ggccctcctccaggttacaggttca

SEQ ID NO: 486994 - DNA, 25 bp, Rattus norvegicus
ttcacacctagacagcggcagtgcg

SEQ ID NO: 486995 - DNA, 25 bp, Rattus norvegicus
ctcttccaggttacaggttcacacc

SEQ ID NO: 486996 - DNA, 25 bp, Rattus norvegicus
gttcacacctagacagcggcagtgc

SEQ ID NO: 486997 - DNA, 25 bp, Rattus norvegicus
tcacacctagacagcggcgagtgcg

SEQ ID NO: 486998 - DNA, 25 bp, Rattus norvegicus
tgcggctctcttccaggttacaggt

SEQ ID NO: 486999 - DNA, 25 bp, Rattus norvegicus
ggttcacacctagacagcggcagtg

SEQ ID NO: 487000 - DNA, 25 bp, Rattus norvegicus
ggctctcttccaggttacaggttca

SEQ ID NO: 487001 - DNA, 25 bp, Rattus norvegicus
gaggaaccttgctcgcctcactctg

SEQ ID NO: 487002 - DNA, 25 bp, Rattus norvegicus
cgccgttgctaaggccggcggcgag

SEQ ID NO: 487003 - DNA, 25 bp, Rattus norvegicus
gctcgactggctttttgacccggaa

SEQ ID NO: 487004 - DNA, 25 bp, Rattus norvegicus
ctcactctgctcgactggctttttg

SEQ ID NO: 487005 - DNA, 25 bp, Rattus norvegicus
caaggacgtgagtgtccaagtaggc

SEQ ID NO: 487006 - DNA, 25 bp, Rattus norvegicus
ggccaggcgaggaaccttgctcgcc

SEQ ID NO: 487007 - DNA, 25 bp, Rattus norvegicus
tccaagtaggcgagactgttgggcc

SEQ ID NO: 487008 - DNA, 25 bp, Rattus norvegicus
cgtgagtgtccaagtaggcgagact

SEQ ID NO: 487009 - DNA, 25 bp, Rattus norvegicus
ctacaggtgcaaggacgtgagtgtc

SEQ ID NO: 487010 - DNA, 25 bp, Rattus norvegicus
gcccgcgagtgagcgtcttctacag

SEQ ID NO: 487011 - DNA, 25 bp, Rattus norvegicus
aactcttcacgcgtgcccatgggtg

SEQ ID NO: 487012 - DNA, 25 bp, Rattus norvegicus
actctgctcgactggctttttgacc

SEQ ID NO: 487013 - DNA, 25 bp, Rattus norvegicus
gccgagggtccctagcaacgggcgc

SEQ ID NO: 487014 - DNA, 25 bp, Rattus norvegicus
cgagtgagcgtcttctacaggtgca

SEQ ID NO: 487015 - DNA, 25 bp, Rattus norvegicus
ggcagccaggccttgagccctaggt

SEQ ID NO: 487016 - DNA, 25 bp, Rattus norvegicus
gtgcccgcatagatgagcgtgctcg

SEQ ID NO: 487017 - DNA, 25 bp, Rattus norvegicus
aacgacggagtcagggtgcccgcat

SEQ ID NO: 487018 - DNA, 25 bp, Rattus norvegicus
ccgtcagcatctccgaggcctgggg

SEQ ID NO: 487019 - DNA, 25 bp, Rattus norvegicus
gagccgtcagcatctccgaggcctg

SEQ ID NO: 487020 - DNA, 25 bp, Rattus norvegicus
gctgagccgtcagcatctccgaggc

SEQ ID NO: 487021 - DNA, 25 bp, Rattus norvegicus
ggtgctgagccgtcagcatctccga

SEQ ID NO: 487022 - DNA, 25 bp, Rattus norvegicus
cagccaggccttgagccctaggtgc

SEQ ID NO: 487023 - DNA, 25 bp, Rattus norvegicus
cgcttcaggcagacggggcagccag

SEQ ID NO: 487024 - DNA, 25 bp, Rattus norvegicus
aactttgtgtatgcggccggctccg

SEQ ID NO: 487025 - DNA, 25 bp, Rattus norvegicus
gaaactttgtgtatgcggccggctc

SEQ ID NO: 487026 - DNA, 25 bp, Rattus norvegicus
ctttggaaactttgtgtatgcggcc

SEQ ID NO: 487027 - DNA, 25 bp, Rattus norvegicus
cccaactttggaaactttgtgtatg

SEQ ID NO: 487028 - DNA, 25 bp, Rattus norvegicus
ggccttgagccctaggtgcccgccc

SEQ ID NO: 487029 - DNA, 25 bp, Rattus norvegicus
gctggcctagctggccagtgagctc

SEQ ID NO: 487030 - DNA, 25 bp, Rattus norvegicus
gggattaaaagccaccgtgccagct

SEQ ID NO: 487031 - DNA, 25 bp, Rattus norvegicus
agtgagctccagagcctctctctgc

SEQ ID NO: 487032 - DNA, 25 bp, Rattus norvegicus
accctggagtttgctgattggctgg

SEQ ID NO: 487033 - DNA, 25 bp, Rattus norvegicus
cgctgaccctggagtttgctgattg

SEQ ID NO: 487034 - DNA, 25 bp, Rattus norvegicus
ttttgaaacaggatcgctgaccctg

SEQ ID NO: 487035 - DNA, 25 bp, Rattus norvegicus
gtgccagcttccatcttaatttttg

SEQ ID NO: 487036 - DNA, 25 bp, Rattus norvegicus
attcgttctgcccttgctttccgcg

SEQ ID NO: 487037 - DNA, 25 bp, Rattus norvegicus
agagattcgttctgcccttgctttc

SEQ ID NO: 487038 - DNA, 25 bp, Rattus norvegicus
ccggctgtcctcaaatcagagattc

SEQ ID NO: 487039 - DNA, 25 bp, Rattus norvegicus
cacactgtgtagaccggctgtcctc

SEQ ID NO: 487040 - DNA, 25 bp, Rattus norvegicus
tttaacttaagacaggttctctgtg

SEQ ID NO: 487041 - DNA, 25 bp, Rattus norvegicus
ccagcacttggatttcaggtgcaca

SEQ ID NO: 487042 - DNA, 25 bp, Rattus norvegicus
cgcgccgggattaaaagccaccgtg

SEQ ID NO: 487043 - DNA, 25 bp, Rattus norvegicus
gctcagcactgccagggctcacgta

SEQ ID NO: 487044 - DNA, 25 bp, Rattus norvegicus
ctatcattcggtggacaagcccttc

SEQ ID NO: 487045 - DNA, 25 bp, Rattus norvegicus
cgtcgtaggtctctgcacgttcgta

SEQ ID NO: 487046 - DNA, 25 bp, Rattus norvegicus
ggtagctgctcaataacacgtcgta

SEQ ID NO: 487047 - DNA, 25 bp, Rattus norvegicus
ttcgccgtcgtggaggtaagtctat

SEQ ID NO: 487048 - DNA, 25 bp, Rattus norvegicus
aggcacggcactggctcacacaatt

SEQ ID NO: 487049 - DNA, 25 bp, Rattus norvegicus
ttcctgaatcagtgtggtgccagcc

SEQ ID NO: 487050 - DNA, 25 bp, Rattus norvegicus
aatcactggtgcagcgggacatcca

SEQ ID NO: 487051 - DNA, 25 bp, Rattus norvegicus
gcctcctgccggcaaatcactggtg

SEQ ID NO: 487052 - DNA, 25 bp, Rattus norvegicus
tccagcccagctcaacggcaagtta

SEQ ID NO: 487053 - DNA, 25 bp, Rattus norvegicus
cacgtagaggacaacgagggcacta

SEQ ID NO: 487054 - DNA, 25 bp, Rattus norvegicus
accagtgggtttagttgtcgtcatg

SEQ ID NO: 487055 - DNA, 25 bp, Rattus norvegicus
tccagaccgaccgtcacctgtgggt

SEQ ID NO: 487056 - DNA, 25 bp, Rattus norvegicus
gcactaagggtcgtgtccagtctcc

SEQ ID NO: 487057 - DNA, 25 bp, Rattus norvegicus
gcctccaactggaaccagaaccgga

SEQ ID NO: 487058 - DNA, 25 bp, Rattus norvegicus
ctggtgcgagacagtcacgccatct

SEQ ID NO: 487059 - DNA, 25 bp, Rattus norvegicus
atgcggtccagttcccggcggacaa

SEQ ID NO: 487060 - DNA, 25 bp, Rattus norvegicus
cggcgtggacagtctgcctcaatct

SEQ ID NO: 487061 - DNA, 25 bp, Rattus norvegicus
tttctctagcactgactcgggccgc

SEQ ID NO: 487062 - DNA, 25 bp, Rattus norvegicus
aggggcgacactcagccttcctttc

SEQ ID NO: 487063 - DNA, 25 bp, Rattus norvegicus
agaacgctgcagaggggtctgactc

SEQ ID NO: 487064 - DNA, 25 bp, Rattus norvegicus
gtcctgaatagtggcgatgtcctga

SEQ ID NO: 487065 - DNA, 25 bp, Rattus norvegicus
cgggcagtcgacgtgtcctgaatag

SEQ ID NO: 487066 - DNA, 25 bp, Rattus norvegicus
cgccatctcggatatggtaaggctc

SEQ ID NO: 487067 - DNA, 25 bp, Rattus norvegicus
acagtcgggacagggctgtctgatc

SEQ ID NO: 487068 - DNA, 25 bp, Rattus norvegicus
ccgtgattgaggctgaggtttctct

SEQ ID NO: 487069 - DNA, 25 bp, Rattus norvegicus
tgaggctcccaatgcctaggaagtg

SEQ ID NO: 487070 - DNA, 25 bp, Rattus norvegicus
ttacgccacctcttgctgcagatgg

SEQ ID NO: 487071 - DNA, 25 bp, Rattus norvegicus
caggagctatcgtgtcgttgaccca

SEQ ID NO: 487072 - DNA, 25 bp, Rattus norvegicus
gctccttcaggacgcggtggcacaa

SEQ ID NO: 487073 - DNA, 25 bp, Rattus norvegicus
tgccggctcctgatagctgagtccc

SEQ ID NO: 487074 - DNA, 25 bp, Rattus norvegicus
ctgaagcaggtaaggaagccacacg

SEQ ID NO: 487075 - DNA, 25 bp, Rattus norvegicus
gctggacctcttcctgaagcaggta

SEQ ID NO: 487076 - DNA, 25 bp, Rattus norvegicus
cacatttgacctggagcggtaccga

SEQ ID NO: 487077 - DNA, 25 bp, Rattus norvegicus
gcggacttccctccactgctggggt

SEQ ID NO: 487078 - DNA, 25 bp, Rattus norvegicus
ctcaaacgcacttcaggcggacttc

SEQ ID NO: 487079 - DNA, 25 bp, Rattus norvegicus
cgtaaggcctcaaggacagtgctgc

SEQ ID NO: 487080 - DNA, 25 bp, Rattus norvegicus
gcgcttttctgcattcacctccgtg

SEQ ID NO: 487081 - DNA, 25 bp, Rattus norvegicus
acctgcagacgttcacgcgcgacga

SEQ ID NO: 487082 - DNA, 25 bp, Rattus norvegicus
cgctggtaatgccaccacctgcaga

SEQ ID NO: 487083 - DNA, 25 bp, Rattus norvegicus
gtggcacaaggtaagcccgcacctt

SEQ ID NO: 487084 - DNA, 25 bp, Rattus norvegicus
attgagctgtcctctcgtcgcagga

SEQ ID NO: 487085 - DNA, 25 bp, Rattus norvegicus
ctgcttcttgctgttgtccgaggta

SEQ ID NO: 487086 - DNA, 25 bp, Rattus norvegicus
tagcggcaatgccacgaccctcaga

SEQ ID NO: 487087 - DNA, 25 bp, Rattus norvegicus
cgctgcgtgtatagcggcaatgcca

SEQ ID NO: 487088 - DNA, 25 bp, Rattus norvegicus
gcagtcactatagccgctgcgtgta

SEQ ID NO: 487089 - DNA, 25 bp, Rattus norvegicus
tatcgggcacattgaggacggtgcc

SEQ ID NO: 487090 - DNA, 25 bp, Rattus norvegicus
cttcttgctgttgtccgaggtatcg

SEQ ID NO: 487091 - DNA, 25 bp, Rattus norvegicus
gcgtccgcagcatctgcttcttgct

SEQ ID NO: 487092 - DNA, 25 bp, Rattus norvegicus
accttgaagacgaagcgccgtttgc

SEQ ID NO: 487093 - DNA, 25 bp, Rattus norvegicus
tcctctggaaccttgaagacgaagc

SEQ ID NO: 487094 - DNA, 25 bp, Rattus norvegicus
ctctcttcctctggaaccttgaaga

SEQ ID NO: 487095 - DNA, 25 bp, Rattus norvegicus
gccacagggaccacactcaccgccg

SEQ ID NO: 487096 - DNA, 25 bp, Rattus norvegicus
aggggcccgagccacagggaccaca

SEQ ID NO: 487097 - DNA, 25 bp, Rattus norvegicus
gacgaagcgccgtttgctccgcgtc

SEQ ID NO: 487098 - DNA, 25 bp, Rattus norvegicus
tgtccgaggtatcgggcacattgag

SEQ ID NO: 487099 - DNA, 25 bp, Rattus norvegicus
tccgagatgtggacggacagtgccc

SEQ ID NO: 487100 - DNA, 25 bp, Rattus norvegicus
gaggaactccgccacatacttgtcg

SEQ ID NO: 487101 - DNA, 25 bp, Rattus norvegicus
tagccgcgcagtccttgtcgtcgca

SEQ ID NO: 487102 - DNA, 25 bp, Rattus norvegicus
ggcctaggccgacatcttgggctcc

SEQ ID NO: 487103 - DNA, 25 bp, Rattus norvegicus
tcgcgattcgccgtaggaacggtgt

SEQ ID NO: 487104 - DNA, 25 bp, Rattus norvegicus
gtgcccagtgcgaaaccgagattgc

SEQ ID NO: 487105 - DNA, 25 bp, Rattus norvegicus
gtgtgccctaggtcccatagttcgg

SEQ ID NO: 487106 - DNA, 25 bp, Rattus norvegicus
ccatagttcggctctgttctcgggc

SEQ ID NO: 487107 - DNA, 25 bp, Rattus norvegicus
ctgggtttcggttgagcttgtccga

SEQ ID NO: 487108 - DNA, 25 bp, Rattus norvegicus
tccacgctcagggagctctcattgc

SEQ ID NO: 487109 - DNA, 25 bp, Rattus norvegicus
gtgtaaaggcacaccagcacgtcca

SEQ ID NO: 487110 - DNA, 25 bp, Rattus norvegicus
ttcttgagccgcaccttggccgaca

SEQ ID NO: 487111 - DNA, 25 bp, Rattus norvegicus
agtggctgcactcggtgtaaaggca

SEQ ID NO: 487112 - DNA, 25 bp, Rattus norvegicus
aggagcagctgctccagcttcttga

SEQ ID NO: 487113 - DNA, 25 bp, Rattus norvegicus
cccgcaagcgccagcggtgagtgtc

SEQ ID NO: 487114 - DNA, 25 bp, Rattus norvegicus
tgccctcaggcttccttctgaggtg

SEQ ID NO: 487115 - DNA, 25 bp, Rattus norvegicus
gagctcccgagccagcgtggagtcc

SEQ ID NO: 487116 - DNA, 25 bp, Rattus norvegicus
tgagtgtgcaggaggcacaacgccc

SEQ ID NO: 487117 - DNA, 25 bp, Rattus norvegicus
ctcaggcttccttctgaggtgtacc

SEQ ID NO: 487118 - DNA, 25 bp, Rattus norvegicus
ctctcgcagcggaggcttcagatac

SEQ ID NO: 487119 - DNA, 25 bp, Rattus norvegicus
ccttctgcaccccagagcggataga

SEQ ID NO: 487120 - DNA, 25 bp, Rattus norvegicus
gcggtccacaacacctggccttctg

SEQ ID NO: 487121 - DNA, 25 bp, Rattus norvegicus
aagcatcgctctactgccggcggtc

SEQ ID NO: 487122 - DNA, 25 bp, Rattus norvegicus
tcgggatcaagcatcgctctactgc

SEQ ID NO: 487123 - DNA, 25 bp, Rattus norvegicus
gggctcgggatcaagcatcgctcta

SEQ ID NO: 487124 - DNA, 25 bp, Rattus norvegicus
gtaaggagttagtgggagcacccca

SEQ ID NO: 487125 - DNA, 25 bp, Rattus norvegicus
tctgaggtgtaccttggcagccatg

SEQ ID NO: 487126 - DNA, 25 bp, Rattus norvegicus
cgcagcggaggcttcagataccggc

SEQ ID NO: 487127 - DNA, 25 bp, Rattus norvegicus
ctggatactgagaaaaagttcggta

SEQ ID NO: 487128 - DNA, 25 bp, Rattus norvegicus
ttcggtagaactcgcagcggccttc

SEQ ID NO: 487129 - DNA, 25 bp, Rattus norvegicus
gtagaactcgcagcggccttcagag

SEQ ID NO: 487130 - DNA, 25 bp, Rattus norvegicus
gagcggcgctatggagtcagctcca

SEQ ID NO: 487131 - DNA, 25 bp, Rattus norvegicus
tggagtcagctccatgcacgacatg

SEQ ID NO: 487132 - DNA, 25 bp, Rattus norvegicus
catgcacgacatggacagtgtatcc

SEQ ID NO: 487133 - DNA, 25 bp, Rattus norvegicus
agacccagagttcactggatactga

SEQ ID NO: 487134 - DNA, 25 bp, Rattus norvegicus
acagtgtatccagccgcgcggtcgg

SEQ ID NO: 487135 - DNA, 25 bp, Rattus norvegicus
ctaccccaggaacgaggcttgcgcg

SEQ ID NO: 487136 - DNA, 25 bp, Rattus norvegicus
catggacagtgtatccagccgcgcg

SEQ ID NO: 487137 - DNA, 25 bp, Rattus norvegicus
tcctgttccacaaagacccagagtt

SEQ ID NO: 487138 - DNA, 25 bp, Rattus norvegicus
gcaagaagaagcattcctgttccac

SEQ ID NO: 487139 - DNA, 25 bp, Rattus norvegicus
gaagagactcctattcccgacacgc

SEQ ID NO: 487140 - DNA, 25 bp, Rattus norvegicus
ggcttgcgcgaagagactcctattc

SEQ ID NO: 487141 - DNA, 25 bp, Rattus norvegicus
tgcgatcagagatgcagcccgctta

SEQ ID NO: 487142 - DNA, 25 bp, Rattus norvegicus
ttcccagtgtgggagacctacttgc

SEQ ID NO: 487143 - DNA, 25 bp, Rattus norvegicus
acgaagccaccgacttcccagtgtg

SEQ ID NO: 487144 - DNA, 25 bp, Rattus norvegicus
ccgcgacctgcagaaggtgcgatca

SEQ ID NO: 487145 - DNA, 25 bp, Rattus norvegicus
ttgcgtgccttccacagcgcagtgg

SEQ ID NO: 487146 - DNA, 25 bp, Rattus norvegicus
gcaggcaggcgccaaagtcatcccg

SEQ ID NO: 487147 - DNA, 25 bp, Rattus norvegicus
ccattgtacgcgaggcgctgaattc

SEQ ID NO: 487148 - DNA, 25 bp, Rattus norvegicus
tggatcgagacgctctggcggaact

SEQ ID NO: 487149 - DNA, 25 bp, Rattus norvegicus
cggaactggcccaagtggtgcactt

SEQ ID NO: 487150 - DNA, 25 bp, Rattus norvegicus
tgcacttggaagaggaggcccatca

SEQ ID NO: 487151 - DNA, 25 bp, Rattus norvegicus
cgcccaagccgagggtgatttcttg

SEQ ID NO: 487152 - DNA, 25 bp, Rattus norvegicus
ggcgcgctatggacctttgtctaca

SEQ ID NO: 487153 - DNA, 25 bp, Rattus norvegicus
gcggacaaaacctcacgcaccttta

SEQ ID NO: 487154 - DNA, 25 bp, Rattus norvegicus
ctgcggagataggagccattgtacg

SEQ ID NO: 487155 - DNA, 25 bp, Rattus norvegicus
ctggcgcaatctccgcggagctaga

SEQ ID NO: 487156 - DNA, 25 bp, Rattus norvegicus
aggtcgccctagctccaggacattg

SEQ ID NO: 487157 - DNA, 25 bp, Rattus norvegicus
ttaacgcctgcgtagagctgaggta

SEQ ID NO: 487158 - DNA, 25 bp, Rattus norvegicus
acctgggtgcttacattaacgcctg

SEQ ID NO: 487159 - DNA, 25 bp, Rattus norvegicus
cgaaggccgtgagcgaatggtacct

SEQ ID NO: 487160 - DNA, 25 bp, Rattus norvegicus
cgaaaaggcttttctggcgtcgaag

SEQ ID NO: 487161 - DNA, 25 bp, Rattus norvegicus
gtgccgacctgaacttagaggaata

SEQ ID NO: 487162 - DNA, 25 bp, Rattus norvegicus
tgacgacctaacgagggtgccgacc

SEQ ID NO: 487163 - DNA, 25 bp, Rattus norvegicus
gtgaggccctcatcactggtgacga

SEQ ID NO: 487164 - DNA, 25 bp, Rattus norvegicus
tagcattctcttcccgggacgggtg

SEQ ID NO: 487165 - DNA, 25 bp, Rattus norvegicus
tgcccaggtgcgagtagcattctct

SEQ ID NO: 487166 - DNA, 25 bp, Rattus norvegicus
gcgctctgcctctttgtgcccaggt

SEQ ID NO: 487167 - DNA, 25 bp, Rattus norvegicus
gagctagaggccaccaccctgcaga

SEQ ID NO: 487168 - DNA, 25 bp, Rattus norvegicus
aggacattgccagccactgccagca

SEQ ID NO: 487169 - DNA, 25 bp, Rattus norvegicus
ctctcgggaagtcctcaaagtcctc

SEQ ID NO: 487170 - DNA, 25 bp, Rattus norvegicus
aactgtggcttagcggggaagcgaa

SEQ ID NO: 487171 - DNA, 25 bp, Rattus norvegicus
tgagtcatcggagcccgtggaaatc

SEQ ID NO: 487172 - DNA, 25 bp, Rattus norvegicus
aacaggctcggatcccgggtcgtgt

SEQ ID NO: 487173 - DNA, 25 bp, Rattus norvegicus
aagcgaaccgcgacggacccgtgtg

SEQ ID NO: 487174 - DNA, 25 bp, Rattus norvegicus
acggacccgtgtgtgcgcatgcccg

SEQ ID NO: 487175 - DNA, 25 bp, Rattus norvegicus
gcatgcccgcgaggaaaggggaccc

SEQ ID NO: 487176 - DNA, 25 bp, Rattus norvegicus
tcaaagtcctcgacagccgcgaaca

SEQ ID NO: 487177 - DNA, 25 bp, Rattus norvegicus
tctctcgtgttctccaccatctgtg

SEQ ID NO: 487178 - DNA, 25 bp, Rattus norvegicus
ggaagtcctcaaagtcctcgacagc

SEQ ID NO: 487179 - DNA, 25 bp, Rattus norvegicus
tccaccatctgtggacaacgtggcc

SEQ ID NO: 487180 - DNA, 25 bp, Rattus norvegicus
ttctcgggctcaaaccctctcggga

SEQ ID NO: 487181 - DNA, 25 bp, Rattus norvegicus
gcattgagtcatcggagcccgtgga

SEQ ID NO: 487182 - DNA, 25 bp, Rattus norvegicus
cgacagccgcgaacaggctcggatc

SEQ ID NO: 487183 - DNA, 25 bp, Rattus norvegicus
ttgggaacagcaaattgactccgcc

SEQ ID NO: 487184 - DNA, 25 bp, Rattus norvegicus
ccctgctaagtagccaatcagagac

SEQ ID NO: 487185 - DNA, 25 bp, Rattus norvegicus
ggcggagcctgcgactattttaggc

SEQ ID NO: 487186 - DNA, 25 bp, Rattus norvegicus
tgcgactattttaggcgggtccctg

SEQ ID NO: 487187 - DNA, 25 bp, Rattus norvegicus
attttccgcggttgcggctgttgga

SEQ ID NO: 487188 - DNA, 25 bp, Rattus norvegicus
ctaggcgtccgccagcggattttcc

SEQ ID NO: 487189 - DNA, 25 bp, Rattus norvegicus
ccagcactggaatcggccgggccta

SEQ ID NO: 487190 - DNA, 25 bp, Rattus norvegicus
ctctttccaggcctttgggaacagc

SEQ ID NO: 487191 - DNA, 25 bp, Rattus norvegicus
ctaagcactgcacccggcccactct

SEQ ID NO: 487192 - DNA, 25 bp, Rattus norvegicus
tctgatgccctttccctaagcactg

SEQ ID NO: 487193 - DNA, 25 bp, Rattus norvegicus
gtggtggaacaacggctcgccgctc

SEQ ID NO: 487194 - DNA, 25 bp, Rattus norvegicus
gctaagtagccaatcagagaccgtg

SEQ ID NO: 487195 - DNA, 25 bp, Rattus norvegicus
caatcagagaccgtggtggaacaac

SEQ ID NO: 487196 - DNA, 25 bp, Rattus norvegicus
ccaggcctttgggaacagcaaattg

SEQ ID NO: 487197 - DNA, 25 bp, Rattus norvegicus
ggccaaggagaggttttaatctgcc

SEQ ID NO: 487198 - DNA, 25 bp, Rattus norvegicus
cccagagggtcctgagcggaccgta

SEQ ID NO: 487199 - DNA, 25 bp, Rattus norvegicus
ctatgtctctgaggggtgagcctcc

SEQ ID NO: 487200 - DNA, 25 bp, Rattus norvegicus
ggttacactcgatctatgtctctga

SEQ ID NO: 487201 - DNA, 25 bp, Rattus norvegicus
tgcgcccacggttacactcgatcta

SEQ ID NO: 487202 - DNA, 25 bp, Rattus norvegicus
actatctggagtcactgcgcccacg

SEQ ID NO: 487203 - DNA, 25 bp, Rattus norvegicus
ccgagaagactatctggagtcactg

SEQ ID NO: 487204 - DNA, 25 bp, Rattus norvegicus
tcggcaagaaactccgagaagacta

SEQ ID NO: 487205 - DNA, 25 bp, Rattus norvegicus
caacgctagcttcggcaagaaactc

SEQ ID NO: 487206 - DNA, 25 bp, Rattus norvegicus
gtgaacctagtcaacgctagcttcg

SEQ ID NO: 487207 - DNA, 25 bp, Rattus norvegicus
ggccgcctagtgaacctagtcaacg

SEQ ID NO: 487208 - DNA, 25 bp, Rattus norvegicus
gaccagggccgcctagtgaacctag

SEQ ID NO: 487209 - DNA, 25 bp, Rattus norvegicus
atgctgcgtgtgcgcagcctggaca

SEQ ID NO: 487210 - DNA, 25 bp, Rattus norvegicus
gttttaatctgcctctctcccgctg

SEQ ID NO: 487211 - DNA, 25 bp, Rattus norvegicus
cgctgtatgtactgctgcgcgacca

SEQ ID NO: 487212 - DNA, 25 bp, Rattus norvegicus
gaacacttcgccacccacctgtgca

SEQ ID NO: 487213 - DNA, 25 bp, Rattus norvegicus
acgcagagagctaccacgaacactt

SEQ ID NO: 487214 - DNA, 25 bp, Rattus norvegicus
ttgtgcacacttacgcagagagcta

SEQ ID NO: 487215 - DNA, 25 bp, Rattus norvegicus
tggagcggctgaaaccgctgttccc

SEQ ID NO: 487216 - DNA, 25 bp, Rattus norvegicus
aacaggttcctgcacatgggccgca

SEQ ID NO: 487217 - DNA, 25 bp, Rattus norvegicus
gctccgaggccgagaacaggttcct

SEQ ID NO: 487218 - DNA, 25 bp, Rattus norvegicus
tctggacgcgcagcccgcctttgtg

SEQ ID NO: 487219 - DNA, 25 bp, Rattus norvegicus
tagcagccgagcgtctggacgcgca

SEQ ID NO: 487220 - DNA, 25 bp, Rattus norvegicus
cacctgtgcaccttggcgcagttcg

SEQ ID NO: 487221 - DNA, 25 bp, Rattus norvegicus
gggacctttggcaacggcactagca

SEQ ID NO: 487222 - DNA, 25 bp, Rattus norvegicus
cccgaagagttcaacgttgtgcaca

SEQ ID NO: 487223 - DNA, 25 bp, Rattus norvegicus
ggcaacggcactagcaatcacacgc

SEQ ID NO: 487224 - DNA, 25 bp, Rattus norvegicus
gttcctgcacatgggccgcaccatg

SEQ ID NO: 487225 - DNA, 25 bp, Rattus norvegicus
ggcgctctagccaatgaacctctcg

SEQ ID NO: 487226 - DNA, 25 bp, Rattus norvegicus
tgtctctttgcctcagcctcgcgta

SEQ ID NO: 487227 - DNA, 25 bp, Rattus norvegicus
ttcgatcaccttgctgaacagctcc

SEQ ID NO: 487228 - DNA, 25 bp, Rattus norvegicus
agcccggtttacttcgatcaccttg

SEQ ID NO: 487229 - DNA, 25 bp, Rattus norvegicus
ggtccttgagggtgaccagatgctc

SEQ ID NO: 487230 - DNA, 25 bp, Rattus norvegicus
cgaagccgtcgctgttcctgatgta

SEQ ID NO: 487231 - DNA, 25 bp, Rattus norvegicus
ttgcagacgctgtagagcaccacga

SEQ ID NO: 487232 - DNA, 25 bp, Rattus norvegicus
gcacagcctggaacgaggcctcgtt

SEQ ID NO: 487233 - DNA, 25 bp, Rattus norvegicus
ttggtgcccaccaacaccagcggga

SEQ ID NO: 487234 - DNA, 25 bp, Rattus norvegicus
cctgagccgtcagtacttggcgctc

SEQ ID NO: 487235 - DNA, 25 bp, Rattus norvegicus
tcttggccgtgatctccaggaaagg

SEQ ID NO: 487236 - DNA, 25 bp, Rattus norvegicus
agcagcaccacacggtagtccttgg

SEQ ID NO: 487237 - DNA, 25 bp, Rattus norvegicus
cgtgaacacgcggtccaccatcatt

SEQ ID NO: 487238 - DNA, 25 bp, Rattus norvegicus
accatcattttgctcttggccgtga

SEQ ID NO: 487239 - DNA, 25 bp, Rattus norvegicus
gctcttgactgtcgcgtagccatgg

SEQ ID NO: 487240 - DNA, 25 bp, Rattus norvegicus
gaggccaggcgataggctcttgact

SEQ ID NO: 487241 - DNA, 25 bp, Rattus norvegicus
gagccgcgttgggtttatgtcttta

SEQ ID NO: 487242 - DNA, 25 bp, Rattus norvegicus
agcgagaacattccagaggtgagtc

SEQ ID NO: 487243 - DNA, 25 bp, Rattus norvegicus
cggcgttgttcagtcagagcgagaa

SEQ ID NO: 487244 - DNA, 25 bp, Rattus norvegicus
caataaccagttgcggcccgctgca

SEQ ID NO: 487245 - DNA, 25 bp, Rattus norvegicus
agggtctgtggccaataaccagttg

SEQ ID NO: 487246 - DNA, 25 bp, Rattus norvegicus
gacgtgcctccaatccaataacaag

SEQ ID NO: 487247 - DNA, 25 bp, Rattus norvegicus
gaactgtgagattgacgtgcctcca

SEQ ID NO: 487248 - DNA, 25 bp, Rattus norvegicus
tacctaaacttacagcgagccgggc

SEQ ID NO: 487249 - DNA, 25 bp, Rattus norvegicus
tccagcgtggtcgacaggaacacac

SEQ ID NO: 487250 - DNA, 25 bp, Rattus norvegicus
cactgtggatatgatcggctccgcc

SEQ ID NO: 487251 - DNA, 25 bp, Rattus norvegicus
gagcaagcgccatattgcctgaata

SEQ ID NO: 487252 - DNA, 25 bp, Rattus norvegicus
cgagaccgcaaagacctctgggagg

SEQ ID NO: 487253 - DNA, 25 bp, Rattus norvegicus
tgaaaacgtgagtggactgcgctgc

SEQ ID NO: 487254 - DNA, 25 bp, Rattus norvegicus
aaagcgcaataagatgtccactagg

SEQ ID NO: 487255 - DNA, 25 bp, Rattus norvegicus
gggccaggccggagatctagactcc

SEQ ID NO: 487256 - DNA, 25 bp, Rattus norvegicus
accgcgctgattggcggaactccag

SEQ ID NO: 487257 - DNA, 25 bp, Rattus norvegicus
cgccttggcgttgtgcagaatcaaa

SEQ ID NO: 487258 - DNA, 25 bp, Rattus norvegicus
ttgccaacggtgaatgaacgagaca

SEQ ID NO: 487259 - DNA, 25 bp, Rattus norvegicus
gcgcggccatcttgagtctgtaagg

SEQ ID NO: 487260 - DNA, 25 bp, Rattus norvegicus
gggacccagcccagatgcttcggca

SEQ ID NO: 487261 - DNA, 25 bp, Rattus norvegicus
tgtccttacggtctgctgagcatta

SEQ ID NO: 487262 - DNA, 25 bp, Rattus norvegicus
cagagctgggcggttttgttttcgc

SEQ ID NO: 487263 - DNA, 25 bp, Rattus norvegicus
tctgctgagcattacccgtccgtgc

SEQ ID NO: 487264 - DNA, 25 bp, Rattus norvegicus
agtctgtaaggctcctgaggtgccg

SEQ ID NO: 487265 - DNA, 25 bp, Rattus norvegicus
ggcggcctgtcttgcgcttcatctc

SEQ ID NO: 487266 - DNA, 25 bp, Rattus norvegicus
actccaggcggcagtaacgtcactt

SEQ ID NO: 487267 - DNA, 25 bp, Rattus norvegicus
gcctgacgctacaagggtgtgcata

SEQ ID NO: 487268 - DNA, 25 bp, Rattus norvegicus
ggctgataccggaccctaccttcta

SEQ ID NO: 487269 - DNA, 25 bp, Rattus norvegicus
ggggtcagcaccttggccatatggt

SEQ ID NO: 487270 - DNA, 25 bp, Rattus norvegicus
gtcgtccaacgtaaagccgctcggc

SEQ ID NO: 487271 - DNA, 25 bp, Rattus norvegicus
tacccggattgtctacgccagtctg

SEQ ID NO: 487272 - DNA, 25 bp, Rattus norvegicus
ggctgctcagatcagggaattcatc

SEQ ID NO: 487273 - DNA, 25 bp, Rattus norvegicus
gtcagaggagctttacacaccggtc

SEQ ID NO: 487274 - DNA, 25 bp, Rattus norvegicus
aggcccttatggctaagcgcagaga

SEQ ID NO: 487275 - DNA, 25 bp, Rattus norvegicus
cgacagtgacgtcagcgccaagcta

SEQ ID NO: 487276 - DNA, 25 bp, Rattus norvegicus
ctgcacccactgtcatgatgtacgg

SEQ ID NO: 487277 - DNA, 25 bp, Rattus norvegicus
ccggtcctcgatgatggggtcgaaa

SEQ ID NO: 487278 - DNA, 25 bp, Rattus norvegicus
tcttgtgctcatcactgggctggta

SEQ ID NO: 487279 - DNA, 25 bp, Rattus norvegicus
agctcagcacgtagttggggtccag

SEQ ID NO: 487280 - DNA, 25 bp, Rattus norvegicus
ccgctgtcttagttgggtcttccac

SEQ ID NO: 487281 - DNA, 25 bp, Rattus norvegicus
ccgtgcgctggtttgacgtcatcaa

SEQ ID NO: 487282 - DNA, 25 bp, Rattus norvegicus
cgctccgggcttgctagcaagtcca

SEQ ID NO: 487283 - DNA, 25 bp, Rattus norvegicus
taagtttccgagcttggagcggcgc

SEQ ID NO: 487284 - DNA, 25 bp, Rattus norvegicus
gccggtttatgctgcgtaagtttcc

SEQ ID NO: 487285 - DNA, 25 bp, Rattus norvegicus
acgtcatcaaagagcaccggaagtg

SEQ ID NO: 487286 - DNA, 25 bp, Rattus norvegicus
caagtccagtgttgttcggccggaa

SEQ ID NO: 487287 - DNA, 25 bp, Rattus norvegicus
gaaacgtcctttgggagcgcgcaaa

SEQ ID NO: 487288 - DNA, 25 bp, Rattus norvegicus
gacgccagccaggaaacgtcctttg

SEQ ID NO: 487289 - DNA, 25 bp, Rattus norvegicus
agccctccgtggagactctgggcaa

SEQ ID NO: 487290 - DNA, 25 bp, Rattus norvegicus
cgggcaacgcgcaagtgtgcacaca

SEQ ID NO: 487291 - DNA, 25 bp, Rattus norvegicus
ttttgcacagtgctcgggtttctcg

SEQ ID NO: 487292 - DNA, 25 bp, Rattus norvegicus
gcaaccctaaaaggccgcacgcgga

SEQ ID NO: 487293 - DNA, 25 bp, Rattus norvegicus
aagcttcgtgcactgggcaacccta

SEQ ID NO: 487294 - DNA, 25 bp, Rattus norvegicus
gaacaggggacttttattttgcaca

SEQ ID NO: 487295 - DNA, 25 bp, Rattus norvegicus
gcagaagccctcctagaagggaaac

SEQ ID NO: 487296 - DNA, 25 bp, Rattus norvegicus
cgctacgaagcagaagccctcctag

SEQ ID NO: 487297 - DNA, 25 bp, Rattus norvegicus
gcagtggaaccacaacttcagcttc

SEQ ID NO: 487298 - DNA, 25 bp, Rattus norvegicus
aaccggaaggcacgtttttgctcag

SEQ ID NO: 487299 - DNA, 25 bp, Rattus norvegicus
aaggcacgtttttgctcagggactc

SEQ ID NO: 487300 - DNA, 25 bp, Rattus norvegicus
gactctgcgcaggaggactacctct

SEQ ID NO: 487301 - DNA, 25 bp, Rattus norvegicus
ggaggactacctcttctctgtgagc

SEQ ID NO: 487302 - DNA, 25 bp, Rattus norvegicus
ttctctgtgagcttccgccgctaca

SEQ ID NO: 487303 - DNA, 25 bp, Rattus norvegicus
cacgcccggatcgagcagtggaacc

SEQ ID NO: 487304 - DNA, 25 bp, Rattus norvegicus
gtttcactcctccactgtcacggga

SEQ ID NO: 487305 - DNA, 25 bp, Rattus norvegicus
ttgcgtgtttcactcctccactgtc

SEQ ID NO: 487306 - DNA, 25 bp, Rattus norvegicus
cgatgcccacgacccttgcgtgttt

SEQ ID NO: 487307 - DNA, 25 bp, Rattus norvegicus
acaacttcagcttcgatgcccacga

SEQ ID NO: 487308 - DNA, 25 bp, Rattus norvegicus
tgatggaccgctacgaagcagaagc

SEQ ID NO: 487309 - DNA, 25 bp, Rattus norvegicus
tcgacttcaagtacccgccgcaaaa

SEQ ID NO: 487310 - DNA, 25 bp, Rattus norvegicus
tttgcggcccggaagcaaagctctt

SEQ ID NO: 487311 - DNA, 25 bp, Rattus norvegicus
ccaggctttgcgacgctgccgtaaa

SEQ ID NO: 487312 - DNA, 25 bp, Rattus norvegicus
gagaaaactcgcctcctcgtccgtg

SEQ ID NO: 487313 - DNA, 25 bp, Rattus norvegicus
acctgacctcacaatgggcgcgcgg

SEQ ID NO: 487314 - DNA, 25 bp, Rattus norvegicus
tcgcagcgctttactccgagaggtc

SEQ ID NO: 487315 - DNA, 25 bp, Rattus norvegicus
ccacagaactcagtccctggggagg

SEQ ID NO: 487316 - DNA, 25 bp, Rattus norvegicus
ttctgtcaaacagctcacttctggc

SEQ ID NO: 487317 - DNA, 25 bp, Rattus norvegicus
tttcccacgctctcaggtttctgtc

SEQ ID NO: 487318 - DNA, 25 bp, Rattus norvegicus
cctgacgactgcgattaactcggtc

SEQ ID NO: 487319 - DNA, 25 bp, Rattus norvegicus
aaagccaacctttccactgtcgcga

SEQ ID NO: 487320 - DNA, 25 bp, Rattus norvegicus
ctccggcaggctaatgatccttgta

SEQ ID NO: 487321 - DNA, 25 bp, Rattus norvegicus
cccgtaagtgtgcttagagcatttc

SEQ ID NO: 487322 - DNA, 25 bp, Rattus norvegicus
gcaaccggtcgtccctctcagggaa

SEQ ID NO: 487323 - DNA, 25 bp, Rattus norvegicus
cgttcctccatgctccggtttcttg

SEQ ID NO: 487324 - DNA, 25 bp, Rattus norvegicus
cgcgaccagtaaggcctccgggtct

SEQ ID NO: 487325 - DNA, 25 bp, Rattus norvegicus
gtctgaggggaccacacccggatca

SEQ ID NO: 487326 - DNA, 25 bp, Rattus norvegicus
acccggatcagaggctggtgaagaa

SEQ ID NO: 487327 - DNA, 25 bp, Rattus norvegicus
ctggtgaagaactccggactgcgga

SEQ ID NO: 487328 - DNA, 25 bp, Rattus norvegicus
acgtcacggcgcacagcattgtggg

SEQ ID NO: 487329 - DNA, 25 bp, Rattus norvegicus
acgagcgcggcgcttccgatcggac

SEQ ID NO: 487330 - DNA, 25 bp, Rattus norvegicus
cgcttccgatcggacggtgagtgca

SEQ ID NO: 487331 - DNA, 25 bp, Rattus norvegicus
gcggcttgtgcgcaatgctccagcc

SEQ ID NO: 487332 - DNA, 25 bp, Rattus norvegicus
ccaggctgaggcttctggacctttc

SEQ ID NO: 487333 - DNA, 25 bp, Rattus norvegicus
ggcttctggacctttccgtccatcg

SEQ ID NO: 487334 - DNA, 25 bp, Rattus norvegicus
tgcgatttttgctcctccacccgga

SEQ ID NO: 487335 - DNA, 25 bp, Rattus norvegicus
cggtttcttgtcacctctgcctgcg

SEQ ID NO: 487336 - DNA, 25 bp, Rattus norvegicus
gcacccggtccaggctgcgattttt

SEQ ID NO: 487337 - DNA, 25 bp, Rattus norvegicus
gccaagaagcttgtgcgctcgccca

SEQ ID NO: 487338 - DNA, 25 bp, Rattus norvegicus
gggtccggactctcgattcgatcca

SEQ ID NO: 487339 - DNA, 25 bp, Rattus norvegicus
tcccggatcagcaacgcagcaattc

SEQ ID NO: 487340 - DNA, 25 bp, Rattus norvegicus
tccaatgaaaatccggagtccgagc

SEQ ID NO: 487341 - DNA, 25 bp, Rattus norvegicus
gagcctgctccacccagaagaagcg

SEQ ID NO: 487342 - DNA, 25 bp, Rattus norvegicus
cgtggctgattagttggccaatcca

SEQ ID NO: 487343 - DNA, 25 bp, Rattus norvegicus
tccaaagtcacaatctcccgagagg

SEQ ID NO: 487344 - DNA, 25 bp, Rattus norvegicus
gctcatattccgagctgtggctatg

SEQ ID NO: 487345 - DNA, 25 bp, Rattus norvegicus
gccctttcggcttggaggaaccgca

SEQ ID NO: 487346 - DNA, 25 bp, Rattus norvegicus
tccggacaaggaggtgcgtcctagc

SEQ ID NO: 487347 - DNA, 25 bp, Rattus norvegicus
ggcgttttccattccttggcggtca

SEQ ID NO: 487348 - DNA, 25 bp, Rattus norvegicus
agggtgagcgagtccgccttcacca

SEQ ID NO: 487349 - DNA, 25 bp, Rattus norvegicus
tggggctctcgaaacccacgttgcc

SEQ ID NO: 487350 - DNA, 25 bp, Rattus norvegicus
gcggatactactctccgattggctc

SEQ ID NO: 487351 - DNA, 25 bp, Rattus norvegicus
ccaactactgaatggtcaggtcctc

SEQ ID NO: 487352 - DNA, 25 bp, Rattus norvegicus
ccagattcgtatgcggtcaggtacc

SEQ ID NO: 487353 - DNA, 25 bp, Rattus norvegicus
tggagagaaccaactactgaatggt

SEQ ID NO: 487354 - DNA, 25 bp, Rattus norvegicus
ctgtctagattggagagaaccaact

SEQ ID NO: 487355 - DNA, 25 bp, Rattus norvegicus
gactctgtctagattggagagaacc

SEQ ID NO: 487356 - DNA, 25 bp, Rattus norvegicus
aggcagagactctgtctagattgga

SEQ ID NO: 487357 - DNA, 25 bp, Rattus norvegicus
cgccctcaggcagagactctgtcta

SEQ ID NO: 487358 - DNA, 25 bp, Rattus norvegicus
gtgatgggaacgtcaccggaaagta

SEQ ID NO: 487359 - DNA, 25 bp, Rattus norvegicus
cgtcaccggaaagtagattcttcct

SEQ ID NO: 487360 - DNA, 25 bp, Rattus norvegicus
cggaaagtagattcttcctggcttt

SEQ ID NO: 487361 - DNA, 25 bp, Rattus norvegicus
tagattcttcctggctttttaacgc

SEQ ID NO: 487362 - DNA, 25 bp, Rattus norvegicus
cttcctggctttttaacgcccgatg

SEQ ID NO: 487363 - DNA, 25 bp, Rattus norvegicus
gcggcccagattcgtatgcggtcag

SEQ ID NO: 487364 - DNA, 25 bp, Rattus norvegicus
actactgaatggtcaggtcctcggg

SEQ ID NO: 487365 - DNA, 25 bp, Rattus norvegicus
gcatccagcgtctcgaaccaatctt

SEQ ID NO: 487366 - DNA, 25 bp, Rattus norvegicus
aaagctctcgctctctagttccggg

SEQ ID NO: 487367 - DNA, 25 bp, Rattus norvegicus
tttcgtccggaaacaaagctctcgc

SEQ ID NO: 487368 - DNA, 25 bp, Rattus norvegicus
gatacaggcaacttccggtccctta

SEQ ID NO: 487369 - DNA, 25 bp, Rattus norvegicus
accagcacggaggatgatacaggca

SEQ ID NO: 487370 - DNA, 25 bp, Rattus norvegicus
tcagccgggtctgggagaccagcac

SEQ ID NO: 487371 - DNA, 25 bp, Rattus norvegicus
gaaccaatcttcgaagccatcttgg

SEQ ID NO: 487372 - DNA, 25 bp, Rattus norvegicus
tgcatgattagctgcagcatccagc

SEQ ID NO: 487373 - DNA, 25 bp, Rattus norvegicus
agcacggaacccagctgcatgatta

SEQ ID NO: 487374 - DNA, 25 bp, Rattus norvegicus
cagcgcgtgagcagcacggaaccca

SEQ ID NO: 487375 - DNA, 25 bp, Rattus norvegicus
acaacatgagttggctgaagcagcc

SEQ ID NO: 487376 - DNA, 25 bp, Rattus norvegicus
aagggcagtccggtacggcctcagc

SEQ ID NO: 487377 - DNA, 25 bp, Rattus norvegicus
caccgcattcgacggcttcgtgggc

SEQ ID NO: 487378 - DNA, 25 bp, Rattus norvegicus
ctcggccctttcagcgtacaacatg

SEQ ID NO: 487379 - DNA, 25 bp, Rattus norvegicus
aggccacgggccaaagctatgaggt

SEQ ID NO: 487380 - DNA, 25 bp, Rattus norvegicus
cccagtgcaggggaaacgtgaattc

SEQ ID NO: 487381 - DNA, 25 bp, Rattus norvegicus
ccttaagggcacagggacatcacgc

SEQ ID NO: 487382 - DNA, 25 bp, Rattus norvegicus
tcacgccaggtggagcaaatgtacc

SEQ ID NO: 487383 - DNA, 25 bp, Rattus norvegicus
ggaagcctcgacaaggagactccta

SEQ ID NO: 487384 - DNA, 25 bp, Rattus norvegicus
gatggctctctcaatccacgcacgg

SEQ ID NO: 487385 - DNA, 25 bp, Rattus norvegicus
cgtgaattccgagcgtgcgaacacc

SEQ ID NO: 487386 - DNA, 25 bp, Rattus norvegicus
gggacctccgaacctggagtctatg

SEQ ID NO: 487387 - DNA, 25 bp, Rattus norvegicus
ggctcagagtcacttcggacgaata

SEQ ID NO: 487388 - DNA, 25 bp, Rattus norvegicus
tcgcaatcggaggagactcgaacct

SEQ ID NO: 487389 - DNA, 25 bp, Rattus norvegicus
tggcgagctggctacagaccaactc

SEQ ID NO: 487390 - DNA, 25 bp, Rattus norvegicus
ccgacgtgtctacatcagccgattg

SEQ ID NO: 487391 - DNA, 25 bp, Rattus norvegicus
gacgaacgtcttcctagccaaaagc

SEQ ID NO: 487392 - DNA, 25 bp, Rattus norvegicus
cctctcctgcataccagctaagggg

SEQ ID NO: 487393 - DNA, 25 bp, Rattus norvegicus
ctgcggtccatgaagactagagaca

SEQ ID NO: 487394 - DNA, 25 bp, Rattus norvegicus
gagtcgaacgcaaacccatcgcctg

SEQ ID NO: 487395 - DNA, 25 bp, Rattus norvegicus
gtcgaacgcaaacccatcgcctgtg

SEQ ID NO: 487396 - DNA, 25 bp, Rattus norvegicus
atcgcctgtgtcctcgccattatta

SEQ ID NO: 487397 - DNA, 25 bp, Rattus norvegicus
tgtgtcctcgccattattaatcaga

SEQ ID NO: 487398 - DNA, 25 bp, Rattus norvegicus
cgccattattaatcagactcaaaag

SEQ ID NO: 487399 - DNA, 25 bp, Rattus norvegicus
ggacctgcggtccatgaagactaga

SEQ ID NO: 487400 - DNA, 25 bp, Rattus norvegicus
tccatgaagactagagacacacgcc

SEQ ID NO: 487401 - DNA, 25 bp, Rattus norvegicus
tgaagactagagacacacgccggct

SEQ ID NO: 487402 - DNA, 25 bp, Rattus norvegicus
agactagagacacacgccggctcgc

SEQ ID NO: 487403 - DNA, 25 bp, Rattus norvegicus
cgccggctcgcccaagaagactaga

SEQ ID NO: 487404 - DNA, 25 bp, Rattus norvegicus
tcgcccaagaagactagagccgtgc

SEQ ID NO: 487405 - DNA, 25 bp, Rattus norvegicus
gcccaagaagactagagccgtgcgc

SEQ ID NO: 487406 - DNA, 25 bp, Rattus norvegicus
gtacaagaccctggacctgcggtcc

SEQ ID NO: 487407 - DNA, 25 bp, Rattus norvegicus
ggccacactagattccgcgacagaa

SEQ ID NO: 487408 - DNA, 25 bp, Rattus norvegicus
aaaggtcacagagcacgcaggcgcc

SEQ ID NO: 487409 - DNA, 25 bp, Rattus norvegicus
cagaatgggaaaggtcacagagcac

SEQ ID NO: 487410 - DNA, 25 bp, Rattus norvegicus
ctagacgcccgctgtggggtctttc

SEQ ID NO: 487411 - DNA, 25 bp, Rattus norvegicus
tcagcgggatcaaggccacactaga

SEQ ID NO: 487412 - DNA, 25 bp, Rattus norvegicus
cgctcttacctcagcgggatcaagg

SEQ ID NO: 487413 - DNA, 25 bp, Rattus norvegicus
ttgggaacacacaaaaaagcccaga

SEQ ID NO: 487414 - DNA, 25 bp, Rattus norvegicus
gaaggagcggatacgctagacgccc

SEQ ID NO: 487415 - DNA, 25 bp, Rattus norvegicus
atcgcagagtccctcgcttgcgttc

SEQ ID NO: 487416 - DNA, 25 bp, Rattus norvegicus
acccaaggtcagtgtggatcgcaga

SEQ ID NO: 487417 - DNA, 25 bp, Rattus norvegicus
ccctccttgaagttggcggcgtagg

SEQ ID NO: 487418 - DNA, 25 bp, Rattus norvegicus
ccgtggaccctccttgaagttggcg

SEQ ID NO: 487419 - DNA, 25 bp, Rattus norvegicus
acatcgctgccctctgcgtgagtga

SEQ ID NO: 487420 - DNA, 25 bp, Rattus norvegicus
cttgcgttccgcgacctacttgggc

SEQ ID NO: 487421 - DNA, 25 bp, Rattus norvegicus
tctctttgaagcgagtccgcggtgc

SEQ ID NO: 487422 - DNA, 25 bp, Rattus norvegicus
acactgctgacacgtgcgctggcaa

SEQ ID NO: 487423 - DNA, 25 bp, Rattus norvegicus
tgagacccgtgcgttctcgctgcct

SEQ ID NO: 487424 - DNA, 25 bp, Rattus norvegicus
aggcacccggatcgctgagacccgt

SEQ ID NO: 487425 - DNA, 25 bp, Rattus norvegicus
tgtttaggaccactagacccggcgc

SEQ ID NO: 487426 - DNA, 25 bp, Rattus norvegicus
tcaacagttctgtagcgcaattgtg

SEQ ID NO: 487427 - DNA, 25 bp, Rattus norvegicus
gcgcgcctggtccagtggttcttaa

SEQ ID NO: 487428 - DNA, 25 bp, Rattus norvegicus
gcccaggtctgggaagcagaaactc

SEQ ID NO: 487429 - DNA, 25 bp, Rattus norvegicus
cctttggcgagctttgcaaagccga

SEQ ID NO: 487430 - DNA, 25 bp, Rattus norvegicus
ccctcccacggagttctctttgaag

SEQ ID NO: 487431 - DNA, 25 bp, Rattus norvegicus
agaggcgctagcgtcaccttgcttc

SEQ ID NO: 487432 - DNA, 25 bp, Rattus norvegicus
gcgcggccgtgccacataaaaggcg

SEQ ID NO: 487433 - DNA, 25 bp, Rattus norvegicus
tgcagagcgacgatccgagacgcac

SEQ ID NO: 487434 - DNA, 25 bp, Rattus norvegicus
ccactgaatctttggcaggaacgcg

SEQ ID NO: 487435 - DNA, 25 bp, Rattus norvegicus
ttcagagcccaggacaacgaggatg

SEQ ID NO: 487436 - DNA, 25 bp, Rattus norvegicus
cgcatccgcactcaactaacaggtt

SEQ ID NO: 487437 - DNA, 25 bp, Rattus norvegicus
gcactgccaacttcagagcagcagg

SEQ ID NO: 487438 - DNA, 25 bp, Rattus norvegicus
cgcgtaacttgggtctctgcagcca

SEQ ID NO: 487439 - DNA, 25 bp, Rattus norvegicus
gagagccaacgtatcccttcctgcg

SEQ ID NO: 487440 - DNA, 25 bp, Rattus norvegicus
caacgaggatgctaacggggtgtac

SEQ ID NO: 487441 - DNA, 25 bp, Rattus norvegicus
gcgttgcatccagcgccctaacttt

SEQ ID NO: 487442 - DNA, 25 bp, Rattus norvegicus
taacttttgcgcgagcgtggcttta

SEQ ID NO: 487443 - DNA, 25 bp, Rattus norvegicus
gaagccttgggcttactgtcccatc

SEQ ID NO: 487444 - DNA, 25 bp, Rattus norvegicus
ccgcttgaggtatctccgcgcaaga

SEQ ID NO: 487445 - DNA, 25 bp, Rattus norvegicus
ccgggctcgaccaagacctatgcag

SEQ ID NO: 487446 - DNA, 25 bp, Rattus norvegicus
gccactgccacacgaagctcgtgga

SEQ ID NO: 487447 - DNA, 25 bp, Rattus norvegicus
tcgtggagctcaaacgacaggcgtg

SEQ ID NO: 487448 - DNA, 25 bp, Rattus norvegicus
ctgggccggatcacgtagccactgc

SEQ ID NO: 487449 - DNA, 25 bp, Rattus norvegicus
ggacaatggcaccaccaccacgaag

SEQ ID NO: 487450 - DNA, 25 bp, Rattus norvegicus
aagtcgtggccattctcggacaatg

SEQ ID NO: 487451 - DNA, 25 bp, Rattus norvegicus
ccctgcatcgtcaggttggcactca

SEQ ID NO: 487452 - DNA, 25 bp, Rattus norvegicus
cgtcaggttggcactcagccacata

SEQ ID NO: 487453 - DNA, 25 bp, Rattus norvegicus
ctcagccacataccctcggtaaaga

SEQ ID NO: 487454 - DNA, 25 bp, Rattus norvegicus
cctcggtaaagagtaggcagcgacc

SEQ ID NO: 487455 - DNA, 25 bp, Rattus norvegicus
ccaccaccacgaagctgaacaagaa

SEQ ID NO: 487456 - DNA, 25 bp, Rattus norvegicus
ggccaaaaagtagcagacgcactgc

SEQ ID NO: 487457 - DNA, 25 bp, Rattus norvegicus
cgcactgcgcgaagaggaaattgtt

SEQ ID NO: 487458 - DNA, 25 bp, Rattus norvegicus
attgttgagcgccatggtggtgcca

SEQ ID NO: 487459 - DNA, 25 bp, Rattus norvegicus
gccaccggtcggagatgcgaccact

SEQ ID NO: 487460 - DNA, 25 bp, Rattus norvegicus
gagatgcgaccactccaggagccgg

SEQ ID NO: 487461 - DNA, 25 bp, Rattus norvegicus
cgggtctctcgcgttgcgcgcagac

SEQ ID NO: 487462 - DNA, 25 bp, Rattus norvegicus
agtaggcagcgaccacgaaagtcgt

SEQ ID NO: 487463 - DNA, 25 bp, Rattus norvegicus
cgcgtgtgcaccaaggtggccaaga

SEQ ID NO: 487464 - DNA, 25 bp, Rattus norvegicus
ataaacttcaactggaggtccgcct

SEQ ID NO: 487465 - DNA, 25 bp, Rattus norvegicus
agccacagttgagaaaataaacttc

SEQ ID NO: 487466 - DNA, 25 bp, Rattus norvegicus
cctgaccatgaatcagccacagttg

SEQ ID NO: 487467 - DNA, 25 bp, Rattus norvegicus
ttgcggctaccacatcctgaccatg

SEQ ID NO: 487468 - DNA, 25 bp, Rattus norvegicus
atcgctgctcacagggtgtttgccc

SEQ ID NO: 487469 - DNA, 25 bp, Rattus norvegicus
caagaacctggtcccgcgctcttgt

SEQ ID NO: 487470 - DNA, 25 bp, Rattus norvegicus
gctagcctggaacctggagggaaac

SEQ ID NO: 487471 - DNA, 25 bp, Rattus norvegicus
ccgcggcttcgagctagcctggaac

SEQ ID NO: 487472 - DNA, 25 bp, Rattus norvegicus
cacccggtaagtccgcggcttcgag

SEQ ID NO: 487473 - DNA, 25 bp, Rattus norvegicus
tcggctgtgcccacacccggtaagt

SEQ ID NO: 487474 - DNA, 25 bp, Rattus norvegicus
cggttagaccgtgcggaaagctgcc

SEQ ID NO: 487475 - DNA, 25 bp, Rattus norvegicus
ctcccgggtaggatagcgcgagctt

SEQ ID NO: 487476 - DNA, 25 bp, Rattus norvegicus
ctgacactgagatgctgatcgctgc

SEQ ID NO: 487477 - DNA, 25 bp, Rattus norvegicus
gcggcccgatccattgagtccacgt

SEQ ID NO: 487478 - DNA, 25 bp, Rattus norvegicus
tggcgcgccggatctgcctcctgag

SEQ ID NO: 487479 - DNA, 25 bp, Rattus norvegicus
ggcgacaccctgctgcttagccctg

SEQ ID NO: 487480 - DNA, 25 bp, Rattus norvegicus
tgacgctttttctccgcacgccgga

SEQ ID NO: 487481 - DNA, 25 bp, Rattus norvegicus
tggatgaaccttgccagctgccgtc

SEQ ID NO: 487482 - DNA, 25 bp, Rattus norvegicus
cgcgaagcacttctggatgaacctt

SEQ ID NO: 487483 - DNA, 25 bp, Rattus norvegicus
tccctgacgcagtcgcgaagcactt

SEQ ID NO: 487484 - DNA, 25 bp, Rattus norvegicus
ctgataatccctgacgcagtcgcga

SEQ ID NO: 487485 - DNA, 25 bp, Rattus norvegicus
ggttcgctcaccctgataatccctg

SEQ ID NO: 487486 - DNA, 25 bp, Rattus norvegicus
gccaccgaccgacctctgctccaag

SEQ ID NO: 487487 - DNA, 25 bp, Rattus norvegicus
actgtgcccggacggtcggcatcct

SEQ ID NO: 487488 - DNA, 25 bp, Rattus norvegicus
acaggtcccactgtgcccggacggt

SEQ ID NO: 487489 - DNA, 25 bp, Rattus norvegicus
tgccgtgggccacaggtcccactgt

SEQ ID NO: 487490 - DNA, 25 bp, Rattus norvegicus
aaccctctcggaagacaggcggctg

SEQ ID NO: 487491 - DNA, 25 bp, Rattus norvegicus
aaagccgagtcgaagccgagtcctg

SEQ ID NO: 487492 - DNA, 25 bp, Rattus norvegicus
tgcttagcaacaacagagacgtctg

SEQ ID NO: 487493 - DNA, 25 bp, Rattus norvegicus
acgtctggcttttcgcgcgctgaaa

SEQ ID NO: 487494 - DNA, 25 bp, Rattus norvegicus
tagtttttggcctatcctgagctgc

SEQ ID NO: 487495 - DNA, 25 bp, Rattus norvegicus
tatcccatgccacgccttgcgtaga

SEQ ID NO: 487496 - DNA, 25 bp, Rattus norvegicus
tcgcggctaactgcataagtccctc

SEQ ID NO: 487497 - DNA, 25 bp, Rattus norvegicus
atcccatgcagcgacccgcttgagg

SEQ ID NO: 487498 - DNA, 25 bp, Rattus norvegicus
ctgtgtctggtacccgctatcatgc

SEQ ID NO: 487499 - DNA, 25 bp, Rattus norvegicus
cccagcggatggatgttgttgagca

SEQ ID NO: 487500 - DNA, 25 bp, Rattus norvegicus
tcaaagtccacgtgagcccgagaga

SEQ ID NO: 487501 - DNA, 25 bp, Rattus norvegicus
tgccctgggccctcttaagttgact

SEQ ID NO: 487502 - DNA, 25 bp, Rattus norvegicus
ttggtactggtaactccgtaacatc

SEQ ID NO: 487503 - DNA, 25 bp, Rattus norvegicus
aagcgcgccaccctactgtttggta

SEQ ID NO: 487504 - DNA, 25 bp, Rattus norvegicus
tatcatgcccaagcggagctgcccg

SEQ ID NO: 487505 - DNA, 25 bp, Rattus norvegicus
accacctagtccaggaagcagcttc

SEQ ID NO: 487506 - DNA, 25 bp, Rattus norvegicus
aggccgagcccacgccgtcctccag

SEQ ID NO: 487507 - DNA, 25 bp, Rattus norvegicus
cagaaaccacctagtccaggaagca

SEQ ID NO: 487508 - DNA, 25 bp, Rattus norvegicus
caggaagcagcttccgggcccagga

SEQ ID NO: 487509 - DNA, 25 bp, Rattus norvegicus
cccaggagggctagcagtcctttgt

SEQ ID NO: 487510 - DNA, 25 bp, Rattus norvegicus
tagcagtcctttgtgggctagcctg

SEQ ID NO: 487511 - DNA, 25 bp, Rattus norvegicus
gggcaccgtgccaccgcgcacaact

SEQ ID NO: 487512 - DNA, 25 bp, Rattus norvegicus
gcgcacaactttctgtccgtgggaa

SEQ ID NO: 487513 - DNA, 25 bp, Rattus norvegicus
tctgtccgtgggaaatgagttctcc

SEQ ID NO: 487514 - DNA, 25 bp, Rattus norvegicus
ggaaatgagttctccttcccagggc

SEQ ID NO: 487515 - DNA, 25 bp, Rattus norvegicus
aggccgcggggcgagcctttctcct

SEQ ID NO: 487516 - DNA, 25 bp, Rattus norvegicus
ttctcctaccctcgctggccgagtg

SEQ ID NO: 487517 - DNA, 25 bp, Rattus norvegicus
cacccaaggtcacgcagcggccgcc

SEQ ID NO: 487518 - DNA, 25 bp, Rattus norvegicus
ggccacttcctgctctcgctccgag

SEQ ID NO: 487519 - DNA, 25 bp, Rattus norvegicus
ccggcctcggggtccacgcagagaa

SEQ ID NO: 487520 - DNA, 25 bp, Rattus norvegicus
gggtccacgcagagaaggatactta

SEQ ID NO: 487521 - DNA, 25 bp, Rattus norvegicus
ccagcattttggactggtagtcgaa

SEQ ID NO: 487522 - DNA, 25 bp, Rattus norvegicus
tttggactggtagtcgaaggctacc

SEQ ID NO: 487523 - DNA, 25 bp, Rattus norvegicus
ggtagtcgaaggctaccacctcgcc

SEQ ID NO: 487524 - DNA, 25 bp, Rattus norvegicus
tgctcctggcacgtccggcacgaca

SEQ ID NO: 487525 - DNA, 25 bp, Rattus norvegicus
acacctggctcccaacgctgaagta

SEQ ID NO: 487526 - DNA, 25 bp, Rattus norvegicus
tggctcccaacgctgaagtactcgc

SEQ ID NO: 487527 - DNA, 25 bp, Rattus norvegicus
aacgctgaagtactcgcccggagga

SEQ ID NO: 487528 - DNA, 25 bp, Rattus norvegicus
ccgccatcttgggagagcagccgcg

SEQ ID NO: 487529 - DNA, 25 bp, Rattus norvegicus
cgacgcgacgcacgaggcgtactga

SEQ ID NO: 487530 - DNA, 25 bp, Rattus norvegicus
acgaggcgtactgacgtcacgcgca

SEQ ID NO: 487531 - DNA, 25 bp, Rattus norvegicus
caccgcacctacacgccggcccggc

SEQ ID NO: 487532 - DNA, 25 bp, Rattus norvegicus
aggatacttagagccagcattttgg

SEQ ID NO: 487533 - DNA, 25 bp, Rattus norvegicus
gatcgagtttttcctgctccgggca

SEQ ID NO: 487534 - DNA, 25 bp, Rattus norvegicus
tagcgaggtgacctcagcggttccg

SEQ ID NO: 487535 - DNA, 25 bp, Rattus norvegicus
agctccagccgggagtttcgctctt

SEQ ID NO: 487536 - DNA, 25 bp, Rattus norvegicus
ccacccgtagctcggtgaggtccga

SEQ ID NO: 487537 - DNA, 25 bp, Rattus norvegicus
cacgggaaagcttgcagaacgagcg

SEQ ID NO: 487538 - DNA, 25 bp, Rattus norvegicus
cgctgccataaatggggccgacggc

SEQ ID NO: 487539 - DNA, 25 bp, Rattus norvegicus
gcagcttctgtttactttcgatcga

SEQ ID NO: 487540 - DNA, 25 bp, Rattus norvegicus
ccgtgagctgcctgcaacccgggaa

SEQ ID NO: 487541 - DNA, 25 bp, Rattus norvegicus
acaggcgtcccgtttgtgcccaggt

SEQ ID NO: 487542 - DNA, 25 bp, Rattus norvegicus
ttcctgtgcgactgcactgtcctgg

SEQ ID NO: 487543 - DNA, 25 bp, Rattus norvegicus
tactggccgcgtgcagtgtctactt

SEQ ID NO: 487544 - DNA, 25 bp, Rattus norvegicus
gtctacttccatctcttctacaggg

SEQ ID NO: 487545 - DNA, 25 bp, Rattus norvegicus
acacagtgcggctcaacggcgacat

SEQ ID NO: 487546 - DNA, 25 bp, Rattus norvegicus
cgaggcagcctgaagtcccgacttc

SEQ ID NO: 487547 - DNA, 25 bp, Rattus norvegicus
gtggcggcgcagcactctccagaac

SEQ ID NO: 487548 - DNA, 25 bp, Rattus norvegicus
cctgtggtcactcatgccttggagc

SEQ ID NO: 487549 - DNA, 25 bp, Rattus norvegicus
ccgtgcttcctgtggtcactcatgc

SEQ ID NO: 487550 - DNA, 25 bp, Rattus norvegicus
cctgcagaagctcgttccgtgcttc

SEQ ID NO: 487551 - DNA, 25 bp, Rattus norvegicus
agcgcgagccctgcagaagctcgtt

SEQ ID NO: 487552 - DNA, 25 bp, Rattus norvegicus
gtgttcccgcatcacgcggcctccg

SEQ ID NO: 487553 - DNA, 25 bp, Rattus norvegicus
aggcgcactcctcctcccgtgttcc

SEQ ID NO: 487554 - DNA, 25 bp, Rattus norvegicus
cggccttctgcacaccatctgcgca

SEQ ID NO: 487555 - DNA, 25 bp, Rattus norvegicus
gaccctaaacactcgcggccttctg

SEQ ID NO: 487556 - DNA, 25 bp, Rattus norvegicus
actcatgccttggagcgtccgcgag

SEQ ID NO: 487557 - DNA, 25 bp, Rattus norvegicus
acttccggcgcagcactctccagaa

SEQ ID NO: 487558 - DNA, 25 bp, Rattus norvegicus
gcaaacttccacctcgcgaccctaa

SEQ ID NO: 487559 - DNA, 25 bp, Rattus norvegicus
tggcgactgcagcaaacttccacct

SEQ ID NO: 487560 - DNA, 25 bp, Rattus norvegicus
gaacaccgtggcgactgcagcaaac

SEQ ID NO: 487561 - DNA, 25 bp, Rattus norvegicus
gattcaggagacaacgccgctccct

SEQ ID NO: 487562 - DNA, 25 bp, Rattus norvegicus
cctccttctgcggtccctccttccg

SEQ ID NO: 487563 - DNA, 25 bp, Rattus norvegicus
ctgattcaggagacaacgccgctcc

SEQ ID NO: 487564 - DNA, 25 bp, Rattus norvegicus
cgctgattcaggagacaacgccgct

SEQ ID NO: 487565 - DNA, 25 bp, Rattus norvegicus
cagcgctgattcaggagacaacgcc

SEQ ID NO: 487566 - DNA, 25 bp, Rattus norvegicus
gccagcgctgattcaggagacaacg

SEQ ID NO: 487567 - DNA, 25 bp, Rattus norvegicus
gggccagcgctgattcaggagacaa

SEQ ID NO: 487568 - DNA, 25 bp, Rattus norvegicus
gcactggcgacaaggcctggctccg

SEQ ID NO: 487569 - DNA, 25 bp, Rattus norvegicus
tgccgagctggtagacctgggcgcc

SEQ ID NO: 487570 - DNA, 25 bp, Rattus norvegicus
acgcggcctgccgagctggtagacc

SEQ ID NO: 487571 - DNA, 25 bp, Rattus norvegicus
tccgcgcatgtctacgcggcctgcc

SEQ ID NO: 487572 - DNA, 25 bp, Rattus norvegicus
cctggcactggcgacaaggcctggc

SEQ ID NO: 487573 - DNA, 25 bp, Rattus norvegicus
cctggctccgcgcatgtctacgcgg

SEQ ID NO: 487574 - DNA, 25 bp, Rattus norvegicus
cagggccagcgctgattcaggagac

SEQ ID NO: 487575 - DNA, 25 bp, Rattus norvegicus
aggctaccgtgtcaggtcgccaagg

SEQ ID NO: 487576 - DNA, 25 bp, Rattus norvegicus
ccgggaggagcaaagccgcagttcc

SEQ ID NO: 487577 - DNA, 25 bp, Rattus norvegicus
gagcaaagccgcagttccaccacgg

SEQ ID NO: 487578 - DNA, 25 bp, Rattus norvegicus
tccaccacggctcagaaggtgcagc

SEQ ID NO: 487579 - DNA, 25 bp, Rattus norvegicus
aaggtgcagcaggtactgacccgct

SEQ ID NO: 487580 - DNA, 25 bp, Rattus norvegicus
agcaggtactgacccgctccaacag

SEQ ID NO: 487581 - DNA, 25 bp, Rattus norvegicus
ctcagacactgaggccgtggatggt

SEQ ID NO: 487582 - DNA, 25 bp, Rattus norvegicus
gaaactgacacgcttggacatcctg

SEQ ID NO: 487583 - DNA, 25 bp, Rattus norvegicus
cacggccaaccctgaaccagtaaat

SEQ ID NO: 487584 - DNA, 25 bp, Rattus norvegicus
accctgaaccagtaaatcgtgccgc

SEQ ID NO: 487585 - DNA, 25 bp, Rattus norvegicus
cctgagcaggccaagaaactgacac

SEQ ID NO: 487586 - DNA, 25 bp, Rattus norvegicus
tcaggtcgccaagggcctcgccgga

SEQ ID NO: 487587 - DNA, 25 bp, Rattus norvegicus
acacgcttggacatcctggccatgc

SEQ ID NO: 487588 - DNA, 25 bp, Rattus norvegicus
tggtgaacgagggaccacggccaac

SEQ ID NO: 487589 - DNA, 25 bp, Rattus norvegicus
tggggtacctccagaccttggctcc

SEQ ID NO: 487590 - DNA, 25 bp, Rattus norvegicus
ggtccgaaagcaagcgagacccgcc

SEQ ID NO: 487591 - DNA, 25 bp, Rattus norvegicus
tgacgcgcgcagttggtcccgcact

SEQ ID NO: 487592 - DNA, 25 bp, Rattus norvegicus
gctccgggccaggtaggcagcacca

SEQ ID NO: 487593 - DNA, 25 bp, Rattus norvegicus
taggcagcaccacgtggaagcagtc

SEQ ID NO: 487594 - DNA, 25 bp, Rattus norvegicus
cgtggaagcagtcgcacatcttggc

SEQ ID NO: 487595 - DNA, 25 bp, Rattus norvegicus
tccagtcgcggtcctggagctgatg

SEQ ID NO: 487596 - DNA, 25 bp, Rattus norvegicus
agccgggctgtgactgcagctaaca

SEQ ID NO: 487597 - DNA, 25 bp, Rattus norvegicus
agtccgtgctgaccactccgcaggg

SEQ ID NO: 487598 - DNA, 25 bp, Rattus norvegicus
actccgcagggacgatgcgagcagc

SEQ ID NO: 487599 - DNA, 25 bp, Rattus norvegicus
cgccggtctcattcagcccattggt

SEQ ID NO: 487600 - DNA, 25 bp, Rattus norvegicus
tcagcccattggttgctgcagtcgc

SEQ ID NO: 487601 - DNA, 25 bp, Rattus norvegicus
gtcgcacatcttggcggctagtggt

SEQ ID NO: 487602 - DNA, 25 bp, Rattus norvegicus
ctgcagctaacacttggggtacctc

SEQ ID NO: 487603 - DNA, 25 bp, Rattus norvegicus
tttctgagcagctttccttcgggtc

SEQ ID NO: 487604 - DNA, 25 bp, Rattus norvegicus
tggcctggccacaccaagatgcaag

SEQ ID NO: 487605 - DNA, 25 bp, Rattus norvegicus
actccacagaggcacgtgaacgctc

SEQ ID NO: 487606 - DNA, 25 bp, Rattus norvegicus
tcagtgagtgacctcgcagaggaac

SEQ ID NO: 487607 - DNA, 25 bp, Rattus norvegicus
tcggctacgacggtcccgtgattct

SEQ ID NO: 487608 - DNA, 25 bp, Rattus norvegicus
atgctaacagctccaggctggatga

SEQ ID NO: 487609 - DNA, 25 bp, Rattus norvegicus
tcagcagctgcatgttttctgagca

SEQ ID NO: 487610 - DNA, 25 bp, Rattus norvegicus
gcctcacttgtttggccctaggaca

SEQ ID NO: 487611 - DNA, 25 bp, Rattus norvegicus
gttctgcggttcatccaccaggacc

SEQ ID NO: 487612 - DNA, 25 bp, Rattus norvegicus
gctaagctggctgtaggtatctccc

SEQ ID NO: 487613 - DNA, 25 bp, Rattus norvegicus
tgacgacacttgaagcacgccggaa

SEQ ID NO: 487614 - DNA, 25 bp, Rattus norvegicus
cacacggtggcgtgctgacgacact

SEQ ID NO: 487615 - DNA, 25 bp, Rattus norvegicus
tgagggtctttcctccagccgtcca

SEQ ID NO: 487616 - DNA, 25 bp, Rattus norvegicus
tgattctgccggacgccaatgctaa

SEQ ID NO: 487617 - DNA, 25 bp, Rattus norvegicus
gatcccttgtccgtccacagctcga

SEQ ID NO: 487618 - DNA, 25 bp, Rattus norvegicus
cgcagctcttaagggacacgcacag

SEQ ID NO: 487619 - DNA, 25 bp, Rattus norvegicus
caccggcggccagcccgaaaggtga

SEQ ID NO: 487620 - DNA, 25 bp, Rattus norvegicus
gctacggcctctccggtatgtgtcc

SEQ ID NO: 487621 - DNA, 25 bp, Rattus norvegicus
ggtatgtgtccacctcaacacgccg

SEQ ID NO: 487622 - DNA, 25 bp, Rattus norvegicus
caggcctccagaggcctccgaagga

SEQ ID NO: 487623 - DNA, 25 bp, Rattus norvegicus
ggcctccgaaggagccaaatccatc

SEQ ID NO: 487624 - DNA, 25 bp, Rattus norvegicus
aggagccaaatccatccgacacact

SEQ ID NO: 487625 - DNA, 25 bp, Rattus norvegicus
agtgcccacaaaggggtcgccatgg

SEQ ID NO: 487626 - DNA, 25 bp, Rattus norvegicus
tgcgggccggagcttcgttcaaacc

SEQ ID NO: 487627 - DNA, 25 bp, Rattus norvegicus
ggagcttcgttcaaacccacgcaag

SEQ ID NO: 487628 - DNA, 25 bp, Rattus norvegicus
ttcaaacccacgcaagggcggacgc

SEQ ID NO: 487629 - DNA, 25 bp, Rattus norvegicus
ccgcgcttcgacttcagccgttagg

SEQ ID NO: 487630 - DNA, 25 bp, Rattus norvegicus
acttcagccgttaggctcgcgcgct

SEQ ID NO: 487631 - DNA, 25 bp, Rattus norvegicus
ccaggaagatggtgacgactgcaat

SEQ ID NO: 487632 - DNA, 25 bp, Rattus norvegicus
ccgcaggtagtagtagccggctatc

SEQ ID NO: 487633 - DNA, 25 bp, Rattus norvegicus
cggctttgatgaggagcaccacgtg

SEQ ID NO: 487634 - DNA, 25 bp, Rattus norvegicus
caaagccaaaagtgaaccgcaggta

SEQ ID NO: 487635 - DNA, 25 bp, Rattus norvegicus
tgcgcagcgctcaggctatcactga

SEQ ID NO: 487636 - DNA, 25 bp, Rattus norvegicus
cttgatgctccggaagatctggtga

SEQ ID NO: 487637 - DNA, 25 bp, Rattus norvegicus
cgccgagagggacggcaaagccaaa

SEQ ID NO: 487638 - DNA, 25 bp, Rattus norvegicus
actgcaatggcggagcgcttcacct

SEQ ID NO: 487639 - DNA, 25 bp, Rattus norvegicus
cacgtggtagggagcaaagcagacc

SEQ ID NO: 487640 - DNA, 25 bp, Rattus norvegicus
gcatcccggtctccttcgtagaagg

SEQ ID NO: 487641 - DNA, 25 bp, Rattus norvegicus
tgttttcgaagtcacacaccgcatc

SEQ ID NO: 487642 - DNA, 25 bp, Rattus norvegicus
tagagaccgtgtacagcctgttttc

SEQ ID NO: 487643 - DNA, 25 bp, Rattus norvegicus
gcacaggaacactgtagagaccgtg

SEQ ID NO: 487644 - DNA, 25 bp, Rattus norvegicus
ttcaccttgtttttctgcgcagcgc

SEQ ID NO: 487645 - DNA, 25 bp, Rattus norvegicus
gcatctgcaggtgctgggcatttcc

SEQ ID NO: 487646 - DNA, 25 bp, Rattus norvegicus
cgcaagccgctcctcggatttgtga

SEQ ID NO: 487647 - DNA, 25 bp, Rattus norvegicus
tcggatttgtgacgtgccgcaggct

SEQ ID NO: 487648 - DNA, 25 bp, Rattus norvegicus
tgacggggccaccacacaaagccgg

SEQ ID NO: 487649 - DNA, 25 bp, Rattus norvegicus
cccgcagcattaaagtgagcactca

SEQ ID NO: 487650 - DNA, 25 bp, Rattus norvegicus
agatcgcccagcacgcgcttggctt

SEQ ID NO: 487651 - DNA, 25 bp, Rattus norvegicus
cggcgagggatagccacgcctactt

SEQ ID NO: 487652 - DNA, 25 bp, Rattus norvegicus
agcacccgctcgaagatggctgcga

SEQ ID NO: 487653 - DNA, 25 bp, Rattus norvegicus
accgcatgttccagctggtccggca

SEQ ID NO: 487654 - DNA, 25 bp, Rattus norvegicus
cggcagtagcaaccggcgaagcagc

SEQ ID NO: 487655 - DNA, 25 bp, Rattus norvegicus
cagcccgagcggcaggttcatctct

SEQ ID NO: 487656 - DNA, 25 bp, Rattus norvegicus
ggttcatctctctggacaccggtga

SEQ ID NO: 487657 - DNA, 25 bp, Rattus norvegicus
ttcgcccggagcgaacgcgcgaaaa

SEQ ID NO: 487658 - DNA, 25 bp, Rattus norvegicus
gcgcacggcacccacctgaaggtgg

SEQ ID NO: 487659 - DNA, 25 bp, Rattus norvegicus
acgctccgtgatgccagtcttggca

SEQ ID NO: 487660 - DNA, 25 bp, Rattus norvegicus
ccggaatgtggctgaagattctgtc

SEQ ID NO: 487661 - DNA, 25 bp, Rattus norvegicus
cgccaactctggctagcgggccacg

SEQ ID NO: 487662 - DNA, 25 bp, Rattus norvegicus
cacccggaatgtggctgaagattct

SEQ ID NO: 487663 - DNA, 25 bp, Rattus norvegicus
tgccagtcttggcactccagctccg

SEQ ID NO: 487664 - DNA, 25 bp, Rattus norvegicus
ccaacccggcccaggcgcgagatgg

SEQ ID NO: 487665 - DNA, 25 bp, Rattus norvegicus
gcggtctttcccacgctccgtgatg

SEQ ID NO: 487666 - DNA, 25 bp, Rattus norvegicus
acggattcctgtctcagtgggtgtg

SEQ ID NO: 487667 - DNA, 25 bp, Rattus norvegicus
gggccacggattcctgtctcagtgg

SEQ ID NO: 487668 - DNA, 25 bp, Rattus norvegicus
ccggggccacggattcctgtctcag

SEQ ID NO: 487669 - DNA, 25 bp, Rattus norvegicus
ctgaagattctgtcccccggggcca

SEQ ID NO: 487670 - DNA, 25 bp, Rattus norvegicus
ggaatgtggctgaagattctgtccc

SEQ ID NO: 487671 - DNA, 25 bp, Rattus norvegicus
ccacgctccgtgatgccagtcttgg

SEQ ID NO: 487672 - DNA, 25 bp, Rattus norvegicus
gcgggccacgcccaaagcctgccaa

SEQ ID NO: 487673 - DNA, 25 bp, Rattus norvegicus
gccggctgtactcgagaggccgctt

SEQ ID NO: 487674 - DNA, 25 bp, Rattus norvegicus
cgagccacggactgtcgtcatggta

SEQ ID NO: 487675 - DNA, 25 bp, Rattus norvegicus
tcgagtctgatacggccgggccaat

SEQ ID NO: 487676 - DNA, 25 bp, Rattus norvegicus
cccactttacatcagggtcgagttg

SEQ ID NO: 487677 - DNA, 25 bp, Rattus norvegicus
tgctctggggatactgtctggcaca

SEQ ID NO: 487678 - DNA, 25 bp, Rattus norvegicus
taaagacgcttctctctgacgctgc

SEQ ID NO: 487679 - DNA, 25 bp, Rattus norvegicus
gcttccgctgcggtcttaaagacgc

SEQ ID NO: 487680 - DNA, 25 bp, Rattus norvegicus
ggcgcacattcttaggcgaccctct

SEQ ID NO: 487681 - DNA, 25 bp, Rattus norvegicus
tcgaaagtcgctttgggcgcacatt

SEQ ID NO: 487682 - DNA, 25 bp, Rattus norvegicus
agctactgttatggcggcggcttcg

SEQ ID NO: 487683 - DNA, 25 bp, Rattus norvegicus
tcagcgggataaaattggggccttc

SEQ ID NO: 487684 - DNA, 25 bp, Rattus norvegicus
agaaaaactttgtgtcagcgggata

SEQ ID NO: 487685 - DNA, 25 bp, Rattus norvegicus
cgtcatggtaatgccgcgtctacgc

SEQ ID NO: 487686 - DNA, 25 bp, Rattus norvegicus
tccctttaaggctgaggcggaagac

SEQ ID NO: 487687 - DNA, 25 bp, Rattus norvegicus
tcataggctgtctcaggtctgtgct

SEQ ID NO: 487688 - DNA, 25 bp, Rattus norvegicus
actccctcgggacagaatggaggtg

SEQ ID NO: 487689 - DNA, 25 bp, Rattus norvegicus
tccttaagcttgttctggcgggccc

SEQ ID NO: 487690 - DNA, 25 bp, Rattus norvegicus
tgtctcaggtctgtgctgcgccgct

SEQ ID NO: 487691 - DNA, 25 bp, Rattus norvegicus
ggggttcataggctgtctcaggtct

SEQ ID NO: 487692 - DNA, 25 bp, Rattus norvegicus
cagtcgaccgcgctccagcgtccgc

SEQ ID NO: 487693 - DNA, 25 bp, Rattus norvegicus
taagcttgttctggcgggcccagtc

SEQ ID NO: 487694 - DNA, 25 bp, Rattus norvegicus
tgcgcgccgtccttaagcttgttct

SEQ ID NO: 487695 - DNA, 25 bp, Rattus norvegicus
aatgcgcctttgtgcgcgccgtcct

SEQ ID NO: 487696 - DNA, 25 bp, Rattus norvegicus
gagaggaccctgatcgcgacacacc

SEQ ID NO: 487697 - DNA, 25 bp, Rattus norvegicus
aggagaggaccctgatcgcgacaca

SEQ ID NO: 487698 - DNA, 25 bp, Rattus norvegicus
gggtcagacaagtccgcgcctgcgc

SEQ ID NO: 487699 - DNA, 25 bp, Rattus norvegicus
cagattccagcacgggggtcagaca

SEQ ID NO: 487700 - DNA, 25 bp, Rattus norvegicus
gccgctgactccctcgggacagaat

SEQ ID NO: 487701 - DNA, 25 bp, Rattus norvegicus
cggatgggattgagcggagcccact

SEQ ID NO: 487702 - DNA, 25 bp, Rattus norvegicus
gcggtgtgaagttcttgcactggta

SEQ ID NO: 487703 - DNA, 25 bp, Rattus norvegicus
gtgaagttcttgcactggtagagta

SEQ ID NO: 487704 - DNA, 25 bp, Rattus norvegicus
gttcttgcactggtagagtacgtcc

SEQ ID NO: 487705 - DNA, 25 bp, Rattus norvegicus
cttgcactggtagagtacgtccttg

SEQ ID NO: 487706 - DNA, 25 bp, Rattus norvegicus
ctgcctggccgctcaatggggttgc

SEQ ID NO: 487707 - DNA, 25 bp, Rattus norvegicus
ggcccaggcagtgcctcgcctgccc

SEQ ID NO: 487708 - DNA, 25 bp, Rattus norvegicus
gagcccactggttgttggcgctctc

SEQ ID NO: 487709 - DNA, 25 bp, Rattus norvegicus
ccactggttgttggcgctctcgtcc

SEQ ID NO: 487710 - DNA, 25 bp, Rattus norvegicus
ttggcgctctcgtcccgtggtagcc

SEQ ID NO: 487711 - DNA, 25 bp, Rattus norvegicus
cgtggtagccggctcctctcacgtt

SEQ ID NO: 487712 - DNA, 25 bp, Rattus norvegicus
gtagccggctcctctcacgttcttt

SEQ ID NO: 487713 - DNA, 25 bp, Rattus norvegicus
acgttctttcctgcgcttccgtgtc

SEQ ID NO: 487714 - DNA, 25 bp, Rattus norvegicus
actggtagagtacgtccttgtggcc

SEQ ID NO: 487715 - DNA, 25 bp, Rattus norvegicus
cagcgggcaggccatattgaccaca

SEQ ID NO: 487716 - DNA, 25 bp, Rattus norvegicus
agcggaaggtgtcgccgctgtcata

SEQ ID NO: 487717 - DNA, 25 bp, Rattus norvegicus
attgaccaggtcatagcagcggccg

SEQ ID NO: 487718 - DNA, 25 bp, Rattus norvegicus
gacacagtagaagtcattgaccagg

SEQ ID NO: 487719 - DNA, 25 bp, Rattus norvegicus
tccagccatcatcgcagacacagta

SEQ ID NO: 487720 - DNA, 25 bp, Rattus norvegicus
tgagtggcaggtcttgcccttccag

SEQ ID NO: 487721 - DNA, 25 bp, Rattus norvegicus
cacttacgtgagtggcaggtcttgc

SEQ ID NO: 487722 - DNA, 25 bp, Rattus norvegicus
gcaggccatattgaccacagcaggg

SEQ ID NO: 487723 - DNA, 25 bp, Rattus norvegicus
tgcaagcacacagccgctcagcggg

SEQ ID NO: 487724 - DNA, 25 bp, Rattus norvegicus
actggaactcgcctgcaagcacaca

SEQ ID NO: 487725 - DNA, 25 bp, Rattus norvegicus
aggtgtaggcgtcacactggaactc

SEQ ID NO: 487726 - DNA, 25 bp, Rattus norvegicus
ccaccgttgctgcaggtgtaggcgt

SEQ ID NO: 487727 - DNA, 25 bp, Rattus norvegicus
gctgtcatagcatgtgccaccgttg

SEQ ID NO: 487728 - DNA, 25 bp, Rattus norvegicus
cacagcagggtcctggcaagcggcc

SEQ ID NO: 487729 - DNA, 25 bp, Rattus norvegicus
tggtactccttaaggcacacgcgca

SEQ ID NO: 487730 - DNA, 25 bp, Rattus norvegicus
cgtcaccttggcctggtactcctta

SEQ ID NO: 487731 - DNA, 25 bp, Rattus norvegicus
aggcgcgaacctggtcgccagagca

SEQ ID NO: 487732 - DNA, 25 bp, Rattus norvegicus
gcacgtaccggccaggcgaactgaa

SEQ ID NO: 487733 - DNA, 25 bp, Rattus norvegicus
actgaaagggaatgacgacgaggcc

SEQ ID NO: 487734 - DNA, 25 bp, Rattus norvegicus
cggcaggtagaaggagttgccaccc

SEQ ID NO: 487735 - DNA, 25 bp, Rattus norvegicus
tccttaaggcacacgcgcacgtacg

SEQ ID NO: 487736 - DNA, 25 bp, Rattus norvegicus
gcacgtacgtgtcgcactcgtcgcg

SEQ ID NO: 487737 - DNA, 25 bp, Rattus norvegicus
cgcgctcagctgcagctcgaaatag

SEQ ID NO: 487738 - DNA, 25 bp, Rattus norvegicus
ctcgaaatagcccatgggccgcgtc

SEQ ID NO: 487739 - DNA, 25 bp, Rattus norvegicus
ggccgcgtcgcctaaaaataaggca

SEQ ID NO: 487740 - DNA, 25 bp, Rattus norvegicus
aataaggcagctcagagtgcaggga

SEQ ID NO: 487741 - DNA, 25 bp, Rattus norvegicus
gaaggagttgccacccagcacgggc

SEQ ID NO: 487742 - DNA, 25 bp, Rattus norvegicus
cacgcatagaaccagcagcagcagc

SEQ ID NO: 487743 - DNA, 25 bp, Rattus norvegicus
agctcaagctctgagaatccgctca

SEQ ID NO: 487744 - DNA, 25 bp, Rattus norvegicus
tctgggcatgcccagttcacgcgcg

SEQ ID NO: 487745 - DNA, 25 bp, Rattus norvegicus
aagcaggcgggcgtgtctacgcact

SEQ ID NO: 487746 - DNA, 25 bp, Rattus norvegicus
tgtcttccgcggatccaagcaggcg

SEQ ID NO: 487747 - DNA, 25 bp, Rattus norvegicus
cctcgatgcgctccatggtggcgcg

SEQ ID NO: 487748 - DNA, 25 bp, Rattus norvegicus
tagggcgaatgggcacagagaccca

SEQ ID NO: 487749 - DNA, 25 bp, Rattus norvegicus
atcacctggcggtagtgcagcgtga

SEQ ID NO: 487750 - DNA, 25 bp, Rattus norvegicus
gtgagcacgcggagacatgcgagcg

SEQ ID NO: 487751 - DNA, 25 bp, Rattus norvegicus
ccgggcctgcaacgcaggggtttgg

SEQ ID NO: 487752 - DNA, 25 bp, Rattus norvegicus
gtctacgcacttctgggcatgccca

SEQ ID NO: 487753 - DNA, 25 bp, Rattus norvegicus
gggcggagctcaagctctgagaatc

SEQ ID NO: 487754 - DNA, 25 bp, Rattus norvegicus
ctgacccgcggtcaggactgcagga

SEQ ID NO: 487755 - DNA, 25 bp, Rattus norvegicus
gcgtgtctacgcacttctgggcatg

SEQ ID NO: 487756 - DNA, 25 bp, Rattus norvegicus
agctctgagaatccgctcagggcgg

SEQ ID NO: 487757 - DNA, 25 bp, Rattus norvegicus
gaagtggccgcctcctgaacaaagg

SEQ ID NO: 487758 - DNA, 25 bp, Rattus norvegicus
cagaatcctccggtgctgcctgtta

SEQ ID NO: 487759 - DNA, 25 bp, Rattus norvegicus
tagggcccgtagtgacagaatcctc

SEQ ID NO: 487760 - DNA, 25 bp, Rattus norvegicus
ttggctcgcagcttcggtaccacct

SEQ ID NO: 487761 - DNA, 25 bp, Rattus norvegicus
aaagcctggcttggctcgcagcttc

SEQ ID NO: 487762 - DNA, 25 bp, Rattus norvegicus
accaatctcgggagcgtacggagga

SEQ ID NO: 487763 - DNA, 25 bp, Rattus norvegicus
ctttcggaccaatctcgggagcgta

SEQ ID NO: 487764 - DNA, 25 bp, Rattus norvegicus
cggcgggaagaccaaggctcaccga

SEQ ID NO: 487765 - DNA, 25 bp, Rattus norvegicus
acacggaaccgtgcgcgcgtctctt

SEQ ID NO: 487766 - DNA, 25 bp, Rattus norvegicus
ggcccagtacgacacggaaccgtgc

SEQ ID NO: 487767 - DNA, 25 bp, Rattus norvegicus
ctgataagagcctacgcgccgggcc

SEQ ID NO: 487768 - DNA, 25 bp, Rattus norvegicus
gccggcggacaatggccattgaatt

SEQ ID NO: 487769 - DNA, 25 bp, Rattus norvegicus
tggcctccgcatttcggtttcctgc

SEQ ID NO: 487770 - DNA, 25 bp, Rattus norvegicus
ccgccagatgcccacgctgataaga

SEQ ID NO: 487771 - DNA, 25 bp, Rattus norvegicus
tcgacgcacagtgacgagagacgcc

SEQ ID NO: 487772 - DNA, 25 bp, Rattus norvegicus
acgaggagccgcgtctcgacgcaca

SEQ ID NO: 487773 - DNA, 25 bp, Rattus norvegicus
gtggcgcagtgcctaacctacctgc

SEQ ID NO: 487774 - DNA, 25 bp, Rattus norvegicus
taacctacctgctggggctcgcaga

SEQ ID NO: 487775 - DNA, 25 bp, Rattus norvegicus
cagtactgaccagtgcggaggccgc

SEQ ID NO: 487776 - DNA, 25 bp, Rattus norvegicus
aagatggccgcggaactgtacccgc

SEQ ID NO: 487777 - DNA, 25 bp, Rattus norvegicus
acatcgccaacagcaacgcggcggg

SEQ ID NO: 487778 - DNA, 25 bp, Rattus norvegicus
ccgaaagcacgaaggttggcctttg

SEQ ID NO: 487779 - DNA, 25 bp, Rattus norvegicus
gaaggttggcctttgctgcccaccc

SEQ ID NO: 487780 - DNA, 25 bp, Rattus norvegicus
ttccaccctacgctgcgcgagaggt

SEQ ID NO: 487781 - DNA, 25 bp, Rattus norvegicus
tgccctttgcaggaatgcgctcatg

SEQ ID NO: 487782 - DNA, 25 bp, Rattus norvegicus
ggaatgcgctcatgttcaacaacga

SEQ ID NO: 487783 - DNA, 25 bp, Rattus norvegicus
acaacgagctgatggccgacgtcca

SEQ ID NO: 487784 - DNA, 25 bp, Rattus norvegicus
tggccgacgtccatttcatcgtggg

SEQ ID NO: 487785 - DNA, 25 bp, Rattus norvegicus
tagcttcgacttcctacccatcttg

SEQ ID NO: 487786 - DNA, 25 bp, Rattus norvegicus
gagcttgaaagctgtgcctgccaga

SEQ ID NO: 487787 - DNA, 25 bp, Rattus norvegicus
gaacctgcatcaggcgcgagcttga

SEQ ID NO: 487788 - DNA, 25 bp, Rattus norvegicus
gaacctccgttggaccagaccgcga

SEQ ID NO: 487789 - DNA, 25 bp, Rattus norvegicus
cggccggaagcgaagctccaaacca

SEQ ID NO: 487790 - DNA, 25 bp, Rattus norvegicus
ctccagaatcactgggacgctggga

SEQ ID NO: 487791 - DNA, 25 bp, Rattus norvegicus
cgcgggaccaataaaggaactccag

SEQ ID NO: 487792 - DNA, 25 bp, Rattus norvegicus
cccgccgattcgtagcggcagattc

SEQ ID NO: 487793 - DNA, 25 bp, Rattus norvegicus
gcagggcgatctgcttccgtttccc

SEQ ID NO: 487794 - DNA, 25 bp, Rattus norvegicus
gcgacacgaactggccgactgccga

SEQ ID NO: 487795 - DNA, 25 bp, Rattus norvegicus
tgttctccacgaactgcacctcgga

SEQ ID NO: 487796 - DNA, 25 bp, Rattus norvegicus
gatgatgttgtcctcgagcaccgaa

SEQ ID NO: 487797 - DNA, 25 bp, Rattus norvegicus
tgccagatttcaggccagccggacg

SEQ ID NO: 487798 - DNA, 25 bp, Rattus norvegicus
gcgaagctcatgtcagcgtacagga

SEQ ID NO: 487799 - DNA, 25 bp, Rattus norvegicus
ggtctgctctctcttcacctgtcgg

SEQ ID NO: 487800 - DNA, 25 bp, Rattus norvegicus
tgccctgtcggccaataggcgttgt

SEQ ID NO: 487801 - DNA, 25 bp, Rattus norvegicus
atgaacctgtttgccacctgggagg

SEQ ID NO: 487802 - DNA, 25 bp, Rattus norvegicus
accttgacacctgcgtccgggctgg

SEQ ID NO: 487803 - DNA, 25 bp, Rattus norvegicus
ggcacacaggatggcaacgggataa

SEQ ID NO: 487804 - DNA, 25 bp, Rattus norvegicus
actccggtgcccatgaacctgtttg

SEQ ID NO: 487805 - DNA, 25 bp, Rattus norvegicus
tctccgtctaccctgcgggtgaggt

SEQ ID NO: 487806 - DNA, 25 bp, Rattus norvegicus
gcctcacttccggtaggcagtgatt

SEQ ID NO: 487807 - DNA, 25 bp, Rattus norvegicus
taagtccctgagagggcacagcctg

SEQ ID NO: 487808 - DNA, 25 bp, Rattus norvegicus
gcaacgggataagagtcaccgggta

SEQ ID NO: 487809 - DNA, 25 bp, Rattus norvegicus
tacaggggaatgtccctaggcctgc

SEQ ID NO: 487810 - DNA, 25 bp, Rattus norvegicus
gcgtaagggcttgtagacctggcca

SEQ ID NO: 487811 - DNA, 25 bp, Rattus norvegicus
agcgtcgctcgcctaagtccctgag

SEQ ID NO: 487812 - DNA, 25 bp, Rattus norvegicus
tgaggctcacgggacacgccactgt

SEQ ID NO: 487813 - DNA, 25 bp, Rattus norvegicus
ggtttcactcccaggcaagccgtta

SEQ ID NO: 487814 - DNA, 25 bp, Rattus norvegicus
cgaacgccgttgagctagctgctga

SEQ ID NO: 487815 - DNA, 25 bp, Rattus norvegicus
caccggtcagacaggcaagagataa

SEQ ID NO: 487816 - DNA, 25 bp, Rattus norvegicus
gaacatagcgaacgagtcccggcca

SEQ ID NO: 487817 - DNA, 25 bp, Rattus norvegicus
gcctcacgacagataacggaacata

SEQ ID NO: 487818 - DNA, 25 bp, Rattus norvegicus
gggctgacctttagcgccgcctcag

SEQ ID NO: 487819 - DNA, 25 bp, Rattus norvegicus
taccggtttccgagaccagaacaga

SEQ ID NO: 487820 - DNA, 25 bp, Rattus norvegicus
cgggagacccttttctccgcagtca

SEQ ID NO: 487821 - DNA, 25 bp, Rattus norvegicus
cgcactcaccatgctgcaagggcta

SEQ ID NO: 487822 - DNA, 25 bp, Rattus norvegicus
cctctttagtcagtccgcttcggca

SEQ ID NO: 487823 - DNA, 25 bp, Rattus norvegicus
ggcctttttggtgccatccctctgg

SEQ ID NO: 487824 - DNA, 25 bp, Rattus norvegicus
ggggacacctgcgacatgaccgtcg

SEQ ID NO: 487825 - DNA, 25 bp, Rattus norvegicus
ccgactcatctaagggaacccaaga

SEQ ID NO: 487826 - DNA, 25 bp, Rattus norvegicus
gctggtttgtacctgcaatgcgtca

SEQ ID NO: 487827 - DNA, 25 bp, Rattus norvegicus
cgccacggggcaagccctggagtca

SEQ ID NO: 487828 - DNA, 25 bp, Rattus norvegicus
ctgcgcgctgcaagcggtacaggac

SEQ ID NO: 487829 - DNA, 25 bp, Rattus norvegicus
acgccaatggactgcgcgctgcaag

SEQ ID NO: 487830 - DNA, 25 bp, Rattus norvegicus
gggcaggccacacgccaatggactg

SEQ ID NO: 487831 - DNA, 25 bp, Rattus norvegicus
accaatggggcaggccacacgccaa

SEQ ID NO: 487832 - DNA, 25 bp, Rattus norvegicus
gggcaagccctggagtcaccaatgg

SEQ ID NO: 487833 - DNA, 25 bp, Rattus norvegicus
caacgcctgtgctaatggctgcgga

SEQ ID NO: 487834 - DNA, 25 bp, Rattus norvegicus
actgcacaacgcctgtgctaatggc

SEQ ID NO: 487835 - DNA, 25 bp, Rattus norvegicus
ggctgcgggtcgcaagcgccacaca

SEQ ID NO: 487836 - DNA, 25 bp, Rattus norvegicus
tgccgcgcgacagctcctggaagct

SEQ ID NO: 487837 - DNA, 25 bp, Rattus norvegicus
gactgcgctgaacgcagcgtgcgct

SEQ ID NO: 487838 - DNA, 25 bp, Rattus norvegicus
ctgcgcaccagccagggagagactg

SEQ ID NO: 487839 - DNA, 25 bp, Rattus norvegicus
ctggagtcaccaatggggcaggcca

SEQ ID NO: 487840 - DNA, 25 bp, Rattus norvegicus
ccagggagagactgcgctgaacgca

SEQ ID NO: 487841 - DNA, 25 bp, Rattus norvegicus
tgcagcgaggccgttgctatagaaa

SEQ ID NO: 487842 - DNA, 25 bp, Rattus norvegicus
tggacatggaatcctcgggcgatcc

SEQ ID NO: 487843 - DNA, 25 bp, Rattus norvegicus
cgctctccagctagagatcacaatg

SEQ ID NO: 487844 - DNA, 25 bp, Rattus norvegicus
gtcccaagtgtgacaagaccgtgta

SEQ ID NO: 487845 - DNA, 25 bp, Rattus norvegicus
cccgggcctcaagacctagagctgg

SEQ ID NO: 487846 - DNA, 25 bp, Rattus norvegicus
cccgagacaggttcgttgagatccc

SEQ ID NO: 487847 - DNA, 25 bp, Rattus norvegicus
ggccaccctcttgttcagcttatcg

SEQ ID NO: 487848 - DNA, 25 bp, Rattus norvegicus
cactgggcgaggtacgcaaagtcct

SEQ ID NO: 487849 - DNA, 25 bp, Rattus norvegicus
ggttcggaagcgctcggtaagcact

SEQ ID NO: 487850 - DNA, 25 bp, Rattus norvegicus
tcggtagctaagctcgccacgctgc

SEQ ID NO: 487851 - DNA, 25 bp, Rattus norvegicus
gaccgtgtacttcggtgagtatcca

SEQ ID NO: 487852 - DNA, 25 bp, Rattus norvegicus
ccgatgcttcgtgcttctgtgcagc

SEQ ID NO: 487853 - DNA, 25 bp, Rattus norvegicus
ttcagcaccacagacaggaccgcgg

SEQ ID NO: 487854 - DNA, 25 bp, Rattus norvegicus
tggggatcccaagtccgctctccag

SEQ ID NO: 487855 - DNA, 25 bp, Rattus norvegicus
tggtgtttgtttccaaggagttgtc

SEQ ID NO: 487856 - DNA, 25 bp, Rattus norvegicus
cgcgggcagctttgctgtacatcgg

SEQ ID NO: 487857 - DNA, 25 bp, Rattus norvegicus
acggggcaggatctggccttttcct

SEQ ID NO: 487858 - DNA, 25 bp, Rattus norvegicus
gatctggccttttcctgcggaggaa

SEQ ID NO: 487859 - DNA, 25 bp, Rattus norvegicus
tcctgcggaggaagatgacgttgct

SEQ ID NO: 487860 - DNA, 25 bp, Rattus norvegicus
atgacgttgcttggtgtttgtttcc

SEQ ID NO: 487861 - DNA, 25 bp, Rattus norvegicus
tccaaggagttgtcgtggaaacgcg

SEQ ID NO: 487862 - DNA, 25 bp, Rattus norvegicus
tttgtctgggtcttgttgccaggcg

SEQ ID NO: 487863 - DNA, 25 bp, Rattus norvegicus
tgttgccaggcggtgtccgctgcat

SEQ ID NO: 487864 - DNA, 25 bp, Rattus norvegicus
tgtccgctgcattgccaggtcgcgt

SEQ ID NO: 487865 - DNA, 25 bp, Rattus norvegicus
ttgccaggtcgcgtcagtggcacca

SEQ ID NO: 487866 - DNA, 25 bp, Rattus norvegicus
aggtcgcgtcagtggcaccagcttc

SEQ ID NO: 487867 - DNA, 25 bp, Rattus norvegicus
gcccgcgggcagctttgctgtacat

SEQ ID NO: 487868 - DNA, 25 bp, Rattus norvegicus
tgctgcgactgtttgtctgggtctt

SEQ ID NO: 487869 - DNA, 25 bp, Rattus norvegicus
cggtacgcggaagcatggtccagaa

SEQ ID NO: 487870 - DNA, 25 bp, Rattus norvegicus
ccctcccaatgctaagtagaaacag

SEQ ID NO: 487871 - DNA, 25 bp, Rattus norvegicus
gtctctcccgcgttctgtctgtgcg

SEQ ID NO: 487872 - DNA, 25 bp, Rattus norvegicus
ggcctttggatcctgctgtctctcc

SEQ ID NO: 487873 - DNA, 25 bp, Rattus norvegicus
tctctctgaccctggcctttggatc

SEQ ID NO: 487874 - DNA, 25 bp, Rattus norvegicus
cgtgactcccgtgcttctggatctc

SEQ ID NO: 487875 - DNA, 25 bp, Rattus norvegicus
tctggcttctttgcctctgggtttc

SEQ ID NO: 487876 - DNA, 25 bp, Rattus norvegicus
gtcttatgtttctgggtcggtcttc

SEQ ID NO: 487877 - DNA, 25 bp, Rattus norvegicus
atctgtgcccactcgctgtcttatg

SEQ ID NO: 487878 - DNA, 25 bp, Rattus norvegicus
tggtgttaaacggaaccgacatctg

SEQ ID NO: 487879 - DNA, 25 bp, Rattus norvegicus
tgggttcgaacccatggaccttgcc

SEQ ID NO: 487880 - DNA, 25 bp, Rattus norvegicus
cttttcaggtggaccggagtgtcta

SEQ ID NO: 487881 - DNA, 25 bp, Rattus norvegicus
atctcgggtgctcgttttcttgctg

SEQ ID NO: 487882 - DNA, 25 bp, Rattus norvegicus
tggtccagaaacagacaatactgtg

SEQ ID NO: 487883 - DNA, 25 bp, Rattus norvegicus
ctgcctgaagctgtcgcagcgctga

SEQ ID NO: 487884 - DNA, 25 bp, Rattus norvegicus
aagtgcctgcctacgggatagactg

SEQ ID NO: 487885 - DNA, 25 bp, Rattus norvegicus
agcgctgagtcggtccctaccagct

SEQ ID NO: 487886 - DNA, 25 bp, Rattus norvegicus
tcatccggaaccgtgattggtcgcg

SEQ ID NO: 487887 - DNA, 25 bp, Rattus norvegicus
cagggccaccggtcattgggcctga

SEQ ID NO: 487888 - DNA, 25 bp, Rattus norvegicus
tcttccgccgcgcaaagtttgatcg

SEQ ID NO: 487889 - DNA, 25 bp, Rattus norvegicus
accagaggcggtgaggctaccagaa

SEQ ID NO: 487890 - DNA, 25 bp, Rattus norvegicus
actttgcagggctcagctgcttctc

SEQ ID NO: 487891 - DNA, 25 bp, Rattus norvegicus
cagagacactcctttcgtggccggg

SEQ ID NO: 487892 - DNA, 25 bp, Rattus norvegicus
agccatattgctcgggcgcatgtgc

SEQ ID NO: 487893 - DNA, 25 bp, Rattus norvegicus
ccgtggttgctaaggaggttgctaa

SEQ ID NO: 487894 - DNA, 25 bp, Rattus norvegicus
ggttgctaagtcgaggtgctaattg

SEQ ID NO: 487895 - DNA, 25 bp, Rattus norvegicus
attggtgagttccaaagaaattagc

SEQ ID NO: 487896 - DNA, 25 bp, Rattus norvegicus
cgggatagactggtaggcactcaaa

SEQ ID NO: 487897 - DNA, 25 bp, Rattus norvegicus
ctatatgctgctgttggtgctgccc

SEQ ID NO: 487898 - DNA, 25 bp, Rattus norvegicus
cgtgctggagatcaagctctatttc

SEQ ID NO: 487899 - DNA, 25 bp, Rattus norvegicus
cggtgctcagtctcgccactgtcaa

SEQ ID NO: 487900 - DNA, 25 bp, Rattus norvegicus
tcgcaccgcagaagatgatgttgta

SEQ ID NO: 487901 - DNA, 25 bp, Rattus norvegicus
ggacatgcaggccaacctctgggaa

SEQ ID NO: 487902 - DNA, 25 bp, Rattus norvegicus
gatctgctggatctgctggacatgc

SEQ ID NO: 487903 - DNA, 25 bp, Rattus norvegicus
gcctcttctgggtggccttagatct

SEQ ID NO: 487904 - DNA, 25 bp, Rattus norvegicus
ttgtggcactagatcgcatggaata

SEQ ID NO: 487905 - DNA, 25 bp, Rattus norvegicus
tttcagaactacaaggcagcgcggc

SEQ ID NO: 487906 - DNA, 25 bp, Rattus norvegicus
ctggttcctctatatcttcgtgctg

SEQ ID NO: 487907 - DNA, 25 bp, Rattus norvegicus
tggctacgctatgatcctctggttc

SEQ ID NO: 487908 - DNA, 25 bp, Rattus norvegicus
accacgctggtgatcatgggcagta

SEQ ID NO: 487909 - DNA, 25 bp, Rattus norvegicus
ccgtcatggacgcatacctggtgga

SEQ ID NO: 487910 - DNA, 25 bp, Rattus norvegicus
aggcctgttcctcttgcttgtggca

SEQ ID NO: 487911 - DNA, 25 bp, Rattus norvegicus
gcggtaaagatgataggcttctgta

SEQ ID NO: 487912 - DNA, 25 bp, Rattus norvegicus
gtgtccggcatccacttatataaag

SEQ ID NO: 487913 - DNA, 25 bp, Rattus norvegicus
cggcatccacttatataaagcagag

SEQ ID NO: 487914 - DNA, 25 bp, Rattus norvegicus
acaacagctctgtgtccggcatcca

SEQ ID NO: 487915 - DNA, 25 bp, Rattus norvegicus
cacaatgtcctgtacacaacagctc

SEQ ID NO: 487916 - DNA, 25 bp, Rattus norvegicus
aatgagtcccttcccttaccacaat

SEQ ID NO: 487917 - DNA, 25 bp, Rattus norvegicus
caagggattagaaaatgagtccctt

SEQ ID NO: 487918 - DNA, 25 bp, Rattus norvegicus
gcacattccgtggtcgagagcggta

SEQ ID NO: 487919 - DNA, 25 bp, Rattus norvegicus
cattccgtggtcgagagcggtaaag

SEQ ID NO: 487920 - DNA, 25 bp, Rattus norvegicus
tgccagtgatgaccggcacattccg

SEQ ID NO: 487921 - DNA, 25 bp, Rattus norvegicus
aaccagctctcgctgggtactcaat

SEQ ID NO: 487922 - DNA, 25 bp, Rattus norvegicus
ctggaaaccagctctcgctgggtac

SEQ ID NO: 487923 - DNA, 25 bp, Rattus norvegicus
gtaaagatgataggcttctgtaccc

SEQ ID NO: 487924 - DNA, 25 bp, Rattus norvegicus
tatttggcctccacgcctctgtgaa

SEQ ID NO: 487925 - DNA, 25 bp, Rattus norvegicus
gccaatcaagttcaccgagcaaagg

SEQ ID NO: 487926 - DNA, 25 bp, Rattus norvegicus
gcggacctagcgtcctcgggtgccc

SEQ ID NO: 487927 - DNA, 25 bp, Rattus norvegicus
gtgagcgatggtcgctaggctgagc

SEQ ID NO: 487928 - DNA, 25 bp, Rattus norvegicus
ccggagagccatggagatggtgagc

SEQ ID NO: 487929 - DNA, 25 bp, Rattus norvegicus
acgaaatcacggtagccggagagcc

SEQ ID NO: 487930 - DNA, 25 bp, Rattus norvegicus
gctttacgaaatcacggtagccgga

SEQ ID NO: 487931 - DNA, 25 bp, Rattus norvegicus
cggtgctttacgaaatcacggtagc

SEQ ID NO: 487932 - DNA, 25 bp, Rattus norvegicus
cgtgatttccagcttttggaagccc

SEQ ID NO: 487933 - DNA, 25 bp, Rattus norvegicus
atgtaggcgtgatttccagcttttg

SEQ ID NO: 487934 - DNA, 25 bp, Rattus norvegicus
ctttgcgttggaaaatgtaggcgtg

SEQ ID NO: 487935 - DNA, 25 bp, Rattus norvegicus
cccgcgacctttgcgttggaaaatg

SEQ ID NO: 487936 - DNA, 25 bp, Rattus norvegicus
gggccttgacaatctcgcgagccca

SEQ ID NO: 487937 - DNA, 25 bp, Rattus norvegicus
aaaggggcgggccttgacaatctcg

SEQ ID NO: 487938 - DNA, 25 bp, Rattus norvegicus
atcaagttcaccgagcaaaggggcg

SEQ ID NO: 487939 - DNA, 25 bp, Rattus norvegicus
ggaccgctgggctcacctccggagt

SEQ ID NO: 487940 - DNA, 25 bp, Rattus norvegicus
ccagaagtggggtccaggttctcct

SEQ ID NO: 487941 - DNA, 25 bp, Rattus norvegicus
actggcacttttcctagtctcaccg

SEQ ID NO: 487942 - DNA, 25 bp, Rattus norvegicus
gctggactcactggcacttttccta

SEQ ID NO: 487943 - DNA, 25 bp, Rattus norvegicus
gatccctggactgctggactcactg

SEQ ID NO: 487944 - DNA, 25 bp, Rattus norvegicus
tgaagccttaccgatccctggactg

SEQ ID NO: 487945 - DNA, 25 bp, Rattus norvegicus
atgcgtcctactgaagccttaccga

SEQ ID NO: 487946 - DNA, 25 bp, Rattus norvegicus
gccagcggagacagtccagagcaga

SEQ ID NO: 487947 - DNA, 25 bp, Rattus norvegicus
gaggcgcatcctgcagtggaccgct

SEQ ID NO: 487948 - DNA, 25 bp, Rattus norvegicus
acctgctactgctggttgctggtgc

SEQ ID NO: 487949 - DNA, 25 bp, Rattus norvegicus
tggtgctgacctgctactgctggtt

SEQ ID NO: 487950 - DNA, 25 bp, Rattus norvegicus
cgataggcgcgagactgaggaaatc

SEQ ID NO: 487951 - DNA, 25 bp, Rattus norvegicus
gccgggacttgctaactggaaggca

SEQ ID NO: 487952 - DNA, 25 bp, Rattus norvegicus
acagtccagagcagaatgcgtccta

SEQ ID NO: 487953 - DNA, 25 bp, Rattus norvegicus
cccgcggctgttcccagtacgcttg

SEQ ID NO: 487954 - DNA, 25 bp, Rattus norvegicus
gtgtcttcagcccaacaggcgcggg

SEQ ID NO: 487955 - DNA, 25 bp, Rattus norvegicus
ccggaggaagacaagcccgccgtcg

SEQ ID NO: 487956 - DNA, 25 bp, Rattus norvegicus
ggaggaagacaagcccgccgtcgct

SEQ ID NO: 487957 - DNA, 25 bp, Rattus norvegicus
gtcgctcagctcgactagcctgcta

SEQ ID NO: 487958 - DNA, 25 bp, Rattus norvegicus
gctcagctcgactagcctgctaggg

SEQ ID NO: 487959 - DNA, 25 bp, Rattus norvegicus
gctcgactagcctgctagggcctgc

SEQ ID NO: 487960 - DNA, 25 bp, Rattus norvegicus
actagcctgctagggcctgccgcga

SEQ ID NO: 487961 - DNA, 25 bp, Rattus norvegicus
ggcgtccctgcctcctagcaacggg

SEQ ID NO: 487962 - DNA, 25 bp, Rattus norvegicus
gggcagccgcgtgtcttcagcccaa

SEQ ID NO: 487963 - DNA, 25 bp, Rattus norvegicus
acgggccgaagtcgctggcccagca

SEQ ID NO: 487964 - DNA, 25 bp, Rattus norvegicus
agccgcgtgtcttcagcccaacagg

SEQ ID NO: 487965 - DNA, 25 bp, Rattus norvegicus
ggccgaagtcgctggcccagcatgc

SEQ ID NO: 487966 - DNA, 25 bp, Rattus norvegicus
tagcaacgggccgaagtcgctggcc

SEQ ID NO: 487967 - DNA, 25 bp, Rattus norvegicus
tgcccaccctcttagagcgcagagg

SEQ ID NO: 487968 - DNA, 25 bp, Rattus norvegicus
cccttaaggaagagccgggcgcacg

SEQ ID NO: 487969 - DNA, 25 bp, Rattus norvegicus
ccgcccagattcttttcagcgtaga

SEQ ID NO: 487970 - DNA, 25 bp, Rattus norvegicus
cgggatcgggttagcgattgacatc

SEQ ID NO: 487971 - DNA, 25 bp, Rattus norvegicus
cccaggttcttttccgagggcgctg

SEQ ID NO: 487972 - DNA, 25 bp, Rattus norvegicus
gatgacaccctgcacacagtccatt

SEQ ID NO: 487973 - DNA, 25 bp, Rattus norvegicus
tagccgcgcaggaacactagagtcg

SEQ ID NO: 487974 - DNA, 25 bp, Rattus norvegicus
gtaacgaccggggaatagccgcgca

SEQ ID NO: 487975 - DNA, 25 bp, Rattus norvegicus
cagctgcccattcctggtgtaacga

SEQ ID NO: 487976 - DNA, 25 bp, Rattus norvegicus
cctcctacggagcaaagtccgggtg

SEQ ID NO: 487977 - DNA, 25 bp, Rattus norvegicus
gcgcacggtgattgtgtcaccaaaa

SEQ ID NO: 487978 - DNA, 25 bp, Rattus norvegicus
cctcggctacctgggattgagcttc

SEQ ID NO: 487979 - DNA, 25 bp, Rattus norvegicus
gcgcaccgtgatgacgtcgagtccc

SEQ ID NO: 487980 - DNA, 25 bp, Rattus norvegicus
atactagacactctcccggagacgc

SEQ ID NO: 487981 - DNA, 25 bp, Rattus norvegicus
gagttccgaaatcccgccaacagtg

SEQ ID NO: 487982 - DNA, 25 bp, Rattus norvegicus
cttcacctcagataaaagcacggtc

SEQ ID NO: 487983 - DNA, 25 bp, Rattus norvegicus
tagaacctctcagacgccgagcctt

SEQ ID NO: 487984 - DNA, 25 bp, Rattus norvegicus
catggactccactgccaagggaata

SEQ ID NO: 487985 - DNA, 25 bp, Rattus norvegicus
tgggcactgcgtccgaaacccggaa

SEQ ID NO: 487986 - DNA, 25 bp, Rattus norvegicus
taaaccatcactgaccgggagagtc

SEQ ID NO: 487987 - DNA, 25 bp, Rattus norvegicus
gctttgtcaggtgaggctctccttc

SEQ ID NO: 487988 - DNA, 25 bp, Rattus norvegicus
tgccctggcgaagtcaaaacattta

SEQ ID NO: 487989 - DNA, 25 bp, Rattus norvegicus
agacgagtacaaagactgccctggc

SEQ ID NO: 487990 - DNA, 25 bp, Rattus norvegicus
cggagcctggacagaatcctgaatt

SEQ ID NO: 487991 - DNA, 25 bp, Rattus norvegicus
ctttgcgtcatcagtacaaggcggg

SEQ ID NO: 487992 - DNA, 25 bp, Rattus norvegicus
cgtcagtccgccttacgtagctttg

SEQ ID NO: 487993 - DNA, 25 bp, Rattus norvegicus
aagcacggtcggagacgactcccga

SEQ ID NO: 487994 - DNA, 25 bp, Rattus norvegicus
cgcggcgcaacctggcccttttatt

SEQ ID NO: 487995 - DNA, 25 bp, Rattus norvegicus
gcacacaccgttcccaggccgccca

SEQ ID NO: 487996 - DNA, 25 bp, Rattus norvegicus
aacatgttgcgccacacatgcgcca

SEQ ID NO: 487997 - DNA, 25 bp, Rattus norvegicus
atgcgccacccaggcaccaagaata

SEQ ID NO: 487998 - DNA, 25 bp, Rattus norvegicus
cacccaggcaccaagaatacgcaga

SEQ ID NO: 487999 - DNA, 25 bp, Rattus norvegicus
ggcaccaagaatacgcagaacaatg

SEQ ID NO: 488000 - DNA, 25 bp, Rattus norvegicus
cacttactgagaacatgttgcgcca

SEQ ID NO: 488001 - DNA, 25 bp, Rattus norvegicus
tgcggctcaacccacttgtcaatca

SEQ ID NO: 488002 - DNA, 25 bp, Rattus norvegicus
tggaacatgcggctcaacccacttg

SEQ ID NO: 488003 - DNA, 25 bp, Rattus norvegicus
ccacgtgcccagcacttactgagaa

SEQ ID NO: 488004 - DNA, 25 bp, Rattus norvegicus
gtgcccagcacttactgagaacatg

SEQ ID NO: 488005 - DNA, 25 bp, Rattus norvegicus
cccagcacttactgagaacatgttg

SEQ ID NO: 488006 - DNA, 25 bp, Rattus norvegicus
ctgagaacatgttgcgccacacatg

SEQ ID NO: 488007 - DNA, 25 bp, Rattus norvegicus
cgtgcatgtgtgcagggtgtgattg

SEQ ID NO: 488008 - DNA, 25 bp, Rattus norvegicus
acgcagaacaatgcgtgcatgtgtg

SEQ ID NO: 488009 - DNA, 25 bp, Rattus norvegicus
gggctcgccacggaggatctcagct

SEQ ID NO: 488010 - DNA, 25 bp, Rattus norvegicus
ggatctcagctttgaacccgggttc

SEQ ID NO: 488011 - DNA, 25 bp, Rattus norvegicus
gcctggacagcgtcagatctcgtga

SEQ ID NO: 488012 - DNA, 25 bp, Rattus norvegicus
cctggccaaagagttgccggatatg

SEQ ID NO: 488013 - DNA, 25 bp, Rattus norvegicus
cgaagcgggaaacatggccagcagc

SEQ ID NO: 488014 - DNA, 25 bp, Rattus norvegicus
ccgccgcgttaccacagaaggtctg

SEQ ID NO: 488015 - DNA, 25 bp, Rattus norvegicus
gaaacacagtagcaaccgccgcgtt

SEQ ID NO: 488016 - DNA, 25 bp, Rattus norvegicus
aatctagtccgagcgcgggaaacca

SEQ ID NO: 488017 - DNA, 25 bp, Rattus norvegicus
tgagaagtaagtaggacccggtgtc

SEQ ID NO: 488018 - DNA, 25 bp, Rattus norvegicus
cggatactgtcgcaggtctcttgtc

SEQ ID NO: 488019 - DNA, 25 bp, Rattus norvegicus
cccggctgactaggaaggatcctag

SEQ ID NO: 488020 - DNA, 25 bp, Rattus norvegicus
atcctagaccaagacgcggggctcg

SEQ ID NO: 488021 - DNA, 25 bp, Rattus norvegicus
gcgcgggtgtgtttgaatctagtcc

SEQ ID NO: 488022 - DNA, 25 bp, Rattus norvegicus
gttcactaggtagaaccgcagacta

SEQ ID NO: 488023 - DNA, 25 bp, Rattus norvegicus
tgctctcgtgtttcctacgtgtgtc

SEQ ID NO: 488024 - DNA, 25 bp, Rattus norvegicus
tgcctgagcgcgcatggctgacaga

SEQ ID NO: 488025 - DNA, 25 bp, Rattus norvegicus
tatgagccctgcctgctctcgtgtt

SEQ ID NO: 488026 - DNA, 25 bp, Rattus norvegicus
acgctttgcgcgtgtctatgagccc

SEQ ID NO: 488027 - DNA, 25 bp, Rattus norvegicus
cccgagtgtccacgctttgcgcgtg

SEQ ID NO: 488028 - DNA, 25 bp, Rattus norvegicus
ctgggacagctcaaccatatggttg

SEQ ID NO: 488029 - DNA, 25 bp, Rattus norvegicus
agggacctgggacagctcaaccata

SEQ ID NO: 488030 - DNA, 25 bp, Rattus norvegicus
tcctgcgtcagggaatagggacctg

SEQ ID NO: 488031 - DNA, 25 bp, Rattus norvegicus
ccctttggctatgggctcctgcgtc

SEQ ID NO: 488032 - DNA, 25 bp, Rattus norvegicus
tggggctaccgctcccgcttttgct

SEQ ID NO: 488033 - DNA, 25 bp, Rattus norvegicus
cgcgcggccatggactgagcgccaa

SEQ ID NO: 488034 - DNA, 25 bp, Rattus norvegicus
ggcaccgcctcgctaaatccctatc

SEQ ID NO: 488035 - DNA, 25 bp, Rattus norvegicus
agcgccgcaaaaggagctggcaccg

SEQ ID NO: 488036 - DNA, 25 bp, Rattus norvegicus
gtttcctacgtgtgtccgtgcgctc

SEQ ID NO: 488037 - DNA, 25 bp, Rattus norvegicus
ccgctcgtcagtggctccaatgcag

SEQ ID NO: 488038 - DNA, 25 bp, Rattus norvegicus
ttgcgatgatggcgttgtcgccagc

SEQ ID NO: 488039 - DNA, 25 bp, Rattus norvegicus
acatcgctatagcaaccggaggctg

SEQ ID NO: 488040 - DNA, 25 bp, Rattus norvegicus
atagcaaccggaggctggaccacga

SEQ ID NO: 488041 - DNA, 25 bp, Rattus norvegicus
ctggaccacgatccgcgctgctgtt

SEQ ID NO: 488042 - DNA, 25 bp, Rattus norvegicus
gccgcgccgacaggcctcgcagaac

SEQ ID NO: 488043 - DNA, 25 bp, Rattus norvegicus
tgcaccctctggctccgagcgaaag

SEQ ID NO: 488044 - DNA, 25 bp, Rattus norvegicus
agcgaaagctaaggcgccgccgctg

SEQ ID NO: 488045 - DNA, 25 bp, Rattus norvegicus
ggacgcgcggcacctttgtttccac

SEQ ID NO: 488046 - DNA, 25 bp, Rattus norvegicus
ttccacccgcctcctgagaagtttg

SEQ ID NO: 488047 - DNA, 25 bp, Rattus norvegicus
ccgcctcctgagaagtttgtggtca

SEQ ID NO: 488048 - DNA, 25 bp, Rattus norvegicus
cctcctgagaagtttgtggtcagaa

SEQ ID NO: 488049 - DNA, 25 bp, Rattus norvegicus
tcagaagcagcagaatggccccgct

SEQ ID NO: 488050 - DNA, 25 bp, Rattus norvegicus
ctccaatgcagggaagcggttggtt

SEQ ID NO: 488051 - DNA, 25 bp, Rattus norvegicus
gctctgtcaagatgcagccgccgtg

SEQ ID NO: 488052 - DNA, 25 bp, Rattus norvegicus
tcagatgcacctgagcgaaccgggg

SEQ ID NO: 488053 - DNA, 25 bp, Rattus norvegicus
ccctcggtctgcgacggccaccctt

SEQ ID NO: 488054 - DNA, 25 bp, Rattus norvegicus
actcctctggagagggactcgggac

SEQ ID NO: 488055 - DNA, 25 bp, Rattus norvegicus
cccgccacgccgtggctggaagttg

SEQ ID NO: 488056 - DNA, 25 bp, Rattus norvegicus
gctcacgctgcggaggaagcggagc

SEQ ID NO: 488057 - DNA, 25 bp, Rattus norvegicus
gcgccaatgggcagcggctggtagc

SEQ ID NO: 488058 - DNA, 25 bp, Rattus norvegicus
tgtcaagatgcagccgccgtgcgag

SEQ ID NO: 488059 - DNA, 25 bp, Rattus norvegicus
cgcccgagccgcagtctcgccctct

SEQ ID NO: 488060 - DNA, 25 bp, Rattus norvegicus
cggtgggctctgtcaagatgcagcc

SEQ ID NO: 488061 - DNA, 25 bp, Rattus norvegicus
caaccgtcagggcatcaggatggcg

SEQ ID NO: 488062 - DNA, 25 bp, Rattus norvegicus
cgccgcaaccgtcagggcatcagga

SEQ ID NO: 488063 - DNA, 25 bp, Rattus norvegicus
tctcgctgccttgcgaaggcgcgga

SEQ ID NO: 488064 - DNA, 25 bp, Rattus norvegicus
tcagggacctgcctgcgctgctgcg

SEQ ID NO: 488065 - DNA, 25 bp, Rattus norvegicus
cagcttgattctcccgcgcgaaact

SEQ ID NO: 488066 - DNA, 25 bp, Rattus norvegicus
gcgcgaaactgagcggactgctcca

SEQ ID NO: 488067 - DNA, 25 bp, Rattus norvegicus
cgccggccgtaaggctaggaccgca

SEQ ID NO: 488068 - DNA, 25 bp, Rattus norvegicus
tcagtgcgctgctccacggcaaact

SEQ ID NO: 488069 - DNA, 25 bp, Rattus norvegicus
gaagatggagctggccacgcgctcc

SEQ ID NO: 488070 - DNA, 25 bp, Rattus norvegicus
cgctcccaggtgagggttctcccag

SEQ ID NO: 488071 - DNA, 25 bp, Rattus norvegicus
gctgctttctgcaggtccggctctt

SEQ ID NO: 488072 - DNA, 25 bp, Rattus norvegicus
gctgctgtgaacttaggtccggtag

SEQ ID NO: 488073 - DNA, 25 bp, Rattus norvegicus
tccggtagttgtgctcgtggctccc

SEQ ID NO: 488074 - DNA, 25 bp, Rattus norvegicus
gctcaggtgaggatgccaattctgg

SEQ ID NO: 488075 - DNA, 25 bp, Rattus norvegicus
tgccaattctggagctgcaggccgg

SEQ ID NO: 488076 - DNA, 25 bp, Rattus norvegicus
gggagggcagcgagcaataacaacc

SEQ ID NO: 488077 - DNA, 25 bp, Rattus norvegicus
ccaggtacccggagctcagaagcgc

SEQ ID NO: 488078 - DNA, 25 bp, Rattus norvegicus
gcgcaaccaaacacgcggaccaatg

SEQ ID NO: 488079 - DNA, 25 bp, Rattus norvegicus
ggggcgacactaaacaccaggctag

SEQ ID NO: 488080 - DNA, 25 bp, Rattus norvegicus
agcagttctgactgcagagccagga

SEQ ID NO: 488081 - DNA, 25 bp, Rattus norvegicus
ctgtgccacagaggcgatctcccga

SEQ ID NO: 488082 - DNA, 25 bp, Rattus norvegicus
aggattctcggagtcctgtgccaca

SEQ ID NO: 488083 - DNA, 25 bp, Rattus norvegicus
ggctgccatctcgtacctagctaga

SEQ ID NO: 488084 - DNA, 25 bp, Rattus norvegicus
cttcttcctgggctgccatctcgta

SEQ ID NO: 488085 - DNA, 25 bp, Rattus norvegicus
aaaacgttgcgctctccgtgcagcc

SEQ ID NO: 488086 - DNA, 25 bp, Rattus norvegicus
gggtctacggcaaaacgttgcgctc

SEQ ID NO: 488087 - DNA, 25 bp, Rattus norvegicus
tgcagacggcctcccaggaagcgca

SEQ ID NO: 488088 - DNA, 25 bp, Rattus norvegicus
ggtggtcctcgctctccagatattc

SEQ ID NO: 488089 - DNA, 25 bp, Rattus norvegicus
gaaagtctcctaggacctgccggtg

SEQ ID NO: 488090 - DNA, 25 bp, Rattus norvegicus
ggaccactgctctccagaaagtctc

SEQ ID NO: 488091 - DNA, 25 bp, Rattus norvegicus
ggactgcatcgcgtcccgttgccag

SEQ ID NO: 488092 - DNA, 25 bp, Rattus norvegicus
aacaccaggctagcaggaccactgc

SEQ ID NO: 488093 - DNA, 25 bp, Rattus norvegicus
acaggacaaaccctctcagagacac

SEQ ID NO: 488094 - DNA, 25 bp, Rattus norvegicus
gaatacgtaccgctcatcccgcatt

SEQ ID NO: 488095 - DNA, 25 bp, Rattus norvegicus
atacgtaccgctcatcccgcattaa

SEQ ID NO: 488096 - DNA, 25 bp, Rattus norvegicus
cgctcatcccgcattaacaggacaa

SEQ ID NO: 488097 - DNA, 25 bp, Rattus norvegicus
gctcatcccgcattaacaggacaaa

SEQ ID NO: 488098 - DNA, 25 bp, Rattus norvegicus
tcatcccgcattaacaggacaaacc

SEQ ID NO: 488099 - DNA, 25 bp, Rattus norvegicus
atcccgcattaacaggacaaaccct

SEQ ID NO: 488100 - DNA, 25 bp, Rattus norvegicus
cgcattaacaggacaaaccctctca

SEQ ID NO: 488101 - DNA, 25 bp, Rattus norvegicus
ttaacaggacaaaccctctcagaga

SEQ ID NO: 488102 - DNA, 25 bp, Rattus norvegicus
ggacaaaccctctcagagacactgg

SEQ ID NO: 488103 - DNA, 25 bp, Rattus norvegicus
accctctcagagacactgggataga

SEQ ID NO: 488104 - DNA, 25 bp, Rattus norvegicus
tctcagagacactgggatagaggtg

SEQ ID NO: 488105 - DNA, 25 bp, Rattus norvegicus
ggagaatacgtaccgctcatcccgc

SEQ ID NO: 488106 - DNA, 25 bp, Rattus norvegicus
acaaaccctctcagagacactggga

SEQ ID NO: 488107 - DNA, 25 bp, Rattus norvegicus
cctctcggtgagctagctgcggttt

SEQ ID NO: 488108 - DNA, 25 bp, Rattus norvegicus
tcgcccggctttctttactctctta

SEQ ID NO: 488109 - DNA, 25 bp, Rattus norvegicus
tgaagctgacatggggtacaccctc

SEQ ID NO: 488110 - DNA, 25 bp, Rattus norvegicus
cctcggggtttgaatgaagctgaca

SEQ ID NO: 488111 - DNA, 25 bp, Rattus norvegicus
gctatcggattgaggcaccgccttc

SEQ ID NO: 488112 - DNA, 25 bp, Rattus norvegicus
ggtcttgtagtttctgtcagctatc

SEQ ID NO: 488113 - DNA, 25 bp, Rattus norvegicus
ccgcaaagcctttcgggtcttgtag

SEQ ID NO: 488114 - DNA, 25 bp, Rattus norvegicus
tggctttcctaaggcgcatccggac

SEQ ID NO: 488115 - DNA, 25 bp, Rattus norvegicus
tcggcgtgagcatggctttcctaag

SEQ ID NO: 488116 - DNA, 25 bp, Rattus norvegicus
ctcaaaaacgcgtcgcagcatcttg

SEQ ID NO: 488117 - DNA, 25 bp, Rattus norvegicus
aacttgttgtctcaggatatcccgc

SEQ ID NO: 488118 - DNA, 25 bp, Rattus norvegicus
gcccttcatacagccaaacttgttg

SEQ ID NO: 488119 - DNA, 25 bp, Rattus norvegicus
tctttactctcttagctcgcccggg

SEQ ID NO: 488120 - DNA, 25 bp, Rattus norvegicus
tttgctgccggcaggcccttcatac

SEQ ID NO: 488121 - DNA, 25 bp, Rattus norvegicus
gctgcaatctgacccggcggcgacc

SEQ ID NO: 488122 - DNA, 25 bp, Rattus norvegicus
ttccataggacttccgccggcttta

SEQ ID NO: 488123 - DNA, 25 bp, Rattus norvegicus
ctggagctgtcacacttccatagga

SEQ ID NO: 488124 - DNA, 25 bp, Rattus norvegicus
gagcagccctaaagccgggaagccc

SEQ ID NO: 488125 - DNA, 25 bp, Rattus norvegicus
tgtattcgcggagcagccctaaagc

SEQ ID NO: 488126 - DNA, 25 bp, Rattus norvegicus
gacctgtgtattcgcggagcagccc

SEQ ID NO: 488127 - DNA, 25 bp, Rattus norvegicus
aaagagagcactgctggggacctgt

SEQ ID NO: 488128 - DNA, 25 bp, Rattus norvegicus
gctaggccggtcagcaggaaagaga

SEQ ID NO: 488129 - DNA, 25 bp, Rattus norvegicus
cgcaacaagcaacccggggcgtgct

SEQ ID NO: 488130 - DNA, 25 bp, Rattus norvegicus
tggctaccgtgtccgcacagcgcgg

SEQ ID NO: 488131 - DNA, 25 bp, Rattus norvegicus
ttggcgagagccagcacagcccgca

SEQ ID NO: 488132 - DNA, 25 bp, Rattus norvegicus
gaggagcagcttgctgacccgcgcc

SEQ ID NO: 488133 - DNA, 25 bp, Rattus norvegicus
ttcccgcccgcagggtgtgcgagct

SEQ ID NO: 488134 - DNA, 25 bp, Rattus norvegicus
cgcctcccggacgtcgcgcagagca

SEQ ID NO: 488135 - DNA, 25 bp, Rattus norvegicus
caggcctccgaaccgagaagagcta

SEQ ID NO: 488136 - DNA, 25 bp, Rattus norvegicus
gcccacgaagcccaataggcttgag

SEQ ID NO: 488137 - DNA, 25 bp, Rattus norvegicus
cccgaggcatacagtcagttgtgtg

SEQ ID NO: 488138 - DNA, 25 bp, Rattus norvegicus
taggcgctcaggaaggaacaccctt

SEQ ID NO: 488139 - DNA, 25 bp, Rattus norvegicus
ccttaaaaggtgttggtctgcattc

SEQ ID NO: 488140 - DNA, 25 bp, Rattus norvegicus
tttctgagtgggtcactagccaccc

SEQ ID NO: 488141 - DNA, 25 bp, Rattus norvegicus
gggaaaagatccactgccgagcgca

SEQ ID NO: 488142 - DNA, 25 bp, Rattus norvegicus
tgccgagcgcaagctgcgtccttct

SEQ ID NO: 488143 - DNA, 25 bp, Rattus norvegicus
ggcctccgtggacaagttcgaccaa

SEQ ID NO: 488144 - DNA, 25 bp, Rattus norvegicus
cgcagctcggcagcatttgctccag

SEQ ID NO: 488145 - DNA, 25 bp, Rattus norvegicus
ccaatcgcagagtgtcctgggccca

SEQ ID NO: 488146 - DNA, 25 bp, Rattus norvegicus
tagaagggcccgagcgcgtgcatct

SEQ ID NO: 488147 - DNA, 25 bp, Rattus norvegicus
gcgtccttctgagcggagcgcgctc

SEQ ID NO: 488148 - DNA, 25 bp, Rattus norvegicus
ctgcattcgttctgtgcgtttctga

SEQ ID NO: 488149 - DNA, 25 bp, Rattus norvegicus
gagggactcagctaccttacccact

SEQ ID NO: 488150 - DNA, 25 bp, Rattus norvegicus
ttgtcacacatcctctcggtgcttg

SEQ ID NO: 488151 - DNA, 25 bp, Rattus norvegicus
ctgcccttactaggccacgtttttg

SEQ ID NO: 488152 - DNA, 25 bp, Rattus norvegicus
gccacgtttttgtgaccctgcccag

SEQ ID NO: 488153 - DNA, 25 bp, Rattus norvegicus
ttcacttcgacgtgggtcacactcg

SEQ ID NO: 488154 - DNA, 25 bp, Rattus norvegicus
ggattgaacatactgtcgctcctga

SEQ ID NO: 488155 - DNA, 25 bp, Rattus norvegicus
gtcacactcgcgatcactttacacg

SEQ ID NO: 488156 - DNA, 25 bp, Rattus norvegicus
ctccgcggcacttcaaagccggaga

SEQ ID NO: 488157 - DNA, 25 bp, Rattus norvegicus
acgctctctacatggttcacttcga

SEQ ID NO: 488158 - DNA, 25 bp, Rattus norvegicus
gctcctgactccctaagaaagaggg

SEQ ID NO: 488159 - DNA, 25 bp, Rattus norvegicus
tccgcacccgggattgaacatactg

SEQ ID NO: 488160 - DNA, 25 bp, Rattus norvegicus
tattgtattgtttcgattccctacc

SEQ ID NO: 488161 - DNA, 25 bp, Rattus norvegicus
tacgcacgtacactttattgtattg

SEQ ID NO: 488162 - DNA, 25 bp, Rattus norvegicus
gccaaatctcttacgcacgtacact

SEQ ID NO: 488163 - DNA, 25 bp, Rattus norvegicus
gcatgagctatccacgcaataccca

SEQ ID NO: 488164 - DNA, 25 bp, Rattus norvegicus
gcgcggcacgcatgagctatccacg

SEQ ID NO: 488165 - DNA, 25 bp, Rattus norvegicus
atgcttcccactcgcaaccacgtgc

SEQ ID NO: 488166 - DNA, 25 bp, Rattus norvegicus
gcaatacccactcacttttcacgtg

SEQ ID NO: 488167 - DNA, 25 bp, Rattus norvegicus
ttttcacgtgacatgcacgcgccgc

SEQ ID NO: 488168 - DNA, 25 bp, Rattus norvegicus
acccactcacttttcacgtgacatg

SEQ ID NO: 488169 - DNA, 25 bp, Rattus norvegicus
gcacgcatgagctatccacgcaata

SEQ ID NO: 488170 - DNA, 25 bp, Rattus norvegicus
aggggccaattttgcgctgcccacc

SEQ ID NO: 488171 - DNA, 25 bp, Rattus norvegicus
gccaatcacgagctgcccacgcgca

SEQ ID NO: 488172 - DNA, 25 bp, Rattus norvegicus
acgcgcagcccacactccgtgcaca

SEQ ID NO: 488173 - DNA, 25 bp, Rattus norvegicus
gtgcacacaccagtcacgcatcatg

SEQ ID NO: 488174 - DNA, 25 bp, Rattus norvegicus
gtcacgcatcatgcccatgcttccc

SEQ ID NO: 488175 - DNA, 25 bp, Rattus norvegicus
aaccacgtgccaaacatgcgccaaa

SEQ ID NO: 488176 - DNA, 25 bp, Rattus norvegicus
cacgcgccgcccaggggccaatttt

SEQ ID NO: 488177 - DNA, 25 bp, Rattus norvegicus
actcggccttcagtagtggtgcctc

SEQ ID NO: 488178 - DNA, 25 bp, Rattus norvegicus
ctgttctgcggtaagcgctttacgc

SEQ ID NO: 488179 - DNA, 25 bp, Rattus norvegicus
ggctgcatagctgccacatcccagg

SEQ ID NO: 488180 - DNA, 25 bp, Rattus norvegicus
agcctgcgtcgcaaagggctgcata

SEQ ID NO: 488181 - DNA, 25 bp, Rattus norvegicus
tattgcccggctcgtacccggattc

SEQ ID NO: 488182 - DNA, 25 bp, Rattus norvegicus
tggacggtttcaagcccgtattgcc

SEQ ID NO: 488183 - DNA, 25 bp, Rattus norvegicus
gattactccggcctgagccactcgg

SEQ ID NO: 488184 - DNA, 25 bp, Rattus norvegicus
caggacagcacctcatggacggttt

SEQ ID NO: 488185 - DNA, 25 bp, Rattus norvegicus
tggacggactgcaaggcatctaccc

SEQ ID NO: 488186 - DNA, 25 bp, Rattus norvegicus
tgggaggctacaactcggattactc

SEQ ID NO: 488187 - DNA, 25 bp, Rattus norvegicus
cccgtatgagtcgtggttcaagccc

SEQ ID NO: 488188 - DNA, 25 bp, Rattus norvegicus
atctccaaggtgcacacgtcggtgg

SEQ ID NO: 488189 - DNA, 25 bp, Rattus norvegicus
catcagccggtgttcatctccaagg

SEQ ID NO: 488190 - DNA, 25 bp, Rattus norvegicus
gccctttgccaacgactactctgtg

SEQ ID NO: 488191 - DNA, 25 bp, Rattus norvegicus
cagctgatgcgttctgggctgtacc

SEQ ID NO: 488192 - DNA, 25 bp, Rattus norvegicus
atgcgttctgggctgtacccggaga

SEQ ID NO: 488193 - DNA, 25 bp, Rattus norvegicus
ccacgcacctcgctgggagggagtt

SEQ ID NO: 488194 - DNA, 25 bp, Rattus norvegicus
aaggggacgttccacgcacctcgct

SEQ ID NO: 488195 - DNA, 25 bp, Rattus norvegicus
cctactgagctggaaggggacgttc

SEQ ID NO: 488196 - DNA, 25 bp, Rattus norvegicus
acagggcatcccagttgcctactga

SEQ ID NO: 488197 - DNA, 25 bp, Rattus norvegicus
acccgcaggcaaagaacagggcatc

SEQ ID NO: 488198 - DNA, 25 bp, Rattus norvegicus
agggctcccagctttcgggtgtctg

SEQ ID NO: 488199 - DNA, 25 bp, Rattus norvegicus
atggggtgctctagttctgtggccc

SEQ ID NO: 488200 - DNA, 25 bp, Rattus norvegicus
ccagaaccctggcagctgatgcgtt

SEQ ID NO: 488201 - DNA, 25 bp, Rattus norvegicus
ggctcaggcgtctggccacccagaa

SEQ ID NO: 488202 - DNA, 25 bp, Rattus norvegicus
ttgcgtacccttgttctttctcgga

SEQ ID NO: 488203 - DNA, 25 bp, Rattus norvegicus
tcgaggcggcaacgtcccgattggc

SEQ ID NO: 488204 - DNA, 25 bp, Rattus norvegicus
ctttctcggactctgtcggctcagg

SEQ ID NO: 488205 - DNA, 25 bp, Rattus norvegicus
cggttcctccgccaggaaggagaag

SEQ ID NO: 488206 - DNA, 25 bp, Rattus norvegicus
cagagcctggctcctccgtaaaagc

SEQ ID NO: 488207 - DNA, 25 bp, Rattus norvegicus
gggttgcgagctgctcccctttatc

SEQ ID NO: 488208 - DNA, 25 bp, Rattus norvegicus
ccctttatcgctaggaaaccaagct

SEQ ID NO: 488209 - DNA, 25 bp, Rattus norvegicus
gtaaaagcttctggactcccaccca

SEQ ID NO: 488210 - DNA, 25 bp, Rattus norvegicus
cagggtttgctctccagagcctggc

SEQ ID NO: 488211 - DNA, 25 bp, Rattus norvegicus
tggctcctccgtaaaagcttctgga

SEQ ID NO: 488212 - DNA, 25 bp, Rattus norvegicus
agctcggttcctccgccaggaagga

SEQ ID NO: 488213 - DNA, 25 bp, Rattus norvegicus
cgcagagcagagacgcggcagaact

SEQ ID NO: 488214 - DNA, 25 bp, Rattus norvegicus
agagacgcggcagaactctggactg

SEQ ID NO: 488215 - DNA, 25 bp, Rattus norvegicus
agaactctggactgcgcctccgaca

SEQ ID NO: 488216 - DNA, 25 bp, Rattus norvegicus
cgacaccgacaaggctcagatccag

SEQ ID NO: 488217 - DNA, 25 bp, Rattus norvegicus
caaggctcagatccagggtttgctc

SEQ ID NO: 488218 - DNA, 25 bp, Rattus norvegicus
tcgctaggaaaccaagctcggttcc

SEQ ID NO: 488219 - DNA, 25 bp, Rattus norvegicus
gcggctccgacttggcgttccaagt

SEQ ID NO: 488220 - DNA, 25 bp, Rattus norvegicus
ggccacagctggtccttccagggta

SEQ ID NO: 488221 - DNA, 25 bp, Rattus norvegicus
tccttccagggtactggagtctctg

SEQ ID NO: 488222 - DNA, 25 bp, Rattus norvegicus
gtactggagtctctgccttagcccg

SEQ ID NO: 488223 - DNA, 25 bp, Rattus norvegicus
gcagcgcgactgtccctggagccgt

SEQ ID NO: 488224 - DNA, 25 bp, Rattus norvegicus
tagctcccgggaggccgctatgcac

SEQ ID NO: 488225 - DNA, 25 bp, Rattus norvegicus
tcgcgttcgggctcctgctcgcggt

SEQ ID NO: 488226 - DNA, 25 bp, Rattus norvegicus
tcctgctcgcggtggtcacggcgac

SEQ ID NO: 488227 - DNA, 25 bp, Rattus norvegicus
acgctggccgcagctcagaaaggtg

SEQ ID NO: 488228 - DNA, 25 bp, Rattus norvegicus
ttggcgttccaagtcccaaagcttg

SEQ ID NO: 488229 - DNA, 25 bp, Rattus norvegicus
gtcccaaagcttgggccttggtcgc

SEQ ID NO: 488230 - DNA, 25 bp, Rattus norvegicus
tcgctgcgacttgtcggtcagtccc

SEQ ID NO: 488231 - DNA, 25 bp, Rattus norvegicus
cgctatgcacctgcgcgacggaggc

SEQ ID NO: 488232 - DNA, 25 bp, Rattus norvegicus
cttggtcgctgcgacttgtcggtca

SEQ ID NO: 488233 - DNA, 25 bp, Rattus norvegicus
cgcgctatgctcgaacctcactttg

SEQ ID NO: 488234 - DNA, 25 bp, Rattus norvegicus
tcagcccgacgggtcgggagaacaa

SEQ ID NO: 488235 - DNA, 25 bp, Rattus norvegicus
cttcacctgcgacacaagtcaaact

SEQ ID NO: 488236 - DNA, 25 bp, Rattus norvegicus
cgactacttacagaggcgggctcgg

SEQ ID NO: 488237 - DNA, 25 bp, Rattus norvegicus
cgcgaacttttttcggtgtctgctc

SEQ ID NO: 488238 - DNA, 25 bp, Rattus norvegicus
caggactcgaaggacgcgctatgct

SEQ ID NO: 488239 - DNA, 25 bp, Rattus norvegicus
tcactttgctgtccgctaggcgatg

SEQ ID NO: 488240 - DNA, 25 bp, Rattus norvegicus
gctccctcaagcgactacttacaga

SEQ ID NO: 488241 - DNA, 25 bp, Rattus norvegicus
ccagagtggaggaccttcctttcca

SEQ ID NO: 488242 - DNA, 25 bp, Rattus norvegicus
caaagttgtcccttcggcgttctcg

SEQ ID NO: 488243 - DNA, 25 bp, Rattus norvegicus
cgttctcggtggcttccgtcacttc

SEQ ID NO: 488244 - DNA, 25 bp, Rattus norvegicus
cgagctatacagcaacagcccttca

SEQ ID NO: 488245 - DNA, 25 bp, Rattus norvegicus
caaacttggaaacgctgcttgcacg

SEQ ID NO: 488246 - DNA, 25 bp, Rattus norvegicus
ctcggctgttctggagaaagtcggc

SEQ ID NO: 488247 - DNA, 25 bp, Rattus norvegicus
tgcatgctgattgggcgagcccacc

SEQ ID NO: 488248 - DNA, 25 bp, Rattus norvegicus
acccaccaaggagcagcgctgcatg

SEQ ID NO: 488249 - DNA, 25 bp, Rattus norvegicus
ttgcgcatctgcaggtcagcgtgca

SEQ ID NO: 488250 - DNA, 25 bp, Rattus norvegicus
tgcaagcgtgcaggcaagtcaaacg

SEQ ID NO: 488251 - DNA, 25 bp, Rattus norvegicus
catgcgcagtagctagggtgctaga

SEQ ID NO: 488252 - DNA, 25 bp, Rattus norvegicus
ccttgctcggttatgattggctatt

SEQ ID NO: 488253 - DNA, 25 bp, Rattus norvegicus
gcggacctgaaagcgtagcctctga

SEQ ID NO: 488254 - DNA, 25 bp, Rattus norvegicus
gtccggctgtactctcttgggttgt

SEQ ID NO: 488255 - DNA, 25 bp, Rattus norvegicus
cgtttcggaaatggcggtgcagcct

SEQ ID NO: 488256 - DNA, 25 bp, Rattus norvegicus
tcgtacgcttctttgagggcatgcc

SEQ ID NO: 488257 - DNA, 25 bp, Rattus norvegicus
gcgacttttacaccgcgcacggcga

SEQ ID NO: 488258 - DNA, 25 bp, Rattus norvegicus
gcccgcgaggtgttcaagacccaag

SEQ ID NO: 488259 - DNA, 25 bp, Rattus norvegicus
gacccaaggcgtgatcaagtacatg

SEQ ID NO: 488260 - DNA, 25 bp, Rattus norvegicus
ttggctattgcggtagactcccacc

SEQ ID NO: 488261 - DNA, 25 bp, Rattus norvegicus
cccaggatgagcagcacgtgataca

SEQ ID NO: 488262 - DNA, 25 bp, Rattus norvegicus
gctcagcttgcgcagcatccagttg

SEQ ID NO: 488263 - DNA, 25 bp, Rattus norvegicus
aggtcgcgcattgagatgagctctc

SEQ ID NO: 488264 - DNA, 25 bp, Rattus norvegicus
agcgacaccttgttggacgccgtga

SEQ ID NO: 488265 - DNA, 25 bp, Rattus norvegicus
ttctgcagcagtgccagcgacacct

SEQ ID NO: 488266 - DNA, 25 bp, Rattus norvegicus
gccgtctcggaaagctgcttctgca

SEQ ID NO: 488267 - DNA, 25 bp, Rattus norvegicus
cgcctttgctgaccgacttaagtta

SEQ ID NO: 488268 - DNA, 25 bp, Rattus norvegicus
tcagcgaaggcctgtggcacatgca

SEQ ID NO: 488269 - DNA, 25 bp, Rattus norvegicus
cctgcggggataacagccagagtca

SEQ ID NO: 488270 - DNA, 25 bp, Rattus norvegicus
acgtgatacaccgagggcttccagc

SEQ ID NO: 488271 - DNA, 25 bp, Rattus norvegicus
tagatgcagcacacgccgagcagga

SEQ ID NO: 488272 - DNA, 25 bp, Rattus norvegicus
cctccacgctggtgtacatggccga

SEQ ID NO: 488273 - DNA, 25 bp, Rattus norvegicus
agcagaagtagagcgagtccacgta

SEQ ID NO: 488274 - DNA, 25 bp, Rattus norvegicus
tccgtaggcgatgaggaaggccttc

SEQ ID NO: 488275 - DNA, 25 bp, Rattus norvegicus
tcctctggagcgtcccatgaggcta

SEQ ID NO: 488276 - DNA, 25 bp, Rattus norvegicus
ccctgtaaatgagctggtggcgtcg

SEQ ID NO: 488277 - DNA, 25 bp, Rattus norvegicus
ttcctttccgggctaccgctgagga

SEQ ID NO: 488278 - DNA, 25 bp, Rattus norvegicus
gttctggccgcaacagtgcgtccca

SEQ ID NO: 488279 - DNA, 25 bp, Rattus norvegicus
tgccagctcgctaggaaaccacgtc

SEQ ID NO: 488280 - DNA, 25 bp, Rattus norvegicus
ctgctcttggtctccggaacgtctt

SEQ ID NO: 488281 - DNA, 25 bp, Rattus norvegicus
tccggacgcctaggatcggaacacg

SEQ ID NO: 488282 - DNA, 25 bp, Rattus norvegicus
ttcaacttggtgctttgaggtctca

SEQ ID NO: 488283 - DNA, 25 bp, Rattus norvegicus
cccatgaggctactggggatcggtc

SEQ ID NO: 488284 - DNA, 25 bp, Rattus norvegicus
gcatcgggagccaaacctgactttt

SEQ ID NO: 488285 - DNA, 25 bp, Rattus norvegicus
cctgacttttgattctccggctcta

SEQ ID NO: 488286 - DNA, 25 bp, Rattus norvegicus
tcaagccaccgggaaactttgttca

SEQ ID NO: 488287 - DNA, 25 bp, Rattus norvegicus
ggccgcatactccactctggacagg

SEQ ID NO: 488288 - DNA, 25 bp, Rattus norvegicus
ggcttccgagcctcagagccgagtc

SEQ ID NO: 488289 - DNA, 25 bp, Rattus norvegicus
ctgggacaaagacaccgaaacctag

SEQ ID NO: 488290 - DNA, 25 bp, Rattus norvegicus
cttggatatcgtgggtggccgaacc

SEQ ID NO: 488291 - DNA, 25 bp, Rattus norvegicus
ctcctaggcttggatatcgtgggtg

SEQ ID NO: 488292 - DNA, 25 bp, Rattus norvegicus
cactcctaggcttggatatcgtggg

SEQ ID NO: 488293 - DNA, 25 bp, Rattus norvegicus
cgcactcctaggcttggatatcgtg

SEQ ID NO: 488294 - DNA, 25 bp, Rattus norvegicus
tctcgcactcctaggcttggatatc

SEQ ID NO: 488295 - DNA, 25 bp, Rattus norvegicus
ggtctcgcactcctaggcttggata

SEQ ID NO: 488296 - DNA, 25 bp, Rattus norvegicus
ctggtctcgcactcctaggcttgga

SEQ ID NO: 488297 - DNA, 25 bp, Rattus norvegicus
tcctggtctcgcactcctaggcttg

SEQ ID NO: 488298 - DNA, 25 bp, Rattus norvegicus
cagctctgcgggcgccgccattaag

SEQ ID NO: 488299 - DNA, 25 bp, Rattus norvegicus
cctgcaggcgcggacccagctctgc

SEQ ID NO: 488300 - DNA, 25 bp, Rattus norvegicus
gcttggccactttggggcgggactc

SEQ ID NO: 488301 - DNA, 25 bp, Rattus norvegicus
cacctgcttggccactttggggcgg

SEQ ID NO: 488302 - DNA, 25 bp, Rattus norvegicus
ctccacctgcttggccactttgggg

SEQ ID NO: 488303 - DNA, 25 bp, Rattus norvegicus
cttctagaagccactccatggatgc

SEQ ID NO: 488304 - DNA, 25 bp, Rattus norvegicus
tgacggcagaacagcccttcttctc

SEQ ID NO: 488305 - DNA, 25 bp, Rattus norvegicus
tactcggatgcggtacggaacattc

SEQ ID NO: 488306 - DNA, 25 bp, Rattus norvegicus
atgcggtacggaacattctttattc

SEQ ID NO: 488307 - DNA, 25 bp, Rattus norvegicus
ccttggcccggacggctttattgag

SEQ ID NO: 488308 - DNA, 25 bp, Rattus norvegicus
acggctttattgagcctggcgtcaa

SEQ ID NO: 488309 - DNA, 25 bp, Rattus norvegicus
agcctggcgtcaatgcgcacatcta

SEQ ID NO: 488310 - DNA, 25 bp, Rattus norvegicus
atttctttgagtgccgaggagcacg

SEQ ID NO: 488311 - DNA, 25 bp, Rattus norvegicus
ttccgaatttctttgagtgccgagg

SEQ ID NO: 488312 - DNA, 25 bp, Rattus norvegicus
ctccttcgtggcaaatttccgaatt

SEQ ID NO: 488313 - DNA, 25 bp, Rattus norvegicus
cgtggcaaatttccgaatttctttg

SEQ ID NO: 488314 - DNA, 25 bp, Rattus norvegicus
cgtcaatgcgcacatctagagtccc

SEQ ID NO: 488315 - DNA, 25 bp, Rattus norvegicus
ggagcacgcttctagaagccactcc

SEQ ID NO: 488316 - DNA, 25 bp, Rattus norvegicus
cttcttctcgctatccttcttcgcg

SEQ ID NO: 488317 - DNA, 25 bp, Rattus norvegicus
tgtcagggtagccacccggatctca

SEQ ID NO: 488318 - DNA, 25 bp, Rattus norvegicus
ccggatctcaactgctttccgcagg

SEQ ID NO: 488319 - DNA, 25 bp, Rattus norvegicus
tttccgcaggcccaatttcaaggcc

SEQ ID NO: 488320 - DNA, 25 bp, Rattus norvegicus
aaggcccgccaacccgagcatgagg

SEQ ID NO: 488321 - DNA, 25 bp, Rattus norvegicus
gatgccgtccctgtaggcgctcgga

SEQ ID NO: 488322 - DNA, 25 bp, Rattus norvegicus
attcggcccgtcagccttcatcatg

SEQ ID NO: 488323 - DNA, 25 bp, Rattus norvegicus
caaaggaccttaacggagggctgcg

SEQ ID NO: 488324 - DNA, 25 bp, Rattus norvegicus
cagccttcatcatgtcgcgacaaag

SEQ ID NO: 488325 - DNA, 25 bp, Rattus norvegicus
gtcttctacctgcagacttgtcagg

SEQ ID NO: 488326 - DNA, 25 bp, Rattus norvegicus
gtcgcgacaaagcaccctatacagc

SEQ ID NO: 488327 - DNA, 25 bp, Rattus norvegicus
cagcgttatccacctcgttgccgga

SEQ ID NO: 488328 - DNA, 25 bp, Rattus norvegicus
cgccaggtagccgactccgggctga

SEQ ID NO: 488329 - DNA, 25 bp, Rattus norvegicus
ctcgttgccggaggcaaaggacctt

SEQ ID NO: 488330 - DNA, 25 bp, Rattus norvegicus
ttcgatgcggcttcccgcaaggtgc

SEQ ID NO: 488331 - DNA, 25 bp, Rattus norvegicus
ggggcacacaagttccctagccagc

SEQ ID NO: 488332 - DNA, 25 bp, Rattus norvegicus
cagatacacacacaatcccaagggg

SEQ ID NO: 488333 - DNA, 25 bp, Rattus norvegicus
tgtaactaaagggaaactgcgcagc

SEQ ID NO: 488334 - DNA, 25 bp, Rattus norvegicus
gcgaatcgcgcagtcgcggcttttc

SEQ ID NO: 488335 - DNA, 25 bp, Rattus norvegicus
cgaaaccaaacaaagcgcggcctga

SEQ ID NO: 488336 - DNA, 25 bp, Rattus norvegicus
cccagaccgagccaggcggcagaaa

SEQ ID NO: 488337 - DNA, 25 bp, Rattus norvegicus
gcgcgctcgtctacatacagataca

SEQ ID NO: 488338 - DNA, 25 bp, Rattus norvegicus
ctggaaatggccgatagcttctata

SEQ ID NO: 488339 - DNA, 25 bp, Rattus norvegicus
taactgcactgcacatgagggaggg

SEQ ID NO: 488340 - DNA, 25 bp, Rattus norvegicus
gacacagcggaagggtaactgcact

SEQ ID NO: 488341 - DNA, 25 bp, Rattus norvegicus
cccagacatagaggagagtaccgtt

SEQ ID NO: 488342 - DNA, 25 bp, Rattus norvegicus
tctacagcaggggtgctcaaaccca

SEQ ID NO: 488343 - DNA, 25 bp, Rattus norvegicus
cccaaggggcccgttctacagcagg

SEQ ID NO: 488344 - DNA, 25 bp, Rattus norvegicus
gcagcccacggagaaggggaaaaca

SEQ ID NO: 488345 - DNA, 25 bp, Rattus norvegicus
aggaacgcagacagaaagacgggcc

SEQ ID NO: 488346 - DNA, 25 bp, Rattus norvegicus
caacgccctgtttcctctctcgggt

SEQ ID NO: 488347 - DNA, 25 bp, Rattus norvegicus
tacagtctcggagccaatggggcct

SEQ ID NO: 488348 - DNA, 25 bp, Rattus norvegicus
cgctcgtacagtctcggagccaatg

SEQ ID NO: 488349 - DNA, 25 bp, Rattus norvegicus
cggccgcgaggaacgcagacagaaa

SEQ ID NO: 488350 - DNA, 25 bp, Rattus norvegicus
caatgggaagcgctcgtacagtctc

SEQ ID NO: 488351 - DNA, 25 bp, Rattus norvegicus
cggccggacctgaccaatgggaagc

SEQ ID NO: 488352 - DNA, 25 bp, Rattus norvegicus
ggattccggccggacctgaccaatg

SEQ ID NO: 488353 - DNA, 25 bp, Rattus norvegicus
ggagcctccactctagcccagtcgg

SEQ ID NO: 488354 - DNA, 25 bp, Rattus norvegicus
ggagccattgacaccgccggagcct

SEQ ID NO: 488355 - DNA, 25 bp, Rattus norvegicus
ggcaggaggagccattgacaccgcc

SEQ ID NO: 488356 - DNA, 25 bp, Rattus norvegicus
gagcgccctgcgaggttttttcttg

SEQ ID NO: 488357 - DNA, 25 bp, Rattus norvegicus
ggggcctcctctcttatcgcgaagc

SEQ ID NO: 488358 - DNA, 25 bp, Rattus norvegicus
gcacaaccggagctcgagcgaggcc

SEQ ID NO: 488359 - DNA, 25 bp, Rattus norvegicus
cggactcgtgaacacactgaggtaa

SEQ ID NO: 488360 - DNA, 25 bp, Rattus norvegicus
ccctggactcgtgaacacactgagg

SEQ ID NO: 488361 - DNA, 25 bp, Rattus norvegicus
cactgaggtaacgtgttgtgatccc

SEQ ID NO: 488362 - DNA, 25 bp, Rattus norvegicus
tgttgtgatcccctggccccggact

SEQ ID NO: 488363 - DNA, 25 bp, Rattus norvegicus
ccggactcgtgaacacactgaggta

SEQ ID NO: 488364 - DNA, 25 bp, Rattus norvegicus
cactgaggtaacgtgttgtgagccc

SEQ ID NO: 488365 - DNA, 25 bp, Rattus norvegicus
ggccctggactcgtgaacacactga

SEQ ID NO: 488366 - DNA, 25 bp, Rattus norvegicus
ctcgtgaacacactgaggtaacgtg

SEQ ID NO: 488367 - DNA, 25 bp, Rattus norvegicus
acacactgaggtaacgtgttgtgat

SEQ ID NO: 488368 - DNA, 25 bp, Rattus norvegicus
gactcgtgaacacactgaggtaacg

SEQ ID NO: 488369 - DNA, 25 bp, Rattus norvegicus
gtgaacacactgaggtaacgtgttg

SEQ ID NO: 488370 - DNA, 25 bp, Rattus norvegicus
tgaggtaacgtgttgtgagcccccg

SEQ ID NO: 488371 - DNA, 25 bp, Rattus norvegicus
gtaacgtgttgtgagcccctaatcc

SEQ ID NO: 488372 - DNA, 25 bp, Rattus norvegicus
acactgaggtaacgtgttgtgagcc

SEQ ID NO: 488373 - DNA, 25 bp, Rattus norvegicus
ccctggactcgtgaacacactgagg

SEQ ID NO: 488374 - DNA, 25 bp, Rattus norvegicus
ggactcgtgaacacactgaggtaac

SEQ ID NO: 488375 - DNA, 25 bp, Rattus norvegicus
aacacactgaggtaacgtgttgtga

SEQ ID NO: 488376 - DNA, 25 bp, Rattus norvegicus
gtaacgtgttgtgatcccctggccc

SEQ ID NO: 488377 - DNA, 25 bp, Rattus norvegicus
ccggactcgtgaacacactgaggta

SEQ ID NO: 488378 - DNA, 25 bp, Rattus norvegicus
cacactgaggtaacgtgttgtgagc

SEQ ID NO: 488379 - DNA, 25 bp, Rattus norvegicus
actcgtgaacacactgaggtaacgt

SEQ ID NO: 488380 - DNA, 25 bp, Rattus norvegicus
cactgaggtaacgtgttgtgatccc

SEQ ID NO: 488381 - DNA, 25 bp, Rattus norvegicus
tggactcgtgaacacactgaggtaa

SEQ ID NO: 488382 - DNA, 25 bp, Rattus norvegicus
acactgaggtaacgtgttgtgagcc

SEQ ID NO: 488383 - DNA, 25 bp, Rattus norvegicus
cggactcgtgaacacactgaggtaa

SEQ ID NO: 488384 - DNA, 25 bp, Rattus norvegicus
acacactgaggtaacgtgttgtgag

SEQ ID NO: 488385 - DNA, 25 bp, Rattus norvegicus
ggccctggactcgtgaacacactga

SEQ ID NO: 488386 - DNA, 25 bp, Rattus norvegicus
cactgaggtaacgtgttgtgagccc

SEQ ID NO: 488387 - DNA, 25 bp, Rattus norvegicus
ccagatcgtcatgtccgcggatagc

SEQ ID NO: 488388 - DNA, 25 bp, Rattus norvegicus
catccagcatcacagactgggtggc

SEQ ID NO: 488389 - DNA, 25 bp, Rattus norvegicus
tgggattgcacagcatccagcatca

SEQ ID NO: 488390 - DNA, 25 bp, Rattus norvegicus
tgccacactgggattgcacagcatc

SEQ ID NO: 488391 - DNA, 25 bp, Rattus norvegicus
ctgggctttccatgccacactggga

SEQ ID NO: 488392 - DNA, 25 bp, Rattus norvegicus
tcctcaggagctctctgggctttcc

SEQ ID NO: 488393 - DNA, 25 bp, Rattus norvegicus
tggactgaagatctgtggctcctca

SEQ ID NO: 488394 - DNA, 25 bp, Rattus norvegicus
ttctttacccttacaacatggactg

SEQ ID NO: 488395 - DNA, 25 bp, Rattus norvegicus
cccacagggaactgtgagcctgctc

SEQ ID NO: 488396 - DNA, 25 bp, Rattus norvegicus
gggtggctattggatcctctgcctc

SEQ ID NO: 488397 - DNA, 25 bp, Rattus norvegicus
ctgcctgaaacctagattctttacc

SEQ ID NO: 488398 - DNA, 25 bp, Rattus norvegicus
gcgattcaaactgcctgaaacctag

SEQ ID NO: 488399 - DNA, 25 bp, Rattus norvegicus
ccttgatcagagagcccagatcgtc

SEQ ID NO: 488400 - DNA, 25 bp, Rattus norvegicus
aagctcggacaagtgaggtagagat

SEQ ID NO: 488401 - DNA, 25 bp, Rattus norvegicus
gcgtgcagcctgcttcccttgcaag

SEQ ID NO: 488402 - DNA, 25 bp, Rattus norvegicus
ctcccggaggtaggagctgcgaaac

SEQ ID NO: 488403 - DNA, 25 bp, Rattus norvegicus
cgaaactgggttgccagcgagcgtc

SEQ ID NO: 488404 - DNA, 25 bp, Rattus norvegicus
caccacccttagacctgcaggagtg

SEQ ID NO: 488405 - DNA, 25 bp, Rattus norvegicus
gctcttggaggacaatgggcaccca

SEQ ID NO: 488406 - DNA, 25 bp, Rattus norvegicus
ttctctctgaggcaaacccggctgg

SEQ ID NO: 488407 - DNA, 25 bp, Rattus norvegicus
gctccctcaggcacaaagagaagtg

SEQ ID NO: 488408 - DNA, 25 bp, Rattus norvegicus
ccagagcgttgctgtccgtaagtgc

SEQ ID NO: 488409 - DNA, 25 bp, Rattus norvegicus
gactccctggcagccgaagctcttg

SEQ ID NO: 488410 - DNA, 25 bp, Rattus norvegicus
aatctgctcccggactgtgcgcagc

SEQ ID NO: 488411 - DNA, 25 bp, Rattus norvegicus
cttgcaagctgtcgccaaaacccgg

SEQ ID NO: 488412 - DNA, 25 bp, Rattus norvegicus
aacgcagacgcagcaggtttttcct

SEQ ID NO: 488413 - DNA, 25 bp, Rattus norvegicus
tctgtccgagattgacctaaagctg

SEQ ID NO: 488414 - DNA, 25 bp, Rattus norvegicus
tacctaacccacctagcagtgcggg

SEQ ID NO: 488415 - DNA, 25 bp, Rattus norvegicus
gcaaaggaaccgcacaagcatatcg

SEQ ID NO: 488416 - DNA, 25 bp, Rattus norvegicus
ccacaggccgagcaaaggaaccgca

SEQ ID NO: 488417 - DNA, 25 bp, Rattus norvegicus
cctgcccaggagcaagtgtggggtt

SEQ ID NO: 488418 - DNA, 25 bp, Rattus norvegicus
cgagcaaaggaaccgcacaagcata

SEQ ID NO: 488419 - DNA, 25 bp, Rattus norvegicus
gcagaagctggctgagccctgccca

SEQ ID NO: 488420 - DNA, 25 bp, Rattus norvegicus
aggaaccgcacaagcatatcggcga

SEQ ID NO: 488421 - DNA, 25 bp, Rattus norvegicus
aaccgcacaagcatatcggcgaggc

SEQ ID NO: 488422 - DNA, 25 bp, Rattus norvegicus
gcacaagcatatcggcgaggccgca

SEQ ID NO: 488423 - DNA, 25 bp, Rattus norvegicus
gcgaggccgcacatgcgtgaactga

SEQ ID NO: 488424 - DNA, 25 bp, Rattus norvegicus
ggccgcacatgcgtgaactgaagca

SEQ ID NO: 488425 - DNA, 25 bp, Rattus norvegicus
cgcacatgcgtgaactgaagcacca

SEQ ID NO: 488426 - DNA, 25 bp, Rattus norvegicus
tgcgtgaactgaagcaccagagggt

SEQ ID NO: 488427 - DNA, 25 bp, Rattus norvegicus
tgatgtcaagacgttgccccgccca

SEQ ID NO: 488428 - DNA, 25 bp, Rattus norvegicus
ggccgagcaaaggaaccgcacaagc

SEQ ID NO: 488429 - DNA, 25 bp, Rattus norvegicus
caggccttaccttggctgcagtctt

SEQ ID NO: 488430 - DNA, 25 bp, Rattus norvegicus
cgcagcacgcgttccacttggggaa

SEQ ID NO: 488431 - DNA, 25 bp, Rattus norvegicus
ggaagctcatctcactctcgcagca

SEQ ID NO: 488432 - DNA, 25 bp, Rattus norvegicus
ctgcgtgtcttcagctggaagctca

SEQ ID NO: 488433 - DNA, 25 bp, Rattus norvegicus
cgcagaagccctcgtcgtcgaagta

SEQ ID NO: 488434 - DNA, 25 bp, Rattus norvegicus
tcaggatgagctcgaggaagtcgca

SEQ ID NO: 488435 - DNA, 25 bp, Rattus norvegicus
cacggaaaccggtcctcgagcagtc

SEQ ID NO: 488436 - DNA, 25 bp, Rattus norvegicus
tgcagtctttgccacggaaaccggt

SEQ ID NO: 488437 - DNA, 25 bp, Rattus norvegicus
tcgagcagtcacacacggcctggtc

SEQ ID NO: 488438 - DNA, 25 bp, Rattus norvegicus
gctcttcgtccagcttgggacctcg

SEQ ID NO: 488439 - DNA, 25 bp, Rattus norvegicus
cctgggacgagttgaccctgacatc

SEQ ID NO: 488440 - DNA, 25 bp, Rattus norvegicus
ctgacatcacggatccagcccttga

SEQ ID NO: 488441 - DNA, 25 bp, Rattus norvegicus
gaacaccgtcatgtccctgcgcttg

SEQ ID NO: 488442 - DNA, 25 bp, Rattus norvegicus
ttggacttgacctccacccacttgg

SEQ ID NO: 488443 - DNA, 25 bp, Rattus norvegicus
cgccgaacagcacccgtgaaactta

SEQ ID NO: 488444 - DNA, 25 bp, Rattus norvegicus
taggttcccttaacgccgaacagca

SEQ ID NO: 488445 - DNA, 25 bp, Rattus norvegicus
gcaccaggcagcaccacaggcggaa

SEQ ID NO: 488446 - DNA, 25 bp, Rattus norvegicus
ttaccgagcgtgtgggtgctagtaa

SEQ ID NO: 488447 - DNA, 25 bp, Rattus norvegicus
ccgaggcttacttaccgagcgtgtg

SEQ ID NO: 488448 - DNA, 25 bp, Rattus norvegicus
cgaaatccgcggcaccgaggcttac

SEQ ID NO: 488449 - DNA, 25 bp, Rattus norvegicus
cggttcaatccagcccggcgtggct

SEQ ID NO: 488450 - DNA, 25 bp, Rattus norvegicus
ctcacacccgggaatcggccaggaa

SEQ ID NO: 488451 - DNA, 25 bp, Rattus norvegicus
ccggggcagcgagtctccagacaaa

SEQ ID NO: 488452 - DNA, 25 bp, Rattus norvegicus
tctccagacaaagcccgagatggcg

SEQ ID NO: 488453 - DNA, 25 bp, Rattus norvegicus
ccacaggcggaagagctgagccgca

SEQ ID NO: 488454 - DNA, 25 bp, Rattus norvegicus
ggcagccctgctctggagctctctt

SEQ ID NO: 488455 - DNA, 25 bp, Rattus norvegicus
gagtcgctctgggagccggttcaat

SEQ ID NO: 488456 - DNA, 25 bp, Rattus norvegicus
gttgcgaggtttcggcgcctacctc

SEQ ID NO: 488457 - DNA, 25 bp, Rattus norvegicus
agtaggcggaaccaaactgcttgcg

SEQ ID NO: 488458 - DNA, 25 bp, Rattus norvegicus
ccacagtagcatggagtgtgacctc

SEQ ID NO: 488459 - DNA, 25 bp, Rattus norvegicus
gcacgcgtcgaaccggccattttca

SEQ ID NO: 488460 - DNA, 25 bp, Rattus norvegicus
cattatctgatagtgcgcacgcgtc

SEQ ID NO: 488461 - DNA, 25 bp, Rattus norvegicus
cgccagctgtcgacttggaagttcc

SEQ ID NO: 488462 - DNA, 25 bp, Rattus norvegicus
gggcagctagcctcattatctgata

SEQ ID NO: 488463 - DNA, 25 bp, Rattus norvegicus
gggcagcctgacgactcggaaattt

SEQ ID NO: 488464 - DNA, 25 bp, Rattus norvegicus
tcggaaatttgaataccacagtagc

SEQ ID NO: 488465 - DNA, 25 bp, Rattus norvegicus
gtgcacatgcgcattccaaaagctc

SEQ ID NO: 488466 - DNA, 25 bp, Rattus norvegicus
aaactgcttgcgcacgctcagggca

SEQ ID NO: 488467 - DNA, 25 bp, Rattus norvegicus
tcgttggaagatctagggtaagacc

SEQ ID NO: 488468 - DNA, 25 bp, Rattus norvegicus
taccggcaccgtgtgtcagtcatgc

SEQ ID NO: 488469 - DNA, 25 bp, Rattus norvegicus
tgacctcatggagactgacatcttg

SEQ ID NO: 488470 - DNA, 25 bp, Rattus norvegicus
ttctgaaagtccactctgctagagc

SEQ ID NO: 488471 - DNA, 25 bp, Rattus norvegicus
actcggtggagttgttactgagccc

SEQ ID NO: 488472 - DNA, 25 bp, Rattus norvegicus
ccggtgttcagtgtcgagaaaggcc

SEQ ID NO: 488473 - DNA, 25 bp, Rattus norvegicus
tgcagatcatgtgggccggtgttca

SEQ ID NO: 488474 - DNA, 25 bp, Rattus norvegicus
ttactgagccctgcagatcatgtgg

SEQ ID NO: 488475 - DNA, 25 bp, Rattus norvegicus
gccgtgagatgtgacggtctgatcc

SEQ ID NO: 488476 - DNA, 25 bp, Rattus norvegicus
atgatggcagcggacgtactgctgt

SEQ ID NO: 488477 - DNA, 25 bp, Rattus norvegicus
acgtactgctgtgggagacacatgc

SEQ ID NO: 488478 - DNA, 25 bp, Rattus norvegicus
tgggagacacatgcgcgcaacctca

SEQ ID NO: 488479 - DNA, 25 bp, Rattus norvegicus
tctgcacgaggccttggagacctgc

SEQ ID NO: 488480 - DNA, 25 bp, Rattus norvegicus
ccgcctactcggtggagttgttact

SEQ ID NO: 488481 - DNA, 25 bp, Rattus norvegicus
tggagttgttactgagccctgcaga

SEQ ID NO: 488482 - DNA, 25 bp, Rattus norvegicus
tcagtgtcgagaaaggccgtgagat

SEQ ID NO: 488483 - DNA, 25 bp, Rattus norvegicus
ggagacctgcgttcctggcaactca

SEQ ID NO: 488484 - DNA, 25 bp, Rattus norvegicus
tcactcaaccgcctactcggtggag

SEQ ID NO: 488485 - DNA, 25 bp, Rattus norvegicus
tgctgcttctgctgaacctgcagtc

SEQ ID NO: 488486 - DNA, 25 bp, Rattus norvegicus
tggctgttgagctccggctgtacct

SEQ ID NO: 488487 - DNA, 25 bp, Rattus norvegicus
ttctgctgaacctgcagtctggagc

SEQ ID NO: 488488 - DNA, 25 bp, Rattus norvegicus
gctatgggcgccgactcccgtcgag

SEQ ID NO: 488489 - DNA, 25 bp, Rattus norvegicus
tgtacctggcgtccagtgcgacgtt

SEQ ID NO: 488490 - DNA, 25 bp, Rattus norvegicus
caccggcctttgagtggagctgccg

SEQ ID NO: 488491 - DNA, 25 bp, Rattus norvegicus
tgaccgcggtctgagcaccggcctt

SEQ ID NO: 488492 - DNA, 25 bp, Rattus norvegicus
tccagtgcgacgttgaaggtccgcg

SEQ ID NO: 488493 - DNA, 25 bp, Rattus norvegicus
catgtttggcgaagcgagtgaccgc

SEQ ID NO: 488494 - DNA, 25 bp, Rattus norvegicus
cgacttgcctgccatgtttggcgaa

SEQ ID NO: 488495 - DNA, 25 bp, Rattus norvegicus
gagcgcacgacttgcctgccatgtt

SEQ ID NO: 488496 - DNA, 25 bp, Rattus norvegicus
tcctgctgcactttggagcgcacga

SEQ ID NO: 488497 - DNA, 25 bp, Rattus norvegicus
ccggagctctgcgtgtcctgctgca

SEQ ID NO: 488498 - DNA, 25 bp, Rattus norvegicus
ggcccgggcgcaccacgtacgtgat

SEQ ID NO: 488499 - DNA, 25 bp, Rattus norvegicus
ctcccagggtctaataggcgggcct

SEQ ID NO: 488500 - DNA, 25 bp, Rattus norvegicus
aaggcccgaaaagcaactcgcagcg

SEQ ID NO: 488501 - DNA, 25 bp, Rattus norvegicus
gaccaggccggtccagacgcaaaag

SEQ ID NO: 488502 - DNA, 25 bp, Rattus norvegicus
tccgaaggtcctcagccgtagcttc

SEQ ID NO: 488503 - DNA, 25 bp, Rattus norvegicus
tgggaggcttcctcgaccagcatcc

SEQ ID NO: 488504 - DNA, 25 bp, Rattus norvegicus
cccgacgtgccatcgatgactttga

SEQ ID NO: 488505 - DNA, 25 bp, Rattus norvegicus
tcgatgactttgatggtcccgcggc

SEQ ID NO: 488506 - DNA, 25 bp, Rattus norvegicus
cacaatcacactgggaagcggctca

SEQ ID NO: 488507 - DNA, 25 bp, Rattus norvegicus
ccggaagtgaagtcaagcgcctgca

SEQ ID NO: 488508 - DNA, 25 bp, Rattus norvegicus
agcgcctgcacgcacagggaacgtc

SEQ ID NO: 488509 - DNA, 25 bp, Rattus norvegicus
cgcaccaaaagatgggcaggagccc

SEQ ID NO: 488510 - DNA, 25 bp, Rattus norvegicus
cggagggaagctgataaggaacacc

SEQ ID NO: 488511 - DNA, 25 bp, Rattus norvegicus
gtgaacatgcgcagaagggctccca

SEQ ID NO: 488512 - DNA, 25 bp, Rattus norvegicus
ctgctgctttctgagtccgaaggtc

SEQ ID NO: 488513 - DNA, 25 bp, Rattus norvegicus
caccttctgcgtccgccgaagagac

SEQ ID NO: 488514 - DNA, 25 bp, Rattus norvegicus
tcaccttctgcgtccgccgaagaga

SEQ ID NO: 488515 - DNA, 25 bp, Rattus norvegicus
gaaaggcctagggatcacaggggcg

SEQ ID NO: 488516 - DNA, 25 bp, Rattus norvegicus
ctagtcacccgaggcctccggaaag

SEQ ID NO: 488517 - DNA, 25 bp, Rattus norvegicus
ctccggaaaggcctagggatcacag

SEQ ID NO: 488518 - DNA, 25 bp, Rattus norvegicus
tccggaaaggcctagggatcacagg

SEQ ID NO: 488519 - DNA, 25 bp, Rattus norvegicus
ccggaaaggcctagggatcacaggg

SEQ ID NO: 488520 - DNA, 25 bp, Rattus norvegicus
aaggcctagggatcacaggggcgga

SEQ ID NO: 488521 - DNA, 25 bp, Rattus norvegicus
atcacaggggcggagtccccactct

SEQ ID NO: 488522 - DNA, 25 bp, Rattus norvegicus
tcacaggggcggagtccccactctg

SEQ ID NO: 488523 - DNA, 25 bp, Rattus norvegicus
gggcggagtccccactctgccaccc

SEQ ID NO: 488524 - DNA, 25 bp, Rattus norvegicus
agcctcggcctcaccttctgcgtcc

SEQ ID NO: 488525 - DNA, 25 bp, Rattus norvegicus
gcacccaagcaccacgacgccggcg

SEQ ID NO: 488526 - DNA, 25 bp, Rattus norvegicus
ctagggatcacaggggcggagtccc

SEQ ID NO: 488527 - DNA, 25 bp, Rattus norvegicus
aagacgctctgagaattcgcttttc

SEQ ID NO: 488528 - DNA, 25 bp, Rattus norvegicus
ttcgcttttctcaagcggaagggga

SEQ ID NO: 488529 - DNA, 25 bp, Rattus norvegicus
ccttagagtcggattggttgcagga

SEQ ID NO: 488530 - DNA, 25 bp, Rattus norvegicus
tcgaccacgcggttccgagcggctg

SEQ ID NO: 488531 - DNA, 25 bp, Rattus norvegicus
tagagcagggtgctcgggcgaggaa

SEQ ID NO: 488532 - DNA, 25 bp, Rattus norvegicus
caggaggaaacaccccgcaagaatc

SEQ ID NO: 488533 - DNA, 25 bp, Rattus norvegicus
caactcaccatggtaaggagccgta

SEQ ID NO: 488534 - DNA, 25 bp, Rattus norvegicus
tcaccatggtaaggagccgtacagc

SEQ ID NO: 488535 - DNA, 25 bp, Rattus norvegicus
ccatggtaaggagccgtacagctcc

SEQ ID NO: 488536 - DNA, 25 bp, Rattus norvegicus
aggagccgtacagctcccgccggaa

SEQ ID NO: 488537 - DNA, 25 bp, Rattus norvegicus
tcccgccggaagacgctctgagaat

SEQ ID NO: 488538 - DNA, 25 bp, Rattus norvegicus
cgccggaagacgctctgagaattcg

SEQ ID NO: 488539 - DNA, 25 bp, Rattus norvegicus
ccggaagacgctctgagaattcgct

SEQ ID NO: 488540 - DNA, 25 bp, Rattus norvegicus
cggaactgcgcatgtgcccaaggtc

SEQ ID NO: 488541 - DNA, 25 bp, Rattus norvegicus
cgcagggcaatggagatgtactcaa

SEQ ID NO: 488542 - DNA, 25 bp, Rattus norvegicus
agtacctttctcttcctcgtcgatg

SEQ ID NO: 488543 - DNA, 25 bp, Rattus norvegicus
ggagatgtactcaaaggcctgcttg

SEQ ID NO: 488544 - DNA, 25 bp, Rattus norvegicus
tcaaaggcctgcttgtggaagacgc

SEQ ID NO: 488545 - DNA, 25 bp, Rattus norvegicus
tggaagacgcggacgctctcggcct

SEQ ID NO: 488546 - DNA, 25 bp, Rattus norvegicus
ccggagctcctcttggcggccatga

SEQ ID NO: 488547 - DNA, 25 bp, Rattus norvegicus
agaagcgctggcagagccacacgaa

SEQ ID NO: 488548 - DNA, 25 bp, Rattus norvegicus
ctggcagagccacacgaagaggagc

SEQ ID NO: 488549 - DNA, 25 bp, Rattus norvegicus
cgcagcagggcgaagccgacgacca

SEQ ID NO: 488550 - DNA, 25 bp, Rattus norvegicus
cgacgaccagcggatacgagaagta

SEQ ID NO: 488551 - DNA, 25 bp, Rattus norvegicus
cgagaagtaatacaggttccgctta

SEQ ID NO: 488552 - DNA, 25 bp, Rattus norvegicus
acaggttccgcttatgcggcgagcc

SEQ ID NO: 488553 - DNA, 25 bp, Rattus norvegicus
cgtccggccggagaactcattcaca

SEQ ID NO: 488554 - DNA, 25 bp, Rattus norvegicus
tcttcctcgtcgatgcgcagggcaa

SEQ ID NO: 488555 - DNA, 25 bp, Rattus norvegicus
ttttttgatgacgaaagccttcgtg

SEQ ID NO: 488556 - DNA, 25 bp, Rattus norvegicus
tcccgcgcttctggtccgtactttg

SEQ ID NO: 488557 - DNA, 25 bp, Rattus norvegicus
gcatcagacacgcttcgggagtaca

SEQ ID NO: 488558 - DNA, 25 bp, Rattus norvegicus
acacgcttcgggagtacaaggtggt

SEQ ID NO: 488559 - DNA, 25 bp, Rattus norvegicus
acactgccactgtgccgaatgcgaa

SEQ ID NO: 488560 - DNA, 25 bp, Rattus norvegicus
ccactgtgccgaatgcgaatctttg

SEQ ID NO: 488561 - DNA, 25 bp, Rattus norvegicus
tgcgaatctttgcaccggaccatgt

SEQ ID NO: 488562 - DNA, 25 bp, Rattus norvegicus
tttgcaccggaccatgtggtggcca

SEQ ID NO: 488563 - DNA, 25 bp, Rattus norvegicus
cgcttctggtccgtactttgtgtcg

SEQ ID NO: 488564 - DNA, 25 bp, Rattus norvegicus
ccattttgcgtggtggtgaacgacc

SEQ ID NO: 488565 - DNA, 25 bp, Rattus norvegicus
tggtgaacgaccacaccgtgccatg

SEQ ID NO: 488566 - DNA, 25 bp, Rattus norvegicus
agccttcgtgaaaagcggcacttcc

SEQ ID NO: 488567 - DNA, 25 bp, Rattus norvegicus
caccgtgccatgaaggcatcagaca

SEQ ID NO: 488568 - DNA, 25 bp, Rattus norvegicus
aaagcggcacttccattttgcgtgg

SEQ ID NO: 488569 - DNA, 25 bp, Rattus norvegicus
ccacgacggaccttgggacctgcgg

SEQ ID NO: 488570 - DNA, 25 bp, Rattus norvegicus
agcccaggagaccaccggagcggtc

SEQ ID NO: 488571 - DNA, 25 bp, Rattus norvegicus
ccctggagaggtggcttcgtgaccc

SEQ ID NO: 488572 - DNA, 25 bp, Rattus norvegicus
ctggcacagtcctgcaggagcctgc

SEQ ID NO: 488573 - DNA, 25 bp, Rattus norvegicus
gaccgccggctgtgctggcacagtc

SEQ ID NO: 488574 - DNA, 25 bp, Rattus norvegicus
ttcgaggcctgacgcctggtgaccc

SEQ ID NO: 488575 - DNA, 25 bp, Rattus norvegicus
cgctgcttcacttccggttcgaggc

SEQ ID NO: 488576 - DNA, 25 bp, Rattus norvegicus
agccacaaagaagcccgcgcaacga

SEQ ID NO: 488577 - DNA, 25 bp, Rattus norvegicus
gctgcagggttcactcgcctatcct

SEQ ID NO: 488578 - DNA, 25 bp, Rattus norvegicus
cgagaaggccgccacgacggacctt

SEQ ID NO: 488579 - DNA, 25 bp, Rattus norvegicus
tatctaggtcagacgagaaggccgc

SEQ ID NO: 488580 - DNA, 25 bp, Rattus norvegicus
ggcgcctccgctatctaggtcagac

SEQ ID NO: 488581 - DNA, 25 bp, Rattus norvegicus
agcaggcccgcggatgagaaaagca

SEQ ID NO: 488582 - DNA, 25 bp, Rattus norvegicus
tatcctctccctgttcgttcgctcg

SEQ ID NO: 488583 - DNA, 25 bp, Rattus norvegicus
gctctggcactcatgcctgcggtgc

SEQ ID NO: 488584 - DNA, 25 bp, Rattus norvegicus
taggcccacttaggcgggctctggc

SEQ ID NO: 488585 - DNA, 25 bp, Rattus norvegicus
gggctgcaccgcatcctggcgtctt

SEQ ID NO: 488586 - DNA, 25 bp, Rattus norvegicus
agcagcgcgacgtctctcacttacg

SEQ ID NO: 488587 - DNA, 25 bp, Rattus norvegicus
gtctctcacttacggccgaagctgt

SEQ ID NO: 488588 - DNA, 25 bp, Rattus norvegicus
cttacggccgaagctgttcgcgctt

SEQ ID NO: 488589 - DNA, 25 bp, Rattus norvegicus
ggtgcagggcacttaggaaccgaca

SEQ ID NO: 488590 - DNA, 25 bp, Rattus norvegicus
accgacagcattggcgcgggtaatc

SEQ ID NO: 488591 - DNA, 25 bp, Rattus norvegicus
ggcgcgggtaatcagctccctgtct

SEQ ID NO: 488592 - DNA, 25 bp, Rattus norvegicus
tgtcttccttctcccactgctagat

SEQ ID NO: 488593 - DNA, 25 bp, Rattus norvegicus
cttctcccactgctagattctcggg

SEQ ID NO: 488594 - DNA, 25 bp, Rattus norvegicus
tagattctcgggacggcctccgagc

SEQ ID NO: 488595 - DNA, 25 bp, Rattus norvegicus
tcctggcgtcttccacttgaaatct

SEQ ID NO: 488596 - DNA, 25 bp, Rattus norvegicus
agccgcagaggcgtaggcccactta

SEQ ID NO: 488597 - DNA, 25 bp, Rattus norvegicus
agcgagctttgtccagaccaccatg

SEQ ID NO: 488598 - DNA, 25 bp, Rattus norvegicus
ccagaccaccatggctctggggctg

SEQ ID NO: 488599 - DNA, 25 bp, Rattus norvegicus
gggctgccctccaagaaagcatctt

SEQ ID NO: 488600 - DNA, 25 bp, Rattus norvegicus
caagaaagcatcttcccgcaacgtg

SEQ ID NO: 488601 - DNA, 25 bp, Rattus norvegicus
tcccgcaacgtgatcgtggagcgca

SEQ ID NO: 488602 - DNA, 25 bp, Rattus norvegicus
ctttgtccagaccaccatggctctg

SEQ ID NO: 488603 - DNA, 25 bp, Rattus norvegicus
cacatctggatggaagcgagctttg

SEQ ID NO: 488604 - DNA, 25 bp, Rattus norvegicus
tggccgcacatctggatggaagcga

SEQ ID NO: 488605 - DNA, 25 bp, Rattus norvegicus
gccctaggtgtccaggccgagggat

SEQ ID NO: 488606 - DNA, 25 bp, Rattus norvegicus
ttttgctccggaatcgctgctgggg

SEQ ID NO: 488607 - DNA, 25 bp, Rattus norvegicus
cggccttgttttgctccggaatcgc

SEQ ID NO: 488608 - DNA, 25 bp, Rattus norvegicus
ctcagcacctcggagagctccctcc

SEQ ID NO: 488609 - DNA, 25 bp, Rattus norvegicus
ggggccttatggccctgacgtcacc

SEQ ID NO: 488610 - DNA, 25 bp, Rattus norvegicus
gcatcttcccgcaacgtgatcgtgg

SEQ ID NO: 488611 - DNA, 25 bp, Rattus norvegicus
cgcgcgcatagtttctactagggaa

SEQ ID NO: 488612 - DNA, 25 bp, Rattus norvegicus
tggctccgcggacggcctctgcgtt

SEQ ID NO: 488613 - DNA, 25 bp, Rattus norvegicus
cccgtcccgcttccgccgttgagcg

SEQ ID NO: 488614 - DNA, 25 bp, Rattus norvegicus
cttctgctggcgctaaaccccggag

SEQ ID NO: 488615 - DNA, 25 bp, Rattus norvegicus
tgtgcgtactgaaccagcggcgcgc

SEQ ID NO: 488616 - DNA, 25 bp, Rattus norvegicus
accgcgtgtgcgtactgaaccagcg

SEQ ID NO: 488617 - DNA, 25 bp, Rattus norvegicus
cagcgaccgcgtgtgcgtactgaac

SEQ ID NO: 488618 - DNA, 25 bp, Rattus norvegicus
cagactcgcattcctgggcgacacc

SEQ ID NO: 488619 - DNA, 25 bp, Rattus norvegicus
ttctactagggaaacttcgcggcgc

SEQ ID NO: 488620 - DNA, 25 bp, Rattus norvegicus
cgcggtcctcgtgccagagactggc

SEQ ID NO: 488621 - DNA, 25 bp, Rattus norvegicus
tcgccgcgcgcatagtttctactag

SEQ ID NO: 488622 - DNA, 25 bp, Rattus norvegicus
aggacgcgtgggcttcccaggctct

SEQ ID NO: 488623 - DNA, 25 bp, Rattus norvegicus
tactagggaaacttcgcggcgcggc

SEQ ID NO: 488624 - DNA, 25 bp, Rattus norvegicus
cctcgtctcgcggttgcgtcctgcg

SEQ ID NO: 488625 - DNA, 25 bp, Rattus norvegicus
cgtctggtgctccataaaggggccc

SEQ ID NO: 488626 - DNA, 25 bp, Rattus norvegicus
tgctggctctcttctctgcacatta

SEQ ID NO: 488627 - DNA, 25 bp, Rattus norvegicus
gttgccttcctttgtggtgtcggta

SEQ ID NO: 488628 - DNA, 25 bp, Rattus norvegicus
cctggttcctgcaggagttgccttc

SEQ ID NO: 488629 - DNA, 25 bp, Rattus norvegicus
tgccagttacgggaaacacacagag

SEQ ID NO: 488630 - DNA, 25 bp, Rattus norvegicus
tatggggaccctgatcctgtgctta

SEQ ID NO: 488631 - DNA, 25 bp, Rattus norvegicus
gcaggtagcgccacattggccacta

SEQ ID NO: 488632 - DNA, 25 bp, Rattus norvegicus
attgtctgccatcaggtcccggtgc

SEQ ID NO: 488633 - DNA, 25 bp, Rattus norvegicus
caggttagccttttctccgcagagc

SEQ ID NO: 488634 - DNA, 25 bp, Rattus norvegicus
gtgaccacaggcgagatgcagattg

SEQ ID NO: 488635 - DNA, 25 bp, Rattus norvegicus
tgcacattacttccacaggttagcc

SEQ ID NO: 488636 - DNA, 25 bp, Rattus norvegicus
gggcggcagctaccaactgtgacca

SEQ ID NO: 488637 - DNA, 25 bp, Rattus norvegicus
tcgctccagctcgtggactaacgtc

SEQ ID NO: 488638 - DNA, 25 bp, Rattus norvegicus
tgtgcttagggaaacctgccagtta

SEQ ID NO: 488639 - DNA, 25 bp, Rattus norvegicus
gctaagtgacacagacgagactgga

SEQ ID NO: 488640 - DNA, 25 bp, Rattus norvegicus
gcagccgtatttctcttatctatcg

SEQ ID NO: 488641 - DNA, 25 bp, Rattus norvegicus
cctttattccgacacgcagccgtat

SEQ ID NO: 488642 - DNA, 25 bp, Rattus norvegicus
gcccatctgacgtcataacccttta

SEQ ID NO: 488643 - DNA, 25 bp, Rattus norvegicus
ctcgaacaggcgagaccggcttcta

SEQ ID NO: 488644 - DNA, 25 bp, Rattus norvegicus
cggcttctatcgttacacgccaaca

SEQ ID NO: 488645 - DNA, 25 bp, Rattus norvegicus
ggacaaggagtccatcagcctcgcc

SEQ ID NO: 488646 - DNA, 25 bp, Rattus norvegicus
tacactggcgtaggaggaagactgc

SEQ ID NO: 488647 - DNA, 25 bp, Rattus norvegicus
tgtgatttttcccagtacactggcg

SEQ ID NO: 488648 - DNA, 25 bp, Rattus norvegicus
tgaacgatgatcgtgtctcatcctg

SEQ ID NO: 488649 - DNA, 25 bp, Rattus norvegicus
tgtcatacacgacagtgaacgatga

SEQ ID NO: 488650 - DNA, 25 bp, Rattus norvegicus
cagtgctggatggtcacgtgtcata

SEQ ID NO: 488651 - DNA, 25 bp, Rattus norvegicus
cgccaacatacatgacacagtgctg

SEQ ID NO: 488652 - DNA, 25 bp, Rattus norvegicus
tcgatctacgtcttacgacccggta

SEQ ID NO: 488653 - DNA, 25 bp, Rattus norvegicus
ggattccaccttcgcggctgctcga

SEQ ID NO: 488654 - DNA, 25 bp, Rattus norvegicus
tctccttcggagtcagtctgtctgt

SEQ ID NO: 488655 - DNA, 25 bp, Rattus norvegicus
tgctcgagtcagtttccctcgcggc

SEQ ID NO: 488656 - DNA, 25 bp, Rattus norvegicus
ctcagggctccggacactagcctgt

SEQ ID NO: 488657 - DNA, 25 bp, Rattus norvegicus
cgtctccgtatctttggcgtgtgta

SEQ ID NO: 488658 - DNA, 25 bp, Rattus norvegicus
tttgagggttccaagtcaggggctc

SEQ ID NO: 488659 - DNA, 25 bp, Rattus norvegicus
aaggtatgccgtttcgtggcgctca

SEQ ID NO: 488660 - DNA, 25 bp, Rattus norvegicus
tgctgctgttcttctgggtcaccaa

SEQ ID NO: 488661 - DNA, 25 bp, Rattus norvegicus
cccatctttggggtgctttggatca

SEQ ID NO: 488662 - DNA, 25 bp, Rattus norvegicus
gacgcgtcgccaccaagagaagcag

SEQ ID NO: 488663 - DNA, 25 bp, Rattus norvegicus
tccggatcccaggagcaacgtttcc

SEQ ID NO: 488664 - DNA, 25 bp, Rattus norvegicus
gccattcagcatccggatcccagga

SEQ ID NO: 488665 - DNA, 25 bp, Rattus norvegicus
gtgccgggcacagcctcggattcca

SEQ ID NO: 488666 - DNA, 25 bp, Rattus norvegicus
atttaagaagcttggggcgtctccg

SEQ ID NO: 488667 - DNA, 25 bp, Rattus norvegicus
attcatcccgaagcggggaggcgtc

SEQ ID NO: 488668 - DNA, 25 bp, Rattus norvegicus
ggtgtttagggactcggcagctccc

SEQ ID NO: 488669 - DNA, 25 bp, Rattus norvegicus
cagctcccgcatttcgccgaggtgt

SEQ ID NO: 488670 - DNA, 25 bp, Rattus norvegicus
tcagtgagcacagaccggacacccg

SEQ ID NO: 488671 - DNA, 25 bp, Rattus norvegicus
tgctctcgggaaaagcggtcgagcc

SEQ ID NO: 488672 - DNA, 25 bp, Rattus norvegicus
acactggggcgaaactgcgactcac

SEQ ID NO: 488673 - DNA, 25 bp, Rattus norvegicus
ctgcgagcagaacccgccgctaatt

SEQ ID NO: 488674 - DNA, 25 bp, Rattus norvegicus
gcgtcgtctaggctcctttaaagga

SEQ ID NO: 488675 - DNA, 25 bp, Rattus norvegicus
gcgtcgagcccgtcgccttagtaat

SEQ ID NO: 488676 - DNA, 25 bp, Rattus norvegicus
cgccttagtaatgcgtccctccaga

SEQ ID NO: 488677 - DNA, 25 bp, Rattus norvegicus
agactccacactgattggctactgg

SEQ ID NO: 488678 - DNA, 25 bp, Rattus norvegicus
actgattggctactggcgctgtgac

SEQ ID NO: 488679 - DNA, 25 bp, Rattus norvegicus
tgacgcaaggcgtctccggctgcgt

SEQ ID NO: 488680 - DNA, 25 bp, Rattus norvegicus
ggggtcacaacctgcgagcagaacc

SEQ ID NO: 488681 - DNA, 25 bp, Rattus norvegicus
gaccggcggtcgctgcgacagtcac

SEQ ID NO: 488682 - DNA, 25 bp, Rattus norvegicus
gccacagcctcacaaagagcgacgg

SEQ ID NO: 488683 - DNA, 25 bp, Rattus norvegicus
aaggggaagaggcacttcctgcctg

SEQ ID NO: 488684 - DNA, 25 bp, Rattus norvegicus
aagccgccggcccaagggcttcgag

SEQ ID NO: 488685 - DNA, 25 bp, Rattus norvegicus
gggatcggcgctgccagcagctctt

SEQ ID NO: 488686 - DNA, 25 bp, Rattus norvegicus
agcagctcttcgctcctcagctggg

SEQ ID NO: 488687 - DNA, 25 bp, Rattus norvegicus
ttcgctcctcagctgggtcgaagcc

SEQ ID NO: 488688 - DNA, 25 bp, Rattus norvegicus
tccaagtcttcaggtttagtcaggc

SEQ ID NO: 488689 - DNA, 25 bp, Rattus norvegicus
ttcaggtttagtcaggccttggccc

SEQ ID NO: 488690 - DNA, 25 bp, Rattus norvegicus
tcgggcctgggcgtcaatcacccag

SEQ ID NO: 488691 - DNA, 25 bp, Rattus norvegicus
tgggcgtcaatcacccagcgtggcc

SEQ ID NO: 488692 - DNA, 25 bp, Rattus norvegicus
agggacgagcctcccggtcggctca

SEQ ID NO: 488693 - DNA, 25 bp, Rattus norvegicus
caaacacaggcggaacagctgggca

SEQ ID NO: 488694 - DNA, 25 bp, Rattus norvegicus
ccagacacctgagcacgagcgggcg

SEQ ID NO: 488695 - DNA, 25 bp, Rattus norvegicus
agcagggcgctctatagtgtacaca

SEQ ID NO: 488696 - DNA, 25 bp, Rattus norvegicus
catcgcctggaatctcctgggcaga

SEQ ID NO: 488697 - DNA, 25 bp, Rattus norvegicus
tgggcaagacagtgaccgactcaga

SEQ ID NO: 488698 - DNA, 25 bp, Rattus norvegicus
gctccttgaacggtacctaattgcc

SEQ ID NO: 488699 - DNA, 25 bp, Rattus norvegicus
ccagctgttgaacccaaggtgtctc

SEQ ID NO: 488700 - DNA, 25 bp, Rattus norvegicus
aaggtgtctcactgtctccgaactc

SEQ ID NO: 488701 - DNA, 25 bp, Rattus norvegicus
tgcctccttgtagactggggaaagc

SEQ ID NO: 488702 - DNA, 25 bp, Rattus norvegicus
gccgttcaggaccaaggactatttg

SEQ ID NO: 488703 - DNA, 25 bp, Rattus norvegicus
gtctagtgtaaactcgccctccgga

SEQ ID NO: 488704 - DNA, 25 bp, Rattus norvegicus
tttgacagcagcctcgtactccgga

SEQ ID NO: 488705 - DNA, 25 bp, Rattus norvegicus
tattcgcgcctgcagaggaagagtc

SEQ ID NO: 488706 - DNA, 25 bp, Rattus norvegicus
gcagggtgatcgatccgaagacttc

SEQ ID NO: 488707 - DNA, 25 bp, Rattus norvegicus
atcactggctctggactgcgaccct

SEQ ID NO: 488708 - DNA, 25 bp, Rattus norvegicus
gctgagaaccctttttgcctccttg

SEQ ID NO: 488709 - DNA, 25 bp, Rattus norvegicus
cgccaggcccgctggtgaagaagcc

SEQ ID NO: 488710 - DNA, 25 bp, Rattus norvegicus
ccgatcggggccacgtgaacatggc

SEQ ID NO: 488711 - DNA, 25 bp, Rattus norvegicus
ggccacgtgaacatggcgttctctc

SEQ ID NO: 488712 - DNA, 25 bp, Rattus norvegicus
gtgaacatggcgttctctcagccca

SEQ ID NO: 488713 - DNA, 25 bp, Rattus norvegicus
caaaggcccgggctccagaaacaag

SEQ ID NO: 488714 - DNA, 25 bp, Rattus norvegicus
ggcccgggctccagaaacaagccga

SEQ ID NO: 488715 - DNA, 25 bp, Rattus norvegicus
gggctccagaaacaagccgaccagc

SEQ ID NO: 488716 - DNA, 25 bp, Rattus norvegicus
acctacggctcgtggttcaccgaga

SEQ ID NO: 488717 - DNA, 25 bp, Rattus norvegicus
tcgtggttcaccgagaagccagcca

SEQ ID NO: 488718 - DNA, 25 bp, Rattus norvegicus
gttcaccgagaagccagccaaaaag

SEQ ID NO: 488719 - DNA, 25 bp, Rattus norvegicus
agaagccagccaaaaagacccatcc

SEQ ID NO: 488720 - DNA, 25 bp, Rattus norvegicus
tgctgctcgagccgtcggcgctcag

SEQ ID NO: 488721 - DNA, 25 bp, Rattus norvegicus
aaccctcagccctggcagcgccagg

SEQ ID NO: 488722 - DNA, 25 bp, Rattus norvegicus
cccgctggtgaagaagccctcgggt

SEQ ID NO: 488723 - DNA, 25 bp, Rattus norvegicus
aacggtggccatttcgttagagctc

SEQ ID NO: 488724 - DNA, 25 bp, Rattus norvegicus
gccatttcgttagagctcgtgagca

SEQ ID NO: 488725 - DNA, 25 bp, Rattus norvegicus
ccagaggcaaagtccgtgggaccca

SEQ ID NO: 488726 - DNA, 25 bp, Rattus norvegicus
ccagataccagaggcaaagtccgtg

SEQ ID NO: 488727 - DNA, 25 bp, Rattus norvegicus
tccagtccaagccagataccagagg

SEQ ID NO: 488728 - DNA, 25 bp, Rattus norvegicus
cggagctccagtccaagccagatac

SEQ ID NO: 488729 - DNA, 25 bp, Rattus norvegicus
tgtcacccacggcgccgtcattttt

SEQ ID NO: 488730 - DNA, 25 bp, Rattus norvegicus
tcggcttacaggtgaaatagcgctt

SEQ ID NO: 488731 - DNA, 25 bp, Rattus norvegicus
ccagcactccgtagttcggcttaca

SEQ ID NO: 488732 - DNA, 25 bp, Rattus norvegicus
actcggcttggtctaaccagcactc

SEQ ID NO: 488733 - DNA, 25 bp, Rattus norvegicus
taggtcactcggcttggtctaacca

SEQ ID NO: 488734 - DNA, 25 bp, Rattus norvegicus
ttaatccctcggtaggtcactcggc

SEQ ID NO: 488735 - DNA, 25 bp, Rattus norvegicus
tgaaatagcgcttgtcacccacggc

SEQ ID NO: 488736 - DNA, 25 bp, Rattus norvegicus
tagagctcgtgagcaggacctgaga

SEQ ID NO: 488737 - DNA, 25 bp, Rattus norvegicus
tgacctggacttgcccggcagaagc

SEQ ID NO: 488738 - DNA, 25 bp, Rattus norvegicus
ggatccagaaagtcggtaagacctc

SEQ ID NO: 488739 - DNA, 25 bp, Rattus norvegicus
cacgggccattgtccggatccagaa

SEQ ID NO: 488740 - DNA, 25 bp, Rattus norvegicus
acaattcgagtcctgcgccagggca

SEQ ID NO: 488741 - DNA, 25 bp, Rattus norvegicus
cctgaagcacaattcgagtcctgcg

SEQ ID NO: 488742 - DNA, 25 bp, Rattus norvegicus
attttaggggcagcacctgaagcac

SEQ ID NO: 488743 - DNA, 25 bp, Rattus norvegicus
ttgcccggcagaagcgacagtggtc

SEQ ID NO: 488744 - DNA, 25 bp, Rattus norvegicus
agagaactagcctgacctggacttg

SEQ ID NO: 488745 - DNA, 25 bp, Rattus norvegicus
ggaaaacgaaacagagagaactagc

SEQ ID NO: 488746 - DNA, 25 bp, Rattus norvegicus
cctacctgacttctcgcgggtgcga

SEQ ID NO: 488747 - DNA, 25 bp, Rattus norvegicus
gaggcgacacgcctacctgacttct

SEQ ID NO: 488748 - DNA, 25 bp, Rattus norvegicus
cccgggaacagaggcgacacgccta

SEQ ID NO: 488749 - DNA, 25 bp, Rattus norvegicus
attcggtcggaccttggctccggag

SEQ ID NO: 488750 - DNA, 25 bp, Rattus norvegicus
gcgacgagattttaggggcagcacc

SEQ ID NO: 488751 - DNA, 25 bp, Rattus norvegicus
ctaagctacgactacctgacggatg

SEQ ID NO: 488752 - DNA, 25 bp, Rattus norvegicus
cccaaaggtgagcagcccggttatt

SEQ ID NO: 488753 - DNA, 25 bp, Rattus norvegicus
accggaagggcgctgagtgtcatcc

SEQ ID NO: 488754 - DNA, 25 bp, Rattus norvegicus
ccctcgtcaccgatgaagacagttg

SEQ ID NO: 488755 - DNA, 25 bp, Rattus norvegicus
tgtcactgcccaagggtcggagttg

SEQ ID NO: 488756 - DNA, 25 bp, Rattus norvegicus
aggcacagtgcagagagcagcacca

SEQ ID NO: 488757 - DNA, 25 bp, Rattus norvegicus
gcaccagcgaggacaactcaccaga

SEQ ID NO: 488758 - DNA, 25 bp, Rattus norvegicus
aggcagcggcacaaaatcagcgtga

SEQ ID NO: 488759 - DNA, 25 bp, Rattus norvegicus
ttgtctacgctcagaaggtgcgcgg

SEQ ID NO: 488760 - DNA, 25 bp, Rattus norvegicus
cagaagtttcgcattgtctacgctc

SEQ ID NO: 488761 - DNA, 25 bp, Rattus norvegicus
tggcacaagatggaacagaagtttc

SEQ ID NO: 488762 - DNA, 25 bp, Rattus norvegicus
gacagttggtacaacaaatggcaca

SEQ ID NO: 488763 - DNA, 25 bp, Rattus norvegicus
gacgccggtggtcatcgattacaca

SEQ ID NO: 488764 - DNA, 25 bp, Rattus norvegicus
gtgtcatcctggtgtcactgcccaa

SEQ ID NO: 488765 - DNA, 25 bp, Rattus norvegicus
cccagctggctgcagtttttccgca

SEQ ID NO: 488766 - DNA, 25 bp, Rattus norvegicus
catggcactgacgttgccctgcggc

SEQ ID NO: 488767 - DNA, 25 bp, Rattus norvegicus
ggtccgttctcccatggcactgacg

SEQ ID NO: 488768 - DNA, 25 bp, Rattus norvegicus
ggtctccttgctgcggtccgttctc

SEQ ID NO: 488769 - DNA, 25 bp, Rattus norvegicus
tggctgcagtttttccgcaataaca

SEQ ID NO: 488770 - DNA, 25 bp, Rattus norvegicus
cgcaataacaatatcccggggaggg

SEQ ID NO: 488771 - DNA, 25 bp, Rattus norvegicus
ccgattaattatgcgccgcggagcg

SEQ ID NO: 488772 - DNA, 25 bp, Rattus norvegicus
tgcgcgccctgaaaggcctgggctt

SEQ ID NO: 488773 - DNA, 25 bp, Rattus norvegicus
ccgcgcattagcagcccagcaatta

SEQ ID NO: 488774 - DNA, 25 bp, Rattus norvegicus
gcagcccagcaattacccagcgttt

SEQ ID NO: 488775 - DNA, 25 bp, Rattus norvegicus
acccagcgttttggatgtgtccttg

SEQ ID NO: 488776 - DNA, 25 bp, Rattus norvegicus
tggatgtgtccttgtctcgctgaca

SEQ ID NO: 488777 - DNA, 25 bp, Rattus norvegicus
gtgtccttgtctcgctgacactgcg

SEQ ID NO: 488778 - DNA, 25 bp, Rattus norvegicus
ccgactcggtgaaggccgattaatt

SEQ ID NO: 488779 - DNA, 25 bp, Rattus norvegicus
catcgaagcgtctagcaccaaggtt

SEQ ID NO: 488780 - DNA, 25 bp, Rattus norvegicus
aggttcgagtaacgcagcggtcctc

SEQ ID NO: 488781 - DNA, 25 bp, Rattus norvegicus
agcggtcctcagatagcatgcccaa

SEQ ID NO: 488782 - DNA, 25 bp, Rattus norvegicus
gcagcgaatgcagctcagtactatt

SEQ ID NO: 488783 - DNA, 25 bp, Rattus norvegicus
tcagtactattccttcgtgcggatg

SEQ ID NO: 488784 - DNA, 25 bp, Rattus norvegicus
ggcccggctaaggttccgcatcgaa

SEQ ID NO: 488785 - DNA, 25 bp, Rattus norvegicus
caccaaggttggaagaagtcccgcg

SEQ ID NO: 488786 - DNA, 25 bp, Rattus norvegicus
gcagtttcgtcccaaccggtactca

SEQ ID NO: 488787 - DNA, 25 bp, Rattus norvegicus
ggtcttctacgtggcccaatgggga

SEQ ID NO: 488788 - DNA, 25 bp, Rattus norvegicus
gtcccttcggccttgaagttcaggc

SEQ ID NO: 488789 - DNA, 25 bp, Rattus norvegicus
acgtcctcgccgtgttgaacctgga

SEQ ID NO: 488790 - DNA, 25 bp, Rattus norvegicus
taagaggttggtggccactgtaaca

SEQ ID NO: 488791 - DNA, 25 bp, Rattus norvegicus
tacgcgagacgctgctaagaggttg

SEQ ID NO: 488792 - DNA, 25 bp, Rattus norvegicus
gcggacttcatatcccacgggcgca

SEQ ID NO: 488793 - DNA, 25 bp, Rattus norvegicus
cccagcaccacggtcttggagatga

SEQ ID NO: 488794 - DNA, 25 bp, Rattus norvegicus
ccacagctcctcgtaggggatctcg

SEQ ID NO: 488795 - DNA, 25 bp, Rattus norvegicus
cagcagtggagtactcgtccggatc

SEQ ID NO: 488796 - DNA, 25 bp, Rattus norvegicus
tgaccagcttatagcagtggccctc

SEQ ID NO: 488797 - DNA, 25 bp, Rattus norvegicus
ctcccgcacagggtgtaggtcgtaa

SEQ ID NO: 488798 - DNA, 25 bp, Rattus norvegicus
ctgggtaccagcacgttcaccggaa

SEQ ID NO: 488799 - DNA, 25 bp, Rattus norvegicus
tcctgcatttgtagctccagagggc

SEQ ID NO: 488800 - DNA, 25 bp, Rattus norvegicus
acagggcatcttgcctctgacgggc

SEQ ID NO: 488801 - DNA, 25 bp, Rattus norvegicus
cccaacttgcgcaggagcgtggtga

SEQ ID NO: 488802 - DNA, 25 bp, Rattus norvegicus
agcgcgagcgctctttggttgtctt

SEQ ID NO: 488803 - DNA, 25 bp, Rattus norvegicus
ttgtcttggcgcacagaatctcggc

SEQ ID NO: 488804 - DNA, 25 bp, Rattus norvegicus
cctgacccatgagagtgagctcgtc

SEQ ID NO: 488805 - DNA, 25 bp, Rattus norvegicus
cctgcgtgcagtgtgaagttgtaca

SEQ ID NO: 488806 - DNA, 25 bp, Rattus norvegicus
tcacgtactcctggtcgctgtcgct

SEQ ID NO: 488807 - DNA, 25 bp, Rattus norvegicus
ttctggcccggtgtcctaggttatc

SEQ ID NO: 488808 - DNA, 25 bp, Rattus norvegicus
ccgctactccaagccggaggcgatg

SEQ ID NO: 488809 - DNA, 25 bp, Rattus norvegicus
aggaccgctgcgttgctcacgtccg

SEQ ID NO: 488810 - DNA, 25 bp, Rattus norvegicus
agtctggacccaggaccgctgcgtt

SEQ ID NO: 488811 - DNA, 25 bp, Rattus norvegicus
caaggcctaacggagtctggaccca

SEQ ID NO: 488812 - DNA, 25 bp, Rattus norvegicus
ctaggttatcccttcgtgccaaggc

SEQ ID NO: 488813 - DNA, 25 bp, Rattus norvegicus
tagcagtcctgtgggctccaacgga

SEQ ID NO: 488814 - DNA, 25 bp, Rattus norvegicus
tcgagagtcacgtggccagcctcct

SEQ ID NO: 488815 - DNA, 25 bp, Rattus norvegicus
cagcccagcagagcctcgagagtca

SEQ ID NO: 488816 - DNA, 25 bp, Rattus norvegicus
ggaaagcgcccatgctccagcgcag

SEQ ID NO: 488817 - DNA, 25 bp, Rattus norvegicus
tcgtgccaaggcctaacggagtctg

SEQ ID NO: 488818 - DNA, 25 bp, Rattus norvegicus
aggtccagcgggaaagcgcccatgc

SEQ ID NO: 488819 - DNA, 25 bp, Rattus norvegicus
gaatgcgcctagcagtcctgtgggc

SEQ ID NO: 488820 - DNA, 25 bp, Rattus norvegicus
acagcggctgacgatgaggtccagc

SEQ ID NO: 488821 - DNA, 25 bp, Rattus norvegicus
agaatgcgggtgatcagcatggctc

SEQ ID NO: 488822 - DNA, 25 bp, Rattus norvegicus
gtcggagacttgcagcctctgctcc

SEQ ID NO: 488823 - DNA, 25 bp, Rattus norvegicus
gccgtgcacatgagcgaaatccaca

SEQ ID NO: 488824 - DNA, 25 bp, Rattus norvegicus
tgagcgaaatccacagagaccaatg

SEQ ID NO: 488825 - DNA, 25 bp, Rattus norvegicus
tccacagagaccaatgaacggcggc

SEQ ID NO: 488826 - DNA, 25 bp, Rattus norvegicus
gagaccaatgaacggcggccacggc

SEQ ID NO: 488827 - DNA, 25 bp, Rattus norvegicus
cgcaccgcccgctagaagcagaggg

SEQ ID NO: 488828 - DNA, 25 bp, Rattus norvegicus
agcatggctcgactagtgctcggta

SEQ ID NO: 488829 - DNA, 25 bp, Rattus norvegicus
ctcgactagtgctcggtaagtgcgg

SEQ ID NO: 488830 - DNA, 25 bp, Rattus norvegicus
aagtgcgggcctgcagtaagaagcc

SEQ ID NO: 488831 - DNA, 25 bp, Rattus norvegicus
atgccggaccagcttagggacttgg

SEQ ID NO: 488832 - DNA, 25 bp, Rattus norvegicus
caggtccggccctctagaggaggcc

SEQ ID NO: 488833 - DNA, 25 bp, Rattus norvegicus
ccactttcaattggccgtgcacatg

SEQ ID NO: 488834 - DNA, 25 bp, Rattus norvegicus
aagaggccaggtccggccctctaga

SEQ ID NO: 488835 - DNA, 25 bp, Rattus norvegicus
gtgcactgctaccacttaaagtccc

SEQ ID NO: 488836 - DNA, 25 bp, Rattus norvegicus
ggcgggtgattactctttgtgcact

SEQ ID NO: 488837 - DNA, 25 bp, Rattus norvegicus
gcgggtgattactctttgtgcactg

SEQ ID NO: 488838 - DNA, 25 bp, Rattus norvegicus
ctctttgtgcactgctaccacttaa

SEQ ID NO: 488839 - DNA, 25 bp, Rattus norvegicus
ctttgtgcactgctaccacttaaag

SEQ ID NO: 488840 - DNA, 25 bp, Rattus norvegicus
ttgtgcactgctaccacttaaagtc

SEQ ID NO: 488841 - DNA, 25 bp, Rattus norvegicus
tctccatttaatcgctcatcgtctt

SEQ ID NO: 488842 - DNA, 25 bp, Rattus norvegicus
tgtgcactgctaccacttaaagtcc

SEQ ID NO: 488843 - DNA, 25 bp, Rattus norvegicus
cactgctaccacttaaagtcccggt

SEQ ID NO: 488844 - DNA, 25 bp, Rattus norvegicus
tgcactgctaccacttaaagtcccg

SEQ ID NO: 488845 - DNA, 25 bp, Rattus norvegicus
tgctaccacttaaagtcccggtagc

SEQ ID NO: 488846 - DNA, 25 bp, Rattus norvegicus
gcactgctaccacttaaagtcccgg

SEQ ID NO: 488847 - DNA, 25 bp, Rattus norvegicus
cggcgggtgattactctttgtgcac

SEQ ID NO: 488848 - DNA, 25 bp, Rattus norvegicus
ctgctaccacttaaagtcccggtag

SEQ ID NO: 488849 - DNA, 25 bp, Rattus norvegicus
tcagggtactctctgctgcacatcc

SEQ ID NO: 488850 - DNA, 25 bp, Rattus norvegicus
gcttaacggagccttcggcgccact

SEQ ID NO: 488851 - DNA, 25 bp, Rattus norvegicus
gaggatgctactcccgactgaaggg

SEQ ID NO: 488852 - DNA, 25 bp, Rattus norvegicus
cccttcctctgtgcgggtggacagc

SEQ ID NO: 488853 - DNA, 25 bp, Rattus norvegicus
agagaaagaaccctgccgagcctga

SEQ ID NO: 488854 - DNA, 25 bp, Rattus norvegicus
tggctacccgttggctctgtctcca

SEQ ID NO: 488855 - DNA, 25 bp, Rattus norvegicus
gcgccggacccattccgtgaggaaa

SEQ ID NO: 488856 - DNA, 25 bp, Rattus norvegicus
tccgctaaggttcgagcacacaatg

SEQ ID NO: 488857 - DNA, 25 bp, Rattus norvegicus
cccgttctgtgctagtttcagggta

SEQ ID NO: 488858 - DNA, 25 bp, Rattus norvegicus
gtctacacagacgaaagccgcctga

SEQ ID NO: 488859 - DNA, 25 bp, Rattus norvegicus
gagtgctcgggctttcgtctacaca

SEQ ID NO: 488860 - DNA, 25 bp, Rattus norvegicus
ctggagctcagagaacccggccact

SEQ ID NO: 488861 - DNA, 25 bp, Rattus norvegicus
accagcgaccctggcatgtgcacag

SEQ ID NO: 488862 - DNA, 25 bp, Rattus norvegicus
agcacacaatggcaccgcggatcgg

SEQ ID NO: 488863 - DNA, 25 bp, Rattus norvegicus
ctcccgcgttcaggcaacagctacc

SEQ ID NO: 488864 - DNA, 25 bp, Rattus norvegicus
acagtttaggaggtttccgccgctg

SEQ ID NO: 488865 - DNA, 25 bp, Rattus norvegicus
gtgcgccacgcgcagagacagttta

SEQ ID NO: 488866 - DNA, 25 bp, Rattus norvegicus
agcctcagcacacgttccctgttga

SEQ ID NO: 488867 - DNA, 25 bp, Rattus norvegicus
cgttccctgttgaaagtacgcactt

SEQ ID NO: 488868 - DNA, 25 bp, Rattus norvegicus
agtacgcactttacgcgtccgggcg

SEQ ID NO: 488869 - DNA, 25 bp, Rattus norvegicus
aaggtggctcagttcgggcgctcca

SEQ ID NO: 488870 - DNA, 25 bp, Rattus norvegicus
tcagttcgggcgctccagtctcgac

SEQ ID NO: 488871 - DNA, 25 bp, Rattus norvegicus
ccagtctcgacgttcccggggcaga

SEQ ID NO: 488872 - DNA, 25 bp, Rattus norvegicus
cgcagagacagtttaggaggtttcc

SEQ ID NO: 488873 - DNA, 25 bp, Rattus norvegicus
cagagagcaacgtccggggacgaac

SEQ ID NO: 488874 - DNA, 25 bp, Rattus norvegicus
agtcacttgccgcgactctccgggt

SEQ ID NO: 488875 - DNA, 25 bp, Rattus norvegicus
ctgatcccaagtcgccggcagtgcg

SEQ ID NO: 488876 - DNA, 25 bp, Rattus norvegicus
ttcccggggcagagagcaacgtccg

SEQ ID NO: 488877 - DNA, 25 bp, Rattus norvegicus
acccgcccgttggtgctcaattttg

SEQ ID NO: 488878 - DNA, 25 bp, Rattus norvegicus
tgagatcgggctcctagtccctagc

SEQ ID NO: 488879 - DNA, 25 bp, Rattus norvegicus
gatccctcagggctcaagttgcaag

SEQ ID NO: 488880 - DNA, 25 bp, Rattus norvegicus
ggagtctcccgccaattcaagcttt

SEQ ID NO: 488881 - DNA, 25 bp, Rattus norvegicus
cgtgtcagcgcagcaagagtacttc

SEQ ID NO: 488882 - DNA, 25 bp, Rattus norvegicus
gcgcgacgttgacttccttatcatc

SEQ ID NO: 488883 - DNA, 25 bp, Rattus norvegicus
tggcagctgtacctgaccaccgttc

SEQ ID NO: 488884 - DNA, 25 bp, Rattus norvegicus
tggcccagcacctaactcggaggtc

SEQ ID NO: 488885 - DNA, 25 bp, Rattus norvegicus
gatttcttcaagcaggcccatgagg

SEQ ID NO: 488886 - DNA, 25 bp, Rattus norvegicus
cgtatccgacgacaaccggctgtgc

SEQ ID NO: 488887 - DNA, 25 bp, Rattus norvegicus
gcccgaagtagagctcaacagtgaa

SEQ ID NO: 488888 - DNA, 25 bp, Rattus norvegicus
ggtcaccaagtaccagcgcgacgtt

SEQ ID NO: 488889 - DNA, 25 bp, Rattus norvegicus
gcaagcatttcctgcgccgtcgtca

SEQ ID NO: 488890 - DNA, 25 bp, Rattus norvegicus
cacggccttcatgctctggctttta

SEQ ID NO: 488891 - DNA, 25 bp, Rattus norvegicus
gtacaccgatgtccggacttgccta

SEQ ID NO: 488892 - DNA, 25 bp, Rattus norvegicus
tttctcccttttgtacaccgatgtc

SEQ ID NO: 488893 - DNA, 25 bp, Rattus norvegicus
atgtccggacttgcctatctgcccg

SEQ ID NO: 488894 - DNA, 25 bp, Rattus norvegicus
cgctgaaagaggttattacgtcatc

SEQ ID NO: 488895 - DNA, 25 bp, Rattus norvegicus
cagcttccggggtgaagcgctgaaa

SEQ ID NO: 488896 - DNA, 25 bp, Rattus norvegicus
gtttcccagcagcttccggggtgaa

SEQ ID NO: 488897 - DNA, 25 bp, Rattus norvegicus
acgctgccctggaggtttcccagca

SEQ ID NO: 488898 - DNA, 25 bp, Rattus norvegicus
cagaggcctctacgctccggacgga

SEQ ID NO: 488899 - DNA, 25 bp, Rattus norvegicus
gtgtgcctaaaatacaattcccaga

SEQ ID NO: 488900 - DNA, 25 bp, Rattus norvegicus
gcctactgaggtcaccgtgtgccta

SEQ ID NO: 488901 - DNA, 25 bp, Rattus norvegicus
aaagccttaggggtggcctactgag

SEQ ID NO: 488902 - DNA, 25 bp, Rattus norvegicus
gcacctcgttgtgaaactacaattc

SEQ ID NO: 488903 - DNA, 25 bp, Rattus norvegicus
ccgttcccagcacctcgttgtgaaa

SEQ ID NO: 488904 - DNA, 25 bp, Rattus norvegicus
gttattacgtcatccagcacgcacc

SEQ ID NO: 488905 - DNA, 25 bp, Rattus norvegicus
tagaaggaggccgagcgagccaatc

SEQ ID NO: 488906 - DNA, 25 bp, Rattus norvegicus
ccggtccggagcgccgagctgtcat

SEQ ID NO: 488907 - DNA, 25 bp, Rattus norvegicus
gcgagccaatccgaggtgacgagga

SEQ ID NO: 488908 - DNA, 25 bp, Rattus norvegicus
gccggcgccaacagtcctgcccgcc

SEQ ID NO: 488909 - DNA, 25 bp, Rattus norvegicus
ctccgaccaggagccgtatttccgg

SEQ ID NO: 488910 - DNA, 25 bp, Rattus norvegicus
cattctccgcgggacatgaaggccc

SEQ ID NO: 488911 - DNA, 25 bp, Rattus norvegicus
cataactatcattctccgcgggaca

SEQ ID NO: 488912 - DNA, 25 bp, Rattus norvegicus
tcacccattggtcaacataactatc

SEQ ID NO: 488913 - DNA, 25 bp, Rattus norvegicus
tgcagcagccgagattcaccctcgg

SEQ ID NO: 488914 - DNA, 25 bp, Rattus norvegicus
tcctctcacccattggtcaacataa

SEQ ID NO: 488915 - DNA, 25 bp, Rattus norvegicus
cgctcaccagctggctggtggtcct

SEQ ID NO: 488916 - DNA, 25 bp, Rattus norvegicus
taacggacgggtgcaccctacagcc

SEQ ID NO: 488917 - DNA, 25 bp, Rattus norvegicus
gcagaacccagacgaccgccacgct

SEQ ID NO: 488918 - DNA, 25 bp, Rattus norvegicus
gccacccagccgcaggtgaggcgcc

SEQ ID NO: 488919 - DNA, 25 bp, Rattus norvegicus
caaggtcatcagagtgtcggacagc

SEQ ID NO: 488920 - DNA, 25 bp, Rattus norvegicus
cgagggtcggttcttcaaggtcatc

SEQ ID NO: 488921 - DNA, 25 bp, Rattus norvegicus
tgctgctccgcgtcctatagaaggc

SEQ ID NO: 488922 - DNA, 25 bp, Rattus norvegicus
tgcccaggcccagcaaaaaggttca

SEQ ID NO: 488923 - DNA, 25 bp, Rattus norvegicus
cgggagtttacaatttatagcgagc

SEQ ID NO: 488924 - DNA, 25 bp, Rattus norvegicus
cacttagctccgtggcgggagttta

SEQ ID NO: 488925 - DNA, 25 bp, Rattus norvegicus
tgtcggacagcaatggcaaacttct

SEQ ID NO: 488926 - DNA, 25 bp, Rattus norvegicus
tttccagaccgcgtgggtattgctg

SEQ ID NO: 488927 - DNA, 25 bp, Rattus norvegicus
gacttgcgatcgctggaactttcca

SEQ ID NO: 488928 - DNA, 25 bp, Rattus norvegicus
cccggagagtccagacttgcgatcg

SEQ ID NO: 488929 - DNA, 25 bp, Rattus norvegicus
gcgcttgcacctggccacagtagct

SEQ ID NO: 488930 - DNA, 25 bp, Rattus norvegicus
tctcaggtcaaggtcgccgcctgga

SEQ ID NO: 488931 - DNA, 25 bp, Rattus norvegicus
cgctccttgcggctctcaggtcaag

SEQ ID NO: 488932 - DNA, 25 bp, Rattus norvegicus
ggaccctcagagaacccgcttcatt

SEQ ID NO: 488933 - DNA, 25 bp, Rattus norvegicus
atgttttttccgctctctcccggca

SEQ ID NO: 488934 - DNA, 25 bp, Rattus norvegicus
gtgaattactacatccggtggaacc

SEQ ID NO: 488935 - DNA, 25 bp, Rattus norvegicus
ctggaactgtgggtgaattactaca

SEQ ID NO: 488936 - DNA, 25 bp, Rattus norvegicus
accagcgtgcgccacctggaactgt

SEQ ID NO: 488937 - DNA, 25 bp, Rattus norvegicus
tgatctacccggtcaccagcgtgcg

SEQ ID NO: 488938 - DNA, 25 bp, Rattus norvegicus
gagagcaaccgcgtgatctacccgg

SEQ ID NO: 488939 - DNA, 25 bp, Rattus norvegicus
ccgttctacgcaagggagagcaacc

SEQ ID NO: 488940 - DNA, 25 bp, Rattus norvegicus
tcacaaacccgttctacgcaaggga

SEQ ID NO: 488941 - DNA, 25 bp, Rattus norvegicus
gcaacaaagacgaattcacaaaccc

SEQ ID NO: 488942 - DNA, 25 bp, Rattus norvegicus
ggtccctgatcaacagcaacaaaga

SEQ ID NO: 488943 - DNA, 25 bp, Rattus norvegicus
tgtctgtgtggtccctgatcaacag

SEQ ID NO: 488944 - DNA, 25 bp, Rattus norvegicus
agagactcgcagaaaggacggtgtc

SEQ ID NO: 488945 - DNA, 25 bp, Rattus norvegicus
tcccggcacagagactcgcagaaag

SEQ ID NO: 488946 - DNA, 25 bp, Rattus norvegicus
tgagtgcgaagacgaccctctcacg

SEQ ID NO: 488947 - DNA, 25 bp, Rattus norvegicus
cggccaacggctcgctaacgcgaga

SEQ ID NO: 488948 - DNA, 25 bp, Rattus norvegicus
gagcacttgtcggtgccgccgtaag

SEQ ID NO: 488949 - DNA, 25 bp, Rattus norvegicus
actcgtgtgtgagctttccgccatg

SEQ ID NO: 488950 - DNA, 25 bp, Rattus norvegicus
gccttaggcctcaaactcgtgtgtg

SEQ ID NO: 488951 - DNA, 25 bp, Rattus norvegicus
ctctgggaacttagccttaggcctc

SEQ ID NO: 488952 - DNA, 25 bp, Rattus norvegicus
gcctgtttcactcggaactctggga

SEQ ID NO: 488953 - DNA, 25 bp, Rattus norvegicus
ttcaccatgtgagtgcgacatcccg

SEQ ID NO: 488954 - DNA, 25 bp, Rattus norvegicus
tctcgtgccagagatcccacttttc

SEQ ID NO: 488955 - DNA, 25 bp, Rattus norvegicus
ttgcattctgggcatcgaggccgag

SEQ ID NO: 488956 - DNA, 25 bp, Rattus norvegicus
cccgggcattttgctgcgtcaccag

SEQ ID NO: 488957 - DNA, 25 bp, Rattus norvegicus
accgcgcagtctggaagtagtgact

SEQ ID NO: 488958 - DNA, 25 bp, Rattus norvegicus
gagatctctagaaaaccgcgcagtc

SEQ ID NO: 488959 - DNA, 25 bp, Rattus norvegicus
ccgccgtaagccagtgctaccggta

SEQ ID NO: 488960 - DNA, 25 bp, Rattus norvegicus
tttcctccctagacggcctgtttca

SEQ ID NO: 488961 - DNA, 25 bp, Rattus norvegicus
atctcgtacacgttctgctggtcca

SEQ ID NO: 488962 - DNA, 25 bp, Rattus norvegicus
gcagccgggccgcactcaggatgtc

SEQ ID NO: 488963 - DNA, 25 bp, Rattus norvegicus
agcgtggctgtgtaggcaaagtcca

SEQ ID NO: 488964 - DNA, 25 bp, Rattus norvegicus
cggcgctcacaaagtcaatctcgta

SEQ ID NO: 488965 - DNA, 25 bp, Rattus norvegicus
atgtcgcccacattggccgtgctga

SEQ ID NO: 488966 - DNA, 25 bp, Rattus norvegicus
gctggtccacgacagcgcccgaagt

SEQ ID NO: 488967 - DNA, 25 bp, Rattus norvegicus
gcgcccgaagtgaacagcttcttga

SEQ ID NO: 488968 - DNA, 25 bp, Rattus norvegicus
agcttcttgaagtactgactgcagg

SEQ ID NO: 488969 - DNA, 25 bp, Rattus norvegicus
aagtactgactgcaggcggccagca

SEQ ID NO: 488970 - DNA, 25 bp, Rattus norvegicus
cgatgcgtggggaactcacgtccct

SEQ ID NO: 488971 - DNA, 25 bp, Rattus norvegicus
tgagtccgctgctcattcaggccgc

SEQ ID NO: 488972 - DNA, 25 bp, Rattus norvegicus
tcattcaggccgctcaggatgtcgc

SEQ ID NO: 488973 - DNA, 25 bp, Rattus norvegicus
ctcaggatgtcgctgctgtggtctg

SEQ ID NO: 488974 - DNA, 25 bp, Rattus norvegicus
gcaaagtccatgagcgccgtcagcg

SEQ ID NO: 488975 - DNA, 25 bp, Rattus norvegicus
tgcaggctcacttcaagcagcggga

SEQ ID NO: 488976 - DNA, 25 bp, Rattus norvegicus
cctgcagatctcagtgatccggatc

SEQ ID NO: 488977 - DNA, 25 bp, Rattus norvegicus
acgacggggaaatgaacaacctgca

SEQ ID NO: 488978 - DNA, 25 bp, Rattus norvegicus
cggccacagacgacgacggggaaat

SEQ ID NO: 488979 - DNA, 25 bp, Rattus norvegicus
cagcagcgtggagaagtacatcatc

SEQ ID NO: 488980 - DNA, 25 bp, Rattus norvegicus
aacggaaccaccagcggcatcggca

SEQ ID NO: 488981 - DNA, 25 bp, Rattus norvegicus
atatccaccggaacggcgacttcca

SEQ ID NO: 488982 - DNA, 25 bp, Rattus norvegicus
accacacgggcgtggatatccaccg

SEQ ID NO: 488983 - DNA, 25 bp, Rattus norvegicus
tgcatcgccaaccacacgggcgtgg

SEQ ID NO: 488984 - DNA, 25 bp, Rattus norvegicus
atccggatcaagaagggcgtggcct

SEQ ID NO: 488985 - DNA, 25 bp, Rattus norvegicus
ccctcgacgagctgtatgagaagaa

SEQ ID NO: 488986 - DNA, 25 bp, Rattus norvegicus
aggtgcacgccttcatgcaggctca

SEQ ID NO: 488987 - DNA, 25 bp, Rattus norvegicus
cctggaccaaagtgaaggtgcacgc

SEQ ID NO: 488988 - DNA, 25 bp, Rattus norvegicus
ctgtatgagaagaaggccaactgca

SEQ ID NO: 488989 - DNA, 25 bp, Rattus norvegicus
atcaagggcgccaaagggatccgca

SEQ ID NO: 488990 - DNA, 25 bp, Rattus norvegicus
cttcgcatacgtgaagcacgaggcc

SEQ ID NO: 488991 - DNA, 25 bp, Rattus norvegicus
cgtgaagcacgaggccggcattgac

SEQ ID NO: 488992 - DNA, 25 bp, Rattus norvegicus
ggcatgtccaacttcgcatacgtga

SEQ ID NO: 488993 - DNA, 25 bp, Rattus norvegicus
gagttatccgattggcccgtattgg

SEQ ID NO: 488994 - DNA, 25 bp, Rattus norvegicus
ttggcccgtattgggcgcatcttgc

SEQ ID NO: 488995 - DNA, 25 bp, Rattus norvegicus
attgggcgcatcttgcgtctgatca

SEQ ID NO: 488996 - DNA, 25 bp, Rattus norvegicus
tgcgtctgatcaagggcgccaaagg

SEQ ID NO: 488997 - DNA, 25 bp, Rattus norvegicus
aaagggatccgcaccctgctctttg

SEQ ID NO: 488998 - DNA, 25 bp, Rattus norvegicus
caccctgctctttgccttaatgatg

SEQ ID NO: 488999 - DNA, 25 bp, Rattus norvegicus
gccttaatgatgtcgctgcccgccc

SEQ ID NO: 489000 - DNA, 25 bp, Rattus norvegicus
gtcatgttcatcttctccatttttg

SEQ ID NO: 489001 - DNA, 25 bp, Rattus norvegicus
ctccatttttggcatgtccaacttc

SEQ ID NO: 489002 - DNA, 25 bp, Rattus norvegicus
atcttgcgtctgatcaagggcgcca

SEQ ID NO: 489003 - DNA, 25 bp, Rattus norvegicus
agctccttgtccacgtcgggctcgg

SEQ ID NO: 489004 - DNA, 25 bp, Rattus norvegicus
tcgccggtgatccacagcgttagca

SEQ ID NO: 489005 - DNA, 25 bp, Rattus norvegicus
ccacagcgttagcaaggtgatcagc

SEQ ID NO: 489006 - DNA, 25 bp, Rattus norvegicus
ggcgctccacgatcagttccaactg

SEQ ID NO: 489007 - DNA, 25 bp, Rattus norvegicus
ctggagccctaagctgctgcatgta

SEQ ID NO: 489008 - DNA, 25 bp, Rattus norvegicus
aagagatcggaagtggctgcactcc

SEQ ID NO: 489009 - DNA, 25 bp, Rattus norvegicus
ccgcagctgcaacgtcgcttgctga

SEQ ID NO: 489010 - DNA, 25 bp, Rattus norvegicus
acgagaccacgcagggtcgccatcg

SEQ ID NO: 489011 - DNA, 25 bp, Rattus norvegicus
ctgatggaggttcttggccagctcc

SEQ ID NO: 489012 - DNA, 25 bp, Rattus norvegicus
ggcagccgtcggaaacctccctgga

SEQ ID NO: 489013 - DNA, 25 bp, Rattus norvegicus
tggactcgggcacgaccttcgtctc

SEQ ID NO: 489014 - DNA, 25 bp, Rattus norvegicus
gtctccttcgaaggctgtacggctg

SEQ ID NO: 489015 - DNA, 25 bp, Rattus norvegicus
cccgagcttgactatggatggctcg

SEQ ID NO: 489016 - DNA, 25 bp, Rattus norvegicus
gtcagcagttccgacaggcggactg

SEQ ID NO: 489017 - DNA, 25 bp, Rattus norvegicus
gcagtagccggacgccaggtacccg

SEQ ID NO: 489018 - DNA, 25 bp, Rattus norvegicus
ttgccggtcccatcctctgtggttc

SEQ ID NO: 489019 - DNA, 25 bp, Rattus norvegicus
tagcccgccgcgtactcggtggcag

SEQ ID NO: 489020 - DNA, 25 bp, Rattus norvegicus
gcgctgcacttgtctgcgcgcagta

SEQ ID NO: 489021 - DNA, 25 bp, Rattus norvegicus
cacgcgttgcccgtgtagagaggct

SEQ ID NO: 489022 - DNA, 25 bp, Rattus norvegicus
ccatcctctgtggttccgggtggct

SEQ ID NO: 489023 - DNA, 25 bp, Rattus norvegicus
agcactttgagagaaccgccgccgc

SEQ ID NO: 489024 - DNA, 25 bp, Rattus norvegicus
gggagcccagcactttgagagaacc

SEQ ID NO: 489025 - DNA, 25 bp, Rattus norvegicus
gctgggacccgctccgcaaacttgt

SEQ ID NO: 489026 - DNA, 25 bp, Rattus norvegicus
ctcgtacgcgtacttgcggtagcgg

SEQ ID NO: 489027 - DNA, 25 bp, Rattus norvegicus
cgaatcctccgtgcgcggctgggac

SEQ ID NO: 489028 - DNA, 25 bp, Rattus norvegicus
gggtccgcagtccaccatcttgctg

SEQ ID NO: 489029 - DNA, 25 bp, Rattus norvegicus
ggcggcctcagcaagggccacagca

SEQ ID NO: 489030 - DNA, 25 bp, Rattus norvegicus
ccttggcgggctcgtacgcgtactt

SEQ ID NO: 489031 - DNA, 25 bp, Rattus norvegicus
ggaaatgaccctggactcccacgca

SEQ ID NO: 489032 - DNA, 25 bp, Rattus norvegicus
ccgcttcctgggtcgaagggcaaag

SEQ ID NO: 489033 - DNA, 25 bp, Rattus norvegicus
gactgagctcttggctgccctgagt

SEQ ID NO: 489034 - DNA, 25 bp, Rattus norvegicus
aatgaccctcggtgcgagagtgtcc

SEQ ID NO: 489035 - DNA, 25 bp, Rattus norvegicus
aaagagcaaatgaccctcggtgcga

SEQ ID NO: 489036 - DNA, 25 bp, Rattus norvegicus
ctcgaaaataaattagccacccagg

SEQ ID NO: 489037 - DNA, 25 bp, Rattus norvegicus
acacaggggccgctggacaaagacc

SEQ ID NO: 489038 - DNA, 25 bp, Rattus norvegicus
cgcccgcggacaaagctctggacat

SEQ ID NO: 489039 - DNA, 25 bp, Rattus norvegicus
ctgaggggcgatctcattgctggtc

SEQ ID NO: 489040 - DNA, 25 bp, Rattus norvegicus
ctcctcggctccagattgggcggtg

SEQ ID NO: 489041 - DNA, 25 bp, Rattus norvegicus
tcaggccgccggatccttctgggac

SEQ ID NO: 489042 - DNA, 25 bp, Rattus norvegicus
cgctggacaaagacctgacggagtg

SEQ ID NO: 489043 - DNA, 25 bp, Rattus norvegicus
tctggacatcggaccgcacagtcgc

SEQ ID NO: 489044 - DNA, 25 bp, Rattus norvegicus
tgcgagagtgtccttgcgccactct

SEQ ID NO: 489045 - DNA, 25 bp, Rattus norvegicus
cctctggagccgagctctgatgctc

SEQ ID NO: 489046 - DNA, 25 bp, Rattus norvegicus
atgcaagtttctgcctctgggtgcg

SEQ ID NO: 489047 - DNA, 25 bp, Rattus norvegicus
tctgcctctgggtgcgcgttaccct

SEQ ID NO: 489048 - DNA, 25 bp, Rattus norvegicus
gtgctgggcaataggaaacgagtta

SEQ ID NO: 489049 - DNA, 25 bp, Rattus norvegicus
gaataagaaacattttgctccagcc

SEQ ID NO: 489050 - DNA, 25 bp, Rattus norvegicus
ttctgcggccctctggagccgagct

SEQ ID NO: 489051 - DNA, 25 bp, Rattus norvegicus
ctgaagcccgcacggatgcaagttt

SEQ ID NO: 489052 - DNA, 25 bp, Rattus norvegicus
atggtcctgcctagaactcacgggg

SEQ ID NO: 489053 - DNA, 25 bp, Rattus norvegicus
agctcagtccaaatggtcctgccta

SEQ ID NO: 489054 - DNA, 25 bp, Rattus norvegicus
ttccgcagccagctcagtccaaatg

SEQ ID NO: 489055 - DNA, 25 bp, Rattus norvegicus
ggcctagagtgacgcttccgcagcc

SEQ ID NO: 489056 - DNA, 25 bp, Rattus norvegicus
cctgtcgcccggtccaaaggtgagt

SEQ ID NO: 489057 - DNA, 25 bp, Rattus norvegicus
tctcctggcctagagtgacgcttcc

SEQ ID NO: 489058 - DNA, 25 bp, Rattus norvegicus
ggccaggcaggaagaagctagaata

SEQ ID NO: 489059 - DNA, 25 bp, Rattus norvegicus
ccggctaaatatagcagcttccaga

SEQ ID NO: 489060 - DNA, 25 bp, Rattus norvegicus
gttccgcgtgcgctctgcaatcctt

SEQ ID NO: 489061 - DNA, 25 bp, Rattus norvegicus
ccgctgcaccggctaaatatagcag

SEQ ID NO: 489062 - DNA, 25 bp, Rattus norvegicus
aatagttttcctctcgcccgctgca

SEQ ID NO: 489063 - DNA, 25 bp, Rattus norvegicus
gcgcggattgtttgatctataaata

SEQ ID NO: 489064 - DNA, 25 bp, Rattus norvegicus
gggagcgcggattgtttgatctata

SEQ ID NO: 489065 - DNA, 25 bp, Rattus norvegicus
ttccattgacgcagggagcgcggat

SEQ ID NO: 489066 - DNA, 25 bp, Rattus norvegicus
acgcacgcggggttccattgacgca

SEQ ID NO: 489067 - DNA, 25 bp, Rattus norvegicus
cctggaatgtctgcgcgcgtgacgc

SEQ ID NO: 489068 - DNA, 25 bp, Rattus norvegicus
cgagctttggccatacaagggcgcg

SEQ ID NO: 489069 - DNA, 25 bp, Rattus norvegicus
gcccggcgagctttggccatacaag

SEQ ID NO: 489070 - DNA, 25 bp, Rattus norvegicus
gccactgacgcacacggcccggcga

SEQ ID NO: 489071 - DNA, 25 bp, Rattus norvegicus
gacccacctcttaagcgctccgtga

SEQ ID NO: 489072 - DNA, 25 bp, Rattus norvegicus
atagcagcttccagacccactaggc

SEQ ID NO: 489073 - DNA, 25 bp, Rattus norvegicus
ggctctgtgtcttcgctgagcgcca

SEQ ID NO: 489074 - DNA, 25 bp, Rattus norvegicus
cccttgtggcccagataatggtcga

SEQ ID NO: 489075 - DNA, 25 bp, Rattus norvegicus
accggaatggtgaccgaaccgctga

SEQ ID NO: 489076 - DNA, 25 bp, Rattus norvegicus
tccgtccagggacacgaaccaggcg

SEQ ID NO: 489077 - DNA, 25 bp, Rattus norvegicus
ggtgaggcttcacgcccagttccag

SEQ ID NO: 489078 - DNA, 25 bp, Rattus norvegicus
agcttcttctcggtcagagcctgca

SEQ ID NO: 489079 - DNA, 25 bp, Rattus norvegicus
gccatggtggactcgttgaacagca

SEQ ID NO: 489080 - DNA, 25 bp, Rattus norvegicus
cacttgcgagttggaacgtccgtcc

SEQ ID NO: 489081 - DNA, 25 bp, Rattus norvegicus
cgcacatagtgtgcggggatgacca

SEQ ID NO: 489082 - DNA, 25 bp, Rattus norvegicus
tgggcatgacattgcggtacacgtt

SEQ ID NO: 489083 - DNA, 25 bp, Rattus norvegicus
tacacgttgtccttgaggtggtcga

SEQ ID NO: 489084 - DNA, 25 bp, Rattus norvegicus
gcgccaactggtccaccgactgtga

SEQ ID NO: 489085 - DNA, 25 bp, Rattus norvegicus
gccggtattcttccaggctgggctc

SEQ ID NO: 489086 - DNA, 25 bp, Rattus norvegicus
tggtcgatggaaccgcagaaaatga

SEQ ID NO: 489087 - DNA, 25 bp, Rattus norvegicus
actcaaccgactggagggtcgcggc

SEQ ID NO: 489088 - DNA, 25 bp, Rattus norvegicus
gcgccaccacttcgcggagggagga

SEQ ID NO: 489089 - DNA, 25 bp, Rattus norvegicus
ccctggaggcgaacccagtgggact

SEQ ID NO: 489090 - DNA, 25 bp, Rattus norvegicus
aaaacacagacgctcgcacaggtag

SEQ ID NO: 489091 - DNA, 25 bp, Rattus norvegicus
cgcggcggtggcctcaccggctccc

SEQ ID NO: 489092 - DNA, 25 bp, Rattus norvegicus
ctcagctccgcaccggcgcgcgagg

SEQ ID NO: 489093 - DNA, 25 bp, Rattus norvegicus
accggctcccgggagctcacgtgcc

SEQ ID NO: 489094 - DNA, 25 bp, Rattus norvegicus
ggaggcgaacccagtgggactcaac

SEQ ID NO: 489095 - DNA, 25 bp, Rattus norvegicus
agactcgtggggacgccggctagga

SEQ ID NO: 489096 - DNA, 25 bp, Rattus norvegicus
tccagcggactgcaggggtggagac

SEQ ID NO: 489097 - DNA, 25 bp, Rattus norvegicus
ctcgcacaggtagttgggtccagcg

SEQ ID NO: 489098 - DNA, 25 bp, Rattus norvegicus
acgctcgcacaggtagttgggtcca

SEQ ID NO: 489099 - DNA, 25 bp, Rattus norvegicus
cacagacgctcgcacaggtagttgg

SEQ ID NO: 489100 - DNA, 25 bp, Rattus norvegicus
gttggcctaggcgagagcctccgcc

SEQ ID NO: 489101 - DNA, 25 bp, Rattus norvegicus
cttcctcgagatgtggaggtccctg

SEQ ID NO: 489102 - DNA, 25 bp, Rattus norvegicus
gtgggtcagccttggggacccgcgc

SEQ ID NO: 489103 - DNA, 25 bp, Rattus norvegicus
ggacccgcgcgctctaacaggcgga

SEQ ID NO: 489104 - DNA, 25 bp, Rattus norvegicus
gcgcgctctaacaggcggagcccga

SEQ ID NO: 489105 - DNA, 25 bp, Rattus norvegicus
ccagcccaggcttcctcgagatgtg

SEQ ID NO: 489106 - DNA, 25 bp, Rattus norvegicus
agcccaggcttcctcgagatgtgga

SEQ ID NO: 489107 - DNA, 25 bp, Rattus norvegicus
caggcttcctcgagatgtggaggtc

SEQ ID NO: 489108 - DNA, 25 bp, Rattus norvegicus
tcctcgagatgtggaggtccctggc

SEQ ID NO: 489109 - DNA, 25 bp, Rattus norvegicus
cctcgagatgtggaggtccctggct

SEQ ID NO: 489110 - DNA, 25 bp, Rattus norvegicus
tcgagatgtggaggtccctggctcc

SEQ ID NO: 489111 - DNA, 25 bp, Rattus norvegicus
gagatgtggaggtccctggctcctc

SEQ ID NO: 489112 - DNA, 25 bp, Rattus norvegicus
gctcctcctgcccttcagcacgtcc

SEQ ID NO: 489113 - DNA, 25 bp, Rattus norvegicus
tcctgcccttcagcacgtccgtgcg

SEQ ID NO: 489114 - DNA, 25 bp, Rattus norvegicus
cccaggcttcctcgagatgtggagg

SEQ ID NO: 489115 - DNA, 25 bp, Rattus norvegicus
tataaagcaaggctacacgaggccc

SEQ ID NO: 489116 - DNA, 25 bp, Rattus norvegicus
acgcctctcgggagtctataaagca

SEQ ID NO: 489117 - DNA, 25 bp, Rattus norvegicus
gacccttcgccgactcaggaagctg

SEQ ID NO: 489118 - DNA, 25 bp, Rattus norvegicus
agttcgggtggctctccgtcccatt

SEQ ID NO: 489119 - DNA, 25 bp, Rattus norvegicus
tcagagggcgcaagtctgcccactc

SEQ ID NO: 489120 - DNA, 25 bp, Rattus norvegicus
tcggccttgtcctcagagggcgcaa

SEQ ID NO: 489121 - DNA, 25 bp, Rattus norvegicus
gggccactcgccttgttcggccttg

SEQ ID NO: 489122 - DNA, 25 bp, Rattus norvegicus
ggatgactgccacattcctcggctc

SEQ ID NO: 489123 - DNA, 25 bp, Rattus norvegicus
aactcacacgtagccgcgccggatg

SEQ ID NO: 489124 - DNA, 25 bp, Rattus norvegicus
cttcggcaggtccaactcacacgta

SEQ ID NO: 489125 - DNA, 25 bp, Rattus norvegicus
cgaaaggtgcgttacttaacctgca

SEQ ID NO: 489126 - DNA, 25 bp, Rattus norvegicus
ttggaggactatcaccctgcggagc

SEQ ID NO: 489127 - DNA, 25 bp, Rattus norvegicus
ctgtacgcagcattggaggactatc

SEQ ID NO: 489128 - DNA, 25 bp, Rattus norvegicus
atctaccggagtgagtgcggcctcc

SEQ ID NO: 489129 - DNA, 25 bp, Rattus norvegicus
cgggagaacagatcgggctgcaatt

SEQ ID NO: 489130 - DNA, 25 bp, Rattus norvegicus
gcccaggcagcttacctcgcgggga

SEQ ID NO: 489131 - DNA, 25 bp, Rattus norvegicus
atccaatccgttccgctcagtacgg

SEQ ID NO: 489132 - DNA, 25 bp, Rattus norvegicus
ggccgggcaaccttggtatccagaa

SEQ ID NO: 489133 - DNA, 25 bp, Rattus norvegicus
actcgtctccggctatggccgggca

SEQ ID NO: 489134 - DNA, 25 bp, Rattus norvegicus
ttgcaaacttagcacgcgacgcgcc

SEQ ID NO: 489135 - DNA, 25 bp, Rattus norvegicus
cccaggccctattgcaaacttagca

SEQ ID NO: 489136 - DNA, 25 bp, Rattus norvegicus
gcttgcccactaccactcagaaagg

SEQ ID NO: 489137 - DNA, 25 bp, Rattus norvegicus
cttcctggtttgtccgagggcaaga

SEQ ID NO: 489138 - DNA, 25 bp, Rattus norvegicus
ctcgtcttaaaggtgccgcagcgcc

SEQ ID NO: 489139 - DNA, 25 bp, Rattus norvegicus
gcggccagaacaggctctgcaggtc

SEQ ID NO: 489140 - DNA, 25 bp, Rattus norvegicus
tctgcaggtcggctcttgccacgtc

SEQ ID NO: 489141 - DNA, 25 bp, Rattus norvegicus
agcctgctggcttatctacggccca

SEQ ID NO: 489142 - DNA, 25 bp, Rattus norvegicus
gatgctcgcgactcccttcctggtt

SEQ ID NO: 489143 - DNA, 25 bp, Rattus norvegicus
tacgtaagaccaagtaccgcagctt

SEQ ID NO: 489144 - DNA, 25 bp, Rattus norvegicus
tgcgctcctgcctctacggcgcagg

SEQ ID NO: 489145 - DNA, 25 bp, Rattus norvegicus
cgtgtatcacacgtgcttctttggg

SEQ ID NO: 489146 - DNA, 25 bp, Rattus norvegicus
agactccggcgtccgtgctgtgtcc

SEQ ID NO: 489147 - DNA, 25 bp, Rattus norvegicus
cgtgccacgctcagccgcagcgcca

SEQ ID NO: 489148 - DNA, 25 bp, Rattus norvegicus
caggagccctctggactgaggcccg

SEQ ID NO: 489149 - DNA, 25 bp, Rattus norvegicus
ccctctggactgaggcccgtgagca

SEQ ID NO: 489150 - DNA, 25 bp, Rattus norvegicus
actgaggcccgtgagcaggccctgt

SEQ ID NO: 489151 - DNA, 25 bp, Rattus norvegicus
gcgccggtctacgtaagaccaagta

SEQ ID NO: 489152 - DNA, 25 bp, Rattus norvegicus
gaccaagtaccgcagcttccgcagg

SEQ ID NO: 489153 - DNA, 25 bp, Rattus norvegicus
ttccgcaggcggctgctcaaattca

SEQ ID NO: 489154 - DNA, 25 bp, Rattus norvegicus
gcaggcggctgctcaaattcatccc

SEQ ID NO: 489155 - DNA, 25 bp, Rattus norvegicus
tgcggcgccggtctacgtaagacca

SEQ ID NO: 489156 - DNA, 25 bp, Rattus norvegicus
cttcccggctcgctgccctttgggc

SEQ ID NO: 489157 - DNA, 25 bp, Rattus norvegicus
tgtaatggaatcctggctcgccggc

SEQ ID NO: 489158 - DNA, 25 bp, Rattus norvegicus
gctcgcccagggctcggctttgctt

SEQ ID NO: 489159 - DNA, 25 bp, Rattus norvegicus
ctccctgcggattgcgcggtgacgt

SEQ ID NO: 489160 - DNA, 25 bp, Rattus norvegicus
cggcttgggtgatgtaatggaatcc

SEQ ID NO: 489161 - DNA, 25 bp, Rattus norvegicus
cagcagtgtttacagcgcggcttgg

SEQ ID NO: 489162 - DNA, 25 bp, Rattus norvegicus
caatggctgcagcagtgtttacagc

SEQ ID NO: 489163 - DNA, 25 bp, Rattus norvegicus
tcacgccattggctgcgagtgcggt

SEQ ID NO: 489164 - DNA, 25 bp, Rattus norvegicus
gctttgcttcgtggcccgccgagtt

SEQ ID NO: 489165 - DNA, 25 bp, Rattus norvegicus
gatttgcatgctctcacgccattgg

SEQ ID NO: 489166 - DNA, 25 bp, Rattus norvegicus
ccgccgagtttcttccggctcggtg

SEQ ID NO: 489167 - DNA, 25 bp, Rattus norvegicus
agctcgggccaaatccggtctccgg

SEQ ID NO: 489168 - DNA, 25 bp, Rattus norvegicus
tcttccggctcggtgttccggtggc

SEQ ID NO: 489169 - DNA, 25 bp, Rattus norvegicus
gttggctcaacgacgatttgcatgc

SEQ ID NO: 489170 - DNA, 25 bp, Rattus norvegicus
attgcgcggtgacgtagcggcttcc

SEQ ID NO: 489171 - DNA, 25 bp, Rattus norvegicus
ctgtttctaggggtagtgcatgaaa

SEQ ID NO: 489172 - DNA, 25 bp, Rattus norvegicus
catctgtttctaggggtagtgcatg

SEQ ID NO: 489173 - DNA, 25 bp, Rattus norvegicus
cgtgcatctgtttctaggggtagtg

SEQ ID NO: 489174 - DNA, 25 bp, Rattus norvegicus
gagcgtgcatctgtttctaggggta

SEQ ID NO: 489175 - DNA, 25 bp, Rattus norvegicus
cagggagcgtgcatctgtttctagg

SEQ ID NO: 489176 - DNA, 25 bp, Rattus norvegicus
atgaaagagatggagtgtacgcgcg

SEQ ID NO: 489177 - DNA, 25 bp, Rattus norvegicus
tccgcagggagcgtgcatctgtttc

SEQ ID NO: 489178 - DNA, 25 bp, Rattus norvegicus
gtcctgggtcgctggtcccggccac

SEQ ID NO: 489179 - DNA, 25 bp, Rattus norvegicus
aggtactccgcagggagcgtgcatc

SEQ ID NO: 489180 - DNA, 25 bp, Rattus norvegicus
tctaggggtagtgcatgaaagagat

SEQ ID NO: 489181 - DNA, 25 bp, Rattus norvegicus
gagccggccgggtaggtactccgca

SEQ ID NO: 489182 - DNA, 25 bp, Rattus norvegicus
cgcagggagcgtgcatctgtttcta

SEQ ID NO: 489183 - DNA, 25 bp, Rattus norvegicus
tactccgcagggagcgtgcatctgt

SEQ ID NO: 489184 - DNA, 25 bp, Rattus norvegicus
agatggagtgtacgcgcgggcggaa

SEQ ID NO: 489185 - DNA, 25 bp, Rattus norvegicus
gtgggtctggaagctgctatattta

SEQ ID NO: 489186 - DNA, 25 bp, Rattus norvegicus
gaagctgctatatttagccggtgca

SEQ ID NO: 489187 - DNA, 25 bp, Rattus norvegicus
tgcagcgggcgagaggaaaactatt

SEQ ID NO: 489188 - DNA, 25 bp, Rattus norvegicus
tttatagatcaaacaatccgcgctc

SEQ ID NO: 489189 - DNA, 25 bp, Rattus norvegicus
atccgcgctccctgcgtcaatggaa

SEQ ID NO: 489190 - DNA, 25 bp, Rattus norvegicus
gcgtcacgcgcgcagacattccagg

SEQ ID NO: 489191 - DNA, 25 bp, Rattus norvegicus
cgcgcccttgtatggccaaagctcg

SEQ ID NO: 489192 - DNA, 25 bp, Rattus norvegicus
cttgtatggccaaagctcgccgggc

SEQ ID NO: 489193 - DNA, 25 bp, Rattus norvegicus
atggccaaagctcgccgggccgtgt

SEQ ID NO: 489194 - DNA, 25 bp, Rattus norvegicus
tcacggagcgcttaagaggtgggtc

SEQ ID NO: 489195 - DNA, 25 bp, Rattus norvegicus
attgcagagcgcacgcggaaccaga

SEQ ID NO: 489196 - DNA, 25 bp, Rattus norvegicus
cggaaccagactgcgactgggtcct

SEQ ID NO: 489197 - DNA, 25 bp, Rattus norvegicus
accagactgcgactgggtcctgggt

SEQ ID NO: 489198 - DNA, 25 bp, Rattus norvegicus
agcctagtgggtctggaagctgcta

SEQ ID NO: 489199 - DNA, 25 bp, Rattus norvegicus
tgggattcctaccagcaaggtgagg

SEQ ID NO: 489200 - DNA, 25 bp, Rattus norvegicus
catgcgcttggcgtcctgcaacaca

SEQ ID NO: 489201 - DNA, 25 bp, Rattus norvegicus
ccgctcagatgctatggccgtgatc

SEQ ID NO: 489202 - DNA, 25 bp, Rattus norvegicus
tcccagtggtcttaaggctgtcagc

SEQ ID NO: 489203 - DNA, 25 bp, Rattus norvegicus
ccctctcatctcgatggcggaagtg

SEQ ID NO: 489204 - DNA, 25 bp, Rattus norvegicus
cggaagtgtgttgtcccagcccaaa

SEQ ID NO: 489205 - DNA, 25 bp, Rattus norvegicus
ccaaacaacgctctcgctggtggga

SEQ ID NO: 489206 - DNA, 25 bp, Rattus norvegicus
gattcctttcaacgagtccagggcc

SEQ ID NO: 489207 - DNA, 25 bp, Rattus norvegicus
agctagtgcgagcttcccgatgccc

SEQ ID NO: 489208 - DNA, 25 bp, Rattus norvegicus
ccagcatcctccatgggcgcggata

SEQ ID NO: 489209 - DNA, 25 bp, Rattus norvegicus
gcggatagttccttccggagccttc

SEQ ID NO: 489210 - DNA, 25 bp, Rattus norvegicus
accctgacgtcttgtccgaattctc

SEQ ID NO: 489211 - DNA, 25 bp, Rattus norvegicus
ggtctgtccctgaatactccgtgtt

SEQ ID NO: 489212 - DNA, 25 bp, Rattus norvegicus
cgaattctcggtacggatccaaata

SEQ ID NO: 489213 - DNA, 25 bp, Rattus norvegicus
atcttgtccagtctgggccgccctg

SEQ ID NO: 489214 - DNA, 25 bp, Rattus norvegicus
gtacctggggctctgtcagggtcgc

SEQ ID NO: 489215 - DNA, 25 bp, Rattus norvegicus
cggtgccctggaatgctatgctcag

SEQ ID NO: 489216 - DNA, 25 bp, Rattus norvegicus
ctgcaggaatagaagctgccagccc

SEQ ID NO: 489217 - DNA, 25 bp, Rattus norvegicus
gtgtctgcaggaatagaagctgcca

SEQ ID NO: 489218 - DNA, 25 bp, Rattus norvegicus
accaggtgtctgcaggaatagaagc

SEQ ID NO: 489219 - DNA, 25 bp, Rattus norvegicus
cggataccaggtgtctgcaggaata

SEQ ID NO: 489220 - DNA, 25 bp, Rattus norvegicus
ctgcaggcggataccaggtgtctgc

SEQ ID NO: 489221 - DNA, 25 bp, Rattus norvegicus
agtcccatcttgtccagtctgggcc

SEQ ID NO: 489222 - DNA, 25 bp, Rattus norvegicus
gcccgcgtcgcgtccagtcccatct

SEQ ID NO: 489223 - DNA, 25 bp, Rattus norvegicus
atgctatgctcagatgtggcggcac

SEQ ID NO: 489224 - DNA, 25 bp, Rattus norvegicus
ctggaatgctatgctcagatgtggc

SEQ ID NO: 489225 - DNA, 25 bp, Rattus norvegicus
tgccctggaatgctatgctcagatg

SEQ ID NO: 489226 - DNA, 25 bp, Rattus norvegicus
cttgtccagtctgggccgccctgag

SEQ ID NO: 489227 - DNA, 25 bp, Rattus norvegicus
tcgtgtggccgtgcgctccgcttat

SEQ ID NO: 489228 - DNA, 25 bp, Rattus norvegicus
tgtccagccgctatgtccatccact

SEQ ID NO: 489229 - DNA, 25 bp, Rattus norvegicus
cggcagagaaaggtggccagcggcc

SEQ ID NO: 489230 - DNA, 25 bp, Rattus norvegicus
gggcttcggcagcaggagcctctat

SEQ ID NO: 489231 - DNA, 25 bp, Rattus norvegicus
gtccatccacttcagctctcgctcc

SEQ ID NO: 489232 - DNA, 25 bp, Rattus norvegicus
tcggcagcaggagcctctatggcct

SEQ ID NO: 489233 - DNA, 25 bp, Rattus norvegicus
tgcttctctcctggtccagccagcc

SEQ ID NO: 489234 - DNA, 25 bp, Rattus norvegicus
agggagttcgcgctgcttctctcct

SEQ ID NO: 489235 - DNA, 25 bp, Rattus norvegicus
cagactgcctgaggtcagggagttc

SEQ ID NO: 489236 - DNA, 25 bp, Rattus norvegicus
gtctcagactgcctgaggtcaggga

SEQ ID NO: 489237 - DNA, 25 bp, Rattus norvegicus
ggataaaaggtctcagactgcctga

SEQ ID NO: 489238 - DNA, 25 bp, Rattus norvegicus
tcatggagggataaaaggtctcaga

SEQ ID NO: 489239 - DNA, 25 bp, Rattus norvegicus
cacctgtgtgcgctcagcctccgcc

SEQ ID NO: 489240 - DNA, 25 bp, Rattus norvegicus
gctcaggtgcggctgagctcgggcc

SEQ ID NO: 489241 - DNA, 25 bp, Rattus norvegicus
ctcgaggccgagactcaccctgagg

SEQ ID NO: 489242 - DNA, 25 bp, Rattus norvegicus
gtcgatcacggggtacaggcccacg

SEQ ID NO: 489243 - DNA, 25 bp, Rattus norvegicus
cgatcacggggtacaggcccacgat

SEQ ID NO: 489244 - DNA, 25 bp, Rattus norvegicus
ccctgcagtcggcacctggcacggc

SEQ ID NO: 489245 - DNA, 25 bp, Rattus norvegicus
tcggcgcgattgtctccgcccggag

SEQ ID NO: 489246 - DNA, 25 bp, Rattus norvegicus
tcacggggtacaggcccacgatcgc

SEQ ID NO: 489247 - DNA, 25 bp, Rattus norvegicus
accgctctgtgcagctccgggttgg

SEQ ID NO: 489248 - DNA, 25 bp, Rattus norvegicus
tgcaccgctctgtgcagctccgggt

SEQ ID NO: 489249 - DNA, 25 bp, Rattus norvegicus
cctagcggtccatcgctgccgcccg

SEQ ID NO: 489250 - DNA, 25 bp, Rattus norvegicus
ctcggccgggccctagcggtccatc

SEQ ID NO: 489251 - DNA, 25 bp, Rattus norvegicus
ccggggccacttggcggcggcatcg

SEQ ID NO: 489252 - DNA, 25 bp, Rattus norvegicus
aggccgagactcaccctgagggctg

SEQ ID NO: 489253 - DNA, 25 bp, Rattus norvegicus
ggggccagcggtggcagtcgatcac

SEQ ID NO: 489254 - DNA, 25 bp, Rattus norvegicus
tccggcggagacttgccgggagccc

SEQ ID NO: 489255 - DNA, 25 bp, Rattus norvegicus
ttgcctgtcagaatcaaagcagccc

SEQ ID NO: 489256 - DNA, 25 bp, Rattus norvegicus
aggcgatacagagccaggatggatc

SEQ ID NO: 489257 - DNA, 25 bp, Rattus norvegicus
caggatggatcccaaggctcgcgct

SEQ ID NO: 489258 - DNA, 25 bp, Rattus norvegicus
ggctcgcgctgagccttatatcttg

SEQ ID NO: 489259 - DNA, 25 bp, Rattus norvegicus
gcgctgagccttatatcttgcagga

SEQ ID NO: 489260 - DNA, 25 bp, Rattus norvegicus
ccttatatcttgcaggagggagcgg

SEQ ID NO: 489261 - DNA, 25 bp, Rattus norvegicus
ttgccgctcccataaaacggcgttc

SEQ ID NO: 489262 - DNA, 25 bp, Rattus norvegicus
gctcccataaaacggcgttcttctc

SEQ ID NO: 489263 - DNA, 25 bp, Rattus norvegicus
tttatggtggcaagaagcgcctggt

SEQ ID NO: 489264 - DNA, 25 bp, Rattus norvegicus
caagaagcgcctggtcagctccggg

SEQ ID NO: 489265 - DNA, 25 bp, Rattus norvegicus
caggacatggtgatgaggcgataca

SEQ ID NO: 489266 - DNA, 25 bp, Rattus norvegicus
cccacagacgctgcggctgccgaag

SEQ ID NO: 489267 - DNA, 25 bp, Rattus norvegicus
ccaggagtttatgagcttgcctgtc

SEQ ID NO: 489268 - DNA, 25 bp, Rattus norvegicus
gcatcgggcgggaccctcctgttgc

SEQ ID NO: 489269 - DNA, 25 bp, Rattus norvegicus
atccgaagctgcgtccacaggagcc

SEQ ID NO: 489270 - DNA, 25 bp, Rattus norvegicus
tcggtatccgaagctgcgtccacag

SEQ ID NO: 489271 - DNA, 25 bp, Rattus norvegicus
aagctgcgtccacaggagccagagc

SEQ ID NO: 489272 - DNA, 25 bp, Rattus norvegicus
tgcccctgtagggagctgcagtgat

SEQ ID NO: 489273 - DNA, 25 bp, Rattus norvegicus
gcctccggatcggtatccgaagctg

SEQ ID NO: 489274 - DNA, 25 bp, Rattus norvegicus
atcggtatccgaagctgcgtccaca

SEQ ID NO: 489275 - DNA, 25 bp, Rattus norvegicus
gacgcctccggatcggtatccgaag

SEQ ID NO: 489276 - DNA, 25 bp, Rattus norvegicus
ggtatccgaagctgcgtccacagga

SEQ ID NO: 489277 - DNA, 25 bp, Rattus norvegicus
cgaagctgcgtccacaggagccaga

SEQ ID NO: 489278 - DNA, 25 bp, Rattus norvegicus
cagacgcctccggatcggtatccga

SEQ ID NO: 489279 - DNA, 25 bp, Rattus norvegicus
tgcgtccacaggagccagagcggaa

SEQ ID NO: 489280 - DNA, 25 bp, Rattus norvegicus
gagtccgcggtagcaggagatgccc

SEQ ID NO: 489281 - DNA, 25 bp, Rattus norvegicus
cgcggtagcaggagatgcccctgta

SEQ ID NO: 489282 - DNA, 25 bp, Rattus norvegicus
ccggatcggtatccgaagctgcgtc

SEQ ID NO: 489283 - DNA, 25 bp, Rattus norvegicus
agagctcaatgccagcctccggccg

SEQ ID NO: 489284 - DNA, 25 bp, Rattus norvegicus
accgaggcgtggctgccgctgaacc

SEQ ID NO: 489285 - DNA, 25 bp, Rattus norvegicus
tgctgccaaatgctgctcccttgac

SEQ ID NO: 489286 - DNA, 25 bp, Rattus norvegicus
ggcttctgctgccaaatgctgctcc

SEQ ID NO: 489287 - DNA, 25 bp, Rattus norvegicus
tctgctgccaaatgctgctcccttg

SEQ ID NO: 489288 - DNA, 25 bp, Rattus norvegicus
cggcgggcacacagatgggcatgtg

SEQ ID NO: 489289 - DNA, 25 bp, Rattus norvegicus
cacacagatgggcatgtgggcccca

SEQ ID NO: 489290 - DNA, 25 bp, Rattus norvegicus
gcgctgccaaagacagtgcccacaa

SEQ ID NO: 489291 - DNA, 25 bp, Rattus norvegicus
gctgccaaagacagtgcccacaaag

SEQ ID NO: 489292 - DNA, 25 bp, Rattus norvegicus
tgccaaagacagtgcccacaaagcc

SEQ ID NO: 489293 - DNA, 25 bp, Rattus norvegicus
tccgtgacccagagtgaagccgccg

SEQ ID NO: 489294 - DNA, 25 bp, Rattus norvegicus
acccagagtgaagccgccgctccgc

SEQ ID NO: 489295 - DNA, 25 bp, Rattus norvegicus
aacaggcttctgctgccaaatgctg

SEQ ID NO: 489296 - DNA, 25 bp, Rattus norvegicus
gtgacccagagtgaagccgccgctc

SEQ ID NO: 489297 - DNA, 25 bp, Rattus norvegicus
tgagctgaaggccacccgcttgact

SEQ ID NO: 489298 - DNA, 25 bp, Rattus norvegicus
cagctgcgacgagcgtagaaccgaa

SEQ ID NO: 489299 - DNA, 25 bp, Rattus norvegicus
tctggagatcatggctgagagatga

SEQ ID NO: 489300 - DNA, 25 bp, Rattus norvegicus
cggacgcttgactgtctggagatca

SEQ ID NO: 489301 - DNA, 25 bp, Rattus norvegicus
gagactccgcggacgcttgactgtc

SEQ ID NO: 489302 - DNA, 25 bp, Rattus norvegicus
ccggcaacagctgagccactgctaa

SEQ ID NO: 489303 - DNA, 25 bp, Rattus norvegicus
ttgaaggagcctccaaagccaccgc

SEQ ID NO: 489304 - DNA, 25 bp, Rattus norvegicus
acatggaggctgagctgaaggccac

SEQ ID NO: 489305 - DNA, 25 bp, Rattus norvegicus
gtaaagactcctgctgccgaaaccc

SEQ ID NO: 489306 - DNA, 25 bp, Rattus norvegicus
cccgaggttgtaaagactcctgctg

SEQ ID NO: 489307 - DNA, 25 bp, Rattus norvegicus
gctcatggagatactcttgtgaccc

SEQ ID NO: 489308 - DNA, 25 bp, Rattus norvegicus
agccacgctcatggagatactcttg

SEQ ID NO: 489309 - DNA, 25 bp, Rattus norvegicus
ttggcaggacccagccacgctcatg

SEQ ID NO: 489310 - DNA, 25 bp, Rattus norvegicus
cggccgttgaaggagcctccaaagc

SEQ ID NO: 489311 - DNA, 25 bp, Rattus norvegicus
ggccagaattctacgcccacagctg

SEQ ID NO: 489312 - DNA, 25 bp, Rattus norvegicus
ctaggagcactgaagcacccgggtc

SEQ ID NO: 489313 - DNA, 25 bp, Rattus norvegicus
taggagcactgaagcacccgggtcg

SEQ ID NO: 489314 - DNA, 25 bp, Rattus norvegicus
agcactgaagcacccgggtcgctgc

SEQ ID NO: 489315 - DNA, 25 bp, Rattus norvegicus
agcctaggagcactgaagcacccgg

SEQ ID NO: 489316 - DNA, 25 bp, Rattus norvegicus
gccagaattctacgcccacagctga

SEQ ID NO: 489317 - DNA, 25 bp, Rattus norvegicus
gaattctacgcccacagctgaggct

SEQ ID NO: 489318 - DNA, 25 bp, Rattus norvegicus
aattctacgcccacagctgaggctc

SEQ ID NO: 489319 - DNA, 25 bp, Rattus norvegicus
ggctcctcccacctacctcgatttc

SEQ ID NO: 489320 - DNA, 25 bp, Rattus norvegicus
ctcgatttccctagaaacgggcgct

SEQ ID NO: 489321 - DNA, 25 bp, Rattus norvegicus
tcgatttccctagaaacgggcgctg

SEQ ID NO: 489322 - DNA, 25 bp, Rattus norvegicus
cgatttccctagaaacgggcgctgg

SEQ ID NO: 489323 - DNA, 25 bp, Rattus norvegicus
ggagcactgaagcacccgggtcgct

SEQ ID NO: 489324 - DNA, 25 bp, Rattus norvegicus
cctaggagcactgaagcacccgggt

SEQ ID NO: 489325 - DNA, 25 bp, Rattus norvegicus
aggcaccggctcctttcggacctgg

SEQ ID NO: 489326 - DNA, 25 bp, Rattus norvegicus
aagggtttcgcgacagctcagactc

SEQ ID NO: 489327 - DNA, 25 bp, Rattus norvegicus
ttcggccacatgtcgcgcaggtctt

SEQ ID NO: 489328 - DNA, 25 bp, Rattus norvegicus
cgcgcccgctataatcacgtgattg

SEQ ID NO: 489329 - DNA, 25 bp, Rattus norvegicus
cgtggccaaagaccaggctcggaaa

SEQ ID NO: 489330 - DNA, 25 bp, Rattus norvegicus
cacagatcggacttgacggccgcgc

SEQ ID NO: 489331 - DNA, 25 bp, Rattus norvegicus
cgctttaggttaccacctcgggatg

SEQ ID NO: 489332 - DNA, 25 bp, Rattus norvegicus
gtggactctgccttcaattggagaa

SEQ ID NO: 489333 - DNA, 25 bp, Rattus norvegicus
ggcgcgaggctctcatagacgtgaa

SEQ ID NO: 489334 - DNA, 25 bp, Rattus norvegicus
atagacgtgaagcactgcgcccgcg

SEQ ID NO: 489335 - DNA, 25 bp, Rattus norvegicus
cgcgcggaccggaacacattagacc

SEQ ID NO: 489336 - DNA, 25 bp, Rattus norvegicus
tgctttacgaacctagcgcggcggc

SEQ ID NO: 489337 - DNA, 25 bp, Rattus norvegicus
ccagaagtctgtgcgccaggagacc

SEQ ID NO: 489338 - DNA, 25 bp, Rattus norvegicus
catccgggtcctttgcgttctctct

SEQ ID NO: 489339 - DNA, 25 bp, Rattus norvegicus
cggccttaacctgtcaatgcggcta

SEQ ID NO: 489340 - DNA, 25 bp, Rattus norvegicus
gtacctaacactcggcggcgtcgta

SEQ ID NO: 489341 - DNA, 25 bp, Rattus norvegicus
tagcagcaaccgcactgggtcccgg

SEQ ID NO: 489342 - DNA, 25 bp, Rattus norvegicus
cggcgtcgtaggaaccctggtatcg

SEQ ID NO: 489343 - DNA, 25 bp, Rattus norvegicus
ggatcttcgagaacccgacagcctc

SEQ ID NO: 489344 - DNA, 25 bp, Rattus norvegicus
cggtgagccgggtacctaacactcg

SEQ ID NO: 489345 - DNA, 25 bp, Rattus norvegicus
ggcgctttcaacagccaatcgcagg

SEQ ID NO: 489346 - DNA, 25 bp, Rattus norvegicus
cgctctctgaagacaggcgctttca

SEQ ID NO: 489347 - DNA, 25 bp, Rattus norvegicus
gaccaatcctcagcgctctctgaag

SEQ ID NO: 489348 - DNA, 25 bp, Rattus norvegicus
gaacgccagcgaccggaaaccctga

SEQ ID NO: 489349 - DNA, 25 bp, Rattus norvegicus
ccacaggccctgctgcactggggaa

SEQ ID NO: 489350 - DNA, 25 bp, Rattus norvegicus
gcaccgccggttctctcaggtgaca

SEQ ID NO: 489351 - DNA, 25 bp, Rattus norvegicus
tcagcaccaggtagcagcaaccgca

SEQ ID NO: 489352 - DNA, 25 bp, Rattus norvegicus
gagatctgctgagaccgaggcctcc

SEQ ID NO: 489353 - DNA, 25 bp, Rattus norvegicus
gcctgcagacggctgtgcagagacc

SEQ ID NO: 489354 - DNA, 25 bp, Rattus norvegicus
cagggccgctgtcaacgcgccagag

SEQ ID NO: 489355 - DNA, 25 bp, Rattus norvegicus
ctttgcgggcgctgctgatcggcca

SEQ ID NO: 489356 - DNA, 25 bp, Rattus norvegicus
aagagacacctttgcgggcgctgct

SEQ ID NO: 489357 - DNA, 25 bp, Rattus norvegicus
cccgagagaacgaagagacaccttt

SEQ ID NO: 489358 - DNA, 25 bp, Rattus norvegicus
ggactgcagtgccaaccccgagaga

SEQ ID NO: 489359 - DNA, 25 bp, Rattus norvegicus
taagtgcgccccaggactgcagtgc

SEQ ID NO: 489360 - DNA, 25 bp, Rattus norvegicus
cggggtctacatccctaagtgcgcc

SEQ ID NO: 489361 - DNA, 25 bp, Rattus norvegicus
gctgcgggctccgagtccgccttag

SEQ ID NO: 489362 - DNA, 25 bp, Rattus norvegicus
agaccggaggctgtttcaggagaga

SEQ ID NO: 489363 - DNA, 25 bp, Rattus norvegicus
tccgagtccgccttagcggggtgcc

SEQ ID NO: 489364 - DNA, 25 bp, Rattus norvegicus
ctgtcaacgcgccagagggccgtcg

SEQ ID NO: 489365 - DNA, 25 bp, Rattus norvegicus
tcgggtgagtccatgccctgtcccg

SEQ ID NO: 489366 - DNA, 25 bp, Rattus norvegicus
accgtgcggggtctacatccctaag

SEQ ID NO: 489367 - DNA, 25 bp, Rattus norvegicus
cgcctcagcagctcgcaggccgtgg

SEQ ID NO: 489368 - DNA, 25 bp, Rattus norvegicus
cccactcgccagctgcaactctccg

SEQ ID NO: 489369 - DNA, 25 bp, Rattus norvegicus
tcccgagcccggaagtggatgtggc

SEQ ID NO: 489370 - DNA, 25 bp, Rattus norvegicus
tggatgtggccgcttggcaaagagg

SEQ ID NO: 489371 - DNA, 25 bp, Rattus norvegicus
tggtgtttgtaaacttgcctcggtc

SEQ ID NO: 489372 - DNA, 25 bp, Rattus norvegicus
gagaccgcgccggacaggtaggcgc

SEQ ID NO: 489373 - DNA, 25 bp, Rattus norvegicus
gcctgcagagcgcacacgcccgccc

SEQ ID NO: 489374 - DNA, 25 bp, Rattus norvegicus
cgcggtgaatttacgcaccttcggg

SEQ ID NO: 489375 - DNA, 25 bp, Rattus norvegicus
gagctccgagtgacgctcacgtgcg

SEQ ID NO: 489376 - DNA, 25 bp, Rattus norvegicus
tgacgctcacgtgcgggcactgcca

SEQ ID NO: 489377 - DNA, 25 bp, Rattus norvegicus
ccagccacctcggtgctcggcggag

SEQ ID NO: 489378 - DNA, 25 bp, Rattus norvegicus
gagcttcctcccaccacggttctgc

SEQ ID NO: 489379 - DNA, 25 bp, Rattus norvegicus
ttcgcaccaccctcctccggtcctc

SEQ ID NO: 489380 - DNA, 25 bp, Rattus norvegicus
cctccgcggtgaatttacgcacctt

SEQ ID NO: 489381 - DNA, 25 bp, Rattus norvegicus
agcagcagggcttgcccgagctgtc

SEQ ID NO: 489382 - DNA, 25 bp, Rattus norvegicus
gtcgcaacgtgacgcggatccgctg

SEQ ID NO: 489383 - DNA, 25 bp, Rattus norvegicus
ccaagactcacctggtcgcaacgtg

SEQ ID NO: 489384 - DNA, 25 bp, Rattus norvegicus
ggccagcacagacttgcaccctgtg

SEQ ID NO: 489385 - DNA, 25 bp, Rattus norvegicus
gcccaatgcattcgaggccagcaca

SEQ ID NO: 489386 - DNA, 25 bp, Rattus norvegicus
gggaggctcgattctgcagcccaat

SEQ ID NO: 489387 - DNA, 25 bp, Rattus norvegicus
ccctgatagagaaagggaggctcga

SEQ ID NO: 489388 - DNA, 25 bp, Rattus norvegicus
ggatatcccgcagctcggaggaagc

SEQ ID NO: 489389 - DNA, 25 bp, Rattus norvegicus
tagtacaggtccacgggatatcccg

SEQ ID NO: 489390 - DNA, 25 bp, Rattus norvegicus
tcaggtccataaggtagtacaggtc

SEQ ID NO: 489391 - DNA, 25 bp, Rattus norvegicus
cttcattgaatagctcaggtccata

SEQ ID NO: 489392 - DNA, 25 bp, Rattus norvegicus
gttccaagtcgtccttcattgaata

SEQ ID NO: 489393 - DNA, 25 bp, Rattus norvegicus
ctgagtggcctgtcctgcagcacct

SEQ ID NO: 489394 - DNA, 25 bp, Rattus norvegicus
ccgagctgtcgcacacgttccaagt

SEQ ID NO: 489395 - DNA, 25 bp, Rattus norvegicus
agcgcttactaaaaccctgtgagta

SEQ ID NO: 489396 - DNA, 25 bp, Rattus norvegicus
gagccaatggcggaccagcgcttac

SEQ ID NO: 489397 - DNA, 25 bp, Rattus norvegicus
gccaatggcggaccagcgcttacta

SEQ ID NO: 489398 - DNA, 25 bp, Rattus norvegicus
aatggcggaccagcgcttactaaaa

SEQ ID NO: 489399 - DNA, 25 bp, Rattus norvegicus
cggaccagcgcttactaaaaccctg

SEQ ID NO: 489400 - DNA, 25 bp, Rattus norvegicus
ttgcagcgactagtgggcggagcca

SEQ ID NO: 489401 - DNA, 25 bp, Rattus norvegicus
accctgtgagtaaacggagctcatg

SEQ ID NO: 489402 - DNA, 25 bp, Rattus norvegicus
cctgtgagtaaacggagctcatggt

SEQ ID NO: 489403 - DNA, 25 bp, Rattus norvegicus
agtaaacggagctcatggtgttgga

SEQ ID NO: 489404 - DNA, 25 bp, Rattus norvegicus
tcatggtgttggagcgacagggcga

SEQ ID NO: 489405 - DNA, 25 bp, Rattus norvegicus
ctcccaggacgcgaggtttggtggt

SEQ ID NO: 489406 - DNA, 25 bp, Rattus norvegicus
acagggcgagtattctgcgcggccc

SEQ ID NO: 489407 - DNA, 25 bp, Rattus norvegicus
tcagccacgaagcagcctcctaccg

SEQ ID NO: 489408 - DNA, 25 bp, Rattus norvegicus
gaccagcgcttactaaaaccctgtg

SEQ ID NO: 489409 - DNA, 25 bp, Rattus norvegicus
gctcccgcggtgaactctccgggaa

SEQ ID NO: 489410 - DNA, 25 bp, Rattus norvegicus
gcgcgcttcagagctgaatactaca

SEQ ID NO: 489411 - DNA, 25 bp, Rattus norvegicus
cgagtttccactgtgctaagggctc

SEQ ID NO: 489412 - DNA, 25 bp, Rattus norvegicus
tactacattcctgcggctcagtgcg

SEQ ID NO: 489413 - DNA, 25 bp, Rattus norvegicus
ccaaactgcgactcagacgaaactg

SEQ ID NO: 489414 - DNA, 25 bp, Rattus norvegicus
ggctatccttcctctgccgagggct

SEQ ID NO: 489415 - DNA, 25 bp, Rattus norvegicus
ctaagaatctgctgtaccgagtcgg

SEQ ID NO: 489416 - DNA, 25 bp, Rattus norvegicus
gcggggcgcacttttctaagaatct

SEQ ID NO: 489417 - DNA, 25 bp, Rattus norvegicus
tggccacgtcagaagtttgcccttg

SEQ ID NO: 489418 - DNA, 25 bp, Rattus norvegicus
cattcactgctcagggtcacttaaa

SEQ ID NO: 489419 - DNA, 25 bp, Rattus norvegicus
aactgccctgctggtcattcactgc

SEQ ID NO: 489420 - DNA, 25 bp, Rattus norvegicus
agacgaaactgatccctcccaatga

SEQ ID NO: 489421 - DNA, 25 bp, Rattus norvegicus
actgtccctacagaaccaaactgcg

SEQ ID NO: 489422 - DNA, 25 bp, Rattus norvegicus
acctgacttcagcttttagagcaca

SEQ ID NO: 489423 - DNA, 25 bp, Rattus norvegicus
cactgactccgcaggcggggacacg

SEQ ID NO: 489424 - DNA, 25 bp, Rattus norvegicus
cccaaaatatccgacacattttctc

SEQ ID NO: 489425 - DNA, 25 bp, Rattus norvegicus
cgcggtgttagtgactcgcggtaat

SEQ ID NO: 489426 - DNA, 25 bp, Rattus norvegicus
atatccgacacattttctcccaaac

SEQ ID NO: 489427 - DNA, 25 bp, Rattus norvegicus
caatcccggggcctctcggagcccg

SEQ ID NO: 489428 - DNA, 25 bp, Rattus norvegicus
ggctgggacaatcccggggcctctc

SEQ ID NO: 489429 - DNA, 25 bp, Rattus norvegicus
ctctaggctgggacaatcccggggc

SEQ ID NO: 489430 - DNA, 25 bp, Rattus norvegicus
cgcacactgactccgcaggcgggga

SEQ ID NO: 489431 - DNA, 25 bp, Rattus norvegicus
cgtcgggcggtctccgggatggagc

SEQ ID NO: 489432 - DNA, 25 bp, Rattus norvegicus
cccgcctgactcacctggaggggag

SEQ ID NO: 489433 - DNA, 25 bp, Rattus norvegicus
cctggctcatttcagcagaggaccc

SEQ ID NO: 489434 - DNA, 25 bp, Rattus norvegicus
ttttctcccaaaccgcacactgact

SEQ ID NO: 489435 - DNA, 25 bp, Rattus norvegicus
ccctggctcatttcagcagaggacc

SEQ ID NO: 489436 - DNA, 25 bp, Rattus norvegicus
ccgcggtgttagtgactcgcggtaa

SEQ ID NO: 489437 - DNA, 25 bp, Rattus norvegicus
ccggctcccggaagcaggctgtgag

SEQ ID NO: 489438 - DNA, 25 bp, Rattus norvegicus
tgtgcgtgcgcgtgaccgcgaagca

SEQ ID NO: 489439 - DNA, 25 bp, Rattus norvegicus
accgcgaagcagtggagaggccgac

SEQ ID NO: 489440 - DNA, 25 bp, Rattus norvegicus
acggggctatcatggcggcggccac

SEQ ID NO: 489441 - DNA, 25 bp, Rattus norvegicus
gcggccacgagccagcccggctccc

SEQ ID NO: 489442 - DNA, 25 bp, Rattus norvegicus
cgcgctgctggaacccgagcggagc

SEQ ID NO: 489443 - DNA, 25 bp, Rattus norvegicus
agcggagccggagctagtgcgggga

SEQ ID NO: 489444 - DNA, 25 bp, Rattus norvegicus
gcctggagccggacgtgtccggagc

SEQ ID NO: 489445 - DNA, 25 bp, Rattus norvegicus
gacgtgtccggagcgtccccgcaga

SEQ ID NO: 489446 - DNA, 25 bp, Rattus norvegicus
aggcgcgatctggtgaggggacgct

SEQ ID NO: 489447 - DNA, 25 bp, Rattus norvegicus
tgaggggacgctcggctgaggctag

SEQ ID NO: 489448 - DNA, 25 bp, Rattus norvegicus
tcaaccgtgacccagagtcggggaa

SEQ ID NO: 489449 - DNA, 25 bp, Rattus norvegicus
agtcggggaacctgctgtgcgtgcg

SEQ ID NO: 489450 - DNA, 25 bp, Rattus norvegicus
ctatcatggcggcggccacgagcca

SEQ ID NO: 489451 - DNA, 25 bp, Rattus norvegicus
ttggccactagagatatttgaaagg

SEQ ID NO: 489452 - DNA, 25 bp, Rattus norvegicus
aagcggccggcctgcgtaacgcttt

SEQ ID NO: 489453 - DNA, 25 bp, Rattus norvegicus
cagtccttccgctccagagcggtaa

SEQ ID NO: 489454 - DNA, 25 bp, Rattus norvegicus
ctccaggaacacgtgacagacagcg

SEQ ID NO: 489455 - DNA, 25 bp, Rattus norvegicus
acagacagcgcggtgggtaaactac

SEQ ID NO: 489456 - DNA, 25 bp, Rattus norvegicus
cagcgcggtgggtaaactacaactc

SEQ ID NO: 489457 - DNA, 25 bp, Rattus norvegicus
gtgacgttcccattgctgacctggg

SEQ ID NO: 489458 - DNA, 25 bp, Rattus norvegicus
gctggcgcggaaaacgaagcgtacc

SEQ ID NO: 489459 - DNA, 25 bp, Rattus norvegicus
tcctagaccggtgaaacacggcctg

SEQ ID NO: 489460 - DNA, 25 bp, Rattus norvegicus
tgagcgcgcgctcaagctgcggtaa

SEQ ID NO: 489461 - DNA, 25 bp, Rattus norvegicus
tcaagctgcggtaagtgacgttccc

SEQ ID NO: 489462 - DNA, 25 bp, Rattus norvegicus
gctgattggccactagagatatttg

SEQ ID NO: 489463 - DNA, 25 bp, Rattus norvegicus
gtaacgctttctcgctgattggcca

SEQ ID NO: 489464 - DNA, 25 bp, Rattus norvegicus
cggtaagtgacgttcccattgctga

SEQ ID NO: 489465 - DNA, 25 bp, Rattus norvegicus
ctgcgtgaagctgaacggaagtgca

SEQ ID NO: 489466 - DNA, 25 bp, Rattus norvegicus
agttcccgggctagattcgtatgcg

SEQ ID NO: 489467 - DNA, 25 bp, Rattus norvegicus
cgacctgtatagtaaggaatgccgc

SEQ ID NO: 489468 - DNA, 25 bp, Rattus norvegicus
cgtccgaggaccgacctgtatagta

SEQ ID NO: 489469 - DNA, 25 bp, Rattus norvegicus
gacacgacactgacacgtccgagga

SEQ ID NO: 489470 - DNA, 25 bp, Rattus norvegicus
cttgcggacggagcggacacgacac

SEQ ID NO: 489471 - DNA, 25 bp, Rattus norvegicus
aagttccgcgtgaggtttcaggacg

SEQ ID NO: 489472 - DNA, 25 bp, Rattus norvegicus
cttgaatcttagttcccgggctaga

SEQ ID NO: 489473 - DNA, 25 bp, Rattus norvegicus
ggtgactgcgctctcttgaatctta

SEQ ID NO: 489474 - DNA, 25 bp, Rattus norvegicus
aaccgacaggctcccggctggtgac

SEQ ID NO: 489475 - DNA, 25 bp, Rattus norvegicus
catcttgtcagtccggagggtgtct

SEQ ID NO: 489476 - DNA, 25 bp, Rattus norvegicus
cccagggagcacatcttgtcagtcc

SEQ ID NO: 489477 - DNA, 25 bp, Rattus norvegicus
gccgtacaggacaaactactgcgtg

SEQ ID NO: 489478 - DNA, 25 bp, Rattus norvegicus
ttcgtatgcggacgggtagccgtac

SEQ ID NO: 489479 - DNA, 25 bp, Rattus norvegicus
ttcagtttcaagctgggaagagaga

SEQ ID NO: 489480 - DNA, 25 bp, Rattus norvegicus
aggccgtctcacctgagggcccgtt

SEQ ID NO: 489481 - DNA, 25 bp, Rattus norvegicus
ggcactgaaagggaaggccgtctca

SEQ ID NO: 489482 - DNA, 25 bp, Rattus norvegicus
ggtcaaacgcgcctgatgtggcact

SEQ ID NO: 489483 - DNA, 25 bp, Rattus norvegicus
gggtcaaggtcaaacgcgcctgatg

SEQ ID NO: 489484 - DNA, 25 bp, Rattus norvegicus
cccacagccttcagcgctaaggtta

SEQ ID NO: 489485 - DNA, 25 bp, Rattus norvegicus
atttaggcagcaggactcgacccca

SEQ ID NO: 489486 - DNA, 25 bp, Rattus norvegicus
acccagtggccctcggttcacccag

SEQ ID NO: 489487 - DNA, 25 bp, Rattus norvegicus
tcgctacggtggtttcagtttcaag

SEQ ID NO: 489488 - DNA, 25 bp, Rattus norvegicus
gtttcatttcgctacggtggtttca

SEQ ID NO: 489489 - DNA, 25 bp, Rattus norvegicus
ccggggctctagtttcatttcgcta

SEQ ID NO: 489490 - DNA, 25 bp, Rattus norvegicus
agggcccgttccttctggggtcatg

SEQ ID NO: 489491 - DNA, 25 bp, Rattus norvegicus
ttccttctggggtcatggtcgcgcc

SEQ ID NO: 489492 - DNA, 25 bp, Rattus norvegicus
gtcgcgccgcaggtgttacgacacc

SEQ ID NO: 489493 - DNA, 25 bp, Rattus norvegicus
ctcctgagacctgagcgggcaaatc

SEQ ID NO: 489494 - DNA, 25 bp, Rattus norvegicus
ttcggataccgagcctccacttggg

SEQ ID NO: 489495 - DNA, 25 bp, Rattus norvegicus
gccacagagtggcttttgttcctcc

SEQ ID NO: 489496 - DNA, 25 bp, Rattus norvegicus
gcgctgcgtgctaatccatactgtg

SEQ ID NO: 489497 - DNA, 25 bp, Rattus norvegicus
cagttctaatactcaggccgggtca

SEQ ID NO: 489498 - DNA, 25 bp, Rattus norvegicus
cacacacagtctgggaggcatagcc

SEQ ID NO: 489499 - DNA, 25 bp, Rattus norvegicus
cgggtcactgcccagaccaagattg

SEQ ID NO: 489500 - DNA, 25 bp, Rattus norvegicus
ctcagatttcttcaaagcgcctttg

SEQ ID NO: 489501 - DNA, 25 bp, Rattus norvegicus
gccggagacttctaagggcaccctc

SEQ ID NO: 489502 - DNA, 25 bp, Rattus norvegicus
tgaggcggtttttatctcccagaaa

SEQ ID NO: 489503 - DNA, 25 bp, Rattus norvegicus
gccagaaggcttaggatcttgcacc

SEQ ID NO: 489504 - DNA, 25 bp, Rattus norvegicus
cgggcaaatccaggcagcgctcaat

SEQ ID NO: 489505 - DNA, 25 bp, Rattus norvegicus
cccaagccgagtctagcaagatgaa

SEQ ID NO: 489506 - DNA, 25 bp, Rattus norvegicus
taggttaccactgctcctcctgaga

SEQ ID NO: 489507 - DNA, 25 bp, Rattus norvegicus
gcagagcagacaggtgaacttcttc

SEQ ID NO: 489508 - DNA, 25 bp, Rattus norvegicus
ttcttctcccgggtgtgagtgcgca

SEQ ID NO: 489509 - DNA, 25 bp, Rattus norvegicus
gagtgcgcacgtggcgctccagctc

SEQ ID NO: 489510 - DNA, 25 bp, Rattus norvegicus
ctcaagtggtcgcttcgggtaaagc

SEQ ID NO: 489511 - DNA, 25 bp, Rattus norvegicus
cgggtgaacctcttgccacagaaaa

SEQ ID NO: 489512 - DNA, 25 bp, Rattus norvegicus
ccacagaaaagccagttgcagacga

SEQ ID NO: 489513 - DNA, 25 bp, Rattus norvegicus
gttgcagacgaaaggcctctcgcca

SEQ ID NO: 489514 - DNA, 25 bp, Rattus norvegicus
ctctcgccagtgtgccagcgcaagt

SEQ ID NO: 489515 - DNA, 25 bp, Rattus norvegicus
gccagcgcaagtgggctttcagatg

SEQ ID NO: 489516 - DNA, 25 bp, Rattus norvegicus
ctttcagatgcgaagccttgccgta

SEQ ID NO: 489517 - DNA, 25 bp, Rattus norvegicus
tccagctcgtcagagcgggtgaacc

SEQ ID NO: 489518 - DNA, 25 bp, Rattus norvegicus
gggcggctgattggcttcttcttcc

SEQ ID NO: 489519 - DNA, 25 bp, Rattus norvegicus
ctgatgtttgctcaagtggtcgctt

SEQ ID NO: 489520 - DNA, 25 bp, Rattus norvegicus
gtaaagcgcttggagcagagcagac

SEQ ID NO: 489521 - DNA, 25 bp, Rattus norvegicus
ggtgacgcgacaccctcgccctcgc

SEQ ID NO: 489522 - DNA, 25 bp, Rattus norvegicus
gtgtgccgtcaccaagctgtcgtcc

SEQ ID NO: 489523 - DNA, 25 bp, Rattus norvegicus
acagggcttccacccacggcgaggg

SEQ ID NO: 489524 - DNA, 25 bp, Rattus norvegicus
cgcccatcccggcaggggtgacatt

SEQ ID NO: 489525 - DNA, 25 bp, Rattus norvegicus
atcccggcaggggtgacattcgaga

SEQ ID NO: 489526 - DNA, 25 bp, Rattus norvegicus
tgtaggagcggtgaagggaaaactc

SEQ ID NO: 489527 - DNA, 25 bp, Rattus norvegicus
tcgcgcgtctcagcgctgacacttg

SEQ ID NO: 489528 - DNA, 25 bp, Rattus norvegicus
cagcgctgacacttgtggaactgca

SEQ ID NO: 489529 - DNA, 25 bp, Rattus norvegicus
tgacacttgtggaactgcaaggctc

SEQ ID NO: 489530 - DNA, 25 bp, Rattus norvegicus
cttgtggaactgcaaggctccgcta

SEQ ID NO: 489531 - DNA, 25 bp, Rattus norvegicus
aactgcaaggctccgctaaagcgta

SEQ ID NO: 489532 - DNA, 25 bp, Rattus norvegicus
ggctccgctaaagcgtaccacctaa

SEQ ID NO: 489533 - DNA, 25 bp, Rattus norvegicus
gcgtctcagcgctgacacttgtgga

SEQ ID NO: 489534 - DNA, 25 bp, Rattus norvegicus
cattcgagaggtgctgtgtaggagc

SEQ ID NO: 489535 - DNA, 25 bp, Rattus norvegicus
ccaccatgagcggtaaggatgagtc

SEQ ID NO: 489536 - DNA, 25 bp, Rattus norvegicus
tccactccaagcctaggggtgggag

SEQ ID NO: 489537 - DNA, 25 bp, Rattus norvegicus
tgagtccactccaagcctaggggtg

SEQ ID NO: 489538 - DNA, 25 bp, Rattus norvegicus
gatgagtccactccaagcctagggg

SEQ ID NO: 489539 - DNA, 25 bp, Rattus norvegicus
taaggatgagtccactccaagccta

SEQ ID NO: 489540 - DNA, 25 bp, Rattus norvegicus
cggtaaggatgagtccactccaagc

SEQ ID NO: 489541 - DNA, 25 bp, Rattus norvegicus
agcggtaaggatgagtccactccaa

SEQ ID NO: 489542 - DNA, 25 bp, Rattus norvegicus
tgagcggtaaggatgagtccactcc

SEQ ID NO: 489543 - DNA, 25 bp, Rattus norvegicus
ccatgagcggtaaggatgagtccac

SEQ ID NO: 489544 - DNA, 25 bp, Rattus norvegicus
gactaggccgggcttgtggcgcgct

SEQ ID NO: 489545 - DNA, 25 bp, Rattus norvegicus
gtccgggttcgcttgcctcgtcagc

SEQ ID NO: 489546 - DNA, 25 bp, Rattus norvegicus
ggttcgcttgcctcgtcagcgtccg

SEQ ID NO: 489547 - DNA, 25 bp, Rattus norvegicus
tgcctcgtcagcgtccgcgtttttc

SEQ ID NO: 489548 - DNA, 25 bp, Rattus norvegicus
cttgcctcgtcagcgtccgcgtttt

SEQ ID NO: 489549 - DNA, 25 bp, Rattus norvegicus
tgtagcttcggcttcgctgccagct

SEQ ID NO: 489550 - DNA, 25 bp, Rattus norvegicus
actgcgactacagctgctactgcgg

SEQ ID NO: 489551 - DNA, 25 bp, Rattus norvegicus
gaacctgatctctgagaagggctcc

SEQ ID NO: 489552 - DNA, 25 bp, Rattus norvegicus
cctgatcggaaatagtggggagact

SEQ ID NO: 489553 - DNA, 25 bp, Rattus norvegicus
tcccttgtatgactccgagaccggc

SEQ ID NO: 489554 - DNA, 25 bp, Rattus norvegicus
ccgggatcttgatcgctcccttgta

SEQ ID NO: 489555 - DNA, 25 bp, Rattus norvegicus
tcttctcttgcttcgactgcgacta

SEQ ID NO: 489556 - DNA, 25 bp, Rattus norvegicus
tggtgctgcgacttcttctcttgct

SEQ ID NO: 489557 - DNA, 25 bp, Rattus norvegicus
cggctccggtctcggctgtagcttc

SEQ ID NO: 489558 - DNA, 25 bp, Rattus norvegicus
ccctttctggaacctgatctctgag

SEQ ID NO: 489559 - DNA, 25 bp, Rattus norvegicus
agagcgcctttcctcggggctctcg

SEQ ID NO: 489560 - DNA, 25 bp, Rattus norvegicus
atgaaatcccgacggccagagcgcc

SEQ ID NO: 489561 - DNA, 25 bp, Rattus norvegicus
ctttgaacgaatgaaatcccgacgg

SEQ ID NO: 489562 - DNA, 25 bp, Rattus norvegicus
actgagagcggtaaatctttgaacg

SEQ ID NO: 489563 - DNA, 25 bp, Rattus norvegicus
gcacctctgcgctgccgctctatca

SEQ ID NO: 489564 - DNA, 25 bp, Rattus norvegicus
cgctctatcacagacctcgcggttg

SEQ ID NO: 489565 - DNA, 25 bp, Rattus norvegicus
ctatcacagacctcgcggttggtta

SEQ ID NO: 489566 - DNA, 25 bp, Rattus norvegicus
cagacctcgcggttggttaccggct

SEQ ID NO: 489567 - DNA, 25 bp, Rattus norvegicus
ctcgcggttggttaccggctgtctc

SEQ ID NO: 489568 - DNA, 25 bp, Rattus norvegicus
ttaccggctgtctcgctggtgccga

SEQ ID NO: 489569 - DNA, 25 bp, Rattus norvegicus
tgccgacgctgtccaaggagccgct

SEQ ID NO: 489570 - DNA, 25 bp, Rattus norvegicus
aaggagccgctctaggctccgggaa

SEQ ID NO: 489571 - DNA, 25 bp, Rattus norvegicus
aggctccgggaaggcggtccgcatt

SEQ ID NO: 489572 - DNA, 25 bp, Rattus norvegicus
ggtccgcattgcgtggggaaagtgt

SEQ ID NO: 489573 - DNA, 25 bp, Rattus norvegicus
ggaaagtgtggacgacgcagtcaac

SEQ ID NO: 489574 - DNA, 25 bp, Rattus norvegicus
tggacgacgcagtcaactcgccggc

SEQ ID NO: 489575 - DNA, 25 bp, Rattus norvegicus
aagtgtggacgacgcagtcaactcg

SEQ ID NO: 489576 - DNA, 25 bp, Rattus norvegicus
ctcgctggtgccgacgctgtccaag

SEQ ID NO: 489577 - DNA, 25 bp, Rattus norvegicus
agcgtctactacttcactctgcctg

SEQ ID NO: 489578 - DNA, 25 bp, Rattus norvegicus
tagtcccgcatgagcgtctactact

SEQ ID NO: 489579 - DNA, 25 bp, Rattus norvegicus
tcccgcatgagcgtctactacttca

SEQ ID NO: 489580 - DNA, 25 bp, Rattus norvegicus
ttcactctgcctgcccgtccattca

SEQ ID NO: 489581 - DNA, 25 bp, Rattus norvegicus
ctctaggaggcgctacttgtccggc

SEQ ID NO: 489582 - DNA, 25 bp, Rattus norvegicus
cgcatgagcgtctactacttcactc

SEQ ID NO: 489583 - DNA, 25 bp, Rattus norvegicus
gtccattcacgcgaggccctggttc

SEQ ID NO: 489584 - DNA, 25 bp, Rattus norvegicus
ggaggcgctacttgtccggcgcctc

SEQ ID NO: 489585 - DNA, 25 bp, Rattus norvegicus
gactctctaggaggcgctacttgtc

SEQ ID NO: 489586 - DNA, 25 bp, Rattus norvegicus
cgctgactctctaggaggcgctact

SEQ ID NO: 489587 - DNA, 25 bp, Rattus norvegicus
tagtaggcctcgcgcaaagcctgcc

SEQ ID NO: 489588 - DNA, 25 bp, Rattus norvegicus
ttccagcgcggcctagtaggcctcg

SEQ ID NO: 489589 - DNA, 25 bp, Rattus norvegicus
cgctggcgctgactctctaggaggc

SEQ ID NO: 489590 - DNA, 25 bp, Rattus norvegicus
gccctggttccagcgcggcctagta

SEQ ID NO: 489591 - DNA, 25 bp, Rattus norvegicus
tgcggcgtaaccatgactactgggc

SEQ ID NO: 489592 - DNA, 25 bp, Rattus norvegicus
ttagcccagggtcacgtgaacatga

SEQ ID NO: 489593 - DNA, 25 bp, Rattus norvegicus
ccgggacaagattagcccagggtca

SEQ ID NO: 489594 - DNA, 25 bp, Rattus norvegicus
tgaagtcaccgggacaagattagcc

SEQ ID NO: 489595 - DNA, 25 bp, Rattus norvegicus
tggaaggggttacagccacggcgcc

SEQ ID NO: 489596 - DNA, 25 bp, Rattus norvegicus
tgggcccgtgaagtcaccgggacaa

SEQ ID NO: 489597 - DNA, 25 bp, Rattus norvegicus
actactgggcccgtgaagtcaccgg

SEQ ID NO: 489598 - DNA, 25 bp, Rattus norvegicus
gcgctgcggcgtaaccatgactact

SEQ ID NO: 489599 - DNA, 25 bp, Rattus norvegicus
cgtaaccatgactactgggcccgtg

SEQ ID NO: 489600 - DNA, 25 bp, Rattus norvegicus
accaggacgtcaccgcggcaagcgg

SEQ ID NO: 489601 - DNA, 25 bp, Rattus norvegicus
cttcccgaccgtcacgtggtgcggg

SEQ ID NO: 489602 - DNA, 25 bp, Rattus norvegicus
atgctctcggcccacctgctggacc

SEQ ID NO: 489603 - DNA, 25 bp, Rattus norvegicus
cagggtcacgtgaacatgaggcatg

SEQ ID NO: 489604 - DNA, 25 bp, Rattus norvegicus
accatgactactgggcccgtgaagt

SEQ ID NO: 489605 - DNA, 25 bp, Rattus norvegicus
tcaggccacggactagctaatgtta

SEQ ID NO: 489606 - DNA, 25 bp, Rattus norvegicus
ccacggactagctaatgttaacagg

SEQ ID NO: 489607 - DNA, 25 bp, Rattus norvegicus
aggactcacccgctggtagctccgg

SEQ ID NO: 489608 - DNA, 25 bp, Rattus norvegicus
gctcggtcccacaatctgtctcctg

SEQ ID NO: 489609 - DNA, 25 bp, Rattus norvegicus
tcagcggagcagatactttcctccc

SEQ ID NO: 489610 - DNA, 25 bp, Rattus norvegicus
gagcagatactttcctcccgtccgg

SEQ ID NO: 489611 - DNA, 25 bp, Rattus norvegicus
caggcgtgttcacttctcgcgagaa

SEQ ID NO: 489612 - DNA, 25 bp, Rattus norvegicus
gaaggttgagtgagagctgtacaca

SEQ ID NO: 489613 - DNA, 25 bp, Rattus norvegicus
gagctgtacacacgactcacacgtg

SEQ ID NO: 489614 - DNA, 25 bp, Rattus norvegicus
ctcacacgtgttcggctgcaaagtg

SEQ ID NO: 489615 - DNA, 25 bp, Rattus norvegicus
tcaaaagcggccctggtatccacgc

SEQ ID NO: 489616 - DNA, 25 bp, Rattus norvegicus
tatccacgcggtcggtctgtctgta

SEQ ID NO: 489617 - DNA, 25 bp, Rattus norvegicus
aaggggagactcctgtcaggccacg

SEQ ID NO: 489618 - DNA, 25 bp, Rattus norvegicus
tgttaacaggactcacccgctggta

SEQ ID NO: 489619 - DNA, 25 bp, Rattus norvegicus
cgagagaacacgcatgccagcattt

SEQ ID NO: 489620 - DNA, 25 bp, Rattus norvegicus
agctacaaaaggagcccaccgtgtg

SEQ ID NO: 489621 - DNA, 25 bp, Rattus norvegicus
cgccatctggtgtccaacaggagaa

SEQ ID NO: 489622 - DNA, 25 bp, Rattus norvegicus
tcgggaaacaagtacgccatctggt

SEQ ID NO: 489623 - DNA, 25 bp, Rattus norvegicus
tgaacgcaagctaaaggatcggccc

SEQ ID NO: 489624 - DNA, 25 bp, Rattus norvegicus
tcccgcggatagagtgaacgcaagc

SEQ ID NO: 489625 - DNA, 25 bp, Rattus norvegicus
ccaacgagtcgctttcccgcggata

SEQ ID NO: 489626 - DNA, 25 bp, Rattus norvegicus
catgcgcgactagagccaacgagtc

SEQ ID NO: 489627 - DNA, 25 bp, Rattus norvegicus
ctgctcccagggtagagaagacaga

SEQ ID NO: 489628 - DNA, 25 bp, Rattus norvegicus
tcatagacacgaggaaggggcagct

SEQ ID NO: 489629 - DNA, 25 bp, Rattus norvegicus
ccgcgcggttagaggtcatagacac

SEQ ID NO: 489630 - DNA, 25 bp, Rattus norvegicus
tgagacacccaagatggcgccaggc

SEQ ID NO: 489631 - DNA, 25 bp, Rattus norvegicus
ccaccgtgtgcggaagagccgccaa

SEQ ID NO: 489632 - DNA, 25 bp, Rattus norvegicus
agcatttggctttcgccggccgcag

SEQ ID NO: 489633 - DNA, 25 bp, Rattus norvegicus
ccgctgaaagcccacggagcaattt

SEQ ID NO: 489634 - DNA, 25 bp, Rattus norvegicus
aggcctttgtgtgcacgcaggacca

SEQ ID NO: 489635 - DNA, 25 bp, Rattus norvegicus
atgagcccagacgaccgctgcaagg

SEQ ID NO: 489636 - DNA, 25 bp, Rattus norvegicus
gggctgtaaataaaggcaaatccgc

SEQ ID NO: 489637 - DNA, 25 bp, Rattus norvegicus
gccaccctctgaggggccgtttgtc

SEQ ID NO: 489638 - DNA, 25 bp, Rattus norvegicus
gagctcctccatttaatcggatttg

SEQ ID NO: 489639 - DNA, 25 bp, Rattus norvegicus
ggaggataaatcacggcagcagctt

SEQ ID NO: 489640 - DNA, 25 bp, Rattus norvegicus
agcagctttacggtcccggaggaga

SEQ ID NO: 489641 - DNA, 25 bp, Rattus norvegicus
cccgagcgacgccattacaggaatg

SEQ ID NO: 489642 - DNA, 25 bp, Rattus norvegicus
cgagtttaattatcctcgcggagga

SEQ ID NO: 489643 - DNA, 25 bp, Rattus norvegicus
cggaggaatttcaatgcggccaatc

SEQ ID NO: 489644 - DNA, 25 bp, Rattus norvegicus
tgcggccaatccatcttgcaggcgg

SEQ ID NO: 489645 - DNA, 25 bp, Rattus norvegicus
cctgctttgcttcagtgccctttcg

SEQ ID NO: 489646 - DNA, 25 bp, Rattus norvegicus
caggaatgtaattttgcccggatga

SEQ ID NO: 489647 - DNA, 25 bp, Rattus norvegicus
ccgggctctcgcgagatctttttcg

SEQ ID NO: 489648 - DNA, 25 bp, Rattus norvegicus
gtactatcggtttcccacgctcggc

SEQ ID NO: 489649 - DNA, 25 bp, Rattus norvegicus
aatcggctgtactatcggtttccca

SEQ ID NO: 489650 - DNA, 25 bp, Rattus norvegicus
cgcagcggtgtaatcggctgtacta

SEQ ID NO: 489651 - DNA, 25 bp, Rattus norvegicus
gctgtactacttccgcagcggtgta

SEQ ID NO: 489652 - DNA, 25 bp, Rattus norvegicus
agccactggcgctgtactacttccg

SEQ ID NO: 489653 - DNA, 25 bp, Rattus norvegicus
cgcgagatctttttcggcgaggctc

SEQ ID NO: 489654 - DNA, 25 bp, Rattus norvegicus
gccacaagatcgcaggccgggctct

SEQ ID NO: 489655 - DNA, 25 bp, Rattus norvegicus
agctgacgctgcagcgcagtccgga

SEQ ID NO: 489656 - DNA, 25 bp, Rattus norvegicus
cgagacagagtgaagctgacgctgc

SEQ ID NO: 489657 - DNA, 25 bp, Rattus norvegicus
agagaagaccgagacagagtgaagc

SEQ ID NO: 489658 - DNA, 25 bp, Rattus norvegicus
tccgggccagcatcagggctctgcg

SEQ ID NO: 489659 - DNA, 25 bp, Rattus norvegicus
ggtgagcgccggtaacaccggcttc

SEQ ID NO: 489660 - DNA, 25 bp, Rattus norvegicus
ccctgtaggagaaatggcagccact

SEQ ID NO: 489661 - DNA, 25 bp, Rattus norvegicus
tggcgcacgttcagacttaaatggt

SEQ ID NO: 489662 - DNA, 25 bp, Rattus norvegicus
cctaaatcatcgctgaattaacatc

SEQ ID NO: 489663 - DNA, 25 bp, Rattus norvegicus
taacatcacaatcggcggctggcgc

SEQ ID NO: 489664 - DNA, 25 bp, Rattus norvegicus
tggaggctgcggctcgccatcaccg

SEQ ID NO: 489665 - DNA, 25 bp, Rattus norvegicus
gaattaacatcacaatcggcggctg

SEQ ID NO: 489666 - DNA, 25 bp, Rattus norvegicus
cggctggcgcacgttcagacttaaa

SEQ ID NO: 489667 - DNA, 25 bp, Rattus norvegicus
ctgcaccgggcggtcgcctccgccc

SEQ ID NO: 489668 - DNA, 25 bp, Rattus norvegicus
actgtctcgggcagacccgcgggat

SEQ ID NO: 489669 - DNA, 25 bp, Rattus norvegicus
gttcgcgcactgtctcgggcagacc

SEQ ID NO: 489670 - DNA, 25 bp, Rattus norvegicus
tggcatattgttcgcgcactgtctc

SEQ ID NO: 489671 - DNA, 25 bp, Rattus norvegicus
atattgttcgcgcactgtctcgggc

SEQ ID NO: 489672 - DNA, 25 bp, Rattus norvegicus
ggctcgccatcaccgcagcgcgctg

SEQ ID NO: 489673 - DNA, 25 bp, Rattus norvegicus
acgttcagacttaaatggtggcata

SEQ ID NO: 489674 - DNA, 25 bp, Rattus norvegicus
ttaaatggtggcatattgttcgcgc

SEQ ID NO: 489675 - DNA, 25 bp, Rattus norvegicus
ggcaggcgctctgccttccatgtgg

SEQ ID NO: 489676 - DNA, 25 bp, Rattus norvegicus
ctcgcgcccggtaattgctaaatta

SEQ ID NO: 489677 - DNA, 25 bp, Rattus norvegicus
attgctaaattacccgccatctgct

SEQ ID NO: 489678 - DNA, 25 bp, Rattus norvegicus
taaattacccgccatctgctcggct

SEQ ID NO: 489679 - DNA, 25 bp, Rattus norvegicus
aggcctcagttctgcagaaggggca

SEQ ID NO: 489680 - DNA, 25 bp, Rattus norvegicus
gccacagaagcggtgtactttcctc

SEQ ID NO: 489681 - DNA, 25 bp, Rattus norvegicus
ggctctcagacataaattatctgcg

SEQ ID NO: 489682 - DNA, 25 bp, Rattus norvegicus
gcggtccaagggcactaatagagcc

SEQ ID NO: 489683 - DNA, 25 bp, Rattus norvegicus
attatctgcgaggagaaaagccaca

SEQ ID NO: 489684 - DNA, 25 bp, Rattus norvegicus
ctgcgaggagaaaagccacagaagc

SEQ ID NO: 489685 - DNA, 25 bp, Rattus norvegicus
tgccttccatgtggcggcacgaacc

SEQ ID NO: 489686 - DNA, 25 bp, Rattus norvegicus
cagaagcggtgtactttcctcccgc

SEQ ID NO: 489687 - DNA, 25 bp, Rattus norvegicus
ctcccgcccgcccaaactcgcgaga

SEQ ID NO: 489688 - DNA, 25 bp, Rattus norvegicus
ctgctcggctctcagacataaatta

SEQ ID NO: 489689 - DNA, 25 bp, Rattus norvegicus
gtgcggcgcgattgtttagtattca

SEQ ID NO: 489690 - DNA, 25 bp, Rattus norvegicus
atcgcgaacatttgggccgtggcca

SEQ ID NO: 489691 - DNA, 25 bp, Rattus norvegicus
gttattacggaaaacgcgacctgca

SEQ ID NO: 489692 - DNA, 25 bp, Rattus norvegicus
tggccagccgcattaaaggttatta

SEQ ID NO: 489693 - DNA, 25 bp, Rattus norvegicus
ccagcgctccatcgcgaacatttgg

SEQ ID NO: 489694 - DNA, 25 bp, Rattus norvegicus
tcatcgtccatctgatgcgcggggc

SEQ ID NO: 489695 - DNA, 25 bp, Rattus norvegicus
gggatgattaacacttcatcgtcca

SEQ ID NO: 489696 - DNA, 25 bp, Rattus norvegicus
gtccataaagaatgtctcggaattg

SEQ ID NO: 489697 - DNA, 25 bp, Rattus norvegicus
gtcctgtcatataactgtctcccgc

SEQ ID NO: 489698 - DNA, 25 bp, Rattus norvegicus
tattcatggggcgacgcaatctctc

SEQ ID NO: 489699 - DNA, 25 bp, Rattus norvegicus
ctccacgcaggacagagtggggttt

SEQ ID NO: 489700 - DNA, 25 bp, Rattus norvegicus
taatgacgactttctgcgggacggc

SEQ ID NO: 489701 - DNA, 25 bp, Rattus norvegicus
tctgcttagcacagcaagtcctgtc

SEQ ID NO: 489702 - DNA, 25 bp, Rattus norvegicus
gtctcccgcactgtctgtccataaa

SEQ ID NO: 489703 - DNA, 25 bp, Rattus norvegicus
ctcaccgctcggtttcacgcccggc

SEQ ID NO: 489704 - DNA, 25 bp, Rattus norvegicus
aggcagaaaagagagccggcttgca

SEQ ID NO: 489705 - DNA, 25 bp, Rattus norvegicus
cggagacgcggcctcatctcaggct

SEQ ID NO: 489706 - DNA, 25 bp, Rattus norvegicus
agacgacgtgaatagggatgaagcc

SEQ ID NO: 489707 - DNA, 25 bp, Rattus norvegicus
ccctagtttaagagacgacgtgaat

SEQ ID NO: 489708 - DNA, 25 bp, Rattus norvegicus
agcggaaagccagaggcaaatagga

SEQ ID NO: 489709 - DNA, 25 bp, Rattus norvegicus
acgcggcctcatctcaggctgggag

SEQ ID NO: 489710 - DNA, 25 bp, Rattus norvegicus
tcggcgacgcccgtgtttacctgaa

SEQ ID NO: 489711 - DNA, 25 bp, Rattus norvegicus
gcccgtgtttacctgaaagtctctg

SEQ ID NO: 489712 - DNA, 25 bp, Rattus norvegicus
tgaaagtctctgtcctcgttgaagc

SEQ ID NO: 489713 - DNA, 25 bp, Rattus norvegicus
ctgtcctcgttgaagcgggagaagc

SEQ ID NO: 489714 - DNA, 25 bp, Rattus norvegicus
acaagaatgcgtccggacgggaatc

SEQ ID NO: 489715 - DNA, 25 bp, Rattus norvegicus
ccctagagaaatgagaggcagaaaa

SEQ ID NO: 489716 - DNA, 25 bp, Rattus norvegicus
cgggagaagcggtccgccattttgc

SEQ ID NO: 489717 - DNA, 25 bp, Rattus norvegicus
cgctcatgcgtataggccatcaata

SEQ ID NO: 489718 - DNA, 25 bp, Rattus norvegicus
ctacccgcctcagtgttggtggatc

SEQ ID NO: 489719 - DNA, 25 bp, Rattus norvegicus
ttttcatacattggcgaggaccgtc

SEQ ID NO: 489720 - DNA, 25 bp, Rattus norvegicus
gaacccacattcttgtctgccgcag

SEQ ID NO: 489721 - DNA, 25 bp, Rattus norvegicus
tccgtgtccttgagctgaaggtctc

SEQ ID NO: 489722 - DNA, 25 bp, Rattus norvegicus
cagccaatttcatgccagcgccggg

SEQ ID NO: 489723 - DNA, 25 bp, Rattus norvegicus
gcggactcattacggctgcagccaa

SEQ ID NO: 489724 - DNA, 25 bp, Rattus norvegicus
gcagcgcggtggaacgttttaatta

SEQ ID NO: 489725 - DNA, 25 bp, Rattus norvegicus
caatcgcgcggaatgtctgcaggct

SEQ ID NO: 489726 - DNA, 25 bp, Rattus norvegicus
gcacacttcgacttcggagccaatc

SEQ ID NO: 489727 - DNA, 25 bp, Rattus norvegicus
gttggccttcattccctttgctctg

SEQ ID NO: 489728 - DNA, 25 bp, Rattus norvegicus
ccgactctggctgttggccttcatt

SEQ ID NO: 489729 - DNA, 25 bp, Rattus norvegicus
tcgttccgggtatccgccatttctc

SEQ ID NO: 489730 - DNA, 25 bp, Rattus norvegicus
ccatcaatagcgtcagggcctcggg

SEQ ID NO: 489731 - DNA, 25 bp, Rattus norvegicus
ccgggtccagagtgaagcaatcaga

SEQ ID NO: 489732 - DNA, 25 bp, Rattus norvegicus
gtgacgacctgtcctctagggctaa

SEQ ID NO: 489733 - DNA, 25 bp, Rattus norvegicus
tgttgaaggctaccagcactgggct

SEQ ID NO: 489734 - DNA, 25 bp, Rattus norvegicus
ctggaagtctcccttcccaggtaag

SEQ ID NO: 489735 - DNA, 25 bp, Rattus norvegicus
acagtcaggtgtactgctccaagga

SEQ ID NO: 489736 - DNA, 25 bp, Rattus norvegicus
actgggctctttccaatggctggga

SEQ ID NO: 489737 - DNA, 25 bp, Rattus norvegicus
aatgcgctggggaagaaatctgctc

SEQ ID NO: 489738 - DNA, 25 bp, Rattus norvegicus
ctagggctaaggagttcgccttcta

SEQ ID NO: 489739 - DNA, 25 bp, Rattus norvegicus
acgacgcgctcatccctgttgaagg

SEQ ID NO: 489740 - DNA, 25 bp, Rattus norvegicus
agacaagtacccagagccgtcgggc

SEQ ID NO: 489741 - DNA, 25 bp, Rattus norvegicus
agaagccttgctcctaccatccggg

SEQ ID NO: 489742 - DNA, 25 bp, Rattus norvegicus
gcctgtcgcacaacgtgaacctgca

SEQ ID NO: 489743 - DNA, 25 bp, Rattus norvegicus
caatgcccggctacctggacgtgtc

SEQ ID NO: 489744 - DNA, 25 bp, Rattus norvegicus
gatactacggctgccgcctgtcgca

SEQ ID NO: 489745 - DNA, 25 bp, Rattus norvegicus
acacatttctgtcggagtgagcagc

SEQ ID NO: 489746 - DNA, 25 bp, Rattus norvegicus
ctccaggagcggtggaattcgaaga

SEQ ID NO: 489747 - DNA, 25 bp, Rattus norvegicus
tgggatatgaaatcgctccaggagc

SEQ ID NO: 489748 - DNA, 25 bp, Rattus norvegicus
ctgtcggagtgagcagctatggttt

SEQ ID NO: 489749 - DNA, 25 bp, Rattus norvegicus
cccgcggggacacatttctgtcgga

SEQ ID NO: 489750 - DNA, 25 bp, Rattus norvegicus
gcgccaagctgcgggccgctagcta

SEQ ID NO: 489751 - DNA, 25 bp, Rattus norvegicus
aatctgcttttctttccgccgagtc

SEQ ID NO: 489752 - DNA, 25 bp, Rattus norvegicus
ttctttccgccgagtcctgtagagg

SEQ ID NO: 489753 - DNA, 25 bp, Rattus norvegicus
tccgccgagtcctgtagaggagaga

SEQ ID NO: 489754 - DNA, 25 bp, Rattus norvegicus
gaagagcggaatgagaatctcctgc

SEQ ID NO: 489755 - DNA, 25 bp, Rattus norvegicus
agaatctcctgcgattctgtctgcg

SEQ ID NO: 489756 - DNA, 25 bp, Rattus norvegicus
cggtggaattcgaagaatctgcttt

SEQ ID NO: 489757 - DNA, 25 bp, Rattus norvegicus
gcggaatgagaatctcctgcgattc

SEQ ID NO: 489758 - DNA, 25 bp, Rattus norvegicus
cagctatggtttgggatatgaaatc

SEQ ID NO: 489759 - DNA, 25 bp, Rattus norvegicus
cgctggtgaatatccacacgggaga

SEQ ID NO: 489760 - DNA, 25 bp, Rattus norvegicus
cctggctctctggtatctccgttga

SEQ ID NO: 489761 - DNA, 25 bp, Rattus norvegicus
actcaacgagggcaataagggcgcc

SEQ ID NO: 489762 - DNA, 25 bp, Rattus norvegicus
caccctcgtgtcagtcattggaatc

SEQ ID NO: 489763 - DNA, 25 bp, Rattus norvegicus
ggccacctgcgctcggcttcaagta

SEQ ID NO: 489764 - DNA, 25 bp, Rattus norvegicus
gttactaccgagagccctgcgctga

SEQ ID NO: 489765 - DNA, 25 bp, Rattus norvegicus
ggtgtctctcaacccgccttttggc

SEQ ID NO: 489766 - DNA, 25 bp, Rattus norvegicus
gcgataacgtgtgctcgctgccctg

SEQ ID NO: 489767 - DNA, 25 bp, Rattus norvegicus
ctcctgaatcctgggtttgtggggc

SEQ ID NO: 489768 - DNA, 25 bp, Rattus norvegicus
atgggcgagcataatctcctgaatc

SEQ ID NO: 489769 - DNA, 25 bp, Rattus norvegicus
tatctccgttgaacccaggcggcgg

SEQ ID NO: 489770 - DNA, 25 bp, Rattus norvegicus
ggaatctgactccagttcatcccta

SEQ ID NO: 489771 - DNA, 25 bp, Rattus norvegicus
tatctcggcagtccggtgtctctca

SEQ ID NO: 489772 - DNA, 25 bp, Rattus norvegicus
ttcaagtacgactacccagcgggcg

SEQ ID NO: 489773 - DNA, 25 bp, Rattus norvegicus
tcacgaagttctgcacgctgatccg

SEQ ID NO: 489774 - DNA, 25 bp, Rattus norvegicus
ctctgatggttgcttctcccgagga

SEQ ID NO: 489775 - DNA, 25 bp, Rattus norvegicus
ttttcagcgcaaaggtcaatggccc

SEQ ID NO: 489776 - DNA, 25 bp, Rattus norvegicus
tcgcagcggacatccaaacagttac

SEQ ID NO: 489777 - DNA, 25 bp, Rattus norvegicus
taatgcagccggaaacccagctctt

SEQ ID NO: 489778 - DNA, 25 bp, Rattus norvegicus
acattcgccttttcatcgcagcgga

SEQ ID NO: 489779 - DNA, 25 bp, Rattus norvegicus
cctcggttaagagcggacattcgcc

SEQ ID NO: 489780 - DNA, 25 bp, Rattus norvegicus
cgcgaacacattccgcctcggttaa

SEQ ID NO: 489781 - DNA, 25 bp, Rattus norvegicus
gccaaacctcagtgcggtgtgcgtc

SEQ ID NO: 489782 - DNA, 25 bp, Rattus norvegicus
gccgctgtagaaacgcaccctggag

SEQ ID NO: 489783 - DNA, 25 bp, Rattus norvegicus
cgctcgccctccgtgtgtagggaaa

SEQ ID NO: 489784 - DNA, 25 bp, Rattus norvegicus
gcccagatccgcgaacaaagcaaaa

SEQ ID NO: 489785 - DNA, 25 bp, Rattus norvegicus
cccagctctttggatcgatgactca

SEQ ID NO: 489786 - DNA, 25 bp, Rattus norvegicus
tccgggatccgtggatgctaatgca

SEQ ID NO: 489787 - DNA, 25 bp, Rattus norvegicus
ctactttggatcacgtgctcgggga

SEQ ID NO: 489788 - DNA, 25 bp, Rattus norvegicus
acagtctcgtgttttgggtcagtcc

SEQ ID NO: 489789 - DNA, 25 bp, Rattus norvegicus
ctcctcagtgaacaagaacagcgtc

SEQ ID NO: 489790 - DNA, 25 bp, Rattus norvegicus
ctgcgaagtgctccgaactgatata

SEQ ID NO: 489791 - DNA, 25 bp, Rattus norvegicus
gttcttcccattcggcgaccaagga

SEQ ID NO: 489792 - DNA, 25 bp, Rattus norvegicus
ctactcgtcttgttatgcggcggcc

SEQ ID NO: 489793 - DNA, 25 bp, Rattus norvegicus
gtggcaccatcggaacagctactcg

SEQ ID NO: 489794 - DNA, 25 bp, Rattus norvegicus
gcttcttcgacaacgcctactgcgg

SEQ ID NO: 489795 - DNA, 25 bp, Rattus norvegicus
tctgcccagttgcacttactacgtg

SEQ ID NO: 489796 - DNA, 25 bp, Rattus norvegicus
ttctgctcgccttcgcgcaaggaga

SEQ ID NO: 489797 - DNA, 25 bp, Rattus norvegicus
actcggtcaacctgggcaacttctg

SEQ ID NO: 489798 - DNA, 25 bp, Rattus norvegicus
tcgctagatcgggtccaaaacctcc

SEQ ID NO: 489799 - DNA, 25 bp, Rattus norvegicus
ccgccggtttctactcctcagtgaa

SEQ ID NO: 489800 - DNA, 25 bp, Rattus norvegicus
gcgtcatctcgccttcccaaaattt

SEQ ID NO: 489801 - DNA, 25 bp, Rattus norvegicus
ctggagcgagagtttttcttcaacg

SEQ ID NO: 489802 - DNA, 25 bp, Rattus norvegicus
gctgagctttcagcggcccgggttg

SEQ ID NO: 489803 - DNA, 25 bp, Rattus norvegicus
cttattcgaaattccagatccggga

SEQ ID NO: 489804 - DNA, 25 bp, Rattus norvegicus
gcccttattcgaaattccagatccg

SEQ ID NO: 489805 - DNA, 25 bp, Rattus norvegicus
cgctgcccttattcgaaattccaga

SEQ ID NO: 489806 - DNA, 25 bp, Rattus norvegicus
agcgctgcccttattcgaaattcca

SEQ ID NO: 489807 - DNA, 25 bp, Rattus norvegicus
gaacccgcaagaagcgctgccctta

SEQ ID NO: 489808 - DNA, 25 bp, Rattus norvegicus
ctgtgcggctgagctttcagcggcc

SEQ ID NO: 489809 - DNA, 25 bp, Rattus norvegicus
gtcgcccggggtctcacgtgtctct

SEQ ID NO: 489810 - DNA, 25 bp, Rattus norvegicus
ggaactggagcgagagtttttcttc

SEQ ID NO: 489811 - DNA, 25 bp, Rattus norvegicus
ttcgaaattccagatccgggaactg

SEQ ID NO: 489812 - DNA, 25 bp, Rattus norvegicus
atccgggaactggagcgagagtttt

SEQ ID NO: 489813 - DNA, 25 bp, Rattus norvegicus
ccggggtctcacgtgtctctctccc

SEQ ID NO: 489814 - DNA, 25 bp, Rattus norvegicus
tccagatccgggaactggagcgaga

SEQ ID NO: 489815 - DNA, 25 bp, Rattus norvegicus
gtgtctcctccacctggttcatgta

SEQ ID NO: 489816 - DNA, 25 bp, Rattus norvegicus
ggttcatgtagtaccgcatgtccca

SEQ ID NO: 489817 - DNA, 25 bp, Rattus norvegicus
catgtcccatgcgtggatgcgccca

SEQ ID NO: 489818 - DNA, 25 bp, Rattus norvegicus
atgcgcccatcgaatgggagcccgc

SEQ ID NO: 489819 - DNA, 25 bp, Rattus norvegicus
gtctacgcggtagcgtgtctcctcc

SEQ ID NO: 489820 - DNA, 25 bp, Rattus norvegicus
cacgcgtgaccacctgcatggggaa

SEQ ID NO: 489821 - DNA, 25 bp, Rattus norvegicus
ggggaagtactccttcagcaggttc

SEQ ID NO: 489822 - DNA, 25 bp, Rattus norvegicus
agatggccagcagcccacgcgtgac

SEQ ID NO: 489823 - DNA, 25 bp, Rattus norvegicus
tcagcaggttctggtctacgcggta

SEQ ID NO: 489824 - DNA, 25 bp, Rattus norvegicus
cccagcagctcttggtagatggcca

SEQ ID NO: 489825 - DNA, 25 bp, Rattus norvegicus
ggcggcaccttcctccagcgtgaag

SEQ ID NO: 489826 - DNA, 25 bp, Rattus norvegicus
tacagccgcacgtcttcgtgccagg

SEQ ID NO: 489827 - DNA, 25 bp, Rattus norvegicus
gcgtcacgcacagagtacagccgca

SEQ ID NO: 489828 - DNA, 25 bp, Rattus norvegicus
tgggagcccgcgcttggcgcactct

SEQ ID NO: 489829 - DNA, 25 bp, Rattus norvegicus
cgctgttactccacgttgagcgctc

SEQ ID NO: 489830 - DNA, 25 bp, Rattus norvegicus
ggggcgcttcctttgttcgccatga

SEQ ID NO: 489831 - DNA, 25 bp, Rattus norvegicus
cggataattatggagctgatatttc

SEQ ID NO: 489832 - DNA, 25 bp, Rattus norvegicus
cgtcacatggtgaggaccgaatgca

SEQ ID NO: 489833 - DNA, 25 bp, Rattus norvegicus
atcccattggtctagccgtcacatg

SEQ ID NO: 489834 - DNA, 25 bp, Rattus norvegicus
cagctgctaggtggcgctgttactc

SEQ ID NO: 489835 - DNA, 25 bp, Rattus norvegicus
ccattttcaaatcccattggtctag

SEQ ID NO: 489836 - DNA, 25 bp, Rattus norvegicus
aggtggcgctgttactccacgttga

SEQ ID NO: 489837 - DNA, 25 bp, Rattus norvegicus
cgtctgaatcatcaaggccattttc

SEQ ID NO: 489838 - DNA, 25 bp, Rattus norvegicus
agcgctccgcctgccgacaacttga

SEQ ID NO: 489839 - DNA, 25 bp, Rattus norvegicus
ccgctgacgtcacggccgtctgaat

SEQ ID NO: 489840 - DNA, 25 bp, Rattus norvegicus
gtcacggccgtctgaatcatcaagg

SEQ ID NO: 489841 - DNA, 25 bp, Rattus norvegicus
tttgttcgccatgaagggctccggt

SEQ ID NO: 489842 - DNA, 25 bp, Rattus norvegicus
ccgaatgcacggataattatggagc

SEQ ID NO: 489843 - DNA, 25 bp, Rattus norvegicus
aggaacgggccaagaccgcagactc

SEQ ID NO: 489844 - DNA, 25 bp, Rattus norvegicus
gacacctcggataatgaagctaaag

SEQ ID NO: 489845 - DNA, 25 bp, Rattus norvegicus
gcccagacacctcggataatgaagc

SEQ ID NO: 489846 - DNA, 25 bp, Rattus norvegicus
tccagcccagacacctcggataatg

SEQ ID NO: 489847 - DNA, 25 bp, Rattus norvegicus
aacgggccaagaccgcagactccag

SEQ ID NO: 489848 - DNA, 25 bp, Rattus norvegicus
tcggagagcgaaaaggaacgggcca

SEQ ID NO: 489849 - DNA, 25 bp, Rattus norvegicus
tgaagctaaaggtaaggccgtctgg

SEQ ID NO: 489850 - DNA, 25 bp, Rattus norvegicus
agcaaagcctggtgggcccaaaagc

SEQ ID NO: 489851 - DNA, 25 bp, Rattus norvegicus
tcccaacgagatcaagacggagcaa

SEQ ID NO: 489852 - DNA, 25 bp, Rattus norvegicus
cccagtcccaacgagatcaagacgg

SEQ ID NO: 489853 - DNA, 25 bp, Rattus norvegicus
tgagttttcctgagacccccaagtc

SEQ ID NO: 489854 - DNA, 25 bp, Rattus norvegicus
ggcaaagtgagttttcctgagaccc

SEQ ID NO: 489855 - DNA, 25 bp, Rattus norvegicus
ctcggataatgaagctaaaggtaag

SEQ ID NO: 489856 - DNA, 25 bp, Rattus norvegicus
aagccagcccctcggagagcgaaaa

SEQ ID NO: 489857 - DNA, 25 bp, Rattus norvegicus
caaagaatttcagcatctggggctg

SEQ ID NO: 489858 - DNA, 25 bp, Rattus norvegicus
cgaggacaaagaatttcagcatctg

SEQ ID NO: 489859 - DNA, 25 bp, Rattus norvegicus
ccaatcgaggacaaagaatttcagc

SEQ ID NO: 489860 - DNA, 25 bp, Rattus norvegicus
ttggtcgatcagaaaccaatcgagg

SEQ ID NO: 489861 - DNA, 25 bp, Rattus norvegicus
tgtctttattggtcgatcagaaacc

SEQ ID NO: 489862 - DNA, 25 bp, Rattus norvegicus
caggaagctggtgtctttattggtc

SEQ ID NO: 489863 - DNA, 25 bp, Rattus norvegicus
gatgttttttcgtcacttggtggcc

SEQ ID NO: 489864 - DNA, 25 bp, Rattus norvegicus
gctgatgttttttcgtcacttggtg

SEQ ID NO: 489865 - DNA, 25 bp, Rattus norvegicus
ggaactctaagtgtccgccccttgc

SEQ ID NO: 489866 - DNA, 25 bp, Rattus norvegicus
caccctaggaactctaagtgtccgc

SEQ ID NO: 489867 - DNA, 25 bp, Rattus norvegicus
accctcaccctaggaactctaagtg

SEQ ID NO: 489868 - DNA, 25 bp, Rattus norvegicus
agctggtgtctttattggtcgatca

SEQ ID NO: 489869 - DNA, 25 bp, Rattus norvegicus
cactccactcttcatcctaccctca

SEQ ID NO: 489870 - DNA, 25 bp, Rattus norvegicus
gccggacaggaagctggtgtcttta

SEQ ID NO: 489871 - DNA, 25 bp, Rattus norvegicus
gggcagcgactatgagctccctctc

SEQ ID NO: 489872 - DNA, 25 bp, Rattus norvegicus
agcttacagaagagccagcggcagc

SEQ ID NO: 489873 - DNA, 25 bp, Rattus norvegicus
gcgacaaggtaagagaatcggtttc

SEQ ID NO: 489874 - DNA, 25 bp, Rattus norvegicus
atcggtttcttgttcttctcttggc

SEQ ID NO: 489875 - DNA, 25 bp, Rattus norvegicus
tgttcttctcttggcggtcgacaga

SEQ ID NO: 489876 - DNA, 25 bp, Rattus norvegicus
cggtcgacagaggactagcagcgtc

SEQ ID NO: 489877 - DNA, 25 bp, Rattus norvegicus
gactagcagcgtcctcaggtgcccg

SEQ ID NO: 489878 - DNA, 25 bp, Rattus norvegicus
cgtagagcacggaggaaggtgtttc

SEQ ID NO: 489879 - DNA, 25 bp, Rattus norvegicus
aggtgtttcgggcatctgtgttttc

SEQ ID NO: 489880 - DNA, 25 bp, Rattus norvegicus
cgggcatctgtgttttctgagagcc

SEQ ID NO: 489881 - DNA, 25 bp, Rattus norvegicus
ctgagagccccggattttccttgtg

SEQ ID NO: 489882 - DNA, 25 bp, Rattus norvegicus
tttccttgtggccgccggcagtgga

SEQ ID NO: 489883 - DNA, 25 bp, Rattus norvegicus
tggagggcagcgactatgagctccc

SEQ ID NO: 489884 - DNA, 25 bp, Rattus norvegicus
gccctcgacagcagcttacagaaga

SEQ ID NO: 489885 - DNA, 25 bp, Rattus norvegicus
tattcagcacgtcgtgggcgcccgt

SEQ ID NO: 489886 - DNA, 25 bp, Rattus norvegicus
gtggactcgctcatctctcacgaca

SEQ ID NO: 489887 - DNA, 25 bp, Rattus norvegicus
gacggggcccatcagtaactattac

SEQ ID NO: 489888 - DNA, 25 bp, Rattus norvegicus
ccgacacgcgctacatgcggacttg

SEQ ID NO: 489889 - DNA, 25 bp, Rattus norvegicus
agtcgtccgtggtctatcaccctta

SEQ ID NO: 489890 - DNA, 25 bp, Rattus norvegicus
tacatgtacggctctcccggggaac

SEQ ID NO: 489891 - DNA, 25 bp, Rattus norvegicus
cctggaccctagtaagttgggagca

SEQ ID NO: 489892 - DNA, 25 bp, Rattus norvegicus
gcagctacccggactacatgtacgg

SEQ ID NO: 489893 - DNA, 25 bp, Rattus norvegicus
gcccaagccggctgtattcagcacg

SEQ ID NO: 489894 - DNA, 25 bp, Rattus norvegicus
attttccgtcctgtagcttcgcgcc

SEQ ID NO: 489895 - DNA, 25 bp, Rattus norvegicus
tgccggactgtagcgattttccgtc

SEQ ID NO: 489896 - DNA, 25 bp, Rattus norvegicus
tcacgacaatgaagacctcctagcg

SEQ ID NO: 489897 - DNA, 25 bp, Rattus norvegicus
ggcggggacagctagattacagccc

SEQ ID NO: 489898 - DNA, 25 bp, Rattus norvegicus
cgctggccggcagcaagcacaaaga

SEQ ID NO: 489899 - DNA, 25 bp, Rattus norvegicus
gagctaagtgagagcgcgcgctcta

SEQ ID NO: 489900 - DNA, 25 bp, Rattus norvegicus
gctgccacggagacgcctccaaatt

SEQ ID NO: 489901 - DNA, 25 bp, Rattus norvegicus
agaacccgtgctcgctgagctgcca

SEQ ID NO: 489902 - DNA, 25 bp, Rattus norvegicus
tccctcagacgtgggcagaagccat

SEQ ID NO: 489903 - DNA, 25 bp, Rattus norvegicus
ttacgactgccggttccctcagacg

SEQ ID NO: 489904 - DNA, 25 bp, Rattus norvegicus
cctggaaccggcctattacgactgc

SEQ ID NO: 489905 - DNA, 25 bp, Rattus norvegicus
tacaaaggcggcgagtccctggaac

SEQ ID NO: 489906 - DNA, 25 bp, Rattus norvegicus
ccagcatgagctcctacttcgtcaa

SEQ ID NO: 489907 - DNA, 25 bp, Rattus norvegicus
ggggccgcaggttttcatgtaccca

SEQ ID NO: 489908 - DNA, 25 bp, Rattus norvegicus
ctccaaattctatggctacgaggcg

SEQ ID NO: 489909 - DNA, 25 bp, Rattus norvegicus
cctgggctgttagaggaaagagcta

SEQ ID NO: 489910 - DNA, 25 bp, Rattus norvegicus
ccaccgccgggagtctgaggaattc

SEQ ID NO: 489911 - DNA, 25 bp, Rattus norvegicus
gcgaatcgcgtgtaagcgccgccac

SEQ ID NO: 489912 - DNA, 25 bp, Rattus norvegicus
gcgcgctctacctaccgacagtgag

SEQ ID NO: 489913 - DNA, 25 bp, Rattus norvegicus
gcatgctcctaaatgccgccgtcgt

SEQ ID NO: 489914 - DNA, 25 bp, Rattus norvegicus
tctggcgcccggcttctttggaaat

SEQ ID NO: 489915 - DNA, 25 bp, Rattus norvegicus
gcgggatgcgctctttagaaatgca

SEQ ID NO: 489916 - DNA, 25 bp, Rattus norvegicus
gggtaccattcggtttctgcagata

SEQ ID NO: 489917 - DNA, 25 bp, Rattus norvegicus
cgccgtcgtcccattaccgaaatgg

SEQ ID NO: 489918 - DNA, 25 bp, Rattus norvegicus
agaaatgcatgctcctaaatgccgc

SEQ ID NO: 489919 - DNA, 25 bp, Rattus norvegicus
ttgcgagagcgggatgcgctcttta

SEQ ID NO: 489920 - DNA, 25 bp, Rattus norvegicus
cacttcagttttctcgtttggaaag

SEQ ID NO: 489921 - DNA, 25 bp, Rattus norvegicus
tgcccaccacttcagttttctcgtt

SEQ ID NO: 489922 - DNA, 25 bp, Rattus norvegicus
ggttagacctaaggagacccagcgc

SEQ ID NO: 489923 - DNA, 25 bp, Rattus norvegicus
ggcagccagaaggttagacctaagg

SEQ ID NO: 489924 - DNA, 25 bp, Rattus norvegicus
tctttggaaatgtcgggcagccaga

SEQ ID NO: 489925 - DNA, 25 bp, Rattus norvegicus
gcgcccggcttctttggaaatgtcg

SEQ ID NO: 489926 - DNA, 25 bp, Rattus norvegicus
ccattaccgaaatgggtaccattcg

SEQ ID NO: 489927 - DNA, 25 bp, Rattus norvegicus
gcattggagtgagcgcacagcctag

SEQ ID NO: 489928 - DNA, 25 bp, Rattus norvegicus
ctctggaaatcaagaactggagatg

SEQ ID NO: 489929 - DNA, 25 bp, Rattus norvegicus
ggaatggaatacgtgcatctgtgcg

SEQ ID NO: 489930 - DNA, 25 bp, Rattus norvegicus
cggccaggaatggaatacgtgcatc

SEQ ID NO: 489931 - DNA, 25 bp, Rattus norvegicus
gcgttgccggccaggaatggaatac

SEQ ID NO: 489932 - DNA, 25 bp, Rattus norvegicus
gcgccgagctgtagttggcgttgcc

SEQ ID NO: 489933 - DNA, 25 bp, Rattus norvegicus
gcacagcctagggaggcgccgagct

SEQ ID NO: 489934 - DNA, 25 bp, Rattus norvegicus
ccagcattggagtgagcgcacagcc

SEQ ID NO: 489935 - DNA, 25 bp, Rattus norvegicus
agggagcttagagtccagccgctcc

SEQ ID NO: 489936 - DNA, 25 bp, Rattus norvegicus
ctttttaggcaggcgagggagctta

SEQ ID NO: 489937 - DNA, 25 bp, Rattus norvegicus
cccgcagctgcgtggctttttaggc

SEQ ID NO: 489938 - DNA, 25 bp, Rattus norvegicus
aaccgttccgtatctctggaaatca

SEQ ID NO: 489939 - DNA, 25 bp, Rattus norvegicus
cggcataaccgttccgtatctctgg

SEQ ID NO: 489940 - DNA, 25 bp, Rattus norvegicus
cagctgcgtggctttttaggcaggc

SEQ ID NO: 489941 - DNA, 25 bp, Rattus norvegicus
agaatctaatctcacgtccacgctc

SEQ ID NO: 489942 - DNA, 25 bp, Rattus norvegicus
gatctctaggggtcggttacggagc

SEQ ID NO: 489943 - DNA, 25 bp, Rattus norvegicus
gaagtggaaaaaagaatctaatctc

SEQ ID NO: 489944 - DNA, 25 bp, Rattus norvegicus
atcgagatcgccaatgctctgtgcc

SEQ ID NO: 489945 - DNA, 25 bp, Rattus norvegicus
taactcggcgccggcgcatcgagat

SEQ ID NO: 489946 - DNA, 25 bp, Rattus norvegicus
tcaaccgctacctaactcggcgccg

SEQ ID NO: 489947 - DNA, 25 bp, Rattus norvegicus
gaaagaatttcacttcaaccgctac

SEQ ID NO: 489948 - DNA, 25 bp, Rattus norvegicus
ctggagaaagaatttcacttcaacc

SEQ ID NO: 489949 - DNA, 25 bp, Rattus norvegicus
aatctcacgtccacgctctcagggg

SEQ ID NO: 489950 - DNA, 25 bp, Rattus norvegicus
atctactctcggtaccagaccctgg

SEQ ID NO: 489951 - DNA, 25 bp, Rattus norvegicus
cgccagatctactctcggtaccaga

SEQ ID NO: 489952 - DNA, 25 bp, Rattus norvegicus
gcggccgccagatctactctcggta

SEQ ID NO: 489953 - DNA, 25 bp, Rattus norvegicus
cacgtccacgctctcagggggtggc

SEQ ID NO: 489954 - DNA, 25 bp, Rattus norvegicus
ggaactggagaaagaatttcacttc

SEQ ID NO: 489955 - DNA, 25 bp, Rattus norvegicus
agtgagccgggttgggctccaagcc

SEQ ID NO: 489956 - DNA, 25 bp, Rattus norvegicus
aaaagggccgcctggactttcgctg

SEQ ID NO: 489957 - DNA, 25 bp, Rattus norvegicus
ggagcaacacacaccccggaaaaga

SEQ ID NO: 489958 - DNA, 25 bp, Rattus norvegicus
agccaggcgctgagcctcggtctcc

SEQ ID NO: 489959 - DNA, 25 bp, Rattus norvegicus
ttgggaccctccctacacggagcaa

SEQ ID NO: 489960 - DNA, 25 bp, Rattus norvegicus
tgagaggcctttgggaccctcccta

SEQ ID NO: 489961 - DNA, 25 bp, Rattus norvegicus
tttctgagaggcctttgggaccctc

SEQ ID NO: 489962 - DNA, 25 bp, Rattus norvegicus
accgcgatgggtttctgagaggcct

SEQ ID NO: 489963 - DNA, 25 bp, Rattus norvegicus
ctcggtctccgggttctcttgaccg

SEQ ID NO: 489964 - DNA, 25 bp, Rattus norvegicus
cccagccctctgcactcgcctgccc

SEQ ID NO: 489965 - DNA, 25 bp, Rattus norvegicus
acttgccagcggagctctcgcgcag

SEQ ID NO: 489966 - DNA, 25 bp, Rattus norvegicus
cgctgacttgccagcggagctctcg

SEQ ID NO: 489967 - DNA, 25 bp, Rattus norvegicus
gcctgtctgctcattcgcccgcccg

SEQ ID NO: 489968 - DNA, 25 bp, Rattus norvegicus
tctcttgaccgcgatgggtttctga

SEQ ID NO: 489969 - DNA, 25 bp, Rattus norvegicus
tgaaccctgggatgtacagtcagaa

SEQ ID NO: 489970 - DNA, 25 bp, Rattus norvegicus
ctgtgtgcgcccaaatttacgacga

SEQ ID NO: 489971 - DNA, 25 bp, Rattus norvegicus
cccgccacagatttacccgtggatg

SEQ ID NO: 489972 - DNA, 25 bp, Rattus norvegicus
cggatctcgagggtgcttattgttc

SEQ ID NO: 489973 - DNA, 25 bp, Rattus norvegicus
cccgtggatgaccaaactgcacatg

SEQ ID NO: 489974 - DNA, 25 bp, Rattus norvegicus
atggcaagcggtcccgaaccagtta

SEQ ID NO: 489975 - DNA, 25 bp, Rattus norvegicus
gtggaaagtttcctgcccaggcaga

SEQ ID NO: 489976 - DNA, 25 bp, Rattus norvegicus
cgaaccagttacacgcgctaccaga

SEQ ID NO: 489977 - DNA, 25 bp, Rattus norvegicus
ggcatcaatggctcgtaaaactgtc

SEQ ID NO: 489978 - DNA, 25 bp, Rattus norvegicus
taggacttcattttgcgcgctcggg

SEQ ID NO: 489979 - DNA, 25 bp, Rattus norvegicus
gtccgcctgggttttataggccatg

SEQ ID NO: 489980 - DNA, 25 bp, Rattus norvegicus
cctgcggccataaattttacgatcc

SEQ ID NO: 489981 - DNA, 25 bp, Rattus norvegicus
ctgcacatgagccacggtaaacttt

SEQ ID NO: 489982 - DNA, 25 bp, Rattus norvegicus
ttattgttcggtccgagcctgggtc

SEQ ID NO: 489983 - DNA, 25 bp, Rattus norvegicus
gctagctccgagcacgctaagaagg

SEQ ID NO: 489984 - DNA, 25 bp, Rattus norvegicus
tcagggtcgggaactccacaggttc

SEQ ID NO: 489985 - DNA, 25 bp, Rattus norvegicus
ccacaggttccatctgcccgaggga

SEQ ID NO: 489986 - DNA, 25 bp, Rattus norvegicus
gtcctcacgcctgtgcggtccgggt

SEQ ID NO: 489987 - DNA, 25 bp, Rattus norvegicus
gggtctccttgggagctcgcttcac

SEQ ID NO: 489988 - DNA, 25 bp, Rattus norvegicus
ggctctcagactgaggcgcctgccg

SEQ ID NO: 489989 - DNA, 25 bp, Rattus norvegicus
ggcagctggtctacatgagtgtgca

SEQ ID NO: 489990 - DNA, 25 bp, Rattus norvegicus
acatgagtgtgcatgcgcgggaaca

SEQ ID NO: 489991 - DNA, 25 bp, Rattus norvegicus
cgcgggaacaaccagtctggcgcca

SEQ ID NO: 489992 - DNA, 25 bp, Rattus norvegicus
agtctggcgccagtgcataccggct

SEQ ID NO: 489993 - DNA, 25 bp, Rattus norvegicus
gcccacgtcatcctgaggttgcctt

SEQ ID NO: 489994 - DNA, 25 bp, Rattus norvegicus
cctgaggttgccttgccaatggtga

SEQ ID NO: 489995 - DNA, 25 bp, Rattus norvegicus
aatggtgagattttgcgcatgcgcc

SEQ ID NO: 489996 - DNA, 25 bp, Rattus norvegicus
ggagctcgcttcacctcagtcggtt

SEQ ID NO: 489997 - DNA, 25 bp, Rattus norvegicus
ctagggacctcgaaaggcgccggca

SEQ ID NO: 489998 - DNA, 25 bp, Rattus norvegicus
gtgggcaggatcatattgtcgcagc

SEQ ID NO: 489999 - DNA, 25 bp, Rattus norvegicus
atcatattgtcgcagcctcagcgcg

SEQ ID NO: 490000 - DNA, 25 bp, Rattus norvegicus
cgcccaggactgtgtggattagcca

SEQ ID NO: 490001 - DNA, 25 bp, Rattus norvegicus
ccatttctttggagtgtaaggcgag

SEQ ID NO: 490002 - DNA, 25 bp, Rattus norvegicus
gaaaggcgccggcagccgacacatc

SEQ ID NO: 490003 - DNA, 25 bp, Rattus norvegicus
ccggcagccgacacatctcgggaga

SEQ ID NO: 490004 - DNA, 25 bp, Rattus norvegicus
catctcgggagaactcgggaaaaca

SEQ ID NO: 490005 - DNA, 25 bp, Rattus norvegicus
aggcatcccgaagaagccctagaga

SEQ ID NO: 490006 - DNA, 25 bp, Rattus norvegicus
agccctagagaaaatcaatcacgta

SEQ ID NO: 490007 - DNA, 25 bp, Rattus norvegicus
caatcacgtaattagaacagggagg

SEQ ID NO: 490008 - DNA, 25 bp, Rattus norvegicus
gttgtccgaggttctgtggcctaag

SEQ ID NO: 490009 - DNA, 25 bp, Rattus norvegicus
ttctgtggcctaagtgttggggact

SEQ ID NO: 490010 - DNA, 25 bp, Rattus norvegicus
actgtgtggattagccatttctttg

SEQ ID NO: 490011 - DNA, 25 bp, Rattus norvegicus
ctgaataatccctgcgctatcggga

SEQ ID NO: 490012 - DNA, 25 bp, Rattus norvegicus
ggagctgagcagaaaccaaaacaca

SEQ ID NO: 490013 - DNA, 25 bp, Rattus norvegicus
ctatcgggagaaaagaaggccacgc

SEQ ID NO: 490014 - DNA, 25 bp, Rattus norvegicus
ggtgagccgccacctaggttgtccc

SEQ ID NO: 490015 - DNA, 25 bp, Rattus norvegicus
tgagcagaaaccaaaacacacacgc

SEQ ID NO: 490016 - DNA, 25 bp, Rattus norvegicus
cccacgtggagctgagcagaaacca

SEQ ID NO: 490017 - DNA, 25 bp, Rattus norvegicus
cgccgggatgcgcactttcctcggg

SEQ ID NO: 490018 - DNA, 25 bp, Rattus norvegicus
agttcaggaggctccctgaataatc

SEQ ID NO: 490019 - DNA, 25 bp, Rattus norvegicus
ggctccctgaataatccctgcgcta

SEQ ID NO: 490020 - DNA, 25 bp, Rattus norvegicus
acgcgcttggtgagccgccacctag

SEQ ID NO: 490021 - DNA, 25 bp, Rattus norvegicus
taatccctgcgctatcgggagaaaa

SEQ ID NO: 490022 - DNA, 25 bp, Rattus norvegicus
gaaaagaaggccacgccaatcccac

SEQ ID NO: 490023 - DNA, 25 bp, Rattus norvegicus
gccaatcccacccaaaccgcaatcc

SEQ ID NO: 490024 - DNA, 25 bp, Rattus norvegicus
aacacacacgccacgcgcttggtga

SEQ ID NO: 490025 - DNA, 25 bp, Rattus norvegicus
agccctataaaagctgtagcgacga

SEQ ID NO: 490026 - DNA, 25 bp, Rattus norvegicus
gggcgattccgcgagactgatttat

SEQ ID NO: 490027 - DNA, 25 bp, Rattus norvegicus
ataaaagctgtagcgacgaggcaag

SEQ ID NO: 490028 - DNA, 25 bp, Rattus norvegicus
tgacgttttacagccctataaaagc

SEQ ID NO: 490029 - DNA, 25 bp, Rattus norvegicus
cgcgagactgatttatgacgtttta

SEQ ID NO: 490030 - DNA, 25 bp, Rattus norvegicus
cgacacaaagagtgcgggcgattcc

SEQ ID NO: 490031 - DNA, 25 bp, Rattus norvegicus
ccctgtgccgccgacacaaagagtg

SEQ ID NO: 490032 - DNA, 25 bp, Rattus norvegicus
ttttcgtggaaaggagggagcaggc

SEQ ID NO: 490033 - DNA, 25 bp, Rattus norvegicus
aaatcacattacgacttttcgtgga

SEQ ID NO: 490034 - DNA, 25 bp, Rattus norvegicus
cggcggcgatcataataataaaatc

SEQ ID NO: 490035 - DNA, 25 bp, Rattus norvegicus
tcacggcggcgatcataataataaa

SEQ ID NO: 490036 - DNA, 25 bp, Rattus norvegicus
gattgactaatcacggcggcgatca

SEQ ID NO: 490037 - DNA, 25 bp, Rattus norvegicus
ggcgaattaaaggtagattgactaa

SEQ ID NO: 490038 - DNA, 25 bp, Rattus norvegicus
tgatttatgacgttttacagcccta

SEQ ID NO: 490039 - DNA, 25 bp, Rattus norvegicus
gatccgaaatttcctccatgcgaag

SEQ ID NO: 490040 - DNA, 25 bp, Rattus norvegicus
aaatcgcagccgctctgcgagccgg

SEQ ID NO: 490041 - DNA, 25 bp, Rattus norvegicus
accctgagaaatcgcagccgctctg

SEQ ID NO: 490042 - DNA, 25 bp, Rattus norvegicus
aggggcccggcaattcgcgagccca

SEQ ID NO: 490043 - DNA, 25 bp, Rattus norvegicus
atagctgcaccagtctccaggggcc

SEQ ID NO: 490044 - DNA, 25 bp, Rattus norvegicus
ccctgagcgtcagtatagctgcacc

SEQ ID NO: 490045 - DNA, 25 bp, Rattus norvegicus
gccctagctaccctgagcgtcagta

SEQ ID NO: 490046 - DNA, 25 bp, Rattus norvegicus
gggattccagcatcaccaccaggag

SEQ ID NO: 490047 - DNA, 25 bp, Rattus norvegicus
gccggaccagggaatcgggattcca

SEQ ID NO: 490048 - DNA, 25 bp, Rattus norvegicus
atattacggccggaccagggaatcg

SEQ ID NO: 490049 - DNA, 25 bp, Rattus norvegicus
cctgaacacagtccggaatattacg

SEQ ID NO: 490050 - DNA, 25 bp, Rattus norvegicus
gctacatccctgaacacagtccgga

SEQ ID NO: 490051 - DNA, 25 bp, Rattus norvegicus
ttcctccatgcgaagaatattcgca

SEQ ID NO: 490052 - DNA, 25 bp, Rattus norvegicus
tattcgcaaaatagctacatccctg

SEQ ID NO: 490053 - DNA, 25 bp, Rattus norvegicus
cgcatgaaatggaagaaggaccacc

SEQ ID NO: 490054 - DNA, 25 bp, Rattus norvegicus
cccgaaggagaaggatcgagatcgc

SEQ ID NO: 490055 - DNA, 25 bp, Rattus norvegicus
aaggatcgagatcgcccactcgctg

SEQ ID NO: 490056 - DNA, 25 bp, Rattus norvegicus
cactcgctgtgcctctctgagaggc

SEQ ID NO: 490057 - DNA, 25 bp, Rattus norvegicus
ctctctgagaggcagatcaaaatct

SEQ ID NO: 490058 - DNA, 25 bp, Rattus norvegicus
caaaaccgtcgcatgaaatggaaga

SEQ ID NO: 490059 - DNA, 25 bp, Rattus norvegicus
ctacctgacccgaaggagaaggatc

SEQ ID NO: 490060 - DNA, 25 bp, Rattus norvegicus
gaaatggaagaaggaccaccgactc

SEQ ID NO: 490061 - DNA, 25 bp, Rattus norvegicus
caacaccaaagtgaggtcagcgccc

SEQ ID NO: 490062 - DNA, 25 bp, Rattus norvegicus
ggccggcgctgcacccagcaccctc

SEQ ID NO: 490063 - DNA, 25 bp, Rattus norvegicus
ggcacttctgaagaccactcccaga

SEQ ID NO: 490064 - DNA, 25 bp, Rattus norvegicus
acttctgaagaccactcccagagcg

SEQ ID NO: 490065 - DNA, 25 bp, Rattus norvegicus
cccagagcgccacgccgccggagca

SEQ ID NO: 490066 - DNA, 25 bp, Rattus norvegicus
ggttccaaaaccgtcgcatgaaatg

SEQ ID NO: 490067 - DNA, 25 bp, Rattus norvegicus
cagctcttttttcgggactgccgga

SEQ ID NO: 490068 - DNA, 25 bp, Rattus norvegicus
ggtgaactcaaaagcctggggtctc

SEQ ID NO: 490069 - DNA, 25 bp, Rattus norvegicus
actactacgcggtgaactcaaaagc

SEQ ID NO: 490070 - DNA, 25 bp, Rattus norvegicus
caaaagcctggggtctcgccctgcg

SEQ ID NO: 490071 - DNA, 25 bp, Rattus norvegicus
acgggagagggcagctcttttttcg

SEQ ID NO: 490072 - DNA, 25 bp, Rattus norvegicus
ctcaggaccgagaaatggggaaata

SEQ ID NO: 490073 - DNA, 25 bp, Rattus norvegicus
caagggctgctttgggctccaggcc

SEQ ID NO: 490074 - DNA, 25 bp, Rattus norvegicus
aagcgactgtttcgcttgaggttga

SEQ ID NO: 490075 - DNA, 25 bp, Rattus norvegicus
tgctttgggctccaggccgcgtccg

SEQ ID NO: 490076 - DNA, 25 bp, Rattus norvegicus
ggggtcgccttcacctaggtcacga

SEQ ID NO: 490077 - DNA, 25 bp, Rattus norvegicus
cccaagctctggctacagacaatag

SEQ ID NO: 490078 - DNA, 25 bp, Rattus norvegicus
tctggctacagacaatagggcgcgg

SEQ ID NO: 490079 - DNA, 25 bp, Rattus norvegicus
ccgctgggcgggttcactactacgc

SEQ ID NO: 490080 - DNA, 25 bp, Rattus norvegicus
actgtttcgcttgaggttgacggga

SEQ ID NO: 490081 - DNA, 25 bp, Rattus norvegicus
ggcacctctgcatcccagcggccca

SEQ ID NO: 490082 - DNA, 25 bp, Rattus norvegicus
cggtcttcgcttcctttatggaaat

SEQ ID NO: 490083 - DNA, 25 bp, Rattus norvegicus
ttcctttatggaaatcgcttggctc

SEQ ID NO: 490084 - DNA, 25 bp, Rattus norvegicus
cgcttggctccaagttcggaaaaga

SEQ ID NO: 490085 - DNA, 25 bp, Rattus norvegicus
agaaaaattcaaagcgccctagctc

SEQ ID NO: 490086 - DNA, 25 bp, Rattus norvegicus
agcgccctagctctcgctacttttt

SEQ ID NO: 490087 - DNA, 25 bp, Rattus norvegicus
ctcgctactttttaagaaggctcta

SEQ ID NO: 490088 - DNA, 25 bp, Rattus norvegicus
gaaggctctagggagggactgtccc

SEQ ID NO: 490089 - DNA, 25 bp, Rattus norvegicus
gagctgccttcaggagctccggcct

SEQ ID NO: 490090 - DNA, 25 bp, Rattus norvegicus
gagctccggcctcgcgctcttccca

SEQ ID NO: 490091 - DNA, 25 bp, Rattus norvegicus
ttccctctctaccacggcacctctg

SEQ ID NO: 490092 - DNA, 25 bp, Rattus norvegicus
agcaggaatccggacccggtcttcg

SEQ ID NO: 490093 - DNA, 25 bp, Rattus norvegicus
ccagcggcccaaccgacttcggcta

SEQ ID NO: 490094 - DNA, 25 bp, Rattus norvegicus
ccggcggccataaatattttttctg

SEQ ID NO: 490095 - DNA, 25 bp, Rattus norvegicus
agaagagataattgaaaactccggg

SEQ ID NO: 490096 - DNA, 25 bp, Rattus norvegicus
aattaagcttgcgagatggagaggc

SEQ ID NO: 490097 - DNA, 25 bp, Rattus norvegicus
gcgttaattaagcttgcgagatgga

SEQ ID NO: 490098 - DNA, 25 bp, Rattus norvegicus
cccgcgcttgatgaaagagcccctg

SEQ ID NO: 490099 - DNA, 25 bp, Rattus norvegicus
cctgcaaatccattaagaagagata

SEQ ID NO: 490100 - DNA, 25 bp, Rattus norvegicus
gcatctttcatgctgctgacgatcg

SEQ ID NO: 490101 - DNA, 25 bp, Rattus norvegicus
gggcggctccgctttatttgcagca

SEQ ID NO: 490102 - DNA, 25 bp, Rattus norvegicus
ccctcagcgttaattaagcttgcga

SEQ ID NO: 490103 - DNA, 25 bp, Rattus norvegicus
ggtaatatttaaggcctcgcgcctg

SEQ ID NO: 490104 - DNA, 25 bp, Rattus norvegicus
ttcatgctgctgacgatcgtaaagg

SEQ ID NO: 490105 - DNA, 25 bp, Rattus norvegicus
tgctgctgacgatcgtaaagggctt

SEQ ID NO: 490106 - DNA, 25 bp, Rattus norvegicus
gggctttaatattgaaatatgggcc

SEQ ID NO: 490107 - DNA, 25 bp, Rattus norvegicus
tgaaatatgggccattttcccagct

SEQ ID NO: 490108 - DNA, 25 bp, Rattus norvegicus
ggctccgctttatttgcagcatctt

SEQ ID NO: 490109 - DNA, 25 bp, Rattus norvegicus
ggccctctccgatgctctgtagatc

SEQ ID NO: 490110 - DNA, 25 bp, Rattus norvegicus
tggggctaaggggaccctcatcctc

SEQ ID NO: 490111 - DNA, 25 bp, Rattus norvegicus
aattggaggacacgacagacgtcgc

SEQ ID NO: 490112 - DNA, 25 bp, Rattus norvegicus
ccttcttttcagctgccgggtgttc

SEQ ID NO: 490113 - DNA, 25 bp, Rattus norvegicus
gatcgccgcttcgtccttacttttg

SEQ ID NO: 490114 - DNA, 25 bp, Rattus norvegicus
ggatggtcacatgcgtcccgcttcc

SEQ ID NO: 490115 - DNA, 25 bp, Rattus norvegicus
tttagatcaggcatctgcgccctcc

SEQ ID NO: 490116 - DNA, 25 bp, Rattus norvegicus
gtgagcctcttctggaaatcctttg

SEQ ID NO: 490117 - DNA, 25 bp, Rattus norvegicus
cgcgcgaagcttctgtctggaaatt

SEQ ID NO: 490118 - DNA, 25 bp, Rattus norvegicus
ttgcaattctctgtctgtccctcgg

SEQ ID NO: 490119 - DNA, 25 bp, Rattus norvegicus
ccttacttttgggatggtcacatgc

SEQ ID NO: 490120 - DNA, 25 bp, Rattus norvegicus
gaaaatctattggagcctgtccgga

SEQ ID NO: 490121 - DNA, 25 bp, Rattus norvegicus
gagcacgtggtgtctcgtaccaata

SEQ ID NO: 490122 - DNA, 25 bp, Rattus norvegicus
cttcccacggccgttttagatcagg

SEQ ID NO: 490123 - DNA, 25 bp, Rattus norvegicus
ctcgcggaggatcccagcccattga

SEQ ID NO: 490124 - DNA, 25 bp, Rattus norvegicus
agctcgcttgcatacatttgcatgc

SEQ ID NO: 490125 - DNA, 25 bp, Rattus norvegicus
cgcagcactagctcgcttgcataca

SEQ ID NO: 490126 - DNA, 25 bp, Rattus norvegicus
atgcgatttgcatgtgatcaacttc

SEQ ID NO: 490127 - DNA, 25 bp, Rattus norvegicus
atcctcctgggtgcggccagggtcc

SEQ ID NO: 490128 - DNA, 25 bp, Rattus norvegicus
tgcatacatttgcatgcgatttgca

SEQ ID NO: 490129 - DNA, 25 bp, Rattus norvegicus
ccagcccattgaggccgctgattga

SEQ ID NO: 490130 - DNA, 25 bp, Rattus norvegicus
gccgctgattgatggcgctgccctc

SEQ ID NO: 490131 - DNA, 25 bp, Rattus norvegicus
tgccctccgcgtgaacccgccttta

SEQ ID NO: 490132 - DNA, 25 bp, Rattus norvegicus
gcctttaataccgaggaagttatga

SEQ ID NO: 490133 - DNA, 25 bp, Rattus norvegicus
ttatgaaaccgccatacatcagcgc

SEQ ID NO: 490134 - DNA, 25 bp, Rattus norvegicus
ggctcctcttcaaaacctcatttgg

SEQ ID NO: 490135 - DNA, 25 bp, Rattus norvegicus
caaaacctcatttgggctccggccg

SEQ ID NO: 490136 - DNA, 25 bp, Rattus norvegicus
tgatcaacttcacgttcaaagcctg

SEQ ID NO: 490137 - DNA, 25 bp, Rattus norvegicus
ccggcccagtcaccgcacctcatgg

SEQ ID NO: 490138 - DNA, 25 bp, Rattus norvegicus
agggctgcccggctcaacgactaga

SEQ ID NO: 490139 - DNA, 25 bp, Rattus norvegicus
gactccgccagtgcaggagggcgca

SEQ ID NO: 490140 - DNA, 25 bp, Rattus norvegicus
atctctgcgagcgtagggatctccc

SEQ ID NO: 490141 - DNA, 25 bp, Rattus norvegicus
acagacatctctgcgagcgtaggga

SEQ ID NO: 490142 - DNA, 25 bp, Rattus norvegicus
ctcagggaaacagacatctctgcga

SEQ ID NO: 490143 - DNA, 25 bp, Rattus norvegicus
tctcattttcctgcgggtctttgcc

SEQ ID NO: 490144 - DNA, 25 bp, Rattus norvegicus
tacgtctctctcattttcctgcggg

SEQ ID NO: 490145 - DNA, 25 bp, Rattus norvegicus
gcagctctagtttacgtctctctca

SEQ ID NO: 490146 - DNA, 25 bp, Rattus norvegicus
cccggctcaacgactagaaggcacg

SEQ ID NO: 490147 - DNA, 25 bp, Rattus norvegicus
cccatgtcactcaaggctctgcagg

SEQ ID NO: 490148 - DNA, 25 bp, Rattus norvegicus
acctcatggcctgcccttcgccctg

SEQ ID NO: 490149 - DNA, 25 bp, Rattus norvegicus
gggtactgcagctctagtttacgtc

SEQ ID NO: 490150 - DNA, 25 bp, Rattus norvegicus
gtctttgcctccgagctcaccgcgc

SEQ ID NO: 490151 - DNA, 25 bp, Rattus norvegicus
gggagcacttggtcgcatgcgcaaa

SEQ ID NO: 490152 - DNA, 25 bp, Rattus norvegicus
tttctcacgaaaaggccagcgttta

SEQ ID NO: 490153 - DNA, 25 bp, Rattus norvegicus
cttcgcccttcagggtcacgtgagc

SEQ ID NO: 490154 - DNA, 25 bp, Rattus norvegicus
tgtgatcgggacttcttcgcccttc

SEQ ID NO: 490155 - DNA, 25 bp, Rattus norvegicus
cgcatgcgcaaaaggaatctacaca

SEQ ID NO: 490156 - DNA, 25 bp, Rattus norvegicus
tgtcacttctgttttagagcgaagg

SEQ ID NO: 490157 - DNA, 25 bp, Rattus norvegicus
gcccgccttcgtgtgatgtcacttc

SEQ ID NO: 490158 - DNA, 25 bp, Rattus norvegicus
ggcagtttccataacaaccatcttg

SEQ ID NO: 490159 - DNA, 25 bp, Rattus norvegicus
tgacgtctccagagggcagtttcca

SEQ ID NO: 490160 - DNA, 25 bp, Rattus norvegicus
acttccggtcttcgtgacgtctcca

SEQ ID NO: 490161 - DNA, 25 bp, Rattus norvegicus
ttgctgcccgtcagactaacttccg

SEQ ID NO: 490162 - DNA, 25 bp, Rattus norvegicus
agcgctttaggcctgacccgcttgc

SEQ ID NO: 490163 - DNA, 25 bp, Rattus norvegicus
actccgtaccacgtggtctgcctta

SEQ ID NO: 490164 - DNA, 25 bp, Rattus norvegicus
gtagcttcgcggcacttggaaaccc

SEQ ID NO: 490165 - DNA, 25 bp, Rattus norvegicus
caggcgcagaaaccctctcttttta

SEQ ID NO: 490166 - DNA, 25 bp, Rattus norvegicus
cattggacttcaggaaccgggtcga

SEQ ID NO: 490167 - DNA, 25 bp, Rattus norvegicus
ccgggtcgaaagaacagaagacact

SEQ ID NO: 490168 - DNA, 25 bp, Rattus norvegicus
ctcgggctcccgaagttcaattgtc

SEQ ID NO: 490169 - DNA, 25 bp, Rattus norvegicus
gttcaattgtctgtcccagccagtg

SEQ ID NO: 490170 - DNA, 25 bp, Rattus norvegicus
ccagccagtgatctgcgggtccgat

SEQ ID NO: 490171 - DNA, 25 bp, Rattus norvegicus
gcgggtccgatctgtgtatttactc

SEQ ID NO: 490172 - DNA, 25 bp, Rattus norvegicus
aagttttcccttcgcgctgtgtctc

SEQ ID NO: 490173 - DNA, 25 bp, Rattus norvegicus
gcctttagactgaagggaccagccc

SEQ ID NO: 490174 - DNA, 25 bp, Rattus norvegicus
ggacactgcctgttgtcatcggctt

SEQ ID NO: 490175 - DNA, 25 bp, Rattus norvegicus
tttgcgctcaaaccagaagccgccg

SEQ ID NO: 490176 - DNA, 25 bp, Rattus norvegicus
ttttattcaatctcgggacactgcc

SEQ ID NO: 490177 - DNA, 25 bp, Rattus norvegicus
ttttttgccttctttgcggtctcgc

SEQ ID NO: 490178 - DNA, 25 bp, Rattus norvegicus
ctctggtgaaaacaggacatccctt

SEQ ID NO: 490179 - DNA, 25 bp, Rattus norvegicus
tgattccaaagtgcggccacccagg

SEQ ID NO: 490180 - DNA, 25 bp, Rattus norvegicus
tgtgaggcaggtcctacagtctctc

SEQ ID NO: 490181 - DNA, 25 bp, Rattus norvegicus
cgcgcgagacgtgccgccaagagca

SEQ ID NO: 490182 - DNA, 25 bp, Rattus norvegicus
gtgccgccaagagcagggcctcgct

SEQ ID NO: 490183 - DNA, 25 bp, Rattus norvegicus
cggtgtcaccctcggggacaggtct

SEQ ID NO: 490184 - DNA, 25 bp, Rattus norvegicus
caccctcggggacaggtctcgagga

SEQ ID NO: 490185 - DNA, 25 bp, Rattus norvegicus
tctcgaggagtttgaggtccctgca

SEQ ID NO: 490186 - DNA, 25 bp, Rattus norvegicus
acccagccgtcccagtgggcggcca

SEQ ID NO: 490187 - DNA, 25 bp, Rattus norvegicus
caaagtgcggccacccagggcgact

SEQ ID NO: 490188 - DNA, 25 bp, Rattus norvegicus
cccagggcgactcaggcactggcaa

SEQ ID NO: 490189 - DNA, 25 bp, Rattus norvegicus
tcaggcactggcaagagcaatgtga

SEQ ID NO: 490190 - DNA, 25 bp, Rattus norvegicus
caagagcaatgtgaggcaggtccta

SEQ ID NO: 490191 - DNA, 25 bp, Rattus norvegicus
ggtccctgcagtgtgattccaaagt

SEQ ID NO: 490192 - DNA, 25 bp, Rattus norvegicus
aggtcctacagtctctcaccgaagc

SEQ ID NO: 490193 - DNA, 25 bp, Rattus norvegicus
gctaccgccgccttctgcgcaatgc

SEQ ID NO: 490194 - DNA, 25 bp, Rattus norvegicus
aaaacggatccttccctgcgcctgc

SEQ ID NO: 490195 - DNA, 25 bp, Rattus norvegicus
caaaacggatccttccctgcgcctg

SEQ ID NO: 490196 - DNA, 25 bp, Rattus norvegicus
gccaaaacggatccttccctgcgcc

SEQ ID NO: 490197 - DNA, 25 bp, Rattus norvegicus
ccgccaaaacggatccttccctgcg

SEQ ID NO: 490198 - DNA, 25 bp, Rattus norvegicus
tgcgcaatgccaaccgcccgccaaa

SEQ ID NO: 490199 - DNA, 25 bp, Rattus norvegicus
tctgcgcaatgccaaccgcccgcca

SEQ ID NO: 490200 - DNA, 25 bp, Rattus norvegicus
cttctgcgcaatgccaaccgcccgc

SEQ ID NO: 490201 - DNA, 25 bp, Rattus norvegicus
gccttctgcgcaatgccaaccgccc

SEQ ID NO: 490202 - DNA, 25 bp, Rattus norvegicus
ccgccttctgcgcaatgccaaccgc

SEQ ID NO: 490203 - DNA, 25 bp, Rattus norvegicus
ccgccgccttctgcgcaatgccaac

SEQ ID NO: 490204 - DNA, 25 bp, Rattus norvegicus
accgccgccttctgcgcaatgccaa

SEQ ID NO: 490205 - DNA, 25 bp, Rattus norvegicus
taccgccgccttctgcgcaatgcca

SEQ ID NO: 490206 - DNA, 25 bp, Rattus norvegicus
aaacggatccttccctgcgcctgcg

SEQ ID NO: 490207 - DNA, 25 bp, Rattus norvegicus
tgcgcaaccaatcccgggcttggac

SEQ ID NO: 490208 - DNA, 25 bp, Rattus norvegicus
agtcgcggcgaactactttctaacg

SEQ ID NO: 490209 - DNA, 25 bp, Rattus norvegicus
ttatagctgggaaaagtcgcggcga

SEQ ID NO: 490210 - DNA, 25 bp, Rattus norvegicus
attacacatgcgctttatagctggg

SEQ ID NO: 490211 - DNA, 25 bp, Rattus norvegicus
gcgtaaactcgccatttttattaca

SEQ ID NO: 490212 - DNA, 25 bp, Rattus norvegicus
tgcgccggcgtaaactcgccatttt

SEQ ID NO: 490213 - DNA, 25 bp, Rattus norvegicus
gaacttcgtactgcgccggcgtaaa

SEQ ID NO: 490214 - DNA, 25 bp, Rattus norvegicus
agacagcaggcggaacttcgtactg

SEQ ID NO: 490215 - DNA, 25 bp, Rattus norvegicus
tttcacgtgttccagacagcaggcg

SEQ ID NO: 490216 - DNA, 25 bp, Rattus norvegicus
ccgccatttcacgtgttccagacag

SEQ ID NO: 490217 - DNA, 25 bp, Rattus norvegicus
tacgcaggcgcctacgaacctcgta

SEQ ID NO: 490218 - DNA, 25 bp, Rattus norvegicus
gcgcaaaacagaacacaggtccctc

SEQ ID NO: 490219 - DNA, 25 bp, Rattus norvegicus
ctttctaacgtatcgtcctttgccg

SEQ ID NO: 490220 - DNA, 25 bp, Rattus norvegicus
gcccaaaacgcctgcgcaaaacaga

SEQ ID NO: 490221 - DNA, 25 bp, Rattus norvegicus
atgacgggatgtgacctgttttgtc

SEQ ID NO: 490222 - DNA, 25 bp, Rattus norvegicus
cacacttactgaatatgacgggatg

SEQ ID NO: 490223 - DNA, 25 bp, Rattus norvegicus
cagaaggtaggctgccggacacgtt

SEQ ID NO: 490224 - DNA, 25 bp, Rattus norvegicus
gcttcgctttcttccacacttactg

SEQ ID NO: 490225 - DNA, 25 bp, Rattus norvegicus
ttgagcgcgctctgcagcttcgctt

SEQ ID NO: 490226 - DNA, 25 bp, Rattus norvegicus
tcctaccgtcatgtctaagtcagag

SEQ ID NO: 490227 - DNA, 25 bp, Rattus norvegicus
atcgctgaacgctctcatcatccta

SEQ ID NO: 490228 - DNA, 25 bp, Rattus norvegicus
ggaagcatcgctgaacgctctcatc

SEQ ID NO: 490229 - DNA, 25 bp, Rattus norvegicus
ttgacgctggcgaggaagcatcgct

SEQ ID NO: 490230 - DNA, 25 bp, Rattus norvegicus
cctttctgctctttgacgctggcga

SEQ ID NO: 490231 - DNA, 25 bp, Rattus norvegicus
acgttcgctatcttattcctttctg

SEQ ID NO: 490232 - DNA, 25 bp, Rattus norvegicus
gccggacacgttcgctatcttattc

SEQ ID NO: 490233 - DNA, 25 bp, Rattus norvegicus
tgacctgttttgtcgctggctcccg

SEQ ID NO: 490234 - DNA, 25 bp, Rattus norvegicus
ctaccaatgccgaaagcgaggaggc

SEQ ID NO: 490235 - DNA, 25 bp, Rattus norvegicus
gcggcgacgtcgcttgtgcgactcc

SEQ ID NO: 490236 - DNA, 25 bp, Rattus norvegicus
gtccgtgaagcgagtgactacgctg

SEQ ID NO: 490237 - DNA, 25 bp, Rattus norvegicus
gtgactacgctgactggtccagatg

SEQ ID NO: 490238 - DNA, 25 bp, Rattus norvegicus
caagatggaggcgctgattttggta

SEQ ID NO: 490239 - DNA, 25 bp, Rattus norvegicus
tgcgactccacgtcggcagcagcta

SEQ ID NO: 490240 - DNA, 25 bp, Rattus norvegicus
ccaatcagcggcgacgtcgcttgtg

SEQ ID NO: 490241 - DNA, 25 bp, Rattus norvegicus
agcgaagactcagggccaatcagcg

SEQ ID NO: 490242 - DNA, 25 bp, Rattus norvegicus
tctagcgaagactcagggccaatca

SEQ ID NO: 490243 - DNA, 25 bp, Rattus norvegicus
cgggatctagcgaagactcagggcc

SEQ ID NO: 490244 - DNA, 25 bp, Rattus norvegicus
acccaatgttgcttctttggggcgg

SEQ ID NO: 490245 - DNA, 25 bp, Rattus norvegicus
gctggcttattttcacccaatgttg

SEQ ID NO: 490246 - DNA, 25 bp, Rattus norvegicus
tgcgaaggctggcttattttcaccc

SEQ ID NO: 490247 - DNA, 25 bp, Rattus norvegicus
ctgactggtccagatgcgaaggctg

SEQ ID NO: 490248 - DNA, 25 bp, Rattus norvegicus
cgtcggcagcagctacgggcaagat

SEQ ID NO: 490249 - DNA, 25 bp, Rattus norvegicus
tgggcagcatggtgatagaaggata

SEQ ID NO: 490250 - DNA, 25 bp, Rattus norvegicus
cgtgtccaacaaggtggcaggagtc

SEQ ID NO: 490251 - DNA, 25 bp, Rattus norvegicus
tgcttccaggaaaggccttgttccg

SEQ ID NO: 490252 - DNA, 25 bp, Rattus norvegicus
gaccctgcttccaggaaaggccttg

SEQ ID NO: 490253 - DNA, 25 bp, Rattus norvegicus
ctgggaagagggcttaggcagaaga

SEQ ID NO: 490254 - DNA, 25 bp, Rattus norvegicus
gcgactagaccctgcttccaggaaa

SEQ ID NO: 490255 - DNA, 25 bp, Rattus norvegicus
tggggaccgcgactagaccctgctt

SEQ ID NO: 490256 - DNA, 25 bp, Rattus norvegicus
ccagttgggctccagagatcggcga

SEQ ID NO: 490257 - DNA, 25 bp, Rattus norvegicus
aagcagaggctagcgtgtccaacaa

SEQ ID NO: 490258 - DNA, 25 bp, Rattus norvegicus
aattccaaggacctgggaagcagag

SEQ ID NO: 490259 - DNA, 25 bp, Rattus norvegicus
gggaattccaaggacctgggaagca

SEQ ID NO: 490260 - DNA, 25 bp, Rattus norvegicus
ataggggtaggaccgatggcaagtc

SEQ ID NO: 490261 - DNA, 25 bp, Rattus norvegicus
cttaggcagaagagaggtctgggca

SEQ ID NO: 490262 - DNA, 25 bp, Rattus norvegicus
atggcaagtctgagatttggggaat

SEQ ID NO: 490263 - DNA, 25 bp, Rattus norvegicus
cccaactcaagtcttagtctttcca

SEQ ID NO: 490264 - DNA, 25 bp, Rattus norvegicus
ccagaggcgaatgactcaacgcggg

SEQ ID NO: 490265 - DNA, 25 bp, Rattus norvegicus
taaacctcccagaggcgaatgactc

SEQ ID NO: 490266 - DNA, 25 bp, Rattus norvegicus
gccaccgacccggagccgcttccta

SEQ ID NO: 490267 - DNA, 25 bp, Rattus norvegicus
ttcttccctgtcctggggccaccga

SEQ ID NO: 490268 - DNA, 25 bp, Rattus norvegicus
cagcaccgcatggagaggagatcgt

SEQ ID NO: 490269 - DNA, 25 bp, Rattus norvegicus
ggcctccgcgtctaggttgaagccc

SEQ ID NO: 490270 - DNA, 25 bp, Rattus norvegicus
actccacggagaagccaaagaggga

SEQ ID NO: 490271 - DNA, 25 bp, Rattus norvegicus
caagtcttagtctttccaaactccg

SEQ ID NO: 490272 - DNA, 25 bp, Rattus norvegicus
atctcacactccacgtcggccacgg

SEQ ID NO: 490273 - DNA, 25 bp, Rattus norvegicus
tcaacgcggggaggagtttgcccaa

SEQ ID NO: 490274 - DNA, 25 bp, Rattus norvegicus
atcgtggcgaccgtggcgtccagct

SEQ ID NO: 490275 - DNA, 25 bp, Rattus norvegicus
tcctggtcgcctccagtactcggcg

SEQ ID NO: 490276 - DNA, 25 bp, Rattus norvegicus
ccagcgcagcagcaccgcatggaga

SEQ ID NO: 490277 - DNA, 25 bp, Rattus norvegicus
cccttgggcgctcctgagtgtgcac

SEQ ID NO: 490278 - DNA, 25 bp, Rattus norvegicus
tagccacgcgtggaatattgggacc

SEQ ID NO: 490279 - DNA, 25 bp, Rattus norvegicus
ggcgactagccacgcgtggaatatt

SEQ ID NO: 490280 - DNA, 25 bp, Rattus norvegicus
gatatgcgggcgactagccacgcgt

SEQ ID NO: 490281 - DNA, 25 bp, Rattus norvegicus
ccacgcgtggaatattgggaccaca

SEQ ID NO: 490282 - DNA, 25 bp, Rattus norvegicus
gtggaatattgggaccacatgcgca

SEQ ID NO: 490283 - DNA, 25 bp, Rattus norvegicus
gcacattcacagaaactctgaacac

SEQ ID NO: 490284 - DNA, 25 bp, Rattus norvegicus
tcacagaaactctgaacacacccag

SEQ ID NO: 490285 - DNA, 25 bp, Rattus norvegicus
caccatccacacgaagtcctgtggg

SEQ ID NO: 490286 - DNA, 25 bp, Rattus norvegicus
atccacacgaagtcctgtgggccgc

SEQ ID NO: 490287 - DNA, 25 bp, Rattus norvegicus
ccgcgctcgctgtcaacacgcacta

SEQ ID NO: 490288 - DNA, 25 bp, Rattus norvegicus
cacgcagcagccactcgtgccgggc

SEQ ID NO: 490289 - DNA, 25 bp, Rattus norvegicus
agtggctgcactgcgcggtagaccg

SEQ ID NO: 490290 - DNA, 25 bp, Rattus norvegicus
cgcgcgcaagggcacacgcagcagc

SEQ ID NO: 490291 - DNA, 25 bp, Rattus norvegicus
gccttaaccctgtggtggctgcgct

SEQ ID NO: 490292 - DNA, 25 bp, Rattus norvegicus
tgcggattggctcgtcactgtccct

SEQ ID NO: 490293 - DNA, 25 bp, Rattus norvegicus
atagctgtcctcatccctttccgtg

SEQ ID NO: 490294 - DNA, 25 bp, Rattus norvegicus
ctcatagcccaggtgcggatgactc

SEQ ID NO: 490295 - DNA, 25 bp, Rattus norvegicus
actcggaggtaaggagagctgtctc

SEQ ID NO: 490296 - DNA, 25 bp, Rattus norvegicus
ggcggtacccttcagcccagcgatg

SEQ ID NO: 490297 - DNA, 25 bp, Rattus norvegicus
cataaactgggcgagtacgttcccg

SEQ ID NO: 490298 - DNA, 25 bp, Rattus norvegicus
acttgcagaagggaacaccagcttg

SEQ ID NO: 490299 - DNA, 25 bp, Rattus norvegicus
gtcccacgtgctccgacttgcagaa

SEQ ID NO: 490300 - DNA, 25 bp, Rattus norvegicus
tgggcagcgagtgaaccacgctctt

SEQ ID NO: 490301 - DNA, 25 bp, Rattus norvegicus
ggcagagttatacccaggtcccacg

SEQ ID NO: 490302 - DNA, 25 bp, Rattus norvegicus
actggatcttccgtggactgttgtc

SEQ ID NO: 490303 - DNA, 25 bp, Rattus norvegicus
cagcggaaccgtaaactggatcttc

SEQ ID NO: 490304 - DNA, 25 bp, Rattus norvegicus
atgccacctagcagggaaactctgg

SEQ ID NO: 490305 - DNA, 25 bp, Rattus norvegicus
actgcacacagccatggcacagggc

SEQ ID NO: 490306 - DNA, 25 bp, Rattus norvegicus
ttcaatgctggctcagacgccggca

SEQ ID NO: 490307 - DNA, 25 bp, Rattus norvegicus
ggagcggcctccctttatagacctg

SEQ ID NO: 490308 - DNA, 25 bp, Rattus norvegicus
atagacctggagaccttcaatgctg

SEQ ID NO: 490309 - DNA, 25 bp, Rattus norvegicus
tgggcggccgtaaccacggcctgta

SEQ ID NO: 490310 - DNA, 25 bp, Rattus norvegicus
ctcagcctggtcttcgcgctgtctg

SEQ ID NO: 490311 - DNA, 25 bp, Rattus norvegicus
gcgctgtctgcacactcggtgtttg

SEQ ID NO: 490312 - DNA, 25 bp, Rattus norvegicus
tgagcgtgtggtcagcctgttcgtt

SEQ ID NO: 490313 - DNA, 25 bp, Rattus norvegicus
gccctgggcatcagcatggcccgaa

SEQ ID NO: 490314 - DNA, 25 bp, Rattus norvegicus
cagcatggcccgaagtgcagtaccc

SEQ ID NO: 490315 - DNA, 25 bp, Rattus norvegicus
cggtgaccgtgagcgccatgatccc

SEQ ID NO: 490316 - DNA, 25 bp, Rattus norvegicus
ccatgatcccggtgggcattgggct

SEQ ID NO: 490317 - DNA, 25 bp, Rattus norvegicus
cctgggcatcgagagtgcccgcagc

SEQ ID NO: 490318 - DNA, 25 bp, Rattus norvegicus
ctcggagtacgagagcccatttgtg

SEQ ID NO: 490319 - DNA, 25 bp, Rattus norvegicus
gatgcccagagctctgcatgccgcg

SEQ ID NO: 490320 - DNA, 25 bp, Rattus norvegicus
atgcccagagctctgcatgccgcgg

SEQ ID NO: 490321 - DNA, 25 bp, Rattus norvegicus
gcggggaccacagcggcccaggtag

SEQ ID NO: 490322 - DNA, 25 bp, Rattus norvegicus
gcttggccgtgacctggggctgcag

SEQ ID NO: 490323 - DNA, 25 bp, Rattus norvegicus
ctgatggacacccagggcgggcttg

SEQ ID NO: 490324 - DNA, 25 bp, Rattus norvegicus
atgccgcgggttgctgatggacacc

SEQ ID NO: 490325 - DNA, 25 bp, Rattus norvegicus
agagctctgcatgccgcgggttgct

SEQ ID NO: 490326 - DNA, 25 bp, Rattus norvegicus
cgttccctgcggtgcaggtggccac

SEQ ID NO: 490327 - DNA, 25 bp, Rattus norvegicus
gtcccgatgcccagagctctgcatg

SEQ ID NO: 490328 - DNA, 25 bp, Rattus norvegicus
tgggtgtcccgatgcccagagctct

SEQ ID NO: 490329 - DNA, 25 bp, Rattus norvegicus
tgtgggtgtcccgatgcccagagct

SEQ ID NO: 490330 - DNA, 25 bp, Rattus norvegicus
gtggccacgtggtgcgcgtgggtgt

SEQ ID NO: 490331 - DNA, 25 bp, Rattus norvegicus
ttccctgcggtgcaggtggccacgt

SEQ ID NO: 490332 - DNA, 25 bp, Rattus norvegicus
cccagagctctgcatgccgcgggtt

SEQ ID NO: 490333 - DNA, 25 bp, Rattus norvegicus
ccttccgactctaagtggctgagcc

SEQ ID NO: 490334 - DNA, 25 bp, Rattus norvegicus
ggccatgatctcgtcattgtccagc

SEQ ID NO: 490335 - DNA, 25 bp, Rattus norvegicus
gcgccttggcaacagacaccggaag

SEQ ID NO: 490336 - DNA, 25 bp, Rattus norvegicus
tccggccggtactggagttccagag

SEQ ID NO: 490337 - DNA, 25 bp, Rattus norvegicus
acccggctccgtcggcaaagaggct

SEQ ID NO: 490338 - DNA, 25 bp, Rattus norvegicus
acggtgtcgcaaagggccatgatct

SEQ ID NO: 490339 - DNA, 25 bp, Rattus norvegicus
attgtccagcatgccgagtaggttc

SEQ ID NO: 490340 - DNA, 25 bp, Rattus norvegicus
agtaggttccggcagccttccgact

SEQ ID NO: 490341 - DNA, 25 bp, Rattus norvegicus
ggcagaggacgacgccaccaatgtc

SEQ ID NO: 490342 - DNA, 25 bp, Rattus norvegicus
accggaagtgccttttcaatcaatc

SEQ ID NO: 490343 - DNA, 25 bp, Rattus norvegicus
tcaatcaatcgctggtgccggaaga

SEQ ID NO: 490344 - DNA, 25 bp, Rattus norvegicus
tgccggaagagtctcgaatattcta

SEQ ID NO: 490345 - DNA, 25 bp, Rattus norvegicus
agtcagcgcggaaacatgatggttc

SEQ ID NO: 490346 - DNA, 25 bp, Rattus norvegicus
tggagagttgtgcagcgacttccct

SEQ ID NO: 490347 - DNA, 25 bp, Rattus norvegicus
ccggtgaccttaagctgccctaaca

SEQ ID NO: 490348 - DNA, 25 bp, Rattus norvegicus
cacaggcgcagcttctactacgaac

SEQ ID NO: 490349 - DNA, 25 bp, Rattus norvegicus
gtccatcctggtaagcgccttcctg

SEQ ID NO: 490350 - DNA, 25 bp, Rattus norvegicus
ggcctagcagatctgtgctccatta

SEQ ID NO: 490351 - DNA, 25 bp, Rattus norvegicus
tgtgctccattaggatcctggcgca

SEQ ID NO: 490352 - DNA, 25 bp, Rattus norvegicus
tcctggcgcagcgaactactgtcca

SEQ ID NO: 490353 - DNA, 25 bp, Rattus norvegicus
ccagccgcagagtgcaaggacagtc

SEQ ID NO: 490354 - DNA, 25 bp, Rattus norvegicus
atcgaaccagctgtgtcccattttg

SEQ ID NO: 490355 - DNA, 25 bp, Rattus norvegicus
tacgttaaagtggagggcagctgcc

SEQ ID NO: 490356 - DNA, 25 bp, Rattus norvegicus
cgattgcagcgtggccttctccaca

SEQ ID NO: 490357 - DNA, 25 bp, Rattus norvegicus
caggagacatagtctgggctgcatc

SEQ ID NO: 490358 - DNA, 25 bp, Rattus norvegicus
tagccagagactatgcggcgcagtc

SEQ ID NO: 490359 - DNA, 25 bp, Rattus norvegicus
caccgggcaaattgtggcagtcatc

SEQ ID NO: 490360 - DNA, 25 bp, Rattus norvegicus
ccacacggctccctattttgcagga

SEQ ID NO: 490361 - DNA, 25 bp, Rattus norvegicus
tccaacaagcagaagagggccgacc

SEQ ID NO: 490362 - DNA, 25 bp, Rattus norvegicus
tcagcctcagcgtggacggcaaacg

SEQ ID NO: 490363 - DNA, 25 bp, Rattus norvegicus
actacaacgtgaaggagctgttcca

SEQ ID NO: 490364 - DNA, 25 bp, Rattus norvegicus
ctcggccaagatgaactacaacgtg

SEQ ID NO: 490365 - DNA, 25 bp, Rattus norvegicus
aagtgcgccttcatggagacctcgg

SEQ ID NO: 490366 - DNA, 25 bp, Rattus norvegicus
cccatcatgctggtggggaacaagt

SEQ ID NO: 490367 - DNA, 25 bp, Rattus norvegicus
tggtgttctcggtgaccagcaagca

SEQ ID NO: 490368 - DNA, 25 bp, Rattus norvegicus
agggccacgccttcatcctggtgtt

SEQ ID NO: 490369 - DNA, 25 bp, Rattus norvegicus
tgcacactgcagatcacggacacca

SEQ ID NO: 490370 - DNA, 25 bp, Rattus norvegicus
taccggcaggtgatcagctgtgaca

SEQ ID NO: 490371 - DNA, 25 bp, Rattus norvegicus
ccaccatagaggacacgtaccggca

SEQ ID NO: 490372 - DNA, 25 bp, Rattus norvegicus
ggggacgtttcgtgacacttacatc

SEQ ID NO: 490373 - DNA, 25 bp, Rattus norvegicus
tgctccgctttgtgaaggggacgtt

SEQ ID NO: 490374 - DNA, 25 bp, Rattus norvegicus
cgcatcaagggcaagtgcgcgctca

SEQ ID NO: 490375 - DNA, 25 bp, Rattus norvegicus
cggtctccgttgtactcacttctga

SEQ ID NO: 490376 - DNA, 25 bp, Rattus norvegicus
ccggcgctgcaagccgcttataaga

SEQ ID NO: 490377 - DNA, 25 bp, Rattus norvegicus
cgaccagaagtgtccgaggctttcc

SEQ ID NO: 490378 - DNA, 25 bp, Rattus norvegicus
cgtccagatccgaacccaagaggta

SEQ ID NO: 490379 - DNA, 25 bp, Rattus norvegicus
ccaaggcaaagcactcgtccagatc

SEQ ID NO: 490380 - DNA, 25 bp, Rattus norvegicus
tgattcagtcacacttcacagcgga

SEQ ID NO: 490381 - DNA, 25 bp, Rattus norvegicus
ttctgaaccgcgttgtcgctcgcca

SEQ ID NO: 490382 - DNA, 25 bp, Rattus norvegicus
ggggtgctgactcacacattcatca

SEQ ID NO: 490383 - DNA, 25 bp, Rattus norvegicus
ccgcccatccattggtggaggcaca

SEQ ID NO: 490384 - DNA, 25 bp, Rattus norvegicus
caaagagccgagtagcctgcgctga

SEQ ID NO: 490385 - DNA, 25 bp, Rattus norvegicus
agaagtttctctcctgatttcccgg

SEQ ID NO: 490386 - DNA, 25 bp, Rattus norvegicus
cattcatcagtttggccgcctcgta

SEQ ID NO: 490387 - DNA, 25 bp, Rattus norvegicus
agtcaccgcctgcatcctaaaaggc

SEQ ID NO: 490388 - DNA, 25 bp, Rattus norvegicus
ccagctcttccagggtcatgattca

SEQ ID NO: 490389 - DNA, 25 bp, Rattus norvegicus
cggcaaggacatgagggaggcagac

SEQ ID NO: 490390 - DNA, 25 bp, Rattus norvegicus
ggtctggtgacgcatcctgcatcct

SEQ ID NO: 490391 - DNA, 25 bp, Rattus norvegicus
gcgtgggattctcccacagcgcacg

SEQ ID NO: 490392 - DNA, 25 bp, Rattus norvegicus
tgggattctcccacagcgcacgggg

SEQ ID NO: 490393 - DNA, 25 bp, Rattus norvegicus
catcccgggtctggtgacgcatcct

SEQ ID NO: 490394 - DNA, 25 bp, Rattus norvegicus
gccgcccacccaaggtgcgaaatgt

SEQ ID NO: 490395 - DNA, 25 bp, Rattus norvegicus
cacccaaggtgcgaaatgtcccggg

SEQ ID NO: 490396 - DNA, 25 bp, Rattus norvegicus
ccaaggtgcgaaatgtcccgggcgt

SEQ ID NO: 490397 - DNA, 25 bp, Rattus norvegicus
cgtgagaggcgctgcggcgacacct

SEQ ID NO: 490398 - DNA, 25 bp, Rattus norvegicus
gacacctggcggtcccacgaggtct

SEQ ID NO: 490399 - DNA, 25 bp, Rattus norvegicus
ggcggtcccacgaggtctctgctca

SEQ ID NO: 490400 - DNA, 25 bp, Rattus norvegicus
ccacgaggtctctgctcacgcagtt

SEQ ID NO: 490401 - DNA, 25 bp, Rattus norvegicus
gaggtctctgctcacgcagtttccg

SEQ ID NO: 490402 - DNA, 25 bp, Rattus norvegicus
agccgcgcggctcgattcgccggat

SEQ ID NO: 490403 - DNA, 25 bp, Rattus norvegicus
gacccgggtagctcagcggatcctc

SEQ ID NO: 490404 - DNA, 25 bp, Rattus norvegicus
catcttccgcggagcggattgaatg

SEQ ID NO: 490405 - DNA, 25 bp, Rattus norvegicus
gcgagcttaacgaccgcctggcaca

SEQ ID NO: 490406 - DNA, 25 bp, Rattus norvegicus
agcttgacccgggtgataggtgcag

SEQ ID NO: 490407 - DNA, 25 bp, Rattus norvegicus
cgtgctccgcgccagagagactaca

SEQ ID NO: 490408 - DNA, 25 bp, Rattus norvegicus
agactacaaattccggcgcgctgcg

SEQ ID NO: 490409 - DNA, 25 bp, Rattus norvegicus
cgccgccaccgccatggcgtctctg

SEQ ID NO: 490410 - DNA, 25 bp, Rattus norvegicus
tggcacactacatcgaccgcgtccg

SEQ ID NO: 490411 - DNA, 25 bp, Rattus norvegicus
gctggaaaatgataagctgctgctc

SEQ ID NO: 490412 - DNA, 25 bp, Rattus norvegicus
aagctgctgctcagaatctccgaga

SEQ ID NO: 490413 - DNA, 25 bp, Rattus norvegicus
agaatctccgagaaggaggaggtta

SEQ ID NO: 490414 - DNA, 25 bp, Rattus norvegicus
gaggaggttaccactcgtgaggtac

SEQ ID NO: 490415 - DNA, 25 bp, Rattus norvegicus
accactcgtgaggtacgtgtgtcgg

SEQ ID NO: 490416 - DNA, 25 bp, Rattus norvegicus
tccgcgccagagagactacaaattc

SEQ ID NO: 490417 - DNA, 25 bp, Rattus norvegicus
ttttccctaccagtaacggcagctc

SEQ ID NO: 490418 - DNA, 25 bp, Rattus norvegicus
gttggaactggcttctgcgcctatg

SEQ ID NO: 490419 - DNA, 25 bp, Rattus norvegicus
tgtgcctcacggtcggaactgtttt

SEQ ID NO: 490420 - DNA, 25 bp, Rattus norvegicus
gcgggaacgagccaacatgtgacca

SEQ ID NO: 490421 - DNA, 25 bp, Rattus norvegicus
accggtacatggacgcctggaacac

SEQ ID NO: 490422 - DNA, 25 bp, Rattus norvegicus
cgcctatgtaggtgcagccttagtg

SEQ ID NO: 490423 - DNA, 25 bp, Rattus norvegicus
tttagccgcagcttactgaggagtc

SEQ ID NO: 490424 - DNA, 25 bp, Rattus norvegicus
ataactcggagcaggtgagacaccc

SEQ ID NO: 490425 - DNA, 25 bp, Rattus norvegicus
ctgaggcctcgcatgtgtccacaga

SEQ ID NO: 490426 - DNA, 25 bp, Rattus norvegicus
ctggacccgggagccattatggaac

SEQ ID NO: 490427 - DNA, 25 bp, Rattus norvegicus
ctgagcagccatggacagcggattc

SEQ ID NO: 490428 - DNA, 25 bp, Rattus norvegicus
ggacaagtgtttccggaagtgcatc

SEQ ID NO: 490429 - DNA, 25 bp, Rattus norvegicus
tgggaatcgacacagcctccgtttc

SEQ ID NO: 490430 - DNA, 25 bp, Rattus norvegicus
tgaaagtgcagatcgccgtggccaa

SEQ ID NO: 490431 - DNA, 25 bp, Rattus norvegicus
gtggcgatagatgcgtgccacacgc

SEQ ID NO: 490432 - DNA, 25 bp, Rattus norvegicus
ccgtgctgctcaggaacggggtccc

SEQ ID NO: 490433 - DNA, 25 bp, Rattus norvegicus
cgcagcgaaccccagccagtgatga

SEQ ID NO: 490434 - DNA, 25 bp, Rattus norvegicus
gccctccgtgctgctcaggaacggg

SEQ ID NO: 490435 - DNA, 25 bp, Rattus norvegicus
gatgcgtgccacacgctccaactgg

SEQ ID NO: 490436 - DNA, 25 bp, Rattus norvegicus
gcgcacaagtgcctacctccttctc

SEQ ID NO: 490437 - DNA, 25 bp, Rattus norvegicus
ccagtgatgacacagcgcgcgcctt

SEQ ID NO: 490438 - DNA, 25 bp, Rattus norvegicus
acctggtaggcagatgggtcgcacc

SEQ ID NO: 490439 - DNA, 25 bp, Rattus norvegicus
atgggtcgcaccaagcggctacggc

SEQ ID NO: 490440 - DNA, 25 bp, Rattus norvegicus
agcagcgccacgtcatagtccagcg

SEQ ID NO: 490441 - DNA, 25 bp, Rattus norvegicus
gcgccacgtcatagtccagcgtgta

SEQ ID NO: 490442 - DNA, 25 bp, Rattus norvegicus
cgtcatagtccagcgtgtagatgtt

SEQ ID NO: 490443 - DNA, 25 bp, Rattus norvegicus
tccagcgtgtagatgttgtagaacg

SEQ ID NO: 490444 - DNA, 25 bp, Rattus norvegicus
cggcgcccagcgcacaagtgcctac

SEQ ID NO: 490445 - DNA, 25 bp, Rattus norvegicus
cactatccgggtcagggcccctggg

SEQ ID NO: 490446 - DNA, 25 bp, Rattus norvegicus
tgtgaaagagcgagtactgtgaacc

SEQ ID NO: 490447 - DNA, 25 bp, Rattus norvegicus
cacaggctcacttgccagggccatt

SEQ ID NO: 490448 - DNA, 25 bp, Rattus norvegicus
gagtactgtgaacccggtgcagagc

SEQ ID NO: 490449 - DNA, 25 bp, Rattus norvegicus
gcgagtactgtgaacccggtgcaga

SEQ ID NO: 490450 - DNA, 25 bp, Rattus norvegicus
aagagcgagtactgtgaacccggtg

SEQ ID NO: 490451 - DNA, 25 bp, Rattus norvegicus
cgcagtctgtgaaagagcgagtact

SEQ ID NO: 490452 - DNA, 25 bp, Rattus norvegicus
cattctccaagcgaggctgcgctgc

SEQ ID NO: 490453 - DNA, 25 bp, Rattus norvegicus
ccagggccattctccaagcgaggct

SEQ ID NO: 490454 - DNA, 25 bp, Rattus norvegicus
cgctgccgcccactatccgggtcag

SEQ ID NO: 490455 - DNA, 25 bp, Rattus norvegicus
aggctcacttgccagggccattctc

SEQ ID NO: 490456 - DNA, 25 bp, Rattus norvegicus
ccaggccgcagtctgtgaaagagcg

SEQ ID NO: 490457 - DNA, 25 bp, Rattus norvegicus
ttctccaagcgaggctgcgctgccg

SEQ ID NO: 490458 - DNA, 25 bp, Rattus norvegicus
agggccattctccaagcgaggctgc

SEQ ID NO: 490459 - DNA, 25 bp, Rattus norvegicus
cacgctgcctgcctgggcggcccat

SEQ ID NO: 490460 - DNA, 25 bp, Rattus norvegicus
gagatcaggcacttcttgcgcggtg

SEQ ID NO: 490461 - DNA, 25 bp, Rattus norvegicus
tcaggcacttcttgcgcggtgggaa

SEQ ID NO: 490462 - DNA, 25 bp, Rattus norvegicus
caggcaggctgcacatagcggccga

SEQ ID NO: 490463 - DNA, 25 bp, Rattus norvegicus
ctgcacatagcggccgaagggcagc

SEQ ID NO: 490464 - DNA, 25 bp, Rattus norvegicus
gggcgagccagttccagcaccgcca

SEQ ID NO: 490465 - DNA, 25 bp, Rattus norvegicus
tccagcaccgccacgtcaaagtccg

SEQ ID NO: 490466 - DNA, 25 bp, Rattus norvegicus
tcaaagtccgccgtgtccgcgttgt

SEQ ID NO: 490467 - DNA, 25 bp, Rattus norvegicus
tgtccgcgttgtaggcaggatgctt

SEQ ID NO: 490468 - DNA, 25 bp, Rattus norvegicus
ttgtaggcaggatgcttggcgatac

SEQ ID NO: 490469 - DNA, 25 bp, Rattus norvegicus
atgcttggcgatacggagcacgcgc

SEQ ID NO: 490470 - DNA, 25 bp, Rattus norvegicus
gcgatacggagcacgcgcgcacgca

SEQ ID NO: 490471 - DNA, 25 bp, Rattus norvegicus
ctggcctctgaaccgctcaggtgca

SEQ ID NO: 490472 - DNA, 25 bp, Rattus norvegicus
agcccgagatcaggcacttcttgcg

SEQ ID NO: 490473 - DNA, 25 bp, Rattus norvegicus
tggaacccggagactcgctccattc

SEQ ID NO: 490474 - DNA, 25 bp, Rattus norvegicus
gacaagatggcggtgagcattgcta

SEQ ID NO: 490475 - DNA, 25 bp, Rattus norvegicus
gagactcgctccattctgcagaaag

SEQ ID NO: 490476 - DNA, 25 bp, Rattus norvegicus
cgggctaaacctggccggaagtctg

SEQ ID NO: 490477 - DNA, 25 bp, Rattus norvegicus
taaacctggccggaagtctgcggtg

SEQ ID NO: 490478 - DNA, 25 bp, Rattus norvegicus
agagagcgagtgaaccgcaaggtca

SEQ ID NO: 490479 - DNA, 25 bp, Rattus norvegicus
tgaaccgcaaggtcacggccacact

SEQ ID NO: 490480 - DNA, 25 bp, Rattus norvegicus
cggtcccaccgcagttctaggcgga

SEQ ID NO: 490481 - DNA, 25 bp, Rattus norvegicus
caccgcagttctaggcggaaggttt

SEQ ID NO: 490482 - DNA, 25 bp, Rattus norvegicus
taggcggaaggtttcctggcaacgc

SEQ ID NO: 490483 - DNA, 25 bp, Rattus norvegicus
ccacgacgcgcatgcgccgagtctg

SEQ ID NO: 490484 - DNA, 25 bp, Rattus norvegicus
ctgcgcagaacgacgcgcggcgaca

SEQ ID NO: 490485 - DNA, 25 bp, Rattus norvegicus
agcattgctagatcgcggggagagt

SEQ ID NO: 490486 - DNA, 25 bp, Rattus norvegicus
cccagggatggaacccggagactcg

SEQ ID NO: 490487 - DNA, 25 bp, Rattus norvegicus
tgccgaaaagtcagccggccttttg

SEQ ID NO: 490488 - DNA, 25 bp, Rattus norvegicus
acaccattggccagatgcgccgctg

SEQ ID NO: 490489 - DNA, 25 bp, Rattus norvegicus
agcggtaccgcgacctaatcgaggc

SEQ ID NO: 490490 - DNA, 25 bp, Rattus norvegicus
caggttcgagccgagatcgagcaca

SEQ ID NO: 490491 - DNA, 25 bp, Rattus norvegicus
tgagactcatggagcggaggaaatc

SEQ ID NO: 490492 - DNA, 25 bp, Rattus norvegicus
gcgcgatcccaacgcactctttgag

SEQ ID NO: 490493 - DNA, 25 bp, Rattus norvegicus
agcggctggatttgcgcgatcccaa

SEQ ID NO: 490494 - DNA, 25 bp, Rattus norvegicus
tcctccgcgctgaagcggctggatt

SEQ ID NO: 490495 - DNA, 25 bp, Rattus norvegicus
cccgcaggtcagtccgggatccgaa

SEQ ID NO: 490496 - DNA, 25 bp, Rattus norvegicus
acgctggtccgctgccgaaaagtca

SEQ ID NO: 490497 - DNA, 25 bp, Rattus norvegicus
cttttgctccaggatccttcccgga

SEQ ID NO: 490498 - DNA, 25 bp, Rattus norvegicus
gccgtgcaggccaccgatcaatact

SEQ ID NO: 490499 - DNA, 25 bp, Rattus norvegicus
aggctcccgacctggcggaagtact

SEQ ID NO: 490500 - DNA, 25 bp, Rattus norvegicus
ctcacgccgctgtgtgcttctggga

SEQ ID NO: 490501 - DNA, 25 bp, Rattus norvegicus
aggaccgcctacgagctttgccata

SEQ ID NO: 490502 - DNA, 25 bp, Rattus norvegicus
tgttggtcaacactactcggcggtt

SEQ ID NO: 490503 - DNA, 25 bp, Rattus norvegicus
ggatctccttcatcccgttgctctg

SEQ ID NO: 490504 - DNA, 25 bp, Rattus norvegicus
ccctgaagaggctgtctagcacgtc

SEQ ID NO: 490505 - DNA, 25 bp, Rattus norvegicus
aggaaaccgccaatcataggcatgc

SEQ ID NO: 490506 - DNA, 25 bp, Rattus norvegicus
cagccctgccatctgttggtcaaca

SEQ ID NO: 490507 - DNA, 25 bp, Rattus norvegicus
agggccactccactgggctctactt

SEQ ID NO: 490508 - DNA, 25 bp, Rattus norvegicus
actactcggcggttgctgaggaccg

SEQ ID NO: 490509 - DNA, 25 bp, Rattus norvegicus
gttcggcctcttggtcgctctcttc

SEQ ID NO: 490510 - DNA, 25 bp, Rattus norvegicus
tacgagctttgccatagggcgcgcc

SEQ ID NO: 490511 - DNA, 25 bp, Rattus norvegicus
cctacggtcccgaagagctgagaag

SEQ ID NO: 490512 - DNA, 25 bp, Rattus norvegicus
agcctgacagcgacggcctcggctg

SEQ ID NO: 490513 - DNA, 25 bp, Rattus norvegicus
cagacacggagtcggccgagtaacc

SEQ ID NO: 490514 - DNA, 25 bp, Rattus norvegicus
taaccgtctgtttgacagccctgcc

SEQ ID NO: 490515 - DNA, 25 bp, Rattus norvegicus
cccgaggacagggatgtgctaggca

SEQ ID NO: 490516 - DNA, 25 bp, Rattus norvegicus
gacgcggaatggtgatgcgcactgc

SEQ ID NO: 490517 - DNA, 25 bp, Rattus norvegicus
taccggggtgctgcgtccccgtctg

SEQ ID NO: 490518 - DNA, 25 bp, Rattus norvegicus
ccggacctgctccaacacgtgttgt

SEQ ID NO: 490519 - DNA, 25 bp, Rattus norvegicus
gctccaacacgtgttgtcgcgcgcg

SEQ ID NO: 490520 - DNA, 25 bp, Rattus norvegicus
gcaccctggccatgcgcacggggat

SEQ ID NO: 490521 - DNA, 25 bp, Rattus norvegicus
cccgcgccgtccaaggaggagccgc

SEQ ID NO: 490522 - DNA, 25 bp, Rattus norvegicus
cgcccaggtgagtgacagcgctgca

SEQ ID NO: 490523 - DNA, 25 bp, Rattus norvegicus
tactcagtgtctgcggaggccccga

SEQ ID NO: 490524 - DNA, 25 bp, Rattus norvegicus
ccgcctccagagatgcagaacctag

SEQ ID NO: 490525 - DNA, 25 bp, Rattus norvegicus
ccagagatgcagaacctaggggatc

SEQ ID NO: 490526 - DNA, 25 bp, Rattus norvegicus
ccagccagtgctgggcgatgcgcgc

SEQ ID NO: 490527 - DNA, 25 bp, Rattus norvegicus
agagatgcagaacctaggggatcga

SEQ ID NO: 490528 - DNA, 25 bp, Rattus norvegicus
caggtgagtgacagcgctgcagtcc

SEQ ID NO: 490529 - DNA, 25 bp, Rattus norvegicus
acggaggacgcacgctacagtcgct

SEQ ID NO: 490530 - DNA, 25 bp, Rattus norvegicus
aaccttgtgatactccgcttcagcg

SEQ ID NO: 490531 - DNA, 25 bp, Rattus norvegicus
cgacgctgccggaaccttgtgatac

SEQ ID NO: 490532 - DNA, 25 bp, Rattus norvegicus
cacctaaagcttttcctgcggagtt

SEQ ID NO: 490533 - DNA, 25 bp, Rattus norvegicus
tacagtcgctgtctgtcctgctccg

SEQ ID NO: 490534 - DNA, 25 bp, Rattus norvegicus
tggaactagcgctttcccacgccat

SEQ ID NO: 490535 - DNA, 25 bp, Rattus norvegicus
tcttctctggaactagcgctttccc

SEQ ID NO: 490536 - DNA, 25 bp, Rattus norvegicus
cggtctgggtttcgcctcctcttct

SEQ ID NO: 490537 - DNA, 25 bp, Rattus norvegicus
ggatccggaggcttctcacgcctct

SEQ ID NO: 490538 - DNA, 25 bp, Rattus norvegicus
gggatccaggctctgaccttccctg

SEQ ID NO: 490539 - DNA, 25 bp, Rattus norvegicus
tccaggcccgggatcccgtgcagag

SEQ ID NO: 490540 - DNA, 25 bp, Rattus norvegicus
ccttgcttcaggtgaggcccggcat

SEQ ID NO: 490541 - DNA, 25 bp, Rattus norvegicus
tgagcgctcgtcctcacccgggtgg

SEQ ID NO: 490542 - DNA, 25 bp, Rattus norvegicus
aagttcagctaagtcccacctaaag

SEQ ID NO: 490543 - DNA, 25 bp, Rattus norvegicus
ctccttcagagacctggtgcgcctg

SEQ ID NO: 490544 - DNA, 25 bp, Rattus norvegicus
tctccgtggcaaccagctgaagctc

SEQ ID NO: 490545 - DNA, 25 bp, Rattus norvegicus
cgtgttcacacatctggacagcctc

SEQ ID NO: 490546 - DNA, 25 bp, Rattus norvegicus
aacgacctggtgttcatctcccgca

SEQ ID NO: 490547 - DNA, 25 bp, Rattus norvegicus
ccgggactcttacatctggagattg

SEQ ID NO: 490548 - DNA, 25 bp, Rattus norvegicus
ctggacctgagcgagaacaaactgg

SEQ ID NO: 490549 - DNA, 25 bp, Rattus norvegicus
tgcgcgagcttcacctagcaggagc

SEQ ID NO: 490550 - DNA, 25 bp, Rattus norvegicus
tccacgctggaggagaacacgttcc

SEQ ID NO: 490551 - DNA, 25 bp, Rattus norvegicus
tccgtgaacacgctcgagacgctgc

SEQ ID NO: 490552 - DNA, 25 bp, Rattus norvegicus
aggaagaccctgaactttgacggca

SEQ ID NO: 490553 - DNA, 25 bp, Rattus norvegicus
tccctgactccgtgctcttcgagta

SEQ ID NO: 490554 - DNA, 25 bp, Rattus norvegicus
agtacttcgtgtgtcgcaagcccaa

SEQ ID NO: 490555 - DNA, 25 bp, Rattus norvegicus
actggtcatcctgctggatttcagc

SEQ ID NO: 490556 - DNA, 25 bp, Rattus norvegicus
tgccgccctggaggaccagaatttc

SEQ ID NO: 490557 - DNA, 25 bp, Rattus norvegicus
ggcctacgcggacgctgtttctgaa

SEQ ID NO: 490558 - DNA, 25 bp, Rattus norvegicus
atatgcgtcgtcactgcaggccacg

SEQ ID NO: 490559 - DNA, 25 bp, Rattus norvegicus
cgagcccgccctcgaggttttatga

SEQ ID NO: 490560 - DNA, 25 bp, Rattus norvegicus
tcccgcctctacaaaactctgattg

SEQ ID NO: 490561 - DNA, 25 bp, Rattus norvegicus
tgcgtcactctgtgggcggaaagac

SEQ ID NO: 490562 - DNA, 25 bp, Rattus norvegicus
cacctactacggcttctgattggag

SEQ ID NO: 490563 - DNA, 25 bp, Rattus norvegicus
ggcgccgacgcccacttttatatgc

SEQ ID NO: 490564 - DNA, 25 bp, Rattus norvegicus
cgctgctcgccgttcgcaaaatggc

SEQ ID NO: 490565 - DNA, 25 bp, Rattus norvegicus
atccgctgcagggaggatttcacca

SEQ ID NO: 490566 - DNA, 25 bp, Rattus norvegicus
tttctctctggcgaagcagtggctg

SEQ ID NO: 490567 - DNA, 25 bp, Rattus norvegicus
ctcgcgctaccgagacttatctggc

SEQ ID NO: 490568 - DNA, 25 bp, Rattus norvegicus
ctgtttctgaaagcttcgcggcggc

SEQ ID NO: 490569 - DNA, 25 bp, Rattus norvegicus
tcggagcctacgatttcgcgaaatg

SEQ ID NO: 490570 - DNA, 25 bp, Rattus norvegicus
ccacaaaggggaggatctcgcgcta

SEQ ID NO: 490571 - DNA, 25 bp, Rattus norvegicus
caccagggtccagggccagacgagt

SEQ ID NO: 490572 - DNA, 25 bp, Rattus norvegicus
tgagcgctctgctcgaaggtccacg

SEQ ID NO: 490573 - DNA, 25 bp, Rattus norvegicus
acatcaccggcagccgcattcggta

SEQ ID NO: 490574 - DNA, 25 bp, Rattus norvegicus
cattcggtagccaccatgttgggca

SEQ ID NO: 490575 - DNA, 25 bp, Rattus norvegicus
atgtgctcctccgacaggctgatga

SEQ ID NO: 490576 - DNA, 25 bp, Rattus norvegicus
cgtgcctgcatttttagcagcagca

SEQ ID NO: 490577 - DNA, 25 bp, Rattus norvegicus
gcagcagcaccacgtggttcccgta

SEQ ID NO: 490578 - DNA, 25 bp, Rattus norvegicus
tacggtccgactgtggccatgcaca

SEQ ID NO: 490579 - DNA, 25 bp, Rattus norvegicus
ctccgggatgagcactgagcgctct

SEQ ID NO: 490580 - DNA, 25 bp, Rattus norvegicus
gaaggtccacgctcagctcgcgcag

SEQ ID NO: 490581 - DNA, 25 bp, Rattus norvegicus
gccacggggtctgaaaggttgacca

SEQ ID NO: 490582 - DNA, 25 bp, Rattus norvegicus
aggccctgcagtgccttcagcagca

SEQ ID NO: 490583 - DNA, 25 bp, Rattus norvegicus
cagcagcagtaataggggttcctcc

SEQ ID NO: 490584 - DNA, 25 bp, Rattus norvegicus
atgcacaggcgccttggcagttgtt

SEQ ID NO: 490585 - DNA, 25 bp, Rattus norvegicus
ccgactccttgttctactgtgctga

SEQ ID NO: 490586 - DNA, 25 bp, Rattus norvegicus
cgcacgaccgcttgagcaatcactt

SEQ ID NO: 490587 - DNA, 25 bp, Rattus norvegicus
agctggtggtcaacttcctctttta

SEQ ID NO: 490588 - DNA, 25 bp, Rattus norvegicus
aaagagttgcaagcgctgtcccggc

SEQ ID NO: 490589 - DNA, 25 bp, Rattus norvegicus
acgaggtcgcttcctgagacttttg

SEQ ID NO: 490590 - DNA, 25 bp, Rattus norvegicus
tagcaccgttgggacttacgaggtc

SEQ ID NO: 490591 - DNA, 25 bp, Rattus norvegicus
tgtgctgacccaccaactagcgtca

SEQ ID NO: 490592 - DNA, 25 bp, Rattus norvegicus
tgactatcgcgacaggacttaaacc

SEQ ID NO: 490593 - DNA, 25 bp, Rattus norvegicus
cctaactctgttggcgctgactatc

SEQ ID NO: 490594 - DNA, 25 bp, Rattus norvegicus
gtctacgaattcttgctccgcccta

SEQ ID NO: 490595 - DNA, 25 bp, Rattus norvegicus
gtacgcgtgcgcactgcattgtcta

SEQ ID NO: 490596 - DNA, 25 bp, Rattus norvegicus
tgcgcatgcccagcgaatggactcc

SEQ ID NO: 490597 - DNA, 25 bp, Rattus norvegicus
cgtatcgtgaggtgctatgagtcta

SEQ ID NO: 490598 - DNA, 25 bp, Rattus norvegicus
cccgaatgccgcgattttgttgtgc

SEQ ID NO: 490599 - DNA, 25 bp, Rattus norvegicus
agccaagaggcggtgcgcgcccaaa

SEQ ID NO: 490600 - DNA, 25 bp, Rattus norvegicus
ccctctttgtaggagtcacagagcc

SEQ ID NO: 490601 - DNA, 25 bp, Rattus norvegicus
cagggtcgcacgcacgtcctcggtt

SEQ ID NO: 490602 - DNA, 25 bp, Rattus norvegicus
acgcacgcacgttcgcacgcagggt

SEQ ID NO: 490603 - DNA, 25 bp, Rattus norvegicus
cctccgacgccaccgccagccggaa

SEQ ID NO: 490604 - DNA, 25 bp, Rattus norvegicus
cacgaaggcaaagcgtccccgacta

SEQ ID NO: 490605 - DNA, 25 bp, Rattus norvegicus
aacgtcagcccagacccaagtctta

SEQ ID NO: 490606 - DNA, 25 bp, Rattus norvegicus
ccaagtcttaaaaggctggagacgc

SEQ ID NO: 490607 - DNA, 25 bp, Rattus norvegicus
ggttctccgcaagtacactcacgta

SEQ ID NO: 490608 - DNA, 25 bp, Rattus norvegicus
tacactcacgtagaccggcagcggc

SEQ ID NO: 490609 - DNA, 25 bp, Rattus norvegicus
ggctccgcgcccacaggcgacttga

SEQ ID NO: 490610 - DNA, 25 bp, Rattus norvegicus
agctccagcttctcgcccatgtcgg

SEQ ID NO: 490611 - DNA, 25 bp, Rattus norvegicus
tctttgtaggagtcacagagccggg

SEQ ID NO: 490612 - DNA, 25 bp, Rattus norvegicus
acgttcgcacgcagggtcgcacgca

SEQ ID NO: 490613 - DNA, 25 bp, Rattus norvegicus
tggcctccacgtcgtcctctccgcg

SEQ ID NO: 490614 - DNA, 25 bp, Rattus norvegicus
acagccgtcgctctggcctccacgt

SEQ ID NO: 490615 - DNA, 25 bp, Rattus norvegicus
gtctccggccacagccgtcgctctg

SEQ ID NO: 490616 - DNA, 25 bp, Rattus norvegicus
tcagactggtctccggccacagccg

SEQ ID NO: 490617 - DNA, 25 bp, Rattus norvegicus
agcgggggctaactcgctgcccctt

SEQ ID NO: 490618 - DNA, 25 bp, Rattus norvegicus
cgccatttgcgggtggccctgagca

SEQ ID NO: 490619 - DNA, 25 bp, Rattus norvegicus
atcttggccgccatttgcgggtggc

SEQ ID NO: 490620 - DNA, 25 bp, Rattus norvegicus
catcttggccgccatttgcgggtgg

SEQ ID NO: 490621 - DNA, 25 bp, Rattus norvegicus
cgtcagctgacccaccgccatcttg

SEQ ID NO: 490622 - DNA, 25 bp, Rattus norvegicus
gccggaaacgcagcggggcggtcgc

SEQ ID NO: 490623 - DNA, 25 bp, Rattus norvegicus
gggacgccgaggctctccgtcagct

SEQ ID NO: 490624 - DNA, 25 bp, Rattus norvegicus
agcagggaagggtctgcggaagcgg

SEQ ID NO: 490625 - DNA, 25 bp, Rattus norvegicus
ctccgtcagctgacccaccgccatc

SEQ ID NO: 490626 - DNA, 25 bp, Rattus norvegicus
ttggccgccatttgcgggtggccct

SEQ ID NO: 490627 - DNA, 25 bp, Rattus norvegicus
cctcaagatggtcaagggcagtatc

SEQ ID NO: 490628 - DNA, 25 bp, Rattus norvegicus
atcgaccgcatgttcgacaagaacc

SEQ ID NO: 490629 - DNA, 25 bp, Rattus norvegicus
caagatggtcaagggcagtatcgac

SEQ ID NO: 490630 - DNA, 25 bp, Rattus norvegicus
tcaagggcagtatcgaccgcatgtt

SEQ ID NO: 490631 - DNA, 25 bp, Rattus norvegicus
agggcagtatcgaccgcatgttcga

SEQ ID NO: 490632 - DNA, 25 bp, Rattus norvegicus
agtatcgaccgcatgttcgacaaga

SEQ ID NO: 490633 - DNA, 25 bp, Rattus norvegicus
accgcatgttcgacaagaacctgca

SEQ ID NO: 490634 - DNA, 25 bp, Rattus norvegicus
atgttcgacaagaacctgcaggatc

SEQ ID NO: 490635 - DNA, 25 bp, Rattus norvegicus
ttcgacaagaacctgcaggatctgg

SEQ ID NO: 490636 - DNA, 25 bp, Rattus norvegicus
gcatccgcaaccacaaggaggacga

SEQ ID NO: 490637 - DNA, 25 bp, Rattus norvegicus
cgcaaccacaaggaggacgaggtga

SEQ ID NO: 490638 - DNA, 25 bp, Rattus norvegicus
gcgatggccctcaagatggtcaagg

SEQ ID NO: 490639 - DNA, 25 bp, Rattus norvegicus
ccgcgatggccctcaagatggtcaa

SEQ ID NO: 490640 - DNA, 25 bp, Rattus norvegicus
agcctatagcctctggcccgccttg

SEQ ID NO: 490641 - DNA, 25 bp, Rattus norvegicus
agcagcgtccgttctggtctccagg

SEQ ID NO: 490642 - DNA, 25 bp, Rattus norvegicus
tccagcgacggagcccaaagtgggc

SEQ ID NO: 490643 - DNA, 25 bp, Rattus norvegicus
acagtgtccagcgacggagcccaaa

SEQ ID NO: 490644 - DNA, 25 bp, Rattus norvegicus
atccctcaggatgacagtgtccagc

SEQ ID NO: 490645 - DNA, 25 bp, Rattus norvegicus
cggcgggacttcatccctcaggatg

SEQ ID NO: 490646 - DNA, 25 bp, Rattus norvegicus
ttcatacgggaatcctcggagctcg

SEQ ID NO: 490647 - DNA, 25 bp, Rattus norvegicus
gtcagtgcccgcctttcatacggga

SEQ ID NO: 490648 - DNA, 25 bp, Rattus norvegicus
ccgttctggtctccaggggcgccga

SEQ ID NO: 490649 - DNA, 25 bp, Rattus norvegicus
agccattgagcagcgtccgttctgg

SEQ ID NO: 490650 - DNA, 25 bp, Rattus norvegicus
ctcaaccgcagcactccagccattg

SEQ ID NO: 490651 - DNA, 25 bp, Rattus norvegicus
cgctagttccggagccatcgaggga

SEQ ID NO: 490652 - DNA, 25 bp, Rattus norvegicus
actggcgctagttccggagccatcg

SEQ ID NO: 490653 - DNA, 25 bp, Rattus norvegicus
atgcgccatggactggcgctagttc

SEQ ID NO: 490654 - DNA, 25 bp, Rattus norvegicus
ctgcggggtctaccgtcagtgcccg

SEQ ID NO: 490655 - DNA, 25 bp, Rattus norvegicus
gcacgcagcgcttcgagctacacaa

SEQ ID NO: 490656 - DNA, 25 bp, Rattus norvegicus
gcgtcaacctcatctacggtaccat

SEQ ID NO: 490657 - DNA, 25 bp, Rattus norvegicus
atctcaacgactgggtggccgtgca

SEQ ID NO: 490658 - DNA, 25 bp, Rattus norvegicus
acctgcggctggctgtgcagctgcc

SEQ ID NO: 490659 - DNA, 25 bp, Rattus norvegicus
tcatctacggtaccatcagcgatgg

SEQ ID NO: 490660 - DNA, 25 bp, Rattus norvegicus
accatcagcgatggctgtaccgagc

SEQ ID NO: 490661 - DNA, 25 bp, Rattus norvegicus
atggctgtaccgagcagtcgtgtcc

SEQ ID NO: 490662 - DNA, 25 bp, Rattus norvegicus
acaagcgcgcgcaggcatctctgaa

SEQ ID NO: 490663 - DNA, 25 bp, Rattus norvegicus
gcttcgagctacacaagcgcgcgca

SEQ ID NO: 490664 - DNA, 25 bp, Rattus norvegicus
caagttcgagcctggcacgcagcgc

SEQ ID NO: 490665 - DNA, 25 bp, Rattus norvegicus
accgagcagtcgtgtccggtcatgt

SEQ ID NO: 490666 - DNA, 25 bp, Rattus norvegicus
cgctggcaggacgagcagcgctacc

SEQ ID NO: 490667 - DNA, 25 bp, Rattus norvegicus
ccaagtacgagtaccgctggcagga

SEQ ID NO: 490668 - DNA, 25 bp, Rattus norvegicus
cgcaggcatctctgaacgcggggct

SEQ ID NO: 490669 - DNA, 25 bp, Rattus norvegicus
aggaagatttcccaccgcgcattgt

SEQ ID NO: 490670 - DNA, 25 bp, Rattus norvegicus
ctgtaaagctgaaggccgccctacc

SEQ ID NO: 490671 - DNA, 25 bp, Rattus norvegicus
cgccaccctcaactgtaaagctgaa

SEQ ID NO: 490672 - DNA, 25 bp, Rattus norvegicus
aacggacaaagacgaccctcgctca

SEQ ID NO: 490673 - DNA, 25 bp, Rattus norvegicus
tgatcgtctctaaaggggaacccgc

SEQ ID NO: 490674 - DNA, 25 bp, Rattus norvegicus
gttgagcacccttcagacctgatcg

SEQ ID NO: 490675 - DNA, 25 bp, Rattus norvegicus
cgcgcattgttgagcacccttcaga

SEQ ID NO: 490676 - DNA, 25 bp, Rattus norvegicus
gctcccgtctccgtcaggaagattt

SEQ ID NO: 490677 - DNA, 25 bp, Rattus norvegicus
tgttcaactcttctgcaggctcccg

SEQ ID NO: 490678 - DNA, 25 bp, Rattus norvegicus
gagacctttaaccattttcagataa

SEQ ID NO: 490679 - DNA, 25 bp, Rattus norvegicus
gtgcttctgacgtgagagaccttta

SEQ ID NO: 490680 - DNA, 25 bp, Rattus norvegicus
aatagcgtccaatctgtgcttctga

SEQ ID NO: 490681 - DNA, 25 bp, Rattus norvegicus
cgaggcgatgtttaaatagcgtcca

SEQ ID NO: 490682 - DNA, 25 bp, Rattus norvegicus
gcgtccattcgaggcgatgtttaaa

SEQ ID NO: 490683 - DNA, 25 bp, Rattus norvegicus
ggcgccaagggcgacattctccgag

SEQ ID NO: 490684 - DNA, 25 bp, Rattus norvegicus
aagcggctcaggacgccgtccacaa

SEQ ID NO: 490685 - DNA, 25 bp, Rattus norvegicus
gagcatccacacatacatcaagcag

SEQ ID NO: 490686 - DNA, 25 bp, Rattus norvegicus
gcagcagcattcgtgtatctttcca

SEQ ID NO: 490687 - DNA, 25 bp, Rattus norvegicus
gctcgaagtgcgcagccacgtttcg

SEQ ID NO: 490688 - DNA, 25 bp, Rattus norvegicus
ttcggcgtcgctcacacgctcattg

SEQ ID NO: 490689 - DNA, 25 bp, Rattus norvegicus
tcttcaatgcccttctgcgcaggcg

SEQ ID NO: 490690 - DNA, 25 bp, Rattus norvegicus
gcaactccgggaccgcgcctataaa

SEQ ID NO: 490691 - DNA, 25 bp, Rattus norvegicus
ggagaagacggcctcaccgcccaaa

SEQ ID NO: 490692 - DNA, 25 bp, Rattus norvegicus
cccggactgaagatggtgcagaaga

SEQ ID NO: 490693 - DNA, 25 bp, Rattus norvegicus
gtgcagaagagaacagccgaacttc

SEQ ID NO: 490694 - DNA, 25 bp, Rattus norvegicus
tcagggcttccaccgttcgttcaag

SEQ ID NO: 490695 - DNA, 25 bp, Rattus norvegicus
accgcccaaactgaattcttcaatg

SEQ ID NO: 490696 - DNA, 25 bp, Rattus norvegicus
cgcctcctctgttccctgagaaggg

SEQ ID NO: 490697 - DNA, 25 bp, Rattus norvegicus
tgaggctcttggtatgcacatactc

SEQ ID NO: 490698 - DNA, 25 bp, Rattus norvegicus
aaggtccaggttcagtagtcacaca

SEQ ID NO: 490699 - DNA, 25 bp, Rattus norvegicus
ggcgtggcacgcttggtatcaccaa

SEQ ID NO: 490700 - DNA, 25 bp, Rattus norvegicus
ccaatcttctggtagcgttccttca

SEQ ID NO: 490701 - DNA, 25 bp, Rattus norvegicus
tggccaggccaaagtcgatgatgtg

SEQ ID NO: 490702 - DNA, 25 bp, Rattus norvegicus
tcgcacaggtcgaacaggtcctcca

SEQ ID NO: 490703 - DNA, 25 bp, Rattus norvegicus
ggccttagagtcagcacccagagtc

SEQ ID NO: 490704 - DNA, 25 bp, Rattus norvegicus
cttcttggtctcagggtcgatgtac

SEQ ID NO: 490705 - DNA, 25 bp, Rattus norvegicus
ggccgcccaaccaggaagttctcag

SEQ ID NO: 490706 - DNA, 25 bp, Rattus norvegicus
agttctcaggcttcacgtcgcggta

SEQ ID NO: 490707 - DNA, 25 bp, Rattus norvegicus
atggcgatcatcagcaccgtcttta

SEQ ID NO: 490708 - DNA, 25 bp, Rattus norvegicus
ctccagcaccatggcgttgtacttc

SEQ ID NO: 490709 - DNA, 25 bp, Rattus norvegicus
ttctgccaaggaaacatcgatgctg

SEQ ID NO: 490710 - DNA, 25 bp, Rattus norvegicus
ctgccgcgtaggaagtacatgaaca

SEQ ID NO: 490711 - DNA, 25 bp, Rattus norvegicus
ctgccggccatgttggctcggctct

SEQ ID NO: 490712 - DNA, 25 bp, Rattus norvegicus
aatcccggcccgagagaggaagccg

SEQ ID NO: 490713 - DNA, 25 bp, Rattus norvegicus
cggacggtgattccctagagagctt

SEQ ID NO: 490714 - DNA, 25 bp, Rattus norvegicus
tccactcgccgaggaatccctggga

SEQ ID NO: 490715 - DNA, 25 bp, Rattus norvegicus
gggacgcatccactcgccgaggaat

SEQ ID NO: 490716 - DNA, 25 bp, Rattus norvegicus
cgcctcagatgactgggacttctcc

SEQ ID NO: 490717 - DNA, 25 bp, Rattus norvegicus
ttctgcgggcgtccctcaggcaact

SEQ ID NO: 490718 - DNA, 25 bp, Rattus norvegicus
gagcctggccatgtgaaccgcccgt

SEQ ID NO: 490719 - DNA, 25 bp, Rattus norvegicus
tgcccggtgttctgcgggcgtccct

SEQ ID NO: 490720 - DNA, 25 bp, Rattus norvegicus
tcaggcaactgacgcgcctcagatg

SEQ ID NO: 490721 - DNA, 25 bp, Rattus norvegicus
ttccctagagagcttcgggtttctg

SEQ ID NO: 490722 - DNA, 25 bp, Rattus norvegicus
gcactaggacccagcgggcgcagca

SEQ ID NO: 490723 - DNA, 25 bp, Rattus norvegicus
ctgttctccggcttggctgttggtc

SEQ ID NO: 490724 - DNA, 25 bp, Rattus norvegicus
cgggtttctgttctccggcttggct

SEQ ID NO: 490725 - DNA, 25 bp, Rattus norvegicus
ttcgtgccggttttggacattctcc

SEQ ID NO: 490726 - DNA, 25 bp, Rattus norvegicus
attgcggacgccgtggttgctccga

SEQ ID NO: 490727 - DNA, 25 bp, Rattus norvegicus
cggcctagtacaccattgcgcctgg

SEQ ID NO: 490728 - DNA, 25 bp, Rattus norvegicus
tagtacaccattgcgcctggtggcc

SEQ ID NO: 490729 - DNA, 25 bp, Rattus norvegicus
attgacacccgggtacgctcacagg

SEQ ID NO: 490730 - DNA, 25 bp, Rattus norvegicus
gttgctccgattcgtgccggttttg

SEQ ID NO: 490731 - DNA, 25 bp, Rattus norvegicus
ttggctcccggctattgacacccgg

SEQ ID NO: 490732 - DNA, 25 bp, Rattus norvegicus
ggttttggacattctcctgccctcc

SEQ ID NO: 490733 - DNA, 25 bp, Rattus norvegicus
ccctcctttcttgtcaaaatccata

SEQ ID NO: 490734 - DNA, 25 bp, Rattus norvegicus
cataagtttgtggtaccctggcctc

SEQ ID NO: 490735 - DNA, 25 bp, Rattus norvegicus
tggtaccctggcctctccacggtga

SEQ ID NO: 490736 - DNA, 25 bp, Rattus norvegicus
tccacggtgactctgccgtgagatc

SEQ ID NO: 490737 - DNA, 25 bp, Rattus norvegicus
ctgccgtgagatccgagtgcgaaac

SEQ ID NO: 490738 - DNA, 25 bp, Rattus norvegicus
agatccgagtgcgaaacctgagctc

SEQ ID NO: 490739 - DNA, 25 bp, Rattus norvegicus
gcaccagtcaggaatcgtaggatga

SEQ ID NO: 490740 - DNA, 25 bp, Rattus norvegicus
cggtggccgagctcagcagcgcggc

SEQ ID NO: 490741 - DNA, 25 bp, Rattus norvegicus
tgcgcgcgcaacattacctgcgccc

SEQ ID NO: 490742 - DNA, 25 bp, Rattus norvegicus
agcggaccctgcgcgcgcaacatta

SEQ ID NO: 490743 - DNA, 25 bp, Rattus norvegicus
tcagtgggagtcacggggtcccgac

SEQ ID NO: 490744 - DNA, 25 bp, Rattus norvegicus
accgttcaagacccggcgcggagtg

SEQ ID NO: 490745 - DNA, 25 bp, Rattus norvegicus
atgaggaccgttcaagacccggcgc

SEQ ID NO: 490746 - DNA, 25 bp, Rattus norvegicus
cgtaggatgaggaccgttcaagacc

SEQ ID NO: 490747 - DNA, 25 bp, Rattus norvegicus
agtcaggaatcgtaggatgaggacc

SEQ ID NO: 490748 - DNA, 25 bp, Rattus norvegicus
agagcaccagtcaggaatcgtagga

SEQ ID NO: 490749 - DNA, 25 bp, Rattus norvegicus
tgcagagcaccagtcaggaatcgta

SEQ ID NO: 490750 - DNA, 25 bp, Rattus norvegicus
cggtgcagagcaccagtcaggaatc

SEQ ID NO: 490751 - DNA, 25 bp, Rattus norvegicus
gtcgcccggtgcagagcaccagtca

SEQ ID NO: 490752 - DNA, 25 bp, Rattus norvegicus
ggaatcgtaggatgaggaccgttca

SEQ ID NO: 490753 - DNA, 25 bp, Rattus norvegicus
atagggcggagcttttaccacaata

SEQ ID NO: 490754 - DNA, 25 bp, Rattus norvegicus
cctagaggcaggatgagcgctttac

SEQ ID NO: 490755 - DNA, 25 bp, Rattus norvegicus
tgtctgtgacgtcactgtctcgcca

SEQ ID NO: 490756 - DNA, 25 bp, Rattus norvegicus
tggaggagagcgaagctttatcata

SEQ ID NO: 490757 - DNA, 25 bp, Rattus norvegicus
ctttatcataaagcaagggcgtgac

SEQ ID NO: 490758 - DNA, 25 bp, Rattus norvegicus
ctgttggtaaagagtcgccacgcta

SEQ ID NO: 490759 - DNA, 25 bp, Rattus norvegicus
gggtcccgagggacaccagagacta

SEQ ID NO: 490760 - DNA, 25 bp, Rattus norvegicus
ccggagcgtacctgaactgtgaata

SEQ ID NO: 490761 - DNA, 25 bp, Rattus norvegicus
gcggctttacgacaatatgggtatg

SEQ ID NO: 490762 - DNA, 25 bp, Rattus norvegicus
ctgtgaataagaccagcagcggccc

SEQ ID NO: 490763 - DNA, 25 bp, Rattus norvegicus
aaccgccctttcgttgccatggaga

SEQ ID NO: 490764 - DNA, 25 bp, Rattus norvegicus
gcgccaacccaaagccgtgtctgtg

SEQ ID NO: 490765 - DNA, 25 bp, Rattus norvegicus
agagactagtagctaccggagcgta

SEQ ID NO: 490766 - DNA, 25 bp, Rattus norvegicus
gccgcggcactttacgacgatcaga

SEQ ID NO: 490767 - DNA, 25 bp, Rattus norvegicus
acgtactgcccgttccatgtgggtc

SEQ ID NO: 490768 - DNA, 25 bp, Rattus norvegicus
aacacatggtccgaggctgggtcca

SEQ ID NO: 490769 - DNA, 25 bp, Rattus norvegicus
ggccaccaggtcgatgcataccatg

SEQ ID NO: 490770 - DNA, 25 bp, Rattus norvegicus
agttgcccggccaaagcactggtca

SEQ ID NO: 490771 - DNA, 25 bp, Rattus norvegicus
atggcgcacatgacacagggctctc

SEQ ID NO: 490772 - DNA, 25 bp, Rattus norvegicus
ctggtcacctgcttgtcttcatgga

SEQ ID NO: 490773 - DNA, 25 bp, Rattus norvegicus
gcctcctcaaactggctccgggtaa

SEQ ID NO: 490774 - DNA, 25 bp, Rattus norvegicus
tagacagcagacacctcccggagga

SEQ ID NO: 490775 - DNA, 25 bp, Rattus norvegicus
gcttgtccaggacaggtgcagcgta

SEQ ID NO: 490776 - DNA, 25 bp, Rattus norvegicus
gcagcgtaggccagtaccagctcca

SEQ ID NO: 490777 - DNA, 25 bp, Rattus norvegicus
tcgagcctgcgcagagaagagttgc

SEQ ID NO: 490778 - DNA, 25 bp, Rattus norvegicus
cggtgcacacatagggcaggctatc

SEQ ID NO: 490779 - DNA, 25 bp, Rattus norvegicus
gctctcgggtgacgtacaggtcata

SEQ ID NO: 490780 - DNA, 25 bp, Rattus norvegicus
aggctatcttcgtccagcttgcgca

SEQ ID NO: 490781 - DNA, 25 bp, Rattus norvegicus
ctgtgagatatgacggcagagcctc

SEQ ID NO: 490782 - DNA, 25 bp, Rattus norvegicus
gcagagcctcgactacatttccctt

SEQ ID NO: 490783 - DNA, 25 bp, Rattus norvegicus
tatcctagtcctagcaaccgggccg

SEQ ID NO: 490784 - DNA, 25 bp, Rattus norvegicus
gaacgccacgcttatcctagtccta

SEQ ID NO: 490785 - DNA, 25 bp, Rattus norvegicus
cccatgtcagatacggaacggcgga

SEQ ID NO: 490786 - DNA, 25 bp, Rattus norvegicus
actagtactcaacgcgggctgcccg

SEQ ID NO: 490787 - DNA, 25 bp, Rattus norvegicus
cgggacgcacgcaacactagtactc

SEQ ID NO: 490788 - DNA, 25 bp, Rattus norvegicus
aacatacaaccggaagcagctggaa

SEQ ID NO: 490789 - DNA, 25 bp, Rattus norvegicus
agcagctggaaatcacggggtttcc

SEQ ID NO: 490790 - DNA, 25 bp, Rattus norvegicus
tccggaatcagaagtagggtacacg

SEQ ID NO: 490791 - DNA, 25 bp, Rattus norvegicus
agggtacacgcgtgcgccgcaaacc

SEQ ID NO: 490792 - DNA, 25 bp, Rattus norvegicus
gcgcaaagccctgtgcgcacgcgta

SEQ ID NO: 490793 - DNA, 25 bp, Rattus norvegicus
tactagcgttgactgcgagcgcacg

SEQ ID NO: 490794 - DNA, 25 bp, Rattus norvegicus
tacatttcccttaaggccgtgcgcg

SEQ ID NO: 490795 - DNA, 25 bp, Rattus norvegicus
cgatacttctttgcgctctcccggg

SEQ ID NO: 490796 - DNA, 25 bp, Rattus norvegicus
acgaccagcggagtccttctcgctt

SEQ ID NO: 490797 - DNA, 25 bp, Rattus norvegicus
gcggagtccttctcgcttgcgcatt

SEQ ID NO: 490798 - DNA, 25 bp, Rattus norvegicus
gagtccttctcgcttgcgcattcgc

SEQ ID NO: 490799 - DNA, 25 bp, Rattus norvegicus
taacctcctcaggacaaggctgtgc

SEQ ID NO: 490800 - DNA, 25 bp, Rattus norvegicus
ggccctgcgtccgatacttctttgc

SEQ ID NO: 490801 - DNA, 25 bp, Rattus norvegicus
ttctttgcgctctcccgggatggct

SEQ ID NO: 490802 - DNA, 25 bp, Rattus norvegicus
gctctcccgggatggctacgggacc

SEQ ID NO: 490803 - DNA, 25 bp, Rattus norvegicus
tggctacgggacccggtccctggca

SEQ ID NO: 490804 - DNA, 25 bp, Rattus norvegicus
cccgtccagcgatcctggagtgatc

SEQ ID NO: 490805 - DNA, 25 bp, Rattus norvegicus
gatcctggagtgatcgcttaacctc

SEQ ID NO: 490806 - DNA, 25 bp, Rattus norvegicus
gagtgatcgcttaacctcctcagga

SEQ ID NO: 490807 - DNA, 25 bp, Rattus norvegicus
gatcgcttaacctcctcaggacaag

SEQ ID NO: 490808 - DNA, 25 bp, Rattus norvegicus
gcattcgcctcgcatcacttccggg

SEQ ID NO: 490809 - DNA, 25 bp, Rattus norvegicus
aagatccacctgacggagcgcgctg

SEQ ID NO: 490810 - DNA, 25 bp, Rattus norvegicus
gacggagcgcgctgacttccagtat

SEQ ID NO: 490811 - DNA, 25 bp, Rattus norvegicus
tcgtgaccaagagcgcgcgcgccaa

SEQ ID NO: 490812 - DNA, 25 bp, Rattus norvegicus
accattgaggtcttcgtgaccaaga

SEQ ID NO: 490813 - DNA, 25 bp, Rattus norvegicus
cgagctggacaccattgaggtcttc

SEQ ID NO: 490814 - DNA, 25 bp, Rattus norvegicus
gccagcgcgagctggacaccattga

SEQ ID NO: 490815 - DNA, 25 bp, Rattus norvegicus
gcgccaaccgcattgcctgcatgta

SEQ ID NO: 490816 - DNA, 25 bp, Rattus norvegicus
ccgggcgctggaagatccacctgac

SEQ ID NO: 490817 - DNA, 25 bp, Rattus norvegicus
tctctggtacctgaacccgagccgg

SEQ ID NO: 490818 - DNA, 25 bp, Rattus norvegicus
tcccgagcccacctactctctggta

SEQ ID NO: 490819 - DNA, 25 bp, Rattus norvegicus
gcccgccatgaacggcctgtcggtg

SEQ ID NO: 490820 - DNA, 25 bp, Rattus norvegicus
ctaacgggactgaggtgtgcagccc

SEQ ID NO: 490821 - DNA, 25 bp, Rattus norvegicus
tgcggcctcctaacgggactgaggt

SEQ ID NO: 490822 - DNA, 25 bp, Rattus norvegicus
ctgacttccagtatggccagcgcga

SEQ ID NO: 490823 - DNA, 25 bp, Rattus norvegicus
gaccagaccggactcgaggcatttc

SEQ ID NO: 490824 - DNA, 25 bp, Rattus norvegicus
tgaagacgaacctgtgcctctgcgc

SEQ ID NO: 490825 - DNA, 25 bp, Rattus norvegicus
ccacaggtggcggacaattctcgtc

SEQ ID NO: 490826 - DNA, 25 bp, Rattus norvegicus
cctgtatcggttcttggcatctcaa

SEQ ID NO: 490827 - DNA, 25 bp, Rattus norvegicus
tctccacctcggtagggaccaagga

SEQ ID NO: 490828 - DNA, 25 bp, Rattus norvegicus
agcctgactgccgagatttttccga

SEQ ID NO: 490829 - DNA, 25 bp, Rattus norvegicus
ctctgcgctctaggaaaggatatca

SEQ ID NO: 490830 - DNA, 25 bp, Rattus norvegicus
taagggcttgctccatcgaaggacc

SEQ ID NO: 490831 - DNA, 25 bp, Rattus norvegicus
ccaagccattagtcagggacccgca

SEQ ID NO: 490832 - DNA, 25 bp, Rattus norvegicus
aggaccacaagccaagccgcgaatc

SEQ ID NO: 490833 - DNA, 25 bp, Rattus norvegicus
gccgcgaatctacggagtcgacttg

SEQ ID NO: 490834 - DNA, 25 bp, Rattus norvegicus
tcggtttccttgtccactccaagta

SEQ ID NO: 490835 - DNA, 25 bp, Rattus norvegicus
tctcgcttaaatctccggaggcggc

SEQ ID NO: 490836 - DNA, 25 bp, Rattus norvegicus
gtctcaagacggtcgcacacatgta

SEQ ID NO: 490837 - DNA, 25 bp, Rattus norvegicus
agctgcgttcccagcgggctggtgc

SEQ ID NO: 490838 - DNA, 25 bp, Rattus norvegicus
taggaccacgtgagcaaggccggtt

SEQ ID NO: 490839 - DNA, 25 bp, Rattus norvegicus
ccgagcttcgtgcagcagctgcgtt

SEQ ID NO: 490840 - DNA, 25 bp, Rattus norvegicus
gtcgcctccgagcttcgtgcagcag

SEQ ID NO: 490841 - DNA, 25 bp, Rattus norvegicus
gaagtctctgccggtcgcctccgag

SEQ ID NO: 490842 - DNA, 25 bp, Rattus norvegicus
ccggttgggctgccgaagtctctgc

SEQ ID NO: 490843 - DNA, 25 bp, Rattus norvegicus
gagctaggaccacgtgagcaaggcc

SEQ ID NO: 490844 - DNA, 25 bp, Rattus norvegicus
ggactggcaggctcccagcacagca

SEQ ID NO: 490845 - DNA, 25 bp, Rattus norvegicus
tgacataccaccactggtgcgcaca

SEQ ID NO: 490846 - DNA, 25 bp, Rattus norvegicus
tgcgtgacataccaccactggtgcg

SEQ ID NO: 490847 - DNA, 25 bp, Rattus norvegicus
gttcggtgtgcgtgacataccacca

SEQ ID NO: 490848 - DNA, 25 bp, Rattus norvegicus
cactggtgcgcacacgtgcgctccc

SEQ ID NO: 490849 - DNA, 25 bp, Rattus norvegicus
tgtgcgtgacataccaccactggtg

SEQ ID NO: 490850 - DNA, 25 bp, Rattus norvegicus
tctgtctcccctgtggcgggagcta

SEQ ID NO: 490851 - DNA, 25 bp, Rattus norvegicus
tcgcgaagctgtacccgccaaagtc

SEQ ID NO: 490852 - DNA, 25 bp, Rattus norvegicus
tagcggcggcgtaacatctcccgca

SEQ ID NO: 490853 - DNA, 25 bp, Rattus norvegicus
catcgactgcccatactgggcggga

SEQ ID NO: 490854 - DNA, 25 bp, Rattus norvegicus
ctaccggcttttttcgctccatcga

SEQ ID NO: 490855 - DNA, 25 bp, Rattus norvegicus
ggaccatgctacgttctaccggctt

SEQ ID NO: 490856 - DNA, 25 bp, Rattus norvegicus
tccgaaaagcgcgagtggaagcctc

SEQ ID NO: 490857 - DNA, 25 bp, Rattus norvegicus
tgtaagcaggctcacttcggtcagc

SEQ ID NO: 490858 - DNA, 25 bp, Rattus norvegicus
ccgcgggaaccgacattgtaagcag

SEQ ID NO: 490859 - DNA, 25 bp, Rattus norvegicus
cgtctatcacaattccgcgggaacc

SEQ ID NO: 490860 - DNA, 25 bp, Rattus norvegicus
agctttgggtcttccgtctatcaca

SEQ ID NO: 490861 - DNA, 25 bp, Rattus norvegicus
agcttctcttgtcctaagctttggg

SEQ ID NO: 490862 - DNA, 25 bp, Rattus norvegicus
ggctctcagaaaccagaagcatata

SEQ ID NO: 490863 - DNA, 25 bp, Rattus norvegicus
tcccgcagcaggtaaagcccgtacg

SEQ ID NO: 490864 - DNA, 25 bp, Rattus norvegicus
tccggggccgaaaggctctcagaaa

SEQ ID NO: 490865 - DNA, 25 bp, Rattus norvegicus
cggggatctgttccacccaaacctg

SEQ ID NO: 490866 - DNA, 25 bp, Rattus norvegicus
gctttccctgggacgttgaggagac

SEQ ID NO: 490867 - DNA, 25 bp, Rattus norvegicus
agacccggctgcagtatgcgcacag

SEQ ID NO: 490868 - DNA, 25 bp, Rattus norvegicus
gcgggccttctgcaactgcccagtt

SEQ ID NO: 490869 - DNA, 25 bp, Rattus norvegicus
tcgaggcggtgtacgaaacgaccaa

SEQ ID NO: 490870 - DNA, 25 bp, Rattus norvegicus
ccaaccttaggatttcggggatctg

SEQ ID NO: 490871 - DNA, 25 bp, Rattus norvegicus
tcctcagtcgggcagctttccctgg

SEQ ID NO: 490872 - DNA, 25 bp, Rattus norvegicus
tgcccatagccgcagggtagtgttt

SEQ ID NO: 490873 - DNA, 25 bp, Rattus norvegicus
tgtggcaagtccgaggctctacact

SEQ ID NO: 490874 - DNA, 25 bp, Rattus norvegicus
ggctctacactgaggcgggccttct

SEQ ID NO: 490875 - DNA, 25 bp, Rattus norvegicus
agcagcgacctcatcctcagtcggg

SEQ ID NO: 490876 - DNA, 25 bp, Rattus norvegicus
aggacgcaggtgctcgcctacagca

SEQ ID NO: 490877 - DNA, 25 bp, Rattus norvegicus
actgcccagttcctagtgagaggtc

SEQ ID NO: 490878 - DNA, 25 bp, Rattus norvegicus
aaacctggtgacctgcccatagccg

SEQ ID NO: 490879 - DNA, 25 bp, Rattus norvegicus
tgcacgtgtctgtttgcaaggacga

SEQ ID NO: 490880 - DNA, 25 bp, Rattus norvegicus
actcagactgcgcacaggctgattc

SEQ ID NO: 490881 - DNA, 25 bp, Rattus norvegicus
cctcctcagtgattggacgcggtcc

SEQ ID NO: 490882 - DNA, 25 bp, Rattus norvegicus
gacgcggtccctgtccatttgattc

SEQ ID NO: 490883 - DNA, 25 bp, Rattus norvegicus
tgcgctccatgagggctctgcagaa

SEQ ID NO: 490884 - DNA, 25 bp, Rattus norvegicus
tccggtactacttcggtgaggccgc

SEQ ID NO: 490885 - DNA, 25 bp, Rattus norvegicus
agccgcagcactcggaccagtaagg

SEQ ID NO: 490886 - DNA, 25 bp, Rattus norvegicus
gcctgtccaaggtgcgtacttattt

SEQ ID NO: 490887 - DNA, 25 bp, Rattus norvegicus
cctttcccagagagcgagcgcatct

SEQ ID NO: 490888 - DNA, 25 bp, Rattus norvegicus
tagccctgcgatgccttttccttta

SEQ ID NO: 490889 - DNA, 25 bp, Rattus norvegicus
cggtcttcgagatgatgcctgtcca

SEQ ID NO: 490890 - DNA, 25 bp, Rattus norvegicus
tacttatttggggacgcagatgggc

SEQ ID NO: 490891 - DNA, 25 bp, Rattus norvegicus
gacgcgtttccacgaactcagactg

SEQ ID NO: 490892 - DNA, 25 bp, Rattus norvegicus
tgtcgttctcgctagctctctggga

SEQ ID NO: 490893 - DNA, 25 bp, Rattus norvegicus
ggatttgagcttgctccagggcttc

SEQ ID NO: 490894 - DNA, 25 bp, Rattus norvegicus
tctaccaggatgcactagccggggc

SEQ ID NO: 490895 - DNA, 25 bp, Rattus norvegicus
gccacgcgagggctgttttagttta

SEQ ID NO: 490896 - DNA, 25 bp, Rattus norvegicus
ggctgttttagtttagcaccctatg

SEQ ID NO: 490897 - DNA, 25 bp, Rattus norvegicus
gtcagtctcaaagacacaagacatc

SEQ ID NO: 490898 - DNA, 25 bp, Rattus norvegicus
gacatcctacacagtccctaaaaga

SEQ ID NO: 490899 - DNA, 25 bp, Rattus norvegicus
cagggacggcgacaattgctattgc

SEQ ID NO: 490900 - DNA, 25 bp, Rattus norvegicus
tattgccctctctctattagcgaca

SEQ ID NO: 490901 - DNA, 25 bp, Rattus norvegicus
tcatgaacccaaggaacgggctaca

SEQ ID NO: 490902 - DNA, 25 bp, Rattus norvegicus
gcctcagaggctagaggacacatcc

SEQ ID NO: 490903 - DNA, 25 bp, Rattus norvegicus
tattagcgacactcggccatgcaga

SEQ ID NO: 490904 - DNA, 25 bp, Rattus norvegicus
cctctcgcatgatgtttggggacga

SEQ ID NO: 490905 - DNA, 25 bp, Rattus norvegicus
tctgatcgtggggaatcatgaaccc

SEQ ID NO: 490906 - DNA, 25 bp, Rattus norvegicus
gcaccctatgtctatgtcagtctca

SEQ ID NO: 490907 - DNA, 25 bp, Rattus norvegicus
cccgatgccactaggcttcggtgtt

SEQ ID NO: 490908 - DNA, 25 bp, Rattus norvegicus
gttcagtgctctcgcccggcttcgg

SEQ ID NO: 490909 - DNA, 25 bp, Rattus norvegicus
tgctgtcccgctcgttcagtgctct

SEQ ID NO: 490910 - DNA, 25 bp, Rattus norvegicus
ggcggctgctgtcccgctcgttcag

SEQ ID NO: 490911 - DNA, 25 bp, Rattus norvegicus
cctccgtgtgtgctcaaggccgcag

SEQ ID NO: 490912 - DNA, 25 bp, Rattus norvegicus
agctcaactccatcctgggcgaccc

SEQ ID NO: 490913 - DNA, 25 bp, Rattus norvegicus
ccgaggctctccaagctcaactcca

SEQ ID NO: 490914 - DNA, 25 bp, Rattus norvegicus
cggctgctgcgagcagcggccacca

SEQ ID NO: 490915 - DNA, 25 bp, Rattus norvegicus
atgccactaggcttcggtgttgggc

SEQ ID NO: 490916 - DNA, 25 bp, Rattus norvegicus
ggcgccaccaccgtccagcaggcta

SEQ ID NO: 490917 - DNA, 25 bp, Rattus norvegicus
atgcccgccaccaggcccggacgcc

SEQ ID NO: 490918 - DNA, 25 bp, Rattus norvegicus
agcaggctagccatgcccgccacca

SEQ ID NO: 490919 - DNA, 25 bp, Rattus norvegicus
agccagctccccacggaagtcaggg

SEQ ID NO: 490920 - DNA, 25 bp, Rattus norvegicus
agctcgccggcttgcgcgtgtgtca

SEQ ID NO: 490921 - DNA, 25 bp, Rattus norvegicus
cgccattaacgcgtcatttatcaga

SEQ ID NO: 490922 - DNA, 25 bp, Rattus norvegicus
agactgctcagcgtctccggggttt

SEQ ID NO: 490923 - DNA, 25 bp, Rattus norvegicus
acgcgtcatttatcagaacacaccc

SEQ ID NO: 490924 - DNA, 25 bp, Rattus norvegicus
gccgggctggaacgcgccattaacg

SEQ ID NO: 490925 - DNA, 25 bp, Rattus norvegicus
caacagcttggctagagcagagggt

SEQ ID NO: 490926 - DNA, 25 bp, Rattus norvegicus
gcctcaacagcttggctagagcaga

SEQ ID NO: 490927 - DNA, 25 bp, Rattus norvegicus
gctcagggcctcaacagcttggcta

SEQ ID NO: 490928 - DNA, 25 bp, Rattus norvegicus
tgaatggcatctggctcagggcctc

SEQ ID NO: 490929 - DNA, 25 bp, Rattus norvegicus
tctggaggagctccaacccgagcga

SEQ ID NO: 490930 - DNA, 25 bp, Rattus norvegicus
tgtcccactgtggcccgggatgtct

SEQ ID NO: 490931 - DNA, 25 bp, Rattus norvegicus
tgctcagcgtctccggggtttctcg

SEQ ID NO: 490932 - DNA, 25 bp, Rattus norvegicus
ctgggcaccgcgtagtagatttgca

SEQ ID NO: 490933 - DNA, 25 bp, Rattus norvegicus
cgcgtagtagatttgcagcggccac

SEQ ID NO: 490934 - DNA, 25 bp, Rattus norvegicus
cgcacgcgggtcaccctgaatggca

SEQ ID NO: 490935 - DNA, 25 bp, Rattus norvegicus
aatatagtgcctcggctgccatccc

SEQ ID NO: 490936 - DNA, 25 bp, Rattus norvegicus
cgggtatctggtctcccgctctcgg

SEQ ID NO: 490937 - DNA, 25 bp, Rattus norvegicus
tctggtctcccgctctcggttttct

SEQ ID NO: 490938 - DNA, 25 bp, Rattus norvegicus
tctcggttttctgggtttgccgcgc

SEQ ID NO: 490939 - DNA, 25 bp, Rattus norvegicus
cccgagataagaaacaggtcaatat

SEQ ID NO: 490940 - DNA, 25 bp, Rattus norvegicus
aggtcaatatagtgcctcggctgcc

SEQ ID NO: 490941 - DNA, 25 bp, Rattus norvegicus
tcatgggacggcggcatcgacccgc

SEQ ID NO: 490942 - DNA, 25 bp, Rattus norvegicus
cagttgcctagcaacccgcggggca

SEQ ID NO: 490943 - DNA, 25 bp, Rattus norvegicus
cggtcgatgcggagcatgcgcaact

SEQ ID NO: 490944 - DNA, 25 bp, Rattus norvegicus
gcgagccatcgatcgccagcgcagc

SEQ ID NO: 490945 - DNA, 25 bp, Rattus norvegicus
cccaggataacgaccggtctgcagg

SEQ ID NO: 490946 - DNA, 25 bp, Rattus norvegicus
ataacgaccggtctgcaggcgccca

SEQ ID NO: 490947 - DNA, 25 bp, Rattus norvegicus
caattcccgcctcccgggtatctgg

SEQ ID NO: 490948 - DNA, 25 bp, Rattus norvegicus
ggagcgcgcacaccgcagttgccta

SEQ ID NO: 490949 - DNA, 25 bp, Rattus norvegicus
gaggggagggtctgttctgaccgcc

SEQ ID NO: 490950 - DNA, 25 bp, Rattus norvegicus
cccgctcgcatcgacctgggcgcgg

SEQ ID NO: 490951 - DNA, 25 bp, Rattus norvegicus
attcagtgtaaaccgcaggttgggc

SEQ ID NO: 490952 - DNA, 25 bp, Rattus norvegicus
cggattcagtgtaaaccgcaggttg

SEQ ID NO: 490953 - DNA, 25 bp, Rattus norvegicus
gtgagttttgcggattcagtgtaaa

SEQ ID NO: 490954 - DNA, 25 bp, Rattus norvegicus
acttttcaagctcgggtgagttttg

SEQ ID NO: 490955 - DNA, 25 bp, Rattus norvegicus
agcacttttcaagctcgggtgagtt

SEQ ID NO: 490956 - DNA, 25 bp, Rattus norvegicus
atggcgtattgagcacttttcaagc

SEQ ID NO: 490957 - DNA, 25 bp, Rattus norvegicus
atcgatggcgtattgagcacttttc

SEQ ID NO: 490958 - DNA, 25 bp, Rattus norvegicus
ccgatcgatcgatggcgtattgagc

SEQ ID NO: 490959 - DNA, 25 bp, Rattus norvegicus
tcagcagcgccgatcgatcgatggc

SEQ ID NO: 490960 - DNA, 25 bp, Rattus norvegicus
gcaccgatcagcagcgccgatcgat

SEQ ID NO: 490961 - DNA, 25 bp, Rattus norvegicus
gggagccccctccttgctgtgctga

SEQ ID NO: 490962 - DNA, 25 bp, Rattus norvegicus
agcagcggcgcaccgatcagcagcg

SEQ ID NO: 490963 - DNA, 25 bp, Rattus norvegicus
tctctccgtaggagtggatctcggc

SEQ ID NO: 490964 - DNA, 25 bp, Rattus norvegicus
gtggcatacacgaagcacaagttta

SEQ ID NO: 490965 - DNA, 25 bp, Rattus norvegicus
cgctcggacgcctgttaagattctc

SEQ ID NO: 490966 - DNA, 25 bp, Rattus norvegicus
ctctgtataggcacaagcacgcgtg

SEQ ID NO: 490967 - DNA, 25 bp, Rattus norvegicus
tgtccacgcaccaacactctgtata

SEQ ID NO: 490968 - DNA, 25 bp, Rattus norvegicus
tgtgcctaacacgaatgtccacgca

SEQ ID NO: 490969 - DNA, 25 bp, Rattus norvegicus
cggctacactttcgaactgcgcttg

SEQ ID NO: 490970 - DNA, 25 bp, Rattus norvegicus
ttcgtgcccatgatctgcactggtg

SEQ ID NO: 490971 - DNA, 25 bp, Rattus norvegicus
accagggcttatgcatggcacgtga

SEQ ID NO: 490972 - DNA, 25 bp, Rattus norvegicus
gcacgtgagtatgaactgaggctcc

SEQ ID NO: 490973 - DNA, 25 bp, Rattus norvegicus
tgtgcctaacacgagtgtgcctaac

SEQ ID NO: 490974 - DNA, 25 bp, Rattus norvegicus
ggctccgggacacgaatgtgcctaa

SEQ ID NO: 490975 - DNA, 25 bp, Rattus norvegicus
aagccgtgcactctggcgcgttcct

SEQ ID NO: 490976 - DNA, 25 bp, Rattus norvegicus
gtgatctaaacacacgagcttcgtg

SEQ ID NO: 490977 - DNA, 25 bp, Rattus norvegicus
ggagccctgtaagccgctttgcgcc

SEQ ID NO: 490978 - DNA, 25 bp, Rattus norvegicus
ggaaccagatcccagacccaagcgg

SEQ ID NO: 490979 - DNA, 25 bp, Rattus norvegicus
tgcgtattgccgcagcctggctcaa

SEQ ID NO: 490980 - DNA, 25 bp, Rattus norvegicus
ccagccggtgcttccgaacaaaata

SEQ ID NO: 490981 - DNA, 25 bp, Rattus norvegicus
gtgctccgacgaaaattactaagtg

SEQ ID NO: 490982 - DNA, 25 bp, Rattus norvegicus
tactaagtggaacggaatctaactc

SEQ ID NO: 490983 - DNA, 25 bp, Rattus norvegicus
atctaactcattcacaaagcgcgga

SEQ ID NO: 490984 - DNA, 25 bp, Rattus norvegicus
tccgtggcctgagtgcctcaaactc

SEQ ID NO: 490985 - DNA, 25 bp, Rattus norvegicus
tgacctgtcgtcgacgtgcagactg

SEQ ID NO: 490986 - DNA, 25 bp, Rattus norvegicus
cgagcacttgatcgcgagccatgtc

SEQ ID NO: 490987 - DNA, 25 bp, Rattus norvegicus
cgagccatgtcttccagtgcacgtg

SEQ ID NO: 490988 - DNA, 25 bp, Rattus norvegicus
ggcgcaccttgtacacctgtccgaa

SEQ ID NO: 490989 - DNA, 25 bp, Rattus norvegicus
tcgcccgcatcgaaggtgcgcaaca

SEQ ID NO: 490990 - DNA, 25 bp, Rattus norvegicus
gcaatttctctaagcccggcgcgga

SEQ ID NO: 490991 - DNA, 25 bp, Rattus norvegicus
ttgagagaggccaggcgacgcgaac

SEQ ID NO: 490992 - DNA, 25 bp, Rattus norvegicus
gtcttcaactttgcgcgcctggaga

SEQ ID NO: 490993 - DNA, 25 bp, Rattus norvegicus
ctgtcttcaactttgcgcgcctgga

SEQ ID NO: 490994 - DNA, 25 bp, Rattus norvegicus
gcgcattgttctctgtcttcaactt

SEQ ID NO: 490995 - DNA, 25 bp, Rattus norvegicus
gcggcgcattgttctctgtcttcaa

SEQ ID NO: 490996 - DNA, 25 bp, Rattus norvegicus
ctccgggtctctctcgggtccgtgg

SEQ ID NO: 490997 - DNA, 25 bp, Rattus norvegicus
agttgcctccgggtctctctcgggt

SEQ ID NO: 490998 - DNA, 25 bp, Rattus norvegicus
tgcatgagaaaaaaagttgcctccg

SEQ ID NO: 490999 - DNA, 25 bp, Rattus norvegicus
cccttctctgcttaatgcatgagaa

SEQ ID NO: 491000 - DNA, 25 bp, Rattus norvegicus
acccgcggtgcacccggtgcatgcc

SEQ ID NO: 491001 - DNA, 25 bp, Rattus norvegicus
ctgcgcgctcctgccgcccacgcgc

SEQ ID NO: 491002 - DNA, 25 bp, Rattus norvegicus
tctgagagacgcttgagagaggcca

SEQ ID NO: 491003 - DNA, 25 bp, Rattus norvegicus
ttcccgcggggcctcctctgagaga

SEQ ID NO: 491004 - DNA, 25 bp, Rattus norvegicus
ccacgcgcgaccctcggggacgcgc

SEQ ID NO: 491005 - DNA, 25 bp, Rattus norvegicus
ctttaaggagctcggccgcatgtgc

SEQ ID NO: 491006 - DNA, 25 bp, Rattus norvegicus
agcagaaggccgagcgggagaagga

SEQ ID NO: 491007 - DNA, 25 bp, Rattus norvegicus
gccgggtggccaataacgcccgaga

SEQ ID NO: 491008 - DNA, 25 bp, Rattus norvegicus
ggtggccaataacgcccgagagcgc

SEQ ID NO: 491009 - DNA, 25 bp, Rattus norvegicus
agcgcctgcgtgtccgcgacatcaa

SEQ ID NO: 491010 - DNA, 25 bp, Rattus norvegicus
gtccgcgacatcaatgaggccttta

SEQ ID NO: 491011 - DNA, 25 bp, Rattus norvegicus
gcctttaaggagctcggccgcatgt

SEQ ID NO: 491012 - DNA, 25 bp, Rattus norvegicus
tgcacctcagcactgagaagccgca

SEQ ID NO: 491013 - DNA, 25 bp, Rattus norvegicus
tgagaagccgcagaccaaactgctc

SEQ ID NO: 491014 - DNA, 25 bp, Rattus norvegicus
tgcgtgtccgcgacatcaatgaggc

SEQ ID NO: 491015 - DNA, 25 bp, Rattus norvegicus
tcatcctgcaccaggccgtggccgt

SEQ ID NO: 491016 - DNA, 25 bp, Rattus norvegicus
catcaatgaggcctttaaggagctc

SEQ ID NO: 491017 - DNA, 25 bp, Rattus norvegicus
cgcgacatcaatgaggcctttaagg

SEQ ID NO: 491018 - DNA, 25 bp, Rattus norvegicus
gtggccgtcatcctcagcctggagc

SEQ ID NO: 491019 - DNA, 25 bp, Rattus norvegicus
ggcgcagaccaagctgctgatcctg

SEQ ID NO: 491020 - DNA, 25 bp, Rattus norvegicus
catggccaataacgctcgggagcgg

SEQ ID NO: 491021 - DNA, 25 bp, Rattus norvegicus
cgtgcgggacattaacgaggccttc

SEQ ID NO: 491022 - DNA, 25 bp, Rattus norvegicus
cattaacgaggccttccgggagctg

SEQ ID NO: 491023 - DNA, 25 bp, Rattus norvegicus
gccagctgcacctcaagtcggataa

SEQ ID NO: 491024 - DNA, 25 bp, Rattus norvegicus
ggagaggcgcatggccaataacgct

SEQ ID NO: 491025 - DNA, 25 bp, Rattus norvegicus
tcggataaggcgcagaccaagctgc

SEQ ID NO: 491026 - DNA, 25 bp, Rattus norvegicus
ccaagctgctgatcctgcagcaggc

SEQ ID NO: 491027 - DNA, 25 bp, Rattus norvegicus
tgcaggttatcctgggcctggagca

SEQ ID NO: 491028 - DNA, 25 bp, Rattus norvegicus
ggtctattccatcctccgctgctgc

SEQ ID NO: 491029 - DNA, 25 bp, Rattus norvegicus
ccagggtggccacggcacagtccta

SEQ ID NO: 491030 - DNA, 25 bp, Rattus norvegicus
ggaccgtctcccactgctctcttct

SEQ ID NO: 491031 - DNA, 25 bp, Rattus norvegicus
ccaaagcagcctgcttgaagcggcg

SEQ ID NO: 491032 - DNA, 25 bp, Rattus norvegicus
cctcaagtcggataaggcgcagacc

SEQ ID NO: 491033 - DNA, 25 bp, Rattus norvegicus
ccgttgctttcacgcatgcgctgta

SEQ ID NO: 491034 - DNA, 25 bp, Rattus norvegicus
gctaccgagaactggccaaaaactg

SEQ ID NO: 491035 - DNA, 25 bp, Rattus norvegicus
ccgcgctaccgagaactggccaaaa

SEQ ID NO: 491036 - DNA, 25 bp, Rattus norvegicus
agcagatttctaggcccgcgctacc

SEQ ID NO: 491037 - DNA, 25 bp, Rattus norvegicus
cccgcagcgatgctcagcagatttc

SEQ ID NO: 491038 - DNA, 25 bp, Rattus norvegicus
tgaccctgagtattgagaccccgca

SEQ ID NO: 491039 - DNA, 25 bp, Rattus norvegicus
cacatgcgtagtgctccagggcggc

SEQ ID NO: 491040 - DNA, 25 bp, Rattus norvegicus
cacgcatgcgctgtacgtctgcaca

SEQ ID NO: 491041 - DNA, 25 bp, Rattus norvegicus
aggtggtgccgttgctttcacgcat

SEQ ID NO: 491042 - DNA, 25 bp, Rattus norvegicus
caccaccggaagaggtggtgccgtt

SEQ ID NO: 491043 - DNA, 25 bp, Rattus norvegicus
ctctgtgccaccaccggaagaggtg

SEQ ID NO: 491044 - DNA, 25 bp, Rattus norvegicus
gatgtcaacgtcctctgtgccacca

SEQ ID NO: 491045 - DNA, 25 bp, Rattus norvegicus
ggaagaagatgtcaacgtcctctgt

SEQ ID NO: 491046 - DNA, 25 bp, Rattus norvegicus
tacgtctgcacatgcgtagtgctcc

SEQ ID NO: 491047 - DNA, 25 bp, Rattus norvegicus
ctcccggcgcgtacgcgagttctga

SEQ ID NO: 491048 - DNA, 25 bp, Rattus norvegicus
cgtcccgccgcgcagttgaagggcg

SEQ ID NO: 491049 - DNA, 25 bp, Rattus norvegicus
gatcgacacgaacatccccgaggtg

SEQ ID NO: 491050 - DNA, 25 bp, Rattus norvegicus
aggacccaggatcgacacgaacatc

SEQ ID NO: 491051 - DNA, 25 bp, Rattus norvegicus
tgtgtcggaaggacccaggatcgac

SEQ ID NO: 491052 - DNA, 25 bp, Rattus norvegicus
ctcatggatagtgggtgagtgtgtc

SEQ ID NO: 491053 - DNA, 25 bp, Rattus norvegicus
cactggccctgcgagccttcagagg

SEQ ID NO: 491054 - DNA, 25 bp, Rattus norvegicus
gccctgcgagccttcagaggactca

SEQ ID NO: 491055 - DNA, 25 bp, Rattus norvegicus
caggcgcggactggtcgctctctgc

SEQ ID NO: 491056 - DNA, 25 bp, Rattus norvegicus
ttcagaggactcatggatagtgggt

SEQ ID NO: 491057 - DNA, 25 bp, Rattus norvegicus
tcgctctctgccgagtggcgggaaa

SEQ ID NO: 491058 - DNA, 25 bp, Rattus norvegicus
tctctgccgagtggcgggaaagtct

SEQ ID NO: 491059 - DNA, 25 bp, Rattus norvegicus
gcgcgtacgcgagttctgacccagc

SEQ ID NO: 491060 - DNA, 25 bp, Rattus norvegicus
cgagccttcagaggactcatggata

SEQ ID NO: 491061 - DNA, 25 bp, Rattus norvegicus
cgacgtgcgtacgagcgtgcgtcct

SEQ ID NO: 491062 - DNA, 25 bp, Rattus norvegicus
cctcgctgttgtcagcgcgcgtgcg

SEQ ID NO: 491063 - DNA, 25 bp, Rattus norvegicus
ccggccacagggatgtcttttacta

SEQ ID NO: 491064 - DNA, 25 bp, Rattus norvegicus
gttggacccagtgcccaacctactg

SEQ ID NO: 491065 - DNA, 25 bp, Rattus norvegicus
gcgtgcgttggacccagtgcccaac

SEQ ID NO: 491066 - DNA, 25 bp, Rattus norvegicus
gctcgacgcccagtgcgcgtgcgtt

SEQ ID NO: 491067 - DNA, 25 bp, Rattus norvegicus
gcagagtccggagcgcactcagaca

SEQ ID NO: 491068 - DNA, 25 bp, Rattus norvegicus
cgagcgtgcgtcctgcgtgccagct

SEQ ID NO: 491069 - DNA, 25 bp, Rattus norvegicus
tttactataggtgaatgagcgcgcc

SEQ ID NO: 491070 - DNA, 25 bp, Rattus norvegicus
agctgcagcctcgtggcttatcgcc

SEQ ID NO: 491071 - DNA, 25 bp, Rattus norvegicus
ttatcgcccgcctgtggcgcgagct

SEQ ID NO: 491072 - DNA, 25 bp, Rattus norvegicus
ggcgcgagcttttgtcctctacgga

SEQ ID NO: 491073 - DNA, 25 bp, Rattus norvegicus
tcctctacggaatcggggaccgtgc

SEQ ID NO: 491074 - DNA, 25 bp, Rattus norvegicus
cgtgccagctgtggtcagtgcgcac

SEQ ID NO: 491075 - DNA, 25 bp, Rattus norvegicus
cagcaccttcgatttccgcacggga

SEQ ID NO: 491076 - DNA, 25 bp, Rattus norvegicus
tcgagtcagtacctctgctggctgc

SEQ ID NO: 491077 - DNA, 25 bp, Rattus norvegicus
agcttccatcgccatcgagtcagta

SEQ ID NO: 491078 - DNA, 25 bp, Rattus norvegicus
ggccctctgggttagcttccatcgc

SEQ ID NO: 491079 - DNA, 25 bp, Rattus norvegicus
ctccaaccaggtcaaggtgagggcg

SEQ ID NO: 491080 - DNA, 25 bp, Rattus norvegicus
gtgcgctatgactcctccaaccagg

SEQ ID NO: 491081 - DNA, 25 bp, Rattus norvegicus
agccgccagcgcgtgcgctatgact

SEQ ID NO: 491082 - DNA, 25 bp, Rattus norvegicus
ctctgctggctgctggcggaagcat

SEQ ID NO: 491083 - DNA, 25 bp, Rattus norvegicus
aacaagatgaataagagccgccagc

SEQ ID NO: 491084 - DNA, 25 bp, Rattus norvegicus
ccgcacgggaaagatgctgatgaac

SEQ ID NO: 491085 - DNA, 25 bp, Rattus norvegicus
cccagcgggaagaagtttcgcagca

SEQ ID NO: 491086 - DNA, 25 bp, Rattus norvegicus
gcggctccatggatctcagcacctt

SEQ ID NO: 491087 - DNA, 25 bp, Rattus norvegicus
tggcacggtacctgggcggctccat

SEQ ID NO: 491088 - DNA, 25 bp, Rattus norvegicus
gcagcaagccacagctggcacggta

SEQ ID NO: 491089 - DNA, 25 bp, Rattus norvegicus
tccctgacagaggtcccgaaggtcc

SEQ ID NO: 491090 - DNA, 25 bp, Rattus norvegicus
cagaggtcccgaaggtcccctggcg

SEQ ID NO: 491091 - DNA, 25 bp, Rattus norvegicus
aagcgatccctgacagaggtcccga

SEQ ID NO: 491092 - DNA, 25 bp, Rattus norvegicus
cgatccctgacagaggtcccgaagg

SEQ ID NO: 491093 - DNA, 25 bp, Rattus norvegicus
agcggcggtgcccattgttggccgc

SEQ ID NO: 491094 - DNA, 25 bp, Rattus norvegicus
gcaaacacgtgaccggcggcccggc

SEQ ID NO: 491095 - DNA, 25 bp, Rattus norvegicus
tggcgagtgctcctgaagcacagga

SEQ ID NO: 491096 - DNA, 25 bp, Rattus norvegicus
gcgagtgctcctgaagcacaggacc

SEQ ID NO: 491097 - DNA, 25 bp, Rattus norvegicus
tgcgggctccgccgaaaaaaatgtg

SEQ ID NO: 491098 - DNA, 25 bp, Rattus norvegicus
tgatggcgagtgctcctgaagcaca

SEQ ID NO: 491099 - DNA, 25 bp, Rattus norvegicus
ggctctgagaactgcgggctccgcc

SEQ ID NO: 491100 - DNA, 25 bp, Rattus norvegicus
tggctctgagaactgcgggctccgc

SEQ ID NO: 491101 - DNA, 25 bp, Rattus norvegicus
agtgctcctgaagcacaggaccctc

SEQ ID NO: 491102 - DNA, 25 bp, Rattus norvegicus
aaaaatgtggggcctcccgcacgtg

SEQ ID NO: 491103 - DNA, 25 bp, Rattus norvegicus
tggcacccacgatggccgtggcttc

SEQ ID NO: 491104 - DNA, 25 bp, Rattus norvegicus
atggccctggcaccgtcggtgacca

SEQ ID NO: 491105 - DNA, 25 bp, Rattus norvegicus
tcggtgaccagtgcagcctccatgg

SEQ ID NO: 491106 - DNA, 25 bp, Rattus norvegicus
gacttgtgcaccctgcatggctgtg

SEQ ID NO: 491107 - DNA, 25 bp, Rattus norvegicus
catggctgtggcaccatcggtgacc

SEQ ID NO: 491108 - DNA, 25 bp, Rattus norvegicus
gacttgtgcaccctcgatggccctg

SEQ ID NO: 491109 - DNA, 25 bp, Rattus norvegicus
tcgatggcactgacaccctcggtga

SEQ ID NO: 491110 - DNA, 25 bp, Rattus norvegicus
agacgtgttcgccagcttcgcgcca

SEQ ID NO: 491111 - DNA, 25 bp, Rattus norvegicus
cgacgctgctggctgaacagttgaa

SEQ ID NO: 491112 - DNA, 25 bp, Rattus norvegicus
cagttgaacgtgatcggcagtcgca

SEQ ID NO: 491113 - DNA, 25 bp, Rattus norvegicus
ggcagtcgcaagaaaagcgtgaaca

SEQ ID NO: 491114 - DNA, 25 bp, Rattus norvegicus
catgaccgaatgtgtgccggtgccc

SEQ ID NO: 491115 - DNA, 25 bp, Rattus norvegicus
cagctcggagcatgtcgcagagatc

SEQ ID NO: 491116 - DNA, 25 bp, Rattus norvegicus
gtgaccgtggcaccctcgatggcac

SEQ ID NO: 491117 - DNA, 25 bp, Rattus norvegicus
cgggaagagatcgaagcgcacatca

SEQ ID NO: 491118 - DNA, 25 bp, Rattus norvegicus
actcccgggcgtgacaaggagccag

SEQ ID NO: 491119 - DNA, 25 bp, Rattus norvegicus
ctcttctgcatggattgtgctgtcc

SEQ ID NO: 491120 - DNA, 25 bp, Rattus norvegicus
aaggagccagtgttcgctgtgaccg

SEQ ID NO: 491121 - DNA, 25 bp, Rattus norvegicus
gacttccacgccaatggtaccgatg

SEQ ID NO: 491122 - DNA, 25 bp, Rattus norvegicus
taccgatgtgtgtctagacctgctg

SEQ ID NO: 491123 - DNA, 25 bp, Rattus norvegicus
gcccttctatgtgggcagccgtgga

SEQ ID NO: 491124 - DNA, 25 bp, Rattus norvegicus
gcttcacatttggtggggacggtcc

SEQ ID NO: 491125 - DNA, 25 bp, Rattus norvegicus
ggactgtgactttggctttgacttc

SEQ ID NO: 491126 - DNA, 25 bp, Rattus norvegicus
aagccatctaccacagcagcgaact

SEQ ID NO: 491127 - DNA, 25 bp, Rattus norvegicus
tcggagggcaaccacaagccatcta

SEQ ID NO: 491128 - DNA, 25 bp, Rattus norvegicus
tgcctgccacggctaccatttgggc

SEQ ID NO: 491129 - DNA, 25 bp, Rattus norvegicus
tcccagatccagtgggtgctgtgcc

SEQ ID NO: 491130 - DNA, 25 bp, Rattus norvegicus
acttcctggcgctagacctgaccgt

SEQ ID NO: 491131 - DNA, 25 bp, Rattus norvegicus
gatccgctccggaaactgcgcagca

SEQ ID NO: 491132 - DNA, 25 bp, Rattus norvegicus
ttgtagtacgcagtgcaggccgacg

SEQ ID NO: 491133 - DNA, 25 bp, Rattus norvegicus
cggaaactgcgcagcaccggaagcc

SEQ ID NO: 491134 - DNA, 25 bp, Rattus norvegicus
tccgggttgcgatccgctccggaaa

SEQ ID NO: 491135 - DNA, 25 bp, Rattus norvegicus
tacctgcctgtggaatgtgcagagc

SEQ ID NO: 491136 - DNA, 25 bp, Rattus norvegicus
ccggggctttacctgcctgtggaat

SEQ ID NO: 491137 - DNA, 25 bp, Rattus norvegicus
tgtaacaaagaacaggcggcgcggc

SEQ ID NO: 491138 - DNA, 25 bp, Rattus norvegicus
cgcggccgcgactgtaacaaagaac

SEQ ID NO: 491139 - DNA, 25 bp, Rattus norvegicus
gttttgactccgatcgcccacggcg

SEQ ID NO: 491140 - DNA, 25 bp, Rattus norvegicus
tccagccgggttttgactccgatcg

SEQ ID NO: 491141 - DNA, 25 bp, Rattus norvegicus
gctccggaatccagccgggttttga

SEQ ID NO: 491142 - DNA, 25 bp, Rattus norvegicus
agccaggcccggcacttagggcaga

SEQ ID NO: 491143 - DNA, 25 bp, Rattus norvegicus
actgtagggactgagctcgcagcca

SEQ ID NO: 491144 - DNA, 25 bp, Rattus norvegicus
catcgtgggagttgtagtacgcagt

SEQ ID NO: 491145 - DNA, 25 bp, Rattus norvegicus
ccagagcttgggcatcagcggtgaa

SEQ ID NO: 491146 - DNA, 25 bp, Rattus norvegicus
cgccgctgcatgtagcaggcaaaga

SEQ ID NO: 491147 - DNA, 25 bp, Rattus norvegicus
ccgcagacgccgctgcatgtagcag

SEQ ID NO: 491148 - DNA, 25 bp, Rattus norvegicus
gggacacgctggatcagggtctctc

SEQ ID NO: 491149 - DNA, 25 bp, Rattus norvegicus
tcagcagacagaagtcaggagaggc

SEQ ID NO: 491150 - DNA, 25 bp, Rattus norvegicus
gcttgggcatcagcggtgaagctca

SEQ ID NO: 491151 - DNA, 25 bp, Rattus norvegicus
ccattgctaaagagcatggccagag

SEQ ID NO: 491152 - DNA, 25 bp, Rattus norvegicus
actgtcccattgctaaagagcatgg

SEQ ID NO: 491153 - DNA, 25 bp, Rattus norvegicus
cacctgcactgtcccattgctaaag

SEQ ID NO: 491154 - DNA, 25 bp, Rattus norvegicus
tggtgctgctcactcacctgcactg

SEQ ID NO: 491155 - DNA, 25 bp, Rattus norvegicus
cgcactccacactgtgagacacagg

SEQ ID NO: 491156 - DNA, 25 bp, Rattus norvegicus
aaagagcctcaggacggccagcttg

SEQ ID NO: 491157 - DNA, 25 bp, Rattus norvegicus
catgtagcaggcaaagagcctcagg

SEQ ID NO: 491158 - DNA, 25 bp, Rattus norvegicus
ggtgaagctcagcagacagaagtca

SEQ ID NO: 491159 - DNA, 25 bp, Rattus norvegicus
cttaagagcaaacaccgcgctggtg

SEQ ID NO: 491160 - DNA, 25 bp, Rattus norvegicus
aaggccacgatgttgcggtggtgca

SEQ ID NO: 491161 - DNA, 25 bp, Rattus norvegicus
ctgtgcagggcgatctcacgctcca

SEQ ID NO: 491162 - DNA, 25 bp, Rattus norvegicus
tcagcaaagtgtgcgtggaaggcca

SEQ ID NO: 491163 - DNA, 25 bp, Rattus norvegicus
tgtccgtgagcttgtagcagcggct

SEQ ID NO: 491164 - DNA, 25 bp, Rattus norvegicus
caaacaccgcgctggtggacatgtc

SEQ ID NO: 491165 - DNA, 25 bp, Rattus norvegicus
ccctcggcaccaccttaagagcaaa

SEQ ID NO: 491166 - DNA, 25 bp, Rattus norvegicus
gaggaggtctcaccttcccgcgcag

SEQ ID NO: 491167 - DNA, 25 bp, Rattus norvegicus
ctgaggcggaggaggtctcaccttc

SEQ ID NO: 491168 - DNA, 25 bp, Rattus norvegicus
ctaggcccggctcgctcgcaggtag

SEQ ID NO: 491169 - DNA, 25 bp, Rattus norvegicus
agtgcaggagacaggccctaggccc

SEQ ID NO: 491170 - DNA, 25 bp, Rattus norvegicus
ctcagctgcagtgcaggagacaggc

SEQ ID NO: 491171 - DNA, 25 bp, Rattus norvegicus
agggcgatctcacgctccacctgtg

SEQ ID NO: 491172 - DNA, 25 bp, Rattus norvegicus
tggacatgtccgtgagcttgtagca

SEQ ID NO: 491173 - DNA, 25 bp, Rattus norvegicus
agcaatgacagcctgccactgcgtg

SEQ ID NO: 491174 - DNA, 25 bp, Rattus norvegicus
ctgccactgcgtgcggagaaccagt

SEQ ID NO: 491175 - DNA, 25 bp, Rattus norvegicus
gtgcacccagaggacgatcagcgcc

SEQ ID NO: 491176 - DNA, 25 bp, Rattus norvegicus
agaggacgatcagcgcccgcactaa

SEQ ID NO: 491177 - DNA, 25 bp, Rattus norvegicus
gcactaacgcgggaaacgcacacac

SEQ ID NO: 491178 - DNA, 25 bp, Rattus norvegicus
cagcctgcagacagagcgccaagtg

SEQ ID NO: 491179 - DNA, 25 bp, Rattus norvegicus
agcgccaagtgtggttcccgcctcg

SEQ ID NO: 491180 - DNA, 25 bp, Rattus norvegicus
aactctagccatggcttccggggtc

SEQ ID NO: 491181 - DNA, 25 bp, Rattus norvegicus
ttccggggtcccgtcctgctcgaga

SEQ ID NO: 491182 - DNA, 25 bp, Rattus norvegicus
tccgttcccgcgctttgaactagtg

SEQ ID NO: 491183 - DNA, 25 bp, Rattus norvegicus
cccgcgctttgaactagtgtgtgtg

SEQ ID NO: 491184 - DNA, 25 bp, Rattus norvegicus
gggaactcccaccttgccgatcagc

SEQ ID NO: 491185 - DNA, 25 bp, Rattus norvegicus
cccgtggagagcaatgacagcctgc

SEQ ID NO: 491186 - DNA, 25 bp, Rattus norvegicus
gagaaccagttgtgcacccagagga

SEQ ID NO: 491187 - DNA, 25 bp, Rattus norvegicus
cgaaccaaggcagggaggtctaatt

SEQ ID NO: 491188 - DNA, 25 bp, Rattus norvegicus
ttcctccgggatgggactgaaactc

SEQ ID NO: 491189 - DNA, 25 bp, Rattus norvegicus
cgatccctaggatggttgtgagttt

SEQ ID NO: 491190 - DNA, 25 bp, Rattus norvegicus
tctccttggagcgaaagcagcgatc

SEQ ID NO: 491191 - DNA, 25 bp, Rattus norvegicus
ggcgacgatgagattggtttctttc

SEQ ID NO: 491192 - DNA, 25 bp, Rattus norvegicus
tatcctgccgctattccacctggtg

SEQ ID NO: 491193 - DNA, 25 bp, Rattus norvegicus
tggtaagtccctcctcgtatcctgc

SEQ ID NO: 491194 - DNA, 25 bp, Rattus norvegicus
gacgcattgccttgggctctgagca

SEQ ID NO: 491195 - DNA, 25 bp, Rattus norvegicus
acgaagttcgcagtcccgcactttg

SEQ ID NO: 491196 - DNA, 25 bp, Rattus norvegicus
ggcacccaggatacgaagaccaacg

SEQ ID NO: 491197 - DNA, 25 bp, Rattus norvegicus
ttcccaaggtcactggcacccagga

SEQ ID NO: 491198 - DNA, 25 bp, Rattus norvegicus
gccgcccggaatagcagtccagtca

SEQ ID NO: 491199 - DNA, 25 bp, Rattus norvegicus
ctggtacgccaatgccggacaggca

SEQ ID NO: 491200 - DNA, 25 bp, Rattus norvegicus
taggcacattccctggccctgagcg

SEQ ID NO: 491201 - DNA, 25 bp, Rattus norvegicus
tcaacggtgatggtgtgctcagcct

SEQ ID NO: 491202 - DNA, 25 bp, Rattus norvegicus
acgggcactacgtgctcaacggtga

SEQ ID NO: 491203 - DNA, 25 bp, Rattus norvegicus
cagattctttgcagcgctggtgacc

SEQ ID NO: 491204 - DNA, 25 bp, Rattus norvegicus
tgcgagaacgggctgacagattctt

SEQ ID NO: 491205 - DNA, 25 bp, Rattus norvegicus
cggctactggaacgtgactttgatc

SEQ ID NO: 491206 - DNA, 25 bp, Rattus norvegicus
atgccaccgcgtcccagaaaatctt

SEQ ID NO: 491207 - DNA, 25 bp, Rattus norvegicus
gtactccagagcatacttccctgtg

SEQ ID NO: 491208 - DNA, 25 bp, Rattus norvegicus
tgagcgcactatcgcacccaaagtg

SEQ ID NO: 491209 - DNA, 25 bp, Rattus norvegicus
cctccctcgaatagatgcgctttta

SEQ ID NO: 491210 - DNA, 25 bp, Rattus norvegicus
ctgattggacaggttaaggcccggc

SEQ ID NO: 491211 - DNA, 25 bp, Rattus norvegicus
ctcctgggagccaagactcttgctg

SEQ ID NO: 491212 - DNA, 25 bp, Rattus norvegicus
tttaacgagtttggctcctgggagc

SEQ ID NO: 491213 - DNA, 25 bp, Rattus norvegicus
acccgcgtggtttacacccgcagtg

SEQ ID NO: 491214 - DNA, 25 bp, Rattus norvegicus
tcacggcctgcacttgaggagcatg

SEQ ID NO: 491215 - DNA, 25 bp, Rattus norvegicus
gttcagcgttgacgcttggtgggac

SEQ ID NO: 491216 - DNA, 25 bp, Rattus norvegicus
ttcagcgttgacgcttggtgggact

SEQ ID NO: 491217 - DNA, 25 bp, Rattus norvegicus
actggggagctcgttcagcgttgac

SEQ ID NO: 491218 - DNA, 25 bp, Rattus norvegicus
ggagctcgttcagcgttgacacttg

SEQ ID NO: 491219 - DNA, 25 bp, Rattus norvegicus
gctcgttcagcgttgacacttggtg

SEQ ID NO: 491220 - DNA, 25 bp, Rattus norvegicus
ttcagcgttgacacttggtgggact

SEQ ID NO: 491221 - DNA, 25 bp, Rattus norvegicus
cgttcagcgttgacgcttggtggga

SEQ ID NO: 491222 - DNA, 25 bp, Rattus norvegicus
gggagctcgttcagcgttgacactt

SEQ ID NO: 491223 - DNA, 25 bp, Rattus norvegicus
cgttcagcgttgacacttggtggga

SEQ ID NO: 491224 - DNA, 25 bp, Rattus norvegicus
tcagcgttgacacttggtgggactg

SEQ ID NO: 491225 - DNA, 25 bp, Rattus norvegicus
tcagcgttgacgcttggtgggactg

SEQ ID NO: 491226 - DNA, 25 bp, Rattus norvegicus
tggggagctcgttcagcgttgacac

SEQ ID NO: 491227 - DNA, 25 bp, Rattus norvegicus
ctcgttcagcgttgacacttggtgg

SEQ ID NO: 491228 - DNA, 25 bp, Rattus norvegicus
tgggactggggagctcgttcagcgt

SEQ ID NO: 491229 - DNA, 25 bp, Rattus norvegicus
tggcacacaggaccggctactgctg

SEQ ID NO: 491230 - DNA, 25 bp, Rattus norvegicus
tactgctgcctcaggctggctatgc

SEQ ID NO: 491231 - DNA, 25 bp, Rattus norvegicus
atctcgagagtatgtgtgggcacca

SEQ ID NO: 491232 - DNA, 25 bp, Rattus norvegicus
gctcgcctctgcgatctcgagagta

SEQ ID NO: 491233 - DNA, 25 bp, Rattus norvegicus
gacacgtcagccctgatggcacaca

SEQ ID NO: 491234 - DNA, 25 bp, Rattus norvegicus
ctgcccggcgttgtccagtgtaaac

SEQ ID NO: 491235 - DNA, 25 bp, Rattus norvegicus
ccgagttcgactagctgcccggcgt

SEQ ID NO: 491236 - DNA, 25 bp, Rattus norvegicus
cggaggacagccgagttcgactagc

SEQ ID NO: 491237 - DNA, 25 bp, Rattus norvegicus
ctttggagtcctgcggaggacagcc

SEQ ID NO: 491238 - DNA, 25 bp, Rattus norvegicus
gtgcgggtcctgctcatctacaaaa

SEQ ID NO: 491239 - DNA, 25 bp, Rattus norvegicus
gctatgctcggctttggagtcctgc

SEQ ID NO: 491240 - DNA, 25 bp, Rattus norvegicus
tatgtgtgggcaccaggccactgcc

SEQ ID NO: 491241 - DNA, 25 bp, Rattus norvegicus
ccacatcgagaatacctgttggcta

SEQ ID NO: 491242 - DNA, 25 bp, Rattus norvegicus
cctgttggctaccaggcgacacgtc

SEQ ID NO: 491243 - DNA, 25 bp, Rattus norvegicus
ttgttcctgtgtggcggcctgttgt

SEQ ID NO: 491244 - DNA, 25 bp, Rattus norvegicus
gtctgctggtttgttcctgtgtggc

SEQ ID NO: 491245 - DNA, 25 bp, Rattus norvegicus
tgttgtccggctgggtcccaaggac

SEQ ID NO: 491246 - DNA, 25 bp, Rattus norvegicus
gggtcccaaggaccggcctgctgac

SEQ ID NO: 491247 - DNA, 25 bp, Rattus norvegicus
gcctgctgactgtggggcagcaaca

SEQ ID NO: 491248 - DNA, 25 bp, Rattus norvegicus
agcaacagagcgcatgggcagctga

SEQ ID NO: 491249 - DNA, 25 bp, Rattus norvegicus
agcgcatgggcagctgaatggaccc

SEQ ID NO: 491250 - DNA, 25 bp, Rattus norvegicus
ccagtgttccactgggcagccgggc

SEQ ID NO: 491251 - DNA, 25 bp, Rattus norvegicus
aactgccccggcttcgatgggtccg

SEQ ID NO: 491252 - DNA, 25 bp, Rattus norvegicus
tcttgctgggaaactgggagccgat

SEQ ID NO: 491253 - DNA, 25 bp, Rattus norvegicus
actgggagccgatgacgaaagaacc

SEQ ID NO: 491254 - DNA, 25 bp, Rattus norvegicus
ccgatgacgaaagaaccagtggcca

SEQ ID NO: 491255 - DNA, 25 bp, Rattus norvegicus
tgacgaaagaaccagtggccagctg

SEQ ID NO: 491256 - DNA, 25 bp, Rattus norvegicus
agtggccagctgaccccgggacgca

SEQ ID NO: 491257 - DNA, 25 bp, Rattus norvegicus
tggtcaccgacccacagatcgtgag

SEQ ID NO: 491258 - DNA, 25 bp, Rattus norvegicus
accaaggtgcacaggaaccacatcc

SEQ ID NO: 491259 - DNA, 25 bp, Rattus norvegicus
gggctgactctgttctctcgggtca

SEQ ID NO: 491260 - DNA, 25 bp, Rattus norvegicus
ggtggcctccactacgacaactgca

SEQ ID NO: 491261 - DNA, 25 bp, Rattus norvegicus
caactgcaattgtgacggctacacc

SEQ ID NO: 491262 - DNA, 25 bp, Rattus norvegicus
cacacgctgtcagtgggcagtacca

SEQ ID NO: 491263 - DNA, 25 bp, Rattus norvegicus
ccttcagcagcggtgtggtcaccga

SEQ ID NO: 491264 - DNA, 25 bp, Rattus norvegicus
tcctcacgcaggaggccttcaggcg

SEQ ID NO: 491265 - DNA, 25 bp, Rattus norvegicus
tcgtgagcatccagccaagaccgcg

SEQ ID NO: 491266 - DNA, 25 bp, Rattus norvegicus
atacacatctatagcgccagttggg

SEQ ID NO: 491267 - DNA, 25 bp, Rattus norvegicus
ccatcactgacatcgtggaggctca

SEQ ID NO: 491268 - DNA, 25 bp, Rattus norvegicus
gtgcgcatgttggatggagccatca

SEQ ID NO: 491269 - DNA, 25 bp, Rattus norvegicus
aggccttcaggcgtggtgtaaccaa

SEQ ID NO: 491270 - DNA, 25 bp, Rattus norvegicus
gcctacaggggcgtcttcacctagg

SEQ ID NO: 491271 - DNA, 25 bp, Rattus norvegicus
aggtccggaggtccagactcgacgc

SEQ ID NO: 491272 - DNA, 25 bp, Rattus norvegicus
gtggctccctactaagcctcagaag

SEQ ID NO: 491273 - DNA, 25 bp, Rattus norvegicus
tactaagcctcagaagaaatgcacc

SEQ ID NO: 491274 - DNA, 25 bp, Rattus norvegicus
aaatgcaccattcgggtggtgcaca

SEQ ID NO: 491275 - DNA, 25 bp, Rattus norvegicus
tccctactaagcctcagaagaaatg

SEQ ID NO: 491276 - DNA, 25 bp, Rattus norvegicus
tggtgcacaccccaacgtgagagag

SEQ ID NO: 491277 - DNA, 25 bp, Rattus norvegicus
gcgcagtgagccaccactatggcta

SEQ ID NO: 491278 - DNA, 25 bp, Rattus norvegicus
aggatcaacggcgtggggcgccaag

SEQ ID NO: 491279 - DNA, 25 bp, Rattus norvegicus
tacgcagggccagtgacggctaccc

SEQ ID NO: 491280 - DNA, 25 bp, Rattus norvegicus
tggctcgcgtgtggctccctactaa

SEQ ID NO: 491281 - DNA, 25 bp, Rattus norvegicus
ctgctggtagacctggctcgcgtgt

SEQ ID NO: 491282 - DNA, 25 bp, Rattus norvegicus
ccactatggctatgggctgctggac

SEQ ID NO: 491283 - DNA, 25 bp, Rattus norvegicus
ccaccactatggctatgggctgctg

SEQ ID NO: 491284 - DNA, 25 bp, Rattus norvegicus
gcgtgtggctccctactaagcctca

SEQ ID NO: 491285 - DNA, 25 bp, Rattus norvegicus
caaattgagccctgcgcgcctggga

SEQ ID NO: 491286 - DNA, 25 bp, Rattus norvegicus
agggccgcgacgaagagcgacacca

SEQ ID NO: 491287 - DNA, 25 bp, Rattus norvegicus
agcgacaccaggaagagccactgca

SEQ ID NO: 491288 - DNA, 25 bp, Rattus norvegicus
aggaagagccactgcacctcgccga

SEQ ID NO: 491289 - DNA, 25 bp, Rattus norvegicus
cacgagcccatgctgacggcgcata

SEQ ID NO: 491290 - DNA, 25 bp, Rattus norvegicus
atgctgacggcgcatacccggcgtg

SEQ ID NO: 491291 - DNA, 25 bp, Rattus norvegicus
gcgactcaggacatccgccgggaca

SEQ ID NO: 491292 - DNA, 25 bp, Rattus norvegicus
tgcgccaagtacaggcccacggtgc

SEQ ID NO: 491293 - DNA, 25 bp, Rattus norvegicus
gataagcgcaccaaattgagccctg

SEQ ID NO: 491294 - DNA, 25 bp, Rattus norvegicus
cccacgcgtggttgggaagtgcaaa

SEQ ID NO: 491295 - DNA, 25 bp, Rattus norvegicus
aagtgcaaagcaaggctcttcttcc

SEQ ID NO: 491296 - DNA, 25 bp, Rattus norvegicus
tcttcccagcttgctgccggggtgt

SEQ ID NO: 491297 - DNA, 25 bp, Rattus norvegicus
cactaaccgcaggaggccgggccta

SEQ ID NO: 491298 - DNA, 25 bp, Rattus norvegicus
cggcgaggagagataagcgcaccaa

SEQ ID NO: 491299 - DNA, 25 bp, Rattus norvegicus
ctgctgtatgggacggcagaggaca

SEQ ID NO: 491300 - DNA, 25 bp, Rattus norvegicus
cagaggacatgacagcgcggcccca

SEQ ID NO: 491301 - DNA, 25 bp, Rattus norvegicus
cgcatggtcacttattgggtgagga

SEQ ID NO: 491302 - DNA, 25 bp, Rattus norvegicus
cctgcccaggaactctgtactactg

SEQ ID NO: 491303 - DNA, 25 bp, Rattus norvegicus
tgcccaggaactctgtactactgca

SEQ ID NO: 491304 - DNA, 25 bp, Rattus norvegicus
ctctgtactactgcacgctgctgct

SEQ ID NO: 491305 - DNA, 25 bp, Rattus norvegicus
cacttattgggtgaggaggcgcagc

SEQ ID NO: 491306 - DNA, 25 bp, Rattus norvegicus
cagctgcgcgcacgcatgtgcagag

SEQ ID NO: 491307 - DNA, 25 bp, Rattus norvegicus
cgcgcacgcatgtgcagagggacac

SEQ ID NO: 491308 - DNA, 25 bp, Rattus norvegicus
gcacgcatgtgcagagggacacaga

SEQ ID NO: 491309 - DNA, 25 bp, Rattus norvegicus
acacagaggggctgtgccagggtga

SEQ ID NO: 491310 - DNA, 25 bp, Rattus norvegicus
tgccagggtgagtggccgcagcgca

SEQ ID NO: 491311 - DNA, 25 bp, Rattus norvegicus
ccgcagcgcatggtcacttattggg

SEQ ID NO: 491312 - DNA, 25 bp, Rattus norvegicus
ggaactctgtactactgcacgctgc

SEQ ID NO: 491313 - DNA, 25 bp, Rattus norvegicus
acggcatactgacgcggaggtcgaa

SEQ ID NO: 491314 - DNA, 25 bp, Rattus norvegicus
cggcggcttcctaagttcttggagc

SEQ ID NO: 491315 - DNA, 25 bp, Rattus norvegicus
aagtgctagaacgtaggggcgctca

SEQ ID NO: 491316 - DNA, 25 bp, Rattus norvegicus
ttcctaagttcttggagcgaagata

SEQ ID NO: 491317 - DNA, 25 bp, Rattus norvegicus
gcgaagataggcagcagggtttttc

SEQ ID NO: 491318 - DNA, 25 bp, Rattus norvegicus
ggcagcagggtttttctacggcata

SEQ ID NO: 491319 - DNA, 25 bp, Rattus norvegicus
tttttctacggcatactgacgcgga

SEQ ID NO: 491320 - DNA, 25 bp, Rattus norvegicus
tgacgcggaggtcgaaccaaactcc

SEQ ID NO: 491321 - DNA, 25 bp, Rattus norvegicus
gccaagccgagagtgcaccccgtta

SEQ ID NO: 491322 - DNA, 25 bp, Rattus norvegicus
ccaaggccaagaaacgcgtggtgct

SEQ ID NO: 491323 - DNA, 25 bp, Rattus norvegicus
aagaaacgcgtggtgctgcccactc

SEQ ID NO: 491324 - DNA, 25 bp, Rattus norvegicus
cacggtagagcagatcctggaggac

SEQ ID NO: 491325 - DNA, 25 bp, Rattus norvegicus
gcagggtttttctacggcatactga

SEQ ID NO: 491326 - DNA, 25 bp, Rattus norvegicus
aagtggcggcggcttcctaagttct

SEQ ID NO: 491327 - DNA, 25 bp, Rattus norvegicus
acacactaatatgtggcagggaggc

SEQ ID NO: 491328 - DNA, 25 bp, Rattus norvegicus
gggcctgcgggacacactaatatgt

SEQ ID NO: 491329 - DNA, 25 bp, Rattus norvegicus
acagagacagcgctatcgggcctgc

SEQ ID NO: 491330 - DNA, 25 bp, Rattus norvegicus
caagacctggcttggcctgcgggac

SEQ ID NO: 491331 - DNA, 25 bp, Rattus norvegicus
ggagacgctcgcagctcatcacagc

SEQ ID NO: 491332 - DNA, 25 bp, Rattus norvegicus
aggcgtacctcttgactgtctcggg

SEQ ID NO: 491333 - DNA, 25 bp, Rattus norvegicus
tcatcacagcgagaggagcagagaa

SEQ ID NO: 491334 - DNA, 25 bp, Rattus norvegicus
gacagctccgatctacggcgccgga

SEQ ID NO: 491335 - DNA, 25 bp, Rattus norvegicus
tgaggccacacgtaccaggcccagg

SEQ ID NO: 491336 - DNA, 25 bp, Rattus norvegicus
cctggggactccttaatgaaggtca

SEQ ID NO: 491337 - DNA, 25 bp, Rattus norvegicus
aggtcagctgccttctgaagccgga

SEQ ID NO: 491338 - DNA, 25 bp, Rattus norvegicus
aagccggagcggtctgaggactcac

SEQ ID NO: 491339 - DNA, 25 bp, Rattus norvegicus
tctgaggactcactgccgctagagc

SEQ ID NO: 491340 - DNA, 25 bp, Rattus norvegicus
gccgctagagcgagttgaggccaca

SEQ ID NO: 491341 - DNA, 25 bp, Rattus norvegicus
ggctggcatctttcccgacagtctg

SEQ ID NO: 491342 - DNA, 25 bp, Rattus norvegicus
acgcagcgcctctagttctttatca

SEQ ID NO: 491343 - DNA, 25 bp, Rattus norvegicus
tgaccgagccctagagccagctggt

SEQ ID NO: 491344 - DNA, 25 bp, Rattus norvegicus
ccaccgcacgttctggacaggctgg

SEQ ID NO: 491345 - DNA, 25 bp, Rattus norvegicus
gcagttccacgtcctgctggacata

SEQ ID NO: 491346 - DNA, 25 bp, Rattus norvegicus
acatacagctcatgcagggccagtg

SEQ ID NO: 491347 - DNA, 25 bp, Rattus norvegicus
cactaacatgtacacggggaccggc

SEQ ID NO: 491348 - DNA, 25 bp, Rattus norvegicus
ttctccaccgtgaagcgtacgctgc

SEQ ID NO: 491349 - DNA, 25 bp, Rattus norvegicus
cgatgtccaggaagcgcttcacgta

SEQ ID NO: 491350 - DNA, 25 bp, Rattus norvegicus
acgtaactttcccactgcaggctga

SEQ ID NO: 491351 - DNA, 25 bp, Rattus norvegicus
cagctcgctgggactcactgtacca

SEQ ID NO: 491352 - DNA, 25 bp, Rattus norvegicus
aacggctctcgaagctgcccaggga

SEQ ID NO: 491353 - DNA, 25 bp, Rattus norvegicus
gtgtctcctggacgcagttctcaga

SEQ ID NO: 491354 - DNA, 25 bp, Rattus norvegicus
ggctggaagcacaagagaaattctc

SEQ ID NO: 491355 - DNA, 25 bp, Rattus norvegicus
tgctaccactgttcaggctgtcgtt

SEQ ID NO: 491356 - DNA, 25 bp, Rattus norvegicus
tgttcccgggtacagtagccatcgc

SEQ ID NO: 491357 - DNA, 25 bp, Rattus norvegicus
cactgttcaggctgtcgttggagag

SEQ ID NO: 491358 - DNA, 25 bp, Rattus norvegicus
tcccgggtacagtagccatcgctgg

SEQ ID NO: 491359 - DNA, 25 bp, Rattus norvegicus
gtagccatcgctggtgctaccactg

SEQ ID NO: 491360 - DNA, 25 bp, Rattus norvegicus
ccatcgctggtgctaccactgttca

SEQ ID NO: 491361 - DNA, 25 bp, Rattus norvegicus
tcgctggtgctaccactgttcaggc

SEQ ID NO: 491362 - DNA, 25 bp, Rattus norvegicus
tggtgctaccactgttcaggctgtc

SEQ ID NO: 491363 - DNA, 25 bp, Rattus norvegicus
taccactgttcaggctgtcgttgga

SEQ ID NO: 491364 - DNA, 25 bp, Rattus norvegicus
gtgggccgccttgagcctcagcaga

SEQ ID NO: 491365 - DNA, 25 bp, Rattus norvegicus
ccgccttgagcctcagcagagggtg

SEQ ID NO: 491366 - DNA, 25 bp, Rattus norvegicus
ttgagcctcagcagagggtgcgccc

SEQ ID NO: 491367 - DNA, 25 bp, Rattus norvegicus
atgtgttcccgggtacagtagccat

SEQ ID NO: 491368 - DNA, 25 bp, Rattus norvegicus
gtgcgcccggctgccagcctcacgc

SEQ ID NO: 491369 - DNA, 25 bp, Rattus norvegicus
ttgctcacgatagtcaagctgtgcg

SEQ ID NO: 491370 - DNA, 25 bp, Rattus norvegicus
cccacaacagttcctggtcgcgggg

SEQ ID NO: 491371 - DNA, 25 bp, Rattus norvegicus
tcatcttgtgtttggagtggacgag

SEQ ID NO: 491372 - DNA, 25 bp, Rattus norvegicus
agtggacgaggtttcgtagcatgcc

SEQ ID NO: 491373 - DNA, 25 bp, Rattus norvegicus
gacgaggtttcgtagcatgcccaca

SEQ ID NO: 491374 - DNA, 25 bp, Rattus norvegicus
aggtttcgtagcatgcccacagccc

SEQ ID NO: 491375 - DNA, 25 bp, Rattus norvegicus
aggtcccacaacagttcctggtcgc

SEQ ID NO: 491376 - DNA, 25 bp, Rattus norvegicus
cagacaggttccaaagggtgccgca

SEQ ID NO: 491377 - DNA, 25 bp, Rattus norvegicus
gttccaaagggtgccgcaggcattg

SEQ ID NO: 491378 - DNA, 25 bp, Rattus norvegicus
aaagggtgccgcaggcattgctcac

SEQ ID NO: 491379 - DNA, 25 bp, Rattus norvegicus
tgccgcaggcattgctcacgatagt

SEQ ID NO: 491380 - DNA, 25 bp, Rattus norvegicus
ggcattgctcacgatagtcaagctg

SEQ ID NO: 491381 - DNA, 25 bp, Rattus norvegicus
ctcacgatagtcaagctgtgcgacg

SEQ ID NO: 491382 - DNA, 25 bp, Rattus norvegicus
cgcaggcattgctcacgatagtcaa

SEQ ID NO: 491383 - DNA, 25 bp, Rattus norvegicus
agggcgtggcgaagcctcctgtcgc

SEQ ID NO: 491384 - DNA, 25 bp, Rattus norvegicus
tacaggccccgaaaggttgtgcgga

SEQ ID NO: 491385 - DNA, 25 bp, Rattus norvegicus
ggaaacgggtccttgagccacttga

SEQ ID NO: 491386 - DNA, 25 bp, Rattus norvegicus
gccggaacgccgagcgtccacagcc

SEQ ID NO: 491387 - DNA, 25 bp, Rattus norvegicus
tccacagccgggtgacgggttccgc

SEQ ID NO: 491388 - DNA, 25 bp, Rattus norvegicus
ggttccgccgctcacggtctgggtc

SEQ ID NO: 491389 - DNA, 25 bp, Rattus norvegicus
ctcacggtctgggtccgccagagtc

SEQ ID NO: 491390 - DNA, 25 bp, Rattus norvegicus
ggtccttgagccacttgaaggattg

SEQ ID NO: 491391 - DNA, 25 bp, Rattus norvegicus
agccacttgaaggattggaagttga

SEQ ID NO: 491392 - DNA, 25 bp, Rattus norvegicus
cttgaaggattggaagttgaaacgg

SEQ ID NO: 491393 - DNA, 25 bp, Rattus norvegicus
agcactggaaggagcggcactttac

SEQ ID NO: 491394 - DNA, 25 bp, Rattus norvegicus
gaaggagcggcactttaccctcaga

SEQ ID NO: 491395 - DNA, 25 bp, Rattus norvegicus
cactttaccctcagaaggtacaggc

SEQ ID NO: 491396 - DNA, 25 bp, Rattus norvegicus
agcggcactttaccctcagaaggta

SEQ ID NO: 491397 - DNA, 25 bp, Rattus norvegicus
cctgatccggctgggagaagactat

SEQ ID NO: 491398 - DNA, 25 bp, Rattus norvegicus
tctcgcagtaggctcggatctgctc

SEQ ID NO: 491399 - DNA, 25 bp, Rattus norvegicus
cgttggcacgcatgcgtgcatcttt

SEQ ID NO: 491400 - DNA, 25 bp, Rattus norvegicus
ccagtcccagcaggtctcgcagtag

SEQ ID NO: 491401 - DNA, 25 bp, Rattus norvegicus
gatctgctccagcacgtgcagcaca

SEQ ID NO: 491402 - DNA, 25 bp, Rattus norvegicus
gtgcagcacacgcatctccttgcgt

SEQ ID NO: 491403 - DNA, 25 bp, Rattus norvegicus
atctccttgcgtgccaggccctgat

SEQ ID NO: 491404 - DNA, 25 bp, Rattus norvegicus
agaagactatgttgtgcagggccgc

SEQ ID NO: 491405 - DNA, 25 bp, Rattus norvegicus
acagacccagcctcagtgccatgaa

SEQ ID NO: 491406 - DNA, 25 bp, Rattus norvegicus
tcagtgccatgaaggatctggagca

SEQ ID NO: 491407 - DNA, 25 bp, Rattus norvegicus
agcagcagtggcagacatcccgagc

SEQ ID NO: 491408 - DNA, 25 bp, Rattus norvegicus
gcatggctacgcagctctctggcga

SEQ ID NO: 491409 - DNA, 25 bp, Rattus norvegicus
gtgcgcgcagtatcttcctggtcgc

SEQ ID NO: 491410 - DNA, 25 bp, Rattus norvegicus
gtgcatctttggcaccaggcgctcc

SEQ ID NO: 491411 - DNA, 25 bp, Rattus norvegicus
gatgtgctgggcttcgaactccagc

SEQ ID NO: 491412 - DNA, 25 bp, Rattus norvegicus
tcgtctgaggtaccgaagcgctcct

SEQ ID NO: 491413 - DNA, 25 bp, Rattus norvegicus
gctgctgccgaattagatccatctg

SEQ ID NO: 491414 - DNA, 25 bp, Rattus norvegicus
tggtcctccactccctgaagcccgg

SEQ ID NO: 491415 - DNA, 25 bp, Rattus norvegicus
actcctgcactttccttaggtgcgc

SEQ ID NO: 491416 - DNA, 25 bp, Rattus norvegicus
ccgctgcaccatctcgtctgaggta

SEQ ID NO: 491417 - DNA, 25 bp, Rattus norvegicus
gcgctcctccatcaacgagcggatg

SEQ ID NO: 491418 - DNA, 25 bp, Rattus norvegicus
atcaacgagcggatgtgctgggctt

SEQ ID NO: 491419 - DNA, 25 bp, Rattus norvegicus
gcggactcctcccatttagctggtc

SEQ ID NO: 491420 - DNA, 25 bp, Rattus norvegicus
ggcttcgaactccagctgctgccga

SEQ ID NO: 491421 - DNA, 25 bp, Rattus norvegicus
gatccatctgcatcgaaaactgctg

SEQ ID NO: 491422 - DNA, 25 bp, Rattus norvegicus
tctgcatcgaaaactgctgggagcg

SEQ ID NO: 491423 - DNA, 25 bp, Rattus norvegicus
cacgggctatggtgagttgcgtttt

SEQ ID NO: 491424 - DNA, 25 bp, Rattus norvegicus
gtgagttgcgttttgacctggaccc

SEQ ID NO: 491425 - DNA, 25 bp, Rattus norvegicus
tggcgacagccaatagcaacccggg

SEQ ID NO: 491426 - DNA, 25 bp, Rattus norvegicus
ttgcgcctgggattgctgtaaaagc

SEQ ID NO: 491427 - DNA, 25 bp, Rattus norvegicus
tgggattgctgtaaaagcccagggc

SEQ ID NO: 491428 - DNA, 25 bp, Rattus norvegicus
ggtctccctcttggctaggcctaca

SEQ ID NO: 491429 - DNA, 25 bp, Rattus norvegicus
gctaggcctacaagccagacctggg

SEQ ID NO: 491430 - DNA, 25 bp, Rattus norvegicus
ccagacctggggtgtctaggtctcc

SEQ ID NO: 491431 - DNA, 25 bp, Rattus norvegicus
cggggtaagacgcacggcttacttg

SEQ ID NO: 491432 - DNA, 25 bp, Rattus norvegicus
ttccagagggacaaagcccgatccg

SEQ ID NO: 491433 - DNA, 25 bp, Rattus norvegicus
ggacaaagcccgatccgggcctggc

SEQ ID NO: 491434 - DNA, 25 bp, Rattus norvegicus
cgctgggcgagaccactgcaagcta

SEQ ID NO: 491435 - DNA, 25 bp, Rattus norvegicus
gcacggcttacttgcgcctgggatt

SEQ ID NO: 491436 - DNA, 25 bp, Rattus norvegicus
aagacgagctggtgctatggcgaca

SEQ ID NO: 491437 - DNA, 25 bp, Rattus norvegicus
agccaatagcaacccggggcaggga

SEQ ID NO: 491438 - DNA, 25 bp, Rattus norvegicus
accactgcaagctagcaggggagga

SEQ ID NO: 491439 - DNA, 25 bp, Rattus norvegicus
caaatgcgggcacagagcatgcgca

SEQ ID NO: 491440 - DNA, 25 bp, Rattus norvegicus
gaatttgacgtcatcccacaccagg

SEQ ID NO: 491441 - DNA, 25 bp, Rattus norvegicus
ccacaccagggatgaggtcatcgca

SEQ ID NO: 491442 - DNA, 25 bp, Rattus norvegicus
gccgctgtgattccatccatcttga

SEQ ID NO: 491443 - DNA, 25 bp, Rattus norvegicus
gcgtgacggttactcaccgctcttc

SEQ ID NO: 491444 - DNA, 25 bp, Rattus norvegicus
tacgtcaggaaaggccgcgttttgc

SEQ ID NO: 491445 - DNA, 25 bp, Rattus norvegicus
ggagagaaatcacctcagagttacg

SEQ ID NO: 491446 - DNA, 25 bp, Rattus norvegicus
acgcccgcaacccactggtggagga

SEQ ID NO: 491447 - DNA, 25 bp, Rattus norvegicus
gtctgggcatgctctgtaaggaccg

SEQ ID NO: 491448 - DNA, 25 bp, Rattus norvegicus
agcatgcgcagtgcaaggacacata

SEQ ID NO: 491449 - DNA, 25 bp, Rattus norvegicus
tctcaacggctctgctgtggccagc

SEQ ID NO: 491450 - DNA, 25 bp, Rattus norvegicus
agtacgataaggtctgcatgggcta

SEQ ID NO: 491451 - DNA, 25 bp, Rattus norvegicus
acacatagggctacgtgggagtctg

SEQ ID NO: 491452 - DNA, 25 bp, Rattus norvegicus
cgcgcacgcgtaaaagggcccgacg

SEQ ID NO: 491453 - DNA, 25 bp, Rattus norvegicus
tgtccagcagctggtcgaggtccac

SEQ ID NO: 491454 - DNA, 25 bp, Rattus norvegicus
ctgcgcagttatcgcgagctctgct

SEQ ID NO: 491455 - DNA, 25 bp, Rattus norvegicus
tactcaccatcttggcggctgctgg

SEQ ID NO: 491456 - DNA, 25 bp, Rattus norvegicus
gcgcagagagcgaagaagacacata

SEQ ID NO: 491457 - DNA, 25 bp, Rattus norvegicus
atggcgacggatacactggcgcaga

SEQ ID NO: 491458 - DNA, 25 bp, Rattus norvegicus
agtctccgaggacccgagcacatcg

SEQ ID NO: 491459 - DNA, 25 bp, Rattus norvegicus
aaggcccgacgaggcgatacacagc

SEQ ID NO: 491460 - DNA, 25 bp, Rattus norvegicus
gagctgcacagctgcccgttaaggc

SEQ ID NO: 491461 - DNA, 25 bp, Rattus norvegicus
gagctcgccgttctttcccgggagc

SEQ ID NO: 491462 - DNA, 25 bp, Rattus norvegicus
gcatagcgacgagcgcagctaacct

SEQ ID NO: 491463 - DNA, 25 bp, Rattus norvegicus
tccacgccacggtaggtgaacttgc

SEQ ID NO: 491464 - DNA, 25 bp, Rattus norvegicus
cggacagaaacccagcggaccaagg

SEQ ID NO: 491465 - DNA, 25 bp, Rattus norvegicus
ttccgccctcggagactcgctattg

SEQ ID NO: 491466 - DNA, 25 bp, Rattus norvegicus
ttctgctccacttcggcctgcgtga

SEQ ID NO: 491467 - DNA, 25 bp, Rattus norvegicus
cgcaggcgcaaacgcgggttccctt

SEQ ID NO: 491468 - DNA, 25 bp, Rattus norvegicus
tatcgtcttgggtcccttgagttac

SEQ ID NO: 491469 - DNA, 25 bp, Rattus norvegicus
ccactcgcggatctgggtcttgcgt

SEQ ID NO: 491470 - DNA, 25 bp, Rattus norvegicus
agtcctgttcattatctggccttca

SEQ ID NO: 491471 - DNA, 25 bp, Rattus norvegicus
ctccgtcgagtctaagccttctggg

SEQ ID NO: 491472 - DNA, 25 bp, Rattus norvegicus
agaaacgcgcttccgctccgtcgag

SEQ ID NO: 491473 - DNA, 25 bp, Rattus norvegicus
cagaaacaactgagaaacgcgcttc

SEQ ID NO: 491474 - DNA, 25 bp, Rattus norvegicus
gcgccggcgcggcagaaacaactga

SEQ ID NO: 491475 - DNA, 25 bp, Rattus norvegicus
cttgagttacccatgggctgccttg

SEQ ID NO: 491476 - DNA, 25 bp, Rattus norvegicus
cccgactcgtgagttatcgtcttgg

SEQ ID NO: 491477 - DNA, 25 bp, Rattus norvegicus
ccctgacgagtgaaccttcatttag

SEQ ID NO: 491478 - DNA, 25 bp, Rattus norvegicus
ccggcgagttatcctacgagatccc

SEQ ID NO: 491479 - DNA, 25 bp, Rattus norvegicus
gggtctctcagtccggcgagttatc

SEQ ID NO: 491480 - DNA, 25 bp, Rattus norvegicus
tctgctctgaaatcccggcccggtt

SEQ ID NO: 491481 - DNA, 25 bp, Rattus norvegicus
cagcggaaaccggaaccacaaactg

SEQ ID NO: 491482 - DNA, 25 bp, Rattus norvegicus
gcttttttcctgtgatcgcgcccga

SEQ ID NO: 491483 - DNA, 25 bp, Rattus norvegicus
gaaccacaaactgagcggttccgac

SEQ ID NO: 491484 - DNA, 25 bp, Rattus norvegicus
cccaaatagacaccagcggaaaccg

SEQ ID NO: 491485 - DNA, 25 bp, Rattus norvegicus
ggttctggtccaacgcccaaataga

SEQ ID NO: 491486 - DNA, 25 bp, Rattus norvegicus
aacctctgcggtccgtcttccaaag

SEQ ID NO: 491487 - DNA, 25 bp, Rattus norvegicus
tcggccttcagacaacctctgcggt

SEQ ID NO: 491488 - DNA, 25 bp, Rattus norvegicus
gaagcccagctcgaggcccaggact

SEQ ID NO: 491489 - DNA, 25 bp, Rattus norvegicus
tcaataccgggcttgggctccaagg

SEQ ID NO: 491490 - DNA, 25 bp, Rattus norvegicus
ccaacgcctgtcaataccgggcttg

SEQ ID NO: 491491 - DNA, 25 bp, Rattus norvegicus
tataggtctctctgcgatcccaacg

SEQ ID NO: 491492 - DNA, 25 bp, Rattus norvegicus
ggctgggttctgacctataggtctc

SEQ ID NO: 491493 - DNA, 25 bp, Rattus norvegicus
cactatcgcgggctgggttctgacc

SEQ ID NO: 491494 - DNA, 25 bp, Rattus norvegicus
tccgacccgcttttttcctgtgatc

SEQ ID NO: 491495 - DNA, 25 bp, Rattus norvegicus
cagagaaggggatttaggtcagaaa

SEQ ID NO: 491496 - DNA, 25 bp, Rattus norvegicus
agcaggaaactggagggtctcagcc

SEQ ID NO: 491497 - DNA, 25 bp, Rattus norvegicus
ttcaggctgcagaagatagggacca

SEQ ID NO: 491498 - DNA, 25 bp, Rattus norvegicus
gaagatagggaccaggccggaaata

SEQ ID NO: 491499 - DNA, 25 bp, Rattus norvegicus
ggccggaaatacgaagctctcagca

SEQ ID NO: 491500 - DNA, 25 bp, Rattus norvegicus
atacgaagctctcagcagggttggg

SEQ ID NO: 491501 - DNA, 25 bp, Rattus norvegicus
gagggtctcagcctccaagggcctc

SEQ ID NO: 491502 - DNA, 25 bp, Rattus norvegicus
gacctgcctcacagcggcgccgagc

SEQ ID NO: 491503 - DNA, 25 bp, Rattus norvegicus
cccgcccacacgaccgcccaatgga

SEQ ID NO: 491504 - DNA, 25 bp, Rattus norvegicus
gatccactggtcacgccctccaccg

SEQ ID NO: 491505 - DNA, 25 bp, Rattus norvegicus
ttcccgctcctcaacttgtagagtg

SEQ ID NO: 491506 - DNA, 25 bp, Rattus norvegicus
cctcaacttgtagagtgcgcagtga

SEQ ID NO: 491507 - DNA, 25 bp, Rattus norvegicus
tttaggtcagaaatacagggttcgc

SEQ ID NO: 491508 - DNA, 25 bp, Rattus norvegicus
atacagggttcgcagcaggaaactg

SEQ ID NO: 491509 - DNA, 25 bp, Rattus norvegicus
gccagcgggctcttctctattctat

SEQ ID NO: 491510 - DNA, 25 bp, Rattus norvegicus
tcctttgtttgtcggtgtgcgccac

SEQ ID NO: 491511 - DNA, 25 bp, Rattus norvegicus
gcgacctcggtgtcagtctcacttc

SEQ ID NO: 491512 - DNA, 25 bp, Rattus norvegicus
tccatccattgtgcattcgcccgtg

SEQ ID NO: 491513 - DNA, 25 bp, Rattus norvegicus
ccaagtggagctcatctggggatcc

SEQ ID NO: 491514 - DNA, 25 bp, Rattus norvegicus
atctgtcgctcgtgaacccaagtgg

SEQ ID NO: 491515 - DNA, 25 bp, Rattus norvegicus
ccaggttcgccatcgggtcatctgt

SEQ ID NO: 491516 - DNA, 25 bp, Rattus norvegicus
acggtacgcggcctcattaggaagc

SEQ ID NO: 491517 - DNA, 25 bp, Rattus norvegicus
cctgttgtggcttttgcacggattc

SEQ ID NO: 491518 - DNA, 25 bp, Rattus norvegicus
ataggttctctctctgtagctcagg

SEQ ID NO: 491519 - DNA, 25 bp, Rattus norvegicus
acggattctgcagcttgtgcttggc

SEQ ID NO: 491520 - DNA, 25 bp, Rattus norvegicus
cggaactcctccactctgtcggaaa

SEQ ID NO: 491521 - DNA, 25 bp, Rattus norvegicus
tgtcggaaatctagcacgcccgtca

SEQ ID NO: 491522 - DNA, 25 bp, Rattus norvegicus
ggctgcggacacaaggtcctttgta

SEQ ID NO: 491523 - DNA, 25 bp, Rattus norvegicus
ggccctcgccgttcaccatgtatag

SEQ ID NO: 491524 - DNA, 25 bp, Rattus norvegicus
ggtcacaggaggcatggccctcgcc

SEQ ID NO: 491525 - DNA, 25 bp, Rattus norvegicus
agcgcttgaagcctcgctgccggtg

SEQ ID NO: 491526 - DNA, 25 bp, Rattus norvegicus
attcccagcgcttgaagcctcgctg

SEQ ID NO: 491527 - DNA, 25 bp, Rattus norvegicus
ccaggtagtcattgatgctgacctc

SEQ ID NO: 491528 - DNA, 25 bp, Rattus norvegicus
tagatgtccaggtagtcattgatgc

SEQ ID NO: 491529 - DNA, 25 bp, Rattus norvegicus
cgggcaatagatgtccaggtagtca

SEQ ID NO: 491530 - DNA, 25 bp, Rattus norvegicus
ccatagtgcgggcaatagatgtcca

SEQ ID NO: 491531 - DNA, 25 bp, Rattus norvegicus
tgtaccgttccatgcgctctgccgg

SEQ ID NO: 491532 - DNA, 25 bp, Rattus norvegicus
ataggatgtaccgttccatgcgctc

SEQ ID NO: 491533 - DNA, 25 bp, Rattus norvegicus
tcaccatgtataggatgtaccgttc

SEQ ID NO: 491534 - DNA, 25 bp, Rattus norvegicus
cgccgttcaccatgtataggatgta

SEQ ID NO: 491535 - DNA, 25 bp, Rattus norvegicus
cattgatgctgacctccacggtgta

SEQ ID NO: 491536 - DNA, 25 bp, Rattus norvegicus
tgaagcctcgctgccggtggtcaca

SEQ ID NO: 491537 - DNA, 25 bp, Rattus norvegicus
tgcgcccggcatctcagtacttaag

SEQ ID NO: 491538 - DNA, 25 bp, Rattus norvegicus
gaacggtgcactgcgcaaggcgctc

SEQ ID NO: 491539 - DNA, 25 bp, Rattus norvegicus
tttgtccccgctggagcgtcttgga

SEQ ID NO: 491540 - DNA, 25 bp, Rattus norvegicus
ctagcctcccgcatcgggaagggga

SEQ ID NO: 491541 - DNA, 25 bp, Rattus norvegicus
cccgtgcggattgtagcgaagggct

SEQ ID NO: 491542 - DNA, 25 bp, Rattus norvegicus
cttgtttgcgctgcgcccggcatct

SEQ ID NO: 491543 - DNA, 25 bp, Rattus norvegicus
cggcatctcagtacttaagaggctg

SEQ ID NO: 491544 - DNA, 25 bp, Rattus norvegicus
ggaggattgactcacgagttccaga

SEQ ID NO: 491545 - DNA, 25 bp, Rattus norvegicus
gactcacgagttccagaccatccta

SEQ ID NO: 491546 - DNA, 25 bp, Rattus norvegicus
ttccagaccatcctaggctacagag

SEQ ID NO: 491547 - DNA, 25 bp, Rattus norvegicus
ggctacagagtaagagctggtctga

SEQ ID NO: 491548 - DNA, 25 bp, Rattus norvegicus
taagagctggtctgaaaaaacaaaa

SEQ ID NO: 491549 - DNA, 25 bp, Rattus norvegicus
ctcagtacttaagaggctgaggcag

SEQ ID NO: 491550 - DNA, 25 bp, Rattus norvegicus
cgaagggcttgtttgcgctgcgccc

SEQ ID NO: 491551 - DNA, 25 bp, Rattus norvegicus
attggctgagacgagcccgtggccc

SEQ ID NO: 491552 - DNA, 25 bp, Rattus norvegicus
gcctgtacctggctccttccgattg

SEQ ID NO: 491553 - DNA, 25 bp, Rattus norvegicus
tggcattccgtaaccttgttttggc

SEQ ID NO: 491554 - DNA, 25 bp, Rattus norvegicus
cgtaaccttgttttggcggagcttg

SEQ ID NO: 491555 - DNA, 25 bp, Rattus norvegicus
cttctccgaagctgcctgtacctgg

SEQ ID NO: 491556 - DNA, 25 bp, Rattus norvegicus
ggctccttccgattggctgagacga

SEQ ID NO: 491557 - DNA, 25 bp, Rattus norvegicus
ctactcgtttgaattccacgcgctc

SEQ ID NO: 491558 - DNA, 25 bp, Rattus norvegicus
gcggagcttgcgtcacacgccttct

SEQ ID NO: 491559 - DNA, 25 bp, Rattus norvegicus
ccctgctgattggaagcgatgactg

SEQ ID NO: 491560 - DNA, 25 bp, Rattus norvegicus
aattccacgcgctccaaaatatccg

SEQ ID NO: 491561 - DNA, 25 bp, Rattus norvegicus
aaactggaatttcccgcggagctga

SEQ ID NO: 491562 - DNA, 25 bp, Rattus norvegicus
gaagcgatgactgccaatccgccgt

SEQ ID NO: 491563 - DNA, 25 bp, Rattus norvegicus
cttgcttgtgttaggttgagccaga

SEQ ID NO: 491564 - DNA, 25 bp, Rattus norvegicus
aatccgccgtccgtcttgcttgtgt

SEQ ID NO: 491565 - DNA, 25 bp, Rattus norvegicus
ccgtgtccgggagactcccgcttgt

SEQ ID NO: 491566 - DNA, 25 bp, Rattus norvegicus
gcgcaccggagaaaaagcagcagca

SEQ ID NO: 491567 - DNA, 25 bp, Rattus norvegicus
tttcagcggaatccggtgtggcgca

SEQ ID NO: 491568 - DNA, 25 bp, Rattus norvegicus
cctgctagagttttcagcggaatcc

SEQ ID NO: 491569 - DNA, 25 bp, Rattus norvegicus
cacacccggcctgctagagttttca

SEQ ID NO: 491570 - DNA, 25 bp, Rattus norvegicus
caagcgaagcatcgcggagcccgtg

SEQ ID NO: 491571 - DNA, 25 bp, Rattus norvegicus
ggagactcccgcttgtgcggttttg

SEQ ID NO: 491572 - DNA, 25 bp, Rattus norvegicus
ggccgcagagcccagtaattacgta

SEQ ID NO: 491573 - DNA, 25 bp, Rattus norvegicus
taaagcgaaaccaggccgcagagcc

SEQ ID NO: 491574 - DNA, 25 bp, Rattus norvegicus
ttacgtagaacaagcgaagcatcgc

SEQ ID NO: 491575 - DNA, 25 bp, Rattus norvegicus
gcccagtaattacgtagaacaagcg

SEQ ID NO: 491576 - DNA, 25 bp, Rattus norvegicus
gcccggatgaggaagtaaagcgaaa

SEQ ID NO: 491577 - DNA, 25 bp, Rattus norvegicus
ctaacgcacctaaaggcccggatga

SEQ ID NO: 491578 - DNA, 25 bp, Rattus norvegicus
gcggttttgagacccggtcggcaca

SEQ ID NO: 491579 - DNA, 25 bp, Rattus norvegicus
actggcaggaggtaccaccaatttg

SEQ ID NO: 491580 - DNA, 25 bp, Rattus norvegicus
agagcgagattcgtttcacacggtc

SEQ ID NO: 491581 - DNA, 25 bp, Rattus norvegicus
ccgcagctcagtgtcggcaatgaaa

SEQ ID NO: 491582 - DNA, 25 bp, Rattus norvegicus
gttacctcgaggcacaggccagctg

SEQ ID NO: 491583 - DNA, 25 bp, Rattus norvegicus
tcacacggtcttttaatcggcttcg

SEQ ID NO: 491584 - DNA, 25 bp, Rattus norvegicus
taaaccggaggggtgagacacaagc

SEQ ID NO: 491585 - DNA, 25 bp, Rattus norvegicus
cgcgagcgagcgaaagtgttacctc

SEQ ID NO: 491586 - DNA, 25 bp, Rattus norvegicus
ccaagcctaagtttctgtccacgtg

SEQ ID NO: 491587 - DNA, 25 bp, Rattus norvegicus
caccaatttgactcggacttccagg

SEQ ID NO: 491588 - DNA, 25 bp, Rattus norvegicus
cagcagcgcaggtctaaagcctgtc

SEQ ID NO: 491589 - DNA, 25 bp, Rattus norvegicus
cctcacggactctgggccaaaatta

SEQ ID NO: 491590 - DNA, 25 bp, Rattus norvegicus
cgcccacgtgtttcgtcccaaggtg

SEQ ID NO: 491591 - DNA, 25 bp, Rattus norvegicus
gacttccaggaagcaaaggtcaacc

SEQ ID NO: 491592 - DNA, 25 bp, Rattus norvegicus
ctgtccacgtgagctataaaccgga

SEQ ID NO: 491593 - DNA, 25 bp, Rattus norvegicus
gtcttttttcgagcccatgggctga

SEQ ID NO: 491594 - DNA, 25 bp, Rattus norvegicus
cgcaaactggttctttagctgggga

SEQ ID NO: 491595 - DNA, 25 bp, Rattus norvegicus
gctggggaaagcactctagccgttg

SEQ ID NO: 491596 - DNA, 25 bp, Rattus norvegicus
ctctagccgttgtggagcaagccca

SEQ ID NO: 491597 - DNA, 25 bp, Rattus norvegicus
tctcgcgaaaccagagtctccggcg

SEQ ID NO: 491598 - DNA, 25 bp, Rattus norvegicus
gtctccggcgagatttcgctaacta

SEQ ID NO: 491599 - DNA, 25 bp, Rattus norvegicus
cgctaactacaatctcgcgagaacg

SEQ ID NO: 491600 - DNA, 25 bp, Rattus norvegicus
cgcgagaacggaaacaggaaatgtc

SEQ ID NO: 491601 - DNA, 25 bp, Rattus norvegicus
tggcctccaagcaggacccggaagt

SEQ ID NO: 491602 - DNA, 25 bp, Rattus norvegicus
tcggcgaactcttaaggaataactg

SEQ ID NO: 491603 - DNA, 25 bp, Rattus norvegicus
ataactgtagcttgcgagctcaggc

SEQ ID NO: 491604 - DNA, 25 bp, Rattus norvegicus
agctcaggcgggaccatgctgactc

SEQ ID NO: 491605 - DNA, 25 bp, Rattus norvegicus
cggtcgagcgtccaggactgaagcc

SEQ ID NO: 491606 - DNA, 25 bp, Rattus norvegicus
aggtaacgctgcaaacgcaaactgg

SEQ ID NO: 491607 - DNA, 25 bp, Rattus norvegicus
tcaccgctgagtcgggcaggtccct

SEQ ID NO: 491608 - DNA, 25 bp, Rattus norvegicus
gtggagctgacccacttccgcgttc

SEQ ID NO: 491609 - DNA, 25 bp, Rattus norvegicus
gctggaatgtgttcaggccgcattc

SEQ ID NO: 491610 - DNA, 25 bp, Rattus norvegicus
cgctgagtgttttgattggctggaa

SEQ ID NO: 491611 - DNA, 25 bp, Rattus norvegicus
ggactccgttggcttcgccattgcc

SEQ ID NO: 491612 - DNA, 25 bp, Rattus norvegicus
tcagattcggcagctgtgcctgggt

SEQ ID NO: 491613 - DNA, 25 bp, Rattus norvegicus
aatcggacgcctcagattcggcagc

SEQ ID NO: 491614 - DNA, 25 bp, Rattus norvegicus
cagcatgccgcgctgaccaatcgga

SEQ ID NO: 491615 - DNA, 25 bp, Rattus norvegicus
ggaagacagcgcgtcacacacccaa

SEQ ID NO: 491616 - DNA, 25 bp, Rattus norvegicus
cactaaagtcggcatcgggcaaggg

SEQ ID NO: 491617 - DNA, 25 bp, Rattus norvegicus
cattgcggcggccattttacaaaaa

SEQ ID NO: 491618 - DNA, 25 bp, Rattus norvegicus
ttcgctggcgcagcttttcaaagca

SEQ ID NO: 491619 - DNA, 25 bp, Rattus norvegicus
ttttcaaagcattgcggcggccatt

SEQ ID NO: 491620 - DNA, 25 bp, Rattus norvegicus
acccaagcttcctaacgcgcgagtg

SEQ ID NO: 491621 - DNA, 25 bp, Rattus norvegicus
cacctggtctctgcacggcggaggc

SEQ ID NO: 491622 - DNA, 25 bp, Rattus norvegicus
ctgggcgtcactatggagacgatga

SEQ ID NO: 491623 - DNA, 25 bp, Rattus norvegicus
actgcacctggtctctgcacggcgg

SEQ ID NO: 491624 - DNA, 25 bp, Rattus norvegicus
ggggacactgcacctggtctctgca

SEQ ID NO: 491625 - DNA, 25 bp, Rattus norvegicus
acagtaataagcgtctgggttggga

SEQ ID NO: 491626 - DNA, 25 bp, Rattus norvegicus
gaccgggcgggagacagtaataagc

SEQ ID NO: 491627 - DNA, 25 bp, Rattus norvegicus
ttggacccaggctaatgaccgggcg

SEQ ID NO: 491628 - DNA, 25 bp, Rattus norvegicus
ctcttggacccaggctaatgaccgg

SEQ ID NO: 491629 - DNA, 25 bp, Rattus norvegicus
ggtcctcttggacccaggctaatga

SEQ ID NO: 491630 - DNA, 25 bp, Rattus norvegicus
gccgggtcctcttggacccaggcta

SEQ ID NO: 491631 - DNA, 25 bp, Rattus norvegicus
gacgatgagaggcaccgcctccact

SEQ ID NO: 491632 - DNA, 25 bp, Rattus norvegicus
atggagacgatgagaggcaccgcct

SEQ ID NO: 491633 - DNA, 25 bp, Rattus norvegicus
gaccgtgatggaacccgcccagttg

SEQ ID NO: 491634 - DNA, 25 bp, Rattus norvegicus
cactatggagacgatgagaggcacc

SEQ ID NO: 491635 - DNA, 25 bp, Rattus norvegicus
cagcagcagccgtcaagcctgcgtt

SEQ ID NO: 491636 - DNA, 25 bp, Rattus norvegicus
ccaagtttgcatacacgcgggcact

SEQ ID NO: 491637 - DNA, 25 bp, Rattus norvegicus
gcgcagtcggctttgccaggctaaa

SEQ ID NO: 491638 - DNA, 25 bp, Rattus norvegicus
tgccaggctaaagcccgccttcaga

SEQ ID NO: 491639 - DNA, 25 bp, Rattus norvegicus
cttcagaaggcaacctggagctatt

SEQ ID NO: 491640 - DNA, 25 bp, Rattus norvegicus
ggcaacctggagctattggtacttc

SEQ ID NO: 491641 - DNA, 25 bp, Rattus norvegicus
gagctattggtacttcaagaagacg

SEQ ID NO: 491642 - DNA, 25 bp, Rattus norvegicus
ttcaagaagacggaaaggagacttc

SEQ ID NO: 491643 - DNA, 25 bp, Rattus norvegicus
gaaaggagacttcaccaatgagacc

SEQ ID NO: 491644 - DNA, 25 bp, Rattus norvegicus
cgatgacgtcgggagcctctcccgg

SEQ ID NO: 491645 - DNA, 25 bp, Rattus norvegicus
tcccggcgcgttgtcctgacaactg

SEQ ID NO: 491646 - DNA, 25 bp, Rattus norvegicus
ttgtcctgacaactgcgtttccatc

SEQ ID NO: 491647 - DNA, 25 bp, Rattus norvegicus
gcgtttccatctcatcgggtttccg

SEQ ID NO: 491648 - DNA, 25 bp, Rattus norvegicus
tcaagcctgcgttgagaatcccgcc

SEQ ID NO: 491649 - DNA, 25 bp, Rattus norvegicus
cgagctatcctggttcgcacggtgc

SEQ ID NO: 491650 - DNA, 25 bp, Rattus norvegicus
gcctctcaaggacaggacagtcttc

SEQ ID NO: 491651 - DNA, 25 bp, Rattus norvegicus
ggaaggtcccaacgttagcaataga

SEQ ID NO: 491652 - DNA, 25 bp, Rattus norvegicus
aacaaggtcctcctctgctccgtgg

SEQ ID NO: 491653 - DNA, 25 bp, Rattus norvegicus
gatccggtttctagggcgtttgaca

SEQ ID NO: 491654 - DNA, 25 bp, Rattus norvegicus
ggtccaacagaaacggggcgagcta

SEQ ID NO: 491655 - DNA, 25 bp, Rattus norvegicus
aagctgtcgcttgagcctgagcctc

SEQ ID NO: 491656 - DNA, 25 bp, Rattus norvegicus
gcagccgctgctctcaagatctggg

SEQ ID NO: 491657 - DNA, 25 bp, Rattus norvegicus
atcaacgttccaatgggcgggacca

SEQ ID NO: 491658 - DNA, 25 bp, Rattus norvegicus
gcggcggccaatcaacacacacaga

SEQ ID NO: 491659 - DNA, 25 bp, Rattus norvegicus
cccgtcccttctgtgtccaatgaag

SEQ ID NO: 491660 - DNA, 25 bp, Rattus norvegicus
cgagttcgaggacttagcaccttca

SEQ ID NO: 491661 - DNA, 25 bp, Rattus norvegicus
agagcgaaggaaccggccattgttc

SEQ ID NO: 491662 - DNA, 25 bp, Rattus norvegicus
acaggaaatcgtggggccatcccgc

SEQ ID NO: 491663 - DNA, 25 bp, Rattus norvegicus
tttagcttagcggacagcagacaca

SEQ ID NO: 491664 - DNA, 25 bp, Rattus norvegicus
gcggacagcagacacacagggatag

SEQ ID NO: 491665 - DNA, 25 bp, Rattus norvegicus
cactgcgatgctccgaaggctgcgc

SEQ ID NO: 491666 - DNA, 25 bp, Rattus norvegicus
ggcgcagttcccacaagaacgcacg

SEQ ID NO: 491667 - DNA, 25 bp, Rattus norvegicus
tgtcttctgggaggcgcagttccca

SEQ ID NO: 491668 - DNA, 25 bp, Rattus norvegicus
cgcgcactgcgatgctccgaaggct

SEQ ID NO: 491669 - DNA, 25 bp, Rattus norvegicus
tcagtggactttagcttagcggaca

SEQ ID NO: 491670 - DNA, 25 bp, Rattus norvegicus
gtggcggaaacgtcagtggacttta

SEQ ID NO: 491671 - DNA, 25 bp, Rattus norvegicus
cagacctgggtgacgaagcaatgcg

SEQ ID NO: 491672 - DNA, 25 bp, Rattus norvegicus
ctggagcaccagacggcgcagacct

SEQ ID NO: 491673 - DNA, 25 bp, Rattus norvegicus
gtacgtacgcgcctggagcaccaga

SEQ ID NO: 491674 - DNA, 25 bp, Rattus norvegicus
ggtgaaggacatctgtccaggccca

SEQ ID NO: 491675 - DNA, 25 bp, Rattus norvegicus
aggcgaaggtgaaggacatctgtcc

SEQ ID NO: 491676 - DNA, 25 bp, Rattus norvegicus
acacacagggatagcgaggcggcct

SEQ ID NO: 491677 - DNA, 25 bp, Rattus norvegicus
gcattcacgcagattacagcctccg

SEQ ID NO: 491678 - DNA, 25 bp, Rattus norvegicus
tgcgtgctagagagaggtcgcacca

SEQ ID NO: 491679 - DNA, 25 bp, Rattus norvegicus
gagcagctcacggaagaggttactg

SEQ ID NO: 491680 - DNA, 25 bp, Rattus norvegicus
cagctcacggaagaggttactgggt

SEQ ID NO: 491681 - DNA, 25 bp, Rattus norvegicus
gttactgggtggcatgcacgccgaa

SEQ ID NO: 491682 - DNA, 25 bp, Rattus norvegicus
actgggtggcatgcacgccgaagca

SEQ ID NO: 491683 - DNA, 25 bp, Rattus norvegicus
ggcgcgcgaaacctggagatgtact

SEQ ID NO: 491684 - DNA, 25 bp, Rattus norvegicus
aaacctggagatgtacttgctcttc

SEQ ID NO: 491685 - DNA, 25 bp, Rattus norvegicus
gatgtacttgctcttctccgcagtc

SEQ ID NO: 491686 - DNA, 25 bp, Rattus norvegicus
cgccactgacgcaggagcccgtgcg

SEQ ID NO: 491687 - DNA, 25 bp, Rattus norvegicus
cactgacgccagttgtgtccgcgca

SEQ ID NO: 491688 - DNA, 25 bp, Rattus norvegicus
gacgccagttgtgtccgcgcagcct

SEQ ID NO: 491689 - DNA, 25 bp, Rattus norvegicus
gcagcctcgctctcggccatgacat

SEQ ID NO: 491690 - DNA, 25 bp, Rattus norvegicus
tctcggccatgacatcaccaccctg

SEQ ID NO: 491691 - DNA, 25 bp, Rattus norvegicus
ttcagggacgttgcagcaccaggta

SEQ ID NO: 491692 - DNA, 25 bp, Rattus norvegicus
cgcctgcagcctggagagggatcac

SEQ ID NO: 491693 - DNA, 25 bp, Rattus norvegicus
gagagccgtgttatctgccgcccgc

SEQ ID NO: 491694 - DNA, 25 bp, Rattus norvegicus
ggagagggatcacgcccatgcctgc

SEQ ID NO: 491695 - DNA, 25 bp, Rattus norvegicus
ccgagctccagagccaaccgggaga

SEQ ID NO: 491696 - DNA, 25 bp, Rattus norvegicus
cattcataaattctccgtcggctcc

SEQ ID NO: 491697 - DNA, 25 bp, Rattus norvegicus
ggcgcatcgccaacgcgatcacgtg

SEQ ID NO: 491698 - DNA, 25 bp, Rattus norvegicus
ggtggccatcacatcgccagccaga

SEQ ID NO: 491699 - DNA, 25 bp, Rattus norvegicus
cgcccgcaccgagttcagggacgtt

SEQ ID NO: 491700 - DNA, 25 bp, Rattus norvegicus
ggcctcagtttaccctagtgagagg

SEQ ID NO: 491701 - DNA, 25 bp, Rattus norvegicus
cgatgtcgccttggcctcctggatc

SEQ ID NO: 491702 - DNA, 25 bp, Rattus norvegicus
ctggatcctcacgagcctggcatcg

SEQ ID NO: 491703 - DNA, 25 bp, Rattus norvegicus
tggcatcgggttctctgcgctttcc

SEQ ID NO: 491704 - DNA, 25 bp, Rattus norvegicus
cggttaccgggtacacagagccagg

SEQ ID NO: 491705 - DNA, 25 bp, Rattus norvegicus
taacgcccaggcgtaggtgcgcaca

SEQ ID NO: 491706 - DNA, 25 bp, Rattus norvegicus
gctgccctgtttgaacagagccgca

SEQ ID NO: 491707 - DNA, 25 bp, Rattus norvegicus
tgtccttcaacgaggctgccctgtt

SEQ ID NO: 491708 - DNA, 25 bp, Rattus norvegicus
tcgccgcgtgtccttcaacgaggct

SEQ ID NO: 491709 - DNA, 25 bp, Rattus norvegicus
gaaacagagcgcttcctagccacca

SEQ ID NO: 491710 - DNA, 25 bp, Rattus norvegicus
ggacaccgaaacagagcgcttccta

SEQ ID NO: 491711 - DNA, 25 bp, Rattus norvegicus
agggccaggacaccgaaacagagcg

SEQ ID NO: 491712 - DNA, 25 bp, Rattus norvegicus
ttcgagtccgactcatctctgtttc

SEQ ID NO: 491713 - DNA, 25 bp, Rattus norvegicus
ccatcctgccctcactcggcccgtg

SEQ ID NO: 491714 - DNA, 25 bp, Rattus norvegicus
tctgtttccttaacgcccaggcgta

SEQ ID NO: 491715 - DNA, 25 bp, Rattus norvegicus
ccgactcatctctgtttccttaacg

SEQ ID NO: 491716 - DNA, 25 bp, Rattus norvegicus
ccgcaaggctcaggacaagggccgc

SEQ ID NO: 491717 - DNA, 25 bp, Rattus norvegicus
ctgtttgaacagagccgcaaggctc

SEQ ID NO: 491718 - DNA, 25 bp, Rattus norvegicus
accctctcttggctctcctcacaga

SEQ ID NO: 491719 - DNA, 25 bp, Rattus norvegicus
tcctcaagcctttcaaggggtcctc

SEQ ID NO: 491720 - DNA, 25 bp, Rattus norvegicus
gaaccgactcgccacgcaagtctgg

SEQ ID NO: 491721 - DNA, 25 bp, Rattus norvegicus
ccagctgctagggttgggagccaaa

SEQ ID NO: 491722 - DNA, 25 bp, Rattus norvegicus
ccgttctttccagccagctgctagg

SEQ ID NO: 491723 - DNA, 25 bp, Rattus norvegicus
atctccgcttaggttcctggttagg

SEQ ID NO: 491724 - DNA, 25 bp, Rattus norvegicus
cgggaccttcagatctccgcttagg

SEQ ID NO: 491725 - DNA, 25 bp, Rattus norvegicus
aggctcgcacgggaccttcagatct

SEQ ID NO: 491726 - DNA, 25 bp, Rattus norvegicus
gggtcattttcgtggaggctcgcac

SEQ ID NO: 491727 - DNA, 25 bp, Rattus norvegicus
gctggcttagggtcattttcgtgga

SEQ ID NO: 491728 - DNA, 25 bp, Rattus norvegicus
aagctgcctgctcgcgcgagagttt

SEQ ID NO: 491729 - DNA, 25 bp, Rattus norvegicus
ttcaaggggtcctcgctgcctcgga

SEQ ID NO: 491730 - DNA, 25 bp, Rattus norvegicus
cgcaagtctgggtcctcaagccttt

SEQ ID NO: 491731 - DNA, 25 bp, Rattus norvegicus
ccaaagtgagagtccggctgctttc

SEQ ID NO: 491732 - DNA, 25 bp, Rattus norvegicus
cctaaagctgcctgctcgcgcgaga

SEQ ID NO: 491733 - DNA, 25 bp, Rattus norvegicus
ctcctccggagcatggcatcagttt

SEQ ID NO: 491734 - DNA, 25 bp, Rattus norvegicus
ctcatgcgcggaagcaatggcaaca

SEQ ID NO: 491735 - DNA, 25 bp, Rattus norvegicus
tttgatgatgctccaagacaccgcg

SEQ ID NO: 491736 - DNA, 25 bp, Rattus norvegicus
tgcgccacgatcctcattttgatga

SEQ ID NO: 491737 - DNA, 25 bp, Rattus norvegicus
ggacgctcttttccatgaattcctg

SEQ ID NO: 491738 - DNA, 25 bp, Rattus norvegicus
gcatcgatgagaagacggacgctct

SEQ ID NO: 491739 - DNA, 25 bp, Rattus norvegicus
ggccgcgccgcgattatagcatcga

SEQ ID NO: 491740 - DNA, 25 bp, Rattus norvegicus
tggagctggcgatgaagtttctgaa

SEQ ID NO: 491741 - DNA, 25 bp, Rattus norvegicus
gcccgacgcctgttacagatggaca

SEQ ID NO: 491742 - DNA, 25 bp, Rattus norvegicus
tagcggcaatgaccgtgactcagtg

SEQ ID NO: 491743 - DNA, 25 bp, Rattus norvegicus
ctaccgtgatctgtggagccttcgt

SEQ ID NO: 491744 - DNA, 25 bp, Rattus norvegicus
tgcacagtgcagctaccgtgatctg

SEQ ID NO: 491745 - DNA, 25 bp, Rattus norvegicus
gttgattgtcctcctgaaggccgtg

SEQ ID NO: 491746 - DNA, 25 bp, Rattus norvegicus
acccgcagcaagagcaggacgccga

SEQ ID NO: 491747 - DNA, 25 bp, Rattus norvegicus
cacactacccggcaggctgtgcgtg

SEQ ID NO: 491748 - DNA, 25 bp, Rattus norvegicus
tggcgcctgctcagccactgatgct

SEQ ID NO: 491749 - DNA, 25 bp, Rattus norvegicus
ttgccaagggaacgccgcgcgctgt

SEQ ID NO: 491750 - DNA, 25 bp, Rattus norvegicus
agaagctcccgttgccaagggaacg

SEQ ID NO: 491751 - DNA, 25 bp, Rattus norvegicus
taggaccggaagaagctcccgttgc

SEQ ID NO: 491752 - DNA, 25 bp, Rattus norvegicus
cctgaataggcgtggctttaggacc

SEQ ID NO: 491753 - DNA, 25 bp, Rattus norvegicus
ggcggacacctaaaatgcctgaata

SEQ ID NO: 491754 - DNA, 25 bp, Rattus norvegicus
aggagaacacgtcggcggacaccta

SEQ ID NO: 491755 - DNA, 25 bp, Rattus norvegicus
tttttaacccagagctcttcagccg

SEQ ID NO: 491756 - DNA, 25 bp, Rattus norvegicus
ctctgatagttattctgcgggaatc

SEQ ID NO: 491757 - DNA, 25 bp, Rattus norvegicus
ctgtgctcacactctctgatagtta

SEQ ID NO: 491758 - DNA, 25 bp, Rattus norvegicus
atgtcttctgtgctcacactctctg

SEQ ID NO: 491759 - DNA, 25 bp, Rattus norvegicus
caggctgtgcgtgggcctacagctc

SEQ ID NO: 491760 - DNA, 25 bp, Rattus norvegicus
atgcgcgcgcagctaaggccgccta

SEQ ID NO: 491761 - DNA, 25 bp, Rattus norvegicus
cacgaagtcgggacaggaaatcttc

SEQ ID NO: 491762 - DNA, 25 bp, Rattus norvegicus
acccgcttcttccaaatgttcaaga

SEQ ID NO: 491763 - DNA, 25 bp, Rattus norvegicus
tttcctgggcgccaattcttcactt

SEQ ID NO: 491764 - DNA, 25 bp, Rattus norvegicus
cttttcttctaggtgctcagggaga

SEQ ID NO: 491765 - DNA, 25 bp, Rattus norvegicus
ggccgctaggtcatggtcgccactt

SEQ ID NO: 491766 - DNA, 25 bp, Rattus norvegicus
acgacttctcggtgcgcaaactcca

SEQ ID NO: 491767 - DNA, 25 bp, Rattus norvegicus
cttcaggcagaaagatgctgtccgc

SEQ ID NO: 491768 - DNA, 25 bp, Rattus norvegicus
tcgcacgtctcaacggtggacacgc

SEQ ID NO: 491769 - DNA, 25 bp, Rattus norvegicus
cgcggcagttggctgtagctttaaa

SEQ ID NO: 491770 - DNA, 25 bp, Rattus norvegicus
tcaccaacgcggattggactatttg

SEQ ID NO: 491771 - DNA, 25 bp, Rattus norvegicus
actatttggatctgggtgggcaccc

SEQ ID NO: 491772 - DNA, 25 bp, Rattus norvegicus
ctgacattggacagctcgggttcca

SEQ ID NO: 491773 - DNA, 25 bp, Rattus norvegicus
cgggagcgccaattcttttcaagtt

SEQ ID NO: 491774 - DNA, 25 bp, Rattus norvegicus
tgctgtccgcgagagaaaactccac

SEQ ID NO: 491775 - DNA, 25 bp, Rattus norvegicus
gagagtgcggcaccgcgacctctga

SEQ ID NO: 491776 - DNA, 25 bp, Rattus norvegicus
aggcgccggcccgagacaccattgt

SEQ ID NO: 491777 - DNA, 25 bp, Rattus norvegicus
cgcgcccccttgcagaagcggaagt

SEQ ID NO: 491778 - DNA, 25 bp, Rattus norvegicus
cgccaagatggcgtccagaacccgg

SEQ ID NO: 491779 - DNA, 25 bp, Rattus norvegicus
caagatggcgtccagaacccggaag

SEQ ID NO: 491780 - DNA, 25 bp, Rattus norvegicus
gaaactgaggcgtcgcgggctcagc

SEQ ID NO: 491781 - DNA, 25 bp, Rattus norvegicus
cgaccaggtctgaggtgaggcgccg

SEQ ID NO: 491782 - DNA, 25 bp, Rattus norvegicus
ggcccgagacaccattgtgaccctt

SEQ ID NO: 491783 - DNA, 25 bp, Rattus norvegicus
gagacaccattgtgacccttccgcg

SEQ ID NO: 491784 - DNA, 25 bp, Rattus norvegicus
gacaccattgtgacccttccgcgat

SEQ ID NO: 491785 - DNA, 25 bp, Rattus norvegicus
ccacgcgactcatgcggtcaggccc

SEQ ID NO: 491786 - DNA, 25 bp, Rattus norvegicus
ttccgtagttctcgcggccgttctg

SEQ ID NO: 491787 - DNA, 25 bp, Rattus norvegicus
ttctcgcggccgttctggggttgca

SEQ ID NO: 491788 - DNA, 25 bp, Rattus norvegicus
aggagagtgcggcaccgcgacctct

SEQ ID NO: 491789 - DNA, 25 bp, Rattus norvegicus
agctacctacagatcgtgcgcctca

SEQ ID NO: 491790 - DNA, 25 bp, Rattus norvegicus
cgtgcgcctcaagaccaaggacaaa

SEQ ID NO: 491791 - DNA, 25 bp, Rattus norvegicus
gctggaggacatgctccgctctttg

SEQ ID NO: 491792 - DNA, 25 bp, Rattus norvegicus
caccagggctgcgacatcaatttca

SEQ ID NO: 491793 - DNA, 25 bp, Rattus norvegicus
gaggtgctggacttgacctacagtc

SEQ ID NO: 491794 - DNA, 25 bp, Rattus norvegicus
gcgattacacttccatgcggtcctg

SEQ ID NO: 491795 - DNA, 25 bp, Rattus norvegicus
catggatgcagaagtgaagcgccgc

SEQ ID NO: 491796 - DNA, 25 bp, Rattus norvegicus
accactacatgctgtgcggggcgct

SEQ ID NO: 491797 - DNA, 25 bp, Rattus norvegicus
tgcgttcaccgcgtactgcaggaac

SEQ ID NO: 491798 - DNA, 25 bp, Rattus norvegicus
gcggacgtcagcagtagcagctacc

SEQ ID NO: 491799 - DNA, 25 bp, Rattus norvegicus
tgcagattatgagctgaccagcggt

SEQ ID NO: 491800 - DNA, 25 bp, Rattus norvegicus
ctgcagccacactacctggtgaggc

SEQ ID NO: 491801 - DNA, 25 bp, Rattus norvegicus
aaccctgggagagcagctatgcgct

SEQ ID NO: 491802 - DNA, 25 bp, Rattus norvegicus
tgcaggaactgcagctcatggatgc

SEQ ID NO: 491803 - DNA, 25 bp, Rattus norvegicus
aaaggctcgggaatgggctccatcc

SEQ ID NO: 491804 - DNA, 25 bp, Rattus norvegicus
ctgcagacagttatccgcgaggttg

SEQ ID NO: 491805 - DNA, 25 bp, Rattus norvegicus
gggcgcttcctaggactttggcgtc

SEQ ID NO: 491806 - DNA, 25 bp, Rattus norvegicus
tttggcgtccaggttcacgccgtcg

SEQ ID NO: 491807 - DNA, 25 bp, Rattus norvegicus
cagccaatgggaagcctgaatgaag

SEQ ID NO: 491808 - DNA, 25 bp, Rattus norvegicus
tgttgttgtcagcaactgcgcatgc

SEQ ID NO: 491809 - DNA, 25 bp, Rattus norvegicus
acgtctcttattggccgggtgcgcc

SEQ ID NO: 491810 - DNA, 25 bp, Rattus norvegicus
cacgcccactgacgtctcttattgg

SEQ ID NO: 491811 - DNA, 25 bp, Rattus norvegicus
tggcttcaataagcggctcagacgg

SEQ ID NO: 491812 - DNA, 25 bp, Rattus norvegicus
ccgcacagcagtgctggcttcaata

SEQ ID NO: 491813 - DNA, 25 bp, Rattus norvegicus
taggtcccagtaacccaccatggtg

SEQ ID NO: 491814 - DNA, 25 bp, Rattus norvegicus
gagccgccgactgtgacgcaccaag

SEQ ID NO: 491815 - DNA, 25 bp, Rattus norvegicus
gagatgcctatcagactccgctttc

SEQ ID NO: 491816 - DNA, 25 bp, Rattus norvegicus
tgcgcatgctcagtgatgggaaaga

SEQ ID NO: 491817 - DNA, 25 bp, Rattus norvegicus
aaatgctgggattgcccaccgctca

SEQ ID NO: 491818 - DNA, 25 bp, Rattus norvegicus
cgcaggctcagtcctggtaggtcta

SEQ ID NO: 491819 - DNA, 25 bp, Rattus norvegicus
tgcactttatgctgtcccgcgcagg

SEQ ID NO: 491820 - DNA, 25 bp, Rattus norvegicus
cggcgatcacctaaaccaaacctgg

SEQ ID NO: 491821 - DNA, 25 bp, Rattus norvegicus
gaaagttggtgtattccggcgatca

SEQ ID NO: 491822 - DNA, 25 bp, Rattus norvegicus
cgcaagactatcatgcaggcgagtt

SEQ ID NO: 491823 - DNA, 25 bp, Rattus norvegicus
cggctgtggaagatccgcaagacta

SEQ ID NO: 491824 - DNA, 25 bp, Rattus norvegicus
accgctcaacctatcctggaaagtt

SEQ ID NO: 491825 - DNA, 25 bp, Rattus norvegicus
atcttcccgtgtgcgatctcgcgca

SEQ ID NO: 491826 - DNA, 25 bp, Rattus norvegicus
tacgagcgcgcgtgcagagttgttt

SEQ ID NO: 491827 - DNA, 25 bp, Rattus norvegicus
cagagttgtttgtgaagtgcgacaa

SEQ ID NO: 491828 - DNA, 25 bp, Rattus norvegicus
agtcctggtaggtctacgagcgcgc

SEQ ID NO: 491829 - DNA, 25 bp, Rattus norvegicus
acgacgaggaggaaacgtatcggct

SEQ ID NO: 491830 - DNA, 25 bp, Rattus norvegicus
agtgcgacaacatggacgacgagga

SEQ ID NO: 491831 - DNA, 25 bp, Rattus norvegicus
aggcccaggcgcaccaggccagaga

SEQ ID NO: 491832 - DNA, 25 bp, Rattus norvegicus
ggcgcgcaaacagttctagatgttc

SEQ ID NO: 491833 - DNA, 25 bp, Rattus norvegicus
agttctagatgttcccggccggtca

SEQ ID NO: 491834 - DNA, 25 bp, Rattus norvegicus
ttagcacctggacagggcgcgttta

SEQ ID NO: 491835 - DNA, 25 bp, Rattus norvegicus
cgcgcaggcgcgcaaacagttctag

SEQ ID NO: 491836 - DNA, 25 bp, Rattus norvegicus
cggtctgcgtagctaggaaggccca

SEQ ID NO: 491837 - DNA, 25 bp, Rattus norvegicus
ccggtcagcaggtcgaagatggcat

SEQ ID NO: 491838 - DNA, 25 bp, Rattus norvegicus
acccgcgggtcggtctgcgtagcta

SEQ ID NO: 491839 - DNA, 25 bp, Rattus norvegicus
ttgcctccgctgtaggtacccgcgg

SEQ ID NO: 491840 - DNA, 25 bp, Rattus norvegicus
agcttccgtttgttgcctccgctgt

SEQ ID NO: 491841 - DNA, 25 bp, Rattus norvegicus
acagtagcccatgctgcggtgcgca

SEQ ID NO: 491842 - DNA, 25 bp, Rattus norvegicus
tcagactggggacagtagcccatgc

SEQ ID NO: 491843 - DNA, 25 bp, Rattus norvegicus
cgaagatggcatcagactggggaca

SEQ ID NO: 491844 - DNA, 25 bp, Rattus norvegicus
cagggcgcgtttacctgggcaactt

SEQ ID NO: 491845 - DNA, 25 bp, Rattus norvegicus
ccgtcttcgtagctgattggctgga

SEQ ID NO: 491846 - DNA, 25 bp, Rattus norvegicus
cagcccacgtctcctgtgcggaccg

SEQ ID NO: 491847 - DNA, 25 bp, Rattus norvegicus
cggtgagacccgcagcccacgtctc

SEQ ID NO: 491848 - DNA, 25 bp, Rattus norvegicus
ttcggctccgttcgccttaggtgac

SEQ ID NO: 491849 - DNA, 25 bp, Rattus norvegicus
cgcgcagccgtcttcgtagctgatt

SEQ ID NO: 491850 - DNA, 25 bp, Rattus norvegicus
cctgttcgcattcttagggggcgga

SEQ ID NO: 491851 - DNA, 25 bp, Rattus norvegicus
ctgattggctggaagggctatagct

SEQ ID NO: 491852 - DNA, 25 bp, Rattus norvegicus
gggctcccgggttcactgtcagcct

SEQ ID NO: 491853 - DNA, 25 bp, Rattus norvegicus
ggaagaccctgttcgcattcttagg

SEQ ID NO: 491854 - DNA, 25 bp, Rattus norvegicus
tcgccttaggtgacccccggtgaga

SEQ ID NO: 491855 - DNA, 25 bp, Rattus norvegicus
gtctggaagaccctgttcgcattct

SEQ ID NO: 491856 - DNA, 25 bp, Rattus norvegicus
agctaaaggctagggtctggaagac

SEQ ID NO: 491857 - DNA, 25 bp, Rattus norvegicus
ggctatagctaaaggctagggtctg

SEQ ID NO: 491858 - DNA, 25 bp, Rattus norvegicus
ggttcactgtcagcctcatcccgga

SEQ ID NO: 491859 - DNA, 25 bp, Rattus norvegicus
tgctactcgggcgactttgccattg

SEQ ID NO: 491860 - DNA, 25 bp, Rattus norvegicus
gaccatcgcccggttctccttgccg

SEQ ID NO: 491861 - DNA, 25 bp, Rattus norvegicus
ccctaacgctactattggatagtgc

SEQ ID NO: 491862 - DNA, 25 bp, Rattus norvegicus
tctccttgccggtttcttaaagaga

SEQ ID NO: 491863 - DNA, 25 bp, Rattus norvegicus
gatagtgcacctgctactcgggcga

SEQ ID NO: 491864 - DNA, 25 bp, Rattus norvegicus
ctattggatagtgcacctgctactc

SEQ ID NO: 491865 - DNA, 25 bp, Rattus norvegicus
cgctactattggatagtgcacctgc

SEQ ID NO: 491866 - DNA, 25 bp, Rattus norvegicus
ggctcaaccgcggacgacgcccttc

SEQ ID NO: 491867 - DNA, 25 bp, Rattus norvegicus
actcgggcgactttgccattgagga

SEQ ID NO: 491868 - DNA, 25 bp, Rattus norvegicus
actttgccattgaggaggcgggacc

SEQ ID NO: 491869 - DNA, 25 bp, Rattus norvegicus
ttgccattgaggaggcgggaccatc

SEQ ID NO: 491870 - DNA, 25 bp, Rattus norvegicus
gaggcgggaccatcgcccggttctc

SEQ ID NO: 491871 - DNA, 25 bp, Rattus norvegicus
agtgcacctgctactcgggcgactt

SEQ ID NO: 491872 - DNA, 25 bp, Rattus norvegicus
ggacgacgcccttcgcaacctggaa

SEQ ID NO: 491873 - DNA, 25 bp, Rattus norvegicus
ccgcgcccactcacccggttcttga

SEQ ID NO: 491874 - DNA, 25 bp, Rattus norvegicus
ttgaactgcgtggagctcatggcgc

SEQ ID NO: 491875 - DNA, 25 bp, Rattus norvegicus
cccttgttgaactgcgtggagctca

SEQ ID NO: 491876 - DNA, 25 bp, Rattus norvegicus
taggacggacccttgttgaactgcg

SEQ ID NO: 491877 - DNA, 25 bp, Rattus norvegicus
accctggcgcgggacaggcagacca

SEQ ID NO: 491878 - DNA, 25 bp, Rattus norvegicus
cccggttcttgacctcggccgagag

SEQ ID NO: 491879 - DNA, 25 bp, Rattus norvegicus
tgcctttggagttacgggaaactga

SEQ ID NO: 491880 - DNA, 25 bp, Rattus norvegicus
tgcatcggtctgtgcgttcgaggct

SEQ ID NO: 491881 - DNA, 25 bp, Rattus norvegicus
cgagagcccgtaggacggacccttg

SEQ ID NO: 491882 - DNA, 25 bp, Rattus norvegicus
gctggcggggcaaatgcccttataa

SEQ ID NO: 491883 - DNA, 25 bp, Rattus norvegicus
aaatgcccttataaggcgtggaagc

SEQ ID NO: 491884 - DNA, 25 bp, Rattus norvegicus
cgccgaattcctgtggccgcgactt

SEQ ID NO: 491885 - DNA, 25 bp, Rattus norvegicus
ctcctgcatcggtctgtgcgttcga

SEQ ID NO: 491886 - DNA, 25 bp, Rattus norvegicus
ataaggcgtggaagcgccgaattcc

SEQ ID NO: 491887 - DNA, 25 bp, Rattus norvegicus
tcggcaccgggacgtatgtacgtac

SEQ ID NO: 491888 - DNA, 25 bp, Rattus norvegicus
gtgacaccgcgaccaggatacaatt

SEQ ID NO: 491889 - DNA, 25 bp, Rattus norvegicus
gccatcccggcttgaaaacgtcaca

SEQ ID NO: 491890 - DNA, 25 bp, Rattus norvegicus
ctgaactaggtaactggagccatcc

SEQ ID NO: 491891 - DNA, 25 bp, Rattus norvegicus
tccaatgtcctggtgtgaccacagc

SEQ ID NO: 491892 - DNA, 25 bp, Rattus norvegicus
tcaggaatctgcgatggacacaccc

SEQ ID NO: 491893 - DNA, 25 bp, Rattus norvegicus
cgcgacagaatagcgacggtcctga

SEQ ID NO: 491894 - DNA, 25 bp, Rattus norvegicus
ttccggagtcccattgaggaccttg

SEQ ID NO: 491895 - DNA, 25 bp, Rattus norvegicus
cttcaatgacggaggcgttggcttc

SEQ ID NO: 491896 - DNA, 25 bp, Rattus norvegicus
cttctgtcgaggagtgatagcgtca

SEQ ID NO: 491897 - DNA, 25 bp, Rattus norvegicus
cggctgaaacagagcccgggacttc

SEQ ID NO: 491898 - DNA, 25 bp, Rattus norvegicus
gcgcaggaagtgctcatcaaccttc

SEQ ID NO: 491899 - DNA, 25 bp, Rattus norvegicus
cactcgcagcgtgctttgtgtgcca

SEQ ID NO: 491900 - DNA, 25 bp, Rattus norvegicus
caaaggacgcttagcctggcacttc

SEQ ID NO: 491901 - DNA, 25 bp, Rattus norvegicus
gctgactcccgctgtgctcagcgag

SEQ ID NO: 491902 - DNA, 25 bp, Rattus norvegicus
gcgggaagccggagcctagcatccc

SEQ ID NO: 491903 - DNA, 25 bp, Rattus norvegicus
tccgggacctgcgagctacggccga

SEQ ID NO: 491904 - DNA, 25 bp, Rattus norvegicus
ccgccatcggggctcccggctctgt

SEQ ID NO: 491905 - DNA, 25 bp, Rattus norvegicus
cagcggccgagggaacctcgcgccc

SEQ ID NO: 491906 - DNA, 25 bp, Rattus norvegicus
ggagcgaaccggagtgcagccaggt

SEQ ID NO: 491907 - DNA, 25 bp, Rattus norvegicus
ccctccactcgtgggaggctgtgca

SEQ ID NO: 491908 - DNA, 25 bp, Rattus norvegicus
tctggggaagttcttgctcccggcc

SEQ ID NO: 491909 - DNA, 25 bp, Rattus norvegicus
ttagatctggggaagttcttgctcc

SEQ ID NO: 491910 - DNA, 25 bp, Rattus norvegicus
cccgccctgggtggcttagatctgg

SEQ ID NO: 491911 - DNA, 25 bp, Rattus norvegicus
gcgctccttcctccttcgctcgggt

SEQ ID NO: 491912 - DNA, 25 bp, Rattus norvegicus
cctggcacagcttctctcggttctt

SEQ ID NO: 491913 - DNA, 25 bp, Rattus norvegicus
ccgctgtgctcagcgagccagggct

SEQ ID NO: 491914 - DNA, 25 bp, Rattus norvegicus
ctccactcgtgggaggctgtgcagc

SEQ ID NO: 491915 - DNA, 25 bp, Rattus norvegicus
tcctaggccatgtgccgcgtgtcct

SEQ ID NO: 491916 - DNA, 25 bp, Rattus norvegicus
ttcccggagctcctaggccatgtgc

SEQ ID NO: 491917 - DNA, 25 bp, Rattus norvegicus
ccttccggctgaggtgaacgttgcc

SEQ ID NO: 491918 - DNA, 25 bp, Rattus norvegicus
tcttgggagccaaggtgagcttaaa

SEQ ID NO: 491919 - DNA, 25 bp, Rattus norvegicus
ccgcgtgtccttccggctgaggtga

SEQ ID NO: 491920 - DNA, 25 bp, Rattus norvegicus
tactcactgcggcagcccggctctt

SEQ ID NO: 491921 - DNA, 25 bp, Rattus norvegicus
ggagttcgccctccatggctctact

SEQ ID NO: 491922 - DNA, 25 bp, Rattus norvegicus
aggtcccggagttcgccctccatgg

SEQ ID NO: 491923 - DNA, 25 bp, Rattus norvegicus
ttggcgcggtctccatcacagcggc

SEQ ID NO: 491924 - DNA, 25 bp, Rattus norvegicus
ctctccgatcccttcccgccaggtc

SEQ ID NO: 491925 - DNA, 25 bp, Rattus norvegicus
cgggctcaagtattggccagagggc

SEQ ID NO: 491926 - DNA, 25 bp, Rattus norvegicus
cgcctctgccggtttgtctaccctt

SEQ ID NO: 491927 - DNA, 25 bp, Rattus norvegicus
ctcggccgcctcctttcaaccttgt

SEQ ID NO: 491928 - DNA, 25 bp, Rattus norvegicus
tcaaccttgtcggtccgttggcgcg

SEQ ID NO: 491929 - DNA, 25 bp, Rattus norvegicus
tgcccgcagtggacctgctgcagat

SEQ ID NO: 491930 - DNA, 25 bp, Rattus norvegicus
gacctgctgcagatgctggagatga

SEQ ID NO: 491931 - DNA, 25 bp, Rattus norvegicus
tcctggctctcgtcggtgaggaccc

SEQ ID NO: 491932 - DNA, 25 bp, Rattus norvegicus
ccaggccctcatgggcggccgccct

SEQ ID NO: 491933 - DNA, 25 bp, Rattus norvegicus
ttgctgaccgtcatcctggctctcg

SEQ ID NO: 491934 - DNA, 25 bp, Rattus norvegicus
agatgaacatggccatcgccttccc

SEQ ID NO: 491935 - DNA, 25 bp, Rattus norvegicus
tcgtcttcatcggtgagtcccagcc

SEQ ID NO: 491936 - DNA, 25 bp, Rattus norvegicus
atcttcgtcttcatcggtgagtccc

SEQ ID NO: 491937 - DNA, 25 bp, Rattus norvegicus
accagatcttcgtcttcatcggtga

SEQ ID NO: 491938 - DNA, 25 bp, Rattus norvegicus
gatactcgcaccaccagatcttcgt

SEQ ID NO: 491939 - DNA, 25 bp, Rattus norvegicus
cccgcagcgcccttgctgaccgtca

SEQ ID NO: 491940 - DNA, 25 bp, Rattus norvegicus
gctgcagatgctggagatgaacatg

SEQ ID NO: 491941 - DNA, 25 bp, Rattus norvegicus
tgaccgtcatcctggctctcgtcgg

SEQ ID NO: 491942 - DNA, 25 bp, Rattus norvegicus
tcatcctggctctcgtcggtgagga

SEQ ID NO: 491943 - DNA, 25 bp, Rattus norvegicus
ccttgtggttcctcagctctcagca

SEQ ID NO: 491944 - DNA, 25 bp, Rattus norvegicus
ggcctcagtatctggcagtgaccta

SEQ ID NO: 491945 - DNA, 25 bp, Rattus norvegicus
atctcggacgcgtccttcctgtcgg

SEQ ID NO: 491946 - DNA, 25 bp, Rattus norvegicus
ctgagcgcctcactgctggagcggc

SEQ ID NO: 491947 - DNA, 25 bp, Rattus norvegicus
ggacagcgcacgacctgaccctggg

SEQ ID NO: 491948 - DNA, 25 bp, Rattus norvegicus
ccgagcccaagagagctgtggtcta

SEQ ID NO: 491949 - DNA, 25 bp, Rattus norvegicus
gcccggactagcaggtggcagctca

SEQ ID NO: 491950 - DNA, 25 bp, Rattus norvegicus
cggcgctcacgttccacgctattta

SEQ ID NO: 491951 - DNA, 25 bp, Rattus norvegicus
cagagtcgtgtttgtatatagaata

SEQ ID NO: 491952 - DNA, 25 bp, Rattus norvegicus
ccgcatgcaacaggcgcagtggcct

SEQ ID NO: 491953 - DNA, 25 bp, Rattus norvegicus
gtgcagcctcaatgcgcagctccag

SEQ ID NO: 491954 - DNA, 25 bp, Rattus norvegicus
ttccagcaggaaacgcacgcgtcgc

SEQ ID NO: 491955 - DNA, 25 bp, Rattus norvegicus
ctgcaccatcggtggcaggcagctc

SEQ ID NO: 491956 - DNA, 25 bp, Rattus norvegicus
acgctatttaattgcagtgtacaga

SEQ ID NO: 491957 - DNA, 25 bp, Rattus norvegicus
gcacactctccatcccgaaagaagt

SEQ ID NO: 491958 - DNA, 25 bp, Rattus norvegicus
cttgtccctcctgcgggtccgggat

SEQ ID NO: 491959 - DNA, 25 bp, Rattus norvegicus
cccgaaagaagttaccactgtgctg

SEQ ID NO: 491960 - DNA, 25 bp, Rattus norvegicus
tgagccacagcgtccgcacactctc

SEQ ID NO: 491961 - DNA, 25 bp, Rattus norvegicus
agggtgaccgcgcaccactcgggac

SEQ ID NO: 491962 - DNA, 25 bp, Rattus norvegicus
tccagactcaggttgtgcggcagcc

SEQ ID NO: 491963 - DNA, 25 bp, Rattus norvegicus
ccaccagttccagactcaggttgtg

SEQ ID NO: 491964 - DNA, 25 bp, Rattus norvegicus
aggtcaccacgccaggcggtgccag

SEQ ID NO: 491965 - DNA, 25 bp, Rattus norvegicus
cgggaaaggctatagaggtcaccac

SEQ ID NO: 491966 - DNA, 25 bp, Rattus norvegicus
gccgcgcctcgggaaaggctataga

SEQ ID NO: 491967 - DNA, 25 bp, Rattus norvegicus
ccaggaactgcagtagccgcagctc

SEQ ID NO: 491968 - DNA, 25 bp, Rattus norvegicus
cgcaggacgctcaccactggggtct

SEQ ID NO: 491969 - DNA, 25 bp, Rattus norvegicus
gtgcgcacctccctccgcaggacgc

SEQ ID NO: 491970 - DNA, 25 bp, Rattus norvegicus
taccactgtgctgtgcgaagggaag

SEQ ID NO: 491971 - DNA, 25 bp, Rattus norvegicus
taggtggctcacatacgcatgcgta

SEQ ID NO: 491972 - DNA, 25 bp, Rattus norvegicus
tgcgtacaaagttcgctgctcttgg

SEQ ID NO: 491973 - DNA, 25 bp, Rattus norvegicus
tccaggaggcctagagagacattta

SEQ ID NO: 491974 - DNA, 25 bp, Rattus norvegicus
taattgtctggtgcttacgggctcc

SEQ ID NO: 491975 - DNA, 25 bp, Rattus norvegicus
atgcgcagtagtttcaccaagccga

SEQ ID NO: 491976 - DNA, 25 bp, Rattus norvegicus
ggctcctggccgactagccttagta

SEQ ID NO: 491977 - DNA, 25 bp, Rattus norvegicus
gcggagtctgtacacaccaccactt

SEQ ID NO: 491978 - DNA, 25 bp, Rattus norvegicus
tcgccattgagtagcgccaggcctc

SEQ ID NO: 491979 - DNA, 25 bp, Rattus norvegicus
ccgccagcaggtactcgccattgag

SEQ ID NO: 491980 - DNA, 25 bp, Rattus norvegicus
gctcccaagcgcagatgtagttctt

SEQ ID NO: 491981 - DNA, 25 bp, Rattus norvegicus
ggaactctaatcttggcgcgccgga

SEQ ID NO: 491982 - DNA, 25 bp, Rattus norvegicus
ggcctccgagtacttccgaatcaca

SEQ ID NO: 491983 - DNA, 25 bp, Rattus norvegicus
ttggcgcccgaatgaagctcccaca

SEQ ID NO: 491984 - DNA, 25 bp, Rattus norvegicus
cggagccgcacgacaagtgtacatg

SEQ ID NO: 491985 - DNA, 25 bp, Rattus norvegicus
tccctccgcggtagcgtgtgttatt

SEQ ID NO: 491986 - DNA, 25 bp, Rattus norvegicus
tcttccggctgactcagcgcagttc

SEQ ID NO: 491987 - DNA, 25 bp, Rattus norvegicus
aggttcttccggctgactcagcgca

SEQ ID NO: 491988 - DNA, 25 bp, Rattus norvegicus
agataaggttcttccggctgactca

SEQ ID NO: 491989 - DNA, 25 bp, Rattus norvegicus
gaccagataaggttcttccggctga

SEQ ID NO: 491990 - DNA, 25 bp, Rattus norvegicus
gcgtagggaccagataaggttcttc

SEQ ID NO: 491991 - DNA, 25 bp, Rattus norvegicus
cggcgtagggaccagataaggttct

SEQ ID NO: 491992 - DNA, 25 bp, Rattus norvegicus
acttgacaacaggtcacagggtggg

SEQ ID NO: 491993 - DNA, 25 bp, Rattus norvegicus
gtagcgtgtgttattagaaagcgtg

SEQ ID NO: 491994 - DNA, 25 bp, Rattus norvegicus
gcagcttttgggacaccgctccctc

SEQ ID NO: 491995 - DNA, 25 bp, Rattus norvegicus
tgactcagcgcagttcccgggggtt

SEQ ID NO: 491996 - DNA, 25 bp, Rattus norvegicus
ttattagaaagcgtggggcgggaca

SEQ ID NO: 491997 - DNA, 25 bp, Rattus norvegicus
gacaaaacttgacaacaggtcacag

SEQ ID NO: 491998 - DNA, 25 bp, Rattus norvegicus
ccgcggtagcgtgtgttattagaaa

SEQ ID NO: 491999 - DNA, 25 bp, Rattus norvegicus
ctcagatgcaaatacctcgccggtg

SEQ ID NO: 492000 - DNA, 25 bp, Rattus norvegicus
ctgcaaaaggccttaccgctcgggg

SEQ ID NO: 492001 - DNA, 25 bp, Rattus norvegicus
cgccgtgtgacaaattgctctcaga

SEQ ID NO: 492002 - DNA, 25 bp, Rattus norvegicus
acccagcagacgaatcgccgtgtga

SEQ ID NO: 492003 - DNA, 25 bp, Rattus norvegicus
cgcgtctacatctccatccgtgtgg

SEQ ID NO: 492004 - DNA, 25 bp, Rattus norvegicus
accgagtctctaggccgcgtctaca

SEQ ID NO: 492005 - DNA, 25 bp, Rattus norvegicus
cacctttaggggatatcgctggagc

SEQ ID NO: 492006 - DNA, 25 bp, Rattus norvegicus
acgcgcgcgtctttacctaactttg

SEQ ID NO: 492007 - DNA, 25 bp, Rattus norvegicus
tctgattccgtcgagtcgcctactc

SEQ ID NO: 492008 - DNA, 25 bp, Rattus norvegicus
aggtctccaagatctacaaccgcga

SEQ ID NO: 492009 - DNA, 25 bp, Rattus norvegicus
ctggagccgagctgcaaaaggcctt

SEQ ID NO: 492010 - DNA, 25 bp, Rattus norvegicus
actcgcgtaccggatgaaggtctcc

SEQ ID NO: 492011 - DNA, 25 bp, Rattus norvegicus
gggtgccctacgctgacacctttag

SEQ ID NO: 492012 - DNA, 25 bp, Rattus norvegicus
ccgcaattgtcagtttccagggtgc

SEQ ID NO: 492013 - DNA, 25 bp, Rattus norvegicus
cagggcttgaagcaccaggaacagc

SEQ ID NO: 492014 - DNA, 25 bp, Rattus norvegicus
ccgaagctgagaacgtgcccttgtc

SEQ ID NO: 492015 - DNA, 25 bp, Rattus norvegicus
ccgcagacatcctccgaagctgaga

SEQ ID NO: 492016 - DNA, 25 bp, Rattus norvegicus
agtggggaacgcatcccatccagga

SEQ ID NO: 492017 - DNA, 25 bp, Rattus norvegicus
cacccaggctgagttcctccgggag

SEQ ID NO: 492018 - DNA, 25 bp, Rattus norvegicus
ctgggaaacgcctcactgcagtagg

SEQ ID NO: 492019 - DNA, 25 bp, Rattus norvegicus
ccagcaggttgtagagcgcgaaagc

SEQ ID NO: 492020 - DNA, 25 bp, Rattus norvegicus
gcgcgcgtggatacaattcaggctc

SEQ ID NO: 492021 - DNA, 25 bp, Rattus norvegicus
ggagaccttggtgcgcactgctcca

SEQ ID NO: 492022 - DNA, 25 bp, Rattus norvegicus
ggacatgcagtgagcccagatcttg

SEQ ID NO: 492023 - DNA, 25 bp, Rattus norvegicus
gcgcagaattgctgtaggacatgca

SEQ ID NO: 492024 - DNA, 25 bp, Rattus norvegicus
cacacgcggcagaaggcctgtctga

SEQ ID NO: 492025 - DNA, 25 bp, Rattus norvegicus
tgggtacctccacacatgcacaata

SEQ ID NO: 492026 - DNA, 25 bp, Rattus norvegicus
tgaacacacagtctcggctccgata

SEQ ID NO: 492027 - DNA, 25 bp, Rattus norvegicus
tagtagcggcttcagatcctcgagc

SEQ ID NO: 492028 - DNA, 25 bp, Rattus norvegicus
ctgcatgtgcttgtggcggcagata

SEQ ID NO: 492029 - DNA, 25 bp, Rattus norvegicus
cctgggccatccgaggcattgacac

SEQ ID NO: 492030 - DNA, 25 bp, Rattus norvegicus
atcccgaagcgttggacggagccca

SEQ ID NO: 492031 - DNA, 25 bp, Rattus norvegicus
ccaggcagccttcacagattgcgtc

SEQ ID NO: 492032 - DNA, 25 bp, Rattus norvegicus
gaaagtggcttctcgctagcgtcgc

SEQ ID NO: 492033 - DNA, 25 bp, Rattus norvegicus
cgcgcactcaccgatgtagaaattg

SEQ ID NO: 492034 - DNA, 25 bp, Rattus norvegicus
gccttcgcgtctccctgcgtagtag

SEQ ID NO: 492035 - DNA, 25 bp, Rattus norvegicus
tttccagagctatgcccggatgacc

SEQ ID NO: 492036 - DNA, 25 bp, Rattus norvegicus
gcagcgaaaaacaggggcaccagcc

SEQ ID NO: 492037 - DNA, 25 bp, Rattus norvegicus
agcctcgttgcgttcctgactgaga

SEQ ID NO: 492038 - DNA, 25 bp, Rattus norvegicus
cggcagataacgaagatgaccagtg

SEQ ID NO: 492039 - DNA, 25 bp, Rattus norvegicus
atgaccagtgagttcccgactagcc

SEQ ID NO: 492040 - DNA, 25 bp, Rattus norvegicus
cccagcaacattagggcagcgaaaa

SEQ ID NO: 492041 - DNA, 25 bp, Rattus norvegicus
caaacggaggtagagcttccagccc

SEQ ID NO: 492042 - DNA, 25 bp, Rattus norvegicus
tgttccgtcaccctgggactgttcc

SEQ ID NO: 492043 - DNA, 25 bp, Rattus norvegicus
gggactgttcccagggctcgcacac

SEQ ID NO: 492044 - DNA, 25 bp, Rattus norvegicus
atctgcgcccccaaggagccttttg

SEQ ID NO: 492045 - DNA, 25 bp, Rattus norvegicus
gccttttgcatctccgcagtcgccc

SEQ ID NO: 492046 - DNA, 25 bp, Rattus norvegicus
gtgtctacaaaagcaaacggaggta

SEQ ID NO: 492047 - DNA, 25 bp, Rattus norvegicus
cccgctatgctgctgttccaggctg

SEQ ID NO: 492048 - DNA, 25 bp, Rattus norvegicus
caccgcttctatctggtggctcaga

SEQ ID NO: 492049 - DNA, 25 bp, Rattus norvegicus
gctcagattttgtcctcagcccttc

SEQ ID NO: 492050 - DNA, 25 bp, Rattus norvegicus
attttgtcctcagcccttctggtcc

SEQ ID NO: 492051 - DNA, 25 bp, Rattus norvegicus
tggacaacccagaaggcggccctga

SEQ ID NO: 492052 - DNA, 25 bp, Rattus norvegicus
catggtggctctggacaacccagaa

SEQ ID NO: 492053 - DNA, 25 bp, Rattus norvegicus
tgcaactgcggctgcaggccatggt

SEQ ID NO: 492054 - DNA, 25 bp, Rattus norvegicus
ctatgctgctgttccaggctgtccc

SEQ ID NO: 492055 - DNA, 25 bp, Rattus norvegicus
tgtccgaggcatccgcctgttcaaa

SEQ ID NO: 492056 - DNA, 25 bp, Rattus norvegicus
cgaacgggataacggactgccagcc

SEQ ID NO: 492057 - DNA, 25 bp, Rattus norvegicus
ccgcgacctttgttgcaggtcaaga

SEQ ID NO: 492058 - DNA, 25 bp, Rattus norvegicus
gttgagctattttccgcgacctttg

SEQ ID NO: 492059 - DNA, 25 bp, Rattus norvegicus
cggagccgattcagtggagtatcta

SEQ ID NO: 492060 - DNA, 25 bp, Rattus norvegicus
gccgcttggaacttcgcgtctccga

SEQ ID NO: 492061 - DNA, 25 bp, Rattus norvegicus
gccacgagttcagggtgcgattgtt

SEQ ID NO: 492062 - DNA, 25 bp, Rattus norvegicus
caggtcgagacccatcaggcactga

SEQ ID NO: 492063 - DNA, 25 bp, Rattus norvegicus
gtatctgcgttaagacactctgagg

SEQ ID NO: 492064 - DNA, 25 bp, Rattus norvegicus
tgttcaaaaacaaagcgggacgcgc

SEQ ID NO: 492065 - DNA, 25 bp, Rattus norvegicus
gtgagcgtgatcagagcaaaccgta

SEQ ID NO: 492066 - DNA, 25 bp, Rattus norvegicus
cgtaccacagctacttccggtgtct

SEQ ID NO: 492067 - DNA, 25 bp, Rattus norvegicus
aaagtgggtcccttctctcacctgg

SEQ ID NO: 492068 - DNA, 25 bp, Rattus norvegicus
cgcgcggtaagagtaaggccgaatt

SEQ ID NO: 492069 - DNA, 25 bp, Rattus norvegicus
tgcgtgtcgtctgcaagttgactgg

SEQ ID NO: 492070 - DNA, 25 bp, Rattus norvegicus
tgcaagttgactgggctacagcgtg

SEQ ID NO: 492071 - DNA, 25 bp, Rattus norvegicus
cacgtcaagggcgtgctcccgagac

SEQ ID NO: 492072 - DNA, 25 bp, Rattus norvegicus
gtaccgcacggtagtcagaaccacc

SEQ ID NO: 492073 - DNA, 25 bp, Rattus norvegicus
gcacggtagtcagaaccaccacact

SEQ ID NO: 492074 - DNA, 25 bp, Rattus norvegicus
acactcaccaggtacggcctgttgc

SEQ ID NO: 492075 - DNA, 25 bp, Rattus norvegicus
cgcgcgcaacctcgctctggcaagc

SEQ ID NO: 492076 - DNA, 25 bp, Rattus norvegicus
ttctcagccggacccgaggcgcaca

SEQ ID NO: 492077 - DNA, 25 bp, Rattus norvegicus
tccggagctgcacttctcagccgga

SEQ ID NO: 492078 - DNA, 25 bp, Rattus norvegicus
gggtccgcagccctcagccacccag

SEQ ID NO: 492079 - DNA, 25 bp, Rattus norvegicus
acggcctgttgcgtgtcgtctgcaa

SEQ ID NO: 492080 - DNA, 25 bp, Rattus norvegicus
aggcgcacacgctgtaccgcacggt

SEQ ID NO: 492081 - DNA, 25 bp, Rattus norvegicus
aagccggccaagctcgcttgtgcct

SEQ ID NO: 492082 - DNA, 25 bp, Rattus norvegicus
tggcaagccggccaagctcgcttgt

SEQ ID NO: 492083 - DNA, 25 bp, Rattus norvegicus
aggaatagtatttgtcctgcttata

SEQ ID NO: 492084 - DNA, 25 bp, Rattus norvegicus
gcctttctataagatctagccaatc

SEQ ID NO: 492085 - DNA, 25 bp, Rattus norvegicus
ctagccaatcattcgaaagaacaga

SEQ ID NO: 492086 - DNA, 25 bp, Rattus norvegicus
cattcgaaagaacagattatttgtc

SEQ ID NO: 492087 - DNA, 25 bp, Rattus norvegicus
cgcttaaggtgaagcctgaggcaac

SEQ ID NO: 492088 - DNA, 25 bp, Rattus norvegicus
atttgtcttttatcgcacgtgtagc

SEQ ID NO: 492089 - DNA, 25 bp, Rattus norvegicus
gcacgtgtagcctcaataattacta

SEQ ID NO: 492090 - DNA, 25 bp, Rattus norvegicus
tatgcaaattaaccggggcaggggc

SEQ ID NO: 492091 - DNA, 25 bp, Rattus norvegicus
ctggctggtgcatttctggcttggc

SEQ ID NO: 492092 - DNA, 25 bp, Rattus norvegicus
tgcatttctggcttggcccgcgagc

SEQ ID NO: 492093 - DNA, 25 bp, Rattus norvegicus
gagatgtgattaggttccccgctta

SEQ ID NO: 492094 - DNA, 25 bp, Rattus norvegicus
tcctgcttatatagttaagcctttc

SEQ ID NO: 492095 - DNA, 25 bp, Rattus norvegicus
aacaaagcttgctgggtagaggccg

SEQ ID NO: 492096 - DNA, 25 bp, Rattus norvegicus
gcctgggaacaaagcttgctgggta

SEQ ID NO: 492097 - DNA, 25 bp, Rattus norvegicus
gcccgcgaaggccaagaagtagctg

SEQ ID NO: 492098 - DNA, 25 bp, Rattus norvegicus
gcacccgcccggagcatcaaatttg

SEQ ID NO: 492099 - DNA, 25 bp, Rattus norvegicus
ggagcatcaaatttgcacacgtatc

SEQ ID NO: 492100 - DNA, 25 bp, Rattus norvegicus
ttcgagctcctagggcaccaccaat

SEQ ID NO: 492101 - DNA, 25 bp, Rattus norvegicus
cacagaaactcagggtgccgggcga

SEQ ID NO: 492102 - DNA, 25 bp, Rattus norvegicus
ccgcgccgggtaggctgtcactgaa

SEQ ID NO: 492103 - DNA, 25 bp, Rattus norvegicus
tcactgaagcgttgaccgctgctcc

SEQ ID NO: 492104 - DNA, 25 bp, Rattus norvegicus
tcacgtcacaccgttgccagggaga

SEQ ID NO: 492105 - DNA, 25 bp, Rattus norvegicus
gaaacgctgcctgtcgggagatgta

SEQ ID NO: 492106 - DNA, 25 bp, Rattus norvegicus
ctgggtgcgtatctgagtagctgca

SEQ ID NO: 492107 - DNA, 25 bp, Rattus norvegicus
aggtcgcctggcacaaactacttgg

SEQ ID NO: 492108 - DNA, 25 bp, Rattus norvegicus
actacttggcgagtctgtggtcaca

SEQ ID NO: 492109 - DNA, 25 bp, Rattus norvegicus
tcacaggacctgatacgtaggcgcc

SEQ ID NO: 492110 - DNA, 25 bp, Rattus norvegicus
aagaagtagctggtacgcacccgcc

SEQ ID NO: 492111 - DNA, 25 bp, Rattus norvegicus
agtgcatcgcccgtgaagttctaca

SEQ ID NO: 492112 - DNA, 25 bp, Rattus norvegicus
gctgtttatgcgctgcaccaccgac

SEQ ID NO: 492113 - DNA, 25 bp, Rattus norvegicus
gaacatcgttgtggccgctgcggac

SEQ ID NO: 492114 - DNA, 25 bp, Rattus norvegicus
tgccctcgctgtttatgcgctgcac

SEQ ID NO: 492115 - DNA, 25 bp, Rattus norvegicus
acacggagatcctgccctcgctgtt

SEQ ID NO: 492116 - DNA, 25 bp, Rattus norvegicus
gtgccgcatcgacacggagatcctg

SEQ ID NO: 492117 - DNA, 25 bp, Rattus norvegicus
tgagcgagaagtgccgcatcgacac

SEQ ID NO: 492118 - DNA, 25 bp, Rattus norvegicus
aagttctacaaggtgtgcgtgagcg

SEQ ID NO: 492119 - DNA, 25 bp, Rattus norvegicus
ctgcggacggcagcagtgcatcgcc

SEQ ID NO: 492120 - DNA, 25 bp, Rattus norvegicus
cttcacaggcggtgggaacatcgtt

SEQ ID NO: 492121 - DNA, 25 bp, Rattus norvegicus
ggccgacatcgccttcacaggcggt

SEQ ID NO: 492122 - DNA, 25 bp, Rattus norvegicus
tggccgagtggcactggccgacatc

SEQ ID NO: 492123 - DNA, 25 bp, Rattus norvegicus
cccgtgaagttctacaaggtgtgcg

SEQ ID NO: 492124 - DNA, 25 bp, Rattus norvegicus
tccacggagagcctgtgccggctgc

SEQ ID NO: 492125 - DNA, 25 bp, Rattus norvegicus
ggcactcaataaagatgcacacggc

SEQ ID NO: 492126 - DNA, 25 bp, Rattus norvegicus
ccctgggtgtgtatgcagtaggcac

SEQ ID NO: 492127 - DNA, 25 bp, Rattus norvegicus
gttgccacgcgggtaaagacacctg

SEQ ID NO: 492128 - DNA, 25 bp, Rattus norvegicus
atccacggcacgtaggttgccacgc

SEQ ID NO: 492129 - DNA, 25 bp, Rattus norvegicus
gaacgttttcaatccacggcacgta

SEQ ID NO: 492130 - DNA, 25 bp, Rattus norvegicus
tcacgttaccactcagaacgttttc

SEQ ID NO: 492131 - DNA, 25 bp, Rattus norvegicus
ggccgtcacgttaacactcacgtta

SEQ ID NO: 492132 - DNA, 25 bp, Rattus norvegicus
tgtgagtcacggtctccggtgtccc

SEQ ID NO: 492133 - DNA, 25 bp, Rattus norvegicus
cacacggcttagatgcatgcattta

SEQ ID NO: 492134 - DNA, 25 bp, Rattus norvegicus
ctccggttgccacagactcgagatc

SEQ ID NO: 492135 - DNA, 25 bp, Rattus norvegicus
gcacaccagaggaccgccggagtcg

SEQ ID NO: 492136 - DNA, 25 bp, Rattus norvegicus
tccgtgtggccgagcgtggaaccac

SEQ ID NO: 492137 - DNA, 25 bp, Rattus norvegicus
catgcatttattgtgagtcacggtc

SEQ ID NO: 492138 - DNA, 25 bp, Rattus norvegicus
aaagacacctggctttctccggttg

SEQ ID NO: 492139 - DNA, 25 bp, Rattus norvegicus
gcgcccagggacctcaccatggaaa

SEQ ID NO: 492140 - DNA, 25 bp, Rattus norvegicus
agactccgccgcgatctcccaggtc

SEQ ID NO: 492141 - DNA, 25 bp, Rattus norvegicus
ccatggaaacggactccagcgagcc

SEQ ID NO: 492142 - DNA, 25 bp, Rattus norvegicus
accgaggaatcggcgaccgtgagac

SEQ ID NO: 492143 - DNA, 25 bp, Rattus norvegicus
gggacctcaccatggaaacggactc

SEQ ID NO: 492144 - DNA, 25 bp, Rattus norvegicus
accaaccgtgctcgcgcagggcgca

SEQ ID NO: 492145 - DNA, 25 bp, Rattus norvegicus
agcggtctgcagagcgcgcagacaa

SEQ ID NO: 492146 - DNA, 25 bp, Rattus norvegicus
cagagcgcgcagacaaagagtccgc

SEQ ID NO: 492147 - DNA, 25 bp, Rattus norvegicus
cccacgcggggaccctggctttgtg

SEQ ID NO: 492148 - DNA, 25 bp, Rattus norvegicus
ggctttgtgtcctctctctgcaacg

SEQ ID NO: 492149 - DNA, 25 bp, Rattus norvegicus
tgtgtcctctctctgcaacggactc

SEQ ID NO: 492150 - DNA, 25 bp, Rattus norvegicus
ccctgctcccgccaggtgagcgagc

SEQ ID NO: 492151 - DNA, 25 bp, Rattus norvegicus
ccagcgagccgcaggcacggaagac

SEQ ID NO: 492152 - DNA, 25 bp, Rattus norvegicus
accctggctttgtgtcctctctctg

SEQ ID NO: 492153 - DNA, 25 bp, Rattus norvegicus
gtccgcctgtgtgcagtagctaaaa

SEQ ID NO: 492154 - DNA, 25 bp, Rattus norvegicus
gtaccgcagtcaccctgtggacgtc

SEQ ID NO: 492155 - DNA, 25 bp, Rattus norvegicus
gtggcctcacacagatcacccagta

SEQ ID NO: 492156 - DNA, 25 bp, Rattus norvegicus
gctggcgtctgtggcctcacacaga

SEQ ID NO: 492157 - DNA, 25 bp, Rattus norvegicus
aaacccatccttgtgttcgccttcg

SEQ ID NO: 492158 - DNA, 25 bp, Rattus norvegicus
aaagctgctgaaacccatccttgtg

SEQ ID NO: 492159 - DNA, 25 bp, Rattus norvegicus
tatctcggacgccacaaagctgctg

SEQ ID NO: 492160 - DNA, 25 bp, Rattus norvegicus
tccgccttcgctgctgtctacgttt

SEQ ID NO: 492161 - DNA, 25 bp, Rattus norvegicus
cctgcccacctgttggccagatgta

SEQ ID NO: 492162 - DNA, 25 bp, Rattus norvegicus
tctacgtttcggtgagtgataaccc

SEQ ID NO: 492163 - DNA, 25 bp, Rattus norvegicus
agtcaccctgtggacgtctacgccg

SEQ ID NO: 492164 - DNA, 25 bp, Rattus norvegicus
agtagctaaaacctgaccctgccca

SEQ ID NO: 492165 - DNA, 25 bp, Rattus norvegicus
ggccagatgtacttcaactccgtta

SEQ ID NO: 492166 - DNA, 25 bp, Rattus norvegicus
tgctgcacctcgtgtccgcctgtgt

SEQ ID NO: 492167 - DNA, 25 bp, Rattus norvegicus
atgggtgcggccaacctaaaccagc

SEQ ID NO: 492168 - DNA, 25 bp, Rattus norvegicus
gccgttggcctccaacatgagggta

SEQ ID NO: 492169 - DNA, 25 bp, Rattus norvegicus
agaagcgtgctttcggcagtccacc

SEQ ID NO: 492170 - DNA, 25 bp, Rattus norvegicus
ccaacccgttggacgccatcttgag

SEQ ID NO: 492171 - DNA, 25 bp, Rattus norvegicus
tgagcaagtctttatccaacccgtt

SEQ ID NO: 492172 - DNA, 25 bp, Rattus norvegicus
tagcgtctgagccaatgagcaagtc

SEQ ID NO: 492173 - DNA, 25 bp, Rattus norvegicus
cgccaaggccttctattggtcaaaa

SEQ ID NO: 492174 - DNA, 25 bp, Rattus norvegicus
cgacccaacggctccgagttataga

SEQ ID NO: 492175 - DNA, 25 bp, Rattus norvegicus
aaagcaggtgcttcgccatcttaga

SEQ ID NO: 492176 - DNA, 25 bp, Rattus norvegicus
ttccttgcgggcctcagatatcagg

SEQ ID NO: 492177 - DNA, 25 bp, Rattus norvegicus
ggccaatccgcctcaagtgaacgcg

SEQ ID NO: 492178 - DNA, 25 bp, Rattus norvegicus
agtccacctccatattgcaagcggg

SEQ ID NO: 492179 - DNA, 25 bp, Rattus norvegicus
cacgcggaatgcgaagggacatttc

SEQ ID NO: 492180 - DNA, 25 bp, Rattus norvegicus
ccatggcacacagaggagacccgca

SEQ ID NO: 492181 - DNA, 25 bp, Rattus norvegicus
tccatctcccgcgaggtccgtgggc

SEQ ID NO: 492182 - DNA, 25 bp, Rattus norvegicus
gctgcaccccaaagcgtcgcggaga

SEQ ID NO: 492183 - DNA, 25 bp, Rattus norvegicus
cgcagacgccccgtaccgcgcagct

SEQ ID NO: 492184 - DNA, 25 bp, Rattus norvegicus
gcgcggcccagctcgatccttccct

SEQ ID NO: 492185 - DNA, 25 bp, Rattus norvegicus
ccagcgcgccgggtattgtccgggc

SEQ ID NO: 492186 - DNA, 25 bp, Rattus norvegicus
gtgggctcgtgtgcgcgccgcttct

SEQ ID NO: 492187 - DNA, 25 bp, Rattus norvegicus
gggccgactctagggcctggcggcc

SEQ ID NO: 492188 - DNA, 25 bp, Rattus norvegicus
tccgtgggcggtgcagcacggggca

SEQ ID NO: 492189 - DNA, 25 bp, Rattus norvegicus
cgggtactcactccatctcccgcga

SEQ ID NO: 492190 - DNA, 25 bp, Rattus norvegicus
gcgcggccgggtactcactccatct

SEQ ID NO: 492191 - DNA, 25 bp, Rattus norvegicus
cgatccttcccttttgcagctgggc

SEQ ID NO: 492192 - DNA, 25 bp, Rattus norvegicus
tcgatccttcccttttgcagctggg

SEQ ID NO: 492193 - DNA, 25 bp, Rattus norvegicus
ctcgatccttcccttttgcagctgg

SEQ ID NO: 492194 - DNA, 25 bp, Rattus norvegicus
cagcacggggcagggccgactctag

SEQ ID NO: 492195 - DNA, 25 bp, Rattus norvegicus
taacgttgttgttgccgcagagttc

SEQ ID NO: 492196 - DNA, 25 bp, Rattus norvegicus
acctgagcgcaggactctgaaggcc

SEQ ID NO: 492197 - DNA, 25 bp, Rattus norvegicus
tggaacggcccagaaagcaagtggc

SEQ ID NO: 492198 - DNA, 25 bp, Rattus norvegicus
gggtgccgaactccaatggaacggc

SEQ ID NO: 492199 - DNA, 25 bp, Rattus norvegicus
aaagcaagtggcctggcgcaagtga

SEQ ID NO: 492200 - DNA, 25 bp, Rattus norvegicus
ggcgcaagtgacacgacgagatgta

SEQ ID NO: 492201 - DNA, 25 bp, Rattus norvegicus
taggtaacgttgttgttgccgcaga

SEQ ID NO: 492202 - DNA, 25 bp, Rattus norvegicus
tgccgcagagttcttggccagggtt

SEQ ID NO: 492203 - DNA, 25 bp, Rattus norvegicus
tgcagcgcgacacaccacgcagtgt

SEQ ID NO: 492204 - DNA, 25 bp, Rattus norvegicus
accacgcagtgtgcgctgccagtct

SEQ ID NO: 492205 - DNA, 25 bp, Rattus norvegicus
tgcgctgccagtctgatccacaagg

SEQ ID NO: 492206 - DNA, 25 bp, Rattus norvegicus
tctgatccacaaggcacgactgggg

SEQ ID NO: 492207 - DNA, 25 bp, Rattus norvegicus
gcgggcacactacctgagcgcagga

SEQ ID NO: 492208 - DNA, 25 bp, Rattus norvegicus
gacacgacgagatgtaggtaacgtt

SEQ ID NO: 492209 - DNA, 25 bp, Rattus norvegicus
acacgcactcgcagtgtggacggcc

SEQ ID NO: 492210 - DNA, 25 bp, Rattus norvegicus
gtggcgccatcagagccgcagacct

SEQ ID NO: 492211 - DNA, 25 bp, Rattus norvegicus
tcgcagttggacacgcactcgcagt

SEQ ID NO: 492212 - DNA, 25 bp, Rattus norvegicus
actccactccgtcgcaagaatctga

SEQ ID NO: 492213 - DNA, 25 bp, Rattus norvegicus
tcgcaagaatctgaggacacagagc

SEQ ID NO: 492214 - DNA, 25 bp, Rattus norvegicus
ggttcccacgtgtcactggagtcta

SEQ ID NO: 492215 - DNA, 25 bp, Rattus norvegicus
cgctcttactttggcagcggccgcg

SEQ ID NO: 492216 - DNA, 25 bp, Rattus norvegicus
tcactggagtctaggcgcaccgcac

SEQ ID NO: 492217 - DNA, 25 bp, Rattus norvegicus
ccgcggtacatgacgcgcaggtctg

SEQ ID NO: 492218 - DNA, 25 bp, Rattus norvegicus
acatgacgcgcaggtctgggtgtcc

SEQ ID NO: 492219 - DNA, 25 bp, Rattus norvegicus
cgcggtgcgcagttcgcattcgtcc

SEQ ID NO: 492220 - DNA, 25 bp, Rattus norvegicus
cacggtcaccgctcttactttggca

SEQ ID NO: 492221 - DNA, 25 bp, Rattus norvegicus
gttcgcattcgtcccggtaggtggc

SEQ ID NO: 492222 - DNA, 25 bp, Rattus norvegicus
ccgcagacctggaagcccgcgggaa

SEQ ID NO: 492223 - DNA, 25 bp, Rattus norvegicus
cggtgaaaaagctgctagagccaga

SEQ ID NO: 492224 - DNA, 25 bp, Rattus norvegicus
agccagaggagagcatgcccgacga

SEQ ID NO: 492225 - DNA, 25 bp, Rattus norvegicus
gctccgaccacagcaacctactctc

SEQ ID NO: 492226 - DNA, 25 bp, Rattus norvegicus
acgccggtgaaaaagctgctagagc

SEQ ID NO: 492227 - DNA, 25 bp, Rattus norvegicus
gtaggaacgccggtgaaaaagctgc

SEQ ID NO: 492228 - DNA, 25 bp, Rattus norvegicus
ccaaagcggccctgagccgaggggc

SEQ ID NO: 492229 - DNA, 25 bp, Rattus norvegicus
tccgcctccaccctaggccgggcca

SEQ ID NO: 492230 - DNA, 25 bp, Rattus norvegicus
gacgcacttccctgcagagcccgcc

SEQ ID NO: 492231 - DNA, 25 bp, Rattus norvegicus
cgcctcctctgacgcacttccctgc

SEQ ID NO: 492232 - DNA, 25 bp, Rattus norvegicus
cgcgacccgtgctggctcgcgaccc

SEQ ID NO: 492233 - DNA, 25 bp, Rattus norvegicus
gcactcaccgcccatcctctcactc

SEQ ID NO: 492234 - DNA, 25 bp, Rattus norvegicus
tcctctcactccaccggcttcgccc

SEQ ID NO: 492235 - DNA, 25 bp, Rattus norvegicus
cagaggagagcatgcccgacgacgc

SEQ ID NO: 492236 - DNA, 25 bp, Rattus norvegicus
ggcttcgccctccagctccgaccac

SEQ ID NO: 492237 - DNA, 25 bp, Rattus norvegicus
ctttggctgttctgtggactcatgg

SEQ ID NO: 492238 - DNA, 25 bp, Rattus norvegicus
gcatgtaaacagtaagagctcaata

SEQ ID NO: 492239 - DNA, 25 bp, Rattus norvegicus
gctcaataaataaatgtcagtcctc

SEQ ID NO: 492240 - DNA, 25 bp, Rattus norvegicus
gccgcattcctcaggccacgtgggt

SEQ ID NO: 492241 - DNA, 25 bp, Rattus norvegicus
ggactcagcgagtgcagacgcctcg

SEQ ID NO: 492242 - DNA, 25 bp, Rattus norvegicus
cctcggcctataaaagcccagggcg

SEQ ID NO: 492243 - DNA, 25 bp, Rattus norvegicus
gtcccatctgggaaccagacagttg

SEQ ID NO: 492244 - DNA, 25 bp, Rattus norvegicus
gtctaggaagaacaacccacaatgg

SEQ ID NO: 492245 - DNA, 25 bp, Rattus norvegicus
cccacaatggggtcaggtcataaac

SEQ ID NO: 492246 - DNA, 25 bp, Rattus norvegicus
gtcataaactgtggtccggagggca

SEQ ID NO: 492247 - DNA, 25 bp, Rattus norvegicus
gcatgttctgggaggtgcacacctc

SEQ ID NO: 492248 - DNA, 25 bp, Rattus norvegicus
cctccaggtgttcagtgttcctttg

SEQ ID NO: 492249 - DNA, 25 bp, Rattus norvegicus
tgttcctttggggatctctggggta

SEQ ID NO: 492250 - DNA, 25 bp, Rattus norvegicus
tggactcatgggaaagcatgtaaac

SEQ ID NO: 492251 - DNA, 25 bp, Rattus norvegicus
ttactttgtcctagtgcggccaccg

SEQ ID NO: 492252 - DNA, 25 bp, Rattus norvegicus
ctgacttctgcttccaagcctgatt

SEQ ID NO: 492253 - DNA, 25 bp, Rattus norvegicus
cccagaggagctgcgaatccgacgg

SEQ ID NO: 492254 - DNA, 25 bp, Rattus norvegicus
ctgtctagaggggaaattgagaccc

SEQ ID NO: 492255 - DNA, 25 bp, Rattus norvegicus
ggacggtacttctgccactgctgtt

SEQ ID NO: 492256 - DNA, 25 bp, Rattus norvegicus
ggcttccggcagtacttactttgtc

SEQ ID NO: 492257 - DNA, 25 bp, Rattus norvegicus
acacgctcgactcgggtctctggct

SEQ ID NO: 492258 - DNA, 25 bp, Rattus norvegicus
aaggtgactagtctccgccgcctcg

SEQ ID NO: 492259 - DNA, 25 bp, Rattus norvegicus
ggttaccaaggtgactagtctccgc

SEQ ID NO: 492260 - DNA, 25 bp, Rattus norvegicus
aaattgccaagacctctagctccgc

SEQ ID NO: 492261 - DNA, 25 bp, Rattus norvegicus
ttaacttccgcactcttcaagcgtg

SEQ ID NO: 492262 - DNA, 25 bp, Rattus norvegicus
cctcctaaagtcgtcgccaaggcga

SEQ ID NO: 492263 - DNA, 25 bp, Rattus norvegicus
agcctgatttcacctcctaaagtcg

SEQ ID NO: 492264 - DNA, 25 bp, Rattus norvegicus
tgccactgctgttcggtggagatcg

SEQ ID NO: 492265 - DNA, 25 bp, Rattus norvegicus
cctctcgcagaaggagaacatcaat

SEQ ID NO: 492266 - DNA, 25 bp, Rattus norvegicus
agctcttagccgaccgactgttttg

SEQ ID NO: 492267 - DNA, 25 bp, Rattus norvegicus
ggcccgctccctgaaagctggttct

SEQ ID NO: 492268 - DNA, 25 bp, Rattus norvegicus
gaagtgcgttccctcctctcgcaga

SEQ ID NO: 492269 - DNA, 25 bp, Rattus norvegicus
acatcaatgtactggtgagttggga

SEQ ID NO: 492270 - DNA, 25 bp, Rattus norvegicus
tctttagccgagatgtggaggaagt

SEQ ID NO: 492271 - DNA, 25 bp, Rattus norvegicus
cctggtccaggccatctttagccga

SEQ ID NO: 492272 - DNA, 25 bp, Rattus norvegicus
tgaaagctggttctccctgcagccg

SEQ ID NO: 492273 - DNA, 25 bp, Rattus norvegicus
gcatggccagaatccgctgcagcca

SEQ ID NO: 492274 - DNA, 25 bp, Rattus norvegicus
ccatggggatcctcagcatcacgga

SEQ ID NO: 492275 - DNA, 25 bp, Rattus norvegicus
cagcgtagttcgctggcagagccga

SEQ ID NO: 492276 - DNA, 25 bp, Rattus norvegicus
gactgttttggtcctgagctccgga

SEQ ID NO: 492277 - DNA, 25 bp, Rattus norvegicus
caaggcgtccgctctgccggtgcat

SEQ ID NO: 492278 - DNA, 25 bp, Rattus norvegicus
gagcgagacacgacttcgagccatg

SEQ ID NO: 492279 - DNA, 25 bp, Rattus norvegicus
cgcatcccgacctgtgcccggcggc

SEQ ID NO: 492280 - DNA, 25 bp, Rattus norvegicus
tcgccaacgcgtcccctgcacccga

SEQ ID NO: 492281 - DNA, 25 bp, Rattus norvegicus
aggatccacacgcaggaaaaagtgg

SEQ ID NO: 492282 - DNA, 25 bp, Rattus norvegicus
ggctatggctgctgccgtccaatgg

SEQ ID NO: 492283 - DNA, 25 bp, Rattus norvegicus
gatccacacgcaggaaaaagtgggt

SEQ ID NO: 492284 - DNA, 25 bp, Rattus norvegicus
aagaggcggcgccagcgcacgtcgc

SEQ ID NO: 492285 - DNA, 25 bp, Rattus norvegicus
acgtcgccctccagatgtgggtacc

SEQ ID NO: 492286 - DNA, 25 bp, Rattus norvegicus
gtcgccctccagatgtgggtacccg

SEQ ID NO: 492287 - DNA, 25 bp, Rattus norvegicus
ctgcacccgaccaccaggatccaca

SEQ ID NO: 492288 - DNA, 25 bp, Rattus norvegicus
gaggcggcggcgcatcccgacctgt

SEQ ID NO: 492289 - DNA, 25 bp, Rattus norvegicus
cgcgcggtgttccagctgcacggtc

SEQ ID NO: 492290 - DNA, 25 bp, Rattus norvegicus
cggtgttccagctgcacggtcgggg

SEQ ID NO: 492291 - DNA, 25 bp, Rattus norvegicus
cggggctatggctgctgccgtccaa

SEQ ID NO: 492292 - DNA, 25 bp, Rattus norvegicus
ctccagatgtgggtacccgcccggg

SEQ ID NO: 492293 - DNA, 25 bp, Rattus norvegicus
gaccgcgtcttctggttgccacaca

SEQ ID NO: 492294 - DNA, 25 bp, Rattus norvegicus
tctggactggctcaagatacacctg

SEQ ID NO: 492295 - DNA, 25 bp, Rattus norvegicus
tgccacacaacatggacttccgagg

SEQ ID NO: 492296 - DNA, 25 bp, Rattus norvegicus
tatcgcctgtcgttggcacagcacc

SEQ ID NO: 492297 - DNA, 25 bp, Rattus norvegicus
cctcaaggcggctcgagagatgcac

SEQ ID NO: 492298 - DNA, 25 bp, Rattus norvegicus
cacaagtctgaactgcggaaggagc

SEQ ID NO: 492299 - DNA, 25 bp, Rattus norvegicus
ggctccacaccagtgcacaagtctg

SEQ ID NO: 492300 - DNA, 25 bp, Rattus norvegicus
ctggacttggtgctgcagatcttta

SEQ ID NO: 492301 - DNA, 25 bp, Rattus norvegicus
gggtaccacgcaacaccagcgtcta

SEQ ID NO: 492302 - DNA, 25 bp, Rattus norvegicus
cctgctgagttccaccaaaataatg

SEQ ID NO: 492303 - DNA, 25 bp, Rattus norvegicus
ctgcactctggtgcctacctgctga

SEQ ID NO: 492304 - DNA, 25 bp, Rattus norvegicus
ttcgagaccacggaagtgccaatgc

SEQ ID NO: 492305 - DNA, 25 bp, Rattus norvegicus
cgcgtgcactgttggagttcgctga

SEQ ID NO: 492306 - DNA, 25 bp, Rattus norvegicus
gcagagcccacgctgaccttcgaga

SEQ ID NO: 492307 - DNA, 25 bp, Rattus norvegicus
cctctatggcttctgcacgggcacg

SEQ ID NO: 492308 - DNA, 25 bp, Rattus norvegicus
taagctacctacgtccctctatggc

SEQ ID NO: 492309 - DNA, 25 bp, Rattus norvegicus
ctgaggcaccgaggtgatcgcaccc

SEQ ID NO: 492310 - DNA, 25 bp, Rattus norvegicus
gatccatattcttcctcggaggcca

SEQ ID NO: 492311 - DNA, 25 bp, Rattus norvegicus
cgcgcaagggtcacaagttggaaga

SEQ ID NO: 492312 - DNA, 25 bp, Rattus norvegicus
gcgggccgagtattgcacttgatcc

SEQ ID NO: 492313 - DNA, 25 bp, Rattus norvegicus
cgagctggttattgcgtgagcttgc

SEQ ID NO: 492314 - DNA, 25 bp, Rattus norvegicus
cattcatggcgacggcggggaccca

SEQ ID NO: 492315 - DNA, 25 bp, Rattus norvegicus
tcagtacattcatggcgacggcggg

SEQ ID NO: 492316 - DNA, 25 bp, Rattus norvegicus
ctcggctcgtcagtacattcatggc

SEQ ID NO: 492317 - DNA, 25 bp, Rattus norvegicus
ccaggcacaccgtagggtgaggtcc

SEQ ID NO: 492318 - DNA, 25 bp, Rattus norvegicus
gaggccaccgcacatgcggggcaca

SEQ ID NO: 492319 - DNA, 25 bp, Rattus norvegicus
tgctgcctcggctcgtcagtacatt

SEQ ID NO: 492320 - DNA, 25 bp, Rattus norvegicus
cgagtattgcacttgatccatattc

SEQ ID NO: 492321 - DNA, 25 bp, Rattus norvegicus
actgaggatcttggtgaaacgcacg

SEQ ID NO: 492322 - DNA, 25 bp, Rattus norvegicus
agtgtccgagaccacgttgaagacg

SEQ ID NO: 492323 - DNA, 25 bp, Rattus norvegicus
ccaagtccatgaggaagaaagtgtc

SEQ ID NO: 492324 - DNA, 25 bp, Rattus norvegicus
gcgaaagttcagcaccaagtccatg

SEQ ID NO: 492325 - DNA, 25 bp, Rattus norvegicus
ctccacgatgaggaagatgtagtcc

SEQ ID NO: 492326 - DNA, 25 bp, Rattus norvegicus
gtcctcaataacaatgccggtgcga

SEQ ID NO: 492327 - DNA, 25 bp, Rattus norvegicus
gatgatctccgtgttgtcctcaata

SEQ ID NO: 492328 - DNA, 25 bp, Rattus norvegicus
tcttttcggggtccaggatgatctc

SEQ ID NO: 492329 - DNA, 25 bp, Rattus norvegicus
gtctaccacgaaccacgtacgcagg

SEQ ID NO: 492330 - DNA, 25 bp, Rattus norvegicus
caccgggatggatgacacgaagtct

SEQ ID NO: 492331 - DNA, 25 bp, Rattus norvegicus
tagccgcagcaaccgcagcagactg

SEQ ID NO: 492332 - DNA, 25 bp, Rattus norvegicus
ggagtcgattcccttctccacgatg

SEQ ID NO: 492333 - DNA, 25 bp, Rattus norvegicus
gccgtcttgtagacctcggagtcga

SEQ ID NO: 492334 - DNA, 25 bp, Rattus norvegicus
tcctcccattggtggatatatcgga

SEQ ID NO: 492335 - DNA, 25 bp, Rattus norvegicus
ctcccggaaagaagagacagacgca

SEQ ID NO: 492336 - DNA, 25 bp, Rattus norvegicus
cccgaattggcgctgcaggaagctg

SEQ ID NO: 492337 - DNA, 25 bp, Rattus norvegicus
tccgcagggagaacttgttgacgcc

SEQ ID NO: 492338 - DNA, 25 bp, Rattus norvegicus
ttctggctgccaaacatccgcaggg

SEQ ID NO: 492339 - DNA, 25 bp, Rattus norvegicus
ctctgcacatcagggtccctcaggg

SEQ ID NO: 492340 - DNA, 25 bp, Rattus norvegicus
cactccaggcctccaaaagggcgga

SEQ ID NO: 492341 - DNA, 25 bp, Rattus norvegicus
ttatgtgctcagaccctgtccctga

SEQ ID NO: 492342 - DNA, 25 bp, Rattus norvegicus
atccatctttacaccctcgtttctg

SEQ ID NO: 492343 - DNA, 25 bp, Rattus norvegicus
aatactcgggtcatggccctacgcc

SEQ ID NO: 492344 - DNA, 25 bp, Rattus norvegicus
atcgggcatcacatcacaagctctc

SEQ ID NO: 492345 - DNA, 25 bp, Rattus norvegicus
cccgcgacatgagaacgaaaccttg

SEQ ID NO: 492346 - DNA, 25 bp, Rattus norvegicus
gcggctctggctcactgcaaccagg

SEQ ID NO: 492347 - DNA, 25 bp, Rattus norvegicus
tccgtatccacacacacgggatgtg

SEQ ID NO: 492348 - DNA, 25 bp, Rattus norvegicus
tatttgtcctctccacccttatgtg

SEQ ID NO: 492349 - DNA, 25 bp, Rattus norvegicus
ctgcggcctggactgcctctgtgct

SEQ ID NO: 492350 - DNA, 25 bp, Rattus norvegicus
gggaagcgttggcacgtgatcatac

SEQ ID NO: 492351 - DNA, 25 bp, Rattus norvegicus
gttggcacgtgatcatacgaccaca

SEQ ID NO: 492352 - DNA, 25 bp, Rattus norvegicus
gccgctcaggctcgcactacagaag

SEQ ID NO: 492353 - DNA, 25 bp, Rattus norvegicus
cacaccctcaaaggggcggggcctg

SEQ ID NO: 492354 - DNA, 25 bp, Rattus norvegicus
ctcgcactacagaagcggagcgggt

SEQ ID NO: 492355 - DNA, 25 bp, Rattus norvegicus
ctggactgcctctgtgctcgcgggc

SEQ ID NO: 492356 - DNA, 25 bp, Rattus norvegicus
cgccttggccactcaggaacgtgaa

SEQ ID NO: 492357 - DNA, 25 bp, Rattus norvegicus
actcaggaacgtgaaggccagcgcc

SEQ ID NO: 492358 - DNA, 25 bp, Rattus norvegicus
gccatgtcgcctcgtccaagagcag

SEQ ID NO: 492359 - DNA, 25 bp, Rattus norvegicus
gagcaggcacgtatccagcgtccgc

SEQ ID NO: 492360 - DNA, 25 bp, Rattus norvegicus
cccactgcggctctataagaagggt

SEQ ID NO: 492361 - DNA, 25 bp, Rattus norvegicus
caggcgcacagcgagcaggcacgta

SEQ ID NO: 492362 - DNA, 25 bp, Rattus norvegicus
tcatacgaccacaccctcaaagggg

SEQ ID NO: 492363 - DNA, 25 bp, Rattus norvegicus
cgcaggcgccttgcgtttccgaagc

SEQ ID NO: 492364 - DNA, 25 bp, Rattus norvegicus
tcgcctccggccggaagagctccgc

SEQ ID NO: 492365 - DNA, 25 bp, Rattus norvegicus
cagccgccgggcctcgaatgcgcct

SEQ ID NO: 492366 - DNA, 25 bp, Rattus norvegicus
tcccggccccgaatgcgcctgcgtg

SEQ ID NO: 492367 - DNA, 25 bp, Rattus norvegicus
ttcggaccccgaatgcgcctgcgtg

SEQ ID NO: 492368 - DNA, 25 bp, Rattus norvegicus
ggccggaaatgcacctgcgcgccac

SEQ ID NO: 492369 - DNA, 25 bp, Rattus norvegicus
cgccactgccgggtctagaatgcgc

SEQ ID NO: 492370 - DNA, 25 bp, Rattus norvegicus
ccactgccgggtctagaatgcgcct

SEQ ID NO: 492371 - DNA, 25 bp, Rattus norvegicus
actgccgggtctagaatgcgcctgt

SEQ ID NO: 492372 - DNA, 25 bp, Rattus norvegicus
cgggtctagaatgcgcctgtgcgac

SEQ ID NO: 492373 - DNA, 25 bp, Rattus norvegicus
tctagaatgcgcctgtgcgacgcct

SEQ ID NO: 492374 - DNA, 25 bp, Rattus norvegicus
agaatgcgcctgtgcgacgcctcca

SEQ ID NO: 492375 - DNA, 25 bp, Rattus norvegicus
gtgcgacgcctccaccgggtccgga

SEQ ID NO: 492376 - DNA, 25 bp, Rattus norvegicus
ccggaatgtgtctgcgcgcccgccc

SEQ ID NO: 492377 - DNA, 25 bp, Rattus norvegicus
tgagcgcgtactctcagggcgctga

SEQ ID NO: 492378 - DNA, 25 bp, Rattus norvegicus
agggcgctgagcatatactctcagg

SEQ ID NO: 492379 - DNA, 25 bp, Rattus norvegicus
tgagcatatactctcagggcgctga

SEQ ID NO: 492380 - DNA, 25 bp, Rattus norvegicus
ctgagcgcgtactctcaggcgctga

SEQ ID NO: 492381 - DNA, 25 bp, Rattus norvegicus
tcagggcgctgagcgcgtactctca

SEQ ID NO: 492382 - DNA, 25 bp, Rattus norvegicus
gctgagcgcgtactctcagggcgct

SEQ ID NO: 492383 - DNA, 25 bp, Rattus norvegicus
tgagcgtgtactctcagggcgctga

SEQ ID NO: 492384 - DNA, 25 bp, Rattus norvegicus
gggcgctgagcatatactctcaggg

SEQ ID NO: 492385 - DNA, 25 bp, Rattus norvegicus
ctgagcgtgtactctcagggcgctg

SEQ ID NO: 492386 - DNA, 25 bp, Rattus norvegicus
ctcaggcgctgagcatatactctca

SEQ ID NO: 492387 - DNA, 25 bp, Rattus norvegicus
cgctgagcatatactctcagggcgc

SEQ ID NO: 492388 - DNA, 25 bp, Rattus norvegicus
ctgagcatatactctcagggcgctg

SEQ ID NO: 492389 - DNA, 25 bp, Rattus norvegicus
gctgagcgtgtactctcagggcgct

SEQ ID NO: 492390 - DNA, 25 bp, Rattus norvegicus
cgcgtactctcaggcgctgagcata

SEQ ID NO: 492391 - DNA, 25 bp, Rattus norvegicus
tctcggcactggatcttgcgcagca

SEQ ID NO: 492392 - DNA, 25 bp, Rattus norvegicus
cacgctcacgttgttgttgaaggcc

SEQ ID NO: 492393 - DNA, 25 bp, Rattus norvegicus
gcactcataggccacgctcacgttg

SEQ ID NO: 492394 - DNA, 25 bp, Rattus norvegicus
atccaggcctggcttcttcttgcgg

SEQ ID NO: 492395 - DNA, 25 bp, Rattus norvegicus
agctcgctgtatgtgcgcccatcca

SEQ ID NO: 492396 - DNA, 25 bp, Rattus norvegicus
atcttgcgcagcagcggtgccacca

SEQ ID NO: 492397 - DNA, 25 bp, Rattus norvegicus
gatcagccaccgctaggccagggtc

SEQ ID NO: 492398 - DNA, 25 bp, Rattus norvegicus
acagcctcatggtctcggcactgga

SEQ ID NO: 492399 - DNA, 25 bp, Rattus norvegicus
tgccggttctgaagatgcccagagg

SEQ ID NO: 492400 - DNA, 25 bp, Rattus norvegicus
acaaagcaggacagcatgccggttc

SEQ ID NO: 492401 - DNA, 25 bp, Rattus norvegicus
tcgagcgtgtccagcacagcctgac

SEQ ID NO: 492402 - DNA, 25 bp, Rattus norvegicus
ggccagggtcctccagcagctggaa

SEQ ID NO: 492403 - DNA, 25 bp, Rattus norvegicus
gcgccacgaattccagcagcacaaa

SEQ ID NO: 492404 - DNA, 25 bp, Rattus norvegicus
gcaaactcgcttcagcagctcgctg

SEQ ID NO: 492405 - DNA, 25 bp, Rattus norvegicus
tcacgccaacctgccgtaggaaatc

SEQ ID NO: 492406 - DNA, 25 bp, Rattus norvegicus
gcgaagcgtgcggagaaccttaacc

SEQ ID NO: 492407 - DNA, 25 bp, Rattus norvegicus
ctcaagtcggccaggcccaggaaaa

SEQ ID NO: 492408 - DNA, 25 bp, Rattus norvegicus
cccaggaaaagaggacagaccacta

SEQ ID NO: 492409 - DNA, 25 bp, Rattus norvegicus
ggacagaccactactcccagaaacg

SEQ ID NO: 492410 - DNA, 25 bp, Rattus norvegicus
ccgcacctctgcgagtggtgagcca

SEQ ID NO: 492411 - DNA, 25 bp, Rattus norvegicus
ggcgagcgcaaacccatgttctcga

SEQ ID NO: 492412 - DNA, 25 bp, Rattus norvegicus
atgttctcgaagtaatgcgccaaga

SEQ ID NO: 492413 - DNA, 25 bp, Rattus norvegicus
gccgccataattcacggcgcgacga

SEQ ID NO: 492414 - DNA, 25 bp, Rattus norvegicus
agggctgcgcgcagcatctccgtca

SEQ ID NO: 492415 - DNA, 25 bp, Rattus norvegicus
gcgctcactgcagctgaaatcgacg

SEQ ID NO: 492416 - DNA, 25 bp, Rattus norvegicus
acgtccggccactgtctgggaaatt

SEQ ID NO: 492417 - DNA, 25 bp, Rattus norvegicus
aaattggccgctggtgctactgccg

SEQ ID NO: 492418 - DNA, 25 bp, Rattus norvegicus
cgccaagaaggcgatgggctcttcg

SEQ ID NO: 492419 - DNA, 25 bp, Rattus norvegicus
agtgatctctccacatcacccagga

SEQ ID NO: 492420 - DNA, 25 bp, Rattus norvegicus
ccatcggtcagagcttgactggaca

SEQ ID NO: 492421 - DNA, 25 bp, Rattus norvegicus
acttgaaagttggagaattgcgccc

SEQ ID NO: 492422 - DNA, 25 bp, Rattus norvegicus
tctgggttcccacggcgtcacgtgg

SEQ ID NO: 492423 - DNA, 25 bp, Rattus norvegicus
atcacccaggaacccggtatccagt

SEQ ID NO: 492424 - DNA, 25 bp, Rattus norvegicus
ccgagagccaagtgatctctccaca

SEQ ID NO: 492425 - DNA, 25 bp, Rattus norvegicus
tacatcgttcgggtgagtgcgccca

SEQ ID NO: 492426 - DNA, 25 bp, Rattus norvegicus
ggggtctcttacatcgttcgggtga

SEQ ID NO: 492427 - DNA, 25 bp, Rattus norvegicus
gcgcaagggcggcttcattcacaag

SEQ ID NO: 492428 - DNA, 25 bp, Rattus norvegicus
gaactcccgacgtcgccgacgagtg

SEQ ID NO: 492429 - DNA, 25 bp, Rattus norvegicus
tgctaccgcgcatgccgcagtggaa

SEQ ID NO: 492430 - DNA, 25 bp, Rattus norvegicus
ctgcgcggagcggtgacatcactcg

SEQ ID NO: 492431 - DNA, 25 bp, Rattus norvegicus
tcagagcttgactggacagctcctc

SEQ ID NO: 492432 - DNA, 25 bp, Rattus norvegicus
aacccggtatccagtgcgcgcgctt

SEQ ID NO: 492433 - DNA, 25 bp, Rattus norvegicus
agggaacagaacctcactcggcaga

SEQ ID NO: 492434 - DNA, 25 bp, Rattus norvegicus
gctgaaggagactcgtagggaaccc

SEQ ID NO: 492435 - DNA, 25 bp, Rattus norvegicus
gcccatccaatcaggctccgagatt

SEQ ID NO: 492436 - DNA, 25 bp, Rattus norvegicus
ccggtgcagctccagggaacagaac

SEQ ID NO: 492437 - DNA, 25 bp, Rattus norvegicus
atccaatcaggctccgagattccct

SEQ ID NO: 492438 - DNA, 25 bp, Rattus norvegicus
aacctcactcggcagatcttcctga

SEQ ID NO: 492439 - DNA, 25 bp, Rattus norvegicus
cggcagatcttcctgaactctcgtc

SEQ ID NO: 492440 - DNA, 25 bp, Rattus norvegicus
aggccggactgtgcacaccgccaag

SEQ ID NO: 492441 - DNA, 25 bp, Rattus norvegicus
aaggaacgcgggagcgcgtacattc

SEQ ID NO: 492442 - DNA, 25 bp, Rattus norvegicus
gagcgcgtacattcccggaaacgtc

SEQ ID NO: 492443 - DNA, 25 bp, Rattus norvegicus
tgatctcctccagccaatagagtcc

SEQ ID NO: 492444 - DNA, 25 bp, Rattus norvegicus
cctccagccaatagagtcctatctg

SEQ ID NO: 492445 - DNA, 25 bp, Rattus norvegicus
agagtcctatctgccgcccaaagcg

SEQ ID NO: 492446 - DNA, 25 bp, Rattus norvegicus
agactcgtagggaacccggtgcagc

SEQ ID NO: 492447 - DNA, 25 bp, Rattus norvegicus
ccatacgccgcgcacagggagtcgg

SEQ ID NO: 492448 - DNA, 25 bp, Rattus norvegicus
cggtcagttcgctgcgcggggccca

SEQ ID NO: 492449 - DNA, 25 bp, Rattus norvegicus
gtggcaggtgaacccagcgcgctcc

SEQ ID NO: 492450 - DNA, 25 bp, Rattus norvegicus
cagcccgcgtggcaggtgaacccag

SEQ ID NO: 492451 - DNA, 25 bp, Rattus norvegicus
ctccgggttctggagtcgccgcagc

SEQ ID NO: 492452 - DNA, 25 bp, Rattus norvegicus
ccgcctcgcttgcagctgcgccggg

SEQ ID NO: 492453 - DNA, 25 bp, Rattus norvegicus
ctgcgctgccgcctcgcttgcagct

SEQ ID NO: 492454 - DNA, 25 bp, Rattus norvegicus
cgcagagctggccactgcgctgccg

SEQ ID NO: 492455 - DNA, 25 bp, Rattus norvegicus
cgcgccgagcgcagagctggccact

SEQ ID NO: 492456 - DNA, 25 bp, Rattus norvegicus
tggtgggcggtttcccgcgccgagc

SEQ ID NO: 492457 - DNA, 25 bp, Rattus norvegicus
cgcgctccgcggtgcccatacgccg

SEQ ID NO: 492458 - DNA, 25 bp, Rattus norvegicus
cggccgctttcggaggaatacggct

SEQ ID NO: 492459 - DNA, 25 bp, Rattus norvegicus
ccctctcggattgcgaggacgcggg

SEQ ID NO: 492460 - DNA, 25 bp, Rattus norvegicus
cgctttcggaggaatacggcttggt

SEQ ID NO: 492461 - DNA, 25 bp, Rattus norvegicus
gtcgccgcttgacccgcagggctac

SEQ ID NO: 492462 - DNA, 25 bp, Rattus norvegicus
tgatgcgcggagcatcaattgctgc

SEQ ID NO: 492463 - DNA, 25 bp, Rattus norvegicus
gtcgccatggctccctgtctgcgga

SEQ ID NO: 492464 - DNA, 25 bp, Rattus norvegicus
catggctccctgtctgcggatgaca

SEQ ID NO: 492465 - DNA, 25 bp, Rattus norvegicus
ccctgtctgcggatgacagtacacc

SEQ ID NO: 492466 - DNA, 25 bp, Rattus norvegicus
ggatgacagtacaccggacaccagc

SEQ ID NO: 492467 - DNA, 25 bp, Rattus norvegicus
cacacagtacggatgggcaccaggg

SEQ ID NO: 492468 - DNA, 25 bp, Rattus norvegicus
agcccaggtgtccgtcgccgcttga

SEQ ID NO: 492469 - DNA, 25 bp, Rattus norvegicus
agtctggccaggcaccacgtggaga

SEQ ID NO: 492470 - DNA, 25 bp, Rattus norvegicus
ccacgtggagagcacacagtacgga

SEQ ID NO: 492471 - DNA, 25 bp, Rattus norvegicus
agagcacacagtacggatgggcacc

SEQ ID NO: 492472 - DNA, 25 bp, Rattus norvegicus
cggccctgtgatgcgcggagcatca

SEQ ID NO: 492473 - DNA, 25 bp, Rattus norvegicus
agggcctgtatgaccggccctgtga

SEQ ID NO: 492474 - DNA, 25 bp, Rattus norvegicus
agtacaccggacaccagcccaggtg

SEQ ID NO: 492475 - DNA, 25 bp, Rattus norvegicus
cggcgctctgcgagccgaaagtttc

SEQ ID NO: 492476 - DNA, 25 bp, Rattus norvegicus
agtccctatcgacgcgctacgaatc

SEQ ID NO: 492477 - DNA, 25 bp, Rattus norvegicus
agcttgggcagcaacaggcccgcgc

SEQ ID NO: 492478 - DNA, 25 bp, Rattus norvegicus
tccatctcgttcacggtgcgcatgc

SEQ ID NO: 492479 - DNA, 25 bp, Rattus norvegicus
ataagcgcgcggcaccgcatccggg

SEQ ID NO: 492480 - DNA, 25 bp, Rattus norvegicus
tacgaatccgccactccggtactga

SEQ ID NO: 492481 - DNA, 25 bp, Rattus norvegicus
gccactccggtactgaaactcagca

SEQ ID NO: 492482 - DNA, 25 bp, Rattus norvegicus
gggaccagtccctatcgacgcgcta

SEQ ID NO: 492483 - DNA, 25 bp, Rattus norvegicus
gcggccgctgaactccgggaccagt

SEQ ID NO: 492484 - DNA, 25 bp, Rattus norvegicus
ccagagctgacctgcacctcggggt

SEQ ID NO: 492485 - DNA, 25 bp, Rattus norvegicus
aaagtttcgcgcgtggagttcgtct

SEQ ID NO: 492486 - DNA, 25 bp, Rattus norvegicus
tactgaaactcagcacggtgcgcga

SEQ ID NO: 492487 - DNA, 25 bp, Rattus norvegicus
ggaccgtatcccagcgcactgggga

SEQ ID NO: 492488 - DNA, 25 bp, Rattus norvegicus
cacacgtgccctgggtcgaccgggt

SEQ ID NO: 492489 - DNA, 25 bp, Rattus norvegicus
gccagtgacccgtggccaaggtcca

SEQ ID NO: 492490 - DNA, 25 bp, Rattus norvegicus
cctctggccagtgtgcgtttgagat

SEQ ID NO: 492491 - DNA, 25 bp, Rattus norvegicus
tgcggacgatggtgaccgatgcact

SEQ ID NO: 492492 - DNA, 25 bp, Rattus norvegicus
tggtgaccgatgcactctatttccc

SEQ ID NO: 492493 - DNA, 25 bp, Rattus norvegicus
gggactctttcccaagtgcacgctc

SEQ ID NO: 492494 - DNA, 25 bp, Rattus norvegicus
atcggggctgcttgtctacctgtag

SEQ ID NO: 492495 - DNA, 25 bp, Rattus norvegicus
ctacctgtagctgttcccgggtgga

SEQ ID NO: 492496 - DNA, 25 bp, Rattus norvegicus
accaagaccctggaggccagtgacc

SEQ ID NO: 492497 - DNA, 25 bp, Rattus norvegicus
tggccaaggtccagcactgtgccct

SEQ ID NO: 492498 - DNA, 25 bp, Rattus norvegicus
ggcgaggctcgcacagacaaacctg

SEQ ID NO: 492499 - DNA, 25 bp, Rattus norvegicus
gacaaacctgccagtccggttcagg

SEQ ID NO: 492500 - DNA, 25 bp, Rattus norvegicus
ttggttggtaagaggctcagacccg

SEQ ID NO: 492501 - DNA, 25 bp, Rattus norvegicus
ctcagacccgggtgcggggactctt

SEQ ID NO: 492502 - DNA, 25 bp, Rattus norvegicus
tcctggcagcaggaagtcgctcgag

SEQ ID NO: 492503 - DNA, 25 bp, Rattus norvegicus
ctgctccgctgtgggcctttgtctg

SEQ ID NO: 492504 - DNA, 25 bp, Rattus norvegicus
tagcctcatccggttctggaggatc

SEQ ID NO: 492505 - DNA, 25 bp, Rattus norvegicus
tgtctgcaaagcctgccatggtgag

SEQ ID NO: 492506 - DNA, 25 bp, Rattus norvegicus
cgggatgtctgcaaagcctgccatg

SEQ ID NO: 492507 - DNA, 25 bp, Rattus norvegicus
gtctgtcccggccatcttagatctg

SEQ ID NO: 492508 - DNA, 25 bp, Rattus norvegicus
gcctttgtctgtcccggccatctta

SEQ ID NO: 492509 - DNA, 25 bp, Rattus norvegicus
cctctgtctcctgtgacagtcgcgg

SEQ ID NO: 492510 - DNA, 25 bp, Rattus norvegicus
cggttctggaggatcggagaccact

SEQ ID NO: 492511 - DNA, 25 bp, Rattus norvegicus
atccggttctggaggatcggagacc

SEQ ID NO: 492512 - DNA, 25 bp, Rattus norvegicus
gtcccggccatcttagatctgtagc

SEQ ID NO: 492513 - DNA, 25 bp, Rattus norvegicus
gccatcttagatctgtagcctcatc

SEQ ID NO: 492514 - DNA, 25 bp, Rattus norvegicus
aggacgcgggatgtctgcaaagcct

SEQ ID NO: 492515 - DNA, 25 bp, Rattus norvegicus
ctgtctcctgtgacagtcgcggcgg

SEQ ID NO: 492516 - DNA, 25 bp, Rattus norvegicus
atctgtagcctcatccggttctgga

SEQ ID NO: 492517 - DNA, 25 bp, Rattus norvegicus
gtacccagccctgttaccgctggga

SEQ ID NO: 492518 - DNA, 25 bp, Rattus norvegicus
agacagtgtcgggtgaccacagcca

SEQ ID NO: 492519 - DNA, 25 bp, Rattus norvegicus
tctgcgttggggacccgaagacaga

SEQ ID NO: 492520 - DNA, 25 bp, Rattus norvegicus
acccgaagacagaggtagccgcgcg

SEQ ID NO: 492521 - DNA, 25 bp, Rattus norvegicus
cgcggagcaaggatgcgctttgcaa

SEQ ID NO: 492522 - DNA, 25 bp, Rattus norvegicus
atgcgctttgcaatcggaggaatgc

SEQ ID NO: 492523 - DNA, 25 bp, Rattus norvegicus
ctggccttgagctcacgtgggcgct

SEQ ID NO: 492524 - DNA, 25 bp, Rattus norvegicus
cgcagcctctcaggagctcggggac

SEQ ID NO: 492525 - DNA, 25 bp, Rattus norvegicus
tgttaccgctgggacagcgcccaca

SEQ ID NO: 492526 - DNA, 25 bp, Rattus norvegicus
tcccgagtccttcgaggccagcagg

SEQ ID NO: 492527 - DNA, 25 bp, Rattus norvegicus
cagggacccgctctgtgtctgcgtt

SEQ ID NO: 492528 - DNA, 25 bp, Rattus norvegicus
ctgcgccgggatgcaaaagccagaa

SEQ ID NO: 492529 - DNA, 25 bp, Rattus norvegicus
aaaagccagaacacgcggaagcgcc

SEQ ID NO: 492530 - DNA, 25 bp, Rattus norvegicus
ccacatcctcaacaccggtttgagg

SEQ ID NO: 492531 - DNA, 25 bp, Rattus norvegicus
tcaccggcgaggacatgaaggtgct

SEQ ID NO: 492532 - DNA, 25 bp, Rattus norvegicus
cgagctcttgggcaccatctccgcc

SEQ ID NO: 492533 - DNA, 25 bp, Rattus norvegicus
atctagagaccgagactccctggta

SEQ ID NO: 492534 - DNA, 25 bp, Rattus norvegicus
ctggaagagcggcaacgactgtaga

SEQ ID NO: 492535 - DNA, 25 bp, Rattus norvegicus
cgagactccctggtattggaacctg

SEQ ID NO: 492536 - DNA, 25 bp, Rattus norvegicus
ctgcacgtgccctaagacggcggct

SEQ ID NO: 492537 - DNA, 25 bp, Rattus norvegicus
cgtgccctaagacggcggctgccag

SEQ ID NO: 492538 - DNA, 25 bp, Rattus norvegicus
gcgcgcagctgtgcatagtcacctc

SEQ ID NO: 492539 - DNA, 25 bp, Rattus norvegicus
agctgtgcatagtcacctcgcaccg

SEQ ID NO: 492540 - DNA, 25 bp, Rattus norvegicus
ccctggtattggaacctggggcctg

SEQ ID NO: 492541 - DNA, 25 bp, Rattus norvegicus
cgggagctcccaggatctagagacc

SEQ ID NO: 492542 - DNA, 25 bp, Rattus norvegicus
gatcctgcagatccacgggagctcc

SEQ ID NO: 492543 - DNA, 25 bp, Rattus norvegicus
gcagctcggtcaccggcgaggacat

SEQ ID NO: 492544 - DNA, 25 bp, Rattus norvegicus
caacgactgtagagcgccggctgtg

SEQ ID NO: 492545 - DNA, 25 bp, Rattus norvegicus
accttctgaccgatcgctgtgggaa

SEQ ID NO: 492546 - DNA, 25 bp, Rattus norvegicus
accaggactcgcgtgttggagctcc

SEQ ID NO: 492547 - DNA, 25 bp, Rattus norvegicus
ttggagctccagaatggcaccaggc

SEQ ID NO: 492548 - DNA, 25 bp, Rattus norvegicus
gtgcccagcaaaccgccgaggtggt

SEQ ID NO: 492549 - DNA, 25 bp, Rattus norvegicus
aggcacaccttctgaccgatcgctg

SEQ ID NO: 492550 - DNA, 25 bp, Rattus norvegicus
gctatggaaagggaagatgaaaccc

SEQ ID NO: 492551 - DNA, 25 bp, Rattus norvegicus
gcagtgaccatgtggcagcccaagg

SEQ ID NO: 492552 - DNA, 25 bp, Rattus norvegicus
caaggacagtgtgctggacccaaac

SEQ ID NO: 492553 - DNA, 25 bp, Rattus norvegicus
ggacccaaacgtggcgcaccacttg

SEQ ID NO: 492554 - DNA, 25 bp, Rattus norvegicus
gcgctttcgagtggagatgctcaaa

SEQ ID NO: 492555 - DNA, 25 bp, Rattus norvegicus
ggcggcaccgtggaaaagccacctc

SEQ ID NO: 492556 - DNA, 25 bp, Rattus norvegicus
ccggcgaaggcgtcacgctatggaa

SEQ ID NO: 492557 - DNA, 25 bp, Rattus norvegicus
ctacatggaaccctggcgctttcga

SEQ ID NO: 492558 - DNA, 25 bp, Rattus norvegicus
agaatggcaccaggcggccaaggcc

SEQ ID NO: 492559 - DNA, 25 bp, Rattus norvegicus
accgagccctgatgtgagagaggaa

SEQ ID NO: 492560 - DNA, 25 bp, Rattus norvegicus
gctcaggaagaccttctcccgcttg

SEQ ID NO: 492561 - DNA, 25 bp, Rattus norvegicus
cggaaaaagtcagatgccaaggacc

SEQ ID NO: 492562 - DNA, 25 bp, Rattus norvegicus
tcagatgccaaggaccgcggtgagt

SEQ ID NO: 492563 - DNA, 25 bp, Rattus norvegicus
gtacgcagcgggacctaatgagcaa

SEQ ID NO: 492564 - DNA, 25 bp, Rattus norvegicus
cctaatgagcaagccgggaccgagc

SEQ ID NO: 492565 - DNA, 25 bp, Rattus norvegicus
tgagagaggaatatggaccggaacc

SEQ ID NO: 492566 - DNA, 25 bp, Rattus norvegicus
ggccacggaccgttatgtgcagctg

SEQ ID NO: 492567 - DNA, 25 bp, Rattus norvegicus
accgttatgtgcagctggccagaga

SEQ ID NO: 492568 - DNA, 25 bp, Rattus norvegicus
tgcagctggccagagatgccagccc

SEQ ID NO: 492569 - DNA, 25 bp, Rattus norvegicus
tgggatccttgcaaggcccagcagg

SEQ ID NO: 492570 - DNA, 25 bp, Rattus norvegicus
ccctgacaggaaatggggcctcgac

SEQ ID NO: 492571 - DNA, 25 bp, Rattus norvegicus
agccgctgctcaggaagaccttctc

SEQ ID NO: 492572 - DNA, 25 bp, Rattus norvegicus
atatggaccggaaccttgtccggcg

SEQ ID NO: 492573 - DNA, 25 bp, Rattus norvegicus
ctggcaaccgtctccgcaggccaca

SEQ ID NO: 492574 - DNA, 25 bp, Rattus norvegicus
ccaggagtcagcagcgctgtggatt

SEQ ID NO: 492575 - DNA, 25 bp, Rattus norvegicus
tggctccggcccaggagtcagcagc

SEQ ID NO: 492576 - DNA, 25 bp, Rattus norvegicus
ggtgctgctgccagcgagacaaaca

SEQ ID NO: 492577 - DNA, 25 bp, Rattus norvegicus
tgcttcggaccggtgctgctgccag

SEQ ID NO: 492578 - DNA, 25 bp, Rattus norvegicus
agaacttggcggtgtgcttcggacc

SEQ ID NO: 492579 - DNA, 25 bp, Rattus norvegicus
cccgcagaacttggcggtgtgcttc

SEQ ID NO: 492580 - DNA, 25 bp, Rattus norvegicus
tccttccacacccacaaccgcatga

SEQ ID NO: 492581 - DNA, 25 bp, Rattus norvegicus
tgcgccttgtctcctccttccacac

SEQ ID NO: 492582 - DNA, 25 bp, Rattus norvegicus
ttctggaccatctgcgccttgtctc

SEQ ID NO: 492583 - DNA, 25 bp, Rattus norvegicus
tgacgcttcttctggaccatctgcg

SEQ ID NO: 492584 - DNA, 25 bp, Rattus norvegicus
acactgacgcttcttctggaccatc

SEQ ID NO: 492585 - DNA, 25 bp, Rattus norvegicus
tcagcagcgctgtggatttcaagcg

SEQ ID NO: 492586 - DNA, 25 bp, Rattus norvegicus
gcaggccacactgacgcttcttctg

SEQ ID NO: 492587 - DNA, 25 bp, Rattus norvegicus
ctggatggcccagaagtggtgactc

SEQ ID NO: 492588 - DNA, 25 bp, Rattus norvegicus
cgtcgcaccgtatttgcggcccaaa

SEQ ID NO: 492589 - DNA, 25 bp, Rattus norvegicus
tgactatgaccacgtgacaggcagc

SEQ ID NO: 492590 - DNA, 25 bp, Rattus norvegicus
cggacctgactatgaccacgtgaca

SEQ ID NO: 492591 - DNA, 25 bp, Rattus norvegicus
tcctgtccggacctgactatgacca

SEQ ID NO: 492592 - DNA, 25 bp, Rattus norvegicus
gggacttcctgtccggacctgacta

SEQ ID NO: 492593 - DNA, 25 bp, Rattus norvegicus
atttactgccgcgtgggcgggactt

SEQ ID NO: 492594 - DNA, 25 bp, Rattus norvegicus
caaccgctatgcaggcgactggagc

SEQ ID NO: 492595 - DNA, 25 bp, Rattus norvegicus
ccaagcaaccgctatgcaggcgact

SEQ ID NO: 492596 - DNA, 25 bp, Rattus norvegicus
gcccagaagtggtgactcggcctcg

SEQ ID NO: 492597 - DNA, 25 bp, Rattus norvegicus
gcacttgccgctggatggcccagaa

SEQ ID NO: 492598 - DNA, 25 bp, Rattus norvegicus
tatttgcggcccaaacgacagccac

SEQ ID NO: 492599 - DNA, 25 bp, Rattus norvegicus
cccagacgtcgcaccgtatttgcgg

SEQ ID NO: 492600 - DNA, 25 bp, Rattus norvegicus
caccgctgcacttgccgctggatgg

SEQ ID NO: 492601 - DNA, 25 bp, Rattus norvegicus
gtcaagggctagctcgagaaggcga

SEQ ID NO: 492602 - DNA, 25 bp, Rattus norvegicus
cgtcccgtgcggttcgtagtgcgcc

SEQ ID NO: 492603 - DNA, 25 bp, Rattus norvegicus
tcgtagtgcgcctgagcgagcttat

SEQ ID NO: 492604 - DNA, 25 bp, Rattus norvegicus
tgcgcctgagcgagcttataacccg

SEQ ID NO: 492605 - DNA, 25 bp, Rattus norvegicus
tgagcgagcttataacccggggttg

SEQ ID NO: 492606 - DNA, 25 bp, Rattus norvegicus
ccgtggcctcagctacagccaggtc

SEQ ID NO: 492607 - DNA, 25 bp, Rattus norvegicus
ttgagacccggtacgcaggctgcgc

SEQ ID NO: 492608 - DNA, 25 bp, Rattus norvegicus
gaggagtggtcggaaccttcttctc

SEQ ID NO: 492609 - DNA, 25 bp, Rattus norvegicus
caggcgccaccgagttaaacagaga

SEQ ID NO: 492610 - DNA, 25 bp, Rattus norvegicus
gtctacagcggaggcctagctagcc

SEQ ID NO: 492611 - DNA, 25 bp, Rattus norvegicus
tctcgtaggccgctcgctaggagcg

SEQ ID NO: 492612 - DNA, 25 bp, Rattus norvegicus
gctaggagcgtccaggcgccaccga

SEQ ID NO: 492613 - DNA, 25 bp, Rattus norvegicus
ttccgccccgttgcgtagcagcagt

SEQ ID NO: 492614 - DNA, 25 bp, Rattus norvegicus
ccaccgagttaaacagagaggcggg

SEQ ID NO: 492615 - DNA, 25 bp, Rattus norvegicus
agccgtttatcattggtcgcttctc

SEQ ID NO: 492616 - DNA, 25 bp, Rattus norvegicus
cgcttctgggtcacatgactcggta

SEQ ID NO: 492617 - DNA, 25 bp, Rattus norvegicus
cgcgagaaccatcccgctgcacgtt

SEQ ID NO: 492618 - DNA, 25 bp, Rattus norvegicus
tcacatgactcggtagtgtgcggtg

SEQ ID NO: 492619 - DNA, 25 bp, Rattus norvegicus
cgtagtccagcgtgacgcgcctgcg

SEQ ID NO: 492620 - DNA, 25 bp, Rattus norvegicus
acgcgcctgcgccaaactggagtct

SEQ ID NO: 492621 - DNA, 25 bp, Rattus norvegicus
ctgcgccaaactggagtcttgctga

SEQ ID NO: 492622 - DNA, 25 bp, Rattus norvegicus
ctggagtcttgctgaaaaagctacc

SEQ ID NO: 492623 - DNA, 25 bp, Rattus norvegicus
tgctgaaaaagctacccgcaagagc

SEQ ID NO: 492624 - DNA, 25 bp, Rattus norvegicus
ccgcaagagccgtttatcattggtc

SEQ ID NO: 492625 - DNA, 25 bp, Rattus norvegicus
ctccctctaattggctaacactaca

SEQ ID NO: 492626 - DNA, 25 bp, Rattus norvegicus
attggctaacactacaccgcgcctt

SEQ ID NO: 492627 - DNA, 25 bp, Rattus norvegicus
gcgccttccacacccgcgagaacca

SEQ ID NO: 492628 - DNA, 25 bp, Rattus norvegicus
aagctacccgcaagagccgtttatc

SEQ ID NO: 492629 - DNA, 25 bp, Rattus norvegicus
cagcacagcttagtttcagcacagg

SEQ ID NO: 492630 - DNA, 25 bp, Rattus norvegicus
tccacgtggcctgcgccacagaagg

SEQ ID NO: 492631 - DNA, 25 bp, Rattus norvegicus
tcacagaagaagtgctccacgtggc

SEQ ID NO: 492632 - DNA, 25 bp, Rattus norvegicus
atgaccaccgtgagatgggccgcgc

SEQ ID NO: 492633 - DNA, 25 bp, Rattus norvegicus
ccggccagcagctgaagggatcctc

SEQ ID NO: 492634 - DNA, 25 bp, Rattus norvegicus
ttagtttcagcacaggcgcgatatc

SEQ ID NO: 492635 - DNA, 25 bp, Rattus norvegicus
gaagggatcctcacgatggctgcca

SEQ ID NO: 492636 - DNA, 25 bp, Rattus norvegicus
ttgagcgaactctcagcacagctta

SEQ ID NO: 492637 - DNA, 25 bp, Rattus norvegicus
gccgagcgccttgagcgaactctca

SEQ ID NO: 492638 - DNA, 25 bp, Rattus norvegicus
gaagaagatgccgagcgccttgagc

SEQ ID NO: 492639 - DNA, 25 bp, Rattus norvegicus
gcacgacgaggatgctcaggaagaa

SEQ ID NO: 492640 - DNA, 25 bp, Rattus norvegicus
aaggagaacagcacgacgaggatgc

SEQ ID NO: 492641 - DNA, 25 bp, Rattus norvegicus
cgatggctgccacgatgaaggcgta

SEQ ID NO: 492642 - DNA, 25 bp, Rattus norvegicus
agcacaggcgcgatatcacagaaga

SEQ ID NO: 492643 - DNA, 25 bp, Rattus norvegicus
cgcacaagcgcatgagaagctagca

SEQ ID NO: 492644 - DNA, 25 bp, Rattus norvegicus
gatccggagagcagtcgtccacgtt

SEQ ID NO: 492645 - DNA, 25 bp, Rattus norvegicus
aaagaacgggacgtcagcgtctgcc

SEQ ID NO: 492646 - DNA, 25 bp, Rattus norvegicus
tcaaagcctgaaagaacgggacgtc

SEQ ID NO: 492647 - DNA, 25 bp, Rattus norvegicus
cacagggtgccctcaaagcctgaaa

SEQ ID NO: 492648 - DNA, 25 bp, Rattus norvegicus
gtccacgtttcgctcacacagggtg

SEQ ID NO: 492649 - DNA, 25 bp, Rattus norvegicus
agcagtcgtccacgtttcgctcaca

SEQ ID NO: 492650 - DNA, 25 bp, Rattus norvegicus
cacaccgcccgtggtgacagggatc

SEQ ID NO: 492651 - DNA, 25 bp, Rattus norvegicus
tgtagcctggcgcacaagcgcatga

SEQ ID NO: 492652 - DNA, 25 bp, Rattus norvegicus
tatgcccgtgtagcctggcgcacaa

SEQ ID NO: 492653 - DNA, 25 bp, Rattus norvegicus
ggctctcgcagcgtatgcccgtgta

SEQ ID NO: 492654 - DNA, 25 bp, Rattus norvegicus
ggcactcatccacctggctctcgca

SEQ ID NO: 492655 - DNA, 25 bp, Rattus norvegicus
gcagggctggctgcggcactcatcc

SEQ ID NO: 492656 - DNA, 25 bp, Rattus norvegicus
gaagctagcaatgccgtcgacacac

SEQ ID NO: 492657 - DNA, 25 bp, Rattus norvegicus
tcgcggccttagctttaggggagac

SEQ ID NO: 492658 - DNA, 25 bp, Rattus norvegicus
ggaccacgggtatcatcgccaggct

SEQ ID NO: 492659 - DNA, 25 bp, Rattus norvegicus
cagtccaggcgtgtagctccactgc

SEQ ID NO: 492660 - DNA, 25 bp, Rattus norvegicus
cttccaaggagggaatggaccagca

SEQ ID NO: 492661 - DNA, 25 bp, Rattus norvegicus
tggaccagcaagaccgacaaggacc

SEQ ID NO: 492662 - DNA, 25 bp, Rattus norvegicus
gacaaggaccaagcgacagagaact

SEQ ID NO: 492663 - DNA, 25 bp, Rattus norvegicus
agcgacagagaactccggagccttc

SEQ ID NO: 492664 - DNA, 25 bp, Rattus norvegicus
ttcacctgtcggcagcagtccaggc

SEQ ID NO: 492665 - DNA, 25 bp, Rattus norvegicus
tctcccgggaggaagacttatggga

SEQ ID NO: 492666 - DNA, 25 bp, Rattus norvegicus
ccggagccggtgattcacctgtcga

SEQ ID NO: 492667 - DNA, 25 bp, Rattus norvegicus
gatctctactctggagcctgggcga

SEQ ID NO: 492668 - DNA, 25 bp, Rattus norvegicus
cactcctaagaggacaggaggattt

SEQ ID NO: 492669 - DNA, 25 bp, Rattus norvegicus
agacttatgggaccggagtgtttgt

SEQ ID NO: 492670 - DNA, 25 bp, Rattus norvegicus
gcagcctcgggcgtattcacctgtc

SEQ ID NO: 492671 - DNA, 25 bp, Rattus norvegicus
agacggcgaagccattgtcccgagc

SEQ ID NO: 492672 - DNA, 25 bp, Rattus norvegicus
ttcaggccctccgtgggtcctgctt

SEQ ID NO: 492673 - DNA, 25 bp, Rattus norvegicus
tgggtcctgctttgtctggcaaaga

SEQ ID NO: 492674 - DNA, 25 bp, Rattus norvegicus
tgtctagacggcgaagccattgtcc

SEQ ID NO: 492675 - DNA, 25 bp, Rattus norvegicus
gacccagaagccagagatgagcacg

SEQ ID NO: 492676 - DNA, 25 bp, Rattus norvegicus
agagatgagcacgtggacctcgccc

SEQ ID NO: 492677 - DNA, 25 bp, Rattus norvegicus
tctgcaagggctccagctcctgctt

SEQ ID NO: 492678 - DNA, 25 bp, Rattus norvegicus
agcgccgggtcttgcagctctccag

SEQ ID NO: 492679 - DNA, 25 bp, Rattus norvegicus
ggtcttgcagctctccagcctgaga

SEQ ID NO: 492680 - DNA, 25 bp, Rattus norvegicus
ctccagcctgagaagttttctcgga

SEQ ID NO: 492681 - DNA, 25 bp, Rattus norvegicus
gagaagttttctcggagttcagagc

SEQ ID NO: 492682 - DNA, 25 bp, Rattus norvegicus
ttcagagctccgagaacttcgcgcc

SEQ ID NO: 492683 - DNA, 25 bp, Rattus norvegicus
ttgtctggcaaagaaagcgcgaggc

SEQ ID NO: 492684 - DNA, 25 bp, Rattus norvegicus
agactgccggatcccggcggcctga

SEQ ID NO: 492685 - DNA, 25 bp, Rattus norvegicus
gggaagattgcgttgtccacccagc

SEQ ID NO: 492686 - DNA, 25 bp, Rattus norvegicus
cgccgagcatctggcgccagcaata

SEQ ID NO: 492687 - DNA, 25 bp, Rattus norvegicus
ggcgccagcaataaggaggagcttc

SEQ ID NO: 492688 - DNA, 25 bp, Rattus norvegicus
gaggtctcagactcccggcaacaca

SEQ ID NO: 492689 - DNA, 25 bp, Rattus norvegicus
ggaagggatcgtgtccttgccaccc

SEQ ID NO: 492690 - DNA, 25 bp, Rattus norvegicus
ctcgggcctcggcaggtaactcttt

SEQ ID NO: 492691 - DNA, 25 bp, Rattus norvegicus
ctgactcggcatccgctgagaacta

SEQ ID NO: 492692 - DNA, 25 bp, Rattus norvegicus
tcacgctgcggctctgcttgcctag

SEQ ID NO: 492693 - DNA, 25 bp, Rattus norvegicus
gggtgcagcccagacacgctgactc

SEQ ID NO: 492694 - DNA, 25 bp, Rattus norvegicus
gggcagcactttcggcgcgaacttg

SEQ ID NO: 492695 - DNA, 25 bp, Rattus norvegicus
tgagaccctccagccaaccgggtgt

SEQ ID NO: 492696 - DNA, 25 bp, Rattus norvegicus
gcaggaactctcctctccttggtcg

SEQ ID NO: 492697 - DNA, 25 bp, Rattus norvegicus
aactctcctgtaggggccgggagct

SEQ ID NO: 492698 - DNA, 25 bp, Rattus norvegicus
aactctttgcggctggtcacgctgc

SEQ ID NO: 492699 - DNA, 25 bp, Rattus norvegicus
attcacgtccgccacaagagatgcg

SEQ ID NO: 492700 - DNA, 25 bp, Rattus norvegicus
tggtacattcacgtccgccacaaga

SEQ ID NO: 492701 - DNA, 25 bp, Rattus norvegicus
gaccttggtacattcacgtccgcca

SEQ ID NO: 492702 - DNA, 25 bp, Rattus norvegicus
gtccgccacaagagatgcgggctta

SEQ ID NO: 492703 - DNA, 25 bp, Rattus norvegicus
gccacaagagatgcgggcttaacct

SEQ ID NO: 492704 - DNA, 25 bp, Rattus norvegicus
ttgcggaccttggtacattcacgtc

SEQ ID NO: 492705 - DNA, 25 bp, Rattus norvegicus
aacttcgccgaagtgaggctgttgg

SEQ ID NO: 492706 - DNA, 25 bp, Rattus norvegicus
cggacttgcggaccttggtacattc

SEQ ID NO: 492707 - DNA, 25 bp, Rattus norvegicus
agatgcgggcttaacctgcgtgacg

SEQ ID NO: 492708 - DNA, 25 bp, Rattus norvegicus
ccaagcggacttgcggaccttggta

SEQ ID NO: 492709 - DNA, 25 bp, Rattus norvegicus
gtacattcacgtccgccacaagaga

SEQ ID NO: 492710 - DNA, 25 bp, Rattus norvegicus
tttacccgccaagcggacttgcgga

SEQ ID NO: 492711 - DNA, 25 bp, Rattus norvegicus
tccctctttcccagggctccgggca

SEQ ID NO: 492712 - DNA, 25 bp, Rattus norvegicus
cgccgccaacttcgccgaagtgagg

SEQ ID NO: 492713 - DNA, 25 bp, Rattus norvegicus
ctcgtagcagcttcagcgacaggcg

SEQ ID NO: 492714 - DNA, 25 bp, Rattus norvegicus
ctacagagccgtggtcggaagactg

SEQ ID NO: 492715 - DNA, 25 bp, Rattus norvegicus
ttgcgctccgggaccactacagagc

SEQ ID NO: 492716 - DNA, 25 bp, Rattus norvegicus
aattccggcatatccttgcgctccg

SEQ ID NO: 492717 - DNA, 25 bp, Rattus norvegicus
tttccaccgtgctgtctgggtccac

SEQ ID NO: 492718 - DNA, 25 bp, Rattus norvegicus
cgagcagcgcggtcaccacaaattc

SEQ ID NO: 492719 - DNA, 25 bp, Rattus norvegicus
caggatcatcaccagcgctcgtagc

SEQ ID NO: 492720 - DNA, 25 bp, Rattus norvegicus
ggcagccaagtacaccaggatcatc

SEQ ID NO: 492721 - DNA, 25 bp, Rattus norvegicus
acgcggctaccaaggcagccaagta

SEQ ID NO: 492722 - DNA, 25 bp, Rattus norvegicus
acgcagctgtagacaaacgcggcta

SEQ ID NO: 492723 - DNA, 25 bp, Rattus norvegicus
acacattggtgagcgcgacgcagct

SEQ ID NO: 492724 - DNA, 25 bp, Rattus norvegicus
cgagggtggcacaacacattggtga

SEQ ID NO: 492725 - DNA, 25 bp, Rattus norvegicus
tgcgcgactcggatagagactgcca

SEQ ID NO: 492726 - DNA, 25 bp, Rattus norvegicus
ggccgaggaaacagatgcgcgactc

SEQ ID NO: 492727 - DNA, 25 bp, Rattus norvegicus
gccagcgcactgatgtcatcacgca

SEQ ID NO: 492728 - DNA, 25 bp, Rattus norvegicus
ccggctccattacgcaatgcaggtt

SEQ ID NO: 492729 - DNA, 25 bp, Rattus norvegicus
acgcaatgcaggttacgcgggccgc

SEQ ID NO: 492730 - DNA, 25 bp, Rattus norvegicus
ggtcctcacctgagacgctaggccg

SEQ ID NO: 492731 - DNA, 25 bp, Rattus norvegicus
atacttagtccacgagcccacccgg

SEQ ID NO: 492732 - DNA, 25 bp, Rattus norvegicus
agagcagaacaaacagccctgccgc

SEQ ID NO: 492733 - DNA, 25 bp, Rattus norvegicus
tcccaggaccagagaacttcgctag

SEQ ID NO: 492734 - DNA, 25 bp, Rattus norvegicus
accagagaacttcgctagagcccgc

SEQ ID NO: 492735 - DNA, 25 bp, Rattus norvegicus
gtggcgcaccggctccattacgcaa

SEQ ID NO: 492736 - DNA, 25 bp, Rattus norvegicus
cgcgccagggcaaaacgcgcaggaa

SEQ ID NO: 492737 - DNA, 25 bp, Rattus norvegicus
ggcaaaacgcgcaggaacggcccgc

SEQ ID NO: 492738 - DNA, 25 bp, Rattus norvegicus
cgcaagcagagagaccagcagtacc

SEQ ID NO: 492739 - DNA, 25 bp, Rattus norvegicus
tcctcacttgacaaaatggcggcgg

SEQ ID NO: 492740 - DNA, 25 bp, Rattus norvegicus
ctcggctgcgggagagcagaacaaa

SEQ ID NO: 492741 - DNA, 25 bp, Rattus norvegicus
caacgtgccgtctgctactggaaga

SEQ ID NO: 492742 - DNA, 25 bp, Rattus norvegicus
ctgctgaggatgagctctgagactc

SEQ ID NO: 492743 - DNA, 25 bp, Rattus norvegicus
gcctcggtgggaaagcactttatta

SEQ ID NO: 492744 - DNA, 25 bp, Rattus norvegicus
tcgcgcacgcgtgaactgttctagc

SEQ ID NO: 492745 - DNA, 25 bp, Rattus norvegicus
agccttccgggttgcaaatctacag

SEQ ID NO: 492746 - DNA, 25 bp, Rattus norvegicus
tattggttgcttaagtaggcccgcc

SEQ ID NO: 492747 - DNA, 25 bp, Rattus norvegicus
acgtctctccttctgggcgctacta

SEQ ID NO: 492748 - DNA, 25 bp, Rattus norvegicus
cccgaataccacatgcagcagagtc

SEQ ID NO: 492749 - DNA, 25 bp, Rattus norvegicus
tccgggccgactacacagaaccagg

SEQ ID NO: 492750 - DNA, 25 bp, Rattus norvegicus
ggaacgattgcgcagaggcccaata

SEQ ID NO: 492751 - DNA, 25 bp, Rattus norvegicus
gagccactggacctgcacggtgaaa

SEQ ID NO: 492752 - DNA, 25 bp, Rattus norvegicus
gccgccattttgtggcgtcttcaga

SEQ ID NO: 492753 - DNA, 25 bp, Rattus norvegicus
gtagctttgctccatgtcttcgaca

SEQ ID NO: 492754 - DNA, 25 bp, Rattus norvegicus
ctgagacagcccaagtcctagggtc

SEQ ID NO: 492755 - DNA, 25 bp, Rattus norvegicus
ctgttaacaaaagcctgcgccgata

SEQ ID NO: 492756 - DNA, 25 bp, Rattus norvegicus
gccgaccgaaagcactgatctcaga

SEQ ID NO: 492757 - DNA, 25 bp, Rattus norvegicus
gccttggacacagaccgctactctg

SEQ ID NO: 492758 - DNA, 25 bp, Rattus norvegicus
acacctcttcgcgacagtggttaga

SEQ ID NO: 492759 - DNA, 25 bp, Rattus norvegicus
ttggcttgtgcaaacctcggacttc

SEQ ID NO: 492760 - DNA, 25 bp, Rattus norvegicus
gtctgacgccacaacaatccctggg

SEQ ID NO: 492761 - DNA, 25 bp, Rattus norvegicus
ccgcagagaacacccgagccttgga

SEQ ID NO: 492762 - DNA, 25 bp, Rattus norvegicus
cctacctgtgtagctcatggccgca

SEQ ID NO: 492763 - DNA, 25 bp, Rattus norvegicus
tgggcgatcctgacaagactcagtc

SEQ ID NO: 492764 - DNA, 25 bp, Rattus norvegicus
agcctaggacgccattttgtgacca

SEQ ID NO: 492765 - DNA, 25 bp, Rattus norvegicus
tgggcttcggctccaaaacgagaac

SEQ ID NO: 492766 - DNA, 25 bp, Rattus norvegicus
gcccgggaactacggtcacagaaga

SEQ ID NO: 492767 - DNA, 25 bp, Rattus norvegicus
tctgcgacgttttgcaccgaaactg

SEQ ID NO: 492768 - DNA, 25 bp, Rattus norvegicus
ctgaggtcactgagagccgaagctt

SEQ ID NO: 492769 - DNA, 25 bp, Rattus norvegicus
agttccacaggaacctgcgtgctgg

SEQ ID NO: 492770 - DNA, 25 bp, Rattus norvegicus
caggaatggttggaaggaacttatt

SEQ ID NO: 492771 - DNA, 25 bp, Rattus norvegicus
cttacagaaagggtccgcacggcga

SEQ ID NO: 492772 - DNA, 25 bp, Rattus norvegicus
cacggaggtgcatacccggagcagc

SEQ ID NO: 492773 - DNA, 25 bp, Rattus norvegicus
ggagcagctccctccgtcgtacttt

SEQ ID NO: 492774 - DNA, 25 bp, Rattus norvegicus
gtcgtactttcgcaccataacattc

SEQ ID NO: 492775 - DNA, 25 bp, Rattus norvegicus
acattcgagactggctcggggaatc

SEQ ID NO: 492776 - DNA, 25 bp, Rattus norvegicus
gccgactcctaaatcggaggcgatt

SEQ ID NO: 492777 - DNA, 25 bp, Rattus norvegicus
aggcgattggtgagaaccgaagata

SEQ ID NO: 492778 - DNA, 25 bp, Rattus norvegicus
ctaactcccgggtggcatcaggggt

SEQ ID NO: 492779 - DNA, 25 bp, Rattus norvegicus
ctcgtgtattgaaacaggaatggtt

SEQ ID NO: 492780 - DNA, 25 bp, Rattus norvegicus
cttattggagcgaaagagttccaca

SEQ ID NO: 492781 - DNA, 25 bp, Rattus norvegicus
tggggtggaacagtaagcccactcc

SEQ ID NO: 492782 - DNA, 25 bp, Rattus norvegicus
ggagcgtcagggatactcgtgtatt

SEQ ID NO: 492783 - DNA, 25 bp, Rattus norvegicus
ccgaggagcgactgcagagtgcttc

SEQ ID NO: 492784 - DNA, 25 bp, Rattus norvegicus
aggagcgactgcagagtgcttccga

SEQ ID NO: 492785 - DNA, 25 bp, Rattus norvegicus
tccgaagcctgggaccctccaggag

SEQ ID NO: 492786 - DNA, 25 bp, Rattus norvegicus
cgaagcctgggaccctccaggaggc

SEQ ID NO: 492787 - DNA, 25 bp, Rattus norvegicus
agcctgggaccctccaggaggctga

SEQ ID NO: 492788 - DNA, 25 bp, Rattus norvegicus
ggaggctgagagaggcccagggccc

SEQ ID NO: 492789 - DNA, 25 bp, Rattus norvegicus
cccagggcccgagcgcctgaggtgg

SEQ ID NO: 492790 - DNA, 25 bp, Rattus norvegicus
ccacagagatcggacggcgggtgtt

SEQ ID NO: 492791 - DNA, 25 bp, Rattus norvegicus
gttgagggtggcgacggcacactcc

SEQ ID NO: 492792 - DNA, 25 bp, Rattus norvegicus
gcacactccggagggacgccgactt

SEQ ID NO: 492793 - DNA, 25 bp, Rattus norvegicus
ctccgccaactcttacccggagcgg

SEQ ID NO: 492794 - DNA, 25 bp, Rattus norvegicus
caactcttacccggagcgggcgcgg

SEQ ID NO: 492795 - DNA, 25 bp, Rattus norvegicus
tcccgaggagcgactgcagagtgct

SEQ ID NO: 492796 - DNA, 25 bp, Rattus norvegicus
ggagcgactgcagagtgcttccgaa

SEQ ID NO: 492797 - DNA, 25 bp, Rattus norvegicus
taccgctggggtaggcactgccgga

SEQ ID NO: 492798 - DNA, 25 bp, Rattus norvegicus
gctagggtccccaggatgcgccctt

SEQ ID NO: 492799 - DNA, 25 bp, Rattus norvegicus
gcaccctgcggggaagctagggtcc

SEQ ID NO: 492800 - DNA, 25 bp, Rattus norvegicus
ctgcgcggacgcaccctgcggggaa

SEQ ID NO: 492801 - DNA, 25 bp, Rattus norvegicus
cccacctcccgcaggggtcgcagag

SEQ ID NO: 492802 - DNA, 25 bp, Rattus norvegicus
tccagtccagatggtcgttccctac

SEQ ID NO: 492803 - DNA, 25 bp, Rattus norvegicus
gggctccagtccagatggtcgttcc

SEQ ID NO: 492804 - DNA, 25 bp, Rattus norvegicus
cttcggagcactttggcagcttggg

SEQ ID NO: 492805 - DNA, 25 bp, Rattus norvegicus
gcaacttcggagcactttggcagct

SEQ ID NO: 492806 - DNA, 25 bp, Rattus norvegicus
accgcaacttcggagcactttggca

SEQ ID NO: 492807 - DNA, 25 bp, Rattus norvegicus
ggaccgcaacttcggagcactttgg

SEQ ID NO: 492808 - DNA, 25 bp, Rattus norvegicus
gcaggaccgcaacttcggagcactt

SEQ ID NO: 492809 - DNA, 25 bp, Rattus norvegicus
ggatgcgcccttcgcccgtgcacct

SEQ ID NO: 492810 - DNA, 25 bp, Rattus norvegicus
gatcgggcaggaccgcaacttcgga

SEQ ID NO: 492811 - DNA, 25 bp, Rattus norvegicus
ctggctcctcaactgggaattttaa

SEQ ID NO: 492812 - DNA, 25 bp, Rattus norvegicus
actgcagctcttggtgcgggtgcca

SEQ ID NO: 492813 - DNA, 25 bp, Rattus norvegicus
cgccgccatgatgaggaggtctgcc

SEQ ID NO: 492814 - DNA, 25 bp, Rattus norvegicus
ccgccatattgggagtggccaagca

SEQ ID NO: 492815 - DNA, 25 bp, Rattus norvegicus
tggccaagcaggtcacccttaaagg

SEQ ID NO: 492816 - DNA, 25 bp, Rattus norvegicus
ccactgggtcttcctatactaggtt

SEQ ID NO: 492817 - DNA, 25 bp, Rattus norvegicus
aagcctagtctccacccagaacgtg

SEQ ID NO: 492818 - DNA, 25 bp, Rattus norvegicus
tctttgtttccggaagcctagtctc

SEQ ID NO: 492819 - DNA, 25 bp, Rattus norvegicus
cccgcaggaccttagcgtcgaggga

SEQ ID NO: 492820 - DNA, 25 bp, Rattus norvegicus
gatctagtcggtttcagcactgcta

SEQ ID NO: 492821 - DNA, 25 bp, Rattus norvegicus
cgatctgaacgaactctggctcctc

SEQ ID NO: 492822 - DNA, 25 bp, Rattus norvegicus
ggaggggctctgttaccatgacaac

SEQ ID NO: 492823 - DNA, 25 bp, Rattus norvegicus
cccagaacgtggatgactgcagctc

SEQ ID NO: 492824 - DNA, 25 bp, Rattus norvegicus
tcagcactgctagactctttgtttc

SEQ ID NO: 492825 - DNA, 25 bp, Rattus norvegicus
tcatctggaccgcatgtcaccttgc

SEQ ID NO: 492826 - DNA, 25 bp, Rattus norvegicus
ctctgtgtgcgcagcactggccgcg

SEQ ID NO: 492827 - DNA, 25 bp, Rattus norvegicus
cgtctggcagggacgctctgtgtgc

SEQ ID NO: 492828 - DNA, 25 bp, Rattus norvegicus
tttgggtcgaggcttggaacccgca

SEQ ID NO: 492829 - DNA, 25 bp, Rattus norvegicus
ccagtgcgtagagagcctttgggtc

SEQ ID NO: 492830 - DNA, 25 bp, Rattus norvegicus
caggaccagtgcgtagagagccttt

SEQ ID NO: 492831 - DNA, 25 bp, Rattus norvegicus
tccggaagtcgcaggaccagtgcgt

SEQ ID NO: 492832 - DNA, 25 bp, Rattus norvegicus
caggcccgtccggaagtcgcaggac

SEQ ID NO: 492833 - DNA, 25 bp, Rattus norvegicus
caccgatggcttccgaggtagagag

SEQ ID NO: 492834 - DNA, 25 bp, Rattus norvegicus
ccagttggcgctgccaaggcaccga

SEQ ID NO: 492835 - DNA, 25 bp, Rattus norvegicus
gtccagttggcgctgccaaggcacc

SEQ ID NO: 492836 - DNA, 25 bp, Rattus norvegicus
ccactggtcggtgcgttcccggagt

SEQ ID NO: 492837 - DNA, 25 bp, Rattus norvegicus
tgtcaccttgcccactggtcggtgc

SEQ ID NO: 492838 - DNA, 25 bp, Rattus norvegicus
gcatgtcaccttgcccactggtcgg

SEQ ID NO: 492839 - DNA, 25 bp, Rattus norvegicus
cgtcccacccgcctccctcgatccg

SEQ ID NO: 492840 - DNA, 25 bp, Rattus norvegicus
ctcctcggcctactgaaaccaatga

SEQ ID NO: 492841 - DNA, 25 bp, Rattus norvegicus
cgctcgtagcccgaccggctctccc

SEQ ID NO: 492842 - DNA, 25 bp, Rattus norvegicus
atcgccctggacctctgggagcgtc

SEQ ID NO: 492843 - DNA, 25 bp, Rattus norvegicus
tgccaatcgccctggacctctggga

SEQ ID NO: 492844 - DNA, 25 bp, Rattus norvegicus
tgttagctcctctcctagagctcca

SEQ ID NO: 492845 - DNA, 25 bp, Rattus norvegicus
tgttctgtcgacctgttagctcctc

SEQ ID NO: 492846 - DNA, 25 bp, Rattus norvegicus
atcagcacgctgtctgttctgtcga

SEQ ID NO: 492847 - DNA, 25 bp, Rattus norvegicus
gctgcccaatcagcacgctgtctgt

SEQ ID NO: 492848 - DNA, 25 bp, Rattus norvegicus
gagcgtccagatctggtccagctcc

SEQ ID NO: 492849 - DNA, 25 bp, Rattus norvegicus
gacgagctgagacgcgctcccgccc

SEQ ID NO: 492850 - DNA, 25 bp, Rattus norvegicus
tcgacctgttagctcctctcctaga

SEQ ID NO: 492851 - DNA, 25 bp, Rattus norvegicus
gtccagctccttccgtgctgcccaa

SEQ ID NO: 492852 - DNA, 25 bp, Rattus norvegicus
cgctgtctgttctgtcgacctgtta

SEQ ID NO: 492853 - DNA, 25 bp, Rattus norvegicus
taactccttatagcgctccgacggc

SEQ ID NO: 492854 - DNA, 25 bp, Rattus norvegicus
cccagaagagttggtcagggcccgc

SEQ ID NO: 492855 - DNA, 25 bp, Rattus norvegicus
aagtggaagcgttcggcccagaaga

SEQ ID NO: 492856 - DNA, 25 bp, Rattus norvegicus
tggcaacgcctcgaagtggaagcgt

SEQ ID NO: 492857 - DNA, 25 bp, Rattus norvegicus
tgctcacctcgtccagttctagtac

SEQ ID NO: 492858 - DNA, 25 bp, Rattus norvegicus
gggatgctcacctcgtccagttcta

SEQ ID NO: 492859 - DNA, 25 bp, Rattus norvegicus
cgagcacggggaaccagcgctccag

SEQ ID NO: 492860 - DNA, 25 bp, Rattus norvegicus
ctcggccagtggctcgtagcacgcg

SEQ ID NO: 492861 - DNA, 25 bp, Rattus norvegicus
ttatagcgctccgacggcagcacgc

SEQ ID NO: 492862 - DNA, 25 bp, Rattus norvegicus
tgaggaactccgctaactccttata

SEQ ID NO: 492863 - DNA, 25 bp, Rattus norvegicus
tagtggaaggtgaggaactccgcta

SEQ ID NO: 492864 - DNA, 25 bp, Rattus norvegicus
cctgagcagacagcgcgggctccag

SEQ ID NO: 492865 - DNA, 25 bp, Rattus norvegicus
gtagcacgcgcaccatggctgctgc

SEQ ID NO: 492866 - DNA, 25 bp, Rattus norvegicus
agcacgcgcagacatcgtaccctga

SEQ ID NO: 492867 - DNA, 25 bp, Rattus norvegicus
cgcttccgcctgagcgtggaccgaa

SEQ ID NO: 492868 - DNA, 25 bp, Rattus norvegicus
tcgtggcgctgacactcctgcgctt

SEQ ID NO: 492869 - DNA, 25 bp, Rattus norvegicus
cccaagatattgaggacgttgacta

SEQ ID NO: 492870 - DNA, 25 bp, Rattus norvegicus
gcctgagcgtggaccgaacccgcaa

SEQ ID NO: 492871 - DNA, 25 bp, Rattus norvegicus
cgaacccgcaaggtgcggaggaagc

SEQ ID NO: 492872 - DNA, 25 bp, Rattus norvegicus
cggaggaagccggagcttattctac

SEQ ID NO: 492873 - DNA, 25 bp, Rattus norvegicus
ccggagcttattctacgcacggaga

SEQ ID NO: 492874 - DNA, 25 bp, Rattus norvegicus
agaacggcctttggctcaacgtgga

SEQ ID NO: 492875 - DNA, 25 bp, Rattus norvegicus
cagagcttcgccatggcagagatgc

SEQ ID NO: 492876 - DNA, 25 bp, Rattus norvegicus
tttggctcaacgtggagccgctacc

SEQ ID NO: 492877 - DNA, 25 bp, Rattus norvegicus
aacgtggagccgctaccctcgcggg

SEQ ID NO: 492878 - DNA, 25 bp, Rattus norvegicus
tagaccacgcctccaaaggcctgga

SEQ ID NO: 492879 - DNA, 25 bp, Rattus norvegicus
ttgaggacgttgactacgctcctcg

SEQ ID NO: 492880 - DNA, 25 bp, Rattus norvegicus
ttctacgcacggagaacggcctttg

SEQ ID NO: 492881 - DNA, 25 bp, Rattus norvegicus
agtctcaccgcgacgctgctgccac

SEQ ID NO: 492882 - DNA, 25 bp, Rattus norvegicus
cctagggaggccatggccgcagtac

SEQ ID NO: 492883 - DNA, 25 bp, Rattus norvegicus
ccatggccgcagtactgagctatca

SEQ ID NO: 492884 - DNA, 25 bp, Rattus norvegicus
actgagctatcagcgagggaccgga

SEQ ID NO: 492885 - DNA, 25 bp, Rattus norvegicus
accggacagcggctctgcttgctgg

SEQ ID NO: 492886 - DNA, 25 bp, Rattus norvegicus
agcggctctgcttgctggcccagct

SEQ ID NO: 492887 - DNA, 25 bp, Rattus norvegicus
caagatgagacgcagactcagctgc

SEQ ID NO: 492888 - DNA, 25 bp, Rattus norvegicus
gcccagcggagcaagatgagacgca

SEQ ID NO: 492889 - DNA, 25 bp, Rattus norvegicus
gcacgcaccatttccagttaccggg

SEQ ID NO: 492890 - DNA, 25 bp, Rattus norvegicus
cagctgccctggaaggccgcgtccc

SEQ ID NO: 492891 - DNA, 25 bp, Rattus norvegicus
ctccgcttccagcagcctcctccca

SEQ ID NO: 492892 - DNA, 25 bp, Rattus norvegicus
cagttaccgggtgtcctactgttct

SEQ ID NO: 492893 - DNA, 25 bp, Rattus norvegicus
tccacccagaggaacccgggctgtg

SEQ ID NO: 492894 - DNA, 25 bp, Rattus norvegicus
tgtcctactgttctccggcggctct

SEQ ID NO: 492895 - DNA, 25 bp, Rattus norvegicus
aagcgcagcagcgtcagcgccagcg

SEQ ID NO: 492896 - DNA, 25 bp, Rattus norvegicus
tcctatgcagttcctgcgggagaac

SEQ ID NO: 492897 - DNA, 25 bp, Rattus norvegicus
gactctgactgtgcggagacctagc

SEQ ID NO: 492898 - DNA, 25 bp, Rattus norvegicus
ggagacctagccagacgtcctcgga

SEQ ID NO: 492899 - DNA, 25 bp, Rattus norvegicus
agacgtcctcggaccctctcagggg

SEQ ID NO: 492900 - DNA, 25 bp, Rattus norvegicus
ggcgaaagtctgtcctatgcagttc

SEQ ID NO: 492901 - DNA, 25 bp, Rattus norvegicus
tcgctcatggcgaaagtctgtccta

SEQ ID NO: 492902 - DNA, 25 bp, Rattus norvegicus
agcgccacctttatctcgctcatgg

SEQ ID NO: 492903 - DNA, 25 bp, Rattus norvegicus
ggttccacccgcagccacagtccgc

SEQ ID NO: 492904 - DNA, 25 bp, Rattus norvegicus
acagtccgccctccgcacgcaggat

SEQ ID NO: 492905 - DNA, 25 bp, Rattus norvegicus
acgcaggatcagctccggcttccgg

SEQ ID NO: 492906 - DNA, 25 bp, Rattus norvegicus
cggcgcggctccttgtcatctggca

SEQ ID NO: 492907 - DNA, 25 bp, Rattus norvegicus
agtctgtcctatgcagttcctgcgg

SEQ ID NO: 492908 - DNA, 25 bp, Rattus norvegicus
tcatctggcaggacgcagaagcgca

SEQ ID NO: 492909 - DNA, 25 bp, Rattus norvegicus
acgtgcctgactcggatgcctagac

SEQ ID NO: 492910 - DNA, 25 bp, Rattus norvegicus
ctcggttaagtcctcaggctccaga

SEQ ID NO: 492911 - DNA, 25 bp, Rattus norvegicus
agctcggttaagtcctcaggctcca

SEQ ID NO: 492912 - DNA, 25 bp, Rattus norvegicus
gcccttgggactttggcaccgcacg

SEQ ID NO: 492913 - DNA, 25 bp, Rattus norvegicus
ggagctcggttaagtcctcaggctc

SEQ ID NO: 492914 - DNA, 25 bp, Rattus norvegicus
ttgggactttggcaccgcacggtgc

SEQ ID NO: 492915 - DNA, 25 bp, Rattus norvegicus
gcctgactcggatgcctagacatga

SEQ ID NO: 492916 - DNA, 25 bp, Rattus norvegicus
tacgacgtgcctgactcggatgcct

SEQ ID NO: 492917 - DNA, 25 bp, Rattus norvegicus
ctgggctacgacgtgcctgactcgg

SEQ ID NO: 492918 - DNA, 25 bp, Rattus norvegicus
gactcggatgcctagacatgagatg

SEQ ID NO: 492919 - DNA, 25 bp, Rattus norvegicus
gcaccgcacggtgcgtgcagggcca

SEQ ID NO: 492920 - DNA, 25 bp, Rattus norvegicus
cagggccaagacgtgagaacgccag

SEQ ID NO: 492921 - DNA, 25 bp, Rattus norvegicus
actttggcaccgcacggtgcgtgca

SEQ ID NO: 492922 - DNA, 25 bp, Rattus norvegicus
tgcagggccaagacgtgagaacgcc

SEQ ID NO: 492923 - DNA, 25 bp, Rattus norvegicus
ccaggcctccccagtgctttgtgta

SEQ ID NO: 492924 - DNA, 25 bp, Rattus norvegicus
acgtccggagacagatggcagagca

SEQ ID NO: 492925 - DNA, 25 bp, Rattus norvegicus
tgtacgtccggagacagatggcaga

SEQ ID NO: 492926 - DNA, 25 bp, Rattus norvegicus
tgtgtacgtccggagacagatggca

SEQ ID NO: 492927 - DNA, 25 bp, Rattus norvegicus
ctttgtgtacgtccggagacagatg

SEQ ID NO: 492928 - DNA, 25 bp, Rattus norvegicus
tgctttgtgtacgtccggagacaga

SEQ ID NO: 492929 - DNA, 25 bp, Rattus norvegicus
agtgctttgtgtacgtccggagaca

SEQ ID NO: 492930 - DNA, 25 bp, Rattus norvegicus
cccagtgctttgtgtacgtccggag

SEQ ID NO: 492931 - DNA, 25 bp, Rattus norvegicus
ccgagccagacaccggcgcggccca

SEQ ID NO: 492932 - DNA, 25 bp, Rattus norvegicus
ttctccgctccggtgtgcgagccgc

SEQ ID NO: 492933 - DNA, 25 bp, Rattus norvegicus
ccgcgcgccttctccgctccggtgt

SEQ ID NO: 492934 - DNA, 25 bp, Rattus norvegicus
ctgccctggtgcagcccgcggcttg

SEQ ID NO: 492935 - DNA, 25 bp, Rattus norvegicus
cagagcaggagggtagacaggcgcg

SEQ ID NO: 492936 - DNA, 25 bp, Rattus norvegicus
cagtgctttgtgtacgtccggagac

SEQ ID NO: 492937 - DNA, 25 bp, Rattus norvegicus
ttcttcctggcacgtactggtcagc

SEQ ID NO: 492938 - DNA, 25 bp, Rattus norvegicus
cgtgctgtgcggttgccaacactag

SEQ ID NO: 492939 - DNA, 25 bp, Rattus norvegicus
ggtcctctttggctcggtaacagcg

SEQ ID NO: 492940 - DNA, 25 bp, Rattus norvegicus
cctatggtcctctttggctcggtaa

SEQ ID NO: 492941 - DNA, 25 bp, Rattus norvegicus
ctggcacgtactggtcagctgcgag

SEQ ID NO: 492942 - DNA, 25 bp, Rattus norvegicus
gcggttgccaacactaggatcattg

SEQ ID NO: 492943 - DNA, 25 bp, Rattus norvegicus
caggaacgccggcagaaagcggata

SEQ ID NO: 492944 - DNA, 25 bp, Rattus norvegicus
ctgtccaatcaggaacgccggcaga

SEQ ID NO: 492945 - DNA, 25 bp, Rattus norvegicus
tatggtaaacgtccctgcggccagc

SEQ ID NO: 492946 - DNA, 25 bp, Rattus norvegicus
ggcccagatatggtaaacgtccctg

SEQ ID NO: 492947 - DNA, 25 bp, Rattus norvegicus
tttgggcccagatatggtaaacgtc

SEQ ID NO: 492948 - DNA, 25 bp, Rattus norvegicus
ccaggaagctttgggcccagatatg

SEQ ID NO: 492949 - DNA, 25 bp, Rattus norvegicus
aacactaggatcattgttcgggccc

SEQ ID NO: 492950 - DNA, 25 bp, Rattus norvegicus
gagggctgcgcctatggtcctcttt

SEQ ID NO: 492951 - DNA, 25 bp, Rattus norvegicus
agagagtcctgtgggatctttcgcc

SEQ ID NO: 492952 - DNA, 25 bp, Rattus norvegicus
tctccaggaacagacatggtgagcg

SEQ ID NO: 492953 - DNA, 25 bp, Rattus norvegicus
ccaggaacagacatggtgagcgtga

SEQ ID NO: 492954 - DNA, 25 bp, Rattus norvegicus
ggcctcccgtaagtcctcgatctga

SEQ ID NO: 492955 - DNA, 25 bp, Rattus norvegicus
tcctcgatctgaggcagacaccgtc

SEQ ID NO: 492956 - DNA, 25 bp, Rattus norvegicus
tagctctcaatccttggctccttga

SEQ ID NO: 492957 - DNA, 25 bp, Rattus norvegicus
ctcaatccttggctccttgagccga

SEQ ID NO: 492958 - DNA, 25 bp, Rattus norvegicus
ctccttgagccgatgggactccatc

SEQ ID NO: 492959 - DNA, 25 bp, Rattus norvegicus
tgggactccatcgttttatcacccg

SEQ ID NO: 492960 - DNA, 25 bp, Rattus norvegicus
tatcacccggttttctatcggcagc

SEQ ID NO: 492961 - DNA, 25 bp, Rattus norvegicus
ccggttttctatcggcagctccgtc

SEQ ID NO: 492962 - DNA, 25 bp, Rattus norvegicus
ttttctatcggcagctccgtcctcg

SEQ ID NO: 492963 - DNA, 25 bp, Rattus norvegicus
tgaggccgcaggagtctccaggaac

SEQ ID NO: 492964 - DNA, 25 bp, Rattus norvegicus
ggggtggtatagctctcaatccttg

SEQ ID NO: 492965 - DNA, 25 bp, Rattus norvegicus
gcggagcgcgactgagttataataa

SEQ ID NO: 492966 - DNA, 25 bp, Rattus norvegicus
accgctaaccaggtcgttcgcactg

SEQ ID NO: 492967 - DNA, 25 bp, Rattus norvegicus
aaccaggtcgttcgcactgcccgtg

SEQ ID NO: 492968 - DNA, 25 bp, Rattus norvegicus
ggagcgcgactgagttataataacg

SEQ ID NO: 492969 - DNA, 25 bp, Rattus norvegicus
ctacagagctaaagcgcggagcgcg

SEQ ID NO: 492970 - DNA, 25 bp, Rattus norvegicus
ctaggtcactacagagctaaagcgc

SEQ ID NO: 492971 - DNA, 25 bp, Rattus norvegicus
gctggactaggtcactacagagcta

SEQ ID NO: 492972 - DNA, 25 bp, Rattus norvegicus
ctcgctcagtttagaactggaattc

SEQ ID NO: 492973 - DNA, 25 bp, Rattus norvegicus
ccgcagcacgcttggaacctcgggg

SEQ ID NO: 492974 - DNA, 25 bp, Rattus norvegicus
ttcaacggccgcagcacgcttggaa

SEQ ID NO: 492975 - DNA, 25 bp, Rattus norvegicus
actggaattcaacggccgcagcacg

SEQ ID NO: 492976 - DNA, 25 bp, Rattus norvegicus
tccgtggagcgccatctgtctgctg

SEQ ID NO: 492977 - DNA, 25 bp, Rattus norvegicus
cgtgctgcccacaactcccaaaatc

SEQ ID NO: 492978 - DNA, 25 bp, Rattus norvegicus
cctcgtctctctcgctcagtttaga

SEQ ID NO: 492979 - DNA, 25 bp, Rattus norvegicus
atcccagcggtgcagcgggccgctt

SEQ ID NO: 492980 - DNA, 25 bp, Rattus norvegicus
ggcagcccaggtaagcgttcgcccg

SEQ ID NO: 492981 - DNA, 25 bp, Rattus norvegicus
tctcacggagatggcagacgatctg

SEQ ID NO: 492982 - DNA, 25 bp, Rattus norvegicus
gctcgcgtccgggtctcacggagat

SEQ ID NO: 492983 - DNA, 25 bp, Rattus norvegicus
tcatctggttgtcagctcgcgtccg

SEQ ID NO: 492984 - DNA, 25 bp, Rattus norvegicus
cagcgggccgctttgcattcatctg

SEQ ID NO: 492985 - DNA, 25 bp, Rattus norvegicus
ctctgaagctgatcccagcggtgca

SEQ ID NO: 492986 - DNA, 25 bp, Rattus norvegicus
ctaacgcggactctgaagctgatcc

SEQ ID NO: 492987 - DNA, 25 bp, Rattus norvegicus
tgcagcgttgctaacgcggactctg

SEQ ID NO: 492988 - DNA, 25 bp, Rattus norvegicus
tttcctcgtgcagcgttgctaacgc

SEQ ID NO: 492989 - DNA, 25 bp, Rattus norvegicus
cttggtttttcctcgtgcagcgttg

SEQ ID NO: 492990 - DNA, 25 bp, Rattus norvegicus
cgcagaagaccgcgttccttggttt

SEQ ID NO: 492991 - DNA, 25 bp, Rattus norvegicus
gccacggctcccttgccggtgagtg

SEQ ID NO: 492992 - DNA, 25 bp, Rattus norvegicus
ttgcattcatctggttgtcagctcg

SEQ ID NO: 492993 - DNA, 25 bp, Rattus norvegicus
gccctgggctccttgaatcgtttgt

SEQ ID NO: 492994 - DNA, 25 bp, Rattus norvegicus
tgagtgtgccctgggctccttgaat

SEQ ID NO: 492995 - DNA, 25 bp, Rattus norvegicus
atgcatcggaagcagaagatggtga

SEQ ID NO: 492996 - DNA, 25 bp, Rattus norvegicus
acacctggatgcatcggaagcagaa

SEQ ID NO: 492997 - DNA, 25 bp, Rattus norvegicus
cttagggaggacacctggatgcatc

SEQ ID NO: 492998 - DNA, 25 bp, Rattus norvegicus
tgtgctccatcgaccttgttgactg

SEQ ID NO: 492999 - DNA, 25 bp, Rattus norvegicus
tgactgtgttttcgcttagggagga

SEQ ID NO: 493000 - DNA, 25 bp, Rattus norvegicus
cagtcgccaatcaggaaagctgtta

SEQ ID NO: 493001 - DNA, 25 bp, Rattus norvegicus
ttttcgcttagggaggacacctgga

SEQ ID NO: 493002 - DNA, 25 bp, Rattus norvegicus
tgagaggtgtgctccatcgaccttg

SEQ ID NO: 493003 - DNA, 25 bp, Rattus norvegicus
ccttgaatcgtttgtggcgggtttg

SEQ ID NO: 493004 - DNA, 25 bp, Rattus norvegicus
cccgcttatcagtcgccaatcagga

SEQ ID NO: 493005 - DNA, 25 bp, Rattus norvegicus
catcgaccttgttgactgtgttttc

SEQ ID NO: 493006 - DNA, 25 bp, Rattus norvegicus
tcaggaaagctgttacgacttagca

SEQ ID NO: 493007 - DNA, 25 bp, Rattus norvegicus
gacttcagaagccaccacgcactca

SEQ ID NO: 493008 - DNA, 25 bp, Rattus norvegicus
caccatttccagcttcggacgcatg

SEQ ID NO: 493009 - DNA, 25 bp, Rattus norvegicus
aaagtctgccgggtgcatgtccatc

SEQ ID NO: 493010 - DNA, 25 bp, Rattus norvegicus
gtgcatgtccatcgcgcggattccc

SEQ ID NO: 493011 - DNA, 25 bp, Rattus norvegicus
gcgcggattccccatgataacctgg

SEQ ID NO: 493012 - DNA, 25 bp, Rattus norvegicus
ggggaccgagagaaagcagtttcac

SEQ ID NO: 493013 - DNA, 25 bp, Rattus norvegicus
aaagcagtttcacagcgacaggaca

SEQ ID NO: 493014 - DNA, 25 bp, Rattus norvegicus
cacagcgacaggacaggaagagctc

SEQ ID NO: 493015 - DNA, 25 bp, Rattus norvegicus
gacaggacaggaagagctccgactc

SEQ ID NO: 493016 - DNA, 25 bp, Rattus norvegicus
aggccgcggcccacgacttcagaag

SEQ ID NO: 493017 - DNA, 25 bp, Rattus norvegicus
ttcggacgcatgcagaggtccttcg

SEQ ID NO: 493018 - DNA, 25 bp, Rattus norvegicus
tccagcttcggacgcatgcagaggt

SEQ ID NO: 493019 - DNA, 25 bp, Rattus norvegicus
aacccgtccgcgctgcaaagtctgc

SEQ ID NO: 493020 - DNA, 25 bp, Rattus norvegicus
acaggaagagctccgactcccgggt

SEQ ID NO: 493021 - DNA, 25 bp, Rattus norvegicus
tgctaagtcgtaacagctttcctga

SEQ ID NO: 493022 - DNA, 25 bp, Rattus norvegicus
caaggtcgatggagcacacctctca

SEQ ID NO: 493023 - DNA, 25 bp, Rattus norvegicus
cagtcaacaaggtcgatggagcaca

SEQ ID NO: 493024 - DNA, 25 bp, Rattus norvegicus
aacagctttcctgattggcgactga

SEQ ID NO: 493025 - DNA, 25 bp, Rattus norvegicus
caggtgtcctccctaagcgaaaaca

SEQ ID NO: 493026 - DNA, 25 bp, Rattus norvegicus
attcaaggagcccagggcacactca

SEQ ID NO: 493027 - DNA, 25 bp, Rattus norvegicus
tccctaagcgaaaacacagtcaaca

SEQ ID NO: 493028 - DNA, 25 bp, Rattus norvegicus
tcctgattggcgactgataagcggg

SEQ ID NO: 493029 - DNA, 25 bp, Rattus norvegicus
tgcatccaggtgtcctccctaagcg

SEQ ID NO: 493030 - DNA, 25 bp, Rattus norvegicus
agtcaccgcagtgtcacaaacccgc

SEQ ID NO: 493031 - DNA, 25 bp, Rattus norvegicus
aacgattcaaggagcccagggcaca

SEQ ID NO: 493032 - DNA, 25 bp, Rattus norvegicus
tcaccatcttctgcttccgatgcat

SEQ ID NO: 493033 - DNA, 25 bp, Rattus norvegicus
tctgcttccgatgcatccaggtgtc

SEQ ID NO: 493034 - DNA, 25 bp, Rattus norvegicus
caaacccgccacaaacgattcaagg

SEQ ID NO: 493035 - DNA, 25 bp, Rattus norvegicus
agatgttgatatcccaagaacgctc

SEQ ID NO: 493036 - DNA, 25 bp, Rattus norvegicus
gacaccgctccgagagagcacttga

SEQ ID NO: 493037 - DNA, 25 bp, Rattus norvegicus
agagagcacttgagcacttcatcgg

SEQ ID NO: 493038 - DNA, 25 bp, Rattus norvegicus
cttggctcccggagagcacttgagc

SEQ ID NO: 493039 - DNA, 25 bp, Rattus norvegicus
ggagagcacttgagcacttcatcgg

SEQ ID NO: 493040 - DNA, 25 bp, Rattus norvegicus
ggcgccttgggcatactgcacatgc

SEQ ID NO: 493041 - DNA, 25 bp, Rattus norvegicus
agagtccaaactggcgtgtcggagt

SEQ ID NO: 493042 - DNA, 25 bp, Rattus norvegicus
gcgtgtcggagtgtgcacatttttt

SEQ ID NO: 493043 - DNA, 25 bp, Rattus norvegicus
ctacgatcctttaacccgtgtgaca

SEQ ID NO: 493044 - DNA, 25 bp, Rattus norvegicus
accgaagcctagagatgttgatatc

SEQ ID NO: 493045 - DNA, 25 bp, Rattus norvegicus
ggagacaagtgcctacgatccttta

SEQ ID NO: 493046 - DNA, 25 bp, Rattus norvegicus
ccgtgtgacaccgaaattcggacgc

SEQ ID NO: 493047 - DNA, 25 bp, Rattus norvegicus
aaattcggacgcttccgctggcctg

SEQ ID NO: 493048 - DNA, 25 bp, Rattus norvegicus
cgcgagacctagtgagaaaaaccga

SEQ ID NO: 493049 - DNA, 25 bp, Rattus norvegicus
tgtgtcttgaggacaagatgtgctg

SEQ ID NO: 493050 - DNA, 25 bp, Rattus norvegicus
tgagtctgtgcggctacggcagacc

SEQ ID NO: 493051 - DNA, 25 bp, Rattus norvegicus
atcccgttgtgcgtgtgttgcgttg

SEQ ID NO: 493052 - DNA, 25 bp, Rattus norvegicus
acggatcccgttgtgcgtgtgttgc

SEQ ID NO: 493053 - DNA, 25 bp, Rattus norvegicus
atgtgctggacggatcccgttgtgc

SEQ ID NO: 493054 - DNA, 25 bp, Rattus norvegicus
cctcccttcctgtgcgcggggcggt

SEQ ID NO: 493055 - DNA, 25 bp, Rattus norvegicus
aggacaagatgtgctggacggatcc

SEQ ID NO: 493056 - DNA, 25 bp, Rattus norvegicus
agtgattttgtgtgtcttgaggaca

SEQ ID NO: 493057 - DNA, 25 bp, Rattus norvegicus
agtgcagtgattacaagtgattttg

SEQ ID NO: 493058 - DNA, 25 bp, Rattus norvegicus
accggagtgcagtgattacaagtga

SEQ ID NO: 493059 - DNA, 25 bp, Rattus norvegicus
cgcagtcaccggagtgcagtgatta

SEQ ID NO: 493060 - DNA, 25 bp, Rattus norvegicus
ccaggcacgcaggtaccggcggtct

SEQ ID NO: 493061 - DNA, 25 bp, Rattus norvegicus
cggctacggcagaccggaggctcca

SEQ ID NO: 493062 - DNA, 25 bp, Rattus norvegicus
caagatgtgctggacggatcccgtt

SEQ ID NO: 493063 - DNA, 25 bp, Rattus norvegicus
ggcacgggaaccagaggtctaactg

SEQ ID NO: 493064 - DNA, 25 bp, Rattus norvegicus
gcgagatctgagaagcgggaaaatg

SEQ ID NO: 493065 - DNA, 25 bp, Rattus norvegicus
atagggagcggttctgccgcgcctc

SEQ ID NO: 493066 - DNA, 25 bp, Rattus norvegicus
atggtgagcgcagcatcccggacgc

SEQ ID NO: 493067 - DNA, 25 bp, Rattus norvegicus
tctaactgagtagaggatggtgagc

SEQ ID NO: 493068 - DNA, 25 bp, Rattus norvegicus
cgggaaccagaggtctaactgagta

SEQ ID NO: 493069 - DNA, 25 bp, Rattus norvegicus
agccaccgaaggcacgggaaccaga

SEQ ID NO: 493070 - DNA, 25 bp, Rattus norvegicus
tggagccagagccaccgaaggcacg

SEQ ID NO: 493071 - DNA, 25 bp, Rattus norvegicus
tgctggagccagagccaccgaaggc

SEQ ID NO: 493072 - DNA, 25 bp, Rattus norvegicus
acgtgagcgtgagcctgtgccgcca

SEQ ID NO: 493073 - DNA, 25 bp, Rattus norvegicus
aagcgggaaaatggcgccgacgtga

SEQ ID NO: 493074 - DNA, 25 bp, Rattus norvegicus
tagaggatggtgagcgcagcatccc

SEQ ID NO: 493075 - DNA, 25 bp, Rattus norvegicus
accagaggtctaactgagtagagga

SEQ ID NO: 493076 - DNA, 25 bp, Rattus norvegicus
cgcggaagagcagcgggactgatag

SEQ ID NO: 493077 - DNA, 25 bp, Rattus norvegicus
aagactgttggctcccatgcgctca

SEQ ID NO: 493078 - DNA, 25 bp, Rattus norvegicus
ttccaggcccatgcgctcaagactg

SEQ ID NO: 493079 - DNA, 25 bp, Rattus norvegicus
gccggtggccatacgatccatcaca

SEQ ID NO: 493080 - DNA, 25 bp, Rattus norvegicus
gtgggcaccattcgatccatgctta

SEQ ID NO: 493081 - DNA, 25 bp, Rattus norvegicus
catgcttaggcccattcgctcaatg

SEQ ID NO: 493082 - DNA, 25 bp, Rattus norvegicus
aggacccatgcgctctacaccagag

SEQ ID NO: 493083 - DNA, 25 bp, Rattus norvegicus
tgcgctcaatggtttggcccacacg

SEQ ID NO: 493084 - DNA, 25 bp, Rattus norvegicus
tggtctggcccatgcgctcaatact

SEQ ID NO: 493085 - DNA, 25 bp, Rattus norvegicus
ctcaatactggaggccatgtggtca

SEQ ID NO: 493086 - DNA, 25 bp, Rattus norvegicus
tgccggagcccatgcgctcaactga

SEQ ID NO: 493087 - DNA, 25 bp, Rattus norvegicus
ctcaactgagcccatgcggtccatg

SEQ ID NO: 493088 - DNA, 25 bp, Rattus norvegicus
caggcccatacgctcaatctcagag

SEQ ID NO: 493089 - DNA, 25 bp, Rattus norvegicus
agagcccactcgatccatgccatgg

SEQ ID NO: 493090 - DNA, 25 bp, Rattus norvegicus
ccaatgcgttccatggtctggccca

SEQ ID NO: 493091 - DNA, 25 bp, Rattus norvegicus
gcgtgcgccagttccggaattgaaa

SEQ ID NO: 493092 - DNA, 25 bp, Rattus norvegicus
tctgctccagactttcctccgtgtg

SEQ ID NO: 493093 - DNA, 25 bp, Rattus norvegicus
gacgccgcctatgcagcgcgttcgt

SEQ ID NO: 493094 - DNA, 25 bp, Rattus norvegicus
ctggcgactgaggtagatgttaaga

SEQ ID NO: 493095 - DNA, 25 bp, Rattus norvegicus
tgatcttagccgaaaagcctagagg

SEQ ID NO: 493096 - DNA, 25 bp, Rattus norvegicus
cgtaacttgaagagtttcgcatttt

SEQ ID NO: 493097 - DNA, 25 bp, Rattus norvegicus
ttagctgcggcgtcacgtaacttga

SEQ ID NO: 493098 - DNA, 25 bp, Rattus norvegicus
ctgctttcgcttcctcaggccgtta

SEQ ID NO: 493099 - DNA, 25 bp, Rattus norvegicus
tacagtttagcctggtcatctgctc

SEQ ID NO: 493100 - DNA, 25 bp, Rattus norvegicus
gaattgaaagggcttgagacgtccc

SEQ ID NO: 493101 - DNA, 25 bp, Rattus norvegicus
ctcagacactgaggcgtgcgccagt

SEQ ID NO: 493102 - DNA, 25 bp, Rattus norvegicus
gcccgtggtggcaattgttgactca

SEQ ID NO: 493103 - DNA, 25 bp, Rattus norvegicus
tgagagttggcggtcacttccggcc

SEQ ID NO: 493104 - DNA, 25 bp, Rattus norvegicus
cctagggatgcagactcagggacgc

SEQ ID NO: 493105 - DNA, 25 bp, Rattus norvegicus
cgccgtttgctgaccgtacacgtga

SEQ ID NO: 493106 - DNA, 25 bp, Rattus norvegicus
caaggatggccgtgtagacaccttc

SEQ ID NO: 493107 - DNA, 25 bp, Rattus norvegicus
tcttagacctgggaaaccgagacag

SEQ ID NO: 493108 - DNA, 25 bp, Rattus norvegicus
ggtcctaatggctcaaccctcgaga

SEQ ID NO: 493109 - DNA, 25 bp, Rattus norvegicus
gcgcgccatcactgctccaagagta

SEQ ID NO: 493110 - DNA, 25 bp, Rattus norvegicus
ggctctcctggcttcgtcgtcacag

SEQ ID NO: 493111 - DNA, 25 bp, Rattus norvegicus
ccaactctcggcagggaaaaggcct

SEQ ID NO: 493112 - DNA, 25 bp, Rattus norvegicus
gaaagcggccaacagacctaacgga

SEQ ID NO: 493113 - DNA, 25 bp, Rattus norvegicus
cctaacggagctgcgaagtagcctg

SEQ ID NO: 493114 - DNA, 25 bp, Rattus norvegicus
ctccattttgggctctgtcgctgcc

SEQ ID NO: 493115 - DNA, 25 bp, Rattus norvegicus
attttctccgcgtctgggctttgtg

SEQ ID NO: 493116 - DNA, 25 bp, Rattus norvegicus
gaacgaccagtaacgcctgcgtgtg

SEQ ID NO: 493117 - DNA, 25 bp, Rattus norvegicus
aatgcccgcggagacagtttgggtc

SEQ ID NO: 493118 - DNA, 25 bp, Rattus norvegicus
ccgcgccgccatgggagaagagaaa

SEQ ID NO: 493119 - DNA, 25 bp, Rattus norvegicus
gagccgacagcacagcgaaccaatg

SEQ ID NO: 493120 - DNA, 25 bp, Rattus norvegicus
tgtctcgcccgagtactctgccggg

SEQ ID NO: 493121 - DNA, 25 bp, Rattus norvegicus
cggagacctctcaccaacgtcgaaa

SEQ ID NO: 493122 - DNA, 25 bp, Rattus norvegicus
ccaacgtcgaaatgataaataactg

SEQ ID NO: 493123 - DNA, 25 bp, Rattus norvegicus
ggagactccctctgagcaccatctg

SEQ ID NO: 493124 - DNA, 25 bp, Rattus norvegicus
aagggtgcagccctgtctcgcccga

SEQ ID NO: 493125 - DNA, 25 bp, Rattus norvegicus
tcgaacccgagacctgggagacctg

SEQ ID NO: 493126 - DNA, 25 bp, Rattus norvegicus
tgggagacctgcctacatacttggg

SEQ ID NO: 493127 - DNA, 25 bp, Rattus norvegicus
tgcctacatacttgggccagacccg

SEQ ID NO: 493128 - DNA, 25 bp, Rattus norvegicus
gctcgctcttcggtgcctacctgtt

SEQ ID NO: 493129 - DNA, 25 bp, Rattus norvegicus
gcgaaccaatggagactccctctga

SEQ ID NO: 493130 - DNA, 25 bp, Rattus norvegicus
tgagcaccatctgccaatcagcgta

SEQ ID NO: 493131 - DNA, 25 bp, Rattus norvegicus
ccttcaaaatattgggacgtcctgg

SEQ ID NO: 493132 - DNA, 25 bp, Rattus norvegicus
taaataactgaggtgcctgcgtccg

SEQ ID NO: 493133 - DNA, 25 bp, Rattus norvegicus
tctcgggcttacctgagctgcaggc

SEQ ID NO: 493134 - DNA, 25 bp, Rattus norvegicus
ggctctctcgggcttacctgagctg

SEQ ID NO: 493135 - DNA, 25 bp, Rattus norvegicus
acgtcaccgctcagccttataaggc

SEQ ID NO: 493136 - DNA, 25 bp, Rattus norvegicus
cgggagcctcccgaacaatgcgagc

SEQ ID NO: 493137 - DNA, 25 bp, Rattus norvegicus
tggatgccctgtgggttcccggctc

SEQ ID NO: 493138 - DNA, 25 bp, Rattus norvegicus
ggcgttacgtcaccgctcagcctta

SEQ ID NO: 493139 - DNA, 25 bp, Rattus norvegicus
ccttggggcgttacgtcaccgctca

SEQ ID NO: 493140 - DNA, 25 bp, Rattus norvegicus
ccttataaggcgcgcggcatgtgcg

SEQ ID NO: 493141 - DNA, 25 bp, Rattus norvegicus
tcacggctccgcagacagcggcgtg

SEQ ID NO: 493142 - DNA, 25 bp, Rattus norvegicus
cagtgctggtcggatgggcctgacc

SEQ ID NO: 493143 - DNA, 25 bp, Rattus norvegicus
ccgaacaatgcgagcgggacgccga

SEQ ID NO: 493144 - DNA, 25 bp, Rattus norvegicus
ttcccggctcgggtcccagtgctgg

SEQ ID NO: 493145 - DNA, 25 bp, Rattus norvegicus
tcaccgctcagccttataaggcgcg

SEQ ID NO: 493146 - DNA, 25 bp, Rattus norvegicus
cggggccacgacagcccagaccctc

SEQ ID NO: 493147 - DNA, 25 bp, Rattus norvegicus
cctctggtcctgtatcacggcttcg

SEQ ID NO: 493148 - DNA, 25 bp, Rattus norvegicus
gtctggtggccagtcaacggtgaaa

SEQ ID NO: 493149 - DNA, 25 bp, Rattus norvegicus
gctgcgcactaaggcccaaaaccta

SEQ ID NO: 493150 - DNA, 25 bp, Rattus norvegicus
taaggcccaaaacctagcaagctcc

SEQ ID NO: 493151 - DNA, 25 bp, Rattus norvegicus
tagcaagctccacttgccacggctt

SEQ ID NO: 493152 - DNA, 25 bp, Rattus norvegicus
accttgaaccctctggtcctgtatc

SEQ ID NO: 493153 - DNA, 25 bp, Rattus norvegicus
tgtatcacggcttcggccctccagt

SEQ ID NO: 493154 - DNA, 25 bp, Rattus norvegicus
tcgctactgcgaccttgcctatttg

SEQ ID NO: 493155 - DNA, 25 bp, Rattus norvegicus
caccgggcgcacctttgaataggta

SEQ ID NO: 493156 - DNA, 25 bp, Rattus norvegicus
ataggtaatcgtactcgtcgtcccg

SEQ ID NO: 493157 - DNA, 25 bp, Rattus norvegicus
attgtcctggcgcttccggcgggat

SEQ ID NO: 493158 - DNA, 25 bp, Rattus norvegicus
ttccggcgggatcggcgactccgca

SEQ ID NO: 493159 - DNA, 25 bp, Rattus norvegicus
gggtccataggcctctccgagtctc

SEQ ID NO: 493160 - DNA, 25 bp, Rattus norvegicus
gcgcatccggggtccataggcctct

SEQ ID NO: 493161 - DNA, 25 bp, Rattus norvegicus
agcaacgctaggacttcgggacgca

SEQ ID NO: 493162 - DNA, 25 bp, Rattus norvegicus
ttaccgcaggcagccatgcggcgtt

SEQ ID NO: 493163 - DNA, 25 bp, Rattus norvegicus
ctgatcagcgtttcacggttgtacc

SEQ ID NO: 493164 - DNA, 25 bp, Rattus norvegicus
aaagcctgtagatcgcagctgatca

SEQ ID NO: 493165 - DNA, 25 bp, Rattus norvegicus
cttagacttgctctggtgcagaaga

SEQ ID NO: 493166 - DNA, 25 bp, Rattus norvegicus
cagcccgtgagccagcaagttcatt

SEQ ID NO: 493167 - DNA, 25 bp, Rattus norvegicus
ggacgcaggagttcaagacccagta

SEQ ID NO: 493168 - DNA, 25 bp, Rattus norvegicus
cttgggtgcagcaacgctaggactt

SEQ ID NO: 493169 - DNA, 25 bp, Rattus norvegicus
cagcgcatgattccggggatggcct

SEQ ID NO: 493170 - DNA, 25 bp, Rattus norvegicus
tagcactagagcagcgcctgcggtc

SEQ ID NO: 493171 - DNA, 25 bp, Rattus norvegicus
cccgcagtagctgcgcatagcacta

SEQ ID NO: 493172 - DNA, 25 bp, Rattus norvegicus
ccattttataaagccggtgtgggag

SEQ ID NO: 493173 - DNA, 25 bp, Rattus norvegicus
agcaagttcatttcatcccaggatg

SEQ ID NO: 493174 - DNA, 25 bp, Rattus norvegicus
ggaagccggctcagacttagacttg

SEQ ID NO: 493175 - DNA, 25 bp, Rattus norvegicus
acgcgggtcctagagaggaaactga

SEQ ID NO: 493176 - DNA, 25 bp, Rattus norvegicus
cgtgtcctgtaatggtgaccgttcg

SEQ ID NO: 493177 - DNA, 25 bp, Rattus norvegicus
aaactgaggatacaagtgtccggga

SEQ ID NO: 493178 - DNA, 25 bp, Rattus norvegicus
tcccgagcatcgaaggggcgggctc

SEQ ID NO: 493179 - DNA, 25 bp, Rattus norvegicus
ggcttcgctttcaggtaaagtcacc

SEQ ID NO: 493180 - DNA, 25 bp, Rattus norvegicus
tcaggtaaagtcacccacgcgggtc

SEQ ID NO: 493181 - DNA, 25 bp, Rattus norvegicus
ggggcttcgctttcaggtaaagtca

SEQ ID NO: 493182 - DNA, 25 bp, Rattus norvegicus
cacccacgcgggtcctagagaggaa

SEQ ID NO: 493183 - DNA, 25 bp, Rattus norvegicus
agaggaaactgaggatacaagtgtc

SEQ ID NO: 493184 - DNA, 25 bp, Rattus norvegicus
gtgtggcgcttttagcccccttcta

SEQ ID NO: 493185 - DNA, 25 bp, Rattus norvegicus
cccttctatgggttctgtgtgttgc

SEQ ID NO: 493186 - DNA, 25 bp, Rattus norvegicus
ttctatgggttctgtgtgttgcgac

SEQ ID NO: 493187 - DNA, 25 bp, Rattus norvegicus
gcgccgtgtcctgtaatggtgaccg

SEQ ID NO: 493188 - DNA, 25 bp, Rattus norvegicus
taaagtcacccacgcgggtcctaga

SEQ ID NO: 493189 - DNA, 25 bp, Rattus norvegicus
ccctgagaccgttgaggtggacacg

SEQ ID NO: 493190 - DNA, 25 bp, Rattus norvegicus
gcggagcttctggtgcactctctcc

SEQ ID NO: 493191 - DNA, 25 bp, Rattus norvegicus
caggagcttggacctccagcgagtc

SEQ ID NO: 493192 - DNA, 25 bp, Rattus norvegicus
cgcgtcgagcacacgctcttggaga

SEQ ID NO: 493193 - DNA, 25 bp, Rattus norvegicus
tcttggagaccagccgacgactgga

SEQ ID NO: 493194 - DNA, 25 bp, Rattus norvegicus
gcacaggctcaagagcgcgcgctca

SEQ ID NO: 493195 - DNA, 25 bp, Rattus norvegicus
ggtcctgcccaactgcagctcgtga

SEQ ID NO: 493196 - DNA, 25 bp, Rattus norvegicus
gcagccagagcaagatgtagagatc

SEQ ID NO: 493197 - DNA, 25 bp, Rattus norvegicus
tagagatcgaggtgcgcccagacaa

SEQ ID NO: 493198 - DNA, 25 bp, Rattus norvegicus
gcgtctaggacacccgatggggaac

SEQ ID NO: 493199 - DNA, 25 bp, Rattus norvegicus
gatgcccaggcagtacccgagacaa

SEQ ID NO: 493200 - DNA, 25 bp, Rattus norvegicus
ccgcacgagcttggagcatcagcga

SEQ ID NO: 493201 - DNA, 25 bp, Rattus norvegicus
tgagctggaactgctccgcacgagc

SEQ ID NO: 493202 - DNA, 25 bp, Rattus norvegicus
caccgaagtcgtgcctgagacccga

SEQ ID NO: 493203 - DNA, 25 bp, Rattus norvegicus
tactcgcgttatccaaaagcttcgg

SEQ ID NO: 493204 - DNA, 25 bp, Rattus norvegicus
tccatgatggcggagatctagcgga

SEQ ID NO: 493205 - DNA, 25 bp, Rattus norvegicus
atgccatttatagtcggctcggacc

SEQ ID NO: 493206 - DNA, 25 bp, Rattus norvegicus
ttatagtcggctcggaccacgcctc

SEQ ID NO: 493207 - DNA, 25 bp, Rattus norvegicus
gagaccgcacgcagtacccaggaac

SEQ ID NO: 493208 - DNA, 25 bp, Rattus norvegicus
cccaggaaccctcggggcagaatcg

SEQ ID NO: 493209 - DNA, 25 bp, Rattus norvegicus
ggcagaatcgtcaccggcgtccttc

SEQ ID NO: 493210 - DNA, 25 bp, Rattus norvegicus
tcaccggcgtccttcggagcggaag

SEQ ID NO: 493211 - DNA, 25 bp, Rattus norvegicus
tatggcgtccgctactcgcgttatc

SEQ ID NO: 493212 - DNA, 25 bp, Rattus norvegicus
cgactcgtgtccatgatggcggaga

SEQ ID NO: 493213 - DNA, 25 bp, Rattus norvegicus
caaaagcttcggaactgggcgtctg

SEQ ID NO: 493214 - DNA, 25 bp, Rattus norvegicus
ctggggtgcgtgtactgtccgaccc

SEQ ID NO: 493215 - DNA, 25 bp, Rattus norvegicus
cggaaggaatatggcgtccgctact

SEQ ID NO: 493216 - DNA, 25 bp, Rattus norvegicus
acgtgagcaggggatgccatttata

SEQ ID NO: 493217 - DNA, 25 bp, Rattus norvegicus
acctctgtgcagtcgcggctggagc

SEQ ID NO: 493218 - DNA, 25 bp, Rattus norvegicus
tcttagaacaggtcccgaggccgct

SEQ ID NO: 493219 - DNA, 25 bp, Rattus norvegicus
cataccctagtccaagtctcgggtg

SEQ ID NO: 493220 - DNA, 25 bp, Rattus norvegicus
tagtccaagtctcgggtgagtgaac

SEQ ID NO: 493221 - DNA, 25 bp, Rattus norvegicus
acaccgcttttgtcccaccctcatg

SEQ ID NO: 493222 - DNA, 25 bp, Rattus norvegicus
ctcatgcgctgacatcgtctcacta

SEQ ID NO: 493223 - DNA, 25 bp, Rattus norvegicus
gctgacatcgtctcactattggctg

SEQ ID NO: 493224 - DNA, 25 bp, Rattus norvegicus
cactattggctgtgcctcccgtctg

SEQ ID NO: 493225 - DNA, 25 bp, Rattus norvegicus
gtgcctcccgtctgtcgttgacact

SEQ ID NO: 493226 - DNA, 25 bp, Rattus norvegicus
ctgcggctgctcttgggtcttagaa

SEQ ID NO: 493227 - DNA, 25 bp, Rattus norvegicus
tgcgcgagaatcagcgcacctctgt

SEQ ID NO: 493228 - DNA, 25 bp, Rattus norvegicus
aatcagcgcacctctgtgcagtcgc

SEQ ID NO: 493229 - DNA, 25 bp, Rattus norvegicus
cccagcacgcgcttttggatttagc

SEQ ID NO: 493230 - DNA, 25 bp, Rattus norvegicus
tgctcttgggtcttagaacaggtcc

SEQ ID NO: 493231 - DNA, 25 bp, Rattus norvegicus
tctgggctgcgaggtagcccaagtc

SEQ ID NO: 493232 - DNA, 25 bp, Rattus norvegicus
ctcgggagcggcgttgcctctccta

SEQ ID NO: 493233 - DNA, 25 bp, Rattus norvegicus
gtcagtcgccggagaggccaaatga

SEQ ID NO: 493234 - DNA, 25 bp, Rattus norvegicus
aagttcggcgcaccgccaggtggct

SEQ ID NO: 493235 - DNA, 25 bp, Rattus norvegicus
tcctagtccgggagcgccatccgtg

SEQ ID NO: 493236 - DNA, 25 bp, Rattus norvegicus
tgcgcgacaagacggtgcgccctgc

SEQ ID NO: 493237 - DNA, 25 bp, Rattus norvegicus
cacctgacggttggtgcgcagcctt

SEQ ID NO: 493238 - DNA, 25 bp, Rattus norvegicus
acggttggtgcgcagccttctttga

SEQ ID NO: 493239 - DNA, 25 bp, Rattus norvegicus
tgaccagtggacttggcagcagggt

SEQ ID NO: 493240 - DNA, 25 bp, Rattus norvegicus
tgcggcttgaagttcggcgcaccgc

SEQ ID NO: 493241 - DNA, 25 bp, Rattus norvegicus
tgaggagccggcttcagacggtttt

SEQ ID NO: 493242 - DNA, 25 bp, Rattus norvegicus
aacccaccaaggcggtgaggagccg

SEQ ID NO: 493243 - DNA, 25 bp, Rattus norvegicus
cggcgttgcctctcctagtccggga

SEQ ID NO: 493244 - DNA, 25 bp, Rattus norvegicus
cgcggccacgtcgtccaggacaccg

SEQ ID NO: 493245 - DNA, 25 bp, Rattus norvegicus
tactccaagtcttacgcgggccctg

SEQ ID NO: 493246 - DNA, 25 bp, Rattus norvegicus
agtcctttattacaagtactccaag

SEQ ID NO: 493247 - DNA, 25 bp, Rattus norvegicus
ccaagcaactgaaagtcctttatta

SEQ ID NO: 493248 - DNA, 25 bp, Rattus norvegicus
ctctccaagcaactgaaagtccttt

SEQ ID NO: 493249 - DNA, 25 bp, Rattus norvegicus
tttttataactctccaagcaactga

SEQ ID NO: 493250 - DNA, 25 bp, Rattus norvegicus
tgtacctttttataactctccaagc

SEQ ID NO: 493251 - DNA, 25 bp, Rattus norvegicus
gtaaatagcataatgtaccttttta

SEQ ID NO: 493252 - DNA, 25 bp, Rattus norvegicus
actttctcaataatagtaaatagca

SEQ ID NO: 493253 - DNA, 25 bp, Rattus norvegicus
ggcaacaactttctcaataatagta

SEQ ID NO: 493254 - DNA, 25 bp, Rattus norvegicus
aaatctgaaaggcaacaactttctc

SEQ ID NO: 493255 - DNA, 25 bp, Rattus norvegicus
tacaaatgataaatgagctaagaaa

SEQ ID NO: 493256 - DNA, 25 bp, Rattus norvegicus
tacaagtactccaagtcttacgcgg

SEQ ID NO: 493257 - DNA, 25 bp, Rattus norvegicus
ctccaagtcttacgcgggccctggt

SEQ ID NO: 493258 - DNA, 25 bp, Rattus norvegicus
tcctatatacaaatgataaatgagc

SEQ ID NO: 493259 - DNA, 25 bp, Rattus norvegicus
aaaggcgcgagtggcaccaaaagtc

SEQ ID NO: 493260 - DNA, 25 bp, Rattus norvegicus
cgtccgaaggaagtcagcaccgcca

SEQ ID NO: 493261 - DNA, 25 bp, Rattus norvegicus
gcgaggccgaaaagcacgaaaccca

SEQ ID NO: 493262 - DNA, 25 bp, Rattus norvegicus
tataaagcgtttctgccgtgatccg

SEQ ID NO: 493263 - DNA, 25 bp, Rattus norvegicus
caggtagttcccgatggctcatata

SEQ ID NO: 493264 - DNA, 25 bp, Rattus norvegicus
tggtaactcacccaggcaggtagtt

SEQ ID NO: 493265 - DNA, 25 bp, Rattus norvegicus
caccaagggctgacgtggtaactca

SEQ ID NO: 493266 - DNA, 25 bp, Rattus norvegicus
ggaagagctgtactgcaccaagggc

SEQ ID NO: 493267 - DNA, 25 bp, Rattus norvegicus
cctaagtcggggagctgacttcgta

SEQ ID NO: 493268 - DNA, 25 bp, Rattus norvegicus
ggtgagtcccagcaaacaagcgcta

SEQ ID NO: 493269 - DNA, 25 bp, Rattus norvegicus
gattccgtggaaggatccgctctgc

SEQ ID NO: 493270 - DNA, 25 bp, Rattus norvegicus
gactgctgtagtccgaggagaccga

SEQ ID NO: 493271 - DNA, 25 bp, Rattus norvegicus
gcgccagctcagacggactgctgta

SEQ ID NO: 493272 - DNA, 25 bp, Rattus norvegicus
agcgagcagtctacacgcttggttg

SEQ ID NO: 493273 - DNA, 25 bp, Rattus norvegicus
cacagccggcgtgtcccaggctgag

SEQ ID NO: 493274 - DNA, 25 bp, Rattus norvegicus
ccggagttcactgtgtggtagaaag

SEQ ID NO: 493275 - DNA, 25 bp, Rattus norvegicus
ataacgtaccggagttcactgtgtg

SEQ ID NO: 493276 - DNA, 25 bp, Rattus norvegicus
tcatgtactgttggtttataacgta

SEQ ID NO: 493277 - DNA, 25 bp, Rattus norvegicus
ccctacacctttcatgtactgttgg

SEQ ID NO: 493278 - DNA, 25 bp, Rattus norvegicus
cttgcatccctacacctttcatgta

SEQ ID NO: 493279 - DNA, 25 bp, Rattus norvegicus
gcgtgtcccaggctgagcaaactca

SEQ ID NO: 493280 - DNA, 25 bp, Rattus norvegicus
cagatccctagtttaagacacttac

SEQ ID NO: 493281 - DNA, 25 bp, Rattus norvegicus
ctgagcaaactcagctccttgcatc

SEQ ID NO: 493282 - DNA, 25 bp, Rattus norvegicus
gtcccaccagcgtgtcccacggcca

SEQ ID NO: 493283 - DNA, 25 bp, Rattus norvegicus
caagcagatataggctggaaaggtg

SEQ ID NO: 493284 - DNA, 25 bp, Rattus norvegicus
gacacttacaagcagatataggctg

SEQ ID NO: 493285 - DNA, 25 bp, Rattus norvegicus
tgtggtagaaagtaagacagatccc

SEQ ID NO: 493286 - DNA, 25 bp, Rattus norvegicus
agtaagacagatccctagtttaaga

SEQ ID NO: 493287 - DNA, 25 bp, Rattus norvegicus
ttcccatgcgcctcagatttgcaca

SEQ ID NO: 493288 - DNA, 25 bp, Rattus norvegicus
gcagtggcgtggcttcatcctctag

SEQ ID NO: 493289 - DNA, 25 bp, Rattus norvegicus
tggcttcatcctctaggacaccgca

SEQ ID NO: 493290 - DNA, 25 bp, Rattus norvegicus
tcggggctgcgaggccacccaagtc

SEQ ID NO: 493291 - DNA, 25 bp, Rattus norvegicus
ctcagttgcctgagaggccaaatga

SEQ ID NO: 493292 - DNA, 25 bp, Rattus norvegicus
cctacctgtcctggcgcagtggcgt

SEQ ID NO: 493293 - DNA, 25 bp, Rattus norvegicus
tgcgcctcagatttgcacagagctt

SEQ ID NO: 493294 - DNA, 25 bp, Rattus norvegicus
ggcaagtggcctctccttcaacctt

SEQ ID NO: 493295 - DNA, 25 bp, Rattus norvegicus
cacagaggcaagtggcctctccttc

SEQ ID NO: 493296 - DNA, 25 bp, Rattus norvegicus
cggcttgaagttaggcacagaggca

SEQ ID NO: 493297 - DNA, 25 bp, Rattus norvegicus
gacgtcgcctcccatagtccgggag

SEQ ID NO: 493298 - DNA, 25 bp, Rattus norvegicus
aaccaggcgagctccggtgcgacgt

SEQ ID NO: 493299 - DNA, 25 bp, Rattus norvegicus
aaacccaccagagcggcggtgagcc

SEQ ID NO: 493300 - DNA, 25 bp, Rattus norvegicus
ccctgaggtcgggatgactcagttg

SEQ ID NO: 493301 - DNA, 25 bp, Rattus norvegicus
aaaagaacgcgcgtgccggcgccca

SEQ ID NO: 493302 - DNA, 25 bp, Rattus norvegicus
ctccttcaccaacctgcgccgcgtc

SEQ ID NO: 493303 - DNA, 25 bp, Rattus norvegicus
aggctcacagcctggcgccttgtcc

SEQ ID NO: 493304 - DNA, 25 bp, Rattus norvegicus
ctttctatttttgatcctgatgtgg

SEQ ID NO: 493305 - DNA, 25 bp, Rattus norvegicus
ctatcagggcgccattggcgctgag

SEQ ID NO: 493306 - DNA, 25 bp, Rattus norvegicus
cgccaaaaagaacgcgcgtgccggc

SEQ ID NO: 493307 - DNA, 25 bp, Rattus norvegicus
gcgccagaccttggctaaggcgacc

SEQ ID NO: 493308 - DNA, 25 bp, Rattus norvegicus
ttttgatcctgatgtggcgcatgcg

SEQ ID NO: 493309 - DNA, 25 bp, Rattus norvegicus
cccgacactgcgagtctgtagtctc

SEQ ID NO: 493310 - DNA, 25 bp, Rattus norvegicus
agagcaccatgcctcgaggttccct

SEQ ID NO: 493311 - DNA, 25 bp, Rattus norvegicus
ggccagagcaccatgcctcgaggtt

SEQ ID NO: 493312 - DNA, 25 bp, Rattus norvegicus
ctaggggtcggccagagcaccatgc

SEQ ID NO: 493313 - DNA, 25 bp, Rattus norvegicus
cttggctaaggcgaccgcccttggc

SEQ ID NO: 493314 - DNA, 25 bp, Rattus norvegicus
ctgcctcctccatcgctgcgcgagg

SEQ ID NO: 493315 - DNA, 25 bp, Rattus norvegicus
ctcaaagttgccgagcgctagcgcc

SEQ ID NO: 493316 - DNA, 25 bp, Rattus norvegicus
catcactaggccaccggttgggttc

SEQ ID NO: 493317 - DNA, 25 bp, Rattus norvegicus
tctgaccaatggcagcgccgcatta

SEQ ID NO: 493318 - DNA, 25 bp, Rattus norvegicus
gagtccagggctgcagagtgatata

SEQ ID NO: 493319 - DNA, 25 bp, Rattus norvegicus
ccgctgcccactgtgagcaagagtc

SEQ ID NO: 493320 - DNA, 25 bp, Rattus norvegicus
gctccggggaagtgccttccaagta

SEQ ID NO: 493321 - DNA, 25 bp, Rattus norvegicus
ccgggtttaaccgtgcactgtgcac

SEQ ID NO: 493322 - DNA, 25 bp, Rattus norvegicus
agtccgagctcactcgccgggttta

SEQ ID NO: 493323 - DNA, 25 bp, Rattus norvegicus
gggactgccgctcttttcctcaaag

SEQ ID NO: 493324 - DNA, 25 bp, Rattus norvegicus
tgtcggagttgcagaaggcatcctg

SEQ ID NO: 493325 - DNA, 25 bp, Rattus norvegicus
ctcccagagcgcttaccgatgtcgg

SEQ ID NO: 493326 - DNA, 25 bp, Rattus norvegicus
aaggcatttctgtacatagagtccc

SEQ ID NO: 493327 - DNA, 25 bp, Rattus norvegicus
cccaagccagggagtcatggtagct

SEQ ID NO: 493328 - DNA, 25 bp, Rattus norvegicus
ttgggttccgtctgcaaggcatttc

SEQ ID NO: 493329 - DNA, 25 bp, Rattus norvegicus
ctggaacgagcgctgcccacagtgt

SEQ ID NO: 493330 - DNA, 25 bp, Rattus norvegicus
aacccggaagtgactactcaccatg

SEQ ID NO: 493331 - DNA, 25 bp, Rattus norvegicus
actcaccatggtggacagcggcacc

SEQ ID NO: 493332 - DNA, 25 bp, Rattus norvegicus
tgggccatggtctcccaaagccaga

SEQ ID NO: 493333 - DNA, 25 bp, Rattus norvegicus
actcagctgccgagcgtcacagtca

SEQ ID NO: 493334 - DNA, 25 bp, Rattus norvegicus
cagtcacaggcgtctagaccagcta

SEQ ID NO: 493335 - DNA, 25 bp, Rattus norvegicus
gtccgcttttgaagccgcacgcgca

SEQ ID NO: 493336 - DNA, 25 bp, Rattus norvegicus
cagcttcatggtgagcggaccgcaa

SEQ ID NO: 493337 - DNA, 25 bp, Rattus norvegicus
tagagccttctgctcgagccgagtg

SEQ ID NO: 493338 - DNA, 25 bp, Rattus norvegicus
cgagcgcctgcgcttctctatcggt

SEQ ID NO: 493339 - DNA, 25 bp, Rattus norvegicus
agcgagttcgttctttcggtcccag

SEQ ID NO: 493340 - DNA, 25 bp, Rattus norvegicus
tcggtcccagcttgcaggatcttta

SEQ ID NO: 493341 - DNA, 25 bp, Rattus norvegicus
tgcaggatctttagcgctggaacga

SEQ ID NO: 493342 - DNA, 25 bp, Rattus norvegicus
gcccacagtgtgcagacgtgacaga

SEQ ID NO: 493343 - DNA, 25 bp, Rattus norvegicus
aactgctggaggatcaagaagggct

SEQ ID NO: 493344 - DNA, 25 bp, Rattus norvegicus
gactcgtgcgatgcgttttgagcct

SEQ ID NO: 493345 - DNA, 25 bp, Rattus norvegicus
gccttcggaactgcaggccgcgact

SEQ ID NO: 493346 - DNA, 25 bp, Rattus norvegicus
caagaagggctttgtgcccaacatg

SEQ ID NO: 493347 - DNA, 25 bp, Rattus norvegicus
cgggatccacacacgaggacagttg

SEQ ID NO: 493348 - DNA, 25 bp, Rattus norvegicus
tggacaagatcaataagaactgctg

SEQ ID NO: 493349 - DNA, 25 bp, Rattus norvegicus
gatgagctacagttcttggacaaga

SEQ ID NO: 493350 - DNA, 25 bp, Rattus norvegicus
gagtcgtaactacaacgatgagcta

SEQ ID NO: 493351 - DNA, 25 bp, Rattus norvegicus
tcgccgccaccatgagtcgtaacta

SEQ ID NO: 493352 - DNA, 25 bp, Rattus norvegicus
gggaggtatcgctagctcgccgcca

SEQ ID NO: 493353 - DNA, 25 bp, Rattus norvegicus
tctttctacgtgtagccgggaggta

SEQ ID NO: 493354 - DNA, 25 bp, Rattus norvegicus
cggacagtgaggctgtttctctttc

SEQ ID NO: 493355 - DNA, 25 bp, Rattus norvegicus
cgttttgagcctcggcgcctgccat

SEQ ID NO: 493356 - DNA, 25 bp, Rattus norvegicus
tttgtgcccaacatgcaggtgagtg

SEQ ID NO: 493357 - DNA, 25 bp, Rattus norvegicus
aggacgctttggactcgccatcgct

SEQ ID NO: 493358 - DNA, 25 bp, Rattus norvegicus
tttggactcgccatcgctgttgagg

SEQ ID NO: 493359 - DNA, 25 bp, Rattus norvegicus
gactcgccatcgctgttgaggtccg

SEQ ID NO: 493360 - DNA, 25 bp, Rattus norvegicus
ccatcgctgttgaggtccggcctgt

SEQ ID NO: 493361 - DNA, 25 bp, Rattus norvegicus
aggtccggcctgtgacgctccagca

SEQ ID NO: 493362 - DNA, 25 bp, Rattus norvegicus
tcttgcagttgcttgatgtagccga

SEQ ID NO: 493363 - DNA, 25 bp, Rattus norvegicus
atagccctcgttcacacagcgcacg

SEQ ID NO: 493364 - DNA, 25 bp, Rattus norvegicus
cgcgctcgttgcgttggcgcagaaa

SEQ ID NO: 493365 - DNA, 25 bp, Rattus norvegicus
cacggccgtcttcgcgcgcagtccg

SEQ ID NO: 493366 - DNA, 25 bp, Rattus norvegicus
tagccacgctcctcaggctcgctgc

SEQ ID NO: 493367 - DNA, 25 bp, Rattus norvegicus
cgcggagaccctgcagggctccctc

SEQ ID NO: 493368 - DNA, 25 bp, Rattus norvegicus
gacgctccagcagctcttgcagttg

SEQ ID NO: 493369 - DNA, 25 bp, Rattus norvegicus
cgcagtccgcggtatcctggcgcgc

SEQ ID NO: 493370 - DNA, 25 bp, Rattus norvegicus
cagttgcttgatgtagccgatggcg

SEQ ID NO: 493371 - DNA, 25 bp, Rattus norvegicus
tgctgccagcgcttctgggaaaaca

SEQ ID NO: 493372 - DNA, 25 bp, Rattus norvegicus
gggccgacttctggcccgatgaaga

SEQ ID NO: 493373 - DNA, 25 bp, Rattus norvegicus
gggtcgattactcggcactcgattg

SEQ ID NO: 493374 - DNA, 25 bp, Rattus norvegicus
attggatccacacccacctgagctg

SEQ ID NO: 493375 - DNA, 25 bp, Rattus norvegicus
agagctctgggtggagcgtctctaa

SEQ ID NO: 493376 - DNA, 25 bp, Rattus norvegicus
cggctctgccgtacacgcacagaga

SEQ ID NO: 493377 - DNA, 25 bp, Rattus norvegicus
tgggcaggttgcacgtacgcagaat

SEQ ID NO: 493378 - DNA, 25 bp, Rattus norvegicus
acgtacgcagaatggctgggaagcc

SEQ ID NO: 493379 - DNA, 25 bp, Rattus norvegicus
tggcccgatgaagagccaggcgact

SEQ ID NO: 493380 - DNA, 25 bp, Rattus norvegicus
tcttcttctaggtcagccagtcttg

SEQ ID NO: 493381 - DNA, 25 bp, Rattus norvegicus
ccggccctcgtagacgtcgggcgat

SEQ ID NO: 493382 - DNA, 25 bp, Rattus norvegicus
atgtggtagcacgtgacaccggccc

SEQ ID NO: 493383 - DNA, 25 bp, Rattus norvegicus
caccctcggagagggcgtctttgtt

SEQ ID NO: 493384 - DNA, 25 bp, Rattus norvegicus
aaggccacggctgatcgcttttctc

SEQ ID NO: 493385 - DNA, 25 bp, Rattus norvegicus
cctcaccttgtctggcgtctctttg

SEQ ID NO: 493386 - DNA, 25 bp, Rattus norvegicus
tgaacccagcgcgaacaagacacct

SEQ ID NO: 493387 - DNA, 25 bp, Rattus norvegicus
gcaacagagccacactccgtggcta

SEQ ID NO: 493388 - DNA, 25 bp, Rattus norvegicus
cgtggctacgccacacgtggttaca

SEQ ID NO: 493389 - DNA, 25 bp, Rattus norvegicus
ttacaggccggccaaccttagcagg

SEQ ID NO: 493390 - DNA, 25 bp, Rattus norvegicus
accttagcaggtcccatccagtggc

SEQ ID NO: 493391 - DNA, 25 bp, Rattus norvegicus
atccagtggctcaagcccggcgcgt

SEQ ID NO: 493392 - DNA, 25 bp, Rattus norvegicus
tgatgttccgcttgaacccagcgcg

SEQ ID NO: 493393 - DNA, 25 bp, Rattus norvegicus
acacctggtcgctgggagagactat

SEQ ID NO: 493394 - DNA, 25 bp, Rattus norvegicus
gagagactatgagctccacgtagag

SEQ ID NO: 493395 - DNA, 25 bp, Rattus norvegicus
tccacgtagaggaacaacgcgcagg

SEQ ID NO: 493396 - DNA, 25 bp, Rattus norvegicus
tgacgtcattagcaggcgccaaggg

SEQ ID NO: 493397 - DNA, 25 bp, Rattus norvegicus
caggccacgcaggtcacttggcggc

SEQ ID NO: 493398 - DNA, 25 bp, Rattus norvegicus
cggctgcggttcatgatgttccgct

SEQ ID NO: 493399 - DNA, 25 bp, Rattus norvegicus
gctcctcgtcgcctaggttcacttt

SEQ ID NO: 493400 - DNA, 25 bp, Rattus norvegicus
cgccgccagcactgctcatgttata

SEQ ID NO: 493401 - DNA, 25 bp, Rattus norvegicus
cccaggacaggacgatctccatagc

SEQ ID NO: 493402 - DNA, 25 bp, Rattus norvegicus
atagcactctggacctcgtacttgg

SEQ ID NO: 493403 - DNA, 25 bp, Rattus norvegicus
tcgtacttggtgcacttggcgaagc

SEQ ID NO: 493404 - DNA, 25 bp, Rattus norvegicus
cgcctctttagcgatgcgcaccaga

SEQ ID NO: 493405 - DNA, 25 bp, Rattus norvegicus
ccggcttaccagcatcgagagcttg

SEQ ID NO: 493406 - DNA, 25 bp, Rattus norvegicus
caccagggcagtgttgacggtatca

SEQ ID NO: 493407 - DNA, 25 bp, Rattus norvegicus
tccagcgtcagatcttccagcgttc

SEQ ID NO: 493408 - DNA, 25 bp, Rattus norvegicus
gcgttgccagcaagtgtcactactt

SEQ ID NO: 493409 - DNA, 25 bp, Rattus norvegicus
agccgtcaccgctggaagacacacg

SEQ ID NO: 493410 - DNA, 25 bp, Rattus norvegicus
cacggcggaacctgaaatcatcttc

SEQ ID NO: 493411 - DNA, 25 bp, Rattus norvegicus
ggacccgcgcctttcatccaaaata

SEQ ID NO: 493412 - DNA, 25 bp, Rattus norvegicus
tcaaagctgttgtgccggctgtgca

SEQ ID NO: 493413 - DNA, 25 bp, Rattus norvegicus
tcctgcggaagaaagggacgctcta

SEQ ID NO: 493414 - DNA, 25 bp, Rattus norvegicus
aactcgcacagcgtcaacttctacg

SEQ ID NO: 493415 - DNA, 25 bp, Rattus norvegicus
caagccttgcgcgtcaccatggtaa

SEQ ID NO: 493416 - DNA, 25 bp, Rattus norvegicus
gcaggaagctcccagcaagccttgc

SEQ ID NO: 493417 - DNA, 25 bp, Rattus norvegicus
gcgtgctcttaaccgcaggaagctc

SEQ ID NO: 493418 - DNA, 25 bp, Rattus norvegicus
tctatggtcccattgcgtgctctta

SEQ ID NO: 493419 - DNA, 25 bp, Rattus norvegicus
agacccggaaacacactctatggtc

SEQ ID NO: 493420 - DNA, 25 bp, Rattus norvegicus
tctagcttcgacaaagagccgccca

SEQ ID NO: 493421 - DNA, 25 bp, Rattus norvegicus
gccggtcctctagcttcgacaaaga

SEQ ID NO: 493422 - DNA, 25 bp, Rattus norvegicus
cggcagagcccagccgatgggccat

SEQ ID NO: 493423 - DNA, 25 bp, Rattus norvegicus
aaagggctctgttctgggtaaccag

SEQ ID NO: 493424 - DNA, 25 bp, Rattus norvegicus
cgaggtcaatcagaaaaagggctct

SEQ ID NO: 493425 - DNA, 25 bp, Rattus norvegicus
tttgctcgggaagcgaggtcaatca

SEQ ID NO: 493426 - DNA, 25 bp, Rattus norvegicus
tacggtcttccgcttcctgcggaag

SEQ ID NO: 493427 - DNA, 25 bp, Rattus norvegicus
ccagcaggagcggagtcctcggtac

SEQ ID NO: 493428 - DNA, 25 bp, Rattus norvegicus
catgtctagtaagtggctcgtggcc

SEQ ID NO: 493429 - DNA, 25 bp, Rattus norvegicus
ggacctctcaccgatattcggacct

SEQ ID NO: 493430 - DNA, 25 bp, Rattus norvegicus
agcggtggataatcggacctctcac

SEQ ID NO: 493431 - DNA, 25 bp, Rattus norvegicus
ccctcgcctcacagagcggtggata

SEQ ID NO: 493432 - DNA, 25 bp, Rattus norvegicus
tggtggtgtcaaactcgtgactccg

SEQ ID NO: 493433 - DNA, 25 bp, Rattus norvegicus
ctgcactctaggagctggtcggctt

SEQ ID NO: 493434 - DNA, 25 bp, Rattus norvegicus
gagcacaggcctctgcccagggcat

SEQ ID NO: 493435 - DNA, 25 bp, Rattus norvegicus
ccgatcaaccatgcgggtggctctt

SEQ ID NO: 493436 - DNA, 25 bp, Rattus norvegicus
tgggtccgtgcgtccgccgatcaac

SEQ ID NO: 493437 - DNA, 25 bp, Rattus norvegicus
cctggttgtccagctcccagcagga

SEQ ID NO: 493438 - DNA, 25 bp, Rattus norvegicus
cggggaagagccatgtctagtaagt

SEQ ID NO: 493439 - DNA, 25 bp, Rattus norvegicus
attgactggctgcagtccttgcggc

SEQ ID NO: 493440 - DNA, 25 bp, Rattus norvegicus
agccttccgcgctaggcagaggaga

SEQ ID NO: 493441 - DNA, 25 bp, Rattus norvegicus
gaggtccgagccagcgtagtaaaca

SEQ ID NO: 493442 - DNA, 25 bp, Rattus norvegicus
acttcagaaacgtgaggtgccggtg

SEQ ID NO: 493443 - DNA, 25 bp, Rattus norvegicus
cccgccctgaaggagtgcatccagg

SEQ ID NO: 493444 - DNA, 25 bp, Rattus norvegicus
aagggactccggctgcacgacaacc

SEQ ID NO: 493445 - DNA, 25 bp, Rattus norvegicus
cgtgcattggttccgaaagggactc

SEQ ID NO: 493446 - DNA, 25 bp, Rattus norvegicus
ctcgcttgaagctctcggtagaaga

SEQ ID NO: 493447 - DNA, 25 bp, Rattus norvegicus
atgagcccgacttccctcgcttgaa

SEQ ID NO: 493448 - DNA, 25 bp, Rattus norvegicus
ctcctcgcgtgaggaggttctcctg

SEQ ID NO: 493449 - DNA, 25 bp, Rattus norvegicus
gaaggtatgcgtgtcctccggacgc

SEQ ID NO: 493450 - DNA, 25 bp, Rattus norvegicus
gagcgtaccgcccaatgagaagccg

SEQ ID NO: 493451 - DNA, 25 bp, Rattus norvegicus
ggctcccaagcgacaacacaggtcg

SEQ ID NO: 493452 - DNA, 25 bp, Rattus norvegicus
ccagcgatcgcaacgggtcccgaag

SEQ ID NO: 493453 - DNA, 25 bp, Rattus norvegicus
cttcagccaatggaggcggctccca

SEQ ID NO: 493454 - DNA, 25 bp, Rattus norvegicus
agcccagggagcagaactacgcctc

SEQ ID NO: 493455 - DNA, 25 bp, Rattus norvegicus
gcgccagcctgacgctcaaggcaag

SEQ ID NO: 493456 - DNA, 25 bp, Rattus norvegicus
tcaggagtcggaagactctccgttc

SEQ ID NO: 493457 - DNA, 25 bp, Rattus norvegicus
ctcaggctcaggagtcggaagactc

SEQ ID NO: 493458 - DNA, 25 bp, Rattus norvegicus
ccagatgctctcctcaggctcagga

SEQ ID NO: 493459 - DNA, 25 bp, Rattus norvegicus
ggcggctacgagacccagatgctct

SEQ ID NO: 493460 - DNA, 25 bp, Rattus norvegicus
acagcagaggccctgacgcggccag

SEQ ID NO: 493461 - DNA, 25 bp, Rattus norvegicus
gacatactcactcaccgcgggatcg

SEQ ID NO: 493462 - DNA, 25 bp, Rattus norvegicus
ctggagtgcagccagccaggccagc

SEQ ID NO: 493463 - DNA, 25 bp, Rattus norvegicus
aaagggcctggagtgcagccagcca

SEQ ID NO: 493464 - DNA, 25 bp, Rattus norvegicus
caaactcgcggacccactggggtga

SEQ ID NO: 493465 - DNA, 25 bp, Rattus norvegicus
aaactgctaacaccgcgtccgcaaa

SEQ ID NO: 493466 - DNA, 25 bp, Rattus norvegicus
ggacccaggcttccaggagcgactc

SEQ ID NO: 493467 - DNA, 25 bp, Rattus norvegicus
cgctcaaggcaagaggtcggaccca

SEQ ID NO: 493468 - DNA, 25 bp, Rattus norvegicus
gcaagaggtcggacccaggcttcca

SEQ ID NO: 493469 - DNA, 25 bp, Rattus norvegicus
agcaggccggaattggtagtcaacc

SEQ ID NO: 493470 - DNA, 25 bp, Rattus norvegicus
acgcatgcccaagccggaaacgttt

SEQ ID NO: 493471 - DNA, 25 bp, Rattus norvegicus
accttgtcgctgtaatctctcagga

SEQ ID NO: 493472 - DNA, 25 bp, Rattus norvegicus
ctgacgagccaccagagactgagtc

SEQ ID NO: 493473 - DNA, 25 bp, Rattus norvegicus
tctaccagccttggagaagagttcg

SEQ ID NO: 493474 - DNA, 25 bp, Rattus norvegicus
gggctttcacgagcagacctgtctc

SEQ ID NO: 493475 - DNA, 25 bp, Rattus norvegicus
gacctgtctctcctaacactctatg

SEQ ID NO: 493476 - DNA, 25 bp, Rattus norvegicus
ttcccgacgtgcaacggggtcatcc

SEQ ID NO: 493477 - DNA, 25 bp, Rattus norvegicus
tattagggaaccgaacagcaggccg

SEQ ID NO: 493478 - DNA, 25 bp, Rattus norvegicus
ggggccagagctctttaccttgtcg

SEQ ID NO: 493479 - DNA, 25 bp, Rattus norvegicus
gtcaaccagtgcgaaagatttttcc

SEQ ID NO: 493480 - DNA, 25 bp, Rattus norvegicus
ttccgctttccaaaaggcatgctgg

SEQ ID NO: 493481 - DNA, 25 bp, Rattus norvegicus
tcccacgctgtcatcggagttatta

SEQ ID NO: 493482 - DNA, 25 bp, Rattus norvegicus
ctcttcatccatggccgcaggtgcg

SEQ ID NO: 493483 - DNA, 25 bp, Rattus norvegicus
caaaactgcaatcgcgcgtctccgg

SEQ ID NO: 493484 - DNA, 25 bp, Rattus norvegicus
tggcccaaaactgcaatcgcgcgtc

SEQ ID NO: 493485 - DNA, 25 bp, Rattus norvegicus
ccgggtggcccaaaactgcaatcgc

SEQ ID NO: 493486 - DNA, 25 bp, Rattus norvegicus
cctggtggagtcagacttgtgtact

SEQ ID NO: 493487 - DNA, 25 bp, Rattus norvegicus
ccgcaacctggtggagtcagacttg

SEQ ID NO: 493488 - DNA, 25 bp, Rattus norvegicus
tgtgaaatcgcgagcccgcaacctg

SEQ ID NO: 493489 - DNA, 25 bp, Rattus norvegicus
tcgcactgggaaaagtgcgctgtcc

SEQ ID NO: 493490 - DNA, 25 bp, Rattus norvegicus
ctctgggtgtcgcactgggaaaagt

SEQ ID NO: 493491 - DNA, 25 bp, Rattus norvegicus
cttttccgggtctctgggtgtcgca

SEQ ID NO: 493492 - DNA, 25 bp, Rattus norvegicus
gcggagcagcccctgttaacttttc

SEQ ID NO: 493493 - DNA, 25 bp, Rattus norvegicus
gctgttcagatctcaggcctgagcc

SEQ ID NO: 493494 - DNA, 25 bp, Rattus norvegicus
cggcggctgttcagatctcaggcct

SEQ ID NO: 493495 - DNA, 25 bp, Rattus norvegicus
tccggggcccgccttgtgaaatcgc

SEQ ID NO: 493496 - DNA, 25 bp, Rattus norvegicus
ggggaccacgcgacactcgcttgac

SEQ ID NO: 493497 - DNA, 25 bp, Rattus norvegicus
ccagcgactgctgtgagcctgttgt

SEQ ID NO: 493498 - DNA, 25 bp, Rattus norvegicus
tcgagcgcaaccttacacggagaga

SEQ ID NO: 493499 - DNA, 25 bp, Rattus norvegicus
agcctgttgtttgagcccgttaaga

SEQ ID NO: 493500 - DNA, 25 bp, Rattus norvegicus
tctgaacgtggatgctccggacttc

SEQ ID NO: 493501 - DNA, 25 bp, Rattus norvegicus
agactgctgcttcgatttggcggcc

SEQ ID NO: 493502 - DNA, 25 bp, Rattus norvegicus
agcaacactgttctcccatgccgga

SEQ ID NO: 493503 - DNA, 25 bp, Rattus norvegicus
tgagtttccgcaggtcacgctgaag

SEQ ID NO: 493504 - DNA, 25 bp, Rattus norvegicus
taccagctcgatgcgcggaacaaag

SEQ ID NO: 493505 - DNA, 25 bp, Rattus norvegicus
tttgccgctgcgttaagaaaccaga

SEQ ID NO: 493506 - DNA, 25 bp, Rattus norvegicus
ccatctccgagggactttgccgctg

SEQ ID NO: 493507 - DNA, 25 bp, Rattus norvegicus
tgttaaactcagtcccggagggcgc

SEQ ID NO: 493508 - DNA, 25 bp, Rattus norvegicus
gtggtgctatctccgactgttaaac

SEQ ID NO: 493509 - DNA, 25 bp, Rattus norvegicus
cacacttgtagcgtattttggaaaa

SEQ ID NO: 493510 - DNA, 25 bp, Rattus norvegicus
gatttcgcgtttctactcgagcgca

SEQ ID NO: 493511 - DNA, 25 bp, Rattus norvegicus
cgcgagccagcgagcatctttatgc

SEQ ID NO: 493512 - DNA, 25 bp, Rattus norvegicus
cgcgattccagaagcaagagactcc

SEQ ID NO: 493513 - DNA, 25 bp, Rattus norvegicus
caagagactccagtgcgccgtgaga

SEQ ID NO: 493514 - DNA, 25 bp, Rattus norvegicus
gtgagacgccgtacacggtcgccct

SEQ ID NO: 493515 - DNA, 25 bp, Rattus norvegicus
ttccggggccctaagcatgccatta

SEQ ID NO: 493516 - DNA, 25 bp, Rattus norvegicus
aagcatgccattaccctacccaaag

SEQ ID NO: 493517 - DNA, 25 bp, Rattus norvegicus
ctacccaaagccagagaagccgcgg

SEQ ID NO: 493518 - DNA, 25 bp, Rattus norvegicus
cggctggctctcaaagttcctgcaa

SEQ ID NO: 493519 - DNA, 25 bp, Rattus norvegicus
ataagcacctcgagctcgccgcgag

SEQ ID NO: 493520 - DNA, 25 bp, Rattus norvegicus
ctttatgcaactttatgtccaagcg

SEQ ID NO: 493521 - DNA, 25 bp, Rattus norvegicus
aaccgctagtggattgtgtcttcgc

SEQ ID NO: 493522 - DNA, 25 bp, Rattus norvegicus
atgtccaagcgaaagcgcgctcctc

SEQ ID NO: 493523 - DNA, 25 bp, Rattus norvegicus
tctctcatagcccaagctacgaatg

SEQ ID NO: 493524 - DNA, 25 bp, Rattus norvegicus
ttcctgcaagtaacataagcacctc

SEQ ID NO: 493525 - DNA, 25 bp, Rattus norvegicus
ccgagctggggactcggctttccca

SEQ ID NO: 493526 - DNA, 25 bp, Rattus norvegicus
cggccgcgctgtgattagaatatga

SEQ ID NO: 493527 - DNA, 25 bp, Rattus norvegicus
ccctgtatgtcagtctgtctgcgtc

SEQ ID NO: 493528 - DNA, 25 bp, Rattus norvegicus
gtctctttgtctctccctacttctg

SEQ ID NO: 493529 - DNA, 25 bp, Rattus norvegicus
tgcctcgctgtctcactcttcgttt

SEQ ID NO: 493530 - DNA, 25 bp, Rattus norvegicus
gcttgcctcctccagaacttttgta

SEQ ID NO: 493531 - DNA, 25 bp, Rattus norvegicus
cttgagtttcttccacgcagatccg

SEQ ID NO: 493532 - DNA, 25 bp, Rattus norvegicus
ccggggcgcaatgtcttgagtttct

SEQ ID NO: 493533 - DNA, 25 bp, Rattus norvegicus
gtgggcctgactccttttatctctc

SEQ ID NO: 493534 - DNA, 25 bp, Rattus norvegicus
tagaatatgaatggactcggcgggc

SEQ ID NO: 493535 - DNA, 25 bp, Rattus norvegicus
tttgaccatggacagaggcagcgcc

SEQ ID NO: 493536 - DNA, 25 bp, Rattus norvegicus
ctgagccacgccaagtgggacaatg

SEQ ID NO: 493537 - DNA, 25 bp, Rattus norvegicus
aagggaccagcacgtgccgagttaa

SEQ ID NO: 493538 - DNA, 25 bp, Rattus norvegicus
tgccgagttaaggtcacgagacgcg

SEQ ID NO: 493539 - DNA, 25 bp, Rattus norvegicus
cacccacggtaaaggaagaaggcag

SEQ ID NO: 493540 - DNA, 25 bp, Rattus norvegicus
cctggtccgggcctaacctgcggag

SEQ ID NO: 493541 - DNA, 25 bp, Rattus norvegicus
gcgcttcaaaaggttccgcctggtc

SEQ ID NO: 493542 - DNA, 25 bp, Rattus norvegicus
gcttgtttacgggaggcgcttcaaa

SEQ ID NO: 493543 - DNA, 25 bp, Rattus norvegicus
cccgctgcgcttgtttacgggaggc

SEQ ID NO: 493544 - DNA, 25 bp, Rattus norvegicus
tggtgtgcgtagtcctccagtgtcc

SEQ ID NO: 493545 - DNA, 25 bp, Rattus norvegicus
tccattcaaacagcacgcggagagt

SEQ ID NO: 493546 - DNA, 25 bp, Rattus norvegicus
gtcctctcaaaaaactctcccggca

SEQ ID NO: 493547 - DNA, 25 bp, Rattus norvegicus
ggaagaaggcagaatgttcacatcc

SEQ ID NO: 493548 - DNA, 25 bp, Rattus norvegicus
gaactcctcagctagcacgtccatt

SEQ ID NO: 493549 - DNA, 25 bp, Rattus norvegicus
gcgcagccagctcctccggagtcag

SEQ ID NO: 493550 - DNA, 25 bp, Rattus norvegicus
tccacagtcgggatcggcgcagcca

SEQ ID NO: 493551 - DNA, 25 bp, Rattus norvegicus
ggcgcttacctccacagtcgggatc

SEQ ID NO: 493552 - DNA, 25 bp, Rattus norvegicus
agaatgttcacatccgcccgtgcgg

SEQ ID NO: 493553 - DNA, 25 bp, Rattus norvegicus
aaagggttgtcatcacggccaaggg

SEQ ID NO: 493554 - DNA, 25 bp, Rattus norvegicus
acccaaagggttgtcatcacggcca

SEQ ID NO: 493555 - DNA, 25 bp, Rattus norvegicus
agcctgggccaacaccgccaccgtg

SEQ ID NO: 493556 - DNA, 25 bp, Rattus norvegicus
cccacttcaggccttgactcggagg

SEQ ID NO: 493557 - DNA, 25 bp, Rattus norvegicus
cgctggcacgcacccaaagggttgt

SEQ ID NO: 493558 - DNA, 25 bp, Rattus norvegicus
cgagagcacagtcgctggcacgcac

SEQ ID NO: 493559 - DNA, 25 bp, Rattus norvegicus
tcgcgcccgagagcacagtcgctgg

SEQ ID NO: 493560 - DNA, 25 bp, Rattus norvegicus
ctcggaggtcaaatgtcctgacttc

SEQ ID NO: 493561 - DNA, 25 bp, Rattus norvegicus
aatgtcctgacttcggagggcacca

SEQ ID NO: 493562 - DNA, 25 bp, Rattus norvegicus
aggagacgcggtcccttcagatccc

SEQ ID NO: 493563 - DNA, 25 bp, Rattus norvegicus
ggatcccgcgcagagactcgaggaa

SEQ ID NO: 493564 - DNA, 25 bp, Rattus norvegicus
gtacggggagcccagtccgtctcgc

SEQ ID NO: 493565 - DNA, 25 bp, Rattus norvegicus
cttgactcggaggtcaaatgtcctg

SEQ ID NO: 493566 - DNA, 25 bp, Rattus norvegicus
cgcagagactcgaggaagactaggt

SEQ ID NO: 493567 - DNA, 25 bp, Rattus norvegicus
ttctacctctccctggtggcggcgg

SEQ ID NO: 493568 - DNA, 25 bp, Rattus norvegicus
cctccgcccaggtggggattgcact

SEQ ID NO: 493569 - DNA, 25 bp, Rattus norvegicus
gggattgcactcagcacagtgctca

SEQ ID NO: 493570 - DNA, 25 bp, Rattus norvegicus
actcagcacagtgctcaggggcacc

SEQ ID NO: 493571 - DNA, 25 bp, Rattus norvegicus
tcccgctgactccactcgagggtag

SEQ ID NO: 493572 - DNA, 25 bp, Rattus norvegicus
tgactccactcgagggtagccggta

SEQ ID NO: 493573 - DNA, 25 bp, Rattus norvegicus
agcactaggaggctcggccatccag

SEQ ID NO: 493574 - DNA, 25 bp, Rattus norvegicus
tgccctcggccaaacaaaggggctc

SEQ ID NO: 493575 - DNA, 25 bp, Rattus norvegicus
acccgcagaatcaggcgcaccgggg

SEQ ID NO: 493576 - DNA, 25 bp, Rattus norvegicus
ttggccggctgctcaactttctctt

SEQ ID NO: 493577 - DNA, 25 bp, Rattus norvegicus
cggccgccttctccggctggtatgt

SEQ ID NO: 493578 - DNA, 25 bp, Rattus norvegicus
ctccggctggtatgtccatcacgtc

SEQ ID NO: 493579 - DNA, 25 bp, Rattus norvegicus
tccatcacgtcctggaagaggtcca

SEQ ID NO: 493580 - DNA, 25 bp, Rattus norvegicus
tctgcgtcctgttcgcgcaggcttg

SEQ ID NO: 493581 - DNA, 25 bp, Rattus norvegicus
gtctggtcccagtctacctacgctg

SEQ ID NO: 493582 - DNA, 25 bp, Rattus norvegicus
cctacgctgggtccagagaggtgta

SEQ ID NO: 493583 - DNA, 25 bp, Rattus norvegicus
ttctccacgtcaccaggggtctcga

SEQ ID NO: 493584 - DNA, 25 bp, Rattus norvegicus
ccgcagggccacaaacggatgctca

SEQ ID NO: 493585 - DNA, 25 bp, Rattus norvegicus
aggtcgcccagcgtaaagcctcgta

SEQ ID NO: 493586 - DNA, 25 bp, Rattus norvegicus
tttcaaagggacagccagctcggcc

SEQ ID NO: 493587 - DNA, 25 bp, Rattus norvegicus
ggccttggcctccaagtcttccgag

SEQ ID NO: 493588 - DNA, 25 bp, Rattus norvegicus
ttaggcgattgccttccagccggct

SEQ ID NO: 493589 - DNA, 25 bp, Rattus norvegicus
cgcgcctactgcagtgtgtgtacga

SEQ ID NO: 493590 - DNA, 25 bp, Rattus norvegicus
tttgccactacagacgaactcagct

SEQ ID NO: 493591 - DNA, 25 bp, Rattus norvegicus
ctcagctgttgttcacggagaagtc

SEQ ID NO: 493592 - DNA, 25 bp, Rattus norvegicus
cacggagaagtctgtgcgcacacgc

SEQ ID NO: 493593 - DNA, 25 bp, Rattus norvegicus
gcaaacgattttctgggacacggta

SEQ ID NO: 493594 - DNA, 25 bp, Rattus norvegicus
ccgagacgattgtgtgcctgcccac

SEQ ID NO: 493595 - DNA, 25 bp, Rattus norvegicus
gccactcggcagtttccgaccggtg

SEQ ID NO: 493596 - DNA, 25 bp, Rattus norvegicus
ggcttctcaccatttccagggagtc

SEQ ID NO: 493597 - DNA, 25 bp, Rattus norvegicus
aaggatggatgtgcgtctggcgttt

SEQ ID NO: 493598 - DNA, 25 bp, Rattus norvegicus
agtgaacaggggagaaccacttccg

SEQ ID NO: 493599 - DNA, 25 bp, Rattus norvegicus
cctatcgagtgaacaggggagaacc

SEQ ID NO: 493600 - DNA, 25 bp, Rattus norvegicus
ccgggctagacctgcggttgtgccc

SEQ ID NO: 493601 - DNA, 25 bp, Rattus norvegicus
agcccggagcatgccgggctagacc

SEQ ID NO: 493602 - DNA, 25 bp, Rattus norvegicus
cagaaaagggccagaggtcaccgga

SEQ ID NO: 493603 - DNA, 25 bp, Rattus norvegicus
gacgacagaaaagggccagaggtca

SEQ ID NO: 493604 - DNA, 25 bp, Rattus norvegicus
taagcagcaggagcggacgacagaa

SEQ ID NO: 493605 - DNA, 25 bp, Rattus norvegicus
ggcggcttctcaccatttccaggga

SEQ ID NO: 493606 - DNA, 25 bp, Rattus norvegicus
aggaaaagctgcatccgctcctttt

SEQ ID NO: 493607 - DNA, 25 bp, Rattus norvegicus
caacgggtcaaggaaaagctgcatc

SEQ ID NO: 493608 - DNA, 25 bp, Rattus norvegicus
ccgcacaacgggtcaaggaaaagct

SEQ ID NO: 493609 - DNA, 25 bp, Rattus norvegicus
agccacggagctttccacttcgccc

SEQ ID NO: 493610 - DNA, 25 bp, Rattus norvegicus
tgggaagtcgaagttccagttctcc

SEQ ID NO: 493611 - DNA, 25 bp, Rattus norvegicus
ctttggtccacaatgcgcgcccaaa

SEQ ID NO: 493612 - DNA, 25 bp, Rattus norvegicus
gcaaaccgcactaacctcctcaact

SEQ ID NO: 493613 - DNA, 25 bp, Rattus norvegicus
aagtcgaagttccagttctcccttg

SEQ ID NO: 493614 - DNA, 25 bp, Rattus norvegicus
gtcgaagttccagttctcccttgaa

SEQ ID NO: 493615 - DNA, 25 bp, Rattus norvegicus
gaagttccagttctcccttgaaatg

SEQ ID NO: 493616 - DNA, 25 bp, Rattus norvegicus
cgctgctaagtgtggtccccagtgg

SEQ ID NO: 493617 - DNA, 25 bp, Rattus norvegicus
ctgggaagtcgaagttccagttctc

SEQ ID NO: 493618 - DNA, 25 bp, Rattus norvegicus
gcccacttggacctttggtccacaa

SEQ ID NO: 493619 - DNA, 25 bp, Rattus norvegicus
acttggacctttggtccacaatgcg

SEQ ID NO: 493620 - DNA, 25 bp, Rattus norvegicus
ggacctttggtccacaatgcgcgcc

SEQ ID NO: 493621 - DNA, 25 bp, Rattus norvegicus
ttggtccacaatgcgcgcccaaaca

SEQ ID NO: 493622 - DNA, 25 bp, Rattus norvegicus
aagttccagttctcccttgaaatga

SEQ ID NO: 493623 - DNA, 25 bp, Rattus norvegicus
aggtggcctcactgctgccagtcag

SEQ ID NO: 493624 - DNA, 25 bp, Rattus norvegicus
accaaccgcctagggtcggagcatg

SEQ ID NO: 493625 - DNA, 25 bp, Rattus norvegicus
cagcccaggcatggctgctcagttc

SEQ ID NO: 493626 - DNA, 25 bp, Rattus norvegicus
ccgcactcacggttggcgatgtcgc

SEQ ID NO: 493627 - DNA, 25 bp, Rattus norvegicus
acgaccaggtcctcggcgatagttt

SEQ ID NO: 493628 - DNA, 25 bp, Rattus norvegicus
cgatagtttgctcctgctgctcgtc

SEQ ID NO: 493629 - DNA, 25 bp, Rattus norvegicus
ccacaagctgtagccggagtctctt

SEQ ID NO: 493630 - DNA, 25 bp, Rattus norvegicus
ggagtctcttcgatccgcgaggaaa

SEQ ID NO: 493631 - DNA, 25 bp, Rattus norvegicus
gcagggtacactgggacaatgagtc

SEQ ID NO: 493632 - DNA, 25 bp, Rattus norvegicus
tcgagcgctcgagaactacaattcc

SEQ ID NO: 493633 - DNA, 25 bp, Rattus norvegicus
tgtctccgggaaaaacctctcattc

SEQ ID NO: 493634 - DNA, 25 bp, Rattus norvegicus
agcgccgacccagagctcttaacag

SEQ ID NO: 493635 - DNA, 25 bp, Rattus norvegicus
aaaggggcgcttccgtcgccaacag

SEQ ID NO: 493636 - DNA, 25 bp, Rattus norvegicus
aacagctggccgcttccctttcgag

SEQ ID NO: 493637 - DNA, 25 bp, Rattus norvegicus
tggctctgtgcgttgtcgcctctgc

SEQ ID NO: 493638 - DNA, 25 bp, Rattus norvegicus
ccgaagcatccctcctggggacttt

SEQ ID NO: 493639 - DNA, 25 bp, Rattus norvegicus
ctcggcttgcctggcgcttggtcat

SEQ ID NO: 493640 - DNA, 25 bp, Rattus norvegicus
gccacaccagaacaaacattaagaa

SEQ ID NO: 493641 - DNA, 25 bp, Rattus norvegicus
tcctggggactttccaggccctgcg

SEQ ID NO: 493642 - DNA, 25 bp, Rattus norvegicus
cctctggtcacagagcgtgcgcctg

SEQ ID NO: 493643 - DNA, 25 bp, Rattus norvegicus
ccgtgagctttatccgaggccgata

SEQ ID NO: 493644 - DNA, 25 bp, Rattus norvegicus
atccgaggccgataggcctaagcta

SEQ ID NO: 493645 - DNA, 25 bp, Rattus norvegicus
gcctaagctagctgcggaacgcccg

SEQ ID NO: 493646 - DNA, 25 bp, Rattus norvegicus
aacgcccgcagtagctccggagggt

SEQ ID NO: 493647 - DNA, 25 bp, Rattus norvegicus
aggggacaagcgcactgacgaccgc

SEQ ID NO: 493648 - DNA, 25 bp, Rattus norvegicus
ccacccggcgaggacaaagcgactt

SEQ ID NO: 493649 - DNA, 25 bp, Rattus norvegicus
ccgcgccgcacaaagagtgaacgac

SEQ ID NO: 493650 - DNA, 25 bp, Rattus norvegicus
tcgggtcgtctcagcaatgctgctg

SEQ ID NO: 493651 - DNA, 25 bp, Rattus norvegicus
agatgaaggccaagcccggggcctc

SEQ ID NO: 493652 - DNA, 25 bp, Rattus norvegicus
ctggggctacaagagcagcgtctgt

SEQ ID NO: 493653 - DNA, 25 bp, Rattus norvegicus
agcagcgtctgtgactgcgatgccc

SEQ ID NO: 493654 - DNA, 25 bp, Rattus norvegicus
tgtgactgcgatgcccttcccgact

SEQ ID NO: 493655 - DNA, 25 bp, Rattus norvegicus
gggccaccatcgaggacatcgccaa

SEQ ID NO: 493656 - DNA, 25 bp, Rattus norvegicus
cgagtctccgctcttggctcggatc

SEQ ID NO: 493657 - DNA, 25 bp, Rattus norvegicus
tcgccaaccactggtgggtgaactg

SEQ ID NO: 493658 - DNA, 25 bp, Rattus norvegicus
ccgctcttggctcggatcattgatt

SEQ ID NO: 493659 - DNA, 25 bp, Rattus norvegicus
gctcggatcattgattggcatcacc

SEQ ID NO: 493660 - DNA, 25 bp, Rattus norvegicus
tgattggcatcaccgctccaccggg

SEQ ID NO: 493661 - DNA, 25 bp, Rattus norvegicus
ctccaccgggctgcaggctgaggct

SEQ ID NO: 493662 - DNA, 25 bp, Rattus norvegicus
tgacgccaagatgaaggccaagccc

SEQ ID NO: 493663 - DNA, 25 bp, Rattus norvegicus
cgaggacatcgccaaccactggtgg

SEQ ID NO: 493664 - DNA, 25 bp, Rattus norvegicus
tgcaggctgaggctgacgccaagat

SEQ ID NO: 493665 - DNA, 25 bp, Rattus norvegicus
atctctcggagctacagtcgcccgt

SEQ ID NO: 493666 - DNA, 25 bp, Rattus norvegicus
cgaaatacccacactggaatccttg

SEQ ID NO: 493667 - DNA, 25 bp, Rattus norvegicus
tccgatggcatctctcggagctaca

SEQ ID NO: 493668 - DNA, 25 bp, Rattus norvegicus
agtcgcccgtccagtatcatcagtg

SEQ ID NO: 493669 - DNA, 25 bp, Rattus norvegicus
tatcatcagtgacgacagcgtcctg

SEQ ID NO: 493670 - DNA, 25 bp, Rattus norvegicus
gcgtcctgtccagcgactctttcga

SEQ ID NO: 493671 - DNA, 25 bp, Rattus norvegicus
ccagcgactctttcgacttgttaga

SEQ ID NO: 493672 - DNA, 25 bp, Rattus norvegicus
tcgacttgttagatctccaggagaa

SEQ ID NO: 493673 - DNA, 25 bp, Rattus norvegicus
gatctccaggagaatcggccggccc

SEQ ID NO: 493674 - DNA, 25 bp, Rattus norvegicus
cagcgcatccgcagctgcgtctctg

SEQ ID NO: 493675 - DNA, 25 bp, Rattus norvegicus
tgcgtctctgcggaaaacttcctcc

SEQ ID NO: 493676 - DNA, 25 bp, Rattus norvegicus
tctgcggaaaacttcctccagcttc

SEQ ID NO: 493677 - DNA, 25 bp, Rattus norvegicus
ctccagcttcaggactttgagactc

SEQ ID NO: 493678 - DNA, 25 bp, Rattus norvegicus
tggaatccttgtcgcctcccggtgt

SEQ ID NO: 493679 - DNA, 25 bp, Rattus norvegicus
aaccgtggcgccaaccaatgcgcag

SEQ ID NO: 493680 - DNA, 25 bp, Rattus norvegicus
aggggcaccggcttcctctcggtct

SEQ ID NO: 493681 - DNA, 25 bp, Rattus norvegicus
ccagaagcgggcgagcttcagtctc

SEQ ID NO: 493682 - DNA, 25 bp, Rattus norvegicus
agcgggcgagcttcagtctcagaaa

SEQ ID NO: 493683 - DNA, 25 bp, Rattus norvegicus
ggcgagcttcagtctcagaaattga

SEQ ID NO: 493684 - DNA, 25 bp, Rattus norvegicus
cagtctcagaaattgaggatggggc

SEQ ID NO: 493685 - DNA, 25 bp, Rattus norvegicus
gccgcctctcccgagggacccacgc

SEQ ID NO: 493686 - DNA, 25 bp, Rattus norvegicus
cgtagcctggcttacctcggcccgc

SEQ ID NO: 493687 - DNA, 25 bp, Rattus norvegicus
tggccgtggagttcccgcaacccat

SEQ ID NO: 493688 - DNA, 25 bp, Rattus norvegicus
cccatcgcgccacccgcagggaatc

SEQ ID NO: 493689 - DNA, 25 bp, Rattus norvegicus
agggaatccgcgctctggacctcag

SEQ ID NO: 493690 - DNA, 25 bp, Rattus norvegicus
gaatccgcgctctggacctcaggtc

SEQ ID NO: 493691 - DNA, 25 bp, Rattus norvegicus
cgcgggaccagggacagccctagcc

SEQ ID NO: 493692 - DNA, 25 bp, Rattus norvegicus
tcctgcgcgttcctgggccgggcat

SEQ ID NO: 493693 - DNA, 25 bp, Rattus norvegicus
ggcaatcggctgtcccatagtagta

SEQ ID NO: 493694 - DNA, 25 bp, Rattus norvegicus
agctacacgtctggtgctggccaca

SEQ ID NO: 493695 - DNA, 25 bp, Rattus norvegicus
ccatgcccgccgtggacaagctcct

SEQ ID NO: 493696 - DNA, 25 bp, Rattus norvegicus
gtcccatagtagtagctcgctcacg

SEQ ID NO: 493697 - DNA, 25 bp, Rattus norvegicus
tgtcccgtgctagaccagctacacg

SEQ ID NO: 493698 - DNA, 25 bp, Rattus norvegicus
cacacttccggtgtcccgtgctaga

SEQ ID NO: 493699 - DNA, 25 bp, Rattus norvegicus
tgctggccacacttcctgttgatcc

SEQ ID NO: 493700 - DNA, 25 bp, Rattus norvegicus
ccaccgggagaaccgccaggagcga

SEQ ID NO: 493701 - DNA, 25 bp, Rattus norvegicus
cacacttcctgttgatccgggcggc

SEQ ID NO: 493702 - DNA, 25 bp, Rattus norvegicus
ggaacctcccatcgccactgccctg

SEQ ID NO: 493703 - DNA, 25 bp, Rattus norvegicus
cgggctcggagctaagcctcaagtc

SEQ ID NO: 493704 - DNA, 25 bp, Rattus norvegicus
ttcgagcaagcgaagagcagcctcc

SEQ ID NO: 493705 - DNA, 25 bp, Rattus norvegicus
cacaggggagggcaacttcgagcaa

SEQ ID NO: 493706 - DNA, 25 bp, Rattus norvegicus
tcggaagcgtggtcgccacacttcc

SEQ ID NO: 493707 - DNA, 25 bp, Rattus norvegicus
tcgtccacgcggtcgaagtcccagt

SEQ ID NO: 493708 - DNA, 25 bp, Rattus norvegicus
cttactctgagagccgtcgtccacg

SEQ ID NO: 493709 - DNA, 25 bp, Rattus norvegicus
caaagcctgggacgggatgcgcaac

SEQ ID NO: 493710 - DNA, 25 bp, Rattus norvegicus
agtcccagtcgggtgacagagtgtc

SEQ ID NO: 493711 - DNA, 25 bp, Rattus norvegicus
cgcccgacgctgaggcttactctga

SEQ ID NO: 493712 - DNA, 25 bp, Rattus norvegicus
agtgtccacggccatcgccgcggaa

SEQ ID NO: 493713 - DNA, 25 bp, Rattus norvegicus
tgcgcaacccgggaggctggcctct

SEQ ID NO: 493714 - DNA, 25 bp, Rattus norvegicus
cgccgcggaacctcccacagacaca

SEQ ID NO: 493715 - DNA, 25 bp, Rattus norvegicus
cagccgctgtcaccgcacgtgactt

SEQ ID NO: 493716 - DNA, 25 bp, Rattus norvegicus
gcgcaccagagccagtggactctcg

SEQ ID NO: 493717 - DNA, 25 bp, Rattus norvegicus
agagccagtggactctcggccctgc

SEQ ID NO: 493718 - DNA, 25 bp, Rattus norvegicus
gagtcactgggaaagcgagtcgtcc

SEQ ID NO: 493719 - DNA, 25 bp, Rattus norvegicus
ggaaagcgagtcgtccgcctgcacc

SEQ ID NO: 493720 - DNA, 25 bp, Rattus norvegicus
gtgacagagtgtccacggccatcgc

SEQ ID NO: 493721 - DNA, 25 bp, Rattus norvegicus
tgcggtaggcagacaccagcctctc

SEQ ID NO: 493722 - DNA, 25 bp, Rattus norvegicus
tctgcgtgaacttgttgcggtaggc

SEQ ID NO: 493723 - DNA, 25 bp, Rattus norvegicus
aggaggtgttgtacttctgcgtgaa

SEQ ID NO: 493724 - DNA, 25 bp, Rattus norvegicus
ggatgatcttcgtgccgtagcgctt

SEQ ID NO: 493725 - DNA, 25 bp, Rattus norvegicus
ggccacgaactcctcgaacttgaca

SEQ ID NO: 493726 - DNA, 25 bp, Rattus norvegicus
gtcgatgaggtaggccacgaactcc

SEQ ID NO: 493727 - DNA, 25 bp, Rattus norvegicus
tagaccgtctgccagtgctcgttga

SEQ ID NO: 493728 - DNA, 25 bp, Rattus norvegicus
cgtacttgcccacgaggtcgtagtg

SEQ ID NO: 493729 - DNA, 25 bp, Rattus norvegicus
cggccagccgcagtacgtaattgga

SEQ ID NO: 493730 - DNA, 25 bp, Rattus norvegicus
ggggaacttcaggtagccgctcacc

SEQ ID NO: 493731 - DNA, 25 bp, Rattus norvegicus
gttctggaagaactccgtggtcatc

SEQ ID NO: 493732 - DNA, 25 bp, Rattus norvegicus
tccgtggtcatctcgtcggtagttc

SEQ ID NO: 493733 - DNA, 25 bp, Rattus norvegicus
tcggtagttcgggtggactttgcat

SEQ ID NO: 493734 - DNA, 25 bp, Rattus norvegicus
gactttgcataggtggggaacttca

SEQ ID NO: 493735 - DNA, 25 bp, Rattus norvegicus
cccattctccggtgtggcgagaagc

SEQ ID NO: 493736 - DNA, 25 bp, Rattus norvegicus
ccggcttcatggctttgtcctggcc

SEQ ID NO: 493737 - DNA, 25 bp, Rattus norvegicus
accagcgcccgggaggttcagaacg

SEQ ID NO: 493738 - DNA, 25 bp, Rattus norvegicus
tccctcgccaaaagctacttcattg

SEQ ID NO: 493739 - DNA, 25 bp, Rattus norvegicus
cttcattgcgctccagtgatctata

SEQ ID NO: 493740 - DNA, 25 bp, Rattus norvegicus
gtgatctatatattccagggctggg

SEQ ID NO: 493741 - DNA, 25 bp, Rattus norvegicus
ggttttaccaaacgcaactcgcagc

SEQ ID NO: 493742 - DNA, 25 bp, Rattus norvegicus
cctacccgagacgtggtggcgtcca

SEQ ID NO: 493743 - DNA, 25 bp, Rattus norvegicus
caaaagccctcagtccctgggcgga

SEQ ID NO: 493744 - DNA, 25 bp, Rattus norvegicus
tgtctcgagcttgcgtgaacgtttc

SEQ ID NO: 493745 - DNA, 25 bp, Rattus norvegicus
tgaacgtttccatgacacaaccggg

SEQ ID NO: 493746 - DNA, 25 bp, Rattus norvegicus
tgctgtagtgctgccacccattctc

SEQ ID NO: 493747 - DNA, 25 bp, Rattus norvegicus
tggtggcacgcgatcgtttaaaatc

SEQ ID NO: 493748 - DNA, 25 bp, Rattus norvegicus
ggggaaaaccacgaataagatgctg

SEQ ID NO: 493749 - DNA, 25 bp, Rattus norvegicus
tcggctcacacttcctacacttggt

SEQ ID NO: 493750 - DNA, 25 bp, Rattus norvegicus
gcctcgtagcgacccggtcagctga

SEQ ID NO: 493751 - DNA, 25 bp, Rattus norvegicus
tgtcggtagcctccctgcgacactg

SEQ ID NO: 493752 - DNA, 25 bp, Rattus norvegicus
tgcgattggccaggtccgcgcagcc

SEQ ID NO: 493753 - DNA, 25 bp, Rattus norvegicus
ctcttgctaggctcgttgggtgtgt

SEQ ID NO: 493754 - DNA, 25 bp, Rattus norvegicus
tgccacgtacgggaccgcggctctt

SEQ ID NO: 493755 - DNA, 25 bp, Rattus norvegicus
acacttggtcatccagtgaggaagc

SEQ ID NO: 493756 - DNA, 25 bp, Rattus norvegicus
ctggtaattcctcgcgcatgcgtgt

SEQ ID NO: 493757 - DNA, 25 bp, Rattus norvegicus
accggaagtgctggtaattcctcgc

SEQ ID NO: 493758 - DNA, 25 bp, Rattus norvegicus
tagctgtcgggaaaaccggaagtgc

SEQ ID NO: 493759 - DNA, 25 bp, Rattus norvegicus
gcaattactagctgtcgggaaaacc

SEQ ID NO: 493760 - DNA, 25 bp, Rattus norvegicus
ccggagagagttagcaattactagc

SEQ ID NO: 493761 - DNA, 25 bp, Rattus norvegicus
cgcccaccggagagagttagcaatt

SEQ ID NO: 493762 - DNA, 25 bp, Rattus norvegicus
ctctggttggcctgtccgtcttgag

SEQ ID NO: 493763 - DNA, 25 bp, Rattus norvegicus
aaagcagagcggcagtgagccttcc

SEQ ID NO: 493764 - DNA, 25 bp, Rattus norvegicus
aatccgggatcgtgcgcggttccta

SEQ ID NO: 493765 - DNA, 25 bp, Rattus norvegicus
gatcgtgcgcggttcctaccttcag

SEQ ID NO: 493766 - DNA, 25 bp, Rattus norvegicus
gcggttcctaccttcagggctggac

SEQ ID NO: 493767 - DNA, 25 bp, Rattus norvegicus
gttcctaccttcagggctggaccat

SEQ ID NO: 493768 - DNA, 25 bp, Rattus norvegicus
cagggctggaccatggccgccctcc

SEQ ID NO: 493769 - DNA, 25 bp, Rattus norvegicus
gctctccctcgccttctgccggctc

SEQ ID NO: 493770 - DNA, 25 bp, Rattus norvegicus
tcccgcggcctctccgtttgcccgc

SEQ ID NO: 493771 - DNA, 25 bp, Rattus norvegicus
agagcggcagtgagccttcctccgg

SEQ ID NO: 493772 - DNA, 25 bp, Rattus norvegicus
cgggacgccacacgccctccggtca

SEQ ID NO: 493773 - DNA, 25 bp, Rattus norvegicus
ggtcactcccgccagtggactccga

SEQ ID NO: 493774 - DNA, 25 bp, Rattus norvegicus
agtggactccgacccgcaagcagcc

SEQ ID NO: 493775 - DNA, 25 bp, Rattus norvegicus
ctgtggcacaaagcagagcggcagt

SEQ ID NO: 493776 - DNA, 25 bp, Rattus norvegicus
gccgccctctgtggcacaaagcaga

SEQ ID NO: 493777 - DNA, 25 bp, Rattus norvegicus
aagagaggctggttcctagtggctc

SEQ ID NO: 493778 - DNA, 25 bp, Rattus norvegicus
cgtgaaacatcctcgctgcccggaa

SEQ ID NO: 493779 - DNA, 25 bp, Rattus norvegicus
gctcctaattggaccgtgaaacatc

SEQ ID NO: 493780 - DNA, 25 bp, Rattus norvegicus
cccgcaaagtgagagctcctaattg

SEQ ID NO: 493781 - DNA, 25 bp, Rattus norvegicus
agcaaaaatccagtcctcgcgcagc

SEQ ID NO: 493782 - DNA, 25 bp, Rattus norvegicus
tgtcagaatgacaaagcaaaaatcc

SEQ ID NO: 493783 - DNA, 25 bp, Rattus norvegicus
gcgaactgcccgtgtcagaatgaca

SEQ ID NO: 493784 - DNA, 25 bp, Rattus norvegicus
cctgctcttagtaggcgggcgaact

SEQ ID NO: 493785 - DNA, 25 bp, Rattus norvegicus
ggttcctagtggctccgggaagcca

SEQ ID NO: 493786 - DNA, 25 bp, Rattus norvegicus
actgaggataaagagaggctggttc

SEQ ID NO: 493787 - DNA, 25 bp, Rattus norvegicus
gcctgacggaagcacactgaggata

SEQ ID NO: 493788 - DNA, 25 bp, Rattus norvegicus
atgcgaggcctgacggaagcacact

SEQ ID NO: 493789 - DNA, 25 bp, Rattus norvegicus
acctcccgcgtggatgcgaggcctg

SEQ ID NO: 493790 - DNA, 25 bp, Rattus norvegicus
ggaagccacgccctgctcttagtag

SEQ ID NO: 493791 - DNA, 25 bp, Rattus norvegicus
agtttacgttctctgggcattagcc

SEQ ID NO: 493792 - DNA, 25 bp, Rattus norvegicus
ggtggcttctaaactacgcagagtt

SEQ ID NO: 493793 - DNA, 25 bp, Rattus norvegicus
cgcagagttttgaggcgggcataac

SEQ ID NO: 493794 - DNA, 25 bp, Rattus norvegicus
tttgaggcgggcataacgaacatgg

SEQ ID NO: 493795 - DNA, 25 bp, Rattus norvegicus
tctcctcgtacccttgctcagctgc

SEQ ID NO: 493796 - DNA, 25 bp, Rattus norvegicus
tcgaaggcagagtcggtggcttcta

SEQ ID NO: 493797 - DNA, 25 bp, Rattus norvegicus
ccagtaatcggggttgtcgaaggca

SEQ ID NO: 493798 - DNA, 25 bp, Rattus norvegicus
ctgctgtgccagtaatcggggttgt

SEQ ID NO: 493799 - DNA, 25 bp, Rattus norvegicus
ggaaaagcctgctgtgccagtaatc

SEQ ID NO: 493800 - DNA, 25 bp, Rattus norvegicus
ctctgggcattagccttggggaaaa

SEQ ID NO: 493801 - DNA, 25 bp, Rattus norvegicus
cgtcacggagcagaagtttacgttc

SEQ ID NO: 493802 - DNA, 25 bp, Rattus norvegicus
gcccgcagagcgtcacggagcagaa

SEQ ID NO: 493803 - DNA, 25 bp, Rattus norvegicus
ggcagagtcggtggcttctaaacta

SEQ ID NO: 493804 - DNA, 25 bp, Rattus norvegicus
tagccttggggaaaagcctgctgtg

SEQ ID NO: 493805 - DNA, 25 bp, Rattus norvegicus
cacgcgagggaggaggaccgaaagc

SEQ ID NO: 493806 - DNA, 25 bp, Rattus norvegicus
agctggttgggccaccaacgccttt

SEQ ID NO: 493807 - DNA, 25 bp, Rattus norvegicus
aacgcctttgagaacccgcggctga

SEQ ID NO: 493808 - DNA, 25 bp, Rattus norvegicus
cgcctttgagaacccgcggctgagg

SEQ ID NO: 493809 - DNA, 25 bp, Rattus norvegicus
caggaggagcccgttggcgacctgc

SEQ ID NO: 493810 - DNA, 25 bp, Rattus norvegicus
ctctccgctccagcccagccgccga

SEQ ID NO: 493811 - DNA, 25 bp, Rattus norvegicus
agccgccgatccctcggaggctctg

SEQ ID NO: 493812 - DNA, 25 bp, Rattus norvegicus
tcctccgggaggagcgcactatggg

SEQ ID NO: 493813 - DNA, 25 bp, Rattus norvegicus
cactatgggcgcagcgtggatgagc

SEQ ID NO: 493814 - DNA, 25 bp, Rattus norvegicus
atgagcgcagctcggccgtacctga

SEQ ID NO: 493815 - DNA, 25 bp, Rattus norvegicus
ggttgggccaccaacgcctttgaga

SEQ ID NO: 493816 - DNA, 25 bp, Rattus norvegicus
ttgctctcgcgcagctcaacacgcg

SEQ ID NO: 493817 - DNA, 25 bp, Rattus norvegicus
gaagagataagctgtgggtcgcgcc

SEQ ID NO: 493818 - DNA, 25 bp, Rattus norvegicus
tacctgacgcaccttagccgctttg

SEQ ID NO: 493819 - DNA, 25 bp, Rattus norvegicus
accgactccactttagctcgaatga

SEQ ID NO: 493820 - DNA, 25 bp, Rattus norvegicus
ggatcagaacgccagcctctccgaa

SEQ ID NO: 493821 - DNA, 25 bp, Rattus norvegicus
cgagacgcctgttcgtgaggaagaa

SEQ ID NO: 493822 - DNA, 25 bp, Rattus norvegicus
ggccggagcaaacccgctctgcaag

SEQ ID NO: 493823 - DNA, 25 bp, Rattus norvegicus
gctcgaatgaaatgtccgtctcctc

SEQ ID NO: 493824 - DNA, 25 bp, Rattus norvegicus
ggccaatgatcgctcctaaaccgac

SEQ ID NO: 493825 - DNA, 25 bp, Rattus norvegicus
ttgtgtctcgcttcggccaatgatc

SEQ ID NO: 493826 - DNA, 25 bp, Rattus norvegicus
ccaaccagggctgcattggaggttt

SEQ ID NO: 493827 - DNA, 25 bp, Rattus norvegicus
cagccgattggagacgggagccaac

SEQ ID NO: 493828 - DNA, 25 bp, Rattus norvegicus
ttctgtccaaccaaacagccgattg

SEQ ID NO: 493829 - DNA, 25 bp, Rattus norvegicus
gggactggttccttcgcagccattt

SEQ ID NO: 493830 - DNA, 25 bp, Rattus norvegicus
ccttgcttctggactcccaggcggg

SEQ ID NO: 493831 - DNA, 25 bp, Rattus norvegicus
agatcagcgagcgtccagagcccgc

SEQ ID NO: 493832 - DNA, 25 bp, Rattus norvegicus
tccgaagctcagcagcaaggagatc

SEQ ID NO: 493833 - DNA, 25 bp, Rattus norvegicus
cgcctaccggtgttgtagacgtgca

SEQ ID NO: 493834 - DNA, 25 bp, Rattus norvegicus
cttcgttccaagaagatgggtgcaa

SEQ ID NO: 493835 - DNA, 25 bp, Rattus norvegicus
accgaagttacagagccagaagagc

SEQ ID NO: 493836 - DNA, 25 bp, Rattus norvegicus
tgagaaagtcttgccggcttccgcc

SEQ ID NO: 493837 - DNA, 25 bp, Rattus norvegicus
gcccgtttagagaactgtcgactga

SEQ ID NO: 493838 - DNA, 25 bp, Rattus norvegicus
gcagggatcactccgggttcaccca

SEQ ID NO: 493839 - DNA, 25 bp, Rattus norvegicus
tacatcggttttgcagggatcactc

SEQ ID NO: 493840 - DNA, 25 bp, Rattus norvegicus
ggcaaagaccactgaggcccggctt

SEQ ID NO: 493841 - DNA, 25 bp, Rattus norvegicus
ttgttcttgacactggcgggatctc

SEQ ID NO: 493842 - DNA, 25 bp, Rattus norvegicus
ttccagcacattgcgagctcgggct

SEQ ID NO: 493843 - DNA, 25 bp, Rattus norvegicus
tctcgatgtctaccggcggagtcac

SEQ ID NO: 493844 - DNA, 25 bp, Rattus norvegicus
cggagtcacgtccagcccgaggaac

SEQ ID NO: 493845 - DNA, 25 bp, Rattus norvegicus
gatgatcatcagctcccggatggcc

SEQ ID NO: 493846 - DNA, 25 bp, Rattus norvegicus
cccggaagggcaaagcgtatacata

SEQ ID NO: 493847 - DNA, 25 bp, Rattus norvegicus
gcggtatatggacccgtgaacagac

SEQ ID NO: 493848 - DNA, 25 bp, Rattus norvegicus
tcgatgcccttcagctggtctcgca

SEQ ID NO: 493849 - DNA, 25 bp, Rattus norvegicus
cctgaacgtccgtgctgcgctcgat

SEQ ID NO: 493850 - DNA, 25 bp, Rattus norvegicus
cgtgaacagacactaaaacccgcta

SEQ ID NO: 493851 - DNA, 25 bp, Rattus norvegicus
acccgctaccagaggaagctggtga

SEQ ID NO: 493852 - DNA, 25 bp, Rattus norvegicus
tagcaaaccttgtgcgagctgcagg

SEQ ID NO: 493853 - DNA, 25 bp, Rattus norvegicus
gtactgcacctcctgaacgtccgtg

SEQ ID NO: 493854 - DNA, 25 bp, Rattus norvegicus
ggtcgaacgtgtactgcacctcctg

SEQ ID NO: 493855 - DNA, 25 bp, Rattus norvegicus
gcgagctgcaggtcgaacgtgtact

SEQ ID NO: 493856 - DNA, 25 bp, Rattus norvegicus
aatggactttgtcctgcgcccgagg

SEQ ID NO: 493857 - DNA, 25 bp, Rattus norvegicus
cagcttaatgtagtaatggactttg

SEQ ID NO: 493858 - DNA, 25 bp, Rattus norvegicus
agggacggtagcaaaccttgtgcga

SEQ ID NO: 493859 - DNA, 25 bp, Rattus norvegicus
gcaagtccttcagcttaatgtagta

SEQ ID NO: 493860 - DNA, 25 bp, Rattus norvegicus
ttcagctggtctcgcaagtccttca

SEQ ID NO: 493861 - DNA, 25 bp, Rattus norvegicus
ggactcaccacaggatccgggcggc

SEQ ID NO: 493862 - DNA, 25 bp, Rattus norvegicus
ggcgagtccacagtgcacttccgtc

SEQ ID NO: 493863 - DNA, 25 bp, Rattus norvegicus
acgctgctacatcaccgcggcgagt

SEQ ID NO: 493864 - DNA, 25 bp, Rattus norvegicus
cctctagagcccaccgtgatggaga

SEQ ID NO: 493865 - DNA, 25 bp, Rattus norvegicus
gaggacgccgctgcaagcacattca

SEQ ID NO: 493866 - DNA, 25 bp, Rattus norvegicus
tgacactggccaagccaatggcgtc

SEQ ID NO: 493867 - DNA, 25 bp, Rattus norvegicus
ctgagagtgcggctactcctgccca

SEQ ID NO: 493868 - DNA, 25 bp, Rattus norvegicus
caatggcgtctcctttttggggcac

SEQ ID NO: 493869 - DNA, 25 bp, Rattus norvegicus
accgtgatggagaatgaagaactgc

SEQ ID NO: 493870 - DNA, 25 bp, Rattus norvegicus
cacaccaccttttaaagctcgcggg

SEQ ID NO: 493871 - DNA, 25 bp, Rattus norvegicus
taaagctcgcgggtacccgaggctg

SEQ ID NO: 493872 - DNA, 25 bp, Rattus norvegicus
ggtggcctcgctgtcacatgacact

SEQ ID NO: 493873 - DNA, 25 bp, Rattus norvegicus
agcggtgaggtctccaccgcgcacg

SEQ ID NO: 493874 - DNA, 25 bp, Rattus norvegicus
tgcaagcacattcacagggcacccg

SEQ ID NO: 493875 - DNA, 25 bp, Rattus norvegicus
cccaggctggctaaggtgtggaaac

SEQ ID NO: 493876 - DNA, 25 bp, Rattus norvegicus
caaacgcaggattgggacagtgtcc

SEQ ID NO: 493877 - DNA, 25 bp, Rattus norvegicus
tcttcctagccacttggcacacgtg

SEQ ID NO: 493878 - DNA, 25 bp, Rattus norvegicus
cacgtgccggttttctttgtgcgaa

SEQ ID NO: 493879 - DNA, 25 bp, Rattus norvegicus
tgccgtaaacaccacaaaggccagg

SEQ ID NO: 493880 - DNA, 25 bp, Rattus norvegicus
gttgcccgggcacccgaagcagcat

SEQ ID NO: 493881 - DNA, 25 bp, Rattus norvegicus
cgtcagaaccattcgagtgcgcatg

SEQ ID NO: 493882 - DNA, 25 bp, Rattus norvegicus
agggagcaaggaaccaccgagtcca

SEQ ID NO: 493883 - DNA, 25 bp, Rattus norvegicus
ggtacagtctcccatgcgcatagtc

SEQ ID NO: 493884 - DNA, 25 bp, Rattus norvegicus
gcggtccgcttcaactctggaggaa

SEQ ID NO: 493885 - DNA, 25 bp, Rattus norvegicus
attggttcctatccgctggcggtcc

SEQ ID NO: 493886 - DNA, 25 bp, Rattus norvegicus
gtgcgaaaggacaaacgatgccgta

SEQ ID NO: 493887 - DNA, 25 bp, Rattus norvegicus
agtccagtgacccactttcgtcaga

SEQ ID NO: 493888 - DNA, 25 bp, Rattus norvegicus
gcgggatcctgtacattggttccta

SEQ ID NO: 493889 - DNA, 25 bp, Rattus norvegicus
cccttgcgcttactctggtcttgtg

SEQ ID NO: 493890 - DNA, 25 bp, Rattus norvegicus
ggcgtctaagccagttgcgtagttt

SEQ ID NO: 493891 - DNA, 25 bp, Rattus norvegicus
atgcaacgcgctagtctcaagaatg

SEQ ID NO: 493892 - DNA, 25 bp, Rattus norvegicus
ggtcacgttacgagccctttcagcg

SEQ ID NO: 493893 - DNA, 25 bp, Rattus norvegicus
tccggctcttagagaacgtttgttc

SEQ ID NO: 493894 - DNA, 25 bp, Rattus norvegicus
atgtaggcgcatagcacgtctgtcc

SEQ ID NO: 493895 - DNA, 25 bp, Rattus norvegicus
ttctccaatcaaatggctccgcggg

SEQ ID NO: 493896 - DNA, 25 bp, Rattus norvegicus
agcgtggctcctttcgattgggttt

SEQ ID NO: 493897 - DNA, 25 bp, Rattus norvegicus
ggggaccgcaactcgccaatcggaa

SEQ ID NO: 493898 - DNA, 25 bp, Rattus norvegicus
gccggagagtcgcaagtccttttcg

SEQ ID NO: 493899 - DNA, 25 bp, Rattus norvegicus
acgcactctctgcacccaatgggga

SEQ ID NO: 493900 - DNA, 25 bp, Rattus norvegicus
gggtttgtccagcagcttttctcca

SEQ ID NO: 493901 - DNA, 25 bp, Rattus norvegicus
cgcgggaaatgtctcctgagtgatt

SEQ ID NO: 493902 - DNA, 25 bp, Rattus norvegicus
cttggtctctgaggaaaaccgtcca

SEQ ID NO: 493903 - DNA, 25 bp, Rattus norvegicus
cctacaggccagagggagtaaactg

SEQ ID NO: 493904 - DNA, 25 bp, Rattus norvegicus
ccaaagagagctccgctggcgatgt

SEQ ID NO: 493905 - DNA, 25 bp, Rattus norvegicus
ctccgctggcgatgttcgtagcatc

SEQ ID NO: 493906 - DNA, 25 bp, Rattus norvegicus
gttcgtagcatcctgatagtaagcc

SEQ ID NO: 493907 - DNA, 25 bp, Rattus norvegicus
tgatagtaagccaggccgcgggtca

SEQ ID NO: 493908 - DNA, 25 bp, Rattus norvegicus
gtcaggaccataagtctcgcaccgc

SEQ ID NO: 493909 - DNA, 25 bp, Rattus norvegicus
ggagtaaactgacgtagcggaacca

SEQ ID NO: 493910 - DNA, 25 bp, Rattus norvegicus
gtagcggaaccagtacaagtgtacc

SEQ ID NO: 493911 - DNA, 25 bp, Rattus norvegicus
tacaagtgtaccgatggcccgccgg

SEQ ID NO: 493912 - DNA, 25 bp, Rattus norvegicus
ccgccgggtaaaatagcaaactgca

SEQ ID NO: 493913 - DNA, 25 bp, Rattus norvegicus
actgcaaaatgaagcagatcggttc

SEQ ID NO: 493914 - DNA, 25 bp, Rattus norvegicus
agcagatcggttcacgtcgtgcaca

SEQ ID NO: 493915 - DNA, 25 bp, Rattus norvegicus
ggttcacgtcgtgcacaggattacg

SEQ ID NO: 493916 - DNA, 25 bp, Rattus norvegicus
gccgcgggtcaggaccataagtctc

SEQ ID NO: 493917 - DNA, 25 bp, Rattus norvegicus
cccgctggggaagctatttcatacc

SEQ ID NO: 493918 - DNA, 25 bp, Rattus norvegicus
cttgtcattggctctgggagcgata

SEQ ID NO: 493919 - DNA, 25 bp, Rattus norvegicus
ggaacaccgttaggtcttgtcattg

SEQ ID NO: 493920 - DNA, 25 bp, Rattus norvegicus
tgcatcggatgtgctctgggccgcc

SEQ ID NO: 493921 - DNA, 25 bp, Rattus norvegicus
tgctgccgcgctgtcctagacaggc

SEQ ID NO: 493922 - DNA, 25 bp, Rattus norvegicus
ttaaaccaggagtgtgcatcggatg

SEQ ID NO: 493923 - DNA, 25 bp, Rattus norvegicus
tttcatacctggagattgttaaacc

SEQ ID NO: 493924 - DNA, 25 bp, Rattus norvegicus
agcgatagtagcagcccggcttgct

SEQ ID NO: 493925 - DNA, 25 bp, Rattus norvegicus
gactctaaaacttcgcaactcttgc

SEQ ID NO: 493926 - DNA, 25 bp, Rattus norvegicus
ggggaggcgactctaaaacttcgca

SEQ ID NO: 493927 - DNA, 25 bp, Rattus norvegicus
agcttgggcagcctactcgaggacc

SEQ ID NO: 493928 - DNA, 25 bp, Rattus norvegicus
ctaccacgaggcgaagaggagcacg

SEQ ID NO: 493929 - DNA, 25 bp, Rattus norvegicus
catgaaaagctacctgtgggcgcgc

SEQ ID NO: 493930 - DNA, 25 bp, Rattus norvegicus
cccggctgctgtggacatgaaaagc

SEQ ID NO: 493931 - DNA, 25 bp, Rattus norvegicus
accgagacgcacacgctccttaatc

SEQ ID NO: 493932 - DNA, 25 bp, Rattus norvegicus
gcggaagagcccgatcgctcctggt

SEQ ID NO: 493933 - DNA, 25 bp, Rattus norvegicus
gatcgctcctggtggtcgtcaaccc

SEQ ID NO: 493934 - DNA, 25 bp, Rattus norvegicus
cccggcttgaccagtcccagggtag

SEQ ID NO: 493935 - DNA, 25 bp, Rattus norvegicus
gaggagacagaaatgcgccaagccc

SEQ ID NO: 493936 - DNA, 25 bp, Rattus norvegicus
cctacagccagtgcccacaccgaga

SEQ ID NO: 493937 - DNA, 25 bp, Rattus norvegicus
acagcccagacgagcaggtgatgca

SEQ ID NO: 493938 - DNA, 25 bp, Rattus norvegicus
cagacgagcaggtgatgcattgaca

SEQ ID NO: 493939 - DNA, 25 bp, Rattus norvegicus
tgcattgacagcgagcagatggtcc

SEQ ID NO: 493940 - DNA, 25 bp, Rattus norvegicus
gcggcccacaaagcgcccagcgcag

SEQ ID NO: 493941 - DNA, 25 bp, Rattus norvegicus
ccgcgctgcccgcatgctaataggg

SEQ ID NO: 493942 - DNA, 25 bp, Rattus norvegicus
ctgcccgcatgctaataggggtcgg

SEQ ID NO: 493943 - DNA, 25 bp, Rattus norvegicus
cccagggtagaggagacagaaatgc

SEQ ID NO: 493944 - DNA, 25 bp, Rattus norvegicus
gttgcccgggcgacagcccagacga

SEQ ID NO: 493945 - DNA, 25 bp, Rattus norvegicus
gctgtagccgaagccactgaagttg

SEQ ID NO: 493946 - DNA, 25 bp, Rattus norvegicus
ttccacgttccctggccagaagtga

SEQ ID NO: 493947 - DNA, 25 bp, Rattus norvegicus
taaccaacttgacccggttgcgctc

SEQ ID NO: 493948 - DNA, 25 bp, Rattus norvegicus
agccggcgtttgcagcgcatcagtt

SEQ ID NO: 493949 - DNA, 25 bp, Rattus norvegicus
gcttgacctgcttggccgctgactt

SEQ ID NO: 493950 - DNA, 25 bp, Rattus norvegicus
cgcggtcgcaaagaagcaggctgca

SEQ ID NO: 493951 - DNA, 25 bp, Rattus norvegicus
atcttgccagagctctccatgctgg

SEQ ID NO: 493952 - DNA, 25 bp, Rattus norvegicus
cttctgggattatttggctgaaccc

SEQ ID NO: 493953 - DNA, 25 bp, Rattus norvegicus
actcaggggacgcagagagctagaa

SEQ ID NO: 493954 - DNA, 25 bp, Rattus norvegicus
agcgggactgcgaagcacgatcaaa

SEQ ID NO: 493955 - DNA, 25 bp, Rattus norvegicus
ggcagagttgtctagcagcaacgga

SEQ ID NO: 493956 - DNA, 25 bp, Rattus norvegicus
ccgcaaaagtcagcgccgagcgtgc

SEQ ID NO: 493957 - DNA, 25 bp, Rattus norvegicus
gggcttgagcctacttctgggatta

SEQ ID NO: 493958 - DNA, 25 bp, Rattus norvegicus
tccatgctggcccaaactgtcgcgg

SEQ ID NO: 493959 - DNA, 25 bp, Rattus norvegicus
aggaggggtcttactccagcaattc

SEQ ID NO: 493960 - DNA, 25 bp, Rattus norvegicus
aaattgcactgtctccggccgcttc

SEQ ID NO: 493961 - DNA, 25 bp, Rattus norvegicus
cgtaactcatgtacccagctcggga

SEQ ID NO: 493962 - DNA, 25 bp, Rattus norvegicus
gcctagcgttcatgccacctcagtt

SEQ ID NO: 493963 - DNA, 25 bp, Rattus norvegicus
ccttctttcgtagtgtgagtatttc

SEQ ID NO: 493964 - DNA, 25 bp, Rattus norvegicus
ccagcaattccctccggagatggtt

SEQ ID NO: 493965 - DNA, 25 bp, Rattus norvegicus
ctgaagtcctgatggttgtagcccg

SEQ ID NO: 493966 - DNA, 25 bp, Rattus norvegicus
caaactgcaactggagccggagtca

SEQ ID NO: 493967 - DNA, 25 bp, Rattus norvegicus
gccgcagcggaggttgcaaactgca

SEQ ID NO: 493968 - DNA, 25 bp, Rattus norvegicus
cccaagattaggaggacatcgaagc

SEQ ID NO: 493969 - DNA, 25 bp, Rattus norvegicus
gtcgccctcatgattccagcggatg

SEQ ID NO: 493970 - DNA, 25 bp, Rattus norvegicus
cccggagaccgcgtgaaattgcact

SEQ ID NO: 493971 - DNA, 25 bp, Rattus norvegicus
ccctagccggttggatcacttgagg

SEQ ID NO: 493972 - DNA, 25 bp, Rattus norvegicus
ggccgcccgagagaacagctgtctc

SEQ ID NO: 493973 - DNA, 25 bp, Rattus norvegicus
atagtagttaagcaccaggcgcagc

SEQ ID NO: 493974 - DNA, 25 bp, Rattus norvegicus
gagatcggcgatggcatcgtagaac

SEQ ID NO: 493975 - DNA, 25 bp, Rattus norvegicus
tggtctcatgggctttgctgtaagc

SEQ ID NO: 493976 - DNA, 25 bp, Rattus norvegicus
ccttgctggtctcatgggctttgct

SEQ ID NO: 493977 - DNA, 25 bp, Rattus norvegicus
agtagttaagcaccaggcgcagccc

SEQ ID NO: 493978 - DNA, 25 bp, Rattus norvegicus
acgactccaccacggatgccctttc

SEQ ID NO: 493979 - DNA, 25 bp, Rattus norvegicus
tctcgtagtagaaaatagtagttaa

SEQ ID NO: 493980 - DNA, 25 bp, Rattus norvegicus
tccggggtgctctggatctcgtagt

SEQ ID NO: 493981 - DNA, 25 bp, Rattus norvegicus
gcttgctccggggtgctctggatct

SEQ ID NO: 493982 - DNA, 25 bp, Rattus norvegicus
tcgtagaacgcggtcttggccaggc

SEQ ID NO: 493983 - DNA, 25 bp, Rattus norvegicus
atgggctttgctgtaagccttctcg

SEQ ID NO: 493984 - DNA, 25 bp, Rattus norvegicus
tggcatcgtagaacgcggtcttggc

SEQ ID NO: 493985 - DNA, 25 bp, Rattus norvegicus
cgatggcatcgtagaacgcggtctt

SEQ ID NO: 493986 - DNA, 25 bp, Rattus norvegicus
agcaccaggcgcagcccgatcgggt

SEQ ID NO: 493987 - DNA, 25 bp, Rattus norvegicus
agcagcagcctgaattaccacgatg

SEQ ID NO: 493988 - DNA, 25 bp, Rattus norvegicus
cagaggtttgaatcgcctcggcgtc

SEQ ID NO: 493989 - DNA, 25 bp, Rattus norvegicus
ctagtccggcgacccaggggctgca

SEQ ID NO: 493990 - DNA, 25 bp, Rattus norvegicus
agtcgagatccacctagtccggcga

SEQ ID NO: 493991 - DNA, 25 bp, Rattus norvegicus
gagggcagagaaaagtcgagatcca

SEQ ID NO: 493992 - DNA, 25 bp, Rattus norvegicus
aatcgcctcggcgtccctttcaaat

SEQ ID NO: 493993 - DNA, 25 bp, Rattus norvegicus
ccctgcattaggtgcgtatggagcg

SEQ ID NO: 493994 - DNA, 25 bp, Rattus norvegicus
gttgctgtcaccaaaacgcgttcgc

SEQ ID NO: 493995 - DNA, 25 bp, Rattus norvegicus
caaatctcgcggcacgacccgggaa

SEQ ID NO: 493996 - DNA, 25 bp, Rattus norvegicus
gtccctttcaaatctcgcggcacga

SEQ ID NO: 493997 - DNA, 25 bp, Rattus norvegicus
aattaccacgatgccgctggagggc

SEQ ID NO: 493998 - DNA, 25 bp, Rattus norvegicus
tcatgagagtggtacccaggtcgcc

SEQ ID NO: 493999 - DNA, 25 bp, Rattus norvegicus
ccgcccttggtcatgagagtggtac

SEQ ID NO: 494000 - DNA, 25 bp, Rattus norvegicus
acgcgttcgcaaagcagcagcctga

SEQ ID NO: 494001 - DNA, 25 bp, Rattus norvegicus
ccacgtaggagatgatgaaggctgc

SEQ ID NO: 494002 - DNA, 25 bp, Rattus norvegicus
gcttttgcttgagacggcgacgtgt

SEQ ID NO: 494003 - DNA, 25 bp, Rattus norvegicus
gtcacaaagcggcagcctggtcccg

SEQ ID NO: 494004 - DNA, 25 bp, Rattus norvegicus
tgcgaaaccggtgaagtcacaaagc

SEQ ID NO: 494005 - DNA, 25 bp, Rattus norvegicus
gcggtcctggcttgttgcgaaaccg

SEQ ID NO: 494006 - DNA, 25 bp, Rattus norvegicus
acacagacagctaacgcgcgcggcg

SEQ ID NO: 494007 - DNA, 25 bp, Rattus norvegicus
gcagtggccgagacacagacagcta

SEQ ID NO: 494008 - DNA, 25 bp, Rattus norvegicus
agagcaccgcgaccacgtaggagat

SEQ ID NO: 494009 - DNA, 25 bp, Rattus norvegicus
ccacgaagccggcttgctgcgggct

SEQ ID NO: 494010 - DNA, 25 bp, Rattus norvegicus
cacagcatcgcggtgagaggacgct

SEQ ID NO: 494011 - DNA, 25 bp, Rattus norvegicus
ccctaagaaagcacagcatcgcggt

SEQ ID NO: 494012 - DNA, 25 bp, Rattus norvegicus
gacgaccaagtcaccaggaggaagg

SEQ ID NO: 494013 - DNA, 25 bp, Rattus norvegicus
tcctttcgcttttgcttgagacggc

SEQ ID NO: 494014 - DNA, 25 bp, Rattus norvegicus
atgaaggctgcggacgaccaagtca

SEQ ID NO: 494015 - DNA, 25 bp, Rattus norvegicus
agagacagacctatacctgcctatc

SEQ ID NO: 494016 - DNA, 25 bp, Rattus norvegicus
ttaagctcctgcagagacagaccta

SEQ ID NO: 494017 - DNA, 25 bp, Rattus norvegicus
gggtgatgctgcttaagctcctgca

SEQ ID NO: 494018 - DNA, 25 bp, Rattus norvegicus
ctgcctatcccacaggtatgggctc

SEQ ID NO: 494019 - DNA, 25 bp, Rattus norvegicus
ttccagttcggagaggtaagtagcg

SEQ ID NO: 494020 - DNA, 25 bp, Rattus norvegicus
caggtatgggctctacgtctgcttc

SEQ ID NO: 494021 - DNA, 25 bp, Rattus norvegicus
gtccgggcctcccatgcttagcgtg

SEQ ID NO: 494022 - DNA, 25 bp, Rattus norvegicus
tggactggacgtccgggcctcccat

SEQ ID NO: 494023 - DNA, 25 bp, Rattus norvegicus
gctcgcctgagcagctggactggac

SEQ ID NO: 494024 - DNA, 25 bp, Rattus norvegicus
tccttgcagcctgggaaccagcaca

SEQ ID NO: 494025 - DNA, 25 bp, Rattus norvegicus
catcgtctcggctttccagttcgga

SEQ ID NO: 494026 - DNA, 25 bp, Rattus norvegicus
gtcgtggtcaccatcgtctcggctt

SEQ ID NO: 494027 - DNA, 25 bp, Rattus norvegicus
tctacgtctgcttcgtgggcgtcgt

SEQ ID NO: 494028 - DNA, 25 bp, Rattus norvegicus
tgcagcctgggaaccagcacacggc

SEQ ID NO: 494029 - DNA, 25 bp, Rattus norvegicus
gacctagaggatgctctgttacaca

SEQ ID NO: 494030 - DNA, 25 bp, Rattus norvegicus
cgcacttccctgctagacctagagg

SEQ ID NO: 494031 - DNA, 25 bp, Rattus norvegicus
agcactagtgtggtgaacaggttga

SEQ ID NO: 494032 - DNA, 25 bp, Rattus norvegicus
catctccgaaggaggcccaagggct

SEQ ID NO: 494033 - DNA, 25 bp, Rattus norvegicus
cgggatccattggagcagccaggtc

SEQ ID NO: 494034 - DNA, 25 bp, Rattus norvegicus
ccaggtccagaaaagctgcagcggc

SEQ ID NO: 494035 - DNA, 25 bp, Rattus norvegicus
tgtagcggtggtcctccagccgccg

SEQ ID NO: 494036 - DNA, 25 bp, Rattus norvegicus
gatgctctgttacacagggtctccc

SEQ ID NO: 494037 - DNA, 25 bp, Rattus norvegicus
ggggctatccagagcgggatccatt

SEQ ID NO: 494038 - DNA, 25 bp, Rattus norvegicus
tctcccgccgcgctgtagcggtggt

SEQ ID NO: 494039 - DNA, 25 bp, Rattus norvegicus
tacctcctccgtgaccgtagggcag

SEQ ID NO: 494040 - DNA, 25 bp, Rattus norvegicus
cagcggtctggtcacgtccgcactt

SEQ ID NO: 494041 - DNA, 25 bp, Rattus norvegicus
ccgtagggcagtagaagatgagcac

SEQ ID NO: 494042 - DNA, 25 bp, Rattus norvegicus
gtcgcctcctctagtggggccatct

SEQ ID NO: 494043 - DNA, 25 bp, Rattus norvegicus
tgccttcgcttcatcgagcttttta

SEQ ID NO: 494044 - DNA, 25 bp, Rattus norvegicus
tgcgccagcattctgtgccttcgct

SEQ ID NO: 494045 - DNA, 25 bp, Rattus norvegicus
gtgcgggtgagctttctcgttatta

SEQ ID NO: 494046 - DNA, 25 bp, Rattus norvegicus
gtgccctgtgttggtggcacgcagt

SEQ ID NO: 494047 - DNA, 25 bp, Rattus norvegicus
tattattacgtaaccctggctcctc

SEQ ID NO: 494048 - DNA, 25 bp, Rattus norvegicus
cctggctcctcctgcgaaaatgcat

SEQ ID NO: 494049 - DNA, 25 bp, Rattus norvegicus
gcaccgggatctgcaaccaccagga

SEQ ID NO: 494050 - DNA, 25 bp, Rattus norvegicus
ggtgagctttctcgttattattacg

SEQ ID NO: 494051 - DNA, 25 bp, Rattus norvegicus
catcgagctttttatttttcgttag

SEQ ID NO: 494052 - DNA, 25 bp, Rattus norvegicus
gcattctgtgccttcgcttcatcga

SEQ ID NO: 494053 - DNA, 25 bp, Rattus norvegicus
ttagaggaaagtggaccgcctccgc

SEQ ID NO: 494054 - DNA, 25 bp, Rattus norvegicus
ctgcgaaaatgcatttagaggaaag

SEQ ID NO: 494055 - DNA, 25 bp, Rattus norvegicus
tccgcagactgcaccgggatctgca

SEQ ID NO: 494056 - DNA, 25 bp, Rattus norvegicus
aagtggaccgcctccgcagactgca

SEQ ID NO: 494057 - DNA, 25 bp, Rattus norvegicus
tccgccgagcaagggtaacccggca

SEQ ID NO: 494058 - DNA, 25 bp, Rattus norvegicus
cccggagagatctagcgtccagctg

SEQ ID NO: 494059 - DNA, 25 bp, Rattus norvegicus
agacctaggagctccggacctggga

SEQ ID NO: 494060 - DNA, 25 bp, Rattus norvegicus
cctgaggatgctagtgcgtggtcca

SEQ ID NO: 494061 - DNA, 25 bp, Rattus norvegicus
tggtccagcctccaggagcagtcca

SEQ ID NO: 494062 - DNA, 25 bp, Rattus norvegicus
cctttccggacagtcactgcttctg

SEQ ID NO: 494063 - DNA, 25 bp, Rattus norvegicus
gaaagagctgctcccagtatatccc

SEQ ID NO: 494064 - DNA, 25 bp, Rattus norvegicus
gtaacccggcaagcgataagtctta

SEQ ID NO: 494065 - DNA, 25 bp, Rattus norvegicus
ggacggaaatgaaccaatgtggagc

SEQ ID NO: 494066 - DNA, 25 bp, Rattus norvegicus
tgaaccaatgtggagccgcttcggg

SEQ ID NO: 494067 - DNA, 25 bp, Rattus norvegicus
tcgggctcgctaggactgcgattag

SEQ ID NO: 494068 - DNA, 25 bp, Rattus norvegicus
ggactgcgattagccatcaactctt

SEQ ID NO: 494069 - DNA, 25 bp, Rattus norvegicus
gccatcaactctttcccattctggg

SEQ ID NO: 494070 - DNA, 25 bp, Rattus norvegicus
ggacagtcactgcttctgcggcgga

SEQ ID NO: 494071 - DNA, 25 bp, Rattus norvegicus
ccttatcccgcatccccatctcggt

SEQ ID NO: 494072 - DNA, 25 bp, Rattus norvegicus
cgttggctcttcacctgcagggaga

SEQ ID NO: 494073 - DNA, 25 bp, Rattus norvegicus
ctgcagggagaccccacctcccggc

SEQ ID NO: 494074 - DNA, 25 bp, Rattus norvegicus
ccacctcccggctcggtcctttgca

SEQ ID NO: 494075 - DNA, 25 bp, Rattus norvegicus
tgcacccgcggggtccaaactggtc

SEQ ID NO: 494076 - DNA, 25 bp, Rattus norvegicus
gcatccccatctcggttgggtgggc

SEQ ID NO: 494077 - DNA, 25 bp, Rattus norvegicus
cccttatcccgcatccccatctcgg

SEQ ID NO: 494078 - DNA, 25 bp, Rattus norvegicus
cttatcccgcatccccatctcggtt

SEQ ID NO: 494079 - DNA, 25 bp, Rattus norvegicus
ttatcccgcatccccatctcggttg

SEQ ID NO: 494080 - DNA, 25 bp, Rattus norvegicus
atcccgcatccccatctcggttggg

SEQ ID NO: 494081 - DNA, 25 bp, Rattus norvegicus
cccgcatccccatctcggttgggtg

SEQ ID NO: 494082 - DNA, 25 bp, Rattus norvegicus
ccgcatccccatctcggttgggtgg

SEQ ID NO: 494083 - DNA, 25 bp, Rattus norvegicus
cgcatccccatctcggttgggtggg

SEQ ID NO: 494084 - DNA, 25 bp, Rattus norvegicus
tcccgcatccccatctcggttgggt

SEQ ID NO: 494085 - DNA, 25 bp, Rattus norvegicus
acgacgtggaagttgctggctgacc

SEQ ID NO: 494086 - DNA, 25 bp, Rattus norvegicus
ctacgctcagagaaccaggaatttg

SEQ ID NO: 494087 - DNA, 25 bp, Rattus norvegicus
caggaatttgcgtcgaaagcgccga

SEQ ID NO: 494088 - DNA, 25 bp, Rattus norvegicus
gaaagcgccgactcggacgcccaga

SEQ ID NO: 494089 - DNA, 25 bp, Rattus norvegicus
cagatcgccgtgctcggcgcgcagt

SEQ ID NO: 494090 - DNA, 25 bp, Rattus norvegicus
agtcgcagtggcctctcgctctggc

SEQ ID NO: 494091 - DNA, 25 bp, Rattus norvegicus
aagttgctggctgaccaggcttgga

SEQ ID NO: 494092 - DNA, 25 bp, Rattus norvegicus
tcttcggaatcggagtctgggaaca

SEQ ID NO: 494093 - DNA, 25 bp, Rattus norvegicus
ctcaattaggagtcgctgccgagtc

SEQ ID NO: 494094 - DNA, 25 bp, Rattus norvegicus
cgagtcccggcctgtcactgaggat

SEQ ID NO: 494095 - DNA, 25 bp, Rattus norvegicus
cgggcagatcttcgctacgttggct

SEQ ID NO: 494096 - DNA, 25 bp, Rattus norvegicus
atcttcgctacgttggctcttcacc

SEQ ID NO: 494097 - DNA, 25 bp, Rattus norvegicus
ggcgttcattttggctacgctcaga

SEQ ID NO: 494098 - DNA, 25 bp, Rattus norvegicus
cttggaggagtcgtcttcggaatcg

SEQ ID NO: 494099 - DNA, 25 bp, Rattus norvegicus
aaagccaggatgtgtgggtcacatg

SEQ ID NO: 494100 - DNA, 25 bp, Rattus norvegicus
gcgccgccatgttgaaaagccagga

SEQ ID NO: 494101 - DNA, 25 bp, Rattus norvegicus
cgctcttcctggttgccagtcggtc

SEQ ID NO: 494102 - DNA, 25 bp, Rattus norvegicus
tcacatgggcggaaaaggcagaccg

SEQ ID NO: 494103 - DNA, 25 bp, Rattus norvegicus
agtcggtcctgcagtttgtgcaggc

SEQ ID NO: 494104 - DNA, 25 bp, Rattus norvegicus
gctcacccggtatgtgttctcggtc

SEQ ID NO: 494105 - DNA, 25 bp, Rattus norvegicus
ttctcggtcttgtgggaaactggct

SEQ ID NO: 494106 - DNA, 25 bp, Rattus norvegicus
aactggctttggcttcatgactgcg

SEQ ID NO: 494107 - DNA, 25 bp, Rattus norvegicus
tacggaggaaaaagcggctcacacg

SEQ ID NO: 494108 - DNA, 25 bp, Rattus norvegicus
ggctcacacgcggtactctccgatg

SEQ ID NO: 494109 - DNA, 25 bp, Rattus norvegicus
tactctccgatgctcggttgtctgc

SEQ ID NO: 494110 - DNA, 25 bp, Rattus norvegicus
ggttgtctgctttttctcacgtgta

SEQ ID NO: 494111 - DNA, 25 bp, Rattus norvegicus
ttctcacgtgtagctagtgctgctg

SEQ ID NO: 494112 - DNA, 25 bp, Rattus norvegicus
aggcagaccgagcatgcgcgctctt

SEQ ID NO: 494113 - DNA, 25 bp, Rattus norvegicus
gtctaccgttttggggcgatattca

SEQ ID NO: 494114 - DNA, 25 bp, Rattus norvegicus
aggacgtacctgatctccgcgggac

SEQ ID NO: 494115 - DNA, 25 bp, Rattus norvegicus
gcgatattcagcatctttggcgtca

SEQ ID NO: 494116 - DNA, 25 bp, Rattus norvegicus
ctcggcggccatcggcatctattac

SEQ ID NO: 494117 - DNA, 25 bp, Rattus norvegicus
gaggtcttccttccggtgttctata

SEQ ID NO: 494118 - DNA, 25 bp, Rattus norvegicus
cggccagcagacctccaaggacttt

SEQ ID NO: 494119 - DNA, 25 bp, Rattus norvegicus
tgttcgcaggcatgctgctcatctc

SEQ ID NO: 494120 - DNA, 25 bp, Rattus norvegicus
ggaccatggacgcttcgcgggacat

SEQ ID NO: 494121 - DNA, 25 bp, Rattus norvegicus
ttcatgtccgctgtcactgtcctgg

SEQ ID NO: 494122 - DNA, 25 bp, Rattus norvegicus
cagcgggtattttggctcctccttc

SEQ ID NO: 494123 - DNA, 25 bp, Rattus norvegicus
ccaggatccacacctgcaggacgta

SEQ ID NO: 494124 - DNA, 25 bp, Rattus norvegicus
gcgacttctcccgatccctgagtga

SEQ ID NO: 494125 - DNA, 25 bp, Rattus norvegicus
cgccgctgtcacttaataaaacttg

SEQ ID NO: 494126 - DNA, 25 bp, Rattus norvegicus
tccaaggactttctgatgggcggcc

SEQ ID NO: 494127 - DNA, 25 bp, Rattus norvegicus
tgcggcgcaagctggccagcgcatc

SEQ ID NO: 494128 - DNA, 25 bp, Rattus norvegicus
aggctccggagcatgcccagtcagc

SEQ ID NO: 494129 - DNA, 25 bp, Rattus norvegicus
gcgatccggagaggtgcaggagcct

SEQ ID NO: 494130 - DNA, 25 bp, Rattus norvegicus
ggacgcaagcgcgacggagcagaga

SEQ ID NO: 494131 - DNA, 25 bp, Rattus norvegicus
cgcaagctggccagcgcatcggcga

SEQ ID NO: 494132 - DNA, 25 bp, Rattus norvegicus
gcatgcccagtcagcccgccgcgat

SEQ ID NO: 494133 - DNA, 25 bp, Rattus norvegicus
atcctggctcgcgtgcggcgcaagc

SEQ ID NO: 494134 - DNA, 25 bp, Rattus norvegicus
agggaagccatcctggctcgcgtgc

SEQ ID NO: 494135 - DNA, 25 bp, Rattus norvegicus
ggccaggctccggagcatgcccagt

SEQ ID NO: 494136 - DNA, 25 bp, Rattus norvegicus
taccgtaggcggtgagggaagccat

SEQ ID NO: 494137 - DNA, 25 bp, Rattus norvegicus
ccgtgccagccgtaccgtaggcggt

SEQ ID NO: 494138 - DNA, 25 bp, Rattus norvegicus
ggcagccccgcaaacatagcggaac

SEQ ID NO: 494139 - DNA, 25 bp, Rattus norvegicus
cccggagagtgcatgcgctcggctc

SEQ ID NO: 494140 - DNA, 25 bp, Rattus norvegicus
agagtgcatgcgctcggctcccacg

SEQ ID NO: 494141 - DNA, 25 bp, Rattus norvegicus
acgagattcctacgctcacgccgga

SEQ ID NO: 494142 - DNA, 25 bp, Rattus norvegicus
ctcagagacgtgtgattctattttc

SEQ ID NO: 494143 - DNA, 25 bp, Rattus norvegicus
ggctggacggacactctgtcacttc

SEQ ID NO: 494144 - DNA, 25 bp, Rattus norvegicus
ggctttgactctcatgtccctacga

SEQ ID NO: 494145 - DNA, 25 bp, Rattus norvegicus
acgcggcgacactcaccatattgga

SEQ ID NO: 494146 - DNA, 25 bp, Rattus norvegicus
actcgaaagaggacccggcggctct

SEQ ID NO: 494147 - DNA, 25 bp, Rattus norvegicus
ctagcaactattgtacgcgaattta

SEQ ID NO: 494148 - DNA, 25 bp, Rattus norvegicus
tgtgataagtccctagaaattgtga

SEQ ID NO: 494149 - DNA, 25 bp, Rattus norvegicus
ttgtgacgcaaagtaccaatgggac

SEQ ID NO: 494150 - DNA, 25 bp, Rattus norvegicus
caatgggactatttaccggcggaag

SEQ ID NO: 494151 - DNA, 25 bp, Rattus norvegicus
ttatacgctaacgaaccaggaagtg

SEQ ID NO: 494152 - DNA, 25 bp, Rattus norvegicus
taggctctataacatccggtttacg

SEQ ID NO: 494153 - DNA, 25 bp, Rattus norvegicus
ggcggctctcccgacactcttatat

SEQ ID NO: 494154 - DNA, 25 bp, Rattus norvegicus
ccaggaagtgaatctaggctctata

SEQ ID NO: 494155 - DNA, 25 bp, Rattus norvegicus
gccgcctgtttcgaaggagccaatc

SEQ ID NO: 494156 - DNA, 25 bp, Rattus norvegicus
gaacttcatcgtgacagctccaaga

SEQ ID NO: 494157 - DNA, 25 bp, Rattus norvegicus
tccaagagctaatcagagcacgcgg

SEQ ID NO: 494158 - DNA, 25 bp, Rattus norvegicus
ccaatcgcagagttccagggactcc

SEQ ID NO: 494159 - DNA, 25 bp, Rattus norvegicus
tccagggactcctgccgctctgtag

SEQ ID NO: 494160 - DNA, 25 bp, Rattus norvegicus
ctccacccggactctatagactagg

SEQ ID NO: 494161 - DNA, 25 bp, Rattus norvegicus
tccaacagggaaatcacttaccagc

SEQ ID NO: 494162 - DNA, 25 bp, Rattus norvegicus
tcttacccaccagagcgggcaggtg

SEQ ID NO: 494163 - DNA, 25 bp, Rattus norvegicus
ttgggctcaatctgtgcgtgccagc

SEQ ID NO: 494164 - DNA, 25 bp, Rattus norvegicus
ttctgctccgtcagtggcagcgaca

SEQ ID NO: 494165 - DNA, 25 bp, Rattus norvegicus
tggacgccctgcctccagaggcttt

SEQ ID NO: 494166 - DNA, 25 bp, Rattus norvegicus
cagaggctttccaccgcacactgga

SEQ ID NO: 494167 - DNA, 25 bp, Rattus norvegicus
gcacactggattcgtaggtcctctc

SEQ ID NO: 494168 - DNA, 25 bp, Rattus norvegicus
gagaccacttctccctgcggggcga

SEQ ID NO: 494169 - DNA, 25 bp, Rattus norvegicus
cctaggcaaaggatgcgagtgtatc

SEQ ID NO: 494170 - DNA, 25 bp, Rattus norvegicus
gggatccatccctgctctcgtgttt

SEQ ID NO: 494171 - DNA, 25 bp, Rattus norvegicus
gctcattttgaaatcgggatccatc

SEQ ID NO: 494172 - DNA, 25 bp, Rattus norvegicus
gcctgctattttatcggagctcatt

SEQ ID NO: 494173 - DNA, 25 bp, Rattus norvegicus
cgacggaatggcctgctattttatc

SEQ ID NO: 494174 - DNA, 25 bp, Rattus norvegicus
tagataaagctaaaacgacggaatg

SEQ ID NO: 494175 - DNA, 25 bp, Rattus norvegicus
ggcgatcagatagcatagataaagc

SEQ ID NO: 494176 - DNA, 25 bp, Rattus norvegicus
cgagtgtatctggatcaccgttggc

SEQ ID NO: 494177 - DNA, 25 bp, Rattus norvegicus
gccctttatttcacgttcctaggca

SEQ ID NO: 494178 - DNA, 25 bp, Rattus norvegicus
gcgggcgtgtccagccctttatttc

SEQ ID NO: 494179 - DNA, 25 bp, Rattus norvegicus
gaatcgctgccaccgcgggcgtgtc

SEQ ID NO: 494180 - DNA, 25 bp, Rattus norvegicus
tgcaggatgatgaatcgctgccacc

SEQ ID NO: 494181 - DNA, 25 bp, Rattus norvegicus
gacgctcgctgcaggatgatgaatc

SEQ ID NO: 494182 - DNA, 25 bp, Rattus norvegicus
tcaccgttggcgatcagatagcata

SEQ ID NO: 494183 - DNA, 25 bp, Rattus norvegicus
ccgtagcccattagctggccgctga

SEQ ID NO: 494184 - DNA, 25 bp, Rattus norvegicus
agcagcagaacgacacaggcaccga

SEQ ID NO: 494185 - DNA, 25 bp, Rattus norvegicus
attagctggccgctgacccaggtcg

SEQ ID NO: 494186 - DNA, 25 bp, Rattus norvegicus
aggtcactcacctctcagccggcta

SEQ ID NO: 494187 - DNA, 25 bp, Rattus norvegicus
aatgcctccgggctgtgactgctcg

SEQ ID NO: 494188 - DNA, 25 bp, Rattus norvegicus
aagagcaccgaaagacctgcccgct

SEQ ID NO: 494189 - DNA, 25 bp, Rattus norvegicus
tgcccgctcctgcatgacgtcactt

SEQ ID NO: 494190 - DNA, 25 bp, Rattus norvegicus
cagaacgacacaggcaccgagtctc

SEQ ID NO: 494191 - DNA, 25 bp, Rattus norvegicus
cgagtctcccgtcgcctaaaggcct

SEQ ID NO: 494192 - DNA, 25 bp, Rattus norvegicus
ggagtcactggcctctcagatccgc

SEQ ID NO: 494193 - DNA, 25 bp, Rattus norvegicus
taccgcttgtcactacctgggtccg

SEQ ID NO: 494194 - DNA, 25 bp, Rattus norvegicus
ttgtcactacctgggtccggcttcc

SEQ ID NO: 494195 - DNA, 25 bp, Rattus norvegicus
ctaggcaacagtcgccagccgcgag

SEQ ID NO: 494196 - DNA, 25 bp, Rattus norvegicus
cggggaggcccgtagcccattagct

SEQ ID NO: 494197 - DNA, 25 bp, Rattus norvegicus
tctgcacaggcttcttccggtactc

SEQ ID NO: 494198 - DNA, 25 bp, Rattus norvegicus
gggccgcttttccactgtttggatc

SEQ ID NO: 494199 - DNA, 25 bp, Rattus norvegicus
ctgacaacggagtacgccggaagtc

SEQ ID NO: 494200 - DNA, 25 bp, Rattus norvegicus
cttccggtactctatggtttatggg

SEQ ID NO: 494201 - DNA, 25 bp, Rattus norvegicus
cgcgatggtgtctgaggatcattca

SEQ ID NO: 494202 - DNA, 25 bp, Rattus norvegicus
gagccgcttttctagtccttgtatc

SEQ ID NO: 494203 - DNA, 25 bp, Rattus norvegicus
ttcaagtcggaaagcaaagctgtca

SEQ ID NO: 494204 - DNA, 25 bp, Rattus norvegicus
tgtcaaaccacaatgctcacgcatc

SEQ ID NO: 494205 - DNA, 25 bp, Rattus norvegicus
gcatcctgtccctcggggacgacga

SEQ ID NO: 494206 - DNA, 25 bp, Rattus norvegicus
cggaagtcaagcagcggagccgctt

SEQ ID NO: 494207 - DNA, 25 bp, Rattus norvegicus
actgtcatggctgtaaccgattttg

SEQ ID NO: 494208 - DNA, 25 bp, Rattus norvegicus
ccgttatccagaactaaggtcgtca

SEQ ID NO: 494209 - DNA, 25 bp, Rattus norvegicus
aaggtcgtcatctcgggacccacca

SEQ ID NO: 494210 - DNA, 25 bp, Rattus norvegicus
gacgacgaccacttacgagacactg

SEQ ID NO: 494211 - DNA, 25 bp, Rattus norvegicus
gagcttccttccctgtgctcagcat

SEQ ID NO: 494212 - DNA, 25 bp, Rattus norvegicus
catcagcctcagagctccgtgttgc

SEQ ID NO: 494213 - DNA, 25 bp, Rattus norvegicus
agcatcctgcccagtgcttggcatt

SEQ ID NO: 494214 - DNA, 25 bp, Rattus norvegicus
cagaacccagtagggtccaggctgg

SEQ ID NO: 494215 - DNA, 25 bp, Rattus norvegicus
cagagctccgtgttgctcctcagtg

SEQ ID NO: 494216 - DNA, 25 bp, Rattus norvegicus
cgggaggacgcgcttgactcgctcc

SEQ ID NO: 494217 - DNA, 25 bp, Rattus norvegicus
tctagctcccgggaggacgcgcttg

SEQ ID NO: 494218 - DNA, 25 bp, Rattus norvegicus
gcctgccgggcgcagaacccagtag

SEQ ID NO: 494219 - DNA, 25 bp, Rattus norvegicus
ccattgtaaagctgctccgggagaa

SEQ ID NO: 494220 - DNA, 25 bp, Rattus norvegicus
ggcattctctgtgctcagcgtcctc

SEQ ID NO: 494221 - DNA, 25 bp, Rattus norvegicus
ttgctcctcagtgccggagcttcct

SEQ ID NO: 494222 - DNA, 25 bp, Rattus norvegicus
cagtgcttggcattctctgtgctca

SEQ ID NO: 494223 - DNA, 25 bp, Rattus norvegicus
gttgtggttcgctaccctctagctc

SEQ ID NO: 494224 - DNA, 25 bp, Rattus norvegicus
ccgcctctgccgttgtggttcgcta

SEQ ID NO: 494225 - DNA, 25 bp, Rattus norvegicus
acttccaggcgctgtcacctcagga

SEQ ID NO: 494226 - DNA, 25 bp, Rattus norvegicus
agccgcgcaggtagcacagtccgct

SEQ ID NO: 494227 - DNA, 25 bp, Rattus norvegicus
caggacagcggctagccagcagaaa

SEQ ID NO: 494228 - DNA, 25 bp, Rattus norvegicus
agccagcagaaaagaccggtgaacc

SEQ ID NO: 494229 - DNA, 25 bp, Rattus norvegicus
accggtgaaccgaagacaattgaga

SEQ ID NO: 494230 - DNA, 25 bp, Rattus norvegicus
gcagaggcttctccgacagctgcgg

SEQ ID NO: 494231 - DNA, 25 bp, Rattus norvegicus
agaagtgggattcgcgcttgcgcac

SEQ ID NO: 494232 - DNA, 25 bp, Rattus norvegicus
cgcactagtagtcgcctccctccga

SEQ ID NO: 494233 - DNA, 25 bp, Rattus norvegicus
ctctgccggaggtcgcgcttcctgg

SEQ ID NO: 494234 - DNA, 25 bp, Rattus norvegicus
cgcttcctgggccttgttttgcctg

SEQ ID NO: 494235 - DNA, 25 bp, Rattus norvegicus
tgggccttgttttgcctgcgagcca

SEQ ID NO: 494236 - DNA, 25 bp, Rattus norvegicus
ttttgcctgcgagccacggcctagg

SEQ ID NO: 494237 - DNA, 25 bp, Rattus norvegicus
aagacaattgagagtgtcccgggag

SEQ ID NO: 494238 - DNA, 25 bp, Rattus norvegicus
agaaagccagaagtgggattcgcgc

SEQ ID NO: 494239 - DNA, 25 bp, Rattus norvegicus
ctgcacagacagttcgggttacacc

SEQ ID NO: 494240 - DNA, 25 bp, Rattus norvegicus
aatggacataagtaagtgccactta

SEQ ID NO: 494241 - DNA, 25 bp, Rattus norvegicus
ctgcgtggttctcgctcctgaaagc

SEQ ID NO: 494242 - DNA, 25 bp, Rattus norvegicus
cgcagttttcgtaggctacccgtcg

SEQ ID NO: 494243 - DNA, 25 bp, Rattus norvegicus
tcctgaaagcgtgactctgtacctg

SEQ ID NO: 494244 - DNA, 25 bp, Rattus norvegicus
tctgtacctgttaactctgtgcttg

SEQ ID NO: 494245 - DNA, 25 bp, Rattus norvegicus
ttgtgtttgtttcgttcgcagcatc

SEQ ID NO: 494246 - DNA, 25 bp, Rattus norvegicus
gggttacaccgctttgcaccacgca

SEQ ID NO: 494247 - DNA, 25 bp, Rattus norvegicus
gcgaggtcccaacgtgaactgcaca

SEQ ID NO: 494248 - DNA, 25 bp, Rattus norvegicus
gttcgcagcatctggcgaggtccca

SEQ ID NO: 494249 - DNA, 25 bp, Rattus norvegicus
ctgctacgcgcctgcgtggttctcg

SEQ ID NO: 494250 - DNA, 25 bp, Rattus norvegicus
cctgttaactctgtgcttgtgtttg

SEQ ID NO: 494251 - DNA, 25 bp, Rattus norvegicus
gtgccacttattcggactggacgtt

SEQ ID NO: 494252 - DNA, 25 bp, Rattus norvegicus
caccacgcagccttaaatggacata

SEQ ID NO: 494253 - DNA, 25 bp, Rattus norvegicus
catcagcgcgcacccaaacttaatg

SEQ ID NO: 494254 - DNA, 25 bp, Rattus norvegicus
ctcaaaggcgatgctgccgtcctgc

SEQ ID NO: 494255 - DNA, 25 bp, Rattus norvegicus
tgaagctggacgctcaaaggcgatg

SEQ ID NO: 494256 - DNA, 25 bp, Rattus norvegicus
aagtgagtcttgaagctggacgctc

SEQ ID NO: 494257 - DNA, 25 bp, Rattus norvegicus
cgtgagctgtcaagtgagtcttgaa

SEQ ID NO: 494258 - DNA, 25 bp, Rattus norvegicus
atggacgtgagctgtcaagtgagtc

SEQ ID NO: 494259 - DNA, 25 bp, Rattus norvegicus
ccgcaatggtcacaaggccgtggtg

SEQ ID NO: 494260 - DNA, 25 bp, Rattus norvegicus
tcgcggcccgcaatggtcacaaggc

SEQ ID NO: 494261 - DNA, 25 bp, Rattus norvegicus
cccaaacttaatgagctgtaacacg

SEQ ID NO: 494262 - DNA, 25 bp, Rattus norvegicus
agatgatcatcagcgcgcacccaaa

SEQ ID NO: 494263 - DNA, 25 bp, Rattus norvegicus
ctgagggtggtgaagatgatcatca

SEQ ID NO: 494264 - DNA, 25 bp, Rattus norvegicus
acttggcagcgctctacggaaggct

SEQ ID NO: 494265 - DNA, 25 bp, Rattus norvegicus
caccgctggacttggcagcgctcta

SEQ ID NO: 494266 - DNA, 25 bp, Rattus norvegicus
ctgtaacacgcggaagcacacgccg

SEQ ID NO: 494267 - DNA, 25 bp, Rattus norvegicus
gaagatgctcagaggcgacggctaa

SEQ ID NO: 494268 - DNA, 25 bp, Rattus norvegicus
tccatagtaaccgaggatgctaggg

SEQ ID NO: 494269 - DNA, 25 bp, Rattus norvegicus
ccgcgaaccgctgcggagacggttt

SEQ ID NO: 494270 - DNA, 25 bp, Rattus norvegicus
cggaggcgcgagatatccatagtaa

SEQ ID NO: 494271 - DNA, 25 bp, Rattus norvegicus
gcactcggctggaccgctacggtaa

SEQ ID NO: 494272 - DNA, 25 bp, Rattus norvegicus
ctccgtggccgcagaacaatggaga

SEQ ID NO: 494273 - DNA, 25 bp, Rattus norvegicus
gcagaacaatggagagcgccgcccg

SEQ ID NO: 494274 - DNA, 25 bp, Rattus norvegicus
ttgcggggatctggcgcctctccca

SEQ ID NO: 494275 - DNA, 25 bp, Rattus norvegicus
gcaagaggcgtgagctgcacgtcca

SEQ ID NO: 494276 - DNA, 25 bp, Rattus norvegicus
ccagagagcgaggttcggtttcttc

SEQ ID NO: 494277 - DNA, 25 bp, Rattus norvegicus
cccgctggcgaagatgcggctctga

SEQ ID NO: 494278 - DNA, 25 bp, Rattus norvegicus
gctctgagaagtgcggctgcagccc

SEQ ID NO: 494279 - DNA, 25 bp, Rattus norvegicus
cccttgcttgctcacgttcactgga

SEQ ID NO: 494280 - DNA, 25 bp, Rattus norvegicus
tccggcaggaaagccgcgaaccgct

SEQ ID NO: 494281 - DNA, 25 bp, Rattus norvegicus
acggccatccctagggagccttctg

SEQ ID NO: 494282 - DNA, 25 bp, Rattus norvegicus
agcgagactttgacgccccttagag

SEQ ID NO: 494283 - DNA, 25 bp, Rattus norvegicus
tccctagggagccttctgccagcga

SEQ ID NO: 494284 - DNA, 25 bp, Rattus norvegicus
tcgcggtgccttgctcgccaagcag

SEQ ID NO: 494285 - DNA, 25 bp, Rattus norvegicus
gcggtgccttgctcgccaagcagtc

SEQ ID NO: 494286 - DNA, 25 bp, Rattus norvegicus
cccgcagcaggctttccttcgcgcc

SEQ ID NO: 494287 - DNA, 25 bp, Rattus norvegicus
caggctttccttcgcgcctccgtgt

SEQ ID NO: 494288 - DNA, 25 bp, Rattus norvegicus
ttcgcgcctccgtgtccacccaccc

SEQ ID NO: 494289 - DNA, 25 bp, Rattus norvegicus
ccgggaggaagaccgctccagctcg

SEQ ID NO: 494290 - DNA, 25 bp, Rattus norvegicus
cgtggcctcgtcacgggcggaaggg

SEQ ID NO: 494291 - DNA, 25 bp, Rattus norvegicus
ggcgacggccatccctagggagcct

SEQ ID NO: 494292 - DNA, 25 bp, Rattus norvegicus
gagccttctgccagcgagactttga

SEQ ID NO: 494293 - DNA, 25 bp, Rattus norvegicus
ccttctgccagcgagactttgacgc

SEQ ID NO: 494294 - DNA, 25 bp, Rattus norvegicus
ttctgccagcgagactttgacgccc

SEQ ID NO: 494295 - DNA, 25 bp, Rattus norvegicus
tcagcctgctgtctctggcgacaag

SEQ ID NO: 494296 - DNA, 25 bp, Rattus norvegicus
atgcccaggatttccgagcggcgtc

SEQ ID NO: 494297 - DNA, 25 bp, Rattus norvegicus
gtgatcacctcgatggacttgcctc

SEQ ID NO: 494298 - DNA, 25 bp, Rattus norvegicus
cggatccaggacacaaaagcacggc

SEQ ID NO: 494299 - DNA, 25 bp, Rattus norvegicus
ggctgactgcacacacctctagctg

SEQ ID NO: 494300 - DNA, 25 bp, Rattus norvegicus
cggagaaagccgtctacccagctcg

SEQ ID NO: 494301 - DNA, 25 bp, Rattus norvegicus
caggaccgcggagcactcaaacaca

SEQ ID NO: 494302 - DNA, 25 bp, Rattus norvegicus
aagccctggttgagcgtcctcgcat

SEQ ID NO: 494303 - DNA, 25 bp, Rattus norvegicus
gcacccgcgagtttgagtttcagtc

SEQ ID NO: 494304 - DNA, 25 bp, Rattus norvegicus
tttcagtctcctagcggaatccaga

SEQ ID NO: 494305 - DNA, 25 bp, Rattus norvegicus
gtggccttccgaaagcggctctgca

SEQ ID NO: 494306 - DNA, 25 bp, Rattus norvegicus
agggcacttagcacctcgagcaaac

SEQ ID NO: 494307 - DNA, 25 bp, Rattus norvegicus
atcttcagggctccagacatgtctg

SEQ ID NO: 494308 - DNA, 25 bp, Rattus norvegicus
agccatcctggcttcgaaatcttca

SEQ ID NO: 494309 - DNA, 25 bp, Rattus norvegicus
gagtgcgggtggtgtgtgcatgtct

SEQ ID NO: 494310 - DNA, 25 bp, Rattus norvegicus
catgtctgcgtcttggtggcaggca

SEQ ID NO: 494311 - DNA, 25 bp, Rattus norvegicus
gccactcaccttccaggaagcgtgg

SEQ ID NO: 494312 - DNA, 25 bp, Rattus norvegicus
ctcaccttccaggaagcgtggattc

SEQ ID NO: 494313 - DNA, 25 bp, Rattus norvegicus
accttccaggaagcgtggattcctg

SEQ ID NO: 494314 - DNA, 25 bp, Rattus norvegicus
ccaggaagcgtggattcctggaagt

SEQ ID NO: 494315 - DNA, 25 bp, Rattus norvegicus
gattcctggaagtgaggggaaccgc

SEQ ID NO: 494316 - DNA, 25 bp, Rattus norvegicus
gggaaccgccgtcatttcgcaggca

SEQ ID NO: 494317 - DNA, 25 bp, Rattus norvegicus
ggaaccgccgtcatttcgcaggcag

SEQ ID NO: 494318 - DNA, 25 bp, Rattus norvegicus
ggcccacggctgcagtcggcagaac

SEQ ID NO: 494319 - DNA, 25 bp, Rattus norvegicus
cacggctgcagtcggcagaaccgct

SEQ ID NO: 494320 - DNA, 25 bp, Rattus norvegicus
gctgcagtcggcagaaccgctcagc

SEQ ID NO: 494321 - DNA, 25 bp, Rattus norvegicus
ccgccttggaaacggcgagggagtg

SEQ ID NO: 494322 - DNA, 25 bp, Rattus norvegicus
gcaggcaggggtgagcccagccact

SEQ ID NO: 494323 - DNA, 25 bp, Rattus norvegicus
agggtgtgacctcaccttccacggc

SEQ ID NO: 494324 - DNA, 25 bp, Rattus norvegicus
ctatccggcccaggtctcgtaggca

SEQ ID NO: 494325 - DNA, 25 bp, Rattus norvegicus
ggggacccgacacatcgtgcaccag

SEQ ID NO: 494326 - DNA, 25 bp, Rattus norvegicus
gcaccagctgcagatgtggcgcgtt

SEQ ID NO: 494327 - DNA, 25 bp, Rattus norvegicus
tacggacgagaacatcctcctgcgg

SEQ ID NO: 494328 - DNA, 25 bp, Rattus norvegicus
gcccttgaggaggtcacagcttctt

SEQ ID NO: 494329 - DNA, 25 bp, Rattus norvegicus
cggccgcgttcacttgcctaagatg

SEQ ID NO: 494330 - DNA, 25 bp, Rattus norvegicus
tgcggctcacagaggccgaatgtcc

SEQ ID NO: 494331 - DNA, 25 bp, Rattus norvegicus
aagatccgtgcccttcgcgcagcgt

SEQ ID NO: 494332 - DNA, 25 bp, Rattus norvegicus
gcgcgctgcccatttgcagagagga

SEQ ID NO: 494333 - DNA, 25 bp, Rattus norvegicus
ggacgtcatcgcgtcctcctagcaa

SEQ ID NO: 494334 - DNA, 25 bp, Rattus norvegicus
ggctagtgcgcaggaggattcctac

SEQ ID NO: 494335 - DNA, 25 bp, Rattus norvegicus
aggattcctactacgcaggcgcata

SEQ ID NO: 494336 - DNA, 25 bp, Rattus norvegicus
taagatggcgaacacccaaccgctc

SEQ ID NO: 494337 - DNA, 25 bp, Rattus norvegicus
tgcacgtacacgtccttgcgctgct

SEQ ID NO: 494338 - DNA, 25 bp, Rattus norvegicus
caccactggtgagcaagtgcggcca

SEQ ID NO: 494339 - DNA, 25 bp, Rattus norvegicus
gcgagaggtgcagaaacgcagttta

SEQ ID NO: 494340 - DNA, 25 bp, Rattus norvegicus
tagcccacacacaagctagtgcgtg

SEQ ID NO: 494341 - DNA, 25 bp, Rattus norvegicus
aagtgcggccaagcctggagcccgc

SEQ ID NO: 494342 - DNA, 25 bp, Rattus norvegicus
caggtagagctgcacgtacacgtcc

SEQ ID NO: 494343 - DNA, 25 bp, Rattus norvegicus
agcgtcacgttgttggcgaccaact

SEQ ID NO: 494344 - DNA, 25 bp, Rattus norvegicus
gcgaccaactcgctcttcaacttgt

SEQ ID NO: 494345 - DNA, 25 bp, Rattus norvegicus
tcaacttgtctttggtcaggaccga

SEQ ID NO: 494346 - DNA, 25 bp, Rattus norvegicus
gaagggtcctctaggaactccggca

SEQ ID NO: 494347 - DNA, 25 bp, Rattus norvegicus
tcgggaatccctgaccgggagaagc

SEQ ID NO: 494348 - DNA, 25 bp, Rattus norvegicus
gcagaactcggacacaaagcccagg

SEQ ID NO: 494349 - DNA, 25 bp, Rattus norvegicus
agcccaggccggctaagccacaaaa

SEQ ID NO: 494350 - DNA, 25 bp, Rattus norvegicus
tcgcgctcctcgtcgctcgagaagt

SEQ ID NO: 494351 - DNA, 25 bp, Rattus norvegicus
cgggagactagctggcgtctaatcc

SEQ ID NO: 494352 - DNA, 25 bp, Rattus norvegicus
cctgccactcactcgggagagctgg

SEQ ID NO: 494353 - DNA, 25 bp, Rattus norvegicus
tttcttaggagtccgaaaacatggc

SEQ ID NO: 494354 - DNA, 25 bp, Rattus norvegicus
gtccgaaaacatggcggctgaagca

SEQ ID NO: 494355 - DNA, 25 bp, Rattus norvegicus
ggctgaagcatgcatcccacactta

SEQ ID NO: 494356 - DNA, 25 bp, Rattus norvegicus
ccaaaagcactaggcgttttctctc

SEQ ID NO: 494357 - DNA, 25 bp, Rattus norvegicus
ggcgccgggacaccatagttgatcc

SEQ ID NO: 494358 - DNA, 25 bp, Rattus norvegicus
cgtctaatccggtcagcggagtcga

SEQ ID NO: 494359 - DNA, 25 bp, Rattus norvegicus
tcagcggagtcgaaggaaacccact

SEQ ID NO: 494360 - DNA, 25 bp, Rattus norvegicus
gcggagccagtgacctccctttgta

SEQ ID NO: 494361 - DNA, 25 bp, Rattus norvegicus
gcctgtgccaaatggcgccgggaca

SEQ ID NO: 494362 - DNA, 25 bp, Rattus norvegicus
gagaccaagcgggttcactcggcgc

SEQ ID NO: 494363 - DNA, 25 bp, Rattus norvegicus
actcgggagagctggcagagaccaa

SEQ ID NO: 494364 - DNA, 25 bp, Rattus norvegicus
ccctttgtaatctggcgggatccca

SEQ ID NO: 494365 - DNA, 25 bp, Rattus norvegicus
acgatgacgatggagcgagacctcg

SEQ ID NO: 494366 - DNA, 25 bp, Rattus norvegicus
taaacagagctgagacgtacggccc

SEQ ID NO: 494367 - DNA, 25 bp, Rattus norvegicus
ttccagccgcttccaaaattaagta

SEQ ID NO: 494368 - DNA, 25 bp, Rattus norvegicus
tttcgcattaaaggcacgtttccag

SEQ ID NO: 494369 - DNA, 25 bp, Rattus norvegicus
cgccagcgattcgactttcgcatta

SEQ ID NO: 494370 - DNA, 25 bp, Rattus norvegicus
cgagaagtctgaacgccagcgattc

SEQ ID NO: 494371 - DNA, 25 bp, Rattus norvegicus
tccgagtacgagaagtctgaacgcc

SEQ ID NO: 494372 - DNA, 25 bp, Rattus norvegicus
gctgataattttgttccgagtacga

SEQ ID NO: 494373 - DNA, 25 bp, Rattus norvegicus
ggggccgatcctgacatcacatttg

SEQ ID NO: 494374 - DNA, 25 bp, Rattus norvegicus
gagcgagacctcgttccgtttccga

SEQ ID NO: 494375 - DNA, 25 bp, Rattus norvegicus
ggggtgaacatgtcaagaaaatgga

SEQ ID NO: 494376 - DNA, 25 bp, Rattus norvegicus
tcaagaaaatggaggacgatgacga

SEQ ID NO: 494377 - DNA, 25 bp, Rattus norvegicus
tccgtttccgaagctgataattttg

SEQ ID NO: 494378 - DNA, 25 bp, Rattus norvegicus
atcacatttggttcgccgatagacg

SEQ ID NO: 494379 - DNA, 25 bp, Rattus norvegicus
cttgtgcgctaaaaactacaggcga

SEQ ID NO: 494380 - DNA, 25 bp, Rattus norvegicus
gcgataaccaaaaccgtctccagta

SEQ ID NO: 494381 - DNA, 25 bp, Rattus norvegicus
ctgcactaccggaagccgaagccga

SEQ ID NO: 494382 - DNA, 25 bp, Rattus norvegicus
tagaagtcgtaagtactgcactacc

SEQ ID NO: 494383 - DNA, 25 bp, Rattus norvegicus
gcaggttgtggaacttgtgcgctaa

SEQ ID NO: 494384 - DNA, 25 bp, Rattus norvegicus
ccggctttccaggatgcaggttgtg

SEQ ID NO: 494385 - DNA, 25 bp, Rattus norvegicus
ccgtactctgatgttgggtagactc

SEQ ID NO: 494386 - DNA, 25 bp, Rattus norvegicus
cgggcttctctctgtccgtactctg

SEQ ID NO: 494387 - DNA, 25 bp, Rattus norvegicus
tctcctcgttctggtgtcctgctgt

SEQ ID NO: 494388 - DNA, 25 bp, Rattus norvegicus
tgcccgccgagctaaacgtcagagg

SEQ ID NO: 494389 - DNA, 25 bp, Rattus norvegicus
gggaaacaaactgcccgccgagcta

SEQ ID NO: 494390 - DNA, 25 bp, Rattus norvegicus
ggactcaccggcagccagtcagcga

SEQ ID NO: 494391 - DNA, 25 bp, Rattus norvegicus
ctgcagcggaaacccttggcttctc

SEQ ID NO: 494392 - DNA, 25 bp, Rattus norvegicus
gtcattttcacagggactcaccggc

SEQ ID NO: 494393 - DNA, 25 bp, Rattus norvegicus
ggaacctcacctctcaagcgtggga

SEQ ID NO: 494394 - DNA, 25 bp, Rattus norvegicus
ggaagtcccgcctcacatgacgtca

SEQ ID NO: 494395 - DNA, 25 bp, Rattus norvegicus
ccgcctcacatgacgtcacggagag

SEQ ID NO: 494396 - DNA, 25 bp, Rattus norvegicus
ctggactgttaaacttaggcggccg

SEQ ID NO: 494397 - DNA, 25 bp, Rattus norvegicus
cacctctcaagcgtgggaccacagg

SEQ ID NO: 494398 - DNA, 25 bp, Rattus norvegicus
ctgcggtgcttgctcacagagaccc

SEQ ID NO: 494399 - DNA, 25 bp, Rattus norvegicus
cagcccgggatagctcggcccgtag

SEQ ID NO: 494400 - DNA, 25 bp, Rattus norvegicus
ctgcgctacgcaggagagtcagacc

SEQ ID NO: 494401 - DNA, 25 bp, Rattus norvegicus
aagaagagttctctggggtcgcacc

SEQ ID NO: 494402 - DNA, 25 bp, Rattus norvegicus
ctgcacactctgctaaagaagagtt

SEQ ID NO: 494403 - DNA, 25 bp, Rattus norvegicus
gagcgacagcgaccaactgcacact

SEQ ID NO: 494404 - DNA, 25 bp, Rattus norvegicus
atcccgtgaaagaagagcgacagcg

SEQ ID NO: 494405 - DNA, 25 bp, Rattus norvegicus
ctccaccagcgcttgctgggtggca

SEQ ID NO: 494406 - DNA, 25 bp, Rattus norvegicus
cggctcccgcctggactgttaaact

SEQ ID NO: 494407 - DNA, 25 bp, Rattus norvegicus
gcgccggcgacaccgatgtctcaga

SEQ ID NO: 494408 - DNA, 25 bp, Rattus norvegicus
caggagcgggtttttaccatccagg

SEQ ID NO: 494409 - DNA, 25 bp, Rattus norvegicus
taccatccaggggcccgtagaaggc

SEQ ID NO: 494410 - DNA, 25 bp, Rattus norvegicus
ccaggggcccgtagaaggcggcaga

SEQ ID NO: 494411 - DNA, 25 bp, Rattus norvegicus
gcagcaagtcctcggagcgggtcca

SEQ ID NO: 494412 - DNA, 25 bp, Rattus norvegicus
agcaagtcctcggagcgggtccagt

SEQ ID NO: 494413 - DNA, 25 bp, Rattus norvegicus
caagtcctcggagcgggtccagtgc

SEQ ID NO: 494414 - DNA, 25 bp, Rattus norvegicus
ggatggtggagctcgacttggactc

SEQ ID NO: 494415 - DNA, 25 bp, Rattus norvegicus
tcgacttggactcggtgggcgactt

SEQ ID NO: 494416 - DNA, 25 bp, Rattus norvegicus
gcgacttgagaaccgcggtggaggt

SEQ ID NO: 494417 - DNA, 25 bp, Rattus norvegicus
agttgcgccggcgacaccgatgtct

SEQ ID NO: 494418 - DNA, 25 bp, Rattus norvegicus
gccggcgacaccgatgtctcagagc

SEQ ID NO: 494419 - DNA, 25 bp, Rattus norvegicus
gccaggagcgggtttttaccatcca

SEQ ID NO: 494420 - DNA, 25 bp, Rattus norvegicus
ggcgacaccgatgtctcagagcccg

SEQ ID NO: 494421 - DNA, 25 bp, Rattus norvegicus
cgcagcctccgagcgagagaaagca

SEQ ID NO: 494422 - DNA, 25 bp, Rattus norvegicus
gcggaggcgttaagccgcagcctcc

SEQ ID NO: 494423 - DNA, 25 bp, Rattus norvegicus
cgctcttgctcgctccggggaacag

SEQ ID NO: 494424 - DNA, 25 bp, Rattus norvegicus
cgagagaaagcaacgcgcacgcaga

SEQ ID NO: 494425 - DNA, 25 bp, Rattus norvegicus
aacgcgcacgcagacgaacgagagc

SEQ ID NO: 494426 - DNA, 25 bp, Rattus norvegicus
aacgagagcggcagctgcggtctcc

SEQ ID NO: 494427 - DNA, 25 bp, Rattus norvegicus
tccgctgcccggagtactgggccgt

SEQ ID NO: 494428 - DNA, 25 bp, Rattus norvegicus
agtactgggccgtccgcgaggctcc

SEQ ID NO: 494429 - DNA, 25 bp, Rattus norvegicus
tctccgcacttgctggtgagttggc

SEQ ID NO: 494430 - DNA, 25 bp, Rattus norvegicus
ggaccgtgtcggtcgaatgtccacg

SEQ ID NO: 494431 - DNA, 25 bp, Rattus norvegicus
tcggtcgaatgtccacgcgcgacgt

SEQ ID NO: 494432 - DNA, 25 bp, Rattus norvegicus
tggttggatcgtttcaataaaagtc

SEQ ID NO: 494433 - DNA, 25 bp, Rattus norvegicus
gccgctggttggatcgtttcaataa

SEQ ID NO: 494434 - DNA, 25 bp, Rattus norvegicus
tcgggtcgacacaaagctccgggca

SEQ ID NO: 494435 - DNA, 25 bp, Rattus norvegicus
gtcgacttcgctcgccgggcactga

SEQ ID NO: 494436 - DNA, 25 bp, Rattus norvegicus
ggtagttccgtcctgcccttcacta

SEQ ID NO: 494437 - DNA, 25 bp, Rattus norvegicus
gcgctgagatcgctgtctctccctg

SEQ ID NO: 494438 - DNA, 25 bp, Rattus norvegicus
cttgctccctgcgagcgctgagatc

SEQ ID NO: 494439 - DNA, 25 bp, Rattus norvegicus
ctcacggtccagtcacaggaggata

SEQ ID NO: 494440 - DNA, 25 bp, Rattus norvegicus
tccatcttcgctgcagcgtcgactt

SEQ ID NO: 494441 - DNA, 25 bp, Rattus norvegicus
gcggatacttgttccttggcttctc

SEQ ID NO: 494442 - DNA, 25 bp, Rattus norvegicus
accatgcctgaggtcgcggatactt

SEQ ID NO: 494443 - DNA, 25 bp, Rattus norvegicus
gtgcggcggatctcccacaaccatg

SEQ ID NO: 494444 - DNA, 25 bp, Rattus norvegicus
cctcctttctcaggcttgcggtgaa

SEQ ID NO: 494445 - DNA, 25 bp, Rattus norvegicus
atcgcgctgcatcatgggattggta

SEQ ID NO: 494446 - DNA, 25 bp, Rattus norvegicus
tctagcgttagcctgatcgcgctgc

SEQ ID NO: 494447 - DNA, 25 bp, Rattus norvegicus
cccaatcccatgctgtctagcgtta

SEQ ID NO: 494448 - DNA, 25 bp, Rattus norvegicus
ggaggataatctgcgcagcctggta

SEQ ID NO: 494449 - DNA, 25 bp, Rattus norvegicus
ttcacctctcgcctcgttgtctagg

SEQ ID NO: 494450 - DNA, 25 bp, Rattus norvegicus
gtgctcatcctccttaccatcgcga

SEQ ID NO: 494451 - DNA, 25 bp, Rattus norvegicus
aagggaagggctccaatgcacgcac

SEQ ID NO: 494452 - DNA, 25 bp, Rattus norvegicus
agggctccaatgcacgcacagcaag

SEQ ID NO: 494453 - DNA, 25 bp, Rattus norvegicus
cggcgcctcatgtggatgaatggaa

SEQ ID NO: 494454 - DNA, 25 bp, Rattus norvegicus
cctcatgtggatgaatggaaggcat

SEQ ID NO: 494455 - DNA, 25 bp, Rattus norvegicus
atggaaggcatagcgtgcagccgtc

SEQ ID NO: 494456 - DNA, 25 bp, Rattus norvegicus
cgtcctctagccctgcggtgctcat

SEQ ID NO: 494457 - DNA, 25 bp, Rattus norvegicus
agctgccgctacaccaccgaaagga

SEQ ID NO: 494458 - DNA, 25 bp, Rattus norvegicus
tacaccaccgaaaggacgggcgcta

SEQ ID NO: 494459 - DNA, 25 bp, Rattus norvegicus
gacgggcgctaaaagaaatggccgc

SEQ ID NO: 494460 - DNA, 25 bp, Rattus norvegicus
aggaggcgtaacctttcacctctcg

SEQ ID NO: 494461 - DNA, 25 bp, Rattus norvegicus
ctctcgcctcgttgtctaggcttcg

SEQ ID NO: 494462 - DNA, 25 bp, Rattus norvegicus
cgctaaaagaaatggccgccaaaag

SEQ ID NO: 494463 - DNA, 25 bp, Rattus norvegicus
cgacctcctgcagagcttcggcccg

SEQ ID NO: 494464 - DNA, 25 bp, Rattus norvegicus
ttctactgcgttgcaggcaacgccc

SEQ ID NO: 494465 - DNA, 25 bp, Rattus norvegicus
cggttgcccgtagtccagttactga

SEQ ID NO: 494466 - DNA, 25 bp, Rattus norvegicus
tatctgccggttgcccgtagtccag

SEQ ID NO: 494467 - DNA, 25 bp, Rattus norvegicus
gcccgtagtccagttactgagccaa

SEQ ID NO: 494468 - DNA, 25 bp, Rattus norvegicus
agtccagttactgagccaaggaaca

SEQ ID NO: 494469 - DNA, 25 bp, Rattus norvegicus
tactgagccaaggaacagacccgcc

SEQ ID NO: 494470 - DNA, 25 bp, Rattus norvegicus
gaacagacccgcctccgacctcctg

SEQ ID NO: 494471 - DNA, 25 bp, Rattus norvegicus
gccagctccgggcaatcaccacctg

SEQ ID NO: 494472 - DNA, 25 bp, Rattus norvegicus
cccatggtcccagttcgagttctac

SEQ ID NO: 494473 - DNA, 25 bp, Rattus norvegicus
tggtcccagttcgagttctactgcg

SEQ ID NO: 494474 - DNA, 25 bp, Rattus norvegicus
agttcgagttctactgcgttgcagg

SEQ ID NO: 494475 - DNA, 25 bp, Rattus norvegicus
gggcagtcagccagctccgggcaat

SEQ ID NO: 494476 - DNA, 25 bp, Rattus norvegicus
agacgggtatctgccggttgcccgt

SEQ ID NO: 494477 - DNA, 25 bp, Rattus norvegicus
gcgactgggccaaataccgagcgcc

SEQ ID NO: 494478 - DNA, 25 bp, Rattus norvegicus
gagcgccgaaagatttaagtccgaa

SEQ ID NO: 494479 - DNA, 25 bp, Rattus norvegicus
agccgagcgccgaaagatttaagtc

SEQ ID NO: 494480 - DNA, 25 bp, Rattus norvegicus
gagaatagccgagcgccgaaagatt

SEQ ID NO: 494481 - DNA, 25 bp, Rattus norvegicus
agccggggagactgctgagggaaaa

SEQ ID NO: 494482 - DNA, 25 bp, Rattus norvegicus
gcgataggcgactgggccaaatacc

SEQ ID NO: 494483 - DNA, 25 bp, Rattus norvegicus
taccaggcgataggcgactgggcca

SEQ ID NO: 494484 - DNA, 25 bp, Rattus norvegicus
ggtcccactaccaggcgataggcga

SEQ ID NO: 494485 - DNA, 25 bp, Rattus norvegicus
ttccggtcccactaccaggcgatag

SEQ ID NO: 494486 - DNA, 25 bp, Rattus norvegicus
gcttcacctgaggagggaccgaccc

SEQ ID NO: 494487 - DNA, 25 bp, Rattus norvegicus
ggctccatctccatcaggggcttca

SEQ ID NO: 494488 - DNA, 25 bp, Rattus norvegicus
agcggtggcggctccatctccatca

SEQ ID NO: 494489 - DNA, 25 bp, Rattus norvegicus
gccgaagccgggatccgggtgttca

SEQ ID NO: 494490 - DNA, 25 bp, Rattus norvegicus
ggagaggagctaggggagaatagcc

SEQ ID NO: 494491 - DNA, 25 bp, Rattus norvegicus
ctcccagggcgccaggctcgctcag

SEQ ID NO: 494492 - DNA, 25 bp, Rattus norvegicus
aagcggcagcggtcctccggagcac

SEQ ID NO: 494493 - DNA, 25 bp, Rattus norvegicus
cggcagcggtcctccggagcacccg

SEQ ID NO: 494494 - DNA, 25 bp, Rattus norvegicus
ccggggctctgtggttcttcctcct

SEQ ID NO: 494495 - DNA, 25 bp, Rattus norvegicus
ggctctgtggttcttcctcctccca

SEQ ID NO: 494496 - DNA, 25 bp, Rattus norvegicus
cggggctctgtggttcttcctcctc

SEQ ID NO: 494497 - DNA, 25 bp, Rattus norvegicus
ggggctctgtggttcttcctcctcc

SEQ ID NO: 494498 - DNA, 25 bp, Rattus norvegicus
gccaggctcgctcagtgggcaccgt

SEQ ID NO: 494499 - DNA, 25 bp, Rattus norvegicus
ccaggctcgctcagtgggcaccgtg

SEQ ID NO: 494500 - DNA, 25 bp, Rattus norvegicus
ggctcgctcagtgggcaccgtgggt

SEQ ID NO: 494501 - DNA, 25 bp, Rattus norvegicus
caccgtgggtgcagagtcgcggacc

SEQ ID NO: 494502 - DNA, 25 bp, Rattus norvegicus
tgggtgcagagtcgcggaccggggc

SEQ ID NO: 494503 - DNA, 25 bp, Rattus norvegicus
aggcggcggggtgaccgtcgcgcac

SEQ ID NO: 494504 - DNA, 25 bp, Rattus norvegicus
tgaccgtcgcgcaccggcctggcgg

SEQ ID NO: 494505 - DNA, 25 bp, Rattus norvegicus
ggcttcatcctcagtaaccgagctc

SEQ ID NO: 494506 - DNA, 25 bp, Rattus norvegicus
tggatggggcaggagcaagggaaga

SEQ ID NO: 494507 - DNA, 25 bp, Rattus norvegicus
aaggagacggaacatggccactggc

SEQ ID NO: 494508 - DNA, 25 bp, Rattus norvegicus
gagacggaacatggccactggcttc

SEQ ID NO: 494509 - DNA, 25 bp, Rattus norvegicus
acggaacatggccactggcttcatc

SEQ ID NO: 494510 - DNA, 25 bp, Rattus norvegicus
gcaaaggagacggaacatggccact

SEQ ID NO: 494511 - DNA, 25 bp, Rattus norvegicus
tggcttcatcctcagtaaccgagct

SEQ ID NO: 494512 - DNA, 25 bp, Rattus norvegicus
ttcatcctcagtaaccgagctctgg

SEQ ID NO: 494513 - DNA, 25 bp, Rattus norvegicus
catcctcagtaaccgagctctgggc

SEQ ID NO: 494514 - DNA, 25 bp, Rattus norvegicus
tcctcagtaaccgagctctgggctc

SEQ ID NO: 494515 - DNA, 25 bp, Rattus norvegicus
agcagccgtgcgcagctccccatgg

SEQ ID NO: 494516 - DNA, 25 bp, Rattus norvegicus
cgtcaccacccacctgcggccaccg

SEQ ID NO: 494517 - DNA, 25 bp, Rattus norvegicus
cccaacccccgagcttgggtggatg

SEQ ID NO: 494518 - DNA, 25 bp, Rattus norvegicus
aacatggccactggcttcatcctca

SEQ ID NO: 494519 - DNA, 25 bp, Rattus norvegicus
gcccgccctgagagaagtttttgtc

SEQ ID NO: 494520 - DNA, 25 bp, Rattus norvegicus
tttttgtcggccacgcagagccatg

SEQ ID NO: 494521 - DNA, 25 bp, Rattus norvegicus
tgggacactggacggccagcacgct

SEQ ID NO: 494522 - DNA, 25 bp, Rattus norvegicus
tcacaccgaacaaccaaggggcgtg

SEQ ID NO: 494523 - DNA, 25 bp, Rattus norvegicus
ggcctctcacatgggcgtggctatg

SEQ ID NO: 494524 - DNA, 25 bp, Rattus norvegicus
tggtctcgcctctgctgacgtcgtc

SEQ ID NO: 494525 - DNA, 25 bp, Rattus norvegicus
ctgacggagttttcccgcccgcagg

SEQ ID NO: 494526 - DNA, 25 bp, Rattus norvegicus
cggcgccggcgaatttagaattggc

SEQ ID NO: 494527 - DNA, 25 bp, Rattus norvegicus
tagaattggcgcctctgggaagtct

SEQ ID NO: 494528 - DNA, 25 bp, Rattus norvegicus
cacctcccgggtaccggagatgcta

SEQ ID NO: 494529 - DNA, 25 bp, Rattus norvegicus
ccggacctctctctgatcgtcggga

SEQ ID NO: 494530 - DNA, 25 bp, Rattus norvegicus
tcgggaggtgacactcgccttccct

SEQ ID NO: 494531 - DNA, 25 bp, Rattus norvegicus
ctcccagtaggagcggacgtcggac

SEQ ID NO: 494532 - DNA, 25 bp, Rattus norvegicus
ctgcggcaagtggaaagcccgccct

SEQ ID NO: 494533 - DNA, 25 bp, Rattus norvegicus
gaccgcgttaaactcactgtcaaca

SEQ ID NO: 494534 - DNA, 25 bp, Rattus norvegicus
tcttgatgactcaaagaccgcgtta

SEQ ID NO: 494535 - DNA, 25 bp, Rattus norvegicus
tgcacccgagatgccacgaatacga

SEQ ID NO: 494536 - DNA, 25 bp, Rattus norvegicus
aaaaagggtcttcgctccagagtgc

SEQ ID NO: 494537 - DNA, 25 bp, Rattus norvegicus
cctgtgcgcttattccggcttggaa

SEQ ID NO: 494538 - DNA, 25 bp, Rattus norvegicus
tgcgcctggcttagttagtctgttc

SEQ ID NO: 494539 - DNA, 25 bp, Rattus norvegicus
ggactgcgaaaacacgactccttta

SEQ ID NO: 494540 - DNA, 25 bp, Rattus norvegicus
agccaagtcgttcggccattcctgg

SEQ ID NO: 494541 - DNA, 25 bp, Rattus norvegicus
ccgtcaggcctggagatttaataaa

SEQ ID NO: 494542 - DNA, 25 bp, Rattus norvegicus
accatttctgagcagccgcggcacg

SEQ ID NO: 494543 - DNA, 25 bp, Rattus norvegicus
ctaccattcgggaagcggaggcact

SEQ ID NO: 494544 - DNA, 25 bp, Rattus norvegicus
gctctgagaccctagggctaccatt

SEQ ID NO: 494545 - DNA, 25 bp, Rattus norvegicus
cttgtgcatgtttcaggtccgtgtc

SEQ ID NO: 494546 - DNA, 25 bp, Rattus norvegicus
ggaattccgcgtttcgtgtgccgca

SEQ ID NO: 494547 - DNA, 25 bp, Rattus norvegicus
ctgagcatgtaaaaacctggaattc

SEQ ID NO: 494548 - DNA, 25 bp, Rattus norvegicus
tccgtacgtgatcttccataaattg

SEQ ID NO: 494549 - DNA, 25 bp, Rattus norvegicus
aattgcgtttcggtgtcattacaca

SEQ ID NO: 494550 - DNA, 25 bp, Rattus norvegicus
cggcgtccgataactgctgaagttt

SEQ ID NO: 494551 - DNA, 25 bp, Rattus norvegicus
ggaattccaccaactgtaccagcgt

SEQ ID NO: 494552 - DNA, 25 bp, Rattus norvegicus
gacacccggttcatgccgcagcaag

SEQ ID NO: 494553 - DNA, 25 bp, Rattus norvegicus
ccgcagcaagccaatgacgtcactt

SEQ ID NO: 494554 - DNA, 25 bp, Rattus norvegicus
gttccaggaccgctctaggctgcat

SEQ ID NO: 494555 - DNA, 25 bp, Rattus norvegicus
cccgcccgaagctttgtggttgctg

SEQ ID NO: 494556 - DNA, 25 bp, Rattus norvegicus
cgtgacgttcttgcccggactgcaa

SEQ ID NO: 494557 - DNA, 25 bp, Rattus norvegicus
ctttacggcatctcaggaacgggcg

SEQ ID NO: 494558 - DNA, 25 bp, Rattus norvegicus
gtctcctcagagagcccgccagtta

SEQ ID NO: 494559 - DNA, 25 bp, Rattus norvegicus
cgccagttaccaccgggccttgaga

SEQ ID NO: 494560 - DNA, 25 bp, Rattus norvegicus
ggtgtcaacactagacggcgtccga

SEQ ID NO: 494561 - DNA, 25 bp, Rattus norvegicus
ttccgtgacttaggcgctgtcgcct

SEQ ID NO: 494562 - DNA, 25 bp, Rattus norvegicus
actcttgagcccaggtgatggaacg

SEQ ID NO: 494563 - DNA, 25 bp, Rattus norvegicus
agtcatgacttctgccgtgggtaag

SEQ ID NO: 494564 - DNA, 25 bp, Rattus norvegicus
ctgctcaaactctggggagcgtgga

SEQ ID NO: 494565 - DNA, 25 bp, Rattus norvegicus
cggggacttttgtctcctgctcaaa

SEQ ID NO: 494566 - DNA, 25 bp, Rattus norvegicus
cgaagtcgcggctagctcctctcgt

SEQ ID NO: 494567 - DNA, 25 bp, Rattus norvegicus
ggagcgcggattttcttactagatg

SEQ ID NO: 494568 - DNA, 25 bp, Rattus norvegicus
gtctgccttttacatcccgcgacta

SEQ ID NO: 494569 - DNA, 25 bp, Rattus norvegicus
attggagagtgctatggcttttgtc

SEQ ID NO: 494570 - DNA, 25 bp, Rattus norvegicus
cctttccgacctgcttattggagta

SEQ ID NO: 494571 - DNA, 25 bp, Rattus norvegicus
tcaggggcaccgaaaactacaactc

SEQ ID NO: 494572 - DNA, 25 bp, Rattus norvegicus
cccgcctcagcacgatgggaaatga

SEQ ID NO: 494573 - DNA, 25 bp, Rattus norvegicus
gtcaaactccggtgtcatccttctc

SEQ ID NO: 494574 - DNA, 25 bp, Rattus norvegicus
gtggactgaactggagccatggatt

SEQ ID NO: 494575 - DNA, 25 bp, Rattus norvegicus
tgggcggcccaaccgccaagcgtcg

SEQ ID NO: 494576 - DNA, 25 bp, Rattus norvegicus
ggttgcgggatgacacctccgcccg

SEQ ID NO: 494577 - DNA, 25 bp, Rattus norvegicus
ttgggttgcgggatgacacctccgc

SEQ ID NO: 494578 - DNA, 25 bp, Rattus norvegicus
gtacccttgggttgcgggatgacac

SEQ ID NO: 494579 - DNA, 25 bp, Rattus norvegicus
ccatgtacccttgggttgcgggatg

SEQ ID NO: 494580 - DNA, 25 bp, Rattus norvegicus
gaacgcttccgtatcggcgccgctt

SEQ ID NO: 494581 - DNA, 25 bp, Rattus norvegicus
acagggaacgcttccgtatcggcgc

SEQ ID NO: 494582 - DNA, 25 bp, Rattus norvegicus
acccacagggaacgcttccgtatcg

SEQ ID NO: 494583 - DNA, 25 bp, Rattus norvegicus
ttcacccacagggaacgcttccgta

SEQ ID NO: 494584 - DNA, 25 bp, Rattus norvegicus
tagcggacagctcaatgccgcggga

SEQ ID NO: 494585 - DNA, 25 bp, Rattus norvegicus
gtggtagcggacagctcaatgccgc

SEQ ID NO: 494586 - DNA, 25 bp, Rattus norvegicus
aaccgccaagcgtcgtggcccgagc

SEQ ID NO: 494587 - DNA, 25 bp, Rattus norvegicus
taagtcgggtgctgggcggcccaac

SEQ ID NO: 494588 - DNA, 25 bp, Rattus norvegicus
tcccagctcccggttacccgagtgc

SEQ ID NO: 494589 - DNA, 25 bp, Rattus norvegicus
gctcctgattaggaacctccaaacg

SEQ ID NO: 494590 - DNA, 25 bp, Rattus norvegicus
aatggagcaactgcgggtcctgaag

SEQ ID NO: 494591 - DNA, 25 bp, Rattus norvegicus
ttcagaatggagcaactgcgggtcc

SEQ ID NO: 494592 - DNA, 25 bp, Rattus norvegicus
ccacgcagttcagaatggagcaact

SEQ ID NO: 494593 - DNA, 25 bp, Rattus norvegicus
aaagggcgggccacgcagttcagaa

SEQ ID NO: 494594 - DNA, 25 bp, Rattus norvegicus
cagcttttaccggagcacggaaagg

SEQ ID NO: 494595 - DNA, 25 bp, Rattus norvegicus
gggcagcttttaccggagcacggaa

SEQ ID NO: 494596 - DNA, 25 bp, Rattus norvegicus
gtctagtggcagcttccgccgggca

SEQ ID NO: 494597 - DNA, 25 bp, Rattus norvegicus
gctataatacggagagaagcctccc

SEQ ID NO: 494598 - DNA, 25 bp, Rattus norvegicus
ctgattaggaacctccaaacgttgg

SEQ ID NO: 494599 - DNA, 25 bp, Rattus norvegicus
ggagagaagcctccctgcgcgagct

SEQ ID NO: 494600 - DNA, 25 bp, Rattus norvegicus
tccgccgggcagcttttaccggagc

SEQ ID NO: 494601 - DNA, 25 bp, Rattus norvegicus
ccaaacgttggttccttgctgtcta

SEQ ID NO: 494602 - DNA, 25 bp, Rattus norvegicus
tccttgctgtctagtggcagcttcc

SEQ ID NO: 494603 - DNA, 25 bp, Rattus norvegicus
gcagtttgcattcgcttcatcgatc

SEQ ID NO: 494604 - DNA, 25 bp, Rattus norvegicus
gcttcatcgatctgcccagcagcga

SEQ ID NO: 494605 - DNA, 25 bp, Rattus norvegicus
catgggctcagcagtttgcattcgc

SEQ ID NO: 494606 - DNA, 25 bp, Rattus norvegicus
tcagcagcacgcatgcatgggctca

SEQ ID NO: 494607 - DNA, 25 bp, Rattus norvegicus
ttcatggctgtcagcagcacgcatg

SEQ ID NO: 494608 - DNA, 25 bp, Rattus norvegicus
tccacccgtggcgttcatggctgtc

SEQ ID NO: 494609 - DNA, 25 bp, Rattus norvegicus
agcgaccctttcctggactctgaag

SEQ ID NO: 494610 - DNA, 25 bp, Rattus norvegicus
tctgaagtctgtcacgctccatcgg

SEQ ID NO: 494611 - DNA, 25 bp, Rattus norvegicus
gtcacgctccatcggcttatcatga

SEQ ID NO: 494612 - DNA, 25 bp, Rattus norvegicus
tcggcttatcatgactgaacacacc

SEQ ID NO: 494613 - DNA, 25 bp, Rattus norvegicus
tgaacacaccaaacacgaggcgctg

SEQ ID NO: 494614 - DNA, 25 bp, Rattus norvegicus
cgaggcgctgtgtttggaaattgac

SEQ ID NO: 494615 - DNA, 25 bp, Rattus norvegicus
ggaaattgactagaaccaccgctgg

SEQ ID NO: 494616 - DNA, 25 bp, Rattus norvegicus
ggggttccttcctccgtgccgagca

SEQ ID NO: 494617 - DNA, 25 bp, Rattus norvegicus
taggaaccgacaggagcgtgccttt

SEQ ID NO: 494618 - DNA, 25 bp, Rattus norvegicus
tcggtgcccgcccaaagaaggagga

SEQ ID NO: 494619 - DNA, 25 bp, Rattus norvegicus
tgcaggcttcagttgggtttcctcg

SEQ ID NO: 494620 - DNA, 25 bp, Rattus norvegicus
ccaaggaaactttgcaggcttcagt

SEQ ID NO: 494621 - DNA, 25 bp, Rattus norvegicus
cgcggccctaggagccaaggaaact

SEQ ID NO: 494622 - DNA, 25 bp, Rattus norvegicus
agaggtcgcccggtggcccacgaca

SEQ ID NO: 494623 - DNA, 25 bp, Rattus norvegicus
cgtggtgttcgcagcgacgagtccc

SEQ ID NO: 494624 - DNA, 25 bp, Rattus norvegicus
gtttgaaacgcagtcccggccacca

SEQ ID NO: 494625 - DNA, 25 bp, Rattus norvegicus
agtgcgagcggtttgaaacgcagtc

SEQ ID NO: 494626 - DNA, 25 bp, Rattus norvegicus
aactccaggctgaggcgagagccga

SEQ ID NO: 494627 - DNA, 25 bp, Rattus norvegicus
ctcccgaaacgtggaacctctagag

SEQ ID NO: 494628 - DNA, 25 bp, Rattus norvegicus
caaggtaccttggaggtggcgcatc

SEQ ID NO: 494629 - DNA, 25 bp, Rattus norvegicus
ggaacctctagagtaggaaccgaca

SEQ ID NO: 494630 - DNA, 25 bp, Rattus norvegicus
tcctgccgggatcggaagagaactc

SEQ ID NO: 494631 - DNA, 25 bp, Rattus norvegicus
ggcgccttcgccacggtttgcagcg

SEQ ID NO: 494632 - DNA, 25 bp, Rattus norvegicus
acgcgctgcctagatcaaaagtcga

SEQ ID NO: 494633 - DNA, 25 bp, Rattus norvegicus
acctgcggggctctgcattgctgct

SEQ ID NO: 494634 - DNA, 25 bp, Rattus norvegicus
ccgagaacgcaaagttgtcagtcta

SEQ ID NO: 494635 - DNA, 25 bp, Rattus norvegicus
agcgacacggcgctcactgtggacc

SEQ ID NO: 494636 - DNA, 25 bp, Rattus norvegicus
ctgggagacacagcaccgcggaacc

SEQ ID NO: 494637 - DNA, 25 bp, Rattus norvegicus
ggtgtcaccgctggaatcggagcta

SEQ ID NO: 494638 - DNA, 25 bp, Rattus norvegicus
ctggaatcggagctagtcagcccta

SEQ ID NO: 494639 - DNA, 25 bp, Rattus norvegicus
gtcagccctattccacgacgttgta

SEQ ID NO: 494640 - DNA, 25 bp, Rattus norvegicus
atctcggcatggacgctccggagtt

SEQ ID NO: 494641 - DNA, 25 bp, Rattus norvegicus
gggactcccttgatctggctcccgg

SEQ ID NO: 494642 - DNA, 25 bp, Rattus norvegicus
tctaagcgcagacatgccgggcagc

SEQ ID NO: 494643 - DNA, 25 bp, Rattus norvegicus
attccacgacgttgtagcccgtccg

SEQ ID NO: 494644 - DNA, 25 bp, Rattus norvegicus
tcaaaagtcgatctcggcatggacg

SEQ ID NO: 494645 - DNA, 25 bp, Rattus norvegicus
tcaaccttccctaggagtgggtgcc

SEQ ID NO: 494646 - DNA, 25 bp, Rattus norvegicus
gctacctcaaccttccctaggagtg

SEQ ID NO: 494647 - DNA, 25 bp, Rattus norvegicus
cgtgaggcgagacctgccgtttccc

SEQ ID NO: 494648 - DNA, 25 bp, Rattus norvegicus
gtgtggcccacagggccgtcccaga

SEQ ID NO: 494649 - DNA, 25 bp, Rattus norvegicus
gagtggcgtccgcacttttcccaca

SEQ ID NO: 494650 - DNA, 25 bp, Rattus norvegicus
acttttcccacagtagcagcggctg

SEQ ID NO: 494651 - DNA, 25 bp, Rattus norvegicus
agcccggctcgttggcttgtctcca

SEQ ID NO: 494652 - DNA, 25 bp, Rattus norvegicus
ctgtgctagggcacgctgctaggac

SEQ ID NO: 494653 - DNA, 25 bp, Rattus norvegicus
gctgctaggaccgtgtgtaagtttg

SEQ ID NO: 494654 - DNA, 25 bp, Rattus norvegicus
tgtaagtttggtaagtcacctcgct

SEQ ID NO: 494655 - DNA, 25 bp, Rattus norvegicus
tcacctcgctttctaggcatgctgg

SEQ ID NO: 494656 - DNA, 25 bp, Rattus norvegicus
atgctgggcgtctgcttggaatcct

SEQ ID NO: 494657 - DNA, 25 bp, Rattus norvegicus
tgcttggaatcctgcagcactcctc

SEQ ID NO: 494658 - DNA, 25 bp, Rattus norvegicus
tgcgcagtgccgatgacgtagcacg

SEQ ID NO: 494659 - DNA, 25 bp, Rattus norvegicus
agtggccgcctaggtcccaccctcg

SEQ ID NO: 494660 - DNA, 25 bp, Rattus norvegicus
tcaggtcgccagatcgccaggtcgc

SEQ ID NO: 494661 - DNA, 25 bp, Rattus norvegicus
agctgtcctcaggtcgccagatcgc

SEQ ID NO: 494662 - DNA, 25 bp, Rattus norvegicus
ctgacgaggactggcagctgtcctc

SEQ ID NO: 494663 - DNA, 25 bp, Rattus norvegicus
tgctactgacgaggactggcagctg

SEQ ID NO: 494664 - DNA, 25 bp, Rattus norvegicus
ccctagcttcccagctgctactgac

SEQ ID NO: 494665 - DNA, 25 bp, Rattus norvegicus
tcgcccgcgtcgcaaccattggccc

SEQ ID NO: 494666 - DNA, 25 bp, Rattus norvegicus
agtttgtgcaggcgtcctcacgccc

SEQ ID NO: 494667 - DNA, 25 bp, Rattus norvegicus
ggtcgtgacgtgtacagtttgtgca

SEQ ID NO: 494668 - DNA, 25 bp, Rattus norvegicus
cccttacctagctggacgtcggcag

SEQ ID NO: 494669 - DNA, 25 bp, Rattus norvegicus
ggactcggtcgtgacgtgtacagtt

SEQ ID NO: 494670 - DNA, 25 bp, Rattus norvegicus
tcggcagcggaacaatttcacccgc

SEQ ID NO: 494671 - DNA, 25 bp, Rattus norvegicus
acgtcggcagcggaacaatttcacc

SEQ ID NO: 494672 - DNA, 25 bp, Rattus norvegicus
cgtgacgtgtacagtttgtgcaggc

SEQ ID NO: 494673 - DNA, 25 bp, Rattus norvegicus
tggcttgctcagatcgccacaccgg

SEQ ID NO: 494674 - DNA, 25 bp, Rattus norvegicus
ttgtgaaagtgggatgcaactggcc

SEQ ID NO: 494675 - DNA, 25 bp, Rattus norvegicus
tgcgcttgtgcgtttcactttccca

SEQ ID NO: 494676 - DNA, 25 bp, Rattus norvegicus
tccgcttcgccggagagttcctctg

SEQ ID NO: 494677 - DNA, 25 bp, Rattus norvegicus
aagccttgcgcgctccggagacgct

SEQ ID NO: 494678 - DNA, 25 bp, Rattus norvegicus
ggaaccgccagtgccagcagatagg

SEQ ID NO: 494679 - DNA, 25 bp, Rattus norvegicus
gccgctatggctccgatggcttgct

SEQ ID NO: 494680 - DNA, 25 bp, Rattus norvegicus
ctgtagtccagctggtccaggcagc

SEQ ID NO: 494681 - DNA, 25 bp, Rattus norvegicus
tataggcgggagagcctgttcttca

SEQ ID NO: 494682 - DNA, 25 bp, Rattus norvegicus
agttgcccgcttggtcccggtatag

SEQ ID NO: 494683 - DNA, 25 bp, Rattus norvegicus
gcgccaacgagacaggctcggtgca

SEQ ID NO: 494684 - DNA, 25 bp, Rattus norvegicus
cctcgcggtagggtaatagcagctt

SEQ ID NO: 494685 - DNA, 25 bp, Rattus norvegicus
taaggttgcccaagggccgcacctc

SEQ ID NO: 494686 - DNA, 25 bp, Rattus norvegicus
cctccgggagacctccatggggcta

SEQ ID NO: 494687 - DNA, 25 bp, Rattus norvegicus
gcaccgctgttgagccaaacgcata

SEQ ID NO: 494688 - DNA, 25 bp, Rattus norvegicus
cactgtaggcttgagcaccgctgtt

SEQ ID NO: 494689 - DNA, 25 bp, Rattus norvegicus
agggactgtctcaaacactgtaggc

SEQ ID NO: 494690 - DNA, 25 bp, Rattus norvegicus
tcgggctgattatggacatcgttga

SEQ ID NO: 494691 - DNA, 25 bp, Rattus norvegicus
tgccgacagaacacgaggcaaatcg

SEQ ID NO: 494692 - DNA, 25 bp, Rattus norvegicus
gcacatttgaggcactgccgacaga

SEQ ID NO: 494693 - DNA, 25 bp, Rattus norvegicus
gggcctacagtacgggcacatttga

SEQ ID NO: 494694 - DNA, 25 bp, Rattus norvegicus
tccagcgaattctcccaggggccta

SEQ ID NO: 494695 - DNA, 25 bp, Rattus norvegicus
gcaacgacagcgcacattaatccag

SEQ ID NO: 494696 - DNA, 25 bp, Rattus norvegicus
gcgggcctcgcttcacgtaaaatgc

SEQ ID NO: 494697 - DNA, 25 bp, Rattus norvegicus
ggcttctccgcgtctcaattttgtg

SEQ ID NO: 494698 - DNA, 25 bp, Rattus norvegicus
ttgacgagcttgcacttttctaggc

SEQ ID NO: 494699 - DNA, 25 bp, Rattus norvegicus
aactgcagagttccgcttggctgtg

SEQ ID NO: 494700 - DNA, 25 bp, Rattus norvegicus
tgtgcggctctgcagttcttgacga

SEQ ID NO: 494701 - DNA, 25 bp, Rattus norvegicus
tgcccggtgcataaggctcacgttc

SEQ ID NO: 494702 - DNA, 25 bp, Rattus norvegicus
tcagtaaaggtgcaacagtggcggc

SEQ ID NO: 494703 - DNA, 25 bp, Rattus norvegicus
ggcagacagcgctctggatcagtaa

SEQ ID NO: 494704 - DNA, 25 bp, Rattus norvegicus
tcctcgcttgacatcgctggtggca

SEQ ID NO: 494705 - DNA, 25 bp, Rattus norvegicus
tggcccgatagctttcctcgcttga

SEQ ID NO: 494706 - DNA, 25 bp, Rattus norvegicus
ggctcacgttcgttcgtcaaatagc

SEQ ID NO: 494707 - DNA, 25 bp, Rattus norvegicus
atccgctggcgactgacaaaatggc

SEQ ID NO: 494708 - DNA, 25 bp, Rattus norvegicus
ttgacattgccttcagtgcccggtg

SEQ ID NO: 494709 - DNA, 25 bp, Rattus norvegicus
agccttgcggattttacgcttgaca

SEQ ID NO: 494710 - DNA, 25 bp, Rattus norvegicus
cgcactacgtagcaggcggcagcct

SEQ ID NO: 494711 - DNA, 25 bp, Rattus norvegicus
cttggacaggtcatgccaggtctga

SEQ ID NO: 494712 - DNA, 25 bp, Rattus norvegicus
tcgccaccagtacgtcttggacagg

SEQ ID NO: 494713 - DNA, 25 bp, Rattus norvegicus
ggtcccagacttcaggctcgcgagt

SEQ ID NO: 494714 - DNA, 25 bp, Rattus norvegicus
tcaaatagcgcaggatggcccgata

SEQ ID NO: 494715 - DNA, 25 bp, Rattus norvegicus
gtaagtgaacccgacgactgccctc

SEQ ID NO: 494716 - DNA, 25 bp, Rattus norvegicus
ccacagcgcggggattgagagagaa

SEQ ID NO: 494717 - DNA, 25 bp, Rattus norvegicus
ccgacgactgccctcaaggaggaaa

SEQ ID NO: 494718 - DNA, 25 bp, Rattus norvegicus
gtctcggcagctgaaagccgtggtt

SEQ ID NO: 494719 - DNA, 25 bp, Rattus norvegicus
ctgaaagccgtggttgtggcacaaa

SEQ ID NO: 494720 - DNA, 25 bp, Rattus norvegicus
ttgtggcacaaacgggaagagctac

SEQ ID NO: 494721 - DNA, 25 bp, Rattus norvegicus
cacaaacgggaagagctaccggcgg

SEQ ID NO: 494722 - DNA, 25 bp, Rattus norvegicus
tcacggtaagtgaacccgacgactg

SEQ ID NO: 494723 - DNA, 25 bp, Rattus norvegicus
tgaacccgacgactgccctcaagga

SEQ ID NO: 494724 - DNA, 25 bp, Rattus norvegicus
ccgcgcaggggcgatgtcgccacag

SEQ ID NO: 494725 - DNA, 25 bp, Rattus norvegicus
ttgagagagaagatggagtcgtatt

SEQ ID NO: 494726 - DNA, 25 bp, Rattus norvegicus
ggagtcgtattacttacgtccgcga

SEQ ID NO: 494727 - DNA, 25 bp, Rattus norvegicus
tattacttacgtccgcgaccacgta

SEQ ID NO: 494728 - DNA, 25 bp, Rattus norvegicus
actgccctcaaggaggaaaccgatc

SEQ ID NO: 494729 - DNA, 25 bp, Rattus norvegicus
gagctccaaatgaggccgggactga

SEQ ID NO: 494730 - DNA, 25 bp, Rattus norvegicus
gccgtatttttctgcgccaaaggca

SEQ ID NO: 494731 - DNA, 25 bp, Rattus norvegicus
ctcagtaggagcagccgtatttttc

SEQ ID NO: 494732 - DNA, 25 bp, Rattus norvegicus
atgcctagggatgcaaccggctctg

SEQ ID NO: 494733 - DNA, 25 bp, Rattus norvegicus
tgcaggaatcacactcaggcagctt

SEQ ID NO: 494734 - DNA, 25 bp, Rattus norvegicus
agcgcagcgggctatgccatcaact

SEQ ID NO: 494735 - DNA, 25 bp, Rattus norvegicus
tgggtaaacagacacgtggaaaatc

SEQ ID NO: 494736 - DNA, 25 bp, Rattus norvegicus
cgcctgtgtgcttctgtaccattta

SEQ ID NO: 494737 - DNA, 25 bp, Rattus norvegicus
ggatgcatccggcaaaacctggttc

SEQ ID NO: 494738 - DNA, 25 bp, Rattus norvegicus
tgttttcccgcccaagaactgtgtg

SEQ ID NO: 494739 - DNA, 25 bp, Rattus norvegicus
ggcagttctctgcacttggcatttc

SEQ ID NO: 494740 - DNA, 25 bp, Rattus norvegicus
ataggccttcgtcacgggcaagtcg

SEQ ID NO: 494741 - DNA, 25 bp, Rattus norvegicus
caggcagcttgggaaacagtcagtc

SEQ ID NO: 494742 - DNA, 25 bp, Rattus norvegicus
tcaactgggactgagggcttacctc

SEQ ID NO: 494743 - DNA, 25 bp, Rattus norvegicus
ttccctcggcagcttctgagaagcc

SEQ ID NO: 494744 - DNA, 25 bp, Rattus norvegicus
cggcatttgttacgtcgcccaccga

SEQ ID NO: 494745 - DNA, 25 bp, Rattus norvegicus
aggcgtagtcgcacgtacactgctc

SEQ ID NO: 494746 - DNA, 25 bp, Rattus norvegicus
aatgaatggacggacaccgagagcc

SEQ ID NO: 494747 - DNA, 25 bp, Rattus norvegicus
tgagaagcccgaggcatcgcagaga

SEQ ID NO: 494748 - DNA, 25 bp, Rattus norvegicus
aaggtaaccgcccaggcaggcttca

SEQ ID NO: 494749 - DNA, 25 bp, Rattus norvegicus
cccgcaggatcatcaaggtaaccgc

SEQ ID NO: 494750 - DNA, 25 bp, Rattus norvegicus
atctgacaagatggccgggctgccc

SEQ ID NO: 494751 - DNA, 25 bp, Rattus norvegicus
ggccgaactcgggatctgacaagat

SEQ ID NO: 494752 - DNA, 25 bp, Rattus norvegicus
ggacttccactcgtgcgtgaggcga

SEQ ID NO: 494753 - DNA, 25 bp, Rattus norvegicus
cgcgccctagcagggactacatttc

SEQ ID NO: 494754 - DNA, 25 bp, Rattus norvegicus
ctctggacgcccagttgcgcgaatt

SEQ ID NO: 494755 - DNA, 25 bp, Rattus norvegicus
tacactgctcgtggactctggacgc

SEQ ID NO: 494756 - DNA, 25 bp, Rattus norvegicus
tccgcaggttctgttcacccgcgag

SEQ ID NO: 494757 - DNA, 25 bp, Rattus norvegicus
taagtctagggctctaccagctctg

SEQ ID NO: 494758 - DNA, 25 bp, Rattus norvegicus
aagcgatccgagacttcctggccct

SEQ ID NO: 494759 - DNA, 25 bp, Rattus norvegicus
caaggccacagaagggaagcgatcc

SEQ ID NO: 494760 - DNA, 25 bp, Rattus norvegicus
gccagtgctcgagccgagtcgcctt

SEQ ID NO: 494761 - DNA, 25 bp, Rattus norvegicus
gcgccattacgcctgcgtgccagga

SEQ ID NO: 494762 - DNA, 25 bp, Rattus norvegicus
ttcgcccgcatttaagctgggctcc

SEQ ID NO: 494763 - DNA, 25 bp, Rattus norvegicus
gccgcttgcagccactctttgcttg

SEQ ID NO: 494764 - DNA, 25 bp, Rattus norvegicus
tcggaccgaacgaagtcgcggtgct

SEQ ID NO: 494765 - DNA, 25 bp, Rattus norvegicus
tgaacttcatcctagagccgggctc

SEQ ID NO: 494766 - DNA, 25 bp, Rattus norvegicus
gcggaggccgctttgccaaaaaaga

SEQ ID NO: 494767 - DNA, 25 bp, Rattus norvegicus
gtaattaaaccaacagcctgcgatc

SEQ ID NO: 494768 - DNA, 25 bp, Rattus norvegicus
gcctgcgatctaatgggcgagccca

SEQ ID NO: 494769 - DNA, 25 bp, Rattus norvegicus
ctggttgggcttgaacttcatccta

SEQ ID NO: 494770 - DNA, 25 bp, Rattus norvegicus
ggggcgtgctttgtacaaggccaca

SEQ ID NO: 494771 - DNA, 25 bp, Rattus norvegicus
caactcttgggatcctcggaggcta

SEQ ID NO: 494772 - DNA, 25 bp, Rattus norvegicus
gccaccatgataggcgagatcgccg

SEQ ID NO: 494773 - DNA, 25 bp, Rattus norvegicus
ccgagcgatgtgaccaggccgccat

SEQ ID NO: 494774 - DNA, 25 bp, Rattus norvegicus
agcgagcgacagctgcagactttca

SEQ ID NO: 494775 - DNA, 25 bp, Rattus norvegicus
cctcggagctggaaatgcaactctt

SEQ ID NO: 494776 - DNA, 25 bp, Rattus norvegicus
cgcggtgtccttcatctccaagttc

SEQ ID NO: 494777 - DNA, 25 bp, Rattus norvegicus
agactttcagccagagcctgcagga

SEQ ID NO: 494778 - DNA, 25 bp, Rattus norvegicus
tacaagcagattacgtcagctcctc

SEQ ID NO: 494779 - DNA, 25 bp, Rattus norvegicus
ctccgaatctgcctgcgtcacaatg

SEQ ID NO: 494780 - DNA, 25 bp, Rattus norvegicus
tcacaatggtgcgatctccggattg

SEQ ID NO: 494781 - DNA, 25 bp, Rattus norvegicus
ttcctttccgcagcactataaaatg

SEQ ID NO: 494782 - DNA, 25 bp, Rattus norvegicus
aagttcctccgcaccaaggggctca

SEQ ID NO: 494783 - DNA, 25 bp, Rattus norvegicus
ctataaaatgagctgcacggcggcg

SEQ ID NO: 494784 - DNA, 25 bp, Rattus norvegicus
gccgcgacacgcacaacaaaggatc

SEQ ID NO: 494785 - DNA, 25 bp, Rattus norvegicus
ggcggagacgcgctcaccggatcct

SEQ ID NO: 494786 - DNA, 25 bp, Rattus norvegicus
tccgagccgcgctacctccgctcgt

SEQ ID NO: 494787 - DNA, 25 bp, Rattus norvegicus
accctttccgcaccgcgcgctgcaa

SEQ ID NO: 494788 - DNA, 25 bp, Rattus norvegicus
ccttgattcttctctcggaaaaatg

SEQ ID NO: 494789 - DNA, 25 bp, Rattus norvegicus
ctcggaaaaatggttcccgctgcgg

SEQ ID NO: 494790 - DNA, 25 bp, Rattus norvegicus
atccttccttgattcttctctcgga

SEQ ID NO: 494791 - DNA, 25 bp, Rattus norvegicus
gacccacccgcctatccttccttga

SEQ ID NO: 494792 - DNA, 25 bp, Rattus norvegicus
gcctccttccagaggtgcagtcgca

SEQ ID NO: 494793 - DNA, 25 bp, Rattus norvegicus
cccggctggtggacgccgagtctct

SEQ ID NO: 494794 - DNA, 25 bp, Rattus norvegicus
cctcctcgcggtgcagcgtgagtag

SEQ ID NO: 494795 - DNA, 25 bp, Rattus norvegicus
tctgcgaaccggtgtctgccggacc

SEQ ID NO: 494796 - DNA, 25 bp, Rattus norvegicus
ttgagctccgccgtctgcgaaccgg

SEQ ID NO: 494797 - DNA, 25 bp, Rattus norvegicus
aggtgcagtcgcacctccgcgtggc

SEQ ID NO: 494798 - DNA, 25 bp, Rattus norvegicus
gcccggcactccaggccaccctttc

SEQ ID NO: 494799 - DNA, 25 bp, Rattus norvegicus
gagtctgcgtgctggttaaagccac

SEQ ID NO: 494800 - DNA, 25 bp, Rattus norvegicus
tcaccgttctagtggtcgcggtgcc

SEQ ID NO: 494801 - DNA, 25 bp, Rattus norvegicus
agtggttcccggattccgatgcacg

SEQ ID NO: 494802 - DNA, 25 bp, Rattus norvegicus
aaggcagtggttcccggattccgat

SEQ ID NO: 494803 - DNA, 25 bp, Rattus norvegicus
tccttaaagacgaaggcagtggttc

SEQ ID NO: 494804 - DNA, 25 bp, Rattus norvegicus
tagagggcttccatttccttaaaga

SEQ ID NO: 494805 - DNA, 25 bp, Rattus norvegicus
tctggcccggaaagtagagggcttc

SEQ ID NO: 494806 - DNA, 25 bp, Rattus norvegicus
gcatccttttctggcccggaaagta

SEQ ID NO: 494807 - DNA, 25 bp, Rattus norvegicus
ctggcttactccgtcaaggtgagtg

SEQ ID NO: 494808 - DNA, 25 bp, Rattus norvegicus
gcgtgctggttaaagccacggctca

SEQ ID NO: 494809 - DNA, 25 bp, Rattus norvegicus
actccgtcaaggtgagtgaggagca

SEQ ID NO: 494810 - DNA, 25 bp, Rattus norvegicus
tggccgtcacgatctcactggctta

SEQ ID NO: 494811 - DNA, 25 bp, Rattus norvegicus
atctcactggcttactccgtcaagg

SEQ ID NO: 494812 - DNA, 25 bp, Rattus norvegicus
taaagccacggctcacccggggcat

SEQ ID NO: 494813 - DNA, 25 bp, Rattus norvegicus
ggggacaggcaacgttgacctctga

SEQ ID NO: 494814 - DNA, 25 bp, Rattus norvegicus
ctcgccgaagctgcgatgtcctctt

SEQ ID NO: 494815 - DNA, 25 bp, Rattus norvegicus
ctctcagccgggttatgatgcccgc

SEQ ID NO: 494816 - DNA, 25 bp, Rattus norvegicus
ctggggcaatgcctgagcctctcag

SEQ ID NO: 494817 - DNA, 25 bp, Rattus norvegicus
atcacctgggaggtttgaagggctt

SEQ ID NO: 494818 - DNA, 25 bp, Rattus norvegicus
ggctcatctggccacgcctggagcg

SEQ ID NO: 494819 - DNA, 25 bp, Rattus norvegicus
tgacctctgacctcgagagttcgaa

SEQ ID NO: 494820 - DNA, 25 bp, Rattus norvegicus
actgagcgagagttggctcccggac

SEQ ID NO: 494821 - DNA, 25 bp, Rattus norvegicus
tagtgaccgggaagcgcccgcactc

SEQ ID NO: 494822 - DNA, 25 bp, Rattus norvegicus
attgggccgccgttgttgtagtgac

SEQ ID NO: 494823 - DNA, 25 bp, Rattus norvegicus
atcgatcacgggctcacagccgctt

SEQ ID NO: 494824 - DNA, 25 bp, Rattus norvegicus
tcggagcacgaggacttcgctatgt

SEQ ID NO: 494825 - DNA, 25 bp, Rattus norvegicus
tccagattgcatcgatcacgggctc

SEQ ID NO: 494826 - DNA, 25 bp, Rattus norvegicus
ggcgccgtctctttaaggtgtaata

SEQ ID NO: 494827 - DNA, 25 bp, Rattus norvegicus
tgcccttgtgggctccatcagctcg

SEQ ID NO: 494828 - DNA, 25 bp, Rattus norvegicus
tgtgggctccatcagctcggtacct

SEQ ID NO: 494829 - DNA, 25 bp, Rattus norvegicus
ctctgccgcaggcaaggctgcgctc

SEQ ID NO: 494830 - DNA, 25 bp, Rattus norvegicus
tggcgtcggcccgacccgcctctgc

SEQ ID NO: 494831 - DNA, 25 bp, Rattus norvegicus
caggaggctctcgagccctggcgtc

SEQ ID NO: 494832 - DNA, 25 bp, Rattus norvegicus
ttttgcccgctccaggaggctctcg

SEQ ID NO: 494833 - DNA, 25 bp, Rattus norvegicus
cggcgcccactaggcctgcgggaca

SEQ ID NO: 494834 - DNA, 25 bp, Rattus norvegicus
cgatcacctcctcggcgcccactag

SEQ ID NO: 494835 - DNA, 25 bp, Rattus norvegicus
gctcccagccctgccgatcacctcc

SEQ ID NO: 494836 - DNA, 25 bp, Rattus norvegicus
cccaactagaggctcggctcccagc

SEQ ID NO: 494837 - DNA, 25 bp, Rattus norvegicus
agccagaacccagccgcctcccaac

SEQ ID NO: 494838 - DNA, 25 bp, Rattus norvegicus
gagtcccgaggcaggccctggtcct

SEQ ID NO: 494839 - DNA, 25 bp, Rattus norvegicus
gctcagagtcccgaggcaggccctg

SEQ ID NO: 494840 - DNA, 25 bp, Rattus norvegicus
tccatcagctcggtacctggggctc

SEQ ID NO: 494841 - DNA, 25 bp, Rattus norvegicus
gctcgtctctccaggctcgatgggt

SEQ ID NO: 494842 - DNA, 25 bp, Rattus norvegicus
cccaccggagcataagaaaagtgta

SEQ ID NO: 494843 - DNA, 25 bp, Rattus norvegicus
tagggctagctgacaaggtttttcc

SEQ ID NO: 494844 - DNA, 25 bp, Rattus norvegicus
tagtgccctggtttatgtgccctgc

SEQ ID NO: 494845 - DNA, 25 bp, Rattus norvegicus
gcaagatctccggagcaatggctca

SEQ ID NO: 494846 - DNA, 25 bp, Rattus norvegicus
taacacttcgttgggtcgctaaagc

SEQ ID NO: 494847 - DNA, 25 bp, Rattus norvegicus
cagcttgtttgcactggggcttatc

SEQ ID NO: 494848 - DNA, 25 bp, Rattus norvegicus
ggctggccgagagaatgtatccatt

SEQ ID NO: 494849 - DNA, 25 bp, Rattus norvegicus
gacgctggctgtttgtatccattga

SEQ ID NO: 494850 - DNA, 25 bp, Rattus norvegicus
atccattgaggagctgcctggcaca

SEQ ID NO: 494851 - DNA, 25 bp, Rattus norvegicus
agtcctagggactgcgagcaaaccc

SEQ ID NO: 494852 - DNA, 25 bp, Rattus norvegicus
cccagtcttgaataatccggcgaga

SEQ ID NO: 494853 - DNA, 25 bp, Rattus norvegicus
cagcctcggctaaaaggacttcaga

SEQ ID NO: 494854 - DNA, 25 bp, Rattus norvegicus
agacgcgaagtgtgaactctcaaca

SEQ ID NO: 494855 - DNA, 25 bp, Rattus norvegicus
ttaccttcccatcggtcctggcgta

SEQ ID NO: 494856 - DNA, 25 bp, Rattus norvegicus
tcccgggtagatcttgtacccacta

SEQ ID NO: 494857 - DNA, 25 bp, Rattus norvegicus
gtacccactaaaactgcacagctcg

SEQ ID NO: 494858 - DNA, 25 bp, Rattus norvegicus
actgcacagctcgaccctgtaagga

SEQ ID NO: 494859 - DNA, 25 bp, Rattus norvegicus
gctcgaccctgtaaggaaaagccga

SEQ ID NO: 494860 - DNA, 25 bp, Rattus norvegicus
aaagccgaagctcgttaggatctgc

SEQ ID NO: 494861 - DNA, 25 bp, Rattus norvegicus
gctcgttaggatctgcactgcaaaa

SEQ ID NO: 494862 - DNA, 25 bp, Rattus norvegicus
cccgggtgctctgcctcaggatgga

SEQ ID NO: 494863 - DNA, 25 bp, Rattus norvegicus
ctctgcctcaggatggaggcggatt

SEQ ID NO: 494864 - DNA, 25 bp, Rattus norvegicus
atcgggcgcccgcttacttcatggt

SEQ ID NO: 494865 - DNA, 25 bp, Rattus norvegicus
cccgcttacttcatggtgacagatg

SEQ ID NO: 494866 - DNA, 25 bp, Rattus norvegicus
tcatggtgacagatgtcggcctgcc

SEQ ID NO: 494867 - DNA, 25 bp, Rattus norvegicus
ttcgcgagacaccagaccgtccttt

SEQ ID NO: 494868 - DNA, 25 bp, Rattus norvegicus
aggccttcgcgagacaccagaccgt

SEQ ID NO: 494869 - DNA, 25 bp, Rattus norvegicus
ctgcgctcgagctacccaatgctgg

SEQ ID NO: 494870 - DNA, 25 bp, Rattus norvegicus
ggtgcctcatggactctggccagta

SEQ ID NO: 494871 - DNA, 25 bp, Rattus norvegicus
ctctgtataaaaagcgctggcggcg

SEQ ID NO: 494872 - DNA, 25 bp, Rattus norvegicus
cccgggcttcatttgctgtctgtca

SEQ ID NO: 494873 - DNA, 25 bp, Rattus norvegicus
ccagaacagctaaacggagtcgcca

SEQ ID NO: 494874 - DNA, 25 bp, Rattus norvegicus
gcagcgctgcctttccttatgaaga

SEQ ID NO: 494875 - DNA, 25 bp, Rattus norvegicus
agctcggaggctttccaagaaaatc

SEQ ID NO: 494876 - DNA, 25 bp, Rattus norvegicus
agcctgtggcaagtttgcagccgca

SEQ ID NO: 494877 - DNA, 25 bp, Rattus norvegicus
tcgggtagattatgaaacagcttcc

SEQ ID NO: 494878 - DNA, 25 bp, Rattus norvegicus
aggtctctccctgtggattcgggta

SEQ ID NO: 494879 - DNA, 25 bp, Rattus norvegicus
cgcagatgcaggcttccctcttcgg

SEQ ID NO: 494880 - DNA, 25 bp, Rattus norvegicus
gacgcaccaggctcgatcggtccaa

SEQ ID NO: 494881 - DNA, 25 bp, Rattus norvegicus
gccgctgctcgtgcaatatgctgga

SEQ ID NO: 494882 - DNA, 25 bp, Rattus norvegicus
ctgtcagtggcaaaccgcagatgca

SEQ ID NO: 494883 - DNA, 25 bp, Rattus norvegicus
gtagagtcctcttctcacggctttc

SEQ ID NO: 494884 - DNA, 25 bp, Rattus norvegicus
atgtagtcttccctggtatccgggg

SEQ ID NO: 494885 - DNA, 25 bp, Rattus norvegicus
acggctttccctcatccacagtgaa

SEQ ID NO: 494886 - DNA, 25 bp, Rattus norvegicus
gccgaactgcactctgggacgtaga

SEQ ID NO: 494887 - DNA, 25 bp, Rattus norvegicus
taatcccagtatgcacagccgcagc

SEQ ID NO: 494888 - DNA, 25 bp, Rattus norvegicus
gaacgcgctgctcttcccaaaactt

SEQ ID NO: 494889 - DNA, 25 bp, Rattus norvegicus
acagagcttccctaaaacgcaaatg

SEQ ID NO: 494890 - DNA, 25 bp, Rattus norvegicus
agcctctcgcattgcacgccgggaa

SEQ ID NO: 494891 - DNA, 25 bp, Rattus norvegicus
cgccgcttcggcttgtttgggaaga

SEQ ID NO: 494892 - DNA, 25 bp, Rattus norvegicus
ggactctgcagaaaacactgtcata

SEQ ID NO: 494893 - DNA, 25 bp, Rattus norvegicus
atggttcaggaaagcttcggagacg

SEQ ID NO: 494894 - DNA, 25 bp, Rattus norvegicus
cccagtcgtgaaatgtagtcttccc

SEQ ID NO: 494895 - DNA, 25 bp, Rattus norvegicus
cggctccgccaagagatggttcagg

SEQ ID NO: 494896 - DNA, 25 bp, Rattus norvegicus
acagctattggaagcgagaggccca

SEQ ID NO: 494897 - DNA, 25 bp, Rattus norvegicus
gcgcaacttgtctccactgagctgg

SEQ ID NO: 494898 - DNA, 25 bp, Rattus norvegicus
ctcgcttagctgaaggctcagcttt

SEQ ID NO: 494899 - DNA, 25 bp, Rattus norvegicus
attcatggtgcccacgcgcaacttg

SEQ ID NO: 494900 - DNA, 25 bp, Rattus norvegicus
ccgggtacctgatgctctcgcttag

SEQ ID NO: 494901 - DNA, 25 bp, Rattus norvegicus
cggaggaagtctgcagcaacaaaca

SEQ ID NO: 494902 - DNA, 25 bp, Rattus norvegicus
aaacagaatccaaacaccagccaga

SEQ ID NO: 494903 - DNA, 25 bp, Rattus norvegicus
accagccagaggatccaagcagcac

SEQ ID NO: 494904 - DNA, 25 bp, Rattus norvegicus
ggatccaagcagcaccgtcaaggtc

SEQ ID NO: 494905 - DNA, 25 bp, Rattus norvegicus
gcaccgtcaaggtccacccgggaga

SEQ ID NO: 494906 - DNA, 25 bp, Rattus norvegicus
actcaataccggaagcgaccgtcta

SEQ ID NO: 494907 - DNA, 25 bp, Rattus norvegicus
cgaccgtctagtcgcggtgcattct

SEQ ID NO: 494908 - DNA, 25 bp, Rattus norvegicus
tagtgcgatcgtgaggctacagagc

SEQ ID NO: 494909 - DNA, 25 bp, Rattus norvegicus
gctacagagcatgcgcctccacgtg

SEQ ID NO: 494910 - DNA, 25 bp, Rattus norvegicus
ctgcaccgagcccaagcgattcatg

SEQ ID NO: 494911 - DNA, 25 bp, Rattus norvegicus
gcgggctcttaagggcaaacttctc

SEQ ID NO: 494912 - DNA, 25 bp, Rattus norvegicus
gtcactgtttttactcggcgggctc

SEQ ID NO: 494913 - DNA, 25 bp, Rattus norvegicus
cgcgcctcctgtgcccatgtaaaag

SEQ ID NO: 494914 - DNA, 25 bp, Rattus norvegicus
agcgtctccataacgtgctccaacg

SEQ ID NO: 494915 - DNA, 25 bp, Rattus norvegicus
ggactcattgtccagcgtctccata

SEQ ID NO: 494916 - DNA, 25 bp, Rattus norvegicus
gccagccgtcgctttgccataaaag

SEQ ID NO: 494917 - DNA, 25 bp, Rattus norvegicus
cgaaggcctgcacgcatttgccagc

SEQ ID NO: 494918 - DNA, 25 bp, Rattus norvegicus
tcgctcagaaactccataatcctgg

SEQ ID NO: 494919 - DNA, 25 bp, Rattus norvegicus
aacttaccgctgctgtcctgacagg

SEQ ID NO: 494920 - DNA, 25 bp, Rattus norvegicus
tcaggcaggatttagctccggaccc

SEQ ID NO: 494921 - DNA, 25 bp, Rattus norvegicus
tggactctatccgaaagcgaaatgg

SEQ ID NO: 494922 - DNA, 25 bp, Rattus norvegicus
cggagccttcttgtccagttgtgga

SEQ ID NO: 494923 - DNA, 25 bp, Rattus norvegicus
agcggaggcgcggtattttaactca

SEQ ID NO: 494924 - DNA, 25 bp, Rattus norvegicus
tgacctatttcgagccctgttaacc

SEQ ID NO: 494925 - DNA, 25 bp, Rattus norvegicus
tggctataggtgttacggtttccgc

SEQ ID NO: 494926 - DNA, 25 bp, Rattus norvegicus
tccgcgtcgtctaaaccttcaggtg

SEQ ID NO: 494927 - DNA, 25 bp, Rattus norvegicus
cttcaggtgcagatacctgtccgca

SEQ ID NO: 494928 - DNA, 25 bp, Rattus norvegicus
cttcaacctgacagaaagcagtgct

SEQ ID NO: 494929 - DNA, 25 bp, Rattus norvegicus
gcagtgctagatccaccgatgaacc

SEQ ID NO: 494930 - DNA, 25 bp, Rattus norvegicus
tacctgtcatcgtagcagaaatccg

SEQ ID NO: 494931 - DNA, 25 bp, Rattus norvegicus
tccgcactcagggtgttgagataca

SEQ ID NO: 494932 - DNA, 25 bp, Rattus norvegicus
gagcgctgctcaccaactctgcaat

SEQ ID NO: 494933 - DNA, 25 bp, Rattus norvegicus
cattgccggacaaccgcgagaggca

SEQ ID NO: 494934 - DNA, 25 bp, Rattus norvegicus
atggcactttgggacaccctaggta

SEQ ID NO: 494935 - DNA, 25 bp, Rattus norvegicus
acgactccggggtcgttcgcagcaa

SEQ ID NO: 494936 - DNA, 25 bp, Rattus norvegicus
ggctgcggcacattcactctttatt

SEQ ID NO: 494937 - DNA, 25 bp, Rattus norvegicus
tccagtgaagtgagaagcggcgact

SEQ ID NO: 494938 - DNA, 25 bp, Rattus norvegicus
ggcgactggggactccaaaagctcc

SEQ ID NO: 494939 - DNA, 25 bp, Rattus norvegicus
tgacgtattttgtcggcgtccactg

SEQ ID NO: 494940 - DNA, 25 bp, Rattus norvegicus
gctcttgccagatcgacttggtgta

SEQ ID NO: 494941 - DNA, 25 bp, Rattus norvegicus
actgtatgcgcactggaaatggcca

SEQ ID NO: 494942 - DNA, 25 bp, Rattus norvegicus
tcgagctccgagcatgcgctagttt

SEQ ID NO: 494943 - DNA, 25 bp, Rattus norvegicus
ctgtagttctactaacccggtggtg

SEQ ID NO: 494944 - DNA, 25 bp, Rattus norvegicus
agggactcctcaggtcagattcgga

SEQ ID NO: 494945 - DNA, 25 bp, Rattus norvegicus
cgcgagggtacgtaagaagacagcc

SEQ ID NO: 494946 - DNA, 25 bp, Rattus norvegicus
ccctcggaatcctaggtgcacgatg

SEQ ID NO: 494947 - DNA, 25 bp, Rattus norvegicus
cttaagatcggggtagccattccta

SEQ ID NO: 494948 - DNA, 25 bp, Rattus norvegicus
cgagagcttctcagtcctttgcatg

SEQ ID NO: 494949 - DNA, 25 bp, Rattus norvegicus
gaaccggacggtgctgtcaacttga

SEQ ID NO: 494950 - DNA, 25 bp, Rattus norvegicus
gcagctctttagtttaagcggaagc

SEQ ID NO: 494951 - DNA, 25 bp, Rattus norvegicus
ccagcaagccttcctagggagcgtg

SEQ ID NO: 494952 - DNA, 25 bp, Rattus norvegicus
caagtcctgtaacgtggcgtgcagc

SEQ ID NO: 494953 - DNA, 25 bp, Rattus norvegicus
acattgacagtggtccagccgctta

SEQ ID NO: 494954 - DNA, 25 bp, Rattus norvegicus
tccctgcgctggaaacgaggggtct

SEQ ID NO: 494955 - DNA, 25 bp, Rattus norvegicus
agtggggaagccaactgccaactgc

SEQ ID NO: 494956 - DNA, 25 bp, Rattus norvegicus
agctaacgctgctaagggaccagtg

SEQ ID NO: 494957 - DNA, 25 bp, Rattus norvegicus
tgggcacagaaagcccttccagcta

SEQ ID NO: 494958 - DNA, 25 bp, Rattus norvegicus
cgatgcttcagctgccagtctcagt

SEQ ID NO: 494959 - DNA, 25 bp, Rattus norvegicus
gtgcttgccagagctcgatgcttca

SEQ ID NO: 494960 - DNA, 25 bp, Rattus norvegicus
ttcgcgcccagaacaggacactttc

SEQ ID NO: 494961 - DNA, 25 bp, Rattus norvegicus
tctgcccagtcccacagggaaggca

SEQ ID NO: 494962 - DNA, 25 bp, Rattus norvegicus
tcggggacatcgcatccaagagccc

SEQ ID NO: 494963 - DNA, 25 bp, Rattus norvegicus
tcccacggcagacatggcgacattg

SEQ ID NO: 494964 - DNA, 25 bp, Rattus norvegicus
ggtttcgccttccattctgcccagt

SEQ ID NO: 494965 - DNA, 25 bp, Rattus norvegicus
aggccacacagtccgcacggtttcg

SEQ ID NO: 494966 - DNA, 25 bp, Rattus norvegicus
cagccgcttactctggacagaggta

SEQ ID NO: 494967 - DNA, 25 bp, Rattus norvegicus
ccaagcacctaatgcgcgacctgtg

SEQ ID NO: 494968 - DNA, 25 bp, Rattus norvegicus
ggcgccgacatcaattacgccaatg

SEQ ID NO: 494969 - DNA, 25 bp, Rattus norvegicus
cggacgaggttctcaagctgctgca

SEQ ID NO: 494970 - DNA, 25 bp, Rattus norvegicus
aagttcgacgatggcgccgtcttcc

SEQ ID NO: 494971 - DNA, 25 bp, Rattus norvegicus
gcgccagaagaccaaggtgaagttc

SEQ ID NO: 494972 - DNA, 25 bp, Rattus norvegicus
agcctcccgtggtgaagcgccagaa

SEQ ID NO: 494973 - DNA, 25 bp, Rattus norvegicus
atcggctccgagacggacctcgagc

SEQ ID NO: 494974 - DNA, 25 bp, Rattus norvegicus
gcagctgaagcgctggatcggctcc

SEQ ID NO: 494975 - DNA, 25 bp, Rattus norvegicus
ctcgcgataagaagagccggcggca

SEQ ID NO: 494976 - DNA, 25 bp, Rattus norvegicus
actggaagtctcgagcgtctcctcc

SEQ ID NO: 494977 - DNA, 25 bp, Rattus norvegicus
tgctctgtgggatactggaagtctc

SEQ ID NO: 494978 - DNA, 25 bp, Rattus norvegicus
ccgcgatctcgcgaagttacgctca

SEQ ID NO: 494979 - DNA, 25 bp, Rattus norvegicus
tacgccaatgtggacggactcaccg

SEQ ID NO: 494980 - DNA, 25 bp, Rattus norvegicus
tcacgcagccaataggaaaaccctc

SEQ ID NO: 494981 - DNA, 25 bp, Rattus norvegicus
aagccgatcgctgctccgcagtcgt

SEQ ID NO: 494982 - DNA, 25 bp, Rattus norvegicus
atctcattctcgcttcccaggcagg

SEQ ID NO: 494983 - DNA, 25 bp, Rattus norvegicus
aggacgagtgtcctattgccgctgg

SEQ ID NO: 494984 - DNA, 25 bp, Rattus norvegicus
agcgcgagaagatgcgcgccaagca

SEQ ID NO: 494985 - DNA, 25 bp, Rattus norvegicus
acttcctggaggagtggaaagcgaa

SEQ ID NO: 494986 - DNA, 25 bp, Rattus norvegicus
gcggcagcaccacggacttcctgga

SEQ ID NO: 494987 - DNA, 25 bp, Rattus norvegicus
ccctctgggaacatggcgaccggcg

SEQ ID NO: 494988 - DNA, 25 bp, Rattus norvegicus
gctccgcagtcgtccggggacctga

SEQ ID NO: 494989 - DNA, 25 bp, Rattus norvegicus
cgccaggaaaggcaaagggcagatc

SEQ ID NO: 494990 - DNA, 25 bp, Rattus norvegicus
agccctgcgaacttggcgcctggga

SEQ ID NO: 494991 - DNA, 25 bp, Rattus norvegicus
cactgcggaggtgagccctgcgaac

SEQ ID NO: 494992 - DNA, 25 bp, Rattus norvegicus
ccatgtcccgtctcggaatggaggc

SEQ ID NO: 494993 - DNA, 25 bp, Rattus norvegicus
ttctcggaggtaaggggctcatccg

SEQ ID NO: 494994 - DNA, 25 bp, Rattus norvegicus
tgcttccttgcagagcgtctgtccg

SEQ ID NO: 494995 - DNA, 25 bp, Rattus norvegicus
agcacggcagccctagctcgggatg

SEQ ID NO: 494996 - DNA, 25 bp, Rattus norvegicus
tccttccgattggttcacgtcacga

SEQ ID NO: 494997 - DNA, 25 bp, Rattus norvegicus
ttcacgtcacgagggcggaccggac

SEQ ID NO: 494998 - DNA, 25 bp, Rattus norvegicus
acttgaaacaatgttgccgcctccc

SEQ ID NO: 494999 - DNA, 25 bp, Rattus norvegicus
agctcagctcttgacaatttgtcca

SEQ ID NO: 495000 - DNA, 25 bp, Rattus norvegicus
tggaacgcaagcagagctcagctct

SEQ ID NO: 495001 - DNA, 25 bp, Rattus norvegicus
gccctagctcgggatggaacgcaag

SEQ ID NO: 495002 - DNA, 25 bp, Rattus norvegicus
gttctccatggagcgctagtgaggc

SEQ ID NO: 495003 - DNA, 25 bp, Rattus norvegicus
ctccaccttttggaagttctccatg

SEQ ID NO: 495004 - DNA, 25 bp, Rattus norvegicus
ggctttgtacaccactccgtacgtg

SEQ ID NO: 495005 - DNA, 25 bp, Rattus norvegicus
agccggattttcttaagcgccacaa

SEQ ID NO: 495006 - DNA, 25 bp, Rattus norvegicus
gccactcacgtgtcgagccggattt

SEQ ID NO: 495007 - DNA, 25 bp, Rattus norvegicus
ggacagtctcctccgggagagcgtc

SEQ ID NO: 495008 - DNA, 25 bp, Rattus norvegicus
gagttccggcttcggaggccactca

SEQ ID NO: 495009 - DNA, 25 bp, Rattus norvegicus
caggaagcagggaaagaacggcctg

SEQ ID NO: 495010 - DNA, 25 bp, Rattus norvegicus
agctgcagagccctgtgtgtgccgc

SEQ ID NO: 495011 - DNA, 25 bp, Rattus norvegicus
agagccctgtgtgtgccgcgcagac

SEQ ID NO: 495012 - DNA, 25 bp, Rattus norvegicus
gtgtgtgccgcgcagaccctgcgtc

SEQ ID NO: 495013 - DNA, 25 bp, Rattus norvegicus
cgcagaccctgcgtccctaacgtcc

SEQ ID NO: 495014 - DNA, 25 bp, Rattus norvegicus
accggagacctggtgagtgcgaggt

SEQ ID NO: 495015 - DNA, 25 bp, Rattus norvegicus
cgagcggttagcgagaccggagacc

SEQ ID NO: 495016 - DNA, 25 bp, Rattus norvegicus
tccacatcccataggagggcgagcg

SEQ ID NO: 495017 - DNA, 25 bp, Rattus norvegicus
gcgtccacatcccataggagggcga

SEQ ID NO: 495018 - DNA, 25 bp, Rattus norvegicus
ccgagcgtccacatcccataggagg

SEQ ID NO: 495019 - DNA, 25 bp, Rattus norvegicus
gaggccagcgatccgagcgtccaca

SEQ ID NO: 495020 - DNA, 25 bp, Rattus norvegicus
tgaggcgccgtagcgcggtcaggaa

SEQ ID NO: 495021 - DNA, 25 bp, Rattus norvegicus
tcgagcgcctggcagctgcagagcc

SEQ ID NO: 495022 - DNA, 25 bp, Rattus norvegicus
gatccgagcgtccacatcccatagg

SEQ ID NO: 495023 - DNA, 25 bp, Rattus norvegicus
gggccgccgaaatcctcaggtttgc

SEQ ID NO: 495024 - DNA, 25 bp, Rattus norvegicus
tcttagggaggacgcgagcaaagca

SEQ ID NO: 495025 - DNA, 25 bp, Rattus norvegicus
aatcgtcttagggaggacgcgagca

SEQ ID NO: 495026 - DNA, 25 bp, Rattus norvegicus
tcgggttactatggaaatcgtctta

SEQ ID NO: 495027 - DNA, 25 bp, Rattus norvegicus
cctgagccacttgatcgggttacta

SEQ ID NO: 495028 - DNA, 25 bp, Rattus norvegicus
tcaggtttgcggtcctgagccactt

SEQ ID NO: 495029 - DNA, 25 bp, Rattus norvegicus
ttacctggccgaggtcaacgccggc

SEQ ID NO: 495030 - DNA, 25 bp, Rattus norvegicus
cgcagcgttacctggccgaggtcaa

SEQ ID NO: 495031 - DNA, 25 bp, Rattus norvegicus
cgaagaggagaagatcgcagcgtta

SEQ ID NO: 495032 - DNA, 25 bp, Rattus norvegicus
agtggcgctgtttcccagccgcgca

SEQ ID NO: 495033 - DNA, 25 bp, Rattus norvegicus
ccgcgcagctgggatttaaagagac

SEQ ID NO: 495034 - DNA, 25 bp, Rattus norvegicus
agccgaagcgcgagctcgcagcagc

SEQ ID NO: 495035 - DNA, 25 bp, Rattus norvegicus
agacagacgcgtcgccgggctctag

SEQ ID NO: 495036 - DNA, 25 bp, Rattus norvegicus
tgggatttaaagagacagacgcgtc

SEQ ID NO: 495037 - DNA, 25 bp, Rattus norvegicus
agcggagggtctgcgaactttgccc

SEQ ID NO: 495038 - DNA, 25 bp, Rattus norvegicus
tctgctcgcagtccaggtgctaacc

SEQ ID NO: 495039 - DNA, 25 bp, Rattus norvegicus
tgctaaccagggttcacgtgtcacc

SEQ ID NO: 495040 - DNA, 25 bp, Rattus norvegicus
gagccgccctggcaggtccaggcaa

SEQ ID NO: 495041 - DNA, 25 bp, Rattus norvegicus
ccgctcccgcaggttgctggggaca

SEQ ID NO: 495042 - DNA, 25 bp, Rattus norvegicus
cgccgctcattggtgaatgctcaaa

SEQ ID NO: 495043 - DNA, 25 bp, Rattus norvegicus
tgctcaaattcagtctcaaggcgcc

SEQ ID NO: 495044 - DNA, 25 bp, Rattus norvegicus
gatcccgggctggagcttgtcttag

SEQ ID NO: 495045 - DNA, 25 bp, Rattus norvegicus
agatagcctccatcgcgctgcggca

SEQ ID NO: 495046 - DNA, 25 bp, Rattus norvegicus
aaacgctgtcgctaccacgggtgga

SEQ ID NO: 495047 - DNA, 25 bp, Rattus norvegicus
gaactttgccctgtcctgcccatgt

SEQ ID NO: 495048 - DNA, 25 bp, Rattus norvegicus
gagatctacacggtctgccggcgca

SEQ ID NO: 495049 - DNA, 25 bp, Rattus norvegicus
gccagtcggccgctgagatctacac

SEQ ID NO: 495050 - DNA, 25 bp, Rattus norvegicus
tcttaggcgggtaggaaacgctgtc

SEQ ID NO: 495051 - DNA, 25 bp, Rattus norvegicus
gtgagtcctaggaagcctgccgccc

SEQ ID NO: 495052 - DNA, 25 bp, Rattus norvegicus
cggccctgagtgctcgggaagctcc

SEQ ID NO: 495053 - DNA, 25 bp, Rattus norvegicus
tccggtcttttgtctcggggccaga

SEQ ID NO: 495054 - DNA, 25 bp, Rattus norvegicus
tcagaacccgcagcaggagcctagc

SEQ ID NO: 495055 - DNA, 25 bp, Rattus norvegicus
gcaggagcctagctcagcgcgccga

SEQ ID NO: 495056 - DNA, 25 bp, Rattus norvegicus
gcgccgagcggagaccttccgacaa

SEQ ID NO: 495057 - DNA, 25 bp, Rattus norvegicus
tccgacaacccgaggggcgtgccaa

SEQ ID NO: 495058 - DNA, 25 bp, Rattus norvegicus
cgtgccaagagataggcgtggctaa

SEQ ID NO: 495059 - DNA, 25 bp, Rattus norvegicus
gcgtggctaacgaggccacgcccaa

SEQ ID NO: 495060 - DNA, 25 bp, Rattus norvegicus
ctcccactcgggtgagtcctaggaa

SEQ ID NO: 495061 - DNA, 25 bp, Rattus norvegicus
ggaggctaatagatgacgtttgcgc

SEQ ID NO: 495062 - DNA, 25 bp, Rattus norvegicus
tgacgtttgcgccacagagagtggc

SEQ ID NO: 495063 - DNA, 25 bp, Rattus norvegicus
atagatgacgtttgcgccacagaga

SEQ ID NO: 495064 - DNA, 25 bp, Rattus norvegicus
cgcggctttcctctgtctagacctc

SEQ ID NO: 495065 - DNA, 25 bp, Rattus norvegicus
tgcaccgtctcctgggctaaaacac

SEQ ID NO: 495066 - DNA, 25 bp, Rattus norvegicus
gcttccaccgctgctgctttctgtg

SEQ ID NO: 495067 - DNA, 25 bp, Rattus norvegicus
ccacgctgaagaggtgcagtgtgat

SEQ ID NO: 495068 - DNA, 25 bp, Rattus norvegicus
ccgtgtaccacgctgaagaggtgca

SEQ ID NO: 495069 - DNA, 25 bp, Rattus norvegicus
ggagaaccgtgtaccacgctgaaga

SEQ ID NO: 495070 - DNA, 25 bp, Rattus norvegicus
ggcctgcgggagaaccgtgtaccac

SEQ ID NO: 495071 - DNA, 25 bp, Rattus norvegicus
gttccgcagaatgcctgtctggggc

SEQ ID NO: 495072 - DNA, 25 bp, Rattus norvegicus
ctttgttccgcagaatgcctgtctg

SEQ ID NO: 495073 - DNA, 25 bp, Rattus norvegicus
ggagaagctcgaactgcaccgtctc

SEQ ID NO: 495074 - DNA, 25 bp, Rattus norvegicus
aatgcatcctttgttccgcagaatg

SEQ ID NO: 495075 - DNA, 25 bp, Rattus norvegicus
gcctcctaatgcatcctttgttccg

SEQ ID NO: 495076 - DNA, 25 bp, Rattus norvegicus
cgaactgcaccgtctcctgggctaa

SEQ ID NO: 495077 - DNA, 25 bp, Rattus norvegicus
aactcgtaaaacaagcctcctaatg

SEQ ID NO: 495078 - DNA, 25 bp, Rattus norvegicus
ttctgtgcagtgagtaccgcccctc

SEQ ID NO: 495079 - DNA, 25 bp, Rattus norvegicus
ctgctccggctaccagggcaaggct

SEQ ID NO: 495080 - DNA, 25 bp, Rattus norvegicus
gagaccaaggatgcgttctcgcctc

SEQ ID NO: 495081 - DNA, 25 bp, Rattus norvegicus
ccgcaggcaacgcagcaacaaaaca

SEQ ID NO: 495082 - DNA, 25 bp, Rattus norvegicus
tcgggcctggactcgcttcttcagc

SEQ ID NO: 495083 - DNA, 25 bp, Rattus norvegicus
gcggtccctcacctccgggtggaga

SEQ ID NO: 495084 - DNA, 25 bp, Rattus norvegicus
tggagaaggggcacacagcccgttt

SEQ ID NO: 495085 - DNA, 25 bp, Rattus norvegicus
agcccgtttcggtatcgtactcatc

SEQ ID NO: 495086 - DNA, 25 bp, Rattus norvegicus
ggtatcgtactcatccgggccgtcc

SEQ ID NO: 495087 - DNA, 25 bp, Rattus norvegicus
cgtccgccatcttggtgttaaatcc

SEQ ID NO: 495088 - DNA, 25 bp, Rattus norvegicus
gaaagcgtttcagcctcgcggggct

SEQ ID NO: 495089 - DNA, 25 bp, Rattus norvegicus
agcgggagtgtgctctctgctgcac

SEQ ID NO: 495090 - DNA, 25 bp, Rattus norvegicus
cccggtcggaagcagatgctgctct

SEQ ID NO: 495091 - DNA, 25 bp, Rattus norvegicus
atcccgcgccgcatagggcagggtc

SEQ ID NO: 495092 - DNA, 25 bp, Rattus norvegicus
tgcgctcgggtcagcaccgagatcc

SEQ ID NO: 495093 - DNA, 25 bp, Rattus norvegicus
ccgcgcaggggttgaaaacctatcg

SEQ ID NO: 495094 - DNA, 25 bp, Rattus norvegicus
agcacgacgagctgccagcagtttc

SEQ ID NO: 495095 - DNA, 25 bp, Rattus norvegicus
tcctgaagtttgacagggctacgcc

SEQ ID NO: 495096 - DNA, 25 bp, Rattus norvegicus
agcgagttcctctcctgcctttgtc

SEQ ID NO: 495097 - DNA, 25 bp, Rattus norvegicus
cctttggggtgactgtagtccctca

SEQ ID NO: 495098 - DNA, 25 bp, Rattus norvegicus
tccgcatcggtgagtggcactcagt

SEQ ID NO: 495099 - DNA, 25 bp, Rattus norvegicus
actgtgatcccgttgaagcctgctg

SEQ ID NO: 495100 - DNA, 25 bp, Rattus norvegicus
tcagggtggatgacagcattctgct

SEQ ID NO: 495101 - DNA, 25 bp, Rattus norvegicus
ccggattccggcgtcactgtgatcc

SEQ ID NO: 495102 - DNA, 25 bp, Rattus norvegicus
cagttaccgccgtgactgggaccga

SEQ ID NO: 495103 - DNA, 25 bp, Rattus norvegicus
tagactgtgccctccatcgggctgg

SEQ ID NO: 495104 - DNA, 25 bp, Rattus norvegicus
agttctctcgttgctccgggccgag

SEQ ID NO: 495105 - DNA, 25 bp, Rattus norvegicus
gcattctgctgcgacgcgctctcag

SEQ ID NO: 495106 - DNA, 25 bp, Rattus norvegicus
ggctctctacctcaggggttcctga

SEQ ID NO: 495107 - DNA, 25 bp, Rattus norvegicus
gagcatcccttagccaggtacctcg

SEQ ID NO: 495108 - DNA, 25 bp, Rattus norvegicus
gctactgcacttccgcctttctcta

SEQ ID NO: 495109 - DNA, 25 bp, Rattus norvegicus
ctaaagaagtatttacccacagctc

SEQ ID NO: 495110 - DNA, 25 bp, Rattus norvegicus
ctccatcggtcctgaccttctaaag

SEQ ID NO: 495111 - DNA, 25 bp, Rattus norvegicus
agctccgtttccatggcgtcccagg

SEQ ID NO: 495112 - DNA, 25 bp, Rattus norvegicus
cccaggggtctgtgacagcggcact

SEQ ID NO: 495113 - DNA, 25 bp, Rattus norvegicus
ctgaggtgctggaaaccatcgcgaa

SEQ ID NO: 495114 - DNA, 25 bp, Rattus norvegicus
aaaccatcgcgaaccgctgcgtggg

SEQ ID NO: 495115 - DNA, 25 bp, Rattus norvegicus
gcctggtgttgtgtacgaagcccac

SEQ ID NO: 495116 - DNA, 25 bp, Rattus norvegicus
gttgtgtacgaagcccaccggcgag

SEQ ID NO: 495117 - DNA, 25 bp, Rattus norvegicus
cccaccggcgaggtgctgcttagca

SEQ ID NO: 495118 - DNA, 25 bp, Rattus norvegicus
ttagcagggatggaggttgcctcct

SEQ ID NO: 495119 - DNA, 25 bp, Rattus norvegicus
ttgcctcctggaggcgctgcactta

SEQ ID NO: 495120 - DNA, 25 bp, Rattus norvegicus
cgctgcacttagagcatcccttagc

SEQ ID NO: 495121 - DNA, 25 bp, Rattus norvegicus
atatgagcgcgagccgcgggctctc

SEQ ID NO: 495122 - DNA, 25 bp, Rattus norvegicus
agcctcctggaacggtaacggctgg

SEQ ID NO: 495123 - DNA, 25 bp, Rattus norvegicus
gcgtccgagcctcctggaacggtaa

SEQ ID NO: 495124 - DNA, 25 bp, Rattus norvegicus
tgagtcactgcctgcgcagctccgg

SEQ ID NO: 495125 - DNA, 25 bp, Rattus norvegicus
tttttagcgccatctgctcgcggcg

SEQ ID NO: 495126 - DNA, 25 bp, Rattus norvegicus
ggctctcgggtcttttttagcgcca

SEQ ID NO: 495127 - DNA, 25 bp, Rattus norvegicus
ctaattgtatatgagcgcgagccgc

SEQ ID NO: 495128 - DNA, 25 bp, Rattus norvegicus
cctacgtgctgacgctaattgtata

SEQ ID NO: 495129 - DNA, 25 bp, Rattus norvegicus
gagcagccctacgtgctgacgctaa

SEQ ID NO: 495130 - DNA, 25 bp, Rattus norvegicus
gttgctaagcaacgccgaggccagg

SEQ ID NO: 495131 - DNA, 25 bp, Rattus norvegicus
tgttaccaggcaacaaggcccaggc

SEQ ID NO: 495132 - DNA, 25 bp, Rattus norvegicus
aagaaagacggctctgttaccaggc

SEQ ID NO: 495133 - DNA, 25 bp, Rattus norvegicus
cctctggcgggaagcctaaggagcc

SEQ ID NO: 495134 - DNA, 25 bp, Rattus norvegicus
tcgggtcttttttagcgccatctgc

SEQ ID NO: 495135 - DNA, 25 bp, Rattus norvegicus
atcttgtggcgggtcaggactcgcc

SEQ ID NO: 495136 - DNA, 25 bp, Rattus norvegicus
agcctaaaggccgagcggagcagca

SEQ ID NO: 495137 - DNA, 25 bp, Rattus norvegicus
cagccggagcgtctggaagcctaaa

SEQ ID NO: 495138 - DNA, 25 bp, Rattus norvegicus
gacagcgcacggctgctactgctac

SEQ ID NO: 495139 - DNA, 25 bp, Rattus norvegicus
cccaagttaatgaggcgtacgccgg

SEQ ID NO: 495140 - DNA, 25 bp, Rattus norvegicus
gcccttcagtgagcgctccgcggaa

SEQ ID NO: 495141 - DNA, 25 bp, Rattus norvegicus
agagtttccggagcccggcttccag

SEQ ID NO: 495142 - DNA, 25 bp, Rattus norvegicus
gctctgtctcctgcgagtcagcctt

SEQ ID NO: 495143 - DNA, 25 bp, Rattus norvegicus
gagtcagccttctctgtgcgctccg

SEQ ID NO: 495144 - DNA, 25 bp, Rattus norvegicus
ggtggcccattgaaaagcgctgcga

SEQ ID NO: 495145 - DNA, 25 bp, Rattus norvegicus
ccaggagccgccttttccgctgggt

SEQ ID NO: 495146 - DNA, 25 bp, Rattus norvegicus
tttcggcgccctctgggcgtcggca

SEQ ID NO: 495147 - DNA, 25 bp, Rattus norvegicus
tggagccgccaagagtttccggagc

SEQ ID NO: 495148 - DNA, 25 bp, Rattus norvegicus
agcggagagcccacccgcctgggaa

SEQ ID NO: 495149 - DNA, 25 bp, Rattus norvegicus
tgtagacacgcctgccaaagaagct

SEQ ID NO: 495150 - DNA, 25 bp, Rattus norvegicus
ccggatcatgcggaactcattttgc

SEQ ID NO: 495151 - DNA, 25 bp, Rattus norvegicus
ctcattttgcgttagagacgctgta

SEQ ID NO: 495152 - DNA, 25 bp, Rattus norvegicus
ggacagttccacttccggtagcacc

SEQ ID NO: 495153 - DNA, 25 bp, Rattus norvegicus
cggtagcaccggaagcaattttaag

SEQ ID NO: 495154 - DNA, 25 bp, Rattus norvegicus
gcgcagattttgtccggatcatgcg

SEQ ID NO: 495155 - DNA, 25 bp, Rattus norvegicus
aagatggcaacttctgtagacacgc

SEQ ID NO: 495156 - DNA, 25 bp, Rattus norvegicus
cctgccaaagaagctcgaaaaagtg

SEQ ID NO: 495157 - DNA, 25 bp, Rattus norvegicus
cgaaaaagtgactctcggcagcaga

SEQ ID NO: 495158 - DNA, 25 bp, Rattus norvegicus
tgactctcggcagcagaaacagaag

SEQ ID NO: 495159 - DNA, 25 bp, Rattus norvegicus
aacagaagcgtgagaaccaaggtga

SEQ ID NO: 495160 - DNA, 25 bp, Rattus norvegicus
ggggacttcgaagcatcgcttttcc

SEQ ID NO: 495161 - DNA, 25 bp, Rattus norvegicus
gaagcatcgcttttccttctttggc

SEQ ID NO: 495162 - DNA, 25 bp, Rattus norvegicus
ccggaagcaattttaagatggcaac

SEQ ID NO: 495163 - DNA, 25 bp, Rattus norvegicus
aaccagtgatccgtgctcaccgtgc

SEQ ID NO: 495164 - DNA, 25 bp, Rattus norvegicus
agtgcctcctggtaactcgccgact

SEQ ID NO: 495165 - DNA, 25 bp, Rattus norvegicus
agcagctctgcgttgcgggaagcaa

SEQ ID NO: 495166 - DNA, 25 bp, Rattus norvegicus
tcattagcctcgtgcttggcctggc

SEQ ID NO: 495167 - DNA, 25 bp, Rattus norvegicus
cagttggcggcgatagtcattagcc

SEQ ID NO: 495168 - DNA, 25 bp, Rattus norvegicus
accgtgccgcgcaaggactcaaggt

SEQ ID NO: 495169 - DNA, 25 bp, Rattus norvegicus
ctgatctcttccgtgttcgcctatg

SEQ ID NO: 495170 - DNA, 25 bp, Rattus norvegicus
ttgagaaacttcgaggctgcaaccc

SEQ ID NO: 495171 - DNA, 25 bp, Rattus norvegicus
cttggccgggagattttgagaaact

SEQ ID NO: 495172 - DNA, 25 bp, Rattus norvegicus
tctgcgggatggaactgatcacttg

SEQ ID NO: 495173 - DNA, 25 bp, Rattus norvegicus
ctccaaggactcgttctgcgggatg

SEQ ID NO: 495174 - DNA, 25 bp, Rattus norvegicus
gttcgcgcatttgcctctccaagga

SEQ ID NO: 495175 - DNA, 25 bp, Rattus norvegicus
ggcgctcctcctgttcgcgcatttg

SEQ ID NO: 495176 - DNA, 25 bp, Rattus norvegicus
gactcaaggtcgcaggtcaaggcct

SEQ ID NO: 495177 - DNA, 25 bp, Rattus norvegicus
gagcacctccgactaccaaactttg

SEQ ID NO: 495178 - DNA, 25 bp, Rattus norvegicus
ggccgacgtagtcaccacggttcca

SEQ ID NO: 495179 - DNA, 25 bp, Rattus norvegicus
ctgggactggatgctagcagaacac

SEQ ID NO: 495180 - DNA, 25 bp, Rattus norvegicus
ctagcagaacacagtggcaggcgcg

SEQ ID NO: 495181 - DNA, 25 bp, Rattus norvegicus
cgcggttagcataacggtccgaatc

SEQ ID NO: 495182 - DNA, 25 bp, Rattus norvegicus
gagccggagccgaagttttcttctc

SEQ ID NO: 495183 - DNA, 25 bp, Rattus norvegicus
tctaactttgcagaaggcatctggc

SEQ ID NO: 495184 - DNA, 25 bp, Rattus norvegicus
tggcagggccaagccacccttcaga

SEQ ID NO: 495185 - DNA, 25 bp, Rattus norvegicus
gctcagcgtcctaagagccgctctg

SEQ ID NO: 495186 - DNA, 25 bp, Rattus norvegicus
cggggctcgccctaagctctgagca

SEQ ID NO: 495187 - DNA, 25 bp, Rattus norvegicus
acccgggttccagccagtgctcggg

SEQ ID NO: 495188 - DNA, 25 bp, Rattus norvegicus
gagcctcagagtctgcctgcgtcga

SEQ ID NO: 495189 - DNA, 25 bp, Rattus norvegicus
taagagccgctctgctgccgagcct

SEQ ID NO: 495190 - DNA, 25 bp, Rattus norvegicus
acggtcctcgcacccaattcagtga

SEQ ID NO: 495191 - DNA, 25 bp, Rattus norvegicus
tactgcgtgaatcgatgactacgtg

SEQ ID NO: 495192 - DNA, 25 bp, Rattus norvegicus
gcccttcgttgctatgcagcagttt

SEQ ID NO: 495193 - DNA, 25 bp, Rattus norvegicus
tgcagcagtttggttgttctccgtc

SEQ ID NO: 495194 - DNA, 25 bp, Rattus norvegicus
ttgttctccgtctcggccgtgaatg

SEQ ID NO: 495195 - DNA, 25 bp, Rattus norvegicus
tccgtctcggccgtgaatgtaaagc

SEQ ID NO: 495196 - DNA, 25 bp, Rattus norvegicus
gccgtgaatgtaaagccgtgaatgc

SEQ ID NO: 495197 - DNA, 25 bp, Rattus norvegicus
gccgtgaatgcaagcacacagactg

SEQ ID NO: 495198 - DNA, 25 bp, Rattus norvegicus
tgcaagcacacagactgcatttctg

SEQ ID NO: 495199 - DNA, 25 bp, Rattus norvegicus
agactgcatttctgtccagcactgc

SEQ ID NO: 495200 - DNA, 25 bp, Rattus norvegicus
gatggctgtgcctgctccttaagca

SEQ ID NO: 495201 - DNA, 25 bp, Rattus norvegicus
gctccttaagcacttactgcgtgaa

SEQ ID NO: 495202 - DNA, 25 bp, Rattus norvegicus
atgactacgtgagcttttgtgaccg

SEQ ID NO: 495203 - DNA, 25 bp, Rattus norvegicus
gatgcacgtcggaccacttgccctt

SEQ ID NO: 495204 - DNA, 25 bp, Rattus norvegicus
ggaccacttgcccttcgttgctatg

SEQ ID NO: 495205 - DNA, 25 bp, Rattus norvegicus
cggtgggctctaacttgacccagga

SEQ ID NO: 495206 - DNA, 25 bp, Rattus norvegicus
gctctcggtgggctctaacttgacc

SEQ ID NO: 495207 - DNA, 25 bp, Rattus norvegicus
tgccagctttccaacacaatctgct

SEQ ID NO: 495208 - DNA, 25 bp, Rattus norvegicus
cgctgttgccagctttccaacacaa

SEQ ID NO: 495209 - DNA, 25 bp, Rattus norvegicus
gctcctgacgacacactgcccgccc

SEQ ID NO: 495210 - DNA, 25 bp, Rattus norvegicus
acttgacccaggagagcgcacggtc

SEQ ID NO: 495211 - DNA, 25 bp, Rattus norvegicus
ctctggacgctgcagccctcaccca

SEQ ID NO: 495212 - DNA, 25 bp, Rattus norvegicus
aacgcttccttctctggacgctgca

SEQ ID NO: 495213 - DNA, 25 bp, Rattus norvegicus
agctgtcaacgcttccttctctgga

SEQ ID NO: 495214 - DNA, 25 bp, Rattus norvegicus
gcagccggctccagctgtcaacgct

SEQ ID NO: 495215 - DNA, 25 bp, Rattus norvegicus
gtcccggcgcaaacccttccagcag

SEQ ID NO: 495216 - DNA, 25 bp, Rattus norvegicus
cccgtcttgcgtagcgctacggcaa

SEQ ID NO: 495217 - DNA, 25 bp, Rattus norvegicus
cgcagtccttctgcccgggtgcgag

SEQ ID NO: 495218 - DNA, 25 bp, Rattus norvegicus
ccgcccagctcctgacgacacactg

SEQ ID NO: 495219 - DNA, 25 bp, Rattus norvegicus
ctgctgcgggtgacaagctgcagcc

SEQ ID NO: 495220 - DNA, 25 bp, Rattus norvegicus
tcgagacacccgacctcatcggagg

SEQ ID NO: 495221 - DNA, 25 bp, Rattus norvegicus
ggaggccctggatatcttcgagaca

SEQ ID NO: 495222 - DNA, 25 bp, Rattus norvegicus
atgacctacaggcagcaccgggacg

SEQ ID NO: 495223 - DNA, 25 bp, Rattus norvegicus
tcttcgaggaagagctggcattctg

SEQ ID NO: 495224 - DNA, 25 bp, Rattus norvegicus
cccaggagtcttcgcctatgtgctc

SEQ ID NO: 495225 - DNA, 25 bp, Rattus norvegicus
ggaggccgcgaattcttcttcgatc

SEQ ID NO: 495226 - DNA, 25 bp, Rattus norvegicus
aactgcagttcgcacggtggcaatg

SEQ ID NO: 495227 - DNA, 25 bp, Rattus norvegicus
ctctgaacctcagggcgactgcctg

SEQ ID NO: 495228 - DNA, 25 bp, Rattus norvegicus
aagacccttcctggaactcgcctgg

SEQ ID NO: 495229 - DNA, 25 bp, Rattus norvegicus
gaaacctaccgcagcactctcaaga

SEQ ID NO: 495230 - DNA, 25 bp, Rattus norvegicus
tcggaggcaccaggcacgaaaccta

SEQ ID NO: 495231 - DNA, 25 bp, Rattus norvegicus
caacgagagggtgatcctcaatgtc

SEQ ID NO: 495232 - DNA, 25 bp, Rattus norvegicus
gtggcaatggcagcgaccaccctgg

SEQ ID NO: 495233 - DNA, 25 bp, Rattus norvegicus
ctctggcgcagaccgctagcttaga

SEQ ID NO: 495234 - DNA, 25 bp, Rattus norvegicus
ggttcataaaatgccatcgacgacg

SEQ ID NO: 495235 - DNA, 25 bp, Rattus norvegicus
gcctgtcgctctctcggttcataaa

SEQ ID NO: 495236 - DNA, 25 bp, Rattus norvegicus
tggggacaactgtcatgcctgtcgc

SEQ ID NO: 495237 - DNA, 25 bp, Rattus norvegicus
cttagagcgttgtgggtctgtatga

SEQ ID NO: 495238 - DNA, 25 bp, Rattus norvegicus
catcgacgacgcatatggtattttg

SEQ ID NO: 495239 - DNA, 25 bp, Rattus norvegicus
tcttcctctagctgacggtctgggc

SEQ ID NO: 495240 - DNA, 25 bp, Rattus norvegicus
cgttccggcttcttcctctagctga

SEQ ID NO: 495241 - DNA, 25 bp, Rattus norvegicus
attctgagcagcacccgagcaacga

SEQ ID NO: 495242 - DNA, 25 bp, Rattus norvegicus
gacacccacgttcgggattctgagc

SEQ ID NO: 495243 - DNA, 25 bp, Rattus norvegicus
tccgcggcgacagtaactgctgctc

SEQ ID NO: 495244 - DNA, 25 bp, Rattus norvegicus
gctaggcctgcaaggcctctccagg

SEQ ID NO: 495245 - DNA, 25 bp, Rattus norvegicus
tgggtctactcacggcacactcgtc

SEQ ID NO: 495246 - DNA, 25 bp, Rattus norvegicus
tctgtatgagccagtggggacaact

SEQ ID NO: 495247 - DNA, 25 bp, Rattus norvegicus
gcgcgctcgggtccctgaaaccatt

SEQ ID NO: 495248 - DNA, 25 bp, Rattus norvegicus
tcccagcttgttggcaagcgtatgc

SEQ ID NO: 495249 - DNA, 25 bp, Rattus norvegicus
cccgcgcgttgggtgagtcgaataa

SEQ ID NO: 495250 - DNA, 25 bp, Rattus norvegicus
cgttgggtgagtcgaataatgcagc

SEQ ID NO: 495251 - DNA, 25 bp, Rattus norvegicus
tcgaataatgcagctggcgggacag

SEQ ID NO: 495252 - DNA, 25 bp, Rattus norvegicus
gcgggacaggtttccagtctggaaa

SEQ ID NO: 495253 - DNA, 25 bp, Rattus norvegicus
ttccagtctggaaagcgggcagtga

SEQ ID NO: 495254 - DNA, 25 bp, Rattus norvegicus
gttagttcattcattagccaccgca

SEQ ID NO: 495255 - DNA, 25 bp, Rattus norvegicus
attcattagccaccgcaggatgtgc

SEQ ID NO: 495256 - DNA, 25 bp, Rattus norvegicus
aggctgttcccagcttgttggcaag

SEQ ID NO: 495257 - DNA, 25 bp, Rattus norvegicus
gcgatgtatgcttccgggtcgtatg

SEQ ID NO: 495258 - DNA, 25 bp, Rattus norvegicus
tatgcttccgggtcgtatgtggtgt

SEQ ID NO: 495259 - DNA, 25 bp, Rattus norvegicus
cgcacaggaaacaggtacgaccatg

SEQ ID NO: 495260 - DNA, 25 bp, Rattus norvegicus
cgcaggatgtgcgatgtatgcttcc

SEQ ID NO: 495261 - DNA, 25 bp, Rattus norvegicus
ggccgcaaacggtgaactgctcttc

SEQ ID NO: 495262 - DNA, 25 bp, Rattus norvegicus
agactctggaggctagtgacgaccg

SEQ ID NO: 495263 - DNA, 25 bp, Rattus norvegicus
tcgccgatctcacgctgcgaggatt

SEQ ID NO: 495264 - DNA, 25 bp, Rattus norvegicus
tccagcgcagtcatcagagaccgca

SEQ ID NO: 495265 - DNA, 25 bp, Rattus norvegicus
tgctgttgccaccacgctcagggaa

SEQ ID NO: 495266 - DNA, 25 bp, Rattus norvegicus
cgtcttctcccatggtggccgcaaa

SEQ ID NO: 495267 - DNA, 25 bp, Rattus norvegicus
aagcctcttgtgcactgcgatgtgg

SEQ ID NO: 495268 - DNA, 25 bp, Rattus norvegicus
ggcaaaagccagcacaagcctcttg

SEQ ID NO: 495269 - DNA, 25 bp, Rattus norvegicus
tgacagccagcagtgccacgatgga

SEQ ID NO: 495270 - DNA, 25 bp, Rattus norvegicus
agtacggccagcatggtgacagcca

SEQ ID NO: 495271 - DNA, 25 bp, Rattus norvegicus
acactcgtcgaaccgcaggctgagc

SEQ ID NO: 495272 - DNA, 25 bp, Rattus norvegicus
tgcgaggattcctcacccgcgtggt

SEQ ID NO: 495273 - DNA, 25 bp, Rattus norvegicus
agatcctgggtagctgctgttgcca

SEQ ID NO: 495274 - DNA, 25 bp, Rattus norvegicus
cttaggaaggccagctcagattctc

SEQ ID NO: 495275 - DNA, 25 bp, Rattus norvegicus
agctgtcgtgcctcactgcgcctgt

SEQ ID NO: 495276 - DNA, 25 bp, Rattus norvegicus
ggaaaagcgccgaggcctgcaccgc

SEQ ID NO: 495277 - DNA, 25 bp, Rattus norvegicus
ccgcctgggagcaggaaccgtctat

SEQ ID NO: 495278 - DNA, 25 bp, Rattus norvegicus
ggagccctttcactgtcacacgccg

SEQ ID NO: 495279 - DNA, 25 bp, Rattus norvegicus
cccgcgcgtgcctggtgatgacgta

SEQ ID NO: 495280 - DNA, 25 bp, Rattus norvegicus
cctggtgatgacgtagcagaacctc

SEQ ID NO: 495281 - DNA, 25 bp, Rattus norvegicus
agcagaacctcacgtgtctctcaga

SEQ ID NO: 495282 - DNA, 25 bp, Rattus norvegicus
agactcacaacaacatccggccggt

SEQ ID NO: 495283 - DNA, 25 bp, Rattus norvegicus
catccggccggtctaaaataacatc

SEQ ID NO: 495284 - DNA, 25 bp, Rattus norvegicus
ggtctaaaataacatccgggcagga

SEQ ID NO: 495285 - DNA, 25 bp, Rattus norvegicus
ggactagcgggaactgcaattggac

SEQ ID NO: 495286 - DNA, 25 bp, Rattus norvegicus
caggaaccgtctatcgccgggttca

SEQ ID NO: 495287 - DNA, 25 bp, Rattus norvegicus
aactgcaattggacgcatgcgtagt

SEQ ID NO: 495288 - DNA, 25 bp, Rattus norvegicus
tcacgtgtctctcagactcacaaca

SEQ ID NO: 495289 - DNA, 25 bp, Rattus norvegicus
aaggggttgatctttgcggccagac

SEQ ID NO: 495290 - DNA, 25 bp, Rattus norvegicus
gggccgagagaaagtcccagaatga

SEQ ID NO: 495291 - DNA, 25 bp, Rattus norvegicus
gagaaagtcccagaatgaagggccc

SEQ ID NO: 495292 - DNA, 25 bp, Rattus norvegicus
cggctaccacgtcagggacccgagg

SEQ ID NO: 495293 - DNA, 25 bp, Rattus norvegicus
taccacgtcagggacccgaggctag

SEQ ID NO: 495294 - DNA, 25 bp, Rattus norvegicus
cccgaggctaggagagagctacctc

SEQ ID NO: 495295 - DNA, 25 bp, Rattus norvegicus
gagctacctctcctccctctaatgg

SEQ ID NO: 495296 - DNA, 25 bp, Rattus norvegicus
taatggcgtctccttcctcctacgt

SEQ ID NO: 495297 - DNA, 25 bp, Rattus norvegicus
ctacgtcacactccgcgtcacgtga

SEQ ID NO: 495298 - DNA, 25 bp, Rattus norvegicus
tcagcgctccgggaatcccgcgttg

SEQ ID NO: 495299 - DNA, 25 bp, Rattus norvegicus
ccactctgatgggatagaatacagg

SEQ ID NO: 495300 - DNA, 25 bp, Rattus norvegicus
aatacaggacgcgatcgcctggccc

SEQ ID NO: 495301 - DNA, 25 bp, Rattus norvegicus
tgggatagaatacaggacgcgatcg

SEQ ID NO: 495302 - DNA, 25 bp, Rattus norvegicus
gggcctgttccggtgtccgcaccga

SEQ ID NO: 495303 - DNA, 25 bp, Rattus norvegicus
ggcgtctgccgcttgcttcacttct

SEQ ID NO: 495304 - DNA, 25 bp, Rattus norvegicus
gcttgcttcacttctgcggtacgca

SEQ ID NO: 495305 - DNA, 25 bp, Rattus norvegicus
cacttctgcggtacgcagcctgggc

SEQ ID NO: 495306 - DNA, 25 bp, Rattus norvegicus
ctgggcgagcgaacctgggcccaga

SEQ ID NO: 495307 - DNA, 25 bp, Rattus norvegicus
cgggagagcgcctttagatctacac

SEQ ID NO: 495308 - DNA, 25 bp, Rattus norvegicus
gcctttagatctacacccggctgtc

SEQ ID NO: 495309 - DNA, 25 bp, Rattus norvegicus
atctacacccggctgtccttggagt

SEQ ID NO: 495310 - DNA, 25 bp, Rattus norvegicus
cggctgtccttggagtctgattcta

SEQ ID NO: 495311 - DNA, 25 bp, Rattus norvegicus
tccttggagtctgattctagccagc

SEQ ID NO: 495312 - DNA, 25 bp, Rattus norvegicus
cagtctcaccgcgactatctgcgta

SEQ ID NO: 495313 - DNA, 25 bp, Rattus norvegicus
accgcgactatctgcgtacgcatgc

SEQ ID NO: 495314 - DNA, 25 bp, Rattus norvegicus
gcgactatctgcgtacgcatgcgca

SEQ ID NO: 495315 - DNA, 25 bp, Rattus norvegicus
gacctgcctcgctcacgtgaccatt

SEQ ID NO: 495316 - DNA, 25 bp, Rattus norvegicus
tgattctagccagcggggcccaaga

SEQ ID NO: 495317 - DNA, 25 bp, Rattus norvegicus
tttccgctttcgaggcaggccttac

SEQ ID NO: 495318 - DNA, 25 bp, Rattus norvegicus
gagccacatagctttggaccgtttc

SEQ ID NO: 495319 - DNA, 25 bp, Rattus norvegicus
gacacagcagctaccgacccaaaga

SEQ ID NO: 495320 - DNA, 25 bp, Rattus norvegicus
gaggaatttctcacgctcgcggcac

SEQ ID NO: 495321 - DNA, 25 bp, Rattus norvegicus
tcgtcctcttctcagcagcagctga

SEQ ID NO: 495322 - DNA, 25 bp, Rattus norvegicus
ctagcggcctctcaccgaaagaaga

SEQ ID NO: 495323 - DNA, 25 bp, Rattus norvegicus
gcagaacctgctaggcgtccgaaca

SEQ ID NO: 495324 - DNA, 25 bp, Rattus norvegicus
acagagcctttctcgcgaggcggaa

SEQ ID NO: 495325 - DNA, 25 bp, Rattus norvegicus
aatgacgatcgggacacagcctcct

SEQ ID NO: 495326 - DNA, 25 bp, Rattus norvegicus
cggcgtgtcgcaggaaatgacgatc

SEQ ID NO: 495327 - DNA, 25 bp, Rattus norvegicus
gacacttagctttcgccttccggcg

SEQ ID NO: 495328 - DNA, 25 bp, Rattus norvegicus
aaagcctgttctcgcgacacttagc

SEQ ID NO: 495329 - DNA, 25 bp, Rattus norvegicus
catcgctggtctacaaagcctgttc

SEQ ID NO: 495330 - DNA, 25 bp, Rattus norvegicus
gcccttgcaatgaatgagatgatga

SEQ ID NO: 495331 - DNA, 25 bp, Rattus norvegicus
agcttccgtccggtgggttccagca

SEQ ID NO: 495332 - DNA, 25 bp, Rattus norvegicus
ccaggcgtctgcaaccctactgaga

SEQ ID NO: 495333 - DNA, 25 bp, Rattus norvegicus
cttagcgagtgctgggagcttccgt

SEQ ID NO: 495334 - DNA, 25 bp, Rattus norvegicus
agcgcccgggctgatgcagaaccga

SEQ ID NO: 495335 - DNA, 25 bp, Rattus norvegicus
ctggcagcctgaggtcttagcgagt

SEQ ID NO: 495336 - DNA, 25 bp, Rattus norvegicus
agtgacgtcagctcagccctgcttt

SEQ ID NO: 495337 - DNA, 25 bp, Rattus norvegicus
tccagccaaattgcgcgcccagtga

SEQ ID NO: 495338 - DNA, 25 bp, Rattus norvegicus
tttttaaagcgctccagccaaattg

SEQ ID NO: 495339 - DNA, 25 bp, Rattus norvegicus
tccgctcgcacgctccttttttaaa

SEQ ID NO: 495340 - DNA, 25 bp, Rattus norvegicus
cggtctgagctgtgtgcagcagcat

SEQ ID NO: 495341 - DNA, 25 bp, Rattus norvegicus
acagcgcagagaacagtggcccagc

SEQ ID NO: 495342 - DNA, 25 bp, Rattus norvegicus
ccctactgagagtctgccgggtcgt

SEQ ID NO: 495343 - DNA, 25 bp, Rattus norvegicus
gggttcttctccaccagcttctgca

SEQ ID NO: 495344 - DNA, 25 bp, Rattus norvegicus
cgtagctccgttgggacagcgcaga

SEQ ID NO: 495345 - DNA, 25 bp, Rattus norvegicus
cgcacgtactagtggctctgccgca

SEQ ID NO: 495346 - DNA, 25 bp, Rattus norvegicus
tgcggtgcaccaagcgcaggccaac

SEQ ID NO: 495347 - DNA, 25 bp, Rattus norvegicus
ccgggaaagcttggagctggcacca

SEQ ID NO: 495348 - DNA, 25 bp, Rattus norvegicus
agggcacattgcctcatcccgggca

SEQ ID NO: 495349 - DNA, 25 bp, Rattus norvegicus
catcccgggcattttactggaaact

SEQ ID NO: 495350 - DNA, 25 bp, Rattus norvegicus
gccggttaaatagcgcggccgcctc

SEQ ID NO: 495351 - DNA, 25 bp, Rattus norvegicus
ctgggagcatgatcgtggacaagct

SEQ ID NO: 495352 - DNA, 25 bp, Rattus norvegicus
gctcaacctcgcttacttctacgga

SEQ ID NO: 495353 - DNA, 25 bp, Rattus norvegicus
cctctattcggggttcacacgctgg

SEQ ID NO: 495354 - DNA, 25 bp, Rattus norvegicus
cgatagtcgagacgttaggcggccc

SEQ ID NO: 495355 - DNA, 25 bp, Rattus norvegicus
ctgcgacttccttagcggcgggaca

SEQ ID NO: 495356 - DNA, 25 bp, Rattus norvegicus
aggcaccggaggagactgaactctg

SEQ ID NO: 495357 - DNA, 25 bp, Rattus norvegicus
aactctgcacgcacggctctggctt

SEQ ID NO: 495358 - DNA, 25 bp, Rattus norvegicus
ctggaaactagacgcatccggaggc

SEQ ID NO: 495359 - DNA, 25 bp, Rattus norvegicus
ccgccgcctgtcgtgtccgcagccc

SEQ ID NO: 495360 - DNA, 25 bp, Rattus norvegicus
cgctgagcgcgcaacaagtggtacc

SEQ ID NO: 495361 - DNA, 25 bp, Rattus norvegicus
tcgggtcagaatggcagcgtgggaa

SEQ ID NO: 495362 - DNA, 25 bp, Rattus norvegicus
gcgctgagcgcgcaacaagtggtac

SEQ ID NO: 495363 - DNA, 25 bp, Rattus norvegicus
gggaagggctgtgcgtcgcgggtcc

SEQ ID NO: 495364 - DNA, 25 bp, Rattus norvegicus
aggcagctcgggtcagaatggcagc

SEQ ID NO: 495365 - DNA, 25 bp, Rattus norvegicus
cgcctgtcgtgtccgcagcccgccc

SEQ ID NO: 495366 - DNA, 25 bp, Rattus norvegicus
gctgagcgcgcaacaagtggtaccc

SEQ ID NO: 495367 - DNA, 25 bp, Rattus norvegicus
ctgagcgcgcaacaagtggtacccg

SEQ ID NO: 495368 - DNA, 25 bp, Rattus norvegicus
cagcggcggcctcagcgcttgagca

SEQ ID NO: 495369 - DNA, 25 bp, Rattus norvegicus
gcggcggcctcagcgcttgagcatc

SEQ ID NO: 495370 - DNA, 25 bp, Rattus norvegicus
ggcctcagcgcttgagcatcgccag

SEQ ID NO: 495371 - DNA, 25 bp, Rattus norvegicus
ctcagcgcttgagcatcgccagccc

SEQ ID NO: 495372 - DNA, 25 bp, Rattus norvegicus
agaatggcagcgtgggaagggctgt

SEQ ID NO: 495373 - DNA, 25 bp, Rattus norvegicus
caactcaggaagatctgcctgggcc

SEQ ID NO: 495374 - DNA, 25 bp, Rattus norvegicus
acgcctcagcatcacaccagctggc

SEQ ID NO: 495375 - DNA, 25 bp, Rattus norvegicus
gacgcctcagcatcacaccagctgg

SEQ ID NO: 495376 - DNA, 25 bp, Rattus norvegicus
aggaagatctgcctgggcccgctac

SEQ ID NO: 495377 - DNA, 25 bp, Rattus norvegicus
ccaactcaggaagatctgcctgggc

SEQ ID NO: 495378 - DNA, 25 bp, Rattus norvegicus
tcccagcggtcccagagccagagcc

SEQ ID NO: 495379 - DNA, 25 bp, Rattus norvegicus
ctgccagccgcagaacaggggggga

SEQ ID NO: 495380 - DNA, 25 bp, Rattus norvegicus
caacccaactcaggaagatctgcct

SEQ ID NO: 495381 - DNA, 25 bp, Rattus norvegicus
aacccaactcaggaagatctgcctg

SEQ ID NO: 495382 - DNA, 25 bp, Rattus norvegicus
acccaactcaggaagatctgcctgg

SEQ ID NO: 495383 - DNA, 25 bp, Rattus norvegicus
cccaactcaggaagatctgcctggg

SEQ ID NO: 495384 - DNA, 25 bp, Rattus norvegicus
cgcctcagcatcacaccagctggcg

SEQ ID NO: 495385 - DNA, 25 bp, Rattus norvegicus
agacgcctcagcatcacaccagctg

SEQ ID NO: 495386 - DNA, 25 bp, Rattus norvegicus
tccctatgtaactgacgagaccggc

SEQ ID NO: 495387 - DNA, 25 bp, Rattus norvegicus
cttctctcgggattcttgggttagg

SEQ ID NO: 495388 - DNA, 25 bp, Rattus norvegicus
tggaaaagggtttgtgccacgccca

SEQ ID NO: 495389 - DNA, 25 bp, Rattus norvegicus
aagggtttgtgccacgcccatcccg

SEQ ID NO: 495390 - DNA, 25 bp, Rattus norvegicus
atcccggggctcctcctttgccacg

SEQ ID NO: 495391 - DNA, 25 bp, Rattus norvegicus
atccgggagccgcttctctcgggat

SEQ ID NO: 495392 - DNA, 25 bp, Rattus norvegicus
taactgacgagaccggcggtgagtt

SEQ ID NO: 495393 - DNA, 25 bp, Rattus norvegicus
gagccgcttctctcgggattcttgg

SEQ ID NO: 495394 - DNA, 25 bp, Rattus norvegicus
gcgactccctatgtaactgacgaga

SEQ ID NO: 495395 - DNA, 25 bp, Rattus norvegicus
atggcgactccctatgtaactgacg

SEQ ID NO: 495396 - DNA, 25 bp, Rattus norvegicus
cgcttctctcgggattcttgggtta

SEQ ID NO: 495397 - DNA, 25 bp, Rattus norvegicus
cggaagtggttagggttctcaagat

SEQ ID NO: 495398 - DNA, 25 bp, Rattus norvegicus
ttagggttctcaagatggcgactcc

SEQ ID NO: 495399 - DNA, 25 bp, Rattus norvegicus
tatgtaactgacgagaccggcggtg

SEQ ID NO: 495400 - DNA, 25 bp, Rattus norvegicus
ccacaggtgaaggtgcactcgaaca

SEQ ID NO: 495401 - DNA, 25 bp, Rattus norvegicus
ctagcgagggcagtacaatcgattc

SEQ ID NO: 495402 - DNA, 25 bp, Rattus norvegicus
cgcgtgcttaccttggggttagtca

SEQ ID NO: 495403 - DNA, 25 bp, Rattus norvegicus
cgctgtgtagcagcgccctggagtt

SEQ ID NO: 495404 - DNA, 25 bp, Rattus norvegicus
ttggactcggagttgttcacgtaca

SEQ ID NO: 495405 - DNA, 25 bp, Rattus norvegicus
acctgcactgttaggtgggagctcc

SEQ ID NO: 495406 - DNA, 25 bp, Rattus norvegicus
ccctgcagtcggtgccacaggtgaa

SEQ ID NO: 495407 - DNA, 25 bp, Rattus norvegicus
tgcaccgacagcaccgtgcagttgg

SEQ ID NO: 495408 - DNA, 25 bp, Rattus norvegicus
ccgccgtggcttgcagatcctgcaa

SEQ ID NO: 495409 - DNA, 25 bp, Rattus norvegicus
agccgagccggatgctcttgtcttc

SEQ ID NO: 495410 - DNA, 25 bp, Rattus norvegicus
ctgagccagcagaagccgaagatga

SEQ ID NO: 495411 - DNA, 25 bp, Rattus norvegicus
ccgaagatgaagagcgacaggatgc

SEQ ID NO: 495412 - DNA, 25 bp, Rattus norvegicus
tgccagagacgatgaggaacaagcc

SEQ ID NO: 495413 - DNA, 25 bp, Rattus norvegicus
tgttcacgtacacctggacgcaggg

SEQ ID NO: 495414 - DNA, 25 bp, Rattus norvegicus
caggcacactggcaaagcgagttca

SEQ ID NO: 495415 - DNA, 25 bp, Rattus norvegicus
cccggctggtgcaagctaacgggat

SEQ ID NO: 495416 - DNA, 25 bp, Rattus norvegicus
ctgcgcggacgcagcaggatgccca

SEQ ID NO: 495417 - DNA, 25 bp, Rattus norvegicus
cactggcaaagcgagttcaggtggc

SEQ ID NO: 495418 - DNA, 25 bp, Rattus norvegicus
ctccgatcccgagagctgcggggca

SEQ ID NO: 495419 - DNA, 25 bp, Rattus norvegicus
ttaaaactccgatcccgagagctgc

SEQ ID NO: 495420 - DNA, 25 bp, Rattus norvegicus
tgcaaggcgggaatcttaaaactcc

SEQ ID NO: 495421 - DNA, 25 bp, Rattus norvegicus
gtgagcatgcaaggcgggaatctta

SEQ ID NO: 495422 - DNA, 25 bp, Rattus norvegicus
ggccgcggcgaacgcctagcaccga

SEQ ID NO: 495423 - DNA, 25 bp, Rattus norvegicus
tcgccagatgcaacctggagagatg

SEQ ID NO: 495424 - DNA, 25 bp, Rattus norvegicus
tctcggaatcctcgccagatgcaac

SEQ ID NO: 495425 - DNA, 25 bp, Rattus norvegicus
ccgccgcgagcagctctcggaatcc

SEQ ID NO: 495426 - DNA, 25 bp, Rattus norvegicus
tccgccgtgagggaggctgctcctc

SEQ ID NO: 495427 - DNA, 25 bp, Rattus norvegicus
agcgacagaggacacctgcgcggac

SEQ ID NO: 495428 - DNA, 25 bp, Rattus norvegicus
ttgccaaaaactcaccgcatgaatt

SEQ ID NO: 495429 - DNA, 25 bp, Rattus norvegicus
agtgctactactacctgccggcgca

SEQ ID NO: 495430 - DNA, 25 bp, Rattus norvegicus
tggcagcggtactcaggtccaatcg

SEQ ID NO: 495431 - DNA, 25 bp, Rattus norvegicus
ggtccaatcgtcgttccgcagcctg

SEQ ID NO: 495432 - DNA, 25 bp, Rattus norvegicus
gcgctgccttgtggcgattacggaa

SEQ ID NO: 495433 - DNA, 25 bp, Rattus norvegicus
aacgccggtcgacggtgagaagcac

SEQ ID NO: 495434 - DNA, 25 bp, Rattus norvegicus
ctcgcctcaaggacagagtgtttcc

SEQ ID NO: 495435 - DNA, 25 bp, Rattus norvegicus
tcgctccgacttcgctctaaggcgg

SEQ ID NO: 495436 - DNA, 25 bp, Rattus norvegicus
ggctgctgggagcaagacctttacc

SEQ ID NO: 495437 - DNA, 25 bp, Rattus norvegicus
catgaattttcttgtcccgcggatc

SEQ ID NO: 495438 - DNA, 25 bp, Rattus norvegicus
ccctctctcgattggagccgagaca

SEQ ID NO: 495439 - DNA, 25 bp, Rattus norvegicus
gcacggcgacgctttacgtcttgtc

SEQ ID NO: 495440 - DNA, 25 bp, Rattus norvegicus
acctggggacgcacagcgtgtttgt

SEQ ID NO: 495441 - DNA, 25 bp, Rattus norvegicus
aagatggcgacgtatccaccgcgga

SEQ ID NO: 495442 - DNA, 25 bp, Rattus norvegicus
gcgtccacccggcaccatcggctcc

SEQ ID NO: 495443 - DNA, 25 bp, Rattus norvegicus
agcctcgcttttccgcgggcagcgg

SEQ ID NO: 495444 - DNA, 25 bp, Rattus norvegicus
actcccgaagtcaggtcggccaggc

SEQ ID NO: 495445 - DNA, 25 bp, Rattus norvegicus
aggggctcggtgcaggctgcctctc

SEQ ID NO: 495446 - DNA, 25 bp, Rattus norvegicus
ccgaagtcaggtcggccaggccgac

SEQ ID NO: 495447 - DNA, 25 bp, Rattus norvegicus
cggtgtcccgactcccgaagtcagg

SEQ ID NO: 495448 - DNA, 25 bp, Rattus norvegicus
gacttaagcaactcagcgacccagg

SEQ ID NO: 495449 - DNA, 25 bp, Rattus norvegicus
aagcaactcagcgacccaggccgtg

SEQ ID NO: 495450 - DNA, 25 bp, Rattus norvegicus
aactcagcgacccaggccgtgcggg

SEQ ID NO: 495451 - DNA, 25 bp, Rattus norvegicus
tgggcgggcgacatccgcgccctcc

SEQ ID NO: 495452 - DNA, 25 bp, Rattus norvegicus
actcacctgccggacccgccgcggc

SEQ ID NO: 495453 - DNA, 25 bp, Rattus norvegicus
ggacagacgccgctccactccgccg

SEQ ID NO: 495454 - DNA, 25 bp, Rattus norvegicus
gcccgcgacttaagcaactcagcga

SEQ ID NO: 495455 - DNA, 25 bp, Rattus norvegicus
tgcccagctcgggagacgcgaagga

SEQ ID NO: 495456 - DNA, 25 bp, Rattus norvegicus
aacttctccgctagggctaaggccg

SEQ ID NO: 495457 - DNA, 25 bp, Rattus norvegicus
ccgacgaattcagagtagaggataa

SEQ ID NO: 495458 - DNA, 25 bp, Rattus norvegicus
ggctcaccatggttccgacgaattc

SEQ ID NO: 495459 - DNA, 25 bp, Rattus norvegicus
cctgggccgaaagctaggctcacca

SEQ ID NO: 495460 - DNA, 25 bp, Rattus norvegicus
ctgcgactccggttagacaagagga

SEQ ID NO: 495461 - DNA, 25 bp, Rattus norvegicus
gccatgtgccgagggtccatgagac

SEQ ID NO: 495462 - DNA, 25 bp, Rattus norvegicus
tcgaggtaccctagatgagaagctc

SEQ ID NO: 495463 - DNA, 25 bp, Rattus norvegicus
tcgtgttagcccagtagcggaaatc

SEQ ID NO: 495464 - DNA, 25 bp, Rattus norvegicus
caagagtagctagaaacttctccgc

SEQ ID NO: 495465 - DNA, 25 bp, Rattus norvegicus
ttacaaagagatgctggcttagggc

SEQ ID NO: 495466 - DNA, 25 bp, Rattus norvegicus
gctaggggcgagctgatttagaata

SEQ ID NO: 495467 - DNA, 25 bp, Rattus norvegicus
caaagagactttgtaccgcgcgggt

SEQ ID NO: 495468 - DNA, 25 bp, Rattus norvegicus
aagtgacgacacgatctgccgcagg

SEQ ID NO: 495469 - DNA, 25 bp, Rattus norvegicus
agaggataatccctcacaagccgcg

SEQ ID NO: 495470 - DNA, 25 bp, Rattus norvegicus
ccctgggagacacacgataattact

SEQ ID NO: 495471 - DNA, 25 bp, Rattus norvegicus
ctggcgaccctgacgcagatctaga

SEQ ID NO: 495472 - DNA, 25 bp, Rattus norvegicus
gagtccaaatcgaaccctggcgacc

SEQ ID NO: 495473 - DNA, 25 bp, Rattus norvegicus
gttttggcaccggaactgctcccag

SEQ ID NO: 495474 - DNA, 25 bp, Rattus norvegicus
cgaaccctaggcaagcacttccggg

SEQ ID NO: 495475 - DNA, 25 bp, Rattus norvegicus
gagcctcggcgcctgtatctaccag

SEQ ID NO: 495476 - DNA, 25 bp, Rattus norvegicus
ggctactcaccgtcggcgcgaaggc

SEQ ID NO: 495477 - DNA, 25 bp, Rattus norvegicus
cttgcccgagcaaagaggtggtagc

SEQ ID NO: 495478 - DNA, 25 bp, Rattus norvegicus
cacagcggaggcaccgagcctactt

SEQ ID NO: 495479 - DNA, 25 bp, Rattus norvegicus
atgtccgggacagtcttgctgttca

SEQ ID NO: 495480 - DNA, 25 bp, Rattus norvegicus
acgaaagtcgggcactgatgtccgg

SEQ ID NO: 495481 - DNA, 25 bp, Rattus norvegicus
cacgataattactgagccgggaagg

SEQ ID NO: 495482 - DNA, 25 bp, Rattus norvegicus
cccaagccaagaggcgacgaaagtc

SEQ ID NO: 495483 - DNA, 25 bp, Rattus norvegicus
ccgacagctgaacctgctgtggaca

SEQ ID NO: 495484 - DNA, 25 bp, Rattus norvegicus
tcacctgggcttgcggcgccgaaca

SEQ ID NO: 495485 - DNA, 25 bp, Rattus norvegicus
ggagtcaggcccaaattccgccatt

SEQ ID NO: 495486 - DNA, 25 bp, Rattus norvegicus
aatgagcgccgagcttccgctctgc

SEQ ID NO: 495487 - DNA, 25 bp, Rattus norvegicus
ggcccaaattccgccattctcttga

SEQ ID NO: 495488 - DNA, 25 bp, Rattus norvegicus
ttctcttgaacatattgtcccaggg

SEQ ID NO: 495489 - DNA, 25 bp, Rattus norvegicus
ttgaacatattgtcccagggaagga

SEQ ID NO: 495490 - DNA, 25 bp, Rattus norvegicus
gccgccagggaaagagctcaggccg

SEQ ID NO: 495491 - DNA, 25 bp, Rattus norvegicus
ttgcggcgccgaacagccacctcct

SEQ ID NO: 495492 - DNA, 25 bp, Rattus norvegicus
catgcgcaacggttttgggcagcta

SEQ ID NO: 495493 - DNA, 25 bp, Rattus norvegicus
acggttttgggcagctacggcgcac

SEQ ID NO: 495494 - DNA, 25 bp, Rattus norvegicus
tgccttccgggcgagagctagttga

SEQ ID NO: 495495 - DNA, 25 bp, Rattus norvegicus
cgagagctagttgagcagttgtaga

SEQ ID NO: 495496 - DNA, 25 bp, Rattus norvegicus
tgagcagttgtagagagaaccgacc

SEQ ID NO: 495497 - DNA, 25 bp, Rattus norvegicus
catattgtcccagggaaggagccgc

SEQ ID NO: 495498 - DNA, 25 bp, Rattus norvegicus
tgtcctttgaaaggcggagtcaagg

SEQ ID NO: 495499 - DNA, 25 bp, Rattus norvegicus
cggcgctccaaccacctgctccgcg

SEQ ID NO: 495500 - DNA, 25 bp, Rattus norvegicus
ctaggctgcggatcggcgctccaac

SEQ ID NO: 495501 - DNA, 25 bp, Rattus norvegicus
ctgcagcgcctctaggctgcggatc

SEQ ID NO: 495502 - DNA, 25 bp, Rattus norvegicus
acttggtcctgcagcgcctctaggc

SEQ ID NO: 495503 - DNA, 25 bp, Rattus norvegicus
agtctccgacttggtcctgcagcgc

SEQ ID NO: 495504 - DNA, 25 bp, Rattus norvegicus
gctcagtctccgacttggtcctgca

SEQ ID NO: 495505 - DNA, 25 bp, Rattus norvegicus
agctccgctcagtctccgacttggt

SEQ ID NO: 495506 - DNA, 25 bp, Rattus norvegicus
tctcctcccaccaggggcggccagc

SEQ ID NO: 495507 - DNA, 25 bp, Rattus norvegicus
agtcaagggcagctccgcccaccgg

SEQ ID NO: 495508 - DNA, 25 bp, Rattus norvegicus
tcattggcgggtgtgtcctttgaaa

SEQ ID NO: 495509 - DNA, 25 bp, Rattus norvegicus
ccgctcctcattggcgggtgtgtcc

SEQ ID NO: 495510 - DNA, 25 bp, Rattus norvegicus
tctgaagcccgctcctcattggcgg

SEQ ID NO: 495511 - DNA, 25 bp, Rattus norvegicus
ggggctggggcatcagactctcctc

SEQ ID NO: 495512 - DNA, 25 bp, Rattus norvegicus
cagatgacttgttgcagacgtaacc

SEQ ID NO: 495513 - DNA, 25 bp, Rattus norvegicus
tttgttctgtccaaccaccgcgctt

SEQ ID NO: 495514 - DNA, 25 bp, Rattus norvegicus
tctctgatcagttaagctaggtacc

SEQ ID NO: 495515 - DNA, 25 bp, Rattus norvegicus
ggtaccagcatccaccatctttttg

SEQ ID NO: 495516 - DNA, 25 bp, Rattus norvegicus
atccgcgtaaatgtctatgtggtcc

SEQ ID NO: 495517 - DNA, 25 bp, Rattus norvegicus
ccgcgcttccaagtctttggcgata

SEQ ID NO: 495518 - DNA, 25 bp, Rattus norvegicus
cggaggctctgcaagtcctcgacta

SEQ ID NO: 495519 - DNA, 25 bp, Rattus norvegicus
cggcccgcaaaacgacgcgcgagaa

SEQ ID NO: 495520 - DNA, 25 bp, Rattus norvegicus
tcggtgggtccaaaagtcagatgac

SEQ ID NO: 495521 - DNA, 25 bp, Rattus norvegicus
ctggaccctcacgtacctggttgaa

SEQ ID NO: 495522 - DNA, 25 bp, Rattus norvegicus
acaaagggctgtgaacgcggccttc

SEQ ID NO: 495523 - DNA, 25 bp, Rattus norvegicus
tgcgcggacagagacacaaaatgga

SEQ ID NO: 495524 - DNA, 25 bp, Rattus norvegicus
ccacctagccaacaatggggcgtga

SEQ ID NO: 495525 - DNA, 25 bp, Rattus norvegicus
agtcctcgactaccaaggtgggccg

SEQ ID NO: 495526 - DNA, 25 bp, Rattus norvegicus
actacagttcgatcacgcacttgca

SEQ ID NO: 495527 - DNA, 25 bp, Rattus norvegicus
caataccctatggtggaccttgtcc

SEQ ID NO: 495528 - DNA, 25 bp, Rattus norvegicus
ttgaatggcactgtctggtcctctg

SEQ ID NO: 495529 - DNA, 25 bp, Rattus norvegicus
cgcacttgcacagcatcgggaaatc

SEQ ID NO: 495530 - DNA, 25 bp, Rattus norvegicus
tgctcgctgtcctcaataccctatg

SEQ ID NO: 495531 - DNA, 25 bp, Rattus norvegicus
accttgtcccttgagcgagagcgga

SEQ ID NO: 495532 - DNA, 25 bp, Rattus norvegicus
ctccggtgggaccatctttacctgg

SEQ ID NO: 495533 - DNA, 25 bp, Rattus norvegicus
atctttacctggctcctcagaggag

SEQ ID NO: 495534 - DNA, 25 bp, Rattus norvegicus
catctctaggacatggacggcgcgc

SEQ ID NO: 495535 - DNA, 25 bp, Rattus norvegicus
gtggccgccttggatttccgatacc

SEQ ID NO: 495536 - DNA, 25 bp, Rattus norvegicus
ttccgataccaccaccaggaaggga

SEQ ID NO: 495537 - DNA, 25 bp, Rattus norvegicus
aggctttcctaaagagcgtggctca

SEQ ID NO: 495538 - DNA, 25 bp, Rattus norvegicus
agagcgtggctcagaactacagttc

SEQ ID NO: 495539 - DNA, 25 bp, Rattus norvegicus
aggccaggctgcacgtccaacacgg

SEQ ID NO: 495540 - DNA, 25 bp, Rattus norvegicus
ggcaccgcctcctgaaccaataggg

SEQ ID NO: 495541 - DNA, 25 bp, Rattus norvegicus
cctcaccctgatgaataagggcatc

SEQ ID NO: 495542 - DNA, 25 bp, Rattus norvegicus
gagttccgtgacgagcgccctctat

SEQ ID NO: 495543 - DNA, 25 bp, Rattus norvegicus
cccgttaacaaagcagagttccgtg

SEQ ID NO: 495544 - DNA, 25 bp, Rattus norvegicus
cgacagcggctcctgacgtagaacg

SEQ ID NO: 495545 - DNA, 25 bp, Rattus norvegicus
ccgggacttgagagaccatttcgct

SEQ ID NO: 495546 - DNA, 25 bp, Rattus norvegicus
ggaatgatcagaactcgccaccgcc

SEQ ID NO: 495547 - DNA, 25 bp, Rattus norvegicus
gcgtgcgctgtgttaacccagaccc

SEQ ID NO: 495548 - DNA, 25 bp, Rattus norvegicus
ctgagtcaactaggcacagcccagt

SEQ ID NO: 495549 - DNA, 25 bp, Rattus norvegicus
cgctgaacgtgtcctaacttgacca

SEQ ID NO: 495550 - DNA, 25 bp, Rattus norvegicus
gtcaggacttagctcctccaacagc

SEQ ID NO: 495551 - DNA, 25 bp, Rattus norvegicus
ctcagctggagacatgtcaggactt

SEQ ID NO: 495552 - DNA, 25 bp, Rattus norvegicus
cagggtttaaatagcctcagctgga

SEQ ID NO: 495553 - DNA, 25 bp, Rattus norvegicus
ccgctgcggaaacgagcagggttta

SEQ ID NO: 495554 - DNA, 25 bp, Rattus norvegicus
acaaggaatataatccgcaggcttc

SEQ ID NO: 495555 - DNA, 25 bp, Rattus norvegicus
cggctcctctgcgtgccctgggtgt

SEQ ID NO: 495556 - DNA, 25 bp, Rattus norvegicus
ccctgggtgtctgcacgccaaagac

SEQ ID NO: 495557 - DNA, 25 bp, Rattus norvegicus
gcacgccaaagacggtgtgtggttc

SEQ ID NO: 495558 - DNA, 25 bp, Rattus norvegicus
cctcatctccgtttcagcagtgaca

SEQ ID NO: 495559 - DNA, 25 bp, Rattus norvegicus
tccgtttcagcagtgacaaggaata

SEQ ID NO: 495560 - DNA, 25 bp, Rattus norvegicus
caggcttcagctcgcttacagcggg

SEQ ID NO: 495561 - DNA, 25 bp, Rattus norvegicus
agctcgcttacagcgggacctgcgt

SEQ ID NO: 495562 - DNA, 25 bp, Rattus norvegicus
gggccggatgttctagcaccgcctc

SEQ ID NO: 495563 - DNA, 25 bp, Rattus norvegicus
gcctcctcgattgacttcgtgccag

SEQ ID NO: 495564 - DNA, 25 bp, Rattus norvegicus
ttgacttcgtgccagctgcgcaagc

SEQ ID NO: 495565 - DNA, 25 bp, Rattus norvegicus
cagctgcgcaagctggcgctttgtc

SEQ ID NO: 495566 - DNA, 25 bp, Rattus norvegicus
tggcgctttgtccaaccgcttttca

SEQ ID NO: 495567 - DNA, 25 bp, Rattus norvegicus
aatataatccgcaggcttcagctcg

SEQ ID NO: 495568 - DNA, 25 bp, Rattus norvegicus
acaggcatgcgccagccgggtccaa

SEQ ID NO: 495569 - DNA, 25 bp, Rattus norvegicus
cccgcccgtacttccgccgcgcagg

SEQ ID NO: 495570 - DNA, 25 bp, Rattus norvegicus
ccagtccacggctgctcctcccagc

SEQ ID NO: 495571 - DNA, 25 bp, Rattus norvegicus
gccgccctcggagccagtccacggc

SEQ ID NO: 495572 - DNA, 25 bp, Rattus norvegicus
acccggtcggccagcgatgccataa

SEQ ID NO: 495573 - DNA, 25 bp, Rattus norvegicus
ccagccgggtccaagcctgcagcgc

SEQ ID NO: 495574 - DNA, 25 bp, Rattus norvegicus
tccggccggagacaggcatgcgcca

SEQ ID NO: 495575 - DNA, 25 bp, Rattus norvegicus
gcagcctcccgcctcacagtccggc

SEQ ID NO: 495576 - DNA, 25 bp, Rattus norvegicus
cggagcccgggctgtccagcctccc

SEQ ID NO: 495577 - DNA, 25 bp, Rattus norvegicus
cataacgcccgacggctgcggggca

SEQ ID NO: 495578 - DNA, 25 bp, Rattus norvegicus
gcgatgccataacgcccgacggctg

SEQ ID NO: 495579 - DNA, 25 bp, Rattus norvegicus
ggtcggccagcgatgccataacgcc

SEQ ID NO: 495580 - DNA, 25 bp, Rattus norvegicus
acagtccggccggagacaggcatgc

SEQ ID NO: 495581 - DNA, 25 bp, Rattus norvegicus
ccgcgaggtaagaggccgccgccct

SEQ ID NO: 495582 - DNA, 25 bp, Rattus norvegicus
tgactgaatgggcagacctcggctc

SEQ ID NO: 495583 - DNA, 25 bp, Rattus norvegicus
tccagcagaggtagttaggtcgcta

SEQ ID NO: 495584 - DNA, 25 bp, Rattus norvegicus
tcgctaacaggcgagagccacagtc

SEQ ID NO: 495585 - DNA, 25 bp, Rattus norvegicus
agccacagtcttggccgaggcgtcc

SEQ ID NO: 495586 - DNA, 25 bp, Rattus norvegicus
cctagatagaaccttgcaactttga

SEQ ID NO: 495587 - DNA, 25 bp, Rattus norvegicus
ttgattacagtccagccaccgcgtt

SEQ ID NO: 495588 - DNA, 25 bp, Rattus norvegicus
cggaagcaccgctctggctaagcca

SEQ ID NO: 495589 - DNA, 25 bp, Rattus norvegicus
tcggcgcatgcgcaactttcgtcta

SEQ ID NO: 495590 - DNA, 25 bp, Rattus norvegicus
ttcgtctactgtcgcaggtccagtg

SEQ ID NO: 495591 - DNA, 25 bp, Rattus norvegicus
gcgtccttctgggaagccggaaatc

SEQ ID NO: 495592 - DNA, 25 bp, Rattus norvegicus
gccggaaatctgtaacctggactga

SEQ ID NO: 495593 - DNA, 25 bp, Rattus norvegicus
aaagagtctggcctcagcgttccgg

SEQ ID NO: 495594 - DNA, 25 bp, Rattus norvegicus
cggttctgcgccactctacaggatc

SEQ ID NO: 495595 - DNA, 25 bp, Rattus norvegicus
gaacgcggggatacgcattctctgc

SEQ ID NO: 495596 - DNA, 25 bp, Rattus norvegicus
cccactggctgactgtccgacagaa

SEQ ID NO: 495597 - DNA, 25 bp, Rattus norvegicus
tgccacttcccgcaacaaatgaagc

SEQ ID NO: 495598 - DNA, 25 bp, Rattus norvegicus
ggcaaactttttccctgtcaggctc

SEQ ID NO: 495599 - DNA, 25 bp, Rattus norvegicus
gcctgggtgtctgcagaggacaact

SEQ ID NO: 495600 - DNA, 25 bp, Rattus norvegicus
ggacaactttctggtttccgctcta

SEQ ID NO: 495601 - DNA, 25 bp, Rattus norvegicus
gccttgacgtcaggcgttcagcctc

SEQ ID NO: 495602 - DNA, 25 bp, Rattus norvegicus
atgcacctccgtgctgcggtcagct

SEQ ID NO: 495603 - DNA, 25 bp, Rattus norvegicus
gtccgacagaatcggtgtcagcctc

SEQ ID NO: 495604 - DNA, 25 bp, Rattus norvegicus
tgtcagcctcaacggaccgcatctg

SEQ ID NO: 495605 - DNA, 25 bp, Rattus norvegicus
agagctcagggcttggaaacctctg

SEQ ID NO: 495606 - DNA, 25 bp, Rattus norvegicus
ttggaaacctctgaagccttcgcgg

SEQ ID NO: 495607 - DNA, 25 bp, Rattus norvegicus
tccaagtgcacacaggaattcagtc

SEQ ID NO: 495608 - DNA, 25 bp, Rattus norvegicus
tgctagcctcgcagtgggccttgcc

SEQ ID NO: 495609 - DNA, 25 bp, Rattus norvegicus
cccagcggataaggaagagctcagg

SEQ ID NO: 495610 - DNA, 25 bp, Rattus norvegicus
ggctaccattggttttcaggactca

SEQ ID NO: 495611 - DNA, 25 bp, Rattus norvegicus
atcgtaatgacggtgagggctacca

SEQ ID NO: 495612 - DNA, 25 bp, Rattus norvegicus
ccgagtgctggttggtctaatcgta

SEQ ID NO: 495613 - DNA, 25 bp, Rattus norvegicus
ctctctgcccgccattagggagcgg

SEQ ID NO: 495614 - DNA, 25 bp, Rattus norvegicus
cgtgtcctcattggctagctctctg

SEQ ID NO: 495615 - DNA, 25 bp, Rattus norvegicus
aacgcagctcccgtgtcctcattgg

SEQ ID NO: 495616 - DNA, 25 bp, Rattus norvegicus
tttcaggactcaaaatgggcggaga

SEQ ID NO: 495617 - DNA, 25 bp, Rattus norvegicus
aaaggctgcagtcggtgtaggacac

SEQ ID NO: 495618 - DNA, 25 bp, Rattus norvegicus
cttgacagtgggacgaaaggctgca

SEQ ID NO: 495619 - DNA, 25 bp, Rattus norvegicus
cctgacggagtcagtctggggtccc

SEQ ID NO: 495620 - DNA, 25 bp, Rattus norvegicus
gcgacatgccggtgcgcttcaaggt

SEQ ID NO: 495621 - DNA, 25 bp, Rattus norvegicus
atcttgctagggaaccagtgttgtc

SEQ ID NO: 495622 - DNA, 25 bp, Rattus norvegicus
gacgcccggtccagtatcttgctag

SEQ ID NO: 495623 - DNA, 25 bp, Rattus norvegicus
gtgctggtaatctgcccgcagcctc

SEQ ID NO: 495624 - DNA, 25 bp, Rattus norvegicus
agaagatggaaggagacacccggcc

SEQ ID NO: 495625 - DNA, 25 bp, Rattus norvegicus
gcgcacccgccagctgcaaagttaa

SEQ ID NO: 495626 - DNA, 25 bp, Rattus norvegicus
ggccgctggtgaacattctttttcg

SEQ ID NO: 495627 - DNA, 25 bp, Rattus norvegicus
tgcaaagttaagttcgcgacccgga

SEQ ID NO: 495628 - DNA, 25 bp, Rattus norvegicus
gggcccacgccacgaatctcttttg

SEQ ID NO: 495629 - DNA, 25 bp, Rattus norvegicus
tggggaaagagagctacccagaccc

SEQ ID NO: 495630 - DNA, 25 bp, Rattus norvegicus
ccaggtctcaccgtgtgggatgtag

SEQ ID NO: 495631 - DNA, 25 bp, Rattus norvegicus
tcccaaagccaggtctcaccgtgtg

SEQ ID NO: 495632 - DNA, 25 bp, Rattus norvegicus
gcaagaacccaacaagccaggggtc

SEQ ID NO: 495633 - DNA, 25 bp, Rattus norvegicus
ggcgtggagattcggccctctcttc

SEQ ID NO: 495634 - DNA, 25 bp, Rattus norvegicus
cccaagttacagagggcggcgtcga

SEQ ID NO: 495635 - DNA, 25 bp, Rattus norvegicus
cagctcggggctcgcccaagttaca

SEQ ID NO: 495636 - DNA, 25 bp, Rattus norvegicus
aatctcttttgtggcagcagctcgg

SEQ ID NO: 495637 - DNA, 25 bp, Rattus norvegicus
tttcctgggtaagatggccgctggt

SEQ ID NO: 495638 - DNA, 25 bp, Rattus norvegicus
gcgcgttcgcgcacactcgcacaca

SEQ ID NO: 495639 - DNA, 25 bp, Rattus norvegicus
ctccctgccctaccgcgcaacctac

SEQ ID NO: 495640 - DNA, 25 bp, Rattus norvegicus
gcccgtgcacatgcctcgccctccc

SEQ ID NO: 495641 - DNA, 25 bp, Rattus norvegicus
cccaggaaaactgcggctcgggctc

SEQ ID NO: 495642 - DNA, 25 bp, Rattus norvegicus
cgctcccaggaaaactgcggctcgg

SEQ ID NO: 495643 - DNA, 25 bp, Rattus norvegicus
gcagagccgtcctccgctcccagga

SEQ ID NO: 495644 - DNA, 25 bp, Rattus norvegicus
gccagacacacgcagtccactgcat

SEQ ID NO: 495645 - DNA, 25 bp, Rattus norvegicus
ctctccgatcttccgcagagccgtc

SEQ ID NO: 495646 - DNA, 25 bp, Rattus norvegicus
ccggtcccgccgctactcctcgccg

SEQ ID NO: 495647 - DNA, 25 bp, Rattus norvegicus
ggctcgcgcccgagaaggccagccc

SEQ ID NO: 495648 - DNA, 25 bp, Rattus norvegicus
gccagcccgcgagtcccaccctctc

SEQ ID NO: 495649 - DNA, 25 bp, Rattus norvegicus
gacccactcgctcgggagcctcctc

SEQ ID NO: 495650 - DNA, 25 bp, Rattus norvegicus
cgactccctcacatcggggccgcgg

SEQ ID NO: 495651 - DNA, 25 bp, Rattus norvegicus
tcccgctacagccagacacacgcag

SEQ ID NO: 495652 - DNA, 25 bp, Rattus norvegicus
ctgtgcgctctagcgtgtgcttagc

SEQ ID NO: 495653 - DNA, 25 bp, Rattus norvegicus
tgcttagcgaagtatgggagccata

SEQ ID NO: 495654 - DNA, 25 bp, Rattus norvegicus
tgagcacccactgtcgcggttgtta

SEQ ID NO: 495655 - DNA, 25 bp, Rattus norvegicus
aagtatgggagccataaaggcgcgc

SEQ ID NO: 495656 - DNA, 25 bp, Rattus norvegicus
taaagcgagacccacaagcgagcgg

SEQ ID NO: 495657 - DNA, 25 bp, Rattus norvegicus
ccactgtcgcggttgttacggagcg

SEQ ID NO: 495658 - DNA, 25 bp, Rattus norvegicus
gaccaggtaagcctctggcctctga

SEQ ID NO: 495659 - DNA, 25 bp, Rattus norvegicus
cgccgcggtcctcagaccaggtaag

SEQ ID NO: 495660 - DNA, 25 bp, Rattus norvegicus
cccttcttgccgtctggttttctgc

SEQ ID NO: 495661 - DNA, 25 bp, Rattus norvegicus
aggaatatggcatctaaagggtccc

SEQ ID NO: 495662 - DNA, 25 bp, Rattus norvegicus
cttctaggaggaggaatatggcatc

SEQ ID NO: 495663 - DNA, 25 bp, Rattus norvegicus
gactttgtcggtggccttctaggag

SEQ ID NO: 495664 - DNA, 25 bp, Rattus norvegicus
ccctcctgcggcgtggactttgtcg

SEQ ID NO: 495665 - DNA, 25 bp, Rattus norvegicus
cttgccgtctggttttctgcctctt

SEQ ID NO: 495666 - DNA, 25 bp, Rattus norvegicus
tcgcgagaccttaaagcgacggtta

SEQ ID NO: 495667 - DNA, 25 bp, Rattus norvegicus
gttcgggtcggatttcagtctcacc

SEQ ID NO: 495668 - DNA, 25 bp, Rattus norvegicus
ggatgtcattttttccagcaagttg

SEQ ID NO: 495669 - DNA, 25 bp, Rattus norvegicus
tggtacgaagcgctcgccatgttgc

SEQ ID NO: 495670 - DNA, 25 bp, Rattus norvegicus
aaggcgcttcgacacgacgtccagt

SEQ ID NO: 495671 - DNA, 25 bp, Rattus norvegicus
cgccgggaagccagacacttgcgtt

SEQ ID NO: 495672 - DNA, 25 bp, Rattus norvegicus
tccgcactcgcttcttagggcaaga

SEQ ID NO: 495673 - DNA, 25 bp, Rattus norvegicus
gcgctctacgcaggcgcggttcaca

SEQ ID NO: 495674 - DNA, 25 bp, Rattus norvegicus
ggacgctcccattggttctgtcgga

SEQ ID NO: 495675 - DNA, 25 bp, Rattus norvegicus
ttctgtcggatgtctgtctttgcgc

SEQ ID NO: 495676 - DNA, 25 bp, Rattus norvegicus
aatagctccttgctcctccgtacga

SEQ ID NO: 495677 - DNA, 25 bp, Rattus norvegicus
ctcaagggccttttctcgcgagacc

SEQ ID NO: 495678 - DNA, 25 bp, Rattus norvegicus
cgtacaaggccggaattctgaaata

SEQ ID NO: 495679 - DNA, 25 bp, Rattus norvegicus
ccgcctttcgggaggaatgacaacg

SEQ ID NO: 495680 - DNA, 25 bp, Rattus norvegicus
ggaagctcgggtgcgttcaagatac

SEQ ID NO: 495681 - DNA, 25 bp, Rattus norvegicus
cgggtgcgttcaagatactgcgtca

SEQ ID NO: 495682 - DNA, 25 bp, Rattus norvegicus
cgttcaagatactgcgtcacccgtg

SEQ ID NO: 495683 - DNA, 25 bp, Rattus norvegicus
agatactgcgtcacccgtgatccac

SEQ ID NO: 495684 - DNA, 25 bp, Rattus norvegicus
catggccgaggaaggcatagctgct

SEQ ID NO: 495685 - DNA, 25 bp, Rattus norvegicus
tgaagaccgcccttattctcgatgg

SEQ ID NO: 495686 - DNA, 25 bp, Rattus norvegicus
cttattctcgatggcctagtacgtg

SEQ ID NO: 495687 - DNA, 25 bp, Rattus norvegicus
tctcgatggcctagtacgtggcata

SEQ ID NO: 495688 - DNA, 25 bp, Rattus norvegicus
tgccgaagcctcagacaagcgccaa

SEQ ID NO: 495689 - DNA, 25 bp, Rattus norvegicus
gccaccaagtcgtggggaggcggaa

SEQ ID NO: 495690 - DNA, 25 bp, Rattus norvegicus
cgacgagcccgtgtgtgtcaagatg

SEQ ID NO: 495691 - DNA, 25 bp, Rattus norvegicus
aggcatagctgctggagatgtaatg

SEQ ID NO: 495692 - DNA, 25 bp, Rattus norvegicus
catccgactgcgacgagcccgtgtg

SEQ ID NO: 495693 - DNA, 25 bp, Rattus norvegicus
cgcccttattctcgatggcctagta

SEQ ID NO: 495694 - DNA, 25 bp, Rattus norvegicus
agctcccgaagacctgtcctcgagt

SEQ ID NO: 495695 - DNA, 25 bp, Rattus norvegicus
cctgcagaggacctagagggaactc

SEQ ID NO: 495696 - DNA, 25 bp, Rattus norvegicus
ggacctagagggaactccagcttct

SEQ ID NO: 495697 - DNA, 25 bp, Rattus norvegicus
ggggagaatcttgcaatgctttaag

SEQ ID NO: 495698 - DNA, 25 bp, Rattus norvegicus
cttgcaatgctttaagtgacttttc

SEQ ID NO: 495699 - DNA, 25 bp, Rattus norvegicus
ccggggaaagattttgttctgcctg

SEQ ID NO: 495700 - DNA, 25 bp, Rattus norvegicus
tgcgacaagcaacttttcgcccggg

SEQ ID NO: 495701 - DNA, 25 bp, Rattus norvegicus
acagtgctgcgacaagcaacttttc

SEQ ID NO: 495702 - DNA, 25 bp, Rattus norvegicus
gcaagggaacagtgctgcgacaagc

SEQ ID NO: 495703 - DNA, 25 bp, Rattus norvegicus
cttgcgaaatccgagaggggatttg

SEQ ID NO: 495704 - DNA, 25 bp, Rattus norvegicus
aggtggcaccttgcgaaatccgaga

SEQ ID NO: 495705 - DNA, 25 bp, Rattus norvegicus
tcccggccaggtggcaccttgcgaa

SEQ ID NO: 495706 - DNA, 25 bp, Rattus norvegicus
aaagattttgttctgcctgcagagg

SEQ ID NO: 495707 - DNA, 25 bp, Rattus norvegicus
acctgtcctcgagtccgcaagggag

SEQ ID NO: 495708 - DNA, 25 bp, Rattus norvegicus
tgtccggtcaggaaagaaatacgta

SEQ ID NO: 495709 - DNA, 25 bp, Rattus norvegicus
ccacgactggatcagagagggtttc

SEQ ID NO: 495710 - DNA, 25 bp, Rattus norvegicus
gctggaatccgggaaagccgccacc

SEQ ID NO: 495711 - DNA, 25 bp, Rattus norvegicus
tgacccaggagaccagccaagaaaa

SEQ ID NO: 495712 - DNA, 25 bp, Rattus norvegicus
agtcctcgccttgggacgtgaccca

SEQ ID NO: 495713 - DNA, 25 bp, Rattus norvegicus
atgaaccgttctgtcagtcctcgcc

SEQ ID NO: 495714 - DNA, 25 bp, Rattus norvegicus
cagagagggtttcggtacatctttt

SEQ ID NO: 495715 - DNA, 25 bp, Rattus norvegicus
cgcggaaattcagctccacgacggc

SEQ ID NO: 495716 - DNA, 25 bp, Rattus norvegicus
cccacgctgagaagcagagacgtcg

SEQ ID NO: 495717 - DNA, 25 bp, Rattus norvegicus
agcgagtgtggcgacagcgtaccac

SEQ ID NO: 495718 - DNA, 25 bp, Rattus norvegicus
tatccaggatcgtgcacagctcgcc

SEQ ID NO: 495719 - DNA, 25 bp, Rattus norvegicus
agcggaccatcgcagctatccagga

SEQ ID NO: 495720 - DNA, 25 bp, Rattus norvegicus
cctgtcctcttgttatgaaccgttc

SEQ ID NO: 495721 - DNA, 25 bp, Rattus norvegicus
acggctgcccggagcttgcaacact

SEQ ID NO: 495722 - DNA, 25 bp, Rattus norvegicus
ttacgcgatggggacgtacaattgg

SEQ ID NO: 495723 - DNA, 25 bp, Rattus norvegicus
gcttggggcacagctcttacacctg

SEQ ID NO: 495724 - DNA, 25 bp, Rattus norvegicus
tcaagtcttacgcagcccatacctg

SEQ ID NO: 495725 - DNA, 25 bp, Rattus norvegicus
gtaaccttttcaagtcttacgcagc

SEQ ID NO: 495726 - DNA, 25 bp, Rattus norvegicus
ggcacctctcgaatttaaggttgtc

SEQ ID NO: 495727 - DNA, 25 bp, Rattus norvegicus
aagtgcccgactttcgccctgtctg

SEQ ID NO: 495728 - DNA, 25 bp, Rattus norvegicus
tgtctgcgctctccctattggtgga

SEQ ID NO: 495729 - DNA, 25 bp, Rattus norvegicus
ccggggtccaccttttcagagagct

SEQ ID NO: 495730 - DNA, 25 bp, Rattus norvegicus
ccaatcattggctggttacgcgatg

SEQ ID NO: 495731 - DNA, 25 bp, Rattus norvegicus
gacgtacaattggtcgccttttcta

SEQ ID NO: 495732 - DNA, 25 bp, Rattus norvegicus
gccttttctatcgttaggccatgca

SEQ ID NO: 495733 - DNA, 25 bp, Rattus norvegicus
ttcagagagctgtggaaagtggcca

SEQ ID NO: 495734 - DNA, 25 bp, Rattus norvegicus
tggtctccaggaagtgcccgacttt

SEQ ID NO: 495735 - DNA, 25 bp, Rattus norvegicus
cctattggtggaacagaatccgctc

SEQ ID NO: 495736 - DNA, 25 bp, Rattus norvegicus
tgcacattcgcatgggtatgtggcg

SEQ ID NO: 495737 - DNA, 25 bp, Rattus norvegicus
cagcgtgcacattcgcatgggtatg

SEQ ID NO: 495738 - DNA, 25 bp, Rattus norvegicus
tggctgatacggacccgcgctatcc

SEQ ID NO: 495739 - DNA, 25 bp, Rattus norvegicus
cataggtaccttttcgatgggtggg

SEQ ID NO: 495740 - DNA, 25 bp, Rattus norvegicus
cccgctcttccatcgaggatgactt

SEQ ID NO: 495741 - DNA, 25 bp, Rattus norvegicus
tgacgacatggctgatacggacccg

SEQ ID NO: 495742 - DNA, 25 bp, Rattus norvegicus
tctgtctggcggcactcccggaagt

SEQ ID NO: 495743 - DNA, 25 bp, Rattus norvegicus
tcggctagttctgtctggcggcact

SEQ ID NO: 495744 - DNA, 25 bp, Rattus norvegicus
ccagcaaggccgctcggctagttct

SEQ ID NO: 495745 - DNA, 25 bp, Rattus norvegicus
actggttcggcgctcgctccagcaa

SEQ ID NO: 495746 - DNA, 25 bp, Rattus norvegicus
tttaccaaacgaagggagcggtgca

SEQ ID NO: 495747 - DNA, 25 bp, Rattus norvegicus
gagcggtgcataggtaccttttcga

SEQ ID NO: 495748 - DNA, 25 bp, Rattus norvegicus
cgtcggccagcgtgcacattcgcat

SEQ ID NO: 495749 - DNA, 25 bp, Rattus norvegicus
aggatgacttcaactatggcagctg

SEQ ID NO: 495750 - DNA, 25 bp, Rattus norvegicus
tctcaaagactacgcctcccaaaaa

SEQ ID NO: 495751 - DNA, 25 bp, Rattus norvegicus
gatccgcccgggctctcaaagacta

SEQ ID NO: 495752 - DNA, 25 bp, Rattus norvegicus
gggatcacgagagcagatccgcccg

SEQ ID NO: 495753 - DNA, 25 bp, Rattus norvegicus
tcccaaaaatcccagcatgctgtgc

SEQ ID NO: 495754 - DNA, 25 bp, Rattus norvegicus
agcttccggttggtgtcccactcgt

SEQ ID NO: 495755 - DNA, 25 bp, Rattus norvegicus
tgtcccactcgtggtgtgcggtcgt

SEQ ID NO: 495756 - DNA, 25 bp, Rattus norvegicus
cggtcgtgtatctcaggtgagttgc

SEQ ID NO: 495757 - DNA, 25 bp, Rattus norvegicus
aactcagatctggagggctggctcg

SEQ ID NO: 495758 - DNA, 25 bp, Rattus norvegicus
ctggctcggaaactgcctcctcggt

SEQ ID NO: 495759 - DNA, 25 bp, Rattus norvegicus
aaactgcctcctcggtgaatcccgg

SEQ ID NO: 495760 - DNA, 25 bp, Rattus norvegicus
gaccaggatgttcttggcggcgcca

SEQ ID NO: 495761 - DNA, 25 bp, Rattus norvegicus
ctcgcggcgctcaggcagatttcga

SEQ ID NO: 495762 - DNA, 25 bp, Rattus norvegicus
tcaggcagatttcgacccgcagggt

SEQ ID NO: 495763 - DNA, 25 bp, Rattus norvegicus
gttgcgtgggctttgaactcagatc

SEQ ID NO: 495764 - DNA, 25 bp, Rattus norvegicus
ttccaaagctccctgggcgaagcgc

SEQ ID NO: 495765 - DNA, 25 bp, Rattus norvegicus
ctcacaatagcgaaagtcccggtcc

SEQ ID NO: 495766 - DNA, 25 bp, Rattus norvegicus
gccgctccaggactgctcacaatag

SEQ ID NO: 495767 - DNA, 25 bp, Rattus norvegicus
agcggctgacaaagcgacgctttta

SEQ ID NO: 495768 - DNA, 25 bp, Rattus norvegicus
cccggtcgccaaaagcggctgacaa

SEQ ID NO: 495769 - DNA, 25 bp, Rattus norvegicus
gctccgcacgcgttctttgtcggga

SEQ ID NO: 495770 - DNA, 25 bp, Rattus norvegicus
ggacatgggaagactgctctgctca

SEQ ID NO: 495771 - DNA, 25 bp, Rattus norvegicus
gctactgtgcactctccttccaaag

SEQ ID NO: 495772 - DNA, 25 bp, Rattus norvegicus
gggaagcgaccctagctactgtgca

SEQ ID NO: 495773 - DNA, 25 bp, Rattus norvegicus
ctcgccaaggaggacgctaaaactt

SEQ ID NO: 495774 - DNA, 25 bp, Rattus norvegicus
gccggctgcacgcttaattagttgc

SEQ ID NO: 495775 - DNA, 25 bp, Rattus norvegicus
tgagcgcaacgcacagctctgcaat

SEQ ID NO: 495776 - DNA, 25 bp, Rattus norvegicus
ttaaagatcccgaggagcaaccgga

SEQ ID NO: 495777 - DNA, 25 bp, Rattus norvegicus
cagctcggcgggcttttaaagatcc

SEQ ID NO: 495778 - DNA, 25 bp, Rattus norvegicus
ggccggcgcacaaacacagcgtgca

SEQ ID NO: 495779 - DNA, 25 bp, Rattus norvegicus
tccagaagcattcagggtcaatcgc

SEQ ID NO: 495780 - DNA, 25 bp, Rattus norvegicus
cgagccgtgcccgaagtttccagaa

SEQ ID NO: 495781 - DNA, 25 bp, Rattus norvegicus
ccagcccgggatgcaagttttctga

SEQ ID NO: 495782 - DNA, 25 bp, Rattus norvegicus
ccggccagaggcaacgttcgaaaca

SEQ ID NO: 495783 - DNA, 25 bp, Rattus norvegicus
ttcgaaacacaactgcctgggcagc

SEQ ID NO: 495784 - DNA, 25 bp, Rattus norvegicus
atgaccatctcagagttaccctagg

SEQ ID NO: 495785 - DNA, 25 bp, Rattus norvegicus
cccgactctgctccactgagaagag

SEQ ID NO: 495786 - DNA, 25 bp, Rattus norvegicus
tgcacgaagatacacgcgcccacgg

SEQ ID NO: 495787 - DNA, 25 bp, Rattus norvegicus
cgcccacgggtgtgaccgcagacat

SEQ ID NO: 495788 - DNA, 25 bp, Rattus norvegicus
gttaccctaggaagcttggcctcta

SEQ ID NO: 495789 - DNA, 25 bp, Rattus norvegicus
ccgcagacatgcttgcacgcagatg

SEQ ID NO: 495790 - DNA, 25 bp, Rattus norvegicus
cacacttcactggtaaacacgcacg

SEQ ID NO: 495791 - DNA, 25 bp, Rattus norvegicus
ggtcaatcgccgctgtctagtattt

SEQ ID NO: 495792 - DNA, 25 bp, Rattus norvegicus
ggcccagcttggttctcacgatccg

SEQ ID NO: 495793 - DNA, 25 bp, Rattus norvegicus
accgagcgtgtcaggatgctccaac

SEQ ID NO: 495794 - DNA, 25 bp, Rattus norvegicus
agtctgttctgtgcactgggtcaga

SEQ ID NO: 495795 - DNA, 25 bp, Rattus norvegicus
gcgcctttgaagtctcggcagcaga

SEQ ID NO: 495796 - DNA, 25 bp, Rattus norvegicus
cttgtcaggggctatcgtatggata

SEQ ID NO: 495797 - DNA, 25 bp, Rattus norvegicus
tgcgcgggacatagtctcggtgaaa

SEQ ID NO: 495798 - DNA, 25 bp, Rattus norvegicus
ggcgtctgccgagcatcggaattcg

SEQ ID NO: 495799 - DNA, 25 bp, Rattus norvegicus
cgaatgagagcacgtgggtgatacc

SEQ ID NO: 495800 - DNA, 25 bp, Rattus norvegicus
cgtatggatagacccgaggccattt

SEQ ID NO: 495801 - DNA, 25 bp, Rattus norvegicus
gaggccatttcggtacccgagcagc

SEQ ID NO: 495802 - DNA, 25 bp, Rattus norvegicus
aaaggcgaccctgaacgagtcacgg

SEQ ID NO: 495803 - DNA, 25 bp, Rattus norvegicus
gggcaccgtccctaaatgtgagcca

SEQ ID NO: 495804 - DNA, 25 bp, Rattus norvegicus
tgcaagcagagaaaaggcgaccctg

SEQ ID NO: 495805 - DNA, 25 bp, Rattus norvegicus
tggtacacgtgagagaacccggcgt

SEQ ID NO: 495806 - DNA, 25 bp, Rattus norvegicus
ctctgaagatagtagaggaagaatg

SEQ ID NO: 495807 - DNA, 25 bp, Rattus norvegicus
aagaatgggatgaggaatggtccaa

SEQ ID NO: 495808 - DNA, 25 bp, Rattus norvegicus
gatgaggaatggtccaaggtcagac

SEQ ID NO: 495809 - DNA, 25 bp, Rattus norvegicus
atgaggaatggtccaaggtcagact

SEQ ID NO: 495810 - DNA, 25 bp, Rattus norvegicus
atcctctgaagatagtagaggaaga

SEQ ID NO: 495811 - DNA, 25 bp, Rattus norvegicus
tgaggaatggtccaaggtcagactg

SEQ ID NO: 495812 - DNA, 25 bp, Rattus norvegicus
gaggaatggtccaaggtcagactgg

SEQ ID NO: 495813 - DNA, 25 bp, Rattus norvegicus
tcagactgggaggtgaatagtgact

SEQ ID NO: 495814 - DNA, 25 bp, Rattus norvegicus
gaggtgaatagtgactggactgtaa

SEQ ID NO: 495815 - DNA, 25 bp, Rattus norvegicus
ctgtaaaaaagattaaggctctaag

SEQ ID NO: 495816 - DNA, 25 bp, Rattus norvegicus
acatcctctgaagatagtagaggaa

SEQ ID NO: 495817 - DNA, 25 bp, Rattus norvegicus
taaaaaagattaaggctctaagatc

SEQ ID NO: 495818 - DNA, 25 bp, Rattus norvegicus
aaaagattaaggctctaagatctgt

SEQ ID NO: 495819 - DNA, 25 bp, Rattus norvegicus
tgtaaaaaagattaaggctctaaga

SEQ ID NO: 495820 - DNA, 25 bp, Rattus norvegicus
ccattcacgggcgaggcaacttccc

SEQ ID NO: 495821 - DNA, 25 bp, Rattus norvegicus
ggctctaagatctgttagtcctccc

SEQ ID NO: 495822 - DNA, 25 bp, Rattus norvegicus
tctaagatctgttagtcctccctgc

SEQ ID NO: 495823 - DNA, 25 bp, Rattus norvegicus
gagttgttccctgggtttgcctcgc

SEQ ID NO: 495824 - DNA, 25 bp, Rattus norvegicus
ccgccttggcccgtgcacagccact

SEQ ID NO: 495825 - DNA, 25 bp, Rattus norvegicus
cgccttcaccattcccgggtctctg

SEQ ID NO: 495826 - DNA, 25 bp, Rattus norvegicus
cgggtgaatgatgccgtcggagagt

SEQ ID NO: 495827 - DNA, 25 bp, Rattus norvegicus
gaccggtgcagcctcggcagtggcc

SEQ ID NO: 495828 - DNA, 25 bp, Rattus norvegicus
gcggcccggacctggaggcctcctc

SEQ ID NO: 495829 - DNA, 25 bp, Rattus norvegicus
ctctgggacggcaccagagccgact

SEQ ID NO: 495830 - DNA, 25 bp, Rattus norvegicus
ttgttccctgggtttgcctcgccgc

SEQ ID NO: 495831 - DNA, 25 bp, Rattus norvegicus
ctgagcgtgcaaccccagcagattg

SEQ ID NO: 495832 - DNA, 25 bp, Rattus norvegicus
cggcctctctgggacggcaccagag

SEQ ID NO: 495833 - DNA, 25 bp, Rattus norvegicus
cccgtgcacagccactctccctgcc

SEQ ID NO: 495834 - DNA, 25 bp, Rattus norvegicus
gcccttggaccatggaggacgtgaa

SEQ ID NO: 495835 - DNA, 25 bp, Rattus norvegicus
cttgtcgcctctgccagcccggggg

SEQ ID NO: 495836 - DNA, 25 bp, Rattus norvegicus
cccttggaccatggaggacgtgaaa

SEQ ID NO: 495837 - DNA, 25 bp, Rattus norvegicus
tgccatccgccttcctgtcgcagcc

SEQ ID NO: 495838 - DNA, 25 bp, Rattus norvegicus
ccatggaggacgtgaaactggagtt

SEQ ID NO: 495839 - DNA, 25 bp, Rattus norvegicus
tcgctcccgcagtgcaaagacgacg

SEQ ID NO: 495840 - DNA, 25 bp, Rattus norvegicus
cgtgaaactggagttcccctcgctc

SEQ ID NO: 495841 - DNA, 25 bp, Rattus norvegicus
tggaggacgtgaaactggagttccc

SEQ ID NO: 495842 - DNA, 25 bp, Rattus norvegicus
atggaggacgtgaaactggagttcc

SEQ ID NO: 495843 - DNA, 25 bp, Rattus norvegicus
catggaggacgtgaaactggagttc

SEQ ID NO: 495844 - DNA, 25 bp, Rattus norvegicus
ccttggaccatggaggacgtgaaac

SEQ ID NO: 495845 - DNA, 25 bp, Rattus norvegicus
cttggaccatggaggacgtgaaact

SEQ ID NO: 495846 - DNA, 25 bp, Rattus norvegicus
ttggaccatggaggacgtgaaactg

SEQ ID NO: 495847 - DNA, 25 bp, Rattus norvegicus
accatggaggacgtgaaactggagt

SEQ ID NO: 495848 - DNA, 25 bp, Rattus norvegicus
gggcacattcgggtcccaagctgac

SEQ ID NO: 495849 - DNA, 25 bp, Rattus norvegicus
tcccaagctgacttggagggttgga

SEQ ID NO: 495850 - DNA, 25 bp, Rattus norvegicus
aggcggagactcaccacgcggcgta

SEQ ID NO: 495851 - DNA, 25 bp, Rattus norvegicus
tcaccacgcggcgtagtggccgcga

SEQ ID NO: 495852 - DNA, 25 bp, Rattus norvegicus
gcctcagctgtcgagaggtccgaga

SEQ ID NO: 495853 - DNA, 25 bp, Rattus norvegicus
gaagaggagccaccgctgtccgatc

SEQ ID NO: 495854 - DNA, 25 bp, Rattus norvegicus
gcatgacgggaaattcctgggcacg

SEQ ID NO: 495855 - DNA, 25 bp, Rattus norvegicus
gcggcagagtccaaatatgagcata

SEQ ID NO: 495856 - DNA, 25 bp, Rattus norvegicus
gtccaccgcgcactccggggaagag

SEQ ID NO: 495857 - DNA, 25 bp, Rattus norvegicus
cgtctctggggtccgcccgagatct

SEQ ID NO: 495858 - DNA, 25 bp, Rattus norvegicus
tcgcctgacctcgttttgagctgtc

SEQ ID NO: 495859 - DNA, 25 bp, Rattus norvegicus
tttgagctgtccctcgttggtgcgg

SEQ ID NO: 495860 - DNA, 25 bp, Rattus norvegicus
agggacgcgccctccgagctgcagt

SEQ ID NO: 495861 - DNA, 25 bp, Rattus norvegicus
agggtacgagctctttcgcctgacc

SEQ ID NO: 495862 - DNA, 25 bp, Rattus norvegicus
gctcttcctcgcgaagcttcttcag

SEQ ID NO: 495863 - DNA, 25 bp, Rattus norvegicus
cggctgccgccagatttagcagtca

SEQ ID NO: 495864 - DNA, 25 bp, Rattus norvegicus
cctgaactgaagtctcctgccggct

SEQ ID NO: 495865 - DNA, 25 bp, Rattus norvegicus
tcgaggtttcggctcctgtctagac

SEQ ID NO: 495866 - DNA, 25 bp, Rattus norvegicus
taatacctgtctagccgaggccacg

SEQ ID NO: 495867 - DNA, 25 bp, Rattus norvegicus
ccgagtaatgctcccggcagctgta

SEQ ID NO: 495868 - DNA, 25 bp, Rattus norvegicus
tccgactcgtcggagctaaagccca

SEQ ID NO: 495869 - DNA, 25 bp, Rattus norvegicus
agaccggccgagtgctctctgtcac

SEQ ID NO: 495870 - DNA, 25 bp, Rattus norvegicus
gttattactgttccgcgtcttgttg

SEQ ID NO: 495871 - DNA, 25 bp, Rattus norvegicus
ttcagcttcttgaggtagaccggcc

SEQ ID NO: 495872 - DNA, 25 bp, Rattus norvegicus
tcagcgcggagaacggcttactatg

SEQ ID NO: 495873 - DNA, 25 bp, Rattus norvegicus
cttactatggctccgtctgggtcga

SEQ ID NO: 495874 - DNA, 25 bp, Rattus norvegicus
ggagtcgtcctttaatacctgtcta

SEQ ID NO: 495875 - DNA, 25 bp, Rattus norvegicus
cggccgccgtgttattgttattact

SEQ ID NO: 495876 - DNA, 25 bp, Rattus norvegicus
ctcagaaatccttttgggcgcgttt

SEQ ID NO: 495877 - DNA, 25 bp, Rattus norvegicus
cggagactggagacttgcacgccca

SEQ ID NO: 495878 - DNA, 25 bp, Rattus norvegicus
agtgacgactcagaaatccttttgg

SEQ ID NO: 495879 - DNA, 25 bp, Rattus norvegicus
tgggcgcgtttctcggttgtgtccc

SEQ ID NO: 495880 - DNA, 25 bp, Rattus norvegicus
cttcatttacctggcgctggcgaga

SEQ ID NO: 495881 - DNA, 25 bp, Rattus norvegicus
caatgctcgccggtgccagcagttc

SEQ ID NO: 495882 - DNA, 25 bp, Rattus norvegicus
tccacacgtgcctcttcgggtggca

SEQ ID NO: 495883 - DNA, 25 bp, Rattus norvegicus
ggtgccagcagttcccgcggatcct

SEQ ID NO: 495884 - DNA, 25 bp, Rattus norvegicus
agtgtgatcctcgaactgctggcgc

SEQ ID NO: 495885 - DNA, 25 bp, Rattus norvegicus
ggacgtgctggcatcgccagctttg

SEQ ID NO: 495886 - DNA, 25 bp, Rattus norvegicus
atcgccagctttgccagcatcgtgt

SEQ ID NO: 495887 - DNA, 25 bp, Rattus norvegicus
ttgccagcatcgtgtctctgcggtc

SEQ ID NO: 495888 - DNA, 25 bp, Rattus norvegicus
aggctcactcgcaccggagactgga

SEQ ID NO: 495889 - DNA, 25 bp, Rattus norvegicus
gcggatcctccctctcgagtgtgat

SEQ ID NO: 495890 - DNA, 25 bp, Rattus norvegicus
acattgctcaggatggtgcccacgc

SEQ ID NO: 495891 - DNA, 25 bp, Rattus norvegicus
ggatcagagagagccgatgagcttc

SEQ ID NO: 495892 - DNA, 25 bp, Rattus norvegicus
tgcggagcccaaacgtctgagaccc

SEQ ID NO: 495893 - DNA, 25 bp, Rattus norvegicus
accgtgcatggaggctaagctcata

SEQ ID NO: 495894 - DNA, 25 bp, Rattus norvegicus
ggccgctgaatgcacccaggccagg

SEQ ID NO: 495895 - DNA, 25 bp, Rattus norvegicus
aggccgacggtgttccgcagacacc

SEQ ID NO: 495896 - DNA, 25 bp, Rattus norvegicus
tgcagctgcgcttcttgagcacatt

SEQ ID NO: 495897 - DNA, 25 bp, Rattus norvegicus
ggcttctgcagaacggcgcattctc

SEQ ID NO: 495898 - DNA, 25 bp, Rattus norvegicus
acgcagggagctggtcagtttgtcc

SEQ ID NO: 495899 - DNA, 25 bp, Rattus norvegicus
tcagtttgtcctgccgcatccgaga

SEQ ID NO: 495900 - DNA, 25 bp, Rattus norvegicus
tggaacgactctgcacgcagggctc

SEQ ID NO: 495901 - DNA, 25 bp, Rattus norvegicus
ctccctggagagctgcgaacgcgca

SEQ ID NO: 495902 - DNA, 25 bp, Rattus norvegicus
tggcatctgcagtgcggagcccaaa

SEQ ID NO: 495903 - DNA, 25 bp, Rattus norvegicus
tcacccggctccaaggtgcagagca

SEQ ID NO: 495904 - DNA, 25 bp, Rattus norvegicus
tgcgacttgatgctctccaggcgca

SEQ ID NO: 495905 - DNA, 25 bp, Rattus norvegicus
aatggggcgtgcactcaactccgct

SEQ ID NO: 495906 - DNA, 25 bp, Rattus norvegicus
cttctccgctcaaaaaagttgtgtg

SEQ ID NO: 495907 - DNA, 25 bp, Rattus norvegicus
cccaatccgtcaagttttcgcagaa

SEQ ID NO: 495908 - DNA, 25 bp, Rattus norvegicus
tcaagttttcgcagaaagggcttcc

SEQ ID NO: 495909 - DNA, 25 bp, Rattus norvegicus
cacttactctcctgggccatgctta

SEQ ID NO: 495910 - DNA, 25 bp, Rattus norvegicus
tgggccatgcttatgaccgtctcgg

SEQ ID NO: 495911 - DNA, 25 bp, Rattus norvegicus
accgtctcggtggtagcgtggtact

SEQ ID NO: 495912 - DNA, 25 bp, Rattus norvegicus
gcgtggtactcgtcctcttccaaga

SEQ ID NO: 495913 - DNA, 25 bp, Rattus norvegicus
tcttccaagaagtcctcgggctgca

SEQ ID NO: 495914 - DNA, 25 bp, Rattus norvegicus
tcgccttggaagtcgtgcagatcca

SEQ ID NO: 495915 - DNA, 25 bp, Rattus norvegicus
accacctcccggctgatgttgggcg

SEQ ID NO: 495916 - DNA, 25 bp, Rattus norvegicus
agtttgctcaggatctgcgacttga

SEQ ID NO: 495917 - DNA, 25 bp, Rattus norvegicus
gcgcctccttgagccgcagtttgct

SEQ ID NO: 495918 - DNA, 25 bp, Rattus norvegicus
gggcaactagcacaggtggacaagc

SEQ ID NO: 495919 - DNA, 25 bp, Rattus norvegicus
ccggcaggggtcgaaatgccaacca

SEQ ID NO: 495920 - DNA, 25 bp, Rattus norvegicus
ggccacgcgggcagtaaagagtccc

SEQ ID NO: 495921 - DNA, 25 bp, Rattus norvegicus
ggaaggacctccatgactcgaaccg

SEQ ID NO: 495922 - DNA, 25 bp, Rattus norvegicus
ggcttgctgcgagtcccacatcctg

SEQ ID NO: 495923 - DNA, 25 bp, Rattus norvegicus
tgtgcaactgtagagctccgtgagc

SEQ ID NO: 495924 - DNA, 25 bp, Rattus norvegicus
atcctcctcctctgtgcaactgtag

SEQ ID NO: 495925 - DNA, 25 bp, Rattus norvegicus
agctgtccaggctgtccttgcgcag

SEQ ID NO: 495926 - DNA, 25 bp, Rattus norvegicus
aacccgaggtctcagtggagctgtc

SEQ ID NO: 495927 - DNA, 25 bp, Rattus norvegicus
gagacgccacactctccgggtgtgc

SEQ ID NO: 495928 - DNA, 25 bp, Rattus norvegicus
tactgcatctggagccgcaggctcg

SEQ ID NO: 495929 - DNA, 25 bp, Rattus norvegicus
tacacgtggtgcaagtgggcaacta

SEQ ID NO: 495930 - DNA, 25 bp, Rattus norvegicus
atgccaaccaatgggcggaggcccg

SEQ ID NO: 495931 - DNA, 25 bp, Rattus norvegicus
agctcctgcagcactcgggagtcgc

SEQ ID NO: 495932 - DNA, 25 bp, Rattus norvegicus
tcctgacttcatctccagttcgctg

SEQ ID NO: 495933 - DNA, 25 bp, Rattus norvegicus
tcttccgtgagcttggacgggtctc

SEQ ID NO: 495934 - DNA, 25 bp, Rattus norvegicus
cccggactttaaccagcagctgatc

SEQ ID NO: 495935 - DNA, 25 bp, Rattus norvegicus
gctgatcttatgcacgcagcacgtg

SEQ ID NO: 495936 - DNA, 25 bp, Rattus norvegicus
agatgggccgactgcctcctgactt

SEQ ID NO: 495937 - DNA, 25 bp, Rattus norvegicus
cagttcgctgtcgagcttcctccag

SEQ ID NO: 495938 - DNA, 25 bp, Rattus norvegicus
ccagcttcaggggtaggcctgacca

SEQ ID NO: 495939 - DNA, 25 bp, Rattus norvegicus
ctacggccgtccgtcatgtgatggc

SEQ ID NO: 495940 - DNA, 25 bp, Rattus norvegicus
tgatcgcgcctagggagagaaagct

SEQ ID NO: 495941 - DNA, 25 bp, Rattus norvegicus
gagaaagcttgacccgcatctcctg

SEQ ID NO: 495942 - DNA, 25 bp, Rattus norvegicus
aggcccaacgtgttgctgctgctca

SEQ ID NO: 495943 - DNA, 25 bp, Rattus norvegicus
tgctgctcacggacgaccaggacgc

SEQ ID NO: 495944 - DNA, 25 bp, Rattus norvegicus
ggcggcatggtaactcccgtccacg

SEQ ID NO: 495945 - DNA, 25 bp, Rattus norvegicus
acgtgcgtcgcttccctctggagag

SEQ ID NO: 495946 - DNA, 25 bp, Rattus norvegicus
cagagtcccttgtgccaatccgtga

SEQ ID NO: 495947 - DNA, 25 bp, Rattus norvegicus
ttcatgcgtccatgtactccagggc

SEQ ID NO: 495948 - DNA, 25 bp, Rattus norvegicus
tccatgtactccagggcgtgcccga

SEQ ID NO: 495949 - DNA, 25 bp, Rattus norvegicus
caggctcacagcttgcaagaggtaa

SEQ ID NO: 495950 - DNA, 25 bp, Rattus norvegicus
caagcttgcagagtcccttgtgcca

SEQ ID NO: 495951 - DNA, 25 bp, Rattus norvegicus
tgtgccaatccgtgaggcgcaggct

SEQ ID NO: 495952 - DNA, 25 bp, Rattus norvegicus
ctgctgcgtgaccaggctcagaact

SEQ ID NO: 495953 - DNA, 25 bp, Rattus norvegicus
gacgcgcacaggctcacagcttgca

SEQ ID NO: 495954 - DNA, 25 bp, Rattus norvegicus
ccaggctcagaactgtgtgtacaga

SEQ ID NO: 495955 - DNA, 25 bp, Rattus norvegicus
aacgtcgcttaacagaacaagcttg

SEQ ID NO: 495956 - DNA, 25 bp, Rattus norvegicus
atcaatgcggctctctcatgcgtcc

SEQ ID NO: 495957 - DNA, 25 bp, Rattus norvegicus
agcttgcaagaggtaacgtcgctta

SEQ ID NO: 495958 - DNA, 25 bp, Rattus norvegicus
cgagaagagaggcaatcaatgcggc

SEQ ID NO: 495959 - DNA, 25 bp, Rattus norvegicus
gggcacgaagacagctctccgagaa

SEQ ID NO: 495960 - DNA, 25 bp, Rattus norvegicus
aagcaaactgcagctaggacggcgc

SEQ ID NO: 495961 - DNA, 25 bp, Rattus norvegicus
gaaattccgaattcctaagtgactc

SEQ ID NO: 495962 - DNA, 25 bp, Rattus norvegicus
aagacggctgagttccgcccagctc

SEQ ID NO: 495963 - DNA, 25 bp, Rattus norvegicus
cccacaggccaagacggctgagttc

SEQ ID NO: 495964 - DNA, 25 bp, Rattus norvegicus
catgctgctggtccggttgcgctca

SEQ ID NO: 495965 - DNA, 25 bp, Rattus norvegicus
tgctgtagccgctgctcatgctgct

SEQ ID NO: 495966 - DNA, 25 bp, Rattus norvegicus
gcgtcctcctcgaggctgctgtagc

SEQ ID NO: 495967 - DNA, 25 bp, Rattus norvegicus
tgaagaaaaaatcctccgcgtcctc

SEQ ID NO: 495968 - DNA, 25 bp, Rattus norvegicus
ctctcctgaagaaggaggtcctggc

SEQ ID NO: 495969 - DNA, 25 bp, Rattus norvegicus
tgcccggaggcgctctcctgaagaa

SEQ ID NO: 495970 - DNA, 25 bp, Rattus norvegicus
gccgaaagggcaaaggccactctca

SEQ ID NO: 495971 - DNA, 25 bp, Rattus norvegicus
tcccagcacctttcaggagccgaaa

SEQ ID NO: 495972 - DNA, 25 bp, Rattus norvegicus
gctgccgaaagagccatcccgagtg

SEQ ID NO: 495973 - DNA, 25 bp, Rattus norvegicus
agtgacccggccattacccagaagg

SEQ ID NO: 495974 - DNA, 25 bp, Rattus norvegicus
ctgggatgacccattccttcctcta

SEQ ID NO: 495975 - DNA, 25 bp, Rattus norvegicus
tggcccaaagctttgtttcagaacg

SEQ ID NO: 495976 - DNA, 25 bp, Rattus norvegicus
gtttcagaacgcctgtgccctttcc

SEQ ID NO: 495977 - DNA, 25 bp, Rattus norvegicus
gcccgccactcagggtctgggaaag

SEQ ID NO: 495978 - DNA, 25 bp, Rattus norvegicus
gatctcgcgccagtagcatgcacct

SEQ ID NO: 495979 - DNA, 25 bp, Rattus norvegicus
ccaccagaggcgatcagccagagtc

SEQ ID NO: 495980 - DNA, 25 bp, Rattus norvegicus
ccagcctgggactgctgtttaaatc

SEQ ID NO: 495981 - DNA, 25 bp, Rattus norvegicus
gggactctgtggaatcgccctaaga

SEQ ID NO: 495982 - DNA, 25 bp, Rattus norvegicus
gcggcaattaccgtgcagacagctc

SEQ ID NO: 495983 - DNA, 25 bp, Rattus norvegicus
ctacccggtatcgagtggcccaaag

SEQ ID NO: 495984 - DNA, 25 bp, Rattus norvegicus
gtggccttgagtcgtccgaccaatc

SEQ ID NO: 495985 - DNA, 25 bp, Rattus norvegicus
tacgaacttgctttctgccagacag

SEQ ID NO: 495986 - DNA, 25 bp, Rattus norvegicus
gggcacgcaccaacggagttcactt

SEQ ID NO: 495987 - DNA, 25 bp, Rattus norvegicus
gagttcacttctcgggtggcccttc

SEQ ID NO: 495988 - DNA, 25 bp, Rattus norvegicus
accagaggagctatggaagcgtgca

SEQ ID NO: 495989 - DNA, 25 bp, Rattus norvegicus
ctcttacccagcgagcgtccgccgc

SEQ ID NO: 495990 - DNA, 25 bp, Rattus norvegicus
gtctcatgcccgtatcctcggatga

SEQ ID NO: 495991 - DNA, 25 bp, Rattus norvegicus
gtatcctcggatgagtaaaaccttg

SEQ ID NO: 495992 - DNA, 25 bp, Rattus norvegicus
atgagtaaaaccttgggaacgccag

SEQ ID NO: 495993 - DNA, 25 bp, Rattus norvegicus
cagcggcgagacaactccgggcaga

SEQ ID NO: 495994 - DNA, 25 bp, Rattus norvegicus
aactccgggcagagcagcccttctg

SEQ ID NO: 495995 - DNA, 25 bp, Rattus norvegicus
agagcagcccttctgcccggacgga

SEQ ID NO: 495996 - DNA, 25 bp, Rattus norvegicus
cgggccacgaagcacgtgaccgacg

SEQ ID NO: 495997 - DNA, 25 bp, Rattus norvegicus
ctccggcgcggaccagaggagctat

SEQ ID NO: 495998 - DNA, 25 bp, Rattus norvegicus
tggccttgatcgctttcgcggagta

SEQ ID NO: 495999 - DNA, 25 bp, Rattus norvegicus
ccttgatcgctttcgcggagtagga

SEQ ID NO: 496000 - DNA, 25 bp, Rattus norvegicus
cccaggctacttccggctttgccag

SEQ ID NO: 496001 - DNA, 25 bp, Rattus norvegicus
cgcgtgcgtattccgcggcagccga

SEQ ID NO: 496002 - DNA, 25 bp, Rattus norvegicus
agcggccctcgtccttgtcgctgta

SEQ ID NO: 496003 - DNA, 25 bp, Rattus norvegicus
cctcgtggccactcgggtgatgaaa

SEQ ID NO: 496004 - DNA, 25 bp, Rattus norvegicus
ggtgatgaaacacccggcaaccggc

SEQ ID NO: 496005 - DNA, 25 bp, Rattus norvegicus
cataggacgcttccgagcggaggac

SEQ ID NO: 496006 - DNA, 25 bp, Rattus norvegicus
tcatggaagaagagtgtagacggcc

SEQ ID NO: 496007 - DNA, 25 bp, Rattus norvegicus
gcgccagccctagcctcatggaaga

SEQ ID NO: 496008 - DNA, 25 bp, Rattus norvegicus
ttgtcgctgtagtcctccactacgg

SEQ ID NO: 496009 - DNA, 25 bp, Rattus norvegicus
gcaaccggcagccacgcactaggga

SEQ ID NO: 496010 - DNA, 25 bp, Rattus norvegicus
ttccttgcctgcactcccgaggggt

SEQ ID NO: 496011 - DNA, 25 bp, Rattus norvegicus
gaggaccgcacacgtgctccctgga

SEQ ID NO: 496012 - DNA, 25 bp, Rattus norvegicus
ggatcccttcctgggcgaagcctcg

SEQ ID NO: 496013 - DNA, 25 bp, Rattus norvegicus
gaaaactgcgcaggggcccgctaac

SEQ ID NO: 496014 - DNA, 25 bp, Rattus norvegicus
cccagcgtgcaatgcgcataggacg

SEQ ID NO: 496015 - DNA, 25 bp, Rattus norvegicus
tccctggagctctcagtagggcgtg

SEQ ID NO: 496016 - DNA, 25 bp, Rattus norvegicus
cactcgttcaagtacgtggtgctga

SEQ ID NO: 496017 - DNA, 25 bp, Rattus norvegicus
ttccactgggtgtcttggagtcgta

SEQ ID NO: 496018 - DNA, 25 bp, Rattus norvegicus
acctgcctccggaggtgtacgacgc

SEQ ID NO: 496019 - DNA, 25 bp, Rattus norvegicus
tgtacgacgcggtccgcgcctatga

SEQ ID NO: 496020 - DNA, 25 bp, Rattus norvegicus
cctatgagccgtgcatcgtggtgtc

SEQ ID NO: 496021 - DNA, 25 bp, Rattus norvegicus
cggcgcgcacgaattgccgtctgga

SEQ ID NO: 496022 - DNA, 25 bp, Rattus norvegicus
gaccgactcatctacctgaccgaga

SEQ ID NO: 496023 - DNA, 25 bp, Rattus norvegicus
attgccgtctggacgcgttcttgcg

SEQ ID NO: 496024 - DNA, 25 bp, Rattus norvegicus
tgtcggacgccgagaagcactcgtt

SEQ ID NO: 496025 - DNA, 25 bp, Rattus norvegicus
tggtgctgagcgaccgactcatcta

SEQ ID NO: 496026 - DNA, 25 bp, Rattus norvegicus
ttttgtcagtgaaagcagctacgcg

SEQ ID NO: 496027 - DNA, 25 bp, Rattus norvegicus
ccggacttcccgatctcttttgtca

SEQ ID NO: 496028 - DNA, 25 bp, Rattus norvegicus
cgtggccattgacttggtgaggatc

SEQ ID NO: 496029 - DNA, 25 bp, Rattus norvegicus
gcccaagtccatccggcgggtcgtg

SEQ ID NO: 496030 - DNA, 25 bp, Rattus norvegicus
cttcgggatccgctgctggtctctg

SEQ ID NO: 496031 - DNA, 25 bp, Rattus norvegicus
gaaggaacgagaggccaacaagagc

SEQ ID NO: 496032 - DNA, 25 bp, Rattus norvegicus
aagaactgacgtcaagtccgcgtga

SEQ ID NO: 496033 - DNA, 25 bp, Rattus norvegicus
tcatctgagctaaggcgatggccgc

SEQ ID NO: 496034 - DNA, 25 bp, Rattus norvegicus
cggcctcgagatcctaggctcagga

SEQ ID NO: 496035 - DNA, 25 bp, Rattus norvegicus
gctcaggagccttctagacccttcg

SEQ ID NO: 496036 - DNA, 25 bp, Rattus norvegicus
ttacgacaaggccaaggacaatgtg

SEQ ID NO: 496037 - DNA, 25 bp, Rattus norvegicus
atcttctcttacgacaaggccaagg

SEQ ID NO: 496038 - DNA, 25 bp, Rattus norvegicus
tcttctctcacctgggtatcttctc

SEQ ID NO: 496039 - DNA, 25 bp, Rattus norvegicus
gagacgttcttctctcacctgggta

SEQ ID NO: 496040 - DNA, 25 bp, Rattus norvegicus
cggtgctggagacgttcttctctca

SEQ ID NO: 496041 - DNA, 25 bp, Rattus norvegicus
tcgcatgggggagtctatcccacta

SEQ ID NO: 496042 - DNA, 25 bp, Rattus norvegicus
aggagccttctagacccttcgcctt

SEQ ID NO: 496043 - DNA, 25 bp, Rattus norvegicus
gtccgcgtgacgtcatctgagctaa

SEQ ID NO: 496044 - DNA, 25 bp, Rattus norvegicus
gcgatcgccgcgcaccattgttgag

SEQ ID NO: 496045 - DNA, 25 bp, Rattus norvegicus
gccggcaccatgctctgggctgagc

SEQ ID NO: 496046 - DNA, 25 bp, Rattus norvegicus
gccgcttcctctacggccgccgggc

SEQ ID NO: 496047 - DNA, 25 bp, Rattus norvegicus
atcgccgcgcaccattgttgagacc

SEQ ID NO: 496048 - DNA, 25 bp, Rattus norvegicus
cgcaccattgttgagacccgcgcgg

SEQ ID NO: 496049 - DNA, 25 bp, Rattus norvegicus
caccattgttgagacccgcgcgggg

SEQ ID NO: 496050 - DNA, 25 bp, Rattus norvegicus
aggccgaagggatggcggttctcac

SEQ ID NO: 496051 - DNA, 25 bp, Rattus norvegicus
atggcggttctcacgcgggtgcgat

SEQ ID NO: 496052 - DNA, 25 bp, Rattus norvegicus
agttgacggatctggatctggagcc

SEQ ID NO: 496053 - DNA, 25 bp, Rattus norvegicus
cgcgagggtcctccgctgcctcggt

SEQ ID NO: 496054 - DNA, 25 bp, Rattus norvegicus
ttctccgccgcccactggccgctgc

SEQ ID NO: 496055 - DNA, 25 bp, Rattus norvegicus
gctacacgcgcacccggagccgcgc

SEQ ID NO: 496056 - DNA, 25 bp, Rattus norvegicus
cgcctcccttcctgccggcgcccgg

SEQ ID NO: 496057 - DNA, 25 bp, Rattus norvegicus
gccggccgtgcaaagtcgggcgagt

SEQ ID NO: 496058 - DNA, 25 bp, Rattus norvegicus
gctcgcccaggatgagcagagcttc

SEQ ID NO: 496059 - DNA, 25 bp, Rattus norvegicus
aaacacaggccgcagactggggctg

SEQ ID NO: 496060 - DNA, 25 bp, Rattus norvegicus
tcccgaaacacaggccgcagactgg

SEQ ID NO: 496061 - DNA, 25 bp, Rattus norvegicus
tcagcgttctgtttccgctctccgc

SEQ ID NO: 496062 - DNA, 25 bp, Rattus norvegicus
cctccctgtgggctaagccgggaga

SEQ ID NO: 496063 - DNA, 25 bp, Rattus norvegicus
aggcgtgaggaaaagctttggtcca

SEQ ID NO: 496064 - DNA, 25 bp, Rattus norvegicus
cgcttccaccttaggcgtgaggaaa

SEQ ID NO: 496065 - DNA, 25 bp, Rattus norvegicus
gtcctcgcttccaccttaggcgtga

SEQ ID NO: 496066 - DNA, 25 bp, Rattus norvegicus
tcgcttgcgccgctgtcttcctgga

SEQ ID NO: 496067 - DNA, 25 bp, Rattus norvegicus
atgagcagagcttccgagccgagcc

SEQ ID NO: 496068 - DNA, 25 bp, Rattus norvegicus
actgttgcaggaagctcgcccagga

SEQ ID NO: 496069 - DNA, 25 bp, Rattus norvegicus
tggccactgttgcaggaagctcgcc

SEQ ID NO: 496070 - DNA, 25 bp, Rattus norvegicus
ccagcctcgggtggccactgttgca

SEQ ID NO: 496071 - DNA, 25 bp, Rattus norvegicus
cccgagagatccgagatccgagccc

SEQ ID NO: 496072 - DNA, 25 bp, Rattus norvegicus
tcgcctactcccgaaccagagagaa

SEQ ID NO: 496073 - DNA, 25 bp, Rattus norvegicus
accagagagaaccagacggtgctgg

SEQ ID NO: 496074 - DNA, 25 bp, Rattus norvegicus
ctcctggctcgaggcttccgggcag

SEQ ID NO: 496075 - DNA, 25 bp, Rattus norvegicus
ttcccgcgtcacatgagagagggag

SEQ ID NO: 496076 - DNA, 25 bp, Rattus norvegicus
ctagcccgggtgactcaggccgcag

SEQ ID NO: 496077 - DNA, 25 bp, Rattus norvegicus
agctgttcccgcgtcacatgagaga

SEQ ID NO: 496078 - DNA, 25 bp, Rattus norvegicus
ctgagccgcggtaggagagcatcaa

SEQ ID NO: 496079 - DNA, 25 bp, Rattus norvegicus
ccgtggggacaactttgcctcgaag

SEQ ID NO: 496080 - DNA, 25 bp, Rattus norvegicus
tgcctcgaagttcgcggggcgccac

SEQ ID NO: 496081 - DNA, 25 bp, Rattus norvegicus
cgagtgtcctggatcgcggcctgta

SEQ ID NO: 496082 - DNA, 25 bp, Rattus norvegicus
ggatcccgaggcaccattccctggt

SEQ ID NO: 496083 - DNA, 25 bp, Rattus norvegicus
agacgtggatctgactgcgggtttc

SEQ ID NO: 496084 - DNA, 25 bp, Rattus norvegicus
gaaccctgaggtccggctcctggct

SEQ ID NO: 496085 - DNA, 25 bp, Rattus norvegicus
cggtaggagagcatcaagaagcgtc

SEQ ID NO: 496086 - DNA, 25 bp, Rattus norvegicus
cgcagctatgctgggacatcaccta

SEQ ID NO: 496087 - DNA, 25 bp, Rattus norvegicus
ctgcctatatgctggtggtgatgac

SEQ ID NO: 496088 - DNA, 25 bp, Rattus norvegicus
ctggcgcaacatccgcggaaagaca

SEQ ID NO: 496089 - DNA, 25 bp, Rattus norvegicus
tggcttcatctgctaccacatctgg

SEQ ID NO: 496090 - DNA, 25 bp, Rattus norvegicus
cgtcttgggtacatgctatggcttc

SEQ ID NO: 496091 - DNA, 25 bp, Rattus norvegicus
gcgcctacgtgacctggatgaccag

SEQ ID NO: 496092 - DNA, 25 bp, Rattus norvegicus
cacctcttgggtgctgagtttcata

SEQ ID NO: 496093 - DNA, 25 bp, Rattus norvegicus
tcccaggctctgtacggacagcatg

SEQ ID NO: 496094 - DNA, 25 bp, Rattus norvegicus
cgcagagcttagaactcggatcctc

SEQ ID NO: 496095 - DNA, 25 bp, Rattus norvegicus
gctggccaaactggaaatcgctgtg

SEQ ID NO: 496096 - DNA, 25 bp, Rattus norvegicus
aactccagcccgtggtggcctctaa

SEQ ID NO: 496097 - DNA, 25 bp, Rattus norvegicus
acagcatgagtttcccgcgaggctc

SEQ ID NO: 496098 - DNA, 25 bp, Rattus norvegicus
gcacctgcaggtgtttgccatgttc

SEQ ID NO: 496099 - DNA, 25 bp, Rattus norvegicus
tgccatgttcgcgtctgcctatatg

SEQ ID NO: 496100 - DNA, 25 bp, Rattus norvegicus
gcctcttcgcttacactgaccagtt

SEQ ID NO: 496101 - DNA, 25 bp, Rattus norvegicus
tgggcactagggttctccaccagct

SEQ ID NO: 496102 - DNA, 25 bp, Rattus norvegicus
ttcctctcacggcttctgggcacta

SEQ ID NO: 496103 - DNA, 25 bp, Rattus norvegicus
cacgggctacgcagagtgagtgcac

SEQ ID NO: 496104 - DNA, 25 bp, Rattus norvegicus
tcatcctcaaggagacccggcggct

SEQ ID NO: 496105 - DNA, 25 bp, Rattus norvegicus
ggagtgcagcgcagaccacatcgcc

SEQ ID NO: 496106 - DNA, 25 bp, Rattus norvegicus
agttcctcgggctgtctcaggatga

SEQ ID NO: 496107 - DNA, 25 bp, Rattus norvegicus
ctcgggtgaaatctgccgtggccaa

SEQ ID NO: 496108 - DNA, 25 bp, Rattus norvegicus
cggcgccggagtaatatgctcactc

SEQ ID NO: 496109 - DNA, 25 bp, Rattus norvegicus
atcatcacatgactcgacggcggta

SEQ ID NO: 496110 - DNA, 25 bp, Rattus norvegicus
gcccgtgcagcctgatcatcacatg

SEQ ID NO: 496111 - DNA, 25 bp, Rattus norvegicus
tatgggctttcggacccagcagtgg

SEQ ID NO: 496112 - DNA, 25 bp, Rattus norvegicus
gtctccctaaggtcacggtctcgga

SEQ ID NO: 496113 - DNA, 25 bp, Rattus norvegicus
cgtggccaatttcatgggcggcatc

SEQ ID NO: 496114 - DNA, 25 bp, Rattus norvegicus
tgctctgggcgtgagcagtaaagat

SEQ ID NO: 496115 - DNA, 25 bp, Rattus norvegicus
ccctgcgggaatgcggctagctaac

SEQ ID NO: 496116 - DNA, 25 bp, Rattus norvegicus
gctagctaacggtttccgcgccggc

SEQ ID NO: 496117 - DNA, 25 bp, Rattus norvegicus
gcggcgctgagcatcaccagcacta

SEQ ID NO: 496118 - DNA, 25 bp, Rattus norvegicus
tcaccagcactagcaaggcagtagc

SEQ ID NO: 496119 - DNA, 25 bp, Rattus norvegicus
aggcagtagcttgcgcagttatctc

SEQ ID NO: 496120 - DNA, 25 bp, Rattus norvegicus
agttatctccacagcgggcaatgtc

SEQ ID NO: 496121 - DNA, 25 bp, Rattus norvegicus
accgcggtcgaactaaaatcctgca

SEQ ID NO: 496122 - DNA, 25 bp, Rattus norvegicus
gggcaatgtcacaacccgaccaaca

SEQ ID NO: 496123 - DNA, 25 bp, Rattus norvegicus
cctctgtccgagtggagctgcgctt

SEQ ID NO: 496124 - DNA, 25 bp, Rattus norvegicus
aggcggaaagttgagccgcgtcttc

SEQ ID NO: 496125 - DNA, 25 bp, Rattus norvegicus
atcctgcacgagttaaaattatccg

SEQ ID NO: 496126 - DNA, 25 bp, Rattus norvegicus
gcacaaactactacctcagccaggg

SEQ ID NO: 496127 - DNA, 25 bp, Rattus norvegicus
ctcccggagcaattccgaaggcttc

SEQ ID NO: 496128 - DNA, 25 bp, Rattus norvegicus
atgcgagtatcctcctcttgtccca

SEQ ID NO: 496129 - DNA, 25 bp, Rattus norvegicus
tgcgtagagctgtcagccgcaccca

SEQ ID NO: 496130 - DNA, 25 bp, Rattus norvegicus
acgccgcgcttctaccaaagttgca

SEQ ID NO: 496131 - DNA, 25 bp, Rattus norvegicus
gacctgtcagaaccgagaagatccc

SEQ ID NO: 496132 - DNA, 25 bp, Rattus norvegicus
ggcaaaaccgttccgtgtgggctgc

SEQ ID NO: 496133 - DNA, 25 bp, Rattus norvegicus
cggagtggcatcgagtcttgttcga

SEQ ID NO: 496134 - DNA, 25 bp, Rattus norvegicus
ttgttcgagtccgaagagcttcctg

SEQ ID NO: 496135 - DNA, 25 bp, Rattus norvegicus
cttcctgctactctaagccggttta

SEQ ID NO: 496136 - DNA, 25 bp, Rattus norvegicus
agccagccgcccaagctaagcggtg

SEQ ID NO: 496137 - DNA, 25 bp, Rattus norvegicus
agccggtttaagtgatgcgagtatc

SEQ ID NO: 496138 - DNA, 25 bp, Rattus norvegicus
acccggtctgcgtcctgatacctag

SEQ ID NO: 496139 - DNA, 25 bp, Rattus norvegicus
gtcctgatacctagtggactccgcc

SEQ ID NO: 496140 - DNA, 25 bp, Rattus norvegicus
agtgcgagcatcctgaacgttcaag

SEQ ID NO: 496141 - DNA, 25 bp, Rattus norvegicus
gaacgttcaaggtgtcctgcgcggc

SEQ ID NO: 496142 - DNA, 25 bp, Rattus norvegicus
ctgtcagttgcttgtgcgaccagca

SEQ ID NO: 496143 - DNA, 25 bp, Rattus norvegicus
gcgaccaagcaagcactgtcagttg

SEQ ID NO: 496144 - DNA, 25 bp, Rattus norvegicus
gatctggaccggagcgaccaagcaa

SEQ ID NO: 496145 - DNA, 25 bp, Rattus norvegicus
tcagcctttcgcagccggagctcag

SEQ ID NO: 496146 - DNA, 25 bp, Rattus norvegicus
ggagcccaccagacgggcaggtctc

SEQ ID NO: 496147 - DNA, 25 bp, Rattus norvegicus
gaactggccacaagcttcagcgatg

SEQ ID NO: 496148 - DNA, 25 bp, Rattus norvegicus
ttcagcgatgcccactcagggtgcc

SEQ ID NO: 496149 - DNA, 25 bp, Rattus norvegicus
gccattagccgagtcgcccacaatt

SEQ ID NO: 496150 - DNA, 25 bp, Rattus norvegicus
gagaagctccgacacgctccagctg

SEQ ID NO: 496151 - DNA, 25 bp, Rattus norvegicus
gcgcaggcgcgtcctgcttcctttt

SEQ ID NO: 496152 - DNA, 25 bp, Rattus norvegicus
ctgcttccttttcgcgagctggtaa

SEQ ID NO: 496153 - DNA, 25 bp, Rattus norvegicus
cgagctggtaacctggggatgatcc

SEQ ID NO: 496154 - DNA, 25 bp, Rattus norvegicus
atgatccggggttcctccctacgtg

SEQ ID NO: 496155 - DNA, 25 bp, Rattus norvegicus
gtgcccagacttgccgacgccatta

SEQ ID NO: 496156 - DNA, 25 bp, Rattus norvegicus
gccatcttcttccactagcggtagc

SEQ ID NO: 496157 - DNA, 25 bp, Rattus norvegicus
cgggatctgtcaaaaactgaggcag

SEQ ID NO: 496158 - DNA, 25 bp, Rattus norvegicus
tgaggcaggctcacgccgagccact

SEQ ID NO: 496159 - DNA, 25 bp, Rattus norvegicus
cctttccggagcgaggttttgagca

SEQ ID NO: 496160 - DNA, 25 bp, Rattus norvegicus
aggttttgagcagcgtcgcgatgtc

SEQ ID NO: 496161 - DNA, 25 bp, Rattus norvegicus
ggacatggcagaaagagcgcagttc

SEQ ID NO: 496162 - DNA, 25 bp, Rattus norvegicus
tcagaacgctgggtgtccaggtccg

SEQ ID NO: 496163 - DNA, 25 bp, Rattus norvegicus
cccgccggcaggtctgtaccaaatg

SEQ ID NO: 496164 - DNA, 25 bp, Rattus norvegicus
tctgtaccaaatgggacgcgagggc

SEQ ID NO: 496165 - DNA, 25 bp, Rattus norvegicus
cggcgccctagacctctgagtttac

SEQ ID NO: 496166 - DNA, 25 bp, Rattus norvegicus
agccggactctccttgtcctgctgg

SEQ ID NO: 496167 - DNA, 25 bp, Rattus norvegicus
tttttgcgggttcactcctgctgga

SEQ ID NO: 496168 - DNA, 25 bp, Rattus norvegicus
tgagtttacacggttctcccagggc

SEQ ID NO: 496169 - DNA, 25 bp, Rattus norvegicus
tcgcgatgtcagaacgctgggtgtc

SEQ ID NO: 496170 - DNA, 25 bp, Rattus norvegicus
ctgcagacctaggacagccggggaa

SEQ ID NO: 496171 - DNA, 25 bp, Rattus norvegicus
cgcggaagctacaggaccatcacta

SEQ ID NO: 496172 - DNA, 25 bp, Rattus norvegicus
accggtggacttcaggtccctatgc

SEQ ID NO: 496173 - DNA, 25 bp, Rattus norvegicus
tccgcgagcacacaccggtggactt

SEQ ID NO: 496174 - DNA, 25 bp, Rattus norvegicus
accctgtatgtgaagacactgccga

SEQ ID NO: 496175 - DNA, 25 bp, Rattus norvegicus
gctgcatcttcctttggcttcgggg

SEQ ID NO: 496176 - DNA, 25 bp, Rattus norvegicus
ccttctgattactttgacactgtgg

SEQ ID NO: 496177 - DNA, 25 bp, Rattus norvegicus
aggctgctctgctgaaggtgaatca

SEQ ID NO: 496178 - DNA, 25 bp, Rattus norvegicus
gaacctgtccataccggagcctgca

SEQ ID NO: 496179 - DNA, 25 bp, Rattus norvegicus
agttgctgctaagtggacgcgaccc

SEQ ID NO: 496180 - DNA, 25 bp, Rattus norvegicus
ccggctgctcttgaaggcgagatca

SEQ ID NO: 496181 - DNA, 25 bp, Rattus norvegicus
ctttggggaccacagtagtcgcacc

SEQ ID NO: 496182 - DNA, 25 bp, Rattus norvegicus
gcgtccaattgcctttccctagaga

SEQ ID NO: 496183 - DNA, 25 bp, Rattus norvegicus
aaaagtcctcgctcgccgctcaaag

SEQ ID NO: 496184 - DNA, 25 bp, Rattus norvegicus
gaccctgaagttcccgtcggagctc

SEQ ID NO: 496185 - DNA, 25 bp, Rattus norvegicus
tccgctgaatggaattatttattta

SEQ ID NO: 496186 - DNA, 25 bp, Rattus norvegicus
cgctgtcatccgctgaatggaatta

SEQ ID NO: 496187 - DNA, 25 bp, Rattus norvegicus
tcgcctcgctgtcatccgctgaatg

SEQ ID NO: 496188 - DNA, 25 bp, Rattus norvegicus
tttacctggctctgacacccggtgc

SEQ ID NO: 496189 - DNA, 25 bp, Rattus norvegicus
tgggagcaccgcctttacctggctc

SEQ ID NO: 496190 - DNA, 25 bp, Rattus norvegicus
tgcggtccctgcgagtaacctcact

SEQ ID NO: 496191 - DNA, 25 bp, Rattus norvegicus
caccgggctgccatttctccacacc

SEQ ID NO: 496192 - DNA, 25 bp, Rattus norvegicus
tctatataagggctcgcggcactcg

SEQ ID NO: 496193 - DNA, 25 bp, Rattus norvegicus
ttttgtctatataagggctcgcggc

SEQ ID NO: 496194 - DNA, 25 bp, Rattus norvegicus
catcttcgggatttttgtctatata

SEQ ID NO: 496195 - DNA, 25 bp, Rattus norvegicus
agcctgctcatcttcgggatttttg

SEQ ID NO: 496196 - DNA, 25 bp, Rattus norvegicus
aagttcccgtcggagctctagcctg

SEQ ID NO: 496197 - DNA, 25 bp, Rattus norvegicus
agctctagcctgctcatcttcggga

SEQ ID NO: 496198 - DNA, 25 bp, Rattus norvegicus
tcactcggctgtgagtatcagtatc

SEQ ID NO: 496199 - DNA, 25 bp, Rattus norvegicus
cagctctcggacgaagctacgcggc

SEQ ID NO: 496200 - DNA, 25 bp, Rattus norvegicus
gaggctgcagagctcccggccgaac

SEQ ID NO: 496201 - DNA, 25 bp, Rattus norvegicus
gctggagccttgttattgtcacgtg

SEQ ID NO: 496202 - DNA, 25 bp, Rattus norvegicus
ccgccgcaggcggaaaagtttctca

SEQ ID NO: 496203 - DNA, 25 bp, Rattus norvegicus
ttctcagcgtgcgatcgcgctttcg

SEQ ID NO: 496204 - DNA, 25 bp, Rattus norvegicus
gctgctagctcttccgctgtgcaca

SEQ ID NO: 496205 - DNA, 25 bp, Rattus norvegicus
agcccggtctgtgagtcggtgcttt

SEQ ID NO: 496206 - DNA, 25 bp, Rattus norvegicus
atcagtatcattccggtggggtgga

SEQ ID NO: 496207 - DNA, 25 bp, Rattus norvegicus
gacgagaagagtccgccgaggccca

SEQ ID NO: 496208 - DNA, 25 bp, Rattus norvegicus
gcccagtggagggactctgtctctc

SEQ ID NO: 496209 - DNA, 25 bp, Rattus norvegicus
tgtctctctcggcttccgcgcaggt

SEQ ID NO: 496210 - DNA, 25 bp, Rattus norvegicus
cacttgcgggcctgcagacccgatt

SEQ ID NO: 496211 - DNA, 25 bp, Rattus norvegicus
ctgtgcacaggcatgagaggccttc

SEQ ID NO: 496212 - DNA, 25 bp, Rattus norvegicus
ccctatgacgttcgcttggaagaaa

SEQ ID NO: 496213 - DNA, 25 bp, Rattus norvegicus
tgcgtcatctccaaccacttcggtt

SEQ ID NO: 496214 - DNA, 25 bp, Rattus norvegicus
aagggaggtaccagtgcgtcatctc

SEQ ID NO: 496215 - DNA, 25 bp, Rattus norvegicus
aacgtggaatttgccagcgaaggga

SEQ ID NO: 496216 - DNA, 25 bp, Rattus norvegicus
cctgaggctccgcaacgtggaattt

SEQ ID NO: 496217 - DNA, 25 bp, Rattus norvegicus
ggagtacaccaccatcctgaggctc

SEQ ID NO: 496218 - DNA, 25 bp, Rattus norvegicus
aggcgagctgatggagtacaccacc

SEQ ID NO: 496219 - DNA, 25 bp, Rattus norvegicus
atggagaactatgcgcacctccggg

SEQ ID NO: 496220 - DNA, 25 bp, Rattus norvegicus
ttcaggacgctgaaatggagaacta

SEQ ID NO: 496221 - DNA, 25 bp, Rattus norvegicus
cttggaagaaagacaacgaagcgct

SEQ ID NO: 496222 - DNA, 25 bp, Rattus norvegicus
agttttacctgctcggccgctagca

SEQ ID NO: 496223 - DNA, 25 bp, Rattus norvegicus
aaccacttcggttcatcgtactccg

SEQ ID NO: 496224 - DNA, 25 bp, Rattus norvegicus
acaacgaagcgcttcaggacgctga

SEQ ID NO: 496225 - DNA, 25 bp, Rattus norvegicus
acgtgagttttacctgctcggccgc

SEQ ID NO: 496226 - DNA, 25 bp, Rattus norvegicus
tggtactgagagaggcaatgttcgc

SEQ ID NO: 496227 - DNA, 25 bp, Rattus norvegicus
tttgctgtgtggtgggcacgtccct

SEQ ID NO: 496228 - DNA, 25 bp, Rattus norvegicus
catcatagccgtggtttgctgtgtg

SEQ ID NO: 496229 - DNA, 25 bp, Rattus norvegicus
cgtggtcatcatagccgtggtttgc

SEQ ID NO: 496230 - DNA, 25 bp, Rattus norvegicus
actgtgggcgtggtcatcatagccg

SEQ ID NO: 496231 - DNA, 25 bp, Rattus norvegicus
gtgtgatccctactccaacctgcga

SEQ ID NO: 496232 - DNA, 25 bp, Rattus norvegicus
cggggaaatacacgtgcgagatgtc

SEQ ID NO: 496233 - DNA, 25 bp, Rattus norvegicus
gttcgcctcagtgtgatccctactc

SEQ ID NO: 496234 - DNA, 25 bp, Rattus norvegicus
gcaatgttcgcctcagtgtgatccc

SEQ ID NO: 496235 - DNA, 25 bp, Rattus norvegicus
acccttggtactgagagaggcaatg

SEQ ID NO: 496236 - DNA, 25 bp, Rattus norvegicus
caatacccttggtactgagagaggc

SEQ ID NO: 496237 - DNA, 25 bp, Rattus norvegicus
gagatgtccaatacccttggtactg

SEQ ID NO: 496238 - DNA, 25 bp, Rattus norvegicus
acgtgcgagatgtccaatacccttg

SEQ ID NO: 496239 - DNA, 25 bp, Rattus norvegicus
tacacgtgcgagatgtccaataccc

SEQ ID NO: 496240 - DNA, 25 bp, Rattus norvegicus
cttccggaagaagctaggccgcggc

SEQ ID NO: 496241 - DNA, 25 bp, Rattus norvegicus
gttctttgagcaggcgggacagcat

SEQ ID NO: 496242 - DNA, 25 bp, Rattus norvegicus
ggctcgcttgctccgaacggaatca

SEQ ID NO: 496243 - DNA, 25 bp, Rattus norvegicus
cggaatcacgtgattgcggcgtcac

SEQ ID NO: 496244 - DNA, 25 bp, Rattus norvegicus
agctccttccgttcgttctgctttg

SEQ ID NO: 496245 - DNA, 25 bp, Rattus norvegicus
ggacacttgagctcaccctgcagct

SEQ ID NO: 496246 - DNA, 25 bp, Rattus norvegicus
cctccctaaagctgcgggagccgga

SEQ ID NO: 496247 - DNA, 25 bp, Rattus norvegicus
cgaggtccaggcttccggaagaagc

SEQ ID NO: 496248 - DNA, 25 bp, Rattus norvegicus
cggaccttgccttggctcgcttgct

SEQ ID NO: 496249 - DNA, 25 bp, Rattus norvegicus
atctgggtggttacccgaggtccag

SEQ ID NO: 496250 - DNA, 25 bp, Rattus norvegicus
gacggagtttccagaagtgcctccc

SEQ ID NO: 496251 - DNA, 25 bp, Rattus norvegicus
acagcatggtcgagtctggctcggt

SEQ ID NO: 496252 - DNA, 25 bp, Rattus norvegicus
ttggcaaagggacggagtttccaga

SEQ ID NO: 496253 - DNA, 25 bp, Rattus norvegicus
agcggccgaccggacacttgagctc

SEQ ID NO: 496254 - DNA, 25 bp, Rattus norvegicus
gctcaagtttatcagcggtatcttc

SEQ ID NO: 496255 - DNA, 25 bp, Rattus norvegicus
gcaatcccagttccagctacttctg

SEQ ID NO: 496256 - DNA, 25 bp, Rattus norvegicus
caagaagcggcacgagcgtctcttc

SEQ ID NO: 496257 - DNA, 25 bp, Rattus norvegicus
tagtgacttgcacccaggacccagt

SEQ ID NO: 496258 - DNA, 25 bp, Rattus norvegicus
cctcggaaaggcaagagtaagacct

SEQ ID NO: 496259 - DNA, 25 bp, Rattus norvegicus
gagcgctgcagtcacgacctctggt

SEQ ID NO: 496260 - DNA, 25 bp, Rattus norvegicus
tagccgcctgtcatggcccgaaagc

SEQ ID NO: 496261 - DNA, 25 bp, Rattus norvegicus
ttcaccaagagcacaggagggcctc

SEQ ID NO: 496262 - DNA, 25 bp, Rattus norvegicus
tgaccactagtggagccaaagccgg

SEQ ID NO: 496263 - DNA, 25 bp, Rattus norvegicus
gctcccaagcctttcaagaccgtga

SEQ ID NO: 496264 - DNA, 25 bp, Rattus norvegicus
caggatgcgctgtggatcagtacca

SEQ ID NO: 496265 - DNA, 25 bp, Rattus norvegicus
agcgtctcttccaccggcaggatgc

SEQ ID NO: 496266 - DNA, 25 bp, Rattus norvegicus
gtcaagctcgagtcggtacctccgc

SEQ ID NO: 496267 - DNA, 25 bp, Rattus norvegicus
cgtgaccgcaagatgctcaagttta

SEQ ID NO: 496268 - DNA, 25 bp, Rattus norvegicus
cccgggaacgtccggccagtgtcag

SEQ ID NO: 496269 - DNA, 25 bp, Rattus norvegicus
ggaactgctgctaagacaattctta

SEQ ID NO: 496270 - DNA, 25 bp, Rattus norvegicus
gacaattcttatcccgggagacttg

SEQ ID NO: 496271 - DNA, 25 bp, Rattus norvegicus
ttatcccgggagacttgggaggcca

SEQ ID NO: 496272 - DNA, 25 bp, Rattus norvegicus
cccgggagacttgggaggccataca

SEQ ID NO: 496273 - DNA, 25 bp, Rattus norvegicus
gggcggaactgctgctaagacaatt

SEQ ID NO: 496274 - DNA, 25 bp, Rattus norvegicus
gaggccatacaaggaggtcgcttta

SEQ ID NO: 496275 - DNA, 25 bp, Rattus norvegicus
ccatacaaggaggtcgctttattta

SEQ ID NO: 496276 - DNA, 25 bp, Rattus norvegicus
ctcccgagggtgcctttattattat

SEQ ID NO: 496277 - DNA, 25 bp, Rattus norvegicus
ttttctaactggtaaagagaggcgc

SEQ ID NO: 496278 - DNA, 25 bp, Rattus norvegicus
tgcgaccgacgactcggttcggctc

SEQ ID NO: 496279 - DNA, 25 bp, Rattus norvegicus
gacgactcggttcggctcacattcc

SEQ ID NO: 496280 - DNA, 25 bp, Rattus norvegicus
cccacagcggcgtcgagacccgccc

SEQ ID NO: 496281 - DNA, 25 bp, Rattus norvegicus
taactggtaaagagaggcgcattgg

SEQ ID NO: 496282 - DNA, 25 bp, Rattus norvegicus
gttttacgtagccagcaaggtccca

SEQ ID NO: 496283 - DNA, 25 bp, Rattus norvegicus
ctggctcgctggaaaaggcctctgg

SEQ ID NO: 496284 - DNA, 25 bp, Rattus norvegicus
aaacctgttttacgtagccagcaag

SEQ ID NO: 496285 - DNA, 25 bp, Rattus norvegicus
aacctgttttacgtagccagcaagg

SEQ ID NO: 496286 - DNA, 25 bp, Rattus norvegicus
cctgttttacgtagccagcaaggtc

SEQ ID NO: 496287 - DNA, 25 bp, Rattus norvegicus
ctgttttacgtagccagcaaggtcc

SEQ ID NO: 496288 - DNA, 25 bp, Rattus norvegicus
ttttacgtagccagcaaggtcccac

SEQ ID NO: 496289 - DNA, 25 bp, Rattus norvegicus
tttacgtagccagcaaggtcccact

SEQ ID NO: 496290 - DNA, 25 bp, Rattus norvegicus
ttacgtagccagcaaggtcccactg

SEQ ID NO: 496291 - DNA, 25 bp, Rattus norvegicus
tacgtagccagcaaggtcccactgc

SEQ ID NO: 496292 - DNA, 25 bp, Rattus norvegicus
cgtagccagcaaggtcccactgcct

SEQ ID NO: 496293 - DNA, 25 bp, Rattus norvegicus
ggccacgcgaacaatagccctaccc

SEQ ID NO: 496294 - DNA, 25 bp, Rattus norvegicus
ccgcctggctcgctggaaaaggcct

SEQ ID NO: 496295 - DNA, 25 bp, Rattus norvegicus
gcctggctcgctggaaaaggcctct

SEQ ID NO: 496296 - DNA, 25 bp, Rattus norvegicus
gggacagcgcatgccttccgttgcg

SEQ ID NO: 496297 - DNA, 25 bp, Rattus norvegicus
ctgcctcgttttagcgcggttattc

SEQ ID NO: 496298 - DNA, 25 bp, Rattus norvegicus
tgttcagtcatctggccagggctta

SEQ ID NO: 496299 - DNA, 25 bp, Rattus norvegicus
cagaaggttcgatttacagtttccg

SEQ ID NO: 496300 - DNA, 25 bp, Rattus norvegicus
agatacccagaaggttcgatttaca

SEQ ID NO: 496301 - DNA, 25 bp, Rattus norvegicus
ccgggagaagaaagtggcaccgctt

SEQ ID NO: 496302 - DNA, 25 bp, Rattus norvegicus
agctccgggagaagaaagtggcacc

SEQ ID NO: 496303 - DNA, 25 bp, Rattus norvegicus
taaagaagacgtgagctccgggaga

SEQ ID NO: 496304 - DNA, 25 bp, Rattus norvegicus
agcgcatgccttccgttgcgaccag

SEQ ID NO: 496305 - DNA, 25 bp, Rattus norvegicus
cgcggttattctaatgagataaaga

SEQ ID NO: 496306 - DNA, 25 bp, Rattus norvegicus
ttagcgcggttattctaatgagata

SEQ ID NO: 496307 - DNA, 25 bp, Rattus norvegicus
atgccttccgttgcgaccagcacgt

SEQ ID NO: 496308 - DNA, 25 bp, Rattus norvegicus
cgttttagcgcggttattctaatga

SEQ ID NO: 496309 - DNA, 25 bp, Rattus norvegicus
ctaatgagataaagaagacgtgagc

SEQ ID NO: 496310 - DNA, 25 bp, Rattus norvegicus
gcacctgtctcgagtgcgttcgctg

SEQ ID NO: 496311 - DNA, 25 bp, Rattus norvegicus
accattggacagatgcacccactca

SEQ ID NO: 496312 - DNA, 25 bp, Rattus norvegicus
cgcgggactcttcgaggtaaggatc

SEQ ID NO: 496313 - DNA, 25 bp, Rattus norvegicus
aggtctggactagaggtcccttaca

SEQ ID NO: 496314 - DNA, 25 bp, Rattus norvegicus
cgggccaagtacgaacagctgctgt

SEQ ID NO: 496315 - DNA, 25 bp, Rattus norvegicus
agctcgcccacgttgttattacaca

SEQ ID NO: 496316 - DNA, 25 bp, Rattus norvegicus
cacagctgctgttgtgggtacgtga

SEQ ID NO: 496317 - DNA, 25 bp, Rattus norvegicus
tggtgcgtggtcacaagacttttcc

SEQ ID NO: 496318 - DNA, 25 bp, Rattus norvegicus
agacttttcctcctgcagtatggcg

SEQ ID NO: 496319 - DNA, 25 bp, Rattus norvegicus
acagcattgttctacgcccgccagg

SEQ ID NO: 496320 - DNA, 25 bp, Rattus norvegicus
tggcagccagctatgtgcagacatc

SEQ ID NO: 496321 - DNA, 25 bp, Rattus norvegicus
acgatcgcgctggtatagttgccca

SEQ ID NO: 496322 - DNA, 25 bp, Rattus norvegicus
tcagcgtaagggtgtatgatttctc

SEQ ID NO: 496323 - DNA, 25 bp, Rattus norvegicus
cgactacaccgggtggaccattgga

SEQ ID NO: 496324 - DNA, 25 bp, Rattus norvegicus
taaacgtggcgtcaaagcctccagg

SEQ ID NO: 496325 - DNA, 25 bp, Rattus norvegicus
cggggatagatctgcctgccattcc

SEQ ID NO: 496326 - DNA, 25 bp, Rattus norvegicus
ctgccattcccagcaggatcgtaga

SEQ ID NO: 496327 - DNA, 25 bp, Rattus norvegicus
ggatcgtagaaacaccaccatgtct

SEQ ID NO: 496328 - DNA, 25 bp, Rattus norvegicus
tcccatgacaggcaacggcaggatc

SEQ ID NO: 496329 - DNA, 25 bp, Rattus norvegicus
cggcaggatctggatgccataacgc

SEQ ID NO: 496330 - DNA, 25 bp, Rattus norvegicus
ccgcccgtcagatgcgcaggtaaca

SEQ ID NO: 496331 - DNA, 25 bp, Rattus norvegicus
atcccaacagactggacagcagcgc

SEQ ID NO: 496332 - DNA, 25 bp, Rattus norvegicus
tcttccgcttcgtctctgctagaga

SEQ ID NO: 496333 - DNA, 25 bp, Rattus norvegicus
tctgctagagatgttccttccgccc

SEQ ID NO: 496334 - DNA, 25 bp, Rattus norvegicus
ggcagcggcctcacccgtctattag

SEQ ID NO: 496335 - DNA, 25 bp, Rattus norvegicus
tagcgcctcaagctctcattggctg

SEQ ID NO: 496336 - DNA, 25 bp, Rattus norvegicus
ggctcctttcaacgcgacctgggga

SEQ ID NO: 496337 - DNA, 25 bp, Rattus norvegicus
cgggcgctctctcttacgtaactca

SEQ ID NO: 496338 - DNA, 25 bp, Rattus norvegicus
cgcggcggatttacgattcagttca

SEQ ID NO: 496339 - DNA, 25 bp, Rattus norvegicus
gcacacatcccagtcaggatcaagg

SEQ ID NO: 496340 - DNA, 25 bp, Rattus norvegicus
tagaccttgccactgagcctcgcta

SEQ ID NO: 496341 - DNA, 25 bp, Rattus norvegicus
ccgaggctcgatctgctagaccttg

SEQ ID NO: 496342 - DNA, 25 bp, Rattus norvegicus
gtctcccgaaccctctggcattgtg

SEQ ID NO: 496343 - DNA, 25 bp, Rattus norvegicus
ccggcaggaaacattcagaaccacc

SEQ ID NO: 496344 - DNA, 25 bp, Rattus norvegicus
gccctctatgcgctagttctgctgc

SEQ ID NO: 496345 - DNA, 25 bp, Rattus norvegicus
cttgggtacctgagcgagtctcgga

SEQ ID NO: 496346 - DNA, 25 bp, Rattus norvegicus
caaaccttgggtgaatgcggaagcc

SEQ ID NO: 496347 - DNA, 25 bp, Rattus norvegicus
tgcatgtcaccacgccaaaccttgg

SEQ ID NO: 496348 - DNA, 25 bp, Rattus norvegicus
ttgctgacccgccaggtgcagtaca

SEQ ID NO: 496349 - DNA, 25 bp, Rattus norvegicus
acgttagacaggtcagtgcgctggc

SEQ ID NO: 496350 - DNA, 25 bp, Rattus norvegicus
cctgccgcggtcttagaacgttaga

SEQ ID NO: 496351 - DNA, 25 bp, Rattus norvegicus
tcgctgggtctcctgtacgccagca

SEQ ID NO: 496352 - DNA, 25 bp, Rattus norvegicus
accacgagctcgctggctttccaaa

SEQ ID NO: 496353 - DNA, 25 bp, Rattus norvegicus
taccacctaccgacagctgctaagt

SEQ ID NO: 496354 - DNA, 25 bp, Rattus norvegicus
caccgacggcgtagtcaacttcttc

SEQ ID NO: 496355 - DNA, 25 bp, Rattus norvegicus
cgcctcaaccgggtggctcatctgg

SEQ ID NO: 496356 - DNA, 25 bp, Rattus norvegicus
cacagataaagtgcgccaggtgggc

SEQ ID NO: 496357 - DNA, 25 bp, Rattus norvegicus
tcctggcgcgcacagataaagtgcg

SEQ ID NO: 496358 - DNA, 25 bp, Rattus norvegicus
tgcctccggcaaaagcagggcttcc

SEQ ID NO: 496359 - DNA, 25 bp, Rattus norvegicus
agtcaacttcttcctggcgcgcaca

SEQ ID NO: 496360 - DNA, 25 bp, Rattus norvegicus
agatctcgggctacgctaccaccta

SEQ ID NO: 496361 - DNA, 25 bp, Rattus norvegicus
tccaaactgcgtggtcaccgacggc

SEQ ID NO: 496362 - DNA, 25 bp, Rattus norvegicus
gctggctttccaaactgcgtggtca

SEQ ID NO: 496363 - DNA, 25 bp, Rattus norvegicus
caggtgggctttgacccacgcctca

SEQ ID NO: 496364 - DNA, 25 bp, Rattus norvegicus
aaagcagggcttccaccacgagctc

SEQ ID NO: 496365 - DNA, 25 bp, Rattus norvegicus
caggctttgggaactgcctccggca

SEQ ID NO: 496366 - DNA, 25 bp, Rattus norvegicus
tgtccagctagaggaaggggtgatg

SEQ ID NO: 496367 - DNA, 25 bp, Rattus norvegicus
agagagcggaataacaggccgagcc

SEQ ID NO: 496368 - DNA, 25 bp, Rattus norvegicus
tccaggagtagacggaagtaggggc

SEQ ID NO: 496369 - DNA, 25 bp, Rattus norvegicus
cgggtccagatgtccagctagagga

SEQ ID NO: 496370 - DNA, 25 bp, Rattus norvegicus
cctccacgcctgaagtccgcgtccc

SEQ ID NO: 496371 - DNA, 25 bp, Rattus norvegicus
cccaggcacctccacgcctgaagtc

SEQ ID NO: 496372 - DNA, 25 bp, Rattus norvegicus
agagcggaataacaggccgagccgc

SEQ ID NO: 496373 - DNA, 25 bp, Rattus norvegicus
agcagagagcggaataacaggccga

SEQ ID NO: 496374 - DNA, 25 bp, Rattus norvegicus
ggagccactggagccgcgcgggtcc

SEQ ID NO: 496375 - DNA, 25 bp, Rattus norvegicus
gccgactccgggagccactggagcc

SEQ ID NO: 496376 - DNA, 25 bp, Rattus norvegicus
ttaggggtggctctaggcccgggca

SEQ ID NO: 496377 - DNA, 25 bp, Rattus norvegicus
ctccggcctcggcttaggggtggct

SEQ ID NO: 496378 - DNA, 25 bp, Rattus norvegicus
tccagatgtccagctagaggaaggg

SEQ ID NO: 496379 - DNA, 25 bp, Rattus norvegicus
cggccgggatgcgacagccgctcca

SEQ ID NO: 496380 - DNA, 25 bp, Rattus norvegicus
ccagtatccggtcagtgcggccagg

SEQ ID NO: 496381 - DNA, 25 bp, Rattus norvegicus
gggctctgaggcctgcgtgcgtccg

SEQ ID NO: 496382 - DNA, 25 bp, Rattus norvegicus
cgggtacggcgcatgcgcgcagcat

SEQ ID NO: 496383 - DNA, 25 bp, Rattus norvegicus
ggagttgctactgccgaatccgccc

SEQ ID NO: 496384 - DNA, 25 bp, Rattus norvegicus
gggagttgctactgccgaatccgcc

SEQ ID NO: 496385 - DNA, 25 bp, Rattus norvegicus
cctcctgcccgggtacggcgcatgc

SEQ ID NO: 496386 - DNA, 25 bp, Rattus norvegicus
gtccggggagttgctactgccgaat

SEQ ID NO: 496387 - DNA, 25 bp, Rattus norvegicus
tcagggcctaggggccacggaagct

SEQ ID NO: 496388 - DNA, 25 bp, Rattus norvegicus
cctgcttcaagtttcagggcctagg

SEQ ID NO: 496389 - DNA, 25 bp, Rattus norvegicus
accctgcttcaagtttcagggccta

SEQ ID NO: 496390 - DNA, 25 bp, Rattus norvegicus
ccctaccctgcttcaagtttcaggg

SEQ ID NO: 496391 - DNA, 25 bp, Rattus norvegicus
ggcttcatgctggacccctaccctg

SEQ ID NO: 496392 - DNA, 25 bp, Rattus norvegicus
cccagtatccggtcagtgcggccag

SEQ ID NO: 496393 - DNA, 25 bp, Rattus norvegicus
ccggggagttgctactgccgaatcc

SEQ ID NO: 496394 - DNA, 25 bp, Rattus norvegicus
ggggcgccgggctcacctacctctc

SEQ ID NO: 496395 - DNA, 25 bp, Rattus norvegicus
gagtctcgccgcttggtgagggtgt

SEQ ID NO: 496396 - DNA, 25 bp, Rattus norvegicus
tgagggtgtgtgtccacctgactgc

SEQ ID NO: 496397 - DNA, 25 bp, Rattus norvegicus
cgggctcacctacctctcgtcagcg

SEQ ID NO: 496398 - DNA, 25 bp, Rattus norvegicus
agcttgtgagggtgcggacccggcc

SEQ ID NO: 496399 - DNA, 25 bp, Rattus norvegicus
gaggtgcgggaaagatgacaggccc

SEQ ID NO: 496400 - DNA, 25 bp, Rattus norvegicus
gctcacctacctctcgtcagcgccg

SEQ ID NO: 496401 - DNA, 25 bp, Rattus norvegicus
ccaaatggaggccagggctggaggt

SEQ ID NO: 496402 - DNA, 25 bp, Rattus norvegicus
aaccaactcccgcatccctactcga

SEQ ID NO: 496403 - DNA, 25 bp, Rattus norvegicus
tcccgcatccctactcgaggaagcc

SEQ ID NO: 496404 - DNA, 25 bp, Rattus norvegicus
tgtgtgtccacctgactgcggccct

SEQ ID NO: 496405 - DNA, 25 bp, Rattus norvegicus
gtccacctgactgcggccctcagaa

SEQ ID NO: 496406 - DNA, 25 bp, Rattus norvegicus
ctcagaacccccaaatggaggccag

SEQ ID NO: 496407 - DNA, 25 bp, Rattus norvegicus
gcgggaaagatgacaggcccggccc

SEQ ID NO: 496408 - DNA, 25 bp, Rattus norvegicus
aagcggtgctcacctgcgcagccgt

SEQ ID NO: 496409 - DNA, 25 bp, Rattus norvegicus
cagggcggctcttccgccgtttccg

SEQ ID NO: 496410 - DNA, 25 bp, Rattus norvegicus
accctcaggccgtagggcaggagcc

SEQ ID NO: 496411 - DNA, 25 bp, Rattus norvegicus
agtcaacctggccagggttgtgctg

SEQ ID NO: 496412 - DNA, 25 bp, Rattus norvegicus
tcggttcttaccgagtgggcgacgc

SEQ ID NO: 496413 - DNA, 25 bp, Rattus norvegicus
ggacagtcaacctggccagggttgt

SEQ ID NO: 496414 - DNA, 25 bp, Rattus norvegicus
cttcttggttttggaggcgaagccg

SEQ ID NO: 496415 - DNA, 25 bp, Rattus norvegicus
cggaacaccttcactttctgctgca

SEQ ID NO: 496416 - DNA, 25 bp, Rattus norvegicus
agccggccgcgactccgaagcccga

SEQ ID NO: 496417 - DNA, 25 bp, Rattus norvegicus
tcccgcgcacccaagcgagtggaag

SEQ ID NO: 496418 - DNA, 25 bp, Rattus norvegicus
ggaagacgccataatctcccgcgca

SEQ ID NO: 496419 - DNA, 25 bp, Rattus norvegicus
ggacggaggaagacgccataatctc

SEQ ID NO: 496420 - DNA, 25 bp, Rattus norvegicus
aacaccttcactttctgctgcacga

SEQ ID NO: 496421 - DNA, 25 bp, Rattus norvegicus
caggaacacgcccaccagtgggtcg

SEQ ID NO: 496422 - DNA, 25 bp, Rattus norvegicus
agatcagctagatttcggaaaccag

SEQ ID NO: 496423 - DNA, 25 bp, Rattus norvegicus
ccggagcgcacagcatgcaggagtt

SEQ ID NO: 496424 - DNA, 25 bp, Rattus norvegicus
gcacagcatgcaggagttgtattta

SEQ ID NO: 496425 - DNA, 25 bp, Rattus norvegicus
gttgtatttagctggtcctggggca

SEQ ID NO: 496426 - DNA, 25 bp, Rattus norvegicus
tgccgaggtgaaagattgaaagacc

SEQ ID NO: 496427 - DNA, 25 bp, Rattus norvegicus
cgaggtgcgatttcctcgggctccc

SEQ ID NO: 496428 - DNA, 25 bp, Rattus norvegicus
ttgaaagaccataaaagatcagcta

SEQ ID NO: 496429 - DNA, 25 bp, Rattus norvegicus
gctagatttcggaaaccagaaacac

SEQ ID NO: 496430 - DNA, 25 bp, Rattus norvegicus
gggccgcgacgatttcctcgcatta

SEQ ID NO: 496431 - DNA, 25 bp, Rattus norvegicus
tcctcgcattagcagagagagcgcg

SEQ ID NO: 496432 - DNA, 25 bp, Rattus norvegicus
agcgttggtcccatggccaggattc

SEQ ID NO: 496433 - DNA, 25 bp, Rattus norvegicus
gccaggattccgaggtgcgatttcc

SEQ ID NO: 496434 - DNA, 25 bp, Rattus norvegicus
ctctccggcaccagagtctgtatca

SEQ ID NO: 496435 - DNA, 25 bp, Rattus norvegicus
agagtctgtatcagcggcttgggca

SEQ ID NO: 496436 - DNA, 25 bp, Rattus norvegicus
gatgcccaggcgaaggtgcgctttt

SEQ ID NO: 496437 - DNA, 25 bp, Rattus norvegicus
ttttggtcctctcgccgcgctgtgc

SEQ ID NO: 496438 - DNA, 25 bp, Rattus norvegicus
tcggcctggttcaggggccgaaatc

SEQ ID NO: 496439 - DNA, 25 bp, Rattus norvegicus
gcgacctgggcttttggtcctctcg

SEQ ID NO: 496440 - DNA, 25 bp, Rattus norvegicus
cttttggtgtcctgcggcactggat

SEQ ID NO: 496441 - DNA, 25 bp, Rattus norvegicus
cgaaggtgcgcttttggtgtcctgc

SEQ ID NO: 496442 - DNA, 25 bp, Rattus norvegicus
cggctgcaacggtagcgtgtgctcc

SEQ ID NO: 496443 - DNA, 25 bp, Rattus norvegicus
acaggtgatctgtcgctgaggccaa

SEQ ID NO: 496444 - DNA, 25 bp, Rattus norvegicus
tctccgccatggtggtcgacgtcga

SEQ ID NO: 496445 - DNA, 25 bp, Rattus norvegicus
ctgcattcgttattggtctccgcca

SEQ ID NO: 496446 - DNA, 25 bp, Rattus norvegicus
aagcaccttgatgctgcattcgtta

SEQ ID NO: 496447 - DNA, 25 bp, Rattus norvegicus
cggcaaagcaccttgatgctgcatt

SEQ ID NO: 496448 - DNA, 25 bp, Rattus norvegicus
ttcaggggccgaaatcggcaaagca

SEQ ID NO: 496449 - DNA, 25 bp, Rattus norvegicus
gcgcgtctccggctgcaacggtagc

SEQ ID NO: 496450 - DNA, 25 bp, Rattus norvegicus
cccggaccttcggaagctcggctgg

SEQ ID NO: 496451 - DNA, 25 bp, Rattus norvegicus
gttctccaggacaatcgggctcctc

SEQ ID NO: 496452 - DNA, 25 bp, Rattus norvegicus
gccgcgctgttctccaggacaatcg

SEQ ID NO: 496453 - DNA, 25 bp, Rattus norvegicus
cacttcccggatggggccgcgctgt

SEQ ID NO: 496454 - DNA, 25 bp, Rattus norvegicus
ctgggccgctgcaggtacccacgac

SEQ ID NO: 496455 - DNA, 25 bp, Rattus norvegicus
aagctcggctggctcagatctccgg

SEQ ID NO: 496456 - DNA, 25 bp, Rattus norvegicus
cactgtgcggatgccagcaggagtc

SEQ ID NO: 496457 - DNA, 25 bp, Rattus norvegicus
cgcctgcactgtgcggatgccagca

SEQ ID NO: 496458 - DNA, 25 bp, Rattus norvegicus
gccaaggcgcctgcactgtgcggat

SEQ ID NO: 496459 - DNA, 25 bp, Rattus norvegicus
ccgcacgcgctcgtcgccaaggcgc

SEQ ID NO: 496460 - DNA, 25 bp, Rattus norvegicus
tggcagcttcgactgtgtttgcgta

SEQ ID NO: 496461 - DNA, 25 bp, Rattus norvegicus
tcagctggcagcttcgactgtgttt

SEQ ID NO: 496462 - DNA, 25 bp, Rattus norvegicus
ctggctcagatctccgggactggcg

SEQ ID NO: 496463 - DNA, 25 bp, Rattus norvegicus
cttcgactgtgtttgcgtaggtagg

SEQ ID NO: 496464 - DNA, 25 bp, Rattus norvegicus
cccgagtgtttgtaccgtccatgtc

SEQ ID NO: 496465 - DNA, 25 bp, Rattus norvegicus
cgtccatgtcaacagtgctcttgtc

SEQ ID NO: 496466 - DNA, 25 bp, Rattus norvegicus
cccagaaatcacttccaggcgctta

SEQ ID NO: 496467 - DNA, 25 bp, Rattus norvegicus
tagcgggtttctccgcccagaaatc

SEQ ID NO: 496468 - DNA, 25 bp, Rattus norvegicus
ccctctctggcagtagcgggtttct

SEQ ID NO: 496469 - DNA, 25 bp, Rattus norvegicus
gccggctatcctcgcgacttttgcg

SEQ ID NO: 496470 - DNA, 25 bp, Rattus norvegicus
tcccagcctgtccaggggtgtggta

SEQ ID NO: 496471 - DNA, 25 bp, Rattus norvegicus
ggcgcttaccacttgtgcccgagtg

SEQ ID NO: 496472 - DNA, 25 bp, Rattus norvegicus
ggcggaccctaaatacgccgatctc

SEQ ID NO: 496473 - DNA, 25 bp, Rattus norvegicus
gacctcccgaggatccctaacagaa

SEQ ID NO: 496474 - DNA, 25 bp, Rattus norvegicus
aggatccctaacagaaaccagcccg

SEQ ID NO: 496475 - DNA, 25 bp, Rattus norvegicus
accttctggactccagagccggctg

SEQ ID NO: 496476 - DNA, 25 bp, Rattus norvegicus
attacctcattcactgtcgctctca

SEQ ID NO: 496477 - DNA, 25 bp, Rattus norvegicus
gccgccatggcggaccctaaatacg

SEQ ID NO: 496478 - DNA, 25 bp, Rattus norvegicus
gcgcatgactcactcacctcctctg

SEQ ID NO: 496479 - DNA, 25 bp, Rattus norvegicus
tccgggtccgagataacgtagactc

SEQ ID NO: 496480 - DNA, 25 bp, Rattus norvegicus
aacgtagactctcgagccagagggc

SEQ ID NO: 496481 - DNA, 25 bp, Rattus norvegicus
agactctcgagccagagggcgcgat

SEQ ID NO: 496482 - DNA, 25 bp, Rattus norvegicus
cacgggactcctgagtggcggacgt

SEQ ID NO: 496483 - DNA, 25 bp, Rattus norvegicus
ctctgcgaagcctcgtgacccaaag

SEQ ID NO: 496484 - DNA, 25 bp, Rattus norvegicus
cggttgccaaacattgcatcatccc

SEQ ID NO: 496485 - DNA, 25 bp, Rattus norvegicus
gacaccggttgccaaacattgcatc

SEQ ID NO: 496486 - DNA, 25 bp, Rattus norvegicus
gcgcggacaccggttgccaaacatt

SEQ ID NO: 496487 - DNA, 25 bp, Rattus norvegicus
ctcccaccaccatcgacgtctcctg

SEQ ID NO: 496488 - DNA, 25 bp, Rattus norvegicus
gtgagctggcgctccgccttctttc

SEQ ID NO: 496489 - DNA, 25 bp, Rattus norvegicus
acactgtgagctggcgctccgcctt

SEQ ID NO: 496490 - DNA, 25 bp, Rattus norvegicus
ccgttggacactgtgagctggcgct

SEQ ID NO: 496491 - DNA, 25 bp, Rattus norvegicus
tgcgaagcctcgtgacccaaagcca

SEQ ID NO: 496492 - DNA, 25 bp, Rattus norvegicus
agccgactatgtatcccatcatgca

SEQ ID NO: 496493 - DNA, 25 bp, Rattus norvegicus
cgtttgaacagtggaagccggttgc

SEQ ID NO: 496494 - DNA, 25 bp, Rattus norvegicus
ccgctccgagaggatcgtttgaaca

SEQ ID NO: 496495 - DNA, 25 bp, Rattus norvegicus
gtaatgcgggctagcgcggcactct

SEQ ID NO: 496496 - DNA, 25 bp, Rattus norvegicus
tgcaccagcacaaaacaggaaatgg

SEQ ID NO: 496497 - DNA, 25 bp, Rattus norvegicus
cagtggaagccggttgctgtaaagc

SEQ ID NO: 496498 - DNA, 25 bp, Rattus norvegicus
cttctgggttaagctgcaaggtata

SEQ ID NO: 496499 - DNA, 25 bp, Rattus norvegicus
ccggggagccttcgctcacgaacag

SEQ ID NO: 496500 - DNA, 25 bp, Rattus norvegicus
gaacagcctcatcgtgtctcggagc

SEQ ID NO: 496501 - DNA, 25 bp, Rattus norvegicus
tggttaccaatgagaaccggaagta

SEQ ID NO: 496502 - DNA, 25 bp, Rattus norvegicus
ctgatgcaaccggaacgggcctcca

SEQ ID NO: 496503 - DNA, 25 bp, Rattus norvegicus
gtcagctccaagaaagccgactatg

SEQ ID NO: 496504 - DNA, 25 bp, Rattus norvegicus
gcacgctcgcagtcagctccaagaa

SEQ ID NO: 496505 - DNA, 25 bp, Rattus norvegicus
gtctcggagcccacgctgatgcaac

SEQ ID NO: 496506 - DNA, 25 bp, Rattus norvegicus
ccgccggaacgtcctgcacgtgagt

SEQ ID NO: 496507 - DNA, 25 bp, Rattus norvegicus
tcctcgcagggatttgggctctcct

SEQ ID NO: 496508 - DNA, 25 bp, Rattus norvegicus
agggcatgagttcctgctgcagtcg

SEQ ID NO: 496509 - DNA, 25 bp, Rattus norvegicus
gcacgtgagtgccttccaggcgtcc

SEQ ID NO: 496510 - DNA, 25 bp, Rattus norvegicus
tccaggcgtccccaaagacagggtg

SEQ ID NO: 496511 - DNA, 25 bp, Rattus norvegicus
ccagaaagtagcgtggacctgcgcg

SEQ ID NO: 496512 - DNA, 25 bp, Rattus norvegicus
agggcgctcgtcctcgcagggattt

SEQ ID NO: 496513 - DNA, 25 bp, Rattus norvegicus
agcagaccagaaagtagcgtggacc

SEQ ID NO: 496514 - DNA, 25 bp, Rattus norvegicus
ttgggctctcctcgctaacgcaagc

SEQ ID NO: 496515 - DNA, 25 bp, Rattus norvegicus
acggtcccagggcatgagttcctgc

SEQ ID NO: 496516 - DNA, 25 bp, Rattus norvegicus
tcctgctgcagtcggatgaggagac

SEQ ID NO: 496517 - DNA, 25 bp, Rattus norvegicus
agctgagagcatggcaccgcgcgct

SEQ ID NO: 496518 - DNA, 25 bp, Rattus norvegicus
agggatttgggctctcctcgctaac

SEQ ID NO: 496519 - DNA, 25 bp, Rattus norvegicus
cagatccgcacggtcccagggcatg

SEQ ID NO: 496520 - DNA, 25 bp, Rattus norvegicus
gcgagccaccgtctacactcacgtc

SEQ ID NO: 496521 - DNA, 25 bp, Rattus norvegicus
cccttcatactactaaagacatcgc

SEQ ID NO: 496522 - DNA, 25 bp, Rattus norvegicus
agacatcgctaacttttccagtttc

SEQ ID NO: 496523 - DNA, 25 bp, Rattus norvegicus
tcgctaacttttccagtttcagtaa

SEQ ID NO: 496524 - DNA, 25 bp, Rattus norvegicus
cagtaaaggttttctgggcggtatg

SEQ ID NO: 496525 - DNA, 25 bp, Rattus norvegicus
ttttctgggcggtatgagagcaaga

SEQ ID NO: 496526 - DNA, 25 bp, Rattus norvegicus
gtatgagagcaagagaattagcctc

SEQ ID NO: 496527 - DNA, 25 bp, Rattus norvegicus
tcccagagacccgaatcatcttcgg

SEQ ID NO: 496528 - DNA, 25 bp, Rattus norvegicus
cccgaatcatcttcggtgtctattt

SEQ ID NO: 496529 - DNA, 25 bp, Rattus norvegicus
cttcggtgtctattttctagagtcc

SEQ ID NO: 496530 - DNA, 25 bp, Rattus norvegicus
ggcccacccaagtcgccgccgcagg

SEQ ID NO: 496531 - DNA, 25 bp, Rattus norvegicus
gctctggctgcagaccgctcagctt

SEQ ID NO: 496532 - DNA, 25 bp, Rattus norvegicus
cttcgcccacgcgagccaccgtcta

SEQ ID NO: 496533 - DNA, 25 bp, Rattus norvegicus
cggtatgagagcaagagaattagcc

SEQ ID NO: 496534 - DNA, 25 bp, Rattus norvegicus
accacgccggacgtggtgacgtagc

SEQ ID NO: 496535 - DNA, 25 bp, Rattus norvegicus
aacgcggcgagcgaggcagcggcca

SEQ ID NO: 496536 - DNA, 25 bp, Rattus norvegicus
ggaggcgcgttctcagaggagtcga

SEQ ID NO: 496537 - DNA, 25 bp, Rattus norvegicus
agacgaggggcaaggtgcgccctga

SEQ ID NO: 496538 - DNA, 25 bp, Rattus norvegicus
ctccctgagaggagacgaggggagc

SEQ ID NO: 496539 - DNA, 25 bp, Rattus norvegicus
aggcgcgctctgaggggaggcagaa

SEQ ID NO: 496540 - DNA, 25 bp, Rattus norvegicus
ccccgggaggcgcacacaggaagca

SEQ ID NO: 496541 - DNA, 25 bp, Rattus norvegicus
cacacaggaagcagggacgcgagcc

SEQ ID NO: 496542 - DNA, 25 bp, Rattus norvegicus
ggctctgagagcgacctcgggaccc

SEQ ID NO: 496543 - DNA, 25 bp, Rattus norvegicus
cgctgacgaccacgccggacgtggt

SEQ ID NO: 496544 - DNA, 25 bp, Rattus norvegicus
cccgtgaggtgaggccacctcgggc

SEQ ID NO: 496545 - DNA, 25 bp, Rattus norvegicus
aggtggcggtgccacctgtgacgga

SEQ ID NO: 496546 - DNA, 25 bp, Rattus norvegicus
cacctgtgacggagcgagggtccgg

SEQ ID NO: 496547 - DNA, 25 bp, Rattus norvegicus
aggacgcgctgacgaccacgccgga

SEQ ID NO: 496548 - DNA, 25 bp, Rattus norvegicus
cgcatgctctggagcgaacaccgga

SEQ ID NO: 496549 - DNA, 25 bp, Rattus norvegicus
tgaccctacaactgcggtgtaatcg

SEQ ID NO: 496550 - DNA, 25 bp, Rattus norvegicus
ccggactgtcttgaccctacaactg

SEQ ID NO: 496551 - DNA, 25 bp, Rattus norvegicus
cctgcgcactgagacgtcgtgcaga

SEQ ID NO: 496552 - DNA, 25 bp, Rattus norvegicus
gcggcgtctcggaagcgcatgctct

SEQ ID NO: 496553 - DNA, 25 bp, Rattus norvegicus
tctggagcgaacaccggacgttgga

SEQ ID NO: 496554 - DNA, 25 bp, Rattus norvegicus
tggttagtccgtgagaattgatgga

SEQ ID NO: 496555 - DNA, 25 bp, Rattus norvegicus
ccgtgagaattgatggaggagattc

SEQ ID NO: 496556 - DNA, 25 bp, Rattus norvegicus
aagcacgtggtgaaatatggtccta

SEQ ID NO: 496557 - DNA, 25 bp, Rattus norvegicus
atatggtcctaagagcttgtctaac

SEQ ID NO: 496558 - DNA, 25 bp, Rattus norvegicus
gagcttgtctaactttacaggagca

SEQ ID NO: 496559 - DNA, 25 bp, Rattus norvegicus
actttacaggagcagtggtgacggc

SEQ ID NO: 496560 - DNA, 25 bp, Rattus norvegicus
cctgcacgggaacccggactgtctt

SEQ ID NO: 496561 - DNA, 25 bp, Rattus norvegicus
tgcagaagccggctcgcggcgtctc

SEQ ID NO: 496562 - DNA, 25 bp, Rattus norvegicus
gcgtcctctccaatcacatcaacac

SEQ ID NO: 496563 - DNA, 25 bp, Rattus norvegicus
acccgaatgacagtgtgacgcccgc

SEQ ID NO: 496564 - DNA, 25 bp, Rattus norvegicus
gtgtctgcttgcaggtgtgtgtctc

SEQ ID NO: 496565 - DNA, 25 bp, Rattus norvegicus
cttgcaggtgtgtgtctcggtgaca

SEQ ID NO: 496566 - DNA, 25 bp, Rattus norvegicus
ctgcgcggcagcaagaacccgaatg

SEQ ID NO: 496567 - DNA, 25 bp, Rattus norvegicus
cagcaagaacccgaatgacagtgtg

SEQ ID NO: 496568 - DNA, 25 bp, Rattus norvegicus
aatgacagtgtgacgcccgcgcccg

SEQ ID NO: 496569 - DNA, 25 bp, Rattus norvegicus
cgcgttcccgtgagtgagagccgct

SEQ ID NO: 496570 - DNA, 25 bp, Rattus norvegicus
ttcccgtgagtgagagccgctgatt

SEQ ID NO: 496571 - DNA, 25 bp, Rattus norvegicus
agagccgctgattgagtctcccgcc

SEQ ID NO: 496572 - DNA, 25 bp, Rattus norvegicus
tccgcatcatctccatccattattg

SEQ ID NO: 496573 - DNA, 25 bp, Rattus norvegicus
ttattgaagaaacagccgcgtcctc

SEQ ID NO: 496574 - DNA, 25 bp, Rattus norvegicus
gcgctgctctggtgtctgcttgcag

SEQ ID NO: 496575 - DNA, 25 bp, Rattus norvegicus
tccatccattattgaagaaacagcc

SEQ ID NO: 496576 - DNA, 25 bp, Rattus norvegicus
gccagccacgcggattagtatcctg

SEQ ID NO: 496577 - DNA, 25 bp, Rattus norvegicus
gagcctgagagcggctcggcctcca

SEQ ID NO: 496578 - DNA, 25 bp, Rattus norvegicus
gcgccggcacccacggaccaccgta

SEQ ID NO: 496579 - DNA, 25 bp, Rattus norvegicus
caccgtaatcggctcgctccggaga

SEQ ID NO: 496580 - DNA, 25 bp, Rattus norvegicus
taatcggctcgctccggagagcaca

SEQ ID NO: 496581 - DNA, 25 bp, Rattus norvegicus
ggagagcacagctgcatttgacttg

SEQ ID NO: 496582 - DNA, 25 bp, Rattus norvegicus
agctgcatttgacttgctgcgccgc

SEQ ID NO: 496583 - DNA, 25 bp, Rattus norvegicus
gcatttgacttgctgcgccgccagc

SEQ ID NO: 496584 - DNA, 25 bp, Rattus norvegicus
cggattagtatcctggagcggttta

SEQ ID NO: 496585 - DNA, 25 bp, Rattus norvegicus
tcctggagcggtttagagttgaaga

SEQ ID NO: 496586 - DNA, 25 bp, Rattus norvegicus
gtttagagttgaagagtctggtccc

SEQ ID NO: 496587 - DNA, 25 bp, Rattus norvegicus
ttgggaccacgggtcgctcctaatc

SEQ ID NO: 496588 - DNA, 25 bp, Rattus norvegicus
gggtcgctcctaatcctcggctaac

SEQ ID NO: 496589 - DNA, 25 bp, Rattus norvegicus
gtcgctcctaatcctcggctaacga

SEQ ID NO: 496590 - DNA, 25 bp, Rattus norvegicus
cggcagccgctgaataacttccatc

SEQ ID NO: 496591 - DNA, 25 bp, Rattus norvegicus
gtgacaccccgtgaggttcctgcaa

SEQ ID NO: 496592 - DNA, 25 bp, Rattus norvegicus
tcatcttgcagtgtgcgcgcatgcg

SEQ ID NO: 496593 - DNA, 25 bp, Rattus norvegicus
gacgtcatcttgcagtgtgcgcgca

SEQ ID NO: 496594 - DNA, 25 bp, Rattus norvegicus
ttgttgctgacgtcatcttgcagtg

SEQ ID NO: 496595 - DNA, 25 bp, Rattus norvegicus
tgtggttgtcttgttgctgacgtca

SEQ ID NO: 496596 - DNA, 25 bp, Rattus norvegicus
gcgcgcctgtgcagaacagggtatt

SEQ ID NO: 496597 - DNA, 25 bp, Rattus norvegicus
gtgtctctatttcgcgctgtcttgc

SEQ ID NO: 496598 - DNA, 25 bp, Rattus norvegicus
gaactggaggagagacgtgacaccc

SEQ ID NO: 496599 - DNA, 25 bp, Rattus norvegicus
cttgttcgccctgggctgcgggaac

SEQ ID NO: 496600 - DNA, 25 bp, Rattus norvegicus
agagctcggaatccgcaccatggtg

SEQ ID NO: 496601 - DNA, 25 bp, Rattus norvegicus
gggagagctcggaatccgcaccatg

SEQ ID NO: 496602 - DNA, 25 bp, Rattus norvegicus
tctatttcgcgctgtcttgctgccg

SEQ ID NO: 496603 - DNA, 25 bp, Rattus norvegicus
gctgaataacttccatccctggggc

SEQ ID NO: 496604 - DNA, 25 bp, Rattus norvegicus
gcccagttgctcgttcatctgcaga

SEQ ID NO: 496605 - DNA, 25 bp, Rattus norvegicus
atgagtgttttcagtctctccgggt

SEQ ID NO: 496606 - DNA, 25 bp, Rattus norvegicus
ggcaggctgccttatataaaatgag

SEQ ID NO: 496607 - DNA, 25 bp, Rattus norvegicus
tccgtcacggcgtgggccaatggca

SEQ ID NO: 496608 - DNA, 25 bp, Rattus norvegicus
actggccgctgagggcgagccacac

SEQ ID NO: 496609 - DNA, 25 bp, Rattus norvegicus
ggcgctctcccgcactttctgtttt

SEQ ID NO: 496610 - DNA, 25 bp, Rattus norvegicus
tgttttcctactcacttgcgagccg

SEQ ID NO: 496611 - DNA, 25 bp, Rattus norvegicus
cctcagccaaaactttgggtggcga

SEQ ID NO: 496612 - DNA, 25 bp, Rattus norvegicus
gctgcgtttgcaggcagcacctctc

SEQ ID NO: 496613 - DNA, 25 bp, Rattus norvegicus
aaacaacaacggagcggtcctcacg

SEQ ID NO: 496614 - DNA, 25 bp, Rattus norvegicus
tgaccgggaccagcagcccagttgc

SEQ ID NO: 496615 - DNA, 25 bp, Rattus norvegicus
ctgcagagttaggatttgggtgttc

SEQ ID NO: 496616 - DNA, 25 bp, Rattus norvegicus
ctctccgggttgcatgtactgtatg

SEQ ID NO: 496617 - DNA, 25 bp, Rattus norvegicus
cttcaaggaggcgaaagtacgtgga

SEQ ID NO: 496618 - DNA, 25 bp, Rattus norvegicus
gctgcttctagagcgcatgcgcgag

SEQ ID NO: 496619 - DNA, 25 bp, Rattus norvegicus
tagggtattgctaacacagcgtctg

SEQ ID NO: 496620 - DNA, 25 bp, Rattus norvegicus
acagcgtctgcggatctttacctta

SEQ ID NO: 496621 - DNA, 25 bp, Rattus norvegicus
cagaaccctgttcttacccgagtgg

SEQ ID NO: 496622 - DNA, 25 bp, Rattus norvegicus
gatttcctggtgaagcatccgttcc

SEQ ID NO: 496623 - DNA, 25 bp, Rattus norvegicus
gtgcctcgttaactgagcggttaca

SEQ ID NO: 496624 - DNA, 25 bp, Rattus norvegicus
aagaccctaggacgtctgatcgcca

SEQ ID NO: 496625 - DNA, 25 bp, Rattus norvegicus
gaggaccagccgctaacttgtattg

SEQ ID NO: 496626 - DNA, 25 bp, Rattus norvegicus
tggtcatccagtatccagaaccctg

SEQ ID NO: 496627 - DNA, 25 bp, Rattus norvegicus
gtgcgctgtctcagggatttcctgg

SEQ ID NO: 496628 - DNA, 25 bp, Rattus norvegicus
ccacttgttcgctagggtattgcta

SEQ ID NO: 496629 - DNA, 25 bp, Rattus norvegicus
taggagcccaagcaccgcacgtgcg

SEQ ID NO: 496630 - DNA, 25 bp, Rattus norvegicus
tctgatcgccagaactaggagccca

SEQ ID NO: 496631 - DNA, 25 bp, Rattus norvegicus
agagaagggtaccatcgccaccgga

SEQ ID NO: 496632 - DNA, 25 bp, Rattus norvegicus
cggcacgatactgacacttaggtta

SEQ ID NO: 496633 - DNA, 25 bp, Rattus norvegicus
acatggtccacaatcttgccggtca

SEQ ID NO: 496634 - DNA, 25 bp, Rattus norvegicus
tgaagcacacctgcgacgggtcgta

SEQ ID NO: 496635 - DNA, 25 bp, Rattus norvegicus
cgcggtttgtcttctcatattctac

SEQ ID NO: 496636 - DNA, 25 bp, Rattus norvegicus
cgtggcaattaaaagcgcgcgactc

SEQ ID NO: 496637 - DNA, 25 bp, Rattus norvegicus
cacacgcttggaaggcggcacgata

SEQ ID NO: 496638 - DNA, 25 bp, Rattus norvegicus
tacccaggctggacgaattgtgacg

SEQ ID NO: 496639 - DNA, 25 bp, Rattus norvegicus
ctgaaggtaccgttcacatggtcca

SEQ ID NO: 496640 - DNA, 25 bp, Rattus norvegicus
ctctgcgtgtgctcggtgaagcaca

SEQ ID NO: 496641 - DNA, 25 bp, Rattus norvegicus
ttcaggccctcggaagaagcgggca

SEQ ID NO: 496642 - DNA, 25 bp, Rattus norvegicus
ctaatgccagcgtagactgtagagg

SEQ ID NO: 496643 - DNA, 25 bp, Rattus norvegicus
cgggccgctttaatggatggctttc

SEQ ID NO: 496644 - DNA, 25 bp, Rattus norvegicus
tgccggtcaccagcagcgagaactt

SEQ ID NO: 496645 - DNA, 25 bp, Rattus norvegicus
cagcgagaacttgagggtatgtaca

SEQ ID NO: 496646 - DNA, 25 bp, Rattus norvegicus
ttcggcctggagatgagaatcattg

SEQ ID NO: 496647 - DNA, 25 bp, Rattus norvegicus
tcagccaacttgctgggtgcgtgcc

SEQ ID NO: 496648 - DNA, 25 bp, Rattus norvegicus
tcctaaagcgggtagtctgtctgtc

SEQ ID NO: 496649 - DNA, 25 bp, Rattus norvegicus
acgcacaaagttgggacgcttagtg

SEQ ID NO: 496650 - DNA, 25 bp, Rattus norvegicus
atgcagggttcttcgtgtcccggac

SEQ ID NO: 496651 - DNA, 25 bp, Rattus norvegicus
taccttcctaaggagccaaggacca

SEQ ID NO: 496652 - DNA, 25 bp, Rattus norvegicus
gaccaaagagcaagaggagccattc

SEQ ID NO: 496653 - DNA, 25 bp, Rattus norvegicus
ggaaggtgactttcactgtgacaca

SEQ ID NO: 496654 - DNA, 25 bp, Rattus norvegicus
ccaagacgccaggtctgggcgcaga

SEQ ID NO: 496655 - DNA, 25 bp, Rattus norvegicus
aggaccctggtcctgtgatgcccga

SEQ ID NO: 496656 - DNA, 25 bp, Rattus norvegicus
gtgtcctatgctcctggcagaggtg

SEQ ID NO: 496657 - DNA, 25 bp, Rattus norvegicus
cctcgggcgactaacactgagcaca

SEQ ID NO: 496658 - DNA, 25 bp, Rattus norvegicus
cccatcacgtctgtcaatagactga

SEQ ID NO: 496659 - DNA, 25 bp, Rattus norvegicus
gccattccgggagcagccgcatctt

SEQ ID NO: 496660 - DNA, 25 bp, Rattus norvegicus
tgcatggacggccagagatcacccg

SEQ ID NO: 496661 - DNA, 25 bp, Rattus norvegicus
ggtgttcggttcctcctgctccgct

SEQ ID NO: 496662 - DNA, 25 bp, Rattus norvegicus
ccgcgccatgccgttagtttgaatg

SEQ ID NO: 496663 - DNA, 25 bp, Rattus norvegicus
gcgcacgtacgtgcacacgcgtcta

SEQ ID NO: 496664 - DNA, 25 bp, Rattus norvegicus
acaagtatacaaagacacgcgcacg

SEQ ID NO: 496665 - DNA, 25 bp, Rattus norvegicus
gcagtttcacaaccacgcacaagta

SEQ ID NO: 496666 - DNA, 25 bp, Rattus norvegicus
ctgtgagccgagagcgcagtttcac

SEQ ID NO: 496667 - DNA, 25 bp, Rattus norvegicus
cactcctactcctgtgagccgagag

SEQ ID NO: 496668 - DNA, 25 bp, Rattus norvegicus
actgaggtgaccgaggccgagctat

SEQ ID NO: 496669 - DNA, 25 bp, Rattus norvegicus
gcgcaggaatcccttcggtgtttca

SEQ ID NO: 496670 - DNA, 25 bp, Rattus norvegicus
cctccgagaggctgctgcggagact

SEQ ID NO: 496671 - DNA, 25 bp, Rattus norvegicus
gtgttatccgctctgccaggtggct

SEQ ID NO: 496672 - DNA, 25 bp, Rattus norvegicus
ccgctcccggaggatgtacccttag

SEQ ID NO: 496673 - DNA, 25 bp, Rattus norvegicus
cggggactcaagaatcgggctccga

SEQ ID NO: 496674 - DNA, 25 bp, Rattus norvegicus
ctcccacagaccgttggttggggcg

SEQ ID NO: 496675 - DNA, 25 bp, Rattus norvegicus
tcactgcggtgctgcgccccagcct

SEQ ID NO: 496676 - DNA, 25 bp, Rattus norvegicus
cgaggtgcgccctcactgcggtgct

SEQ ID NO: 496677 - DNA, 25 bp, Rattus norvegicus
cagccaccgaggtgcgccctcactg

SEQ ID NO: 496678 - DNA, 25 bp, Rattus norvegicus
tcctttctgtcgccctggctgggcg

SEQ ID NO: 496679 - DNA, 25 bp, Rattus norvegicus
cgtcctttctgtcgccctggctggg

SEQ ID NO: 496680 - DNA, 25 bp, Rattus norvegicus
tcgtcctttctgtcgccctggctgg

SEQ ID NO: 496681 - DNA, 25 bp, Rattus norvegicus
ggactcccgctcgtcctttctgtcg

SEQ ID NO: 496682 - DNA, 25 bp, Rattus norvegicus
cgcggctcccacagaccgttggttg

SEQ ID NO: 496683 - DNA, 25 bp, Rattus norvegicus
ccgcggagccgggtaagcgcggtcg

SEQ ID NO: 496684 - DNA, 25 bp, Rattus norvegicus
cggctcccacagaccgttggttggg

SEQ ID NO: 496685 - DNA, 25 bp, Rattus norvegicus
aagcgcggtcgggtccagccggact

SEQ ID NO: 496686 - DNA, 25 bp, Rattus norvegicus
ctgccctggcggatcgcggggagac

SEQ ID NO: 496687 - DNA, 25 bp, Rattus norvegicus
tccagccggactcccgctcgtcctt

SEQ ID NO: 496688 - DNA, 25 bp, Rattus norvegicus
tgcgctccgaatgggcgaaaccatc

SEQ ID NO: 496689 - DNA, 25 bp, Rattus norvegicus
acggggagaagaactatggcgtcct

SEQ ID NO: 496690 - DNA, 25 bp, Rattus norvegicus
cccagcgtcaggctagtttgccgct

SEQ ID NO: 496691 - DNA, 25 bp, Rattus norvegicus
tccctttgctagcacccttagggtg

SEQ ID NO: 496692 - DNA, 25 bp, Rattus norvegicus
tcgccgtgtcctggtatccgtcact

SEQ ID NO: 496693 - DNA, 25 bp, Rattus norvegicus
ctgtcgctcagcaagacagcgattc

SEQ ID NO: 496694 - DNA, 25 bp, Rattus norvegicus
aggctcccggatcctgctgggtaca

SEQ ID NO: 496695 - DNA, 25 bp, Rattus norvegicus
gttaccgatacctaccaagccgcga

SEQ ID NO: 496696 - DNA, 25 bp, Rattus norvegicus
gacgcaccgatcaagtccgaatctc

SEQ ID NO: 496697 - DNA, 25 bp, Rattus norvegicus
accacaaggctcagggacgcaccga

SEQ ID NO: 496698 - DNA, 25 bp, Rattus norvegicus
cggcgttgccaccacaaggctcagg

SEQ ID NO: 496699 - DNA, 25 bp, Rattus norvegicus
agatgttaaacaagcccggcggcgt

SEQ ID NO: 496700 - DNA, 25 bp, Rattus norvegicus
agccctagtccggagatgttaaaca

SEQ ID NO: 496701 - DNA, 25 bp, Rattus norvegicus
gtgaggactccgctatctcgccctg

SEQ ID NO: 496702 - DNA, 25 bp, Rattus norvegicus
aaatcagacagcaccgcgacccaga

SEQ ID NO: 496703 - DNA, 25 bp, Rattus norvegicus
cgctgggcttcgttttatgcgggta

SEQ ID NO: 496704 - DNA, 25 bp, Rattus norvegicus
tagactcgtgaagcagcaactctgg

SEQ ID NO: 496705 - DNA, 25 bp, Rattus norvegicus
ccgagtccgcggagtgaaagcacaa

SEQ ID NO: 496706 - DNA, 25 bp, Rattus norvegicus
cacaacgccgagtaggaccagacca

SEQ ID NO: 496707 - DNA, 25 bp, Rattus norvegicus
accagaccaggaaaatagactcgtg

SEQ ID NO: 496708 - DNA, 25 bp, Rattus norvegicus
ccaacaagtgagaaggcgcggcgtt

SEQ ID NO: 496709 - DNA, 25 bp, Rattus norvegicus
ctgtgcgaaagctagagcaggcgcc

SEQ ID NO: 496710 - DNA, 25 bp, Rattus norvegicus
cgccagagaagacagctcgagctca

SEQ ID NO: 496711 - DNA, 25 bp, Rattus norvegicus
tttatgcgggtacgagccacgtccc

SEQ ID NO: 496712 - DNA, 25 bp, Rattus norvegicus
tcgagctcagaacccgagaccaagc

SEQ ID NO: 496713 - DNA, 25 bp, Rattus norvegicus
tctgtttcaacccatcggctgcttg

SEQ ID NO: 496714 - DNA, 25 bp, Rattus norvegicus
tcggctgcttgcttcaaatcagaca

SEQ ID NO: 496715 - DNA, 25 bp, Rattus norvegicus
gcccagcggctgtactccagatact

SEQ ID NO: 496716 - DNA, 25 bp, Rattus norvegicus
gcttcaaggccgctatcagccggtg

SEQ ID NO: 496717 - DNA, 25 bp, Rattus norvegicus
cggggactcgccgatttccaatgcg

SEQ ID NO: 496718 - DNA, 25 bp, Rattus norvegicus
tcccacggttcccacgaagctgatg

SEQ ID NO: 496719 - DNA, 25 bp, Rattus norvegicus
ggttccgttcctccatgagcagtgc

SEQ ID NO: 496720 - DNA, 25 bp, Rattus norvegicus
tgagcagtgccatcctgcacctgag

SEQ ID NO: 496721 - DNA, 25 bp, Rattus norvegicus
ctggcttttcgtcgcgccagatgtc

SEQ ID NO: 496722 - DNA, 25 bp, Rattus norvegicus
gtgccagcggacaaggcttcaaggc

SEQ ID NO: 496723 - DNA, 25 bp, Rattus norvegicus
tccaatgcgggaaccttgtcgcagc

SEQ ID NO: 496724 - DNA, 25 bp, Rattus norvegicus
ctatcagccggtgggctctacggag

SEQ ID NO: 496725 - DNA, 25 bp, Rattus norvegicus
acggagctggcctctccatggcaac

SEQ ID NO: 496726 - DNA, 25 bp, Rattus norvegicus
atggcaaccgtgacgtcaccacggc

SEQ ID NO: 496727 - DNA, 25 bp, Rattus norvegicus
acggcagaacccactgagcccagtg

SEQ ID NO: 496728 - DNA, 25 bp, Rattus norvegicus
tactacgaccgctcatggtgccagc

SEQ ID NO: 496729 - DNA, 25 bp, Rattus norvegicus
agctgatgtcgctggtcagacgctc

SEQ ID NO: 496730 - DNA, 25 bp, Rattus norvegicus
aagcggtacccgagctgggtgatcc

SEQ ID NO: 496731 - DNA, 25 bp, Rattus norvegicus
cggcgtcatcccgagagtctctgac

SEQ ID NO: 496732 - DNA, 25 bp, Rattus norvegicus
cagaagttccgcagccaggcttcta

SEQ ID NO: 496733 - DNA, 25 bp, Rattus norvegicus
ccacgactgttccagcggcgtctgt

SEQ ID NO: 496734 - DNA, 25 bp, Rattus norvegicus
acgaactggctcagcaggccgagga

SEQ ID NO: 496735 - DNA, 25 bp, Rattus norvegicus
gcctaggttttctgcgcacggagtt

SEQ ID NO: 496736 - DNA, 25 bp, Rattus norvegicus
ctctcgggttgctgcttctcttcct

SEQ ID NO: 496737 - DNA, 25 bp, Rattus norvegicus
tcttcctcctaggttacggctgggc

SEQ ID NO: 496738 - DNA, 25 bp, Rattus norvegicus
ctgcacgaagctggcaggacgaact

SEQ ID NO: 496739 - DNA, 25 bp, Rattus norvegicus
gccggcgcccgcaaaaagcgaagga

SEQ ID NO: 496740 - DNA, 25 bp, Rattus norvegicus
cttagcggccgcctctggagacact

SEQ ID NO: 496741 - DNA, 25 bp, Rattus norvegicus
ccaagccgccaacagctcaaggaga

SEQ ID NO: 496742 - DNA, 25 bp, Rattus norvegicus
cagagcgcccgagcctgcagaagtt

SEQ ID NO: 496743 - DNA, 25 bp, Rattus norvegicus
agttgctctctgtcggcctaggttt

SEQ ID NO: 496744 - DNA, 25 bp, Rattus norvegicus
ctcggttctattcccacagctgctg

SEQ ID NO: 496745 - DNA, 25 bp, Rattus norvegicus
gcgatcatccgcctaaagttgtatt

SEQ ID NO: 496746 - DNA, 25 bp, Rattus norvegicus
acggcaccacggctggtgagcgttc

SEQ ID NO: 496747 - DNA, 25 bp, Rattus norvegicus
ttgtgcggcccggtcattttcaccc

SEQ ID NO: 496748 - DNA, 25 bp, Rattus norvegicus
tcgcgagttcgggtccgagcagaaa

SEQ ID NO: 496749 - DNA, 25 bp, Rattus norvegicus
gcttagtctaggtcggcttcggtct

SEQ ID NO: 496750 - DNA, 25 bp, Rattus norvegicus
ggccactcgtagctctcggtgcagt

SEQ ID NO: 496751 - DNA, 25 bp, Rattus norvegicus
gcaccatcctgttgggcatctggta

SEQ ID NO: 496752 - DNA, 25 bp, Rattus norvegicus
ggagcccgcggtgacatcacgagcc

SEQ ID NO: 496753 - DNA, 25 bp, Rattus norvegicus
gtcgcgccctggactcggttctatt

SEQ ID NO: 496754 - DNA, 25 bp, Rattus norvegicus
ctgagctatgaagatggtcgcgccc

SEQ ID NO: 496755 - DNA, 25 bp, Rattus norvegicus
caaacttgtgcgagcgcctgagcta

SEQ ID NO: 496756 - DNA, 25 bp, Rattus norvegicus
gagagacggtctcgcaaacttgtgc

SEQ ID NO: 496757 - DNA, 25 bp, Rattus norvegicus
ccgcaccgctaagtcgcttagtcta

SEQ ID NO: 496758 - DNA, 25 bp, Rattus norvegicus
atcgcggccgtttaactcggaggct

SEQ ID NO: 496759 - DNA, 25 bp, Rattus norvegicus
gcttccagtaggctcgggacgagcc

SEQ ID NO: 496760 - DNA, 25 bp, Rattus norvegicus
cccggcggaaggatgccaaatgtga

SEQ ID NO: 496761 - DNA, 25 bp, Rattus norvegicus
gactttctactcacagcccggcgga

SEQ ID NO: 496762 - DNA, 25 bp, Rattus norvegicus
tgaggaaatcaaggactttctactc

SEQ ID NO: 496763 - DNA, 25 bp, Rattus norvegicus
gcagcctcggaaaattgaggaaatc

SEQ ID NO: 496764 - DNA, 25 bp, Rattus norvegicus
ccctgtgttgcagcctcggaaaatt

SEQ ID NO: 496765 - DNA, 25 bp, Rattus norvegicus
accgggacgggcttgatcgcctcaa

SEQ ID NO: 496766 - DNA, 25 bp, Rattus norvegicus
ccacaggtgctgacgccagagccga

SEQ ID NO: 496767 - DNA, 25 bp, Rattus norvegicus
ttaaatccgaggcaatccgtagccg

SEQ ID NO: 496768 - DNA, 25 bp, Rattus norvegicus
ttttccgttgttcggtgctcgctcc

SEQ ID NO: 496769 - DNA, 25 bp, Rattus norvegicus
caaatgtgagtgtgcgcttccagta

SEQ ID NO: 496770 - DNA, 25 bp, Rattus norvegicus
cccgtcgccatggtgagtccgggac

SEQ ID NO: 496771 - DNA, 25 bp, Rattus norvegicus
ttgggcgcctctgaaaagcagtttc

SEQ ID NO: 496772 - DNA, 25 bp, Rattus norvegicus
gtccagttctcgtctaccggccgtg

SEQ ID NO: 496773 - DNA, 25 bp, Rattus norvegicus
gggctgcccactcgcggcgtgggtt

SEQ ID NO: 496774 - DNA, 25 bp, Rattus norvegicus
agttctcgtctaccggccgtggacg

SEQ ID NO: 496775 - DNA, 25 bp, Rattus norvegicus
tctaccggccgtggacgccgggctg

SEQ ID NO: 496776 - DNA, 25 bp, Rattus norvegicus
acgccgggctgctgttcctgtggct

SEQ ID NO: 496777 - DNA, 25 bp, Rattus norvegicus
gaggggcgctctcggccatcccttg

SEQ ID NO: 496778 - DNA, 25 bp, Rattus norvegicus
cgcgccacggcaggaatggcagcgc

SEQ ID NO: 496779 - DNA, 25 bp, Rattus norvegicus
ctctgctcgcgcgacttttgtagcc

SEQ ID NO: 496780 - DNA, 25 bp, Rattus norvegicus
tgctcgcgcgacttttgtagccaga

SEQ ID NO: 496781 - DNA, 25 bp, Rattus norvegicus
ccacgcgcgccacggcaggaatggc

SEQ ID NO: 496782 - DNA, 25 bp, Rattus norvegicus
gcgcgacttttgtagccagactacg

SEQ ID NO: 496783 - DNA, 25 bp, Rattus norvegicus
cagttctcgtctaccggccgtggac

SEQ ID NO: 496784 - DNA, 25 bp, Rattus norvegicus
tcgcgcgacttttgtagccagacta

SEQ ID NO: 496785 - DNA, 25 bp, Rattus norvegicus
cggccatcccttggggctgcccact

SEQ ID NO: 496786 - DNA, 25 bp, Rattus norvegicus
aggcgggaacttccggtctgccttg

SEQ ID NO: 496787 - DNA, 25 bp, Rattus norvegicus
ccgccgtccccatgtgtggaggatc

SEQ ID NO: 496788 - DNA, 25 bp, Rattus norvegicus
ctgggaccctgcttcccacagctgt

SEQ ID NO: 496789 - DNA, 25 bp, Rattus norvegicus
aatagaggcgggaacttccggtctg

SEQ ID NO: 496790 - DNA, 25 bp, Rattus norvegicus
cagtcggaatagaggcgggaacttc

SEQ ID NO: 496791 - DNA, 25 bp, Rattus norvegicus
catcagtcggaatagaggcgggaac

SEQ ID NO: 496792 - DNA, 25 bp, Rattus norvegicus
gcggaacatcagtcggaatagaggc

SEQ ID NO: 496793 - DNA, 25 bp, Rattus norvegicus
gaggcggaacatcagtcggaataga

SEQ ID NO: 496794 - DNA, 25 bp, Rattus norvegicus
tcgaggcggaacatcagtcggaata

SEQ ID NO: 496795 - DNA, 25 bp, Rattus norvegicus
cctcgaggcggaacatcagtcggaa

SEQ ID NO: 496796 - DNA, 25 bp, Rattus norvegicus
aagcgtcactcgctaatcagggcct

SEQ ID NO: 496797 - DNA, 25 bp, Rattus norvegicus
tcaagcgtcactcgctaatcagggc

SEQ ID NO: 496798 - DNA, 25 bp, Rattus norvegicus
tgtcactcaagcgtcactcgctaat

SEQ ID NO: 496799 - DNA, 25 bp, Rattus norvegicus
tgaggtcagaatccgcgctatggtg

SEQ ID NO: 496800 - DNA, 25 bp, Rattus norvegicus
atgcacaatctgtcacgctccgggg

SEQ ID NO: 496801 - DNA, 25 bp, Rattus norvegicus
ttgcagggagccttgcaggcagcca

SEQ ID NO: 496802 - DNA, 25 bp, Rattus norvegicus
agagcgctctggaatgggacttgaa

SEQ ID NO: 496803 - DNA, 25 bp, Rattus norvegicus
cggtgcccaaggagctctgcggtcc

SEQ ID NO: 496804 - DNA, 25 bp, Rattus norvegicus
gcggacaacggagacggatcctcac

SEQ ID NO: 496805 - DNA, 25 bp, Rattus norvegicus
ggagacggatcctcacggctgcgcc

SEQ ID NO: 496806 - DNA, 25 bp, Rattus norvegicus
gcatggcagtagtctacgagtgccc

SEQ ID NO: 496807 - DNA, 25 bp, Rattus norvegicus
ctgacccgggctcagacagatgacc

SEQ ID NO: 496808 - DNA, 25 bp, Rattus norvegicus
gccgcccttgcagggagccttgcag

SEQ ID NO: 496809 - DNA, 25 bp, Rattus norvegicus
ccactgaccgacagatgcacaatct

SEQ ID NO: 496810 - DNA, 25 bp, Rattus norvegicus
gtcctcggctgggagaagtcccgcc

SEQ ID NO: 496811 - DNA, 25 bp, Rattus norvegicus
cacgccgggctagacgcgggacaca

SEQ ID NO: 496812 - DNA, 25 bp, Rattus norvegicus
ggacacacggcatggcagtagtcta

SEQ ID NO: 496813 - DNA, 25 bp, Rattus norvegicus
gacagatgacccactgaccgacaga

SEQ ID NO: 496814 - DNA, 25 bp, Rattus norvegicus
tgtagcccgagctccgctacgcgtg

SEQ ID NO: 496815 - DNA, 25 bp, Rattus norvegicus
agcgccctcaacaaggcgggcgaca

SEQ ID NO: 496816 - DNA, 25 bp, Rattus norvegicus
ttgcgcgatgggctgctccagcagc

SEQ ID NO: 496817 - DNA, 25 bp, Rattus norvegicus
cacctgactgcgctttgcgcgatgg

SEQ ID NO: 496818 - DNA, 25 bp, Rattus norvegicus
gggctaggccacctgactgcgcttt

SEQ ID NO: 496819 - DNA, 25 bp, Rattus norvegicus
cgacctacacccgtgtggggctagg

SEQ ID NO: 496820 - DNA, 25 bp, Rattus norvegicus
tgagcatcgcatcctcgaccggcga

SEQ ID NO: 496821 - DNA, 25 bp, Rattus norvegicus
ctaagtttgcggtgagcatcgcatc

SEQ ID NO: 496822 - DNA, 25 bp, Rattus norvegicus
aacttcagccgctaagtttgcggtg

SEQ ID NO: 496823 - DNA, 25 bp, Rattus norvegicus
tcgcatagttgcagaaacttcagcc

SEQ ID NO: 496824 - DNA, 25 bp, Rattus norvegicus
ttgagaaagcaagatcgcatagttg

SEQ ID NO: 496825 - DNA, 25 bp, Rattus norvegicus
tgagctcttgagaaagcaagatcgc

SEQ ID NO: 496826 - DNA, 25 bp, Rattus norvegicus
tccgctacgcgtgcgtcttgagctc

SEQ ID NO: 496827 - DNA, 25 bp, Rattus norvegicus
acgcgtgcgtcttgagctcttgaga

SEQ ID NO: 496828 - DNA, 25 bp, Rattus norvegicus
tgggatcttccaggggtttcagaac

SEQ ID NO: 496829 - DNA, 25 bp, Rattus norvegicus
ttttaagtttgtcgttgccttgcca

SEQ ID NO: 496830 - DNA, 25 bp, Rattus norvegicus
cgctcctgcgctccttttaagtttg

SEQ ID NO: 496831 - DNA, 25 bp, Rattus norvegicus
tttcacttgcggaggtccatgctgc

SEQ ID NO: 496832 - DNA, 25 bp, Rattus norvegicus
gtccggttgccgcatctttcacttg

SEQ ID NO: 496833 - DNA, 25 bp, Rattus norvegicus
cttactcacagtggcggtgtccggt

SEQ ID NO: 496834 - DNA, 25 bp, Rattus norvegicus
cgccgcgtgtgtgggcttactcaca

SEQ ID NO: 496835 - DNA, 25 bp, Rattus norvegicus
agccctcggagcatttggcaggttg

SEQ ID NO: 496836 - DNA, 25 bp, Rattus norvegicus
tttcagaaccttgtcactgaccggc

SEQ ID NO: 496837 - DNA, 25 bp, Rattus norvegicus
agttcacttgctcgcccgccgtggt

SEQ ID NO: 496838 - DNA, 25 bp, Rattus norvegicus
gctcatgcgcgctcagttcacttgc

SEQ ID NO: 496839 - DNA, 25 bp, Rattus norvegicus
ttcatatgtgactccacgacacgtg

SEQ ID NO: 496840 - DNA, 25 bp, Rattus norvegicus
cctccggtgaattcgcagggtccga

SEQ ID NO: 496841 - DNA, 25 bp, Rattus norvegicus
tcactgaccggcgaagccctcggag

SEQ ID NO: 496842 - DNA, 25 bp, Rattus norvegicus
gcgctcgacagcgagccgttgctcg

SEQ ID NO: 496843 - DNA, 25 bp, Rattus norvegicus
tgtcctctggcagcggcagccactt

SEQ ID NO: 496844 - DNA, 25 bp, Rattus norvegicus
gcggccttacctggtttctgtgata

SEQ ID NO: 496845 - DNA, 25 bp, Rattus norvegicus
cgccggcgacgccatgaagagttgc

SEQ ID NO: 496846 - DNA, 25 bp, Rattus norvegicus
aaggacggccgaggcatcgtcctgc

SEQ ID NO: 496847 - DNA, 25 bp, Rattus norvegicus
acagctcgtcaaggacggccgaggc

SEQ ID NO: 496848 - DNA, 25 bp, Rattus norvegicus
ggcctggcgcccagtatgtgaagtt

SEQ ID NO: 496849 - DNA, 25 bp, Rattus norvegicus
agcacctggttcctgcggcacgcag

SEQ ID NO: 496850 - DNA, 25 bp, Rattus norvegicus
tttctgtgataccaggcgctcgaca

SEQ ID NO: 496851 - DNA, 25 bp, Rattus norvegicus
agtgtcggcgtcacgtgtcggctct

SEQ ID NO: 496852 - DNA, 25 bp, Rattus norvegicus
gaaggcgctgaagcctggcgtctct

SEQ ID NO: 496853 - DNA, 25 bp, Rattus norvegicus
cgtctctgccgagcctgcgtggagc

SEQ ID NO: 496854 - DNA, 25 bp, Rattus norvegicus
atgtgaagttgcgagacagctcgtc

SEQ ID NO: 496855 - DNA, 25 bp, Rattus norvegicus
ccatgaagagttgctccgcgagctg

SEQ ID NO: 496856 - DNA, 25 bp, Rattus norvegicus
ttccagaacgcgcaaggcgagctcc

SEQ ID NO: 496857 - DNA, 25 bp, Rattus norvegicus
tgggctttcagagccgctacgcgcc

SEQ ID NO: 496858 - DNA, 25 bp, Rattus norvegicus
ctcacaggcaaggtcagcacgcagc

SEQ ID NO: 496859 - DNA, 25 bp, Rattus norvegicus
cgtctccttggtctgctcacaggca

SEQ ID NO: 496860 - DNA, 25 bp, Rattus norvegicus
gcatctcagcttgggtcccgcctgt

SEQ ID NO: 496861 - DNA, 25 bp, Rattus norvegicus
ttacagactagagaggtgaatttcc

SEQ ID NO: 496862 - DNA, 25 bp, Rattus norvegicus
ccctcggctaagatttacagactag

SEQ ID NO: 496863 - DNA, 25 bp, Rattus norvegicus
tcggtccttgaaagctggagatctg

SEQ ID NO: 496864 - DNA, 25 bp, Rattus norvegicus
cggtgcacccaggtaagcgcttcca

SEQ ID NO: 496865 - DNA, 25 bp, Rattus norvegicus
tcgccagcaggtttgggaagtttcc

SEQ ID NO: 496866 - DNA, 25 bp, Rattus norvegicus
gtggcggtgcacacacacaggcgca

SEQ ID NO: 496867 - DNA, 25 bp, Rattus norvegicus
tccacgagcgttggagccacgcagc

SEQ ID NO: 496868 - DNA, 25 bp, Rattus norvegicus
gttcagcaccacagcgcagcgcggg

SEQ ID NO: 496869 - DNA, 25 bp, Rattus norvegicus
gggcgctgagttgaccctcttaccc

SEQ ID NO: 496870 - DNA, 25 bp, Rattus norvegicus
ggcacccgaactgggctgcgctctg

SEQ ID NO: 496871 - DNA, 25 bp, Rattus norvegicus
cgtcggcacagagactaggcgtccc

SEQ ID NO: 496872 - DNA, 25 bp, Rattus norvegicus
cgcggcttccgtcctcatcccgctc

SEQ ID NO: 496873 - DNA, 25 bp, Rattus norvegicus
tccctcccgctccagaacgcggttc

SEQ ID NO: 496874 - DNA, 25 bp, Rattus norvegicus
cagcgatggctactcaacttgcggc

SEQ ID NO: 496875 - DNA, 25 bp, Rattus norvegicus
gcagccggccgaacgcaagggacca

SEQ ID NO: 496876 - DNA, 25 bp, Rattus norvegicus
caggacgtcggcacagagactaggc

SEQ ID NO: 496877 - DNA, 25 bp, Rattus norvegicus
ccttgggcacccgaactgggctgcg

SEQ ID NO: 496878 - DNA, 25 bp, Rattus norvegicus
gctctgcgcctaacaggcgaggaca

SEQ ID NO: 496879 - DNA, 25 bp, Rattus norvegicus
gctcccgctgtcgtttacctcttgg

SEQ ID NO: 496880 - DNA, 25 bp, Rattus norvegicus
tgtcgtttacctcttgggcgccggc

SEQ ID NO: 496881 - DNA, 25 bp, Rattus norvegicus
cagaaagagggaccgaatggaccgt

SEQ ID NO: 496882 - DNA, 25 bp, Rattus norvegicus
accgaatggaccgtgaaggccgtag

SEQ ID NO: 496883 - DNA, 25 bp, Rattus norvegicus
gctactcaacttgcggcgcgccagg

SEQ ID NO: 496884 - DNA, 25 bp, Rattus norvegicus
tcaccaggtagacagacccgcacta

SEQ ID NO: 496885 - DNA, 25 bp, Rattus norvegicus
agcgcgctcagcgccgtaccttccc

SEQ ID NO: 496886 - DNA, 25 bp, Rattus norvegicus
gtagacagacccgcactatgcctcg

SEQ ID NO: 496887 - DNA, 25 bp, Rattus norvegicus
aacttctccgctctcagacctcgtc

SEQ ID NO: 496888 - DNA, 25 bp, Rattus norvegicus
agcccgcacgcatcgagagaacggt

SEQ ID NO: 496889 - DNA, 25 bp, Rattus norvegicus
cgcacgcatcgagagaacggtctca

SEQ ID NO: 496890 - DNA, 25 bp, Rattus norvegicus
acgcatcgagagaacggtctcacca

SEQ ID NO: 496891 - DNA, 25 bp, Rattus norvegicus
atcgagagaacggtctcaccaggta

SEQ ID NO: 496892 - DNA, 25 bp, Rattus norvegicus
agagaacggtctcaccaggtagaca

SEQ ID NO: 496893 - DNA, 25 bp, Rattus norvegicus
gcacccgaacttctccgctctcaga

SEQ ID NO: 496894 - DNA, 25 bp, Rattus norvegicus
gtctcaccaggtagacagacccgca

SEQ ID NO: 496895 - DNA, 25 bp, Rattus norvegicus
accaggtagacagacccgcactatg

SEQ ID NO: 496896 - DNA, 25 bp, Rattus norvegicus
caggtagacagacccgcactatgcc

SEQ ID NO: 496897 - DNA, 25 bp, Rattus norvegicus
agaacggtctcaccaggtagacaga

SEQ ID NO: 496898 - DNA, 25 bp, Rattus norvegicus
caggaacctcggcttctgcacggca

SEQ ID NO: 496899 - DNA, 25 bp, Rattus norvegicus
tctcggactcttcccaaccattttc

SEQ ID NO: 496900 - DNA, 25 bp, Rattus norvegicus
cacctgcaaaggctctcggactctt

SEQ ID NO: 496901 - DNA, 25 bp, Rattus norvegicus
gctgccacctgcaaaggctctcgga

SEQ ID NO: 496902 - DNA, 25 bp, Rattus norvegicus
acctcggcttctgcacggcaggaca

SEQ ID NO: 496903 - DNA, 25 bp, Rattus norvegicus
aaccattttcctgccgcggcggagc

SEQ ID NO: 496904 - DNA, 25 bp, Rattus norvegicus
cttgggctgggttgacccagagttc

SEQ ID NO: 496905 - DNA, 25 bp, Rattus norvegicus
ctgggttgacccagagttcttcgca

SEQ ID NO: 496906 - DNA, 25 bp, Rattus norvegicus
ttgacccagagttcttcgcaggctg

SEQ ID NO: 496907 - DNA, 25 bp, Rattus norvegicus
cccagagttcttcgcaggctgagaa

SEQ ID NO: 496908 - DNA, 25 bp, Rattus norvegicus
ttcttcgcaggctgagaagcgcgag

SEQ ID NO: 496909 - DNA, 25 bp, Rattus norvegicus
ggcagactcaggaacctcggcttct

SEQ ID NO: 496910 - DNA, 25 bp, Rattus norvegicus
tcagctggcctgtggcagactcagg

SEQ ID NO: 496911 - DNA, 25 bp, Rattus norvegicus
ttctgcacggcaggacaccgctggt

SEQ ID NO: 496912 - DNA, 25 bp, Rattus norvegicus
tgctgcccggacctagtctgaaccg

SEQ ID NO: 496913 - DNA, 25 bp, Rattus norvegicus
cgaaggcgcatttcacaggggaata

SEQ ID NO: 496914 - DNA, 25 bp, Rattus norvegicus
tgagcactcatccagagcacgcttg

SEQ ID NO: 496915 - DNA, 25 bp, Rattus norvegicus
cccggtgcagtcaagtcagcgactc

SEQ ID NO: 496916 - DNA, 25 bp, Rattus norvegicus
ggggatccacgcttcctactgcagc

SEQ ID NO: 496917 - DNA, 25 bp, Rattus norvegicus
cggatcgtcgtactttgtggccaga

SEQ ID NO: 496918 - DNA, 25 bp, Rattus norvegicus
gctgcccaggcagacatcggttctg

SEQ ID NO: 496919 - DNA, 25 bp, Rattus norvegicus
tgacctttccaagctgtgcgtcctg

SEQ ID NO: 496920 - DNA, 25 bp, Rattus norvegicus
agttcacccagtttggacctcatga

SEQ ID NO: 496921 - DNA, 25 bp, Rattus norvegicus
cagcgcgccgaaaaagaagttcacc

SEQ ID NO: 496922 - DNA, 25 bp, Rattus norvegicus
cagatcatgtcctcggttcccggga

SEQ ID NO: 496923 - DNA, 25 bp, Rattus norvegicus
tgccgaagaccaagtaccgctgtcg

SEQ ID NO: 496924 - DNA, 25 bp, Rattus norvegicus
actttacccgcagtccgcagagaga

SEQ ID NO: 496925 - DNA, 25 bp, Rattus norvegicus
tctcagtctggagcgctacaagttc

SEQ ID NO: 496926 - DNA, 25 bp, Rattus norvegicus
tcgttgacgtgaagccagcctcaca

SEQ ID NO: 496927 - DNA, 25 bp, Rattus norvegicus
cttcaagagaacgaccagcagcgcc

SEQ ID NO: 496928 - DNA, 25 bp, Rattus norvegicus
agcagcgccgcagccgtgataggca

SEQ ID NO: 496929 - DNA, 25 bp, Rattus norvegicus
gccgcctctgctcgttgacgtgaag

SEQ ID NO: 496930 - DNA, 25 bp, Rattus norvegicus
ggagcgccaagcactagcctgttcc

SEQ ID NO: 496931 - DNA, 25 bp, Rattus norvegicus
agcactagcctgttcccgggctgtg

SEQ ID NO: 496932 - DNA, 25 bp, Rattus norvegicus
ctgtgcgagctgcactctctgctca

SEQ ID NO: 496933 - DNA, 25 bp, Rattus norvegicus
gctctcttccggcttcgtgtcctgg

SEQ ID NO: 496934 - DNA, 25 bp, Rattus norvegicus
gcttcgtgtcctgggccggcctgaa

SEQ ID NO: 496935 - DNA, 25 bp, Rattus norvegicus
cctgaaagacggagcgtggagcaca

SEQ ID NO: 496936 - DNA, 25 bp, Rattus norvegicus
tgctgcgcaccagcctgagagccgg

SEQ ID NO: 496937 - DNA, 25 bp, Rattus norvegicus
gcacacacgctcactggaactcaca

SEQ ID NO: 496938 - DNA, 25 bp, Rattus norvegicus
ccgtgataggcaggaacggccgccc

SEQ ID NO: 496939 - DNA, 25 bp, Rattus norvegicus
gcctccgctgccttcaagagaacga

SEQ ID NO: 496940 - DNA, 25 bp, Rattus norvegicus
gacccatcctcgtgtgagtccgcgg

SEQ ID NO: 496941 - DNA, 25 bp, Rattus norvegicus
gacgacgagctgtcctaccggcgtc

SEQ ID NO: 496942 - DNA, 25 bp, Rattus norvegicus
tcgcctccgccctcgacgacgagct

SEQ ID NO: 496943 - DNA, 25 bp, Rattus norvegicus
tcccacgcccgcttgcggctgctgt

SEQ ID NO: 496944 - DNA, 25 bp, Rattus norvegicus
aagccgtagcgctgtggcccacgct

SEQ ID NO: 496945 - DNA, 25 bp, Rattus norvegicus
cctaaagccgtagcgctgtggccca

SEQ ID NO: 496946 - DNA, 25 bp, Rattus norvegicus
tccctttcctaaagccgtagcgctg

SEQ ID NO: 496947 - DNA, 25 bp, Rattus norvegicus
ccggtgattccaggcgcaggctcga

SEQ ID NO: 496948 - DNA, 25 bp, Rattus norvegicus
agcccgcgcggagccggtgattcca

SEQ ID NO: 496949 - DNA, 25 bp, Rattus norvegicus
ctggtgagacttgacagcccgcgcg

SEQ ID NO: 496950 - DNA, 25 bp, Rattus norvegicus
tgccgagctggtgagacttgacagc

SEQ ID NO: 496951 - DNA, 25 bp, Rattus norvegicus
ggctcttccaccagtctcgaccgca

SEQ ID NO: 496952 - DNA, 25 bp, Rattus norvegicus
cgctgcggggacgaattcgcagccc

SEQ ID NO: 496953 - DNA, 25 bp, Rattus norvegicus
atcctcgtgtgagtccgcggctctt

SEQ ID NO: 496954 - DNA, 25 bp, Rattus norvegicus
gtttccaagcacagctcccgcttcc

SEQ ID NO: 496955 - DNA, 25 bp, Rattus norvegicus
ttccgactgatgttccgcctcgagg

SEQ ID NO: 496956 - DNA, 25 bp, Rattus norvegicus
gttcccgcctctattccgactgatg

SEQ ID NO: 496957 - DNA, 25 bp, Rattus norvegicus
ggcagaccggaagttcccgcctcta

SEQ ID NO: 496958 - DNA, 25 bp, Rattus norvegicus
acagctgtgggaagcagggtcccag

SEQ ID NO: 496959 - DNA, 25 bp, Rattus norvegicus
caccatagcgcggattctgacctca

SEQ ID NO: 496960 - DNA, 25 bp, Rattus norvegicus
atcctccacacatggggacggcggc

SEQ ID NO: 496961 - DNA, 25 bp, Rattus norvegicus
cgcggatcctccacacatggggacg

SEQ ID NO: 496962 - DNA, 25 bp, Rattus norvegicus
taacacagggcactgcgtgtcgccg

SEQ ID NO: 496963 - DNA, 25 bp, Rattus norvegicus
caaacggagtaacacagggcactgc

SEQ ID NO: 496964 - DNA, 25 bp, Rattus norvegicus
gaagcgggaccaaacctcctgaaca

SEQ ID NO: 496965 - DNA, 25 bp, Rattus norvegicus
tttgaagcgggaccaaacctcctga

SEQ ID NO: 496966 - DNA, 25 bp, Rattus norvegicus
gagaactaagtcaatgagaggtttg

SEQ ID NO: 496967 - DNA, 25 bp, Rattus norvegicus
gcccaggagaactaagtcaatgaga

SEQ ID NO: 496968 - DNA, 25 bp, Rattus norvegicus
agtgtttttccagtcgttgcctgcc

SEQ ID NO: 496969 - DNA, 25 bp, Rattus norvegicus
tttcggctactacagcctctcgggc

SEQ ID NO: 496970 - DNA, 25 bp, Rattus norvegicus
accgagcgcttcgtagaggtcgttt

SEQ ID NO: 496971 - DNA, 25 bp, Rattus norvegicus
aggtcgtttctaacccagagctgcg

SEQ ID NO: 496972 - DNA, 25 bp, Rattus norvegicus
gggagtcgtcccacgtagacgcgct

SEQ ID NO: 496973 - DNA, 25 bp, Rattus norvegicus
ccgcggaaacctgagggactgcaaa

SEQ ID NO: 496974 - DNA, 25 bp, Rattus norvegicus
tgcaaagcgggcacaccggaagtgt

SEQ ID NO: 496975 - DNA, 25 bp, Rattus norvegicus
cactctgtggcgtgtttaccttgga

SEQ ID NO: 496976 - DNA, 25 bp, Rattus norvegicus
ctgacgccagctcgggttctatggc

SEQ ID NO: 496977 - DNA, 25 bp, Rattus norvegicus
cagcctctttgcctactcttggtca

SEQ ID NO: 496978 - DNA, 25 bp, Rattus norvegicus
tactcttggtcaggtgaggcgcaca

SEQ ID NO: 496979 - DNA, 25 bp, Rattus norvegicus
tgttcttggagaaacctgcggccgc

SEQ ID NO: 496980 - DNA, 25 bp, Rattus norvegicus
ctcgccaggcttcccgagaagtgtt

SEQ ID NO: 496981 - DNA, 25 bp, Rattus norvegicus
ggccgcctcctggtttcggctacta

SEQ ID NO: 496982 - DNA, 25 bp, Rattus norvegicus
ctccgtaaggattctttttgaatgt

SEQ ID NO: 496983 - DNA, 25 bp, Rattus norvegicus
tgtcttttttaatgactctcgtttg

SEQ ID NO: 496984 - DNA, 25 bp, Rattus norvegicus
ccttgtcttttttaatgactctcgt

SEQ ID NO: 496985 - DNA, 25 bp, Rattus norvegicus
tccttgtcttttttaatgactctcg

SEQ ID NO: 496986 - DNA, 25 bp, Rattus norvegicus
ttctttttgaatgtaggtgcccttg

SEQ ID NO: 496987 - DNA, 25 bp, Rattus norvegicus
attctttttgaatgtaggtgccctt

SEQ ID NO: 496988 - DNA, 25 bp, Rattus norvegicus
ctctccgtaaggattctttttgaat

SEQ ID NO: 496989 - DNA, 25 bp, Rattus norvegicus
ggattctttttgaatgtaggtgccc

SEQ ID NO: 496990 - DNA, 25 bp, Rattus norvegicus
aaggattctttttgaatgtaggtgc

SEQ ID NO: 496991 - DNA, 25 bp, Rattus norvegicus
cgtaaggattctttttgaatgtagg

SEQ ID NO: 496992 - DNA, 25 bp, Rattus norvegicus
ccgtaaggattctttttgaatgtag

SEQ ID NO: 496993 - DNA, 25 bp, Rattus norvegicus
tccgtaaggattctttttgaatgta

SEQ ID NO: 496994 - DNA, 25 bp, Rattus norvegicus
tctccgtaaggattctttttgaatg

SEQ ID NO: 496995 - DNA, 25 bp, Rattus norvegicus
gtcttttttaatgactctcgtttga

SEQ ID NO: 496996 - DNA, 25 bp, Rattus norvegicus
cttgactaggtgcatgttgagcgca

SEQ ID NO: 496997 - DNA, 25 bp, Rattus norvegicus
catgttgagcgcaggactgttgggc

SEQ ID NO: 496998 - DNA, 25 bp, Rattus norvegicus
gactgttgggcaggatcttgccgca

SEQ ID NO: 496999 - DNA, 25 bp, Rattus norvegicus
tgttgggcaggatcttgccgcagcc

SEQ ID NO: 497000 - DNA, 25 bp, Rattus norvegicus
tcttgccgcagccgcgcacagtgca

SEQ ID NO: 497001 - DNA, 25 bp, Rattus norvegicus
gcacagtgcacagaatattggtgcg

SEQ ID NO: 497002 - DNA, 25 bp, Rattus norvegicus
agccctggccagtcgcggtcgactg

SEQ ID NO: 497003 - DNA, 25 bp, Rattus norvegicus
tggccagtcgcggtcgactgccttg

SEQ ID NO: 497004 - DNA, 25 bp, Rattus norvegicus
gccagtcgcggtcgactgccttgca

SEQ ID NO: 497005 - DNA, 25 bp, Rattus norvegicus
agtcgcggtcgactgccttgcagtc

SEQ ID NO: 497006 - DNA, 25 bp, Rattus norvegicus
gtcgcggtcgactgccttgcagtcg

SEQ ID NO: 497007 - DNA, 25 bp, Rattus norvegicus
tccgacggcctccacgggcttgagg

SEQ ID NO: 497008 - DNA, 25 bp, Rattus norvegicus
ctaggtgcatgttgagcgcaggact

SEQ ID NO: 497009 - DNA, 25 bp, Rattus norvegicus
actaggtgcatgttgagcgcaggac

SEQ ID NO: 497010 - DNA, 25 bp, Rattus norvegicus
ccacgagaagccgaaaaccacagtt

SEQ ID NO: 497011 - DNA, 25 bp, Rattus norvegicus
gcgacggtggcctaaggagttcaaa

SEQ ID NO: 497012 - DNA, 25 bp, Rattus norvegicus
ctaggctgggacatggaacaaatcc

SEQ ID NO: 497013 - DNA, 25 bp, Rattus norvegicus
gtggcctaaggagttcaaaagtata

SEQ ID NO: 497014 - DNA, 25 bp, Rattus norvegicus
gagccttctagcagcacgcatgcgc

SEQ ID NO: 497015 - DNA, 25 bp, Rattus norvegicus
ggagagccttctagcagcacgcatg

SEQ ID NO: 497016 - DNA, 25 bp, Rattus norvegicus
gttctcggagaaacggagagccttc

SEQ ID NO: 497017 - DNA, 25 bp, Rattus norvegicus
gaagccgaaaaccacagttgtcaaa

SEQ ID NO: 497018 - DNA, 25 bp, Rattus norvegicus
tggaacaaatcctagttcgccgccc

SEQ ID NO: 497019 - DNA, 25 bp, Rattus norvegicus
ccgcggctccactaggctgggacat

SEQ ID NO: 497020 - DNA, 25 bp, Rattus norvegicus
cgatagcgcactcgggtaaacagcg

SEQ ID NO: 497021 - DNA, 25 bp, Rattus norvegicus
cagcgaggcccagaggctccgcaga

SEQ ID NO: 497022 - DNA, 25 bp, Rattus norvegicus
cggccatcagcgaggcccagaggct

SEQ ID NO: 497023 - DNA, 25 bp, Rattus norvegicus
aggagttcaaaagtatacaaacgcg

SEQ ID NO: 497024 - DNA, 25 bp, Rattus norvegicus
aggtcaagtcgctcggaatctctcc

SEQ ID NO: 497025 - DNA, 25 bp, Rattus norvegicus
cagggaaggtcaagtcgctcggaat

SEQ ID NO: 497026 - DNA, 25 bp, Rattus norvegicus
gaatctctccgacccgcggcagccg

SEQ ID NO: 497027 - DNA, 25 bp, Rattus norvegicus
tccgggactctctccagctagtctt

SEQ ID NO: 497028 - DNA, 25 bp, Rattus norvegicus
gggactctctccagctagtcttgga

SEQ ID NO: 497029 - DNA, 25 bp, Rattus norvegicus
ctctccagctagtcttggacgtggg

SEQ ID NO: 497030 - DNA, 25 bp, Rattus norvegicus
tgcgtgcgggactaacggtcgtcac

SEQ ID NO: 497031 - DNA, 25 bp, Rattus norvegicus
ctaacggtcgtcacccggacaagcg

SEQ ID NO: 497032 - DNA, 25 bp, Rattus norvegicus
tggacaccgccctctccaccttcgg

SEQ ID NO: 497033 - DNA, 25 bp, Rattus norvegicus
gctccacgccctcatccctccgcag

SEQ ID NO: 497034 - DNA, 25 bp, Rattus norvegicus
tccctgcatcactgagtgtgcccag

SEQ ID NO: 497035 - DNA, 25 bp, Rattus norvegicus
tgcatcactgagtgtgcccaggagg

SEQ ID NO: 497036 - DNA, 25 bp, Rattus norvegicus
gccgtctgctgcgtgcgggactaac

SEQ ID NO: 497037 - DNA, 25 bp, Rattus norvegicus
cccgactgctactggaagggcagcg

SEQ ID NO: 497038 - DNA, 25 bp, Rattus norvegicus
tctggtctggaaaggtgattggaac

SEQ ID NO: 497039 - DNA, 25 bp, Rattus norvegicus
aaattgtggtggagttgccgcactg

SEQ ID NO: 497040 - DNA, 25 bp, Rattus norvegicus
ctcagcccaggccagaggaacgact

SEQ ID NO: 497041 - DNA, 25 bp, Rattus norvegicus
agccatctgcttcagcccggggaac

SEQ ID NO: 497042 - DNA, 25 bp, Rattus norvegicus
gcacacgcacactatcgatgaacgt

SEQ ID NO: 497043 - DNA, 25 bp, Rattus norvegicus
ggagttgccgcactgcggtttcctg

SEQ ID NO: 497044 - DNA, 25 bp, Rattus norvegicus
gccgggcagcgagcttagtctccgc

SEQ ID NO: 497045 - DNA, 25 bp, Rattus norvegicus
tcccaccgctgtggttcgcacggga

SEQ ID NO: 497046 - DNA, 25 bp, Rattus norvegicus
tgattggaacttcccaccgctgtgg

SEQ ID NO: 497047 - DNA, 25 bp, Rattus norvegicus
tcgatgaacgtcctttctggtctgg

SEQ ID NO: 497048 - DNA, 25 bp, Rattus norvegicus
tcgctctccgctggtcatagtcaga

SEQ ID NO: 497049 - DNA, 25 bp, Rattus norvegicus
gttaagcactggctccggttctcgg

SEQ ID NO: 497050 - DNA, 25 bp, Rattus norvegicus
agtctccgcccagtcgtgttaagca

SEQ ID NO: 497051 - DNA, 25 bp, Rattus norvegicus
cggtttcctgggacagccatctgct

SEQ ID NO: 497052 - DNA, 25 bp, Rattus norvegicus
ggacggccagtaccagcgacaacca

SEQ ID NO: 497053 - DNA, 25 bp, Rattus norvegicus
cagaagaagctgatggttcggagcc

SEQ ID NO: 497054 - DNA, 25 bp, Rattus norvegicus
cggccatgggcaacatccagaagaa

SEQ ID NO: 497055 - DNA, 25 bp, Rattus norvegicus
ctacagcggccatgggcaacatcca

SEQ ID NO: 497056 - DNA, 25 bp, Rattus norvegicus
gcaatacctcggaatgcggagcctg

SEQ ID NO: 497057 - DNA, 25 bp, Rattus norvegicus
agttcgctgaggcagccgtacagta

SEQ ID NO: 497058 - DNA, 25 bp, Rattus norvegicus
gagccacggtgacagacgctggccc

SEQ ID NO: 497059 - DNA, 25 bp, Rattus norvegicus
ggcgatagcgcagctggaacccaca

SEQ ID NO: 497060 - DNA, 25 bp, Rattus norvegicus
ccgtacagtactcaggggcgatagc

SEQ ID NO: 497061 - DNA, 25 bp, Rattus norvegicus
agcgacaaccacgacctggaggagc

SEQ ID NO: 497062 - DNA, 25 bp, Rattus norvegicus
caagagccgcggcaacgagctgttc

SEQ ID NO: 497063 - DNA, 25 bp, Rattus norvegicus
tggaacccacaggtaggggagccac

SEQ ID NO: 497064 - DNA, 25 bp, Rattus norvegicus
ctaagggcacggtgagcaatacctc

SEQ ID NO: 497065 - DNA, 25 bp, Rattus norvegicus
ttccttcccgctgactaagggcacg

SEQ ID NO: 497066 - DNA, 25 bp, Rattus norvegicus
tgggcgggagacacccttcttgtaa

SEQ ID NO: 497067 - DNA, 25 bp, Rattus norvegicus
cgggctgcgactcactctgagtgcg

SEQ ID NO: 497068 - DNA, 25 bp, Rattus norvegicus
ctcagtgactccagccggacggtcg

SEQ ID NO: 497069 - DNA, 25 bp, Rattus norvegicus
cggtagtagttccttggcttgggca

SEQ ID NO: 497070 - DNA, 25 bp, Rattus norvegicus
gggaaccaacacagcaactgccatt

SEQ ID NO: 497071 - DNA, 25 bp, Rattus norvegicus
agcgtgtgcgcgatctccgatcgca

SEQ ID NO: 497072 - DNA, 25 bp, Rattus norvegicus
aacggaggacggctcttcagcaccg

SEQ ID NO: 497073 - DNA, 25 bp, Rattus norvegicus
gccgttgtcccagcccaagtaagag

SEQ ID NO: 497074 - DNA, 25 bp, Rattus norvegicus
cgcggacagccacaacgcggtcgga

SEQ ID NO: 497075 - DNA, 25 bp, Rattus norvegicus
tttcacccgtcaggaatgcgctccg

SEQ ID NO: 497076 - DNA, 25 bp, Rattus norvegicus
cgcggaaccttctcagctagggaga

SEQ ID NO: 497077 - DNA, 25 bp, Rattus norvegicus
tccgatcgcaaaggaggcggtcatc

SEQ ID NO: 497078 - DNA, 25 bp, Rattus norvegicus
cgaggcccagaaagagtcccgttag

SEQ ID NO: 497079 - DNA, 25 bp, Rattus norvegicus
gagtcccgttagagccgatttcacc

SEQ ID NO: 497080 - DNA, 25 bp, Rattus norvegicus
tccgaaatatccgtgggcatcctcc

SEQ ID NO: 497081 - DNA, 25 bp, Rattus norvegicus
tgggctgccaggagactccgaaata

SEQ ID NO: 497082 - DNA, 25 bp, Rattus norvegicus
ccggcctgggaaggacgtcgccata

SEQ ID NO: 497083 - DNA, 25 bp, Rattus norvegicus
atgacaattcctaactatgctctgc

SEQ ID NO: 497084 - DNA, 25 bp, Rattus norvegicus
gcagagcggccttgcacctcgtgac

SEQ ID NO: 497085 - DNA, 25 bp, Rattus norvegicus
gtgaccagctaaggacatgacaatt

SEQ ID NO: 497086 - DNA, 25 bp, Rattus norvegicus
actatgctctgcatcccggcctggg

SEQ ID NO: 497087 - DNA, 25 bp, Rattus norvegicus
tccgtgggcatcctccgtgcaatct

SEQ ID NO: 497088 - DNA, 25 bp, Rattus norvegicus
agctcctcctctccagtgactgagg

SEQ ID NO: 497089 - DNA, 25 bp, Rattus norvegicus
ctgcggactcctcgtgaccagctaa

SEQ ID NO: 497090 - DNA, 25 bp, Rattus norvegicus
ccaggtacctgatcctgaaggagca

SEQ ID NO: 497091 - DNA, 25 bp, Rattus norvegicus
aggtgtcactcgctccagtccagct

SEQ ID NO: 497092 - DNA, 25 bp, Rattus norvegicus
ctccacggcccttagggcaggtgtc

SEQ ID NO: 497093 - DNA, 25 bp, Rattus norvegicus
gtgcaatctcccaggcctgacctag

SEQ ID NO: 497094 - DNA, 25 bp, Rattus norvegicus
cacgaacatgtggtaggccgctccc

SEQ ID NO: 497095 - DNA, 25 bp, Rattus norvegicus
cgccctgtaggcgtggcgtttattc

SEQ ID NO: 497096 - DNA, 25 bp, Rattus norvegicus
cgctggggcacagcacgcacctgga

SEQ ID NO: 497097 - DNA, 25 bp, Rattus norvegicus
gcctaggaagtagctccgccctgta

SEQ ID NO: 497098 - DNA, 25 bp, Rattus norvegicus
ggcttcagattgctctttcggagta

SEQ ID NO: 497099 - DNA, 25 bp, Rattus norvegicus
tttcggagtagctcctcctcgtagc

SEQ ID NO: 497100 - DNA, 25 bp, Rattus norvegicus
cctcgtagcggagcagcttcagctt

SEQ ID NO: 497101 - DNA, 25 bp, Rattus norvegicus
agtcttccatcaccacgaacatgtg

SEQ ID NO: 497102 - DNA, 25 bp, Rattus norvegicus
atcgctgctcagatccacagggccg

SEQ ID NO: 497103 - DNA, 25 bp, Rattus norvegicus
gccaacgttaccaggcgaccgcagg

SEQ ID NO: 497104 - DNA, 25 bp, Rattus norvegicus
ttcagccggcctctctaaattctcg

SEQ ID NO: 497105 - DNA, 25 bp, Rattus norvegicus
taaattctcgccaaccaaagctggg

SEQ ID NO: 497106 - DNA, 25 bp, Rattus norvegicus
aaagctgggtttcgccacgacgtca

SEQ ID NO: 497107 - DNA, 25 bp, Rattus norvegicus
gcttcagcttctccactaagtcttc

SEQ ID NO: 497108 - DNA, 25 bp, Rattus norvegicus
tcggctgcttcaccgggttatttta

SEQ ID NO: 497109 - DNA, 25 bp, Rattus norvegicus
gcgggtgatcatgtccctgcagacc

SEQ ID NO: 497110 - DNA, 25 bp, Rattus norvegicus
tcatgtccctgcagacccggatgga

SEQ ID NO: 497111 - DNA, 25 bp, Rattus norvegicus
tggggttcatctcggcacggctgcc

SEQ ID NO: 497112 - DNA, 25 bp, Rattus norvegicus
gcaggccgcgacctttcccgtgaga

SEQ ID NO: 497113 - DNA, 25 bp, Rattus norvegicus
cgacctttcccgtgagaggaggaga

SEQ ID NO: 497114 - DNA, 25 bp, Rattus norvegicus
cgcagagggacaaaattcaaccgga

SEQ ID NO: 497115 - DNA, 25 bp, Rattus norvegicus
gacgcgtactcaacggccgtggaac

SEQ ID NO: 497116 - DNA, 25 bp, Rattus norvegicus
taataaatgtgtgttccgagcccgg

SEQ ID NO: 497117 - DNA, 25 bp, Rattus norvegicus
atgtgtgttccgagcccggagcaca

SEQ ID NO: 497118 - DNA, 25 bp, Rattus norvegicus
ctctcagcactaaccgccggggaga

SEQ ID NO: 497119 - DNA, 25 bp, Rattus norvegicus
ccgaaagagcgttaacccgtcagcg

SEQ ID NO: 497120 - DNA, 25 bp, Rattus norvegicus
cgttaacccgtcagcgcagcgggtg

SEQ ID NO: 497121 - DNA, 25 bp, Rattus norvegicus
ttcaaccggaatcgacgcgtactca

SEQ ID NO: 497122 - DNA, 25 bp, Rattus norvegicus
tgattggtgcccacagttctccggc

SEQ ID NO: 497123 - DNA, 25 bp, Rattus norvegicus
tgcggcccgcggaaggaagcctctc

SEQ ID NO: 497124 - DNA, 25 bp, Rattus norvegicus
cccgagagtcctttccggcattgcg

SEQ ID NO: 497125 - DNA, 25 bp, Rattus norvegicus
acgctgctatggcaaccgttgattg

SEQ ID NO: 497126 - DNA, 25 bp, Rattus norvegicus
cacgatgacgtcaaacgctgctatg

SEQ ID NO: 497127 - DNA, 25 bp, Rattus norvegicus
aggggcaccacacgcacgatgacgt

SEQ ID NO: 497128 - DNA, 25 bp, Rattus norvegicus
ctgatctggctgctcacaggctaca

SEQ ID NO: 497129 - DNA, 25 bp, Rattus norvegicus
aggctgagactctgtccctgatctg

SEQ ID NO: 497130 - DNA, 25 bp, Rattus norvegicus
gcttctcacctgtgtccggagtggg

SEQ ID NO: 497131 - DNA, 25 bp, Rattus norvegicus
gaggccgactcagggcggcttctca

SEQ ID NO: 497132 - DNA, 25 bp, Rattus norvegicus
cacgaccgagtcacagtcgcgggcg

SEQ ID NO: 497133 - DNA, 25 bp, Rattus norvegicus
gggacccagcaagcccaactcaggg

SEQ ID NO: 497134 - DNA, 25 bp, Rattus norvegicus
ctttccggcattgcgggacccagca

SEQ ID NO: 497135 - DNA, 25 bp, Rattus norvegicus
gggaaggatgcgcacctcccaccgg

SEQ ID NO: 497136 - DNA, 25 bp, Rattus norvegicus
caccctggcacaggcacctgttgca

SEQ ID NO: 497137 - DNA, 25 bp, Rattus norvegicus
gacatgggaccccacgaacccagta

SEQ ID NO: 497138 - DNA, 25 bp, Rattus norvegicus
cccacgaacccagtacccagcggcg

SEQ ID NO: 497139 - DNA, 25 bp, Rattus norvegicus
ccctcctggggacgactgatgggcc

SEQ ID NO: 497140 - DNA, 25 bp, Rattus norvegicus
ctcctggggacgactgatgggccgt

SEQ ID NO: 497141 - DNA, 25 bp, Rattus norvegicus
tcctggggacgactgatgggccgta

SEQ ID NO: 497142 - DNA, 25 bp, Rattus norvegicus
tgatgggccgtagggcgacaccccc

SEQ ID NO: 497143 - DNA, 25 bp, Rattus norvegicus
gcacaggcacctgttgcacgcgaca

SEQ ID NO: 497144 - DNA, 25 bp, Rattus norvegicus
aggcacctgttgcacgcgacagaga

SEQ ID NO: 497145 - DNA, 25 bp, Rattus norvegicus
gagctggtcccagccaccgagttcg

SEQ ID NO: 497146 - DNA, 25 bp, Rattus norvegicus
gctggtcccagccaccgagttcgcc

SEQ ID NO: 497147 - DNA, 25 bp, Rattus norvegicus
ctggtcccagccaccgagttcgccc

SEQ ID NO: 497148 - DNA, 25 bp, Rattus norvegicus
tggtcccagccaccgagttcgcccc

SEQ ID NO: 497149 - DNA, 25 bp, Rattus norvegicus
actgatgggccgtagggcgacaccc

SEQ ID NO: 497150 - DNA, 25 bp, Rattus norvegicus
ctgcgcctgcgcatactgctgcatt

SEQ ID NO: 497151 - DNA, 25 bp, Rattus norvegicus
gtggctcccacacctctgcgcctgc

SEQ ID NO: 497152 - DNA, 25 bp, Rattus norvegicus
cgcctgcgcatactgctgcattttt

SEQ ID NO: 497153 - DNA, 25 bp, Rattus norvegicus
tgcgcatactgctgcattttttccc

SEQ ID NO: 497154 - DNA, 25 bp, Rattus norvegicus
catccgccgctctcgtgcgtgtgtg

SEQ ID NO: 497155 - DNA, 25 bp, Rattus norvegicus
cgcactaggcgccaggcacgcggaa

SEQ ID NO: 497156 - DNA, 25 bp, Rattus norvegicus
gcacgcggaaaggtcgtcagctcta

SEQ ID NO: 497157 - DNA, 25 bp, Rattus norvegicus
caacatcaggtacgcccaggagtcc

SEQ ID NO: 497158 - DNA, 25 bp, Rattus norvegicus
aaggtcgtcagctctactttgttgc

SEQ ID NO: 497159 - DNA, 25 bp, Rattus norvegicus
gtcgtcagctctactttgttgccaa

SEQ ID NO: 497160 - DNA, 25 bp, Rattus norvegicus
cagctctactttgttgccaacgcaa

SEQ ID NO: 497161 - DNA, 25 bp, Rattus norvegicus
ttgccaacgcaacatcaggtacgcc

SEQ ID NO: 497162 - DNA, 25 bp, Rattus norvegicus
aacgcaacatcaggtacgcccagga

SEQ ID NO: 497163 - DNA, 25 bp, Rattus norvegicus
cgcggaaaggtcgtcagctctactt

SEQ ID NO: 497164 - DNA, 25 bp, Rattus norvegicus
tagcatgctcgcgtccttccggtct

SEQ ID NO: 497165 - DNA, 25 bp, Rattus norvegicus
cgtccttccggtctgcaaaccaatg

SEQ ID NO: 497166 - DNA, 25 bp, Rattus norvegicus
gtctgcaaaccaatggcagctctcc

SEQ ID NO: 497167 - DNA, 25 bp, Rattus norvegicus
cctgttacataagcgcgcaggggcg

SEQ ID NO: 497168 - DNA, 25 bp, Rattus norvegicus
cctaggacgggaactgcagagccct

SEQ ID NO: 497169 - DNA, 25 bp, Rattus norvegicus
cttccagccctctctcttggtggtg

SEQ ID NO: 497170 - DNA, 25 bp, Rattus norvegicus
ctgcggtgtgtgacctccggcctac

SEQ ID NO: 497171 - DNA, 25 bp, Rattus norvegicus
ctcggagccctgtaaggcgctagcc

SEQ ID NO: 497172 - DNA, 25 bp, Rattus norvegicus
cttgtttcccactcaccaggcctgg

SEQ ID NO: 497173 - DNA, 25 bp, Rattus norvegicus
ttccctggctagctcggagccctgt

SEQ ID NO: 497174 - DNA, 25 bp, Rattus norvegicus
agcagagccgggagcacaacagccc

SEQ ID NO: 497175 - DNA, 25 bp, Rattus norvegicus
cctctctcttggtggtgcctctgcg

SEQ ID NO: 497176 - DNA, 25 bp, Rattus norvegicus
tcgatagtcactcccttgtttccca

SEQ ID NO: 497177 - DNA, 25 bp, Rattus norvegicus
tggtcggcagagtgactcgatagtc

SEQ ID NO: 497178 - DNA, 25 bp, Rattus norvegicus
caaactgagcatgactgtttgctta

SEQ ID NO: 497179 - DNA, 25 bp, Rattus norvegicus
cactgcgtccttgttccgcctggct

SEQ ID NO: 497180 - DNA, 25 bp, Rattus norvegicus
gcctggcggccactgcgtccttgtt

SEQ ID NO: 497181 - DNA, 25 bp, Rattus norvegicus
gctttattgactcaggtcccgcctc

SEQ ID NO: 497182 - DNA, 25 bp, Rattus norvegicus
ttagtggctttattgactcaggtcc

SEQ ID NO: 497183 - DNA, 25 bp, Rattus norvegicus
catgactgtttgcttagtggcttta

SEQ ID NO: 497184 - DNA, 25 bp, Rattus norvegicus
acgggccgccatcttgcggtgagac

SEQ ID NO: 497185 - DNA, 25 bp, Rattus norvegicus
gccatcttgcggtgagacgagccat

SEQ ID NO: 497186 - DNA, 25 bp, Rattus norvegicus
tgcggtgagacgagccatgtaaaca

SEQ ID NO: 497187 - DNA, 25 bp, Rattus norvegicus
gtgagacgagccatgtaaacaaagc

SEQ ID NO: 497188 - DNA, 25 bp, Rattus norvegicus
atgtgtgccggcttccagcgctcct

SEQ ID NO: 497189 - DNA, 25 bp, Rattus norvegicus
ccactgtacaaactgagcatgactg

SEQ ID NO: 497190 - DNA, 25 bp, Rattus norvegicus
ccagctcccgctcgcccgaagctgc

SEQ ID NO: 497191 - DNA, 25 bp, Rattus norvegicus
caagcctcaaccactgtacaaactg

SEQ ID NO: 497192 - DNA, 25 bp, Rattus norvegicus
cttgatggatccagaccctctagga

SEQ ID NO: 497193 - DNA, 25 bp, Rattus norvegicus
agctcttgttctgccatctcgggcg

SEQ ID NO: 497194 - DNA, 25 bp, Rattus norvegicus
agtccagtttcaccagaggctgagg

SEQ ID NO: 497195 - DNA, 25 bp, Rattus norvegicus
cctttgggctgatggcaactggttt

SEQ ID NO: 497196 - DNA, 25 bp, Rattus norvegicus
gggaagagaccctacacgaacgtga

SEQ ID NO: 497197 - DNA, 25 bp, Rattus norvegicus
ggacggacccttgggcactgattga

SEQ ID NO: 497198 - DNA, 25 bp, Rattus norvegicus
gcctgtagttattcccttgcctgga

SEQ ID NO: 497199 - DNA, 25 bp, Rattus norvegicus
cctcagatttcctgggccatttgga

SEQ ID NO: 497200 - DNA, 25 bp, Rattus norvegicus
cagtagacttccttcgattaggcca

SEQ ID NO: 497201 - DNA, 25 bp, Rattus norvegicus
gggccgcttttgtgtgctctcaaca

SEQ ID NO: 497202 - DNA, 25 bp, Rattus norvegicus
tcaatcggccttcgcaagggctgtc

SEQ ID NO: 497203 - DNA, 25 bp, Rattus norvegicus
tgtgcttgcttttcgttccctcccg

SEQ ID NO: 497204 - DNA, 25 bp, Rattus norvegicus
tgcgattgcagacacggccatcttc

SEQ ID NO: 497205 - DNA, 25 bp, Rattus norvegicus
gggagcgagttcattggatcaaaca

SEQ ID NO: 497206 - DNA, 25 bp, Rattus norvegicus
gactcagtatgacctgccctccata

SEQ ID NO: 497207 - DNA, 25 bp, Rattus norvegicus
ctatctaaaggacgaccagcgcagc

SEQ ID NO: 497208 - DNA, 25 bp, Rattus norvegicus
tacagcgtgtccatcactgagagcc

SEQ ID NO: 497209 - DNA, 25 bp, Rattus norvegicus
cacggtggtgaaagctgaggatttc

SEQ ID NO: 497210 - DNA, 25 bp, Rattus norvegicus
agctgaggatttcacgcccgtgttc

SEQ ID NO: 497211 - DNA, 25 bp, Rattus norvegicus
atttcacgcccgtgttcatggcgcc

SEQ ID NO: 497212 - DNA, 25 bp, Rattus norvegicus
agcagcgcgtggttatctttgaaca

SEQ ID NO: 497213 - DNA, 25 bp, Rattus norvegicus
ctttgaacagactcagtatgacctg

SEQ ID NO: 497214 - DNA, 25 bp, Rattus norvegicus
agcgagagcttcaaggacggcgccc

SEQ ID NO: 497215 - DNA, 25 bp, Rattus norvegicus
acagcacctacagcgagagcttcaa

SEQ ID NO: 497216 - DNA, 25 bp, Rattus norvegicus
taaaggacgaccagcgcagcacgcc

SEQ ID NO: 497217 - DNA, 25 bp, Rattus norvegicus
gccagccacagctcctatctaaagg

SEQ ID NO: 497218 - DNA, 25 bp, Rattus norvegicus
aagcgtgagcagtacagcgtgtcca

SEQ ID NO: 497219 - DNA, 25 bp, Rattus norvegicus
cgcgtggttatctttgaacagactc

SEQ ID NO: 497220 - DNA, 25 bp, Rattus norvegicus
gtttaaagcttgtaggtccctgaga

SEQ ID NO: 497221 - DNA, 25 bp, Rattus norvegicus
aaattgacaaggtgggtggcacctg

SEQ ID NO: 497222 - DNA, 25 bp, Rattus norvegicus
gcctcgcgaggttccagacacgaga

SEQ ID NO: 497223 - DNA, 25 bp, Rattus norvegicus
ggttccagacacgagaatctttcgc

SEQ ID NO: 497224 - DNA, 25 bp, Rattus norvegicus
gaatctttcgcttcaaaacgccgtg

SEQ ID NO: 497225 - DNA, 25 bp, Rattus norvegicus
caaaacgccgtggatttctgccgca

SEQ ID NO: 497226 - DNA, 25 bp, Rattus norvegicus
atttctgccgcaggttccagccgcg

SEQ ID NO: 497227 - DNA, 25 bp, Rattus norvegicus
acgggcctcctgcagctttcaatgc

SEQ ID NO: 497228 - DNA, 25 bp, Rattus norvegicus
aatgcagactctgcaggcccgggcg

SEQ ID NO: 497229 - DNA, 25 bp, Rattus norvegicus
accgggcgagcatgctccggacatc

SEQ ID NO: 497230 - DNA, 25 bp, Rattus norvegicus
gcctcgcccggtactcagcaaagtt

SEQ ID NO: 497231 - DNA, 25 bp, Rattus norvegicus
gcccggtactcagcaaagttgcttt

SEQ ID NO: 497232 - DNA, 25 bp, Rattus norvegicus
tctcgagccaccagcttggggctta

SEQ ID NO: 497233 - DNA, 25 bp, Rattus norvegicus
cagcttggggcttatgggtttaaag

SEQ ID NO: 497234 - DNA, 25 bp, Rattus norvegicus
cccggagttgctcccgaatgtgttc

SEQ ID NO: 497235 - DNA, 25 bp, Rattus norvegicus
agccgtggctttacaatacgatttc

SEQ ID NO: 497236 - DNA, 25 bp, Rattus norvegicus
cggttcccgtgacaagttagccgtg

SEQ ID NO: 497237 - DNA, 25 bp, Rattus norvegicus
tccacagacgacttgcacggggtga

SEQ ID NO: 497238 - DNA, 25 bp, Rattus norvegicus
ccctagtctagacacggtgaggaac

SEQ ID NO: 497239 - DNA, 25 bp, Rattus norvegicus
ttcaagcaggcggtggaatccatgc

SEQ ID NO: 497240 - DNA, 25 bp, Rattus norvegicus
acgctagtgctgctcaacctgtgga

SEQ ID NO: 497241 - DNA, 25 bp, Rattus norvegicus
gcgggatctcgcgagacacgctagt

SEQ ID NO: 497242 - DNA, 25 bp, Rattus norvegicus
gactccggaagtccctgagctgtct

SEQ ID NO: 497243 - DNA, 25 bp, Rattus norvegicus
agctcgcctcggtatccagctgtcg

SEQ ID NO: 497244 - DNA, 25 bp, Rattus norvegicus
tgtcagcgacaacagcccagcagct

SEQ ID NO: 497245 - DNA, 25 bp, Rattus norvegicus
tcgcctccgacttaacggctttgta

SEQ ID NO: 497246 - DNA, 25 bp, Rattus norvegicus
acggctttgtactgactgatgctca

SEQ ID NO: 497247 - DNA, 25 bp, Rattus norvegicus
ctcagagcagtatctgtggggctta

SEQ ID NO: 497248 - DNA, 25 bp, Rattus norvegicus
agccacccgagctgaggaactgaga

SEQ ID NO: 497249 - DNA, 25 bp, Rattus norvegicus
ttctgctggcgacgaataaaatacc

SEQ ID NO: 497250 - DNA, 25 bp, Rattus norvegicus
tacagcagacctgcaactgacttgc

SEQ ID NO: 497251 - DNA, 25 bp, Rattus norvegicus
actgacttgcaggttcccacaactc

SEQ ID NO: 497252 - DNA, 25 bp, Rattus norvegicus
ctcgcaacctaaaatccgggcgtga

SEQ ID NO: 497253 - DNA, 25 bp, Rattus norvegicus
gaagctactgcgacatttacctcac

SEQ ID NO: 497254 - DNA, 25 bp, Rattus norvegicus
agcggcagggcaaatccgagtaata

SEQ ID NO: 497255 - DNA, 25 bp, Rattus norvegicus
gtagccaacaagtctgcactgtgtg

SEQ ID NO: 497256 - DNA, 25 bp, Rattus norvegicus
gtctgcactgtgtgaacctcctcct

SEQ ID NO: 497257 - DNA, 25 bp, Rattus norvegicus
tgcaccggtcctgggttctagccaa

SEQ ID NO: 497258 - DNA, 25 bp, Rattus norvegicus
aacccattcgaagggctcttcctgc

SEQ ID NO: 497259 - DNA, 25 bp, Rattus norvegicus
aaagatccgcctttcctgcgggctc

SEQ ID NO: 497260 - DNA, 25 bp, Rattus norvegicus
ccttccggcctgcatagtgtttctg

SEQ ID NO: 497261 - DNA, 25 bp, Rattus norvegicus
ccgagtaataccgaggtagccaaca

SEQ ID NO: 497262 - DNA, 25 bp, Rattus norvegicus
ccgaagttaagcatggttggctgcc

SEQ ID NO: 497263 - DNA, 25 bp, Rattus norvegicus
aggaccagcatctccaggtaactta

SEQ ID NO: 497264 - DNA, 25 bp, Rattus norvegicus
cagcccatgagtagtctttgccacc

SEQ ID NO: 497265 - DNA, 25 bp, Rattus norvegicus
tttgccaccctgagtcgcattcctg

SEQ ID NO: 497266 - DNA, 25 bp, Rattus norvegicus
attcctgctgcagacgggcatctcc

SEQ ID NO: 497267 - DNA, 25 bp, Rattus norvegicus
cttgtctcctggacacccaggggta

SEQ ID NO: 497268 - DNA, 25 bp, Rattus norvegicus
gcacgtcccaggctttttcttccga

SEQ ID NO: 497269 - DNA, 25 bp, Rattus norvegicus
tctgcacatgccctcgatgatattc

SEQ ID NO: 497270 - DNA, 25 bp, Rattus norvegicus
caggcgtggtttatttaggggctca

SEQ ID NO: 497271 - DNA, 25 bp, Rattus norvegicus
ctacggggaccacctgactccgtga

SEQ ID NO: 497272 - DNA, 25 bp, Rattus norvegicus
tgtcagtggagcgtgtacacaaccc

SEQ ID NO: 497273 - DNA, 25 bp, Rattus norvegicus
tgagacactagacgtcgacgccacc

SEQ ID NO: 497274 - DNA, 25 bp, Rattus norvegicus
cgcctctcgggtagacagcccatga

SEQ ID NO: 497275 - DNA, 25 bp, Rattus norvegicus
ccacagacggagcactgagacacta

SEQ ID NO: 497276 - DNA, 25 bp, Rattus norvegicus
actcatcagaaagctgtgcgcgccc

SEQ ID NO: 497277 - DNA, 25 bp, Rattus norvegicus
gcctggcggccagcgtctgatgtca

SEQ ID NO: 497278 - DNA, 25 bp, Rattus norvegicus
gggcgggtccagctttgccacccag

SEQ ID NO: 497279 - DNA, 25 bp, Rattus norvegicus
actcacggtgcgtcacggagcagat

SEQ ID NO: 497280 - DNA, 25 bp, Rattus norvegicus
tctgatgtcagcctggaacccggcc

SEQ ID NO: 497281 - DNA, 25 bp, Rattus norvegicus
ctgctgactcatcagaaagctgtgc

SEQ ID NO: 497282 - DNA, 25 bp, Rattus norvegicus
gaaactgttgactcagagggtggcc

SEQ ID NO: 497283 - DNA, 25 bp, Rattus norvegicus
gctgcgcttcggaaactgttgactc

SEQ ID NO: 497284 - DNA, 25 bp, Rattus norvegicus
ctggcagcaggctgcgcttcggaaa

SEQ ID NO: 497285 - DNA, 25 bp, Rattus norvegicus
cggcctcgtgacttctggtaaaggc

SEQ ID NO: 497286 - DNA, 25 bp, Rattus norvegicus
cctcggcctcgtgacttctggtaaa

SEQ ID NO: 497287 - DNA, 25 bp, Rattus norvegicus
cagggtggcgttggccctcccttct

SEQ ID NO: 497288 - DNA, 25 bp, Rattus norvegicus
ggcgggcttccaaggcacccagcta

SEQ ID NO: 497289 - DNA, 25 bp, Rattus norvegicus
ggcgcccgtgactcacggtgcgtca

SEQ ID NO: 497290 - DNA, 25 bp, Rattus norvegicus
cttagagaatgcacgcggggacgca

SEQ ID NO: 497291 - DNA, 25 bp, Rattus norvegicus
agaggaaccgaaggctcgttcttag

SEQ ID NO: 497292 - DNA, 25 bp, Rattus norvegicus
accgaaggctcgttcttagagaatg

SEQ ID NO: 497293 - DNA, 25 bp, Rattus norvegicus
aggctcgttcttagagaatgcacgc

SEQ ID NO: 497294 - DNA, 25 bp, Rattus norvegicus
ctcgttcttagagaatgcacgcggg

SEQ ID NO: 497295 - DNA, 25 bp, Rattus norvegicus
ttcttagagaatgcacgcggggacg

SEQ ID NO: 497296 - DNA, 25 bp, Rattus norvegicus
ccctcccaggggatcgcgaactgcc

SEQ ID NO: 497297 - DNA, 25 bp, Rattus norvegicus
cgaactgccccaggtgcccagaagt

SEQ ID NO: 497298 - DNA, 25 bp, Rattus norvegicus
caggtgcccagaagtccaacctccc

SEQ ID NO: 497299 - DNA, 25 bp, Rattus norvegicus
gccggaatctcggcggtcacgtctc

SEQ ID NO: 497300 - DNA, 25 bp, Rattus norvegicus
atccggctccaaagtgcgagccagc

SEQ ID NO: 497301 - DNA, 25 bp, Rattus norvegicus
cgagaggcaggcaacgccccagctg

SEQ ID NO: 497302 - DNA, 25 bp, Rattus norvegicus
ctgggccagcccgtgggaaggctgc

SEQ ID NO: 497303 - DNA, 25 bp, Rattus norvegicus
tccaaagtgcgagccagctgcggct

SEQ ID NO: 497304 - DNA, 25 bp, Rattus norvegicus
cttcttgcttcccatactatgcgca

SEQ ID NO: 497305 - DNA, 25 bp, Rattus norvegicus
gaaatcacaatggtcactgagtgtc

SEQ ID NO: 497306 - DNA, 25 bp, Rattus norvegicus
cctcaggtgaacaaatgaaatcaca

SEQ ID NO: 497307 - DNA, 25 bp, Rattus norvegicus
taagggaactcaggaacctcaggtg

SEQ ID NO: 497308 - DNA, 25 bp, Rattus norvegicus
ctgcctgggaggttaagggaactca

SEQ ID NO: 497309 - DNA, 25 bp, Rattus norvegicus
tcccgcttctgcctgggaggttaag

SEQ ID NO: 497310 - DNA, 25 bp, Rattus norvegicus
tcgcattgagaggtcccgcttctgc

SEQ ID NO: 497311 - DNA, 25 bp, Rattus norvegicus
aaactgtcgcattgagaggtcccgc

SEQ ID NO: 497312 - DNA, 25 bp, Rattus norvegicus
gaacgtatccgaccaccacttcttg

SEQ ID NO: 497313 - DNA, 25 bp, Rattus norvegicus
cgcaggcgcagccaaggaaactgtc

SEQ ID NO: 497314 - DNA, 25 bp, Rattus norvegicus
accacttcttgcttcccatactatg

SEQ ID NO: 497315 - DNA, 25 bp, Rattus norvegicus
gtcactgagtgtcgccaccggttcc

SEQ ID NO: 497316 - DNA, 25 bp, Rattus norvegicus
cgcagccaaggaaactgtcgcattg

SEQ ID NO: 497317 - DNA, 25 bp, Rattus norvegicus
tgaaggatgaacgtatccgaccacc

SEQ ID NO: 497318 - DNA, 25 bp, Rattus norvegicus
tgccgccgagaatgaaccgcgacca

SEQ ID NO: 497319 - DNA, 25 bp, Rattus norvegicus
ggaaacagcaatgcaccacgggagt

SEQ ID NO: 497320 - DNA, 25 bp, Rattus norvegicus
ccctaagcccggtactcacgtgaga

SEQ ID NO: 497321 - DNA, 25 bp, Rattus norvegicus
ctcacgtgagataacggcccaaaga

SEQ ID NO: 497322 - DNA, 25 bp, Rattus norvegicus
caaagagtcgggtaaagcgtcttct

SEQ ID NO: 497323 - DNA, 25 bp, Rattus norvegicus
agcgtcttctctttttcggcggaat

SEQ ID NO: 497324 - DNA, 25 bp, Rattus norvegicus
gatgtggttaccttgagcagaaata

SEQ ID NO: 497325 - DNA, 25 bp, Rattus norvegicus
ggcaccgacaccagctgagcagcag

SEQ ID NO: 497326 - DNA, 25 bp, Rattus norvegicus
gggagaagattcagcctcgtcactc

SEQ ID NO: 497327 - DNA, 25 bp, Rattus norvegicus
ctcgtcactccgcagagcagcagag

SEQ ID NO: 497328 - DNA, 25 bp, Rattus norvegicus
aacaccgcggccgagagttgagcca

SEQ ID NO: 497329 - DNA, 25 bp, Rattus norvegicus
cgccggagacgccagtatttatatt

SEQ ID NO: 497330 - DNA, 25 bp, Rattus norvegicus
cttgcgacgtcacagacggctggtc

SEQ ID NO: 497331 - DNA, 25 bp, Rattus norvegicus
agcagaaatacccaaggcggcctgg

SEQ ID NO: 497332 - DNA, 25 bp, Rattus norvegicus
ctgagacaccttctcgggtcagtga

SEQ ID NO: 497333 - DNA, 25 bp, Rattus norvegicus
tccgcccacccggaagtccgctctg

SEQ ID NO: 497334 - DNA, 25 bp, Rattus norvegicus
tggagaagcggaaactccgcccacc

SEQ ID NO: 497335 - DNA, 25 bp, Rattus norvegicus
tgcatctggagaagcggaaactccg

SEQ ID NO: 497336 - DNA, 25 bp, Rattus norvegicus
ccaccgcaggtgcatctggagaagc

SEQ ID NO: 497337 - DNA, 25 bp, Rattus norvegicus
gctggatagccaccgcaggtgcatc

SEQ ID NO: 497338 - DNA, 25 bp, Rattus norvegicus
agcgctgagcggttaacgtctgcta

SEQ ID NO: 497339 - DNA, 25 bp, Rattus norvegicus
gttaacgtctgctaggcttcctgcc

SEQ ID NO: 497340 - DNA, 25 bp, Rattus norvegicus
ctagactgtggcgtcggacctgcag

SEQ ID NO: 497341 - DNA, 25 bp, Rattus norvegicus
tctcgggtcagtgaacgacagccct

SEQ ID NO: 497342 - DNA, 25 bp, Rattus norvegicus
ccgtgtcgtgattgcgcgcagtgct

SEQ ID NO: 497343 - DNA, 25 bp, Rattus norvegicus
actgctccggctggcacgtgacttg

SEQ ID NO: 497344 - DNA, 25 bp, Rattus norvegicus
gacgtttcaggtggctggatagcca

SEQ ID NO: 497345 - DNA, 25 bp, Rattus norvegicus
tcagtgaacgacagccctgtgggga

SEQ ID NO: 497346 - DNA, 25 bp, Rattus norvegicus
ctctggcggttaggggaccaatgtc

SEQ ID NO: 497347 - DNA, 25 bp, Rattus norvegicus
gaggcccggctacctgcagcgagcc

SEQ ID NO: 497348 - DNA, 25 bp, Rattus norvegicus
cctacaccgactcggacgcgctgcc

SEQ ID NO: 497349 - DNA, 25 bp, Rattus norvegicus
tggctcacctacaccgactcggacg

SEQ ID NO: 497350 - DNA, 25 bp, Rattus norvegicus
agtccacctggctcacctacaccga

SEQ ID NO: 497351 - DNA, 25 bp, Rattus norvegicus
gggagaccgagtccacctggctcac

SEQ ID NO: 497352 - DNA, 25 bp, Rattus norvegicus
gctggacccgggagaccgagtccac

SEQ ID NO: 497353 - DNA, 25 bp, Rattus norvegicus
cgctactatgagagctggacccggg

SEQ ID NO: 497354 - DNA, 25 bp, Rattus norvegicus
cccgctactatgagagctggacccg

SEQ ID NO: 497355 - DNA, 25 bp, Rattus norvegicus
ggagccgagccgatgccatcgagcc

SEQ ID NO: 497356 - DNA, 25 bp, Rattus norvegicus
cccgcaacacgggaggatgggctgc

SEQ ID NO: 497357 - DNA, 25 bp, Rattus norvegicus
cagccgcaagccgaacggccgctgg

SEQ ID NO: 497358 - DNA, 25 bp, Rattus norvegicus
ttaggggaccaatgtcgctgccgcc

SEQ ID NO: 497359 - DNA, 25 bp, Rattus norvegicus
tcctcctcgagggccggagctgcgt

SEQ ID NO: 497360 - DNA, 25 bp, Rattus norvegicus
tcgcttccagaaccgagtgtgctct

SEQ ID NO: 497361 - DNA, 25 bp, Rattus norvegicus
cggctaaggctcctcgcttccagaa

SEQ ID NO: 497362 - DNA, 25 bp, Rattus norvegicus
gacaagtcactacagagcagatccc

SEQ ID NO: 497363 - DNA, 25 bp, Rattus norvegicus
tgtcccggcgacaagtcactacaga

SEQ ID NO: 497364 - DNA, 25 bp, Rattus norvegicus
cgatcgacgccagagacagccgcca

SEQ ID NO: 497365 - DNA, 25 bp, Rattus norvegicus
ccctaaggcccaggacggacgcctg

SEQ ID NO: 497366 - DNA, 25 bp, Rattus norvegicus
gcagggcgctttccctaaggcccag

SEQ ID NO: 497367 - DNA, 25 bp, Rattus norvegicus
ctctgcagggcgctttccctaaggc

SEQ ID NO: 497368 - DNA, 25 bp, Rattus norvegicus
caactcctgggaagtgactccgggt

SEQ ID NO: 497369 - DNA, 25 bp, Rattus norvegicus
cagaaccgagtgtgctctgcagggc

SEQ ID NO: 497370 - DNA, 25 bp, Rattus norvegicus
ggcctggaacaggtgccccgactca

SEQ ID NO: 497371 - DNA, 25 bp, Rattus norvegicus
ccacgcaactcctgggaagtgactc

SEQ ID NO: 497372 - DNA, 25 bp, Rattus norvegicus
tggagtcccacgcaactcctgggaa

SEQ ID NO: 497373 - DNA, 25 bp, Rattus norvegicus
caggtgcgtcgccttggagtcccac

SEQ ID NO: 497374 - DNA, 25 bp, Rattus norvegicus
ccagcggagagtgggttccgcacct

SEQ ID NO: 497375 - DNA, 25 bp, Rattus norvegicus
caaattaagcacctcccgcacggac

SEQ ID NO: 497376 - DNA, 25 bp, Rattus norvegicus
tccgcaccttgccttccccgaactc

SEQ ID NO: 497377 - DNA, 25 bp, Rattus norvegicus
agcggagagtgggttccgcaccttg

SEQ ID NO: 497378 - DNA, 25 bp, Rattus norvegicus
atccagcttcccaaattaagcacct

SEQ ID NO: 497379 - DNA, 25 bp, Rattus norvegicus
accagcggagagtgggttccgcacc

SEQ ID NO: 497380 - DNA, 25 bp, Rattus norvegicus
ctcccgcacggaccagcggagagtg

SEQ ID NO: 497381 - DNA, 25 bp, Rattus norvegicus
ggcatccagcttcccaaattaagca

SEQ ID NO: 497382 - DNA, 25 bp, Rattus norvegicus
agcttcccaaattaagcacctcccg

SEQ ID NO: 497383 - DNA, 25 bp, Rattus norvegicus
tcccaaattaagcacctcccgcacg

SEQ ID NO: 497384 - DNA, 25 bp, Rattus norvegicus
ccaaattaagcacctcccgcacgga

SEQ ID NO: 497385 - DNA, 25 bp, Rattus norvegicus
aattaagcacctcccgcacggacca

SEQ ID NO: 497386 - DNA, 25 bp, Rattus norvegicus
gcggcatccagcttcccaaattaag

SEQ ID NO: 497387 - DNA, 25 bp, Rattus norvegicus
cggcatccagcttcccaaattaagc

SEQ ID NO: 497388 - DNA, 25 bp, Rattus norvegicus
gaaccgccacactcaggaggagaga

SEQ ID NO: 497389 - DNA, 25 bp, Rattus norvegicus
aaccgccacactcaggaggagagaa

SEQ ID NO: 497390 - DNA, 25 bp, Rattus norvegicus
gcaggactgggagtcccgcagccct

SEQ ID NO: 497391 - DNA, 25 bp, Rattus norvegicus
cagccctccgcctcagagcgcctcg

SEQ ID NO: 497392 - DNA, 25 bp, Rattus norvegicus
ctccgcctcagagcgcctcggtgtg

SEQ ID NO: 497393 - DNA, 25 bp, Rattus norvegicus
cggagtgggcgagaccatctcaagc

SEQ ID NO: 497394 - DNA, 25 bp, Rattus norvegicus
gagtgggcgagaccatctcaagcgc

SEQ ID NO: 497395 - DNA, 25 bp, Rattus norvegicus
gtgggcgagaccatctcaagcgctg

SEQ ID NO: 497396 - DNA, 25 bp, Rattus norvegicus
tgggcgagaccatctcaagcgctgg

SEQ ID NO: 497397 - DNA, 25 bp, Rattus norvegicus
gcgagaccatctcaagcgctggcga

SEQ ID NO: 497398 - DNA, 25 bp, Rattus norvegicus
agaccatctcaagcgctggcgaggg

SEQ ID NO: 497399 - DNA, 25 bp, Rattus norvegicus
catctcaagcgctggcgaggggaga

SEQ ID NO: 497400 - DNA, 25 bp, Rattus norvegicus
ctggggaaccgccacactcaggagg

SEQ ID NO: 497401 - DNA, 25 bp, Rattus norvegicus
caggaggagagaaaggcaggactgg

SEQ ID NO: 497402 - DNA, 25 bp, Rattus norvegicus
ctcttccttgtgctactgctgcttc

SEQ ID NO: 497403 - DNA, 25 bp, Rattus norvegicus
cggcctcttccttgtgctactgctg

SEQ ID NO: 497404 - DNA, 25 bp, Rattus norvegicus
cccaggcctattacagtatgcaagc

SEQ ID NO: 497405 - DNA, 25 bp, Rattus norvegicus
gcctattacagtatgcaagctctgg

SEQ ID NO: 497406 - DNA, 25 bp, Rattus norvegicus
aaaggcgcattgatgcggccggccg

SEQ ID NO: 497407 - DNA, 25 bp, Rattus norvegicus
cagagctgggccagacgctgagcag

SEQ ID NO: 497408 - DNA, 25 bp, Rattus norvegicus
tcctgctctgcgcttcgcagctacc

SEQ ID NO: 497409 - DNA, 25 bp, Rattus norvegicus
tcgcagctaccgcacacgatgcacc

SEQ ID NO: 497410 - DNA, 25 bp, Rattus norvegicus
ccacagctgctgctcggcctcttcc

SEQ ID NO: 497411 - DNA, 25 bp, Rattus norvegicus
ctgcttctgcagctgtccgcgccgt

SEQ ID NO: 497412 - DNA, 25 bp, Rattus norvegicus
cagtatgcaagctctggtgtccagg

SEQ ID NO: 497413 - DNA, 25 bp, Rattus norvegicus
ggggacccaggcctattacagtatg

SEQ ID NO: 497414 - DNA, 25 bp, Rattus norvegicus
gctcggcagcaacccgcgagggtct

SEQ ID NO: 497415 - DNA, 25 bp, Rattus norvegicus
gcgttcctctctggctcggcagcaa

SEQ ID NO: 497416 - DNA, 25 bp, Rattus norvegicus
gcacagttccagcaaagccgcgtga

SEQ ID NO: 497417 - DNA, 25 bp, Rattus norvegicus
tgcagcgccagattggacaagaccc

SEQ ID NO: 497418 - DNA, 25 bp, Rattus norvegicus
agccaccaggttctcgtatcggacg

SEQ ID NO: 497419 - DNA, 25 bp, Rattus norvegicus
acgtggcggaacactgcactccatg

SEQ ID NO: 497420 - DNA, 25 bp, Rattus norvegicus
gccgggttaagtcgagctcggctta

SEQ ID NO: 497421 - DNA, 25 bp, Rattus norvegicus
ttccacactgcggagccacgtgaca

SEQ ID NO: 497422 - DNA, 25 bp, Rattus norvegicus
ttgcctgagcgactacggaacgcca

SEQ ID NO: 497423 - DNA, 25 bp, Rattus norvegicus
cgacgcgagcgatagataaaggacc

SEQ ID NO: 497424 - DNA, 25 bp, Rattus norvegicus
acgcgagcccacttccggaactgga

SEQ ID NO: 497425 - DNA, 25 bp, Rattus norvegicus
gcgtgaaccagcaaagcggcgtgaa

SEQ ID NO: 497426 - DNA, 25 bp, Rattus norvegicus
gacctgcagcggagaaggcacagtt

SEQ ID NO: 497427 - DNA, 25 bp, Rattus norvegicus
gaagcggatctttacgaggtcgagc

SEQ ID NO: 497428 - DNA, 25 bp, Rattus norvegicus
tggctacagtcacgatccggggccc

SEQ ID NO: 497429 - DNA, 25 bp, Rattus norvegicus
aagcagagtttagccagtttagccc

SEQ ID NO: 497430 - DNA, 25 bp, Rattus norvegicus
gaaggccattgatttgtatgtattt

SEQ ID NO: 497431 - DNA, 25 bp, Rattus norvegicus
cggattgaaggccattgatttgtat

SEQ ID NO: 497432 - DNA, 25 bp, Rattus norvegicus
cctcggattgaaggccattgatttg

SEQ ID NO: 497433 - DNA, 25 bp, Rattus norvegicus
cgcctcggattgaaggccattgatt

SEQ ID NO: 497434 - DNA, 25 bp, Rattus norvegicus
ctgtcgcctcggattgaaggccatt

SEQ ID NO: 497435 - DNA, 25 bp, Rattus norvegicus
gaagaagaaacatttccccgagcgc

SEQ ID NO: 497436 - DNA, 25 bp, Rattus norvegicus
gaaccgctcacttgccagcccttcg

SEQ ID NO: 497437 - DNA, 25 bp, Rattus norvegicus
ctcgctcccgcgaaccgctcacttg

SEQ ID NO: 497438 - DNA, 25 bp, Rattus norvegicus
gcgctccgagcgagttcccgggact

SEQ ID NO: 497439 - DNA, 25 bp, Rattus norvegicus
tgccgcctcagttcccttggccgct

SEQ ID NO: 497440 - DNA, 25 bp, Rattus norvegicus
tcctcgcgacgtccgggagcctagt

SEQ ID NO: 497441 - DNA, 25 bp, Rattus norvegicus
gaggggtccatcctcgcgacgtccg

SEQ ID NO: 497442 - DNA, 25 bp, Rattus norvegicus
gcagcccgcgcctcgtggttcccgg

SEQ ID NO: 497443 - DNA, 25 bp, Rattus norvegicus
cccgagcgcactcatcagccctccc

SEQ ID NO: 497444 - DNA, 25 bp, Rattus norvegicus
gacttccaccgtgaacagctgcttc

SEQ ID NO: 497445 - DNA, 25 bp, Rattus norvegicus
gggcgctccatgcagcgctctcaga

SEQ ID NO: 497446 - DNA, 25 bp, Rattus norvegicus
gctgcttctcttgacggctttcctc

SEQ ID NO: 497447 - DNA, 25 bp, Rattus norvegicus
ctccgattggcggaggctcagcatc

SEQ ID NO: 497448 - DNA, 25 bp, Rattus norvegicus
ggcggaggctcagcatcagcagcat

SEQ ID NO: 497449 - DNA, 25 bp, Rattus norvegicus
ccctgggtgacacttcagacttcca

SEQ ID NO: 497450 - DNA, 25 bp, Rattus norvegicus
gtgacacttcagacttccaccgtga

SEQ ID NO: 497451 - DNA, 25 bp, Rattus norvegicus
agcgctctcagagccggagcagcct

SEQ ID NO: 497452 - DNA, 25 bp, Rattus norvegicus
ttgacggctttcctcctgatccttc

SEQ ID NO: 497453 - DNA, 25 bp, Rattus norvegicus
ggtctccgctcaacagccgccaaaa

SEQ ID NO: 497454 - DNA, 25 bp, Rattus norvegicus
ccgccaaaacgcctcgtatcttgta

SEQ ID NO: 497455 - DNA, 25 bp, Rattus norvegicus
gcctcgtatcttgtaccgcgggaaa

SEQ ID NO: 497456 - DNA, 25 bp, Rattus norvegicus
tgaacagctgcttctcttgacggct

SEQ ID NO: 497457 - DNA, 25 bp, Rattus norvegicus
tcgtatcttgtaccgcgggaaaagc

SEQ ID NO: 497458 - DNA, 25 bp, Rattus norvegicus
catgaacgggaactgcatgtgcgtg

SEQ ID NO: 497459 - DNA, 25 bp, Rattus norvegicus
actgcgagcccatgaacgggaactg

SEQ ID NO: 497460 - DNA, 25 bp, Rattus norvegicus
cgtcggccacctgtgagaagtcatc

SEQ ID NO: 497461 - DNA, 25 bp, Rattus norvegicus
tagcacgtcggccacctgtgagaag

SEQ ID NO: 497462 - DNA, 25 bp, Rattus norvegicus
cgcaccacgccgtcctccactagca

SEQ ID NO: 497463 - DNA, 25 bp, Rattus norvegicus
tgcccgctgcatctaggatccgcag

SEQ ID NO: 497464 - DNA, 25 bp, Rattus norvegicus
agcttgcccgctgcatctaggatcc

SEQ ID NO: 497465 - DNA, 25 bp, Rattus norvegicus
caggacgagcttgcccgctgcatct

SEQ ID NO: 497466 - DNA, 25 bp, Rattus norvegicus
atgcctcccggcaggacgagcttgc

SEQ ID NO: 497467 - DNA, 25 bp, Rattus norvegicus
tgtgcgtgtgtgtgtcgatgcctcc

SEQ ID NO: 497468 - DNA, 25 bp, Rattus norvegicus
gccacctgtgagaagtcatcattga

SEQ ID NO: 497469 - DNA, 25 bp, Rattus norvegicus
gaagtcatcattgaccacgcgaccc

SEQ ID NO: 497470 - DNA, 25 bp, Rattus norvegicus
tcgactgactgcgagcccatgaacg

SEQ ID NO: 497471 - DNA, 25 bp, Rattus norvegicus
gtgtgtcgatgcctcccggcaggac

SEQ ID NO: 497472 - DNA, 25 bp, Rattus norvegicus
actgttgtactgcagtttgcggaca

SEQ ID NO: 497473 - DNA, 25 bp, Rattus norvegicus
catgcgcttgcgctgactgttgtac

SEQ ID NO: 497474 - DNA, 25 bp, Rattus norvegicus
tccgtcctgactggcagtccgagtc

SEQ ID NO: 497475 - DNA, 25 bp, Rattus norvegicus
tcctaggacggaagtgtccgcctcc

SEQ ID NO: 497476 - DNA, 25 bp, Rattus norvegicus
caaacctgcagcatcctaggacgga

SEQ ID NO: 497477 - DNA, 25 bp, Rattus norvegicus
gttgaaagagctgcgcgcggaacca

SEQ ID NO: 497478 - DNA, 25 bp, Rattus norvegicus
cagctcccagcagccgttgaaagag

SEQ ID NO: 497479 - DNA, 25 bp, Rattus norvegicus
gaacaaagggatcacgcagggcgcc

SEQ ID NO: 497480 - DNA, 25 bp, Rattus norvegicus
gcagggaccacaaggtgaacaaagg

SEQ ID NO: 497481 - DNA, 25 bp, Rattus norvegicus
ttccgtctgggaagtgcagggacca

SEQ ID NO: 497482 - DNA, 25 bp, Rattus norvegicus
ccaaatcattgagaggtccgggttc

SEQ ID NO: 497483 - DNA, 25 bp, Rattus norvegicus
gacgtgaaatccacgcatgcgcttg

SEQ ID NO: 497484 - DNA, 25 bp, Rattus norvegicus
gtttgcggacaccaggtcccgcttc

SEQ ID NO: 497485 - DNA, 25 bp, Rattus norvegicus
ttcccacgttgtacgcaagcgcagt

SEQ ID NO: 497486 - DNA, 25 bp, Rattus norvegicus
cacggtcacatctttgtgcgcgaga

SEQ ID NO: 497487 - DNA, 25 bp, Rattus norvegicus
gcgagagctgtacacccggcagcga

SEQ ID NO: 497488 - DNA, 25 bp, Rattus norvegicus
gctccgcaaggatccctagctcgga

SEQ ID NO: 497489 - DNA, 25 bp, Rattus norvegicus
aagcacagcccgtcctggaggcctg

SEQ ID NO: 497490 - DNA, 25 bp, Rattus norvegicus
catacccacggcagatggagggagc

SEQ ID NO: 497491 - DNA, 25 bp, Rattus norvegicus
actcctttgtgctccagcgacgggc

SEQ ID NO: 497492 - DNA, 25 bp, Rattus norvegicus
atttcgccgctcctggtgcccgagt

SEQ ID NO: 497493 - DNA, 25 bp, Rattus norvegicus
tgcccgagtagcgaggcagtgccaa

SEQ ID NO: 497494 - DNA, 25 bp, Rattus norvegicus
ggcagtgccaatcgatgtgcgagca

SEQ ID NO: 497495 - DNA, 25 bp, Rattus norvegicus
atgtgcgagcacacgaacccagccg

SEQ ID NO: 497496 - DNA, 25 bp, Rattus norvegicus
tgttctctgaccgagctccgccata

SEQ ID NO: 497497 - DNA, 25 bp, Rattus norvegicus
tccgccatagttcccggccttggtg

SEQ ID NO: 497498 - DNA, 25 bp, Rattus norvegicus
cccagcgaggaaaagcaagagccac

SEQ ID NO: 497499 - DNA, 25 bp, Rattus norvegicus
ggcgctcatccgtgcactcggcaat

SEQ ID NO: 497500 - DNA, 25 bp, Rattus norvegicus
cagaggcagcgacaacccagggaac

SEQ ID NO: 497501 - DNA, 25 bp, Rattus norvegicus
ctgtgagtttgcatccggactggct

SEQ ID NO: 497502 - DNA, 25 bp, Rattus norvegicus
ccggactggctttggatgcagccaa

SEQ ID NO: 497503 - DNA, 25 bp, Rattus norvegicus
ttggatgcagccaatcctcctttcg

SEQ ID NO: 497504 - DNA, 25 bp, Rattus norvegicus
tcctcctttcgctgatggcatagtc

SEQ ID NO: 497505 - DNA, 25 bp, Rattus norvegicus
tggccgatcgctcctagattcccat

SEQ ID NO: 497506 - DNA, 25 bp, Rattus norvegicus
ttcgctcggcctctcatttgcttgc

SEQ ID NO: 497507 - DNA, 25 bp, Rattus norvegicus
ttgcttgctcatctccaaacgtgga

SEQ ID NO: 497508 - DNA, 25 bp, Rattus norvegicus
cggaggagcctagctccgggatccc

SEQ ID NO: 497509 - DNA, 25 bp, Rattus norvegicus
cagggaccgcggacaccgcaggaac

SEQ ID NO: 497510 - DNA, 25 bp, Rattus norvegicus
tcaaacgtaagtttgcgcgcgggac

SEQ ID NO: 497511 - DNA, 25 bp, Rattus norvegicus
cccggcagatcaaacgtaagtttgc

SEQ ID NO: 497512 - DNA, 25 bp, Rattus norvegicus
tgtcccggcgaaagcagagtaaacc

SEQ ID NO: 497513 - DNA, 25 bp, Rattus norvegicus
atctccaaacgtggatccgcggctc

SEQ ID NO: 497514 - DNA, 25 bp, Rattus norvegicus
ctgcgtcaggctgagcgcagtccgc

SEQ ID NO: 497515 - DNA, 25 bp, Rattus norvegicus
ccgctgggcagctccggcttacaag

SEQ ID NO: 497516 - DNA, 25 bp, Rattus norvegicus
tgctccagcaaaggcgatgatgaac

SEQ ID NO: 497517 - DNA, 25 bp, Rattus norvegicus
ccgcaagtaagtttgtgaggctgct

SEQ ID NO: 497518 - DNA, 25 bp, Rattus norvegicus
ttccgcaggagctatttttagcagc

SEQ ID NO: 497519 - DNA, 25 bp, Rattus norvegicus
tccggcttacaaggatgctccagca

SEQ ID NO: 497520 - DNA, 25 bp, Rattus norvegicus
tgagcatgtctgcaagcgctcggcg

SEQ ID NO: 497521 - DNA, 25 bp, Rattus norvegicus
ggtccggaaactgagcatgtctgca

SEQ ID NO: 497522 - DNA, 25 bp, Rattus norvegicus
tccacgcgggcaggtccggaaactg

SEQ ID NO: 497523 - DNA, 25 bp, Rattus norvegicus
atggctcttggtagcttccacgcgg

SEQ ID NO: 497524 - DNA, 25 bp, Rattus norvegicus
cccgccgcggatggctcttggtagc

SEQ ID NO: 497525 - DNA, 25 bp, Rattus norvegicus
tgtggtcgcctccagctcgtggccg

SEQ ID NO: 497526 - DNA, 25 bp, Rattus norvegicus
ggtggcttccttccgcaggagctat

SEQ ID NO: 497527 - DNA, 25 bp, Rattus norvegicus
ccgccgacccgcaagtaagtttgtg

SEQ ID NO: 497528 - DNA, 25 bp, Rattus norvegicus
tgcctcctccaaccagttgtgacgt

SEQ ID NO: 497529 - DNA, 25 bp, Rattus norvegicus
tgcgcagcttttgccttggtcagtc

SEQ ID NO: 497530 - DNA, 25 bp, Rattus norvegicus
gaacgccgtgtttgcgcagcttttg

SEQ ID NO: 497531 - DNA, 25 bp, Rattus norvegicus
ttagacttccagaacgccgtgtttg

SEQ ID NO: 497532 - DNA, 25 bp, Rattus norvegicus
cttggtcagtcgtttttctcggtgc

SEQ ID NO: 497533 - DNA, 25 bp, Rattus norvegicus
ctcgtcctaattcagtgtgtgatcc

SEQ ID NO: 497534 - DNA, 25 bp, Rattus norvegicus
ccatgcaactgcgtggtggcccttc

SEQ ID NO: 497535 - DNA, 25 bp, Rattus norvegicus
tgcgcttcgaggactacctgaggga

SEQ ID NO: 497536 - DNA, 25 bp, Rattus norvegicus
ctggaactttgtgcgtcagggctcc

SEQ ID NO: 497537 - DNA, 25 bp, Rattus norvegicus
cgacaggcagaacttttctggaact

SEQ ID NO: 497538 - DNA, 25 bp, Rattus norvegicus
gctaagttaagctccgcccagattg

SEQ ID NO: 497539 - DNA, 25 bp, Rattus norvegicus
ggtccatccaggtagaagagatata

SEQ ID NO: 497540 - DNA, 25 bp, Rattus norvegicus
caggcgcgagagactgaaaggtccc

SEQ ID NO: 497541 - DNA, 25 bp, Rattus norvegicus
gtgacgtccacggagttagacttcc

SEQ ID NO: 497542 - DNA, 25 bp, Rattus norvegicus
gaggccttggagcacctgcagcacc

SEQ ID NO: 497543 - DNA, 25 bp, Rattus norvegicus
agcgctacctggaggcccacttcgg

SEQ ID NO: 497544 - DNA, 25 bp, Rattus norvegicus
ggcgcattctggagcgctacctgga

SEQ ID NO: 497545 - DNA, 25 bp, Rattus norvegicus
acccggtggaacagaggcgcattct

SEQ ID NO: 497546 - DNA, 25 bp, Rattus norvegicus
cttcatcgactttccggacccggtg

SEQ ID NO: 497547 - DNA, 25 bp, Rattus norvegicus
cgccctacagagatatatgtgttcc

SEQ ID NO: 497548 - DNA, 25 bp, Rattus norvegicus
ttcgcgccctacagagatatatgtg

SEQ ID NO: 497549 - DNA, 25 bp, Rattus norvegicus
agcactgatgttcgcgccctacaga

SEQ ID NO: 497550 - DNA, 25 bp, Rattus norvegicus
ggccaaggcccagcactgatgttcg

SEQ ID NO: 497551 - DNA, 25 bp, Rattus norvegicus
gtttccggccaaggcccagcactga

SEQ ID NO: 497552 - DNA, 25 bp, Rattus norvegicus
ggcggcctcctcaaatactgccacc

SEQ ID NO: 497553 - DNA, 25 bp, Rattus norvegicus
ttgccacacgcagccccgaggagat

SEQ ID NO: 497554 - DNA, 25 bp, Rattus norvegicus
acttcggcggagcagaagcagcccg

SEQ ID NO: 497555 - DNA, 25 bp, Rattus norvegicus
tgcagcaccgcgtcattgccacacg

SEQ ID NO: 497556 - DNA, 25 bp, Rattus norvegicus
atgctgggtctccaccttcgagagc

SEQ ID NO: 497557 - DNA, 25 bp, Rattus norvegicus
gacgggctatcccagagccgcggca

SEQ ID NO: 497558 - DNA, 25 bp, Rattus norvegicus
cggcaccaggtgtggatcgcctacc

SEQ ID NO: 497559 - DNA, 25 bp, Rattus norvegicus
gatcgcctaccgtgcgctcgtgtct

SEQ ID NO: 497560 - DNA, 25 bp, Rattus norvegicus
ggcgctccatcccaggctcgggaag

SEQ ID NO: 497561 - DNA, 25 bp, Rattus norvegicus
tcagcacgtgggctcggaaaaagtt

SEQ ID NO: 497562 - DNA, 25 bp, Rattus norvegicus
agtttgcggacacccgcccggagct

SEQ ID NO: 497563 - DNA, 25 bp, Rattus norvegicus
cgggcaagcacaaccgcaagcgctg

SEQ ID NO: 497564 - DNA, 25 bp, Rattus norvegicus
ccttcgagagcgattccaggcgagg

SEQ ID NO: 497565 - DNA, 25 bp, Rattus norvegicus
agtccgctcttctcttggcgtccgg

SEQ ID NO: 497566 - DNA, 25 bp, Rattus norvegicus
agcagccgcgcgcagggctttaaag

SEQ ID NO: 497567 - DNA, 25 bp, Rattus norvegicus
aagggaaggagctctagaagcagcc

SEQ ID NO: 497568 - DNA, 25 bp, Rattus norvegicus
aatccgccggctgcagaagggtccc

SEQ ID NO: 497569 - DNA, 25 bp, Rattus norvegicus
aggggcgttctgacgcccttcgctc

SEQ ID NO: 497570 - DNA, 25 bp, Rattus norvegicus
agtaagcgagaagctaccgggccca

SEQ ID NO: 497571 - DNA, 25 bp, Rattus norvegicus
gcgcgatgcgagtagtcaagtcgta

SEQ ID NO: 497572 - DNA, 25 bp, Rattus norvegicus
gcactgcgcatgtgcactcgtggtc

SEQ ID NO: 497573 - DNA, 25 bp, Rattus norvegicus
cgaaggcacagttgagtcccaccgc

SEQ ID NO: 497574 - DNA, 25 bp, Rattus norvegicus
agtcaagtcgtactccgccatcttg

SEQ ID NO: 497575 - DNA, 25 bp, Rattus norvegicus
gcatcgtcagaacccggcgctatca

SEQ ID NO: 497576 - DNA, 25 bp, Rattus norvegicus
tgtcgatccagaaaatgcgcgatgc

SEQ ID NO: 497577 - DNA, 25 bp, Rattus norvegicus
agaccaggtgtcgatccagaaaatg

SEQ ID NO: 497578 - DNA, 25 bp, Rattus norvegicus
ctcactcctccgaaggcacagttga

SEQ ID NO: 497579 - DNA, 25 bp, Rattus norvegicus
tttcacagagagaaactcaagaagc

SEQ ID NO: 497580 - DNA, 25 bp, Rattus norvegicus
cttccggctcgcacgtgtgtaggcc

SEQ ID NO: 497581 - DNA, 25 bp, Rattus norvegicus
cccagctggtgtcaggccggctcaa

SEQ ID NO: 497582 - DNA, 25 bp, Rattus norvegicus
cccaactgcgatacagtaagcgaga

SEQ ID NO: 497583 - DNA, 25 bp, Rattus norvegicus
ggagggcttgttcgctataacttta

SEQ ID NO: 497584 - DNA, 25 bp, Rattus norvegicus
ccgctgcctctaggttctaggaaga

SEQ ID NO: 497585 - DNA, 25 bp, Rattus norvegicus
ccaaagccctgggatatggttcaga

SEQ ID NO: 497586 - DNA, 25 bp, Rattus norvegicus
tcgtcatttgccattgcccggtagc

SEQ ID NO: 497587 - DNA, 25 bp, Rattus norvegicus
atggttcagaagtacccagagtccc

SEQ ID NO: 497588 - DNA, 25 bp, Rattus norvegicus
gctctccctgaactggttgaaccta

SEQ ID NO: 497589 - DNA, 25 bp, Rattus norvegicus
ggtctgcgacgtaccctgtcgcttt

SEQ ID NO: 497590 - DNA, 25 bp, Rattus norvegicus
cctctctgtgcaccggttctgtcat

SEQ ID NO: 497591 - DNA, 25 bp, Rattus norvegicus
cttctgtttaagaggcgagaggaac

SEQ ID NO: 497592 - DNA, 25 bp, Rattus norvegicus
gggtgcaggaagacccaaagccctg

SEQ ID NO: 497593 - DNA, 25 bp, Rattus norvegicus
tgggaggaagattccgcccattccc

SEQ ID NO: 497594 - DNA, 25 bp, Rattus norvegicus
agatggcgaaggtcactgagcgtta

SEQ ID NO: 497595 - DNA, 25 bp, Rattus norvegicus
ctgagcgttacgatgtgacttggga

SEQ ID NO: 497596 - DNA, 25 bp, Rattus norvegicus
caccggttctgtcatcttctgttta

SEQ ID NO: 497597 - DNA, 25 bp, Rattus norvegicus
ttcccgtaagagctgtagaaatggg

SEQ ID NO: 497598 - DNA, 25 bp, Rattus norvegicus
cccaggctcctttcgatgtgctgtc

SEQ ID NO: 497599 - DNA, 25 bp, Rattus norvegicus
tcgtcagcgcaagggtcatttcgtc

SEQ ID NO: 497600 - DNA, 25 bp, Rattus norvegicus
cccggaaatgcgtggtctagctttc

SEQ ID NO: 497601 - DNA, 25 bp, Rattus norvegicus
ggcccgcgctagttgaattctcaca

SEQ ID NO: 497602 - DNA, 25 bp, Rattus norvegicus
cactcgccacttagcagactctgga

SEQ ID NO: 497603 - DNA, 25 bp, Rattus norvegicus
actccgttgcatgctggggaatgta

SEQ ID NO: 497604 - DNA, 25 bp, Rattus norvegicus
tgtccgtgagaaagctgactccgtt

SEQ ID NO: 497605 - DNA, 25 bp, Rattus norvegicus
tggttcccatcccagaggactctgc

SEQ ID NO: 497606 - DNA, 25 bp, Rattus norvegicus
ttcgcgcttcactcctggaactgag

SEQ ID NO: 497607 - DNA, 25 bp, Rattus norvegicus
gctcttgttgaaaggttcgcgcttc

SEQ ID NO: 497608 - DNA, 25 bp, Rattus norvegicus
tcttttcacccgcagggagcaatta

SEQ ID NO: 497609 - DNA, 25 bp, Rattus norvegicus
gctcgagcgatagcttgtagccctc

SEQ ID NO: 497610 - DNA, 25 bp, Rattus norvegicus
ggcgccacatcttttctgggaaatg

SEQ ID NO: 497611 - DNA, 25 bp, Rattus norvegicus
gcccgagctactgagggtctaagtc

SEQ ID NO: 497612 - DNA, 25 bp, Rattus norvegicus
ttgcggcttgcacgtcaatgacgta

SEQ ID NO: 497613 - DNA, 25 bp, Rattus norvegicus
cggctcccaccttcagcagtttaga

SEQ ID NO: 497614 - DNA, 25 bp, Rattus norvegicus
tgtgagctgccgacccggaaaagcc

SEQ ID NO: 497615 - DNA, 25 bp, Rattus norvegicus
gtgggattgcgtaaccagaaagctc

SEQ ID NO: 497616 - DNA, 25 bp, Rattus norvegicus
agctatgctgcgctcacgcacggga

SEQ ID NO: 497617 - DNA, 25 bp, Rattus norvegicus
ccaacgtggctaggaaccggcttgt

SEQ ID NO: 497618 - DNA, 25 bp, Rattus norvegicus
actgtttccgggtcagggtgacctg

SEQ ID NO: 497619 - DNA, 25 bp, Rattus norvegicus
ggccaccactcaggggtactgtttc

SEQ ID NO: 497620 - DNA, 25 bp, Rattus norvegicus
cgcccggctttgaatgagcggagca

SEQ ID NO: 497621 - DNA, 25 bp, Rattus norvegicus
tgacgtatctatcctctattgggcc

SEQ ID NO: 497622 - DNA, 25 bp, Rattus norvegicus
ccctgtgcagtcattggcttgcggc

SEQ ID NO: 497623 - DNA, 25 bp, Rattus norvegicus
ttccgtcttcccaaagggcaatgtg

SEQ ID NO: 497624 - DNA, 25 bp, Rattus norvegicus
agtttagagcgcctcacttgacgcc

SEQ ID NO: 497625 - DNA, 25 bp, Rattus norvegicus
ctattgggccagaagtacgagatac

SEQ ID NO: 497626 - DNA, 25 bp, Rattus norvegicus
gactaccctacagcagcgagtatga

SEQ ID NO: 497627 - DNA, 25 bp, Rattus norvegicus
ctacctacagcagcgagcgtgacta

SEQ ID NO: 497628 - DNA, 25 bp, Rattus norvegicus
ctacggcaacgagcgtgactaccta

SEQ ID NO: 497629 - DNA, 25 bp, Rattus norvegicus
ctacctacggcaacgagcgtgacta

SEQ ID NO: 497630 - DNA, 25 bp, Rattus norvegicus
cgtgactaccctacagcagcgagta

SEQ ID NO: 497631 - DNA, 25 bp, Rattus norvegicus
gtgtgactacctacagcagcgagtg

SEQ ID NO: 497632 - DNA, 25 bp, Rattus norvegicus
ctacagcagcgagcgtgactaccta

SEQ ID NO: 497633 - DNA, 25 bp, Rattus norvegicus
ctccctacaacagcgagtgtgacta

SEQ ID NO: 497634 - DNA, 25 bp, Rattus norvegicus
agcgtgactacctacagctgctaga

SEQ ID NO: 497635 - DNA, 25 bp, Rattus norvegicus
ctacagctgcgagcgtgactaccta

SEQ ID NO: 497636 - DNA, 25 bp, Rattus norvegicus
tgactacctacagcagcgagcgtga

SEQ ID NO: 497637 - DNA, 25 bp, Rattus norvegicus
ctacctacagctgcgagcgtgacta

SEQ ID NO: 497638 - DNA, 25 bp, Rattus norvegicus
gtatgactccctacaacagcgagtg

SEQ ID NO: 497639 - DNA, 25 bp, Rattus norvegicus
gcagcgagtgtgactacctacagca

SEQ ID NO: 497640 - DNA, 25 bp, Rattus norvegicus
cagccggactcaccacggaacccgg

SEQ ID NO: 497641 - DNA, 25 bp, Rattus norvegicus
cagctcctagcagccggactcacca

SEQ ID NO: 497642 - DNA, 25 bp, Rattus norvegicus
gaaacacagcggagcgtgcagcatg

SEQ ID NO: 497643 - DNA, 25 bp, Rattus norvegicus
cacagctcctagcagccggactcac

SEQ ID NO: 497644 - DNA, 25 bp, Rattus norvegicus
tagcagccggactcaccacggaacc

SEQ ID NO: 497645 - DNA, 25 bp, Rattus norvegicus
cagcatggtggaccggaagtatccg

SEQ ID NO: 497646 - DNA, 25 bp, Rattus norvegicus
gcagcatggtggaccggaagtatcc

SEQ ID NO: 497647 - DNA, 25 bp, Rattus norvegicus
tgcagcatggtggaccggaagtatc

SEQ ID NO: 497648 - DNA, 25 bp, Rattus norvegicus
ctagcagccggactcaccacggaac

SEQ ID NO: 497649 - DNA, 25 bp, Rattus norvegicus
gcagccggactcaccacggaacccg

SEQ ID NO: 497650 - DNA, 25 bp, Rattus norvegicus
cccggaaccaccaaagcttctctca

SEQ ID NO: 497651 - DNA, 25 bp, Rattus norvegicus
caccaaagcttctctcagaaacaca

SEQ ID NO: 497652 - DNA, 25 bp, Rattus norvegicus
aaacacagcggagcgtgcagcatgg

SEQ ID NO: 497653 - DNA, 25 bp, Rattus norvegicus
tcctagcagccggactcaccacgga

SEQ ID NO: 497654 - DNA, 25 bp, Rattus norvegicus
gtgcccacctcgtcttttactgaag

SEQ ID NO: 497655 - DNA, 25 bp, Rattus norvegicus
cttggtcgccgcctttacctgaggc

SEQ ID NO: 497656 - DNA, 25 bp, Rattus norvegicus
agcactgagtccgaggctgcgtgca

SEQ ID NO: 497657 - DNA, 25 bp, Rattus norvegicus
ccgccgtccaggaggaggcacctgt

SEQ ID NO: 497658 - DNA, 25 bp, Rattus norvegicus
ggtcccatctcgtcgttgcctgcag

SEQ ID NO: 497659 - DNA, 25 bp, Rattus norvegicus
ttgctctctcggaggggtcccatct

SEQ ID NO: 497660 - DNA, 25 bp, Rattus norvegicus
cttaccttgctctctcggaggggtc

SEQ ID NO: 497661 - DNA, 25 bp, Rattus norvegicus
accctgtcaccgagtccgcacaccg

SEQ ID NO: 497662 - DNA, 25 bp, Rattus norvegicus
cttcctagcctagcccgacccactg

SEQ ID NO: 497663 - DNA, 25 bp, Rattus norvegicus
tcgtcttttactgaagcaccttcgg

SEQ ID NO: 497664 - DNA, 25 bp, Rattus norvegicus
gcaagctgtgcccacctcgtctttt

SEQ ID NO: 497665 - DNA, 25 bp, Rattus norvegicus
gcggggaacagctgcctggcacctc

SEQ ID NO: 497666 - DNA, 25 bp, Rattus norvegicus
gcctttacctgaggcggggaacagc

SEQ ID NO: 497667 - DNA, 25 bp, Rattus norvegicus
actgaagcaccttcggaccctgtca

SEQ ID NO: 497668 - DNA, 25 bp, Rattus norvegicus
gccggagactctggaccggtaggta

SEQ ID NO: 497669 - DNA, 25 bp, Rattus norvegicus
gtggcaaccggtttgcgctggggct

SEQ ID NO: 497670 - DNA, 25 bp, Rattus norvegicus
cgcgccagccgggttagcacacgtg

SEQ ID NO: 497671 - DNA, 25 bp, Rattus norvegicus
cgccagccgggttagcacacgtggt

SEQ ID NO: 497672 - DNA, 25 bp, Rattus norvegicus
ccagccgggttagcacacgtggtgc

SEQ ID NO: 497673 - DNA, 25 bp, Rattus norvegicus
ttagcacacgtggtgcggcagccgc

SEQ ID NO: 497674 - DNA, 25 bp, Rattus norvegicus
agcacacgtggtgcggcagccgcca

SEQ ID NO: 497675 - DNA, 25 bp, Rattus norvegicus
ttctggagccagcgcggcggcacct

SEQ ID NO: 497676 - DNA, 25 bp, Rattus norvegicus
cggcacctggggcttcggaacacgt

SEQ ID NO: 497677 - DNA, 25 bp, Rattus norvegicus
taggtaggggcgcaaagacgctggc

SEQ ID NO: 497678 - DNA, 25 bp, Rattus norvegicus
cgccggaggccggagactctggacc

SEQ ID NO: 497679 - DNA, 25 bp, Rattus norvegicus
tctggaccggtaggtaggggcgcaa

SEQ ID NO: 497680 - DNA, 25 bp, Rattus norvegicus
cggccggcgactcggcgcgtggcaa

SEQ ID NO: 497681 - DNA, 25 bp, Rattus norvegicus
aacacgtggggacaggcgccggagg

SEQ ID NO: 497682 - DNA, 25 bp, Rattus norvegicus
ggggtgacagatccatcccgaccgc

SEQ ID NO: 497683 - DNA, 25 bp, Rattus norvegicus
gtactcgttgtctaccgggttggca

SEQ ID NO: 497684 - DNA, 25 bp, Rattus norvegicus
ccgggttggcatcatcacaaagctc

SEQ ID NO: 497685 - DNA, 25 bp, Rattus norvegicus
caggacagagcttgctgagagagca

SEQ ID NO: 497686 - DNA, 25 bp, Rattus norvegicus
agagagcacgaagcggctgcctccc

SEQ ID NO: 497687 - DNA, 25 bp, Rattus norvegicus
ccctcgctgcagaagacgctggagt

SEQ ID NO: 497688 - DNA, 25 bp, Rattus norvegicus
cgccttggcctgaaggcactgcgaa

SEQ ID NO: 497689 - DNA, 25 bp, Rattus norvegicus
cgaagttgggaaggcgctagatcta

SEQ ID NO: 497690 - DNA, 25 bp, Rattus norvegicus
ggcgctagatctaagcgtgggtccc

SEQ ID NO: 497691 - DNA, 25 bp, Rattus norvegicus
gcagggatctcccaggttcccgagg

SEQ ID NO: 497692 - DNA, 25 bp, Rattus norvegicus
ttcccgagggagaagcctcccacta

SEQ ID NO: 497693 - DNA, 25 bp, Rattus norvegicus
acataacggaatgcctgagagctgc

SEQ ID NO: 497694 - DNA, 25 bp, Rattus norvegicus
tgcaagcggccagtgcgataatagt

SEQ ID NO: 497695 - DNA, 25 bp, Rattus norvegicus
gctgcctcccacgttgaccgtaagg

SEQ ID NO: 497696 - DNA, 25 bp, Rattus norvegicus
gggaaccgttacttccgagctgatg

SEQ ID NO: 497697 - DNA, 25 bp, Rattus norvegicus
ttgagctccaagtccggaaaccgtg

SEQ ID NO: 497698 - DNA, 25 bp, Rattus norvegicus
caccgcggactttgcctggaaactt

SEQ ID NO: 497699 - DNA, 25 bp, Rattus norvegicus
aaagcgaacagggcgccgaccgctg

SEQ ID NO: 497700 - DNA, 25 bp, Rattus norvegicus
tgaagccttcgggtccacgcctctt

SEQ ID NO: 497701 - DNA, 25 bp, Rattus norvegicus
tccggaaaccgtgtggacactagcc

SEQ ID NO: 497702 - DNA, 25 bp, Rattus norvegicus
cccgatgaaacttgagctccaagtc

SEQ ID NO: 497703 - DNA, 25 bp, Rattus norvegicus
gggatgtatgttgccgcctcctcct

SEQ ID NO: 497704 - DNA, 25 bp, Rattus norvegicus
atgccgggatgtatgttgccgcctc

SEQ ID NO: 497705 - DNA, 25 bp, Rattus norvegicus
ttaggatgccgggatgtatgttgcc

SEQ ID NO: 497706 - DNA, 25 bp, Rattus norvegicus
cggacttctgggctgaggttaggat

SEQ ID NO: 497707 - DNA, 25 bp, Rattus norvegicus
ttccgagctgatgcgccgaagcgga

SEQ ID NO: 497708 - DNA, 25 bp, Rattus norvegicus
cgttacttccgagctgatgcgccga

SEQ ID NO: 497709 - DNA, 25 bp, Rattus norvegicus
aaccgtgtggacactagcccggcgc

SEQ ID NO: 497710 - DNA, 25 bp, Rattus norvegicus
cccactccgagtggcaggaaaacta

SEQ ID NO: 497711 - DNA, 25 bp, Rattus norvegicus
taaaatacggtaggtgctaggcgcc

SEQ ID NO: 497712 - DNA, 25 bp, Rattus norvegicus
tgctaggcgccagagctgaaattgc

SEQ ID NO: 497713 - DNA, 25 bp, Rattus norvegicus
ctgaaattgcaagcggcccagctct

SEQ ID NO: 497714 - DNA, 25 bp, Rattus norvegicus
ctctgcgtttctctggctgacgtgc

SEQ ID NO: 497715 - DNA, 25 bp, Rattus norvegicus
cgtgctctgccgctttggcaactca

SEQ ID NO: 497716 - DNA, 25 bp, Rattus norvegicus
ggcaactcactccttctaatgtgcc

SEQ ID NO: 497717 - DNA, 25 bp, Rattus norvegicus
gttttggctcaacaggtatctcatg

SEQ ID NO: 497718 - DNA, 25 bp, Rattus norvegicus
atgaaaattcgcacttaaccctcgg

SEQ ID NO: 497719 - DNA, 25 bp, Rattus norvegicus
aaccctcggtcatcttcttgaagga

SEQ ID NO: 497720 - DNA, 25 bp, Rattus norvegicus
tcttgaaggagacacttctacgttt

SEQ ID NO: 497721 - DNA, 25 bp, Rattus norvegicus
acgtttctttcctcagcccgggctg

SEQ ID NO: 497722 - DNA, 25 bp, Rattus norvegicus
aagcccagacgtgtctctcgtcgca

SEQ ID NO: 497723 - DNA, 25 bp, Rattus norvegicus
ccacgcgaagccgagcgcgtgtcta

SEQ ID NO: 497724 - DNA, 25 bp, Rattus norvegicus
aacacggttttaagatgagtcactg

SEQ ID NO: 497725 - DNA, 25 bp, Rattus norvegicus
tgaggcttacggatccgaggctccc

SEQ ID NO: 497726 - DNA, 25 bp, Rattus norvegicus
aaatggaccctgaggcttacggatc

SEQ ID NO: 497727 - DNA, 25 bp, Rattus norvegicus
ctggcgcagcaaagaaaatggaccc

SEQ ID NO: 497728 - DNA, 25 bp, Rattus norvegicus
gccgcttttcctggcgcagcaaaga

SEQ ID NO: 497729 - DNA, 25 bp, Rattus norvegicus
gaggaaatccgagtgccccgtcatc

SEQ ID NO: 497730 - DNA, 25 bp, Rattus norvegicus
cactgttgataaacccatcttgggg

SEQ ID NO: 497731 - DNA, 25 bp, Rattus norvegicus
agatgagtcactgttgataaaccca

SEQ ID NO: 497732 - DNA, 25 bp, Rattus norvegicus
gcttctccaccgtggcaaactcttg

SEQ ID NO: 497733 - DNA, 25 bp, Rattus norvegicus
ccgtggcaaactcttgcggttttgc

SEQ ID NO: 497734 - DNA, 25 bp, Rattus norvegicus
tcttgcggttttgcacagcgatcgc

SEQ ID NO: 497735 - DNA, 25 bp, Rattus norvegicus
cggttttgcacagcgatcgcaggtg

SEQ ID NO: 497736 - DNA, 25 bp, Rattus norvegicus
atcgcaggtgaagaacacggtttta

SEQ ID NO: 497737 - DNA, 25 bp, Rattus norvegicus
atccgaggctcccatttttccactt

SEQ ID NO: 497738 - DNA, 25 bp, Rattus norvegicus
cccgccctttatctgtggctggaag

SEQ ID NO: 497739 - DNA, 25 bp, Rattus norvegicus
aaaggcaaaggcgagagagcgatca

SEQ ID NO: 497740 - DNA, 25 bp, Rattus norvegicus
cctggagaccgggacctaccttgtg

SEQ ID NO: 497741 - DNA, 25 bp, Rattus norvegicus
cagccgaggcgatgctgcccagata

SEQ ID NO: 497742 - DNA, 25 bp, Rattus norvegicus
ctgcccagatactggagatgctgtc

SEQ ID NO: 497743 - DNA, 25 bp, Rattus norvegicus
tggagatgctgtcctagagaatgcc

SEQ ID NO: 497744 - DNA, 25 bp, Rattus norvegicus
gatgctgtcctagagaatgccaaga

SEQ ID NO: 497745 - DNA, 25 bp, Rattus norvegicus
gtcctagagaatgccaagaactctc

SEQ ID NO: 497746 - DNA, 25 bp, Rattus norvegicus
gccaagaactctcaaagtgcttttt

SEQ ID NO: 497747 - DNA, 25 bp, Rattus norvegicus
tgctttttacctttccctctagctc

SEQ ID NO: 497748 - DNA, 25 bp, Rattus norvegicus
tttccctctagctctcaattaaagg

SEQ ID NO: 497749 - DNA, 25 bp, Rattus norvegicus
gctctcaattaaaggacgcaggatc

SEQ ID NO: 497750 - DNA, 25 bp, Rattus norvegicus
gaaagagaaaggaaatagagctagg

SEQ ID NO: 497751 - DNA, 25 bp, Rattus norvegicus
taaaggacgcaggatctgtgtgtgc

SEQ ID NO: 497752 - DNA, 25 bp, Rattus norvegicus
tcctgcgtttgctggaatcttctcg

SEQ ID NO: 497753 - DNA, 25 bp, Rattus norvegicus
cctactctcttcctgcgtttgctgg

SEQ ID NO: 497754 - DNA, 25 bp, Rattus norvegicus
cctgctcatgggaaaagcggcaaga

SEQ ID NO: 497755 - DNA, 25 bp, Rattus norvegicus
atttgcctggctaatacctttccgc

SEQ ID NO: 497756 - DNA, 25 bp, Rattus norvegicus
cgcggtcagcctgctcatgggaaaa

SEQ ID NO: 497757 - DNA, 25 bp, Rattus norvegicus
ttgctggaatcttctcgcacgcgcg

SEQ ID NO: 497758 - DNA, 25 bp, Rattus norvegicus
tccagccagacaggaagaaagagaa

SEQ ID NO: 497759 - DNA, 25 bp, Rattus norvegicus
gacgccatgtttccagccagacagg

SEQ ID NO: 497760 - DNA, 25 bp, Rattus norvegicus
ggtgccttccttgcgcgacgccatg

SEQ ID NO: 497761 - DNA, 25 bp, Rattus norvegicus
caccgcgccgccagtagagctggaa

SEQ ID NO: 497762 - DNA, 25 bp, Rattus norvegicus
tgcttcacggccgaatctccagagc

SEQ ID NO: 497763 - DNA, 25 bp, Rattus norvegicus
aggccgtcaatctgcacctgcttca

SEQ ID NO: 497764 - DNA, 25 bp, Rattus norvegicus
aactacgaagttccttacgctgtcg

SEQ ID NO: 497765 - DNA, 25 bp, Rattus norvegicus
cacgcgcgtgatttgcctggctaat

SEQ ID NO: 497766 - DNA, 25 bp, Rattus norvegicus
acaatttcggagtccgcgagcccta

SEQ ID NO: 497767 - DNA, 25 bp, Rattus norvegicus
tggctttttccgcaacaatttcgga

SEQ ID NO: 497768 - DNA, 25 bp, Rattus norvegicus
tgaagatcaccaggcagaaacacgc

SEQ ID NO: 497769 - DNA, 25 bp, Rattus norvegicus
tgcttaagcaggcatgaagatcacc

SEQ ID NO: 497770 - DNA, 25 bp, Rattus norvegicus
cgcgcctgttgtcctgttgcttaag

SEQ ID NO: 497771 - DNA, 25 bp, Rattus norvegicus
tgagaacgactgactccagagaggt

SEQ ID NO: 497772 - DNA, 25 bp, Rattus norvegicus
tggaagtgggcgttcctctgagaac

SEQ ID NO: 497773 - DNA, 25 bp, Rattus norvegicus
tctccgaggcaaattgaaagtcgtg

SEQ ID NO: 497774 - DNA, 25 bp, Rattus norvegicus
ggtgtggcccagaattctccgaggc

SEQ ID NO: 497775 - DNA, 25 bp, Rattus norvegicus
gagagacccagctgtgcaccacgag

SEQ ID NO: 497776 - DNA, 25 bp, Rattus norvegicus
aagtcgtgagctactatgggcggta

SEQ ID NO: 497777 - DNA, 25 bp, Rattus norvegicus
cccgctaccttatgggagagaccca

SEQ ID NO: 497778 - DNA, 25 bp, Rattus norvegicus
gcgagccctaccagatccttctaga

SEQ ID NO: 497779 - DNA, 25 bp, Rattus norvegicus
gatccttctagatggcacattctgc

SEQ ID NO: 497780 - DNA, 25 bp, Rattus norvegicus
aacaagatggctgccgttacggcgc

SEQ ID NO: 497781 - DNA, 25 bp, Rattus norvegicus
gccgtggaatgcagcggaaccatta

SEQ ID NO: 497782 - DNA, 25 bp, Rattus norvegicus
ccgagagcgggctcgttcaaacctc

SEQ ID NO: 497783 - DNA, 25 bp, Rattus norvegicus
ccgggtcgcttacctgtatctctgc

SEQ ID NO: 497784 - DNA, 25 bp, Rattus norvegicus
tccttgtctttggaccagccgcctg

SEQ ID NO: 497785 - DNA, 25 bp, Rattus norvegicus
gccgcccaaatccttggttcaaatc

SEQ ID NO: 497786 - DNA, 25 bp, Rattus norvegicus
tcggcaggatgtttacggtcaaaaa

SEQ ID NO: 497787 - DNA, 25 bp, Rattus norvegicus
ccattagtaactcagcaggcgcgga

SEQ ID NO: 497788 - DNA, 25 bp, Rattus norvegicus
cactgtccgacctccaagtagcgga

SEQ ID NO: 497789 - DNA, 25 bp, Rattus norvegicus
aaaaaggtacttgtgcgcctgcgca

SEQ ID NO: 497790 - DNA, 25 bp, Rattus norvegicus
ggcgcgctgaccacttccttgtctt

SEQ ID NO: 497791 - DNA, 25 bp, Rattus norvegicus
agcaggcgcaaaggttcgtcgaaga

SEQ ID NO: 497792 - DNA, 25 bp, Rattus norvegicus
tttcgagcgtcagagttggcaaata

SEQ ID NO: 497793 - DNA, 25 bp, Rattus norvegicus
cccgcgtctttgcagacagccattt

SEQ ID NO: 497794 - DNA, 25 bp, Rattus norvegicus
tgctggagcacctccggagacagct

SEQ ID NO: 497795 - DNA, 25 bp, Rattus norvegicus
cggcacttggcgcatcgaggcacca

SEQ ID NO: 497796 - DNA, 25 bp, Rattus norvegicus
gcatcgaggcaccagagcatgtccg

SEQ ID NO: 497797 - DNA, 25 bp, Rattus norvegicus
gcgggactcgcgctcaggactccgt

SEQ ID NO: 497798 - DNA, 25 bp, Rattus norvegicus
agccgggcgcgcatggagtgcgccc

SEQ ID NO: 497799 - DNA, 25 bp, Rattus norvegicus
agacagctggagcgcgccttccagc

SEQ ID NO: 497800 - DNA, 25 bp, Rattus norvegicus
gctggagcacctccggagacagctg

SEQ ID NO: 497801 - DNA, 25 bp, Rattus norvegicus
tgcaccgcatgccttgcggcacttg

SEQ ID NO: 497802 - DNA, 25 bp, Rattus norvegicus
agagcatgtccgggcgtccagcccg

SEQ ID NO: 497803 - DNA, 25 bp, Rattus norvegicus
cgcatcgaggcaccagagcatgtcc

SEQ ID NO: 497804 - DNA, 25 bp, Rattus norvegicus
cacttggcgcatcgaggcaccagag

SEQ ID NO: 497805 - DNA, 25 bp, Rattus norvegicus
tcgcgctcaggactccgtggcttcg

SEQ ID NO: 497806 - DNA, 25 bp, Rattus norvegicus
ccttgcggcacttggcgcatcgagg

SEQ ID NO: 497807 - DNA, 25 bp, Rattus norvegicus
ttggcgcatcgaggcaccagagcat

SEQ ID NO: 497808 - DNA, 25 bp, Rattus norvegicus
agaggttccacttccagctgggagg

SEQ ID NO: 497809 - DNA, 25 bp, Rattus norvegicus
ttccagctgggaggcgcagagactc

SEQ ID NO: 497810 - DNA, 25 bp, Rattus norvegicus
acttccagctgggaggcgcagagac

SEQ ID NO: 497811 - DNA, 25 bp, Rattus norvegicus
tccacttccagctgggaggcgcaga

SEQ ID NO: 497812 - DNA, 25 bp, Rattus norvegicus
aggttccacttccagctgggaggcg

SEQ ID NO: 497813 - DNA, 25 bp, Rattus norvegicus
tcccgccttctaggctatgcgcagg

SEQ ID NO: 497814 - DNA, 25 bp, Rattus norvegicus
tgagaggttccacttccagctggga

SEQ ID NO: 497815 - DNA, 25 bp, Rattus norvegicus
accaattcccgccttctaggctatg

SEQ ID NO: 497816 - DNA, 25 bp, Rattus norvegicus
cgttgagaggttccacttccagctg

SEQ ID NO: 497817 - DNA, 25 bp, Rattus norvegicus
gtcgttgagaggttccacttccagc

SEQ ID NO: 497818 - DNA, 25 bp, Rattus norvegicus
aagtcgttgagaggttccacttcca

SEQ ID NO: 497819 - DNA, 25 bp, Rattus norvegicus
gccttctaggctatgcgcaggcgca

SEQ ID NO: 497820 - DNA, 25 bp, Rattus norvegicus
attcccgccttctaggctatgcgca

SEQ ID NO: 497821 - DNA, 25 bp, Rattus norvegicus
gttccacttccagctgggaggcgca

SEQ ID NO: 497822 - DNA, 25 bp, Rattus norvegicus
tcttccggtacagcgcttgcgtcgc

SEQ ID NO: 497823 - DNA, 25 bp, Rattus norvegicus
ccgcgtgacacaggctcctgggtct

SEQ ID NO: 497824 - DNA, 25 bp, Rattus norvegicus
gacctccgcggacgacctcagggtg

SEQ ID NO: 497825 - DNA, 25 bp, Rattus norvegicus
tgcagagctggtgaaagcggacctc

SEQ ID NO: 497826 - DNA, 25 bp, Rattus norvegicus
ccagctgctcaggaacatgcaggtg

SEQ ID NO: 497827 - DNA, 25 bp, Rattus norvegicus
caccatggagatcttccagctgctc

SEQ ID NO: 497828 - DNA, 25 bp, Rattus norvegicus
agacatcgtgtaccgcaccatggag

SEQ ID NO: 497829 - DNA, 25 bp, Rattus norvegicus
ggagaccgtgcaagacatcgtgtac

SEQ ID NO: 497830 - DNA, 25 bp, Rattus norvegicus
ccgcatcgggcaggagaccgtgcaa

SEQ ID NO: 497831 - DNA, 25 bp, Rattus norvegicus
cgcgaggtcaacacggccacgctgt

SEQ ID NO: 497832 - DNA, 25 bp, Rattus norvegicus
acgggcatggcgtccggacccttcg

SEQ ID NO: 497833 - DNA, 25 bp, Rattus norvegicus
tttgaaattggcagagtaggctccg

SEQ ID NO: 497834 - DNA, 25 bp, Rattus norvegicus
aagtggcgccgcttgtttgaaattg

SEQ ID NO: 497835 - DNA, 25 bp, Rattus norvegicus
aatcgcgtcaggctccgcgtgacac

SEQ ID NO: 497836 - DNA, 25 bp, Rattus norvegicus
gctgggaatgcaacctgaacgaggc

SEQ ID NO: 497837 - DNA, 25 bp, Rattus norvegicus
cccggttctgaatgttacacttaca

SEQ ID NO: 497838 - DNA, 25 bp, Rattus norvegicus
gtcgccgaatgttacccggttctga

SEQ ID NO: 497839 - DNA, 25 bp, Rattus norvegicus
ccggtgtttactcctgcgctcacgg

SEQ ID NO: 497840 - DNA, 25 bp, Rattus norvegicus
ggctcctacactccgccggtgttta

SEQ ID NO: 497841 - DNA, 25 bp, Rattus norvegicus
ggtctccacgagctggaaacgcctc

SEQ ID NO: 497842 - DNA, 25 bp, Rattus norvegicus
cttcagccggctagtgcatcttgca

SEQ ID NO: 497843 - DNA, 25 bp, Rattus norvegicus
ggtgcagagcactacggttccaaca

SEQ ID NO: 497844 - DNA, 25 bp, Rattus norvegicus
gaagtgactgcctctccgctcggat

SEQ ID NO: 497845 - DNA, 25 bp, Rattus norvegicus
aaagctcccgatacccaatcaatgg

SEQ ID NO: 497846 - DNA, 25 bp, Rattus norvegicus
gcggactgtaattttcttgcatgca

SEQ ID NO: 497847 - DNA, 25 bp, Rattus norvegicus
cagaagatctcgcacccagggcggg

SEQ ID NO: 497848 - DNA, 25 bp, Rattus norvegicus
tggggcgccgtaacctcacaaatcc

SEQ ID NO: 497849 - DNA, 25 bp, Rattus norvegicus
ttattcccttctgcagcggctccta

SEQ ID NO: 497850 - DNA, 25 bp, Rattus norvegicus
ggcacgtctctatgcccggtaggca

SEQ ID NO: 497851 - DNA, 25 bp, Rattus norvegicus
cggttactcttctgagagcccttca

SEQ ID NO: 497852 - DNA, 25 bp, Rattus norvegicus
agctcgcctagacgcgcaaatctgc

SEQ ID NO: 497853 - DNA, 25 bp, Rattus norvegicus
agcttgtgtaccagcccggggacac

SEQ ID NO: 497854 - DNA, 25 bp, Rattus norvegicus
gggacacccacggaagcacccatga

SEQ ID NO: 497855 - DNA, 25 bp, Rattus norvegicus
agtgaccaatcacagctcgcctaga

SEQ ID NO: 497856 - DNA, 25 bp, Rattus norvegicus
cggaagcacccatgaataagatatg

SEQ ID NO: 497857 - DNA, 25 bp, Rattus norvegicus
gtgcagcccgctggcacgtctctat

SEQ ID NO: 497858 - DNA, 25 bp, Rattus norvegicus
gtaggcacctgtcgtgtgagtagct

SEQ ID NO: 497859 - DNA, 25 bp, Rattus norvegicus
ggccgccggttactcttctgagagc

SEQ ID NO: 497860 - DNA, 25 bp, Rattus norvegicus
ataagatatggtgcaacccgggcgc

SEQ ID NO: 497861 - DNA, 25 bp, Rattus norvegicus
gtccacacgttaccaggtaggagtg

SEQ ID NO: 497862 - DNA, 25 bp, Rattus norvegicus
gcagcgcgatctgtccacacgttac

SEQ ID NO: 497863 - DNA, 25 bp, Rattus norvegicus
ccagagcgtcgtccaatcagagcga

SEQ ID NO: 497864 - DNA, 25 bp, Rattus norvegicus
ctggccctgacatcctgaggaccta

SEQ ID NO: 497865 - DNA, 25 bp, Rattus norvegicus
aggctggggagcaccacacctgcgc

SEQ ID NO: 497866 - DNA, 25 bp, Rattus norvegicus
acacctgcgctggtgaccctgacgg

SEQ ID NO: 497867 - DNA, 25 bp, Rattus norvegicus
ctcacctgtgctcacgtgacggggc

SEQ ID NO: 497868 - DNA, 25 bp, Rattus norvegicus
tctgtcggcagagggcccgtagcca

SEQ ID NO: 497869 - DNA, 25 bp, Rattus norvegicus
tttccgcgctcagcacgcctgaacc

SEQ ID NO: 497870 - DNA, 25 bp, Rattus norvegicus
ccggatcaccctgccggctggccct

SEQ ID NO: 497871 - DNA, 25 bp, Rattus norvegicus
tcctgaggacctactcgggagcttt

SEQ ID NO: 497872 - DNA, 25 bp, Rattus norvegicus
acctactcgggagctttcgtctgcc

SEQ ID NO: 497873 - DNA, 25 bp, Rattus norvegicus
gctttcgtctgcctggagattgtaa

SEQ ID NO: 497874 - DNA, 25 bp, Rattus norvegicus
cctggagattgtaagtgggacagca

SEQ ID NO: 497875 - DNA, 25 bp, Rattus norvegicus
aagtgggacagcataggtgacgatc

SEQ ID NO: 497876 - DNA, 25 bp, Rattus norvegicus
gacagcataggtgacgatcgagccc

SEQ ID NO: 497877 - DNA, 25 bp, Rattus norvegicus
acgtagcagcggcagcatgtcggcc

SEQ ID NO: 497878 - DNA, 25 bp, Rattus norvegicus
tgctagacggctgctcctgctgtcc

SEQ ID NO: 497879 - DNA, 25 bp, Rattus norvegicus
ggagagttgctctgagatgagaccc

SEQ ID NO: 497880 - DNA, 25 bp, Rattus norvegicus
ctcttcctaggtctctgcaactctg

SEQ ID NO: 497881 - DNA, 25 bp, Rattus norvegicus
taggtctctgcaactctgcgctgcc

SEQ ID NO: 497882 - DNA, 25 bp, Rattus norvegicus
cgctcggtgctagacggctgctcct

SEQ ID NO: 497883 - DNA, 25 bp, Rattus norvegicus
ggtctctactgcgaccgcagcgcgg

SEQ ID NO: 497884 - DNA, 25 bp, Rattus norvegicus
agacggctgctcctgctgtccggtg

SEQ ID NO: 497885 - DNA, 25 bp, Rattus norvegicus
gctctgagatgagaccctgcgacca

SEQ ID NO: 497886 - DNA, 25 bp, Rattus norvegicus
gagatgagaccctgcgaccagagca

SEQ ID NO: 497887 - DNA, 25 bp, Rattus norvegicus
tgagaccctgcgaccagagcagcgg

SEQ ID NO: 497888 - DNA, 25 bp, Rattus norvegicus
accagagcagcggtctctactgcga

SEQ ID NO: 497889 - DNA, 25 bp, Rattus norvegicus
agcagcggtctctactgcgaccgca

SEQ ID NO: 497890 - DNA, 25 bp, Rattus norvegicus
cccagtatatcaccgacctgcgccc

SEQ ID NO: 497891 - DNA, 25 bp, Rattus norvegicus
gttgctctgagatgagaccctgcga

SEQ ID NO: 497892 - DNA, 25 bp, Rattus norvegicus
accgcggctcctgactgcgcttgtt

SEQ ID NO: 497893 - DNA, 25 bp, Rattus norvegicus
tggaacccggtccagctgagggcac

SEQ ID NO: 497894 - DNA, 25 bp, Rattus norvegicus
ggcacgggaaggcagcccaacaacc

SEQ ID NO: 497895 - DNA, 25 bp, Rattus norvegicus
cggacgttttttccggctgctgccg

SEQ ID NO: 497896 - DNA, 25 bp, Rattus norvegicus
ttttttccggctgctgccgaggccc

SEQ ID NO: 497897 - DNA, 25 bp, Rattus norvegicus
ccctttgcaaggattgccctggttg

SEQ ID NO: 497898 - DNA, 25 bp, Rattus norvegicus
aaggattgccctggttgcaccgtgc

SEQ ID NO: 497899 - DNA, 25 bp, Rattus norvegicus
tggttgcaccgtgcagccgccgtga

SEQ ID NO: 497900 - DNA, 25 bp, Rattus norvegicus
caggagccccaagccgtagagcacg

SEQ ID NO: 497901 - DNA, 25 bp, Rattus norvegicus
cgcagagaggggttgcctaccctac

SEQ ID NO: 497902 - DNA, 25 bp, Rattus norvegicus
gtttgtgagcctggaacccggtcca

SEQ ID NO: 497903 - DNA, 25 bp, Rattus norvegicus
cgtggcgactcatgctgcggcgtcc

SEQ ID NO: 497904 - DNA, 25 bp, Rattus norvegicus
tgactgcgcttgtttgcgctgggcc

SEQ ID NO: 497905 - DNA, 25 bp, Rattus norvegicus
ctaccctacccgatcggcgtggcga

SEQ ID NO: 497906 - DNA, 25 bp, Rattus norvegicus
cctgtcacacagatgagccgcttta

SEQ ID NO: 497907 - DNA, 25 bp, Rattus norvegicus
accggaagtcttctccgggcgccag

SEQ ID NO: 497908 - DNA, 25 bp, Rattus norvegicus
acgtcagaggaagtggagccaccgc

SEQ ID NO: 497909 - DNA, 25 bp, Rattus norvegicus
acctctgaccggtgacgtcagagga

SEQ ID NO: 497910 - DNA, 25 bp, Rattus norvegicus
cttgctcgtcacctctgaccggtga

SEQ ID NO: 497911 - DNA, 25 bp, Rattus norvegicus
agccgctttacaggagctcaaagcc

SEQ ID NO: 497912 - DNA, 25 bp, Rattus norvegicus
gccctaaccctgtcacacagatgag

SEQ ID NO: 497913 - DNA, 25 bp, Rattus norvegicus
gccactctcagtctcctacgcccta

SEQ ID NO: 497914 - DNA, 25 bp, Rattus norvegicus
gcggcctgtgcactctgagggccca

SEQ ID NO: 497915 - DNA, 25 bp, Rattus norvegicus
gcattcccggtagcggcctgtgcac

SEQ ID NO: 497916 - DNA, 25 bp, Rattus norvegicus
tccggaggctgcagcgcattcccgg

SEQ ID NO: 497917 - DNA, 25 bp, Rattus norvegicus
tcctgcggggctcgcctttcaggct

SEQ ID NO: 497918 - DNA, 25 bp, Rattus norvegicus
catgaagagctcctgcggggctcgc

SEQ ID NO: 497919 - DNA, 25 bp, Rattus norvegicus
gccgcctgccgacatcttgctcgtc

SEQ ID NO: 497920 - DNA, 25 bp, Rattus norvegicus
ggagccgaagctcaggcagtgcaca

SEQ ID NO: 497921 - DNA, 25 bp, Rattus norvegicus
gcggcatttagcttggcgacctgca

SEQ ID NO: 497922 - DNA, 25 bp, Rattus norvegicus
cccgctggagtcaacttccggggcg

SEQ ID NO: 497923 - DNA, 25 bp, Rattus norvegicus
cgccaaaacccgctggagtcaactt

SEQ ID NO: 497924 - DNA, 25 bp, Rattus norvegicus
ggaaagcgcgccaaaacccgctgga

SEQ ID NO: 497925 - DNA, 25 bp, Rattus norvegicus
aaggcgtgtcatcgacccgaactcc

SEQ ID NO: 497926 - DNA, 25 bp, Rattus norvegicus
cccgcagcacggagaaaggcgtgtc

SEQ ID NO: 497927 - DNA, 25 bp, Rattus norvegicus
ccgggcatcccgcagcacggagaaa

SEQ ID NO: 497928 - DNA, 25 bp, Rattus norvegicus
gtcgcgtccacttcctcgcgggtcc

SEQ ID NO: 497929 - DNA, 25 bp, Rattus norvegicus
tgggcagcaactcggcggcatttag

SEQ ID NO: 497930 - DNA, 25 bp, Rattus norvegicus
atttagcttggcgacctgcagcgtc

SEQ ID NO: 497931 - DNA, 25 bp, Rattus norvegicus
caactcggcggcatttagcttggcg

SEQ ID NO: 497932 - DNA, 25 bp, Rattus norvegicus
tcaggcagtgcacagtgggcagcaa

SEQ ID NO: 497933 - DNA, 25 bp, Rattus norvegicus
ttggcgacctgcagcgtcgcgtcca

SEQ ID NO: 497934 - DNA, 25 bp, Rattus norvegicus
ctcttcagcttacccgcagggattc

SEQ ID NO: 497935 - DNA, 25 bp, Rattus norvegicus
cccgatgtttatattttgctcctta

SEQ ID NO: 497936 - DNA, 25 bp, Rattus norvegicus
aaagttctagggctggactcgccga

SEQ ID NO: 497937 - DNA, 25 bp, Rattus norvegicus
tggactcgccgacctcttcagctta

SEQ ID NO: 497938 - DNA, 25 bp, Rattus norvegicus
cgcacacgcgatctggttcgtggca

SEQ ID NO: 497939 - DNA, 25 bp, Rattus norvegicus
agccaatcgcgtctgagccacggga

SEQ ID NO: 497940 - DNA, 25 bp, Rattus norvegicus
ctcggtgagggcacactgatccaaa

SEQ ID NO: 497941 - DNA, 25 bp, Rattus norvegicus
cctccaggacagcaaaggcagagtg

SEQ ID NO: 497942 - DNA, 25 bp, Rattus norvegicus
agagctggaacgcatggctgaagtc

SEQ ID NO: 497943 - DNA, 25 bp, Rattus norvegicus
ctgaagtcctagttacgggagagca

SEQ ID NO: 497944 - DNA, 25 bp, Rattus norvegicus
cagctccggtaaggaaaggcactca

SEQ ID NO: 497945 - DNA, 25 bp, Rattus norvegicus
tggtgggctatcgattgcactatgc

SEQ ID NO: 497946 - DNA, 25 bp, Rattus norvegicus
agccgggaggctaacagcttcagca

SEQ ID NO: 497947 - DNA, 25 bp, Rattus norvegicus
tgcgccctagctggactgctgcagc

SEQ ID NO: 497948 - DNA, 25 bp, Rattus norvegicus
tttccagctaacctaagcggcagga

SEQ ID NO: 497949 - DNA, 25 bp, Rattus norvegicus
tccgcttccctgctactctcgggtc

SEQ ID NO: 497950 - DNA, 25 bp, Rattus norvegicus
gtagccgtttcgttatgaaaggagc

SEQ ID NO: 497951 - DNA, 25 bp, Rattus norvegicus
ttcgttatgaaaggagcaaacagtg

SEQ ID NO: 497952 - DNA, 25 bp, Rattus norvegicus
agcaaacagtgtggctactgagaga

SEQ ID NO: 497953 - DNA, 25 bp, Rattus norvegicus
ggctactgagagaataatttcccaa

SEQ ID NO: 497954 - DNA, 25 bp, Rattus norvegicus
taatttcccaaaataattggcagga

SEQ ID NO: 497955 - DNA, 25 bp, Rattus norvegicus
ttggcaggaaaaccaacgtaggaca

SEQ ID NO: 497956 - DNA, 25 bp, Rattus norvegicus
cctaagcggcaggaaaccggaagtg

SEQ ID NO: 497957 - DNA, 25 bp, Rattus norvegicus
gacagtattttccagctaacctaag

SEQ ID NO: 497958 - DNA, 25 bp, Rattus norvegicus
ggttcctatcactgtcgtgcattca

SEQ ID NO: 497959 - DNA, 25 bp, Rattus norvegicus
aacacgaaggttcctatcactgtcg

SEQ ID NO: 497960 - DNA, 25 bp, Rattus norvegicus
ccaacgtaggacagtattttccagc

SEQ ID NO: 497961 - DNA, 25 bp, Rattus norvegicus
tgtcgtgcattcatccgcttccctg

SEQ ID NO: 497962 - DNA, 25 bp, Rattus norvegicus
agtccctatgccgttgtacgccgta

SEQ ID NO: 497963 - DNA, 25 bp, Rattus norvegicus
agagtccggggcttgaggcacacca

SEQ ID NO: 497964 - DNA, 25 bp, Rattus norvegicus
cgaaccattggtggtagtccctatg

SEQ ID NO: 497965 - DNA, 25 bp, Rattus norvegicus
tgcctcagttcgcatttgcaccttg

SEQ ID NO: 497966 - DNA, 25 bp, Rattus norvegicus
ggcgtcctcgctcaagttcaccaga

SEQ ID NO: 497967 - DNA, 25 bp, Rattus norvegicus
gttcaccagaactttatgccagcga

SEQ ID NO: 497968 - DNA, 25 bp, Rattus norvegicus
ttatgccagcgatcccgcaccaaaa

SEQ ID NO: 497969 - DNA, 25 bp, Rattus norvegicus
cgccatctttccagcattcttaaaa

SEQ ID NO: 497970 - DNA, 25 bp, Rattus norvegicus
aaatgccatgtgattgcaaacgggg

SEQ ID NO: 497971 - DNA, 25 bp, Rattus norvegicus
cctaaaagaagaaggagagccctcg

SEQ ID NO: 497972 - DNA, 25 bp, Rattus norvegicus
aagccagctgccagttgcaaaaccc

SEQ ID NO: 497973 - DNA, 25 bp, Rattus norvegicus
cggagcggccaagtgctattgagaa

SEQ ID NO: 497974 - DNA, 25 bp, Rattus norvegicus
caagtgctattgagaaccggtagga

SEQ ID NO: 497975 - DNA, 25 bp, Rattus norvegicus
acgtcgcgctgtctcagacccgggt

SEQ ID NO: 497976 - DNA, 25 bp, Rattus norvegicus
cagcgcaacgcacgggacacactag

SEQ ID NO: 497977 - DNA, 25 bp, Rattus norvegicus
cttccgcctaggaggggcagagact

SEQ ID NO: 497978 - DNA, 25 bp, Rattus norvegicus
gcaacgcacgggacacactagagcc

SEQ ID NO: 497979 - DNA, 25 bp, Rattus norvegicus
aacgcacgggacacactagagcctt

SEQ ID NO: 497980 - DNA, 25 bp, Rattus norvegicus
tcgtcgagaggttccgcttccgcct

SEQ ID NO: 497981 - DNA, 25 bp, Rattus norvegicus
cgtcgagaggttccgcttccgccta

SEQ ID NO: 497982 - DNA, 25 bp, Rattus norvegicus
caattcccgcctcccaggctacgcg

SEQ ID NO: 497983 - DNA, 25 bp, Rattus norvegicus
tccgcttccgcctaggaggggcaga

SEQ ID NO: 497984 - DNA, 25 bp, Rattus norvegicus
tcccgcctcccaggctacgcgcagg

SEQ ID NO: 497985 - DNA, 25 bp, Rattus norvegicus
aagtcgtcgagaggttccgcttccg

SEQ ID NO: 497986 - DNA, 25 bp, Rattus norvegicus
tcagcgcaacgcacgggacacacta

SEQ ID NO: 497987 - DNA, 25 bp, Rattus norvegicus
cgcaacgcacgggacacactagagc

SEQ ID NO: 497988 - DNA, 25 bp, Rattus norvegicus
ttccgcctaggaggggcagagactc

SEQ ID NO: 497989 - DNA, 25 bp, Rattus norvegicus
ccgcaccccggtcaatctcacacgg

SEQ ID NO: 497990 - DNA, 25 bp, Rattus norvegicus
cgtgagcgctgaacgtgacgtaaac

SEQ ID NO: 497991 - DNA, 25 bp, Rattus norvegicus
cgcctccactctgattgcaagcccg

SEQ ID NO: 497992 - DNA, 25 bp, Rattus norvegicus
tttccgcctccactctgattgcaag

SEQ ID NO: 497993 - DNA, 25 bp, Rattus norvegicus
agtttccgcctccactctgattgca

SEQ ID NO: 497994 - DNA, 25 bp, Rattus norvegicus
ggaagtttccgcctccactctgatt

SEQ ID NO: 497995 - DNA, 25 bp, Rattus norvegicus
ctagagccttcctcagactcgcagt

SEQ ID NO: 497996 - DNA, 25 bp, Rattus norvegicus
gctcccagcagccagactcagcgca

SEQ ID NO: 497997 - DNA, 25 bp, Rattus norvegicus
cagagactccgggaacaaacggagt

SEQ ID NO: 497998 - DNA, 25 bp, Rattus norvegicus
gacgtaaacactttccaagcaccaa

SEQ ID NO: 497999 - DNA, 25 bp, Rattus norvegicus
cgctgaacgtgacgtaaacactttc

SEQ ID NO: 498000 - DNA, 25 bp, Rattus norvegicus
tgcgtgagcgctgaacgtgacgtaa

SEQ ID NO: 498001 - DNA, 25 bp, Rattus norvegicus
caacgcgtgcgtgagcgctgaacgt

SEQ ID NO: 498002 - DNA, 25 bp, Rattus norvegicus
aaagcaacgcgtgcgtgagcgctga

SEQ ID NO: 498003 - DNA, 25 bp, Rattus norvegicus
acgtgacgtaaacactttccaagca

SEQ ID NO: 498004 - DNA, 25 bp, Rattus norvegicus
ccacgtcggatttggctcaagactg

SEQ ID NO: 498005 - DNA, 25 bp, Rattus norvegicus
tctccagctgcatcggaggaaagaa

SEQ ID NO: 498006 - DNA, 25 bp, Rattus norvegicus
cccgagtggcgaatgccacagcctg

SEQ ID NO: 498007 - DNA, 25 bp, Rattus norvegicus
gagggatgcgcgctctcctctctcc

SEQ ID NO: 498008 - DNA, 25 bp, Rattus norvegicus
cttagctgggcgtccggcacaagga

SEQ ID NO: 498009 - DNA, 25 bp, Rattus norvegicus
acgccctggctacgggctgcttagc

SEQ ID NO: 498010 - DNA, 25 bp, Rattus norvegicus
ctcaagactggttgcagctgcggga

SEQ ID NO: 498011 - DNA, 25 bp, Rattus norvegicus
ttggctcaagactggttgcagctgc

SEQ ID NO: 498012 - DNA, 25 bp, Rattus norvegicus
agcatctccagctgcatcggaggaa

SEQ ID NO: 498013 - DNA, 25 bp, Rattus norvegicus
tccgtgccacgtcggatttggctca

SEQ ID NO: 498014 - DNA, 25 bp, Rattus norvegicus
gaaagaagcgccagcgtgctccgtg

SEQ ID NO: 498015 - DNA, 25 bp, Rattus norvegicus
tgcatcggaggaaagaagcgccagc

SEQ ID NO: 498016 - DNA, 25 bp, Rattus norvegicus
cggatttggctcaagactggttgca

SEQ ID NO: 498017 - DNA, 25 bp, Rattus norvegicus
cagcgtgctccgtgccacgtcggat

SEQ ID NO: 498018 - DNA, 25 bp, Rattus norvegicus
agccggcctgcgttgcctttgcgca

SEQ ID NO: 498019 - DNA, 25 bp, Rattus norvegicus
ttgcggtgcattgaaactccggctg

SEQ ID NO: 498020 - DNA, 25 bp, Rattus norvegicus
tgcattgaaactccggctgggacta

SEQ ID NO: 498021 - DNA, 25 bp, Rattus norvegicus
gagcttcgaggagtccactaccgcg

SEQ ID NO: 498022 - DNA, 25 bp, Rattus norvegicus
tgtgacacagagcaaccagggtgcc

SEQ ID NO: 498023 - DNA, 25 bp, Rattus norvegicus
gcaccgtctggctgcttcgctgcgg

SEQ ID NO: 498024 - DNA, 25 bp, Rattus norvegicus
tagccgccggtctctctgcggaggt

SEQ ID NO: 498025 - DNA, 25 bp, Rattus norvegicus
ctttgcgcaccctggtggctccttg

SEQ ID NO: 498026 - DNA, 25 bp, Rattus norvegicus
gcgctgctgagtgtgacacagagca

SEQ ID NO: 498027 - DNA, 25 bp, Rattus norvegicus
cgcgctgttgccacaggtgagtagt

SEQ ID NO: 498028 - DNA, 25 bp, Rattus norvegicus
gccatctgcattcggccgcgctgtt

SEQ ID NO: 498029 - DNA, 25 bp, Rattus norvegicus
gctttctttggccatctgcattcgg

SEQ ID NO: 498030 - DNA, 25 bp, Rattus norvegicus
ccctcagctgagttggtagccgccg

SEQ ID NO: 498031 - DNA, 25 bp, Rattus norvegicus
ccagggtgcctgctttctttggcca

SEQ ID NO: 498032 - DNA, 25 bp, Rattus norvegicus
tagctggcgcagagcaagccctagc

SEQ ID NO: 498033 - DNA, 25 bp, Rattus norvegicus
aaacgcaggcagagcccaaggcgcg

SEQ ID NO: 498034 - DNA, 25 bp, Rattus norvegicus
tagcgccctgccgtcttacggtccg

SEQ ID NO: 498035 - DNA, 25 bp, Rattus norvegicus
ttacggtccgccactccacgtggtg

SEQ ID NO: 498036 - DNA, 25 bp, Rattus norvegicus
ccactccacgtggtgaggatcaaca

SEQ ID NO: 498037 - DNA, 25 bp, Rattus norvegicus
ccacgtggtgaggatcaacagtttg

SEQ ID NO: 498038 - DNA, 25 bp, Rattus norvegicus
gaggatcaacagtttgttgagctca

SEQ ID NO: 498039 - DNA, 25 bp, Rattus norvegicus
tcagtgacaccttgaacttttcata

SEQ ID NO: 498040 - DNA, 25 bp, Rattus norvegicus
tcataaagaaaatgggtattgcacc

SEQ ID NO: 498041 - DNA, 25 bp, Rattus norvegicus
tattgcaccgagagggtttggccgt

SEQ ID NO: 498042 - DNA, 25 bp, Rattus norvegicus
gggtcgtgctcaagattcagggatc

SEQ ID NO: 498043 - DNA, 25 bp, Rattus norvegicus
tcaagattcagggatctcgattgcg

SEQ ID NO: 498044 - DNA, 25 bp, Rattus norvegicus
gttgagctcatcagtgacaccttga

SEQ ID NO: 498045 - DNA, 25 bp, Rattus norvegicus
cgggcgaaaacgcaggcagagccca

SEQ ID NO: 498046 - DNA, 25 bp, Rattus norvegicus
cgctttgtgcgaaacgggcaggtcc

SEQ ID NO: 498047 - DNA, 25 bp, Rattus norvegicus
aagcatgacgccgtgttgaggctgc

SEQ ID NO: 498048 - DNA, 25 bp, Rattus norvegicus
cctggtgacgattcgccgtaatgtg

SEQ ID NO: 498049 - DNA, 25 bp, Rattus norvegicus
cgtctcggcgcttttcggcagcctg

SEQ ID NO: 498050 - DNA, 25 bp, Rattus norvegicus
ttcttggccaaactgcggcgctttg

SEQ ID NO: 498051 - DNA, 25 bp, Rattus norvegicus
agggcgttacgtagacccgactctg

SEQ ID NO: 498052 - DNA, 25 bp, Rattus norvegicus
tccgctttcgacagggcgttacgta

SEQ ID NO: 498053 - DNA, 25 bp, Rattus norvegicus
aaaaatatggcgtccgctttcgaca

SEQ ID NO: 498054 - DNA, 25 bp, Rattus norvegicus
gtctacgtttccctatgtcgacata

SEQ ID NO: 498055 - DNA, 25 bp, Rattus norvegicus
tttggataaatggaagccagaccga

SEQ ID NO: 498056 - DNA, 25 bp, Rattus norvegicus
agctcccgaaaatgtgttgttaatg

SEQ ID NO: 498057 - DNA, 25 bp, Rattus norvegicus
ttccattttggaacgcccgtgcctc

SEQ ID NO: 498058 - DNA, 25 bp, Rattus norvegicus
tgttgaggctgcctctcctcgcgtc

SEQ ID NO: 498059 - DNA, 25 bp, Rattus norvegicus
ctgctctcctctcctggtgacgatt

SEQ ID NO: 498060 - DNA, 25 bp, Rattus norvegicus
tctcgacatcctggggtggggccaa

SEQ ID NO: 498061 - DNA, 25 bp, Rattus norvegicus
aggtagcgatcacaagagaaacttc

SEQ ID NO: 498062 - DNA, 25 bp, Rattus norvegicus
agaggcgggacgacgacgccttcac

SEQ ID NO: 498063 - DNA, 25 bp, Rattus norvegicus
tacccggtctcgacatcctggggtg

SEQ ID NO: 498064 - DNA, 25 bp, Rattus norvegicus
ggctgtagtctctactgcccaacgc

SEQ ID NO: 498065 - DNA, 25 bp, Rattus norvegicus
ctgtcttttgaagcgccgtacccgg

SEQ ID NO: 498066 - DNA, 25 bp, Rattus norvegicus
aagggccagagctgtcttttgaagc

SEQ ID NO: 498067 - DNA, 25 bp, Rattus norvegicus
ttgaagcgccgtacccggtctcgac

SEQ ID NO: 498068 - DNA, 25 bp, Rattus norvegicus
cttccggtggccacgggccacgtga

SEQ ID NO: 498069 - DNA, 25 bp, Rattus norvegicus
tcggacgagctaggtagcgatcaca

SEQ ID NO: 498070 - DNA, 25 bp, Rattus norvegicus
ggcgccaccgaattcggacgagcta

SEQ ID NO: 498071 - DNA, 25 bp, Rattus norvegicus
atggccgggatgctcctgaaccagt

SEQ ID NO: 498072 - DNA, 25 bp, Rattus norvegicus
cgccagctactacctggaagcgata

SEQ ID NO: 498073 - DNA, 25 bp, Rattus norvegicus
cacgggccacgtgaccagaagtgcc

SEQ ID NO: 498074 - DNA, 25 bp, Rattus norvegicus
gttggtcgtttccattatcctgagc

SEQ ID NO: 498075 - DNA, 25 bp, Rattus norvegicus
atcgccagccactcacaacgggtga

SEQ ID NO: 498076 - DNA, 25 bp, Rattus norvegicus
gcaagatatggcaccgcaagccatc

SEQ ID NO: 498077 - DNA, 25 bp, Rattus norvegicus
gcaacaaggagagcggcaagatatg

SEQ ID NO: 498078 - DNA, 25 bp, Rattus norvegicus
cagagcactaacctgggcaacaagg

SEQ ID NO: 498079 - DNA, 25 bp, Rattus norvegicus
ggggattcgacatgcagagcactaa

SEQ ID NO: 498080 - DNA, 25 bp, Rattus norvegicus
atcgggtcagctgtagtccagagtc

SEQ ID NO: 498081 - DNA, 25 bp, Rattus norvegicus
gccgctcgaatttcccgggttgtgc

SEQ ID NO: 498082 - DNA, 25 bp, Rattus norvegicus
cccgcgtaattggtacagtccttgg

SEQ ID NO: 498083 - DNA, 25 bp, Rattus norvegicus
tggttgtagctagaaagggcgtccc

SEQ ID NO: 498084 - DNA, 25 bp, Rattus norvegicus
tccgaattctgattggttgtagcta

SEQ ID NO: 498085 - DNA, 25 bp, Rattus norvegicus
cggagtgggctgatccgaattctga

SEQ ID NO: 498086 - DNA, 25 bp, Rattus norvegicus
tatcctgagcggagggatagcccga

SEQ ID NO: 498087 - DNA, 25 bp, Rattus norvegicus
gcctggggattctgactctggccgt

SEQ ID NO: 498088 - DNA, 25 bp, Rattus norvegicus
ggcaagaggacagccgtctcacctg

SEQ ID NO: 498089 - DNA, 25 bp, Rattus norvegicus
ctcgcagagcttggcgccataggag

SEQ ID NO: 498090 - DNA, 25 bp, Rattus norvegicus
tccggcttctgctcgaacaccgaat

SEQ ID NO: 498091 - DNA, 25 bp, Rattus norvegicus
tctccatcgcgcgagcgtgaaaccg

SEQ ID NO: 498092 - DNA, 25 bp, Rattus norvegicus
tcagcggctgcgcaaactggatttc

SEQ ID NO: 498093 - DNA, 25 bp, Rattus norvegicus
gcctcgaaacgaggctatgcctaga

SEQ ID NO: 498094 - DNA, 25 bp, Rattus norvegicus
ctgcaggagagacaaccggaggctc

SEQ ID NO: 498095 - DNA, 25 bp, Rattus norvegicus
tggcttgctagcctcagactgcagg

SEQ ID NO: 498096 - DNA, 25 bp, Rattus norvegicus
gctatgcctagagcgacgcccatca

SEQ ID NO: 498097 - DNA, 25 bp, Rattus norvegicus
cagccaggcaccgagactaagtaga

SEQ ID NO: 498098 - DNA, 25 bp, Rattus norvegicus
actaagtagagtctagagcggcacc

SEQ ID NO: 498099 - DNA, 25 bp, Rattus norvegicus
gcgaccaacacggaagcggtgcgtt

SEQ ID NO: 498100 - DNA, 25 bp, Rattus norvegicus
gttgtctgccggagcgttgcattct

SEQ ID NO: 498101 - DNA, 25 bp, Rattus norvegicus
ctggaaagtgacagtggcggacctt

SEQ ID NO: 498102 - DNA, 25 bp, Rattus norvegicus
ttagcccgcttccacctaggtctgt

SEQ ID NO: 498103 - DNA, 25 bp, Rattus norvegicus
cggtgctgcgtcttgtttggaattt

SEQ ID NO: 498104 - DNA, 25 bp, Rattus norvegicus
gacgtcgttcttccttctgtagttc

SEQ ID NO: 498105 - DNA, 25 bp, Rattus norvegicus
ctagcaggaattagcgacgtcgttc

SEQ ID NO: 498106 - DNA, 25 bp, Rattus norvegicus
ggaacctctgccgaagcgaactgga

SEQ ID NO: 498107 - DNA, 25 bp, Rattus norvegicus
gccttagcgtaagcgcgccgaatcc

SEQ ID NO: 498108 - DNA, 25 bp, Rattus norvegicus
ctccgctttgggcacagtagatttc

SEQ ID NO: 498109 - DNA, 25 bp, Rattus norvegicus
agaggtggcgaccaactgcttagcc

SEQ ID NO: 498110 - DNA, 25 bp, Rattus norvegicus
ggctcttggtttcctcttgcgtaga

SEQ ID NO: 498111 - DNA, 25 bp, Rattus norvegicus
ggctcagccctacgcagcatttcgg

SEQ ID NO: 498112 - DNA, 25 bp, Rattus norvegicus
atgttcgtgtgcatgcgctcaagta

SEQ ID NO: 498113 - DNA, 25 bp, Rattus norvegicus
gaactcttgagttactgtgcccgca

SEQ ID NO: 498114 - DNA, 25 bp, Rattus norvegicus
ggccgcaaatggaggtcagtgaact

SEQ ID NO: 498115 - DNA, 25 bp, Rattus norvegicus
atcgtgtcccgcttcaaaagccgga

SEQ ID NO: 498116 - DNA, 25 bp, Rattus norvegicus
ttgtttagttgttctgtgagccaca

SEQ ID NO: 498117 - DNA, 25 bp, Rattus norvegicus
acgcatgtgtctacagcagctgcta

SEQ ID NO: 498118 - DNA, 25 bp, Rattus norvegicus
tggcaacaattgtggctagcgggtt

SEQ ID NO: 498119 - DNA, 25 bp, Rattus norvegicus
tccggaaccacgcagtcttcgtcgt

SEQ ID NO: 498120 - DNA, 25 bp, Rattus norvegicus
ggcaggcccacactgcccgggtttg

SEQ ID NO: 498121 - DNA, 25 bp, Rattus norvegicus
tacagcagctgctattggtgaggga

SEQ ID NO: 498122 - DNA, 25 bp, Rattus norvegicus
ccctacgcgggacgcatgtgtctac

SEQ ID NO: 498123 - DNA, 25 bp, Rattus norvegicus
gtgagccacagtttcgggtcatgga

SEQ ID NO: 498124 - DNA, 25 bp, Rattus norvegicus
tggctagcgggttgtttagttgttc

SEQ ID NO: 498125 - DNA, 25 bp, Rattus norvegicus
tccgcttgggagattggcaacaatt

SEQ ID NO: 498126 - DNA, 25 bp, Rattus norvegicus
ctgtcctctccgcttgggagattgg

SEQ ID NO: 498127 - DNA, 25 bp, Rattus norvegicus
tgtcctggcagtctacactcctgtc

SEQ ID NO: 498128 - DNA, 25 bp, Rattus norvegicus
cttctacccggaaactgtcctggca

SEQ ID NO: 498129 - DNA, 25 bp, Rattus norvegicus
gggaatctgcgcgtcttcgcgcgcc

SEQ ID NO: 498130 - DNA, 25 bp, Rattus norvegicus
cctgaccaaggaacggcatggtacc

SEQ ID NO: 498131 - DNA, 25 bp, Rattus norvegicus
cccgaggccacgtggctttgtttat

SEQ ID NO: 498132 - DNA, 25 bp, Rattus norvegicus
cccgtctctttgttgccggaagagc

SEQ ID NO: 498133 - DNA, 25 bp, Rattus norvegicus
cgcagtatttatcccgggccgctgc

SEQ ID NO: 498134 - DNA, 25 bp, Rattus norvegicus
gctgccggagcgcagtatttatccc

SEQ ID NO: 498135 - DNA, 25 bp, Rattus norvegicus
tcgcgtcctgacttcgggaatgctg

SEQ ID NO: 498136 - DNA, 25 bp, Rattus norvegicus
caactggaacaagagtcggggaact

SEQ ID NO: 498137 - DNA, 25 bp, Rattus norvegicus
ccgctctgggaagacgctagggaac

SEQ ID NO: 498138 - DNA, 25 bp, Rattus norvegicus
acgcgaccgacggataggacggatc

SEQ ID NO: 498139 - DNA, 25 bp, Rattus norvegicus
tgtttatgggctcgccttgttttcc

SEQ ID NO: 498140 - DNA, 25 bp, Rattus norvegicus
gggaccgccagtcctgaccaaggaa

SEQ ID NO: 498141 - DNA, 25 bp, Rattus norvegicus
tttctcatccaagaagcgcttccag

SEQ ID NO: 498142 - DNA, 25 bp, Rattus norvegicus
taggacggatcgacagccaggaacc

SEQ ID NO: 498143 - DNA, 25 bp, Rattus norvegicus
gctcacgaaggtgccgcttttctca

SEQ ID NO: 498144 - DNA, 25 bp, Rattus norvegicus
gcggtgcagatcagagcctctgtta

SEQ ID NO: 498145 - DNA, 25 bp, Rattus norvegicus
tgccaactaacgtgaaacaggtatg

SEQ ID NO: 498146 - DNA, 25 bp, Rattus norvegicus
gccgctagcgactctaggtcaatgg

SEQ ID NO: 498147 - DNA, 25 bp, Rattus norvegicus
cactcgagttctccgggaccttgtt

SEQ ID NO: 498148 - DNA, 25 bp, Rattus norvegicus
ggttcttccattagcagcgtttttg

SEQ ID NO: 498149 - DNA, 25 bp, Rattus norvegicus
tttgctaagacaaccgaccgccgtg

SEQ ID NO: 498150 - DNA, 25 bp, Rattus norvegicus
ctggggacacatattcgggaaactg

SEQ ID NO: 498151 - DNA, 25 bp, Rattus norvegicus
ctgttacacgcaggcgcaactaacc

SEQ ID NO: 498152 - DNA, 25 bp, Rattus norvegicus
agtgacgtcggcaaagagccatttc

SEQ ID NO: 498153 - DNA, 25 bp, Rattus norvegicus
ttccggcaggccgaaactaggaaga

SEQ ID NO: 498154 - DNA, 25 bp, Rattus norvegicus
tgggctccggcatcatgaacatcga

SEQ ID NO: 498155 - DNA, 25 bp, Rattus norvegicus
gttgagttccacatccggcacatta

SEQ ID NO: 498156 - DNA, 25 bp, Rattus norvegicus
tttagccgcctgtccagagccactg

SEQ ID NO: 498157 - DNA, 25 bp, Rattus norvegicus
cggcacattatccttggagcaagtt

SEQ ID NO: 498158 - DNA, 25 bp, Rattus norvegicus
agcaattcccgaagcgcctctagct

SEQ ID NO: 498159 - DNA, 25 bp, Rattus norvegicus
gcctccgtggccttcgaacaattgg

SEQ ID NO: 498160 - DNA, 25 bp, Rattus norvegicus
atagccgtgtcctgcgctccagtgc

SEQ ID NO: 498161 - DNA, 25 bp, Rattus norvegicus
gctctcgtgggctccatagccgtgt

SEQ ID NO: 498162 - DNA, 25 bp, Rattus norvegicus
ccgtagtatctaacacagtggcctg

SEQ ID NO: 498163 - DNA, 25 bp, Rattus norvegicus
cgttggtctcggcttccgtagtatc

SEQ ID NO: 498164 - DNA, 25 bp, Rattus norvegicus
gtagcgcctcctccagagcacggat

SEQ ID NO: 498165 - DNA, 25 bp, Rattus norvegicus
agccgtggccgtggccagcaattcc

SEQ ID NO: 498166 - DNA, 25 bp, Rattus norvegicus
aggcggctagttgttggcgcaactc

SEQ ID NO: 498167 - DNA, 25 bp, Rattus norvegicus
agctcctcacgagcagcgtcctggg

SEQ ID NO: 498168 - DNA, 25 bp, Rattus norvegicus
gctcgtgctcgtccgcaggaaccga

SEQ ID NO: 498169 - DNA, 25 bp, Rattus norvegicus
ctgcgctagtcttctcgtgcctgcg

SEQ ID NO: 498170 - DNA, 25 bp, Rattus norvegicus
gctcacctggaagacctctgcgcta

SEQ ID NO: 498171 - DNA, 25 bp, Rattus norvegicus
agaatcgcagcgcagtggtcctctg

SEQ ID NO: 498172 - DNA, 25 bp, Rattus norvegicus
gcaccgaggcctgatcgcgtcactt

SEQ ID NO: 498173 - DNA, 25 bp, Rattus norvegicus
gccttcctgcggactgcgcgtgcgt

SEQ ID NO: 498174 - DNA, 25 bp, Rattus norvegicus
atgcaagttagcaacctccgccttc

SEQ ID NO: 498175 - DNA, 25 bp, Rattus norvegicus
tcccacgtgatgcaagttagcaacc

SEQ ID NO: 498176 - DNA, 25 bp, Rattus norvegicus
tctttcgaaggcctggcgatcgtcc

SEQ ID NO: 498177 - DNA, 25 bp, Rattus norvegicus
tgatcgcgtcacttgctcggaagcc

SEQ ID NO: 498178 - DNA, 25 bp, Rattus norvegicus
tggcgatcgtccagtgcccgccttg

SEQ ID NO: 498179 - DNA, 25 bp, Rattus norvegicus
ggctgtgtccttcggccggcaccga

SEQ ID NO: 498180 - DNA, 25 bp, Rattus norvegicus
aagatggctgcctgggtaccttgtc

SEQ ID NO: 498181 - DNA, 25 bp, Rattus norvegicus
accgcgcgaccggtgcacgtctgta

SEQ ID NO: 498182 - DNA, 25 bp, Rattus norvegicus
cgggagaaacaaatcccacgtgatg

SEQ ID NO: 498183 - DNA, 25 bp, Rattus norvegicus
cgcatgcgtctcctcgggagaaaca

SEQ ID NO: 498184 - DNA, 25 bp, Rattus norvegicus
agacagcacccttgcgcatgcgtct

SEQ ID NO: 498185 - DNA, 25 bp, Rattus norvegicus
catggtggctctcaggttagtgtag

SEQ ID NO: 498186 - DNA, 25 bp, Rattus norvegicus
ccgagactgtcaggccttagctgca

SEQ ID NO: 498187 - DNA, 25 bp, Rattus norvegicus
ccactcccttgcgtggcaaggaaac

SEQ ID NO: 498188 - DNA, 25 bp, Rattus norvegicus
cgcctgtgttaagtgcacagcaaga

SEQ ID NO: 498189 - DNA, 25 bp, Rattus norvegicus
tcagtaggattgctgcgccctcaaa

SEQ ID NO: 498190 - DNA, 25 bp, Rattus norvegicus
cctgtcagacggcatccgcctgtgt

SEQ ID NO: 498191 - DNA, 25 bp, Rattus norvegicus
agctcggcgagcgagtctgatcttc

SEQ ID NO: 498192 - DNA, 25 bp, Rattus norvegicus
aggaaaactttctgtgccgcggccg

SEQ ID NO: 498193 - DNA, 25 bp, Rattus norvegicus
cgcaggccgtgagcccaggaaaact

SEQ ID NO: 498194 - DNA, 25 bp, Rattus norvegicus
aagagttcagggttggatgcccacc

SEQ ID NO: 498195 - DNA, 25 bp, Rattus norvegicus
atcttccagagggatgagtcaccgc

SEQ ID NO: 498196 - DNA, 25 bp, Rattus norvegicus
actacgccggcgcatagcagctcgg

SEQ ID NO: 498197 - DNA, 25 bp, Rattus norvegicus
cctaaatctggagctcggacgaccc

SEQ ID NO: 498198 - DNA, 25 bp, Rattus norvegicus
tggtggtacagctgccgcactgttt

SEQ ID NO: 498199 - DNA, 25 bp, Rattus norvegicus
cactgtttccgcgacgtcgtcctaa

SEQ ID NO: 498200 - DNA, 25 bp, Rattus norvegicus
cagcgggcggttttctctgcaccaa

SEQ ID NO: 498201 - DNA, 25 bp, Rattus norvegicus
agcaaccagccgaccttgcacgagg

SEQ ID NO: 498202 - DNA, 25 bp, Rattus norvegicus
agcgctgcttcactagctgccattg

SEQ ID NO: 498203 - DNA, 25 bp, Rattus norvegicus
tgctgctgccctatttcgttctctc

SEQ ID NO: 498204 - DNA, 25 bp, Rattus norvegicus
ctgcaccaagatgggctttgccgtt

SEQ ID NO: 498205 - DNA, 25 bp, Rattus norvegicus
atcagcgacatgaaggtaggacgcc

SEQ ID NO: 498206 - DNA, 25 bp, Rattus norvegicus
cgtggtggcttgattgtcagtcttc

SEQ ID NO: 498207 - DNA, 25 bp, Rattus norvegicus
ttttgaggccaggagccgaacactg

SEQ ID NO: 498208 - DNA, 25 bp, Rattus norvegicus
gaacactgcacgtaggcgactcgcc

SEQ ID NO: 498209 - DNA, 25 bp, Rattus norvegicus
gagcaccgcgtgctctctgcaaaac

SEQ ID NO: 498210 - DNA, 25 bp, Rattus norvegicus
tgatcgagaaggaatgcagcgcgct

SEQ ID NO: 498211 - DNA, 25 bp, Rattus norvegicus
ggaggcctcttccagaccatcatca

SEQ ID NO: 498212 - DNA, 25 bp, Rattus norvegicus
ttgccgtttccgtcatgggcacccg

SEQ ID NO: 498213 - DNA, 25 bp, Rattus norvegicus
tgcgagcaacagatccgggcgacgc

SEQ ID NO: 498214 - DNA, 25 bp, Rattus norvegicus
tcgccacgggatggcctgaatgtac

SEQ ID NO: 498215 - DNA, 25 bp, Rattus norvegicus
tcattcatcgccacgggatggcctg

SEQ ID NO: 498216 - DNA, 25 bp, Rattus norvegicus
cggaccgtcattcatcgccacggga

SEQ ID NO: 498217 - DNA, 25 bp, Rattus norvegicus
caagcgcggccggaccgtcattcat

SEQ ID NO: 498218 - DNA, 25 bp, Rattus norvegicus
tacctgctttgcgagccgtgttctc

SEQ ID NO: 498219 - DNA, 25 bp, Rattus norvegicus
aaggttcctgacaagcgcggccgga

SEQ ID NO: 498220 - DNA, 25 bp, Rattus norvegicus
caggcgctgggaaggttcctgacaa

SEQ ID NO: 498221 - DNA, 25 bp, Rattus norvegicus
tatatattagctcccaggcgctggg

SEQ ID NO: 498222 - DNA, 25 bp, Rattus norvegicus
gctatatattagctcccaggcgctg

SEQ ID NO: 498223 - DNA, 25 bp, Rattus norvegicus
gaatgtacctgctttgcgagccgtg

SEQ ID NO: 498224 - DNA, 25 bp, Rattus norvegicus
cccggagccttgctatatattagct

SEQ ID NO: 498225 - DNA, 25 bp, Rattus norvegicus
tggcctgaatgtacctgctttgcga

SEQ ID NO: 498226 - DNA, 25 bp, Rattus norvegicus
agcacctccgcggtctggcccgacc

SEQ ID NO: 498227 - DNA, 25 bp, Rattus norvegicus
cgggatggcctgaatgtacctgctt

SEQ ID NO: 498228 - DNA, 25 bp, Rattus norvegicus
ggacgctcatccgagacagccattc

SEQ ID NO: 498229 - DNA, 25 bp, Rattus norvegicus
gccgggttaagtctgaggtcctcaa

SEQ ID NO: 498230 - DNA, 25 bp, Rattus norvegicus
gcgccgcgctctgaaggacgctcat

SEQ ID NO: 498231 - DNA, 25 bp, Rattus norvegicus
tactctggttactgtccgcgaggga

SEQ ID NO: 498232 - DNA, 25 bp, Rattus norvegicus
gcgcgcagcggttactctggttact

SEQ ID NO: 498233 - DNA, 25 bp, Rattus norvegicus
cctagcagctgaaacgcgaggggcc

SEQ ID NO: 498234 - DNA, 25 bp, Rattus norvegicus
cgctctcattggctcggagcggcga

SEQ ID NO: 498235 - DNA, 25 bp, Rattus norvegicus
ggacaaacgttctatagcgccatct

SEQ ID NO: 498236 - DNA, 25 bp, Rattus norvegicus
cgtgcacttccagtccgccgggatg

SEQ ID NO: 498237 - DNA, 25 bp, Rattus norvegicus
ggaatacgccgcctaccattggaca

SEQ ID NO: 498238 - DNA, 25 bp, Rattus norvegicus
ggtcctcaaggccaccaaggaactc

SEQ ID NO: 498239 - DNA, 25 bp, Rattus norvegicus
gacagccattcatccttaaagaagg

SEQ ID NO: 498240 - DNA, 25 bp, Rattus norvegicus
taattacgtcaggttcgcccgcctg

SEQ ID NO: 498241 - DNA, 25 bp, Rattus norvegicus
agaactgagcttccaggctccggcc

SEQ ID NO: 498242 - DNA, 25 bp, Rattus norvegicus
catgtgatcgttcgcgggcgctaaa

SEQ ID NO: 498243 - DNA, 25 bp, Rattus norvegicus
gtgtgcgacgttcggcaagatatcg

SEQ ID NO: 498244 - DNA, 25 bp, Rattus norvegicus
ccactggagaagtaggctgaggaaa

SEQ ID NO: 498245 - DNA, 25 bp, Rattus norvegicus
gggcgtttcagccactggagaagta

SEQ ID NO: 498246 - DNA, 25 bp, Rattus norvegicus
cggtccgatgctggccgcgtaaact

SEQ ID NO: 498247 - DNA, 25 bp, Rattus norvegicus
ttcgcgggcgctaaatgatgacgca

SEQ ID NO: 498248 - DNA, 25 bp, Rattus norvegicus
gctaaatgatgacgcagagcgcgcg

SEQ ID NO: 498249 - DNA, 25 bp, Rattus norvegicus
ccgggcccgagcatcatgtgatcgt

SEQ ID NO: 498250 - DNA, 25 bp, Rattus norvegicus
cctggtttctgtcctggttcccagc

SEQ ID NO: 498251 - DNA, 25 bp, Rattus norvegicus
tgcagagagtcagcttcccggaccc

SEQ ID NO: 498252 - DNA, 25 bp, Rattus norvegicus
ctagagtcccgggttgcagagagtc

SEQ ID NO: 498253 - DNA, 25 bp, Rattus norvegicus
cctctcgcgctccagagatctccta

SEQ ID NO: 498254 - DNA, 25 bp, Rattus norvegicus
ctggccgcgtaaactggacacccgg

SEQ ID NO: 498255 - DNA, 25 bp, Rattus norvegicus
tccgactcacctgccagcggtccga

SEQ ID NO: 498256 - DNA, 25 bp, Rattus norvegicus
gtgaagccaacgagcctgcggaatc

SEQ ID NO: 498257 - DNA, 25 bp, Rattus norvegicus
cggaatctgtcctccaggctcagca

SEQ ID NO: 498258 - DNA, 25 bp, Rattus norvegicus
aagtgcgtttgctcggtgaagccaa

SEQ ID NO: 498259 - DNA, 25 bp, Rattus norvegicus
gctatccacggtctcggcaacaata

SEQ ID NO: 498260 - DNA, 25 bp, Rattus norvegicus
accggcttttactcaagactaattg

SEQ ID NO: 498261 - DNA, 25 bp, Rattus norvegicus
tacaacatcagcgtcctggaactgc

SEQ ID NO: 498262 - DNA, 25 bp, Rattus norvegicus
ctcgggatccattgtgttgtgtgaa

SEQ ID NO: 498263 - DNA, 25 bp, Rattus norvegicus
gccagtgtggttctcgtgtacaaca

SEQ ID NO: 498264 - DNA, 25 bp, Rattus norvegicus
cggcgcggaaaagttgcaccggctt

SEQ ID NO: 498265 - DNA, 25 bp, Rattus norvegicus
ttcagtcactctctctaagcgcgtc

SEQ ID NO: 498266 - DNA, 25 bp, Rattus norvegicus
gtgcggcacacactcatattcagtc

SEQ ID NO: 498267 - DNA, 25 bp, Rattus norvegicus
gcgtgcaccaatccgcagtcgtttc

SEQ ID NO: 498268 - DNA, 25 bp, Rattus norvegicus
ccaccagggtaaaggcgtgaccgct

SEQ ID NO: 498269 - DNA, 25 bp, Rattus norvegicus
caactgtttacacagcccgggctgt

SEQ ID NO: 498270 - DNA, 25 bp, Rattus norvegicus
gcatctgggtttccaacaactcacc

SEQ ID NO: 498271 - DNA, 25 bp, Rattus norvegicus
ggctctcccggagagcgcctagccg

SEQ ID NO: 498272 - DNA, 25 bp, Rattus norvegicus
gtccacccgcgtgaaatctcagacg

SEQ ID NO: 498273 - DNA, 25 bp, Rattus norvegicus
gtttgctgctgccacctactgtcca

SEQ ID NO: 498274 - DNA, 25 bp, Rattus norvegicus
gtggcatctgggtttccaacaactc

SEQ ID NO: 498275 - DNA, 25 bp, Rattus norvegicus
aaaagtggcatctgggtttccaaca

SEQ ID NO: 498276 - DNA, 25 bp, Rattus norvegicus
ttcttctggagttaaaagtggcatc

SEQ ID NO: 498277 - DNA, 25 bp, Rattus norvegicus
caccgactcctttcattcttctgga

SEQ ID NO: 498278 - DNA, 25 bp, Rattus norvegicus
gacatcctgtctccgggccacggag

SEQ ID NO: 498279 - DNA, 25 bp, Rattus norvegicus
agtcggacatcctgtctccgggcca

SEQ ID NO: 498280 - DNA, 25 bp, Rattus norvegicus
ctttgtgagtcggacatcctgtctc

SEQ ID NO: 498281 - DNA, 25 bp, Rattus norvegicus
tctgcgctttgtgagtcggacatcc

SEQ ID NO: 498282 - DNA, 25 bp, Rattus norvegicus
aggacggctgcgcagtctgcgcttt

SEQ ID NO: 498283 - DNA, 25 bp, Rattus norvegicus
ctgtccacccgcgtgaaatctcaga

SEQ ID NO: 498284 - DNA, 25 bp, Rattus norvegicus
ttcaagaggagaaagcgaaaccacc

SEQ ID NO: 498285 - DNA, 25 bp, Rattus norvegicus
gttcggattacctgcgccgactctc

SEQ ID NO: 498286 - DNA, 25 bp, Rattus norvegicus
catcagagtcattggcactggtccc

SEQ ID NO: 498287 - DNA, 25 bp, Rattus norvegicus
ggggctaaagccacctgttggaaga

SEQ ID NO: 498288 - DNA, 25 bp, Rattus norvegicus
ggtgttcgtaggtgccactccagaa

SEQ ID NO: 498289 - DNA, 25 bp, Rattus norvegicus
cacctctagggtcatgatcacggga

SEQ ID NO: 498290 - DNA, 25 bp, Rattus norvegicus
gatcacgggagacatggccactttc

SEQ ID NO: 498291 - DNA, 25 bp, Rattus norvegicus
ctctcccggagagctagaagcccta

SEQ ID NO: 498292 - DNA, 25 bp, Rattus norvegicus
gggacgcttgttcacaggacttcaa

SEQ ID NO: 498293 - DNA, 25 bp, Rattus norvegicus
ttacccattacgctggggacgcttg

SEQ ID NO: 498294 - DNA, 25 bp, Rattus norvegicus
taacttaggtgggtcagtttctcca

SEQ ID NO: 498295 - DNA, 25 bp, Rattus norvegicus
aggttccacatcctcgtcgtcattg

SEQ ID NO: 498296 - DNA, 25 bp, Rattus norvegicus
ccggcgcgaagcttttctgatagat

SEQ ID NO: 498297 - DNA, 25 bp, Rattus norvegicus
attctccggtgtataggtgctcagc

SEQ ID NO: 498298 - DNA, 25 bp, Rattus norvegicus
cggtgagtcttgatctgagctgttc

SEQ ID NO: 498299 - DNA, 25 bp, Rattus norvegicus
tctgacagcctgagaccaactcggg

SEQ ID NO: 498300 - DNA, 25 bp, Rattus norvegicus
tgcaaccggtccctgatccttttaa

SEQ ID NO: 498301 - DNA, 25 bp, Rattus norvegicus
acttggtgttggactagcgcactga

SEQ ID NO: 498302 - DNA, 25 bp, Rattus norvegicus
ccggttggacattcttgctgtgcta

SEQ ID NO: 498303 - DNA, 25 bp, Rattus norvegicus
tcacattcctggttgggatccgcgg

SEQ ID NO: 498304 - DNA, 25 bp, Rattus norvegicus
ccagtctttgggagggcatttaaat

SEQ ID NO: 498305 - DNA, 25 bp, Rattus norvegicus
gtagcctctgacttcccagtctttg

SEQ ID NO: 498306 - DNA, 25 bp, Rattus norvegicus
ccgcaaaaagcgagaaggctccgta

SEQ ID NO: 498307 - DNA, 25 bp, Rattus norvegicus
agcccttcgtatcctgaggtctttg

SEQ ID NO: 498308 - DNA, 25 bp, Rattus norvegicus
ccggggtgcattttgaaactgtctt

SEQ ID NO: 498309 - DNA, 25 bp, Rattus norvegicus
tctcttcgcggtggccaaaggaagc

SEQ ID NO: 498310 - DNA, 25 bp, Rattus norvegicus
aaactgtcttccagaggttaccgtg

SEQ ID NO: 498311 - DNA, 25 bp, Rattus norvegicus
atttcggcttggtgcatttctgaca

SEQ ID NO: 498312 - DNA, 25 bp, Rattus norvegicus
gcgcttctttcagccgccggaggct

SEQ ID NO: 498313 - DNA, 25 bp, Rattus norvegicus
caaagcgtagcgtggtccgaggacc

SEQ ID NO: 498314 - DNA, 25 bp, Rattus norvegicus
tggtagcaaagacacgcaaaccctc

SEQ ID NO: 498315 - DNA, 25 bp, Rattus norvegicus
ccatagcggagcaccggggcagaaa

SEQ ID NO: 498316 - DNA, 25 bp, Rattus norvegicus
gcgaactcaagcactcggccgcgct

SEQ ID NO: 498317 - DNA, 25 bp, Rattus norvegicus
ccttaaaggggcagcaccttcgcgg

SEQ ID NO: 498318 - DNA, 25 bp, Rattus norvegicus
aaaccctccactggcgcagggtgtc

SEQ ID NO: 498319 - DNA, 25 bp, Rattus norvegicus
gccggaggctcctcacggcgctaga

SEQ ID NO: 498320 - DNA, 25 bp, Rattus norvegicus
gcaagagacccggatgtacagggta

SEQ ID NO: 498321 - DNA, 25 bp, Rattus norvegicus
ccgcgcgaccgctgcgcaaggtaaa

SEQ ID NO: 498322 - DNA, 25 bp, Rattus norvegicus
accgctgcgcaaggtaaagcctcga

SEQ ID NO: 498323 - DNA, 25 bp, Rattus norvegicus
caaggtaaagcctcgaccgtcctct

SEQ ID NO: 498324 - DNA, 25 bp, Rattus norvegicus
gccgcacaagaccacgccctccctt

SEQ ID NO: 498325 - DNA, 25 bp, Rattus norvegicus
gccggtcactcacccgccgcgaact

SEQ ID NO: 498326 - DNA, 25 bp, Rattus norvegicus
tgtcctcacttagggctggacatga

SEQ ID NO: 498327 - DNA, 25 bp, Rattus norvegicus
tcgtaaagctggaaaggttggagta

SEQ ID NO: 498328 - DNA, 25 bp, Rattus norvegicus
cggacgctcgtcctagatggaaacc

SEQ ID NO: 498329 - DNA, 25 bp, Rattus norvegicus
tcttggttcccagttgggccctctc

SEQ ID NO: 498330 - DNA, 25 bp, Rattus norvegicus
cgtgcttctcagactctcttggttc

SEQ ID NO: 498331 - DNA, 25 bp, Rattus norvegicus
ccagccactaagagggaccctgaga

SEQ ID NO: 498332 - DNA, 25 bp, Rattus norvegicus
ggtaagcccgtaatcccagccacta

SEQ ID NO: 498333 - DNA, 25 bp, Rattus norvegicus
tagcgacgaaacttaccaggaggta

SEQ ID NO: 498334 - DNA, 25 bp, Rattus norvegicus
acagcactttcagccctagcgacga

SEQ ID NO: 498335 - DNA, 25 bp, Rattus norvegicus
ctgcagcgcgtggacagcactttca

SEQ ID NO: 498336 - DNA, 25 bp, Rattus norvegicus
tcgtgtggcttcacagcgtcccgca

SEQ ID NO: 498337 - DNA, 25 bp, Rattus norvegicus
cgcgtggagtacattgcgccctggt

SEQ ID NO: 498338 - DNA, 25 bp, Rattus norvegicus
cctgccgcagcttgtgttagccatg

SEQ ID NO: 498339 - DNA, 25 bp, Rattus norvegicus
gggctgagccttccgaagacttata

SEQ ID NO: 498340 - DNA, 25 bp, Rattus norvegicus
gctgttcgttggagaaccgggtatc

SEQ ID NO: 498341 - DNA, 25 bp, Rattus norvegicus
gttgcggagataccctccacagtgg

SEQ ID NO: 498342 - DNA, 25 bp, Rattus norvegicus
tccacactaggagctgtagcgactg

SEQ ID NO: 498343 - DNA, 25 bp, Rattus norvegicus
actaggagctgtagcgactgcgtgt

SEQ ID NO: 498344 - DNA, 25 bp, Rattus norvegicus
gctgaatggtcgtgtccctgtgaca

SEQ ID NO: 498345 - DNA, 25 bp, Rattus norvegicus
tccctgtgacaggtgttgcggagat

SEQ ID NO: 498346 - DNA, 25 bp, Rattus norvegicus
cgcctcatccacactaggagctgta

SEQ ID NO: 498347 - DNA, 25 bp, Rattus norvegicus
tccacagtggaagagctcagacccg

SEQ ID NO: 498348 - DNA, 25 bp, Rattus norvegicus
agtggaagagctcagacccggagac

SEQ ID NO: 498349 - DNA, 25 bp, Rattus norvegicus
acccggagacgctggtgtcttactg

SEQ ID NO: 498350 - DNA, 25 bp, Rattus norvegicus
ccaagaggctgttcgttggagaacc

SEQ ID NO: 498351 - DNA, 25 bp, Rattus norvegicus
attagggctctgtaaggagtcacgg

SEQ ID NO: 498352 - DNA, 25 bp, Rattus norvegicus
aaaagcccaggaacgcgtgtccctg

SEQ ID NO: 498353 - DNA, 25 bp, Rattus norvegicus
ctgcggcccagagcaaggatgggca

SEQ ID NO: 498354 - DNA, 25 bp, Rattus norvegicus
tttattgttcccgtgcggcggcagt

SEQ ID NO: 498355 - DNA, 25 bp, Rattus norvegicus
agggcgcacgcgctctggaaagaat

SEQ ID NO: 498356 - DNA, 25 bp, Rattus norvegicus
cgcgctctggaaagaatgctgttta

SEQ ID NO: 498357 - DNA, 25 bp, Rattus norvegicus
gcggaagcggcctcaacaagggaaa

SEQ ID NO: 498358 - DNA, 25 bp, Rattus norvegicus
ccatacgcggataagggcaagtgcg

SEQ ID NO: 498359 - DNA, 25 bp, Rattus norvegicus
cagtgttggtgatgtcggtgaatta

SEQ ID NO: 498360 - DNA, 25 bp, Rattus norvegicus
ggtgatgtcggtgaattatgcagca

SEQ ID NO: 498361 - DNA, 25 bp, Rattus norvegicus
cggtgaattatgcagcagggttgtc

SEQ ID NO: 498362 - DNA, 25 bp, Rattus norvegicus
tatgcagcagggttgtcgccatacg

SEQ ID NO: 498363 - DNA, 25 bp, Rattus norvegicus
cagggttgtcgccatacgcggataa

SEQ ID NO: 498364 - DNA, 25 bp, Rattus norvegicus
tcgccatacgcggataagggcaagt

SEQ ID NO: 498365 - DNA, 25 bp, Rattus norvegicus
cgcggtgttcgggtcaccgaatgac

SEQ ID NO: 498366 - DNA, 25 bp, Rattus norvegicus
gcccgctgcatcagaagggcgcacg

SEQ ID NO: 498367 - DNA, 25 bp, Rattus norvegicus
cacgcccaggcacgtatttttccgg

SEQ ID NO: 498368 - DNA, 25 bp, Rattus norvegicus
tgcaacgctcacctagcctgcaaga

SEQ ID NO: 498369 - DNA, 25 bp, Rattus norvegicus
tccctcacctgggatgaggggtcga

SEQ ID NO: 498370 - DNA, 25 bp, Rattus norvegicus
ggaccctccctcacctgggatgagg

SEQ ID NO: 498371 - DNA, 25 bp, Rattus norvegicus
ccgcacaaaaggaggacgcggcgac

SEQ ID NO: 498372 - DNA, 25 bp, Rattus norvegicus
agcccggcgccgcacaaaaggagga

SEQ ID NO: 498373 - DNA, 25 bp, Rattus norvegicus
ggaagcgctgtttaccttcacagcc

SEQ ID NO: 498374 - DNA, 25 bp, Rattus norvegicus
gaagaggaagcgctgtttaccttca

SEQ ID NO: 498375 - DNA, 25 bp, Rattus norvegicus
aatcgctataaaaggaagaggcggc

SEQ ID NO: 498376 - DNA, 25 bp, Rattus norvegicus
cccggcgcgaccagaaatcgctata

SEQ ID NO: 498377 - DNA, 25 bp, Rattus norvegicus
ctgcggtgcacacacgccgcttccg

SEQ ID NO: 498378 - DNA, 25 bp, Rattus norvegicus
ctgcacgtacctggctgtccgacgg

SEQ ID NO: 498379 - DNA, 25 bp, Rattus norvegicus
cctccctgcagtcgggtggaccaag

SEQ ID NO: 498380 - DNA, 25 bp, Rattus norvegicus
agcctcggagtgctcggcgcctcag

SEQ ID NO: 498381 - DNA, 25 bp, Rattus norvegicus
acctagcctgcaagaggggtgtgcc

SEQ ID NO: 498382 - DNA, 25 bp, Rattus norvegicus
tcctgcagttgtgcagccgcgtggt

SEQ ID NO: 498383 - DNA, 25 bp, Rattus norvegicus
acggtgttcctgcagttgtgcagcc

SEQ ID NO: 498384 - DNA, 25 bp, Rattus norvegicus
cgagcgtttttgcaagagagggacc

SEQ ID NO: 498385 - DNA, 25 bp, Rattus norvegicus
gcgagttgtagtcctcggtggtctc

SEQ ID NO: 498386 - DNA, 25 bp, Rattus norvegicus
tcctcggtggtctcggcgatgaact

SEQ ID NO: 498387 - DNA, 25 bp, Rattus norvegicus
tcggcgatgaactcggacacggaga

SEQ ID NO: 498388 - DNA, 25 bp, Rattus norvegicus
tgaactcggacacggagatctggtc

SEQ ID NO: 498389 - DNA, 25 bp, Rattus norvegicus
gatctggtccggcatcctgccgcgg

SEQ ID NO: 498390 - DNA, 25 bp, Rattus norvegicus
gcccgcgctagtggctagtgcctgt

SEQ ID NO: 498391 - DNA, 25 bp, Rattus norvegicus
cccagagcggttacttcagcgagct

SEQ ID NO: 498392 - DNA, 25 bp, Rattus norvegicus
ttacttcagcgagctggttacgcga

SEQ ID NO: 498393 - DNA, 25 bp, Rattus norvegicus
agctggttacgcgagcgtttttgca

SEQ ID NO: 498394 - DNA, 25 bp, Rattus norvegicus
tttttagtcccgagtgggtgcagga

SEQ ID NO: 498395 - DNA, 25 bp, Rattus norvegicus
cctccagcagcgtgacggtgttcct

SEQ ID NO: 498396 - DNA, 25 bp, Rattus norvegicus
ctccgctgcgccagagacaatgcgg

SEQ ID NO: 498397 - DNA, 25 bp, Rattus norvegicus
gggccgctgggcattattccatcac

SEQ ID NO: 498398 - DNA, 25 bp, Rattus norvegicus
gccgcctcgccactcaccgggaccg

SEQ ID NO: 498399 - DNA, 25 bp, Rattus norvegicus
cacccggagcccacaggggtgtccg

SEQ ID NO: 498400 - DNA, 25 bp, Rattus norvegicus
tgctctgcgggcagacggggacacc

SEQ ID NO: 498401 - DNA, 25 bp, Rattus norvegicus
cgcggaacaggagaacgcgcgctcc

SEQ ID NO: 498402 - DNA, 25 bp, Rattus norvegicus
tcgcctccgcggaacaggagaacgc

SEQ ID NO: 498403 - DNA, 25 bp, Rattus norvegicus
ccggagtcgcctccgcggaacagga

SEQ ID NO: 498404 - DNA, 25 bp, Rattus norvegicus
cctgagctgggagccttgcgccctg

SEQ ID NO: 498405 - DNA, 25 bp, Rattus norvegicus
gccagagacaatgcggcggccaaag

SEQ ID NO: 498406 - DNA, 25 bp, Rattus norvegicus
tgggcattattccatcacgggcgcg

SEQ ID NO: 498407 - DNA, 25 bp, Rattus norvegicus
gccgaggggaactttcctccgctgc

SEQ ID NO: 498408 - DNA, 25 bp, Rattus norvegicus
attattccatcacgggcgcggcgag

SEQ ID NO: 498409 - DNA, 25 bp, Rattus norvegicus
gaaagcgccccagcggactccgaga

SEQ ID NO: 498410 - DNA, 25 bp, Rattus norvegicus
ggctgcaatcatcgcccttcggata

SEQ ID NO: 498411 - DNA, 25 bp, Rattus norvegicus
tgtccacgaaatcctcggcactctg

SEQ ID NO: 498412 - DNA, 25 bp, Rattus norvegicus
agcgtcttggcgcagtcttctctaa

SEQ ID NO: 498413 - DNA, 25 bp, Rattus norvegicus
cggataactccattgcgccggcatg

SEQ ID NO: 498414 - DNA, 25 bp, Rattus norvegicus
gtgtgctggatgaagctctctcttc

SEQ ID NO: 498415 - DNA, 25 bp, Rattus norvegicus
ctcttcggttccttcctggttgtgg

SEQ ID NO: 498416 - DNA, 25 bp, Rattus norvegicus
gcgcgagttctggactgatgcattc

SEQ ID NO: 498417 - DNA, 25 bp, Rattus norvegicus
ccagtctccgctacaggactaagtc

SEQ ID NO: 498418 - DNA, 25 bp, Rattus norvegicus
cgattctgatgggtcgcagcacaca

SEQ ID NO: 498419 - DNA, 25 bp, Rattus norvegicus
tcaagtcatagtgagcccgagagca

SEQ ID NO: 498420 - DNA, 25 bp, Rattus norvegicus
ctctttcctaggctgctcgattgca

SEQ ID NO: 498421 - DNA, 25 bp, Rattus norvegicus
aggcagtgcacatccgagagttcca

SEQ ID NO: 498422 - DNA, 25 bp, Rattus norvegicus
ggtatagagttcctcgctgccgcta

SEQ ID NO: 498423 - DNA, 25 bp, Rattus norvegicus
cccgccaatcagctccgttgggata

SEQ ID NO: 498424 - DNA, 25 bp, Rattus norvegicus
tcaggaagcgctggtccgccttgag

SEQ ID NO: 498425 - DNA, 25 bp, Rattus norvegicus
aagcccgggctggtcagcttgccgc

SEQ ID NO: 498426 - DNA, 25 bp, Rattus norvegicus
cgcggtaacggagaccagtgccacc

SEQ ID NO: 498427 - DNA, 25 bp, Rattus norvegicus
agcattacgggaactgacggcagcc

SEQ ID NO: 498428 - DNA, 25 bp, Rattus norvegicus
ccagggaaacttaagggagagcatt

SEQ ID NO: 498429 - DNA, 25 bp, Rattus norvegicus
ctctgtgcacctccagggaaactta

SEQ ID NO: 498430 - DNA, 25 bp, Rattus norvegicus
ttccagcggcaacgcgctgacgtca

SEQ ID NO: 498431 - DNA, 25 bp, Rattus norvegicus
ccgccttgagttagtttcgcttaga

SEQ ID NO: 498432 - DNA, 25 bp, Rattus norvegicus
ggtcgccatgcctacccgtgagtgt

SEQ ID NO: 498433 - DNA, 25 bp, Rattus norvegicus
ttccgcagtcatgctgtggtcgacg

SEQ ID NO: 498434 - DNA, 25 bp, Rattus norvegicus
agcgtccgctcgctcggctattcgt

SEQ ID NO: 498435 - DNA, 25 bp, Rattus norvegicus
tagctgtacccggtcagcgtccgct

SEQ ID NO: 498436 - DNA, 25 bp, Rattus norvegicus
tgggtcggcccaacgcgtcgtcgac

SEQ ID NO: 498437 - DNA, 25 bp, Rattus norvegicus
ttagacttaagcgtcccatgggccg

SEQ ID NO: 498438 - DNA, 25 bp, Rattus norvegicus
cagcagggtcccgtctttgtcggct

SEQ ID NO: 498439 - DNA, 25 bp, Rattus norvegicus
tcaaagtttggatgcgcctgtactt

SEQ ID NO: 498440 - DNA, 25 bp, Rattus norvegicus
cgcagtttatttacaagccctgtgc

SEQ ID NO: 498441 - DNA, 25 bp, Rattus norvegicus
cctgtacttggcgttgttcctctta

SEQ ID NO: 498442 - DNA, 25 bp, Rattus norvegicus
gtctttgccaggagcccgatgccct

SEQ ID NO: 498443 - DNA, 25 bp, Rattus norvegicus
tccctagcgccaaggtgacttgctc

SEQ ID NO: 498444 - DNA, 25 bp, Rattus norvegicus
gtgacttgctccacgtctcctggcg

SEQ ID NO: 498445 - DNA, 25 bp, Rattus norvegicus
cagggcgtcatagatcaaagtttgg

SEQ ID NO: 498446 - DNA, 25 bp, Rattus norvegicus
tccgctgctgctccgggaagaagga

SEQ ID NO: 498447 - DNA, 25 bp, Rattus norvegicus
tccaatggcatgatgcgcaagttcc

SEQ ID NO: 498448 - DNA, 25 bp, Rattus norvegicus
tcaatgggtcacatcccgagcgggt

SEQ ID NO: 498449 - DNA, 25 bp, Rattus norvegicus
gagcctggcaccgaagctccaggga

SEQ ID NO: 498450 - DNA, 25 bp, Rattus norvegicus
gagcccgagacagcatcgcagttta

SEQ ID NO: 498451 - DNA, 25 bp, Rattus norvegicus
gttcctcttaactggacggctcagg

SEQ ID NO: 498452 - DNA, 25 bp, Rattus norvegicus
ctggtcccacatctctgcttagctt

SEQ ID NO: 498453 - DNA, 25 bp, Rattus norvegicus
taccgctgcccgggcagagtcggac

SEQ ID NO: 498454 - DNA, 25 bp, Rattus norvegicus
cggccctcgtgaaccacgtgatgca

SEQ ID NO: 498455 - DNA, 25 bp, Rattus norvegicus
gtgaaccacgtgatgcaacccagcc

SEQ ID NO: 498456 - DNA, 25 bp, Rattus norvegicus
tgatgcaacccagcccgcttccggc

SEQ ID NO: 498457 - DNA, 25 bp, Rattus norvegicus
ggtcccacatctctgcttagcttcg

SEQ ID NO: 498458 - DNA, 25 bp, Rattus norvegicus
ccgcgttgctctcgtccggcgtccc

SEQ ID NO: 498459 - DNA, 25 bp, Rattus norvegicus
cggcgtcccgctccctgccatccgc

SEQ ID NO: 498460 - DNA, 25 bp, Rattus norvegicus
tgccatccgctgaccctattgtctg

SEQ ID NO: 498461 - DNA, 25 bp, Rattus norvegicus
atccgctgaccctattgtctgcgcg

SEQ ID NO: 498462 - DNA, 25 bp, Rattus norvegicus
gtcaacctgcagctcccgggctcag

SEQ ID NO: 498463 - DNA, 25 bp, Rattus norvegicus
aaggcggctgcgatggtagcgaccc

SEQ ID NO: 498464 - DNA, 25 bp, Rattus norvegicus
ggccagcggctgtcaacctgcagct

SEQ ID NO: 498465 - DNA, 25 bp, Rattus norvegicus
ctggccgccctgacgcgacccggct

SEQ ID NO: 498466 - DNA, 25 bp, Rattus norvegicus
cgcgcgaccctagaggcacaaacca

SEQ ID NO: 498467 - DNA, 25 bp, Rattus norvegicus
tagagggccgcaccctgcctatgct

SEQ ID NO: 498468 - DNA, 25 bp, Rattus norvegicus
ggaggcgaaaatgacgacactcgga

SEQ ID NO: 498469 - DNA, 25 bp, Rattus norvegicus
gtactacctagagggccgcaccctg

SEQ ID NO: 498470 - DNA, 25 bp, Rattus norvegicus
attgccaacccggtactacctagag

SEQ ID NO: 498471 - DNA, 25 bp, Rattus norvegicus
gcgcagccacattgccaacccggta

SEQ ID NO: 498472 - DNA, 25 bp, Rattus norvegicus
cgaaaatgacgacactcggagctcc

SEQ ID NO: 498473 - DNA, 25 bp, Rattus norvegicus
tgacgacactcggagctccagccaa

SEQ ID NO: 498474 - DNA, 25 bp, Rattus norvegicus
ctcggagctccagccaactctaggg

SEQ ID NO: 498475 - DNA, 25 bp, Rattus norvegicus
tgcctatgctgctctcgccgccaac

SEQ ID NO: 498476 - DNA, 25 bp, Rattus norvegicus
aactctagggctgccagatgcccgc

SEQ ID NO: 498477 - DNA, 25 bp, Rattus norvegicus
agatgcccgcgcgaccctagaggca

SEQ ID NO: 498478 - DNA, 25 bp, Rattus norvegicus
ggcacaaaccacctctcccgcgcag

SEQ ID NO: 498479 - DNA, 25 bp, Rattus norvegicus
cagccaactctagggctgccagatg

SEQ ID NO: 498480 - DNA, 25 bp, Rattus norvegicus
ccacaaagcactggcggggaatcca

SEQ ID NO: 498481 - DNA, 25 bp, Rattus norvegicus
gcggggaatccagtaaagtagcacc

SEQ ID NO: 498482 - DNA, 25 bp, Rattus norvegicus
ggagggcttacctaaccagcaagga

SEQ ID NO: 498483 - DNA, 25 bp, Rattus norvegicus
tgagcaatctgctggcagctcgaga

SEQ ID NO: 498484 - DNA, 25 bp, Rattus norvegicus
tagcctggcaaggtttgtttacgtc

SEQ ID NO: 498485 - DNA, 25 bp, Rattus norvegicus
cgtccgtgcgaaggacgatttaata

SEQ ID NO: 498486 - DNA, 25 bp, Rattus norvegicus
ccgcctgttgcgcaagcctttgcag

SEQ ID NO: 498487 - DNA, 25 bp, Rattus norvegicus
ggagagactgccaagcccgcccaag

SEQ ID NO: 498488 - DNA, 25 bp, Rattus norvegicus
ctcctccctgtgatctggtctcggg

SEQ ID NO: 498489 - DNA, 25 bp, Rattus norvegicus
agtggtagtgtatgttcccgtgcgc

SEQ ID NO: 498490 - DNA, 25 bp, Rattus norvegicus
gcttgcggacttccttgtgtctctc

SEQ ID NO: 498491 - DNA, 25 bp, Rattus norvegicus
gcctccgagtttcctaagcgtctgc

SEQ ID NO: 498492 - DNA, 25 bp, Rattus norvegicus
tggtcttcgcaagggccacaaagca

SEQ ID NO: 498493 - DNA, 25 bp, Rattus norvegicus
agacgagttttcctgagggtccttg

SEQ ID NO: 498494 - DNA, 25 bp, Rattus norvegicus
gtactcggccacttccagagccttt

SEQ ID NO: 498495 - DNA, 25 bp, Rattus norvegicus
cagagcctttcccttcaccgtgttg

SEQ ID NO: 498496 - DNA, 25 bp, Rattus norvegicus
acattctgcatcctgggaccggagc

SEQ ID NO: 498497 - DNA, 25 bp, Rattus norvegicus
tccgggccagggagtcaaaaactgc

SEQ ID NO: 498498 - DNA, 25 bp, Rattus norvegicus
ggcggccaatgcagagcaagtcaga

SEQ ID NO: 498499 - DNA, 25 bp, Rattus norvegicus
ggtcgcttttccctggcactcagct

SEQ ID NO: 498500 - DNA, 25 bp, Rattus norvegicus
cagctttgtgatccagccctgcaag

SEQ ID NO: 498501 - DNA, 25 bp, Rattus norvegicus
gggccttcaaaatctactgctgcta

SEQ ID NO: 498502 - DNA, 25 bp, Rattus norvegicus
ctactacggagctaggcagtcacta

SEQ ID NO: 498503 - DNA, 25 bp, Rattus norvegicus
cagctctatgatgtccgttcttcca

SEQ ID NO: 498504 - DNA, 25 bp, Rattus norvegicus
ccttccctgagcgactgaggtaacc

SEQ ID NO: 498505 - DNA, 25 bp, Rattus norvegicus
ggagccgcccgctattcctattgcg

SEQ ID NO: 498506 - DNA, 25 bp, Rattus norvegicus
tcctaggcctcacgtgactcgaatc

SEQ ID NO: 498507 - DNA, 25 bp, Rattus norvegicus
tctcccgggacacgtgacagaagta

SEQ ID NO: 498508 - DNA, 25 bp, Rattus norvegicus
atgaggcaaggcgaagcgcccaaca

SEQ ID NO: 498509 - DNA, 25 bp, Rattus norvegicus
cccgtgcacttatcaaagcggcaga

SEQ ID NO: 498510 - DNA, 25 bp, Rattus norvegicus
accaagtcgccttggccggtgtcac

SEQ ID NO: 498511 - DNA, 25 bp, Rattus norvegicus
acagtactccaaccaagtcgccttg

SEQ ID NO: 498512 - DNA, 25 bp, Rattus norvegicus
ggtccgattccgagctaacagtact

SEQ ID NO: 498513 - DNA, 25 bp, Rattus norvegicus
gttgcttgcgcaaaggtccgattcc

SEQ ID NO: 498514 - DNA, 25 bp, Rattus norvegicus
acgagggctgaaagttgcttgcgca

SEQ ID NO: 498515 - DNA, 25 bp, Rattus norvegicus
cactcaaacgcccacgcgtagaaaa

SEQ ID NO: 498516 - DNA, 25 bp, Rattus norvegicus
tgtctcgagttcagtcgcgctgcct

SEQ ID NO: 498517 - DNA, 25 bp, Rattus norvegicus
aggcttagtccctgtctcgagttca

SEQ ID NO: 498518 - DNA, 25 bp, Rattus norvegicus
gcaccgggaggcttagtccctgtct

SEQ ID NO: 498519 - DNA, 25 bp, Rattus norvegicus
tacctgtactatgaggcgggcaccg

SEQ ID NO: 498520 - DNA, 25 bp, Rattus norvegicus
tcaaagcggcagaccgtgccctgcg

SEQ ID NO: 498521 - DNA, 25 bp, Rattus norvegicus
gcccaacaccttacctgtactatga

SEQ ID NO: 498522 - DNA, 25 bp, Rattus norvegicus
gtcgacgcaacccaaggtgcgcctg

SEQ ID NO: 498523 - DNA, 25 bp, Rattus norvegicus
tccgagctgtgggacctctgtcact

SEQ ID NO: 498524 - DNA, 25 bp, Rattus norvegicus
ggcaactggtcagcgcgtcctgcag

SEQ ID NO: 498525 - DNA, 25 bp, Rattus norvegicus
cggtctctggtctccggctagtagc

SEQ ID NO: 498526 - DNA, 25 bp, Rattus norvegicus
acctctgtcactgggacccggtggg

SEQ ID NO: 498527 - DNA, 25 bp, Rattus norvegicus
tcggtgagctacgtctccgagctgt

SEQ ID NO: 498528 - DNA, 25 bp, Rattus norvegicus
caagctgctgcttctcggtgagcta

SEQ ID NO: 498529 - DNA, 25 bp, Rattus norvegicus
tcgagaaacagctgcggcgagacaa

SEQ ID NO: 498530 - DNA, 25 bp, Rattus norvegicus
cgcatcaacgcggagatcgagaaac

SEQ ID NO: 498531 - DNA, 25 bp, Rattus norvegicus
catgatggcgtgttgcctgagcgac

SEQ ID NO: 498532 - DNA, 25 bp, Rattus norvegicus
ctccgcctccgggtgattctagagt

SEQ ID NO: 498533 - DNA, 25 bp, Rattus norvegicus
ggaccgcgacgatgactctggagtc

SEQ ID NO: 498534 - DNA, 25 bp, Rattus norvegicus
tccgggtgattctagagtcctgtcc

SEQ ID NO: 498535 - DNA, 25 bp, Rattus norvegicus
tgaaggagtcgaagcgcatcaacgc

SEQ ID NO: 498536 - DNA, 25 bp, Rattus norvegicus
actcccgagaggctcgaagcccgtg

SEQ ID NO: 498537 - DNA, 25 bp, Rattus norvegicus
agggcttttcctttgccgatgtaca

SEQ ID NO: 498538 - DNA, 25 bp, Rattus norvegicus
acgcctgctcttctgagggcttttc

SEQ ID NO: 498539 - DNA, 25 bp, Rattus norvegicus
cgcagagcaggtcactaaaggcatc

SEQ ID NO: 498540 - DNA, 25 bp, Rattus norvegicus
gatcgcggtgacctgagccttggac

SEQ ID NO: 498541 - DNA, 25 bp, Rattus norvegicus
cgggactccaggtgggatttagata

SEQ ID NO: 498542 - DNA, 25 bp, Rattus norvegicus
gaggggtctatcaggcaaagccatc

SEQ ID NO: 498543 - DNA, 25 bp, Rattus norvegicus
cgaggctagggaagaactcccgaga

SEQ ID NO: 498544 - DNA, 25 bp, Rattus norvegicus
tctgccggaacagttggcgaggcta

SEQ ID NO: 498545 - DNA, 25 bp, Rattus norvegicus
cccaagagagggatctgccggaaca

SEQ ID NO: 498546 - DNA, 25 bp, Rattus norvegicus
cgagcccaatatagctcagccgagc

SEQ ID NO: 498547 - DNA, 25 bp, Rattus norvegicus
cttggggcttcctgcgagcccaata

SEQ ID NO: 498548 - DNA, 25 bp, Rattus norvegicus
cagcagaggttagcgccggagaaac

SEQ ID NO: 498549 - DNA, 25 bp, Rattus norvegicus
ctctttctctaagggcgcgggactc

SEQ ID NO: 498550 - DNA, 25 bp, Rattus norvegicus
ccagctactgaacgtggtccgcaga

SEQ ID NO: 498551 - DNA, 25 bp, Rattus norvegicus
ccctgaggaaacttcgctctttatt

SEQ ID NO: 498552 - DNA, 25 bp, Rattus norvegicus
tcctgcggcaggataaagccagcta

SEQ ID NO: 498553 - DNA, 25 bp, Rattus norvegicus
ccaacatggcggatggagtcttcgc

SEQ ID NO: 498554 - DNA, 25 bp, Rattus norvegicus
aaaagcctcgggctcttcctggctc

SEQ ID NO: 498555 - DNA, 25 bp, Rattus norvegicus
ccacggggatcctacgcctacgtag

SEQ ID NO: 498556 - DNA, 25 bp, Rattus norvegicus
ttctccgcgctgttttgagccactc

SEQ ID NO: 498557 - DNA, 25 bp, Rattus norvegicus
aatagcttgcaaggcgcgcagggta

SEQ ID NO: 498558 - DNA, 25 bp, Rattus norvegicus
ctcggcacgcaaggcacagtgcgca

SEQ ID NO: 498559 - DNA, 25 bp, Rattus norvegicus
gcccacagccctggaaatagcttgc

SEQ ID NO: 498560 - DNA, 25 bp, Rattus norvegicus
tatccaaccagaactacgcggcttg

SEQ ID NO: 498561 - DNA, 25 bp, Rattus norvegicus
gcgaatctgcggcatccaacatggc

SEQ ID NO: 498562 - DNA, 25 bp, Rattus norvegicus
ctcctgggtcaggacgttgtgatcc

SEQ ID NO: 498563 - DNA, 25 bp, Rattus norvegicus
gccgagcgagaaggtcggacaccct

SEQ ID NO: 498564 - DNA, 25 bp, Rattus norvegicus
tttccctccagtgtgtctgaggaga

SEQ ID NO: 498565 - DNA, 25 bp, Rattus norvegicus
tagtttgacctttccctccagtgtg

SEQ ID NO: 498566 - DNA, 25 bp, Rattus norvegicus
tcgctcgcctttagtttgacctttc

SEQ ID NO: 498567 - DNA, 25 bp, Rattus norvegicus
gttctctccgttcgctcgcctttag

SEQ ID NO: 498568 - DNA, 25 bp, Rattus norvegicus
gcggcggtcgctcgctgcgttctct

SEQ ID NO: 498569 - DNA, 25 bp, Rattus norvegicus
ggaaatgcacttcgcgggtccggac

SEQ ID NO: 498570 - DNA, 25 bp, Rattus norvegicus
actttggcggggaaatgcacttcgc

SEQ ID NO: 498571 - DNA, 25 bp, Rattus norvegicus
ctccgtgcgactttggcggggaaat

SEQ ID NO: 498572 - DNA, 25 bp, Rattus norvegicus
gcctgacgtcactgccatggcaacg

SEQ ID NO: 498573 - DNA, 25 bp, Rattus norvegicus
tgctcactgaatgcgcgtgcgcacg

SEQ ID NO: 498574 - DNA, 25 bp, Rattus norvegicus
gtctgtgggtctccgacccggtctg

SEQ ID NO: 498575 - DNA, 25 bp, Rattus norvegicus
ggcggtctggaaactcctccttatc

SEQ ID NO: 498576 - DNA, 25 bp, Rattus norvegicus
tggaaactcctccttatcctcgcgg

SEQ ID NO: 498577 - DNA, 25 bp, Rattus norvegicus
ggggctcacgtgctcactgaatgcg

SEQ ID NO: 498578 - DNA, 25 bp, Rattus norvegicus
ctcaaggcctagagagccctccgtg

SEQ ID NO: 498579 - DNA, 25 bp, Rattus norvegicus
aaggcctagagagccctccgtgccg

SEQ ID NO: 498580 - DNA, 25 bp, Rattus norvegicus
gtgccgctcagctctgctcctgcag

SEQ ID NO: 498581 - DNA, 25 bp, Rattus norvegicus
tcctgcagcctctgcgtaccgggtt

SEQ ID NO: 498582 - DNA, 25 bp, Rattus norvegicus
gcagcctctgcgtaccgggttaggc

SEQ ID NO: 498583 - DNA, 25 bp, Rattus norvegicus
agcctctgcgtaccgggttaggctg

SEQ ID NO: 498584 - DNA, 25 bp, Rattus norvegicus
accgggttaggctgcgcgactagct

SEQ ID NO: 498585 - DNA, 25 bp, Rattus norvegicus
cgtaccgggttaggctgcgcgacta

SEQ ID NO: 498586 - DNA, 25 bp, Rattus norvegicus
ctgcgcgactagctgggaggcgccg

SEQ ID NO: 498587 - DNA, 25 bp, Rattus norvegicus
acctctgttggccagaagagcctag

SEQ ID NO: 498588 - DNA, 25 bp, Rattus norvegicus
ctctgttggccagaagagcctaggc

SEQ ID NO: 498589 - DNA, 25 bp, Rattus norvegicus
ctgttggccagaagagcctaggcgc

SEQ ID NO: 498590 - DNA, 25 bp, Rattus norvegicus
cgccaggctgtcctgccgccaaacc

SEQ ID NO: 498591 - DNA, 25 bp, Rattus norvegicus
aggctcttctgcctgccggcccggc

SEQ ID NO: 498592 - DNA, 25 bp, Rattus norvegicus
gctcagcctctgaagctcaggaaca

SEQ ID NO: 498593 - DNA, 25 bp, Rattus norvegicus
tgcggatggatgacccaagctcgtt

SEQ ID NO: 498594 - DNA, 25 bp, Rattus norvegicus
cgcgagagctgatctgcgaagtttg

SEQ ID NO: 498595 - DNA, 25 bp, Rattus norvegicus
tgcgaagtttgttccgctcagcctc

SEQ ID NO: 498596 - DNA, 25 bp, Rattus norvegicus
gtctatctagcagggcaacgggcga

SEQ ID NO: 498597 - DNA, 25 bp, Rattus norvegicus
cctgcaagcagggagaaagtctatc

SEQ ID NO: 498598 - DNA, 25 bp, Rattus norvegicus
ggcccagctaatcgcctccagtgtg

SEQ ID NO: 498599 - DNA, 25 bp, Rattus norvegicus
ctcaggaacaggacgaagcccaaga

SEQ ID NO: 498600 - DNA, 25 bp, Rattus norvegicus
caccctatgccaggcctgggtcaaa

SEQ ID NO: 498601 - DNA, 25 bp, Rattus norvegicus
caagttgatggcattgctttggcgc

SEQ ID NO: 498602 - DNA, 25 bp, Rattus norvegicus
agcacccagtgcaacggattccgcg

SEQ ID NO: 498603 - DNA, 25 bp, Rattus norvegicus
ggggtcctcactctcacgaacttca

SEQ ID NO: 498604 - DNA, 25 bp, Rattus norvegicus
ggtgtctctagaatccctgcaagca

SEQ ID NO: 498605 - DNA, 25 bp, Rattus norvegicus
ggactctgcggattccgcggcatca

SEQ ID NO: 498606 - DNA, 25 bp, Rattus norvegicus
cggcaatctgctggttatggacaca

SEQ ID NO: 498607 - DNA, 25 bp, Rattus norvegicus
gagccgcaccatcacagacatctgg

SEQ ID NO: 498608 - DNA, 25 bp, Rattus norvegicus
gacatctgggttttttcggcgcctc

SEQ ID NO: 498609 - DNA, 25 bp, Rattus norvegicus
ttttgcccattcctcggtcacattg

SEQ ID NO: 498610 - DNA, 25 bp, Rattus norvegicus
tgaaaaattcccagctccgtggctg

SEQ ID NO: 498611 - DNA, 25 bp, Rattus norvegicus
tggacacattctgaggcgccaccta

SEQ ID NO: 498612 - DNA, 25 bp, Rattus norvegicus
agccgcggcaatgatcctctacata

SEQ ID NO: 498613 - DNA, 25 bp, Rattus norvegicus
tgctcagatttcagtgcgcaggtgc

SEQ ID NO: 498614 - DNA, 25 bp, Rattus norvegicus
tgccgcagtctgcagtctttagaga

SEQ ID NO: 498615 - DNA, 25 bp, Rattus norvegicus
gagatccgctcagctccaagccgtg

SEQ ID NO: 498616 - DNA, 25 bp, Rattus norvegicus
gtcctcttcggttcgtcgtcacaga

SEQ ID NO: 498617 - DNA, 25 bp, Rattus norvegicus
atgggataacgatggccaccgggtc

SEQ ID NO: 498618 - DNA, 25 bp, Rattus norvegicus
cacgggcacttggatgggctatcca

SEQ ID NO: 498619 - DNA, 25 bp, Rattus norvegicus
cttcagagaaaaggccgcggatctt

SEQ ID NO: 498620 - DNA, 25 bp, Rattus norvegicus
ttctcgaaagtctgtggccagtctt

SEQ ID NO: 498621 - DNA, 25 bp, Rattus norvegicus
acaaccttgcggtgcgtctggaagt

SEQ ID NO: 498622 - DNA, 25 bp, Rattus norvegicus
cactcgttgttctccggcgggtagt

SEQ ID NO: 498623 - DNA, 25 bp, Rattus norvegicus
tgccggtaacggatgaagagtgcac

SEQ ID NO: 498624 - DNA, 25 bp, Rattus norvegicus
gtgcacgctgtgagtcgcgcacact

SEQ ID NO: 498625 - DNA, 25 bp, Rattus norvegicus
gcgcacactgagctggctcaccgag

SEQ ID NO: 498626 - DNA, 25 bp, Rattus norvegicus
ggctcaccgagcagatccgcttgta

SEQ ID NO: 498627 - DNA, 25 bp, Rattus norvegicus
taatgaggcccacaaccttgcggtg

SEQ ID NO: 498628 - DNA, 25 bp, Rattus norvegicus
aagaagttctcctcagagacgatgc

SEQ ID NO: 498629 - DNA, 25 bp, Rattus norvegicus
agagacgatgcccacggcctgaacg

SEQ ID NO: 498630 - DNA, 25 bp, Rattus norvegicus
gagcgtggagccgtagatctccttc

SEQ ID NO: 498631 - DNA, 25 bp, Rattus norvegicus
tccttctgcacgtggaacttctcga

SEQ ID NO: 498632 - DNA, 25 bp, Rattus norvegicus
cagtcggtgatggtaatgaggccca

SEQ ID NO: 498633 - DNA, 25 bp, Rattus norvegicus
ccgcttgtagatcctgaagaagttc

SEQ ID NO: 498634 - DNA, 25 bp, Rattus norvegicus
gtcccgcatccgagtcatcatgaag

SEQ ID NO: 498635 - DNA, 25 bp, Rattus norvegicus
tcttcccgaagtactaagacgcttg

SEQ ID NO: 498636 - DNA, 25 bp, Rattus norvegicus
aggccaccgcgctacacggagtctg

SEQ ID NO: 498637 - DNA, 25 bp, Rattus norvegicus
tcatgaagagctctcctgaggtgtc

SEQ ID NO: 498638 - DNA, 25 bp, Rattus norvegicus
gtcgagcatcaaccaggaggcacta

SEQ ID NO: 498639 - DNA, 25 bp, Rattus norvegicus
gaggcactagtgctcacggccaagg

SEQ ID NO: 498640 - DNA, 25 bp, Rattus norvegicus
ggagtcttggtctctccctgcgcct

SEQ ID NO: 498641 - DNA, 25 bp, Rattus norvegicus
cccgctgtcctttgcgctgcttttg

SEQ ID NO: 498642 - DNA, 25 bp, Rattus norvegicus
ttcgcacgcgtgaggagctaagtgc

SEQ ID NO: 498643 - DNA, 25 bp, Rattus norvegicus
gagggcgtactgtctacttcttttc

SEQ ID NO: 498644 - DNA, 25 bp, Rattus norvegicus
tctgtcgctgacttcccgcagagtg

SEQ ID NO: 498645 - DNA, 25 bp, Rattus norvegicus
cccgcagagtgatgcgagggttctc

SEQ ID NO: 498646 - DNA, 25 bp, Rattus norvegicus
tccgcacactcctagcctttggttg

SEQ ID NO: 498647 - DNA, 25 bp, Rattus norvegicus
tgaaagcgcttcttccgggagattg

SEQ ID NO: 498648 - DNA, 25 bp, Rattus norvegicus
atggcggctactaggttatggcata

SEQ ID NO: 498649 - DNA, 25 bp, Rattus norvegicus
gaaagtagtgtacccgctgcgggaa

SEQ ID NO: 498650 - DNA, 25 bp, Rattus norvegicus
gagcagcacctcgtcacggactcta

SEQ ID NO: 498651 - DNA, 25 bp, Rattus norvegicus
taggcctggcctcatcgaacagaga

SEQ ID NO: 498652 - DNA, 25 bp, Rattus norvegicus
agagactcttcgacccgagcctgga

SEQ ID NO: 498653 - DNA, 25 bp, Rattus norvegicus
gtccggaaccgcattgagtacctca

SEQ ID NO: 498654 - DNA, 25 bp, Rattus norvegicus
tgaccggcttgtctactgtaggtgc

SEQ ID NO: 498655 - DNA, 25 bp, Rattus norvegicus
ttgcgctcttttcccgtcaccagaa

SEQ ID NO: 498656 - DNA, 25 bp, Rattus norvegicus
aagcactcagtgtggatgcaccgcg

SEQ ID NO: 498657 - DNA, 25 bp, Rattus norvegicus
agatttctctcttgtgctgtccagg

SEQ ID NO: 498658 - DNA, 25 bp, Rattus norvegicus
tgtccaggtcctacgaataaaatcc

SEQ ID NO: 498659 - DNA, 25 bp, Rattus norvegicus
ttcgctgaagtactaaggatgccac

SEQ ID NO: 498660 - DNA, 25 bp, Rattus norvegicus
ttatggcatagaacgggaaggctcc

SEQ ID NO: 498661 - DNA, 25 bp, Rattus norvegicus
ctccttgagatagcgtcggcatttg

SEQ ID NO: 498662 - DNA, 25 bp, Rattus norvegicus
tcgcagggcgattagcacttgaatg

SEQ ID NO: 498663 - DNA, 25 bp, Rattus norvegicus
ggcgccaagtacagcctggcggaca

SEQ ID NO: 498664 - DNA, 25 bp, Rattus norvegicus
caagtacagcctggcggacaaaggg

SEQ ID NO: 498665 - DNA, 25 bp, Rattus norvegicus
aggcgaaaaagcctcccaacacttg

SEQ ID NO: 498666 - DNA, 25 bp, Rattus norvegicus
agcctcccaacacttgttttctcaa

SEQ ID NO: 498667 - DNA, 25 bp, Rattus norvegicus
ctccactctgctcgaaaagcggggt

SEQ ID NO: 498668 - DNA, 25 bp, Rattus norvegicus
tggaacttttccagagaaacgggca

SEQ ID NO: 498669 - DNA, 25 bp, Rattus norvegicus
ttttccagagaaacgggcacgctgg

SEQ ID NO: 498670 - DNA, 25 bp, Rattus norvegicus
ccgctaggaaatcgcagggcgatta

SEQ ID NO: 498671 - DNA, 25 bp, Rattus norvegicus
ctcgccagcgtggaactgcgtccaa

SEQ ID NO: 498672 - DNA, 25 bp, Rattus norvegicus
tggaactgcgtccaagcagacgatc

SEQ ID NO: 498673 - DNA, 25 bp, Rattus norvegicus
gtccaagcagacgatcgcggtcccg

SEQ ID NO: 498674 - DNA, 25 bp, Rattus norvegicus
cacagctatgcgcttggggacagag

SEQ ID NO: 498675 - DNA, 25 bp, Rattus norvegicus
acccgctccgctaggaaatcgcagg

SEQ ID NO: 498676 - DNA, 25 bp, Rattus norvegicus
ctgccacctcttttgtttttcggct

SEQ ID NO: 498677 - DNA, 25 bp, Rattus norvegicus
gcggagggaacttggacagcacaat

SEQ ID NO: 498678 - DNA, 25 bp, Rattus norvegicus
gggaacttggacagcacaatgactc

SEQ ID NO: 498679 - DNA, 25 bp, Rattus norvegicus
acttggacagcacaatgactcccgg

SEQ ID NO: 498680 - DNA, 25 bp, Rattus norvegicus
tggacagcacaatgactcccgggtt

SEQ ID NO: 498681 - DNA, 25 bp, Rattus norvegicus
gacagcacaatgactcccgggttcg

SEQ ID NO: 498682 - DNA, 25 bp, Rattus norvegicus
cagcacaatgactcccgggttcgtg

SEQ ID NO: 498683 - DNA, 25 bp, Rattus norvegicus
cgtgtccgccaaagcccgcaccgcg

SEQ ID NO: 498684 - DNA, 25 bp, Rattus norvegicus
ccgggcctgacgaggagcgaggccg

SEQ ID NO: 498685 - DNA, 25 bp, Rattus norvegicus
aatgactcccgggttcgtgcgctcg

SEQ ID NO: 498686 - DNA, 25 bp, Rattus norvegicus
accggcggggacaggcagcgcgccg

SEQ ID NO: 498687 - DNA, 25 bp, Rattus norvegicus
tcccgggttcgtgcgctcgcactgg

SEQ ID NO: 498688 - DNA, 25 bp, Rattus norvegicus
ggttcgtgcgctcgcactggaagcc

SEQ ID NO: 498689 - DNA, 25 bp, Rattus norvegicus
cgcctgccacctcttttgtttttcg

SEQ ID NO: 498690 - DNA, 25 bp, Rattus norvegicus
ggcagcgtgatcaccgtgtgcacct

SEQ ID NO: 498691 - DNA, 25 bp, Rattus norvegicus
tgagagcgggaaaagcacgttcatc

SEQ ID NO: 498692 - DNA, 25 bp, Rattus norvegicus
ctaagcacgctgtttgtccccaggg

SEQ ID NO: 498693 - DNA, 25 bp, Rattus norvegicus
gtgagcaccacgtgtagcccttacc

SEQ ID NO: 498694 - DNA, 25 bp, Rattus norvegicus
agcgctgtgttcaccgtgagcacca

SEQ ID NO: 498695 - DNA, 25 bp, Rattus norvegicus
catgagcactgtgagcgctgtgttc

SEQ ID NO: 498696 - DNA, 25 bp, Rattus norvegicus
cacgttcatcaagcaaatgcgcatc

SEQ ID NO: 498697 - DNA, 25 bp, Rattus norvegicus
gctgctggtgccatgagcactgtga

SEQ ID NO: 498698 - DNA, 25 bp, Rattus norvegicus
caccgtgattgctgctggtgccatg

SEQ ID NO: 498699 - DNA, 25 bp, Rattus norvegicus
cgtaggcattgggtacaccgtgatt

SEQ ID NO: 498700 - DNA, 25 bp, Rattus norvegicus
tgcaccttgtgtgccgtaggcattg

SEQ ID NO: 498701 - DNA, 25 bp, Rattus norvegicus
gtgatcaccgtgtgcaccttgtgtg

SEQ ID NO: 498702 - DNA, 25 bp, Rattus norvegicus
tgcgcatcattcacggcgccggcta

SEQ ID NO: 498703 - DNA, 25 bp, Rattus norvegicus
gccggctactctgaggaggaccgca

SEQ ID NO: 498704 - DNA, 25 bp, Rattus norvegicus
tgattcgagtcatcgctgccgggca

SEQ ID NO: 498705 - DNA, 25 bp, Rattus norvegicus
ctcaagacagcctccgcggcctgga

SEQ ID NO: 498706 - DNA, 25 bp, Rattus norvegicus
acgcggctggctggcaaccgaccga

SEQ ID NO: 498707 - DNA, 25 bp, Rattus norvegicus
gcgctgctgggtgcctctcaagaca

SEQ ID NO: 498708 - DNA, 25 bp, Rattus norvegicus
agccctcggcgcgacacctgtcgct

SEQ ID NO: 498709 - DNA, 25 bp, Rattus norvegicus
cgagtcatcgctgccgggcaatcga

SEQ ID NO: 498710 - DNA, 25 bp, Rattus norvegicus
cgtcctctgattcgagtcatcgctg

SEQ ID NO: 498711 - DNA, 25 bp, Rattus norvegicus
gcgccagcgtcctctgattcgagtc

SEQ ID NO: 498712 - DNA, 25 bp, Rattus norvegicus
gtctggcttgaaggcgccagcgtcc

SEQ ID NO: 498713 - DNA, 25 bp, Rattus norvegicus
cgaggccttgtctgaggcgctctgt

SEQ ID NO: 498714 - DNA, 25 bp, Rattus norvegicus
aagagaagcgccgaggccttgtctg

SEQ ID NO: 498715 - DNA, 25 bp, Rattus norvegicus
gcaaccgaccgaagagaagcgccga

SEQ ID NO: 498716 - DNA, 25 bp, Rattus norvegicus
tggctggcaaccgaccgaagagaag

SEQ ID NO: 498717 - DNA, 25 bp, Rattus norvegicus
atcgctgccgggcaatcgagggctc

SEQ ID NO: 498718 - DNA, 25 bp, Rattus norvegicus
ggcgactcatcactgaggtctttga

SEQ ID NO: 498719 - DNA, 25 bp, Rattus norvegicus
ctgagctcaggcgactcatcactga

SEQ ID NO: 498720 - DNA, 25 bp, Rattus norvegicus
cactgaggtctttgataagcaagga

SEQ ID NO: 498721 - DNA, 25 bp, Rattus norvegicus
gtctttgataagcaaggagaggccc

SEQ ID NO: 498722 - DNA, 25 bp, Rattus norvegicus
cccaaggtggacgacgccgtgaaga

SEQ ID NO: 498723 - DNA, 25 bp, Rattus norvegicus
tggacgacgccgtgaagaacttcga

SEQ ID NO: 498724 - DNA, 25 bp, Rattus norvegicus
cgccgtgaagaacttcgaactgccc

SEQ ID NO: 498725 - DNA, 25 bp, Rattus norvegicus
atccaccgtctgttcgacgccctga

SEQ ID NO: 498726 - DNA, 25 bp, Rattus norvegicus
aagcacatgcaactcaatgacttcg

SEQ ID NO: 498727 - DNA, 25 bp, Rattus norvegicus
tgcaactcaatgacttcgtgaagcg

SEQ ID NO: 498728 - DNA, 25 bp, Rattus norvegicus
atgacttcgtgaagcgggtccagga

SEQ ID NO: 498729 - DNA, 25 bp, Rattus norvegicus
gtcggggatcgtgaaggataccacc

SEQ ID NO: 498730 - DNA, 25 bp, Rattus norvegicus
tcgtgaaggataccaccatcatcca

SEQ ID NO: 498731 - DNA, 25 bp, Rattus norvegicus
ttcgaactgcccaagaagcacatgc

SEQ ID NO: 498732 - DNA, 25 bp, Rattus norvegicus
gcgcggggacaacgccgctttatca

SEQ ID NO: 498733 - DNA, 25 bp, Rattus norvegicus
cgccgctttatcaggtcggaaacag

SEQ ID NO: 498734 - DNA, 25 bp, Rattus norvegicus
caggtcggaaacagccgctgcgcgc

SEQ ID NO: 498735 - DNA, 25 bp, Rattus norvegicus
cggcctgcgcctcatgactatgcag

SEQ ID NO: 498736 - DNA, 25 bp, Rattus norvegicus
tcatgactatgcagcggactctagg

SEQ ID NO: 498737 - DNA, 25 bp, Rattus norvegicus
gcctgagatgcgctcgtccattggt

SEQ ID NO: 498738 - DNA, 25 bp, Rattus norvegicus
attggtcagtagaggcatgtggccc

SEQ ID NO: 498739 - DNA, 25 bp, Rattus norvegicus
tgtagtgcgctatgctcaccctccg

SEQ ID NO: 498740 - DNA, 25 bp, Rattus norvegicus
tcaaggtctctaggccgccgctgtg

SEQ ID NO: 498741 - DNA, 25 bp, Rattus norvegicus
ccgctgtgtagtgcgctatgctcac

SEQ ID NO: 498742 - DNA, 25 bp, Rattus norvegicus
tcagtcagctactcggacagggtgc

SEQ ID NO: 498743 - DNA, 25 bp, Rattus norvegicus
atgcgctcgtccattggtcagtaga

SEQ ID NO: 498744 - DNA, 25 bp, Rattus norvegicus
agacaccctcaaggtctctaggccg

SEQ ID NO: 498745 - DNA, 25 bp, Rattus norvegicus
ggttttcctgccagacaccctcaag

SEQ ID NO: 498746 - DNA, 25 bp, Rattus norvegicus
gcaaagacccggcagcatgaccgtc

SEQ ID NO: 498747 - DNA, 25 bp, Rattus norvegicus
atgatacggcctgtgaacacgctga

SEQ ID NO: 498748 - DNA, 25 bp, Rattus norvegicus
aagacgcacacagccttggcgcagg

SEQ ID NO: 498749 - DNA, 25 bp, Rattus norvegicus
cacacaaagacgcacacagccttgg

SEQ ID NO: 498750 - DNA, 25 bp, Rattus norvegicus
acagacagggtcacgactcccgctg

SEQ ID NO: 498751 - DNA, 25 bp, Rattus norvegicus
ggcagcatgaccgtccaccagtctt

SEQ ID NO: 498752 - DNA, 25 bp, Rattus norvegicus
tccagaacggtcagagcaaagaccc

SEQ ID NO: 498753 - DNA, 25 bp, Rattus norvegicus
agcaggaactccagaacggtcagag

SEQ ID NO: 498754 - DNA, 25 bp, Rattus norvegicus
acgctgatgaccagtagcggcagca

SEQ ID NO: 498755 - DNA, 25 bp, Rattus norvegicus
cctgtgaacacgctgatgaccagta

SEQ ID NO: 498756 - DNA, 25 bp, Rattus norvegicus
cgctgacgaccctggcgtagcaggc

SEQ ID NO: 498757 - DNA, 25 bp, Rattus norvegicus
cctggcctcgacagtgcacacatga

SEQ ID NO: 498758 - DNA, 25 bp, Rattus norvegicus
gacagtgcacacatgatacggcctg

SEQ ID NO: 498759 - DNA, 25 bp, Rattus norvegicus
gtcttcacacccaatacagacaggg

SEQ ID NO: 498760 - DNA, 25 bp, Rattus norvegicus
cctaaccctactgggatgggccctg

SEQ ID NO: 498761 - DNA, 25 bp, Rattus norvegicus
cctcttcctctactggccgcgcctt

SEQ ID NO: 498762 - DNA, 25 bp, Rattus norvegicus
gccgcgcctttgtttgcgtgctatc

SEQ ID NO: 498763 - DNA, 25 bp, Rattus norvegicus
ctccctggcgtgctgggtgggaagc

SEQ ID NO: 498764 - DNA, 25 bp, Rattus norvegicus
aaccctactgggatgggccctgcac

SEQ ID NO: 498765 - DNA, 25 bp, Rattus norvegicus
gcgcctttgtttgcgtgctatcttt

SEQ ID NO: 498766 - DNA, 25 bp, Rattus norvegicus
gcctcgaggacgctcccgaacccta

SEQ ID NO: 498767 - DNA, 25 bp, Rattus norvegicus
gggacccagcctcgaggacgctccc

SEQ ID NO: 498768 - DNA, 25 bp, Rattus norvegicus
cgctataaatagctgggcggcgggc

SEQ ID NO: 498769 - DNA, 25 bp, Rattus norvegicus
tgtgagtcgggtcgcccgccggtca

SEQ ID NO: 498770 - DNA, 25 bp, Rattus norvegicus
ctatctttaggcagcaggtgcggga

SEQ ID NO: 498771 - DNA, 25 bp, Rattus norvegicus
cgtgctatctttaggcagcaggtgc

SEQ ID NO: 498772 - DNA, 25 bp, Rattus norvegicus
tgtttgcgtgctatctttaggcagc

SEQ ID NO: 498773 - DNA, 25 bp, Rattus norvegicus
ccctactgggatgggccctgcacgg

SEQ ID NO: 498774 - DNA, 25 bp, Rattus norvegicus
gtgctcaccgaggacttcacgctgc

SEQ ID NO: 498775 - DNA, 25 bp, Rattus norvegicus
aagctggccgtcctgcttggcgcac

SEQ ID NO: 498776 - DNA, 25 bp, Rattus norvegicus
tcgcccgcgacagcgaataaagcct

SEQ ID NO: 498777 - DNA, 25 bp, Rattus norvegicus
gcgggcttcgacttcctgctgcgcg

SEQ ID NO: 498778 - DNA, 25 bp, Rattus norvegicus
aggacttcacgctgcctttcccgtt

SEQ ID NO: 498779 - DNA, 25 bp, Rattus norvegicus
cgacagcgaataaagcctctgcctc

SEQ ID NO: 498780 - DNA, 25 bp, Rattus norvegicus
cgcgcttccctgacatttacggcgg

SEQ ID NO: 498781 - DNA, 25 bp, Rattus norvegicus
tccctgacatttacggcggcgacgc

SEQ ID NO: 498782 - DNA, 25 bp, Rattus norvegicus
gcagctctgggaggcgcatttccgt

SEQ ID NO: 498783 - DNA, 25 bp, Rattus norvegicus
atttccgtggcatcgggcgcgccta

SEQ ID NO: 498784 - DNA, 25 bp, Rattus norvegicus
gcgcctaccgcgctttgggcaaaga

SEQ ID NO: 498785 - DNA, 25 bp, Rattus norvegicus
ctttgggcaaagaggacgacttcgc

SEQ ID NO: 498786 - DNA, 25 bp, Rattus norvegicus
gacgacttcgctatccgcgtgctca

SEQ ID NO: 498787 - DNA, 25 bp, Rattus norvegicus
ctatccgcgtgctcaccgaggactt

SEQ ID NO: 498788 - DNA, 25 bp, Rattus norvegicus
gtggagagctttgacgaagttctgc

SEQ ID NO: 498789 - DNA, 25 bp, Rattus norvegicus
tttgacgaagttctgcggctctgcg

SEQ ID NO: 498790 - DNA, 25 bp, Rattus norvegicus
ggatacttctccgcggctgctgtgt

SEQ ID NO: 498791 - DNA, 25 bp, Rattus norvegicus
tgtgtttccagccaacgcctcacgc

SEQ ID NO: 498792 - DNA, 25 bp, Rattus norvegicus
aacgcctcacgctgctcttggactc

SEQ ID NO: 498793 - DNA, 25 bp, Rattus norvegicus
gctcttggactcttcgcaacccgga

SEQ ID NO: 498794 - DNA, 25 bp, Rattus norvegicus
cctcgtcgttacacgctctacatga

SEQ ID NO: 498795 - DNA, 25 bp, Rattus norvegicus
cgctctacatgaaggtggccaaggc

SEQ ID NO: 498796 - DNA, 25 bp, Rattus norvegicus
aggtggccaaggcacctgcaccctg

SEQ ID NO: 498797 - DNA, 25 bp, Rattus norvegicus
ggccgagttcgcacctaccagttcg

SEQ ID NO: 498798 - DNA, 25 bp, Rattus norvegicus
cacctaccagttcgactctttcttg

SEQ ID NO: 498799 - DNA, 25 bp, Rattus norvegicus
gttcgactctttcttggaatccacg

SEQ ID NO: 498800 - DNA, 25 bp, Rattus norvegicus
ctttcttggaatccacgcgcaccta

SEQ ID NO: 498801 - DNA, 25 bp, Rattus norvegicus
ccacgcgcacctacctgggtgtgga

SEQ ID NO: 498802 - DNA, 25 bp, Rattus norvegicus
gcactgtcagtgtgctgcagttccc

SEQ ID NO: 498803 - DNA, 25 bp, Rattus norvegicus
ggatcttcacgcggttccacggctc

SEQ ID NO: 498804 - DNA, 25 bp, Rattus norvegicus
gatcctgcactgtcagtgtgctgca

SEQ ID NO: 498805 - DNA, 25 bp, Rattus norvegicus
cctgggaaggccgagctgggcgaaa

SEQ ID NO: 498806 - DNA, 25 bp, Rattus norvegicus
cacgcggttccacggctccgcggct

SEQ ID NO: 498807 - DNA, 25 bp, Rattus norvegicus
cgaaagcgagtagagcggccctggc

SEQ ID NO: 498808 - DNA, 25 bp, Rattus norvegicus
cccgcctgggggatcttcacgcggt

SEQ ID NO: 498809 - DNA, 25 bp, Rattus norvegicus
ctgcactgtcagtgtgctgcagttc

SEQ ID NO: 498810 - DNA, 25 bp, Rattus norvegicus
ctgggatcctgcactgtcagtgtgc

SEQ ID NO: 498811 - DNA, 25 bp, Rattus norvegicus
cgctgggatcctgcactgtcagtgt

SEQ ID NO: 498812 - DNA, 25 bp, Rattus norvegicus
gtggcgctgggatcctgcactgtca

SEQ ID NO: 498813 - DNA, 25 bp, Rattus norvegicus
gcctcactcacccagggtggcgctg

SEQ ID NO: 498814 - DNA, 25 bp, Rattus norvegicus
acacgcggaacctcctcgccggcct

SEQ ID NO: 498815 - DNA, 25 bp, Rattus norvegicus
tacggccgcggccatcttgagcggc

SEQ ID NO: 498816 - DNA, 25 bp, Rattus norvegicus
ttcggtcaacagatgccggtgggtc

SEQ ID NO: 498817 - DNA, 25 bp, Rattus norvegicus
gcagagacaggccttgatggacttc

SEQ ID NO: 498818 - DNA, 25 bp, Rattus norvegicus
gatggacttcttccagcgctgtgag

SEQ ID NO: 498819 - DNA, 25 bp, Rattus norvegicus
gggcacatagccgtccaagttgttc

SEQ ID NO: 498820 - DNA, 25 bp, Rattus norvegicus
agttgttctccagcttgcccaccga

SEQ ID NO: 498821 - DNA, 25 bp, Rattus norvegicus
ccacctgcttggacacttcggtcaa

SEQ ID NO: 498822 - DNA, 25 bp, Rattus norvegicus
gctcggcacttaccaatctgcagga

SEQ ID NO: 498823 - DNA, 25 bp, Rattus norvegicus
ccggtcgtcatatggtccagctcca

SEQ ID NO: 498824 - DNA, 25 bp, Rattus norvegicus
tcgggacaggctaagaactcctctg

SEQ ID NO: 498825 - DNA, 25 bp, Rattus norvegicus
gactactcgccagagcactgcacta

SEQ ID NO: 498826 - DNA, 25 bp, Rattus norvegicus
cgccaccggcggctttttatgctgc

SEQ ID NO: 498827 - DNA, 25 bp, Rattus norvegicus
tgactaatgtgctctgctgcgcgcc

SEQ ID NO: 498828 - DNA, 25 bp, Rattus norvegicus
gcccacctctccagacggtagaaga

SEQ ID NO: 498829 - DNA, 25 bp, Rattus norvegicus
tctgcaggatcacattgggtttggc

SEQ ID NO: 498830 - DNA, 25 bp, Rattus norvegicus
tgtgccagtcccgaatgcgactcga

SEQ ID NO: 498831 - DNA, 25 bp, Rattus norvegicus
tcctgaagaacggaagcctcgagcc

SEQ ID NO: 498832 - DNA, 25 bp, Rattus norvegicus
cccagcgtccggttctgggagccat

SEQ ID NO: 498833 - DNA, 25 bp, Rattus norvegicus
gaggttgggtcaatcgccaccttgc

SEQ ID NO: 498834 - DNA, 25 bp, Rattus norvegicus
gccaccttgcggtgggaggtaccca

SEQ ID NO: 498835 - DNA, 25 bp, Rattus norvegicus
tagaacaacgaaggccggaggaagc

SEQ ID NO: 498836 - DNA, 25 bp, Rattus norvegicus
ccggtctgcgtactggtgaagcgca

SEQ ID NO: 498837 - DNA, 25 bp, Rattus norvegicus
ccgcgaccaagcaaggaagaggccc

SEQ ID NO: 498838 - DNA, 25 bp, Rattus norvegicus
tggtgtctaggtcgctattccgcga

SEQ ID NO: 498839 - DNA, 25 bp, Rattus norvegicus
accaccgggaggcttcggtctcagt

SEQ ID NO: 498840 - DNA, 25 bp, Rattus norvegicus
ggccggaaatgccagccacgcagct

SEQ ID NO: 498841 - DNA, 25 bp, Rattus norvegicus
aagagcgcaagctgggcctccagtc

SEQ ID NO: 498842 - DNA, 25 bp, Rattus norvegicus
ggaagcctcgcgtttcctgaagaac

SEQ ID NO: 498843 - DNA, 25 bp, Rattus norvegicus
tgcgactcgactccagtctctgggg

SEQ ID NO: 498844 - DNA, 25 bp, Rattus norvegicus
agagaagtggtgcactccggtcctc

SEQ ID NO: 498845 - DNA, 25 bp, Rattus norvegicus
cagcacttgtgcaagcgcagggtga

SEQ ID NO: 498846 - DNA, 25 bp, Rattus norvegicus
ccctcgcactgctgagagaagtggt

SEQ ID NO: 498847 - DNA, 25 bp, Rattus norvegicus
cgccggatcgagtagtacagcactt

SEQ ID NO: 498848 - DNA, 25 bp, Rattus norvegicus
cgcccgctgccaagatgatggagct

SEQ ID NO: 498849 - DNA, 25 bp, Rattus norvegicus
agctgttggtggtgtcgttatcctt

SEQ ID NO: 498850 - DNA, 25 bp, Rattus norvegicus
ctcgccttctttgcgctgctggacg

SEQ ID NO: 498851 - DNA, 25 bp, Rattus norvegicus
ggacctgctgctgcacatgaataac

SEQ ID NO: 498852 - DNA, 25 bp, Rattus norvegicus
gcgcctgtttgagccgttcgaagta

SEQ ID NO: 498853 - DNA, 25 bp, Rattus norvegicus
gttcgaagtacacacgcgactgcta

SEQ ID NO: 498854 - DNA, 25 bp, Rattus norvegicus
gccttctacctggaggcgcgctttg

SEQ ID NO: 498855 - DNA, 25 bp, Rattus norvegicus
ctttgtcagccttcgcgatggtttc

SEQ ID NO: 498856 - DNA, 25 bp, Rattus norvegicus
gcgccttgctgcgtttccggcagca

SEQ ID NO: 498857 - DNA, 25 bp, Rattus norvegicus
gcacatgaataacgcgcgctacctg

SEQ ID NO: 498858 - DNA, 25 bp, Rattus norvegicus
gcgtggaacactggcgactccgaca

SEQ ID NO: 498859 - DNA, 25 bp, Rattus norvegicus
aacactggcgactccgacaaatgga

SEQ ID NO: 498860 - DNA, 25 bp, Rattus norvegicus
actggcgactccgacaaatggagca

SEQ ID NO: 498861 - DNA, 25 bp, Rattus norvegicus
tggcgactccgacaaatggagcagc

SEQ ID NO: 498862 - DNA, 25 bp, Rattus norvegicus
cgactccgacaaatggagcagcagc

SEQ ID NO: 498863 - DNA, 25 bp, Rattus norvegicus
actccgacaaatggagcagcagctg

SEQ ID NO: 498864 - DNA, 25 bp, Rattus norvegicus
ctccgacaaatggagcagcagctgg

SEQ ID NO: 498865 - DNA, 25 bp, Rattus norvegicus
ctggaagctgaagggccgagaagct

SEQ ID NO: 498866 - DNA, 25 bp, Rattus norvegicus
agctgaagggccgagaagctggtgt

SEQ ID NO: 498867 - DNA, 25 bp, Rattus norvegicus
aggtgcgtggaacactggcgactcc

SEQ ID NO: 498868 - DNA, 25 bp, Rattus norvegicus
tggaacactggcgactccgacaaat

SEQ ID NO: 498869 - DNA, 25 bp, Rattus norvegicus
tgcgtggaacactggcgactccgac

SEQ ID NO: 498870 - DNA, 25 bp, Rattus norvegicus
gaacactggcgactccgacaaatgg

SEQ ID NO: 498871 - DNA, 25 bp, Rattus norvegicus
ggaacactggcgactccgacaaatg

SEQ ID NO: 498872 - DNA, 25 bp, Rattus norvegicus
atgtacgcgcgcgtgtacgcgagct

SEQ ID NO: 498873 - DNA, 25 bp, Rattus norvegicus
tcaacctgttgtgacacggggaacc

SEQ ID NO: 498874 - DNA, 25 bp, Rattus norvegicus
acctggacgagatcaacctgttgtg

SEQ ID NO: 498875 - DNA, 25 bp, Rattus norvegicus
gcccggtacctggacgagatcaacc

SEQ ID NO: 498876 - DNA, 25 bp, Rattus norvegicus
tgttcaaggacgtgcgggactcagt

SEQ ID NO: 498877 - DNA, 25 bp, Rattus norvegicus
gtccgcagcgtgttcaaggacgtgc

SEQ ID NO: 498878 - DNA, 25 bp, Rattus norvegicus
aagcgcttcatcttggacatgtacg

SEQ ID NO: 498879 - DNA, 25 bp, Rattus norvegicus
gcacagcgtccgcagcgtgttcaag

SEQ ID NO: 498880 - DNA, 25 bp, Rattus norvegicus
ttcacctgtgccacggacacgcaca

SEQ ID NO: 498881 - DNA, 25 bp, Rattus norvegicus
ttcatcttggacatgtacgcgcgcg

SEQ ID NO: 498882 - DNA, 25 bp, Rattus norvegicus
cgtgtacgcgagctgtgcagagccc

SEQ ID NO: 498883 - DNA, 25 bp, Rattus norvegicus
cttggacatgtacgcgcgcgtgtac

SEQ ID NO: 498884 - DNA, 25 bp, Rattus norvegicus
gcagaggccgccaagcgcttcatct

SEQ ID NO: 498885 - DNA, 25 bp, Rattus norvegicus
gccgcctcttcgcacacttcacctg

SEQ ID NO: 498886 - DNA, 25 bp, Rattus norvegicus
gcccttgcccttcaccaccacgata

SEQ ID NO: 498887 - DNA, 25 bp, Rattus norvegicus
ggtgcggagtgacctcgcccttgcc

SEQ ID NO: 498888 - DNA, 25 bp, Rattus norvegicus
cgatacctatcgtcatgcaaactca

SEQ ID NO: 498889 - DNA, 25 bp, Rattus norvegicus
tatcgtcatgcaaactcacccgtgg

SEQ ID NO: 498890 - DNA, 25 bp, Rattus norvegicus
aaactcacccgtggccgctcccagg

SEQ ID NO: 498891 - DNA, 25 bp, Rattus norvegicus
gtgaatctgtacacacttcgtgcgg

SEQ ID NO: 498892 - DNA, 25 bp, Rattus norvegicus
cccgcagtctgacagtgaatctgta

SEQ ID NO: 498893 - DNA, 25 bp, Rattus norvegicus
cacttcgtgcggtgtttgtaccgca

SEQ ID NO: 498894 - DNA, 25 bp, Rattus norvegicus
tgtttgtaccgcatcgcaggcaggt

SEQ ID NO: 498895 - DNA, 25 bp, Rattus norvegicus
agtaggctccgccaccgcaacagat

SEQ ID NO: 498896 - DNA, 25 bp, Rattus norvegicus
gcaacagatccgcagcgcagctcat

SEQ ID NO: 498897 - DNA, 25 bp, Rattus norvegicus
atccgcagcgcagctcattactggc

SEQ ID NO: 498898 - DNA, 25 bp, Rattus norvegicus
ggtccctcccgcagtctgacagtga

SEQ ID NO: 498899 - DNA, 25 bp, Rattus norvegicus
ctgtacacacttcgtgcggtgtttg

SEQ ID NO: 498900 - DNA, 25 bp, Rattus norvegicus
agagacccgcccacagcccgtagaa

SEQ ID NO: 498901 - DNA, 25 bp, Rattus norvegicus
gccttggccgcagcgtgtaggatct

SEQ ID NO: 498902 - DNA, 25 bp, Rattus norvegicus
acgcgttacgcgagggcccacacgg

SEQ ID NO: 498903 - DNA, 25 bp, Rattus norvegicus
ctcaggtgtccacgcgttacgcgag

SEQ ID NO: 498904 - DNA, 25 bp, Rattus norvegicus
tgagtctgctgagcccggcctcagg

SEQ ID NO: 498905 - DNA, 25 bp, Rattus norvegicus
cttcacccggaggtgagtctgctga

SEQ ID NO: 498906 - DNA, 25 bp, Rattus norvegicus
tatcttcggggctgcttcacccgga

SEQ ID NO: 498907 - DNA, 25 bp, Rattus norvegicus
ctcccgagccttcagcctttggtga

SEQ ID NO: 498908 - DNA, 25 bp, Rattus norvegicus
acagccagagctcccagagtccagc

SEQ ID NO: 498909 - DNA, 25 bp, Rattus norvegicus
tctcagaggagcgttgtgcagcaag

SEQ ID NO: 498910 - DNA, 25 bp, Rattus norvegicus
cgcccgccttctgggcaccactagg

SEQ ID NO: 498911 - DNA, 25 bp, Rattus norvegicus
acattgtgtgccgtgggccgcttag

SEQ ID NO: 498912 - DNA, 25 bp, Rattus norvegicus
ctctgacgccacattgtgtgccgtg

SEQ ID NO: 498913 - DNA, 25 bp, Rattus norvegicus
gcctttggtgatttccaggacctaa

SEQ ID NO: 498914 - DNA, 25 bp, Rattus norvegicus
tggcgcccttcgtccgcgcgcaact

SEQ ID NO: 498915 - DNA, 25 bp, Rattus norvegicus
cttcgccctgcacctgcgtggggag

SEQ ID NO: 498916 - DNA, 25 bp, Rattus norvegicus
acatccctggggtgtccgcactcgg

SEQ ID NO: 498917 - DNA, 25 bp, Rattus norvegicus
ggcgcactcacatccctggggtgtc

SEQ ID NO: 498918 - DNA, 25 bp, Rattus norvegicus
ggagcgatgcccttcggtctccctg

SEQ ID NO: 498919 - DNA, 25 bp, Rattus norvegicus
cgcagcttcgtctttcggggaacgc

SEQ ID NO: 498920 - DNA, 25 bp, Rattus norvegicus
agcttcgtctttcggggaacgcagc

SEQ ID NO: 498921 - DNA, 25 bp, Rattus norvegicus
ggaggccacgcagcaggtcgcccta

SEQ ID NO: 498922 - DNA, 25 bp, Rattus norvegicus
tctctccccaaggagcagtaggtgc

SEQ ID NO: 498923 - DNA, 25 bp, Rattus norvegicus
cagtaggtgcgtccggacaggaaaa

SEQ ID NO: 498924 - DNA, 25 bp, Rattus norvegicus
gaggagggagcgcaccttacctgcc

SEQ ID NO: 498925 - DNA, 25 bp, Rattus norvegicus
gagcgcaccttacctgccgacgggg

SEQ ID NO: 498926 - DNA, 25 bp, Rattus norvegicus
cgcctcggcgctcaccgcgaatcgg

SEQ ID NO: 498927 - DNA, 25 bp, Rattus norvegicus
tttcggggaacgcagccgcagacgc

SEQ ID NO: 498928 - DNA, 25 bp, Rattus norvegicus
acggagcatgcgttggtaccaccga

SEQ ID NO: 498929 - DNA, 25 bp, Rattus norvegicus
gcccgacgactaagaaaagacacga

SEQ ID NO: 498930 - DNA, 25 bp, Rattus norvegicus
tgcactactgagtcggccatgccgg

SEQ ID NO: 498931 - DNA, 25 bp, Rattus norvegicus
ccagtatgctggagccctgagaaga

SEQ ID NO: 498932 - DNA, 25 bp, Rattus norvegicus
gcccaaaagtttgcacaggcacaga

SEQ ID NO: 498933 - DNA, 25 bp, Rattus norvegicus
ggcacagaagcctccatacatcctg

SEQ ID NO: 498934 - DNA, 25 bp, Rattus norvegicus
catacatcctggcaagctaagctca

SEQ ID NO: 498935 - DNA, 25 bp, Rattus norvegicus
ctccagaagggcgtgactaaacagg

SEQ ID NO: 498936 - DNA, 25 bp, Rattus norvegicus
tctgtggactacctcagcggtgttg

SEQ ID NO: 498937 - DNA, 25 bp, Rattus norvegicus
aaggccggcttctgagtcttttctc

SEQ ID NO: 498938 - DNA, 25 bp, Rattus norvegicus
ctttctgcgtgtgtactcggtatcc

SEQ ID NO: 498939 - DNA, 25 bp, Rattus norvegicus
gcgctcggcacccatcaggtacttt

SEQ ID NO: 498940 - DNA, 25 bp, Rattus norvegicus
tcaagtgggcattgttaacggtcgc

SEQ ID NO: 498941 - DNA, 25 bp, Rattus norvegicus
ccgcagcattacgagggcagtgtct

SEQ ID NO: 498942 - DNA, 25 bp, Rattus norvegicus
tttcatgcgcgtgggtgcctatctc

SEQ ID NO: 498943 - DNA, 25 bp, Rattus norvegicus
cagtggttccaatcgggacccttcg

SEQ ID NO: 498944 - DNA, 25 bp, Rattus norvegicus
tagggcggccgtacagtgtccgccc

SEQ ID NO: 498945 - DNA, 25 bp, Rattus norvegicus
tcaacctaggagaccctgtagggcg

SEQ ID NO: 498946 - DNA, 25 bp, Rattus norvegicus
tggtttcaacctaggagaccctgta

SEQ ID NO: 498947 - DNA, 25 bp, Rattus norvegicus
ggtcctctgagtggtttcaacctag

SEQ ID NO: 498948 - DNA, 25 bp, Rattus norvegicus
gcccgggtcctctgagtggtttcaa

SEQ ID NO: 498949 - DNA, 25 bp, Rattus norvegicus
ggcctcctccctttcgcaaggtgag

SEQ ID NO: 498950 - DNA, 25 bp, Rattus norvegicus
ggtgcctatctctttctcccgcagt

SEQ ID NO: 498951 - DNA, 25 bp, Rattus norvegicus
ccctttcgcaaggtgagtggtcgcc

SEQ ID NO: 498952 - DNA, 25 bp, Rattus norvegicus
cccttcgtttcatgcgcgtgggtgc

SEQ ID NO: 498953 - DNA, 25 bp, Rattus norvegicus
aatcgggacccttcgtttcatgcgc

SEQ ID NO: 498954 - DNA, 25 bp, Rattus norvegicus
tggtcctccggggtccagagcgtcc

SEQ ID NO: 498955 - DNA, 25 bp, Rattus norvegicus
tttctcccgcagtgacttcggtcac

SEQ ID NO: 498956 - DNA, 25 bp, Rattus norvegicus
cctgcgaagccgagcgagccgtgct

SEQ ID NO: 498957 - DNA, 25 bp, Rattus norvegicus
aggtgagtcatgtcgctgaagtttg

SEQ ID NO: 498958 - DNA, 25 bp, Rattus norvegicus
gcttcttgcagtggggaccctgagc

SEQ ID NO: 498959 - DNA, 25 bp, Rattus norvegicus
gtgtggccctctccgcttcaccacg

SEQ ID NO: 498960 - DNA, 25 bp, Rattus norvegicus
tgtcatcgcgccgtgcgtgtgtgtc

SEQ ID NO: 498961 - DNA, 25 bp, Rattus norvegicus
ggccactctcccgtggtgtgtgtcc

SEQ ID NO: 498962 - DNA, 25 bp, Rattus norvegicus
ctttgttgctctggctgcggccact

SEQ ID NO: 498963 - DNA, 25 bp, Rattus norvegicus
caacttctgggtcctgggctccttt

SEQ ID NO: 498964 - DNA, 25 bp, Rattus norvegicus
acaagcccttcctcctcgggccgca

SEQ ID NO: 498965 - DNA, 25 bp, Rattus norvegicus
accctccgcggccacacaagccctt

SEQ ID NO: 498966 - DNA, 25 bp, Rattus norvegicus
cactcgcacactctcgcacctcgta

SEQ ID NO: 498967 - DNA, 25 bp, Rattus norvegicus
gtctcgctggtgtcagctccgacca

SEQ ID NO: 498968 - DNA, 25 bp, Rattus norvegicus
ccacggctccggcttcttgcagtgg

SEQ ID NO: 498969 - DNA, 25 bp, Rattus norvegicus
tcatgtcgctgaagtttgttttctt

SEQ ID NO: 498970 - DNA, 25 bp, Rattus norvegicus
tcccaacgtgtctggtgtgacccgg

SEQ ID NO: 498971 - DNA, 25 bp, Rattus norvegicus
ggattcggcaggtcactgagcccta

SEQ ID NO: 498972 - DNA, 25 bp, Rattus norvegicus
aacgtgtctggtgtgacccggcgca

SEQ ID NO: 498973 - DNA, 25 bp, Rattus norvegicus
caggagcaggattcggcaggtcact

SEQ ID NO: 498974 - DNA, 25 bp, Rattus norvegicus
tcggcaggtcactgagccctatctc

SEQ ID NO: 498975 - DNA, 25 bp, Rattus norvegicus
actgagccctatctcgcctgagttc

SEQ ID NO: 498976 - DNA, 25 bp, Rattus norvegicus
ctcgcctgagttccggcccacccgc

SEQ ID NO: 498977 - DNA, 25 bp, Rattus norvegicus
cccacccgccttacccggctctgct

SEQ ID NO: 498978 - DNA, 25 bp, Rattus norvegicus
gacatgctggaaacgccggcacaga

SEQ ID NO: 498979 - DNA, 25 bp, Rattus norvegicus
aacgccggcacagagctctgagcca

SEQ ID NO: 498980 - DNA, 25 bp, Rattus norvegicus
gccatagcagcagcatgcgtgtgcg

SEQ ID NO: 498981 - DNA, 25 bp, Rattus norvegicus
tagcagcagcatgcgtgtgcgtcgt

SEQ ID NO: 498982 - DNA, 25 bp, Rattus norvegicus
gaatttcccaacgtgtctggtgtga

SEQ ID NO: 498983 - DNA, 25 bp, Rattus norvegicus
ggtcactgagccctatctcgcctga

SEQ ID NO: 498984 - DNA, 25 bp, Rattus norvegicus
actctggttggtagtagtttctatc

SEQ ID NO: 498985 - DNA, 25 bp, Rattus norvegicus
aacctcccgcgttgtgcagtgcggc

SEQ ID NO: 498986 - DNA, 25 bp, Rattus norvegicus
cccagttctgctagtcttttcctaa

SEQ ID NO: 498987 - DNA, 25 bp, Rattus norvegicus
taaagccctgaagtccctgcagagg

SEQ ID NO: 498988 - DNA, 25 bp, Rattus norvegicus
tgccggggtgacgagataaagccct

SEQ ID NO: 498989 - DNA, 25 bp, Rattus norvegicus
tgtaaacatttttggagcagtcctg

SEQ ID NO: 498990 - DNA, 25 bp, Rattus norvegicus
gttctggaagcaagcggaccgacca

SEQ ID NO: 498991 - DNA, 25 bp, Rattus norvegicus
gcccgcctttctcttactctggttg

SEQ ID NO: 498992 - DNA, 25 bp, Rattus norvegicus
gtttctatccatcgaagcagctttc

SEQ ID NO: 498993 - DNA, 25 bp, Rattus norvegicus
accaagtttttgcaggcgtggcctc

SEQ ID NO: 498994 - DNA, 25 bp, Rattus norvegicus
tgggcagcaatgatcctcgaggaga

SEQ ID NO: 498995 - DNA, 25 bp, Rattus norvegicus
aggacagccctcgtcagcagaacga

SEQ ID NO: 498996 - DNA, 25 bp, Rattus norvegicus
agcagctttcacctctgattggaca

SEQ ID NO: 498997 - DNA, 25 bp, Rattus norvegicus
cccggttgctaagagtaaccagatc

SEQ ID NO: 498998 - DNA, 25 bp, Rattus norvegicus
ctcacatgctgccatctgtcggcga

SEQ ID NO: 498999 - DNA, 25 bp, Rattus norvegicus
tccagatgcgcagagcccatggccg

SEQ ID NO: 499000 - DNA, 25 bp, Rattus norvegicus
gcagttcatcgtgtcacctcccgtg

SEQ ID NO: 499001 - DNA, 25 bp, Rattus norvegicus
cactggcggtggcagttcatcgtgt

SEQ ID NO: 499002 - DNA, 25 bp, Rattus norvegicus
caccttatccactttgcccgggttg

SEQ ID NO: 499003 - DNA, 25 bp, Rattus norvegicus
gtgtgatccgcggttcccaccttat

SEQ ID NO: 499004 - DNA, 25 bp, Rattus norvegicus
ctgcgtgcagacagctgtgtgatcc

SEQ ID NO: 499005 - DNA, 25 bp, Rattus norvegicus
ccaaaggcgcacagctgcgtgcaga

SEQ ID NO: 499006 - DNA, 25 bp, Rattus norvegicus
ttgtcttccaaaggcgcacagctgc

SEQ ID NO: 499007 - DNA, 25 bp, Rattus norvegicus
cgcgtgcgcaagagttgtcttccaa

SEQ ID NO: 499008 - DNA, 25 bp, Rattus norvegicus
ctcgcgcgcgcataggtctgagcgc

SEQ ID NO: 499009 - DNA, 25 bp, Rattus norvegicus
gaaccggttctgtacttcagctccc

SEQ ID NO: 499010 - DNA, 25 bp, Rattus norvegicus
tccgcatccgcgaaccggttctgta

SEQ ID NO: 499011 - DNA, 25 bp, Rattus norvegicus
gctgccatctgtcggcgatggaacc

SEQ ID NO: 499012 - DNA, 25 bp, Rattus norvegicus
tccttgtacaggtcccgctccttgg

SEQ ID NO: 499013 - DNA, 25 bp, Rattus norvegicus
ggcaaagtctagacggcgaccctga

SEQ ID NO: 499014 - DNA, 25 bp, Rattus norvegicus
ggtcccgcgctcacagaaagaagtc

SEQ ID NO: 499015 - DNA, 25 bp, Rattus norvegicus
cgaccctgaagacgctcggaccggg

SEQ ID NO: 499016 - DNA, 25 bp, Rattus norvegicus
cacagaaagaagtcgggtgcgcctt

SEQ ID NO: 499017 - DNA, 25 bp, Rattus norvegicus
cgcaccgcggtaagtacctggagct

SEQ ID NO: 499018 - DNA, 25 bp, Rattus norvegicus
ccacctggctctggagctggcactt

SEQ ID NO: 499019 - DNA, 25 bp, Rattus norvegicus
agctggcacttctcgctctccagaa

SEQ ID NO: 499020 - DNA, 25 bp, Rattus norvegicus
ctctccagaatgtgccgctgctgca

SEQ ID NO: 499021 - DNA, 25 bp, Rattus norvegicus
cgccgcttctgtttcagtcggatga

SEQ ID NO: 499022 - DNA, 25 bp, Rattus norvegicus
cctccttgctgaagccgcggagctg

SEQ ID NO: 499023 - DNA, 25 bp, Rattus norvegicus
ggtcgtcggagaagcgctcctccaa

SEQ ID NO: 499024 - DNA, 25 bp, Rattus norvegicus
ccggaaggcctcataggccgcagca

SEQ ID NO: 499025 - DNA, 25 bp, Rattus norvegicus
ttcaggtggtgctgatacccgctca

SEQ ID NO: 499026 - DNA, 25 bp, Rattus norvegicus
catcatcttgatgcgcccggaagta

SEQ ID NO: 499027 - DNA, 25 bp, Rattus norvegicus
ctctgaagtccagcccgctcatttg

SEQ ID NO: 499028 - DNA, 25 bp, Rattus norvegicus
cgctcatttgcccagaagcctggtg

SEQ ID NO: 499029 - DNA, 25 bp, Rattus norvegicus
aagcctggtggcttctgttacccgc

SEQ ID NO: 499030 - DNA, 25 bp, Rattus norvegicus
tgacgaccatcaggagaccgcaacc

SEQ ID NO: 499031 - DNA, 25 bp, Rattus norvegicus
cctggaggtcagctgacgcgaccac

SEQ ID NO: 499032 - DNA, 25 bp, Rattus norvegicus
cagcacccgcttctgagagggtcta

SEQ ID NO: 499033 - DNA, 25 bp, Rattus norvegicus
gggtctacggcgatcacaagaaaca

SEQ ID NO: 499034 - DNA, 25 bp, Rattus norvegicus
tcaccctgcaggaggcgtatctgcc

SEQ ID NO: 499035 - DNA, 25 bp, Rattus norvegicus
aacgtcatcactgcgcgactgtttc

SEQ ID NO: 499036 - DNA, 25 bp, Rattus norvegicus
ggcttccgaaccagccgagcctgga

SEQ ID NO: 499037 - DNA, 25 bp, Rattus norvegicus
cgccgatcttcactatgcgttgata

SEQ ID NO: 499038 - DNA, 25 bp, Rattus norvegicus
agaccaccgtgctgtcgactcctga

SEQ ID NO: 499039 - DNA, 25 bp, Rattus norvegicus
gggccgagagaacgccgatcttcac

SEQ ID NO: 499040 - DNA, 25 bp, Rattus norvegicus
ttccaccgcgcacggagccgtttaa

SEQ ID NO: 499041 - DNA, 25 bp, Rattus norvegicus
ccacagcttctgagaggccgcaacg

SEQ ID NO: 499042 - DNA, 25 bp, Rattus norvegicus
gtacgacctgcagggccagccatac

SEQ ID NO: 499043 - DNA, 25 bp, Rattus norvegicus
gttcaccgtgtaccgcatgcagcag

SEQ ID NO: 499044 - DNA, 25 bp, Rattus norvegicus
acgccgcgcacgagttcaccgtgta

SEQ ID NO: 499045 - DNA, 25 bp, Rattus norvegicus
gccgctcggctttatcgtcttcttg

SEQ ID NO: 499046 - DNA, 25 bp, Rattus norvegicus
tgctcgagaacgtgctgaaggcgtc

SEQ ID NO: 499047 - DNA, 25 bp, Rattus norvegicus
gcagccgcccatgctgagctgagtc

SEQ ID NO: 499048 - DNA, 25 bp, Rattus norvegicus
atccgtggttctgcccgaaggacct

SEQ ID NO: 499049 - DNA, 25 bp, Rattus norvegicus
agcgctgcccgaaggaccctagggc

SEQ ID NO: 499050 - DNA, 25 bp, Rattus norvegicus
cgaggttcgctcacaagaaagacta

SEQ ID NO: 499051 - DNA, 25 bp, Rattus norvegicus
cttagtatgcctacaactcccagcg

SEQ ID NO: 499052 - DNA, 25 bp, Rattus norvegicus
ggccgcaacgcgagtcttagtatgc

SEQ ID NO: 499053 - DNA, 25 bp, Rattus norvegicus
acatttcccgaaaagcgatgcggca

SEQ ID NO: 499054 - DNA, 25 bp, Rattus norvegicus
tccggcgtaggaatggactatcgtc

SEQ ID NO: 499055 - DNA, 25 bp, Rattus norvegicus
gacagcatggatcgtgcccacaaat

SEQ ID NO: 499056 - DNA, 25 bp, Rattus norvegicus
caaatcttgataccgggtctggctc

SEQ ID NO: 499057 - DNA, 25 bp, Rattus norvegicus
cgggtctggctcaacgaggttcaag

SEQ ID NO: 499058 - DNA, 25 bp, Rattus norvegicus
caacgaggttcaaggcagctccatc

SEQ ID NO: 499059 - DNA, 25 bp, Rattus norvegicus
aggctccggcgtaggaatggactat

SEQ ID NO: 499060 - DNA, 25 bp, Rattus norvegicus
cgaggaaaccgcagactccgggtcg

SEQ ID NO: 499061 - DNA, 25 bp, Rattus norvegicus
tggatcgtgcccacaaatcttgata

SEQ ID NO: 499062 - DNA, 25 bp, Rattus norvegicus
atggactatcgtcgtagagcggatg

SEQ ID NO: 499063 - DNA, 25 bp, Rattus norvegicus
gagctgcgtgtttggacctgcgccc

SEQ ID NO: 499064 - DNA, 25 bp, Rattus norvegicus
cgtgtttggacctgcgcccgggcaa

SEQ ID NO: 499065 - DNA, 25 bp, Rattus norvegicus
cagacacgtgcgctgccgaggaaac

SEQ ID NO: 499066 - DNA, 25 bp, Rattus norvegicus
tgcgctgccgaggaaaccgcagact

SEQ ID NO: 499067 - DNA, 25 bp, Rattus norvegicus
aggcagctccatcggcctgcaaggc

SEQ ID NO: 499068 - DNA, 25 bp, Rattus norvegicus
cagcggtcagggcaaaggaacctcc

SEQ ID NO: 499069 - DNA, 25 bp, Rattus norvegicus
cgcagggtacacaggctctggatta

SEQ ID NO: 499070 - DNA, 25 bp, Rattus norvegicus
agctccatctccattccgcagggta

SEQ ID NO: 499071 - DNA, 25 bp, Rattus norvegicus
cccattgtagcctggtagaggtcgg

SEQ ID NO: 499072 - DNA, 25 bp, Rattus norvegicus
gttcgaactctgcttcctcacatgc

SEQ ID NO: 499073 - DNA, 25 bp, Rattus norvegicus
agtggcggaagaagagttcgaactc

SEQ ID NO: 499074 - DNA, 25 bp, Rattus norvegicus
tatacagtcctgcaggccagcggtc

SEQ ID NO: 499075 - DNA, 25 bp, Rattus norvegicus
aggcgcgaagaaagcgtatacagtc

SEQ ID NO: 499076 - DNA, 25 bp, Rattus norvegicus
tgctggtcgtggaactacctgcatc

SEQ ID NO: 499077 - DNA, 25 bp, Rattus norvegicus
gctctggattaatggcgcctactcc

SEQ ID NO: 499078 - DNA, 25 bp, Rattus norvegicus
cgactcacgcggaaggaggtccttt

SEQ ID NO: 499079 - DNA, 25 bp, Rattus norvegicus
gggcacaggtccagacaaccgactc

SEQ ID NO: 499080 - DNA, 25 bp, Rattus norvegicus
aggaggtcctttcccggcagaagtg

SEQ ID NO: 499081 - DNA, 25 bp, Rattus norvegicus
acctgcatcgcgcagacggaaggcg

SEQ ID NO: 499082 - DNA, 25 bp, Rattus norvegicus
cctctgcgtccttgtgcaggaagta

SEQ ID NO: 499083 - DNA, 25 bp, Rattus norvegicus
gcttctaggcgccaggcaatccgca

SEQ ID NO: 499084 - DNA, 25 bp, Rattus norvegicus
aggcgccaggcaatccgcagggcct

SEQ ID NO: 499085 - DNA, 25 bp, Rattus norvegicus
cctcggcggcatggtggcgacactc

SEQ ID NO: 499086 - DNA, 25 bp, Rattus norvegicus
tcgtaggtcggcttgctaagccagg

SEQ ID NO: 499087 - DNA, 25 bp, Rattus norvegicus
gaagtaccagtagggcaaggcagaa

SEQ ID NO: 499088 - DNA, 25 bp, Rattus norvegicus
cccgttttgacccagctcgcttgtt

SEQ ID NO: 499089 - DNA, 25 bp, Rattus norvegicus
cccagctcgcttgtttcctacagta

SEQ ID NO: 499090 - DNA, 25 bp, Rattus norvegicus
gtttcctacagtattgcggctccga

SEQ ID NO: 499091 - DNA, 25 bp, Rattus norvegicus
acagtattgcggctccgacggtctc

SEQ ID NO: 499092 - DNA, 25 bp, Rattus norvegicus
tattgcggctccgacggtctctgcg

SEQ ID NO: 499093 - DNA, 25 bp, Rattus norvegicus
cgacactcggcgctgtcgtaggtcg

SEQ ID NO: 499094 - DNA, 25 bp, Rattus norvegicus
cgtccttgtgcaggaagtaccagta

SEQ ID NO: 499095 - DNA, 25 bp, Rattus norvegicus
agtaccctccgcctgactggctcgc

SEQ ID NO: 499096 - DNA, 25 bp, Rattus norvegicus
ggcctactccatcaaagacaagcta

SEQ ID NO: 499097 - DNA, 25 bp, Rattus norvegicus
cggtaccttgccctcagagcatgca

SEQ ID NO: 499098 - DNA, 25 bp, Rattus norvegicus
ccaccatggtagaagccagaggaca

SEQ ID NO: 499099 - DNA, 25 bp, Rattus norvegicus
gcacttcaccgaggaggtatcgcta

SEQ ID NO: 499100 - DNA, 25 bp, Rattus norvegicus
cgctagcggccaagaaccggatctc

SEQ ID NO: 499101 - DNA, 25 bp, Rattus norvegicus
gggacacaacccttggcacgcggta

SEQ ID NO: 499102 - DNA, 25 bp, Rattus norvegicus
tcagactcgctatctcgggtggtcc

SEQ ID NO: 499103 - DNA, 25 bp, Rattus norvegicus
cgagcccaagttgcgctggtttttg

SEQ ID NO: 499104 - DNA, 25 bp, Rattus norvegicus
gtggccgtgaagatgactttccgta

SEQ ID NO: 499105 - DNA, 25 bp, Rattus norvegicus
tctggccaacgaggaggagatcgac

SEQ ID NO: 499106 - DNA, 25 bp, Rattus norvegicus
cgtctactcgtggttcctcaccttg

SEQ ID NO: 499107 - DNA, 25 bp, Rattus norvegicus
tacaagccatcgagcgcgtcaaggg

SEQ ID NO: 499108 - DNA, 25 bp, Rattus norvegicus
ggtgacgcacccaagaccagacttg

SEQ ID NO: 499109 - DNA, 25 bp, Rattus norvegicus
aaacgccgcggcacagaccacgaaa

SEQ ID NO: 499110 - DNA, 25 bp, Rattus norvegicus
ttggacaccaaacatctggagcacc

SEQ ID NO: 499111 - DNA, 25 bp, Rattus norvegicus
gcaagctcctcagaggcgtcccaga

SEQ ID NO: 499112 - DNA, 25 bp, Rattus norvegicus
gcgtacatccggcaagctcctcaga

SEQ ID NO: 499113 - DNA, 25 bp, Rattus norvegicus
tgtcccaacaccaagtacacggcgt

SEQ ID NO: 499114 - DNA, 25 bp, Rattus norvegicus
gcacccgacagcctcgggatatttc

SEQ ID NO: 499115 - DNA, 25 bp, Rattus norvegicus
atatttcccgccagcggggtgcagg

SEQ ID NO: 499116 - DNA, 25 bp, Rattus norvegicus
gcaggagcaccaggcgctacccgga

SEQ ID NO: 499117 - DNA, 25 bp, Rattus norvegicus
ggaaccgcactctcgggctctgcga

SEQ ID NO: 499118 - DNA, 25 bp, Rattus norvegicus
aacctgccttgctgctggccgactg

SEQ ID NO: 499119 - DNA, 25 bp, Rattus norvegicus
tgagtctccagaaccacagagcccg

SEQ ID NO: 499120 - DNA, 25 bp, Rattus norvegicus
ccacagggcaaacgcggaaagcggc

SEQ ID NO: 499121 - DNA, 25 bp, Rattus norvegicus
ttgcccgggttactgtagctccgcc

SEQ ID NO: 499122 - DNA, 25 bp, Rattus norvegicus
cacgcctgtgcgtacatccggcaag

SEQ ID NO: 499123 - DNA, 25 bp, Rattus norvegicus
gccctatggtgaggacgccttccct

SEQ ID NO: 499124 - DNA, 25 bp, Rattus norvegicus
cggctgcttgaaggctagctgctca

SEQ ID NO: 499125 - DNA, 25 bp, Rattus norvegicus
gaatctggcccggaagtctgtgaca

SEQ ID NO: 499126 - DNA, 25 bp, Rattus norvegicus
tcctagagtgcctacggatgtcctc

SEQ ID NO: 499127 - DNA, 25 bp, Rattus norvegicus
gctcagcgagttgattggtgtcccg

SEQ ID NO: 499128 - DNA, 25 bp, Rattus norvegicus
cacttcgcttttgcgggtgtccgca

SEQ ID NO: 499129 - DNA, 25 bp, Rattus norvegicus
gtgtccgcaactcctcgcttggttc

SEQ ID NO: 499130 - DNA, 25 bp, Rattus norvegicus
cggagccttgcatcttctcgcggaa

SEQ ID NO: 499131 - DNA, 25 bp, Rattus norvegicus
ttctcgcggaactgatgcttggacc

SEQ ID NO: 499132 - DNA, 25 bp, Rattus norvegicus
ggtcttccgcggacatagaggccct

SEQ ID NO: 499133 - DNA, 25 bp, Rattus norvegicus
tgcacactcagctttgcagcctgcg

SEQ ID NO: 499134 - DNA, 25 bp, Rattus norvegicus
gcaggtgcgcacaacgctgctgttc

SEQ ID NO: 499135 - DNA, 25 bp, Rattus norvegicus
tcctccagctgaccgcaggaatctg

SEQ ID NO: 499136 - DNA, 25 bp, Rattus norvegicus
gccgaaccattcacgtgcgcaaaca

SEQ ID NO: 499137 - DNA, 25 bp, Rattus norvegicus
tagaggccctcaagcgctgcacact

SEQ ID NO: 499138 - DNA, 25 bp, Rattus norvegicus
gttgatgtcagagcggtgtgaagcc

SEQ ID NO: 499139 - DNA, 25 bp, Rattus norvegicus
caggaactggggaatcgtttgaagg

SEQ ID NO: 499140 - DNA, 25 bp, Rattus norvegicus
gcagacttccgccttcttgtctggc

SEQ ID NO: 499141 - DNA, 25 bp, Rattus norvegicus
ctgcaggaactggggaatcgtttga

SEQ ID NO: 499142 - DNA, 25 bp, Rattus norvegicus
ctggagagttgatgtcagagcggtg

SEQ ID NO: 499143 - DNA, 25 bp, Rattus norvegicus
tcttgtctggccagttctttaagta

SEQ ID NO: 499144 - DNA, 25 bp, Rattus norvegicus
gccttcttgtctggccagttcttta

SEQ ID NO: 499145 - DNA, 25 bp, Rattus norvegicus
ccgccttcttgtctggccagttctt

SEQ ID NO: 499146 - DNA, 25 bp, Rattus norvegicus
agacttccgccttcttgtctggcca

SEQ ID NO: 499147 - DNA, 25 bp, Rattus norvegicus
tccgccttcttgtctggccagttct

SEQ ID NO: 499148 - DNA, 25 bp, Rattus norvegicus
ttccgccttcttgtctggccagttc

SEQ ID NO: 499149 - DNA, 25 bp, Rattus norvegicus
cttccgccttcttgtctggccagtt

SEQ ID NO: 499150 - DNA, 25 bp, Rattus norvegicus
gacttccgccttcttgtctggccag

SEQ ID NO: 499151 - DNA, 25 bp, Rattus norvegicus
cgccttcttgtctggccagttcttt

SEQ ID NO: 499152 - DNA, 25 bp, Rattus norvegicus
gtttcctgcttctcgctggtaccgc

SEQ ID NO: 499153 - DNA, 25 bp, Rattus norvegicus
cttgcgctaaatccgacccggcatt

SEQ ID NO: 499154 - DNA, 25 bp, Rattus norvegicus
cttccgatgcgtcggtgtcttgctg

SEQ ID NO: 499155 - DNA, 25 bp, Rattus norvegicus
agcgctcttccggagcgggctaacg

SEQ ID NO: 499156 - DNA, 25 bp, Rattus norvegicus
taacggcgatgcctctccggtgagt

SEQ ID NO: 499157 - DNA, 25 bp, Rattus norvegicus
ctctccggtgagtacggaccctcta

SEQ ID NO: 499158 - DNA, 25 bp, Rattus norvegicus
ctgctttgggctgctctgcttcgcc

SEQ ID NO: 499159 - DNA, 25 bp, Rattus norvegicus
ccatggcactgtcgcttgggtttcc

SEQ ID NO: 499160 - DNA, 25 bp, Rattus norvegicus
aacggcctggctgctttgggctgct

SEQ ID NO: 499161 - DNA, 25 bp, Rattus norvegicus
tttgaaggagccgaacggcctggct

SEQ ID NO: 499162 - DNA, 25 bp, Rattus norvegicus
agccgagttgactggtgaagctgca

SEQ ID NO: 499163 - DNA, 25 bp, Rattus norvegicus
caggttggcgtctttccgctggaga

SEQ ID NO: 499164 - DNA, 25 bp, Rattus norvegicus
agcagattcaggttggcgtctttcc

SEQ ID NO: 499165 - DNA, 25 bp, Rattus norvegicus
tttaagtagccggaagcagattcag

SEQ ID NO: 499166 - DNA, 25 bp, Rattus norvegicus
agagcggcacgcagccgagttgact

SEQ ID NO: 499167 - DNA, 25 bp, Rattus norvegicus
tcagagcggcacgcagccgagttga

SEQ ID NO: 499168 - DNA, 25 bp, Rattus norvegicus
gtcagagcggcacgcagccgagttg

SEQ ID NO: 499169 - DNA, 25 bp, Rattus norvegicus
gagcggcacgcagccgagttgactg

SEQ ID NO: 499170 - DNA, 25 bp, Rattus norvegicus
agcggcacgcagccgagttgactgg

SEQ ID NO: 499171 - DNA, 25 bp, Rattus norvegicus
caagagctggggaatcctttgaagg

SEQ ID NO: 499172 - DNA, 25 bp, Rattus norvegicus
tagaagtcagagcggcacgcagccg

SEQ ID NO: 499173 - DNA, 25 bp, Rattus norvegicus
gcaagagctggggaatcctttgaag

SEQ ID NO: 499174 - DNA, 25 bp, Rattus norvegicus
agaagtcagagcggcacgcagccga

SEQ ID NO: 499175 - DNA, 25 bp, Rattus norvegicus
gtagaagtcagagcggcacgcagcc

SEQ ID NO: 499176 - DNA, 25 bp, Rattus norvegicus
agtagaagtcagagcggcacgcagc

SEQ ID NO: 499177 - DNA, 25 bp, Rattus norvegicus
agagtagaagtcagagcggcacgca

SEQ ID NO: 499178 - DNA, 25 bp, Rattus norvegicus
agtcagagcggcacgcagccgagtt

SEQ ID NO: 499179 - DNA, 25 bp, Rattus norvegicus
aagtcagagcggcacgcagccgagt

SEQ ID NO: 499180 - DNA, 25 bp, Rattus norvegicus
gcagcctgggctcttaacatgtgtt

SEQ ID NO: 499181 - DNA, 25 bp, Rattus norvegicus
cttatcatccaggaagcgttgcttc

SEQ ID NO: 499182 - DNA, 25 bp, Rattus norvegicus
gagttcttgtcggagacgcccattg

SEQ ID NO: 499183 - DNA, 25 bp, Rattus norvegicus
gctggcgcatgttctgcagtaactg

SEQ ID NO: 499184 - DNA, 25 bp, Rattus norvegicus
gctccaggttctgcatgtccacgtg

SEQ ID NO: 499185 - DNA, 25 bp, Rattus norvegicus
ctgtgtcatgttttctgcgcgcttc

SEQ ID NO: 499186 - DNA, 25 bp, Rattus norvegicus
gacaaatgacccgatgcgcaagtta

SEQ ID NO: 499187 - DNA, 25 bp, Rattus norvegicus
tgcctcccgctcgaaagcagactta

SEQ ID NO: 499188 - DNA, 25 bp, Rattus norvegicus
ctcactggacagtacggatggactc

SEQ ID NO: 499189 - DNA, 25 bp, Rattus norvegicus
ggagcaatcacagacccagccttaa

SEQ ID NO: 499190 - DNA, 25 bp, Rattus norvegicus
accagccgtgcatgtgctccaggtt

SEQ ID NO: 499191 - DNA, 25 bp, Rattus norvegicus
tgcgcgcttcttcatttcctgcagc

SEQ ID NO: 499192 - DNA, 25 bp, Rattus norvegicus
ccctctggagaagcctcatgagttc

SEQ ID NO: 499193 - DNA, 25 bp, Rattus norvegicus
agcgtgcgcgctcacataaccgaca

SEQ ID NO: 499194 - DNA, 25 bp, Rattus norvegicus
agctcccttcagtgcggttcgtacc

SEQ ID NO: 499195 - DNA, 25 bp, Rattus norvegicus
ccagtgttgtccaccggcactgcaa

SEQ ID NO: 499196 - DNA, 25 bp, Rattus norvegicus
ctcccattccgcagatgatcctgga

SEQ ID NO: 499197 - DNA, 25 bp, Rattus norvegicus
gccgcagccctcgagaggaagactt

SEQ ID NO: 499198 - DNA, 25 bp, Rattus norvegicus
acccggccgaaggatgtttggcatc

SEQ ID NO: 499199 - DNA, 25 bp, Rattus norvegicus
agggcttcccagaggcaatcgctca

SEQ ID NO: 499200 - DNA, 25 bp, Rattus norvegicus
tcaggcggccaatcagcctctgatc

SEQ ID NO: 499201 - DNA, 25 bp, Rattus norvegicus
ccctccaggtgaagactcacgttag

SEQ ID NO: 499202 - DNA, 25 bp, Rattus norvegicus
tgcggtccctttccgtgaccgactg

SEQ ID NO: 499203 - DNA, 25 bp, Rattus norvegicus
ctccgcaccctcaggggtaagtcga

SEQ ID NO: 499204 - DNA, 25 bp, Rattus norvegicus
gaagttcgcaggcagagttcagacc

SEQ ID NO: 499205 - DNA, 25 bp, Rattus norvegicus
ttctgtgtagggcaaccaacgtgtg

SEQ ID NO: 499206 - DNA, 25 bp, Rattus norvegicus
cctcagaatggccatggtcacgatc

SEQ ID NO: 499207 - DNA, 25 bp, Rattus norvegicus
aaacgcggacccaaacctcagaatg

SEQ ID NO: 499208 - DNA, 25 bp, Rattus norvegicus
tgcccagcacctagtgcaaagtcgt

SEQ ID NO: 499209 - DNA, 25 bp, Rattus norvegicus
gtcggcctgctcgaagcttctcaaa

SEQ ID NO: 499210 - DNA, 25 bp, Rattus norvegicus
tgtacatcagcaccgagttctggga

SEQ ID NO: 499211 - DNA, 25 bp, Rattus norvegicus
ggcacatattccagtcgttggtgta

SEQ ID NO: 499212 - DNA, 25 bp, Rattus norvegicus
cgagatgcgctggatggcacatatt

SEQ ID NO: 499213 - DNA, 25 bp, Rattus norvegicus
aacgctggcccagattgggacgcga

SEQ ID NO: 499214 - DNA, 25 bp, Rattus norvegicus
cagccgctcaggtaggaagccaggc

SEQ ID NO: 499215 - DNA, 25 bp, Rattus norvegicus
agcttctcaaagaggccctgtgggc

SEQ ID NO: 499216 - DNA, 25 bp, Rattus norvegicus
gcaaagtcgtcagggtccgcaaagc

SEQ ID NO: 499217 - DNA, 25 bp, Rattus norvegicus
tagcggtgtccaggccttgcctcaa

SEQ ID NO: 499218 - DNA, 25 bp, Rattus norvegicus
ggccttgcctcaaagttgcttggca

SEQ ID NO: 499219 - DNA, 25 bp, Rattus norvegicus
ttgcttggcatggaaaacgctggcc

SEQ ID NO: 499220 - DNA, 25 bp, Rattus norvegicus
gaagccaggcgccagtgacgcagcc

SEQ ID NO: 499221 - DNA, 25 bp, Rattus norvegicus
caggctctgcctccgtagcggtgtc

SEQ ID NO: 499222 - DNA, 25 bp, Rattus norvegicus
gcccgacggcatgaaggacctggac

SEQ ID NO: 499223 - DNA, 25 bp, Rattus norvegicus
cgaagcggccgcaccacagctcctg

SEQ ID NO: 499224 - DNA, 25 bp, Rattus norvegicus
tcttcgtgggccaaatcccgcgtca

SEQ ID NO: 499225 - DNA, 25 bp, Rattus norvegicus
cgtgggccaaatcccgcgtcatttg

SEQ ID NO: 499226 - DNA, 25 bp, Rattus norvegicus
tcccgcgtcatttgcacgaacagga

SEQ ID NO: 499227 - DNA, 25 bp, Rattus norvegicus
tttgcacgaacaggacctcaagccg

SEQ ID NO: 499228 - DNA, 25 bp, Rattus norvegicus
cctcaagccgctatttgagcagttc

SEQ ID NO: 499229 - DNA, 25 bp, Rattus norvegicus
gctatttgagcagttcggccgcatc

SEQ ID NO: 499230 - DNA, 25 bp, Rattus norvegicus
cgcatctacgagctcacagtgctca

SEQ ID NO: 499231 - DNA, 25 bp, Rattus norvegicus
agctcacagtgctcaaagacccgca

SEQ ID NO: 499232 - DNA, 25 bp, Rattus norvegicus
ccgcacaccggcgtgcacaaaggtg

SEQ ID NO: 499233 - DNA, 25 bp, Rattus norvegicus
cgtgcacaaaggtgggcaccatgtc

SEQ ID NO: 499234 - DNA, 25 bp, Rattus norvegicus
caaaggtgggcaccatgtcccgaac

SEQ ID NO: 499235 - DNA, 25 bp, Rattus norvegicus
ccgccaggaacgctgtggcgcagtc

SEQ ID NO: 499236 - DNA, 25 bp, Rattus norvegicus
ttccggcttagtcgctaggaaactg

SEQ ID NO: 499237 - DNA, 25 bp, Rattus norvegicus
gtgattcggaagttccggcttagtc

SEQ ID NO: 499238 - DNA, 25 bp, Rattus norvegicus
tttgcgaaccgatcgctcgaagccc

SEQ ID NO: 499239 - DNA, 25 bp, Rattus norvegicus
ccttgaacccatttgcgaaccgatc

SEQ ID NO: 499240 - DNA, 25 bp, Rattus norvegicus
gcctcttctttcaggacgccgaagc

SEQ ID NO: 499241 - DNA, 25 bp, Rattus norvegicus
ctccggactgctagagcctcttctt

SEQ ID NO: 499242 - DNA, 25 bp, Rattus norvegicus
gccagcgtcactccggactgctaga

SEQ ID NO: 499243 - DNA, 25 bp, Rattus norvegicus
ctctagtggagtcccagagctgcgc

SEQ ID NO: 499244 - DNA, 25 bp, Rattus norvegicus
ccgggtctccagtgtggtctcactg

SEQ ID NO: 499245 - DNA, 25 bp, Rattus norvegicus
ggaggcccgagccttccgtcctgtg

SEQ ID NO: 499246 - DNA, 25 bp, Rattus norvegicus
gtccaaagaccagacccgggtgcca

SEQ ID NO: 499247 - DNA, 25 bp, Rattus norvegicus
agagcgaatcgcactcttctgcctc

SEQ ID NO: 499248 - DNA, 25 bp, Rattus norvegicus
acctaggccgccagagcgaatcgca

SEQ ID NO: 499249 - DNA, 25 bp, Rattus norvegicus
taggaaactggccagctcgacgcga

SEQ ID NO: 499250 - DNA, 25 bp, Rattus norvegicus
ccactgtggagtgcgaggacagcca

SEQ ID NO: 499251 - DNA, 25 bp, Rattus norvegicus
gacagccacgggaacacgcctctat

SEQ ID NO: 499252 - DNA, 25 bp, Rattus norvegicus
aacacgcctctatccgaggcggcgg

SEQ ID NO: 499253 - DNA, 25 bp, Rattus norvegicus
gcaggtcccggccatccagttgctg

SEQ ID NO: 499254 - DNA, 25 bp, Rattus norvegicus
cggccatccagttgctggcggagct

SEQ ID NO: 499255 - DNA, 25 bp, Rattus norvegicus
gccactctaccgggcagcttttggg

SEQ ID NO: 499256 - DNA, 25 bp, Rattus norvegicus
tgcttctgaagaacggagcagaccc

SEQ ID NO: 499257 - DNA, 25 bp, Rattus norvegicus
ggtgacctgtccctgcgcccaggtg

SEQ ID NO: 499258 - DNA, 25 bp, Rattus norvegicus
ccgccaggtgctcaaggaggtctgt

SEQ ID NO: 499259 - DNA, 25 bp, Rattus norvegicus
gcgagatccgccaggtgctcaagga

SEQ ID NO: 499260 - DNA, 25 bp, Rattus norvegicus
acctggccttggtgcgccaggagca

SEQ ID NO: 499261 - DNA, 25 bp, Rattus norvegicus
tgtcttgcaggcctacctggccttg

SEQ ID NO: 499262 - DNA, 25 bp, Rattus norvegicus
cgcgggccatgtcttgcaggcctac

SEQ ID NO: 499263 - DNA, 25 bp, Rattus norvegicus
agccgtggaggtgcttctgaagaac

SEQ ID NO: 499264 - DNA, 25 bp, Rattus norvegicus
tccacgtgccggttgcaacgccaga

SEQ ID NO: 499265 - DNA, 25 bp, Rattus norvegicus
tcctggatactacagatctcgggtc

SEQ ID NO: 499266 - DNA, 25 bp, Rattus norvegicus
ctggtacaacctgcagcgagcaatg

SEQ ID NO: 499267 - DNA, 25 bp, Rattus norvegicus
gtccggactgctctcagcgatattc

SEQ ID NO: 499268 - DNA, 25 bp, Rattus norvegicus
cgcaaaaagctctcggtcctggata

SEQ ID NO: 499269 - DNA, 25 bp, Rattus norvegicus
tccggcgtgacccatagtagtagct

SEQ ID NO: 499270 - DNA, 25 bp, Rattus norvegicus
cggcccgcgttcaatacgagctgta

SEQ ID NO: 499271 - DNA, 25 bp, Rattus norvegicus
cacttcagcatgatgcgggccggca

SEQ ID NO: 499272 - DNA, 25 bp, Rattus norvegicus
gagcaatgccgcttatccaccgact

SEQ ID NO: 499273 - DNA, 25 bp, Rattus norvegicus
ctgtagcggtaaatctcctctggta

SEQ ID NO: 499274 - DNA, 25 bp, Rattus norvegicus
agctcctccaggctacgactgtagc

SEQ ID NO: 499275 - DNA, 25 bp, Rattus norvegicus
tcaccttaggtagctcgcgcagctg

SEQ ID NO: 499276 - DNA, 25 bp, Rattus norvegicus
ccagagcgggatgcacttcagcatg

SEQ ID NO: 499277 - DNA, 25 bp, Rattus norvegicus
tgcggcggctactcaccttaggtag

SEQ ID NO: 499278 - DNA, 25 bp, Rattus norvegicus
atcggagctcgggtctcccttccct

SEQ ID NO: 499279 - DNA, 25 bp, Rattus norvegicus
tttgtgggcaatttagaggcccgtg

SEQ ID NO: 499280 - DNA, 25 bp, Rattus norvegicus
cgctgcggaccgcagggatgttccc

SEQ ID NO: 499281 - DNA, 25 bp, Rattus norvegicus
ccgctcaggaggaggctgacaggac

SEQ ID NO: 499282 - DNA, 25 bp, Rattus norvegicus
ctgacaggaccgtgtttgtgggcaa

SEQ ID NO: 499283 - DNA, 25 bp, Rattus norvegicus
caggaccgtgtttgtgggcaattta

SEQ ID NO: 499284 - DNA, 25 bp, Rattus norvegicus
gcccgtgtgcgggaagagattcttt

SEQ ID NO: 499285 - DNA, 25 bp, Rattus norvegicus
ccgtgtgcgggaagagattctttac

SEQ ID NO: 499286 - DNA, 25 bp, Rattus norvegicus
gagattctttacgagctgttccttc

SEQ ID NO: 499287 - DNA, 25 bp, Rattus norvegicus
ctgttccttcaggtaccgtcctcgg

SEQ ID NO: 499288 - DNA, 25 bp, Rattus norvegicus
gcacctcctccatccctcgctgcgg

SEQ ID NO: 499289 - DNA, 25 bp, Rattus norvegicus
tccctcacttagacccgcaagtgtg

SEQ ID NO: 499290 - DNA, 25 bp, Rattus norvegicus
cttagacccgcaagtgtgcagccgg

SEQ ID NO: 499291 - DNA, 25 bp, Rattus norvegicus
ttacgagctgttccttcaggtaccg

SEQ ID NO: 499292 - DNA, 25 bp, Rattus norvegicus
tgtcgcccagcctcagcaaaaagag

SEQ ID NO: 499293 - DNA, 25 bp, Rattus norvegicus
ttaatgttccggaggagaacggatc

SEQ ID NO: 499294 - DNA, 25 bp, Rattus norvegicus
cgccggacgcggaattctcgcgata

SEQ ID NO: 499295 - DNA, 25 bp, Rattus norvegicus
gagagctatagttgccgtcgccatc

SEQ ID NO: 499296 - DNA, 25 bp, Rattus norvegicus
gcgagggattcacttacgagagcta

SEQ ID NO: 499297 - DNA, 25 bp, Rattus norvegicus
acgactcactcctaccagttgacgg

SEQ ID NO: 499298 - DNA, 25 bp, Rattus norvegicus
ggtcaagccaatgcgcacccagggg

SEQ ID NO: 499299 - DNA, 25 bp, Rattus norvegicus
aagcccgtatgaggccgggtcaagc

SEQ ID NO: 499300 - DNA, 25 bp, Rattus norvegicus
ggtgaccaccagaaagcccgtatga

SEQ ID NO: 499301 - DNA, 25 bp, Rattus norvegicus
ccagctgccggaaactgaagtcctc

SEQ ID NO: 499302 - DNA, 25 bp, Rattus norvegicus
agggctcccagacgcctagacaact

SEQ ID NO: 499303 - DNA, 25 bp, Rattus norvegicus
gggcggagcaggcatttaatgttcc

SEQ ID NO: 499304 - DNA, 25 bp, Rattus norvegicus
cgacctagctacgtgagtggagacc

SEQ ID NO: 499305 - DNA, 25 bp, Rattus norvegicus
cgagccggaagctgcagccaagcca

SEQ ID NO: 499306 - DNA, 25 bp, Rattus norvegicus
gggcacgcctcgtcctcccagacca

SEQ ID NO: 499307 - DNA, 25 bp, Rattus norvegicus
ccgcttctgccagcggccacacggg

SEQ ID NO: 499308 - DNA, 25 bp, Rattus norvegicus
tagctcgatccagggcgtcagagcc

SEQ ID NO: 499309 - DNA, 25 bp, Rattus norvegicus
cggtgctggagtgtagctcgatcca

SEQ ID NO: 499310 - DNA, 25 bp, Rattus norvegicus
cccttctcagctccgggaattggga

SEQ ID NO: 499311 - DNA, 25 bp, Rattus norvegicus
cgagcccttctcagctccgggaatt

SEQ ID NO: 499312 - DNA, 25 bp, Rattus norvegicus
cagcgcccggcagcccaacctggag

SEQ ID NO: 499313 - DNA, 25 bp, Rattus norvegicus
acacgggctctcctccaggatgtcg

SEQ ID NO: 499314 - DNA, 25 bp, Rattus norvegicus
tccatgcttaggctacgggacggtg

SEQ ID NO: 499315 - DNA, 25 bp, Rattus norvegicus
catggcctccatgcttaggctacgg

SEQ ID NO: 499316 - DNA, 25 bp, Rattus norvegicus
ctcggatgccatggcctccatgctt

SEQ ID NO: 499317 - DNA, 25 bp, Rattus norvegicus
tactggctcggcctctcggatgcca

SEQ ID NO: 499318 - DNA, 25 bp, Rattus norvegicus
ggagaccctcatactggctcggcct

SEQ ID NO: 499319 - DNA, 25 bp, Rattus norvegicus
aggatgtcgctctcgtcctcgctct

SEQ ID NO: 499320 - DNA, 25 bp, Rattus norvegicus
ttgctggccagcagtacctccatct

SEQ ID NO: 499321 - DNA, 25 bp, Rattus norvegicus
ggcctccttctctttgagtgcaatc

SEQ ID NO: 499322 - DNA, 25 bp, Rattus norvegicus
ctctgcctccgtcttgagccttgtg

SEQ ID NO: 499323 - DNA, 25 bp, Rattus norvegicus
ctgatggcagccagcttctccgtaa

SEQ ID NO: 499324 - DNA, 25 bp, Rattus norvegicus
agcctctgcttggacttttcactgg

SEQ ID NO: 499325 - DNA, 25 bp, Rattus norvegicus
tttcactggtggagcgagactcctc

SEQ ID NO: 499326 - DNA, 25 bp, Rattus norvegicus
gagactcctcttcggctcgtgcctt

SEQ ID NO: 499327 - DNA, 25 bp, Rattus norvegicus
tggaaggcctcatcttcagccaggc

SEQ ID NO: 499328 - DNA, 25 bp, Rattus norvegicus
ttcctgcagcgtgcgctccaactgt

SEQ ID NO: 499329 - DNA, 25 bp, Rattus norvegicus
gcgctcctctatgtctgccttgtgc

SEQ ID NO: 499330 - DNA, 25 bp, Rattus norvegicus
gtctctgcccgcaggcgaatcagct

SEQ ID NO: 499331 - DNA, 25 bp, Rattus norvegicus
ttctgcttctctgcatcggcctggg

SEQ ID NO: 499332 - DNA, 25 bp, Rattus norvegicus
gcagcgcctcattggccttcagctg

SEQ ID NO: 499333 - DNA, 25 bp, Rattus norvegicus
gtcactgtcacgtgctcttcctgca

SEQ ID NO: 499334 - DNA, 25 bp, Rattus norvegicus
gcccgtgttgaaggctgagggccct

SEQ ID NO: 499335 - DNA, 25 bp, Rattus norvegicus
gttcgctaacaacacggaagccgtg

SEQ ID NO: 499336 - DNA, 25 bp, Rattus norvegicus
gagcaaactacctcgcgggaactcg

SEQ ID NO: 499337 - DNA, 25 bp, Rattus norvegicus
taacaacacggaagccgtgcccgtg

SEQ ID NO: 499338 - DNA, 25 bp, Rattus norvegicus
cacggaagccgtgcccgtgttgaag

SEQ ID NO: 499339 - DNA, 25 bp, Rattus norvegicus
ctgggctgttcgctaacaacacgga

SEQ ID NO: 499340 - DNA, 25 bp, Rattus norvegicus
tgaagacgcccttcgctgcccacgt

SEQ ID NO: 499341 - DNA, 25 bp, Rattus norvegicus
ggacgcaatacccagacccggagaa

SEQ ID NO: 499342 - DNA, 25 bp, Rattus norvegicus
gcaatacccagacccggagaacctg

SEQ ID NO: 499343 - DNA, 25 bp, Rattus norvegicus
agacccggagaacctgcccctgatg

SEQ ID NO: 499344 - DNA, 25 bp, Rattus norvegicus
cgcccagtgtgggtcaggaagccgc

SEQ ID NO: 499345 - DNA, 25 bp, Rattus norvegicus
agcccaacgggagcaaactacctcg

SEQ ID NO: 499346 - DNA, 25 bp, Rattus norvegicus
cgccctgggctgttcgctaacaaca

SEQ ID NO: 499347 - DNA, 25 bp, Rattus norvegicus
ccacgtccctgccattgccaggagc

SEQ ID NO: 499348 - DNA, 25 bp, Rattus norvegicus
gtagaagtggcaccaggcaaaggtc

SEQ ID NO: 499349 - DNA, 25 bp, Rattus norvegicus
cgcatgacctgtagattggtgacgc

SEQ ID NO: 499350 - DNA, 25 bp, Rattus norvegicus
catggcacgcatgacctgtagattg

SEQ ID NO: 499351 - DNA, 25 bp, Rattus norvegicus
cagcgaggtcatggcacgcatgacc

SEQ ID NO: 499352 - DNA, 25 bp, Rattus norvegicus
caggccccgagctttcagcgaggtc

SEQ ID NO: 499353 - DNA, 25 bp, Rattus norvegicus
agtggcaccaggcaaaggtctcccg

SEQ ID NO: 499354 - DNA, 25 bp, Rattus norvegicus
tcgatgccctcgttggtcaggtacc

SEQ ID NO: 499355 - DNA, 25 bp, Rattus norvegicus
tactggcgtaggtggtcgatgccct

SEQ ID NO: 499356 - DNA, 25 bp, Rattus norvegicus
cagagaggcaggtacgatctccggt

SEQ ID NO: 499357 - DNA, 25 bp, Rattus norvegicus
cgcacacgctgcagagaggcaggta

SEQ ID NO: 499358 - DNA, 25 bp, Rattus norvegicus
acgacgtgcaggcatcaccatggca

SEQ ID NO: 499359 - DNA, 25 bp, Rattus norvegicus
tgtagattggtgacgccgggcacat

SEQ ID NO: 499360 - DNA, 25 bp, Rattus norvegicus
gtcaggtaccagtagaagtggcacc

SEQ ID NO: 499361 - DNA, 25 bp, Rattus norvegicus
caccatggcaacagggcggcgcaca

SEQ ID NO: 499362 - DNA, 25 bp, Rattus norvegicus
ctggatgaagtcctgttcgtcgggt

SEQ ID NO: 499363 - DNA, 25 bp, Rattus norvegicus
gggctcagtggagcgcatccatccc

SEQ ID NO: 499364 - DNA, 25 bp, Rattus norvegicus
tgcctcgagatgtcctattaaggtc

SEQ ID NO: 499365 - DNA, 25 bp, Rattus norvegicus
ggagcgcatccatccctttcctggg

SEQ ID NO: 499366 - DNA, 25 bp, Rattus norvegicus
ggcgagcgaagttagtaagacttgt

SEQ ID NO: 499367 - DNA, 25 bp, Rattus norvegicus
agacttgtggcgaatgactgggctc

SEQ ID NO: 499368 - DNA, 25 bp, Rattus norvegicus
ttgtggcgaatgactgggctctgtt

SEQ ID NO: 499369 - DNA, 25 bp, Rattus norvegicus
ccgcgcgcccgaaagggcagacaga

SEQ ID NO: 499370 - DNA, 25 bp, Rattus norvegicus
cagacagaggccagcggctccgtac

SEQ ID NO: 499371 - DNA, 25 bp, Rattus norvegicus
cctcgtaggcctggatgaagtcctg

SEQ ID NO: 499372 - DNA, 25 bp, Rattus norvegicus
ggagcagaacgcaacgggccaccgc

SEQ ID NO: 499373 - DNA, 25 bp, Rattus norvegicus
ccgcgcgcacggcttaaagaggcct

SEQ ID NO: 499374 - DNA, 25 bp, Rattus norvegicus
tcctattaaggtcatagacgcgggg

SEQ ID NO: 499375 - DNA, 25 bp, Rattus norvegicus
gcggctccgtacctttgtacttctc

SEQ ID NO: 499376 - DNA, 25 bp, Rattus norvegicus
cgcaggcggggctaatccagagccc

SEQ ID NO: 499377 - DNA, 25 bp, Rattus norvegicus
cctccgaaagcaagcaaacgattca

SEQ ID NO: 499378 - DNA, 25 bp, Rattus norvegicus
gcaagcaaacgattcacgcgtgacc

SEQ ID NO: 499379 - DNA, 25 bp, Rattus norvegicus
acttagtgcgcacaccttggtgggc

SEQ ID NO: 499380 - DNA, 25 bp, Rattus norvegicus
gcttgcctcctctctgccgctgcag

SEQ ID NO: 499381 - DNA, 25 bp, Rattus norvegicus
acgattcacgcgtgaccgggctacg

SEQ ID NO: 499382 - DNA, 25 bp, Rattus norvegicus
gctacgggccaagagtcctagaccg

SEQ ID NO: 499383 - DNA, 25 bp, Rattus norvegicus
tcctagaccgggaggttgcagaacc

SEQ ID NO: 499384 - DNA, 25 bp, Rattus norvegicus
ttgcagaaccggaaccgaagatatg

SEQ ID NO: 499385 - DNA, 25 bp, Rattus norvegicus
ccggaaccgaagatatgactagatc

SEQ ID NO: 499386 - DNA, 25 bp, Rattus norvegicus
gatatgactagatcaggcggcactc

SEQ ID NO: 499387 - DNA, 25 bp, Rattus norvegicus
tagatcaggcggcactcacttagtg

SEQ ID NO: 499388 - DNA, 25 bp, Rattus norvegicus
cactcacttagtgcgcacaccttgg

SEQ ID NO: 499389 - DNA, 25 bp, Rattus norvegicus
agaagcctggatccactgcccaccg

SEQ ID NO: 499390 - DNA, 25 bp, Rattus norvegicus
gtgcacagtgctgcgaggacccgat

SEQ ID NO: 499391 - DNA, 25 bp, Rattus norvegicus
cagcagtcggaggaagacgtgctca

SEQ ID NO: 499392 - DNA, 25 bp, Rattus norvegicus
tctgcaggaccagcgcgggctcagc

SEQ ID NO: 499393 - DNA, 25 bp, Rattus norvegicus
gcccacaggggaccggaagctgttc

SEQ ID NO: 499394 - DNA, 25 bp, Rattus norvegicus
aagctgttcgtgggcatgctcaaca

SEQ ID NO: 499395 - DNA, 25 bp, Rattus norvegicus
tgggcatgctcaacaagcagcagtc

SEQ ID NO: 499396 - DNA, 25 bp, Rattus norvegicus
tcaacaagcagcagtcggaggaaga

SEQ ID NO: 499397 - DNA, 25 bp, Rattus norvegicus
aagacgtgctcaggctcttccagcc

SEQ ID NO: 499398 - DNA, 25 bp, Rattus norvegicus
agccctttggcgttatagacgagtg

SEQ ID NO: 499399 - DNA, 25 bp, Rattus norvegicus
ttatagacgagtgcacagtgctgcg

SEQ ID NO: 499400 - DNA, 25 bp, Rattus norvegicus
cgaggacccgatggcagcagcaaag

SEQ ID NO: 499401 - DNA, 25 bp, Rattus norvegicus
cccgatggcagcagcaaaggtgact

SEQ ID NO: 499402 - DNA, 25 bp, Rattus norvegicus
atggcagcagcaaaggtgactggca

SEQ ID NO: 499403 - DNA, 25 bp, Rattus norvegicus
ctttggcgttatagacgagtgcaca

SEQ ID NO: 499404 - DNA, 25 bp, Rattus norvegicus
cgggcaccgtagacaccggtctctg

SEQ ID NO: 499405 - DNA, 25 bp, Rattus norvegicus
caggcgcaggcccaagcaactcggc

SEQ ID NO: 499406 - DNA, 25 bp, Rattus norvegicus
tgcgcagcgggcaccgtagacaccg

SEQ ID NO: 499407 - DNA, 25 bp, Rattus norvegicus
gacaccggtctctggctccctagag

SEQ ID NO: 499408 - DNA, 25 bp, Rattus norvegicus
ctctggctccctagagcggtgagtc

SEQ ID NO: 499409 - DNA, 25 bp, Rattus norvegicus
cccgactaatcccagaagcgtgtcg

SEQ ID NO: 499410 - DNA, 25 bp, Rattus norvegicus
gccatcctctccctgtgttactgag

SEQ ID NO: 499411 - DNA, 25 bp, Rattus norvegicus
tctccctgtgttactgagcgcggcc

SEQ ID NO: 499412 - DNA, 25 bp, Rattus norvegicus
ctgtgttactgagcgcggccgcctc

SEQ ID NO: 499413 - DNA, 25 bp, Rattus norvegicus
cgcctcgggtcagttggttcggaca

SEQ ID NO: 499414 - DNA, 25 bp, Rattus norvegicus
tcagttggttcggacaggactcgcg

SEQ ID NO: 499415 - DNA, 25 bp, Rattus norvegicus
ttcggacaggactcgcggccgactc

SEQ ID NO: 499416 - DNA, 25 bp, Rattus norvegicus
tcccagaagcgtgtcgccgtctcag

SEQ ID NO: 499417 - DNA, 25 bp, Rattus norvegicus
caactcggccgtccagcgggtgcag

SEQ ID NO: 499418 - DNA, 25 bp, Rattus norvegicus
gaggctgttgaataccgaccgaccg

SEQ ID NO: 499419 - DNA, 25 bp, Rattus norvegicus
gtgaagaggctgttgaataccgacc

SEQ ID NO: 499420 - DNA, 25 bp, Rattus norvegicus
ttgggaggacttcactgggattgcc

SEQ ID NO: 499421 - DNA, 25 bp, Rattus norvegicus
ttcacctgcgtgagtgacgctgttg

SEQ ID NO: 499422 - DNA, 25 bp, Rattus norvegicus
gcgctctgctcttcacctgcgtgag

SEQ ID NO: 499423 - DNA, 25 bp, Rattus norvegicus
tcgtgtacgcctcgctgggcgctct

SEQ ID NO: 499424 - DNA, 25 bp, Rattus norvegicus
tcctggagatcgtgtacgcctcgct

SEQ ID NO: 499425 - DNA, 25 bp, Rattus norvegicus
ccgcatcctggagatcgtgtacgcc

SEQ ID NO: 499426 - DNA, 25 bp, Rattus norvegicus
tcttcatccggaaccgcatcctgga

SEQ ID NO: 499427 - DNA, 25 bp, Rattus norvegicus
cacctcgtgcatgggcgtgctcctg

SEQ ID NO: 499428 - DNA, 25 bp, Rattus norvegicus
gctacgacttcacctcgtgcatggg

SEQ ID NO: 499429 - DNA, 25 bp, Rattus norvegicus
tgctcttcatcttcgccatactctg

SEQ ID NO: 499430 - DNA, 25 bp, Rattus norvegicus
gccatactctgcatcttcatccgga

SEQ ID NO: 499431 - DNA, 25 bp, Rattus norvegicus
acttcacctcgtgcatgggcgtgct

SEQ ID NO: 499432 - DNA, 25 bp, Rattus norvegicus
gtctacagcggcgtggtgagtctca

SEQ ID NO: 499433 - DNA, 25 bp, Rattus norvegicus
cgccacaggcagcttcggaaggacc

SEQ ID NO: 499434 - DNA, 25 bp, Rattus norvegicus
gcagcttcggaaggaccatctcggt

SEQ ID NO: 499435 - DNA, 25 bp, Rattus norvegicus
cccgccagaggagcggatttcgatc

SEQ ID NO: 499436 - DNA, 25 bp, Rattus norvegicus
agccttggcagcagctttgggcacc

SEQ ID NO: 499437 - DNA, 25 bp, Rattus norvegicus
agcggatttcgatcgcgtctacagc

SEQ ID NO: 499438 - DNA, 25 bp, Rattus norvegicus
gcaccgagaacatctactccttcaa

SEQ ID NO: 499439 - DNA, 25 bp, Rattus norvegicus
caccagccatcctggccaggtaaga

SEQ ID NO: 499440 - DNA, 25 bp, Rattus norvegicus
ctggccaggtaagaagctcgctccc

SEQ ID NO: 499441 - DNA, 25 bp, Rattus norvegicus
gtaagaagctcgctccctcggctga

SEQ ID NO: 499442 - DNA, 25 bp, Rattus norvegicus
ctcccaggtacctcgggagacttcg

SEQ ID NO: 499443 - DNA, 25 bp, Rattus norvegicus
ccattcctgggctttgcagaggcgc

SEQ ID NO: 499444 - DNA, 25 bp, Rattus norvegicus
ggtgagtctcagcaccgagaacatc

SEQ ID NO: 499445 - DNA, 25 bp, Rattus norvegicus
tcccgcttgaggcaatcgctgcctt

SEQ ID NO: 499446 - DNA, 25 bp, Rattus norvegicus
tgtctgcaggaagtgttcgacctcc

SEQ ID NO: 499447 - DNA, 25 bp, Rattus norvegicus
gtgctgaaggccacattacctatgg

SEQ ID NO: 499448 - DNA, 25 bp, Rattus norvegicus
ttcggtcgtcacagtatggggttac

SEQ ID NO: 499449 - DNA, 25 bp, Rattus norvegicus
ccgtactgctagatggccttcggtc

SEQ ID NO: 499450 - DNA, 25 bp, Rattus norvegicus
tttgtcgaatagtcagcagcgggcg

SEQ ID NO: 499451 - DNA, 25 bp, Rattus norvegicus
cggactggcacactttaacaatttg

SEQ ID NO: 499452 - DNA, 25 bp, Rattus norvegicus
tctcactgctaatctgtgcctgttc

SEQ ID NO: 499453 - DNA, 25 bp, Rattus norvegicus
cgccagcgttgctttgtctttctca

SEQ ID NO: 499454 - DNA, 25 bp, Rattus norvegicus
cctatgggtttggacttcgtgtgtc

SEQ ID NO: 499455 - DNA, 25 bp, Rattus norvegicus
ctcgtgcgcattttggtaccaaatc

SEQ ID NO: 499456 - DNA, 25 bp, Rattus norvegicus
tctgggcccggttctatatgatgta

SEQ ID NO: 499457 - DNA, 25 bp, Rattus norvegicus
gtgccaccttccgttgctttcctaa

SEQ ID NO: 499458 - DNA, 25 bp, Rattus norvegicus
gctttcctaacgctcgtcgcgagga

SEQ ID NO: 499459 - DNA, 25 bp, Rattus norvegicus
caaaggtctattatccgtccaggta

SEQ ID NO: 499460 - DNA, 25 bp, Rattus norvegicus
ctatcgagaaagactaccatgggga

SEQ ID NO: 499461 - DNA, 25 bp, Rattus norvegicus
gcgcacagacaaggggatgactatc

SEQ ID NO: 499462 - DNA, 25 bp, Rattus norvegicus
gactatcgagaaagactaccatggg

SEQ ID NO: 499463 - DNA, 25 bp, Rattus norvegicus
ggatgactatcgagaaagactacca

SEQ ID NO: 499464 - DNA, 25 bp, Rattus norvegicus
gggatgactatcgagaaagactacc

SEQ ID NO: 499465 - DNA, 25 bp, Rattus norvegicus
aggggatgactatcgagaaagacta

SEQ ID NO: 499466 - DNA, 25 bp, Rattus norvegicus
caaggggatgactatcgagaaagac

SEQ ID NO: 499467 - DNA, 25 bp, Rattus norvegicus
gacaaggggatgactatcgagaaag

SEQ ID NO: 499468 - DNA, 25 bp, Rattus norvegicus
tgactatcgagaaagactaccatgg

SEQ ID NO: 499469 - DNA, 25 bp, Rattus norvegicus
cacagacaaggggatgactatcgag

SEQ ID NO: 499470 - DNA, 25 bp, Rattus norvegicus
ggcgcacagacaaggggatgactat

SEQ ID NO: 499471 - DNA, 25 bp, Rattus norvegicus
tggcgcacagacaaggggatgacta

SEQ ID NO: 499472 - DNA, 25 bp, Rattus norvegicus
cagacaaggggatgactatcgagaa

SEQ ID NO: 499473 - DNA, 25 bp, Rattus norvegicus
ctggcgcacagacaaggggatgact

SEQ ID NO: 499474 - DNA, 25 bp, Rattus norvegicus
ctcgaatacactgccgcgctcgggg

SEQ ID NO: 499475 - DNA, 25 bp, Rattus norvegicus
catggggagcggagcccaaatatcg

SEQ ID NO: 499476 - DNA, 25 bp, Rattus norvegicus
gcggagcccaaatatcgtgcgattc

SEQ ID NO: 499477 - DNA, 25 bp, Rattus norvegicus
gcccaaatatcgtgcgattcaaagg

SEQ ID NO: 499478 - DNA, 25 bp, Rattus norvegicus
tacactgccgcgctcggggaaggct

SEQ ID NO: 499479 - DNA, 25 bp, Rattus norvegicus
ggtactcgaatacactgccgcgctc

SEQ ID NO: 499480 - DNA, 25 bp, Rattus norvegicus
cgcggcggtactcgaatacactgcc

SEQ ID NO: 499481 - DNA, 25 bp, Rattus norvegicus
ggggcactcatacggcttcctgggc

SEQ ID NO: 499482 - DNA, 25 bp, Rattus norvegicus
tattgtggggcactcatacggcttc

SEQ ID NO: 499483 - DNA, 25 bp, Rattus norvegicus
aaggatctttattgtggggcactca

SEQ ID NO: 499484 - DNA, 25 bp, Rattus norvegicus
cgtgtggaggcagaacacgtcctgc

SEQ ID NO: 499485 - DNA, 25 bp, Rattus norvegicus
cgtgcgattcaaaggatctttattg

SEQ ID NO: 499486 - DNA, 25 bp, Rattus norvegicus
tatcgtgcgattcaaaggatcttta

SEQ ID NO: 499487 - DNA, 25 bp, Rattus norvegicus
gcgctggatcctccgggtctccgta

SEQ ID NO: 499488 - DNA, 25 bp, Rattus norvegicus
gataactggatacctgtgcagatga

SEQ ID NO: 499489 - DNA, 25 bp, Rattus norvegicus
tgatgggcacagcgcgtatgagcac

SEQ ID NO: 499490 - DNA, 25 bp, Rattus norvegicus
atgatgggcacagcgcgtatgagca

SEQ ID NO: 499491 - DNA, 25 bp, Rattus norvegicus
cagatgatgggcacagcgcgtatga

SEQ ID NO: 499492 - DNA, 25 bp, Rattus norvegicus
cctgtgcagatgatgggcacagcgc

SEQ ID NO: 499493 - DNA, 25 bp, Rattus norvegicus
tacctgtgcagatgatgggcacagc

SEQ ID NO: 499494 - DNA, 25 bp, Rattus norvegicus
gatacctgtgcagatgatgggcaca

SEQ ID NO: 499495 - DNA, 25 bp, Rattus norvegicus
tggatacctgtgcagatgatgggca

SEQ ID NO: 499496 - DNA, 25 bp, Rattus norvegicus
ctggatacctgtgcagatgatgggc

SEQ ID NO: 499497 - DNA, 25 bp, Rattus norvegicus
actggatacctgtgcagatgatggg

SEQ ID NO: 499498 - DNA, 25 bp, Rattus norvegicus
taactggatacctgtgcagatgatg

SEQ ID NO: 499499 - DNA, 25 bp, Rattus norvegicus
ggataactggatacctgtgcagatg

SEQ ID NO: 499500 - DNA, 25 bp, Rattus norvegicus
aggataactggatacctgtgcagat

SEQ ID NO: 499501 - DNA, 25 bp, Rattus norvegicus
aactggatacctgtgcagatgatgg

SEQ ID NO: 499502 - DNA, 25 bp, Rattus norvegicus
gaaagaccagctctcggactacgcc

SEQ ID NO: 499503 - DNA, 25 bp, Rattus norvegicus
ctggcctcagctcaaagcggcgcag

SEQ ID NO: 499504 - DNA, 25 bp, Rattus norvegicus
cctcagctcaaagcggcgcaggata

SEQ ID NO: 499505 - DNA, 25 bp, Rattus norvegicus
aagaccagctctcggactacgccat

SEQ ID NO: 499506 - DNA, 25 bp, Rattus norvegicus
gaagagctggggaagccacacccac

SEQ ID NO: 499507 - DNA, 25 bp, Rattus norvegicus
tcttcccgaaagaccagctctcgga

SEQ ID NO: 499508 - DNA, 25 bp, Rattus norvegicus
gctcggtgagcacagacaacagcgc

SEQ ID NO: 499509 - DNA, 25 bp, Rattus norvegicus
cggcgctcggtgagcacagacaaca

SEQ ID NO: 499510 - DNA, 25 bp, Rattus norvegicus
cccggcgctcggtgagcacagacaa

SEQ ID NO: 499511 - DNA, 25 bp, Rattus norvegicus
caaagcggcgcaggataactggata

SEQ ID NO: 499512 - DNA, 25 bp, Rattus norvegicus
ccgtaaggctggaaggcccggcgct

SEQ ID NO: 499513 - DNA, 25 bp, Rattus norvegicus
agctctcggactacgccatcacctc

SEQ ID NO: 499514 - DNA, 25 bp, Rattus norvegicus
acccaccgtggaggccgtaaggctg

SEQ ID NO: 499515 - DNA, 25 bp, Rattus norvegicus
cacacccaccgtggaggccgtaagg

SEQ ID NO: 499516 - DNA, 25 bp, Rattus norvegicus
gtgactcgtacattcagcaggccgg

SEQ ID NO: 499517 - DNA, 25 bp, Rattus norvegicus
ggcttatatcgagcagggcaacacc

SEQ ID NO: 499518 - DNA, 25 bp, Rattus norvegicus
acaccaaggcactggcggtggtcta

SEQ ID NO: 499519 - DNA, 25 bp, Rattus norvegicus
tacgggcctcacgaggcgagtaagc

SEQ ID NO: 499520 - DNA, 25 bp, Rattus norvegicus
cctgtccgatcagggttaccggata

SEQ ID NO: 499521 - DNA, 25 bp, Rattus norvegicus
caggtcatctaaggggtcgtgctct

SEQ ID NO: 499522 - DNA, 25 bp, Rattus norvegicus
agcgcctccgacaaaccgaggacgt

SEQ ID NO: 499523 - DNA, 25 bp, Rattus norvegicus
gaagctacgagccttgcaccggaaa

SEQ ID NO: 499524 - DNA, 25 bp, Rattus norvegicus
ggaaccgaacgacgtgactcgtaca

SEQ ID NO: 499525 - DNA, 25 bp, Rattus norvegicus
aaccagctcggctcgggcctttgat

SEQ ID NO: 499526 - DNA, 25 bp, Rattus norvegicus
aggcgtacctacttcaacaaccgag

SEQ ID NO: 499527 - DNA, 25 bp, Rattus norvegicus
gaagtttgtcttcaaggcgtaccta

SEQ ID NO: 499528 - DNA, 25 bp, Rattus norvegicus
gcaggccgatggctcggcttatatc

SEQ ID NO: 499529 - DNA, 25 bp, Rattus norvegicus
ggaagttatagctctccgagactga

SEQ ID NO: 499530 - DNA, 25 bp, Rattus norvegicus
tgggaccggaaataaaggcagcacg

SEQ ID NO: 499531 - DNA, 25 bp, Rattus norvegicus
ccctacgctaccaagcgtagtggcg

SEQ ID NO: 499532 - DNA, 25 bp, Rattus norvegicus
tcctgggaccggaaataaaggcagc

SEQ ID NO: 499533 - DNA, 25 bp, Rattus norvegicus
gggtctgacaggaaccctgcgcttg

SEQ ID NO: 499534 - DNA, 25 bp, Rattus norvegicus
ggaaccctgcgcttggaggtgtcaa

SEQ ID NO: 499535 - DNA, 25 bp, Rattus norvegicus
ccctgcgcttggaggtgtcaagctg

SEQ ID NO: 499536 - DNA, 25 bp, Rattus norvegicus
tcaagctgcggcgagagctgagccc

SEQ ID NO: 499537 - DNA, 25 bp, Rattus norvegicus
atgggtctcctgtcggacccggtgc

SEQ ID NO: 499538 - DNA, 25 bp, Rattus norvegicus
gcccgcatcgtcttgcgcctcaaca

SEQ ID NO: 499539 - DNA, 25 bp, Rattus norvegicus
gcctcaacactcctctatggtgagg

SEQ ID NO: 499540 - DNA, 25 bp, Rattus norvegicus
ctcctctatggtgagggcgggtata

SEQ ID NO: 499541 - DNA, 25 bp, Rattus norvegicus
actcgcgggaacatgaactgctgta

SEQ ID NO: 499542 - DNA, 25 bp, Rattus norvegicus
atgaactgctgtagttccactcgcg

SEQ ID NO: 499543 - DNA, 25 bp, Rattus norvegicus
cgcgacggatcctgggaccggaaat

SEQ ID NO: 499544 - DNA, 25 bp, Rattus norvegicus
tgctctgagcccagggtccgactgt

SEQ ID NO: 499545 - DNA, 25 bp, Rattus norvegicus
gtctgagttctcgtcggcccgcaag

SEQ ID NO: 499546 - DNA, 25 bp, Rattus norvegicus
gagattcctgcgaagggctcgccca

SEQ ID NO: 499547 - DNA, 25 bp, Rattus norvegicus
ttgctctcgcgtggtctgagttctc

SEQ ID NO: 499548 - DNA, 25 bp, Rattus norvegicus
gacaccgcaggtgagtactggcacg

SEQ ID NO: 499549 - DNA, 25 bp, Rattus norvegicus
ccgcactaaagagggccgacatggc

SEQ ID NO: 499550 - DNA, 25 bp, Rattus norvegicus
gccttggagccatagggcatgttgc

SEQ ID NO: 499551 - DNA, 25 bp, Rattus norvegicus
cttcgcttcgccgatcggtgctagg

SEQ ID NO: 499552 - DNA, 25 bp, Rattus norvegicus
ttccaggtgcaagtgctccgggcct

SEQ ID NO: 499553 - DNA, 25 bp, Rattus norvegicus
ggcatcttccattacggacaccgca

SEQ ID NO: 499554 - DNA, 25 bp, Rattus norvegicus
cctcagccctgaaggtcacggcggg

SEQ ID NO: 499555 - DNA, 25 bp, Rattus norvegicus
gcacactcgggaagccagtctgggt

SEQ ID NO: 499556 - DNA, 25 bp, Rattus norvegicus
gtaggcccgcccattgggttgctct

SEQ ID NO: 499557 - DNA, 25 bp, Rattus norvegicus
attcctcctacgactcggcagggtc

SEQ ID NO: 499558 - DNA, 25 bp, Rattus norvegicus
cttccgccgacagaaacttggactg

SEQ ID NO: 499559 - DNA, 25 bp, Rattus norvegicus
ccactctggaaagagggttgactcc

SEQ ID NO: 499560 - DNA, 25 bp, Rattus norvegicus
cagaactgtcgagtacttccgccga

SEQ ID NO: 499561 - DNA, 25 bp, Rattus norvegicus
caccacaggtgaagcagggtctgca

SEQ ID NO: 499562 - DNA, 25 bp, Rattus norvegicus
tgctgcgcactaccagagcctgata

SEQ ID NO: 499563 - DNA, 25 bp, Rattus norvegicus
agtccgtccacgctagtcacgtttc

SEQ ID NO: 499564 - DNA, 25 bp, Rattus norvegicus
accctgtggttggagtggaccattc

SEQ ID NO: 499565 - DNA, 25 bp, Rattus norvegicus
cgaacgatagctgctgcccgacata

SEQ ID NO: 499566 - DNA, 25 bp, Rattus norvegicus
tgcccgacataagccaaaaccagtt

SEQ ID NO: 499567 - DNA, 25 bp, Rattus norvegicus
agcgagccaggcgtcaatacacaca

SEQ ID NO: 499568 - DNA, 25 bp, Rattus norvegicus
agacgtacttcgaaactgtgcacca

SEQ ID NO: 499569 - DNA, 25 bp, Rattus norvegicus
acccgtcggacgcttgttgttgtcg

SEQ ID NO: 499570 - DNA, 25 bp, Rattus norvegicus
tggggacagtgtcacagaccgatca

SEQ ID NO: 499571 - DNA, 25 bp, Rattus norvegicus
ccgagagcgcttccgtgatacagaa

SEQ ID NO: 499572 - DNA, 25 bp, Rattus norvegicus
gcccttgtgtagtgagaagcgacta

SEQ ID NO: 499573 - DNA, 25 bp, Rattus norvegicus
cgtgcttttctcctggacccggaca

SEQ ID NO: 499574 - DNA, 25 bp, Rattus norvegicus
tctccaaccttagccagcaggcgga

SEQ ID NO: 499575 - DNA, 25 bp, Rattus norvegicus
ccctgcattacctggggccgttgct

SEQ ID NO: 499576 - DNA, 25 bp, Rattus norvegicus
tgtgcatgcccagttacaacgcgtc

SEQ ID NO: 499577 - DNA, 25 bp, Rattus norvegicus
ttggctgcagtgctggccaacctga

SEQ ID NO: 499578 - DNA, 25 bp, Rattus norvegicus
aacttggctgctgatccggatctgc

SEQ ID NO: 499579 - DNA, 25 bp, Rattus norvegicus
acagacagcgttgttgcgggctttg

SEQ ID NO: 499580 - DNA, 25 bp, Rattus norvegicus
gcgactaaaactgctggcggcatga

SEQ ID NO: 499581 - DNA, 25 bp, Rattus norvegicus
cttcagctgggttctcagactcgga

SEQ ID NO: 499582 - DNA, 25 bp, Rattus norvegicus
acaggtgaaacccagtcgcttgcgg

SEQ ID NO: 499583 - DNA, 25 bp, Rattus norvegicus
gctttgatcgacctagcggtggccc

SEQ ID NO: 499584 - DNA, 25 bp, Rattus norvegicus
agcgcgagcagacctacaggcagcc

SEQ ID NO: 499585 - DNA, 25 bp, Rattus norvegicus
ccgcacgctgttggctggacagaca

SEQ ID NO: 499586 - DNA, 25 bp, Rattus norvegicus
tcttacgccgttggaggtgtttgga

SEQ ID NO: 499587 - DNA, 25 bp, Rattus norvegicus
ttagcggaaaatggccgtgcgcccg

SEQ ID NO: 499588 - DNA, 25 bp, Rattus norvegicus
ttctaaatatagacccgcaaggcca

SEQ ID NO: 499589 - DNA, 25 bp, Rattus norvegicus
cccgcgcgagttcagttttttcata

SEQ ID NO: 499590 - DNA, 25 bp, Rattus norvegicus
agcctgtcgcgtggcacctgtcact

SEQ ID NO: 499591 - DNA, 25 bp, Rattus norvegicus
tgctttgacctcttacgccgttgga

SEQ ID NO: 499592 - DNA, 25 bp, Rattus norvegicus
cggcgcgcgcagcttagcggaaaat

SEQ ID NO: 499593 - DNA, 25 bp, Rattus norvegicus
acctgtcactcctggcgtgcggact

SEQ ID NO: 499594 - DNA, 25 bp, Rattus norvegicus
ctccacggcctggaggctcttgtct

SEQ ID NO: 499595 - DNA, 25 bp, Rattus norvegicus
tgtccgcgaccgcaagcatgcacga

SEQ ID NO: 499596 - DNA, 25 bp, Rattus norvegicus
ggtctgcagccgaagaccgtccgga

SEQ ID NO: 499597 - DNA, 25 bp, Rattus norvegicus
ctcggcgtccttgtctgctccggag

SEQ ID NO: 499598 - DNA, 25 bp, Rattus norvegicus
accgcaatcgagaggctgcagccgc

SEQ ID NO: 499599 - DNA, 25 bp, Rattus norvegicus
ggcagccgcggattttgctttgacc

SEQ ID NO: 499600 - DNA, 25 bp, Rattus norvegicus
ggagttggtgtacctaggctctcta

SEQ ID NO: 499601 - DNA, 25 bp, Rattus norvegicus
ggcgcagcagcagtactcacacttg

SEQ ID NO: 499602 - DNA, 25 bp, Rattus norvegicus
taacgtgagggacagaactctgacc

SEQ ID NO: 499603 - DNA, 25 bp, Rattus norvegicus
tctgaccaatgagcgtggagatctc

SEQ ID NO: 499604 - DNA, 25 bp, Rattus norvegicus
catagaggcggggtcaaattgccgc

SEQ ID NO: 499605 - DNA, 25 bp, Rattus norvegicus
cccactctgggacgcttggggcata

SEQ ID NO: 499606 - DNA, 25 bp, Rattus norvegicus
cggctcctcaggtaaacggcttgtg

SEQ ID NO: 499607 - DNA, 25 bp, Rattus norvegicus
ttggacaggagagcctagggacctt

SEQ ID NO: 499608 - DNA, 25 bp, Rattus norvegicus
gggaccttcctatctgccagcagca

SEQ ID NO: 499609 - DNA, 25 bp, Rattus norvegicus
cgcgtggtacacctggaagggatct

SEQ ID NO: 499610 - DNA, 25 bp, Rattus norvegicus
agggatctcggagcttgcgattcaa

SEQ ID NO: 499611 - DNA, 25 bp, Rattus norvegicus
acttgtcagacatcggcgcgtggtc

SEQ ID NO: 499612 - DNA, 25 bp, Rattus norvegicus
aacggcttgtgaaggctcgtctttg

SEQ ID NO: 499613 - DNA, 25 bp, Rattus norvegicus
ttgtgaaatggtcaccggaccgctg

SEQ ID NO: 499614 - DNA, 25 bp, Rattus norvegicus
cccgcctgggtcatggtcccaggag

SEQ ID NO: 499615 - DNA, 25 bp, Rattus norvegicus
actcacccgccggtgacgcgctccg

SEQ ID NO: 499616 - DNA, 25 bp, Rattus norvegicus
gaaggcagcggtgtctagccgtcta

SEQ ID NO: 499617 - DNA, 25 bp, Rattus norvegicus
tgtctagccgtctaggcgagcctct

SEQ ID NO: 499618 - DNA, 25 bp, Rattus norvegicus
ctaggcgagcctctgggtccgcagc

SEQ ID NO: 499619 - DNA, 25 bp, Rattus norvegicus
agcccgagccctcgaggccggagac

SEQ ID NO: 499620 - DNA, 25 bp, Rattus norvegicus
agcctagcctggatgcgcctcgcgt

SEQ ID NO: 499621 - DNA, 25 bp, Rattus norvegicus
aagccggagtttcgctgcgctaggc

SEQ ID NO: 499622 - DNA, 25 bp, Rattus norvegicus
aatcggcctgccaatccggtgctgg

SEQ ID NO: 499623 - DNA, 25 bp, Rattus norvegicus
gatgccgcggtagccaatcagaagc

SEQ ID NO: 499624 - DNA, 25 bp, Rattus norvegicus
ggtagccaatcagaagccggagttt

SEQ ID NO: 499625 - DNA, 25 bp, Rattus norvegicus
agccaatcagaagccggagtttcgc

SEQ ID NO: 499626 - DNA, 25 bp, Rattus norvegicus
tcagaagccggagtttcgctgcgct

SEQ ID NO: 499627 - DNA, 25 bp, Rattus norvegicus
aaccaatcggcctgccaatccggtg

SEQ ID NO: 499628 - DNA, 25 bp, Rattus norvegicus
cgctttcttccacagcggtcgtgcg

SEQ ID NO: 499629 - DNA, 25 bp, Rattus norvegicus
tctcacctgggcaacgtgctactgg

SEQ ID NO: 499630 - DNA, 25 bp, Rattus norvegicus
agctacatttctcacctgggcaacg

SEQ ID NO: 499631 - DNA, 25 bp, Rattus norvegicus
ggaggagccgactgctataaaggca

SEQ ID NO: 499632 - DNA, 25 bp, Rattus norvegicus
gccagcagatcgcaagctctccaag

SEQ ID NO: 499633 - DNA, 25 bp, Rattus norvegicus
tataaaggcactgatccgctggcgg

SEQ ID NO: 499634 - DNA, 25 bp, Rattus norvegicus
cgggaccgcaccaacagcgtgaaca

SEQ ID NO: 499635 - DNA, 25 bp, Rattus norvegicus
cggcagcggcacacagcgaatgcgc

SEQ ID NO: 499636 - DNA, 25 bp, Rattus norvegicus
aaaccctgtcgtgttcatgctgcgc

SEQ ID NO: 499637 - DNA, 25 bp, Rattus norvegicus
cgggccgctacctgtaccctgaggt

SEQ ID NO: 499638 - DNA, 25 bp, Rattus norvegicus
catgtccttcgccatgctgcgttca

SEQ ID NO: 499639 - DNA, 25 bp, Rattus norvegicus
caacgtgctactggtgggtgaagcc

SEQ ID NO: 499640 - DNA, 25 bp, Rattus norvegicus
ctaaagaggcggcatgagcagcgca

SEQ ID NO: 499641 - DNA, 25 bp, Rattus norvegicus
agcccgctgtccgaggatgaggacc

SEQ ID NO: 499642 - DNA, 25 bp, Rattus norvegicus
tcctacatttcaccgggacgataag

SEQ ID NO: 499643 - DNA, 25 bp, Rattus norvegicus
cctgtttaggagaagcggcctgaga

SEQ ID NO: 499644 - DNA, 25 bp, Rattus norvegicus
tctgttgccggagtgaacctgttta

SEQ ID NO: 499645 - DNA, 25 bp, Rattus norvegicus
cacagacgcgctcatctgctggagc

SEQ ID NO: 499646 - DNA, 25 bp, Rattus norvegicus
ccggccttcctaaccaagctgtgga

SEQ ID NO: 499647 - DNA, 25 bp, Rattus norvegicus
ctgcctgcttcttcggagatggatc

SEQ ID NO: 499648 - DNA, 25 bp, Rattus norvegicus
acagcgcctgcgcacaggaggtaca

SEQ ID NO: 499649 - DNA, 25 bp, Rattus norvegicus
tcggcagaaaagatcacagcgcctg

SEQ ID NO: 499650 - DNA, 25 bp, Rattus norvegicus
cagggcctgtgaagtcggcagaaaa

SEQ ID NO: 499651 - DNA, 25 bp, Rattus norvegicus
tgaagccatcttgcgcaggcgtaca

SEQ ID NO: 499652 - DNA, 25 bp, Rattus norvegicus
ctctaattggtgagcagcccgagtg

SEQ ID NO: 499653 - DNA, 25 bp, Rattus norvegicus
atcccggtgacatgtggtgcttacc

SEQ ID NO: 499654 - DNA, 25 bp, Rattus norvegicus
ggagagtaggccgagacccaaaatc

SEQ ID NO: 499655 - DNA, 25 bp, Rattus norvegicus
ggctaccgatttactgccgcttccg

SEQ ID NO: 499656 - DNA, 25 bp, Rattus norvegicus
tctggaccctgagcaacggcctcgg

SEQ ID NO: 499657 - DNA, 25 bp, Rattus norvegicus
cctaatcgaagacgcggagcacgct

SEQ ID NO: 499658 - DNA, 25 bp, Rattus norvegicus
catttgtagtccgaggccaagctga

SEQ ID NO: 499659 - DNA, 25 bp, Rattus norvegicus
agagtccatttgtagtccgaggcca

SEQ ID NO: 499660 - DNA, 25 bp, Rattus norvegicus
ctgtggcgtcaactgagagtccatt

SEQ ID NO: 499661 - DNA, 25 bp, Rattus norvegicus
cagctgactggctgtggcgtcaact

SEQ ID NO: 499662 - DNA, 25 bp, Rattus norvegicus
ctgggatgctatagagcagctgact

SEQ ID NO: 499663 - DNA, 25 bp, Rattus norvegicus
ggcgcagggcaccactacttctgcg

SEQ ID NO: 499664 - DNA, 25 bp, Rattus norvegicus
taccaccctggatggaaacccgcga

SEQ ID NO: 499665 - DNA, 25 bp, Rattus norvegicus
atgggcccactaccaccctggatgg

SEQ ID NO: 499666 - DNA, 25 bp, Rattus norvegicus
caagtcggggcccacagcggcgtct

SEQ ID NO: 499667 - DNA, 25 bp, Rattus norvegicus
tctgccggtctttgtcccgggtgtg

SEQ ID NO: 499668 - DNA, 25 bp, Rattus norvegicus
cccacgctggtctgccggtctttgt

SEQ ID NO: 499669 - DNA, 25 bp, Rattus norvegicus
cactacttctgcgacggtgaagctg

SEQ ID NO: 499670 - DNA, 25 bp, Rattus norvegicus
acctgagtctctgcaacgcgatcca

SEQ ID NO: 499671 - DNA, 25 bp, Rattus norvegicus
cgacgacgtggcgtaagttttgcca

SEQ ID NO: 499672 - DNA, 25 bp, Rattus norvegicus
ggcccgtattgctgagagccgacct

SEQ ID NO: 499673 - DNA, 25 bp, Rattus norvegicus
cctgtcttcagagacccaactaaga

SEQ ID NO: 499674 - DNA, 25 bp, Rattus norvegicus
ccaactaagagatgaggttcggttc

SEQ ID NO: 499675 - DNA, 25 bp, Rattus norvegicus
ctggtcgaccctattgctgggagaa

SEQ ID NO: 499676 - DNA, 25 bp, Rattus norvegicus
ccctcgggaccctattgcttgaagg

SEQ ID NO: 499677 - DNA, 25 bp, Rattus norvegicus
ctgccctaggcttgaaccgggctga

SEQ ID NO: 499678 - DNA, 25 bp, Rattus norvegicus
caggctgactcgtagtgcttgttga

SEQ ID NO: 499679 - DNA, 25 bp, Rattus norvegicus
agctcttcttgcagcgcttgcactg

SEQ ID NO: 499680 - DNA, 25 bp, Rattus norvegicus
tgcgcacagccgaagggtttctcgc

SEQ ID NO: 499681 - DNA, 25 bp, Rattus norvegicus
gccatggccggcatggacacgtaca

SEQ ID NO: 499682 - DNA, 25 bp, Rattus norvegicus
ttgggcaacgccttgccagctggct

SEQ ID NO: 499683 - DNA, 25 bp, Rattus norvegicus
cgtacaccttgccacacgttgggca

SEQ ID NO: 499684 - DNA, 25 bp, Rattus norvegicus
ctcctataaggtctggaggctaggc

SEQ ID NO: 499685 - DNA, 25 bp, Rattus norvegicus
aaaacgcagcgtggaagcctgtgtg

SEQ ID NO: 499686 - DNA, 25 bp, Rattus norvegicus
cgcgcgtctgcagcttctacaggag

SEQ ID NO: 499687 - DNA, 25 bp, Rattus norvegicus
cgcttcattggtggtttccgccctt

SEQ ID NO: 499688 - DNA, 25 bp, Rattus norvegicus
aacggatgtccagcacagtggcgtc

SEQ ID NO: 499689 - DNA, 25 bp, Rattus norvegicus
ccaaaggagtgaatgctgaggcagc

SEQ ID NO: 499690 - DNA, 25 bp, Rattus norvegicus
ctggctttattgttctgcagtcgga

SEQ ID NO: 499691 - DNA, 25 bp, Rattus norvegicus
agtcgagtccacactgcctcctata

SEQ ID NO: 499692 - DNA, 25 bp, Rattus norvegicus
aacgcaagcggacctcagtcgagtc

SEQ ID NO: 499693 - DNA, 25 bp, Rattus norvegicus
cgccaggctctcgttcttttgggga

SEQ ID NO: 499694 - DNA, 25 bp, Rattus norvegicus
aaaggtgggaataggcctggcactc

SEQ ID NO: 499695 - DNA, 25 bp, Rattus norvegicus
tggcgacctgatacttggtggcata

SEQ ID NO: 499696 - DNA, 25 bp, Rattus norvegicus
ccgagcgcagcctctggcttttaaa

SEQ ID NO: 499697 - DNA, 25 bp, Rattus norvegicus
ctgttccagaaattccgcttcattg

SEQ ID NO: 499698 - DNA, 25 bp, Rattus norvegicus
cttccgccgagagtcaggagcatta

SEQ ID NO: 499699 - DNA, 25 bp, Rattus norvegicus
ccaggacttctaagggaatacgatc

SEQ ID NO: 499700 - DNA, 25 bp, Rattus norvegicus
tgcagccctaggagaagaaacagtt

SEQ ID NO: 499701 - DNA, 25 bp, Rattus norvegicus
tgtcgcccgctctcaaagctattgg

SEQ ID NO: 499702 - DNA, 25 bp, Rattus norvegicus
gagcacttgtgtacgcccgctgaga

SEQ ID NO: 499703 - DNA, 25 bp, Rattus norvegicus
cacccgctcagtgggccagtctaaa

SEQ ID NO: 499704 - DNA, 25 bp, Rattus norvegicus
gcgctgttagtgtacctgccaagaa

SEQ ID NO: 499705 - DNA, 25 bp, Rattus norvegicus
ccaggccctggtcaagtgatggctc

SEQ ID NO: 499706 - DNA, 25 bp, Rattus norvegicus
cttgctttacacttggcttccgggg

SEQ ID NO: 499707 - DNA, 25 bp, Rattus norvegicus
tcaggagcattagccggcgtcttaa

SEQ ID NO: 499708 - DNA, 25 bp, Rattus norvegicus
accttccgggcaaagcggcattctc

SEQ ID NO: 499709 - DNA, 25 bp, Rattus norvegicus
gttcgctgccatccagtttggttta

SEQ ID NO: 499710 - DNA, 25 bp, Rattus norvegicus
tgcacaacacttagcggaggagccc

SEQ ID NO: 499711 - DNA, 25 bp, Rattus norvegicus
cttggagcctcgaactcgacgccta

SEQ ID NO: 499712 - DNA, 25 bp, Rattus norvegicus
gggcgtggcccttccactctaccca

SEQ ID NO: 499713 - DNA, 25 bp, Rattus norvegicus
cggaggtcgtcacgtcacgtcttgg

SEQ ID NO: 499714 - DNA, 25 bp, Rattus norvegicus
ccactctacccaggtctgtgtggag

SEQ ID NO: 499715 - DNA, 25 bp, Rattus norvegicus
gccggtgcgcaagcgcattgcctat

SEQ ID NO: 499716 - DNA, 25 bp, Rattus norvegicus
tgcgcaagcgcattgcctattcttt

SEQ ID NO: 499717 - DNA, 25 bp, Rattus norvegicus
agcgcattgcctattctttcgcggg

SEQ ID NO: 499718 - DNA, 25 bp, Rattus norvegicus
cattgcctattctttcgcggggtcg

SEQ ID NO: 499719 - DNA, 25 bp, Rattus norvegicus
cagtggggacgtctgcggcgaaacc

SEQ ID NO: 499720 - DNA, 25 bp, Rattus norvegicus
gcgaaaccgggaagagagcactgcc

SEQ ID NO: 499721 - DNA, 25 bp, Rattus norvegicus
gaagagagcactgccggggacatgt

SEQ ID NO: 499722 - DNA, 25 bp, Rattus norvegicus
acacgccctggaccggggctctgat

SEQ ID NO: 499723 - DNA, 25 bp, Rattus norvegicus
gggctctgattctgctttccgcatc

SEQ ID NO: 499724 - DNA, 25 bp, Rattus norvegicus
tgattctgctttccgcatccctgcg

SEQ ID NO: 499725 - DNA, 25 bp, Rattus norvegicus
cgtagcggaggtcgtcacgtcacgt

SEQ ID NO: 499726 - DNA, 25 bp, Rattus norvegicus
ccttctaggaggactaggttgttga

SEQ ID NO: 499727 - DNA, 25 bp, Rattus norvegicus
cgttcaggagacacggcctacctca

SEQ ID NO: 499728 - DNA, 25 bp, Rattus norvegicus
gcctacctcagcgtcgcggttcagg

SEQ ID NO: 499729 - DNA, 25 bp, Rattus norvegicus
cggttcaggcggtacacatagagct

SEQ ID NO: 499730 - DNA, 25 bp, Rattus norvegicus
acacatagagctgcgaggtgccggc

SEQ ID NO: 499731 - DNA, 25 bp, Rattus norvegicus
gccaccacgaggttgcgctcactgt

SEQ ID NO: 499732 - DNA, 25 bp, Rattus norvegicus
aggttgcgctcactgttgttgaaga

SEQ ID NO: 499733 - DNA, 25 bp, Rattus norvegicus
tgttgaagaagttgcagtacatggc

SEQ ID NO: 499734 - DNA, 25 bp, Rattus norvegicus
gtacatggcaaactcgagcccggtg

SEQ ID NO: 499735 - DNA, 25 bp, Rattus norvegicus
cgcctgcttgtacaccgcgtacatg

SEQ ID NO: 499736 - DNA, 25 bp, Rattus norvegicus
cgccaccgagttccgagtttctgcg

SEQ ID NO: 499737 - DNA, 25 bp, Rattus norvegicus
gttccggaccgcttcgcatttgcgc

SEQ ID NO: 499738 - DNA, 25 bp, Rattus norvegicus
ttccgagtttctgcgcctgcgcttt

SEQ ID NO: 499739 - DNA, 25 bp, Rattus norvegicus
ggcctgggcatctccgttcaggaga

SEQ ID NO: 499740 - DNA, 25 bp, Rattus norvegicus
catagcaagcccaatccgtaggtcg

SEQ ID NO: 499741 - DNA, 25 bp, Rattus norvegicus
ttgagcctacgcacatagcaagccc

SEQ ID NO: 499742 - DNA, 25 bp, Rattus norvegicus
tctccaacttgagcctacgcacata

SEQ ID NO: 499743 - DNA, 25 bp, Rattus norvegicus
gcagctcggcgctcattctccaact

SEQ ID NO: 499744 - DNA, 25 bp, Rattus norvegicus
atggcgacagaagctcggtgctcgc

SEQ ID NO: 499745 - DNA, 25 bp, Rattus norvegicus
gccgggaaacccgatcggcagctcg

SEQ ID NO: 499746 - DNA, 25 bp, Rattus norvegicus
gcctgagacactggccgcgcggcaa

SEQ ID NO: 499747 - DNA, 25 bp, Rattus norvegicus
cggcaagggccgcagagccctaaag

SEQ ID NO: 499748 - DNA, 25 bp, Rattus norvegicus
gcagagccctaaaggagaagggacc

SEQ ID NO: 499749 - DNA, 25 bp, Rattus norvegicus
agaagggaccgagacacctagccca

SEQ ID NO: 499750 - DNA, 25 bp, Rattus norvegicus
ctagcccaagggttcccacgaggag

SEQ ID NO: 499751 - DNA, 25 bp, Rattus norvegicus
gcccactgccgctgtgtacctgggg

SEQ ID NO: 499752 - DNA, 25 bp, Rattus norvegicus
cagaagctcggtgctcgctttttcc

SEQ ID NO: 499753 - DNA, 25 bp, Rattus norvegicus
tcggtgctcgctttttccgcctgcg

SEQ ID NO: 499754 - DNA, 25 bp, Rattus norvegicus
cctggaaccgcattcttgcagtctg

SEQ ID NO: 499755 - DNA, 25 bp, Rattus norvegicus
ctggaaccgcattcttgcagtctgg

SEQ ID NO: 499756 - DNA, 25 bp, Rattus norvegicus
aaagcgcgcgcgtccttcctaccca

SEQ ID NO: 499757 - DNA, 25 bp, Rattus norvegicus
gcattcttgcagtctggaacctccc

SEQ ID NO: 499758 - DNA, 25 bp, Rattus norvegicus
ccgcattcttgcagtctggaacctc

SEQ ID NO: 499759 - DNA, 25 bp, Rattus norvegicus
aaccgcattcttgcagtctggaacc

SEQ ID NO: 499760 - DNA, 25 bp, Rattus norvegicus
ggaaccgcattcttgcagtctggaa

SEQ ID NO: 499761 - DNA, 25 bp, Rattus norvegicus
cagcgccccgggatgtattcctccc

SEQ ID NO: 499762 - DNA, 25 bp, Rattus norvegicus
cacctggaaccgcattcttgcagtc

SEQ ID NO: 499763 - DNA, 25 bp, Rattus norvegicus
ggctccacctggaaccgcattcttg

SEQ ID NO: 499764 - DNA, 25 bp, Rattus norvegicus
tggctccacctggaaccgcattctt

SEQ ID NO: 499765 - DNA, 25 bp, Rattus norvegicus
ctctgcctgacccaggtacgcaccc

SEQ ID NO: 499766 - DNA, 25 bp, Rattus norvegicus
ccgctctgcctgacccaggtacgca

SEQ ID NO: 499767 - DNA, 25 bp, Rattus norvegicus
tggaaccgcattcttgcagtctgga

SEQ ID NO: 499768 - DNA, 25 bp, Rattus norvegicus
aaagcccgcggccacagcatggatc

SEQ ID NO: 499769 - DNA, 25 bp, Rattus norvegicus
ggccacagcatggatcccggatttg

SEQ ID NO: 499770 - DNA, 25 bp, Rattus norvegicus
gatcccggatttggatgagcacctg

SEQ ID NO: 499771 - DNA, 25 bp, Rattus norvegicus
tttggatgagcacctgaggcggctc

SEQ ID NO: 499772 - DNA, 25 bp, Rattus norvegicus
acctgaggcggctcagtcgtgcgct

SEQ ID NO: 499773 - DNA, 25 bp, Rattus norvegicus
cggctcagtcgtgcgctcccgggaa

SEQ ID NO: 499774 - DNA, 25 bp, Rattus norvegicus
gggtctcattcggtgcacactcgtt

SEQ ID NO: 499775 - DNA, 25 bp, Rattus norvegicus
ttctccgggttgaaatcgtggcctc

SEQ ID NO: 499776 - DNA, 25 bp, Rattus norvegicus
ggggaagcctcgcaatgtccctccg

SEQ ID NO: 499777 - DNA, 25 bp, Rattus norvegicus
gccggcccttcagcccgccaacagc

SEQ ID NO: 499778 - DNA, 25 bp, Rattus norvegicus
caagggaccggggaagcctcgcaat

SEQ ID NO: 499779 - DNA, 25 bp, Rattus norvegicus
cgcttctccacacgtgcactccgga

SEQ ID NO: 499780 - DNA, 25 bp, Rattus norvegicus
cggtgcacactcgttctccgggttg

SEQ ID NO: 499781 - DNA, 25 bp, Rattus norvegicus
tgaaatcgtggcctcgcgcccttgc

SEQ ID NO: 499782 - DNA, 25 bp, Rattus norvegicus
ccaatggaagctccgcgagggacaa

SEQ ID NO: 499783 - DNA, 25 bp, Rattus norvegicus
tccgcgcaagccaatggaagctccg

SEQ ID NO: 499784 - DNA, 25 bp, Rattus norvegicus
gtcacgtgggctccgcgcaagccaa

SEQ ID NO: 499785 - DNA, 25 bp, Rattus norvegicus
ccctcgtcctcctggtcacgtgggc

SEQ ID NO: 499786 - DNA, 25 bp, Rattus norvegicus
ccatctttgttttcgctgcggaccc

SEQ ID NO: 499787 - DNA, 25 bp, Rattus norvegicus
ggccgccatctttgttttcgctgcg

SEQ ID NO: 499788 - DNA, 25 bp, Rattus norvegicus
ccgtgcagctgcctcagtgggcctg

SEQ ID NO: 499789 - DNA, 25 bp, Rattus norvegicus
ccctgccggcttctcactgccgcgg

SEQ ID NO: 499790 - DNA, 25 bp, Rattus norvegicus
gcagccgcttcttaggcggcgcgtc

SEQ ID NO: 499791 - DNA, 25 bp, Rattus norvegicus
agctccgcgagggacaagacgacgc

SEQ ID NO: 499792 - DNA, 25 bp, Rattus norvegicus
ccgcctcttgcagctgccgagcgcc

SEQ ID NO: 499793 - DNA, 25 bp, Rattus norvegicus
tcgccggctggaagttagggtcgcc

SEQ ID NO: 499794 - DNA, 25 bp, Rattus norvegicus
ctccaatgggcgagcgagaacgccg

SEQ ID NO: 499795 - DNA, 25 bp, Rattus norvegicus
gccacctccaatgggcgagcgagaa

SEQ ID NO: 499796 - DNA, 25 bp, Rattus norvegicus
atacggtcttccacgccggagaagg

SEQ ID NO: 499797 - DNA, 25 bp, Rattus norvegicus
agcggcagcgaaggccagcctgcca

SEQ ID NO: 499798 - DNA, 25 bp, Rattus norvegicus
aagcggcagcgaaggccagcctgcc

SEQ ID NO: 499799 - DNA, 25 bp, Rattus norvegicus
tccacgccggagaagggaagaagcg

SEQ ID NO: 499800 - DNA, 25 bp, Rattus norvegicus
ttccacgccggagaagggaagaagc

SEQ ID NO: 499801 - DNA, 25 bp, Rattus norvegicus
cttccacgccggagaagggaagaag

SEQ ID NO: 499802 - DNA, 25 bp, Rattus norvegicus
gtcctatacggtcttccacgccgga

SEQ ID NO: 499803 - DNA, 25 bp, Rattus norvegicus
gcagcgaaggccagcctgccacagg

SEQ ID NO: 499804 - DNA, 25 bp, Rattus norvegicus
ggcagcgaaggccagcctgccacag

SEQ ID NO: 499805 - DNA, 25 bp, Rattus norvegicus
tatacggtcttccacgccggagaag

SEQ ID NO: 499806 - DNA, 25 bp, Rattus norvegicus
ctatacggtcttccacgccggagaa

SEQ ID NO: 499807 - DNA, 25 bp, Rattus norvegicus
cctatacggtcttccacgccggaga

SEQ ID NO: 499808 - DNA, 25 bp, Rattus norvegicus
tcctatacggtcttccacgccggag

SEQ ID NO: 499809 - DNA, 25 bp, Rattus norvegicus
tcttccacgccggagaagggaagaa

SEQ ID NO: 499810 - DNA, 25 bp, Rattus norvegicus
ttgcacgcaccaacgagaggagctc

SEQ ID NO: 499811 - DNA, 25 bp, Rattus norvegicus
acgcaccaacgagaggagctcgggc

SEQ ID NO: 499812 - DNA, 25 bp, Rattus norvegicus
tagcttgcacgcaccaacgagagga

SEQ ID NO: 499813 - DNA, 25 bp, Rattus norvegicus
gcagctagcttgcacgcaccaacga

SEQ ID NO: 499814 - DNA, 25 bp, Rattus norvegicus
ctggagcagctagcttgcacgcacc

SEQ ID NO: 499815 - DNA, 25 bp, Rattus norvegicus
gcggactggagcagctagcttgcac

SEQ ID NO: 499816 - DNA, 25 bp, Rattus norvegicus
tagcccgccctcctgaggcgcggac

SEQ ID NO: 499817 - DNA, 25 bp, Rattus norvegicus
agtcagcctcgcctcctagcccgcc

SEQ ID NO: 499818 - DNA, 25 bp, Rattus norvegicus
cgcccacaacagtcagcctcgcctc

SEQ ID NO: 499819 - DNA, 25 bp, Rattus norvegicus
tgaaggcccgaacccgcccacaaca

SEQ ID NO: 499820 - DNA, 25 bp, Rattus norvegicus
acgcagaactgaaggcccgaacccg

SEQ ID NO: 499821 - DNA, 25 bp, Rattus norvegicus
cctggagacgcagaactgaaggccc

SEQ ID NO: 499822 - DNA, 25 bp, Rattus norvegicus
gcagcacctggagacgcagaactga

SEQ ID NO: 499823 - DNA, 25 bp, Rattus norvegicus
gcgcgcagcacctggagacgcagaa

SEQ ID NO: 499824 - DNA, 25 bp, Rattus norvegicus
gaagtctccgttcccgtgcgcgtac

SEQ ID NO: 499825 - DNA, 25 bp, Rattus norvegicus
cctccgccggtggaagatcgtccgt

SEQ ID NO: 499826 - DNA, 25 bp, Rattus norvegicus
gttttgcatttcctcgcggtcgccc

SEQ ID NO: 499827 - DNA, 25 bp, Rattus norvegicus
gccttaaatacaggttttgcatttc

SEQ ID NO: 499828 - DNA, 25 bp, Rattus norvegicus
cttgatagggccttaaatacaggtt

SEQ ID NO: 499829 - DNA, 25 bp, Rattus norvegicus
gagactaaaaaacgcttgatagggc

SEQ ID NO: 499830 - DNA, 25 bp, Rattus norvegicus
tctttgcgaaagagagactaaaaaa

SEQ ID NO: 499831 - DNA, 25 bp, Rattus norvegicus
gccttttggagctctttgcgaaaga

SEQ ID NO: 499832 - DNA, 25 bp, Rattus norvegicus
aagaggatagacagccttttggagc

SEQ ID NO: 499833 - DNA, 25 bp, Rattus norvegicus
cgcaggattcccaaaagaggataga

SEQ ID NO: 499834 - DNA, 25 bp, Rattus norvegicus
gggtctccgcaggattcccaaaaga

SEQ ID NO: 499835 - DNA, 25 bp, Rattus norvegicus
cacgagcatgcgcatgggcactgcg

SEQ ID NO: 499836 - DNA, 25 bp, Rattus norvegicus
accgccacgagcatgcgcatgggca

SEQ ID NO: 499837 - DNA, 25 bp, Rattus norvegicus
tacgctgaagtctccgttcccgtgc

SEQ ID NO: 499838 - DNA, 25 bp, Rattus norvegicus
tcgggcctgtatgggaacgtaggga

SEQ ID NO: 499839 - DNA, 25 bp, Rattus norvegicus
aagtgtcgcgttgccatggcgagga

SEQ ID NO: 499840 - DNA, 25 bp, Rattus norvegicus
agaaggggcgccagctaggcggcca

SEQ ID NO: 499841 - DNA, 25 bp, Rattus norvegicus
agcgggtcacaaggggcctgcagaa

SEQ ID NO: 499842 - DNA, 25 bp, Rattus norvegicus
gccggttcttctgcggcccggtgct

SEQ ID NO: 499843 - DNA, 25 bp, Rattus norvegicus
cggtgagcccgcgccggttcttctg

SEQ ID NO: 499844 - DNA, 25 bp, Rattus norvegicus
gaacgtagggaaggccgggcacgca

SEQ ID NO: 499845 - DNA, 25 bp, Rattus norvegicus
gttccaggtgagagggcccgcgatt

SEQ ID NO: 499846 - DNA, 25 bp, Rattus norvegicus
cacctcgggccggaagtgtcgcgtt

SEQ ID NO: 499847 - DNA, 25 bp, Rattus norvegicus
gcttccgctcgggacacctcgggcc

SEQ ID NO: 499848 - DNA, 25 bp, Rattus norvegicus
tcagcaccgcggcttccgctcggga

SEQ ID NO: 499849 - DNA, 25 bp, Rattus norvegicus
cccagcactcccactcagcaccgcg

SEQ ID NO: 499850 - DNA, 25 bp, Rattus norvegicus
tgcggagccgctctgcccagcactc

SEQ ID NO: 499851 - DNA, 25 bp, Rattus norvegicus
gcgattgtgagtgagggtcgggcct

SEQ ID NO: 499852 - DNA, 25 bp, Rattus norvegicus
tcgcccacagacaatgctcaagctg

SEQ ID NO: 499853 - DNA, 25 bp, Rattus norvegicus
tggctgaactggacgccgtgcaagt

SEQ ID NO: 499854 - DNA, 25 bp, Rattus norvegicus
ggccgtgcacgaacaggtgtactca

SEQ ID NO: 499855 - DNA, 25 bp, Rattus norvegicus
gttgtttcactcttccctgcaagcg

SEQ ID NO: 499856 - DNA, 25 bp, Rattus norvegicus
ctcgagtactgtgcgtcatcaaccc

SEQ ID NO: 499857 - DNA, 25 bp, Rattus norvegicus
gtgaccgttgctgccctcgagtact

SEQ ID NO: 499858 - DNA, 25 bp, Rattus norvegicus
ctctgtgccaggcacgtgaccgttg

SEQ ID NO: 499859 - DNA, 25 bp, Rattus norvegicus
ccgtgcaagtggactactacctgga

SEQ ID NO: 499860 - DNA, 25 bp, Rattus norvegicus
tactcagccgcgctggctgaactgg

SEQ ID NO: 499861 - DNA, 25 bp, Rattus norvegicus
acaggtgtactcattcccattcctc

SEQ ID NO: 499862 - DNA, 25 bp, Rattus norvegicus
ctcaagctgctggtatctggcgagg

SEQ ID NO: 499863 - DNA, 25 bp, Rattus norvegicus
gttgcgctaacgctctgctccctat

SEQ ID NO: 499864 - DNA, 25 bp, Rattus norvegicus
gggcgtgcaaccctggttgcgctaa

SEQ ID NO: 499865 - DNA, 25 bp, Rattus norvegicus
cgcctgggctctggacatcgcagag

SEQ ID NO: 499866 - DNA, 25 bp, Rattus norvegicus
cacattctttgaaccctggaggggc

SEQ ID NO: 499867 - DNA, 25 bp, Rattus norvegicus
cgtgcagccgtacaaaagcgcgttc

SEQ ID NO: 499868 - DNA, 25 bp, Rattus norvegicus
gcagcccgggcttgagtttaaggaa

SEQ ID NO: 499869 - DNA, 25 bp, Rattus norvegicus
tttttctcgaaggacccgagcgtgc

SEQ ID NO: 499870 - DNA, 25 bp, Rattus norvegicus
aacgtcctgttcttagccaatgaga

SEQ ID NO: 499871 - DNA, 25 bp, Rattus norvegicus
tgggcggtgcgcacattctttgaac

SEQ ID NO: 499872 - DNA, 25 bp, Rattus norvegicus
aatatcccgcggtcctaacgtcctg

SEQ ID NO: 499873 - DNA, 25 bp, Rattus norvegicus
ctgtgctaggagtcagcagccgtta

SEQ ID NO: 499874 - DNA, 25 bp, Rattus norvegicus
gcagccgttaatggtcagggcattc

SEQ ID NO: 499875 - DNA, 25 bp, Rattus norvegicus
cgaggactgacgcttgaaggccaca

SEQ ID NO: 499876 - DNA, 25 bp, Rattus norvegicus
aggccacagctgaggcggattctcg

SEQ ID NO: 499877 - DNA, 25 bp, Rattus norvegicus
tgagaacgttctcggcctgtaaaaa

SEQ ID NO: 499878 - DNA, 25 bp, Rattus norvegicus
ggctcgcctggattagttgaagttc

SEQ ID NO: 499879 - DNA, 25 bp, Rattus norvegicus
agcgtgcgcgtccatatgaatcacc

SEQ ID NO: 499880 - DNA, 25 bp, Rattus norvegicus
ttcgtacttgcctgcgtgagccagt

SEQ ID NO: 499881 - DNA, 25 bp, Rattus norvegicus
ctcctcgagctgtgcgaaggtgcaa

SEQ ID NO: 499882 - DNA, 25 bp, Rattus norvegicus
tggaccggtcaataacgaacatttc

SEQ ID NO: 499883 - DNA, 25 bp, Rattus norvegicus
gtcattgacaaatagggtgccttcc

SEQ ID NO: 499884 - DNA, 25 bp, Rattus norvegicus
ttatgtcattagtacgcgcaagctc

SEQ ID NO: 499885 - DNA, 25 bp, Rattus norvegicus
cattggtggcctcgcattcgtactt

SEQ ID NO: 499886 - DNA, 25 bp, Rattus norvegicus
ctcctccggcggtatctctgtgaac

SEQ ID NO: 499887 - DNA, 25 bp, Rattus norvegicus
ccatggtcatcacggagctcctcga

SEQ ID NO: 499888 - DNA, 25 bp, Rattus norvegicus
aggtgcaaggcccatccgaatagtc

SEQ ID NO: 499889 - DNA, 25 bp, Rattus norvegicus
aggcatctttttccgccgacgtcgg

SEQ ID NO: 499890 - DNA, 25 bp, Rattus norvegicus
ccgacgtcggcgtctgcagatcata

SEQ ID NO: 499891 - DNA, 25 bp, Rattus norvegicus
tgatcgctgtctgcgttgctagccc

SEQ ID NO: 499892 - DNA, 25 bp, Rattus norvegicus
gtagatggaagagcacccgcgcttt

SEQ ID NO: 499893 - DNA, 25 bp, Rattus norvegicus
cgcaagctcagcaatggatctcata

SEQ ID NO: 499894 - DNA, 25 bp, Rattus norvegicus
ctgtgcacgaaaggcgccagactcc

SEQ ID NO: 499895 - DNA, 25 bp, Rattus norvegicus
ccggtcagcgccagttcaagcaggc

SEQ ID NO: 499896 - DNA, 25 bp, Rattus norvegicus
accgtccactcactagactcttagg

SEQ ID NO: 499897 - DNA, 25 bp, Rattus norvegicus
tccagcgcccgcagggtattgttat

SEQ ID NO: 499898 - DNA, 25 bp, Rattus norvegicus
attgttatgcaggtagaggtgtcgc

SEQ ID NO: 499899 - DNA, 25 bp, Rattus norvegicus
cgcgatgctgttgtcttgcaggaac

SEQ ID NO: 499900 - DNA, 25 bp, Rattus norvegicus
tgcaggaacagcgtctaaaggttgt

SEQ ID NO: 499901 - DNA, 25 bp, Rattus norvegicus
gttgtagggacgacaatattacttc

SEQ ID NO: 499902 - DNA, 25 bp, Rattus norvegicus
tcttaggttcacacactcgattctg

SEQ ID NO: 499903 - DNA, 25 bp, Rattus norvegicus
tctgatggacactcgcagcccatta

SEQ ID NO: 499904 - DNA, 25 bp, Rattus norvegicus
gattcccggtgggaccacgcgcaac

SEQ ID NO: 499905 - DNA, 25 bp, Rattus norvegicus
cgtagggcgccacactccactgtgg

SEQ ID NO: 499906 - DNA, 25 bp, Rattus norvegicus
ggacatgtcctagcgaccgtccact

SEQ ID NO: 499907 - DNA, 25 bp, Rattus norvegicus
tattacttcattgtgggacatgtcc

SEQ ID NO: 499908 - DNA, 25 bp, Rattus norvegicus
cgagaggggtaacctgcgaatacta

SEQ ID NO: 499909 - DNA, 25 bp, Rattus norvegicus
cttgcggctgcaagactggagaagc

SEQ ID NO: 499910 - DNA, 25 bp, Rattus norvegicus
gcgcaggccaatccgtggtatgcaa

SEQ ID NO: 499911 - DNA, 25 bp, Rattus norvegicus
tacagtcgcccagggctcacctatg

SEQ ID NO: 499912 - DNA, 25 bp, Rattus norvegicus
gcgcgcacgcgaatgcactcagtca

SEQ ID NO: 499913 - DNA, 25 bp, Rattus norvegicus
caccgtgcaggtgacagtggacatc

SEQ ID NO: 499914 - DNA, 25 bp, Rattus norvegicus
ttaacctggagttctgaagccgaga

SEQ ID NO: 499915 - DNA, 25 bp, Rattus norvegicus
ggaagttacgctctctgccacaaag

SEQ ID NO: 499916 - DNA, 25 bp, Rattus norvegicus
ggccagatccatagttagggcgata

SEQ ID NO: 499917 - DNA, 25 bp, Rattus norvegicus
gccgaccttgccactgtacgtgaga

SEQ ID NO: 499918 - DNA, 25 bp, Rattus norvegicus
ccgtgggtgagttaggtccatactc

SEQ ID NO: 499919 - DNA, 25 bp, Rattus norvegicus
ggtccatactcgaagcaagcgctga

SEQ ID NO: 499920 - DNA, 25 bp, Rattus norvegicus
ccggtcttcacagcgcaggaagtta

SEQ ID NO: 499921 - DNA, 25 bp, Rattus norvegicus
cagtggacatctaggttaacctgga

SEQ ID NO: 499922 - DNA, 25 bp, Rattus norvegicus
tctgggctccggactttggccctgt

SEQ ID NO: 499923 - DNA, 25 bp, Rattus norvegicus
tgaactttattcacacggagcactg

SEQ ID NO: 499924 - DNA, 25 bp, Rattus norvegicus
gcgagtgtgcacttgaactttattc

SEQ ID NO: 499925 - DNA, 25 bp, Rattus norvegicus
taaactggagcacaggtagcgagtg

SEQ ID NO: 499926 - DNA, 25 bp, Rattus norvegicus
cccgccgtgtcagaagtaaactgga

SEQ ID NO: 499927 - DNA, 25 bp, Rattus norvegicus
gtagctacgggatgtggacccgccc

SEQ ID NO: 499928 - DNA, 25 bp, Rattus norvegicus
cctccggaagtagctacgggatgtg

SEQ ID NO: 499929 - DNA, 25 bp, Rattus norvegicus
atcacacagtgctgtgcttggggtt

SEQ ID NO: 499930 - DNA, 25 bp, Rattus norvegicus
tcacaccggaaacagatcacacagt

SEQ ID NO: 499931 - DNA, 25 bp, Rattus norvegicus
actagagccaagttacgcattgccc

SEQ ID NO: 499932 - DNA, 25 bp, Rattus norvegicus
tgcgacctcgccaagactagagcca

SEQ ID NO: 499933 - DNA, 25 bp, Rattus norvegicus
agacacgttcgttcccactgcaggc

SEQ ID NO: 499934 - DNA, 25 bp, Rattus norvegicus
ggccctgtgtgtaggagacacgttc

SEQ ID NO: 499935 - DNA, 25 bp, Rattus norvegicus
tcgatccacacgtccgagggagcgc

SEQ ID NO: 499936 - DNA, 25 bp, Rattus norvegicus
tgcccgcatcgctcttggaaacttg

SEQ ID NO: 499937 - DNA, 25 bp, Rattus norvegicus
cgtctcggccatgccagttttcgcg

SEQ ID NO: 499938 - DNA, 25 bp, Rattus norvegicus
agagcgacccgaagaggtgaccaca

SEQ ID NO: 499939 - DNA, 25 bp, Rattus norvegicus
gcgtccagctcacccaagttcaggg

SEQ ID NO: 499940 - DNA, 25 bp, Rattus norvegicus
gaaagcgtcaggaccagcagcagta

SEQ ID NO: 499941 - DNA, 25 bp, Rattus norvegicus
tcttggaaacttgaggctgctgggc

SEQ ID NO: 499942 - DNA, 25 bp, Rattus norvegicus
gctactcgtactgatagaaagcgtc

SEQ ID NO: 499943 - DNA, 25 bp, Rattus norvegicus
tggagacgcccagtaacagctaggc

SEQ ID NO: 499944 - DNA, 25 bp, Rattus norvegicus
acagctaggcgagcagcggaagatc

SEQ ID NO: 499945 - DNA, 25 bp, Rattus norvegicus
caaggttgcttctgcccagctagtc

SEQ ID NO: 499946 - DNA, 25 bp, Rattus norvegicus
ccaggaggagttccggacgctcaga

SEQ ID NO: 499947 - DNA, 25 bp, Rattus norvegicus
aggggccactaaacggacgccgctg

SEQ ID NO: 499948 - DNA, 25 bp, Rattus norvegicus
agcgcagaagacacagccaggggcc

SEQ ID NO: 499949 - DNA, 25 bp, Rattus norvegicus
ctgcaacagtagtgcaaggggaccg

SEQ ID NO: 499950 - DNA, 25 bp, Rattus norvegicus
gccaggtaagcagcctcgagggact

SEQ ID NO: 499951 - DNA, 25 bp, Rattus norvegicus
cgagcccgttcctggctaggcgacg

SEQ ID NO: 499952 - DNA, 25 bp, Rattus norvegicus
tgataattaattcctcccttccctc

SEQ ID NO: 499953 - DNA, 25 bp, Rattus norvegicus
ctctttggcgtaattcgaaaagttg

SEQ ID NO: 499954 - DNA, 25 bp, Rattus norvegicus
gaacccgctccgattatgataatta

SEQ ID NO: 499955 - DNA, 25 bp, Rattus norvegicus
tggttgtttgaacccgctccgatta

SEQ ID NO: 499956 - DNA, 25 bp, Rattus norvegicus
cctctgcatggttgtttgaacccgc

SEQ ID NO: 499957 - DNA, 25 bp, Rattus norvegicus
ttcgccggcagtttcctctgcatgg

SEQ ID NO: 499958 - DNA, 25 bp, Rattus norvegicus
agcctcgagggactggctcccgaga

SEQ ID NO: 499959 - DNA, 25 bp, Rattus norvegicus
tgtttcctgtgtctcccgcgagccc

SEQ ID NO: 499960 - DNA, 25 bp, Rattus norvegicus
tgacggcccgccaggtaagcagcct

SEQ ID NO: 499961 - DNA, 25 bp, Rattus norvegicus
ctcccgagaggtggcttcgccggca

SEQ ID NO: 499962 - DNA, 25 bp, Rattus norvegicus
taccaaggaaactgtttcctgtgtc

SEQ ID NO: 499963 - DNA, 25 bp, Rattus norvegicus
ccctcagtactctttggcgtaattc

SEQ ID NO: 499964 - DNA, 25 bp, Rattus norvegicus
tgacaggcaagaaggcaccaggctg

SEQ ID NO: 499965 - DNA, 25 bp, Rattus norvegicus
atgtgcgtgccttcgcctacacctg

SEQ ID NO: 499966 - DNA, 25 bp, Rattus norvegicus
cgaagacttcgtactggctgtgaca

SEQ ID NO: 499967 - DNA, 25 bp, Rattus norvegicus
tgtgtgctgtccaacccggaccaga

SEQ ID NO: 499968 - DNA, 25 bp, Rattus norvegicus
aagatgcggcgcatcgactgcctgc

SEQ ID NO: 499969 - DNA, 25 bp, Rattus norvegicus
gctgacaaagtatggcgcctggacc

SEQ ID NO: 499970 - DNA, 25 bp, Rattus norvegicus
acctggtcatggtcatcctgttcaa

SEQ ID NO: 499971 - DNA, 25 bp, Rattus norvegicus
tatcccactggagagcacggacggc

SEQ ID NO: 499972 - DNA, 25 bp, Rattus norvegicus
ccgcaccatattggcgtggccgtca

SEQ ID NO: 499973 - DNA, 25 bp, Rattus norvegicus
cgtcaaggagctggacctgtacctg

SEQ ID NO: 499974 - DNA, 25 bp, Rattus norvegicus
tgtacctggcctacttcgtgcggga

SEQ ID NO: 499975 - DNA, 25 bp, Rattus norvegicus
tgtgggcagaggcaaagataccctg

SEQ ID NO: 499976 - DNA, 25 bp, Rattus norvegicus
tcctgttcaagggtatcccactgga

SEQ ID NO: 499977 - DNA, 25 bp, Rattus norvegicus
atgaactgctgggtgaaaaggccga

SEQ ID NO: 499978 - DNA, 25 bp, Rattus norvegicus
cttcagccgaccaggagggcagtgt

SEQ ID NO: 499979 - DNA, 25 bp, Rattus norvegicus
ggacatctcctttcgtgtattctcg

SEQ ID NO: 499980 - DNA, 25 bp, Rattus norvegicus
tatctaaatgctgaatgagcactcg

SEQ ID NO: 499981 - DNA, 25 bp, Rattus norvegicus
cctccatgaagctggtatctaaatg

SEQ ID NO: 499982 - DNA, 25 bp, Rattus norvegicus
cgtgctatagcacgccctccatgaa

SEQ ID NO: 499983 - DNA, 25 bp, Rattus norvegicus
ctaggagtccatagcccgcgtgcta

SEQ ID NO: 499984 - DNA, 25 bp, Rattus norvegicus
acgagatatggcgtggctgctttgc

SEQ ID NO: 499985 - DNA, 25 bp, Rattus norvegicus
cggtacccacaggaactggccacga

SEQ ID NO: 499986 - DNA, 25 bp, Rattus norvegicus
tcggctccgggaaacagaaggcact

SEQ ID NO: 499987 - DNA, 25 bp, Rattus norvegicus
acacgaggatcatccgactggcagc

SEQ ID NO: 499988 - DNA, 25 bp, Rattus norvegicus
tgtattctcgaagatgacacgagga

SEQ ID NO: 499989 - DNA, 25 bp, Rattus norvegicus
gcaacgcggtatgtgcttcagccga

SEQ ID NO: 499990 - DNA, 25 bp, Rattus norvegicus
acagaaggcacttctcggggctggc

SEQ ID NO: 499991 - DNA, 25 bp, Rattus norvegicus
tgagcactcgaaggaaggacatctc

SEQ ID NO: 499992 - DNA, 25 bp, Rattus norvegicus
tggcatacatacgttcgcgcgtgcg

SEQ ID NO: 499993 - DNA, 25 bp, Rattus norvegicus
actggtcctcactggtgcgcttgat

SEQ ID NO: 499994 - DNA, 25 bp, Rattus norvegicus
acctgctagtctcctccttcgaagt

SEQ ID NO: 499995 - DNA, 25 bp, Rattus norvegicus
gggtcgaagagctcccaccactggt

SEQ ID NO: 499996 - DNA, 25 bp, Rattus norvegicus
actgtagtagtagaagcgtgatgta

SEQ ID NO: 499997 - DNA, 25 bp, Rattus norvegicus
tgcgctgcgaagcagcactgtagta

SEQ ID NO: 499998 - DNA, 25 bp, Rattus norvegicus
cttcgaagtgaccaaggttgtcgcc

SEQ ID NO: 499999 - DNA, 25 bp, Rattus norvegicus
tcgcagttctgtgggcgatgccaca

SEQ ID NO: 500000 - DNA, 25 bp, Rattus norvegicus
ggccagcggaatgatgtcgcagttc

SEQ ID NO: 500001 - DNA, 25 bp, Rattus norvegicus
tttcagcgtctgcagtttggccagc

SEQ ID NO: 500002 - DNA, 25 bp, Rattus norvegicus
cgcggagactcagtgttctgtttca

SEQ ID NO: 500003 - DNA, 25 bp, Rattus norvegicus
cccggtgaccaggttggcatacata

SEQ ID NO: 500004 - DNA, 25 bp, Rattus norvegicus
gtgccctttcttcaggctcgggttc

SEQ ID NO: 500005 - DNA, 25 bp, Rattus norvegicus
gaggagcccgtgctaccatctcgac

SEQ ID NO: 500006 - DNA, 25 bp, Rattus norvegicus
aacgcatgcacacctgtcctcggga

SEQ ID NO: 500007 - DNA, 25 bp, Rattus norvegicus
agccagcgcttcacgtcctgggtct

SEQ ID NO: 500008 - DNA, 25 bp, Rattus norvegicus
cccgattcctagcacgactgtgctg

SEQ ID NO: 500009 - DNA, 25 bp, Rattus norvegicus
ggcacgcgtgcagaccatggcacct

SEQ ID NO: 500010 - DNA, 25 bp, Rattus norvegicus
actatcttgggcagggacacacacg

SEQ ID NO: 500011 - DNA, 25 bp, Rattus norvegicus
agggctctcacacaactatcttggg

SEQ ID NO: 500012 - DNA, 25 bp, Rattus norvegicus
tcacatctcacattcaccatcgggt

SEQ ID NO: 500013 - DNA, 25 bp, Rattus norvegicus
taaagacagcctggccgggatgcac

SEQ ID NO: 500014 - DNA, 25 bp, Rattus norvegicus
ccggctctgggcctggacacataac

SEQ ID NO: 500015 - DNA, 25 bp, Rattus norvegicus
gaagggcacaagcacaccggctctg

SEQ ID NO: 500016 - DNA, 25 bp, Rattus norvegicus
cggacaaagcctggcccgcaagatc

SEQ ID NO: 500017 - DNA, 25 bp, Rattus norvegicus
cgactcccgggcatcgcggacaaag

SEQ ID NO: 500018 - DNA, 25 bp, Rattus norvegicus
cgcccagggagttccaagtctgaaa

SEQ ID NO: 500019 - DNA, 25 bp, Rattus norvegicus
aaccacctcaagcaaagggctctca

SEQ ID NO: 500020 - DNA, 25 bp, Rattus norvegicus
cagggcgctctggaccaggcatcca

SEQ ID NO: 500021 - DNA, 25 bp, Rattus norvegicus
cctgggcaaaacctaaaggccatcg

SEQ ID NO: 500022 - DNA, 25 bp, Rattus norvegicus
cctaaaggccatcgttcttcacatc

SEQ ID NO: 500023 - DNA, 25 bp, Rattus norvegicus
caggtgtcgcggcatcatcagcgcc

SEQ ID NO: 500024 - DNA, 25 bp, Rattus norvegicus
tcatcagcgcccttggccagaagca

SEQ ID NO: 500025 - DNA, 25 bp, Rattus norvegicus
gctgtctgctggctgtccttgccca

SEQ ID NO: 500026 - DNA, 25 bp, Rattus norvegicus
cctcacggcgataggcctcacaggg

SEQ ID NO: 500027 - DNA, 25 bp, Rattus norvegicus
ctggcccgcgctaagcgggcaagct

SEQ ID NO: 500028 - DNA, 25 bp, Rattus norvegicus
aagcgggcaagctgactgctgacta

SEQ ID NO: 500029 - DNA, 25 bp, Rattus norvegicus
tgactaggggcggaacagccaagct

SEQ ID NO: 500030 - DNA, 25 bp, Rattus norvegicus
cgcgcacttccggagcttctttagg

SEQ ID NO: 500031 - DNA, 25 bp, Rattus norvegicus
cttctttagggtctcagagaccggc

SEQ ID NO: 500032 - DNA, 25 bp, Rattus norvegicus
agagaccggcgaccctacgcacggg

SEQ ID NO: 500033 - DNA, 25 bp, Rattus norvegicus
agccagcccgagacgctgtctgctg

SEQ ID NO: 500034 - DNA, 25 bp, Rattus norvegicus
attgttggcgggtccctgacgcgtc

SEQ ID NO: 500035 - DNA, 25 bp, Rattus norvegicus
ccgctagacgatcgccggaatctga

SEQ ID NO: 500036 - DNA, 25 bp, Rattus norvegicus
gatcgccggaatctgaccgagtccc

SEQ ID NO: 500037 - DNA, 25 bp, Rattus norvegicus
ccgccttccttgaccttcagccaca

SEQ ID NO: 500038 - DNA, 25 bp, Rattus norvegicus
ccacgtcctgccctcagactctaga

SEQ ID NO: 500039 - DNA, 25 bp, Rattus norvegicus
tctagaccagctctttacagggtga

SEQ ID NO: 500040 - DNA, 25 bp, Rattus norvegicus
ccagctctttacagggtgacaactt

SEQ ID NO: 500041 - DNA, 25 bp, Rattus norvegicus
atgctggagaagcaactgggtgctt

SEQ ID NO: 500042 - DNA, 25 bp, Rattus norvegicus
aagcaactgggtgctttggcctgcg

SEQ ID NO: 500043 - DNA, 25 bp, Rattus norvegicus
ctttggcctgcgagcggatccgaac

SEQ ID NO: 500044 - DNA, 25 bp, Rattus norvegicus
acacagagggataggcgtgcaaagc

SEQ ID NO: 500045 - DNA, 25 bp, Rattus norvegicus
cgtgcaaagccgtttccggtggcta

SEQ ID NO: 500046 - DNA, 25 bp, Rattus norvegicus
gccgtttccggtggctagattgttg

SEQ ID NO: 500047 - DNA, 25 bp, Rattus norvegicus
tttacagggtgacaacttgtggccc

SEQ ID NO: 500048 - DNA, 25 bp, Rattus norvegicus
agtgagccatttccagactcgccgc

SEQ ID NO: 500049 - DNA, 25 bp, Rattus norvegicus
aaggctgccgtgagccgtgtatttc

SEQ ID NO: 500050 - DNA, 25 bp, Rattus norvegicus
ccgtgtatttcctcttttggccttg

SEQ ID NO: 500051 - DNA, 25 bp, Rattus norvegicus
cggcaggtaggttgtgttttgtcta

SEQ ID NO: 500052 - DNA, 25 bp, Rattus norvegicus
gtttgaaagtatccaccgccatccg

SEQ ID NO: 500053 - DNA, 25 bp, Rattus norvegicus
ccgtttagtacttggtggtctgtca

SEQ ID NO: 500054 - DNA, 25 bp, Rattus norvegicus
ttggacgctgaaagtgagccatttc

SEQ ID NO: 500055 - DNA, 25 bp, Rattus norvegicus
catcgtaaaggtgtgaggcaccacc

SEQ ID NO: 500056 - DNA, 25 bp, Rattus norvegicus
ggcgtctcgagcagaccttgtaata

SEQ ID NO: 500057 - DNA, 25 bp, Rattus norvegicus
cctgacccacaggacatcattcatg

SEQ ID NO: 500058 - DNA, 25 bp, Rattus norvegicus
actgcggcaagaagggtgagcttca

SEQ ID NO: 500059 - DNA, 25 bp, Rattus norvegicus
gatccgggcttggaatgcagaactt

SEQ ID NO: 500060 - DNA, 25 bp, Rattus norvegicus
tgcagaactttcgtggtatgggagc

SEQ ID NO: 500061 - DNA, 25 bp, Rattus norvegicus
atgcggcctggtccactcatccaag

SEQ ID NO: 500062 - DNA, 25 bp, Rattus norvegicus
agcggtggctaaaggtcttgccgca

SEQ ID NO: 500063 - DNA, 25 bp, Rattus norvegicus
gctaaaggtcttgccgcactcgctg

SEQ ID NO: 500064 - DNA, 25 bp, Rattus norvegicus
actcgctgcactcgtacggcttctc

SEQ ID NO: 500065 - DNA, 25 bp, Rattus norvegicus
cccggtgtgtacattgtgatgctgg

SEQ ID NO: 500066 - DNA, 25 bp, Rattus norvegicus
cattgtgatgctggatgagcacgga

SEQ ID NO: 500067 - DNA, 25 bp, Rattus norvegicus
acggagcggtcgctgaaggccttcc

SEQ ID NO: 500068 - DNA, 25 bp, Rattus norvegicus
gagcggtcgctgaaggccttcccgc

SEQ ID NO: 500069 - DNA, 25 bp, Rattus norvegicus
ccttcccgcactcgctgcacgtgta

SEQ ID NO: 500070 - DNA, 25 bp, Rattus norvegicus
tgcagcagcgtcctcttcacactga

SEQ ID NO: 500071 - DNA, 25 bp, Rattus norvegicus
agcagcgtcctcttcacactgaacg

SEQ ID NO: 500072 - DNA, 25 bp, Rattus norvegicus
gcgtcctcttcacactgaacgtctt

SEQ ID NO: 500073 - DNA, 25 bp, Rattus norvegicus
cacactgaacgtcttcccgcactcg

SEQ ID NO: 500074 - DNA, 25 bp, Rattus norvegicus
gctcgtggttcatcagggtggagcg

SEQ ID NO: 500075 - DNA, 25 bp, Rattus norvegicus
aaggtcttgccgcactcgctgcact

SEQ ID NO: 500076 - DNA, 25 bp, Rattus norvegicus
acgcccgagagtcggatggtccgcc

SEQ ID NO: 500077 - DNA, 25 bp, Rattus norvegicus
ctgaagcctccgttctcctgagggc

SEQ ID NO: 500078 - DNA, 25 bp, Rattus norvegicus
aatccgagtgcctccctgcctcgcc

SEQ ID NO: 500079 - DNA, 25 bp, Rattus norvegicus
cgcgcagtccctacaaatccgagtg

SEQ ID NO: 500080 - DNA, 25 bp, Rattus norvegicus
ctctttgaggcagtagcggaagccg

SEQ ID NO: 500081 - DNA, 25 bp, Rattus norvegicus
gcgcctgctctttgaggcagtagcg

SEQ ID NO: 500082 - DNA, 25 bp, Rattus norvegicus
tgcctagagagaccgcgttctgacc

SEQ ID NO: 500083 - DNA, 25 bp, Rattus norvegicus
aggcctccgctgtgcctagagagac

SEQ ID NO: 500084 - DNA, 25 bp, Rattus norvegicus
accgagagccgaggcctccgctgtg

SEQ ID NO: 500085 - DNA, 25 bp, Rattus norvegicus
tagtaaagaactctggctagcgccc

SEQ ID NO: 500086 - DNA, 25 bp, Rattus norvegicus
ctcctgctctagtaaagaactctgg

SEQ ID NO: 500087 - DNA, 25 bp, Rattus norvegicus
gcccgcctcctgctctagtaaagaa

SEQ ID NO: 500088 - DNA, 25 bp, Rattus norvegicus
tctcctgagggccttcggtcacttc

SEQ ID NO: 500089 - DNA, 25 bp, Rattus norvegicus
gagagtcggatggtccgcccgcctc

SEQ ID NO: 500090 - DNA, 25 bp, Rattus norvegicus
gttcgaaccagcttcgcgctgtgta

SEQ ID NO: 500091 - DNA, 25 bp, Rattus norvegicus
aaagctgtactctgtgaacgcgccg

SEQ ID NO: 500092 - DNA, 25 bp, Rattus norvegicus
ctcgatggttcaaagctgtactctg

SEQ ID NO: 500093 - DNA, 25 bp, Rattus norvegicus
gggactgaggctactcgatggttca

SEQ ID NO: 500094 - DNA, 25 bp, Rattus norvegicus
atggccgctctatacccaagcacgt

SEQ ID NO: 500095 - DNA, 25 bp, Rattus norvegicus
tgctgcccaaatcaaccgcaactga

SEQ ID NO: 500096 - DNA, 25 bp, Rattus norvegicus
taccatagtctgctgcccaaatcaa

SEQ ID NO: 500097 - DNA, 25 bp, Rattus norvegicus
aggagggacccgttaccatagtctg

SEQ ID NO: 500098 - DNA, 25 bp, Rattus norvegicus
ctcatcaagggaagtcgtacccggc

SEQ ID NO: 500099 - DNA, 25 bp, Rattus norvegicus
gcggaggcttcgtctagtgaactca

SEQ ID NO: 500100 - DNA, 25 bp, Rattus norvegicus
caccagatgacgcttcccaggcgga

SEQ ID NO: 500101 - DNA, 25 bp, Rattus norvegicus
tccacgctgcactggggacaccaga

SEQ ID NO: 500102 - DNA, 25 bp, Rattus norvegicus
gtgtagccgaatctgcatcccgccg

SEQ ID NO: 500103 - DNA, 25 bp, Rattus norvegicus
ttcgcgctgtgtagccgaatctgca

SEQ ID NO: 500104 - DNA, 25 bp, Rattus norvegicus
cacctgcgagggtgagtttccacga

SEQ ID NO: 500105 - DNA, 25 bp, Rattus norvegicus
gagtttccacgacgcgcagctttgg

SEQ ID NO: 500106 - DNA, 25 bp, Rattus norvegicus
gctcgcacccgcaggtgaactgggc

SEQ ID NO: 500107 - DNA, 25 bp, Rattus norvegicus
tgaactgggccgctctagctctgct

SEQ ID NO: 500108 - DNA, 25 bp, Rattus norvegicus
caaggtcattctccaggcccgccca

SEQ ID NO: 500109 - DNA, 25 bp, Rattus norvegicus
tctgtcggagggcaggtaacttccc

SEQ ID NO: 500110 - DNA, 25 bp, Rattus norvegicus
gcctctgtcggagggcaggtaactt

SEQ ID NO: 500111 - DNA, 25 bp, Rattus norvegicus
ctccgtgcaaggtcggaggcgcaac

SEQ ID NO: 500112 - DNA, 25 bp, Rattus norvegicus
gtgctcacaggtgggcgactccgcc

SEQ ID NO: 500113 - DNA, 25 bp, Rattus norvegicus
aacgcccgggtctgatccggcgcca

SEQ ID NO: 500114 - DNA, 25 bp, Rattus norvegicus
gatcgaacccaacgcctgttgccgg

SEQ ID NO: 500115 - DNA, 25 bp, Rattus norvegicus
gtgcggatcgaacccaacgcctgtt

SEQ ID NO: 500116 - DNA, 25 bp, Rattus norvegicus
ggcgacggtgcggatcgaacccaac

SEQ ID NO: 500117 - DNA, 25 bp, Rattus norvegicus
gcccggcccttccaagctcgcaccc

SEQ ID NO: 500118 - DNA, 25 bp, Rattus norvegicus
ctccgtcccgcggtgagcattggct

SEQ ID NO: 500119 - DNA, 25 bp, Rattus norvegicus
tccggtgacctctccagctaatggc

SEQ ID NO: 500120 - DNA, 25 bp, Rattus norvegicus
gtggggagaccctgtgaatttcgtc

SEQ ID NO: 500121 - DNA, 25 bp, Rattus norvegicus
ctctgggtccgctgtactttctgcg

SEQ ID NO: 500122 - DNA, 25 bp, Rattus norvegicus
actttctgcggaaccttgtgtcgta

SEQ ID NO: 500123 - DNA, 25 bp, Rattus norvegicus
gagtgagttcgctatgggattttta

SEQ ID NO: 500124 - DNA, 25 bp, Rattus norvegicus
gacctgtttccaggggagtgagttc

SEQ ID NO: 500125 - DNA, 25 bp, Rattus norvegicus
taggatttactagcttccggtgacc

SEQ ID NO: 500126 - DNA, 25 bp, Rattus norvegicus
accttgtgtcgtagacctgtttcca

SEQ ID NO: 500127 - DNA, 25 bp, Rattus norvegicus
catcctgctcgggaggcaccagcag

SEQ ID NO: 500128 - DNA, 25 bp, Rattus norvegicus
ccagcagcctcaagccggagaacta

SEQ ID NO: 500129 - DNA, 25 bp, Rattus norvegicus
cggagaactaatcgcgctccgcgca

SEQ ID NO: 500130 - DNA, 25 bp, Rattus norvegicus
cacgtttttcaggagccagggcatc

SEQ ID NO: 500131 - DNA, 25 bp, Rattus norvegicus
tgtgaatttcgtcctgtcccacgtt

SEQ ID NO: 500132 - DNA, 25 bp, Rattus norvegicus
cgccatcttggtggccacgtgatca

SEQ ID NO: 500133 - DNA, 25 bp, Rattus norvegicus
ttcggaaaccctgacggtgccctga

SEQ ID NO: 500134 - DNA, 25 bp, Rattus norvegicus
cccgggcagagagtacctcagaacg

SEQ ID NO: 500135 - DNA, 25 bp, Rattus norvegicus
actgcttaccctgctttcgactata

SEQ ID NO: 500136 - DNA, 25 bp, Rattus norvegicus
ttcgactataaggactggtcactga

SEQ ID NO: 500137 - DNA, 25 bp, Rattus norvegicus
gcggccacagctccgagaacaagtc

SEQ ID NO: 500138 - DNA, 25 bp, Rattus norvegicus
ccgcgactaggggtgttcaaagaca

SEQ ID NO: 500139 - DNA, 25 bp, Rattus norvegicus
ttcaaagacagagcgatacggcagc

SEQ ID NO: 500140 - DNA, 25 bp, Rattus norvegicus
gcgacgcctcgggactgtcctaaaa

SEQ ID NO: 500141 - DNA, 25 bp, Rattus norvegicus
actgtcctaaaagccggagaagcga

SEQ ID NO: 500142 - DNA, 25 bp, Rattus norvegicus
ttcaaagagcaacagcgacgatccc

SEQ ID NO: 500143 - DNA, 25 bp, Rattus norvegicus
cccacagaacgtgcgcaggttctaa

SEQ ID NO: 500144 - DNA, 25 bp, Rattus norvegicus
ttctaataggcgtggcggtgttcta

SEQ ID NO: 500145 - DNA, 25 bp, Rattus norvegicus
cactgagctctggtcactcgggaca

SEQ ID NO: 500146 - DNA, 25 bp, Rattus norvegicus
tcttagggagctgaagcagccgcca

SEQ ID NO: 500147 - DNA, 25 bp, Rattus norvegicus
ttgcggcagatggtgagtggcgctc

SEQ ID NO: 500148 - DNA, 25 bp, Rattus norvegicus
ccctttgtcttagggagctgaagca

SEQ ID NO: 500149 - DNA, 25 bp, Rattus norvegicus
tgtcttagggagctgaagcagccgc

SEQ ID NO: 500150 - DNA, 25 bp, Rattus norvegicus
tagggagctgaagcagccgccacag

SEQ ID NO: 500151 - DNA, 25 bp, Rattus norvegicus
ccgccacagggcgagaggttgcggc

SEQ ID NO: 500152 - DNA, 25 bp, Rattus norvegicus
tccgcacccaacctccgcgccctag

SEQ ID NO: 500153 - DNA, 25 bp, Rattus norvegicus
aacctccgcgccctagcgtatgcca

SEQ ID NO: 500154 - DNA, 25 bp, Rattus norvegicus
gccctagcgtatgccagcccttccc

SEQ ID NO: 500155 - DNA, 25 bp, Rattus norvegicus
ttcccccgacggatggctgcgaccg

SEQ ID NO: 500156 - DNA, 25 bp, Rattus norvegicus
ggctgctgacccaggccgcaccctc

SEQ ID NO: 500157 - DNA, 25 bp, Rattus norvegicus
aggccgcaccctccgatccctcgga

SEQ ID NO: 500158 - DNA, 25 bp, Rattus norvegicus
tttgtcttagggagctgaagcagcc

SEQ ID NO: 500159 - DNA, 25 bp, Rattus norvegicus
tgagtggcgctctgtcggctgcgcg

SEQ ID NO: 500160 - DNA, 25 bp, Rattus norvegicus
cagcgagctgactggtcgggatcct

SEQ ID NO: 500161 - DNA, 25 bp, Rattus norvegicus
gaggaacctggatgtgtgggactcg

SEQ ID NO: 500162 - DNA, 25 bp, Rattus norvegicus
tccgtcccgccactgtggcagcgcc

SEQ ID NO: 500163 - DNA, 25 bp, Rattus norvegicus
tgactggtcgggatcctccgtcccg

SEQ ID NO: 500164 - DNA, 25 bp, Rattus norvegicus
accactcgccggctgtgcgaagaag

SEQ ID NO: 500165 - DNA, 25 bp, Rattus norvegicus
gtgcgccgatccctctgtcccttgg

SEQ ID NO: 500166 - DNA, 25 bp, Rattus norvegicus
caggttatggctccggcttcggccc

SEQ ID NO: 500167 - DNA, 25 bp, Rattus norvegicus
ccgactcaggttatggctccggctt

SEQ ID NO: 500168 - DNA, 25 bp, Rattus norvegicus
accgctccgactcaggttatggctc

SEQ ID NO: 500169 - DNA, 25 bp, Rattus norvegicus
ttcactaccgctccgactcaggtta

SEQ ID NO: 500170 - DNA, 25 bp, Rattus norvegicus
cgggcgacccgcgacaggccacctc

SEQ ID NO: 500171 - DNA, 25 bp, Rattus norvegicus
gcaccggcagctccacctccgactc

SEQ ID NO: 500172 - DNA, 25 bp, Rattus norvegicus
ttcgtcggccgcctcctctgtgcgt

SEQ ID NO: 500173 - DNA, 25 bp, Rattus norvegicus
ggtcacctgcatcccttcgtcggcc

SEQ ID NO: 500174 - DNA, 25 bp, Rattus norvegicus
ctgcttcaggcgagtggatgccttg

SEQ ID NO: 500175 - DNA, 25 bp, Rattus norvegicus
gcagcagcacatccttcagcttctt

SEQ ID NO: 500176 - DNA, 25 bp, Rattus norvegicus
cagggacactggtgagtcgctctga

SEQ ID NO: 500177 - DNA, 25 bp, Rattus norvegicus
tgagtcgctctgagtgcagcccacc

SEQ ID NO: 500178 - DNA, 25 bp, Rattus norvegicus
ggctcggcccgagcacaaacctggt

SEQ ID NO: 500179 - DNA, 25 bp, Rattus norvegicus
ggcccgagcacaaacctggtccttg

SEQ ID NO: 500180 - DNA, 25 bp, Rattus norvegicus
gagcacaaacctggtccttgaactg

SEQ ID NO: 500181 - DNA, 25 bp, Rattus norvegicus
gtccttgaactgctccgcgttcctc

SEQ ID NO: 500182 - DNA, 25 bp, Rattus norvegicus
ccttgtcggcctgtagaaacaggtg

SEQ ID NO: 500183 - DNA, 25 bp, Rattus norvegicus
tcgtcttccacttgcagcagcacat

SEQ ID NO: 500184 - DNA, 25 bp, Rattus norvegicus
tggatgccttgtcggcctgtagaaa

SEQ ID NO: 500185 - DNA, 25 bp, Rattus norvegicus
ctgtagaaacaggtggccagggaca

SEQ ID NO: 500186 - DNA, 25 bp, Rattus norvegicus
ctgccgcttaagctgcttcaggcga

SEQ ID NO: 500187 - DNA, 25 bp, Rattus norvegicus
ctctagctgccgcttaagctgcttc

SEQ ID NO: 500188 - DNA, 25 bp, Rattus norvegicus
cccaatccaataggggtctggccta

SEQ ID NO: 500189 - DNA, 25 bp, Rattus norvegicus
caaacgcctagagtctggtcgccgc

SEQ ID NO: 500190 - DNA, 25 bp, Rattus norvegicus
gtctggcctaaactgacaggttttc

SEQ ID NO: 500191 - DNA, 25 bp, Rattus norvegicus
cagcagatcaggttcttgagccttc

SEQ ID NO: 500192 - DNA, 25 bp, Rattus norvegicus
cgcgagactggagctacagcagatc

SEQ ID NO: 500193 - DNA, 25 bp, Rattus norvegicus
gcgctggttcttccgagtggacttt

SEQ ID NO: 500194 - DNA, 25 bp, Rattus norvegicus
agagctcgctcacctgaacctggat

SEQ ID NO: 500195 - DNA, 25 bp, Rattus norvegicus
ccctcggatgaggatgcgaagtcga

SEQ ID NO: 500196 - DNA, 25 bp, Rattus norvegicus
ctcagcccagggctcagagactgca

SEQ ID NO: 500197 - DNA, 25 bp, Rattus norvegicus
ggagcccacgacctcatctggcgag

SEQ ID NO: 500198 - DNA, 25 bp, Rattus norvegicus
tgccaaacttacaaaggagccgctg

SEQ ID NO: 500199 - DNA, 25 bp, Rattus norvegicus
cccttccagaggagggcaggtctac

SEQ ID NO: 500200 - DNA, 25 bp, Rattus norvegicus
acagccaggcgcaatgtctgcagca

SEQ ID NO: 500201 - DNA, 25 bp, Rattus norvegicus
aggaccgaccgatcctgactcagga

SEQ ID NO: 500202 - DNA, 25 bp, Rattus norvegicus
tcctattgtcacttcctcaggggcg

SEQ ID NO: 500203 - DNA, 25 bp, Rattus norvegicus
gcgcgaccggaaggaatgagatccc

SEQ ID NO: 500204 - DNA, 25 bp, Rattus norvegicus
atttttcaccaatgagaatgacgga

SEQ ID NO: 500205 - DNA, 25 bp, Rattus norvegicus
ggacagcgtttctctgcaacttggg

SEQ ID NO: 500206 - DNA, 25 bp, Rattus norvegicus
cgggaacgactatccggacagcgtt

SEQ ID NO: 500207 - DNA, 25 bp, Rattus norvegicus
cctcaggggcgggttagcgtcattt

SEQ ID NO: 500208 - DNA, 25 bp, Rattus norvegicus
gcccgtcaagggcactcctattgtc

SEQ ID NO: 500209 - DNA, 25 bp, Rattus norvegicus
tacctcccggcagtgtgagcagagg

SEQ ID NO: 500210 - DNA, 25 bp, Rattus norvegicus
gggctcctacctcccggcagtgtga

SEQ ID NO: 500211 - DNA, 25 bp, Rattus norvegicus
atcgccttcctgcataggagcgcgc

SEQ ID NO: 500212 - DNA, 25 bp, Rattus norvegicus
tctgccgatcgccttcctgcatagg

SEQ ID NO: 500213 - DNA, 25 bp, Rattus norvegicus
ctctaggagcttcggtctgccgatc

SEQ ID NO: 500214 - DNA, 25 bp, Rattus norvegicus
ggcggctcggtatttttcaccaatg

SEQ ID NO: 500215 - DNA, 25 bp, Rattus norvegicus
ttagcgtcatttccgggaacgacta

SEQ ID NO: 500216 - DNA, 25 bp, Rattus norvegicus
caggtgcggactctcgttcgaatac

SEQ ID NO: 500217 - DNA, 25 bp, Rattus norvegicus
gaagtcacccaggtagcgcaccata

SEQ ID NO: 500218 - DNA, 25 bp, Rattus norvegicus
cgcaccatatcgctggcgtctggga

SEQ ID NO: 500219 - DNA, 25 bp, Rattus norvegicus
taagcctgggagtagtgtctgaaga

SEQ ID NO: 500220 - DNA, 25 bp, Rattus norvegicus
tcgtcgctgaggagagagttccagt

SEQ ID NO: 500221 - DNA, 25 bp, Rattus norvegicus
cagcacgcagtagtcccggtgcgga

SEQ ID NO: 500222 - DNA, 25 bp, Rattus norvegicus
aggaccagcgcccagcacgcagtag

SEQ ID NO: 500223 - DNA, 25 bp, Rattus norvegicus
tccagtcgtggcgaaggttgaactc

SEQ ID NO: 500224 - DNA, 25 bp, Rattus norvegicus
tgcagccatctgcaggcccgcagga

SEQ ID NO: 500225 - DNA, 25 bp, Rattus norvegicus
gctcgatgcaggagtgcagccatct

SEQ ID NO: 500226 - DNA, 25 bp, Rattus norvegicus
cgcttgttgatgctgatgagcttgc

SEQ ID NO: 500227 - DNA, 25 bp, Rattus norvegicus
gaatacctcgtagtccctgccggct

SEQ ID NO: 500228 - DNA, 25 bp, Rattus norvegicus
agccctaggcgctgtgcgaagtcac

SEQ ID NO: 500229 - DNA, 25 bp, Rattus norvegicus
cttgcctgtgtaccgcttgttgatg

SEQ ID NO: 500230 - DNA, 25 bp, Rattus norvegicus
gatgctctcacggtaggctgcagtg

SEQ ID NO: 500231 - DNA, 25 bp, Rattus norvegicus
cgagtggtgcgcacgtgctgtgagc

SEQ ID NO: 500232 - DNA, 25 bp, Rattus norvegicus
ccacgcgcggcacgccgggactagt

SEQ ID NO: 500233 - DNA, 25 bp, Rattus norvegicus
tcacgtgtgccacgcgcggcacgcc

SEQ ID NO: 500234 - DNA, 25 bp, Rattus norvegicus
cccactccgggccaatagcaggggg

SEQ ID NO: 500235 - DNA, 25 bp, Rattus norvegicus
agcggccacgcctctccccactccg

SEQ ID NO: 500236 - DNA, 25 bp, Rattus norvegicus
cgacggctgactcgcgccacagcgg

SEQ ID NO: 500237 - DNA, 25 bp, Rattus norvegicus
aagcgacggctgactcgcgccacag

SEQ ID NO: 500238 - DNA, 25 bp, Rattus norvegicus
taggctgcagtggagggaagcgacg

SEQ ID NO: 500239 - DNA, 25 bp, Rattus norvegicus
atgctctcacggtaggctgcagtgg

SEQ ID NO: 500240 - DNA, 25 bp, Rattus norvegicus
gcgatgctctcacggtaggctgcag

SEQ ID NO: 500241 - DNA, 25 bp, Rattus norvegicus
tcacggtaggctgcagtggagggaa

SEQ ID NO: 500242 - DNA, 25 bp, Rattus norvegicus
tgctctcacggtaggctgcagtgga

SEQ ID NO: 500243 - DNA, 25 bp, Rattus norvegicus
ggaagcgacggctgactcgcgccac

SEQ ID NO: 500244 - DNA, 25 bp, Rattus norvegicus
gacgttctcgcttgctccagtctgg

SEQ ID NO: 500245 - DNA, 25 bp, Rattus norvegicus
cagcgctgtcgtaaatggcccatca

SEQ ID NO: 500246 - DNA, 25 bp, Rattus norvegicus
cgcctctgaggtgccagacacagtg

SEQ ID NO: 500247 - DNA, 25 bp, Rattus norvegicus
cgccctgagcggttcagaactgaaa

SEQ ID NO: 500248 - DNA, 25 bp, Rattus norvegicus
gctaaaagtcctacctcgcctctga

SEQ ID NO: 500249 - DNA, 25 bp, Rattus norvegicus
ggaagtccgtcacagctcttggcta

SEQ ID NO: 500250 - DNA, 25 bp, Rattus norvegicus
tccttctagtcagcggaaaaacgtc

SEQ ID NO: 500251 - DNA, 25 bp, Rattus norvegicus
ccagtctggttgttggtctggctca

SEQ ID NO: 500252 - DNA, 25 bp, Rattus norvegicus
cggcgcgttacttgtgcttgttacc

SEQ ID NO: 500253 - DNA, 25 bp, Rattus norvegicus
gcccgggtaagaaactgcgatagcc

SEQ ID NO: 500254 - DNA, 25 bp, Rattus norvegicus
gaggtctgcagggtcctaccaaaca

SEQ ID NO: 500255 - DNA, 25 bp, Rattus norvegicus
gcggtgtcccacaatgcttcgcgtc

SEQ ID NO: 500256 - DNA, 25 bp, Rattus norvegicus
ctcgatactcgcagggaccaagaca

SEQ ID NO: 500257 - DNA, 25 bp, Rattus norvegicus
tcgggagagggatccacacacaatg

SEQ ID NO: 500258 - DNA, 25 bp, Rattus norvegicus
tcaccaggcgtgttccccggtgtgc

SEQ ID NO: 500259 - DNA, 25 bp, Rattus norvegicus
tgtcaccaggcgtgttccccagtgt

SEQ ID NO: 500260 - DNA, 25 bp, Rattus norvegicus
cccagtgtgcgtgtcaccaggcgtg

SEQ ID NO: 500261 - DNA, 25 bp, Rattus norvegicus
cagtgtgcgtgtcaccaggcgtgtt

SEQ ID NO: 500262 - DNA, 25 bp, Rattus norvegicus
accaggcgtgttccccagtgtgcgt

SEQ ID NO: 500263 - DNA, 25 bp, Rattus norvegicus
gtgtcaccaggcgtgttccccagtg

SEQ ID NO: 500264 - DNA, 25 bp, Rattus norvegicus
ctcaccaggcgtgttccccggtgtg

SEQ ID NO: 500265 - DNA, 25 bp, Rattus norvegicus
gtgtgcgtgtcaccaggcgtgttcc

SEQ ID NO: 500266 - DNA, 25 bp, Rattus norvegicus
cccagtgtgcatgtcaccaggcgtg

SEQ ID NO: 500267 - DNA, 25 bp, Rattus norvegicus
tgtgcatgtcaccaggcgtgttccc

SEQ ID NO: 500268 - DNA, 25 bp, Rattus norvegicus
ccagtgtgcgtgtcaccaggcgtgt

SEQ ID NO: 500269 - DNA, 25 bp, Rattus norvegicus
tgtgcgtgtcaccaggcgtgttccc

SEQ ID NO: 500270 - DNA, 25 bp, Rattus norvegicus
ccagtgtgcatgtcaccaggcgtgt

SEQ ID NO: 500271 - DNA, 25 bp, Rattus norvegicus
tctcaccaggcgtgttccccggtgt

SEQ ID NO: 500272 - DNA, 25 bp, Rattus norvegicus
ccttctggatacagttgtggacctg

SEQ ID NO: 500273 - DNA, 25 bp, Rattus norvegicus
gacggcagggtgttgaagcccttca

SEQ ID NO: 500274 - DNA, 25 bp, Rattus norvegicus
tgttgaagcccttcacgcccacggg

SEQ ID NO: 500275 - DNA, 25 bp, Rattus norvegicus
cgcagctgtttgtggcggtcgataa

SEQ ID NO: 500276 - DNA, 25 bp, Rattus norvegicus
cggtcgataaacatgtgcacggcca

SEQ ID NO: 500277 - DNA, 25 bp, Rattus norvegicus
ataaacatgtgcacggccagcaccc

SEQ ID NO: 500278 - DNA, 25 bp, Rattus norvegicus
cctactgagggtgtacatggagatc

SEQ ID NO: 500279 - DNA, 25 bp, Rattus norvegicus
atccctgtccgagttgtaggtggcg

SEQ ID NO: 500280 - DNA, 25 bp, Rattus norvegicus
ggacctggagaaagctgttatccct

SEQ ID NO: 500281 - DNA, 25 bp, Rattus norvegicus
agtccttgctgtccttctggataca

SEQ ID NO: 500282 - DNA, 25 bp, Rattus norvegicus
cgtggagagagtccttgctgtcctt

SEQ ID NO: 500283 - DNA, 25 bp, Rattus norvegicus
gtcccacggtcttcatacgggcgtg

SEQ ID NO: 500284 - DNA, 25 bp, Rattus norvegicus
tacatggagatctccgtggacggca

SEQ ID NO: 500285 - DNA, 25 bp, Rattus norvegicus
agctgttatccctgtccgagttgta

SEQ ID NO: 500286 - DNA, 25 bp, Rattus norvegicus
tacggggcctctgttgtccgcggac

SEQ ID NO: 500287 - DNA, 25 bp, Rattus norvegicus
cgactcctgttccacagttccggaa

SEQ ID NO: 500288 - DNA, 25 bp, Rattus norvegicus
agacagggcgctctcacctacagca

SEQ ID NO: 500289 - DNA, 25 bp, Rattus norvegicus
agcaggagcgcccacctactgcgtc

SEQ ID NO: 500290 - DNA, 25 bp, Rattus norvegicus
ttccacttactgcatcgccgtggtg

SEQ ID NO: 500291 - DNA, 25 bp, Rattus norvegicus
cagcgctctgtagcccgccaggagt

SEQ ID NO: 500292 - DNA, 25 bp, Rattus norvegicus
tccgcaaagctccttggaagccagc

SEQ ID NO: 500293 - DNA, 25 bp, Rattus norvegicus
tcccagctacagcatcgccgtggtg

SEQ ID NO: 500294 - DNA, 25 bp, Rattus norvegicus
cccgatccgcaaagctccttggaag

SEQ ID NO: 500295 - DNA, 25 bp, Rattus norvegicus
agcagccgcggttattgttgttggc

SEQ ID NO: 500296 - DNA, 25 bp, Rattus norvegicus
ctgttccacagttccggaatgagcg

SEQ ID NO: 500297 - DNA, 25 bp, Rattus norvegicus
actggacagctctcggagcaggagc

SEQ ID NO: 500298 - DNA, 25 bp, Rattus norvegicus
ccgcggtgctggactggacagctct

SEQ ID NO: 500299 - DNA, 25 bp, Rattus norvegicus
tccttggaagccagcgagcgagaga

SEQ ID NO: 500300 - DNA, 25 bp, Rattus norvegicus
gctgagtgccgccatattagccacc

SEQ ID NO: 500301 - DNA, 25 bp, Rattus norvegicus
ttgcccggggcaacgagtgccgcct

SEQ ID NO: 500302 - DNA, 25 bp, Rattus norvegicus
agctcttcggaccacggttgcccgg

SEQ ID NO: 500303 - DNA, 25 bp, Rattus norvegicus
gacagctcttcggaccacggttgcc

SEQ ID NO: 500304 - DNA, 25 bp, Rattus norvegicus
cgtgttcctgagaccagcgggaacc

SEQ ID NO: 500305 - DNA, 25 bp, Rattus norvegicus
ccgcctcgcttcctgtattgattta

SEQ ID NO: 500306 - DNA, 25 bp, Rattus norvegicus
gttgccgctgagtgccgccatatta

SEQ ID NO: 500307 - DNA, 25 bp, Rattus norvegicus
gcttcctgtattgatttaaatcctg

SEQ ID NO: 500308 - DNA, 25 bp, Rattus norvegicus
tgatttaaatcctgaaggacgtccc

SEQ ID NO: 500309 - DNA, 25 bp, Rattus norvegicus
cgtggcttgttctaggaaaaccttg

SEQ ID NO: 500310 - DNA, 25 bp, Rattus norvegicus
aaggacgtcccatactcccgagctg

SEQ ID NO: 500311 - DNA, 25 bp, Rattus norvegicus
cgtatcctcaaggaacaggggcaga

SEQ ID NO: 500312 - DNA, 25 bp, Rattus norvegicus
ccatattagccaccgcggaggccgg

SEQ ID NO: 500313 - DNA, 25 bp, Rattus norvegicus
cccgagagaggcgttggttagtcga

SEQ ID NO: 500314 - DNA, 25 bp, Rattus norvegicus
ccaccttgccggaccgaatggattc

SEQ ID NO: 500315 - DNA, 25 bp, Rattus norvegicus
atctcgtaaggcgaagtcgtgtccc

SEQ ID NO: 500316 - DNA, 25 bp, Rattus norvegicus
tccatcgtataccacgacgtgtgtg

SEQ ID NO: 500317 - DNA, 25 bp, Rattus norvegicus
tgtcgttgcttatgcccaggttgcc

SEQ ID NO: 500318 - DNA, 25 bp, Rattus norvegicus
cactgggcagcatcatctcgtaagg

SEQ ID NO: 500319 - DNA, 25 bp, Rattus norvegicus
gtcccggcactcctctatatcaaag

SEQ ID NO: 500320 - DNA, 25 bp, Rattus norvegicus
tatatcaaagaaggacgcgccaggc

SEQ ID NO: 500321 - DNA, 25 bp, Rattus norvegicus
acgtgtcgctcctggtactctttgc

SEQ ID NO: 500322 - DNA, 25 bp, Rattus norvegicus
atgacgcgtccagcacccgaaggct

SEQ ID NO: 500323 - DNA, 25 bp, Rattus norvegicus
aatggattccgccagccacttggtg

SEQ ID NO: 500324 - DNA, 25 bp, Rattus norvegicus
agccacttggtggagaccagcgctc

SEQ ID NO: 500325 - DNA, 25 bp, Rattus norvegicus
cagcgctcgatagagcacctgatga

SEQ ID NO: 500326 - DNA, 25 bp, Rattus norvegicus
catagtgtcagctctgcgtgtcacc

SEQ ID NO: 500327 - DNA, 25 bp, Rattus norvegicus
cgggtccctggtgagtaccatgacg

SEQ ID NO: 500328 - DNA, 25 bp, Rattus norvegicus
cttctcggaagtgcgtagcgaggca

SEQ ID NO: 500329 - DNA, 25 bp, Rattus norvegicus
ccgcagtccggggaatggaaggtgc

SEQ ID NO: 500330 - DNA, 25 bp, Rattus norvegicus
aaggtgcaagggctcggagtggccc

SEQ ID NO: 500331 - DNA, 25 bp, Rattus norvegicus
ccaggcagtgggctgtgcccaagtc

SEQ ID NO: 500332 - DNA, 25 bp, Rattus norvegicus
gcagtgggctgtgcccaagtctcct

SEQ ID NO: 500333 - DNA, 25 bp, Rattus norvegicus
ctgtgcccaagtctcctcccttcgg

SEQ ID NO: 500334 - DNA, 25 bp, Rattus norvegicus
ctcccttcggctggccgcaggttgg

SEQ ID NO: 500335 - DNA, 25 bp, Rattus norvegicus
gagcgcgaaaccctggtacctactg

SEQ ID NO: 500336 - DNA, 25 bp, Rattus norvegicus
aaaccctggtacctactgcccaatg

SEQ ID NO: 500337 - DNA, 25 bp, Rattus norvegicus
cctactgcccaatgcgtcctatttg

SEQ ID NO: 500338 - DNA, 25 bp, Rattus norvegicus
gcccaatgcgtcctatttgcttttc

SEQ ID NO: 500339 - DNA, 25 bp, Rattus norvegicus
gcgtcctatttgcttttctatgaga

SEQ ID NO: 500340 - DNA, 25 bp, Rattus norvegicus
tcggaagtgcgtagcgaggcaccac

SEQ ID NO: 500341 - DNA, 25 bp, Rattus norvegicus
ctatgagagagggtgcttctcggaa

SEQ ID NO: 500342 - DNA, 25 bp, Rattus norvegicus
atttcgccgactacgcgggcagctt

SEQ ID NO: 500343 - DNA, 25 bp, Rattus norvegicus
gttactggatgcgtcctggtaccta

SEQ ID NO: 500344 - DNA, 25 bp, Rattus norvegicus
acgcgagtttgaggagcgccacatc

SEQ ID NO: 500345 - DNA, 25 bp, Rattus norvegicus
ggcgccgccttctttgacatcgatc

SEQ ID NO: 500346 - DNA, 25 bp, Rattus norvegicus
gacatcgatcgttgcagcgaccaca

SEQ ID NO: 500347 - DNA, 25 bp, Rattus norvegicus
tgcctagtgccacgcatttcgccga

SEQ ID NO: 500348 - DNA, 25 bp, Rattus norvegicus
gagtgccgctacacacgtcgtgatc

SEQ ID NO: 500349 - DNA, 25 bp, Rattus norvegicus
cagggcctctattccgctccgaggg

SEQ ID NO: 500350 - DNA, 25 bp, Rattus norvegicus
accactctgtgtcgttgctggacgg

SEQ ID NO: 500351 - DNA, 25 bp, Rattus norvegicus
tggctgagccagaacctgccaatta

SEQ ID NO: 500352 - DNA, 25 bp, Rattus norvegicus
cccacgaggatatcctggagaactt

SEQ ID NO: 500353 - DNA, 25 bp, Rattus norvegicus
agctggccgtttccaaggcacacag

SEQ ID NO: 500354 - DNA, 25 bp, Rattus norvegicus
tctcagccgctgaagttactggatg

SEQ ID NO: 500355 - DNA, 25 bp, Rattus norvegicus
tcgtgatctacgacggcagcgacca

SEQ ID NO: 500356 - DNA, 25 bp, Rattus norvegicus
cgggacagcacaggccgcagccatt

SEQ ID NO: 500357 - DNA, 25 bp, Rattus norvegicus
attgccgtggcaacgggacagcaca

SEQ ID NO: 500358 - DNA, 25 bp, Rattus norvegicus
ccgggagcagaagtccttcctcagc

SEQ ID NO: 500359 - DNA, 25 bp, Rattus norvegicus
tgtgccaaggcgaagagctgcaatc

SEQ ID NO: 500360 - DNA, 25 bp, Rattus norvegicus
gctgcaatcggacagggtgagcctt

SEQ ID NO: 500361 - DNA, 25 bp, Rattus norvegicus
tcggcctctggctttcctaggattc

SEQ ID NO: 500362 - DNA, 25 bp, Rattus norvegicus
ctttcctaggattctgaggcgggga

SEQ ID NO: 500363 - DNA, 25 bp, Rattus norvegicus
gagcctagaggaatagctatgccca

SEQ ID NO: 500364 - DNA, 25 bp, Rattus norvegicus
atagctatgcccattgccgtggcaa

SEQ ID NO: 500365 - DNA, 25 bp, Rattus norvegicus
cttccttactaaggagcgctgggga

SEQ ID NO: 500366 - DNA, 25 bp, Rattus norvegicus
ctggatcccggacgcttccttacta

SEQ ID NO: 500367 - DNA, 25 bp, Rattus norvegicus
atttggagctgtggagcgctgccct

SEQ ID NO: 500368 - DNA, 25 bp, Rattus norvegicus
acggtgttcctgaccacccgccaga

SEQ ID NO: 500369 - DNA, 25 bp, Rattus norvegicus
ccgcagccatttggagctgtggagc

SEQ ID NO: 500370 - DNA, 25 bp, Rattus norvegicus
ctctcttccctggtcggcggcgggt

SEQ ID NO: 500371 - DNA, 25 bp, Rattus norvegicus
caccagggttagctcagcgcctggc

SEQ ID NO: 500372 - DNA, 25 bp, Rattus norvegicus
cacagagcacggacgagcagctgga

SEQ ID NO: 500373 - DNA, 25 bp, Rattus norvegicus
agaggacgattgctaatgacagccc

SEQ ID NO: 500374 - DNA, 25 bp, Rattus norvegicus
cccaagaggacgattgctaatgaca

SEQ ID NO: 500375 - DNA, 25 bp, Rattus norvegicus
cggatgcccaggagaaaggtgcagc

SEQ ID NO: 500376 - DNA, 25 bp, Rattus norvegicus
gtgcacagagcacggacgagcagct

SEQ ID NO: 500377 - DNA, 25 bp, Rattus norvegicus
gtgtctccactctctcttccctggt

SEQ ID NO: 500378 - DNA, 25 bp, Rattus norvegicus
ccctcgtcagtgtctccactctctc

SEQ ID NO: 500379 - DNA, 25 bp, Rattus norvegicus
gggtccctgcggacagccgcccgca

SEQ ID NO: 500380 - DNA, 25 bp, Rattus norvegicus
attgctaatgacagcccgggcctcc

SEQ ID NO: 500381 - DNA, 25 bp, Rattus norvegicus
ggccaccagggttagctcagcgcct

SEQ ID NO: 500382 - DNA, 25 bp, Rattus norvegicus
acgattgctaatgacagcccgggcc

SEQ ID NO: 500383 - DNA, 25 bp, Rattus norvegicus
agggttagctcagcgcctggcgcct

SEQ ID NO: 500384 - DNA, 25 bp, Rattus norvegicus
ccacgaagcggccagtggccatgtc

SEQ ID NO: 500385 - DNA, 25 bp, Rattus norvegicus
atcgctgtagatgccattctcccgc

SEQ ID NO: 500386 - DNA, 25 bp, Rattus norvegicus
ttgaagagccgcacccacacgtagt

SEQ ID NO: 500387 - DNA, 25 bp, Rattus norvegicus
tgtacgtgtccatgtcatcgctgta

SEQ ID NO: 500388 - DNA, 25 bp, Rattus norvegicus
cacacgtagtcacctggcaccaggg

SEQ ID NO: 500389 - DNA, 25 bp, Rattus norvegicus
gtgcatacagaatcacgaccgcctg

SEQ ID NO: 500390 - DNA, 25 bp, Rattus norvegicus
accgcctgctcgttgtggactatgt

SEQ ID NO: 500391 - DNA, 25 bp, Rattus norvegicus
ttccagctgtgcacattgaggctga

SEQ ID NO: 500392 - DNA, 25 bp, Rattus norvegicus
gcccacagagaaggccgagtaatgc

SEQ ID NO: 500393 - DNA, 25 bp, Rattus norvegicus
gccatgtcgaagtggccgtccgtgt

SEQ ID NO: 500394 - DNA, 25 bp, Rattus norvegicus
gtccgtgttcacgaagaccctgtcg

SEQ ID NO: 500395 - DNA, 25 bp, Rattus norvegicus
ccctgtcgaacagcagtgagaggaa

SEQ ID NO: 500396 - DNA, 25 bp, Rattus norvegicus
aggaagttctcgctgctgtgcaagc

SEQ ID NO: 500397 - DNA, 25 bp, Rattus norvegicus
gcacgtaggtctccttgtaattcca

SEQ ID NO: 500398 - DNA, 25 bp, Rattus norvegicus
cagcgcgaccaccaggaagtagagg

SEQ ID NO: 500399 - DNA, 25 bp, Rattus norvegicus
tactcgccgagaaggtcttagcagg

SEQ ID NO: 500400 - DNA, 25 bp, Rattus norvegicus
tgcctgtacccactggcacgagggc

SEQ ID NO: 500401 - DNA, 25 bp, Rattus norvegicus
ctggcaagcgggtgcctgtacccac

SEQ ID NO: 500402 - DNA, 25 bp, Rattus norvegicus
atgcgtgtcaccctgcgctcagagc

SEQ ID NO: 500403 - DNA, 25 bp, Rattus norvegicus
gcagaggacgaagagtgccaccaca

SEQ ID NO: 500404 - DNA, 25 bp, Rattus norvegicus
gttgagtaaatagaaaggcatccag

SEQ ID NO: 500405 - DNA, 25 bp, Rattus norvegicus
ccacattaacgatgttgagtaaata

SEQ ID NO: 500406 - DNA, 25 bp, Rattus norvegicus
ggcagcgggcacaccacattaacga

SEQ ID NO: 500407 - DNA, 25 bp, Rattus norvegicus
accaccaggaagtagaggccaaaga

SEQ ID NO: 500408 - DNA, 25 bp, Rattus norvegicus
aagccctgcttgaagcggtaggaga

SEQ ID NO: 500409 - DNA, 25 bp, Rattus norvegicus
ggatcctgcggaagccctgcttgaa

SEQ ID NO: 500410 - DNA, 25 bp, Rattus norvegicus
gaggccaaagaaggcgggctcctcc

SEQ ID NO: 500411 - DNA, 25 bp, Rattus norvegicus
cgagaaggtcttagcaggatcctgc

SEQ ID NO: 500412 - DNA, 25 bp, Rattus norvegicus
ggttgccgcccataaacaaaatgca

SEQ ID NO: 500413 - DNA, 25 bp, Rattus norvegicus
tggcgttacctcctcgcgctcttta

SEQ ID NO: 500414 - DNA, 25 bp, Rattus norvegicus
ttcttcggcaaaaggcccacattgg

SEQ ID NO: 500415 - DNA, 25 bp, Rattus norvegicus
cttgaagccgcgaacctctaactta

SEQ ID NO: 500416 - DNA, 25 bp, Rattus norvegicus
ttaggctactattgggcggatcgca

SEQ ID NO: 500417 - DNA, 25 bp, Rattus norvegicus
ggatcgcatgccactcggtgtttta

SEQ ID NO: 500418 - DNA, 25 bp, Rattus norvegicus
ggccttagagacacccaatccgcta

SEQ ID NO: 500419 - DNA, 25 bp, Rattus norvegicus
gaccggaaacgtcactcagaacatg

SEQ ID NO: 500420 - DNA, 25 bp, Rattus norvegicus
tattggtcaacggtctcaacacttg

SEQ ID NO: 500421 - DNA, 25 bp, Rattus norvegicus
ccctgtgtagagaggccagacgtct

SEQ ID NO: 500422 - DNA, 25 bp, Rattus norvegicus
ccagacgtctctccttgttcagtga

SEQ ID NO: 500423 - DNA, 25 bp, Rattus norvegicus
accggaccgtagtgatcagtgattg

SEQ ID NO: 500424 - DNA, 25 bp, Rattus norvegicus
gtgactgatgcctactgcctctgta

SEQ ID NO: 500425 - DNA, 25 bp, Rattus norvegicus
ctcaagcgtcgattggtgaccggaa

SEQ ID NO: 500426 - DNA, 25 bp, Rattus norvegicus
ttctcgaggcccagttcatccgctg

SEQ ID NO: 500427 - DNA, 25 bp, Rattus norvegicus
gtgaaatatccgaacaccggaaatg

SEQ ID NO: 500428 - DNA, 25 bp, Rattus norvegicus
ccggaaatgctaaacgctggagctg

SEQ ID NO: 500429 - DNA, 25 bp, Rattus norvegicus
cgctggagctgataattacaggata

SEQ ID NO: 500430 - DNA, 25 bp, Rattus norvegicus
ttacaggataaataaccagccgacc

SEQ ID NO: 500431 - DNA, 25 bp, Rattus norvegicus
cgagcgcctccatcagtcctctgtc

SEQ ID NO: 500432 - DNA, 25 bp, Rattus norvegicus
gtgtcgtaaattctaaggtgaaata

SEQ ID NO: 500433 - DNA, 25 bp, Rattus norvegicus
agttcatccgctggtctccaaatga

SEQ ID NO: 500434 - DNA, 25 bp, Rattus norvegicus
ccgctggtctccaaatgacattgaa

SEQ ID NO: 500435 - DNA, 25 bp, Rattus norvegicus
tgacattgaagcgtggcccaagggc

SEQ ID NO: 500436 - DNA, 25 bp, Rattus norvegicus
gtggcccaagggctcgctaatcttg

SEQ ID NO: 500437 - DNA, 25 bp, Rattus norvegicus
agggctcgctaatcttgttctttaa

SEQ ID NO: 500438 - DNA, 25 bp, Rattus norvegicus
aattaagaatcggacgatgttcgcg

SEQ ID NO: 500439 - DNA, 25 bp, Rattus norvegicus
ggataaataaccagccgacctctac

SEQ ID NO: 500440 - DNA, 25 bp, Rattus norvegicus
cggctgcggctacaaattctaagca

SEQ ID NO: 500441 - DNA, 25 bp, Rattus norvegicus
tctaagcacagggaagtaaggcgga

SEQ ID NO: 500442 - DNA, 25 bp, Rattus norvegicus
atacacacctcctctgggatgcctt

SEQ ID NO: 500443 - DNA, 25 bp, Rattus norvegicus
ctgggatgccttcccggctctgaac

SEQ ID NO: 500444 - DNA, 25 bp, Rattus norvegicus
ccagctcgggcccaccggatacaca

SEQ ID NO: 500445 - DNA, 25 bp, Rattus norvegicus
ccttcccacccgctgcgttgcgcag

SEQ ID NO: 500446 - DNA, 25 bp, Rattus norvegicus
cggctacaaattctaagcacaggga

SEQ ID NO: 500447 - DNA, 25 bp, Rattus norvegicus
tgaaattggctgtgagagcgtcagc

SEQ ID NO: 500448 - DNA, 25 bp, Rattus norvegicus
ccgtgaaattggctgtgagagcgtc

SEQ ID NO: 500449 - DNA, 25 bp, Rattus norvegicus
cagagcccgtgaaattggctgtgag

SEQ ID NO: 500450 - DNA, 25 bp, Rattus norvegicus
gcggctctccatcctgcgcaccgag

SEQ ID NO: 500451 - DNA, 25 bp, Rattus norvegicus
acgcgccggcctcactgcgttccta

SEQ ID NO: 500452 - DNA, 25 bp, Rattus norvegicus
cagcggctgcggctacaaattctaa

SEQ ID NO: 500453 - DNA, 25 bp, Rattus norvegicus
ccggatacacacctcctctgggatg

SEQ ID NO: 500454 - DNA, 25 bp, Rattus norvegicus
tctgcttccacagccacaagcgcgc

SEQ ID NO: 500455 - DNA, 25 bp, Rattus norvegicus
atggtgatcactgcgtctgtccgtc

SEQ ID NO: 500456 - DNA, 25 bp, Rattus norvegicus
gggatggtgatcactgcgtctgtcc

SEQ ID NO: 500457 - DNA, 25 bp, Rattus norvegicus
cttcaggggatggtgatcactgcgt

SEQ ID NO: 500458 - DNA, 25 bp, Rattus norvegicus
gacttcaggggatggtgatcactgc

SEQ ID NO: 500459 - DNA, 25 bp, Rattus norvegicus
gctctgtagccggatcccttcacag

SEQ ID NO: 500460 - DNA, 25 bp, Rattus norvegicus
ccttcacaggcctctccgctgcaga

SEQ ID NO: 500461 - DNA, 25 bp, Rattus norvegicus
gccacaagcgcgctcccagacacac

SEQ ID NO: 500462 - DNA, 25 bp, Rattus norvegicus
ctctccgctgcagaccctcctgccc

SEQ ID NO: 500463 - DNA, 25 bp, Rattus norvegicus
gtgatcactgcgtctgtccgtccgt

SEQ ID NO: 500464 - DNA, 25 bp, Rattus norvegicus
gctcccagacacacgccacgaggcg

SEQ ID NO: 500465 - DNA, 25 bp, Rattus norvegicus
tctgtagccggatcccttcacaggc

SEQ ID NO: 500466 - DNA, 25 bp, Rattus norvegicus
cgtccgtccggctctgtagccggat

SEQ ID NO: 500467 - DNA, 25 bp, Rattus norvegicus
cagcgccctgtgaggtggctgcacc

SEQ ID NO: 500468 - DNA, 25 bp, Rattus norvegicus
caagcaagctgtgcgctggaagttc

SEQ ID NO: 500469 - DNA, 25 bp, Rattus norvegicus
ggtacactggcttgaccaactcgaa

SEQ ID NO: 500470 - DNA, 25 bp, Rattus norvegicus
cagatgtggtacactggcttgacca

SEQ ID NO: 500471 - DNA, 25 bp, Rattus norvegicus
acgcggccggccagatgtggtacac

SEQ ID NO: 500472 - DNA, 25 bp, Rattus norvegicus
gctggaagttcacgcccatgggtca

SEQ ID NO: 500473 - DNA, 25 bp, Rattus norvegicus
aagctgtgcgctggaagttcacgcc

SEQ ID NO: 500474 - DNA, 25 bp, Rattus norvegicus
gccatcaagcaagctgtgcgctgga

SEQ ID NO: 500475 - DNA, 25 bp, Rattus norvegicus
ggcgcaggccatcaagcaagctgtg

SEQ ID NO: 500476 - DNA, 25 bp, Rattus norvegicus
ttgggcgcaggccatcaagcaagct

SEQ ID NO: 500477 - DNA, 25 bp, Rattus norvegicus
ggcttgaccaactcgaatccatgtg

SEQ ID NO: 500478 - DNA, 25 bp, Rattus norvegicus
ttgaccaactcgaatccatgtgatg

SEQ ID NO: 500479 - DNA, 25 bp, Rattus norvegicus
ctcgaatccatgtgatgcctggtac

SEQ ID NO: 500480 - DNA, 25 bp, Rattus norvegicus
atgtgatgcctggtacatgctgccc

SEQ ID NO: 500481 - DNA, 25 bp, Rattus norvegicus
tgtgcgctggaagttcacgcccatg

SEQ ID NO: 500482 - DNA, 25 bp, Rattus norvegicus
atccttgaggcgcagcagctccagg

SEQ ID NO: 500483 - DNA, 25 bp, Rattus norvegicus
ggtgcagctggctctttcgagcttc

SEQ ID NO: 500484 - DNA, 25 bp, Rattus norvegicus
agttgctgttctcggtgcagctggc

SEQ ID NO: 500485 - DNA, 25 bp, Rattus norvegicus
ctgcagttgctgttctcggtgcagc

SEQ ID NO: 500486 - DNA, 25 bp, Rattus norvegicus
gctgctctaaccctgcccgctcctc

SEQ ID NO: 500487 - DNA, 25 bp, Rattus norvegicus
gctgctcccgaagccgctgctctaa

SEQ ID NO: 500488 - DNA, 25 bp, Rattus norvegicus
ctcagccgctggcagcgttcctgtg

SEQ ID NO: 500489 - DNA, 25 bp, Rattus norvegicus
tctcatccttgaggcgcagcagctc

SEQ ID NO: 500490 - DNA, 25 bp, Rattus norvegicus
ggcaatcatgtagttctcatccttg

SEQ ID NO: 500491 - DNA, 25 bp, Rattus norvegicus
ccaggcgcatggcaatcatgtagtt

SEQ ID NO: 500492 - DNA, 25 bp, Rattus norvegicus
gctacgcagcacagccgagttcttc

SEQ ID NO: 500493 - DNA, 25 bp, Rattus norvegicus
caagctgcaggtctcggctacgcag

SEQ ID NO: 500494 - DNA, 25 bp, Rattus norvegicus
ctggctctttcgagcttcccgaagc

SEQ ID NO: 500495 - DNA, 25 bp, Rattus norvegicus
gctggcagcgttcctgtgccgcctg

SEQ ID NO: 500496 - DNA, 25 bp, Rattus norvegicus
agcgtcccgtcagcgtcctttcagg

SEQ ID NO: 500497 - DNA, 25 bp, Rattus norvegicus
gtgccctcggggtcattggctccgc

SEQ ID NO: 500498 - DNA, 25 bp, Rattus norvegicus
ctcaccggtacggttagcgcggcac

SEQ ID NO: 500499 - DNA, 25 bp, Rattus norvegicus
cacggaaaacggtaggtgctgagca

SEQ ID NO: 500500 - DNA, 25 bp, Rattus norvegicus
gtaggtgctgagcacctcctcctcg

SEQ ID NO: 500501 - DNA, 25 bp, Rattus norvegicus
gctcgtccaagacgcggcactggcg

SEQ ID NO: 500502 - DNA, 25 bp, Rattus norvegicus
caagacgcggcactggcgcagataa

SEQ ID NO: 500503 - DNA, 25 bp, Rattus norvegicus
cctgagcgcaacagctgcctgcacc

SEQ ID NO: 500504 - DNA, 25 bp, Rattus norvegicus
actggcgcagataaggcgtgagctt

SEQ ID NO: 500505 - DNA, 25 bp, Rattus norvegicus
ggacgccctcgatccgctcccatag

SEQ ID NO: 500506 - DNA, 25 bp, Rattus norvegicus
tgcatggccgcgtcctcggagtctg

SEQ ID NO: 500507 - DNA, 25 bp, Rattus norvegicus
gggtcccagcgctgtctcgctctgt

SEQ ID NO: 500508 - DNA, 25 bp, Rattus norvegicus
tgcctgcaccctccacacaagccgg

SEQ ID NO: 500509 - DNA, 25 bp, Rattus norvegicus
acggtgggcactgagccacggccac

SEQ ID NO: 500510 - DNA, 25 bp, Rattus norvegicus
agcctagggccgtctgcggcatttc

SEQ ID NO: 500511 - DNA, 25 bp, Rattus norvegicus
actctcagggcagcgcaaggacgcg

SEQ ID NO: 500512 - DNA, 25 bp, Rattus norvegicus
gtccggttcccttctggccaaggca

SEQ ID NO: 500513 - DNA, 25 bp, Rattus norvegicus
cagatgaggtcatcccgtccggttc

SEQ ID NO: 500514 - DNA, 25 bp, Rattus norvegicus
gctggagcagcagatgaggtcatcc

SEQ ID NO: 500515 - DNA, 25 bp, Rattus norvegicus
acgatggggacagggcaccctgccc

SEQ ID NO: 500516 - DNA, 25 bp, Rattus norvegicus
tctgcggcatttctgcgcgggcaac

SEQ ID NO: 500517 - DNA, 25 bp, Rattus norvegicus
ccgggctcgacgacacgaggtaatc

SEQ ID NO: 500518 - DNA, 25 bp, Rattus norvegicus
gaaggccagggtgttcagacttctc

SEQ ID NO: 500519 - DNA, 25 bp, Rattus norvegicus
agacttctcgggtggttttgacacg

SEQ ID NO: 500520 - DNA, 25 bp, Rattus norvegicus
ttgcgggaggtcagggcaccaaaac

SEQ ID NO: 500521 - DNA, 25 bp, Rattus norvegicus
gcaccaaaaccgaagcacagcgctg

SEQ ID NO: 500522 - DNA, 25 bp, Rattus norvegicus
cacagcgctgtgtatactgggactc

SEQ ID NO: 500523 - DNA, 25 bp, Rattus norvegicus
agaccggcccagcagactctcaggg

SEQ ID NO: 500524 - DNA, 25 bp, Rattus norvegicus
gctctggaaacacccaccgctcgcc

SEQ ID NO: 500525 - DNA, 25 bp, Rattus norvegicus
cgaaggatggcttccccggctgcaa

SEQ ID NO: 500526 - DNA, 25 bp, Rattus norvegicus
ctccagcaggtacgcagagtcggcg

SEQ ID NO: 500527 - DNA, 25 bp, Rattus norvegicus
gaagctccagcaggtacgcagagtc

SEQ ID NO: 500528 - DNA, 25 bp, Rattus norvegicus
gccaggaagctccagcaggtacgca

SEQ ID NO: 500529 - DNA, 25 bp, Rattus norvegicus
gttttctggccaggaagctccagca

SEQ ID NO: 500530 - DNA, 25 bp, Rattus norvegicus
gaggccgctctggaaacacccaccg

SEQ ID NO: 500531 - DNA, 25 bp, Rattus norvegicus
tcctcagcaaccacggaggccgctc

SEQ ID NO: 500532 - DNA, 25 bp, Rattus norvegicus
gatacctccttcctcagcaaccacg

SEQ ID NO: 500533 - DNA, 25 bp, Rattus norvegicus
gtcttcggtgatacctccttcctca

SEQ ID NO: 500534 - DNA, 25 bp, Rattus norvegicus
ggacgtcttcggtgatacctccttc

SEQ ID NO: 500535 - DNA, 25 bp, Rattus norvegicus
cacaccatgcacgtgggccgtggcg

SEQ ID NO: 500536 - DNA, 25 bp, Rattus norvegicus
ggacttccgccacaccatgcacgtg

SEQ ID NO: 500537 - DNA, 25 bp, Rattus norvegicus
tctggccaggaagctccagcaggta

SEQ ID NO: 500538 - DNA, 25 bp, Rattus norvegicus
ctggaggcacgaatcagtgagtgtc

SEQ ID NO: 500539 - DNA, 25 bp, Rattus norvegicus
tcacgggtgtctgcgtgacgctaac

SEQ ID NO: 500540 - DNA, 25 bp, Rattus norvegicus
ctaactgagttagagcgtcccgtgg

SEQ ID NO: 500541 - DNA, 25 bp, Rattus norvegicus
tagagcgtcccgtggtgtttctatg

SEQ ID NO: 500542 - DNA, 25 bp, Rattus norvegicus
tgtttctatggtgccgtccggaacc

SEQ ID NO: 500543 - DNA, 25 bp, Rattus norvegicus
gtcgaccggtcccaccagcgactcc

SEQ ID NO: 500544 - DNA, 25 bp, Rattus norvegicus
ggattgccaaagacgtgacgctctg

SEQ ID NO: 500545 - DNA, 25 bp, Rattus norvegicus
aaagacgtgacgctctggacggccc

SEQ ID NO: 500546 - DNA, 25 bp, Rattus norvegicus
cacctgcgtctcgatggtgcccagc

SEQ ID NO: 500547 - DNA, 25 bp, Rattus norvegicus
tctgcgtgacgctaactgagttaga

SEQ ID NO: 500548 - DNA, 25 bp, Rattus norvegicus
ccggagactctggaggcacgaatca

SEQ ID NO: 500549 - DNA, 25 bp, Rattus norvegicus
ccaattcggggctcggaccctagca

SEQ ID NO: 500550 - DNA, 25 bp, Rattus norvegicus
gggctcggaccctagcagctgcgca

SEQ ID NO: 500551 - DNA, 25 bp, Rattus norvegicus
cagcggcccgactcatctgggcgga

SEQ ID NO: 500552 - DNA, 25 bp, Rattus norvegicus
tgagagagcgagactccaaacttgg

SEQ ID NO: 500553 - DNA, 25 bp, Rattus norvegicus
acccgcttctagctgtgctgtcgtc

SEQ ID NO: 500554 - DNA, 25 bp, Rattus norvegicus
ggacggtgagtgtcacccgcttcta

SEQ ID NO: 500555 - DNA, 25 bp, Rattus norvegicus
gctgtcgtctcgcaggacctgagcg

SEQ ID NO: 500556 - DNA, 25 bp, Rattus norvegicus
agaggcagctgcaccgcatgcggca

SEQ ID NO: 500557 - DNA, 25 bp, Rattus norvegicus
tcccagcccggacccaagatgatga

SEQ ID NO: 500558 - DNA, 25 bp, Rattus norvegicus
caaacttggagaaaggagtgacctg

SEQ ID NO: 500559 - DNA, 25 bp, Rattus norvegicus
cggacactcggcaggagaacggccc

SEQ ID NO: 500560 - DNA, 25 bp, Rattus norvegicus
cagagagacagaccggcggacactc

SEQ ID NO: 500561 - DNA, 25 bp, Rattus norvegicus
agagcccgcactcaactgtggaccg

SEQ ID NO: 500562 - DNA, 25 bp, Rattus norvegicus
tgcgggaaggaagagcccgcactca

SEQ ID NO: 500563 - DNA, 25 bp, Rattus norvegicus
aagacatctggatagcggcccttcg

SEQ ID NO: 500564 - DNA, 25 bp, Rattus norvegicus
gaagcagtgagagagcgagactcca

SEQ ID NO: 500565 - DNA, 25 bp, Rattus norvegicus
accggtcaaagaggtcgaagacatc

SEQ ID NO: 500566 - DNA, 25 bp, Rattus norvegicus
cccatccgtggacgtccagggagct

SEQ ID NO: 500567 - DNA, 25 bp, Rattus norvegicus
gcatcgcggtttcgcagacagcaca

SEQ ID NO: 500568 - DNA, 25 bp, Rattus norvegicus
atcgcggtttcgcagacagcacagc

SEQ ID NO: 500569 - DNA, 25 bp, Rattus norvegicus
ggtttcgcagacagcacagccgacc

SEQ ID NO: 500570 - DNA, 25 bp, Rattus norvegicus
acagcacagccgacccgcacccggg

SEQ ID NO: 500571 - DNA, 25 bp, Rattus norvegicus
caagtgcaagcatcgcggtttcgca

SEQ ID NO: 500572 - DNA, 25 bp, Rattus norvegicus
tggcaagtgcaagcatcgcggtttc

SEQ ID NO: 500573 - DNA, 25 bp, Rattus norvegicus
ccctcgtggcaagtgcaagcatcgc

SEQ ID NO: 500574 - DNA, 25 bp, Rattus norvegicus
acttcctgccgcgctggctggtggt

SEQ ID NO: 500575 - DNA, 25 bp, Rattus norvegicus
tgacgccaagtgagcagccgcgggc

SEQ ID NO: 500576 - DNA, 25 bp, Rattus norvegicus
caactgcggtgatgggtgacgccaa

SEQ ID NO: 500577 - DNA, 25 bp, Rattus norvegicus
cagaaacctggcggggctgtcaact

SEQ ID NO: 500578 - DNA, 25 bp, Rattus norvegicus
caagcatcgcggtttcgcagacagc

SEQ ID NO: 500579 - DNA, 25 bp, Rattus norvegicus
cgtccagggagctggcagaaacctg

SEQ ID NO: 500580 - DNA, 25 bp, Rattus norvegicus
ctaaactctcgtcgccactggctga

SEQ ID NO: 500581 - DNA, 25 bp, Rattus norvegicus
ccgactgcctgctagtggccacaga

SEQ ID NO: 500582 - DNA, 25 bp, Rattus norvegicus
cgtaggctacgacgagcatttttcc

SEQ ID NO: 500583 - DNA, 25 bp, Rattus norvegicus
gttcgtgagcaacaacagccggcgc

SEQ ID NO: 500584 - DNA, 25 bp, Rattus norvegicus
ggcaaggccacgctgttcgtgagca

SEQ ID NO: 500585 - DNA, 25 bp, Rattus norvegicus
cagggcgtcttgttcgactgcgacg

SEQ ID NO: 500586 - DNA, 25 bp, Rattus norvegicus
tcgtaataactgcagctgccgcctg

SEQ ID NO: 500587 - DNA, 25 bp, Rattus norvegicus
actggctgaagcctgtgatggtagc

SEQ ID NO: 500588 - DNA, 25 bp, Rattus norvegicus
cccgtctcacgtctcgtaataactg

SEQ ID NO: 500589 - DNA, 25 bp, Rattus norvegicus
tcggctagagccttcgactaaactc

SEQ ID NO: 500590 - DNA, 25 bp, Rattus norvegicus
ccgagctccttcgagatcggctaga

SEQ ID NO: 500591 - DNA, 25 bp, Rattus norvegicus
ggcgattcgctccagaccagtctgg

SEQ ID NO: 500592 - DNA, 25 bp, Rattus norvegicus
cccgttctgcacgtcaattggtgga

SEQ ID NO: 500593 - DNA, 25 bp, Rattus norvegicus
tttccttcgccaagttgaccgaggc

SEQ ID NO: 500594 - DNA, 25 bp, Rattus norvegicus
tggtcgaccgacatcgccgtggtct

SEQ ID NO: 500595 - DNA, 25 bp, Rattus norvegicus
ggcgtgaccggccagaaccgcttct

SEQ ID NO: 500596 - DNA, 25 bp, Rattus norvegicus
ccccgccgcgggttaatgggcagct

SEQ ID NO: 500597 - DNA, 25 bp, Rattus norvegicus
tgcgttttctgggtgagtcatttcc

SEQ ID NO: 500598 - DNA, 25 bp, Rattus norvegicus
ggtgagtcatttcctcgccgggtct

SEQ ID NO: 500599 - DNA, 25 bp, Rattus norvegicus
acctaaaatgcgatgggcgtgaccg

SEQ ID NO: 500600 - DNA, 25 bp, Rattus norvegicus
ctcgccgggtctggtcgaccgacat

SEQ ID NO: 500601 - DNA, 25 bp, Rattus norvegicus
ttctgggtgagtcatttcctcgccg

SEQ ID NO: 500602 - DNA, 25 bp, Rattus norvegicus
agctgctgcctcaactccagcttgc

SEQ ID NO: 500603 - DNA, 25 bp, Rattus norvegicus
agggcgtggtcaccctcgtgcctgc

SEQ ID NO: 500604 - DNA, 25 bp, Rattus norvegicus
ttcttaaactaaaacagctgctgcc

SEQ ID NO: 500605 - DNA, 25 bp, Rattus norvegicus
tctctccccgctggagtttcttaaa

SEQ ID NO: 500606 - DNA, 25 bp, Rattus norvegicus
gggttcgcagacctaaaatgcgatg

SEQ ID NO: 500607 - DNA, 25 bp, Rattus norvegicus
gagtcatttcctcgccgggtctggt

SEQ ID NO: 500608 - DNA, 25 bp, Rattus norvegicus
agcttcactgttatgggccgcaaca

SEQ ID NO: 500609 - DNA, 25 bp, Rattus norvegicus
cacgctgccggaagcttcactgtta

SEQ ID NO: 500610 - DNA, 25 bp, Rattus norvegicus
cccggctcatcctcaactttgatga

SEQ ID NO: 500611 - DNA, 25 bp, Rattus norvegicus
tgagtgccagggtagaaacagattc

SEQ ID NO: 500612 - DNA, 25 bp, Rattus norvegicus
aaacagattcccgtccggctgccgg

SEQ ID NO: 500613 - DNA, 25 bp, Rattus norvegicus
cctggatgtgactgaagagcgtgtt

SEQ ID NO: 500614 - DNA, 25 bp, Rattus norvegicus
cctcactcgcggtttacggttctca

SEQ ID NO: 500615 - DNA, 25 bp, Rattus norvegicus
tctcagggctatgccttggaccacg

SEQ ID NO: 500616 - DNA, 25 bp, Rattus norvegicus
cacgcgagtccaacatcgtccttta

SEQ ID NO: 500617 - DNA, 25 bp, Rattus norvegicus
tcgtcctttatcacggcatatagcc

SEQ ID NO: 500618 - DNA, 25 bp, Rattus norvegicus
gcatatagccggctcccagtcgttg

SEQ ID NO: 500619 - DNA, 25 bp, Rattus norvegicus
tatgaaacggctccgcccggaagtg

SEQ ID NO: 500620 - DNA, 25 bp, Rattus norvegicus
gttttaggtcagaagcagccacgct

SEQ ID NO: 500621 - DNA, 25 bp, Rattus norvegicus
tcccagtcgttgtcgacgaatcgac

SEQ ID NO: 500622 - DNA, 25 bp, Rattus norvegicus
agagtgctgtactgcgttcgctttg

SEQ ID NO: 500623 - DNA, 25 bp, Rattus norvegicus
ttccttcctgcgaactacggccgga

SEQ ID NO: 500624 - DNA, 25 bp, Rattus norvegicus
tgacaccgcgggtaactttagtaga

SEQ ID NO: 500625 - DNA, 25 bp, Rattus norvegicus
cgggtaactttagtagagtgctgta

SEQ ID NO: 500626 - DNA, 25 bp, Rattus norvegicus
tactgcgttcgctttgcaacactga

SEQ ID NO: 500627 - DNA, 25 bp, Rattus norvegicus
tcgctttgcaacactgacgtcttcg

SEQ ID NO: 500628 - DNA, 25 bp, Rattus norvegicus
gacgtcttcgccagaggcatctatc

SEQ ID NO: 500629 - DNA, 25 bp, Rattus norvegicus
agaggcatctatcactctggcgggg

SEQ ID NO: 500630 - DNA, 25 bp, Rattus norvegicus
tcaggctctctgtctcggctgtgcg

SEQ ID NO: 500631 - DNA, 25 bp, Rattus norvegicus
tccggcggagtcacctgcacgcagg

SEQ ID NO: 500632 - DNA, 25 bp, Rattus norvegicus
tttgcccgggcttccaagttgccca

SEQ ID NO: 500633 - DNA, 25 bp, Rattus norvegicus
caagttgcccattggtccgcccggg

SEQ ID NO: 500634 - DNA, 25 bp, Rattus norvegicus
agagtcccgtgcagcgtcctcgggc

SEQ ID NO: 500635 - DNA, 25 bp, Rattus norvegicus
ccctatgcggtctccggcggagtca

SEQ ID NO: 500636 - DNA, 25 bp, Rattus norvegicus
gaggaacaagactaagctgagaagc

SEQ ID NO: 500637 - DNA, 25 bp, Rattus norvegicus
acagccgctgtggtggagcacgtcc

SEQ ID NO: 500638 - DNA, 25 bp, Rattus norvegicus
ccgctgtggtggagcacgtccagct

SEQ ID NO: 500639 - DNA, 25 bp, Rattus norvegicus
tgtggtggagcacgtccagctgccc

SEQ ID NO: 500640 - DNA, 25 bp, Rattus norvegicus
agcacgtccagctgcccgggggcat

SEQ ID NO: 500641 - DNA, 25 bp, Rattus norvegicus
ggaggccgccgaggcagaagagctg

SEQ ID NO: 500642 - DNA, 25 bp, Rattus norvegicus
cgcagcactgcgtggccaccacagc

SEQ ID NO: 500643 - DNA, 25 bp, Rattus norvegicus
ctgatgaggaacaagactaagctga

SEQ ID NO: 500644 - DNA, 25 bp, Rattus norvegicus
ccacagccgctgtggtggagcacgt

SEQ ID NO: 500645 - DNA, 25 bp, Rattus norvegicus
ctgagaagcaggagggccgcggcat

SEQ ID NO: 500646 - DNA, 25 bp, Rattus norvegicus
gctgcagcgcagcactgcgtggcca

SEQ ID NO: 500647 - DNA, 25 bp, Rattus norvegicus
tggtgcccggcatggcggctgcagc

SEQ ID NO: 500648 - DNA, 25 bp, Rattus norvegicus
cgtcggagcaagtggtgcccggcat

SEQ ID NO: 500649 - DNA, 25 bp, Rattus norvegicus
ggctgatgaggaacaagactaagct

SEQ ID NO: 500650 - DNA, 25 bp, Rattus norvegicus
tgattcatgtgtccgtgtccctgta

SEQ ID NO: 500651 - DNA, 25 bp, Rattus norvegicus
acgctctgataaagccgtgttactg

SEQ ID NO: 500652 - DNA, 25 bp, Rattus norvegicus
tgtaagccgggcgatctctcccacg

SEQ ID NO: 500653 - DNA, 25 bp, Rattus norvegicus
gtgtccctgtaagccgggcgatctc

SEQ ID NO: 500654 - DNA, 25 bp, Rattus norvegicus
tccgtgtccctgtaagccgggcgat

SEQ ID NO: 500655 - DNA, 25 bp, Rattus norvegicus
tctgataaagccgtgttactgattc

SEQ ID NO: 500656 - DNA, 25 bp, Rattus norvegicus
cccacgctctgataaagccgtgtta

SEQ ID NO: 500657 - DNA, 25 bp, Rattus norvegicus
actgattcatgtgtccgtgtccctg

SEQ ID NO: 500658 - DNA, 25 bp, Rattus norvegicus
ttactgattcatgtgtccgtgtccc

SEQ ID NO: 500659 - DNA, 25 bp, Rattus norvegicus
cgtgttactgattcatgtgtccgtg

SEQ ID NO: 500660 - DNA, 25 bp, Rattus norvegicus
atgtgtccgtgtccctgtaagccgg

SEQ ID NO: 500661 - DNA, 25 bp, Rattus norvegicus
ttcatgtgtccgtgtccctgtaagc

SEQ ID NO: 500662 - DNA, 25 bp, Rattus norvegicus
taaagccgtgttactgattcatgtg

SEQ ID NO: 500663 - DNA, 25 bp, Rattus norvegicus
agccgtgttactgattcatgtgtcc

SEQ ID NO: 500664 - DNA, 25 bp, Rattus norvegicus
tgactacgtgcaggacctgtcgccg

SEQ ID NO: 500665 - DNA, 25 bp, Rattus norvegicus
cccgcacaaggattgaggggcgcct

SEQ ID NO: 500666 - DNA, 25 bp, Rattus norvegicus
cacgcgcagagctagtctggtccta

SEQ ID NO: 500667 - DNA, 25 bp, Rattus norvegicus
cagagctagtctggtcctatccgca

SEQ ID NO: 500668 - DNA, 25 bp, Rattus norvegicus
agtctggtcctatccgcagtggtca

SEQ ID NO: 500669 - DNA, 25 bp, Rattus norvegicus
ggtcctatccgcagtggtcaacagg

SEQ ID NO: 500670 - DNA, 25 bp, Rattus norvegicus
cacaaggattgaggggcgcctgccc

SEQ ID NO: 500671 - DNA, 25 bp, Rattus norvegicus
cggcggtctgactacgtgcaggacc

SEQ ID NO: 500672 - DNA, 25 bp, Rattus norvegicus
tgtcgccgccacatcggccgcgctt

SEQ ID NO: 500673 - DNA, 25 bp, Rattus norvegicus
ggccgcgcttcactgcacaggactt

SEQ ID NO: 500674 - DNA, 25 bp, Rattus norvegicus
tgcacaggacttcaaacagcggggc

SEQ ID NO: 500675 - DNA, 25 bp, Rattus norvegicus
ggacttcaaacagcggggcctggac

SEQ ID NO: 500676 - DNA, 25 bp, Rattus norvegicus
ctggaccgtccctacccggccactg

SEQ ID NO: 500677 - DNA, 25 bp, Rattus norvegicus
ggtcaacaggaaccagtttggggca

SEQ ID NO: 500678 - DNA, 25 bp, Rattus norvegicus
ccaagcaaacaggaggatctggagc

SEQ ID NO: 500679 - DNA, 25 bp, Rattus norvegicus
ctctgaggaaagacgcaagtggttc

SEQ ID NO: 500680 - DNA, 25 bp, Rattus norvegicus
tggtcctcgaaaggtggatggatca

SEQ ID NO: 500681 - DNA, 25 bp, Rattus norvegicus
aagacgcaagtggttcgagtccacg

SEQ ID NO: 500682 - DNA, 25 bp, Rattus norvegicus
ctcgaaaggtggatggatcacggca

SEQ ID NO: 500683 - DNA, 25 bp, Rattus norvegicus
atggatcacggcagtcactggacta

SEQ ID NO: 500684 - DNA, 25 bp, Rattus norvegicus
tcactggactacgtggaactctctc

SEQ ID NO: 500685 - DNA, 25 bp, Rattus norvegicus
ctggactacgtggaactctctccat

SEQ ID NO: 500686 - DNA, 25 bp, Rattus norvegicus
cccacagcgcgtgcgtactctgtcc

SEQ ID NO: 500687 - DNA, 25 bp, Rattus norvegicus
ctcctgaacgcccaagcaaacagga

SEQ ID NO: 500688 - DNA, 25 bp, Rattus norvegicus
acgcccaagcaaacaggaggatctg

SEQ ID NO: 500689 - DNA, 25 bp, Rattus norvegicus
cctggcacaacgctctgaggaaaga

SEQ ID NO: 500690 - DNA, 25 bp, Rattus norvegicus
tggagcgggacctggcacaacgctc

SEQ ID NO: 500691 - DNA, 25 bp, Rattus norvegicus
acgggctctgaagttatcggccggg

SEQ ID NO: 500692 - DNA, 25 bp, Rattus norvegicus
tattcagacatgatcgtggctgcca

SEQ ID NO: 500693 - DNA, 25 bp, Rattus norvegicus
aggccgccaagaagtccacggacca

SEQ ID NO: 500694 - DNA, 25 bp, Rattus norvegicus
gcaggccggccaccatgaccgagaa

SEQ ID NO: 500695 - DNA, 25 bp, Rattus norvegicus
gctccttgaacagccggagcaggcc

SEQ ID NO: 500696 - DNA, 25 bp, Rattus norvegicus
cggaagaacagatcgcgagtcaggt

SEQ ID NO: 500697 - DNA, 25 bp, Rattus norvegicus
aggacaggagccacgcgtcttccgt

SEQ ID NO: 500698 - DNA, 25 bp, Rattus norvegicus
agcgccagacgcagaactgggaaaa

SEQ ID NO: 500699 - DNA, 25 bp, Rattus norvegicus
taaatacccggatgcgccgcccgag

SEQ ID NO: 500700 - DNA, 25 bp, Rattus norvegicus
ttgctcggcggaagaaacacagatg

SEQ ID NO: 500701 - DNA, 25 bp, Rattus norvegicus
agccgagcagagaccctgagagacg

SEQ ID NO: 500702 - DNA, 25 bp, Rattus norvegicus
gcgtgtgttagttgtggccgcttct

SEQ ID NO: 500703 - DNA, 25 bp, Rattus norvegicus
gctggccctttggaaggctccttga

SEQ ID NO: 500704 - DNA, 25 bp, Rattus norvegicus
tgccatccaggcagagaagaaccgc

SEQ ID NO: 500705 - DNA, 25 bp, Rattus norvegicus
ctttagtctggcctgctagtggagc

SEQ ID NO: 500706 - DNA, 25 bp, Rattus norvegicus
ctgcgtcctggaccgcgagctggaa

SEQ ID NO: 500707 - DNA, 25 bp, Rattus norvegicus
aagagtgagcgggtgatcacgtccc

SEQ ID NO: 500708 - DNA, 25 bp, Rattus norvegicus
actcagcgctggctcagctgcgctg

SEQ ID NO: 500709 - DNA, 25 bp, Rattus norvegicus
atgtgggtcaacttcttgtggcgcg

SEQ ID NO: 500710 - DNA, 25 bp, Rattus norvegicus
acacttcagtccgtgggcgcgatgt

SEQ ID NO: 500711 - DNA, 25 bp, Rattus norvegicus
aggctggccggcacacttcagtccg

SEQ ID NO: 500712 - DNA, 25 bp, Rattus norvegicus
ccacacctcgtgacggggagctcta

SEQ ID NO: 500713 - DNA, 25 bp, Rattus norvegicus
gtaagctcctgttgttctgattggc

SEQ ID NO: 500714 - DNA, 25 bp, Rattus norvegicus
accatccagttaaagtaagctcctg

SEQ ID NO: 500715 - DNA, 25 bp, Rattus norvegicus
ctgcgggtggggttaaccatccagt

SEQ ID NO: 500716 - DNA, 25 bp, Rattus norvegicus
gggcaaacgctgtcaggctccgcct

SEQ ID NO: 500717 - DNA, 25 bp, Rattus norvegicus
caaatcaatctttgcgtcgcgggca

SEQ ID NO: 500718 - DNA, 25 bp, Rattus norvegicus
ggaccttcccagtctcgacttacaa

SEQ ID NO: 500719 - DNA, 25 bp, Rattus norvegicus
ccgtgtatccgcgtggaaggcatct

SEQ ID NO: 500720 - DNA, 25 bp, Rattus norvegicus
gtacggccgcttcgccttcagcccg

SEQ ID NO: 500721 - DNA, 25 bp, Rattus norvegicus
ctatgtttcctatgggccgccgtgg

SEQ ID NO: 500722 - DNA, 25 bp, Rattus norvegicus
gcgctctacgcgctttgctggggcc

SEQ ID NO: 500723 - DNA, 25 bp, Rattus norvegicus
tctacgcgctttgctggggcccgca

SEQ ID NO: 500724 - DNA, 25 bp, Rattus norvegicus
ctctgcttctggtacggccgcttcg

SEQ ID NO: 500725 - DNA, 25 bp, Rattus norvegicus
cttcagcccggccacctacgcctgt

SEQ ID NO: 500726 - DNA, 25 bp, Rattus norvegicus
acctacgcctgtcgcctggcctcgc

SEQ ID NO: 500727 - DNA, 25 bp, Rattus norvegicus
ctggcctcgcactgcctcgcctacg

SEQ ID NO: 500728 - DNA, 25 bp, Rattus norvegicus
ctcgcctacgccaactcctgcctta

SEQ ID NO: 500729 - DNA, 25 bp, Rattus norvegicus
actcctgccttaacccgctcgtcta

SEQ ID NO: 500730 - DNA, 25 bp, Rattus norvegicus
tcatcgagccctccgtcgtgtccag

SEQ ID NO: 500731 - DNA, 25 bp, Rattus norvegicus
accacgcgctcatcctctgcttctg

SEQ ID NO: 500732 - DNA, 25 bp, Rattus norvegicus
gcacgctatgtttcctatgggccgc

SEQ ID NO: 500733 - DNA, 25 bp, Rattus norvegicus
ggttatcccggcgacgccaggcctc

SEQ ID NO: 500734 - DNA, 25 bp, Rattus norvegicus
tcccgaccatggtggcctcggcgag

SEQ ID NO: 500735 - DNA, 25 bp, Rattus norvegicus
agccactgccaaggctgctcgggcg

SEQ ID NO: 500736 - DNA, 25 bp, Rattus norvegicus
ttaaaatccacgctgcgaacgggca

SEQ ID NO: 500737 - DNA, 25 bp, Rattus norvegicus
ttccgatcaggttgaactctcccga

SEQ ID NO: 500738 - DNA, 25 bp, Rattus norvegicus
cggcaactgtttccgatcaggttga

SEQ ID NO: 500739 - DNA, 25 bp, Rattus norvegicus
ggaccagcggcaactgtttccgatc

SEQ ID NO: 500740 - DNA, 25 bp, Rattus norvegicus
ctcagtaggaccagcggcaactgtt

SEQ ID NO: 500741 - DNA, 25 bp, Rattus norvegicus
agcagtctcagtaggaccagcggca

SEQ ID NO: 500742 - DNA, 25 bp, Rattus norvegicus
tgaactctcccgaccatggtggcct

SEQ ID NO: 500743 - DNA, 25 bp, Rattus norvegicus
ccacgctgcgaacgggcagtcctgt

SEQ ID NO: 500744 - DNA, 25 bp, Rattus norvegicus
tgcctcggttaaaatccacgctgcg

SEQ ID NO: 500745 - DNA, 25 bp, Rattus norvegicus
gtgatgttgtccgtgcctcggttaa

SEQ ID NO: 500746 - DNA, 25 bp, Rattus norvegicus
tgtccccctgcctcacggtgatgtt

SEQ ID NO: 500747 - DNA, 25 bp, Rattus norvegicus
ggaagaaggcagagcagtctcagta

SEQ ID NO: 500748 - DNA, 25 bp, Rattus norvegicus
aacgcagttcgtcgcgaggctcgac

SEQ ID NO: 500749 - DNA, 25 bp, Rattus norvegicus
aggagaacaggcctccggcttccgc

SEQ ID NO: 500750 - DNA, 25 bp, Rattus norvegicus
aggtccgcaaaggagaacaggcctc

SEQ ID NO: 500751 - DNA, 25 bp, Rattus norvegicus
cagtgcagcgccgaggtccgcaaag

SEQ ID NO: 500752 - DNA, 25 bp, Rattus norvegicus
ccacaggacttggaggtagcgcagc

SEQ ID NO: 500753 - DNA, 25 bp, Rattus norvegicus
aactactgcgatcacacacgagcga

SEQ ID NO: 500754 - DNA, 25 bp, Rattus norvegicus
agggtccctgacttagctcaccgtg

SEQ ID NO: 500755 - DNA, 25 bp, Rattus norvegicus
accgtgcacctctttgccggtgggc

SEQ ID NO: 500756 - DNA, 25 bp, Rattus norvegicus
ggctcgacgtcctgctgccacagga

SEQ ID NO: 500757 - DNA, 25 bp, Rattus norvegicus
cggcgggaatcttgcaacgcagttc

SEQ ID NO: 500758 - DNA, 25 bp, Rattus norvegicus
gaccgcgccagagcgtcggaccaat

SEQ ID NO: 500759 - DNA, 25 bp, Rattus norvegicus
gggcctgcaaccacggcaacagagt

SEQ ID NO: 500760 - DNA, 25 bp, Rattus norvegicus
ccaggagaagcctcgctgtcaggga

SEQ ID NO: 500761 - DNA, 25 bp, Rattus norvegicus
gcaaccacggcaacagagtgcggga

SEQ ID NO: 500762 - DNA, 25 bp, Rattus norvegicus
cggcgtccagatccggccggaatat

SEQ ID NO: 500763 - DNA, 25 bp, Rattus norvegicus
cttatccggctgatgactacgagtc

SEQ ID NO: 500764 - DNA, 25 bp, Rattus norvegicus
cgagcaggcgcggaatacttcttcc

SEQ ID NO: 500765 - DNA, 25 bp, Rattus norvegicus
cttactggacgtttgtcccggcgcg

SEQ ID NO: 500766 - DNA, 25 bp, Rattus norvegicus
ctcctgcggtcttactggacgtttg

SEQ ID NO: 500767 - DNA, 25 bp, Rattus norvegicus
catctcggccctctcggcgaccaga

SEQ ID NO: 500768 - DNA, 25 bp, Rattus norvegicus
tatgcgggactcgatcatctcggcc

SEQ ID NO: 500769 - DNA, 25 bp, Rattus norvegicus
tctgaggtaatgaaacggtgagcgc

SEQ ID NO: 500770 - DNA, 25 bp, Rattus norvegicus
tagccatgtcttatccggctgatga

SEQ ID NO: 500771 - DNA, 25 bp, Rattus norvegicus
ctggagcgccgtagccatgtcttat

SEQ ID NO: 500772 - DNA, 25 bp, Rattus norvegicus
cttccacgggcttctggagcgccgt

SEQ ID NO: 500773 - DNA, 25 bp, Rattus norvegicus
gcggaatacttcttccgctctcttc

SEQ ID NO: 500774 - DNA, 25 bp, Rattus norvegicus
ccggccggaatatgcgggactcgat

SEQ ID NO: 500775 - DNA, 25 bp, Rattus norvegicus
gactacgagtctgaggtaatgaaac

SEQ ID NO: 500776 - DNA, 25 bp, Rattus norvegicus
tcctggcctggtgtcgccgccagtg

SEQ ID NO: 500777 - DNA, 25 bp, Rattus norvegicus
cccacaatgaggacagcgggccgcg

SEQ ID NO: 500778 - DNA, 25 bp, Rattus norvegicus
agctccttccgggacggcctggctt

SEQ ID NO: 500779 - DNA, 25 bp, Rattus norvegicus
gctatgtggggcgtccgcccttccg

SEQ ID NO: 500780 - DNA, 25 bp, Rattus norvegicus
gccgcagacacagccggaaactggc

SEQ ID NO: 500781 - DNA, 25 bp, Rattus norvegicus
gagcgccagcctagtgccacctgac

SEQ ID NO: 500782 - DNA, 25 bp, Rattus norvegicus
agtgggagccacacgaaccgcagcc

SEQ ID NO: 500783 - DNA, 25 bp, Rattus norvegicus
gctaccgcggcgtggacatccgcga

SEQ ID NO: 500784 - DNA, 25 bp, Rattus norvegicus
tggacatccgcgacctgagcagctc

SEQ ID NO: 500785 - DNA, 25 bp, Rattus norvegicus
gcgacctgagcagctccttccggga

SEQ ID NO: 500786 - DNA, 25 bp, Rattus norvegicus
tgagaggtccgggacctcatacccg

SEQ ID NO: 500787 - DNA, 25 bp, Rattus norvegicus
gcacacgccgccttgagaggtccgg

SEQ ID NO: 500788 - DNA, 25 bp, Rattus norvegicus
ctcagtgacgcggtggcacacgccg

SEQ ID NO: 500789 - DNA, 25 bp, Rattus norvegicus
ggacggcctggctttctgcgccatc

SEQ ID NO: 500790 - DNA, 25 bp, Rattus norvegicus
caccctctcctgtgaagccatggga

SEQ ID NO: 500791 - DNA, 25 bp, Rattus norvegicus
caaaccacacgtgttgccgcaaggg

SEQ ID NO: 500792 - DNA, 25 bp, Rattus norvegicus
gcctcccggaagtgattgcgcctag

SEQ ID NO: 500793 - DNA, 25 bp, Rattus norvegicus
attagcgctcgcgatcgactgcctc

SEQ ID NO: 500794 - DNA, 25 bp, Rattus norvegicus
taccatggtaactagcagacacgcc

SEQ ID NO: 500795 - DNA, 25 bp, Rattus norvegicus
agccagagtgtgagcgtcctcacca

SEQ ID NO: 500796 - DNA, 25 bp, Rattus norvegicus
tgacagagccttcctcacggaaatc

SEQ ID NO: 500797 - DNA, 25 bp, Rattus norvegicus
gcggagcgctcaccatcagcgatga

SEQ ID NO: 500798 - DNA, 25 bp, Rattus norvegicus
gtcgcagacagacctctcatcgcta

SEQ ID NO: 500799 - DNA, 25 bp, Rattus norvegicus
ccggccagtaaggagaaggtatcat

SEQ ID NO: 500800 - DNA, 25 bp, Rattus norvegicus
ccgggctcctggagtacaggctagt

SEQ ID NO: 500801 - DNA, 25 bp, Rattus norvegicus
tgggcagagatttcgtccgtgtagc

SEQ ID NO: 500802 - DNA, 25 bp, Rattus norvegicus
gaacttattacctcgcggagcagtg

SEQ ID NO: 500803 - DNA, 25 bp, Rattus norvegicus
agcgcggtgaccacagtccttatcc

SEQ ID NO: 500804 - DNA, 25 bp, Rattus norvegicus
taactttctgcgtgccgcctgtgcc

SEQ ID NO: 500805 - DNA, 25 bp, Rattus norvegicus
ccgtgcacatgccagaccctaggtg

SEQ ID NO: 500806 - DNA, 25 bp, Rattus norvegicus
ggtactggtcggctaactttctgcg

SEQ ID NO: 500807 - DNA, 25 bp, Rattus norvegicus
gtgaagagcccaacgcccacctaga

SEQ ID NO: 500808 - DNA, 25 bp, Rattus norvegicus
gccgtttgacgtgcggcttgctctt

SEQ ID NO: 500809 - DNA, 25 bp, Rattus norvegicus
gcttgctcttgctggcaccgttgac

SEQ ID NO: 500810 - DNA, 25 bp, Rattus norvegicus
agcgtccagtcgtagccgctgagca

SEQ ID NO: 500811 - DNA, 25 bp, Rattus norvegicus
cttcgcggatgcacaccgggaactt

SEQ ID NO: 500812 - DNA, 25 bp, Rattus norvegicus
tcgccgtcctgctgttccttcttga

SEQ ID NO: 500813 - DNA, 25 bp, Rattus norvegicus
ttccttcttgaccttgcccaattcg

SEQ ID NO: 500814 - DNA, 25 bp, Rattus norvegicus
acaggcagcgaggttcctccgagcc

SEQ ID NO: 500815 - DNA, 25 bp, Rattus norvegicus
gctccacctctgataggtcttgctc

SEQ ID NO: 500816 - DNA, 25 bp, Rattus norvegicus
aggtcttgctcctcggccatgtcgc

SEQ ID NO: 500817 - DNA, 25 bp, Rattus norvegicus
ccgggaacttgtcatcgtctgcctc

SEQ ID NO: 500818 - DNA, 25 bp, Rattus norvegicus
tgcccaccatgtgacttggctgacg

SEQ ID NO: 500819 - DNA, 25 bp, Rattus norvegicus
tgatcaaggcactgggctcacacgg

SEQ ID NO: 500820 - DNA, 25 bp, Rattus norvegicus
ctggacaagtgggtgacgttgatca

SEQ ID NO: 500821 - DNA, 25 bp, Rattus norvegicus
ttccgtcctgggctgctggacaagt

SEQ ID NO: 500822 - DNA, 25 bp, Rattus norvegicus
gaagggcctagaggcttccgtcctg

SEQ ID NO: 500823 - DNA, 25 bp, Rattus norvegicus
acagcactgcgtggaagggcctaga

SEQ ID NO: 500824 - DNA, 25 bp, Rattus norvegicus
accatgtgacttggctgacgacagc

SEQ ID NO: 500825 - DNA, 25 bp, Rattus norvegicus
gctgcctgcccaccatgtgacttgg

SEQ ID NO: 500826 - DNA, 25 bp, Rattus norvegicus
agaagctaccggaaggcgccgtagc

SEQ ID NO: 500827 - DNA, 25 bp, Rattus norvegicus
ttttccaaacgtagcggtatcctga

SEQ ID NO: 500828 - DNA, 25 bp, Rattus norvegicus
accgagtggcggatttatgtttcca

SEQ ID NO: 500829 - DNA, 25 bp, Rattus norvegicus
caagtgggtgacgttgatcaaggca

SEQ ID NO: 500830 - DNA, 25 bp, Rattus norvegicus
tgacgttgatcaaggcactgggctc

SEQ ID NO: 500831 - DNA, 25 bp, Rattus norvegicus
acttggctgacgacagcactgcgtg

SEQ ID NO: 500832 - DNA, 25 bp, Rattus norvegicus
gtccgccgtactcctgcggccctaa

SEQ ID NO: 500833 - DNA, 25 bp, Rattus norvegicus
acaacgccggctttttatcgtcgca

SEQ ID NO: 500834 - DNA, 25 bp, Rattus norvegicus
aggcgtggcctctgtccgccgtact

SEQ ID NO: 500835 - DNA, 25 bp, Rattus norvegicus
caatcagcaagaggaggcgtggcct

SEQ ID NO: 500836 - DNA, 25 bp, Rattus norvegicus
gcctggcgcccaatcagcaagagga

SEQ ID NO: 500837 - DNA, 25 bp, Rattus norvegicus
ttgaggaagtgaccgaccgcgaagc

SEQ ID NO: 500838 - DNA, 25 bp, Rattus norvegicus
caacggccacgctcgccaaccggag

SEQ ID NO: 500839 - DNA, 25 bp, Rattus norvegicus
gccggctttttatcgtcgcagttcg

SEQ ID NO: 500840 - DNA, 25 bp, Rattus norvegicus
cgcgaagctacccagctgccgctcc

SEQ ID NO: 500841 - DNA, 25 bp, Rattus norvegicus
gcagatcgtacctcccgcactgtgg

SEQ ID NO: 500842 - DNA, 25 bp, Rattus norvegicus
gcgacatcgcggccgcagatcgtac

SEQ ID NO: 500843 - DNA, 25 bp, Rattus norvegicus
tgagtcgcccgacggaggcgacatc

SEQ ID NO: 500844 - DNA, 25 bp, Rattus norvegicus
ccgcgaagctcagacgcgcggcaag

SEQ ID NO: 500845 - DNA, 25 bp, Rattus norvegicus
gtgaccgaccgcgaagctcagacgc

SEQ ID NO: 500846 - DNA, 25 bp, Rattus norvegicus
cccgagcgccatcaggaacttggta

SEQ ID NO: 500847 - DNA, 25 bp, Rattus norvegicus
aggcgacagcgtggacagaaacacc

SEQ ID NO: 500848 - DNA, 25 bp, Rattus norvegicus
tcctagtcccagctgctattccggg

SEQ ID NO: 500849 - DNA, 25 bp, Rattus norvegicus
cagaaggcggtcctatgagcacagc

SEQ ID NO: 500850 - DNA, 25 bp, Rattus norvegicus
ctgccaagtccagcagctgcctgtg

SEQ ID NO: 500851 - DNA, 25 bp, Rattus norvegicus
gcgtccttggcgtagttcaccagca

SEQ ID NO: 500852 - DNA, 25 bp, Rattus norvegicus
accagcaggatagccggcacaaaga

SEQ ID NO: 500853 - DNA, 25 bp, Rattus norvegicus
tccacgagcagcactaggcccaagg

SEQ ID NO: 500854 - DNA, 25 bp, Rattus norvegicus
cggtcgccatgagcacctcaaattg

SEQ ID NO: 500855 - DNA, 25 bp, Rattus norvegicus
agcgcgcccaccatgccataggaga

SEQ ID NO: 500856 - DNA, 25 bp, Rattus norvegicus
tgcagaaagccacaagggtgccgta

SEQ ID NO: 500857 - DNA, 25 bp, Rattus norvegicus
cgctaatcaggtccgtgagcccatt

SEQ ID NO: 500858 - DNA, 25 bp, Rattus norvegicus
tggccgtgccacgatgtccacaaag

SEQ ID NO: 500859 - DNA, 25 bp, Rattus norvegicus
aggagaccgccaaacagcaggaagc

SEQ ID NO: 500860 - DNA, 25 bp, Rattus norvegicus
gtttatcctccaaccttcctgctga

SEQ ID NO: 500861 - DNA, 25 bp, Rattus norvegicus
acgagccctccagcttgccgtagag

SEQ ID NO: 500862 - DNA, 25 bp, Rattus norvegicus
tagagccagccgttctgagcctcgg

SEQ ID NO: 500863 - DNA, 25 bp, Rattus norvegicus
tcgggcaccagcacttcaactacgt

SEQ ID NO: 500864 - DNA, 25 bp, Rattus norvegicus
acgtctccagccgagaagcgcagca

SEQ ID NO: 500865 - DNA, 25 bp, Rattus norvegicus
cgcagcagcgtgtggttggcaccct

SEQ ID NO: 500866 - DNA, 25 bp, Rattus norvegicus
ttggcaccctccgagtgggagacca

SEQ ID NO: 500867 - DNA, 25 bp, Rattus norvegicus
cgcccaggcgctcgccgaaggaatt

SEQ ID NO: 500868 - DNA, 25 bp, Rattus norvegicus
ccgaaggaattagaccgggagcgct

SEQ ID NO: 500869 - DNA, 25 bp, Rattus norvegicus
gagcgctgggtattgctagcataga

SEQ ID NO: 500870 - DNA, 25 bp, Rattus norvegicus
tattgctagcatagagcgaggctgc

SEQ ID NO: 500871 - DNA, 25 bp, Rattus norvegicus
aagctgcccgcagtttatcctccaa

SEQ ID NO: 500872 - DNA, 25 bp, Rattus norvegicus
agggcctcaccatgtccagccgggt

SEQ ID NO: 500873 - DNA, 25 bp, Rattus norvegicus
tgcggggatgacagtacaagctgcc

SEQ ID NO: 500874 - DNA, 25 bp, Rattus norvegicus
acatgcctcagagtcgcggacacga

SEQ ID NO: 500875 - DNA, 25 bp, Rattus norvegicus
gccatgtctgcatcgggcggaagtt

SEQ ID NO: 500876 - DNA, 25 bp, Rattus norvegicus
cgccaggggatcaaaggacagaagc

SEQ ID NO: 500877 - DNA, 25 bp, Rattus norvegicus
taagagtcaacggaggacatgcctc

SEQ ID NO: 500878 - DNA, 25 bp, Rattus norvegicus
ggcaacggagaagaatccggtcacc

SEQ ID NO: 500879 - DNA, 25 bp, Rattus norvegicus
taagcagggtccaggtgacgacatc

SEQ ID NO: 500880 - DNA, 25 bp, Rattus norvegicus
tgacgacatccaagacaggggtacc

SEQ ID NO: 500881 - DNA, 25 bp, Rattus norvegicus
tcagcttactcagcacttctcagca

SEQ ID NO: 500882 - DNA, 25 bp, Rattus norvegicus
caaaggctgtggctcggccctcaag

SEQ ID NO: 500883 - DNA, 25 bp, Rattus norvegicus
catcttcttcaactgcccaatggaa

SEQ ID NO: 500884 - DNA, 25 bp, Rattus norvegicus
atggaagccgcttctgttgccaggg

SEQ ID NO: 500885 - DNA, 25 bp, Rattus norvegicus
gtcgggtttccgactggagccaatc

SEQ ID NO: 500886 - DNA, 25 bp, Rattus norvegicus
ccaatcctgcgtggctaatggcggc

SEQ ID NO: 500887 - DNA, 25 bp, Rattus norvegicus
cgggaacactcaaggaggccagata

SEQ ID NO: 500888 - DNA, 25 bp, Rattus norvegicus
gagcagtctcctgcgaatcccagca

SEQ ID NO: 500889 - DNA, 25 bp, Rattus norvegicus
ctccagcgacgcgtacggagcagtc

SEQ ID NO: 500890 - DNA, 25 bp, Rattus norvegicus
taaaacgcgcagctcgcttcccttg

SEQ ID NO: 500891 - DNA, 25 bp, Rattus norvegicus
cactcctgctctctagtaaaacgcg

SEQ ID NO: 500892 - DNA, 25 bp, Rattus norvegicus
taggtcctcatgtcgccaagcactc

SEQ ID NO: 500893 - DNA, 25 bp, Rattus norvegicus
gcacccagacgctgtgcagccagta

SEQ ID NO: 500894 - DNA, 25 bp, Rattus norvegicus
cctaccttgcaatgagaagagggac

SEQ ID NO: 500895 - DNA, 25 bp, Rattus norvegicus
tgtagacccagagcgctggtgaccc

SEQ ID NO: 500896 - DNA, 25 bp, Rattus norvegicus
aagccggattctgtgtagacccaga

SEQ ID NO: 500897 - DNA, 25 bp, Rattus norvegicus
cggacttgtcaataagccggattct

SEQ ID NO: 500898 - DNA, 25 bp, Rattus norvegicus
gtaggaacgcatcaccggacttgtc

SEQ ID NO: 500899 - DNA, 25 bp, Rattus norvegicus
agtctggactacagcaccgcgggta

SEQ ID NO: 500900 - DNA, 25 bp, Rattus norvegicus
gcctcgggacctagtctggactaca

SEQ ID NO: 500901 - DNA, 25 bp, Rattus norvegicus
ccgggttctgaaggatgctcgcagt

SEQ ID NO: 500902 - DNA, 25 bp, Rattus norvegicus
ctcgatgagaacagtccctggagcc

SEQ ID NO: 500903 - DNA, 25 bp, Rattus norvegicus
acaaaactccgagcggcactgcacg

SEQ ID NO: 500904 - DNA, 25 bp, Rattus norvegicus
cacggagccgggttcctagtgaact

SEQ ID NO: 500905 - DNA, 25 bp, Rattus norvegicus
ctagtgaactgtggtcccaatcgga

SEQ ID NO: 500906 - DNA, 25 bp, Rattus norvegicus
ctgaacatcagctcacctaggggcc

SEQ ID NO: 500907 - DNA, 25 bp, Rattus norvegicus
gtgcacgtacgcgactcgatgagaa

SEQ ID NO: 500908 - DNA, 25 bp, Rattus norvegicus
ccagcaccttgttgcgcggtttgtt

SEQ ID NO: 500909 - DNA, 25 bp, Rattus norvegicus
ctgcggactacgtgcacacggtgta

SEQ ID NO: 500910 - DNA, 25 bp, Rattus norvegicus
cacggtgtacttcgcgttgtgtgtg

SEQ ID NO: 500911 - DNA, 25 bp, Rattus norvegicus
gcgctccctggagactgatactagc

SEQ ID NO: 500912 - DNA, 25 bp, Rattus norvegicus
acgtcactgcatgactgggttttta

SEQ ID NO: 500913 - DNA, 25 bp, Rattus norvegicus
gcgcaccggtgtccactggagcaaa

SEQ ID NO: 500914 - DNA, 25 bp, Rattus norvegicus
ttccgggaagctcgccttacaactg

SEQ ID NO: 500915 - DNA, 25 bp, Rattus norvegicus
tactagcccagtgtatgttgaagtg

SEQ ID NO: 500916 - DNA, 25 bp, Rattus norvegicus
aggagctgcagaagcagaagtccga

SEQ ID NO: 500917 - DNA, 25 bp, Rattus norvegicus
ctgcagaagcagaagtccgagctgg

SEQ ID NO: 500918 - DNA, 25 bp, Rattus norvegicus
aagcgctgcagggcttcgcgcgctc

SEQ ID NO: 500919 - DNA, 25 bp, Rattus norvegicus
atgcgtctggagctcgacgcgctgc

SEQ ID NO: 500920 - DNA, 25 bp, Rattus norvegicus
cgagaacgccgccatgcgtctggag

SEQ ID NO: 500921 - DNA, 25 bp, Rattus norvegicus
ctcaaccgcaacttgcgcgggctgt

SEQ ID NO: 500922 - DNA, 25 bp, Rattus norvegicus
tgcgcgagctcaaccgcaacttgcg

SEQ ID NO: 500923 - DNA, 25 bp, Rattus norvegicus
tgtcggtgcgcgagctcaaccgcaa

SEQ ID NO: 500924 - DNA, 25 bp, Rattus norvegicus
cgcacctgtcggatgaggcgctgat

SEQ ID NO: 500925 - DNA, 25 bp, Rattus norvegicus
agaacacgccgcacctgtcggatga

SEQ ID NO: 500926 - DNA, 25 bp, Rattus norvegicus
tgagcgagaacacgccgcacctgtc

SEQ ID NO: 500927 - DNA, 25 bp, Rattus norvegicus
gcgagctgagcgagaacacgccgca

SEQ ID NO: 500928 - DNA, 25 bp, Rattus norvegicus
acgccgccatgcgtctggagctcga

SEQ ID NO: 500929 - DNA, 25 bp, Rattus norvegicus
ctacgcggccagctgccgtgtgaag

SEQ ID NO: 500930 - DNA, 25 bp, Rattus norvegicus
tcaggagcccatggcgctggagtct

SEQ ID NO: 500931 - DNA, 25 bp, Rattus norvegicus
tttacgcatgtaccgcctcaagggc

SEQ ID NO: 500932 - DNA, 25 bp, Rattus norvegicus
aaagccactgcactggggaccgacg

SEQ ID NO: 500933 - DNA, 25 bp, Rattus norvegicus
cgctccgttcagtcctgccaggatg

SEQ ID NO: 500934 - DNA, 25 bp, Rattus norvegicus
aggatgcagcacatccaccgcgacg

SEQ ID NO: 500935 - DNA, 25 bp, Rattus norvegicus
gcgacgcgcacagtcccatcggtaa

SEQ ID NO: 500936 - DNA, 25 bp, Rattus norvegicus
gtcccatcggtaagaggctgggccc

SEQ ID NO: 500937 - DNA, 25 bp, Rattus norvegicus
ccacgagcaggtcgggttacactca

SEQ ID NO: 500938 - DNA, 25 bp, Rattus norvegicus
cggccaggtcaaagccactgcactg

SEQ ID NO: 500939 - DNA, 25 bp, Rattus norvegicus
gcccgggtacctcaggagcccatgg

SEQ ID NO: 500940 - DNA, 25 bp, Rattus norvegicus
agctgaggtcactcgctgagcctta

SEQ ID NO: 500941 - DNA, 25 bp, Rattus norvegicus
cactcgctgagccttaaagggaccg

SEQ ID NO: 500942 - DNA, 25 bp, Rattus norvegicus
agggaccgcgcactaagaagcacca

SEQ ID NO: 500943 - DNA, 25 bp, Rattus norvegicus
gaagcgggcacacccacgggctgct

SEQ ID NO: 500944 - DNA, 25 bp, Rattus norvegicus
cgcctttgtcctcacgggcggcgcc

SEQ ID NO: 500945 - DNA, 25 bp, Rattus norvegicus
atgccagaggattcgccgggccgcg

SEQ ID NO: 500946 - DNA, 25 bp, Rattus norvegicus
cccgccggggcggatgccagaggat

SEQ ID NO: 500947 - DNA, 25 bp, Rattus norvegicus
caggagaatggcttcagtgacccgg

SEQ ID NO: 500948 - DNA, 25 bp, Rattus norvegicus
cccgcgctcgcgcaaaaagaaaaca

SEQ ID NO: 500949 - DNA, 25 bp, Rattus norvegicus
cccggccgcgcctttgtcctcacgg

SEQ ID NO: 500950 - DNA, 25 bp, Rattus norvegicus
acccggcggcctgcgaagcgcccgt

SEQ ID NO: 500951 - DNA, 25 bp, Rattus norvegicus
gagaatggcttcagtgacccggagc

SEQ ID NO: 500952 - DNA, 25 bp, Rattus norvegicus
cgcgcccccaccctacaggagaatg

SEQ ID NO: 500953 - DNA, 25 bp, Rattus norvegicus
actcggggccgcctcggtgcacccg

SEQ ID NO: 500954 - DNA, 25 bp, Rattus norvegicus
tggcttcagtgacccggagcccagg

SEQ ID NO: 500955 - DNA, 25 bp, Rattus norvegicus
aatggcttcagtgacccggagccca

SEQ ID NO: 500956 - DNA, 25 bp, Rattus norvegicus
ggcccgggtgaccacgcaccccatc

SEQ ID NO: 500957 - DNA, 25 bp, Rattus norvegicus
ccgcgctcgcgcaaaaagaaaacac

SEQ ID NO: 500958 - DNA, 25 bp, Rattus norvegicus
cgtcaccggcgtaaagccattccta

SEQ ID NO: 500959 - DNA, 25 bp, Rattus norvegicus
ccggttgcgcacactgccttattta

SEQ ID NO: 500960 - DNA, 25 bp, Rattus norvegicus
ggctggccaacgacgcaaacaatgt

SEQ ID NO: 500961 - DNA, 25 bp, Rattus norvegicus
tgccgggataagtcgattctctaaa

SEQ ID NO: 500962 - DNA, 25 bp, Rattus norvegicus
cccgaagcctgaccaaagcaacatg

SEQ ID NO: 500963 - DNA, 25 bp, Rattus norvegicus
gccgaggccaaccaagagggtctca

SEQ ID NO: 500964 - DNA, 25 bp, Rattus norvegicus
atcctcgcaatagtgggctggccaa

SEQ ID NO: 500965 - DNA, 25 bp, Rattus norvegicus
aatgtctgtagcatcgcgcgcagcc

SEQ ID NO: 500966 - DNA, 25 bp, Rattus norvegicus
gggtctcaagactttcagggttcta

SEQ ID NO: 500967 - DNA, 25 bp, Rattus norvegicus
ggtttgagcgtgaccagacctccca

SEQ ID NO: 500968 - DNA, 25 bp, Rattus norvegicus
ctgagttttgctcccgtctccgacg

SEQ ID NO: 500969 - DNA, 25 bp, Rattus norvegicus
tctttatccgtttgggaccatgcgc

SEQ ID NO: 500970 - DNA, 25 bp, Rattus norvegicus
ccgccattttgtgcagttgctggga

SEQ ID NO: 500971 - DNA, 25 bp, Rattus norvegicus
ttgtgtctgcacaaggctggcatca

SEQ ID NO: 500972 - DNA, 25 bp, Rattus norvegicus
caggagccaggaagctgcgcttccc

SEQ ID NO: 500973 - DNA, 25 bp, Rattus norvegicus
aacacgttcatggtccggcctgcgg

SEQ ID NO: 500974 - DNA, 25 bp, Rattus norvegicus
cacgttcatggtccggcctgcggct

SEQ ID NO: 500975 - DNA, 25 bp, Rattus norvegicus
cccacgccgtgtcgcgcggaacttc

SEQ ID NO: 500976 - DNA, 25 bp, Rattus norvegicus
tcccagggaactttctggtgcgcgg

SEQ ID NO: 500977 - DNA, 25 bp, Rattus norvegicus
ggaacacgttcatggtccggcctgc

SEQ ID NO: 500978 - DNA, 25 bp, Rattus norvegicus
gcggctcggcgtgggacaggagcca

SEQ ID NO: 500979 - DNA, 25 bp, Rattus norvegicus
gcctgcggctcccacgccgtgtcgc

SEQ ID NO: 500980 - DNA, 25 bp, Rattus norvegicus
agccaggaagctgcgcttcccacgt

SEQ ID NO: 500981 - DNA, 25 bp, Rattus norvegicus
cggggcagctcgcacaacggctgct

SEQ ID NO: 500982 - DNA, 25 bp, Rattus norvegicus
ggcagctcgcacaacggctgctggc

SEQ ID NO: 500983 - DNA, 25 bp, Rattus norvegicus
cgcttcccacgtccctacgccgacg

SEQ ID NO: 500984 - DNA, 25 bp, Rattus norvegicus
gaactttctggtgcgcggggcgctg

SEQ ID NO: 500985 - DNA, 25 bp, Rattus norvegicus
acttcccagggaactttctggtgcg

SEQ ID NO: 500986 - DNA, 25 bp, Rattus norvegicus
atgtagcgctgggacttgttgctca

SEQ ID NO: 500987 - DNA, 25 bp, Rattus norvegicus
ctaggctccaggtcaccgtggaaaa

SEQ ID NO: 500988 - DNA, 25 bp, Rattus norvegicus
cgaagtacacgttgcactggccgtt

SEQ ID NO: 500989 - DNA, 25 bp, Rattus norvegicus
ttgttgctcaggttggcgaagtaca

SEQ ID NO: 500990 - DNA, 25 bp, Rattus norvegicus
cttgccgtcccgcacggagatgaca

SEQ ID NO: 500991 - DNA, 25 bp, Rattus norvegicus
gtcgtgaagatgtccgccatgtagc

SEQ ID NO: 500992 - DNA, 25 bp, Rattus norvegicus
cgcgtgtccacgcacgtcgtgaaga

SEQ ID NO: 500993 - DNA, 25 bp, Rattus norvegicus
ccgcggagaagatcatgagcatgta

SEQ ID NO: 500994 - DNA, 25 bp, Rattus norvegicus
tacatgcatgatacacggtttggcc

SEQ ID NO: 500995 - DNA, 25 bp, Rattus norvegicus
tcccaaaaagccgtttacatgcatg

SEQ ID NO: 500996 - DNA, 25 bp, Rattus norvegicus
gtcgtctgtgtctccaccgagaaga

SEQ ID NO: 500997 - DNA, 25 bp, Rattus norvegicus
cccataaccgatggtcgtctgtgtc

SEQ ID NO: 500998 - DNA, 25 bp, Rattus norvegicus
ggagtcgatgacacagcccacaatg

SEQ ID NO: 500999 - DNA, 25 bp, Rattus norvegicus
atggactggacaaccactgcgatga

SEQ ID NO: 501000 - DNA, 25 bp, Rattus norvegicus
ctgtcccgaccctggatatgtcttg

SEQ ID NO: 501001 - DNA, 25 bp, Rattus norvegicus
aacctttgccggcttctgttccagg

SEQ ID NO: 501002 - DNA, 25 bp, Rattus norvegicus
tcgcaacaaaggatcgcggggcctc

SEQ ID NO: 501003 - DNA, 25 bp, Rattus norvegicus
gggactcgatctcgcaacaaaggat

SEQ ID NO: 501004 - DNA, 25 bp, Rattus norvegicus
ttggttggagcgtcgccgcatccca

SEQ ID NO: 501005 - DNA, 25 bp, Rattus norvegicus
cgctaggcttgggtttattagcatg

SEQ ID NO: 501006 - DNA, 25 bp, Rattus norvegicus
tcagccaattgaagcgctaggcttg

SEQ ID NO: 501007 - DNA, 25 bp, Rattus norvegicus
cccatggattactcagccaattgaa

SEQ ID NO: 501008 - DNA, 25 bp, Rattus norvegicus
cggcgcgccgaaattaatctgcata

SEQ ID NO: 501009 - DNA, 25 bp, Rattus norvegicus
agatctttagccaatcaccgcccgg

SEQ ID NO: 501010 - DNA, 25 bp, Rattus norvegicus
acgcggctccgcagatctttagcca

SEQ ID NO: 501011 - DNA, 25 bp, Rattus norvegicus
cgtccgagcgcagccgaacttgacg

SEQ ID NO: 501012 - DNA, 25 bp, Rattus norvegicus
tacctactggccctttaaggagctc

SEQ ID NO: 501013 - DNA, 25 bp, Rattus norvegicus
tggtctccatctccatacctactgg

SEQ ID NO: 501014 - DNA, 25 bp, Rattus norvegicus
cttgtcttacctgaaagcttcggca

SEQ ID NO: 501015 - DNA, 25 bp, Rattus norvegicus
tcggcagaatcccaaagcctcaggg

SEQ ID NO: 501016 - DNA, 25 bp, Rattus norvegicus
tcgggccattttgctactatgagtc

SEQ ID NO: 501017 - DNA, 25 bp, Rattus norvegicus
tgagtccagccagggttaccacgta

SEQ ID NO: 501018 - DNA, 25 bp, Rattus norvegicus
cagcctgccttgttgccagtgtaca

SEQ ID NO: 501019 - DNA, 25 bp, Rattus norvegicus
cccggcctatgccacaaggctttgt

SEQ ID NO: 501020 - DNA, 25 bp, Rattus norvegicus
caaggctttgtgtgtatctccagaa

SEQ ID NO: 501021 - DNA, 25 bp, Rattus norvegicus
ggacctcgctgcttctcggaggctc

SEQ ID NO: 501022 - DNA, 25 bp, Rattus norvegicus
tccagaagacgtgctcgaggctttc

SEQ ID NO: 501023 - DNA, 25 bp, Rattus norvegicus
agccaatcgcggtcgcggcagttga

SEQ ID NO: 501024 - DNA, 25 bp, Rattus norvegicus
tagaaaccagagaagccgcgcgtgc

SEQ ID NO: 501025 - DNA, 25 bp, Rattus norvegicus
ctctattcatgaacccgagggagac

SEQ ID NO: 501026 - DNA, 25 bp, Rattus norvegicus
cctctgtcctcagtggtagaaacca

SEQ ID NO: 501027 - DNA, 25 bp, Rattus norvegicus
tctcggaggtggttttccctctgtc

SEQ ID NO: 501028 - DNA, 25 bp, Rattus norvegicus
ggtctgacggagatgtttcccgaga

SEQ ID NO: 501029 - DNA, 25 bp, Rattus norvegicus
atgtttcccgagagggtccggtcag

SEQ ID NO: 501030 - DNA, 25 bp, Rattus norvegicus
agccgctggagccacctttgatctc

SEQ ID NO: 501031 - DNA, 25 bp, Rattus norvegicus
atatctcctctatcacagctagatg

SEQ ID NO: 501032 - DNA, 25 bp, Rattus norvegicus
tcccgaaagccgaggcagagaaagc

SEQ ID NO: 501033 - DNA, 25 bp, Rattus norvegicus
cgaagaattggtcccgaaagccgag

SEQ ID NO: 501034 - DNA, 25 bp, Rattus norvegicus
ttccggtgtcctacagccatggccg

SEQ ID NO: 501035 - DNA, 25 bp, Rattus norvegicus
tgctgctctcttccgcttccggtgt

SEQ ID NO: 501036 - DNA, 25 bp, Rattus norvegicus
acgctctgtcccgaggtgggccgat

SEQ ID NO: 501037 - DNA, 25 bp, Rattus norvegicus
gctcgcttccggaagacgctctgtc

SEQ ID NO: 501038 - DNA, 25 bp, Rattus norvegicus
ctatcggagagactctggggtctga

SEQ ID NO: 501039 - DNA, 25 bp, Rattus norvegicus
aggttgggatgtgaaagtcgcaaac

SEQ ID NO: 501040 - DNA, 25 bp, Rattus norvegicus
cagctagatgagaccctatcggaga

SEQ ID NO: 501041 - DNA, 25 bp, Rattus norvegicus
agggctgctgccgtttcgccaacga

SEQ ID NO: 501042 - DNA, 25 bp, Rattus norvegicus
cgaaggcccaacaaaccaggctttg

SEQ ID NO: 501043 - DNA, 25 bp, Rattus norvegicus
gagctgcagttctggaccgtccata

SEQ ID NO: 501044 - DNA, 25 bp, Rattus norvegicus
cgtccatagtttagacgccgtaagg

SEQ ID NO: 501045 - DNA, 25 bp, Rattus norvegicus
cgcctctccgcattgtactgtggga

SEQ ID NO: 501046 - DNA, 25 bp, Rattus norvegicus
ggagagcctacttgcggtataaaca

SEQ ID NO: 501047 - DNA, 25 bp, Rattus norvegicus
tcaaacccgaaactaggagagccta

SEQ ID NO: 501048 - DNA, 25 bp, Rattus norvegicus
aaagcccggagtttgccattcatca

SEQ ID NO: 501049 - DNA, 25 bp, Rattus norvegicus
ttcatctaccatcaggccgcggggc

SEQ ID NO: 501050 - DNA, 25 bp, Rattus norvegicus
ggaactacgactctcaccacagcga

SEQ ID NO: 501051 - DNA, 25 bp, Rattus norvegicus
tcccgccgaacaggcagaaggatga

SEQ ID NO: 501052 - DNA, 25 bp, Rattus norvegicus
aagatcgtcatctctccggccatca

SEQ ID NO: 501053 - DNA, 25 bp, Rattus norvegicus
cctgaggtactgacctaagatcgtc

SEQ ID NO: 501054 - DNA, 25 bp, Rattus norvegicus
ttgtcgactgccataaccgcaagga

SEQ ID NO: 501055 - DNA, 25 bp, Rattus norvegicus
cacgcaagccagtgaggaaagactc

SEQ ID NO: 501056 - DNA, 25 bp, Rattus norvegicus
ttgtagttcgcggagccgttgtcca

SEQ ID NO: 501057 - DNA, 25 bp, Rattus norvegicus
cactcggcgcgcaccctagacacgc

SEQ ID NO: 501058 - DNA, 25 bp, Rattus norvegicus
ttttcaccgcagcttctccggggcg

SEQ ID NO: 501059 - DNA, 25 bp, Rattus norvegicus
ggtcgacttgtcttttcaccgcagc

SEQ ID NO: 501060 - DNA, 25 bp, Rattus norvegicus
agccgttgtccagggctccgcgata

SEQ ID NO: 501061 - DNA, 25 bp, Rattus norvegicus
gttcacctggcgcttgtagttcgcg

SEQ ID NO: 501062 - DNA, 25 bp, Rattus norvegicus
cctgacgttgtgtgacgtaaccggc

SEQ ID NO: 501063 - DNA, 25 bp, Rattus norvegicus
gaatgggtcacatcgctccttttct

SEQ ID NO: 501064 - DNA, 25 bp, Rattus norvegicus
gtcacatcgctccttttcttccatt

SEQ ID NO: 501065 - DNA, 25 bp, Rattus norvegicus
gacttcgggagtagcgctccatgcc

SEQ ID NO: 501066 - DNA, 25 bp, Rattus norvegicus
cacctgaggccgacgtcagcggcgt

SEQ ID NO: 501067 - DNA, 25 bp, Rattus norvegicus
aggccgacgtcagcggcgttcactc

SEQ ID NO: 501068 - DNA, 25 bp, Rattus norvegicus
gtcagcggcgttcactcggcgcgca

SEQ ID NO: 501069 - DNA, 25 bp, Rattus norvegicus
atagtggggaaggtcgacttgtctt

SEQ ID NO: 501070 - DNA, 25 bp, Rattus norvegicus
ttcgactccgactgcagcgaggacg

SEQ ID NO: 501071 - DNA, 25 bp, Rattus norvegicus
acggcggcttcgactccgactgcag

SEQ ID NO: 501072 - DNA, 25 bp, Rattus norvegicus
tggactcgccggtgccggcctcgat

SEQ ID NO: 501073 - DNA, 25 bp, Rattus norvegicus
gaattagcctaagttcttaaagatg

SEQ ID NO: 501074 - DNA, 25 bp, Rattus norvegicus
ggctgcgaattagcctaagttctta

SEQ ID NO: 501075 - DNA, 25 bp, Rattus norvegicus
ccggcagtgtccacccggcctcccg

SEQ ID NO: 501076 - DNA, 25 bp, Rattus norvegicus
agctggacctcaccagcaaggtagg

SEQ ID NO: 501077 - DNA, 25 bp, Rattus norvegicus
cggccggctgcgaattagcctaagt

SEQ ID NO: 501078 - DNA, 25 bp, Rattus norvegicus
cggctgtccagtggcgcggctcaca

SEQ ID NO: 501079 - DNA, 25 bp, Rattus norvegicus
cccagggactcaacccggccacctg

SEQ ID NO: 501080 - DNA, 25 bp, Rattus norvegicus
acctgccgctctctgggacgtgcgg

SEQ ID NO: 501081 - DNA, 25 bp, Rattus norvegicus
gcccactctccgcacccggcagtgt

SEQ ID NO: 501082 - DNA, 25 bp, Rattus norvegicus
tggctccgccacgtggaaccgggct

SEQ ID NO: 501083 - DNA, 25 bp, Rattus norvegicus
cctcaccagcaaggtaggcctggga

SEQ ID NO: 501084 - DNA, 25 bp, Rattus norvegicus
ccgcccattggttggtttgaacaca

SEQ ID NO: 501085 - DNA, 25 bp, Rattus norvegicus
tgggacttgtgcgttccgtcgccca

SEQ ID NO: 501086 - DNA, 25 bp, Rattus norvegicus
aggacctcctggctgtgggacttgt

SEQ ID NO: 501087 - DNA, 25 bp, Rattus norvegicus
cgggagcaagtaggacctcctggct

SEQ ID NO: 501088 - DNA, 25 bp, Rattus norvegicus
tttgaacacaaaggctccggctcgg

SEQ ID NO: 501089 - DNA, 25 bp, Rattus norvegicus
cgttgccgcccattggttggtttga

SEQ ID NO: 501090 - DNA, 25 bp, Rattus norvegicus
acagcccacaagtcattggccaggc

SEQ ID NO: 501091 - DNA, 25 bp, Rattus norvegicus
gtgcgcctgtcagtcaaggctgaca

SEQ ID NO: 501092 - DNA, 25 bp, Rattus norvegicus
gtatgtgtgcgcctgtcagtcaagg

SEQ ID NO: 501093 - DNA, 25 bp, Rattus norvegicus
cttaccttccgtggctgttcccgtg

SEQ ID NO: 501094 - DNA, 25 bp, Rattus norvegicus
aggcccgctacagctggacggcgac

SEQ ID NO: 501095 - DNA, 25 bp, Rattus norvegicus
gacggtgaggctcaggcccgctaca

SEQ ID NO: 501096 - DNA, 25 bp, Rattus norvegicus
aggctgacagcccacaagtcattgg

SEQ ID NO: 501097 - DNA, 25 bp, Rattus norvegicus
cgcccttcgcgtgggccctgtagtt

SEQ ID NO: 501098 - DNA, 25 bp, Rattus norvegicus
ggaagtcccgtcctatcaccggaca

SEQ ID NO: 501099 - DNA, 25 bp, Rattus norvegicus
atcaccggacattgacagcaatttc

SEQ ID NO: 501100 - DNA, 25 bp, Rattus norvegicus
aggaccgagcaagagtgtcttagca

SEQ ID NO: 501101 - DNA, 25 bp, Rattus norvegicus
cttattattggtgtagaaaaatgcc

SEQ ID NO: 501102 - DNA, 25 bp, Rattus norvegicus
ttgtcaaggaccgagcaagagtgtc

SEQ ID NO: 501103 - DNA, 25 bp, Rattus norvegicus
tgccaattaattccgaaggggccta

SEQ ID NO: 501104 - DNA, 25 bp, Rattus norvegicus
cctagaaggccgtcgcttacgcgag

SEQ ID NO: 501105 - DNA, 25 bp, Rattus norvegicus
acgcgaggggcatggctcaaagaac

SEQ ID NO: 501106 - DNA, 25 bp, Rattus norvegicus
ggggcttcgctcatagtcgtcttaa

SEQ ID NO: 501107 - DNA, 25 bp, Rattus norvegicus
gctcatagtcgtcttaagcctgccg

SEQ ID NO: 501108 - DNA, 25 bp, Rattus norvegicus
aatgtcactgccgagctccgaggtc

SEQ ID NO: 501109 - DNA, 25 bp, Rattus norvegicus
acagcaatttcacttattattggtg

SEQ ID NO: 501110 - DNA, 25 bp, Rattus norvegicus
cccgccagggttgtcaaggaccgag

SEQ ID NO: 501111 - DNA, 25 bp, Rattus norvegicus
ttagcaaccatcacggaagtcccgt

SEQ ID NO: 501112 - DNA, 25 bp, Rattus norvegicus
gatccagaccaggacactcccatgg

SEQ ID NO: 501113 - DNA, 25 bp, Rattus norvegicus
cacctcgatgcgctcgatgcggtct

SEQ ID NO: 501114 - DNA, 25 bp, Rattus norvegicus
ggcatgcttcgagggaccagacgac

SEQ ID NO: 501115 - DNA, 25 bp, Rattus norvegicus
gaccagacgacagctccggggactt

SEQ ID NO: 501116 - DNA, 25 bp, Rattus norvegicus
cgacggtgcgctactcacctcgatg

SEQ ID NO: 501117 - DNA, 25 bp, Rattus norvegicus
ggacactcccatggtgcctacgagg

SEQ ID NO: 501118 - DNA, 25 bp, Rattus norvegicus
tcccaggcgccgtcggccatagtgt

SEQ ID NO: 501119 - DNA, 25 bp, Rattus norvegicus
ccagcttgccggtgagctcgcgaat

SEQ ID NO: 501120 - DNA, 25 bp, Rattus norvegicus
tgagctcgcgaatggtgtcccggtc

SEQ ID NO: 501121 - DNA, 25 bp, Rattus norvegicus
tgctgcagcgccgtctggcgcagct

SEQ ID NO: 501122 - DNA, 25 bp, Rattus norvegicus
tggcgatgatgcagatgacggcacc

SEQ ID NO: 501123 - DNA, 25 bp, Rattus norvegicus
acggcaccgaggaacgccagcatgc

SEQ ID NO: 501124 - DNA, 25 bp, Rattus norvegicus
gcagcacggccaggaacttcagcgt

SEQ ID NO: 501125 - DNA, 25 bp, Rattus norvegicus
catggtgcctacgaggggcatgctt

SEQ ID NO: 501126 - DNA, 25 bp, Rattus norvegicus
cagtgacatcaggaggcacccgctg

SEQ ID NO: 501127 - DNA, 25 bp, Rattus norvegicus
agccggtacctgtggcctccagaac

SEQ ID NO: 501128 - DNA, 25 bp, Rattus norvegicus
cctccagaactgtgtgtagcgcctg

SEQ ID NO: 501129 - DNA, 25 bp, Rattus norvegicus
cagaactgtgtgtagcgcctggccc

SEQ ID NO: 501130 - DNA, 25 bp, Rattus norvegicus
ccgcagcagcagtgacatcaggagg

SEQ ID NO: 501131 - DNA, 25 bp, Rattus norvegicus
cctcaggctcggaggagccggtacc

SEQ ID NO: 501132 - DNA, 25 bp, Rattus norvegicus
acccgctggccggtggcagctgcct

SEQ ID NO: 501133 - DNA, 25 bp, Rattus norvegicus
agggatggacagatcgagcacctct

SEQ ID NO: 501134 - DNA, 25 bp, Rattus norvegicus
ttggacgcagatcggcttatggtct

SEQ ID NO: 501135 - DNA, 25 bp, Rattus norvegicus
tggacagatcgagcacctctgactc

SEQ ID NO: 501136 - DNA, 25 bp, Rattus norvegicus
gagcacctctgactctcgccagttg

SEQ ID NO: 501137 - DNA, 25 bp, Rattus norvegicus
ctgactctcgccagttggacgcaga

SEQ ID NO: 501138 - DNA, 25 bp, Rattus norvegicus
tcgccagttggacgcagatcggctt

SEQ ID NO: 501139 - DNA, 25 bp, Rattus norvegicus
tgtgtgtagcgcctggcccgcagca

SEQ ID NO: 501140 - DNA, 25 bp, Rattus norvegicus
ttggcttgacagagaaatgcacatc

SEQ ID NO: 501141 - DNA, 25 bp, Rattus norvegicus
cagcggcggatgtctttcttgagcc

SEQ ID NO: 501142 - DNA, 25 bp, Rattus norvegicus
atgtctttcttgagccggtgcaccg

SEQ ID NO: 501143 - DNA, 25 bp, Rattus norvegicus
tttcttgagccggtgcaccgcagcg

SEQ ID NO: 501144 - DNA, 25 bp, Rattus norvegicus
caccgcagcgctggagtgcagcttg

SEQ ID NO: 501145 - DNA, 25 bp, Rattus norvegicus
gctggcgcttggcttgacagagaaa

SEQ ID NO: 501146 - DNA, 25 bp, Rattus norvegicus
gcgcttggcttgacagagaaatgca

SEQ ID NO: 501147 - DNA, 25 bp, Rattus norvegicus
cagagaaatgcacatcactgatgcg

SEQ ID NO: 501148 - DNA, 25 bp, Rattus norvegicus
cacatcactgatgcggagggcctcc

SEQ ID NO: 501149 - DNA, 25 bp, Rattus norvegicus
atcactgatgcggagggcctccgcc

SEQ ID NO: 501150 - DNA, 25 bp, Rattus norvegicus
cccgggcctgcaggcaaaggggcgt

SEQ ID NO: 501151 - DNA, 25 bp, Rattus norvegicus
tgggtgggacctcaagacttcccgc

SEQ ID NO: 501152 - DNA, 25 bp, Rattus norvegicus
cggatgtctttcttgagccggtgca

SEQ ID NO: 501153 - DNA, 25 bp, Rattus norvegicus
cttgacagagaaatgcacatcactg

SEQ ID NO: 501154 - DNA, 25 bp, Rattus norvegicus
ggcccgaggtttccgacacggcagc

SEQ ID NO: 501155 - DNA, 25 bp, Rattus norvegicus
tgctagggaaaatgagcgctcgccg

SEQ ID NO: 501156 - DNA, 25 bp, Rattus norvegicus
cggttgctagggaaaatgagcgctc

SEQ ID NO: 501157 - DNA, 25 bp, Rattus norvegicus
ggcctgagcgccgttgccaggacct

SEQ ID NO: 501158 - DNA, 25 bp, Rattus norvegicus
tcacgtgatgctccaggcctgagcg

SEQ ID NO: 501159 - DNA, 25 bp, Rattus norvegicus
cagctgcgggccgtcacgtgatgct

SEQ ID NO: 501160 - DNA, 25 bp, Rattus norvegicus
gacagctccatcttgctcagcggca

SEQ ID NO: 501161 - DNA, 25 bp, Rattus norvegicus
gcctactgcagacagctccatcttg

SEQ ID NO: 501162 - DNA, 25 bp, Rattus norvegicus
tcttaaaggggcctgtcctctccgc

SEQ ID NO: 501163 - DNA, 25 bp, Rattus norvegicus
cgcgaagacccgctcgcctactgca

SEQ ID NO: 501164 - DNA, 25 bp, Rattus norvegicus
tgatgatggattcggccgcgaagac

SEQ ID NO: 501165 - DNA, 25 bp, Rattus norvegicus
tccggcgtttgatgatggattcggc

SEQ ID NO: 501166 - DNA, 25 bp, Rattus norvegicus
cacctttcggatccggcgtttgatg

SEQ ID NO: 501167 - DNA, 25 bp, Rattus norvegicus
cggagggctcacctttcggatccgg

SEQ ID NO: 501168 - DNA, 25 bp, Rattus norvegicus
caggctccgcttccgcagtatctgt

SEQ ID NO: 501169 - DNA, 25 bp, Rattus norvegicus
cgtcaaggagatcctggcgcgagta

SEQ ID NO: 501170 - DNA, 25 bp, Rattus norvegicus
cctgcggaagatgaacgtggctttc

SEQ ID NO: 501171 - DNA, 25 bp, Rattus norvegicus
gctgcagcgccacactcagagcatg

SEQ ID NO: 501172 - DNA, 25 bp, Rattus norvegicus
cgctggcgctgcaacagcaactgca

SEQ ID NO: 501173 - DNA, 25 bp, Rattus norvegicus
actgcaggctgtgagacaagcgctc

SEQ ID NO: 501174 - DNA, 25 bp, Rattus norvegicus
gctcacggctagtttcgcctctctg

SEQ ID NO: 501175 - DNA, 25 bp, Rattus norvegicus
gcccgcccacaggacgttctgttag

SEQ ID NO: 501176 - DNA, 25 bp, Rattus norvegicus
cttctctgcgtgttcagcctcgggt

SEQ ID NO: 501177 - DNA, 25 bp, Rattus norvegicus
acgctcggaacgctggacttctaca

SEQ ID NO: 501178 - DNA, 25 bp, Rattus norvegicus
ggacttctacatggcgcggcttcac

SEQ ID NO: 501179 - DNA, 25 bp, Rattus norvegicus
gcttcacggagccatcgagcgcgac

SEQ ID NO: 501180 - DNA, 25 bp, Rattus norvegicus
acgagagactgatcgcgcgcgtcaa

SEQ ID NO: 501181 - DNA, 25 bp, Rattus norvegicus
atctgtcccatctaccggacgcgga

SEQ ID NO: 501182 - DNA, 25 bp, Rattus norvegicus
tcacgccgccgacgttccatttttg

SEQ ID NO: 501183 - DNA, 25 bp, Rattus norvegicus
cagcctcaccttccgcacgcgcttc

SEQ ID NO: 501184 - DNA, 25 bp, Rattus norvegicus
ttccgcacgcgcttcttccggatgc

SEQ ID NO: 501185 - DNA, 25 bp, Rattus norvegicus
ttccggatgctctccaccgcaaaca

SEQ ID NO: 501186 - DNA, 25 bp, Rattus norvegicus
gcaaacacctgctcgcctatggctg

SEQ ID NO: 501187 - DNA, 25 bp, Rattus norvegicus
ctcgcctatggctgacagctccatg

SEQ ID NO: 501188 - DNA, 25 bp, Rattus norvegicus
tatggctgacagctccatgcggggc

SEQ ID NO: 501189 - DNA, 25 bp, Rattus norvegicus
cccgtcaggctcgtccgggcgcgca

SEQ ID NO: 501190 - DNA, 25 bp, Rattus norvegicus
gcgcgtgcttctgagagcgcccaga

SEQ ID NO: 501191 - DNA, 25 bp, Rattus norvegicus
ccttctagtgctccctcacgccgcc

SEQ ID NO: 501192 - DNA, 25 bp, Rattus norvegicus
cgccgacgttccatttttgaacctg

SEQ ID NO: 501193 - DNA, 25 bp, Rattus norvegicus
ttccatttttgaacctgcgcaacgt

SEQ ID NO: 501194 - DNA, 25 bp, Rattus norvegicus
aacgttttccccagcgccagagagc

SEQ ID NO: 501195 - DNA, 25 bp, Rattus norvegicus
cgcacgcgcgcacaccttctagtgc

SEQ ID NO: 501196 - DNA, 25 bp, Rattus norvegicus
gactctggcctccaccaccgtcccg

SEQ ID NO: 501197 - DNA, 25 bp, Rattus norvegicus
acccgcagaacgcacagaactcatg

SEQ ID NO: 501198 - DNA, 25 bp, Rattus norvegicus
tccgcaccgcctgcccactcgccga

SEQ ID NO: 501199 - DNA, 25 bp, Rattus norvegicus
cgagcagcgacaagagcagccagga

SEQ ID NO: 501200 - DNA, 25 bp, Rattus norvegicus
ttactcaccgagcagcgacaagagc

SEQ ID NO: 501201 - DNA, 25 bp, Rattus norvegicus
ctgggttactcaccgagcagcgaca

SEQ ID NO: 501202 - DNA, 25 bp, Rattus norvegicus
gctggacaagctgggttactcaccg

SEQ ID NO: 501203 - DNA, 25 bp, Rattus norvegicus
cacagaactcatggctgctggcgcg

SEQ ID NO: 501204 - DNA, 25 bp, Rattus norvegicus
cagccggttcccagctcctgcgggc

SEQ ID NO: 501205 - DNA, 25 bp, Rattus norvegicus
actcgccgagcggtctccagggcaa

SEQ ID NO: 501206 - DNA, 25 bp, Rattus norvegicus
agctcggggacacctgggcgactct

SEQ ID NO: 501207 - DNA, 25 bp, Rattus norvegicus
cagccggagttcgttccgggaagtg

SEQ ID NO: 501208 - DNA, 25 bp, Rattus norvegicus
cccacgcggctggacaagctgggtt

SEQ ID NO: 501209 - DNA, 25 bp, Rattus norvegicus
aaggccactccgctccgctgaggct

SEQ ID NO: 501210 - DNA, 25 bp, Rattus norvegicus
aaccggagccagtcttagcgggcga

SEQ ID NO: 501211 - DNA, 25 bp, Rattus norvegicus
cgccacagcctggacttcgatggtt

SEQ ID NO: 501212 - DNA, 25 bp, Rattus norvegicus
agggacagacgccacaggttttcca

SEQ ID NO: 501213 - DNA, 25 bp, Rattus norvegicus
tggacttcgatggttttccgccgcg

SEQ ID NO: 501214 - DNA, 25 bp, Rattus norvegicus
ttggcccgcagcagatcccgccaca

SEQ ID NO: 501215 - DNA, 25 bp, Rattus norvegicus
acgggtcacacaatcgagcgcgcta

SEQ ID NO: 501216 - DNA, 25 bp, Rattus norvegicus
gcgatgccaaaacgcacgggtcaca

SEQ ID NO: 501217 - DNA, 25 bp, Rattus norvegicus
tcttagcgggcgatgccaaaacgca

SEQ ID NO: 501218 - DNA, 25 bp, Rattus norvegicus
acccatcaaccggagccagtcttag

SEQ ID NO: 501219 - DNA, 25 bp, Rattus norvegicus
aacaggtgcctctgcgtccaccgtt

SEQ ID NO: 501220 - DNA, 25 bp, Rattus norvegicus
aggcccgaacaggtgcctctgcgtc

SEQ ID NO: 501221 - DNA, 25 bp, Rattus norvegicus
gtgcgtagtctaggcaggcccgaac

SEQ ID NO: 501222 - DNA, 25 bp, Rattus norvegicus
cgccacaggttttccaccaggagtg

SEQ ID NO: 501223 - DNA, 25 bp, Rattus norvegicus
tccaccaggagtgcgtagtctaggc

SEQ ID NO: 501224 - DNA, 25 bp, Rattus norvegicus
cattgctgcggggtgactcagcccg

SEQ ID NO: 501225 - DNA, 25 bp, Rattus norvegicus
gtttcctgttgtgagccgtcgtcat

SEQ ID NO: 501226 - DNA, 25 bp, Rattus norvegicus
cgtcgtcatggcaactggagccatc

SEQ ID NO: 501227 - DNA, 25 bp, Rattus norvegicus
tcatggcaactggagccatcggtgg

SEQ ID NO: 501228 - DNA, 25 bp, Rattus norvegicus
aactggagccatcggtgggctccac

SEQ ID NO: 501229 - DNA, 25 bp, Rattus norvegicus
ggcgacatgacatcacccggtggga

SEQ ID NO: 501230 - DNA, 25 bp, Rattus norvegicus
gggcagaatgcttcgcattctttcg

SEQ ID NO: 501231 - DNA, 25 bp, Rattus norvegicus
aggccgcctgcgggcacattgctgc

SEQ ID NO: 501232 - DNA, 25 bp, Rattus norvegicus
ctgttgtgagccgtcgtcatggcaa

SEQ ID NO: 501233 - DNA, 25 bp, Rattus norvegicus
ctgcggggtgactcagcccgagaca

SEQ ID NO: 501234 - DNA, 25 bp, Rattus norvegicus
actcagcccgagacagggcagaatg

SEQ ID NO: 501235 - DNA, 25 bp, Rattus norvegicus
cccgagacagggcagaatgcttcgc

SEQ ID NO: 501236 - DNA, 25 bp, Rattus norvegicus
agacagggcagaatgcttcgcattc

SEQ ID NO: 501237 - DNA, 25 bp, Rattus norvegicus
tgacatcacccggtgggaaggcgaa

SEQ ID NO: 501238 - DNA, 25 bp, Rattus norvegicus
gcaaggctccaaagttcactgcagg

SEQ ID NO: 501239 - DNA, 25 bp, Rattus norvegicus
agcagcgattcatgccgactccggg

SEQ ID NO: 501240 - DNA, 25 bp, Rattus norvegicus
ctaggcttctgcaagcgtgcgctcc

SEQ ID NO: 501241 - DNA, 25 bp, Rattus norvegicus
gtcctgtctctactccaagcgtcta

SEQ ID NO: 501242 - DNA, 25 bp, Rattus norvegicus
caagcgtctaaacctaccgtatgtc

SEQ ID NO: 501243 - DNA, 25 bp, Rattus norvegicus
tgtctgcctgtctctctagtctctc

SEQ ID NO: 501244 - DNA, 25 bp, Rattus norvegicus
acaaggtgcttttagaccgtccagc

SEQ ID NO: 501245 - DNA, 25 bp, Rattus norvegicus
cctcagcgctgaccagacgcaggta

SEQ ID NO: 501246 - DNA, 25 bp, Rattus norvegicus
tcctgagttcgagggcacacttcta

SEQ ID NO: 501247 - DNA, 25 bp, Rattus norvegicus
aggaggtctcgatgccttaggcacc

SEQ ID NO: 501248 - DNA, 25 bp, Rattus norvegicus
cttaggcaccctaggtatcacctca

SEQ ID NO: 501249 - DNA, 25 bp, Rattus norvegicus
taacctggatggagcttaagacctc

SEQ ID NO: 501250 - DNA, 25 bp, Rattus norvegicus
gcagggtaacaaccttctaggacgc

SEQ ID NO: 501251 - DNA, 25 bp, Rattus norvegicus
tctccaaaggtctctggatatcctg

SEQ ID NO: 501252 - DNA, 25 bp, Rattus norvegicus
gactccctagaataacctctcagta

SEQ ID NO: 501253 - DNA, 25 bp, Rattus norvegicus
cctcgggattgacaaatagcgtttg

SEQ ID NO: 501254 - DNA, 25 bp, Rattus norvegicus
cgccttctcagcgtgcgaacgtgct

SEQ ID NO: 501255 - DNA, 25 bp, Rattus norvegicus
tggaacatcattttacacacgtttc

SEQ ID NO: 501256 - DNA, 25 bp, Rattus norvegicus
ggtcgaagggcacgaatggaacatc

SEQ ID NO: 501257 - DNA, 25 bp, Rattus norvegicus
cctctcagtattggtgaggccggga

SEQ ID NO: 501258 - DNA, 25 bp, Rattus norvegicus
ccgatacagtcaggccagcggaaga

SEQ ID NO: 501259 - DNA, 25 bp, Rattus norvegicus
ccagcggaagactatagaggaaagc

SEQ ID NO: 501260 - DNA, 25 bp, Rattus norvegicus
gaggaaagcatcacagtcgtacata

SEQ ID NO: 501261 - DNA, 25 bp, Rattus norvegicus
acacgccgccgatagagatcgagca

SEQ ID NO: 501262 - DNA, 25 bp, Rattus norvegicus
ggcgctggtgcaggctatataaagc

SEQ ID NO: 501263 - DNA, 25 bp, Rattus norvegicus
tataaagccactcgatggctccgcc

SEQ ID NO: 501264 - DNA, 25 bp, Rattus norvegicus
ttcaaacttagcgaaacgcttttga

SEQ ID NO: 501265 - DNA, 25 bp, Rattus norvegicus
gcgccgatggtaggccgatacagtc

SEQ ID NO: 501266 - DNA, 25 bp, Rattus norvegicus
gcggatcagggcgtggatctttttc

SEQ ID NO: 501267 - DNA, 25 bp, Rattus norvegicus
gatctttttctagggcgcactgctg

SEQ ID NO: 501268 - DNA, 25 bp, Rattus norvegicus
ggtgcgacagccacataccatcctg

SEQ ID NO: 501269 - DNA, 25 bp, Rattus norvegicus
acataccatcctgcgcgtcgtgtct

SEQ ID NO: 501270 - DNA, 25 bp, Rattus norvegicus
tcttgggtaaggacacagcaaggcg

SEQ ID NO: 501271 - DNA, 25 bp, Rattus norvegicus
gagacctccaggttgtcgctgccca

SEQ ID NO: 501272 - DNA, 25 bp, Rattus norvegicus
cccgtggagactgagcccaagttca

SEQ ID NO: 501273 - DNA, 25 bp, Rattus norvegicus
ccggactgcacaagccgagcgcagg

SEQ ID NO: 501274 - DNA, 25 bp, Rattus norvegicus
ctttctgagcgcgagcttcggagag

SEQ ID NO: 501275 - DNA, 25 bp, Rattus norvegicus
gcaaaaaggtcatcccgctggcagg

SEQ ID NO: 501276 - DNA, 25 bp, Rattus norvegicus
cgactacgcgttatttggcaaaaag

SEQ ID NO: 501277 - DNA, 25 bp, Rattus norvegicus
gatgcgtctgcattctccgtccaca

SEQ ID NO: 501278 - DNA, 25 bp, Rattus norvegicus
gctacagtccggagggctcccgaag

SEQ ID NO: 501279 - DNA, 25 bp, Rattus norvegicus
tgcccagcatctagcgactcggttc

SEQ ID NO: 501280 - DNA, 25 bp, Rattus norvegicus
tctttagatggcagagtgcggaccc

SEQ ID NO: 501281 - DNA, 25 bp, Rattus norvegicus
gtcgaagccgctctagccatccatt

SEQ ID NO: 501282 - DNA, 25 bp, Rattus norvegicus
taatctctgggtcagtcgaagccgc

SEQ ID NO: 501283 - DNA, 25 bp, Rattus norvegicus
agccatccatttcgctactccgaga

SEQ ID NO: 501284 - DNA, 25 bp, Rattus norvegicus
ttcgctactccgagagactggcgcg

SEQ ID NO: 501285 - DNA, 25 bp, Rattus norvegicus
cagagtgtgaggaaaccgacccgct

SEQ ID NO: 501286 - DNA, 25 bp, Rattus norvegicus
ctcgggtgcagaagctgttgtcttt

SEQ ID NO: 501287 - DNA, 25 bp, Rattus norvegicus
tcaagccggaaagggacatggcgcc

SEQ ID NO: 501288 - DNA, 25 bp, Rattus norvegicus
cccagaggccctagggtgcttgcag

SEQ ID NO: 501289 - DNA, 25 bp, Rattus norvegicus
cgcgcaagaccctttccagtctaga

SEQ ID NO: 501290 - DNA, 25 bp, Rattus norvegicus
agagcctcgcctagttctgcgcgtg

SEQ ID NO: 501291 - DNA, 25 bp, Rattus norvegicus
aatgggagcgtcctcaagccggaaa

SEQ ID NO: 501292 - DNA, 25 bp, Rattus norvegicus
gggcggacacgactaataataaatc

SEQ ID NO: 501293 - DNA, 25 bp, Rattus norvegicus
gaaaccgacccgctctctgggctgg

SEQ ID NO: 501294 - DNA, 25 bp, Rattus norvegicus
ccctccgtgttggtcccgcagcacc

SEQ ID NO: 501295 - DNA, 25 bp, Rattus norvegicus
cgatgggtgagttgaccctggagct

SEQ ID NO: 501296 - DNA, 25 bp, Rattus norvegicus
gcctgctctccgcagctcttcctgg

SEQ ID NO: 501297 - DNA, 25 bp, Rattus norvegicus
agctcttcctggccgcggggcagaa

SEQ ID NO: 501298 - DNA, 25 bp, Rattus norvegicus
cgcggggcagaaccttgcgcagcga

SEQ ID NO: 501299 - DNA, 25 bp, Rattus norvegicus
aggcgcggagctccagccatgcttt

SEQ ID NO: 501300 - DNA, 25 bp, Rattus norvegicus
cggagctccagccatgctttgtgcg

SEQ ID NO: 501301 - DNA, 25 bp, Rattus norvegicus
ctccagccatgctttgtgcgctgca

SEQ ID NO: 501302 - DNA, 25 bp, Rattus norvegicus
cagccatgctttgtgcgctgcactc

SEQ ID NO: 501303 - DNA, 25 bp, Rattus norvegicus
gccatgctttgtgcgctgcactctc

SEQ ID NO: 501304 - DNA, 25 bp, Rattus norvegicus
tgctttgtgcgctgcactctccctt

SEQ ID NO: 501305 - DNA, 25 bp, Rattus norvegicus
gctgcactctcccttccacctccgg

SEQ ID NO: 501306 - DNA, 25 bp, Rattus norvegicus
tcccttccacctccggcgcggctcg

SEQ ID NO: 501307 - DNA, 25 bp, Rattus norvegicus
ccgctgctgagacccagcgggcgat

SEQ ID NO: 501308 - DNA, 25 bp, Rattus norvegicus
ggggtgcccactgtggtccagtatt

SEQ ID NO: 501309 - DNA, 25 bp, Rattus norvegicus
tgcccaccaaggagcgcctggtacc

SEQ ID NO: 501310 - DNA, 25 bp, Rattus norvegicus
cgcctggtacccagggaggtgccga

SEQ ID NO: 501311 - DNA, 25 bp, Rattus norvegicus
gtgccgaggcgggttatcaacgcca

SEQ ID NO: 501312 - DNA, 25 bp, Rattus norvegicus
gcgggttatcaacgccatcaacatc

SEQ ID NO: 501313 - DNA, 25 bp, Rattus norvegicus
gtcctgctcggaggcctatgcggca

SEQ ID NO: 501314 - DNA, 25 bp, Rattus norvegicus
cctatgcggcatgtgttgagtgcac

SEQ ID NO: 501315 - DNA, 25 bp, Rattus norvegicus
cactaggcgcaagtgggttgagtgt

SEQ ID NO: 501316 - DNA, 25 bp, Rattus norvegicus
ctgccaggctggcacgggcccagct

SEQ ID NO: 501317 - DNA, 25 bp, Rattus norvegicus
tgcccactgtggtccagtattccaa

SEQ ID NO: 501318 - DNA, 25 bp, Rattus norvegicus
actgtggtccagtattccaacctgc

SEQ ID NO: 501319 - DNA, 25 bp, Rattus norvegicus
gtggtccagtattccaacctgccca

SEQ ID NO: 501320 - DNA, 25 bp, Rattus norvegicus
gtattccaacctgcccaccaaggag

SEQ ID NO: 501321 - DNA, 25 bp, Rattus norvegicus
ggttatcaacgccatcaacatcaac

SEQ ID NO: 501322 - DNA, 25 bp, Rattus norvegicus
cttcgagtacatccgccacaaggtg

SEQ ID NO: 501323 - DNA, 25 bp, Rattus norvegicus
gtctttatcatcgacgacgcggacg

SEQ ID NO: 501324 - DNA, 25 bp, Rattus norvegicus
atcaaccatgagttcgacctgctgg

SEQ ID NO: 501325 - DNA, 25 bp, Rattus norvegicus
tcgacctgctggatgtgcgcttcca

SEQ ID NO: 501326 - DNA, 25 bp, Rattus norvegicus
cctgcgacctgatgacgtctttatc

SEQ ID NO: 501327 - DNA, 25 bp, Rattus norvegicus
tgcgtaccttcctcacccaggatgg

SEQ ID NO: 501328 - DNA, 25 bp, Rattus norvegicus
cggctggattgcagacgactacctg

SEQ ID NO: 501329 - DNA, 25 bp, Rattus norvegicus
aggtgctctacgtcttcctggacca

SEQ ID NO: 501330 - DNA, 25 bp, Rattus norvegicus
ccgagagatgctgaccaatggcacc

SEQ ID NO: 501331 - DNA, 25 bp, Rattus norvegicus
tcggccgctcaagttccgagagatg

SEQ ID NO: 501332 - DNA, 25 bp, Rattus norvegicus
cgaatccaatttcaccgcctacggg

SEQ ID NO: 501333 - DNA, 25 bp, Rattus norvegicus
gcgcttccatgagctgggcgatgtt

SEQ ID NO: 501334 - DNA, 25 bp, Rattus norvegicus
acttcccacctggtggccgtcagga

SEQ ID NO: 501335 - DNA, 25 bp, Rattus norvegicus
gacgcctttgtggtctgcgaatcca

SEQ ID NO: 501336 - DNA, 25 bp, Rattus norvegicus
cccgctggggtgactacgaggacaa

SEQ ID NO: 501337 - DNA, 25 bp, Rattus norvegicus
atccgaagcttgattcgcactgggg

SEQ ID NO: 501338 - DNA, 25 bp, Rattus norvegicus
ggacctcaattacatccgaagcttg

SEQ ID NO: 501339 - DNA, 25 bp, Rattus norvegicus
tacgaggacaagagggacctcaatt

SEQ ID NO: 501340 - DNA, 25 bp, Rattus norvegicus
gtcagtactacaccatgcccaactt

SEQ ID NO: 501341 - DNA, 25 bp, Rattus norvegicus
ccatgcccaactttcgacagtatga

SEQ ID NO: 501342 - DNA, 25 bp, Rattus norvegicus
gcaccggccacatcctagtgcagtg

SEQ ID NO: 501343 - DNA, 25 bp, Rattus norvegicus
catcctagtgcagtggtctctcggc

SEQ ID NO: 501344 - DNA, 25 bp, Rattus norvegicus
gtgtcggcccagaatggtgacttcc

SEQ ID NO: 501345 - DNA, 25 bp, Rattus norvegicus
tacttcaaactcgtgtcggcccaga

SEQ ID NO: 501346 - DNA, 25 bp, Rattus norvegicus
cacccgagggcatctacttcaaact

SEQ ID NO: 501347 - DNA, 25 bp, Rattus norvegicus
tgctcctggtgcttcacacccgagg

SEQ ID NO: 501348 - DNA, 25 bp, Rattus norvegicus
ctggcactgctcctggtgcttcaca

SEQ ID NO: 501349 - DNA, 25 bp, Rattus norvegicus
tcgacagtatgagaaccgcaccggc

SEQ ID NO: 501350 - DNA, 25 bp, Rattus norvegicus
gatcgagggcttcacgaacgtccga

SEQ ID NO: 501351 - DNA, 25 bp, Rattus norvegicus
cccagtctgatggagtttctatatc

SEQ ID NO: 501352 - DNA, 25 bp, Rattus norvegicus
ataccacccgggacccagtctgatg

SEQ ID NO: 501353 - DNA, 25 bp, Rattus norvegicus
tgagagcggaccacggataccaccc

SEQ ID NO: 501354 - DNA, 25 bp, Rattus norvegicus
catcgcgcctactgaggtgagagcg

SEQ ID NO: 501355 - DNA, 25 bp, Rattus norvegicus
aacgtccgagagctctacgccaaga

SEQ ID NO: 501356 - DNA, 25 bp, Rattus norvegicus
gtttctatatcctccgagaacccga

SEQ ID NO: 501357 - DNA, 25 bp, Rattus norvegicus
acggcagcccgactggcaggatcga

SEQ ID NO: 501358 - DNA, 25 bp, Rattus norvegicus
gcgcctagtgttccgcacgcagctg

SEQ ID NO: 501359 - DNA, 25 bp, Rattus norvegicus
ctgcgcgccatggacagtgctgcgc

SEQ ID NO: 501360 - DNA, 25 bp, Rattus norvegicus
ctcgggttcccggatctgcttacgc

SEQ ID NO: 501361 - DNA, 25 bp, Rattus norvegicus
ctggccatggcaggcggtttcacct

SEQ ID NO: 501362 - DNA, 25 bp, Rattus norvegicus
gccaagactggatgcggcacccaca

SEQ ID NO: 501363 - DNA, 25 bp, Rattus norvegicus
ctacgccaagatcgcggaggccttc

SEQ ID NO: 501364 - DNA, 25 bp, Rattus norvegicus
cacgcgccgctggagcttgagaaaa

SEQ ID NO: 501365 - DNA, 25 bp, Rattus norvegicus
agaaaaatgatgctttggactcgcg

SEQ ID NO: 501366 - DNA, 25 bp, Rattus norvegicus
cggcgctttgccgagcagaaaaatg

SEQ ID NO: 501367 - DNA, 25 bp, Rattus norvegicus
aagagatcgtatcccggcgctttgc

SEQ ID NO: 501368 - DNA, 25 bp, Rattus norvegicus
tcaccggaacctggaaaagagatcg

SEQ ID NO: 501369 - DNA, 25 bp, Rattus norvegicus
gctccgggcgcttctcagattccat

SEQ ID NO: 501370 - DNA, 25 bp, Rattus norvegicus
gatcacgaacggttctggggataaa

SEQ ID NO: 501371 - DNA, 25 bp, Rattus norvegicus
ggggtgcacaacttagcctttagga

SEQ ID NO: 501372 - DNA, 25 bp, Rattus norvegicus
cggttctcccaggacctgttgcaca

SEQ ID NO: 501373 - DNA, 25 bp, Rattus norvegicus
ggatctcccttgtggaccgcctgcg

SEQ ID NO: 501374 - DNA, 25 bp, Rattus norvegicus
cagccctggggatctcccttgtgga

SEQ ID NO: 501375 - DNA, 25 bp, Rattus norvegicus
ggctcgcagctcagcgatggccgct

SEQ ID NO: 501376 - DNA, 25 bp, Rattus norvegicus
ggacgcgacggatgcactctgcatc

SEQ ID NO: 501377 - DNA, 25 bp, Rattus norvegicus
gcctttaggagatcacgaacggttc

SEQ ID NO: 501378 - DNA, 25 bp, Rattus norvegicus
gtcctctgggagttgtaccccgatc

SEQ ID NO: 501379 - DNA, 25 bp, Rattus norvegicus
gggtctgtgtccctgtcctctggga

SEQ ID NO: 501380 - DNA, 25 bp, Rattus norvegicus
tctggctccggggtctgtgtccctg

SEQ ID NO: 501381 - DNA, 25 bp, Rattus norvegicus
gccactctggctccggggtctgtgt

SEQ ID NO: 501382 - DNA, 25 bp, Rattus norvegicus
gagccactctggctccggggtctgt

SEQ ID NO: 501383 - DNA, 25 bp, Rattus norvegicus
tttctcaagccacggagccactctg

SEQ ID NO: 501384 - DNA, 25 bp, Rattus norvegicus
ggtttctcaagccacggagccactc

SEQ ID NO: 501385 - DNA, 25 bp, Rattus norvegicus
caagacccggtttctcaagccacgg

SEQ ID NO: 501386 - DNA, 25 bp, Rattus norvegicus
tcaagacccggtttctcaagccacg

SEQ ID NO: 501387 - DNA, 25 bp, Rattus norvegicus
ggctgatcggggctaccggctccca

SEQ ID NO: 501388 - DNA, 25 bp, Rattus norvegicus
cgcccgcttgagctcgggctgatcg

SEQ ID NO: 501389 - DNA, 25 bp, Rattus norvegicus
gatcgcccgcttgagctcgggctga

SEQ ID NO: 501390 - DNA, 25 bp, Rattus norvegicus
cccgcgggtgagtgagggagcgtat

SEQ ID NO: 501391 - DNA, 25 bp, Rattus norvegicus
gtaccccgatcggagcccatagtcg

SEQ ID NO: 501392 - DNA, 25 bp, Rattus norvegicus
tgtctctctgtacgctgttcctttc

SEQ ID NO: 501393 - DNA, 25 bp, Rattus norvegicus
ctcgcgtgataaccaggcagctttg

SEQ ID NO: 501394 - DNA, 25 bp, Rattus norvegicus
ggcagctttggctttgaccgtcata

SEQ ID NO: 501395 - DNA, 25 bp, Rattus norvegicus
cgtcatagctttggttaggtgtctc

SEQ ID NO: 501396 - DNA, 25 bp, Rattus norvegicus
aggtgtctctccacgccctgtaaga

SEQ ID NO: 501397 - DNA, 25 bp, Rattus norvegicus
gtgacttcagttggtcgcaaaccta

SEQ ID NO: 501398 - DNA, 25 bp, Rattus norvegicus
catggggccttcaggatactctgta

SEQ ID NO: 501399 - DNA, 25 bp, Rattus norvegicus
cgccgccatttctgcttgctctgtg

SEQ ID NO: 501400 - DNA, 25 bp, Rattus norvegicus
ccaccatggcgtattagaggcagca

SEQ ID NO: 501401 - DNA, 25 bp, Rattus norvegicus
accggcttaagccatggcgtgagta

SEQ ID NO: 501402 - DNA, 25 bp, Rattus norvegicus
gttgaccagcatacgcggctttaca

SEQ ID NO: 501403 - DNA, 25 bp, Rattus norvegicus
ttcccggtgtcattctgcgaacgtg

SEQ ID NO: 501404 - DNA, 25 bp, Rattus norvegicus
gggagtagtgcctaaaaccctgcta

SEQ ID NO: 501405 - DNA, 25 bp, Rattus norvegicus
ctgcgtccctcaccgattctataaa

SEQ ID NO: 501406 - DNA, 25 bp, Rattus norvegicus
tcccagctcacctaatgcggactta

SEQ ID NO: 501407 - DNA, 25 bp, Rattus norvegicus
tcaatggctttcctctagtcctaga

SEQ ID NO: 501408 - DNA, 25 bp, Rattus norvegicus
cgttagaacgcaggctcaatggctt

SEQ ID NO: 501409 - DNA, 25 bp, Rattus norvegicus
ccgcagcgagcggaagtaccacgtt

SEQ ID NO: 501410 - DNA, 25 bp, Rattus norvegicus
cggcagaaactggagccggaaccca

SEQ ID NO: 501411 - DNA, 25 bp, Rattus norvegicus
cggtgttcgctcctcggcagaaact

SEQ ID NO: 501412 - DNA, 25 bp, Rattus norvegicus
acgctgcgagttacttccgccctgg

SEQ ID NO: 501413 - DNA, 25 bp, Rattus norvegicus
tctaaaagctccaagccgcgccgta

SEQ ID NO: 501414 - DNA, 25 bp, Rattus norvegicus
gaccacgcaggataagccctcctta

SEQ ID NO: 501415 - DNA, 25 bp, Rattus norvegicus
cttcacagcgcgaccacgcaggata

SEQ ID NO: 501416 - DNA, 25 bp, Rattus norvegicus
tcccttcgctgagttccgtagtttc

SEQ ID NO: 501417 - DNA, 25 bp, Rattus norvegicus
actcggagtcttctttcccagctca

SEQ ID NO: 501418 - DNA, 25 bp, Rattus norvegicus
caaatcctgcgaagcactcggagtc

SEQ ID NO: 501419 - DNA, 25 bp, Rattus norvegicus
ttcacggcctgtttggccttggctc

SEQ ID NO: 501420 - DNA, 25 bp, Rattus norvegicus
atttattatttctggggactgatcc

SEQ ID NO: 501421 - DNA, 25 bp, Rattus norvegicus
gccggcttcggggacacgcgtcaac

SEQ ID NO: 501422 - DNA, 25 bp, Rattus norvegicus
gggcgcagctgatcccggattccca

SEQ ID NO: 501423 - DNA, 25 bp, Rattus norvegicus
ccggccacgtccatgccaaggtagg

SEQ ID NO: 501424 - DNA, 25 bp, Rattus norvegicus
cgcgtcgggctttctttacagaggc

SEQ ID NO: 501425 - DNA, 25 bp, Rattus norvegicus
tttgtctgtccgtcctgctgtccct

SEQ ID NO: 501426 - DNA, 25 bp, Rattus norvegicus
gtgcccatcaggtgggcgccacatc

SEQ ID NO: 501427 - DNA, 25 bp, Rattus norvegicus
tgggcgccacatctcttgcttgggg

SEQ ID NO: 501428 - DNA, 25 bp, Rattus norvegicus
ctctccaaggccacgaaagttctct

SEQ ID NO: 501429 - DNA, 25 bp, Rattus norvegicus
acgaaagttctcttggtgccaatac

SEQ ID NO: 501430 - DNA, 25 bp, Rattus norvegicus
gtgccaataccgaagcccaaagccg

SEQ ID NO: 501431 - DNA, 25 bp, Rattus norvegicus
gccggctcaaccagcgctgcagaaa

SEQ ID NO: 501432 - DNA, 25 bp, Rattus norvegicus
cagcgctgcagaaatttattcaaca

SEQ ID NO: 501433 - DNA, 25 bp, Rattus norvegicus
aaggagaggatcagtccctcgctcg

SEQ ID NO: 501434 - DNA, 25 bp, Rattus norvegicus
gtagccacagcagtggcggctccac

SEQ ID NO: 501435 - DNA, 25 bp, Rattus norvegicus
tgggccacgggctagcctgtcaccg

SEQ ID NO: 501436 - DNA, 25 bp, Rattus norvegicus
acgggctagcctgtcaccggccacc

SEQ ID NO: 501437 - DNA, 25 bp, Rattus norvegicus
gcctgtttagtctgcgtgggctgcg

SEQ ID NO: 501438 - DNA, 25 bp, Rattus norvegicus
gctgcgggcccatcagcgtagccac

SEQ ID NO: 501439 - DNA, 25 bp, Rattus norvegicus
tcagcgtagccacagcagtggcggc

SEQ ID NO: 501440 - DNA, 25 bp, Rattus norvegicus
cgtagccacagcagtggcggctcca

SEQ ID NO: 501441 - DNA, 25 bp, Rattus norvegicus
gcggctccaccagccctggctgcac

SEQ ID NO: 501442 - DNA, 25 bp, Rattus norvegicus
ccagccctggctgcactcaccacga

SEQ ID NO: 501443 - DNA, 25 bp, Rattus norvegicus
tggctgcactcaccacgactccatg

SEQ ID NO: 501444 - DNA, 25 bp, Rattus norvegicus
gctgcactcaccacgactccatgga

SEQ ID NO: 501445 - DNA, 25 bp, Rattus norvegicus
acgactccatggacccctctgatga

SEQ ID NO: 501446 - DNA, 25 bp, Rattus norvegicus
tccatggacccctctgatgaggagg

SEQ ID NO: 501447 - DNA, 25 bp, Rattus norvegicus
agcgtagccacagcagtggcggctc

SEQ ID NO: 501448 - DNA, 25 bp, Rattus norvegicus
tgccgccttctactactgcgagagg

SEQ ID NO: 501449 - DNA, 25 bp, Rattus norvegicus
tggctgactatagcccggctccaag

SEQ ID NO: 501450 - DNA, 25 bp, Rattus norvegicus
ggcgtgagccgagtcacgctcttca

SEQ ID NO: 501451 - DNA, 25 bp, Rattus norvegicus
gggtggaccgactccagcttctacc

SEQ ID NO: 501452 - DNA, 25 bp, Rattus norvegicus
tactggccagatcgctccgacactg

SEQ ID NO: 501453 - DNA, 25 bp, Rattus norvegicus
cggtgagtccctggcctactggcca

SEQ ID NO: 501454 - DNA, 25 bp, Rattus norvegicus
caggcctaccgcgaacgggtcaaga

SEQ ID NO: 501455 - DNA, 25 bp, Rattus norvegicus
acgccatggccgagtcccagttgaa

SEQ ID NO: 501456 - DNA, 25 bp, Rattus norvegicus
tgaccgaggcacatgccgccttcta

SEQ ID NO: 501457 - DNA, 25 bp, Rattus norvegicus
ctcaaaggccgcacgtggctgacta

SEQ ID NO: 501458 - DNA, 25 bp, Rattus norvegicus
tgctggatgcattaaaggtcaagtc

SEQ ID NO: 501459 - DNA, 25 bp, Rattus norvegicus
aggccaagtcccattcccgggctga

SEQ ID NO: 501460 - DNA, 25 bp, Rattus norvegicus
ccctacgaggaagcggtctccaaca

SEQ ID NO: 501461 - DNA, 25 bp, Rattus norvegicus
cccagttgaactgcctggacgaggc

SEQ ID NO: 501462 - DNA, 25 bp, Rattus norvegicus
ccagtgaaaactagaggcatcctgc

SEQ ID NO: 501463 - DNA, 25 bp, Rattus norvegicus
acggcccgcttaagtgcagcgagtg

SEQ ID NO: 501464 - DNA, 25 bp, Rattus norvegicus
cgtcgcctctacagcttgcggagaa

SEQ ID NO: 501465 - DNA, 25 bp, Rattus norvegicus
cacagcggaacgacgcgctctcgga

SEQ ID NO: 501466 - DNA, 25 bp, Rattus norvegicus
ctcttttctcgcgagcagcccggag

SEQ ID NO: 501467 - DNA, 25 bp, Rattus norvegicus
aggcatcctgcctgcggccaatgga

SEQ ID NO: 501468 - DNA, 25 bp, Rattus norvegicus
ctgtgggatcgctatgtgcagacgt

SEQ ID NO: 501469 - DNA, 25 bp, Rattus norvegicus
atccgagcgcttcgtgtagcctagg

SEQ ID NO: 501470 - DNA, 25 bp, Rattus norvegicus
tagccaatgaggagagacgacagcg

SEQ ID NO: 501471 - DNA, 25 bp, Rattus norvegicus
aggaacagcgacttgacgggcacga

SEQ ID NO: 501472 - DNA, 25 bp, Rattus norvegicus
tcatgattggcgcaggccgctcaac

SEQ ID NO: 501473 - DNA, 25 bp, Rattus norvegicus
acgacagcggcgaggacttaagaga

SEQ ID NO: 501474 - DNA, 25 bp, Rattus norvegicus
tgacgggcacgaaagctaaccagtg

SEQ ID NO: 501475 - DNA, 25 bp, Rattus norvegicus
cagttcggcaaacgggaagcactta

SEQ ID NO: 501476 - DNA, 25 bp, Rattus norvegicus
tgaaagctaccgttctccgctggcg

SEQ ID NO: 501477 - DNA, 25 bp, Rattus norvegicus
tccgagtgtccactagggctccttc

SEQ ID NO: 501478 - DNA, 25 bp, Rattus norvegicus
ctacgactggcctctggaactttcc

SEQ ID NO: 501479 - DNA, 25 bp, Rattus norvegicus
cgcgggtcttaatgtgcgttcctca

SEQ ID NO: 501480 - DNA, 25 bp, Rattus norvegicus
cacggcgttggacagagatttaaga

SEQ ID NO: 501481 - DNA, 25 bp, Rattus norvegicus
gaagctttaaccgtacctcgctgaa

SEQ ID NO: 501482 - DNA, 25 bp, Rattus norvegicus
cgttgaccctcagaaaggacgagcc

SEQ ID NO: 501483 - DNA, 25 bp, Rattus norvegicus
ggacgagccaaacgtgaactacctc

SEQ ID NO: 501484 - DNA, 25 bp, Rattus norvegicus
ggcccgctactgaagtccgccgtag

SEQ ID NO: 501485 - DNA, 25 bp, Rattus norvegicus
ccgtagctgagtcgcgtgttgaaaa

SEQ ID NO: 501486 - DNA, 25 bp, Rattus norvegicus
ggaccctgcctgtgctgaaagctac

SEQ ID NO: 501487 - DNA, 25 bp, Rattus norvegicus
ctcgctacgccagccatgaaatgtg

SEQ ID NO: 501488 - DNA, 25 bp, Rattus norvegicus
ttcagcgacaggtacaagttccaga

SEQ ID NO: 501489 - DNA, 25 bp, Rattus norvegicus
ttgaaaatggctgcatccggggacc

SEQ ID NO: 501490 - DNA, 25 bp, Rattus norvegicus
cgcagtagggcagctgtcgctgatt

SEQ ID NO: 501491 - DNA, 25 bp, Rattus norvegicus
ggcgaacgctcactagccccttagt

SEQ ID NO: 501492 - DNA, 25 bp, Rattus norvegicus
gagcgaggcgaacgctcactagccc

SEQ ID NO: 501493 - DNA, 25 bp, Rattus norvegicus
tccgagcgaggcgaacgctcactag

SEQ ID NO: 501494 - DNA, 25 bp, Rattus norvegicus
agtctccgagcgaggcgaacgctca

SEQ ID NO: 501495 - DNA, 25 bp, Rattus norvegicus
ctgaggtggccctgacacaggtgag

SEQ ID NO: 501496 - DNA, 25 bp, Rattus norvegicus
ctagccggagcagctgaggtgctga

SEQ ID NO: 501497 - DNA, 25 bp, Rattus norvegicus
gagccagccgctagccggagcagct

SEQ ID NO: 501498 - DNA, 25 bp, Rattus norvegicus
ctgattaggagccagccgctagccg

SEQ ID NO: 501499 - DNA, 25 bp, Rattus norvegicus
ggcagctgtcgctgattaggagcca

SEQ ID NO: 501500 - DNA, 25 bp, Rattus norvegicus
gccgccgactctacagcccgcgcgt

SEQ ID NO: 501501 - DNA, 25 bp, Rattus norvegicus
ctagccccttagttggaggccgcgg

SEQ ID NO: 501502 - DNA, 25 bp, Rattus norvegicus
gccgcggggtacgagctgaagggaa

SEQ ID NO: 501503 - DNA, 25 bp, Rattus norvegicus
gtcgctgattaggagccagccgcta

SEQ ID NO: 501504 - DNA, 25 bp, Rattus norvegicus
atcagaaacctagcgcggtcagggc

SEQ ID NO: 501505 - DNA, 25 bp, Rattus norvegicus
aaaaatcctgcagccttcatctcgg

SEQ ID NO: 501506 - DNA, 25 bp, Rattus norvegicus
cgaccggtcccaaacagattgcaca

SEQ ID NO: 501507 - DNA, 25 bp, Rattus norvegicus
atctcggcccttccgcctgtttttg

SEQ ID NO: 501508 - DNA, 25 bp, Rattus norvegicus
ccagcctggaggtttactgcaaaaa

SEQ ID NO: 501509 - DNA, 25 bp, Rattus norvegicus
agcagatcacccagtcaaaggaagg

SEQ ID NO: 501510 - DNA, 25 bp, Rattus norvegicus
taaagtgaccgtaacccagcagatc

SEQ ID NO: 501511 - DNA, 25 bp, Rattus norvegicus
tcatcgctgaggaaagtctggaact

SEQ ID NO: 501512 - DNA, 25 bp, Rattus norvegicus
ttcctgtgactgacagcatagcgca

SEQ ID NO: 501513 - DNA, 25 bp, Rattus norvegicus
cagtcaggctgcaccaagatgggga

SEQ ID NO: 501514 - DNA, 25 bp, Rattus norvegicus
gacagccgtgtcgaccaatcagaaa

SEQ ID NO: 501515 - DNA, 25 bp, Rattus norvegicus
tcccgagcctcaaggaccagtcagg

SEQ ID NO: 501516 - DNA, 25 bp, Rattus norvegicus
gggaacctagctgctccctagcaag

SEQ ID NO: 501517 - DNA, 25 bp, Rattus norvegicus
gcatagcgcaaccaatcggtaactg

SEQ ID NO: 501518 - DNA, 25 bp, Rattus norvegicus
ccgcgtgcacgaactggaggtggaa

SEQ ID NO: 501519 - DNA, 25 bp, Rattus norvegicus
gccagcggcagatcatcgacggtag

SEQ ID NO: 501520 - DNA, 25 bp, Rattus norvegicus
agcagcgcgaggtgctcagcctgct

SEQ ID NO: 501521 - DNA, 25 bp, Rattus norvegicus
cggcagatcatcgacggtagggccc

SEQ ID NO: 501522 - DNA, 25 bp, Rattus norvegicus
tggaagagacgctgccgcgccgcat

SEQ ID NO: 501523 - DNA, 25 bp, Rattus norvegicus
atcatccagggccagcggcagatca

SEQ ID NO: 501524 - DNA, 25 bp, Rattus norvegicus
tgcgacgagatcatccagggccagc

SEQ ID NO: 501525 - DNA, 25 bp, Rattus norvegicus
gcagcctctgcgacgagatcatcca

SEQ ID NO: 501526 - DNA, 25 bp, Rattus norvegicus
agcaccgcagcctctgcgacgagat

SEQ ID NO: 501527 - DNA, 25 bp, Rattus norvegicus
acaccgagatgcagtcgcacgctct

SEQ ID NO: 501528 - DNA, 25 bp, Rattus norvegicus
gtggaaaacaccgagatgcagtcgc

SEQ ID NO: 501529 - DNA, 25 bp, Rattus norvegicus
tggaggtggaaaacaccgagatgca

SEQ ID NO: 501530 - DNA, 25 bp, Rattus norvegicus
tcagcctgctgtgccgcgtgcacga

SEQ ID NO: 501531 - DNA, 25 bp, Rattus norvegicus
tgctccgcgacagcgccctgcgcca

SEQ ID NO: 501532 - DNA, 25 bp, Rattus norvegicus
ggctcctcgtgaggccgatttcctc

SEQ ID NO: 501533 - DNA, 25 bp, Rattus norvegicus
cctccagcggtctgaaggcagagcg

SEQ ID NO: 501534 - DNA, 25 bp, Rattus norvegicus
actcgtagagccacctcgggagagc

SEQ ID NO: 501535 - DNA, 25 bp, Rattus norvegicus
ctgggcgatactctggactcgtaga

SEQ ID NO: 501536 - DNA, 25 bp, Rattus norvegicus
tcctcctgcgctgtgcaaagagccg

SEQ ID NO: 501537 - DNA, 25 bp, Rattus norvegicus
ccgaaaccctcaacagcggtgcgga

SEQ ID NO: 501538 - DNA, 25 bp, Rattus norvegicus
gccacctcgggagagcgcgatctct

SEQ ID NO: 501539 - DNA, 25 bp, Rattus norvegicus
ccctcaacagcggtgcggagtaaga

SEQ ID NO: 501540 - DNA, 25 bp, Rattus norvegicus
atgctcgctgttcgcggtcctccag

SEQ ID NO: 501541 - DNA, 25 bp, Rattus norvegicus
tcctgagctggacgatcctgggatt

SEQ ID NO: 501542 - DNA, 25 bp, Rattus norvegicus
tgacttccttccagcgcttcctgag

SEQ ID NO: 501543 - DNA, 25 bp, Rattus norvegicus
agctgccaaaaatttccaacctccg

SEQ ID NO: 501544 - DNA, 25 bp, Rattus norvegicus
cacactcagagctgccaaaaatttc

SEQ ID NO: 501545 - DNA, 25 bp, Rattus norvegicus
tcctcgcaaggctcagccgagaagc

SEQ ID NO: 501546 - DNA, 25 bp, Rattus norvegicus
cctttccagacgagttcgtggtgga

SEQ ID NO: 501547 - DNA, 25 bp, Rattus norvegicus
cctactggagagctacatgggcatc

SEQ ID NO: 501548 - DNA, 25 bp, Rattus norvegicus
ggagagctacatgggcatccgagac

SEQ ID NO: 501549 - DNA, 25 bp, Rattus norvegicus
tgcacccgagctcacagtcagtctg

SEQ ID NO: 501550 - DNA, 25 bp, Rattus norvegicus
agtcagtctgtcttttcaccctgtc

SEQ ID NO: 501551 - DNA, 25 bp, Rattus norvegicus
aggcccacgacgcttgtggctagcg

SEQ ID NO: 501552 - DNA, 25 bp, Rattus norvegicus
cgtccgtccctctgtttgtctatct

SEQ ID NO: 501553 - DNA, 25 bp, Rattus norvegicus
cctctgtttgtctatcttgtccctc

SEQ ID NO: 501554 - DNA, 25 bp, Rattus norvegicus
tatcttgtccctctttccgtctggc

SEQ ID NO: 501555 - DNA, 25 bp, Rattus norvegicus
ttcgcacgcggcctggacgctgttc

SEQ ID NO: 501556 - DNA, 25 bp, Rattus norvegicus
tcgcctttccagacgagttcgtggt

SEQ ID NO: 501557 - DNA, 25 bp, Rattus norvegicus
atcggcgaggcccacgacgcttgtg

SEQ ID NO: 501558 - DNA, 25 bp, Rattus norvegicus
gtggacgacctactggagagctaca

SEQ ID NO: 501559 - DNA, 25 bp, Rattus norvegicus
cctggacgctgttctgggcgagttc

SEQ ID NO: 501560 - DNA, 25 bp, Rattus norvegicus
ttcgataggcgaacagtcttaactc

SEQ ID NO: 501561 - DNA, 25 bp, Rattus norvegicus
ggcgcgccaaaactcagccggctga

SEQ ID NO: 501562 - DNA, 25 bp, Rattus norvegicus
ttcaagaggaacacagggaggcatt

SEQ ID NO: 501563 - DNA, 25 bp, Rattus norvegicus
tacgaaggggcctagaccacgctac

SEQ ID NO: 501564 - DNA, 25 bp, Rattus norvegicus
cctctgatgtagttcctgggataga

SEQ ID NO: 501565 - DNA, 25 bp, Rattus norvegicus
gcccgtgataatgcctgcttcgata

SEQ ID NO: 501566 - DNA, 25 bp, Rattus norvegicus
tctagaagtgtagctgcccgtgata

SEQ ID NO: 501567 - DNA, 25 bp, Rattus norvegicus
tgtgctccgcctagaaccttctaga

SEQ ID NO: 501568 - DNA, 25 bp, Rattus norvegicus
tgcctcgaggcagaacagactagaa

SEQ ID NO: 501569 - DNA, 25 bp, Rattus norvegicus
ctcgctcactttgcggggatccata

SEQ ID NO: 501570 - DNA, 25 bp, Rattus norvegicus
cgaaggcccgaagctcgctcacttt

SEQ ID NO: 501571 - DNA, 25 bp, Rattus norvegicus
aggacgctcgggtcctgcctacaca

SEQ ID NO: 501572 - DNA, 25 bp, Rattus norvegicus
catttcctcggtgtgcaggacgctc

SEQ ID NO: 501573 - DNA, 25 bp, Rattus norvegicus
cgaaggaccttgtgtgtgtgctttc

SEQ ID NO: 501574 - DNA, 25 bp, Rattus norvegicus
ctgtgggtccaatcgcagagctgct

SEQ ID NO: 501575 - DNA, 25 bp, Rattus norvegicus
acccgcacgcgccaataaggggagg

SEQ ID NO: 501576 - DNA, 25 bp, Rattus norvegicus
cgcacgacagtgtgtttccaaaatg

SEQ ID NO: 501577 - DNA, 25 bp, Rattus norvegicus
gggcaagaagcgctttgaagttaaa

SEQ ID NO: 501578 - DNA, 25 bp, Rattus norvegicus
taaaaaggttgggtctcgccagcgc

SEQ ID NO: 501579 - DNA, 25 bp, Rattus norvegicus
agggcttcatttcagggcgttcctg

SEQ ID NO: 501580 - DNA, 25 bp, Rattus norvegicus
ttgatcggcatgatggtggcccact

SEQ ID NO: 501581 - DNA, 25 bp, Rattus norvegicus
ttcgctgggaaagctgtgggtccaa

SEQ ID NO: 501582 - DNA, 25 bp, Rattus norvegicus
ctgcttactgaaatacgcgaggtta

SEQ ID NO: 501583 - DNA, 25 bp, Rattus norvegicus
agccaagcgcttaagctgtcactga

SEQ ID NO: 501584 - DNA, 25 bp, Rattus norvegicus
gcgatgacaccgcagaagagctctg

SEQ ID NO: 501585 - DNA, 25 bp, Rattus norvegicus
agagctctgccggtgttcttgctcc

SEQ ID NO: 501586 - DNA, 25 bp, Rattus norvegicus
agaaacccgggaacgtgcgatgaca

SEQ ID NO: 501587 - DNA, 25 bp, Rattus norvegicus
gcccactgtcttggccatattagtt

SEQ ID NO: 501588 - DNA, 25 bp, Rattus norvegicus
ctgcgtctgtagagctgtgagttcc

SEQ ID NO: 501589 - DNA, 25 bp, Rattus norvegicus
agagaggcggccgtacttatttctc

SEQ ID NO: 501590 - DNA, 25 bp, Rattus norvegicus
cagtgttgctgtaccctcctcccgg

SEQ ID NO: 501591 - DNA, 25 bp, Rattus norvegicus
acgtgctcgtgggatcagtgttgct

SEQ ID NO: 501592 - DNA, 25 bp, Rattus norvegicus
ggcggccgtacttatttctcctcca

SEQ ID NO: 501593 - DNA, 25 bp, Rattus norvegicus
tatttctcctccacgggcttgcgag

SEQ ID NO: 501594 - DNA, 25 bp, Rattus norvegicus
cgccagtctggctctcggctcgggt

SEQ ID NO: 501595 - DNA, 25 bp, Rattus norvegicus
agaattcgctgcagcggacgtgctc

SEQ ID NO: 501596 - DNA, 25 bp, Rattus norvegicus
gagctgtgagttcccgagaattcgc

SEQ ID NO: 501597 - DNA, 25 bp, Rattus norvegicus
cccgcctccttgtggcgatgagaag

SEQ ID NO: 501598 - DNA, 25 bp, Rattus norvegicus
aggtgagtgtctctggtcgcctcct

SEQ ID NO: 501599 - DNA, 25 bp, Rattus norvegicus
acgcccggctgagtgcgaactgcgc

SEQ ID NO: 501600 - DNA, 25 bp, Rattus norvegicus
tcgggtgagctcagtgcggccatta

SEQ ID NO: 501601 - DNA, 25 bp, Rattus norvegicus
tgagttcccgagaattcgctgcagc

SEQ ID NO: 501602 - DNA, 25 bp, Rattus norvegicus
atatggcttcctgcacctggtgacg

SEQ ID NO: 501603 - DNA, 25 bp, Rattus norvegicus
cggcttcctatttcctgcggcatga

SEQ ID NO: 501604 - DNA, 25 bp, Rattus norvegicus
gcgagcgcggaaccggcttcctatt

SEQ ID NO: 501605 - DNA, 25 bp, Rattus norvegicus
tcactcggaggacgcggagtttagc

SEQ ID NO: 501606 - DNA, 25 bp, Rattus norvegicus
gaacgcctcactcggaggacgcgga

SEQ ID NO: 501607 - DNA, 25 bp, Rattus norvegicus
aatttggtatcatggagaagccgcg

SEQ ID NO: 501608 - DNA, 25 bp, Rattus norvegicus
gcttcctgcacctggtgacggttga

SEQ ID NO: 501609 - DNA, 25 bp, Rattus norvegicus
agcggtgagggcaatatggcttcct

SEQ ID NO: 501610 - DNA, 25 bp, Rattus norvegicus
tgagcacactctcggagagcggtga

SEQ ID NO: 501611 - DNA, 25 bp, Rattus norvegicus
tagccaatgagcacactctcggaga

SEQ ID NO: 501612 - DNA, 25 bp, Rattus norvegicus
gcggggtagccaatgagcacactct

SEQ ID NO: 501613 - DNA, 25 bp, Rattus norvegicus
tgcggcatgattggcccgcagctcg

SEQ ID NO: 501614 - DNA, 25 bp, Rattus norvegicus
cctggtgacggttgaggaaattgaa

SEQ ID NO: 501615 - DNA, 25 bp, Rattus norvegicus
tatttcctgcggcatgattggcccg

SEQ ID NO: 501616 - DNA, 25 bp, Rattus norvegicus
aacgacaccaagtggcgcaggcccg

SEQ ID NO: 501617 - DNA, 25 bp, Rattus norvegicus
agcgtatccagggtctcgcctcgca

SEQ ID NO: 501618 - DNA, 25 bp, Rattus norvegicus
gcaccacagtgggttgccctgcaac

SEQ ID NO: 501619 - DNA, 25 bp, Rattus norvegicus
ggacccgtgatccagggcgagctcc

SEQ ID NO: 501620 - DNA, 25 bp, Rattus norvegicus
agggcctgcagctcattgtggtgca

SEQ ID NO: 501621 - DNA, 25 bp, Rattus norvegicus
ggccagtacactgagcgcgttgtga

SEQ ID NO: 501622 - DNA, 25 bp, Rattus norvegicus
gcgcgttgtgagacagttgcagcca

SEQ ID NO: 501623 - DNA, 25 bp, Rattus norvegicus
aaatggttgcgcctcaggtccagga

SEQ ID NO: 501624 - DNA, 25 bp, Rattus norvegicus
ccgcagtgctgcaggtgcaacgaca

SEQ ID NO: 501625 - DNA, 25 bp, Rattus norvegicus
tagagatagaccaggccgtccaggc

SEQ ID NO: 501626 - DNA, 25 bp, Rattus norvegicus
cgctcaggcccgagagctggttgtt

SEQ ID NO: 501627 - DNA, 25 bp, Rattus norvegicus
ttgtgctccaggtacaggtagccta

SEQ ID NO: 501628 - DNA, 25 bp, Rattus norvegicus
gatcctcaggaagcggttgtgctcc

SEQ ID NO: 501629 - DNA, 25 bp, Rattus norvegicus
cgcaggtctgaaggccgcagcgtat

SEQ ID NO: 501630 - DNA, 25 bp, Rattus norvegicus
taccgtccactctaggcctcagttt

SEQ ID NO: 501631 - DNA, 25 bp, Rattus norvegicus
ggcttctggctctttctctacggga

SEQ ID NO: 501632 - DNA, 25 bp, Rattus norvegicus
acagtgctcggagttcgcaaccctc

SEQ ID NO: 501633 - DNA, 25 bp, Rattus norvegicus
atggctggacgcacaagatgaacta

SEQ ID NO: 501634 - DNA, 25 bp, Rattus norvegicus
cggcagtttctttccttcgatttga

SEQ ID NO: 501635 - DNA, 25 bp, Rattus norvegicus
cggctgctcgtctagcttgtgcaca

SEQ ID NO: 501636 - DNA, 25 bp, Rattus norvegicus
tatacggcggttccagtgaccagtc

SEQ ID NO: 501637 - DNA, 25 bp, Rattus norvegicus
cggaccctggtagccaagcaagtga

SEQ ID NO: 501638 - DNA, 25 bp, Rattus norvegicus
cagccgcacccttccgtagaggtta

SEQ ID NO: 501639 - DNA, 25 bp, Rattus norvegicus
tctccaaacgtacaaggggtagcgc

SEQ ID NO: 501640 - DNA, 25 bp, Rattus norvegicus
cgcctacaggtgagatgggtgccaa

SEQ ID NO: 501641 - DNA, 25 bp, Rattus norvegicus
ctctacgggactctgttggatggta

SEQ ID NO: 501642 - DNA, 25 bp, Rattus norvegicus
caacgccgggctcagcgagatcaaa

SEQ ID NO: 501643 - DNA, 25 bp, Rattus norvegicus
ccggtgcatccgctgactacaaatc

SEQ ID NO: 501644 - DNA, 25 bp, Rattus norvegicus
cggccgcccgtaattaaatagcatt

SEQ ID NO: 501645 - DNA, 25 bp, Rattus norvegicus
catttatcgggctcggcgcaggccc

SEQ ID NO: 501646 - DNA, 25 bp, Rattus norvegicus
tagtcatagcataccatttatcggg

SEQ ID NO: 501647 - DNA, 25 bp, Rattus norvegicus
tagcatttactcttattattactaa

SEQ ID NO: 501648 - DNA, 25 bp, Rattus norvegicus
cataccatttatcgggctcggcgca

SEQ ID NO: 501649 - DNA, 25 bp, Rattus norvegicus
atgcggccgcccgtaattaaatagc

SEQ ID NO: 501650 - DNA, 25 bp, Rattus norvegicus
ctccggagccacatggaccgagctg

SEQ ID NO: 501651 - DNA, 25 bp, Rattus norvegicus
aatgaaagtaaagcgctccggagcc

SEQ ID NO: 501652 - DNA, 25 bp, Rattus norvegicus
gctggaaatgaaagtaaagcgctcc

SEQ ID NO: 501653 - DNA, 25 bp, Rattus norvegicus
agcctccagcgggtgctgccgcgag

SEQ ID NO: 501654 - DNA, 25 bp, Rattus norvegicus
ctctaggacccgaggagggagagct

SEQ ID NO: 501655 - DNA, 25 bp, Rattus norvegicus
aggaggagctgcgctctctaggacc

SEQ ID NO: 501656 - DNA, 25 bp, Rattus norvegicus
cgcgactaaggcgaggaggagctgc

SEQ ID NO: 501657 - DNA, 25 bp, Rattus norvegicus
acgtaatcatacctctagtcatagc

SEQ ID NO: 501658 - DNA, 25 bp, Rattus norvegicus
atgggtcgccccagtcggttacagc

SEQ ID NO: 501659 - DNA, 25 bp, Rattus norvegicus
gtcggctgagcaagagggcatttcc

SEQ ID NO: 501660 - DNA, 25 bp, Rattus norvegicus
cgagggccggggacaatggccggct

SEQ ID NO: 501661 - DNA, 25 bp, Rattus norvegicus
aagagggcatttccggtcgtggcat

SEQ ID NO: 501662 - DNA, 25 bp, Rattus norvegicus
caagagggcatttccggtcgtggca

SEQ ID NO: 501663 - DNA, 25 bp, Rattus norvegicus
tcggctgagcaagagggcatttccg

SEQ ID NO: 501664 - DNA, 25 bp, Rattus norvegicus
agggcatttccggtcgtggcatccg

SEQ ID NO: 501665 - DNA, 25 bp, Rattus norvegicus
ggcgcggtctgggtcggctgagcaa

SEQ ID NO: 501666 - DNA, 25 bp, Rattus norvegicus
gttacagcggccacgcgagtccggg

SEQ ID NO: 501667 - DNA, 25 bp, Rattus norvegicus
tcggttacagcggccacgcgagtcc

SEQ ID NO: 501668 - DNA, 25 bp, Rattus norvegicus
cagtcggttacagcggccacgcgag

SEQ ID NO: 501669 - DNA, 25 bp, Rattus norvegicus
ccagtcggttacagcggccacgcga

SEQ ID NO: 501670 - DNA, 25 bp, Rattus norvegicus
acaatggccggctgatgggtcgccc

SEQ ID NO: 501671 - DNA, 25 bp, Rattus norvegicus
tgagcaagagggcatttccggtcgt

SEQ ID NO: 501672 - DNA, 25 bp, Rattus norvegicus
gggacgcgactgaccaaaaagaaca

SEQ ID NO: 501673 - DNA, 25 bp, Rattus norvegicus
ggagcgcttgctgagcatccacttc

SEQ ID NO: 501674 - DNA, 25 bp, Rattus norvegicus
agagtccgccaaacaacaggccagg

SEQ ID NO: 501675 - DNA, 25 bp, Rattus norvegicus
gtgcagagcctcgtgcaatcgcgcc

SEQ ID NO: 501676 - DNA, 25 bp, Rattus norvegicus
gctgacatgggcctttccctcattg

SEQ ID NO: 501677 - DNA, 25 bp, Rattus norvegicus
actgggaggaaacctgtagtcacga

SEQ ID NO: 501678 - DNA, 25 bp, Rattus norvegicus
ccctctagtcctgaagaagctgatg

SEQ ID NO: 501679 - DNA, 25 bp, Rattus norvegicus
ccaaaaagaacaggggtgctccaca

SEQ ID NO: 501680 - DNA, 25 bp, Rattus norvegicus
ggcggagcgatactcctcacctggc

SEQ ID NO: 501681 - DNA, 25 bp, Rattus norvegicus
tggcccagcacgtgtctacatcgtt

SEQ ID NO: 501682 - DNA, 25 bp, Rattus norvegicus
ggcaacctgacacccgcttgaacgg

SEQ ID NO: 501683 - DNA, 25 bp, Rattus norvegicus
gctggcctggccttatgaataatga

SEQ ID NO: 501684 - DNA, 25 bp, Rattus norvegicus
aagaagccgcctgtggagcctcagg

SEQ ID NO: 501685 - DNA, 25 bp, Rattus norvegicus
catcgtttggttcccacagccaatc

SEQ ID NO: 501686 - DNA, 25 bp, Rattus norvegicus
cagactgttctgtgactgaccatga

SEQ ID NO: 501687 - DNA, 25 bp, Rattus norvegicus
aagaccctgtctgggtacgcaggca

SEQ ID NO: 501688 - DNA, 25 bp, Rattus norvegicus
acagagctggcgctcattcctcggt

SEQ ID NO: 501689 - DNA, 25 bp, Rattus norvegicus
ggcgctcattcctcggtgccatgaa

SEQ ID NO: 501690 - DNA, 25 bp, Rattus norvegicus
ggtgccatgaaaggacagactgttc

SEQ ID NO: 501691 - DNA, 25 bp, Rattus norvegicus
gacactgaccagttaaagaggagaa

SEQ ID NO: 501692 - DNA, 25 bp, Rattus norvegicus
cgtcattgtgcaaggcctccctggt

SEQ ID NO: 501693 - DNA, 25 bp, Rattus norvegicus
ttctgtgactgaccatgagcggatg

SEQ ID NO: 501694 - DNA, 25 bp, Rattus norvegicus
aagagaatgcggctgtgtcttcgcc

SEQ ID NO: 501695 - DNA, 25 bp, Rattus norvegicus
tacgcaggcagacactgaccagtta

SEQ ID NO: 501696 - DNA, 25 bp, Rattus norvegicus
ctggtgctaaagaacggggtaaatg

SEQ ID NO: 501697 - DNA, 25 bp, Rattus norvegicus
cccaagcgtcattgtgcaaggcctc

SEQ ID NO: 501698 - DNA, 25 bp, Rattus norvegicus
tggagcaccgcccaagcgtcattgt

SEQ ID NO: 501699 - DNA, 25 bp, Rattus norvegicus
atggagaggcgtccctgcacagcgc

SEQ ID NO: 501700 - DNA, 25 bp, Rattus norvegicus
cgtctcactcaaggcggtacactca

SEQ ID NO: 501701 - DNA, 25 bp, Rattus norvegicus
actcaaggcggtgccgcgctcagca

SEQ ID NO: 501702 - DNA, 25 bp, Rattus norvegicus
gagacgtagtcctatggcttcctgg

SEQ ID NO: 501703 - DNA, 25 bp, Rattus norvegicus
cgagggtagagactcgtgacctact

SEQ ID NO: 501704 - DNA, 25 bp, Rattus norvegicus
cgtgacctacttttcgagcacacta

SEQ ID NO: 501705 - DNA, 25 bp, Rattus norvegicus
ttcgagcacactacacttccctgtg

SEQ ID NO: 501706 - DNA, 25 bp, Rattus norvegicus
tccctgtgcactatgcgagggccca

SEQ ID NO: 501707 - DNA, 25 bp, Rattus norvegicus
gggcccagcctgatagaccgcgcat

SEQ ID NO: 501708 - DNA, 25 bp, Rattus norvegicus
ccacactaggttctggccaagggtc

SEQ ID NO: 501709 - DNA, 25 bp, Rattus norvegicus
ttctggccaagggtccgaagcccag

SEQ ID NO: 501710 - DNA, 25 bp, Rattus norvegicus
cgaagcccaggaaaagtttccgatg

SEQ ID NO: 501711 - DNA, 25 bp, Rattus norvegicus
gtttccgatgcacatgcgcgctgcg

SEQ ID NO: 501712 - DNA, 25 bp, Rattus norvegicus
ggccctaggctcgtctcactcaagg

SEQ ID NO: 501713 - DNA, 25 bp, Rattus norvegicus
cagcactctgggagacgtagtccta

SEQ ID NO: 501714 - DNA, 25 bp, Rattus norvegicus
gtggccacgctcacggtgttgagca

SEQ ID NO: 501715 - DNA, 25 bp, Rattus norvegicus
tgccgcgaaccatggcgacgcgatg

SEQ ID NO: 501716 - DNA, 25 bp, Rattus norvegicus
ccagtgcgcagaaggatgccgcgaa

SEQ ID NO: 501717 - DNA, 25 bp, Rattus norvegicus
acactcagcgccagcaggttggacc

SEQ ID NO: 501718 - DNA, 25 bp, Rattus norvegicus
acgaggccgcacagcaaagcgagga

SEQ ID NO: 501719 - DNA, 25 bp, Rattus norvegicus
aacaaggcggcgtgttgcgacgcca

SEQ ID NO: 501720 - DNA, 25 bp, Rattus norvegicus
ggatcagtggcacgccagtccaaca

SEQ ID NO: 501721 - DNA, 25 bp, Rattus norvegicus
ggcaaaggcggcaacctggatcagt

SEQ ID NO: 501722 - DNA, 25 bp, Rattus norvegicus
atggccgcgcccatgaagtggcaaa

SEQ ID NO: 501723 - DNA, 25 bp, Rattus norvegicus
gggacacagcccgaagaacaccatg

SEQ ID NO: 501724 - DNA, 25 bp, Rattus norvegicus
cgtgtgatgcccacgaagcgctctg

SEQ ID NO: 501725 - DNA, 25 bp, Rattus norvegicus
tactgcacactgtagcggccgagcc

SEQ ID NO: 501726 - DNA, 25 bp, Rattus norvegicus
cgtcgctcctgcagcgtgatgttca

SEQ ID NO: 501727 - DNA, 25 bp, Rattus norvegicus
ctgcccaggagagcaaacatgagcc

SEQ ID NO: 501728 - DNA, 25 bp, Rattus norvegicus
tccgctgtttttggaggtcgagctc

SEQ ID NO: 501729 - DNA, 25 bp, Rattus norvegicus
gcggcgagtgtaatagcgatctttc

SEQ ID NO: 501730 - DNA, 25 bp, Rattus norvegicus
gattccagattctgcggcgagtgta

SEQ ID NO: 501731 - DNA, 25 bp, Rattus norvegicus
cgtcccagtcgcaggttgggattcc

SEQ ID NO: 501732 - DNA, 25 bp, Rattus norvegicus
ggactacttttcctcctgtggcacc

SEQ ID NO: 501733 - DNA, 25 bp, Rattus norvegicus
caaccctgcgcatggatctgctttc

SEQ ID NO: 501734 - DNA, 25 bp, Rattus norvegicus
ccctggcccgaagtgagcaaagtca

SEQ ID NO: 501735 - DNA, 25 bp, Rattus norvegicus
gctcatgtgattctttccgctgttt

SEQ ID NO: 501736 - DNA, 25 bp, Rattus norvegicus
gacgaggaccgagctcatgtgattc

SEQ ID NO: 501737 - DNA, 25 bp, Rattus norvegicus
cacggtgtccttttacgtcgttgag

SEQ ID NO: 501738 - DNA, 25 bp, Rattus norvegicus
gcactcactcgggtctccgcgaagg

SEQ ID NO: 501739 - DNA, 25 bp, Rattus norvegicus
gggccgcactcgaaactaggtactc

SEQ ID NO: 501740 - DNA, 25 bp, Rattus norvegicus
agcgatctttccacgttgtcttctc

SEQ ID NO: 501741 - DNA, 25 bp, Rattus norvegicus
tgaaaagtttcaccctcagcaaccc

SEQ ID NO: 501742 - DNA, 25 bp, Rattus norvegicus
ttacagcctactggtcacccggctg

SEQ ID NO: 501743 - DNA, 25 bp, Rattus norvegicus
ctttaagagcgccagctgtcacgtc

SEQ ID NO: 501744 - DNA, 25 bp, Rattus norvegicus
agctgtcacgtcactttcacgcgac

SEQ ID NO: 501745 - DNA, 25 bp, Rattus norvegicus
tcactttcacgcgacctcatctttg

SEQ ID NO: 501746 - DNA, 25 bp, Rattus norvegicus
gcgacctcatctttgtcagtgcaca

SEQ ID NO: 501747 - DNA, 25 bp, Rattus norvegicus
atggcgccttacagcctactggtca

SEQ ID NO: 501748 - DNA, 25 bp, Rattus norvegicus
ttcccaatgctttaagagcgccagc

SEQ ID NO: 501749 - DNA, 25 bp, Rattus norvegicus
tcacctgtcgcggttgcaggcccag

SEQ ID NO: 501750 - DNA, 25 bp, Rattus norvegicus
tcacccggctgcaggtgagcgagct

SEQ ID NO: 501751 - DNA, 25 bp, Rattus norvegicus
agcgagctcagagttgtgggtttac

SEQ ID NO: 501752 - DNA, 25 bp, Rattus norvegicus
tcctgccttgcctgcggctgtaggc

SEQ ID NO: 501753 - DNA, 25 bp, Rattus norvegicus
cgaccggggctgagttttcgatcac

SEQ ID NO: 501754 - DNA, 25 bp, Rattus norvegicus
ttttcgatcacctgtcgcggttgca

SEQ ID NO: 501755 - DNA, 25 bp, Rattus norvegicus
tgtcagtgcacaaaatggcgcctta

SEQ ID NO: 501756 - DNA, 25 bp, Rattus norvegicus
tcagcaatggagtcgttgagtttcc

SEQ ID NO: 501757 - DNA, 25 bp, Rattus norvegicus
gccactgagcgagtctggttgctag

SEQ ID NO: 501758 - DNA, 25 bp, Rattus norvegicus
ggccaatttcttgttcagctcctca

SEQ ID NO: 501759 - DNA, 25 bp, Rattus norvegicus
agtttccgctcaaactgccacgggg

SEQ ID NO: 501760 - DNA, 25 bp, Rattus norvegicus
gtatgcgcacggtgtccaccatctc

SEQ ID NO: 501761 - DNA, 25 bp, Rattus norvegicus
gaacatcctgcgctagggctctgga

SEQ ID NO: 501762 - DNA, 25 bp, Rattus norvegicus
ctccaggcttggagaagagccgacc

SEQ ID NO: 501763 - DNA, 25 bp, Rattus norvegicus
aacgcagcgctagccaaaccaaatg

SEQ ID NO: 501764 - DNA, 25 bp, Rattus norvegicus
aatgaactcagcttccggagaactg

SEQ ID NO: 501765 - DNA, 25 bp, Rattus norvegicus
tccggagaactgaccaataagaagc

SEQ ID NO: 501766 - DNA, 25 bp, Rattus norvegicus
gcactctcccgctactgagaggaga

SEQ ID NO: 501767 - DNA, 25 bp, Rattus norvegicus
ggggcctcgttctgaagccagccaa

SEQ ID NO: 501768 - DNA, 25 bp, Rattus norvegicus
ctcggattctaacaagccaagcctg

SEQ ID NO: 501769 - DNA, 25 bp, Rattus norvegicus
cgagggcctagtaccttgttggcca

SEQ ID NO: 501770 - DNA, 25 bp, Rattus norvegicus
caggagccggtaccactgcattcta

SEQ ID NO: 501771 - DNA, 25 bp, Rattus norvegicus
agagccctggtacccgaccgatata

SEQ ID NO: 501772 - DNA, 25 bp, Rattus norvegicus
ctgagccaccgaaagtaaactactg

SEQ ID NO: 501773 - DNA, 25 bp, Rattus norvegicus
gagcagtggctatcggccctcccat

SEQ ID NO: 501774 - DNA, 25 bp, Rattus norvegicus
tagctccgcgcacgaagcgctatcg

SEQ ID NO: 501775 - DNA, 25 bp, Rattus norvegicus
gcagaggatgcgctctttcctgcgg

SEQ ID NO: 501776 - DNA, 25 bp, Rattus norvegicus
gggtcccgtccacgtcaaacaggca

SEQ ID NO: 501777 - DNA, 25 bp, Rattus norvegicus
tcacggcccttacctggcgagctgg

SEQ ID NO: 501778 - DNA, 25 bp, Rattus norvegicus
gacggcttcacgctgggtcacctat

SEQ ID NO: 501779 - DNA, 25 bp, Rattus norvegicus
tgcattctacgtttccgaccgggtc

SEQ ID NO: 501780 - DNA, 25 bp, Rattus norvegicus
tgggtcctatctcctccgtgacagg

SEQ ID NO: 501781 - DNA, 25 bp, Rattus norvegicus
ctcggcaggaacgtggatgccaacc

SEQ ID NO: 501782 - DNA, 25 bp, Rattus norvegicus
ccacatacgttcctccgggaggctg

SEQ ID NO: 501783 - DNA, 25 bp, Rattus norvegicus
ctacgatgacatggcggtgacggct

SEQ ID NO: 501784 - DNA, 25 bp, Rattus norvegicus
gcctggcggttaagtttgtgcgctc

SEQ ID NO: 501785 - DNA, 25 bp, Rattus norvegicus
cggttaagtttgtgcgctcgcagtc

SEQ ID NO: 501786 - DNA, 25 bp, Rattus norvegicus
tgcgctcgcagtcttttcgcgattc

SEQ ID NO: 501787 - DNA, 25 bp, Rattus norvegicus
gtcttttcgcgattcgagggctgca

SEQ ID NO: 501788 - DNA, 25 bp, Rattus norvegicus
tttcgcgattcgagggctgcaggct

SEQ ID NO: 501789 - DNA, 25 bp, Rattus norvegicus
tcgctggaaatccagctcctccagg

SEQ ID NO: 501790 - DNA, 25 bp, Rattus norvegicus
tcctccagggctgttatcgcccggt

SEQ ID NO: 501791 - DNA, 25 bp, Rattus norvegicus
cagggctgttatcgcccggtccgct

SEQ ID NO: 501792 - DNA, 25 bp, Rattus norvegicus
tccgctgcggccagtaagaagcggc

SEQ ID NO: 501793 - DNA, 25 bp, Rattus norvegicus
ggaagaaccgaccatacagtggatg

SEQ ID NO: 501794 - DNA, 25 bp, Rattus norvegicus
atacagtggatggaggacccagagc

SEQ ID NO: 501795 - DNA, 25 bp, Rattus norvegicus
cccagagcccgaggatgaaaacgtg

SEQ ID NO: 501796 - DNA, 25 bp, Rattus norvegicus
tgtacttgaagaacccaaacttcca

SEQ ID NO: 501797 - DNA, 25 bp, Rattus norvegicus
cccgaggatgaaaacgtgtacttga

SEQ ID NO: 501798 - DNA, 25 bp, Rattus norvegicus
agagatcccagagaatccgcacgga

SEQ ID NO: 501799 - DNA, 25 bp, Rattus norvegicus
ggcccttggacaggtcgtacacgta

SEQ ID NO: 501800 - DNA, 25 bp, Rattus norvegicus
cgtacacgtagagcttcaccggata

SEQ ID NO: 501801 - DNA, 25 bp, Rattus norvegicus
cgcgaccggcaacgactactgtgag

SEQ ID NO: 501802 - DNA, 25 bp, Rattus norvegicus
cggggacgcactttcacgcatgtgc

SEQ ID NO: 501803 - DNA, 25 bp, Rattus norvegicus
ggcctcatgcgttccagattaggga

SEQ ID NO: 501804 - DNA, 25 bp, Rattus norvegicus
cctgacggatcgaaaggcgtgttgt

SEQ ID NO: 501805 - DNA, 25 bp, Rattus norvegicus
tggccttgcttgcacgctcattgtc

SEQ ID NO: 501806 - DNA, 25 bp, Rattus norvegicus
tcgctgattggacgagagacctgga

SEQ ID NO: 501807 - DNA, 25 bp, Rattus norvegicus
cgcctccggctaaggtaggtccgct

SEQ ID NO: 501808 - DNA, 25 bp, Rattus norvegicus
taggtccgctgcactgtatgtgttg

SEQ ID NO: 501809 - DNA, 25 bp, Rattus norvegicus
actgtatgtgttggttgtggcctgc

SEQ ID NO: 501810 - DNA, 25 bp, Rattus norvegicus
cgtgctgacgtaaacatcgctgatt

SEQ ID NO: 501811 - DNA, 25 bp, Rattus norvegicus
accggatagagattcggcggctcca

SEQ ID NO: 501812 - DNA, 25 bp, Rattus norvegicus
tacgcctcccacaagacggagcgaa

SEQ ID NO: 501813 - DNA, 25 bp, Rattus norvegicus
cgggcgacatgtcgcacacgctacg

SEQ ID NO: 501814 - DNA, 25 bp, Rattus norvegicus
gctaccagggttctcgactctgccg

SEQ ID NO: 501815 - DNA, 25 bp, Rattus norvegicus
ttcaaagcggaccaggcctcaccga

SEQ ID NO: 501816 - DNA, 25 bp, Rattus norvegicus
ctccttcccagagggcgcaagcgtt

SEQ ID NO: 501817 - DNA, 25 bp, Rattus norvegicus
gcccactgcttcaaagcggaccagg

SEQ ID NO: 501818 - DNA, 25 bp, Rattus norvegicus
acggagcgaacagggctcgcatccc

SEQ ID NO: 501819 - DNA, 25 bp, Rattus norvegicus
gacagacagaaacgtcgcgcagaaa

SEQ ID NO: 501820 - DNA, 25 bp, Rattus norvegicus
gcagcggaaaccactccaggagtgg

SEQ ID NO: 501821 - DNA, 25 bp, Rattus norvegicus
gcactcactcaccatggctgcggtg

SEQ ID NO: 501822 - DNA, 25 bp, Rattus norvegicus
agcccacctcagacagacagaaacg

SEQ ID NO: 501823 - DNA, 25 bp, Rattus norvegicus
aggcctcaccgagacttcacaacag

SEQ ID NO: 501824 - DNA, 25 bp, Rattus norvegicus
tcgcgcagaaaaagcagcggaaacc

SEQ ID NO: 501825 - DNA, 25 bp, Rattus norvegicus
ctcaccatggctgcggtgcgcaggc

SEQ ID NO: 501826 - DNA, 25 bp, Rattus norvegicus
ggcagatgaaggctgctgaccattc

SEQ ID NO: 501827 - DNA, 25 bp, Rattus norvegicus
gcctggcctgcgcattggagctgct

SEQ ID NO: 501828 - DNA, 25 bp, Rattus norvegicus
gctgctgaccattctgcgttcggga

SEQ ID NO: 501829 - DNA, 25 bp, Rattus norvegicus
ccattctgcgttcgggagagatgaa

SEQ ID NO: 501830 - DNA, 25 bp, Rattus norvegicus
tcctggagaggactcatcaccggca

SEQ ID NO: 501831 - DNA, 25 bp, Rattus norvegicus
gagaggactcatcaccggcacgatc

SEQ ID NO: 501832 - DNA, 25 bp, Rattus norvegicus
atcaccggcacgatccgcgctggtt

SEQ ID NO: 501833 - DNA, 25 bp, Rattus norvegicus
ggaaaacttgcgctacagagctgaa

SEQ ID NO: 501834 - DNA, 25 bp, Rattus norvegicus
atccgcgctggttgctgccggtgtc

SEQ ID NO: 501835 - DNA, 25 bp, Rattus norvegicus
gcgtgtcggtgcgacctaaaccctc

SEQ ID NO: 501836 - DNA, 25 bp, Rattus norvegicus
ttgcgctacagagctgaagcgagga

SEQ ID NO: 501837 - DNA, 25 bp, Rattus norvegicus
aagcggcgcgggaaaacttgcgcta

SEQ ID NO: 501838 - DNA, 25 bp, Rattus norvegicus
agcgtcgaggctccacgtgtgctcc

SEQ ID NO: 501839 - DNA, 25 bp, Rattus norvegicus
gctggctgcagcgtcgaggctccac

SEQ ID NO: 501840 - DNA, 25 bp, Rattus norvegicus
ccgtgccagagccagacctgaagtc

SEQ ID NO: 501841 - DNA, 25 bp, Rattus norvegicus
cgtgtcgggtctctacgttaccaga

SEQ ID NO: 501842 - DNA, 25 bp, Rattus norvegicus
cagtcgaagaaacgtgtcgggtctc

SEQ ID NO: 501843 - DNA, 25 bp, Rattus norvegicus
aggcaggatcccacaggacagtcga

SEQ ID NO: 501844 - DNA, 25 bp, Rattus norvegicus
aagcgctccaaaacagctgcccgga

SEQ ID NO: 501845 - DNA, 25 bp, Rattus norvegicus
cgaactcactcccttctttgaagcg

SEQ ID NO: 501846 - DNA, 25 bp, Rattus norvegicus
ctcacgcatggaacaggctggccac

SEQ ID NO: 501847 - DNA, 25 bp, Rattus norvegicus
gcaggttaagtaaaactcacgcatg

SEQ ID NO: 501848 - DNA, 25 bp, Rattus norvegicus
gacagagagatgacaaagcaggtta

SEQ ID NO: 501849 - DNA, 25 bp, Rattus norvegicus
ccgaagcacgccagggacagagaga

SEQ ID NO: 501850 - DNA, 25 bp, Rattus norvegicus
cgaccgaaaggaccgaagcacgcca

SEQ ID NO: 501851 - DNA, 25 bp, Rattus norvegicus
cggaaacagacttgcggccagcaga

SEQ ID NO: 501852 - DNA, 25 bp, Rattus norvegicus
acggcgatgacgtcagctctgcgtc

SEQ ID NO: 501853 - DNA, 25 bp, Rattus norvegicus
gcttccatcgcccaggagctgagga

SEQ ID NO: 501854 - DNA, 25 bp, Rattus norvegicus
cactacgttcaaagggccgggcagc

SEQ ID NO: 501855 - DNA, 25 bp, Rattus norvegicus
cttggatcttgcgaactggtgttta

SEQ ID NO: 501856 - DNA, 25 bp, Rattus norvegicus
acggattctgctagttccttggatc

SEQ ID NO: 501857 - DNA, 25 bp, Rattus norvegicus
ggggtttgctgacgcgctttaagca

SEQ ID NO: 501858 - DNA, 25 bp, Rattus norvegicus
taccagaaccgagatcaccagcgtg

SEQ ID NO: 501859 - DNA, 25 bp, Rattus norvegicus
caggaccatgcggttgccaacagct

SEQ ID NO: 501860 - DNA, 25 bp, Rattus norvegicus
cgacttgtcggtctcctagcactga

SEQ ID NO: 501861 - DNA, 25 bp, Rattus norvegicus
ttcttacaccgctagcctgggtagg

SEQ ID NO: 501862 - DNA, 25 bp, Rattus norvegicus
gccggacggtactgtaggcttcatg

SEQ ID NO: 501863 - DNA, 25 bp, Rattus norvegicus
tcgggactcggacacctcctagaag

SEQ ID NO: 501864 - DNA, 25 bp, Rattus norvegicus
tcctagaagggctcgctagctcctc

SEQ ID NO: 501865 - DNA, 25 bp, Rattus norvegicus
ggccactaccactggctctacaaga

SEQ ID NO: 501866 - DNA, 25 bp, Rattus norvegicus
cgcttgccgagcctgaaagagttct

SEQ ID NO: 501867 - DNA, 25 bp, Rattus norvegicus
ctccagtgttccgtgccttgccgga

SEQ ID NO: 501868 - DNA, 25 bp, Rattus norvegicus
cgatgagctgactctcggggacatc

SEQ ID NO: 501869 - DNA, 25 bp, Rattus norvegicus
ctactctccgctggcgcttggaagc

SEQ ID NO: 501870 - DNA, 25 bp, Rattus norvegicus
gcggagtctcgctatgcaaatctga

SEQ ID NO: 501871 - DNA, 25 bp, Rattus norvegicus
gctgctgatcgatgacgcgccatca

SEQ ID NO: 501872 - DNA, 25 bp, Rattus norvegicus
gctccgattggctaatgcaggcctg

SEQ ID NO: 501873 - DNA, 25 bp, Rattus norvegicus
tgcaggcctggtcccattgacaaca

SEQ ID NO: 501874 - DNA, 25 bp, Rattus norvegicus
gtctccctgagctggacctcacggg

SEQ ID NO: 501875 - DNA, 25 bp, Rattus norvegicus
tctggagaccatggagaccctcacg

SEQ ID NO: 501876 - DNA, 25 bp, Rattus norvegicus
ggttcccagttcttcttgctccaga

SEQ ID NO: 501877 - DNA, 25 bp, Rattus norvegicus
gcgtcgcgaatactgccagagaaga

SEQ ID NO: 501878 - DNA, 25 bp, Rattus norvegicus
cacgctctctggtttgtccggtctt

SEQ ID NO: 501879 - DNA, 25 bp, Rattus norvegicus
agcggcttcgggatttcccggactg

SEQ ID NO: 501880 - DNA, 25 bp, Rattus norvegicus
ctcttttcgggattgactgacagcc

SEQ ID NO: 501881 - DNA, 25 bp, Rattus norvegicus
actctgcgccgaactgggcgatgga

SEQ ID NO: 501882 - DNA, 25 bp, Rattus norvegicus
aagtactctggtgtggcacgtttgc

SEQ ID NO: 501883 - DNA, 25 bp, Rattus norvegicus
gtagccctgcacgatcttgggtgga

SEQ ID NO: 501884 - DNA, 25 bp, Rattus norvegicus
gatgttaaatttgtagccctgcacg

SEQ ID NO: 501885 - DNA, 25 bp, Rattus norvegicus
gccgatacttgtcggcccacaggta

SEQ ID NO: 501886 - DNA, 25 bp, Rattus norvegicus
cggttaaagaatcgcggcttccgcg

SEQ ID NO: 501887 - DNA, 25 bp, Rattus norvegicus
cctgtgtgcacacggttaaagaatc

SEQ ID NO: 501888 - DNA, 25 bp, Rattus norvegicus
agggttgtcaaagtcataatgtgtc

SEQ ID NO: 501889 - DNA, 25 bp, Rattus norvegicus
tagcggtagcgcttgaagtggaacc

SEQ ID NO: 501890 - DNA, 25 bp, Rattus norvegicus
tgaggtccgggtagaagatgttaaa

SEQ ID NO: 501891 - DNA, 25 bp, Rattus norvegicus
ggcaaagtcccggttgtcagcgcag

SEQ ID NO: 501892 - DNA, 25 bp, Rattus norvegicus
cgtggaaacgcaggatggcaaagtc

SEQ ID NO: 501893 - DNA, 25 bp, Rattus norvegicus
gagtactcccattctcgactgacga

SEQ ID NO: 501894 - DNA, 25 bp, Rattus norvegicus
tccattggcaaactggcagcggaag

SEQ ID NO: 501895 - DNA, 25 bp, Rattus norvegicus
ttgttccattcaaagcctgtgtgca

SEQ ID NO: 501896 - DNA, 25 bp, Rattus norvegicus
ttccttccacagacgacgctcacct

SEQ ID NO: 501897 - DNA, 25 bp, Rattus norvegicus
agacgacgctcaccttccttcacag

SEQ ID NO: 501898 - DNA, 25 bp, Rattus norvegicus
ttccttcacagacgacgctcacctt

SEQ ID NO: 501899 - DNA, 25 bp, Rattus norvegicus
tccttcacagacgacgctcaccttc

SEQ ID NO: 501900 - DNA, 25 bp, Rattus norvegicus
ttccttccacagacgacgctcatcc

SEQ ID NO: 501901 - DNA, 25 bp, Rattus norvegicus
tccttccacagatgacgctcacctt

SEQ ID NO: 501902 - DNA, 25 bp, Rattus norvegicus
ttccttcccacagacgacgctcacc

SEQ ID NO: 501903 - DNA, 25 bp, Rattus norvegicus
accttccttccacagatgacgctca

SEQ ID NO: 501904 - DNA, 25 bp, Rattus norvegicus
cacagacgacgctcaccttccttca

SEQ ID NO: 501905 - DNA, 25 bp, Rattus norvegicus
cagacgacgctcaccttccttcaca

SEQ ID NO: 501906 - DNA, 25 bp, Rattus norvegicus
tccttcacagacgacgctcatcctt

SEQ ID NO: 501907 - DNA, 25 bp, Rattus norvegicus
ccttccttcacagacgacgctcatc

SEQ ID NO: 501908 - DNA, 25 bp, Rattus norvegicus
cttccacagacgacgctcatccttc

SEQ ID NO: 501909 - DNA, 25 bp, Rattus norvegicus
tcacagacgacgctcaccttccttc

SEQ ID NO: 501910 - DNA, 25 bp, Rattus norvegicus
gcccgcgctgctgtaaaagctcgtg

SEQ ID NO: 501911 - DNA, 25 bp, Rattus norvegicus
ctcggtagagggaaaacgttgatag

SEQ ID NO: 501912 - DNA, 25 bp, Rattus norvegicus
acccgcgcagggagagtccgcgggc

SEQ ID NO: 501913 - DNA, 25 bp, Rattus norvegicus
agcgcaggcaagtcctctggaggcc

SEQ ID NO: 501914 - DNA, 25 bp, Rattus norvegicus
ctctgcccgcgctgctgtaaaagct

SEQ ID NO: 501915 - DNA, 25 bp, Rattus norvegicus
gtcgagcagcgcaggcaagtcctct

SEQ ID NO: 501916 - DNA, 25 bp, Rattus norvegicus
tccaggccgcataagggacggacga

SEQ ID NO: 501917 - DNA, 25 bp, Rattus norvegicus
acctgagccaccaagtggctacggg

SEQ ID NO: 501918 - DNA, 25 bp, Rattus norvegicus
acgctgaactgacgccgcggcgcgt

SEQ ID NO: 501919 - DNA, 25 bp, Rattus norvegicus
tcgggcagcttctccacgctgaact

SEQ ID NO: 501920 - DNA, 25 bp, Rattus norvegicus
cgctgaaggcctcgggcagcttctc

SEQ ID NO: 501921 - DNA, 25 bp, Rattus norvegicus
tgtaaaagctcgtgggctgcgcgct

SEQ ID NO: 501922 - DNA, 25 bp, Rattus norvegicus
gctgctgtaaaagctcgtgggctgc

SEQ ID NO: 501923 - DNA, 25 bp, Rattus norvegicus
aacgttgatagaagtcctggggcgc

SEQ ID NO: 501924 - DNA, 25 bp, Rattus norvegicus
ccagtctgcacccaggccggtgtgt

SEQ ID NO: 501925 - DNA, 25 bp, Rattus norvegicus
cacaagtgagctccgtgtggagttc

SEQ ID NO: 501926 - DNA, 25 bp, Rattus norvegicus
tccgcagttccagacacaagtgagc

SEQ ID NO: 501927 - DNA, 25 bp, Rattus norvegicus
gacgcctcctggtgcgtccgcagtt

SEQ ID NO: 501928 - DNA, 25 bp, Rattus norvegicus
atcacgtcgtaatagccgcggcagc

SEQ ID NO: 501929 - DNA, 25 bp, Rattus norvegicus
ccactggcccatcacgtcgtaatag

SEQ ID NO: 501930 - DNA, 25 bp, Rattus norvegicus
ctgtagacaccggagctgcagttga

SEQ ID NO: 501931 - DNA, 25 bp, Rattus norvegicus
ccgatgccgaccagcacgagcagtg

SEQ ID NO: 501932 - DNA, 25 bp, Rattus norvegicus
cgtcgtggcaacagaagcggtagcc

SEQ ID NO: 501933 - DNA, 25 bp, Rattus norvegicus
cgcacaccgcgtagaccgcagtgtg

SEQ ID NO: 501934 - DNA, 25 bp, Rattus norvegicus
aggcaggtgctcgtctgcacagtcc

SEQ ID NO: 501935 - DNA, 25 bp, Rattus norvegicus
tcctgggtctttcggggactgagcc

SEQ ID NO: 501936 - DNA, 25 bp, Rattus norvegicus
gtagccgcacgtgccgcagcagaag

SEQ ID NO: 501937 - DNA, 25 bp, Rattus norvegicus
gctcacctcggactgtgcaccgtga

SEQ ID NO: 501938 - DNA, 25 bp, Rattus norvegicus
tcgcaccagagggtcgaagcactca

SEQ ID NO: 501939 - DNA, 25 bp, Rattus norvegicus
aatgaaaccgcgacgcagcatcctc

SEQ ID NO: 501940 - DNA, 25 bp, Rattus norvegicus
ctggtctagaatgaaaccgcgacgc

SEQ ID NO: 501941 - DNA, 25 bp, Rattus norvegicus
tctgggtctctctggtctagaatga

SEQ ID NO: 501942 - DNA, 25 bp, Rattus norvegicus
acagtctgggctctgggtctctctg

SEQ ID NO: 501943 - DNA, 25 bp, Rattus norvegicus
catgcagctgggacagtctgggctc

SEQ ID NO: 501944 - DNA, 25 bp, Rattus norvegicus
atgtcgccgccgcatgcagctggga

SEQ ID NO: 501945 - DNA, 25 bp, Rattus norvegicus
ggagcctcctgacgcccatgtcgcc

SEQ ID NO: 501946 - DNA, 25 bp, Rattus norvegicus
cactgggtggacaccgggctgtccc

SEQ ID NO: 501947 - DNA, 25 bp, Rattus norvegicus
agtctgattgcactgggtggacacc

SEQ ID NO: 501948 - DNA, 25 bp, Rattus norvegicus
agggtcgaagcactcagtctgattg

SEQ ID NO: 501949 - DNA, 25 bp, Rattus norvegicus
aggacacgcagtttcgcaccagagg

SEQ ID NO: 501950 - DNA, 25 bp, Rattus norvegicus
agagctcacaggacacgcagtttcg

SEQ ID NO: 501951 - DNA, 25 bp, Rattus norvegicus
ggcgtgtagaagagctcacaggaca

SEQ ID NO: 501952 - DNA, 25 bp, Rattus norvegicus
cgcctattggtggaggcgtccctca

SEQ ID NO: 501953 - DNA, 25 bp, Rattus norvegicus
gtggtaaaatcagccgcgcgcctat

SEQ ID NO: 501954 - DNA, 25 bp, Rattus norvegicus
gaacgcccactcagcccggtggtaa

SEQ ID NO: 501955 - DNA, 25 bp, Rattus norvegicus
tccgtctcgaaacgcgggaaagcca

SEQ ID NO: 501956 - DNA, 25 bp, Rattus norvegicus
cggatctttcaaaccgccgcaagtc

SEQ ID NO: 501957 - DNA, 25 bp, Rattus norvegicus
caccggtctaggctgagggaagcca

SEQ ID NO: 501958 - DNA, 25 bp, Rattus norvegicus
cgctgctcccattggtccagaacaa

SEQ ID NO: 501959 - DNA, 25 bp, Rattus norvegicus
cagagtgcgccatttcacgagaaga

SEQ ID NO: 501960 - DNA, 25 bp, Rattus norvegicus
ctaaggagccaacctcggaaggatc

SEQ ID NO: 501961 - DNA, 25 bp, Rattus norvegicus
tcgcacagtcgattttgagcaccga

SEQ ID NO: 501962 - DNA, 25 bp, Rattus norvegicus
tcccttctggaggtacaaactcagc

SEQ ID NO: 501963 - DNA, 25 bp, Rattus norvegicus
gcctctcgcacctaccaagatggta

SEQ ID NO: 501964 - DNA, 25 bp, Rattus norvegicus
gcactgacatcttagcggcagccga

SEQ ID NO: 501965 - DNA, 25 bp, Rattus norvegicus
ggcagcttgtccatcggcctcagca

SEQ ID NO: 501966 - DNA, 25 bp, Rattus norvegicus
aatatcccaatcaccgcgtgactca

SEQ ID NO: 501967 - DNA, 25 bp, Rattus norvegicus
agctccggcacccactcccgcgtgc

SEQ ID NO: 501968 - DNA, 25 bp, Rattus norvegicus
acgggcaccttactcggccgggcat

SEQ ID NO: 501969 - DNA, 25 bp, Rattus norvegicus
gcagaaccgcggtgagccagcgcaa

SEQ ID NO: 501970 - DNA, 25 bp, Rattus norvegicus
gtgactcacgcacgcgcaccgtcgc

SEQ ID NO: 501971 - DNA, 25 bp, Rattus norvegicus
gcgcaatatcccaatcaccgcgtga

SEQ ID NO: 501972 - DNA, 25 bp, Rattus norvegicus
cagagactgcgatacgggcacctta

SEQ ID NO: 501973 - DNA, 25 bp, Rattus norvegicus
cgatacgggcaccttactcggccgg

SEQ ID NO: 501974 - DNA, 25 bp, Rattus norvegicus
ctgcgatacgggcaccttactcggc

SEQ ID NO: 501975 - DNA, 25 bp, Rattus norvegicus
caccgtcgccggcagctgccaccgg

SEQ ID NO: 501976 - DNA, 25 bp, Rattus norvegicus
agctgccaccggtgtcctgctccct

SEQ ID NO: 501977 - DNA, 25 bp, Rattus norvegicus
acaggatctagggaggcagacagag

SEQ ID NO: 501978 - DNA, 25 bp, Rattus norvegicus
cagacagagactgcgatacgggcac

SEQ ID NO: 501979 - DNA, 25 bp, Rattus norvegicus
ggtgagccagcgcaatatcccaatc

SEQ ID NO: 501980 - DNA, 25 bp, Rattus norvegicus
tgtgggttccgattctcggttctta

SEQ ID NO: 501981 - DNA, 25 bp, Rattus norvegicus
cgcgccgctatgctacttgtctggt

SEQ ID NO: 501982 - DNA, 25 bp, Rattus norvegicus
cgcgctcccgtggaaagtcggcttg

SEQ ID NO: 501983 - DNA, 25 bp, Rattus norvegicus
tccgcccttctaagctcgtgttctg

SEQ ID NO: 501984 - DNA, 25 bp, Rattus norvegicus
atcagaatcccttagcaacgccgtg

SEQ ID NO: 501985 - DNA, 25 bp, Rattus norvegicus
cggacaaccctttctgagcaaccaa

SEQ ID NO: 501986 - DNA, 25 bp, Rattus norvegicus
ggaagcggaatgtcaccggacaacc

SEQ ID NO: 501987 - DNA, 25 bp, Rattus norvegicus
cgtacctatagtgaccggggaagcg

SEQ ID NO: 501988 - DNA, 25 bp, Rattus norvegicus
cgcggccgcacgtacctatagtgac

SEQ ID NO: 501989 - DNA, 25 bp, Rattus norvegicus
ctgtgcgcttaagccctggaagccc

SEQ ID NO: 501990 - DNA, 25 bp, Rattus norvegicus
tcgctcagtccgctgtgcgcttaag

SEQ ID NO: 501991 - DNA, 25 bp, Rattus norvegicus
gattcttaccctcgtactcgctcag

SEQ ID NO: 501992 - DNA, 25 bp, Rattus norvegicus
ggttcttaaacatcgcaggctcagc

SEQ ID NO: 501993 - DNA, 25 bp, Rattus norvegicus
tatgctacttgtctggttggtgtcc

SEQ ID NO: 501994 - DNA, 25 bp, Rattus norvegicus
tgccggtcggaatccgcagtggtct

SEQ ID NO: 501995 - DNA, 25 bp, Rattus norvegicus
agcttgccgcctcggctcggggtct

SEQ ID NO: 501996 - DNA, 25 bp, Rattus norvegicus
ccgccagaaggactcaggtgggctc

SEQ ID NO: 501997 - DNA, 25 bp, Rattus norvegicus
attgctcctgttcccggtgcagggc

SEQ ID NO: 501998 - DNA, 25 bp, Rattus norvegicus
atgctgttattgctcctgttcccgg

SEQ ID NO: 501999 - DNA, 25 bp, Rattus norvegicus
aggccatggatgctgttattgctcc

SEQ ID NO: 502000 - DNA, 25 bp, Rattus norvegicus
ctgtcgggctgtaggcttaggccat

SEQ ID NO: 502001 - DNA, 25 bp, Rattus norvegicus
gagggctcggcagccatctttgtgt

SEQ ID NO: 502002 - DNA, 25 bp, Rattus norvegicus
cttccgccggcgtgccggtcggaat

SEQ ID NO: 502003 - DNA, 25 bp, Rattus norvegicus
tccgccgccatccttctgccgggcg

SEQ ID NO: 502004 - DNA, 25 bp, Rattus norvegicus
ggcagttcccacgtgccgaggcgtc

SEQ ID NO: 502005 - DNA, 25 bp, Rattus norvegicus
ttgtgtagggcagttcccacgtgcc

SEQ ID NO: 502006 - DNA, 25 bp, Rattus norvegicus
ccatctttgtgtagggcagttccca

SEQ ID NO: 502007 - DNA, 25 bp, Rattus norvegicus
taggcttaggccatggatgctgtta

SEQ ID NO: 502008 - DNA, 25 bp, Rattus norvegicus
gcccgggccggatcctgggatccag

SEQ ID NO: 502009 - DNA, 25 bp, Rattus norvegicus
gtctccgggctcctgcggccacgtt

SEQ ID NO: 502010 - DNA, 25 bp, Rattus norvegicus
gctcctgcggccacgttcgcgacct

SEQ ID NO: 502011 - DNA, 25 bp, Rattus norvegicus
ccacgttcgcgacctgggcggaggc

SEQ ID NO: 502012 - DNA, 25 bp, Rattus norvegicus
cgcgggcttcggagcgagaaagacc

SEQ ID NO: 502013 - DNA, 25 bp, Rattus norvegicus
cgagaaagaccaggggacgatagca

SEQ ID NO: 502014 - DNA, 25 bp, Rattus norvegicus
aaagaccaggggacgatagcatcgc

SEQ ID NO: 502015 - DNA, 25 bp, Rattus norvegicus
accaggggacgatagcatcgcactc

SEQ ID NO: 502016 - DNA, 25 bp, Rattus norvegicus
ggggacgatagcatcgcactcgacc

SEQ ID NO: 502017 - DNA, 25 bp, Rattus norvegicus
atagcatcgcactcgaccggccagg

SEQ ID NO: 502018 - DNA, 25 bp, Rattus norvegicus
cactcgaccggccaggccctcgggc

SEQ ID NO: 502019 - DNA, 25 bp, Rattus norvegicus
gggctcccggaggaggtgaccagga

SEQ ID NO: 502020 - DNA, 25 bp, Rattus norvegicus
ggatccaggcaccagcagggccgcc

SEQ ID NO: 502021 - DNA, 25 bp, Rattus norvegicus
ggccgtggacctggctggagagccc

SEQ ID NO: 502022 - DNA, 25 bp, Rattus norvegicus
ctggctatcagtccgacctggggct

SEQ ID NO: 502023 - DNA, 25 bp, Rattus norvegicus
caaggactttcccactgctacagga

SEQ ID NO: 502024 - DNA, 25 bp, Rattus norvegicus
cactgctacaggaatgcgtgctcta

SEQ ID NO: 502025 - DNA, 25 bp, Rattus norvegicus
gaatgcgtgctctacgccgacggga

SEQ ID NO: 502026 - DNA, 25 bp, Rattus norvegicus
tctcgcgaattttggagacagtttc

SEQ ID NO: 502027 - DNA, 25 bp, Rattus norvegicus
acagtttcggcgagagggccgcttt

SEQ ID NO: 502028 - DNA, 25 bp, Rattus norvegicus
agtggcgatgtctacaccgtaccgg

SEQ ID NO: 502029 - DNA, 25 bp, Rattus norvegicus
tcaggtctcagccaggtaccgtcga

SEQ ID NO: 502030 - DNA, 25 bp, Rattus norvegicus
ccgtcgaggtcagtcatcgtcactc

SEQ ID NO: 502031 - DNA, 25 bp, Rattus norvegicus
atcgtcactcgcagcggcgccattt

SEQ ID NO: 502032 - DNA, 25 bp, Rattus norvegicus
ccattttgcccaagccggtgaaagt

SEQ ID NO: 502033 - DNA, 25 bp, Rattus norvegicus
ccggtgaaagtgagtgtctgtcttg

SEQ ID NO: 502034 - DNA, 25 bp, Rattus norvegicus
gcttctcatgacgtcactacgtcgg

SEQ ID NO: 502035 - DNA, 25 bp, Rattus norvegicus
accgtaccgggcagctcaggtctca

SEQ ID NO: 502036 - DNA, 25 bp, Rattus norvegicus
gaccgcggcgctgaagaaccaccag

SEQ ID NO: 502037 - DNA, 25 bp, Rattus norvegicus
acaccgattggtggttggctccttc

SEQ ID NO: 502038 - DNA, 25 bp, Rattus norvegicus
tcccgactgaaaatgggcttcaccg

SEQ ID NO: 502039 - DNA, 25 bp, Rattus norvegicus
cttcaccgaggtactggctgcagaa

SEQ ID NO: 502040 - DNA, 25 bp, Rattus norvegicus
ggccgccatcttgctaaggaagccc

SEQ ID NO: 502041 - DNA, 25 bp, Rattus norvegicus
cgtagcgttacaggacgcgacgcca

SEQ ID NO: 502042 - DNA, 25 bp, Rattus norvegicus
tctccgattggacgggctctgccat

SEQ ID NO: 502043 - DNA, 25 bp, Rattus norvegicus
gggctctgccatgcgcatgctctac

SEQ ID NO: 502044 - DNA, 25 bp, Rattus norvegicus
tgctctaccgcggaaacaccgattg

SEQ ID NO: 502045 - DNA, 25 bp, Rattus norvegicus
ggcttgagctttgtgccgtttctca

SEQ ID NO: 502046 - DNA, 25 bp, Rattus norvegicus
gcaaaagcgcctccggcttgagctt

SEQ ID NO: 502047 - DNA, 25 bp, Rattus norvegicus
acttggtgtagatcgcaaaagcgcc

SEQ ID NO: 502048 - DNA, 25 bp, Rattus norvegicus
ttggcctctttcaggtcccgactga

SEQ ID NO: 502049 - DNA, 25 bp, Rattus norvegicus
agcggtcggtttgttgttccagccg

SEQ ID NO: 502050 - DNA, 25 bp, Rattus norvegicus
ctgactcgcggccagggcagctact

SEQ ID NO: 502051 - DNA, 25 bp, Rattus norvegicus
tgaggaccggtcctgtgagtgccat

SEQ ID NO: 502052 - DNA, 25 bp, Rattus norvegicus
tcctagacttctgcacacggtttcc

SEQ ID NO: 502053 - DNA, 25 bp, Rattus norvegicus
cacgcttctcctcgggtgtctcgaa

SEQ ID NO: 502054 - DNA, 25 bp, Rattus norvegicus
tcgggtgtctcgaaggccttgagca

SEQ ID NO: 502055 - DNA, 25 bp, Rattus norvegicus
ttgctgctttcgctcctcacgaagc

SEQ ID NO: 502056 - DNA, 25 bp, Rattus norvegicus
tcgggagccctgtgcttgctcctca

SEQ ID NO: 502057 - DNA, 25 bp, Rattus norvegicus
ttcctgaaggctctgctgctgactc

SEQ ID NO: 502058 - DNA, 25 bp, Rattus norvegicus
ggcagctactccaggactccgggag

SEQ ID NO: 502059 - DNA, 25 bp, Rattus norvegicus
tcttggggagtcagagctagatgct

SEQ ID NO: 502060 - DNA, 25 bp, Rattus norvegicus
cagagctagatgctgatgaccctgg

SEQ ID NO: 502061 - DNA, 25 bp, Rattus norvegicus
atgaccctggggaccacgaatgcct

SEQ ID NO: 502062 - DNA, 25 bp, Rattus norvegicus
acgaatgcctgtgacccttccgggc

SEQ ID NO: 502063 - DNA, 25 bp, Rattus norvegicus
cacccgagtcagagtgtgaggaccg

SEQ ID NO: 502064 - DNA, 25 bp, Rattus norvegicus
ctccggcgcgcttcagggaggactc

SEQ ID NO: 502065 - DNA, 25 bp, Rattus norvegicus
gccgcatccacatggcctcaggtgt

SEQ ID NO: 502066 - DNA, 25 bp, Rattus norvegicus
agccaagaggccagcaacgccggtc

SEQ ID NO: 502067 - DNA, 25 bp, Rattus norvegicus
ctcaggccgcaacgaccaggtatct

SEQ ID NO: 502068 - DNA, 25 bp, Rattus norvegicus
cacacaggaaataacagagcgtcag

SEQ ID NO: 502069 - DNA, 25 bp, Rattus norvegicus
cgccgagctgccaagaacgtagacc

SEQ ID NO: 502070 - DNA, 25 bp, Rattus norvegicus
ttccctcagaccgagcggcggttac

SEQ ID NO: 502071 - DNA, 25 bp, Rattus norvegicus
tctcagcagccaggatgagcggtgc

SEQ ID NO: 502072 - DNA, 25 bp, Rattus norvegicus
cctgtgctctcagcagccaggatga

SEQ ID NO: 502073 - DNA, 25 bp, Rattus norvegicus
ggaagtgcatcctgcgcccctagct

SEQ ID NO: 502074 - DNA, 25 bp, Rattus norvegicus
gggccacgacctgtgctctcagcag

SEQ ID NO: 502075 - DNA, 25 bp, Rattus norvegicus
ccaaggctcagcactcgcagggcgg

SEQ ID NO: 502076 - DNA, 25 bp, Rattus norvegicus
ataacagagcgtcaggtgacggcgc

SEQ ID NO: 502077 - DNA, 25 bp, Rattus norvegicus
cttgacgcccgtcctggcggttgac

SEQ ID NO: 502078 - DNA, 25 bp, Rattus norvegicus
tgctgcgactgcactcggccagcag

SEQ ID NO: 502079 - DNA, 25 bp, Rattus norvegicus
ctcctgggcactgctctgagcatcc

SEQ ID NO: 502080 - DNA, 25 bp, Rattus norvegicus
tccctccatcgctctttatggcagt

SEQ ID NO: 502081 - DNA, 25 bp, Rattus norvegicus
catcgctctttatggcagtttcaaa

SEQ ID NO: 502082 - DNA, 25 bp, Rattus norvegicus
ttatggcagtttcaaagctgcagcc

SEQ ID NO: 502083 - DNA, 25 bp, Rattus norvegicus
agtttcaaagctgcagccgccactc

SEQ ID NO: 502084 - DNA, 25 bp, Rattus norvegicus
cactcgagcagctgcggcctttgat

SEQ ID NO: 502085 - DNA, 25 bp, Rattus norvegicus
cagctgcggcctttgatggggacaa

SEQ ID NO: 502086 - DNA, 25 bp, Rattus norvegicus
acaaggcagtgaaggccgcccagga

SEQ ID NO: 502087 - DNA, 25 bp, Rattus norvegicus
cgcccagcgggcacgcctcacacgc

SEQ ID NO: 502088 - DNA, 25 bp, Rattus norvegicus
tcacacgccagagcaaactttcgcg

SEQ ID NO: 502089 - DNA, 25 bp, Rattus norvegicus
gccagagcaaactttcgcgaccgtg

SEQ ID NO: 502090 - DNA, 25 bp, Rattus norvegicus
agagcaaactttcgcgaccgtggga

SEQ ID NO: 502091 - DNA, 25 bp, Rattus norvegicus
caaactttcgcgaccgtgggagagg

SEQ ID NO: 502092 - DNA, 25 bp, Rattus norvegicus
cccatcgcgcgcacagtaggcacgc

SEQ ID NO: 502093 - DNA, 25 bp, Rattus norvegicus
ggacgcccccacgtgccagacgctg

SEQ ID NO: 502094 - DNA, 25 bp, Rattus norvegicus
gcctccagagggaactcgggacgcc

SEQ ID NO: 502095 - DNA, 25 bp, Rattus norvegicus
agcctccagagggaactcgggacgc

SEQ ID NO: 502096 - DNA, 25 bp, Rattus norvegicus
tccagcctccagagggaactcggga

SEQ ID NO: 502097 - DNA, 25 bp, Rattus norvegicus
gtcgtcgccacctgtccagcctcca

SEQ ID NO: 502098 - DNA, 25 bp, Rattus norvegicus
aagtgcgggcctcggagcatcacac

SEQ ID NO: 502099 - DNA, 25 bp, Rattus norvegicus
cgcagctaactaagtgcgggcctcg

SEQ ID NO: 502100 - DNA, 25 bp, Rattus norvegicus
gccggcatcggtcccgcaggagagc

SEQ ID NO: 502101 - DNA, 25 bp, Rattus norvegicus
acgcagctaactaagtgcgggcctc

SEQ ID NO: 502102 - DNA, 25 bp, Rattus norvegicus
aggcacgcagctaactaagtgcggg

SEQ ID NO: 502103 - DNA, 25 bp, Rattus norvegicus
gtaggcacgcagctaactaagtgcg

SEQ ID NO: 502104 - DNA, 25 bp, Rattus norvegicus
cagtaggcacgcagctaactaagtg

SEQ ID NO: 502105 - DNA, 25 bp, Rattus norvegicus
cctggcggccggagggccggcatcg

SEQ ID NO: 502106 - DNA, 25 bp, Rattus norvegicus
caccacgtggcctccttttatgata

SEQ ID NO: 502107 - DNA, 25 bp, Rattus norvegicus
tcagctctcagaattggcacacggc

SEQ ID NO: 502108 - DNA, 25 bp, Rattus norvegicus
ataaagcctgcgcagcatcgctcct

SEQ ID NO: 502109 - DNA, 25 bp, Rattus norvegicus
tccgagtcacaaggataaagcctgc

SEQ ID NO: 502110 - DNA, 25 bp, Rattus norvegicus
tggcagctccgagtcacaaggataa

SEQ ID NO: 502111 - DNA, 25 bp, Rattus norvegicus
ggagagtggcagctccgagtcacaa

SEQ ID NO: 502112 - DNA, 25 bp, Rattus norvegicus
gtggcctccttttatgataaggtta

SEQ ID NO: 502113 - DNA, 25 bp, Rattus norvegicus
gccggagcaattccatcagctctca

SEQ ID NO: 502114 - DNA, 25 bp, Rattus norvegicus
tccgaagggccggagcaattccatc

SEQ ID NO: 502115 - DNA, 25 bp, Rattus norvegicus
accgcatggcaagctccgaagggcc

SEQ ID NO: 502116 - DNA, 25 bp, Rattus norvegicus
tcattcaccgcatggcaagctccga

SEQ ID NO: 502117 - DNA, 25 bp, Rattus norvegicus
ccacatcgtttattcattcaccgca

SEQ ID NO: 502118 - DNA, 25 bp, Rattus norvegicus
cgctgccataaatagacaccacgtg

SEQ ID NO: 502119 - DNA, 25 bp, Rattus norvegicus
tcagaattggcacacggcgagcctc

SEQ ID NO: 502120 - DNA, 25 bp, Rattus norvegicus
caccgtctggaggaaacgcgcccaa

SEQ ID NO: 502121 - DNA, 25 bp, Rattus norvegicus
agctgtagttccgtcttccggtgcg

SEQ ID NO: 502122 - DNA, 25 bp, Rattus norvegicus
ccttcactcaggaagcgcttgttga

SEQ ID NO: 502123 - DNA, 25 bp, Rattus norvegicus
gccttctgtttcttcctgcgtgaca

SEQ ID NO: 502124 - DNA, 25 bp, Rattus norvegicus
ttctgaggaccatgaagcggctcgc

SEQ ID NO: 502125 - DNA, 25 bp, Rattus norvegicus
ttgaagaacgagacaccggcagatc

SEQ ID NO: 502126 - DNA, 25 bp, Rattus norvegicus
tggccctcacctgaataccctggtg

SEQ ID NO: 502127 - DNA, 25 bp, Rattus norvegicus
ctacaccagtgggatgcgaatctcg

SEQ ID NO: 502128 - DNA, 25 bp, Rattus norvegicus
gctctgtttggcgtactaaccctct

SEQ ID NO: 502129 - DNA, 25 bp, Rattus norvegicus
ctcggataatcacggcagaaggctg

SEQ ID NO: 502130 - DNA, 25 bp, Rattus norvegicus
ctgcgtgacaccatcttgccgactg

SEQ ID NO: 502131 - DNA, 25 bp, Rattus norvegicus
ctgttcgtccattcatccacgggga

SEQ ID NO: 502132 - DNA, 25 bp, Rattus norvegicus
acgcccgcggaatcagctctcagag

SEQ ID NO: 502133 - DNA, 25 bp, Rattus norvegicus
tcggagtatccgctgtctaacacca

SEQ ID NO: 502134 - DNA, 25 bp, Rattus norvegicus
cctcggccggagttatgagcagctt

SEQ ID NO: 502135 - DNA, 25 bp, Rattus norvegicus
tgagcagcttccgacaccggaacga

SEQ ID NO: 502136 - DNA, 25 bp, Rattus norvegicus
tcttgcgccgccaaggtagcggaga

SEQ ID NO: 502137 - DNA, 25 bp, Rattus norvegicus
ggcccagcagccagtggactaccta

SEQ ID NO: 502138 - DNA, 25 bp, Rattus norvegicus
ggaacgaccaactctcgcgacagct

SEQ ID NO: 502139 - DNA, 25 bp, Rattus norvegicus
gatgaaaggccgtcagcagcgagcc

SEQ ID NO: 502140 - DNA, 25 bp, Rattus norvegicus
ccagcgagatatcggccatcttgcg

SEQ ID NO: 502141 - DNA, 25 bp, Rattus norvegicus
ctcgtccagcgagatatcggccatc

SEQ ID NO: 502142 - DNA, 25 bp, Rattus norvegicus
cgcgcttccggatgagctcgtccag

SEQ ID NO: 502143 - DNA, 25 bp, Rattus norvegicus
ttggtcgccgttccgcgcttccgga

SEQ ID NO: 502144 - DNA, 25 bp, Rattus norvegicus
cacgagcctcgaataaaggaaaaag

SEQ ID NO: 502145 - DNA, 25 bp, Rattus norvegicus
agcggcgtcgcaccctcaagctgtt

SEQ ID NO: 502146 - DNA, 25 bp, Rattus norvegicus
ccagtggactacctagcggctgggc

SEQ ID NO: 502147 - DNA, 25 bp, Rattus norvegicus
ctcaaacgaagctcgaaacggaagg

SEQ ID NO: 502148 - DNA, 25 bp, Rattus norvegicus
tgtgggtcaccctctcccacggtgt

SEQ ID NO: 502149 - DNA, 25 bp, Rattus norvegicus
gggacttccgctctcttgtttccga

SEQ ID NO: 502150 - DNA, 25 bp, Rattus norvegicus
ttgtcctgacccttggcctttgcac

SEQ ID NO: 502151 - DNA, 25 bp, Rattus norvegicus
agccttcagcctttcgttgtcctga

SEQ ID NO: 502152 - DNA, 25 bp, Rattus norvegicus
tagccctaccggaagagccttcagc

SEQ ID NO: 502153 - DNA, 25 bp, Rattus norvegicus
ccttaggaccttacttagatgaacg

SEQ ID NO: 502154 - DNA, 25 bp, Rattus norvegicus
cggagctgcgttcttatgtctcaga

SEQ ID NO: 502155 - DNA, 25 bp, Rattus norvegicus
gacggtgcgcaaacaccttaggacc

SEQ ID NO: 502156 - DNA, 25 bp, Rattus norvegicus
cagtgtcccgaagggttccctggtg

SEQ ID NO: 502157 - DNA, 25 bp, Rattus norvegicus
cctcggaatccggatgggaccgcct

SEQ ID NO: 502158 - DNA, 25 bp, Rattus norvegicus
gaccctagggtgtctgtctctctgc

SEQ ID NO: 502159 - DNA, 25 bp, Rattus norvegicus
ctctctgcggataggagggcgccat

SEQ ID NO: 502160 - DNA, 25 bp, Rattus norvegicus
cccgagtctttgctgcgggtgctgt

SEQ ID NO: 502161 - DNA, 25 bp, Rattus norvegicus
cccaaagctttgtggaggatccgga

SEQ ID NO: 502162 - DNA, 25 bp, Rattus norvegicus
gccacttagccagggcgtgagtcac

SEQ ID NO: 502163 - DNA, 25 bp, Rattus norvegicus
ccctctggcttgagatagggccgga

SEQ ID NO: 502164 - DNA, 25 bp, Rattus norvegicus
ggtcttcaatgtccatcccgcgctt

SEQ ID NO: 502165 - DNA, 25 bp, Rattus norvegicus
ggattctagaatcccgcccacttac

SEQ ID NO: 502166 - DNA, 25 bp, Rattus norvegicus
cgcacacggaacagggtcttcaatg

SEQ ID NO: 502167 - DNA, 25 bp, Rattus norvegicus
tcccgcccacttacgcttgtgaaga

SEQ ID NO: 502168 - DNA, 25 bp, Rattus norvegicus
cgcttggggccctctggcttgagat

SEQ ID NO: 502169 - DNA, 25 bp, Rattus norvegicus
tggtggcaccgttctacacccgcta

SEQ ID NO: 502170 - DNA, 25 bp, Rattus norvegicus
cgaagaagacagtggtggcaccgtt

SEQ ID NO: 502171 - DNA, 25 bp, Rattus norvegicus
atgccgcctaccgtgctcagctggg

SEQ ID NO: 502172 - DNA, 25 bp, Rattus norvegicus
gtcacattcgcgcacacggaacagg

SEQ ID NO: 502173 - DNA, 25 bp, Rattus norvegicus
atcccacggtgcgagcctagagacc

SEQ ID NO: 502174 - DNA, 25 bp, Rattus norvegicus
cggatcgtcccgtgatcccacggtg

SEQ ID NO: 502175 - DNA, 25 bp, Rattus norvegicus
tacgcttgtgaagacgggagcacgc

SEQ ID NO: 502176 - DNA, 25 bp, Rattus norvegicus
agcgtgatgatctgggaccgagcgc

SEQ ID NO: 502177 - DNA, 25 bp, Rattus norvegicus
cgcgctcaacttcggggcgcatctc

SEQ ID NO: 502178 - DNA, 25 bp, Rattus norvegicus
ttcccggtgcgggtccaagccagag

SEQ ID NO: 502179 - DNA, 25 bp, Rattus norvegicus
cccagggctcctgctcgcccaacgt

SEQ ID NO: 502180 - DNA, 25 bp, Rattus norvegicus
gcccaacgtccctgagcagcgcttt

SEQ ID NO: 502181 - DNA, 25 bp, Rattus norvegicus
cgtggacctcgtcctccgacaggcc

SEQ ID NO: 502182 - DNA, 25 bp, Rattus norvegicus
aagccagagcatccggagagcccag

SEQ ID NO: 502183 - DNA, 25 bp, Rattus norvegicus
tccaagccagagcatccggagagcc

SEQ ID NO: 502184 - DNA, 25 bp, Rattus norvegicus
atcggcggctccatgccagcttttc

SEQ ID NO: 502185 - DNA, 25 bp, Rattus norvegicus
tccacctgaagacccttcccggtgc

SEQ ID NO: 502186 - DNA, 25 bp, Rattus norvegicus
ccaggctaccctctccacctgaaga

SEQ ID NO: 502187 - DNA, 25 bp, Rattus norvegicus
cccagcgccgactcccagcccaaag

SEQ ID NO: 502188 - DNA, 25 bp, Rattus norvegicus
agccctccctgcagcgcacagcatt

SEQ ID NO: 502189 - DNA, 25 bp, Rattus norvegicus
agcgcacagcattccattcctctcc

SEQ ID NO: 502190 - DNA, 25 bp, Rattus norvegicus
tgctacgggactccagtgtgaccga

SEQ ID NO: 502191 - DNA, 25 bp, Rattus norvegicus
cgctgtcttcgtggcttcactggcc

SEQ ID NO: 502192 - DNA, 25 bp, Rattus norvegicus
gagccttcgggagcctccaccggat

SEQ ID NO: 502193 - DNA, 25 bp, Rattus norvegicus
tggagaagctacatcacctgcaacc

SEQ ID NO: 502194 - DNA, 25 bp, Rattus norvegicus
gtgcattgccaacccgctgtcttcg

SEQ ID NO: 502195 - DNA, 25 bp, Rattus norvegicus
ggatctggaccgcacagtgcattgc

SEQ ID NO: 502196 - DNA, 25 bp, Rattus norvegicus
ttggctacgatctgctggaactgtg

SEQ ID NO: 502197 - DNA, 25 bp, Rattus norvegicus
acttcccgcgtgtacggcagctcta

SEQ ID NO: 502198 - DNA, 25 bp, Rattus norvegicus
tctcggtatgaacgcccgggtagct

SEQ ID NO: 502199 - DNA, 25 bp, Rattus norvegicus
gacaggaaatatgcgaaggaccgcc

SEQ ID NO: 502200 - DNA, 25 bp, Rattus norvegicus
cagtgtgtctcagccgccgcgttaa

SEQ ID NO: 502201 - DNA, 25 bp, Rattus norvegicus
gccgcgttaacgaacacctgctctg

SEQ ID NO: 502202 - DNA, 25 bp, Rattus norvegicus
acctgctctgcgtctcggtatgaac

SEQ ID NO: 502203 - DNA, 25 bp, Rattus norvegicus
cgcaccgagtgcttggctacgatct

SEQ ID NO: 502204 - DNA, 25 bp, Rattus norvegicus
gatgccgcttctgccatcgccgtag

SEQ ID NO: 502205 - DNA, 25 bp, Rattus norvegicus
tctatcggggacaggtgtaaactac

SEQ ID NO: 502206 - DNA, 25 bp, Rattus norvegicus
gggacagatgcgaagctggattcta

SEQ ID NO: 502207 - DNA, 25 bp, Rattus norvegicus
aggtcgcctaagaaggcctttctgc

SEQ ID NO: 502208 - DNA, 25 bp, Rattus norvegicus
tggactaaactacccaggtcgccta

SEQ ID NO: 502209 - DNA, 25 bp, Rattus norvegicus
ccaagtttccgacaccgagggcacg

SEQ ID NO: 502210 - DNA, 25 bp, Rattus norvegicus
ggggctccaaatccctggctaaata

SEQ ID NO: 502211 - DNA, 25 bp, Rattus norvegicus
ctggctaaatagtggctgcagaacc

SEQ ID NO: 502212 - DNA, 25 bp, Rattus norvegicus
ctgcagaaccgctgttttaaaagtc

SEQ ID NO: 502213 - DNA, 25 bp, Rattus norvegicus
gtcgttaacttgcagacgttcttcc

SEQ ID NO: 502214 - DNA, 25 bp, Rattus norvegicus
gacacagtgtccgtgccagtgcatc

SEQ ID NO: 502215 - DNA, 25 bp, Rattus norvegicus
cagtgcatctgcgagtgtgctctcc

SEQ ID NO: 502216 - DNA, 25 bp, Rattus norvegicus
tgtaaactaccagatcgcggcagga

SEQ ID NO: 502217 - DNA, 25 bp, Rattus norvegicus
cccgagtattcgtagatgccgcttc

SEQ ID NO: 502218 - DNA, 25 bp, Rattus norvegicus
cctgctagcggagtgcttaagaaac

SEQ ID NO: 502219 - DNA, 25 bp, Rattus norvegicus
actacgctaggagtatggctgggcc

SEQ ID NO: 502220 - DNA, 25 bp, Rattus norvegicus
tcgacacattggacctgagggccgg

SEQ ID NO: 502221 - DNA, 25 bp, Rattus norvegicus
gccttggaggtgagatcgacacatt

SEQ ID NO: 502222 - DNA, 25 bp, Rattus norvegicus
ggcgggacctagcagaaagcttaca

SEQ ID NO: 502223 - DNA, 25 bp, Rattus norvegicus
tgccattagaaccagaggattgacg

SEQ ID NO: 502224 - DNA, 25 bp, Rattus norvegicus
ccggagttctcaagcttggcacgca

SEQ ID NO: 502225 - DNA, 25 bp, Rattus norvegicus
cagggacgacacaactcgagatttc

SEQ ID NO: 502226 - DNA, 25 bp, Rattus norvegicus
gagtgacttactccctctaccgcag

SEQ ID NO: 502227 - DNA, 25 bp, Rattus norvegicus
actgcccaagttgcgcctgatccta

SEQ ID NO: 502228 - DNA, 25 bp, Rattus norvegicus
catgcgcgggcctaaacaaccagga

SEQ ID NO: 502229 - DNA, 25 bp, Rattus norvegicus
tggcacgcatgttgtattcctaacg

SEQ ID NO: 502230 - DNA, 25 bp, Rattus norvegicus
tatcaggacctgagagggcggaatc

SEQ ID NO: 502231 - DNA, 25 bp, Rattus norvegicus
ggattgacgttccattcaggcagtg

SEQ ID NO: 502232 - DNA, 25 bp, Rattus norvegicus
cgcagtctcggctggcggcagaagc

SEQ ID NO: 502233 - DNA, 25 bp, Rattus norvegicus
ggccgcgccgctcgaaacttctagt

SEQ ID NO: 502234 - DNA, 25 bp, Rattus norvegicus
tggccgcgcctacccctgtcaggcc

SEQ ID NO: 502235 - DNA, 25 bp, Rattus norvegicus
ttgggacacgggtcggtggccgcgc

SEQ ID NO: 502236 - DNA, 25 bp, Rattus norvegicus
ggtgagccgcgacggttgggacacg

SEQ ID NO: 502237 - DNA, 25 bp, Rattus norvegicus
cggcgtgctcagtgggacccgaggt

SEQ ID NO: 502238 - DNA, 25 bp, Rattus norvegicus
tgcgcgaccggagcggaacggaaag

SEQ ID NO: 502239 - DNA, 25 bp, Rattus norvegicus
ccgctcgaaacttctagtccgcgcg

SEQ ID NO: 502240 - DNA, 25 bp, Rattus norvegicus
agccaatagggcgagcacagcgggc

SEQ ID NO: 502241 - DNA, 25 bp, Rattus norvegicus
aatcccgagcgccgcagggtcgaag

SEQ ID NO: 502242 - DNA, 25 bp, Rattus norvegicus
tgtccaatcccgagcgccgcagggt

SEQ ID NO: 502243 - DNA, 25 bp, Rattus norvegicus
gctctagtctgtccaatcccgagcg

SEQ ID NO: 502244 - DNA, 25 bp, Rattus norvegicus
gccgcctccgctctagtctgtccaa

SEQ ID NO: 502245 - DNA, 25 bp, Rattus norvegicus
aggggtcggagtcgcatcccggccg

SEQ ID NO: 502246 - DNA, 25 bp, Rattus norvegicus
gactgctcgtctacgtccgtgagta

SEQ ID NO: 502247 - DNA, 25 bp, Rattus norvegicus
tgtcgcagacgcacctgaacactgg

SEQ ID NO: 502248 - DNA, 25 bp, Rattus norvegicus
actgcgcgccaagcccaaggcagtg

SEQ ID NO: 502249 - DNA, 25 bp, Rattus norvegicus
ccaaggcagtgaggcaaggaacaga

SEQ ID NO: 502250 - DNA, 25 bp, Rattus norvegicus
agggagcttacttccacgcgctgca

SEQ ID NO: 502251 - DNA, 25 bp, Rattus norvegicus
ccaacggcagttggtctctgaggcc

SEQ ID NO: 502252 - DNA, 25 bp, Rattus norvegicus
ctctgaggccgctacagtttctctc

SEQ ID NO: 502253 - DNA, 25 bp, Rattus norvegicus
acagtttctctctggaggtcctgcc

SEQ ID NO: 502254 - DNA, 25 bp, Rattus norvegicus
gcgcgatgcctctggatcctcaggt

SEQ ID NO: 502255 - DNA, 25 bp, Rattus norvegicus
acgttggcaatcaggacatcctggc

SEQ ID NO: 502256 - DNA, 25 bp, Rattus norvegicus
accgcctgcgctttgtgcttagcaa

SEQ ID NO: 502257 - DNA, 25 bp, Rattus norvegicus
ttagcaaccacatagcggccgcctg

SEQ ID NO: 502258 - DNA, 25 bp, Rattus norvegicus
tcgtattcgcccacgcgggttctga

SEQ ID NO: 502259 - DNA, 25 bp, Rattus norvegicus
tgagtaaccttgctccgtagacgtc

SEQ ID NO: 502260 - DNA, 25 bp, Rattus norvegicus
tggaacccggagaaaccagtggcgc

SEQ ID NO: 502261 - DNA, 25 bp, Rattus norvegicus
gtgcccactaacaaggtaacggctg

SEQ ID NO: 502262 - DNA, 25 bp, Rattus norvegicus
gcgctcggtgcccactaacaaggta

SEQ ID NO: 502263 - DNA, 25 bp, Rattus norvegicus
atcttcaagcgcctgcgctcggtgc

SEQ ID NO: 502264 - DNA, 25 bp, Rattus norvegicus
tcacctcggttctcggtaactatgg

SEQ ID NO: 502265 - DNA, 25 bp, Rattus norvegicus
gactgcttcacctcggttctcggta

SEQ ID NO: 502266 - DNA, 25 bp, Rattus norvegicus
gttggagactgcttcacctcggttc

SEQ ID NO: 502267 - DNA, 25 bp, Rattus norvegicus
ttcccggttgttggagactgcttca

SEQ ID NO: 502268 - DNA, 25 bp, Rattus norvegicus
caaccgcttctcttcccggttgttg

SEQ ID NO: 502269 - DNA, 25 bp, Rattus norvegicus
tccgggaggcggcaaccgcttctct

SEQ ID NO: 502270 - DNA, 25 bp, Rattus norvegicus
acatccggagtgaaggagaacgcgc

SEQ ID NO: 502271 - DNA, 25 bp, Rattus norvegicus
ccagtggcgccgcaggacatccgga

SEQ ID NO: 502272 - DNA, 25 bp, Rattus norvegicus
gccgcgcccgacttcgaagttggaa

SEQ ID NO: 502273 - DNA, 25 bp, Rattus norvegicus
ctaacaaggtaacggctgcaagcgg

SEQ ID NO: 502274 - DNA, 25 bp, Rattus norvegicus
agtttgcatcctcagcgggcccaga

SEQ ID NO: 502275 - DNA, 25 bp, Rattus norvegicus
tcctcatccgtaagtggagtcgcga

SEQ ID NO: 502276 - DNA, 25 bp, Rattus norvegicus
ttctgactcccaggtacacactgct

SEQ ID NO: 502277 - DNA, 25 bp, Rattus norvegicus
gcgccgcggaaagcaactccacaga

SEQ ID NO: 502278 - DNA, 25 bp, Rattus norvegicus
acctcgtgctccagcttgtgcagga

SEQ ID NO: 502279 - DNA, 25 bp, Rattus norvegicus
cacagagttctacggaccaagcaga

SEQ ID NO: 502280 - DNA, 25 bp, Rattus norvegicus
ctgaaatgatgctggtgtagcctga

SEQ ID NO: 502281 - DNA, 25 bp, Rattus norvegicus
ggagtcgcgagttctactccttaca

SEQ ID NO: 502282 - DNA, 25 bp, Rattus norvegicus
cgagccaagcgcatgccagtttgca

SEQ ID NO: 502283 - DNA, 25 bp, Rattus norvegicus
gggcgcaactctcgatatccttctg

SEQ ID NO: 502284 - DNA, 25 bp, Rattus norvegicus
ctcctgagcttataagtggctcctc

SEQ ID NO: 502285 - DNA, 25 bp, Rattus norvegicus
cccatagtcgctctgggacgcctga

SEQ ID NO: 502286 - DNA, 25 bp, Rattus norvegicus
gtccgtgtagcgacacgaactcgtc

SEQ ID NO: 502287 - DNA, 25 bp, Rattus norvegicus
gatttaagcttacggtgcgcgcgcg

SEQ ID NO: 502288 - DNA, 25 bp, Rattus norvegicus
ttctgaacacctccggtatctccta

SEQ ID NO: 502289 - DNA, 25 bp, Rattus norvegicus
aggcacaagtgccagcgcacggccg

SEQ ID NO: 502290 - DNA, 25 bp, Rattus norvegicus
agacaagctgacagccgcgcgctca

SEQ ID NO: 502291 - DNA, 25 bp, Rattus norvegicus
tctgcagcaagctccgctaccgctc

SEQ ID NO: 502292 - DNA, 25 bp, Rattus norvegicus
cgagcgctcctgtctgcagcaagct

SEQ ID NO: 502293 - DNA, 25 bp, Rattus norvegicus
acgggacgctcagagcggccgctct

SEQ ID NO: 502294 - DNA, 25 bp, Rattus norvegicus
acagccggcgcgcaagacaagctga

SEQ ID NO: 502295 - DNA, 25 bp, Rattus norvegicus
gagcgagcagcaggcacaagtgcca

SEQ ID NO: 502296 - DNA, 25 bp, Rattus norvegicus
cgttctcatcctcccggggtcctcg

SEQ ID NO: 502297 - DNA, 25 bp, Rattus norvegicus
gaagttactttgcaaggaggcagga

SEQ ID NO: 502298 - DNA, 25 bp, Rattus norvegicus
ccagggcgctcgcagaagttacttt

SEQ ID NO: 502299 - DNA, 25 bp, Rattus norvegicus
tccggtatctcctacgcggcagctg

SEQ ID NO: 502300 - DNA, 25 bp, Rattus norvegicus
gcgtcctttctgaacacctccggta

SEQ ID NO: 502301 - DNA, 25 bp, Rattus norvegicus
cccgcccgtctctgtacgcatgccg

SEQ ID NO: 502302 - DNA, 25 bp, Rattus norvegicus
accgagctgttaccgggcagatctc

SEQ ID NO: 502303 - DNA, 25 bp, Rattus norvegicus
aacaggcgctggctgtcgtacggtc

SEQ ID NO: 502304 - DNA, 25 bp, Rattus norvegicus
agcaccactcgtctcagcccacacg

SEQ ID NO: 502305 - DNA, 25 bp, Rattus norvegicus
acacgcagcaccgagctgttaccgg

SEQ ID NO: 502306 - DNA, 25 bp, Rattus norvegicus
ttaccgggcagatctcagaggctta

SEQ ID NO: 502307 - DNA, 25 bp, Rattus norvegicus
gcagatctcagaggcttaggcgccc

SEQ ID NO: 502308 - DNA, 25 bp, Rattus norvegicus
ttcctccttccatccggtgcggagg

SEQ ID NO: 502309 - DNA, 25 bp, Rattus norvegicus
tccttccatccggtgcggaggacgc

SEQ ID NO: 502310 - DNA, 25 bp, Rattus norvegicus
ccctgttctgctctaggttccggtg

SEQ ID NO: 502311 - DNA, 25 bp, Rattus norvegicus
tctgctctaggttccggtgcccaca

SEQ ID NO: 502312 - DNA, 25 bp, Rattus norvegicus
agctccgcctcagcaggtacagccg

SEQ ID NO: 502313 - DNA, 25 bp, Rattus norvegicus
tacagccgcactccctgagccacta

SEQ ID NO: 502314 - DNA, 25 bp, Rattus norvegicus
gccactatcctactgctgaccctga

SEQ ID NO: 502315 - DNA, 25 bp, Rattus norvegicus
ccgctctgagaagtgggtaacaggc

SEQ ID NO: 502316 - DNA, 25 bp, Rattus norvegicus
cgacggaggtccatgtggcgcacta

SEQ ID NO: 502317 - DNA, 25 bp, Rattus norvegicus
tcttcagtctgttcgcaggtctgga

SEQ ID NO: 502318 - DNA, 25 bp, Rattus norvegicus
ggatgctggcatcctgaaggccgaa

SEQ ID NO: 502319 - DNA, 25 bp, Rattus norvegicus
ggccgactcatcatcgaggtggacg

SEQ ID NO: 502320 - DNA, 25 bp, Rattus norvegicus
tggcatcctgaaggccgaagccctg

SEQ ID NO: 502321 - DNA, 25 bp, Rattus norvegicus
tggcctgggcatggcgttctcccag

SEQ ID NO: 502322 - DNA, 25 bp, Rattus norvegicus
tgggcatggcgttctcccagtccca

SEQ ID NO: 502323 - DNA, 25 bp, Rattus norvegicus
agtcccacgtgatggcctctcgacg

SEQ ID NO: 502324 - DNA, 25 bp, Rattus norvegicus
gctccgtctcttcagtctgttcgca

SEQ ID NO: 502325 - DNA, 25 bp, Rattus norvegicus
atggcctctcgacggcaccaacatg

SEQ ID NO: 502326 - DNA, 25 bp, Rattus norvegicus
gacggcaccaacatggccgactcat

SEQ ID NO: 502327 - DNA, 25 bp, Rattus norvegicus
caacatggccgactcatcatcgagg

SEQ ID NO: 502328 - DNA, 25 bp, Rattus norvegicus
gcatggttctgctccgtctcttcag

SEQ ID NO: 502329 - DNA, 25 bp, Rattus norvegicus
cgcactaggtgggatgctggcatcc

SEQ ID NO: 502330 - DNA, 25 bp, Rattus norvegicus
tcaaagtacttgctctcgaactcgc

SEQ ID NO: 502331 - DNA, 25 bp, Rattus norvegicus
cgcaaaggtgcgtcctgttcgtacc

SEQ ID NO: 502332 - DNA, 25 bp, Rattus norvegicus
gcagccgcacgccatggaactcaaa

SEQ ID NO: 502333 - DNA, 25 bp, Rattus norvegicus
agtcatccgtgctagtcagggtccc

SEQ ID NO: 502334 - DNA, 25 bp, Rattus norvegicus
gcgtcctgttcgtacctgtcagtca

SEQ ID NO: 502335 - DNA, 25 bp, Rattus norvegicus
cctggagcaaaaaggaggcgtccgc

SEQ ID NO: 502336 - DNA, 25 bp, Rattus norvegicus
gcctgccgcaaaggtgcgtcctgtt

SEQ ID NO: 502337 - DNA, 25 bp, Rattus norvegicus
gggcatgacgtcatggccgcaccca

SEQ ID NO: 502338 - DNA, 25 bp, Rattus norvegicus
gctccgcgggcatgacgtcatggcc

SEQ ID NO: 502339 - DNA, 25 bp, Rattus norvegicus
cagctccagggcgtgacgtcacggc

SEQ ID NO: 502340 - DNA, 25 bp, Rattus norvegicus
gggtctccgcttcgctctccgccat

SEQ ID NO: 502341 - DNA, 25 bp, Rattus norvegicus
atggaactcaaagtacttgctctcg

SEQ ID NO: 502342 - DNA, 25 bp, Rattus norvegicus
tgtcctccatcttcccgcggcagaa

SEQ ID NO: 502343 - DNA, 25 bp, Rattus norvegicus
cgtacctgtcagtcatccgtgctag

SEQ ID NO: 502344 - DNA, 25 bp, Rattus norvegicus
ttcccagtgtcgttgggcacccatc

SEQ ID NO: 502345 - DNA, 25 bp, Rattus norvegicus
ctccacttggggaatcggtaacact

SEQ ID NO: 502346 - DNA, 25 bp, Rattus norvegicus
aagcgcgcactttcttcggctgctc

SEQ ID NO: 502347 - DNA, 25 bp, Rattus norvegicus
ttcctaggcttctaccacatcgggg

SEQ ID NO: 502348 - DNA, 25 bp, Rattus norvegicus
gaattgagctgcatcgccttccgga

SEQ ID NO: 502349 - DNA, 25 bp, Rattus norvegicus
tgcggctccttaagctcagagcagc

SEQ ID NO: 502350 - DNA, 25 bp, Rattus norvegicus
tgacgtcacccgaggactgcttagg

SEQ ID NO: 502351 - DNA, 25 bp, Rattus norvegicus
attgggcctcccactggcttatttg

SEQ ID NO: 502352 - DNA, 25 bp, Rattus norvegicus
caggagtccagtacgcccattgggc

SEQ ID NO: 502353 - DNA, 25 bp, Rattus norvegicus
tccaagcctacgattagggaaagcc

SEQ ID NO: 502354 - DNA, 25 bp, Rattus norvegicus
tttgcccagcgagcatccaagccta

SEQ ID NO: 502355 - DNA, 25 bp, Rattus norvegicus
cacgcggtcaccttcgtgtgcagtc

SEQ ID NO: 502356 - DNA, 25 bp, Rattus norvegicus
tgtcacctggcgtggaatttccctg

SEQ ID NO: 502357 - DNA, 25 bp, Rattus norvegicus
cacatcggggctacgctatgtctga

SEQ ID NO: 502358 - DNA, 25 bp, Rattus norvegicus
aggacgagtctttcttgggcaagtt

SEQ ID NO: 502359 - DNA, 25 bp, Rattus norvegicus
gagctcagctgcagcaccgggacct

SEQ ID NO: 502360 - DNA, 25 bp, Rattus norvegicus
ggtgcgcactcgcttatgtcctccg

SEQ ID NO: 502361 - DNA, 25 bp, Rattus norvegicus
cccaagatgaagaaggacgagtctt

SEQ ID NO: 502362 - DNA, 25 bp, Rattus norvegicus
gtgcctggcactacgcgcagggtcc

SEQ ID NO: 502363 - DNA, 25 bp, Rattus norvegicus
tggcactacgcgcagggtcccgctg

SEQ ID NO: 502364 - DNA, 25 bp, Rattus norvegicus
ctttcttgggcaagttgggcggcac

SEQ ID NO: 502365 - DNA, 25 bp, Rattus norvegicus
cggcgccaatgagccctcccgtcgc

SEQ ID NO: 502366 - DNA, 25 bp, Rattus norvegicus
ctttgcggtactggcccggtgccca

SEQ ID NO: 502367 - DNA, 25 bp, Rattus norvegicus
tgtccctacgacctttgcggtactg

SEQ ID NO: 502368 - DNA, 25 bp, Rattus norvegicus
ctcccgtcgcgttcaggctgagcga

SEQ ID NO: 502369 - DNA, 25 bp, Rattus norvegicus
cactggcaaggaagaagaagaccag

SEQ ID NO: 502370 - DNA, 25 bp, Rattus norvegicus
tccctttggcgccagcggggtgcca

SEQ ID NO: 502371 - DNA, 25 bp, Rattus norvegicus
ctccgcgctaccacgatcgcccacc

SEQ ID NO: 502372 - DNA, 25 bp, Rattus norvegicus
cccgatcctggcgaccatcacctcg

SEQ ID NO: 502373 - DNA, 25 bp, Rattus norvegicus
agacgctggggtctcgttgctatga

SEQ ID NO: 502374 - DNA, 25 bp, Rattus norvegicus
tcgttgctatgacaacagctggcgc

SEQ ID NO: 502375 - DNA, 25 bp, Rattus norvegicus
gctatgacaacagctggcgctaatg

SEQ ID NO: 502376 - DNA, 25 bp, Rattus norvegicus
aacagctggcgctaatgagcttttc

SEQ ID NO: 502377 - DNA, 25 bp, Rattus norvegicus
ctggcgctaatgagcttttcggagg

SEQ ID NO: 502378 - DNA, 25 bp, Rattus norvegicus
ccgggcgcgggatcactatggatcc

SEQ ID NO: 502379 - DNA, 25 bp, Rattus norvegicus
atcactatggatccggccctgggag

SEQ ID NO: 502380 - DNA, 25 bp, Rattus norvegicus
ccgatgtcgccgaacggaacccagg

SEQ ID NO: 502381 - DNA, 25 bp, Rattus norvegicus
gtcgctcctcgctatgcagccggga

SEQ ID NO: 502382 - DNA, 25 bp, Rattus norvegicus
tcctcgctatgcagccgggagccgg

SEQ ID NO: 502383 - DNA, 25 bp, Rattus norvegicus
gcgccgccgcaacagttgtccgcca

SEQ ID NO: 502384 - DNA, 25 bp, Rattus norvegicus
gtcccgcgccgcgttcagctcagcc

SEQ ID NO: 502385 - DNA, 25 bp, Rattus norvegicus
ggcagcagatgagccttggggttcc

SEQ ID NO: 502386 - DNA, 25 bp, Rattus norvegicus
tccctcgaggtcaaggccatggcgg

SEQ ID NO: 502387 - DNA, 25 bp, Rattus norvegicus
tagccttatttagaccgcgccacca

SEQ ID NO: 502388 - DNA, 25 bp, Rattus norvegicus
ggcccgcgtgtccacttaggaattc

SEQ ID NO: 502389 - DNA, 25 bp, Rattus norvegicus
gaacacgggctctgtgacgttcgct

SEQ ID NO: 502390 - DNA, 25 bp, Rattus norvegicus
gagcgtccctcgaggtcaaggccat

SEQ ID NO: 502391 - DNA, 25 bp, Rattus norvegicus
tcgcatacggtcttggagcgtccct

SEQ ID NO: 502392 - DNA, 25 bp, Rattus norvegicus
agctgtcgctatttcgcatacggtc

SEQ ID NO: 502393 - DNA, 25 bp, Rattus norvegicus
cgcgttcttaaaacagctgtcgcta

SEQ ID NO: 502394 - DNA, 25 bp, Rattus norvegicus
cacggacgcgttcttaaaacagctg

SEQ ID NO: 502395 - DNA, 25 bp, Rattus norvegicus
tctcaaagagcaaacacggacgcgt

SEQ ID NO: 502396 - DNA, 25 bp, Rattus norvegicus
attcgcaactccttctctcaaagag

SEQ ID NO: 502397 - DNA, 25 bp, Rattus norvegicus
gttcgctgttaattcgcaactcctt

SEQ ID NO: 502398 - DNA, 25 bp, Rattus norvegicus
gctctgtgacgttcgctgttaattc

SEQ ID NO: 502399 - DNA, 25 bp, Rattus norvegicus
gtccacttaggaattcctagcctta

SEQ ID NO: 502400 - DNA, 25 bp, Rattus norvegicus
cgcgaagctcttaaccaatcggata

SEQ ID NO: 502401 - DNA, 25 bp, Rattus norvegicus
ctagaagaggttcgctgcgtgcaca

SEQ ID NO: 502402 - DNA, 25 bp, Rattus norvegicus
tcgctgcgtgcacaggctgccagga

SEQ ID NO: 502403 - DNA, 25 bp, Rattus norvegicus
ctgccaggataaagagccgcaccca

SEQ ID NO: 502404 - DNA, 25 bp, Rattus norvegicus
ggaccctaaaattggccgagcgctg

SEQ ID NO: 502405 - DNA, 25 bp, Rattus norvegicus
tataaggaccggacttagggcggca

SEQ ID NO: 502406 - DNA, 25 bp, Rattus norvegicus
ctcatgcaatgggagagcgcgagca

SEQ ID NO: 502407 - DNA, 25 bp, Rattus norvegicus
gccgcgcgtgagaatggatcaaccc

SEQ ID NO: 502408 - DNA, 25 bp, Rattus norvegicus
gcctggagtcaacgcgaagctctta

SEQ ID NO: 502409 - DNA, 25 bp, Rattus norvegicus
taccgcatgcatctagaagaggttc

SEQ ID NO: 502410 - DNA, 25 bp, Rattus norvegicus
caatcggatataaggaccggactta

SEQ ID NO: 502411 - DNA, 25 bp, Rattus norvegicus
catcgtgcacccaaggaccctaaaa

SEQ ID NO: 502412 - DNA, 25 bp, Rattus norvegicus
tgagaatggatcaacccggctggcc

SEQ ID NO: 502413 - DNA, 25 bp, Rattus norvegicus
ctaaaattggccgagcgctgcgagc

SEQ ID NO: 502414 - DNA, 25 bp, Rattus norvegicus
tgccatgcgatcacccgcgcgagaa

SEQ ID NO: 502415 - DNA, 25 bp, Rattus norvegicus
cgcccagactttgcgggatgcacct

SEQ ID NO: 502416 - DNA, 25 bp, Rattus norvegicus
agagaccgctcgctctcggagcagc

SEQ ID NO: 502417 - DNA, 25 bp, Rattus norvegicus
acggccgctgggaacctggcaacca

SEQ ID NO: 502418 - DNA, 25 bp, Rattus norvegicus
atgcccacgggtgccatgcgatcac

SEQ ID NO: 502419 - DNA, 25 bp, Rattus norvegicus
ctgctggttgccatagagaccgctc

SEQ ID NO: 502420 - DNA, 25 bp, Rattus norvegicus
gcggcgtttgtacctgtcgctccgc

SEQ ID NO: 502421 - DNA, 25 bp, Rattus norvegicus
tccgctgccaagatggcccgagggt

SEQ ID NO: 502422 - DNA, 25 bp, Rattus norvegicus
ctgcacgtcacggaggccgccggaa

SEQ ID NO: 502423 - DNA, 25 bp, Rattus norvegicus
caccgcgcggtctttgtgcaggcgc

SEQ ID NO: 502424 - DNA, 25 bp, Rattus norvegicus
ctcaacagcctattagcgaggagcg

SEQ ID NO: 502425 - DNA, 25 bp, Rattus norvegicus
tgcgcctttctcaacagcctattag

SEQ ID NO: 502426 - DNA, 25 bp, Rattus norvegicus
cggaagtgacgcacctgcgcctttc

SEQ ID NO: 502427 - DNA, 25 bp, Rattus norvegicus
cagcggccgggaccttgtcttccgg

SEQ ID NO: 502428 - DNA, 25 bp, Rattus norvegicus
ccttgagcgtcccaattctgttagc

SEQ ID NO: 502429 - DNA, 25 bp, Rattus norvegicus
gctagagacagagcctctgcgggct

SEQ ID NO: 502430 - DNA, 25 bp, Rattus norvegicus
ctgttagctagagacagagcctctg

SEQ ID NO: 502431 - DNA, 25 bp, Rattus norvegicus
gcgtcccaattctgttagctagaga

SEQ ID NO: 502432 - DNA, 25 bp, Rattus norvegicus
ggctgcacacgctttcgcaggaggc

SEQ ID NO: 502433 - DNA, 25 bp, Rattus norvegicus
ccagcctgtccaggctttgcgcggt

SEQ ID NO: 502434 - DNA, 25 bp, Rattus norvegicus
gagatgatgggcgtgtctgcaaccc

SEQ ID NO: 502435 - DNA, 25 bp, Rattus norvegicus
acgcagtagtatacaaggaggggcc

SEQ ID NO: 502436 - DNA, 25 bp, Rattus norvegicus
gcaatgcacgcagtagtatacaagg

SEQ ID NO: 502437 - DNA, 25 bp, Rattus norvegicus
gaacagcttgcgcaatgcacgcagt

SEQ ID NO: 502438 - DNA, 25 bp, Rattus norvegicus
tgggacgaacagcttgcgcaatgca

SEQ ID NO: 502439 - DNA, 25 bp, Rattus norvegicus
aggatgggacgaacagcttgcgcaa

SEQ ID NO: 502440 - DNA, 25 bp, Rattus norvegicus
tgcacacgctttcgcaggaggcgaa

SEQ ID NO: 502441 - DNA, 25 bp, Rattus norvegicus
acgctttcgcaggaggcgaaaccgg

SEQ ID NO: 502442 - DNA, 25 bp, Rattus norvegicus
actctccgcaggttgaagttcatga

SEQ ID NO: 502443 - DNA, 25 bp, Rattus norvegicus
tgagcatgaggactctccgcaggtt

SEQ ID NO: 502444 - DNA, 25 bp, Rattus norvegicus
aagttcatgagttcgcccagcctca

SEQ ID NO: 502445 - DNA, 25 bp, Rattus norvegicus
ccaacgccacctggaacaggtaagg

SEQ ID NO: 502446 - DNA, 25 bp, Rattus norvegicus
aagtgagtgcaacgtgtcggcagca

SEQ ID NO: 502447 - DNA, 25 bp, Rattus norvegicus
tgtcggcagcacgagcccacgatcg

SEQ ID NO: 502448 - DNA, 25 bp, Rattus norvegicus
acctggaacaggtaaggcgcgcagc

SEQ ID NO: 502449 - DNA, 25 bp, Rattus norvegicus
cagccgactatcgtcgtaggggaca

SEQ ID NO: 502450 - DNA, 25 bp, Rattus norvegicus
cgggcttgctgctagcagccgacta

SEQ ID NO: 502451 - DNA, 25 bp, Rattus norvegicus
tgcgccagctgccagacattcctta

SEQ ID NO: 502452 - DNA, 25 bp, Rattus norvegicus
cacttcctgtatgcgtgtcgggccc

SEQ ID NO: 502453 - DNA, 25 bp, Rattus norvegicus
gcagggcgccgctgcacttcctgta

SEQ ID NO: 502454 - DNA, 25 bp, Rattus norvegicus
tcgcaggggcgcacttgaacctcgt

SEQ ID NO: 502455 - DNA, 25 bp, Rattus norvegicus
agctgccagacattccttaccggac

SEQ ID NO: 502456 - DNA, 25 bp, Rattus norvegicus
gccttcttggtctccgggcaggcac

SEQ ID NO: 502457 - DNA, 25 bp, Rattus norvegicus
agccaagcagcggaagcccggagtc

SEQ ID NO: 502458 - DNA, 25 bp, Rattus norvegicus
gcgcacacaaaagggcgtggcttta

SEQ ID NO: 502459 - DNA, 25 bp, Rattus norvegicus
acagcagggcttcagaggcttcttc

SEQ ID NO: 502460 - DNA, 25 bp, Rattus norvegicus
gccagtcccggcatctttccagagg

SEQ ID NO: 502461 - DNA, 25 bp, Rattus norvegicus
tttccagaggaaagcagtaacgatc

SEQ ID NO: 502462 - DNA, 25 bp, Rattus norvegicus
agtaacgatcgcacacgcgcaaagc

SEQ ID NO: 502463 - DNA, 25 bp, Rattus norvegicus
acgcgcaaagctcccaaaactcaga

SEQ ID NO: 502464 - DNA, 25 bp, Rattus norvegicus
aaaactcagaccaacccgagctgtc

SEQ ID NO: 502465 - DNA, 25 bp, Rattus norvegicus
cgagctgtctgtatccacttccgca

SEQ ID NO: 502466 - DNA, 25 bp, Rattus norvegicus
acttccgcagtcaagcgaacgcaga

SEQ ID NO: 502467 - DNA, 25 bp, Rattus norvegicus
gcgaacgcagacaggaagtccctcc

SEQ ID NO: 502468 - DNA, 25 bp, Rattus norvegicus
cctctccggacggaagcgagcctaa

SEQ ID NO: 502469 - DNA, 25 bp, Rattus norvegicus
cgagcctaaggagcgcgcacacaaa

SEQ ID NO: 502470 - DNA, 25 bp, Rattus norvegicus
ttttagggtgctgccaaagtgcccg

SEQ ID NO: 502471 - DNA, 25 bp, Rattus norvegicus
tcggcagtaccacgcggaaatggct

SEQ ID NO: 502472 - DNA, 25 bp, Rattus norvegicus
cttctaggcataggcactcaagtta

SEQ ID NO: 502473 - DNA, 25 bp, Rattus norvegicus
atggacaacttttcttcaccgtggg

SEQ ID NO: 502474 - DNA, 25 bp, Rattus norvegicus
ggcaactttgaggactgctgccata

SEQ ID NO: 502475 - DNA, 25 bp, Rattus norvegicus
agctcagcgcaactaactcacaatg

SEQ ID NO: 502476 - DNA, 25 bp, Rattus norvegicus
caccgcagcagggatcagggaatgc

SEQ ID NO: 502477 - DNA, 25 bp, Rattus norvegicus
gggtcaccaaacctggtcggcagta

SEQ ID NO: 502478 - DNA, 25 bp, Rattus norvegicus
cggcatctgttcgtggtgctgaaac

SEQ ID NO: 502479 - DNA, 25 bp, Rattus norvegicus
agctggcgtcagattccgagaataa

SEQ ID NO: 502480 - DNA, 25 bp, Rattus norvegicus
ggctgtacagctcaaagttctcggc

SEQ ID NO: 502481 - DNA, 25 bp, Rattus norvegicus
cccgggtgcaccattggctgtacag

SEQ ID NO: 502482 - DNA, 25 bp, Rattus norvegicus
accggcggcgacattccgaaggaag

SEQ ID NO: 502483 - DNA, 25 bp, Rattus norvegicus
ggaatgtccacgttcccaaaacatg

SEQ ID NO: 502484 - DNA, 25 bp, Rattus norvegicus
ccctgaatctgcaaacagtgctgga

SEQ ID NO: 502485 - DNA, 25 bp, Rattus norvegicus
tccctgggaagctctaggagggtcc

SEQ ID NO: 502486 - DNA, 25 bp, Rattus norvegicus
gcggtaaagttgtgcctcggcacga

SEQ ID NO: 502487 - DNA, 25 bp, Rattus norvegicus
ggactatatttcctccggcgcgcgc

SEQ ID NO: 502488 - DNA, 25 bp, Rattus norvegicus
accgccggcagggactatatttcct

SEQ ID NO: 502489 - DNA, 25 bp, Rattus norvegicus
actcttccggctgccgctaagttgc

SEQ ID NO: 502490 - DNA, 25 bp, Rattus norvegicus
tcccgggcactgagagacacgagtc

SEQ ID NO: 502491 - DNA, 25 bp, Rattus norvegicus
tgggcagcactttgagctcactttg

SEQ ID NO: 502492 - DNA, 25 bp, Rattus norvegicus
gagttgtgcaaaccgggcaaccgca

SEQ ID NO: 502493 - DNA, 25 bp, Rattus norvegicus
gggcctgtttccagcacctctgaga

SEQ ID NO: 502494 - DNA, 25 bp, Rattus norvegicus
tggggtcccacgaaccctgaatctg

SEQ ID NO: 502495 - DNA, 25 bp, Rattus norvegicus
tcggcacgatgctaattcggcagtg

SEQ ID NO: 502496 - DNA, 25 bp, Rattus norvegicus
gcggagcgcaaagtcgcggctctaa

SEQ ID NO: 502497 - DNA, 25 bp, Rattus norvegicus
ttgcagctccatcgccgcaacttgg

SEQ ID NO: 502498 - DNA, 25 bp, Rattus norvegicus
ggtgcatgcactcacggtattccta

SEQ ID NO: 502499 - DNA, 25 bp, Rattus norvegicus
tggtgtgcacattacccgaagcggc

SEQ ID NO: 502500 - DNA, 25 bp, Rattus norvegicus
tcatctctgacagcagggttgtacc

SEQ ID NO: 502501 - DNA, 25 bp, Rattus norvegicus
ccggggcgttatagtgatctcgatc

SEQ ID NO: 502502 - DNA, 25 bp, Rattus norvegicus
ggttggccttcatctctcacttgtc

SEQ ID NO: 502503 - DNA, 25 bp, Rattus norvegicus
tgaaggcgctcaacgcaccggaatc

SEQ ID NO: 502504 - DNA, 25 bp, Rattus norvegicus
actcctgctgatcacgaagtccttg

SEQ ID NO: 502505 - DNA, 25 bp, Rattus norvegicus
tattcgagttgcaaaatggcggccc

SEQ ID NO: 502506 - DNA, 25 bp, Rattus norvegicus
ccgattggttctgaggggtatattc

SEQ ID NO: 502507 - DNA, 25 bp, Rattus norvegicus
cagcaactgtttccagggcgggctt

SEQ ID NO: 502508 - DNA, 25 bp, Rattus norvegicus
tcagcgttcagtagcagcttcaggc

SEQ ID NO: 502509 - DNA, 25 bp, Rattus norvegicus
gcgcgaacttcctcaaaccgggatg

SEQ ID NO: 502510 - DNA, 25 bp, Rattus norvegicus
cggctcctagtgttttcgtgtgaaa

SEQ ID NO: 502511 - DNA, 25 bp, Rattus norvegicus
gaccaacgtgcttaacccgcgcaga

SEQ ID NO: 502512 - DNA, 25 bp, Rattus norvegicus
gagcccagccgagcactgcgatcct

SEQ ID NO: 502513 - DNA, 25 bp, Rattus norvegicus
ccggccaaggcgatgagtcgtccct

SEQ ID NO: 502514 - DNA, 25 bp, Rattus norvegicus
gctcctcggctatggcgcgcagcat

SEQ ID NO: 502515 - DNA, 25 bp, Rattus norvegicus
aaggcgtccgcgctcctcggctatg

SEQ ID NO: 502516 - DNA, 25 bp, Rattus norvegicus
acctcgcggcgcaggctaaggcgtc

SEQ ID NO: 502517 - DNA, 25 bp, Rattus norvegicus
tggacacgcgcggacactcaggcgc

SEQ ID NO: 502518 - DNA, 25 bp, Rattus norvegicus
tcgctccaacctgtcgcgtgacgtt

SEQ ID NO: 502519 - DNA, 25 bp, Rattus norvegicus
aaggcgatgagtcgtccctggccct

SEQ ID NO: 502520 - DNA, 25 bp, Rattus norvegicus
aatccgcttttgtgcgcgtcgccac

SEQ ID NO: 502521 - DNA, 25 bp, Rattus norvegicus
ccagtgaagccacaatccgcttttg

SEQ ID NO: 502522 - DNA, 25 bp, Rattus norvegicus
ctcgagcaccagtgaagccacaatc

SEQ ID NO: 502523 - DNA, 25 bp, Rattus norvegicus
gtgctgcaacgagcgctcctccgtt

SEQ ID NO: 502524 - DNA, 25 bp, Rattus norvegicus
ttgaggccagccactgccaacttta

SEQ ID NO: 502525 - DNA, 25 bp, Rattus norvegicus
tatggcgcgcagcatgtgctgcaac

SEQ ID NO: 502526 - DNA, 25 bp, Rattus norvegicus
agcaacactggcgtctccgtggcgc

SEQ ID NO: 502527 - DNA, 25 bp, Rattus norvegicus
ggcattgagggaacgctgcagattt

SEQ ID NO: 502528 - DNA, 25 bp, Rattus norvegicus
ggaacgctgcagatttggctcggca

SEQ ID NO: 502529 - DNA, 25 bp, Rattus norvegicus
ctgcagatttggctcggcaggctcc

SEQ ID NO: 502530 - DNA, 25 bp, Rattus norvegicus
gcgcgcagcgccatccggcgcacca

SEQ ID NO: 502531 - DNA, 25 bp, Rattus norvegicus
cgggaccctagtgccctctgatgcg

SEQ ID NO: 502532 - DNA, 25 bp, Rattus norvegicus
gtgccctctgatgcgctggggaccc

SEQ ID NO: 502533 - DNA, 25 bp, Rattus norvegicus
aatttcagggcggaacgttcgcgcg

SEQ ID NO: 502534 - DNA, 25 bp, Rattus norvegicus
acactggcgtctccgtggcgcggca

SEQ ID NO: 502535 - DNA, 25 bp, Rattus norvegicus
ttcgggctggatgccagcgtcccgc

SEQ ID NO: 502536 - DNA, 25 bp, Rattus norvegicus
ggctggatgccagcgtcccgcgtct

SEQ ID NO: 502537 - DNA, 25 bp, Rattus norvegicus
cttcaggcggggcttcccgttgccg

SEQ ID NO: 502538 - DNA, 25 bp, Rattus norvegicus
accctagtgccctctgatgcgctgg

SEQ ID NO: 502539 - DNA, 25 bp, Rattus norvegicus
ggcggctccacccagcccaaggggc

SEQ ID NO: 502540 - DNA, 25 bp, Rattus norvegicus
ctcaaacttttgtgggcgctgcttc

SEQ ID NO: 502541 - DNA, 25 bp, Rattus norvegicus
ttagcaaccgaggttggcgtctccc

SEQ ID NO: 502542 - DNA, 25 bp, Rattus norvegicus
tgcctgtgtccgctgggacagactt

SEQ ID NO: 502543 - DNA, 25 bp, Rattus norvegicus
aagatcgttgcggaaagcggactgc

SEQ ID NO: 502544 - DNA, 25 bp, Rattus norvegicus
gattcctgcgccacaaagatcgttg

SEQ ID NO: 502545 - DNA, 25 bp, Rattus norvegicus
cgtctcccggggaatccgattcctg

SEQ ID NO: 502546 - DNA, 25 bp, Rattus norvegicus
agcgaggcgccgttgcttagcaacc

SEQ ID NO: 502547 - DNA, 25 bp, Rattus norvegicus
aagaatttttctaagtctcgcgaga

SEQ ID NO: 502548 - DNA, 25 bp, Rattus norvegicus
cctcgtgcgcccgtgagaaaagcgc

SEQ ID NO: 502549 - DNA, 25 bp, Rattus norvegicus
tctccacgagcagcaactcaaggtg

SEQ ID NO: 502550 - DNA, 25 bp, Rattus norvegicus
gcggcctcgccacgacttgaaattc

SEQ ID NO: 502551 - DNA, 25 bp, Rattus norvegicus
gaacctcttgaaagggccgatgacc

SEQ ID NO: 502552 - DNA, 25 bp, Rattus norvegicus
gggccgatgatacaggtgaacctct

SEQ ID NO: 502553 - DNA, 25 bp, Rattus norvegicus
ggacagacttgctctcaaacttttg

SEQ ID NO: 502554 - DNA, 25 bp, Rattus norvegicus
ctcggcagcctctcgctgctggcgg

SEQ ID NO: 502555 - DNA, 25 bp, Rattus norvegicus
agcctccgatgctccggagcgcgcg

SEQ ID NO: 502556 - DNA, 25 bp, Rattus norvegicus
gcgggataattgaacgcggcgcgca

SEQ ID NO: 502557 - DNA, 25 bp, Rattus norvegicus
ccgtgcttttgtccgccgcccgagc

SEQ ID NO: 502558 - DNA, 25 bp, Rattus norvegicus
tgcgtggaattcaggccggcgacct

SEQ ID NO: 502559 - DNA, 25 bp, Rattus norvegicus
gaattcaggccggcgacctcttctc

SEQ ID NO: 502560 - DNA, 25 bp, Rattus norvegicus
cccagagctgcgtggaattcaggcc

SEQ ID NO: 502561 - DNA, 25 bp, Rattus norvegicus
cgccgtcgcgcctcgtcccgctgcc

SEQ ID NO: 502562 - DNA, 25 bp, Rattus norvegicus
cgtgtagcggctgcccgccgtgctt

SEQ ID NO: 502563 - DNA, 25 bp, Rattus norvegicus
cttgatcgtgtagcggctgcccgcc

SEQ ID NO: 502564 - DNA, 25 bp, Rattus norvegicus
ccggcttgatcgtgtagcggctgcc

SEQ ID NO: 502565 - DNA, 25 bp, Rattus norvegicus
ccaggcccggcttgatcgtgtagcg

SEQ ID NO: 502566 - DNA, 25 bp, Rattus norvegicus
caggagacttgcgttggctgcccag

SEQ ID NO: 502567 - DNA, 25 bp, Rattus norvegicus
cgcaggagacttgcgttggctgccc

SEQ ID NO: 502568 - DNA, 25 bp, Rattus norvegicus
ggtactccgttcctcctggccgtga

SEQ ID NO: 502569 - DNA, 25 bp, Rattus norvegicus
aacctcgatgtgtgttggtacgtgg

SEQ ID NO: 502570 - DNA, 25 bp, Rattus norvegicus
acaccatggcggtgagattccaggc

SEQ ID NO: 502571 - DNA, 25 bp, Rattus norvegicus
gccgcccgggcgaacctcgatgtgt

SEQ ID NO: 502572 - DNA, 25 bp, Rattus norvegicus
gagaaacgtctcagacccggtactc

SEQ ID NO: 502573 - DNA, 25 bp, Rattus norvegicus
gctcagcccggctttgcgggaaacc

SEQ ID NO: 502574 - DNA, 25 bp, Rattus norvegicus
ctttgcgggaaaccaggacaggatc

SEQ ID NO: 502575 - DNA, 25 bp, Rattus norvegicus
aaaccaggacaggatcgcgcttgtc

SEQ ID NO: 502576 - DNA, 25 bp, Rattus norvegicus
gatcgcgcttgtccggatcggatcg

SEQ ID NO: 502577 - DNA, 25 bp, Rattus norvegicus
cggcctccgacttgaaggaggaaga

SEQ ID NO: 502578 - DNA, 25 bp, Rattus norvegicus
cggttgtttccaggcgcctccaggt

SEQ ID NO: 502579 - DNA, 25 bp, Rattus norvegicus
cctaccgtttccaggacgcctgttg

SEQ ID NO: 502580 - DNA, 25 bp, Rattus norvegicus
caggacgcctgttgtacaccatggc

SEQ ID NO: 502581 - DNA, 25 bp, Rattus norvegicus
tggtacgtgggaagagaaacgtctc

SEQ ID NO: 502582 - DNA, 25 bp, Rattus norvegicus
cccacgctcaggttgtggctctgtg

SEQ ID NO: 502583 - DNA, 25 bp, Rattus norvegicus
tcgggcatcatggtgccagcaccta

SEQ ID NO: 502584 - DNA, 25 bp, Rattus norvegicus
cggctcgtcccacgctcaggttgtg

SEQ ID NO: 502585 - DNA, 25 bp, Rattus norvegicus
ggagcagcgtaaccggtaactgcgc

SEQ ID NO: 502586 - DNA, 25 bp, Rattus norvegicus
tcttcaaggagcagcgtaaccggta

SEQ ID NO: 502587 - DNA, 25 bp, Rattus norvegicus
acggcgctcttcaaggagcagcgta

SEQ ID NO: 502588 - DNA, 25 bp, Rattus norvegicus
ggtgccagcacctatccaggacctg

SEQ ID NO: 502589 - DNA, 25 bp, Rattus norvegicus
cctcccggctgtcgggcatcatggt

SEQ ID NO: 502590 - DNA, 25 bp, Rattus norvegicus
ctcgcccagagagcgagtggcaaga

SEQ ID NO: 502591 - DNA, 25 bp, Rattus norvegicus
gcgtctctgtctcctcgcctgtcgt

SEQ ID NO: 502592 - DNA, 25 bp, Rattus norvegicus
agcaccacgggatctgagtgacgcg

SEQ ID NO: 502593 - DNA, 25 bp, Rattus norvegicus
gccttgcagcaccacgggatctgag

SEQ ID NO: 502594 - DNA, 25 bp, Rattus norvegicus
cgcctgaggcaagacagctagtctc

SEQ ID NO: 502595 - DNA, 25 bp, Rattus norvegicus
gccttgtcctcttcgcctgaggcaa

SEQ ID NO: 502596 - DNA, 25 bp, Rattus norvegicus
tgccgaccatggaaaaggccgcgtc

SEQ ID NO: 502597 - DNA, 25 bp, Rattus norvegicus
tcacaaccgcctgggcggacggagc

SEQ ID NO: 502598 - DNA, 25 bp, Rattus norvegicus
cgggtcgttcacaaccgcctgggcg

SEQ ID NO: 502599 - DNA, 25 bp, Rattus norvegicus
cgaccatggaaaaggccgcgtcagc

SEQ ID NO: 502600 - DNA, 25 bp, Rattus norvegicus
ctttctctgccgaccatggaaaagg

SEQ ID NO: 502601 - DNA, 25 bp, Rattus norvegicus
gctttgtgtgccaggcctttctttc

SEQ ID NO: 502602 - DNA, 25 bp, Rattus norvegicus
ccaccgacgcggctttgtgtgccag

SEQ ID NO: 502603 - DNA, 25 bp, Rattus norvegicus
cgtgactaaatcagagccccctggc

SEQ ID NO: 502604 - DNA, 25 bp, Rattus norvegicus
tcgtgggccgtgactaaatcagagc

SEQ ID NO: 502605 - DNA, 25 bp, Rattus norvegicus
ttctcgtgggccgtgactaaatcag

SEQ ID NO: 502606 - DNA, 25 bp, Rattus norvegicus
ccctcctgaccggatgctctggtgg

SEQ ID NO: 502607 - DNA, 25 bp, Rattus norvegicus
aaaaggccgcgtcagcgtccgcttt

SEQ ID NO: 502608 - DNA, 25 bp, Rattus norvegicus
tcagcgtccgctttgtctgccctgt

SEQ ID NO: 502609 - DNA, 25 bp, Rattus norvegicus
tctcagggcggacaaagcccgggtc

SEQ ID NO: 502610 - DNA, 25 bp, Rattus norvegicus
agacgtcgtttgcttgcagctccgg

SEQ ID NO: 502611 - DNA, 25 bp, Rattus norvegicus
aatgggcgaccactgctgtgtaatc

SEQ ID NO: 502612 - DNA, 25 bp, Rattus norvegicus
catctcattggtctgcagcatcgga

SEQ ID NO: 502613 - DNA, 25 bp, Rattus norvegicus
cggagggagtgcatctataaagtgc

SEQ ID NO: 502614 - DNA, 25 bp, Rattus norvegicus
gcttccgaggacatctggccagtca

SEQ ID NO: 502615 - DNA, 25 bp, Rattus norvegicus
ctccaccgggcgtgttcttttctca

SEQ ID NO: 502616 - DNA, 25 bp, Rattus norvegicus
cgtttcctcattggctggacaactc

SEQ ID NO: 502617 - DNA, 25 bp, Rattus norvegicus
ttaaggacagcgaaactcccgagtc

SEQ ID NO: 502618 - DNA, 25 bp, Rattus norvegicus
ctgtggagccgaaacctaagctgga

SEQ ID NO: 502619 - DNA, 25 bp, Rattus norvegicus
gccgagcggcctaaataaccaatga

SEQ ID NO: 502620 - DNA, 25 bp, Rattus norvegicus
ctgtgtaatcgcaagacctagctgc

SEQ ID NO: 502621 - DNA, 25 bp, Rattus norvegicus
gctggaaccaatcaaagacgtcgtt

SEQ ID NO: 502622 - DNA, 25 bp, Rattus norvegicus
gcgacagtggccaatcggagctcta

SEQ ID NO: 502623 - DNA, 25 bp, Rattus norvegicus
cgtaacaggcgtctgggaatcgctc

SEQ ID NO: 502624 - DNA, 25 bp, Rattus norvegicus
agttgcactgccacaccttggtgta

SEQ ID NO: 502625 - DNA, 25 bp, Rattus norvegicus
cgggagcctcacttgcaggtgaaga

SEQ ID NO: 502626 - DNA, 25 bp, Rattus norvegicus
aggtgaagacctcggtgcgctcgct

SEQ ID NO: 502627 - DNA, 25 bp, Rattus norvegicus
cgctcgctgcacgtgttgcacttga

SEQ ID NO: 502628 - DNA, 25 bp, Rattus norvegicus
tgcgcagctgcttgatgcgcaggaa

SEQ ID NO: 502629 - DNA, 25 bp, Rattus norvegicus
aacaccagtggaatttgcagttgca

SEQ ID NO: 502630 - DNA, 25 bp, Rattus norvegicus
tactggtgcgtgttgtagccacggc

SEQ ID NO: 502631 - DNA, 25 bp, Rattus norvegicus
gcacatggtgtcacagccgtcggca

SEQ ID NO: 502632 - DNA, 25 bp, Rattus norvegicus
ccgcgtcctcctcgcagtagttggg

SEQ ID NO: 502633 - DNA, 25 bp, Rattus norvegicus
agtagttgggcgacttctcgatgta

SEQ ID NO: 502634 - DNA, 25 bp, Rattus norvegicus
cttctcgatgtacaccaggtccgtc

SEQ ID NO: 502635 - DNA, 25 bp, Rattus norvegicus
ggtccgtctccatcggcttctgata

SEQ ID NO: 502636 - DNA, 25 bp, Rattus norvegicus
tcggcttctgatagctgcgcagctg

SEQ ID NO: 502637 - DNA, 25 bp, Rattus norvegicus
ttgcacttgacgaagcaacaccagt

SEQ ID NO: 502638 - DNA, 25 bp, Rattus norvegicus
tgcgcgctccctagaccttagttac

SEQ ID NO: 502639 - DNA, 25 bp, Rattus norvegicus
ggcggcttaggccagcaaattgacc

SEQ ID NO: 502640 - DNA, 25 bp, Rattus norvegicus
ccaggtaatctacctcggcggctta

SEQ ID NO: 502641 - DNA, 25 bp, Rattus norvegicus
cgttgttacagctgtcctccaggta

SEQ ID NO: 502642 - DNA, 25 bp, Rattus norvegicus
ctggctctcacgctcagtgcacata

SEQ ID NO: 502643 - DNA, 25 bp, Rattus norvegicus
cgcgactagctagttctggctctca

SEQ ID NO: 502644 - DNA, 25 bp, Rattus norvegicus
ccaggatcatgctgggacgcgacta

SEQ ID NO: 502645 - DNA, 25 bp, Rattus norvegicus
agggtcacccactgatccaggatca

SEQ ID NO: 502646 - DNA, 25 bp, Rattus norvegicus
gcgcctcgtgggttaatatggtcta

SEQ ID NO: 502647 - DNA, 25 bp, Rattus norvegicus
ctctccttagtgtggcacggccatg

SEQ ID NO: 502648 - DNA, 25 bp, Rattus norvegicus
agcaccagtggccacagagacttcg

SEQ ID NO: 502649 - DNA, 25 bp, Rattus norvegicus
ccacagtttctttgcgcgcagggca

SEQ ID NO: 502650 - DNA, 25 bp, Rattus norvegicus
gaccttagttacctgcgcgcacatt

SEQ ID NO: 502651 - DNA, 25 bp, Rattus norvegicus
aggccagagcatatgcgtcccatta

SEQ ID NO: 502652 - DNA, 25 bp, Rattus norvegicus
ctcggatgagtctctgcgaggcttc

SEQ ID NO: 502653 - DNA, 25 bp, Rattus norvegicus
gggcgctgccttcactgggctcagc

SEQ ID NO: 502654 - DNA, 25 bp, Rattus norvegicus
tgacccgagcggagaactgcgacct

SEQ ID NO: 502655 - DNA, 25 bp, Rattus norvegicus
acgcgttgccaccatggtgagccca

SEQ ID NO: 502656 - DNA, 25 bp, Rattus norvegicus
ataggaccacgttcagccggcacta

SEQ ID NO: 502657 - DNA, 25 bp, Rattus norvegicus
cagggaatactcacccggaggcttc

SEQ ID NO: 502658 - DNA, 25 bp, Rattus norvegicus
gcggggtccggagacaccagcctac

SEQ ID NO: 502659 - DNA, 25 bp, Rattus norvegicus
ctgagccagccggacgagttgtcaa

SEQ ID NO: 502660 - DNA, 25 bp, Rattus norvegicus
gaggatatctgtctccggggactcg

SEQ ID NO: 502661 - DNA, 25 bp, Rattus norvegicus
gcccaaacaggtgaaagtacgcgcc

SEQ ID NO: 502662 - DNA, 25 bp, Rattus norvegicus
gtaatttcaacatgtccgggtgatg

SEQ ID NO: 502663 - DNA, 25 bp, Rattus norvegicus
cggacgagttgtcaaggtaatttca

SEQ ID NO: 502664 - DNA, 25 bp, Rattus norvegicus
ctcggagcccagagaagtgaccgtg

SEQ ID NO: 502665 - DNA, 25 bp, Rattus norvegicus
tcctcaggtccgctggagaggttct

SEQ ID NO: 502666 - DNA, 25 bp, Rattus norvegicus
cgccgcgatttgcatgcgctccagt

SEQ ID NO: 502667 - DNA, 25 bp, Rattus norvegicus
cgagcccacgcagcccgccatgtac

SEQ ID NO: 502668 - DNA, 25 bp, Rattus norvegicus
cccagcgcgtgaatggccgagcgcc

SEQ ID NO: 502669 - DNA, 25 bp, Rattus norvegicus
caggcgctattcttcgcccgggcgg

SEQ ID NO: 502670 - DNA, 25 bp, Rattus norvegicus
tccagtcacaaaggttcaaggtcag

SEQ ID NO: 502671 - DNA, 25 bp, Rattus norvegicus
tgcatgcgctccagtcacaaaggtt

SEQ ID NO: 502672 - DNA, 25 bp, Rattus norvegicus
ggcgctttgtgtctcggcccggcca

SEQ ID NO: 502673 - DNA, 25 bp, Rattus norvegicus
acagcggcgcattgttccccgggac

SEQ ID NO: 502674 - DNA, 25 bp, Rattus norvegicus
gccgccgccgtctgaggcgctttgt

SEQ ID NO: 502675 - DNA, 25 bp, Rattus norvegicus
tgtactcgcgggcactgcgcaagtc

SEQ ID NO: 502676 - DNA, 25 bp, Rattus norvegicus
ccatgctaatcagcctggcagcgcg

SEQ ID NO: 502677 - DNA, 25 bp, Rattus norvegicus
tcgcccatgctaatcagcctggcag

SEQ ID NO: 502678 - DNA, 25 bp, Rattus norvegicus
gcagcactgcctgcgccgttcccag

SEQ ID NO: 502679 - DNA, 25 bp, Rattus norvegicus
cgcatccgcattcctcgcagcactg

SEQ ID NO: 502680 - DNA, 25 bp, Rattus norvegicus
ctgtgcaagactccgcctctagtca

SEQ ID NO: 502681 - DNA, 25 bp, Rattus norvegicus
gcctgtccgcacttacgctgggagt

SEQ ID NO: 502682 - DNA, 25 bp, Rattus norvegicus
ttacgctgggagtgcactccgccag

SEQ ID NO: 502683 - DNA, 25 bp, Rattus norvegicus
ccgctgcctgcctaggccgtaaatt

SEQ ID NO: 502684 - DNA, 25 bp, Rattus norvegicus
ggccgtaaatttgcattcagagctg

SEQ ID NO: 502685 - DNA, 25 bp, Rattus norvegicus
attcagagctggtcgacccaaggcc

SEQ ID NO: 502686 - DNA, 25 bp, Rattus norvegicus
cccggaagtcggagacgatggccaa

SEQ ID NO: 502687 - DNA, 25 bp, Rattus norvegicus
tggctccacctccagctgtgcaaga

SEQ ID NO: 502688 - DNA, 25 bp, Rattus norvegicus
cgcatactcatttaggccgcctgca

SEQ ID NO: 502689 - DNA, 25 bp, Rattus norvegicus
ctggacttcatttccggcgcaggcc

SEQ ID NO: 502690 - DNA, 25 bp, Rattus norvegicus
ggcgcaggccgcttgaagtcacgcc

SEQ ID NO: 502691 - DNA, 25 bp, Rattus norvegicus
tctaccgcgagcctgcttccggggt

SEQ ID NO: 502692 - DNA, 25 bp, Rattus norvegicus
ggggtcctgagtctgcgcatactca

SEQ ID NO: 502693 - DNA, 25 bp, Rattus norvegicus
gacgatggccaagtggctccacctc

SEQ ID NO: 502694 - DNA, 25 bp, Rattus norvegicus
gcccagcctccgcaaagcccggaaa

SEQ ID NO: 502695 - DNA, 25 bp, Rattus norvegicus
ttgacctggtaaagcgctccgccca

SEQ ID NO: 502696 - DNA, 25 bp, Rattus norvegicus
ctccggttgacctggtaaagcgctc

SEQ ID NO: 502697 - DNA, 25 bp, Rattus norvegicus
acgtgaacttgacccggtgctcctc

SEQ ID NO: 502698 - DNA, 25 bp, Rattus norvegicus
cctggcggtggacgtgaacttgacc

SEQ ID NO: 502699 - DNA, 25 bp, Rattus norvegicus
tccagacagccctggcggtggacgt

SEQ ID NO: 502700 - DNA, 25 bp, Rattus norvegicus
gcatacttctagagacctccagaca

SEQ ID NO: 502701 - DNA, 25 bp, Rattus norvegicus
cggactacagcagagcatacttcta

SEQ ID NO: 502702 - DNA, 25 bp, Rattus norvegicus
cccgaggtcgtgacccggactacag

SEQ ID NO: 502703 - DNA, 25 bp, Rattus norvegicus
cattagcacccggagctgcccgagg

SEQ ID NO: 502704 - DNA, 25 bp, Rattus norvegicus
agtccagagagaggggcattagcac

SEQ ID NO: 502705 - DNA, 25 bp, Rattus norvegicus
tgtaagaagttgaagcggcgagtcc

SEQ ID NO: 502706 - DNA, 25 bp, Rattus norvegicus
cgagttcagcgactgtgtaagaagt

SEQ ID NO: 502707 - DNA, 25 bp, Rattus norvegicus
agcccggaaacttcgagttcagcga

SEQ ID NO: 502708 - DNA, 25 bp, Rattus norvegicus
tgctcggccgagcaaacacgggaac

SEQ ID NO: 502709 - DNA, 25 bp, Rattus norvegicus
cctctttagtcaatatagtgtgcgc

SEQ ID NO: 502710 - DNA, 25 bp, Rattus norvegicus
agtcaatatagtgtgcgctctgctc

SEQ ID NO: 502711 - DNA, 25 bp, Rattus norvegicus
agcctccggacacccacgcgtggac

SEQ ID NO: 502712 - DNA, 25 bp, Rattus norvegicus
gagcaaacacgggaacaaaacagcg

SEQ ID NO: 502713 - DNA, 25 bp, Rattus norvegicus
gggaacaaaacagcggccggcagcc

SEQ ID NO: 502714 - DNA, 25 bp, Rattus norvegicus
ctgaccctggggtcgcgccctttgt

SEQ ID NO: 502715 - DNA, 25 bp, Rattus norvegicus
gcgccctttgttcgccctcaatggg

SEQ ID NO: 502716 - DNA, 25 bp, Rattus norvegicus
ttcgccctcaatggggctgcttgcc

SEQ ID NO: 502717 - DNA, 25 bp, Rattus norvegicus
gcgaccctctaatcctctttagtca

SEQ ID NO: 502718 - DNA, 25 bp, Rattus norvegicus
tggacacccaccctgggcacagaca

SEQ ID NO: 502719 - DNA, 25 bp, Rattus norvegicus
agggcgcgaccctctaatcctcttt

SEQ ID NO: 502720 - DNA, 25 bp, Rattus norvegicus
gcacagcgagcaagctgcggcctga

SEQ ID NO: 502721 - DNA, 25 bp, Rattus norvegicus
gcctggatctggatacggacgcaga

SEQ ID NO: 502722 - DNA, 25 bp, Rattus norvegicus
atcatggcagccagagctttggagc

SEQ ID NO: 502723 - DNA, 25 bp, Rattus norvegicus
ccttgctccgttggactggctgggt

SEQ ID NO: 502724 - DNA, 25 bp, Rattus norvegicus
tgcgggaagccactgccactatccg

SEQ ID NO: 502725 - DNA, 25 bp, Rattus norvegicus
actatccggcccaccatgctgtctc

SEQ ID NO: 502726 - DNA, 25 bp, Rattus norvegicus
atgctgtctcagtaccctatctaga

SEQ ID NO: 502727 - DNA, 25 bp, Rattus norvegicus
gtaccctatctagagctcggcgacc

SEQ ID NO: 502728 - DNA, 25 bp, Rattus norvegicus
tggcggctgtcctcagcgcgcactg

SEQ ID NO: 502729 - DNA, 25 bp, Rattus norvegicus
cagagaggatcgctgtcgaccgatg

SEQ ID NO: 502730 - DNA, 25 bp, Rattus norvegicus
tcgctgtcgaccgatggtcccaatc

SEQ ID NO: 502731 - DNA, 25 bp, Rattus norvegicus
tgtcgaccgatggtcccaatcggcc

SEQ ID NO: 502732 - DNA, 25 bp, Rattus norvegicus
tggtactgcccgcaatcatggcagc

SEQ ID NO: 502733 - DNA, 25 bp, Rattus norvegicus
agccagagctttggagcgcagccgc

SEQ ID NO: 502734 - DNA, 25 bp, Rattus norvegicus
tctaccggtgggtctccgccgtgcg

SEQ ID NO: 502735 - DNA, 25 bp, Rattus norvegicus
gcgtgcacgcgcgtcttggtactgc

SEQ ID NO: 502736 - DNA, 25 bp, Rattus norvegicus
ttctacatccgcacacactttgagc

SEQ ID NO: 502737 - DNA, 25 bp, Rattus norvegicus
ccgcacacactttgagctggagcca

SEQ ID NO: 502738 - DNA, 25 bp, Rattus norvegicus
ctcgcggtgatgtgttccacgtggt

SEQ ID NO: 502739 - DNA, 25 bp, Rattus norvegicus
gggtgactccttctacatccgcaca

SEQ ID NO: 502740 - DNA, 25 bp, Rattus norvegicus
tacatccgcacacactttgagctgg

SEQ ID NO: 502741 - DNA, 25 bp, Rattus norvegicus
atccgcacacactttgagctggagc

SEQ ID NO: 502742 - DNA, 25 bp, Rattus norvegicus
agctggagccaagcccgccctacgg

SEQ ID NO: 502743 - DNA, 25 bp, Rattus norvegicus
ctacggcctgggcttcactcgcggt

SEQ ID NO: 502744 - DNA, 25 bp, Rattus norvegicus
ctgggcttcactcgcggtgatgtgt

SEQ ID NO: 502745 - DNA, 25 bp, Rattus norvegicus
tgatgtgttccacgtggtggacacg

SEQ ID NO: 502746 - DNA, 25 bp, Rattus norvegicus
tcactcgcggtgatgtgttccacgt

SEQ ID NO: 502747 - DNA, 25 bp, Rattus norvegicus
gtgttccacgtggtggacacgttgt

SEQ ID NO: 502748 - DNA, 25 bp, Rattus norvegicus
gtgggtgactccttctacatccgca

SEQ ID NO: 502749 - DNA, 25 bp, Rattus norvegicus
cacacactttgagctggagccaagc

SEQ ID NO: 502750 - DNA, 25 bp, Rattus norvegicus
agcacagcgctagcggcggccaaga

SEQ ID NO: 502751 - DNA, 25 bp, Rattus norvegicus
tagcgtccgggacaaaggtctccag

SEQ ID NO: 502752 - DNA, 25 bp, Rattus norvegicus
acaaaggtctccagtggcgccagcc

SEQ ID NO: 502753 - DNA, 25 bp, Rattus norvegicus
gccagccgtggacgcgtgactcgat

SEQ ID NO: 502754 - DNA, 25 bp, Rattus norvegicus
cgctctgcccttggctgttcctgtg

SEQ ID NO: 502755 - DNA, 25 bp, Rattus norvegicus
tggacgcgtgactcgatccttcgcg

SEQ ID NO: 502756 - DNA, 25 bp, Rattus norvegicus
atccttcgcgccactcttttgcgtg

SEQ ID NO: 502757 - DNA, 25 bp, Rattus norvegicus
cactcttttgcgtgttgggtcgttg

SEQ ID NO: 502758 - DNA, 25 bp, Rattus norvegicus
cgttggatgtaagactgcagaaacc

SEQ ID NO: 502759 - DNA, 25 bp, Rattus norvegicus
ctgcgggcatgccagcacagcgcta

SEQ ID NO: 502760 - DNA, 25 bp, Rattus norvegicus
ccacccttcgaagagttgcgggagc

SEQ ID NO: 502761 - DNA, 25 bp, Rattus norvegicus
gccattccacccttcgaagagttgc

SEQ ID NO: 502762 - DNA, 25 bp, Rattus norvegicus
cacgctctcgttagcgtccgggaca

SEQ ID NO: 502763 - DNA, 25 bp, Rattus norvegicus
tcgccgtgcgctggccagaggccat

SEQ ID NO: 502764 - DNA, 25 bp, Rattus norvegicus
tccttcccaggttagccgtgccctg

SEQ ID NO: 502765 - DNA, 25 bp, Rattus norvegicus
gcgagcaccgcgcaagggagaaacc

SEQ ID NO: 502766 - DNA, 25 bp, Rattus norvegicus
ccgcgcaagggagaaaccggcgata

SEQ ID NO: 502767 - DNA, 25 bp, Rattus norvegicus
tgggtcccggcgcattacacccagg

SEQ ID NO: 502768 - DNA, 25 bp, Rattus norvegicus
gcgcattacacccagggcggctgcg

SEQ ID NO: 502769 - DNA, 25 bp, Rattus norvegicus
gtctgcaggccttctcgccggtgct

SEQ ID NO: 502770 - DNA, 25 bp, Rattus norvegicus
tgggaactccacaacttggcggctg

SEQ ID NO: 502771 - DNA, 25 bp, Rattus norvegicus
cgagttcggggctctgctgcaatgt

SEQ ID NO: 502772 - DNA, 25 bp, Rattus norvegicus
gctgcaatgtctgcgaggctgactt

SEQ ID NO: 502773 - DNA, 25 bp, Rattus norvegicus
aggctgactttgagcgcctcgctcg

SEQ ID NO: 502774 - DNA, 25 bp, Rattus norvegicus
cgccattcagctcttcagccaagtt

SEQ ID NO: 502775 - DNA, 25 bp, Rattus norvegicus
gctcttcagccaagtttcttaaccc

SEQ ID NO: 502776 - DNA, 25 bp, Rattus norvegicus
tccctcccattgtcacccgggcgga

SEQ ID NO: 502777 - DNA, 25 bp, Rattus norvegicus
gagcccgcggctgggaactccacaa

SEQ ID NO: 502778 - DNA, 25 bp, Rattus norvegicus
gccaatcagatgctgccgtccgggg

SEQ ID NO: 502779 - DNA, 25 bp, Rattus norvegicus
ttgggcagtcccttcacctagccag

SEQ ID NO: 502780 - DNA, 25 bp, Rattus norvegicus
gcatcctggggctctgaagatcaga

SEQ ID NO: 502781 - DNA, 25 bp, Rattus norvegicus
gcgctccacgatctagaccagttca

SEQ ID NO: 502782 - DNA, 25 bp, Rattus norvegicus
tagaccagttcaccgagggcacccg

SEQ ID NO: 502783 - DNA, 25 bp, Rattus norvegicus
cacccggtgggaagctctaccagac

SEQ ID NO: 502784 - DNA, 25 bp, Rattus norvegicus
cagacccgcagccttgaacttcagt

SEQ ID NO: 502785 - DNA, 25 bp, Rattus norvegicus
tctggagacccacagccactggcga

SEQ ID NO: 502786 - DNA, 25 bp, Rattus norvegicus
tgaacttcagttctggccggtgcgc

SEQ ID NO: 502787 - DNA, 25 bp, Rattus norvegicus
tggagtcctggaactgaagcgacgc

SEQ ID NO: 502788 - DNA, 25 bp, Rattus norvegicus
tcagtttaccaacagatgcccgagc

SEQ ID NO: 502789 - DNA, 25 bp, Rattus norvegicus
tgtgtctcgttctgaaccgcggccc

SEQ ID NO: 502790 - DNA, 25 bp, Rattus norvegicus
tgtgccggctctgaacattggcgtt

SEQ ID NO: 502791 - DNA, 25 bp, Rattus norvegicus
cattggcgttcgcagctgttttgtg

SEQ ID NO: 502792 - DNA, 25 bp, Rattus norvegicus
agtccagctcgctacgcgtgttcca

SEQ ID NO: 502793 - DNA, 25 bp, Rattus norvegicus
cgcctctgtgagcaagataagccta

SEQ ID NO: 502794 - DNA, 25 bp, Rattus norvegicus
cttgtcgcttacgtttccgctgcta

SEQ ID NO: 502795 - DNA, 25 bp, Rattus norvegicus
tccttgtcagggtagagctgtactt

SEQ ID NO: 502796 - DNA, 25 bp, Rattus norvegicus
gataagcctaaagagcgtccttgtc

SEQ ID NO: 502797 - DNA, 25 bp, Rattus norvegicus
ggggttttccaagcagctcctaagc

SEQ ID NO: 502798 - DNA, 25 bp, Rattus norvegicus
ctcgatccagcgtgtttgtgcaacc

SEQ ID NO: 502799 - DNA, 25 bp, Rattus norvegicus
cgatctgctgttgctctgccctcga

SEQ ID NO: 502800 - DNA, 25 bp, Rattus norvegicus
actagttccgttttactgcgcctgc

SEQ ID NO: 502801 - DNA, 25 bp, Rattus norvegicus
gtgttccagcgccacacggtccggg

SEQ ID NO: 502802 - DNA, 25 bp, Rattus norvegicus
ccgctgctagcttatagtgattgtg

SEQ ID NO: 502803 - DNA, 25 bp, Rattus norvegicus
aggcagctaggccagacccagcgag

SEQ ID NO: 502804 - DNA, 25 bp, Rattus norvegicus
ccctgcgctctaagcggggtatcta

SEQ ID NO: 502805 - DNA, 25 bp, Rattus norvegicus
gcgtggcccgcccacagtactagtt

SEQ ID NO: 502806 - DNA, 25 bp, Rattus norvegicus
cgagggacacctacggggcagcgta

SEQ ID NO: 502807 - DNA, 25 bp, Rattus norvegicus
gcggggtcgaaggaattgactttca

SEQ ID NO: 502808 - DNA, 25 bp, Rattus norvegicus
ctgcggggtcgaaggaattgacttt

SEQ ID NO: 502809 - DNA, 25 bp, Rattus norvegicus
caggacaccgtagccttggcggctg

SEQ ID NO: 502810 - DNA, 25 bp, Rattus norvegicus
gtctggcaggacaccgtagccttgg

SEQ ID NO: 502811 - DNA, 25 bp, Rattus norvegicus
gcggctgcgcccgagggacacctac

SEQ ID NO: 502812 - DNA, 25 bp, Rattus norvegicus
cgaaggaattgactttcaggaggac

SEQ ID NO: 502813 - DNA, 25 bp, Rattus norvegicus
actgagcgcggggacaggccaccgg

SEQ ID NO: 502814 - DNA, 25 bp, Rattus norvegicus
gctggctgcccagacccaggcccag

SEQ ID NO: 502815 - DNA, 25 bp, Rattus norvegicus
ggcgcaacggccgtgacgctgagct

SEQ ID NO: 502816 - DNA, 25 bp, Rattus norvegicus
aattgactttcaggaggacgcgcgc

SEQ ID NO: 502817 - DNA, 25 bp, Rattus norvegicus
ggcagtggcagcgtgctccgccact

SEQ ID NO: 502818 - DNA, 25 bp, Rattus norvegicus
agctgggccgcgagcgtactggcag

SEQ ID NO: 502819 - DNA, 25 bp, Rattus norvegicus
attgactttcaggaggacgcgcgcg

SEQ ID NO: 502820 - DNA, 25 bp, Rattus norvegicus
catgtcactgagagactgccaggta

SEQ ID NO: 502821 - DNA, 25 bp, Rattus norvegicus
ggagttggctcagcgccgagcagca

SEQ ID NO: 502822 - DNA, 25 bp, Rattus norvegicus
ccaggtacgcgcaccggttcggttg

SEQ ID NO: 502823 - DNA, 25 bp, Rattus norvegicus
tcactgagagactgccaggtacgcg

SEQ ID NO: 502824 - DNA, 25 bp, Rattus norvegicus
tataatcatgtcactgagagactgc

SEQ ID NO: 502825 - DNA, 25 bp, Rattus norvegicus
cctacagaccaaatctataatcatg

SEQ ID NO: 502826 - DNA, 25 bp, Rattus norvegicus
gctgtcaccctacagaccaaatcta

SEQ ID NO: 502827 - DNA, 25 bp, Rattus norvegicus
agctttgaccggtgctgtcacccta

SEQ ID NO: 502828 - DNA, 25 bp, Rattus norvegicus
tccaaaagctttgaccggtgctgtc

SEQ ID NO: 502829 - DNA, 25 bp, Rattus norvegicus
gacctcagaaactccaaaagctttg

SEQ ID NO: 502830 - DNA, 25 bp, Rattus norvegicus
ccagcggacctcagaaactccaaaa

SEQ ID NO: 502831 - DNA, 25 bp, Rattus norvegicus
tcctcggtccgggagttggctcagc

SEQ ID NO: 502832 - DNA, 25 bp, Rattus norvegicus
tgaccggtgctgtcaccctacagac

SEQ ID NO: 502833 - DNA, 25 bp, Rattus norvegicus
agactgccaggtacgcgcaccggtt

SEQ ID NO: 502834 - DNA, 25 bp, Rattus norvegicus
agtcccagcgcgttgatctcacaca

SEQ ID NO: 502835 - DNA, 25 bp, Rattus norvegicus
tctgcagctcagagccggaaatccg

SEQ ID NO: 502836 - DNA, 25 bp, Rattus norvegicus
taagaagtgggcatagggctcgtcc

SEQ ID NO: 502837 - DNA, 25 bp, Rattus norvegicus
agctgaattttacgccctcctggtc

SEQ ID NO: 502838 - DNA, 25 bp, Rattus norvegicus
ccggtagcagagactcagctgaatt

SEQ ID NO: 502839 - DNA, 25 bp, Rattus norvegicus
gcgcagcatttaaaccggtagcaga

SEQ ID NO: 502840 - DNA, 25 bp, Rattus norvegicus
tggagaccggcgcagcatttaaacc

SEQ ID NO: 502841 - DNA, 25 bp, Rattus norvegicus
tctgtttaaacaggccaatcggtgg

SEQ ID NO: 502842 - DNA, 25 bp, Rattus norvegicus
gagagcatctctctgtttaaacagg

SEQ ID NO: 502843 - DNA, 25 bp, Rattus norvegicus
gttgatctcacacatcagcactccg

SEQ ID NO: 502844 - DNA, 25 bp, Rattus norvegicus
cgagccaatccgtggcgtggagtcc

SEQ ID NO: 502845 - DNA, 25 bp, Rattus norvegicus
tgaacacttccggtgagagtttccg

SEQ ID NO: 502846 - DNA, 25 bp, Rattus norvegicus
ttcggaggagagtcgtgaacacttc

SEQ ID NO: 502847 - DNA, 25 bp, Rattus norvegicus
ttcccaggctgcaccgagagcatct

SEQ ID NO: 502848 - DNA, 25 bp, Rattus norvegicus
cgttgcggcacgtcgtgtgtgccct

SEQ ID NO: 502849 - DNA, 25 bp, Rattus norvegicus
gccacctagtgtttctctgtcaatc

SEQ ID NO: 502850 - DNA, 25 bp, Rattus norvegicus
cacgcagccagaaagctgctgggag

SEQ ID NO: 502851 - DNA, 25 bp, Rattus norvegicus
ggcgtatcgtgcacgcagccagaaa

SEQ ID NO: 502852 - DNA, 25 bp, Rattus norvegicus
gaacttccggcgtatcgtgcacgca

SEQ ID NO: 502853 - DNA, 25 bp, Rattus norvegicus
aggctggaacttccggcgtatcgtg

SEQ ID NO: 502854 - DNA, 25 bp, Rattus norvegicus
gacgctcctcggaggctggaacttc

SEQ ID NO: 502855 - DNA, 25 bp, Rattus norvegicus
gcgccgccacctagtgtttctctgt

SEQ ID NO: 502856 - DNA, 25 bp, Rattus norvegicus
accaggtgaagagtgaggacgctcc

SEQ ID NO: 502857 - DNA, 25 bp, Rattus norvegicus
gagcacgtttccgaccaggtgaaga

SEQ ID NO: 502858 - DNA, 25 bp, Rattus norvegicus
ggtgagcggagcacgtttccgacca

SEQ ID NO: 502859 - DNA, 25 bp, Rattus norvegicus
atctgccgcgcggaacccgaaagtc

SEQ ID NO: 502860 - DNA, 25 bp, Rattus norvegicus
tttctctgtcaatctgccgcgcgga

SEQ ID NO: 502861 - DNA, 25 bp, Rattus norvegicus
cacgtcgtgtgtgccctgtctggcg

SEQ ID NO: 502862 - DNA, 25 bp, Rattus norvegicus
ctgcacttacgcaagggagacggta

SEQ ID NO: 502863 - DNA, 25 bp, Rattus norvegicus
agcctccgatgagcaggttcacgca

SEQ ID NO: 502864 - DNA, 25 bp, Rattus norvegicus
cttacgcaagggagacggtaaaatg

SEQ ID NO: 502865 - DNA, 25 bp, Rattus norvegicus
acggtaaaatggaagcgctgccgca

SEQ ID NO: 502866 - DNA, 25 bp, Rattus norvegicus
aaaatggaagcgctgccgcaggccc

SEQ ID NO: 502867 - DNA, 25 bp, Rattus norvegicus
tgggaagctcctggtgctcacttca

SEQ ID NO: 502868 - DNA, 25 bp, Rattus norvegicus
agctcctggtgctcacttcacagta

SEQ ID NO: 502869 - DNA, 25 bp, Rattus norvegicus
tcacttcacagtacgggtgctcata

SEQ ID NO: 502870 - DNA, 25 bp, Rattus norvegicus
tcacagtacgggtgctcatactcgc

SEQ ID NO: 502871 - DNA, 25 bp, Rattus norvegicus
tacgggtgctcatactcgccgggcg

SEQ ID NO: 502872 - DNA, 25 bp, Rattus norvegicus
atactcgccgggcgggcacacacag

SEQ ID NO: 502873 - DNA, 25 bp, Rattus norvegicus
cacagtggaagcctccgatgagcag

SEQ ID NO: 502874 - DNA, 25 bp, Rattus norvegicus
tggtgctcacttcacagtacgggtg

SEQ ID NO: 502875 - DNA, 25 bp, Rattus norvegicus
gatgagcaggttcacgcaggtgccc

SEQ ID NO: 502876 - DNA, 25 bp, Rattus norvegicus
agcagtgccgagaaggtcacgttca

SEQ ID NO: 502877 - DNA, 25 bp, Rattus norvegicus
tgccgaactgtcgaacctgagcacg

SEQ ID NO: 502878 - DNA, 25 bp, Rattus norvegicus
cctgagcacggacacgcacttcatg

SEQ ID NO: 502879 - DNA, 25 bp, Rattus norvegicus
gcacggacacgcacttcatgtagtt

SEQ ID NO: 502880 - DNA, 25 bp, Rattus norvegicus
atgtagttctcgcagggctccctca

SEQ ID NO: 502881 - DNA, 25 bp, Rattus norvegicus
gctccctcaggcagatgttatcatc

SEQ ID NO: 502882 - DNA, 25 bp, Rattus norvegicus
tgttatcatcgaagggcagcacgcg

SEQ ID NO: 502883 - DNA, 25 bp, Rattus norvegicus
ccgagaaggtcacgttcaggatgtt

SEQ ID NO: 502884 - DNA, 25 bp, Rattus norvegicus
gtccggttcaggtagatctgctcct

SEQ ID NO: 502885 - DNA, 25 bp, Rattus norvegicus
gttcaggatgttggagctgacgtcc

SEQ ID NO: 502886 - DNA, 25 bp, Rattus norvegicus
agcaccgtggtggaactaatgaagg

SEQ ID NO: 502887 - DNA, 25 bp, Rattus norvegicus
cggaacagcaccgtggtggaactaa

SEQ ID NO: 502888 - DNA, 25 bp, Rattus norvegicus
cagcagtgtccggttcaggtagatc

SEQ ID NO: 502889 - DNA, 25 bp, Rattus norvegicus
aactaatgaagggtgccgaactgtc

SEQ ID NO: 502890 - DNA, 25 bp, Rattus norvegicus
ggccctgagggtcagcacgctgctc

SEQ ID NO: 502891 - DNA, 25 bp, Rattus norvegicus
tgatagacacgctggccgaggagct

SEQ ID NO: 502892 - DNA, 25 bp, Rattus norvegicus
cggggtcgttgtcgtttacatccag

SEQ ID NO: 502893 - DNA, 25 bp, Rattus norvegicus
catcctcgttcagacgcagctcata

SEQ ID NO: 502894 - DNA, 25 bp, Rattus norvegicus
cgtttacatccagcaccgtgataga

SEQ ID NO: 502895 - DNA, 25 bp, Rattus norvegicus
tgatcacactgttggcatctcggtc

SEQ ID NO: 502896 - DNA, 25 bp, Rattus norvegicus
cccgtcagctggtaggtgatcacac

SEQ ID NO: 502897 - DNA, 25 bp, Rattus norvegicus
ttgcgggtgtttccgcccgtcagct

SEQ ID NO: 502898 - DNA, 25 bp, Rattus norvegicus
ccaaggtgatgaggccaccgccgct

SEQ ID NO: 502899 - DNA, 25 bp, Rattus norvegicus
cgttcctgcttgtagtccaggggca

SEQ ID NO: 502900 - DNA, 25 bp, Rattus norvegicus
gcacatactgccgttcctgcttgta

SEQ ID NO: 502901 - DNA, 25 bp, Rattus norvegicus
aacgggtgccgtcggacgcagtcac

SEQ ID NO: 502902 - DNA, 25 bp, Rattus norvegicus
tgatgaagacctgcgctgtgtgtga

SEQ ID NO: 502903 - DNA, 25 bp, Rattus norvegicus
tcatacacgggctgcgtgaacacgg

SEQ ID NO: 502904 - DNA, 25 bp, Rattus norvegicus
gaggacgactcatcgaaggagaccg

SEQ ID NO: 502905 - DNA, 25 bp, Rattus norvegicus
tgaggacgactcatcgaaggagacc

SEQ ID NO: 502906 - DNA, 25 bp, Rattus norvegicus
caccctacgagcgagtcgtgctacg

SEQ ID NO: 502907 - DNA, 25 bp, Rattus norvegicus
aaggtgaggacgactcatcgaagga

SEQ ID NO: 502908 - DNA, 25 bp, Rattus norvegicus
tgctacgagaaggtgggtagctgcg

SEQ ID NO: 502909 - DNA, 25 bp, Rattus norvegicus
tacgagcgagtcgtgctacgagaag

SEQ ID NO: 502910 - DNA, 25 bp, Rattus norvegicus
cctacgagcgagtcgtgctacgaga

SEQ ID NO: 502911 - DNA, 25 bp, Rattus norvegicus
gcgctgaccaggcagggacactacc

SEQ ID NO: 502912 - DNA, 25 bp, Rattus norvegicus
tcggcgctgaccaggcagggacact

SEQ ID NO: 502913 - DNA, 25 bp, Rattus norvegicus
cgcgaggacctgtcggcgctgacca

SEQ ID NO: 502914 - DNA, 25 bp, Rattus norvegicus
tgacccagcggagccgcgaggacct

SEQ ID NO: 502915 - DNA, 25 bp, Rattus norvegicus
aagacaatgacccagcggagccgcg

SEQ ID NO: 502916 - DNA, 25 bp, Rattus norvegicus
gacaatgacccagcggagccgcgag

SEQ ID NO: 502917 - DNA, 25 bp, Rattus norvegicus
gggacactacccaccctacgagcga

SEQ ID NO: 502918 - DNA, 25 bp, Rattus norvegicus
atcgtctcatctcgtggttccctgg

SEQ ID NO: 502919 - DNA, 25 bp, Rattus norvegicus
ctgaccgcgcccatcgccgcgcgga

SEQ ID NO: 502920 - DNA, 25 bp, Rattus norvegicus
ttcccacagctgtgctcaaagagcc

SEQ ID NO: 502921 - DNA, 25 bp, Rattus norvegicus
ggacgcgcgtgctctccgggtctct

SEQ ID NO: 502922 - DNA, 25 bp, Rattus norvegicus
catctcgtggttccctgggcagctt

SEQ ID NO: 502923 - DNA, 25 bp, Rattus norvegicus
tcaaagagccgcttgcagcgccggc

SEQ ID NO: 502924 - DNA, 25 bp, Rattus norvegicus
ccgtctcatcgtctcatctcgtggt

SEQ ID NO: 502925 - DNA, 25 bp, Rattus norvegicus
agggtgtccactcccgtctcatcgt

SEQ ID NO: 502926 - DNA, 25 bp, Rattus norvegicus
tcctccactcctcagagggtgtcca

SEQ ID NO: 502927 - DNA, 25 bp, Rattus norvegicus
ggacccgaccctgcgctaggctgca

SEQ ID NO: 502928 - DNA, 25 bp, Rattus norvegicus
tgcgaagtgtaaggtgccctaccgg

SEQ ID NO: 502929 - DNA, 25 bp, Rattus norvegicus
tctccgggtctctggtgggctctcg

SEQ ID NO: 502930 - DNA, 25 bp, Rattus norvegicus
ctgcaggctgctccactccggagtc

SEQ ID NO: 502931 - DNA, 25 bp, Rattus norvegicus
ctgtgcgaagtgtaaggtgccctac

SEQ ID NO: 502932 - DNA, 25 bp, Rattus norvegicus
gaacagcgcctccatctggtaacta

SEQ ID NO: 502933 - DNA, 25 bp, Rattus norvegicus
gggcgccggagcacaatccatgcac

SEQ ID NO: 502934 - DNA, 25 bp, Rattus norvegicus
gccattagagcgctcatcgaacagc

SEQ ID NO: 502935 - DNA, 25 bp, Rattus norvegicus
tctggtaactaaggcgtcctgcttc

SEQ ID NO: 502936 - DNA, 25 bp, Rattus norvegicus
gtcgtgcgcgcgcagttcaatgacc

SEQ ID NO: 502937 - DNA, 25 bp, Rattus norvegicus
ttcaatgaccgcagtgcccgcaggc

SEQ ID NO: 502938 - DNA, 25 bp, Rattus norvegicus
ccgcaggctcattctcaggcactga

SEQ ID NO: 502939 - DNA, 25 bp, Rattus norvegicus
cactgacacctggtagctgggcagc

SEQ ID NO: 502940 - DNA, 25 bp, Rattus norvegicus
actggttaagcgacgatggcgacac

SEQ ID NO: 502941 - DNA, 25 bp, Rattus norvegicus
gaggtcgcctctactaccagctcta

SEQ ID NO: 502942 - DNA, 25 bp, Rattus norvegicus
aggcaaatgggtccgcgcctacagc

SEQ ID NO: 502943 - DNA, 25 bp, Rattus norvegicus
ccgccgccagaagccgggaaacaga

SEQ ID NO: 502944 - DNA, 25 bp, Rattus norvegicus
aacagagcgcatctccgagcccagg

SEQ ID NO: 502945 - DNA, 25 bp, Rattus norvegicus
cgcgtggtgtccaaactgtagatcc

SEQ ID NO: 502946 - DNA, 25 bp, Rattus norvegicus
tgtatgctggtgcttggttgtgccc

SEQ ID NO: 502947 - DNA, 25 bp, Rattus norvegicus
ctcgtgcgtaccacgggcgctgtgt

SEQ ID NO: 502948 - DNA, 25 bp, Rattus norvegicus
gacgccaggtcaagtatttctactc

SEQ ID NO: 502949 - DNA, 25 bp, Rattus norvegicus
tatttctactccaagcacgggtccc

SEQ ID NO: 502950 - DNA, 25 bp, Rattus norvegicus
ttcgcggaaaccgtcaagccagttc

SEQ ID NO: 502951 - DNA, 25 bp, Rattus norvegicus
ccgtcaagccagttcaccggagaga

SEQ ID NO: 502952 - DNA, 25 bp, Rattus norvegicus
gccagttcaccggagagaggtgaca

SEQ ID NO: 502953 - DNA, 25 bp, Rattus norvegicus
atcccgcagggtaagcggcgcgcac

SEQ ID NO: 502954 - DNA, 25 bp, Rattus norvegicus
acggacctgggcgacgctcgccaag

SEQ ID NO: 502955 - DNA, 25 bp, Rattus norvegicus
ctgggcgacgctcgccaagctctgt

SEQ ID NO: 502956 - DNA, 25 bp, Rattus norvegicus
gctgtgcctctctcggtggccaaca

SEQ ID NO: 502957 - DNA, 25 bp, Rattus norvegicus
tctctcggtggccaacagcggcgac

SEQ ID NO: 502958 - DNA, 25 bp, Rattus norvegicus
agcagcgcgggagcgtctcgcacac

SEQ ID NO: 502959 - DNA, 25 bp, Rattus norvegicus
ccgatcatcccgcagggtaagcggc

SEQ ID NO: 502960 - DNA, 25 bp, Rattus norvegicus
gacggcacagcgttgctgcttcacc

SEQ ID NO: 502961 - DNA, 25 bp, Rattus norvegicus
gcgtagtacttagaccgcccggcac

SEQ ID NO: 502962 - DNA, 25 bp, Rattus norvegicus
ccagaggccgcgtagtacttagacc

SEQ ID NO: 502963 - DNA, 25 bp, Rattus norvegicus
tcccagcagcgtggaaatgttgccc

SEQ ID NO: 502964 - DNA, 25 bp, Rattus norvegicus
aaaagacaggcggagtcccagcagc

SEQ ID NO: 502965 - DNA, 25 bp, Rattus norvegicus
ctgaacgacgctagtctgtggcctc

SEQ ID NO: 502966 - DNA, 25 bp, Rattus norvegicus
tagccctaggttgaggagcagaaga

SEQ ID NO: 502967 - DNA, 25 bp, Rattus norvegicus
atcgagtgctgtagccctaggttga

SEQ ID NO: 502968 - DNA, 25 bp, Rattus norvegicus
accggggctctgagtctcggattcc

SEQ ID NO: 502969 - DNA, 25 bp, Rattus norvegicus
ggtgctgcgtcacccggtacgcaga

SEQ ID NO: 502970 - DNA, 25 bp, Rattus norvegicus
ggctccaagctgacggcacagcgtt

SEQ ID NO: 502971 - DNA, 25 bp, Rattus norvegicus
gggctccgccaccagcgtagcagag

SEQ ID NO: 502972 - DNA, 25 bp, Rattus norvegicus
ggatggccacacttaccgggatcgg

SEQ ID NO: 502973 - DNA, 25 bp, Rattus norvegicus
ctggacttggggacagagaagaatc

SEQ ID NO: 502974 - DNA, 25 bp, Rattus norvegicus
cattacagcgggagaggttttccac

SEQ ID NO: 502975 - DNA, 25 bp, Rattus norvegicus
tgcctctgtgcctattcgttcttca

SEQ ID NO: 502976 - DNA, 25 bp, Rattus norvegicus
atggcgtcaagcacagcctgaaacg

SEQ ID NO: 502977 - DNA, 25 bp, Rattus norvegicus
cagcgtcgccttttcatggcgtcaa

SEQ ID NO: 502978 - DNA, 25 bp, Rattus norvegicus
agactgcattctttcctgcgcaaca

SEQ ID NO: 502979 - DNA, 25 bp, Rattus norvegicus
cggctccggaattcatagcggtcaa

SEQ ID NO: 502980 - DNA, 25 bp, Rattus norvegicus
ccgacttggtcttcagaggcacgcg

SEQ ID NO: 502981 - DNA, 25 bp, Rattus norvegicus
tgcgaacaaactaaggccgacttgg

SEQ ID NO: 502982 - DNA, 25 bp, Rattus norvegicus
tgctccttctggttctccgcacttg

SEQ ID NO: 502983 - DNA, 25 bp, Rattus norvegicus
tttactggtccgtggtcaatgccct

SEQ ID NO: 502984 - DNA, 25 bp, Rattus norvegicus
ggcggtagttgcttccttcacttta

SEQ ID NO: 502985 - DNA, 25 bp, Rattus norvegicus
tcctggtatctctgaggggccaacc

SEQ ID NO: 502986 - DNA, 25 bp, Rattus norvegicus
tccgggatcgccgagtcacaacttc

SEQ ID NO: 502987 - DNA, 25 bp, Rattus norvegicus
cgcacttgctagtgggctgcgaaca

SEQ ID NO: 502988 - DNA, 25 bp, Rattus norvegicus
ggactagccagcagggccagcatca

SEQ ID NO: 502989 - DNA, 25 bp, Rattus norvegicus
tgctcatcgcctactgcagtgagta

SEQ ID NO: 502990 - DNA, 25 bp, Rattus norvegicus
ggcaccgcggcttcaatggcgccat

SEQ ID NO: 502991 - DNA, 25 bp, Rattus norvegicus
gcgacactccctccggggacttatg

SEQ ID NO: 502992 - DNA, 25 bp, Rattus norvegicus
ttctgccttgataggaagcgggctc

SEQ ID NO: 502993 - DNA, 25 bp, Rattus norvegicus
ttgggcattcatgatcctggccagc

SEQ ID NO: 502994 - DNA, 25 bp, Rattus norvegicus
cccaggaccagcagccggcaagatg

SEQ ID NO: 502995 - DNA, 25 bp, Rattus norvegicus
cagtgagtaccgtacactcgggccc

SEQ ID NO: 502996 - DNA, 25 bp, Rattus norvegicus
ccaggctagcgaccgagcggagctt

SEQ ID NO: 502997 - DNA, 25 bp, Rattus norvegicus
ggacttatggggacgcagtaaccga

SEQ ID NO: 502998 - DNA, 25 bp, Rattus norvegicus
cagtaaccgagcctgagcgggactc

SEQ ID NO: 502999 - DNA, 25 bp, Rattus norvegicus
gactcctcgggcaggagtgccgctt

SEQ ID NO: 503000 - DNA, 25 bp, Rattus norvegicus
ttcctccgacgcgtggaggagcttc

SEQ ID NO: 503001 - DNA, 25 bp, Rattus norvegicus
gcccagcatgtcctcaactttttgg

SEQ ID NO: 503002 - DNA, 25 bp, Rattus norvegicus
ctccgggccgtgcaagttggactgc

SEQ ID NO: 503003 - DNA, 25 bp, Rattus norvegicus
ctggaccttcgcagcgcgacttcgg

SEQ ID NO: 503004 - DNA, 25 bp, Rattus norvegicus
gacacagatcgcctcccggagtggc

SEQ ID NO: 503005 - DNA, 25 bp, Rattus norvegicus
gtcggccgagttggcactccgcgat

SEQ ID NO: 503006 - DNA, 25 bp, Rattus norvegicus
cgagttggcactccgcgatgcagct

SEQ ID NO: 503007 - DNA, 25 bp, Rattus norvegicus
cctgaaggcgctctgggcactcgca

SEQ ID NO: 503008 - DNA, 25 bp, Rattus norvegicus
gctgcttcctcgtcctggtgattca

SEQ ID NO: 503009 - DNA, 25 bp, Rattus norvegicus
caaaagacacagatcgcctcccgga

SEQ ID NO: 503010 - DNA, 25 bp, Rattus norvegicus
cctggtgattcacgcgcagttcctc

SEQ ID NO: 503011 - DNA, 25 bp, Rattus norvegicus
ttcacgcgcagttcctcaaagaagg

SEQ ID NO: 503012 - DNA, 25 bp, Rattus norvegicus
gcgcagttcctcaaagaaggtaata

SEQ ID NO: 503013 - DNA, 25 bp, Rattus norvegicus
ctgatgcggcgcctggaccttcgca

SEQ ID NO: 503014 - DNA, 25 bp, Rattus norvegicus
agaaggtaatagtccccggcgcgcg

SEQ ID NO: 503015 - DNA, 25 bp, Rattus norvegicus
ccaccagcaccggagcatcagcgtc

SEQ ID NO: 503016 - DNA, 25 bp, Rattus norvegicus
ccagacccggcctctcgggcaagcc

SEQ ID NO: 503017 - DNA, 25 bp, Rattus norvegicus
gcctctaaacatggcgcctgcacct

SEQ ID NO: 503018 - DNA, 25 bp, Rattus norvegicus
ccgcgcccaccaggcctcacggcct

SEQ ID NO: 503019 - DNA, 25 bp, Rattus norvegicus
gcaagccgccggcacccatctcggc

SEQ ID NO: 503020 - DNA, 25 bp, Rattus norvegicus
cgcccgctccattctcttggccgcc

SEQ ID NO: 503021 - DNA, 25 bp, Rattus norvegicus
cccgcctcctgaaacctgccgcccg

SEQ ID NO: 503022 - DNA, 25 bp, Rattus norvegicus
gacgtgggcagacgccacgagaccc

SEQ ID NO: 503023 - DNA, 25 bp, Rattus norvegicus
cagacactcaccttcggggcgccgc

SEQ ID NO: 503024 - DNA, 25 bp, Rattus norvegicus
ggcgaacggcgaccgtcagacactc

SEQ ID NO: 503025 - DNA, 25 bp, Rattus norvegicus
ggacctatctgttacataatgcgac

SEQ ID NO: 503026 - DNA, 25 bp, Rattus norvegicus
tctgttacataatgcgaccggctcc

SEQ ID NO: 503027 - DNA, 25 bp, Rattus norvegicus
ttacataatgcgaccggctccgcac

SEQ ID NO: 503028 - DNA, 25 bp, Rattus norvegicus
ccgccaaggctacaggcgaggacgt

SEQ ID NO: 503029 - DNA, 25 bp, Rattus norvegicus
tcggccttctcagttcctccggctc

SEQ ID NO: 503030 - DNA, 25 bp, Rattus norvegicus
cagcgaccagacctcgtgtgtgaga

SEQ ID NO: 503031 - DNA, 25 bp, Rattus norvegicus
tgaaggaccaccctaacggccaagc

SEQ ID NO: 503032 - DNA, 25 bp, Rattus norvegicus
ccagccgttggaagagtgaaggacc

SEQ ID NO: 503033 - DNA, 25 bp, Rattus norvegicus
gcgcctgcgtagtcttcggacgcta

SEQ ID NO: 503034 - DNA, 25 bp, Rattus norvegicus
attgcgcctgcgtagttttcgcggc

SEQ ID NO: 503035 - DNA, 25 bp, Rattus norvegicus
cttcggacgctatcctgacagggca

SEQ ID NO: 503036 - DNA, 25 bp, Rattus norvegicus
aacgcgtggcaattccaaccaaccg

SEQ ID NO: 503037 - DNA, 25 bp, Rattus norvegicus
gctaaggggaaattgcgcctgcgta

SEQ ID NO: 503038 - DNA, 25 bp, Rattus norvegicus
gtttgacgaaggaggccagcgacca

SEQ ID NO: 503039 - DNA, 25 bp, Rattus norvegicus
tcagaagaaaccacggaggacgcgc

SEQ ID NO: 503040 - DNA, 25 bp, Rattus norvegicus
gcgcgctcccaaacgcgtggcaatt

SEQ ID NO: 503041 - DNA, 25 bp, Rattus norvegicus
gaccgcgcttgcgtggtttgacgaa

SEQ ID NO: 503042 - DNA, 25 bp, Rattus norvegicus
agactgcgccggagtaacctgaccc

SEQ ID NO: 503043 - DNA, 25 bp, Rattus norvegicus
cctaacggccaagccctcagaagaa

SEQ ID NO: 503044 - DNA, 25 bp, Rattus norvegicus
gacacgggtcggtgtcacgcttctt

SEQ ID NO: 503045 - DNA, 25 bp, Rattus norvegicus
aagcggctaatgaatgggcgcgccc

SEQ ID NO: 503046 - DNA, 25 bp, Rattus norvegicus
ccgttggatctttcgtcaggtgccc

SEQ ID NO: 503047 - DNA, 25 bp, Rattus norvegicus
ctcgctctgtgtctggagatttctc

SEQ ID NO: 503048 - DNA, 25 bp, Rattus norvegicus
tcacgcttcttggtgcctgactgca

SEQ ID NO: 503049 - DNA, 25 bp, Rattus norvegicus
gtgcctgactgcagcgtgtgcttct

SEQ ID NO: 503050 - DNA, 25 bp, Rattus norvegicus
tctgaccgcggaggcttaacgaaac

SEQ ID NO: 503051 - DNA, 25 bp, Rattus norvegicus
cgaaacttaactcacgccttggctc

SEQ ID NO: 503052 - DNA, 25 bp, Rattus norvegicus
tccgcagcgtcttcacgggtgctac

SEQ ID NO: 503053 - DNA, 25 bp, Rattus norvegicus
cgggtgctacctgccatcatttttg

SEQ ID NO: 503054 - DNA, 25 bp, Rattus norvegicus
ttgtcctttttggtgcgacccactc

SEQ ID NO: 503055 - DNA, 25 bp, Rattus norvegicus
acccactctctgctggggtggctgc

SEQ ID NO: 503056 - DNA, 25 bp, Rattus norvegicus
tggagatttctcacgaggctcgagc

SEQ ID NO: 503057 - DNA, 25 bp, Rattus norvegicus
cgcaggacacttcagtggcgtcttc

SEQ ID NO: 503058 - DNA, 25 bp, Rattus norvegicus
tcaattggtccacatcaggcagggg

SEQ ID NO: 503059 - DNA, 25 bp, Rattus norvegicus
cccgaacttaacatggccaccattg

SEQ ID NO: 503060 - DNA, 25 bp, Rattus norvegicus
caccattgctcaagctggccacaga

SEQ ID NO: 503061 - DNA, 25 bp, Rattus norvegicus
tcccgcccggagaaaagatggccgc

SEQ ID NO: 503062 - DNA, 25 bp, Rattus norvegicus
cggggcaagaagaccggatagatta

SEQ ID NO: 503063 - DNA, 25 bp, Rattus norvegicus
acggttccgcctcattctcgcggga

SEQ ID NO: 503064 - DNA, 25 bp, Rattus norvegicus
tccgaccaatagaaacgcgcagtgt

SEQ ID NO: 503065 - DNA, 25 bp, Rattus norvegicus
cgttgcagtcaagtagcccggggaa

SEQ ID NO: 503066 - DNA, 25 bp, Rattus norvegicus
tccaagaagccgacacagtgccaga

SEQ ID NO: 503067 - DNA, 25 bp, Rattus norvegicus
gggttcacagtggaccatcgagctg

SEQ ID NO: 503068 - DNA, 25 bp, Rattus norvegicus
acctcttctgcaggggatggccaac

SEQ ID NO: 503069 - DNA, 25 bp, Rattus norvegicus
ggccaacacggccaggaagaatttc

SEQ ID NO: 503070 - DNA, 25 bp, Rattus norvegicus
ttctcgtggcgagcctcaattggtc

SEQ ID NO: 503071 - DNA, 25 bp, Rattus norvegicus
gctttctcattggtggcttctcgtg

SEQ ID NO: 503072 - DNA, 25 bp, Rattus norvegicus
agtcccacactgcagcatgctatca

SEQ ID NO: 503073 - DNA, 25 bp, Rattus norvegicus
tatctagcagcacaggcgaaggccc

SEQ ID NO: 503074 - DNA, 25 bp, Rattus norvegicus
cagcgaggacaatctatctagcagc

SEQ ID NO: 503075 - DNA, 25 bp, Rattus norvegicus
ctctgggaacggaagggcgccacct

SEQ ID NO: 503076 - DNA, 25 bp, Rattus norvegicus
atgctatcagcgaggacaatctatc

SEQ ID NO: 503077 - DNA, 25 bp, Rattus norvegicus
tatctccgtgaaggccgcccagcgg

SEQ ID NO: 503078 - DNA, 25 bp, Rattus norvegicus
ctgcagcatgctatcagcgaggaca

SEQ ID NO: 503079 - DNA, 25 bp, Rattus norvegicus
tggcacctgccacagagcgcagcag

SEQ ID NO: 503080 - DNA, 25 bp, Rattus norvegicus
tgtccctgcactcgttgagcgaagc

SEQ ID NO: 503081 - DNA, 25 bp, Rattus norvegicus
tcgttgagcgaagctgatgacgttc

SEQ ID NO: 503082 - DNA, 25 bp, Rattus norvegicus
gcgaagctgatgacgttcgtccacc

SEQ ID NO: 503083 - DNA, 25 bp, Rattus norvegicus
atgacgttcgtccaccgggtccact

SEQ ID NO: 503084 - DNA, 25 bp, Rattus norvegicus
accgggtccactggcctgcaagcgg

SEQ ID NO: 503085 - DNA, 25 bp, Rattus norvegicus
gaccaagtgtatctccgtgaaggcc

SEQ ID NO: 503086 - DNA, 25 bp, Rattus norvegicus
tcctggaagcagttgccgctgaggt

SEQ ID NO: 503087 - DNA, 25 bp, Rattus norvegicus
cacctctgcaagttctcgatctcgg

SEQ ID NO: 503088 - DNA, 25 bp, Rattus norvegicus
tcagcgtcagcagctcgggtcccag

SEQ ID NO: 503089 - DNA, 25 bp, Rattus norvegicus
ccttggccgccagagtaaacagctc

SEQ ID NO: 503090 - DNA, 25 bp, Rattus norvegicus
gcgggccgctcgctttttatattcg

SEQ ID NO: 503091 - DNA, 25 bp, Rattus norvegicus
atagtctgagggagctaggctcgcc

SEQ ID NO: 503092 - DNA, 25 bp, Rattus norvegicus
cttcaacacagtgccacggagctcg

SEQ ID NO: 503093 - DNA, 25 bp, Rattus norvegicus
tctgcagctggttgcctcccaggct

SEQ ID NO: 503094 - DNA, 25 bp, Rattus norvegicus
ccgagccggttgttcctggccagca

SEQ ID NO: 503095 - DNA, 25 bp, Rattus norvegicus
ttgccgctcacgtccaggagctgga

SEQ ID NO: 503096 - DNA, 25 bp, Rattus norvegicus
tggcagcgacgtcagacggttatac

SEQ ID NO: 503097 - DNA, 25 bp, Rattus norvegicus
cagacggttatacggcagcagcagc

SEQ ID NO: 503098 - DNA, 25 bp, Rattus norvegicus
gcctggtgctcactggatagtctga

SEQ ID NO: 503099 - DNA, 25 bp, Rattus norvegicus
cggacctcacgtagcgagccggaag

SEQ ID NO: 503100 - DNA, 25 bp, Rattus norvegicus
cgtgcagtactaccctgtcgtcatc

SEQ ID NO: 503101 - DNA, 25 bp, Rattus norvegicus
ctgtcgtcatcttctgtgctccgga

SEQ ID NO: 503102 - DNA, 25 bp, Rattus norvegicus
cgtcatcttctgtgctccggagagc

SEQ ID NO: 503103 - DNA, 25 bp, Rattus norvegicus
tccggagagccggtcagcgctcaag

SEQ ID NO: 503104 - DNA, 25 bp, Rattus norvegicus
ggtcagcgctcaaggcccttcgcga

SEQ ID NO: 503105 - DNA, 25 bp, Rattus norvegicus
cgctcaaggcccttcgcgagtggct

SEQ ID NO: 503106 - DNA, 25 bp, Rattus norvegicus
aaggcccttcgcgagtggctggccc

SEQ ID NO: 503107 - DNA, 25 bp, Rattus norvegicus
agcagccgccgcctgtatgcgcagg

SEQ ID NO: 503108 - DNA, 25 bp, Rattus norvegicus
cgcaggcccagaagctgcagaaaca

SEQ ID NO: 503109 - DNA, 25 bp, Rattus norvegicus
acctcttcaccggtgcgcggaggtg

SEQ ID NO: 503110 - DNA, 25 bp, Rattus norvegicus
ctcaactacgtgcagtactaccctg

SEQ ID NO: 503111 - DNA, 25 bp, Rattus norvegicus
gagcgcctcaactacgtgcagtact

SEQ ID NO: 503112 - DNA, 25 bp, Rattus norvegicus
tactaccctgtcgtcatcttctgtg

SEQ ID NO: 503113 - DNA, 25 bp, Rattus norvegicus
gctgcagaaacacagtggccacctc

SEQ ID NO: 503114 - DNA, 25 bp, Rattus norvegicus
tgcgccctttcttgtgtgcctgggc

SEQ ID NO: 503115 - DNA, 25 bp, Rattus norvegicus
aatctgagtcgcgtgtcccgccctt

SEQ ID NO: 503116 - DNA, 25 bp, Rattus norvegicus
tggtcctgtggttcccgcaggagat

SEQ ID NO: 503117 - DNA, 25 bp, Rattus norvegicus
gaccttcctggaaagcacttggcta

SEQ ID NO: 503118 - DNA, 25 bp, Rattus norvegicus
ccagctctttcagggcgaaggccac

SEQ ID NO: 503119 - DNA, 25 bp, Rattus norvegicus
cacttggctacaaatgaccgtcgta

SEQ ID NO: 503120 - DNA, 25 bp, Rattus norvegicus
actcacaggggatcggtgaatctga

SEQ ID NO: 503121 - DNA, 25 bp, Rattus norvegicus
cagcgaagctgggaaaggaatactg

SEQ ID NO: 503122 - DNA, 25 bp, Rattus norvegicus
gcacaaccggttcaggccctgggaa

SEQ ID NO: 503123 - DNA, 25 bp, Rattus norvegicus
tccagatgcgctacaacgcgggttg

SEQ ID NO: 503124 - DNA, 25 bp, Rattus norvegicus
gtgcagcaagcttgagatccagatg

SEQ ID NO: 503125 - DNA, 25 bp, Rattus norvegicus
gggtccgccactttgagacacagtg

SEQ ID NO: 503126 - DNA, 25 bp, Rattus norvegicus
caaatgaccgtcgtaggcgggcgct

SEQ ID NO: 503127 - DNA, 25 bp, Rattus norvegicus
gggcgaaggccacgaccttcctgga

SEQ ID NO: 503128 - DNA, 25 bp, Rattus norvegicus
agccacaccgcaaagtgagcctcgg

SEQ ID NO: 503129 - DNA, 25 bp, Rattus norvegicus
gaggggctttgggacatcaccaacg

SEQ ID NO: 503130 - DNA, 25 bp, Rattus norvegicus
tgaagatcctacagccaggtatgtg

SEQ ID NO: 503131 - DNA, 25 bp, Rattus norvegicus
cgtggaccacctcccagtgaagatc

SEQ ID NO: 503132 - DNA, 25 bp, Rattus norvegicus
atgctgctgtccaagttcggctccc

SEQ ID NO: 503133 - DNA, 25 bp, Rattus norvegicus
ggatacgtgtctccgcggtccaaaa

SEQ ID NO: 503134 - DNA, 25 bp, Rattus norvegicus
ccagcccttggtgaaccgacaggga

SEQ ID NO: 503135 - DNA, 25 bp, Rattus norvegicus
tccgcgactctactacggcaagcta

SEQ ID NO: 503136 - DNA, 25 bp, Rattus norvegicus
cgtagaacgctgtgatcctccgcga

SEQ ID NO: 503137 - DNA, 25 bp, Rattus norvegicus
agcgcgctgtggaaagccgtagaac

SEQ ID NO: 503138 - DNA, 25 bp, Rattus norvegicus
gccacgaacgcccacgagaaacgag

SEQ ID NO: 503139 - DNA, 25 bp, Rattus norvegicus
ccaacgggattgtgtgtcccacagc

SEQ ID NO: 503140 - DNA, 25 bp, Rattus norvegicus
acctcgattttcattggcttatgcg

SEQ ID NO: 503141 - DNA, 25 bp, Rattus norvegicus
tagtatcagtgaaggcctcagagcc

SEQ ID NO: 503142 - DNA, 25 bp, Rattus norvegicus
aggtcacacggaagccctgcgagga

SEQ ID NO: 503143 - DNA, 25 bp, Rattus norvegicus
gcagaaggcgccctgcggtatcaag

SEQ ID NO: 503144 - DNA, 25 bp, Rattus norvegicus
gtctatgtgtcggttcccgcagaga

SEQ ID NO: 503145 - DNA, 25 bp, Rattus norvegicus
ggttcccgcagagacgccatgatct

SEQ ID NO: 503146 - DNA, 25 bp, Rattus norvegicus
cacacggaagccctgcgaggaaagg

SEQ ID NO: 503147 - DNA, 25 bp, Rattus norvegicus
cgcttggaggtcacacggaagccct

SEQ ID NO: 503148 - DNA, 25 bp, Rattus norvegicus
taggcacggcgcttggaggtcacac

SEQ ID NO: 503149 - DNA, 25 bp, Rattus norvegicus
gcgggcggaagccacagcaaactag

SEQ ID NO: 503150 - DNA, 25 bp, Rattus norvegicus
agacgccatgatctgggggcgtctc

SEQ ID NO: 503151 - DNA, 25 bp, Rattus norvegicus
aggcgccctgcggtatcaaggcgca

SEQ ID NO: 503152 - DNA, 25 bp, Rattus norvegicus
gtctcggtccggtcttcgtcctcat

SEQ ID NO: 503153 - DNA, 25 bp, Rattus norvegicus
gtccggtcttcgtcctcatcctggt

SEQ ID NO: 503154 - DNA, 25 bp, Rattus norvegicus
gtcctcatcctggtcctcgtcctgg

SEQ ID NO: 503155 - DNA, 25 bp, Rattus norvegicus
ctatgtgtcggttcccgcagagacg

SEQ ID NO: 503156 - DNA, 25 bp, Rattus norvegicus
agggcacccgagacgcagtccggac

SEQ ID NO: 503157 - DNA, 25 bp, Rattus norvegicus
acagcggcgcaaagagggcacccga

SEQ ID NO: 503158 - DNA, 25 bp, Rattus norvegicus
ttccgagcaccggataggaggggac

SEQ ID NO: 503159 - DNA, 25 bp, Rattus norvegicus
cctggcgcgtctgagggcagacagt

SEQ ID NO: 503160 - DNA, 25 bp, Rattus norvegicus
cagacagtgctcacctgggacccgc

SEQ ID NO: 503161 - DNA, 25 bp, Rattus norvegicus
atgcattgtgcagacccgtggcgct

SEQ ID NO: 503162 - DNA, 25 bp, Rattus norvegicus
gctgcgtgaaagaggaatccgctga

SEQ ID NO: 503163 - DNA, 25 bp, Rattus norvegicus
cggccaggcgtcttgcggttgccca

SEQ ID NO: 503164 - DNA, 25 bp, Rattus norvegicus
gaatccgctgacagcggcgcaaaga

SEQ ID NO: 503165 - DNA, 25 bp, Rattus norvegicus
ttgcctgcgcgatgcattgtgcaga

SEQ ID NO: 503166 - DNA, 25 bp, Rattus norvegicus
agggcaaccggccttgcctgcgcga

SEQ ID NO: 503167 - DNA, 25 bp, Rattus norvegicus
gacccgccctacagcgcgtgctgcg

SEQ ID NO: 503168 - DNA, 25 bp, Rattus norvegicus
cgtcttgcggttgcccagggcaacc

SEQ ID NO: 503169 - DNA, 25 bp, Rattus norvegicus
gcgcgatgcattgtgcagacccgtg

SEQ ID NO: 503170 - DNA, 25 bp, Rattus norvegicus
atcctgctggtcaccctggtcttca

SEQ ID NO: 503171 - DNA, 25 bp, Rattus norvegicus
tcctgcctggctcgcaggacgacaa

SEQ ID NO: 503172 - DNA, 25 bp, Rattus norvegicus
tgcagctcaagctggaactgccgtt

SEQ ID NO: 503173 - DNA, 25 bp, Rattus norvegicus
caagctggaactgccgttcgaccgc

SEQ ID NO: 503174 - DNA, 25 bp, Rattus norvegicus
ttcgaccgcgtggtcaccatcggca

SEQ ID NO: 503175 - DNA, 25 bp, Rattus norvegicus
ggtcaccatcggcaccgtgctggta

SEQ ID NO: 503176 - DNA, 25 bp, Rattus norvegicus
aggcagccagttcagctggaccgca

SEQ ID NO: 503177 - DNA, 25 bp, Rattus norvegicus
tggtcttcaccaagaacttcgcagg

SEQ ID NO: 503178 - DNA, 25 bp, Rattus norvegicus
ccaagaacttcgcaggtgaggcagg

SEQ ID NO: 503179 - DNA, 25 bp, Rattus norvegicus
cgcttcggcaggtgttgagcgccca

SEQ ID NO: 503180 - DNA, 25 bp, Rattus norvegicus
tgttgagcgcccagcgctacgagcg

SEQ ID NO: 503181 - DNA, 25 bp, Rattus norvegicus
ctacgagcgcgccaggcagccagtt

SEQ ID NO: 503182 - DNA, 25 bp, Rattus norvegicus
acctggccaagcgttgaggcactgc

SEQ ID NO: 503183 - DNA, 25 bp, Rattus norvegicus
gtgctggtacccatcctgctggtca

SEQ ID NO: 503184 - DNA, 25 bp, Rattus norvegicus
acatcctggccatgttctgtaacga

SEQ ID NO: 503185 - DNA, 25 bp, Rattus norvegicus
gccatcatgtatgtgcccgcactgg

SEQ ID NO: 503186 - DNA, 25 bp, Rattus norvegicus
tcctgcttcaggagatcgacaactg

SEQ ID NO: 503187 - DNA, 25 bp, Rattus norvegicus
agccctgagcagaatttgtttgaga

SEQ ID NO: 503188 - DNA, 25 bp, Rattus norvegicus
gcagcaacttcttggccaagctgta

SEQ ID NO: 503189 - DNA, 25 bp, Rattus norvegicus
cggcacgtactgatcctgctactca

SEQ ID NO: 503190 - DNA, 25 bp, Rattus norvegicus
ctgctactcagtgtggtgcccatct

SEQ ID NO: 503191 - DNA, 25 bp, Rattus norvegicus
tgcacaaggtgggtatcaagacgcg

SEQ ID NO: 503192 - DNA, 25 bp, Rattus norvegicus
acatcaagtcgcttaaccggctgga

SEQ ID NO: 503193 - DNA, 25 bp, Rattus norvegicus
tggctgccttggctcagtctaacca

SEQ ID NO: 503194 - DNA, 25 bp, Rattus norvegicus
cggctggacttcatcaccaacgaga

SEQ ID NO: 503195 - DNA, 25 bp, Rattus norvegicus
gagcgacctcatgtacgacaacgtg

SEQ ID NO: 503196 - DNA, 25 bp, Rattus norvegicus
ggccatcgctgtttgagcacaagtt

SEQ ID NO: 503197 - DNA, 25 bp, Rattus norvegicus
gtggacatcgtattgctctgcttca

SEQ ID NO: 503198 - DNA, 25 bp, Rattus norvegicus
agtcgcacagattcggctttggggc

SEQ ID NO: 503199 - DNA, 25 bp, Rattus norvegicus
cctcgctcggtacgccgtggcctga

SEQ ID NO: 503200 - DNA, 25 bp, Rattus norvegicus
cgcaccctcggcctgtccggcccgt

SEQ ID NO: 503201 - DNA, 25 bp, Rattus norvegicus
ggtgtttcccggcatgctccgcggc

SEQ ID NO: 503202 - DNA, 25 bp, Rattus norvegicus
cctgggaggtgtttcccggcatgct

SEQ ID NO: 503203 - DNA, 25 bp, Rattus norvegicus
ctctcggttgcgctctaggacctgg

SEQ ID NO: 503204 - DNA, 25 bp, Rattus norvegicus
cacagattcggctttggggccaaca

SEQ ID NO: 503205 - DNA, 25 bp, Rattus norvegicus
aacgcagccgagtcgcacagattcg

SEQ ID NO: 503206 - DNA, 25 bp, Rattus norvegicus
ttaaagaacgcagccgagtcgcaca

SEQ ID NO: 503207 - DNA, 25 bp, Rattus norvegicus
gacgcttaaagaacgcagccgagtc

SEQ ID NO: 503208 - DNA, 25 bp, Rattus norvegicus
ggccatcctgcggacgcttaaagaa

SEQ ID NO: 503209 - DNA, 25 bp, Rattus norvegicus
gtgccctgacggctccctagactcc

SEQ ID NO: 503210 - DNA, 25 bp, Rattus norvegicus
acaccctcgagcctgctctcggttg

SEQ ID NO: 503211 - DNA, 25 bp, Rattus norvegicus
tttggggccaacaccctcgagcctg

SEQ ID NO: 503212 - DNA, 25 bp, Rattus norvegicus
cgacgcggcgaatggcctctttcag

SEQ ID NO: 503213 - DNA, 25 bp, Rattus norvegicus
agttcccaagcgatatacccttctg

SEQ ID NO: 503214 - DNA, 25 bp, Rattus norvegicus
acggccttctccaggtgcggaagtc

SEQ ID NO: 503215 - DNA, 25 bp, Rattus norvegicus
acggtgccgccatgtacctgggcga

SEQ ID NO: 503216 - DNA, 25 bp, Rattus norvegicus
accagttcggtcagttcgctgggca

SEQ ID NO: 503217 - DNA, 25 bp, Rattus norvegicus
cgcactgctactgtggacaccagtt

SEQ ID NO: 503218 - DNA, 25 bp, Rattus norvegicus
cgctcttcttcagcggcaatgcgct

SEQ ID NO: 503219 - DNA, 25 bp, Rattus norvegicus
gaggccgaagctgcgctcttcttca

SEQ ID NO: 503220 - DNA, 25 bp, Rattus norvegicus
tgtcagagcccgcactggcgctgct

SEQ ID NO: 503221 - DNA, 25 bp, Rattus norvegicus
agccacgtctagtggcgctgtcaga

SEQ ID NO: 503222 - DNA, 25 bp, Rattus norvegicus
ggagcctgcttcagccgtgcacggc

SEQ ID NO: 503223 - DNA, 25 bp, Rattus norvegicus
gaggctgcgcttcgacaaccgtgcc

SEQ ID NO: 503224 - DNA, 25 bp, Rattus norvegicus
gagcttcagtcgtccgcgccctggt

SEQ ID NO: 503225 - DNA, 25 bp, Rattus norvegicus
ggccacagtgtgtcggcctcgagct

SEQ ID NO: 503226 - DNA, 25 bp, Rattus norvegicus
ccgggaactgtgcatctccgtctcg

SEQ ID NO: 503227 - DNA, 25 bp, Rattus norvegicus
gcatctccgtctcgggtttcgcagt

SEQ ID NO: 503228 - DNA, 25 bp, Rattus norvegicus
cgggtctcctgaaccatgacaagtc

SEQ ID NO: 503229 - DNA, 25 bp, Rattus norvegicus
gacaagtctaccaaccgaatgcgtg

SEQ ID NO: 503230 - DNA, 25 bp, Rattus norvegicus
cgaatgcgtgggtcccatgacctgc

SEQ ID NO: 503231 - DNA, 25 bp, Rattus norvegicus
atgacctgcctgcaagcccaggacg

SEQ ID NO: 503232 - DNA, 25 bp, Rattus norvegicus
gcccaggacgccagaactgggactc

SEQ ID NO: 503233 - DNA, 25 bp, Rattus norvegicus
agaactgggactcccgccgctctgg

SEQ ID NO: 503234 - DNA, 25 bp, Rattus norvegicus
ccgctctggcgtcacacttaggcga

SEQ ID NO: 503235 - DNA, 25 bp, Rattus norvegicus
taggcgacggcagacaacaccaaga

SEQ ID NO: 503236 - DNA, 25 bp, Rattus norvegicus
aacaccaagagacgcaccggaagtg

SEQ ID NO: 503237 - DNA, 25 bp, Rattus norvegicus
aagtgcgtcatcataggcggtcgtt

SEQ ID NO: 503238 - DNA, 25 bp, Rattus norvegicus
gaccgcttcacacccgggaactgtg

SEQ ID NO: 503239 - DNA, 25 bp, Rattus norvegicus
tcgcagtgcaagaggccacacgccg

SEQ ID NO: 503240 - DNA, 25 bp, Rattus norvegicus
atctcaagagaaggcacggggtgtc

SEQ ID NO: 503241 - DNA, 25 bp, Rattus norvegicus
aactcttggccgctggggctcaaac

SEQ ID NO: 503242 - DNA, 25 bp, Rattus norvegicus
tagctgcggactgcagcggcaaccg

SEQ ID NO: 503243 - DNA, 25 bp, Rattus norvegicus
cgatggtcaccagcgcgagcgccag

SEQ ID NO: 503244 - DNA, 25 bp, Rattus norvegicus
cagccagcgtttccacatctgcgga

SEQ ID NO: 503245 - DNA, 25 bp, Rattus norvegicus
tccacatctgcggaagagagaagag

SEQ ID NO: 503246 - DNA, 25 bp, Rattus norvegicus
ggccctgctcagaccctagaaactt

SEQ ID NO: 503247 - DNA, 25 bp, Rattus norvegicus
tagaaacttcttcgggtcccgcaga

SEQ ID NO: 503248 - DNA, 25 bp, Rattus norvegicus
tcgccgatcaccaggcgccgaggaa

SEQ ID NO: 503249 - DNA, 25 bp, Rattus norvegicus
tacctcgccgtggaccagggcgatg

SEQ ID NO: 503250 - DNA, 25 bp, Rattus norvegicus
ccaagaatcctcagatatctcaaga

SEQ ID NO: 503251 - DNA, 25 bp, Rattus norvegicus
tgtctcaggggtccctgcaacaaag

SEQ ID NO: 503252 - DNA, 25 bp, Rattus norvegicus
cagcaggaactagctgcggactgca

SEQ ID NO: 503253 - DNA, 25 bp, Rattus norvegicus
gcaggcatccatgtcctctcctaga

SEQ ID NO: 503254 - DNA, 25 bp, Rattus norvegicus
acgggctttggactcacgttctcgt

SEQ ID NO: 503255 - DNA, 25 bp, Rattus norvegicus
ggtcgccaccctgaactctgtatag

SEQ ID NO: 503256 - DNA, 25 bp, Rattus norvegicus
gggctttcctttgcgggctcttctc

SEQ ID NO: 503257 - DNA, 25 bp, Rattus norvegicus
agcaccgcgctctaggaccggactt

SEQ ID NO: 503258 - DNA, 25 bp, Rattus norvegicus
cctcctggcggtaaaagcccttgcg

SEQ ID NO: 503259 - DNA, 25 bp, Rattus norvegicus
ccaggccgttttggtcacctcctgg

SEQ ID NO: 503260 - DNA, 25 bp, Rattus norvegicus
caacgggctgcaggtcctggtacac

SEQ ID NO: 503261 - DNA, 25 bp, Rattus norvegicus
tgcaccataggcaccagagccaacg

SEQ ID NO: 503262 - DNA, 25 bp, Rattus norvegicus
atggccaccttgttgccagtgcggc

SEQ ID NO: 503263 - DNA, 25 bp, Rattus norvegicus
gaagggccggtacaacttcttgatg

SEQ ID NO: 503264 - DNA, 25 bp, Rattus norvegicus
cgcgcttggcaaacagctccgactg

SEQ ID NO: 503265 - DNA, 25 bp, Rattus norvegicus
caactctctgtaggcgcgcttggca

SEQ ID NO: 503266 - DNA, 25 bp, Rattus norvegicus
ctgaactctgtatagccgccaactc

SEQ ID NO: 503267 - DNA, 25 bp, Rattus norvegicus
tgtgtttgaggaggcgcaactctct

SEQ ID NO: 503268 - DNA, 25 bp, Rattus norvegicus
tggttccgttgatggcagtgacacg

SEQ ID NO: 503269 - DNA, 25 bp, Rattus norvegicus
ttccgttgatggcagtgacacggtc

SEQ ID NO: 503270 - DNA, 25 bp, Rattus norvegicus
tgacacggtcccctatgctcagggc

SEQ ID NO: 503271 - DNA, 25 bp, Rattus norvegicus
ccgttgatggcagtgacacggtccc

SEQ ID NO: 503272 - DNA, 25 bp, Rattus norvegicus
gccgcttctggatgcaaacctgggg

SEQ ID NO: 503273 - DNA, 25 bp, Rattus norvegicus
caatgaccgcggtgggcagcagcga

SEQ ID NO: 503274 - DNA, 25 bp, Rattus norvegicus
caccaggctggttccgttgatggca

SEQ ID NO: 503275 - DNA, 25 bp, Rattus norvegicus
ccagcctgactcaaccagcgcgaca

SEQ ID NO: 503276 - DNA, 25 bp, Rattus norvegicus
aaccagcgcgacacccaggccctcc

SEQ ID NO: 503277 - DNA, 25 bp, Rattus norvegicus
ccaggccgcttctggatgcaaacct

SEQ ID NO: 503278 - DNA, 25 bp, Rattus norvegicus
aggccgcttctggatgcaaacctgg

SEQ ID NO: 503279 - DNA, 25 bp, Rattus norvegicus
cccaccaggctggttccgttgatgg

SEQ ID NO: 503280 - DNA, 25 bp, Rattus norvegicus
gctggttccgttgatggcagtgaca

SEQ ID NO: 503281 - DNA, 25 bp, Rattus norvegicus
cccgtggaggaggttggcaatgacc

SEQ ID NO: 503282 - DNA, 25 bp, Rattus norvegicus
aggacactcacacttcgctgaaatc

SEQ ID NO: 503283 - DNA, 25 bp, Rattus norvegicus
ctccaagacctaggaggcatgtccc

SEQ ID NO: 503284 - DNA, 25 bp, Rattus norvegicus
cgagcctctgctactgactccaaga

SEQ ID NO: 503285 - DNA, 25 bp, Rattus norvegicus
agcctgagtccacccgacgctgtgg

SEQ ID NO: 503286 - DNA, 25 bp, Rattus norvegicus
gaaagggcgagacagcttcttcaca

SEQ ID NO: 503287 - DNA, 25 bp, Rattus norvegicus
tcctcctcgcgtggatcagcgattg

SEQ ID NO: 503288 - DNA, 25 bp, Rattus norvegicus
gtagctcacggtatgtcctcctcgc

SEQ ID NO: 503289 - DNA, 25 bp, Rattus norvegicus
tcaggtgtttgagtaggcgtagctc

SEQ ID NO: 503290 - DNA, 25 bp, Rattus norvegicus
acgttctcgtgcttcaggtgtttga

SEQ ID NO: 503291 - DNA, 25 bp, Rattus norvegicus
ccaccaagaggcgtccgtcgttcag

SEQ ID NO: 503292 - DNA, 25 bp, Rattus norvegicus
gaggcgggacaacagctcagctgta

SEQ ID NO: 503293 - DNA, 25 bp, Rattus norvegicus
ctatgacctggtcagggaaccgagg

SEQ ID NO: 503294 - DNA, 25 bp, Rattus norvegicus
gccggcgtgaagacgtccaaaagtc

SEQ ID NO: 503295 - DNA, 25 bp, Rattus norvegicus
aaatcctcgatggatgtggccggcg

SEQ ID NO: 503296 - DNA, 25 bp, Rattus norvegicus
agctcttgccggtagaatcccgcgc

SEQ ID NO: 503297 - DNA, 25 bp, Rattus norvegicus
tggagggtcgcgcacactttcccgc

SEQ ID NO: 503298 - DNA, 25 bp, Rattus norvegicus
tgccggtagaatcccgcgcgcggac

SEQ ID NO: 503299 - DNA, 25 bp, Rattus norvegicus
gacccgacatatccgcagaggcagc

SEQ ID NO: 503300 - DNA, 25 bp, Rattus norvegicus
catatccgcagaggcagctggagcg

SEQ ID NO: 503301 - DNA, 25 bp, Rattus norvegicus
gcccagcaccgctgagcaaagcggg

SEQ ID NO: 503302 - DNA, 25 bp, Rattus norvegicus
gcgcggacccgacatatccgcagag

SEQ ID NO: 503303 - DNA, 25 bp, Rattus norvegicus
ttgttcagctcttgccggtagaatc

SEQ ID NO: 503304 - DNA, 25 bp, Rattus norvegicus
cccatactgttttgttcagctcttg

SEQ ID NO: 503305 - DNA, 25 bp, Rattus norvegicus
ggcacctcccatactgttttgttca

SEQ ID NO: 503306 - DNA, 25 bp, Rattus norvegicus
tgcggcacctcccatactgttttgt

SEQ ID NO: 503307 - DNA, 25 bp, Rattus norvegicus
ctaccagaccgagccgtaggcgccg

SEQ ID NO: 503308 - DNA, 25 bp, Rattus norvegicus
tcgcgctggagggtcgcgcacactt

SEQ ID NO: 503309 - DNA, 25 bp, Rattus norvegicus
agcccaccgggcgtaggccctgcag

SEQ ID NO: 503310 - DNA, 25 bp, Rattus norvegicus
acgcacaatgaactcggggaggttg

SEQ ID NO: 503311 - DNA, 25 bp, Rattus norvegicus
cggcctagcacccactctcgagagc

SEQ ID NO: 503312 - DNA, 25 bp, Rattus norvegicus
tcgctcgcacgtgtgtcgtactcca

SEQ ID NO: 503313 - DNA, 25 bp, Rattus norvegicus
tctcgagagccaaacttcacctgtg

SEQ ID NO: 503314 - DNA, 25 bp, Rattus norvegicus
aacttcacctgtgtggaagccaggg

SEQ ID NO: 503315 - DNA, 25 bp, Rattus norvegicus
cggtggcttctcctgagagggtccc

SEQ ID NO: 503316 - DNA, 25 bp, Rattus norvegicus
gtgtgtcgtactccacccggcctag

SEQ ID NO: 503317 - DNA, 25 bp, Rattus norvegicus
atgcaacgctcagcacccacaaatg

SEQ ID NO: 503318 - DNA, 25 bp, Rattus norvegicus
aggttgtgtgctgtgtctcgcttct

SEQ ID NO: 503319 - DNA, 25 bp, Rattus norvegicus
tgtgtctcgcttctgccgccgcttg

SEQ ID NO: 503320 - DNA, 25 bp, Rattus norvegicus
cgcagtacaggtcggtctcagtcag

SEQ ID NO: 503321 - DNA, 25 bp, Rattus norvegicus
tcggtctcagtcagcgtcttcataa

SEQ ID NO: 503322 - DNA, 25 bp, Rattus norvegicus
cgtcttcataatgcaacgctcagca

SEQ ID NO: 503323 - DNA, 25 bp, Rattus norvegicus
gccctcacgcacaatgaactcgggg

SEQ ID NO: 503324 - DNA, 25 bp, Rattus norvegicus
ttagctgcgagcgttaaacaaatca

SEQ ID NO: 503325 - DNA, 25 bp, Rattus norvegicus
tacaatccaggaggctaggtcagtc

SEQ ID NO: 503326 - DNA, 25 bp, Rattus norvegicus
ggggcatcctctctcggaaggctac

SEQ ID NO: 503327 - DNA, 25 bp, Rattus norvegicus
ggaaggctacgaaaatctgcaatta

SEQ ID NO: 503328 - DNA, 25 bp, Rattus norvegicus
ctcctccgggatcgcaagacggtta

SEQ ID NO: 503329 - DNA, 25 bp, Rattus norvegicus
gaccgaagctcacctagggacctgg

SEQ ID NO: 503330 - DNA, 25 bp, Rattus norvegicus
accgacatggtgatcgcatagaaga

SEQ ID NO: 503331 - DNA, 25 bp, Rattus norvegicus
tcagaagagacaaaacaggccgcgg

SEQ ID NO: 503332 - DNA, 25 bp, Rattus norvegicus
cacggtcctgaaacctagggatccg

SEQ ID NO: 503333 - DNA, 25 bp, Rattus norvegicus
acggttacctgggaactgcactgga

SEQ ID NO: 503334 - DNA, 25 bp, Rattus norvegicus
ttcctcatagacaggcccaggtgtc

SEQ ID NO: 503335 - DNA, 25 bp, Rattus norvegicus
tcgcaaccgggtcagagtacaatcc

SEQ ID NO: 503336 - DNA, 25 bp, Rattus norvegicus
ccgcagccacagagacagtatcata

SEQ ID NO: 503337 - DNA, 25 bp, Rattus norvegicus
ccaagcctcggctgttttcaaaaca

SEQ ID NO: 503338 - DNA, 25 bp, Rattus norvegicus
actagattggcaacaggcggaccac

SEQ ID NO: 503339 - DNA, 25 bp, Rattus norvegicus
aacatcccggcgcagagggcctcgt

SEQ ID NO: 503340 - DNA, 25 bp, Rattus norvegicus
ccaggcccagccgattggaaagaca

SEQ ID NO: 503341 - DNA, 25 bp, Rattus norvegicus
acagacacggggcaaagacgcaggc

SEQ ID NO: 503342 - DNA, 25 bp, Rattus norvegicus
gagtgccgtacctgctccttcgcag

SEQ ID NO: 503343 - DNA, 25 bp, Rattus norvegicus
gtgtttcctaagcacaccgctttgc

SEQ ID NO: 503344 - DNA, 25 bp, Rattus norvegicus
accgctttgcttggaggttcgcgcc

SEQ ID NO: 503345 - DNA, 25 bp, Rattus norvegicus
aggttcgcgccctgtagcaatccgc

SEQ ID NO: 503346 - DNA, 25 bp, Rattus norvegicus
cccgtcatcggtggagttcgctcag

SEQ ID NO: 503347 - DNA, 25 bp, Rattus norvegicus
cccaggccgaactgaatggcgcacg

SEQ ID NO: 503348 - DNA, 25 bp, Rattus norvegicus
cccaggcctcaagtgtcctctttga

SEQ ID NO: 503349 - DNA, 25 bp, Rattus norvegicus
tcctctttgagatgggcgggacgca

SEQ ID NO: 503350 - DNA, 25 bp, Rattus norvegicus
gcagggaaccgcaccactagattgg

SEQ ID NO: 503351 - DNA, 25 bp, Rattus norvegicus
actagctctggtccatcgtttcggc

SEQ ID NO: 503352 - DNA, 25 bp, Rattus norvegicus
ccgaaggaaaggcactgagacagtt

SEQ ID NO: 503353 - DNA, 25 bp, Rattus norvegicus
cccgataatgggaattgcgtgaccc

SEQ ID NO: 503354 - DNA, 25 bp, Rattus norvegicus
atggaggcgcttcccgataatggga

SEQ ID NO: 503355 - DNA, 25 bp, Rattus norvegicus
tcgcctgacgtaccagcgagaaagg

SEQ ID NO: 503356 - DNA, 25 bp, Rattus norvegicus
ctggcgctagaggagcgtccgccct

SEQ ID NO: 503357 - DNA, 25 bp, Rattus norvegicus
ccgccttggagcagtcgagctgccg

SEQ ID NO: 503358 - DNA, 25 bp, Rattus norvegicus
tacccggcacgttgcggagaagcgc

SEQ ID NO: 503359 - DNA, 25 bp, Rattus norvegicus
agctccagcggtacccggcacgttg

SEQ ID NO: 503360 - DNA, 25 bp, Rattus norvegicus
actccagccaggcagagaagcgcgc

SEQ ID NO: 503361 - DNA, 25 bp, Rattus norvegicus
tggcccagctccagatcgaaggtga

SEQ ID NO: 503362 - DNA, 25 bp, Rattus norvegicus
tcgaaggtgaccacgcacacgcact

SEQ ID NO: 503363 - DNA, 25 bp, Rattus norvegicus
tgagacagttctggaggctcagccc

SEQ ID NO: 503364 - DNA, 25 bp, Rattus norvegicus
ttcaggccgccgaaggaaaggcact

SEQ ID NO: 503365 - DNA, 25 bp, Rattus norvegicus
aaccgcgcggtagcatagaggaatt

SEQ ID NO: 503366 - DNA, 25 bp, Rattus norvegicus
cagagaatttagcacagccagcttg

SEQ ID NO: 503367 - DNA, 25 bp, Rattus norvegicus
gtgaccgaaggtgcccagagaattt

SEQ ID NO: 503368 - DNA, 25 bp, Rattus norvegicus
tacaggagaccagcgcacgccactg

SEQ ID NO: 503369 - DNA, 25 bp, Rattus norvegicus
tcagaaacaggaggtacaggagacc

SEQ ID NO: 503370 - DNA, 25 bp, Rattus norvegicus
gctggcgatccggttcagaaacagg

SEQ ID NO: 503371 - DNA, 25 bp, Rattus norvegicus
caccctgcgcttcgtcaaggggtca

SEQ ID NO: 503372 - DNA, 25 bp, Rattus norvegicus
ggacgcctcaggacgttccagagca

SEQ ID NO: 503373 - DNA, 25 bp, Rattus norvegicus
tcagcatgtgcagtcagcgcccagt

SEQ ID NO: 503374 - DNA, 25 bp, Rattus norvegicus
cgccattttggagcgatctcgcccg

SEQ ID NO: 503375 - DNA, 25 bp, Rattus norvegicus
ttctccgtcagtcagcgtcctgctg

SEQ ID NO: 503376 - DNA, 25 bp, Rattus norvegicus
ggtccgcacttcacctctgggagcg

SEQ ID NO: 503377 - DNA, 25 bp, Rattus norvegicus
agccagcttgatcacggggacgcct

SEQ ID NO: 503378 - DNA, 25 bp, Rattus norvegicus
gcgtcctgctgtcagtcagcatgtg

SEQ ID NO: 503379 - DNA, 25 bp, Rattus norvegicus
ttccagagcaactcgaacagaaccc

SEQ ID NO: 503380 - DNA, 25 bp, Rattus norvegicus
cgccaccgtggccaataactacgga

SEQ ID NO: 503381 - DNA, 25 bp, Rattus norvegicus
aggccaagtattctggggtcctcgc

SEQ ID NO: 503382 - DNA, 25 bp, Rattus norvegicus
cggtccacctcggaacacggcaggt

SEQ ID NO: 503383 - DNA, 25 bp, Rattus norvegicus
aactacggagggctctttcgcaggc

SEQ ID NO: 503384 - DNA, 25 bp, Rattus norvegicus
gggtctccttagtttcgagtcctca

SEQ ID NO: 503385 - DNA, 25 bp, Rattus norvegicus
ccgaacgccaccagcacgaagtagt

SEQ ID NO: 503386 - DNA, 25 bp, Rattus norvegicus
acaccggtcaggtctagggcatact

SEQ ID NO: 503387 - DNA, 25 bp, Rattus norvegicus
acgctggccctaagctgcacacttg

SEQ ID NO: 503388 - DNA, 25 bp, Rattus norvegicus
gcgggacctgacacagtgcacttcc

SEQ ID NO: 503389 - DNA, 25 bp, Rattus norvegicus
acttccattggtccactccacgtgg

SEQ ID NO: 503390 - DNA, 25 bp, Rattus norvegicus
ccagctcaaccctttgggcgggtga

SEQ ID NO: 503391 - DNA, 25 bp, Rattus norvegicus
gcggccggcatttcgacctgaaaca

SEQ ID NO: 503392 - DNA, 25 bp, Rattus norvegicus
ctccacggctcgaggattcgatggc

SEQ ID NO: 503393 - DNA, 25 bp, Rattus norvegicus
ggacggatcttacacaggccaagta

SEQ ID NO: 503394 - DNA, 25 bp, Rattus norvegicus
gggtcacccagctccaatccgtgtg

SEQ ID NO: 503395 - DNA, 25 bp, Rattus norvegicus
cttcctgagtctgaaggtcaaacta

SEQ ID NO: 503396 - DNA, 25 bp, Rattus norvegicus
ggcagccgcatctcgcgcgggcaca

SEQ ID NO: 503397 - DNA, 25 bp, Rattus norvegicus
ccaaacgcacatcgtgagtggggcc

SEQ ID NO: 503398 - DNA, 25 bp, Rattus norvegicus
tcgaccccgccgagtatgacgtgtc

SEQ ID NO: 503399 - DNA, 25 bp, Rattus norvegicus
gtcaaactaaagagggcagccctta

SEQ ID NO: 503400 - DNA, 25 bp, Rattus norvegicus
tgaaggtcaaactaaagagggcagc

SEQ ID NO: 503401 - DNA, 25 bp, Rattus norvegicus
cgcacttcctgagtctgaaggtcaa

SEQ ID NO: 503402 - DNA, 25 bp, Rattus norvegicus
cagagcactctgtgcgcgcgcaggc

SEQ ID NO: 503403 - DNA, 25 bp, Rattus norvegicus
tcttcctgccagagcactctgtgcg

SEQ ID NO: 503404 - DNA, 25 bp, Rattus norvegicus
cgcctcgaactctacctcttttcca

SEQ ID NO: 503405 - DNA, 25 bp, Rattus norvegicus
cgtgcgcagactacgcatgacgaga

SEQ ID NO: 503406 - DNA, 25 bp, Rattus norvegicus
gctccaatccgtgtgctggacaccg

SEQ ID NO: 503407 - DNA, 25 bp, Rattus norvegicus
gactacgcatgacgagaggcttgga

SEQ ID NO: 503408 - DNA, 25 bp, Rattus norvegicus
ttacctaggtcacagcggacgtccg

SEQ ID NO: 503409 - DNA, 25 bp, Rattus norvegicus
cactgaggaactacgggaggacgca

SEQ ID NO: 503410 - DNA, 25 bp, Rattus norvegicus
cggacgcactccacaatgcctaaga

SEQ ID NO: 503411 - DNA, 25 bp, Rattus norvegicus
agggttccagacagcgcttaccgcg

SEQ ID NO: 503412 - DNA, 25 bp, Rattus norvegicus
ttaccgcgggacaaccattggccca

SEQ ID NO: 503413 - DNA, 25 bp, Rattus norvegicus
ttggcccacgtcgaccagtagttcg

SEQ ID NO: 503414 - DNA, 25 bp, Rattus norvegicus
ggtgcagcgcagagccatcatccaa

SEQ ID NO: 503415 - DNA, 25 bp, Rattus norvegicus
cacgagcccggatcaggaaagacac

SEQ ID NO: 503416 - DNA, 25 bp, Rattus norvegicus
tctgccggtgagagcagctcttctt

SEQ ID NO: 503417 - DNA, 25 bp, Rattus norvegicus
tcttcttgctttcgggcgtgaggca

SEQ ID NO: 503418 - DNA, 25 bp, Rattus norvegicus
tggggcttccggagcacaatgctct

SEQ ID NO: 503419 - DNA, 25 bp, Rattus norvegicus
acaatgctctagctaggccggggtc

SEQ ID NO: 503420 - DNA, 25 bp, Rattus norvegicus
cctgcgccgaaagcatcagctggaa

SEQ ID NO: 503421 - DNA, 25 bp, Rattus norvegicus
gctccgagctcgtgcagtacacagg

SEQ ID NO: 503422 - DNA, 25 bp, Rattus norvegicus
ttggtggcagcttgtattttggccc

SEQ ID NO: 503423 - DNA, 25 bp, Rattus norvegicus
cggcaggcaccaggtaactcggtcc

SEQ ID NO: 503424 - DNA, 25 bp, Rattus norvegicus
ccggtccgcaggttgcatgccgcaa

SEQ ID NO: 503425 - DNA, 25 bp, Rattus norvegicus
ccgagatgggtcgtgcagtttgtaa

SEQ ID NO: 503426 - DNA, 25 bp, Rattus norvegicus
cagtttgtaacctgcgggagcattc

SEQ ID NO: 503427 - DNA, 25 bp, Rattus norvegicus
ggcagacccagcacagaacctctta

SEQ ID NO: 503428 - DNA, 25 bp, Rattus norvegicus
ggcctcccttttttgcttcggcaca

SEQ ID NO: 503429 - DNA, 25 bp, Rattus norvegicus
ttcctggacgccaggcaccagtgta

SEQ ID NO: 503430 - DNA, 25 bp, Rattus norvegicus
cccttgctaccggtgtttggtggca

SEQ ID NO: 503431 - DNA, 25 bp, Rattus norvegicus
gcgttatgtggcttaggcgaccata

SEQ ID NO: 503432 - DNA, 25 bp, Rattus norvegicus
gccaagtgccgacccagacttctga

SEQ ID NO: 503433 - DNA, 25 bp, Rattus norvegicus
gacttctgagcccatagcgcaggtg

SEQ ID NO: 503434 - DNA, 25 bp, Rattus norvegicus
ctggcagcacctgcggacagaattc

SEQ ID NO: 503435 - DNA, 25 bp, Rattus norvegicus
ggcaccagtgtagaccgcccacagt

SEQ ID NO: 503436 - DNA, 25 bp, Rattus norvegicus
cctcgggtcgcccactggagcccat

SEQ ID NO: 503437 - DNA, 25 bp, Rattus norvegicus
catgcgcactcacggaggcctgctg

SEQ ID NO: 503438 - DNA, 25 bp, Rattus norvegicus
ggcatattgcgcatgcgcactcacg

SEQ ID NO: 503439 - DNA, 25 bp, Rattus norvegicus
gcactatccaggcatattgcgcatg

SEQ ID NO: 503440 - DNA, 25 bp, Rattus norvegicus
tcggtcagtgcactatccaggcata

SEQ ID NO: 503441 - DNA, 25 bp, Rattus norvegicus
ccggatcatcggtcagtgcactatc

SEQ ID NO: 503442 - DNA, 25 bp, Rattus norvegicus
gtccttccaggagagtcagcagctc

SEQ ID NO: 503443 - DNA, 25 bp, Rattus norvegicus
tcccagctttggaaccggatcatcg

SEQ ID NO: 503444 - DNA, 25 bp, Rattus norvegicus
ggagagtcagcagctctctgggatc

SEQ ID NO: 503445 - DNA, 25 bp, Rattus norvegicus
tgcgcccgtccttccaggagagtca

SEQ ID NO: 503446 - DNA, 25 bp, Rattus norvegicus
cggaaatatccggtgcgcccgtcct

SEQ ID NO: 503447 - DNA, 25 bp, Rattus norvegicus
gcccgcagtacctgtgcctccggcc

SEQ ID NO: 503448 - DNA, 25 bp, Rattus norvegicus
gcggccgctctctccttacgcggaa

SEQ ID NO: 503449 - DNA, 25 bp, Rattus norvegicus
agctctctgggatcccagctttgga

SEQ ID NO: 503450 - DNA, 25 bp, Rattus norvegicus
cgctgcagatccacacaggtcaggc

SEQ ID NO: 503451 - DNA, 25 bp, Rattus norvegicus
aatgacgtaggccaatcccgagcgc

SEQ ID NO: 503452 - DNA, 25 bp, Rattus norvegicus
gacacgcctatcagtctctgcaaag

SEQ ID NO: 503453 - DNA, 25 bp, Rattus norvegicus
tgtttccaagccagatgcgattctc

SEQ ID NO: 503454 - DNA, 25 bp, Rattus norvegicus
tccggctttcttcgagactccagtc

SEQ ID NO: 503455 - DNA, 25 bp, Rattus norvegicus
ctccttccgggtatgctcggttcca

SEQ ID NO: 503456 - DNA, 25 bp, Rattus norvegicus
tcttcaggtgggattagctccttcc

SEQ ID NO: 503457 - DNA, 25 bp, Rattus norvegicus
cgggtgctcagcaatcttcaggtgg

SEQ ID NO: 503458 - DNA, 25 bp, Rattus norvegicus
catgacgtggactccgttaggctta

SEQ ID NO: 503459 - DNA, 25 bp, Rattus norvegicus
ttagcatccagcaaaccgtccttgg

SEQ ID NO: 503460 - DNA, 25 bp, Rattus norvegicus
attggttctgggcacttagcatcca

SEQ ID NO: 503461 - DNA, 25 bp, Rattus norvegicus
gtactcccggcaccactgataggct

SEQ ID NO: 503462 - DNA, 25 bp, Rattus norvegicus
ttggacagtagctccgcaaagctta

SEQ ID NO: 503463 - DNA, 25 bp, Rattus norvegicus
gacctcacggggcaaacgctcagct

SEQ ID NO: 503464 - DNA, 25 bp, Rattus norvegicus
attcggcggggctcatcttcacgta

SEQ ID NO: 503465 - DNA, 25 bp, Rattus norvegicus
cggagatgttttctctctcaacctt

SEQ ID NO: 503466 - DNA, 25 bp, Rattus norvegicus
gttttctctctcaacctttcactcg

SEQ ID NO: 503467 - DNA, 25 bp, Rattus norvegicus
ctcaacctttcactcgctgtcgcct

SEQ ID NO: 503468 - DNA, 25 bp, Rattus norvegicus
cgcgcggagatgttttctctctcaa

SEQ ID NO: 503469 - DNA, 25 bp, Rattus norvegicus
cggatcgcgcggagatgttttctct

SEQ ID NO: 503470 - DNA, 25 bp, Rattus norvegicus
atcgacttcaactacccaggccggg

SEQ ID NO: 503471 - DNA, 25 bp, Rattus norvegicus
ccgcgagcctgagcaccaagggcgc

SEQ ID NO: 503472 - DNA, 25 bp, Rattus norvegicus
tcgcctccgggctgcaggtacgcat

SEQ ID NO: 503473 - DNA, 25 bp, Rattus norvegicus
cgggctgcaggtacgcattcattcg

SEQ ID NO: 503474 - DNA, 25 bp, Rattus norvegicus
gtacgcattcattcggcggggctca

SEQ ID NO: 503475 - DNA, 25 bp, Rattus norvegicus
ggggctcatcttcacgtaggtctct

SEQ ID NO: 503476 - DNA, 25 bp, Rattus norvegicus
tcatcttcacgtaggtctcttcggc

SEQ ID NO: 503477 - DNA, 25 bp, Rattus norvegicus
tcacgtaggtctcttcggcctgcca

SEQ ID NO: 503478 - DNA, 25 bp, Rattus norvegicus
cggaccctcatctgcgccggttagg

SEQ ID NO: 503479 - DNA, 25 bp, Rattus norvegicus
ccctcgtgtttgtgcgcctaggaga

SEQ ID NO: 503480 - DNA, 25 bp, Rattus norvegicus
tttgtgcgcctaggagacccttccg

SEQ ID NO: 503481 - DNA, 25 bp, Rattus norvegicus
ctctttgctcctgcgcggtaggctc

SEQ ID NO: 503482 - DNA, 25 bp, Rattus norvegicus
tgaggctggagattgctcacgcgct

SEQ ID NO: 503483 - DNA, 25 bp, Rattus norvegicus
ggagattgctcacgcgctccggacc

SEQ ID NO: 503484 - DNA, 25 bp, Rattus norvegicus
tcacgtgacacttggcagccggaga

SEQ ID NO: 503485 - DNA, 25 bp, Rattus norvegicus
ctgggcttggtaaccttacgctctt

SEQ ID NO: 503486 - DNA, 25 bp, Rattus norvegicus
actgagaaggaactggtcgtagaca

SEQ ID NO: 503487 - DNA, 25 bp, Rattus norvegicus
tcccgtgctgggcttggtaacctta

SEQ ID NO: 503488 - DNA, 25 bp, Rattus norvegicus
tctcaggccgtctgggattcgcccg

SEQ ID NO: 503489 - DNA, 25 bp, Rattus norvegicus
atctgcgccggttagggtgtcccgt

SEQ ID NO: 503490 - DNA, 25 bp, Rattus norvegicus
agacagcgtcggtctcaggccgtct

SEQ ID NO: 503491 - DNA, 25 bp, Rattus norvegicus
actggtcgtagacagcgtcggtctc

SEQ ID NO: 503492 - DNA, 25 bp, Rattus norvegicus
tgcgacgctcgcctgcagcggaagc

SEQ ID NO: 503493 - DNA, 25 bp, Rattus norvegicus
accagctgcagggttgggctagcca

SEQ ID NO: 503494 - DNA, 25 bp, Rattus norvegicus
tgcgggaggccacagagtccgaaca

SEQ ID NO: 503495 - DNA, 25 bp, Rattus norvegicus
gtcgcttccgtggactgcaggccct

SEQ ID NO: 503496 - DNA, 25 bp, Rattus norvegicus
gcctggggtctgcagccttccgact

SEQ ID NO: 503497 - DNA, 25 bp, Rattus norvegicus
ccaccacatccttggggtctggagt

SEQ ID NO: 503498 - DNA, 25 bp, Rattus norvegicus
cggcagattagggagatttctaccc

SEQ ID NO: 503499 - DNA, 25 bp, Rattus norvegicus
cccgggacaccaattttcctgcttg

SEQ ID NO: 503500 - DNA, 25 bp, Rattus norvegicus
accctagtacggtggtctgcgacgc

SEQ ID NO: 503501 - DNA, 25 bp, Rattus norvegicus
tcccgcgttgccacgacaacgtgtg

SEQ ID NO: 503502 - DNA, 25 bp, Rattus norvegicus
taagcctttcctcgtaggtcgcgcc

SEQ ID NO: 503503 - DNA, 25 bp, Rattus norvegicus
cgttgggcatttccgaggcagcgcc

SEQ ID NO: 503504 - DNA, 25 bp, Rattus norvegicus
tgagttggttcactcgcagcgctcc

SEQ ID NO: 503505 - DNA, 25 bp, Rattus norvegicus
tctcagtcggcctgtgggtcctctt

SEQ ID NO: 503506 - DNA, 25 bp, Rattus norvegicus
ggacgcgctcaactacgggctattc

SEQ ID NO: 503507 - DNA, 25 bp, Rattus norvegicus
acagccttcaggacgcgctcaacta

SEQ ID NO: 503508 - DNA, 25 bp, Rattus norvegicus
gtgctctgcgccctcaaccacagcc

SEQ ID NO: 503509 - DNA, 25 bp, Rattus norvegicus
ggccgccaagcagcgtgtgctctgc

SEQ ID NO: 503510 - DNA, 25 bp, Rattus norvegicus
agtgcctgcgtctggatccaaccgc

SEQ ID NO: 503511 - DNA, 25 bp, Rattus norvegicus
ctgcagaagtgcctgcgtctggatc

SEQ ID NO: 503512 - DNA, 25 bp, Rattus norvegicus
tcacgactcgctccgctgcagaagt

SEQ ID NO: 503513 - DNA, 25 bp, Rattus norvegicus
ctgtgtggcccgctagcagtgaccc

SEQ ID NO: 503514 - DNA, 25 bp, Rattus norvegicus
gtgagccttcgcgatctcgccgtac

SEQ ID NO: 503515 - DNA, 25 bp, Rattus norvegicus
aaacggtgagccttcgcgatctcgc

SEQ ID NO: 503516 - DNA, 25 bp, Rattus norvegicus
gacctgcaacaaacggtgagccttc

SEQ ID NO: 503517 - DNA, 25 bp, Rattus norvegicus
ggcatcccggacctgcaacaaacgg

SEQ ID NO: 503518 - DNA, 25 bp, Rattus norvegicus
tctctccgccgggaacagtcagggc

SEQ ID NO: 503519 - DNA, 25 bp, Rattus norvegicus
cgcgctcaactacgggctattccag

SEQ ID NO: 503520 - DNA, 25 bp, Rattus norvegicus
ccacctctggctctcgttgtttctt

SEQ ID NO: 503521 - DNA, 25 bp, Rattus norvegicus
cgagggcgagatcccgctgcaccgc

SEQ ID NO: 503522 - DNA, 25 bp, Rattus norvegicus
tcatcgctgtgaaggcgcacagccc

SEQ ID NO: 503523 - DNA, 25 bp, Rattus norvegicus
gcaagttcatcgctgtgaaggcgca

SEQ ID NO: 503524 - DNA, 25 bp, Rattus norvegicus
gaagcggaaactttacagtgccgtc

SEQ ID NO: 503525 - DNA, 25 bp, Rattus norvegicus
gcccgaagcggaaactttacagtgc

SEQ ID NO: 503526 - DNA, 25 bp, Rattus norvegicus
acgtgttcgtctacagccccagcgg

SEQ ID NO: 503527 - DNA, 25 bp, Rattus norvegicus
gtcacctacgtgttcgtctacagcc

SEQ ID NO: 503528 - DNA, 25 bp, Rattus norvegicus
cgtccgtcacctacgtgttcgtcta

SEQ ID NO: 503529 - DNA, 25 bp, Rattus norvegicus
atcgcgtccgtcacctacgtgttcg

SEQ ID NO: 503530 - DNA, 25 bp, Rattus norvegicus
ttgtttctttccagccgcccgcgtg

SEQ ID NO: 503531 - DNA, 25 bp, Rattus norvegicus
gctctcgttgtttctttccagccgc

SEQ ID NO: 503532 - DNA, 25 bp, Rattus norvegicus
ctctggctctcgttgtttctttcca

SEQ ID NO: 503533 - DNA, 25 bp, Rattus norvegicus
ctgcaccgcggcgaggccgtgaagg

SEQ ID NO: 503534 - DNA, 25 bp, Rattus norvegicus
gtggaagctttgcacgagaaccctc

SEQ ID NO: 503535 - DNA, 25 bp, Rattus norvegicus
tgttcctgtctgtgggtgccatcga

SEQ ID NO: 503536 - DNA, 25 bp, Rattus norvegicus
accctgagcgccagaagcgtgcacg

SEQ ID NO: 503537 - DNA, 25 bp, Rattus norvegicus
gcgtgcacgctccatgatcatattg

SEQ ID NO: 503538 - DNA, 25 bp, Rattus norvegicus
tcatattgcaggactctgcgccaga

SEQ ID NO: 503539 - DNA, 25 bp, Rattus norvegicus
ctgcgccagaagtgggcgatgtacc

SEQ ID NO: 503540 - DNA, 25 bp, Rattus norvegicus
cgtcaggccctgatagtccctatgc

SEQ ID NO: 503541 - DNA, 25 bp, Rattus norvegicus
ctatgccaacctgggcgccttcagt

SEQ ID NO: 503542 - DNA, 25 bp, Rattus norvegicus
agtgccagcctctttgctccgtcga

SEQ ID NO: 503543 - DNA, 25 bp, Rattus norvegicus
tctttgctccgtcgaaaccgcagcg

SEQ ID NO: 503544 - DNA, 25 bp, Rattus norvegicus
cgacgccgttccactgtgttcctgt

SEQ ID NO: 503545 - DNA, 25 bp, Rattus norvegicus
cggccttgactacagctctggagaa

SEQ ID NO: 503546 - DNA, 25 bp, Rattus norvegicus
ctccattgatgagcgcctcctgggg

SEQ ID NO: 503547 - DNA, 25 bp, Rattus norvegicus
agagtccgctggtgaagcagcttca

SEQ ID NO: 503548 - DNA, 25 bp, Rattus norvegicus
tctcaccaatccgagcagggcttgt

SEQ ID NO: 503549 - DNA, 25 bp, Rattus norvegicus
tggtcgcaggaattaagcgttcgtc

SEQ ID NO: 503550 - DNA, 25 bp, Rattus norvegicus
ggcggtttccaaactggtcgcagga

SEQ ID NO: 503551 - DNA, 25 bp, Rattus norvegicus
gaacgtgactgatcgaaagcttcgc

SEQ ID NO: 503552 - DNA, 25 bp, Rattus norvegicus
tgtgggcagggcatatcatcttatt

SEQ ID NO: 503553 - DNA, 25 bp, Rattus norvegicus
cacgatttccttgaggttgacgccc

SEQ ID NO: 503554 - DNA, 25 bp, Rattus norvegicus
agggacgccatcttgccacgatttc

SEQ ID NO: 503555 - DNA, 25 bp, Rattus norvegicus
agaaccttcactcgatccagggacg

SEQ ID NO: 503556 - DNA, 25 bp, Rattus norvegicus
tgagtctcccaataccagaaccttc

SEQ ID NO: 503557 - DNA, 25 bp, Rattus norvegicus
agcgttcgtccttgtctcgcaagtg

SEQ ID NO: 503558 - DNA, 25 bp, Rattus norvegicus
ctcgtcggtagtcccagacgcgggt

SEQ ID NO: 503559 - DNA, 25 bp, Rattus norvegicus
aaagcttcgctgtgcggattaacgg

SEQ ID NO: 503560 - DNA, 25 bp, Rattus norvegicus
cagacgcgggttaagctgctcacct

SEQ ID NO: 503561 - DNA, 25 bp, Rattus norvegicus
atcatcttattggtcggtcagaacg

SEQ ID NO: 503562 - DNA, 25 bp, Rattus norvegicus
ccatgagatcgaaggcgcacacctg

SEQ ID NO: 503563 - DNA, 25 bp, Rattus norvegicus
cccgcgtcggccatttcaacagaag

SEQ ID NO: 503564 - DNA, 25 bp, Rattus norvegicus
cgactggctggagagcatccactta

SEQ ID NO: 503565 - DNA, 25 bp, Rattus norvegicus
agcatccacttaggcgagcaccgag

SEQ ID NO: 503566 - DNA, 25 bp, Rattus norvegicus
cgagcaccgagaccgcttcgaggac

SEQ ID NO: 503567 - DNA, 25 bp, Rattus norvegicus
agaccgcttcgaggaccatgagatc

SEQ ID NO: 503568 - DNA, 25 bp, Rattus norvegicus
acctgcctgcgctcaccaaggaaga

SEQ ID NO: 503569 - DNA, 25 bp, Rattus norvegicus
agacttcgtggagctgggagtcaca

SEQ ID NO: 503570 - DNA, 25 bp, Rattus norvegicus
ggagtcacacgcgttggccaccgca

SEQ ID NO: 503571 - DNA, 25 bp, Rattus norvegicus
gttggccaccgcatgaacatcgagc

SEQ ID NO: 503572 - DNA, 25 bp, Rattus norvegicus
cgcatgaacatcgagcgtgcgctca

SEQ ID NO: 503573 - DNA, 25 bp, Rattus norvegicus
ctcaggcagctggatggcagctgac

SEQ ID NO: 503574 - DNA, 25 bp, Rattus norvegicus
cgaacccaaggaagtgcgcttcgtg

SEQ ID NO: 503575 - DNA, 25 bp, Rattus norvegicus
tgcgctcaccaaggaagacttcgtg

SEQ ID NO: 503576 - DNA, 25 bp, Rattus norvegicus
tacgactcggcgaacactgcttcga

SEQ ID NO: 503577 - DNA, 25 bp, Rattus norvegicus
ccaggtactttgtcctcagttcggc

SEQ ID NO: 503578 - DNA, 25 bp, Rattus norvegicus
ctcagttcggcttcgcgaaggctca

SEQ ID NO: 503579 - DNA, 25 bp, Rattus norvegicus
tcgggacaccgcagatgcgctttcc

SEQ ID NO: 503580 - DNA, 25 bp, Rattus norvegicus
ggcttaccgcttacaggtgaccgta

SEQ ID NO: 503581 - DNA, 25 bp, Rattus norvegicus
gacaaacgtttttaggcgctcatcg

SEQ ID NO: 503582 - DNA, 25 bp, Rattus norvegicus
acaccggtgcgtaacatcatctcta

SEQ ID NO: 503583 - DNA, 25 bp, Rattus norvegicus
tgcggtcaagctctctttcgtgtga

SEQ ID NO: 503584 - DNA, 25 bp, Rattus norvegicus
tgtcactgtcttcatgcggtcaagc

SEQ ID NO: 503585 - DNA, 25 bp, Rattus norvegicus
cagtggaatccctcagtgactgtca

SEQ ID NO: 503586 - DNA, 25 bp, Rattus norvegicus
ccgactatcgactcacagtggaatc

SEQ ID NO: 503587 - DNA, 25 bp, Rattus norvegicus
cccgctgggctgcaattacactaca

SEQ ID NO: 503588 - DNA, 25 bp, Rattus norvegicus
tctcccgtaaaggacccgcgatctg

SEQ ID NO: 503589 - DNA, 25 bp, Rattus norvegicus
taatccagattcttcgcccgctggg

SEQ ID NO: 503590 - DNA, 25 bp, Rattus norvegicus
acagctcggtgatgatgtgcagcgc

SEQ ID NO: 503591 - DNA, 25 bp, Rattus norvegicus
cctggccgctcctatcggctggaaa

SEQ ID NO: 503592 - DNA, 25 bp, Rattus norvegicus
cggctggaaagatgcccgaacactt

SEQ ID NO: 503593 - DNA, 25 bp, Rattus norvegicus
aagatgcccgaacacttgtcccact

SEQ ID NO: 503594 - DNA, 25 bp, Rattus norvegicus
cccgcgaagcacagctcggtgatga

SEQ ID NO: 503595 - DNA, 25 bp, Rattus norvegicus
tgatgatgtgcagcgccttctggca

SEQ ID NO: 503596 - DNA, 25 bp, Rattus norvegicus
gtcctccttgcggaaactcatcttg

SEQ ID NO: 503597 - DNA, 25 bp, Rattus norvegicus
ctcgcagcttctctgatttcccttg

SEQ ID NO: 503598 - DNA, 25 bp, Rattus norvegicus
tctctgatttcccttggcccgaggc

SEQ ID NO: 503599 - DNA, 25 bp, Rattus norvegicus
cttggcccgaggctgagccttaaga

SEQ ID NO: 503600 - DNA, 25 bp, Rattus norvegicus
gtggcagaggcgaccatgccctcca

SEQ ID NO: 503601 - DNA, 25 bp, Rattus norvegicus
agcgccttctggcacaggctgctca

SEQ ID NO: 503602 - DNA, 25 bp, Rattus norvegicus
agccttaagagttgcgagttggccc

SEQ ID NO: 503603 - DNA, 25 bp, Rattus norvegicus
actcatcttggcttctgctcgcagc

SEQ ID NO: 503604 - DNA, 25 bp, Rattus norvegicus
tccgaggtttagctgcgcaggcgca

SEQ ID NO: 503605 - DNA, 25 bp, Rattus norvegicus
caggtgtaacccttgtgggccagga

SEQ ID NO: 503606 - DNA, 25 bp, Rattus norvegicus
gttcgctcttgcctcggcgctcagt

SEQ ID NO: 503607 - DNA, 25 bp, Rattus norvegicus
cagcgacacgaaggccgagcggaac

SEQ ID NO: 503608 - DNA, 25 bp, Rattus norvegicus
cgctcagtgcgcaggtgtaaccctt

SEQ ID NO: 503609 - DNA, 25 bp, Rattus norvegicus
ctccgaaggaagcaacgtgggtacg

SEQ ID NO: 503610 - DNA, 25 bp, Rattus norvegicus
tgagcaggctccgaaggaagcaacg

SEQ ID NO: 503611 - DNA, 25 bp, Rattus norvegicus
ccaagaaggcaggtgagcaggctcc

SEQ ID NO: 503612 - DNA, 25 bp, Rattus norvegicus
ttatccgggaatatgccaagaaggc

SEQ ID NO: 503613 - DNA, 25 bp, Rattus norvegicus
ccgggagacctggagaattatttat

SEQ ID NO: 503614 - DNA, 25 bp, Rattus norvegicus
acacggaagcatgcacgtgtgagcg

SEQ ID NO: 503615 - DNA, 25 bp, Rattus norvegicus
tggagcgctgccgtaacacggaagc

SEQ ID NO: 503616 - DNA, 25 bp, Rattus norvegicus
caacgccctaaagaggctctggagc

SEQ ID NO: 503617 - DNA, 25 bp, Rattus norvegicus
agcggaacggaacgcctctggcgtt

SEQ ID NO: 503618 - DNA, 25 bp, Rattus norvegicus
ccttgagctgcaccttcctggtgtc

SEQ ID NO: 503619 - DNA, 25 bp, Rattus norvegicus
ggttattacttctcggccgccttga

SEQ ID NO: 503620 - DNA, 25 bp, Rattus norvegicus
cgcagctggagggttattacttctc

SEQ ID NO: 503621 - DNA, 25 bp, Rattus norvegicus
atagatcccgtgttccgggctcggc

SEQ ID NO: 503622 - DNA, 25 bp, Rattus norvegicus
gcagtactaggccatagatcccgtg

SEQ ID NO: 503623 - DNA, 25 bp, Rattus norvegicus
cgctgtacttcaccaggcagtacta

SEQ ID NO: 503624 - DNA, 25 bp, Rattus norvegicus
taaatgcttcactccggaaacagtg

SEQ ID NO: 503625 - DNA, 25 bp, Rattus norvegicus
gtccggtgcgttgcataaatgcttc

SEQ ID NO: 503626 - DNA, 25 bp, Rattus norvegicus
attgacaggaaagccgtccggtgcg

SEQ ID NO: 503627 - DNA, 25 bp, Rattus norvegicus
ccgagcagtgattgacaggaaagcc

SEQ ID NO: 503628 - DNA, 25 bp, Rattus norvegicus
gccactctgagagctccgagcagtg

SEQ ID NO: 503629 - DNA, 25 bp, Rattus norvegicus
tcagcctctggccactctgagagct

SEQ ID NO: 503630 - DNA, 25 bp, Rattus norvegicus
gccgcgctctgcgtgagccttacat

SEQ ID NO: 503631 - DNA, 25 bp, Rattus norvegicus
tgagccttacatggacgagatcttc

SEQ ID NO: 503632 - DNA, 25 bp, Rattus norvegicus
gcgtcagccatctcctgcaacttga

SEQ ID NO: 503633 - DNA, 25 bp, Rattus norvegicus
ggccgcactcagctggttcaagtcc

SEQ ID NO: 503634 - DNA, 25 bp, Rattus norvegicus
accgcggagtttggcaagcagatcc

SEQ ID NO: 503635 - DNA, 25 bp, Rattus norvegicus
gatcggtgcctcgtaacgcactttc

SEQ ID NO: 503636 - DNA, 25 bp, Rattus norvegicus
acccaaggcgtcactgcgggtcctt

SEQ ID NO: 503637 - DNA, 25 bp, Rattus norvegicus
ctgcgttataagagaggaggcttca

SEQ ID NO: 503638 - DNA, 25 bp, Rattus norvegicus
ctgttgggacaatcgctgcgttata

SEQ ID NO: 503639 - DNA, 25 bp, Rattus norvegicus
gcgtgccaatatttggggccagctc

SEQ ID NO: 503640 - DNA, 25 bp, Rattus norvegicus
ggcaagagatgccaccagcctttgg

SEQ ID NO: 503641 - DNA, 25 bp, Rattus norvegicus
cccacttcgggccaaaggactaatg

SEQ ID NO: 503642 - DNA, 25 bp, Rattus norvegicus
agcgaccgtaggtgacccgtacaga

SEQ ID NO: 503643 - DNA, 25 bp, Rattus norvegicus
ccctcgggctatgactgggtttgca

SEQ ID NO: 503644 - DNA, 25 bp, Rattus norvegicus
cgcgaccgagtcagtcctggccaaa

SEQ ID NO: 503645 - DNA, 25 bp, Rattus norvegicus
caagtcctgaaagctgggcagccta

SEQ ID NO: 503646 - DNA, 25 bp, Rattus norvegicus
tggccttcacattctcgatggttcg

SEQ ID NO: 503647 - DNA, 25 bp, Rattus norvegicus
aatgcgatgaaagcacagatcgccc

SEQ ID NO: 503648 - DNA, 25 bp, Rattus norvegicus
tttgacctgttaacaaatgcgatga

SEQ ID NO: 503649 - DNA, 25 bp, Rattus norvegicus
cgaagatttgcattttgacctgtta

SEQ ID NO: 503650 - DNA, 25 bp, Rattus norvegicus
ggtcttcacgaagatttgcattttg

SEQ ID NO: 503651 - DNA, 25 bp, Rattus norvegicus
tctagggcgattgatggtcttgccg

SEQ ID NO: 503652 - DNA, 25 bp, Rattus norvegicus
cacttctagggcgattgatggtctt

SEQ ID NO: 503653 - DNA, 25 bp, Rattus norvegicus
cgatggttcgctgggttccacttct

SEQ ID NO: 503654 - DNA, 25 bp, Rattus norvegicus
tccgaacgttgtgatcagagagggt

SEQ ID NO: 503655 - DNA, 25 bp, Rattus norvegicus
tccttccgaacgttgtgatcagaga

SEQ ID NO: 503656 - DNA, 25 bp, Rattus norvegicus
ggttgactccttccgaacgttgtga

SEQ ID NO: 503657 - DNA, 25 bp, Rattus norvegicus
ccgactgaagaattagtagccaccc

SEQ ID NO: 503658 - DNA, 25 bp, Rattus norvegicus
ccgggagtgccgactgaagaattag

SEQ ID NO: 503659 - DNA, 25 bp, Rattus norvegicus
tgggttccacttctagggcgattga

SEQ ID NO: 503660 - DNA, 25 bp, Rattus norvegicus
cgcgcgtttgtcaccgcgacgcttt

SEQ ID NO: 503661 - DNA, 25 bp, Rattus norvegicus
tcacctgacagccacgcgcaccgag

SEQ ID NO: 503662 - DNA, 25 bp, Rattus norvegicus
tccagccatgttgggcgactgaatg

SEQ ID NO: 503663 - DNA, 25 bp, Rattus norvegicus
tcccagcacagtgccgagtgttcgg

SEQ ID NO: 503664 - DNA, 25 bp, Rattus norvegicus
ccggatcccagcacagtgccgagtg

SEQ ID NO: 503665 - DNA, 25 bp, Rattus norvegicus
cggcgcccaacatgcctgcggccgc

SEQ ID NO: 503666 - DNA, 25 bp, Rattus norvegicus
ccgagctctcgtccgcggcgcccaa

SEQ ID NO: 503667 - DNA, 25 bp, Rattus norvegicus
tgttcccggagaagccgcgatgcga

SEQ ID NO: 503668 - DNA, 25 bp, Rattus norvegicus
caaacgtgaggctccggtgcagcga

SEQ ID NO: 503669 - DNA, 25 bp, Rattus norvegicus
cacccggaggccaaacgtgaggctc

SEQ ID NO: 503670 - DNA, 25 bp, Rattus norvegicus
gcgctcacccggaggccaaacgtga

SEQ ID NO: 503671 - DNA, 25 bp, Rattus norvegicus
gcaggggacagacacctcgggccca

SEQ ID NO: 503672 - DNA, 25 bp, Rattus norvegicus
ttgtcaccgcgacgctttgtctgcg

SEQ ID NO: 503673 - DNA, 25 bp, Rattus norvegicus
ctttgtctgcggctccgagcccggt

SEQ ID NO: 503674 - DNA, 25 bp, Rattus norvegicus
ccggaaggcactctcacgcagtggc

SEQ ID NO: 503675 - DNA, 25 bp, Rattus norvegicus
ctctcacgcagtggctgtcgggaga

SEQ ID NO: 503676 - DNA, 25 bp, Rattus norvegicus
atcccggtaaggtgtgcgcgctcgg

SEQ ID NO: 503677 - DNA, 25 bp, Rattus norvegicus
cgcgctcgggttgagatccagccct

SEQ ID NO: 503678 - DNA, 25 bp, Rattus norvegicus
tgtcacaccggaaggcactctcacg

SEQ ID NO: 503679 - DNA, 25 bp, Rattus norvegicus
cccgtcagtgtgcaagctgtgagct

SEQ ID NO: 503680 - DNA, 25 bp, Rattus norvegicus
gggttgagatccagccctcacggtc

SEQ ID NO: 503681 - DNA, 25 bp, Rattus norvegicus
tcagtgtgcaagctgtgagctgcga

SEQ ID NO: 503682 - DNA, 25 bp, Rattus norvegicus
tgagatccagccctcacggtcctgg

SEQ ID NO: 503683 - DNA, 25 bp, Rattus norvegicus
ggtgtcacaccggaaggcactctca

SEQ ID NO: 503684 - DNA, 25 bp, Rattus norvegicus
atccagccctcacggtcctggagtg

SEQ ID NO: 503685 - DNA, 25 bp, Rattus norvegicus
gcttctggagagatgaactgggtcg

SEQ ID NO: 503686 - DNA, 25 bp, Rattus norvegicus
cacggaggtagacgaggtgtcacac

SEQ ID NO: 503687 - DNA, 25 bp, Rattus norvegicus
ggcactctcacgcagtggctgtcgg

SEQ ID NO: 503688 - DNA, 25 bp, Rattus norvegicus
ccggtggtcgaagagcgattcgatt

SEQ ID NO: 503689 - DNA, 25 bp, Rattus norvegicus
cttcagtaactggaaagccatcggg

SEQ ID NO: 503690 - DNA, 25 bp, Rattus norvegicus
aaagccatcgggtggaagtcactcc

SEQ ID NO: 503691 - DNA, 25 bp, Rattus norvegicus
aagtcactccacgtccgaggcgtcg

SEQ ID NO: 503692 - DNA, 25 bp, Rattus norvegicus
tcgttgtcggagagatggtagttac

SEQ ID NO: 503693 - DNA, 25 bp, Rattus norvegicus
atggtagttacttcccttcacgcgg

SEQ ID NO: 503694 - DNA, 25 bp, Rattus norvegicus
cccacagcggcgaatccggcgtaga

SEQ ID NO: 503695 - DNA, 25 bp, Rattus norvegicus
tgtactcgatgtacctgccctcgtc

SEQ ID NO: 503696 - DNA, 25 bp, Rattus norvegicus
cccgacacgttcacttcagtaactg

SEQ ID NO: 503697 - DNA, 25 bp, Rattus norvegicus
agcgattcgatttcctctagttttt

SEQ ID NO: 503698 - DNA, 25 bp, Rattus norvegicus
ctttggtttcaggaagacagccata

SEQ ID NO: 503699 - DNA, 25 bp, Rattus norvegicus
cagccatagacgaaaagcagtccca

SEQ ID NO: 503700 - DNA, 25 bp, Rattus norvegicus
aaaagcagtcccacagcggcgaatc

SEQ ID NO: 503701 - DNA, 25 bp, Rattus norvegicus
ccttcacgcggatgtactcgatgta

SEQ ID NO: 503702 - DNA, 25 bp, Rattus norvegicus
cggcagtgactctgagagtgagacc

SEQ ID NO: 503703 - DNA, 25 bp, Rattus norvegicus
gctccggtgactgctgccaacggca

SEQ ID NO: 503704 - DNA, 25 bp, Rattus norvegicus
ggaggtcatgcgagctctactcatt

SEQ ID NO: 503705 - DNA, 25 bp, Rattus norvegicus
ttcatgagaagaagacgtcttcggc

SEQ ID NO: 503706 - DNA, 25 bp, Rattus norvegicus
tgcgagctctactcattcatgagaa

SEQ ID NO: 503707 - DNA, 25 bp, Rattus norvegicus
ccaacggcagtgactctgagagtga

SEQ ID NO: 503708 - DNA, 25 bp, Rattus norvegicus
tgagaccagtgagtcggatgacgac

SEQ ID NO: 503709 - DNA, 25 bp, Rattus norvegicus
tgagtcggatgacgactctccaccc

SEQ ID NO: 503710 - DNA, 25 bp, Rattus norvegicus
caacgaggaggtcatgcgagctcta

SEQ ID NO: 503711 - DNA, 25 bp, Rattus norvegicus
tcttcggcgacagctggctcagtgg

SEQ ID NO: 503712 - DNA, 25 bp, Rattus norvegicus
agaagacgtcttcggcgacagctgg

SEQ ID NO: 503713 - DNA, 25 bp, Rattus norvegicus
cctgatgacaacgaggaggtcatgc

SEQ ID NO: 503714 - DNA, 25 bp, Rattus norvegicus
cccgtgcggggcctgatgacaacga

SEQ ID NO: 503715 - DNA, 25 bp, Rattus norvegicus
tgactgctgccaacggcagtgactc

SEQ ID NO: 503716 - DNA, 25 bp, Rattus norvegicus
accacgccggtgtcgtagccgaaca

SEQ ID NO: 503717 - DNA, 25 bp, Rattus norvegicus
tctcgtcgcgctggaactgcctgcg

SEQ ID NO: 503718 - DNA, 25 bp, Rattus norvegicus
ggcgaccgcagattccacgtgggaa

SEQ ID NO: 503719 - DNA, 25 bp, Rattus norvegicus
ctggccagcaggatggcgcttcgcc

SEQ ID NO: 503720 - DNA, 25 bp, Rattus norvegicus
cggccagcagcgtctccttgttggc

SEQ ID NO: 503721 - DNA, 25 bp, Rattus norvegicus
accaggacgctcgtgacaccgagct

SEQ ID NO: 503722 - DNA, 25 bp, Rattus norvegicus
atccgggagaaggaagcgcatcctc

SEQ ID NO: 503723 - DNA, 25 bp, Rattus norvegicus
tcaggctgcgcagcgtgtactccac

SEQ ID NO: 503724 - DNA, 25 bp, Rattus norvegicus
gctgactgacccgagggcgaccgca

SEQ ID NO: 503725 - DNA, 25 bp, Rattus norvegicus
gtcctcgctcgccttgcgggacatg

SEQ ID NO: 503726 - DNA, 25 bp, Rattus norvegicus
gacatgggacagacggacgccgccc

SEQ ID NO: 503727 - DNA, 25 bp, Rattus norvegicus
cgtgcgtcacttgcccgcttagagg

SEQ ID NO: 503728 - DNA, 25 bp, Rattus norvegicus
tgccagctgctgagccgctgctctt

SEQ ID NO: 503729 - DNA, 25 bp, Rattus norvegicus
gtagccgaacaggaagccgccgagc

SEQ ID NO: 503730 - DNA, 25 bp, Rattus norvegicus
tcgcagtcgctgtcgccgtctgggc

SEQ ID NO: 503731 - DNA, 25 bp, Rattus norvegicus
accatggccagtggcgcctgtcagg

SEQ ID NO: 503732 - DNA, 25 bp, Rattus norvegicus
gcaccatggccagtggcgcctgtca

SEQ ID NO: 503733 - DNA, 25 bp, Rattus norvegicus
gaccttcccagctcgccgcagtccc

SEQ ID NO: 503734 - DNA, 25 bp, Rattus norvegicus
ggagagcaggaccttcccagctcgc

SEQ ID NO: 503735 - DNA, 25 bp, Rattus norvegicus
gctgctattcttagatcgccgggtg

SEQ ID NO: 503736 - DNA, 25 bp, Rattus norvegicus
gagcagtttggagagcaggaccttc

SEQ ID NO: 503737 - DNA, 25 bp, Rattus norvegicus
ctgcaggccgggctaagactgggca

SEQ ID NO: 503738 - DNA, 25 bp, Rattus norvegicus
cagccgcccgatgcggctctgcagg

SEQ ID NO: 503739 - DNA, 25 bp, Rattus norvegicus
ccaggcggcggagttcccagccgcc

SEQ ID NO: 503740 - DNA, 25 bp, Rattus norvegicus
cccgctgctattcttagatcgccgg

SEQ ID NO: 503741 - DNA, 25 bp, Rattus norvegicus
atcgccgggtggtggctttcgcttt

SEQ ID NO: 503742 - DNA, 25 bp, Rattus norvegicus
ctattcttagatcgccgggtggtgg

SEQ ID NO: 503743 - DNA, 25 bp, Rattus norvegicus
cagtttggagagcaggaccttccca

SEQ ID NO: 503744 - DNA, 25 bp, Rattus norvegicus
ttggctcagtacatggcgcacacgc

SEQ ID NO: 503745 - DNA, 25 bp, Rattus norvegicus
cgcaggtaccaggagaagttggctc

SEQ ID NO: 503746 - DNA, 25 bp, Rattus norvegicus
tcggtttgttggagcgcaggtacca

SEQ ID NO: 503747 - DNA, 25 bp, Rattus norvegicus
aagacctgctgaagtggggacacgc

SEQ ID NO: 503748 - DNA, 25 bp, Rattus norvegicus
ggcactcggcgactaagacctgctg

SEQ ID NO: 503749 - DNA, 25 bp, Rattus norvegicus
ctgccagcggctgtgacagccactg

SEQ ID NO: 503750 - DNA, 25 bp, Rattus norvegicus
ccacagcgggcagctgcaggaagct

SEQ ID NO: 503751 - DNA, 25 bp, Rattus norvegicus
caactgcgcgtgcagtgcgacaaca

SEQ ID NO: 503752 - DNA, 25 bp, Rattus norvegicus
gcagcctggtccagcaactgcgcgt

SEQ ID NO: 503753 - DNA, 25 bp, Rattus norvegicus
ttccagtgccagctgtgtgaccagg

SEQ ID NO: 503754 - DNA, 25 bp, Rattus norvegicus
tcgctttggagcgtttcacggaagc

SEQ ID NO: 503755 - DNA, 25 bp, Rattus norvegicus
caccactaccatgggcttcgctttg

SEQ ID NO: 503756 - DNA, 25 bp, Rattus norvegicus
aggaagctgcctgcgcacgtccagc

SEQ ID NO: 503757 - DNA, 25 bp, Rattus norvegicus
acacgcgcaacttcgtcggggaccg

SEQ ID NO: 503758 - DNA, 25 bp, Rattus norvegicus
gtactttctcctcatccgggtcatg

SEQ ID NO: 503759 - DNA, 25 bp, Rattus norvegicus
cagatgtcatcaacaggtcgcagga

SEQ ID NO: 503760 - DNA, 25 bp, Rattus norvegicus
tctccagcagcgaccagatgtcatc

SEQ ID NO: 503761 - DNA, 25 bp, Rattus norvegicus
cggcgatttgtgtggagttgaatct

SEQ ID NO: 503762 - DNA, 25 bp, Rattus norvegicus
tgctccggcgccatggcggcgattt

SEQ ID NO: 503763 - DNA, 25 bp, Rattus norvegicus
cggttgtaccatccgaccctgggct

SEQ ID NO: 503764 - DNA, 25 bp, Rattus norvegicus
gggcgaagcggttgtaccatccgac

SEQ ID NO: 503765 - DNA, 25 bp, Rattus norvegicus
cctgtgcgcccgtagtacgggtgcc

SEQ ID NO: 503766 - DNA, 25 bp, Rattus norvegicus
agttcacgcctgtgcgcccgtagta

SEQ ID NO: 503767 - DNA, 25 bp, Rattus norvegicus
ctcatccgggtcatgttcatgagca

SEQ ID NO: 503768 - DNA, 25 bp, Rattus norvegicus
gctgcctaccttgaagtactttctc

SEQ ID NO: 503769 - DNA, 25 bp, Rattus norvegicus
tcaacaggtcgcaggaagaggacat

SEQ ID NO: 503770 - DNA, 25 bp, Rattus norvegicus
aggacatccgtgtcgacgtacaaca

SEQ ID NO: 503771 - DNA, 25 bp, Rattus norvegicus
ttcatgagcatcactcccgagttca

SEQ ID NO: 503772 - DNA, 25 bp, Rattus norvegicus
cgacgctcctgggtccaggaccgtt

SEQ ID NO: 503773 - DNA, 25 bp, Rattus norvegicus
gcttcctcattttggggcaaggatg

SEQ ID NO: 503774 - DNA, 25 bp, Rattus norvegicus
ggcgcacgtgcatccaggcacaggt

SEQ ID NO: 503775 - DNA, 25 bp, Rattus norvegicus
ctgtgcgcgtgcctcaggcgcacaa

SEQ ID NO: 503776 - DNA, 25 bp, Rattus norvegicus
gctcaatggggtttgcacggcagcc

SEQ ID NO: 503777 - DNA, 25 bp, Rattus norvegicus
gggctcgcgcactcagagacgcgca

SEQ ID NO: 503778 - DNA, 25 bp, Rattus norvegicus
gcgagacccgtgcacctgtgcgcgt

SEQ ID NO: 503779 - DNA, 25 bp, Rattus norvegicus
tccaggaccgtttcgaagtggtgtc

SEQ ID NO: 503780 - DNA, 25 bp, Rattus norvegicus
acgcgctcacctgcttagggcgcga

SEQ ID NO: 503781 - DNA, 25 bp, Rattus norvegicus
tggtggctcaactccgagcaacttg

SEQ ID NO: 503782 - DNA, 25 bp, Rattus norvegicus
ccgagcaacttgcaaggcttcctca

SEQ ID NO: 503783 - DNA, 25 bp, Rattus norvegicus
tgcgctcctggcctcgggctcaatg

SEQ ID NO: 503784 - DNA, 25 bp, Rattus norvegicus
ctttgcagtgaccaccggggctcgc

SEQ ID NO: 503785 - DNA, 25 bp, Rattus norvegicus
gcacaagggctttgcagtgaccacc

SEQ ID NO: 503786 - DNA, 25 bp, Rattus norvegicus
ctacgaaaagcagcaacgcgcagcc

SEQ ID NO: 503787 - DNA, 25 bp, Rattus norvegicus
gaaaagcagcaacgcgcagccgcag

SEQ ID NO: 503788 - DNA, 25 bp, Rattus norvegicus
ccgggcgaactacgaaaagcagcaa

SEQ ID NO: 503789 - DNA, 25 bp, Rattus norvegicus
cgcccgggcgaactacgaaaagcag

SEQ ID NO: 503790 - DNA, 25 bp, Rattus norvegicus
tacgacccgcaggtagcgccgcatc

SEQ ID NO: 503791 - DNA, 25 bp, Rattus norvegicus
aggccaggcacagccctacgacccg

SEQ ID NO: 503792 - DNA, 25 bp, Rattus norvegicus
gagcagaagccgcaggccaggcaca

SEQ ID NO: 503793 - DNA, 25 bp, Rattus norvegicus
cgtacagcagcgagcagaagccgca

SEQ ID NO: 503794 - DNA, 25 bp, Rattus norvegicus
ctgaaggcgtacagcagcgagcaga

SEQ ID NO: 503795 - DNA, 25 bp, Rattus norvegicus
caaggacactgcgagctggctgaag

SEQ ID NO: 503796 - DNA, 25 bp, Rattus norvegicus
cttcctccaaggacactgcgagctg

SEQ ID NO: 503797 - DNA, 25 bp, Rattus norvegicus
ggcctacggccgctccttcctccaa

SEQ ID NO: 503798 - DNA, 25 bp, Rattus norvegicus
cgtccgccagccaggaagccaccgc

SEQ ID NO: 503799 - DNA, 25 bp, Rattus norvegicus
agcagcgagcagaagccgcaggcca

SEQ ID NO: 503800 - DNA, 25 bp, Rattus norvegicus
ttttccttgactaatcctgctcctc

SEQ ID NO: 503801 - DNA, 25 bp, Rattus norvegicus
accgcacctgctaacttttccttga

SEQ ID NO: 503802 - DNA, 25 bp, Rattus norvegicus
gcacctgctaacttttccttgacta

SEQ ID NO: 503803 - DNA, 25 bp, Rattus norvegicus
gctaacttttccttgactaatcctg

SEQ ID NO: 503804 - DNA, 25 bp, Rattus norvegicus
cttgactaatcctgctcctcacgga

SEQ ID NO: 503805 - DNA, 25 bp, Rattus norvegicus
gactaatcctgctcctcacggactt

SEQ ID NO: 503806 - DNA, 25 bp, Rattus norvegicus
taatcctgctcctcacggacttcag

SEQ ID NO: 503807 - DNA, 25 bp, Rattus norvegicus
ctcacggacttcagcgtccggtcta

SEQ ID NO: 503808 - DNA, 25 bp, Rattus norvegicus
cttcagcgtccggtctaaaacgtct

SEQ ID NO: 503809 - DNA, 25 bp, Rattus norvegicus
cagcgtccggtctaaaacgtctgtc

SEQ ID NO: 503810 - DNA, 25 bp, Rattus norvegicus
tggttaccgcacctgctaacttttc

SEQ ID NO: 503811 - DNA, 25 bp, Rattus norvegicus
gaacccgtggttaccgcacctgcta

SEQ ID NO: 503812 - DNA, 25 bp, Rattus norvegicus
cctgctaacttttccttgactaatc

SEQ ID NO: 503813 - DNA, 25 bp, Rattus norvegicus
ccgtggttaccgcacctgctaactt

SEQ ID NO: 503814 - DNA, 25 bp, Rattus norvegicus
gacgctggttcctcgttagagatta

SEQ ID NO: 503815 - DNA, 25 bp, Rattus norvegicus
tgcattgaccaaaaagaacccgtgg

SEQ ID NO: 503816 - DNA, 25 bp, Rattus norvegicus
ctgagacatcgctgcattgaccaaa

SEQ ID NO: 503817 - DNA, 25 bp, Rattus norvegicus
acttgaattctgagacatcgctgca

SEQ ID NO: 503818 - DNA, 25 bp, Rattus norvegicus
ggcgccgggcaacttgaattctgag

SEQ ID NO: 503819 - DNA, 25 bp, Rattus norvegicus
ggatttttccattgcgcagtttgtg

SEQ ID NO: 503820 - DNA, 25 bp, Rattus norvegicus
ggctgttgccctaaatctaggattt

SEQ ID NO: 503821 - DNA, 25 bp, Rattus norvegicus
cggggctgtaggctgttgccctaaa

SEQ ID NO: 503822 - DNA, 25 bp, Rattus norvegicus
ttcctcgttagagattacccggctc

SEQ ID NO: 503823 - DNA, 25 bp, Rattus norvegicus
accatgagatggacgctggttcctc

SEQ ID NO: 503824 - DNA, 25 bp, Rattus norvegicus
cagcctccgcgcaggaccatgagat

SEQ ID NO: 503825 - DNA, 25 bp, Rattus norvegicus
aagcggagctgagccctagcgcact

SEQ ID NO: 503826 - DNA, 25 bp, Rattus norvegicus
ctcccggaagcggagctgagcccta

SEQ ID NO: 503827 - DNA, 25 bp, Rattus norvegicus
gagattacccggctctgagctgtgg

SEQ ID NO: 503828 - DNA, 25 bp, Rattus norvegicus
cgcgccggccaaccagcggccgcgc

SEQ ID NO: 503829 - DNA, 25 bp, Rattus norvegicus
gcggccgcgccggagacttcaaacg

SEQ ID NO: 503830 - DNA, 25 bp, Rattus norvegicus
gcccatgctcgctgccgacgcgcgc

SEQ ID NO: 503831 - DNA, 25 bp, Rattus norvegicus
ctggcgcccgcagacacacgtgcgc

SEQ ID NO: 503832 - DNA, 25 bp, Rattus norvegicus
tcaggccgtggctcgcacgcccgga

SEQ ID NO: 503833 - DNA, 25 bp, Rattus norvegicus
gggaaactcctgcccgcgcgcacgt

SEQ ID NO: 503834 - DNA, 25 bp, Rattus norvegicus
ccagcacccgcggcgagttcgcggc

SEQ ID NO: 503835 - DNA, 25 bp, Rattus norvegicus
cgcagacacacgtgcgcccagcgcg

SEQ ID NO: 503836 - DNA, 25 bp, Rattus norvegicus
gcgcgcacgtgacccgcgccggcca

SEQ ID NO: 503837 - DNA, 25 bp, Rattus norvegicus
gcctccagctgtcggggaaactcct

SEQ ID NO: 503838 - DNA, 25 bp, Rattus norvegicus
agcctccagctgtcggggaaactcc

SEQ ID NO: 503839 - DNA, 25 bp, Rattus norvegicus
gcccgtctgtcagcgccgaggcgag

SEQ ID NO: 503840 - DNA, 25 bp, Rattus norvegicus
gccgcggcccgtctgtcagcgccga

SEQ ID NO: 503841 - DNA, 25 bp, Rattus norvegicus
gcgctcaggccgtggctcgcacgcc

SEQ ID NO: 503842 - DNA, 25 bp, Rattus norvegicus
gtctggcttcgcgggtttcaccggc

SEQ ID NO: 503843 - DNA, 25 bp, Rattus norvegicus
tggaacgtaggtgagcgagctctcc

SEQ ID NO: 503844 - DNA, 25 bp, Rattus norvegicus
cgccggaagtgcctttggggcgagc

SEQ ID NO: 503845 - DNA, 25 bp, Rattus norvegicus
cggtgcagcgtttcttccgtatccc

SEQ ID NO: 503846 - DNA, 25 bp, Rattus norvegicus
agcaccgtgggagcttaccttcgac

SEQ ID NO: 503847 - DNA, 25 bp, Rattus norvegicus
accgcagcgcggtgcagcgtttctt

SEQ ID NO: 503848 - DNA, 25 bp, Rattus norvegicus
ccgagcaggctggatgcgagcccgc

SEQ ID NO: 503849 - DNA, 25 bp, Rattus norvegicus
cttcgacgcagtggccgagcaggct

SEQ ID NO: 503850 - DNA, 25 bp, Rattus norvegicus
ttaccttcgacgcagtggccgagca

SEQ ID NO: 503851 - DNA, 25 bp, Rattus norvegicus
cgtaggtgagcgagctctccgcaaa

SEQ ID NO: 503852 - DNA, 25 bp, Rattus norvegicus
accgtgggagcttaccttcgacgca

SEQ ID NO: 503853 - DNA, 25 bp, Rattus norvegicus
tgagcgagctctccgcaaaggcgcg

SEQ ID NO: 503854 - DNA, 25 bp, Rattus norvegicus
tccgggctccagcaccgtgggagct

SEQ ID NO: 503855 - DNA, 25 bp, Rattus norvegicus
ggagcttaccttcgacgcagtggcc

SEQ ID NO: 503856 - DNA, 25 bp, Rattus norvegicus
tccataaagtatgcgacaagactcg

SEQ ID NO: 503857 - DNA, 25 bp, Rattus norvegicus
cgagctttaaagacccggctaggag

SEQ ID NO: 503858 - DNA, 25 bp, Rattus norvegicus
ctaggaggaaggatgtcaccggttt

SEQ ID NO: 503859 - DNA, 25 bp, Rattus norvegicus
tcaccggtttcagggacacagcggc

SEQ ID NO: 503860 - DNA, 25 bp, Rattus norvegicus
cagacccttgggcaagcaacctcgg

SEQ ID NO: 503861 - DNA, 25 bp, Rattus norvegicus
acagaccgtttgtgttcgcctccgc

SEQ ID NO: 503862 - DNA, 25 bp, Rattus norvegicus
tcgctccgctagctttccaggaact

SEQ ID NO: 503863 - DNA, 25 bp, Rattus norvegicus
aagttacccagacgccggagctccg

SEQ ID NO: 503864 - DNA, 25 bp, Rattus norvegicus
gcccgagcacggcattcctagaaaa

SEQ ID NO: 503865 - DNA, 25 bp, Rattus norvegicus
gcacacggcttagcccgagctttaa

SEQ ID NO: 503866 - DNA, 25 bp, Rattus norvegicus
gcccactttatctgcacacggctta

SEQ ID NO: 503867 - DNA, 25 bp, Rattus norvegicus
ggtgctgagcctcgaactcacggcc

SEQ ID NO: 503868 - DNA, 25 bp, Rattus norvegicus
ggcacagaactgtggccagcgcgct

SEQ ID NO: 503869 - DNA, 25 bp, Rattus norvegicus
tccaggaactgtcacgctgaccgtc

SEQ ID NO: 503870 - DNA, 25 bp, Rattus norvegicus
agagcgccaggcaccagcaccagag

SEQ ID NO: 503871 - DNA, 25 bp, Rattus norvegicus
gccgcaggcgtcaccgccgcctcac

SEQ ID NO: 503872 - DNA, 25 bp, Rattus norvegicus
tgcgtgtggcttgcccggctagccc

SEQ ID NO: 503873 - DNA, 25 bp, Rattus norvegicus
cctgtgcgcacgcttgtgtgtgtgt

SEQ ID NO: 503874 - DNA, 25 bp, Rattus norvegicus
acacctgtgcgcacgcttgtgtgtg

SEQ ID NO: 503875 - DNA, 25 bp, Rattus norvegicus
gtcccatcgcgtcttgccctcacac

SEQ ID NO: 503876 - DNA, 25 bp, Rattus norvegicus
agggacacccgtgccgtcccatcgc

SEQ ID NO: 503877 - DNA, 25 bp, Rattus norvegicus
taagtctggggtctccagggacacc

SEQ ID NO: 503878 - DNA, 25 bp, Rattus norvegicus
aaggtgctaagtctggggtctccag

SEQ ID NO: 503879 - DNA, 25 bp, Rattus norvegicus
tagtggcgtctgaggaaggtgctaa

SEQ ID NO: 503880 - DNA, 25 bp, Rattus norvegicus
tcgcccgccagcgagcctgcagcct

SEQ ID NO: 503881 - DNA, 25 bp, Rattus norvegicus
atccgggctggaccttcgcccgcca

SEQ ID NO: 503882 - DNA, 25 bp, Rattus norvegicus
caccagagggacccgagaagcggcc

SEQ ID NO: 503883 - DNA, 25 bp, Rattus norvegicus
cggaggcggagcctaagacagaccc

SEQ ID NO: 503884 - DNA, 25 bp, Rattus norvegicus
acctggctgccacgcagcacgaggg

SEQ ID NO: 503885 - DNA, 25 bp, Rattus norvegicus
ctcccggatctctcgtggcggggct

SEQ ID NO: 503886 - DNA, 25 bp, Rattus norvegicus
ggtgacaggcgatcctcagccactc

SEQ ID NO: 503887 - DNA, 25 bp, Rattus norvegicus
ctgcgtgcagagcaagggtctccac

SEQ ID NO: 503888 - DNA, 25 bp, Rattus norvegicus
agagcaagggtctccaccgagggca

SEQ ID NO: 503889 - DNA, 25 bp, Rattus norvegicus
aggcggcccttctcgggcgctctaa

SEQ ID NO: 503890 - DNA, 25 bp, Rattus norvegicus
ctcgggcgctctaagggccgagcct

SEQ ID NO: 503891 - DNA, 25 bp, Rattus norvegicus
acgccggggatccaggctgctctgc

SEQ ID NO: 503892 - DNA, 25 bp, Rattus norvegicus
cacgctcacagtgcggggccgcgat

SEQ ID NO: 503893 - DNA, 25 bp, Rattus norvegicus
ccgccgacgccagtaggtgacaggc

SEQ ID NO: 503894 - DNA, 25 bp, Rattus norvegicus
tcccggaacgctgctcggctgcagg

SEQ ID NO: 503895 - DNA, 25 bp, Rattus norvegicus
cgaggcagatccctcccgctgggat

SEQ ID NO: 503896 - DNA, 25 bp, Rattus norvegicus
cgccagcgaaatcccggagcgcgga

SEQ ID NO: 503897 - DNA, 25 bp, Rattus norvegicus
gatccctcccgctgggatctgcagg

SEQ ID NO: 503898 - DNA, 25 bp, Rattus norvegicus
cttcggaagccacctcacattgggg

SEQ ID NO: 503899 - DNA, 25 bp, Rattus norvegicus
atctttgacggcgactgcaaaagga

SEQ ID NO: 503900 - DNA, 25 bp, Rattus norvegicus
gtttaccatcgaagtcggaacattg

SEQ ID NO: 503901 - DNA, 25 bp, Rattus norvegicus
gccgctgatgtcgaaatgtttacca

SEQ ID NO: 503902 - DNA, 25 bp, Rattus norvegicus
cgactgcaaaaggaagggtcacatt

SEQ ID NO: 503903 - DNA, 25 bp, Rattus norvegicus
ggaagggtcacattttggatgcaga

SEQ ID NO: 503904 - DNA, 25 bp, Rattus norvegicus
actcactcccgctgtacttcggaag

SEQ ID NO: 503905 - DNA, 25 bp, Rattus norvegicus
gcaaaggctttactcactcccgctg

SEQ ID NO: 503906 - DNA, 25 bp, Rattus norvegicus
tgtgttcagatcagagcaaaggctt

SEQ ID NO: 503907 - DNA, 25 bp, Rattus norvegicus
ccgtaaggcggaatgtgttcagatc

SEQ ID NO: 503908 - DNA, 25 bp, Rattus norvegicus
cgaagttctgcgtttccgtaaggcg

SEQ ID NO: 503909 - DNA, 25 bp, Rattus norvegicus
cagaacggcgaagttctgcgtttcc

SEQ ID NO: 503910 - DNA, 25 bp, Rattus norvegicus
cggaacattgcttttctcggaagtc

SEQ ID NO: 503911 - DNA, 25 bp, Rattus norvegicus
gaggccgctgatgtcgaaatgttta

SEQ ID NO: 503912 - DNA, 25 bp, Rattus norvegicus
ctcctattaaggtctccggtcgtgt

SEQ ID NO: 503913 - DNA, 25 bp, Rattus norvegicus
ggctccgttcaccttccaatccgaa

SEQ ID NO: 503914 - DNA, 25 bp, Rattus norvegicus
tcctggaatgtaaccggctccgttc

SEQ ID NO: 503915 - DNA, 25 bp, Rattus norvegicus
aggaaacgcttactcctggaatgta

SEQ ID NO: 503916 - DNA, 25 bp, Rattus norvegicus
tcttgggtacgacaggaaacgctta

SEQ ID NO: 503917 - DNA, 25 bp, Rattus norvegicus
ttccacgtatcttgggtacgacagg

SEQ ID NO: 503918 - DNA, 25 bp, Rattus norvegicus
gtcaccataacttccacgtatcttg

SEQ ID NO: 503919 - DNA, 25 bp, Rattus norvegicus
ttagcgtccgccgtcaccataactt

SEQ ID NO: 503920 - DNA, 25 bp, Rattus norvegicus
gatggcgaaccatcttagcgtccgc

SEQ ID NO: 503921 - DNA, 25 bp, Rattus norvegicus
tctgcccgtgatggcgaaccatctt

SEQ ID NO: 503922 - DNA, 25 bp, Rattus norvegicus
gtgctgcaaattctgcccgtgatgg

SEQ ID NO: 503923 - DNA, 25 bp, Rattus norvegicus
gcgtcagcacatagtgctgcaaatt

SEQ ID NO: 503924 - DNA, 25 bp, Rattus norvegicus
cgatggacattagcgtcagcacata

SEQ ID NO: 503925 - DNA, 25 bp, Rattus norvegicus
gttacggtacttacgatggacatta

SEQ ID NO: 503926 - DNA, 25 bp, Rattus norvegicus
ggtcaccacttcgtaggaggccaga

SEQ ID NO: 503927 - DNA, 25 bp, Rattus norvegicus
gcgctaatacggtagtgggtcctga

SEQ ID NO: 503928 - DNA, 25 bp, Rattus norvegicus
tccgaactcattgacccgcgtgggg

SEQ ID NO: 503929 - DNA, 25 bp, Rattus norvegicus
agagcaacccggtcagccacttggc

SEQ ID NO: 503930 - DNA, 25 bp, Rattus norvegicus
aggccagagtcttcaccagggcttc

SEQ ID NO: 503931 - DNA, 25 bp, Rattus norvegicus
agggcttctgcaacacagcaaaatg

SEQ ID NO: 503932 - DNA, 25 bp, Rattus norvegicus
gttcccagtcatggtcagtcccagg

SEQ ID NO: 503933 - DNA, 25 bp, Rattus norvegicus
ggcgcgacagatgaacacccacaca

SEQ ID NO: 503934 - DNA, 25 bp, Rattus norvegicus
gcactgtggccatgcactgctttcc

SEQ ID NO: 503935 - DNA, 25 bp, Rattus norvegicus
agcaactcgtgtcgtccggacgcac

SEQ ID NO: 503936 - DNA, 25 bp, Rattus norvegicus
cccgcctcatgatcaggagaacttg

SEQ ID NO: 503937 - DNA, 25 bp, Rattus norvegicus
gcgattccaggacacccagcaaagt

SEQ ID NO: 503938 - DNA, 25 bp, Rattus norvegicus
gaagagctgcccgtaggcgctaata

SEQ ID NO: 503939 - DNA, 25 bp, Rattus norvegicus
ggagcttcgtttcttccggctgaaa

SEQ ID NO: 503940 - DNA, 25 bp, Rattus norvegicus
ttctccgggtactgaacgttgtatc

SEQ ID NO: 503941 - DNA, 25 bp, Rattus norvegicus
cacgaagcgtcgaggtcaaaggata

SEQ ID NO: 503942 - DNA, 25 bp, Rattus norvegicus
tgtttcacgatgtgcctgtagcagc

SEQ ID NO: 503943 - DNA, 25 bp, Rattus norvegicus
gcagccgggtacattcagcttcagg

SEQ ID NO: 503944 - DNA, 25 bp, Rattus norvegicus
cgttgtatccaagcacgggcagaac

SEQ ID NO: 503945 - DNA, 25 bp, Rattus norvegicus
ggaccagtcggtgtgatacattgtg

SEQ ID NO: 503946 - DNA, 25 bp, Rattus norvegicus
tttccctcagacaaacggtggcgta

SEQ ID NO: 503947 - DNA, 25 bp, Rattus norvegicus
gtgggtttaaatgtcgtccttcatc

SEQ ID NO: 503948 - DNA, 25 bp, Rattus norvegicus
gcagctaccttagggtgtgggttta

SEQ ID NO: 503949 - DNA, 25 bp, Rattus norvegicus
acagctacctaatggcgggctcgca

SEQ ID NO: 503950 - DNA, 25 bp, Rattus norvegicus
gagcgagccctaggaaccacagcta

SEQ ID NO: 503951 - DNA, 25 bp, Rattus norvegicus
agcagcaaccgcgaagctcaaggtc

SEQ ID NO: 503952 - DNA, 25 bp, Rattus norvegicus
cgccactcaggatactgtgaaaacc

SEQ ID NO: 503953 - DNA, 25 bp, Rattus norvegicus
agacaccgatgcttacgttaatacg

SEQ ID NO: 503954 - DNA, 25 bp, Rattus norvegicus
ctcgttacctggacgacgggctggc

SEQ ID NO: 503955 - DNA, 25 bp, Rattus norvegicus
cggaagagctgctagccgccatgtc

SEQ ID NO: 503956 - DNA, 25 bp, Rattus norvegicus
tcccggagcccacgggagtgacgtc

SEQ ID NO: 503957 - DNA, 25 bp, Rattus norvegicus
cggagcccacgggagtgacgtcagg

SEQ ID NO: 503958 - DNA, 25 bp, Rattus norvegicus
tgacgtcagggtcctgcccccgacg

SEQ ID NO: 503959 - DNA, 25 bp, Rattus norvegicus
ctgctagccgccatgtccgcgtcct

SEQ ID NO: 503960 - DNA, 25 bp, Rattus norvegicus
gaagagctgctagccgccatgtccg

SEQ ID NO: 503961 - DNA, 25 bp, Rattus norvegicus
tagccgccatgtccgcgtcctcccg

SEQ ID NO: 503962 - DNA, 25 bp, Rattus norvegicus
cacggggctcgttacctggacgacg

SEQ ID NO: 503963 - DNA, 25 bp, Rattus norvegicus
cgcctcgccgcccacggggctcgtt

SEQ ID NO: 503964 - DNA, 25 bp, Rattus norvegicus
tgactcacgacccagtcccgcgggg

SEQ ID NO: 503965 - DNA, 25 bp, Rattus norvegicus
cgtgactcacgacccagtcccgcgg

SEQ ID NO: 503966 - DNA, 25 bp, Rattus norvegicus
aggccggaagagctgctagccgcca

SEQ ID NO: 503967 - DNA, 25 bp, Rattus norvegicus
ccggaagagctgctagccgccatgt

SEQ ID NO: 503968 - DNA, 25 bp, Rattus norvegicus
taggctgccagtctgtacgacgctg

SEQ ID NO: 503969 - DNA, 25 bp, Rattus norvegicus
gagtcacctccgtggccggtactca

SEQ ID NO: 503970 - DNA, 25 bp, Rattus norvegicus
agctcgtagccacttccacggcaga

SEQ ID NO: 503971 - DNA, 25 bp, Rattus norvegicus
gccggtactcactttactgcttgga

SEQ ID NO: 503972 - DNA, 25 bp, Rattus norvegicus
actgcttggaagatgctcgtccgca

SEQ ID NO: 503973 - DNA, 25 bp, Rattus norvegicus
tgcctcgttccaaatcctgctactg

SEQ ID NO: 503974 - DNA, 25 bp, Rattus norvegicus
cttcaccaccttgggtccgtaggct

SEQ ID NO: 503975 - DNA, 25 bp, Rattus norvegicus
tcacgccaaagcgatgcaaggactc

SEQ ID NO: 503976 - DNA, 25 bp, Rattus norvegicus
gagctacccgcaggatgccttttcg

SEQ ID NO: 503977 - DNA, 25 bp, Rattus norvegicus
cgtcctctgaaacgaagaacaaatc

SEQ ID NO: 503978 - DNA, 25 bp, Rattus norvegicus
actgtatgcgtggatgtagaatata

SEQ ID NO: 503979 - DNA, 25 bp, Rattus norvegicus
aaagcgtgcctttagcgtcctctga

SEQ ID NO: 503980 - DNA, 25 bp, Rattus norvegicus
ccggaactcgggcatcagtgaaagc

SEQ ID NO: 503981 - DNA, 25 bp, Rattus norvegicus
cgcatcttcatccaagcagaccagg

SEQ ID NO: 503982 - DNA, 25 bp, Rattus norvegicus
tgcccagaagcctttctgctgccta

SEQ ID NO: 503983 - DNA, 25 bp, Rattus norvegicus
ccagaaccaggaaatgggcgcactc

SEQ ID NO: 503984 - DNA, 25 bp, Rattus norvegicus
ggaaggctgatctcaagccacgatc

SEQ ID NO: 503985 - DNA, 25 bp, Rattus norvegicus
tcgccttgtgcaggaagcgaggaac

SEQ ID NO: 503986 - DNA, 25 bp, Rattus norvegicus
cggatcgcaggcaatctgaagtccc

SEQ ID NO: 503987 - DNA, 25 bp, Rattus norvegicus
tggcccgcatcatccggatcgcagg

SEQ ID NO: 503988 - DNA, 25 bp, Rattus norvegicus
atttggtacccggtggcccgcatca

SEQ ID NO: 503989 - DNA, 25 bp, Rattus norvegicus
ccttgtcccacagaaggatttggta

SEQ ID NO: 503990 - DNA, 25 bp, Rattus norvegicus
gcctagcctcttacaggggcgttta

SEQ ID NO: 503991 - DNA, 25 bp, Rattus norvegicus
ctgcgacacagtgcgcatgcccaga

SEQ ID NO: 503992 - DNA, 25 bp, Rattus norvegicus
gagaaagtggcctccctgcgacaca

SEQ ID NO: 503993 - DNA, 25 bp, Rattus norvegicus
agctctacctcgcttccgagagaaa

SEQ ID NO: 503994 - DNA, 25 bp, Rattus norvegicus
tccaccagtcttggacccacgggta

SEQ ID NO: 503995 - DNA, 25 bp, Rattus norvegicus
acaggctccggttggtgtagctcct

SEQ ID NO: 503996 - DNA, 25 bp, Rattus norvegicus
agttcgggaggcaccctacagcggt

SEQ ID NO: 503997 - DNA, 25 bp, Rattus norvegicus
agccaccggcctgttacgtggcggc

SEQ ID NO: 503998 - DNA, 25 bp, Rattus norvegicus
ccgaggaaaagtcgctcggctggcc

SEQ ID NO: 503999 - DNA, 25 bp, Rattus norvegicus
tgagtgctggaaccatctcctttgg

SEQ ID NO: 504000 - DNA, 25 bp, Rattus norvegicus
caccctacagcggtgggatgtgttt

SEQ ID NO: 504001 - DNA, 25 bp, Rattus norvegicus
ttctgagagataatccggggagttc

SEQ ID NO: 504002 - DNA, 25 bp, Rattus norvegicus
cgtggcactcagagccgctccaatg

SEQ ID NO: 504003 - DNA, 25 bp, Rattus norvegicus
tctcctttggcaggtcccgaggaaa

SEQ ID NO: 504004 - DNA, 25 bp, Rattus norvegicus
tcaaacgatctgagtgctggaacca

SEQ ID NO: 504005 - DNA, 25 bp, Rattus norvegicus
cgccgttaccttggatgccggtctg

SEQ ID NO: 504006 - DNA, 25 bp, Rattus norvegicus
gatccaggaagtagcggctccgcct

SEQ ID NO: 504007 - DNA, 25 bp, Rattus norvegicus
cccgctttcctgtgcggcttaggtc

SEQ ID NO: 504008 - DNA, 25 bp, Rattus norvegicus
aggcacacccgcgttctgagagata

SEQ ID NO: 504009 - DNA, 25 bp, Rattus norvegicus
tcagagccgctccaatgatgtccgc

SEQ ID NO: 504010 - DNA, 25 bp, Rattus norvegicus
cggaggccgatcaagacccagcggc

SEQ ID NO: 504011 - DNA, 25 bp, Rattus norvegicus
ttggtttgcatcaggtccgacttta

SEQ ID NO: 504012 - DNA, 25 bp, Rattus norvegicus
ggtccgactttaacgagatagtcta

SEQ ID NO: 504013 - DNA, 25 bp, Rattus norvegicus
gatagtctacaagtcctcccatctg

SEQ ID NO: 504014 - DNA, 25 bp, Rattus norvegicus
ctcccatctgacatcggaaaacttg

SEQ ID NO: 504015 - DNA, 25 bp, Rattus norvegicus
atcggaaaacttgagcctgcatctg

SEQ ID NO: 504016 - DNA, 25 bp, Rattus norvegicus
tctgaaggagtctaccagtgcggcg

SEQ ID NO: 504017 - DNA, 25 bp, Rattus norvegicus
gtggaagacccgctgaacgacccgc

SEQ ID NO: 504018 - DNA, 25 bp, Rattus norvegicus
agacccagcggcctctccgagtctg

SEQ ID NO: 504019 - DNA, 25 bp, Rattus norvegicus
tccgagtctgcggacggactagagt

SEQ ID NO: 504020 - DNA, 25 bp, Rattus norvegicus
tctgcggacggactagagtctcttc

SEQ ID NO: 504021 - DNA, 25 bp, Rattus norvegicus
agcctgcatctgaaggagtctacca

SEQ ID NO: 504022 - DNA, 25 bp, Rattus norvegicus
gagtctcttccgtagagatagcacg

SEQ ID NO: 504023 - DNA, 25 bp, Rattus norvegicus
aacgacccgcccttggtttgcatca

SEQ ID NO: 504024 - DNA, 25 bp, Rattus norvegicus
gtggactcagcaccggcctacacag

SEQ ID NO: 504025 - DNA, 25 bp, Rattus norvegicus
gaggtggactcagcaccggcctaca

SEQ ID NO: 504026 - DNA, 25 bp, Rattus norvegicus
tacgagtacctgtccctgcgagcct

SEQ ID NO: 504027 - DNA, 25 bp, Rattus norvegicus
ctgctgccctcgaccgtgtcggccc

SEQ ID NO: 504028 - DNA, 25 bp, Rattus norvegicus
tgttggaataccgtctcctgctgcc

SEQ ID NO: 504029 - DNA, 25 bp, Rattus norvegicus
ccggatgatgaacgccgccgtttcc

SEQ ID NO: 504030 - DNA, 25 bp, Rattus norvegicus
tcggagccggatgatgaacgccgcc

SEQ ID NO: 504031 - DNA, 25 bp, Rattus norvegicus
ccgagaacgagaatgagtcggagcc

SEQ ID NO: 504032 - DNA, 25 bp, Rattus norvegicus
cgtctcccgagaacgagaatgagtc

SEQ ID NO: 504033 - DNA, 25 bp, Rattus norvegicus
agctatcaccgtctcccgagaacga

SEQ ID NO: 504034 - DNA, 25 bp, Rattus norvegicus
gagctgagggctgacacagctatca

SEQ ID NO: 504035 - DNA, 25 bp, Rattus norvegicus
cctacacaggagctgagggctgaca

SEQ ID NO: 504036 - DNA, 25 bp, Rattus norvegicus
agcaccggcctacacaggagctgag

SEQ ID NO: 504037 - DNA, 25 bp, Rattus norvegicus
gctgtacgagtacctgtccctgcga

SEQ ID NO: 504038 - DNA, 25 bp, Rattus norvegicus
atgcggcttgtgagcgcatacctga

SEQ ID NO: 504039 - DNA, 25 bp, Rattus norvegicus
cggcgcgtcatctggaaagaaagtc

SEQ ID NO: 504040 - DNA, 25 bp, Rattus norvegicus
ttagtatttgtatttatgcggcttg

SEQ ID NO: 504041 - DNA, 25 bp, Rattus norvegicus
agccatagtcaagtcacgcctccga

SEQ ID NO: 504042 - DNA, 25 bp, Rattus norvegicus
tgagcgcatacctgacggacggaac

SEQ ID NO: 504043 - DNA, 25 bp, Rattus norvegicus
atacctgacggacggaactgcagcc

SEQ ID NO: 504044 - DNA, 25 bp, Rattus norvegicus
cgcgacggtgcagccatagtcaagt

SEQ ID NO: 504045 - DNA, 25 bp, Rattus norvegicus
caagtcacgcctccgagtgtgacgc

SEQ ID NO: 504046 - DNA, 25 bp, Rattus norvegicus
tgtgacgcccacactcagagtagct

SEQ ID NO: 504047 - DNA, 25 bp, Rattus norvegicus
ctggaaagaaagtctgaactgctga

SEQ ID NO: 504048 - DNA, 25 bp, Rattus norvegicus
gaaagcggcgttccggcgcgtcatc

SEQ ID NO: 504049 - DNA, 25 bp, Rattus norvegicus
ctcagagtagctgcgaatgcactgc

SEQ ID NO: 504050 - DNA, 25 bp, Rattus norvegicus
cgggaagaactgcaaaacattagta

SEQ ID NO: 504051 - DNA, 25 bp, Rattus norvegicus
aactgctgagatggacgggaagaac

SEQ ID NO: 504052 - DNA, 25 bp, Rattus norvegicus
gttgcaaagaaaggcacccggccgc

SEQ ID NO: 504053 - DNA, 25 bp, Rattus norvegicus
gttctcagtaatacccgggattcca

SEQ ID NO: 504054 - DNA, 25 bp, Rattus norvegicus
ggattccatggcgtgcatcgtctca

SEQ ID NO: 504055 - DNA, 25 bp, Rattus norvegicus
gtgcatcgtctcagtccatcgtctc

SEQ ID NO: 504056 - DNA, 25 bp, Rattus norvegicus
tcagacacctaagaccgagtggggc

SEQ ID NO: 504057 - DNA, 25 bp, Rattus norvegicus
ctcccgcgcctgaacctgttggaaa

SEQ ID NO: 504058 - DNA, 25 bp, Rattus norvegicus
tctccgctcgggatcctaggatctc

SEQ ID NO: 504059 - DNA, 25 bp, Rattus norvegicus
ggatctcaagccaagagccaagttg

SEQ ID NO: 504060 - DNA, 25 bp, Rattus norvegicus
cctcgaaatcgggagcgtgtctcca

SEQ ID NO: 504061 - DNA, 25 bp, Rattus norvegicus
gagcgtgtctccaaacccggcgaga

SEQ ID NO: 504062 - DNA, 25 bp, Rattus norvegicus
cccggcgagagaaaggaccacccag

SEQ ID NO: 504063 - DNA, 25 bp, Rattus norvegicus
ccacccagccgcagaaggcgaggtt

SEQ ID NO: 504064 - DNA, 25 bp, Rattus norvegicus
agcccgaggatcacgcagaacgttc

SEQ ID NO: 504065 - DNA, 25 bp, Rattus norvegicus
agggaagccctcacttagacgctca

SEQ ID NO: 504066 - DNA, 25 bp, Rattus norvegicus
tcttgcccagactgccaaagccagg

SEQ ID NO: 504067 - DNA, 25 bp, Rattus norvegicus
tctgcagatccggactgggttttca

SEQ ID NO: 504068 - DNA, 25 bp, Rattus norvegicus
gcaccaaagggtccggccgggcaca

SEQ ID NO: 504069 - DNA, 25 bp, Rattus norvegicus
cctgcgcgcagcaagttctcgatca

SEQ ID NO: 504070 - DNA, 25 bp, Rattus norvegicus
agttctcgatcaggaaactcttgcc

SEQ ID NO: 504071 - DNA, 25 bp, Rattus norvegicus
atggaaggtgtgtccgacccatcca

SEQ ID NO: 504072 - DNA, 25 bp, Rattus norvegicus
gagtgcgtccttagccctcagcagc

SEQ ID NO: 504073 - DNA, 25 bp, Rattus norvegicus
agcgtcctggaacagtctgcagatc

SEQ ID NO: 504074 - DNA, 25 bp, Rattus norvegicus
tgagcgcaatgagagtccgggctcc

SEQ ID NO: 504075 - DNA, 25 bp, Rattus norvegicus
cggccaacaatgagcgcaatgagag

SEQ ID NO: 504076 - DNA, 25 bp, Rattus norvegicus
cccacagtgacagatgcggccaaca

SEQ ID NO: 504077 - DNA, 25 bp, Rattus norvegicus
attcatgtcatccagcccacagtga

SEQ ID NO: 504078 - DNA, 25 bp, Rattus norvegicus
gaggacgccaccacatcccagtagg

SEQ ID NO: 504079 - DNA, 25 bp, Rattus norvegicus
tgtgtccgacccatccattcatgtc

SEQ ID NO: 504080 - DNA, 25 bp, Rattus norvegicus
tgtgttcacgttaagatccagacgg

SEQ ID NO: 504081 - DNA, 25 bp, Rattus norvegicus
ttttacgaaacatgactctcctccg

SEQ ID NO: 504082 - DNA, 25 bp, Rattus norvegicus
gaaacagccgttttacgaaacatga

SEQ ID NO: 504083 - DNA, 25 bp, Rattus norvegicus
gcaaccagagggaaaccgagaaaca

SEQ ID NO: 504084 - DNA, 25 bp, Rattus norvegicus
gggaagtcgtgctgcagcaaccaga

SEQ ID NO: 504085 - DNA, 25 bp, Rattus norvegicus
cagaacgatttctttgtgttcgtgg

SEQ ID NO: 504086 - DNA, 25 bp, Rattus norvegicus
ggatgttaagggacagaacgatttc

SEQ ID NO: 504087 - DNA, 25 bp, Rattus norvegicus
tctcgagctcgtcggtggacaagtg

SEQ ID NO: 504088 - DNA, 25 bp, Rattus norvegicus
gtaacagctgtctcgagctcgtcgg

SEQ ID NO: 504089 - DNA, 25 bp, Rattus norvegicus
tgcggactagcacgttgtgttcacg

SEQ ID NO: 504090 - DNA, 25 bp, Rattus norvegicus
atccagacggagaggtagggccacc

SEQ ID NO: 504091 - DNA, 25 bp, Rattus norvegicus
ggccacccgctgagttcaagagacg

SEQ ID NO: 504092 - DNA, 25 bp, Rattus norvegicus
tctcctccgtccctatcaagttgtg

SEQ ID NO: 504093 - DNA, 25 bp, Rattus norvegicus
cctatcaagttgtggctcgtggtgc

SEQ ID NO: 504094 - DNA, 25 bp, Rattus norvegicus
ctgagcagcgcttgccgaagcagag

SEQ ID NO: 504095 - DNA, 25 bp, Rattus norvegicus
tgcagatgatgactaggaacgtcct

SEQ ID NO: 504096 - DNA, 25 bp, Rattus norvegicus
ctatgacgtgttcggcatagtcccg

SEQ ID NO: 504097 - DNA, 25 bp, Rattus norvegicus
acaccaatcgggcaccttgtgacgc

SEQ ID NO: 504098 - DNA, 25 bp, Rattus norvegicus
cctcgtcactgtgcagactagttta

SEQ ID NO: 504099 - DNA, 25 bp, Rattus norvegicus
gactagtttaaagaccctggcgagc

SEQ ID NO: 504100 - DNA, 25 bp, Rattus norvegicus
tcctgctgaacatggagctggaaga

SEQ ID NO: 504101 - DNA, 25 bp, Rattus norvegicus
ctgggcatgctcagttgcacagctg

SEQ ID NO: 504102 - DNA, 25 bp, Rattus norvegicus
gaagccgaggctcccgagcaacttt

SEQ ID NO: 504103 - DNA, 25 bp, Rattus norvegicus
gagcaactttgggtctttttcctgc

SEQ ID NO: 504104 - DNA, 25 bp, Rattus norvegicus
tcctgcgtcgtctctggcagtgttt

SEQ ID NO: 504105 - DNA, 25 bp, Rattus norvegicus
cgggttcacgacacacctgagcagg

SEQ ID NO: 504106 - DNA, 25 bp, Rattus norvegicus
ctgagcaggattctccgaggccaca

SEQ ID NO: 504107 - DNA, 25 bp, Rattus norvegicus
ccggcccgcagagacacaaacaaaa

SEQ ID NO: 504108 - DNA, 25 bp, Rattus norvegicus
ttccgtcgaatgattgcaaagcgcg

SEQ ID NO: 504109 - DNA, 25 bp, Rattus norvegicus
cgggttttatgagttgcgaagatta

SEQ ID NO: 504110 - DNA, 25 bp, Rattus norvegicus
gttgcgaagattacatcctctcaga

SEQ ID NO: 504111 - DNA, 25 bp, Rattus norvegicus
gattacatcctctcagatgtgtgga

SEQ ID NO: 504112 - DNA, 25 bp, Rattus norvegicus
tctgggatggcggtaaaacccgaca

SEQ ID NO: 504113 - DNA, 25 bp, Rattus norvegicus
acccgacagtttctgcgctaatcga

SEQ ID NO: 504114 - DNA, 25 bp, Rattus norvegicus
tttctgcgctaatcgatgctgaacg

SEQ ID NO: 504115 - DNA, 25 bp, Rattus norvegicus
gctaatcgatgctgaacgcagacga

SEQ ID NO: 504116 - DNA, 25 bp, Rattus norvegicus
tgctgaacgcagacgagaatgaatc

SEQ ID NO: 504117 - DNA, 25 bp, Rattus norvegicus
cgcagacgagaatgaatcacattta

SEQ ID NO: 504118 - DNA, 25 bp, Rattus norvegicus
catttaatgaacgtagcatgcaggc

SEQ ID NO: 504119 - DNA, 25 bp, Rattus norvegicus
acgcatgcgcgggttttatgagttg

SEQ ID NO: 504120 - DNA, 25 bp, Rattus norvegicus
caggccgttccgtcgaatgattgca

SEQ ID NO: 504121 - DNA, 25 bp, Rattus norvegicus
aacgtagcatgcaggccgttccgtc

SEQ ID NO: 504122 - DNA, 25 bp, Rattus norvegicus
cgcctgcggacaaaatggggtctgc

SEQ ID NO: 504123 - DNA, 25 bp, Rattus norvegicus
gctgctctgcttgctacaggaagtg

SEQ ID NO: 504124 - DNA, 25 bp, Rattus norvegicus
gcgcctgacccggaactatatgttg

SEQ ID NO: 504125 - DNA, 25 bp, Rattus norvegicus
ttccttctgcaacaggcgtgggtca

SEQ ID NO: 504126 - DNA, 25 bp, Rattus norvegicus
ttggttccgtgttctccgcacagta

SEQ ID NO: 504127 - DNA, 25 bp, Rattus norvegicus
ttgcgcctctgctttccatccgtag

SEQ ID NO: 504128 - DNA, 25 bp, Rattus norvegicus
cccgtatttaggcatcggaacgtga

SEQ ID NO: 504129 - DNA, 25 bp, Rattus norvegicus
tcacagccttggaactcgtaacgtc

SEQ ID NO: 504130 - DNA, 25 bp, Rattus norvegicus
cgtaacgtcgttcgtcctgtggcaa

SEQ ID NO: 504131 - DNA, 25 bp, Rattus norvegicus
cgtattcttgctctgcgaagtggtc

SEQ ID NO: 504132 - DNA, 25 bp, Rattus norvegicus
tcagaagagtctatgggtcccaggc

SEQ ID NO: 504133 - DNA, 25 bp, Rattus norvegicus
gggcccaaggtagcgcctgaaatct

SEQ ID NO: 504134 - DNA, 25 bp, Rattus norvegicus
ctgtggagctcagagttcttaactc

SEQ ID NO: 504135 - DNA, 25 bp, Rattus norvegicus
cccgggcatttagttaaggagcact

SEQ ID NO: 504136 - DNA, 25 bp, Rattus norvegicus
agaaatgcccgcctttgtgtccgag

SEQ ID NO: 504137 - DNA, 25 bp, Rattus norvegicus
cccgcctttgtgtccgagtgacagc

SEQ ID NO: 504138 - DNA, 25 bp, Rattus norvegicus
ctttgtgtccgagtgacagcgcacg

SEQ ID NO: 504139 - DNA, 25 bp, Rattus norvegicus
ggacaggggtgctgctactaaccca

SEQ ID NO: 504140 - DNA, 25 bp, Rattus norvegicus
ctcgcctgggtaccaccaagaaatg

SEQ ID NO: 504141 - DNA, 25 bp, Rattus norvegicus
acaggtgtgcgtggccacgtcgccc

SEQ ID NO: 504142 - DNA, 25 bp, Rattus norvegicus
gtggacttggccctgagcatccttc

SEQ ID NO: 504143 - DNA, 25 bp, Rattus norvegicus
tgaccttcttcggatgtggacttgg

SEQ ID NO: 504144 - DNA, 25 bp, Rattus norvegicus
aatgcccgcctttgtgtccgagtga

SEQ ID NO: 504145 - DNA, 25 bp, Rattus norvegicus
gccctgggtgaccttcttcggatgt

SEQ ID NO: 504146 - DNA, 25 bp, Rattus norvegicus
acgtcgccctgggtgaccttcttcg

SEQ ID NO: 504147 - DNA, 25 bp, Rattus norvegicus
taccaccaagaaatgcccgcctttg

SEQ ID NO: 504148 - DNA, 25 bp, Rattus norvegicus
gggtgctgctactaacccacggcgc

SEQ ID NO: 504149 - DNA, 25 bp, Rattus norvegicus
gcctcacaggtgtgcgtggccacgt

SEQ ID NO: 504150 - DNA, 25 bp, Rattus norvegicus
gcctgtagttcagactctgcgtcta

SEQ ID NO: 504151 - DNA, 25 bp, Rattus norvegicus
tctgcgtctaattaaggccctcgtc

SEQ ID NO: 504152 - DNA, 25 bp, Rattus norvegicus
cttgaaggaaacaacatgacggtct

SEQ ID NO: 504153 - DNA, 25 bp, Rattus norvegicus
gtaccaactctctgtggcccgcaga

SEQ ID NO: 504154 - DNA, 25 bp, Rattus norvegicus
catgacggtctttgttaaactgcgg

SEQ ID NO: 504155 - DNA, 25 bp, Rattus norvegicus
actgcggttggaatgtaaattacta

SEQ ID NO: 504156 - DNA, 25 bp, Rattus norvegicus
ctcgtcgtgcgcttacttgaaggaa

SEQ ID NO: 504157 - DNA, 25 bp, Rattus norvegicus
atgtcctgagtcacgcctgtagttc

SEQ ID NO: 504158 - DNA, 25 bp, Rattus norvegicus
caccgtgctatgtaggctggaaaga

SEQ ID NO: 504159 - DNA, 25 bp, Rattus norvegicus
tgtgccatcttatccgtaccaactc

SEQ ID NO: 504160 - DNA, 25 bp, Rattus norvegicus
agcacaggctgggacttctcggtct

SEQ ID NO: 504161 - DNA, 25 bp, Rattus norvegicus
acttctcggtcttctagcgcgcgct

SEQ ID NO: 504162 - DNA, 25 bp, Rattus norvegicus
tacagacgcgcaacaccgtgctatg

SEQ ID NO: 504163 - DNA, 25 bp, Rattus norvegicus
agggtaggattacgattgtgccatc

SEQ ID NO: 504164 - DNA, 25 bp, Rattus norvegicus
gctcccatcggaaaagactacctga

SEQ ID NO: 504165 - DNA, 25 bp, Rattus norvegicus
cctgttgggtgcaccaaaccgacca

SEQ ID NO: 504166 - DNA, 25 bp, Rattus norvegicus
tgaccgtttgcatacctcctgttgg

SEQ ID NO: 504167 - DNA, 25 bp, Rattus norvegicus
tgatgctcaacctttgtaaaccggg

SEQ ID NO: 504168 - DNA, 25 bp, Rattus norvegicus
caccaaaggggaagcatgatgctca

SEQ ID NO: 504169 - DNA, 25 bp, Rattus norvegicus
accttgggctagtgactttgccacc

SEQ ID NO: 504170 - DNA, 25 bp, Rattus norvegicus
aaatccgtttcctagagtgagcacc

SEQ ID NO: 504171 - DNA, 25 bp, Rattus norvegicus
cctcgggtgtcaggaatttcctagc

SEQ ID NO: 504172 - DNA, 25 bp, Rattus norvegicus
gcttgcgaggcactcactggtcctc

SEQ ID NO: 504173 - DNA, 25 bp, Rattus norvegicus
ctcggctgtgtgtaatggttgaaga

SEQ ID NO: 504174 - DNA, 25 bp, Rattus norvegicus
agatccctcgcctcgcacaaaatgg

SEQ ID NO: 504175 - DNA, 25 bp, Rattus norvegicus
cggaagcacgctccgctgtattaca

SEQ ID NO: 504176 - DNA, 25 bp, Rattus norvegicus
gccaccagtggctgtctctaaaatg

SEQ ID NO: 504177 - DNA, 25 bp, Rattus norvegicus
tgactcttactatcctgtgaccttg

SEQ ID NO: 504178 - DNA, 25 bp, Rattus norvegicus
tcgacctatcggagctacgcacagg

SEQ ID NO: 504179 - DNA, 25 bp, Rattus norvegicus
gactgatcgggtgtctgtgtctccg

SEQ ID NO: 504180 - DNA, 25 bp, Rattus norvegicus
ctctaacagcgaccggggagcacta

SEQ ID NO: 504181 - DNA, 25 bp, Rattus norvegicus
cggggagcactaactttgttaagag

SEQ ID NO: 504182 - DNA, 25 bp, Rattus norvegicus
actttgttaagaggccgaatgagca

SEQ ID NO: 504183 - DNA, 25 bp, Rattus norvegicus
tgcacgcagggctgaccagctcgct

SEQ ID NO: 504184 - DNA, 25 bp, Rattus norvegicus
aaggaacgaccctgccggccgactg

SEQ ID NO: 504185 - DNA, 25 bp, Rattus norvegicus
cgttgcggagctctccacggagcct

SEQ ID NO: 504186 - DNA, 25 bp, Rattus norvegicus
ctcacctgtaggtggccgtcccaga

SEQ ID NO: 504187 - DNA, 25 bp, Rattus norvegicus
ggtggccgtcccagacaactccgga

SEQ ID NO: 504188 - DNA, 25 bp, Rattus norvegicus
ctaagccacgtcagctcgggtaacc

SEQ ID NO: 504189 - DNA, 25 bp, Rattus norvegicus
ctgggagtcagccactcgctgtgaa

SEQ ID NO: 504190 - DNA, 25 bp, Rattus norvegicus
aaggctggattaaggcgtcgaccta

SEQ ID NO: 504191 - DNA, 25 bp, Rattus norvegicus
actcgctgtgaaacggaaggctgga

SEQ ID NO: 504192 - DNA, 25 bp, Rattus norvegicus
gtgtccgtcagtccgccgctaagtt

SEQ ID NO: 504193 - DNA, 25 bp, Rattus norvegicus
ccgctaagttctgcaccatggactc

SEQ ID NO: 504194 - DNA, 25 bp, Rattus norvegicus
tggactcctccggacgctcagaagc

SEQ ID NO: 504195 - DNA, 25 bp, Rattus norvegicus
agcacgcagccacgcagcaggagac

SEQ ID NO: 504196 - DNA, 25 bp, Rattus norvegicus
cggggcttctgggaaacattcttct

SEQ ID NO: 504197 - DNA, 25 bp, Rattus norvegicus
ggatgaagtactcggccagctgacc

SEQ ID NO: 504198 - DNA, 25 bp, Rattus norvegicus
tgtcgctcggagcactacgcgcacg

SEQ ID NO: 504199 - DNA, 25 bp, Rattus norvegicus
acgcgcggctctcagacttcatcat

SEQ ID NO: 504200 - DNA, 25 bp, Rattus norvegicus
ccgtggggacaataaagatgttttg

SEQ ID NO: 504201 - DNA, 25 bp, Rattus norvegicus
agatgttttggagagtctgcagtcc

SEQ ID NO: 504202 - DNA, 25 bp, Rattus norvegicus
tctgcagtcctgagaagaactcgtg

SEQ ID NO: 504203 - DNA, 25 bp, Rattus norvegicus
actcgtgcgttgttggcatggatga

SEQ ID NO: 504204 - DNA, 25 bp, Rattus norvegicus
ggctccaactttgctcgcagcgaaa

SEQ ID NO: 504205 - DNA, 25 bp, Rattus norvegicus
tacctcaggccgaggtccaggcgtc

SEQ ID NO: 504206 - DNA, 25 bp, Rattus norvegicus
gttcctgaagccaacacctgcgttc

SEQ ID NO: 504207 - DNA, 25 bp, Rattus norvegicus
agtagtgatccgcaaccgtaaagcc

SEQ ID NO: 504208 - DNA, 25 bp, Rattus norvegicus
accgtcatctctgggttagtagtga

SEQ ID NO: 504209 - DNA, 25 bp, Rattus norvegicus
gggcagccaacgtgcacgtgtttac

SEQ ID NO: 504210 - DNA, 25 bp, Rattus norvegicus
tcctcttggtgtcaaggtctgccta

SEQ ID NO: 504211 - DNA, 25 bp, Rattus norvegicus
cccggcagttagatgtcctcttggt

SEQ ID NO: 504212 - DNA, 25 bp, Rattus norvegicus
gttaccggcgaccttcaggcagagt

SEQ ID NO: 504213 - DNA, 25 bp, Rattus norvegicus
tgacgcaaccactcgcaggtaaggg

SEQ ID NO: 504214 - DNA, 25 bp, Rattus norvegicus
ctttaatttgggcagtgacgcaacc

SEQ ID NO: 504215 - DNA, 25 bp, Rattus norvegicus
ccagcacagttccacgggagagaga

SEQ ID NO: 504216 - DNA, 25 bp, Rattus norvegicus
gtccctgctgttgtgtgagaatcgc

SEQ ID NO: 504217 - DNA, 25 bp, Rattus norvegicus
tggaaccggatctggtgccacactt

SEQ ID NO: 504218 - DNA, 25 bp, Rattus norvegicus
tgcagactgattcacactcctcggt

SEQ ID NO: 504219 - DNA, 25 bp, Rattus norvegicus
acgtgtttacggcactgaggagcca

SEQ ID NO: 504220 - DNA, 25 bp, Rattus norvegicus
ttgcagcagacaagagacccgcgcg

SEQ ID NO: 504221 - DNA, 25 bp, Rattus norvegicus
cgggcgttcgtctttgtgtatcaac

SEQ ID NO: 504222 - DNA, 25 bp, Rattus norvegicus
cccggttgtgttctcgatctttcca

SEQ ID NO: 504223 - DNA, 25 bp, Rattus norvegicus
tcccgcagaacttgagccagcgctg

SEQ ID NO: 504224 - DNA, 25 bp, Rattus norvegicus
cccagcccgcgacttaagatttacg

SEQ ID NO: 504225 - DNA, 25 bp, Rattus norvegicus
ttgtgtatcaacagcacctgggctc

SEQ ID NO: 504226 - DNA, 25 bp, Rattus norvegicus
cgcaatccaacaggcacaagagatg

SEQ ID NO: 504227 - DNA, 25 bp, Rattus norvegicus
acctcggtgctcttcctgcgagctg

SEQ ID NO: 504228 - DNA, 25 bp, Rattus norvegicus
ggtcacgatcctccagcagagacta

SEQ ID NO: 504229 - DNA, 25 bp, Rattus norvegicus
gggtttccaagccaatggagtcaca

SEQ ID NO: 504230 - DNA, 25 bp, Rattus norvegicus
gcccggactccacgatgggtttcca

SEQ ID NO: 504231 - DNA, 25 bp, Rattus norvegicus
actgatgcaataccgaggggcgatt

SEQ ID NO: 504232 - DNA, 25 bp, Rattus norvegicus
ccaacgctgcgtttcggggacacat

SEQ ID NO: 504233 - DNA, 25 bp, Rattus norvegicus
gggctgtctcggtcacaccagaatt

SEQ ID NO: 504234 - DNA, 25 bp, Rattus norvegicus
tcagtaggtctcctgaaaaatttcc

SEQ ID NO: 504235 - DNA, 25 bp, Rattus norvegicus
gcttcccgggctcgtcacgctaaat

SEQ ID NO: 504236 - DNA, 25 bp, Rattus norvegicus
cctctgaggaaagccgctccgggag

SEQ ID NO: 504237 - DNA, 25 bp, Rattus norvegicus
tgctcgcctctcaggatgccaggcg

SEQ ID NO: 504238 - DNA, 25 bp, Rattus norvegicus
ccagcgcgagttgctggggaagtca

SEQ ID NO: 504239 - DNA, 25 bp, Rattus norvegicus
atgccaggcggccacacattaggtc

SEQ ID NO: 504240 - DNA, 25 bp, Rattus norvegicus
cgcgcagcctcagtaggtctcctga

SEQ ID NO: 504241 - DNA, 25 bp, Rattus norvegicus
tctcctgaaaaatttccactgaggc

SEQ ID NO: 504242 - DNA, 25 bp, Rattus norvegicus
agcgcttctgcgcagagcgcctctg

SEQ ID NO: 504243 - DNA, 25 bp, Rattus norvegicus
cagcgacacggggaacctagagagt

SEQ ID NO: 504244 - DNA, 25 bp, Rattus norvegicus
ggaacctagagagtcgtgatcctca

SEQ ID NO: 504245 - DNA, 25 bp, Rattus norvegicus
gtcgtgatcctcagggctgatcctc

SEQ ID NO: 504246 - DNA, 25 bp, Rattus norvegicus
tcagggctgatcctctgaggaaagc

SEQ ID NO: 504247 - DNA, 25 bp, Rattus norvegicus
aacccgctcagaggcaaacgggcgg

SEQ ID NO: 504248 - DNA, 25 bp, Rattus norvegicus
caagctcttgggactccttagagtc

SEQ ID NO: 504249 - DNA, 25 bp, Rattus norvegicus
gggaagggtgcgatcctctttaaga

SEQ ID NO: 504250 - DNA, 25 bp, Rattus norvegicus
ggcgcacttccagcgactcgggtaa

SEQ ID NO: 504251 - DNA, 25 bp, Rattus norvegicus
ctgctactatagcttggaggtccca

SEQ ID NO: 504252 - DNA, 25 bp, Rattus norvegicus
atcaactatcaagagaccgcgagtc

SEQ ID NO: 504253 - DNA, 25 bp, Rattus norvegicus
agcgcgttcgccgtcagaaattcaa

SEQ ID NO: 504254 - DNA, 25 bp, Rattus norvegicus
ctactcgcggtatggaaattcaaca

SEQ ID NO: 504255 - DNA, 25 bp, Rattus norvegicus
cgggtaacacctcgtgggcacgatc

SEQ ID NO: 504256 - DNA, 25 bp, Rattus norvegicus
ggagcctgctgatctactcgcggta

SEQ ID NO: 504257 - DNA, 25 bp, Rattus norvegicus
acagcaaaatctcagcgcccgtgga

SEQ ID NO: 504258 - DNA, 25 bp, Rattus norvegicus
gcctgggctctaaacaaattccctc

SEQ ID NO: 504259 - DNA, 25 bp, Rattus norvegicus
ctccgcctgccctggtttactttat

SEQ ID NO: 504260 - DNA, 25 bp, Rattus norvegicus
acagagttccgagacctatatgccc

SEQ ID NO: 504261 - DNA, 25 bp, Rattus norvegicus
ccacgcgggcacagtaggaaaaaga

SEQ ID NO: 504262 - DNA, 25 bp, Rattus norvegicus
ccaacctgagcctcgtggataaagc

SEQ ID NO: 504263 - DNA, 25 bp, Rattus norvegicus
cgttaccggttttgccgtcacagtg

SEQ ID NO: 504264 - DNA, 25 bp, Rattus norvegicus
cccagatgaaatcggtgttcccgtt

SEQ ID NO: 504265 - DNA, 25 bp, Rattus norvegicus
gtctcattcaacaggcgctgcctgt

SEQ ID NO: 504266 - DNA, 25 bp, Rattus norvegicus
ccgtgtctttatccggctccaacag

SEQ ID NO: 504267 - DNA, 25 bp, Rattus norvegicus
caggcttccgttgtaaaacactcga

SEQ ID NO: 504268 - DNA, 25 bp, Rattus norvegicus
agggttctctataaccaggcttccg

SEQ ID NO: 504269 - DNA, 25 bp, Rattus norvegicus
ctgagcctcgtggataaagccaagt

SEQ ID NO: 504270 - DNA, 25 bp, Rattus norvegicus
cgggacccacccagatgaaatcggt

SEQ ID NO: 504271 - DNA, 25 bp, Rattus norvegicus
cgtcacagtggacaatcgccctttc

SEQ ID NO: 504272 - DNA, 25 bp, Rattus norvegicus
tccaacagcctgttgtcgggaccca

SEQ ID NO: 504273 - DNA, 25 bp, Rattus norvegicus
gcgtcctcaaaaccagggttctcta

SEQ ID NO: 504274 - DNA, 25 bp, Rattus norvegicus
ttcatggcgatacaggagtaaaccc

SEQ ID NO: 504275 - DNA, 25 bp, Rattus norvegicus
ggcgctgcctgttcatggcgataca

SEQ ID NO: 504276 - DNA, 25 bp, Rattus norvegicus
tagccgaccactcacagcgcgggga

SEQ ID NO: 504277 - DNA, 25 bp, Rattus norvegicus
tcgcatcccataaacaattgaacgg

SEQ ID NO: 504278 - DNA, 25 bp, Rattus norvegicus
gaaatacttagccagccgtcggtct

SEQ ID NO: 504279 - DNA, 25 bp, Rattus norvegicus
gcgcgctcgcaccttccctccagct

SEQ ID NO: 504280 - DNA, 25 bp, Rattus norvegicus
accccgatctcggagcctggtttag

SEQ ID NO: 504281 - DNA, 25 bp, Rattus norvegicus
cggcgcgttccctccggcaccaccg

SEQ ID NO: 504282 - DNA, 25 bp, Rattus norvegicus
gccgacacaaaaaatacacaatcgc

SEQ ID NO: 504283 - DNA, 25 bp, Rattus norvegicus
gttcgagcccttttcctaactcaga

SEQ ID NO: 504284 - DNA, 25 bp, Rattus norvegicus
cttagccagccgtcggtctagccga

SEQ ID NO: 504285 - DNA, 25 bp, Rattus norvegicus
attgaacggaaatacttagccagcc

SEQ ID NO: 504286 - DNA, 25 bp, Rattus norvegicus
tcctaactcagagacggcggcgcga

SEQ ID NO: 504287 - DNA, 25 bp, Rattus norvegicus
tgcgctcaaaaggtccgcgcgtccg

SEQ ID NO: 504288 - DNA, 25 bp, Rattus norvegicus
agcccttttcctaactcagagacgg

SEQ ID NO: 504289 - DNA, 25 bp, Rattus norvegicus
ccgccgacggcggtgcgctcaaaag

SEQ ID NO: 504290 - DNA, 25 bp, Rattus norvegicus
tgagagaaccaaacccgacaacttc

SEQ ID NO: 504291 - DNA, 25 bp, Rattus norvegicus
gcgggtctcatagcgacctcctttc

SEQ ID NO: 504292 - DNA, 25 bp, Rattus norvegicus
gcgggtggaaatgcttctaggctcc

SEQ ID NO: 504293 - DNA, 25 bp, Rattus norvegicus
tctaggctccgaaaagcattgcgtg

SEQ ID NO: 504294 - DNA, 25 bp, Rattus norvegicus
gttgtgtgatttttacagttgaaca

SEQ ID NO: 504295 - DNA, 25 bp, Rattus norvegicus
cattgcgtggccgagttggaaagtt

SEQ ID NO: 504296 - DNA, 25 bp, Rattus norvegicus
tatcaccgtgagagaaccaaacccg

SEQ ID NO: 504297 - DNA, 25 bp, Rattus norvegicus
ccgacaacttctatttcactgtatc

SEQ ID NO: 504298 - DNA, 25 bp, Rattus norvegicus
tttcagaggaatgaaccggacgggc

SEQ ID NO: 504299 - DNA, 25 bp, Rattus norvegicus
ccgggtttgattccctgcttgaagg

SEQ ID NO: 504300 - DNA, 25 bp, Rattus norvegicus
cttgaaggtaagaacttggactcgc

SEQ ID NO: 504301 - DNA, 25 bp, Rattus norvegicus
cttggactcgcgagagtcctggatg

SEQ ID NO: 504302 - DNA, 25 bp, Rattus norvegicus
ttttaaacgggtgcgcgttcattgc

SEQ ID NO: 504303 - DNA, 25 bp, Rattus norvegicus
cagttgaacagtacgtatcaccgtg

SEQ ID NO: 504304 - DNA, 25 bp, Rattus norvegicus
cagtgcgtggaaagtagctttattc

SEQ ID NO: 504305 - DNA, 25 bp, Rattus norvegicus
agatcgcgcacgaactgcacctcag

SEQ ID NO: 504306 - DNA, 25 bp, Rattus norvegicus
tcagcagccacctgtgcggctagcg

SEQ ID NO: 504307 - DNA, 25 bp, Rattus norvegicus
ctagcgcgtcgtagcggttctcaag

SEQ ID NO: 504308 - DNA, 25 bp, Rattus norvegicus
tcacgccggcgaacctgtgaggagc

SEQ ID NO: 504309 - DNA, 25 bp, Rattus norvegicus
gttctcaaggcgacacaggcgacgt

SEQ ID NO: 504310 - DNA, 25 bp, Rattus norvegicus
acttgagactgtactcgcgcaggcg

SEQ ID NO: 504311 - DNA, 25 bp, Rattus norvegicus
cggcatgcttgagtgcgacttgaga

SEQ ID NO: 504312 - DNA, 25 bp, Rattus norvegicus
gtagctcgtgtttcgcggcatgctt

SEQ ID NO: 504313 - DNA, 25 bp, Rattus norvegicus
tagctttattctggggatgggccga

SEQ ID NO: 504314 - DNA, 25 bp, Rattus norvegicus
gaagcgctcgaagctggcgtagctc

SEQ ID NO: 504315 - DNA, 25 bp, Rattus norvegicus
tccagcacgcgcgagaagcgctcga

SEQ ID NO: 504316 - DNA, 25 bp, Rattus norvegicus
tgcgcagagcctcggtgcgacccag

SEQ ID NO: 504317 - DNA, 25 bp, Rattus norvegicus
acaggcgacgtttcaggccaccagc

SEQ ID NO: 504318 - DNA, 25 bp, Rattus norvegicus
accgaggctccgcaggacgagtctc

SEQ ID NO: 504319 - DNA, 25 bp, Rattus norvegicus
cgggtctcatcctctctgttacggg

SEQ ID NO: 504320 - DNA, 25 bp, Rattus norvegicus
atcccgggtctcatcctctctgtta

SEQ ID NO: 504321 - DNA, 25 bp, Rattus norvegicus
ctaggcctttgagatcccgggtctc

SEQ ID NO: 504322 - DNA, 25 bp, Rattus norvegicus
cagtcgtgactaggcctttgagatc

SEQ ID NO: 504323 - DNA, 25 bp, Rattus norvegicus
ccagtttgttgtgctggcgttgaaa

SEQ ID NO: 504324 - DNA, 25 bp, Rattus norvegicus
catcctctctgttacgggaggggaa

SEQ ID NO: 504325 - DNA, 25 bp, Rattus norvegicus
tagcctgagatgtaggaagcgcccg

SEQ ID NO: 504326 - DNA, 25 bp, Rattus norvegicus
cggcgcgtctggctgctgacctaac

SEQ ID NO: 504327 - DNA, 25 bp, Rattus norvegicus
ggctgctgacctaacccaggaggta

SEQ ID NO: 504328 - DNA, 25 bp, Rattus norvegicus
tgacctaacccaggaggtacgtgtc

SEQ ID NO: 504329 - DNA, 25 bp, Rattus norvegicus
gcgtcgggtcctcgggctttcgcta

SEQ ID NO: 504330 - DNA, 25 bp, Rattus norvegicus
gctttcgctagaacccgagtggggc

SEQ ID NO: 504331 - DNA, 25 bp, Rattus norvegicus
cccggtgtcccgcagtcgtgactag

SEQ ID NO: 504332 - DNA, 25 bp, Rattus norvegicus
acagcgtacctcagcgtggcggcct

SEQ ID NO: 504333 - DNA, 25 bp, Rattus norvegicus
aagcagccgcgctgtgctttccaca

SEQ ID NO: 504334 - DNA, 25 bp, Rattus norvegicus
tttccacaccgtgcgctgtgagtgc

SEQ ID NO: 504335 - DNA, 25 bp, Rattus norvegicus
ccgtcgcgagcggattctcaaatta

SEQ ID NO: 504336 - DNA, 25 bp, Rattus norvegicus
ttccagaaccgcctcggagcaacta

SEQ ID NO: 504337 - DNA, 25 bp, Rattus norvegicus
gaccagcgggactcgcatacctcga

SEQ ID NO: 504338 - DNA, 25 bp, Rattus norvegicus
cgcggccagtgcaagctactccaga

SEQ ID NO: 504339 - DNA, 25 bp, Rattus norvegicus
cgcacgcgtctggagagagatgaac

SEQ ID NO: 504340 - DNA, 25 bp, Rattus norvegicus
ggggcggagcaactgtctccagaca

SEQ ID NO: 504341 - DNA, 25 bp, Rattus norvegicus
tcgccaccttaggtctgttacctca

SEQ ID NO: 504342 - DNA, 25 bp, Rattus norvegicus
cagttcttccctacgttcctggcgt

SEQ ID NO: 504343 - DNA, 25 bp, Rattus norvegicus
aggaggcccacgctcccgttagcag

SEQ ID NO: 504344 - DNA, 25 bp, Rattus norvegicus
cgaaagtttcgagaagcagccgcgc

SEQ ID NO: 504345 - DNA, 25 bp, Rattus norvegicus
ccaatcaagactcggggcgctccaa

SEQ ID NO: 504346 - DNA, 25 bp, Rattus norvegicus
cacctccagacacggcctgtccgcg

SEQ ID NO: 504347 - DNA, 25 bp, Rattus norvegicus
ttctactgaccatcttgccctccac

SEQ ID NO: 504348 - DNA, 25 bp, Rattus norvegicus
tactgaccatcttgccctccacctc

SEQ ID NO: 504349 - DNA, 25 bp, Rattus norvegicus
gccctccacctccagacacggcctg

SEQ ID NO: 504350 - DNA, 25 bp, Rattus norvegicus
tccacctccagacacggcctgtccg

SEQ ID NO: 504351 - DNA, 25 bp, Rattus norvegicus
tccagacacggcctgtccgcgatct

SEQ ID NO: 504352 - DNA, 25 bp, Rattus norvegicus
cagacacggcctgtccgcgatctcc

SEQ ID NO: 504353 - DNA, 25 bp, Rattus norvegicus
gacacggcctgtccgcgatctcccg

SEQ ID NO: 504354 - DNA, 25 bp, Rattus norvegicus
agaacagctcgtcatggctgatgag

SEQ ID NO: 504355 - DNA, 25 bp, Rattus norvegicus
gaacagctcgtcatggctgatgagg

SEQ ID NO: 504356 - DNA, 25 bp, Rattus norvegicus
agcgcggagcgaacgcagtgcagcg

SEQ ID NO: 504357 - DNA, 25 bp, Rattus norvegicus
gcggagcgaacgcagtgcagcggga

SEQ ID NO: 504358 - DNA, 25 bp, Rattus norvegicus
cagtgcagcgggagtggcgctcggg

SEQ ID NO: 504359 - DNA, 25 bp, Rattus norvegicus
cctccacctccagacacggcctgtc

SEQ ID NO: 504360 - DNA, 25 bp, Rattus norvegicus
gacagtggcgctagcctgacagcgc

SEQ ID NO: 504361 - DNA, 25 bp, Rattus norvegicus
tcgatggcaccctctgttctactga

SEQ ID NO: 504362 - DNA, 25 bp, Rattus norvegicus
tgaggtcccggtagatgatcatggt

SEQ ID NO: 504363 - DNA, 25 bp, Rattus norvegicus
agcatttccaccaatgagtgaatca

SEQ ID NO: 504364 - DNA, 25 bp, Rattus norvegicus
gcgatctcccggatcttgtagatgt

SEQ ID NO: 504365 - DNA, 25 bp, Rattus norvegicus
cgcgatctcccggatcttgtagatg

SEQ ID NO: 504366 - DNA, 25 bp, Rattus norvegicus
gatgaggtcccggtagatgatcatg

SEQ ID NO: 504367 - DNA, 25 bp, Rattus norvegicus
gatggcaccctctgttctactgacc

SEQ ID NO: 504368 - DNA, 25 bp, Rattus norvegicus
gcgctagcctgacagcgcggagcga

SEQ ID NO: 504369 - DNA, 25 bp, Rattus norvegicus
atcatcgatggcaccctctgttcta

SEQ ID NO: 504370 - DNA, 25 bp, Rattus norvegicus
agtgaatcatcgatggcaccctctg

SEQ ID NO: 504371 - DNA, 25 bp, Rattus norvegicus
tgagtgaatcatcgatggcaccctc

SEQ ID NO: 504372 - DNA, 25 bp, Rattus norvegicus
tccaccaatgagtgaatcatcgatg

SEQ ID NO: 504373 - DNA, 25 bp, Rattus norvegicus
tggcaccctctgttctactgaccat

SEQ ID NO: 504374 - DNA, 25 bp, Rattus norvegicus
gcgctccgctcgagcgtgcgcagaa

SEQ ID NO: 504375 - DNA, 25 bp, Rattus norvegicus
gccctctcgggactgtggctctgga

SEQ ID NO: 504376 - DNA, 25 bp, Rattus norvegicus
actgtggctctggaggtccggctac

SEQ ID NO: 504377 - DNA, 25 bp, Rattus norvegicus
tccggctaccgcagatggcccgagt

SEQ ID NO: 504378 - DNA, 25 bp, Rattus norvegicus
cagatggcccgagtccggatgcaga

SEQ ID NO: 504379 - DNA, 25 bp, Rattus norvegicus
cgagtccggatgcagagccagctca

SEQ ID NO: 504380 - DNA, 25 bp, Rattus norvegicus
agagccagctcaggccgaaccctgg

SEQ ID NO: 504381 - DNA, 25 bp, Rattus norvegicus
ccctgcagctggcagtaacggcaaa

SEQ ID NO: 504382 - DNA, 25 bp, Rattus norvegicus
ccagggagacgcacggcgtcctaca

SEQ ID NO: 504383 - DNA, 25 bp, Rattus norvegicus
ccggtgctctggcacagcttgcggc

SEQ ID NO: 504384 - DNA, 25 bp, Rattus norvegicus
tggtcctcggccctctcgggactgt

SEQ ID NO: 504385 - DNA, 25 bp, Rattus norvegicus
ggaggtctgcgccttcccacaaggc

SEQ ID NO: 504386 - DNA, 25 bp, Rattus norvegicus
agtaacggcaaaacctgctcacccg

SEQ ID NO: 504387 - DNA, 25 bp, Rattus norvegicus
tgcgcagaaggttcggctcccgcgc

SEQ ID NO: 504388 - DNA, 25 bp, Rattus norvegicus
ggacctggtgccttctgaacgtgtc

SEQ ID NO: 504389 - DNA, 25 bp, Rattus norvegicus
ccctgcacctgtgagtcggtggcgc

SEQ ID NO: 504390 - DNA, 25 bp, Rattus norvegicus
ggtggccactaaagcgtcctctgcg

SEQ ID NO: 504391 - DNA, 25 bp, Rattus norvegicus
tgtcgggacctagggtgcccacagc

SEQ ID NO: 504392 - DNA, 25 bp, Rattus norvegicus
tgccttctgaacgtgtcgggaccta

SEQ ID NO: 504393 - DNA, 25 bp, Rattus norvegicus
cagagacagcgcaggcccgggttcc

SEQ ID NO: 504394 - DNA, 25 bp, Rattus norvegicus
ttactccagagagaccagagacagc

SEQ ID NO: 504395 - DNA, 25 bp, Rattus norvegicus
ggaccggagcgttgtttactccaga

SEQ ID NO: 504396 - DNA, 25 bp, Rattus norvegicus
tggtctaccgacaaccggggactgc

SEQ ID NO: 504397 - DNA, 25 bp, Rattus norvegicus
tctggacggtggtctaccgacaacc

SEQ ID NO: 504398 - DNA, 25 bp, Rattus norvegicus
ctccatcttcttcgtctggacggtg

SEQ ID NO: 504399 - DNA, 25 bp, Rattus norvegicus
tcgttggccggcttctccatcttct

SEQ ID NO: 504400 - DNA, 25 bp, Rattus norvegicus
tactcgggcttcagctcgttggccg

SEQ ID NO: 504401 - DNA, 25 bp, Rattus norvegicus
ccggcctttgcaaagccgcgttgtc

SEQ ID NO: 504402 - DNA, 25 bp, Rattus norvegicus
cagttcagtgggtcctagcctttgc

SEQ ID NO: 504403 - DNA, 25 bp, Rattus norvegicus
cagggcgcgcgtaggacccggccag

SEQ ID NO: 504404 - DNA, 25 bp, Rattus norvegicus
tagcctttgccctcccgcttccaaa

SEQ ID NO: 504405 - DNA, 25 bp, Rattus norvegicus
tcagtgggtcctagcctttgccctc

SEQ ID NO: 504406 - DNA, 25 bp, Rattus norvegicus
gttcagtgggtcctagcctttgccc

SEQ ID NO: 504407 - DNA, 25 bp, Rattus norvegicus
aagtcctgccccagttcagtgggtc

SEQ ID NO: 504408 - DNA, 25 bp, Rattus norvegicus
ggcgctgatgtccagccccgcaagt

SEQ ID NO: 504409 - DNA, 25 bp, Rattus norvegicus
ctcggttccacgaaatgggggcgct

SEQ ID NO: 504410 - DNA, 25 bp, Rattus norvegicus
agggccctctcggttccacgaaatg

SEQ ID NO: 504411 - DNA, 25 bp, Rattus norvegicus
ctgagtagggccctctcggttccac

SEQ ID NO: 504412 - DNA, 25 bp, Rattus norvegicus
gctacgggatctgagtagggccctc

SEQ ID NO: 504413 - DNA, 25 bp, Rattus norvegicus
agacccagccgcaaccggagcccga

SEQ ID NO: 504414 - DNA, 25 bp, Rattus norvegicus
tacgggatctgagtagggccctctc

SEQ ID NO: 504415 - DNA, 25 bp, Rattus norvegicus
acgcccggcccatgcacaggcggcc

SEQ ID NO: 504416 - DNA, 25 bp, Rattus norvegicus
aatctttgatgatatcgtgtgtgta

SEQ ID NO: 504417 - DNA, 25 bp, Rattus norvegicus
ccttccgtggggcaatctttgatga

SEQ ID NO: 504418 - DNA, 25 bp, Rattus norvegicus
cgtgtgtgtaaatacacgtttctgc

SEQ ID NO: 504419 - DNA, 25 bp, Rattus norvegicus
atacacgtttctgccggtggtgacc

SEQ ID NO: 504420 - DNA, 25 bp, Rattus norvegicus
gtggtgacctgtgacgtatccgcca

SEQ ID NO: 504421 - DNA, 25 bp, Rattus norvegicus
ggtgacctgtgacgtatccgccacc

SEQ ID NO: 504422 - DNA, 25 bp, Rattus norvegicus
gccgtggttctacccagtctgctgt

SEQ ID NO: 504423 - DNA, 25 bp, Rattus norvegicus
tgctgtagacgcctccgccaggtgt

SEQ ID NO: 504424 - DNA, 25 bp, Rattus norvegicus
cgccaggtgtgtcacccgtacctga

SEQ ID NO: 504425 - DNA, 25 bp, Rattus norvegicus
tgtcacccgtacctgagttgacccg

SEQ ID NO: 504426 - DNA, 25 bp, Rattus norvegicus
ccagtggggaatcgccgacgacttt

SEQ ID NO: 504427 - DNA, 25 bp, Rattus norvegicus
atcgccgacgactttctcctgcagg

SEQ ID NO: 504428 - DNA, 25 bp, Rattus norvegicus
gacgactttctcctgcagggcgctc

SEQ ID NO: 504429 - DNA, 25 bp, Rattus norvegicus
agtctgctgtagacgcctccgccag

SEQ ID NO: 504430 - DNA, 25 bp, Rattus norvegicus
ctctgtcgctctctaccggtgctaa

SEQ ID NO: 504431 - DNA, 25 bp, Rattus norvegicus
taacagccaggagttggtgcgccac

SEQ ID NO: 504432 - DNA, 25 bp, Rattus norvegicus
aggcgcgtcggagactcgctggagc

SEQ ID NO: 504433 - DNA, 25 bp, Rattus norvegicus
ggcgggcttgccattctgcgcctgc

SEQ ID NO: 504434 - DNA, 25 bp, Rattus norvegicus
aggacgcgctggagctcagagcgca

SEQ ID NO: 504435 - DNA, 25 bp, Rattus norvegicus
taagtacaatgcagctgcgcggcgg

SEQ ID NO: 504436 - DNA, 25 bp, Rattus norvegicus
ccggtgctaagtacaatgcagctgc

SEQ ID NO: 504437 - DNA, 25 bp, Rattus norvegicus
gtcgttgtgtctccgagcacctccc

SEQ ID NO: 504438 - DNA, 25 bp, Rattus norvegicus
tgtcgctctctaccggtgctaagta

SEQ ID NO: 504439 - DNA, 25 bp, Rattus norvegicus
gagcacctcccgcagttctctgtcg

SEQ ID NO: 504440 - DNA, 25 bp, Rattus norvegicus
ccgggcctcggaggcctgaacgcgt

SEQ ID NO: 504441 - DNA, 25 bp, Rattus norvegicus
ccaggagttggtgcgccacaggtcc

SEQ ID NO: 504442 - DNA, 25 bp, Rattus norvegicus
tctctaccggtgctaagtacaatgc

SEQ ID NO: 504443 - DNA, 25 bp, Rattus norvegicus
tcccgggagtaacagccaggagttg

SEQ ID NO: 504444 - DNA, 25 bp, Rattus norvegicus
tcaccgcgaggcctggcagagcctt

SEQ ID NO: 504445 - DNA, 25 bp, Rattus norvegicus
cccgatgtgcccagtggcctgatcg

SEQ ID NO: 504446 - DNA, 25 bp, Rattus norvegicus
gcgcctaggacttggcgccctaact

SEQ ID NO: 504447 - DNA, 25 bp, Rattus norvegicus
ggcatcctggccctgacattgtagg

SEQ ID NO: 504448 - DNA, 25 bp, Rattus norvegicus
cgaggcggatcatggctcaccgcga

SEQ ID NO: 504449 - DNA, 25 bp, Rattus norvegicus
cgccctcatgcaggaggctctagga

SEQ ID NO: 504450 - DNA, 25 bp, Rattus norvegicus
acttggcgccctaactcggacggag

SEQ ID NO: 504451 - DNA, 25 bp, Rattus norvegicus
tctcccagcagaggctccggttata

SEQ ID NO: 504452 - DNA, 25 bp, Rattus norvegicus
aggctccggttatatgctcccggtc

SEQ ID NO: 504453 - DNA, 25 bp, Rattus norvegicus
tatatgctcccggtcgctccaaagg

SEQ ID NO: 504454 - DNA, 25 bp, Rattus norvegicus
ccggtcgctccaaaggctggcaaac

SEQ ID NO: 504455 - DNA, 25 bp, Rattus norvegicus
aaggctggcaaaccagcccaaaccg

SEQ ID NO: 504456 - DNA, 25 bp, Rattus norvegicus
cgacttacgggcatcctggccctga

SEQ ID NO: 504457 - DNA, 25 bp, Rattus norvegicus
ctgacattgtaggaccgtggcgatg

SEQ ID NO: 504458 - DNA, 25 bp, Rattus norvegicus
ttgacccgctgtctcctggttccgt

SEQ ID NO: 504459 - DNA, 25 bp, Rattus norvegicus
gaagctgagggagcgtttgactcta

SEQ ID NO: 504460 - DNA, 25 bp, Rattus norvegicus
gggcggcctcagtaagcccaactac

SEQ ID NO: 504461 - DNA, 25 bp, Rattus norvegicus
ccaactaccagacccgggccagaca

SEQ ID NO: 504462 - DNA, 25 bp, Rattus norvegicus
accggaaccggctgctaggcaaagg

SEQ ID NO: 504463 - DNA, 25 bp, Rattus norvegicus
caagaggtcaaagagctcgtggaac

SEQ ID NO: 504464 - DNA, 25 bp, Rattus norvegicus
caaagagctcgtggaacgcctgcgc

SEQ ID NO: 504465 - DNA, 25 bp, Rattus norvegicus
ggagcgtttgactctagtttcaatc

SEQ ID NO: 504466 - DNA, 25 bp, Rattus norvegicus
gtttcaatcttcctgtcaccctgtc

SEQ ID NO: 504467 - DNA, 25 bp, Rattus norvegicus
tgtcaccctgtcagactggggtttt

SEQ ID NO: 504468 - DNA, 25 bp, Rattus norvegicus
gttttttctcttcgtcgcacttcga

SEQ ID NO: 504469 - DNA, 25 bp, Rattus norvegicus
cttcgtcgcacttcgagtactgtta

SEQ ID NO: 504470 - DNA, 25 bp, Rattus norvegicus
agtgcgcccgccgtcctttgctttt

SEQ ID NO: 504471 - DNA, 25 bp, Rattus norvegicus
cttcgagtactgttagtgcgcccgc

SEQ ID NO: 504472 - DNA, 25 bp, Rattus norvegicus
ctcatagcaatctgggcgagtcccg

SEQ ID NO: 504473 - DNA, 25 bp, Rattus norvegicus
acaatggcgtcccttgccgcaggga

SEQ ID NO: 504474 - DNA, 25 bp, Rattus norvegicus
ttggcctagtccgaggctcccaacg

SEQ ID NO: 504475 - DNA, 25 bp, Rattus norvegicus
gcactcaccgaaccgcggggcagat

SEQ ID NO: 504476 - DNA, 25 bp, Rattus norvegicus
ctagggcagtaaatgtcaggacaat

SEQ ID NO: 504477 - DNA, 25 bp, Rattus norvegicus
cagcagcctcgggtttacagcgcaa

SEQ ID NO: 504478 - DNA, 25 bp, Rattus norvegicus
ctttggatcgctgcctcgcctctaa

SEQ ID NO: 504479 - DNA, 25 bp, Rattus norvegicus
aatcgtccgctttccctttggatcg

SEQ ID NO: 504480 - DNA, 25 bp, Rattus norvegicus
ctggacggcgaaggttcttcaactt

SEQ ID NO: 504481 - DNA, 25 bp, Rattus norvegicus
ttgcagctgccgagtccggacgaac

SEQ ID NO: 504482 - DNA, 25 bp, Rattus norvegicus
tttacagcgcaagacggccgagtgc

SEQ ID NO: 504483 - DNA, 25 bp, Rattus norvegicus
acccggaagcagaagcggcccgcag

SEQ ID NO: 504484 - DNA, 25 bp, Rattus norvegicus
gaagccgctgtcaaggcgtgacccg

SEQ ID NO: 504485 - DNA, 25 bp, Rattus norvegicus
tggccaatgtgagcacgccgagtgc

SEQ ID NO: 504486 - DNA, 25 bp, Rattus norvegicus
tggacaccgtccaggatctgcttga

SEQ ID NO: 504487 - DNA, 25 bp, Rattus norvegicus
ggcaggcgccgcttctttatgaact

SEQ ID NO: 504488 - DNA, 25 bp, Rattus norvegicus
ttctcgaacacatcgtgcagcgtga

SEQ ID NO: 504489 - DNA, 25 bp, Rattus norvegicus
tctcagccagaaagtcgaaaagttc

SEQ ID NO: 504490 - DNA, 25 bp, Rattus norvegicus
tgtcagtgactccttctcagccaga

SEQ ID NO: 504491 - DNA, 25 bp, Rattus norvegicus
tctgcttgaggaactgcgtggcctc

SEQ ID NO: 504492 - DNA, 25 bp, Rattus norvegicus
tggcacttgcgcacgatggcgaact

SEQ ID NO: 504493 - DNA, 25 bp, Rattus norvegicus
taccttcaggtcaaagtgcgcgatg

SEQ ID NO: 504494 - DNA, 25 bp, Rattus norvegicus
gcaacatgatgttctccggctgcga

SEQ ID NO: 504495 - DNA, 25 bp, Rattus norvegicus
ggctgcatgcttgtccagcaacatg

SEQ ID NO: 504496 - DNA, 25 bp, Rattus norvegicus
cgcgatgccaaagtcgatgagctta

SEQ ID NO: 504497 - DNA, 25 bp, Rattus norvegicus
tgttcttgaactcgctaccggcctc

SEQ ID NO: 504498 - DNA, 25 bp, Rattus norvegicus
ctctggcgtgccaaagatgttcttg

SEQ ID NO: 504499 - DNA, 25 bp, Rattus norvegicus
cgtggcctcatcctctgtcagtgac

SEQ ID NO: 504500 - DNA, 25 bp, Rattus norvegicus
tcccttctgcggattgctctcctgg

SEQ ID NO: 504501 - DNA, 25 bp, Rattus norvegicus
ctgcggattgctctcctggaaccga

SEQ ID NO: 504502 - DNA, 25 bp, Rattus norvegicus
acgcggcccggcttgctcgtgcttt

SEQ ID NO: 504503 - DNA, 25 bp, Rattus norvegicus
ttgctctcctggaaccgacggcgtc

SEQ ID NO: 504504 - DNA, 25 bp, Rattus norvegicus
ccgtggagcagaatgtgctgcagca

SEQ ID NO: 504505 - DNA, 25 bp, Rattus norvegicus
gccatgaccgtggagcagaatgtgc

SEQ ID NO: 504506 - DNA, 25 bp, Rattus norvegicus
tgcgtccactcccttctgcggattg

SEQ ID NO: 504507 - DNA, 25 bp, Rattus norvegicus
cgtgctttccctcgcctgcgcccat

SEQ ID NO: 504508 - DNA, 25 bp, Rattus norvegicus
gcgaagctgagtgcgaacgcgtgac

SEQ ID NO: 504509 - DNA, 25 bp, Rattus norvegicus
tcccccggagcggtcaggcgaagct

SEQ ID NO: 504510 - DNA, 25 bp, Rattus norvegicus
gccgctccctccgtccgcttgccac

SEQ ID NO: 504511 - DNA, 25 bp, Rattus norvegicus
gaggacagcgccattccgggtggcc

SEQ ID NO: 504512 - DNA, 25 bp, Rattus norvegicus
tagtgagaggctttgcgtccactcc

SEQ ID NO: 504513 - DNA, 25 bp, Rattus norvegicus
ctctccggcagcgtctcgccgcttg

SEQ ID NO: 504514 - DNA, 25 bp, Rattus norvegicus
tgccactcaatggaggacagtctgc

SEQ ID NO: 504515 - DNA, 25 bp, Rattus norvegicus
gaactgatggagcacctgaaggccc

SEQ ID NO: 504516 - DNA, 25 bp, Rattus norvegicus
ttctctgaggctactgcagcgtccc

SEQ ID NO: 504517 - DNA, 25 bp, Rattus norvegicus
tccactgcagcttcggaaccctgtt

SEQ ID NO: 504518 - DNA, 25 bp, Rattus norvegicus
cttcacttcctcgttgccatggaga

SEQ ID NO: 504519 - DNA, 25 bp, Rattus norvegicus
cgtcatttacgtgccgtgcgtcgcc

SEQ ID NO: 504520 - DNA, 25 bp, Rattus norvegicus
cactctttgctgatgattaccggga

SEQ ID NO: 504521 - DNA, 25 bp, Rattus norvegicus
gcggcagggacataggtaccacact

SEQ ID NO: 504522 - DNA, 25 bp, Rattus norvegicus
ctgggaaagcctgaagacgctcgtc

SEQ ID NO: 504523 - DNA, 25 bp, Rattus norvegicus
agacgggtcttcgtcctgtcgactc

SEQ ID NO: 504524 - DNA, 25 bp, Rattus norvegicus
gacagtctgctggagatcatgacca

SEQ ID NO: 504525 - DNA, 25 bp, Rattus norvegicus
atcatgaccaaggacggcggcgaca

SEQ ID NO: 504526 - DNA, 25 bp, Rattus norvegicus
tggtgcagctctcttcacgtcggct

SEQ ID NO: 504527 - DNA, 25 bp, Rattus norvegicus
gcagccacatgctctttgcagcttc

SEQ ID NO: 504528 - DNA, 25 bp, Rattus norvegicus
gtagagggctctccggctatgctcc

SEQ ID NO: 504529 - DNA, 25 bp, Rattus norvegicus
agggtcttctcgagttgttaactga

SEQ ID NO: 504530 - DNA, 25 bp, Rattus norvegicus
ttaactgaaagggagcgataaggcg

SEQ ID NO: 504531 - DNA, 25 bp, Rattus norvegicus
cggctgaggacactgcagttgttta

SEQ ID NO: 504532 - DNA, 25 bp, Rattus norvegicus
cactgcagttgtttacgggcgggaa

SEQ ID NO: 504533 - DNA, 25 bp, Rattus norvegicus
gcgggaagagcagcccagcattaca

SEQ ID NO: 504534 - DNA, 25 bp, Rattus norvegicus
gcccagcattacacaattcgctaaa

SEQ ID NO: 504535 - DNA, 25 bp, Rattus norvegicus
tcgctaaaaatggagctatcgcttg

SEQ ID NO: 504536 - DNA, 25 bp, Rattus norvegicus
ctatcgcttggagagattcaggctc

SEQ ID NO: 504537 - DNA, 25 bp, Rattus norvegicus
gagattcaggctccgcatcctcaga

SEQ ID NO: 504538 - DNA, 25 bp, Rattus norvegicus
catcctcagactggactggcagcta

SEQ ID NO: 504539 - DNA, 25 bp, Rattus norvegicus
ctggcagctaccgagccttaacgtg

SEQ ID NO: 504540 - DNA, 25 bp, Rattus norvegicus
ttaacgtgattggtagagggctctc

SEQ ID NO: 504541 - DNA, 25 bp, Rattus norvegicus
gtacgtggcaagagggtcttctcga

SEQ ID NO: 504542 - DNA, 25 bp, Rattus norvegicus
atcttcctgcgcacttcgtagccgg

SEQ ID NO: 504543 - DNA, 25 bp, Rattus norvegicus
tgaccctcaggagcgtgtatttctc

SEQ ID NO: 504544 - DNA, 25 bp, Rattus norvegicus
ccgcttggtgagaggagatcttcct

SEQ ID NO: 504545 - DNA, 25 bp, Rattus norvegicus
tcttggggatttgagcacagtcttc

SEQ ID NO: 504546 - DNA, 25 bp, Rattus norvegicus
gcgtgtatttctccgacctggtgga

SEQ ID NO: 504547 - DNA, 25 bp, Rattus norvegicus
tgccactgaccctcaggagcgtgta

SEQ ID NO: 504548 - DNA, 25 bp, Rattus norvegicus
tgaagtagcctgcagcgtcgctgcc

SEQ ID NO: 504549 - DNA, 25 bp, Rattus norvegicus
tttccagaccctgaagtagcctgca

SEQ ID NO: 504550 - DNA, 25 bp, Rattus norvegicus
ctcctaggctttgaaattttccaga

SEQ ID NO: 504551 - DNA, 25 bp, Rattus norvegicus
cgtggcgcctttctcctaggctttg

SEQ ID NO: 504552 - DNA, 25 bp, Rattus norvegicus
gctgcccagtgtcaaccgggaccgt

SEQ ID NO: 504553 - DNA, 25 bp, Rattus norvegicus
cttcccgtgagagtggctgcccagt

SEQ ID NO: 504554 - DNA, 25 bp, Rattus norvegicus
tgagcacagtcttcccgtgagagtg

SEQ ID NO: 504555 - DNA, 25 bp, Rattus norvegicus
aggagatcttcctgcgcacttcgta

SEQ ID NO: 504556 - DNA, 25 bp, Rattus norvegicus
cgaccacccacagcgcctggcggtg

SEQ ID NO: 504557 - DNA, 25 bp, Rattus norvegicus
ggctggcgccctcctccacgcccac

SEQ ID NO: 504558 - DNA, 25 bp, Rattus norvegicus
ggacgcccatgccagtgacagcgac

SEQ ID NO: 504559 - DNA, 25 bp, Rattus norvegicus
gcccatgccagtgacagcgacggga

SEQ ID NO: 504560 - DNA, 25 bp, Rattus norvegicus
catgccagtgacagcgacgggaccg

SEQ ID NO: 504561 - DNA, 25 bp, Rattus norvegicus
ccgggcttgcgacaccgacgccaca

SEQ ID NO: 504562 - DNA, 25 bp, Rattus norvegicus
cccacggtcaggctggcgccctcct

SEQ ID NO: 504563 - DNA, 25 bp, Rattus norvegicus
cagagccagcgacaggcgacagggc

SEQ ID NO: 504564 - DNA, 25 bp, Rattus norvegicus
gcgggcacaggaaatcccgccgctt

SEQ ID NO: 504565 - DNA, 25 bp, Rattus norvegicus
atcccgccgcttccggggctccgtg

SEQ ID NO: 504566 - DNA, 25 bp, Rattus norvegicus
aggggaccgctggacccaggctcct

SEQ ID NO: 504567 - DNA, 25 bp, Rattus norvegicus
gctggacccaggctcctgtcgctgc

SEQ ID NO: 504568 - DNA, 25 bp, Rattus norvegicus
cgcccacagcctgcgaccacccaca

SEQ ID NO: 504569 - DNA, 25 bp, Rattus norvegicus
agcccaggggctttgctactcccgg

SEQ ID NO: 504570 - DNA, 25 bp, Rattus norvegicus
attggctgatgtgaagtgtctgtca

SEQ ID NO: 504571 - DNA, 25 bp, Rattus norvegicus
ctgtacctttattggtcagaatcaa

SEQ ID NO: 504572 - DNA, 25 bp, Rattus norvegicus
ccgcaacgcgattggctgatgtgaa

SEQ ID NO: 504573 - DNA, 25 bp, Rattus norvegicus
gacagtgagactccgcaacgcgatt

SEQ ID NO: 504574 - DNA, 25 bp, Rattus norvegicus
atcaacactagacccgaggagggcg

SEQ ID NO: 504575 - DNA, 25 bp, Rattus norvegicus
tcagaatcaacactagacccgagga

SEQ ID NO: 504576 - DNA, 25 bp, Rattus norvegicus
cgctgattggtcgttgtattaaggc

SEQ ID NO: 504577 - DNA, 25 bp, Rattus norvegicus
gccctgcggctcctaagcgctgatt

SEQ ID NO: 504578 - DNA, 25 bp, Rattus norvegicus
tgtcccacgcggcacaactgcaacg

SEQ ID NO: 504579 - DNA, 25 bp, Rattus norvegicus
caggacgagggttgcaccgtaactc

SEQ ID NO: 504580 - DNA, 25 bp, Rattus norvegicus
gtcgttgtattaaggctgctgtacc

SEQ ID NO: 504581 - DNA, 25 bp, Rattus norvegicus
tgtctgtcagaaactcggcccgtga

SEQ ID NO: 504582 - DNA, 25 bp, Rattus norvegicus
ctggtccctaccacgttggccgagt

SEQ ID NO: 504583 - DNA, 25 bp, Rattus norvegicus
ggctcctaagcgctgattggtcgtt

SEQ ID NO: 504584 - DNA, 25 bp, Rattus norvegicus
gcctaggccgcaaggatacacgtta

SEQ ID NO: 504585 - DNA, 25 bp, Rattus norvegicus
cgggaaattgactccgcctcacttc

SEQ ID NO: 504586 - DNA, 25 bp, Rattus norvegicus
ggtatgaaccctacgacgccctgta

SEQ ID NO: 504587 - DNA, 25 bp, Rattus norvegicus
catgtcctggagtagattggccgcc

SEQ ID NO: 504588 - DNA, 25 bp, Rattus norvegicus
cgccctgtaggcgaatcagcagcca

SEQ ID NO: 504589 - DNA, 25 bp, Rattus norvegicus
ctcttccgaggaggacgttcgtgtt

SEQ ID NO: 504590 - DNA, 25 bp, Rattus norvegicus
gattcaagcgcctacttccggtatg

SEQ ID NO: 504591 - DNA, 25 bp, Rattus norvegicus
tccgctcaggaagccgaagattcaa

SEQ ID NO: 504592 - DNA, 25 bp, Rattus norvegicus
aggttgtgacacacttccgctcagg

SEQ ID NO: 504593 - DNA, 25 bp, Rattus norvegicus
ctccaagggtcgaccaccaggttgt

SEQ ID NO: 504594 - DNA, 25 bp, Rattus norvegicus
cagacaactgcgacgtgacgaactt

SEQ ID NO: 504595 - DNA, 25 bp, Rattus norvegicus
gctgttttccagttgttctcgagta

SEQ ID NO: 504596 - DNA, 25 bp, Rattus norvegicus
cgcctgctggcgataagatagttct

SEQ ID NO: 504597 - DNA, 25 bp, Rattus norvegicus
tttaaaagtctcgtgcgtccgcgcg

SEQ ID NO: 504598 - DNA, 25 bp, Rattus norvegicus
ttgttcgcctccagttccacataga

SEQ ID NO: 504599 - DNA, 25 bp, Rattus norvegicus
gtctgacgacaacagaacgcacctc

SEQ ID NO: 504600 - DNA, 25 bp, Rattus norvegicus
gaacgcacctcatcaaagtccgcga

SEQ ID NO: 504601 - DNA, 25 bp, Rattus norvegicus
aagtccgcgatgatctcattgagca

SEQ ID NO: 504602 - DNA, 25 bp, Rattus norvegicus
tctcattgagcagtcgcaggcactc

SEQ ID NO: 504603 - DNA, 25 bp, Rattus norvegicus
attgagcagtcgcaggcactccacg

SEQ ID NO: 504604 - DNA, 25 bp, Rattus norvegicus
gcaggcactccacgccctcattgtt

SEQ ID NO: 504605 - DNA, 25 bp, Rattus norvegicus
ttccacatagaactcagagaagttg

SEQ ID NO: 504606 - DNA, 25 bp, Rattus norvegicus
gttggcgatggaggcaaacatgaca

SEQ ID NO: 504607 - DNA, 25 bp, Rattus norvegicus
ggcaaacatgacagccacgcactcg

SEQ ID NO: 504608 - DNA, 25 bp, Rattus norvegicus
atgacagccacgcactcgcaggatt

SEQ ID NO: 504609 - DNA, 25 bp, Rattus norvegicus
tagtacagctcgtcgttgcggcgct

SEQ ID NO: 504610 - DNA, 25 bp, Rattus norvegicus
cgcaggattggtagtacagctcgtc

SEQ ID NO: 504611 - DNA, 25 bp, Rattus norvegicus
ccacgcactcgcaggattggtagta

SEQ ID NO: 504612 - DNA, 25 bp, Rattus norvegicus
tcgggtctccgctaaacaagcggcc

SEQ ID NO: 504613 - DNA, 25 bp, Rattus norvegicus
tccacaaggcgccaggtgtgtgcgc

SEQ ID NO: 504614 - DNA, 25 bp, Rattus norvegicus
ttcattccacaaggcgccaggtgtg

SEQ ID NO: 504615 - DNA, 25 bp, Rattus norvegicus
ttaattaagatttcattccacaagg

SEQ ID NO: 504616 - DNA, 25 bp, Rattus norvegicus
cgggagctgagtttaataattaatt

SEQ ID NO: 504617 - DNA, 25 bp, Rattus norvegicus
ccggcgggagctgagtttaataatt

SEQ ID NO: 504618 - DNA, 25 bp, Rattus norvegicus
agcttccttcctgtcggggtgccct

SEQ ID NO: 504619 - DNA, 25 bp, Rattus norvegicus
ccagagggtcagcttccttcctgtc

SEQ ID NO: 504620 - DNA, 25 bp, Rattus norvegicus
cacccagggcggcatcctgcagggt

SEQ ID NO: 504621 - DNA, 25 bp, Rattus norvegicus
ggtcctctcgggtctccgctaaaca

SEQ ID NO: 504622 - DNA, 25 bp, Rattus norvegicus
ctgtccgtcgggtcctctcgggtct

SEQ ID NO: 504623 - DNA, 25 bp, Rattus norvegicus
acgcaaacctgctgcgcccagaacc

SEQ ID NO: 504624 - DNA, 25 bp, Rattus norvegicus
taaacaagcggccactgttctgggc

SEQ ID NO: 504625 - DNA, 25 bp, Rattus norvegicus
cggccactgttctgggcttcagacc

SEQ ID NO: 504626 - DNA, 25 bp, Rattus norvegicus
cagccctttgtttcccggcggagca

SEQ ID NO: 504627 - DNA, 25 bp, Rattus norvegicus
cagttcctgggttgcgagagtccct

SEQ ID NO: 504628 - DNA, 25 bp, Rattus norvegicus
cacctgttgggaccggagctgcttt

SEQ ID NO: 504629 - DNA, 25 bp, Rattus norvegicus
gagctgctttcatggcacgggtctg

SEQ ID NO: 504630 - DNA, 25 bp, Rattus norvegicus
ggtctgggagctcaaaaccgttctc

SEQ ID NO: 504631 - DNA, 25 bp, Rattus norvegicus
ttgctttgggtgtctccaggacttc

SEQ ID NO: 504632 - DNA, 25 bp, Rattus norvegicus
ccaggacttccagggagccgacatt

SEQ ID NO: 504633 - DNA, 25 bp, Rattus norvegicus
attgccggatcacctgagacctctc

SEQ ID NO: 504634 - DNA, 25 bp, Rattus norvegicus
ttgcgagagtccctgtctccgcatc

SEQ ID NO: 504635 - DNA, 25 bp, Rattus norvegicus
atttttctgtctccgcgttctccca

SEQ ID NO: 504636 - DNA, 25 bp, Rattus norvegicus
tgtatgacgactcctacgtgcccgg

SEQ ID NO: 504637 - DNA, 25 bp, Rattus norvegicus
aggagccggcggcagattcctcagc

SEQ ID NO: 504638 - DNA, 25 bp, Rattus norvegicus
tctgagctgcgagcagctggtcttc

SEQ ID NO: 504639 - DNA, 25 bp, Rattus norvegicus
cgtcctcctttcgatctccattttt

SEQ ID NO: 504640 - DNA, 25 bp, Rattus norvegicus
ttcctgatcacggaggagcaccctg

SEQ ID NO: 504641 - DNA, 25 bp, Rattus norvegicus
cgtccggtcccagagactgaagcta

SEQ ID NO: 504642 - DNA, 25 bp, Rattus norvegicus
gaagctacggctatcttcctgctcc

SEQ ID NO: 504643 - DNA, 25 bp, Rattus norvegicus
tgggtaatgtggtttgcgaagattc

SEQ ID NO: 504644 - DNA, 25 bp, Rattus norvegicus
cccagagactgaagctacggctatc

SEQ ID NO: 504645 - DNA, 25 bp, Rattus norvegicus
ctttcgcgtttcctgatcacggagg

SEQ ID NO: 504646 - DNA, 25 bp, Rattus norvegicus
acgtcgccgaacagtcgccatcttt

SEQ ID NO: 504647 - DNA, 25 bp, Rattus norvegicus
gggaaagcgagttcctgggccttca

SEQ ID NO: 504648 - DNA, 25 bp, Rattus norvegicus
ccttcaccgcgcgagctgacgaatt

SEQ ID NO: 504649 - DNA, 25 bp, Rattus norvegicus
accgcgcgagctgacgaattagccc

SEQ ID NO: 504650 - DNA, 25 bp, Rattus norvegicus
taccaatcccagaatgcacggcgcg

SEQ ID NO: 504651 - DNA, 25 bp, Rattus norvegicus
gctgaccaggttgcgtggtcttctg

SEQ ID NO: 504652 - DNA, 25 bp, Rattus norvegicus
tggtcttctgggtaatgtggtttgc

SEQ ID NO: 504653 - DNA, 25 bp, Rattus norvegicus
agtcgccatctttcgcgtttcctga

SEQ ID NO: 504654 - DNA, 25 bp, Rattus norvegicus
ccgccacggcagaaaggttccaagc

SEQ ID NO: 504655 - DNA, 25 bp, Rattus norvegicus
ccaagccaggaactgcaggcagctc

SEQ ID NO: 504656 - DNA, 25 bp, Rattus norvegicus
agttgcgcctctgcagatctgcgtg

SEQ ID NO: 504657 - DNA, 25 bp, Rattus norvegicus
cctcgctgctctgatggaagctgta

SEQ ID NO: 504658 - DNA, 25 bp, Rattus norvegicus
agcacggtcttctggaaactcacgc

SEQ ID NO: 504659 - DNA, 25 bp, Rattus norvegicus
gagcacgttccaggtaatccgacga

SEQ ID NO: 504660 - DNA, 25 bp, Rattus norvegicus
cgagccgggttgttgatgacccatg

SEQ ID NO: 504661 - DNA, 25 bp, Rattus norvegicus
tgcgcggcaggaaagcactgctgtt

SEQ ID NO: 504662 - DNA, 25 bp, Rattus norvegicus
actgctgttcacgtggaagaacttg

SEQ ID NO: 504663 - DNA, 25 bp, Rattus norvegicus
agaacttggcgtagtgcaacggcga

SEQ ID NO: 504664 - DNA, 25 bp, Rattus norvegicus
gcgtggaactgataagcctgcagca

SEQ ID NO: 504665 - DNA, 25 bp, Rattus norvegicus
cccggtgctcactgcatagtggtac

SEQ ID NO: 504666 - DNA, 25 bp, Rattus norvegicus
gctgcaagagctgtgccagcaactc

SEQ ID NO: 504667 - DNA, 25 bp, Rattus norvegicus
gcgcgtggaacagctccagctcatc

SEQ ID NO: 504668 - DNA, 25 bp, Rattus norvegicus
taatttgtttgagtggcgtgctacc

SEQ ID NO: 504669 - DNA, 25 bp, Rattus norvegicus
cccagcttgcgatgtcaagttaatt

SEQ ID NO: 504670 - DNA, 25 bp, Rattus norvegicus
ctagatctctcaggtcagcctttga

SEQ ID NO: 504671 - DNA, 25 bp, Rattus norvegicus
ggcgtgctaccgtctgaagttccct

SEQ ID NO: 504672 - DNA, 25 bp, Rattus norvegicus
gaagttccctggtcgccttgggtca

SEQ ID NO: 504673 - DNA, 25 bp, Rattus norvegicus
tcgccttgggtcaagctactgcctc

SEQ ID NO: 504674 - DNA, 25 bp, Rattus norvegicus
cgcagaccctctgacggccaccttg

SEQ ID NO: 504675 - DNA, 25 bp, Rattus norvegicus
agcccgcccagcttgcgatgtcaag

SEQ ID NO: 504676 - DNA, 25 bp, Rattus norvegicus
gcctgcgtgcttcctggggtctcca

SEQ ID NO: 504677 - DNA, 25 bp, Rattus norvegicus
ggggtctccagcctccaaatccctc

SEQ ID NO: 504678 - DNA, 25 bp, Rattus norvegicus
ctccaaatacacctacagtccggtg

SEQ ID NO: 504679 - DNA, 25 bp, Rattus norvegicus
acctacagtccggtgcctgagccgg

SEQ ID NO: 504680 - DNA, 25 bp, Rattus norvegicus
cgggctccctagatctctcaggtca

SEQ ID NO: 504681 - DNA, 25 bp, Rattus norvegicus
cagcctttgagctgtgcgcttcgga

SEQ ID NO: 504682 - DNA, 25 bp, Rattus norvegicus
gcgggttcatctacgcatgcgccga

SEQ ID NO: 504683 - DNA, 25 bp, Rattus norvegicus
ctccggtgcaaaccctgcgggttca

SEQ ID NO: 504684 - DNA, 25 bp, Rattus norvegicus
cttacggagacagccatgcccttcg

SEQ ID NO: 504685 - DNA, 25 bp, Rattus norvegicus
cctcgaggttggagcttacggagac

SEQ ID NO: 504686 - DNA, 25 bp, Rattus norvegicus
ctaacgcatgcgtagcagcggtgcc

SEQ ID NO: 504687 - DNA, 25 bp, Rattus norvegicus
catgcgccgactgcgttgcgacacg

SEQ ID NO: 504688 - DNA, 25 bp, Rattus norvegicus
gaactcaggagtgtcgccggaaacc

SEQ ID NO: 504689 - DNA, 25 bp, Rattus norvegicus
cattggctaccatccgacctatcgg

SEQ ID NO: 504690 - DNA, 25 bp, Rattus norvegicus
gtgtcgccggaaacctaacgcatgc

SEQ ID NO: 504691 - DNA, 25 bp, Rattus norvegicus
tggatcacgtctcacccggaaactg

SEQ ID NO: 504692 - DNA, 25 bp, Rattus norvegicus
acctatcggcgtaactgggcgttga

SEQ ID NO: 504693 - DNA, 25 bp, Rattus norvegicus
ggtgacgccaccacgctaggctaga

SEQ ID NO: 504694 - DNA, 25 bp, Rattus norvegicus
cccaaaactaggaagcctgtgctca

SEQ ID NO: 504695 - DNA, 25 bp, Rattus norvegicus
ggaagcctgtgctcactggatcacg

SEQ ID NO: 504696 - DNA, 25 bp, Rattus norvegicus
ccagtcccgcctccacgtgctagcc

SEQ ID NO: 504697 - DNA, 25 bp, Rattus norvegicus
tgtagtgtatgtggagcgtgtctcc

SEQ ID NO: 504698 - DNA, 25 bp, Rattus norvegicus
gcgtgtctccaaaggcagcggactc

SEQ ID NO: 504699 - DNA, 25 bp, Rattus norvegicus
tctccaaaggcagcggactccgtgc

SEQ ID NO: 504700 - DNA, 25 bp, Rattus norvegicus
tggcgagaggacaatccagtcccgc

SEQ ID NO: 504701 - DNA, 25 bp, Rattus norvegicus
agctgacgtgttttagctgggcgcc

SEQ ID NO: 504702 - DNA, 25 bp, Rattus norvegicus
cgtgctagccgaccctaggactcaa

SEQ ID NO: 504703 - DNA, 25 bp, Rattus norvegicus
gccgaccctaggactcaagttctca

SEQ ID NO: 504704 - DNA, 25 bp, Rattus norvegicus
gactcaagttctcaagcccagcgtg

SEQ ID NO: 504705 - DNA, 25 bp, Rattus norvegicus
gtgccacgtgtccaagccaaagctg

SEQ ID NO: 504706 - DNA, 25 bp, Rattus norvegicus
cctcaccgtgtagtgtatgtggagc

SEQ ID NO: 504707 - DNA, 25 bp, Rattus norvegicus
tgtccaagccaaagctgacgtgttt

SEQ ID NO: 504708 - DNA, 25 bp, Rattus norvegicus
ttctcaagcccagcgtgccacgtgt

SEQ ID NO: 504709 - DNA, 25 bp, Rattus norvegicus
aaagaagctggcgagaggacaatcc

SEQ ID NO: 504710 - DNA, 25 bp, Rattus norvegicus
tccgaacctgttcctgctctctgcg

SEQ ID NO: 504711 - DNA, 25 bp, Rattus norvegicus
acgatcgcgcgagaagtgcgcgcta

SEQ ID NO: 504712 - DNA, 25 bp, Rattus norvegicus
cgaggccgaggacaaatccgtgtgc

SEQ ID NO: 504713 - DNA, 25 bp, Rattus norvegicus
gccgaggacaaatccgtgtgcgccc

SEQ ID NO: 504714 - DNA, 25 bp, Rattus norvegicus
tgcgcgctagcgagcggcagttctc

SEQ ID NO: 504715 - DNA, 25 bp, Rattus norvegicus
ccagctcggcgtccttcagctgcgg

SEQ ID NO: 504716 - DNA, 25 bp, Rattus norvegicus
gctcccaccctgacccagcctcttc

SEQ ID NO: 504717 - DNA, 25 bp, Rattus norvegicus
gctgcctcccgctccgcaagccgac

SEQ ID NO: 504718 - DNA, 25 bp, Rattus norvegicus
cacctccacgatcgcgcgagaagtg

SEQ ID NO: 504719 - DNA, 25 bp, Rattus norvegicus
cgtcacctcccaccgtgggtcagtt

SEQ ID NO: 504720 - DNA, 25 bp, Rattus norvegicus
cgggatacttcccacctccacgatc

SEQ ID NO: 504721 - DNA, 25 bp, Rattus norvegicus
ctagcaccggaagccgcgacggcga

SEQ ID NO: 504722 - DNA, 25 bp, Rattus norvegicus
caagccgaccgcggcgtagctggtc

SEQ ID NO: 504723 - DNA, 25 bp, Rattus norvegicus
tggggtccccagctctgcgaggatc

SEQ ID NO: 504724 - DNA, 25 bp, Rattus norvegicus
ggagcacgttgtgcccacggccaca

SEQ ID NO: 504725 - DNA, 25 bp, Rattus norvegicus
gctaccacagccatccaataggcgg

SEQ ID NO: 504726 - DNA, 25 bp, Rattus norvegicus
ccagaattgcggttatgggtatcga

SEQ ID NO: 504727 - DNA, 25 bp, Rattus norvegicus
cgtctgccggagcacgttgtgccca

SEQ ID NO: 504728 - DNA, 25 bp, Rattus norvegicus
tgggtatcgatgaagatggctctgc

SEQ ID NO: 504729 - DNA, 25 bp, Rattus norvegicus
cggggctggaaaactccagaattgc

SEQ ID NO: 504730 - DNA, 25 bp, Rattus norvegicus
ctcgctcacagaagtcaggagactt

SEQ ID NO: 504731 - DNA, 25 bp, Rattus norvegicus
cccaaagcggggtctcgctcacaga

SEQ ID NO: 504732 - DNA, 25 bp, Rattus norvegicus
cacggccacagcacaggctaccaca

SEQ ID NO: 504733 - DNA, 25 bp, Rattus norvegicus
gtcaggagacttctcaaagtaaacc

SEQ ID NO: 504734 - DNA, 25 bp, Rattus norvegicus
tggtcttgttgcaagcccggcctct

SEQ ID NO: 504735 - DNA, 25 bp, Rattus norvegicus
cctctcgtgcctggggagcccaaag

SEQ ID NO: 504736 - DNA, 25 bp, Rattus norvegicus
tgaagatggctctgcccaaccgctc

SEQ ID NO: 504737 - DNA, 25 bp, Rattus norvegicus
caataggcggctggtcttgttgcaa

SEQ ID NO: 504738 - DNA, 25 bp, Rattus norvegicus
tcgcgcagctggtgctgacactcgt

SEQ ID NO: 504739 - DNA, 25 bp, Rattus norvegicus
tttaggcccagaatctcattgctta

SEQ ID NO: 504740 - DNA, 25 bp, Rattus norvegicus
ctcattgcttagagccctgaggaca

SEQ ID NO: 504741 - DNA, 25 bp, Rattus norvegicus
ccctgaggacaagcgacaagggtct

SEQ ID NO: 504742 - DNA, 25 bp, Rattus norvegicus
gtctgggttctagtcgcgcgaccct

SEQ ID NO: 504743 - DNA, 25 bp, Rattus norvegicus
tctcaccgactgaacaaagccaaga

SEQ ID NO: 504744 - DNA, 25 bp, Rattus norvegicus
aagaacaggagacccgcgaggccta

SEQ ID NO: 504745 - DNA, 25 bp, Rattus norvegicus
tccagcatgtcgaagcccggaggct

SEQ ID NO: 504746 - DNA, 25 bp, Rattus norvegicus
ctcaagccggacagggtcaagcaca

SEQ ID NO: 504747 - DNA, 25 bp, Rattus norvegicus
aagcacacggtgttggccgtcagcg

SEQ ID NO: 504748 - DNA, 25 bp, Rattus norvegicus
ctgacactcgtgaacggcgatgtgc

SEQ ID NO: 504749 - DNA, 25 bp, Rattus norvegicus
tctagtgccgagcagttccagcgct

SEQ ID NO: 504750 - DNA, 25 bp, Rattus norvegicus
tcaccgcgcttgaggatggcgctgt

SEQ ID NO: 504751 - DNA, 25 bp, Rattus norvegicus
agctgccgcttactcaagccggaca

SEQ ID NO: 504752 - DNA, 25 bp, Rattus norvegicus
cggttgagtcactcgggctcggctc

SEQ ID NO: 504753 - DNA, 25 bp, Rattus norvegicus
ctcggctcgtggggcttaaaccgtg

SEQ ID NO: 504754 - DNA, 25 bp, Rattus norvegicus
ccgtggggaaactgtgtggagttca

SEQ ID NO: 504755 - DNA, 25 bp, Rattus norvegicus
gagttcagccccctcggcggagcag

SEQ ID NO: 504756 - DNA, 25 bp, Rattus norvegicus
gagcagcattcttccagcgcccggc

SEQ ID NO: 504757 - DNA, 25 bp, Rattus norvegicus
ccggccactcctctttgccgcttcc

SEQ ID NO: 504758 - DNA, 25 bp, Rattus norvegicus
cccagcgtcgccacggccgcccgga

SEQ ID NO: 504759 - DNA, 25 bp, Rattus norvegicus
gagtgatccagatagctagcgagcg

SEQ ID NO: 504760 - DNA, 25 bp, Rattus norvegicus
tccagatagctagcgagcgaacccg

SEQ ID NO: 504761 - DNA, 25 bp, Rattus norvegicus
agatagctagcgagcgaacccggga

SEQ ID NO: 504762 - DNA, 25 bp, Rattus norvegicus
gctagcgagcgaacccgggacaaaa

SEQ ID NO: 504763 - DNA, 25 bp, Rattus norvegicus
ttggctctgctcgacctaactcacg

SEQ ID NO: 504764 - DNA, 25 bp, Rattus norvegicus
gctcgcggttgagtcactcgggctc

SEQ ID NO: 504765 - DNA, 25 bp, Rattus norvegicus
aaacaccgggggctttggctctgct

SEQ ID NO: 504766 - DNA, 25 bp, Rattus norvegicus
gtgcctcctgcagcggctgcttcag

SEQ ID NO: 504767 - DNA, 25 bp, Rattus norvegicus
gccagcctgagaatactcaccactg

SEQ ID NO: 504768 - DNA, 25 bp, Rattus norvegicus
ctacgggctcccgacgcgcagaaga

SEQ ID NO: 504769 - DNA, 25 bp, Rattus norvegicus
cggggagcaaccaaagtcgccagaa

SEQ ID NO: 504770 - DNA, 25 bp, Rattus norvegicus
accagccgggacagcgaaccatgct

SEQ ID NO: 504771 - DNA, 25 bp, Rattus norvegicus
cgcaactataagaggcggtgcctcc

SEQ ID NO: 504772 - DNA, 25 bp, Rattus norvegicus
tcactgcagtcagcgccgcaactat

SEQ ID NO: 504773 - DNA, 25 bp, Rattus norvegicus
ggggcagcctcttctcactgcagtc

SEQ ID NO: 504774 - DNA, 25 bp, Rattus norvegicus
accagtgcgccctggtgctttagtg

SEQ ID NO: 504775 - DNA, 25 bp, Rattus norvegicus
cgctactcattgtctgtggccctga

SEQ ID NO: 504776 - DNA, 25 bp, Rattus norvegicus
gctagagccacagcttcgctcgcta

SEQ ID NO: 504777 - DNA, 25 bp, Rattus norvegicus
cagctctttgctcagaccggctaga

SEQ ID NO: 504778 - DNA, 25 bp, Rattus norvegicus
gacggctagcctgtcagctctttgc

SEQ ID NO: 504779 - DNA, 25 bp, Rattus norvegicus
tccagactttctagagccagcctga

SEQ ID NO: 504780 - DNA, 25 bp, Rattus norvegicus
gccttccaaaaagagtgctgacttg

SEQ ID NO: 504781 - DNA, 25 bp, Rattus norvegicus
ccttggctgaggtttccacaacatc

SEQ ID NO: 504782 - DNA, 25 bp, Rattus norvegicus
ccgtgttctctgagatgcgccaaga

SEQ ID NO: 504783 - DNA, 25 bp, Rattus norvegicus
tctacttgggatctactcttggagc

SEQ ID NO: 504784 - DNA, 25 bp, Rattus norvegicus
ttggactgtagggtaccaagccttc

SEQ ID NO: 504785 - DNA, 25 bp, Rattus norvegicus
cccacgggttctctcaactggtgtg

SEQ ID NO: 504786 - DNA, 25 bp, Rattus norvegicus
tcgcttcacccataggctgccgaga

SEQ ID NO: 504787 - DNA, 25 bp, Rattus norvegicus
gctccgaaggctccatcgaatcctg

SEQ ID NO: 504788 - DNA, 25 bp, Rattus norvegicus
gcgggacctacgcttcctcatgaac

SEQ ID NO: 504789 - DNA, 25 bp, Rattus norvegicus
cttcacaataacgaggcagggcgca

SEQ ID NO: 504790 - DNA, 25 bp, Rattus norvegicus
gcgggctatcaacacgtgggatgta

SEQ ID NO: 504791 - DNA, 25 bp, Rattus norvegicus
tgggatgtattgtcacctccattgc

SEQ ID NO: 504792 - DNA, 25 bp, Rattus norvegicus
tgagcttagtcacgcctggaccttg

SEQ ID NO: 504793 - DNA, 25 bp, Rattus norvegicus
cgccaaggctctagagtctcagtga

SEQ ID NO: 504794 - DNA, 25 bp, Rattus norvegicus
gggaatccgcgacctgcgcgcgccc

SEQ ID NO: 504795 - DNA, 25 bp, Rattus norvegicus
ggtaggcgtggattaatacaaagaa

SEQ ID NO: 504796 - DNA, 25 bp, Rattus norvegicus
taatacaaagaagggctcggcgcgc

SEQ ID NO: 504797 - DNA, 25 bp, Rattus norvegicus
ctcggcgcgccccagaagtctggga

SEQ ID NO: 504798 - DNA, 25 bp, Rattus norvegicus
tctgggagaccggaggcctgctccc

SEQ ID NO: 504799 - DNA, 25 bp, Rattus norvegicus
cccgcgcgcggtttggaggtgtcaa

SEQ ID NO: 504800 - DNA, 25 bp, Rattus norvegicus
cgggaaataagggatccagataact

SEQ ID NO: 504801 - DNA, 25 bp, Rattus norvegicus
taagggatccagataactggcagtg

SEQ ID NO: 504802 - DNA, 25 bp, Rattus norvegicus
ccagataactggcagtgctggtgta

SEQ ID NO: 504803 - DNA, 25 bp, Rattus norvegicus
ctggtgtaggggcactcgagcacca

SEQ ID NO: 504804 - DNA, 25 bp, Rattus norvegicus
taggggcactcgagcaccagcaacc

SEQ ID NO: 504805 - DNA, 25 bp, Rattus norvegicus
cgtggattaatacaaagaagggctc

SEQ ID NO: 504806 - DNA, 25 bp, Rattus norvegicus
tgcgcgcgccccgtagtggctacag

SEQ ID NO: 504807 - DNA, 25 bp, Rattus norvegicus
ggcactcgagcaccagcaaccgggg

SEQ ID NO: 504808 - DNA, 25 bp, Rattus norvegicus
aggccttcctcggtttgactgatga

SEQ ID NO: 504809 - DNA, 25 bp, Rattus norvegicus
gatactgtcgcccagctctgctgtc

SEQ ID NO: 504810 - DNA, 25 bp, Rattus norvegicus
gcagggtcctctcattccgccagga

SEQ ID NO: 504811 - DNA, 25 bp, Rattus norvegicus
tctgtgtcgcttccatcagaggagc

SEQ ID NO: 504812 - DNA, 25 bp, Rattus norvegicus
aggagccactatgggcgctgagatc

SEQ ID NO: 504813 - DNA, 25 bp, Rattus norvegicus
tgagatcctcggcttcgtctgagtc

SEQ ID NO: 504814 - DNA, 25 bp, Rattus norvegicus
cttcgtctgagtccgaatctggggc

SEQ ID NO: 504815 - DNA, 25 bp, Rattus norvegicus
cctaaggtcgagtgctctgggctac

SEQ ID NO: 504816 - DNA, 25 bp, Rattus norvegicus
atctcgcgggttcacttcgccgaca

SEQ ID NO: 504817 - DNA, 25 bp, Rattus norvegicus
aggagcgctcctccaatgaagaatc

SEQ ID NO: 504818 - DNA, 25 bp, Rattus norvegicus
tcgcgaccctcactcggtgggttta

SEQ ID NO: 504819 - DNA, 25 bp, Rattus norvegicus
ggtgggtttaagactcgactgctca

SEQ ID NO: 504820 - DNA, 25 bp, Rattus norvegicus
tttcctggtgtcctctcggacgagg

SEQ ID NO: 504821 - DNA, 25 bp, Rattus norvegicus
tgttcccaaccgcaggcagggtcct

SEQ ID NO: 504822 - DNA, 25 bp, Rattus norvegicus
gaccgcgaagaagcgtcgacaaaca

SEQ ID NO: 504823 - DNA, 25 bp, Rattus norvegicus
gagaccctggcatctggcgctcatt

SEQ ID NO: 504824 - DNA, 25 bp, Rattus norvegicus
gggtgtccttactataacggtgtga

SEQ ID NO: 504825 - DNA, 25 bp, Rattus norvegicus
actcggtgacattgagcgccagcgc

SEQ ID NO: 504826 - DNA, 25 bp, Rattus norvegicus
cagcgcttcacagttggcagacatc

SEQ ID NO: 504827 - DNA, 25 bp, Rattus norvegicus
cgcgtgtgtgactcgcttgcacaga

SEQ ID NO: 504828 - DNA, 25 bp, Rattus norvegicus
attcccgaagccagaaagccatagg

SEQ ID NO: 504829 - DNA, 25 bp, Rattus norvegicus
aggcttccctcggacattcccgaag

SEQ ID NO: 504830 - DNA, 25 bp, Rattus norvegicus
ggcaagcggtgagaactagattttt

SEQ ID NO: 504831 - DNA, 25 bp, Rattus norvegicus
ccgcggtactgcctgacagcaagta

SEQ ID NO: 504832 - DNA, 25 bp, Rattus norvegicus
gcagctggccaatcaccgtggagca

SEQ ID NO: 504833 - DNA, 25 bp, Rattus norvegicus
ccatattggacgaacgcgaggaccc

SEQ ID NO: 504834 - DNA, 25 bp, Rattus norvegicus
tcacctggaactcggcgaactcttc

SEQ ID NO: 504835 - DNA, 25 bp, Rattus norvegicus
tagctaagtggaaagcaggcttccc

SEQ ID NO: 504836 - DNA, 25 bp, Rattus norvegicus
cccgaagcgctctggtctggagaaa

SEQ ID NO: 504837 - DNA, 25 bp, Rattus norvegicus
aacagcttggacttctgcacccaga

SEQ ID NO: 504838 - DNA, 25 bp, Rattus norvegicus
gcgcgacggctataatgacaggaaa

SEQ ID NO: 504839 - DNA, 25 bp, Rattus norvegicus
tgtccatggactgtcgagaagcagc

SEQ ID NO: 504840 - DNA, 25 bp, Rattus norvegicus
tccttcactcacgtgcggttctggg

SEQ ID NO: 504841 - DNA, 25 bp, Rattus norvegicus
tccgtgcacactttaacagcgactg

SEQ ID NO: 504842 - DNA, 25 bp, Rattus norvegicus
agcgagtgcacgtgcgtatgtgtta

SEQ ID NO: 504843 - DNA, 25 bp, Rattus norvegicus
cactggagaccacttggggcagcca

SEQ ID NO: 504844 - DNA, 25 bp, Rattus norvegicus
tgagcaggaacccaggtgagcagtt

SEQ ID NO: 504845 - DNA, 25 bp, Rattus norvegicus
ggcgcagcctacacctgggacaatg

SEQ ID NO: 504846 - DNA, 25 bp, Rattus norvegicus
cttttctcctgttctcgggctcgga

SEQ ID NO: 504847 - DNA, 25 bp, Rattus norvegicus
cagccttgcgcctttttctctcggt

SEQ ID NO: 504848 - DNA, 25 bp, Rattus norvegicus
ccctcggagaataacgggccatcca

SEQ ID NO: 504849 - DNA, 25 bp, Rattus norvegicus
tctggagaaaactggaaaccctgta

SEQ ID NO: 504850 - DNA, 25 bp, Rattus norvegicus
atatggcgccgcgagccgaccacgt

SEQ ID NO: 504851 - DNA, 25 bp, Rattus norvegicus
aaaggagagctggacgaaggaatta

SEQ ID NO: 504852 - DNA, 25 bp, Rattus norvegicus
ctttcgggcttaacacttgaactgc

SEQ ID NO: 504853 - DNA, 25 bp, Rattus norvegicus
gccgacactcccaaagacgggcaga

SEQ ID NO: 504854 - DNA, 25 bp, Rattus norvegicus
cttgaactgccttgggagtggctgc

SEQ ID NO: 504855 - DNA, 25 bp, Rattus norvegicus
gccacccatgcagaggcagccatgt

SEQ ID NO: 504856 - DNA, 25 bp, Rattus norvegicus
aggcagccatgtctcctttcttttc

SEQ ID NO: 504857 - DNA, 25 bp, Rattus norvegicus
actcaccatggtggcagatggcgtc

SEQ ID NO: 504858 - DNA, 25 bp, Rattus norvegicus
aagagaccgctgacgtcaacgcccg

SEQ ID NO: 504859 - DNA, 25 bp, Rattus norvegicus
tttataggtcgacgccggttgggca

SEQ ID NO: 504860 - DNA, 25 bp, Rattus norvegicus
acccagctatggacgggtgtgcaca

SEQ ID NO: 504861 - DNA, 25 bp, Rattus norvegicus
tgtgcacatgcgcagagctctacct

SEQ ID NO: 504862 - DNA, 25 bp, Rattus norvegicus
cgcagagctctacctttcgggctta

SEQ ID NO: 504863 - DNA, 25 bp, Rattus norvegicus
ttagagaaaacactccaacttcagg

SEQ ID NO: 504864 - DNA, 25 bp, Rattus norvegicus
gcttcgtctctcagggtactgcaga

SEQ ID NO: 504865 - DNA, 25 bp, Rattus norvegicus
cggacacgggtgtggcccagacctc

SEQ ID NO: 504866 - DNA, 25 bp, Rattus norvegicus
agacctcggagatgcacccaccgaa

SEQ ID NO: 504867 - DNA, 25 bp, Rattus norvegicus
gatgcacccaccgaagcagaggagg

SEQ ID NO: 504868 - DNA, 25 bp, Rattus norvegicus
gactccattgctagcacccgccagt

SEQ ID NO: 504869 - DNA, 25 bp, Rattus norvegicus
acccgccagttcctcagcttggaaa

SEQ ID NO: 504870 - DNA, 25 bp, Rattus norvegicus
ttcctcagcttggaaagctcccttg

SEQ ID NO: 504871 - DNA, 25 bp, Rattus norvegicus
ttggaaagctcccttgcagtaggcc

SEQ ID NO: 504872 - DNA, 25 bp, Rattus norvegicus
acccttccggcggtggctgagcctg

SEQ ID NO: 504873 - DNA, 25 bp, Rattus norvegicus
gctgagcctgccttggatcaccttc

SEQ ID NO: 504874 - DNA, 25 bp, Rattus norvegicus
tcgtctctcagggtactgcagaccc

SEQ ID NO: 504875 - DNA, 25 bp, Rattus norvegicus
cggaccttaagatctggctaacggc

SEQ ID NO: 504876 - DNA, 25 bp, Rattus norvegicus
agctctcccggaccttaagatctgg

SEQ ID NO: 504877 - DNA, 25 bp, Rattus norvegicus
ttggatcaccttcctcgcccagctc

SEQ ID NO: 504878 - DNA, 25 bp, Rattus norvegicus
gaacgtcgaggctctccagatggaa

SEQ ID NO: 504879 - DNA, 25 bp, Rattus norvegicus
cctcttggaggaaaggctgtgactc

SEQ ID NO: 504880 - DNA, 25 bp, Rattus norvegicus
ggctgtgactctgcagttctacgca

SEQ ID NO: 504881 - DNA, 25 bp, Rattus norvegicus
agaggctttttcctcgcctgggatc

SEQ ID NO: 504882 - DNA, 25 bp, Rattus norvegicus
gtggttcctgcgaagaggctttttc

SEQ ID NO: 504883 - DNA, 25 bp, Rattus norvegicus
atctgggcagcggtcgtagagactc

SEQ ID NO: 504884 - DNA, 25 bp, Rattus norvegicus
caaccggagaggaaagtagtgcagc

SEQ ID NO: 504885 - DNA, 25 bp, Rattus norvegicus
aaagtggggaacgaggcagccattt

SEQ ID NO: 504886 - DNA, 25 bp, Rattus norvegicus
tctccagatggaacgtcgaggcgcc

SEQ ID NO: 504887 - DNA, 25 bp, Rattus norvegicus
caccggtggctttgatcttgggcaa

SEQ ID NO: 504888 - DNA, 25 bp, Rattus norvegicus
cgaggcagccatttgcaaccggaga

SEQ ID NO: 504889 - DNA, 25 bp, Rattus norvegicus
gttctacgcacacgctgagggatcc

SEQ ID NO: 504890 - DNA, 25 bp, Rattus norvegicus
agcagcccggaaggaatgccgcgcc

SEQ ID NO: 504891 - DNA, 25 bp, Rattus norvegicus
ggtctagaggtgcatggtccaaccc

SEQ ID NO: 504892 - DNA, 25 bp, Rattus norvegicus
actagcggcatgacaggacgccgcc

SEQ ID NO: 504893 - DNA, 25 bp, Rattus norvegicus
caacacagcggctgtacgcagggga

SEQ ID NO: 504894 - DNA, 25 bp, Rattus norvegicus
aaagatcagccgaggtgcaggcctg

SEQ ID NO: 504895 - DNA, 25 bp, Rattus norvegicus
acacggggaaggacagtagctcacc

SEQ ID NO: 504896 - DNA, 25 bp, Rattus norvegicus
aaggacagtagctcaccggagctca

SEQ ID NO: 504897 - DNA, 25 bp, Rattus norvegicus
acgtgatcacaacacagcggctgta

SEQ ID NO: 504898 - DNA, 25 bp, Rattus norvegicus
ttcctgtagcgcactagcggcatga

SEQ ID NO: 504899 - DNA, 25 bp, Rattus norvegicus
tggccaccttcctgtagcgcactag

SEQ ID NO: 504900 - DNA, 25 bp, Rattus norvegicus
aggatggccaccttcctgtagcgca

SEQ ID NO: 504901 - DNA, 25 bp, Rattus norvegicus
acaaagcaacggtgctctcgggagg

SEQ ID NO: 504902 - DNA, 25 bp, Rattus norvegicus
ttctggccacaaagcaacggtgctc

SEQ ID NO: 504903 - DNA, 25 bp, Rattus norvegicus
gcctcttctggccacaaagcaacgg

SEQ ID NO: 504904 - DNA, 25 bp, Rattus norvegicus
gtgtcacatttccgcgacagcgcgc

SEQ ID NO: 504905 - DNA, 25 bp, Rattus norvegicus
gagctcacccggcaaacgcaaggaa

SEQ ID NO: 504906 - DNA, 25 bp, Rattus norvegicus
agcggtgcgaacacgcccacggctt

SEQ ID NO: 504907 - DNA, 25 bp, Rattus norvegicus
gcaaacgcaaaggagcaaaggcgcg

SEQ ID NO: 504908 - DNA, 25 bp, Rattus norvegicus
agtaccaatgcatgccagtcggctg

SEQ ID NO: 504909 - DNA, 25 bp, Rattus norvegicus
tgggcccactggtgactctctagaa

SEQ ID NO: 504910 - DNA, 25 bp, Rattus norvegicus
tggtgactctctagaaccgcgtagc

SEQ ID NO: 504911 - DNA, 25 bp, Rattus norvegicus
tctagaaccgcgtagcaggaggcga

SEQ ID NO: 504912 - DNA, 25 bp, Rattus norvegicus
cgttgaccagcagcgtcccgtgagc

SEQ ID NO: 504913 - DNA, 25 bp, Rattus norvegicus
taaaggaggcgcgagtaccaatgca

SEQ ID NO: 504914 - DNA, 25 bp, Rattus norvegicus
cggcgcgcgaacaccggtgcaaagt

SEQ ID NO: 504915 - DNA, 25 bp, Rattus norvegicus
tgcaaagtcacctggagcaggcgct

SEQ ID NO: 504916 - DNA, 25 bp, Rattus norvegicus
ccgagcggcgaacaccagatgccag

SEQ ID NO: 504917 - DNA, 25 bp, Rattus norvegicus
cagatgccagggtgtgagcaacagt

SEQ ID NO: 504918 - DNA, 25 bp, Rattus norvegicus
gaggacgtcgttgaccagcagcgtc

SEQ ID NO: 504919 - DNA, 25 bp, Rattus norvegicus
ccgagcgcgtgcagcaaacgcaaag

SEQ ID NO: 504920 - DNA, 25 bp, Rattus norvegicus
gttcatcaccgcgatggctagagca

SEQ ID NO: 504921 - DNA, 25 bp, Rattus norvegicus
ggctagagcattcacccgctctttg

SEQ ID NO: 504922 - DNA, 25 bp, Rattus norvegicus
cccgctctttgcaacgctaatgggg

SEQ ID NO: 504923 - DNA, 25 bp, Rattus norvegicus
ctagagcattcacccgctctttgca

SEQ ID NO: 504924 - DNA, 25 bp, Rattus norvegicus
cacatgttcatcaccgcgatggcta

SEQ ID NO: 504925 - DNA, 25 bp, Rattus norvegicus
tcacccgctctttgcaacgctaatg

SEQ ID NO: 504926 - DNA, 25 bp, Rattus norvegicus
ctctttgcaacgctaatgggggtcg

SEQ ID NO: 504927 - DNA, 25 bp, Rattus norvegicus
catcaccgcgatggctagagcattc

SEQ ID NO: 504928 - DNA, 25 bp, Rattus norvegicus
tcaccgcgatggctagagcattcac

SEQ ID NO: 504929 - DNA, 25 bp, Rattus norvegicus
cgatggctagagcattcacccgctc

SEQ ID NO: 504930 - DNA, 25 bp, Rattus norvegicus
cgcgatggctagagcattcacccgc

SEQ ID NO: 504931 - DNA, 25 bp, Rattus norvegicus
accgcgatggctagagcattcaccc

SEQ ID NO: 504932 - DNA, 25 bp, Rattus norvegicus
cacccgctctttgcaacgctaatgg

SEQ ID NO: 504933 - DNA, 25 bp, Rattus norvegicus
gggccacatgttcatcaccgcgatg

SEQ ID NO: 504934 - DNA, 25 bp, Rattus norvegicus
cgtaggcgtactccgggccacatgt

SEQ ID NO: 504935 - DNA, 25 bp, Rattus norvegicus
cttcagtcacgcgtaggcgtactcc

SEQ ID NO: 504936 - DNA, 25 bp, Rattus norvegicus
gtcccaaccttcagtcacgcgtagg

SEQ ID NO: 504937 - DNA, 25 bp, Rattus norvegicus
tgagtcctgtgcgtggtggccatcc

SEQ ID NO: 504938 - DNA, 25 bp, Rattus norvegicus
cttcgtagtgcagtgagtcctgtgc

SEQ ID NO: 504939 - DNA, 25 bp, Rattus norvegicus
cacggccttcgtagtgcagtgagtc

SEQ ID NO: 504940 - DNA, 25 bp, Rattus norvegicus
tcacggtcagacgtggtgatgtcca

SEQ ID NO: 504941 - DNA, 25 bp, Rattus norvegicus
gcgcgccaacaaaccatacttatta

SEQ ID NO: 504942 - DNA, 25 bp, Rattus norvegicus
tgatgtccagggcacggccttcgta

SEQ ID NO: 504943 - DNA, 25 bp, Rattus norvegicus
ccatacttattacggtcacggtcag

SEQ ID NO: 504944 - DNA, 25 bp, Rattus norvegicus
ggttgcgggactcgtagtagaccca

SEQ ID NO: 504945 - DNA, 25 bp, Rattus norvegicus
tcgtagtagacccagtcgaatccgg

SEQ ID NO: 504946 - DNA, 25 bp, Rattus norvegicus
tagacccagtcgaatccggcttcca

SEQ ID NO: 504947 - DNA, 25 bp, Rattus norvegicus
tgctaggcgcgccaacaaaccatac

SEQ ID NO: 504948 - DNA, 25 bp, Rattus norvegicus
gctacaaagacgcttttcagccgcc

SEQ ID NO: 504949 - DNA, 25 bp, Rattus norvegicus
ggggctgcacgcagtacaatggcca

SEQ ID NO: 504950 - DNA, 25 bp, Rattus norvegicus
tcgggagaagcggactcagcagcca

SEQ ID NO: 504951 - DNA, 25 bp, Rattus norvegicus
tccgggatgacttaactaagcgaga

SEQ ID NO: 504952 - DNA, 25 bp, Rattus norvegicus
gcggactcagcagccacagctacaa

SEQ ID NO: 504953 - DNA, 25 bp, Rattus norvegicus
ttctccgggatgacttaactaagcg

SEQ ID NO: 504954 - DNA, 25 bp, Rattus norvegicus
gccattctccgggatgacttaacta

SEQ ID NO: 504955 - DNA, 25 bp, Rattus norvegicus
aatggccattctccgggatgactta

SEQ ID NO: 504956 - DNA, 25 bp, Rattus norvegicus
gtacaatggccattctccgggatga

SEQ ID NO: 504957 - DNA, 25 bp, Rattus norvegicus
tgcacgcagtacaatggccattctc

SEQ ID NO: 504958 - DNA, 25 bp, Rattus norvegicus
tgacttaactaagcgagaatctcgg

SEQ ID NO: 504959 - DNA, 25 bp, Rattus norvegicus
agccacagctacaaagacgcttttc

SEQ ID NO: 504960 - DNA, 25 bp, Rattus norvegicus
tcagcagccacagctacaaagacgc

SEQ ID NO: 504961 - DNA, 25 bp, Rattus norvegicus
aactaagcgagaatctcgggccggg

SEQ ID NO: 504962 - DNA, 25 bp, Rattus norvegicus
gctcgggcatactaggcacaaactg

SEQ ID NO: 504963 - DNA, 25 bp, Rattus norvegicus
gtccgctcgggcatactaggcacaa

SEQ ID NO: 504964 - DNA, 25 bp, Rattus norvegicus
tcgcgccaagggtccgctcgggcat

SEQ ID NO: 504965 - DNA, 25 bp, Rattus norvegicus
ggcacaagttgcttgcgcacgtaac

SEQ ID NO: 504966 - DNA, 25 bp, Rattus norvegicus
cttgtagagcagaggcacaagttgc

SEQ ID NO: 504967 - DNA, 25 bp, Rattus norvegicus
ctaggcacaaactgcttgtagagca

SEQ ID NO: 504968 - DNA, 25 bp, Rattus norvegicus
gggcatactaggcacaaactgcttg

SEQ ID NO: 504969 - DNA, 25 bp, Rattus norvegicus
agttgcttgcgcacgtaacgccgcc

SEQ ID NO: 504970 - DNA, 25 bp, Rattus norvegicus
cctccgctggcccactcgcgccaag

SEQ ID NO: 504971 - DNA, 25 bp, Rattus norvegicus
gacgaggtcccggaagcgctccgac

SEQ ID NO: 504972 - DNA, 25 bp, Rattus norvegicus
ccttgaagattatgtcggggttgta

SEQ ID NO: 504973 - DNA, 25 bp, Rattus norvegicus
cctcatccttgaagattatgtcggg

SEQ ID NO: 504974 - DNA, 25 bp, Rattus norvegicus
gttctcctcatccttgaagattatg

SEQ ID NO: 504975 - DNA, 25 bp, Rattus norvegicus
gccgctgttctcctcatccttgaag

SEQ ID NO: 504976 - DNA, 25 bp, Rattus norvegicus
ccagccgatccgacctaggaggtca

SEQ ID NO: 504977 - DNA, 25 bp, Rattus norvegicus
acccggcggctttgtttacagctca

SEQ ID NO: 504978 - DNA, 25 bp, Rattus norvegicus
tcgcggaccctatcgtggaacagct

SEQ ID NO: 504979 - DNA, 25 bp, Rattus norvegicus
tggaacagctgctctcgcacggata

SEQ ID NO: 504980 - DNA, 25 bp, Rattus norvegicus
cacttcgtagtcagctgcttccata

SEQ ID NO: 504981 - DNA, 25 bp, Rattus norvegicus
atactctgctcagcatgactggggc

SEQ ID NO: 504982 - DNA, 25 bp, Rattus norvegicus
ctgcccgtgacggaaactcaaggta

SEQ ID NO: 504983 - DNA, 25 bp, Rattus norvegicus
gccgcagcccgcctagtcttaaagg

SEQ ID NO: 504984 - DNA, 25 bp, Rattus norvegicus
tggggccactcacaatcagatttca

SEQ ID NO: 504985 - DNA, 25 bp, Rattus norvegicus
agatttcaacgcaagtacccgccgc

SEQ ID NO: 504986 - DNA, 25 bp, Rattus norvegicus
ggcttggtgcccactgacgacacaa

SEQ ID NO: 504987 - DNA, 25 bp, Rattus norvegicus
ttcttcagaagaacggagcttattg

SEQ ID NO: 504988 - DNA, 25 bp, Rattus norvegicus
gagactgtcggtcatcgctacggga

SEQ ID NO: 504989 - DNA, 25 bp, Rattus norvegicus
aactcaaggtaatctggggctcaga

SEQ ID NO: 504990 - DNA, 25 bp, Rattus norvegicus
tgacgtcacacgaatcaggatttga

SEQ ID NO: 504991 - DNA, 25 bp, Rattus norvegicus
gcaaagtttggaacactccgctctt

SEQ ID NO: 504992 - DNA, 25 bp, Rattus norvegicus
actccgctcttgctttcttcgatag

SEQ ID NO: 504993 - DNA, 25 bp, Rattus norvegicus
gactgtgctctctccgctggcagat

SEQ ID NO: 504994 - DNA, 25 bp, Rattus norvegicus
atccgtaatcgtgccgggtgctgtt

SEQ ID NO: 504995 - DNA, 25 bp, Rattus norvegicus
cgttcccagtcaacagcaaagtttg

SEQ ID NO: 504996 - DNA, 25 bp, Rattus norvegicus
ccaagctccaaaatgtcgggaaata

SEQ ID NO: 504997 - DNA, 25 bp, Rattus norvegicus
aggacgacgccaggtacacaccctt

SEQ ID NO: 504998 - DNA, 25 bp, Rattus norvegicus
ccatggatccggctcgacaatctgc

SEQ ID NO: 504999 - DNA, 25 bp, Rattus norvegicus
cgccgaaggaggtcagcatttgctt

SEQ ID NO: 505000 - DNA, 25 bp, Rattus norvegicus
gcggacggttttgattgtaacagga

SEQ ID NO: 505001 - DNA, 25 bp, Rattus norvegicus
caggagatcctctttaaggtccgtt

SEQ ID NO: 505002 - DNA, 25 bp, Rattus norvegicus
cacagtggtcctgggatccgtaatc

SEQ ID NO: 505003 - DNA, 25 bp, Rattus norvegicus
tgttaaaggactaagacgaccagcg

SEQ ID NO: 505004 - DNA, 25 bp, Rattus norvegicus
tgatagaagcagacaccgggtcccg

SEQ ID NO: 505005 - DNA, 25 bp, Rattus norvegicus
gctctcaggcgggaatgtaacggtt

SEQ ID NO: 505006 - DNA, 25 bp, Rattus norvegicus
gtaacggttgcgcatgcgtcctttg

SEQ ID NO: 505007 - DNA, 25 bp, Rattus norvegicus
atgcgtcctttgtctccggcgcctt

SEQ ID NO: 505008 - DNA, 25 bp, Rattus norvegicus
cgccttttcgcgctaaagaggaagt

SEQ ID NO: 505009 - DNA, 25 bp, Rattus norvegicus
gcgcccgaaaagcagcaagcaagtc

SEQ ID NO: 505010 - DNA, 25 bp, Rattus norvegicus
cccgcgggaagacagcagtctgaaa

SEQ ID NO: 505011 - DNA, 25 bp, Rattus norvegicus
aaagcgccacgctgcaggttttgcg

SEQ ID NO: 505012 - DNA, 25 bp, Rattus norvegicus
ttggagaccggattccagagagatc

SEQ ID NO: 505013 - DNA, 25 bp, Rattus norvegicus
cagagagatccgagtgcttcccttc

SEQ ID NO: 505014 - DNA, 25 bp, Rattus norvegicus
cactcaccatgatagctacgggtta

SEQ ID NO: 505015 - DNA, 25 bp, Rattus norvegicus
cgttcccgacaactaagagtcgagg

SEQ ID NO: 505016 - DNA, 25 bp, Rattus norvegicus
attaaacccgcagtgcctcagcgcg

SEQ ID NO: 505017 - DNA, 25 bp, Rattus norvegicus
ccggagcctcttaagtagcagctga

SEQ ID NO: 505018 - DNA, 25 bp, Rattus norvegicus
agagcccgggaaggtttgctcacca

SEQ ID NO: 505019 - DNA, 25 bp, Rattus norvegicus
tcgatgtaagagaacctgcggcact

SEQ ID NO: 505020 - DNA, 25 bp, Rattus norvegicus
gcgcgactcttaagcggtcgatgta

SEQ ID NO: 505021 - DNA, 25 bp, Rattus norvegicus
gttgcttcttacagcgcgactctta

SEQ ID NO: 505022 - DNA, 25 bp, Rattus norvegicus
acgccacggaagcaagagacaaaca

SEQ ID NO: 505023 - DNA, 25 bp, Rattus norvegicus
tgctcaccatggttgctgcttcgcg

SEQ ID NO: 505024 - DNA, 25 bp, Rattus norvegicus
tccttgcagactgagccggctgaca

SEQ ID NO: 505025 - DNA, 25 bp, Rattus norvegicus
acaaaaggcttaggcgtctccttgc

SEQ ID NO: 505026 - DNA, 25 bp, Rattus norvegicus
cccgcagagatgacaaaaggcttag

SEQ ID NO: 505027 - DNA, 25 bp, Rattus norvegicus
cgggactcacggactaagctaaact

SEQ ID NO: 505028 - DNA, 25 bp, Rattus norvegicus
cgcagcctttgttcttcccggtctg

SEQ ID NO: 505029 - DNA, 25 bp, Rattus norvegicus
tattttcccagcgagttagggcggc

SEQ ID NO: 505030 - DNA, 25 bp, Rattus norvegicus
gccatggatcccaggcaaactattt

SEQ ID NO: 505031 - DNA, 25 bp, Rattus norvegicus
aggaggaggtgttgcttcttacagc

SEQ ID NO: 505032 - DNA, 25 bp, Rattus norvegicus
atgaaacggaagcaagaggccgcgc

SEQ ID NO: 505033 - DNA, 25 bp, Rattus norvegicus
agccataaaatgcaccatagccgga

SEQ ID NO: 505034 - DNA, 25 bp, Rattus norvegicus
tttcttcacaaaaaacgcaagcgta

SEQ ID NO: 505035 - DNA, 25 bp, Rattus norvegicus
ctgcccggccgcattctgttcatcc

SEQ ID NO: 505036 - DNA, 25 bp, Rattus norvegicus
ccagctgccgctcgaagggaacagg

SEQ ID NO: 505037 - DNA, 25 bp, Rattus norvegicus
tttaagaccaccctcctggcgctgg

SEQ ID NO: 505038 - DNA, 25 bp, Rattus norvegicus
gcaccatagccggaagaacatacac

SEQ ID NO: 505039 - DNA, 25 bp, Rattus norvegicus
gtcctcccaatgaaacggaagcaag

SEQ ID NO: 505040 - DNA, 25 bp, Rattus norvegicus
acgagagccctgtacctgccagctg

SEQ ID NO: 505041 - DNA, 25 bp, Rattus norvegicus
tgtacctgccagctgccgctcgaag

SEQ ID NO: 505042 - DNA, 25 bp, Rattus norvegicus
gtaaacaagagccataaaatgcacc

SEQ ID NO: 505043 - DNA, 25 bp, Rattus norvegicus
gctacatcgccacgagagccctgta

SEQ ID NO: 505044 - DNA, 25 bp, Rattus norvegicus
gccggaagaacatacacctttaaga

SEQ ID NO: 505045 - DNA, 25 bp, Rattus norvegicus
gcggtccagtcctcccaatgaaacg

SEQ ID NO: 505046 - DNA, 25 bp, Rattus norvegicus
tgcgctgtatcctcaacgccatcga

SEQ ID NO: 505047 - DNA, 25 bp, Rattus norvegicus
agaattcgatcgctgcgctgtatcc

SEQ ID NO: 505048 - DNA, 25 bp, Rattus norvegicus
gcattgatcatagcccagaattcga

SEQ ID NO: 505049 - DNA, 25 bp, Rattus norvegicus
tacacgccgtgcattgatcatagcc

SEQ ID NO: 505050 - DNA, 25 bp, Rattus norvegicus
tttcttgcttttaacgtttcataca

SEQ ID NO: 505051 - DNA, 25 bp, Rattus norvegicus
cctccatggctcatttttaagtaac

SEQ ID NO: 505052 - DNA, 25 bp, Rattus norvegicus
ttaggtttttggacctccatggctc

SEQ ID NO: 505053 - DNA, 25 bp, Rattus norvegicus
gtggccatttccgtcgcagcggatg

SEQ ID NO: 505054 - DNA, 25 bp, Rattus norvegicus
ccctgggcgattgcttaggtttttg

SEQ ID NO: 505055 - DNA, 25 bp, Rattus norvegicus
ggaagtcaccctgggcgattgctta

SEQ ID NO: 505056 - DNA, 25 bp, Rattus norvegicus
tccgtcgcagcggatgagctcaccg

SEQ ID NO: 505057 - DNA, 25 bp, Rattus norvegicus
ctctctgtcgcctttgaccagcagg

SEQ ID NO: 505058 - DNA, 25 bp, Rattus norvegicus
tgtcgcctttgaccagcaggcggcg

SEQ ID NO: 505059 - DNA, 25 bp, Rattus norvegicus
gtttcatacatttacacgccgtgca

SEQ ID NO: 505060 - DNA, 25 bp, Rattus norvegicus
gcccaagtccatcaaactagtgtcg

SEQ ID NO: 505061 - DNA, 25 bp, Rattus norvegicus
cgctttaggctagaagactcgtccc

SEQ ID NO: 505062 - DNA, 25 bp, Rattus norvegicus
tcccggtacctctgtctcgatcgta

SEQ ID NO: 505063 - DNA, 25 bp, Rattus norvegicus
ctcgatcgtactgggagagcatccc

SEQ ID NO: 505064 - DNA, 25 bp, Rattus norvegicus
agagcatcccgtctaggccgccagt

SEQ ID NO: 505065 - DNA, 25 bp, Rattus norvegicus
tacctgggactttcttccggtcaga

SEQ ID NO: 505066 - DNA, 25 bp, Rattus norvegicus
tcttcccggctccaagacctgggtg

SEQ ID NO: 505067 - DNA, 25 bp, Rattus norvegicus
gcccggccagggtatataagcactc

SEQ ID NO: 505068 - DNA, 25 bp, Rattus norvegicus
actccttggtagtctgctagtggga

SEQ ID NO: 505069 - DNA, 25 bp, Rattus norvegicus
tcacttcctcagttttcgcggacca

SEQ ID NO: 505070 - DNA, 25 bp, Rattus norvegicus
cgcggaccacttcaaggactaaata

SEQ ID NO: 505071 - DNA, 25 bp, Rattus norvegicus
gaccagggtttgagagcccaagtcc

SEQ ID NO: 505072 - DNA, 25 bp, Rattus norvegicus
ccagctccttctacggagtttgatt

SEQ ID NO: 505073 - DNA, 25 bp, Rattus norvegicus
ttccggtcagagctccacaaagatc

SEQ ID NO: 505074 - DNA, 25 bp, Rattus norvegicus
agcaagagctacaggagctcaacga

SEQ ID NO: 505075 - DNA, 25 bp, Rattus norvegicus
cccgcatcggtctgcagctccttcc

SEQ ID NO: 505076 - DNA, 25 bp, Rattus norvegicus
ccggcctagttctgccaagcgctga

SEQ ID NO: 505077 - DNA, 25 bp, Rattus norvegicus
tctgccaagcgctgaatgccatctt

SEQ ID NO: 505078 - DNA, 25 bp, Rattus norvegicus
tgaatgccatcttccgccagcatga

SEQ ID NO: 505079 - DNA, 25 bp, Rattus norvegicus
ccgccagcatgagccatcactcgtc

SEQ ID NO: 505080 - DNA, 25 bp, Rattus norvegicus
tcgggcctccggtccagcatcagct

SEQ ID NO: 505081 - DNA, 25 bp, Rattus norvegicus
gctccacctcataccgccggacctt

SEQ ID NO: 505082 - DNA, 25 bp, Rattus norvegicus
gaccttcgggccaccgccctcactg

SEQ ID NO: 505083 - DNA, 25 bp, Rattus norvegicus
ggggctttctcctactcatccagct

SEQ ID NO: 505084 - DNA, 25 bp, Rattus norvegicus
tcggagcgcctcgacttctccatgg

SEQ ID NO: 505085 - DNA, 25 bp, Rattus norvegicus
tggccgaggccctcaaccaggagtt

SEQ ID NO: 505086 - DNA, 25 bp, Rattus norvegicus
ggagcaacgagaagcaagagctaca

SEQ ID NO: 505087 - DNA, 25 bp, Rattus norvegicus
ccagctgtgccagcaggagctgcgc

SEQ ID NO: 505088 - DNA, 25 bp, Rattus norvegicus
acgctgacctgtccgatgctgccaa

SEQ ID NO: 505089 - DNA, 25 bp, Rattus norvegicus
ccagagtctgacgtgcgaagtggac

SEQ ID NO: 505090 - DNA, 25 bp, Rattus norvegicus
gtcccgacgtcagatccagagtctg

SEQ ID NO: 505091 - DNA, 25 bp, Rattus norvegicus
caggagatgaacgagtcccgacgtc

SEQ ID NO: 505092 - DNA, 25 bp, Rattus norvegicus
ctacgtcaggccaagcaggagatga

SEQ ID NO: 505093 - DNA, 25 bp, Rattus norvegicus
aaccatgaggccctacgtcaggcca

SEQ ID NO: 505094 - DNA, 25 bp, Rattus norvegicus
tataagtcaaaagtgcgagagcagg

SEQ ID NO: 505095 - DNA, 25 bp, Rattus norvegicus
tgccactgagcagtacgctgacctg

SEQ ID NO: 505096 - DNA, 25 bp, Rattus norvegicus
cgatgctgccaaccgcaaccatgag

SEQ ID NO: 505097 - DNA, 25 bp, Rattus norvegicus
tccgtgcacagtatgagaacatcgc

SEQ ID NO: 505098 - DNA, 25 bp, Rattus norvegicus
cagtatgagaacatcgcggcgaaga

SEQ ID NO: 505099 - DNA, 25 bp, Rattus norvegicus
acatcgcggcgaagaatctgcagga

SEQ ID NO: 505100 - DNA, 25 bp, Rattus norvegicus
aggcagaggagtggtataagtcaaa

SEQ ID NO: 505101 - DNA, 25 bp, Rattus norvegicus
tgagggacatccgtgcacagtatga

SEQ ID NO: 505102 - DNA, 25 bp, Rattus norvegicus
tgatctcgcgagagtactgtaatgc

SEQ ID NO: 505103 - DNA, 25 bp, Rattus norvegicus
cgagagtactgtaatgcccgttgca

SEQ ID NO: 505104 - DNA, 25 bp, Rattus norvegicus
cagagtcgccttcccgggcttcaga

SEQ ID NO: 505105 - DNA, 25 bp, Rattus norvegicus
ggccactcgcgctccgttttcggat

SEQ ID NO: 505106 - DNA, 25 bp, Rattus norvegicus
tccgttttcggattggctgaagagc

SEQ ID NO: 505107 - DNA, 25 bp, Rattus norvegicus
ctgaagagctggtcagttgttttcc

SEQ ID NO: 505108 - DNA, 25 bp, Rattus norvegicus
ggtcagttgttttcccatccagaaa

SEQ ID NO: 505109 - DNA, 25 bp, Rattus norvegicus
agaggacagacctcgctcggctggc

SEQ ID NO: 505110 - DNA, 25 bp, Rattus norvegicus
tttcggcgacttgtccctctctggc

SEQ ID NO: 505111 - DNA, 25 bp, Rattus norvegicus
gtaatgcccgttgcagcccagagtc

SEQ ID NO: 505112 - DNA, 25 bp, Rattus norvegicus
cgccctcgaagcctgcggattggtt

SEQ ID NO: 505113 - DNA, 25 bp, Rattus norvegicus
tgcgtgtgacgtcacgcgccttcgc

SEQ ID NO: 505114 - DNA, 25 bp, Rattus norvegicus
atccagaaaacgtttcggcgacttg

SEQ ID NO: 505115 - DNA, 25 bp, Rattus norvegicus
ttcccgggcttcagaacagcatcct

SEQ ID NO: 505116 - DNA, 25 bp, Rattus norvegicus
agcccttgagggttcagaacttata

SEQ ID NO: 505117 - DNA, 25 bp, Rattus norvegicus
tgcgacagcgacctagcatctcata

SEQ ID NO: 505118 - DNA, 25 bp, Rattus norvegicus
catctcatagtgtgttggtccgcga

SEQ ID NO: 505119 - DNA, 25 bp, Rattus norvegicus
ctgtgcaccagtagcgggatggcta

SEQ ID NO: 505120 - DNA, 25 bp, Rattus norvegicus
tcctcctcacttttgggcgcaatgg

SEQ ID NO: 505121 - DNA, 25 bp, Rattus norvegicus
gcggtgaattcctcctgtgacagca

SEQ ID NO: 505122 - DNA, 25 bp, Rattus norvegicus
accctcgggtgcagctctaatgatc

SEQ ID NO: 505123 - DNA, 25 bp, Rattus norvegicus
tctcacaggtctaagatgccacttc

SEQ ID NO: 505124 - DNA, 25 bp, Rattus norvegicus
ccagacagttgctttcttgcggatg

SEQ ID NO: 505125 - DNA, 25 bp, Rattus norvegicus
ccctcgttgatttctcccggctaga

SEQ ID NO: 505126 - DNA, 25 bp, Rattus norvegicus
acctcgtcggagattttgcactcta

SEQ ID NO: 505127 - DNA, 25 bp, Rattus norvegicus
gcactctagctcgtggaaagcacta

SEQ ID NO: 505128 - DNA, 25 bp, Rattus norvegicus
cttaggcccgcatagaaggcaattc

SEQ ID NO: 505129 - DNA, 25 bp, Rattus norvegicus
cgcctgagacctgcagcttcttgga

SEQ ID NO: 505130 - DNA, 25 bp, Rattus norvegicus
atcggaaatgtgaagggtcagcgct

SEQ ID NO: 505131 - DNA, 25 bp, Rattus norvegicus
caaagagcagcttcggatggatgag

SEQ ID NO: 505132 - DNA, 25 bp, Rattus norvegicus
agtgcttcctgccatctccttctat

SEQ ID NO: 505133 - DNA, 25 bp, Rattus norvegicus
cgcggccgcggcctttattagggat

SEQ ID NO: 505134 - DNA, 25 bp, Rattus norvegicus
ctttattagggattccgcggctgtc

SEQ ID NO: 505135 - DNA, 25 bp, Rattus norvegicus
gtcggtcccgccatccatcctgtcc

SEQ ID NO: 505136 - DNA, 25 bp, Rattus norvegicus
catcctgtccgccagcaattaggcg

SEQ ID NO: 505137 - DNA, 25 bp, Rattus norvegicus
cgccagcaattaggcggccagacaa

SEQ ID NO: 505138 - DNA, 25 bp, Rattus norvegicus
cggccagacaaagagcagcttcgga

SEQ ID NO: 505139 - DNA, 25 bp, Rattus norvegicus
agagcgcagagcatccctccgaggc

SEQ ID NO: 505140 - DNA, 25 bp, Rattus norvegicus
ctcctgctggagagcgcagagcatc

SEQ ID NO: 505141 - DNA, 25 bp, Rattus norvegicus
ggctggaacagcaacctaggcgccc

SEQ ID NO: 505142 - DNA, 25 bp, Rattus norvegicus
gcggcaggagcccagtgcttcctgc

SEQ ID NO: 505143 - DNA, 25 bp, Rattus norvegicus
ataatcacccgctgcccgtcactca

SEQ ID NO: 505144 - DNA, 25 bp, Rattus norvegicus
gctcaccaggcctcgctcttcgccg

SEQ ID NO: 505145 - DNA, 25 bp, Rattus norvegicus
ccagggaaaccgcagcgatcagggc

SEQ ID NO: 505146 - DNA, 25 bp, Rattus norvegicus
tagtacgggccagggaaaccgcagc

SEQ ID NO: 505147 - DNA, 25 bp, Rattus norvegicus
ctctaggcttagtacgggccaggga

SEQ ID NO: 505148 - DNA, 25 bp, Rattus norvegicus
gcgtggacgctctaggcttagtacg

SEQ ID NO: 505149 - DNA, 25 bp, Rattus norvegicus
gagtctccgtgcgtggacgctctag

SEQ ID NO: 505150 - DNA, 25 bp, Rattus norvegicus
gcacagagccgcgagacccagctca

SEQ ID NO: 505151 - DNA, 25 bp, Rattus norvegicus
cacaaccttgaccagccggcgcgca

SEQ ID NO: 505152 - DNA, 25 bp, Rattus norvegicus
tgcgcctcttctgcgcacaaccttg

SEQ ID NO: 505153 - DNA, 25 bp, Rattus norvegicus
gggtgagacgctcgctctttgcccg

SEQ ID NO: 505154 - DNA, 25 bp, Rattus norvegicus
ctacgagggtgagacgctcgctctt

SEQ ID NO: 505155 - DNA, 25 bp, Rattus norvegicus
cccggtgccactacgagggtgagac

SEQ ID NO: 505156 - DNA, 25 bp, Rattus norvegicus
actcaccgacttcaggcgaccggcc

SEQ ID NO: 505157 - DNA, 25 bp, Rattus norvegicus
agacccagctcagccggcgtgcgca

SEQ ID NO: 505158 - DNA, 25 bp, Rattus norvegicus
gcctggaaggtgaaaatcggaatta

SEQ ID NO: 505159 - DNA, 25 bp, Rattus norvegicus
tggaagctagggcagttctcgctca

SEQ ID NO: 505160 - DNA, 25 bp, Rattus norvegicus
tcagtgggcgcaacagatgtctgca

SEQ ID NO: 505161 - DNA, 25 bp, Rattus norvegicus
tgagagtggcaaaccttggcaaacc

SEQ ID NO: 505162 - DNA, 25 bp, Rattus norvegicus
ccttggcaaacctgcgacgtgagca

SEQ ID NO: 505163 - DNA, 25 bp, Rattus norvegicus
ggaacttctgctcgctcatacctgg

SEQ ID NO: 505164 - DNA, 25 bp, Rattus norvegicus
tgggtttctgtatcagccaaggaca

SEQ ID NO: 505165 - DNA, 25 bp, Rattus norvegicus
tgccagtggcgggtaaatatgttac

SEQ ID NO: 505166 - DNA, 25 bp, Rattus norvegicus
tatgttaccaagtcctccacagctg

SEQ ID NO: 505167 - DNA, 25 bp, Rattus norvegicus
ccctccggtttcagcttgtcagatc

SEQ ID NO: 505168 - DNA, 25 bp, Rattus norvegicus
ctgccctttcctcaccgtaatggtt

SEQ ID NO: 505169 - DNA, 25 bp, Rattus norvegicus
tggggtggccatcaatttcctcttg

SEQ ID NO: 505170 - DNA, 25 bp, Rattus norvegicus
cccgcgccagtttatagaacaacaa

SEQ ID NO: 505171 - DNA, 25 bp, Rattus norvegicus
agccaaggacaacctcgtgccagtg

SEQ ID NO: 505172 - DNA, 25 bp, Rattus norvegicus
gctctttccgtcagttcccgctcgg

SEQ ID NO: 505173 - DNA, 25 bp, Rattus norvegicus
ccagccgcgcctgcgaagtctctgt

SEQ ID NO: 505174 - DNA, 25 bp, Rattus norvegicus
ctccggagagtttcggctctttccg

SEQ ID NO: 505175 - DNA, 25 bp, Rattus norvegicus
ttcccgctcggctcttcacttaggg

SEQ ID NO: 505176 - DNA, 25 bp, Rattus norvegicus
tcggctcttcacttaggggcacgct

SEQ ID NO: 505177 - DNA, 25 bp, Rattus norvegicus
tcacttaggggcacgctggcgccca

SEQ ID NO: 505178 - DNA, 25 bp, Rattus norvegicus
agccgggccgcttcaggtcgccttt

SEQ ID NO: 505179 - DNA, 25 bp, Rattus norvegicus
tttcccgcacgcggacgcgagtacg

SEQ ID NO: 505180 - DNA, 25 bp, Rattus norvegicus
aatttcccgtctcccgcacctcagg

SEQ ID NO: 505181 - DNA, 25 bp, Rattus norvegicus
ctcaggcgcgcgaatcgggcgcgaa

SEQ ID NO: 505182 - DNA, 25 bp, Rattus norvegicus
gtcgctgtggatccgcgggcactcc

SEQ ID NO: 505183 - DNA, 25 bp, Rattus norvegicus
gctggcgcccactcccagccgggcc

SEQ ID NO: 505184 - DNA, 25 bp, Rattus norvegicus
ggccacctccggagagtttcggctc

SEQ ID NO: 505185 - DNA, 25 bp, Rattus norvegicus
tcgcgccggcgcgagtacgcgccct

SEQ ID NO: 505186 - DNA, 25 bp, Rattus norvegicus
aacccggtctcggtgcagctcgctg

SEQ ID NO: 505187 - DNA, 25 bp, Rattus norvegicus
ccctcaaatcgctcatcatgaaata

SEQ ID NO: 505188 - DNA, 25 bp, Rattus norvegicus
tgaaatatactggatgaccacgcag

SEQ ID NO: 505189 - DNA, 25 bp, Rattus norvegicus
accacgcagtccgtgtctctgtttc

SEQ ID NO: 505190 - DNA, 25 bp, Rattus norvegicus
ttcagtgtctcatccgaagaacagc

SEQ ID NO: 505191 - DNA, 25 bp, Rattus norvegicus
cgaagaacagctactcaacccggtc

SEQ ID NO: 505192 - DNA, 25 bp, Rattus norvegicus
gtcctgcagtggctcgacccggtca

SEQ ID NO: 505193 - DNA, 25 bp, Rattus norvegicus
gacccggtcacggtgcagctcactg

SEQ ID NO: 505194 - DNA, 25 bp, Rattus norvegicus
acggtgcagctcactgctgcccgtg

SEQ ID NO: 505195 - DNA, 25 bp, Rattus norvegicus
tgcccgtgtcctgcagtggcccaag

SEQ ID NO: 505196 - DNA, 25 bp, Rattus norvegicus
acagtcaggcgctgtacccactgcg

SEQ ID NO: 505197 - DNA, 25 bp, Rattus norvegicus
aagtgacgtctctgctgcttcctcc

SEQ ID NO: 505198 - DNA, 25 bp, Rattus norvegicus
tgggctccggacattacagtcaggc

SEQ ID NO: 505199 - DNA, 25 bp, Rattus norvegicus
ctgcagtggcccaagtgacgtctct

SEQ ID NO: 505200 - DNA, 25 bp, Rattus norvegicus
agcgccttgaaaaataactgtgggg

SEQ ID NO: 505201 - DNA, 25 bp, Rattus norvegicus
gccgtctactgtcacttctttaccg

SEQ ID NO: 505202 - DNA, 25 bp, Rattus norvegicus
gcagccagcgccttgaaaaataact

SEQ ID NO: 505203 - DNA, 25 bp, Rattus norvegicus
ggcttggcaattgtccgttgtgatt

SEQ ID NO: 505204 - DNA, 25 bp, Rattus norvegicus
ggcaattgtccgttgtgattggcta

SEQ ID NO: 505205 - DNA, 25 bp, Rattus norvegicus
ttgtgattggctagatcctcgggcg

SEQ ID NO: 505206 - DNA, 25 bp, Rattus norvegicus
cgtggagaaaggagccagcacttgc

SEQ ID NO: 505207 - DNA, 25 bp, Rattus norvegicus
cttttattggctctcgcgcaggtcc

SEQ ID NO: 505208 - DNA, 25 bp, Rattus norvegicus
agtcgagggccctcacgtgacgcga

SEQ ID NO: 505209 - DNA, 25 bp, Rattus norvegicus
agggccctcacgtgacgcgacggct

SEQ ID NO: 505210 - DNA, 25 bp, Rattus norvegicus
ggcggagtacggaccgctcctcgca

SEQ ID NO: 505211 - DNA, 25 bp, Rattus norvegicus
gaccgctcctcgcagggagctagga

SEQ ID NO: 505212 - DNA, 25 bp, Rattus norvegicus
aggagccagcacttgcttttattgg

SEQ ID NO: 505213 - DNA, 25 bp, Rattus norvegicus
gtggtagcagccagcgccttgaaaa

SEQ ID NO: 505214 - DNA, 25 bp, Rattus norvegicus
tggtccctctgcaggaaagagaagc

SEQ ID NO: 505215 - DNA, 25 bp, Rattus norvegicus
agagggcccaaaccttcaactactg

SEQ ID NO: 505216 - DNA, 25 bp, Rattus norvegicus
tccgcaggaggcctgtctctttaag

SEQ ID NO: 505217 - DNA, 25 bp, Rattus norvegicus
tgtctctttaaggaggcggccctga

SEQ ID NO: 505218 - DNA, 25 bp, Rattus norvegicus
cgccctaggttgtcaggctgagacc

SEQ ID NO: 505219 - DNA, 25 bp, Rattus norvegicus
agccacctcgccagcagaaacggga

SEQ ID NO: 505220 - DNA, 25 bp, Rattus norvegicus
tggtcgccagttccagttctcctga

SEQ ID NO: 505221 - DNA, 25 bp, Rattus norvegicus
tctgagtactctgcgtagtaagcgc

SEQ ID NO: 505222 - DNA, 25 bp, Rattus norvegicus
tcgcccaaggcgtgtggacttcact

SEQ ID NO: 505223 - DNA, 25 bp, Rattus norvegicus
ttggggttcaccttcccaatgcgcc

SEQ ID NO: 505224 - DNA, 25 bp, Rattus norvegicus
ctcgcgcggcaacagaaacttgagg

SEQ ID NO: 505225 - DNA, 25 bp, Rattus norvegicus
ggctagcgaagctcacacagggttc

SEQ ID NO: 505226 - DNA, 25 bp, Rattus norvegicus
cgtagtaagcgcaacccagagggcc

SEQ ID NO: 505227 - DNA, 25 bp, Rattus norvegicus
tgtgcttctcgccttagggagctta

SEQ ID NO: 505228 - DNA, 25 bp, Rattus norvegicus
gtgagacgcatctacttccgggttg

SEQ ID NO: 505229 - DNA, 25 bp, Rattus norvegicus
ttcaacaatttctccgcggcgacgg

SEQ ID NO: 505230 - DNA, 25 bp, Rattus norvegicus
cgggatctcaccattcctaggctgc

SEQ ID NO: 505231 - DNA, 25 bp, Rattus norvegicus
acactaggagacgaaccgcgggatc

SEQ ID NO: 505232 - DNA, 25 bp, Rattus norvegicus
tctattccggttcgtcctggacgcg

SEQ ID NO: 505233 - DNA, 25 bp, Rattus norvegicus
ctgcgcgccctagtggaaaccattt

SEQ ID NO: 505234 - DNA, 25 bp, Rattus norvegicus
tgcccggttggcaaaagcgcatagg

SEQ ID NO: 505235 - DNA, 25 bp, Rattus norvegicus
ttgtgtgacacaacccaggcgacgc

SEQ ID NO: 505236 - DNA, 25 bp, Rattus norvegicus
tgcgcagatttttcggggcgatacc

SEQ ID NO: 505237 - DNA, 25 bp, Rattus norvegicus
ctaggctgccagcttcaacaatttc

SEQ ID NO: 505238 - DNA, 25 bp, Rattus norvegicus
ggccaggttctagccgatcggattt

SEQ ID NO: 505239 - DNA, 25 bp, Rattus norvegicus
ccgatcggatttacgcatgcgcaga

SEQ ID NO: 505240 - DNA, 25 bp, Rattus norvegicus
gcggcacattgggaaactccacttc

SEQ ID NO: 505241 - DNA, 25 bp, Rattus norvegicus
ccaaagccggcttccgtgagacgca

SEQ ID NO: 505242 - DNA, 25 bp, Rattus norvegicus
tcagagctgtttttactggcgagtg

SEQ ID NO: 505243 - DNA, 25 bp, Rattus norvegicus
tttttactggcgagtgggccgagcc

SEQ ID NO: 505244 - DNA, 25 bp, Rattus norvegicus
tcctcggcgaaagccaccggagccc

SEQ ID NO: 505245 - DNA, 25 bp, Rattus norvegicus
tgaggctctggcatggtaacgtccc

SEQ ID NO: 505246 - DNA, 25 bp, Rattus norvegicus
gtgaaccgccgtgttgctcaacgca

SEQ ID NO: 505247 - DNA, 25 bp, Rattus norvegicus
gagccggcccagctgctctgaggct

SEQ ID NO: 505248 - DNA, 25 bp, Rattus norvegicus
ccggccaatcagagctgtttttact

SEQ ID NO: 505249 - DNA, 25 bp, Rattus norvegicus
ttgagggttccgctcctcggcgaaa

SEQ ID NO: 505250 - DNA, 25 bp, Rattus norvegicus
tctgcgtgaccagcgcgcggtcagt

SEQ ID NO: 505251 - DNA, 25 bp, Rattus norvegicus
actgtgacccgggagatccacgccg

SEQ ID NO: 505252 - DNA, 25 bp, Rattus norvegicus
atgaacggctcggtcccctcagtgt

SEQ ID NO: 505253 - DNA, 25 bp, Rattus norvegicus
aacgcaagggcggaatgaacggctc

SEQ ID NO: 505254 - DNA, 25 bp, Rattus norvegicus
tgttgctcaacgcaagggcggaatg

SEQ ID NO: 505255 - DNA, 25 bp, Rattus norvegicus
ctgctctgaggctctggcatggtaa

SEQ ID NO: 505256 - DNA, 25 bp, Rattus norvegicus
agcgccggtctcaccagcactaggg

SEQ ID NO: 505257 - DNA, 25 bp, Rattus norvegicus
ggccctcagcagctccgacctggct

SEQ ID NO: 505258 - DNA, 25 bp, Rattus norvegicus
cgaagcgctcgacgcgctgaagcgc

SEQ ID NO: 505259 - DNA, 25 bp, Rattus norvegicus
ctgaagcgcgccttattcatgcagg

SEQ ID NO: 505260 - DNA, 25 bp, Rattus norvegicus
gcgcgccttattcatgcaggccacg

SEQ ID NO: 505261 - DNA, 25 bp, Rattus norvegicus
gacagccgcgcctcccaatcacaga

SEQ ID NO: 505262 - DNA, 25 bp, Rattus norvegicus
atcacagagcctcccgccctcagag

SEQ ID NO: 505263 - DNA, 25 bp, Rattus norvegicus
cccggtcaggcatagacagggctgc

SEQ ID NO: 505264 - DNA, 25 bp, Rattus norvegicus
tcccgggaatggaattcgggcagcg

SEQ ID NO: 505265 - DNA, 25 bp, Rattus norvegicus
cgtcggtgctctccaggttgcccat

SEQ ID NO: 505266 - DNA, 25 bp, Rattus norvegicus
acggctcgggcatcggcgtcttgcc

SEQ ID NO: 505267 - DNA, 25 bp, Rattus norvegicus
gtgctctccaggttgcccatcgcgg

SEQ ID NO: 505268 - DNA, 25 bp, Rattus norvegicus
ctagggcgaatctctcttccagctc

SEQ ID NO: 505269 - DNA, 25 bp, Rattus norvegicus
tcaccagcactagggcgaatctctc

SEQ ID NO: 505270 - DNA, 25 bp, Rattus norvegicus
cccggttaggcagactgccctgtca

SEQ ID NO: 505271 - DNA, 25 bp, Rattus norvegicus
ggctaagaaggtacgtgcgaagcta

SEQ ID NO: 505272 - DNA, 25 bp, Rattus norvegicus
tgcgaagctaggatcgggcaagcct

SEQ ID NO: 505273 - DNA, 25 bp, Rattus norvegicus
ttccgctttcggatagatcagctcc

SEQ ID NO: 505274 - DNA, 25 bp, Rattus norvegicus
gatcagctccttagggaacccggcc

SEQ ID NO: 505275 - DNA, 25 bp, Rattus norvegicus
ccggcctactctgcgtcgagatcga

SEQ ID NO: 505276 - DNA, 25 bp, Rattus norvegicus
gaaggcctcttagcgaccctcgctt

SEQ ID NO: 505277 - DNA, 25 bp, Rattus norvegicus
tcagccgagttgagggcttgaattc

SEQ ID NO: 505278 - DNA, 25 bp, Rattus norvegicus
tacttagaagccaacggtagaggcc

SEQ ID NO: 505279 - DNA, 25 bp, Rattus norvegicus
tcactcctgactttgaggtaaacga

SEQ ID NO: 505280 - DNA, 25 bp, Rattus norvegicus
cgggctaggtgatgtcacacttctc

SEQ ID NO: 505281 - DNA, 25 bp, Rattus norvegicus
cacttctctgtgacacgcgagattc

SEQ ID NO: 505282 - DNA, 25 bp, Rattus norvegicus
acgcgagattccttagttacttaga

SEQ ID NO: 505283 - DNA, 25 bp, Rattus norvegicus
ttcgggacaggtccctcactcctga

SEQ ID NO: 505284 - DNA, 25 bp, Rattus norvegicus
gctcagccaatccaggctcagcatg

SEQ ID NO: 505285 - DNA, 25 bp, Rattus norvegicus
aggacgagagctaagtctgcccggc

SEQ ID NO: 505286 - DNA, 25 bp, Rattus norvegicus
gtccgcagggtccatggccgcatct

SEQ ID NO: 505287 - DNA, 25 bp, Rattus norvegicus
tgtcaaggctttaaaggggccaatg

SEQ ID NO: 505288 - DNA, 25 bp, Rattus norvegicus
accggagccgcctcttgatgtcaag

SEQ ID NO: 505289 - DNA, 25 bp, Rattus norvegicus
cttaccgaaatcaggtgctgggttc

SEQ ID NO: 505290 - DNA, 25 bp, Rattus norvegicus
tgccaaacaggcctgaacttaccga

SEQ ID NO: 505291 - DNA, 25 bp, Rattus norvegicus
tcacagcccgttaaatgccaaacag

SEQ ID NO: 505292 - DNA, 25 bp, Rattus norvegicus
aagctgccacgagagcctttcgctc

SEQ ID NO: 505293 - DNA, 25 bp, Rattus norvegicus
ccttccagtcaaagctgccacgaga

SEQ ID NO: 505294 - DNA, 25 bp, Rattus norvegicus
tgctttcaaagagggagggacaccc

SEQ ID NO: 505295 - DNA, 25 bp, Rattus norvegicus
ggggcaaggtcagtgctttcaaaga

SEQ ID NO: 505296 - DNA, 25 bp, Rattus norvegicus
ccacagagactggaaggagtgcgaa

SEQ ID NO: 505297 - DNA, 25 bp, Rattus norvegicus
ccagatgttcccaggacgagagcta

SEQ ID NO: 505298 - DNA, 25 bp, Rattus norvegicus
cactcttccgttccttcaagaaaag

SEQ ID NO: 505299 - DNA, 25 bp, Rattus norvegicus
aaagaaggcgacctgccaccacggg

SEQ ID NO: 505300 - DNA, 25 bp, Rattus norvegicus
caccgccaagtatgcgaactactca

SEQ ID NO: 505301 - DNA, 25 bp, Rattus norvegicus
tatgcgaactactcaccgggtgatg

SEQ ID NO: 505302 - DNA, 25 bp, Rattus norvegicus
tactcaccgggtgatggccctggcc

SEQ ID NO: 505303 - DNA, 25 bp, Rattus norvegicus
aacgaaactgaaactttgcctctcg

SEQ ID NO: 505304 - DNA, 25 bp, Rattus norvegicus
gacgcgccttctctctgtcctggtt

SEQ ID NO: 505305 - DNA, 25 bp, Rattus norvegicus
ctctctgtcctggttgtgcagcacc

SEQ ID NO: 505306 - DNA, 25 bp, Rattus norvegicus
gcgagccagacgcagccagccatgg

SEQ ID NO: 505307 - DNA, 25 bp, Rattus norvegicus
actcgtaaggctgccggagtccatc

SEQ ID NO: 505308 - DNA, 25 bp, Rattus norvegicus
aggcggggagtgctctgttcatccc

SEQ ID NO: 505309 - DNA, 25 bp, Rattus norvegicus
ccctggccgactgcagagcaagaga

SEQ ID NO: 505310 - DNA, 25 bp, Rattus norvegicus
ccgagcgcacatgaagctggagata

SEQ ID NO: 505311 - DNA, 25 bp, Rattus norvegicus
aactttgcctctcgggtctctgggg

SEQ ID NO: 505312 - DNA, 25 bp, Rattus norvegicus
gactccgatccctcccgcgtcactc

SEQ ID NO: 505313 - DNA, 25 bp, Rattus norvegicus
cgcctaggatagagatcggaaacac

SEQ ID NO: 505314 - DNA, 25 bp, Rattus norvegicus
cccaggccagcaccgactccgatcc

SEQ ID NO: 505315 - DNA, 25 bp, Rattus norvegicus
ccacgtcgagccctaggatcggcct

SEQ ID NO: 505316 - DNA, 25 bp, Rattus norvegicus
aggatcggcctcctctcgggaccct

SEQ ID NO: 505317 - DNA, 25 bp, Rattus norvegicus
agggaagagctgtcgaagaagctcc

SEQ ID NO: 505318 - DNA, 25 bp, Rattus norvegicus
atgagggaaatttccgaacggcgcg

SEQ ID NO: 505319 - DNA, 25 bp, Rattus norvegicus
caggcttcaaagctgccgggtcgtc

SEQ ID NO: 505320 - DNA, 25 bp, Rattus norvegicus
aaagctgccgggtcgtcttcctcca

SEQ ID NO: 505321 - DNA, 25 bp, Rattus norvegicus
tttggacaattcctgggttgccgcc

SEQ ID NO: 505322 - DNA, 25 bp, Rattus norvegicus
acaattcctgggttgccgccatcac

SEQ ID NO: 505323 - DNA, 25 bp, Rattus norvegicus
gagcggaaccggaagtctggagcct

SEQ ID NO: 505324 - DNA, 25 bp, Rattus norvegicus
cgcgcgtgcgcctaggatagagatc

SEQ ID NO: 505325 - DNA, 25 bp, Rattus norvegicus
gaattttgaagccacgcccaggcca

SEQ ID NO: 505326 - DNA, 25 bp, Rattus norvegicus
caggcttagcggagcgtaccatccg

SEQ ID NO: 505327 - DNA, 25 bp, Rattus norvegicus
gacatgcgctttgacctcctctgcg

SEQ ID NO: 505328 - DNA, 25 bp, Rattus norvegicus
cgggcaagacatgcgctttgacctc

SEQ ID NO: 505329 - DNA, 25 bp, Rattus norvegicus
cctgagagcgggcaagacatgcgct

SEQ ID NO: 505330 - DNA, 25 bp, Rattus norvegicus
cggagcgtaccatccgcacacgggg

SEQ ID NO: 505331 - DNA, 25 bp, Rattus norvegicus
ggtcatggtgtcgtctctcgaggaa

SEQ ID NO: 505332 - DNA, 25 bp, Rattus norvegicus
ctgcaacccggccaggcttagcgga

SEQ ID NO: 505333 - DNA, 25 bp, Rattus norvegicus
ggattctagcaacatccactgcaac

SEQ ID NO: 505334 - DNA, 25 bp, Rattus norvegicus
cctccgcgtggattctagcaacatc

SEQ ID NO: 505335 - DNA, 25 bp, Rattus norvegicus
gcgtctcttctttcctccgcgtgga

SEQ ID NO: 505336 - DNA, 25 bp, Rattus norvegicus
gtggccgcttgggtcaccgcagcct

SEQ ID NO: 505337 - DNA, 25 bp, Rattus norvegicus
ctttccctgggtcatggtgtcgtct

SEQ ID NO: 505338 - DNA, 25 bp, Rattus norvegicus
tctctcgaggaaggggtccctgaag

SEQ ID NO: 505339 - DNA, 25 bp, Rattus norvegicus
cggacgcaggatgctgcggacctga

SEQ ID NO: 505340 - DNA, 25 bp, Rattus norvegicus
ggtggagctccactctcctcagagc

SEQ ID NO: 505341 - DNA, 25 bp, Rattus norvegicus
cccttgcagggaaccagacacttgg

SEQ ID NO: 505342 - DNA, 25 bp, Rattus norvegicus
cggaagccttgagctaccctcgagc

SEQ ID NO: 505343 - DNA, 25 bp, Rattus norvegicus
agcctgacagtacctccgcccggaa

SEQ ID NO: 505344 - DNA, 25 bp, Rattus norvegicus
ggctcgcccgggagcctgacagtac

SEQ ID NO: 505345 - DNA, 25 bp, Rattus norvegicus
tgagcctcaagaaggggctcgcccg

SEQ ID NO: 505346 - DNA, 25 bp, Rattus norvegicus
agcgagtgcagtgagcctcaagaag

SEQ ID NO: 505347 - DNA, 25 bp, Rattus norvegicus
agtagctgctccagcgagtgcagtg

SEQ ID NO: 505348 - DNA, 25 bp, Rattus norvegicus
tcggttcccagtgcagagtagctgc

SEQ ID NO: 505349 - DNA, 25 bp, Rattus norvegicus
acccgtcgtcggttcccagtgcaga

SEQ ID NO: 505350 - DNA, 25 bp, Rattus norvegicus
tcagagcctgcctcgcggcagcaag

SEQ ID NO: 505351 - DNA, 25 bp, Rattus norvegicus
gaaccagacacttggggaccgaggc

SEQ ID NO: 505352 - DNA, 25 bp, Rattus norvegicus
cggcagtcggtggagctccactctc

SEQ ID NO: 505353 - DNA, 25 bp, Rattus norvegicus
tgcctcgcggcagcaaggcctgagc

SEQ ID NO: 505354 - DNA, 25 bp, Rattus norvegicus
gggagaggcccacaatggccgaacc

SEQ ID NO: 505355 - DNA, 25 bp, Rattus norvegicus
tgagcgcacgatgcgcgcgacccag

SEQ ID NO: 505356 - DNA, 25 bp, Rattus norvegicus
cggagagccaggaccgcgctcagca

SEQ ID NO: 505357 - DNA, 25 bp, Rattus norvegicus
acttccagagctctgtgggagcgga

SEQ ID NO: 505358 - DNA, 25 bp, Rattus norvegicus
gccggagacggacttccagagctct

SEQ ID NO: 505359 - DNA, 25 bp, Rattus norvegicus
caagatgctcgggtcgcgcgagcca

SEQ ID NO: 505360 - DNA, 25 bp, Rattus norvegicus
aatcgcatcactctggccgggccga

SEQ ID NO: 505361 - DNA, 25 bp, Rattus norvegicus
ctgtcctcagagaatcgcatcactc

SEQ ID NO: 505362 - DNA, 25 bp, Rattus norvegicus
tgccattaggctggcattgcgctcc

SEQ ID NO: 505363 - DNA, 25 bp, Rattus norvegicus
ttgggagctaagaggcgctgtcctc

SEQ ID NO: 505364 - DNA, 25 bp, Rattus norvegicus
ttaggctggcattgcgctcccgacc

SEQ ID NO: 505365 - DNA, 25 bp, Rattus norvegicus
ttacaccgccgcgtgggtcacgtgg

SEQ ID NO: 505366 - DNA, 25 bp, Rattus norvegicus
taagaggcgctgtcctcagagaatc

SEQ ID NO: 505367 - DNA, 25 bp, Rattus norvegicus
cggcgtcgaggattgccattaggct

SEQ ID NO: 505368 - DNA, 25 bp, Rattus norvegicus
gggacggtggccacaatgtgcaata

SEQ ID NO: 505369 - DNA, 25 bp, Rattus norvegicus
tgccaggcagacctcggggcatcct

SEQ ID NO: 505370 - DNA, 25 bp, Rattus norvegicus
cacccgactctgtcaggaagcaata

SEQ ID NO: 505371 - DNA, 25 bp, Rattus norvegicus
tcaggaagcaataccgggtccggtc

SEQ ID NO: 505372 - DNA, 25 bp, Rattus norvegicus
gtgtcaccgcatgaactcgctggga

SEQ ID NO: 505373 - DNA, 25 bp, Rattus norvegicus
tgctggcctggtcgcaaccagtttt

SEQ ID NO: 505374 - DNA, 25 bp, Rattus norvegicus
ataaacacttacacgggccggcagc

SEQ ID NO: 505375 - DNA, 25 bp, Rattus norvegicus
gtacttctggactctcctcttgggg

SEQ ID NO: 505376 - DNA, 25 bp, Rattus norvegicus
ggctcccggctcctgtacttctgga

SEQ ID NO: 505377 - DNA, 25 bp, Rattus norvegicus
aaccagttttagttgagaagccatg

SEQ ID NO: 505378 - DNA, 25 bp, Rattus norvegicus
gggtgtcgtttctagccagctacct

SEQ ID NO: 505379 - DNA, 25 bp, Rattus norvegicus
gctacctcggtaactccaattcatt

SEQ ID NO: 505380 - DNA, 25 bp, Rattus norvegicus
atgtgcaataacgtggtgtcccggg

SEQ ID NO: 505381 - DNA, 25 bp, Rattus norvegicus
gccgctgcccgttccagaagggact

SEQ ID NO: 505382 - DNA, 25 bp, Rattus norvegicus
caagaccaccttgagggaaccacac

SEQ ID NO: 505383 - DNA, 25 bp, Rattus norvegicus
agagttcgccaagaccaccttgagg

SEQ ID NO: 505384 - DNA, 25 bp, Rattus norvegicus
tacattagcgagacgccgaaagacg

SEQ ID NO: 505385 - DNA, 25 bp, Rattus norvegicus
tcgggccacgcctcaaaaggacgct

SEQ ID NO: 505386 - DNA, 25 bp, Rattus norvegicus
aaggacgctcccgacttaacgcgca

SEQ ID NO: 505387 - DNA, 25 bp, Rattus norvegicus
tgcgcgcctcactaacggcagtgta

SEQ ID NO: 505388 - DNA, 25 bp, Rattus norvegicus
ggcagtgtaaaaccgcgccgccgga

SEQ ID NO: 505389 - DNA, 25 bp, Rattus norvegicus
gcgccgccggatccggttcaaaatc

SEQ ID NO: 505390 - DNA, 25 bp, Rattus norvegicus
ccggttcaaaatcgcgcagcagcca

SEQ ID NO: 505391 - DNA, 25 bp, Rattus norvegicus
tcacagaggagatcatgctctgggc

SEQ ID NO: 505392 - DNA, 25 bp, Rattus norvegicus
atgctctgggcgacgcacgtgttag

SEQ ID NO: 505393 - DNA, 25 bp, Rattus norvegicus
caaaacgggaagagcgtgcgcatta

SEQ ID NO: 505394 - DNA, 25 bp, Rattus norvegicus
cgtgcgcattacattagcgagacgc

SEQ ID NO: 505395 - DNA, 25 bp, Rattus norvegicus
cgtcccgcactagagttcgccaaga

SEQ ID NO: 505396 - DNA, 25 bp, Rattus norvegicus
ggacgccagcccagcacaggggccc

SEQ ID NO: 505397 - DNA, 25 bp, Rattus norvegicus
ctaaggactaactgatggaaggaaa

SEQ ID NO: 505398 - DNA, 25 bp, Rattus norvegicus
ctggctaggaacagctccgagaccc

SEQ ID NO: 505399 - DNA, 25 bp, Rattus norvegicus
attgtgcctggctaggaacagctcc

SEQ ID NO: 505400 - DNA, 25 bp, Rattus norvegicus
gcagcggactggagaagtcctgcta

SEQ ID NO: 505401 - DNA, 25 bp, Rattus norvegicus
ttgcgccttccacaggcgccggtta

SEQ ID NO: 505402 - DNA, 25 bp, Rattus norvegicus
gggcgctgagattgcgccttccaca

SEQ ID NO: 505403 - DNA, 25 bp, Rattus norvegicus
gccctgggcgctgagattgcgcctt

SEQ ID NO: 505404 - DNA, 25 bp, Rattus norvegicus
tcccagccctatgaattattcaccg

SEQ ID NO: 505405 - DNA, 25 bp, Rattus norvegicus
aggaaaacacgcacccgggcgcgcg

SEQ ID NO: 505406 - DNA, 25 bp, Rattus norvegicus
gtcgagataaagcagagagccgagg

SEQ ID NO: 505407 - DNA, 25 bp, Rattus norvegicus
ctgatggaaggaaaggaaaacacgc

SEQ ID NO: 505408 - DNA, 25 bp, Rattus norvegicus
atgaattattcaccgcctctgcctc

SEQ ID NO: 505409 - DNA, 25 bp, Rattus norvegicus
agcgccctaaggactaactgatgga

SEQ ID NO: 505410 - DNA, 25 bp, Rattus norvegicus
cagatcccggggctgagagcaccgc

SEQ ID NO: 505411 - DNA, 25 bp, Rattus norvegicus
acaactggctgtcatagggaaccgc

SEQ ID NO: 505412 - DNA, 25 bp, Rattus norvegicus
tctgactgcgacgagaagctggact

SEQ ID NO: 505413 - DNA, 25 bp, Rattus norvegicus
cgggaatctgactgcgacgagaagc

SEQ ID NO: 505414 - DNA, 25 bp, Rattus norvegicus
gccgagccgggaatctgactgcgac

SEQ ID NO: 505415 - DNA, 25 bp, Rattus norvegicus
ctccctgcagggctctacgcgggtg

SEQ ID NO: 505416 - DNA, 25 bp, Rattus norvegicus
ctggctgtcatagggaaccgcgccc

SEQ ID NO: 505417 - DNA, 25 bp, Rattus norvegicus
gacgatggatccctgcagatcccgg

SEQ ID NO: 505418 - DNA, 25 bp, Rattus norvegicus
gccggacgatggatccctgcagatc

SEQ ID NO: 505419 - DNA, 25 bp, Rattus norvegicus
tcgcagacactcgtaggcgcgcacg

SEQ ID NO: 505420 - DNA, 25 bp, Rattus norvegicus
gagacaccctcgcagacactcgtag

SEQ ID NO: 505421 - DNA, 25 bp, Rattus norvegicus
cgcacaccggcccagagacaccctc

SEQ ID NO: 505422 - DNA, 25 bp, Rattus norvegicus
ctccaggatccgaggcgaggcagct

SEQ ID NO: 505423 - DNA, 25 bp, Rattus norvegicus
gcgccctgaagcctagactctgctc

SEQ ID NO: 505424 - DNA, 25 bp, Rattus norvegicus
tggcgctcagcctggatgacgtcaa

SEQ ID NO: 505425 - DNA, 25 bp, Rattus norvegicus
caaaagacacgtgagggagcaaggc

SEQ ID NO: 505426 - DNA, 25 bp, Rattus norvegicus
ctccacgccgcctttttgcccgcaa

SEQ ID NO: 505427 - DNA, 25 bp, Rattus norvegicus
gttcccgtcttatgtccctctgtta

SEQ ID NO: 505428 - DNA, 25 bp, Rattus norvegicus
tgtccctctgttagaatccctgcga

SEQ ID NO: 505429 - DNA, 25 bp, Rattus norvegicus
gttagaatccctgcgagagcctccg

SEQ ID NO: 505430 - DNA, 25 bp, Rattus norvegicus
agagcctccgaggacatcctgccgg

SEQ ID NO: 505431 - DNA, 25 bp, Rattus norvegicus
ctccgaggacatcctgccgggatga

SEQ ID NO: 505432 - DNA, 25 bp, Rattus norvegicus
ccgggatgacgtacgctgccaacat

SEQ ID NO: 505433 - DNA, 25 bp, Rattus norvegicus
cctggatgacgtcaaaagacacgtg

SEQ ID NO: 505434 - DNA, 25 bp, Rattus norvegicus
accatcccgctcgaggcacgtttga

SEQ ID NO: 505435 - DNA, 25 bp, Rattus norvegicus
tcgaggcacgtttgaggactttacc

SEQ ID NO: 505436 - DNA, 25 bp, Rattus norvegicus
ggactttacctgctaagccctcgca

SEQ ID NO: 505437 - DNA, 25 bp, Rattus norvegicus
atgacgtacgctgccaacatcctac

SEQ ID NO: 505438 - DNA, 25 bp, Rattus norvegicus
tccggttctttgtgcagctgcagcg

SEQ ID NO: 505439 - DNA, 25 bp, Rattus norvegicus
ggccgaggtgaagcatcactccagc

SEQ ID NO: 505440 - DNA, 25 bp, Rattus norvegicus
ggtgaagcatcactccagccgcctg

SEQ ID NO: 505441 - DNA, 25 bp, Rattus norvegicus
ggctctttgcaaggccttgacgtcc

SEQ ID NO: 505442 - DNA, 25 bp, Rattus norvegicus
tttatcagcacaccgcctctctatg

SEQ ID NO: 505443 - DNA, 25 bp, Rattus norvegicus
atggtgctccctcctggcccgtgaa

SEQ ID NO: 505444 - DNA, 25 bp, Rattus norvegicus
agggagtggtcagcacgcctttccc

SEQ ID NO: 505445 - DNA, 25 bp, Rattus norvegicus
tggtcagcacgcctttcccgctagt

SEQ ID NO: 505446 - DNA, 25 bp, Rattus norvegicus
cctctagcccgtagtctcgctgccc

SEQ ID NO: 505447 - DNA, 25 bp, Rattus norvegicus
tccggttccggttctttgtgcagct

SEQ ID NO: 505448 - DNA, 25 bp, Rattus norvegicus
gtcaagggctgtaccgctctccgat

SEQ ID NO: 505449 - DNA, 25 bp, Rattus norvegicus
gcgggtttccagtccgtggctccga

SEQ ID NO: 505450 - DNA, 25 bp, Rattus norvegicus
aactcccgggcctcccgtgcgaatg

SEQ ID NO: 505451 - DNA, 25 bp, Rattus norvegicus
ggcccacaaacagcccaggcgctcg

SEQ ID NO: 505452 - DNA, 25 bp, Rattus norvegicus
ccagagccggaagaaatctggagga

SEQ ID NO: 505453 - DNA, 25 bp, Rattus norvegicus
ggtcccttcccgctgctggtcgagg

SEQ ID NO: 505454 - DNA, 25 bp, Rattus norvegicus
ttcccgctgctggtcgagggctctt

SEQ ID NO: 505455 - DNA, 25 bp, Rattus norvegicus
cccgaagaacttgatcaacaagttg

SEQ ID NO: 505456 - DNA, 25 bp, Rattus norvegicus
gatcaacaagttgcaaatgtacttc

SEQ ID NO: 505457 - DNA, 25 bp, Rattus norvegicus
ttgcaaatgtacttccagagccgga

SEQ ID NO: 505458 - DNA, 25 bp, Rattus norvegicus
caaatgtacttccagagccggaaga

SEQ ID NO: 505459 - DNA, 25 bp, Rattus norvegicus
cttccagagccggaagaaatctgga

SEQ ID NO: 505460 - DNA, 25 bp, Rattus norvegicus
agcccgggaacccagcacgcttcct

SEQ ID NO: 505461 - DNA, 25 bp, Rattus norvegicus
tcctggtgctcttctccccggagga

SEQ ID NO: 505462 - DNA, 25 bp, Rattus norvegicus
ctcttctccccggaggatggtgagg

SEQ ID NO: 505463 - DNA, 25 bp, Rattus norvegicus
gcggcaggcccagttctcggctgca

SEQ ID NO: 505464 - DNA, 25 bp, Rattus norvegicus
aggcccagttctcggctgcaggagc

SEQ ID NO: 505465 - DNA, 25 bp, Rattus norvegicus
tgtacttccagagccggaagaaatc

SEQ ID NO: 505466 - DNA, 25 bp, Rattus norvegicus
aatcgctctgacgaggccgagttgc

SEQ ID NO: 505467 - DNA, 25 bp, Rattus norvegicus
gcgcgactctgactgagcaggaatc

SEQ ID NO: 505468 - DNA, 25 bp, Rattus norvegicus
tctgcctttctctgttgcggtcgcg

SEQ ID NO: 505469 - DNA, 25 bp, Rattus norvegicus
cgcaccgtgttggtgtctgcctttc

SEQ ID NO: 505470 - DNA, 25 bp, Rattus norvegicus
gtcaccagtgtctgaggcgcaccgt

SEQ ID NO: 505471 - DNA, 25 bp, Rattus norvegicus
ctctctccttagtgggcgagttttc

SEQ ID NO: 505472 - DNA, 25 bp, Rattus norvegicus
aatcggaagttcaaggctggctctc

SEQ ID NO: 505473 - DNA, 25 bp, Rattus norvegicus
ttccgagaggaagactagactgagc

SEQ ID NO: 505474 - DNA, 25 bp, Rattus norvegicus
gcgcatttgctggagcagaaccaca

SEQ ID NO: 505475 - DNA, 25 bp, Rattus norvegicus
tccggttttccaaggagcgcatttg

SEQ ID NO: 505476 - DNA, 25 bp, Rattus norvegicus
ctgcggattggctgattttgagcta

SEQ ID NO: 505477 - DNA, 25 bp, Rattus norvegicus
gcaactgatcgtagactgcggattg

SEQ ID NO: 505478 - DNA, 25 bp, Rattus norvegicus
cgaggatctacctagctacagttta

SEQ ID NO: 505479 - DNA, 25 bp, Rattus norvegicus
ccagaattcaatgggcctttccgag

SEQ ID NO: 505480 - DNA, 25 bp, Rattus norvegicus
cgctcgaacagcatcctcacggaga

SEQ ID NO: 505481 - DNA, 25 bp, Rattus norvegicus
gaacaccgacagcacgtgccgggcg

SEQ ID NO: 505482 - DNA, 25 bp, Rattus norvegicus
gctccgagcatcctcgccgcggccc

SEQ ID NO: 505483 - DNA, 25 bp, Rattus norvegicus
ccacaggaggcccagggcttccgcc

SEQ ID NO: 505484 - DNA, 25 bp, Rattus norvegicus
aagagacctgctgccagcgggaaca

SEQ ID NO: 505485 - DNA, 25 bp, Rattus norvegicus
tcctcacggagaagagacctgctgc

SEQ ID NO: 505486 - DNA, 25 bp, Rattus norvegicus
ctacggccaccctcttccgtcctcg

SEQ ID NO: 505487 - DNA, 25 bp, Rattus norvegicus
cgccgcagtcgccatcttacgcgcg

SEQ ID NO: 505488 - DNA, 25 bp, Rattus norvegicus
gctagcccgtttcgtcttggccacg

SEQ ID NO: 505489 - DNA, 25 bp, Rattus norvegicus
tctgaggcagccagaagcgcccgct

SEQ ID NO: 505490 - DNA, 25 bp, Rattus norvegicus
cagctcacgttctgaggcagccaga

SEQ ID NO: 505491 - DNA, 25 bp, Rattus norvegicus
ccgggccctccaggtccgcccagct

SEQ ID NO: 505492 - DNA, 25 bp, Rattus norvegicus
ccagcgggaacaccgacagcacgtg

SEQ ID NO: 505493 - DNA, 25 bp, Rattus norvegicus
gccaaggcaaaaagaacccgctgga

SEQ ID NO: 505494 - DNA, 25 bp, Rattus norvegicus
gcttgcgccatttcctataaaactc

SEQ ID NO: 505495 - DNA, 25 bp, Rattus norvegicus
ggctcctctccttcagggacgaaga

SEQ ID NO: 505496 - DNA, 25 bp, Rattus norvegicus
gtcgtcttcagctatgcttgcgcca

SEQ ID NO: 505497 - DNA, 25 bp, Rattus norvegicus
tctcactctccagctcaaaagaacg

SEQ ID NO: 505498 - DNA, 25 bp, Rattus norvegicus
actcgggttctaatggagaccgctg

SEQ ID NO: 505499 - DNA, 25 bp, Rattus norvegicus
agctcaaaagaacgaccgtccctgc

SEQ ID NO: 505500 - DNA, 25 bp, Rattus norvegicus
gcttcctcgctctgccagcgtgatt

SEQ ID NO: 505501 - DNA, 25 bp, Rattus norvegicus
cgcgacagtaaacgggcggctcctc

SEQ ID NO: 505502 - DNA, 25 bp, Rattus norvegicus
tgccagcgtgattttcccacactct

SEQ ID NO: 505503 - DNA, 25 bp, Rattus norvegicus
tctccttctcccgagagggcctggg

SEQ ID NO: 505504 - DNA, 25 bp, Rattus norvegicus
gggctttccgtttgtgtcactgtcc

SEQ ID NO: 505505 - DNA, 25 bp, Rattus norvegicus
ggctcttgaccgaggaggttcgaaa

SEQ ID NO: 505506 - DNA, 25 bp, Rattus norvegicus
ggttcgaaaggaagccgcgacagta

SEQ ID NO: 505507 - DNA, 25 bp, Rattus norvegicus
caacccttcctgagggacggcgaca

SEQ ID NO: 505508 - DNA, 25 bp, Rattus norvegicus
ttgcacggccacagtcctgcgctct

SEQ ID NO: 505509 - DNA, 25 bp, Rattus norvegicus
gcggcgtgtacaactcgtgaccgta

SEQ ID NO: 505510 - DNA, 25 bp, Rattus norvegicus
gggctccgcgttgcacggccacagt

SEQ ID NO: 505511 - DNA, 25 bp, Rattus norvegicus
gtcgcaactgggctgcagcacctac

SEQ ID NO: 505512 - DNA, 25 bp, Rattus norvegicus
gagaggaggcgcttacctgcttaca

SEQ ID NO: 505513 - DNA, 25 bp, Rattus norvegicus
tccgcgcgcacacaagctgcggagg

SEQ ID NO: 505514 - DNA, 25 bp, Rattus norvegicus
ttacctgcttacaagccgtcggggc

SEQ ID NO: 505515 - DNA, 25 bp, Rattus norvegicus
cagcgcacctgtcgcaactgggctg

SEQ ID NO: 505516 - DNA, 25 bp, Rattus norvegicus
tgcagcacctacagctccgcggccc

SEQ ID NO: 505517 - DNA, 25 bp, Rattus norvegicus
gctcccggcggcgtgtacaactcgt

SEQ ID NO: 505518 - DNA, 25 bp, Rattus norvegicus
gtgtacaactcgtgaccgtagcgta

SEQ ID NO: 505519 - DNA, 25 bp, Rattus norvegicus
aactcgtgaccgtagcgtagcccta

SEQ ID NO: 505520 - DNA, 25 bp, Rattus norvegicus
tgaccgtagcgtagccctagcagcc

SEQ ID NO: 505521 - DNA, 25 bp, Rattus norvegicus
gtagccctagcagccgcggtgttgc

SEQ ID NO: 505522 - DNA, 25 bp, Rattus norvegicus
ttcaggagtgagagtggtcatctga

SEQ ID NO: 505523 - DNA, 25 bp, Rattus norvegicus
ctcaggggcacgagtgatcggctga

SEQ ID NO: 505524 - DNA, 25 bp, Rattus norvegicus
ctgctcaggggcacgagtgatcggc

SEQ ID NO: 505525 - DNA, 25 bp, Rattus norvegicus
ctgttcaggagtgagagtggtcatc

SEQ ID NO: 505526 - DNA, 25 bp, Rattus norvegicus
cctgggcctgctcagggtagagagt

SEQ ID NO: 505527 - DNA, 25 bp, Rattus norvegicus
tcatctgaggggtaggagtgatacc

SEQ ID NO: 505528 - DNA, 25 bp, Rattus norvegicus
gtaggagtgatacccagagccttgg

SEQ ID NO: 505529 - DNA, 25 bp, Rattus norvegicus
gtgatacccagagccttggcctgtt

SEQ ID NO: 505530 - DNA, 25 bp, Rattus norvegicus
ccttggcctgttgagggctcagact

SEQ ID NO: 505531 - DNA, 25 bp, Rattus norvegicus
cctgttgagggctcagactgacctg

SEQ ID NO: 505532 - DNA, 25 bp, Rattus norvegicus
ctcagactgacctgctcatcaatga

SEQ ID NO: 505533 - DNA, 25 bp, Rattus norvegicus
ctgctcatcaatgagattgatcgcc

SEQ ID NO: 505534 - DNA, 25 bp, Rattus norvegicus
catcaatgagattgatcgccaggac

SEQ ID NO: 505535 - DNA, 25 bp, Rattus norvegicus
cctgagtctgttcaggagtgagagt

SEQ ID NO: 505536 - DNA, 25 bp, Rattus norvegicus
cggagcgcacgaaggtcttgcagca

SEQ ID NO: 505537 - DNA, 25 bp, Rattus norvegicus
gtgcacccgcatgtggttcttcagg

SEQ ID NO: 505538 - DNA, 25 bp, Rattus norvegicus
tcttcaggtcgtagttgtgtgcgaa

SEQ ID NO: 505539 - DNA, 25 bp, Rattus norvegicus
caggtacggtttctcacccgtgtgc

SEQ ID NO: 505540 - DNA, 25 bp, Rattus norvegicus
cagctgtcacactggtacggtcgca

SEQ ID NO: 505541 - DNA, 25 bp, Rattus norvegicus
ggggactccattgcagccgtccttc

SEQ ID NO: 505542 - DNA, 25 bp, Rattus norvegicus
cctggccattgcgtggagcatccgg

SEQ ID NO: 505543 - DNA, 25 bp, Rattus norvegicus
cgccgcactgctggcacaggtacgg

SEQ ID NO: 505544 - DNA, 25 bp, Rattus norvegicus
gagtcaggttgcgaagttaccctca

SEQ ID NO: 505545 - DNA, 25 bp, Rattus norvegicus
aagttaccctcagtggcggccaccg

SEQ ID NO: 505546 - DNA, 25 bp, Rattus norvegicus
attcaggcggcccaagccgtcaggg

SEQ ID NO: 505547 - DNA, 25 bp, Rattus norvegicus
aaagtgcttctcctggccattgcgt

SEQ ID NO: 505548 - DNA, 25 bp, Rattus norvegicus
agccgtccttcttgaggtgtctgtg

SEQ ID NO: 505549 - DNA, 25 bp, Rattus norvegicus
ggtacggtcgcagccctgtgtgcac

SEQ ID NO: 505550 - DNA, 25 bp, Rattus norvegicus
aatcttgttgggtccggttcgccag

SEQ ID NO: 505551 - DNA, 25 bp, Rattus norvegicus
tctggaacattctgtgggtgaaagc

SEQ ID NO: 505552 - DNA, 25 bp, Rattus norvegicus
aggatcgcacacttcggcttacgtc

SEQ ID NO: 505553 - DNA, 25 bp, Rattus norvegicus
tgaagagtgtagaaagctcgcccgc

SEQ ID NO: 505554 - DNA, 25 bp, Rattus norvegicus
gggtgtcccatatggagctcctgaa

SEQ ID NO: 505555 - DNA, 25 bp, Rattus norvegicus
agcccgccgagaggctgacacagca

SEQ ID NO: 505556 - DNA, 25 bp, Rattus norvegicus
ggcaccgctctgaccttttgtaaaa

SEQ ID NO: 505557 - DNA, 25 bp, Rattus norvegicus
gctcttcgttgaggtgagcggctta

SEQ ID NO: 505558 - DNA, 25 bp, Rattus norvegicus
agcggaagcagacatgttgctcttc

SEQ ID NO: 505559 - DNA, 25 bp, Rattus norvegicus
ggcgagtgtccttatcctaccgatt

SEQ ID NO: 505560 - DNA, 25 bp, Rattus norvegicus
aaacagttgttgcttccagggaggc

SEQ ID NO: 505561 - DNA, 25 bp, Rattus norvegicus
ttgcctccagaaccggaaacagttg

SEQ ID NO: 505562 - DNA, 25 bp, Rattus norvegicus
gccatgtgactttccaggccgtaca

SEQ ID NO: 505563 - DNA, 25 bp, Rattus norvegicus
ttgtaaaagttactcggcctgcggc

SEQ ID NO: 505564 - DNA, 25 bp, Rattus norvegicus
gcgttccagacgctccgcggcagag

SEQ ID NO: 505565 - DNA, 25 bp, Rattus norvegicus
tgagctctcattgttgtccctgggg

SEQ ID NO: 505566 - DNA, 25 bp, Rattus norvegicus
tcaccagtgacaggcgtgagaaagg

SEQ ID NO: 505567 - DNA, 25 bp, Rattus norvegicus
tgcgaggtgcctcaccagtgacagg

SEQ ID NO: 505568 - DNA, 25 bp, Rattus norvegicus
ctctaacaatgcgaggtgcctcacc

SEQ ID NO: 505569 - DNA, 25 bp, Rattus norvegicus
gtttcttcctgctcctctaacaatg

SEQ ID NO: 505570 - DNA, 25 bp, Rattus norvegicus
aacgccgcagctgcgtttcttcctg

SEQ ID NO: 505571 - DNA, 25 bp, Rattus norvegicus
ctctcctgcttcagaacgaggcgca

SEQ ID NO: 505572 - DNA, 25 bp, Rattus norvegicus
ccctctcgtcttccggagtgtggct

SEQ ID NO: 505573 - DNA, 25 bp, Rattus norvegicus
acgtgaccctcgctcaatggcggcg

SEQ ID NO: 505574 - DNA, 25 bp, Rattus norvegicus
gctaacccagagagaaccggatccg

SEQ ID NO: 505575 - DNA, 25 bp, Rattus norvegicus
cggtggcgctaacccagagagaacc

SEQ ID NO: 505576 - DNA, 25 bp, Rattus norvegicus
cggctggagccggatcctgtagccc

SEQ ID NO: 505577 - DNA, 25 bp, Rattus norvegicus
agctggagacaaagctgcgccctcc

SEQ ID NO: 505578 - DNA, 25 bp, Rattus norvegicus
aacgtgacgctggtggggacgcaat

SEQ ID NO: 505579 - DNA, 25 bp, Rattus norvegicus
ggagtcctctcacgagactctcgca

SEQ ID NO: 505580 - DNA, 25 bp, Rattus norvegicus
cccacgtgagcacgcggtgacgcag

SEQ ID NO: 505581 - DNA, 25 bp, Rattus norvegicus
agaagggcaagctaagtcttttcca

SEQ ID NO: 505582 - DNA, 25 bp, Rattus norvegicus
tgtgcggatcatgccgccagcgacg

SEQ ID NO: 505583 - DNA, 25 bp, Rattus norvegicus
cacgctcccgcgcactcctcggccc

SEQ ID NO: 505584 - DNA, 25 bp, Rattus norvegicus
cgagactctcgcaactcctgcagca

SEQ ID NO: 505585 - DNA, 25 bp, Rattus norvegicus
tttatagataaacagagcaggtagc

SEQ ID NO: 505586 - DNA, 25 bp, Rattus norvegicus
gataaacagagcaggtagcgagccc

SEQ ID NO: 505587 - DNA, 25 bp, Rattus norvegicus
atggcagcataaggttttatagata

SEQ ID NO: 505588 - DNA, 25 bp, Rattus norvegicus
gcattaagatggcagcataaggttt

SEQ ID NO: 505589 - DNA, 25 bp, Rattus norvegicus
ttttccaaagcattaagatggcagc

SEQ ID NO: 505590 - DNA, 25 bp, Rattus norvegicus
ggcaagctaagtcttttccaaagca

SEQ ID NO: 505591 - DNA, 25 bp, Rattus norvegicus
cggcctgtgcggatcatgccgccag

SEQ ID NO: 505592 - DNA, 25 bp, Rattus norvegicus
agtctcgcagctggccgcctaggtt

SEQ ID NO: 505593 - DNA, 25 bp, Rattus norvegicus
ctccttccgggagtctcgcagctgg

SEQ ID NO: 505594 - DNA, 25 bp, Rattus norvegicus
ggctcccgcctccatgactggggaa

SEQ ID NO: 505595 - DNA, 25 bp, Rattus norvegicus
ccgcctccatgactggggaaccgag

SEQ ID NO: 505596 - DNA, 25 bp, Rattus norvegicus
tccatgactggggaaccgaggcaac

SEQ ID NO: 505597 - DNA, 25 bp, Rattus norvegicus
taggttgtggtagaaacttaactca

SEQ ID NO: 505598 - DNA, 25 bp, Rattus norvegicus
tggggcacgatggtcctctctcctt

SEQ ID NO: 505599 - DNA, 25 bp, Rattus norvegicus
tggccgcctaggttgtggtagaaac

SEQ ID NO: 505600 - DNA, 25 bp, Rattus norvegicus
ttaactcaaaagtctcggtagccgc

SEQ ID NO: 505601 - DNA, 25 bp, Rattus norvegicus
gggatttattcctacgacttctaga

SEQ ID NO: 505602 - DNA, 25 bp, Rattus norvegicus
attcctacgacttctagacgtggtc

SEQ ID NO: 505603 - DNA, 25 bp, Rattus norvegicus
ctacgacttctagacgtggtcgccg

SEQ ID NO: 505604 - DNA, 25 bp, Rattus norvegicus
actcaaaagtctcggtagccgcctt

SEQ ID NO: 505605 - DNA, 25 bp, Rattus norvegicus
ctggggaaccgaggcaacacgcccg

SEQ ID NO: 505606 - DNA, 25 bp, Rattus norvegicus
ctccgtttctgctggtacactcctg

SEQ ID NO: 505607 - DNA, 25 bp, Rattus norvegicus
tgtcacaggaaccagatctgggcca

SEQ ID NO: 505608 - DNA, 25 bp, Rattus norvegicus
tccgatgctggtgtcacaggaacca

SEQ ID NO: 505609 - DNA, 25 bp, Rattus norvegicus
cctctctcttccgatgctggtgtca

SEQ ID NO: 505610 - DNA, 25 bp, Rattus norvegicus
tctgctggtacactcctggctgtct

SEQ ID NO: 505611 - DNA, 25 bp, Rattus norvegicus
tgcacagtgttctccgtttctgctg

SEQ ID NO: 505612 - DNA, 25 bp, Rattus norvegicus
cgcagggcagttctgcacagtgttc

SEQ ID NO: 505613 - DNA, 25 bp, Rattus norvegicus
tgctcctttactggcttgctgcctc

SEQ ID NO: 505614 - DNA, 25 bp, Rattus norvegicus
tccgcgcgtgctcctttactggctt

SEQ ID NO: 505615 - DNA, 25 bp, Rattus norvegicus
cacaggatacctcggggccgactgc

SEQ ID NO: 505616 - DNA, 25 bp, Rattus norvegicus
tctagaaggcgccacaggatacctc

SEQ ID NO: 505617 - DNA, 25 bp, Rattus norvegicus
tggacacgaagactctagaaggcgc

SEQ ID NO: 505618 - DNA, 25 bp, Rattus norvegicus
atctgggccaaacggactcgcggcc

SEQ ID NO: 505619 - DNA, 25 bp, Rattus norvegicus
tggctgtctccttccagtgcgcctc

SEQ ID NO: 505620 - DNA, 25 bp, Rattus norvegicus
ggcggccttccggaagtcctctgct

SEQ ID NO: 505621 - DNA, 25 bp, Rattus norvegicus
agggcttcgacctgaccatggcgag

SEQ ID NO: 505622 - DNA, 25 bp, Rattus norvegicus
ctctcacgcctactctgaggtgctg

SEQ ID NO: 505623 - DNA, 25 bp, Rattus norvegicus
gtgctggaggcaaaccttttcaatc

SEQ ID NO: 505624 - DNA, 25 bp, Rattus norvegicus
ttcccgtgcccaatggcgtccagag

SEQ ID NO: 505625 - DNA, 25 bp, Rattus norvegicus
aagtcctctgctgggcgacaggccc

SEQ ID NO: 505626 - DNA, 25 bp, Rattus norvegicus
agcggcctcaccagtcgagcgaagg

SEQ ID NO: 505627 - DNA, 25 bp, Rattus norvegicus
cgctgagcgccgcactgctgtgttt

SEQ ID NO: 505628 - DNA, 25 bp, Rattus norvegicus
actgctgtgtttgggcggagccctt

SEQ ID NO: 505629 - DNA, 25 bp, Rattus norvegicus
gagcccttgcgtacggcaagctgca

SEQ ID NO: 505630 - DNA, 25 bp, Rattus norvegicus
aagctgcactcgctgaccctcaggg

SEQ ID NO: 505631 - DNA, 25 bp, Rattus norvegicus
ggtcacgaagggcagtatctggtca

SEQ ID NO: 505632 - DNA, 25 bp, Rattus norvegicus
cgcggtgtggagagaccttccttcc

SEQ ID NO: 505633 - DNA, 25 bp, Rattus norvegicus
ggcagtatctggtcatgcgcagccc

SEQ ID NO: 505634 - DNA, 25 bp, Rattus norvegicus
ttcacggtgatgtacaacgagcaga

SEQ ID NO: 505635 - DNA, 25 bp, Rattus norvegicus
ctgtgctcggtgaagagccaagaga

SEQ ID NO: 505636 - DNA, 25 bp, Rattus norvegicus
tctgcaccctggtgctgtgctcggt

SEQ ID NO: 505637 - DNA, 25 bp, Rattus norvegicus
ctgtggacgtggtggtctgcaccct

SEQ ID NO: 505638 - DNA, 25 bp, Rattus norvegicus
acatgcaccaggtggccgatggctc

SEQ ID NO: 505639 - DNA, 25 bp, Rattus norvegicus
ggcacctgcagttcgagcgcttctt

SEQ ID NO: 505640 - DNA, 25 bp, Rattus norvegicus
gtgtcgcagagaaccggcacctgca

SEQ ID NO: 505641 - DNA, 25 bp, Rattus norvegicus
ttcttgttcaagagtgtcgcagaga

SEQ ID NO: 505642 - DNA, 25 bp, Rattus norvegicus
cccaacttcgagaagttcttgttca

SEQ ID NO: 505643 - DNA, 25 bp, Rattus norvegicus
gatgcagggtcacttgcatcgaccc

SEQ ID NO: 505644 - DNA, 25 bp, Rattus norvegicus
acgagcagatggctacccgaaagcg

SEQ ID NO: 505645 - DNA, 25 bp, Rattus norvegicus
agcgggagctcttcagcaacctgca

SEQ ID NO: 505646 - DNA, 25 bp, Rattus norvegicus
ccaagagaagatcctgcgcgaggtg

SEQ ID NO: 505647 - DNA, 25 bp, Rattus norvegicus
cagcaacctgcaggagttcgcgggc

SEQ ID NO: 505648 - DNA, 25 bp, Rattus norvegicus
cctcccggtctcctcgggatatgga

SEQ ID NO: 505649 - DNA, 25 bp, Rattus norvegicus
acggtcggcgccaatgctgagcccg

SEQ ID NO: 505650 - DNA, 25 bp, Rattus norvegicus
tagactgacagggagctgcgctacg

SEQ ID NO: 505651 - DNA, 25 bp, Rattus norvegicus
ggtactgcttggtcggcgaactaga

SEQ ID NO: 505652 - DNA, 25 bp, Rattus norvegicus
ctacagctgcgggtactgcttggtc

SEQ ID NO: 505653 - DNA, 25 bp, Rattus norvegicus
tctcctcgggatatggagctccctc

SEQ ID NO: 505654 - DNA, 25 bp, Rattus norvegicus
tcggcgaactagaaccagaggctcc

SEQ ID NO: 505655 - DNA, 25 bp, Rattus norvegicus
ccgcgtgaaaggtgtccctgaacga

SEQ ID NO: 505656 - DNA, 25 bp, Rattus norvegicus
gaaagggcgcatccaccgcgtgaaa

SEQ ID NO: 505657 - DNA, 25 bp, Rattus norvegicus
tgtccctgaacgaggcctggaaggc

SEQ ID NO: 505658 - DNA, 25 bp, Rattus norvegicus
agcagcactcaacccggaggcctga

SEQ ID NO: 505659 - DNA, 25 bp, Rattus norvegicus
gcctttgggcagaccgagcagctcc

SEQ ID NO: 505660 - DNA, 25 bp, Rattus norvegicus
ctccggcggccgctagactgacagg

SEQ ID NO: 505661 - DNA, 25 bp, Rattus norvegicus
ggcgactccatatcccaggagccag

SEQ ID NO: 505662 - DNA, 25 bp, Rattus norvegicus
actctgacccggagacgacctgtct

SEQ ID NO: 505663 - DNA, 25 bp, Rattus norvegicus
gggttttgcttttccacgctggatc

SEQ ID NO: 505664 - DNA, 25 bp, Rattus norvegicus
gaccctttgtcacccggaggctgca

SEQ ID NO: 505665 - DNA, 25 bp, Rattus norvegicus
gccctggagagagaagagcattttt

SEQ ID NO: 505666 - DNA, 25 bp, Rattus norvegicus
gcatttttgacgtagaagcccttcc

SEQ ID NO: 505667 - DNA, 25 bp, Rattus norvegicus
tccctatgctctgtgtcctgagatc

SEQ ID NO: 505668 - DNA, 25 bp, Rattus norvegicus
tgcacgatctgcctttggtctcaga

SEQ ID NO: 505669 - DNA, 25 bp, Rattus norvegicus
tctcagaccaaagggcttgagtttc

SEQ ID NO: 505670 - DNA, 25 bp, Rattus norvegicus
tccagaagggtcgagttccgcccac

SEQ ID NO: 505671 - DNA, 25 bp, Rattus norvegicus
ggcttctactagttcgcagatcgtc

SEQ ID NO: 505672 - DNA, 25 bp, Rattus norvegicus
ccacagaggtcaaggcagcgcttgc

SEQ ID NO: 505673 - DNA, 25 bp, Rattus norvegicus
tccaaaggcggacgtgaagaacttg

SEQ ID NO: 505674 - DNA, 25 bp, Rattus norvegicus
aacttgatttcttacgtggtgacca

SEQ ID NO: 505675 - DNA, 25 bp, Rattus norvegicus
cccaggcacgaagtggcttctacta

SEQ ID NO: 505676 - DNA, 25 bp, Rattus norvegicus
gaactcagccgtcagccgcaatcca

SEQ ID NO: 505677 - DNA, 25 bp, Rattus norvegicus
agtgcagcaaaaccctcgccggttc

SEQ ID NO: 505678 - DNA, 25 bp, Rattus norvegicus
ttgcggccagtgcagcaaaaccctc

SEQ ID NO: 505679 - DNA, 25 bp, Rattus norvegicus
ggaaatggagtctatacccggccca

SEQ ID NO: 505680 - DNA, 25 bp, Rattus norvegicus
ctgcctcttataggcgccggcgcgt

SEQ ID NO: 505681 - DNA, 25 bp, Rattus norvegicus
gctgcagcgctctgcctcttatagg

SEQ ID NO: 505682 - DNA, 25 bp, Rattus norvegicus
cggctaacaataggctccggctgca

SEQ ID NO: 505683 - DNA, 25 bp, Rattus norvegicus
ttctgaagcgtcctcggcggacctc

SEQ ID NO: 505684 - DNA, 25 bp, Rattus norvegicus
tcgccggttctgaagcgtcctcggc

SEQ ID NO: 505685 - DNA, 25 bp, Rattus norvegicus
tcccggctccggctaacaataggct

SEQ ID NO: 505686 - DNA, 25 bp, Rattus norvegicus
ctattcagtccgtgtgcaaggaggg

SEQ ID NO: 505687 - DNA, 25 bp, Rattus norvegicus
gccctagctgcctattcagtccgtg

SEQ ID NO: 505688 - DNA, 25 bp, Rattus norvegicus
tgccaagcaaggacgaggcggaccc

SEQ ID NO: 505689 - DNA, 25 bp, Rattus norvegicus
cgcccaagagctgctgccaagcaag

SEQ ID NO: 505690 - DNA, 25 bp, Rattus norvegicus
cgcctcgcgggctgatggctatgaa

SEQ ID NO: 505691 - DNA, 25 bp, Rattus norvegicus
atggttgaccggtcgttggatccag

SEQ ID NO: 505692 - DNA, 25 bp, Rattus norvegicus
cgtgcgatcggctcacacaggacca

SEQ ID NO: 505693 - DNA, 25 bp, Rattus norvegicus
tcggctcacacaggaccagagggcg

SEQ ID NO: 505694 - DNA, 25 bp, Rattus norvegicus
tggaacccaccagcgagaccaggct

SEQ ID NO: 505695 - DNA, 25 bp, Rattus norvegicus
cttgcctcgttatggtgtaggtgga

SEQ ID NO: 505696 - DNA, 25 bp, Rattus norvegicus
agccggacggcgtcctcagctatca

SEQ ID NO: 505697 - DNA, 25 bp, Rattus norvegicus
gcgtcctcagctatcaggtgggccc

SEQ ID NO: 505698 - DNA, 25 bp, Rattus norvegicus
cagccggggttccaggcgtgtccct

SEQ ID NO: 505699 - DNA, 25 bp, Rattus norvegicus
cctgctgctcggtgtcccggagcaa

SEQ ID NO: 505700 - DNA, 25 bp, Rattus norvegicus
tgattggctgctcggggagccctct

SEQ ID NO: 505701 - DNA, 25 bp, Rattus norvegicus
ggagcaatgacctctgtccgccgct

SEQ ID NO: 505702 - DNA, 25 bp, Rattus norvegicus
ccggcttctggccttgcctcgttat

SEQ ID NO: 505703 - DNA, 25 bp, Rattus norvegicus
gtgtcccggagcaatgacctctgtc

SEQ ID NO: 505704 - DNA, 25 bp, Rattus norvegicus
atcaccttctcgcaaatggggcact

SEQ ID NO: 505705 - DNA, 25 bp, Rattus norvegicus
ggcccacggacgacatcatctgctg

SEQ ID NO: 505706 - DNA, 25 bp, Rattus norvegicus
tccgggcgggactcctcatcactgt

SEQ ID NO: 505707 - DNA, 25 bp, Rattus norvegicus
catgacacccttgtcgtccgggcgg

SEQ ID NO: 505708 - DNA, 25 bp, Rattus norvegicus
ggtagtagtccatgacacccttgtc

SEQ ID NO: 505709 - DNA, 25 bp, Rattus norvegicus
ctgaagtacttcaggtagtagtcca

SEQ ID NO: 505710 - DNA, 25 bp, Rattus norvegicus
accctcatgggctccgctgaagtac

SEQ ID NO: 505711 - DNA, 25 bp, Rattus norvegicus
ggccgggtacacatcaccctcatgg

SEQ ID NO: 505712 - DNA, 25 bp, Rattus norvegicus
cttctgtgaccaggccgggtacaca

SEQ ID NO: 505713 - DNA, 25 bp, Rattus norvegicus
cttctggaaggccttggcccggatt

SEQ ID NO: 505714 - DNA, 25 bp, Rattus norvegicus
ggcagcttgcctgcgccctgaatca

SEQ ID NO: 505715 - DNA, 25 bp, Rattus norvegicus
gccctgaatcaccttctcgcaaatg

SEQ ID NO: 505716 - DNA, 25 bp, Rattus norvegicus
gccttggcccggattttcttctcgc

SEQ ID NO: 505717 - DNA, 25 bp, Rattus norvegicus
gcaaatggggcacttctggaaggcc

SEQ ID NO: 505718 - DNA, 25 bp, Rattus norvegicus
gcgcactgtaactctacccggcaga

SEQ ID NO: 505719 - DNA, 25 bp, Rattus norvegicus
tccatccacggagggactttcgttc

SEQ ID NO: 505720 - DNA, 25 bp, Rattus norvegicus
tacattcctagctctccgtagccgg

SEQ ID NO: 505721 - DNA, 25 bp, Rattus norvegicus
acagtcacgcggagctacattccta

SEQ ID NO: 505722 - DNA, 25 bp, Rattus norvegicus
tgtgaatgctagtcgcagcctccgg

SEQ ID NO: 505723 - DNA, 25 bp, Rattus norvegicus
gctatagatgcaaaggctcccgccc

SEQ ID NO: 505724 - DNA, 25 bp, Rattus norvegicus
ctccgcagcggtgataggctataga

SEQ ID NO: 505725 - DNA, 25 bp, Rattus norvegicus
gacgtcactttaccatctaccaatg

SEQ ID NO: 505726 - DNA, 25 bp, Rattus norvegicus
aatcaggacgccctctgtggccttg

SEQ ID NO: 505727 - DNA, 25 bp, Rattus norvegicus
gtcagataacatccggtcacccgtt

SEQ ID NO: 505728 - DNA, 25 bp, Rattus norvegicus
cccggcagacaacacagtagtagtc

SEQ ID NO: 505729 - DNA, 25 bp, Rattus norvegicus
ctccggtacaaaggcgcgcactgta

SEQ ID NO: 505730 - DNA, 25 bp, Rattus norvegicus
tcgatcacttcgtcagctagcggca

SEQ ID NO: 505731 - DNA, 25 bp, Rattus norvegicus
ggctgtaccctagctgctcctcagg

SEQ ID NO: 505732 - DNA, 25 bp, Rattus norvegicus
cgggcattgcatattaaccaaattc

SEQ ID NO: 505733 - DNA, 25 bp, Rattus norvegicus
gcaaagcgctttgccgcatgctgca

SEQ ID NO: 505734 - DNA, 25 bp, Rattus norvegicus
gctgctgcgtcatgagcataattta

SEQ ID NO: 505735 - DNA, 25 bp, Rattus norvegicus
tccctccttctgctacttggatttt

SEQ ID NO: 505736 - DNA, 25 bp, Rattus norvegicus
agcggccacggactagacactcatc

SEQ ID NO: 505737 - DNA, 25 bp, Rattus norvegicus
accagccctttctccggagtagtgg

SEQ ID NO: 505738 - DNA, 25 bp, Rattus norvegicus
aaattatgctaattacgggcattgc

SEQ ID NO: 505739 - DNA, 25 bp, Rattus norvegicus
cgcgcctttttctctctttatcata

SEQ ID NO: 505740 - DNA, 25 bp, Rattus norvegicus
gcggccgtggactccagagctccag

SEQ ID NO: 505741 - DNA, 25 bp, Rattus norvegicus
gccactccacgagtgtccgcgggga

SEQ ID NO: 505742 - DNA, 25 bp, Rattus norvegicus
aagcgtcccaggatccagggctctg

SEQ ID NO: 505743 - DNA, 25 bp, Rattus norvegicus
catgtcgccagggaacccaagcgtc

SEQ ID NO: 505744 - DNA, 25 bp, Rattus norvegicus
ccggagtagtggtgacatgtcgcca

SEQ ID NO: 505745 - DNA, 25 bp, Rattus norvegicus
gccgcccgcagacaaagaagccgga

SEQ ID NO: 505746 - DNA, 25 bp, Rattus norvegicus
taaggcacacacaacgtctgtagga

SEQ ID NO: 505747 - DNA, 25 bp, Rattus norvegicus
tgtaatcacggtcctaagagacgtc

SEQ ID NO: 505748 - DNA, 25 bp, Rattus norvegicus
ctggaccgtcaataggaggcctgga

SEQ ID NO: 505749 - DNA, 25 bp, Rattus norvegicus
ggacacggtctacctccgcacggat

SEQ ID NO: 505750 - DNA, 25 bp, Rattus norvegicus
catggtttgtatcagggcgccaagc

SEQ ID NO: 505751 - DNA, 25 bp, Rattus norvegicus
gcttgatgcggtgtcatggtttgta

SEQ ID NO: 505752 - DNA, 25 bp, Rattus norvegicus
tccatctcagggcaggagcttgatg

SEQ ID NO: 505753 - DNA, 25 bp, Rattus norvegicus
gagacgtcgcctctacccttcagga

SEQ ID NO: 505754 - DNA, 25 bp, Rattus norvegicus
agaatccgttcaccgagggcctctc

SEQ ID NO: 505755 - DNA, 25 bp, Rattus norvegicus
tgcccatgaggaaacgggaaaagtg

SEQ ID NO: 505756 - DNA, 25 bp, Rattus norvegicus
gttcctcactctgtgcgtgcccatg

SEQ ID NO: 505757 - DNA, 25 bp, Rattus norvegicus
cagacagctgcgtcggttcctcact

SEQ ID NO: 505758 - DNA, 25 bp, Rattus norvegicus
ttgagcgcgcacaacacaacttctg

SEQ ID NO: 505759 - DNA, 25 bp, Rattus norvegicus
cttcaggacaactgggagtgggcta

SEQ ID NO: 505760 - DNA, 25 bp, Rattus norvegicus
ctcgcagcctgcttccatggttatc

SEQ ID NO: 505761 - DNA, 25 bp, Rattus norvegicus
tggatactgaaaggcgccgagcacg

SEQ ID NO: 505762 - DNA, 25 bp, Rattus norvegicus
ctctttggatactgaaaggcgccga

SEQ ID NO: 505763 - DNA, 25 bp, Rattus norvegicus
ccagtttgttttgctctttggatac

SEQ ID NO: 505764 - DNA, 25 bp, Rattus norvegicus
gcgtggccacgccagtttgttttgc

SEQ ID NO: 505765 - DNA, 25 bp, Rattus norvegicus
gctccctaggtcacgtgatggcgct

SEQ ID NO: 505766 - DNA, 25 bp, Rattus norvegicus
aacccgtgctccctaggtcacgtga

SEQ ID NO: 505767 - DNA, 25 bp, Rattus norvegicus
ttctccgcctctgccggaacccgtg

SEQ ID NO: 505768 - DNA, 25 bp, Rattus norvegicus
ggatctgctgcttccacacaggaag

SEQ ID NO: 505769 - DNA, 25 bp, Rattus norvegicus
cgggatctgctgcttccacacagga

SEQ ID NO: 505770 - DNA, 25 bp, Rattus norvegicus
gtagcaccgggatctgctgcttcca

SEQ ID NO: 505771 - DNA, 25 bp, Rattus norvegicus
ttatcgcgccaaggatggagagagc

SEQ ID NO: 505772 - DNA, 25 bp, Rattus norvegicus
ttccatggttatcgcgccaaggatg

SEQ ID NO: 505773 - DNA, 25 bp, Rattus norvegicus
agcctgcttccatggttatcgcgcc

SEQ ID NO: 505774 - DNA, 25 bp, Rattus norvegicus
gctccctcctcagggccaggattta

SEQ ID NO: 505775 - DNA, 25 bp, Rattus norvegicus
cccataaactctgtggcgcagtttg

SEQ ID NO: 505776 - DNA, 25 bp, Rattus norvegicus
tgcactcgggcatcgactgacgcag

SEQ ID NO: 505777 - DNA, 25 bp, Rattus norvegicus
tcacgtgacacggaagtgactccga

SEQ ID NO: 505778 - DNA, 25 bp, Rattus norvegicus
ataaccgtccgcgacgccgagtgga

SEQ ID NO: 505779 - DNA, 25 bp, Rattus norvegicus
ttagagccaccatgaacagcaaagg

SEQ ID NO: 505780 - DNA, 25 bp, Rattus norvegicus
gtaagcgccctccttgcagcgactg

SEQ ID NO: 505781 - DNA, 25 bp, Rattus norvegicus
ttttccgtgactgacaccggctgga

SEQ ID NO: 505782 - DNA, 25 bp, Rattus norvegicus
gcgcttcggaacaacaggccttggc

SEQ ID NO: 505783 - DNA, 25 bp, Rattus norvegicus
agcttaactcgtgaggtgccggctc

SEQ ID NO: 505784 - DNA, 25 bp, Rattus norvegicus
aggatttatagtcgtgcctgtgcta

SEQ ID NO: 505785 - DNA, 25 bp, Rattus norvegicus
gcctgtgctaatgtttgtcagacca

SEQ ID NO: 505786 - DNA, 25 bp, Rattus norvegicus
tcagaccatggtcgcgtttacctcc

SEQ ID NO: 505787 - DNA, 25 bp, Rattus norvegicus
ggccttggccgagcttaactcgtga

SEQ ID NO: 505788 - DNA, 25 bp, Rattus norvegicus
gaaaagccactgtccgaagccgctc

SEQ ID NO: 505789 - DNA, 25 bp, Rattus norvegicus
cgggcgccgcgcgtccttttgaact

SEQ ID NO: 505790 - DNA, 25 bp, Rattus norvegicus
gaccagaggcgttggtgaccctttc

SEQ ID NO: 505791 - DNA, 25 bp, Rattus norvegicus
cccaggcatgggaaagtgaagcaag

SEQ ID NO: 505792 - DNA, 25 bp, Rattus norvegicus
tccgccacctgcaatacctgggctt

SEQ ID NO: 505793 - DNA, 25 bp, Rattus norvegicus
gccttggccgacgaggatcctcgca

SEQ ID NO: 505794 - DNA, 25 bp, Rattus norvegicus
gcagccacgcgctaccctcccaggt

SEQ ID NO: 505795 - DNA, 25 bp, Rattus norvegicus
ctttccagtccgaccggcgggcagg

SEQ ID NO: 505796 - DNA, 25 bp, Rattus norvegicus
ggctgccggacgacttagcccagca

SEQ ID NO: 505797 - DNA, 25 bp, Rattus norvegicus
ctcgggaggaaaagccactgtccga

SEQ ID NO: 505798 - DNA, 25 bp, Rattus norvegicus
cccgtgctagggtacgcagtgcccg

SEQ ID NO: 505799 - DNA, 25 bp, Rattus norvegicus
cgcgcgtccttttgaactcgccggg

SEQ ID NO: 505800 - DNA, 25 bp, Rattus norvegicus
gagtccgcggctgccggacgactta

SEQ ID NO: 505801 - DNA, 25 bp, Rattus norvegicus
gcgcccgtgagcgattcgggtccct

SEQ ID NO: 505802 - DNA, 25 bp, Rattus norvegicus
cttctcaaccgcaagggtgaagggg

SEQ ID NO: 505803 - DNA, 25 bp, Rattus norvegicus
tgcttacctaccgcgccgaggcaga

SEQ ID NO: 505804 - DNA, 25 bp, Rattus norvegicus
ccgagctgctcgtgggtttcccgac

SEQ ID NO: 505805 - DNA, 25 bp, Rattus norvegicus
tgcgcggccactctcattgggcgta

SEQ ID NO: 505806 - DNA, 25 bp, Rattus norvegicus
tctcattgggcgtagggtcccaggt

SEQ ID NO: 505807 - DNA, 25 bp, Rattus norvegicus
tagggtcccaggtcagaccgcaaca

SEQ ID NO: 505808 - DNA, 25 bp, Rattus norvegicus
agagcagcgagtcacgatgtgcagc

SEQ ID NO: 505809 - DNA, 25 bp, Rattus norvegicus
agtcacgatgtgcagcgcgctggct

SEQ ID NO: 505810 - DNA, 25 bp, Rattus norvegicus
ccaaggagcactgggttgccaggtc

SEQ ID NO: 505811 - DNA, 25 bp, Rattus norvegicus
cccttcatcgcactgctggggacgg

SEQ ID NO: 505812 - DNA, 25 bp, Rattus norvegicus
ttgccaggtccaagggctccacggg

SEQ ID NO: 505813 - DNA, 25 bp, Rattus norvegicus
tcccaccgagggaggcgctagatgt

SEQ ID NO: 505814 - DNA, 25 bp, Rattus norvegicus
cctcaacttctcaaccgcaagggtg

SEQ ID NO: 505815 - DNA, 25 bp, Rattus norvegicus
gatgagtctggctcggccccttcat

SEQ ID NO: 505816 - DNA, 25 bp, Rattus norvegicus
gagctaacgtcctgtgccgtgttta

SEQ ID NO: 505817 - DNA, 25 bp, Rattus norvegicus
tgttatttcgggagctaacgtcctg

SEQ ID NO: 505818 - DNA, 25 bp, Rattus norvegicus
ctgcgccaggttcgctccacggtga

SEQ ID NO: 505819 - DNA, 25 bp, Rattus norvegicus
tctggttgtttgctgcgccaggttc

SEQ ID NO: 505820 - DNA, 25 bp, Rattus norvegicus
accgctctggttgtttgctgcgcca

SEQ ID NO: 505821 - DNA, 25 bp, Rattus norvegicus
tgtgccgtgtttaaccgctctggtt

SEQ ID NO: 505822 - DNA, 25 bp, Rattus norvegicus
ctccacggtgagtgacttcgctgtg

SEQ ID NO: 505823 - DNA, 25 bp, Rattus norvegicus
agtgacttcgctgtgttcctcacca

SEQ ID NO: 505824 - DNA, 25 bp, Rattus norvegicus
acctcggggagcttcgcgcctgagt

SEQ ID NO: 505825 - DNA, 25 bp, Rattus norvegicus
gctgtgttcctcaccatctttacta

SEQ ID NO: 505826 - DNA, 25 bp, Rattus norvegicus
ccatctttactatggtgatcctaga

SEQ ID NO: 505827 - DNA, 25 bp, Rattus norvegicus
atggtgatcctagactttctgattg

SEQ ID NO: 505828 - DNA, 25 bp, Rattus norvegicus
ccagcgtgttcaaggtaagtggacc

SEQ ID NO: 505829 - DNA, 25 bp, Rattus norvegicus
tcgcgcctgagtgcgcactgatctc

SEQ ID NO: 505830 - DNA, 25 bp, Rattus norvegicus
agtcttgcttccttccacggtgttt

SEQ ID NO: 505831 - DNA, 25 bp, Rattus norvegicus
cagggagcaaggagactcttgtcat

SEQ ID NO: 505832 - DNA, 25 bp, Rattus norvegicus
aaggagactcttgtcattgaccagg

SEQ ID NO: 505833 - DNA, 25 bp, Rattus norvegicus
tcttgtcattgaccagggccgcaga

SEQ ID NO: 505834 - DNA, 25 bp, Rattus norvegicus
accagggccgcagagcatctatcgg

SEQ ID NO: 505835 - DNA, 25 bp, Rattus norvegicus
agcatctatcgggtgtcgacgccgg

SEQ ID NO: 505836 - DNA, 25 bp, Rattus norvegicus
tccaggttgcctggtcgcccaggga

SEQ ID NO: 505837 - DNA, 25 bp, Rattus norvegicus
cacggtgtttgccgaggttcccgag

SEQ ID NO: 505838 - DNA, 25 bp, Rattus norvegicus
tatcgggtgtcgacgccggtactgt

SEQ ID NO: 505839 - DNA, 25 bp, Rattus norvegicus
cgccgtggagcggtttctgcccttc

SEQ ID NO: 505840 - DNA, 25 bp, Rattus norvegicus
cggtttctgcccttcgtgctttgca

SEQ ID NO: 505841 - DNA, 25 bp, Rattus norvegicus
tcgtgctttgcacggacgtttggaa

SEQ ID NO: 505842 - DNA, 25 bp, Rattus norvegicus
ttgcacggacgtttggaagtcttgc

SEQ ID NO: 505843 - DNA, 25 bp, Rattus norvegicus
ggccgcagagcatctatcgggtgtc

SEQ ID NO: 505844 - DNA, 25 bp, Rattus norvegicus
cgaggactcggttcccttactctga

SEQ ID NO: 505845 - DNA, 25 bp, Rattus norvegicus
atcggttcccttactctgagctgtc

SEQ ID NO: 505846 - DNA, 25 bp, Rattus norvegicus
gaggactcggttcccttactctgag

SEQ ID NO: 505847 - DNA, 25 bp, Rattus norvegicus
ctcggttcccttactctgagctgtc

SEQ ID NO: 505848 - DNA, 25 bp, Rattus norvegicus
ctgtccagcggatgctttgctgctt

SEQ ID NO: 505849 - DNA, 25 bp, Rattus norvegicus
gatgctttgctgcttccgaggactc

SEQ ID NO: 505850 - DNA, 25 bp, Rattus norvegicus
atgctttgctgcttccgaggactcg

SEQ ID NO: 505851 - DNA, 25 bp, Rattus norvegicus
ccagcggatgctttgctgcttccga

SEQ ID NO: 505852 - DNA, 25 bp, Rattus norvegicus
tgcttccgaggaatcggttccctta

SEQ ID NO: 505853 - DNA, 25 bp, Rattus norvegicus
gtccagcggatgctttgctgcttcc

SEQ ID NO: 505854 - DNA, 25 bp, Rattus norvegicus
gaatcggttcccttactctgagctg

SEQ ID NO: 505855 - DNA, 25 bp, Rattus norvegicus
tctgagctgtccagcggatgctttg

SEQ ID NO: 505856 - DNA, 25 bp, Rattus norvegicus
ctctgagctgtccagcggatgcttt

SEQ ID NO: 505857 - DNA, 25 bp, Rattus norvegicus
gctgtccagcggatgctttgctgct

SEQ ID NO: 505858 - DNA, 25 bp, Rattus norvegicus
aatagataaggcagctacggacagc

SEQ ID NO: 505859 - DNA, 25 bp, Rattus norvegicus
ctacggacagcgtaaggaaggacac

SEQ ID NO: 505860 - DNA, 25 bp, Rattus norvegicus
ggcgtgactcgctcttcatcccgat

SEQ ID NO: 505861 - DNA, 25 bp, Rattus norvegicus
ctcctgcctgaggtgaaaatagata

SEQ ID NO: 505862 - DNA, 25 bp, Rattus norvegicus
ggtgtcactcatcgggcccggctca

SEQ ID NO: 505863 - DNA, 25 bp, Rattus norvegicus
cgcaacagcacggtggactgcaacg

SEQ ID NO: 505864 - DNA, 25 bp, Rattus norvegicus
gatgaacacagcaccgtggaggaga

SEQ ID NO: 505865 - DNA, 25 bp, Rattus norvegicus
ttcgcagacgatgaacacagcaccg

SEQ ID NO: 505866 - DNA, 25 bp, Rattus norvegicus
gactgcaacggcgtggtgtcactca

SEQ ID NO: 505867 - DNA, 25 bp, Rattus norvegicus
cgccgcagcagctacagtggctaca

SEQ ID NO: 505868 - DNA, 25 bp, Rattus norvegicus
cagctacagtggctacagcggctac

SEQ ID NO: 505869 - DNA, 25 bp, Rattus norvegicus
ggctacagccagtgcagccgctcgt

SEQ ID NO: 505870 - DNA, 25 bp, Rattus norvegicus
cggcgcagcgtgaagcgcaacagca

SEQ ID NO: 505871 - DNA, 25 bp, Rattus norvegicus
ctgagaatgagttcgcagacgatga

SEQ ID NO: 505872 - DNA, 25 bp, Rattus norvegicus
tccaggtcacggttcctactcgtct

SEQ ID NO: 505873 - DNA, 25 bp, Rattus norvegicus
ttccgccgcccgcagacggaccgga

SEQ ID NO: 505874 - DNA, 25 bp, Rattus norvegicus
atgcggcccgcaagcctcctcctgc

SEQ ID NO: 505875 - DNA, 25 bp, Rattus norvegicus
cctgagtcggatcgctgcagcagcg

SEQ ID NO: 505876 - DNA, 25 bp, Rattus norvegicus
acgagccctggcctgagtcggatcg

SEQ ID NO: 505877 - DNA, 25 bp, Rattus norvegicus
ggaaaggaagccctgctgggacttc

SEQ ID NO: 505878 - DNA, 25 bp, Rattus norvegicus
ggacaactctgatcccgggtgaaga

SEQ ID NO: 505879 - DNA, 25 bp, Rattus norvegicus
agcatgagcggacaactctgatccc

SEQ ID NO: 505880 - DNA, 25 bp, Rattus norvegicus
ggctgcagtgcagcccgggatctgt

SEQ ID NO: 505881 - DNA, 25 bp, Rattus norvegicus
ctcgtctccagcgtcttcaagagca

SEQ ID NO: 505882 - DNA, 25 bp, Rattus norvegicus
cccgactagcagttcggggcgggct

SEQ ID NO: 505883 - DNA, 25 bp, Rattus norvegicus
tccagcgtcttcaagagcatgagcg

SEQ ID NO: 505884 - DNA, 25 bp, Rattus norvegicus
cttcaagagcatgagcggacaactc

SEQ ID NO: 505885 - DNA, 25 bp, Rattus norvegicus
ggttcctactcgtctccagcgtctt

SEQ ID NO: 505886 - DNA, 25 bp, Rattus norvegicus
cgccgggctctctccgcggctctaa

SEQ ID NO: 505887 - DNA, 25 bp, Rattus norvegicus
tctccgcggctctaacactgccttc

SEQ ID NO: 505888 - DNA, 25 bp, Rattus norvegicus
ctccgcggctctaacactgccttcc

SEQ ID NO: 505889 - DNA, 25 bp, Rattus norvegicus
tccgcggctctaacactgccttccc

SEQ ID NO: 505890 - DNA, 25 bp, Rattus norvegicus
gcggctctaacactgccttcccctc

SEQ ID NO: 505891 - DNA, 25 bp, Rattus norvegicus
ggctctaacactgccttcccctcct

SEQ ID NO: 505892 - DNA, 25 bp, Rattus norvegicus
tctctccgcggctctaacactgcct

SEQ ID NO: 505893 - DNA, 25 bp, Rattus norvegicus
ctctctccgcggctctaacactgcc

SEQ ID NO: 505894 - DNA, 25 bp, Rattus norvegicus
gggctctctccgcggctctaacact

SEQ ID NO: 505895 - DNA, 25 bp, Rattus norvegicus
ctctccgcggctctaacactgcctt

SEQ ID NO: 505896 - DNA, 25 bp, Rattus norvegicus
gccgggctctctccgcggctctaac

SEQ ID NO: 505897 - DNA, 25 bp, Rattus norvegicus
ccgccgggctctctccgcggctcta

SEQ ID NO: 505898 - DNA, 25 bp, Rattus norvegicus
cgggctctctccgcggctctaacac

SEQ ID NO: 505899 - DNA, 25 bp, Rattus norvegicus
gccgccgggctctctccgcggctct

SEQ ID NO: 505900 - DNA, 25 bp, Rattus norvegicus
tgcaaaggccgaagacagtcgcaca

SEQ ID NO: 505901 - DNA, 25 bp, Rattus norvegicus
gatcgccgatcgtaggccaagtaga

SEQ ID NO: 505902 - DNA, 25 bp, Rattus norvegicus
ccataggactcgcttggatcgccga

SEQ ID NO: 505903 - DNA, 25 bp, Rattus norvegicus
ctagttacggatgtcgccaggctcc

SEQ ID NO: 505904 - DNA, 25 bp, Rattus norvegicus
cagcctcttggctgggaacaccata

SEQ ID NO: 505905 - DNA, 25 bp, Rattus norvegicus
cagcgaacgccctccatgtacggga

SEQ ID NO: 505906 - DNA, 25 bp, Rattus norvegicus
aagccattcggctggacttggcagc

SEQ ID NO: 505907 - DNA, 25 bp, Rattus norvegicus
tggatcgatcgcaccgccagaagcc

SEQ ID NO: 505908 - DNA, 25 bp, Rattus norvegicus
tccttctcctctggctggatcgatc

SEQ ID NO: 505909 - DNA, 25 bp, Rattus norvegicus
caaacacgaactggccgatgcgctc

SEQ ID NO: 505910 - DNA, 25 bp, Rattus norvegicus
gccgccttagcgtcgcgagcaaaca

SEQ ID NO: 505911 - DNA, 25 bp, Rattus norvegicus
ggcctcaagtaccaaggccgcctta

SEQ ID NO: 505912 - DNA, 25 bp, Rattus norvegicus
ggctgcaacaccagaagcgcatata

SEQ ID NO: 505913 - DNA, 25 bp, Rattus norvegicus
cagtcgcacacactacggagtcatc

SEQ ID NO: 505914 - DNA, 25 bp, Rattus norvegicus
cacagggcctggtctggaatacctg

SEQ ID NO: 505915 - DNA, 25 bp, Rattus norvegicus
gcgagtgactgactcagcctccttc

SEQ ID NO: 505916 - DNA, 25 bp, Rattus norvegicus
acccgtagggtctccggcttctctg

SEQ ID NO: 505917 - DNA, 25 bp, Rattus norvegicus
cttctctgcggggaacgttcctgag

SEQ ID NO: 505918 - DNA, 25 bp, Rattus norvegicus
ggaacgttcctgagctcccagcaag

SEQ ID NO: 505919 - DNA, 25 bp, Rattus norvegicus
agctcccagcaagcagggtggaccc

SEQ ID NO: 505920 - DNA, 25 bp, Rattus norvegicus
tgcttctcttctcgctcctggcgtt

SEQ ID NO: 505921 - DNA, 25 bp, Rattus norvegicus
gccaggcctatagcttcaccggatg

SEQ ID NO: 505922 - DNA, 25 bp, Rattus norvegicus
tcaccggatgggacatcgcgctcct

SEQ ID NO: 505923 - DNA, 25 bp, Rattus norvegicus
ttcctgccctgcttcgcgttcatgt

SEQ ID NO: 505924 - DNA, 25 bp, Rattus norvegicus
tcgcgttcatgtggctgctggacaa

SEQ ID NO: 505925 - DNA, 25 bp, Rattus norvegicus
ctgcgggcgtgtcccttctctggta

SEQ ID NO: 505926 - DNA, 25 bp, Rattus norvegicus
ttctctggtagtcggcgcctcccag

SEQ ID NO: 505927 - DNA, 25 bp, Rattus norvegicus
ccgaggactagagcggctccagctc

SEQ ID NO: 505928 - DNA, 25 bp, Rattus norvegicus
tgccggagcacgaacacgaagaacc

SEQ ID NO: 505929 - DNA, 25 bp, Rattus norvegicus
ctcgtttccatagcgacacagctgg

SEQ ID NO: 505930 - DNA, 25 bp, Rattus norvegicus
ggagccacggccctagcccaccgac

SEQ ID NO: 505931 - DNA, 25 bp, Rattus norvegicus
actggcggagcctgttggtgatctc

SEQ ID NO: 505932 - DNA, 25 bp, Rattus norvegicus
ctgttggtgatctcccgggcgctca

SEQ ID NO: 505933 - DNA, 25 bp, Rattus norvegicus
gcgctcagggacgagaaggttctct

SEQ ID NO: 505934 - DNA, 25 bp, Rattus norvegicus
ttctctgaggtaggaatctgaagta

SEQ ID NO: 505935 - DNA, 25 bp, Rattus norvegicus
gtagtgccaagtgccggagcacgaa

SEQ ID NO: 505936 - DNA, 25 bp, Rattus norvegicus
gaatctgaagtagtagccgcctcta

SEQ ID NO: 505937 - DNA, 25 bp, Rattus norvegicus
agtagtagccgcctctatcccgcgg

SEQ ID NO: 505938 - DNA, 25 bp, Rattus norvegicus
agtcgccatcgtgcttacggccacg

SEQ ID NO: 505939 - DNA, 25 bp, Rattus norvegicus
ccatcgtgcttacggccacgggaaa

SEQ ID NO: 505940 - DNA, 25 bp, Rattus norvegicus
gaaagtagtactcgtttccatagcg

SEQ ID NO: 505941 - DNA, 25 bp, Rattus norvegicus
cgacacagctggaggagacgcacca

SEQ ID NO: 505942 - DNA, 25 bp, Rattus norvegicus
gtgtgtggcccttctcaatgtcatc

SEQ ID NO: 505943 - DNA, 25 bp, Rattus norvegicus
gctccgtactgtgggtagaagccgc

SEQ ID NO: 505944 - DNA, 25 bp, Rattus norvegicus
tgtcatccacgtacttaagaaagtc

SEQ ID NO: 505945 - DNA, 25 bp, Rattus norvegicus
tgcaccggcaccctgcgcagtgtgt

SEQ ID NO: 505946 - DNA, 25 bp, Rattus norvegicus
acagcgactctgtggacgtccacca

SEQ ID NO: 505947 - DNA, 25 bp, Rattus norvegicus
cactggcgtcagagcacagcgactc

SEQ ID NO: 505948 - DNA, 25 bp, Rattus norvegicus
atagggcgtctccaccgagtatggc

SEQ ID NO: 505949 - DNA, 25 bp, Rattus norvegicus
atccagcagcgtgcgttccacgcgt

SEQ ID NO: 505950 - DNA, 25 bp, Rattus norvegicus
agagcccaggccacccgatgatggg

SEQ ID NO: 505951 - DNA, 25 bp, Rattus norvegicus
ccactggggtggacaagccagagct

SEQ ID NO: 505952 - DNA, 25 bp, Rattus norvegicus
tccagccatctgttcgcgcacgtgg

SEQ ID NO: 505953 - DNA, 25 bp, Rattus norvegicus
cttgcgcagggctccagccatctgt

SEQ ID NO: 505954 - DNA, 25 bp, Rattus norvegicus
acttaagaaagtccaggtccaggcg

SEQ ID NO: 505955 - DNA, 25 bp, Rattus norvegicus
gcgggtctccaaggctccgtactgt

SEQ ID NO: 505956 - DNA, 25 bp, Rattus norvegicus
tagtccctctagagaagcccagacc

SEQ ID NO: 505957 - DNA, 25 bp, Rattus norvegicus
ctggaagtcttccagctgcaggccg

SEQ ID NO: 505958 - DNA, 25 bp, Rattus norvegicus
cagggtcccggcttctacaagcctg

SEQ ID NO: 505959 - DNA, 25 bp, Rattus norvegicus
ggtctcagtcgactcctggccacaa

SEQ ID NO: 505960 - DNA, 25 bp, Rattus norvegicus
ctgagcgcgtcctagggtctcagtc

SEQ ID NO: 505961 - DNA, 25 bp, Rattus norvegicus
ccaagcctgtggagccaacgcggta

SEQ ID NO: 505962 - DNA, 25 bp, Rattus norvegicus
gaaatcccgatagtccctctagaga

SEQ ID NO: 505963 - DNA, 25 bp, Rattus norvegicus
gttaagacttggcagggaccagcta

SEQ ID NO: 505964 - DNA, 25 bp, Rattus norvegicus
tttgggcgcagatggttaagacttg

SEQ ID NO: 505965 - DNA, 25 bp, Rattus norvegicus
ctccggtttgcaaagtttgggcgca

SEQ ID NO: 505966 - DNA, 25 bp, Rattus norvegicus
ggacccagacgctccggtttgcaaa

SEQ ID NO: 505967 - DNA, 25 bp, Rattus norvegicus
gccggatgccttcccgccgttgagg

SEQ ID NO: 505968 - DNA, 25 bp, Rattus norvegicus
tggaggtgggttagaaatcccgata

SEQ ID NO: 505969 - DNA, 25 bp, Rattus norvegicus
tgcacgcgctttcgctgcggcctga

SEQ ID NO: 505970 - DNA, 25 bp, Rattus norvegicus
tagcggcccagcctggtgcagaact

SEQ ID NO: 505971 - DNA, 25 bp, Rattus norvegicus
tgggtctgcgttctaggagacaaca

SEQ ID NO: 505972 - DNA, 25 bp, Rattus norvegicus
ttctaggagacaacagcgtggtggc

SEQ ID NO: 505973 - DNA, 25 bp, Rattus norvegicus
aacaggaattagagatcagagtgct

SEQ ID NO: 505974 - DNA, 25 bp, Rattus norvegicus
cgacaggtgaatgccaaggtgagcc

SEQ ID NO: 505975 - DNA, 25 bp, Rattus norvegicus
cctcaccgccctcggagtcggaatc

SEQ ID NO: 505976 - DNA, 25 bp, Rattus norvegicus
tcggaatcccggtcctgtggcccga

SEQ ID NO: 505977 - DNA, 25 bp, Rattus norvegicus
ttcggcccaagtgggtctgcgttct

SEQ ID NO: 505978 - DNA, 25 bp, Rattus norvegicus
gcccgacgctgctcacgatgttagc

SEQ ID NO: 505979 - DNA, 25 bp, Rattus norvegicus
ctgctcacgatgttagccaggtgca

SEQ ID NO: 505980 - DNA, 25 bp, Rattus norvegicus
cgatgttagccaggtgcaccgctgt

SEQ ID NO: 505981 - DNA, 25 bp, Rattus norvegicus
caccgctgtccaggcgaagggcatg

SEQ ID NO: 505982 - DNA, 25 bp, Rattus norvegicus
gtgcagaactgctccgcggccaggc

SEQ ID NO: 505983 - DNA, 25 bp, Rattus norvegicus
ccaggtgcaccgctgtccaggcgaa

SEQ ID NO: 505984 - DNA, 25 bp, Rattus norvegicus
gaagtcctcggggagcccggcacgc

SEQ ID NO: 505985 - DNA, 25 bp, Rattus norvegicus
gtgcgaatttcctcaggatggcgga

SEQ ID NO: 505986 - DNA, 25 bp, Rattus norvegicus
atttcctcaggatggcggagggaaa

SEQ ID NO: 505987 - DNA, 25 bp, Rattus norvegicus
aaagaccgcaggagggttggaatgc

SEQ ID NO: 505988 - DNA, 25 bp, Rattus norvegicus
ggttggaatgcagcctagcactctc

SEQ ID NO: 505989 - DNA, 25 bp, Rattus norvegicus
gaatgcagcctagcactctcgagcc

SEQ ID NO: 505990 - DNA, 25 bp, Rattus norvegicus
accgacctgggatgcgcttcctcct

SEQ ID NO: 505991 - DNA, 25 bp, Rattus norvegicus
tccctcccagaacggccgtgaccgc

SEQ ID NO: 505992 - DNA, 25 bp, Rattus norvegicus
gaacggccgtgaccgcggccactct

SEQ ID NO: 505993 - DNA, 25 bp, Rattus norvegicus
ggccactctcgctacctgttgatct

SEQ ID NO: 505994 - DNA, 25 bp, Rattus norvegicus
actctcgctacctgttgatcttgtg

SEQ ID NO: 505995 - DNA, 25 bp, Rattus norvegicus
ctcgctacctgttgatcttgtgagc

SEQ ID NO: 505996 - DNA, 25 bp, Rattus norvegicus
tagcactctcgagcccggcccgcac

SEQ ID NO: 505997 - DNA, 25 bp, Rattus norvegicus
ctacctgttgatcttgtgagcgaag

SEQ ID NO: 505998 - DNA, 25 bp, Rattus norvegicus
ccacgaagttgctatggcccgcaca

SEQ ID NO: 505999 - DNA, 25 bp, Rattus norvegicus
tagcgttttgggctagccttgcagg

SEQ ID NO: 506000 - DNA, 25 bp, Rattus norvegicus
ttgctgcaagagtactagcgttttg

SEQ ID NO: 506001 - DNA, 25 bp, Rattus norvegicus
gctatggcccgcacagggctgcgac

SEQ ID NO: 506002 - DNA, 25 bp, Rattus norvegicus
aggatccgcccacgaagttgctatg

SEQ ID NO: 506003 - DNA, 25 bp, Rattus norvegicus
gcacacaaggatccgcccacgaagt

SEQ ID NO: 506004 - DNA, 25 bp, Rattus norvegicus
cggttggctggtgcacccgctcctg

SEQ ID NO: 506005 - DNA, 25 bp, Rattus norvegicus
gtcataatgcacaggcgaatcggcc

SEQ ID NO: 506006 - DNA, 25 bp, Rattus norvegicus
cccagttcagccctgtcataatgca

SEQ ID NO: 506007 - DNA, 25 bp, Rattus norvegicus
agaagagccagcagcactcactggg

SEQ ID NO: 506008 - DNA, 25 bp, Rattus norvegicus
tgcggggaacccagaagagccagca

SEQ ID NO: 506009 - DNA, 25 bp, Rattus norvegicus
accgttcacagagcttgcggggtgc

SEQ ID NO: 506010 - DNA, 25 bp, Rattus norvegicus
ggcgggaccacctcaagaggcgtca

SEQ ID NO: 506011 - DNA, 25 bp, Rattus norvegicus
cctgtcggtgacaggattgctgcaa

SEQ ID NO: 506012 - DNA, 25 bp, Rattus norvegicus
atctgtctgactgttctgcggcgcc

SEQ ID NO: 506013 - DNA, 25 bp, Rattus norvegicus
ggctgcccatcctggacacgcagga

SEQ ID NO: 506014 - DNA, 25 bp, Rattus norvegicus
gatcccttccctgcgggtccattgc

SEQ ID NO: 506015 - DNA, 25 bp, Rattus norvegicus
atggacgtgggtctttccgatccct

SEQ ID NO: 506016 - DNA, 25 bp, Rattus norvegicus
ataccatggacgtgggtctttccga

SEQ ID NO: 506017 - DNA, 25 bp, Rattus norvegicus
accataccatggacgtgggtctttc

SEQ ID NO: 506018 - DNA, 25 bp, Rattus norvegicus
tggacacgcaggaccataccatgga

SEQ ID NO: 506019 - DNA, 25 bp, Rattus norvegicus
tctgactgttctgcggcgccgggac

SEQ ID NO: 506020 - DNA, 25 bp, Rattus norvegicus
ccagcgatctgtctgactgttctgc

SEQ ID NO: 506021 - DNA, 25 bp, Rattus norvegicus
ctgaccagcgatctgtctgactgtt

SEQ ID NO: 506022 - DNA, 25 bp, Rattus norvegicus
ttcttctcgttgtccgcctgcctga

SEQ ID NO: 506023 - DNA, 25 bp, Rattus norvegicus
gcaagtccggcggtccaggcttctt

SEQ ID NO: 506024 - DNA, 25 bp, Rattus norvegicus
gtccaggcttcttctcgttgtccgc

SEQ ID NO: 506025 - DNA, 25 bp, Rattus norvegicus
cctagacagggtgagggagaagcgt

SEQ ID NO: 506026 - DNA, 25 bp, Rattus norvegicus
tcttcctgacgcgaaggcctcttca

SEQ ID NO: 506027 - DNA, 25 bp, Rattus norvegicus
cgggcccaagatgagatctcgcttc

SEQ ID NO: 506028 - DNA, 25 bp, Rattus norvegicus
ggacctggctatgcgtcacccaatg

SEQ ID NO: 506029 - DNA, 25 bp, Rattus norvegicus
taaccggagggctggacctggctat

SEQ ID NO: 506030 - DNA, 25 bp, Rattus norvegicus
accattggcggctccaggtaaccgg

SEQ ID NO: 506031 - DNA, 25 bp, Rattus norvegicus
agtacacccgcagcgcgagaccatt

SEQ ID NO: 506032 - DNA, 25 bp, Rattus norvegicus
tcttcagagcctgcctctcagtaca

SEQ ID NO: 506033 - DNA, 25 bp, Rattus norvegicus
gacgcgaaggcctcttcagagcctg

SEQ ID NO: 506034 - DNA, 25 bp, Rattus norvegicus
ctctgcgcagacgtcgctgctgttt

SEQ ID NO: 506035 - DNA, 25 bp, Rattus norvegicus
cagggcccggagaggatagcaaccc

SEQ ID NO: 506036 - DNA, 25 bp, Rattus norvegicus
tactaagcaaatggcggaggcgctg

SEQ ID NO: 506037 - DNA, 25 bp, Rattus norvegicus
acagcggtactaagcaaatggcgga

SEQ ID NO: 506038 - DNA, 25 bp, Rattus norvegicus
aagatgagatctcgcttctgattgg

SEQ ID NO: 506039 - DNA, 25 bp, Rattus norvegicus
tcgctgctgtttgccgcggctcttg

SEQ ID NO: 506040 - DNA, 25 bp, Rattus norvegicus
ccaagtcttccaagcgctgggtgaa

SEQ ID NO: 506041 - DNA, 25 bp, Rattus norvegicus
ccagtggcacaaaactcgacgtgtc

SEQ ID NO: 506042 - DNA, 25 bp, Rattus norvegicus
ccaggctatgacattcaggaagctc

SEQ ID NO: 506043 - DNA, 25 bp, Rattus norvegicus
ggagttcgccgcttcctcccagaaa

SEQ ID NO: 506044 - DNA, 25 bp, Rattus norvegicus
gtagttgaagcccatcccggagttc

SEQ ID NO: 506045 - DNA, 25 bp, Rattus norvegicus
gtcgcctgtgcagatccgataatta

SEQ ID NO: 506046 - DNA, 25 bp, Rattus norvegicus
tcaggggagtccaggtctatcttcc

SEQ ID NO: 506047 - DNA, 25 bp, Rattus norvegicus
aaagtggcgcctctagaactacgga

SEQ ID NO: 506048 - DNA, 25 bp, Rattus norvegicus
gcaggcgacatgactttcttgattc

SEQ ID NO: 506049 - DNA, 25 bp, Rattus norvegicus
gagtttcggatttctttggcccata

SEQ ID NO: 506050 - DNA, 25 bp, Rattus norvegicus
ccatatcgtggggacaagagcattt

SEQ ID NO: 506051 - DNA, 25 bp, Rattus norvegicus
cccggagcccattgatggagaatta

SEQ ID NO: 506052 - DNA, 25 bp, Rattus norvegicus
tccaggctgagggaaccattccagg

SEQ ID NO: 506053 - DNA, 25 bp, Rattus norvegicus
gccttcgaggggtcttgcaaaagtg

SEQ ID NO: 506054 - DNA, 25 bp, Rattus norvegicus
agcacacagccggtcaccgcattga

SEQ ID NO: 506055 - DNA, 25 bp, Rattus norvegicus
tcgcgctgagaccacatggaaccca

SEQ ID NO: 506056 - DNA, 25 bp, Rattus norvegicus
acatggaacccaggcactcgcagga

SEQ ID NO: 506057 - DNA, 25 bp, Rattus norvegicus
ccggtcgcgctgagaccacatggaa

SEQ ID NO: 506058 - DNA, 25 bp, Rattus norvegicus
ccgcattgaactgggccacggtggc

SEQ ID NO: 506059 - DNA, 25 bp, Rattus norvegicus
ggtcaccgcattgaactgggccacg

SEQ ID NO: 506060 - DNA, 25 bp, Rattus norvegicus
agccggtcaccgcattgaactgggc

SEQ ID NO: 506061 - DNA, 25 bp, Rattus norvegicus
gttgtgccctctgcgaggccgccag

SEQ ID NO: 506062 - DNA, 25 bp, Rattus norvegicus
ttcaatgcgttgtgccctctgcgag

SEQ ID NO: 506063 - DNA, 25 bp, Rattus norvegicus
ccatttttcaatgcgttgtgccctc

SEQ ID NO: 506064 - DNA, 25 bp, Rattus norvegicus
ggcgatgcgaatccatttttcaatg

SEQ ID NO: 506065 - DNA, 25 bp, Rattus norvegicus
cctgggcgatgcgaatccatttttc

SEQ ID NO: 506066 - DNA, 25 bp, Rattus norvegicus
ccgacgcacacctgggcgatgcgaa

SEQ ID NO: 506067 - DNA, 25 bp, Rattus norvegicus
cacacctgggcgatgcgaatccatt

SEQ ID NO: 506068 - DNA, 25 bp, Rattus norvegicus
cagggatcatatcaaagaccgaatc

SEQ ID NO: 506069 - DNA, 25 bp, Rattus norvegicus
ctggcaggtccgactgtcatgaatg

SEQ ID NO: 506070 - DNA, 25 bp, Rattus norvegicus
tgtcatgaatgcagcgccgttcctc

SEQ ID NO: 506071 - DNA, 25 bp, Rattus norvegicus
accacctggttctctgctgacgagc

SEQ ID NO: 506072 - DNA, 25 bp, Rattus norvegicus
tctctgctgacgagcgagccactgc

SEQ ID NO: 506073 - DNA, 25 bp, Rattus norvegicus
tgccaccgcgatcgcttcgatgctg

SEQ ID NO: 506074 - DNA, 25 bp, Rattus norvegicus
gatcgcttcgatgctgagctatctc

SEQ ID NO: 506075 - DNA, 25 bp, Rattus norvegicus
gctgagctatctcggtggagcatgc

SEQ ID NO: 506076 - DNA, 25 bp, Rattus norvegicus
gagcatgcgcgttcctcgtcgggcc

SEQ ID NO: 506077 - DNA, 25 bp, Rattus norvegicus
ggttccggcgcccaatgggacagca

SEQ ID NO: 506078 - DNA, 25 bp, Rattus norvegicus
aatgggacagcaccgctcctcactg

SEQ ID NO: 506079 - DNA, 25 bp, Rattus norvegicus
tgcggagagtagcagggatcatatc

SEQ ID NO: 506080 - DNA, 25 bp, Rattus norvegicus
agaccgaatcgagactgtgctatac

SEQ ID NO: 506081 - DNA, 25 bp, Rattus norvegicus
gcaccgctcctcactgcggagagta

SEQ ID NO: 506082 - DNA, 25 bp, Rattus norvegicus
ttggcccgctttcccgaacatagta

SEQ ID NO: 506083 - DNA, 25 bp, Rattus norvegicus
acggcgccatcctcggtctcctctc

SEQ ID NO: 506084 - DNA, 25 bp, Rattus norvegicus
agtcctgtagtggtgcctggacgtg

SEQ ID NO: 506085 - DNA, 25 bp, Rattus norvegicus
gctcagggacgtcccaccggcctta

SEQ ID NO: 506086 - DNA, 25 bp, Rattus norvegicus
cctgactttatgtttggcccgcttt

SEQ ID NO: 506087 - DNA, 25 bp, Rattus norvegicus
tgggctcccaggtgggtccctcttc

SEQ ID NO: 506088 - DNA, 25 bp, Rattus norvegicus
tgtttggcccgctttcccgaacata

SEQ ID NO: 506089 - DNA, 25 bp, Rattus norvegicus
ccgctttcccgaacatagtaggcga

SEQ ID NO: 506090 - DNA, 25 bp, Rattus norvegicus
ttcccgaacatagtaggcgagactc

SEQ ID NO: 506091 - DNA, 25 bp, Rattus norvegicus
ccgaacatagtaggcgagactcggg

SEQ ID NO: 506092 - DNA, 25 bp, Rattus norvegicus
acccctctggggttgagcgctggct

SEQ ID NO: 506093 - DNA, 25 bp, Rattus norvegicus
gccgccgcagggagacgctgtacac

SEQ ID NO: 506094 - DNA, 25 bp, Rattus norvegicus
gagacgctgtacacggcgccatcct

SEQ ID NO: 506095 - DNA, 25 bp, Rattus norvegicus
tgactttatgtttggcccgctttcc

SEQ ID NO: 506096 - DNA, 25 bp, Rattus norvegicus
tgccgtgctctaatcgtctccactt

SEQ ID NO: 506097 - DNA, 25 bp, Rattus norvegicus
ccacttctttatggctctgctcaag

SEQ ID NO: 506098 - DNA, 25 bp, Rattus norvegicus
atgctcgctcactgccgtgctctaa

SEQ ID NO: 506099 - DNA, 25 bp, Rattus norvegicus
cgtgctctaatcgtctccacttctt

SEQ ID NO: 506100 - DNA, 25 bp, Rattus norvegicus
gtgctctaatcgtctccacttcttt

SEQ ID NO: 506101 - DNA, 25 bp, Rattus norvegicus
ttctttatggctctgctcaagcccg

SEQ ID NO: 506102 - DNA, 25 bp, Rattus norvegicus
gcccgcacccatgctcgctcactgc

SEQ ID NO: 506103 - DNA, 25 bp, Rattus norvegicus
gctcactgccgtgctctaatcgtct

SEQ ID NO: 506104 - DNA, 25 bp, Rattus norvegicus
acttctttatggctctgctcaagcc

SEQ ID NO: 506105 - DNA, 25 bp, Rattus norvegicus
ccatgctcgctcactgccgtgctct

SEQ ID NO: 506106 - DNA, 25 bp, Rattus norvegicus
gccgtgctctaatcgtctccacttc

SEQ ID NO: 506107 - DNA, 25 bp, Rattus norvegicus
ctccacttctttatggctctgctca

SEQ ID NO: 506108 - DNA, 25 bp, Rattus norvegicus
tttatggctctgctcaagcccgcac

SEQ ID NO: 506109 - DNA, 25 bp, Rattus norvegicus
ctttatggctctgctcaagcccgca

SEQ ID NO: 506110 - DNA, 25 bp, Rattus norvegicus
aagtgacgtaccctagagcgttccg

SEQ ID NO: 506111 - DNA, 25 bp, Rattus norvegicus
agctctcactggctgactccgttcg

SEQ ID NO: 506112 - DNA, 25 bp, Rattus norvegicus
gtcccgcaaggaggcccagcaaaag

SEQ ID NO: 506113 - DNA, 25 bp, Rattus norvegicus
ccagcaaaagagaggcgcgatcgtt

SEQ ID NO: 506114 - DNA, 25 bp, Rattus norvegicus
gcgatcgtttcggtcacgtgacctc

SEQ ID NO: 506115 - DNA, 25 bp, Rattus norvegicus
gttcgccggcagtggccagaaactc

SEQ ID NO: 506116 - DNA, 25 bp, Rattus norvegicus
ccagaaactcgccacttccaagatg

SEQ ID NO: 506117 - DNA, 25 bp, Rattus norvegicus
ttccaagatggaggcacgttacgcc

SEQ ID NO: 506118 - DNA, 25 bp, Rattus norvegicus
cgttacgccgccattaagcgctaca

SEQ ID NO: 506119 - DNA, 25 bp, Rattus norvegicus
gcgctacactttcaatcgagttctc

SEQ ID NO: 506120 - DNA, 25 bp, Rattus norvegicus
ctctaaggctaggtcttcacgttcc

SEQ ID NO: 506121 - DNA, 25 bp, Rattus norvegicus
gttcctactcaagatggccgcctca

SEQ ID NO: 506122 - DNA, 25 bp, Rattus norvegicus
cgttcgccaagcgtggtgagcaaaa

SEQ ID NO: 506123 - DNA, 25 bp, Rattus norvegicus
gcgtcctcgagttgccgttcgccaa

SEQ ID NO: 506124 - DNA, 25 bp, Rattus norvegicus
agtgaccattcttgtgtgcccggcg

SEQ ID NO: 506125 - DNA, 25 bp, Rattus norvegicus
ggagtacctacagtgaccattcttg

SEQ ID NO: 506126 - DNA, 25 bp, Rattus norvegicus
agttgcgggcgctttcaaggtcacc

SEQ ID NO: 506127 - DNA, 25 bp, Rattus norvegicus
caggccctatggagtgctgctgcag

SEQ ID NO: 506128 - DNA, 25 bp, Rattus norvegicus
tcgaggacgaagatgcccgcctctc

SEQ ID NO: 506129 - DNA, 25 bp, Rattus norvegicus
ctcccagagaatgcggtgtggcgtt

SEQ ID NO: 506130 - DNA, 25 bp, Rattus norvegicus
ttacccggaccaacagtaggcgatc

SEQ ID NO: 506131 - DNA, 25 bp, Rattus norvegicus
agtaggcgatcgtagccctcgtcct

SEQ ID NO: 506132 - DNA, 25 bp, Rattus norvegicus
cacagccttccagtgaggagccaca

SEQ ID NO: 506133 - DNA, 25 bp, Rattus norvegicus
tgaggagccacaaggaccaccgggt

SEQ ID NO: 506134 - DNA, 25 bp, Rattus norvegicus
agaactccagatgcggctctggcca

SEQ ID NO: 506135 - DNA, 25 bp, Rattus norvegicus
tcccgtgttcgtctcgcggcgacaa

SEQ ID NO: 506136 - DNA, 25 bp, Rattus norvegicus
gcggcgacaagggagtacctacagt

SEQ ID NO: 506137 - DNA, 25 bp, Rattus norvegicus
ggaactgacccgagcctgcggatgc

SEQ ID NO: 506138 - DNA, 25 bp, Rattus norvegicus
gggcgccactcactgcaagggcgtc

SEQ ID NO: 506139 - DNA, 25 bp, Rattus norvegicus
aagcgcttcccgcagcgatcgcatg

SEQ ID NO: 506140 - DNA, 25 bp, Rattus norvegicus
cgcagcgatcgcatgtgaagttgta

SEQ ID NO: 506141 - DNA, 25 bp, Rattus norvegicus
cgcatgtgaagttgtactgtacctc

SEQ ID NO: 506142 - DNA, 25 bp, Rattus norvegicus
agttgtactgtacctctgctgtgtg

SEQ ID NO: 506143 - DNA, 25 bp, Rattus norvegicus
tacctctgctgtgtgcttcttcatg

SEQ ID NO: 506144 - DNA, 25 bp, Rattus norvegicus
acaggtcaccgtgggttgagcctcc

SEQ ID NO: 506145 - DNA, 25 bp, Rattus norvegicus
gtgtgcttcttcatgtgccaattga

SEQ ID NO: 506146 - DNA, 25 bp, Rattus norvegicus
tgccaattgagcgaagcacgctgtc

SEQ ID NO: 506147 - DNA, 25 bp, Rattus norvegicus
gcgaagcacgctgtcgacactggta

SEQ ID NO: 506148 - DNA, 25 bp, Rattus norvegicus
gtcgacactggtacccgcaaatctc

SEQ ID NO: 506149 - DNA, 25 bp, Rattus norvegicus
gcaaatctcgcacctgcatggcagg

SEQ ID NO: 506150 - DNA, 25 bp, Rattus norvegicus
agaggggcccaagacaggtcaccgt

SEQ ID NO: 506151 - DNA, 25 bp, Rattus norvegicus
tctcgcacctgcatggcaggagagg

SEQ ID NO: 506152 - DNA, 25 bp, Rattus norvegicus
ttgttaggagcctcgaccggaagtg

SEQ ID NO: 506153 - DNA, 25 bp, Rattus norvegicus
cgctggccacgctccagcgaaatga

SEQ ID NO: 506154 - DNA, 25 bp, Rattus norvegicus
agcctgagaccgaggcccgccagga

SEQ ID NO: 506155 - DNA, 25 bp, Rattus norvegicus
tctgggctgcctaagcctgagaccg

SEQ ID NO: 506156 - DNA, 25 bp, Rattus norvegicus
agtttggcgtcgctccagccgctac

SEQ ID NO: 506157 - DNA, 25 bp, Rattus norvegicus
tacggcgtctcaagtccacccaggg

SEQ ID NO: 506158 - DNA, 25 bp, Rattus norvegicus
gtcgtacttcttccgggactcgagc

SEQ ID NO: 506159 - DNA, 25 bp, Rattus norvegicus
tagtctgcgccgtcgggagatttct

SEQ ID NO: 506160 - DNA, 25 bp, Rattus norvegicus
tcgggagatttctcacagggtcttc

SEQ ID NO: 506161 - DNA, 25 bp, Rattus norvegicus
cgcggcgccaaacggggacaactag

SEQ ID NO: 506162 - DNA, 25 bp, Rattus norvegicus
ggacaactagccaaagctgcgcatg

SEQ ID NO: 506163 - DNA, 25 bp, Rattus norvegicus
tccagcgaaatgaggtaagcggcga

SEQ ID NO: 506164 - DNA, 25 bp, Rattus norvegicus
gctgcgcatgcgcatagtccgtccg

SEQ ID NO: 506165 - DNA, 25 bp, Rattus norvegicus
gccgcacgtcgtacttcttccggga

SEQ ID NO: 506166 - DNA, 25 bp, Rattus norvegicus
tggctctatgccctgcgggcgataa

SEQ ID NO: 506167 - DNA, 25 bp, Rattus norvegicus
ccacctacaggggtccagggatcag

SEQ ID NO: 506168 - DNA, 25 bp, Rattus norvegicus
ataaagagaagagcgccggtccgcc

SEQ ID NO: 506169 - DNA, 25 bp, Rattus norvegicus
ttgttacagcgcatgcgccgtcccg

SEQ ID NO: 506170 - DNA, 25 bp, Rattus norvegicus
cctgtctccgcgcaattgttacagc

SEQ ID NO: 506171 - DNA, 25 bp, Rattus norvegicus
aatgggcgtgtagaccctacctcca

SEQ ID NO: 506172 - DNA, 25 bp, Rattus norvegicus
ctccttaaccaagtaaatgggcgtg

SEQ ID NO: 506173 - DNA, 25 bp, Rattus norvegicus
aatatcgctttgtgtttcccgccca

SEQ ID NO: 506174 - DNA, 25 bp, Rattus norvegicus
caggagacgctaacttccggccctt

SEQ ID NO: 506175 - DNA, 25 bp, Rattus norvegicus
agccaaggctgcttcacccaggaga

SEQ ID NO: 506176 - DNA, 25 bp, Rattus norvegicus
catgcggtcgtcctcagagccatgc

SEQ ID NO: 506177 - DNA, 25 bp, Rattus norvegicus
caagccatggtgtcctgaggcgacc

SEQ ID NO: 506178 - DNA, 25 bp, Rattus norvegicus
agcctgcgaacaagccatggtgtcc

SEQ ID NO: 506179 - DNA, 25 bp, Rattus norvegicus
ccctgcgggcgataaagagaagagc

SEQ ID NO: 506180 - DNA, 25 bp, Rattus norvegicus
ccgcccagcatgagacatgctctga

SEQ ID NO: 506181 - DNA, 25 bp, Rattus norvegicus
cccagggacaggatcgcctgaactg

SEQ ID NO: 506182 - DNA, 25 bp, Rattus norvegicus
aatagagcgtgacgtcccagggaca

SEQ ID NO: 506183 - DNA, 25 bp, Rattus norvegicus
cccagatatggcgtctcagggaact

SEQ ID NO: 506184 - DNA, 25 bp, Rattus norvegicus
agcagatcgactggggttacggttt

SEQ ID NO: 506185 - DNA, 25 bp, Rattus norvegicus
ggacacgcggcgacttctccgaact

SEQ ID NO: 506186 - DNA, 25 bp, Rattus norvegicus
ctgagtcagagctacggaaagcgtt

SEQ ID NO: 506187 - DNA, 25 bp, Rattus norvegicus
ctacggaaagcgttgcagcagggct

SEQ ID NO: 506188 - DNA, 25 bp, Rattus norvegicus
cctcagaccggacaggacaagcgga

SEQ ID NO: 506189 - DNA, 25 bp, Rattus norvegicus
tcagggttccgggacacccagagcc

SEQ ID NO: 506190 - DNA, 25 bp, Rattus norvegicus
ccagagccctcactgtggttctcag

SEQ ID NO: 506191 - DNA, 25 bp, Rattus norvegicus
ttctcagtggagaaatgggacacgc

SEQ ID NO: 506192 - DNA, 25 bp, Rattus norvegicus
ttctccgaacttctgggcgagcgcg

SEQ ID NO: 506193 - DNA, 25 bp, Rattus norvegicus
ccaaggtgcagagacaacggagagc

SEQ ID NO: 506194 - DNA, 25 bp, Rattus norvegicus
tggtacgtcacagacaaaggcctta

SEQ ID NO: 506195 - DNA, 25 bp, Rattus norvegicus
gacaaaggccttagcaggaccgtga

SEQ ID NO: 506196 - DNA, 25 bp, Rattus norvegicus
cttagcaggaccgtgaaagcccgcc

SEQ ID NO: 506197 - DNA, 25 bp, Rattus norvegicus
cccttacctttgtctgttcgcctga

SEQ ID NO: 506198 - DNA, 25 bp, Rattus norvegicus
caagatggtggtatgctggtacgtc

SEQ ID NO: 506199 - DNA, 25 bp, Rattus norvegicus
cggttccagattccaagatggtggt

SEQ ID NO: 506200 - DNA, 25 bp, Rattus norvegicus
caactcgcaacaggacgcccgggat

SEQ ID NO: 506201 - DNA, 25 bp, Rattus norvegicus
gagtaccctcgcaactcgcaacagg

SEQ ID NO: 506202 - DNA, 25 bp, Rattus norvegicus
tggcgggactcgagtaccctcgcaa

SEQ ID NO: 506203 - DNA, 25 bp, Rattus norvegicus
aacgtggtcctagccaggcaggagc

SEQ ID NO: 506204 - DNA, 25 bp, Rattus norvegicus
ccagtgtccaacgtggtcctagcca

SEQ ID NO: 506205 - DNA, 25 bp, Rattus norvegicus
ctaaggaccgtgacctgcgtgcgcc

SEQ ID NO: 506206 - DNA, 25 bp, Rattus norvegicus
gcttcggtctaaggaccgtgacctg

SEQ ID NO: 506207 - DNA, 25 bp, Rattus norvegicus
ttcgcctgattgcacggttctcacc

SEQ ID NO: 506208 - DNA, 25 bp, Rattus norvegicus
tcgacggctcaagttcaggaacagg

SEQ ID NO: 506209 - DNA, 25 bp, Rattus norvegicus
agtcctcaggggtcatggttcacag

SEQ ID NO: 506210 - DNA, 25 bp, Rattus norvegicus
tcatggttcacagcgcccgcagagt

SEQ ID NO: 506211 - DNA, 25 bp, Rattus norvegicus
cccaagcctcacgagtggactgcta

SEQ ID NO: 506212 - DNA, 25 bp, Rattus norvegicus
aagaagtgagtacaggctcggcgca

SEQ ID NO: 506213 - DNA, 25 bp, Rattus norvegicus
ctccgcaccggagtcggtaggctac

SEQ ID NO: 506214 - DNA, 25 bp, Rattus norvegicus
gctaccacggccgttcaaaatttga

SEQ ID NO: 506215 - DNA, 25 bp, Rattus norvegicus
aatttgaatttcagcgcccgggacg

SEQ ID NO: 506216 - DNA, 25 bp, Rattus norvegicus
ctggtcacgtgagtcggccacgttc

SEQ ID NO: 506217 - DNA, 25 bp, Rattus norvegicus
tggagacgcttctgccgttgaactg

SEQ ID NO: 506218 - DNA, 25 bp, Rattus norvegicus
tgccgttgaactgcctaaggagatc

SEQ ID NO: 506219 - DNA, 25 bp, Rattus norvegicus
taaggagatcgacctgctgtcaggc

SEQ ID NO: 506220 - DNA, 25 bp, Rattus norvegicus
agcacgtcctttcctggttctgtca

SEQ ID NO: 506221 - DNA, 25 bp, Rattus norvegicus
tctcacctcggtgaacgggtccatc

SEQ ID NO: 506222 - DNA, 25 bp, Rattus norvegicus
tgaactggagcacgggagccaacgc

SEQ ID NO: 506223 - DNA, 25 bp, Rattus norvegicus
tgaggccacgtgacgcaggaaccct

SEQ ID NO: 506224 - DNA, 25 bp, Rattus norvegicus
ggcccacgtgattgaggccacgtga

SEQ ID NO: 506225 - DNA, 25 bp, Rattus norvegicus
cacgggagccaacgctgcggactgc

SEQ ID NO: 506226 - DNA, 25 bp, Rattus norvegicus
gactgcccgctacgcatcgtgagtc

SEQ ID NO: 506227 - DNA, 25 bp, Rattus norvegicus
tacgcatcgtgagtcgcgctgaacc

SEQ ID NO: 506228 - DNA, 25 bp, Rattus norvegicus
agtcgcgctgaaccctttgggcgca

SEQ ID NO: 506229 - DNA, 25 bp, Rattus norvegicus
cgctgaaccctttgggcgcaggccg

SEQ ID NO: 506230 - DNA, 25 bp, Rattus norvegicus
agcagtggtaatcggaagccggcca

SEQ ID NO: 506231 - DNA, 25 bp, Rattus norvegicus
aggccgcaccacgtgactcagatga

SEQ ID NO: 506232 - DNA, 25 bp, Rattus norvegicus
tgactcagatgaaggggctatcacg

SEQ ID NO: 506233 - DNA, 25 bp, Rattus norvegicus
gctatcacgtggctgctaggcccac

SEQ ID NO: 506234 - DNA, 25 bp, Rattus norvegicus
gctgctaggcccacgtgattgaggc

SEQ ID NO: 506235 - DNA, 25 bp, Rattus norvegicus
cccggagcagtggtaatcggaagcc

SEQ ID NO: 506236 - DNA, 25 bp, Rattus norvegicus
ctcctactgtgcttcgtgctcctgt

SEQ ID NO: 506237 - DNA, 25 bp, Rattus norvegicus
aagactgagacgttcggtgtcaatc

SEQ ID NO: 506238 - DNA, 25 bp, Rattus norvegicus
aacgccattatttgagagaagactg

SEQ ID NO: 506239 - DNA, 25 bp, Rattus norvegicus
cggggaggctgaattacaaacgcca

SEQ ID NO: 506240 - DNA, 25 bp, Rattus norvegicus
tccaggctgcgagtttttacgtatc

SEQ ID NO: 506241 - DNA, 25 bp, Rattus norvegicus
ccgatttccaagctccaggctgcga

SEQ ID NO: 506242 - DNA, 25 bp, Rattus norvegicus
tgaccttgtctgtttcccgcgtctc

SEQ ID NO: 506243 - DNA, 25 bp, Rattus norvegicus
gaccacttcgctttatctgaccttg

SEQ ID NO: 506244 - DNA, 25 bp, Rattus norvegicus
gccagccgggagaatgcatctgtcc

SEQ ID NO: 506245 - DNA, 25 bp, Rattus norvegicus
tttacctgcaagctacggcccggca

SEQ ID NO: 506246 - DNA, 25 bp, Rattus norvegicus
cccgagctgagagcgtttacctgca

SEQ ID NO: 506247 - DNA, 25 bp, Rattus norvegicus
ggctctggaaaaagcagggctaccc

SEQ ID NO: 506248 - DNA, 25 bp, Rattus norvegicus
gaagtgacgcgttcacctgccgagc

SEQ ID NO: 506249 - DNA, 25 bp, Rattus norvegicus
ggcagcttaccctagggaccacttc

SEQ ID NO: 506250 - DNA, 25 bp, Rattus norvegicus
gggaagaaggcaggatcgtctccta

SEQ ID NO: 506251 - DNA, 25 bp, Rattus norvegicus
cgggacgatgctggagtctattcgc

SEQ ID NO: 506252 - DNA, 25 bp, Rattus norvegicus
tatctggtcccgagctaccttacgg

SEQ ID NO: 506253 - DNA, 25 bp, Rattus norvegicus
agacgtggtcctccaccttgcgctg

SEQ ID NO: 506254 - DNA, 25 bp, Rattus norvegicus
aaacaccctagctgcggcggaccag

SEQ ID NO: 506255 - DNA, 25 bp, Rattus norvegicus
accctctggaacagacgtggtcctc

SEQ ID NO: 506256 - DNA, 25 bp, Rattus norvegicus
tgaggccaggtggaaccaccctctg

SEQ ID NO: 506257 - DNA, 25 bp, Rattus norvegicus
atcgtctcctagcaacggggttgca

SEQ ID NO: 506258 - DNA, 25 bp, Rattus norvegicus
gcctccagcggcgagcacgtttggt

SEQ ID NO: 506259 - DNA, 25 bp, Rattus norvegicus
ggtgtcaatcgcaggagcgcctcca

SEQ ID NO: 506260 - DNA, 25 bp, Rattus norvegicus
tctccctatgagcagggtgtcaatc

SEQ ID NO: 506261 - DNA, 25 bp, Rattus norvegicus
agttgtagttcgcttcccttctctc

SEQ ID NO: 506262 - DNA, 25 bp, Rattus norvegicus
tctattcgcgtaacgggtgagtgca

SEQ ID NO: 506263 - DNA, 25 bp, Rattus norvegicus
cgacgtcaccgtggcgggttcttag

SEQ ID NO: 506264 - DNA, 25 bp, Rattus norvegicus
acaggctcacctagcagcagcgtgc

SEQ ID NO: 506265 - DNA, 25 bp, Rattus norvegicus
ttgccagggcaacaacggaacgccg

SEQ ID NO: 506266 - DNA, 25 bp, Rattus norvegicus
gaaaagtcggagagagctgttaaca

SEQ ID NO: 506267 - DNA, 25 bp, Rattus norvegicus
gcggggacacacttgagagtctcga

SEQ ID NO: 506268 - DNA, 25 bp, Rattus norvegicus
cggccagccgagcagctgttgatct

SEQ ID NO: 506269 - DNA, 25 bp, Rattus norvegicus
ccgctctcgggttgccagggcaaca

SEQ ID NO: 506270 - DNA, 25 bp, Rattus norvegicus
actggcggtcgctcactctggccgg

SEQ ID NO: 506271 - DNA, 25 bp, Rattus norvegicus
gatccgcggactggcggtcgctcac

SEQ ID NO: 506272 - DNA, 25 bp, Rattus norvegicus
atcttggcatagtcgcgcccgctag

SEQ ID NO: 506273 - DNA, 25 bp, Rattus norvegicus
ctagcagcagcgtgctccaggtccg

SEQ ID NO: 506274 - DNA, 25 bp, Rattus norvegicus
gagctgttaacaggctcacctagca

SEQ ID NO: 506275 - DNA, 25 bp, Rattus norvegicus
tgatctcggggccatgtttttaaaa

SEQ ID NO: 506276 - DNA, 25 bp, Rattus norvegicus
cgagcagctgttgatctcggggcca

SEQ ID NO: 506277 - DNA, 25 bp, Rattus norvegicus
gcgcctgcaggaccatcttggcata

SEQ ID NO: 506278 - DNA, 25 bp, Rattus norvegicus
cgtggaaaggatacaggtaggcgcc

SEQ ID NO: 506279 - DNA, 25 bp, Rattus norvegicus
cgcccgccgctgtcccgggcgccaa

SEQ ID NO: 506280 - DNA, 25 bp, Rattus norvegicus
cttcacctaagtgccgcccgcatgg

SEQ ID NO: 506281 - DNA, 25 bp, Rattus norvegicus
cgtcacgggcgtcgcaggctcggct

SEQ ID NO: 506282 - DNA, 25 bp, Rattus norvegicus
cgcatggccgctcggccttcctggt

SEQ ID NO: 506283 - DNA, 25 bp, Rattus norvegicus
cctggtcctctcctcggcgctccgg

SEQ ID NO: 506284 - DNA, 25 bp, Rattus norvegicus
tgcagcagtcctagcttcgcagcgg

SEQ ID NO: 506285 - DNA, 25 bp, Rattus norvegicus
tcttgacaaccaaccgacgccgcgt

SEQ ID NO: 506286 - DNA, 25 bp, Rattus norvegicus
gacgccgcgtccttcgcgacggaaa

SEQ ID NO: 506287 - DNA, 25 bp, Rattus norvegicus
tccttcgcgacggaaaccaggcgga

SEQ ID NO: 506288 - DNA, 25 bp, Rattus norvegicus
tcgcgacggaaaccaggcggaacgc

SEQ ID NO: 506289 - DNA, 25 bp, Rattus norvegicus
atgaggtgccggctggttcaaagcc

SEQ ID NO: 506290 - DNA, 25 bp, Rattus norvegicus
gggcctgcccgccagcatccttcac

SEQ ID NO: 506291 - DNA, 25 bp, Rattus norvegicus
gccgcagccatcttgacaaccaacc

SEQ ID NO: 506292 - DNA, 25 bp, Rattus norvegicus
gtgcagtccaggcagtcttgcgcca

SEQ ID NO: 506293 - DNA, 25 bp, Rattus norvegicus
aacaaggatggcgagcgtgcagtcc

SEQ ID NO: 506294 - DNA, 25 bp, Rattus norvegicus
tcaaggcgaccgtgaaacaaggatg

SEQ ID NO: 506295 - DNA, 25 bp, Rattus norvegicus
agcctcgtcgtcaaggcgaccgtga

SEQ ID NO: 506296 - DNA, 25 bp, Rattus norvegicus
ccgttgcgggcagcctcgtcgtcaa

SEQ ID NO: 506297 - DNA, 25 bp, Rattus norvegicus
catagcccgtgttcaggtggatgga

SEQ ID NO: 506298 - DNA, 25 bp, Rattus norvegicus
accatcttctcatagcccgtgttca

SEQ ID NO: 506299 - DNA, 25 bp, Rattus norvegicus
cggggctcgcatccctgagcttact

SEQ ID NO: 506300 - DNA, 25 bp, Rattus norvegicus
tgcgctcctgctggggctccactgt

SEQ ID NO: 506301 - DNA, 25 bp, Rattus norvegicus
aggaccacttcgtcctctcctgagg

SEQ ID NO: 506302 - DNA, 25 bp, Rattus norvegicus
atgctgcagcaaggaccacttcgtc

SEQ ID NO: 506303 - DNA, 25 bp, Rattus norvegicus
ccctaggaggaaatgctgcagcaag

SEQ ID NO: 506304 - DNA, 25 bp, Rattus norvegicus
gcagtcttgcgccatccacgtgcag

SEQ ID NO: 506305 - DNA, 25 bp, Rattus norvegicus
ttcagatttcggatcctccgcgccg

SEQ ID NO: 506306 - DNA, 25 bp, Rattus norvegicus
tcactgcttcctggctgtgcggcgt

SEQ ID NO: 506307 - DNA, 25 bp, Rattus norvegicus
cccaggtctcggagaggtgacgatc

SEQ ID NO: 506308 - DNA, 25 bp, Rattus norvegicus
ccttccctgcttgggaccgcgggat

SEQ ID NO: 506309 - DNA, 25 bp, Rattus norvegicus
tcctacctcgcgctcttggtggaga

SEQ ID NO: 506310 - DNA, 25 bp, Rattus norvegicus
ctctagagggtgcagaaacctggga

SEQ ID NO: 506311 - DNA, 25 bp, Rattus norvegicus
tccctgtgaacagcagccagtcagc

SEQ ID NO: 506312 - DNA, 25 bp, Rattus norvegicus
agagccggagacgacacagtgaacc

SEQ ID NO: 506313 - DNA, 25 bp, Rattus norvegicus
agccagtcagcgtggtctcacgtca

SEQ ID NO: 506314 - DNA, 25 bp, Rattus norvegicus
cttaatttgctagcggtgaccgtcc

SEQ ID NO: 506315 - DNA, 25 bp, Rattus norvegicus
gctgcctcgcgccttaatttgctag

SEQ ID NO: 506316 - DNA, 25 bp, Rattus norvegicus
taaactgtgcctaggcgcctgctgc

SEQ ID NO: 506317 - DNA, 25 bp, Rattus norvegicus
gcagcaaggcgcgacctaaactgtg

SEQ ID NO: 506318 - DNA, 25 bp, Rattus norvegicus
tctcctctgcagagcgcagcaaggc

SEQ ID NO: 506319 - DNA, 25 bp, Rattus norvegicus
acctgggaatcggatctcctctgca

SEQ ID NO: 506320 - DNA, 25 bp, Rattus norvegicus
cccgaggaacgttccttgggatgcg

SEQ ID NO: 506321 - DNA, 25 bp, Rattus norvegicus
gagacgttaggtattttcgaacaca

SEQ ID NO: 506322 - DNA, 25 bp, Rattus norvegicus
tattttcgaacacaagcggtttgtg

SEQ ID NO: 506323 - DNA, 25 bp, Rattus norvegicus
gaacacaagcggtttgtgggaagta

SEQ ID NO: 506324 - DNA, 25 bp, Rattus norvegicus
gaagtaagggcatagggtctcagca

SEQ ID NO: 506325 - DNA, 25 bp, Rattus norvegicus
tagggtctcagcaaaagccgccgga

SEQ ID NO: 506326 - DNA, 25 bp, Rattus norvegicus
aactagcgaggagaggttccacgga

SEQ ID NO: 506327 - DNA, 25 bp, Rattus norvegicus
gcagtcagactgcaactagcgagga

SEQ ID NO: 506328 - DNA, 25 bp, Rattus norvegicus
agcgctccgggcagtcagactgcaa

SEQ ID NO: 506329 - DNA, 25 bp, Rattus norvegicus
actgcaactagcgaggagaggttcc

SEQ ID NO: 506330 - DNA, 25 bp, Rattus norvegicus
aacgttccttgggatgcgggagcat

SEQ ID NO: 506331 - DNA, 25 bp, Rattus norvegicus
caaaagccgccggacgctgcggttg

SEQ ID NO: 506332 - DNA, 25 bp, Rattus norvegicus
cacatccctgaagggccccgaggaa

SEQ ID NO: 506333 - DNA, 25 bp, Rattus norvegicus
cattgagctgcctggtgctgggtaa

SEQ ID NO: 506334 - DNA, 25 bp, Rattus norvegicus
cctctgccaccgctggtccctgctc

SEQ ID NO: 506335 - DNA, 25 bp, Rattus norvegicus
tcttttggggtctgcacccgggtca

SEQ ID NO: 506336 - DNA, 25 bp, Rattus norvegicus
gtccctgctctgacggcgcgggaac

SEQ ID NO: 506337 - DNA, 25 bp, Rattus norvegicus
aagcagacgccgaggcggagcctct

SEQ ID NO: 506338 - DNA, 25 bp, Rattus norvegicus
tcctccaggaccagaggccagggac

SEQ ID NO: 506339 - DNA, 25 bp, Rattus norvegicus
ctttcctccaggaccagaggccagg

SEQ ID NO: 506340 - DNA, 25 bp, Rattus norvegicus
cgggtcacctttggcccatggcctt

SEQ ID NO: 506341 - DNA, 25 bp, Rattus norvegicus
aagatcttcttttggggtctgcacc

SEQ ID NO: 506342 - DNA, 25 bp, Rattus norvegicus
cggaggtccctaagatcttcttttg

SEQ ID NO: 506343 - DNA, 25 bp, Rattus norvegicus
ctgcggaggtccctaagatcttctt

SEQ ID NO: 506344 - DNA, 25 bp, Rattus norvegicus
cagcactgcggaggtccctaagatc

SEQ ID NO: 506345 - DNA, 25 bp, Rattus norvegicus
caggccagcactgcggaggtcccta

SEQ ID NO: 506346 - DNA, 25 bp, Rattus norvegicus
gcggagctctaagtggcccggctct

SEQ ID NO: 506347 - DNA, 25 bp, Rattus norvegicus
agtggcccggctctcgccgatcgcc

SEQ ID NO: 506348 - DNA, 25 bp, Rattus norvegicus
agtgagttctcaaaattccaggtcc

SEQ ID NO: 506349 - DNA, 25 bp, Rattus norvegicus
ttccaggtccaaatcagtcacaagc

SEQ ID NO: 506350 - DNA, 25 bp, Rattus norvegicus
tcagtcacaagcacatcgggcgata

SEQ ID NO: 506351 - DNA, 25 bp, Rattus norvegicus
atcgggcgatacgaaggccattgcc

SEQ ID NO: 506352 - DNA, 25 bp, Rattus norvegicus
ggccattgccggtaccaacgatgga

SEQ ID NO: 506353 - DNA, 25 bp, Rattus norvegicus
ggcaacagccgcagagcgagcttga

SEQ ID NO: 506354 - DNA, 25 bp, Rattus norvegicus
cttgaagaaaatgacggcggccgga

SEQ ID NO: 506355 - DNA, 25 bp, Rattus norvegicus
gccggagagcaagcctgagacaagc

SEQ ID NO: 506356 - DNA, 25 bp, Rattus norvegicus
ctgagacaagcaaggccgcgaccga

SEQ ID NO: 506357 - DNA, 25 bp, Rattus norvegicus
cgaccgaggagcgagctaaaggaaa

SEQ ID NO: 506358 - DNA, 25 bp, Rattus norvegicus
gctgaggaaagcaagcctgcggctc

SEQ ID NO: 506359 - DNA, 25 bp, Rattus norvegicus
gccctcctgactgcggctaggcagt

SEQ ID NO: 506360 - DNA, 25 bp, Rattus norvegicus
ggaagtgcgtcacccgcggctactc

SEQ ID NO: 506361 - DNA, 25 bp, Rattus norvegicus
cgagcgcccgagattgttgttgtga

SEQ ID NO: 506362 - DNA, 25 bp, Rattus norvegicus
taatctcgcgagagcgtagccgcct

SEQ ID NO: 506363 - DNA, 25 bp, Rattus norvegicus
tcgactcttcggtcccgaggccttg

SEQ ID NO: 506364 - DNA, 25 bp, Rattus norvegicus
agtctttcctgcgtctcctctgggc

SEQ ID NO: 506365 - DNA, 25 bp, Rattus norvegicus
tcacccgccttggaggccagtcttt

SEQ ID NO: 506366 - DNA, 25 bp, Rattus norvegicus
cggcctcggtgacagtttgaattga

SEQ ID NO: 506367 - DNA, 25 bp, Rattus norvegicus
gcgtcaactgcagcaccatgggtga

SEQ ID NO: 506368 - DNA, 25 bp, Rattus norvegicus
aggttttggagaatccgccggctgc

SEQ ID NO: 506369 - DNA, 25 bp, Rattus norvegicus
acgctcagagcgaacgaagcagggc

SEQ ID NO: 506370 - DNA, 25 bp, Rattus norvegicus
taaacatggcggttgaggaggcaca

SEQ ID NO: 506371 - DNA, 25 bp, Rattus norvegicus
cccagacgcggccaatgtaaacatg

SEQ ID NO: 506372 - DNA, 25 bp, Rattus norvegicus
ctgtccacgacaacggaagtgccca

SEQ ID NO: 506373 - DNA, 25 bp, Rattus norvegicus
cagtgacaaaagtagcgcagttaac

SEQ ID NO: 506374 - DNA, 25 bp, Rattus norvegicus
gatgtcggtcagtgcgagatccgct

SEQ ID NO: 506375 - DNA, 25 bp, Rattus norvegicus
cgcagttaaccgtagaggtagtgtc

SEQ ID NO: 506376 - DNA, 25 bp, Rattus norvegicus
cgggaaagctgcactgaagagtttc

SEQ ID NO: 506377 - DNA, 25 bp, Rattus norvegicus
tgcactgaagagtttccctgggaga

SEQ ID NO: 506378 - DNA, 25 bp, Rattus norvegicus
cgtttaggagcaatcctgcctgccc

SEQ ID NO: 506379 - DNA, 25 bp, Rattus norvegicus
tactgtcgtttaggagcaatcctgc

SEQ ID NO: 506380 - DNA, 25 bp, Rattus norvegicus
cgctgctactgtcgtttaggagcaa

SEQ ID NO: 506381 - DNA, 25 bp, Rattus norvegicus
ggggccgaatttcgccgctgctact

SEQ ID NO: 506382 - DNA, 25 bp, Rattus norvegicus
ggatcgacgcagctgcgacgccgct

SEQ ID NO: 506383 - DNA, 25 bp, Rattus norvegicus
gggttttgcctggatcgacgcagct

SEQ ID NO: 506384 - DNA, 25 bp, Rattus norvegicus
ctcgcacccgagttaggcgccgggt

SEQ ID NO: 506385 - DNA, 25 bp, Rattus norvegicus
ctgtgacacccacggcgaaaggcgg

SEQ ID NO: 506386 - DNA, 25 bp, Rattus norvegicus
tacttcagctgtgacacccacggcg

SEQ ID NO: 506387 - DNA, 25 bp, Rattus norvegicus
cgggcgccgcgaccctacttcagct

SEQ ID NO: 506388 - DNA, 25 bp, Rattus norvegicus
cccacgaggcccaccaatggtcccg

SEQ ID NO: 506389 - DNA, 25 bp, Rattus norvegicus
gaagagtttccctgggagaaagagc

SEQ ID NO: 506390 - DNA, 25 bp, Rattus norvegicus
ctgcgcagcagatcctccactaggg

SEQ ID NO: 506391 - DNA, 25 bp, Rattus norvegicus
gttctcttacgtacgcggaagccca

SEQ ID NO: 506392 - DNA, 25 bp, Rattus norvegicus
tccactagggctgcaaagggtcgca

SEQ ID NO: 506393 - DNA, 25 bp, Rattus norvegicus
gactctgacgttgggctttgcccta

SEQ ID NO: 506394 - DNA, 25 bp, Rattus norvegicus
ctgtaccgtcagtgtcgcatgctcc

SEQ ID NO: 506395 - DNA, 25 bp, Rattus norvegicus
tcctcttgccgaactgcagaccgtg

SEQ ID NO: 506396 - DNA, 25 bp, Rattus norvegicus
cctgcgtcacattcacgggtagcca

SEQ ID NO: 506397 - DNA, 25 bp, Rattus norvegicus
agttgctgctgcacttgctccacga

SEQ ID NO: 506398 - DNA, 25 bp, Rattus norvegicus
agatgcggccatcccagctccagaa

SEQ ID NO: 506399 - DNA, 25 bp, Rattus norvegicus
aggatgcccgcatggatcccacatc

SEQ ID NO: 506400 - DNA, 25 bp, Rattus norvegicus
ctgcaacttcgctgacggacctgga

SEQ ID NO: 506401 - DNA, 25 bp, Rattus norvegicus
gatcccacaggacgtgctgcactga

SEQ ID NO: 506402 - DNA, 25 bp, Rattus norvegicus
ctgagcccacgatgaccatgcggtc

SEQ ID NO: 506403 - DNA, 25 bp, Rattus norvegicus
ggcacgagttgccattctcgcaaga

SEQ ID NO: 506404 - DNA, 25 bp, Rattus norvegicus
tctcactcctcgagccaaagctggg

SEQ ID NO: 506405 - DNA, 25 bp, Rattus norvegicus
ctcgagccaaagctggggtgctctg

SEQ ID NO: 506406 - DNA, 25 bp, Rattus norvegicus
ctcagcccgcgaggttggtacggac

SEQ ID NO: 506407 - DNA, 25 bp, Rattus norvegicus
gccgcctggctgagcccagaagcag

SEQ ID NO: 506408 - DNA, 25 bp, Rattus norvegicus
ctgagcccagaagcagccgggccga

SEQ ID NO: 506409 - DNA, 25 bp, Rattus norvegicus
agaacacccggagagagaagcgcgc

SEQ ID NO: 506410 - DNA, 25 bp, Rattus norvegicus
gggccagggcataggactgccaccc

SEQ ID NO: 506411 - DNA, 25 bp, Rattus norvegicus
ataggactgccacccgctatggacc

SEQ ID NO: 506412 - DNA, 25 bp, Rattus norvegicus
tatggaccgcgccagggacgatatg

SEQ ID NO: 506413 - DNA, 25 bp, Rattus norvegicus
ccagggacgatatggactcgctgcc

SEQ ID NO: 506414 - DNA, 25 bp, Rattus norvegicus
actcgctgccgcaggtcagtgtccg

SEQ ID NO: 506415 - DNA, 25 bp, Rattus norvegicus
ttatgcgtctccatcagtacccacg

SEQ ID NO: 506416 - DNA, 25 bp, Rattus norvegicus
gcagggcgggcgagctctcactcct

SEQ ID NO: 506417 - DNA, 25 bp, Rattus norvegicus
aggccactccagcatccgaacgaag

SEQ ID NO: 506418 - DNA, 25 bp, Rattus norvegicus
accctagggagtactgcatgtccga

SEQ ID NO: 506419 - DNA, 25 bp, Rattus norvegicus
acggaactccactcagccgggtgta

SEQ ID NO: 506420 - DNA, 25 bp, Rattus norvegicus
acgtggcaccatgcagcgcaatctg

SEQ ID NO: 506421 - DNA, 25 bp, Rattus norvegicus
ctacaagctgcgaggtgacgcccga

SEQ ID NO: 506422 - DNA, 25 bp, Rattus norvegicus
agagacaccacgcaactacaagctg

SEQ ID NO: 506423 - DNA, 25 bp, Rattus norvegicus
tacacacctgcacgtagagacacca

SEQ ID NO: 506424 - DNA, 25 bp, Rattus norvegicus
ctgcgcgacactggcctcaactata

SEQ ID NO: 506425 - DNA, 25 bp, Rattus norvegicus
tggaggatgctccacgtaggacgcc

SEQ ID NO: 506426 - DNA, 25 bp, Rattus norvegicus
tgtgcccaaccttcactggctggtg

SEQ ID NO: 506427 - DNA, 25 bp, Rattus norvegicus
gacgcgaatggccaacacgctattg

SEQ ID NO: 506428 - DNA, 25 bp, Rattus norvegicus
tacagtagaccggtgcagaaggcag

SEQ ID NO: 506429 - DNA, 25 bp, Rattus norvegicus
tgtggtgacgcccacctacagtaga

SEQ ID NO: 506430 - DNA, 25 bp, Rattus norvegicus
ccgggtgtagtgtacttcgcagatg

SEQ ID NO: 506431 - DNA, 25 bp, Rattus norvegicus
gcatgtccgaccgtgacatcgtgga

SEQ ID NO: 506432 - DNA, 25 bp, Rattus norvegicus
ggggttcctactccagcaacactca

SEQ ID NO: 506433 - DNA, 25 bp, Rattus norvegicus
cgctcccaggctttgcgcagacaag

SEQ ID NO: 506434 - DNA, 25 bp, Rattus norvegicus
gcccattggctgaggtttagggtcc

SEQ ID NO: 506435 - DNA, 25 bp, Rattus norvegicus
gttacctgggcaaccatgctaccgc

SEQ ID NO: 506436 - DNA, 25 bp, Rattus norvegicus
cgctcactggttacctgggcaacca

SEQ ID NO: 506437 - DNA, 25 bp, Rattus norvegicus
ggaccgctcactggttacctgggca

SEQ ID NO: 506438 - DNA, 25 bp, Rattus norvegicus
agcaacactcagcggcgcgccaaag

SEQ ID NO: 506439 - DNA, 25 bp, Rattus norvegicus
cgcgaaagccgctggtagacaccgg

SEQ ID NO: 506440 - DNA, 25 bp, Rattus norvegicus
catcgcgcgaaagccgctggtagac

SEQ ID NO: 506441 - DNA, 25 bp, Rattus norvegicus
tccacttgggcatcgcgcgaaagcc

SEQ ID NO: 506442 - DNA, 25 bp, Rattus norvegicus
ggcctccgccgcaggctccacttgg

SEQ ID NO: 506443 - DNA, 25 bp, Rattus norvegicus
tggctgaggtttagggtcccgcctc

SEQ ID NO: 506444 - DNA, 25 bp, Rattus norvegicus
cagcggcgcgccaaagccttggccc

SEQ ID NO: 506445 - DNA, 25 bp, Rattus norvegicus
ccaggctttgcgcagacaagggacc

SEQ ID NO: 506446 - DNA, 25 bp, Rattus norvegicus
tccagtttccatagcgaccacgcgg

SEQ ID NO: 506447 - DNA, 25 bp, Rattus norvegicus
ctcagcgccatgtcgaggggaatgt

SEQ ID NO: 506448 - DNA, 25 bp, Rattus norvegicus
aggcgaagtcgcagccgccggctca

SEQ ID NO: 506449 - DNA, 25 bp, Rattus norvegicus
agccgcgcgcacaggcgaagtcgca

SEQ ID NO: 506450 - DNA, 25 bp, Rattus norvegicus
cctgggcgcagaaaccgctattcca

SEQ ID NO: 506451 - DNA, 25 bp, Rattus norvegicus
gtcagcctgagaccggacccgacag

SEQ ID NO: 506452 - DNA, 25 bp, Rattus norvegicus
atccacgcgggtcagcctgagaccg

SEQ ID NO: 506453 - DNA, 25 bp, Rattus norvegicus
ggaccagtcgcatccacgcgggtca

SEQ ID NO: 506454 - DNA, 25 bp, Rattus norvegicus
ctcaggcttggagcgtagaactggc

SEQ ID NO: 506455 - DNA, 25 bp, Rattus norvegicus
cgtagaactggcctcgtgcgcatgc

SEQ ID NO: 506456 - DNA, 25 bp, Rattus norvegicus
gtgcgcatgcgctcacactgcttag

SEQ ID NO: 506457 - DNA, 25 bp, Rattus norvegicus
atgcgctcacactgcttagaccctg

SEQ ID NO: 506458 - DNA, 25 bp, Rattus norvegicus
agctgccacggtccttctagagggc

SEQ ID NO: 506459 - DNA, 25 bp, Rattus norvegicus
ttctagagggccgtgtccctgtccg

SEQ ID NO: 506460 - DNA, 25 bp, Rattus norvegicus
cgcgcggtagtactatgatttggta

SEQ ID NO: 506461 - DNA, 25 bp, Rattus norvegicus
cagcacccgaggtcttgtggctcaa

SEQ ID NO: 506462 - DNA, 25 bp, Rattus norvegicus
tgaagtgcagcatccgtcctccaac

SEQ ID NO: 506463 - DNA, 25 bp, Rattus norvegicus
cccatgggctgcgaacgccttagaa

SEQ ID NO: 506464 - DNA, 25 bp, Rattus norvegicus
accgcacgttgaatctgagctttgg

SEQ ID NO: 506465 - DNA, 25 bp, Rattus norvegicus
ctctaactctggctgctggggactt

SEQ ID NO: 506466 - DNA, 25 bp, Rattus norvegicus
tgccttctccggtctgagcccaaga

SEQ ID NO: 506467 - DNA, 25 bp, Rattus norvegicus
actttgcgataggatgaggctcttg

SEQ ID NO: 506468 - DNA, 25 bp, Rattus norvegicus
atcccgttggcaggtgacaagcaga

SEQ ID NO: 506469 - DNA, 25 bp, Rattus norvegicus
cgcgattaagagcttgggagttccc

SEQ ID NO: 506470 - DNA, 25 bp, Rattus norvegicus
ctctaagggtctcggttctccgctc

SEQ ID NO: 506471 - DNA, 25 bp, Rattus norvegicus
gcgcccttcttttccatacatcttg

SEQ ID NO: 506472 - DNA, 25 bp, Rattus norvegicus
cagaattgacctagagactccgagc

SEQ ID NO: 506473 - DNA, 25 bp, Rattus norvegicus
gcaccactggatgaaggagctcttg

SEQ ID NO: 506474 - DNA, 25 bp, Rattus norvegicus
cgtgtggaactttttatcgccttgg

SEQ ID NO: 506475 - DNA, 25 bp, Rattus norvegicus
cctcggtggatgcttctgtcccggt

SEQ ID NO: 506476 - DNA, 25 bp, Rattus norvegicus
gccttggggtccagatccgagactc

SEQ ID NO: 506477 - DNA, 25 bp, Rattus norvegicus
ctgcgggtcaccgtgtggaactttt

SEQ ID NO: 506478 - DNA, 25 bp, Rattus norvegicus
actgggctacacctgctgcgggtca

SEQ ID NO: 506479 - DNA, 25 bp, Rattus norvegicus
agcggaggaactgggctacacctgc

SEQ ID NO: 506480 - DNA, 25 bp, Rattus norvegicus
cccactgggctaccgggaggacagc

SEQ ID NO: 506481 - DNA, 25 bp, Rattus norvegicus
gctggcaggactcgcccactgggct

SEQ ID NO: 506482 - DNA, 25 bp, Rattus norvegicus
gcgctagagcctgcgccacggtgct

SEQ ID NO: 506483 - DNA, 25 bp, Rattus norvegicus
atcccgtgcagcgtccctggaggag

SEQ ID NO: 506484 - DNA, 25 bp, Rattus norvegicus
tctgagtcgacaccgggagaaagtg

SEQ ID NO: 506485 - DNA, 25 bp, Rattus norvegicus
ccagccggcttgctctgagtcgaca

SEQ ID NO: 506486 - DNA, 25 bp, Rattus norvegicus
cacccgccaggatgagcgtgcagca

SEQ ID NO: 506487 - DNA, 25 bp, Rattus norvegicus
ccaggatgagcgtgcagcagtccgc

SEQ ID NO: 506488 - DNA, 25 bp, Rattus norvegicus
aaggtgaagcgcagtcagcaccgga

SEQ ID NO: 506489 - DNA, 25 bp, Rattus norvegicus
actgtgcgctcatcccggcgggtgc

SEQ ID NO: 506490 - DNA, 25 bp, Rattus norvegicus
ggcggcacggactgtgcgctcatcc

SEQ ID NO: 506491 - DNA, 25 bp, Rattus norvegicus
tgccgactccaagcgatcgggctgg

SEQ ID NO: 506492 - DNA, 25 bp, Rattus norvegicus
actttctctcggtgccgactccaag

SEQ ID NO: 506493 - DNA, 25 bp, Rattus norvegicus
ctctctggctcgctgcagaaggtga

SEQ ID NO: 506494 - DNA, 25 bp, Rattus norvegicus
cagcttgggctgtctctgcagcgca

SEQ ID NO: 506495 - DNA, 25 bp, Rattus norvegicus
agagcccagattcgcgccgcagctt

SEQ ID NO: 506496 - DNA, 25 bp, Rattus norvegicus
ggtcaacttcctcagagcccagatt

SEQ ID NO: 506497 - DNA, 25 bp, Rattus norvegicus
gcagagccacggtcaacttcctcag

SEQ ID NO: 506498 - DNA, 25 bp, Rattus norvegicus
aggaggcgcctgctaagccggcttc

SEQ ID NO: 506499 - DNA, 25 bp, Rattus norvegicus
actcgggaatcctgccgcagagcca

SEQ ID NO: 506500 - DNA, 25 bp, Rattus norvegicus
tcgtgcaatccggactcgggaatcc

SEQ ID NO: 506501 - DNA, 25 bp, Rattus norvegicus
tgctaagccggcttcgtgcaatccg

SEQ ID NO: 506502 - DNA, 25 bp, Rattus norvegicus
tggagttgtgaagtgcagtaccctg

SEQ ID NO: 506503 - DNA, 25 bp, Rattus norvegicus
ggtgtgcgcaccagccgtcaccacc

SEQ ID NO: 506504 - DNA, 25 bp, Rattus norvegicus
acccggaagctgtcgccggctggca

SEQ ID NO: 506505 - DNA, 25 bp, Rattus norvegicus
tgtgaagtgcagtaccctgggctgc

SEQ ID NO: 506506 - DNA, 25 bp, Rattus norvegicus
gtccgctttggagttgtgaagtgca

SEQ ID NO: 506507 - DNA, 25 bp, Rattus norvegicus
ggctctgtccgctttggagttgtga

SEQ ID NO: 506508 - DNA, 25 bp, Rattus norvegicus
tgacgctgattcaccgggccgctct

SEQ ID NO: 506509 - DNA, 25 bp, Rattus norvegicus
cgcggggctgcgaagagactcaccg

SEQ ID NO: 506510 - DNA, 25 bp, Rattus norvegicus
cttcggagttcgtaagtgtccgtgg

SEQ ID NO: 506511 - DNA, 25 bp, Rattus norvegicus
tactgcttcggagttcgtaagtgtc

SEQ ID NO: 506512 - DNA, 25 bp, Rattus norvegicus
cccgctactgcttcggagttcgtaa

SEQ ID NO: 506513 - DNA, 25 bp, Rattus norvegicus
cgatctgcccgctactgcttcggag

SEQ ID NO: 506514 - DNA, 25 bp, Rattus norvegicus
caatgagttcgttcccaggggcgca

SEQ ID NO: 506515 - DNA, 25 bp, Rattus norvegicus
cccaatgagttcgttcccaggggcg

SEQ ID NO: 506516 - DNA, 25 bp, Rattus norvegicus
ctcctgtagtagtggcggccattga

SEQ ID NO: 506517 - DNA, 25 bp, Rattus norvegicus
gtcctgctgaaaagctgtgatctga

SEQ ID NO: 506518 - DNA, 25 bp, Rattus norvegicus
agccaggattgagatgcccagtaga

SEQ ID NO: 506519 - DNA, 25 bp, Rattus norvegicus
ctggcgtcaggtgtagataaaagtc

SEQ ID NO: 506520 - DNA, 25 bp, Rattus norvegicus
cagacgcgctctgggatgaaactta

SEQ ID NO: 506521 - DNA, 25 bp, Rattus norvegicus
ggggacacctagatactcagtagca

SEQ ID NO: 506522 - DNA, 25 bp, Rattus norvegicus
ttacagcagcaaaggagtctggctc

SEQ ID NO: 506523 - DNA, 25 bp, Rattus norvegicus
ggctaatgacatactccgcaccttg

SEQ ID NO: 506524 - DNA, 25 bp, Rattus norvegicus
tccgcgccgtgaaacttgaccattg

SEQ ID NO: 506525 - DNA, 25 bp, Rattus norvegicus
cgcccgggacaatgggcagttccca

SEQ ID NO: 506526 - DNA, 25 bp, Rattus norvegicus
gactcctcccagaacagcgagcgtg

SEQ ID NO: 506527 - DNA, 25 bp, Rattus norvegicus
aaaacgcgctctgggagctctagta

SEQ ID NO: 506528 - DNA, 25 bp, Rattus norvegicus
gctctagtaggatcgctgtcaagtg

SEQ ID NO: 506529 - DNA, 25 bp, Rattus norvegicus
gctccgcgttcacatacccggaata

SEQ ID NO: 506530 - DNA, 25 bp, Rattus norvegicus
atcgcagcccagtggagccagaagc

SEQ ID NO: 506531 - DNA, 25 bp, Rattus norvegicus
gcgaggaaaaaagctccgggagctc

SEQ ID NO: 506532 - DNA, 25 bp, Rattus norvegicus
tgctgaagtttgcaactcgcagccc

SEQ ID NO: 506533 - DNA, 25 bp, Rattus norvegicus
cgggtatcgggaacgcagcagcacc

SEQ ID NO: 506534 - DNA, 25 bp, Rattus norvegicus
ctgcagcctagacgcgctgatcgca

SEQ ID NO: 506535 - DNA, 25 bp, Rattus norvegicus
gatttcacactctgggccggccacg

SEQ ID NO: 506536 - DNA, 25 bp, Rattus norvegicus
gcccagataaggctggagtacctta

SEQ ID NO: 506537 - DNA, 25 bp, Rattus norvegicus
gacagtctgggctccgaagggccca

SEQ ID NO: 506538 - DNA, 25 bp, Rattus norvegicus
catccagggccgtagaggacagtct

SEQ ID NO: 506539 - DNA, 25 bp, Rattus norvegicus
tcccgcacgacgtgagcggaaagtg

SEQ ID NO: 506540 - DNA, 25 bp, Rattus norvegicus
gatcatgctgctacttctgtctcca

SEQ ID NO: 506541 - DNA, 25 bp, Rattus norvegicus
gctttttctcctcggatcatgctgc

SEQ ID NO: 506542 - DNA, 25 bp, Rattus norvegicus
gtccctgcgcgggagatttcacact

SEQ ID NO: 506543 - DNA, 25 bp, Rattus norvegicus
tctacccatccgagttgctgaagtt

SEQ ID NO: 506544 - DNA, 25 bp, Rattus norvegicus
gccggagttcaagatcgagcgactc

SEQ ID NO: 506545 - DNA, 25 bp, Rattus norvegicus
cagcccactcggtgtttcccgagga

SEQ ID NO: 506546 - DNA, 25 bp, Rattus norvegicus
ttcccgaggaaggaggcgactgcac

SEQ ID NO: 506547 - DNA, 25 bp, Rattus norvegicus
gccagctgctcgagttctgtaggtt

SEQ ID NO: 506548 - DNA, 25 bp, Rattus norvegicus
agtgggtctcctcatccgattgatc

SEQ ID NO: 506549 - DNA, 25 bp, Rattus norvegicus
tcatttttcctggacagagcggccc

SEQ ID NO: 506550 - DNA, 25 bp, Rattus norvegicus
cgagcgcggcagtctttttccctct

SEQ ID NO: 506551 - DNA, 25 bp, Rattus norvegicus
gccttcggccagagcttcgtgctgc

SEQ ID NO: 506552 - DNA, 25 bp, Rattus norvegicus
cggctgcttcttctctggcacagtg

SEQ ID NO: 506553 - DNA, 25 bp, Rattus norvegicus
tggggactccctggaccagccgcat

SEQ ID NO: 506554 - DNA, 25 bp, Rattus norvegicus
ctgagcggctcattcttgctggctg

SEQ ID NO: 506555 - DNA, 25 bp, Rattus norvegicus
tgctggctggagaggagttcaccat

SEQ ID NO: 506556 - DNA, 25 bp, Rattus norvegicus
gagttcaccatccagccacagggcg

SEQ ID NO: 506557 - DNA, 25 bp, Rattus norvegicus
aacccggacgcaggcctcggagcta

SEQ ID NO: 506558 - DNA, 25 bp, Rattus norvegicus
agatagggtcccctgagcctcccgg

SEQ ID NO: 506559 - DNA, 25 bp, Rattus norvegicus
attgtgggacacaaacaaagtgccc

SEQ ID NO: 506560 - DNA, 25 bp, Rattus norvegicus
acaaagtgcccccaaacaggctgga

SEQ ID NO: 506561 - DNA, 25 bp, Rattus norvegicus
ccaaacaggctggagtgaaacgagc

SEQ ID NO: 506562 - DNA, 25 bp, Rattus norvegicus
tgaaacgagcggctacggcggcgcc

SEQ ID NO: 506563 - DNA, 25 bp, Rattus norvegicus
cgcacgcgcgctgcggcggctccct

SEQ ID NO: 506564 - DNA, 25 bp, Rattus norvegicus
gagccgtcgcccgccctcggcaaac

SEQ ID NO: 506565 - DNA, 25 bp, Rattus norvegicus
cgcactctcgcactctcgcacctcg

SEQ ID NO: 506566 - DNA, 25 bp, Rattus norvegicus
tcgcacctcgcgtgcacgcgggtga

SEQ ID NO: 506567 - DNA, 25 bp, Rattus norvegicus
cggcccgagatagggtcccctgagc

SEQ ID NO: 506568 - DNA, 25 bp, Rattus norvegicus
ttgcgcaataggcgcgcaccgcctt

SEQ ID NO: 506569 - DNA, 25 bp, Rattus norvegicus
gcggagcattgtgggacacaaacaa

SEQ ID NO: 506570 - DNA, 25 bp, Rattus norvegicus
cacactggcctaggcgcggcggccc

SEQ ID NO: 506571 - DNA, 25 bp, Rattus norvegicus
caggctgcacactggcctaggcgcg

SEQ ID NO: 506572 - DNA, 25 bp, Rattus norvegicus
agaggcagcccgacctcagcgctaa

SEQ ID NO: 506573 - DNA, 25 bp, Rattus norvegicus
tcatttggcctctgcggcgacagag

SEQ ID NO: 506574 - DNA, 25 bp, Rattus norvegicus
tcacctcgatatagccagccagagc

SEQ ID NO: 506575 - DNA, 25 bp, Rattus norvegicus
gatatagccagccagagccgctgcg

SEQ ID NO: 506576 - DNA, 25 bp, Rattus norvegicus
cctaacgcgacccaaaagcgtctga

SEQ ID NO: 506577 - DNA, 25 bp, Rattus norvegicus
aaagcgtctgaagcccgttcgccgc

SEQ ID NO: 506578 - DNA, 25 bp, Rattus norvegicus
tacaccgaccggaactgacttcaca

SEQ ID NO: 506579 - DNA, 25 bp, Rattus norvegicus
aggctggggactcacgagtattcgc

SEQ ID NO: 506580 - DNA, 25 bp, Rattus norvegicus
ctcacgagtattcgcgggcagactg

SEQ ID NO: 506581 - DNA, 25 bp, Rattus norvegicus
ccgctgttccgaaggcgggagtctc

SEQ ID NO: 506582 - DNA, 25 bp, Rattus norvegicus
cttcagattcgggattcgggcgcgc

SEQ ID NO: 506583 - DNA, 25 bp, Rattus norvegicus
ggtaccgccctctttggagcttcta

SEQ ID NO: 506584 - DNA, 25 bp, Rattus norvegicus
cgccctctttggagcttctagaaaa

SEQ ID NO: 506585 - DNA, 25 bp, Rattus norvegicus
aggcataactagctaagatgccgcc

SEQ ID NO: 506586 - DNA, 25 bp, Rattus norvegicus
tgcttagtcccacccaaaatggcgc

SEQ ID NO: 506587 - DNA, 25 bp, Rattus norvegicus
agaggatccgggacccgctgatctt

SEQ ID NO: 506588 - DNA, 25 bp, Rattus norvegicus
tcacccaacgtcgtgtaagtaccta

SEQ ID NO: 506589 - DNA, 25 bp, Rattus norvegicus
ataagccggggtccagagtatccca

SEQ ID NO: 506590 - DNA, 25 bp, Rattus norvegicus
ccgcaactgcgggtctgtctgcaaa

SEQ ID NO: 506591 - DNA, 25 bp, Rattus norvegicus
ccagagtatcccatcgcctgggaga

SEQ ID NO: 506592 - DNA, 25 bp, Rattus norvegicus
ggcaccgcccgatggtacagtccag

SEQ ID NO: 506593 - DNA, 25 bp, Rattus norvegicus
atctgcaccttctacgccgagaggg

SEQ ID NO: 506594 - DNA, 25 bp, Rattus norvegicus
ttctacgccgagaggggagagtccc

SEQ ID NO: 506595 - DNA, 25 bp, Rattus norvegicus
ccgtgggttctcgtgctggcatccc

SEQ ID NO: 506596 - DNA, 25 bp, Rattus norvegicus
ccgcaaaggtgtggggaccgcaact

SEQ ID NO: 506597 - DNA, 25 bp, Rattus norvegicus
tctgtctgcaaacaggatggcgggc

SEQ ID NO: 506598 - DNA, 25 bp, Rattus norvegicus
agtgtttcgtctttgcttagtccca

SEQ ID NO: 506599 - DNA, 25 bp, Rattus norvegicus
cctgggagagtgtttcgtctttgct

SEQ ID NO: 506600 - DNA, 25 bp, Rattus norvegicus
atgcgctcaggtcaaggttcccttc

SEQ ID NO: 506601 - DNA, 25 bp, Rattus norvegicus
gtaactcttcagctgctctccctgg

SEQ ID NO: 506602 - DNA, 25 bp, Rattus norvegicus
gctagccaggcatcttcatctcttc

SEQ ID NO: 506603 - DNA, 25 bp, Rattus norvegicus
tcatcatccacggaagccggggtgc

SEQ ID NO: 506604 - DNA, 25 bp, Rattus norvegicus
ggaagccgctggcagaacctagcta

SEQ ID NO: 506605 - DNA, 25 bp, Rattus norvegicus
agtgacttctactctggcgggcagg

SEQ ID NO: 506606 - DNA, 25 bp, Rattus norvegicus
ggttcccttcgtggctgtctcctaa

SEQ ID NO: 506607 - DNA, 25 bp, Rattus norvegicus
cggcgcaacgagagccaggactatc

SEQ ID NO: 506608 - DNA, 25 bp, Rattus norvegicus
gtcgcggttgacatagtaactcttc

SEQ ID NO: 506609 - DNA, 25 bp, Rattus norvegicus
gcggatttctggacggtcctttgga

SEQ ID NO: 506610 - DNA, 25 bp, Rattus norvegicus
caggactatctgctgatggacgagc

SEQ ID NO: 506611 - DNA, 25 bp, Rattus norvegicus
gcgtgtctcaccagcgacgtctctt

SEQ ID NO: 506612 - DNA, 25 bp, Rattus norvegicus
tatggctactatcccagcttgtaag

SEQ ID NO: 506613 - DNA, 25 bp, Rattus norvegicus
tcttcagactcccagacaagctagg

SEQ ID NO: 506614 - DNA, 25 bp, Rattus norvegicus
gagcccggaacgtgcgcgcacccaa

SEQ ID NO: 506615 - DNA, 25 bp, Rattus norvegicus
actccttgcgggagcgagcgcgtcc

SEQ ID NO: 506616 - DNA, 25 bp, Rattus norvegicus
tgagacccgcggacccggctgaggt

SEQ ID NO: 506617 - DNA, 25 bp, Rattus norvegicus
ggctccacgcgtggcgtgcgacgac

SEQ ID NO: 506618 - DNA, 25 bp, Rattus norvegicus
ggaaagaagcggtgagaacgggaga

SEQ ID NO: 506619 - DNA, 25 bp, Rattus norvegicus
aagtcgggctccgaggtcaacgtca

SEQ ID NO: 506620 - DNA, 25 bp, Rattus norvegicus
cgggctccgaggtcaacgtcaccgt

SEQ ID NO: 506621 - DNA, 25 bp, Rattus norvegicus
tcaacgtcaccgtgggcacgcggcg

SEQ ID NO: 506622 - DNA, 25 bp, Rattus norvegicus
gcacccaaactccttgcgggagcga

SEQ ID NO: 506623 - DNA, 25 bp, Rattus norvegicus
cccaaactccttgcgggagcgagcg

SEQ ID NO: 506624 - DNA, 25 bp, Rattus norvegicus
gagagccttgctcgcagcttgctcg

SEQ ID NO: 506625 - DNA, 25 bp, Rattus norvegicus
cggagagccttgctcgcagcttgct

SEQ ID NO: 506626 - DNA, 25 bp, Rattus norvegicus
ctacggccggagagccttgctcgca

SEQ ID NO: 506627 - DNA, 25 bp, Rattus norvegicus
ccgaggtcaacgtcaccgtgggcac

SEQ ID NO: 506628 - DNA, 25 bp, Rattus norvegicus
tttctcctcttgacccagcggggca

SEQ ID NO: 506629 - DNA, 25 bp, Rattus norvegicus
ctcagaggtgtccacttgccagctt

SEQ ID NO: 506630 - DNA, 25 bp, Rattus norvegicus
cagcggggcatcctaccttttccga

SEQ ID NO: 506631 - DNA, 25 bp, Rattus norvegicus
gcggggcatcctaccttttccgagc

SEQ ID NO: 506632 - DNA, 25 bp, Rattus norvegicus
atcctaccttttccgagcctcagag

SEQ ID NO: 506633 - DNA, 25 bp, Rattus norvegicus
taccttttccgagcctcagaggtgt

SEQ ID NO: 506634 - DNA, 25 bp, Rattus norvegicus
agatggccctaacccggtcgctagc

SEQ ID NO: 506635 - DNA, 25 bp, Rattus norvegicus
cagatggccctaacccggtcgctag

SEQ ID NO: 506636 - DNA, 25 bp, Rattus norvegicus
tgcaggagctggcaacccccagatg

SEQ ID NO: 506637 - DNA, 25 bp, Rattus norvegicus
gaggtgcaagcgtccgcaccccgtt

SEQ ID NO: 506638 - DNA, 25 bp, Rattus norvegicus
gcccaggaggtgcaagcgtccgcac

SEQ ID NO: 506639 - DNA, 25 bp, Rattus norvegicus
tcacacgtgtgaccgcgggtgccca

SEQ ID NO: 506640 - DNA, 25 bp, Rattus norvegicus
ttgccagcttcggtcacacgtgtga

SEQ ID NO: 506641 - DNA, 25 bp, Rattus norvegicus
cacttgccagcttcggtcacacgtg

SEQ ID NO: 506642 - DNA, 25 bp, Rattus norvegicus
gggccgccagttttccaagcagcaa

SEQ ID NO: 506643 - DNA, 25 bp, Rattus norvegicus
gtaggcagctatgtccacacctctg

SEQ ID NO: 506644 - DNA, 25 bp, Rattus norvegicus
accgcacgcggtcaaaagtacaaca

SEQ ID NO: 506645 - DNA, 25 bp, Rattus norvegicus
tcccagcgattgtcttaccggtaca

SEQ ID NO: 506646 - DNA, 25 bp, Rattus norvegicus
gcaccaccagcgatgggcacacaga

SEQ ID NO: 506647 - DNA, 25 bp, Rattus norvegicus
tttctcaaagtagtcgcaggtctcc

SEQ ID NO: 506648 - DNA, 25 bp, Rattus norvegicus
ctccttggagaggatctcatcgatc

SEQ ID NO: 506649 - DNA, 25 bp, Rattus norvegicus
tgaaagtcttgtagcgcctcctggc

SEQ ID NO: 506650 - DNA, 25 bp, Rattus norvegicus
gtgagctcagcctcagttccgcgtg

SEQ ID NO: 506651 - DNA, 25 bp, Rattus norvegicus
ccgccgagcagcatctttgactaca

SEQ ID NO: 506652 - DNA, 25 bp, Rattus norvegicus
tacagcctttttgggacaccgcagc

SEQ ID NO: 506653 - DNA, 25 bp, Rattus norvegicus
aatcagcgcgcacttcctgcagggc

SEQ ID NO: 506654 - DNA, 25 bp, Rattus norvegicus
gccgggctggctctctattttaaga

SEQ ID NO: 506655 - DNA, 25 bp, Rattus norvegicus
ggacgactaccgagcctctcttgtt

SEQ ID NO: 506656 - DNA, 25 bp, Rattus norvegicus
ccctgaagcggtgtgcgtgagctgg

SEQ ID NO: 506657 - DNA, 25 bp, Rattus norvegicus
gtgcgtgagctggagagaaaacgga

SEQ ID NO: 506658 - DNA, 25 bp, Rattus norvegicus
tgtgcgtgagctggagagaaaacgg

SEQ ID NO: 506659 - DNA, 25 bp, Rattus norvegicus
gtgtgcgtgagctggagagaaaacg

SEQ ID NO: 506660 - DNA, 25 bp, Rattus norvegicus
ggtgtgcgtgagctggagagaaaac

SEQ ID NO: 506661 - DNA, 25 bp, Rattus norvegicus
cggtgtgcgtgagctggagagaaaa

SEQ ID NO: 506662 - DNA, 25 bp, Rattus norvegicus
gcggtgtgcgtgagctggagagaaa

SEQ ID NO: 506663 - DNA, 25 bp, Rattus norvegicus
agcggtgtgcgtgagctggagagaa

SEQ ID NO: 506664 - DNA, 25 bp, Rattus norvegicus
aagcggtgtgcgtgagctggagaga

SEQ ID NO: 506665 - DNA, 25 bp, Rattus norvegicus
ctatgcccctgaagcggtgtgcgtg

SEQ ID NO: 506666 - DNA, 25 bp, Rattus norvegicus
cctgaagcggtgtgcgtgagctgga

SEQ ID NO: 506667 - DNA, 25 bp, Rattus norvegicus
tatgcccctgaagcggtgtgcgtga

SEQ ID NO: 506668 - DNA, 25 bp, Rattus norvegicus
tgcgtgagctggagagaaaacggac

SEQ ID NO: 506669 - DNA, 25 bp, Rattus norvegicus
ctgaagcggtgtgcgtgagctggag

SEQ ID NO: 506670 - DNA, 25 bp, Rattus norvegicus
gagtgttctgcgtggctgcgcactc

SEQ ID NO: 506671 - DNA, 25 bp, Rattus norvegicus
tgctcgcactgtggggctgatctga

SEQ ID NO: 506672 - DNA, 25 bp, Rattus norvegicus
agagaaaacggacagcggggataca

SEQ ID NO: 506673 - DNA, 25 bp, Rattus norvegicus
cagcggggatacagaatttgggaca

SEQ ID NO: 506674 - DNA, 25 bp, Rattus norvegicus
tacagaatttgggacacagacagcc

SEQ ID NO: 506675 - DNA, 25 bp, Rattus norvegicus
tgggacacagacagccgacgatgtt

SEQ ID NO: 506676 - DNA, 25 bp, Rattus norvegicus
gacagccgacgatgtttccttgatg

SEQ ID NO: 506677 - DNA, 25 bp, Rattus norvegicus
tgagcacggctagccgcggaagcaa

SEQ ID NO: 506678 - DNA, 25 bp, Rattus norvegicus
ttccttgatgctcgcactgtggggc

SEQ ID NO: 506679 - DNA, 25 bp, Rattus norvegicus
gctgatctgagtctcgggagtgttc

SEQ ID NO: 506680 - DNA, 25 bp, Rattus norvegicus
tctgagtctcgggagtgttctgcgt

SEQ ID NO: 506681 - DNA, 25 bp, Rattus norvegicus
gcactctgagcacggctagccgcgg

SEQ ID NO: 506682 - DNA, 25 bp, Rattus norvegicus
tagccgcggaagcaattcgggacgc

SEQ ID NO: 506683 - DNA, 25 bp, Rattus norvegicus
cgacgatgtttccttgatgctcgca

SEQ ID NO: 506684 - DNA, 25 bp, Rattus norvegicus
tctgaatggcctcagggaagagctt

SEQ ID NO: 506685 - DNA, 25 bp, Rattus norvegicus
attgacagaggcaacggcgagaccg

SEQ ID NO: 506686 - DNA, 25 bp, Rattus norvegicus
agaccggcttgtagtgctcggagcc

SEQ ID NO: 506687 - DNA, 25 bp, Rattus norvegicus
accggcttgtagtgctcggagcccg

SEQ ID NO: 506688 - DNA, 25 bp, Rattus norvegicus
ggagcccggcgtctgaatggcctca

SEQ ID NO: 506689 - DNA, 25 bp, Rattus norvegicus
ccggcgtctgaatggcctcagggaa

SEQ ID NO: 506690 - DNA, 25 bp, Rattus norvegicus
atggcctcagggaagagcttgactg

SEQ ID NO: 506691 - DNA, 25 bp, Rattus norvegicus
cagggaagagcttgactgtgccgcc

SEQ ID NO: 506692 - DNA, 25 bp, Rattus norvegicus
tgtgccgccgcgcttaggctagcag

SEQ ID NO: 506693 - DNA, 25 bp, Rattus norvegicus
gccgcgcttaggctagcaggctccg

SEQ ID NO: 506694 - DNA, 25 bp, Rattus norvegicus
tagcaggctccgcagcggtcgcacg

SEQ ID NO: 506695 - DNA, 25 bp, Rattus norvegicus
cgcagcggtcgcacggaaggcgtgc

SEQ ID NO: 506696 - DNA, 25 bp, Rattus norvegicus
aatgcttggcgggattgacagaggc

SEQ ID NO: 506697 - DNA, 25 bp, Rattus norvegicus
cctcagggaagagcttgactgtgcc

SEQ ID NO: 506698 - DNA, 25 bp, Rattus norvegicus
gctgccatcgctcgcctcgacccgc

SEQ ID NO: 506699 - DNA, 25 bp, Rattus norvegicus
acagtgccgcgcttttaagcagcta

SEQ ID NO: 506700 - DNA, 25 bp, Rattus norvegicus
cgcgcttttaagcagctacgaagaa

SEQ ID NO: 506701 - DNA, 25 bp, Rattus norvegicus
taagcagctacgaagaaactaaatg

SEQ ID NO: 506702 - DNA, 25 bp, Rattus norvegicus
cgaagaaactaaatgcttggcggga

SEQ ID NO: 506703 - DNA, 25 bp, Rattus norvegicus
tcttgagtcaccaggacagtgccgc

SEQ ID NO: 506704 - DNA, 25 bp, Rattus norvegicus
ctctcttgagtcaccaggacagtgc

SEQ ID NO: 506705 - DNA, 25 bp, Rattus norvegicus
ccatggcaatcctggggagctctct

SEQ ID NO: 506706 - DNA, 25 bp, Rattus norvegicus
ctgccatggcaatcctggggagctc

SEQ ID NO: 506707 - DNA, 25 bp, Rattus norvegicus
acactggctgccatggcaatcctgg

SEQ ID NO: 506708 - DNA, 25 bp, Rattus norvegicus
cgcaacactggctgccatggcaatc

SEQ ID NO: 506709 - DNA, 25 bp, Rattus norvegicus
ggaacccgggcgcaacactggctgc

SEQ ID NO: 506710 - DNA, 25 bp, Rattus norvegicus
tcaccaggacagtgccgcgctttta

SEQ ID NO: 506711 - DNA, 25 bp, Rattus norvegicus
cctcgacccgctgcgcaaggagcgg

SEQ ID NO: 506712 - DNA, 25 bp, Rattus norvegicus
cgttacgatccagatgctcttgggg

SEQ ID NO: 506713 - DNA, 25 bp, Rattus norvegicus
gcgtagtctaggacgatgccttttc

SEQ ID NO: 506714 - DNA, 25 bp, Rattus norvegicus
ctaggacgatgccttttcctgcggc

SEQ ID NO: 506715 - DNA, 25 bp, Rattus norvegicus
cttttcctgcggcagctctggaatc

SEQ ID NO: 506716 - DNA, 25 bp, Rattus norvegicus
cctgcggcagctctggaatctttgc

SEQ ID NO: 506717 - DNA, 25 bp, Rattus norvegicus
gacggggacagccaaagtgcaagcc

SEQ ID NO: 506718 - DNA, 25 bp, Rattus norvegicus
ggggcctcgtagcttgtccggcacc

SEQ ID NO: 506719 - DNA, 25 bp, Rattus norvegicus
cgtgcacgttacgatccagatgctc

SEQ ID NO: 506720 - DNA, 25 bp, Rattus norvegicus
aagcctctggcgtagtctaggacga

SEQ ID NO: 506721 - DNA, 25 bp, Rattus norvegicus
ccgccatgaacgtgctttcccggga

SEQ ID NO: 506722 - DNA, 25 bp, Rattus norvegicus
cgtgcccgccacctctcgtttgcat

SEQ ID NO: 506723 - DNA, 25 bp, Rattus norvegicus
tcgtttgcatccctcggcgaaccgg

SEQ ID NO: 506724 - DNA, 25 bp, Rattus norvegicus
ccggtgcttcaggacgtgcacgtta

SEQ ID NO: 506725 - DNA, 25 bp, Rattus norvegicus
tagcttgtccggcaccggtgcttca

SEQ ID NO: 506726 - DNA, 25 bp, Rattus norvegicus
tttacgttcagcgtttcgtcagctc

SEQ ID NO: 506727 - DNA, 25 bp, Rattus norvegicus
ttcaaggccttctcacttgtcagtc

SEQ ID NO: 506728 - DNA, 25 bp, Rattus norvegicus
gtggccgagattcaaggccttctca

SEQ ID NO: 506729 - DNA, 25 bp, Rattus norvegicus
gcgccttgccgtggccgagattcaa

SEQ ID NO: 506730 - DNA, 25 bp, Rattus norvegicus
acactcaggtaagcgccttgccgtg

SEQ ID NO: 506731 - DNA, 25 bp, Rattus norvegicus
tgggttcttcccacacactcaggta

SEQ ID NO: 506732 - DNA, 25 bp, Rattus norvegicus
tcaaaacctcatcagtgggttcttc

SEQ ID NO: 506733 - DNA, 25 bp, Rattus norvegicus
ctcagttcaaaacctcatcagtggg

SEQ ID NO: 506734 - DNA, 25 bp, Rattus norvegicus
cgtgttttcatgtagaactcagttc

SEQ ID NO: 506735 - DNA, 25 bp, Rattus norvegicus
agcgtttcgtcagctctcagccgtg

SEQ ID NO: 506736 - DNA, 25 bp, Rattus norvegicus
tgcagcggctgacactttacgttca

SEQ ID NO: 506737 - DNA, 25 bp, Rattus norvegicus
gcatcctcgtgcagcggctgacact

SEQ ID NO: 506738 - DNA, 25 bp, Rattus norvegicus
acttgtcagtcctgtcgccgagctg

SEQ ID NO: 506739 - DNA, 25 bp, Rattus norvegicus
cagctctcagccgtgttttcatgta

SEQ ID NO: 506740 - DNA, 25 bp, Rattus norvegicus
aagacctcctcgttggtgctccctc

SEQ ID NO: 506741 - DNA, 25 bp, Rattus norvegicus
tgtgtgatcgccctcatgtgtaagc

SEQ ID NO: 506742 - DNA, 25 bp, Rattus norvegicus
cgtgtgtgtgatcgccctcatgtgt

SEQ ID NO: 506743 - DNA, 25 bp, Rattus norvegicus
tatgtgggaaagctcacgtgtgcgt

SEQ ID NO: 506744 - DNA, 25 bp, Rattus norvegicus
ctcccgtgtgtatgtgggaaagctc

SEQ ID NO: 506745 - DNA, 25 bp, Rattus norvegicus
gtcagatgtgtgtgagaatctcccg

SEQ ID NO: 506746 - DNA, 25 bp, Rattus norvegicus
acctgcgccagtcagatgtgtgtga

SEQ ID NO: 506747 - DNA, 25 bp, Rattus norvegicus
agggttagagacctgcgccagtcag

SEQ ID NO: 506748 - DNA, 25 bp, Rattus norvegicus
acgcttctggccacgccgaagcgag

SEQ ID NO: 506749 - DNA, 25 bp, Rattus norvegicus
ggttcgccatctccctccaagacct

SEQ ID NO: 506750 - DNA, 25 bp, Rattus norvegicus
tgtgtgtgagaatctcccgtgtgta

SEQ ID NO: 506751 - DNA, 25 bp, Rattus norvegicus
tgatcgccctcatgtgtaagcgccc

SEQ ID NO: 506752 - DNA, 25 bp, Rattus norvegicus
ccacgccgaagcgagggttagagac

SEQ ID NO: 506753 - DNA, 25 bp, Rattus norvegicus
cgccagtcagatgtgtgtgagaatc

SEQ ID NO: 506754 - DNA, 25 bp, Rattus norvegicus
aggagtgcgccagaaagccaaaaca

SEQ ID NO: 506755 - DNA, 25 bp, Rattus norvegicus
ccacaggccgacagggcactgccga

SEQ ID NO: 506756 - DNA, 25 bp, Rattus norvegicus
tgaagaaacacaatcccggccgccg

SEQ ID NO: 506757 - DNA, 25 bp, Rattus norvegicus
tgcctcgctcctaattgaagaaaca

SEQ ID NO: 506758 - DNA, 25 bp, Rattus norvegicus
cccgtgcctcgctcctaattgaaga

SEQ ID NO: 506759 - DNA, 25 bp, Rattus norvegicus
aaacaaatacaatggcgcaggcttc

SEQ ID NO: 506760 - DNA, 25 bp, Rattus norvegicus
gggaaataaatactaaggagtgcgc

SEQ ID NO: 506761 - DNA, 25 bp, Rattus norvegicus
gcctggccggcaatttgaaaataaa

SEQ ID NO: 506762 - DNA, 25 bp, Rattus norvegicus
cagcctggccggcaatttgaaaata

SEQ ID NO: 506763 - DNA, 25 bp, Rattus norvegicus
tgaatggacggcatccagcctggcc

SEQ ID NO: 506764 - DNA, 25 bp, Rattus norvegicus
agggatccagcgagcaggctccggc

SEQ ID NO: 506765 - DNA, 25 bp, Rattus norvegicus
ggtcgcccagccagatcccgctcca

SEQ ID NO: 506766 - DNA, 25 bp, Rattus norvegicus
tcccgctccacggatagcgcctgga

SEQ ID NO: 506767 - DNA, 25 bp, Rattus norvegicus
atacaatggcgcaggcttcgaggcc

SEQ ID NO: 506768 - DNA, 25 bp, Rattus norvegicus
ggcttctcattatacaatgggaata

SEQ ID NO: 506769 - DNA, 25 bp, Rattus norvegicus
aaggagtgggcgacgtccgatctcc

SEQ ID NO: 506770 - DNA, 25 bp, Rattus norvegicus
tacaggaaaaaagatagaaacagga

SEQ ID NO: 506771 - DNA, 25 bp, Rattus norvegicus
ttcttgcatgtctaggtatttaata

SEQ ID NO: 506772 - DNA, 25 bp, Rattus norvegicus
tgtggcacagaaaaattcttgcatg

SEQ ID NO: 506773 - DNA, 25 bp, Rattus norvegicus
tgggaataacaatagtactaaacta

SEQ ID NO: 506774 - DNA, 25 bp, Rattus norvegicus
tgtcttctacactggctgggaagaa

SEQ ID NO: 506775 - DNA, 25 bp, Rattus norvegicus
ggtgatttgggcttctcattataca

SEQ ID NO: 506776 - DNA, 25 bp, Rattus norvegicus
ccagtgtggtgatttgggcttctca

SEQ ID NO: 506777 - DNA, 25 bp, Rattus norvegicus
gccctgcttcaaaccagtgtggtga

SEQ ID NO: 506778 - DNA, 25 bp, Rattus norvegicus
gtgagaacagattctgccctgcttc

SEQ ID NO: 506779 - DNA, 25 bp, Rattus norvegicus
gaagactgtgagaacagattctgcc

SEQ ID NO: 506780 - DNA, 25 bp, Rattus norvegicus
agtctgtcttctacactggctggga

SEQ ID NO: 506781 - DNA, 25 bp, Rattus norvegicus
actaataaggttttgtggcacagaa

SEQ ID NO: 506782 - DNA, 25 bp, Rattus norvegicus
ctcgcgccgaaggaagcagaaatcc

SEQ ID NO: 506783 - DNA, 25 bp, Rattus norvegicus
cagcctcccggcttgaagatcaagg

SEQ ID NO: 506784 - DNA, 25 bp, Rattus norvegicus
ctccagaaggcgaccctaaagagga

SEQ ID NO: 506785 - DNA, 25 bp, Rattus norvegicus
gcggtgacttcccagactgcaccta

SEQ ID NO: 506786 - DNA, 25 bp, Rattus norvegicus
ggatttcattcacgtgcccattctg

SEQ ID NO: 506787 - DNA, 25 bp, Rattus norvegicus
cctcgagcactggaaggcatgtgca

SEQ ID NO: 506788 - DNA, 25 bp, Rattus norvegicus
tccgcttctgaagagcaaacctcga

SEQ ID NO: 506789 - DNA, 25 bp, Rattus norvegicus
gtgaagccatctcagcagcctgcta

SEQ ID NO: 506790 - DNA, 25 bp, Rattus norvegicus
agcctgcgaggccatcacttcttgg

SEQ ID NO: 506791 - DNA, 25 bp, Rattus norvegicus
tcggggcccgagcaaagccaaacca

SEQ ID NO: 506792 - DNA, 25 bp, Rattus norvegicus
ccagtttacggcgaattccagcctc

SEQ ID NO: 506793 - DNA, 25 bp, Rattus norvegicus
tccggagaaggacagcagactctta

SEQ ID NO: 506794 - DNA, 25 bp, Rattus norvegicus
ctttctctggagtcgaagccgctcg

SEQ ID NO: 506795 - DNA, 25 bp, Rattus norvegicus
gtcttagacaccctgttggcgccct

SEQ ID NO: 506796 - DNA, 25 bp, Rattus norvegicus
cgctacccggaggagaccgcgcgaa

SEQ ID NO: 506797 - DNA, 25 bp, Rattus norvegicus
acattgacccggttacagcctgacc

SEQ ID NO: 506798 - DNA, 25 bp, Rattus norvegicus
aatattccacacattgacccggtta

SEQ ID NO: 506799 - DNA, 25 bp, Rattus norvegicus
tttggccaattctgcagccgagccc

SEQ ID NO: 506800 - DNA, 25 bp, Rattus norvegicus
tgtcccgctgcttaccttaatagtc

SEQ ID NO: 506801 - DNA, 25 bp, Rattus norvegicus
cccgtgggactccactgtggcgcaa

SEQ ID NO: 506802 - DNA, 25 bp, Rattus norvegicus
gtcccaggtttcagctgccgggtct

SEQ ID NO: 506803 - DNA, 25 bp, Rattus norvegicus
aagctggccgccagacgagtgcctg

SEQ ID NO: 506804 - DNA, 25 bp, Rattus norvegicus
atctcggcctctggcgtgaggaagc

SEQ ID NO: 506805 - DNA, 25 bp, Rattus norvegicus
aggggcttccatctggaccctccgg

SEQ ID NO: 506806 - DNA, 25 bp, Rattus norvegicus
tgacatgtaaacaggggcttccatc

SEQ ID NO: 506807 - DNA, 25 bp, Rattus norvegicus
aaccgatcgggctgacatgtaaaca

SEQ ID NO: 506808 - DNA, 25 bp, Rattus norvegicus
gcaaatcgcccgtcagcagcagtga

SEQ ID NO: 506809 - DNA, 25 bp, Rattus norvegicus
atagtcccgtccatttggccaattc

SEQ ID NO: 506810 - DNA, 25 bp, Rattus norvegicus
gctgaccagagagtgcaggctgaca

SEQ ID NO: 506811 - DNA, 25 bp, Rattus norvegicus
tcggagacccgagccccagacaatt

SEQ ID NO: 506812 - DNA, 25 bp, Rattus norvegicus
ccaagggagtcagaggctgaccaga

SEQ ID NO: 506813 - DNA, 25 bp, Rattus norvegicus
gacaattggaagtcgaacccccaga

SEQ ID NO: 506814 - DNA, 25 bp, Rattus norvegicus
agttcttgccttagtacggaccctg

SEQ ID NO: 506815 - DNA, 25 bp, Rattus norvegicus
cccacgctagttcttgccttagtac

SEQ ID NO: 506816 - DNA, 25 bp, Rattus norvegicus
tgccttagtacggaccctgttcaaa

SEQ ID NO: 506817 - DNA, 25 bp, Rattus norvegicus
cggaccctgttcaaaacgctacgtg

SEQ ID NO: 506818 - DNA, 25 bp, Rattus norvegicus
ttcaaaacgctacgtgggaggccgc

SEQ ID NO: 506819 - DNA, 25 bp, Rattus norvegicus
aaaacgctacgtgggaggccgcagc

SEQ ID NO: 506820 - DNA, 25 bp, Rattus norvegicus
cgccatgatggggactatggaggtc

SEQ ID NO: 506821 - DNA, 25 bp, Rattus norvegicus
tgtcgcgaccctcatccagtggcgg

SEQ ID NO: 506822 - DNA, 25 bp, Rattus norvegicus
gagaccagccgggtgtcgcgaccct

SEQ ID NO: 506823 - DNA, 25 bp, Rattus norvegicus
caggccaggagggtctcggagaccc

SEQ ID NO: 506824 - DNA, 25 bp, Rattus norvegicus
ccacgcctcatgtcctgtgtgtcaa

SEQ ID NO: 506825 - DNA, 25 bp, Rattus norvegicus
tcctgtgtgtcaagctttgtgaatg

SEQ ID NO: 506826 - DNA, 25 bp, Rattus norvegicus
tgaatgaatgatgtacacgcacttg

SEQ ID NO: 506827 - DNA, 25 bp, Rattus norvegicus
acttggaaaactatgctgctactgg

SEQ ID NO: 506828 - DNA, 25 bp, Rattus norvegicus
cagcgggtgaccaagcctctaagaa

SEQ ID NO: 506829 - DNA, 25 bp, Rattus norvegicus
agcctctaagaatgcgtgcagaatc

SEQ ID NO: 506830 - DNA, 25 bp, Rattus norvegicus
tgcgtgcagaatcagacggactttc

SEQ ID NO: 506831 - DNA, 25 bp, Rattus norvegicus
tcgccagccattctccggagcggtg

SEQ ID NO: 506832 - DNA, 25 bp, Rattus norvegicus
ttcgcttttggaacgcgggtgatga

SEQ ID NO: 506833 - DNA, 25 bp, Rattus norvegicus
tgggctcggtgaggaacgccctaaa

SEQ ID NO: 506834 - DNA, 25 bp, Rattus norvegicus
cgccctaaagcggaggcgagcctca

SEQ ID NO: 506835 - DNA, 25 bp, Rattus norvegicus
aggctgggacccaagcgcgctctct

SEQ ID NO: 506836 - DNA, 25 bp, Rattus norvegicus
gcgcacctttctgccgggcgatcag

SEQ ID NO: 506837 - DNA, 25 bp, Rattus norvegicus
caagtgccaacttcgcgccgactgg

SEQ ID NO: 506838 - DNA, 25 bp, Rattus norvegicus
agcccggcagcctgtgggtcctgca

SEQ ID NO: 506839 - DNA, 25 bp, Rattus norvegicus
tgggtcctgcaggtatcgctcgcct

SEQ ID NO: 506840 - DNA, 25 bp, Rattus norvegicus
tccctcgcagcgaactgcgagcagg

SEQ ID NO: 506841 - DNA, 25 bp, Rattus norvegicus
taaccgagcccccagaggaggtgag

SEQ ID NO: 506842 - DNA, 25 bp, Rattus norvegicus
tctgccccacgtggtagccgcggaa

SEQ ID NO: 506843 - DNA, 25 bp, Rattus norvegicus
gcaggtatcgctcgccttctctctg

SEQ ID NO: 506844 - DNA, 25 bp, Rattus norvegicus
gtcctgcaggtatcgctcgccttct

SEQ ID NO: 506845 - DNA, 25 bp, Rattus norvegicus
agccgcggaagattgccgttggttt

SEQ ID NO: 506846 - DNA, 25 bp, Rattus norvegicus
cagagcccggcagcctgtgggtcct

SEQ ID NO: 506847 - DNA, 25 bp, Rattus norvegicus
gccatcctacggtgacgggaggtta

SEQ ID NO: 506848 - DNA, 25 bp, Rattus norvegicus
agcaggccatcctacggtgacggga

SEQ ID NO: 506849 - DNA, 25 bp, Rattus norvegicus
tgcgagcaggccatcctacggtgac

SEQ ID NO: 506850 - DNA, 25 bp, Rattus norvegicus
gaactgcgagcaggccatcctacgg

SEQ ID NO: 506851 - DNA, 25 bp, Rattus norvegicus
agcgaactgcgagcaggccatccta

SEQ ID NO: 506852 - DNA, 25 bp, Rattus norvegicus
ggtttcttcactctttacccagcga

SEQ ID NO: 506853 - DNA, 25 bp, Rattus norvegicus
tcaggatcagcttatagtgataccc

SEQ ID NO: 506854 - DNA, 25 bp, Rattus norvegicus
gggtgctcctcaggatcagcttata

SEQ ID NO: 506855 - DNA, 25 bp, Rattus norvegicus
ttgtctgtggcatgggtgctcctca

SEQ ID NO: 506856 - DNA, 25 bp, Rattus norvegicus
cagtctcccagttgtctgtggcatg

SEQ ID NO: 506857 - DNA, 25 bp, Rattus norvegicus
tgcagtgctctcctgaccacagtct

SEQ ID NO: 506858 - DNA, 25 bp, Rattus norvegicus
aggcgctctgtgcagacctctgctc

SEQ ID NO: 506859 - DNA, 25 bp, Rattus norvegicus
agcaccttctactttccggcaggcg

SEQ ID NO: 506860 - DNA, 25 bp, Rattus norvegicus
ggccgaccttgaatagcaccttcta

SEQ ID NO: 506861 - DNA, 25 bp, Rattus norvegicus
aactgcctggggaggccgaccttga

SEQ ID NO: 506862 - DNA, 25 bp, Rattus norvegicus
tgtagagagccagcctaactgcctg

SEQ ID NO: 506863 - DNA, 25 bp, Rattus norvegicus
ccctgtttgtagagagccagcctaa

SEQ ID NO: 506864 - DNA, 25 bp, Rattus norvegicus
agacgtctgttgtgcatggggaaca

SEQ ID NO: 506865 - DNA, 25 bp, Rattus norvegicus
tacccagcgagctttattagacgtc

SEQ ID NO: 506866 - DNA, 25 bp, Rattus norvegicus
acagatagatggtcggcgcgaaccc

SEQ ID NO: 506867 - DNA, 25 bp, Rattus norvegicus
tgccggcccagtggcagtaagtagc

SEQ ID NO: 506868 - DNA, 25 bp, Rattus norvegicus
agaaactaactgctcgcccaagttg

SEQ ID NO: 506869 - DNA, 25 bp, Rattus norvegicus
cgtgcgctgaggaatgagacctttc

SEQ ID NO: 506870 - DNA, 25 bp, Rattus norvegicus
cagtggcagtaagtagcgtcgcttc

SEQ ID NO: 506871 - DNA, 25 bp, Rattus norvegicus
agccgccgctcttgaagagaaacta

SEQ ID NO: 506872 - DNA, 25 bp, Rattus norvegicus
aactcatactggctgcgggtctccg

SEQ ID NO: 506873 - DNA, 25 bp, Rattus norvegicus
gcaggctcgggaactcatactggct

SEQ ID NO: 506874 - DNA, 25 bp, Rattus norvegicus
cacagcgcgccagagttggagcaaa

SEQ ID NO: 506875 - DNA, 25 bp, Rattus norvegicus
agggacagaccgactgacagataga

SEQ ID NO: 506876 - DNA, 25 bp, Rattus norvegicus
tctgcttcttccttttcagtcaagg

SEQ ID NO: 506877 - DNA, 25 bp, Rattus norvegicus
gctggatttgctcttcctctgcttc

SEQ ID NO: 506878 - DNA, 25 bp, Rattus norvegicus
atgagacctttccagctggatttgc

SEQ ID NO: 506879 - DNA, 25 bp, Rattus norvegicus
tcagtcaaggtaggaacccggcaca

SEQ ID NO: 506880 - DNA, 25 bp, Rattus norvegicus
tcgggaagccgacagccgcgaacgc

SEQ ID NO: 506881 - DNA, 25 bp, Rattus norvegicus
acacggtcgggaagccgacagccgc

SEQ ID NO: 506882 - DNA, 25 bp, Rattus norvegicus
gcacacggtcgggaagccgacagcc

SEQ ID NO: 506883 - DNA, 25 bp, Rattus norvegicus
ggccggacacgcttgcgcacacggt

SEQ ID NO: 506884 - DNA, 25 bp, Rattus norvegicus
aaggggccggacacgcttgcgcaca

SEQ ID NO: 506885 - DNA, 25 bp, Rattus norvegicus
ctgggagcgggcaagtccgcctgaa

SEQ ID NO: 506886 - DNA, 25 bp, Rattus norvegicus
cgcgtactcaccctcgcgggtggaa

SEQ ID NO: 506887 - DNA, 25 bp, Rattus norvegicus
gcgcgcagctccgatccgttaggcg

SEQ ID NO: 506888 - DNA, 25 bp, Rattus norvegicus
cactggcgtagtggctccgctcggc

SEQ ID NO: 506889 - DNA, 25 bp, Rattus norvegicus
cgcagctccgatccgttaggcgccc

SEQ ID NO: 506890 - DNA, 25 bp, Rattus norvegicus
ggcgaggtaaatccgcgcgcagctc

SEQ ID NO: 506891 - DNA, 25 bp, Rattus norvegicus
cgtactcaccctcgcgggtggaacg

SEQ ID NO: 506892 - DNA, 25 bp, Rattus norvegicus
gggcaagtccgcctgaaggggaggc

SEQ ID NO: 506893 - DNA, 25 bp, Rattus norvegicus
cagcactggcgtagtggctccgctc

SEQ ID NO: 506894 - DNA, 25 bp, Rattus norvegicus
ttctgaaagggaggcgcagacttta

SEQ ID NO: 506895 - DNA, 25 bp, Rattus norvegicus
agaaaacttctgaaagggaggcgca

SEQ ID NO: 506896 - DNA, 25 bp, Rattus norvegicus
caaggggacgaggagaaaacttctg

SEQ ID NO: 506897 - DNA, 25 bp, Rattus norvegicus
ctgagcctcggtttgtcccgtgtgt

SEQ ID NO: 506898 - DNA, 25 bp, Rattus norvegicus
tcagaccgccgtgaaaccctgagcc

SEQ ID NO: 506899 - DNA, 25 bp, Rattus norvegicus
gccaccacccgcagctcaacccgga

SEQ ID NO: 506900 - DNA, 25 bp, Rattus norvegicus
ttgctcgggaatcccggctgcctgg

SEQ ID NO: 506901 - DNA, 25 bp, Rattus norvegicus
tcacccatccgcgttgctcgggaat

SEQ ID NO: 506902 - DNA, 25 bp, Rattus norvegicus
atgcccgctgaccagaccctagggg

SEQ ID NO: 506903 - DNA, 25 bp, Rattus norvegicus
ccagccactttcctgcccatgcccg

SEQ ID NO: 506904 - DNA, 25 bp, Rattus norvegicus
aaaagggctgactccgcaggctcgt

SEQ ID NO: 506905 - DNA, 25 bp, Rattus norvegicus
tgtccctggaaaagggctgactccg

SEQ ID NO: 506906 - DNA, 25 bp, Rattus norvegicus
agggaggcgcagactttactttctt

SEQ ID NO: 506907 - DNA, 25 bp, Rattus norvegicus
gctggcatcggtgccacagaaaggt

SEQ ID NO: 506908 - DNA, 25 bp, Rattus norvegicus
ggagtctcgcccatgtttgctatta

SEQ ID NO: 506909 - DNA, 25 bp, Rattus norvegicus
gcagcactttgcgaaacatggcctt

SEQ ID NO: 506910 - DNA, 25 bp, Rattus norvegicus
acatggccttacagagcccggcttc

SEQ ID NO: 506911 - DNA, 25 bp, Rattus norvegicus
cccggcttcttccagcttgaggtgc

SEQ ID NO: 506912 - DNA, 25 bp, Rattus norvegicus
ggcacaggccaagacgcagcacttt

SEQ ID NO: 506913 - DNA, 25 bp, Rattus norvegicus
cgctcaggccgactgtgtctttcta

SEQ ID NO: 506914 - DNA, 25 bp, Rattus norvegicus
gatcgcttcctttcctggatcactg

SEQ ID NO: 506915 - DNA, 25 bp, Rattus norvegicus
ccgattagccggcagtgctctttag

SEQ ID NO: 506916 - DNA, 25 bp, Rattus norvegicus
ttagtcttgcgcctacgtcatcccg

SEQ ID NO: 506917 - DNA, 25 bp, Rattus norvegicus
accatcttctcgaagggcgggcttg

SEQ ID NO: 506918 - DNA, 25 bp, Rattus norvegicus
cgttgattcgttctgtactgctgca

SEQ ID NO: 506919 - DNA, 25 bp, Rattus norvegicus
tggtccctcagacccagaccgtggt

SEQ ID NO: 506920 - DNA, 25 bp, Rattus norvegicus
aatcattccgcgtcttctgtcctga

SEQ ID NO: 506921 - DNA, 25 bp, Rattus norvegicus
tgtctttctagtcatcggtccgcgc

SEQ ID NO: 506922 - DNA, 25 bp, Rattus norvegicus
ctctctttccttcggctggcgctgt

SEQ ID NO: 506923 - DNA, 25 bp, Rattus norvegicus
caggtcctgagtatgagttcgcgta

SEQ ID NO: 506924 - DNA, 25 bp, Rattus norvegicus
caaagcgggaggttggactaagaca

SEQ ID NO: 506925 - DNA, 25 bp, Rattus norvegicus
cgcaggctatctacccacgtgatca

SEQ ID NO: 506926 - DNA, 25 bp, Rattus norvegicus
acgcttgccaggacagtgctctcca

SEQ ID NO: 506927 - DNA, 25 bp, Rattus norvegicus
gatccgggccatgcgaaaaccgttg

SEQ ID NO: 506928 - DNA, 25 bp, Rattus norvegicus
ctcggagaaggactggttacaaaca

SEQ ID NO: 506929 - DNA, 25 bp, Rattus norvegicus
tgctctccaagaatgcagatccggg

SEQ ID NO: 506930 - DNA, 25 bp, Rattus norvegicus
acagatccgggaatctccagagggc

SEQ ID NO: 506931 - DNA, 25 bp, Rattus norvegicus
agaacacgacacgtccctctgagga

SEQ ID NO: 506932 - DNA, 25 bp, Rattus norvegicus
tgccggtaaagactgaggagcagcc

SEQ ID NO: 506933 - DNA, 25 bp, Rattus norvegicus
gagcagccagcttcacttctaaagg

SEQ ID NO: 506934 - DNA, 25 bp, Rattus norvegicus
aagtgtttttgagtggagtcgtgcc

SEQ ID NO: 506935 - DNA, 25 bp, Rattus norvegicus
cctcgatgaaggaaaagaaccgtca

SEQ ID NO: 506936 - DNA, 25 bp, Rattus norvegicus
agcctcggtgtctggctcaggcaac

SEQ ID NO: 506937 - DNA, 25 bp, Rattus norvegicus
gtgtctggctcaggcaactcgccct

SEQ ID NO: 506938 - DNA, 25 bp, Rattus norvegicus
ccctcaccgggtcggcagaactgga

SEQ ID NO: 506939 - DNA, 25 bp, Rattus norvegicus
agaactggaggcttcggccgcactt

SEQ ID NO: 506940 - DNA, 25 bp, Rattus norvegicus
cacttgcctgcaggggtgtccgtgt

SEQ ID NO: 506941 - DNA, 25 bp, Rattus norvegicus
tgcccgccgctgatctggcaggctg

SEQ ID NO: 506942 - DNA, 25 bp, Rattus norvegicus
aaaggcagttgagggatgccctgca

SEQ ID NO: 506943 - DNA, 25 bp, Rattus norvegicus
agggatgccctgcagtcggctcacc

SEQ ID NO: 506944 - DNA, 25 bp, Rattus norvegicus
cgcgcagagccacctcgcaggagga

SEQ ID NO: 506945 - DNA, 25 bp, Rattus norvegicus
gtgtcagtgacacgctgaggtcttc

SEQ ID NO: 506946 - DNA, 25 bp, Rattus norvegicus
cgctgaggtcttcttcggagatcta

SEQ ID NO: 506947 - DNA, 25 bp, Rattus norvegicus
cttcggagatctaccagggcaggtg

SEQ ID NO: 506948 - DNA, 25 bp, Rattus norvegicus
atgcggaggccagcttgcccgtaga

SEQ ID NO: 506949 - DNA, 25 bp, Rattus norvegicus
tgagtgcagatctgactggagcctc

SEQ ID NO: 506950 - DNA, 25 bp, Rattus norvegicus
gacactgagaacgccggggagcaac

SEQ ID NO: 506951 - DNA, 25 bp, Rattus norvegicus
agttcgctccctttactgctcttca

SEQ ID NO: 506952 - DNA, 25 bp, Rattus norvegicus
tgctgtacgcagttcgctcccttta

SEQ ID NO: 506953 - DNA, 25 bp, Rattus norvegicus
cggtccctgctgtacgcagttcgct

SEQ ID NO: 506954 - DNA, 25 bp, Rattus norvegicus
agtacagcttcctggcagcgccact

SEQ ID NO: 506955 - DNA, 25 bp, Rattus norvegicus
caccgcagagtacagcttcctggca

SEQ ID NO: 506956 - DNA, 25 bp, Rattus norvegicus
gggttgcaccgcagagtacagcttc

SEQ ID NO: 506957 - DNA, 25 bp, Rattus norvegicus
agactgcgggttgcaccgcagagta

SEQ ID NO: 506958 - DNA, 25 bp, Rattus norvegicus
atcgtcgctcgctcgcaccgttggg

SEQ ID NO: 506959 - DNA, 25 bp, Rattus norvegicus
tccgggcgctgtcaccggggcacat

SEQ ID NO: 506960 - DNA, 25 bp, Rattus norvegicus
ccctccgggcactgtgaacgtcagg

SEQ ID NO: 506961 - DNA, 25 bp, Rattus norvegicus
gcactgtgaacgtcaggccctgagc

SEQ ID NO: 506962 - DNA, 25 bp, Rattus norvegicus
tgtcaccggggcacatcgtcgctcg

SEQ ID NO: 506963 - DNA, 25 bp, Rattus norvegicus
tactgctcttcaagctcacccgatt

SEQ ID NO: 506964 - DNA, 25 bp, Rattus norvegicus
cggcgtccgcctcgcgaccacccgt

SEQ ID NO: 506965 - DNA, 25 bp, Rattus norvegicus
ggcacggaggcggtagacacaccgc

SEQ ID NO: 506966 - DNA, 25 bp, Rattus norvegicus
accagtcggccatccgcacagcaga

SEQ ID NO: 506967 - DNA, 25 bp, Rattus norvegicus
ttccgtttgaccagtcggccatccg

SEQ ID NO: 506968 - DNA, 25 bp, Rattus norvegicus
agctttccgtttgaccagtcggcca

SEQ ID NO: 506969 - DNA, 25 bp, Rattus norvegicus
ctgtgcgggacacccgcgagctttc

SEQ ID NO: 506970 - DNA, 25 bp, Rattus norvegicus
ccaatggtcaggctccgggaccggc

SEQ ID NO: 506971 - DNA, 25 bp, Rattus norvegicus
gctcagtggccaatggtcaggctcc

SEQ ID NO: 506972 - DNA, 25 bp, Rattus norvegicus
gcgccggctcggctcagtggccaat

SEQ ID NO: 506973 - DNA, 25 bp, Rattus norvegicus
gtaacgacgccatagctgcggtctc

SEQ ID NO: 506974 - DNA, 25 bp, Rattus norvegicus
gctgttcagccgctcgctctccgcc

SEQ ID NO: 506975 - DNA, 25 bp, Rattus norvegicus
cccaaagtaacgacgccatagctgc

SEQ ID NO: 506976 - DNA, 25 bp, Rattus norvegicus
cgcgagctttccgtttgaccagtcg

SEQ ID NO: 506977 - DNA, 25 bp, Rattus norvegicus
gacgccatagctgcggtctctgctc

SEQ ID NO: 506978 - DNA, 25 bp, Rattus norvegicus
tcacattgtgacctgcaagggtatg

SEQ ID NO: 506979 - DNA, 25 bp, Rattus norvegicus
tgtatcccggcagcaggttaaaggc

SEQ ID NO: 506980 - DNA, 25 bp, Rattus norvegicus
gtccgagcagctcacgccgacattt

SEQ ID NO: 506981 - DNA, 25 bp, Rattus norvegicus
gccgacatttaccttgaacgcaaga

SEQ ID NO: 506982 - DNA, 25 bp, Rattus norvegicus
ccgctgcaccctctttcaggaaaag

SEQ ID NO: 506983 - DNA, 25 bp, Rattus norvegicus
tcaggaaaagtccacccgcttcgcg

SEQ ID NO: 506984 - DNA, 25 bp, Rattus norvegicus
cgcaggcgcacaattccaagctctg

SEQ ID NO: 506985 - DNA, 25 bp, Rattus norvegicus
agctctgagtagtcgttaacggttc

SEQ ID NO: 506986 - DNA, 25 bp, Rattus norvegicus
ctgttcaagtttaaatcccggagcg

SEQ ID NO: 506987 - DNA, 25 bp, Rattus norvegicus
ctctcgttggtccagaggccaaacg

SEQ ID NO: 506988 - DNA, 25 bp, Rattus norvegicus
gcgcggtagctgtttcctttttgtc

SEQ ID NO: 506989 - DNA, 25 bp, Rattus norvegicus
aggaccgcctgaccaatgccaactg

SEQ ID NO: 506990 - DNA, 25 bp, Rattus norvegicus
tctggcagtcttgtcgcagctcact

SEQ ID NO: 506991 - DNA, 25 bp, Rattus norvegicus
gcaggccgggtgtacatcacattgt

SEQ ID NO: 506992 - DNA, 25 bp, Rattus norvegicus
agaatccatccaaacggcgcatcgg

SEQ ID NO: 506993 - DNA, 25 bp, Rattus norvegicus
ctaaagccggaaaagcatgcgaacc

SEQ ID NO: 506994 - DNA, 25 bp, Rattus norvegicus
ggccgcggtaagacacaggctaatg

SEQ ID NO: 506995 - DNA, 25 bp, Rattus norvegicus
ccgagctctaccgaggagcaatttc

SEQ ID NO: 506996 - DNA, 25 bp, Rattus norvegicus
gctgtcgcaaaagcgcacacctttg

SEQ ID NO: 506997 - DNA, 25 bp, Rattus norvegicus
gccaaaacctgcttgcgtcatgctg

SEQ ID NO: 506998 - DNA, 25 bp, Rattus norvegicus
gccagctgccacaggaatccaagtg

SEQ ID NO: 506999 - DNA, 25 bp, Rattus norvegicus
ccctctgggtactttgctggagttc

SEQ ID NO: 507000 - DNA, 25 bp, Rattus norvegicus
ccgcactaatcaagccctctgggta

SEQ ID NO: 507001 - DNA, 25 bp, Rattus norvegicus
cggaggcttacaaaaagctctggtc

SEQ ID NO: 507002 - DNA, 25 bp, Rattus norvegicus
cctccttcaagtactgggcgtgctt

SEQ ID NO: 507003 - DNA, 25 bp, Rattus norvegicus
cgtgcactatgctggacgccttaca

SEQ ID NO: 507004 - DNA, 25 bp, Rattus norvegicus
acgactgctttggtgagaagtgatc

SEQ ID NO: 507005 - DNA, 25 bp, Rattus norvegicus
ctgagtcccagagtgaaatggcatc

SEQ ID NO: 507006 - DNA, 25 bp, Rattus norvegicus
caaagatgaccggaaggtaaggccg

SEQ ID NO: 507007 - DNA, 25 bp, Rattus norvegicus
agtgggctagattccctgaccctga

SEQ ID NO: 507008 - DNA, 25 bp, Rattus norvegicus
gattccctgaccctgagtgcggttc

SEQ ID NO: 507009 - DNA, 25 bp, Rattus norvegicus
ctgagtgcggttctgcccagccctg

SEQ ID NO: 507010 - DNA, 25 bp, Rattus norvegicus
cccagccctgtgagcagggtcgttc

SEQ ID NO: 507011 - DNA, 25 bp, Rattus norvegicus
cgttctcgggaagcaggacattcta

SEQ ID NO: 507012 - DNA, 25 bp, Rattus norvegicus
ggacattctatctcttcgccgagga

SEQ ID NO: 507013 - DNA, 25 bp, Rattus norvegicus
gccgacgccttcaaagatgaccgga

SEQ ID NO: 507014 - DNA, 25 bp, Rattus norvegicus
tcaaccggaggtatacgctagagcg

SEQ ID NO: 507015 - DNA, 25 bp, Rattus norvegicus
tctcttcgccgaggagacaagactg

SEQ ID NO: 507016 - DNA, 25 bp, Rattus norvegicus
cgctagagcgttacaccatttccga

SEQ ID NO: 507017 - DNA, 25 bp, Rattus norvegicus
cgttacaccatttccgaggaggagg

SEQ ID NO: 507018 - DNA, 25 bp, Rattus norvegicus
ggagacaagactggatttctgcagc

SEQ ID NO: 507019 - DNA, 25 bp, Rattus norvegicus
gatttctgcagcaaaatcaaccgga

SEQ ID NO: 507020 - DNA, 25 bp, Rattus norvegicus
ggaccgacaggataacggttctgtc

SEQ ID NO: 507021 - DNA, 25 bp, Rattus norvegicus
ccaggccgcaagcagggctcggctc

SEQ ID NO: 507022 - DNA, 25 bp, Rattus norvegicus
aggccagcctccagcacctcgttca

SEQ ID NO: 507023 - DNA, 25 bp, Rattus norvegicus
agcacctcgttcaagcccgccaaca

SEQ ID NO: 507024 - DNA, 25 bp, Rattus norvegicus
ccacttcaggggaccgacaggataa

SEQ ID NO: 507025 - DNA, 25 bp, Rattus norvegicus
gatgctcctccggaacccactctgc

SEQ ID NO: 507026 - DNA, 25 bp, Rattus norvegicus
actccgcattggctggcctcggtca

SEQ ID NO: 507027 - DNA, 25 bp, Rattus norvegicus
ggttctgtctgtcatttcgagggcg

SEQ ID NO: 507028 - DNA, 25 bp, Rattus norvegicus
gccatccgttcagcggcgcacccaa

SEQ ID NO: 507029 - DNA, 25 bp, Rattus norvegicus
cggcgcacccaaccctgacagtagc

SEQ ID NO: 507030 - DNA, 25 bp, Rattus norvegicus
tgacagtagccaaggcccgcctccc

SEQ ID NO: 507031 - DNA, 25 bp, Rattus norvegicus
caatgaccacttcaggggaccgaca

SEQ ID NO: 507032 - DNA, 25 bp, Rattus norvegicus
ggctggcctcggtcaatgaccactt

SEQ ID NO: 507033 - DNA, 25 bp, Rattus norvegicus
ctatcgctacccaagagccttctca

SEQ ID NO: 507034 - DNA, 25 bp, Rattus norvegicus
gaaacccgcggagagagcgtgctct

SEQ ID NO: 507035 - DNA, 25 bp, Rattus norvegicus
aaatacgtagagaaagcggaggtcg

SEQ ID NO: 507036 - DNA, 25 bp, Rattus norvegicus
tgagcagaagcggaaatacgtagag

SEQ ID NO: 507037 - DNA, 25 bp, Rattus norvegicus
gtgaccacgagttcccaccgagctg

SEQ ID NO: 507038 - DNA, 25 bp, Rattus norvegicus
accacgagttcccaccgagctgtga

SEQ ID NO: 507039 - DNA, 25 bp, Rattus norvegicus
acagtttggttgagagccgagaagt

SEQ ID NO: 507040 - DNA, 25 bp, Rattus norvegicus
accgagctgtgataggccaacgcgg

SEQ ID NO: 507041 - DNA, 25 bp, Rattus norvegicus
tgacgtgtcggtctgcagaccagga

SEQ ID NO: 507042 - DNA, 25 bp, Rattus norvegicus
agcgtgctctgaacagtttggttga

SEQ ID NO: 507043 - DNA, 25 bp, Rattus norvegicus
atgggaaggagtggacactgtaccc

SEQ ID NO: 507044 - DNA, 25 bp, Rattus norvegicus
accaggaagaaaccgtgatgggaag

SEQ ID NO: 507045 - DNA, 25 bp, Rattus norvegicus
tctgcagaccaggaagaaaccgtga

SEQ ID NO: 507046 - DNA, 25 bp, Rattus norvegicus
ccgagaagtgacgtgtcggtctgca

SEQ ID NO: 507047 - DNA, 25 bp, Rattus norvegicus
gttcccaccgagctgtgataggcca

SEQ ID NO: 507048 - DNA, 25 bp, Rattus norvegicus
cgtcagggcaattgggatgagaccc

SEQ ID NO: 507049 - DNA, 25 bp, Rattus norvegicus
actcccgcgtacaaggtgcggacca

SEQ ID NO: 507050 - DNA, 25 bp, Rattus norvegicus
cggacacaggctgcctcctgagcaa

SEQ ID NO: 507051 - DNA, 25 bp, Rattus norvegicus
tgctagctctcgatgggccctgcca

SEQ ID NO: 507052 - DNA, 25 bp, Rattus norvegicus
cctcctgagcaacgtggggtgctcg

SEQ ID NO: 507053 - DNA, 25 bp, Rattus norvegicus
accgaggttcggttcgcctgctccg

SEQ ID NO: 507054 - DNA, 25 bp, Rattus norvegicus
caggctccgacttgcaagcggctcg

SEQ ID NO: 507055 - DNA, 25 bp, Rattus norvegicus
agctccggcctgctagctctcgatg

SEQ ID NO: 507056 - DNA, 25 bp, Rattus norvegicus
tccagaatctcaggaactagctccg

SEQ ID NO: 507057 - DNA, 25 bp, Rattus norvegicus
aaagatagcctctccgcacctgggg

SEQ ID NO: 507058 - DNA, 25 bp, Rattus norvegicus
ggtcaccggagctaaagatagcctc

SEQ ID NO: 507059 - DNA, 25 bp, Rattus norvegicus
cgctcactgagggtcaccggagcta

SEQ ID NO: 507060 - DNA, 25 bp, Rattus norvegicus
acaaggtgcggaccacgctcactga

SEQ ID NO: 507061 - DNA, 25 bp, Rattus norvegicus
acttgcaagcggctcgagcccactg

SEQ ID NO: 507062 - DNA, 25 bp, Rattus norvegicus
gatgtctggctgaaccccgggatcc

SEQ ID NO: 507063 - DNA, 25 bp, Rattus norvegicus
aaaagatgacgttcaggccctgggc

SEQ ID NO: 507064 - DNA, 25 bp, Rattus norvegicus
aagatgacgttcaggccctgggcgc

SEQ ID NO: 507065 - DNA, 25 bp, Rattus norvegicus
gctagctggcttgcccgctgccgtt

SEQ ID NO: 507066 - DNA, 25 bp, Rattus norvegicus
tggcttgcccgctgccgttgcactg

SEQ ID NO: 507067 - DNA, 25 bp, Rattus norvegicus
accgggccacctctagccggtggat

SEQ ID NO: 507068 - DNA, 25 bp, Rattus norvegicus
cgggatccgattccctcctccagga

SEQ ID NO: 507069 - DNA, 25 bp, Rattus norvegicus
tccaggacctgctcaggtgcggtgg

SEQ ID NO: 507070 - DNA, 25 bp, Rattus norvegicus
tgggaaggacgactttagtctggac

SEQ ID NO: 507071 - DNA, 25 bp, Rattus norvegicus
aggacgactttagtctggactagtc

SEQ ID NO: 507072 - DNA, 25 bp, Rattus norvegicus
ctttagtctggactagtcccagtgc

SEQ ID NO: 507073 - DNA, 25 bp, Rattus norvegicus
agtctggactagtcccagtgctggg

SEQ ID NO: 507074 - DNA, 25 bp, Rattus norvegicus
tcgaatccgggtggtgaaggagacc

SEQ ID NO: 507075 - DNA, 25 bp, Rattus norvegicus
ctgccgttgcactgcaccgggccac

SEQ ID NO: 507076 - DNA, 25 bp, Rattus norvegicus
tttcaatagcctgatccggagtctc

SEQ ID NO: 507077 - DNA, 25 bp, Rattus norvegicus
tgcgctcgtttcttccatggctttg

SEQ ID NO: 507078 - DNA, 25 bp, Rattus norvegicus
attcagccctgtgcaccgagatcca

SEQ ID NO: 507079 - DNA, 25 bp, Rattus norvegicus
tctttagggagagaagccgcagaca

SEQ ID NO: 507080 - DNA, 25 bp, Rattus norvegicus
caccgtggctgggataaactacttt

SEQ ID NO: 507081 - DNA, 25 bp, Rattus norvegicus
ctcacgcatgctgtcaggacccgga

SEQ ID NO: 507082 - DNA, 25 bp, Rattus norvegicus
cctctgtctttgctggtgtgtaaac

SEQ ID NO: 507083 - DNA, 25 bp, Rattus norvegicus
ctcctttaagggctgatccgcatcc

SEQ ID NO: 507084 - DNA, 25 bp, Rattus norvegicus
aacttcgcgcggcacattcaggacc

SEQ ID NO: 507085 - DNA, 25 bp, Rattus norvegicus
tcctagttagagtccctgagcgtcg

SEQ ID NO: 507086 - DNA, 25 bp, Rattus norvegicus
cgggttctggtttctctgactgaca

SEQ ID NO: 507087 - DNA, 25 bp, Rattus norvegicus
tccaaccactcgaaggcagctgaca

SEQ ID NO: 507088 - DNA, 25 bp, Rattus norvegicus
aagcgccagccacaggactcctaga

SEQ ID NO: 507089 - DNA, 25 bp, Rattus norvegicus
ccggagtcaagcctcggatgtaacc

SEQ ID NO: 507090 - DNA, 25 bp, Rattus norvegicus
cagctgtccctagagaaggcgcgga

SEQ ID NO: 507091 - DNA, 25 bp, Rattus norvegicus
gccagtgtcggcagcgatttaaatg

SEQ ID NO: 507092 - DNA, 25 bp, Rattus norvegicus
gagcaagtctctgcgcgtcttggta

SEQ ID NO: 507093 - DNA, 25 bp, Rattus norvegicus
ctgctcaccagctgtccctagagaa

SEQ ID NO: 507094 - DNA, 25 bp, Rattus norvegicus
cgccggagcaagtctctgcgcgtct

SEQ ID NO: 507095 - DNA, 25 bp, Rattus norvegicus
gaaggcgcggaggaaccagataccc

SEQ ID NO: 507096 - DNA, 25 bp, Rattus norvegicus
acgcgcagagacatccgccgccgga

SEQ ID NO: 507097 - DNA, 25 bp, Rattus norvegicus
gaggaaccagatacccggagccagg

SEQ ID NO: 507098 - DNA, 25 bp, Rattus norvegicus
gagccagggaagaccgcatcttgcg

SEQ ID NO: 507099 - DNA, 25 bp, Rattus norvegicus
aagaccgcatcttgcggcgcccgta

SEQ ID NO: 507100 - DNA, 25 bp, Rattus norvegicus
gcgcccgtactcgaagctgggacta

SEQ ID NO: 507101 - DNA, 25 bp, Rattus norvegicus
cgtactcgaagctgggactacggag

SEQ ID NO: 507102 - DNA, 25 bp, Rattus norvegicus
agtgtcggcagcgatttaaatgccc

SEQ ID NO: 507103 - DNA, 25 bp, Rattus norvegicus
aagtctctgcgcgtcttggtagcct

SEQ ID NO: 507104 - DNA, 25 bp, Rattus norvegicus
ggccgctcacgcagctcctcgcgct

SEQ ID NO: 507105 - DNA, 25 bp, Rattus norvegicus
ttgtaggactcctcagagccggatg

SEQ ID NO: 507106 - DNA, 25 bp, Rattus norvegicus
tcctcagagccggatgagaatcccg

SEQ ID NO: 507107 - DNA, 25 bp, Rattus norvegicus
agccggatgagaatcccgctacaga

SEQ ID NO: 507108 - DNA, 25 bp, Rattus norvegicus
ctacagagccacgaagcaccacaga

SEQ ID NO: 507109 - DNA, 25 bp, Rattus norvegicus
gcgcctgtgtttgtaggactcctca

SEQ ID NO: 507110 - DNA, 25 bp, Rattus norvegicus
ctcactgcggactgctggcgtgcac

SEQ ID NO: 507111 - DNA, 25 bp, Rattus norvegicus
cggactgctggcgtgcacagaatcc

SEQ ID NO: 507112 - DNA, 25 bp, Rattus norvegicus
cgtgcacagaatccgggagcaggac

SEQ ID NO: 507113 - DNA, 25 bp, Rattus norvegicus
aggtggaaatcagtgcctgagcctc

SEQ ID NO: 507114 - DNA, 25 bp, Rattus norvegicus
aaatcagtgcctgagcctcctcggg

SEQ ID NO: 507115 - DNA, 25 bp, Rattus norvegicus
cctcctcgggaaccctctgcggttg

SEQ ID NO: 507116 - DNA, 25 bp, Rattus norvegicus
tctgcggttgcccacggtctgctct

SEQ ID NO: 507117 - DNA, 25 bp, Rattus norvegicus
tgagaatcccgctacagagccacga

SEQ ID NO: 507118 - DNA, 25 bp, Rattus norvegicus
ggatgctccaatgcgtccacgcgcc

SEQ ID NO: 507119 - DNA, 25 bp, Rattus norvegicus
ggctcgcgcggatgctccaatgcgt

SEQ ID NO: 507120 - DNA, 25 bp, Rattus norvegicus
gctcgcgcggatgctccaatgcgtc

SEQ ID NO: 507121 - DNA, 25 bp, Rattus norvegicus
tcgcgcggatgctccaatgcgtcca

SEQ ID NO: 507122 - DNA, 25 bp, Rattus norvegicus
gcgcggatgctccaatgcgtccacg

SEQ ID NO: 507123 - DNA, 25 bp, Rattus norvegicus
gcggatgctccaatgcgtccacgcg

SEQ ID NO: 507124 - DNA, 25 bp, Rattus norvegicus
ctgactggctgggtccctcccggag

SEQ ID NO: 507125 - DNA, 25 bp, Rattus norvegicus
tgactggctgggtccctcccggagc

SEQ ID NO: 507126 - DNA, 25 bp, Rattus norvegicus
ccgctccgcgctgtcaccgtcgcca

SEQ ID NO: 507127 - DNA, 25 bp, Rattus norvegicus
ctccgcgctgtcaccgtcgccaggc

SEQ ID NO: 507128 - DNA, 25 bp, Rattus norvegicus
tgtcaccgtcgccaggcgcctcact

SEQ ID NO: 507129 - DNA, 25 bp, Rattus norvegicus
tcgccaggcgcctcactgccttgcg

SEQ ID NO: 507130 - DNA, 25 bp, Rattus norvegicus
gcaggtgcaagtgggcgcctcctcc

SEQ ID NO: 507131 - DNA, 25 bp, Rattus norvegicus
ccgcgcgccctgactggctgggtcc

SEQ ID NO: 507132 - DNA, 25 bp, Rattus norvegicus
caccggtataatgactgagctcttt

SEQ ID NO: 507133 - DNA, 25 bp, Rattus norvegicus
aaatccaggggctcggaaggcgcca

SEQ ID NO: 507134 - DNA, 25 bp, Rattus norvegicus
tcagagagataaaaggagacgaacc

SEQ ID NO: 507135 - DNA, 25 bp, Rattus norvegicus
ctccgcaaccggagggaatgctgtg

SEQ ID NO: 507136 - DNA, 25 bp, Rattus norvegicus
agcaccctagacaaccgttccgcca

SEQ ID NO: 507137 - DNA, 25 bp, Rattus norvegicus
gaaagcaggcttccgcagcacccta

SEQ ID NO: 507138 - DNA, 25 bp, Rattus norvegicus
ctgccagccaggaaagcaggcttcc

SEQ ID NO: 507139 - DNA, 25 bp, Rattus norvegicus
gcgctgctgccagccaggaaagcag

SEQ ID NO: 507140 - DNA, 25 bp, Rattus norvegicus
ataatgactgagctctttgcgttgc

SEQ ID NO: 507141 - DNA, 25 bp, Rattus norvegicus
tggctctcaccggtataatgactga

SEQ ID NO: 507142 - DNA, 25 bp, Rattus norvegicus
gactgagctctttgcgttgcttctg

SEQ ID NO: 507143 - DNA, 25 bp, Rattus norvegicus
ctctttgcgttgcttctggcgccga

SEQ ID NO: 507144 - DNA, 25 bp, Rattus norvegicus
ctcggaaggcgccattccggatccg

SEQ ID NO: 507145 - DNA, 25 bp, Rattus norvegicus
tgcgttgcttctggcgccgatagag

SEQ ID NO: 507146 - DNA, 25 bp, Rattus norvegicus
gtcgaggccggccttcagcacggca

SEQ ID NO: 507147 - DNA, 25 bp, Rattus norvegicus
cacgatgcgtggcatggcatcctcg

SEQ ID NO: 507148 - DNA, 25 bp, Rattus norvegicus
gccgagagcgacgcccgtgcacgat

SEQ ID NO: 507149 - DNA, 25 bp, Rattus norvegicus
agcaggcggtgagcccgcggatcct

SEQ ID NO: 507150 - DNA, 25 bp, Rattus norvegicus
ggatcctcgcgtgcagtggccacgc

SEQ ID NO: 507151 - DNA, 25 bp, Rattus norvegicus
cccattcttgtaccactcgatgttg

SEQ ID NO: 507152 - DNA, 25 bp, Rattus norvegicus
ttcttgtaccactcgatgttgggtc

SEQ ID NO: 507153 - DNA, 25 bp, Rattus norvegicus
taccactcgatgttgggtcgaggcc

SEQ ID NO: 507154 - DNA, 25 bp, Rattus norvegicus
ccggccttcagcacggcagggcaga

SEQ ID NO: 507155 - DNA, 25 bp, Rattus norvegicus
ccctggaaacgagcagatctggcgg

SEQ ID NO: 507156 - DNA, 25 bp, Rattus norvegicus
acgagcagatctggcggctgctcca

SEQ ID NO: 507157 - DNA, 25 bp, Rattus norvegicus
agatctggcggctgctccacgatgc

SEQ ID NO: 507158 - DNA, 25 bp, Rattus norvegicus
agagtggccggctcgcccctggaaa

SEQ ID NO: 507159 - DNA, 25 bp, Rattus norvegicus
gctccacgatgcgtggcatggcatc

SEQ ID NO: 507160 - DNA, 25 bp, Rattus norvegicus
cttgaccggtagtgtccgagccgga

SEQ ID NO: 507161 - DNA, 25 bp, Rattus norvegicus
ttgctgtttggcaggcctgtcctag

SEQ ID NO: 507162 - DNA, 25 bp, Rattus norvegicus
ccacaatgcactgcgtggcgcgtca

SEQ ID NO: 507163 - DNA, 25 bp, Rattus norvegicus
atttagggctgcgagcctcgcggcc

SEQ ID NO: 507164 - DNA, 25 bp, Rattus norvegicus
ggtccctgtgcgacaggtacggccc

SEQ ID NO: 507165 - DNA, 25 bp, Rattus norvegicus
acagcgcccgattggcccaagcgag

SEQ ID NO: 507166 - DNA, 25 bp, Rattus norvegicus
cgggtctctggatgcttcccacagc

SEQ ID NO: 507167 - DNA, 25 bp, Rattus norvegicus
cctcgcggccggcagttgctgtttg

SEQ ID NO: 507168 - DNA, 25 bp, Rattus norvegicus
gtccacctcggcttgaccggtagtg

SEQ ID NO: 507169 - DNA, 25 bp, Rattus norvegicus
tccgggagctctgcctggctgtttg

SEQ ID NO: 507170 - DNA, 25 bp, Rattus norvegicus
ttttcagcttcctcagggtctccgg

SEQ ID NO: 507171 - DNA, 25 bp, Rattus norvegicus
ctcttttcagcttcctcagggtctc

SEQ ID NO: 507172 - DNA, 25 bp, Rattus norvegicus
cgccagccacgttggacgcgggcat

SEQ ID NO: 507173 - DNA, 25 bp, Rattus norvegicus
tccctgcgatttagggctgcgagcc

SEQ ID NO: 507174 - DNA, 25 bp, Rattus norvegicus
tgttttaagcaggtagcgcagcata

SEQ ID NO: 507175 - DNA, 25 bp, Rattus norvegicus
ctgccagcgaggagttgaaaccgaa

SEQ ID NO: 507176 - DNA, 25 bp, Rattus norvegicus
cggaaagcaggtgccactcggatca

SEQ ID NO: 507177 - DNA, 25 bp, Rattus norvegicus
gttgaaaccgaagagtagctcgctg

SEQ ID NO: 507178 - DNA, 25 bp, Rattus norvegicus
accgaagagtagctcgctggagttg

SEQ ID NO: 507179 - DNA, 25 bp, Rattus norvegicus
ttggtgatgtctcccgccagggagt

SEQ ID NO: 507180 - DNA, 25 bp, Rattus norvegicus
cagggagtccgcgaacaagttcatc

SEQ ID NO: 507181 - DNA, 25 bp, Rattus norvegicus
caagttcatctgtagtagtgtttta

SEQ ID NO: 507182 - DNA, 25 bp, Rattus norvegicus
gctgtcctccttcgctggttcttct

SEQ ID NO: 507183 - DNA, 25 bp, Rattus norvegicus
agcgcagcataatgcggcctgcctg

SEQ ID NO: 507184 - DNA, 25 bp, Rattus norvegicus
tcacgccgtaattaagggcttaatc

SEQ ID NO: 507185 - DNA, 25 bp, Rattus norvegicus
tgccactcggatcacgccgtaatta

SEQ ID NO: 507186 - DNA, 25 bp, Rattus norvegicus
tgccgctgtcctgcaggcgtgcctg

SEQ ID NO: 507187 - DNA, 25 bp, Rattus norvegicus
cgtgcctgggtacggccgtgcctct

SEQ ID NO: 507188 - DNA, 25 bp, Rattus norvegicus
tcgtaaatttggagcagatgcggcc

SEQ ID NO: 507189 - DNA, 25 bp, Rattus norvegicus
gcgcggcgacacacaatgggccatc

SEQ ID NO: 507190 - DNA, 25 bp, Rattus norvegicus
acaatgggccatcgaggataccggg

SEQ ID NO: 507191 - DNA, 25 bp, Rattus norvegicus
ggataccgggcacagcgaaagttgt

SEQ ID NO: 507192 - DNA, 25 bp, Rattus norvegicus
cgaaagttgtgcattggtccctccc

SEQ ID NO: 507193 - DNA, 25 bp, Rattus norvegicus
ttggtctccggtgcagacctctcca

SEQ ID NO: 507194 - DNA, 25 bp, Rattus norvegicus
ctcagcccgggtatcttctcagcga

SEQ ID NO: 507195 - DNA, 25 bp, Rattus norvegicus
ctcagcgaccgagtagcagcgcttt

SEQ ID NO: 507196 - DNA, 25 bp, Rattus norvegicus
agcagcgcttttggctcccactttc

SEQ ID NO: 507197 - DNA, 25 bp, Rattus norvegicus
atcagccgctccctggcgggctgga

SEQ ID NO: 507198 - DNA, 25 bp, Rattus norvegicus
ctggagtaatgagccgccaggcaac

SEQ ID NO: 507199 - DNA, 25 bp, Rattus norvegicus
cagcacttggtaaagaggccgtgga

SEQ ID NO: 507200 - DNA, 25 bp, Rattus norvegicus
ctggcagtcagtcacccagctcggg

SEQ ID NO: 507201 - DNA, 25 bp, Rattus norvegicus
cctcagctggggcagcacttggtaa

SEQ ID NO: 507202 - DNA, 25 bp, Rattus norvegicus
cggccatgtacgagcgcgtgtcccg

SEQ ID NO: 507203 - DNA, 25 bp, Rattus norvegicus
gcatcaaggtaaccggccgctctgc

SEQ ID NO: 507204 - DNA, 25 bp, Rattus norvegicus
cttctcagctcggagctccggtgcg

SEQ ID NO: 507205 - DNA, 25 bp, Rattus norvegicus
agcggccagagccaacatgctggag

SEQ ID NO: 507206 - DNA, 25 bp, Rattus norvegicus
aggcaaaaatttgcgggccgcttga

SEQ ID NO: 507207 - DNA, 25 bp, Rattus norvegicus
ggccgcttgagccagccagacacat

SEQ ID NO: 507208 - DNA, 25 bp, Rattus norvegicus
tcgccgctaaaaattccgaagatgg

SEQ ID NO: 507209 - DNA, 25 bp, Rattus norvegicus
atgccgggagcgcatcaaggtaacc

SEQ ID NO: 507210 - DNA, 25 bp, Rattus norvegicus
gcttctcctggcgatctgagcgacg

SEQ ID NO: 507211 - DNA, 25 bp, Rattus norvegicus
tgagcgacgggaacccatcactgtc

SEQ ID NO: 507212 - DNA, 25 bp, Rattus norvegicus
cgccggcagagacgaacgcgctcat

SEQ ID NO: 507213 - DNA, 25 bp, Rattus norvegicus
acgcgctcatcgctgtgtggggcaa

SEQ ID NO: 507214 - DNA, 25 bp, Rattus norvegicus
cggcacggtattcggcagcaaggcc

SEQ ID NO: 507215 - DNA, 25 bp, Rattus norvegicus
tgggaaggctccaatcagtccctca

SEQ ID NO: 507216 - DNA, 25 bp, Rattus norvegicus
gccctctgcagtacgcgcagcgaag

SEQ ID NO: 507217 - DNA, 25 bp, Rattus norvegicus
agtacgcgcagcgaagcgcaccgag

SEQ ID NO: 507218 - DNA, 25 bp, Rattus norvegicus
tgggcgtgaagcaaaaggacatttt

SEQ ID NO: 507219 - DNA, 25 bp, Rattus norvegicus
gcaaaaggacatttttgggagtatg

SEQ ID NO: 507220 - DNA, 25 bp, Rattus norvegicus
agagaaaaggcgaaaggagaccacg

SEQ ID NO: 507221 - DNA, 25 bp, Rattus norvegicus
ggcgaaaggagaccacgttagactg

SEQ ID NO: 507222 - DNA, 25 bp, Rattus norvegicus
aggagaccacgttagactgaggagc

SEQ ID NO: 507223 - DNA, 25 bp, Rattus norvegicus
ccacgttagactgaggagctaaaaa

SEQ ID NO: 507224 - DNA, 25 bp, Rattus norvegicus
gctaaaaagggcacggacttggcta

SEQ ID NO: 507225 - DNA, 25 bp, Rattus norvegicus
aaagggcacggacttggctacgcca

SEQ ID NO: 507226 - DNA, 25 bp, Rattus norvegicus
cacggacttggctacgccacgacga

SEQ ID NO: 507227 - DNA, 25 bp, Rattus norvegicus
acgccacgacgaagccagcctggga

SEQ ID NO: 507228 - DNA, 25 bp, Rattus norvegicus
gcctgggagagggaatctctgggac

SEQ ID NO: 507229 - DNA, 25 bp, Rattus norvegicus
gcattgggcgccctctgcagtacgc

SEQ ID NO: 507230 - DNA, 25 bp, Rattus norvegicus
agcagatggcgatcccaggaacttc

SEQ ID NO: 507231 - DNA, 25 bp, Rattus norvegicus
acccaccggaagttgcgcgaaagca

SEQ ID NO: 507232 - DNA, 25 bp, Rattus norvegicus
gctcaacacgctcatgttccggact

SEQ ID NO: 507233 - DNA, 25 bp, Rattus norvegicus
acacgctcatgttccggacttcggg

SEQ ID NO: 507234 - DNA, 25 bp, Rattus norvegicus
catgttccggacttcgggttgcgga

SEQ ID NO: 507235 - DNA, 25 bp, Rattus norvegicus
aggcagaagcagatggcgatcccag

SEQ ID NO: 507236 - DNA, 25 bp, Rattus norvegicus
cgatcccaggaacttccgtatcttt

SEQ ID NO: 507237 - DNA, 25 bp, Rattus norvegicus
cggaagttgcgcgaaagcactgcca

SEQ ID NO: 507238 - DNA, 25 bp, Rattus norvegicus
ttgcgcgaaagcactgccacgtgta

SEQ ID NO: 507239 - DNA, 25 bp, Rattus norvegicus
agcactgccacgtgtaacttccggg

SEQ ID NO: 507240 - DNA, 25 bp, Rattus norvegicus
ggctcggaagccaggccgctcaaca

SEQ ID NO: 507241 - DNA, 25 bp, Rattus norvegicus
ctgccacgtgtaacttccgggtttg

SEQ ID NO: 507242 - DNA, 25 bp, Rattus norvegicus
gatggcgatcccaggaacttccgta

SEQ ID NO: 507243 - DNA, 25 bp, Rattus norvegicus
caaggaagacccaccggaagttgcg

SEQ ID NO: 507244 - DNA, 25 bp, Rattus norvegicus
tctgcccagctaccacctcctttcg

SEQ ID NO: 507245 - DNA, 25 bp, Rattus norvegicus
cgcgcgactcggatcccgctccgct

SEQ ID NO: 507246 - DNA, 25 bp, Rattus norvegicus
agacgtgagtgtcggggacctggcc

SEQ ID NO: 507247 - DNA, 25 bp, Rattus norvegicus
cctgggcgttgtagccatgtcacct

SEQ ID NO: 507248 - DNA, 25 bp, Rattus norvegicus
gcgttgtagccatgtcacctcctcg

SEQ ID NO: 507249 - DNA, 25 bp, Rattus norvegicus
ttgtagccatgtcacctcctcgcgg

SEQ ID NO: 507250 - DNA, 25 bp, Rattus norvegicus
catgtcacctcctcgcggccggagc

SEQ ID NO: 507251 - DNA, 25 bp, Rattus norvegicus
ccgctccgctcttttggccgggagt

SEQ ID NO: 507252 - DNA, 25 bp, Rattus norvegicus
acaagggtggcgctccaggcttctc

SEQ ID NO: 507253 - DNA, 25 bp, Rattus norvegicus
gggcctgcggacatgcactgtgccc

SEQ ID NO: 507254 - DNA, 25 bp, Rattus norvegicus
tgcactgtgcccctcggatttcgtc

SEQ ID NO: 507255 - DNA, 25 bp, Rattus norvegicus
tcggatttcgtccatgccaaccgct

SEQ ID NO: 507256 - DNA, 25 bp, Rattus norvegicus
ttcgtccatgccaaccgctccggcg

SEQ ID NO: 507257 - DNA, 25 bp, Rattus norvegicus
cggagccgggacgtccggagacaag

SEQ ID NO: 507258 - DNA, 25 bp, Rattus norvegicus
aggctctgctcctgcacgttcttca

SEQ ID NO: 507259 - DNA, 25 bp, Rattus norvegicus
agtgacagtctcctgccaagccttg

SEQ ID NO: 507260 - DNA, 25 bp, Rattus norvegicus
gtcgacccaggacgcagtgacagtc

SEQ ID NO: 507261 - DNA, 25 bp, Rattus norvegicus
agtccgacgagggagagtcgaccca

SEQ ID NO: 507262 - DNA, 25 bp, Rattus norvegicus
aagaagcgcgcttcctcgtgcagtc

SEQ ID NO: 507263 - DNA, 25 bp, Rattus norvegicus
cctgcggtctagaactttaagaagc

SEQ ID NO: 507264 - DNA, 25 bp, Rattus norvegicus
atcaagttccttttcctggagcgcc

SEQ ID NO: 507265 - DNA, 25 bp, Rattus norvegicus
cgagcctgccagtagatcaagttcc

SEQ ID NO: 507266 - DNA, 25 bp, Rattus norvegicus
ctccatcatgttggctgccggcatc

SEQ ID NO: 507267 - DNA, 25 bp, Rattus norvegicus
cgctggagggcgtaatctcaatgga

SEQ ID NO: 507268 - DNA, 25 bp, Rattus norvegicus
cacgttcttcatccggcgcatctta

SEQ ID NO: 507269 - DNA, 25 bp, Rattus norvegicus
caatggacggcagttgcaggaactc

SEQ ID NO: 507270 - DNA, 25 bp, Rattus norvegicus
tgcccgagtgtttgtcttccgcggc

SEQ ID NO: 507271 - DNA, 25 bp, Rattus norvegicus
gcagctgcaggttctccatcatgtt

SEQ ID NO: 507272 - DNA, 25 bp, Rattus norvegicus
tcggctccagccgtctgggtggcta

SEQ ID NO: 507273 - DNA, 25 bp, Rattus norvegicus
tttggactcgccgaccagtgcgttc

SEQ ID NO: 507274 - DNA, 25 bp, Rattus norvegicus
gcagcctttggactcgccgaccagt

SEQ ID NO: 507275 - DNA, 25 bp, Rattus norvegicus
gccgaccagtgcgttcggtccagtt

SEQ ID NO: 507276 - DNA, 25 bp, Rattus norvegicus
gaccagtgcgttcggtccagttgga

SEQ ID NO: 507277 - DNA, 25 bp, Rattus norvegicus
tccagttggaggtacctcctgcagg

SEQ ID NO: 507278 - DNA, 25 bp, Rattus norvegicus
ttggaggtacctcctgcaggtgagc

SEQ ID NO: 507279 - DNA, 25 bp, Rattus norvegicus
gcgcggcgcgagctactggaactcc

SEQ ID NO: 507280 - DNA, 25 bp, Rattus norvegicus
tggctaggtgttaccgcagcgagat

SEQ ID NO: 507281 - DNA, 25 bp, Rattus norvegicus
tgttaccgcagcgagatccctcttt

SEQ ID NO: 507282 - DNA, 25 bp, Rattus norvegicus
gcagcgagatccctctttctatata

SEQ ID NO: 507283 - DNA, 25 bp, Rattus norvegicus
cgagatccctctttctatatatatc

SEQ ID NO: 507284 - DNA, 25 bp, Rattus norvegicus
gctgcgctttggctcgctgtcgtcc

SEQ ID NO: 507285 - DNA, 25 bp, Rattus norvegicus
cctgcgctttgggacagctttggga

SEQ ID NO: 507286 - DNA, 25 bp, Rattus norvegicus
tcgggactacagacttgtgatttag

SEQ ID NO: 507287 - DNA, 25 bp, Rattus norvegicus
cctccctctgcacgcgctcccggaa

SEQ ID NO: 507288 - DNA, 25 bp, Rattus norvegicus
gcggcgacgcaaccgctcctccctc

SEQ ID NO: 507289 - DNA, 25 bp, Rattus norvegicus
atccagccgtcaccctgggcccagc

SEQ ID NO: 507290 - DNA, 25 bp, Rattus norvegicus
taccggctcctccacccgctatcca

SEQ ID NO: 507291 - DNA, 25 bp, Rattus norvegicus
cttcctcagggtgaggcctaccggc

SEQ ID NO: 507292 - DNA, 25 bp, Rattus norvegicus
gatacaggcccttcactaactgcca

SEQ ID NO: 507293 - DNA, 25 bp, Rattus norvegicus
ccaaagttagcggagagcggaagga

SEQ ID NO: 507294 - DNA, 25 bp, Rattus norvegicus
gtactgccaagaccgcggttctcgc

SEQ ID NO: 507295 - DNA, 25 bp, Rattus norvegicus
tgtgatttagtactgccaagaccgc

SEQ ID NO: 507296 - DNA, 25 bp, Rattus norvegicus
gcggataatcgggactacagacttg

SEQ ID NO: 507297 - DNA, 25 bp, Rattus norvegicus
cgcctggaggcggaacttccggctt

SEQ ID NO: 507298 - DNA, 25 bp, Rattus norvegicus
tttagtactgccaagaccgcggttc

SEQ ID NO: 507299 - DNA, 25 bp, Rattus norvegicus
ggcccgggatacaggcccttcacta

SEQ ID NO: 507300 - DNA, 25 bp, Rattus norvegicus
aagcggtagcttcttgccgcctcgc

SEQ ID NO: 507301 - DNA, 25 bp, Rattus norvegicus
gccctgctcacagaaggtccgtcgg

SEQ ID NO: 507302 - DNA, 25 bp, Rattus norvegicus
cacagaaggtccgtcggctgggctc

SEQ ID NO: 507303 - DNA, 25 bp, Rattus norvegicus
ggggatcgggatgtccctcttcttc

SEQ ID NO: 507304 - DNA, 25 bp, Rattus norvegicus
atcgggatgtccctcttcttcctct

SEQ ID NO: 507305 - DNA, 25 bp, Rattus norvegicus
ctggggaaacgccaccctgcgtttg

SEQ ID NO: 507306 - DNA, 25 bp, Rattus norvegicus
caccctgcgtttgggtggagacccg

SEQ ID NO: 507307 - DNA, 25 bp, Rattus norvegicus
gagtgcggcaaccactcggtccctg

SEQ ID NO: 507308 - DNA, 25 bp, Rattus norvegicus
gcgcatctggcaacggaggaccgcc

SEQ ID NO: 507309 - DNA, 25 bp, Rattus norvegicus
ggaccgcccagtcggccatcgaaat

SEQ ID NO: 507310 - DNA, 25 bp, Rattus norvegicus
gtcggccatcgaaatgtctcacaca

SEQ ID NO: 507311 - DNA, 25 bp, Rattus norvegicus
tgtctcacacatctgggccctctag

SEQ ID NO: 507312 - DNA, 25 bp, Rattus norvegicus
atctgggccctctagccagctacgg

SEQ ID NO: 507313 - DNA, 25 bp, Rattus norvegicus
tccgcagtccgggagtgcggcaacc

SEQ ID NO: 507314 - DNA, 25 bp, Rattus norvegicus
tgccaggccgacttagaacggaagc

SEQ ID NO: 507315 - DNA, 25 bp, Rattus norvegicus
gaacgcagcgactctcccagcaagg

SEQ ID NO: 507316 - DNA, 25 bp, Rattus norvegicus
cccgaggtgagaagtagctacgaat

SEQ ID NO: 507317 - DNA, 25 bp, Rattus norvegicus
ccgaccagagggtcgtcaccgctta

SEQ ID NO: 507318 - DNA, 25 bp, Rattus norvegicus
caccgcttagtggagggtcttcatc

SEQ ID NO: 507319 - DNA, 25 bp, Rattus norvegicus
caacggctagccaggcgctgctgct

SEQ ID NO: 507320 - DNA, 25 bp, Rattus norvegicus
ctcacgcttttggagccggacatcc

SEQ ID NO: 507321 - DNA, 25 bp, Rattus norvegicus
gctgaagccgaagcctccgaccaga

SEQ ID NO: 507322 - DNA, 25 bp, Rattus norvegicus
tagctacgaatcagagtccagagtc

SEQ ID NO: 507323 - DNA, 25 bp, Rattus norvegicus
tcccaggtccgagacggagttggct

SEQ ID NO: 507324 - DNA, 25 bp, Rattus norvegicus
ctcgaggcttctgcctaagcggaac

SEQ ID NO: 507325 - DNA, 25 bp, Rattus norvegicus
ccctttgctcgcagcgcactgggag

SEQ ID NO: 507326 - DNA, 25 bp, Rattus norvegicus
tgccagcattattttcttacgaggg

SEQ ID NO: 507327 - DNA, 25 bp, Rattus norvegicus
ctctccgaagctggcagttcccgga

SEQ ID NO: 507328 - DNA, 25 bp, Rattus norvegicus
gctgcacagggtcccaagaggaaca

SEQ ID NO: 507329 - DNA, 25 bp, Rattus norvegicus
tgtctgcaagctaaaggagggtctc

SEQ ID NO: 507330 - DNA, 25 bp, Rattus norvegicus
tctctgtgtggtctcgtcatcagca

SEQ ID NO: 507331 - DNA, 25 bp, Rattus norvegicus
accggtctcattgaacgcggagcca

SEQ ID NO: 507332 - DNA, 25 bp, Rattus norvegicus
ccgtccattggctaaggagctctga

SEQ ID NO: 507333 - DNA, 25 bp, Rattus norvegicus
tcattagtgcactccggagaacctg

SEQ ID NO: 507334 - DNA, 25 bp, Rattus norvegicus
cctaggagagcgttctggttgttca

SEQ ID NO: 507335 - DNA, 25 bp, Rattus norvegicus
actgctggactcacggagaaggacc

SEQ ID NO: 507336 - DNA, 25 bp, Rattus norvegicus
tctgagtgacagaggactcccgcgc

SEQ ID NO: 507337 - DNA, 25 bp, Rattus norvegicus
gggtgcaacaaccttcgcagccatt

SEQ ID NO: 507338 - DNA, 25 bp, Rattus norvegicus
gagcactgctgccattggtccgttg

SEQ ID NO: 507339 - DNA, 25 bp, Rattus norvegicus
tcaggctcttctttcaggctgcaca

SEQ ID NO: 507340 - DNA, 25 bp, Rattus norvegicus
atcagcacagctgggcctacacgca

SEQ ID NO: 507341 - DNA, 25 bp, Rattus norvegicus
tcacgcatgcgtactcggtgccgac

SEQ ID NO: 507342 - DNA, 25 bp, Rattus norvegicus
cttcctgcgaatgcgggttctgtct

SEQ ID NO: 507343 - DNA, 25 bp, Rattus norvegicus
cgggttctgtctgccaactgctctt

SEQ ID NO: 507344 - DNA, 25 bp, Rattus norvegicus
ggtggagattgcttcctgcgaatgc

SEQ ID NO: 507345 - DNA, 25 bp, Rattus norvegicus
ccaactgctcttgtctctgtaggga

SEQ ID NO: 507346 - DNA, 25 bp, Rattus norvegicus
ctcttgtctctgtagggatgccggt

SEQ ID NO: 507347 - DNA, 25 bp, Rattus norvegicus
agggatgccggtcccggctctgttc

SEQ ID NO: 507348 - DNA, 25 bp, Rattus norvegicus
cgcagcatgcagagctacccgggaa

SEQ ID NO: 507349 - DNA, 25 bp, Rattus norvegicus
agagctacccgggaagcactgccgc

SEQ ID NO: 507350 - DNA, 25 bp, Rattus norvegicus
tgttttctgactcgcagctctccgg

SEQ ID NO: 507351 - DNA, 25 bp, Rattus norvegicus
ctcgcacggtgttttctgactcgca

SEQ ID NO: 507352 - DNA, 25 bp, Rattus norvegicus
agcgctacctgtcgacaccagagcg

SEQ ID NO: 507353 - DNA, 25 bp, Rattus norvegicus
ggttcgaaatccagcgctacctgtc

SEQ ID NO: 507354 - DNA, 25 bp, Rattus norvegicus
tctccggcctggagaaaaggttcga

SEQ ID NO: 507355 - DNA, 25 bp, Rattus norvegicus
cgcaaagctcgcacggtgttttctg

SEQ ID NO: 507356 - DNA, 25 bp, Rattus norvegicus
cgcgtccctgctgggagatcagtaa

SEQ ID NO: 507357 - DNA, 25 bp, Rattus norvegicus
cggcggtacatttcgacggagcacc

SEQ ID NO: 507358 - DNA, 25 bp, Rattus norvegicus
ggcggtcgctctccctaaagcagtt

SEQ ID NO: 507359 - DNA, 25 bp, Rattus norvegicus
cttcagtgacctgactgtggcgttc

SEQ ID NO: 507360 - DNA, 25 bp, Rattus norvegicus
cggctggtgattacgtccgctcaca

SEQ ID NO: 507361 - DNA, 25 bp, Rattus norvegicus
ttgactgagcttccatcctctggtg

SEQ ID NO: 507362 - DNA, 25 bp, Rattus norvegicus
tctggtgtcccaatagtcatcggtg

SEQ ID NO: 507363 - DNA, 25 bp, Rattus norvegicus
gcgcaatttctgcttcctgaacttg

SEQ ID NO: 507364 - DNA, 25 bp, Rattus norvegicus
cctgaacttgttgcactcttgtccc

SEQ ID NO: 507365 - DNA, 25 bp, Rattus norvegicus
cagtgtcgctgaccaaactagtagc

SEQ ID NO: 507366 - DNA, 25 bp, Rattus norvegicus
acttatcaacttgcagccgccgcga

SEQ ID NO: 507367 - DNA, 25 bp, Rattus norvegicus
gtgccttcgtgcttacagagccgga

SEQ ID NO: 507368 - DNA, 25 bp, Rattus norvegicus
gactctagactgttcctgcggcctg

SEQ ID NO: 507369 - DNA, 25 bp, Rattus norvegicus
tcaggcagagccacatcggattctt

SEQ ID NO: 507370 - DNA, 25 bp, Rattus norvegicus
ggttttcgccgctgtgtctttctaa

SEQ ID NO: 507371 - DNA, 25 bp, Rattus norvegicus
aaccgcccgtcacctgccggcgctg

SEQ ID NO: 507372 - DNA, 25 bp, Rattus norvegicus
gaccacagactgtgcccgctccctc

SEQ ID NO: 507373 - DNA, 25 bp, Rattus norvegicus
tccttctcctagaccacagactgtg

SEQ ID NO: 507374 - DNA, 25 bp, Rattus norvegicus
tccagaggtcgccggttggagaccc

SEQ ID NO: 507375 - DNA, 25 bp, Rattus norvegicus
gcgtttgaaggtccagaggtcgccg

SEQ ID NO: 507376 - DNA, 25 bp, Rattus norvegicus
cgccgctgtgtctttctaagggtca

SEQ ID NO: 507377 - DNA, 25 bp, Rattus norvegicus
ctgtgtctttctaagggtcagggca

SEQ ID NO: 507378 - DNA, 25 bp, Rattus norvegicus
tcgggatgctcaggtctagccaccc

SEQ ID NO: 507379 - DNA, 25 bp, Rattus norvegicus
agaccgcggccaacaccgcgcctcg

SEQ ID NO: 507380 - DNA, 25 bp, Rattus norvegicus
gccgcgctcctgtagcacgggaggc

SEQ ID NO: 507381 - DNA, 25 bp, Rattus norvegicus
gatcgcagggttttcgccgctgtgt

SEQ ID NO: 507382 - DNA, 25 bp, Rattus norvegicus
tgggcgcggtccttctcctagacca

SEQ ID NO: 507383 - DNA, 25 bp, Rattus norvegicus
ggctcgggatgctcaggtctagcca

SEQ ID NO: 507384 - DNA, 25 bp, Rattus norvegicus
cggggtgactttgctgtacagctcc

SEQ ID NO: 507385 - DNA, 25 bp, Rattus norvegicus
tggctgctgcaggtccgacctcagc

SEQ ID NO: 507386 - DNA, 25 bp, Rattus norvegicus
ttcctggagaggctactggagctcg

SEQ ID NO: 507387 - DNA, 25 bp, Rattus norvegicus
agctgagactgacgcttcctggaga

SEQ ID NO: 507388 - DNA, 25 bp, Rattus norvegicus
tcgcgatgccgagtgaccgctcagc

SEQ ID NO: 507389 - DNA, 25 bp, Rattus norvegicus
aagcccatggacaggagcaggtcca

SEQ ID NO: 507390 - DNA, 25 bp, Rattus norvegicus
aagcaggtctcaggcagcgccagca

SEQ ID NO: 507391 - DNA, 25 bp, Rattus norvegicus
catcgcgtttccctaagcaggtctc

SEQ ID NO: 507392 - DNA, 25 bp, Rattus norvegicus
agagctacccgcgaaaccagggatt

SEQ ID NO: 507393 - DNA, 25 bp, Rattus norvegicus
tctggatcgataggggacccaagtc

SEQ ID NO: 507394 - DNA, 25 bp, Rattus norvegicus
acctgctcagcactctggatcgata

SEQ ID NO: 507395 - DNA, 25 bp, Rattus norvegicus
ctcaagagcgacatccggagctgga

SEQ ID NO: 507396 - DNA, 25 bp, Rattus norvegicus
gcgctcccagatctccgagctgaga

SEQ ID NO: 507397 - DNA, 25 bp, Rattus norvegicus
cctgggcttaatataagaagacctc

SEQ ID NO: 507398 - DNA, 25 bp, Rattus norvegicus
cgcacgcaggacggtgggtcacctc

SEQ ID NO: 507399 - DNA, 25 bp, Rattus norvegicus
gtggctgttactcccctccgcaaga

SEQ ID NO: 507400 - DNA, 25 bp, Rattus norvegicus
cgcaagagtcaaggcgcacgcagga

SEQ ID NO: 507401 - DNA, 25 bp, Rattus norvegicus
agaactccgatgtcactgctgtggc

SEQ ID NO: 507402 - DNA, 25 bp, Rattus norvegicus
acccgctagaactccgatgtcactg

SEQ ID NO: 507403 - DNA, 25 bp, Rattus norvegicus
acctgacccgctagaactccgatgt

SEQ ID NO: 507404 - DNA, 25 bp, Rattus norvegicus
gcatggttttctatcctgccgggga

SEQ ID NO: 507405 - DNA, 25 bp, Rattus norvegicus
tctgtctcgagcatggttttctatc

SEQ ID NO: 507406 - DNA, 25 bp, Rattus norvegicus
ctccttctctgtctcgagcatggtt

SEQ ID NO: 507407 - DNA, 25 bp, Rattus norvegicus
ctgcttgctccttctctgtctcgag

SEQ ID NO: 507408 - DNA, 25 bp, Rattus norvegicus
acttggcggtggcgcctgcttgctc

SEQ ID NO: 507409 - DNA, 25 bp, Rattus norvegicus
ctccgcaagagtcaaggcgcacgca

SEQ ID NO: 507410 - DNA, 25 bp, Rattus norvegicus
gtctcgagcatggttttctatcctg

SEQ ID NO: 507411 - DNA, 25 bp, Rattus norvegicus
aggtggcacctgacccgctagaact

SEQ ID NO: 507412 - DNA, 25 bp, Rattus norvegicus
tgacaaatggcagcgcaggcaagac

SEQ ID NO: 507413 - DNA, 25 bp, Rattus norvegicus
gctagagcagctgggcctcagcctc

SEQ ID NO: 507414 - DNA, 25 bp, Rattus norvegicus
gcctcctgtcggagacgttttgaca

SEQ ID NO: 507415 - DNA, 25 bp, Rattus norvegicus
tgcgagccatcctctgggctaatga

SEQ ID NO: 507416 - DNA, 25 bp, Rattus norvegicus
gcgcgggagataactaatcctaatg

SEQ ID NO: 507417 - DNA, 25 bp, Rattus norvegicus
tgacagctgtatacagtcccggacc

SEQ ID NO: 507418 - DNA, 25 bp, Rattus norvegicus
tcctaatgcaattactgctcggtgc

SEQ ID NO: 507419 - DNA, 25 bp, Rattus norvegicus
gtcccgggagagtgatcttttcaca

SEQ ID NO: 507420 - DNA, 25 bp, Rattus norvegicus
cctgtcggaggtgaaatgaaatctt

SEQ ID NO: 507421 - DNA, 25 bp, Rattus norvegicus
ctcagatgctatttccagggcggtg

SEQ ID NO: 507422 - DNA, 25 bp, Rattus norvegicus
gcccggcagcctgagccaggctaga

SEQ ID NO: 507423 - DNA, 25 bp, Rattus norvegicus
tcggtgcagcactgataggtccact

SEQ ID NO: 507424 - DNA, 25 bp, Rattus norvegicus
aagacctggccctctcctggtgcag

SEQ ID NO: 507425 - DNA, 25 bp, Rattus norvegicus
gtggtgcgagctcagatgctatttc

SEQ ID NO: 507426 - DNA, 25 bp, Rattus norvegicus
tcgcaagaactcatctggaactaat

SEQ ID NO: 507427 - DNA, 25 bp, Rattus norvegicus
ccttagcacccacgcaaggcaggtt

SEQ ID NO: 507428 - DNA, 25 bp, Rattus norvegicus
tagcacccacgcaaggcaggttcct

SEQ ID NO: 507429 - DNA, 25 bp, Rattus norvegicus
tgttttgttcgcgaccccttagcac

SEQ ID NO: 507430 - DNA, 25 bp, Rattus norvegicus
tggcctttcctgttttgttcgcgac

SEQ ID NO: 507431 - DNA, 25 bp, Rattus norvegicus
cgccgccttggcctttcctgttttg

SEQ ID NO: 507432 - DNA, 25 bp, Rattus norvegicus
tgagcgtacgctgacgcaatcgggc

SEQ ID NO: 507433 - DNA, 25 bp, Rattus norvegicus
gccaatgctgccaccctgcccgtgg

SEQ ID NO: 507434 - DNA, 25 bp, Rattus norvegicus
atctggaactaataattttgaggcc

SEQ ID NO: 507435 - DNA, 25 bp, Rattus norvegicus
attacaatcgcaagaactcatctgg

SEQ ID NO: 507436 - DNA, 25 bp, Rattus norvegicus
ggttaaaccaaatattacaatcgca

SEQ ID NO: 507437 - DNA, 25 bp, Rattus norvegicus
tacgctgacgcaatcgggccgattg

SEQ ID NO: 507438 - DNA, 25 bp, Rattus norvegicus
ctgagtgtgagcgtacgctgacgca

SEQ ID NO: 507439 - DNA, 25 bp, Rattus norvegicus
cagaagccagctcgggccaatgctg

SEQ ID NO: 507440 - DNA, 25 bp, Rattus norvegicus
ctccgtgtcgccatgttcgggcgaa

SEQ ID NO: 507441 - DNA, 25 bp, Rattus norvegicus
tcacgtgtgtgctcgcaacgcggcc

SEQ ID NO: 507442 - DNA, 25 bp, Rattus norvegicus
cttgccctccgtgccgcagtgaaga

SEQ ID NO: 507443 - DNA, 25 bp, Rattus norvegicus
tccgtgccgcagtgaagagttgcgt

SEQ ID NO: 507444 - DNA, 25 bp, Rattus norvegicus
gcactttctctgctcgcctcgactg

SEQ ID NO: 507445 - DNA, 25 bp, Rattus norvegicus
tgttcgggcgaacgctcccgcaggt

SEQ ID NO: 507446 - DNA, 25 bp, Rattus norvegicus
tgcgccgcaccgtcacgtgtgtgct

SEQ ID NO: 507447 - DNA, 25 bp, Rattus norvegicus
agggagtctcgactccctcctgctg

SEQ ID NO: 507448 - DNA, 25 bp, Rattus norvegicus
gtgaataggaaagggagtctcgact

SEQ ID NO: 507449 - DNA, 25 bp, Rattus norvegicus
gctccgccaccatgcaatctctgcg

SEQ ID NO: 507450 - DNA, 25 bp, Rattus norvegicus
cgggtcgccctgcaccacgaagaag

SEQ ID NO: 507451 - DNA, 25 bp, Rattus norvegicus
gttcccagccgcagctcgtgcgggt

SEQ ID NO: 507452 - DNA, 25 bp, Rattus norvegicus
cgtcctgagtggcttcctggccgct

SEQ ID NO: 507453 - DNA, 25 bp, Rattus norvegicus
gctccaagccgtccgggcagctcca

SEQ ID NO: 507454 - DNA, 25 bp, Rattus norvegicus
aacatggccgcttccggtctcgcag

SEQ ID NO: 507455 - DNA, 25 bp, Rattus norvegicus
gagaccgtgccaagccgggacagaa

SEQ ID NO: 507456 - DNA, 25 bp, Rattus norvegicus
cgtatggggacagagaccgtgccaa

SEQ ID NO: 507457 - DNA, 25 bp, Rattus norvegicus
aggactcactgtccaggtgaggccg

SEQ ID NO: 507458 - DNA, 25 bp, Rattus norvegicus
cagcgaggactcactgtccaggtga

SEQ ID NO: 507459 - DNA, 25 bp, Rattus norvegicus
aggcttcccagcgaggactcactgt

SEQ ID NO: 507460 - DNA, 25 bp, Rattus norvegicus
ccgcaccgctttgtagagccaaggg

SEQ ID NO: 507461 - DNA, 25 bp, Rattus norvegicus
gcggcaaggcttcccagcgaggact

SEQ ID NO: 507462 - DNA, 25 bp, Rattus norvegicus
ctgcgagagtcttggcgcgcagctc

SEQ ID NO: 507463 - DNA, 25 bp, Rattus norvegicus
aagagctcgagctgcgagagtcttg

SEQ ID NO: 507464 - DNA, 25 bp, Rattus norvegicus
cgcgccatggagaagagctcgagct

SEQ ID NO: 507465 - DNA, 25 bp, Rattus norvegicus
gcctcctgttctcgcgccatggaga

SEQ ID NO: 507466 - DNA, 25 bp, Rattus norvegicus
tcctccctctgcatctcgcgccggc

SEQ ID NO: 507467 - DNA, 25 bp, Rattus norvegicus
gtgcgcaccgcaccgctttgtagag

SEQ ID NO: 507468 - DNA, 25 bp, Rattus norvegicus
tcagactcgagtccggcgctcttat

SEQ ID NO: 507469 - DNA, 25 bp, Rattus norvegicus
tctgtggcccggctacggtgccaac

SEQ ID NO: 507470 - DNA, 25 bp, Rattus norvegicus
ggcgctcttattgggcgattctgtg

SEQ ID NO: 507471 - DNA, 25 bp, Rattus norvegicus
gcccaacttcagctacggtgctgcg

SEQ ID NO: 507472 - DNA, 25 bp, Rattus norvegicus
cccttctctggtccggctctattgg

SEQ ID NO: 507473 - DNA, 25 bp, Rattus norvegicus
tctctggtccggctctattggccgc

SEQ ID NO: 507474 - DNA, 25 bp, Rattus norvegicus
gtccggcgctcttattgggcgattc

SEQ ID NO: 507475 - DNA, 25 bp, Rattus norvegicus
ctattggccgcttccagagctgtca

SEQ ID NO: 507476 - DNA, 25 bp, Rattus norvegicus
tggccgcttccagagctgtcagact

SEQ ID NO: 507477 - DNA, 25 bp, Rattus norvegicus
ctgtcagactcgagtccggcgctct

SEQ ID NO: 507478 - DNA, 25 bp, Rattus norvegicus
tccagagctgtcagactcgagtccg

SEQ ID NO: 507479 - DNA, 25 bp, Rattus norvegicus
ttattgggcgattctgtggcccggc

SEQ ID NO: 507480 - DNA, 25 bp, Rattus norvegicus
ccgcttccagagctgtcagactcga

SEQ ID NO: 507481 - DNA, 25 bp, Rattus norvegicus
tccggctctattggccgcttccaga

SEQ ID NO: 507482 - DNA, 25 bp, Rattus norvegicus
gctataccgcctgcggagtaccgga

SEQ ID NO: 507483 - DNA, 25 bp, Rattus norvegicus
gtttttagcagggacggtcacacac

SEQ ID NO: 507484 - DNA, 25 bp, Rattus norvegicus
cggtcacacacagctgcggaggatg

SEQ ID NO: 507485 - DNA, 25 bp, Rattus norvegicus
gatcgcccgcatgtcctcccactca

SEQ ID NO: 507486 - DNA, 25 bp, Rattus norvegicus
agctgccagcgaacggaacctacct

SEQ ID NO: 507487 - DNA, 25 bp, Rattus norvegicus
gcagcgccgtaagccgccgctatac

SEQ ID NO: 507488 - DNA, 25 bp, Rattus norvegicus
ccgcctgcggagtaccggagctgaa

SEQ ID NO: 507489 - DNA, 25 bp, Rattus norvegicus
tgaagagccggagacaccgcccgct

SEQ ID NO: 507490 - DNA, 25 bp, Rattus norvegicus
gatgccatacaagcgccgggcacct

SEQ ID NO: 507491 - DNA, 25 bp, Rattus norvegicus
ccataagctgatgtgacggcggatc

SEQ ID NO: 507492 - DNA, 25 bp, Rattus norvegicus
tcgccgcggtcacgtggtaagccgc

SEQ ID NO: 507493 - DNA, 25 bp, Rattus norvegicus
cacagctgcggaggatgccatacaa

SEQ ID NO: 507494 - DNA, 25 bp, Rattus norvegicus
gccggcgccataagctgatgtgacg

SEQ ID NO: 507495 - DNA, 25 bp, Rattus norvegicus
agcgaacggaacctacctgccaggc

SEQ ID NO: 507496 - DNA, 25 bp, Rattus norvegicus
gcgtagcatttgttgagtgtgagaa

SEQ ID NO: 507497 - DNA, 25 bp, Rattus norvegicus
actttcgcgctaagggctcagagtc

SEQ ID NO: 507498 - DNA, 25 bp, Rattus norvegicus
aagggctcagagtccgctgtcaatg

SEQ ID NO: 507499 - DNA, 25 bp, Rattus norvegicus
cagagtccgctgtcaatggcgaggc

SEQ ID NO: 507500 - DNA, 25 bp, Rattus norvegicus
ctcaccctccttcgatgatgaagta

SEQ ID NO: 507501 - DNA, 25 bp, Rattus norvegicus
agtaccggagtttgtcgttgctgtc

SEQ ID NO: 507502 - DNA, 25 bp, Rattus norvegicus
gcagaaaactttcgcgctaagggct

SEQ ID NO: 507503 - DNA, 25 bp, Rattus norvegicus
ttgttgagtgtgagaatcaagtgtg

SEQ ID NO: 507504 - DNA, 25 bp, Rattus norvegicus
gaatcaagtgtgtggagtcagcgcc

SEQ ID NO: 507505 - DNA, 25 bp, Rattus norvegicus
aagtgtgtggagtcagcgccaacca

SEQ ID NO: 507506 - DNA, 25 bp, Rattus norvegicus
cacgtagagcacatcccgggtcgtc

SEQ ID NO: 507507 - DNA, 25 bp, Rattus norvegicus
agcacatcccgggtcgtcagcacga

SEQ ID NO: 507508 - DNA, 25 bp, Rattus norvegicus
tttgtaggacgcgtttttatagagc

SEQ ID NO: 507509 - DNA, 25 bp, Rattus norvegicus
cgatgatgaagtaccggagtttgtc

SEQ ID NO: 507510 - DNA, 25 bp, Rattus norvegicus
aggaaggcgccatcaaacgtgcgga

SEQ ID NO: 507511 - DNA, 25 bp, Rattus norvegicus
ggcgccatcaaacgtgcggaagaca

SEQ ID NO: 507512 - DNA, 25 bp, Rattus norvegicus
atcaaacgtgcggaagacaccgccc

SEQ ID NO: 507513 - DNA, 25 bp, Rattus norvegicus
ctgccgccaggcagtaggaggtctt

SEQ ID NO: 507514 - DNA, 25 bp, Rattus norvegicus
cagtaggaggtcttggtgctgaagc

SEQ ID NO: 507515 - DNA, 25 bp, Rattus norvegicus
ttgcgtcggaaacagcggcagcgcc

SEQ ID NO: 507516 - DNA, 25 bp, Rattus norvegicus
ctgcgcagggcgcactcttcatctg

SEQ ID NO: 507517 - DNA, 25 bp, Rattus norvegicus
gggcgcactcttcatctgacttgca

SEQ ID NO: 507518 - DNA, 25 bp, Rattus norvegicus
tcttcatctgacttgcattggcgtg

SEQ ID NO: 507519 - DNA, 25 bp, Rattus norvegicus
catctgacttgcattggcgtgggtc

SEQ ID NO: 507520 - DNA, 25 bp, Rattus norvegicus
cattggcgtgggtcgcactggatca

SEQ ID NO: 507521 - DNA, 25 bp, Rattus norvegicus
gcacgaaggcgcagttggcagggaa

SEQ ID NO: 507522 - DNA, 25 bp, Rattus norvegicus
atcaggttgcgtcggaaacagcggc

SEQ ID NO: 507523 - DNA, 25 bp, Rattus norvegicus
cactggatcaggttgcgtcggaaac

SEQ ID NO: 507524 - DNA, 25 bp, Rattus norvegicus
cagtgtcctgcattgacccggaagc

SEQ ID NO: 507525 - DNA, 25 bp, Rattus norvegicus
tcttagagcgagctgcggttgccat

SEQ ID NO: 507526 - DNA, 25 bp, Rattus norvegicus
cctcttagagcgagctgcggttgcc

SEQ ID NO: 507527 - DNA, 25 bp, Rattus norvegicus
gagcctcttagagcgagctgcggtt

SEQ ID NO: 507528 - DNA, 25 bp, Rattus norvegicus
agaggagcctcttagagcgagctgc

SEQ ID NO: 507529 - DNA, 25 bp, Rattus norvegicus
cacgtgtcacgtccgctgcgtgatt

SEQ ID NO: 507530 - DNA, 25 bp, Rattus norvegicus
ctgcattgacccggaagcagctttc

SEQ ID NO: 507531 - DNA, 25 bp, Rattus norvegicus
agtgtcctgcattgacccggaagca

SEQ ID NO: 507532 - DNA, 25 bp, Rattus norvegicus
ttagagcgagctgcggttgccatag

SEQ ID NO: 507533 - DNA, 25 bp, Rattus norvegicus
tgtcacgtccgctgcgtgattggga

SEQ ID NO: 507534 - DNA, 25 bp, Rattus norvegicus
gtcctgcattgacccggaagcagct

SEQ ID NO: 507535 - DNA, 25 bp, Rattus norvegicus
cgcacgtgtcacgtccgctgcgtga

SEQ ID NO: 507536 - DNA, 25 bp, Rattus norvegicus
cggccgggctacactcacccctcgg

SEQ ID NO: 507537 - DNA, 25 bp, Rattus norvegicus
accgccgtcgcctccgctcggcttc

SEQ ID NO: 507538 - DNA, 25 bp, Rattus norvegicus
tggctccacggtccttcgccgccac

SEQ ID NO: 507539 - DNA, 25 bp, Rattus norvegicus
tcgccgccactactcaggctcgctg

SEQ ID NO: 507540 - DNA, 25 bp, Rattus norvegicus
gctgctgttggtggtcttgtcccac

SEQ ID NO: 507541 - DNA, 25 bp, Rattus norvegicus
gtggtcttgtcccactccaggctct

SEQ ID NO: 507542 - DNA, 25 bp, Rattus norvegicus
cacacgcggatgtgcgtgcagcctc

SEQ ID NO: 507543 - DNA, 25 bp, Rattus norvegicus
cactccaggctctcctcgctgcgcg

SEQ ID NO: 507544 - DNA, 25 bp, Rattus norvegicus
tgtgcgtgcagcctcgggccaccag

SEQ ID NO: 507545 - DNA, 25 bp, Rattus norvegicus
ctgagccagtctctgcgccagttgg

SEQ ID NO: 507546 - DNA, 25 bp, Rattus norvegicus
agtctctgcgccagttggtccggct

SEQ ID NO: 507547 - DNA, 25 bp, Rattus norvegicus
cggcgccacatagcttgccattgct

SEQ ID NO: 507548 - DNA, 25 bp, Rattus norvegicus
atagcttgccattgctgagcgtcgc

SEQ ID NO: 507549 - DNA, 25 bp, Rattus norvegicus
tgccattgctgagcgtcgctgtacc

SEQ ID NO: 507550 - DNA, 25 bp, Rattus norvegicus
caggccctggaagcgccggcactcc

SEQ ID NO: 507551 - DNA, 25 bp, Rattus norvegicus
cggcactccgggcacacgcggatgt

SEQ ID NO: 507552 - DNA, 25 bp, Rattus norvegicus
gacctcggcgggctcattagcattc

SEQ ID NO: 507553 - DNA, 25 bp, Rattus norvegicus
cagctggtggcgacatgacagacat

SEQ ID NO: 507554 - DNA, 25 bp, Rattus norvegicus
cgacatgacagacatgccgggcgcg

SEQ ID NO: 507555 - DNA, 25 bp, Rattus norvegicus
ctggccctgacttgcttgcgacaga

SEQ ID NO: 507556 - DNA, 25 bp, Rattus norvegicus
gacttgcttgcgacagactcaccgg

SEQ ID NO: 507557 - DNA, 25 bp, Rattus norvegicus
gcgacagactcaccggcaaagggtc

SEQ ID NO: 507558 - DNA, 25 bp, Rattus norvegicus
acagggaagctgtgcacagagccgc

SEQ ID NO: 507559 - DNA, 25 bp, Rattus norvegicus
acagagccgcccttgtgcgaagtcc

SEQ ID NO: 507560 - DNA, 25 bp, Rattus norvegicus
ttgtgcgaagtcctgagccgggtcc

SEQ ID NO: 507561 - DNA, 25 bp, Rattus norvegicus
agcccactcggggacctcgaggagc

SEQ ID NO: 507562 - DNA, 25 bp, Rattus norvegicus
gcacgtctgcgtcgggtacatctgc

SEQ ID NO: 507563 - DNA, 25 bp, Rattus norvegicus
actgccgccctttagagggacctcg

SEQ ID NO: 507564 - DNA, 25 bp, Rattus norvegicus
gcgggctcattagcattccgggccg

SEQ ID NO: 507565 - DNA, 25 bp, Rattus norvegicus
gctaattgcctcactacggcccgga

SEQ ID NO: 507566 - DNA, 25 bp, Rattus norvegicus
aggagttattagcttggcccgcttc

SEQ ID NO: 507567 - DNA, 25 bp, Rattus norvegicus
ccgggtccgcaggagttattagctt

SEQ ID NO: 507568 - DNA, 25 bp, Rattus norvegicus
ccgctcgctggaggagcctttagct

SEQ ID NO: 507569 - DNA, 25 bp, Rattus norvegicus
gaacagcccgggtcaaacttgcagc

SEQ ID NO: 507570 - DNA, 25 bp, Rattus norvegicus
aaacttgcagcttccctaatcgggc

SEQ ID NO: 507571 - DNA, 25 bp, Rattus norvegicus
agcttccctaatcgggcagagcggg

SEQ ID NO: 507572 - DNA, 25 bp, Rattus norvegicus
caagtgagggtctggggcacacttc

SEQ ID NO: 507573 - DNA, 25 bp, Rattus norvegicus
agggtctggggcacacttcaccacc

SEQ ID NO: 507574 - DNA, 25 bp, Rattus norvegicus
ccgtcagtgtctccgctcgctggag

SEQ ID NO: 507575 - DNA, 25 bp, Rattus norvegicus
ccgaaggcagagtctgtgtccggct

SEQ ID NO: 507576 - DNA, 25 bp, Rattus norvegicus
actcagcggagaatccggggtcgca

SEQ ID NO: 507577 - DNA, 25 bp, Rattus norvegicus
agcaggggacccgacgttgctcagc

SEQ ID NO: 507578 - DNA, 25 bp, Rattus norvegicus
agcagccgaaggcagagtctgtgtc

SEQ ID NO: 507579 - DNA, 25 bp, Rattus norvegicus
agctcgatccgccagcagccgaagg

SEQ ID NO: 507580 - DNA, 25 bp, Rattus norvegicus
tcacagagggaagtcgcgagccgta

SEQ ID NO: 507581 - DNA, 25 bp, Rattus norvegicus
gtcccggctctatctggggctgccg

SEQ ID NO: 507582 - DNA, 25 bp, Rattus norvegicus
ccgcctcgctgacagggaccctgtc

SEQ ID NO: 507583 - DNA, 25 bp, Rattus norvegicus
cgtttcttccgcagtggcacggcgg

SEQ ID NO: 507584 - DNA, 25 bp, Rattus norvegicus
tcgcccggtcttaggggcactcgcg

SEQ ID NO: 507585 - DNA, 25 bp, Rattus norvegicus
tctccctgggacttcgggaagccgc

SEQ ID NO: 507586 - DNA, 25 bp, Rattus norvegicus
ctctccaaacttgcgcggatgcttc

SEQ ID NO: 507587 - DNA, 25 bp, Rattus norvegicus
aaacttcgtcacagagggaagtcgc

SEQ ID NO: 507588 - DNA, 25 bp, Rattus norvegicus
cggactctccaaacttgcgcggatg

SEQ ID NO: 507589 - DNA, 25 bp, Rattus norvegicus
ggcgaagcgggtggcttcttcctcc

SEQ ID NO: 507590 - DNA, 25 bp, Rattus norvegicus
aaaaagtagttctgtgtggcgaagc

SEQ ID NO: 507591 - DNA, 25 bp, Rattus norvegicus
acgggcgtcggctcctgtcccgagt

SEQ ID NO: 507592 - DNA, 25 bp, Rattus norvegicus
gatgcttccgcgcagcactgtcgcg

SEQ ID NO: 507593 - DNA, 25 bp, Rattus norvegicus
ggaagccgcttcacgcgggatccct

SEQ ID NO: 507594 - DNA, 25 bp, Rattus norvegicus
ggaccgctatctaggcatccagccg

SEQ ID NO: 507595 - DNA, 25 bp, Rattus norvegicus
acagagcgcagaacggatgctgggc

SEQ ID NO: 507596 - DNA, 25 bp, Rattus norvegicus
agggcccggatctcagcgacaggaa

SEQ ID NO: 507597 - DNA, 25 bp, Rattus norvegicus
gcgcccacagcccagggcccggatc

SEQ ID NO: 507598 - DNA, 25 bp, Rattus norvegicus
cgaacgctgttacctggcggagcgc

SEQ ID NO: 507599 - DNA, 25 bp, Rattus norvegicus
ctccggcgaacgctgttacctggcg

SEQ ID NO: 507600 - DNA, 25 bp, Rattus norvegicus
ggccggtgcccatccctccggcgaa

SEQ ID NO: 507601 - DNA, 25 bp, Rattus norvegicus
aagcccgagcgcacctggccgcccg

SEQ ID NO: 507602 - DNA, 25 bp, Rattus norvegicus
cgccctggggcagagaagcccgagc

SEQ ID NO: 507603 - DNA, 25 bp, Rattus norvegicus
tatctaggcatccagccgggtggcc

SEQ ID NO: 507604 - DNA, 25 bp, Rattus norvegicus
catcctggaccgctatctaggcatc

SEQ ID NO: 507605 - DNA, 25 bp, Rattus norvegicus
cacgcccgacttctaacccggatcg

SEQ ID NO: 507606 - DNA, 25 bp, Rattus norvegicus
cgggacgtgcccaactcctcgacca

SEQ ID NO: 507607 - DNA, 25 bp, Rattus norvegicus
catccagccgggtggccaaagcttg

SEQ ID NO: 507608 - DNA, 25 bp, Rattus norvegicus
acacacgttgcggagatggggactc

SEQ ID NO: 507609 - DNA, 25 bp, Rattus norvegicus
tttttctgtaggcacaaggcgggga

SEQ ID NO: 507610 - DNA, 25 bp, Rattus norvegicus
gaggggaaacaagcccagcccgaga

SEQ ID NO: 507611 - DNA, 25 bp, Rattus norvegicus
ttgtagaggggaaacaagcccagcc

SEQ ID NO: 507612 - DNA, 25 bp, Rattus norvegicus
acatcaccgtcctttccttaggttg

SEQ ID NO: 507613 - DNA, 25 bp, Rattus norvegicus
ggggacacatacatcaccgtccttt

SEQ ID NO: 507614 - DNA, 25 bp, Rattus norvegicus
cacaaggcggggacacatacatcac

SEQ ID NO: 507615 - DNA, 25 bp, Rattus norvegicus
tgtagctgctccagaccgcgcactt

SEQ ID NO: 507616 - DNA, 25 bp, Rattus norvegicus
aatgtccatgtgtagctgctccaga

SEQ ID NO: 507617 - DNA, 25 bp, Rattus norvegicus
tagatggcatcggtggcctcggcac

SEQ ID NO: 507618 - DNA, 25 bp, Rattus norvegicus
ggcctccctgactgaagttaacggc

SEQ ID NO: 507619 - DNA, 25 bp, Rattus norvegicus
tgaagttaacggcaatgtccatgtg

SEQ ID NO: 507620 - DNA, 25 bp, Rattus norvegicus
cctcggcacacacgttgcggagatg

SEQ ID NO: 507621 - DNA, 25 bp, Rattus norvegicus
ccgcgcacttcttcagcctgccgca

SEQ ID NO: 507622 - DNA, 25 bp, Rattus norvegicus
tgccgccatgtcaagcgcctgcagc

SEQ ID NO: 507623 - DNA, 25 bp, Rattus norvegicus
gccgaaaacttcgaacagattccca

SEQ ID NO: 507624 - DNA, 25 bp, Rattus norvegicus
ccagatgaacgctcccgctagggtt

SEQ ID NO: 507625 - DNA, 25 bp, Rattus norvegicus
tgaacgctcccgctagggttttgaa

SEQ ID NO: 507626 - DNA, 25 bp, Rattus norvegicus
accaccgcctaaaatgaatggtctc

SEQ ID NO: 507627 - DNA, 25 bp, Rattus norvegicus
aatgaatggtctccgcagccagtcc

SEQ ID NO: 507628 - DNA, 25 bp, Rattus norvegicus
ccgccgtcatcaccacattgtagat

SEQ ID NO: 507629 - DNA, 25 bp, Rattus norvegicus
gatgaccaggtacgccgtggccaca

SEQ ID NO: 507630 - DNA, 25 bp, Rattus norvegicus
gcgtgcacctcagacccactgggta

SEQ ID NO: 507631 - DNA, 25 bp, Rattus norvegicus
ctcagacccactgggtactgcgagg

SEQ ID NO: 507632 - DNA, 25 bp, Rattus norvegicus
ccgccatcttggatgagggcaaaga

SEQ ID NO: 507633 - DNA, 25 bp, Rattus norvegicus
gccatcttggatgggggtaatttcc

SEQ ID NO: 507634 - DNA, 25 bp, Rattus norvegicus
ggcggctggccgaaaacttcgaaca

SEQ ID NO: 507635 - DNA, 25 bp, Rattus norvegicus
ccacattgtagatgaccaggtacgc

SEQ ID NO: 507636 - DNA, 25 bp, Rattus norvegicus
ttagtgtttaggtcaagacagtttg

SEQ ID NO: 507637 - DNA, 25 bp, Rattus norvegicus
tttccgtcatcaaggagctggtcga

SEQ ID NO: 507638 - DNA, 25 bp, Rattus norvegicus
catcaaggagctggtcgaccttgta

SEQ ID NO: 507639 - DNA, 25 bp, Rattus norvegicus
tgagaaacacgtcccgaggacagtg

SEQ ID NO: 507640 - DNA, 25 bp, Rattus norvegicus
tcccgaggacagtgagcccgcgtca

SEQ ID NO: 507641 - DNA, 25 bp, Rattus norvegicus
cgcgtcttatgtgccttccttacta

SEQ ID NO: 507642 - DNA, 25 bp, Rattus norvegicus
gtgccttccttactattctatttta

SEQ ID NO: 507643 - DNA, 25 bp, Rattus norvegicus
acatagcatatgagtgtggtgatta

SEQ ID NO: 507644 - DNA, 25 bp, Rattus norvegicus
tgtggtgattaaataattaagcttg

SEQ ID NO: 507645 - DNA, 25 bp, Rattus norvegicus
gcccagagtttttccgtcatcaagg

SEQ ID NO: 507646 - DNA, 25 bp, Rattus norvegicus
tacctgataatcaacaaagttagtg

SEQ ID NO: 507647 - DNA, 25 bp, Rattus norvegicus
tgatttcagttttcactctttgcca

SEQ ID NO: 507648 - DNA, 25 bp, Rattus norvegicus
caagacagtttgatttcagttttca

SEQ ID NO: 507649 - DNA, 25 bp, Rattus norvegicus
attaagcttgatcacctacctgata

SEQ ID NO: 507650 - DNA, 25 bp, Rattus norvegicus
gcgggatcttttcaaagcggagttc

SEQ ID NO: 507651 - DNA, 25 bp, Rattus norvegicus
aggagcctcggtctcacaaaccaca

SEQ ID NO: 507652 - DNA, 25 bp, Rattus norvegicus
tgagggctctctgtagccaatcata

SEQ ID NO: 507653 - DNA, 25 bp, Rattus norvegicus
cgcctggggcaagccgaatccaagt

SEQ ID NO: 507654 - DNA, 25 bp, Rattus norvegicus
actcagcgcgcaagggaaaggcaac

SEQ ID NO: 507655 - DNA, 25 bp, Rattus norvegicus
aggcgccttccagtgaccaatcaga

SEQ ID NO: 507656 - DNA, 25 bp, Rattus norvegicus
tgacgtcacaaggtagcgcacagcg

SEQ ID NO: 507657 - DNA, 25 bp, Rattus norvegicus
agccttcagcgcctactggtgtgga

SEQ ID NO: 507658 - DNA, 25 bp, Rattus norvegicus
ctccagagagcgttgcctttccagg

SEQ ID NO: 507659 - DNA, 25 bp, Rattus norvegicus
tgaagtactgacctttcggccaatg

SEQ ID NO: 507660 - DNA, 25 bp, Rattus norvegicus
aggggcttaacgacatggtccaatg

SEQ ID NO: 507661 - DNA, 25 bp, Rattus norvegicus
ttcgtgaacctgtgcccaatgggct

SEQ ID NO: 507662 - DNA, 25 bp, Rattus norvegicus
cctgcctaaccgaagcaagggactg

SEQ ID NO: 507663 - DNA, 25 bp, Rattus norvegicus
agcggcagcctcctattggttggtt

SEQ ID NO: 507664 - DNA, 25 bp, Rattus norvegicus
gactgctaagatcgcaagcctcccg

SEQ ID NO: 507665 - DNA, 25 bp, Rattus norvegicus
ggcctaggctggctttctctggatc

SEQ ID NO: 507666 - DNA, 25 bp, Rattus norvegicus
gctcagccgctttgtggcctaggct

SEQ ID NO: 507667 - DNA, 25 bp, Rattus norvegicus
caggacctgccttaaagagaccgcg

SEQ ID NO: 507668 - DNA, 25 bp, Rattus norvegicus
cccgtcacttccttcagaaaacaga

SEQ ID NO: 507669 - DNA, 25 bp, Rattus norvegicus
tccggactccgttcagcacttttca

SEQ ID NO: 507670 - DNA, 25 bp, Rattus norvegicus
ccacgacgtgctgcgaattcacgtg

SEQ ID NO: 507671 - DNA, 25 bp, Rattus norvegicus
gggagacgcgcctacaaagtttgcc

SEQ ID NO: 507672 - DNA, 25 bp, Rattus norvegicus
ttgcagactctcctcagtcacctgg

SEQ ID NO: 507673 - DNA, 25 bp, Rattus norvegicus
tccggtttgcgcagatcaaggctga

SEQ ID NO: 507674 - DNA, 25 bp, Rattus norvegicus
ctcaccttcttgaaatccgcgatga

SEQ ID NO: 507675 - DNA, 25 bp, Rattus norvegicus
cggtggtggtacctcaccttcttga

SEQ ID NO: 507676 - DNA, 25 bp, Rattus norvegicus
ccacctcgagaggagagactcaatc

SEQ ID NO: 507677 - DNA, 25 bp, Rattus norvegicus
attcacgtgggtcgcgcacagccac

SEQ ID NO: 507678 - DNA, 25 bp, Rattus norvegicus
tgcggctgacctggatcctccgagt

SEQ ID NO: 507679 - DNA, 25 bp, Rattus norvegicus
ccctcgtcttccaggctggtttctg

SEQ ID NO: 507680 - DNA, 25 bp, Rattus norvegicus
cgggcatctgccgaggctctgagcc

SEQ ID NO: 507681 - DNA, 25 bp, Rattus norvegicus
cgtgcaacttactgcgggcatctgc

SEQ ID NO: 507682 - DNA, 25 bp, Rattus norvegicus
ggggcatgactcgtgcaacttactg

SEQ ID NO: 507683 - DNA, 25 bp, Rattus norvegicus
aaccggccatggacgcctgcaagtt

SEQ ID NO: 507684 - DNA, 25 bp, Rattus norvegicus
accctcggagaacaaccggccatgg

SEQ ID NO: 507685 - DNA, 25 bp, Rattus norvegicus
attgttgcggatcgcccgcacccag

SEQ ID NO: 507686 - DNA, 25 bp, Rattus norvegicus
gggcagctccacattgttgcggatc

SEQ ID NO: 507687 - DNA, 25 bp, Rattus norvegicus
cagccacagctgcttaggactggga

SEQ ID NO: 507688 - DNA, 25 bp, Rattus norvegicus
catctcgctagcgagggtccctgag

SEQ ID NO: 507689 - DNA, 25 bp, Rattus norvegicus
cgaaagacgtcccaaggggcatctc

SEQ ID NO: 507690 - DNA, 25 bp, Rattus norvegicus
ctccctttgtcagcgaccgcggagg

SEQ ID NO: 507691 - DNA, 25 bp, Rattus norvegicus
tcctcggagaccgtgcagcccagag

SEQ ID NO: 507692 - DNA, 25 bp, Rattus norvegicus
accaggtggccgcatgacccacttt

SEQ ID NO: 507693 - DNA, 25 bp, Rattus norvegicus
gcccatattggcctattctgacgga

SEQ ID NO: 507694 - DNA, 25 bp, Rattus norvegicus
aactccgctccggaccctgaggtgg

SEQ ID NO: 507695 - DNA, 25 bp, Rattus norvegicus
tgccggcagaagaggggttaactcc

SEQ ID NO: 507696 - DNA, 25 bp, Rattus norvegicus
ccgcgtgtctttcctcgaggtatga

SEQ ID NO: 507697 - DNA, 25 bp, Rattus norvegicus
ccactggcttcatgccaaccaggtg

SEQ ID NO: 507698 - DNA, 25 bp, Rattus norvegicus
tcccaggaggaagctccactggctt

SEQ ID NO: 507699 - DNA, 25 bp, Rattus norvegicus
tccacttctaaagcggagggctctc

SEQ ID NO: 507700 - DNA, 25 bp, Rattus norvegicus
gggctccgtactggaactccacttc

SEQ ID NO: 507701 - DNA, 25 bp, Rattus norvegicus
catggggttcgcaaactcccggcct

SEQ ID NO: 507702 - DNA, 25 bp, Rattus norvegicus
actcacctgcggttccttttctgga

SEQ ID NO: 507703 - DNA, 25 bp, Rattus norvegicus
tgcggcaccggcagcttcttactca

SEQ ID NO: 507704 - DNA, 25 bp, Rattus norvegicus
ccacagcgggcgaacggagcctgct

SEQ ID NO: 507705 - DNA, 25 bp, Rattus norvegicus
tttcctcgaggtatgagctgccggc

SEQ ID NO: 507706 - DNA, 25 bp, Rattus norvegicus
tcgactcgtccatcctccgagaaga

SEQ ID NO: 507707 - DNA, 25 bp, Rattus norvegicus
ccgtgacgtatatcagtgacgcaaa

SEQ ID NO: 507708 - DNA, 25 bp, Rattus norvegicus
tgctccacgtggttctctgtatata

SEQ ID NO: 507709 - DNA, 25 bp, Rattus norvegicus
ggttctctgtatatacccggttgtc

SEQ ID NO: 507710 - DNA, 25 bp, Rattus norvegicus
acccggttgtcttggagatccacgc

SEQ ID NO: 507711 - DNA, 25 bp, Rattus norvegicus
gcggggctctactgatgcaacaata

SEQ ID NO: 507712 - DNA, 25 bp, Rattus norvegicus
ggaacaagccaatagccgtgacgta

SEQ ID NO: 507713 - DNA, 25 bp, Rattus norvegicus
accggctccaaacaggcgtgctttt

SEQ ID NO: 507714 - DNA, 25 bp, Rattus norvegicus
agtaccagccaggactcatccgcag

SEQ ID NO: 507715 - DNA, 25 bp, Rattus norvegicus
ctccatgcttgtgcccggttcgact

SEQ ID NO: 507716 - DNA, 25 bp, Rattus norvegicus
tccgagaagaggcaggtacgtgcca

SEQ ID NO: 507717 - DNA, 25 bp, Rattus norvegicus
aggtacgtgccacctgtcgcaggtc

SEQ ID NO: 507718 - DNA, 25 bp, Rattus norvegicus
aacaggcgtgcttttgctccacgtg

SEQ ID NO: 507719 - DNA, 25 bp, Rattus norvegicus
ggactcatccgcagctccatgcttg

SEQ ID NO: 507720 - DNA, 25 bp, Rattus norvegicus
gatctccgccggcttcggtgtcacg

SEQ ID NO: 507721 - DNA, 25 bp, Rattus norvegicus
ctttcccgctctcgccaaggagctg

SEQ ID NO: 507722 - DNA, 25 bp, Rattus norvegicus
ccgcgctgacgtcgcaaagctggaa

SEQ ID NO: 507723 - DNA, 25 bp, Rattus norvegicus
gctgacgtcgcaaagctggaagctc

SEQ ID NO: 507724 - DNA, 25 bp, Rattus norvegicus
acgtcgcaaagctggaagctcggcg

SEQ ID NO: 507725 - DNA, 25 bp, Rattus norvegicus
aagctcggcgggtcagccagtccgc

SEQ ID NO: 507726 - DNA, 25 bp, Rattus norvegicus
tcagtagcggttactgccccacgtc

SEQ ID NO: 507727 - DNA, 25 bp, Rattus norvegicus
gtcctgtgggatctccgccggcttc

SEQ ID NO: 507728 - DNA, 25 bp, Rattus norvegicus
ttcggtgtcacggttgtagcaaggc

SEQ ID NO: 507729 - DNA, 25 bp, Rattus norvegicus
cccttgaccagcagcgttgggtttg

SEQ ID NO: 507730 - DNA, 25 bp, Rattus norvegicus
ttgggtttggggcatagcccaccgc

SEQ ID NO: 507731 - DNA, 25 bp, Rattus norvegicus
agcatgcgtacctcctacaccgtga

SEQ ID NO: 507732 - DNA, 25 bp, Rattus norvegicus
tacaccgtgaccctgcccgaagagc

SEQ ID NO: 507733 - DNA, 25 bp, Rattus norvegicus
ggcttcggtgtcacggttgtagcaa

SEQ ID NO: 507734 - DNA, 25 bp, Rattus norvegicus
ccacgctgggaaagactcagagacc

SEQ ID NO: 507735 - DNA, 25 bp, Rattus norvegicus
gacgactgcatttgcctccgcacag

SEQ ID NO: 507736 - DNA, 25 bp, Rattus norvegicus
cgcacagcgcagctcattgcgcagg

SEQ ID NO: 507737 - DNA, 25 bp, Rattus norvegicus
tgggacagggtgctttggcataatc

SEQ ID NO: 507738 - DNA, 25 bp, Rattus norvegicus
gctttggcataatcccgccactcga

SEQ ID NO: 507739 - DNA, 25 bp, Rattus norvegicus
gaccctggaccctagggcacagtcg

SEQ ID NO: 507740 - DNA, 25 bp, Rattus norvegicus
tggaccctagggcacagtcgcaccg

SEQ ID NO: 507741 - DNA, 25 bp, Rattus norvegicus
cccgccctttcagaggagtgacagg

SEQ ID NO: 507742 - DNA, 25 bp, Rattus norvegicus
agccgcctgagcatttttggtaatg

SEQ ID NO: 507743 - DNA, 25 bp, Rattus norvegicus
aggaccgactgaatcaccgccgagg

SEQ ID NO: 507744 - DNA, 25 bp, Rattus norvegicus
ctcagagaccggattcgaagtttcc

SEQ ID NO: 507745 - DNA, 25 bp, Rattus norvegicus
tcgaagtttccggagagtcccatgg

SEQ ID NO: 507746 - DNA, 25 bp, Rattus norvegicus
caactcgactgagccgcctgagcat

SEQ ID NO: 507747 - DNA, 25 bp, Rattus norvegicus
tttcagaggagtgacaggaccgact

SEQ ID NO: 507748 - DNA, 25 bp, Rattus norvegicus
tctccggatttgacgggatcatagc

SEQ ID NO: 507749 - DNA, 25 bp, Rattus norvegicus
cctgttgctggaaaaggcagtttcc

SEQ ID NO: 507750 - DNA, 25 bp, Rattus norvegicus
cgcgtctccggatttgacgggatca

SEQ ID NO: 507751 - DNA, 25 bp, Rattus norvegicus
tctcctcgcgtctccggatttgacg

SEQ ID NO: 507752 - DNA, 25 bp, Rattus norvegicus
tgtgggtctcctcgcgtctccggat

SEQ ID NO: 507753 - DNA, 25 bp, Rattus norvegicus
ctcacgccagtttggaggtgagcga

SEQ ID NO: 507754 - DNA, 25 bp, Rattus norvegicus
tgacgggatcatagcggaaagacga

SEQ ID NO: 507755 - DNA, 25 bp, Rattus norvegicus
aaggcagtttcccttgctggagggg

SEQ ID NO: 507756 - DNA, 25 bp, Rattus norvegicus
gccctcctgttgctggaaaaggcag

SEQ ID NO: 507757 - DNA, 25 bp, Rattus norvegicus
cgggcgcatccctaaccggtgcaac

SEQ ID NO: 507758 - DNA, 25 bp, Rattus norvegicus
tcccgcagtgctcgccctgggtgtt

SEQ ID NO: 507759 - DNA, 25 bp, Rattus norvegicus
tctgcgggacgctggaccaggcctc

SEQ ID NO: 507760 - DNA, 25 bp, Rattus norvegicus
acttggtcgggttgctgctgcagcg

SEQ ID NO: 507761 - DNA, 25 bp, Rattus norvegicus
cgcctgggcctcacgccagtttgga

SEQ ID NO: 507762 - DNA, 25 bp, Rattus norvegicus
gtccaacccggagccctagccggca

SEQ ID NO: 507763 - DNA, 25 bp, Rattus norvegicus
tcacccagggcgactcctcgtccaa

SEQ ID NO: 507764 - DNA, 25 bp, Rattus norvegicus
agacaggcgagcacggaacgccgca

SEQ ID NO: 507765 - DNA, 25 bp, Rattus norvegicus
ctagccggcagatccaacacacatc

SEQ ID NO: 507766 - DNA, 25 bp, Rattus norvegicus
cccgggcccactcggcgacccacat

SEQ ID NO: 507767 - DNA, 25 bp, Rattus norvegicus
gttcccaactgccaaccgcagctct

SEQ ID NO: 507768 - DNA, 25 bp, Rattus norvegicus
tcaccttgtccatgagcttccagca

SEQ ID NO: 507769 - DNA, 25 bp, Rattus norvegicus
ccttgtccatgagcttccagcactt

SEQ ID NO: 507770 - DNA, 25 bp, Rattus norvegicus
accatcttcttgtccaccgtgcagg

SEQ ID NO: 507771 - DNA, 25 bp, Rattus norvegicus
atcttcttgtccaccgtgcagggag

SEQ ID NO: 507772 - DNA, 25 bp, Rattus norvegicus
gaaggcgtccttcatgagcccgatc

SEQ ID NO: 507773 - DNA, 25 bp, Rattus norvegicus
gcgtccttcatgagcccgatcaggc

SEQ ID NO: 507774 - DNA, 25 bp, Rattus norvegicus
ctcttcttcacgttgccggccatgg

SEQ ID NO: 507775 - DNA, 25 bp, Rattus norvegicus
gaaagcctccaccaagtttccgcgc

SEQ ID NO: 507776 - DNA, 25 bp, Rattus norvegicus
ggagtttgctgccaatcacgcctca

SEQ ID NO: 507777 - DNA, 25 bp, Rattus norvegicus
acggctaacatcctggagtttgctg

SEQ ID NO: 507778 - DNA, 25 bp, Rattus norvegicus
gctgtccttagcgttaccctactga

SEQ ID NO: 507779 - DNA, 25 bp, Rattus norvegicus
ttgctgccaatcacgcctcagtctg

SEQ ID NO: 507780 - DNA, 25 bp, Rattus norvegicus
tcacgcctcagtctggattgcagtc

SEQ ID NO: 507781 - DNA, 25 bp, Rattus norvegicus
ctcagtctggattgcagtcttgttc

SEQ ID NO: 507782 - DNA, 25 bp, Rattus norvegicus
attgcagtcttgttcacggtggacc

SEQ ID NO: 507783 - DNA, 25 bp, Rattus norvegicus
tgttcacggtggaccgctacaacgc

SEQ ID NO: 507784 - DNA, 25 bp, Rattus norvegicus
ggtggaccgctacaacgccctgtgc

SEQ ID NO: 507785 - DNA, 25 bp, Rattus norvegicus
cccttgcgccatcgggccacctcgt

SEQ ID NO: 507786 - DNA, 25 bp, Rattus norvegicus
aggccggacccaccgcgctattgcc

SEQ ID NO: 507787 - DNA, 25 bp, Rattus norvegicus
gctattgccgctgtccttagcgtta

SEQ ID NO: 507788 - DNA, 25 bp, Rattus norvegicus
ctcaggccgtggtgcgcacggctaa

SEQ ID NO: 507789 - DNA, 25 bp, Rattus norvegicus
gcgcacggctaacatcctggagttt

SEQ ID NO: 507790 - DNA, 25 bp, Rattus norvegicus
cgcggcgacgcacagctgcaaacgt

SEQ ID NO: 507791 - DNA, 25 bp, Rattus norvegicus
caaaagcgcgggcaggctcactcac

SEQ ID NO: 507792 - DNA, 25 bp, Rattus norvegicus
gttatccttttgaagctagtgtccc

SEQ ID NO: 507793 - DNA, 25 bp, Rattus norvegicus
ctgggagaggagttatccttttgaa

SEQ ID NO: 507794 - DNA, 25 bp, Rattus norvegicus
ctagtagctgctcctaccgggaacc

SEQ ID NO: 507795 - DNA, 25 bp, Rattus norvegicus
aactcagggcgcagcaacttccacg

SEQ ID NO: 507796 - DNA, 25 bp, Rattus norvegicus
cgcggctatctggactgggaaaact

SEQ ID NO: 507797 - DNA, 25 bp, Rattus norvegicus
ccggtcgtcatcaggccttctgcaa

SEQ ID NO: 507798 - DNA, 25 bp, Rattus norvegicus
tgggaaaactcagggcgcagcaact

SEQ ID NO: 507799 - DNA, 25 bp, Rattus norvegicus
cgtcccagcatcacactggtgggtg

SEQ ID NO: 507800 - DNA, 25 bp, Rattus norvegicus
ctgcaagcaccgaggtggcgactct

SEQ ID NO: 507801 - DNA, 25 bp, Rattus norvegicus
gtgcaagagcgcgaaccctccacgt

SEQ ID NO: 507802 - DNA, 25 bp, Rattus norvegicus
tggctaacccgaaggaaggcgaagc

SEQ ID NO: 507803 - DNA, 25 bp, Rattus norvegicus
acagctgcaaacgtcgggctccgcg

SEQ ID NO: 507804 - DNA, 25 bp, Rattus norvegicus
cccagcgcagccgtccagccagggc

SEQ ID NO: 507805 - DNA, 25 bp, Rattus norvegicus
cgcactgagcggagacctgcagaaa

SEQ ID NO: 507806 - DNA, 25 bp, Rattus norvegicus
cagcctggacgccggagcgcactga

SEQ ID NO: 507807 - DNA, 25 bp, Rattus norvegicus
gcccgtcagcaagcgcgcagtccgg

SEQ ID NO: 507808 - DNA, 25 bp, Rattus norvegicus
cgacccagctgtccggcccttgctt

SEQ ID NO: 507809 - DNA, 25 bp, Rattus norvegicus
agcttccctggctcgttcggcagcg

SEQ ID NO: 507810 - DNA, 25 bp, Rattus norvegicus
ggaagcaggcgtctcccgctggctc

SEQ ID NO: 507811 - DNA, 25 bp, Rattus norvegicus
agcgatcgacccagttaggccttta

SEQ ID NO: 507812 - DNA, 25 bp, Rattus norvegicus
gctgcctaggccctggtgcctgtcg

SEQ ID NO: 507813 - DNA, 25 bp, Rattus norvegicus
ggcgagcagagaagcgatcgaccca

SEQ ID NO: 507814 - DNA, 25 bp, Rattus norvegicus
cggagacctgcagaaagaggatcgt

SEQ ID NO: 507815 - DNA, 25 bp, Rattus norvegicus
cgcagtccggcccactctggcaccc

SEQ ID NO: 507816 - DNA, 25 bp, Rattus norvegicus
aggaaaggaagcaggcgtctcccgc

SEQ ID NO: 507817 - DNA, 25 bp, Rattus norvegicus
gctcgttcggcagcgcgcgtctaag

SEQ ID NO: 507818 - DNA, 25 bp, Rattus norvegicus
gttctcttcaagcttctgctccctg

SEQ ID NO: 507819 - DNA, 25 bp, Rattus norvegicus
gtacagtccctcactccgcgagtgg

SEQ ID NO: 507820 - DNA, 25 bp, Rattus norvegicus
ggcagcagtgttcgttctcttcaag

SEQ ID NO: 507821 - DNA, 25 bp, Rattus norvegicus
cctctagagctagtcgggcagcagt

SEQ ID NO: 507822 - DNA, 25 bp, Rattus norvegicus
tggatgaacccgctgggttttcgta

SEQ ID NO: 507823 - DNA, 25 bp, Rattus norvegicus
tgcgaccctgcttggatgaacccgc

SEQ ID NO: 507824 - DNA, 25 bp, Rattus norvegicus
tggttgagatctcgctgcgaccctg

SEQ ID NO: 507825 - DNA, 25 bp, Rattus norvegicus
tccggtcagaaaggatgacacggtt

SEQ ID NO: 507826 - DNA, 25 bp, Rattus norvegicus
gcaggaggacactcccggctctctt

SEQ ID NO: 507827 - DNA, 25 bp, Rattus norvegicus
acccagatgctcagcgttgcggcgc

SEQ ID NO: 507828 - DNA, 25 bp, Rattus norvegicus
accaggatgttcgacccagatgctc

SEQ ID NO: 507829 - DNA, 25 bp, Rattus norvegicus
gcagagatgctcaaccaggatgttc

SEQ ID NO: 507830 - DNA, 25 bp, Rattus norvegicus
ccgcgacgcaaggatgctcagcaga

SEQ ID NO: 507831 - DNA, 25 bp, Rattus norvegicus
tcctgcttagatggccatgcgcctc

SEQ ID NO: 507832 - DNA, 25 bp, Rattus norvegicus
gtcactctttagcatcgagcctcgg

SEQ ID NO: 507833 - DNA, 25 bp, Rattus norvegicus
taaacttaacttgcccggagattca

SEQ ID NO: 507834 - DNA, 25 bp, Rattus norvegicus
ttgcccggagattcatgttgctctc

SEQ ID NO: 507835 - DNA, 25 bp, Rattus norvegicus
attcatgttgctctcgcctaccgtg

SEQ ID NO: 507836 - DNA, 25 bp, Rattus norvegicus
cgcctaccgtgattggccgacgcta

SEQ ID NO: 507837 - DNA, 25 bp, Rattus norvegicus
ttggccgacgctactcattggctga

SEQ ID NO: 507838 - DNA, 25 bp, Rattus norvegicus
ctactcattggctgagggcgcggaa

SEQ ID NO: 507839 - DNA, 25 bp, Rattus norvegicus
gaagagaacgttgaagcagcccttc

SEQ ID NO: 507840 - DNA, 25 bp, Rattus norvegicus
ttgaagcagcccttcgctagcggcc

SEQ ID NO: 507841 - DNA, 25 bp, Rattus norvegicus
agcccttcgctagcggccgcggtga

SEQ ID NO: 507842 - DNA, 25 bp, Rattus norvegicus
acagcccggcttcggcgcgatgaac

SEQ ID NO: 507843 - DNA, 25 bp, Rattus norvegicus
accaactgccggaaagtgctgcgga

SEQ ID NO: 507844 - DNA, 25 bp, Rattus norvegicus
gacgagatgcgaagggtcctcccgc

SEQ ID NO: 507845 - DNA, 25 bp, Rattus norvegicus
cgagcctcggagataaacttaactt

SEQ ID NO: 507846 - DNA, 25 bp, Rattus norvegicus
gagagccactgtaaccaccaaggta

SEQ ID NO: 507847 - DNA, 25 bp, Rattus norvegicus
agagcgtccagtcccaaggggtaca

SEQ ID NO: 507848 - DNA, 25 bp, Rattus norvegicus
cgtctgacagaaccgtgcgcaccaa

SEQ ID NO: 507849 - DNA, 25 bp, Rattus norvegicus
atcgctgctctcgagtcgaccgaca

SEQ ID NO: 507850 - DNA, 25 bp, Rattus norvegicus
gtttgagcgacgacaagcgacagcc

SEQ ID NO: 507851 - DNA, 25 bp, Rattus norvegicus
caccaaggtaccagagatgcaagcc

SEQ ID NO: 507852 - DNA, 25 bp, Rattus norvegicus
ggacattacaccgagcgctccagga

SEQ ID NO: 507853 - DNA, 25 bp, Rattus norvegicus
aggctaagagccgactcggacatta

SEQ ID NO: 507854 - DNA, 25 bp, Rattus norvegicus
tggcgccaaccgagtccagccgtag

SEQ ID NO: 507855 - DNA, 25 bp, Rattus norvegicus
ttcccggaatcagcagcgtcaagcg

SEQ ID NO: 507856 - DNA, 25 bp, Rattus norvegicus
agtagcccaactccgtgagcccaga

SEQ ID NO: 507857 - DNA, 25 bp, Rattus norvegicus
ggggccaagcttccgaggatagcta

SEQ ID NO: 507858 - DNA, 25 bp, Rattus norvegicus
cgcacgagagcgatcgggacacaaa

SEQ ID NO: 507859 - DNA, 25 bp, Rattus norvegicus
tcacaccatataccctgaggcgttt

SEQ ID NO: 507860 - DNA, 25 bp, Rattus norvegicus
cgacgctcgggctctgtctccgtag

SEQ ID NO: 507861 - DNA, 25 bp, Rattus norvegicus
cgttgccagttctcccggaaagact

SEQ ID NO: 507862 - DNA, 25 bp, Rattus norvegicus
tctccgtagccggagatccgggtcc

SEQ ID NO: 507863 - DNA, 25 bp, Rattus norvegicus
atccgggtccctgacaccggcgttg

SEQ ID NO: 507864 - DNA, 25 bp, Rattus norvegicus
ccggacaccggcagagaccagtctg

SEQ ID NO: 507865 - DNA, 25 bp, Rattus norvegicus
gctgcgtgcgcagaactgacactga

SEQ ID NO: 507866 - DNA, 25 bp, Rattus norvegicus
ccaccgatagagaagaggttctccg

SEQ ID NO: 507867 - DNA, 25 bp, Rattus norvegicus
accagtctgcggagacaccggggct

SEQ ID NO: 507868 - DNA, 25 bp, Rattus norvegicus
gcatactgcagcaaccagcccaata

SEQ ID NO: 507869 - DNA, 25 bp, Rattus norvegicus
cagcccaataccgtgagcagcgagg

SEQ ID NO: 507870 - DNA, 25 bp, Rattus norvegicus
cagtctggatccatgctcccgcggg

SEQ ID NO: 507871 - DNA, 25 bp, Rattus norvegicus
ggcgccgccgagatcctaggaccag

SEQ ID NO: 507872 - DNA, 25 bp, Rattus norvegicus
tcctaggaccagtcggtgccaccga

SEQ ID NO: 507873 - DNA, 25 bp, Rattus norvegicus
gttctcccggaaagacttgaaggca

SEQ ID NO: 507874 - DNA, 25 bp, Rattus norvegicus
ccagagagtttataagggcgagctt

SEQ ID NO: 507875 - DNA, 25 bp, Rattus norvegicus
gtgattcgcctctggcttgcagcca

SEQ ID NO: 507876 - DNA, 25 bp, Rattus norvegicus
tggaccaatcgctgagcgcgttctc

SEQ ID NO: 507877 - DNA, 25 bp, Rattus norvegicus
gcgcgtcaccgaagggttaattgca

SEQ ID NO: 507878 - DNA, 25 bp, Rattus norvegicus
ttgcaaccaaccagaggtgggtatt

SEQ ID NO: 507879 - DNA, 25 bp, Rattus norvegicus
cgcgtgcaccgactgctgcggaaag

SEQ ID NO: 507880 - DNA, 25 bp, Rattus norvegicus
tgcggaaaggccattacgccgagcg

SEQ ID NO: 507881 - DNA, 25 bp, Rattus norvegicus
tcgagtacctcactgccgagatcct

SEQ ID NO: 507882 - DNA, 25 bp, Rattus norvegicus
ctcccaggcctctcaggagtactga

SEQ ID NO: 507883 - DNA, 25 bp, Rattus norvegicus
acctccctcacagaaagagctgagc

SEQ ID NO: 507884 - DNA, 25 bp, Rattus norvegicus
agctcgtgacatcgcttcgccgttc

SEQ ID NO: 507885 - DNA, 25 bp, Rattus norvegicus
gcttcgccgttctcagtcgtcgacg

SEQ ID NO: 507886 - DNA, 25 bp, Rattus norvegicus
cgttctctcggctatggcgcgtcac

SEQ ID NO: 507887 - DNA, 25 bp, Rattus norvegicus
tctacctcgcacacgatgtcgggtc

SEQ ID NO: 507888 - DNA, 25 bp, Rattus norvegicus
tcctctgggcgggaattaggattgc

SEQ ID NO: 507889 - DNA, 25 bp, Rattus norvegicus
gttgccctccctcgaaggggcggca

SEQ ID NO: 507890 - DNA, 25 bp, Rattus norvegicus
ctgagctctgcgtcacgtccgttgc

SEQ ID NO: 507891 - DNA, 25 bp, Rattus norvegicus
cccgcacttcactccggctgcagga

SEQ ID NO: 507892 - DNA, 25 bp, Rattus norvegicus
tggagtctgcagaagccggcgacct

SEQ ID NO: 507893 - DNA, 25 bp, Rattus norvegicus
acatggctccgctcagggcgcaagc

SEQ ID NO: 507894 - DNA, 25 bp, Rattus norvegicus
gttaccggacatggctccgctcagg

SEQ ID NO: 507895 - DNA, 25 bp, Rattus norvegicus
gctcaggactcaccgcggttgtggc

SEQ ID NO: 507896 - DNA, 25 bp, Rattus norvegicus
ggtcatcggtcaccggctcaggact

SEQ ID NO: 507897 - DNA, 25 bp, Rattus norvegicus
aaagtcccgagaagtgcgggtcatc

SEQ ID NO: 507898 - DNA, 25 bp, Rattus norvegicus
ttgcacccagaaagtcccgagaagt

SEQ ID NO: 507899 - DNA, 25 bp, Rattus norvegicus
ggccaatcgttgcacccagaaagtc

SEQ ID NO: 507900 - DNA, 25 bp, Rattus norvegicus
cggagcacggcaacccggggccaat

SEQ ID NO: 507901 - DNA, 25 bp, Rattus norvegicus
ggcaccttcctctgggcgggaatta

SEQ ID NO: 507902 - DNA, 25 bp, Rattus norvegicus
aaggatatctccaaagaccaggctc

SEQ ID NO: 507903 - DNA, 25 bp, Rattus norvegicus
ccactgcaggtaggccgccatcttg

SEQ ID NO: 507904 - DNA, 25 bp, Rattus norvegicus
tgctttgttatgactgccagggcgc

SEQ ID NO: 507905 - DNA, 25 bp, Rattus norvegicus
ttggtggctcttcaatgctttgtta

SEQ ID NO: 507906 - DNA, 25 bp, Rattus norvegicus
agccatgtaagggagcatccgcaca

SEQ ID NO: 507907 - DNA, 25 bp, Rattus norvegicus
ttccagctgtaggaactcgtcgggc

SEQ ID NO: 507908 - DNA, 25 bp, Rattus norvegicus
ctccggaagcaagatcacgtgaacc

SEQ ID NO: 507909 - DNA, 25 bp, Rattus norvegicus
tctaagtgcgagtacgcgaagcgcc

SEQ ID NO: 507910 - DNA, 25 bp, Rattus norvegicus
gaagaaaacgaatcgccgccactgc

SEQ ID NO: 507911 - DNA, 25 bp, Rattus norvegicus
caaaggaacttggaagcagtgggtc

SEQ ID NO: 507912 - DNA, 25 bp, Rattus norvegicus
cggcctgagtcgcagacagtaatgc

SEQ ID NO: 507913 - DNA, 25 bp, Rattus norvegicus
cgtccgctgaggaaaaagccaactc

SEQ ID NO: 507914 - DNA, 25 bp, Rattus norvegicus
agcgcctttgacagattccattcca

SEQ ID NO: 507915 - DNA, 25 bp, Rattus norvegicus
aggcgaatcacgtgagagccatgta

SEQ ID NO: 507916 - DNA, 25 bp, Rattus norvegicus
ggaggctgtcccgatgactgccctt

SEQ ID NO: 507917 - DNA, 25 bp, Rattus norvegicus
ggcctctcgaggctacgtgcggctc

SEQ ID NO: 507918 - DNA, 25 bp, Rattus norvegicus
tcctgactggcagagcctaggctgc

SEQ ID NO: 507919 - DNA, 25 bp, Rattus norvegicus
cgcagttcccaacctggagtcgggt

SEQ ID NO: 507920 - DNA, 25 bp, Rattus norvegicus
agtctccgtagctctcctgctcctg

SEQ ID NO: 507921 - DNA, 25 bp, Rattus norvegicus
agatgccgcgccctcgtggctgcag

SEQ ID NO: 507922 - DNA, 25 bp, Rattus norvegicus
gcggtcttgtagatgccgcgccctc

SEQ ID NO: 507923 - DNA, 25 bp, Rattus norvegicus
cccaggaccgcggtcttgtagatgc

SEQ ID NO: 507924 - DNA, 25 bp, Rattus norvegicus
atgactgcccttccgggatggcgac

SEQ ID NO: 507925 - DNA, 25 bp, Rattus norvegicus
tgacttccgactacgccggaggctg

SEQ ID NO: 507926 - DNA, 25 bp, Rattus norvegicus
ccgcctctctccaggtaggggtggc

SEQ ID NO: 507927 - DNA, 25 bp, Rattus norvegicus
atcctagtggggttaccgcctctct

SEQ ID NO: 507928 - DNA, 25 bp, Rattus norvegicus
gcgtgcgcaccagccttactcgagt

SEQ ID NO: 507929 - DNA, 25 bp, Rattus norvegicus
cccttccgggatggcgacagttccg

SEQ ID NO: 507930 - DNA, 25 bp, Rattus norvegicus
ctctgcgtacttaccggagtgaagc

SEQ ID NO: 507931 - DNA, 25 bp, Rattus norvegicus
agcttcagggcggattccagaccgc

SEQ ID NO: 507932 - DNA, 25 bp, Rattus norvegicus
gcgagctgaatgcgcgctgcagctt

SEQ ID NO: 507933 - DNA, 25 bp, Rattus norvegicus
cagcagcgcgtctgggctgctcttg

SEQ ID NO: 507934 - DNA, 25 bp, Rattus norvegicus
gccagtccacccgagggccgacgcc

SEQ ID NO: 507935 - DNA, 25 bp, Rattus norvegicus
cgtacttaccggagtgaagctgtgg

SEQ ID NO: 507936 - DNA, 25 bp, Rattus norvegicus
gggcggattccagaccgccagtcca

SEQ ID NO: 507937 - DNA, 25 bp, Rattus norvegicus
ggcagctctgcgtacttaccggagt

SEQ ID NO: 507938 - DNA, 25 bp, Rattus norvegicus
ccagggcagctctgcgtacttaccg

SEQ ID NO: 507939 - DNA, 25 bp, Rattus norvegicus
gccctccgcgcgctctccagtgccc

SEQ ID NO: 507940 - DNA, 25 bp, Rattus norvegicus
aggcttttccatccggtgcctccca

SEQ ID NO: 507941 - DNA, 25 bp, Rattus norvegicus
ctagggctagccaggcttttccatc

SEQ ID NO: 507942 - DNA, 25 bp, Rattus norvegicus
ccgaccctagggctagccaggcttt

SEQ ID NO: 507943 - DNA, 25 bp, Rattus norvegicus
gtcctgcctggccacagcagcgcgt

SEQ ID NO: 507944 - DNA, 25 bp, Rattus norvegicus
agcactcgttcgtcgtgcagtttca

SEQ ID NO: 507945 - DNA, 25 bp, Rattus norvegicus
tcgtgcagtttcagcagtaggtcca

SEQ ID NO: 507946 - DNA, 25 bp, Rattus norvegicus
cagcgggtaactgaaagttttctca

SEQ ID NO: 507947 - DNA, 25 bp, Rattus norvegicus
ttttctcagcttcagcccgtggcga

SEQ ID NO: 507948 - DNA, 25 bp, Rattus norvegicus
ggcgagtagctgtcccactggtaaa

SEQ ID NO: 507949 - DNA, 25 bp, Rattus norvegicus
tcccactggtaaatcaggccgccgg

SEQ ID NO: 507950 - DNA, 25 bp, Rattus norvegicus
gccggctttgttcaccacgtacacg

SEQ ID NO: 507951 - DNA, 25 bp, Rattus norvegicus
cacgtacacgctaaaaatcgccatt

SEQ ID NO: 507952 - DNA, 25 bp, Rattus norvegicus
atcgccattactgcgctacggatag

SEQ ID NO: 507953 - DNA, 25 bp, Rattus norvegicus
tacggatagggtactacagcccggc

SEQ ID NO: 507954 - DNA, 25 bp, Rattus norvegicus
ttccagcaccggaactggtgtcata

SEQ ID NO: 507955 - DNA, 25 bp, Rattus norvegicus
ctcggtcctgaagcgcaagcgcaaa

SEQ ID NO: 507956 - DNA, 25 bp, Rattus norvegicus
tggccgaaagcgaccagcactcgtt

SEQ ID NO: 507957 - DNA, 25 bp, Rattus norvegicus
tcagcagtaggtccagcgggtaact

SEQ ID NO: 507958 - DNA, 25 bp, Rattus norvegicus
acgggcaccaacagcaccggtcgtg

SEQ ID NO: 507959 - DNA, 25 bp, Rattus norvegicus
gagacgcagaccacgccagatagga

SEQ ID NO: 507960 - DNA, 25 bp, Rattus norvegicus
cacccgctgagaaccggctgtgaaa

SEQ ID NO: 507961 - DNA, 25 bp, Rattus norvegicus
ttgcaatacgttctgcggctgcgcg

SEQ ID NO: 507962 - DNA, 25 bp, Rattus norvegicus
cctctagaggcagtaggcggatatt

SEQ ID NO: 507963 - DNA, 25 bp, Rattus norvegicus
atagacccaggaccggcgaacaccg

SEQ ID NO: 507964 - DNA, 25 bp, Rattus norvegicus
gtctgccgacacagaggacatctct

SEQ ID NO: 507965 - DNA, 25 bp, Rattus norvegicus
gtgcccgcgaccacagaagaaagtc

SEQ ID NO: 507966 - DNA, 25 bp, Rattus norvegicus
cttgtggctgtaaacgtgcccgcga

SEQ ID NO: 507967 - DNA, 25 bp, Rattus norvegicus
ttcaactgccgctggtgcttgtggc

SEQ ID NO: 507968 - DNA, 25 bp, Rattus norvegicus
agccagctaggaccctgaaactaca

SEQ ID NO: 507969 - DNA, 25 bp, Rattus norvegicus
ccacctgcgggagagaagccagcta

SEQ ID NO: 507970 - DNA, 25 bp, Rattus norvegicus
gataggacctcagaccgcactttta

SEQ ID NO: 507971 - DNA, 25 bp, Rattus norvegicus
tccgggacatagcactccacctggg

SEQ ID NO: 507972 - DNA, 25 bp, Rattus norvegicus
ccgatgcttattcaggctggggaga

SEQ ID NO: 507973 - DNA, 25 bp, Rattus norvegicus
ggcgccttaccgagtcagaccactg

SEQ ID NO: 507974 - DNA, 25 bp, Rattus norvegicus
acccaacgaccctgatctggttatg

SEQ ID NO: 507975 - DNA, 25 bp, Rattus norvegicus
ctctcccggctctggtatgaaggca

SEQ ID NO: 507976 - DNA, 25 bp, Rattus norvegicus
tgatctggttatggcgtccagctcc

SEQ ID NO: 507977 - DNA, 25 bp, Rattus norvegicus
ggctgcgatctggaccctcggcatc

SEQ ID NO: 507978 - DNA, 25 bp, Rattus norvegicus
ctcggcatccgaccaacaataagcg

SEQ ID NO: 507979 - DNA, 25 bp, Rattus norvegicus
ccaggaccatgctccgcggttggga

SEQ ID NO: 507980 - DNA, 25 bp, Rattus norvegicus
aggcaggaacccaggcaaccagcgc

SEQ ID NO: 507981 - DNA, 25 bp, Rattus norvegicus
ggctggtattaagatcaaggcgtcc

SEQ ID NO: 507982 - DNA, 25 bp, Rattus norvegicus
ggcgtccaggatcaaaaagaccacc

SEQ ID NO: 507983 - DNA, 25 bp, Rattus norvegicus
acgactccaccgtcctgctggagga

SEQ ID NO: 507984 - DNA, 25 bp, Rattus norvegicus
tggaggatcccagtccacccaacga

SEQ ID NO: 507985 - DNA, 25 bp, Rattus norvegicus
ctcttattttgacaggggcctctcc

SEQ ID NO: 507986 - DNA, 25 bp, Rattus norvegicus
ggggtgggtctgaacctcagattcc

SEQ ID NO: 507987 - DNA, 25 bp, Rattus norvegicus
cgcgcagcgcgaaacgcggagaaca

SEQ ID NO: 507988 - DNA, 25 bp, Rattus norvegicus
cggagcccgcgaagcgttgacagat

SEQ ID NO: 507989 - DNA, 25 bp, Rattus norvegicus
cccgcgaagcgttgacagatcctca

SEQ ID NO: 507990 - DNA, 25 bp, Rattus norvegicus
gacagatcctcacgtgcgcctcggt

SEQ ID NO: 507991 - DNA, 25 bp, Rattus norvegicus
cccgcgtagaaaaagcggtcgcact

SEQ ID NO: 507992 - DNA, 25 bp, Rattus norvegicus
aaaagcggtcgcactcgccgaagcc

SEQ ID NO: 507993 - DNA, 25 bp, Rattus norvegicus
aagcccgcttgctgcgggagcagca

SEQ ID NO: 507994 - DNA, 25 bp, Rattus norvegicus
ctctgcgctggtctgacttagccca

SEQ ID NO: 507995 - DNA, 25 bp, Rattus norvegicus
tctgacttagcccaagggacggtcc

SEQ ID NO: 507996 - DNA, 25 bp, Rattus norvegicus
tccgaccgagccctgcttacctgcg

SEQ ID NO: 507997 - DNA, 25 bp, Rattus norvegicus
caccaggttcctccgggatgcatgg

SEQ ID NO: 507998 - DNA, 25 bp, Rattus norvegicus
ggaccttgcgtgcaccaggttcctc

SEQ ID NO: 507999 - DNA, 25 bp, Rattus norvegicus
gagaagccggaccttgcgtgcacca

SEQ ID NO: 508000 - DNA, 25 bp, Rattus norvegicus
ctcctgctggttcgcgctgtccagt

SEQ ID NO: 508001 - DNA, 25 bp, Rattus norvegicus
tcgctcttagctcgctctgtctcta

SEQ ID NO: 508002 - DNA, 25 bp, Rattus norvegicus
tggccgtgagcgtctctagtttcct

SEQ ID NO: 508003 - DNA, 25 bp, Rattus norvegicus
tctttgtctccctgtccacgtgtga

SEQ ID NO: 508004 - DNA, 25 bp, Rattus norvegicus
tccacgtgtgagctgtaagtgtgcg

SEQ ID NO: 508005 - DNA, 25 bp, Rattus norvegicus
gggtgcttgtgggtctctttaagtc

SEQ ID NO: 508006 - DNA, 25 bp, Rattus norvegicus
gtctctagtttcctgggctccgtgc

SEQ ID NO: 508007 - DNA, 25 bp, Rattus norvegicus
tccctagaggacttgtccatgtgtc

SEQ ID NO: 508008 - DNA, 25 bp, Rattus norvegicus
tgtctctacactcgggctttgctga

SEQ ID NO: 508009 - DNA, 25 bp, Rattus norvegicus
gaggctcctgcattcttgcggtcgg

SEQ ID NO: 508010 - DNA, 25 bp, Rattus norvegicus
ggaggaatctgagccagcgttactg

SEQ ID NO: 508011 - DNA, 25 bp, Rattus norvegicus
cgttactggtctccaaaagagccca

SEQ ID NO: 508012 - DNA, 25 bp, Rattus norvegicus
ccagtgggccagagcagacctcgca

SEQ ID NO: 508013 - DNA, 25 bp, Rattus norvegicus
tagcgcccagtcagtccctagagga

SEQ ID NO: 508014 - DNA, 25 bp, Rattus norvegicus
ggcagagcagcagagtcagctccgc

SEQ ID NO: 508015 - DNA, 25 bp, Rattus norvegicus
gggagcttcgagtcaacaataaagg

SEQ ID NO: 508016 - DNA, 25 bp, Rattus norvegicus
aagctctccagtccgtccgtccgtc

SEQ ID NO: 508017 - DNA, 25 bp, Rattus norvegicus
ccattttgggagcttcgagtcaaca

SEQ ID NO: 508018 - DNA, 25 bp, Rattus norvegicus
ccgccattttgggagcttcgagtca

SEQ ID NO: 508019 - DNA, 25 bp, Rattus norvegicus
cacagcgggctacggccgaggtagc

SEQ ID NO: 508020 - DNA, 25 bp, Rattus norvegicus
agcagcagagtcagctccgctcagc

SEQ ID NO: 508021 - DNA, 25 bp, Rattus norvegicus
tctcgccatcttgtgtggaggagga

SEQ ID NO: 508022 - DNA, 25 bp, Rattus norvegicus
cggagctctcgccatcttgtgtgga

SEQ ID NO: 508023 - DNA, 25 bp, Rattus norvegicus
cgagtctctcccgaccctcgcccgc

SEQ ID NO: 508024 - DNA, 25 bp, Rattus norvegicus
cggtcccatcagtaacgagtctctc

SEQ ID NO: 508025 - DNA, 25 bp, Rattus norvegicus
cctgagctcggtcccatcagtaacg

SEQ ID NO: 508026 - DNA, 25 bp, Rattus norvegicus
tcaacaataaaggaccgagggtgcg

SEQ ID NO: 508027 - DNA, 25 bp, Rattus norvegicus
gagtcagctccgctcagcggcgaca

SEQ ID NO: 508028 - DNA, 25 bp, Rattus norvegicus
caagccactgcaccgacactgttgt

SEQ ID NO: 508029 - DNA, 25 bp, Rattus norvegicus
tctcagctgctcctgtaactgttcc

SEQ ID NO: 508030 - DNA, 25 bp, Rattus norvegicus
gcacaggggagagagaacacacact

SEQ ID NO: 508031 - DNA, 25 bp, Rattus norvegicus
tatcgagctgcgtctggagctcggc

SEQ ID NO: 508032 - DNA, 25 bp, Rattus norvegicus
tcggggcagttatcgagctgcgtct

SEQ ID NO: 508033 - DNA, 25 bp, Rattus norvegicus
ttcccgcactgactcggggcagtta

SEQ ID NO: 508034 - DNA, 25 bp, Rattus norvegicus
taactgttcccgcactgactcgggg

SEQ ID NO: 508035 - DNA, 25 bp, Rattus norvegicus
agagagaacacacactcctcaactc

SEQ ID NO: 508036 - DNA, 25 bp, Rattus norvegicus
tgacccttctcagctgctcctgtaa

SEQ ID NO: 508037 - DNA, 25 bp, Rattus norvegicus
ggctggtggaactgacccttctcag

SEQ ID NO: 508038 - DNA, 25 bp, Rattus norvegicus
cgctctcctatcttccgggcggtgg

SEQ ID NO: 508039 - DNA, 25 bp, Rattus norvegicus
gcggtcctgtcccaccgctctccta

SEQ ID NO: 508040 - DNA, 25 bp, Rattus norvegicus
tgtccggcaagtactgcaggggcca

SEQ ID NO: 508041 - DNA, 25 bp, Rattus norvegicus
cgacactgttgtccggcaagtactg

SEQ ID NO: 508042 - DNA, 25 bp, Rattus norvegicus
ctcctggagcggttgcgagcagcca

SEQ ID NO: 508043 - DNA, 25 bp, Rattus norvegicus
ttctactagcccgggccctgcaggt

SEQ ID NO: 508044 - DNA, 25 bp, Rattus norvegicus
ggccctgcaggtcgcccgcccgccc

SEQ ID NO: 508045 - DNA, 25 bp, Rattus norvegicus
gctgaacccagacctccggactgtt

SEQ ID NO: 508046 - DNA, 25 bp, Rattus norvegicus
ctccggactgttctcttctactagc

SEQ ID NO: 508047 - DNA, 25 bp, Rattus norvegicus
ggactgttctcttctactagcccgg

SEQ ID NO: 508048 - DNA, 25 bp, Rattus norvegicus
ccagctggagcgtctacgcccggtt

SEQ ID NO: 508049 - DNA, 25 bp, Rattus norvegicus
tctacgcccggttgccgggagcagt

SEQ ID NO: 508050 - DNA, 25 bp, Rattus norvegicus
ctgacctggctgaggactcaccgct

SEQ ID NO: 508051 - DNA, 25 bp, Rattus norvegicus
gcgagcagccgccaatgcccgggga

SEQ ID NO: 508052 - DNA, 25 bp, Rattus norvegicus
ctggctgaggactcaccgctgaacc

SEQ ID NO: 508053 - DNA, 25 bp, Rattus norvegicus
gctgaggactcaccgctgaacccag

SEQ ID NO: 508054 - DNA, 25 bp, Rattus norvegicus
actgttctcttctactagcccgggc

SEQ ID NO: 508055 - DNA, 25 bp, Rattus norvegicus
cagacctccggactgttctcttcta

SEQ ID NO: 508056 - DNA, 25 bp, Rattus norvegicus
ccagtggtgtgacactggactgtcc

SEQ ID NO: 508057 - DNA, 25 bp, Rattus norvegicus
tactaagtgtgtgaagtcgaggcac

SEQ ID NO: 508058 - DNA, 25 bp, Rattus norvegicus
aggattcacgtgtgcaccagtggtg

SEQ ID NO: 508059 - DNA, 25 bp, Rattus norvegicus
ggactgtccgtgtgacgtgtcctgc

SEQ ID NO: 508060 - DNA, 25 bp, Rattus norvegicus
agctgtgcggacacccgtgttagtg

SEQ ID NO: 508061 - DNA, 25 bp, Rattus norvegicus
tagtggccggttttgtttgtgtgac

SEQ ID NO: 508062 - DNA, 25 bp, Rattus norvegicus
agcccgaagtgcgatgagtcagtct

SEQ ID NO: 508063 - DNA, 25 bp, Rattus norvegicus
atgagtcagtctccgcgagcctccg

SEQ ID NO: 508064 - DNA, 25 bp, Rattus norvegicus
gaccgctgagctaacgggcccagaa

SEQ ID NO: 508065 - DNA, 25 bp, Rattus norvegicus
agaagtcgcttgtttgcacggcagg

SEQ ID NO: 508066 - DNA, 25 bp, Rattus norvegicus
gttgcgtgagaggagcagccttccc

SEQ ID NO: 508067 - DNA, 25 bp, Rattus norvegicus
ttcaacaaggccgagagaagaagtc

SEQ ID NO: 508068 - DNA, 25 bp, Rattus norvegicus
gacaagcggcctttcttcaacaagg

SEQ ID NO: 508069 - DNA, 25 bp, Rattus norvegicus
tcgaggcacatgtgaaggattcacg

SEQ ID NO: 508070 - DNA, 25 bp, Rattus norvegicus
agactgcgagtgtgggatactggcc

SEQ ID NO: 508071 - DNA, 25 bp, Rattus norvegicus
agggcaaaagcaagcggtccgccga

SEQ ID NO: 508072 - DNA, 25 bp, Rattus norvegicus
tcaggagggcaaaagcaagcggtcc

SEQ ID NO: 508073 - DNA, 25 bp, Rattus norvegicus
gcaacgactcaggagggcaaaagca

SEQ ID NO: 508074 - DNA, 25 bp, Rattus norvegicus
cgctggcaacgactcaggagggcaa

SEQ ID NO: 508075 - DNA, 25 bp, Rattus norvegicus
gggtccctccgcataataccagggc

SEQ ID NO: 508076 - DNA, 25 bp, Rattus norvegicus
ctcgagatcccgcaaggctcgggaa

SEQ ID NO: 508077 - DNA, 25 bp, Rattus norvegicus
caagagactcgagatcccgcaaggc

SEQ ID NO: 508078 - DNA, 25 bp, Rattus norvegicus
tgcccacaagagactcgagatcccg

SEQ ID NO: 508079 - DNA, 25 bp, Rattus norvegicus
acccacccggagactgcgagtgtgg

SEQ ID NO: 508080 - DNA, 25 bp, Rattus norvegicus
gatactggccgtcggggtgcccaca

SEQ ID NO: 508081 - DNA, 25 bp, Rattus norvegicus
cgtacccacccggagactgcgagtg

SEQ ID NO: 508082 - DNA, 25 bp, Rattus norvegicus
caaaagcaagcggtccgccgagggt

SEQ ID NO: 508083 - DNA, 25 bp, Rattus norvegicus
ggggtgcccacaagagactcgagat

SEQ ID NO: 508084 - DNA, 25 bp, Rattus norvegicus
gtctaacctgtgcaaaccggctcgc

SEQ ID NO: 508085 - DNA, 25 bp, Rattus norvegicus
gcgcgccgcgtctaacctgtgcaaa

SEQ ID NO: 508086 - DNA, 25 bp, Rattus norvegicus
cagccggatccagatgcggccggaa

SEQ ID NO: 508087 - DNA, 25 bp, Rattus norvegicus
tggtcgcgccgagagtccctgaccg

SEQ ID NO: 508088 - DNA, 25 bp, Rattus norvegicus
tgctggcacgaggttgcagaacctc

SEQ ID NO: 508089 - DNA, 25 bp, Rattus norvegicus
aggttgcagaacctcccgcgcgagc

SEQ ID NO: 508090 - DNA, 25 bp, Rattus norvegicus
gcttcctctaggcaattcggccact

SEQ ID NO: 508091 - DNA, 25 bp, Rattus norvegicus
gccgcgtccacccattccaggcccg

SEQ ID NO: 508092 - DNA, 25 bp, Rattus norvegicus
cgcggaaccaattcgcgcgctctgg

SEQ ID NO: 508093 - DNA, 25 bp, Rattus norvegicus
gcgggacgcttcctctaggcaattc

SEQ ID NO: 508094 - DNA, 25 bp, Rattus norvegicus
agcgcgagcgctccgagtatcgtcc

SEQ ID NO: 508095 - DNA, 25 bp, Rattus norvegicus
ctccgagtatcgtccggcgagcgct

SEQ ID NO: 508096 - DNA, 25 bp, Rattus norvegicus
tccaggcccgctctcttcaccgcca

SEQ ID NO: 508097 - DNA, 25 bp, Rattus norvegicus
gtatcgtccggcgagcgctgctgct

SEQ ID NO: 508098 - DNA, 25 bp, Rattus norvegicus
aagctacggacaggcccagtcttgc

SEQ ID NO: 508099 - DNA, 25 bp, Rattus norvegicus
acaggaggacgagaagctacggaca

SEQ ID NO: 508100 - DNA, 25 bp, Rattus norvegicus
acaggcccagtcttgcggacccggg

SEQ ID NO: 508101 - DNA, 25 bp, Rattus norvegicus
gggcggaaggcccacgcgacaacca

SEQ ID NO: 508102 - DNA, 25 bp, Rattus norvegicus
caaccaccaccctgggtaggtcaga

SEQ ID NO: 508103 - DNA, 25 bp, Rattus norvegicus
ccaccctgggtaggtcagagtggct

SEQ ID NO: 508104 - DNA, 25 bp, Rattus norvegicus
gcagctcgctctggtactccgggag

SEQ ID NO: 508105 - DNA, 25 bp, Rattus norvegicus
gcgcggctactacggtccgggctca

SEQ ID NO: 508106 - DNA, 25 bp, Rattus norvegicus
aggacatggcgaacgaacccggctc

SEQ ID NO: 508107 - DNA, 25 bp, Rattus norvegicus
cccggctcggcgcttaccatggtga

SEQ ID NO: 508108 - DNA, 25 bp, Rattus norvegicus
cgcttaccatggtgaggccgcaggt

SEQ ID NO: 508109 - DNA, 25 bp, Rattus norvegicus
ggagctcgggctaccgcccagagaa

SEQ ID NO: 508110 - DNA, 25 bp, Rattus norvegicus
taccgcccagagaagcggagctctg

SEQ ID NO: 508111 - DNA, 25 bp, Rattus norvegicus
tccgcttcgcctcttgccaagatgg

SEQ ID NO: 508112 - DNA, 25 bp, Rattus norvegicus
gctggccgaacaagcgcaggtatcc

SEQ ID NO: 508113 - DNA, 25 bp, Rattus norvegicus
tgaaatcgtgccagcagcccgcgct

SEQ ID NO: 508114 - DNA, 25 bp, Rattus norvegicus
tgctcgaagtctctgcgggcatcgt

SEQ ID NO: 508115 - DNA, 25 bp, Rattus norvegicus
gcagcaccaactggcgccgtgcgaa

SEQ ID NO: 508116 - DNA, 25 bp, Rattus norvegicus
cggcgtacggattgagcagcaccaa

SEQ ID NO: 508117 - DNA, 25 bp, Rattus norvegicus
catgcgattgcacagcgcggcgtac

SEQ ID NO: 508118 - DNA, 25 bp, Rattus norvegicus
catcatgtcggccagcatgcgattg

SEQ ID NO: 508119 - DNA, 25 bp, Rattus norvegicus
tcatcatctagcgagccgcgctcag

SEQ ID NO: 508120 - DNA, 25 bp, Rattus norvegicus
cagtcagagcgtcccggaagtttta

SEQ ID NO: 508121 - DNA, 25 bp, Rattus norvegicus
cccaccgtgagactagtaagtaagc

SEQ ID NO: 508122 - DNA, 25 bp, Rattus norvegicus
ggcaggaccaatcgctggccgaaca

SEQ ID NO: 508123 - DNA, 25 bp, Rattus norvegicus
tcgtcgtcccgaccctgaaatcgtg

SEQ ID NO: 508124 - DNA, 25 bp, Rattus norvegicus
ggcggacacagagcagacgcagtca

SEQ ID NO: 508125 - DNA, 25 bp, Rattus norvegicus
tccaagtcctctagggcgcctgagg

SEQ ID NO: 508126 - DNA, 25 bp, Rattus norvegicus
gccctaggcagccagggacaggcca

SEQ ID NO: 508127 - DNA, 25 bp, Rattus norvegicus
gtgaggccgggcaaaaaccacacga

SEQ ID NO: 508128 - DNA, 25 bp, Rattus norvegicus
ggcaaaaaccacacgaccacactta

SEQ ID NO: 508129 - DNA, 25 bp, Rattus norvegicus
caggcccggttagggcccaacagct

SEQ ID NO: 508130 - DNA, 25 bp, Rattus norvegicus
agcttgtgcgccctaggcagccagg

SEQ ID NO: 508131 - DNA, 25 bp, Rattus norvegicus
cttcctagatctcccggcacggtaa

SEQ ID NO: 508132 - DNA, 25 bp, Rattus norvegicus
gactggggctttgcagttgcctcct

SEQ ID NO: 508133 - DNA, 25 bp, Rattus norvegicus
ttggtgccgcagcacactccttccc

SEQ ID NO: 508134 - DNA, 25 bp, Rattus norvegicus
accatcgacggtgccttgtccgcga

SEQ ID NO: 508135 - DNA, 25 bp, Rattus norvegicus
gccttgtccgcgaggttacggatga

SEQ ID NO: 508136 - DNA, 25 bp, Rattus norvegicus
cgcgaggttacggatgaacttggcc

SEQ ID NO: 508137 - DNA, 25 bp, Rattus norvegicus
acggatgaacttggccatggtctaa

SEQ ID NO: 508138 - DNA, 25 bp, Rattus norvegicus
catggtctaaggtggaaggttcgtc

SEQ ID NO: 508139 - DNA, 25 bp, Rattus norvegicus
gttagggcccaacagcttgtgcgcc

SEQ ID NO: 508140 - DNA, 25 bp, Rattus norvegicus
gccgtaaagagggtgtgtaagtgtc

SEQ ID NO: 508141 - DNA, 25 bp, Rattus norvegicus
ctttccactgctgagcatcctagtc

SEQ ID NO: 508142 - DNA, 25 bp, Rattus norvegicus
caggaaagatggtcgcttttccggt

SEQ ID NO: 508143 - DNA, 25 bp, Rattus norvegicus
aggtcaggaaagatggtcgcttttc

SEQ ID NO: 508144 - DNA, 25 bp, Rattus norvegicus
agctggctgggctccacttccggcc

SEQ ID NO: 508145 - DNA, 25 bp, Rattus norvegicus
gtgtgtaagtgtcggaagagctgtc

SEQ ID NO: 508146 - DNA, 25 bp, Rattus norvegicus
catcctagtcgtccagggtgagtgc

SEQ ID NO: 508147 - DNA, 25 bp, Rattus norvegicus
cactgctgagcatcctagtcgtcca

SEQ ID NO: 508148 - DNA, 25 bp, Rattus norvegicus
tgagcatcctagtcgtccagggtga

SEQ ID NO: 508149 - DNA, 25 bp, Rattus norvegicus
ggcaagaggagcagtaggaggccgt

SEQ ID NO: 508150 - DNA, 25 bp, Rattus norvegicus
ggcaccacctgcatggtcccgggga

SEQ ID NO: 508151 - DNA, 25 bp, Rattus norvegicus
agctgtcgggatgcagcaggcaaga

SEQ ID NO: 508152 - DNA, 25 bp, Rattus norvegicus
gaggccgtggctgcgctctctttcc

SEQ ID NO: 508153 - DNA, 25 bp, Rattus norvegicus
cacctgcatggtcccggggagccgt

SEQ ID NO: 508154 - DNA, 25 bp, Rattus norvegicus
ccgccacagtgagtagcagggcata

SEQ ID NO: 508155 - DNA, 25 bp, Rattus norvegicus
tgagcttctgaaggcactgcgtcga

SEQ ID NO: 508156 - DNA, 25 bp, Rattus norvegicus
tcgcaatggttcgtgagtgagcttc

SEQ ID NO: 508157 - DNA, 25 bp, Rattus norvegicus
tttctgggagttaagggtcgcaatg

SEQ ID NO: 508158 - DNA, 25 bp, Rattus norvegicus
gcttccggttttgcgcagagatttc

SEQ ID NO: 508159 - DNA, 25 bp, Rattus norvegicus
tcccaggtgtagagactggaagttc

SEQ ID NO: 508160 - DNA, 25 bp, Rattus norvegicus
ttgcttccgggtcttagttgagtcc

SEQ ID NO: 508161 - DNA, 25 bp, Rattus norvegicus
ggtcactgggtcagcctctaaaaga

SEQ ID NO: 508162 - DNA, 25 bp, Rattus norvegicus
cgcgtcttctacacagccgttggga

SEQ ID NO: 508163 - DNA, 25 bp, Rattus norvegicus
ggtcgactatgaagcaccggtttca

SEQ ID NO: 508164 - DNA, 25 bp, Rattus norvegicus
taggcgacgtcactccatctttttc

SEQ ID NO: 508165 - DNA, 25 bp, Rattus norvegicus
ctcgcagaaccgcagcgaaagagtc

SEQ ID NO: 508166 - DNA, 25 bp, Rattus norvegicus
agtcggagagccgtgactatcgtcc

SEQ ID NO: 508167 - DNA, 25 bp, Rattus norvegicus
cgttgggagcgcgaagattttgctt

SEQ ID NO: 508168 - DNA, 25 bp, Rattus norvegicus
gctccggagagaacaggaccatgtc

SEQ ID NO: 508169 - DNA, 25 bp, Rattus norvegicus
tgtaccggtcgtccgcagcaggcaa

SEQ ID NO: 508170 - DNA, 25 bp, Rattus norvegicus
cgggctgtgcacactgtcctatcca

SEQ ID NO: 508171 - DNA, 25 bp, Rattus norvegicus
gctctctagccgctaactttccgga

SEQ ID NO: 508172 - DNA, 25 bp, Rattus norvegicus
cttccagagcagaggcgcatcgcag

SEQ ID NO: 508173 - DNA, 25 bp, Rattus norvegicus
tccagcggctggagcgcttccagag

SEQ ID NO: 508174 - DNA, 25 bp, Rattus norvegicus
actgtgcgaaacctgcggggacgcc

SEQ ID NO: 508175 - DNA, 25 bp, Rattus norvegicus
gcgcgacgggcactgtgcgaaacct

SEQ ID NO: 508176 - DNA, 25 bp, Rattus norvegicus
caggctggaccctacggtcctgatc

SEQ ID NO: 508177 - DNA, 25 bp, Rattus norvegicus
tctcctaattggcagctcggcttgg

SEQ ID NO: 508178 - DNA, 25 bp, Rattus norvegicus
cccgtgaactcttctcctaattggc

SEQ ID NO: 508179 - DNA, 25 bp, Rattus norvegicus
ctctgagccgaacaaaacagccttc

SEQ ID NO: 508180 - DNA, 25 bp, Rattus norvegicus
gcccttccttactcgtgttctctga

SEQ ID NO: 508181 - DNA, 25 bp, Rattus norvegicus
gctgggaaccgaggcaatactcagg

SEQ ID NO: 508182 - DNA, 25 bp, Rattus norvegicus
ccagctagacttccacgtgagggcg

SEQ ID NO: 508183 - DNA, 25 bp, Rattus norvegicus
atcctaccgtgtgcgcggaagccca

SEQ ID NO: 508184 - DNA, 25 bp, Rattus norvegicus
aggctcaggctggagatcgagacga

SEQ ID NO: 508185 - DNA, 25 bp, Rattus norvegicus
atcgagacgaggaatgggagtaaac

SEQ ID NO: 508186 - DNA, 25 bp, Rattus norvegicus
aatgggagtaaacgcggcaacatcc

SEQ ID NO: 508187 - DNA, 25 bp, Rattus norvegicus
aacgcggcaacatcctgggcgcaca

SEQ ID NO: 508188 - DNA, 25 bp, Rattus norvegicus
gcgcacagcggcatcgtccactgga

SEQ ID NO: 508189 - DNA, 25 bp, Rattus norvegicus
catcgtccactggagccggccttta

SEQ ID NO: 508190 - DNA, 25 bp, Rattus norvegicus
ctggagccggcctttaggcctccgg

SEQ ID NO: 508191 - DNA, 25 bp, Rattus norvegicus
ccgcgtccggggaattgaagactgc

SEQ ID NO: 508192 - DNA, 25 bp, Rattus norvegicus
tccggggaattgaagactgccgcta

SEQ ID NO: 508193 - DNA, 25 bp, Rattus norvegicus
tgaagactgccgctagattcgccgg

SEQ ID NO: 508194 - DNA, 25 bp, Rattus norvegicus
attcgccgggccagctagacttcca

SEQ ID NO: 508195 - DNA, 25 bp, Rattus norvegicus
ggcctcgacacgctccgccctcagc

SEQ ID NO: 508196 - DNA, 25 bp, Rattus norvegicus
ctgttgcttcttcaagcctcacttc

SEQ ID NO: 508197 - DNA, 25 bp, Rattus norvegicus
gcgggaaaactgcaagccgcgccca

SEQ ID NO: 508198 - DNA, 25 bp, Rattus norvegicus
acccagaagccagtggacgcgggcc

SEQ ID NO: 508199 - DNA, 25 bp, Rattus norvegicus
cagcggtctgcgaggggacccagaa

SEQ ID NO: 508200 - DNA, 25 bp, Rattus norvegicus
caggcgacagcacagcggtctgcga

SEQ ID NO: 508201 - DNA, 25 bp, Rattus norvegicus
cgcaggcgacagcacagcggtctgc

SEQ ID NO: 508202 - DNA, 25 bp, Rattus norvegicus
aagagctcaccgagaggagggcgca

SEQ ID NO: 508203 - DNA, 25 bp, Rattus norvegicus
ctttgcgaagagctcaccgagagga

SEQ ID NO: 508204 - DNA, 25 bp, Rattus norvegicus
ttccctttgcgaagagctcaccgag

SEQ ID NO: 508205 - DNA, 25 bp, Rattus norvegicus
cgcgcgtctcctgttgcttcttcaa

SEQ ID NO: 508206 - DNA, 25 bp, Rattus norvegicus
caagcctcacttccctttgcgaaga

SEQ ID NO: 508207 - DNA, 25 bp, Rattus norvegicus
cgcgtctcctgttgcttcttcaagc

SEQ ID NO: 508208 - DNA, 25 bp, Rattus norvegicus
ccagaagccagtggacgcgggccac

SEQ ID NO: 508209 - DNA, 25 bp, Rattus norvegicus
ctcacttccctttgcgaagagctca

SEQ ID NO: 508210 - DNA, 25 bp, Rattus norvegicus
aagagtcgccctcatctatgtctca

SEQ ID NO: 508211 - DNA, 25 bp, Rattus norvegicus
tctgctggacctagggacaagtgtt

SEQ ID NO: 508212 - DNA, 25 bp, Rattus norvegicus
cctctttatggcatgtggctggtaa

SEQ ID NO: 508213 - DNA, 25 bp, Rattus norvegicus
tggtaactttcctcctgctcctgga

SEQ ID NO: 508214 - DNA, 25 bp, Rattus norvegicus
tgctcctggactctttacacaaagg

SEQ ID NO: 508215 - DNA, 25 bp, Rattus norvegicus
tacacaaaggtgagacccgcgctgc

SEQ ID NO: 508216 - DNA, 25 bp, Rattus norvegicus
tgagaatcagcctgggaccgcttgc

SEQ ID NO: 508217 - DNA, 25 bp, Rattus norvegicus
tgccctgtaagccaggtggtcctcg

SEQ ID NO: 508218 - DNA, 25 bp, Rattus norvegicus
tccgggagccctcagtatttgggtc

SEQ ID NO: 508219 - DNA, 25 bp, Rattus norvegicus
tgggtcctcggacctaggaaagatc

SEQ ID NO: 508220 - DNA, 25 bp, Rattus norvegicus
ggaaagatcactcctaccgtagctt

SEQ ID NO: 508221 - DNA, 25 bp, Rattus norvegicus
atgtccagacctgctcctggggttc

SEQ ID NO: 508222 - DNA, 25 bp, Rattus norvegicus
ttgttcttcagacccaagagtcgcc

SEQ ID NO: 508223 - DNA, 25 bp, Rattus norvegicus
ttccgagcacctgacctgagaggca

SEQ ID NO: 508224 - DNA, 25 bp, Rattus norvegicus
atgccaacgggactctgcagctcta

SEQ ID NO: 508225 - DNA, 25 bp, Rattus norvegicus
gctcttcgatggtacctggccacgg

SEQ ID NO: 508226 - DNA, 25 bp, Rattus norvegicus
gggacgacatctacgatgtgccaca

SEQ ID NO: 508227 - DNA, 25 bp, Rattus norvegicus
atgtgccacacatccggcacgtgca

SEQ ID NO: 508228 - DNA, 25 bp, Rattus norvegicus
atccggcacgtgcatgccaacggga

SEQ ID NO: 508229 - DNA, 25 bp, Rattus norvegicus
cacgtgcatgccaacgggactctgc

SEQ ID NO: 508230 - DNA, 25 bp, Rattus norvegicus
gggactctgcagctctaccctttct

SEQ ID NO: 508231 - DNA, 25 bp, Rattus norvegicus
gctttatccacgacaatgactattt

SEQ ID NO: 508232 - DNA, 25 bp, Rattus norvegicus
acaatgactatttctgcaccgcaga

SEQ ID NO: 508233 - DNA, 25 bp, Rattus norvegicus
tgcaccgcagagaacgcagccggca

SEQ ID NO: 508234 - DNA, 25 bp, Rattus norvegicus
gcagccggcaagatccggagcccta

SEQ ID NO: 508235 - DNA, 25 bp, Rattus norvegicus
gcaagatccggagccctaacattcg

SEQ ID NO: 508236 - DNA, 25 bp, Rattus norvegicus
ccagtgcggctcttcgatggtacct

SEQ ID NO: 508237 - DNA, 25 bp, Rattus norvegicus
tccgccttcaatagctttatccacg

SEQ ID NO: 508238 - DNA, 25 bp, Rattus norvegicus
atttctctcagcctcagaagagccc

SEQ ID NO: 508239 - DNA, 25 bp, Rattus norvegicus
ccagacgtagggaaacgaatacttg

SEQ ID NO: 508240 - DNA, 25 bp, Rattus norvegicus
caacacttcggacgcgctgccgtta

SEQ ID NO: 508241 - DNA, 25 bp, Rattus norvegicus
ccgcctcatagtctttttggtacta

SEQ ID NO: 508242 - DNA, 25 bp, Rattus norvegicus
gacctagcgccctgggcgtgcgcaa

SEQ ID NO: 508243 - DNA, 25 bp, Rattus norvegicus
gacgcgctgccgttactgtttttgc

SEQ ID NO: 508244 - DNA, 25 bp, Rattus norvegicus
cgctgccgttactgtttttgctttt

SEQ ID NO: 508245 - DNA, 25 bp, Rattus norvegicus
ccacagtggactcatcaggtccgca

SEQ ID NO: 508246 - DNA, 25 bp, Rattus norvegicus
tgggcgtgcgcaacagactccgcgc

SEQ ID NO: 508247 - DNA, 25 bp, Rattus norvegicus
tcagcctcagaagagcccagacgta

SEQ ID NO: 508248 - DNA, 25 bp, Rattus norvegicus
tcacctggcccggtcgagatccaga

SEQ ID NO: 508249 - DNA, 25 bp, Rattus norvegicus
gtcgagatccagacctgaccatttc

SEQ ID NO: 508250 - DNA, 25 bp, Rattus norvegicus
gatccagacctgaccatttctctca

SEQ ID NO: 508251 - DNA, 25 bp, Rattus norvegicus
gtggactcatcaggtccgcagccct

SEQ ID NO: 508252 - DNA, 25 bp, Rattus norvegicus
tcctcggcacagaagagccactcgg

SEQ ID NO: 508253 - DNA, 25 bp, Rattus norvegicus
tgaaactctgcttatctcctcggca

SEQ ID NO: 508254 - DNA, 25 bp, Rattus norvegicus
gagcacggttatcctgtcctgcgcc

SEQ ID NO: 508255 - DNA, 25 bp, Rattus norvegicus
ggagttcaccatccgctggtaccgc

SEQ ID NO: 508256 - DNA, 25 bp, Rattus norvegicus
ctggtaccgcaacacagaactggtg

SEQ ID NO: 508257 - DNA, 25 bp, Rattus norvegicus
accgcaacacagaactggtgctgcc

SEQ ID NO: 508258 - DNA, 25 bp, Rattus norvegicus
tgctgcccggtgaggccatctccat

SEQ ID NO: 508259 - DNA, 25 bp, Rattus norvegicus
tccatccgcgggcttagcaatgaaa

SEQ ID NO: 508260 - DNA, 25 bp, Rattus norvegicus
ccgcgggcttagcaatgaaactctg

SEQ ID NO: 508261 - DNA, 25 bp, Rattus norvegicus
ttgccatcatcgtgctggaaggtga

SEQ ID NO: 508262 - DNA, 25 bp, Rattus norvegicus
acagcgcaggactttgccatcatcg

SEQ ID NO: 508263 - DNA, 25 bp, Rattus norvegicus
acccgaaaggcccagacagcgcagg

SEQ ID NO: 508264 - DNA, 25 bp, Rattus norvegicus
gcatcgggagcacggttatcctgtc

SEQ ID NO: 508265 - DNA, 25 bp, Rattus norvegicus
taccagtgcttcgccacccgaaagg

SEQ ID NO: 508266 - DNA, 25 bp, Rattus norvegicus
cagttctcattgatgtgtgccgcca

SEQ ID NO: 508267 - DNA, 25 bp, Rattus norvegicus
gccctggacgacgagcctgtcgtgc

SEQ ID NO: 508268 - DNA, 25 bp, Rattus norvegicus
cctgtcgtgcgggatggaagccacc

SEQ ID NO: 508269 - DNA, 25 bp, Rattus norvegicus
tgcgggatggaagccaccgcaccaa

SEQ ID NO: 508270 - DNA, 25 bp, Rattus norvegicus
aaccagtacaccatgtccgacggca

SEQ ID NO: 508271 - DNA, 25 bp, Rattus norvegicus
atcagccacatgaacgtcacgggtc

SEQ ID NO: 508272 - DNA, 25 bp, Rattus norvegicus
gtcacctgggccctggacgacgagc

SEQ ID NO: 508273 - DNA, 25 bp, Rattus norvegicus
tgtaccggtgcacagcgcggaactc

SEQ ID NO: 508274 - DNA, 25 bp, Rattus norvegicus
actcggtgggcagtgctgaatatca

SEQ ID NO: 508275 - DNA, 25 bp, Rattus norvegicus
cccggggagcagttctcattgatgt

SEQ ID NO: 508276 - DNA, 25 bp, Rattus norvegicus
ccttcagcgagaaggtggtcaaccc

SEQ ID NO: 508277 - DNA, 25 bp, Rattus norvegicus
cgcatcgtctcatccttcagcgaga

SEQ ID NO: 508278 - DNA, 25 bp, Rattus norvegicus
tgctgaatatcaggcgcgaataaac

SEQ ID NO: 508279 - DNA, 25 bp, Rattus norvegicus
ctcattgatgtgtgccgccaagggc

SEQ ID NO: 508280 - DNA, 25 bp, Rattus norvegicus
ttttctgggacgatggctctgcgcc

SEQ ID NO: 508281 - DNA, 25 bp, Rattus norvegicus
gcgcacgccggagggctctcctctc

SEQ ID NO: 508282 - DNA, 25 bp, Rattus norvegicus
ttcccgcgcagcaacacctcacagc

SEQ ID NO: 508283 - DNA, 25 bp, Rattus norvegicus
gcgcagcaacacctcacagctcttc

SEQ ID NO: 508284 - DNA, 25 bp, Rattus norvegicus
tcacagctcttcagctccctgcaaa

SEQ ID NO: 508285 - DNA, 25 bp, Rattus norvegicus
ttcagctccctgcaaactcctgcca

SEQ ID NO: 508286 - DNA, 25 bp, Rattus norvegicus
agctccctgcaaactcctgccacgc

SEQ ID NO: 508287 - DNA, 25 bp, Rattus norvegicus
tggctccgaggagatctcacctgtc

SEQ ID NO: 508288 - DNA, 25 bp, Rattus norvegicus
tgggacgatggctctgcgccgcctc

SEQ ID NO: 508289 - DNA, 25 bp, Rattus norvegicus
ggctccgaggagatctcacctgtcc

SEQ ID NO: 508290 - DNA, 25 bp, Rattus norvegicus
gttttctgggacgatggctctgcgc

SEQ ID NO: 508291 - DNA, 25 bp, Rattus norvegicus
ttctgggacgatggctctgcgccgc

SEQ ID NO: 508292 - DNA, 25 bp, Rattus norvegicus
tcagttcccgcgcagcaacacctca

SEQ ID NO: 508293 - DNA, 25 bp, Rattus norvegicus
cgatccggggttttctgggacgatg

SEQ ID NO: 508294 - DNA, 25 bp, Rattus norvegicus
cacgctgcaaagtccgcctggaaga

SEQ ID NO: 508295 - DNA, 25 bp, Rattus norvegicus
gggagtccctcacgctgcaaagtcc

SEQ ID NO: 508296 - DNA, 25 bp, Rattus norvegicus
tgcaaagtccgcctggaagaccctg

SEQ ID NO: 508297 - DNA, 25 bp, Rattus norvegicus
tggaagaccctgaaagctgcaggct

SEQ ID NO: 508298 - DNA, 25 bp, Rattus norvegicus
accctgaaagctgcaggctccgata

SEQ ID NO: 508299 - DNA, 25 bp, Rattus norvegicus
aagctgcaggctccgatagccatgc

SEQ ID NO: 508300 - DNA, 25 bp, Rattus norvegicus
ctggcggtcgccgtccagatgtagc

SEQ ID NO: 508301 - DNA, 25 bp, Rattus norvegicus
cccggatcgccatcgtcctcttctc

SEQ ID NO: 508302 - DNA, 25 bp, Rattus norvegicus
gtcctcttctctcgtgcgctacaga

SEQ ID NO: 508303 - DNA, 25 bp, Rattus norvegicus
tctcgtgcgctacagatttctcctg

SEQ ID NO: 508304 - DNA, 25 bp, Rattus norvegicus
gtgcgctacagatttctcctgccca

SEQ ID NO: 508305 - DNA, 25 bp, Rattus norvegicus
ctccaccgccgggagcaggaactga

SEQ ID NO: 508306 - DNA, 25 bp, Rattus norvegicus
cgccgtccagatgtagctgggtccc

SEQ ID NO: 508307 - DNA, 25 bp, Rattus norvegicus
agctgggagtccctcacgctgcaaa

SEQ ID NO: 508308 - DNA, 25 bp, Rattus norvegicus
gtcaccagccagacagcgacgcaga

SEQ ID NO: 508309 - DNA, 25 bp, Rattus norvegicus
ggtcatacgtttaactccgcagcta

SEQ ID NO: 508310 - DNA, 25 bp, Rattus norvegicus
ggtcaccgccactcttcactggaag

SEQ ID NO: 508311 - DNA, 25 bp, Rattus norvegicus
tccgcagctagagagcaaagcgaga

SEQ ID NO: 508312 - DNA, 25 bp, Rattus norvegicus
ggtcgcacatctggctggagagtcc

SEQ ID NO: 508313 - DNA, 25 bp, Rattus norvegicus
acatctggctggagagtcccgttta

SEQ ID NO: 508314 - DNA, 25 bp, Rattus norvegicus
tggctggagagtcccgtttacccaa

SEQ ID NO: 508315 - DNA, 25 bp, Rattus norvegicus
ttacccaagggaatcccgcaatcca

SEQ ID NO: 508316 - DNA, 25 bp, Rattus norvegicus
tccagtgatggtcaccagccagaca

SEQ ID NO: 508317 - DNA, 25 bp, Rattus norvegicus
agacagcgacgcagaaggggacaat

SEQ ID NO: 508318 - DNA, 25 bp, Rattus norvegicus
ttcactggaagctaccgctacgctg

SEQ ID NO: 508319 - DNA, 25 bp, Rattus norvegicus
gcaagggtcatacgtttaactccgc

SEQ ID NO: 508320 - DNA, 25 bp, Rattus norvegicus
agggaatcccgcaatccagtgatgg

SEQ ID NO: 508321 - DNA, 25 bp, Rattus norvegicus
cgtttaactccgcagctagagagca

SEQ ID NO: 508322 - DNA, 25 bp, Rattus norvegicus
atctctcacgggacactcagaggcc

SEQ ID NO: 508323 - DNA, 25 bp, Rattus norvegicus
tctccggcgcgctatcccggagggt

SEQ ID NO: 508324 - DNA, 25 bp, Rattus norvegicus
tgcgctcaggaagcagagagatgcc

SEQ ID NO: 508325 - DNA, 25 bp, Rattus norvegicus
cgactttgccctccgcatggggcga

SEQ ID NO: 508326 - DNA, 25 bp, Rattus norvegicus
tcaacactggctcgcaaggtccgcg

SEQ ID NO: 508327 - DNA, 25 bp, Rattus norvegicus
gctggttacctctcaacactggctc

SEQ ID NO: 508328 - DNA, 25 bp, Rattus norvegicus
cccagcttgagctggttacctctca

SEQ ID NO: 508329 - DNA, 25 bp, Rattus norvegicus
cagagctgatgtcagcctgggctcc

SEQ ID NO: 508330 - DNA, 25 bp, Rattus norvegicus
ttctggatctctcacgggacactca

SEQ ID NO: 508331 - DNA, 25 bp, Rattus norvegicus
tgtcttgttgaaccttctggatctc

SEQ ID NO: 508332 - DNA, 25 bp, Rattus norvegicus
ggcacggaatcggattctgattttt

SEQ ID NO: 508333 - DNA, 25 bp, Rattus norvegicus
cacgggaaagaccagtcgggcgtca

SEQ ID NO: 508334 - DNA, 25 bp, Rattus norvegicus
cgggatccgccagctacacgggaaa

SEQ ID NO: 508335 - DNA, 25 bp, Rattus norvegicus
gcggaaacctctcggcccagtcgga

SEQ ID NO: 508336 - DNA, 25 bp, Rattus norvegicus
ggaaagagtcaaggctatggcagtc

SEQ ID NO: 508337 - DNA, 25 bp, Rattus norvegicus
acgccatgaaggacgagggccctct

SEQ ID NO: 508338 - DNA, 25 bp, Rattus norvegicus
aaaccgagatggtccttacagagga

SEQ ID NO: 508339 - DNA, 25 bp, Rattus norvegicus
atgttgctgtcagtggcgcctccgg

SEQ ID NO: 508340 - DNA, 25 bp, Rattus norvegicus
cccggcggaagtgatgttgctgtca

SEQ ID NO: 508341 - DNA, 25 bp, Rattus norvegicus
cgctggtcaagaggccgcaggccca

SEQ ID NO: 508342 - DNA, 25 bp, Rattus norvegicus
tcctgtggcggacgacacgaggact

SEQ ID NO: 508343 - DNA, 25 bp, Rattus norvegicus
tggtccttacagaggacgccatgaa

SEQ ID NO: 508344 - DNA, 25 bp, Rattus norvegicus
aggctatggcagtccgacggagaaa

SEQ ID NO: 508345 - DNA, 25 bp, Rattus norvegicus
cctctctgaggagtttatggggaaa

SEQ ID NO: 508346 - DNA, 25 bp, Rattus norvegicus
cgggagcctctctgaggagtttatg

SEQ ID NO: 508347 - DNA, 25 bp, Rattus norvegicus
tttggagattgaaaccgagatggtc

SEQ ID NO: 508348 - DNA, 25 bp, Rattus norvegicus
gcagtccgacggagaaaagccgcga

SEQ ID NO: 508349 - DNA, 25 bp, Rattus norvegicus
agctctgcccgctggtcaagaggcc

SEQ ID NO: 508350 - DNA, 25 bp, Rattus norvegicus
gcggccaccaggagcacgcacaagg

SEQ ID NO: 508351 - DNA, 25 bp, Rattus norvegicus
tctttctgcgagacgttcttgggcc

SEQ ID NO: 508352 - DNA, 25 bp, Rattus norvegicus
caggctcacccggttgcgggtcacg

SEQ ID NO: 508353 - DNA, 25 bp, Rattus norvegicus
tgactagctcgctgttgacgtcgtc

SEQ ID NO: 508354 - DNA, 25 bp, Rattus norvegicus
acgtcgtccgcgtaggtgcgctcaa

SEQ ID NO: 508355 - DNA, 25 bp, Rattus norvegicus
ggtgcgctcaaactccgcgtctttc

SEQ ID NO: 508356 - DNA, 25 bp, Rattus norvegicus
agcagcttccagcatctcaccggga

SEQ ID NO: 508357 - DNA, 25 bp, Rattus norvegicus
tccttccttcgcagtcctgtgggcg

SEQ ID NO: 508358 - DNA, 25 bp, Rattus norvegicus
cacaagggcagacgccaggcgatca

SEQ ID NO: 508359 - DNA, 25 bp, Rattus norvegicus
gcatctcaccgggaccagaacttta

SEQ ID NO: 508360 - DNA, 25 bp, Rattus norvegicus
gcccgctgacgtcatgggaaaccga

SEQ ID NO: 508361 - DNA, 25 bp, Rattus norvegicus
cgtcatgggaaaccgacgcggattt

SEQ ID NO: 508362 - DNA, 25 bp, Rattus norvegicus
cgcggatttaaagggccagacctcg

SEQ ID NO: 508363 - DNA, 25 bp, Rattus norvegicus
gggccagacctcgtctaactgcttc

SEQ ID NO: 508364 - DNA, 25 bp, Rattus norvegicus
gcaccaaccagcagcgcctccactt

SEQ ID NO: 508365 - DNA, 25 bp, Rattus norvegicus
atagctgccgggtgggtgcacctca

SEQ ID NO: 508366 - DNA, 25 bp, Rattus norvegicus
gaagtcccgccttttgctgcgggga

SEQ ID NO: 508367 - DNA, 25 bp, Rattus norvegicus
ggcaaatggcttccggaagtcccgc

SEQ ID NO: 508368 - DNA, 25 bp, Rattus norvegicus
tgccactccggcaaatggcttccgg

SEQ ID NO: 508369 - DNA, 25 bp, Rattus norvegicus
cagagggtccgtacgggccctcagc

SEQ ID NO: 508370 - DNA, 25 bp, Rattus norvegicus
ccgccttttgctgcggggatagctg

SEQ ID NO: 508371 - DNA, 25 bp, Rattus norvegicus
tcacaataccgtcttgcccgcgtgt

SEQ ID NO: 508372 - DNA, 25 bp, Rattus norvegicus
ggagccgggcctcacaataccgtct

SEQ ID NO: 508373 - DNA, 25 bp, Rattus norvegicus
tcagtcgctcgcttgatcccgacgg

SEQ ID NO: 508374 - DNA, 25 bp, Rattus norvegicus
ggttacgcttcagtcgctcgcttga

SEQ ID NO: 508375 - DNA, 25 bp, Rattus norvegicus
gcgtcggctggttacgcttcagtcg

SEQ ID NO: 508376 - DNA, 25 bp, Rattus norvegicus
ggtgggtgcacctcactttccctcg

SEQ ID NO: 508377 - DNA, 25 bp, Rattus norvegicus
tgtcccacccgcgacgccgaagccc

SEQ ID NO: 508378 - DNA, 25 bp, Rattus norvegicus
ccggaggtttcactgcacaacaaga

SEQ ID NO: 508379 - DNA, 25 bp, Rattus norvegicus
tggaaaggaggcgttggaactctca

SEQ ID NO: 508380 - DNA, 25 bp, Rattus norvegicus
ttagcagctggacaccgaagaggtc

SEQ ID NO: 508381 - DNA, 25 bp, Rattus norvegicus
cctcgtcaccaaggccaaggtagtg

SEQ ID NO: 508382 - DNA, 25 bp, Rattus norvegicus
aacttcgctgtggtcaagcgggcca

SEQ ID NO: 508383 - DNA, 25 bp, Rattus norvegicus
tcgaccgcaccatcggcaagggcaa

SEQ ID NO: 508384 - DNA, 25 bp, Rattus norvegicus
tggccgctcgcatcggctactacga

SEQ ID NO: 508385 - DNA, 25 bp, Rattus norvegicus
ctctcggagtgacgtctgtcggcaa

SEQ ID NO: 508386 - DNA, 25 bp, Rattus norvegicus
ttgccatggcttcgggcagtgacgc

SEQ ID NO: 508387 - DNA, 25 bp, Rattus norvegicus
ggcgcctcaggaacagggacccacg

SEQ ID NO: 508388 - DNA, 25 bp, Rattus norvegicus
tgaccctcgacgttttcactgcctg

SEQ ID NO: 508389 - DNA, 25 bp, Rattus norvegicus
cttagaagttgctgctgaccctcga

SEQ ID NO: 508390 - DNA, 25 bp, Rattus norvegicus
taggcacggcggaagcttagaagtt

SEQ ID NO: 508391 - DNA, 25 bp, Rattus norvegicus
ggctactacgagatcgaccgcacca

SEQ ID NO: 508392 - DNA, 25 bp, Rattus norvegicus
agcgtccctgcagctccgcacagcc

SEQ ID NO: 508393 - DNA, 25 bp, Rattus norvegicus
agcccgagagctcgcgagccagcca

SEQ ID NO: 508394 - DNA, 25 bp, Rattus norvegicus
gatcactttgcagagcgccgcttca

SEQ ID NO: 508395 - DNA, 25 bp, Rattus norvegicus
gctgaacaatagagacgggcagacg

SEQ ID NO: 508396 - DNA, 25 bp, Rattus norvegicus
cgccgactcggacgtggacgccttt

SEQ ID NO: 508397 - DNA, 25 bp, Rattus norvegicus
ggccgcctcggacgcgatgtcttcg

SEQ ID NO: 508398 - DNA, 25 bp, Rattus norvegicus
gagttgcggaggttcacgttgttct

SEQ ID NO: 508399 - DNA, 25 bp, Rattus norvegicus
cgcacagcccgggtcattgttggcc

SEQ ID NO: 508400 - DNA, 25 bp, Rattus norvegicus
tcacgttgttctggcggtgctggca

SEQ ID NO: 508401 - DNA, 25 bp, Rattus norvegicus
ttcacccctgttgcgggagtctgtg

SEQ ID NO: 508402 - DNA, 25 bp, Rattus norvegicus
cccttgggccgccttctctgggaga

SEQ ID NO: 508403 - DNA, 25 bp, Rattus norvegicus
tctctgggagatgttggatcacttt

SEQ ID NO: 508404 - DNA, 25 bp, Rattus norvegicus
atgttggatcactttgcagagcgcc

SEQ ID NO: 508405 - DNA, 25 bp, Rattus norvegicus
tcttcggacaagtttggggaccgca

SEQ ID NO: 508406 - DNA, 25 bp, Rattus norvegicus
tcagacaccggacctttgttccggc

SEQ ID NO: 508407 - DNA, 25 bp, Rattus norvegicus
agcgcgtggggtaatgtcggccagc

SEQ ID NO: 508408 - DNA, 25 bp, Rattus norvegicus
agggtctgcggcctctttaagaagg

SEQ ID NO: 508409 - DNA, 25 bp, Rattus norvegicus
tgcgttatcagacaccggacctttg

SEQ ID NO: 508410 - DNA, 25 bp, Rattus norvegicus
cgttatcagacaccggacctttgtt

SEQ ID NO: 508411 - DNA, 25 bp, Rattus norvegicus
accgcggctgcgttatcagacaccg

SEQ ID NO: 508412 - DNA, 25 bp, Rattus norvegicus
ttcactcgagtagcgcgtggggtaa

SEQ ID NO: 508413 - DNA, 25 bp, Rattus norvegicus
agctttcactcgagtagcgcgtggg

SEQ ID NO: 508414 - DNA, 25 bp, Rattus norvegicus
gaagctttcactcgagtagcgcgtg

SEQ ID NO: 508415 - DNA, 25 bp, Rattus norvegicus
ccggaagctttcactcgagtagcgc

SEQ ID NO: 508416 - DNA, 25 bp, Rattus norvegicus
gaagccggaagctttcactcgagta

SEQ ID NO: 508417 - DNA, 25 bp, Rattus norvegicus
ccacggaagccggaagctttcactc

SEQ ID NO: 508418 - DNA, 25 bp, Rattus norvegicus
tctgcggcctctttaagaaggggcg

SEQ ID NO: 508419 - DNA, 25 bp, Rattus norvegicus
cggctgcgttatcagacaccggacc

SEQ ID NO: 508420 - DNA, 25 bp, Rattus norvegicus
gtccggtcgcaagcggcgcaaaaaa

SEQ ID NO: 508421 - DNA, 25 bp, Rattus norvegicus
tgctgtgagagctgctgaccccgct

SEQ ID NO: 508422 - DNA, 25 bp, Rattus norvegicus
aaggaggtccagagtccggtcgcaa

SEQ ID NO: 508423 - DNA, 25 bp, Rattus norvegicus
gtcctaaaacttccgctgctggctc

SEQ ID NO: 508424 - DNA, 25 bp, Rattus norvegicus
tccacctctaccgtttcgcgttgaa

SEQ ID NO: 508425 - DNA, 25 bp, Rattus norvegicus
cctctaccgtttcgcgttgaagaat

SEQ ID NO: 508426 - DNA, 25 bp, Rattus norvegicus
ttgaagaattttgtcccacacgccg

SEQ ID NO: 508427 - DNA, 25 bp, Rattus norvegicus
attttgtcccacacgccgagctgtt

SEQ ID NO: 508428 - DNA, 25 bp, Rattus norvegicus
cgccctcaccgctgccatggcggca

SEQ ID NO: 508429 - DNA, 25 bp, Rattus norvegicus
cagctccgccgctctccaaggctga

SEQ ID NO: 508430 - DNA, 25 bp, Rattus norvegicus
ccaaggctgagtatctgaagcgtta

SEQ ID NO: 508431 - DNA, 25 bp, Rattus norvegicus
tctgaagcgttacttgtctgggaca

SEQ ID NO: 508432 - DNA, 25 bp, Rattus norvegicus
cttgtctgggacagatgctggcttg

SEQ ID NO: 508433 - DNA, 25 bp, Rattus norvegicus
gcaagcggcgcaaaaaacggccgaa

SEQ ID NO: 508434 - DNA, 25 bp, Rattus norvegicus
tggttacccggcagttccaccacga

SEQ ID NO: 508435 - DNA, 25 bp, Rattus norvegicus
tcctggcgccatccttacgtggtta

SEQ ID NO: 508436 - DNA, 25 bp, Rattus norvegicus
acttctgacgtttcacgggccattg

SEQ ID NO: 508437 - DNA, 25 bp, Rattus norvegicus
cgggccattgtttgaggcctaattg

SEQ ID NO: 508438 - DNA, 25 bp, Rattus norvegicus
ggcctaattgcctgctagtacgatc

SEQ ID NO: 508439 - DNA, 25 bp, Rattus norvegicus
tagtacgatcggctcgcacctcctt

SEQ ID NO: 508440 - DNA, 25 bp, Rattus norvegicus
gcgcgccaaactgccgcagtgtatt

SEQ ID NO: 508441 - DNA, 25 bp, Rattus norvegicus
gccggggacaacaggcctgttacta

SEQ ID NO: 508442 - DNA, 25 bp, Rattus norvegicus
cctgttactaagatgggtccggtgg

SEQ ID NO: 508443 - DNA, 25 bp, Rattus norvegicus
gggacacacagagttcgcctggtga

SEQ ID NO: 508444 - DNA, 25 bp, Rattus norvegicus
aaaccgggaagaccagcattctgca

SEQ ID NO: 508445 - DNA, 25 bp, Rattus norvegicus
gcattctgcacggtcttctcccagt

SEQ ID NO: 508446 - DNA, 25 bp, Rattus norvegicus
acgcctccgggcaagaggaactctc

SEQ ID NO: 508447 - DNA, 25 bp, Rattus norvegicus
agcgcccgtggatgtaggaaaaccg

SEQ ID NO: 508448 - DNA, 25 bp, Rattus norvegicus
cgagccacagctgcgccgctttgat

SEQ ID NO: 508449 - DNA, 25 bp, Rattus norvegicus
aactttgcgggtcgttggatgccac

SEQ ID NO: 508450 - DNA, 25 bp, Rattus norvegicus
ccgctttgatgtgccgattgtgcca

SEQ ID NO: 508451 - DNA, 25 bp, Rattus norvegicus
ccgctgcacggagaaaggtgacgct

SEQ ID NO: 508452 - DNA, 25 bp, Rattus norvegicus
gcgctgtagccgctgattaatcggg

SEQ ID NO: 508453 - DNA, 25 bp, Rattus norvegicus
ttgatttcggggatcaaagcgccgc

SEQ ID NO: 508454 - DNA, 25 bp, Rattus norvegicus
cccatcagacggagggtttgatttc

SEQ ID NO: 508455 - DNA, 25 bp, Rattus norvegicus
gctcggattagcataacatcaagtc

SEQ ID NO: 508456 - DNA, 25 bp, Rattus norvegicus
ctcagctcaatcagctcggattagc

SEQ ID NO: 508457 - DNA, 25 bp, Rattus norvegicus
tcaatatttattcggaactcccagg

SEQ ID NO: 508458 - DNA, 25 bp, Rattus norvegicus
ggggacagatgtgcatcaatattta

SEQ ID NO: 508459 - DNA, 25 bp, Rattus norvegicus
gcgcaaagctcctggttacacctga

SEQ ID NO: 508460 - DNA, 25 bp, Rattus norvegicus
cggccgaaactgttgccagcgcaaa

SEQ ID NO: 508461 - DNA, 25 bp, Rattus norvegicus
tgccgattgtgccaagttaactttg

SEQ ID NO: 508462 - DNA, 25 bp, Rattus norvegicus
tgggcacccgcggattggtcccgaa

SEQ ID NO: 508463 - DNA, 25 bp, Rattus norvegicus
ctgccagtctgaggcaggtgcccga

SEQ ID NO: 508464 - DNA, 25 bp, Rattus norvegicus
tctcattagctgtccgctcgggctc

SEQ ID NO: 508465 - DNA, 25 bp, Rattus norvegicus
ccgcatctcattagcatctcattag

SEQ ID NO: 508466 - DNA, 25 bp, Rattus norvegicus
ccacaggtaggttgtgggcacccgc

SEQ ID NO: 508467 - DNA, 25 bp, Rattus norvegicus
gagtcctgtgctgccgagcggatcc

SEQ ID NO: 508468 - DNA, 25 bp, Rattus norvegicus
ccctaggagccgtagctatggaagg

SEQ ID NO: 508469 - DNA, 25 bp, Rattus norvegicus
aggtgcccgacatggcgagtcctgt

SEQ ID NO: 508470 - DNA, 25 bp, Rattus norvegicus
ttcctaaatccaaagcggcgggagc

SEQ ID NO: 508471 - DNA, 25 bp, Rattus norvegicus
tggaacttacaggtcctcctgtgtc

SEQ ID NO: 508472 - DNA, 25 bp, Rattus norvegicus
tccaggcagggaaagttcccggctc

SEQ ID NO: 508473 - DNA, 25 bp, Rattus norvegicus
caccgaggcctctgccgcgagtaga

SEQ ID NO: 508474 - DNA, 25 bp, Rattus norvegicus
ccgcgagtagagatccgggatttcc

SEQ ID NO: 508475 - DNA, 25 bp, Rattus norvegicus
gaaactcgctcttgtccctggaact

SEQ ID NO: 508476 - DNA, 25 bp, Rattus norvegicus
aggtccacccagaccattcgctgag

SEQ ID NO: 508477 - DNA, 25 bp, Rattus norvegicus
gagtccctcggtcccacgcgcgaat

SEQ ID NO: 508478 - DNA, 25 bp, Rattus norvegicus
ggccacactctctcacctccaggtc

SEQ ID NO: 508479 - DNA, 25 bp, Rattus norvegicus
catggctgcgctaccttcgctgaca

SEQ ID NO: 508480 - DNA, 25 bp, Rattus norvegicus
agcctggcgcccagggatacgccta

SEQ ID NO: 508481 - DNA, 25 bp, Rattus norvegicus
gcgcccagggatacgcctagcatca

SEQ ID NO: 508482 - DNA, 25 bp, Rattus norvegicus
gggatacgcctagcatcacccggca

SEQ ID NO: 508483 - DNA, 25 bp, Rattus norvegicus
gcgcaggcgccacagtcgctaaacg

SEQ ID NO: 508484 - DNA, 25 bp, Rattus norvegicus
cgccacagtcgctaaacgtcgcaaa

SEQ ID NO: 508485 - DNA, 25 bp, Rattus norvegicus
agtcgctaaacgtcgcaaacccacg

SEQ ID NO: 508486 - DNA, 25 bp, Rattus norvegicus
aggtgccgggagaagactacaatcc

SEQ ID NO: 508487 - DNA, 25 bp, Rattus norvegicus
atgctaggtgtcagctcgccctcca

SEQ ID NO: 508488 - DNA, 25 bp, Rattus norvegicus
cgccctccacagctacgcttggcta

SEQ ID NO: 508489 - DNA, 25 bp, Rattus norvegicus
cccggcatgctaggtgtcagctcgc

SEQ ID NO: 508490 - DNA, 25 bp, Rattus norvegicus
gccatagggcacgaagatatccgaa

SEQ ID NO: 508491 - DNA, 25 bp, Rattus norvegicus
caccggctctcatgctgtagctttc

SEQ ID NO: 508492 - DNA, 25 bp, Rattus norvegicus
gagggtgattcgaagttcatccaca

SEQ ID NO: 508493 - DNA, 25 bp, Rattus norvegicus
tgccgcctcagctgatggtagtaac

SEQ ID NO: 508494 - DNA, 25 bp, Rattus norvegicus
cggtccggtaggatagtgtccaatt

SEQ ID NO: 508495 - DNA, 25 bp, Rattus norvegicus
tgtccaattgaagaggtccttagcc

SEQ ID NO: 508496 - DNA, 25 bp, Rattus norvegicus
cagtcaacgcggtgcatagtagtcc

SEQ ID NO: 508497 - DNA, 25 bp, Rattus norvegicus
cccaacagaggcaggcagtcaacgc

SEQ ID NO: 508498 - DNA, 25 bp, Rattus norvegicus
ccaaagggttcccaccagagcagca

SEQ ID NO: 508499 - DNA, 25 bp, Rattus norvegicus
cggcagccgctgatgttgaagcgca

SEQ ID NO: 508500 - DNA, 25 bp, Rattus norvegicus
ggtggaacagcactgcttgagcctc

SEQ ID NO: 508501 - DNA, 25 bp, Rattus norvegicus
tcctggtcgtcgaacacgcgtagct

SEQ ID NO: 508502 - DNA, 25 bp, Rattus norvegicus
ctccagggcttctctagctagcatc

SEQ ID NO: 508503 - DNA, 25 bp, Rattus norvegicus
gtgagttctcaaacgccaggtaaaa

SEQ ID NO: 508504 - DNA, 25 bp, Rattus norvegicus
cgctccttgtccgagcccgtgaatg

SEQ ID NO: 508505 - DNA, 25 bp, Rattus norvegicus
agcagcgtcttgttgcgttaggatc

SEQ ID NO: 508506 - DNA, 25 bp, Rattus norvegicus
ctcgacctcttaagaagtgtgctgc

SEQ ID NO: 508507 - DNA, 25 bp, Rattus norvegicus
ctggttactagacttgatccgaatc

SEQ ID NO: 508508 - DNA, 25 bp, Rattus norvegicus
tccggagacagcttcctggttacta

SEQ ID NO: 508509 - DNA, 25 bp, Rattus norvegicus
aggagatctcaacccgtcggccatg

SEQ ID NO: 508510 - DNA, 25 bp, Rattus norvegicus
cgccggcgatcaagccaacaggatg

SEQ ID NO: 508511 - DNA, 25 bp, Rattus norvegicus
tcgacgtacgtctagcaaacactgc

SEQ ID NO: 508512 - DNA, 25 bp, Rattus norvegicus
tccttccgccgttgcacgaaaaatg

SEQ ID NO: 508513 - DNA, 25 bp, Rattus norvegicus
cccttacctggtggaacagctcgaa

SEQ ID NO: 508514 - DNA, 25 bp, Rattus norvegicus
gttaggatctgctctcgcaacccga

SEQ ID NO: 508515 - DNA, 25 bp, Rattus norvegicus
aagatggcccagaactcggtgtcgc

SEQ ID NO: 508516 - DNA, 25 bp, Rattus norvegicus
tccaggttacccacgaacagagtgc

SEQ ID NO: 508517 - DNA, 25 bp, Rattus norvegicus
agggcccagtttgatcgacgtacgt

SEQ ID NO: 508518 - DNA, 25 bp, Rattus norvegicus
tgacagcctcggctccgctttctag

SEQ ID NO: 508519 - DNA, 25 bp, Rattus norvegicus
agagatctctgggtcctccaccttc

SEQ ID NO: 508520 - DNA, 25 bp, Rattus norvegicus
gccagcccttgcctgtacaaagaca

SEQ ID NO: 508521 - DNA, 25 bp, Rattus norvegicus
tatgagcacccacaggctctctgct

SEQ ID NO: 508522 - DNA, 25 bp, Rattus norvegicus
cgcaccggtccgcatacatatgagc

SEQ ID NO: 508523 - DNA, 25 bp, Rattus norvegicus
gcccgccagcgaataaacacaaata

SEQ ID NO: 508524 - DNA, 25 bp, Rattus norvegicus
ggggcatcaagtccaatcaagaaga

SEQ ID NO: 508525 - DNA, 25 bp, Rattus norvegicus
agcgccagagtctctccgaagcttc

SEQ ID NO: 508526 - DNA, 25 bp, Rattus norvegicus
acgggctgttcccaccgagagccga

SEQ ID NO: 508527 - DNA, 25 bp, Rattus norvegicus
ttccgaatgcatcaggtgcagagcc

SEQ ID NO: 508528 - DNA, 25 bp, Rattus norvegicus
cgccagggtgggaaagacattccga

SEQ ID NO: 508529 - DNA, 25 bp, Rattus norvegicus
tgccaggatcgtgcgcatttcgagc

SEQ ID NO: 508530 - DNA, 25 bp, Rattus norvegicus
caggatcgagatccctgggaagcca

SEQ ID NO: 508531 - DNA, 25 bp, Rattus norvegicus
cgaagcttccctctctccttaaaag

SEQ ID NO: 508532 - DNA, 25 bp, Rattus norvegicus
tctccggcgcaagccgcaagagggt

SEQ ID NO: 508533 - DNA, 25 bp, Rattus norvegicus
ccagggcacctaaggcggaaatcga

SEQ ID NO: 508534 - DNA, 25 bp, Rattus norvegicus
ccacttccagggcacctaaggcgga

SEQ ID NO: 508535 - DNA, 25 bp, Rattus norvegicus
gtgaccgcggcgaagacgacaacga

SEQ ID NO: 508536 - DNA, 25 bp, Rattus norvegicus
ccatgactgcggagctgcagcagga

SEQ ID NO: 508537 - DNA, 25 bp, Rattus norvegicus
cgcggaggcaccacggccatgactg

SEQ ID NO: 508538 - DNA, 25 bp, Rattus norvegicus
ccttgtgtatgagggactccggttg

SEQ ID NO: 508539 - DNA, 25 bp, Rattus norvegicus
cctaaggcggaaatcgaaacagctg

SEQ ID NO: 508540 - DNA, 25 bp, Rattus norvegicus
cggaaatcgaaacagctggtgatgc

SEQ ID NO: 508541 - DNA, 25 bp, Rattus norvegicus
gcatccagcgaacgccgtgggcgga

SEQ ID NO: 508542 - DNA, 25 bp, Rattus norvegicus
gagtctccggcgcaagccgcaagag

SEQ ID NO: 508543 - DNA, 25 bp, Rattus norvegicus
cccgcctccggctcacgcaagccag

SEQ ID NO: 508544 - DNA, 25 bp, Rattus norvegicus
acagctggtgatgcgacgttgaccc

SEQ ID NO: 508545 - DNA, 25 bp, Rattus norvegicus
ccgcggcgaagacgacaacgagagt

SEQ ID NO: 508546 - DNA, 25 bp, Rattus norvegicus
cctctcgggaggtcttcagagtcgc

SEQ ID NO: 508547 - DNA, 25 bp, Rattus norvegicus
ctgtctgtcttcacaggtgtacccg

SEQ ID NO: 508548 - DNA, 25 bp, Rattus norvegicus
ccaatcgcccaatcgcacaggagag

SEQ ID NO: 508549 - DNA, 25 bp, Rattus norvegicus
tcgcacaggagaggagctgcacctc

SEQ ID NO: 508550 - DNA, 25 bp, Rattus norvegicus
gcacctccgtcatcctccgctggct

SEQ ID NO: 508551 - DNA, 25 bp, Rattus norvegicus
gccagcaccggaaactgcactattt

SEQ ID NO: 508552 - DNA, 25 bp, Rattus norvegicus
aaactgcactatttcggggtacaca

SEQ ID NO: 508553 - DNA, 25 bp, Rattus norvegicus
ctatttcggggtacacagtggagta

SEQ ID NO: 508554 - DNA, 25 bp, Rattus norvegicus
tacacagtggagtaccgcgaggaag

SEQ ID NO: 508555 - DNA, 25 bp, Rattus norvegicus
taccgcgaggaaggtgtgttgctcc

SEQ ID NO: 508556 - DNA, 25 bp, Rattus norvegicus
gtgtgttgctccgctcttctggatc

SEQ ID NO: 508557 - DNA, 25 bp, Rattus norvegicus
cttctggatctgcttcctctcggga

SEQ ID NO: 508558 - DNA, 25 bp, Rattus norvegicus
tctgcttcctctcgggaggtcttca

SEQ ID NO: 508559 - DNA, 25 bp, Rattus norvegicus
accgccttgctgtctgtcttcacag

SEQ ID NO: 508560 - DNA, 25 bp, Rattus norvegicus
ggtacgcttcgtggcaatggcttct

SEQ ID NO: 508561 - DNA, 25 bp, Rattus norvegicus
cctatcctgttggtgtgggtacgct

SEQ ID NO: 508562 - DNA, 25 bp, Rattus norvegicus
atctgggcaccaggatcagccgtct

SEQ ID NO: 508563 - DNA, 25 bp, Rattus norvegicus
aagtcttggcccactcggggagcct

SEQ ID NO: 508564 - DNA, 25 bp, Rattus norvegicus
tggcaatggcttctttcgtgacgga

SEQ ID NO: 508565 - DNA, 25 bp, Rattus norvegicus
caggatcagccgtctgacccggcgg

SEQ ID NO: 508566 - DNA, 25 bp, Rattus norvegicus
tcagtttcccggcaggccgtgcggc

SEQ ID NO: 508567 - DNA, 25 bp, Rattus norvegicus
gccgggctacgtagaactcagtttc

SEQ ID NO: 508568 - DNA, 25 bp, Rattus norvegicus
aactgtagtgtgactggcgcctgtg

SEQ ID NO: 508569 - DNA, 25 bp, Rattus norvegicus
aagctgccgaaacggcggacgtctg

SEQ ID NO: 508570 - DNA, 25 bp, Rattus norvegicus
tggtgcctcccagaagctgccgaaa

SEQ ID NO: 508571 - DNA, 25 bp, Rattus norvegicus
ctgcgcactttggtgcctcccagaa

SEQ ID NO: 508572 - DNA, 25 bp, Rattus norvegicus
tctttcgtgacggaagtcttggccc

SEQ ID NO: 508573 - DNA, 25 bp, Rattus norvegicus
ggctgctggagtgacctatcctgtt

SEQ ID NO: 508574 - DNA, 25 bp, Rattus norvegicus
ccgggcgccatatggcttgaaggta

SEQ ID NO: 508575 - DNA, 25 bp, Rattus norvegicus
aacgacagtctgtggcttctgcacg

SEQ ID NO: 508576 - DNA, 25 bp, Rattus norvegicus
ctacactgagtctccgacgggcaga

SEQ ID NO: 508577 - DNA, 25 bp, Rattus norvegicus
tccagcctcagtgccggggctggtc

SEQ ID NO: 508578 - DNA, 25 bp, Rattus norvegicus
cggagctgtccagcctcagtgccgg

SEQ ID NO: 508579 - DNA, 25 bp, Rattus norvegicus
agcgctctgattccgcggagctgtc

SEQ ID NO: 508580 - DNA, 25 bp, Rattus norvegicus
ctgcgcagcgctctgattccgcgga

SEQ ID NO: 508581 - DNA, 25 bp, Rattus norvegicus
agtttgtccagccactctagcgccg

SEQ ID NO: 508582 - DNA, 25 bp, Rattus norvegicus
ggaacagaagtttgtccagccactc

SEQ ID NO: 508583 - DNA, 25 bp, Rattus norvegicus
gctgaccggccaggaacagaagttt

SEQ ID NO: 508584 - DNA, 25 bp, Rattus norvegicus
cgaagcgtccagagctgaccggcca

SEQ ID NO: 508585 - DNA, 25 bp, Rattus norvegicus
gcttctgcacgggtcgaagcgtcca

SEQ ID NO: 508586 - DNA, 25 bp, Rattus norvegicus
tctccgacgggcagattgcgcctcg

SEQ ID NO: 508587 - DNA, 25 bp, Rattus norvegicus
gcgccatatggcttgaaggtaagaa

SEQ ID NO: 508588 - DNA, 25 bp, Rattus norvegicus
gcgccgcaataaaagcctctcgcgg

SEQ ID NO: 508589 - DNA, 25 bp, Rattus norvegicus
attccgcacgccctgtaaagacacg

SEQ ID NO: 508590 - DNA, 25 bp, Rattus norvegicus
ccctagcgtctagtccttggccaga

SEQ ID NO: 508591 - DNA, 25 bp, Rattus norvegicus
ttctgcactcgcaggcgaagcgctc

SEQ ID NO: 508592 - DNA, 25 bp, Rattus norvegicus
ccatggacagggagcctgaatgctc

SEQ ID NO: 508593 - DNA, 25 bp, Rattus norvegicus
tccaagccgccgtgaaagaggcacg

SEQ ID NO: 508594 - DNA, 25 bp, Rattus norvegicus
accaagagatgtcccagggcccatc

SEQ ID NO: 508595 - DNA, 25 bp, Rattus norvegicus
agggcccatccttctccattttatg

SEQ ID NO: 508596 - DNA, 25 bp, Rattus norvegicus
tttatgtcctcgaaaactgccgtgc

SEQ ID NO: 508597 - DNA, 25 bp, Rattus norvegicus
ctgccgtgcagctaggggcagtatc

SEQ ID NO: 508598 - DNA, 25 bp, Rattus norvegicus
tagaacacccggagaccatcctggc

SEQ ID NO: 508599 - DNA, 25 bp, Rattus norvegicus
cagccagactcgctctgattggtcc

SEQ ID NO: 508600 - DNA, 25 bp, Rattus norvegicus
ttggtccctgaccagagttggctgg

SEQ ID NO: 508601 - DNA, 25 bp, Rattus norvegicus
agcgagaccgttaagctagaacacc

SEQ ID NO: 508602 - DNA, 25 bp, Rattus norvegicus
agtgagcggaggctgcaagcctcac

SEQ ID NO: 508603 - DNA, 25 bp, Rattus norvegicus
ttcctcctgtcaaaacgcggcgctg

SEQ ID NO: 508604 - DNA, 25 bp, Rattus norvegicus
cgatggcaggctttgcaactaccca

SEQ ID NO: 508605 - DNA, 25 bp, Rattus norvegicus
caactacccagcaatttggcaaatg

SEQ ID NO: 508606 - DNA, 25 bp, Rattus norvegicus
tttggcaaatgaaaaactaacgtca

SEQ ID NO: 508607 - DNA, 25 bp, Rattus norvegicus
tgaaaaactaacgtcatttgcacgg

SEQ ID NO: 508608 - DNA, 25 bp, Rattus norvegicus
agcctcactttatcacagcccggga

SEQ ID NO: 508609 - DNA, 25 bp, Rattus norvegicus
tcacagcccgggacataacggtggg

SEQ ID NO: 508610 - DNA, 25 bp, Rattus norvegicus
cagccttattgttcactcttctcta

SEQ ID NO: 508611 - DNA, 25 bp, Rattus norvegicus
gttcactcttctctaagcttgacaa

SEQ ID NO: 508612 - DNA, 25 bp, Rattus norvegicus
ccctctaggtggaagatgagcctgg

SEQ ID NO: 508613 - DNA, 25 bp, Rattus norvegicus
atagccgcagcatcctgatcccata

SEQ ID NO: 508614 - DNA, 25 bp, Rattus norvegicus
ctggccaagcaaggacgatgcgatg

SEQ ID NO: 508615 - DNA, 25 bp, Rattus norvegicus
cacctccacgggcacacaagtggga

SEQ ID NO: 508616 - DNA, 25 bp, Rattus norvegicus
cagtgcggtgacacacgtgggcaca

SEQ ID NO: 508617 - DNA, 25 bp, Rattus norvegicus
gactccgcaccttcaccatttcctt

SEQ ID NO: 508618 - DNA, 25 bp, Rattus norvegicus
agctcggctctaacccacccgcgtg

SEQ ID NO: 508619 - DNA, 25 bp, Rattus norvegicus
cggtttcggcgcgtggcacttttcg

SEQ ID NO: 508620 - DNA, 25 bp, Rattus norvegicus
tcccagggacatagcgggacaggcc

SEQ ID NO: 508621 - DNA, 25 bp, Rattus norvegicus
tgcggtgacacacgtgggcacaccc

SEQ ID NO: 508622 - DNA, 25 bp, Rattus norvegicus
cgctgaaggacacgaggcgcgacaa

SEQ ID NO: 508623 - DNA, 25 bp, Rattus norvegicus
acacgaggcgcgacaatcgcgcgcg

SEQ ID NO: 508624 - DNA, 25 bp, Rattus norvegicus
aaccgccgcgttcatggtcttcaga

SEQ ID NO: 508625 - DNA, 25 bp, Rattus norvegicus
gccgcgttcatggtcttcagaccaa

SEQ ID NO: 508626 - DNA, 25 bp, Rattus norvegicus
tcagaccaaagacccacaagctacg

SEQ ID NO: 508627 - DNA, 25 bp, Rattus norvegicus
cacaagctacgggttccggcttccg

SEQ ID NO: 508628 - DNA, 25 bp, Rattus norvegicus
gcgtggccacgatcccagggacata

SEQ ID NO: 508629 - DNA, 25 bp, Rattus norvegicus
cccgccggaagtactcctgggagcg

SEQ ID NO: 508630 - DNA, 25 bp, Rattus norvegicus
cggcccggaagcagttatgtcgtaa

SEQ ID NO: 508631 - DNA, 25 bp, Rattus norvegicus
gtgagacgcagatcccgggcactca

SEQ ID NO: 508632 - DNA, 25 bp, Rattus norvegicus
ggcacagttcactgcgcaggtacga

SEQ ID NO: 508633 - DNA, 25 bp, Rattus norvegicus
tgagggctcaaggtcaccctacggc

SEQ ID NO: 508634 - DNA, 25 bp, Rattus norvegicus
gaacggcgaagcaacctcaagagtg

SEQ ID NO: 508635 - DNA, 25 bp, Rattus norvegicus
agagccctggacactgcagcagagc

SEQ ID NO: 508636 - DNA, 25 bp, Rattus norvegicus
ctcaagagtgaaccggaaggcagga

SEQ ID NO: 508637 - DNA, 25 bp, Rattus norvegicus
gcgtgcgtactccagtgaacagatt

SEQ ID NO: 508638 - DNA, 25 bp, Rattus norvegicus
tgaacagattgacgctgaccatggc

SEQ ID NO: 508639 - DNA, 25 bp, Rattus norvegicus
tgaccatggccgagcttggtgaagc

SEQ ID NO: 508640 - DNA, 25 bp, Rattus norvegicus
gaagcggacgaagcggagttacaac

SEQ ID NO: 508641 - DNA, 25 bp, Rattus norvegicus
agttacaacgcctggtggccgccga

SEQ ID NO: 508642 - DNA, 25 bp, Rattus norvegicus
ccgccgaacagcagaaggcacagtt

SEQ ID NO: 508643 - DNA, 25 bp, Rattus norvegicus
gccatttcgcttttgagggctcaag

SEQ ID NO: 508644 - DNA, 25 bp, Rattus norvegicus
ctctctctccgggacccaggccaga

SEQ ID NO: 508645 - DNA, 25 bp, Rattus norvegicus
gagactcccacagagcgggctcgcc

SEQ ID NO: 508646 - DNA, 25 bp, Rattus norvegicus
agaaacgcttccctccacaggagac

SEQ ID NO: 508647 - DNA, 25 bp, Rattus norvegicus
agtcgtgctccggagaaacgcttcc

SEQ ID NO: 508648 - DNA, 25 bp, Rattus norvegicus
cttccgggccggaagtcgtgctccg

SEQ ID NO: 508649 - DNA, 25 bp, Rattus norvegicus
tctccgcagccttccctcgaaacgc

SEQ ID NO: 508650 - DNA, 25 bp, Rattus norvegicus
cccgggaagtgtctagcgtgcctca

SEQ ID NO: 508651 - DNA, 25 bp, Rattus norvegicus
catgggcacggccttccgttgggcc

SEQ ID NO: 508652 - DNA, 25 bp, Rattus norvegicus
aagccggcgctctcctgagagagaa

SEQ ID NO: 508653 - DNA, 25 bp, Rattus norvegicus
tttcactcccgggacagaatgggga

SEQ ID NO: 508654 - DNA, 25 bp, Rattus norvegicus
cgcagccttcccaccggttacagtg

SEQ ID NO: 508655 - DNA, 25 bp, Rattus norvegicus
agtccttcgtgaaaacgcagccttc

SEQ ID NO: 508656 - DNA, 25 bp, Rattus norvegicus
acgagcccgctgaggagccagtccg

SEQ ID NO: 508657 - DNA, 25 bp, Rattus norvegicus
actcccgggacagaatggggacacg

SEQ ID NO: 508658 - DNA, 25 bp, Rattus norvegicus
ggcctctcaactccgccaccggctg

SEQ ID NO: 508659 - DNA, 25 bp, Rattus norvegicus
ttgtcatagtgaccgccgatgctcc

SEQ ID NO: 508660 - DNA, 25 bp, Rattus norvegicus
catctggggttgtcatagtgaccgc

SEQ ID NO: 508661 - DNA, 25 bp, Rattus norvegicus
acgcaaggcatctggggttgtcata

SEQ ID NO: 508662 - DNA, 25 bp, Rattus norvegicus
gccaccggctgctctggaacgcaag

SEQ ID NO: 508663 - DNA, 25 bp, Rattus norvegicus
tcgacccacagctaccaggcctctc

SEQ ID NO: 508664 - DNA, 25 bp, Rattus norvegicus
gccaccggggtctcctcgacccaca

SEQ ID NO: 508665 - DNA, 25 bp, Rattus norvegicus
gcctcctgccgcctcatgccaccgg

SEQ ID NO: 508666 - DNA, 25 bp, Rattus norvegicus
agccgtcaccaccagcgcctcctgc

SEQ ID NO: 508667 - DNA, 25 bp, Rattus norvegicus
tggcctctgaggctgtcccagccgt

SEQ ID NO: 508668 - DNA, 25 bp, Rattus norvegicus
tctccgtcgcggctggcctctgagg

SEQ ID NO: 508669 - DNA, 25 bp, Rattus norvegicus
tgcgggcctaggctgctctccgtcg

SEQ ID NO: 508670 - DNA, 25 bp, Rattus norvegicus
cgcgcggcacaccagccctgcgggc

SEQ ID NO: 508671 - DNA, 25 bp, Rattus norvegicus
gctgctctggaacgcaaggcatctg

SEQ ID NO: 508672 - DNA, 25 bp, Rattus norvegicus
ctgcggtcgcgcagtgtcgtaaaag

SEQ ID NO: 508673 - DNA, 25 bp, Rattus norvegicus
ccagctctaaggtggtggcctaagg

SEQ ID NO: 508674 - DNA, 25 bp, Rattus norvegicus
ggttgggaagtacggccagctctaa

SEQ ID NO: 508675 - DNA, 25 bp, Rattus norvegicus
aaggccctaagagaggtgtcgcaga

SEQ ID NO: 508676 - DNA, 25 bp, Rattus norvegicus
cagtgcacgtttggtagaaacggga

SEQ ID NO: 508677 - DNA, 25 bp, Rattus norvegicus
atctacggtgacgaaggcgtttcca

SEQ ID NO: 508678 - DNA, 25 bp, Rattus norvegicus
acccgaggcggcagctcggatctac

SEQ ID NO: 508679 - DNA, 25 bp, Rattus norvegicus
tctgccggggaactggtcagagaca

SEQ ID NO: 508680 - DNA, 25 bp, Rattus norvegicus
cgtaaaagcggctgcttggactggc

SEQ ID NO: 508681 - DNA, 25 bp, Rattus norvegicus
gcgggctctgaaggacaacaggctc

SEQ ID NO: 508682 - DNA, 25 bp, Rattus norvegicus
tccggggtggatcactcaccttctg

SEQ ID NO: 508683 - DNA, 25 bp, Rattus norvegicus
aaaggctccgccgtctccggagtga

SEQ ID NO: 508684 - DNA, 25 bp, Rattus norvegicus
ccggagtgacctctccaagagcagc

SEQ ID NO: 508685 - DNA, 25 bp, Rattus norvegicus
accgagagtcggaccggctacagcc

SEQ ID NO: 508686 - DNA, 25 bp, Rattus norvegicus
agcatcttggtccttgcggtcgcgc

SEQ ID NO: 508687 - DNA, 25 bp, Rattus norvegicus
ccggacagccgcattttaacctatc

SEQ ID NO: 508688 - DNA, 25 bp, Rattus norvegicus
caccggagctcgaagaacggttcca

SEQ ID NO: 508689 - DNA, 25 bp, Rattus norvegicus
ggttccagagatcagccagccagcg

SEQ ID NO: 508690 - DNA, 25 bp, Rattus norvegicus
aagaggctccggtagctccagctga

SEQ ID NO: 508691 - DNA, 25 bp, Rattus norvegicus
accgggatgctccctagggtgaagc

SEQ ID NO: 508692 - DNA, 25 bp, Rattus norvegicus
tgaagcgcgctgtcccggtagttca

SEQ ID NO: 508693 - DNA, 25 bp, Rattus norvegicus
gcgctgtcccggtagttcagacacc

SEQ ID NO: 508694 - DNA, 25 bp, Rattus norvegicus
gtagttcagacaccgccgcagccga

SEQ ID NO: 508695 - DNA, 25 bp, Rattus norvegicus
cgcattttaacctatctccctcggg

SEQ ID NO: 508696 - DNA, 25 bp, Rattus norvegicus
cgctggcagcagcatcttggtcctt

SEQ ID NO: 508697 - DNA, 25 bp, Rattus norvegicus
acctatctccctcggggcaagaggc

SEQ ID NO: 508698 - DNA, 25 bp, Rattus norvegicus
tccagctgagcgtcgagtggatcta

SEQ ID NO: 508699 - DNA, 25 bp, Rattus norvegicus
atctagcgtgcggtgctccggctcg

SEQ ID NO: 508700 - DNA, 25 bp, Rattus norvegicus
cgagctgtatgacgtgcaggctttc

SEQ ID NO: 508701 - DNA, 25 bp, Rattus norvegicus
gcgtcttctcagtcaggtaccagcc

SEQ ID NO: 508702 - DNA, 25 bp, Rattus norvegicus
acgcccgcgtcttctcagtcaggta

SEQ ID NO: 508703 - DNA, 25 bp, Rattus norvegicus
gggcatcgtgtcacgcccgcgtctt

SEQ ID NO: 508704 - DNA, 25 bp, Rattus norvegicus
ctacatcgacctgcggggcatcgtg

SEQ ID NO: 508705 - DNA, 25 bp, Rattus norvegicus
ccagtctacatcgacctgcggggca

SEQ ID NO: 508706 - DNA, 25 bp, Rattus norvegicus
aagttcgggagcttcgtgctgaaga

SEQ ID NO: 508707 - DNA, 25 bp, Rattus norvegicus
tttcaagttcgggagcttcgtgctg

SEQ ID NO: 508708 - DNA, 25 bp, Rattus norvegicus
atgacgtgcaggctttcaagttcgg

SEQ ID NO: 508709 - DNA, 25 bp, Rattus norvegicus
tcaccgagctgtatgacgtgcaggc

SEQ ID NO: 508710 - DNA, 25 bp, Rattus norvegicus
cccttggtcaccgagctgtatgacg

SEQ ID NO: 508711 - DNA, 25 bp, Rattus norvegicus
ttccacagcgagctgagcgcgcgag

SEQ ID NO: 508712 - DNA, 25 bp, Rattus norvegicus
tcggcttccacagcgagctgagcgc

SEQ ID NO: 508713 - DNA, 25 bp, Rattus norvegicus
gcaggctttcaagttcgggagcttc

SEQ ID NO: 508714 - DNA, 25 bp, Rattus norvegicus
ccaaactagcggcttgcactgggca

SEQ ID NO: 508715 - DNA, 25 bp, Rattus norvegicus
cgcgctgacacaagcgggtttgcca

SEQ ID NO: 508716 - DNA, 25 bp, Rattus norvegicus
gtttgccagtctaaccatatgcttg

SEQ ID NO: 508717 - DNA, 25 bp, Rattus norvegicus
atcactacactgcaggtttggaggc

SEQ ID NO: 508718 - DNA, 25 bp, Rattus norvegicus
ccgtgcgcgtgctcgcatatacacg

SEQ ID NO: 508719 - DNA, 25 bp, Rattus norvegicus
tctgcacacaaaggcgatcggctca

SEQ ID NO: 508720 - DNA, 25 bp, Rattus norvegicus
cgcgggtcaagcaggctagcattgt

SEQ ID NO: 508721 - DNA, 25 bp, Rattus norvegicus
ttactggaaacctagacccgagcca

SEQ ID NO: 508722 - DNA, 25 bp, Rattus norvegicus
gttcgtggcgagcactcacacatgc

SEQ ID NO: 508723 - DNA, 25 bp, Rattus norvegicus
ggcgctgtgctggttcctatagaaa

SEQ ID NO: 508724 - DNA, 25 bp, Rattus norvegicus
ttcctatagaaacagcagggcgcgc

SEQ ID NO: 508725 - DNA, 25 bp, Rattus norvegicus
agcagacaggcgataggcgctcgca

SEQ ID NO: 508726 - DNA, 25 bp, Rattus norvegicus
aggctagcattgttcctgccgcggg

SEQ ID NO: 508727 - DNA, 25 bp, Rattus norvegicus
ggagtcccgcatgccacttactgga

SEQ ID NO: 508728 - DNA, 25 bp, Rattus norvegicus
ccgcttctctgatcgacggcctgga

SEQ ID NO: 508729 - DNA, 25 bp, Rattus norvegicus
cgcttgaggaatgcgagtgcacctc

SEQ ID NO: 508730 - DNA, 25 bp, Rattus norvegicus
gctctagagaacctacggcgcctgc

SEQ ID NO: 508731 - DNA, 25 bp, Rattus norvegicus
ggagatcccgtagctctagagaacc

SEQ ID NO: 508732 - DNA, 25 bp, Rattus norvegicus
tctggagggagatcccgtagctcta

SEQ ID NO: 508733 - DNA, 25 bp, Rattus norvegicus
cggcttccaacaccgggcggatctg

SEQ ID NO: 508734 - DNA, 25 bp, Rattus norvegicus
gatcccgacgtcagtgttaccgcta

SEQ ID NO: 508735 - DNA, 25 bp, Rattus norvegicus
cagtgttaccgctaccggcttccaa

SEQ ID NO: 508736 - DNA, 25 bp, Rattus norvegicus
gggaatttctccttcgccgcttctc

SEQ ID NO: 508737 - DNA, 25 bp, Rattus norvegicus
gttcctaggcgcctcctgttggttg

SEQ ID NO: 508738 - DNA, 25 bp, Rattus norvegicus
gcgccctagagatcgccgtaaggga

SEQ ID NO: 508739 - DNA, 25 bp, Rattus norvegicus
agaatgtgcgccctagagatcgccg

SEQ ID NO: 508740 - DNA, 25 bp, Rattus norvegicus
agtgcacctcctgggagcgctcacg

SEQ ID NO: 508741 - DNA, 25 bp, Rattus norvegicus
atcgacggcctggatcccgacgtca

SEQ ID NO: 508742 - DNA, 25 bp, Rattus norvegicus
gacaccgtttcccagccaagcaatg

SEQ ID NO: 508743 - DNA, 25 bp, Rattus norvegicus
cctcttgtgagagcgtccgagttcg

SEQ ID NO: 508744 - DNA, 25 bp, Rattus norvegicus
gctctcttactcctgcctcttgtga

SEQ ID NO: 508745 - DNA, 25 bp, Rattus norvegicus
tgcttacgcagtccggctctcttac

SEQ ID NO: 508746 - DNA, 25 bp, Rattus norvegicus
tctctgtcggcggtctgcttacgca

SEQ ID NO: 508747 - DNA, 25 bp, Rattus norvegicus
tgcgggccgtggatctgctctccac

SEQ ID NO: 508748 - DNA, 25 bp, Rattus norvegicus
actcgtctgctctttgctgcgggcc

SEQ ID NO: 508749 - DNA, 25 bp, Rattus norvegicus
gggtctgcactcgtctgctctttgc

SEQ ID NO: 508750 - DNA, 25 bp, Rattus norvegicus
aagctacgggagttactgggcagcc

SEQ ID NO: 508751 - DNA, 25 bp, Rattus norvegicus
ccgcggagaagctacgggagttact

SEQ ID NO: 508752 - DNA, 25 bp, Rattus norvegicus
ccggtactaggcatggcgagccgaa

SEQ ID NO: 508753 - DNA, 25 bp, Rattus norvegicus
agcgtgcagagttctatcctttccc

SEQ ID NO: 508754 - DNA, 25 bp, Rattus norvegicus
cttcactgatttcgtagcgtgcaga

SEQ ID NO: 508755 - DNA, 25 bp, Rattus norvegicus
caagcaatgtctgcgccttcactga

SEQ ID NO: 508756 - DNA, 25 bp, Rattus norvegicus
aaggccggctcagccttagggacga

SEQ ID NO: 508757 - DNA, 25 bp, Rattus norvegicus
accagttcgcgcctcgggtgaacga

SEQ ID NO: 508758 - DNA, 25 bp, Rattus norvegicus
gagagtcgtattcagcctcgggacc

SEQ ID NO: 508759 - DNA, 25 bp, Rattus norvegicus
ccgcaatgaggacgtgcaggtacta

SEQ ID NO: 508760 - DNA, 25 bp, Rattus norvegicus
taatcgacgagctccgcaatgagga

SEQ ID NO: 508761 - DNA, 25 bp, Rattus norvegicus
tcgcggttttaatcgacgagctccg

SEQ ID NO: 508762 - DNA, 25 bp, Rattus norvegicus
gcggagatggagacgattcactcta

SEQ ID NO: 508763 - DNA, 25 bp, Rattus norvegicus
agagccgtcggattggatttagccc

SEQ ID NO: 508764 - DNA, 25 bp, Rattus norvegicus
tccatcggttcctcagagccgtcgg

SEQ ID NO: 508765 - DNA, 25 bp, Rattus norvegicus
cagggaaaaaacttgactccatcgg

SEQ ID NO: 508766 - DNA, 25 bp, Rattus norvegicus
cctccacgcgcagggaaaaaacttg

SEQ ID NO: 508767 - DNA, 25 bp, Rattus norvegicus
cggcgaccagccagaggagaaagaa

SEQ ID NO: 508768 - DNA, 25 bp, Rattus norvegicus
gtggcgtccatctgctcctggcagt

SEQ ID NO: 508769 - DNA, 25 bp, Rattus norvegicus
ttcactctacccgatcgcggtttta

SEQ ID NO: 508770 - DNA, 25 bp, Rattus norvegicus
acacgacgacgggagcgtgaacgaa

SEQ ID NO: 508771 - DNA, 25 bp, Rattus norvegicus
tcctgtagggtcacccggcattctc

SEQ ID NO: 508772 - DNA, 25 bp, Rattus norvegicus
cactgggagcgtctcctgtagggtc

SEQ ID NO: 508773 - DNA, 25 bp, Rattus norvegicus
cagaagcgcaagagcgagccctggt

SEQ ID NO: 508774 - DNA, 25 bp, Rattus norvegicus
cctcttgtcttccagcagaagcgca

SEQ ID NO: 508775 - DNA, 25 bp, Rattus norvegicus
ccgctgcaaggcctgacagggctga

SEQ ID NO: 508776 - DNA, 25 bp, Rattus norvegicus
ggcacgaggcttccggccgctgcaa

SEQ ID NO: 508777 - DNA, 25 bp, Rattus norvegicus
gggcctccatcggtcaccatgacta

SEQ ID NO: 508778 - DNA, 25 bp, Rattus norvegicus
cgctgcagaacacgacgacgggagc

SEQ ID NO: 508779 - DNA, 25 bp, Rattus norvegicus
ggccatccgccatgaccatgcttgg

SEQ ID NO: 508780 - DNA, 25 bp, Rattus norvegicus
ccagcgtgccctcgatgtcgtagaa

SEQ ID NO: 508781 - DNA, 25 bp, Rattus norvegicus
acctccgtcttggtgatccggtgcc

SEQ ID NO: 508782 - DNA, 25 bp, Rattus norvegicus
agactgtgtggcttcccggggacac

SEQ ID NO: 508783 - DNA, 25 bp, Rattus norvegicus
atcggtcaccatgactaccgcagcg

SEQ ID NO: 508784 - DNA, 25 bp, Rattus norvegicus
gtataccgatcctctttacacatca

SEQ ID NO: 508785 - DNA, 25 bp, Rattus norvegicus
tgcagctcctactggccgagtgacc

SEQ ID NO: 508786 - DNA, 25 bp, Rattus norvegicus
cgttaacttctccacggcttccaga

SEQ ID NO: 508787 - DNA, 25 bp, Rattus norvegicus
cgcagcgagaggtgcctcaagctcc

SEQ ID NO: 508788 - DNA, 25 bp, Rattus norvegicus
ctttcgccacggtcgacaggcgagg

SEQ ID NO: 508789 - DNA, 25 bp, Rattus norvegicus
taattacactgcctacaaaccgagc

SEQ ID NO: 508790 - DNA, 25 bp, Rattus norvegicus
gcaccgcactacaatcagctaatta

SEQ ID NO: 508791 - DNA, 25 bp, Rattus norvegicus
gagttagtgattgtcagcaccgcac

SEQ ID NO: 508792 - DNA, 25 bp, Rattus norvegicus
ccttgttttgatggcagtggagtta

SEQ ID NO: 508793 - DNA, 25 bp, Rattus norvegicus
agacccaactctagagccggttcgg

SEQ ID NO: 508794 - DNA, 25 bp, Rattus norvegicus
cctccgctttctgcggagtcagtgg

SEQ ID NO: 508795 - DNA, 25 bp, Rattus norvegicus
cttgcacttagacctcgtgctccgg

SEQ ID NO: 508796 - DNA, 25 bp, Rattus norvegicus
ggtctccgagggttacttgcactta

SEQ ID NO: 508797 - DNA, 25 bp, Rattus norvegicus
acacaggtagccagccgaacggtcc

SEQ ID NO: 508798 - DNA, 25 bp, Rattus norvegicus
cccaggacgccaaggtggaaaagtg

SEQ ID NO: 508799 - DNA, 25 bp, Rattus norvegicus
ctgcagctcttgagtaaaggcatcc

SEQ ID NO: 508800 - DNA, 25 bp, Rattus norvegicus
ggtcggagcctccaaattcccagga

SEQ ID NO: 508801 - DNA, 25 bp, Rattus norvegicus
gtgcgtcctactccagtccagggct

SEQ ID NO: 508802 - DNA, 25 bp, Rattus norvegicus
tcttgctgcaatgccaggacgcgcc

SEQ ID NO: 508803 - DNA, 25 bp, Rattus norvegicus
tcccagcaaagctagtgcgctactc

SEQ ID NO: 508804 - DNA, 25 bp, Rattus norvegicus
cctgagagctaggattcccagcaaa

SEQ ID NO: 508805 - DNA, 25 bp, Rattus norvegicus
tttggcgacagttggcaggccacca

SEQ ID NO: 508806 - DNA, 25 bp, Rattus norvegicus
agagcgcctattagtctcacgggga

SEQ ID NO: 508807 - DNA, 25 bp, Rattus norvegicus
gacacactttccgagtagggtttga

SEQ ID NO: 508808 - DNA, 25 bp, Rattus norvegicus
ggatagacccggcagacacactttc

SEQ ID NO: 508809 - DNA, 25 bp, Rattus norvegicus
aaaggcatcccgaggctccctagga

SEQ ID NO: 508810 - DNA, 25 bp, Rattus norvegicus
agagttctccggcaagagctgcagc

SEQ ID NO: 508811 - DNA, 25 bp, Rattus norvegicus
cgcgattgtccgcagcggccttatg

SEQ ID NO: 508812 - DNA, 25 bp, Rattus norvegicus
accaagaaggtgaggacgccagagc

SEQ ID NO: 508813 - DNA, 25 bp, Rattus norvegicus
cagtaccaccttccagggagctgcg

SEQ ID NO: 508814 - DNA, 25 bp, Rattus norvegicus
cccggaagcacctcgcgaggttagt

SEQ ID NO: 508815 - DNA, 25 bp, Rattus norvegicus
agcgcttgctagcatccgcagctga

SEQ ID NO: 508816 - DNA, 25 bp, Rattus norvegicus
gggcttggcttgcagatcttcttca

SEQ ID NO: 508817 - DNA, 25 bp, Rattus norvegicus
ttcttcatggaagcgatgtctccgc

SEQ ID NO: 508818 - DNA, 25 bp, Rattus norvegicus
ctcgctgacaggcatgtctcgcatc

SEQ ID NO: 508819 - DNA, 25 bp, Rattus norvegicus
ccacagtgcgggatctgaaggttcg

SEQ ID NO: 508820 - DNA, 25 bp, Rattus norvegicus
cgcgcctagcgcctagaagggttaa

SEQ ID NO: 508821 - DNA, 25 bp, Rattus norvegicus
ctatcttctctggtgggaacgggtc

SEQ ID NO: 508822 - DNA, 25 bp, Rattus norvegicus
ggccttgacccgacagcctgaggaa

SEQ ID NO: 508823 - DNA, 25 bp, Rattus norvegicus
gaaggttcggctcggcctagatcta

SEQ ID NO: 508824 - DNA, 25 bp, Rattus norvegicus
tgtctccgcagcaggatgctctagg

SEQ ID NO: 508825 - DNA, 25 bp, Rattus norvegicus
tccgcgaaaaccagactaggcaggc

SEQ ID NO: 508826 - DNA, 25 bp, Rattus norvegicus
tccgaaaggtgtttcacgtagacta

SEQ ID NO: 508827 - DNA, 25 bp, Rattus norvegicus
ctcctgtgagccattctgtagccaa

SEQ ID NO: 508828 - DNA, 25 bp, Rattus norvegicus
tgtgacgtcatgctaccactggctc

SEQ ID NO: 508829 - DNA, 25 bp, Rattus norvegicus
ctcgcgagaagtacggatgcgtttc

SEQ ID NO: 508830 - DNA, 25 bp, Rattus norvegicus
ctcccgcgcccaatttaggtttctg

SEQ ID NO: 508831 - DNA, 25 bp, Rattus norvegicus
ggaactgccatggtgctacctgcga

SEQ ID NO: 508832 - DNA, 25 bp, Rattus norvegicus
tgcgttccgtttcagagtccctcgg

SEQ ID NO: 508833 - DNA, 25 bp, Rattus norvegicus
cagagagaacctggccgagaacttc

SEQ ID NO: 508834 - DNA, 25 bp, Rattus norvegicus
tttccgggtttgcttcctctgcatc

SEQ ID NO: 508835 - DNA, 25 bp, Rattus norvegicus
tccgaatcccaaagcgaaggaactg

SEQ ID NO: 508836 - DNA, 25 bp, Rattus norvegicus
agcggttttcttctcgttctgacga

SEQ ID NO: 508837 - DNA, 25 bp, Rattus norvegicus
acttaggccttgctacggtcttgta

SEQ ID NO: 508838 - DNA, 25 bp, Rattus norvegicus
gagctgtctgtcaccgtggatccga

SEQ ID NO: 508839 - DNA, 25 bp, Rattus norvegicus
tagtggcagcactcgccttcgcaga

SEQ ID NO: 508840 - DNA, 25 bp, Rattus norvegicus
tcccgctgcgagagggctacacgac

SEQ ID NO: 508841 - DNA, 25 bp, Rattus norvegicus
gcgaggtcgacaaggacaacccacc

SEQ ID NO: 508842 - DNA, 25 bp, Rattus norvegicus
agcggccgccataaccctgtcggaa

SEQ ID NO: 508843 - DNA, 25 bp, Rattus norvegicus
cccgagcaccctgcgtgtcctataa

SEQ ID NO: 508844 - DNA, 25 bp, Rattus norvegicus
accacgaaaagcgacggaggcgcag

SEQ ID NO: 508845 - DNA, 25 bp, Rattus norvegicus
cggcagtccagaccacgaaaagcga

SEQ ID NO: 508846 - DNA, 25 bp, Rattus norvegicus
agccgacggcagtccagaccacgaa

SEQ ID NO: 508847 - DNA, 25 bp, Rattus norvegicus
tccactgagggatggcaggtcccgc

SEQ ID NO: 508848 - DNA, 25 bp, Rattus norvegicus
ccaggtccggcctctgcaagcgtgt

SEQ ID NO: 508849 - DNA, 25 bp, Rattus norvegicus
gagctctccggctcggggccagcaa

SEQ ID NO: 508850 - DNA, 25 bp, Rattus norvegicus
gaacgctagcgtcacgggaagagct

SEQ ID NO: 508851 - DNA, 25 bp, Rattus norvegicus
agccaggcccggaacgctagcgtca

SEQ ID NO: 508852 - DNA, 25 bp, Rattus norvegicus
cgacaaggacaacccaccgagaagc

SEQ ID NO: 508853 - DNA, 25 bp, Rattus norvegicus
ggtcctgcgcagtgccaagggtccc

SEQ ID NO: 508854 - DNA, 25 bp, Rattus norvegicus
aaccggccagtgcacgcagatccga

SEQ ID NO: 508855 - DNA, 25 bp, Rattus norvegicus
cacaagggctgctttgtgcaggcga

SEQ ID NO: 508856 - DNA, 25 bp, Rattus norvegicus
aggaagggaaggctcctcctcagcc

SEQ ID NO: 508857 - DNA, 25 bp, Rattus norvegicus
gttgcattatccacagacctccggg

SEQ ID NO: 508858 - DNA, 25 bp, Rattus norvegicus
gagcaaaagttacggagcgcgctgc

SEQ ID NO: 508859 - DNA, 25 bp, Rattus norvegicus
cagagcccgagcagacaggcgtaga

SEQ ID NO: 508860 - DNA, 25 bp, Rattus norvegicus
ctgggacacccggagtagtcaccgt

SEQ ID NO: 508861 - DNA, 25 bp, Rattus norvegicus
cactcggtcagtttacggctaggcg

SEQ ID NO: 508862 - DNA, 25 bp, Rattus norvegicus
gccagcacgcctaggtcctgggctg

SEQ ID NO: 508863 - DNA, 25 bp, Rattus norvegicus
cacagctgacgcacttgtggggatc

SEQ ID NO: 508864 - DNA, 25 bp, Rattus norvegicus
ctcccggatcttggcctctacggga

SEQ ID NO: 508865 - DNA, 25 bp, Rattus norvegicus
cgggacacgctcctttagggctaca

SEQ ID NO: 508866 - DNA, 25 bp, Rattus norvegicus
cctttagggctacagagattacttg

SEQ ID NO: 508867 - DNA, 25 bp, Rattus norvegicus
ggccaccagacgcacgctgtttaca

SEQ ID NO: 508868 - DNA, 25 bp, Rattus norvegicus
gattactagagagcgtgcggacacc

SEQ ID NO: 508869 - DNA, 25 bp, Rattus norvegicus
accctagcagcggaaaggccgtcgc

SEQ ID NO: 508870 - DNA, 25 bp, Rattus norvegicus
tccgcttcgttcactgcgggcttcg

SEQ ID NO: 508871 - DNA, 25 bp, Rattus norvegicus
ggctgcagtcggctgcccgtgtcct

SEQ ID NO: 508872 - DNA, 25 bp, Rattus norvegicus
tgcggacaccctagcagcggaaagg

SEQ ID NO: 508873 - DNA, 25 bp, Rattus norvegicus
ctcctgtttgaaagtcggggtgttg

SEQ ID NO: 508874 - DNA, 25 bp, Rattus norvegicus
gggcggcaaggctagaacttctccc

SEQ ID NO: 508875 - DNA, 25 bp, Rattus norvegicus
gtaggtcgcatgctctctcgcaacc

SEQ ID NO: 508876 - DNA, 25 bp, Rattus norvegicus
aggcgccgcgatcgttaacggctga

SEQ ID NO: 508877 - DNA, 25 bp, Rattus norvegicus
ccgctcatttttggggtaagccctg

SEQ ID NO: 508878 - DNA, 25 bp, Rattus norvegicus
cgggcaaggaaggagccgctcattt

SEQ ID NO: 508879 - DNA, 25 bp, Rattus norvegicus
gcgtcttctctcaggcggcccaggg

SEQ ID NO: 508880 - DNA, 25 bp, Rattus norvegicus
ggccatattgccgagctgtctgcgg

SEQ ID NO: 508881 - DNA, 25 bp, Rattus norvegicus
agccgtctttacctggggctgcagt

SEQ ID NO: 508882 - DNA, 25 bp, Rattus norvegicus
cctaggactcgccagaggacggcag

SEQ ID NO: 508883 - DNA, 25 bp, Rattus norvegicus
cgcgccacccacgtgcaatgtcttc

SEQ ID NO: 508884 - DNA, 25 bp, Rattus norvegicus
gctctcttgacttccttcgccgcca

SEQ ID NO: 508885 - DNA, 25 bp, Rattus norvegicus
cacggcatgctctggaagccgggcc

SEQ ID NO: 508886 - DNA, 25 bp, Rattus norvegicus
cagccatcacggcatgctctggaag

SEQ ID NO: 508887 - DNA, 25 bp, Rattus norvegicus
gtgcaatgtcttctccgcagccatc

SEQ ID NO: 508888 - DNA, 25 bp, Rattus norvegicus
gcaggatgcgctcagctttcccgct

SEQ ID NO: 508889 - DNA, 25 bp, Rattus norvegicus
tactggaccggcgttctaggccgcc

SEQ ID NO: 508890 - DNA, 25 bp, Rattus norvegicus
cgggagctactggaccggcgttcta

SEQ ID NO: 508891 - DNA, 25 bp, Rattus norvegicus
gatcacagccgtgggtccgtttccc

SEQ ID NO: 508892 - DNA, 25 bp, Rattus norvegicus
tggagatgccgggtgatgcctcacc

SEQ ID NO: 508893 - DNA, 25 bp, Rattus norvegicus
caggagagatggctaatgaaagcga

SEQ ID NO: 508894 - DNA, 25 bp, Rattus norvegicus
gttggtttccctaggactcgccaga

SEQ ID NO: 508895 - DNA, 25 bp, Rattus norvegicus
agatggctaatgaaagcgaacggcg

SEQ ID NO: 508896 - DNA, 25 bp, Rattus norvegicus
cgagacacctatctcctcaggagca

SEQ ID NO: 508897 - DNA, 25 bp, Rattus norvegicus
tcgtaattttgcatgaggcggctga

SEQ ID NO: 508898 - DNA, 25 bp, Rattus norvegicus
aggcggctgataccctcacgttcga

SEQ ID NO: 508899 - DNA, 25 bp, Rattus norvegicus
ttcgacctgccattccggcttctta

SEQ ID NO: 508900 - DNA, 25 bp, Rattus norvegicus
gttccttcttttggtgctgcctgtg

SEQ ID NO: 508901 - DNA, 25 bp, Rattus norvegicus
ggaactaggcgtgctctactgcttc

SEQ ID NO: 508902 - DNA, 25 bp, Rattus norvegicus
ctgacccagagaaccaaccgttttg

SEQ ID NO: 508903 - DNA, 25 bp, Rattus norvegicus
ttcttccagcggttgaagctcctca

SEQ ID NO: 508904 - DNA, 25 bp, Rattus norvegicus
ggcgtgcatagggtttccggaaaca

SEQ ID NO: 508905 - DNA, 25 bp, Rattus norvegicus
ctaaaactcagggagaagcgtgctc

SEQ ID NO: 508906 - DNA, 25 bp, Rattus norvegicus
ttggtaatttggcttccgcagggcg

SEQ ID NO: 508907 - DNA, 25 bp, Rattus norvegicus
tgcgcgaacgatgattggtaatttg

SEQ ID NO: 508908 - DNA, 25 bp, Rattus norvegicus
gtgggcacatattaatgacgacatc

SEQ ID NO: 508909 - DNA, 25 bp, Rattus norvegicus
ctcaggagcagcaaggaagacgcga

SEQ ID NO: 508910 - DNA, 25 bp, Rattus norvegicus
cctccctggccagcggagctgagag

SEQ ID NO: 508911 - DNA, 25 bp, Rattus norvegicus
ggaacttcactagctcgccaccagg

SEQ ID NO: 508912 - DNA, 25 bp, Rattus norvegicus
ccgtcacgtgatgcagatggccctt

SEQ ID NO: 508913 - DNA, 25 bp, Rattus norvegicus
gtgattaacttcaaaggccgggcca

SEQ ID NO: 508914 - DNA, 25 bp, Rattus norvegicus
cttcctggcttgcagggcgcgcttc

SEQ ID NO: 508915 - DNA, 25 bp, Rattus norvegicus
ccactgaggaccgttgggtgattaa

SEQ ID NO: 508916 - DNA, 25 bp, Rattus norvegicus
tcctaggcccgcagtgcagaacacg

SEQ ID NO: 508917 - DNA, 25 bp, Rattus norvegicus
ctcggacggccggaacttcactagc

SEQ ID NO: 508918 - DNA, 25 bp, Rattus norvegicus
tcttcctgcagtcggtggactcgga

SEQ ID NO: 508919 - DNA, 25 bp, Rattus norvegicus
tgcagatggcccttcctggcttgca

SEQ ID NO: 508920 - DNA, 25 bp, Rattus norvegicus
ctgcagctcgccctgctggtggcag

SEQ ID NO: 508921 - DNA, 25 bp, Rattus norvegicus
ggtgcacaacgacccagtcggggtc

SEQ ID NO: 508922 - DNA, 25 bp, Rattus norvegicus
ctgggcgcggtgcacaacgacccag

SEQ ID NO: 508923 - DNA, 25 bp, Rattus norvegicus
gtgcgctacttcttcctgcagtcgg

SEQ ID NO: 508924 - DNA, 25 bp, Rattus norvegicus
cgccgtgtttgctctgagttgagtc

SEQ ID NO: 508925 - DNA, 25 bp, Rattus norvegicus
tctgctcgcgtccaagttcaggcta

SEQ ID NO: 508926 - DNA, 25 bp, Rattus norvegicus
cgggtttcatttcggcgcctttctg

SEQ ID NO: 508927 - DNA, 25 bp, Rattus norvegicus
cctaccgttgcattctggctgccaa

SEQ ID NO: 508928 - DNA, 25 bp, Rattus norvegicus
gcctcggacatttgaagcttccttg

SEQ ID NO: 508929 - DNA, 25 bp, Rattus norvegicus
gatcatgctgttaccctcggatgta

SEQ ID NO: 508930 - DNA, 25 bp, Rattus norvegicus
ctccctgtgcagctcggatcatgct

SEQ ID NO: 508931 - DNA, 25 bp, Rattus norvegicus
gagttgagtctcgtcccttcaggcg

SEQ ID NO: 508932 - DNA, 25 bp, Rattus norvegicus
ctgtctcccgcggaagcgattggtt

SEQ ID NO: 508933 - DNA, 25 bp, Rattus norvegicus
ccctcaaaacattcagcgggcctga

SEQ ID NO: 508934 - DNA, 25 bp, Rattus norvegicus
tgcgcctagggatcacgagcttccc

SEQ ID NO: 508935 - DNA, 25 bp, Rattus norvegicus
gccttttcccgcgtgcacggatcta

SEQ ID NO: 508936 - DNA, 25 bp, Rattus norvegicus
tgccaaggcaaacccaggtcgcttc

SEQ ID NO: 508937 - DNA, 25 bp, Rattus norvegicus
gggatgtcccttttcaccgtgctgc

SEQ ID NO: 508938 - DNA, 25 bp, Rattus norvegicus
gcggtgtgcgacagcagcaaagaca

SEQ ID NO: 508939 - DNA, 25 bp, Rattus norvegicus
ggacgacgccgtgtagaaccgccag

SEQ ID NO: 508940 - DNA, 25 bp, Rattus norvegicus
ctcagcggcgattggcccgtagcca

SEQ ID NO: 508941 - DNA, 25 bp, Rattus norvegicus
ctccaatagcagtcagagatcgctg

SEQ ID NO: 508942 - DNA, 25 bp, Rattus norvegicus
cttgtcaagggcagagagacgcgca

SEQ ID NO: 508943 - DNA, 25 bp, Rattus norvegicus
ccatggagaccggaaaagcttgtca

SEQ ID NO: 508944 - DNA, 25 bp, Rattus norvegicus
gtgtagaaccgccagggcagccatg

SEQ ID NO: 508945 - DNA, 25 bp, Rattus norvegicus
ccggaattgaacctgctcacctgca

SEQ ID NO: 508946 - DNA, 25 bp, Rattus norvegicus
cttgcagagcactgtggcccgcgag

SEQ ID NO: 508947 - DNA, 25 bp, Rattus norvegicus
actagacacccgaggcgctcttgca

SEQ ID NO: 508948 - DNA, 25 bp, Rattus norvegicus
gacacacgactacgcggccactaga

SEQ ID NO: 508949 - DNA, 25 bp, Rattus norvegicus
cagcaaagacagactggtggacaca

SEQ ID NO: 508950 - DNA, 25 bp, Rattus norvegicus
acgccttactgcacagccggtgcgg

SEQ ID NO: 508951 - DNA, 25 bp, Rattus norvegicus
actggtggacacacgactacgcggc

SEQ ID NO: 508952 - DNA, 25 bp, Rattus norvegicus
tccgagtcagtcaatcagccggcgg

SEQ ID NO: 508953 - DNA, 25 bp, Rattus norvegicus
gggaggaaccaccagatcctctgga

SEQ ID NO: 508954 - DNA, 25 bp, Rattus norvegicus
agctgaacgcgtcggtcaccgagca

SEQ ID NO: 508955 - DNA, 25 bp, Rattus norvegicus
tgcagtcaggggcttacctttaaca

SEQ ID NO: 508956 - DNA, 25 bp, Rattus norvegicus
ctttaacagattagacgtcgccatg

SEQ ID NO: 508957 - DNA, 25 bp, Rattus norvegicus
gacgtcgccatgttctcaacttgga

SEQ ID NO: 508958 - DNA, 25 bp, Rattus norvegicus
tcaacttggactctcgcgagacgcg

SEQ ID NO: 508959 - DNA, 25 bp, Rattus norvegicus
aggcacccgtgcttcctcgggcttt

SEQ ID NO: 508960 - DNA, 25 bp, Rattus norvegicus
cccacgcgagagagcgcatgcaaac

SEQ ID NO: 508961 - DNA, 25 bp, Rattus norvegicus
aactcgtcttcggttctgcctctgg

SEQ ID NO: 508962 - DNA, 25 bp, Rattus norvegicus
ggccgccagcaacgactttagctcg

SEQ ID NO: 508963 - DNA, 25 bp, Rattus norvegicus
actttagctcggcttagggcccgca

SEQ ID NO: 508964 - DNA, 25 bp, Rattus norvegicus
tcgggagcaacccaggcgatagcaa

SEQ ID NO: 508965 - DNA, 25 bp, Rattus norvegicus
gcgatagcaagccactgggtcccga

SEQ ID NO: 508966 - DNA, 25 bp, Rattus norvegicus
gcccagtgcgctcaggagcaagttc

SEQ ID NO: 508967 - DNA, 25 bp, Rattus norvegicus
cttgcctaccgtggagtcaccgatc

SEQ ID NO: 508968 - DNA, 25 bp, Rattus norvegicus
gcgaccctggttcggacaggaaaga

SEQ ID NO: 508969 - DNA, 25 bp, Rattus norvegicus
acgatgaggcggaactggtagatcc

SEQ ID NO: 508970 - DNA, 25 bp, Rattus norvegicus
tggtagatccaaatagcctccatcg

SEQ ID NO: 508971 - DNA, 25 bp, Rattus norvegicus
cggtgcagaaggcacgacttgccta

SEQ ID NO: 508972 - DNA, 25 bp, Rattus norvegicus
cgcgagaagaagtccacgccgactg

SEQ ID NO: 508973 - DNA, 25 bp, Rattus norvegicus
cagcttgatcctcttgcctggctca

SEQ ID NO: 508974 - DNA, 25 bp, Rattus norvegicus
gccgtgtcccaaagctgcagcttga

SEQ ID NO: 508975 - DNA, 25 bp, Rattus norvegicus
gtggcgcgttcctccctacctgaat

SEQ ID NO: 508976 - DNA, 25 bp, Rattus norvegicus
tagcactttcgagagcctgtggcgc

SEQ ID NO: 508977 - DNA, 25 bp, Rattus norvegicus
gcgagcaccgagcactagcactttc

SEQ ID NO: 508978 - DNA, 25 bp, Rattus norvegicus
gggcgcaggaaatccgcactaaata

SEQ ID NO: 508979 - DNA, 25 bp, Rattus norvegicus
gttctgccgaaggaactgtcccttc

SEQ ID NO: 508980 - DNA, 25 bp, Rattus norvegicus
tatcggcagccaactgagcaggatc

SEQ ID NO: 508981 - DNA, 25 bp, Rattus norvegicus
acggtgggcagtatcggcagccaac

SEQ ID NO: 508982 - DNA, 25 bp, Rattus norvegicus
actgagcaggatccgaggcaaactc

SEQ ID NO: 508983 - DNA, 25 bp, Rattus norvegicus
aggcaaactcttcacctggtgagtg

SEQ ID NO: 508984 - DNA, 25 bp, Rattus norvegicus
tcttcacctggtgagtgcagcgcgc

SEQ ID NO: 508985 - DNA, 25 bp, Rattus norvegicus
cttctccgggttccggacacgcgag

SEQ ID NO: 508986 - DNA, 25 bp, Rattus norvegicus
tacccgcgcgcacgtgtctgcggag

SEQ ID NO: 508987 - DNA, 25 bp, Rattus norvegicus
cccatggaggctgagtcgcccgcta

SEQ ID NO: 508988 - DNA, 25 bp, Rattus norvegicus
ggctcctcgacctcggttccttgcg

SEQ ID NO: 508989 - DNA, 25 bp, Rattus norvegicus
ctaggcgagcgtactagcgagcgca

SEQ ID NO: 508990 - DNA, 25 bp, Rattus norvegicus
cgagtccgcgctatcctcacaggca

SEQ ID NO: 508991 - DNA, 25 bp, Rattus norvegicus
taccgggacctaggcgagcgtacta

SEQ ID NO: 508992 - DNA, 25 bp, Rattus norvegicus
agtcgcccgctagcacgagggccag

SEQ ID NO: 508993 - DNA, 25 bp, Rattus norvegicus
acacgcgaggctcgtagggacccca

SEQ ID NO: 508994 - DNA, 25 bp, Rattus norvegicus
ggccaggccatcgtgtcgtgatgac

SEQ ID NO: 508995 - DNA, 25 bp, Rattus norvegicus
caggccatcgtgttgtgacgacgta

SEQ ID NO: 508996 - DNA, 25 bp, Rattus norvegicus
caggccatcgtgtcgtgacgacgta

SEQ ID NO: 508997 - DNA, 25 bp, Rattus norvegicus
gacgacgtagtagctttggtggcca

SEQ ID NO: 508998 - DNA, 25 bp, Rattus norvegicus
ccaggccatcgtgtcgtgacgacgt

SEQ ID NO: 508999 - DNA, 25 bp, Rattus norvegicus
caggccatcgtgtcgtgatgacgta

SEQ ID NO: 509000 - DNA, 25 bp, Rattus norvegicus
acgacgtagtagctttggtggccag

SEQ ID NO: 509001 - DNA, 25 bp, Rattus norvegicus
agtagctttggtggccaggccatcg

SEQ ID NO: 509002 - DNA, 25 bp, Rattus norvegicus
gccatcgtgttgtgacgacgtagta

SEQ ID NO: 509003 - DNA, 25 bp, Rattus norvegicus
gccatcgtgtcgtgatgacgtagta

SEQ ID NO: 509004 - DNA, 25 bp, Rattus norvegicus
tgtcgtgacgacgtagtagctttgg

SEQ ID NO: 509005 - DNA, 25 bp, Rattus norvegicus
acgtagtagctttggtggccaggcc

SEQ ID NO: 509006 - DNA, 25 bp, Rattus norvegicus
gtgtcgtgacgacgtagtagctttg

SEQ ID NO: 509007 - DNA, 25 bp, Rattus norvegicus
cgtgtcgtgacgacgtagtagcttt

SEQ ID NO: 509008 - DNA, 25 bp, Rattus norvegicus
cccgctccgggtgaacattgctgat

SEQ ID NO: 509009 - DNA, 25 bp, Rattus norvegicus
gaatcaatccgcagatagcagagga

SEQ ID NO: 509010 - DNA, 25 bp, Rattus norvegicus
aatccgcagatagcagaggaaggcg

SEQ ID NO: 509011 - DNA, 25 bp, Rattus norvegicus
gcccggatagcaggccagcgtgctc

SEQ ID NO: 509012 - DNA, 25 bp, Rattus norvegicus
agcaggccagcgtgctccgtcacgt

SEQ ID NO: 509013 - DNA, 25 bp, Rattus norvegicus
gctccgtcacgttcccgcgtggagt

SEQ ID NO: 509014 - DNA, 25 bp, Rattus norvegicus
gtcaagggaccgctgcgtgcgctcc

SEQ ID NO: 509015 - DNA, 25 bp, Rattus norvegicus
gctccgggtgaacattgctgatgtg

SEQ ID NO: 509016 - DNA, 25 bp, Rattus norvegicus
aacattgctgatgtgtgaggagcgc

SEQ ID NO: 509017 - DNA, 25 bp, Rattus norvegicus
cccgaagtgctgtctgccagagcgg

SEQ ID NO: 509018 - DNA, 25 bp, Rattus norvegicus
tctgccagagcggagctgtcgctta

SEQ ID NO: 509019 - DNA, 25 bp, Rattus norvegicus
cggagctgtcgcttagcaacgcacc

SEQ ID NO: 509020 - DNA, 25 bp, Rattus norvegicus
tgtcgcttagcaacgcaccatcttc

SEQ ID NO: 509021 - DNA, 25 bp, Rattus norvegicus
tcgctgcacgcgagaggtcaaggga

SEQ ID NO: 509022 - DNA, 25 bp, Rattus norvegicus
cgctcaggatgagaaagaggattta

SEQ ID NO: 509023 - DNA, 25 bp, Rattus norvegicus
ggacgcaaacagcttccagcgctga

SEQ ID NO: 509024 - DNA, 25 bp, Rattus norvegicus
atttagtctcgggtgactctggcgc

SEQ ID NO: 509025 - DNA, 25 bp, Rattus norvegicus
cacccaggttgtgcgcactttcatc

SEQ ID NO: 509026 - DNA, 25 bp, Rattus norvegicus
ttttgtaccctacacaggtcagccg

SEQ ID NO: 509027 - DNA, 25 bp, Rattus norvegicus
cctctcttttctccaagggcattca

SEQ ID NO: 509028 - DNA, 25 bp, Rattus norvegicus
gggcattcacccttggctcctcggg

SEQ ID NO: 509029 - DNA, 25 bp, Rattus norvegicus
gctcagcagttctgggatcgcgaca

SEQ ID NO: 509030 - DNA, 25 bp, Rattus norvegicus
gatcgcgacagcgtggtctccatct

SEQ ID NO: 509031 - DNA, 25 bp, Rattus norvegicus
tgctacgcactagcgaccgtgatcg

SEQ ID NO: 509032 - DNA, 25 bp, Rattus norvegicus
tggagccctgcaagccgggatgcac

SEQ ID NO: 509033 - DNA, 25 bp, Rattus norvegicus
catgcagaggtttccctgggagcaa

SEQ ID NO: 509034 - DNA, 25 bp, Rattus norvegicus
gcgactcaccgggtcagggacagca

SEQ ID NO: 509035 - DNA, 25 bp, Rattus norvegicus
agtggcgttcagtcgctaggcgacc

SEQ ID NO: 509036 - DNA, 25 bp, Rattus norvegicus
ctaaaggcagcttgactcacgactc

SEQ ID NO: 509037 - DNA, 25 bp, Rattus norvegicus
gcaataagcgcagccacggcggcga

SEQ ID NO: 509038 - DNA, 25 bp, Rattus norvegicus
cccatgagtgcagcgcgcaataagc

SEQ ID NO: 509039 - DNA, 25 bp, Rattus norvegicus
tgaattaagtcgtgcgccagcccga

SEQ ID NO: 509040 - DNA, 25 bp, Rattus norvegicus
cctacgcgcctttctagctgaatta

SEQ ID NO: 509041 - DNA, 25 bp, Rattus norvegicus
accgtgttcgtgctgtaccagtggc

SEQ ID NO: 509042 - DNA, 25 bp, Rattus norvegicus
agacatgacccgagccgcagagcga

SEQ ID NO: 509043 - DNA, 25 bp, Rattus norvegicus
gccctgagtcgttcggcctgagcac

SEQ ID NO: 509044 - DNA, 25 bp, Rattus norvegicus
ccactcgcgcgagggtataaaacct

SEQ ID NO: 509045 - DNA, 25 bp, Rattus norvegicus
ccgcctcgccagacgggtctaaagg

SEQ ID NO: 509046 - DNA, 25 bp, Rattus norvegicus
acggcggcgagcctgcgtcacacat

SEQ ID NO: 509047 - DNA, 25 bp, Rattus norvegicus
cgctgctgtcagtgctgaacgccgt

SEQ ID NO: 509048 - DNA, 25 bp, Rattus norvegicus
gggtataaaacctgccactgcggga

SEQ ID NO: 509049 - DNA, 25 bp, Rattus norvegicus
gcctgagcacagagacatgacccga

SEQ ID NO: 509050 - DNA, 25 bp, Rattus norvegicus
aagaacgcgctcacactagcagtcg

SEQ ID NO: 509051 - DNA, 25 bp, Rattus norvegicus
tcggtgcggaaatgcccggatgctc

SEQ ID NO: 509052 - DNA, 25 bp, Rattus norvegicus
ggaaatgcccggatgctcccacggc

SEQ ID NO: 509053 - DNA, 25 bp, Rattus norvegicus
acggcctgccgcaccggcgcacagt

SEQ ID NO: 509054 - DNA, 25 bp, Rattus norvegicus
cgacacggagggaaaagaacgcgct

SEQ ID NO: 509055 - DNA, 25 bp, Rattus norvegicus
acggagggaaaagaacgcgctcaca

SEQ ID NO: 509056 - DNA, 25 bp, Rattus norvegicus
gagggaaaagaacgcgctcacacta

SEQ ID NO: 509057 - DNA, 25 bp, Rattus norvegicus
gaacgcgctcacactagcagtcgcg

SEQ ID NO: 509058 - DNA, 25 bp, Rattus norvegicus
tcacactagcagtcgcgctctcggc

SEQ ID NO: 509059 - DNA, 25 bp, Rattus norvegicus
agtctccaggacaactgcgcgcgcc

SEQ ID NO: 509060 - DNA, 25 bp, Rattus norvegicus
gtcgcacggaccctctgtgccgatt

SEQ ID NO: 509061 - DNA, 25 bp, Rattus norvegicus
acggaccctctgtgccgattgcgcg

SEQ ID NO: 509062 - DNA, 25 bp, Rattus norvegicus
cgcgcgcagacgtgcgggagttccc

SEQ ID NO: 509063 - DNA, 25 bp, Rattus norvegicus
ctctgtgccgattgcgcgcgcagac

SEQ ID NO: 509064 - DNA, 25 bp, Rattus norvegicus
cctgatctctcagcctttgaccgga

SEQ ID NO: 509065 - DNA, 25 bp, Rattus norvegicus
cgttgagcgaagcaaagacccgagc

SEQ ID NO: 509066 - DNA, 25 bp, Rattus norvegicus
aaggctagcgcgagaggtttttcga

SEQ ID NO: 509067 - DNA, 25 bp, Rattus norvegicus
gacgatgattggtcagctagcggca

SEQ ID NO: 509068 - DNA, 25 bp, Rattus norvegicus
tttgaccggataaaggctagcgcga

SEQ ID NO: 509069 - DNA, 25 bp, Rattus norvegicus
actggggcgccagctacgcgcatgc

SEQ ID NO: 509070 - DNA, 25 bp, Rattus norvegicus
tgtccaaggtgagcgctacagggca

SEQ ID NO: 509071 - DNA, 25 bp, Rattus norvegicus
tacagggcagcaagctcgcggacga

SEQ ID NO: 509072 - DNA, 25 bp, Rattus norvegicus
cgtcaaggtcaaggcggcccgtact

SEQ ID NO: 509073 - DNA, 25 bp, Rattus norvegicus
tccaggataggagcacaggcctcgc

SEQ ID NO: 509074 - DNA, 25 bp, Rattus norvegicus
ggccctgtcacctgcaagtctcggg

SEQ ID NO: 509075 - DNA, 25 bp, Rattus norvegicus
aagtctcggggcagcacgcccaggt

SEQ ID NO: 509076 - DNA, 25 bp, Rattus norvegicus
gctggacccgctgtcacgtcatcaa

SEQ ID NO: 509077 - DNA, 25 bp, Rattus norvegicus
aggctgtgatctcgcttcatggatg

SEQ ID NO: 509078 - DNA, 25 bp, Rattus norvegicus
ggcgctcaagtaccacccagacaag

SEQ ID NO: 509079 - DNA, 25 bp, Rattus norvegicus
tggcggcaatcagaactggagctcc

SEQ ID NO: 509080 - DNA, 25 bp, Rattus norvegicus
gaggccctcctgcaagccagcggat

SEQ ID NO: 509081 - DNA, 25 bp, Rattus norvegicus
gagcatcccaacatggcccgtggcg

SEQ ID NO: 509082 - DNA, 25 bp, Rattus norvegicus
gaaggagacccagtactatgacatc

SEQ ID NO: 509083 - DNA, 25 bp, Rattus norvegicus
ccagcggatctcagagcggcctaac

SEQ ID NO: 509084 - DNA, 25 bp, Rattus norvegicus
ccagaggagcagacttccgaggaga

SEQ ID NO: 509085 - DNA, 25 bp, Rattus norvegicus
gccagtcggagagccatccgtgcct

SEQ ID NO: 509086 - DNA, 25 bp, Rattus norvegicus
ctccgcgaacgttctgggcctttgt

SEQ ID NO: 509087 - DNA, 25 bp, Rattus norvegicus
cacccagacaagaacccggatgagg

SEQ ID NO: 509088 - DNA, 25 bp, Rattus norvegicus
ctatcggaagctggcgctcaagtac

SEQ ID NO: 509089 - DNA, 25 bp, Rattus norvegicus
ggcctttgtggcgtcacgcctcctg

SEQ ID NO: 509090 - DNA, 25 bp, Rattus norvegicus
aggacccgggctgtgaattattgaa

SEQ ID NO: 509091 - DNA, 25 bp, Rattus norvegicus
ccacgcaagggcaaggggccagcct

SEQ ID NO: 509092 - DNA, 25 bp, Rattus norvegicus
aagtctgtgtgacctgatggtccta

SEQ ID NO: 509093 - DNA, 25 bp, Rattus norvegicus
ccttgacccgttgcagggtgtgtca

SEQ ID NO: 509094 - DNA, 25 bp, Rattus norvegicus
cggagatcaacttcaaggtcggaga

SEQ ID NO: 509095 - DNA, 25 bp, Rattus norvegicus
cggtgcgcaccacggagatcaactt

SEQ ID NO: 509096 - DNA, 25 bp, Rattus norvegicus
tacatcaagacatccactacggtgc

SEQ ID NO: 509097 - DNA, 25 bp, Rattus norvegicus
ccaggacggggatcagttctacatc

SEQ ID NO: 509098 - DNA, 25 bp, Rattus norvegicus
cggctgcgtccaagccgcacgtgga

SEQ ID NO: 509099 - DNA, 25 bp, Rattus norvegicus
accggagcctgtgtttccttgcgca

SEQ ID NO: 509100 - DNA, 25 bp, Rattus norvegicus
tactccggttcctctcatactaatc

SEQ ID NO: 509101 - DNA, 25 bp, Rattus norvegicus
ccaagcgccaagaggcgcgcgcttt

SEQ ID NO: 509102 - DNA, 25 bp, Rattus norvegicus
atgtccttgcggtggttagtgctac

SEQ ID NO: 509103 - DNA, 25 bp, Rattus norvegicus
ttagtgctacgctagcagcgccttc

SEQ ID NO: 509104 - DNA, 25 bp, Rattus norvegicus
gcgccttcagcgctagctctggcag

SEQ ID NO: 509105 - DNA, 25 bp, Rattus norvegicus
tttccttgcgcaggtgtgaacgcca

SEQ ID NO: 509106 - DNA, 25 bp, Rattus norvegicus
ccaccctcagtctggaaaacaacgg

SEQ ID NO: 509107 - DNA, 25 bp, Rattus norvegicus
agtgcgctgctatacgccgtggcgc

SEQ ID NO: 509108 - DNA, 25 bp, Rattus norvegicus
agccgggcgcttattccgccactgg

SEQ ID NO: 509109 - DNA, 25 bp, Rattus norvegicus
ttcttacggtcacccggggcgcagc

SEQ ID NO: 509110 - DNA, 25 bp, Rattus norvegicus
cgtggcgcttgctttgcttttctta

SEQ ID NO: 509111 - DNA, 25 bp, Rattus norvegicus
ccgcagggataatatggtctccggc

SEQ ID NO: 509112 - DNA, 25 bp, Rattus norvegicus
tgtctgcgcgagactgcttccttcc

SEQ ID NO: 509113 - DNA, 25 bp, Rattus norvegicus
ttagacggcaaatcccgcgagcgcg

SEQ ID NO: 509114 - DNA, 25 bp, Rattus norvegicus
ctcgcgagagttagacggcaaatcc

SEQ ID NO: 509115 - DNA, 25 bp, Rattus norvegicus
tttcgccggcccgaagatctcgcga

SEQ ID NO: 509116 - DNA, 25 bp, Rattus norvegicus
ccaagtgcaggtcagttcccggccg

SEQ ID NO: 509117 - DNA, 25 bp, Rattus norvegicus
tcaaagttactaccgctcagggctc

SEQ ID NO: 509118 - DNA, 25 bp, Rattus norvegicus
tggaaaacaacggagaatgcgcagc

SEQ ID NO: 509119 - DNA, 25 bp, Rattus norvegicus
ccatagcgtcccgtcgtcaaagtta

SEQ ID NO: 509120 - DNA, 25 bp, Rattus norvegicus
tccaaatcttgtggcgccggcgcca

SEQ ID NO: 509121 - DNA, 25 bp, Rattus norvegicus
gggagccatattcgccgccgatgct

SEQ ID NO: 509122 - DNA, 25 bp, Rattus norvegicus
gcccagcgagtcaatttgggaaagt

SEQ ID NO: 509123 - DNA, 25 bp, Rattus norvegicus
agctgcggggaaagtccaaatcttg

SEQ ID NO: 509124 - DNA, 25 bp, Rattus norvegicus
tctgagacccactgagccggtgcaa

SEQ ID NO: 509125 - DNA, 25 bp, Rattus norvegicus
gccatgggcacgatgactttgcacc

SEQ ID NO: 509126 - DNA, 25 bp, Rattus norvegicus
atctgcgtggagaccacggcccagg

SEQ ID NO: 509127 - DNA, 25 bp, Rattus norvegicus
ccgcaaaagtgaggtgtctgtctcc

SEQ ID NO: 509128 - DNA, 25 bp, Rattus norvegicus
ttcctccggtgaggctcagtccttt

SEQ ID NO: 509129 - DNA, 25 bp, Rattus norvegicus
gtaaagcggcgctgatctgcaccct

SEQ ID NO: 509130 - DNA, 25 bp, Rattus norvegicus
ttcttctccagctgagtaaagcggc

SEQ ID NO: 509131 - DNA, 25 bp, Rattus norvegicus
atccgggttggttcttctccagctg

SEQ ID NO: 509132 - DNA, 25 bp, Rattus norvegicus
tgttcacagtcgaatccgaaacccg

SEQ ID NO: 509133 - DNA, 25 bp, Rattus norvegicus
cgtggaggtagctgtgttcacagtc

SEQ ID NO: 509134 - DNA, 25 bp, Rattus norvegicus
cgcggatcttccacggagcagcgag

SEQ ID NO: 509135 - DNA, 25 bp, Rattus norvegicus
tcggactccgcggatcttccacgga

SEQ ID NO: 509136 - DNA, 25 bp, Rattus norvegicus
gccaggcgccacagctccgccctcg

SEQ ID NO: 509137 - DNA, 25 bp, Rattus norvegicus
tccgcggatcttccacggagcagcg

SEQ ID NO: 509138 - DNA, 25 bp, Rattus norvegicus
gagcagcgaggtgggcttcgttcag

SEQ ID NO: 509139 - DNA, 25 bp, Rattus norvegicus
ttcgttcaggcgctgaagagcgagc

SEQ ID NO: 509140 - DNA, 25 bp, Rattus norvegicus
cgctgaagagcgagcggcgagcggc

SEQ ID NO: 509141 - DNA, 25 bp, Rattus norvegicus
cgagcggcgagagacacccgaggaa

SEQ ID NO: 509142 - DNA, 25 bp, Rattus norvegicus
agacacccgaggaacgagaggagtt

SEQ ID NO: 509143 - DNA, 25 bp, Rattus norvegicus
acacccgaggaacgagaggagttcg

SEQ ID NO: 509144 - DNA, 25 bp, Rattus norvegicus
gagttcggcggcagcccgcttgctc

SEQ ID NO: 509145 - DNA, 25 bp, Rattus norvegicus
ctcggggtccggagttatccgcgag

SEQ ID NO: 509146 - DNA, 25 bp, Rattus norvegicus
agttatccgcgaggcggccgtcggc

SEQ ID NO: 509147 - DNA, 25 bp, Rattus norvegicus
gactccgcggatcttccacggagca

SEQ ID NO: 509148 - DNA, 25 bp, Rattus norvegicus
tgggcttaatgctcgctcgcctttg

SEQ ID NO: 509149 - DNA, 25 bp, Rattus norvegicus
atatctccgtacctcgtcgctttgg

SEQ ID NO: 509150 - DNA, 25 bp, Rattus norvegicus
ggcttcgggactcatgacttatatc

SEQ ID NO: 509151 - DNA, 25 bp, Rattus norvegicus
cgaaatgctaggcagttaacatccc

SEQ ID NO: 509152 - DNA, 25 bp, Rattus norvegicus
gcaaacgtttgctgacgaaatgcta

SEQ ID NO: 509153 - DNA, 25 bp, Rattus norvegicus
ctcgcctttgagactttgtaaccta

SEQ ID NO: 509154 - DNA, 25 bp, Rattus norvegicus
acggtgtggagactttgggcttaat

SEQ ID NO: 509155 - DNA, 25 bp, Rattus norvegicus
tttcggtgttcggtggctgtcaccg

SEQ ID NO: 509156 - DNA, 25 bp, Rattus norvegicus
cccactttgtggctcgttcacggtg

SEQ ID NO: 509157 - DNA, 25 bp, Rattus norvegicus
gctgtcatcgggcttcccactttgt

SEQ ID NO: 509158 - DNA, 25 bp, Rattus norvegicus
tttcctagagcttgccgctgtcatc

SEQ ID NO: 509159 - DNA, 25 bp, Rattus norvegicus
ggcgtgcctcggtacaactttccta

SEQ ID NO: 509160 - DNA, 25 bp, Rattus norvegicus
gtcgctttggaacacagctcgctca

SEQ ID NO: 509161 - DNA, 25 bp, Rattus norvegicus
ctgcagcgtctttgctagaagaagc

SEQ ID NO: 509162 - DNA, 25 bp, Rattus norvegicus
cccacgctggaggttctcactcacc

SEQ ID NO: 509163 - DNA, 25 bp, Rattus norvegicus
agcgcgctctcagccgcaaaagttg

SEQ ID NO: 509164 - DNA, 25 bp, Rattus norvegicus
atgcgagcgcgctctcagccgcaaa

SEQ ID NO: 509165 - DNA, 25 bp, Rattus norvegicus
cgcccgcgctcacatgccgggtgcc

SEQ ID NO: 509166 - DNA, 25 bp, Rattus norvegicus
cccggggaccgtgtgtccagcgcca

SEQ ID NO: 509167 - DNA, 25 bp, Rattus norvegicus
cgcctctggggacacgtccggaacg

SEQ ID NO: 509168 - DNA, 25 bp, Rattus norvegicus
agccgcaaaagttgtgcgagccgcg

SEQ ID NO: 509169 - DNA, 25 bp, Rattus norvegicus
aggttctcactcacccgcgctcacg

SEQ ID NO: 509170 - DNA, 25 bp, Rattus norvegicus
ggccctggtggaacagccccctaga

SEQ ID NO: 509171 - DNA, 25 bp, Rattus norvegicus
agggtccatggaaccgcgcggccct

SEQ ID NO: 509172 - DNA, 25 bp, Rattus norvegicus
cacgcctctggggacacgtccggaa

SEQ ID NO: 509173 - DNA, 25 bp, Rattus norvegicus
tgccacacgccaatcagcccgggcg

SEQ ID NO: 509174 - DNA, 25 bp, Rattus norvegicus
gctctcagccgcaaaagttgtgcga

SEQ ID NO: 509175 - DNA, 25 bp, Rattus norvegicus
cccgttgctgccacacgccaatcag

SEQ ID NO: 509176 - DNA, 25 bp, Rattus norvegicus
gtgggcactgtcagcgtctatcctt

SEQ ID NO: 509177 - DNA, 25 bp, Rattus norvegicus
cgcacagtgggcactgtcagcgtct

SEQ ID NO: 509178 - DNA, 25 bp, Rattus norvegicus
atccttagtgcgcacagtgggcact

SEQ ID NO: 509179 - DNA, 25 bp, Rattus norvegicus
ccttagcgcgcacagcggacactgt

SEQ ID NO: 509180 - DNA, 25 bp, Rattus norvegicus
tctatccttagtgcgcacagtgggc

SEQ ID NO: 509181 - DNA, 25 bp, Rattus norvegicus
gacactgtcagcgtctatccttagc

SEQ ID NO: 509182 - DNA, 25 bp, Rattus norvegicus
tgggcactgtcagcgtctatcctta

SEQ ID NO: 509183 - DNA, 25 bp, Rattus norvegicus
cggacactgtcagcgtctatcctta

SEQ ID NO: 509184 - DNA, 25 bp, Rattus norvegicus
cttagcgcgcacagcggacactgtc

SEQ ID NO: 509185 - DNA, 25 bp, Rattus norvegicus
cgtctatccttagcgcgcacagcgg

SEQ ID NO: 509186 - DNA, 25 bp, Rattus norvegicus
cagcggacactgtcagcgtctatcc

SEQ ID NO: 509187 - DNA, 25 bp, Rattus norvegicus
cagcgtctatccttagcgcgcacag

SEQ ID NO: 509188 - DNA, 25 bp, Rattus norvegicus
ttagcgcgcacagcggacactgtca

SEQ ID NO: 509189 - DNA, 25 bp, Rattus norvegicus
ggcactgtcagcgtctatccttagt

SEQ ID NO: 509190 - DNA, 25 bp, Rattus norvegicus
aaagccgtgcgggaaactgagccct

SEQ ID NO: 509191 - DNA, 25 bp, Rattus norvegicus
gctactcaagtgctggcaccgcgga

SEQ ID NO: 509192 - DNA, 25 bp, Rattus norvegicus
tcggaccacggtctcctgcgtcgat

SEQ ID NO: 509193 - DNA, 25 bp, Rattus norvegicus
gaccaccgaagcacagctactcaag

SEQ ID NO: 509194 - DNA, 25 bp, Rattus norvegicus
gagccactctggtgctgaccaccga

SEQ ID NO: 509195 - DNA, 25 bp, Rattus norvegicus
gagcagcacaacacccatgtctaag

SEQ ID NO: 509196 - DNA, 25 bp, Rattus norvegicus
caccagcatcagcatggacagcggc

SEQ ID NO: 509197 - DNA, 25 bp, Rattus norvegicus
cgagtgggtgccttgacttctaagg

SEQ ID NO: 509198 - DNA, 25 bp, Rattus norvegicus
atcacgctgagatccaaggcgagtg

SEQ ID NO: 509199 - DNA, 25 bp, Rattus norvegicus
aggcagaactgtgggatcacgctga

SEQ ID NO: 509200 - DNA, 25 bp, Rattus norvegicus
ccttagctaattggcggctttggga

SEQ ID NO: 509201 - DNA, 25 bp, Rattus norvegicus
tgggctagcctcgagccttagctaa

SEQ ID NO: 509202 - DNA, 25 bp, Rattus norvegicus
tctatctaccgagcagaaccggaga

SEQ ID NO: 509203 - DNA, 25 bp, Rattus norvegicus
accggagactccgttctgggctagc

SEQ ID NO: 509204 - DNA, 25 bp, Rattus norvegicus
ttccgcatcgtcagctggaagctgg

SEQ ID NO: 509205 - DNA, 25 bp, Rattus norvegicus
gacgagctgcactgccagttcctgg

SEQ ID NO: 509206 - DNA, 25 bp, Rattus norvegicus
cggtgtcgctgttgcccttttaagc

SEQ ID NO: 509207 - DNA, 25 bp, Rattus norvegicus
ctcctgcgggtggagtcggttacaa

SEQ ID NO: 509208 - DNA, 25 bp, Rattus norvegicus
gtcggttacaaaggcagcagccggc

SEQ ID NO: 509209 - DNA, 25 bp, Rattus norvegicus
gaggcctcgagctcctcgccatttt

SEQ ID NO: 509210 - DNA, 25 bp, Rattus norvegicus
ggaagatgtccgtgtcagggctcaa

SEQ ID NO: 509211 - DNA, 25 bp, Rattus norvegicus
gccgcacacgtgtctggccagaggc

SEQ ID NO: 509212 - DNA, 25 bp, Rattus norvegicus
tcaaggccgagctgaagttcctggc

SEQ ID NO: 509213 - DNA, 25 bp, Rattus norvegicus
cgcagtcccgggacaaagggcgcca

SEQ ID NO: 509214 - DNA, 25 bp, Rattus norvegicus
aagaaccacgagctattccgcatcg

SEQ ID NO: 509215 - DNA, 25 bp, Rattus norvegicus
tcagctggaagctggacgagctgca

SEQ ID NO: 509216 - DNA, 25 bp, Rattus norvegicus
gccgccagcccaaatcctccgggta

SEQ ID NO: 509217 - DNA, 25 bp, Rattus norvegicus
tcttcgacaagaaccacgagctatt

SEQ ID NO: 509218 - DNA, 25 bp, Rattus norvegicus
tgcctctgagcctccgtagggcttt

SEQ ID NO: 509219 - DNA, 25 bp, Rattus norvegicus
ccacctggagggacattgcttggtc

SEQ ID NO: 509220 - DNA, 25 bp, Rattus norvegicus
ttaagcgccaggctgcatccgttcc

SEQ ID NO: 509221 - DNA, 25 bp, Rattus norvegicus
tgcatccgttcccttccgggcggaa

SEQ ID NO: 509222 - DNA, 25 bp, Rattus norvegicus
cgcctgctcagtgggctttggttgt

SEQ ID NO: 509223 - DNA, 25 bp, Rattus norvegicus
ccacagatccgcgaggcacctatgt

SEQ ID NO: 509224 - DNA, 25 bp, Rattus norvegicus
cctatgtgctgagtaaccttgcgga

SEQ ID NO: 509225 - DNA, 25 bp, Rattus norvegicus
tgtgtttaccttcctgccggccaaa

SEQ ID NO: 509226 - DNA, 25 bp, Rattus norvegicus
gccggccaaagcgttgcttcgggta

SEQ ID NO: 509227 - DNA, 25 bp, Rattus norvegicus
tgtcctagtgcttggctgacgctgc

SEQ ID NO: 509228 - DNA, 25 bp, Rattus norvegicus
ccctttgtgcttttgcatccctaga

SEQ ID NO: 509229 - DNA, 25 bp, Rattus norvegicus
catccctagagtatgccgcctgtgg

SEQ ID NO: 509230 - DNA, 25 bp, Rattus norvegicus
atcgcagcgtgacctggatctccgc

SEQ ID NO: 509231 - DNA, 25 bp, Rattus norvegicus
cagcggcgtatccagagccggaagc

SEQ ID NO: 509232 - DNA, 25 bp, Rattus norvegicus
tgctagccgcgatcttcggctactt

SEQ ID NO: 509233 - DNA, 25 bp, Rattus norvegicus
tggctgctacaatctcacagataac

SEQ ID NO: 509234 - DNA, 25 bp, Rattus norvegicus
gttcccggagctgctagccgcgatc

SEQ ID NO: 509235 - DNA, 25 bp, Rattus norvegicus
ttcccggagctgctagccgcgatct

SEQ ID NO: 509236 - DNA, 25 bp, Rattus norvegicus
tcccggagctgctagccgcgatctt

SEQ ID NO: 509237 - DNA, 25 bp, Rattus norvegicus
ccggagctgctagccgcgatcttcg

SEQ ID NO: 509238 - DNA, 25 bp, Rattus norvegicus
gctgctagccgcgatcttcggctac

SEQ ID NO: 509239 - DNA, 25 bp, Rattus norvegicus
cctcagtggctgctacaatctcaca

SEQ ID NO: 509240 - DNA, 25 bp, Rattus norvegicus
ctcagtggctgctacaatctcacag

SEQ ID NO: 509241 - DNA, 25 bp, Rattus norvegicus
tcagtggctgctacaatctcacaga

SEQ ID NO: 509242 - DNA, 25 bp, Rattus norvegicus
cagtggctgctacaatctcacagat

SEQ ID NO: 509243 - DNA, 25 bp, Rattus norvegicus
gtggctgctacaatctcacagataa

SEQ ID NO: 509244 - DNA, 25 bp, Rattus norvegicus
cgcgcggcgtagttgtgcagggcct

SEQ ID NO: 509245 - DNA, 25 bp, Rattus norvegicus
agtggctgctacaatctcacagata

SEQ ID NO: 509246 - DNA, 25 bp, Rattus norvegicus
agacctgaacgctcgcgagacgcga

SEQ ID NO: 509247 - DNA, 25 bp, Rattus norvegicus
aagccagaagcccagagtgccgcgc

SEQ ID NO: 509248 - DNA, 25 bp, Rattus norvegicus
gtgcgcaacccggaagaagtcaagg

SEQ ID NO: 509249 - DNA, 25 bp, Rattus norvegicus
cggaggctccagaactttgacccta

SEQ ID NO: 509250 - DNA, 25 bp, Rattus norvegicus
tttgaccctagtctcgggcaccgca

SEQ ID NO: 509251 - DNA, 25 bp, Rattus norvegicus
cgccgatctacacggacggtgggaa

SEQ ID NO: 509252 - DNA, 25 bp, Rattus norvegicus
agcccgtgaccttcgcctgacaggg

SEQ ID NO: 509253 - DNA, 25 bp, Rattus norvegicus
ctgacagggtcagcaggccgccact

SEQ ID NO: 509254 - DNA, 25 bp, Rattus norvegicus
gccgctgctcgaaacattgtctctg

SEQ ID NO: 509255 - DNA, 25 bp, Rattus norvegicus
tcttccagagacctgaacgctcgcg

SEQ ID NO: 509256 - DNA, 25 bp, Rattus norvegicus
cgagacgcgagcacgcgagctgaca

SEQ ID NO: 509257 - DNA, 25 bp, Rattus norvegicus
agctgacagcctaggccgaggctgc

SEQ ID NO: 509258 - DNA, 25 bp, Rattus norvegicus
ccctccaggcgcgagaagccagaag

SEQ ID NO: 509259 - DNA, 25 bp, Rattus norvegicus
ctctgttctagtcagcccagcggta

SEQ ID NO: 509260 - DNA, 25 bp, Rattus norvegicus
tcactccgagccaatcagagctttc

SEQ ID NO: 509261 - DNA, 25 bp, Rattus norvegicus
ctctctagctagctccacgggcggt

SEQ ID NO: 509262 - DNA, 25 bp, Rattus norvegicus
agcatctctctagctagctccacgg

SEQ ID NO: 509263 - DNA, 25 bp, Rattus norvegicus
ggctgcgctccattgttcactccga

SEQ ID NO: 509264 - DNA, 25 bp, Rattus norvegicus
tgcagagaggatcctggaaggtttc

SEQ ID NO: 509265 - DNA, 25 bp, Rattus norvegicus
agatgcggcttccaagggattgcgg

SEQ ID NO: 509266 - DNA, 25 bp, Rattus norvegicus
tacaagcccgaaggaagcgcagcgc

SEQ ID NO: 509267 - DNA, 25 bp, Rattus norvegicus
agccaatctcccttcgcctccgact

SEQ ID NO: 509268 - DNA, 25 bp, Rattus norvegicus
caggagttagttagcaaagagtgga

SEQ ID NO: 509269 - DNA, 25 bp, Rattus norvegicus
gctccttcaactccgcggggcagga

SEQ ID NO: 509270 - DNA, 25 bp, Rattus norvegicus
ggaatcgctccttcaactccgcggg

SEQ ID NO: 509271 - DNA, 25 bp, Rattus norvegicus
ccggtgcggaatcgctccttcaact

SEQ ID NO: 509272 - DNA, 25 bp, Rattus norvegicus
agccgggtgacgctacaggtcccgc

SEQ ID NO: 509273 - DNA, 25 bp, Rattus norvegicus
agtgcgtgctgacgtcatgctgcgt

SEQ ID NO: 509274 - DNA, 25 bp, Rattus norvegicus
tctggatgagacgtgcacgtgcttc

SEQ ID NO: 509275 - DNA, 25 bp, Rattus norvegicus
caggagattgtgttgttttcgtttc

SEQ ID NO: 509276 - DNA, 25 bp, Rattus norvegicus
ggttcccttgtggtcgcacttctaa

SEQ ID NO: 509277 - DNA, 25 bp, Rattus norvegicus
tctgtctctaactgaaccgatacta

SEQ ID NO: 509278 - DNA, 25 bp, Rattus norvegicus
ttccctgccagagaagcccgggacg

SEQ ID NO: 509279 - DNA, 25 bp, Rattus norvegicus
gggagtcagatccacgaccagttta

SEQ ID NO: 509280 - DNA, 25 bp, Rattus norvegicus
gaccagtttatccttcgggtgtcgc

SEQ ID NO: 509281 - DNA, 25 bp, Rattus norvegicus
gcctgcctcaagtgcgctgagtgca

SEQ ID NO: 509282 - DNA, 25 bp, Rattus norvegicus
cgcggcctgcatctgccaggtaagt

SEQ ID NO: 509283 - DNA, 25 bp, Rattus norvegicus
ggaaaacgtactgcaagcgggacta

SEQ ID NO: 509284 - DNA, 25 bp, Rattus norvegicus
ttcggcatcaagtgtgcccagtgtc

SEQ ID NO: 509285 - DNA, 25 bp, Rattus norvegicus
gcccagtgtcaggtgggcttcagca

SEQ ID NO: 509286 - DNA, 25 bp, Rattus norvegicus
cagcgtgtaccacatcgagtgcttc

SEQ ID NO: 509287 - DNA, 25 bp, Rattus norvegicus
actgtgtagccgaccgttgagcttc

SEQ ID NO: 509288 - DNA, 25 bp, Rattus norvegicus
tccattctcatgaagcagctacagc

SEQ ID NO: 509289 - DNA, 25 bp, Rattus norvegicus
tggtttcagaacaagcgttgcaagg

SEQ ID NO: 509290 - DNA, 25 bp, Rattus norvegicus
ggtcatccgcgtgtggtttcagaac

SEQ ID NO: 509291 - DNA, 25 bp, Rattus norvegicus
ctggtagagatgaccggcttgagcc

SEQ ID NO: 509292 - DNA, 25 bp, Rattus norvegicus
ctcatgaaggagcagctggtagaga

SEQ ID NO: 509293 - DNA, 25 bp, Rattus norvegicus
aactgcacaccctgcggacatgcta

SEQ ID NO: 509294 - DNA, 25 bp, Rattus norvegicus
caacgagaagcaactgcacaccctg

SEQ ID NO: 509295 - DNA, 25 bp, Rattus norvegicus
caagcaggcggagaagacaacccgg

SEQ ID NO: 509296 - DNA, 25 bp, Rattus norvegicus
tgcgcacgcacgtgcacaagcaggc

SEQ ID NO: 509297 - DNA, 25 bp, Rattus norvegicus
tggcggccggtcagacctcctgtct

SEQ ID NO: 509298 - DNA, 25 bp, Rattus norvegicus
tcagggaaacgaaatcttggggaga

SEQ ID NO: 509299 - DNA, 25 bp, Rattus norvegicus
agcagcaacacagcgacaaggcggt

SEQ ID NO: 509300 - DNA, 25 bp, Rattus norvegicus
gagggagaggaacaatagacaaacg

SEQ ID NO: 509301 - DNA, 25 bp, Rattus norvegicus
tagacaaacgaacggaatatcaggg

SEQ ID NO: 509302 - DNA, 25 bp, Rattus norvegicus
tgaccgaggctttgctctggacttg

SEQ ID NO: 509303 - DNA, 25 bp, Rattus norvegicus
acacttgcctgcctcgctgagactg

SEQ ID NO: 509304 - DNA, 25 bp, Rattus norvegicus
tggagactcctgcttcaaggacttt

SEQ ID NO: 509305 - DNA, 25 bp, Rattus norvegicus
ggcggctccttatctacgtttggca

SEQ ID NO: 509306 - DNA, 25 bp, Rattus norvegicus
tggggaactgccactctgtctctgc

SEQ ID NO: 509307 - DNA, 25 bp, Rattus norvegicus
cgaggacgggacaaaaacagacata

SEQ ID NO: 509308 - DNA, 25 bp, Rattus norvegicus
aagcgcatgactgccggacagagta

SEQ ID NO: 509309 - DNA, 25 bp, Rattus norvegicus
cgtttggcatcacctgcaagcgata

SEQ ID NO: 509310 - DNA, 25 bp, Rattus norvegicus
gtgagagcctttgccgaacaaacgt

SEQ ID NO: 509311 - DNA, 25 bp, Rattus norvegicus
tgggcctcgtttcagcttcaccggc

SEQ ID NO: 509312 - DNA, 25 bp, Rattus norvegicus
actggcttagggagcgaagctcacc

SEQ ID NO: 509313 - DNA, 25 bp, Rattus norvegicus
tccgtgttgtccctagagtggatgc

SEQ ID NO: 509314 - DNA, 25 bp, Rattus norvegicus
gacgtgatcaatctcgctgcattta

SEQ ID NO: 509315 - DNA, 25 bp, Rattus norvegicus
aatttgggacattctgggttggctc

SEQ ID NO: 509316 - DNA, 25 bp, Rattus norvegicus
tccagaaagtgagtacgcgcaagtg

SEQ ID NO: 509317 - DNA, 25 bp, Rattus norvegicus
tgctgtgtccacgtgtgcaagctcg

SEQ ID NO: 509318 - DNA, 25 bp, Rattus norvegicus
aactttgtgtctcggtgtgttcctc

SEQ ID NO: 509319 - DNA, 25 bp, Rattus norvegicus
tgtgtctcatgggaaagccaggacg

SEQ ID NO: 509320 - DNA, 25 bp, Rattus norvegicus
tctgttatgaggagacgcgccaagg

SEQ ID NO: 509321 - DNA, 25 bp, Rattus norvegicus
tgcgatcactgagggatacagccta

SEQ ID NO: 509322 - DNA, 25 bp, Rattus norvegicus
ggggcgtggcagtaaacagcaacaa

SEQ ID NO: 509323 - DNA, 25 bp, Rattus norvegicus
tggccagaaactcgaatctcccttc

SEQ ID NO: 509324 - DNA, 25 bp, Rattus norvegicus
ccaacccaaaagtgcacggcggctg

SEQ ID NO: 509325 - DNA, 25 bp, Rattus norvegicus
ccgcgctttgttactggtgaggatt

SEQ ID NO: 509326 - DNA, 25 bp, Rattus norvegicus
gctagtacctggagcactgctggcc

SEQ ID NO: 509327 - DNA, 25 bp, Rattus norvegicus
atgtcacggtgatgtagcccggccc

SEQ ID NO: 509328 - DNA, 25 bp, Rattus norvegicus
tctccgggaaggatcacgcacgaaa

SEQ ID NO: 509329 - DNA, 25 bp, Rattus norvegicus
acccactcgtcagtttggccagaaa

SEQ ID NO: 509330 - DNA, 25 bp, Rattus norvegicus
tgctgtggcagctccggcgacagct

SEQ ID NO: 509331 - DNA, 25 bp, Rattus norvegicus
cgaggcctgcggtgcataatgcact

SEQ ID NO: 509332 - DNA, 25 bp, Rattus norvegicus
taatgcactgcaccaagacggcgga

SEQ ID NO: 509333 - DNA, 25 bp, Rattus norvegicus
actgcaccaagacggcggagagccc

SEQ ID NO: 509334 - DNA, 25 bp, Rattus norvegicus
ctgccaggccgagcgtttaccgcgg

SEQ ID NO: 509335 - DNA, 25 bp, Rattus norvegicus
tcactgactgcagacggccgcagct

SEQ ID NO: 509336 - DNA, 25 bp, Rattus norvegicus
ttcctcctcccagagcagtcgagag

SEQ ID NO: 509337 - DNA, 25 bp, Rattus norvegicus
ccagagcagtcgagaggcagacatg

SEQ ID NO: 509338 - DNA, 25 bp, Rattus norvegicus
tgcattatgggaagcctcgcacaca

SEQ ID NO: 509339 - DNA, 25 bp, Rattus norvegicus
tcgcacacaggaagcgctccgggct

SEQ ID NO: 509340 - DNA, 25 bp, Rattus norvegicus
gcgagacctagcgtggctttgattc

SEQ ID NO: 509341 - DNA, 25 bp, Rattus norvegicus
tagcgtggctttgattccggcgcct

SEQ ID NO: 509342 - DNA, 25 bp, Rattus norvegicus
cgcctgcgtgtcagcagtgcagcgt

SEQ ID NO: 509343 - DNA, 25 bp, Rattus norvegicus
aggcgcgcggtcactgactgcagac

SEQ ID NO: 509344 - DNA, 25 bp, Rattus norvegicus
ctcgcggacacttacccgggcggct

SEQ ID NO: 509345 - DNA, 25 bp, Rattus norvegicus
cccggtcatacgcccaggtgaggga

SEQ ID NO: 509346 - DNA, 25 bp, Rattus norvegicus
ctgtcctgggccattcgcgcaggcg

SEQ ID NO: 509347 - DNA, 25 bp, Rattus norvegicus
cctaggctgtcctgggccattcgcg

SEQ ID NO: 509348 - DNA, 25 bp, Rattus norvegicus
tgataccagccgaagcctagccacg

SEQ ID NO: 509349 - DNA, 25 bp, Rattus norvegicus
accacgtgataccagccgaagccta

SEQ ID NO: 509350 - DNA, 25 bp, Rattus norvegicus
cgtaccacgtgataccagccgaagc

SEQ ID NO: 509351 - DNA, 25 bp, Rattus norvegicus
ggccggcgtaccacgtgataccagc

SEQ ID NO: 509352 - DNA, 25 bp, Rattus norvegicus
ttagcgtactttggggcggctccca

SEQ ID NO: 509353 - DNA, 25 bp, Rattus norvegicus
cccacaacacaggttgcccgcgccc

SEQ ID NO: 509354 - DNA, 25 bp, Rattus norvegicus
tggaagggtttccgccgccatcttg

SEQ ID NO: 509355 - DNA, 25 bp, Rattus norvegicus
ggcctcttcagtcgacctcgcggct

SEQ ID NO: 509356 - DNA, 25 bp, Rattus norvegicus
cagatggccggcgtaccacgtgata

SEQ ID NO: 509357 - DNA, 25 bp, Rattus norvegicus
cacggcccgacctgacctcacagtc

SEQ ID NO: 509358 - DNA, 25 bp, Rattus norvegicus
cattcaggaagttttgggagagctg

SEQ ID NO: 509359 - DNA, 25 bp, Rattus norvegicus
gtccctattgatcaagtcagcgcca

SEQ ID NO: 509360 - DNA, 25 bp, Rattus norvegicus
tcaagtcagcgccacaaggaagtgc

SEQ ID NO: 509361 - DNA, 25 bp, Rattus norvegicus
ggctgtgcagtagacctccaccgta

SEQ ID NO: 509362 - DNA, 25 bp, Rattus norvegicus
agttcagcattcaggaagttttggg

SEQ ID NO: 509363 - DNA, 25 bp, Rattus norvegicus
cgcttggaaagttcagcattcagga

SEQ ID NO: 509364 - DNA, 25 bp, Rattus norvegicus
ccacacgcgcttggaaagttcagca

SEQ ID NO: 509365 - DNA, 25 bp, Rattus norvegicus
cgaacccacgtcaacctgttgtttg

SEQ ID NO: 509366 - DNA, 25 bp, Rattus norvegicus
tgcggcacccacacgcgcttggaaa

SEQ ID NO: 509367 - DNA, 25 bp, Rattus norvegicus
gcgccacaaggaagtgcggcaccca

SEQ ID NO: 509368 - DNA, 25 bp, Rattus norvegicus
tgtccagtccctattgatcaagtca

SEQ ID NO: 509369 - DNA, 25 bp, Rattus norvegicus
gttgtttgtccagtccctattgatc

SEQ ID NO: 509370 - DNA, 25 bp, Rattus norvegicus
gtgcagtagacctccaccgtaccag

SEQ ID NO: 509371 - DNA, 25 bp, Rattus norvegicus
cgtcaacctgttgtttgtccagtcc

SEQ ID NO: 509372 - DNA, 25 bp, Rattus norvegicus
ataaaagtgctgtgagaatcgggtg

SEQ ID NO: 509373 - DNA, 25 bp, Rattus norvegicus
cgcacaatccctaggttccctagga

SEQ ID NO: 509374 - DNA, 25 bp, Rattus norvegicus
agtctcctcatacggagcctggcgg

SEQ ID NO: 509375 - DNA, 25 bp, Rattus norvegicus
tcacgggagcgaagagacgctgcac

SEQ ID NO: 509376 - DNA, 25 bp, Rattus norvegicus
cgctgcacggccctataggcggaga

SEQ ID NO: 509377 - DNA, 25 bp, Rattus norvegicus
ctgcccgagcagaggtataaaagtg

SEQ ID NO: 509378 - DNA, 25 bp, Rattus norvegicus
tgacagtccgcacaatccctaggtt

SEQ ID NO: 509379 - DNA, 25 bp, Rattus norvegicus
ctcctgaggatctcggttgtctccc

SEQ ID NO: 509380 - DNA, 25 bp, Rattus norvegicus
ttctctcggaggtcggggctccctc

SEQ ID NO: 509381 - DNA, 25 bp, Rattus norvegicus
gtcggggctccctctatgcttcgcg

SEQ ID NO: 509382 - DNA, 25 bp, Rattus norvegicus
ctcgagtccaggttccctctgtggt

SEQ ID NO: 509383 - DNA, 25 bp, Rattus norvegicus
tccctctgtggtgcggactcctcta

SEQ ID NO: 509384 - DNA, 25 bp, Rattus norvegicus
cctataggcggagacgctctggccc

SEQ ID NO: 509385 - DNA, 25 bp, Rattus norvegicus
ctgcggtccggaccctcctgaggat

SEQ ID NO: 509386 - DNA, 25 bp, Rattus norvegicus
agtcctccgtcactgggctgcgctg

SEQ ID NO: 509387 - DNA, 25 bp, Rattus norvegicus
catgacgtcactgggctgcgctgcc

SEQ ID NO: 509388 - DNA, 25 bp, Rattus norvegicus
atcatgacgtcactgggctgcgctg

SEQ ID NO: 509389 - DNA, 25 bp, Rattus norvegicus
catcatgacgtcactgggctgcgct

SEQ ID NO: 509390 - DNA, 25 bp, Rattus norvegicus
ccatcatgacgtcactgggctgcgc

SEQ ID NO: 509391 - DNA, 25 bp, Rattus norvegicus
cccatcatgacgtcactgggctgcg

SEQ ID NO: 509392 - DNA, 25 bp, Rattus norvegicus
cgcccatcatgacgtcactgggctg

SEQ ID NO: 509393 - DNA, 25 bp, Rattus norvegicus
tcctccgtcactgggctgcgctgcc

SEQ ID NO: 509394 - DNA, 25 bp, Rattus norvegicus
tgcagtcctccgtcactgggctgcg

SEQ ID NO: 509395 - DNA, 25 bp, Rattus norvegicus
atgcagtcctccgtcactgggctgc

SEQ ID NO: 509396 - DNA, 25 bp, Rattus norvegicus
cttggagattgattggctgcggcgg

SEQ ID NO: 509397 - DNA, 25 bp, Rattus norvegicus
agcagcttggagattgattggctgc

SEQ ID NO: 509398 - DNA, 25 bp, Rattus norvegicus
ccagcagcttggagattgattggct

SEQ ID NO: 509399 - DNA, 25 bp, Rattus norvegicus
tcgcccatcatgacgtcactgggct

SEQ ID NO: 509400 - DNA, 25 bp, Rattus norvegicus
cagctgctggcttgcctgcggatta

SEQ ID NO: 509401 - DNA, 25 bp, Rattus norvegicus
gccttagctggagcggcctgacaat

SEQ ID NO: 509402 - DNA, 25 bp, Rattus norvegicus
tcctgtgacaaagcgggacgaccag

SEQ ID NO: 509403 - DNA, 25 bp, Rattus norvegicus
cgcaacgggctttgtcctgtgacaa

SEQ ID NO: 509404 - DNA, 25 bp, Rattus norvegicus
ggctccgcatcgcaacgggctttgt

SEQ ID NO: 509405 - DNA, 25 bp, Rattus norvegicus
accgcgaaacgctgctaggtgtcca

SEQ ID NO: 509406 - DNA, 25 bp, Rattus norvegicus
aggagctgcattacccgcagggcga

SEQ ID NO: 509407 - DNA, 25 bp, Rattus norvegicus
cctccggtgaagcaaggctgccaag

SEQ ID NO: 509408 - DNA, 25 bp, Rattus norvegicus
cgccagacttcaggctgtgactgtg

SEQ ID NO: 509409 - DNA, 25 bp, Rattus norvegicus
cctcagcaacgcagtagtcgccaga

SEQ ID NO: 509410 - DNA, 25 bp, Rattus norvegicus
cccacggccatataaggatgggcct

SEQ ID NO: 509411 - DNA, 25 bp, Rattus norvegicus
acaggtctagcgttctggacccgcc

SEQ ID NO: 509412 - DNA, 25 bp, Rattus norvegicus
ctgcggattagtgggaggcaataac

SEQ ID NO: 509413 - DNA, 25 bp, Rattus norvegicus
cacggcccaatcagcaacaggtcta

SEQ ID NO: 509414 - DNA, 25 bp, Rattus norvegicus
agccctaagagcagagcgccgcgca

SEQ ID NO: 509415 - DNA, 25 bp, Rattus norvegicus
gtcccgacagactcagccctaagag

SEQ ID NO: 509416 - DNA, 25 bp, Rattus norvegicus
acgtagctgctacacgacctgggga

SEQ ID NO: 509417 - DNA, 25 bp, Rattus norvegicus
acagccactggctcagcgaggactc

SEQ ID NO: 509418 - DNA, 25 bp, Rattus norvegicus
cgaggactcagacaaagacagcgga

SEQ ID NO: 509419 - DNA, 25 bp, Rattus norvegicus
gacagcggacccgactcactgggca

SEQ ID NO: 509420 - DNA, 25 bp, Rattus norvegicus
tcttgtcgcggagacccgcgtaacc

SEQ ID NO: 509421 - DNA, 25 bp, Rattus norvegicus
taccaagggctccaagaccgcaagg

SEQ ID NO: 509422 - DNA, 25 bp, Rattus norvegicus
gtcttagaggaggtgatgccgcatt

SEQ ID NO: 509423 - DNA, 25 bp, Rattus norvegicus
ctccgccgagaactgctgggcctga

SEQ ID NO: 509424 - DNA, 25 bp, Rattus norvegicus
ctaggccgttcccaggcaaccaagt

SEQ ID NO: 509425 - DNA, 25 bp, Rattus norvegicus
gtctgcggtcgcttcagccaatcat

SEQ ID NO: 509426 - DNA, 25 bp, Rattus norvegicus
ttcagccaatcatcgccgcggagaa

SEQ ID NO: 509427 - DNA, 25 bp, Rattus norvegicus
actgggcagtgtcccatttcgggcc

SEQ ID NO: 509428 - DNA, 25 bp, Rattus norvegicus
ctaactaactactcgcggccgcgga

SEQ ID NO: 509429 - DNA, 25 bp, Rattus norvegicus
cccgttacctgaggggagcacacgc

SEQ ID NO: 509430 - DNA, 25 bp, Rattus norvegicus
tccaccgagcaactgacacaactaa

SEQ ID NO: 509431 - DNA, 25 bp, Rattus norvegicus
acgccgtcacgatattcaccattgc

SEQ ID NO: 509432 - DNA, 25 bp, Rattus norvegicus
acgatattcaccattgccgcctgtc

SEQ ID NO: 509433 - DNA, 25 bp, Rattus norvegicus
gctaccgggaccatcgcaatccagg

SEQ ID NO: 509434 - DNA, 25 bp, Rattus norvegicus
cttcacttcttgagaacgcgcgcgc

SEQ ID NO: 509435 - DNA, 25 bp, Rattus norvegicus
gcactcttgccgcttcacttcttga

SEQ ID NO: 509436 - DNA, 25 bp, Rattus norvegicus
tcgcaatccagggtaacgaggcctg

SEQ ID NO: 509437 - DNA, 25 bp, Rattus norvegicus
gtccgcccagcccaccagtccgctt

SEQ ID NO: 509438 - DNA, 25 bp, Rattus norvegicus
gcgtcctcacctctcggcgaccctg

SEQ ID NO: 509439 - DNA, 25 bp, Rattus norvegicus
gacacaactaactaactactcgcgg

SEQ ID NO: 509440 - DNA, 25 bp, Rattus norvegicus
agtccgcttgctcctcccaaccctg

SEQ ID NO: 509441 - DNA, 25 bp, Rattus norvegicus
ggagcacacgccgtcacgatattca

SEQ ID NO: 509442 - DNA, 25 bp, Rattus norvegicus
tcaggcgagtagctgcgcacatgca

SEQ ID NO: 509443 - DNA, 25 bp, Rattus norvegicus
cattggctgcgatgcacaggtacgt

SEQ ID NO: 509444 - DNA, 25 bp, Rattus norvegicus
gtacgtgccgttgtcctgtacctgg

SEQ ID NO: 509445 - DNA, 25 bp, Rattus norvegicus
tccagcgtgccatcagggaagactg

SEQ ID NO: 509446 - DNA, 25 bp, Rattus norvegicus
tccttgccctggacgaactcaggtg

SEQ ID NO: 509447 - DNA, 25 bp, Rattus norvegicus
cagggaagactgtgagccgcccatt

SEQ ID NO: 509448 - DNA, 25 bp, Rattus norvegicus
cgcccattgctcttggctgagacca

SEQ ID NO: 509449 - DNA, 25 bp, Rattus norvegicus
tcggggaagtccttgaactccttgc

SEQ ID NO: 509450 - DNA, 25 bp, Rattus norvegicus
tgcccggcatacgaactgcaccgtg

SEQ ID NO: 509451 - DNA, 25 bp, Rattus norvegicus
tgcctgttgaagttgagccgccagc

SEQ ID NO: 509452 - DNA, 25 bp, Rattus norvegicus
accgtgtggccctcatctacaaaca

SEQ ID NO: 509453 - DNA, 25 bp, Rattus norvegicus
caaacacctgctgtgccttgcggtc

SEQ ID NO: 509454 - DNA, 25 bp, Rattus norvegicus
cttgatgtcgaaggggaaaggcaca

SEQ ID NO: 509455 - DNA, 25 bp, Rattus norvegicus
tgaagtagttgggtaggagcacatc

SEQ ID NO: 509456 - DNA, 25 bp, Rattus norvegicus
tcggccaaggcgaaggggctcacct

SEQ ID NO: 509457 - DNA, 25 bp, Rattus norvegicus
aaggggctcacctgcatctcgggcg

SEQ ID NO: 509458 - DNA, 25 bp, Rattus norvegicus
gtccgctcggcttggtcaccaatcg

SEQ ID NO: 509459 - DNA, 25 bp, Rattus norvegicus
ggtcaccaatcgcatgtctctcttg

SEQ ID NO: 509460 - DNA, 25 bp, Rattus norvegicus
atcgcatgtctctcttgccggcgcg

SEQ ID NO: 509461 - DNA, 25 bp, Rattus norvegicus
tcgcagggctggctttccgtctgtc

SEQ ID NO: 509462 - DNA, 25 bp, Rattus norvegicus
cagccggccctagggcaggagctca

SEQ ID NO: 509463 - DNA, 25 bp, Rattus norvegicus
cgggctgagaaaccgtagctctcag

SEQ ID NO: 509464 - DNA, 25 bp, Rattus norvegicus
gtagctctcaggacgcctgtcgcgg

SEQ ID NO: 509465 - DNA, 25 bp, Rattus norvegicus
ggagcctggttctgtccctcgggcc

SEQ ID NO: 509466 - DNA, 25 bp, Rattus norvegicus
cagctgctgcgcatgctgctctgag

SEQ ID NO: 509467 - DNA, 25 bp, Rattus norvegicus
aaccaggcgaagatcgaggagcgtc

SEQ ID NO: 509468 - DNA, 25 bp, Rattus norvegicus
atcgaggagcgtcccggcagctgcc

SEQ ID NO: 509469 - DNA, 25 bp, Rattus norvegicus
ccgactcgggctcggccaaggcgaa
